United States Patent 10,611,818 (MHC MULTIMERS IN TUBERCULOSIS DIAGNOSTICS, VACCINE AND THERAPEUTICS) - sequence listing, part 2

SEQ ID NO: 5361 - protein, 10 aa, Mycobacterium tuberculosis
ESGKEHKGVG

SEQ ID NO: 5362 - protein, 10 aa, Mycobacterium tuberculosis
SGKEHKGVGF

SEQ ID NO: 5363 - protein, 10 aa, Mycobacterium tuberculosis
GKEHKGVGFL

SEQ ID NO: 5364 - protein, 10 aa, Mycobacterium tuberculosis
KEHKGVGFLV

SEQ ID NO: 5365 - protein, 10 aa, Mycobacterium tuberculosis
EHKGVGFLVP

SEQ ID NO: 5366 - protein, 10 aa, Mycobacterium tuberculosis
HKGVGFLVPA

SEQ ID NO: 5367 - protein, 10 aa, Mycobacterium tuberculosis
KGVGFLVPAP

SEQ ID NO: 5368 - protein, 10 aa, Mycobacterium tuberculosis
GVGFLVPAPG

SEQ ID NO: 5369 - protein, 10 aa, Mycobacterium tuberculosis
VGFLVPAPGA

SEQ ID NO: 5370 - protein, 10 aa, Mycobacterium tuberculosis
GFLVPAPGAT

SEQ ID NO: 5371 - protein, 10 aa, Mycobacterium tuberculosis
FLVPAPGATP

SEQ ID NO: 5372 - protein, 10 aa, Mycobacterium tuberculosis
LVPAPGATPI

SEQ ID NO: 5373 - protein, 10 aa, Mycobacterium tuberculosis
VPAPGATPIR

SEQ ID NO: 5374 - protein, 10 aa, Mycobacterium tuberculosis
PAPGATPIRF

SEQ ID NO: 5375 - protein, 10 aa, Mycobacterium tuberculosis
APGATPIRFR

SEQ ID NO: 5376 - protein, 10 aa, Mycobacterium tuberculosis
PGATPIRFRS

SEQ ID NO: 5377 - protein, 10 aa, Mycobacterium tuberculosis
GATPIRFRST

SEQ ID NO: 5378 - protein, 10 aa, Mycobacterium tuberculosis
ATPIRFRSTY

SEQ ID NO: 5379 - protein, 10 aa, Mycobacterium tuberculosis
TPIRFRSTYV

SEQ ID NO: 5380 - protein, 10 aa, Mycobacterium tuberculosis
PIRFRSTYVD

SEQ ID NO: 5381 - protein, 10 aa, Mycobacterium tuberculosis
IRFRSTYVDG

SEQ ID NO: 5382 - protein, 10 aa, Mycobacterium tuberculosis
RFRSTYVDGI

SEQ ID NO: 5383 - protein, 10 aa, Mycobacterium tuberculosis
FRSTYVDGIY

SEQ ID NO: 5384 - protein, 10 aa, Mycobacterium tuberculosis
RSTYVDGIYE

SEQ ID NO: 5385 - protein, 10 aa, Mycobacterium tuberculosis
STYVDGIYEP

SEQ ID NO: 5386 - protein, 10 aa, Mycobacterium tuberculosis
TYVDGIYEPP

SEQ ID NO: 5387 - protein, 10 aa, Mycobacterium tuberculosis
YVDGIYEPPQ

SEQ ID NO: 5388 - protein, 10 aa, Mycobacterium tuberculosis
VDGIYEPPQT

SEQ ID NO: 5389 - protein, 10 aa, Mycobacterium tuberculosis
DGIYEPPQTA

SEQ ID NO: 5390 - protein, 10 aa, Mycobacterium tuberculosis
GIYEPPQTAK

SEQ ID NO: 5391 - protein, 10 aa, Mycobacterium tuberculosis
IYEPPQTAKA

SEQ ID NO: 5392 - protein, 10 aa, Mycobacterium tuberculosis
YEPPQTAKAV

SEQ ID NO: 5393 - protein, 10 aa, Mycobacterium tuberculosis
EPPQTAKAVV

SEQ ID NO: 5394 - protein, 10 aa, Mycobacterium tuberculosis
PPQTAKAVVV

SEQ ID NO: 5395 - protein, 10 aa, Mycobacterium tuberculosis
PQTAKAVVVQ

SEQ ID NO: 5396 - protein, 10 aa, Mycobacterium tuberculosis
QTAKAVVVQS

SEQ ID NO: 5397 - protein, 10 aa, Mycobacterium tuberculosis
TAKAVVVQSV

SEQ ID NO: 5398 - protein, 10 aa, Mycobacterium tuberculosis
AKAVVVQSVP

SEQ ID NO: 5399 - protein, 10 aa, Mycobacterium tuberculosis
KAVVVQSVPE

SEQ ID NO: 5400 - protein, 10 aa, Mycobacterium tuberculosis
AVVVQSVPEP

SEQ ID NO: 5401 - protein, 10 aa, Mycobacterium tuberculosis
VVVQSVPEPK

SEQ ID NO: 5402 - protein, 10 aa, Mycobacterium tuberculosis
VVQSVPEPKL

SEQ ID NO: 5403 - protein, 10 aa, Mycobacterium tuberculosis
VQSVPEPKLF

SEQ ID NO: 5404 - protein, 10 aa, Mycobacterium tuberculosis
QSVPEPKLFT

SEQ ID NO: 5405 - protein, 10 aa, Mycobacterium tuberculosis
SVPEPKLFTA

SEQ ID NO: 5406 - protein, 10 aa, Mycobacterium tuberculosis
VPEPKLFTAA

SEQ ID NO: 5407 - protein, 10 aa, Mycobacterium tuberculosis
PEPKLFTAAA

SEQ ID NO: 5408 - protein, 10 aa, Mycobacterium tuberculosis
EPKLFTAAAV

SEQ ID NO: 5409 - protein, 10 aa, Mycobacterium tuberculosis
PKLFTAAAVE

SEQ ID NO: 5410 - protein, 10 aa, Mycobacterium tuberculosis
KLFTAAAVEP

SEQ ID NO: 5411 - protein, 10 aa, Mycobacterium tuberculosis
LFTAAAVEPD

SEQ ID NO: 5412 - protein, 10 aa, Mycobacterium tuberculosis
FTAAAVEPDP

SEQ ID NO: 5413 - protein, 10 aa, Mycobacterium tuberculosis
TAAAVEPDPG

SEQ ID NO: 5414 - protein, 10 aa, Mycobacterium tuberculosis
AAAVEPDPGT

SEQ ID NO: 5415 - protein, 10 aa, Mycobacterium tuberculosis
AAVEPDPGTV

SEQ ID NO: 5416 - protein, 10 aa, Mycobacterium tuberculosis
AVEPDPGTVI

SEQ ID NO: 5417 - protein, 10 aa, Mycobacterium tuberculosis
VEPDPGTVIA

SEQ ID NO: 5418 - protein, 10 aa, Mycobacterium tuberculosis
EPDPGTVIAD

SEQ ID NO: 5419 - protein, 10 aa, Mycobacterium tuberculosis
PDPGTVIADT

SEQ ID NO: 5420 - protein, 10 aa, Mycobacterium tuberculosis
DPGTVIADTD

SEQ ID NO: 5421 - protein, 10 aa, Mycobacterium tuberculosis
PGTVIADTDE

SEQ ID NO: 5422 - protein, 10 aa, Mycobacterium tuberculosis
GTVIADTDEQ

SEQ ID NO: 5423 - protein, 10 aa, Mycobacterium tuberculosis
TVIADTDEQE

SEQ ID NO: 5424 - protein, 10 aa, Mycobacterium tuberculosis
VIADTDEQEP

SEQ ID NO: 5425 - protein, 10 aa, Mycobacterium tuberculosis
IADTDEQEPA

SEQ ID NO: 5426 - protein, 10 aa, Mycobacterium tuberculosis
ADTDEQEPAD

SEQ ID NO: 5427 - protein, 10 aa, Mycobacterium tuberculosis
DTDEQEPADP

SEQ ID NO: 5428 - protein, 10 aa, Mycobacterium tuberculosis
TDEQEPADPP

SEQ ID NO: 5429 - protein, 10 aa, Mycobacterium tuberculosis
DEQEPADPPR

SEQ ID NO: 5430 - protein, 10 aa, Mycobacterium tuberculosis
EQEPADPPRK

SEQ ID NO: 5431 - protein, 10 aa, Mycobacterium tuberculosis
QEPADPPRKL

SEQ ID NO: 5432 - protein, 10 aa, Mycobacterium tuberculosis
EPADPPRKLI

SEQ ID NO: 5433 - protein, 10 aa, Mycobacterium tuberculosis
PADPPRKLIA

SEQ ID NO: 5434 - protein, 10 aa, Mycobacterium tuberculosis
ADPPRKLIAT

SEQ ID NO: 5435 - protein, 10 aa, Mycobacterium tuberculosis
DPPRKLIATI

SEQ ID NO: 5436 - protein, 10 aa, Mycobacterium tuberculosis
PPRKLIATIG

SEQ ID NO: 5437 - protein, 10 aa, Mycobacterium tuberculosis
PRKLIATIGE

SEQ ID NO: 5438 - protein, 10 aa, Mycobacterium tuberculosis
RKLIATIGEQ

SEQ ID NO: 5439 - protein, 10 aa, Mycobacterium tuberculosis
KLIATIGEQL

SEQ ID NO: 5440 - protein, 10 aa, Mycobacterium tuberculosis
LIATIGEQLA

SEQ ID NO: 5441 - protein, 10 aa, Mycobacterium tuberculosis
IATIGEQLAR

SEQ ID NO: 5442 - protein, 10 aa, Mycobacterium tuberculosis
ATIGEQLARY

SEQ ID NO: 5443 - protein, 10 aa, Mycobacterium tuberculosis
TIGEQLARYG

SEQ ID NO: 5444 - protein, 10 aa, Mycobacterium tuberculosis
IGEQLARYGP

SEQ ID NO: 5445 - protein, 10 aa, Mycobacterium tuberculosis
GEQLARYGPR

SEQ ID NO: 5446 - protein, 10 aa, Mycobacterium tuberculosis
EQLARYGPRA

SEQ ID NO: 5447 - protein, 10 aa, Mycobacterium tuberculosis
QLARYGPRAP

SEQ ID NO: 5448 - protein, 10 aa, Mycobacterium tuberculosis
LARYGPRAPQ

SEQ ID NO: 5449 - protein, 10 aa, Mycobacterium tuberculosis
ARYGPRAPQL

SEQ ID NO: 5450 - protein, 10 aa, Mycobacterium tuberculosis
RYGPRAPQLW

SEQ ID NO: 5451 - protein, 10 aa, Mycobacterium tuberculosis
YGPRAPQLWL

SEQ ID NO: 5452 - protein, 10 aa, Mycobacterium tuberculosis
GPRAPQLWLP

SEQ ID NO: 5453 - protein, 10 aa, Mycobacterium tuberculosis
PRAPQLWLPP

SEQ ID NO: 5454 - protein, 10 aa, Mycobacterium tuberculosis
RAPQLWLPPL

SEQ ID NO: 5455 - protein, 10 aa, Mycobacterium tuberculosis
APQLWLPPLD

SEQ ID NO: 5456 - protein, 10 aa, Mycobacterium tuberculosis
PQLWLPPLDE

SEQ ID NO: 5457 - protein, 10 aa, Mycobacterium tuberculosis
QLWLPPLDET

SEQ ID NO: 5458 - protein, 10 aa, Mycobacterium tuberculosis
LWLPPLDETI

SEQ ID NO: 5459 - protein, 10 aa, Mycobacterium tuberculosis
WLPPLDETIP

SEQ ID NO: 5460 - protein, 10 aa, Mycobacterium tuberculosis
LPPLDETIPL

SEQ ID NO: 5461 - protein, 10 aa, Mycobacterium tuberculosis
PPLDETIPLS

SEQ ID NO: 5462 - protein, 10 aa, Mycobacterium tuberculosis
PLDETIPLSA

SEQ ID NO: 5463 - protein, 10 aa, Mycobacterium tuberculosis
LDETIPLSAA

SEQ ID NO: 5464 - protein, 10 aa, Mycobacterium tuberculosis
DETIPLSAAL

SEQ ID NO: 5465 - protein, 10 aa, Mycobacterium tuberculosis
ETIPLSAALA

SEQ ID NO: 5466 - protein, 10 aa, Mycobacterium tuberculosis
TIPLSAALAR

SEQ ID NO: 5467 - protein, 10 aa, Mycobacterium tuberculosis
IPLSAALARA

SEQ ID NO: 5468 - protein, 10 aa, Mycobacterium tuberculosis
PLSAALARAG

SEQ ID NO: 5469 - protein, 10 aa, Mycobacterium tuberculosis
LSAALARAGV

SEQ ID NO: 5470 - protein, 10 aa, Mycobacterium tuberculosis
SAALARAGVG

SEQ ID NO: 5471 - protein, 10 aa, Mycobacterium tuberculosis
AALARAGVGP

SEQ ID NO: 5472 - protein, 10 aa, Mycobacterium tuberculosis
ALARAGVGPR

SEQ ID NO: 5473 - protein, 10 aa, Mycobacterium tuberculosis
LARAGVGPRQ

SEQ ID NO: 5474 - protein, 10 aa, Mycobacterium tuberculosis
ARAGVGPRQW

SEQ ID NO: 5475 - protein, 10 aa, Mycobacterium tuberculosis
RAGVGPRQWR

SEQ ID NO: 5476 - protein, 10 aa, Mycobacterium tuberculosis
AGVGPRQWRW

SEQ ID NO: 5477 - protein, 10 aa, Mycobacterium tuberculosis
GVGPRQWRWP

SEQ ID NO: 5478 - protein, 10 aa, Mycobacterium tuberculosis
VGPRQWRWPL

SEQ ID NO: 5479 - protein, 10 aa, Mycobacterium tuberculosis
GPRQWRWPLG

SEQ ID NO: 5480 - protein, 10 aa, Mycobacterium tuberculosis
PRQWRWPLGE

SEQ ID NO: 5481 - protein, 10 aa, Mycobacterium tuberculosis
RQWRWPLGEI

SEQ ID NO: 5482 - protein, 10 aa, Mycobacterium tuberculosis
QWRWPLGEID

SEQ ID NO: 5483 - protein, 10 aa, Mycobacterium tuberculosis
WRWPLGEIDR

SEQ ID NO: 5484 - protein, 10 aa, Mycobacterium tuberculosis
RWPLGEIDRP

SEQ ID NO: 5485 - protein, 10 aa, Mycobacterium tuberculosis
WPLGEIDRPF

SEQ ID NO: 5486 - protein, 10 aa, Mycobacterium tuberculosis
PLGEIDRPFE

SEQ ID NO: 5487 - protein, 10 aa, Mycobacterium tuberculosis
LGEIDRPFEM

SEQ ID NO: 5488 - protein, 10 aa, Mycobacterium tuberculosis
GEIDRPFEMR

SEQ ID NO: 5489 - protein, 10 aa, Mycobacterium tuberculosis
EIDRPFEMRR

SEQ ID NO: 5490 - protein, 10 aa, Mycobacterium tuberculosis
IDRPFEMRRD

SEQ ID NO: 5491 - protein, 10 aa, Mycobacterium tuberculosis
DRPFEMRRDP

SEQ ID NO: 5492 - protein, 10 aa, Mycobacterium tuberculosis
RPFEMRRDPL

SEQ ID NO: 5493 - protein, 10 aa, Mycobacterium tuberculosis
PFEMRRDPLV

SEQ ID NO: 5494 - protein, 10 aa, Mycobacterium tuberculosis
FEMRRDPLVF

SEQ ID NO: 5495 - protein, 10 aa, Mycobacterium tuberculosis
EMRRDPLVFD

SEQ ID NO: 5496 - protein, 10 aa, Mycobacterium tuberculosis
MRRDPLVFDA

SEQ ID NO: 5497 - protein, 10 aa, Mycobacterium tuberculosis
RRDPLVFDAR

SEQ ID NO: 5498 - protein, 10 aa, Mycobacterium tuberculosis
RDPLVFDARS

SEQ ID NO: 5499 - protein, 10 aa, Mycobacterium tuberculosis
DPLVFDARSS

SEQ ID NO: 5500 - protein, 10 aa, Mycobacterium tuberculosis
PLVFDARSSA

SEQ ID NO: 5501 - protein, 10 aa, Mycobacterium tuberculosis
LVFDARSSAG

SEQ ID NO: 5502 - protein, 10 aa, Mycobacterium tuberculosis
VFDARSSAGN

SEQ ID NO: 5503 - protein, 10 aa, Mycobacterium tuberculosis
FDARSSAGNM

SEQ ID NO: 5504 - protein, 10 aa, Mycobacterium tuberculosis
DARSSAGNMV

SEQ ID NO: 5505 - protein, 10 aa, Mycobacterium tuberculosis
ARSSAGNMVI

SEQ ID NO: 5506 - protein, 10 aa, Mycobacterium tuberculosis
RSSAGNMVIH

SEQ ID NO: 5507 - protein, 10 aa, Mycobacterium tuberculosis
SSAGNMVIHG

SEQ ID NO: 5508 - protein, 10 aa, Mycobacterium tuberculosis
SAGNMVIHGG

SEQ ID NO: 5509 - protein, 10 aa, Mycobacterium tuberculosis
AGNMVIHGGP

SEQ ID NO: 5510 - protein, 10 aa, Mycobacterium tuberculosis
GNMVIHGGPK

SEQ ID NO: 5511 - protein, 10 aa, Mycobacterium tuberculosis
NMVIHGGPKS

SEQ ID NO: 5512 - protein, 10 aa, Mycobacterium tuberculosis
MVIHGGPKSG

SEQ ID NO: 5513 - protein, 10 aa, Mycobacterium tuberculosis
VIHGGPKSGK

SEQ ID NO: 5514 - protein, 10 aa, Mycobacterium tuberculosis
IHGGPKSGKS

SEQ ID NO: 5515 - protein, 10 aa, Mycobacterium tuberculosis
HGGPKSGKST

SEQ ID NO: 5516 - protein, 10 aa, Mycobacterium tuberculosis
GGPKSGKSTA

SEQ ID NO: 5517 - protein, 10 aa, Mycobacterium tuberculosis
GPKSGKSTAL

SEQ ID NO: 5518 - protein, 10 aa, Mycobacterium tuberculosis
PKSGKSTALQ

SEQ ID NO: 5519 - protein, 10 aa, Mycobacterium tuberculosis
KSGKSTALQT

SEQ ID NO: 5520 - protein, 10 aa, Mycobacterium tuberculosis
SGKSTALQTF

SEQ ID NO: 5521 - protein, 10 aa, Mycobacterium tuberculosis
GKSTALQTFI

SEQ ID NO: 5522 - protein, 10 aa, Mycobacterium tuberculosis
KSTALQTFIL

SEQ ID NO: 5523 - protein, 10 aa, Mycobacterium tuberculosis
STALQTFILS

SEQ ID NO: 5524 - protein, 10 aa, Mycobacterium tuberculosis
TALQTFILSA

SEQ ID NO: 5525 - protein, 10 aa, Mycobacterium tuberculosis
ALQTFILSAA

SEQ ID NO: 5526 - protein, 10 aa, Mycobacterium tuberculosis
LQTFILSAAS

SEQ ID NO: 5527 - protein, 10 aa, Mycobacterium tuberculosis
QTFILSAASL

SEQ ID NO: 5528 - protein, 10 aa, Mycobacterium tuberculosis
TFILSAASLH

SEQ ID NO: 5529 - protein, 10 aa, Mycobacterium tuberculosis
FILSAASLHS

SEQ ID NO: 5530 - protein, 10 aa, Mycobacterium tuberculosis
ILSAASLHSP

SEQ ID NO: 5531 - protein, 10 aa, Mycobacterium tuberculosis
LSAASLHSPH

SEQ ID NO: 5532 - protein, 10 aa, Mycobacterium tuberculosis
SAASLHSPHE

SEQ ID NO: 5533 - protein, 10 aa, Mycobacterium tuberculosis
AASLHSPHEV

SEQ ID NO: 5534 - protein, 10 aa, Mycobacterium tuberculosis
ASLHSPHEVS

SEQ ID NO: 5535 - protein, 10 aa, Mycobacterium tuberculosis
SLHSPHEVSF

SEQ ID NO: 5536 - protein, 10 aa, Mycobacterium tuberculosis
LHSPHEVSFY

SEQ ID NO: 5537 - protein, 10 aa, Mycobacterium tuberculosis
HSPHEVSFYC

SEQ ID NO: 5538 - protein, 10 aa, Mycobacterium tuberculosis
SPHEVSFYCL

SEQ ID NO: 5539 - protein, 10 aa, Mycobacterium tuberculosis
PHEVSFYCLD

SEQ ID NO: 5540 - protein, 10 aa, Mycobacterium tuberculosis
HEVSFYCLDY

SEQ ID NO: 5541 - protein, 10 aa, Mycobacterium tuberculosis
EVSFYCLDYG

SEQ ID NO: 5542 - protein, 10 aa, Mycobacterium tuberculosis
VSFYCLDYGG

SEQ ID NO: 5543 - protein, 10 aa, Mycobacterium tuberculosis
SFYCLDYGGG

SEQ ID NO: 5544 - protein, 10 aa, Mycobacterium tuberculosis
FYCLDYGGGQ

SEQ ID NO: 5545 - protein, 10 aa, Mycobacterium tuberculosis
YCLDYGGGQL

SEQ ID NO: 5546 - protein, 10 aa, Mycobacterium tuberculosis
CLDYGGGQLR

SEQ ID NO: 5547 - protein, 10 aa, Mycobacterium tuberculosis
LDYGGGQLRA

SEQ ID NO: 5548 - protein, 10 aa, Mycobacterium tuberculosis
DYGGGQLRAL

SEQ ID NO: 5549 - protein, 10 aa, Mycobacterium tuberculosis
YGGGQLRALQ

SEQ ID NO: 5550 - protein, 10 aa, Mycobacterium tuberculosis
GGGQLRALQD

SEQ ID NO: 5551 - protein, 10 aa, Mycobacterium tuberculosis
GGQLRALQDL

SEQ ID NO: 5552 - protein, 10 aa, Mycobacterium tuberculosis
GQLRALQDLA

SEQ ID NO: 5553 - protein, 10 aa, Mycobacterium tuberculosis
QLRALQDLAH

SEQ ID NO: 5554 - protein, 10 aa, Mycobacterium tuberculosis
LRALQDLAHV

SEQ ID NO: 5555 - protein, 10 aa, Mycobacterium tuberculosis
RALQDLAHVG

SEQ ID NO: 5556 - protein, 10 aa, Mycobacterium tuberculosis
ALQDLAHVGS

SEQ ID NO: 5557 - protein, 10 aa, Mycobacterium tuberculosis
LQDLAHVGSV

SEQ ID NO: 5558 - protein, 10 aa, Mycobacterium tuberculosis
QDLAHVGSVA

SEQ ID NO: 5559 - protein, 10 aa, Mycobacterium tuberculosis
DLAHVGSVAS

SEQ ID NO: 5560 - protein, 10 aa, Mycobacterium tuberculosis
LAHVGSVASA

SEQ ID NO: 5561 - protein, 10 aa, Mycobacterium tuberculosis
AHVGSVASAL

SEQ ID NO: 5562 - protein, 10 aa, Mycobacterium tuberculosis
HVGSVASALE

SEQ ID NO: 5563 - protein, 10 aa, Mycobacterium tuberculosis
VGSVASALEP

SEQ ID NO: 5564 - protein, 10 aa, Mycobacterium tuberculosis
GSVASALEPE

SEQ ID NO: 5565 - protein, 10 aa, Mycobacterium tuberculosis
SVASALEPER

SEQ ID NO: 5566 - protein, 10 aa, Mycobacterium tuberculosis
VASALEPERI

SEQ ID NO: 5567 - protein, 10 aa, Mycobacterium tuberculosis
ASALEPERIR

SEQ ID NO: 5568 - protein, 10 aa, Mycobacterium tuberculosis
SALEPERIRR

SEQ ID NO: 5569 - protein, 10 aa, Mycobacterium tuberculosis
ALEPERIRRT

SEQ ID NO: 5570 - protein, 10 aa, Mycobacterium tuberculosis
LEPERIRRTF

SEQ ID NO: 5571 - protein, 10 aa, Mycobacterium tuberculosis
EPERIRRTFG

SEQ ID NO: 5572 - protein, 10 aa, Mycobacterium tuberculosis
PERIRRTFGE

SEQ ID NO: 5573 - protein, 10 aa, Mycobacterium tuberculosis
ERIRRTFGEL

SEQ ID NO: 5574 - protein, 10 aa, Mycobacterium tuberculosis
RIRRTFGELE

SEQ ID NO: 5575 - protein, 10 aa, Mycobacterium tuberculosis
IRRTFGELEQ

SEQ ID NO: 5576 - protein, 10 aa, Mycobacterium tuberculosis
RRTFGELEQL

SEQ ID NO: 5577 - protein, 10 aa, Mycobacterium tuberculosis
RTFGELEQLL

SEQ ID NO: 5578 - protein, 10 aa, Mycobacterium tuberculosis
TFGELEQLLL

SEQ ID NO: 5579 - protein, 10 aa, Mycobacterium tuberculosis
FGELEQLLLS

SEQ ID NO: 5580 - protein, 10 aa, Mycobacterium tuberculosis
GELEQLLLSR

SEQ ID NO: 5581 - protein, 10 aa, Mycobacterium tuberculosis
ELEQLLLSRQ

SEQ ID NO: 5582 - protein, 10 aa, Mycobacterium tuberculosis
LEQLLLSRQQ

SEQ ID NO: 5583 - protein, 10 aa, Mycobacterium tuberculosis
EQLLLSRQQR

SEQ ID NO: 5584 - protein, 10 aa, Mycobacterium tuberculosis
QLLLSRQQRE

SEQ ID NO: 5585 - protein, 10 aa, Mycobacterium tuberculosis
LLLSRQQREV

SEQ ID NO: 5586 - protein, 10 aa, Mycobacterium tuberculosis
LLSRQQREVF

SEQ ID NO: 5587 - protein, 10 aa, Mycobacterium tuberculosis
LSRQQREVFR

SEQ ID NO: 5588 - protein, 10 aa, Mycobacterium tuberculosis
SRQQREVFRD

SEQ ID NO: 5589 - protein, 10 aa, Mycobacterium tuberculosis
RQQREVFRDR

SEQ ID NO: 5590 - protein, 10 aa, Mycobacterium tuberculosis
QQREVFRDRG

SEQ ID NO: 5591 - protein, 10 aa, Mycobacterium tuberculosis
QREVFRDRGA

SEQ ID NO: 5592 - protein, 10 aa, Mycobacterium tuberculosis
REVFRDRGAN

SEQ ID NO: 5593 - protein, 10 aa, Mycobacterium tuberculosis
EVFRDRGANG

SEQ ID NO: 5594 - protein, 10 aa, Mycobacterium tuberculosis
VFRDRGANGS

SEQ ID NO: 5595 - protein, 10 aa, Mycobacterium tuberculosis
FRDRGANGST

SEQ ID NO: 5596 - protein, 10 aa, Mycobacterium tuberculosis
RDRGANGSTP

SEQ ID NO: 5597 - protein, 10 aa, Mycobacterium tuberculosis
DRGANGSTPD

SEQ ID NO: 5598 - protein, 10 aa, Mycobacterium tuberculosis
RGANGSTPDD

SEQ ID NO: 5599 - protein, 10 aa, Mycobacterium tuberculosis
GANGSTPDDG

SEQ ID NO: 5600 - protein, 10 aa, Mycobacterium tuberculosis
ANGSTPDDGF

SEQ ID NO: 5601 - protein, 10 aa, Mycobacterium tuberculosis
NGSTPDDGFG

SEQ ID NO: 5602 - protein, 10 aa, Mycobacterium tuberculosis
GSTPDDGFGE

SEQ ID NO: 5603 - protein, 10 aa, Mycobacterium tuberculosis
STPDDGFGEV

SEQ ID NO: 5604 - protein, 10 aa, Mycobacterium tuberculosis
TPDDGFGEVF

SEQ ID NO: 5605 - protein, 10 aa, Mycobacterium tuberculosis
PDDGFGEVFL

SEQ ID NO: 5606 - protein, 10 aa, Mycobacterium tuberculosis
DDGFGEVFLV

SEQ ID NO: 5607 - protein, 10 aa, Mycobacterium tuberculosis
DGFGEVFLVI

SEQ ID NO: 5608 - protein, 10 aa, Mycobacterium tuberculosis
GFGEVFLVID

SEQ ID NO: 5609 - protein, 10 aa, Mycobacterium tuberculosis
FGEVFLVIDN

SEQ ID NO: 5610 - protein, 10 aa, Mycobacterium tuberculosis
GEVFLVIDNL

SEQ ID NO: 5611 - protein, 10 aa, Mycobacterium tuberculosis
EVFLVIDNLY

SEQ ID NO: 5612 - protein, 10 aa, Mycobacterium tuberculosis
VFLVIDNLYG

SEQ ID NO: 5613 - protein, 10 aa, Mycobacterium tuberculosis
FLVIDNLYGF

SEQ ID NO: 5614 - protein, 10 aa, Mycobacterium tuberculosis
LVIDNLYGFG

SEQ ID NO: 5615 - protein, 10 aa, Mycobacterium tuberculosis
VIDNLYGFGR

SEQ ID NO: 5616 - protein, 10 aa, Mycobacterium tuberculosis
IDNLYGFGRD

SEQ ID NO: 5617 - protein, 10 aa, Mycobacterium tuberculosis
DNLYGFGRDN

SEQ ID NO: 5618 - protein, 10 aa, Mycobacterium tuberculosis
NLYGFGRDNT

SEQ ID NO: 5619 - protein, 10 aa, Mycobacterium tuberculosis
LYGFGRDNTD

SEQ ID NO: 5620 - protein, 10 aa, Mycobacterium tuberculosis
YGFGRDNTDQ

SEQ ID NO: 5621 - protein, 10 aa, Mycobacterium tuberculosis
GFGRDNTDQF

SEQ ID NO: 5622 - protein, 10 aa, Mycobacterium tuberculosis
FGRDNTDQFN

SEQ ID NO: 5623 - protein, 10 aa, Mycobacterium tuberculosis
GRDNTDQFNT

SEQ ID NO: 5624 - protein, 10 aa, Mycobacterium tuberculosis
RDNTDQFNTR

SEQ ID NO: 5625 - protein, 10 aa, Mycobacterium tuberculosis
DNTDQFNTRN

SEQ ID NO: 5626 - protein, 10 aa, Mycobacterium tuberculosis
NTDQFNTRNP

SEQ ID NO: 5627 - protein, 10 aa, Mycobacterium tuberculosis
TDQFNTRNPL

SEQ ID NO: 5628 - protein, 10 aa, Mycobacterium tuberculosis
DQFNTRNPLL

SEQ ID NO: 5629 - protein, 10 aa, Mycobacterium tuberculosis
QFNTRNPLLA

SEQ ID NO: 5630 - protein, 10 aa, Mycobacterium tuberculosis
FNTRNPLLAR

SEQ ID NO: 5631 - protein, 10 aa, Mycobacterium tuberculosis
NTRNPLLARV

SEQ ID NO: 5632 - protein, 10 aa, Mycobacterium tuberculosis
TRNPLLARVT

SEQ ID NO: 5633 - protein, 10 aa, Mycobacterium tuberculosis
RNPLLARVTE

SEQ ID NO: 5634 - protein, 10 aa, Mycobacterium tuberculosis
NPLLARVTEL

SEQ ID NO: 5635 - protein, 10 aa, Mycobacterium tuberculosis
PLLARVTELV

SEQ ID NO: 5636 - protein, 10 aa, Mycobacterium tuberculosis
LLARVTELVN

SEQ ID NO: 5637 - protein, 10 aa, Mycobacterium tuberculosis
LARVTELVNV

SEQ ID NO: 5638 - protein, 10 aa, Mycobacterium tuberculosis
ARVTELVNVG

SEQ ID NO: 5639 - protein, 10 aa, Mycobacterium tuberculosis
RVTELVNVGL

SEQ ID NO: 5640 - protein, 10 aa, Mycobacterium tuberculosis
VTELVNVGLA

SEQ ID NO: 5641 - protein, 10 aa, Mycobacterium tuberculosis
TELVNVGLAY

SEQ ID NO: 5642 - protein, 10 aa, Mycobacterium tuberculosis
ELVNVGLAYG

SEQ ID NO: 5643 - protein, 10 aa, Mycobacterium tuberculosis
LVNVGLAYGI

SEQ ID NO: 5644 - protein, 10 aa, Mycobacterium tuberculosis
VNVGLAYGIH

SEQ ID NO: 5645 - protein, 10 aa, Mycobacterium tuberculosis
NVGLAYGIHV

SEQ ID NO: 5646 - protein, 10 aa, Mycobacterium tuberculosis
VGLAYGIHVI

SEQ ID NO: 5647 - protein, 10 aa, Mycobacterium tuberculosis
GLAYGIHVII

SEQ ID NO: 5648 - protein, 10 aa, Mycobacterium tuberculosis
LAYGIHVIIT

SEQ ID NO: 5649 - protein, 10 aa, Mycobacterium tuberculosis
AYGIHVIITT

SEQ ID NO: 5650 - protein, 10 aa, Mycobacterium tuberculosis
YGIHVIITTP

SEQ ID NO: 5651 - protein, 10 aa, Mycobacterium tuberculosis
GIHVIITTPS

SEQ ID NO: 5652 - protein, 10 aa, Mycobacterium tuberculosis
IHVIITTPSW

SEQ ID NO: 5653 - protein, 10 aa, Mycobacterium tuberculosis
HVIITTPSWL

SEQ ID NO: 5654 - protein, 10 aa, Mycobacterium tuberculosis
VIITTPSWLE

SEQ ID NO: 5655 - protein, 10 aa, Mycobacterium tuberculosis
IITTPSWLEV

SEQ ID NO: 5656 - protein, 10 aa, Mycobacterium tuberculosis
ITTPSWLEVP

SEQ ID NO: 5657 - protein, 10 aa, Mycobacterium tuberculosis
TTPSWLEVPL

SEQ ID NO: 5658 - protein, 10 aa, Mycobacterium tuberculosis
TPSWLEVPLA

SEQ ID NO: 5659 - protein, 10 aa, Mycobacterium tuberculosis
PSWLEVPLAM

SEQ ID NO: 5660 - protein, 10 aa, Mycobacterium tuberculosis
SWLEVPLAMR

SEQ ID NO: 5661 - protein, 10 aa, Mycobacterium tuberculosis
WLEVPLAMRD

SEQ ID NO: 5662 - protein, 10 aa, Mycobacterium tuberculosis
LEVPLAMRDG

SEQ ID NO: 5663 - protein, 10 aa, Mycobacterium tuberculosis
EVPLAMRDGL

SEQ ID NO: 5664 - protein, 10 aa, Mycobacterium tuberculosis
VPLAMRDGLG

SEQ ID NO: 5665 - protein, 10 aa, Mycobacterium tuberculosis
PLAMRDGLGL

SEQ ID NO: 5666 - protein, 10 aa, Mycobacterium tuberculosis
LAMRDGLGLR

SEQ ID NO: 5667 - protein, 10 aa, Mycobacterium tuberculosis
AMRDGLGLRL

SEQ ID NO: 5668 - protein, 10 aa, Mycobacterium tuberculosis
MRDGLGLRLE

SEQ ID NO: 5669 - protein, 10 aa, Mycobacterium tuberculosis
RDGLGLRLEL

SEQ ID NO: 5670 - protein, 10 aa, Mycobacterium tuberculosis
DGLGLRLELR

SEQ ID NO: 5671 - protein, 10 aa, Mycobacterium tuberculosis
GLGLRLELRL

SEQ ID NO: 5672 - protein, 10 aa, Mycobacterium tuberculosis
LGLRLELRLH

SEQ ID NO: 5673 - protein, 10 aa, Mycobacterium tuberculosis
GLRLELRLHD

SEQ ID NO: 5674 - protein, 10 aa, Mycobacterium tuberculosis
LRLELRLHDA

SEQ ID NO: 5675 - protein, 10 aa, Mycobacterium tuberculosis
RLELRLHDAR

SEQ ID NO: 5676 - protein, 10 aa, Mycobacterium tuberculosis
LELRLHDARD

SEQ ID NO: 5677 - protein, 10 aa, Mycobacterium tuberculosis
ELRLHDARDS

SEQ ID NO: 5678 - protein, 10 aa, Mycobacterium tuberculosis
LRLHDARDSN

SEQ ID NO: 5679 - protein, 10 aa, Mycobacterium tuberculosis
RLHDARDSNV

SEQ ID NO: 5680 - protein, 10 aa, Mycobacterium tuberculosis
LHDARDSNVR

SEQ ID NO: 5681 - protein, 10 aa, Mycobacterium tuberculosis
HDARDSNVRV

SEQ ID NO: 5682 - protein, 10 aa, Mycobacterium tuberculosis
DARDSNVRVV

SEQ ID NO: 5683 - protein, 10 aa, Mycobacterium tuberculosis
ARDSNVRVVG

SEQ ID NO: 5684 - protein, 10 aa, Mycobacterium tuberculosis
RDSNVRVVGA

SEQ ID NO: 5685 - protein, 10 aa, Mycobacterium tuberculosis
DSNVRVVGAL

SEQ ID NO: 5686 - protein, 10 aa, Mycobacterium tuberculosis
SNVRVVGALR

SEQ ID NO: 5687 - protein, 10 aa, Mycobacterium tuberculosis
NVRVVGALRR

SEQ ID NO: 5688 - protein, 10 aa, Mycobacterium tuberculosis
VRVVGALRRP

SEQ ID NO: 5689 - protein, 10 aa, Mycobacterium tuberculosis
RVVGALRRPA

SEQ ID NO: 5690 - protein, 10 aa, Mycobacterium tuberculosis
VVGALRRPAD

SEQ ID NO: 5691 - protein, 10 aa, Mycobacterium tuberculosis
VGALRRPADA

SEQ ID NO: 5692 - protein, 10 aa, Mycobacterium tuberculosis
GALRRPADAV

SEQ ID NO: 5693 - protein, 10 aa, Mycobacterium tuberculosis
ALRRPADAVP

SEQ ID NO: 5694 - protein, 10 aa, Mycobacterium tuberculosis
LRRPADAVPH

SEQ ID NO: 5695 - protein, 10 aa, Mycobacterium tuberculosis
RRPADAVPHD

SEQ ID NO: 5696 - protein, 10 aa, Mycobacterium tuberculosis
RPADAVPHDQ

SEQ ID NO: 5697 - protein, 10 aa, Mycobacterium tuberculosis
PADAVPHDQP

SEQ ID NO: 5698 - protein, 10 aa, Mycobacterium tuberculosis
ADAVPHDQPG

SEQ ID NO: 5699 - protein, 10 aa, Mycobacterium tuberculosis
DAVPHDQPGR

SEQ ID NO: 5700 - protein, 10 aa, Mycobacterium tuberculosis
AVPHDQPGRG

SEQ ID NO: 5701 - protein, 10 aa, Mycobacterium tuberculosis
VPHDQPGRGL

SEQ ID NO: 5702 - protein, 10 aa, Mycobacterium tuberculosis
PHDQPGRGLT

SEQ ID NO: 5703 - protein, 10 aa, Mycobacterium tuberculosis
HDQPGRGLTM

SEQ ID NO: 5704 - protein, 10 aa, Mycobacterium tuberculosis
DQPGRGLTMA

SEQ ID NO: 5705 - protein, 10 aa, Mycobacterium tuberculosis
QPGRGLTMAA

SEQ ID NO: 5706 - protein, 10 aa, Mycobacterium tuberculosis
PGRGLTMAAE

SEQ ID NO: 5707 - protein, 10 aa, Mycobacterium tuberculosis
GRGLTMAAEH

SEQ ID NO: 5708 - protein, 10 aa, Mycobacterium tuberculosis
RGLTMAAEHF

SEQ ID NO: 5709 - protein, 10 aa, Mycobacterium tuberculosis
GLTMAAEHFL

SEQ ID NO: 5710 - protein, 10 aa, Mycobacterium tuberculosis
LTMAAEHFLF

SEQ ID NO: 5711 - protein, 10 aa, Mycobacterium tuberculosis
TMAAEHFLFA

SEQ ID NO: 5712 - protein, 10 aa, Mycobacterium tuberculosis
MAAEHFLFAA

SEQ ID NO: 5713 - protein, 10 aa, Mycobacterium tuberculosis
AAEHFLFAAP

SEQ ID NO: 5714 - protein, 10 aa, Mycobacterium tuberculosis
AEHFLFAAPE

SEQ ID NO: 5715 - protein, 10 aa, Mycobacterium tuberculosis
EHFLFAAPEL

SEQ ID NO: 5716 - protein, 10 aa, Mycobacterium tuberculosis
HFLFAAPELD

SEQ ID NO: 5717 - protein, 10 aa, Mycobacterium tuberculosis
FLFAAPELDA

SEQ ID NO: 5718 - protein, 10 aa, Mycobacterium tuberculosis
LFAAPELDAQ

SEQ ID NO: 5719 - protein, 10 aa, Mycobacterium tuberculosis
FAAPELDAQT

SEQ ID NO: 5720 - protein, 10 aa, Mycobacterium tuberculosis
AAPELDAQTN

SEQ ID NO: 5721 - protein, 10 aa, Mycobacterium tuberculosis
APELDAQTNP

SEQ ID NO: 5722 - protein, 10 aa, Mycobacterium tuberculosis
PELDAQTNPV

SEQ ID NO: 5723 - protein, 10 aa, Mycobacterium tuberculosis
ELDAQTNPVA

SEQ ID NO: 5724 - protein, 10 aa, Mycobacterium tuberculosis
LDAQTNPVAA

SEQ ID NO: 5725 - protein, 10 aa, Mycobacterium tuberculosis
DAQTNPVAAI

SEQ ID NO: 5726 - protein, 10 aa, Mycobacterium tuberculosis
AQTNPVAAIN

SEQ ID NO: 5727 - protein, 10 aa, Mycobacterium tuberculosis
QTNPVAAINA

SEQ ID NO: 5728 - protein, 10 aa, Mycobacterium tuberculosis
TNPVAAINAR

SEQ ID NO: 5729 - protein, 10 aa, Mycobacterium tuberculosis
NPVAAINARY

SEQ ID NO: 5730 - protein, 10 aa, Mycobacterium tuberculosis
PVAAINARYP

SEQ ID NO: 5731 - protein, 10 aa, Mycobacterium tuberculosis
VAAINARYPG

SEQ ID NO: 5732 - protein, 10 aa, Mycobacterium tuberculosis
AAINARYPGM

SEQ ID NO: 5733 - protein, 10 aa, Mycobacterium tuberculosis
AINARYPGMA

SEQ ID NO: 5734 - protein, 10 aa, Mycobacterium tuberculosis
INARYPGMAA

SEQ ID NO: 5735 - protein, 10 aa, Mycobacterium tuberculosis
NARYPGMAAP

SEQ ID NO: 5736 - protein, 10 aa, Mycobacterium tuberculosis
ARYPGMAAPP

SEQ ID NO: 5737 - protein, 10 aa, Mycobacterium tuberculosis
RYPGMAAPPV

SEQ ID NO: 5738 - protein, 10 aa, Mycobacterium tuberculosis
YPGMAAPPVR

SEQ ID NO: 5739 - protein, 10 aa, Mycobacterium tuberculosis
PGMAAPPVRL

SEQ ID NO: 5740 - protein, 10 aa, Mycobacterium tuberculosis
GMAAPPVRLL

SEQ ID NO: 5741 - protein, 10 aa, Mycobacterium tuberculosis
MAAPPVRLLP

SEQ ID NO: 5742 - protein, 10 aa, Mycobacterium tuberculosis
AAPPVRLLPT

SEQ ID NO: 5743 - protein, 10 aa, Mycobacterium tuberculosis
APPVRLLPTN

SEQ ID NO: 5744 - protein, 10 aa, Mycobacterium tuberculosis
PPVRLLPTNL

SEQ ID NO: 5745 - protein, 10 aa, Mycobacterium tuberculosis
PVRLLPTNLA

SEQ ID NO: 5746 - protein, 10 aa, Mycobacterium tuberculosis
VRLLPTNLAP

SEQ ID NO: 5747 - protein, 10 aa, Mycobacterium tuberculosis
RLLPTNLAPH

SEQ ID NO: 5748 - protein, 10 aa, Mycobacterium tuberculosis
LLPTNLAPHA

SEQ ID NO: 5749 - protein, 10 aa, Mycobacterium tuberculosis
LPTNLAPHAV

SEQ ID NO: 5750 - protein, 10 aa, Mycobacterium tuberculosis
PTNLAPHAVG

SEQ ID NO: 5751 - protein, 10 aa, Mycobacterium tuberculosis
TNLAPHAVGE

SEQ ID NO: 5752 - protein, 10 aa, Mycobacterium tuberculosis
NLAPHAVGEL

SEQ ID NO: 5753 - protein, 10 aa, Mycobacterium tuberculosis
LAPHAVGELY

SEQ ID NO: 5754 - protein, 10 aa, Mycobacterium tuberculosis
APHAVGELYR

SEQ ID NO: 5755 - protein, 10 aa, Mycobacterium tuberculosis
PHAVGELYRG

SEQ ID NO: 5756 - protein, 10 aa, Mycobacterium tuberculosis
HAVGELYRGP

SEQ ID NO: 5757 - protein, 10 aa, Mycobacterium tuberculosis
AVGELYRGPD

SEQ ID NO: 5758 - protein, 10 aa, Mycobacterium tuberculosis
VGELYRGPDQ

SEQ ID NO: 5759 - protein, 10 aa, Mycobacterium tuberculosis
GELYRGPDQL

SEQ ID NO: 5760 - protein, 10 aa, Mycobacterium tuberculosis
ELYRGPDQLV

SEQ ID NO: 5761 - protein, 10 aa, Mycobacterium tuberculosis
LYRGPDQLVI

SEQ ID NO: 5762 - protein, 10 aa, Mycobacterium tuberculosis
YRGPDQLVIG

SEQ ID NO: 5763 - protein, 10 aa, Mycobacterium tuberculosis
RGPDQLVIGQ

SEQ ID NO: 5764 - protein, 10 aa, Mycobacterium tuberculosis
GPDQLVIGQR

SEQ ID NO: 5765 - protein, 10 aa, Mycobacterium tuberculosis
PDQLVIGQRE

SEQ ID NO: 5766 - protein, 10 aa, Mycobacterium tuberculosis
DQLVIGQREE

SEQ ID NO: 5767 - protein, 10 aa, Mycobacterium tuberculosis
QLVIGQREED

SEQ ID NO: 5768 - protein, 10 aa, Mycobacterium tuberculosis
LVIGQREEDL

SEQ ID NO: 5769 - protein, 10 aa, Mycobacterium tuberculosis
VIGQREEDLA

SEQ ID NO: 5770 - protein, 10 aa, Mycobacterium tuberculosis
IGQREEDLAP

SEQ ID NO: 5771 - protein, 10 aa, Mycobacterium tuberculosis
GQREEDLAPV

SEQ ID NO: 5772 - protein, 10 aa, Mycobacterium tuberculosis
QREEDLAPVI

SEQ ID NO: 5773 - protein, 10 aa, Mycobacterium tuberculosis
REEDLAPVIL

SEQ ID NO: 5774 - protein, 10 aa, Mycobacterium tuberculosis
EEDLAPVILD

SEQ ID NO: 5775 - protein, 10 aa, Mycobacterium tuberculosis
EDLAPVILDL

SEQ ID NO: 5776 - protein, 10 aa, Mycobacterium tuberculosis
DLAPVILDLA

SEQ ID NO: 5777 - protein, 10 aa, Mycobacterium tuberculosis
LAPVILDLAA

SEQ ID NO: 5778 - protein, 10 aa, Mycobacterium tuberculosis
APVILDLAAN

SEQ ID NO: 5779 - protein, 10 aa, Mycobacterium tuberculosis
PVILDLAANP

SEQ ID NO: 5780 - protein, 10 aa, Mycobacterium tuberculosis
VILDLAANPL

SEQ ID NO: 5781 - protein, 10 aa, Mycobacterium tuberculosis
ILDLAANPLL

SEQ ID NO: 5782 - protein, 10 aa, Mycobacterium tuberculosis
LDLAANPLLM

SEQ ID NO: 5783 - protein, 10 aa, Mycobacterium tuberculosis
DLAANPLLMV

SEQ ID NO: 5784 - protein, 10 aa, Mycobacterium tuberculosis
LAANPLLMVF

SEQ ID NO: 5785 - protein, 10 aa, Mycobacterium tuberculosis
AANPLLMVFG

SEQ ID NO: 5786 - protein, 10 aa, Mycobacterium tuberculosis
ANPLLMVFGD

SEQ ID NO: 5787 - protein, 10 aa, Mycobacterium tuberculosis
NPLLMVFGDA

SEQ ID NO: 5788 - protein, 10 aa, Mycobacterium tuberculosis
PLLMVFGDAR

SEQ ID NO: 5789 - protein, 10 aa, Mycobacterium tuberculosis
LLMVFGDARS

SEQ ID NO: 5790 - protein, 10 aa, Mycobacterium tuberculosis
LMVFGDARSG

SEQ ID NO: 5791 - protein, 10 aa, Mycobacterium tuberculosis
MVFGDARSGK

SEQ ID NO: 5792 - protein, 10 aa, Mycobacterium tuberculosis
VFGDARSGKT

SEQ ID NO: 5793 - protein, 10 aa, Mycobacterium tuberculosis
FGDARSGKTT

SEQ ID NO: 5794 - protein, 10 aa, Mycobacterium tuberculosis
GDARSGKTTL

SEQ ID NO: 5795 - protein, 10 aa, Mycobacterium tuberculosis
DARSGKTTLL

SEQ ID NO: 5796 - protein, 10 aa, Mycobacterium tuberculosis
ARSGKTTLLR

SEQ ID NO: 5797 - protein, 10 aa, Mycobacterium tuberculosis
RSGKTTLLRH

SEQ ID NO: 5798 - protein, 10 aa, Mycobacterium tuberculosis
SGKTTLLRHI

SEQ ID NO: 5799 - protein, 10 aa, Mycobacterium tuberculosis
GKTTLLRHII

SEQ ID NO: 5800 - protein, 10 aa, Mycobacterium tuberculosis
KTTLLRHIIR

SEQ ID NO: 5801 - protein, 10 aa, Mycobacterium tuberculosis
TTLLRHIIRT

SEQ ID NO: 5802 - protein, 10 aa, Mycobacterium tuberculosis
TLLRHIIRTV

SEQ ID NO: 5803 - protein, 10 aa, Mycobacterium tuberculosis
LLRHIIRTVR

SEQ ID NO: 5804 - protein, 10 aa, Mycobacterium tuberculosis
LRHIIRTVRE

SEQ ID NO: 5805 - protein, 10 aa, Mycobacterium tuberculosis
RHIIRTVREH

SEQ ID NO: 5806 - protein, 10 aa, Mycobacterium tuberculosis
HIIRTVREHS

SEQ ID NO: 5807 - protein, 10 aa, Mycobacterium tuberculosis
IIRTVREHST

SEQ ID NO: 5808 - protein, 10 aa, Mycobacterium tuberculosis
IRTVREHSTA

SEQ ID NO: 5809 - protein, 10 aa, Mycobacterium tuberculosis
RTVREHSTAD

SEQ ID NO: 5810 - protein, 10 aa, Mycobacterium tuberculosis
TVREHSTADR

SEQ ID NO: 5811 - protein, 10 aa, Mycobacterium tuberculosis
VREHSTADRV

SEQ ID NO: 5812 - protein, 10 aa, Mycobacterium tuberculosis
REHSTADRVA

SEQ ID NO: 5813 - protein, 10 aa, Mycobacterium tuberculosis
EHSTADRVAF

SEQ ID NO: 5814 - protein, 10 aa, Mycobacterium tuberculosis
HSTADRVAFT

SEQ ID NO: 5815 - protein, 10 aa, Mycobacterium tuberculosis
STADRVAFTV

SEQ ID NO: 5816 - protein, 10 aa, Mycobacterium tuberculosis
TADRVAFTVL

SEQ ID NO: 5817 - protein, 10 aa, Mycobacterium tuberculosis
ADRVAFTVLD

SEQ ID NO: 5818 - protein, 10 aa, Mycobacterium tuberculosis
DRVAFTVLDR

SEQ ID NO: 5819 - protein, 10 aa, Mycobacterium tuberculosis
RVAFTVLDRR

SEQ ID NO: 5820 - protein, 10 aa, Mycobacterium tuberculosis
VAFTVLDRRL

SEQ ID NO: 5821 - protein, 10 aa, Mycobacterium tuberculosis
AFTVLDRRLH

SEQ ID NO: 5822 - protein, 10 aa, Mycobacterium tuberculosis
FTVLDRRLHL

SEQ ID NO: 5823 - protein, 10 aa, Mycobacterium tuberculosis
TVLDRRLHLV

SEQ ID NO: 5824 - protein, 10 aa, Mycobacterium tuberculosis
VLDRRLHLVD

SEQ ID NO: 5825 - protein, 10 aa, Mycobacterium tuberculosis
LDRRLHLVDE

SEQ ID NO: 5826 - protein, 10 aa, Mycobacterium tuberculosis
DRRLHLVDEP

SEQ ID NO: 5827 - protein, 10 aa, Mycobacterium tuberculosis
RRLHLVDEPL

SEQ ID NO: 5828 - protein, 10 aa, Mycobacterium tuberculosis
RLHLVDEPLF

SEQ ID NO: 5829 - protein, 10 aa, Mycobacterium tuberculosis
LHLVDEPLFP

SEQ ID NO: 5830 - protein, 10 aa, Mycobacterium tuberculosis
HLVDEPLFPD

SEQ ID NO: 5831 - protein, 10 aa, Mycobacterium tuberculosis
LVDEPLFPDN

SEQ ID NO: 5832 - protein, 10 aa, Mycobacterium tuberculosis
VDEPLFPDNE

SEQ ID NO: 5833 - protein, 10 aa, Mycobacterium tuberculosis
DEPLFPDNEY

SEQ ID NO: 5834 - protein, 10 aa, Mycobacterium tuberculosis
EPLFPDNEYT

SEQ ID NO: 5835 - protein, 10 aa, Mycobacterium tuberculosis
PLFPDNEYTA

SEQ ID NO: 5836 - protein, 10 aa, Mycobacterium tuberculosis
LFPDNEYTAN

SEQ ID NO: 5837 - protein, 10 aa, Mycobacterium tuberculosis
FPDNEYTANI

SEQ ID NO: 5838 - protein, 10 aa, Mycobacterium tuberculosis
PDNEYTANID

SEQ ID NO: 5839 - protein, 10 aa, Mycobacterium tuberculosis
DNEYTANIDR

SEQ ID NO: 5840 - protein, 10 aa, Mycobacterium tuberculosis
NEYTANIDRI

SEQ ID NO: 5841 - protein, 10 aa, Mycobacterium tuberculosis
EYTANIDRII

SEQ ID NO: 5842 - protein, 10 aa, Mycobacterium tuberculosis
YTANIDRIIP

SEQ ID NO: 5843 - protein, 10 aa, Mycobacterium tuberculosis
TANIDRIIPA

SEQ ID NO: 5844 - protein, 10 aa, Mycobacterium tuberculosis
ANIDRIIPAM

SEQ ID NO: 5845 - protein, 10 aa, Mycobacterium tuberculosis
NIDRIIPAML

SEQ ID NO: 5846 - protein, 10 aa, Mycobacterium tuberculosis
IDRIIPAMLG

SEQ ID NO: 5847 - protein, 10 aa, Mycobacterium tuberculosis
DRIIPAMLGL

SEQ ID NO: 5848 - protein, 10 aa, Mycobacterium tuberculosis
RIIPAMLGLA

SEQ ID NO: 5849 - protein, 10 aa, Mycobacterium tuberculosis
IIPAMLGLAN

SEQ ID NO: 5850 - protein, 10 aa, Mycobacterium tuberculosis
IPAMLGLANL

SEQ ID NO: 5851 - protein, 10 aa, Mycobacterium tuberculosis
PAMLGLANLI

SEQ ID NO: 5852 - protein, 10 aa, Mycobacterium tuberculosis
AMLGLANLIE

SEQ ID NO: 5853 - protein, 10 aa, Mycobacterium tuberculosis
MLGLANLIEA

SEQ ID NO: 5854 - protein, 10 aa, Mycobacterium tuberculosis
LGLANLIEAR

SEQ ID NO: 5855 - protein, 10 aa, Mycobacterium tuberculosis
GLANLIEARR

SEQ ID NO: 5856 - protein, 10 aa, Mycobacterium tuberculosis
LANLIEARRP

SEQ ID NO: 5857 - protein, 10 aa, Mycobacterium tuberculosis
ANLIEARRPP

SEQ ID NO: 5858 - protein, 10 aa, Mycobacterium tuberculosis
NLIEARRPPA

SEQ ID NO: 5859 - protein, 10 aa, Mycobacterium tuberculosis
LIEARRPPAG

SEQ ID NO: 5860 - protein, 10 aa, Mycobacterium tuberculosis
IEARRPPAGM

SEQ ID NO: 5861 - protein, 10 aa, Mycobacterium tuberculosis
EARRPPAGMS

SEQ ID NO: 5862 - protein, 10 aa, Mycobacterium tuberculosis
ARRPPAGMSA

SEQ ID NO: 5863 - protein, 10 aa, Mycobacterium tuberculosis
RRPPAGMSAA

SEQ ID NO: 5864 - protein, 10 aa, Mycobacterium tuberculosis
RPPAGMSAAE

SEQ ID NO: 5865 - protein, 10 aa, Mycobacterium tuberculosis
PPAGMSAAEL

SEQ ID NO: 5866 - protein, 10 aa, Mycobacterium tuberculosis
PAGMSAAELS

SEQ ID NO: 5867 - protein, 10 aa, Mycobacterium tuberculosis
AGMSAAELSR

SEQ ID NO: 5868 - protein, 10 aa, Mycobacterium tuberculosis
GMSAAELSRW

SEQ ID NO: 5869 - protein, 10 aa, Mycobacterium tuberculosis
MSAAELSRWT

SEQ ID NO: 5870 - protein, 10 aa, Mycobacterium tuberculosis
SAAELSRWTF

SEQ ID NO: 5871 - protein, 10 aa, Mycobacterium tuberculosis
AAELSRWTFA

SEQ ID NO: 5872 - protein, 10 aa, Mycobacterium tuberculosis
AELSRWTFAG

SEQ ID NO: 5873 - protein, 10 aa, Mycobacterium tuberculosis
ELSRWTFAGH

SEQ ID NO: 5874 - protein, 10 aa, Mycobacterium tuberculosis
LSRWTFAGHT

SEQ ID NO: 5875 - protein, 10 aa, Mycobacterium tuberculosis
SRWTFAGHTH

SEQ ID NO: 5876 - protein, 10 aa, Mycobacterium tuberculosis
RWTFAGHTHY

SEQ ID NO: 5877 - protein, 10 aa, Mycobacterium tuberculosis
WTFAGHTHYL

SEQ ID NO: 5878 - protein, 10 aa, Mycobacterium tuberculosis
TFAGHTHYLI

SEQ ID NO: 5879 - protein, 10 aa, Mycobacterium tuberculosis
FAGHTHYLII

SEQ ID NO: 5880 - protein, 10 aa, Mycobacterium tuberculosis
AGHTHYLIID

SEQ ID NO: 5881 - protein, 10 aa, Mycobacterium tuberculosis
GHTHYLIIDD

SEQ ID NO: 5882 - protein, 10 aa, Mycobacterium tuberculosis
HTHYLIIDDV

SEQ ID NO: 5883 - protein, 10 aa, Mycobacterium tuberculosis
THYLIIDDVD

SEQ ID NO: 5884 - protein, 10 aa, Mycobacterium tuberculosis
HYLIIDDVDQ

SEQ ID NO: 5885 - protein, 10 aa, Mycobacterium tuberculosis
YLIIDDVDQV

SEQ ID NO: 5886 - protein, 10 aa, Mycobacterium tuberculosis
LIIDDVDQVP

SEQ ID NO: 5887 - protein, 10 aa, Mycobacterium tuberculosis
IIDDVDQVPD

SEQ ID NO: 5888 - protein, 10 aa, Mycobacterium tuberculosis
IDDVDQVPDS

SEQ ID NO: 5889 - protein, 10 aa, Mycobacterium tuberculosis
DDVDQVPDSP

SEQ ID NO: 5890 - protein, 10 aa, Mycobacterium tuberculosis
DVDQVPDSPA

SEQ ID NO: 5891 - protein, 10 aa, Mycobacterium tuberculosis
VDQVPDSPAM

SEQ ID NO: 5892 - protein, 10 aa, Mycobacterium tuberculosis
DQVPDSPAMT

SEQ ID NO: 5893 - protein, 10 aa, Mycobacterium tuberculosis
QVPDSPAMTG

SEQ ID NO: 5894 - protein, 10 aa, Mycobacterium tuberculosis
VPDSPAMTGP

SEQ ID NO: 5895 - protein, 10 aa, Mycobacterium tuberculosis
PDSPAMTGPY

SEQ ID NO: 5896 - protein, 10 aa, Mycobacterium tuberculosis
DSPAMTGPYI

SEQ ID NO: 5897 - protein, 10 aa, Mycobacterium tuberculosis
SPAMTGPYIG

SEQ ID NO: 5898 - protein, 10 aa, Mycobacterium tuberculosis
PAMTGPYIGQ

SEQ ID NO: 5899 - protein, 10 aa, Mycobacterium tuberculosis
AMTGPYIGQR

SEQ ID NO: 5900 - protein, 10 aa, Mycobacterium tuberculosis
MTGPYIGQRP

SEQ ID NO: 5901 - protein, 10 aa, Mycobacterium tuberculosis
TGPYIGQRPW

SEQ ID NO: 5902 - protein, 10 aa, Mycobacterium tuberculosis
GPYIGQRPWT

SEQ ID NO: 5903 - protein, 10 aa, Mycobacterium tuberculosis
PYIGQRPWTP

SEQ ID NO: 5904 - protein, 10 aa, Mycobacterium tuberculosis
YIGQRPWTPL

SEQ ID NO: 5905 - protein, 10 aa, Mycobacterium tuberculosis
IGQRPWTPLI

SEQ ID NO: 5906 - protein, 10 aa, Mycobacterium tuberculosis
GQRPWTPLIG

SEQ ID NO: 5907 - protein, 10 aa, Mycobacterium tuberculosis
QRPWTPLIGL

SEQ ID NO: 5908 - protein, 10 aa, Mycobacterium tuberculosis
RPWTPLIGLL

SEQ ID NO: 5909 - protein, 10 aa, Mycobacterium tuberculosis
PWTPLIGLLA

SEQ ID NO: 5910 - protein, 10 aa, Mycobacterium tuberculosis
WTPLIGLLAQ

SEQ ID NO: 5911 - protein, 10 aa, Mycobacterium tuberculosis
TPLIGLLAQA

SEQ ID NO: 5912 - protein, 10 aa, Mycobacterium tuberculosis
PLIGLLAQAG

SEQ ID NO: 5913 - protein, 10 aa, Mycobacterium tuberculosis
LIGLLAQAGD

SEQ ID NO: 5914 - protein, 10 aa, Mycobacterium tuberculosis
IGLLAQAGDL

SEQ ID NO: 5915 - protein, 10 aa, Mycobacterium tuberculosis
GLLAQAGDLG

SEQ ID NO: 5916 - protein, 10 aa, Mycobacterium tuberculosis
LLAQAGDLGL

SEQ ID NO: 5917 - protein, 10 aa, Mycobacterium tuberculosis
LAQAGDLGLR

SEQ ID NO: 5918 - protein, 10 aa, Mycobacterium tuberculosis
AQAGDLGLRV

SEQ ID NO: 5919 - protein, 10 aa, Mycobacterium tuberculosis
QAGDLGLRVI

SEQ ID NO: 5920 - protein, 10 aa, Mycobacterium tuberculosis
AGDLGLRVIV

SEQ ID NO: 5921 - protein, 10 aa, Mycobacterium tuberculosis
GDLGLRVIVT

SEQ ID NO: 5922 - protein, 10 aa, Mycobacterium tuberculosis
DLGLRVIVTG

SEQ ID NO: 5923 - protein, 10 aa, Mycobacterium tuberculosis
LGLRVIVTGR

SEQ ID NO: 5924 - protein, 10 aa, Mycobacterium tuberculosis
GLRVIVTGRA

SEQ ID NO: 5925 - protein, 10 aa, Mycobacterium tuberculosis
LRVIVTGRAT

SEQ ID NO: 5926 - protein, 10 aa, Mycobacterium tuberculosis
RVIVTGRATG

SEQ ID NO: 5927 - protein, 10 aa, Mycobacterium tuberculosis
VIVTGRATGS

SEQ ID NO: 5928 - protein, 10 aa, Mycobacterium tuberculosis
IVTGRATGSA

SEQ ID NO: 5929 - protein, 10 aa, Mycobacterium tuberculosis
VTGRATGSAH

SEQ ID NO: 5930 - protein, 10 aa, Mycobacterium tuberculosis
TGRATGSAHL

SEQ ID NO: 5931 - protein, 10 aa, Mycobacterium tuberculosis
GRATGSAHLL

SEQ ID NO: 5932 - protein, 10 aa, Mycobacterium tuberculosis
RATGSAHLLM

SEQ ID NO: 5933 - protein, 10 aa, Mycobacterium tuberculosis
ATGSAHLLMT

SEQ ID NO: 5934 - protein, 10 aa, Mycobacterium tuberculosis
TGSAHLLMTS

SEQ ID NO: 5935 - protein, 10 aa, Mycobacterium tuberculosis
GSAHLLMTSP

SEQ ID NO: 5936 - protein, 10 aa, Mycobacterium tuberculosis
SAHLLMTSPL

SEQ ID NO: 5937 - protein, 10 aa, Mycobacterium tuberculosis
AHLLMTSPLL

SEQ ID NO: 5938 - protein, 10 aa, Mycobacterium tuberculosis
HLLMTSPLLR

SEQ ID NO: 5939 - protein, 10 aa, Mycobacterium tuberculosis
LLMTSPLLRR

SEQ ID NO: 5940 - protein, 10 aa, Mycobacterium tuberculosis
LMTSPLLRRF

SEQ ID NO: 5941 - protein, 10 aa, Mycobacterium tuberculosis
MTSPLLRRFN

SEQ ID NO: 5942 - protein, 10 aa, Mycobacterium tuberculosis
TSPLLRRFND

SEQ ID NO: 5943 - protein, 10 aa, Mycobacterium tuberculosis
SPLLRRFNDL

SEQ ID NO: 5944 - protein, 10 aa, Mycobacterium tuberculosis
PLLRRFNDLQ

SEQ ID NO: 5945 - protein, 10 aa, Mycobacterium tuberculosis
LLRRFNDLQA

SEQ ID NO: 5946 - protein, 10 aa, Mycobacterium tuberculosis
LRRFNDLQAT

SEQ ID NO: 5947 - protein, 10 aa, Mycobacterium tuberculosis
RRFNDLQATT

SEQ ID NO: 5948 - protein, 10 aa, Mycobacterium tuberculosis
RFNDLQATTL

SEQ ID NO: 5949 - protein, 10 aa, Mycobacterium tuberculosis
FNDLQATTLM

SEQ ID NO: 5950 - protein, 10 aa, Mycobacterium tuberculosis
NDLQATTLML

SEQ ID NO: 5951 - protein, 10 aa, Mycobacterium tuberculosis
DLQATTLMLA

SEQ ID NO: 5952 - protein, 10 aa, Mycobacterium tuberculosis
LQATTLMLAG

SEQ ID NO: 5953 - protein, 10 aa, Mycobacterium tuberculosis
QATTLMLAGN

SEQ ID NO: 5954 - protein, 10 aa, Mycobacterium tuberculosis
ATTLMLAGNP

SEQ ID NO: 5955 - protein, 10 aa, Mycobacterium tuberculosis
TTLMLAGNPA

SEQ ID NO: 5956 - protein, 10 aa, Mycobacterium tuberculosis
TLMLAGNPAD

SEQ ID NO: 5957 - protein, 10 aa, Mycobacterium tuberculosis
LMLAGNPADS

SEQ ID NO: 5958 - protein, 10 aa, Mycobacterium tuberculosis
MLAGNPADSG

SEQ ID NO: 5959 - protein, 10 aa, Mycobacterium tuberculosis
LAGNPADSGK

SEQ ID NO: 5960 - protein, 10 aa, Mycobacterium tuberculosis
AGNPADSGKI

SEQ ID NO: 5961 - protein, 10 aa, Mycobacterium tuberculosis
GNPADSGKIR

SEQ ID NO: 5962 - protein, 10 aa, Mycobacterium tuberculosis
NPADSGKIRG

SEQ ID NO: 5963 - protein, 10 aa, Mycobacterium tuberculosis
PADSGKIRGE

SEQ ID NO: 5964 - protein, 10 aa, Mycobacterium tuberculosis
ADSGKIRGER

SEQ ID NO: 5965 - protein, 10 aa, Mycobacterium tuberculosis
DSGKIRGERF

SEQ ID NO: 5966 - protein, 10 aa, Mycobacterium tuberculosis
SGKIRGERFA

SEQ ID NO: 5967 - protein, 10 aa, Mycobacterium tuberculosis
GKIRGERFAR

SEQ ID NO: 5968 - protein, 10 aa, Mycobacterium tuberculosis
KIRGERFARL

SEQ ID NO: 5969 - protein, 10 aa, Mycobacterium tuberculosis
IRGERFARLP

SEQ ID NO: 5970 - protein, 10 aa, Mycobacterium tuberculosis
RGERFARLPA

SEQ ID NO: 5971 - protein, 10 aa, Mycobacterium tuberculosis
GERFARLPAG

SEQ ID NO: 5972 - protein, 10 aa, Mycobacterium tuberculosis
ERFARLPAGR

SEQ ID NO: 5973 - protein, 10 aa, Mycobacterium tuberculosis
RFARLPAGRA

SEQ ID NO: 5974 - protein, 10 aa, Mycobacterium tuberculosis
FARLPAGRAI

SEQ ID NO: 5975 - protein, 10 aa, Mycobacterium tuberculosis
ARLPAGRAIL

SEQ ID NO: 5976 - protein, 10 aa, Mycobacterium tuberculosis
RLPAGRAILL

SEQ ID NO: 5977 - protein, 10 aa, Mycobacterium tuberculosis
LPAGRAILLT

SEQ ID NO: 5978 - protein, 10 aa, Mycobacterium tuberculosis
PAGRAILLTD

SEQ ID NO: 5979 - protein, 10 aa, Mycobacterium tuberculosis
AGRAILLTDS

SEQ ID NO: 5980 - protein, 10 aa, Mycobacterium tuberculosis
GRAILLTDSD

SEQ ID NO: 5981 - protein, 10 aa, Mycobacterium tuberculosis
RAILLTDSDS

SEQ ID NO: 5982 - protein, 10 aa, Mycobacterium tuberculosis
AILLTDSDSP

SEQ ID NO: 5983 - protein, 10 aa, Mycobacterium tuberculosis
ILLTDSDSPT

SEQ ID NO: 5984 - protein, 10 aa, Mycobacterium tuberculosis
LLTDSDSPTY

SEQ ID NO: 5985 - protein, 10 aa, Mycobacterium tuberculosis
LTDSDSPTYV

SEQ ID NO: 5986 - protein, 10 aa, Mycobacterium tuberculosis
TDSDSPTYVQ

SEQ ID NO: 5987 - protein, 10 aa, Mycobacterium tuberculosis
DSDSPTYVQL

SEQ ID NO: 5988 - protein, 10 aa, Mycobacterium tuberculosis
SDSPTYVQLI

SEQ ID NO: 5989 - protein, 10 aa, Mycobacterium tuberculosis
DSPTYVQLIN

SEQ ID NO: 5990 - protein, 10 aa, Mycobacterium tuberculosis
SPTYVQLINP

SEQ ID NO: 5991 - protein, 10 aa, Mycobacterium tuberculosis
PTYVQLINPL

SEQ ID NO: 5992 - protein, 10 aa, Mycobacterium tuberculosis
TYVQLINPLV

SEQ ID NO: 5993 - protein, 10 aa, Mycobacterium tuberculosis
YVQLINPLVD

SEQ ID NO: 5994 - protein, 10 aa, Mycobacterium tuberculosis
VQLINPLVDA

SEQ ID NO: 5995 - protein, 10 aa, Mycobacterium tuberculosis
QLINPLVDAA

SEQ ID NO: 5996 - protein, 10 aa, Mycobacterium tuberculosis
LINPLVDAAA

SEQ ID NO: 5997 - protein, 10 aa, Mycobacterium tuberculosis
INPLVDAAAV

SEQ ID NO: 5998 - protein, 10 aa, Mycobacterium tuberculosis
NPLVDAAAVS

SEQ ID NO: 5999 - protein, 10 aa, Mycobacterium tuberculosis
PLVDAAAVSG

SEQ ID NO: 6000 - protein, 10 aa, Mycobacterium tuberculosis
LVDAAAVSGE

SEQ ID NO: 6001 - protein, 10 aa, Mycobacterium tuberculosis
VDAAAVSGET

SEQ ID NO: 6002 - protein, 10 aa, Mycobacterium tuberculosis
DAAAVSGETQ

SEQ ID NO: 6003 - protein, 10 aa, Mycobacterium tuberculosis
AAAVSGETQQ

SEQ ID NO: 6004 - protein, 10 aa, Mycobacterium tuberculosis
AAVSGETQQK

SEQ ID NO: 6005 - protein, 10 aa, Mycobacterium tuberculosis
AVSGETQQKG

SEQ ID NO: 6006 - protein, 10 aa, Mycobacterium tuberculosis
VSGETQQKGS

SEQ ID NO: 6007 - protein, 10 aa, Mycobacterium tuberculosis
SGETQQKGSQ

SEQ ID NO: 6008 - protein, 10 aa, Mycobacterium tuberculosis
GETQQKGSQS

SEQ ID NO: 6009 - protein, 11 aa, Mycobacterium tuberculosis
MSRLIFEARRR

SEQ ID NO: 6010 - protein, 11 aa, Mycobacterium tuberculosis
SRLIFEARRRL

SEQ ID NO: 6011 - protein, 11 aa, Mycobacterium tuberculosis
RLIFEARRRLA

SEQ ID NO: 6012 - protein, 11 aa, Mycobacterium tuberculosis
LIFEARRRLAP

SEQ ID NO: 6013 - protein, 11 aa, Mycobacterium tuberculosis
IFEARRRLAPP

SEQ ID NO: 6014 - protein, 11 aa, Mycobacterium tuberculosis
FEARRRLAPPS

SEQ ID NO: 6015 - protein, 11 aa, Mycobacterium tuberculosis
EARRRLAPPSS

SEQ ID NO: 6016 - protein, 11 aa, Mycobacterium tuberculosis
ARRRLAPPSSH

SEQ ID NO: 6017 - protein, 11 aa, Mycobacterium tuberculosis
RRRLAPPSSHQ

SEQ ID NO: 6018 - protein, 11 aa, Mycobacterium tuberculosis
RRLAPPSSHQG

SEQ ID NO: 6019 - protein, 11 aa, Mycobacterium tuberculosis
RLAPPSSHQGT

SEQ ID NO: 6020 - protein, 11 aa, Mycobacterium tuberculosis
LAPPSSHQGTI

SEQ ID NO: 6021 - protein, 11 aa, Mycobacterium tuberculosis
APPSSHQGTII

SEQ ID NO: 6022 - protein, 11 aa, Mycobacterium tuberculosis
PPSSHQGTIII

SEQ ID NO: 6023 - protein, 11 aa, Mycobacterium tuberculosis
PSSHQGTIIIE

SEQ ID NO: 6024 - protein, 11 aa, Mycobacterium tuberculosis
SSHQGTIIIEA

SEQ ID NO: 6025 - protein, 11 aa, Mycobacterium tuberculosis
SHQGTIIIEAP

SEQ ID NO: 6026 - protein, 11 aa, Mycobacterium tuberculosis
HQGTIIIEAPP

SEQ ID NO: 6027 - protein, 11 aa, Mycobacterium tuberculosis
QGTIIIEAPPE

SEQ ID NO: 6028 - protein, 11 aa, Mycobacterium tuberculosis
GTIIIEAPPEL

SEQ ID NO: 6029 - protein, 11 aa, Mycobacterium tuberculosis
TIIIEAPPELP

SEQ ID NO: 6030 - protein, 11 aa, Mycobacterium tuberculosis
IIIEAPPELPR

SEQ ID NO: 6031 - protein, 11 aa, Mycobacterium tuberculosis
IIEAPPELPRV

SEQ ID NO: 6032 - protein, 11 aa, Mycobacterium tuberculosis
IEAPPELPRVI

SEQ ID NO: 6033 - protein, 11 aa, Mycobacterium tuberculosis
EAPPELPRVIP

SEQ ID NO: 6034 - protein, 11 aa, Mycobacterium tuberculosis
APPELPRVIPP

SEQ ID NO: 6035 - protein, 11 aa, Mycobacterium tuberculosis
PPELPRVIPPS

SEQ ID NO: 6036 - protein, 11 aa, Mycobacterium tuberculosis
PELPRVIPPSL

SEQ ID NO: 6037 - protein, 11 aa, Mycobacterium tuberculosis
ELPRVIPPSLL

SEQ ID NO: 6038 - protein, 11 aa, Mycobacterium tuberculosis
LPRVIPPSLLR

SEQ ID NO: 6039 - protein, 11 aa, Mycobacterium tuberculosis
PRVIPPSLLRR

SEQ ID NO: 6040 - protein, 11 aa, Mycobacterium tuberculosis
RVIPPSLLRRA

SEQ ID NO: 6041 - protein, 11 aa, Mycobacterium tuberculosis
VIPPSLLRRAL

SEQ ID NO: 6042 - protein, 11 aa, Mycobacterium tuberculosis
IPPSLLRRALP

SEQ ID NO: 6043 - protein, 11 aa, Mycobacterium tuberculosis
PPSLLRRALPY

SEQ ID NO: 6044 - protein, 11 aa, Mycobacterium tuberculosis
PSLLRRALPYL

SEQ ID NO: 6045 - protein, 11 aa, Mycobacterium tuberculosis
SLLRRALPYLI

SEQ ID NO: 6046 - protein, 11 aa, Mycobacterium tuberculosis
LLRRALPYLIG

SEQ ID NO: 6047 - protein, 11 aa, Mycobacterium tuberculosis
LRRALPYLIGI

SEQ ID NO: 6048 - protein, 11 aa, Mycobacterium tuberculosis
RRALPYLIGIL

SEQ ID NO: 6049 - protein, 11 aa, Mycobacterium tuberculosis
RALPYLIGILI

SEQ ID NO: 6050 - protein, 11 aa, Mycobacterium tuberculosis
ALPYLIGILIV

SEQ ID NO: 6051 - protein, 11 aa, Mycobacterium tuberculosis
LPYLIGILIVG

SEQ ID NO: 6052 - protein, 11 aa, Mycobacterium tuberculosis
PYLIGILIVGM

SEQ ID NO: 6053 - protein, 11 aa, Mycobacterium tuberculosis
YLIGILIVGMI

SEQ ID NO: 6054 - protein, 11 aa, Mycobacterium tuberculosis
LIGILIVGMIV

SEQ ID NO: 6055 - protein, 11 aa, Mycobacterium tuberculosis
IGILIVGMIVA

SEQ ID NO: 6056 - protein, 11 aa, Mycobacterium tuberculosis
GILIVGMIVAL

SEQ ID NO: 6057 - protein, 11 aa, Mycobacterium tuberculosis
ILIVGMIVALV

SEQ ID NO: 6058 - protein, 11 aa, Mycobacterium tuberculosis
LIVGMIVALVA

SEQ ID NO: 6059 - protein, 11 aa, Mycobacterium tuberculosis
IVGMIVALVAT

SEQ ID NO: 6060 - protein, 11 aa, Mycobacterium tuberculosis
VGMIVALVATG

SEQ ID NO: 6061 - protein, 11 aa, Mycobacterium tuberculosis
GMIVALVATGM

SEQ ID NO: 6062 - protein, 11 aa, Mycobacterium tuberculosis
MIVALVATGMR

SEQ ID NO: 6063 - protein, 11 aa, Mycobacterium tuberculosis
IVALVATGMRV

SEQ ID NO: 6064 - protein, 11 aa, Mycobacterium tuberculosis
VALVATGMRVI

SEQ ID NO: 6065 - protein, 11 aa, Mycobacterium tuberculosis
ALVATGMRVIS

SEQ ID NO: 6066 - protein, 11 aa, Mycobacterium tuberculosis
LVATGMRVISP

SEQ ID NO: 6067 - protein, 11 aa, Mycobacterium tuberculosis
VATGMRVISPQ

SEQ ID NO: 6068 - protein, 11 aa, Mycobacterium tuberculosis
ATGMRVISPQT

SEQ ID NO: 6069 - protein, 11 aa, Mycobacterium tuberculosis
TGMRVISPQTL

SEQ ID NO: 6070 - protein, 11 aa, Mycobacterium tuberculosis
GMRVISPQTLF

SEQ ID NO: 6071 - protein, 11 aa, Mycobacterium tuberculosis
MRVISPQTLFF

SEQ ID NO: 6072 - protein, 11 aa, Mycobacterium tuberculosis
RVISPQTLFFP

SEQ ID NO: 6073 - protein, 11 aa, Mycobacterium tuberculosis
VISPQTLFFPF

SEQ ID NO: 6074 - protein, 11 aa, Mycobacterium tuberculosis
ISPQTLFFPFV

SEQ ID NO: 6075 - protein, 11 aa, Mycobacterium tuberculosis
SPQTLFFPFVL

SEQ ID NO: 6076 - protein, 11 aa, Mycobacterium tuberculosis
PQTLFFPFVLL

SEQ ID NO: 6077 - protein, 11 aa, Mycobacterium tuberculosis
QTLFFPFVLLL

SEQ ID NO: 6078 - protein, 11 aa, Mycobacterium tuberculosis
TLFFPFVLLLA

SEQ ID NO: 6079 - protein, 11 aa, Mycobacterium tuberculosis
LFFPFVLLLAA

SEQ ID NO: 6080 - protein, 11 aa, Mycobacterium tuberculosis
FFPFVLLLAAT

SEQ ID NO: 6081 - protein, 11 aa, Mycobacterium tuberculosis
FPFVLLLAATA

SEQ ID NO: 6082 - protein, 11 aa, Mycobacterium tuberculosis
PFVLLLAATAL

SEQ ID NO: 6083 - protein, 11 aa, Mycobacterium tuberculosis
FVLLLAATALY

SEQ ID NO: 6084 - protein, 11 aa, Mycobacterium tuberculosis
VLLLAATALYR

SEQ ID NO: 6085 - protein, 11 aa, Mycobacterium tuberculosis
LLLAATALYRG

SEQ ID NO: 6086 - protein, 11 aa, Mycobacterium tuberculosis
LLAATALYRGN

SEQ ID NO: 6087 - protein, 11 aa, Mycobacterium tuberculosis
LAATALYRGND

SEQ ID NO: 6088 - protein, 11 aa, Mycobacterium tuberculosis
AATALYRGNDK

SEQ ID NO: 6089 - protein, 11 aa, Mycobacterium tuberculosis
ATALYRGNDKK

SEQ ID NO: 6090 - protein, 11 aa, Mycobacterium tuberculosis
TALYRGNDKKM

SEQ ID NO: 6091 - protein, 11 aa, Mycobacterium tuberculosis
ALYRGNDKKMR

SEQ ID NO: 6092 - protein, 11 aa, Mycobacterium tuberculosis
LYRGNDKKMRT

SEQ ID NO: 6093 - protein, 11 aa, Mycobacterium tuberculosis
YRGNDKKMRTE

SEQ ID NO: 6094 - protein, 11 aa, Mycobacterium tuberculosis
RGNDKKMRTEE

SEQ ID NO: 6095 - protein, 11 aa, Mycobacterium tuberculosis
GNDKKMRTEEV

SEQ ID NO: 6096 - protein, 11 aa, Mycobacterium tuberculosis
NDKKMRTEEVD

SEQ ID NO: 6097 - protein, 11 aa, Mycobacterium tuberculosis
DKKMRTEEVDA

SEQ ID NO: 6098 - protein, 11 aa, Mycobacterium tuberculosis
KKMRTEEVDAE

SEQ ID NO: 6099 - protein, 11 aa, Mycobacterium tuberculosis
KMRTEEVDAER

SEQ ID NO: 6100 - protein, 11 aa, Mycobacterium tuberculosis
MRTEEVDAERA

SEQ ID NO: 6101 - protein, 11 aa, Mycobacterium tuberculosis
RTEEVDAERAD

SEQ ID NO: 6102 - protein, 11 aa, Mycobacterium tuberculosis
TEEVDAERADY

SEQ ID NO: 6103 - protein, 11 aa, Mycobacterium tuberculosis
EEVDAERADYL

SEQ ID NO: 6104 - protein, 11 aa, Mycobacterium tuberculosis
EVDAERADYLR

SEQ ID NO: 6105 - protein, 11 aa, Mycobacterium tuberculosis
VDAERADYLRY

SEQ ID NO: 6106 - protein, 11 aa, Mycobacterium tuberculosis
DAERADYLRYL

SEQ ID NO: 6107 - protein, 11 aa, Mycobacterium tuberculosis
AERADYLRYLS

SEQ ID NO: 6108 - protein, 11 aa, Mycobacterium tuberculosis
ERADYLRYLSV

SEQ ID NO: 6109 - protein, 11 aa, Mycobacterium tuberculosis
RADYLRYLSVV

SEQ ID NO: 6110 - protein, 11 aa, Mycobacterium tuberculosis
ADYLRYLSVVR

SEQ ID NO: 6111 - protein, 11 aa, Mycobacterium tuberculosis
DYLRYLSVVRD

SEQ ID NO: 6112 - protein, 11 aa, Mycobacterium tuberculosis
YLRYLSVVRDN

SEQ ID NO: 6113 - protein, 11 aa, Mycobacterium tuberculosis
LRYLSVVRDNI

SEQ ID NO: 6114 - protein, 11 aa, Mycobacterium tuberculosis
RYLSVVRDNIR

SEQ ID NO: 6115 - protein, 11 aa, Mycobacterium tuberculosis
YLSVVRDNIRA

SEQ ID NO: 6116 - protein, 11 aa, Mycobacterium tuberculosis
LSVVRDNIRAQ

SEQ ID NO: 6117 - protein, 11 aa, Mycobacterium tuberculosis
SVVRDNIRAQA

SEQ ID NO: 6118 - protein, 11 aa, Mycobacterium tuberculosis
VVRDNIRAQAA

SEQ ID NO: 6119 - protein, 11 aa, Mycobacterium tuberculosis
VRDNIRAQAAE

SEQ ID NO: 6120 - protein, 11 aa, Mycobacterium tuberculosis
RDNIRAQAAEQ

SEQ ID NO: 6121 - protein, 11 aa, Mycobacterium tuberculosis
DNIRAQAAEQR

SEQ ID NO: 6122 - protein, 11 aa, Mycobacterium tuberculosis
NIRAQAAEQRA

SEQ ID NO: 6123 - protein, 11 aa, Mycobacterium tuberculosis
IRAQAAEQRAS

SEQ ID NO: 6124 - protein, 11 aa, Mycobacterium tuberculosis
RAQAAEQRASA

SEQ ID NO: 6125 - protein, 11 aa, Mycobacterium tuberculosis
AQAAEQRASAL

SEQ ID NO: 6126 - protein, 11 aa, Mycobacterium tuberculosis
QAAEQRASALW

SEQ ID NO: 6127 - protein, 11 aa, Mycobacterium tuberculosis
AAEQRASALWS

SEQ ID NO: 6128 - protein, 11 aa, Mycobacterium tuberculosis
AEQRASALWSH

SEQ ID NO: 6129 - protein, 11 aa, Mycobacterium tuberculosis
EQRASALWSHP

SEQ ID NO: 6130 - protein, 11 aa, Mycobacterium tuberculosis
QRASALWSHPD

SEQ ID NO: 6131 - protein, 11 aa, Mycobacterium tuberculosis
RASALWSHPDP

SEQ ID NO: 6132 - protein, 11 aa, Mycobacterium tuberculosis
ASALWSHPDPT

SEQ ID NO: 6133 - protein, 11 aa, Mycobacterium tuberculosis
SALWSHPDPTA

SEQ ID NO: 6134 - protein, 11 aa, Mycobacterium tuberculosis
ALWSHPDPTAL

SEQ ID NO: 6135 - protein, 11 aa, Mycobacterium tuberculosis
LWSHPDPTALA

SEQ ID NO: 6136 - protein, 11 aa, Mycobacterium tuberculosis
WSHPDPTALAS

SEQ ID NO: 6137 - protein, 11 aa, Mycobacterium tuberculosis
SHPDPTALASV

SEQ ID NO: 6138 - protein, 11 aa, Mycobacterium tuberculosis
HPDPTALASVP

SEQ ID NO: 6139 - protein, 11 aa, Mycobacterium tuberculosis
PDPTALASVPG

SEQ ID NO: 6140 - protein, 11 aa, Mycobacterium tuberculosis
DPTALASVPGS

SEQ ID NO: 6141 - protein, 11 aa, Mycobacterium tuberculosis
PTALASVPGSR

SEQ ID NO: 6142 - protein, 11 aa, Mycobacterium tuberculosis
TALASVPGSRR

SEQ ID NO: 6143 - protein, 11 aa, Mycobacterium tuberculosis
ALASVPGSRRQ

SEQ ID NO: 6144 - protein, 11 aa, Mycobacterium tuberculosis
LASVPGSRRQW

SEQ ID NO: 6145 - protein, 11 aa, Mycobacterium tuberculosis
ASVPGSRRQWE

SEQ ID NO: 6146 - protein, 11 aa, Mycobacterium tuberculosis
SVPGSRRQWER

SEQ ID NO: 6147 - protein, 11 aa, Mycobacterium tuberculosis
VPGSRRQWERD

SEQ ID NO: 6148 - protein, 11 aa, Mycobacterium tuberculosis
PGSRRQWERDP

SEQ ID NO: 6149 - protein, 11 aa, Mycobacterium tuberculosis
GSRRQWERDPH

SEQ ID NO: 6150 - protein, 11 aa, Mycobacterium tuberculosis
SRRQWERDPHD

SEQ ID NO: 6151 - protein, 11 aa, Mycobacterium tuberculosis
RRQWERDPHDP

SEQ ID NO: 6152 - protein, 11 aa, Mycobacterium tuberculosis
RQWERDPHDPD

SEQ ID NO: 6153 - protein, 11 aa, Mycobacterium tuberculosis
QWERDPHDPDF

SEQ ID NO: 6154 - protein, 11 aa, Mycobacterium tuberculosis
WERDPHDPDFL

SEQ ID NO: 6155 - protein, 11 aa, Mycobacterium tuberculosis
ERDPHDPDFLV

SEQ ID NO: 6156 - protein, 11 aa, Mycobacterium tuberculosis
RDPHDPDFLVL

SEQ ID NO: 6157 - protein, 11 aa, Mycobacterium tuberculosis
DPHDPDFLVLR

SEQ ID NO: 6158 - protein, 11 aa, Mycobacterium tuberculosis
PHDPDFLVLRA

SEQ ID NO: 6159 - protein, 11 aa, Mycobacterium tuberculosis
HDPDFLVLRAG

SEQ ID NO: 6160 - protein, 11 aa, Mycobacterium tuberculosis
DPDFLVLRAGR

SEQ ID NO: 6161 - protein, 11 aa, Mycobacterium tuberculosis
PDFLVLRAGRH

SEQ ID NO: 6162 - protein, 11 aa, Mycobacterium tuberculosis
DFLVLRAGRHT

SEQ ID NO: 6163 - protein, 11 aa, Mycobacterium tuberculosis
FLVLRAGRHTV

SEQ ID NO: 6164 - protein, 11 aa, Mycobacterium tuberculosis
LVLRAGRHTVP

SEQ ID NO: 6165 - protein, 11 aa, Mycobacterium tuberculosis
VLRAGRHTVPL

SEQ ID NO: 6166 - protein, 11 aa, Mycobacterium tuberculosis
LRAGRHTVPLA

SEQ ID NO: 6167 - protein, 11 aa, Mycobacterium tuberculosis
RAGRHTVPLAT

SEQ ID NO: 6168 - protein, 11 aa, Mycobacterium tuberculosis
AGRHTVPLATT

SEQ ID NO: 6169 - protein, 11 aa, Mycobacterium tuberculosis
GRHTVPLATTL

SEQ ID NO: 6170 - protein, 11 aa, Mycobacterium tuberculosis
RHTVPLATTLR

SEQ ID NO: 6171 - protein, 11 aa, Mycobacterium tuberculosis
HTVPLATTLRV

SEQ ID NO: 6172 - protein, 11 aa, Mycobacterium tuberculosis
TVPLATTLRVN

SEQ ID NO: 6173 - protein, 11 aa, Mycobacterium tuberculosis
VPLATTLRVND

SEQ ID NO: 6174 - protein, 11 aa, Mycobacterium tuberculosis
PLATTLRVNDT

SEQ ID NO: 6175 - protein, 11 aa, Mycobacterium tuberculosis
LATTLRVNDTA

SEQ ID NO: 6176 - protein, 11 aa, Mycobacterium tuberculosis
ATTLRVNDTAD

SEQ ID NO: 6177 - protein, 11 aa, Mycobacterium tuberculosis
TTLRVNDTADE

SEQ ID NO: 6178 - protein, 11 aa, Mycobacterium tuberculosis
TLRVNDTADEI

SEQ ID NO: 6179 - protein, 11 aa, Mycobacterium tuberculosis
LRVNDTADEID

SEQ ID NO: 6180 - protein, 11 aa, Mycobacterium tuberculosis
RVNDTADEIDL

SEQ ID NO: 6181 - protein, 11 aa, Mycobacterium tuberculosis
VNDTADEIDLE

SEQ ID NO: 6182 - protein, 11 aa, Mycobacterium tuberculosis
NDTADEIDLEP

SEQ ID NO: 6183 - protein, 11 aa, Mycobacterium tuberculosis
DTADEIDLEPV

SEQ ID NO: 6184 - protein, 11 aa, Mycobacterium tuberculosis
TADEIDLEPVS

SEQ ID NO: 6185 - protein, 11 aa, Mycobacterium tuberculosis
ADEIDLEPVSH

SEQ ID NO: 6186 - protein, 11 aa, Mycobacterium tuberculosis
DEIDLEPVSHS

SEQ ID NO: 6187 - protein, 11 aa, Mycobacterium tuberculosis
EIDLEPVSHSA

SEQ ID NO: 6188 - protein, 11 aa, Mycobacterium tuberculosis
IDLEPVSHSAL

SEQ ID NO: 6189 - protein, 11 aa, Mycobacterium tuberculosis
DLEPVSHSALR

SEQ ID NO: 6190 - protein, 11 aa, Mycobacterium tuberculosis
LEPVSHSALRS

SEQ ID NO: 6191 - protein, 11 aa, Mycobacterium tuberculosis
EPVSHSALRSL

SEQ ID NO: 6192 - protein, 11 aa, Mycobacterium tuberculosis
PVSHSALRSLL

SEQ ID NO: 6193 - protein, 11 aa, Mycobacterium tuberculosis
VSHSALRSLLD

SEQ ID NO: 6194 - protein, 11 aa, Mycobacterium tuberculosis
SHSALRSLLDT

SEQ ID NO: 6195 - protein, 11 aa, Mycobacterium tuberculosis
HSALRSLLDTQ

SEQ ID NO: 6196 - protein, 11 aa, Mycobacterium tuberculosis
SALRSLLDTQR

SEQ ID NO: 6197 - protein, 11 aa, Mycobacterium tuberculosis
ALRSLLDTQRS

SEQ ID NO: 6198 - protein, 11 aa, Mycobacterium tuberculosis
LRSLLDTQRSI

SEQ ID NO: 6199 - protein, 11 aa, Mycobacterium tuberculosis
RSLLDTQRSIG

SEQ ID NO: 6200 - protein, 11 aa, Mycobacterium tuberculosis
SLLDTQRSIGD

SEQ ID NO: 6201 - protein, 11 aa, Mycobacterium tuberculosis
LLDTQRSIGDV

SEQ ID NO: 6202 - protein, 11 aa, Mycobacterium tuberculosis
LDTQRSIGDVP

SEQ ID NO: 6203 - protein, 11 aa, Mycobacterium tuberculosis
DTQRSIGDVPT

SEQ ID NO: 6204 - protein, 11 aa, Mycobacterium tuberculosis
TQRSIGDVPTG

SEQ ID NO: 6205 - protein, 11 aa, Mycobacterium tuberculosis
QRSIGDVPTGI

SEQ ID NO: 6206 - protein, 11 aa, Mycobacterium tuberculosis
RSIGDVPTGID

SEQ ID NO: 6207 - protein, 11 aa, Mycobacterium tuberculosis
SIGDVPTGIDL

SEQ ID NO: 6208 - protein, 11 aa, Mycobacterium tuberculosis
IGDVPTGIDLT

SEQ ID NO: 6209 - protein, 11 aa, Mycobacterium tuberculosis
GDVPTGIDLTK

SEQ ID NO: 6210 - protein, 11 aa, Mycobacterium tuberculosis
DVPTGIDLTKV

SEQ ID NO: 6211 - protein, 11 aa, Mycobacterium tuberculosis
VPTGIDLTKVS

SEQ ID NO: 6212 - protein, 11 aa, Mycobacterium tuberculosis
PTGIDLTKVSP

SEQ ID NO: 6213 - protein, 11 aa, Mycobacterium tuberculosis
TGIDLTKVSPI

SEQ ID NO: 6214 - protein, 11 aa, Mycobacterium tuberculosis
GIDLTKVSPIT

SEQ ID NO: 6215 - protein, 11 aa, Mycobacterium tuberculosis
IDLTKVSPITV

SEQ ID NO: 6216 - protein, 11 aa, Mycobacterium tuberculosis
DLTKVSPITVL

SEQ ID NO: 6217 - protein, 11 aa, Mycobacterium tuberculosis
LTKVSPITVLG

SEQ ID NO: 6218 - protein, 11 aa, Mycobacterium tuberculosis
TKVSPITVLGE

SEQ ID NO: 6219 - protein, 11 aa, Mycobacterium tuberculosis
KVSPITVLGER

SEQ ID NO: 6220 - protein, 11 aa, Mycobacterium tuberculosis
VSPITVLGERA

SEQ ID NO: 6221 - protein, 11 aa, Mycobacterium tuberculosis
SPITVLGERAQ

SEQ ID NO: 6222 - protein, 11 aa, Mycobacterium tuberculosis
PITVLGERAQV

SEQ ID NO: 6223 - protein, 11 aa, Mycobacterium tuberculosis
ITVLGERAQVR

SEQ ID NO: 6224 - protein, 11 aa, Mycobacterium tuberculosis
TVLGERAQVRA

SEQ ID NO: 6225 - protein, 11 aa, Mycobacterium tuberculosis
VLGERAQVRAV

SEQ ID NO: 6226 - protein, 11 aa, Mycobacterium tuberculosis
LGERAQVRAVL

SEQ ID NO: 6227 - protein, 11 aa, Mycobacterium tuberculosis
GERAQVRAVLR

SEQ ID NO: 6228 - protein, 11 aa, Mycobacterium tuberculosis
ERAQVRAVLRA

SEQ ID NO: 6229 - protein, 11 aa, Mycobacterium tuberculosis
RAQVRAVLRAW

SEQ ID NO: 6230 - protein, 11 aa, Mycobacterium tuberculosis
AQVRAVLRAWI

SEQ ID NO: 6231 - protein, 11 aa, Mycobacterium tuberculosis
QVRAVLRAWIA

SEQ ID NO: 6232 - protein, 11 aa, Mycobacterium tuberculosis
VRAVLRAWIAQ

SEQ ID NO: 6233 - protein, 11 aa, Mycobacterium tuberculosis
RAVLRAWIAQA

SEQ ID NO: 6234 - protein, 11 aa, Mycobacterium tuberculosis
AVLRAWIAQAV

SEQ ID NO: 6235 - protein, 11 aa, Mycobacterium tuberculosis
VLRAWIAQAVT

SEQ ID NO: 6236 - protein, 11 aa, Mycobacterium tuberculosis
LRAWIAQAVTW

SEQ ID NO: 6237 - protein, 11 aa, Mycobacterium tuberculosis
RAWIAQAVTWH

SEQ ID NO: 6238 - protein, 11 aa, Mycobacterium tuberculosis
AWIAQAVTWHD

SEQ ID NO: 6239 - protein, 11 aa, Mycobacterium tuberculosis
WIAQAVTWHDP

SEQ ID NO: 6240 - protein, 11 aa, Mycobacterium tuberculosis
IAQAVTWHDPT

SEQ ID NO: 6241 - protein, 11 aa, Mycobacterium tuberculosis
AQAVTWHDPTV

SEQ ID NO: 6242 - protein, 11 aa, Mycobacterium tuberculosis
QAVTWHDPTVL

SEQ ID NO: 6243 - protein, 11 aa, Mycobacterium tuberculosis
AVTWHDPTVLG

SEQ ID NO: 6244 - protein, 11 aa, Mycobacterium tuberculosis
VTWHDPTVLGV

SEQ ID NO: 6245 - protein, 11 aa, Mycobacterium tuberculosis
TWHDPTVLGVA

SEQ ID NO: 6246 - protein, 11 aa, Mycobacterium tuberculosis
WHDPTVLGVAL

SEQ ID NO: 6247 - protein, 11 aa, Mycobacterium tuberculosis
HDPTVLGVALA

SEQ ID NO: 6248 - protein, 11 aa, Mycobacterium tuberculosis
DPTVLGVALAA

SEQ ID NO: 6249 - protein, 11 aa, Mycobacterium tuberculosis
PTVLGVALAAR

SEQ ID NO: 6250 - protein, 11 aa, Mycobacterium tuberculosis
TVLGVALAARD

SEQ ID NO: 6251 - protein, 11 aa, Mycobacterium tuberculosis
VLGVALAARDL

SEQ ID NO: 6252 - protein, 11 aa, Mycobacterium tuberculosis
LGVALAARDLE

SEQ ID NO: 6253 - protein, 11 aa, Mycobacterium tuberculosis
GVALAARDLEG

SEQ ID NO: 6254 - protein, 11 aa, Mycobacterium tuberculosis
VALAARDLEGR

SEQ ID NO: 6255 - protein, 11 aa, Mycobacterium tuberculosis
ALAARDLEGRD

SEQ ID NO: 6256 - protein, 11 aa, Mycobacterium tuberculosis
LAARDLEGRDW

SEQ ID NO: 6257 - protein, 11 aa, Mycobacterium tuberculosis
AARDLEGRDWN

SEQ ID NO: 6258 - protein, 11 aa, Mycobacterium tuberculosis
ARDLEGRDWNW

SEQ ID NO: 6259 - protein, 11 aa, Mycobacterium tuberculosis
RDLEGRDWNWL

SEQ ID NO: 6260 - protein, 11 aa, Mycobacterium tuberculosis
DLEGRDWNWLK

SEQ ID NO: 6261 - protein, 11 aa, Mycobacterium tuberculosis
LEGRDWNWLKW

SEQ ID NO: 6262 - protein, 11 aa, Mycobacterium tuberculosis
EGRDWNWLKWL

SEQ ID NO: 6263 - protein, 11 aa, Mycobacterium tuberculosis
GRDWNWLKWLP

SEQ ID NO: 6264 - protein, 11 aa, Mycobacterium tuberculosis
RDWNWLKWLPH

SEQ ID NO: 6265 - protein, 11 aa, Mycobacterium tuberculosis
DWNWLKWLPHV

SEQ ID NO: 6266 - protein, 11 aa, Mycobacterium tuberculosis
WNWLKWLPHVD

SEQ ID NO: 6267 - protein, 11 aa, Mycobacterium tuberculosis
NWLKWLPHVDI

SEQ ID NO: 6268 - protein, 11 aa, Mycobacterium tuberculosis
WLKWLPHVDIP

SEQ ID NO: 6269 - protein, 11 aa, Mycobacterium tuberculosis
LKWLPHVDIPG

SEQ ID NO: 6270 - protein, 11 aa, Mycobacterium tuberculosis
KWLPHVDIPGR

SEQ ID NO: 6271 - protein, 11 aa, Mycobacterium tuberculosis
WLPHVDIPGRL

SEQ ID NO: 6272 - protein, 11 aa, Mycobacterium tuberculosis
LPHVDIPGRLD

SEQ ID NO: 6273 - protein, 11 aa, Mycobacterium tuberculosis
PHVDIPGRLDA

SEQ ID NO: 6274 - protein, 11 aa, Mycobacterium tuberculosis
HVDIPGRLDAL

SEQ ID NO: 6275 - protein, 11 aa, Mycobacterium tuberculosis
VDIPGRLDALG

SEQ ID NO: 6276 - protein, 11 aa, Mycobacterium tuberculosis
DIPGRLDALGP

SEQ ID NO: 6277 - protein, 11 aa, Mycobacterium tuberculosis
IPGRLDALGPA

SEQ ID NO: 6278 - protein, 11 aa, Mycobacterium tuberculosis
PGRLDALGPAR

SEQ ID NO: 6279 - protein, 11 aa, Mycobacterium tuberculosis
GRLDALGPARN

SEQ ID NO: 6280 - protein, 11 aa, Mycobacterium tuberculosis
RLDALGPARNL

SEQ ID NO: 6281 - protein, 11 aa, Mycobacterium tuberculosis
LDALGPARNLS

SEQ ID NO: 6282 - protein, 11 aa, Mycobacterium tuberculosis
DALGPARNLST

SEQ ID NO: 6283 - protein, 11 aa, Mycobacterium tuberculosis
ALGPARNLSTD

SEQ ID NO: 6284 - protein, 11 aa, Mycobacterium tuberculosis
LGPARNLSTDP

SEQ ID NO: 6285 - protein, 11 aa, Mycobacterium tuberculosis
GPARNLSTDPD

SEQ ID NO: 6286 - protein, 11 aa, Mycobacterium tuberculosis
PARNLSTDPDE

SEQ ID NO: 6287 - protein, 11 aa, Mycobacterium tuberculosis
ARNLSTDPDEL

SEQ ID NO: 6288 - protein, 11 aa, Mycobacterium tuberculosis
RNLSTDPDELI

SEQ ID NO: 6289 - protein, 11 aa, Mycobacterium tuberculosis
NLSTDPDELIA

SEQ ID NO: 6290 - protein, 11 aa, Mycobacterium tuberculosis
LSTDPDELIAL

SEQ ID NO: 6291 - protein, 11 aa, Mycobacterium tuberculosis
STDPDELIALL

SEQ ID NO: 6292 - protein, 11 aa, Mycobacterium tuberculosis
TDPDELIALLG

SEQ ID NO: 6293 - protein, 11 aa, Mycobacterium tuberculosis
DPDELIALLGP

SEQ ID NO: 6294 - protein, 11 aa, Mycobacterium tuberculosis
PDELIALLGPV

SEQ ID NO: 6295 - protein, 11 aa, Mycobacterium tuberculosis
DELIALLGPVL

SEQ ID NO: 6296 - protein, 11 aa, Mycobacterium tuberculosis
ELIALLGPVLA

SEQ ID NO: 6297 - protein, 11 aa, Mycobacterium tuberculosis
LIALLGPVLAD

SEQ ID NO: 6298 - protein, 11 aa, Mycobacterium tuberculosis
IALLGPVLADR

SEQ ID NO: 6299 - protein, 11 aa, Mycobacterium tuberculosis
ALLGPVLADRP

SEQ ID NO: 6300 - protein, 11 aa, Mycobacterium tuberculosis
LLGPVLADRPA

SEQ ID NO: 6301 - protein, 11 aa, Mycobacterium tuberculosis
LGPVLADRPAF

SEQ ID NO: 6302 - protein, 11 aa, Mycobacterium tuberculosis
GPVLADRPAFT

SEQ ID NO: 6303 - protein, 11 aa, Mycobacterium tuberculosis
PVLADRPAFTG

SEQ ID NO: 6304 - protein, 11 aa, Mycobacterium tuberculosis
VLADRPAFTGQ

SEQ ID NO: 6305 - protein, 11 aa, Mycobacterium tuberculosis
LADRPAFTGQP

SEQ ID NO: 6306 - protein, 11 aa, Mycobacterium tuberculosis
ADRPAFTGQPT

SEQ ID NO: 6307 - protein, 11 aa, Mycobacterium tuberculosis
DRPAFTGQPTD

SEQ ID NO: 6308 - protein, 11 aa, Mycobacterium tuberculosis
RPAFTGQPTDA

SEQ ID NO: 6309 - protein, 11 aa, Mycobacterium tuberculosis
PAFTGQPTDAL

SEQ ID NO: 6310 - protein, 11 aa, Mycobacterium tuberculosis
AFTGQPTDALR

SEQ ID NO: 6311 - protein, 11 aa, Mycobacterium tuberculosis
FTGQPTDALRH

SEQ ID NO: 6312 - protein, 11 aa, Mycobacterium tuberculosis
TGQPTDALRHL

SEQ ID NO: 6313 - protein, 11 aa, Mycobacterium tuberculosis
GQPTDALRHLL

SEQ ID NO: 6314 - protein, 11 aa, Mycobacterium tuberculosis
QPTDALRHLLI

SEQ ID NO: 6315 - protein, 11 aa, Mycobacterium tuberculosis
PTDALRHLLIV

SEQ ID NO: 6316 - protein, 11 aa, Mycobacterium tuberculosis
TDALRHLLIVV

SEQ ID NO: 6317 - protein, 11 aa, Mycobacterium tuberculosis
DALRHLLIVVD

SEQ ID NO: 6318 - protein, 11 aa, Mycobacterium tuberculosis
ALRHLLIVVDD

SEQ ID NO: 6319 - protein, 11 aa, Mycobacterium tuberculosis
LRHLLIVVDDP

SEQ ID NO: 6320 - protein, 11 aa, Mycobacterium tuberculosis
RHLLIVVDDPD

SEQ ID NO: 6321 - protein, 11 aa, Mycobacterium tuberculosis
HLLIVVDDPDY

SEQ ID NO: 6322 - protein, 11 aa, Mycobacterium tuberculosis
LLIVVDDPDYD

SEQ ID NO: 6323 - protein, 11 aa, Mycobacterium tuberculosis
LIVVDDPDYDL

SEQ ID NO: 6324 - protein, 11 aa, Mycobacterium tuberculosis
IVVDDPDYDLG

SEQ ID NO: 6325 - protein, 11 aa, Mycobacterium tuberculosis
VVDDPDYDLGA

SEQ ID NO: 6326 - protein, 11 aa, Mycobacterium tuberculosis
VDDPDYDLGAS

SEQ ID NO: 6327 - protein, 11 aa, Mycobacterium tuberculosis
DDPDYDLGASP

SEQ ID NO: 6328 - protein, 11 aa, Mycobacterium tuberculosis
DPDYDLGASPL

SEQ ID NO: 6329 - protein, 11 aa, Mycobacterium tuberculosis
PDYDLGASPLA

SEQ ID NO: 6330 - protein, 11 aa, Mycobacterium tuberculosis
DYDLGASPLAV

SEQ ID NO: 6331 - protein, 11 aa, Mycobacterium tuberculosis
YDLGASPLAVG

SEQ ID NO: 6332 - protein, 11 aa, Mycobacterium tuberculosis
DLGASPLAVGR

SEQ ID NO: 6333 - protein, 11 aa, Mycobacterium tuberculosis
LGASPLAVGRA

SEQ ID NO: 6334 - protein, 11 aa, Mycobacterium tuberculosis
GASPLAVGRAG

SEQ ID NO: 6335 - protein, 11 aa, Mycobacterium tuberculosis
ASPLAVGRAGV

SEQ ID NO: 6336 - protein, 11 aa, Mycobacterium tuberculosis
SPLAVGRAGVT

SEQ ID NO: 6337 - protein, 11 aa, Mycobacterium tuberculosis
PLAVGRAGVTV

SEQ ID NO: 6338 - protein, 11 aa, Mycobacterium tuberculosis
LAVGRAGVTVV

SEQ ID NO: 6339 - protein, 11 aa, Mycobacterium tuberculosis
AVGRAGVTVVH

SEQ ID NO: 6340 - protein, 11 aa, Mycobacterium tuberculosis
VGRAGVTVVHC

SEQ ID NO: 6341 - protein, 11 aa, Mycobacterium tuberculosis
GRAGVTVVHCS

SEQ ID NO: 6342 - protein, 11 aa, Mycobacterium tuberculosis
RAGVTVVHCSA

SEQ ID NO: 6343 - protein, 11 aa, Mycobacterium tuberculosis
AGVTVVHCSAS

SEQ ID NO: 6344 - protein, 11 aa, Mycobacterium tuberculosis
GVTVVHCSASA

SEQ ID NO: 6345 - protein, 11 aa, Mycobacterium tuberculosis
VTVVHCSASAP

SEQ ID NO: 6346 - protein, 11 aa, Mycobacterium tuberculosis
TVVHCSASAPH

SEQ ID NO: 6347 - protein, 11 aa, Mycobacterium tuberculosis
VVHCSASAPHR

SEQ ID NO: 6348 - protein, 11 aa, Mycobacterium tuberculosis
VHCSASAPHRE

SEQ ID NO: 6349 - protein, 11 aa, Mycobacterium tuberculosis
HCSASAPHREQ

SEQ ID NO: 6350 - protein, 11 aa, Mycobacterium tuberculosis
CSASAPHREQY

SEQ ID NO: 6351 - protein, 11 aa, Mycobacterium tuberculosis
SASAPHREQYS

SEQ ID NO: 6352 - protein, 11 aa, Mycobacterium tuberculosis
ASAPHREQYSD

SEQ ID NO: 6353 - protein, 11 aa, Mycobacterium tuberculosis
SAPHREQYSDP

SEQ ID NO: 6354 - protein, 11 aa, Mycobacterium tuberculosis
APHREQYSDPE

SEQ ID NO: 6355 - protein, 11 aa, Mycobacterium tuberculosis
PHREQYSDPEK

SEQ ID NO: 6356 - protein, 11 aa, Mycobacterium tuberculosis
HREQYSDPEKP

SEQ ID NO: 6357 - protein, 11 aa, Mycobacterium tuberculosis
REQYSDPEKPI

SEQ ID NO: 6358 - protein, 11 aa, Mycobacterium tuberculosis
EQYSDPEKPIL

SEQ ID NO: 6359 - protein, 11 aa, Mycobacterium tuberculosis
QYSDPEKPILR

SEQ ID NO: 6360 - protein, 11 aa, Mycobacterium tuberculosis
YSDPEKPILRV

SEQ ID NO: 6361 - protein, 11 aa, Mycobacterium tuberculosis
SDPEKPILRVA

SEQ ID NO: 6362 - protein, 11 aa, Mycobacterium tuberculosis
DPEKPILRVAH

SEQ ID NO: 6363 - protein, 11 aa, Mycobacterium tuberculosis
PEKPILRVAHG

SEQ ID NO: 6364 - protein, 11 aa, Mycobacterium tuberculosis
EKPILRVAHGA

SEQ ID NO: 6365 - protein, 11 aa, Mycobacterium tuberculosis
KPILRVAHGAI

SEQ ID NO: 6366 - protein, 11 aa, Mycobacterium tuberculosis
PILRVAHGAIE

SEQ ID NO: 6367 - protein, 11 aa, Mycobacterium tuberculosis
ILRVAHGAIER

SEQ ID NO: 6368 - protein, 11 aa, Mycobacterium tuberculosis
LRVAHGAIERW

SEQ ID NO: 6369 - protein, 11 aa, Mycobacterium tuberculosis
RVAHGAIERWQ

SEQ ID NO: 6370 - protein, 11 aa, Mycobacterium tuberculosis
VAHGAIERWQT

SEQ ID NO: 6371 - protein, 11 aa, Mycobacterium tuberculosis
AHGAIERWQTG

SEQ ID NO: 6372 - protein, 11 aa, Mycobacterium tuberculosis
HGAIERWQTGG

SEQ ID NO: 6373 - protein, 11 aa, Mycobacterium tuberculosis
GAIERWQTGGW

SEQ ID NO: 6374 - protein, 11 aa, Mycobacterium tuberculosis
AIERWQTGGWQ

SEQ ID NO: 6375 - protein, 11 aa, Mycobacterium tuberculosis
IERWQTGGWQP

SEQ ID NO: 6376 - protein, 11 aa, Mycobacterium tuberculosis
ERWQTGGWQPY

SEQ ID NO: 6377 - protein, 11 aa, Mycobacterium tuberculosis
RWQTGGWQPYI

SEQ ID NO: 6378 - protein, 11 aa, Mycobacterium tuberculosis
WQTGGWQPYID

SEQ ID NO: 6379 - protein, 11 aa, Mycobacterium tuberculosis
QTGGWQPYIDA

SEQ ID NO: 6380 - protein, 11 aa, Mycobacterium tuberculosis
TGGWQPYIDAA

SEQ ID NO: 6381 - protein, 11 aa, Mycobacterium tuberculosis
GGWQPYIDAAD

SEQ ID NO: 6382 - protein, 11 aa, Mycobacterium tuberculosis
GWQPYIDAADQ

SEQ ID NO: 6383 - protein, 11 aa, Mycobacterium tuberculosis
WQPYIDAADQF

SEQ ID NO: 6384 - protein, 11 aa, Mycobacterium tuberculosis
QPYIDAADQFS

SEQ ID NO: 6385 - protein, 11 aa, Mycobacterium tuberculosis
PYIDAADQFSA

SEQ ID NO: 6386 - protein, 11 aa, Mycobacterium tuberculosis
YIDAADQFSAD

SEQ ID NO: 6387 - protein, 11 aa, Mycobacterium tuberculosis
IDAADQFSADE

SEQ ID NO: 6388 - protein, 11 aa, Mycobacterium tuberculosis
DAADQFSADEA

SEQ ID NO: 6389 - protein, 11 aa, Mycobacterium tuberculosis
AADQFSADEAA

SEQ ID NO: 6390 - protein, 11 aa, Mycobacterium tuberculosis
ADQFSADEAAH

SEQ ID NO: 6391 - protein, 11 aa, Mycobacterium tuberculosis
DQFSADEAAHL

SEQ ID NO: 6392 - protein, 11 aa, Mycobacterium tuberculosis
QFSADEAAHLA

SEQ ID NO: 6393 - protein, 11 aa, Mycobacterium tuberculosis
FSADEAAHLAR

SEQ ID NO: 6394 - protein, 11 aa, Mycobacterium tuberculosis
SADEAAHLARR

SEQ ID NO: 6395 - protein, 11 aa, Mycobacterium tuberculosis
ADEAAHLARRL

SEQ ID NO: 6396 - protein, 11 aa, Mycobacterium tuberculosis
DEAAHLARRLS

SEQ ID NO: 6397 - protein, 11 aa, Mycobacterium tuberculosis
EAAHLARRLSR

SEQ ID NO: 6398 - protein, 11 aa, Mycobacterium tuberculosis
AAHLARRLSRW

SEQ ID NO: 6399 - protein, 11 aa, Mycobacterium tuberculosis
AHLARRLSRWD

SEQ ID NO: 6400 - protein, 11 aa, Mycobacterium tuberculosis
HLARRLSRWDS

SEQ ID NO: 6401 - protein, 11 aa, Mycobacterium tuberculosis
LARRLSRWDSN

SEQ ID NO: 6402 - protein, 11 aa, Mycobacterium tuberculosis
ARRLSRWDSNP

SEQ ID NO: 6403 - protein, 11 aa, Mycobacterium tuberculosis
RRLSRWDSNPT

SEQ ID NO: 6404 - protein, 11 aa, Mycobacterium tuberculosis
RLSRWDSNPTH

SEQ ID NO: 6405 - protein, 11 aa, Mycobacterium tuberculosis
LSRWDSNPTHA

SEQ ID NO: 6406 - protein, 11 aa, Mycobacterium tuberculosis
SRWDSNPTHAG

SEQ ID NO: 6407 - protein, 11 aa, Mycobacterium tuberculosis
RWDSNPTHAGL

SEQ ID NO: 6408 - protein, 11 aa, Mycobacterium tuberculosis
WDSNPTHAGLR

SEQ ID NO: 6409 - protein, 11 aa, Mycobacterium tuberculosis
DSNPTHAGLRS

SEQ ID NO: 6410 - protein, 11 aa, Mycobacterium tuberculosis
SNPTHAGLRSA

SEQ ID NO: 6411 - protein, 11 aa, Mycobacterium tuberculosis
NPTHAGLRSAA

SEQ ID NO: 6412 - protein, 11 aa, Mycobacterium tuberculosis
PTHAGLRSAAT

SEQ ID NO: 6413 - protein, 11 aa, Mycobacterium tuberculosis
THAGLRSAATR

SEQ ID NO: 6414 - protein, 11 aa, Mycobacterium tuberculosis
HAGLRSAATRG

SEQ ID NO: 6415 - protein, 11 aa, Mycobacterium tuberculosis
AGLRSAATRGA

SEQ ID NO: 6416 - protein, 11 aa, Mycobacterium tuberculosis
GLRSAATRGAS

SEQ ID NO: 6417 - protein, 11 aa, Mycobacterium tuberculosis
LRSAATRGASF

SEQ ID NO: 6418 - protein, 11 aa, Mycobacterium tuberculosis
RSAATRGASFT

SEQ ID NO: 6419 - protein, 11 aa, Mycobacterium tuberculosis
SAATRGASFTT

SEQ ID NO: 6420 - protein, 11 aa, Mycobacterium tuberculosis
AATRGASFTTL

SEQ ID NO: 6421 - protein, 11 aa, Mycobacterium tuberculosis
ATRGASFTTLL

SEQ ID NO: 6422 - protein, 11 aa, Mycobacterium tuberculosis
TRGASFTTLLG

SEQ ID NO: 6423 - protein, 11 aa, Mycobacterium tuberculosis
RGASFTTLLGI

SEQ ID NO: 6424 - protein, 11 aa, Mycobacterium tuberculosis
GASFTTLLGIE

SEQ ID NO: 6425 - protein, 11 aa, Mycobacterium tuberculosis
ASFTTLLGIED

SEQ ID NO: 6426 - protein, 11 aa, Mycobacterium tuberculosis
SFTTLLGIEDA

SEQ ID NO: 6427 - protein, 11 aa, Mycobacterium tuberculosis
FTTLLGIEDAS

SEQ ID NO: 6428 - protein, 11 aa, Mycobacterium tuberculosis
TTLLGIEDASR

SEQ ID NO: 6429 - protein, 11 aa, Mycobacterium tuberculosis
TLLGIEDASRL

SEQ ID NO: 6430 - protein, 11 aa, Mycobacterium tuberculosis
LLGIEDASRLD

SEQ ID NO: 6431 - protein, 11 aa, Mycobacterium tuberculosis
LGIEDASRLDV

SEQ ID NO: 6432 - protein, 11 aa, Mycobacterium tuberculosis
GIEDASRLDVP

SEQ ID NO: 6433 - protein, 11 aa, Mycobacterium tuberculosis
IEDASRLDVPA

SEQ ID NO: 6434 - protein, 11 aa, Mycobacterium tuberculosis
EDASRLDVPAL

SEQ ID NO: 6435 - protein, 11 aa, Mycobacterium tuberculosis
DASRLDVPALW

SEQ ID NO: 6436 - protein, 11 aa, Mycobacterium tuberculosis
ASRLDVPALWA

SEQ ID NO: 6437 - protein, 11 aa, Mycobacterium tuberculosis
SRLDVPALWAP

SEQ ID NO: 6438 - protein, 11 aa, Mycobacterium tuberculosis
RLDVPALWAPR

SEQ ID NO: 6439 - protein, 11 aa, Mycobacterium tuberculosis
LDVPALWAPRR

SEQ ID NO: 6440 - protein, 11 aa, Mycobacterium tuberculosis
DVPALWAPRRR

SEQ ID NO: 6441 - protein, 11 aa, Mycobacterium tuberculosis
VPALWAPRRRD

SEQ ID NO: 6442 - protein, 11 aa, Mycobacterium tuberculosis
PALWAPRRRDE

SEQ ID NO: 6443 - protein, 11 aa, Mycobacterium tuberculosis
ALWAPRRRDEE

SEQ ID NO: 6444 - protein, 11 aa, Mycobacterium tuberculosis
LWAPRRRDEEL

SEQ ID NO: 6445 - protein, 11 aa, Mycobacterium tuberculosis
WAPRRRDEELR

SEQ ID NO: 6446 - protein, 11 aa, Mycobacterium tuberculosis
APRRRDEELRV

SEQ ID NO: 6447 - protein, 11 aa, Mycobacterium tuberculosis
PRRRDEELRVP

SEQ ID NO: 6448 - protein, 11 aa, Mycobacterium tuberculosis
RRRDEELRVPI

SEQ ID NO: 6449 - protein, 11 aa, Mycobacterium tuberculosis
RRDEELRVPIG

SEQ ID NO: 6450 - protein, 11 aa, Mycobacterium tuberculosis
RDEELRVPIGV

SEQ ID NO: 6451 - protein, 11 aa, Mycobacterium tuberculosis
DEELRVPIGVT

SEQ ID NO: 6452 - protein, 11 aa, Mycobacterium tuberculosis
EELRVPIGVTG

SEQ ID NO: 6453 - protein, 11 aa, Mycobacterium tuberculosis
ELRVPIGVTGT

SEQ ID NO: 6454 - protein, 11 aa, Mycobacterium tuberculosis
LRVPIGVTGTG

SEQ ID NO: 6455 - protein, 11 aa, Mycobacterium tuberculosis
RVPIGVTGTGE

SEQ ID NO: 6456 - protein, 11 aa, Mycobacterium tuberculosis
VPIGVTGTGEP

SEQ ID NO: 6457 - protein, 11 aa, Mycobacterium tuberculosis
PIGVTGTGEPL

SEQ ID NO: 6458 - protein, 11 aa, Mycobacterium tuberculosis
IGVTGTGEPLM

SEQ ID NO: 6459 - protein, 11 aa, Mycobacterium tuberculosis
GVTGTGEPLMF

SEQ ID NO: 6460 - protein, 11 aa, Mycobacterium tuberculosis
VTGTGEPLMFD

SEQ ID NO: 6461 - protein, 11 aa, Mycobacterium tuberculosis
TGTGEPLMFDL

SEQ ID NO: 6462 - protein, 11 aa, Mycobacterium tuberculosis
GTGEPLMFDLK

SEQ ID NO: 6463 - protein, 11 aa, Mycobacterium tuberculosis
TGEPLMFDLKD

SEQ ID NO: 6464 - protein, 11 aa, Mycobacterium tuberculosis
GEPLMFDLKDE

SEQ ID NO: 6465 - protein, 11 aa, Mycobacterium tuberculosis
EPLMFDLKDEA

SEQ ID NO: 6466 - protein, 11 aa, Mycobacterium tuberculosis
PLMFDLKDEAE

SEQ ID NO: 6467 - protein, 11 aa, Mycobacterium tuberculosis
LMFDLKDEAEG

SEQ ID NO: 6468 - protein, 11 aa, Mycobacterium tuberculosis
MFDLKDEAEGG

SEQ ID NO: 6469 - protein, 11 aa, Mycobacterium tuberculosis
FDLKDEAEGGM

SEQ ID NO: 6470 - protein, 11 aa, Mycobacterium tuberculosis
DLKDEAEGGMG

SEQ ID NO: 6471 - protein, 11 aa, Mycobacterium tuberculosis
LKDEAEGGMGP

SEQ ID NO: 6472 - protein, 11 aa, Mycobacterium tuberculosis
KDEAEGGMGPH

SEQ ID NO: 6473 - protein, 11 aa, Mycobacterium tuberculosis
DEAEGGMGPHG

SEQ ID NO: 6474 - protein, 11 aa, Mycobacterium tuberculosis
EAEGGMGPHGL

SEQ ID NO: 6475 - protein, 11 aa, Mycobacterium tuberculosis
AEGGMGPHGLM

SEQ ID NO: 6476 - protein, 11 aa, Mycobacterium tuberculosis
EGGMGPHGLMI

SEQ ID NO: 6477 - protein, 11 aa, Mycobacterium tuberculosis
GGMGPHGLMIG

SEQ ID NO: 6478 - protein, 11 aa, Mycobacterium tuberculosis
GMGPHGLMIGM

SEQ ID NO: 6479 - protein, 11 aa, Mycobacterium tuberculosis
MGPHGLMIGMT

SEQ ID NO: 6480 - protein, 11 aa, Mycobacterium tuberculosis
GPHGLMIGMTG

SEQ ID NO: 6481 - protein, 11 aa, Mycobacterium tuberculosis
PHGLMIGMTGS

SEQ ID NO: 6482 - protein, 11 aa, Mycobacterium tuberculosis
HGLMIGMTGSG

SEQ ID NO: 6483 - protein, 11 aa, Mycobacterium tuberculosis
GLMIGMTGSGK

SEQ ID NO: 6484 - protein, 11 aa, Mycobacterium tuberculosis
LMIGMTGSGKS

SEQ ID NO: 6485 - protein, 11 aa, Mycobacterium tuberculosis
MIGMTGSGKSQ

SEQ ID NO: 6486 - protein, 11 aa, Mycobacterium tuberculosis
IGMTGSGKSQT

SEQ ID NO: 6487 - protein, 11 aa, Mycobacterium tuberculosis
GMTGSGKSQTL

SEQ ID NO: 6488 - protein, 11 aa, Mycobacterium tuberculosis
MTGSGKSQTLM

SEQ ID NO: 6489 - protein, 11 aa, Mycobacterium tuberculosis
TGSGKSQTLMS

SEQ ID NO: 6490 - protein, 11 aa, Mycobacterium tuberculosis
GSGKSQTLMSI

SEQ ID NO: 6491 - protein, 11 aa, Mycobacterium tuberculosis
SGKSQTLMSIL

SEQ ID NO: 6492 - protein, 11 aa, Mycobacterium tuberculosis
GKSQTLMSILL

SEQ ID NO: 6493 - protein, 11 aa, Mycobacterium tuberculosis
KSQTLMSILLS

SEQ ID NO: 6494 - protein, 11 aa, Mycobacterium tuberculosis
SQTLMSILLSL

SEQ ID NO: 6495 - protein, 11 aa, Mycobacterium tuberculosis
QTLMSILLSLL

SEQ ID NO: 6496 - protein, 11 aa, Mycobacterium tuberculosis
TLMSILLSLLT

SEQ ID NO: 6497 - protein, 11 aa, Mycobacterium tuberculosis
LMSILLSLLTT

SEQ ID NO: 6498 - protein, 11 aa, Mycobacterium tuberculosis
MSILLSLLTTH

SEQ ID NO: 6499 - protein, 11 aa, Mycobacterium tuberculosis
SILLSLLTTHS

SEQ ID NO: 6500 - protein, 11 aa, Mycobacterium tuberculosis
ILLSLLTTHSA

SEQ ID NO: 6501 - protein, 11 aa, Mycobacterium tuberculosis
LLSLLTTHSAE

SEQ ID NO: 6502 - protein, 11 aa, Mycobacterium tuberculosis
LSLLTTHSAER

SEQ ID NO: 6503 - protein, 11 aa, Mycobacterium tuberculosis
SLLTTHSAERL

SEQ ID NO: 6504 - protein, 11 aa, Mycobacterium tuberculosis
LLTTHSAERLI

SEQ ID NO: 6505 - protein, 11 aa, Mycobacterium tuberculosis
LTTHSAERLIV

SEQ ID NO: 6506 - protein, 11 aa, Mycobacterium tuberculosis
TTHSAERLIVI

SEQ ID NO: 6507 - protein, 11 aa, Mycobacterium tuberculosis
THSAERLIVIY

SEQ ID NO: 6508 - protein, 11 aa, Mycobacterium tuberculosis
HSAERLIVIYA

SEQ ID NO: 6509 - protein, 11 aa, Mycobacterium tuberculosis
SAERLIVIYAD

SEQ ID NO: 6510 - protein, 11 aa, Mycobacterium tuberculosis
AERLIVIYADF

SEQ ID NO: 6511 - protein, 11 aa, Mycobacterium tuberculosis
ERLIVIYADFK

SEQ ID NO: 6512 - protein, 11 aa, Mycobacterium tuberculosis
RLIVIYADFKG

SEQ ID NO: 6513 - protein, 11 aa, Mycobacterium tuberculosis
LIVIYADFKGE

SEQ ID NO: 6514 - protein, 11 aa, Mycobacterium tuberculosis
IVIYADFKGEA

SEQ ID NO: 6515 - protein, 11 aa, Mycobacterium tuberculosis
VIYADFKGEAG

SEQ ID NO: 6516 - protein, 11 aa, Mycobacterium tuberculosis
IYADFKGEAGA

SEQ ID NO: 6517 - protein, 11 aa, Mycobacterium tuberculosis
YADFKGEAGAD

SEQ ID NO: 6518 - protein, 11 aa, Mycobacterium tuberculosis
ADFKGEAGADS

SEQ ID NO: 6519 - protein, 11 aa, Mycobacterium tuberculosis
DFKGEAGADSF

SEQ ID NO: 6520 - protein, 11 aa, Mycobacterium tuberculosis
FKGEAGADSFR

SEQ ID NO: 6521 - protein, 11 aa, Mycobacterium tuberculosis
KGEAGADSFRD

SEQ ID NO: 6522 - protein, 11 aa, Mycobacterium tuberculosis
GEAGADSFRDF

SEQ ID NO: 6523 - protein, 11 aa, Mycobacterium tuberculosis
EAGADSFRDFP

SEQ ID NO: 6524 - protein, 11 aa, Mycobacterium tuberculosis
AGADSFRDFPQ

SEQ ID NO: 6525 - protein, 11 aa, Mycobacterium tuberculosis
GADSFRDFPQV

SEQ ID NO: 6526 - protein, 11 aa, Mycobacterium tuberculosis
ADSFRDFPQVV

SEQ ID NO: 6527 - protein, 11 aa, Mycobacterium tuberculosis
DSFRDFPQVVA

SEQ ID NO: 6528 - protein, 11 aa, Mycobacterium tuberculosis
SFRDFPQVVAV

SEQ ID NO: 6529 - protein, 11 aa, Mycobacterium tuberculosis
FRDFPQVVAVI

SEQ ID NO: 6530 - protein, 11 aa, Mycobacterium tuberculosis
RDFPQVVAVIS

SEQ ID NO: 6531 - protein, 11 aa, Mycobacterium tuberculosis
DFPQVVAVISN

SEQ ID NO: 6532 - protein, 11 aa, Mycobacterium tuberculosis
FPQVVAVISNM

SEQ ID NO: 6533 - protein, 11 aa, Mycobacterium tuberculosis
PQVVAVISNMA

SEQ ID NO: 6534 - protein, 11 aa, Mycobacterium tuberculosis
QVVAVISNMAE

SEQ ID NO: 6535 - protein, 11 aa, Mycobacterium tuberculosis
VVAVISNMAEK

SEQ ID NO: 6536 - protein, 11 aa, Mycobacterium tuberculosis
VAVISNMAEKK

SEQ ID NO: 6537 - protein, 11 aa, Mycobacterium tuberculosis
AVISNMAEKKS

SEQ ID NO: 6538 - protein, 11 aa, Mycobacterium tuberculosis
VISNMAEKKSL

SEQ ID NO: 6539 - protein, 11 aa, Mycobacterium tuberculosis
ISNMAEKKSLA

SEQ ID NO: 6540 - protein, 11 aa, Mycobacterium tuberculosis
SNMAEKKSLAD

SEQ ID NO: 6541 - protein, 11 aa, Mycobacterium tuberculosis
NMAEKKSLADR

SEQ ID NO: 6542 - protein, 11 aa, Mycobacterium tuberculosis
MAEKKSLADRF

SEQ ID NO: 6543 - protein, 11 aa, Mycobacterium tuberculosis
AEKKSLADRFA

SEQ ID NO: 6544 - protein, 11 aa, Mycobacterium tuberculosis
EKKSLADRFAD

SEQ ID NO: 6545 - protein, 11 aa, Mycobacterium tuberculosis
KKSLADRFADT

SEQ ID NO: 6546 - protein, 11 aa, Mycobacterium tuberculosis
KSLADRFADTL

SEQ ID NO: 6547 - protein, 11 aa, Mycobacterium tuberculosis
SLADRFADTLR

SEQ ID NO: 6548 - protein, 11 aa, Mycobacterium tuberculosis
LADRFADTLRG

SEQ ID NO: 6549 - protein, 11 aa, Mycobacterium tuberculosis
ADRFADTLRGE

SEQ ID NO: 6550 - protein, 11 aa, Mycobacterium tuberculosis
DRFADTLRGEV

SEQ ID NO: 6551 - protein, 11 aa, Mycobacterium tuberculosis
RFADTLRGEVA

SEQ ID NO: 6552 - protein, 11 aa, Mycobacterium tuberculosis
FADTLRGEVAR

SEQ ID NO: 6553 - protein, 11 aa, Mycobacterium tuberculosis
ADTLRGEVARR

SEQ ID NO: 6554 - protein, 11 aa, Mycobacterium tuberculosis
DTLRGEVARRE

SEQ ID NO: 6555 - protein, 11 aa, Mycobacterium tuberculosis
TLRGEVARREM

SEQ ID NO: 6556 - protein, 11 aa, Mycobacterium tuberculosis
LRGEVARREML

SEQ ID NO: 6557 - protein, 11 aa, Mycobacterium tuberculosis
RGEVARREMLL

SEQ ID NO: 6558 - protein, 11 aa, Mycobacterium tuberculosis
GEVARREMLLR

SEQ ID NO: 6559 - protein, 11 aa, Mycobacterium tuberculosis
EVARREMLLRE

SEQ ID NO: 6560 - protein, 11 aa, Mycobacterium tuberculosis
VARREMLLREA

SEQ ID NO: 6561 - protein, 11 aa, Mycobacterium tuberculosis
ARREMLLREAG

SEQ ID NO: 6562 - protein, 11 aa, Mycobacterium tuberculosis
RREMLLREAGR

SEQ ID NO: 6563 - protein, 11 aa, Mycobacterium tuberculosis
REMLLREAGRK

SEQ ID NO: 6564 - protein, 11 aa, Mycobacterium tuberculosis
EMLLREAGRKV

SEQ ID NO: 6565 - protein, 11 aa, Mycobacterium tuberculosis
MLLREAGRKVQ

SEQ ID NO: 6566 - protein, 11 aa, Mycobacterium tuberculosis
LLREAGRKVQG

SEQ ID NO: 6567 - protein, 11 aa, Mycobacterium tuberculosis
LREAGRKVQGS

SEQ ID NO: 6568 - protein, 11 aa, Mycobacterium tuberculosis
REAGRKVQGSA

SEQ ID NO: 6569 - protein, 11 aa, Mycobacterium tuberculosis
EAGRKVQGSAF

SEQ ID NO: 6570 - protein, 11 aa, Mycobacterium tuberculosis
AGRKVQGSAFN

SEQ ID NO: 6571 - protein, 11 aa, Mycobacterium tuberculosis
GRKVQGSAFNS

SEQ ID NO: 6572 - protein, 11 aa, Mycobacterium tuberculosis
RKVQGSAFNSV

SEQ ID NO: 6573 - protein, 11 aa, Mycobacterium tuberculosis
KVQGSAFNSVL

SEQ ID NO: 6574 - protein, 11 aa, Mycobacterium tuberculosis
VQGSAFNSVLE

SEQ ID NO: 6575 - protein, 11 aa, Mycobacterium tuberculosis
QGSAFNSVLEY

SEQ ID NO: 6576 - protein, 11 aa, Mycobacterium tuberculosis
GSAFNSVLEYE

SEQ ID NO: 6577 - protein, 11 aa, Mycobacterium tuberculosis
SAFNSVLEYEN

SEQ ID NO: 6578 - protein, 11 aa, Mycobacterium tuberculosis
AFNSVLEYENA

SEQ ID NO: 6579 - protein, 11 aa, Mycobacterium tuberculosis
FNSVLEYENAI

SEQ ID NO: 6580 - protein, 11 aa, Mycobacterium tuberculosis
NSVLEYENAIA

SEQ ID NO: 6581 - protein, 11 aa, Mycobacterium tuberculosis
SVLEYENAIAA

SEQ ID NO: 6582 - protein, 11 aa, Mycobacterium tuberculosis
VLEYENAIAAG

SEQ ID NO: 6583 - protein, 11 aa, Mycobacterium tuberculosis
LEYENAIAAGH

SEQ ID NO: 6584 - protein, 11 aa, Mycobacterium tuberculosis
EYENAIAAGHS

SEQ ID NO: 6585 - protein, 11 aa, Mycobacterium tuberculosis
YENAIAAGHSL

SEQ ID NO: 6586 - protein, 11 aa, Mycobacterium tuberculosis
ENAIAAGHSLP

SEQ ID NO: 6587 - protein, 11 aa, Mycobacterium tuberculosis
NAIAAGHSLPP

SEQ ID NO: 6588 - protein, 11 aa, Mycobacterium tuberculosis
AIAAGHSLPPI

SEQ ID NO: 6589 - protein, 11 aa, Mycobacterium tuberculosis
IAAGHSLPPIP

SEQ ID NO: 6590 - protein, 11 aa, Mycobacterium tuberculosis
AAGHSLPPIPT

SEQ ID NO: 6591 - protein, 11 aa, Mycobacterium tuberculosis
AGHSLPPIPTL

SEQ ID NO: 6592 - protein, 11 aa, Mycobacterium tuberculosis
GHSLPPIPTLF

SEQ ID NO: 6593 - protein, 11 aa, Mycobacterium tuberculosis
HSLPPIPTLFV

SEQ ID NO: 6594 - protein, 11 aa, Mycobacterium tuberculosis
SLPPIPTLFVV

SEQ ID NO: 6595 - protein, 11 aa, Mycobacterium tuberculosis
LPPIPTLFVVA

SEQ ID NO: 6596 - protein, 11 aa, Mycobacterium tuberculosis
PPIPTLFVVAD

SEQ ID NO: 6597 - protein, 11 aa, Mycobacterium tuberculosis
PIPTLFVVADE

SEQ ID NO: 6598 - protein, 11 aa, Mycobacterium tuberculosis
IPTLFVVADEF

SEQ ID NO: 6599 - protein, 11 aa, Mycobacterium tuberculosis
PTLFVVADEFT

SEQ ID NO: 6600 - protein, 11 aa, Mycobacterium tuberculosis
TLFVVADEFTL

SEQ ID NO: 6601 - protein, 11 aa, Mycobacterium tuberculosis
LFVVADEFTLM

SEQ ID NO: 6602 - protein, 11 aa, Mycobacterium tuberculosis
FVVADEFTLML

SEQ ID NO: 6603 - protein, 11 aa, Mycobacterium tuberculosis
VVADEFTLMLA

SEQ ID NO: 6604 - protein, 11 aa, Mycobacterium tuberculosis
VADEFTLMLAD

SEQ ID NO: 6605 - protein, 11 aa, Mycobacterium tuberculosis
ADEFTLMLADH

SEQ ID NO: 6606 - protein, 11 aa, Mycobacterium tuberculosis
DEFTLMLADHP

SEQ ID NO: 6607 - protein, 11 aa, Mycobacterium tuberculosis
EFTLMLADHPE

SEQ ID NO: 6608 - protein, 11 aa, Mycobacterium tuberculosis
FTLMLADHPEY

SEQ ID NO: 6609 - protein, 11 aa, Mycobacterium tuberculosis
TLMLADHPEYA

SEQ ID NO: 6610 - protein, 11 aa, Mycobacterium tuberculosis
LMLADHPEYAE

SEQ ID NO: 6611 - protein, 11 aa, Mycobacterium tuberculosis
MLADHPEYAEL

SEQ ID NO: 6612 - protein, 11 aa, Mycobacterium tuberculosis
LADHPEYAELF

SEQ ID NO: 6613 - protein, 11 aa, Mycobacterium tuberculosis
ADHPEYAELFD

SEQ ID NO: 6614 - protein, 11 aa, Mycobacterium tuberculosis
DHPEYAELFDY

SEQ ID NO: 6615 - protein, 11 aa, Mycobacterium tuberculosis
HPEYAELFDYV

SEQ ID NO: 6616 - protein, 11 aa, Mycobacterium tuberculosis
PEYAELFDYVA

SEQ ID NO: 6617 - protein, 11 aa, Mycobacterium tuberculosis
EYAELFDYVAR

SEQ ID NO: 6618 - protein, 11 aa, Mycobacterium tuberculosis
YAELFDYVARK

SEQ ID NO: 6619 - protein, 11 aa, Mycobacterium tuberculosis
AELFDYVARKG

SEQ ID NO: 6620 - protein, 11 aa, Mycobacterium tuberculosis
ELFDYVARKGR

SEQ ID NO: 6621 - protein, 11 aa, Mycobacterium tuberculosis
LFDYVARKGRS

SEQ ID NO: 6622 - protein, 11 aa, Mycobacterium tuberculosis
FDYVARKGRSF

SEQ ID NO: 6623 - protein, 11 aa, Mycobacterium tuberculosis
DYVARKGRSFR

SEQ ID NO: 6624 - protein, 11 aa, Mycobacterium tuberculosis
YVARKGRSFRI

SEQ ID NO: 6625 - protein, 11 aa, Mycobacterium tuberculosis
VARKGRSFRIH

SEQ ID NO: 6626 - protein, 11 aa, Mycobacterium tuberculosis
ARKGRSFRIHI

SEQ ID NO: 6627 - protein, 11 aa, Mycobacterium tuberculosis
RKGRSFRIHIL

SEQ ID NO: 6628 - protein, 11 aa, Mycobacterium tuberculosis
KGRSFRIHILF

SEQ ID NO: 6629 - protein, 11 aa, Mycobacterium tuberculosis
GRSFRIHILFA

SEQ ID NO: 6630 - protein, 11 aa, Mycobacterium tuberculosis
RSFRIHILFAS

SEQ ID NO: 6631 - protein, 11 aa, Mycobacterium tuberculosis
SFRIHILFASQ

SEQ ID NO: 6632 - protein, 11 aa, Mycobacterium tuberculosis
FRIHILFASQT

SEQ ID NO: 6633 - protein, 11 aa, Mycobacterium tuberculosis
RIHILFASQTL

SEQ ID NO: 6634 - protein, 11 aa, Mycobacterium tuberculosis
IHILFASQTLD

SEQ ID NO: 6635 - protein, 11 aa, Mycobacterium tuberculosis
HILFASQTLDV

SEQ ID NO: 6636 - protein, 11 aa, Mycobacterium tuberculosis
ILFASQTLDVG

SEQ ID NO: 6637 - protein, 11 aa, Mycobacterium tuberculosis
LFASQTLDVGK

SEQ ID NO: 6638 - protein, 11 aa, Mycobacterium tuberculosis
FASQTLDVGKI

SEQ ID NO: 6639 - protein, 11 aa, Mycobacterium tuberculosis
ASQTLDVGKIK

SEQ ID NO: 6640 - protein, 11 aa, Mycobacterium tuberculosis
SQTLDVGKIKD

SEQ ID NO: 6641 - protein, 11 aa, Mycobacterium tuberculosis
QTLDVGKIKDI

SEQ ID NO: 6642 - protein, 11 aa, Mycobacterium tuberculosis
TLDVGKIKDID

SEQ ID NO: 6643 - protein, 11 aa, Mycobacterium tuberculosis
LDVGKIKDIDK

SEQ ID NO: 6644 - protein, 11 aa, Mycobacterium tuberculosis
DVGKIKDIDKN

SEQ ID NO: 6645 - protein, 11 aa, Mycobacterium tuberculosis
VGKIKDIDKNT

SEQ ID NO: 6646 - protein, 11 aa, Mycobacterium tuberculosis
GKIKDIDKNTA

SEQ ID NO: 6647 - protein, 11 aa, Mycobacterium tuberculosis
KIKDIDKNTAY

SEQ ID NO: 6648 - protein, 11 aa, Mycobacterium tuberculosis
IKDIDKNTAYR

SEQ ID NO: 6649 - protein, 11 aa, Mycobacterium tuberculosis
KDIDKNTAYRI

SEQ ID NO: 6650 - protein, 11 aa, Mycobacterium tuberculosis
DIDKNTAYRIG

SEQ ID NO: 6651 - protein, 11 aa, Mycobacterium tuberculosis
IDKNTAYRIGL

SEQ ID NO: 6652 - protein, 11 aa, Mycobacterium tuberculosis
DKNTAYRIGLK

SEQ ID NO: 6653 - protein, 11 aa, Mycobacterium tuberculosis
KNTAYRIGLKV

SEQ ID NO: 6654 - protein, 11 aa, Mycobacterium tuberculosis
NTAYRIGLKVA

SEQ ID NO: 6655 - protein, 11 aa, Mycobacterium tuberculosis
TAYRIGLKVAS

SEQ ID NO: 6656 - protein, 11 aa, Mycobacterium tuberculosis
AYRIGLKVASP

SEQ ID NO: 6657 - protein, 11 aa, Mycobacterium tuberculosis
YRIGLKVASPS

SEQ ID NO: 6658 - protein, 11 aa, Mycobacterium tuberculosis
RIGLKVASPSV

SEQ ID NO: 6659 - protein, 11 aa, Mycobacterium tuberculosis
IGLKVASPSVS

SEQ ID NO: 6660 - protein, 11 aa, Mycobacterium tuberculosis
GLKVASPSVSR

SEQ ID NO: 6661 - protein, 11 aa, Mycobacterium tuberculosis
LKVASPSVSRQ

SEQ ID NO: 6662 - protein, 11 aa, Mycobacterium tuberculosis
KVASPSVSRQI

SEQ ID NO: 6663 - protein, 11 aa, Mycobacterium tuberculosis
VASPSVSRQII

SEQ ID NO: 6664 - protein, 11 aa, Mycobacterium tuberculosis
ASPSVSRQIIG

SEQ ID NO: 6665 - protein, 11 aa, Mycobacterium tuberculosis
SPSVSRQIIGV

SEQ ID NO: 6666 - protein, 11 aa, Mycobacterium tuberculosis
PSVSRQIIGVE

SEQ ID NO: 6667 - protein, 11 aa, Mycobacterium tuberculosis
SVSRQIIGVED

SEQ ID NO: 6668 - protein, 11 aa, Mycobacterium tuberculosis
VSRQIIGVEDA

SEQ ID NO: 6669 - protein, 11 aa, Mycobacterium tuberculosis
SRQIIGVEDAY

SEQ ID NO: 6670 - protein, 11 aa, Mycobacterium tuberculosis
RQIIGVEDAYH

SEQ ID NO: 6671 - protein, 11 aa, Mycobacterium tuberculosis
QIIGVEDAYHI

SEQ ID NO: 6672 - protein, 11 aa, Mycobacterium tuberculosis
IIGVEDAYHIE

SEQ ID NO: 6673 - protein, 11 aa, Mycobacterium tuberculosis
IGVEDAYHIES

SEQ ID NO: 6674 - protein, 11 aa, Mycobacterium tuberculosis
GVEDAYHIESG

SEQ ID NO: 6675 - protein, 11 aa, Mycobacterium tuberculosis
VEDAYHIESGK

SEQ ID NO: 6676 - protein, 11 aa, Mycobacterium tuberculosis
EDAYHIESGKE

SEQ ID NO: 6677 - protein, 11 aa, Mycobacterium tuberculosis
DAYHIESGKEH

SEQ ID NO: 6678 - protein, 11 aa, Mycobacterium tuberculosis
AYHIESGKEHK

SEQ ID NO: 6679 - protein, 11 aa, Mycobacterium tuberculosis
YHIESGKEHKG

SEQ ID NO: 6680 - protein, 11 aa, Mycobacterium tuberculosis
HIESGKEHKGV

SEQ ID NO: 6681 - protein, 11 aa, Mycobacterium tuberculosis
IESGKEHKGVG

SEQ ID NO: 6682 - protein, 11 aa, Mycobacterium tuberculosis
ESGKEHKGVGF

SEQ ID NO: 6683 - protein, 11 aa, Mycobacterium tuberculosis
SGKEHKGVGFL

SEQ ID NO: 6684 - protein, 11 aa, Mycobacterium tuberculosis
GKEHKGVGFLV

SEQ ID NO: 6685 - protein, 11 aa, Mycobacterium tuberculosis
KEHKGVGFLVP

SEQ ID NO: 6686 - protein, 11 aa, Mycobacterium tuberculosis
EHKGVGFLVPA

SEQ ID NO: 6687 - protein, 11 aa, Mycobacterium tuberculosis
HKGVGFLVPAP

SEQ ID NO: 6688 - protein, 11 aa, Mycobacterium tuberculosis
KGVGFLVPAPG

SEQ ID NO: 6689 - protein, 11 aa, Mycobacterium tuberculosis
GVGFLVPAPGA

SEQ ID NO: 6690 - protein, 11 aa, Mycobacterium tuberculosis
VGFLVPAPGAT

SEQ ID NO: 6691 - protein, 11 aa, Mycobacterium tuberculosis
GFLVPAPGATP

SEQ ID NO: 6692 - protein, 11 aa, Mycobacterium tuberculosis
FLVPAPGATPI

SEQ ID NO: 6693 - protein, 11 aa, Mycobacterium tuberculosis
LVPAPGATPIR

SEQ ID NO: 6694 - protein, 11 aa, Mycobacterium tuberculosis
VPAPGATPIRF

SEQ ID NO: 6695 - protein, 11 aa, Mycobacterium tuberculosis
PAPGATPIRFR

SEQ ID NO: 6696 - protein, 11 aa, Mycobacterium tuberculosis
APGATPIRFRS

SEQ ID NO: 6697 - protein, 11 aa, Mycobacterium tuberculosis
PGATPIRFRST

SEQ ID NO: 6698 - protein, 11 aa, Mycobacterium tuberculosis
GATPIRFRSTY

SEQ ID NO: 6699 - protein, 11 aa, Mycobacterium tuberculosis
ATPIRFRSTYV

SEQ ID NO: 6700 - protein, 11 aa, Mycobacterium tuberculosis
TPIRFRSTYVD

SEQ ID NO: 6701 - protein, 11 aa, Mycobacterium tuberculosis
PIRFRSTYVDG

SEQ ID NO: 6702 - protein, 11 aa, Mycobacterium tuberculosis
IRFRSTYVDGI

SEQ ID NO: 6703 - protein, 11 aa, Mycobacterium tuberculosis
RFRSTYVDGIY

SEQ ID NO: 6704 - protein, 11 aa, Mycobacterium tuberculosis
FRSTYVDGIYE

SEQ ID NO: 6705 - protein, 11 aa, Mycobacterium tuberculosis
RSTYVDGIYEP

SEQ ID NO: 6706 - protein, 11 aa, Mycobacterium tuberculosis
STYVDGIYEPP

SEQ ID NO: 6707 - protein, 11 aa, Mycobacterium tuberculosis
TYVDGIYEPPQ

SEQ ID NO: 6708 - protein, 11 aa, Mycobacterium tuberculosis
YVDGIYEPPQT

SEQ ID NO: 6709 - protein, 11 aa, Mycobacterium tuberculosis
VDGIYEPPQTA

SEQ ID NO: 6710 - protein, 11 aa, Mycobacterium tuberculosis
DGIYEPPQTAK

SEQ ID NO: 6711 - protein, 11 aa, Mycobacterium tuberculosis
GIYEPPQTAKA

SEQ ID NO: 6712 - protein, 11 aa, Mycobacterium tuberculosis
IYEPPQTAKAV

SEQ ID NO: 6713 - protein, 11 aa, Mycobacterium tuberculosis
YEPPQTAKAVV

SEQ ID NO: 6714 - protein, 11 aa, Mycobacterium tuberculosis
EPPQTAKAVVV

SEQ ID NO: 6715 - protein, 11 aa, Mycobacterium tuberculosis
PPQTAKAVVVQ

SEQ ID NO: 6716 - protein, 11 aa, Mycobacterium tuberculosis
PQTAKAVVVQS

SEQ ID NO: 6717 - protein, 11 aa, Mycobacterium tuberculosis
QTAKAVVVQSV

SEQ ID NO: 6718 - protein, 11 aa, Mycobacterium tuberculosis
TAKAVVVQSVP

SEQ ID NO: 6719 - protein, 11 aa, Mycobacterium tuberculosis
AKAVVVQSVPE

SEQ ID NO: 6720 - protein, 11 aa, Mycobacterium tuberculosis
KAVVVQSVPEP

SEQ ID NO: 6721 - protein, 11 aa, Mycobacterium tuberculosis
AVVVQSVPEPK

SEQ ID NO: 6722 - protein, 11 aa, Mycobacterium tuberculosis
VVVQSVPEPKL

SEQ ID NO: 6723 - protein, 11 aa, Mycobacterium tuberculosis
VVQSVPEPKLF

SEQ ID NO: 6724 - protein, 11 aa, Mycobacterium tuberculosis
VQSVPEPKLFT

SEQ ID NO: 6725 - protein, 11 aa, Mycobacterium tuberculosis
QSVPEPKLFTA

SEQ ID NO: 6726 - protein, 11 aa, Mycobacterium tuberculosis
SVPEPKLFTAA

SEQ ID NO: 6727 - protein, 11 aa, Mycobacterium tuberculosis
VPEPKLFTAAA

SEQ ID NO: 6728 - protein, 11 aa, Mycobacterium tuberculosis
PEPKLFTAAAV

SEQ ID NO: 6729 - protein, 11 aa, Mycobacterium tuberculosis
EPKLFTAAAVE

SEQ ID NO: 6730 - protein, 11 aa, Mycobacterium tuberculosis
PKLFTAAAVEP

SEQ ID NO: 6731 - protein, 11 aa, Mycobacterium tuberculosis
KLFTAAAVEPD

SEQ ID NO: 6732 - protein, 11 aa, Mycobacterium tuberculosis
LFTAAAVEPDP

SEQ ID NO: 6733 - protein, 11 aa, Mycobacterium tuberculosis
FTAAAVEPDPG

SEQ ID NO: 6734 - protein, 11 aa, Mycobacterium tuberculosis
TAAAVEPDPGT

SEQ ID NO: 6735 - protein, 11 aa, Mycobacterium tuberculosis
AAAVEPDPGTV

SEQ ID NO: 6736 - protein, 11 aa, Mycobacterium tuberculosis
AAVEPDPGTVI

SEQ ID NO: 6737 - protein, 11 aa, Mycobacterium tuberculosis
AVEPDPGTVIA

SEQ ID NO: 6738 - protein, 11 aa, Mycobacterium tuberculosis
VEPDPGTVIAD

SEQ ID NO: 6739 - protein, 11 aa, Mycobacterium tuberculosis
EPDPGTVIADT

SEQ ID NO: 6740 - protein, 11 aa, Mycobacterium tuberculosis
PDPGTVIADTD

SEQ ID NO: 6741 - protein, 11 aa, Mycobacterium tuberculosis
DPGTVIADTDE

SEQ ID NO: 6742 - protein, 11 aa, Mycobacterium tuberculosis
PGTVIADTDEQ

SEQ ID NO: 6743 - protein, 11 aa, Mycobacterium tuberculosis
GTVIADTDEQE

SEQ ID NO: 6744 - protein, 11 aa, Mycobacterium tuberculosis
TVIADTDEQEP

SEQ ID NO: 6745 - protein, 11 aa, Mycobacterium tuberculosis
VIADTDEQEPA

SEQ ID NO: 6746 - protein, 11 aa, Mycobacterium tuberculosis
IADTDEQEPAD

SEQ ID NO: 6747 - protein, 11 aa, Mycobacterium tuberculosis
ADTDEQEPADP

SEQ ID NO: 6748 - protein, 11 aa, Mycobacterium tuberculosis
DTDEQEPADPP

SEQ ID NO: 6749 - protein, 11 aa, Mycobacterium tuberculosis
TDEQEPADPPR

SEQ ID NO: 6750 - protein, 11 aa, Mycobacterium tuberculosis
DEQEPADPPRK

SEQ ID NO: 6751 - protein, 11 aa, Mycobacterium tuberculosis
EQEPADPPRKL

SEQ ID NO: 6752 - protein, 11 aa, Mycobacterium tuberculosis
QEPADPPRKLI

SEQ ID NO: 6753 - protein, 11 aa, Mycobacterium tuberculosis
EPADPPRKLIA

SEQ ID NO: 6754 - protein, 11 aa, Mycobacterium tuberculosis
PADPPRKLIAT

SEQ ID NO: 6755 - protein, 11 aa, Mycobacterium tuberculosis
ADPPRKLIATI

SEQ ID NO: 6756 - protein, 11 aa, Mycobacterium tuberculosis
DPPRKLIATIG

SEQ ID NO: 6757 - protein, 11 aa, Mycobacterium tuberculosis
PPRKLIATIGE

SEQ ID NO: 6758 - protein, 11 aa, Mycobacterium tuberculosis
PRKLIATIGEQ

SEQ ID NO: 6759 - protein, 11 aa, Mycobacterium tuberculosis
RKLIATIGEQL

SEQ ID NO: 6760 - protein, 11 aa, Mycobacterium tuberculosis
KLIATIGEQLA

SEQ ID NO: 6761 - protein, 11 aa, Mycobacterium tuberculosis
LIATIGEQLAR

SEQ ID NO: 6762 - protein, 11 aa, Mycobacterium tuberculosis
IATIGEQLARY

SEQ ID NO: 6763 - protein, 11 aa, Mycobacterium tuberculosis
ATIGEQLARYG

SEQ ID NO: 6764 - protein, 11 aa, Mycobacterium tuberculosis
TIGEQLARYGP

SEQ ID NO: 6765 - protein, 11 aa, Mycobacterium tuberculosis
IGEQLARYGPR

SEQ ID NO: 6766 - protein, 11 aa, Mycobacterium tuberculosis
GEQLARYGPRA

SEQ ID NO: 6767 - protein, 11 aa, Mycobacterium tuberculosis
EQLARYGPRAP

SEQ ID NO: 6768 - protein, 11 aa, Mycobacterium tuberculosis
QLARYGPRAPQ

SEQ ID NO: 6769 - protein, 11 aa, Mycobacterium tuberculosis
LARYGPRAPQL

SEQ ID NO: 6770 - protein, 11 aa, Mycobacterium tuberculosis
ARYGPRAPQLW

SEQ ID NO: 6771 - protein, 11 aa, Mycobacterium tuberculosis
RYGPRAPQLWL

SEQ ID NO: 6772 - protein, 11 aa, Mycobacterium tuberculosis
YGPRAPQLWLP

SEQ ID NO: 6773 - protein, 11 aa, Mycobacterium tuberculosis
GPRAPQLWLPP

SEQ ID NO: 6774 - protein, 11 aa, Mycobacterium tuberculosis
PRAPQLWLPPL

SEQ ID NO: 6775 - protein, 11 aa, Mycobacterium tuberculosis
RAPQLWLPPLD

SEQ ID NO: 6776 - protein, 11 aa, Mycobacterium tuberculosis
APQLWLPPLDE

SEQ ID NO: 6777 - protein, 11 aa, Mycobacterium tuberculosis
PQLWLPPLDET

SEQ ID NO: 6778 - protein, 11 aa, Mycobacterium tuberculosis
QLWLPPLDETI

SEQ ID NO: 6779 - protein, 11 aa, Mycobacterium tuberculosis
LWLPPLDETIP

SEQ ID NO: 6780 - protein, 11 aa, Mycobacterium tuberculosis
WLPPLDETIPL

SEQ ID NO: 6781 - protein, 11 aa, Mycobacterium tuberculosis
LPPLDETIPLS

SEQ ID NO: 6782 - protein, 11 aa, Mycobacterium tuberculosis
PPLDETIPLSA

SEQ ID NO: 6783 - protein, 11 aa, Mycobacterium tuberculosis
PLDETIPLSAA

SEQ ID NO: 6784 - protein, 11 aa, Mycobacterium tuberculosis
LDETIPLSAAL

SEQ ID NO: 6785 - protein, 11 aa, Mycobacterium tuberculosis
DETIPLSAALA

SEQ ID NO: 6786 - protein, 11 aa, Mycobacterium tuberculosis
ETIPLSAALAR

SEQ ID NO: 6787 - protein, 11 aa, Mycobacterium tuberculosis
TIPLSAALARA

SEQ ID NO: 6788 - protein, 11 aa, Mycobacterium tuberculosis
IPLSAALARAG

SEQ ID NO: 6789 - protein, 11 aa, Mycobacterium tuberculosis
PLSAALARAGV

SEQ ID NO: 6790 - protein, 11 aa, Mycobacterium tuberculosis
LSAALARAGVG

SEQ ID NO: 6791 - protein, 11 aa, Mycobacterium tuberculosis
SAALARAGVGP

SEQ ID NO: 6792 - protein, 11 aa, Mycobacterium tuberculosis
AALARAGVGPR

SEQ ID NO: 6793 - protein, 11 aa, Mycobacterium tuberculosis
ALARAGVGPRQ

SEQ ID NO: 6794 - protein, 11 aa, Mycobacterium tuberculosis
LARAGVGPRQW

SEQ ID NO: 6795 - protein, 11 aa, Mycobacterium tuberculosis
ARAGVGPRQWR

SEQ ID NO: 6796 - protein, 11 aa, Mycobacterium tuberculosis
RAGVGPRQWRW

SEQ ID NO: 6797 - protein, 11 aa, Mycobacterium tuberculosis
AGVGPRQWRWP

SEQ ID NO: 6798 - protein, 11 aa, Mycobacterium tuberculosis
GVGPRQWRWPL

SEQ ID NO: 6799 - protein, 11 aa, Mycobacterium tuberculosis
VGPRQWRWPLG

SEQ ID NO: 6800 - protein, 11 aa, Mycobacterium tuberculosis
GPRQWRWPLGE

SEQ ID NO: 6801 - protein, 11 aa, Mycobacterium tuberculosis
PRQWRWPLGEI

SEQ ID NO: 6802 - protein, 11 aa, Mycobacterium tuberculosis
RQWRWPLGEID

SEQ ID NO: 6803 - protein, 11 aa, Mycobacterium tuberculosis
QWRWPLGEIDR

SEQ ID NO: 6804 - protein, 11 aa, Mycobacterium tuberculosis
WRWPLGEIDRP

SEQ ID NO: 6805 - protein, 11 aa, Mycobacterium tuberculosis
RWPLGEIDRPF

SEQ ID NO: 6806 - protein, 11 aa, Mycobacterium tuberculosis
WPLGEIDRPFE

SEQ ID NO: 6807 - protein, 11 aa, Mycobacterium tuberculosis
PLGEIDRPFEM

SEQ ID NO: 6808 - protein, 11 aa, Mycobacterium tuberculosis
LGEIDRPFEMR

SEQ ID NO: 6809 - protein, 11 aa, Mycobacterium tuberculosis
GEIDRPFEMRR

SEQ ID NO: 6810 - protein, 11 aa, Mycobacterium tuberculosis
EIDRPFEMRRD

SEQ ID NO: 6811 - protein, 11 aa, Mycobacterium tuberculosis
IDRPFEMRRDP

SEQ ID NO: 6812 - protein, 11 aa, Mycobacterium tuberculosis
DRPFEMRRDPL

SEQ ID NO: 6813 - protein, 11 aa, Mycobacterium tuberculosis
RPFEMRRDPLV

SEQ ID NO: 6814 - protein, 11 aa, Mycobacterium tuberculosis
PFEMRRDPLVF

SEQ ID NO: 6815 - protein, 11 aa, Mycobacterium tuberculosis
FEMRRDPLVFD

SEQ ID NO: 6816 - protein, 11 aa, Mycobacterium tuberculosis
EMRRDPLVFDA

SEQ ID NO: 6817 - protein, 11 aa, Mycobacterium tuberculosis
MRRDPLVFDAR

SEQ ID NO: 6818 - protein, 11 aa, Mycobacterium tuberculosis
RRDPLVFDARS

SEQ ID NO: 6819 - protein, 11 aa, Mycobacterium tuberculosis
RDPLVFDARSS

SEQ ID NO: 6820 - protein, 11 aa, Mycobacterium tuberculosis
DPLVFDARSSA

SEQ ID NO: 6821 - protein, 11 aa, Mycobacterium tuberculosis
PLVFDARSSAG

SEQ ID NO: 6822 - protein, 11 aa, Mycobacterium tuberculosis
LVFDARSSAGN

SEQ ID NO: 6823 - protein, 11 aa, Mycobacterium tuberculosis
VFDARSSAGNM

SEQ ID NO: 6824 - protein, 11 aa, Mycobacterium tuberculosis
FDARSSAGNMV

SEQ ID NO: 6825 - protein, 11 aa, Mycobacterium tuberculosis
DARSSAGNMVI

SEQ ID NO: 6826 - protein, 11 aa, Mycobacterium tuberculosis
ARSSAGNMVIH

SEQ ID NO: 6827 - protein, 11 aa, Mycobacterium tuberculosis
RSSAGNMVIHG

SEQ ID NO: 6828 - protein, 11 aa, Mycobacterium tuberculosis
SSAGNMVIHGG

SEQ ID NO: 6829 - protein, 11 aa, Mycobacterium tuberculosis
SAGNMVIHGGP

SEQ ID NO: 6830 - protein, 11 aa, Mycobacterium tuberculosis
AGNMVIHGGPK

SEQ ID NO: 6831 - protein, 11 aa, Mycobacterium tuberculosis
GNMVIHGGPKS

SEQ ID NO: 6832 - protein, 11 aa, Mycobacterium tuberculosis
NMVIHGGPKSG

SEQ ID NO: 6833 - protein, 11 aa, Mycobacterium tuberculosis
MVIHGGPKSGK

SEQ ID NO: 6834 - protein, 11 aa, Mycobacterium tuberculosis
VIHGGPKSGKS

SEQ ID NO: 6835 - protein, 11 aa, Mycobacterium tuberculosis
IHGGPKSGKST

SEQ ID NO: 6836 - protein, 11 aa, Mycobacterium tuberculosis
HGGPKSGKSTA

SEQ ID NO: 6837 - protein, 11 aa, Mycobacterium tuberculosis
GGPKSGKSTAL

SEQ ID NO: 6838 - protein, 11 aa, Mycobacterium tuberculosis
GPKSGKSTALQ

SEQ ID NO: 6839 - protein, 11 aa, Mycobacterium tuberculosis
PKSGKSTALQT

SEQ ID NO: 6840 - protein, 11 aa, Mycobacterium tuberculosis
KSGKSTALQTF

SEQ ID NO: 6841 - protein, 11 aa, Mycobacterium tuberculosis
SGKSTALQTFI

SEQ ID NO: 6842 - protein, 11 aa, Mycobacterium tuberculosis
GKSTALQTFIL

SEQ ID NO: 6843 - protein, 11 aa, Mycobacterium tuberculosis
KSTALQTFILS

SEQ ID NO: 6844 - protein, 11 aa, Mycobacterium tuberculosis
STALQTFILSA

SEQ ID NO: 6845 - protein, 11 aa, Mycobacterium tuberculosis
TALQTFILSAA

SEQ ID NO: 6846 - protein, 11 aa, Mycobacterium tuberculosis
ALQTFILSAAS

SEQ ID NO: 6847 - protein, 11 aa, Mycobacterium tuberculosis
LQTFILSAASL

SEQ ID NO: 6848 - protein, 11 aa, Mycobacterium tuberculosis
QTFILSAASLH

SEQ ID NO: 6849 - protein, 11 aa, Mycobacterium tuberculosis
TFILSAASLHS

SEQ ID NO: 6850 - protein, 11 aa, Mycobacterium tuberculosis
FILSAASLHSP

SEQ ID NO: 6851 - protein, 11 aa, Mycobacterium tuberculosis
ILSAASLHSPH

SEQ ID NO: 6852 - protein, 11 aa, Mycobacterium tuberculosis
LSAASLHSPHE

SEQ ID NO: 6853 - protein, 11 aa, Mycobacterium tuberculosis
SAASLHSPHEV

SEQ ID NO: 6854 - protein, 11 aa, Mycobacterium tuberculosis
AASLHSPHEVS

SEQ ID NO: 6855 - protein, 11 aa, Mycobacterium tuberculosis
ASLHSPHEVSF

SEQ ID NO: 6856 - protein, 11 aa, Mycobacterium tuberculosis
SLHSPHEVSFY

SEQ ID NO: 6857 - protein, 11 aa, Mycobacterium tuberculosis
LHSPHEVSFYC

SEQ ID NO: 6858 - protein, 11 aa, Mycobacterium tuberculosis
HSPHEVSFYCL

SEQ ID NO: 6859 - protein, 11 aa, Mycobacterium tuberculosis
SPHEVSFYCLD

SEQ ID NO: 6860 - protein, 11 aa, Mycobacterium tuberculosis
PHEVSFYCLDY

SEQ ID NO: 6861 - protein, 11 aa, Mycobacterium tuberculosis
HEVSFYCLDYG

SEQ ID NO: 6862 - protein, 11 aa, Mycobacterium tuberculosis
EVSFYCLDYGG

SEQ ID NO: 6863 - protein, 11 aa, Mycobacterium tuberculosis
VSFYCLDYGGG

SEQ ID NO: 6864 - protein, 11 aa, Mycobacterium tuberculosis
SFYCLDYGGGQ

SEQ ID NO: 6865 - protein, 11 aa, Mycobacterium tuberculosis
FYCLDYGGGQL

SEQ ID NO: 6866 - protein, 11 aa, Mycobacterium tuberculosis
YCLDYGGGQLR

SEQ ID NO: 6867 - protein, 11 aa, Mycobacterium tuberculosis
CLDYGGGQLRA

SEQ ID NO: 6868 - protein, 11 aa, Mycobacterium tuberculosis
LDYGGGQLRAL

SEQ ID NO: 6869 - protein, 11 aa, Mycobacterium tuberculosis
DYGGGQLRALQ

SEQ ID NO: 6870 - protein, 11 aa, Mycobacterium tuberculosis
YGGGQLRALQD

SEQ ID NO: 6871 - protein, 11 aa, Mycobacterium tuberculosis
GGGQLRALQDL

SEQ ID NO: 6872 - protein, 11 aa, Mycobacterium tuberculosis
GGQLRALQDLA

SEQ ID NO: 6873 - protein, 11 aa, Mycobacterium tuberculosis
GQLRALQDLAH

SEQ ID NO: 6874 - protein, 11 aa, Mycobacterium tuberculosis
QLRALQDLAHV

SEQ ID NO: 6875 - protein, 11 aa, Mycobacterium tuberculosis
LRALQDLAHVG

SEQ ID NO: 6876 - protein, 11 aa, Mycobacterium tuberculosis
RALQDLAHVGS

SEQ ID NO: 6877 - protein, 11 aa, Mycobacterium tuberculosis
ALQDLAHVGSV

SEQ ID NO: 6878 - protein, 11 aa, Mycobacterium tuberculosis
LQDLAHVGSVA

SEQ ID NO: 6879 - protein, 11 aa, Mycobacterium tuberculosis
QDLAHVGSVAS

SEQ ID NO: 6880 - protein, 11 aa, Mycobacterium tuberculosis
DLAHVGSVASA

SEQ ID NO: 6881 - protein, 11 aa, Mycobacterium tuberculosis
LAHVGSVASAL

SEQ ID NO: 6882 - protein, 11 aa, Mycobacterium tuberculosis
AHVGSVASALE

SEQ ID NO: 6883 - protein, 11 aa, Mycobacterium tuberculosis
HVGSVASALEP

SEQ ID NO: 6884 - protein, 11 aa, Mycobacterium tuberculosis
VGSVASALEPE

SEQ ID NO: 6885 - protein, 11 aa, Mycobacterium tuberculosis
GSVASALEPER

SEQ ID NO: 6886 - protein, 11 aa, Mycobacterium tuberculosis
SVASALEPERI

SEQ ID NO: 6887 - protein, 11 aa, Mycobacterium tuberculosis
VASALEPERIR

SEQ ID NO: 6888 - protein, 11 aa, Mycobacterium tuberculosis
ASALEPERIRR

SEQ ID NO: 6889 - protein, 11 aa, Mycobacterium tuberculosis
SALEPERIRRT

SEQ ID NO: 6890 - protein, 11 aa, Mycobacterium tuberculosis
ALEPERIRRTF

SEQ ID NO: 6891 - protein, 11 aa, Mycobacterium tuberculosis
LEPERIRRTFG

SEQ ID NO: 6892 - protein, 11 aa, Mycobacterium tuberculosis
EPERIRRTFGE

SEQ ID NO: 6893 - protein, 11 aa, Mycobacterium tuberculosis
PERIRRTFGEL

SEQ ID NO: 6894 - protein, 11 aa, Mycobacterium tuberculosis
ERIRRTFGELE

SEQ ID NO: 6895 - protein, 11 aa, Mycobacterium tuberculosis
RIRRTFGELEQ

SEQ ID NO: 6896 - protein, 11 aa, Mycobacterium tuberculosis
IRRTFGELEQL

SEQ ID NO: 6897 - protein, 11 aa, Mycobacterium tuberculosis
RRTFGELEQLL

SEQ ID NO: 6898 - protein, 11 aa, Mycobacterium tuberculosis
RTFGELEQLLL

SEQ ID NO: 6899 - protein, 11 aa, Mycobacterium tuberculosis
TFGELEQLLLS

SEQ ID NO: 6900 - protein, 11 aa, Mycobacterium tuberculosis
FGELEQLLLSR

SEQ ID NO: 6901 - protein, 11 aa, Mycobacterium tuberculosis
GELEQLLLSRQ

SEQ ID NO: 6902 - protein, 11 aa, Mycobacterium tuberculosis
ELEQLLLSRQQ

SEQ ID NO: 6903 - protein, 11 aa, Mycobacterium tuberculosis
LEQLLLSRQQR

SEQ ID NO: 6904 - protein, 11 aa, Mycobacterium tuberculosis
EQLLLSRQQRE

SEQ ID NO: 6905 - protein, 11 aa, Mycobacterium tuberculosis
QLLLSRQQREV

SEQ ID NO: 6906 - protein, 11 aa, Mycobacterium tuberculosis
LLLSRQQREVF

SEQ ID NO: 6907 - protein, 11 aa, Mycobacterium tuberculosis
LLSRQQREVFR

SEQ ID NO: 6908 - protein, 11 aa, Mycobacterium tuberculosis
LSRQQREVFRD

SEQ ID NO: 6909 - protein, 11 aa, Mycobacterium tuberculosis
SRQQREVFRDR

SEQ ID NO: 6910 - protein, 11 aa, Mycobacterium tuberculosis
RQQREVFRDRG

SEQ ID NO: 6911 - protein, 11 aa, Mycobacterium tuberculosis
QQREVFRDRGA

SEQ ID NO: 6912 - protein, 11 aa, Mycobacterium tuberculosis
QREVFRDRGAN

SEQ ID NO: 6913 - protein, 11 aa, Mycobacterium tuberculosis
REVFRDRGANG

SEQ ID NO: 6914 - protein, 11 aa, Mycobacterium tuberculosis
EVFRDRGANGS

SEQ ID NO: 6915 - protein, 11 aa, Mycobacterium tuberculosis
VFRDRGANGST

SEQ ID NO: 6916 - protein, 11 aa, Mycobacterium tuberculosis
FRDRGANGSTP

SEQ ID NO: 6917 - protein, 11 aa, Mycobacterium tuberculosis
RDRGANGSTPD

SEQ ID NO: 6918 - protein, 11 aa, Mycobacterium tuberculosis
DRGANGSTPDD

SEQ ID NO: 6919 - protein, 11 aa, Mycobacterium tuberculosis
RGANGSTPDDG

SEQ ID NO: 6920 - protein, 11 aa, Mycobacterium tuberculosis
GANGSTPDDGF

SEQ ID NO: 6921 - protein, 11 aa, Mycobacterium tuberculosis
ANGSTPDDGFG

SEQ ID NO: 6922 - protein, 11 aa, Mycobacterium tuberculosis
NGSTPDDGFGE

SEQ ID NO: 6923 - protein, 11 aa, Mycobacterium tuberculosis
GSTPDDGFGEV

SEQ ID NO: 6924 - protein, 11 aa, Mycobacterium tuberculosis
STPDDGFGEVF

SEQ ID NO: 6925 - protein, 11 aa, Mycobacterium tuberculosis
TPDDGFGEVFL

SEQ ID NO: 6926 - protein, 11 aa, Mycobacterium tuberculosis
PDDGFGEVFLV

SEQ ID NO: 6927 - protein, 11 aa, Mycobacterium tuberculosis
DDGFGEVFLVI

SEQ ID NO: 6928 - protein, 11 aa, Mycobacterium tuberculosis
DGFGEVFLVID

SEQ ID NO: 6929 - protein, 11 aa, Mycobacterium tuberculosis
GFGEVFLVIDN

SEQ ID NO: 6930 - protein, 11 aa, Mycobacterium tuberculosis
FGEVFLVIDNL

SEQ ID NO: 6931 - protein, 11 aa, Mycobacterium tuberculosis
GEVFLVIDNLY

SEQ ID NO: 6932 - protein, 11 aa, Mycobacterium tuberculosis
EVFLVIDNLYG

SEQ ID NO: 6933 - protein, 11 aa, Mycobacterium tuberculosis
VFLVIDNLYGF

SEQ ID NO: 6934 - protein, 11 aa, Mycobacterium tuberculosis
FLVIDNLYGFG

SEQ ID NO: 6935 - protein, 11 aa, Mycobacterium tuberculosis
LVIDNLYGFGR

SEQ ID NO: 6936 - protein, 11 aa, Mycobacterium tuberculosis
VIDNLYGFGRD

SEQ ID NO: 6937 - protein, 11 aa, Mycobacterium tuberculosis
IDNLYGFGRDN

SEQ ID NO: 6938 - protein, 11 aa, Mycobacterium tuberculosis
DNLYGFGRDNT

SEQ ID NO: 6939 - protein, 11 aa, Mycobacterium tuberculosis
NLYGFGRDNTD

SEQ ID NO: 6940 - protein, 11 aa, Mycobacterium tuberculosis
LYGFGRDNTDQ

SEQ ID NO: 6941 - protein, 11 aa, Mycobacterium tuberculosis
YGFGRDNTDQF

SEQ ID NO: 6942 - protein, 11 aa, Mycobacterium tuberculosis
GFGRDNTDQFN

SEQ ID NO: 6943 - protein, 11 aa, Mycobacterium tuberculosis
FGRDNTDQFNT

SEQ ID NO: 6944 - protein, 11 aa, Mycobacterium tuberculosis
GRDNTDQFNTR

SEQ ID NO: 6945 - protein, 11 aa, Mycobacterium tuberculosis
RDNTDQFNTRN

SEQ ID NO: 6946 - protein, 11 aa, Mycobacterium tuberculosis
DNTDQFNTRNP

SEQ ID NO: 6947 - protein, 11 aa, Mycobacterium tuberculosis
NTDQFNTRNPL

SEQ ID NO: 6948 - protein, 11 aa, Mycobacterium tuberculosis
TDQFNTRNPLL

SEQ ID NO: 6949 - protein, 11 aa, Mycobacterium tuberculosis
DQFNTRNPLLA

SEQ ID NO: 6950 - protein, 11 aa, Mycobacterium tuberculosis
QFNTRNPLLAR

SEQ ID NO: 6951 - protein, 11 aa, Mycobacterium tuberculosis
FNTRNPLLARV

SEQ ID NO: 6952 - protein, 11 aa, Mycobacterium tuberculosis
NTRNPLLARVT

SEQ ID NO: 6953 - protein, 11 aa, Mycobacterium tuberculosis
TRNPLLARVTE

SEQ ID NO: 6954 - protein, 11 aa, Mycobacterium tuberculosis
RNPLLARVTEL

SEQ ID NO: 6955 - protein, 11 aa, Mycobacterium tuberculosis
NPLLARVTELV

SEQ ID NO: 6956 - protein, 11 aa, Mycobacterium tuberculosis
PLLARVTELVN

SEQ ID NO: 6957 - protein, 11 aa, Mycobacterium tuberculosis
LLARVTELVNV

SEQ ID NO: 6958 - protein, 11 aa, Mycobacterium tuberculosis
LARVTELVNVG

SEQ ID NO: 6959 - protein, 11 aa, Mycobacterium tuberculosis
ARVTELVNVGL

SEQ ID NO: 6960 - protein, 11 aa, Mycobacterium tuberculosis
RVTELVNVGLA

SEQ ID NO: 6961 - protein, 11 aa, Mycobacterium tuberculosis
VTELVNVGLAY

SEQ ID NO: 6962 - protein, 11 aa, Mycobacterium tuberculosis
TELVNVGLAYG

SEQ ID NO: 6963 - protein, 11 aa, Mycobacterium tuberculosis
ELVNVGLAYGI

SEQ ID NO: 6964 - protein, 11 aa, Mycobacterium tuberculosis
LVNVGLAYGIH

SEQ ID NO: 6965 - protein, 11 aa, Mycobacterium tuberculosis
VNVGLAYGIHV

SEQ ID NO: 6966 - protein, 11 aa, Mycobacterium tuberculosis
NVGLAYGIHVI

SEQ ID NO: 6967 - protein, 11 aa, Mycobacterium tuberculosis
VGLAYGIHVII

SEQ ID NO: 6968 - protein, 11 aa, Mycobacterium tuberculosis
GLAYGIHVIIT

SEQ ID NO: 6969 - protein, 11 aa, Mycobacterium tuberculosis
LAYGIHVIITT

SEQ ID NO: 6970 - protein, 11 aa, Mycobacterium tuberculosis
AYGIHVIITTP

SEQ ID NO: 6971 - protein, 11 aa, Mycobacterium tuberculosis
YGIHVIITTPS

SEQ ID NO: 6972 - protein, 11 aa, Mycobacterium tuberculosis
GIHVIITTPSW

SEQ ID NO: 6973 - protein, 11 aa, Mycobacterium tuberculosis
IHVIITTPSWL

SEQ ID NO: 6974 - protein, 11 aa, Mycobacterium tuberculosis
HVIITTPSWLE

SEQ ID NO: 6975 - protein, 11 aa, Mycobacterium tuberculosis
VIITTPSWLEV

SEQ ID NO: 6976 - protein, 11 aa, Mycobacterium tuberculosis
IITTPSWLEVP

SEQ ID NO: 6977 - protein, 11 aa, Mycobacterium tuberculosis
ITTPSWLEVPL

SEQ ID NO: 6978 - protein, 11 aa, Mycobacterium tuberculosis
TTPSWLEVPLA

SEQ ID NO: 6979 - protein, 11 aa, Mycobacterium tuberculosis
TPSWLEVPLAM

SEQ ID NO: 6980 - protein, 11 aa, Mycobacterium tuberculosis
PSWLEVPLAMR

SEQ ID NO: 6981 - protein, 11 aa, Mycobacterium tuberculosis
SWLEVPLAMRD

SEQ ID NO: 6982 - protein, 11 aa, Mycobacterium tuberculosis
WLEVPLAMRDG

SEQ ID NO: 6983 - protein, 11 aa, Mycobacterium tuberculosis
LEVPLAMRDGL

SEQ ID NO: 6984 - protein, 11 aa, Mycobacterium tuberculosis
EVPLAMRDGLG

SEQ ID NO: 6985 - protein, 11 aa, Mycobacterium tuberculosis
VPLAMRDGLGL

SEQ ID NO: 6986 - protein, 11 aa, Mycobacterium tuberculosis
PLAMRDGLGLR

SEQ ID NO: 6987 - protein, 11 aa, Mycobacterium tuberculosis
LAMRDGLGLRL

SEQ ID NO: 6988 - protein, 11 aa, Mycobacterium tuberculosis
AMRDGLGLRLE

SEQ ID NO: 6989 - protein, 11 aa, Mycobacterium tuberculosis
MRDGLGLRLEL

SEQ ID NO: 6990 - protein, 11 aa, Mycobacterium tuberculosis
RDGLGLRLELR

SEQ ID NO: 6991 - protein, 11 aa, Mycobacterium tuberculosis
DGLGLRLELRL

SEQ ID NO: 6992 - protein, 11 aa, Mycobacterium tuberculosis
GLGLRLELRLH

SEQ ID NO: 6993 - protein, 11 aa, Mycobacterium tuberculosis
LGLRLELRLHD

SEQ ID NO: 6994 - protein, 11 aa, Mycobacterium tuberculosis
GLRLELRLHDA

SEQ ID NO: 6995 - protein, 11 aa, Mycobacterium tuberculosis
LRLELRLHDAR

SEQ ID NO: 6996 - protein, 11 aa, Mycobacterium tuberculosis
RLELRLHDARD

SEQ ID NO: 6997 - protein, 11 aa, Mycobacterium tuberculosis
LELRLHDARDS

SEQ ID NO: 6998 - protein, 11 aa, Mycobacterium tuberculosis
ELRLHDARDSN

SEQ ID NO: 6999 - protein, 11 aa, Mycobacterium tuberculosis
LRLHDARDSNV

SEQ ID NO: 7000 - protein, 11 aa, Mycobacterium tuberculosis
RLHDARDSNVR

SEQ ID NO: 7001 - protein, 11 aa, Mycobacterium tuberculosis
LHDARDSNVRV

SEQ ID NO: 7002 - protein, 11 aa, Mycobacterium tuberculosis
HDARDSNVRVV

SEQ ID NO: 7003 - protein, 11 aa, Mycobacterium tuberculosis
DARDSNVRVVG

SEQ ID NO: 7004 - protein, 11 aa, Mycobacterium tuberculosis
ARDSNVRVVGA

SEQ ID NO: 7005 - protein, 11 aa, Mycobacterium tuberculosis
RDSNVRVVGAL

SEQ ID NO: 7006 - protein, 11 aa, Mycobacterium tuberculosis
DSNVRVVGALR

SEQ ID NO: 7007 - protein, 11 aa, Mycobacterium tuberculosis
SNVRVVGALRR

SEQ ID NO: 7008 - protein, 11 aa, Mycobacterium tuberculosis
NVRVVGALRRP

SEQ ID NO: 7009 - protein, 11 aa, Mycobacterium tuberculosis
VRVVGALRRPA

SEQ ID NO: 7010 - protein, 11 aa, Mycobacterium tuberculosis
RVVGALRRPAD

SEQ ID NO: 7011 - protein, 11 aa, Mycobacterium tuberculosis
VVGALRRPADA

SEQ ID NO: 7012 - protein, 11 aa, Mycobacterium tuberculosis
VGALRRPADAV

SEQ ID NO: 7013 - protein, 11 aa, Mycobacterium tuberculosis
GALRRPADAVP

SEQ ID NO: 7014 - protein, 11 aa, Mycobacterium tuberculosis
ALRRPADAVPH

SEQ ID NO: 7015 - protein, 11 aa, Mycobacterium tuberculosis
LRRPADAVPHD

SEQ ID NO: 7016 - protein, 11 aa, Mycobacterium tuberculosis
RRPADAVPHDQ

SEQ ID NO: 7017 - protein, 11 aa, Mycobacterium tuberculosis
RPADAVPHDQP

SEQ ID NO: 7018 - protein, 11 aa, Mycobacterium tuberculosis
PADAVPHDQPG

SEQ ID NO: 7019 - protein, 11 aa, Mycobacterium tuberculosis
ADAVPHDQPGR

SEQ ID NO: 7020 - protein, 11 aa, Mycobacterium tuberculosis
DAVPHDQPGRG

SEQ ID NO: 7021 - protein, 11 aa, Mycobacterium tuberculosis
AVPHDQPGRGL

SEQ ID NO: 7022 - protein, 11 aa, Mycobacterium tuberculosis
VPHDQPGRGLT

SEQ ID NO: 7023 - protein, 11 aa, Mycobacterium tuberculosis
PHDQPGRGLTM

SEQ ID NO: 7024 - protein, 11 aa, Mycobacterium tuberculosis
HDQPGRGLTMA

SEQ ID NO: 7025 - protein, 11 aa, Mycobacterium tuberculosis
DQPGRGLTMAA

SEQ ID NO: 7026 - protein, 11 aa, Mycobacterium tuberculosis
QPGRGLTMAAE

SEQ ID NO: 7027 - protein, 11 aa, Mycobacterium tuberculosis
PGRGLTMAAEH

SEQ ID NO: 7028 - protein, 11 aa, Mycobacterium tuberculosis
GRGLTMAAEHF

SEQ ID NO: 7029 - protein, 11 aa, Mycobacterium tuberculosis
RGLTMAAEHFL

SEQ ID NO: 7030 - protein, 11 aa, Mycobacterium tuberculosis
GLTMAAEHFLF

SEQ ID NO: 7031 - protein, 11 aa, Mycobacterium tuberculosis
LTMAAEHFLFA

SEQ ID NO: 7032 - protein, 11 aa, Mycobacterium tuberculosis
TMAAEHFLFAA

SEQ ID NO: 7033 - protein, 11 aa, Mycobacterium tuberculosis
MAAEHFLFAAP

SEQ ID NO: 7034 - protein, 11 aa, Mycobacterium tuberculosis
AAEHFLFAAPE

SEQ ID NO: 7035 - protein, 11 aa, Mycobacterium tuberculosis
AEHFLFAAPEL

SEQ ID NO: 7036 - protein, 11 aa, Mycobacterium tuberculosis
EHFLFAAPELD

SEQ ID NO: 7037 - protein, 11 aa, Mycobacterium tuberculosis
HFLFAAPELDA

SEQ ID NO: 7038 - protein, 11 aa, Mycobacterium tuberculosis
FLFAAPELDAQ

SEQ ID NO: 7039 - protein, 11 aa, Mycobacterium tuberculosis
LFAAPELDAQT

SEQ ID NO: 7040 - protein, 11 aa, Mycobacterium tuberculosis
FAAPELDAQTN

SEQ ID NO: 7041 - protein, 11 aa, Mycobacterium tuberculosis
AAPELDAQTNP

SEQ ID NO: 7042 - protein, 11 aa, Mycobacterium tuberculosis
APELDAQTNPV

SEQ ID NO: 7043 - protein, 11 aa, Mycobacterium tuberculosis
PELDAQTNPVA

SEQ ID NO: 7044 - protein, 11 aa, Mycobacterium tuberculosis
ELDAQTNPVAA

SEQ ID NO: 7045 - protein, 11 aa, Mycobacterium tuberculosis
LDAQTNPVAAI

SEQ ID NO: 7046 - protein, 11 aa, Mycobacterium tuberculosis
DAQTNPVAAIN

SEQ ID NO: 7047 - protein, 11 aa, Mycobacterium tuberculosis
AQTNPVAAINA

SEQ ID NO: 7048 - protein, 11 aa, Mycobacterium tuberculosis
QTNPVAAINAR

SEQ ID NO: 7049 - protein, 11 aa, Mycobacterium tuberculosis
TNPVAAINARY

SEQ ID NO: 7050 - protein, 11 aa, Mycobacterium tuberculosis
NPVAAINARYP

SEQ ID NO: 7051 - protein, 11 aa, Mycobacterium tuberculosis
PVAAINARYPG

SEQ ID NO: 7052 - protein, 11 aa, Mycobacterium tuberculosis
VAAINARYPGM

SEQ ID NO: 7053 - protein, 11 aa, Mycobacterium tuberculosis
AAINARYPGMA

SEQ ID NO: 7054 - protein, 11 aa, Mycobacterium tuberculosis
AINARYPGMAA

SEQ ID NO: 7055 - protein, 11 aa, Mycobacterium tuberculosis
INARYPGMAAP

SEQ ID NO: 7056 - protein, 11 aa, Mycobacterium tuberculosis
NARYPGMAAPP

SEQ ID NO: 7057 - protein, 11 aa, Mycobacterium tuberculosis
ARYPGMAAPPV

SEQ ID NO: 7058 - protein, 11 aa, Mycobacterium tuberculosis
RYPGMAAPPVR

SEQ ID NO: 7059 - protein, 11 aa, Mycobacterium tuberculosis
YPGMAAPPVRL

SEQ ID NO: 7060 - protein, 11 aa, Mycobacterium tuberculosis
PGMAAPPVRLL

SEQ ID NO: 7061 - protein, 11 aa, Mycobacterium tuberculosis
GMAAPPVRLLP

SEQ ID NO: 7062 - protein, 11 aa, Mycobacterium tuberculosis
MAAPPVRLLPT

SEQ ID NO: 7063 - protein, 11 aa, Mycobacterium tuberculosis
AAPPVRLLPTN

SEQ ID NO: 7064 - protein, 11 aa, Mycobacterium tuberculosis
APPVRLLPTNL

SEQ ID NO: 7065 - protein, 11 aa, Mycobacterium tuberculosis
PPVRLLPTNLA

SEQ ID NO: 7066 - protein, 11 aa, Mycobacterium tuberculosis
PVRLLPTNLAP

SEQ ID NO: 7067 - protein, 11 aa, Mycobacterium tuberculosis
VRLLPTNLAPH

SEQ ID NO: 7068 - protein, 11 aa, Mycobacterium tuberculosis
RLLPTNLAPHA

SEQ ID NO: 7069 - protein, 11 aa, Mycobacterium tuberculosis
LLPTNLAPHAV

SEQ ID NO: 7070 - protein, 11 aa, Mycobacterium tuberculosis
LPTNLAPHAVG

SEQ ID NO: 7071 - protein, 11 aa, Mycobacterium tuberculosis
PTNLAPHAVGE

SEQ ID NO: 7072 - protein, 11 aa, Mycobacterium tuberculosis
TNLAPHAVGEL

SEQ ID NO: 7073 - protein, 11 aa, Mycobacterium tuberculosis
NLAPHAVGELY

SEQ ID NO: 7074 - protein, 11 aa, Mycobacterium tuberculosis
LAPHAVGELYR

SEQ ID NO: 7075 - protein, 11 aa, Mycobacterium tuberculosis
APHAVGELYRG

SEQ ID NO: 7076 - protein, 11 aa, Mycobacterium tuberculosis
PHAVGELYRGP

SEQ ID NO: 7077 - protein, 11 aa, Mycobacterium tuberculosis
HAVGELYRGPD

SEQ ID NO: 7078 - protein, 11 aa, Mycobacterium tuberculosis
AVGELYRGPDQ

SEQ ID NO: 7079 - protein, 11 aa, Mycobacterium tuberculosis
VGELYRGPDQL

SEQ ID NO: 7080 - protein, 11 aa, Mycobacterium tuberculosis
GELYRGPDQLV

SEQ ID NO: 7081 - protein, 11 aa, Mycobacterium tuberculosis
ELYRGPDQLVI

SEQ ID NO: 7082 - protein, 11 aa, Mycobacterium tuberculosis
LYRGPDQLVIG

SEQ ID NO: 7083 - protein, 11 aa, Mycobacterium tuberculosis
YRGPDQLVIGQ

SEQ ID NO: 7084 - protein, 11 aa, Mycobacterium tuberculosis
RGPDQLVIGQR

SEQ ID NO: 7085 - protein, 11 aa, Mycobacterium tuberculosis
GPDQLVIGQRE

SEQ ID NO: 7086 - protein, 11 aa, Mycobacterium tuberculosis
PDQLVIGQREE

SEQ ID NO: 7087 - protein, 11 aa, Mycobacterium tuberculosis
DQLVIGQREED

SEQ ID NO: 7088 - protein, 11 aa, Mycobacterium tuberculosis
QLVIGQREEDL

SEQ ID NO: 7089 - protein, 11 aa, Mycobacterium tuberculosis
LVIGQREEDLA

SEQ ID NO: 7090 - protein, 11 aa, Mycobacterium tuberculosis
VIGQREEDLAP

SEQ ID NO: 7091 - protein, 11 aa, Mycobacterium tuberculosis
IGQREEDLAPV

SEQ ID NO: 7092 - protein, 11 aa, Mycobacterium tuberculosis
GQREEDLAPVI

SEQ ID NO: 7093 - protein, 11 aa, Mycobacterium tuberculosis
QREEDLAPVIL

SEQ ID NO: 7094 - protein, 11 aa, Mycobacterium tuberculosis
REEDLAPVILD

SEQ ID NO: 7095 - protein, 11 aa, Mycobacterium tuberculosis
EEDLAPVILDL

SEQ ID NO: 7096 - protein, 11 aa, Mycobacterium tuberculosis
EDLAPVILDLA

SEQ ID NO: 7097 - protein, 11 aa, Mycobacterium tuberculosis
DLAPVILDLAA

SEQ ID NO: 7098 - protein, 11 aa, Mycobacterium tuberculosis
LAPVILDLAAN

SEQ ID NO: 7099 - protein, 11 aa, Mycobacterium tuberculosis
APVILDLAANP

SEQ ID NO: 7100 - protein, 11 aa, Mycobacterium tuberculosis
PVILDLAANPL

SEQ ID NO: 7101 - protein, 11 aa, Mycobacterium tuberculosis
VILDLAANPLL

SEQ ID NO: 7102 - protein, 11 aa, Mycobacterium tuberculosis
ILDLAANPLLM

SEQ ID NO: 7103 - protein, 11 aa, Mycobacterium tuberculosis
LDLAANPLLMV

SEQ ID NO: 7104 - protein, 11 aa, Mycobacterium tuberculosis
DLAANPLLMVF

SEQ ID NO: 7105 - protein, 11 aa, Mycobacterium tuberculosis
LAANPLLMVFG

SEQ ID NO: 7106 - protein, 11 aa, Mycobacterium tuberculosis
AANPLLMVFGD

SEQ ID NO: 7107 - protein, 11 aa, Mycobacterium tuberculosis
ANPLLMVFGDA

SEQ ID NO: 7108 - protein, 11 aa, Mycobacterium tuberculosis
NPLLMVFGDAR

SEQ ID NO: 7109 - protein, 11 aa, Mycobacterium tuberculosis
PLLMVFGDARS

SEQ ID NO: 7110 - protein, 11 aa, Mycobacterium tuberculosis
LLMVFGDARSG

SEQ ID NO: 7111 - protein, 11 aa, Mycobacterium tuberculosis
LMVFGDARSGK

SEQ ID NO: 7112 - protein, 11 aa, Mycobacterium tuberculosis
MVFGDARSGKT

SEQ ID NO: 7113 - protein, 11 aa, Mycobacterium tuberculosis
VFGDARSGKTT

SEQ ID NO: 7114 - protein, 11 aa, Mycobacterium tuberculosis
FGDARSGKTTL

SEQ ID NO: 7115 - protein, 11 aa, Mycobacterium tuberculosis
GDARSGKTTLL

SEQ ID NO: 7116 - protein, 11 aa, Mycobacterium tuberculosis
DARSGKTTLLR

SEQ ID NO: 7117 - protein, 11 aa, Mycobacterium tuberculosis
ARSGKTTLLRH

SEQ ID NO: 7118 - protein, 11 aa, Mycobacterium tuberculosis
RSGKTTLLRHI

SEQ ID NO: 7119 - protein, 11 aa, Mycobacterium tuberculosis
SGKTTLLRHII

SEQ ID NO: 7120 - protein, 11 aa, Mycobacterium tuberculosis
GKTTLLRHIIR

SEQ ID NO: 7121 - protein, 11 aa, Mycobacterium tuberculosis
KTTLLRHIIRT

SEQ ID NO: 7122 - protein, 11 aa, Mycobacterium tuberculosis
TTLLRHIIRTV

SEQ ID NO: 7123 - protein, 11 aa, Mycobacterium tuberculosis
TLLRHIIRTVR

SEQ ID NO: 7124 - protein, 11 aa, Mycobacterium tuberculosis
LLRHIIRTVRE

SEQ ID NO: 7125 - protein, 11 aa, Mycobacterium tuberculosis
LRHIIRTVREH

SEQ ID NO: 7126 - protein, 11 aa, Mycobacterium tuberculosis
RHIIRTVREHS

SEQ ID NO: 7127 - protein, 11 aa, Mycobacterium tuberculosis
HIIRTVREHST

SEQ ID NO: 7128 - protein, 11 aa, Mycobacterium tuberculosis
IIRTVREHSTA

SEQ ID NO: 7129 - protein, 11 aa, Mycobacterium tuberculosis
IRTVREHSTAD

SEQ ID NO: 7130 - protein, 11 aa, Mycobacterium tuberculosis
RTVREHSTADR

SEQ ID NO: 7131 - protein, 11 aa, Mycobacterium tuberculosis
TVREHSTADRV

SEQ ID NO: 7132 - protein, 11 aa, Mycobacterium tuberculosis
VREHSTADRVA

SEQ ID NO: 7133 - protein, 11 aa, Mycobacterium tuberculosis
REHSTADRVAF

SEQ ID NO: 7134 - protein, 11 aa, Mycobacterium tuberculosis
EHSTADRVAFT

SEQ ID NO: 7135 - protein, 11 aa, Mycobacterium tuberculosis
HSTADRVAFTV

SEQ ID NO: 7136 - protein, 11 aa, Mycobacterium tuberculosis
STADRVAFTVL

SEQ ID NO: 7137 - protein, 11 aa, Mycobacterium tuberculosis
TADRVAFTVLD

SEQ ID NO: 7138 - protein, 11 aa, Mycobacterium tuberculosis
ADRVAFTVLDR

SEQ ID NO: 7139 - protein, 11 aa, Mycobacterium tuberculosis
DRVAFTVLDRR

SEQ ID NO: 7140 - protein, 11 aa, Mycobacterium tuberculosis
RVAFTVLDRRL

SEQ ID NO: 7141 - protein, 11 aa, Mycobacterium tuberculosis
VAFTVLDRRLH

SEQ ID NO: 7142 - protein, 11 aa, Mycobacterium tuberculosis
AFTVLDRRLHL

SEQ ID NO: 7143 - protein, 11 aa, Mycobacterium tuberculosis
FTVLDRRLHLV

SEQ ID NO: 7144 - protein, 11 aa, Mycobacterium tuberculosis
TVLDRRLHLVD

SEQ ID NO: 7145 - protein, 11 aa, Mycobacterium tuberculosis
VLDRRLHLVDE

SEQ ID NO: 7146 - protein, 11 aa, Mycobacterium tuberculosis
LDRRLHLVDEP

SEQ ID NO: 7147 - protein, 11 aa, Mycobacterium tuberculosis
DRRLHLVDEPL

SEQ ID NO: 7148 - protein, 11 aa, Mycobacterium tuberculosis
RRLHLVDEPLF

SEQ ID NO: 7149 - protein, 11 aa, Mycobacterium tuberculosis
RLHLVDEPLFP

SEQ ID NO: 7150 - protein, 11 aa, Mycobacterium tuberculosis
LHLVDEPLFPD

SEQ ID NO: 7151 - protein, 11 aa, Mycobacterium tuberculosis
HLVDEPLFPDN

SEQ ID NO: 7152 - protein, 11 aa, Mycobacterium tuberculosis
LVDEPLFPDNE

SEQ ID NO: 7153 - protein, 11 aa, Mycobacterium tuberculosis
VDEPLFPDNEY

SEQ ID NO: 7154 - protein, 11 aa, Mycobacterium tuberculosis
DEPLFPDNEYT

SEQ ID NO: 7155 - protein, 11 aa, Mycobacterium tuberculosis
EPLFPDNEYTA

SEQ ID NO: 7156 - protein, 11 aa, Mycobacterium tuberculosis
PLFPDNEYTAN

SEQ ID NO: 7157 - protein, 11 aa, Mycobacterium tuberculosis
LFPDNEYTANI

SEQ ID NO: 7158 - protein, 11 aa, Mycobacterium tuberculosis
FPDNEYTANID

SEQ ID NO: 7159 - protein, 11 aa, Mycobacterium tuberculosis
PDNEYTANIDR

SEQ ID NO: 7160 - protein, 11 aa, Mycobacterium tuberculosis
DNEYTANIDRI

SEQ ID NO: 7161 - protein, 11 aa, Mycobacterium tuberculosis
NEYTANIDRII

SEQ ID NO: 7162 - protein, 11 aa, Mycobacterium tuberculosis
EYTANIDRIIP

SEQ ID NO: 7163 - protein, 11 aa, Mycobacterium tuberculosis
YTANIDRIIPA

SEQ ID NO: 7164 - protein, 11 aa, Mycobacterium tuberculosis
TANIDRIIPAM

SEQ ID NO: 7165 - protein, 11 aa, Mycobacterium tuberculosis
ANIDRIIPAML

SEQ ID NO: 7166 - protein, 11 aa, Mycobacterium tuberculosis
NIDRIIPAMLG

SEQ ID NO: 7167 - protein, 11 aa, Mycobacterium tuberculosis
IDRIIPAMLGL

SEQ ID NO: 7168 - protein, 11 aa, Mycobacterium tuberculosis
DRIIPAMLGLA

SEQ ID NO: 7169 - protein, 11 aa, Mycobacterium tuberculosis
RIIPAMLGLAN

SEQ ID NO: 7170 - protein, 11 aa, Mycobacterium tuberculosis
IIPAMLGLANL

SEQ ID NO: 7171 - protein, 11 aa, Mycobacterium tuberculosis
IPAMLGLANLI

SEQ ID NO: 7172 - protein, 11 aa, Mycobacterium tuberculosis
PAMLGLANLIE

SEQ ID NO: 7173 - protein, 11 aa, Mycobacterium tuberculosis
AMLGLANLIEA

SEQ ID NO: 7174 - protein, 11 aa, Mycobacterium tuberculosis
MLGLANLIEAR

SEQ ID NO: 7175 - protein, 11 aa, Mycobacterium tuberculosis
LGLANLIEARR

SEQ ID NO: 7176 - protein, 11 aa, Mycobacterium tuberculosis
GLANLIEARRP

SEQ ID NO: 7177 - protein, 11 aa, Mycobacterium tuberculosis
LANLIEARRPP

SEQ ID NO: 7178 - protein, 11 aa, Mycobacterium tuberculosis
ANLIEARRPPA

SEQ ID NO: 7179 - protein, 11 aa, Mycobacterium tuberculosis
NLIEARRPPAG

SEQ ID NO: 7180 - protein, 11 aa, Mycobacterium tuberculosis
LIEARRPPAGM

SEQ ID NO: 7181 - protein, 11 aa, Mycobacterium tuberculosis
IEARRPPAGMS

SEQ ID NO: 7182 - protein, 11 aa, Mycobacterium tuberculosis
EARRPPAGMSA

SEQ ID NO: 7183 - protein, 11 aa, Mycobacterium tuberculosis
ARRPPAGMSAA

SEQ ID NO: 7184 - protein, 11 aa, Mycobacterium tuberculosis
RRPPAGMSAAE

SEQ ID NO: 7185 - protein, 11 aa, Mycobacterium tuberculosis
RPPAGMSAAEL

SEQ ID NO: 7186 - protein, 11 aa, Mycobacterium tuberculosis
PPAGMSAAELS

SEQ ID NO: 7187 - protein, 11 aa, Mycobacterium tuberculosis
PAGMSAAELSR

SEQ ID NO: 7188 - protein, 11 aa, Mycobacterium tuberculosis
AGMSAAELSRW

SEQ ID NO: 7189 - protein, 11 aa, Mycobacterium tuberculosis
GMSAAELSRWT

SEQ ID NO: 7190 - protein, 11 aa, Mycobacterium tuberculosis
MSAAELSRWTF

SEQ ID NO: 7191 - protein, 11 aa, Mycobacterium tuberculosis
SAAELSRWTFA

SEQ ID NO: 7192 - protein, 11 aa, Mycobacterium tuberculosis
AAELSRWTFAG

SEQ ID NO: 7193 - protein, 11 aa, Mycobacterium tuberculosis
AELSRWTFAGH

SEQ ID NO: 7194 - protein, 11 aa, Mycobacterium tuberculosis
ELSRWTFAGHT

SEQ ID NO: 7195 - protein, 11 aa, Mycobacterium tuberculosis
LSRWTFAGHTH

SEQ ID NO: 7196 - protein, 11 aa, Mycobacterium tuberculosis
SRWTFAGHTHY

SEQ ID NO: 7197 - protein, 11 aa, Mycobacterium tuberculosis
RWTFAGHTHYL

SEQ ID NO: 7198 - protein, 11 aa, Mycobacterium tuberculosis
WTFAGHTHYLI

SEQ ID NO: 7199 - protein, 11 aa, Mycobacterium tuberculosis
TFAGHTHYLII

SEQ ID NO: 7200 - protein, 11 aa, Mycobacterium tuberculosis
FAGHTHYLIID

SEQ ID NO: 7201 - protein, 11 aa, Mycobacterium tuberculosis
AGHTHYLIIDD

SEQ ID NO: 7202 - protein, 11 aa, Mycobacterium tuberculosis
GHTHYLIIDDV

SEQ ID NO: 7203 - protein, 11 aa, Mycobacterium tuberculosis
HTHYLIIDDVD

SEQ ID NO: 7204 - protein, 11 aa, Mycobacterium tuberculosis
THYLIIDDVDQ

SEQ ID NO: 7205 - protein, 11 aa, Mycobacterium tuberculosis
HYLIIDDVDQV

SEQ ID NO: 7206 - protein, 11 aa, Mycobacterium tuberculosis
YLIIDDVDQVP

SEQ ID NO: 7207 - protein, 11 aa, Mycobacterium tuberculosis
LIIDDVDQVPD

SEQ ID NO: 7208 - protein, 11 aa, Mycobacterium tuberculosis
IIDDVDQVPDS

SEQ ID NO: 7209 - protein, 11 aa, Mycobacterium tuberculosis
IDDVDQVPDSP

SEQ ID NO: 7210 - protein, 11 aa, Mycobacterium tuberculosis
DDVDQVPDSPA

SEQ ID NO: 7211 - protein, 11 aa, Mycobacterium tuberculosis
DVDQVPDSPAM

SEQ ID NO: 7212 - protein, 11 aa, Mycobacterium tuberculosis
VDQVPDSPAMT

SEQ ID NO: 7213 - protein, 11 aa, Mycobacterium tuberculosis
DQVPDSPAMTG

SEQ ID NO: 7214 - protein, 11 aa, Mycobacterium tuberculosis
QVPDSPAMTGP

SEQ ID NO: 7215 - protein, 11 aa, Mycobacterium tuberculosis
VPDSPAMTGPY

SEQ ID NO: 7216 - protein, 11 aa, Mycobacterium tuberculosis
PDSPAMTGPYI

SEQ ID NO: 7217 - protein, 11 aa, Mycobacterium tuberculosis
DSPAMTGPYIG

SEQ ID NO: 7218 - protein, 11 aa, Mycobacterium tuberculosis
SPAMTGPYIGQ

SEQ ID NO: 7219 - protein, 11 aa, Mycobacterium tuberculosis
PAMTGPYIGQR

SEQ ID NO: 7220 - protein, 11 aa, Mycobacterium tuberculosis
AMTGPYIGQRP

SEQ ID NO: 7221 - protein, 11 aa, Mycobacterium tuberculosis
MTGPYIGQRPW

SEQ ID NO: 7222 - protein, 11 aa, Mycobacterium tuberculosis
TGPYIGQRPWT

SEQ ID NO: 7223 - protein, 11 aa, Mycobacterium tuberculosis
GPYIGQRPWTP

SEQ ID NO: 7224 - protein, 11 aa, Mycobacterium tuberculosis
PYIGQRPWTPL

SEQ ID NO: 7225 - protein, 11 aa, Mycobacterium tuberculosis
YIGQRPWTPLI

SEQ ID NO: 7226 - protein, 11 aa, Mycobacterium tuberculosis
IGQRPWTPLIG

SEQ ID NO: 7227 - protein, 11 aa, Mycobacterium tuberculosis
GQRPWTPLIGL

SEQ ID NO: 7228 - protein, 11 aa, Mycobacterium tuberculosis
QRPWTPLIGLL

SEQ ID NO: 7229 - protein, 11 aa, Mycobacterium tuberculosis
RPWTPLIGLLA

SEQ ID NO: 7230 - protein, 11 aa, Mycobacterium tuberculosis
PWTPLIGLLAQ

SEQ ID NO: 7231 - protein, 11 aa, Mycobacterium tuberculosis
WTPLIGLLAQA

SEQ ID NO: 7232 - protein, 11 aa, Mycobacterium tuberculosis
TPLIGLLAQAG

SEQ ID NO: 7233 - protein, 11 aa, Mycobacterium tuberculosis
PLIGLLAQAGD

SEQ ID NO: 7234 - protein, 11 aa, Mycobacterium tuberculosis
LIGLLAQAGDL

SEQ ID NO: 7235 - protein, 11 aa, Mycobacterium tuberculosis
IGLLAQAGDLG

SEQ ID NO: 7236 - protein, 11 aa, Mycobacterium tuberculosis
GLLAQAGDLGL

SEQ ID NO: 7237 - protein, 11 aa, Mycobacterium tuberculosis
LLAQAGDLGLR

SEQ ID NO: 7238 - protein, 11 aa, Mycobacterium tuberculosis
LAQAGDLGLRV

SEQ ID NO: 7239 - protein, 11 aa, Mycobacterium tuberculosis
AQAGDLGLRVI

SEQ ID NO: 7240 - protein, 11 aa, Mycobacterium tuberculosis
QAGDLGLRVIV

SEQ ID NO: 7241 - protein, 11 aa, Mycobacterium tuberculosis
AGDLGLRVIVT

SEQ ID NO: 7242 - protein, 11 aa, Mycobacterium tuberculosis
GDLGLRVIVTG

SEQ ID NO: 7243 - protein, 11 aa, Mycobacterium tuberculosis
DLGLRVIVTGR

SEQ ID NO: 7244 - protein, 11 aa, Mycobacterium tuberculosis
LGLRVIVTGRA

SEQ ID NO: 7245 - protein, 11 aa, Mycobacterium tuberculosis
GLRVIVTGRAT

SEQ ID NO: 7246 - protein, 11 aa, Mycobacterium tuberculosis
LRVIVTGRATG

SEQ ID NO: 7247 - protein, 11 aa, Mycobacterium tuberculosis
RVIVTGRATGS

SEQ ID NO: 7248 - protein, 11 aa, Mycobacterium tuberculosis
VIVTGRATGSA

SEQ ID NO: 7249 - protein, 11 aa, Mycobacterium tuberculosis
IVTGRATGSAH

SEQ ID NO: 7250 - protein, 11 aa, Mycobacterium tuberculosis
VTGRATGSAHL

SEQ ID NO: 7251 - protein, 11 aa, Mycobacterium tuberculosis
TGRATGSAHLL

SEQ ID NO: 7252 - protein, 11 aa, Mycobacterium tuberculosis
GRATGSAHLLM

SEQ ID NO: 7253 - protein, 11 aa, Mycobacterium tuberculosis
RATGSAHLLMT

SEQ ID NO: 7254 - protein, 11 aa, Mycobacterium tuberculosis
ATGSAHLLMTS

SEQ ID NO: 7255 - protein, 11 aa, Mycobacterium tuberculosis
TGSAHLLMTSP

SEQ ID NO: 7256 - protein, 11 aa, Mycobacterium tuberculosis
GSAHLLMTSPL

SEQ ID NO: 7257 - protein, 11 aa, Mycobacterium tuberculosis
SAHLLMTSPLL

SEQ ID NO: 7258 - protein, 11 aa, Mycobacterium tuberculosis
AHLLMTSPLLR

SEQ ID NO: 7259 - protein, 11 aa, Mycobacterium tuberculosis
HLLMTSPLLRR

SEQ ID NO: 7260 - protein, 11 aa, Mycobacterium tuberculosis
LLMTSPLLRRF

SEQ ID NO: 7261 - protein, 11 aa, Mycobacterium tuberculosis
LMTSPLLRRFN

SEQ ID NO: 7262 - protein, 11 aa, Mycobacterium tuberculosis
MTSPLLRRFND

SEQ ID NO: 7263 - protein, 11 aa, Mycobacterium tuberculosis
TSPLLRRFNDL

SEQ ID NO: 7264 - protein, 11 aa, Mycobacterium tuberculosis
SPLLRRFNDLQ

SEQ ID NO: 7265 - protein, 11 aa, Mycobacterium tuberculosis
PLLRRFNDLQA

SEQ ID NO: 7266 - protein, 11 aa, Mycobacterium tuberculosis
LLRRFNDLQAT

SEQ ID NO: 7267 - protein, 11 aa, Mycobacterium tuberculosis
LRRFNDLQATT

SEQ ID NO: 7268 - protein, 11 aa, Mycobacterium tuberculosis
RRFNDLQATTL

SEQ ID NO: 7269 - protein, 11 aa, Mycobacterium tuberculosis
RFNDLQATTLM

SEQ ID NO: 7270 - protein, 11 aa, Mycobacterium tuberculosis
FNDLQATTLML

SEQ ID NO: 7271 - protein, 11 aa, Mycobacterium tuberculosis
NDLQATTLMLA

SEQ ID NO: 7272 - protein, 11 aa, Mycobacterium tuberculosis
DLQATTLMLAG

SEQ ID NO: 7273 - protein, 11 aa, Mycobacterium tuberculosis
LQATTLMLAGN

SEQ ID NO: 7274 - protein, 11 aa, Mycobacterium tuberculosis
QATTLMLAGNP

SEQ ID NO: 7275 - protein, 11 aa, Mycobacterium tuberculosis
ATTLMLAGNPA

SEQ ID NO: 7276 - protein, 11 aa, Mycobacterium tuberculosis
TTLMLAGNPAD

SEQ ID NO: 7277 - protein, 11 aa, Mycobacterium tuberculosis
TLMLAGNPADS

SEQ ID NO: 7278 - protein, 11 aa, Mycobacterium tuberculosis
LMLAGNPADSG

SEQ ID NO: 7279 - protein, 11 aa, Mycobacterium tuberculosis
MLAGNPADSGK

SEQ ID NO: 7280 - protein, 11 aa, Mycobacterium tuberculosis
LAGNPADSGKI

SEQ ID NO: 7281 - protein, 11 aa, Mycobacterium tuberculosis
AGNPADSGKIR

SEQ ID NO: 7282 - protein, 11 aa, Mycobacterium tuberculosis
GNPADSGKIRG

SEQ ID NO: 7283 - protein, 11 aa, Mycobacterium tuberculosis
NPADSGKIRGE

SEQ ID NO: 7284 - protein, 11 aa, Mycobacterium tuberculosis
PADSGKIRGER

SEQ ID NO: 7285 - protein, 11 aa, Mycobacterium tuberculosis
ADSGKIRGERF

SEQ ID NO: 7286 - protein, 11 aa, Mycobacterium tuberculosis
DSGKIRGERFA

SEQ ID NO: 7287 - protein, 11 aa, Mycobacterium tuberculosis
SGKIRGERFAR

SEQ ID NO: 7288 - protein, 11 aa, Mycobacterium tuberculosis
GKIRGERFARL

SEQ ID NO: 7289 - protein, 11 aa, Mycobacterium tuberculosis
KIRGERFARLP

SEQ ID NO: 7290 - protein, 11 aa, Mycobacterium tuberculosis
IRGERFARLPA

SEQ ID NO: 7291 - protein, 11 aa, Mycobacterium tuberculosis
RGERFARLPAG

SEQ ID NO: 7292 - protein, 11 aa, Mycobacterium tuberculosis
GERFARLPAGR

SEQ ID NO: 7293 - protein, 11 aa, Mycobacterium tuberculosis
ERFARLPAGRA

SEQ ID NO: 7294 - protein, 11 aa, Mycobacterium tuberculosis
RFARLPAGRAI

SEQ ID NO: 7295 - protein, 11 aa, Mycobacterium tuberculosis
FARLPAGRAIL

SEQ ID NO: 7296 - protein, 11 aa, Mycobacterium tuberculosis
ARLPAGRAILL

SEQ ID NO: 7297 - protein, 11 aa, Mycobacterium tuberculosis
RLPAGRAILLT

SEQ ID NO: 7298 - protein, 11 aa, Mycobacterium tuberculosis
LPAGRAILLTD

SEQ ID NO: 7299 - protein, 11 aa, Mycobacterium tuberculosis
PAGRAILLTDS

SEQ ID NO: 7300 - protein, 11 aa, Mycobacterium tuberculosis
AGRAILLTDSD

SEQ ID NO: 7301 - protein, 11 aa, Mycobacterium tuberculosis
GRAILLTDSDS

SEQ ID NO: 7302 - protein, 11 aa, Mycobacterium tuberculosis
RAILLTDSDSP

SEQ ID NO: 7303 - protein, 11 aa, Mycobacterium tuberculosis
AILLTDSDSPT

SEQ ID NO: 7304 - protein, 11 aa, Mycobacterium tuberculosis
ILLTDSDSPTY

SEQ ID NO: 7305 - protein, 11 aa, Mycobacterium tuberculosis
LLTDSDSPTYV

SEQ ID NO: 7306 - protein, 11 aa, Mycobacterium tuberculosis
LTDSDSPTYVQ

SEQ ID NO: 7307 - protein, 11 aa, Mycobacterium tuberculosis
TDSDSPTYVQL

SEQ ID NO: 7308 - protein, 11 aa, Mycobacterium tuberculosis
DSDSPTYVQLI

SEQ ID NO: 7309 - protein, 11 aa, Mycobacterium tuberculosis
SDSPTYVQLIN

SEQ ID NO: 7310 - protein, 11 aa, Mycobacterium tuberculosis
DSPTYVQLINP

SEQ ID NO: 7311 - protein, 11 aa, Mycobacterium tuberculosis
SPTYVQLINPL

SEQ ID NO: 7312 - protein, 11 aa, Mycobacterium tuberculosis
PTYVQLINPLV

SEQ ID NO: 7313 - protein, 11 aa, Mycobacterium tuberculosis
TYVQLINPLVD

SEQ ID NO: 7314 - protein, 11 aa, Mycobacterium tuberculosis
YVQLINPLVDA

SEQ ID NO: 7315 - protein, 11 aa, Mycobacterium tuberculosis
VQLINPLVDAA

SEQ ID NO: 7316 - protein, 11 aa, Mycobacterium tuberculosis
QLINPLVDAAA

SEQ ID NO: 7317 - protein, 11 aa, Mycobacterium tuberculosis
LINPLVDAAAV

SEQ ID NO: 7318 - protein, 11 aa, Mycobacterium tuberculosis
INPLVDAAAVS

SEQ ID NO: 7319 - protein, 11 aa, Mycobacterium tuberculosis
NPLVDAAAVSG

SEQ ID NO: 7320 - protein, 11 aa, Mycobacterium tuberculosis
PLVDAAAVSGE

SEQ ID NO: 7321 - protein, 11 aa, Mycobacterium tuberculosis
LVDAAAVSGET

SEQ ID NO: 7322 - protein, 11 aa, Mycobacterium tuberculosis
VDAAAVSGETQ

SEQ ID NO: 7323 - protein, 11 aa, Mycobacterium tuberculosis
DAAAVSGETQQ

SEQ ID NO: 7324 - protein, 11 aa, Mycobacterium tuberculosis
AAAVSGETQQK

SEQ ID NO: 7325 - protein, 11 aa, Mycobacterium tuberculosis
AAVSGETQQKG

SEQ ID NO: 7326 - protein, 11 aa, Mycobacterium tuberculosis
AVSGETQQKGS

SEQ ID NO: 7327 - protein, 11 aa, Mycobacterium tuberculosis
VSGETQQKGSQ

SEQ ID NO: 7328 - protein, 11 aa, Mycobacterium tuberculosis
SGETQQKGSQS

SEQ ID NO: 7329 - protein, 8 aa, Mycobacterium tuberculosis
MTLRVVPE

SEQ ID NO: 7330 - protein, 8 aa, Mycobacterium tuberculosis
TLRVVPEG

SEQ ID NO: 7331 - protein, 8 aa, Mycobacterium tuberculosis
LRVVPEGL

SEQ ID NO: 7332 - protein, 8 aa, Mycobacterium tuberculosis
RVVPEGLA

SEQ ID NO: 7333 - protein, 8 aa, Mycobacterium tuberculosis
VVPEGLAA

SEQ ID NO: 7334 - protein, 8 aa, Mycobacterium tuberculosis
VPEGLAAA

SEQ ID NO: 7335 - protein, 8 aa, Mycobacterium tuberculosis
PEGLAAAS

SEQ ID NO: 7336 - protein, 8 aa, Mycobacterium tuberculosis
EGLAAASA

SEQ ID NO: 7337 - protein, 8 aa, Mycobacterium tuberculosis
GLAAASAA

SEQ ID NO: 7338 - protein, 8 aa, Mycobacterium tuberculosis
LAAASAAV

SEQ ID NO: 7339 - protein, 8 aa, Mycobacterium tuberculosis
AAASAAVE

SEQ ID NO: 7340 - protein, 8 aa, Mycobacterium tuberculosis
AASAAVEA

SEQ ID NO: 7341 - protein, 8 aa, Mycobacterium tuberculosis
ASAAVEAL

SEQ ID NO: 7342 - protein, 8 aa, Mycobacterium tuberculosis
SAAVEALT

SEQ ID NO: 7343 - protein, 8 aa, Mycobacterium tuberculosis
AAVEALTA

SEQ ID NO: 7344 - protein, 8 aa, Mycobacterium tuberculosis
AVEALTAR

SEQ ID NO: 7345 - protein, 8 aa, Mycobacterium tuberculosis
VEALTARL

SEQ ID NO: 7346 - protein, 8 aa, Mycobacterium tuberculosis
EALTARLA

SEQ ID NO: 7347 - protein, 8 aa, Mycobacterium tuberculosis
ALTARLAA

SEQ ID NO: 7348 - protein, 8 aa, Mycobacterium tuberculosis
LTARLAAA

SEQ ID NO: 7349 - protein, 8 aa, Mycobacterium tuberculosis
TARLAAAH

SEQ ID NO: 7350 - protein, 8 aa, Mycobacterium tuberculosis
ARLAAAHA

SEQ ID NO: 7351 - protein, 8 aa, Mycobacterium tuberculosis
RLAAAHAS

SEQ ID NO: 7352 - protein, 8 aa, Mycobacterium tuberculosis
LAAAHASA

SEQ ID NO: 7353 - protein, 8 aa, Mycobacterium tuberculosis
AAAHASAA

SEQ ID NO: 7354 - protein, 8 aa, Mycobacterium tuberculosis
AAHASAAP

SEQ ID NO: 7355 - protein, 8 aa, Mycobacterium tuberculosis
AHASAAPV

SEQ ID NO: 7356 - protein, 8 aa, Mycobacterium tuberculosis
HASAAPVI

SEQ ID NO: 7357 - protein, 8 aa, Mycobacterium tuberculosis
ASAAPVIT

SEQ ID NO: 7358 - protein, 8 aa, Mycobacterium tuberculosis
SAAPVITA

SEQ ID NO: 7359 - protein, 8 aa, Mycobacterium tuberculosis
AAPVITAV

SEQ ID NO: 7360 - protein, 8 aa, Mycobacterium tuberculosis
APVITAVV

SEQ ID NO: 7361 - protein, 8 aa, Mycobacterium tuberculosis
PVITAVVP

SEQ ID NO: 7362 - protein, 8 aa, Mycobacterium tuberculosis
VITAVVPP

SEQ ID NO: 7363 - protein, 8 aa, Mycobacterium tuberculosis
ITAVVPPA

SEQ ID NO: 7364 - protein, 8 aa, Mycobacterium tuberculosis
TAVVPPAA

SEQ ID NO: 7365 - protein, 8 aa, Mycobacterium tuberculosis
AVVPPAAD

SEQ ID NO: 7366 - protein, 8 aa, Mycobacterium tuberculosis
VVPPAADP

SEQ ID NO: 7367 - protein, 8 aa, Mycobacterium tuberculosis
VPPAADPV

SEQ ID NO: 7368 - protein, 8 aa, Mycobacterium tuberculosis
PPAADPVS

SEQ ID NO: 7369 - protein, 8 aa, Mycobacterium tuberculosis
PAADPVSL

SEQ ID NO: 7370 - protein, 8 aa, Mycobacterium tuberculosis
AADPVSLQ

SEQ ID NO: 7371 - protein, 8 aa, Mycobacterium tuberculosis
ADPVSLQT

SEQ ID NO: 7372 - protein, 8 aa, Mycobacterium tuberculosis
DPVSLQTA

SEQ ID NO: 7373 - protein, 8 aa, Mycobacterium tuberculosis
PVSLQTAA

SEQ ID NO: 7374 - protein, 8 aa, Mycobacterium tuberculosis
VSLQTAAG

SEQ ID NO: 7375 - protein, 8 aa, Mycobacterium tuberculosis
SLQTAAGF

SEQ ID NO: 7376 - protein, 8 aa, Mycobacterium tuberculosis
LQTAAGFS

SEQ ID NO: 7377 - protein, 8 aa, Mycobacterium tuberculosis
QTAAGFSA

SEQ ID NO: 7378 - protein, 8 aa, Mycobacterium tuberculosis
TAAGFSAQ

SEQ ID NO: 7379 - protein, 8 aa, Mycobacterium tuberculosis
AAGFSAQG

SEQ ID NO: 7380 - protein, 8 aa, Mycobacterium tuberculosis
AGFSAQGV

SEQ ID NO: 7381 - protein, 8 aa, Mycobacterium tuberculosis
GFSAQGVE

SEQ ID NO: 7382 - protein, 8 aa, Mycobacterium tuberculosis
FSAQGVEH

SEQ ID NO: 7383 - protein, 8 aa, Mycobacterium tuberculosis
SAQGVEHA

SEQ ID NO: 7384 - protein, 8 aa, Mycobacterium tuberculosis
AQGVEHAV

SEQ ID NO: 7385 - protein, 8 aa, Mycobacterium tuberculosis
QGVEHAVV

SEQ ID NO: 7386 - protein, 8 aa, Mycobacterium tuberculosis
GVEHAVVT

SEQ ID NO: 7387 - protein, 8 aa, Mycobacterium tuberculosis
VEHAVVTA

SEQ ID NO: 7388 - protein, 8 aa, Mycobacterium tuberculosis
EHAVVTAE

SEQ ID NO: 7389 - protein, 8 aa, Mycobacterium tuberculosis
HAVVTAEG

SEQ ID NO: 7390 - protein, 8 aa, Mycobacterium tuberculosis
AVVTAEGV

SEQ ID NO: 7391 - protein, 8 aa, Mycobacterium tuberculosis
VVTAEGVE

SEQ ID NO: 7392 - protein, 8 aa, Mycobacterium tuberculosis
VTAEGVEE

SEQ ID NO: 7393 - protein, 8 aa, Mycobacterium tuberculosis
TAEGVEEL

SEQ ID NO: 7394 - protein, 8 aa, Mycobacterium tuberculosis
AEGVEELG

SEQ ID NO: 7395 - protein, 8 aa, Mycobacterium tuberculosis
EGVEELGR

SEQ ID NO: 7396 - protein, 8 aa, Mycobacterium tuberculosis
GVEELGRA

SEQ ID NO: 7397 - protein, 8 aa, Mycobacterium tuberculosis
VEELGRAG

SEQ ID NO: 7398 - protein, 8 aa, Mycobacterium tuberculosis
EELGRAGV

SEQ ID NO: 7399 - protein, 8 aa, Mycobacterium tuberculosis
ELGRAGVG

SEQ ID NO: 7400 - protein, 8 aa, Mycobacterium tuberculosis
LGRAGVGV

SEQ ID NO: 7401 - protein, 8 aa, Mycobacterium tuberculosis
GRAGVGVG

SEQ ID NO: 7402 - protein, 8 aa, Mycobacterium tuberculosis
RAGVGVGE

SEQ ID NO: 7403 - protein, 8 aa, Mycobacterium tuberculosis
AGVGVGES

SEQ ID NO: 7404 - protein, 8 aa, Mycobacterium tuberculosis
GVGVGESG

SEQ ID NO: 7405 - protein, 8 aa, Mycobacterium tuberculosis
VGVGESGA

SEQ ID NO: 7406 - protein, 8 aa, Mycobacterium tuberculosis
GVGESGAS

SEQ ID NO: 7407 - protein, 8 aa, Mycobacterium tuberculosis
VGESGASY

SEQ ID NO: 7408 - protein, 8 aa, Mycobacterium tuberculosis
GESGASYL

SEQ ID NO: 7409 - protein, 8 aa, Mycobacterium tuberculosis
ESGASYLA

SEQ ID NO: 7410 - protein, 8 aa, Mycobacterium tuberculosis
SGASYLAG

SEQ ID NO: 7411 - protein, 8 aa, Mycobacterium tuberculosis
GASYLAGD

SEQ ID NO: 7412 - protein, 8 aa, Mycobacterium tuberculosis
ASYLAGDA

SEQ ID NO: 7413 - protein, 8 aa, Mycobacterium tuberculosis
SYLAGDAA

SEQ ID NO: 7414 - protein, 8 aa, Mycobacterium tuberculosis
YLAGDAAA

SEQ ID NO: 7415 - protein, 8 aa, Mycobacterium tuberculosis
LAGDAAAA

SEQ ID NO: 7416 - protein, 8 aa, Mycobacterium tuberculosis
AGDAAAAA

SEQ ID NO: 7417 - protein, 8 aa, Mycobacterium tuberculosis
GDAAAAAT

SEQ ID NO: 7418 - protein, 8 aa, Mycobacterium tuberculosis
DAAAAATY

SEQ ID NO: 7419 - protein, 8 aa, Mycobacterium tuberculosis
AAAAATYG

SEQ ID NO: 7420 - protein, 8 aa, Mycobacterium tuberculosis
AAAATYGV

SEQ ID NO: 7421 - protein, 8 aa, Mycobacterium tuberculosis
AAATYGVV

SEQ ID NO: 7422 - protein, 8 aa, Mycobacterium tuberculosis
AATYGVVG

SEQ ID NO: 7423 - protein, 8 aa, Mycobacterium tuberculosis
ATYGVVGG

SEQ ID NO: 7424 - protein, 9 aa, Mycobacterium tuberculosis
MTLRVVPEG

SEQ ID NO: 7425 - protein, 9 aa, Mycobacterium tuberculosis
TLRVVPEGL

SEQ ID NO: 7426 - protein, 9 aa, Mycobacterium tuberculosis
LRVVPEGLA

SEQ ID NO: 7427 - protein, 9 aa, Mycobacterium tuberculosis
RVVPEGLAA

SEQ ID NO: 7428 - protein, 9 aa, Mycobacterium tuberculosis
VVPEGLAAA

SEQ ID NO: 7429 - protein, 9 aa, Mycobacterium tuberculosis
VPEGLAAAS

SEQ ID NO: 7430 - protein, 9 aa, Mycobacterium tuberculosis
PEGLAAASA

SEQ ID NO: 7431 - protein, 9 aa, Mycobacterium tuberculosis
EGLAAASAA

SEQ ID NO: 7432 - protein, 9 aa, Mycobacterium tuberculosis
GLAAASAAV

SEQ ID NO: 7433 - protein, 9 aa, Mycobacterium tuberculosis
LAAASAAVE

SEQ ID NO: 7434 - protein, 9 aa, Mycobacterium tuberculosis
AAASAAVEA

SEQ ID NO: 7435 - protein, 9 aa, Mycobacterium tuberculosis
AASAAVEAL

SEQ ID NO: 7436 - protein, 9 aa, Mycobacterium tuberculosis
ASAAVEALT

SEQ ID NO: 7437 - protein, 9 aa, Mycobacterium tuberculosis
SAAVEALTA

SEQ ID NO: 7438 - protein, 9 aa, Mycobacterium tuberculosis
AAVEALTAR

SEQ ID NO: 7439 - protein, 9 aa, Mycobacterium tuberculosis
AVEALTARL

SEQ ID NO: 7440 - protein, 9 aa, Mycobacterium tuberculosis
VEALTARLA

SEQ ID NO: 7441 - protein, 9 aa, Mycobacterium tuberculosis
EALTARLAA

SEQ ID NO: 7442 - protein, 9 aa, Mycobacterium tuberculosis
ALTARLAAA

SEQ ID NO: 7443 - protein, 9 aa, Mycobacterium tuberculosis
LTARLAAAH

SEQ ID NO: 7444 - protein, 9 aa, Mycobacterium tuberculosis
TARLAAAHA

SEQ ID NO: 7445 - protein, 9 aa, Mycobacterium tuberculosis
ARLAAAHAS

SEQ ID NO: 7446 - protein, 9 aa, Mycobacterium tuberculosis
RLAAAHASA

SEQ ID NO: 7447 - protein, 9 aa, Mycobacterium tuberculosis
LAAAHASAA

SEQ ID NO: 7448 - protein, 9 aa, Mycobacterium tuberculosis
AAAHASAAP

SEQ ID NO: 7449 - protein, 9 aa, Mycobacterium tuberculosis
AAHASAAPV

SEQ ID NO: 7450 - protein, 9 aa, Mycobacterium tuberculosis
AHASAAPVI

SEQ ID NO: 7451 - protein, 9 aa, Mycobacterium tuberculosis
HASAAPVIT

SEQ ID NO: 7452 - protein, 9 aa, Mycobacterium tuberculosis
ASAAPVITA

SEQ ID NO: 7453 - protein, 9 aa, Mycobacterium tuberculosis
SAAPVITAV

SEQ ID NO: 7454 - protein, 9 aa, Mycobacterium tuberculosis
AAPVITAVV

SEQ ID NO: 7455 - protein, 9 aa, Mycobacterium tuberculosis
APVITAVVP

SEQ ID NO: 7456 - protein, 9 aa, Mycobacterium tuberculosis
PVITAVVPP

SEQ ID NO: 7457 - protein, 9 aa, Mycobacterium tuberculosis
VITAVVPPA

SEQ ID NO: 7458 - protein, 9 aa, Mycobacterium tuberculosis
ITAVVPPAA

SEQ ID NO: 7459 - protein, 9 aa, Mycobacterium tuberculosis
TAVVPPAAD

SEQ ID NO: 7460 - protein, 9 aa, Mycobacterium tuberculosis
AVVPPAADP

SEQ ID NO: 7461 - protein, 9 aa, Mycobacterium tuberculosis
VVPPAADPV

SEQ ID NO: 7462 - protein, 9 aa, Mycobacterium tuberculosis
VPPAADPVS

SEQ ID NO: 7463 - protein, 9 aa, Mycobacterium tuberculosis
PPAADPVSL

SEQ ID NO: 7464 - protein, 9 aa, Mycobacterium tuberculosis
PAADPVSLQ

SEQ ID NO: 7465 - protein, 9 aa, Mycobacterium tuberculosis
AADPVSLQT

SEQ ID NO: 7466 - protein, 9 aa, Mycobacterium tuberculosis
ADPVSLQTA

SEQ ID NO: 7467 - protein, 9 aa, Mycobacterium tuberculosis
DPVSLQTAA

SEQ ID NO: 7468 - protein, 9 aa, Mycobacterium tuberculosis
PVSLQTAAG

SEQ ID NO: 7469 - protein, 9 aa, Mycobacterium tuberculosis
VSLQTAAGF

SEQ ID NO: 7470 - protein, 9 aa, Mycobacterium tuberculosis
SLQTAAGFS

SEQ ID NO: 7471 - protein, 9 aa, Mycobacterium tuberculosis
LQTAAGFSA

SEQ ID NO: 7472 - protein, 9 aa, Mycobacterium tuberculosis
QTAAGFSAQ

SEQ ID NO: 7473 - protein, 9 aa, Mycobacterium tuberculosis
TAAGFSAQG

SEQ ID NO: 7474 - protein, 9 aa, Mycobacterium tuberculosis
AAGFSAQGV

SEQ ID NO: 7475 - protein, 9 aa, Mycobacterium tuberculosis
AGFSAQGVE

SEQ ID NO: 7476 - protein, 9 aa, Mycobacterium tuberculosis
GFSAQGVEH

SEQ ID NO: 7477 - protein, 9 aa, Mycobacterium tuberculosis
FSAQGVEHA

SEQ ID NO: 7478 - protein, 9 aa, Mycobacterium tuberculosis
SAQGVEHAV

SEQ ID NO: 7479 - protein, 9 aa, Mycobacterium tuberculosis
AQGVEHAVV

SEQ ID NO: 7480 - protein, 9 aa, Mycobacterium tuberculosis
QGVEHAVVT

SEQ ID NO: 7481 - protein, 9 aa, Mycobacterium tuberculosis
GVEHAVVTA

SEQ ID NO: 7482 - protein, 9 aa, Mycobacterium tuberculosis
VEHAVVTAE

SEQ ID NO: 7483 - protein, 9 aa, Mycobacterium tuberculosis
EHAVVTAEG

SEQ ID NO: 7484 - protein, 9 aa, Mycobacterium tuberculosis
HAVVTAEGV

SEQ ID NO: 7485 - protein, 9 aa, Mycobacterium tuberculosis
AVVTAEGVE

SEQ ID NO: 7486 - protein, 9 aa, Mycobacterium tuberculosis
VVTAEGVEE

SEQ ID NO: 7487 - protein, 9 aa, Mycobacterium tuberculosis
VTAEGVEEL

SEQ ID NO: 7488 - protein, 9 aa, Mycobacterium tuberculosis
TAEGVEELG

SEQ ID NO: 7489 - protein, 9 aa, Mycobacterium tuberculosis
AEGVEELGR

SEQ ID NO: 7490 - protein, 9 aa, Mycobacterium tuberculosis
EGVEELGRA

SEQ ID NO: 7491 - protein, 9 aa, Mycobacterium tuberculosis
GVEELGRAG

SEQ ID NO: 7492 - protein, 9 aa, Mycobacterium tuberculosis
VEELGRAGV

SEQ ID NO: 7493 - protein, 9 aa, Mycobacterium tuberculosis
EELGRAGVG

SEQ ID NO: 7494 - protein, 9 aa, Mycobacterium tuberculosis
ELGRAGVGV

SEQ ID NO: 7495 - protein, 9 aa, Mycobacterium tuberculosis
LGRAGVGVG

SEQ ID NO: 7496 - protein, 9 aa, Mycobacterium tuberculosis
GRAGVGVGE

SEQ ID NO: 7497 - protein, 9 aa, Mycobacterium tuberculosis
RAGVGVGES

SEQ ID NO: 7498 - protein, 9 aa, Mycobacterium tuberculosis
AGVGVGESG

SEQ ID NO: 7499 - protein, 9 aa, Mycobacterium tuberculosis
GVGVGESGA

SEQ ID NO: 7500 - protein, 9 aa, Mycobacterium tuberculosis
VGVGESGAS

SEQ ID NO: 7501 - protein, 9 aa, Mycobacterium tuberculosis
GVGESGASY

SEQ ID NO: 7502 - protein, 9 aa, Mycobacterium tuberculosis
VGESGASYL

SEQ ID NO: 7503 - protein, 9 aa, Mycobacterium tuberculosis
GESGASYLA

SEQ ID NO: 7504 - protein, 9 aa, Mycobacterium tuberculosis
ESGASYLAG

SEQ ID NO: 7505 - protein, 9 aa, Mycobacterium tuberculosis
SGASYLAGD

SEQ ID NO: 7506 - protein, 9 aa, Mycobacterium tuberculosis
GASYLAGDA

SEQ ID NO: 7507 - protein, 9 aa, Mycobacterium tuberculosis
ASYLAGDAA

SEQ ID NO: 7508 - protein, 9 aa, Mycobacterium tuberculosis
SYLAGDAAA

SEQ ID NO: 7509 - protein, 9 aa, Mycobacterium tuberculosis
YLAGDAAAA

SEQ ID NO: 7510 - protein, 9 aa, Mycobacterium tuberculosis
LAGDAAAAA

SEQ ID NO: 7511 - protein, 9 aa, Mycobacterium tuberculosis
AGDAAAAAT

SEQ ID NO: 7512 - protein, 9 aa, Mycobacterium tuberculosis
GDAAAAATY

SEQ ID NO: 7513 - protein, 9 aa, Mycobacterium tuberculosis
DAAAAATYG

SEQ ID NO: 7514 - protein, 9 aa, Mycobacterium tuberculosis
AAAAATYGV

SEQ ID NO: 7515 - protein, 9 aa, Mycobacterium tuberculosis
AAAATYGVV

SEQ ID NO: 7516 - protein, 9 aa, Mycobacterium tuberculosis
AAATYGVVG

SEQ ID NO: 7517 - protein, 9 aa, Mycobacterium tuberculosis
AATYGVVGG

SEQ ID NO: 7518 - protein, 10 aa, Mycobacterium tuberculosis
MTLRVVPEGL

SEQ ID NO: 7519 - protein, 10 aa, Mycobacterium tuberculosis
TLRVVPEGLA

SEQ ID NO: 7520 - protein, 10 aa, Mycobacterium tuberculosis
LRVVPEGLAA

SEQ ID NO: 7521 - protein, 10 aa, Mycobacterium tuberculosis
RVVPEGLAAA

SEQ ID NO: 7522 - protein, 10 aa, Mycobacterium tuberculosis
VVPEGLAAAS

SEQ ID NO: 7523 - protein, 10 aa, Mycobacterium tuberculosis
VPEGLAAASA

SEQ ID NO: 7524 - protein, 10 aa, Mycobacterium tuberculosis
PEGLAAASAA

SEQ ID NO: 7525 - protein, 10 aa, Mycobacterium tuberculosis
EGLAAASAAV

SEQ ID NO: 7526 - protein, 10 aa, Mycobacterium tuberculosis
GLAAASAAVE

SEQ ID NO: 7527 - protein, 10 aa, Mycobacterium tuberculosis
LAAASAAVEA

SEQ ID NO: 7528 - protein, 10 aa, Mycobacterium tuberculosis
AAASAAVEAL

SEQ ID NO: 7529 - protein, 10 aa, Mycobacterium tuberculosis
AASAAVEALT

SEQ ID NO: 7530 - protein, 10 aa, Mycobacterium tuberculosis
ASAAVEALTA

SEQ ID NO: 7531 - protein, 10 aa, Mycobacterium tuberculosis
SAAVEALTAR

SEQ ID NO: 7532 - protein, 10 aa, Mycobacterium tuberculosis
AAVEALTARL

SEQ ID NO: 7533 - protein, 10 aa, Mycobacterium tuberculosis
AVEALTARLA

SEQ ID NO: 7534 - protein, 10 aa, Mycobacterium tuberculosis
VEALTARLAA

SEQ ID NO: 7535 - protein, 10 aa, Mycobacterium tuberculosis
EALTARLAAA

SEQ ID NO: 7536 - protein, 10 aa, Mycobacterium tuberculosis
ALTARLAAAH

SEQ ID NO: 7537 - protein, 10 aa, Mycobacterium tuberculosis
LTARLAAAHA

SEQ ID NO: 7538 - protein, 10 aa, Mycobacterium tuberculosis
TARLAAAHAS

SEQ ID NO: 7539 - protein, 10 aa, Mycobacterium tuberculosis
ARLAAAHASA

SEQ ID NO: 7540 - protein, 10 aa, Mycobacterium tuberculosis
RLAAAHASAA

SEQ ID NO: 7541 - protein, 10 aa, Mycobacterium tuberculosis
LAAAHASAAP

SEQ ID NO: 7542 - protein, 10 aa, Mycobacterium tuberculosis
AAAHASAAPV

SEQ ID NO: 7543 - protein, 10 aa, Mycobacterium tuberculosis
AAHASAAPVI

SEQ ID NO: 7544 - protein, 10 aa, Mycobacterium tuberculosis
AHASAAPVIT

SEQ ID NO: 7545 - protein, 10 aa, Mycobacterium tuberculosis
HASAAPVITA

SEQ ID NO: 7546 - protein, 10 aa, Mycobacterium tuberculosis
ASAAPVITAV

SEQ ID NO: 7547 - protein, 10 aa, Mycobacterium tuberculosis
SAAPVITAVV

SEQ ID NO: 7548 - protein, 10 aa, Mycobacterium tuberculosis
AAPVITAVVP

SEQ ID NO: 7549 - protein, 10 aa, Mycobacterium tuberculosis
APVITAVVPP

SEQ ID NO: 7550 - protein, 10 aa, Mycobacterium tuberculosis
PVITAVVPPA

SEQ ID NO: 7551 - protein, 10 aa, Mycobacterium tuberculosis
VITAVVPPAA

SEQ ID NO: 7552 - protein, 10 aa, Mycobacterium tuberculosis
ITAVVPPAAD

SEQ ID NO: 7553 - protein, 10 aa, Mycobacterium tuberculosis
TAVVPPAADP

SEQ ID NO: 7554 - protein, 10 aa, Mycobacterium tuberculosis
AVVPPAADPV

SEQ ID NO: 7555 - protein, 10 aa, Mycobacterium tuberculosis
VVPPAADPVS

SEQ ID NO: 7556 - protein, 10 aa, Mycobacterium tuberculosis
VPPAADPVSL

SEQ ID NO: 7557 - protein, 10 aa, Mycobacterium tuberculosis
PPAADPVSLQ

SEQ ID NO: 7558 - protein, 10 aa, Mycobacterium tuberculosis
PAADPVSLQT

SEQ ID NO: 7559 - protein, 10 aa, Mycobacterium tuberculosis
AADPVSLQTA

SEQ ID NO: 7560 - protein, 10 aa, Mycobacterium tuberculosis
ADPVSLQTAA

SEQ ID NO: 7561 - protein, 10 aa, Mycobacterium tuberculosis
DPVSLQTAAG

SEQ ID NO: 7562 - protein, 10 aa, Mycobacterium tuberculosis
PVSLQTAAGF

SEQ ID NO: 7563 - protein, 10 aa, Mycobacterium tuberculosis
VSLQTAAGFS

SEQ ID NO: 7564 - protein, 10 aa, Mycobacterium tuberculosis
SLQTAAGFSA

SEQ ID NO: 7565 - protein, 10 aa, Mycobacterium tuberculosis
LQTAAGFSAQ

SEQ ID NO: 7566 - protein, 10 aa, Mycobacterium tuberculosis
QTAAGFSAQG

SEQ ID NO: 7567 - protein, 10 aa, Mycobacterium tuberculosis
TAAGFSAQGV

SEQ ID NO: 7568 - protein, 10 aa, Mycobacterium tuberculosis
AAGFSAQGVE

SEQ ID NO: 7569 - protein, 10 aa, Mycobacterium tuberculosis
AGFSAQGVEH

SEQ ID NO: 7570 - protein, 10 aa, Mycobacterium tuberculosis
GFSAQGVEHA

SEQ ID NO: 7571 - protein, 10 aa, Mycobacterium tuberculosis
FSAQGVEHAV

SEQ ID NO: 7572 - protein, 10 aa, Mycobacterium tuberculosis
SAQGVEHAVV

SEQ ID NO: 7573 - protein, 10 aa, Mycobacterium tuberculosis
AQGVEHAVVT

SEQ ID NO: 7574 - protein, 10 aa, Mycobacterium tuberculosis
QGVEHAVVTA

SEQ ID NO: 7575 - protein, 10 aa, Mycobacterium tuberculosis
GVEHAVVTAE

SEQ ID NO: 7576 - protein, 10 aa, Mycobacterium tuberculosis
VEHAVVTAEG

SEQ ID NO: 7577 - protein, 10 aa, Mycobacterium tuberculosis
EHAVVTAEGV

SEQ ID NO: 7578 - protein, 10 aa, Mycobacterium tuberculosis
HAVVTAEGVE

SEQ ID NO: 7579 - protein, 10 aa, Mycobacterium tuberculosis
AVVTAEGVEE

SEQ ID NO: 7580 - protein, 10 aa, Mycobacterium tuberculosis
VVTAEGVEEL

SEQ ID NO: 7581 - protein, 10 aa, Mycobacterium tuberculosis
VTAEGVEELG

SEQ ID NO: 7582 - protein, 10 aa, Mycobacterium tuberculosis
TAEGVEELGR

SEQ ID NO: 7583 - protein, 10 aa, Mycobacterium tuberculosis
AEGVEELGRA

SEQ ID NO: 7584 - protein, 10 aa, Mycobacterium tuberculosis
EGVEELGRAG

SEQ ID NO: 7585 - protein, 10 aa, Mycobacterium tuberculosis
GVEELGRAGV

SEQ ID NO: 7586 - protein, 10 aa, Mycobacterium tuberculosis
VEELGRAGVG

SEQ ID NO: 7587 - protein, 10 aa, Mycobacterium tuberculosis
EELGRAGVGV

SEQ ID NO: 7588 - protein, 10 aa, Mycobacterium tuberculosis
ELGRAGVGVG

SEQ ID NO: 7589 - protein, 10 aa, Mycobacterium tuberculosis
LGRAGVGVGE

SEQ ID NO: 7590 - protein, 10 aa, Mycobacterium tuberculosis
GRAGVGVGES

SEQ ID NO: 7591 - protein, 10 aa, Mycobacterium tuberculosis
RAGVGVGESG

SEQ ID NO: 7592 - protein, 10 aa, Mycobacterium tuberculosis
AGVGVGESGA

SEQ ID NO: 7593 - protein, 10 aa, Mycobacterium tuberculosis
GVGVGESGAS

SEQ ID NO: 7594 - protein, 10 aa, Mycobacterium tuberculosis
VGVGESGASY

SEQ ID NO: 7595 - protein, 10 aa, Mycobacterium tuberculosis
GVGESGASYL

SEQ ID NO: 7596 - protein, 10 aa, Mycobacterium tuberculosis
VGESGASYLA

SEQ ID NO: 7597 - protein, 10 aa, Mycobacterium tuberculosis
GESGASYLAG

SEQ ID NO: 7598 - protein, 10 aa, Mycobacterium tuberculosis
ESGASYLAGD

SEQ ID NO: 7599 - protein, 10 aa, Mycobacterium tuberculosis
SGASYLAGDA

SEQ ID NO: 7600 - protein, 10 aa, Mycobacterium tuberculosis
GASYLAGDAA

SEQ ID NO: 7601 - protein, 10 aa, Mycobacterium tuberculosis
ASYLAGDAAA

SEQ ID NO: 7602 - protein, 10 aa, Mycobacterium tuberculosis
SYLAGDAAAA

SEQ ID NO: 7603 - protein, 10 aa, Mycobacterium tuberculosis
YLAGDAAAAA

SEQ ID NO: 7604 - protein, 10 aa, Mycobacterium tuberculosis
LAGDAAAAAT

SEQ ID NO: 7605 - protein, 10 aa, Mycobacterium tuberculosis
AGDAAAAATY

SEQ ID NO: 7606 - protein, 10 aa, Mycobacterium tuberculosis
GDAAAAATYG

SEQ ID NO: 7607 - protein, 10 aa, Mycobacterium tuberculosis
DAAAAATYGV

SEQ ID NO: 7608 - protein, 10 aa, Mycobacterium tuberculosis
AAAAATYGVV

SEQ ID NO: 7609 - protein, 10 aa, Mycobacterium tuberculosis
AAAATYGVVG

SEQ ID NO: 7610 - protein, 10 aa, Mycobacterium tuberculosis
AAATYGVVGG

SEQ ID NO: 7611 - protein, 11 aa, Mycobacterium tuberculosis
MTLRVVPEGLA

SEQ ID NO: 7612 - protein, 11 aa, Mycobacterium tuberculosis
TLRVVPEGLAA

SEQ ID NO: 7613 - protein, 11 aa, Mycobacterium tuberculosis
LRVVPEGLAAA

SEQ ID NO: 7614 - protein, 11 aa, Mycobacterium tuberculosis
RVVPEGLAAAS

SEQ ID NO: 7615 - protein, 11 aa, Mycobacterium tuberculosis
VVPEGLAAASA

SEQ ID NO: 7616 - protein, 11 aa, Mycobacterium tuberculosis
VPEGLAAASAA

SEQ ID NO: 7617 - protein, 11 aa, Mycobacterium tuberculosis
PEGLAAASAAV

SEQ ID NO: 7618 - protein, 11 aa, Mycobacterium tuberculosis
EGLAAASAAVE

SEQ ID NO: 7619 - protein, 11 aa, Mycobacterium tuberculosis
GLAAASAAVEA

SEQ ID NO: 7620 - protein, 11 aa, Mycobacterium tuberculosis
LAAASAAVEAL

SEQ ID NO: 7621 - protein, 11 aa, Mycobacterium tuberculosis
AAASAAVEALT

SEQ ID NO: 7622 - protein, 11 aa, Mycobacterium tuberculosis
AASAAVEALTA

SEQ ID NO: 7623 - protein, 11 aa, Mycobacterium tuberculosis
ASAAVEALTAR

SEQ ID NO: 7624 - protein, 11 aa, Mycobacterium tuberculosis
SAAVEALTARL

SEQ ID NO: 7625 - protein, 11 aa, Mycobacterium tuberculosis
AAVEALTARLA

SEQ ID NO: 7626 - protein, 11 aa, Mycobacterium tuberculosis
AVEALTARLAA

SEQ ID NO: 7627 - protein, 11 aa, Mycobacterium tuberculosis
VEALTARLAAA

SEQ ID NO: 7628 - protein, 11 aa, Mycobacterium tuberculosis
EALTARLAAAH

SEQ ID NO: 7629 - protein, 11 aa, Mycobacterium tuberculosis
ALTARLAAAHA

SEQ ID NO: 7630 - protein, 11 aa, Mycobacterium tuberculosis
LTARLAAAHAS

SEQ ID NO: 7631 - protein, 11 aa, Mycobacterium tuberculosis
TARLAAAHASA

SEQ ID NO: 7632 - protein, 11 aa, Mycobacterium tuberculosis
ARLAAAHASAA

SEQ ID NO: 7633 - protein, 11 aa, Mycobacterium tuberculosis
RLAAAHASAAP

SEQ ID NO: 7634 - protein, 11 aa, Mycobacterium tuberculosis
LAAAHASAAPV

SEQ ID NO: 7635 - protein, 11 aa, Mycobacterium tuberculosis
AAAHASAAPVI

SEQ ID NO: 7636 - protein, 11 aa, Mycobacterium tuberculosis
AAHASAAPVIT

SEQ ID NO: 7637 - protein, 11 aa, Mycobacterium tuberculosis
AHASAAPVITA

SEQ ID NO: 7638 - protein, 11 aa, Mycobacterium tuberculosis
HASAAPVITAV

SEQ ID NO: 7639 - protein, 11 aa, Mycobacterium tuberculosis
ASAAPVITAVV

SEQ ID NO: 7640 - protein, 11 aa, Mycobacterium tuberculosis
SAAPVITAVVP

SEQ ID NO: 7641 - protein, 11 aa, Mycobacterium tuberculosis
AAPVITAVVPP

SEQ ID NO: 7642 - protein, 11 aa, Mycobacterium tuberculosis
APVITAVVPPA

SEQ ID NO: 7643 - protein, 11 aa, Mycobacterium tuberculosis
PVITAVVPPAA

SEQ ID NO: 7644 - protein, 11 aa, Mycobacterium tuberculosis
VITAVVPPAAD

SEQ ID NO: 7645 - protein, 11 aa, Mycobacterium tuberculosis
ITAVVPPAADP

SEQ ID NO: 7646 - protein, 11 aa, Mycobacterium tuberculosis
TAVVPPAADPV

SEQ ID NO: 7647 - protein, 11 aa, Mycobacterium tuberculosis
AVVPPAADPVS

SEQ ID NO: 7648 - protein, 11 aa, Mycobacterium tuberculosis
VVPPAADPVSL

SEQ ID NO: 7649 - protein, 11 aa, Mycobacterium tuberculosis
VPPAADPVSLQ

SEQ ID NO: 7650 - protein, 11 aa, Mycobacterium tuberculosis
PPAADPVSLQT

SEQ ID NO: 7651 - protein, 11 aa, Mycobacterium tuberculosis
PAADPVSLQTA

SEQ ID NO: 7652 - protein, 11 aa, Mycobacterium tuberculosis
AADPVSLQTAA

SEQ ID NO: 7653 - protein, 11 aa, Mycobacterium tuberculosis
ADPVSLQTAAG

SEQ ID NO: 7654 - protein, 11 aa, Mycobacterium tuberculosis
DPVSLQTAAGF

SEQ ID NO: 7655 - protein, 11 aa, Mycobacterium tuberculosis
PVSLQTAAGFS

SEQ ID NO: 7656 - protein, 11 aa, Mycobacterium tuberculosis
VSLQTAAGFSA

SEQ ID NO: 7657 - protein, 11 aa, Mycobacterium tuberculosis
SLQTAAGFSAQ

SEQ ID NO: 7658 - protein, 11 aa, Mycobacterium tuberculosis
LQTAAGFSAQG

SEQ ID NO: 7659 - protein, 11 aa, Mycobacterium tuberculosis
QTAAGFSAQGV

SEQ ID NO: 7660 - protein, 11 aa, Mycobacterium tuberculosis
TAAGFSAQGVE

SEQ ID NO: 7661 - protein, 11 aa, Mycobacterium tuberculosis
AAGFSAQGVEH

SEQ ID NO: 7662 - protein, 11 aa, Mycobacterium tuberculosis
AGFSAQGVEHA

SEQ ID NO: 7663 - protein, 11 aa, Mycobacterium tuberculosis
GFSAQGVEHAV

SEQ ID NO: 7664 - protein, 11 aa, Mycobacterium tuberculosis
FSAQGVEHAVV

SEQ ID NO: 7665 - protein, 11 aa, Mycobacterium tuberculosis
SAQGVEHAVVT

SEQ ID NO: 7666 - protein, 11 aa, Mycobacterium tuberculosis
AQGVEHAVVTA

SEQ ID NO: 7667 - protein, 11 aa, Mycobacterium tuberculosis
QGVEHAVVTAE

SEQ ID NO: 7668 - protein, 11 aa, Mycobacterium tuberculosis
GVEHAVVTAEG

SEQ ID NO: 7669 - protein, 11 aa, Mycobacterium tuberculosis
VEHAVVTAEGV

SEQ ID NO: 7670 - protein, 11 aa, Mycobacterium tuberculosis
EHAVVTAEGVE

SEQ ID NO: 7671 - protein, 11 aa, Mycobacterium tuberculosis
HAVVTAEGVEE

SEQ ID NO: 7672 - protein, 11 aa, Mycobacterium tuberculosis
AVVTAEGVEEL

SEQ ID NO: 7673 - protein, 11 aa, Mycobacterium tuberculosis
VVTAEGVEELG

SEQ ID NO: 7674 - protein, 11 aa, Mycobacterium tuberculosis
VTAEGVEELGR

SEQ ID NO: 7675 - protein, 11 aa, Mycobacterium tuberculosis
TAEGVEELGRA

SEQ ID NO: 7676 - protein, 11 aa, Mycobacterium tuberculosis
AEGVEELGRAG

SEQ ID NO: 7677 - protein, 11 aa, Mycobacterium tuberculosis
EGVEELGRAGV

SEQ ID NO: 7678 - protein, 11 aa, Mycobacterium tuberculosis
GVEELGRAGVG

SEQ ID NO: 7679 - protein, 11 aa, Mycobacterium tuberculosis
VEELGRAGVGV

SEQ ID NO: 7680 - protein, 11 aa, Mycobacterium tuberculosis
EELGRAGVGVG

SEQ ID NO: 7681 - protein, 11 aa, Mycobacterium tuberculosis
ELGRAGVGVGE

SEQ ID NO: 7682 - protein, 11 aa, Mycobacterium tuberculosis
LGRAGVGVGES

SEQ ID NO: 7683 - protein, 11 aa, Mycobacterium tuberculosis
GRAGVGVGESG

SEQ ID NO: 7684 - protein, 11 aa, Mycobacterium tuberculosis
RAGVGVGESGA

SEQ ID NO: 7685 - protein, 11 aa, Mycobacterium tuberculosis
AGVGVGESGAS

SEQ ID NO: 7686 - protein, 11 aa, Mycobacterium tuberculosis
GVGVGESGASY

SEQ ID NO: 7687 - protein, 11 aa, Mycobacterium tuberculosis
VGVGESGASYL

SEQ ID NO: 7688 - protein, 11 aa, Mycobacterium tuberculosis
GVGESGASYLA

SEQ ID NO: 7689 - protein, 11 aa, Mycobacterium tuberculosis
VGESGASYLAG

SEQ ID NO: 7690 - protein, 11 aa, Mycobacterium tuberculosis
GESGASYLAGD

SEQ ID NO: 7691 - protein, 11 aa, Mycobacterium tuberculosis
ESGASYLAGDA

SEQ ID NO: 7692 - protein, 11 aa, Mycobacterium tuberculosis
SGASYLAGDAA

SEQ ID NO: 7693 - protein, 11 aa, Mycobacterium tuberculosis
GASYLAGDAAA

SEQ ID NO: 7694 - protein, 11 aa, Mycobacterium tuberculosis
ASYLAGDAAAA

SEQ ID NO: 7695 - protein, 11 aa, Mycobacterium tuberculosis
SYLAGDAAAAA

SEQ ID NO: 7696 - protein, 11 aa, Mycobacterium tuberculosis
YLAGDAAAAAT

SEQ ID NO: 7697 - protein, 11 aa, Mycobacterium tuberculosis
LAGDAAAAATY

SEQ ID NO: 7698 - protein, 11 aa, Mycobacterium tuberculosis
AGDAAAAATYG

SEQ ID NO: 7699 - protein, 11 aa, Mycobacterium tuberculosis
GDAAAAATYGV

SEQ ID NO: 7700 - protein, 11 aa, Mycobacterium tuberculosis
DAAAAATYGVV

SEQ ID NO: 7701 - protein, 11 aa, Mycobacterium tuberculosis
AAAAATYGVVG

SEQ ID NO: 7702 - protein, 11 aa, Mycobacterium tuberculosis
AAAATYGVVGG

SEQ ID NO: 7703 - protein, 8 aa, Mycobacterium tuberculosis
MSLLDAHI

SEQ ID NO: 7704 - protein, 8 aa, Mycobacterium tuberculosis
SLLDAHIP

SEQ ID NO: 7705 - protein, 8 aa, Mycobacterium tuberculosis
LLDAHIPQ

SEQ ID NO: 7706 - protein, 8 aa, Mycobacterium tuberculosis
LDAHIPQL

SEQ ID NO: 7707 - protein, 8 aa, Mycobacterium tuberculosis
DAHIPQLV

SEQ ID NO: 7708 - protein, 8 aa, Mycobacterium tuberculosis
AHIPQLVA

SEQ ID NO: 7709 - protein, 8 aa, Mycobacterium tuberculosis
HIPQLVAS

SEQ ID NO: 7710 - protein, 8 aa, Mycobacterium tuberculosis
IPQLVASQ

SEQ ID NO: 7711 - protein, 8 aa, Mycobacterium tuberculosis
PQLVASQS

SEQ ID NO: 7712 - protein, 8 aa, Mycobacterium tuberculosis
QLVASQSA

SEQ ID NO: 7713 - protein, 8 aa, Mycobacterium tuberculosis
LVASQSAF

SEQ ID NO: 7714 - protein, 8 aa, Mycobacterium tuberculosis
VASQSAFA

SEQ ID NO: 7715 - protein, 8 aa, Mycobacterium tuberculosis
ASQSAFAA

SEQ ID NO: 7716 - protein, 8 aa, Mycobacterium tuberculosis
SQSAFAAK

SEQ ID NO: 7717 - protein, 8 aa, Mycobacterium tuberculosis
QSAFAAKA

SEQ ID NO: 7718 - protein, 8 aa, Mycobacterium tuberculosis
SAFAAKAG

SEQ ID NO: 7719 - protein, 8 aa, Mycobacterium tuberculosis
AFAAKAGL

SEQ ID NO: 7720 - protein, 8 aa, Mycobacterium tuberculosis
FAAKAGLM

SEQ ID NO: 7721 - protein, 8 aa, Mycobacterium tuberculosis
AAKAGLMR

SEQ ID NO: 7722 - protein, 8 aa, Mycobacterium tuberculosis
AKAGLMRH

SEQ ID NO: 7723 - protein, 8 aa, Mycobacterium tuberculosis
KAGLMRHT

SEQ ID NO: 7724 - protein, 8 aa, Mycobacterium tuberculosis
AGLMRHTI

SEQ ID NO: 7725 - protein, 8 aa, Mycobacterium tuberculosis
GLMRHTIG

SEQ ID NO: 7726 - protein, 8 aa, Mycobacterium tuberculosis
LMRHTIGQ

SEQ ID NO: 7727 - protein, 8 aa, Mycobacterium tuberculosis
MRHTIGQA

SEQ ID NO: 7728 - protein, 8 aa, Mycobacterium tuberculosis
RHTIGQAE

SEQ ID NO: 7729 - protein, 8 aa, Mycobacterium tuberculosis
HTIGQAEQ

SEQ ID NO: 7730 - protein, 8 aa, Mycobacterium tuberculosis
TIGQAEQA

SEQ ID NO: 7731 - protein, 8 aa, Mycobacterium tuberculosis
IGQAEQAA

SEQ ID NO: 7732 - protein, 8 aa, Mycobacterium tuberculosis
GQAEQAAM

SEQ ID NO: 7733 - protein, 8 aa, Mycobacterium tuberculosis
QAEQAAMS

SEQ ID NO: 7734 - protein, 8 aa, Mycobacterium tuberculosis
AEQAAMSA

SEQ ID NO: 7735 - protein, 8 aa, Mycobacterium tuberculosis
EQAAMSAQ

SEQ ID NO: 7736 - protein, 8 aa, Mycobacterium tuberculosis
QAAMSAQA

SEQ ID NO: 7737 - protein, 8 aa, Mycobacterium tuberculosis
AAMSAQAF

SEQ ID NO: 7738 - protein, 8 aa, Mycobacterium tuberculosis
AMSAQAFH

SEQ ID NO: 7739 - protein, 8 aa, Mycobacterium tuberculosis
MSAQAFHQ

SEQ ID NO: 7740 - protein, 8 aa, Mycobacterium tuberculosis
SAQAFHQG

SEQ ID NO: 7741 - protein, 8 aa, Mycobacterium tuberculosis
AQAFHQGE

SEQ ID NO: 7742 - protein, 8 aa, Mycobacterium tuberculosis
QAFHQGES

SEQ ID NO: 7743 - protein, 8 aa, Mycobacterium tuberculosis
AFHQGESS

SEQ ID NO: 7744 - protein, 8 aa, Mycobacterium tuberculosis
FHQGESSA

SEQ ID NO: 7745 - protein, 8 aa, Mycobacterium tuberculosis
HQGESSAA

SEQ ID NO: 7746 - protein, 8 aa, Mycobacterium tuberculosis
QGESSAAF

SEQ ID NO: 7747 - protein, 8 aa, Mycobacterium tuberculosis
GESSAAFQ

SEQ ID NO: 7748 - protein, 8 aa, Mycobacterium tuberculosis
ESSAAFQA

SEQ ID NO: 7749 - protein, 8 aa, Mycobacterium tuberculosis
SSAAFQAA

SEQ ID NO: 7750 - protein, 8 aa, Mycobacterium tuberculosis
SAAFQAAH

SEQ ID NO: 7751 - protein, 8 aa, Mycobacterium tuberculosis
AAFQAAHA

SEQ ID NO: 7752 - protein, 8 aa, Mycobacterium tuberculosis
AFQAAHAR

SEQ ID NO: 7753 - protein, 8 aa, Mycobacterium tuberculosis
FQAAHARF

SEQ ID NO: 7754 - protein, 8 aa, Mycobacterium tuberculosis
QAAHARFV

SEQ ID NO: 7755 - protein, 8 aa, Mycobacterium tuberculosis
AAHARFVA

SEQ ID NO: 7756 - protein, 8 aa, Mycobacterium tuberculosis
AHARFVAA

SEQ ID NO: 7757 - protein, 8 aa, Mycobacterium tuberculosis
HARFVAAA

SEQ ID NO: 7758 - protein, 8 aa, Mycobacterium tuberculosis
ARFVAAAA

SEQ ID NO: 7759 - protein, 8 aa, Mycobacterium tuberculosis
RFVAAAAK

SEQ ID NO: 7760 - protein, 8 aa, Mycobacterium tuberculosis
FVAAAAKV

SEQ ID NO: 7761 - protein, 8 aa, Mycobacterium tuberculosis
VAAAAKVN

SEQ ID NO: 7762 - protein, 8 aa, Mycobacterium tuberculosis
AAAAKVNT

SEQ ID NO: 7763 - protein, 8 aa, Mycobacterium tuberculosis
AAAKVNTL

SEQ ID NO: 7764 - protein, 8 aa, Mycobacterium tuberculosis
AAKVNTLL

SEQ ID NO: 7765 - protein, 8 aa, Mycobacterium tuberculosis
AKVNTLLD

SEQ ID NO: 7766 - protein, 8 aa, Mycobacterium tuberculosis
KVNTLLDV

SEQ ID NO: 7767 - protein, 8 aa, Mycobacterium tuberculosis
VNTLLDVA

SEQ ID NO: 7768 - protein, 8 aa, Mycobacterium tuberculosis
NTLLDVAQ

SEQ ID NO: 7769 - protein, 8 aa, Mycobacterium tuberculosis
TLLDVAQA

SEQ ID NO: 7770 - protein, 8 aa, Mycobacterium tuberculosis
LLDVAQAN

SEQ ID NO: 7771 - protein, 8 aa, Mycobacterium tuberculosis
LDVAQANL

SEQ ID NO: 7772 - protein, 8 aa, Mycobacterium tuberculosis
DVAQANLG

SEQ ID NO: 7773 - protein, 8 aa, Mycobacterium tuberculosis
VAQANLGE

SEQ ID NO: 7774 - protein, 8 aa, Mycobacterium tuberculosis
AQANLGEA

SEQ ID NO: 7775 - protein, 8 aa, Mycobacterium tuberculosis
QANLGEAA

SEQ ID NO: 7776 - protein, 8 aa, Mycobacterium tuberculosis
ANLGEAAG

SEQ ID NO: 7777 - protein, 8 aa, Mycobacterium tuberculosis
NLGEAAGT

SEQ ID NO: 7778 - protein, 8 aa, Mycobacterium tuberculosis
LGEAAGTY

SEQ ID NO: 7779 - protein, 8 aa, Mycobacterium tuberculosis
GEAAGTYV

SEQ ID NO: 7780 - protein, 8 aa, Mycobacterium tuberculosis
EAAGTYVA

SEQ ID NO: 7781 - protein, 8 aa, Mycobacterium tuberculosis
AAGTYVAA

SEQ ID NO: 7782 - protein, 8 aa, Mycobacterium tuberculosis
AGTYVAAD

SEQ ID NO: 7783 - protein, 8 aa, Mycobacterium tuberculosis
GTYVAADA

SEQ ID NO: 7784 - protein, 8 aa, Mycobacterium tuberculosis
TYVAADAA

SEQ ID NO: 7785 - protein, 8 aa, Mycobacterium tuberculosis
YVAADAAA

SEQ ID NO: 7786 - protein, 8 aa, Mycobacterium tuberculosis
VAADAAAA

SEQ ID NO: 7787 - protein, 8 aa, Mycobacterium tuberculosis
AADAAAAS

SEQ ID NO: 7788 - protein, 8 aa, Mycobacterium tuberculosis
ADAAAAST

SEQ ID NO: 7789 - protein, 8 aa, Mycobacterium tuberculosis
DAAAASTY

SEQ ID NO: 7790 - protein, 8 aa, Mycobacterium tuberculosis
AAAASTYT

SEQ ID NO: 7791 - protein, 8 aa, Mycobacterium tuberculosis
AAASTYTG

SEQ ID NO: 7792 - protein, 8 aa, Mycobacterium tuberculosis
AASTYTGF

SEQ ID NO: 7793 - protein, 9 aa, Mycobacterium tuberculosis
MSLLDAHIP

SEQ ID NO: 7794 - protein, 9 aa, Mycobacterium tuberculosis
SLLDAHIPQ

SEQ ID NO: 7795 - protein, 9 aa, Mycobacterium tuberculosis
LLDAHIPQL

SEQ ID NO: 7796 - protein, 9 aa, Mycobacterium tuberculosis
LDAHIPQLV

SEQ ID NO: 7797 - protein, 9 aa, Mycobacterium tuberculosis
DAHIPQLVA

SEQ ID NO: 7798 - protein, 9 aa, Mycobacterium tuberculosis
AHIPQLVAS

SEQ ID NO: 7799 - protein, 9 aa, Mycobacterium tuberculosis
HIPQLVASQ

SEQ ID NO: 7800 - protein, 9 aa, Mycobacterium tuberculosis
IPQLVASQS

SEQ ID NO: 7801 - protein, 9 aa, Mycobacterium tuberculosis
PQLVASQSA

SEQ ID NO: 7802 - protein, 9 aa, Mycobacterium tuberculosis
QLVASQSAF

SEQ ID NO: 7803 - protein, 9 aa, Mycobacterium tuberculosis
LVASQSAFA

SEQ ID NO: 7804 - protein, 9 aa, Mycobacterium tuberculosis
VASQSAFAA

SEQ ID NO: 7805 - protein, 9 aa, Mycobacterium tuberculosis
ASQSAFAAK

SEQ ID NO: 7806 - protein, 9 aa, Mycobacterium tuberculosis
SQSAFAAKA

SEQ ID NO: 7807 - protein, 9 aa, Mycobacterium tuberculosis
QSAFAAKAG

SEQ ID NO: 7808 - protein, 9 aa, Mycobacterium tuberculosis
SAFAAKAGL

SEQ ID NO: 7809 - protein, 9 aa, Mycobacterium tuberculosis
AFAAKAGLM

SEQ ID NO: 7810 - protein, 9 aa, Mycobacterium tuberculosis
FAAKAGLMR

SEQ ID NO: 7811 - protein, 9 aa, Mycobacterium tuberculosis
AAKAGLMRH

SEQ ID NO: 7812 - protein, 9 aa, Mycobacterium tuberculosis
AKAGLMRHT

SEQ ID NO: 7813 - protein, 9 aa, Mycobacterium tuberculosis
KAGLMRHTI

SEQ ID NO: 7814 - protein, 9 aa, Mycobacterium tuberculosis
AGLMRHTIG

SEQ ID NO: 7815 - protein, 9 aa, Mycobacterium tuberculosis
GLMRHTIGQ

SEQ ID NO: 7816 - protein, 9 aa, Mycobacterium tuberculosis
LMRHTIGQA

SEQ ID NO: 7817 - protein, 9 aa, Mycobacterium tuberculosis
MRHTIGQAE

SEQ ID NO: 7818 - protein, 9 aa, Mycobacterium tuberculosis
RHTIGQAEQ

SEQ ID NO: 7819 - protein, 9 aa, Mycobacterium tuberculosis
HTIGQAEQA

SEQ ID NO: 7820 - protein, 9 aa, Mycobacterium tuberculosis
TIGQAEQAA

SEQ ID NO: 7821 - protein, 9 aa, Mycobacterium tuberculosis
IGQAEQAAM

SEQ ID NO: 7822 - protein, 9 aa, Mycobacterium tuberculosis
GQAEQAAMS

SEQ ID NO: 7823 - protein, 9 aa, Mycobacterium tuberculosis
QAEQAAMSA

SEQ ID NO: 7824 - protein, 9 aa, Mycobacterium tuberculosis
AEQAAMSAQ

SEQ ID NO: 7825 - protein, 9 aa, Mycobacterium tuberculosis
EQAAMSAQA

SEQ ID NO: 7826 - protein, 9 aa, Mycobacterium tuberculosis
QAAMSAQAF

SEQ ID NO: 7827 - protein, 9 aa, Mycobacterium tuberculosis
AAMSAQAFH

SEQ ID NO: 7828 - protein, 9 aa, Mycobacterium tuberculosis
AMSAQAFHQ

SEQ ID NO: 7829 - protein, 9 aa, Mycobacterium tuberculosis
MSAQAFHQG

SEQ ID NO: 7830 - protein, 9 aa, Mycobacterium tuberculosis
SAQAFHQGE

SEQ ID NO: 7831 - protein, 9 aa, Mycobacterium tuberculosis
AQAFHQGES

SEQ ID NO: 7832 - protein, 9 aa, Mycobacterium tuberculosis
QAFHQGESS

SEQ ID NO: 7833 - protein, 9 aa, Mycobacterium tuberculosis
AFHQGESSA

SEQ ID NO: 7834 - protein, 9 aa, Mycobacterium tuberculosis
FHQGESSAA

SEQ ID NO: 7835 - protein, 9 aa, Mycobacterium tuberculosis
HQGESSAAF

SEQ ID NO: 7836 - protein, 9 aa, Mycobacterium tuberculosis
QGESSAAFQ

SEQ ID NO: 7837 - protein, 9 aa, Mycobacterium tuberculosis
GESSAAFQA

SEQ ID NO: 7838 - protein, 9 aa, Mycobacterium tuberculosis
ESSAAFQAA

SEQ ID NO: 7839 - protein, 9 aa, Mycobacterium tuberculosis
SSAAFQAAH

SEQ ID NO: 7840 - protein, 9 aa, Mycobacterium tuberculosis
SAAFQAAHA

SEQ ID NO: 7841 - protein, 9 aa, Mycobacterium tuberculosis
AAFQAAHAR

SEQ ID NO: 7842 - protein, 9 aa, Mycobacterium tuberculosis
AFQAAHARF

SEQ ID NO: 7843 - protein, 9 aa, Mycobacterium tuberculosis
FQAAHARFV

SEQ ID NO: 7844 - protein, 9 aa, Mycobacterium tuberculosis
QAAHARFVA

SEQ ID NO: 7845 - protein, 9 aa, Mycobacterium tuberculosis
AAHARFVAA

SEQ ID NO: 7846 - protein, 9 aa, Mycobacterium tuberculosis
AHARFVAAA

SEQ ID NO: 7847 - protein, 9 aa, Mycobacterium tuberculosis
HARFVAAAA

SEQ ID NO: 7848 - protein, 9 aa, Mycobacterium tuberculosis
ARFVAAAAK

SEQ ID NO: 7849 - protein, 9 aa, Mycobacterium tuberculosis
RFVAAAAKV

SEQ ID NO: 7850 - protein, 9 aa, Mycobacterium tuberculosis
FVAAAAKVN

SEQ ID NO: 7851 - protein, 9 aa, Mycobacterium tuberculosis
VAAAAKVNT

SEQ ID NO: 7852 - protein, 9 aa, Mycobacterium tuberculosis
AAAAKVNTL

SEQ ID NO: 7853 - protein, 9 aa, Mycobacterium tuberculosis
AAAKVNTLL

SEQ ID NO: 7854 - protein, 9 aa, Mycobacterium tuberculosis
AAKVNTLLD

SEQ ID NO: 7855 - protein, 9 aa, Mycobacterium tuberculosis
AKVNTLLDV

SEQ ID NO: 7856 - protein, 9 aa, Mycobacterium tuberculosis
KVNTLLDVA

SEQ ID NO: 7857 - protein, 9 aa, Mycobacterium tuberculosis
VNTLLDVAQ

SEQ ID NO: 7858 - protein, 9 aa, Mycobacterium tuberculosis
NTLLDVAQA

SEQ ID NO: 7859 - protein, 9 aa, Mycobacterium tuberculosis
TLLDVAQAN

SEQ ID NO: 7860 - protein, 9 aa, Mycobacterium tuberculosis
LLDVAQANL

SEQ ID NO: 7861 - protein, 9 aa, Mycobacterium tuberculosis
LDVAQANLG

SEQ ID NO: 7862 - protein, 9 aa, Mycobacterium tuberculosis
DVAQANLGE

SEQ ID NO: 7863 - protein, 9 aa, Mycobacterium tuberculosis
VAQANLGEA

SEQ ID NO: 7864 - protein, 9 aa, Mycobacterium tuberculosis
AQANLGEAA

SEQ ID NO: 7865 - protein, 9 aa, Mycobacterium tuberculosis
QANLGEAAG

SEQ ID NO: 7866 - protein, 9 aa, Mycobacterium tuberculosis
ANLGEAAGT

SEQ ID NO: 7867 - protein, 9 aa, Mycobacterium tuberculosis
NLGEAAGTY

SEQ ID NO: 7868 - protein, 9 aa, Mycobacterium tuberculosis
LGEAAGTYV

SEQ ID NO: 7869 - protein, 9 aa, Mycobacterium tuberculosis
GEAAGTYVA

SEQ ID NO: 7870 - protein, 9 aa, Mycobacterium tuberculosis
EAAGTYVAA

SEQ ID NO: 7871 - protein, 9 aa, Mycobacterium tuberculosis
AAGTYVAAD

SEQ ID NO: 7872 - protein, 9 aa, Mycobacterium tuberculosis
AGTYVAADA

SEQ ID NO: 7873 - protein, 9 aa, Mycobacterium tuberculosis
GTYVAADAA

SEQ ID NO: 7874 - protein, 9 aa, Mycobacterium tuberculosis
TYVAADAAA

SEQ ID NO: 7875 - protein, 9 aa, Mycobacterium tuberculosis
YVAADAAAA

SEQ ID NO: 7876 - protein, 9 aa, Mycobacterium tuberculosis
VAADAAAAS

SEQ ID NO: 7877 - protein, 9 aa, Mycobacterium tuberculosis
AADAAAAST

SEQ ID NO: 7878 - protein, 9 aa, Mycobacterium tuberculosis
ADAAAASTY

SEQ ID NO: 7879 - protein, 9 aa, Mycobacterium tuberculosis
DAAAASTYT

SEQ ID NO: 7880 - protein, 9 aa, Mycobacterium tuberculosis
AAAASTYTG

SEQ ID NO: 7881 - protein, 9 aa, Mycobacterium tuberculosis
AAASTYTGF

SEQ ID NO: 7882 - protein, 10 aa, Mycobacterium tuberculosis
MSLLDAHIPQ

SEQ ID NO: 7883 - protein, 10 aa, Mycobacterium tuberculosis
SLLDAHIPQL

SEQ ID NO: 7884 - protein, 10 aa, Mycobacterium tuberculosis
LLDAHIPQLV

SEQ ID NO: 7885 - protein, 10 aa, Mycobacterium tuberculosis
LDAHIPQLVA

SEQ ID NO: 7886 - protein, 10 aa, Mycobacterium tuberculosis
DAHIPQLVAS

SEQ ID NO: 7887 - protein, 10 aa, Mycobacterium tuberculosis
AHIPQLVASQ

SEQ ID NO: 7888 - protein, 10 aa, Mycobacterium tuberculosis
HIPQLVASQS

SEQ ID NO: 7889 - protein, 10 aa, Mycobacterium tuberculosis
IPQLVASQSA

SEQ ID NO: 7890 - protein, 10 aa, Mycobacterium tuberculosis
PQLVASQSAF

SEQ ID NO: 7891 - protein, 10 aa, Mycobacterium tuberculosis
QLVASQSAFA

SEQ ID NO: 7892 - protein, 10 aa, Mycobacterium tuberculosis
LVASQSAFAA

SEQ ID NO: 7893 - protein, 10 aa, Mycobacterium tuberculosis
VASQSAFAAK

SEQ ID NO: 7894 - protein, 10 aa, Mycobacterium tuberculosis
ASQSAFAAKA

SEQ ID NO: 7895 - protein, 10 aa, Mycobacterium tuberculosis
SQSAFAAKAG

SEQ ID NO: 7896 - protein, 10 aa, Mycobacterium tuberculosis
QSAFAAKAGL

SEQ ID NO: 7897 - protein, 10 aa, Mycobacterium tuberculosis
SAFAAKAGLM

SEQ ID NO: 7898 - protein, 10 aa, Mycobacterium tuberculosis
AFAAKAGLMR

SEQ ID NO: 7899 - protein, 10 aa, Mycobacterium tuberculosis
FAAKAGLMRH

SEQ ID NO: 7900 - protein, 10 aa, Mycobacterium tuberculosis
AAKAGLMRHT

SEQ ID NO: 7901 - protein, 10 aa, Mycobacterium tuberculosis
AKAGLMRHTI

SEQ ID NO: 7902 - protein, 10 aa, Mycobacterium tuberculosis
KAGLMRHTIG

SEQ ID NO: 7903 - protein, 10 aa, Mycobacterium tuberculosis
AGLMRHTIGQ

SEQ ID NO: 7904 - protein, 10 aa, Mycobacterium tuberculosis
GLMRHTIGQA

SEQ ID NO: 7905 - protein, 10 aa, Mycobacterium tuberculosis
LMRHTIGQAE

SEQ ID NO: 7906 - protein, 10 aa, Mycobacterium tuberculosis
MRHTIGQAEQ

SEQ ID NO: 7907 - protein, 10 aa, Mycobacterium tuberculosis
RHTIGQAEQA

SEQ ID NO: 7908 - protein, 10 aa, Mycobacterium tuberculosis
HTIGQAEQAA

SEQ ID NO: 7909 - protein, 10 aa, Mycobacterium tuberculosis
TIGQAEQAAM

SEQ ID NO: 7910 - protein, 10 aa, Mycobacterium tuberculosis
IGQAEQAAMS

SEQ ID NO: 7911 - protein, 10 aa, Mycobacterium tuberculosis
GQAEQAAMSA

SEQ ID NO: 7912 - protein, 10 aa, Mycobacterium tuberculosis
QAEQAAMSAQ

SEQ ID NO: 7913 - protein, 10 aa, Mycobacterium tuberculosis
AEQAAMSAQA

SEQ ID NO: 7914 - protein, 10 aa, Mycobacterium tuberculosis
EQAAMSAQAF

SEQ ID NO: 7915 - protein, 10 aa, Mycobacterium tuberculosis
QAAMSAQAFH

SEQ ID NO: 7916 - protein, 10 aa, Mycobacterium tuberculosis
AAMSAQAFHQ

SEQ ID NO: 7917 - protein, 10 aa, Mycobacterium tuberculosis
AMSAQAFHQG

SEQ ID NO: 7918 - protein, 10 aa, Mycobacterium tuberculosis
MSAQAFHQGE

SEQ ID NO: 7919 - protein, 10 aa, Mycobacterium tuberculosis
SAQAFHQGES

SEQ ID NO: 7920 - protein, 10 aa, Mycobacterium tuberculosis
AQAFHQGESS

SEQ ID NO: 7921 - protein, 10 aa, Mycobacterium tuberculosis
QAFHQGESSA

SEQ ID NO: 7922 - protein, 10 aa, Mycobacterium tuberculosis
AFHQGESSAA

SEQ ID NO: 7923 - protein, 10 aa, Mycobacterium tuberculosis
FHQGESSAAF

SEQ ID NO: 7924 - protein, 10 aa, Mycobacterium tuberculosis
HQGESSAAFQ

SEQ ID NO: 7925 - protein, 10 aa, Mycobacterium tuberculosis
QGESSAAFQA

SEQ ID NO: 7926 - protein, 10 aa, Mycobacterium tuberculosis
GESSAAFQAA

SEQ ID NO: 7927 - protein, 10 aa, Mycobacterium tuberculosis
ESSAAFQAAH

SEQ ID NO: 7928 - protein, 10 aa, Mycobacterium tuberculosis
SSAAFQAAHA

SEQ ID NO: 7929 - protein, 10 aa, Mycobacterium tuberculosis
SAAFQAAHAR

SEQ ID NO: 7930 - protein, 10 aa, Mycobacterium tuberculosis
AAFQAAHARF

SEQ ID NO: 7931 - protein, 10 aa, Mycobacterium tuberculosis
AFQAAHARFV

SEQ ID NO: 7932 - protein, 10 aa, Mycobacterium tuberculosis
FQAAHARFVA

SEQ ID NO: 7933 - protein, 10 aa, Mycobacterium tuberculosis
QAAHARFVAA

SEQ ID NO: 7934 - protein, 10 aa, Mycobacterium tuberculosis
AAHARFVAAA

SEQ ID NO: 7935 - protein, 10 aa, Mycobacterium tuberculosis
AHARFVAAAA

SEQ ID NO: 7936 - protein, 10 aa, Mycobacterium tuberculosis
HARFVAAAAK

SEQ ID NO: 7937 - protein, 10 aa, Mycobacterium tuberculosis
ARFVAAAAKV

SEQ ID NO: 7938 - protein, 10 aa, Mycobacterium tuberculosis
RFVAAAAKVN

SEQ ID NO: 7939 - protein, 10 aa, Mycobacterium tuberculosis
FVAAAAKVNT

SEQ ID NO: 7940 - protein, 10 aa, Mycobacterium tuberculosis
VAAAAKVNTL

SEQ ID NO: 7941 - protein, 10 aa, Mycobacterium tuberculosis
AAAAKVNTLL

SEQ ID NO: 7942 - protein, 10 aa, Mycobacterium tuberculosis
AAAKVNTLLD

SEQ ID NO: 7943 - protein, 10 aa, Mycobacterium tuberculosis
AAKVNTLLDV

SEQ ID NO: 7944 - protein, 10 aa, Mycobacterium tuberculosis
AKVNTLLDVA

SEQ ID NO: 7945 - protein, 10 aa, Mycobacterium tuberculosis
KVNTLLDVAQ

SEQ ID NO: 7946 - protein, 10 aa, Mycobacterium tuberculosis
VNTLLDVAQA

SEQ ID NO: 7947 - protein, 10 aa, Mycobacterium tuberculosis
NTLLDVAQAN

SEQ ID NO: 7948 - protein, 10 aa, Mycobacterium tuberculosis
TLLDVAQANL

SEQ ID NO: 7949 - protein, 10 aa, Mycobacterium tuberculosis
LLDVAQANLG

SEQ ID NO: 7950 - protein, 10 aa, Mycobacterium tuberculosis
LDVAQANLGE

SEQ ID NO: 7951 - protein, 10 aa, Mycobacterium tuberculosis
DVAQANLGEA

SEQ ID NO: 7952 - protein, 10 aa, Mycobacterium tuberculosis
VAQANLGEAA

SEQ ID NO: 7953 - protein, 10 aa, Mycobacterium tuberculosis
AQANLGEAAG

SEQ ID NO: 7954 - protein, 10 aa, Mycobacterium tuberculosis
QANLGEAAGT

SEQ ID NO: 7955 - protein, 10 aa, Mycobacterium tuberculosis
ANLGEAAGTY

SEQ ID NO: 7956 - protein, 10 aa, Mycobacterium tuberculosis
NLGEAAGTYV

SEQ ID NO: 7957 - protein, 10 aa, Mycobacterium tuberculosis
LGEAAGTYVA

SEQ ID NO: 7958 - protein, 10 aa, Mycobacterium tuberculosis
GEAAGTYVAA

SEQ ID NO: 7959 - protein, 10 aa, Mycobacterium tuberculosis
EAAGTYVAAD

SEQ ID NO: 7960 - protein, 10 aa, Mycobacterium tuberculosis
AAGTYVAADA

SEQ ID NO: 7961 - protein, 10 aa, Mycobacterium tuberculosis
AGTYVAADAA

SEQ ID NO: 7962 - protein, 10 aa, Mycobacterium tuberculosis
GTYVAADAAA

SEQ ID NO: 7963 - protein, 10 aa, Mycobacterium tuberculosis
TYVAADAAAA

SEQ ID NO: 7964 - protein, 10 aa, Mycobacterium tuberculosis
YVAADAAAAS

SEQ ID NO: 7965 - protein, 10 aa, Mycobacterium tuberculosis
VAADAAAAST

SEQ ID NO: 7966 - protein, 10 aa, Mycobacterium tuberculosis
AADAAAASTY

SEQ ID NO: 7967 - protein, 10 aa, Mycobacterium tuberculosis
ADAAAASTYT

SEQ ID NO: 7968 - protein, 10 aa, Mycobacterium tuberculosis
DAAAASTYTG

SEQ ID NO: 7969 - protein, 10 aa, Mycobacterium tuberculosis
AAAASTYTGF

SEQ ID NO: 7970 - protein, 11 aa, Mycobacterium tuberculosis
MSLLDAHIPQL

SEQ ID NO: 7971 - protein, 11 aa, Mycobacterium tuberculosis
SLLDAHIPQLV

SEQ ID NO: 7972 - protein, 11 aa, Mycobacterium tuberculosis
LLDAHIPQLVA

SEQ ID NO: 7973 - protein, 11 aa, Mycobacterium tuberculosis
LDAHIPQLVAS

SEQ ID NO: 7974 - protein, 11 aa, Mycobacterium tuberculosis
DAHIPQLVASQ

SEQ ID NO: 7975 - protein, 11 aa, Mycobacterium tuberculosis
AHIPQLVASQS

SEQ ID NO: 7976 - protein, 11 aa, Mycobacterium tuberculosis
HIPQLVASQSA

SEQ ID NO: 7977 - protein, 11 aa, Mycobacterium tuberculosis
IPQLVASQSAF

SEQ ID NO: 7978 - protein, 11 aa, Mycobacterium tuberculosis
PQLVASQSAFA

SEQ ID NO: 7979 - protein, 11 aa, Mycobacterium tuberculosis
QLVASQSAFAA

SEQ ID NO: 7980 - protein, 11 aa, Mycobacterium tuberculosis
LVASQSAFAAK

SEQ ID NO: 7981 - protein, 11 aa, Mycobacterium tuberculosis
VASQSAFAAKA

SEQ ID NO: 7982 - protein, 11 aa, Mycobacterium tuberculosis
ASQSAFAAKAG

SEQ ID NO: 7983 - protein, 11 aa, Mycobacterium tuberculosis
SQSAFAAKAGL

SEQ ID NO: 7984 - protein, 11 aa, Mycobacterium tuberculosis
QSAFAAKAGLM

SEQ ID NO: 7985 - protein, 11 aa, Mycobacterium tuberculosis
SAFAAKAGLMR

SEQ ID NO: 7986 - protein, 11 aa, Mycobacterium tuberculosis
AFAAKAGLMRH

SEQ ID NO: 7987 - protein, 11 aa, Mycobacterium tuberculosis
FAAKAGLMRHT

SEQ ID NO: 7988 - protein, 11 aa, Mycobacterium tuberculosis
AAKAGLMRHTI

SEQ ID NO: 7989 - protein, 11 aa, Mycobacterium tuberculosis
AKAGLMRHTIG

SEQ ID NO: 7990 - protein, 11 aa, Mycobacterium tuberculosis
KAGLMRHTIGQ

SEQ ID NO: 7991 - protein, 11 aa, Mycobacterium tuberculosis
AGLMRHTIGQA

SEQ ID NO: 7992 - protein, 11 aa, Mycobacterium tuberculosis
GLMRHTIGQAE

SEQ ID NO: 7993 - protein, 11 aa, Mycobacterium tuberculosis
LMRHTIGQAEQ

SEQ ID NO: 7994 - protein, 11 aa, Mycobacterium tuberculosis
MRHTIGQAEQA

SEQ ID NO: 7995 - protein, 11 aa, Mycobacterium tuberculosis
RHTIGQAEQAA

SEQ ID NO: 7996 - protein, 11 aa, Mycobacterium tuberculosis
HTIGQAEQAAM

SEQ ID NO: 7997 - protein, 11 aa, Mycobacterium tuberculosis
TIGQAEQAAMS

SEQ ID NO: 7998 - protein, 11 aa, Mycobacterium tuberculosis
IGQAEQAAMSA

SEQ ID NO: 7999 - protein, 11 aa, Mycobacterium tuberculosis
GQAEQAAMSAQ

SEQ ID NO: 8000 - protein, 11 aa, Mycobacterium tuberculosis
QAEQAAMSAQA

SEQ ID NO: 8001 - protein, 11 aa, Mycobacterium tuberculosis
AEQAAMSAQAF

SEQ ID NO: 8002 - protein, 11 aa, Mycobacterium tuberculosis
EQAAMSAQAFH

SEQ ID NO: 8003 - protein, 11 aa, Mycobacterium tuberculosis
QAAMSAQAFHQ

SEQ ID NO: 8004 - protein, 11 aa, Mycobacterium tuberculosis
AAMSAQAFHQG

SEQ ID NO: 8005 - protein, 11 aa, Mycobacterium tuberculosis
AMSAQAFHQGE

SEQ ID NO: 8006 - protein, 11 aa, Mycobacterium tuberculosis
MSAQAFHQGES

SEQ ID NO: 8007 - protein, 11 aa, Mycobacterium tuberculosis
SAQAFHQGESS

SEQ ID NO: 8008 - protein, 11 aa, Mycobacterium tuberculosis
AQAFHQGESSA

SEQ ID NO: 8009 - protein, 11 aa, Mycobacterium tuberculosis
QAFHQGESSAA

SEQ ID NO: 8010 - protein, 11 aa, Mycobacterium tuberculosis
AFHQGESSAAF

SEQ ID NO: 8011 - protein, 11 aa, Mycobacterium tuberculosis
FHQGESSAAFQ

SEQ ID NO: 8012 - protein, 11 aa, Mycobacterium tuberculosis
HQGESSAAFQA

SEQ ID NO: 8013 - protein, 11 aa, Mycobacterium tuberculosis
QGESSAAFQAA

SEQ ID NO: 8014 - protein, 11 aa, Mycobacterium tuberculosis
GESSAAFQAAH

SEQ ID NO: 8015 - protein, 11 aa, Mycobacterium tuberculosis
ESSAAFQAAHA

SEQ ID NO: 8016 - protein, 11 aa, Mycobacterium tuberculosis
SSAAFQAAHAR

SEQ ID NO: 8017 - protein, 11 aa, Mycobacterium tuberculosis
SAAFQAAHARF

SEQ ID NO: 8018 - protein, 11 aa, Mycobacterium tuberculosis
AAFQAAHARFV

SEQ ID NO: 8019 - protein, 11 aa, Mycobacterium tuberculosis
AFQAAHARFVA

SEQ ID NO: 8020 - protein, 11 aa, Mycobacterium tuberculosis
FQAAHARFVAA

SEQ ID NO: 8021 - protein, 11 aa, Mycobacterium tuberculosis
QAAHARFVAAA

SEQ ID NO: 8022 - protein, 11 aa, Mycobacterium tuberculosis
AAHARFVAAAA

SEQ ID NO: 8023 - protein, 11 aa, Mycobacterium tuberculosis
AHARFVAAAAK

SEQ ID NO: 8024 - protein, 11 aa, Mycobacterium tuberculosis
HARFVAAAAKV

SEQ ID NO: 8025 - protein, 11 aa, Mycobacterium tuberculosis
ARFVAAAAKVN

SEQ ID NO: 8026 - protein, 11 aa, Mycobacterium tuberculosis
RFVAAAAKVNT

SEQ ID NO: 8027 - protein, 11 aa, Mycobacterium tuberculosis
FVAAAAKVNTL

SEQ ID NO: 8028 - protein, 11 aa, Mycobacterium tuberculosis
VAAAAKVNTLL

SEQ ID NO: 8029 - protein, 11 aa, Mycobacterium tuberculosis
AAAAKVNTLLD

SEQ ID NO: 8030 - protein, 11 aa, Mycobacterium tuberculosis
AAAKVNTLLDV

SEQ ID NO: 8031 - protein, 11 aa, Mycobacterium tuberculosis
AAKVNTLLDVA

SEQ ID NO: 8032 - protein, 11 aa, Mycobacterium tuberculosis
AKVNTLLDVAQ

SEQ ID NO: 8033 - protein, 11 aa, Mycobacterium tuberculosis
KVNTLLDVAQA

SEQ ID NO: 8034 - protein, 11 aa, Mycobacterium tuberculosis
VNTLLDVAQAN

SEQ ID NO: 8035 - protein, 11 aa, Mycobacterium tuberculosis
NTLLDVAQANL

SEQ ID NO: 8036 - protein, 11 aa, Mycobacterium tuberculosis
TLLDVAQANLG

SEQ ID NO: 8037 - protein, 11 aa, Mycobacterium tuberculosis
LLDVAQANLGE

SEQ ID NO: 8038 - protein, 11 aa, Mycobacterium tuberculosis
LDVAQANLGEA

SEQ ID NO: 8039 - protein, 11 aa, Mycobacterium tuberculosis
DVAQANLGEAA

SEQ ID NO: 8040 - protein, 11 aa, Mycobacterium tuberculosis
VAQANLGEAAG

SEQ ID NO: 8041 - protein, 11 aa, Mycobacterium tuberculosis
AQANLGEAAGT

SEQ ID NO: 8042 - protein, 11 aa, Mycobacterium tuberculosis
QANLGEAAGTY

SEQ ID NO: 8043 - protein, 11 aa, Mycobacterium tuberculosis
ANLGEAAGTYV

SEQ ID NO: 8044 - protein, 11 aa, Mycobacterium tuberculosis
NLGEAAGTYVA

SEQ ID NO: 8045 - protein, 11 aa, Mycobacterium tuberculosis
LGEAAGTYVAA

SEQ ID NO: 8046 - protein, 11 aa, Mycobacterium tuberculosis
GEAAGTYVAAD

SEQ ID NO: 8047 - protein, 11 aa, Mycobacterium tuberculosis
EAAGTYVAADA

SEQ ID NO: 8048 - protein, 11 aa, Mycobacterium tuberculosis
AAGTYVAADAA

SEQ ID NO: 8049 - protein, 11 aa, Mycobacterium tuberculosis
AGTYVAADAAA

SEQ ID NO: 8050 - protein, 11 aa, Mycobacterium tuberculosis
GTYVAADAAAA

SEQ ID NO: 8051 - protein, 11 aa, Mycobacterium tuberculosis
TYVAADAAAAS

SEQ ID NO: 8052 - protein, 11 aa, Mycobacterium tuberculosis
YVAADAAAAST

SEQ ID NO: 8053 - protein, 11 aa, Mycobacterium tuberculosis
VAADAAAASTY

SEQ ID NO: 8054 - protein, 11 aa, Mycobacterium tuberculosis
AADAAAASTYT

SEQ ID NO: 8055 - protein, 11 aa, Mycobacterium tuberculosis
ADAAAASTYTG

SEQ ID NO: 8056 - protein, 11 aa, Mycobacterium tuberculosis
DAAAASTYTGF

SEQ ID NO: 8057 - protein, 8 aa, Mycobacterium tuberculosis
MSQIMYNY

SEQ ID NO: 8058 - protein, 8 aa, Mycobacterium tuberculosis
SQIMYNYP

SEQ ID NO: 8059 - protein, 8 aa, Mycobacterium tuberculosis
QIMYNYPA

SEQ ID NO: 8060 - protein, 8 aa, Mycobacterium tuberculosis
IMYNYPAM

SEQ ID NO: 8061 - protein, 8 aa, Mycobacterium tuberculosis
MYNYPAML

SEQ ID NO: 8062 - protein, 8 aa, Mycobacterium tuberculosis
YNYPAMLG

SEQ ID NO: 8063 - protein, 8 aa, Mycobacterium tuberculosis
NYPAMLGH

SEQ ID NO: 8064 - protein, 8 aa, Mycobacterium tuberculosis
YPAMLGHA

SEQ ID NO: 8065 - protein, 8 aa, Mycobacterium tuberculosis
PAMLGHAG

SEQ ID NO: 8066 - protein, 8 aa, Mycobacterium tuberculosis
AMLGHAGD

SEQ ID NO: 8067 - protein, 8 aa, Mycobacterium tuberculosis
MLGHAGDM

SEQ ID NO: 8068 - protein, 8 aa, Mycobacterium tuberculosis
LGHAGDMA

SEQ ID NO: 8069 - protein, 8 aa, Mycobacterium tuberculosis
GHAGDMAG

SEQ ID NO: 8070 - protein, 8 aa, Mycobacterium tuberculosis
HAGDMAGY

SEQ ID NO: 8071 - protein, 8 aa, Mycobacterium tuberculosis
AGDMAGYA

SEQ ID NO: 8072 - protein, 8 aa, Mycobacterium tuberculosis
GDMAGYAG

SEQ ID NO: 8073 - protein, 8 aa, Mycobacterium tuberculosis
DMAGYAGT

SEQ ID NO: 8074 - protein, 8 aa, Mycobacterium tuberculosis
MAGYAGTL

SEQ ID NO: 8075 - protein, 8 aa, Mycobacterium tuberculosis
AGYAGTLQ

SEQ ID NO: 8076 - protein, 8 aa, Mycobacterium tuberculosis
GYAGTLQS

SEQ ID NO: 8077 - protein, 8 aa, Mycobacterium tuberculosis
YAGTLQSL

SEQ ID NO: 8078 - protein, 8 aa, Mycobacterium tuberculosis
AGTLQSLG

SEQ ID NO: 8079 - protein, 8 aa, Mycobacterium tuberculosis
GTLQSLGA

SEQ ID NO: 8080 - protein, 8 aa, Mycobacterium tuberculosis
TLQSLGAE

SEQ ID NO: 8081 - protein, 8 aa, Mycobacterium tuberculosis
LQSLGAEI

SEQ ID NO: 8082 - protein, 8 aa, Mycobacterium tuberculosis
QSLGAEIA

SEQ ID NO: 8083 - protein, 8 aa, Mycobacterium tuberculosis
SLGAEIAV

SEQ ID NO: 8084 - protein, 8 aa, Mycobacterium tuberculosis
LGAEIAVE

SEQ ID NO: 8085 - protein, 8 aa, Mycobacterium tuberculosis
GAEIAVEQ

SEQ ID NO: 8086 - protein, 8 aa, Mycobacterium tuberculosis
AEIAVEQA

SEQ ID NO: 8087 - protein, 8 aa, Mycobacterium tuberculosis
EIAVEQAA

SEQ ID NO: 8088 - protein, 8 aa, Mycobacterium tuberculosis
IAVEQAAL

SEQ ID NO: 8089 - protein, 8 aa, Mycobacterium tuberculosis
AVEQAALQ

SEQ ID NO: 8090 - protein, 8 aa, Mycobacterium tuberculosis
VEQAALQS

SEQ ID NO: 8091 - protein, 8 aa, Mycobacterium tuberculosis
EQAALQSA

SEQ ID NO: 8092 - protein, 8 aa, Mycobacterium tuberculosis
QAALQSAW

SEQ ID NO: 8093 - protein, 8 aa, Mycobacterium tuberculosis
AALQSAWQ

SEQ ID NO: 8094 - protein, 8 aa, Mycobacterium tuberculosis
ALQSAWQG

SEQ ID NO: 8095 - protein, 8 aa, Mycobacterium tuberculosis
LQSAWQGD

SEQ ID NO: 8096 - protein, 8 aa, Mycobacterium tuberculosis
QSAWQGDT

SEQ ID NO: 8097 - protein, 8 aa, Mycobacterium tuberculosis
SAWQGDTG

SEQ ID NO: 8098 - protein, 8 aa, Mycobacterium tuberculosis
AWQGDTGI

SEQ ID NO: 8099 - protein, 8 aa, Mycobacterium tuberculosis
WQGDTGIT

SEQ ID NO: 8100 - protein, 8 aa, Mycobacterium tuberculosis
QGDTGITY

SEQ ID NO: 8101 - protein, 8 aa, Mycobacterium tuberculosis
GDTGITYQ

SEQ ID NO: 8102 - protein, 8 aa, Mycobacterium tuberculosis
DTGITYQA

SEQ ID NO: 8103 - protein, 8 aa, Mycobacterium tuberculosis
TGITYQAW

SEQ ID NO: 8104 - protein, 8 aa, Mycobacterium tuberculosis
GITYQAWQ

SEQ ID NO: 8105 - protein, 8 aa, Mycobacterium tuberculosis
ITYQAWQA

SEQ ID NO: 8106 - protein, 8 aa, Mycobacterium tuberculosis
TYQAWQAQ

SEQ ID NO: 8107 - protein, 8 aa, Mycobacterium tuberculosis
YQAWQAQW

SEQ ID NO: 8108 - protein, 8 aa, Mycobacterium tuberculosis
QAWQAQWN

SEQ ID NO: 8109 - protein, 8 aa, Mycobacterium tuberculosis
AWQAQWNQ

SEQ ID NO: 8110 - protein, 8 aa, Mycobacterium tuberculosis
WQAQWNQA

SEQ ID NO: 8111 - protein, 8 aa, Mycobacterium tuberculosis
QAQWNQAM

SEQ ID NO: 8112 - protein, 8 aa, Mycobacterium tuberculosis
AQWNQAME

SEQ ID NO: 8113 - protein, 8 aa, Mycobacterium tuberculosis
QWNQAMED

SEQ ID NO: 8114 - protein, 8 aa, Mycobacterium tuberculosis
WNQAMEDL

SEQ ID NO: 8115 - protein, 8 aa, Mycobacterium tuberculosis
NQAMEDLV

SEQ ID NO: 8116 - protein, 8 aa, Mycobacterium tuberculosis
QAMEDLVR

SEQ ID NO: 8117 - protein, 8 aa, Mycobacterium tuberculosis
AMEDLVRA

SEQ ID NO: 8118 - protein, 8 aa, Mycobacterium tuberculosis
MEDLVRAY

SEQ ID NO: 8119 - protein, 8 aa, Mycobacterium tuberculosis
EDLVRAYH

SEQ ID NO: 8120 - protein, 8 aa, Mycobacterium tuberculosis
DLVRAYHA

SEQ ID NO: 8121 - protein, 8 aa, Mycobacterium tuberculosis
LVRAYHAM

SEQ ID NO: 8122 - protein, 8 aa, Mycobacterium tuberculosis
VRAYHAMS

SEQ ID NO: 8123 - protein, 8 aa, Mycobacterium tuberculosis
RAYHAMSS

SEQ ID NO: 8124 - protein, 8 aa, Mycobacterium tuberculosis
AYHAMSST

SEQ ID NO: 8125 - protein, 8 aa, Mycobacterium tuberculosis
YHAMSSTH

SEQ ID NO: 8126 - protein, 8 aa, Mycobacterium tuberculosis
HAMSSTHE

SEQ ID NO: 8127 - protein, 8 aa, Mycobacterium tuberculosis
AMSSTHEA

SEQ ID NO: 8128 - protein, 8 aa, Mycobacterium tuberculosis
MSSTHEAN

SEQ ID NO: 8129 - protein, 8 aa, Mycobacterium tuberculosis
SSTHEANT

SEQ ID NO: 8130 - protein, 8 aa, Mycobacterium tuberculosis
STHEANTM

SEQ ID NO: 8131 - protein, 8 aa, Mycobacterium tuberculosis
THEANTMA

SEQ ID NO: 8132 - protein, 8 aa, Mycobacterium tuberculosis
HEANTMAM

SEQ ID NO: 8133 - protein, 8 aa, Mycobacterium tuberculosis
EANTMAMM

SEQ ID NO: 8134 - protein, 8 aa, Mycobacterium tuberculosis
ANTMAMMA

SEQ ID NO: 8135 - protein, 8 aa, Mycobacterium tuberculosis
NTMAMMAR

SEQ ID NO: 8136 - protein, 8 aa, Mycobacterium tuberculosis
TMAMMARD

SEQ ID NO: 8137 - protein, 8 aa, Mycobacterium tuberculosis
MAMMARDT

SEQ ID NO: 8138 - protein, 8 aa, Mycobacterium tuberculosis
AMMARDTA

SEQ ID NO: 8139 - protein, 8 aa, Mycobacterium tuberculosis
MMARDTAE

SEQ ID NO: 8140 - protein, 8 aa, Mycobacterium tuberculosis
MARDTAEA

SEQ ID NO: 8141 - protein, 8 aa, Mycobacterium tuberculosis
ARDTAEAA

SEQ ID NO: 8142 - protein, 8 aa, Mycobacterium tuberculosis
RDTAEAAK

SEQ ID NO: 8143 - protein, 8 aa, Mycobacterium tuberculosis
DTAEAAKW

SEQ ID NO: 8144 - protein, 8 aa, Mycobacterium tuberculosis
TAEAAKWG

SEQ ID NO: 8145 - protein, 8 aa, Mycobacterium tuberculosis
AEAAKWGG

SEQ ID NO: 8146 - protein, 9 aa, Mycobacterium tuberculosis
MSQIMYNYP

SEQ ID NO: 8147 - protein, 9 aa, Mycobacterium tuberculosis
SQIMYNYPA

SEQ ID NO: 8148 - protein, 9 aa, Mycobacterium tuberculosis
QIMYNYPAM

SEQ ID NO: 8149 - protein, 9 aa, Mycobacterium tuberculosis
IMYNYPAML

SEQ ID NO: 8150 - protein, 9 aa, Mycobacterium tuberculosis
MYNYPAMLG

SEQ ID NO: 8151 - protein, 9 aa, Mycobacterium tuberculosis
YNYPAMLGH

SEQ ID NO: 8152 - protein, 9 aa, Mycobacterium tuberculosis
NYPAMLGHA

SEQ ID NO: 8153 - protein, 9 aa, Mycobacterium tuberculosis
YPAMLGHAG

SEQ ID NO: 8154 - protein, 9 aa, Mycobacterium tuberculosis
PAMLGHAGD

SEQ ID NO: 8155 - protein, 9 aa, Mycobacterium tuberculosis
AMLGHAGDM

SEQ ID NO: 8156 - protein, 9 aa, Mycobacterium tuberculosis
MLGHAGDMA

SEQ ID NO: 8157 - protein, 9 aa, Mycobacterium tuberculosis
LGHAGDMAG

SEQ ID NO: 8158 - protein, 9 aa, Mycobacterium tuberculosis
GHAGDMAGY

SEQ ID NO: 8159 - protein, 9 aa, Mycobacterium tuberculosis
HAGDMAGYA

SEQ ID NO: 8160 - protein, 9 aa, Mycobacterium tuberculosis
AGDMAGYAG

SEQ ID NO: 8161 - protein, 9 aa, Mycobacterium tuberculosis
GDMAGYAGT

SEQ ID NO: 8162 - protein, 9 aa, Mycobacterium tuberculosis
DMAGYAGTL

SEQ ID NO: 8163 - protein, 9 aa, Mycobacterium tuberculosis
MAGYAGTLQ

SEQ ID NO: 8164 - protein, 9 aa, Mycobacterium tuberculosis
AGYAGTLQS

SEQ ID NO: 8165 - protein, 9 aa, Mycobacterium tuberculosis
GYAGTLQSL

SEQ ID NO: 8166 - protein, 9 aa, Mycobacterium tuberculosis
YAGTLQSLG

SEQ ID NO: 8167 - protein, 9 aa, Mycobacterium tuberculosis
AGTLQSLGA

SEQ ID NO: 8168 - protein, 9 aa, Mycobacterium tuberculosis
GTLQSLGAE

SEQ ID NO: 8169 - protein, 9 aa, Mycobacterium tuberculosis
TLQSLGAEI

SEQ ID NO: 8170 - protein, 9 aa, Mycobacterium tuberculosis
LQSLGAEIA

SEQ ID NO: 8171 - protein, 9 aa, Mycobacterium tuberculosis
QSLGAEIAV

SEQ ID NO: 8172 - protein, 9 aa, Mycobacterium tuberculosis
SLGAEIAVE

SEQ ID NO: 8173 - protein, 9 aa, Mycobacterium tuberculosis
LGAEIAVEQ

SEQ ID NO: 8174 - protein, 9 aa, Mycobacterium tuberculosis
GAEIAVEQA

SEQ ID NO: 8175 - protein, 9 aa, Mycobacterium tuberculosis
AEIAVEQAA

SEQ ID NO: 8176 - protein, 9 aa, Mycobacterium tuberculosis
EIAVEQAAL

SEQ ID NO: 8177 - protein, 9 aa, Mycobacterium tuberculosis
IAVEQAALQ

SEQ ID NO: 8178 - protein, 9 aa, Mycobacterium tuberculosis
AVEQAALQS

SEQ ID NO: 8179 - protein, 9 aa, Mycobacterium tuberculosis
VEQAALQSA

SEQ ID NO: 8180 - protein, 9 aa, Mycobacterium tuberculosis
EQAALQSAW

SEQ ID NO: 8181 - protein, 9 aa, Mycobacterium tuberculosis
QAALQSAWQ

SEQ ID NO: 8182 - protein, 9 aa, Mycobacterium tuberculosis
AALQSAWQG

SEQ ID NO: 8183 - protein, 9 aa, Mycobacterium tuberculosis
ALQSAWQGD

SEQ ID NO: 8184 - protein, 9 aa, Mycobacterium tuberculosis
LQSAWQGDT

SEQ ID NO: 8185 - protein, 9 aa, Mycobacterium tuberculosis
QSAWQGDTG

SEQ ID NO: 8186 - protein, 9 aa, Mycobacterium tuberculosis
SAWQGDTGI

SEQ ID NO: 8187 - protein, 9 aa, Mycobacterium tuberculosis
AWQGDTGIT

SEQ ID NO: 8188 - protein, 9 aa, Mycobacterium tuberculosis
WQGDTGITY

SEQ ID NO: 8189 - protein, 9 aa, Mycobacterium tuberculosis
QGDTGITYQ

SEQ ID NO: 8190 - protein, 9 aa, Mycobacterium tuberculosis
GDTGITYQA

SEQ ID NO: 8191 - protein, 9 aa, Mycobacterium tuberculosis
DTGITYQAW

SEQ ID NO: 8192 - protein, 9 aa, Mycobacterium tuberculosis
TGITYQAWQ

SEQ ID NO: 8193 - protein, 9 aa, Mycobacterium tuberculosis
GITYQAWQA

SEQ ID NO: 8194 - protein, 9 aa, Mycobacterium tuberculosis
ITYQAWQAQ

SEQ ID NO: 8195 - protein, 9 aa, Mycobacterium tuberculosis
TYQAWQAQW

SEQ ID NO: 8196 - protein, 9 aa, Mycobacterium tuberculosis
YQAWQAQWN

SEQ ID NO: 8197 - protein, 9 aa, Mycobacterium tuberculosis
QAWQAQWNQ

SEQ ID NO: 8198 - protein, 9 aa, Mycobacterium tuberculosis
AWQAQWNQA

SEQ ID NO: 8199 - protein, 9 aa, Mycobacterium tuberculosis
WQAQWNQAM

SEQ ID NO: 8200 - protein, 9 aa, Mycobacterium tuberculosis
QAQWNQAME

SEQ ID NO: 8201 - protein, 9 aa, Mycobacterium tuberculosis
AQWNQAMED

SEQ ID NO: 8202 - protein, 9 aa, Mycobacterium tuberculosis
QWNQAMEDL

SEQ ID NO: 8203 - protein, 9 aa, Mycobacterium tuberculosis
WNQAMEDLV

SEQ ID NO: 8204 - protein, 9 aa, Mycobacterium tuberculosis
NQAMEDLVR

SEQ ID NO: 8205 - protein, 9 aa, Mycobacterium tuberculosis
QAMEDLVRA

SEQ ID NO: 8206 - protein, 9 aa, Mycobacterium tuberculosis
AMEDLVRAY

SEQ ID NO: 8207 - protein, 9 aa, Mycobacterium tuberculosis
MEDLVRAYH

SEQ ID NO: 8208 - protein, 9 aa, Mycobacterium tuberculosis
EDLVRAYHA

SEQ ID NO: 8209 - protein, 9 aa, Mycobacterium tuberculosis
DLVRAYHAM

SEQ ID NO: 8210 - protein, 9 aa, Mycobacterium tuberculosis
LVRAYHAMS

SEQ ID NO: 8211 - protein, 9 aa, Mycobacterium tuberculosis
VRAYHAMSS

SEQ ID NO: 8212 - protein, 9 aa, Mycobacterium tuberculosis
RAYHAMSST

SEQ ID NO: 8213 - protein, 9 aa, Mycobacterium tuberculosis
AYHAMSSTH

SEQ ID NO: 8214 - protein, 9 aa, Mycobacterium tuberculosis
YHAMSSTHE

SEQ ID NO: 8215 - protein, 9 aa, Mycobacterium tuberculosis
HAMSSTHEA

SEQ ID NO: 8216 - protein, 9 aa, Mycobacterium tuberculosis
AMSSTHEAN

SEQ ID NO: 8217 - protein, 9 aa, Mycobacterium tuberculosis
MSSTHEANT

SEQ ID NO: 8218 - protein, 9 aa, Mycobacterium tuberculosis
SSTHEANTM

SEQ ID NO: 8219 - protein, 9 aa, Mycobacterium tuberculosis
STHEANTMA

SEQ ID NO: 8220 - protein, 9 aa, Mycobacterium tuberculosis
THEANTMAM

SEQ ID NO: 8221 - protein, 9 aa, Mycobacterium tuberculosis
HEANTMAMM

SEQ ID NO: 8222 - protein, 9 aa, Mycobacterium tuberculosis
EANTMAMMA

SEQ ID NO: 8223 - protein, 9 aa, Mycobacterium tuberculosis
ANTMAMMAR

SEQ ID NO: 8224 - protein, 9 aa, Mycobacterium tuberculosis
NTMAMMARD

SEQ ID NO: 8225 - protein, 9 aa, Mycobacterium tuberculosis
TMAMMARDT

SEQ ID NO: 8226 - protein, 9 aa, Mycobacterium tuberculosis
MAMMARDTA

SEQ ID NO: 8227 - protein, 9 aa, Mycobacterium tuberculosis
AMMARDTAE

SEQ ID NO: 8228 - protein, 9 aa, Mycobacterium tuberculosis
MMARDTAEA

SEQ ID NO: 8229 - protein, 9 aa, Mycobacterium tuberculosis
MARDTAEAA

SEQ ID NO: 8230 - protein, 9 aa, Mycobacterium tuberculosis
ARDTAEAAK

SEQ ID NO: 8231 - protein, 9 aa, Mycobacterium tuberculosis
RDTAEAAKW

SEQ ID NO: 8232 - protein, 9 aa, Mycobacterium tuberculosis
DTAEAAKWG

SEQ ID NO: 8233 - protein, 9 aa, Mycobacterium tuberculosis
TAEAAKWGG

SEQ ID NO: 8234 - protein, 10 aa, Mycobacterium tuberculosis
MSQIMYNYPA

SEQ ID NO: 8235 - protein, 10 aa, Mycobacterium tuberculosis
SQIMYNYPAM

SEQ ID NO: 8236 - protein, 10 aa, Mycobacterium tuberculosis
QIMYNYPAML

SEQ ID NO: 8237 - protein, 10 aa, Mycobacterium tuberculosis
IMYNYPAMLG

SEQ ID NO: 8238 - protein, 10 aa, Mycobacterium tuberculosis
MYNYPAMLGH

SEQ ID NO: 8239 - protein, 10 aa, Mycobacterium tuberculosis
YNYPAMLGHA

SEQ ID NO: 8240 - protein, 10 aa, Mycobacterium tuberculosis
NYPAMLGHAG

SEQ ID NO: 8241 - protein, 10 aa, Mycobacterium tuberculosis
YPAMLGHAGD

SEQ ID NO: 8242 - protein, 10 aa, Mycobacterium tuberculosis
PAMLGHAGDM

SEQ ID NO: 8243 - protein, 10 aa, Mycobacterium tuberculosis
AMLGHAGDMA

SEQ ID NO: 8244 - protein, 10 aa, Mycobacterium tuberculosis
MLGHAGDMAG

SEQ ID NO: 8245 - protein, 10 aa, Mycobacterium tuberculosis
LGHAGDMAGY

SEQ ID NO: 8246 - protein, 10 aa, Mycobacterium tuberculosis
GHAGDMAGYA

SEQ ID NO: 8247 - protein, 10 aa, Mycobacterium tuberculosis
HAGDMAGYAG

SEQ ID NO: 8248 - protein, 10 aa, Mycobacterium tuberculosis
AGDMAGYAGT

SEQ ID NO: 8249 - protein, 10 aa, Mycobacterium tuberculosis
GDMAGYAGTL

SEQ ID NO: 8250 - protein, 10 aa, Mycobacterium tuberculosis
DMAGYAGTLQ

SEQ ID NO: 8251 - protein, 10 aa, Mycobacterium tuberculosis
MAGYAGTLQS

SEQ ID NO: 8252 - protein, 10 aa, Mycobacterium tuberculosis
AGYAGTLQSL

SEQ ID NO: 8253 - protein, 10 aa, Mycobacterium tuberculosis
GYAGTLQSLG

SEQ ID NO: 8254 - protein, 10 aa, Mycobacterium tuberculosis
YAGTLQSLGA

SEQ ID NO: 8255 - protein, 10 aa, Mycobacterium tuberculosis
AGTLQSLGAE

SEQ ID NO: 8256 - protein, 10 aa, Mycobacterium tuberculosis
GTLQSLGAEI

SEQ ID NO: 8257 - protein, 10 aa, Mycobacterium tuberculosis
TLQSLGAEIA

SEQ ID NO: 8258 - protein, 10 aa, Mycobacterium tuberculosis
LQSLGAEIAV

SEQ ID NO: 8259 - protein, 10 aa, Mycobacterium tuberculosis
QSLGAEIAVE

SEQ ID NO: 8260 - protein, 10 aa, Mycobacterium tuberculosis
SLGAEIAVEQ

SEQ ID NO: 8261 - protein, 10 aa, Mycobacterium tuberculosis
LGAEIAVEQA

SEQ ID NO: 8262 - protein, 10 aa, Mycobacterium tuberculosis
GAEIAVEQAA

SEQ ID NO: 8263 - protein, 10 aa, Mycobacterium tuberculosis
AEIAVEQAAL

SEQ ID NO: 8264 - protein, 10 aa, Mycobacterium tuberculosis
EIAVEQAALQ

SEQ ID NO: 8265 - protein, 10 aa, Mycobacterium tuberculosis
IAVEQAALQS

SEQ ID NO: 8266 - protein, 10 aa, Mycobacterium tuberculosis
AVEQAALQSA

SEQ ID NO: 8267 - protein, 10 aa, Mycobacterium tuberculosis
VEQAALQSAW

SEQ ID NO: 8268 - protein, 10 aa, Mycobacterium tuberculosis
EQAALQSAWQ

SEQ ID NO: 8269 - protein, 10 aa, Mycobacterium tuberculosis
QAALQSAWQG

SEQ ID NO: 8270 - protein, 10 aa, Mycobacterium tuberculosis
AALQSAWQGD

SEQ ID NO: 8271 - protein, 10 aa, Mycobacterium tuberculosis
ALQSAWQGDT

SEQ ID NO: 8272 - protein, 10 aa, Mycobacterium tuberculosis
LQSAWQGDTG

SEQ ID NO: 8273 - protein, 10 aa, Mycobacterium tuberculosis
QSAWQGDTGI

SEQ ID NO: 8274 - protein, 10 aa, Mycobacterium tuberculosis
SAWQGDTGIT

SEQ ID NO: 8275 - protein, 10 aa, Mycobacterium tuberculosis
AWQGDTGITY

SEQ ID NO: 8276 - protein, 10 aa, Mycobacterium tuberculosis
WQGDTGITYQ

SEQ ID NO: 8277 - protein, 10 aa, Mycobacterium tuberculosis
QGDTGITYQA

SEQ ID NO: 8278 - protein, 10 aa, Mycobacterium tuberculosis
GDTGITYQAW

SEQ ID NO: 8279 - protein, 10 aa, Mycobacterium tuberculosis
DTGITYQAWQ

SEQ ID NO: 8280 - protein, 10 aa, Mycobacterium tuberculosis
TGITYQAWQA

SEQ ID NO: 8281 - protein, 10 aa, Mycobacterium tuberculosis
GITYQAWQAQ

SEQ ID NO: 8282 - protein, 10 aa, Mycobacterium tuberculosis
ITYQAWQAQW

SEQ ID NO: 8283 - protein, 10 aa, Mycobacterium tuberculosis
TYQAWQAQWN

SEQ ID NO: 8284 - protein, 10 aa, Mycobacterium tuberculosis
YQAWQAQWNQ

SEQ ID NO: 8285 - protein, 10 aa, Mycobacterium tuberculosis
QAWQAQWNQA

SEQ ID NO: 8286 - protein, 10 aa, Mycobacterium tuberculosis
AWQAQWNQAM

SEQ ID NO: 8287 - protein, 10 aa, Mycobacterium tuberculosis
WQAQWNQAME

SEQ ID NO: 8288 - protein, 10 aa, Mycobacterium tuberculosis
QAQWNQAMED

SEQ ID NO: 8289 - protein, 10 aa, Mycobacterium tuberculosis
AQWNQAMEDL

SEQ ID NO: 8290 - protein, 10 aa, Mycobacterium tuberculosis
QWNQAMEDLV

SEQ ID NO: 8291 - protein, 10 aa, Mycobacterium tuberculosis
WNQAMEDLVR

SEQ ID NO: 8292 - protein, 10 aa, Mycobacterium tuberculosis
NQAMEDLVRA

SEQ ID NO: 8293 - protein, 10 aa, Mycobacterium tuberculosis
QAMEDLVRAY

SEQ ID NO: 8294 - protein, 10 aa, Mycobacterium tuberculosis
AMEDLVRAYH

SEQ ID NO: 8295 - protein, 10 aa, Mycobacterium tuberculosis
MEDLVRAYHA

SEQ ID NO: 8296 - protein, 10 aa, Mycobacterium tuberculosis
EDLVRAYHAM

SEQ ID NO: 8297 - protein, 10 aa, Mycobacterium tuberculosis
DLVRAYHAMS

SEQ ID NO: 8298 - protein, 10 aa, Mycobacterium tuberculosis
LVRAYHAMSS

SEQ ID NO: 8299 - protein, 10 aa, Mycobacterium tuberculosis
VRAYHAMSST

SEQ ID NO: 8300 - protein, 10 aa, Mycobacterium tuberculosis
RAYHAMSSTH

SEQ ID NO: 8301 - protein, 10 aa, Mycobacterium tuberculosis
AYHAMSSTHE

SEQ ID NO: 8302 - protein, 10 aa, Mycobacterium tuberculosis
YHAMSSTHEA

SEQ ID NO: 8303 - protein, 10 aa, Mycobacterium tuberculosis
HAMSSTHEAN

SEQ ID NO: 8304 - protein, 10 aa, Mycobacterium tuberculosis
AMSSTHEANT

SEQ ID NO: 8305 - protein, 10 aa, Mycobacterium tuberculosis
MSSTHEANTM

SEQ ID NO: 8306 - protein, 10 aa, Mycobacterium tuberculosis
SSTHEANTMA

SEQ ID NO: 8307 - protein, 10 aa, Mycobacterium tuberculosis
STHEANTMAM

SEQ ID NO: 8308 - protein, 10 aa, Mycobacterium tuberculosis
THEANTMAMM

SEQ ID NO: 8309 - protein, 10 aa, Mycobacterium tuberculosis
HEANTMAMMA

SEQ ID NO: 8310 - protein, 10 aa, Mycobacterium tuberculosis
EANTMAMMAR

SEQ ID NO: 8311 - protein, 10 aa, Mycobacterium tuberculosis
ANTMAMMARD

SEQ ID NO: 8312 - protein, 10 aa, Mycobacterium tuberculosis
NTMAMMARDT

SEQ ID NO: 8313 - protein, 10 aa, Mycobacterium tuberculosis
TMAMMARDTA

SEQ ID NO: 8314 - protein, 10 aa, Mycobacterium tuberculosis
MAMMARDTAE

SEQ ID NO: 8315 - protein, 10 aa, Mycobacterium tuberculosis
AMMARDTAEA

SEQ ID NO: 8316 - protein, 10 aa, Mycobacterium tuberculosis
MMARDTAEAA

SEQ ID NO: 8317 - protein, 10 aa, Mycobacterium tuberculosis
MARDTAEAAK

SEQ ID NO: 8318 - protein, 10 aa, Mycobacterium tuberculosis
ARDTAEAAKW

SEQ ID NO: 8319 - protein, 10 aa, Mycobacterium tuberculosis
RDTAEAAKWG

SEQ ID NO: 8320 - protein, 10 aa, Mycobacterium tuberculosis
DTAEAAKWGG

SEQ ID NO: 8321 - protein, 11 aa, Mycobacterium tuberculosis
MSQIMYNYPAM

SEQ ID NO: 8322 - protein, 11 aa, Mycobacterium tuberculosis
SQIMYNYPAML

SEQ ID NO: 8323 - protein, 11 aa, Mycobacterium tuberculosis
QIMYNYPAMLG

SEQ ID NO: 8324 - protein, 11 aa, Mycobacterium tuberculosis
IMYNYPAMLGH

SEQ ID NO: 8325 - protein, 11 aa, Mycobacterium tuberculosis
MYNYPAMLGHA

SEQ ID NO: 8326 - protein, 11 aa, Mycobacterium tuberculosis
YNYPAMLGHAG

SEQ ID NO: 8327 - protein, 11 aa, Mycobacterium tuberculosis
NYPAMLGHAGD

SEQ ID NO: 8328 - protein, 11 aa, Mycobacterium tuberculosis
YPAMLGHAGDM

SEQ ID NO: 8329 - protein, 11 aa, Mycobacterium tuberculosis
PAMLGHAGDMA

SEQ ID NO: 8330 - protein, 11 aa, Mycobacterium tuberculosis
AMLGHAGDMAG

SEQ ID NO: 8331 - protein, 11 aa, Mycobacterium tuberculosis
MLGHAGDMAGY

SEQ ID NO: 8332 - protein, 11 aa, Mycobacterium tuberculosis
LGHAGDMAGYA

SEQ ID NO: 8333 - protein, 11 aa, Mycobacterium tuberculosis
GHAGDMAGYAG

SEQ ID NO: 8334 - protein, 11 aa, Mycobacterium tuberculosis
HAGDMAGYAGT

SEQ ID NO: 8335 - protein, 11 aa, Mycobacterium tuberculosis
AGDMAGYAGTL

SEQ ID NO: 8336 - protein, 11 aa, Mycobacterium tuberculosis
GDMAGYAGTLQ

SEQ ID NO: 8337 - protein, 11 aa, Mycobacterium tuberculosis
DMAGYAGTLQS

SEQ ID NO: 8338 - protein, 11 aa, Mycobacterium tuberculosis
MAGYAGTLQSL

SEQ ID NO: 8339 - protein, 11 aa, Mycobacterium tuberculosis
AGYAGTLQSLG

SEQ ID NO: 8340 - protein, 11 aa, Mycobacterium tuberculosis
GYAGTLQSLGA

SEQ ID NO: 8341 - protein, 11 aa, Mycobacterium tuberculosis
YAGTLQSLGAE

SEQ ID NO: 8342 - protein, 11 aa, Mycobacterium tuberculosis
AGTLQSLGAEI

SEQ ID NO: 8343 - protein, 11 aa, Mycobacterium tuberculosis
GTLQSLGAEIA

SEQ ID NO: 8344 - protein, 11 aa, Mycobacterium tuberculosis
TLQSLGAEIAV

SEQ ID NO: 8345 - protein, 11 aa, Mycobacterium tuberculosis
LQSLGAEIAVE

SEQ ID NO: 8346 - protein, 11 aa, Mycobacterium tuberculosis
QSLGAEIAVEQ

SEQ ID NO: 8347 - protein, 11 aa, Mycobacterium tuberculosis
SLGAEIAVEQA

SEQ ID NO: 8348 - protein, 11 aa, Mycobacterium tuberculosis
LGAEIAVEQAA

SEQ ID NO: 8349 - protein, 11 aa, Mycobacterium tuberculosis
GAEIAVEQAAL

SEQ ID NO: 8350 - protein, 11 aa, Mycobacterium tuberculosis
AEIAVEQAALQ

SEQ ID NO: 8351 - protein, 11 aa, Mycobacterium tuberculosis
EIAVEQAALQS

SEQ ID NO: 8352 - protein, 11 aa, Mycobacterium tuberculosis
IAVEQAALQSA

SEQ ID NO: 8353 - protein, 11 aa, Mycobacterium tuberculosis
AVEQAALQSAW

SEQ ID NO: 8354 - protein, 11 aa, Mycobacterium tuberculosis
VEQAALQSAWQ

SEQ ID NO: 8355 - protein, 11 aa, Mycobacterium tuberculosis
EQAALQSAWQG

SEQ ID NO: 8356 - protein, 11 aa, Mycobacterium tuberculosis
QAALQSAWQGD

SEQ ID NO: 8357 - protein, 11 aa, Mycobacterium tuberculosis
AALQSAWQGDT

SEQ ID NO: 8358 - protein, 11 aa, Mycobacterium tuberculosis
ALQSAWQGDTG

SEQ ID NO: 8359 - protein, 11 aa, Mycobacterium tuberculosis
LQSAWQGDTGI

SEQ ID NO: 8360 - protein, 11 aa, Mycobacterium tuberculosis
QSAWQGDTGIT

SEQ ID NO: 8361 - protein, 11 aa, Mycobacterium tuberculosis
SAWQGDTGITY

SEQ ID NO: 8362 - protein, 11 aa, Mycobacterium tuberculosis
AWQGDTGITYQ

SEQ ID NO: 8363 - protein, 11 aa, Mycobacterium tuberculosis
WQGDTGITYQA

SEQ ID NO: 8364 - protein, 11 aa, Mycobacterium tuberculosis
QGDTGITYQAW

SEQ ID NO: 8365 - protein, 11 aa, Mycobacterium tuberculosis
GDTGITYQAWQ

SEQ ID NO: 8366 - protein, 11 aa, Mycobacterium tuberculosis
DTGITYQAWQA

SEQ ID NO: 8367 - protein, 11 aa, Mycobacterium tuberculosis
TGITYQAWQAQ

SEQ ID NO: 8368 - protein, 11 aa, Mycobacterium tuberculosis
GITYQAWQAQW

SEQ ID NO: 8369 - protein, 11 aa, Mycobacterium tuberculosis
ITYQAWQAQWN

SEQ ID NO: 8370 - protein, 11 aa, Mycobacterium tuberculosis
TYQAWQAQWNQ

SEQ ID NO: 8371 - protein, 11 aa, Mycobacterium tuberculosis
YQAWQAQWNQA

SEQ ID NO: 8372 - protein, 11 aa, Mycobacterium tuberculosis
QAWQAQWNQAM

SEQ ID NO: 8373 - protein, 11 aa, Mycobacterium tuberculosis
AWQAQWNQAME

SEQ ID NO: 8374 - protein, 11 aa, Mycobacterium tuberculosis
WQAQWNQAMED

SEQ ID NO: 8375 - protein, 11 aa, Mycobacterium tuberculosis
QAQWNQAMEDL

SEQ ID NO: 8376 - protein, 11 aa, Mycobacterium tuberculosis
AQWNQAMEDLV

SEQ ID NO: 8377 - protein, 11 aa, Mycobacterium tuberculosis
QWNQAMEDLVR

SEQ ID NO: 8378 - protein, 11 aa, Mycobacterium tuberculosis
WNQAMEDLVRA

SEQ ID NO: 8379 - protein, 11 aa, Mycobacterium tuberculosis
NQAMEDLVRAY

SEQ ID NO: 8380 - protein, 11 aa, Mycobacterium tuberculosis
QAMEDLVRAYH

SEQ ID NO: 8381 - protein, 11 aa, Mycobacterium tuberculosis
AMEDLVRAYHA

SEQ ID NO: 8382 - protein, 11 aa, Mycobacterium tuberculosis
MEDLVRAYHAM

SEQ ID NO: 8383 - protein, 11 aa, Mycobacterium tuberculosis
EDLVRAYHAMS

SEQ ID NO: 8384 - protein, 11 aa, Mycobacterium tuberculosis
DLVRAYHAMSS

SEQ ID NO: 8385 - protein, 11 aa, Mycobacterium tuberculosis
LVRAYHAMSST

SEQ ID NO: 8386 - protein, 11 aa, Mycobacterium tuberculosis
VRAYHAMSSTH

SEQ ID NO: 8387 - protein, 11 aa, Mycobacterium tuberculosis
RAYHAMSSTHE

SEQ ID NO: 8388 - protein, 11 aa, Mycobacterium tuberculosis
AYHAMSSTHEA

SEQ ID NO: 8389 - protein, 11 aa, Mycobacterium tuberculosis
YHAMSSTHEAN

SEQ ID NO: 8390 - protein, 11 aa, Mycobacterium tuberculosis
HAMSSTHEANT

SEQ ID NO: 8391 - protein, 11 aa, Mycobacterium tuberculosis
AMSSTHEANTM

SEQ ID NO: 8392 - protein, 11 aa, Mycobacterium tuberculosis
MSSTHEANTMA

SEQ ID NO: 8393 - protein, 11 aa, Mycobacterium tuberculosis
SSTHEANTMAM

SEQ ID NO: 8394 - protein, 11 aa, Mycobacterium tuberculosis
STHEANTMAMM

SEQ ID NO: 8395 - protein, 11 aa, Mycobacterium tuberculosis
THEANTMAMMA

SEQ ID NO: 8396 - protein, 11 aa, Mycobacterium tuberculosis
HEANTMAMMAR

SEQ ID NO: 8397 - protein, 11 aa, Mycobacterium tuberculosis
EANTMAMMARD

SEQ ID NO: 8398 - protein, 11 aa, Mycobacterium tuberculosis
ANTMAMMARDT

SEQ ID NO: 8399 - protein, 11 aa, Mycobacterium tuberculosis
NTMAMMARDTA

SEQ ID NO: 8400 - protein, 11 aa, Mycobacterium tuberculosis
TMAMMARDTAE

SEQ ID NO: 8401 - protein, 11 aa, Mycobacterium tuberculosis
MAMMARDTAEA

SEQ ID NO: 8402 - protein, 11 aa, Mycobacterium tuberculosis
AMMARDTAEAA

SEQ ID NO: 8403 - protein, 11 aa, Mycobacterium tuberculosis
MMARDTAEAAK

SEQ ID NO: 8404 - protein, 11 aa, Mycobacterium tuberculosis
MARDTAEAAKW

SEQ ID NO: 8405 - protein, 11 aa, Mycobacterium tuberculosis
ARDTAEAAKWG

SEQ ID NO: 8406 - protein, 11 aa, Mycobacterium tuberculosis
RDTAEAAKWGG

SEQ ID NO: 8407 - protein, 8 aa, Mycobacterium tuberculosis
MSRLSSIL

SEQ ID NO: 8408 - protein, 8 aa, Mycobacterium tuberculosis
SRLSSILR

SEQ ID NO: 8409 - protein, 8 aa, Mycobacterium tuberculosis
RLSSILRA

SEQ ID NO: 8410 - protein, 8 aa, Mycobacterium tuberculosis
LSSILRAG

SEQ ID NO: 8411 - protein, 8 aa, Mycobacterium tuberculosis
SSILRAGA

SEQ ID NO: 8412 - protein, 8 aa, Mycobacterium tuberculosis
SILRAGAA

SEQ ID NO: 8413 - protein, 8 aa, Mycobacterium tuberculosis
ILRAGAAF

SEQ ID NO: 8414 - protein, 8 aa, Mycobacterium tuberculosis
LRAGAAFL

SEQ ID NO: 8415 - protein, 8 aa, Mycobacterium tuberculosis
RAGAAFLV

SEQ ID NO: 8416 - protein, 8 aa, Mycobacterium tuberculosis
AGAAFLVL

SEQ ID NO: 8417 - protein, 8 aa, Mycobacterium tuberculosis
GAAFLVLG

SEQ ID NO: 8418 - protein, 8 aa, Mycobacterium tuberculosis
AAFLVLGI

SEQ ID NO: 8419 - protein, 8 aa, Mycobacterium tuberculosis
AFLVLGIA

SEQ ID NO: 8420 - protein, 8 aa, Mycobacterium tuberculosis
FLVLGIAA

SEQ ID NO: 8421 - protein, 8 aa, Mycobacterium tuberculosis
LVLGIAAA

SEQ ID NO: 8422 - protein, 8 aa, Mycobacterium tuberculosis
VLGIAAAT

SEQ ID NO: 8423 - protein, 8 aa, Mycobacterium tuberculosis
LGIAAATF

SEQ ID NO: 8424 - protein, 8 aa, Mycobacterium tuberculosis
GIAAATFP

SEQ ID NO: 8425 - protein, 8 aa, Mycobacterium tuberculosis
IAAATFPQ

SEQ ID NO: 8426 - protein, 8 aa, Mycobacterium tuberculosis
AAATFPQS

SEQ ID NO: 8427 - protein, 8 aa, Mycobacterium tuberculosis
AATFPQSA

SEQ ID NO: 8428 - protein, 8 aa, Mycobacterium tuberculosis
ATFPQSAA

SEQ ID NO: 8429 - protein, 8 aa, Mycobacterium tuberculosis
TFPQSAAA

SEQ ID NO: 8430 - protein, 8 aa, Mycobacterium tuberculosis
FPQSAAAD

SEQ ID NO: 8431 - protein, 8 aa, Mycobacterium tuberculosis
PQSAAADS

SEQ ID NO: 8432 - protein, 8 aa, Mycobacterium tuberculosis
QSAAADST

SEQ ID NO: 8433 - protein, 8 aa, Mycobacterium tuberculosis
SAAADSTE

SEQ ID NO: 8434 - protein, 8 aa, Mycobacterium tuberculosis
AAADSTED

SEQ ID NO: 8435 - protein, 8 aa, Mycobacterium tuberculosis
AADSTEDF

SEQ ID NO: 8436 - protein, 8 aa, Mycobacterium tuberculosis
ADSTEDFP

SEQ ID NO: 8437 - protein, 8 aa, Mycobacterium tuberculosis
DSTEDFPI

SEQ ID NO: 8438 - protein, 8 aa, Mycobacterium tuberculosis
STEDFPIP

SEQ ID NO: 8439 - protein, 8 aa, Mycobacterium tuberculosis
TEDFPIPR

SEQ ID NO: 8440 - protein, 8 aa, Mycobacterium tuberculosis
EDFPIPRR

SEQ ID NO: 8441 - protein, 8 aa, Mycobacterium tuberculosis
DFPIPRRM

SEQ ID NO: 8442 - protein, 8 aa, Mycobacterium tuberculosis
FPIPRRMI

SEQ ID NO: 8443 - protein, 8 aa, Mycobacterium tuberculosis
PIPRRMIA

SEQ ID NO: 8444 - protein, 8 aa, Mycobacterium tuberculosis
IPRRMIAT

SEQ ID NO: 8445 - protein, 8 aa, Mycobacterium tuberculosis
PRRMIATT

SEQ ID NO: 8446 - protein, 8 aa, Mycobacterium tuberculosis
RRMIATTC

SEQ ID NO: 8447 - protein, 8 aa, Mycobacterium tuberculosis
RMIATTCD

SEQ ID NO: 8448 - protein, 8 aa, Mycobacterium tuberculosis
MIATTCDA

SEQ ID NO: 8449 - protein, 8 aa, Mycobacterium tuberculosis
IATTCDAE

SEQ ID NO: 8450 - protein, 8 aa, Mycobacterium tuberculosis
ATTCDAEQ

SEQ ID NO: 8451 - protein, 8 aa, Mycobacterium tuberculosis
TTCDAEQY

SEQ ID NO: 8452 - protein, 8 aa, Mycobacterium tuberculosis
TCDAEQYL

SEQ ID NO: 8453 - protein, 8 aa, Mycobacterium tuberculosis
CDAEQYLA

SEQ ID NO: 8454 - protein, 8 aa, Mycobacterium tuberculosis
DAEQYLAA

SEQ ID NO: 8455 - protein, 8 aa, Mycobacterium tuberculosis
AEQYLAAV

SEQ ID NO: 8456 - protein, 8 aa, Mycobacterium tuberculosis
EQYLAAVR

SEQ ID NO: 8457 - protein, 8 aa, Mycobacterium tuberculosis
QYLAAVRD

SEQ ID NO: 8458 - protein, 8 aa, Mycobacterium tuberculosis
YLAAVRDT

SEQ ID NO: 8459 - protein, 8 aa, Mycobacterium tuberculosis
LAAVRDTS

SEQ ID NO: 8460 - protein, 8 aa, Mycobacterium tuberculosis
AAVRDTSP

SEQ ID NO: 8461 - protein, 8 aa, Mycobacterium tuberculosis
AVRDTSPV

SEQ ID NO: 8462 - protein, 8 aa, Mycobacterium tuberculosis
VRDTSPVY

SEQ ID NO: 8463 - protein, 8 aa, Mycobacterium tuberculosis
RDTSPVYY

SEQ ID NO: 8464 - protein, 8 aa, Mycobacterium tuberculosis
DTSPVYYQ

SEQ ID NO: 8465 - protein, 8 aa, Mycobacterium tuberculosis
TSPVYYQR

SEQ ID NO: 8466 - protein, 8 aa, Mycobacterium tuberculosis
SPVYYQRY

SEQ ID NO: 8467 - protein, 8 aa, Mycobacterium tuberculosis
PVYYQRYM

SEQ ID NO: 8468 - protein, 8 aa, Mycobacterium tuberculosis
VYYQRYMI

SEQ ID NO: 8469 - protein, 8 aa, Mycobacterium tuberculosis
YYQRYMID

SEQ ID NO: 8470 - protein, 8 aa, Mycobacterium tuberculosis
YQRYMIDF

SEQ ID NO: 8471 - protein, 8 aa, Mycobacterium tuberculosis
QRYMIDFN

SEQ ID NO: 8472 - protein, 8 aa, Mycobacterium tuberculosis
RYMIDFNN

SEQ ID NO: 8473 - protein, 8 aa, Mycobacterium tuberculosis
YMIDFNNH

SEQ ID NO: 8474 - protein, 8 aa, Mycobacterium tuberculosis
MIDFNNHA

SEQ ID NO: 8475 - protein, 8 aa, Mycobacterium tuberculosis
IDFNNHAN

SEQ ID NO: 8476 - protein, 8 aa, Mycobacterium tuberculosis
DFNNHANL

SEQ ID NO: 8477 - protein, 8 aa, Mycobacterium tuberculosis
FNNHANLQ

SEQ ID NO: 8478 - protein, 8 aa, Mycobacterium tuberculosis
NNHANLQQ

SEQ ID NO: 8479 - protein, 8 aa, Mycobacterium tuberculosis
NHANLQQA

SEQ ID NO: 8480 - protein, 8 aa, Mycobacterium tuberculosis
HANLQQAT

SEQ ID NO: 8481 - protein, 8 aa, Mycobacterium tuberculosis
ANLQQATI

SEQ ID NO: 8482 - protein, 8 aa, Mycobacterium tuberculosis
NLQQATIN

SEQ ID NO: 8483 - protein, 8 aa, Mycobacterium tuberculosis
LQQATINK

SEQ ID NO: 8484 - protein, 8 aa, Mycobacterium tuberculosis
QQATINKA

SEQ ID NO: 8485 - protein, 8 aa, Mycobacterium tuberculosis
QATINKAH

SEQ ID NO: 8486 - protein, 8 aa, Mycobacterium tuberculosis
ATINKAHW

SEQ ID NO: 8487 - protein, 8 aa, Mycobacterium tuberculosis
TINKAHWF

SEQ ID NO: 8488 - protein, 8 aa, Mycobacterium tuberculosis
INKAHWFF

SEQ ID NO: 8489 - protein, 8 aa, Mycobacterium tuberculosis
NKAHWFFS

SEQ ID NO: 8490 - protein, 8 aa, Mycobacterium tuberculosis
KAHWFFSL

SEQ ID NO: 8491 - protein, 8 aa, Mycobacterium tuberculosis
AHWFFSLS

SEQ ID NO: 8492 - protein, 8 aa, Mycobacterium tuberculosis
HWFFSLSP

SEQ ID NO: 8493 - protein, 8 aa, Mycobacterium tuberculosis
WFFSLSPA

SEQ ID NO: 8494 - protein, 8 aa, Mycobacterium tuberculosis
FFSLSPAE

SEQ ID NO: 8495 - protein, 8 aa, Mycobacterium tuberculosis
FSLSPAER

SEQ ID NO: 8496 - protein, 8 aa, Mycobacterium tuberculosis
SLSPAERR

SEQ ID NO: 8497 - protein, 8 aa, Mycobacterium tuberculosis
LSPAERRD

SEQ ID NO: 8498 - protein, 8 aa, Mycobacterium tuberculosis
SPAERRDY

SEQ ID NO: 8499 - protein, 8 aa, Mycobacterium tuberculosis
PAERRDYS

SEQ ID NO: 8500 - protein, 8 aa, Mycobacterium tuberculosis
AERRDYSE

SEQ ID NO: 8501 - protein, 8 aa, Mycobacterium tuberculosis
ERRDYSEH

SEQ ID NO: 8502 - protein, 8 aa, Mycobacterium tuberculosis
RRDYSEHF

SEQ ID NO: 8503 - protein, 8 aa, Mycobacterium tuberculosis
RDYSEHFY

SEQ ID NO: 8504 - protein, 8 aa, Mycobacterium tuberculosis
DYSEHFYN

SEQ ID NO: 8505 - protein, 8 aa, Mycobacterium tuberculosis
YSEHFYNG

SEQ ID NO: 8506 - protein, 8 aa, Mycobacterium tuberculosis
SEHFYNGD

SEQ ID NO: 8507 - protein, 8 aa, Mycobacterium tuberculosis
EHFYNGDP

SEQ ID NO: 8508 - protein, 8 aa, Mycobacterium tuberculosis
HFYNGDPL

SEQ ID NO: 8509 - protein, 8 aa, Mycobacterium tuberculosis
FYNGDPLT

SEQ ID NO: 8510 - protein, 8 aa, Mycobacterium tuberculosis
YNGDPLTF

SEQ ID NO: 8511 - protein, 8 aa, Mycobacterium tuberculosis
NGDPLTFA

SEQ ID NO: 8512 - protein, 8 aa, Mycobacterium tuberculosis
GDPLTFAW

SEQ ID NO: 8513 - protein, 8 aa, Mycobacterium tuberculosis
DPLTFAWV

SEQ ID NO: 8514 - protein, 8 aa, Mycobacterium tuberculosis
PLTFAWVN

SEQ ID NO: 8515 - protein, 8 aa, Mycobacterium tuberculosis
LTFAWVNH

SEQ ID NO: 8516 - protein, 8 aa, Mycobacterium tuberculosis
TFAWVNHM

SEQ ID NO: 8517 - protein, 8 aa, Mycobacterium tuberculosis
FAWVNHMK

SEQ ID NO: 8518 - protein, 8 aa, Mycobacterium tuberculosis
AWVNHMKI

SEQ ID NO: 8519 - protein, 8 aa, Mycobacterium tuberculosis
WVNHMKIF

SEQ ID NO: 8520 - protein, 8 aa, Mycobacterium tuberculosis
VNHMKIFF

SEQ ID NO: 8521 - protein, 8 aa, Mycobacterium tuberculosis
NHMKIFFN

SEQ ID NO: 8522 - protein, 8 aa, Mycobacterium tuberculosis
HMKIFFNN

SEQ ID NO: 8523 - protein, 8 aa, Mycobacterium tuberculosis
MKIFFNNK

SEQ ID NO: 8524 - protein, 8 aa, Mycobacterium tuberculosis
KIFFNNKG

SEQ ID NO: 8525 - protein, 8 aa, Mycobacterium tuberculosis
IFFNNKGV

SEQ ID NO: 8526 - protein, 8 aa, Mycobacterium tuberculosis
FFNNKGVV

SEQ ID NO: 8527 - protein, 8 aa, Mycobacterium tuberculosis
FNNKGVVA

SEQ ID NO: 8528 - protein, 8 aa, Mycobacterium tuberculosis
NNKGVVAK

SEQ ID NO: 8529 - protein, 8 aa, Mycobacterium tuberculosis
NKGVVAKG

SEQ ID NO: 8530 - protein, 8 aa, Mycobacterium tuberculosis
KGVVAKGT

SEQ ID NO: 8531 - protein, 8 aa, Mycobacterium tuberculosis
GVVAKGTE

SEQ ID NO: 8532 - protein, 8 aa, Mycobacterium tuberculosis
VVAKGTEV

SEQ ID NO: 8533 - protein, 8 aa, Mycobacterium tuberculosis
VAKGTEVC

SEQ ID NO: 8534 - protein, 8 aa, Mycobacterium tuberculosis
AKGTEVCN

SEQ ID NO: 8535 - protein, 8 aa, Mycobacterium tuberculosis
KGTEVCNG

SEQ ID NO: 8536 - protein, 8 aa, Mycobacterium tuberculosis
GTEVCNGY

SEQ ID NO: 8537 - protein, 8 aa, Mycobacterium tuberculosis
TEVCNGYP

SEQ ID NO: 8538 - protein, 8 aa, Mycobacterium tuberculosis
EVCNGYPA

SEQ ID NO: 8539 - protein, 8 aa, Mycobacterium tuberculosis
VCNGYPAG

SEQ ID NO: 8540 - protein, 8 aa, Mycobacterium tuberculosis
CNGYPAGD

SEQ ID NO: 8541 - protein, 8 aa, Mycobacterium tuberculosis
NGYPAGDM

SEQ ID NO: 8542 - protein, 8 aa, Mycobacterium tuberculosis
GYPAGDMS

SEQ ID NO: 8543 - protein, 8 aa, Mycobacterium tuberculosis
YPAGDMSV

SEQ ID NO: 8544 - protein, 8 aa, Mycobacterium tuberculosis
PAGDMSVW

SEQ ID NO: 8545 - protein, 8 aa, Mycobacterium tuberculosis
AGDMSVWN

SEQ ID NO: 8546 - protein, 8 aa, Mycobacterium tuberculosis
GDMSVWNW

SEQ ID NO: 8547 - protein, 8 aa, Mycobacterium tuberculosis
DMSVWNWA

SEQ ID NO: 8548 - protein, 9 aa, Mycobacterium tuberculosis
MSRLSSILR

SEQ ID NO: 8549 - protein, 9 aa, Mycobacterium tuberculosis
SRLSSILRA

SEQ ID NO: 8550 - protein, 9 aa, Mycobacterium tuberculosis
RLSSILRAG

SEQ ID NO: 8551 - protein, 9 aa, Mycobacterium tuberculosis
LSSILRAGA

SEQ ID NO: 8552 - protein, 9 aa, Mycobacterium tuberculosis
SSILRAGAA

SEQ ID NO: 8553 - protein, 9 aa, Mycobacterium tuberculosis
SILRAGAAF

SEQ ID NO: 8554 - protein, 9 aa, Mycobacterium tuberculosis
ILRAGAAFL

SEQ ID NO: 8555 - protein, 9 aa, Mycobacterium tuberculosis
LRAGAAFLV

SEQ ID NO: 8556 - protein, 9 aa, Mycobacterium tuberculosis
RAGAAFLVL

SEQ ID NO: 8557 - protein, 9 aa, Mycobacterium tuberculosis
AGAAFLVLG

SEQ ID NO: 8558 - protein, 9 aa, Mycobacterium tuberculosis
GAAFLVLGI

SEQ ID NO: 8559 - protein, 9 aa, Mycobacterium tuberculosis
AAFLVLGIA

SEQ ID NO: 8560 - protein, 9 aa, Mycobacterium tuberculosis
AFLVLGIAA

SEQ ID NO: 8561 - protein, 9 aa, Mycobacterium tuberculosis
FLVLGIAAA

SEQ ID NO: 8562 - protein, 9 aa, Mycobacterium tuberculosis
LVLGIAAAT

SEQ ID NO: 8563 - protein, 9 aa, Mycobacterium tuberculosis
VLGIAAATF

SEQ ID NO: 8564 - protein, 9 aa, Mycobacterium tuberculosis
LGIAAATFP

SEQ ID NO: 8565 - protein, 9 aa, Mycobacterium tuberculosis
GIAAATFPQ

SEQ ID NO: 8566 - protein, 9 aa, Mycobacterium tuberculosis
IAAATFPQS

SEQ ID NO: 8567 - protein, 9 aa, Mycobacterium tuberculosis
AAATFPQSA

SEQ ID NO: 8568 - protein, 9 aa, Mycobacterium tuberculosis
AATFPQSAA

SEQ ID NO: 8569 - protein, 9 aa, Mycobacterium tuberculosis
ATFPQSAAA

SEQ ID NO: 8570 - protein, 9 aa, Mycobacterium tuberculosis
TFPQSAAAD

SEQ ID NO: 8571 - protein, 9 aa, Mycobacterium tuberculosis
FPQSAAADS

SEQ ID NO: 8572 - protein, 9 aa, Mycobacterium tuberculosis
PQSAAADST

SEQ ID NO: 8573 - protein, 9 aa, Mycobacterium tuberculosis
QSAAADSTE

SEQ ID NO: 8574 - protein, 9 aa, Mycobacterium tuberculosis
SAAADSTED

SEQ ID NO: 8575 - protein, 9 aa, Mycobacterium tuberculosis
AAADSTEDF

SEQ ID NO: 8576 - protein, 9 aa, Mycobacterium tuberculosis
AADSTEDFP

SEQ ID NO: 8577 - protein, 9 aa, Mycobacterium tuberculosis
ADSTEDFPI

SEQ ID NO: 8578 - protein, 9 aa, Mycobacterium tuberculosis
DSTEDFPIP

SEQ ID NO: 8579 - protein, 9 aa, Mycobacterium tuberculosis
STEDFPIPR

SEQ ID NO: 8580 - protein, 9 aa, Mycobacterium tuberculosis
TEDFPIPRR

SEQ ID NO: 8581 - protein, 9 aa, Mycobacterium tuberculosis
EDFPIPRRM

SEQ ID NO: 8582 - protein, 9 aa, Mycobacterium tuberculosis
DFPIPRRMI

SEQ ID NO: 8583 - protein, 9 aa, Mycobacterium tuberculosis
FPIPRRMIA

SEQ ID NO: 8584 - protein, 9 aa, Mycobacterium tuberculosis
PIPRRMIAT

SEQ ID NO: 8585 - protein, 9 aa, Mycobacterium tuberculosis
IPRRMIATT

SEQ ID NO: 8586 - protein, 9 aa, Mycobacterium tuberculosis
PRRMIATTC

SEQ ID NO: 8587 - protein, 9 aa, Mycobacterium tuberculosis
RRMIATTCD

SEQ ID NO: 8588 - protein, 9 aa, Mycobacterium tuberculosis
RMIATTCDA

SEQ ID NO: 8589 - protein, 9 aa, Mycobacterium tuberculosis
MIATTCDAE

SEQ ID NO: 8590 - protein, 9 aa, Mycobacterium tuberculosis
IATTCDAEQ

SEQ ID NO: 8591 - protein, 9 aa, Mycobacterium tuberculosis
ATTCDAEQY

SEQ ID NO: 8592 - protein, 9 aa, Mycobacterium tuberculosis
TTCDAEQYL

SEQ ID NO: 8593 - protein, 9 aa, Mycobacterium tuberculosis
TCDAEQYLA

SEQ ID NO: 8594 - protein, 9 aa, Mycobacterium tuberculosis
CDAEQYLAA

SEQ ID NO: 8595 - protein, 9 aa, Mycobacterium tuberculosis
DAEQYLAAV

SEQ ID NO: 8596 - protein, 9 aa, Mycobacterium tuberculosis
AEQYLAAVR

SEQ ID NO: 8597 - protein, 9 aa, Mycobacterium tuberculosis
EQYLAAVRD

SEQ ID NO: 8598 - protein, 9 aa, Mycobacterium tuberculosis
QYLAAVRDT

SEQ ID NO: 8599 - protein, 9 aa, Mycobacterium tuberculosis
YLAAVRDTS

SEQ ID NO: 8600 - protein, 9 aa, Mycobacterium tuberculosis
LAAVRDTSP

SEQ ID NO: 8601 - protein, 9 aa, Mycobacterium tuberculosis
AAVRDTSPV

SEQ ID NO: 8602 - protein, 9 aa, Mycobacterium tuberculosis
AVRDTSPVY

SEQ ID NO: 8603 - protein, 9 aa, Mycobacterium tuberculosis
VRDTSPVYY

SEQ ID NO: 8604 - protein, 9 aa, Mycobacterium tuberculosis
RDTSPVYYQ

SEQ ID NO: 8605 - protein, 9 aa, Mycobacterium tuberculosis
DTSPVYYQR

SEQ ID NO: 8606 - protein, 9 aa, Mycobacterium tuberculosis
TSPVYYQRY

SEQ ID NO: 8607 - protein, 9 aa, Mycobacterium tuberculosis
SPVYYQRYM

SEQ ID NO: 8608 - protein, 9 aa, Mycobacterium tuberculosis
PVYYQRYMI

SEQ ID NO: 8609 - protein, 9 aa, Mycobacterium tuberculosis
VYYQRYMID

SEQ ID NO: 8610 - protein, 9 aa, Mycobacterium tuberculosis
YYQRYMIDF

SEQ ID NO: 8611 - protein, 9 aa, Mycobacterium tuberculosis
YQRYMIDFN

SEQ ID NO: 8612 - protein, 9 aa, Mycobacterium tuberculosis
QRYMIDFNN

SEQ ID NO: 8613 - protein, 9 aa, Mycobacterium tuberculosis
RYMIDFNNH

SEQ ID NO: 8614 - protein, 9 aa, Mycobacterium tuberculosis
YMIDFNNHA

SEQ ID NO: 8615 - protein, 9 aa, Mycobacterium tuberculosis
MIDFNNHAN

SEQ ID NO: 8616 - protein, 9 aa, Mycobacterium tuberculosis
IDFNNHANL

SEQ ID NO: 8617 - protein, 9 aa, Mycobacterium tuberculosis
DFNNHANLQ

SEQ ID NO: 8618 - protein, 9 aa, Mycobacterium tuberculosis
FNNHANLQQ

SEQ ID NO: 8619 - protein, 9 aa, Mycobacterium tuberculosis
NNHANLQQA

SEQ ID NO: 8620 - protein, 9 aa, Mycobacterium tuberculosis
NHANLQQAT

SEQ ID NO: 8621 - protein, 9 aa, Mycobacterium tuberculosis
HANLQQATI

SEQ ID NO: 8622 - protein, 9 aa, Mycobacterium tuberculosis
ANLQQATIN

SEQ ID NO: 8623 - protein, 9 aa, Mycobacterium tuberculosis
NLQQATINK

SEQ ID NO: 8624 - protein, 9 aa, Mycobacterium tuberculosis
LQQATINKA

SEQ ID NO: 8625 - protein, 9 aa, Mycobacterium tuberculosis
QQATINKAH

SEQ ID NO: 8626 - protein, 9 aa, Mycobacterium tuberculosis
QATINKAHW

SEQ ID NO: 8627 - protein, 9 aa, Mycobacterium tuberculosis
ATINKAHWF

SEQ ID NO: 8628 - protein, 9 aa, Mycobacterium tuberculosis
TINKAHWFF

SEQ ID NO: 8629 - protein, 9 aa, Mycobacterium tuberculosis
INKAHWFFS

SEQ ID NO: 8630 - protein, 9 aa, Mycobacterium tuberculosis
NKAHWFFSL

SEQ ID NO: 8631 - protein, 9 aa, Mycobacterium tuberculosis
KAHWFFSLS

SEQ ID NO: 8632 - protein, 9 aa, Mycobacterium tuberculosis
AHWFFSLSP

SEQ ID NO: 8633 - protein, 9 aa, Mycobacterium tuberculosis
HWFFSLSPA

SEQ ID NO: 8634 - protein, 9 aa, Mycobacterium tuberculosis
WFFSLSPAE

SEQ ID NO: 8635 - protein, 9 aa, Mycobacterium tuberculosis
FFSLSPAER

SEQ ID NO: 8636 - protein, 9 aa, Mycobacterium tuberculosis
FSLSPAERR

SEQ ID NO: 8637 - protein, 9 aa, Mycobacterium tuberculosis
SLSPAERRD

SEQ ID NO: 8638 - protein, 9 aa, Mycobacterium tuberculosis
LSPAERRDY

SEQ ID NO: 8639 - protein, 9 aa, Mycobacterium tuberculosis
SPAERRDYS

SEQ ID NO: 8640 - protein, 9 aa, Mycobacterium tuberculosis
PAERRDYSE

SEQ ID NO: 8641 - protein, 9 aa, Mycobacterium tuberculosis
AERRDYSEH

SEQ ID NO: 8642 - protein, 9 aa, Mycobacterium tuberculosis
ERRDYSEHF

SEQ ID NO: 8643 - protein, 9 aa, Mycobacterium tuberculosis
RRDYSEHFY

SEQ ID NO: 8644 - protein, 9 aa, Mycobacterium tuberculosis
RDYSEHFYN

SEQ ID NO: 8645 - protein, 9 aa, Mycobacterium tuberculosis
DYSEHFYNG

SEQ ID NO: 8646 - protein, 9 aa, Mycobacterium tuberculosis
YSEHFYNGD

SEQ ID NO: 8647 - protein, 9 aa, Mycobacterium tuberculosis
SEHFYNGDP

SEQ ID NO: 8648 - protein, 9 aa, Mycobacterium tuberculosis
EHFYNGDPL

SEQ ID NO: 8649 - protein, 9 aa, Mycobacterium tuberculosis
HFYNGDPLT

SEQ ID NO: 8650 - protein, 9 aa, Mycobacterium tuberculosis
FYNGDPLTF

SEQ ID NO: 8651 - protein, 9 aa, Mycobacterium tuberculosis
YNGDPLTFA

SEQ ID NO: 8652 - protein, 9 aa, Mycobacterium tuberculosis
NGDPLTFAW

SEQ ID NO: 8653 - protein, 9 aa, Mycobacterium tuberculosis
GDPLTFAWV

SEQ ID NO: 8654 - protein, 9 aa, Mycobacterium tuberculosis
DPLTFAWVN

SEQ ID NO: 8655 - protein, 9 aa, Mycobacterium tuberculosis
PLTFAWVNH

SEQ ID NO: 8656 - protein, 9 aa, Mycobacterium tuberculosis
LTFAWVNHM

SEQ ID NO: 8657 - protein, 9 aa, Mycobacterium tuberculosis
TFAWVNHMK

SEQ ID NO: 8658 - protein, 9 aa, Mycobacterium tuberculosis
FAWVNHMKI

SEQ ID NO: 8659 - protein, 9 aa, Mycobacterium tuberculosis
AWVNHMKIF

SEQ ID NO: 8660 - protein, 9 aa, Mycobacterium tuberculosis
WVNHMKIFF

SEQ ID NO: 8661 - protein, 9 aa, Mycobacterium tuberculosis
VNHMKIFFN

SEQ ID NO: 8662 - protein, 9 aa, Mycobacterium tuberculosis
NHMKIFFNN

SEQ ID NO: 8663 - protein, 9 aa, Mycobacterium tuberculosis
HMKIFFNNK

SEQ ID NO: 8664 - protein, 9 aa, Mycobacterium tuberculosis
MKIFFNNKG

SEQ ID NO: 8665 - protein, 9 aa, Mycobacterium tuberculosis
KIFFNNKGV

SEQ ID NO: 8666 - protein, 9 aa, Mycobacterium tuberculosis
IFFNNKGVV

SEQ ID NO: 8667 - protein, 9 aa, Mycobacterium tuberculosis
FFNNKGVVA

SEQ ID NO: 8668 - protein, 9 aa, Mycobacterium tuberculosis
FNNKGVVAK

SEQ ID NO: 8669 - protein, 9 aa, Mycobacterium tuberculosis
NNKGVVAKG

SEQ ID NO: 8670 - protein, 9 aa, Mycobacterium tuberculosis
NKGVVAKGT

SEQ ID NO: 8671 - protein, 9 aa, Mycobacterium tuberculosis
KGVVAKGTE

SEQ ID NO: 8672 - protein, 9 aa, Mycobacterium tuberculosis
GVVAKGTEV

SEQ ID NO: 8673 - protein, 9 aa, Mycobacterium tuberculosis
VVAKGTEVC

SEQ ID NO: 8674 - protein, 9 aa, Mycobacterium tuberculosis
VAKGTEVCN

SEQ ID NO: 8675 - protein, 9 aa, Mycobacterium tuberculosis
AKGTEVCNG

SEQ ID NO: 8676 - protein, 9 aa, Mycobacterium tuberculosis
KGTEVCNGY

SEQ ID NO: 8677 - protein, 9 aa, Mycobacterium tuberculosis
GTEVCNGYP

SEQ ID NO: 8678 - protein, 9 aa, Mycobacterium tuberculosis
TEVCNGYPA

SEQ ID NO: 8679 - protein, 9 aa, Mycobacterium tuberculosis
EVCNGYPAG

SEQ ID NO: 8680 - protein, 9 aa, Mycobacterium tuberculosis
VCNGYPAGD

SEQ ID NO: 8681 - protein, 9 aa, Mycobacterium tuberculosis
CNGYPAGDM

SEQ ID NO: 8682 - protein, 9 aa, Mycobacterium tuberculosis
NGYPAGDMS

SEQ ID NO: 8683 - protein, 9 aa, Mycobacterium tuberculosis
GYPAGDMSV

SEQ ID NO: 8684 - protein, 9 aa, Mycobacterium tuberculosis
YPAGDMSVW

SEQ ID NO: 8685 - protein, 9 aa, Mycobacterium tuberculosis
PAGDMSVWN

SEQ ID NO: 8686 - protein, 9 aa, Mycobacterium tuberculosis
AGDMSVWNW

SEQ ID NO: 8687 - protein, 9 aa, Mycobacterium tuberculosis
GDMSVWNWA

SEQ ID NO: 8688 - protein, 10 aa, Mycobacterium tuberculosis
MSRLSSILRA

SEQ ID NO: 8689 - protein, 10 aa, Mycobacterium tuberculosis
SRLSSILRAG

SEQ ID NO: 8690 - protein, 10 aa, Mycobacterium tuberculosis
RLSSILRAGA

SEQ ID NO: 8691 - protein, 10 aa, Mycobacterium tuberculosis
LSSILRAGAA

SEQ ID NO: 8692 - protein, 10 aa, Mycobacterium tuberculosis
SSILRAGAAF

SEQ ID NO: 8693 - protein, 10 aa, Mycobacterium tuberculosis
SILRAGAAFL

SEQ ID NO: 8694 - protein, 10 aa, Mycobacterium tuberculosis
ILRAGAAFLV

SEQ ID NO: 8695 - protein, 10 aa, Mycobacterium tuberculosis
LRAGAAFLVL

SEQ ID NO: 8696 - protein, 10 aa, Mycobacterium tuberculosis
RAGAAFLVLG

SEQ ID NO: 8697 - protein, 10 aa, Mycobacterium tuberculosis
AGAAFLVLGI

SEQ ID NO: 8698 - protein, 10 aa, Mycobacterium tuberculosis
GAAFLVLGIA

SEQ ID NO: 8699 - protein, 10 aa, Mycobacterium tuberculosis
AAFLVLGIAA

SEQ ID NO: 8700 - protein, 10 aa, Mycobacterium tuberculosis
AFLVLGIAAA

SEQ ID NO: 8701 - protein, 10 aa, Mycobacterium tuberculosis
FLVLGIAAAT

SEQ ID NO: 8702 - protein, 10 aa, Mycobacterium tuberculosis
LVLGIAAATF

SEQ ID NO: 8703 - protein, 10 aa, Mycobacterium tuberculosis
VLGIAAATFP

SEQ ID NO: 8704 - protein, 10 aa, Mycobacterium tuberculosis
LGIAAATFPQ

SEQ ID NO: 8705 - protein, 10 aa, Mycobacterium tuberculosis
GIAAATFPQS

SEQ ID NO: 8706 - protein, 10 aa, Mycobacterium tuberculosis
IAAATFPQSA

SEQ ID NO: 8707 - protein, 10 aa, Mycobacterium tuberculosis
AAATFPQSAA

SEQ ID NO: 8708 - protein, 10 aa, Mycobacterium tuberculosis
AATFPQSAAA

SEQ ID NO: 8709 - protein, 10 aa, Mycobacterium tuberculosis
ATFPQSAAAD

SEQ ID NO: 8710 - protein, 10 aa, Mycobacterium tuberculosis
TFPQSAAADS

SEQ ID NO: 8711 - protein, 10 aa, Mycobacterium tuberculosis
FPQSAAADST

SEQ ID NO: 8712 - protein, 10 aa, Mycobacterium tuberculosis
PQSAAADSTE

SEQ ID NO: 8713 - protein, 10 aa, Mycobacterium tuberculosis
QSAAADSTED

SEQ ID NO: 8714 - protein, 10 aa, Mycobacterium tuberculosis
SAAADSTEDF

SEQ ID NO: 8715 - protein, 10 aa, Mycobacterium tuberculosis
AAADSTEDFP

SEQ ID NO: 8716 - protein, 10 aa, Mycobacterium tuberculosis
AADSTEDFPI

SEQ ID NO: 8717 - protein, 10 aa, Mycobacterium tuberculosis
ADSTEDFPIP

SEQ ID NO: 8718 - protein, 10 aa, Mycobacterium tuberculosis
DSTEDFPIPR

SEQ ID NO: 8719 - protein, 10 aa, Mycobacterium tuberculosis
STEDFPIPRR

SEQ ID NO: 8720 - protein, 10 aa, Mycobacterium tuberculosis
TEDFPIPRRM

SEQ ID NO: 8721 - protein, 10 aa, Mycobacterium tuberculosis
EDFPIPRRMI

SEQ ID NO: 8722 - protein, 10 aa, Mycobacterium tuberculosis
DFPIPRRMIA

SEQ ID NO: 8723 - protein, 10 aa, Mycobacterium tuberculosis
FPIPRRMIAT

SEQ ID NO: 8724 - protein, 10 aa, Mycobacterium tuberculosis
PIPRRMIATT

SEQ ID NO: 8725 - protein, 10 aa, Mycobacterium tuberculosis
IPRRMIATTC

SEQ ID NO: 8726 - protein, 10 aa, Mycobacterium tuberculosis
PRRMIATTCD

SEQ ID NO: 8727 - protein, 10 aa, Mycobacterium tuberculosis
RRMIATTCDA

SEQ ID NO: 8728 - protein, 10 aa, Mycobacterium tuberculosis
RMIATTCDAE

SEQ ID NO: 8729 - protein, 10 aa, Mycobacterium tuberculosis
MIATTCDAEQ

SEQ ID NO: 8730 - protein, 10 aa, Mycobacterium tuberculosis
IATTCDAEQY

SEQ ID NO: 8731 - protein, 10 aa, Mycobacterium tuberculosis
ATTCDAEQYL

SEQ ID NO: 8732 - protein, 10 aa, Mycobacterium tuberculosis
TTCDAEQYLA

SEQ ID NO: 8733 - protein, 10 aa, Mycobacterium tuberculosis
TCDAEQYLAA

SEQ ID NO: 8734 - protein, 10 aa, Mycobacterium tuberculosis
CDAEQYLAAV

SEQ ID NO: 8735 - protein, 10 aa, Mycobacterium tuberculosis
DAEQYLAAVR

SEQ ID NO: 8736 - protein, 10 aa, Mycobacterium tuberculosis
AEQYLAAVRD

SEQ ID NO: 8737 - protein, 10 aa, Mycobacterium tuberculosis
EQYLAAVRDT

SEQ ID NO: 8738 - protein, 10 aa, Mycobacterium tuberculosis
QYLAAVRDTS

SEQ ID NO: 8739 - protein, 10 aa, Mycobacterium tuberculosis
YLAAVRDTSP

SEQ ID NO: 8740 - protein, 10 aa, Mycobacterium tuberculosis
LAAVRDTSPV

SEQ ID NO: 8741 - protein, 10 aa, Mycobacterium tuberculosis
AAVRDTSPVY

SEQ ID NO: 8742 - protein, 10 aa, Mycobacterium tuberculosis
AVRDTSPVYY

SEQ ID NO: 8743 - protein, 10 aa, Mycobacterium tuberculosis
VRDTSPVYYQ

SEQ ID NO: 8744 - protein, 10 aa, Mycobacterium tuberculosis
RDTSPVYYQR

SEQ ID NO: 8745 - protein, 10 aa, Mycobacterium tuberculosis
DTSPVYYQRY

SEQ ID NO: 8746 - protein, 10 aa, Mycobacterium tuberculosis
TSPVYYQRYM

SEQ ID NO: 8747 - protein, 10 aa, Mycobacterium tuberculosis
SPVYYQRYMI

SEQ ID NO: 8748 - protein, 10 aa, Mycobacterium tuberculosis
PVYYQRYMID

SEQ ID NO: 8749 - protein, 10 aa, Mycobacterium tuberculosis
VYYQRYMIDF

SEQ ID NO: 8750 - protein, 10 aa, Mycobacterium tuberculosis
YYQRYMIDFN

SEQ ID NO: 8751 - protein, 10 aa, Mycobacterium tuberculosis
YQRYMIDFNN

SEQ ID NO: 8752 - protein, 10 aa, Mycobacterium tuberculosis
QRYMIDFNNH

SEQ ID NO: 8753 - protein, 10 aa, Mycobacterium tuberculosis
RYMIDFNNHA

SEQ ID NO: 8754 - protein, 10 aa, Mycobacterium tuberculosis
YMIDFNNHAN

SEQ ID NO: 8755 - protein, 10 aa, Mycobacterium tuberculosis
MIDFNNHANL

SEQ ID NO: 8756 - protein, 10 aa, Mycobacterium tuberculosis
IDFNNHANLQ

SEQ ID NO: 8757 - protein, 10 aa, Mycobacterium tuberculosis
DFNNHANLQQ

SEQ ID NO: 8758 - protein, 10 aa, Mycobacterium tuberculosis
FNNHANLQQA

SEQ ID NO: 8759 - protein, 10 aa, Mycobacterium tuberculosis
NNHANLQQAT

SEQ ID NO: 8760 - protein, 10 aa, Mycobacterium tuberculosis
NHANLQQATI

SEQ ID NO: 8761 - protein, 10 aa, Mycobacterium tuberculosis
HANLQQATIN

SEQ ID NO: 8762 - protein, 10 aa, Mycobacterium tuberculosis
ANLQQATINK

SEQ ID NO: 8763 - protein, 10 aa, Mycobacterium tuberculosis
NLQQATINKA

SEQ ID NO: 8764 - protein, 10 aa, Mycobacterium tuberculosis
LQQATINKAH

SEQ ID NO: 8765 - protein, 10 aa, Mycobacterium tuberculosis
QQATINKAHW

SEQ ID NO: 8766 - protein, 10 aa, Mycobacterium tuberculosis
QATINKAHWF

SEQ ID NO: 8767 - protein, 10 aa, Mycobacterium tuberculosis
ATINKAHWFF

SEQ ID NO: 8768 - protein, 10 aa, Mycobacterium tuberculosis
TINKAHWFFS

SEQ ID NO: 8769 - protein, 10 aa, Mycobacterium tuberculosis
INKAHWFFSL

SEQ ID NO: 8770 - protein, 10 aa, Mycobacterium tuberculosis
NKAHWFFSLS

SEQ ID NO: 8771 - protein, 10 aa, Mycobacterium tuberculosis
KAHWFFSLSP

SEQ ID NO: 8772 - protein, 10 aa, Mycobacterium tuberculosis
AHWFFSLSPA

SEQ ID NO: 8773 - protein, 10 aa, Mycobacterium tuberculosis
HWFFSLSPAE

SEQ ID NO: 8774 - protein, 10 aa, Mycobacterium tuberculosis
WFFSLSPAER

SEQ ID NO: 8775 - protein, 10 aa, Mycobacterium tuberculosis
FFSLSPAERR

SEQ ID NO: 8776 - protein, 10 aa, Mycobacterium tuberculosis
FSLSPAERRD

SEQ ID NO: 8777 - protein, 10 aa, Mycobacterium tuberculosis
SLSPAERRDY

SEQ ID NO: 8778 - protein, 10 aa, Mycobacterium tuberculosis
LSPAERRDYS

SEQ ID NO: 8779 - protein, 10 aa, Mycobacterium tuberculosis
SPAERRDYSE

SEQ ID NO: 8780 - protein, 10 aa, Mycobacterium tuberculosis
PAERRDYSEH

SEQ ID NO: 8781 - protein, 10 aa, Mycobacterium tuberculosis
AERRDYSEHF

SEQ ID NO: 8782 - protein, 10 aa, Mycobacterium tuberculosis
ERRDYSEHFY

SEQ ID NO: 8783 - protein, 10 aa, Mycobacterium tuberculosis
RRDYSEHFYN

SEQ ID NO: 8784 - protein, 10 aa, Mycobacterium tuberculosis
RDYSEHFYNG

SEQ ID NO: 8785 - protein, 10 aa, Mycobacterium tuberculosis
DYSEHFYNGD

SEQ ID NO: 8786 - protein, 10 aa, Mycobacterium tuberculosis
YSEHFYNGDP

SEQ ID NO: 8787 - protein, 10 aa, Mycobacterium tuberculosis
SEHFYNGDPL

SEQ ID NO: 8788 - protein, 10 aa, Mycobacterium tuberculosis
EHFYNGDPLT

SEQ ID NO: 8789 - protein, 10 aa, Mycobacterium tuberculosis
HFYNGDPLTF

SEQ ID NO: 8790 - protein, 10 aa, Mycobacterium tuberculosis
FYNGDPLTFA

SEQ ID NO: 8791 - protein, 10 aa, Mycobacterium tuberculosis
YNGDPLTFAW

SEQ ID NO: 8792 - protein, 10 aa, Mycobacterium tuberculosis
NGDPLTFAWV

SEQ ID NO: 8793 - protein, 10 aa, Mycobacterium tuberculosis
GDPLTFAWVN

SEQ ID NO: 8794 - protein, 10 aa, Mycobacterium tuberculosis
DPLTFAWVNH

SEQ ID NO: 8795 - protein, 10 aa, Mycobacterium tuberculosis
PLTFAWVNHM

SEQ ID NO: 8796 - protein, 10 aa, Mycobacterium tuberculosis
LTFAWVNHMK

SEQ ID NO: 8797 - protein, 10 aa, Mycobacterium tuberculosis
TFAWVNHMKI

SEQ ID NO: 8798 - protein, 10 aa, Mycobacterium tuberculosis
FAWVNHMKIF

SEQ ID NO: 8799 - protein, 10 aa, Mycobacterium tuberculosis
AWVNHMKIFF

SEQ ID NO: 8800 - protein, 10 aa, Mycobacterium tuberculosis
WVNHMKIFFN

SEQ ID NO: 8801 - protein, 10 aa, Mycobacterium tuberculosis
VNHMKIFFNN

SEQ ID NO: 8802 - protein, 10 aa, Mycobacterium tuberculosis
NHMKIFFNNK

SEQ ID NO: 8803 - protein, 10 aa, Mycobacterium tuberculosis
HMKIFFNNKG

SEQ ID NO: 8804 - protein, 10 aa, Mycobacterium tuberculosis
MKIFFNNKGV

SEQ ID NO: 8805 - protein, 10 aa, Mycobacterium tuberculosis
KIFFNNKGVV

SEQ ID NO: 8806 - protein, 10 aa, Mycobacterium tuberculosis
IFFNNKGVVA

SEQ ID NO: 8807 - protein, 10 aa, Mycobacterium tuberculosis
FFNNKGVVAK

SEQ ID NO: 8808 - protein, 10 aa, Mycobacterium tuberculosis
FNNKGVVAKG

SEQ ID NO: 8809 - protein, 10 aa, Mycobacterium tuberculosis
NNKGVVAKGT

SEQ ID NO: 8810 - protein, 10 aa, Mycobacterium tuberculosis
NKGVVAKGTE

SEQ ID NO: 8811 - protein, 10 aa, Mycobacterium tuberculosis
KGVVAKGTEV

SEQ ID NO: 8812 - protein, 10 aa, Mycobacterium tuberculosis
GVVAKGTEVC

SEQ ID NO: 8813 - protein, 10 aa, Mycobacterium tuberculosis
VVAKGTEVCN

SEQ ID NO: 8814 - protein, 10 aa, Mycobacterium tuberculosis
VAKGTEVCNG

SEQ ID NO: 8815 - protein, 10 aa, Mycobacterium tuberculosis
AKGTEVCNGY

SEQ ID NO: 8816 - protein, 10 aa, Mycobacterium tuberculosis
KGTEVCNGYP

SEQ ID NO: 8817 - protein, 10 aa, Mycobacterium tuberculosis
GTEVCNGYPA

SEQ ID NO: 8818 - protein, 10 aa, Mycobacterium tuberculosis
TEVCNGYPAG

SEQ ID NO: 8819 - protein, 10 aa, Mycobacterium tuberculosis
EVCNGYPAGD

SEQ ID NO: 8820 - protein, 10 aa, Mycobacterium tuberculosis
VCNGYPAGDM

SEQ ID NO: 8821 - protein, 10 aa, Mycobacterium tuberculosis
CNGYPAGDMS

SEQ ID NO: 8822 - protein, 10 aa, Mycobacterium tuberculosis
NGYPAGDMSV

SEQ ID NO: 8823 - protein, 10 aa, Mycobacterium tuberculosis
GYPAGDMSVW

SEQ ID NO: 8824 - protein, 10 aa, Mycobacterium tuberculosis
YPAGDMSVWN

SEQ ID NO: 8825 - protein, 10 aa, Mycobacterium tuberculosis
PAGDMSVWNW

SEQ ID NO: 8826 - protein, 10 aa, Mycobacterium tuberculosis
AGDMSVWNWA

SEQ ID NO: 8827 - protein, 11 aa, Mycobacterium tuberculosis
MSRLSSILRAG

SEQ ID NO: 8828 - protein, 11 aa, Mycobacterium tuberculosis
SRLSSILRAGA

SEQ ID NO: 8829 - protein, 11 aa, Mycobacterium tuberculosis
RLSSILRAGAA

SEQ ID NO: 8830 - protein, 11 aa, Mycobacterium tuberculosis
LSSILRAGAAF

SEQ ID NO: 8831 - protein, 11 aa, Mycobacterium tuberculosis
SSILRAGAAFL

SEQ ID NO: 8832 - protein, 11 aa, Mycobacterium tuberculosis
SILRAGAAFLV

SEQ ID NO: 8833 - protein, 11 aa, Mycobacterium tuberculosis
ILRAGAAFLVL

SEQ ID NO: 8834 - protein, 11 aa, Mycobacterium tuberculosis
LRAGAAFLVLG

SEQ ID NO: 8835 - protein, 11 aa, Mycobacterium tuberculosis
RAGAAFLVLGI

SEQ ID NO: 8836 - protein, 11 aa, Mycobacterium tuberculosis
AGAAFLVLGIA

SEQ ID NO: 8837 - protein, 11 aa, Mycobacterium tuberculosis
GAAFLVLGIAA

SEQ ID NO: 8838 - protein, 11 aa, Mycobacterium tuberculosis
AAFLVLGIAAA

SEQ ID NO: 8839 - protein, 11 aa, Mycobacterium tuberculosis
AFLVLGIAAAT

SEQ ID NO: 8840 - protein, 11 aa, Mycobacterium tuberculosis
FLVLGIAAATF

SEQ ID NO: 8841 - protein, 11 aa, Mycobacterium tuberculosis
LVLGIAAATFP

SEQ ID NO: 8842 - protein, 11 aa, Mycobacterium tuberculosis
VLGIAAATFPQ

SEQ ID NO: 8843 - protein, 11 aa, Mycobacterium tuberculosis
LGIAAATFPQS

SEQ ID NO: 8844 - protein, 11 aa, Mycobacterium tuberculosis
GIAAATFPQSA

SEQ ID NO: 8845 - protein, 11 aa, Mycobacterium tuberculosis
IAAATFPQSAA

SEQ ID NO: 8846 - protein, 11 aa, Mycobacterium tuberculosis
AAATFPQSAAA

SEQ ID NO: 8847 - protein, 11 aa, Mycobacterium tuberculosis
AATFPQSAAAD

SEQ ID NO: 8848 - protein, 11 aa, Mycobacterium tuberculosis
ATFPQSAAADS

SEQ ID NO: 8849 - protein, 11 aa, Mycobacterium tuberculosis
TFPQSAAADST

SEQ ID NO: 8850 - protein, 11 aa, Mycobacterium tuberculosis
FPQSAAADSTE

SEQ ID NO: 8851 - protein, 11 aa, Mycobacterium tuberculosis
PQSAAADSTED

SEQ ID NO: 8852 - protein, 11 aa, Mycobacterium tuberculosis
QSAAADSTEDF

SEQ ID NO: 8853 - protein, 11 aa, Mycobacterium tuberculosis
SAAADSTEDFP

SEQ ID NO: 8854 - protein, 11 aa, Mycobacterium tuberculosis
AAADSTEDFPI

SEQ ID NO: 8855 - protein, 11 aa, Mycobacterium tuberculosis
AADSTEDFPIP

SEQ ID NO: 8856 - protein, 11 aa, Mycobacterium tuberculosis
ADSTEDFPIPR

SEQ ID NO: 8857 - protein, 11 aa, Mycobacterium tuberculosis
DSTEDFPIPRR

SEQ ID NO: 8858 - protein, 11 aa, Mycobacterium tuberculosis
STEDFPIPRRM

SEQ ID NO: 8859 - protein, 11 aa, Mycobacterium tuberculosis
TEDFPIPRRMI

SEQ ID NO: 8860 - protein, 11 aa, Mycobacterium tuberculosis
EDFPIPRRMIA

SEQ ID NO: 8861 - protein, 11 aa, Mycobacterium tuberculosis
DFPIPRRMIAT

SEQ ID NO: 8862 - protein, 11 aa, Mycobacterium tuberculosis
FPIPRRMIATT

SEQ ID NO: 8863 - protein, 11 aa, Mycobacterium tuberculosis
PIPRRMIATTC

SEQ ID NO: 8864 - protein, 11 aa, Mycobacterium tuberculosis
IPRRMIATTCD

SEQ ID NO: 8865 - protein, 11 aa, Mycobacterium tuberculosis
PRRMIATTCDA

SEQ ID NO: 8866 - protein, 11 aa, Mycobacterium tuberculosis
RRMIATTCDAE

SEQ ID NO: 8867 - protein, 11 aa, Mycobacterium tuberculosis
RMIATTCDAEQ

SEQ ID NO: 8868 - protein, 11 aa, Mycobacterium tuberculosis
MIATTCDAEQY

SEQ ID NO: 8869 - protein, 11 aa, Mycobacterium tuberculosis
IATTCDAEQYL

SEQ ID NO: 8870 - protein, 11 aa, Mycobacterium tuberculosis
ATTCDAEQYLA

SEQ ID NO: 8871 - protein, 11 aa, Mycobacterium tuberculosis
TTCDAEQYLAA

SEQ ID NO: 8872 - protein, 11 aa, Mycobacterium tuberculosis
TCDAEQYLAAV

SEQ ID NO: 8873 - protein, 11 aa, Mycobacterium tuberculosis
CDAEQYLAAVR

SEQ ID NO: 8874 - protein, 11 aa, Mycobacterium tuberculosis
DAEQYLAAVRD

SEQ ID NO: 8875 - protein, 11 aa, Mycobacterium tuberculosis
AEQYLAAVRDT

SEQ ID NO: 8876 - protein, 11 aa, Mycobacterium tuberculosis
EQYLAAVRDTS

SEQ ID NO: 8877 - protein, 11 aa, Mycobacterium tuberculosis
QYLAAVRDTSP

SEQ ID NO: 8878 - protein, 11 aa, Mycobacterium tuberculosis
YLAAVRDTSPV

SEQ ID NO: 8879 - protein, 11 aa, Mycobacterium tuberculosis
LAAVRDTSPVY

SEQ ID NO: 8880 - protein, 11 aa, Mycobacterium tuberculosis
AAVRDTSPVYY

SEQ ID NO: 8881 - protein, 11 aa, Mycobacterium tuberculosis
AVRDTSPVYYQ

SEQ ID NO: 8882 - protein, 11 aa, Mycobacterium tuberculosis
VRDTSPVYYQR

SEQ ID NO: 8883 - protein, 11 aa, Mycobacterium tuberculosis
RDTSPVYYQRY

SEQ ID NO: 8884 - protein, 11 aa, Mycobacterium tuberculosis
DTSPVYYQRYM

SEQ ID NO: 8885 - protein, 11 aa, Mycobacterium tuberculosis
TSPVYYQRYMI

SEQ ID NO: 8886 - protein, 11 aa, Mycobacterium tuberculosis
SPVYYQRYMID

SEQ ID NO: 8887 - protein, 11 aa, Mycobacterium tuberculosis
PVYYQRYMIDF

SEQ ID NO: 8888 - protein, 11 aa, Mycobacterium tuberculosis
VYYQRYMIDFN

SEQ ID NO: 8889 - protein, 11 aa, Mycobacterium tuberculosis
YYQRYMIDFNN

SEQ ID NO: 8890 - protein, 11 aa, Mycobacterium tuberculosis
YQRYMIDFNNH

SEQ ID NO: 8891 - protein, 11 aa, Mycobacterium tuberculosis
QRYMIDFNNHA

SEQ ID NO: 8892 - protein, 11 aa, Mycobacterium tuberculosis
RYMIDFNNHAN

SEQ ID NO: 8893 - protein, 11 aa, Mycobacterium tuberculosis
YMIDFNNHANL

SEQ ID NO: 8894 - protein, 11 aa, Mycobacterium tuberculosis
MIDFNNHANLQ

SEQ ID NO: 8895 - protein, 11 aa, Mycobacterium tuberculosis
IDFNNHANLQQ

SEQ ID NO: 8896 - protein, 11 aa, Mycobacterium tuberculosis
DFNNHANLQQA

SEQ ID NO: 8897 - protein, 11 aa, Mycobacterium tuberculosis
FNNHANLQQAT

SEQ ID NO: 8898 - protein, 11 aa, Mycobacterium tuberculosis
NNHANLQQATI

SEQ ID NO: 8899 - protein, 11 aa, Mycobacterium tuberculosis
NHANLQQATIN

SEQ ID NO: 8900 - protein, 11 aa, Mycobacterium tuberculosis
HANLQQATINK

SEQ ID NO: 8901 - protein, 11 aa, Mycobacterium tuberculosis
ANLQQATINKA

SEQ ID NO: 8902 - protein, 11 aa, Mycobacterium tuberculosis
NLQQATINKAH

SEQ ID NO: 8903 - protein, 11 aa, Mycobacterium tuberculosis
LQQATINKAHW

SEQ ID NO: 8904 - protein, 11 aa, Mycobacterium tuberculosis
QQATINKAHWF

SEQ ID NO: 8905 - protein, 11 aa, Mycobacterium tuberculosis
QATINKAHWFF

SEQ ID NO: 8906 - protein, 11 aa, Mycobacterium tuberculosis
ATINKAHWFFS

SEQ ID NO: 8907 - protein, 11 aa, Mycobacterium tuberculosis
TINKAHWFFSL

SEQ ID NO: 8908 - protein, 11 aa, Mycobacterium tuberculosis
INKAHWFFSLS

SEQ ID NO: 8909 - protein, 11 aa, Mycobacterium tuberculosis
NKAHWFFSLSP

SEQ ID NO: 8910 - protein, 11 aa, Mycobacterium tuberculosis
KAHWFFSLSPA

SEQ ID NO: 8911 - protein, 11 aa, Mycobacterium tuberculosis
AHWFFSLSPAE

SEQ ID NO: 8912 - protein, 11 aa, Mycobacterium tuberculosis
HWFFSLSPAER

SEQ ID NO: 8913 - protein, 11 aa, Mycobacterium tuberculosis
WFFSLSPAERR

SEQ ID NO: 8914 - protein, 11 aa, Mycobacterium tuberculosis
FFSLSPAERRD

SEQ ID NO: 8915 - protein, 11 aa, Mycobacterium tuberculosis
FSLSPAERRDY

SEQ ID NO: 8916 - protein, 11 aa, Mycobacterium tuberculosis
SLSPAERRDYS

SEQ ID NO: 8917 - protein, 11 aa, Mycobacterium tuberculosis
LSPAERRDYSE

SEQ ID NO: 8918 - protein, 11 aa, Mycobacterium tuberculosis
SPAERRDYSEH

SEQ ID NO: 8919 - protein, 11 aa, Mycobacterium tuberculosis
PAERRDYSEHF

SEQ ID NO: 8920 - protein, 11 aa, Mycobacterium tuberculosis
AERRDYSEHFY

SEQ ID NO: 8921 - protein, 11 aa, Mycobacterium tuberculosis
ERRDYSEHFYN

SEQ ID NO: 8922 - protein, 11 aa, Mycobacterium tuberculosis
RRDYSEHFYNG

SEQ ID NO: 8923 - protein, 11 aa, Mycobacterium tuberculosis
RDYSEHFYNGD

SEQ ID NO: 8924 - protein, 11 aa, Mycobacterium tuberculosis
DYSEHFYNGDP

SEQ ID NO: 8925 - protein, 11 aa, Mycobacterium tuberculosis
YSEHFYNGDPL

SEQ ID NO: 8926 - protein, 11 aa, Mycobacterium tuberculosis
SEHFYNGDPLT

SEQ ID NO: 8927 - protein, 11 aa, Mycobacterium tuberculosis
EHFYNGDPLTF

SEQ ID NO: 8928 - protein, 11 aa, Mycobacterium tuberculosis
HFYNGDPLTFA

SEQ ID NO: 8929 - protein, 11 aa, Mycobacterium tuberculosis
FYNGDPLTFAW

SEQ ID NO: 8930 - protein, 11 aa, Mycobacterium tuberculosis
YNGDPLTFAWV

SEQ ID NO: 8931 - protein, 11 aa, Mycobacterium tuberculosis
NGDPLTFAWVN

SEQ ID NO: 8932 - protein, 11 aa, Mycobacterium tuberculosis
GDPLTFAWVNH

SEQ ID NO: 8933 - protein, 11 aa, Mycobacterium tuberculosis
DPLTFAWVNHM

SEQ ID NO: 8934 - protein, 11 aa, Mycobacterium tuberculosis
PLTFAWVNHMK

SEQ ID NO: 8935 - protein, 11 aa, Mycobacterium tuberculosis
LTFAWVNHMKI

SEQ ID NO: 8936 - protein, 11 aa, Mycobacterium tuberculosis
TFAWVNHMKIF

SEQ ID NO: 8937 - protein, 11 aa, Mycobacterium tuberculosis
FAWVNHMKIFF

SEQ ID NO: 8938 - protein, 11 aa, Mycobacterium tuberculosis
AWVNHMKIFFN

SEQ ID NO: 8939 - protein, 11 aa, Mycobacterium tuberculosis
WVNHMKIFFNN

SEQ ID NO: 8940 - protein, 11 aa, Mycobacterium tuberculosis
VNHMKIFFNNK

SEQ ID NO: 8941 - protein, 11 aa, Mycobacterium tuberculosis
NHMKIFFNNKG

SEQ ID NO: 8942 - protein, 11 aa, Mycobacterium tuberculosis
HMKIFFNNKGV

SEQ ID NO: 8943 - protein, 11 aa, Mycobacterium tuberculosis
MKIFFNNKGVV

SEQ ID NO: 8944 - protein, 11 aa, Mycobacterium tuberculosis
KIFFNNKGVVA

SEQ ID NO: 8945 - protein, 11 aa, Mycobacterium tuberculosis
IFFNNKGVVAK

SEQ ID NO: 8946 - protein, 11 aa, Mycobacterium tuberculosis
FFNNKGVVAKG

SEQ ID NO: 8947 - protein, 11 aa, Mycobacterium tuberculosis
FNNKGVVAKGT

SEQ ID NO: 8948 - protein, 11 aa, Mycobacterium tuberculosis
NNKGVVAKGTE

SEQ ID NO: 8949 - protein, 11 aa, Mycobacterium tuberculosis
NKGVVAKGTEV

SEQ ID NO: 8950 - protein, 11 aa, Mycobacterium tuberculosis
KGVVAKGTEVC

SEQ ID NO: 8951 - protein, 11 aa, Mycobacterium tuberculosis
GVVAKGTEVCN

SEQ ID NO: 8952 - protein, 11 aa, Mycobacterium tuberculosis
VVAKGTEVCNG

SEQ ID NO: 8953 - protein, 11 aa, Mycobacterium tuberculosis
VAKGTEVCNGY

SEQ ID NO: 8954 - protein, 11 aa, Mycobacterium tuberculosis
AKGTEVCNGYP

SEQ ID NO: 8955 - protein, 11 aa, Mycobacterium tuberculosis
KGTEVCNGYPA

SEQ ID NO: 8956 - protein, 11 aa, Mycobacterium tuberculosis
GTEVCNGYPAG

SEQ ID NO: 8957 - protein, 11 aa, Mycobacterium tuberculosis
TEVCNGYPAGD

SEQ ID NO: 8958 - protein, 11 aa, Mycobacterium tuberculosis
EVCNGYPAGDM

SEQ ID NO: 8959 - protein, 11 aa, Mycobacterium tuberculosis
VCNGYPAGDMS

SEQ ID NO: 8960 - protein, 11 aa, Mycobacterium tuberculosis
CNGYPAGDMSV

SEQ ID NO: 8961 - protein, 11 aa, Mycobacterium tuberculosis
NGYPAGDMSVW

SEQ ID NO: 8962 - protein, 11 aa, Mycobacterium tuberculosis
GYPAGDMSVWN

SEQ ID NO: 8963 - protein, 11 aa, Mycobacterium tuberculosis
YPAGDMSVWNW

SEQ ID NO: 8964 - protein, 11 aa, Mycobacterium tuberculosis
PAGDMSVWNWA

SEQ ID NO: 8965 - protein, 8 aa, Mycobacterium tuberculosis
MTTTIPTS

SEQ ID NO: 8966 - protein, 8 aa, Mycobacterium tuberculosis
TTTIPTSK

SEQ ID NO: 8967 - protein, 8 aa, Mycobacterium tuberculosis
TTIPTSKS

SEQ ID NO: 8968 - protein, 8 aa, Mycobacterium tuberculosis
TIPTSKSA

SEQ ID NO: 8969 - protein, 8 aa, Mycobacterium tuberculosis
IPTSKSAC

SEQ ID NO: 8970 - protein, 8 aa, Mycobacterium tuberculosis
PTSKSACS

SEQ ID NO: 8971 - protein, 8 aa, Mycobacterium tuberculosis
TSKSACSV

SEQ ID NO: 8972 - protein, 8 aa, Mycobacterium tuberculosis
SKSACSVT

SEQ ID NO: 8973 - protein, 8 aa, Mycobacterium tuberculosis
KSACSVTT

SEQ ID NO: 8974 - protein, 8 aa, Mycobacterium tuberculosis
SACSVTTR

SEQ ID NO: 8975 - protein, 8 aa, Mycobacterium tuberculosis
ACSVTTRP

SEQ ID NO: 8976 - protein, 8 aa, Mycobacterium tuberculosis
CSVTTRPG

SEQ ID NO: 8977 - protein, 8 aa, Mycobacterium tuberculosis
SVTTRPGN

SEQ ID NO: 8978 - protein, 8 aa, Mycobacterium tuberculosis
VTTRPGNA

SEQ ID NO: 8979 - protein, 8 aa, Mycobacterium tuberculosis
TTRPGNAA

SEQ ID NO: 8980 - protein, 8 aa, Mycobacterium tuberculosis
TRPGNAAV

SEQ ID NO: 8981 - protein, 8 aa, Mycobacterium tuberculosis
RPGNAAVD

SEQ ID NO: 8982 - protein, 8 aa, Mycobacterium tuberculosis
PGNAAVDY

SEQ ID NO: 8983 - protein, 8 aa, Mycobacterium tuberculosis
GNAAVDYG

SEQ ID NO: 8984 - protein, 8 aa, Mycobacterium tuberculosis
NAAVDYGG

SEQ ID NO: 8985 - protein, 8 aa, Mycobacterium tuberculosis
AAVDYGGA

SEQ ID NO: 8986 - protein, 8 aa, Mycobacterium tuberculosis
AVDYGGAQ

SEQ ID NO: 8987 - protein, 8 aa, Mycobacterium tuberculosis
VDYGGAQI

SEQ ID NO: 8988 - protein, 8 aa, Mycobacterium tuberculosis
DYGGAQIR

SEQ ID NO: 8989 - protein, 8 aa, Mycobacterium tuberculosis
YGGAQIRA

SEQ ID NO: 8990 - protein, 8 aa, Mycobacterium tuberculosis
GGAQIRAY

SEQ ID NO: 8991 - protein, 8 aa, Mycobacterium tuberculosis
GAQIRAYL

SEQ ID NO: 8992 - protein, 8 aa, Mycobacterium tuberculosis
AQIRAYLH

SEQ ID NO: 8993 - protein, 8 aa, Mycobacterium tuberculosis
QIRAYLHH

SEQ ID NO: 8994 - protein, 8 aa, Mycobacterium tuberculosis
IRAYLHHL

SEQ ID NO: 8995 - protein, 8 aa, Mycobacterium tuberculosis
RAYLHHLA

SEQ ID NO: 8996 - protein, 8 aa, Mycobacterium tuberculosis
AYLHHLAT

SEQ ID NO: 8997 - protein, 8 aa, Mycobacterium tuberculosis
YLHHLATV

SEQ ID NO: 8998 - protein, 8 aa, Mycobacterium tuberculosis
LHHLATVV

SEQ ID NO: 8999 - protein, 8 aa, Mycobacterium tuberculosis
HHLATVVT

SEQ ID NO: 9000 - protein, 8 aa, Mycobacterium tuberculosis
HLATVVTI

SEQ ID NO: 9001 - protein, 8 aa, Mycobacterium tuberculosis
LATVVTIR

SEQ ID NO: 9002 - protein, 8 aa, Mycobacterium tuberculosis
ATVVTIRG

SEQ ID NO: 9003 - protein, 8 aa, Mycobacterium tuberculosis
TVVTIRGE

SEQ ID NO: 9004 - protein, 8 aa, Mycobacterium tuberculosis
VVTIRGEI

SEQ ID NO: 9005 - protein, 8 aa, Mycobacterium tuberculosis
VTIRGEID

SEQ ID NO: 9006 - protein, 8 aa, Mycobacterium tuberculosis
TIRGEIDA

SEQ ID NO: 9007 - protein, 8 aa, Mycobacterium tuberculosis
IRGEIDAA

SEQ ID NO: 9008 - protein, 8 aa, Mycobacterium tuberculosis
RGEIDAAN

SEQ ID NO: 9009 - protein, 8 aa, Mycobacterium tuberculosis
GEIDAANV

SEQ ID NO: 9010 - protein, 8 aa, Mycobacterium tuberculosis
EIDAANVE

SEQ ID NO: 9011 - protein, 8 aa, Mycobacterium tuberculosis
IDAANVEQ

SEQ ID NO: 9012 - protein, 8 aa, Mycobacterium tuberculosis
DAANVEQI

SEQ ID NO: 9013 - protein, 8 aa, Mycobacterium tuberculosis
AANVEQIS

SEQ ID NO: 9014 - protein, 8 aa, Mycobacterium tuberculosis
ANVEQISE

SEQ ID NO: 9015 - protein, 8 aa, Mycobacterium tuberculosis
NVEQISEH

SEQ ID NO: 9016 - protein, 8 aa, Mycobacterium tuberculosis
VEQISEHV

SEQ ID NO: 9017 - protein, 8 aa, Mycobacterium tuberculosis
EQISEHVR

SEQ ID NO: 9018 - protein, 8 aa, Mycobacterium tuberculosis
QISEHVRR

SEQ ID NO: 9019 - protein, 8 aa, Mycobacterium tuberculosis
ISEHVRRF

SEQ ID NO: 9020 - protein, 8 aa, Mycobacterium tuberculosis
SEHVRRFS

SEQ ID NO: 9021 - protein, 8 aa, Mycobacterium tuberculosis
EHVRRFSL

SEQ ID NO: 9022 - protein, 8 aa, Mycobacterium tuberculosis
HVRRFSLG

SEQ ID NO: 9023 - protein, 8 aa, Mycobacterium tuberculosis
VRRFSLGT

SEQ ID NO: 9024 - protein, 8 aa, Mycobacterium tuberculosis
RRFSLGTN

SEQ ID NO: 9025 - protein, 8 aa, Mycobacterium tuberculosis
RFSLGTNP

SEQ ID NO: 9026 - protein, 8 aa, Mycobacterium tuberculosis
FSLGTNPM

SEQ ID NO: 9027 - protein, 8 aa, Mycobacterium tuberculosis
SLGTNPMV

SEQ ID NO: 9028 - protein, 8 aa, Mycobacterium tuberculosis
LGTNPMVL

SEQ ID NO: 9029 - protein, 8 aa, Mycobacterium tuberculosis
GTNPMVLD

SEQ ID NO: 9030 - protein, 8 aa, Mycobacterium tuberculosis
TNPMVLDL

SEQ ID NO: 9031 - protein, 8 aa, Mycobacterium tuberculosis
NPMVLDLS

SEQ ID NO: 9032 - protein, 8 aa, Mycobacterium tuberculosis
PMVLDLSE

SEQ ID NO: 9033 - protein, 8 aa, Mycobacterium tuberculosis
MVLDLSEL

SEQ ID NO: 9034 - protein, 8 aa, Mycobacterium tuberculosis
VLDLSELS

SEQ ID NO: 9035 - protein, 8 aa, Mycobacterium tuberculosis
LDLSELSH

SEQ ID NO: 9036 - protein, 8 aa, Mycobacterium tuberculosis
DLSELSHF

SEQ ID NO: 9037 - protein, 8 aa, Mycobacterium tuberculosis
LSELSHFS

SEQ ID NO: 9038 - protein, 8 aa, Mycobacterium tuberculosis
SELSHFSG

SEQ ID NO: 9039 - protein, 8 aa, Mycobacterium tuberculosis
ELSHFSGA

SEQ ID NO: 9040 - protein, 8 aa, Mycobacterium tuberculosis
LSHFSGAG

SEQ ID NO: 9041 - protein, 8 aa, Mycobacterium tuberculosis
SHFSGAGI

SEQ ID NO: 9042 - protein, 8 aa, Mycobacterium tuberculosis
HFSGAGIS

SEQ ID NO: 9043 - protein, 8 aa, Mycobacterium tuberculosis
FSGAGISL

SEQ ID NO: 9044 - protein, 8 aa, Mycobacterium tuberculosis
SGAGISLL

SEQ ID NO: 9045 - protein, 8 aa, Mycobacterium tuberculosis
GAGISLLC

SEQ ID NO: 9046 - protein, 8 aa, Mycobacterium tuberculosis
AGISLLCI

SEQ ID NO: 9047 - protein, 8 aa, Mycobacterium tuberculosis
GISLLCIL

SEQ ID NO: 9048 - protein, 8 aa, Mycobacterium tuberculosis
ISLLCILD

SEQ ID NO: 9049 - protein, 8 aa, Mycobacterium tuberculosis
SLLCILDE

SEQ ID NO: 9050 - protein, 8 aa, Mycobacterium tuberculosis
LLCILDED

SEQ ID NO: 9051 - protein, 8 aa, Mycobacterium tuberculosis
LCILDEDC

SEQ ID NO: 9052 - protein, 8 aa, Mycobacterium tuberculosis
CILDEDCR

SEQ ID NO: 9053 - protein, 8 aa, Mycobacterium tuberculosis
ILDEDCRA

SEQ ID NO: 9054 - protein, 8 aa, Mycobacterium tuberculosis
LDEDCRAA

SEQ ID NO: 9055 - protein, 8 aa, Mycobacterium tuberculosis
DEDCRAAG

SEQ ID NO: 9056 - protein, 8 aa, Mycobacterium tuberculosis
EDCRAAGV

SEQ ID NO: 9057 - protein, 8 aa, Mycobacterium tuberculosis
DCRAAGVQ

SEQ ID NO: 9058 - protein, 8 aa, Mycobacterium tuberculosis
CRAAGVQW

SEQ ID NO: 9059 - protein, 8 aa, Mycobacterium tuberculosis
RAAGVQWA

SEQ ID NO: 9060 - protein, 8 aa, Mycobacterium tuberculosis
AAGVQWAL

SEQ ID NO: 9061 - protein, 8 aa, Mycobacterium tuberculosis
AGVQWALV

SEQ ID NO: 9062 - protein, 8 aa, Mycobacterium tuberculosis
GVQWALVA

SEQ ID NO: 9063 - protein, 8 aa, Mycobacterium tuberculosis
VQWALVAS

SEQ ID NO: 9064 - protein, 8 aa, Mycobacterium tuberculosis
QWALVASP

SEQ ID NO: 9065 - protein, 8 aa, Mycobacterium tuberculosis
WALVASPA

SEQ ID NO: 9066 - protein, 8 aa, Mycobacterium tuberculosis
ALVASPAV

SEQ ID NO: 9067 - protein, 8 aa, Mycobacterium tuberculosis
LVASPAVV

SEQ ID NO: 9068 - protein, 8 aa, Mycobacterium tuberculosis
VASPAVVE

SEQ ID NO: 9069 - protein, 8 aa, Mycobacterium tuberculosis
ASPAVVEQ

SEQ ID NO: 9070 - protein, 8 aa, Mycobacterium tuberculosis
SPAVVEQL

SEQ ID NO: 9071 - protein, 8 aa, Mycobacterium tuberculosis
PAVVEQLG

SEQ ID NO: 9072 - protein, 8 aa, Mycobacterium tuberculosis
AVVEQLGG

SEQ ID NO: 9073 - protein, 8 aa, Mycobacterium tuberculosis
VVEQLGGR

SEQ ID NO: 9074 - protein, 8 aa, Mycobacterium tuberculosis
VEQLGGRC

SEQ ID NO: 9075 - protein, 8 aa, Mycobacterium tuberculosis
EQLGGRCD

SEQ ID NO: 9076 - protein, 8 aa, Mycobacterium tuberculosis
QLGGRCDQ

SEQ ID NO: 9077 - protein, 8 aa, Mycobacterium tuberculosis
LGGRCDQG

SEQ ID NO: 9078 - protein, 8 aa, Mycobacterium tuberculosis
GGRCDQGE

SEQ ID NO: 9079 - protein, 8 aa, Mycobacterium tuberculosis
GRCDQGEH

SEQ ID NO: 9080 - protein, 8 aa, Mycobacterium tuberculosis
RCDQGEHE

SEQ ID NO: 9081 - protein, 8 aa, Mycobacterium tuberculosis
CDQGEHES

SEQ ID NO: 9082 - protein, 8 aa, Mycobacterium tuberculosis
DQGEHESM

SEQ ID NO: 9083 - protein, 8 aa, Mycobacterium tuberculosis
QGEHESMF

SEQ ID NO: 9084 - protein, 8 aa, Mycobacterium tuberculosis
GEHESMFP

SEQ ID NO: 9085 - protein, 8 aa, Mycobacterium tuberculosis
EHESMFPM

SEQ ID NO: 9086 - protein, 8 aa, Mycobacterium tuberculosis
HESMFPMA

SEQ ID NO: 9087 - protein, 8 aa, Mycobacterium tuberculosis
ESMFPMAR

SEQ ID NO: 9088 - protein, 8 aa, Mycobacterium tuberculosis
SMFPMARS

SEQ ID NO: 9089 - protein, 8 aa, Mycobacterium tuberculosis
MFPMARSV

SEQ ID NO: 9090 - protein, 8 aa, Mycobacterium tuberculosis
FPMARSVH

SEQ ID NO: 9091 - protein, 8 aa, Mycobacterium tuberculosis
PMARSVHK

SEQ ID NO: 9092 - protein, 8 aa, Mycobacterium tuberculosis
MARSVHKA

SEQ ID NO: 9093 - protein, 8 aa, Mycobacterium tuberculosis
ARSVHKAL

SEQ ID NO: 9094 - protein, 8 aa, Mycobacterium tuberculosis
RSVHKALH

SEQ ID NO: 9095 - protein, 8 aa, Mycobacterium tuberculosis
SVHKALHD

SEQ ID NO: 9096 - protein, 8 aa, Mycobacterium tuberculosis
VHKALHDL

SEQ ID NO: 9097 - protein, 8 aa, Mycobacterium tuberculosis
HKALHDLA

SEQ ID NO: 9098 - protein, 8 aa, Mycobacterium tuberculosis
KALHDLAD

SEQ ID NO: 9099 - protein, 8 aa, Mycobacterium tuberculosis
ALHDLADA

SEQ ID NO: 9100 - protein, 8 aa, Mycobacterium tuberculosis
LHDLADAI

SEQ ID NO: 9101 - protein, 8 aa, Mycobacterium tuberculosis
HDLADAID

SEQ ID NO: 9102 - protein, 8 aa, Mycobacterium tuberculosis
DLADAIDR

SEQ ID NO: 9103 - protein, 8 aa, Mycobacterium tuberculosis
LADAIDRR

SEQ ID NO: 9104 - protein, 8 aa, Mycobacterium tuberculosis
ADAIDRRR

SEQ ID NO: 9105 - protein, 8 aa, Mycobacterium tuberculosis
DAIDRRRQ

SEQ ID NO: 9106 - protein, 8 aa, Mycobacterium tuberculosis
AIDRRRQL

SEQ ID NO: 9107 - protein, 8 aa, Mycobacterium tuberculosis
IDRRRQLV

SEQ ID NO: 9108 - protein, 8 aa, Mycobacterium tuberculosis
DRRRQLVL

SEQ ID NO: 9109 - protein, 8 aa, Mycobacterium tuberculosis
RRRQLVLP

SEQ ID NO: 9110 - protein, 8 aa, Mycobacterium tuberculosis
RRQLVLPL

SEQ ID NO: 9111 - protein, 8 aa, Mycobacterium tuberculosis
RQLVLPLI

SEQ ID NO: 9112 - protein, 8 aa, Mycobacterium tuberculosis
QLVLPLIS

SEQ ID NO: 9113 - protein, 8 aa, Mycobacterium tuberculosis
LVLPLISR

SEQ ID NO: 9114 - protein, 8 aa, Mycobacterium tuberculosis
VLPLISRS

SEQ ID NO: 9115 - protein, 8 aa, Mycobacterium tuberculosis
LPLISRSA

SEQ ID NO: 9116 - protein, 9 aa, Mycobacterium tuberculosis
MTTTIPTSK

SEQ ID NO: 9117 - protein, 9 aa, Mycobacterium tuberculosis
TTTIPTSKS

SEQ ID NO: 9118 - protein, 9 aa, Mycobacterium tuberculosis
TTIPTSKSA

SEQ ID NO: 9119 - protein, 9 aa, Mycobacterium tuberculosis
TIPTSKSAC

SEQ ID NO: 9120 - protein, 9 aa, Mycobacterium tuberculosis
IPTSKSACS

SEQ ID NO: 9121 - protein, 9 aa, Mycobacterium tuberculosis
PTSKSACSV

SEQ ID NO: 9122 - protein, 9 aa, Mycobacterium tuberculosis
TSKSACSVT

SEQ ID NO: 9123 - protein, 9 aa, Mycobacterium tuberculosis
SKSACSVTT

SEQ ID NO: 9124 - protein, 9 aa, Mycobacterium tuberculosis
KSACSVTTR

SEQ ID NO: 9125 - protein, 9 aa, Mycobacterium tuberculosis
SACSVTTRP

SEQ ID NO: 9126 - protein, 9 aa, Mycobacterium tuberculosis
ACSVTTRPG

SEQ ID NO: 9127 - protein, 9 aa, Mycobacterium tuberculosis
CSVTTRPGN

SEQ ID NO: 9128 - protein, 9 aa, Mycobacterium tuberculosis
SVTTRPGNA

SEQ ID NO: 9129 - protein, 9 aa, Mycobacterium tuberculosis
VTTRPGNAA

SEQ ID NO: 9130 - protein, 9 aa, Mycobacterium tuberculosis
TTRPGNAAV

SEQ ID NO: 9131 - protein, 9 aa, Mycobacterium tuberculosis
TRPGNAAVD

SEQ ID NO: 9132 - protein, 9 aa, Mycobacterium tuberculosis
RPGNAAVDY

SEQ ID NO: 9133 - protein, 9 aa, Mycobacterium tuberculosis
PGNAAVDYG

SEQ ID NO: 9134 - protein, 9 aa, Mycobacterium tuberculosis
GNAAVDYGG

SEQ ID NO: 9135 - protein, 9 aa, Mycobacterium tuberculosis
NAAVDYGGA

SEQ ID NO: 9136 - protein, 9 aa, Mycobacterium tuberculosis
AAVDYGGAQ

SEQ ID NO: 9137 - protein, 9 aa, Mycobacterium tuberculosis
AVDYGGAQI

SEQ ID NO: 9138 - protein, 9 aa, Mycobacterium tuberculosis
VDYGGAQIR

SEQ ID NO: 9139 - protein, 9 aa, Mycobacterium tuberculosis
DYGGAQIRA

SEQ ID NO: 9140 - protein, 9 aa, Mycobacterium tuberculosis
YGGAQIRAY

SEQ ID NO: 9141 - protein, 9 aa, Mycobacterium tuberculosis
GGAQIRAYL

SEQ ID NO: 9142 - protein, 9 aa, Mycobacterium tuberculosis
GAQIRAYLH

SEQ ID NO: 9143 - protein, 9 aa, Mycobacterium tuberculosis
AQIRAYLHH

SEQ ID NO: 9144 - protein, 9 aa, Mycobacterium tuberculosis
QIRAYLHHL

SEQ ID NO: 9145 - protein, 9 aa, Mycobacterium tuberculosis
IRAYLHHLA

SEQ ID NO: 9146 - protein, 9 aa, Mycobacterium tuberculosis
RAYLHHLAT

SEQ ID NO: 9147 - protein, 9 aa, Mycobacterium tuberculosis
AYLHHLATV

SEQ ID NO: 9148 - protein, 9 aa, Mycobacterium tuberculosis
YLHHLATVV

SEQ ID NO: 9149 - protein, 9 aa, Mycobacterium tuberculosis
LHHLATVVT

SEQ ID NO: 9150 - protein, 9 aa, Mycobacterium tuberculosis
HHLATVVTI

SEQ ID NO: 9151 - protein, 9 aa, Mycobacterium tuberculosis
HLATVVTIR

SEQ ID NO: 9152 - protein, 9 aa, Mycobacterium tuberculosis
LATVVTIRG

SEQ ID NO: 9153 - protein, 9 aa, Mycobacterium tuberculosis
ATVVTIRGE

SEQ ID NO: 9154 - protein, 9 aa, Mycobacterium tuberculosis
TVVTIRGEI

SEQ ID NO: 9155 - protein, 9 aa, Mycobacterium tuberculosis
VVTIRGEID

SEQ ID NO: 9156 - protein, 9 aa, Mycobacterium tuberculosis
VTIRGEIDA

SEQ ID NO: 9157 - protein, 9 aa, Mycobacterium tuberculosis
TIRGEIDAA

SEQ ID NO: 9158 - protein, 9 aa, Mycobacterium tuberculosis
IRGEIDAAN

SEQ ID NO: 9159 - protein, 9 aa, Mycobacterium tuberculosis
RGEIDAANV

SEQ ID NO: 9160 - protein, 9 aa, Mycobacterium tuberculosis
GEIDAANVE

SEQ ID NO: 9161 - protein, 9 aa, Mycobacterium tuberculosis
EIDAANVEQ

SEQ ID NO: 9162 - protein, 9 aa, Mycobacterium tuberculosis
IDAANVEQI

SEQ ID NO: 9163 - protein, 9 aa, Mycobacterium tuberculosis
DAANVEQIS

SEQ ID NO: 9164 - protein, 9 aa, Mycobacterium tuberculosis
AANVEQISE

SEQ ID NO: 9165 - protein, 9 aa, Mycobacterium tuberculosis
ANVEQISEH

SEQ ID NO: 9166 - protein, 9 aa, Mycobacterium tuberculosis
NVEQISEHV

SEQ ID NO: 9167 - protein, 9 aa, Mycobacterium tuberculosis
VEQISEHVR

SEQ ID NO: 9168 - protein, 9 aa, Mycobacterium tuberculosis
EQISEHVRR

SEQ ID NO: 9169 - protein, 9 aa, Mycobacterium tuberculosis
QISEHVRRF

SEQ ID NO: 9170 - protein, 9 aa, Mycobacterium tuberculosis
ISEHVRRFS

SEQ ID NO: 9171 - protein, 9 aa, Mycobacterium tuberculosis
SEHVRRFSL

SEQ ID NO: 9172 - protein, 9 aa, Mycobacterium tuberculosis
EHVRRFSLG

SEQ ID NO: 9173 - protein, 9 aa, Mycobacterium tuberculosis
HVRRFSLGT

SEQ ID NO: 9174 - protein, 9 aa, Mycobacterium tuberculosis
VRRFSLGTN

SEQ ID NO: 9175 - protein, 9 aa, Mycobacterium tuberculosis
RRFSLGTNP

SEQ ID NO: 9176 - protein, 9 aa, Mycobacterium tuberculosis
RFSLGTNPM

SEQ ID NO: 9177 - protein, 9 aa, Mycobacterium tuberculosis
FSLGTNPMV

SEQ ID NO: 9178 - protein, 9 aa, Mycobacterium tuberculosis
SLGTNPMVL

SEQ ID NO: 9179 - protein, 9 aa, Mycobacterium tuberculosis
LGTNPMVLD

SEQ ID NO: 9180 - protein, 9 aa, Mycobacterium tuberculosis
GTNPMVLDL

SEQ ID NO: 9181 - protein, 9 aa, Mycobacterium tuberculosis
TNPMVLDLS

SEQ ID NO: 9182 - protein, 9 aa, Mycobacterium tuberculosis
NPMVLDLSE

SEQ ID NO: 9183 - protein, 9 aa, Mycobacterium tuberculosis
PMVLDLSEL

SEQ ID NO: 9184 - protein, 9 aa, Mycobacterium tuberculosis
MVLDLSELS

SEQ ID NO: 9185 - protein, 9 aa, Mycobacterium tuberculosis
VLDLSELSH

SEQ ID NO: 9186 - protein, 9 aa, Mycobacterium tuberculosis
LDLSELSHF

SEQ ID NO: 9187 - protein, 9 aa, Mycobacterium tuberculosis
DLSELSHFS

SEQ ID NO: 9188 - protein, 9 aa, Mycobacterium tuberculosis
LSELSHFSG

SEQ ID NO: 9189 - protein, 9 aa, Mycobacterium tuberculosis
SELSHFSGA

SEQ ID NO: 9190 - protein, 9 aa, Mycobacterium tuberculosis
ELSHFSGAG

SEQ ID NO: 9191 - protein, 9 aa, Mycobacterium tuberculosis
LSHFSGAGI

SEQ ID NO: 9192 - protein, 9 aa, Mycobacterium tuberculosis
SHFSGAGIS

SEQ ID NO: 9193 - protein, 9 aa, Mycobacterium tuberculosis
HFSGAGISL

SEQ ID NO: 9194 - protein, 9 aa, Mycobacterium tuberculosis
FSGAGISLL

SEQ ID NO: 9195 - protein, 9 aa, Mycobacterium tuberculosis
SGAGISLLC

SEQ ID NO: 9196 - protein, 9 aa, Mycobacterium tuberculosis
GAGISLLCI

SEQ ID NO: 9197 - protein, 9 aa, Mycobacterium tuberculosis
AGISLLCIL

SEQ ID NO: 9198 - protein, 9 aa, Mycobacterium tuberculosis
GISLLCILD

SEQ ID NO: 9199 - protein, 9 aa, Mycobacterium tuberculosis
ISLLCILDE

SEQ ID NO: 9200 - protein, 9 aa, Mycobacterium tuberculosis
SLLCILDED

SEQ ID NO: 9201 - protein, 9 aa, Mycobacterium tuberculosis
LLCILDEDC

SEQ ID NO: 9202 - protein, 9 aa, Mycobacterium tuberculosis
LCILDEDCR

SEQ ID NO: 9203 - protein, 9 aa, Mycobacterium tuberculosis
CILDEDCRA

SEQ ID NO: 9204 - protein, 9 aa, Mycobacterium tuberculosis
ILDEDCRAA

SEQ ID NO: 9205 - protein, 9 aa, Mycobacterium tuberculosis
LDEDCRAAG

SEQ ID NO: 9206 - protein, 9 aa, Mycobacterium tuberculosis
DEDCRAAGV

SEQ ID NO: 9207 - protein, 9 aa, Mycobacterium tuberculosis
EDCRAAGVQ

SEQ ID NO: 9208 - protein, 9 aa, Mycobacterium tuberculosis
DCRAAGVQW

SEQ ID NO: 9209 - protein, 9 aa, Mycobacterium tuberculosis
CRAAGVQWA

SEQ ID NO: 9210 - protein, 9 aa, Mycobacterium tuberculosis
RAAGVQWAL

SEQ ID NO: 9211 - protein, 9 aa, Mycobacterium tuberculosis
AAGVQWALV

SEQ ID NO: 9212 - protein, 9 aa, Mycobacterium tuberculosis
AGVQWALVA

SEQ ID NO: 9213 - protein, 9 aa, Mycobacterium tuberculosis
GVQWALVAS

SEQ ID NO: 9214 - protein, 9 aa, Mycobacterium tuberculosis
VQWALVASP

SEQ ID NO: 9215 - protein, 9 aa, Mycobacterium tuberculosis
QWALVASPA

SEQ ID NO: 9216 - protein, 9 aa, Mycobacterium tuberculosis
WALVASPAV

SEQ ID NO: 9217 - protein, 9 aa, Mycobacterium tuberculosis
ALVASPAVV

SEQ ID NO: 9218 - protein, 9 aa, Mycobacterium tuberculosis
LVASPAVVE

SEQ ID NO: 9219 - protein, 9 aa, Mycobacterium tuberculosis
VASPAVVEQ

SEQ ID NO: 9220 - protein, 9 aa, Mycobacterium tuberculosis
ASPAVVEQL

SEQ ID NO: 9221 - protein, 9 aa, Mycobacterium tuberculosis
SPAVVEQLG

SEQ ID NO: 9222 - protein, 9 aa, Mycobacterium tuberculosis
PAVVEQLGG

SEQ ID NO: 9223 - protein, 9 aa, Mycobacterium tuberculosis
AVVEQLGGR

SEQ ID NO: 9224 - protein, 9 aa, Mycobacterium tuberculosis
VVEQLGGRC

SEQ ID NO: 9225 - protein, 9 aa, Mycobacterium tuberculosis
VEQLGGRCD

SEQ ID NO: 9226 - protein, 9 aa, Mycobacterium tuberculosis
EQLGGRCDQ

SEQ ID NO: 9227 - protein, 9 aa, Mycobacterium tuberculosis
QLGGRCDQG

SEQ ID NO: 9228 - protein, 9 aa, Mycobacterium tuberculosis
LGGRCDQGE

SEQ ID NO: 9229 - protein, 9 aa, Mycobacterium tuberculosis
GGRCDQGEH

SEQ ID NO: 9230 - protein, 9 aa, Mycobacterium tuberculosis
GRCDQGEHE

SEQ ID NO: 9231 - protein, 9 aa, Mycobacterium tuberculosis
RCDQGEHES

SEQ ID NO: 9232 - protein, 9 aa, Mycobacterium tuberculosis
CDQGEHESM

SEQ ID NO: 9233 - protein, 9 aa, Mycobacterium tuberculosis
DQGEHESMF

SEQ ID NO: 9234 - protein, 9 aa, Mycobacterium tuberculosis
QGEHESMFP

SEQ ID NO: 9235 - protein, 9 aa, Mycobacterium tuberculosis
GEHESMFPM

SEQ ID NO: 9236 - protein, 9 aa, Mycobacterium tuberculosis
EHESMFPMA

SEQ ID NO: 9237 - protein, 9 aa, Mycobacterium tuberculosis
HESMFPMAR

SEQ ID NO: 9238 - protein, 9 aa, Mycobacterium tuberculosis
ESMFPMARS

SEQ ID NO: 9239 - protein, 9 aa, Mycobacterium tuberculosis
SMFPMARSV

SEQ ID NO: 9240 - protein, 9 aa, Mycobacterium tuberculosis
MFPMARSVH

SEQ ID NO: 9241 - protein, 9 aa, Mycobacterium tuberculosis
FPMARSVHK

SEQ ID NO: 9242 - protein, 9 aa, Mycobacterium tuberculosis
PMARSVHKA

SEQ ID NO: 9243 - protein, 9 aa, Mycobacterium tuberculosis
MARSVHKAL

SEQ ID NO: 9244 - protein, 9 aa, Mycobacterium tuberculosis
ARSVHKALH

SEQ ID NO: 9245 - protein, 9 aa, Mycobacterium tuberculosis
RSVHKALHD

SEQ ID NO: 9246 - protein, 9 aa, Mycobacterium tuberculosis
SVHKALHDL

SEQ ID NO: 9247 - protein, 9 aa, Mycobacterium tuberculosis
VHKALHDLA

SEQ ID NO: 9248 - protein, 9 aa, Mycobacterium tuberculosis
HKALHDLAD

SEQ ID NO: 9249 - protein, 9 aa, Mycobacterium tuberculosis
KALHDLADA

SEQ ID NO: 9250 - protein, 9 aa, Mycobacterium tuberculosis
ALHDLADAI

SEQ ID NO: 9251 - protein, 9 aa, Mycobacterium tuberculosis
LHDLADAID

SEQ ID NO: 9252 - protein, 9 aa, Mycobacterium tuberculosis
HDLADAIDR

SEQ ID NO: 9253 - protein, 9 aa, Mycobacterium tuberculosis
DLADAIDRR

SEQ ID NO: 9254 - protein, 9 aa, Mycobacterium tuberculosis
LADAIDRRR

SEQ ID NO: 9255 - protein, 9 aa, Mycobacterium tuberculosis
ADAIDRRRQ

SEQ ID NO: 9256 - protein, 9 aa, Mycobacterium tuberculosis
DAIDRRRQL

SEQ ID NO: 9257 - protein, 9 aa, Mycobacterium tuberculosis
AIDRRRQLV

SEQ ID NO: 9258 - protein, 9 aa, Mycobacterium tuberculosis
IDRRRQLVL

SEQ ID NO: 9259 - protein, 9 aa, Mycobacterium tuberculosis
DRRRQLVLP

SEQ ID NO: 9260 - protein, 9 aa, Mycobacterium tuberculosis
RRRQLVLPL

SEQ ID NO: 9261 - protein, 9 aa, Mycobacterium tuberculosis
RRQLVLPLI

SEQ ID NO: 9262 - protein, 9 aa, Mycobacterium tuberculosis
RQLVLPLIS

SEQ ID NO: 9263 - protein, 9 aa, Mycobacterium tuberculosis
QLVLPLISR

SEQ ID NO: 9264 - protein, 9 aa, Mycobacterium tuberculosis
LVLPLISRS

SEQ ID NO: 9265 - protein, 9 aa, Mycobacterium tuberculosis
VLPLISRSA

SEQ ID NO: 9266 - protein, 10 aa, Mycobacterium tuberculosis
MTTTIPTSKS

SEQ ID NO: 9267 - protein, 10 aa, Mycobacterium tuberculosis
TTTIPTSKSA

SEQ ID NO: 9268 - protein, 10 aa, Mycobacterium tuberculosis
TTIPTSKSAC

SEQ ID NO: 9269 - protein, 10 aa, Mycobacterium tuberculosis
TIPTSKSACS

SEQ ID NO: 9270 - protein, 10 aa, Mycobacterium tuberculosis
IPTSKSACSV

SEQ ID NO: 9271 - protein, 10 aa, Mycobacterium tuberculosis
PTSKSACSVT

SEQ ID NO: 9272 - protein, 10 aa, Mycobacterium tuberculosis
TSKSACSVTT

SEQ ID NO: 9273 - protein, 10 aa, Mycobacterium tuberculosis
SKSACSVTTR

SEQ ID NO: 9274 - protein, 10 aa, Mycobacterium tuberculosis
KSACSVTTRP

SEQ ID NO: 9275 - protein, 10 aa, Mycobacterium tuberculosis
SACSVTTRPG

SEQ ID NO: 9276 - protein, 10 aa, Mycobacterium tuberculosis
ACSVTTRPGN

SEQ ID NO: 9277 - protein, 10 aa, Mycobacterium tuberculosis
CSVTTRPGNA

SEQ ID NO: 9278 - protein, 10 aa, Mycobacterium tuberculosis
SVTTRPGNAA

SEQ ID NO: 9279 - protein, 10 aa, Mycobacterium tuberculosis
VTTRPGNAAV

SEQ ID NO: 9280 - protein, 10 aa, Mycobacterium tuberculosis
TTRPGNAAVD

SEQ ID NO: 9281 - protein, 10 aa, Mycobacterium tuberculosis
TRPGNAAVDY

SEQ ID NO: 9282 - protein, 10 aa, Mycobacterium tuberculosis
RPGNAAVDYG

SEQ ID NO: 9283 - protein, 10 aa, Mycobacterium tuberculosis
PGNAAVDYGG

SEQ ID NO: 9284 - protein, 10 aa, Mycobacterium tuberculosis
GNAAVDYGGA

SEQ ID NO: 9285 - protein, 10 aa, Mycobacterium tuberculosis
NAAVDYGGAQ

SEQ ID NO: 9286 - protein, 10 aa, Mycobacterium tuberculosis
AAVDYGGAQI

SEQ ID NO: 9287 - protein, 10 aa, Mycobacterium tuberculosis
AVDYGGAQIR

SEQ ID NO: 9288 - protein, 10 aa, Mycobacterium tuberculosis
VDYGGAQIRA

SEQ ID NO: 9289 - protein, 10 aa, Mycobacterium tuberculosis
DYGGAQIRAY

SEQ ID NO: 9290 - protein, 10 aa, Mycobacterium tuberculosis
YGGAQIRAYL

SEQ ID NO: 9291 - protein, 10 aa, Mycobacterium tuberculosis
GGAQIRAYLH

SEQ ID NO: 9292 - protein, 10 aa, Mycobacterium tuberculosis
GAQIRAYLHH

SEQ ID NO: 9293 - protein, 10 aa, Mycobacterium tuberculosis
AQIRAYLHHL

SEQ ID NO: 9294 - protein, 10 aa, Mycobacterium tuberculosis
QIRAYLHHLA

SEQ ID NO: 9295 - protein, 10 aa, Mycobacterium tuberculosis
IRAYLHHLAT

SEQ ID NO: 9296 - protein, 10 aa, Mycobacterium tuberculosis
RAYLHHLATV

SEQ ID NO: 9297 - protein, 10 aa, Mycobacterium tuberculosis
AYLHHLATVV

SEQ ID NO: 9298 - protein, 10 aa, Mycobacterium tuberculosis
YLHHLATVVT

SEQ ID NO: 9299 - protein, 10 aa, Mycobacterium tuberculosis
LHHLATVVTI

SEQ ID NO: 9300 - protein, 10 aa, Mycobacterium tuberculosis
HHLATVVTIR

SEQ ID NO: 9301 - protein, 10 aa, Mycobacterium tuberculosis
HLATVVTIRG

SEQ ID NO: 9302 - protein, 10 aa, Mycobacterium tuberculosis
LATVVTIRGE

SEQ ID NO: 9303 - protein, 10 aa, Mycobacterium tuberculosis
ATVVTIRGEI

SEQ ID NO: 9304 - protein, 10 aa, Mycobacterium tuberculosis
TVVTIRGEID

SEQ ID NO: 9305 - protein, 10 aa, Mycobacterium tuberculosis
VVTIRGEIDA

SEQ ID NO: 9306 - protein, 10 aa, Mycobacterium tuberculosis
VTIRGEIDAA

SEQ ID NO: 9307 - protein, 10 aa, Mycobacterium tuberculosis
TIRGEIDAAN

SEQ ID NO: 9308 - protein, 10 aa, Mycobacterium tuberculosis
IRGEIDAANV

SEQ ID NO: 9309 - protein, 10 aa, Mycobacterium tuberculosis
RGEIDAANVE

SEQ ID NO: 9310 - protein, 10 aa, Mycobacterium tuberculosis
GEIDAANVEQ

SEQ ID NO: 9311 - protein, 10 aa, Mycobacterium tuberculosis
EIDAANVEQI

SEQ ID NO: 9312 - protein, 10 aa, Mycobacterium tuberculosis
IDAANVEQIS

SEQ ID NO: 9313 - protein, 10 aa, Mycobacterium tuberculosis
DAANVEQISE

SEQ ID NO: 9314 - protein, 10 aa, Mycobacterium tuberculosis
AANVEQISEH

SEQ ID NO: 9315 - protein, 10 aa, Mycobacterium tuberculosis
ANVEQISEHV

SEQ ID NO: 9316 - protein, 10 aa, Mycobacterium tuberculosis
NVEQISEHVR

SEQ ID NO: 9317 - protein, 10 aa, Mycobacterium tuberculosis
VEQISEHVRR

SEQ ID NO: 9318 - protein, 10 aa, Mycobacterium tuberculosis
EQISEHVRRF

SEQ ID NO: 9319 - protein, 10 aa, Mycobacterium tuberculosis
QISEHVRRFS

SEQ ID NO: 9320 - protein, 10 aa, Mycobacterium tuberculosis
ISEHVRRFSL

SEQ ID NO: 9321 - protein, 10 aa, Mycobacterium tuberculosis
SEHVRRFSLG

SEQ ID NO: 9322 - protein, 10 aa, Mycobacterium tuberculosis
EHVRRFSLGT

SEQ ID NO: 9323 - protein, 10 aa, Mycobacterium tuberculosis
HVRRFSLGTN

SEQ ID NO: 9324 - protein, 10 aa, Mycobacterium tuberculosis
VRRFSLGTNP

SEQ ID NO: 9325 - protein, 10 aa, Mycobacterium tuberculosis
RRFSLGTNPM

SEQ ID NO: 9326 - protein, 10 aa, Mycobacterium tuberculosis
RFSLGTNPMV

SEQ ID NO: 9327 - protein, 10 aa, Mycobacterium tuberculosis
FSLGTNPMVL

SEQ ID NO: 9328 - protein, 10 aa, Mycobacterium tuberculosis
SLGTNPMVLD

SEQ ID NO: 9329 - protein, 10 aa, Mycobacterium tuberculosis
LGTNPMVLDL

SEQ ID NO: 9330 - protein, 10 aa, Mycobacterium tuberculosis
GTNPMVLDLS

SEQ ID NO: 9331 - protein, 10 aa, Mycobacterium tuberculosis
TNPMVLDLSE

SEQ ID NO: 9332 - protein, 10 aa, Mycobacterium tuberculosis
NPMVLDLSEL

SEQ ID NO: 9333 - protein, 10 aa, Mycobacterium tuberculosis
PMVLDLSELS

SEQ ID NO: 9334 - protein, 10 aa, Mycobacterium tuberculosis
MVLDLSELSH

SEQ ID NO: 9335 - protein, 10 aa, Mycobacterium tuberculosis
VLDLSELSHF

SEQ ID NO: 9336 - protein, 10 aa, Mycobacterium tuberculosis
LDLSELSHFS

SEQ ID NO: 9337 - protein, 10 aa, Mycobacterium tuberculosis
DLSELSHFSG

SEQ ID NO: 9338 - protein, 10 aa, Mycobacterium tuberculosis
LSELSHFSGA

SEQ ID NO: 9339 - protein, 10 aa, Mycobacterium tuberculosis
SELSHFSGAG

SEQ ID NO: 9340 - protein, 10 aa, Mycobacterium tuberculosis
ELSHFSGAGI

SEQ ID NO: 9341 - protein, 10 aa, Mycobacterium tuberculosis
LSHFSGAGIS

SEQ ID NO: 9342 - protein, 10 aa, Mycobacterium tuberculosis
SHFSGAGISL

SEQ ID NO: 9343 - protein, 10 aa, Mycobacterium tuberculosis
HFSGAGISLL

SEQ ID NO: 9344 - protein, 10 aa, Mycobacterium tuberculosis
FSGAGISLLC

SEQ ID NO: 9345 - protein, 10 aa, Mycobacterium tuberculosis
SGAGISLLCI

SEQ ID NO: 9346 - protein, 10 aa, Mycobacterium tuberculosis
GAGISLLCIL

SEQ ID NO: 9347 - protein, 10 aa, Mycobacterium tuberculosis
AGISLLCILD

SEQ ID NO: 9348 - protein, 10 aa, Mycobacterium tuberculosis
GISLLCILDE

SEQ ID NO: 9349 - protein, 10 aa, Mycobacterium tuberculosis
ISLLCILDED

SEQ ID NO: 9350 - protein, 10 aa, Mycobacterium tuberculosis
SLLCILDEDC

SEQ ID NO: 9351 - protein, 10 aa, Mycobacterium tuberculosis
LLCILDEDCR

SEQ ID NO: 9352 - protein, 10 aa, Mycobacterium tuberculosis
LCILDEDCRA

SEQ ID NO: 9353 - protein, 10 aa, Mycobacterium tuberculosis
CILDEDCRAA

SEQ ID NO: 9354 - protein, 10 aa, Mycobacterium tuberculosis
ILDEDCRAAG

SEQ ID NO: 9355 - protein, 10 aa, Mycobacterium tuberculosis
LDEDCRAAGV

SEQ ID NO: 9356 - protein, 10 aa, Mycobacterium tuberculosis
DEDCRAAGVQ

SEQ ID NO: 9357 - protein, 10 aa, Mycobacterium tuberculosis
EDCRAAGVQW

SEQ ID NO: 9358 - protein, 10 aa, Mycobacterium tuberculosis
DCRAAGVQWA

SEQ ID NO: 9359 - protein, 10 aa, Mycobacterium tuberculosis
CRAAGVQWAL

SEQ ID NO: 9360 - protein, 10 aa, Mycobacterium tuberculosis
RAAGVQWALV

SEQ ID NO: 9361 - protein, 10 aa, Mycobacterium tuberculosis
AAGVQWALVA

SEQ ID NO: 9362 - protein, 10 aa, Mycobacterium tuberculosis
AGVQWALVAS

SEQ ID NO: 9363 - protein, 10 aa, Mycobacterium tuberculosis
GVQWALVASP

SEQ ID NO: 9364 - protein, 10 aa, Mycobacterium tuberculosis
VQWALVASPA

SEQ ID NO: 9365 - protein, 10 aa, Mycobacterium tuberculosis
QWALVASPAV

SEQ ID NO: 9366 - protein, 10 aa, Mycobacterium tuberculosis
WALVASPAVV

SEQ ID NO: 9367 - protein, 10 aa, Mycobacterium tuberculosis
ALVASPAVVE

SEQ ID NO: 9368 - protein, 10 aa, Mycobacterium tuberculosis
LVASPAVVEQ

SEQ ID NO: 9369 - protein, 10 aa, Mycobacterium tuberculosis
VASPAVVEQL

SEQ ID NO: 9370 - protein, 10 aa, Mycobacterium tuberculosis
ASPAVVEQLG

SEQ ID NO: 9371 - protein, 10 aa, Mycobacterium tuberculosis
SPAVVEQLGG

SEQ ID NO: 9372 - protein, 10 aa, Mycobacterium tuberculosis
PAVVEQLGGR

SEQ ID NO: 9373 - protein, 10 aa, Mycobacterium tuberculosis
AVVEQLGGRC

SEQ ID NO: 9374 - protein, 10 aa, Mycobacterium tuberculosis
VVEQLGGRCD

SEQ ID NO: 9375 - protein, 10 aa, Mycobacterium tuberculosis
VEQLGGRCDQ

SEQ ID NO: 9376 - protein, 10 aa, Mycobacterium tuberculosis
EQLGGRCDQG

SEQ ID NO: 9377 - protein, 10 aa, Mycobacterium tuberculosis
QLGGRCDQGE

SEQ ID NO: 9378 - protein, 10 aa, Mycobacterium tuberculosis
LGGRCDQGEH

SEQ ID NO: 9379 - protein, 10 aa, Mycobacterium tuberculosis
GGRCDQGEHE

SEQ ID NO: 9380 - protein, 10 aa, Mycobacterium tuberculosis
GRCDQGEHES

SEQ ID NO: 9381 - protein, 10 aa, Mycobacterium tuberculosis
RCDQGEHESM

SEQ ID NO: 9382 - protein, 10 aa, Mycobacterium tuberculosis
CDQGEHESMF

SEQ ID NO: 9383 - protein, 10 aa, Mycobacterium tuberculosis
DQGEHESMFP

SEQ ID NO: 9384 - protein, 10 aa, Mycobacterium tuberculosis
QGEHESMFPM

SEQ ID NO: 9385 - protein, 10 aa, Mycobacterium tuberculosis
GEHESMFPMA

SEQ ID NO: 9386 - protein, 10 aa, Mycobacterium tuberculosis
EHESMFPMAR

SEQ ID NO: 9387 - protein, 10 aa, Mycobacterium tuberculosis
HESMFPMARS

SEQ ID NO: 9388 - protein, 10 aa, Mycobacterium tuberculosis
ESMFPMARSV

SEQ ID NO: 9389 - protein, 10 aa, Mycobacterium tuberculosis
SMFPMARSVH

SEQ ID NO: 9390 - protein, 10 aa, Mycobacterium tuberculosis
MFPMARSVHK

SEQ ID NO: 9391 - protein, 10 aa, Mycobacterium tuberculosis
FPMARSVHKA

SEQ ID NO: 9392 - protein, 10 aa, Mycobacterium tuberculosis
PMARSVHKAL

SEQ ID NO: 9393 - protein, 10 aa, Mycobacterium tuberculosis
MARSVHKALH

SEQ ID NO: 9394 - protein, 10 aa, Mycobacterium tuberculosis
ARSVHKALHD

SEQ ID NO: 9395 - protein, 10 aa, Mycobacterium tuberculosis
RSVHKALHDL

SEQ ID NO: 9396 - protein, 10 aa, Mycobacterium tuberculosis
SVHKALHDLA

SEQ ID NO: 9397 - protein, 10 aa, Mycobacterium tuberculosis
VHKALHDLAD

SEQ ID NO: 9398 - protein, 10 aa, Mycobacterium tuberculosis
HKALHDLADA

SEQ ID NO: 9399 - protein, 10 aa, Mycobacterium tuberculosis
KALHDLADAI

SEQ ID NO: 9400 - protein, 10 aa, Mycobacterium tuberculosis
ALHDLADAID

SEQ ID NO: 9401 - protein, 10 aa, Mycobacterium tuberculosis
LHDLADAIDR

SEQ ID NO: 9402 - protein, 10 aa, Mycobacterium tuberculosis
HDLADAIDRR

SEQ ID NO: 9403 - protein, 10 aa, Mycobacterium tuberculosis
DLADAIDRRR

SEQ ID NO: 9404 - protein, 10 aa, Mycobacterium tuberculosis
LADAIDRRRQ

SEQ ID NO: 9405 - protein, 10 aa, Mycobacterium tuberculosis
ADAIDRRRQL

SEQ ID NO: 9406 - protein, 10 aa, Mycobacterium tuberculosis
DAIDRRRQLV

SEQ ID NO: 9407 - protein, 10 aa, Mycobacterium tuberculosis
AIDRRRQLVL

SEQ ID NO: 9408 - protein, 10 aa, Mycobacterium tuberculosis
IDRRRQLVLP

SEQ ID NO: 9409 - protein, 10 aa, Mycobacterium tuberculosis
DRRRQLVLPL

SEQ ID NO: 9410 - protein, 10 aa, Mycobacterium tuberculosis
RRRQLVLPLI

SEQ ID NO: 9411 - protein, 10 aa, Mycobacterium tuberculosis
RRQLVLPLIS

SEQ ID NO: 9412 - protein, 10 aa, Mycobacterium tuberculosis
RQLVLPLISR

SEQ ID NO: 9413 - protein, 10 aa, Mycobacterium tuberculosis
QLVLPLISRS

SEQ ID NO: 9414 - protein, 10 aa, Mycobacterium tuberculosis
LVLPLISRSA

SEQ ID NO: 9415 - protein, 11 aa, Mycobacterium tuberculosis
MTTTIPTSKSA

SEQ ID NO: 9416 - protein, 11 aa, Mycobacterium tuberculosis
TTTIPTSKSAC

SEQ ID NO: 9417 - protein, 11 aa, Mycobacterium tuberculosis
TTIPTSKSACS

SEQ ID NO: 9418 - protein, 11 aa, Mycobacterium tuberculosis
TIPTSKSACSV

SEQ ID NO: 9419 - protein, 11 aa, Mycobacterium tuberculosis
IPTSKSACSVT

SEQ ID NO: 9420 - protein, 11 aa, Mycobacterium tuberculosis
PTSKSACSVTT

SEQ ID NO: 9421 - protein, 11 aa, Mycobacterium tuberculosis
TSKSACSVTTR

SEQ ID NO: 9422 - protein, 11 aa, Mycobacterium tuberculosis
SKSACSVTTRP

SEQ ID NO: 9423 - protein, 11 aa, Mycobacterium tuberculosis
KSACSVTTRPG

SEQ ID NO: 9424 - protein, 11 aa, Mycobacterium tuberculosis
SACSVTTRPGN

SEQ ID NO: 9425 - protein, 11 aa, Mycobacterium tuberculosis
ACSVTTRPGNA

SEQ ID NO: 9426 - protein, 11 aa, Mycobacterium tuberculosis
CSVTTRPGNAA

SEQ ID NO: 9427 - protein, 11 aa, Mycobacterium tuberculosis
SVTTRPGNAAV

SEQ ID NO: 9428 - protein, 11 aa, Mycobacterium tuberculosis
VTTRPGNAAVD

SEQ ID NO: 9429 - protein, 11 aa, Mycobacterium tuberculosis
TTRPGNAAVDY

SEQ ID NO: 9430 - protein, 11 aa, Mycobacterium tuberculosis
TRPGNAAVDYG

SEQ ID NO: 9431 - protein, 11 aa, Mycobacterium tuberculosis
RPGNAAVDYGG

SEQ ID NO: 9432 - protein, 11 aa, Mycobacterium tuberculosis
PGNAAVDYGGA

SEQ ID NO: 9433 - protein, 11 aa, Mycobacterium tuberculosis
GNAAVDYGGAQ

SEQ ID NO: 9434 - protein, 11 aa, Mycobacterium tuberculosis
NAAVDYGGAQI

SEQ ID NO: 9435 - protein, 11 aa, Mycobacterium tuberculosis
AAVDYGGAQIR

SEQ ID NO: 9436 - protein, 11 aa, Mycobacterium tuberculosis
AVDYGGAQIRA

SEQ ID NO: 9437 - protein, 11 aa, Mycobacterium tuberculosis
VDYGGAQIRAY

SEQ ID NO: 9438 - protein, 11 aa, Mycobacterium tuberculosis
DYGGAQIRAYL

SEQ ID NO: 9439 - protein, 11 aa, Mycobacterium tuberculosis
YGGAQIRAYLH

SEQ ID NO: 9440 - protein, 11 aa, Mycobacterium tuberculosis
GGAQIRAYLHH

SEQ ID NO: 9441 - protein, 11 aa, Mycobacterium tuberculosis
GAQIRAYLHHL

SEQ ID NO: 9442 - protein, 11 aa, Mycobacterium tuberculosis
AQIRAYLHHLA

SEQ ID NO: 9443 - protein, 11 aa, Mycobacterium tuberculosis
QIRAYLHHLAT

SEQ ID NO: 9444 - protein, 11 aa, Mycobacterium tuberculosis
IRAYLHHLATV

SEQ ID NO: 9445 - protein, 11 aa, Mycobacterium tuberculosis
RAYLHHLATVV

SEQ ID NO: 9446 - protein, 11 aa, Mycobacterium tuberculosis
AYLHHLATVVT

SEQ ID NO: 9447 - protein, 11 aa, Mycobacterium tuberculosis
YLHHLATVVTI

SEQ ID NO: 9448 - protein, 11 aa, Mycobacterium tuberculosis
LHHLATVVTIR

SEQ ID NO: 9449 - protein, 11 aa, Mycobacterium tuberculosis
HHLATVVTIRG

SEQ ID NO: 9450 - protein, 11 aa, Mycobacterium tuberculosis
HLATVVTIRGE

SEQ ID NO: 9451 - protein, 11 aa, Mycobacterium tuberculosis
LATVVTIRGEI

SEQ ID NO: 9452 - protein, 11 aa, Mycobacterium tuberculosis
ATVVTIRGEID

SEQ ID NO: 9453 - protein, 11 aa, Mycobacterium tuberculosis
TVVTIRGEIDA

SEQ ID NO: 9454 - protein, 11 aa, Mycobacterium tuberculosis
VVTIRGEIDAA

SEQ ID NO: 9455 - protein, 11 aa, Mycobacterium tuberculosis
VTIRGEIDAAN

SEQ ID NO: 9456 - protein, 11 aa, Mycobacterium tuberculosis
TIRGEIDAANV

SEQ ID NO: 9457 - protein, 11 aa, Mycobacterium tuberculosis
IRGEIDAANVE

SEQ ID NO: 9458 - protein, 11 aa, Mycobacterium tuberculosis
RGEIDAANVEQ

SEQ ID NO: 9459 - protein, 11 aa, Mycobacterium tuberculosis
GEIDAANVEQI

SEQ ID NO: 9460 - protein, 11 aa, Mycobacterium tuberculosis
EIDAANVEQIS

SEQ ID NO: 9461 - protein, 11 aa, Mycobacterium tuberculosis
IDAANVEQISE

SEQ ID NO: 9462 - protein, 11 aa, Mycobacterium tuberculosis
DAANVEQISEH

SEQ ID NO: 9463 - protein, 11 aa, Mycobacterium tuberculosis
AANVEQISEHV

SEQ ID NO: 9464 - protein, 11 aa, Mycobacterium tuberculosis
ANVEQISEHVR

SEQ ID NO: 9465 - protein, 11 aa, Mycobacterium tuberculosis
NVEQISEHVRR

SEQ ID NO: 9466 - protein, 11 aa, Mycobacterium tuberculosis
VEQISEHVRRF

SEQ ID NO: 9467 - protein, 11 aa, Mycobacterium tuberculosis
EQISEHVRRFS

SEQ ID NO: 9468 - protein, 11 aa, Mycobacterium tuberculosis
QISEHVRRFSL

SEQ ID NO: 9469 - protein, 11 aa, Mycobacterium tuberculosis
ISEHVRRFSLG

SEQ ID NO: 9470 - protein, 11 aa, Mycobacterium tuberculosis
SEHVRRFSLGT

SEQ ID NO: 9471 - protein, 11 aa, Mycobacterium tuberculosis
EHVRRFSLGTN

SEQ ID NO: 9472 - protein, 11 aa, Mycobacterium tuberculosis
HVRRFSLGTNP

SEQ ID NO: 9473 - protein, 11 aa, Mycobacterium tuberculosis
VRRFSLGTNPM

SEQ ID NO: 9474 - protein, 11 aa, Mycobacterium tuberculosis
RRFSLGTNPMV

SEQ ID NO: 9475 - protein, 11 aa, Mycobacterium tuberculosis
RFSLGTNPMVL

SEQ ID NO: 9476 - protein, 11 aa, Mycobacterium tuberculosis
FSLGTNPMVLD

SEQ ID NO: 9477 - protein, 11 aa, Mycobacterium tuberculosis
SLGTNPMVLDL

SEQ ID NO: 9478 - protein, 11 aa, Mycobacterium tuberculosis
LGTNPMVLDLS

SEQ ID NO: 9479 - protein, 11 aa, Mycobacterium tuberculosis
GTNPMVLDLSE

SEQ ID NO: 9480 - protein, 11 aa, Mycobacterium tuberculosis
TNPMVLDLSEL

SEQ ID NO: 9481 - protein, 11 aa, Mycobacterium tuberculosis
NPMVLDLSELS

SEQ ID NO: 9482 - protein, 11 aa, Mycobacterium tuberculosis
PMVLDLSELSH

SEQ ID NO: 9483 - protein, 11 aa, Mycobacterium tuberculosis
MVLDLSELSHF

SEQ ID NO: 9484 - protein, 11 aa, Mycobacterium tuberculosis
VLDLSELSHFS

SEQ ID NO: 9485 - protein, 11 aa, Mycobacterium tuberculosis
LDLSELSHFSG

SEQ ID NO: 9486 - protein, 11 aa, Mycobacterium tuberculosis
DLSELSHFSGA

SEQ ID NO: 9487 - protein, 11 aa, Mycobacterium tuberculosis
LSELSHFSGAG

SEQ ID NO: 9488 - protein, 11 aa, Mycobacterium tuberculosis
SELSHFSGAGI

SEQ ID NO: 9489 - protein, 11 aa, Mycobacterium tuberculosis
ELSHFSGAGIS

SEQ ID NO: 9490 - protein, 11 aa, Mycobacterium tuberculosis
LSHFSGAGISL

SEQ ID NO: 9491 - protein, 11 aa, Mycobacterium tuberculosis
SHFSGAGISLL

SEQ ID NO: 9492 - protein, 11 aa, Mycobacterium tuberculosis
HFSGAGISLLC

SEQ ID NO: 9493 - protein, 11 aa, Mycobacterium tuberculosis
FSGAGISLLCI

SEQ ID NO: 9494 - protein, 11 aa, Mycobacterium tuberculosis
SGAGISLLCIL

SEQ ID NO: 9495 - protein, 11 aa, Mycobacterium tuberculosis
GAGISLLCILD

SEQ ID NO: 9496 - protein, 11 aa, Mycobacterium tuberculosis
AGISLLCILDE

SEQ ID NO: 9497 - protein, 11 aa, Mycobacterium tuberculosis
GISLLCILDED

SEQ ID NO: 9498 - protein, 11 aa, Mycobacterium tuberculosis
ISLLCILDEDC

SEQ ID NO: 9499 - protein, 11 aa, Mycobacterium tuberculosis
SLLCILDEDCR

SEQ ID NO: 9500 - protein, 11 aa, Mycobacterium tuberculosis
LLCILDEDCRA

SEQ ID NO: 9501 - protein, 11 aa, Mycobacterium tuberculosis
LCILDEDCRAA

SEQ ID NO: 9502 - protein, 11 aa, Mycobacterium tuberculosis
CILDEDCRAAG

SEQ ID NO: 9503 - protein, 11 aa, Mycobacterium tuberculosis
ILDEDCRAAGV

SEQ ID NO: 9504 - protein, 11 aa, Mycobacterium tuberculosis
LDEDCRAAGVQ

SEQ ID NO: 9505 - protein, 11 aa, Mycobacterium tuberculosis
DEDCRAAGVQW

SEQ ID NO: 9506 - protein, 11 aa, Mycobacterium tuberculosis
EDCRAAGVQWA

SEQ ID NO: 9507 - protein, 11 aa, Mycobacterium tuberculosis
DCRAAGVQWAL

SEQ ID NO: 9508 - protein, 11 aa, Mycobacterium tuberculosis
CRAAGVQWALV

SEQ ID NO: 9509 - protein, 11 aa, Mycobacterium tuberculosis
RAAGVQWALVA

SEQ ID NO: 9510 - protein, 11 aa, Mycobacterium tuberculosis
AAGVQWALVAS

SEQ ID NO: 9511 - protein, 11 aa, Mycobacterium tuberculosis
AGVQWALVASP

SEQ ID NO: 9512 - protein, 11 aa, Mycobacterium tuberculosis
GVQWALVASPA

SEQ ID NO: 9513 - protein, 11 aa, Mycobacterium tuberculosis
VQWALVASPAV

SEQ ID NO: 9514 - protein, 11 aa, Mycobacterium tuberculosis
QWALVASPAVV

SEQ ID NO: 9515 - protein, 11 aa, Mycobacterium tuberculosis
WALVASPAVVE

SEQ ID NO: 9516 - protein, 11 aa, Mycobacterium tuberculosis
ALVASPAVVEQ

SEQ ID NO: 9517 - protein, 11 aa, Mycobacterium tuberculosis
LVASPAVVEQL

SEQ ID NO: 9518 - protein, 11 aa, Mycobacterium tuberculosis
VASPAVVEQLG

SEQ ID NO: 9519 - protein, 11 aa, Mycobacterium tuberculosis
ASPAVVEQLGG

SEQ ID NO: 9520 - protein, 11 aa, Mycobacterium tuberculosis
SPAVVEQLGGR

SEQ ID NO: 9521 - protein, 11 aa, Mycobacterium tuberculosis
PAVVEQLGGRC

SEQ ID NO: 9522 - protein, 11 aa, Mycobacterium tuberculosis
AVVEQLGGRCD

SEQ ID NO: 9523 - protein, 11 aa, Mycobacterium tuberculosis
VVEQLGGRCDQ

SEQ ID NO: 9524 - protein, 11 aa, Mycobacterium tuberculosis
VEQLGGRCDQG

SEQ ID NO: 9525 - protein, 11 aa, Mycobacterium tuberculosis
EQLGGRCDQGE

SEQ ID NO: 9526 - protein, 11 aa, Mycobacterium tuberculosis
QLGGRCDQGEH

SEQ ID NO: 9527 - protein, 11 aa, Mycobacterium tuberculosis
LGGRCDQGEHE

SEQ ID NO: 9528 - protein, 11 aa, Mycobacterium tuberculosis
GGRCDQGEHES

SEQ ID NO: 9529 - protein, 11 aa, Mycobacterium tuberculosis
GRCDQGEHESM

SEQ ID NO: 9530 - protein, 11 aa, Mycobacterium tuberculosis
RCDQGEHESMF

SEQ ID NO: 9531 - protein, 11 aa, Mycobacterium tuberculosis
CDQGEHESMFP

SEQ ID NO: 9532 - protein, 11 aa, Mycobacterium tuberculosis
DQGEHESMFPM

SEQ ID NO: 9533 - protein, 11 aa, Mycobacterium tuberculosis
QGEHESMFPMA

SEQ ID NO: 9534 - protein, 11 aa, Mycobacterium tuberculosis
GEHESMFPMAR

SEQ ID NO: 9535 - protein, 11 aa, Mycobacterium tuberculosis
EHESMFPMARS

SEQ ID NO: 9536 - protein, 11 aa, Mycobacterium tuberculosis
HESMFPMARSV

SEQ ID NO: 9537 - protein, 11 aa, Mycobacterium tuberculosis
ESMFPMARSVH

SEQ ID NO: 9538 - protein, 11 aa, Mycobacterium tuberculosis
SMFPMARSVHK

SEQ ID NO: 9539 - protein, 11 aa, Mycobacterium tuberculosis
MFPMARSVHKA

SEQ ID NO: 9540 - protein, 11 aa, Mycobacterium tuberculosis
FPMARSVHKAL

SEQ ID NO: 9541 - protein, 11 aa, Mycobacterium tuberculosis
PMARSVHKALH

SEQ ID NO: 9542 - protein, 11 aa, Mycobacterium tuberculosis
MARSVHKALHD

SEQ ID NO: 9543 - protein, 11 aa, Mycobacterium tuberculosis
ARSVHKALHDL

SEQ ID NO: 9544 - protein, 11 aa, Mycobacterium tuberculosis
RSVHKALHDLA

SEQ ID NO: 9545 - protein, 11 aa, Mycobacterium tuberculosis
SVHKALHDLAD

SEQ ID NO: 9546 - protein, 11 aa, Mycobacterium tuberculosis
VHKALHDLADA

SEQ ID NO: 9547 - protein, 11 aa, Mycobacterium tuberculosis
HKALHDLADAI

SEQ ID NO: 9548 - protein, 11 aa, Mycobacterium tuberculosis
KALHDLADAID

SEQ ID NO: 9549 - protein, 11 aa, Mycobacterium tuberculosis
ALHDLADAIDR

SEQ ID NO: 9550 - protein, 11 aa, Mycobacterium tuberculosis
LHDLADAIDRR

SEQ ID NO: 9551 - protein, 11 aa, Mycobacterium tuberculosis
HDLADAIDRRR

SEQ ID NO: 9552 - protein, 11 aa, Mycobacterium tuberculosis
DLADAIDRRRQ

SEQ ID NO: 9553 - protein, 11 aa, Mycobacterium tuberculosis
LADAIDRRRQL

SEQ ID NO: 9554 - protein, 11 aa, Mycobacterium tuberculosis
ADAIDRRRQLV

SEQ ID NO: 9555 - protein, 11 aa, Mycobacterium tuberculosis
DAIDRRRQLVL

SEQ ID NO: 9556 - protein, 11 aa, Mycobacterium tuberculosis
AIDRRRQLVLP

SEQ ID NO: 9557 - protein, 11 aa, Mycobacterium tuberculosis
IDRRRQLVLPL

SEQ ID NO: 9558 - protein, 11 aa, Mycobacterium tuberculosis
DRRRQLVLPLI

SEQ ID NO: 9559 - protein, 11 aa, Mycobacterium tuberculosis
RRRQLVLPLIS

SEQ ID NO: 9560 - protein, 11 aa, Mycobacterium tuberculosis
RRQLVLPLISR

SEQ ID NO: 9561 - protein, 11 aa, Mycobacterium tuberculosis
RQLVLPLISRS

SEQ ID NO: 9562 - protein, 11 aa, Mycobacterium tuberculosis
QLVLPLISRSA

SEQ ID NO: 9563 - protein, 8 aa, Mycobacterium tuberculosis
MKAKVGDW

SEQ ID NO: 9564 - protein, 8 aa, Mycobacterium tuberculosis
KAKVGDWL

SEQ ID NO: 9565 - protein, 8 aa, Mycobacterium tuberculosis
AKVGDWLV

SEQ ID NO: 9566 - protein, 8 aa, Mycobacterium tuberculosis
KVGDWLVI

SEQ ID NO: 9567 - protein, 8 aa, Mycobacterium tuberculosis
VGDWLVIK

SEQ ID NO: 9568 - protein, 8 aa, Mycobacterium tuberculosis
GDWLVIKG

SEQ ID NO: 9569 - protein, 8 aa, Mycobacterium tuberculosis
DWLVIKGA

SEQ ID NO: 9570 - protein, 8 aa, Mycobacterium tuberculosis
WLVIKGAT

SEQ ID NO: 9571 - protein, 8 aa, Mycobacterium tuberculosis
LVIKGATI

SEQ ID NO: 9572 - protein, 8 aa, Mycobacterium tuberculosis
VIKGATID

SEQ ID NO: 9573 - protein, 8 aa, Mycobacterium tuberculosis
IKGATIDQ

SEQ ID NO: 9574 - protein, 8 aa, Mycobacterium tuberculosis
KGATIDQP

SEQ ID NO: 9575 - protein, 8 aa, Mycobacterium tuberculosis
GATIDQPD

SEQ ID NO: 9576 - protein, 8 aa, Mycobacterium tuberculosis
ATIDQPDH

SEQ ID NO: 9577 - protein, 8 aa, Mycobacterium tuberculosis
TIDQPDHR

SEQ ID NO: 9578 - protein, 8 aa, Mycobacterium tuberculosis
IDQPDHRG

SEQ ID NO: 9579 - protein, 8 aa, Mycobacterium tuberculosis
DQPDHRGL

SEQ ID NO: 9580 - protein, 8 aa, Mycobacterium tuberculosis
QPDHRGLI

SEQ ID NO: 9581 - protein, 8 aa, Mycobacterium tuberculosis
PDHRGLII

SEQ ID NO: 9582 - protein, 8 aa, Mycobacterium tuberculosis
DHRGLIIE

SEQ ID NO: 9583 - protein, 8 aa, Mycobacterium tuberculosis
HRGLIIEV

SEQ ID NO: 9584 - protein, 8 aa, Mycobacterium tuberculosis
RGLIIEVR

SEQ ID NO: 9585 - protein, 8 aa, Mycobacterium tuberculosis
GLIIEVRS

SEQ ID NO: 9586 - protein, 8 aa, Mycobacterium tuberculosis
LIIEVRSS

SEQ ID NO: 9587 - protein, 8 aa, Mycobacterium tuberculosis
IIEVRSSD

SEQ ID NO: 9588 - protein, 8 aa, Mycobacterium tuberculosis
IEVRSSDG

SEQ ID NO: 9589 - protein, 8 aa, Mycobacterium tuberculosis
EVRSSDGS

SEQ ID NO: 9590 - protein, 8 aa, Mycobacterium tuberculosis
VRSSDGSP

SEQ ID NO: 9591 - protein, 8 aa, Mycobacterium tuberculosis
RSSDGSPP

SEQ ID NO: 9592 - protein, 8 aa, Mycobacterium tuberculosis
SSDGSPPY

SEQ ID NO: 9593 - protein, 8 aa, Mycobacterium tuberculosis
SDGSPPYV

SEQ ID NO: 9594 - protein, 8 aa, Mycobacterium tuberculosis
DGSPPYVV

SEQ ID NO: 9595 - protein, 8 aa, Mycobacterium tuberculosis
GSPPYVVR

SEQ ID NO: 9596 - protein, 8 aa, Mycobacterium tuberculosis
SPPYVVRW

SEQ ID NO: 9597 - protein, 8 aa, Mycobacterium tuberculosis
PPYVVRWL

SEQ ID NO: 9598 - protein, 8 aa, Mycobacterium tuberculosis
PYVVRWLE

SEQ ID NO: 9599 - protein, 8 aa, Mycobacterium tuberculosis
YVVRWLET

SEQ ID NO: 9600 - protein, 8 aa, Mycobacterium tuberculosis
VVRWLETD

SEQ ID NO: 9601 - protein, 8 aa, Mycobacterium tuberculosis
VRWLETDH

SEQ ID NO: 9602 - protein, 8 aa, Mycobacterium tuberculosis
RWLETDHV

SEQ ID NO: 9603 - protein, 8 aa, Mycobacterium tuberculosis
WLETDHVA

SEQ ID NO: 9604 - protein, 8 aa, Mycobacterium tuberculosis
LETDHVAT

SEQ ID NO: 9605 - protein, 8 aa, Mycobacterium tuberculosis
ETDHVATV

SEQ ID NO: 9606 - protein, 8 aa, Mycobacterium tuberculosis
TDHVATVI

SEQ ID NO: 9607 - protein, 8 aa, Mycobacterium tuberculosis
DHVATVIP

SEQ ID NO: 9608 - protein, 8 aa, Mycobacterium tuberculosis
HVATVIPG

SEQ ID NO: 9609 - protein, 8 aa, Mycobacterium tuberculosis
VATVIPGP

SEQ ID NO: 9610 - protein, 8 aa, Mycobacterium tuberculosis
ATVIPGPD

SEQ ID NO: 9611 - protein, 8 aa, Mycobacterium tuberculosis
TVIPGPDA

SEQ ID NO: 9612 - protein, 8 aa, Mycobacterium tuberculosis
VIPGPDAV

SEQ ID NO: 9613 - protein, 8 aa, Mycobacterium tuberculosis
IPGPDAVV

SEQ ID NO: 9614 - protein, 8 aa, Mycobacterium tuberculosis
PGPDAVVV

SEQ ID NO: 9615 - protein, 8 aa, Mycobacterium tuberculosis
GPDAVVVT

SEQ ID NO: 9616 - protein, 8 aa, Mycobacterium tuberculosis
PDAVVVTA

SEQ ID NO: 9617 - protein, 8 aa, Mycobacterium tuberculosis
DAVVVTAE

SEQ ID NO: 9618 - protein, 8 aa, Mycobacterium tuberculosis
AVVVTAEE

SEQ ID NO: 9619 - protein, 8 aa, Mycobacterium tuberculosis
VVVTAEEQ

SEQ ID NO: 9620 - protein, 8 aa, Mycobacterium tuberculosis
VVTAEEQN

SEQ ID NO: 9621 - protein, 8 aa, Mycobacterium tuberculosis
VTAEEQNA

SEQ ID NO: 9622 - protein, 8 aa, Mycobacterium tuberculosis
TAEEQNAA

SEQ ID NO: 9623 - protein, 8 aa, Mycobacterium tuberculosis
AEEQNAAD

SEQ ID NO: 9624 - protein, 8 aa, Mycobacterium tuberculosis
EEQNAADE

SEQ ID NO: 9625 - protein, 8 aa, Mycobacterium tuberculosis
EQNAADER

SEQ ID NO: 9626 - protein, 8 aa, Mycobacterium tuberculosis
QNAADERA

SEQ ID NO: 9627 - protein, 8 aa, Mycobacterium tuberculosis
NAADERAQ

SEQ ID NO: 9628 - protein, 8 aa, Mycobacterium tuberculosis
AADERAQH

SEQ ID NO: 9629 - protein, 8 aa, Mycobacterium tuberculosis
ADERAQHR

SEQ ID NO: 9630 - protein, 8 aa, Mycobacterium tuberculosis
DERAQHRF

SEQ ID NO: 9631 - protein, 8 aa, Mycobacterium tuberculosis
ERAQHRFG

SEQ ID NO: 9632 - protein, 8 aa, Mycobacterium tuberculosis
RAQHRFGA

SEQ ID NO: 9633 - protein, 8 aa, Mycobacterium tuberculosis
AQHRFGAV

SEQ ID NO: 9634 - protein, 8 aa, Mycobacterium tuberculosis
QHRFGAVQ

SEQ ID NO: 9635 - protein, 8 aa, Mycobacterium tuberculosis
HRFGAVQS

SEQ ID NO: 9636 - protein, 8 aa, Mycobacterium tuberculosis
RFGAVQSA

SEQ ID NO: 9637 - protein, 8 aa, Mycobacterium tuberculosis
FGAVQSAI

SEQ ID NO: 9638 - protein, 8 aa, Mycobacterium tuberculosis
GAVQSAIL

SEQ ID NO: 9639 - protein, 8 aa, Mycobacterium tuberculosis
AVQSAILH

SEQ ID NO: 9640 - protein, 8 aa, Mycobacterium tuberculosis
VQSAILHA

SEQ ID NO: 9641 - protein, 8 aa, Mycobacterium tuberculosis
QSAILHAR

SEQ ID NO: 9642 - protein, 8 aa, Mycobacterium tuberculosis
SAILHARG

SEQ ID NO: 9643 - protein, 8 aa, Mycobacterium tuberculosis
AILHARGT

SEQ ID NO: 9644 - protein, 9 aa, Mycobacterium tuberculosis
MKAKVGDWL

SEQ ID NO: 9645 - protein, 9 aa, Mycobacterium tuberculosis
KAKVGDWLV

SEQ ID NO: 9646 - protein, 9 aa, Mycobacterium tuberculosis
AKVGDWLVI

SEQ ID NO: 9647 - protein, 9 aa, Mycobacterium tuberculosis
KVGDWLVIK

SEQ ID NO: 9648 - protein, 9 aa, Mycobacterium tuberculosis
VGDWLVIKG

SEQ ID NO: 9649 - protein, 9 aa, Mycobacterium tuberculosis
GDWLVIKGA

SEQ ID NO: 9650 - protein, 9 aa, Mycobacterium tuberculosis
DWLVIKGAT

SEQ ID NO: 9651 - protein, 9 aa, Mycobacterium tuberculosis
WLVIKGATI

SEQ ID NO: 9652 - protein, 9 aa, Mycobacterium tuberculosis
LVIKGATID

SEQ ID NO: 9653 - protein, 9 aa, Mycobacterium tuberculosis
VIKGATIDQ

SEQ ID NO: 9654 - protein, 9 aa, Mycobacterium tuberculosis
IKGATIDQP

SEQ ID NO: 9655 - protein, 9 aa, Mycobacterium tuberculosis
KGATIDQPD

SEQ ID NO: 9656 - protein, 9 aa, Mycobacterium tuberculosis
GATIDQPDH

SEQ ID NO: 9657 - protein, 9 aa, Mycobacterium tuberculosis
ATIDQPDHR

SEQ ID NO: 9658 - protein, 9 aa, Mycobacterium tuberculosis
TIDQPDHRG

SEQ ID NO: 9659 - protein, 9 aa, Mycobacterium tuberculosis
IDQPDHRGL

SEQ ID NO: 9660 - protein, 9 aa, Mycobacterium tuberculosis
DQPDHRGLI

SEQ ID NO: 9661 - protein, 9 aa, Mycobacterium tuberculosis
QPDHRGLII

SEQ ID NO: 9662 - protein, 9 aa, Mycobacterium tuberculosis
PDHRGLIIE

SEQ ID NO: 9663 - protein, 9 aa, Mycobacterium tuberculosis
DHRGLIIEV

SEQ ID NO: 9664 - protein, 9 aa, Mycobacterium tuberculosis
HRGLIIEVR

SEQ ID NO: 9665 - protein, 9 aa, Mycobacterium tuberculosis
RGLIIEVRS

SEQ ID NO: 9666 - protein, 9 aa, Mycobacterium tuberculosis
GLIIEVRSS

SEQ ID NO: 9667 - protein, 9 aa, Mycobacterium tuberculosis
LIIEVRSSD

SEQ ID NO: 9668 - protein, 9 aa, Mycobacterium tuberculosis
IIEVRSSDG

SEQ ID NO: 9669 - protein, 9 aa, Mycobacterium tuberculosis
IEVRSSDGS

SEQ ID NO: 9670 - protein, 9 aa, Mycobacterium tuberculosis
EVRSSDGSP

SEQ ID NO: 9671 - protein, 9 aa, Mycobacterium tuberculosis
VRSSDGSPP

SEQ ID NO: 9672 - protein, 9 aa, Mycobacterium tuberculosis
RSSDGSPPY

SEQ ID NO: 9673 - protein, 9 aa, Mycobacterium tuberculosis
SSDGSPPYV

SEQ ID NO: 9674 - protein, 9 aa, Mycobacterium tuberculosis
SDGSPPYVV

SEQ ID NO: 9675 - protein, 9 aa, Mycobacterium tuberculosis
DGSPPYVVR

SEQ ID NO: 9676 - protein, 9 aa, Mycobacterium tuberculosis
GSPPYVVRW

SEQ ID NO: 9677 - protein, 9 aa, Mycobacterium tuberculosis
SPPYVVRWL

SEQ ID NO: 9678 - protein, 9 aa, Mycobacterium tuberculosis
PPYVVRWLE

SEQ ID NO: 9679 - protein, 9 aa, Mycobacterium tuberculosis
PYVVRWLET

SEQ ID NO: 9680 - protein, 9 aa, Mycobacterium tuberculosis
YVVRWLETD

SEQ ID NO: 9681 - protein, 9 aa, Mycobacterium tuberculosis
VVRWLETDH

SEQ ID NO: 9682 - protein, 9 aa, Mycobacterium tuberculosis
VRWLETDHV

SEQ ID NO: 9683 - protein, 9 aa, Mycobacterium tuberculosis
RWLETDHVA

SEQ ID NO: 9684 - protein, 9 aa, Mycobacterium tuberculosis
WLETDHVAT

SEQ ID NO: 9685 - protein, 9 aa, Mycobacterium tuberculosis
LETDHVATV

SEQ ID NO: 9686 - protein, 9 aa, Mycobacterium tuberculosis
ETDHVATVI

SEQ ID NO: 9687 - protein, 9 aa, Mycobacterium tuberculosis
TDHVATVIP

SEQ ID NO: 9688 - protein, 9 aa, Mycobacterium tuberculosis
DHVATVIPG

SEQ ID NO: 9689 - protein, 9 aa, Mycobacterium tuberculosis
HVATVIPGP

SEQ ID NO: 9690 - protein, 9 aa, Mycobacterium tuberculosis
VATVIPGPD

SEQ ID NO: 9691 - protein, 9 aa, Mycobacterium tuberculosis
ATVIPGPDA

SEQ ID NO: 9692 - protein, 9 aa, Mycobacterium tuberculosis
TVIPGPDAV

SEQ ID NO: 9693 - protein, 9 aa, Mycobacterium tuberculosis
VIPGPDAVV

SEQ ID NO: 9694 - protein, 9 aa, Mycobacterium tuberculosis
IPGPDAVVV

SEQ ID NO: 9695 - protein, 9 aa, Mycobacterium tuberculosis
PGPDAVVVT

SEQ ID NO: 9696 - protein, 9 aa, Mycobacterium tuberculosis
GPDAVVVTA

SEQ ID NO: 9697 - protein, 9 aa, Mycobacterium tuberculosis
PDAVVVTAE

SEQ ID NO: 9698 - protein, 9 aa, Mycobacterium tuberculosis
DAVVVTAEE

SEQ ID NO: 9699 - protein, 9 aa, Mycobacterium tuberculosis
AVVVTAEEQ

SEQ ID NO: 9700 - protein, 9 aa, Mycobacterium tuberculosis
VVVTAEEQN

SEQ ID NO: 9701 - protein, 9 aa, Mycobacterium tuberculosis
VVTAEEQNA

SEQ ID NO: 9702 - protein, 9 aa, Mycobacterium tuberculosis
VTAEEQNAA

SEQ ID NO: 9703 - protein, 9 aa, Mycobacterium tuberculosis
TAEEQNAAD

SEQ ID NO: 9704 - protein, 9 aa, Mycobacterium tuberculosis
AEEQNAADE

SEQ ID NO: 9705 - protein, 9 aa, Mycobacterium tuberculosis
EEQNAADER

SEQ ID NO: 9706 - protein, 9 aa, Mycobacterium tuberculosis
EQNAADERA

SEQ ID NO: 9707 - protein, 9 aa, Mycobacterium tuberculosis
QNAADERAQ

SEQ ID NO: 9708 - protein, 9 aa, Mycobacterium tuberculosis
NAADERAQH

SEQ ID NO: 9709 - protein, 9 aa, Mycobacterium tuberculosis
AADERAQHR

SEQ ID NO: 9710 - protein, 9 aa, Mycobacterium tuberculosis
ADERAQHRF

SEQ ID NO: 9711 - protein, 9 aa, Mycobacterium tuberculosis
DERAQHRFG

SEQ ID NO: 9712 - protein, 9 aa, Mycobacterium tuberculosis
ERAQHRFGA

SEQ ID NO: 9713 - protein, 9 aa, Mycobacterium tuberculosis
RAQHRFGAV

SEQ ID NO: 9714 - protein, 9 aa, Mycobacterium tuberculosis
AQHRFGAVQ

SEQ ID NO: 9715 - protein, 9 aa, Mycobacterium tuberculosis
QHRFGAVQS

SEQ ID NO: 9716 - protein, 9 aa, Mycobacterium tuberculosis
HRFGAVQSA

SEQ ID NO: 9717 - protein, 9 aa, Mycobacterium tuberculosis
RFGAVQSAI

SEQ ID NO: 9718 - protein, 9 aa, Mycobacterium tuberculosis
FGAVQSAIL

SEQ ID NO: 9719 - protein, 9 aa, Mycobacterium tuberculosis
GAVQSAILH

SEQ ID NO: 9720 - protein, 9 aa, Mycobacterium tuberculosis
AVQSAILHA

SEQ ID NO: 9721 - protein, 9 aa, Mycobacterium tuberculosis
VQSAILHAR

SEQ ID NO: 9722 - protein, 9 aa, Mycobacterium tuberculosis
QSAILHARG

SEQ ID NO: 9723 - protein, 9 aa, Mycobacterium tuberculosis
SAILHARGT

SEQ ID NO: 9724 - protein, 10 aa, Mycobacterium tuberculosis
MKAKVGDWLV

SEQ ID NO: 9725 - protein, 10 aa, Mycobacterium tuberculosis
KAKVGDWLVI

SEQ ID NO: 9726 - protein, 10 aa, Mycobacterium tuberculosis
AKVGDWLVIK

SEQ ID NO: 9727 - protein, 10 aa, Mycobacterium tuberculosis
KVGDWLVIKG

SEQ ID NO: 9728 - protein, 10 aa, Mycobacterium tuberculosis
VGDWLVIKGA

SEQ ID NO: 9729 - protein, 10 aa, Mycobacterium tuberculosis
GDWLVIKGAT

SEQ ID NO: 9730 - protein, 10 aa, Mycobacterium tuberculosis
DWLVIKGATI

SEQ ID NO: 9731 - protein, 10 aa, Mycobacterium tuberculosis
WLVIKGATID

SEQ ID NO: 9732 - protein, 10 aa, Mycobacterium tuberculosis
LVIKGATIDQ

SEQ ID NO: 9733 - protein, 10 aa, Mycobacterium tuberculosis
VIKGATIDQP

SEQ ID NO: 9734 - protein, 10 aa, Mycobacterium tuberculosis
IKGATIDQPD

SEQ ID NO: 9735 - protein, 10 aa, Mycobacterium tuberculosis
KGATIDQPDH

SEQ ID NO: 9736 - protein, 10 aa, Mycobacterium tuberculosis
GATIDQPDHR

SEQ ID NO: 9737 - protein, 10 aa, Mycobacterium tuberculosis
ATIDQPDHRG

SEQ ID NO: 9738 - protein, 10 aa, Mycobacterium tuberculosis
TIDQPDHRGL

SEQ ID NO: 9739 - protein, 10 aa, Mycobacterium tuberculosis
IDQPDHRGLI

SEQ ID NO: 9740 - protein, 10 aa, Mycobacterium tuberculosis
DQPDHRGLII

SEQ ID NO: 9741 - protein, 10 aa, Mycobacterium tuberculosis
QPDHRGLIIE

SEQ ID NO: 9742 - protein, 10 aa, Mycobacterium tuberculosis
PDHRGLIIEV

SEQ ID NO: 9743 - protein, 10 aa, Mycobacterium tuberculosis
DHRGLIIEVR

SEQ ID NO: 9744 - protein, 10 aa, Mycobacterium tuberculosis
HRGLIIEVRS

SEQ ID NO: 9745 - protein, 10 aa, Mycobacterium tuberculosis
RGLIIEVRSS

SEQ ID NO: 9746 - protein, 10 aa, Mycobacterium tuberculosis
GLIIEVRSSD

SEQ ID NO: 9747 - protein, 10 aa, Mycobacterium tuberculosis
LIIEVRSSDG

SEQ ID NO: 9748 - protein, 10 aa, Mycobacterium tuberculosis
IIEVRSSDGS

SEQ ID NO: 9749 - protein, 10 aa, Mycobacterium tuberculosis
IEVRSSDGSP

SEQ ID NO: 9750 - protein, 10 aa, Mycobacterium tuberculosis
EVRSSDGSPP

SEQ ID NO: 9751 - protein, 10 aa, Mycobacterium tuberculosis
VRSSDGSPPY

SEQ ID NO: 9752 - protein, 10 aa, Mycobacterium tuberculosis
RSSDGSPPYV

SEQ ID NO: 9753 - protein, 10 aa, Mycobacterium tuberculosis
SSDGSPPYVV

SEQ ID NO: 9754 - protein, 10 aa, Mycobacterium tuberculosis
SDGSPPYVVR

SEQ ID NO: 9755 - protein, 10 aa, Mycobacterium tuberculosis
DGSPPYVVRW

SEQ ID NO: 9756 - protein, 10 aa, Mycobacterium tuberculosis
GSPPYVVRWL

SEQ ID NO: 9757 - protein, 10 aa, Mycobacterium tuberculosis
SPPYVVRWLE

SEQ ID NO: 9758 - protein, 10 aa, Mycobacterium tuberculosis
PPYVVRWLET

SEQ ID NO: 9759 - protein, 10 aa, Mycobacterium tuberculosis
PYVVRWLETD

SEQ ID NO: 9760 - protein, 10 aa, Mycobacterium tuberculosis
YVVRWLETDH

SEQ ID NO: 9761 - protein, 10 aa, Mycobacterium tuberculosis
VVRWLETDHV

SEQ ID NO: 9762 - protein, 10 aa, Mycobacterium tuberculosis
VRWLETDHVA

SEQ ID NO: 9763 - protein, 10 aa, Mycobacterium tuberculosis
RWLETDHVAT

SEQ ID NO: 9764 - protein, 10 aa, Mycobacterium tuberculosis
WLETDHVATV

SEQ ID NO: 9765 - protein, 10 aa, Mycobacterium tuberculosis
LETDHVATVI

SEQ ID NO: 9766 - protein, 10 aa, Mycobacterium tuberculosis
ETDHVATVIP

SEQ ID NO: 9767 - protein, 10 aa, Mycobacterium tuberculosis
TDHVATVIPG

SEQ ID NO: 9768 - protein, 10 aa, Mycobacterium tuberculosis
DHVATVIPGP

SEQ ID NO: 9769 - protein, 10 aa, Mycobacterium tuberculosis
HVATVIPGPD

SEQ ID NO: 9770 - protein, 10 aa, Mycobacterium tuberculosis
VATVIPGPDA

SEQ ID NO: 9771 - protein, 10 aa, Mycobacterium tuberculosis
ATVIPGPDAV

SEQ ID NO: 9772 - protein, 10 aa, Mycobacterium tuberculosis
TVIPGPDAVV

SEQ ID NO: 9773 - protein, 10 aa, Mycobacterium tuberculosis
VIPGPDAVVV

SEQ ID NO: 9774 - protein, 10 aa, Mycobacterium tuberculosis
IPGPDAVVVT

SEQ ID NO: 9775 - protein, 10 aa, Mycobacterium tuberculosis
PGPDAVVVTA

SEQ ID NO: 9776 - protein, 10 aa, Mycobacterium tuberculosis
GPDAVVVTAE

SEQ ID NO: 9777 - protein, 10 aa, Mycobacterium tuberculosis
PDAVVVTAEE

SEQ ID NO: 9778 - protein, 10 aa, Mycobacterium tuberculosis
DAVVVTAEEQ

SEQ ID NO: 9779 - protein, 10 aa, Mycobacterium tuberculosis
AVVVTAEEQN

SEQ ID NO: 9780 - protein, 10 aa, Mycobacterium tuberculosis
VVVTAEEQNA

SEQ ID NO: 9781 - protein, 10 aa, Mycobacterium tuberculosis
VVTAEEQNAA

SEQ ID NO: 9782 - protein, 10 aa, Mycobacterium tuberculosis
VTAEEQNAAD

SEQ ID NO: 9783 - protein, 10 aa, Mycobacterium tuberculosis
TAEEQNAADE

SEQ ID NO: 9784 - protein, 10 aa, Mycobacterium tuberculosis
AEEQNAADER

SEQ ID NO: 9785 - protein, 10 aa, Mycobacterium tuberculosis
EEQNAADERA

SEQ ID NO: 9786 - protein, 10 aa, Mycobacterium tuberculosis
EQNAADERAQ

SEQ ID NO: 9787 - protein, 10 aa, Mycobacterium tuberculosis
QNAADERAQH

SEQ ID NO: 9788 - protein, 10 aa, Mycobacterium tuberculosis
NAADERAQHR

SEQ ID NO: 9789 - protein, 10 aa, Mycobacterium tuberculosis
AADERAQHRF

SEQ ID NO: 9790 - protein, 10 aa, Mycobacterium tuberculosis
ADERAQHRFG

SEQ ID NO: 9791 - protein, 10 aa, Mycobacterium tuberculosis
DERAQHRFGA

SEQ ID NO: 9792 - protein, 10 aa, Mycobacterium tuberculosis
ERAQHRFGAV

SEQ ID NO: 9793 - protein, 10 aa, Mycobacterium tuberculosis
RAQHRFGAVQ

SEQ ID NO: 9794 - protein, 10 aa, Mycobacterium tuberculosis
AQHRFGAVQS

SEQ ID NO: 9795 - protein, 10 aa, Mycobacterium tuberculosis
QHRFGAVQSA

SEQ ID NO: 9796 - protein, 10 aa, Mycobacterium tuberculosis
HRFGAVQSAI

SEQ ID NO: 9797 - protein, 10 aa, Mycobacterium tuberculosis
RFGAVQSAIL

SEQ ID NO: 9798 - protein, 10 aa, Mycobacterium tuberculosis
FGAVQSAILH

SEQ ID NO: 9799 - protein, 10 aa, Mycobacterium tuberculosis
GAVQSAILHA

SEQ ID NO: 9800 - protein, 10 aa, Mycobacterium tuberculosis
AVQSAILHAR

SEQ ID NO: 9801 - protein, 10 aa, Mycobacterium tuberculosis
VQSAILHARG

SEQ ID NO: 9802 - protein, 10 aa, Mycobacterium tuberculosis
QSAILHARGT

SEQ ID NO: 9803 - protein, 11 aa, Mycobacterium tuberculosis
MKAKVGDWLVI

SEQ ID NO: 9804 - protein, 11 aa, Mycobacterium tuberculosis
KAKVGDWLVIK

SEQ ID NO: 9805 - protein, 11 aa, Mycobacterium tuberculosis
AKVGDWLVIKG

SEQ ID NO: 9806 - protein, 11 aa, Mycobacterium tuberculosis
KVGDWLVIKGA

SEQ ID NO: 9807 - protein, 11 aa, Mycobacterium tuberculosis
VGDWLVIKGAT

SEQ ID NO: 9808 - protein, 11 aa, Mycobacterium tuberculosis
GDWLVIKGATI

SEQ ID NO: 9809 - protein, 11 aa, Mycobacterium tuberculosis
DWLVIKGATID

SEQ ID NO: 9810 - protein, 11 aa, Mycobacterium tuberculosis
WLVIKGATIDQ

SEQ ID NO: 9811 - protein, 11 aa, Mycobacterium tuberculosis
LVIKGATIDQP

SEQ ID NO: 9812 - protein, 11 aa, Mycobacterium tuberculosis
VIKGATIDQPD

SEQ ID NO: 9813 - protein, 11 aa, Mycobacterium tuberculosis
IKGATIDQPDH

SEQ ID NO: 9814 - protein, 11 aa, Mycobacterium tuberculosis
KGATIDQPDHR

SEQ ID NO: 9815 - protein, 11 aa, Mycobacterium tuberculosis
GATIDQPDHRG

SEQ ID NO: 9816 - protein, 11 aa, Mycobacterium tuberculosis
ATIDQPDHRGL

SEQ ID NO: 9817 - protein, 11 aa, Mycobacterium tuberculosis
TIDQPDHRGLI

SEQ ID NO: 9818 - protein, 11 aa, Mycobacterium tuberculosis
IDQPDHRGLII

SEQ ID NO: 9819 - protein, 11 aa, Mycobacterium tuberculosis
DQPDHRGLIIE

SEQ ID NO: 9820 - protein, 11 aa, Mycobacterium tuberculosis
QPDHRGLIIEV

SEQ ID NO: 9821 - protein, 11 aa, Mycobacterium tuberculosis
PDHRGLIIEVR

SEQ ID NO: 9822 - protein, 11 aa, Mycobacterium tuberculosis
DHRGLIIEVRS

SEQ ID NO: 9823 - protein, 11 aa, Mycobacterium tuberculosis
HRGLIIEVRSS

SEQ ID NO: 9824 - protein, 11 aa, Mycobacterium tuberculosis
RGLIIEVRSSD

SEQ ID NO: 9825 - protein, 11 aa, Mycobacterium tuberculosis
GLIIEVRSSDG

SEQ ID NO: 9826 - protein, 11 aa, Mycobacterium tuberculosis
LIIEVRSSDGS

SEQ ID NO: 9827 - protein, 11 aa, Mycobacterium tuberculosis
IIEVRSSDGSP

SEQ ID NO: 9828 - protein, 11 aa, Mycobacterium tuberculosis
IEVRSSDGSPP

SEQ ID NO: 9829 - protein, 11 aa, Mycobacterium tuberculosis
EVRSSDGSPPY

SEQ ID NO: 9830 - protein, 11 aa, Mycobacterium tuberculosis
VRSSDGSPPYV

SEQ ID NO: 9831 - protein, 11 aa, Mycobacterium tuberculosis
RSSDGSPPYVV

SEQ ID NO: 9832 - protein, 11 aa, Mycobacterium tuberculosis
SSDGSPPYVVR

SEQ ID NO: 9833 - protein, 11 aa, Mycobacterium tuberculosis
SDGSPPYVVRW

SEQ ID NO: 9834 - protein, 11 aa, Mycobacterium tuberculosis
DGSPPYVVRWL

SEQ ID NO: 9835 - protein, 11 aa, Mycobacterium tuberculosis
GSPPYVVRWLE

SEQ ID NO: 9836 - protein, 11 aa, Mycobacterium tuberculosis
SPPYVVRWLET

SEQ ID NO: 9837 - protein, 11 aa, Mycobacterium tuberculosis
PPYVVRWLETD

SEQ ID NO: 9838 - protein, 11 aa, Mycobacterium tuberculosis
PYVVRWLETDH

SEQ ID NO: 9839 - protein, 11 aa, Mycobacterium tuberculosis
YVVRWLETDHV

SEQ ID NO: 9840 - protein, 11 aa, Mycobacterium tuberculosis
VVRWLETDHVA

SEQ ID NO: 9841 - protein, 11 aa, Mycobacterium tuberculosis
VRWLETDHVAT

SEQ ID NO: 9842 - protein, 11 aa, Mycobacterium tuberculosis
RWLETDHVATV

SEQ ID NO: 9843 - protein, 11 aa, Mycobacterium tuberculosis
WLETDHVATVI

SEQ ID NO: 9844 - protein, 11 aa, Mycobacterium tuberculosis
LETDHVATVIP

SEQ ID NO: 9845 - protein, 11 aa, Mycobacterium tuberculosis
ETDHVATVIPG

SEQ ID NO: 9846 - protein, 11 aa, Mycobacterium tuberculosis
TDHVATVIPGP

SEQ ID NO: 9847 - protein, 11 aa, Mycobacterium tuberculosis
DHVATVIPGPD

SEQ ID NO: 9848 - protein, 11 aa, Mycobacterium tuberculosis
HVATVIPGPDA

SEQ ID NO: 9849 - protein, 11 aa, Mycobacterium tuberculosis
VATVIPGPDAV

SEQ ID NO: 9850 - protein, 11 aa, Mycobacterium tuberculosis
ATVIPGPDAVV

SEQ ID NO: 9851 - protein, 11 aa, Mycobacterium tuberculosis
TVIPGPDAVVV

SEQ ID NO: 9852 - protein, 11 aa, Mycobacterium tuberculosis
VIPGPDAVVVT

SEQ ID NO: 9853 - protein, 11 aa, Mycobacterium tuberculosis
IPGPDAVVVTA

SEQ ID NO: 9854 - protein, 11 aa, Mycobacterium tuberculosis
PGPDAVVVTAE

SEQ ID NO: 9855 - protein, 11 aa, Mycobacterium tuberculosis
GPDAVVVTAEE

SEQ ID NO: 9856 - protein, 11 aa, Mycobacterium tuberculosis
PDAVVVTAEEQ

SEQ ID NO: 9857 - protein, 11 aa, Mycobacterium tuberculosis
DAVVVTAEEQN

SEQ ID NO: 9858 - protein, 11 aa, Mycobacterium tuberculosis
AVVVTAEEQNA

SEQ ID NO: 9859 - protein, 11 aa, Mycobacterium tuberculosis
VVVTAEEQNAA

SEQ ID NO: 9860 - protein, 11 aa, Mycobacterium tuberculosis
VVTAEEQNAAD

SEQ ID NO: 9861 - protein, 11 aa, Mycobacterium tuberculosis
VTAEEQNAADE

SEQ ID NO: 9862 - protein, 11 aa, Mycobacterium tuberculosis
TAEEQNAADER

SEQ ID NO: 9863 - protein, 11 aa, Mycobacterium tuberculosis
AEEQNAADERA

SEQ ID NO: 9864 - protein, 11 aa, Mycobacterium tuberculosis
EEQNAADERAQ

SEQ ID NO: 9865 - protein, 11 aa, Mycobacterium tuberculosis
EQNAADERAQH

SEQ ID NO: 9866 - protein, 11 aa, Mycobacterium tuberculosis
QNAADERAQHR

SEQ ID NO: 9867 - protein, 11 aa, Mycobacterium tuberculosis
NAADERAQHRF

SEQ ID NO: 9868 - protein, 11 aa, Mycobacterium tuberculosis
AADERAQHRFG

SEQ ID NO: 9869 - protein, 11 aa, Mycobacterium tuberculosis
ADERAQHRFGA

SEQ ID NO: 9870 - protein, 11 aa, Mycobacterium tuberculosis
DERAQHRFGAV

SEQ ID NO: 9871 - protein, 11 aa, Mycobacterium tuberculosis
ERAQHRFGAVQ

SEQ ID NO: 9872 - protein, 11 aa, Mycobacterium tuberculosis
RAQHRFGAVQS

SEQ ID NO: 9873 - protein, 11 aa, Mycobacterium tuberculosis
AQHRFGAVQSA

SEQ ID NO: 9874 - protein, 11 aa, Mycobacterium tuberculosis
QHRFGAVQSAI

SEQ ID NO: 9875 - protein, 11 aa, Mycobacterium tuberculosis
HRFGAVQSAIL

SEQ ID NO: 9876 - protein, 11 aa, Mycobacterium tuberculosis
RFGAVQSAILH

SEQ ID NO: 9877 - protein, 11 aa, Mycobacterium tuberculosis
FGAVQSAILHA

SEQ ID NO: 9878 - protein, 11 aa, Mycobacterium tuberculosis
GAVQSAILHAR

SEQ ID NO: 9879 - protein, 11 aa, Mycobacterium tuberculosis
AVQSAILHARG

SEQ ID NO: 9880 - protein, 11 aa, Mycobacterium tuberculosis
VQSAILHARGT

SEQ ID NO: 9881 - protein, 8 aa, Mycobacterium tuberculosis
MSRRAIHS

SEQ ID NO: 9882 - protein, 8 aa, Mycobacterium tuberculosis
SRRAIHSG

SEQ ID NO: 9883 - protein, 8 aa, Mycobacterium tuberculosis
RRAIHSGR

SEQ ID NO: 9884 - protein, 8 aa, Mycobacterium tuberculosis
RAIHSGRA

SEQ ID NO: 9885 - protein, 8 aa, Mycobacterium tuberculosis
AIHSGRAA

SEQ ID NO: 9886 - protein, 8 aa, Mycobacterium tuberculosis
IHSGRAAP

SEQ ID NO: 9887 - protein, 8 aa, Mycobacterium tuberculosis
HSGRAAPR

SEQ ID NO: 9888 - protein, 8 aa, Mycobacterium tuberculosis
SGRAAPRR

SEQ ID NO: 9889 - protein, 8 aa, Mycobacterium tuberculosis
GRAAPRRS

SEQ ID NO: 9890 - protein, 8 aa, Mycobacterium tuberculosis
RAAPRRSG

SEQ ID NO: 9891 - protein, 8 aa, Mycobacterium tuberculosis
AAPRRSGN

SEQ ID NO: 9892 - protein, 8 aa, Mycobacterium tuberculosis
APRRSGNS

SEQ ID NO: 9893 - protein, 8 aa, Mycobacterium tuberculosis
PRRSGNSH

SEQ ID NO: 9894 - protein, 8 aa, Mycobacterium tuberculosis
RRSGNSHL

SEQ ID NO: 9895 - protein, 8 aa, Mycobacterium tuberculosis
RSGNSHLV

SEQ ID NO: 9896 - protein, 8 aa, Mycobacterium tuberculosis
SGNSHLVL

SEQ ID NO: 9897 - protein, 8 aa, Mycobacterium tuberculosis
GNSHLVLR

SEQ ID NO: 9898 - protein, 8 aa, Mycobacterium tuberculosis
NSHLVLRN

SEQ ID NO: 9899 - protein, 8 aa, Mycobacterium tuberculosis
SHLVLRNR

SEQ ID NO: 9900 - protein, 8 aa, Mycobacterium tuberculosis
HLVLRNRV

SEQ ID NO: 9901 - protein, 8 aa, Mycobacterium tuberculosis
LVLRNRVP

SEQ ID NO: 9902 - protein, 8 aa, Mycobacterium tuberculosis
VLRNRVPS

SEQ ID NO: 9903 - protein, 8 aa, Mycobacterium tuberculosis
LRNRVPSS

SEQ ID NO: 9904 - protein, 8 aa, Mycobacterium tuberculosis
RNRVPSSK

SEQ ID NO: 9905 - protein, 8 aa, Mycobacterium tuberculosis
NRVPSSKD

SEQ ID NO: 9906 - protein, 8 aa, Mycobacterium tuberculosis
RVPSSKDS

SEQ ID NO: 9907 - protein, 8 aa, Mycobacterium tuberculosis
VPSSKDSP

SEQ ID NO: 9908 - protein, 8 aa, Mycobacterium tuberculosis
PSSKDSPR

SEQ ID NO: 9909 - protein, 8 aa, Mycobacterium tuberculosis
SSKDSPRR

SEQ ID NO: 9910 - protein, 8 aa, Mycobacterium tuberculosis
SKDSPRRR

SEQ ID NO: 9911 - protein, 8 aa, Mycobacterium tuberculosis
KDSPRRRP

SEQ ID NO: 9912 - protein, 8 aa, Mycobacterium tuberculosis
DSPRRRPH

SEQ ID NO: 9913 - protein, 8 aa, Mycobacterium tuberculosis
SPRRRPHH

SEQ ID NO: 9914 - protein, 8 aa, Mycobacterium tuberculosis
PRRRPHHE

SEQ ID NO: 9915 - protein, 8 aa, Mycobacterium tuberculosis
RRRPHHEF

SEQ ID NO: 9916 - protein, 8 aa, Mycobacterium tuberculosis
RRPHHEFM

SEQ ID NO: 9917 - protein, 8 aa, Mycobacterium tuberculosis
RPHHEFMT

SEQ ID NO: 9918 - protein, 8 aa, Mycobacterium tuberculosis
PHHEFMTE

SEQ ID NO: 9919 - protein, 8 aa, Mycobacterium tuberculosis
HHEFMTES

SEQ ID NO: 9920 - protein, 8 aa, Mycobacterium tuberculosis
HEFMTESI

SEQ ID NO: 9921 - protein, 8 aa, Mycobacterium tuberculosis
EFMTESIG

SEQ ID NO: 9922 - protein, 8 aa, Mycobacterium tuberculosis
FMTESIGE

SEQ ID NO: 9923 - protein, 8 aa, Mycobacterium tuberculosis
MTESIGEP

SEQ ID NO: 9924 - protein, 8 aa, Mycobacterium tuberculosis
TESIGEPL

SEQ ID NO: 9925 - protein, 8 aa, Mycobacterium tuberculosis
ESIGEPLS

SEQ ID NO: 9926 - protein, 8 aa, Mycobacterium tuberculosis
SIGEPLST

SEQ ID NO: 9927 - protein, 8 aa, Mycobacterium tuberculosis
IGEPLSTN

SEQ ID NO: 9928 - protein, 8 aa, Mycobacterium tuberculosis
GEPLSTNL

SEQ ID NO: 9929 - protein, 8 aa, Mycobacterium tuberculosis
EPLSTNLI

SEQ ID NO: 9930 - protein, 8 aa, Mycobacterium tuberculosis
PLSTNLIE

SEQ ID NO: 9931 - protein, 8 aa, Mycobacterium tuberculosis
LSTNLIER

SEQ ID NO: 9932 - protein, 8 aa, Mycobacterium tuberculosis
STNLIERY

SEQ ID NO: 9933 - protein, 8 aa, Mycobacterium tuberculosis
TNLIERYL

SEQ ID NO: 9934 - protein, 8 aa, Mycobacterium tuberculosis
NLIERYLR

SEQ ID NO: 9935 - protein, 8 aa, Mycobacterium tuberculosis
LIERYLRA

SEQ ID NO: 9936 - protein, 8 aa, Mycobacterium tuberculosis
IERYLRAR

SEQ ID NO: 9937 - protein, 8 aa, Mycobacterium tuberculosis
ERYLRARG

SEQ ID NO: 9938 - protein, 8 aa, Mycobacterium tuberculosis
RYLRARGR

SEQ ID NO: 9939 - protein, 8 aa, Mycobacterium tuberculosis
YLRARGRR

SEQ ID NO: 9940 - protein, 8 aa, Mycobacterium tuberculosis
LRARGRRY

SEQ ID NO: 9941 - protein, 8 aa, Mycobacterium tuberculosis
RARGRRYF

SEQ ID NO: 9942 - protein, 8 aa, Mycobacterium tuberculosis
ARGRRYFR

SEQ ID NO: 9943 - protein, 8 aa, Mycobacterium tuberculosis
RGRRYFRG

SEQ ID NO: 9944 - protein, 8 aa, Mycobacterium tuberculosis
GRRYFRGH

SEQ ID NO: 9945 - protein, 8 aa, Mycobacterium tuberculosis
RRYFRGHH

SEQ ID NO: 9946 - protein, 8 aa, Mycobacterium tuberculosis
RYFRGHHD

SEQ ID NO: 9947 - protein, 8 aa, Mycobacterium tuberculosis
YFRGHHDA

SEQ ID NO: 9948 - protein, 8 aa, Mycobacterium tuberculosis
FRGHHDAE

SEQ ID NO: 9949 - protein, 8 aa, Mycobacterium tuberculosis
RGHHDAEF

SEQ ID NO: 9950 - protein, 8 aa, Mycobacterium tuberculosis
GHHDAEFF

SEQ ID NO: 9951 - protein, 8 aa, Mycobacterium tuberculosis
HHDAEFFF

SEQ ID NO: 9952 - protein, 8 aa, Mycobacterium tuberculosis
HDAEFFFV

SEQ ID NO: 9953 - protein, 8 aa, Mycobacterium tuberculosis
DAEFFFVA

SEQ ID NO: 9954 - protein, 8 aa, Mycobacterium tuberculosis
AEFFFVAN

SEQ ID NO: 9955 - protein, 8 aa, Mycobacterium tuberculosis
EFFFVANA

SEQ ID NO: 9956 - protein, 8 aa, Mycobacterium tuberculosis
FFFVANAH

SEQ ID NO: 9957 - protein, 8 aa, Mycobacterium tuberculosis
FFVANAHL

SEQ ID NO: 9958 - protein, 8 aa, Mycobacterium tuberculosis
FVANAHLL

SEQ ID NO: 9959 - protein, 8 aa, Mycobacterium tuberculosis
VANAHLLH

SEQ ID NO: 9960 - protein, 8 aa, Mycobacterium tuberculosis
ANAHLLHV

SEQ ID NO: 9961 - protein, 8 aa, Mycobacterium tuberculosis
NAHLLHVH

SEQ ID NO: 9962 - protein, 8 aa, Mycobacterium tuberculosis
AHLLHVHL

SEQ ID NO: 9963 - protein, 8 aa, Mycobacterium tuberculosis
HLLHVHLE

SEQ ID NO: 9964 - protein, 8 aa, Mycobacterium tuberculosis
LLHVHLEI

SEQ ID NO: 9965 - protein, 8 aa, Mycobacterium tuberculosis
LHVHLEIS

SEQ ID NO: 9966 - protein, 8 aa, Mycobacterium tuberculosis
HVHLEISP

SEQ ID NO: 9967 - protein, 8 aa, Mycobacterium tuberculosis
VHLEISPA

SEQ ID NO: 9968 - protein, 8 aa, Mycobacterium tuberculosis
HLEISPAY

SEQ ID NO: 9969 - protein, 8 aa, Mycobacterium tuberculosis
LEISPAYR

SEQ ID NO: 9970 - protein, 8 aa, Mycobacterium tuberculosis
EISPAYRD

SEQ ID NO: 9971 - protein, 8 aa, Mycobacterium tuberculosis
ISPAYRDV

SEQ ID NO: 9972 - protein, 8 aa, Mycobacterium tuberculosis
SPAYRDVF

SEQ ID NO: 9973 - protein, 8 aa, Mycobacterium tuberculosis
PAYRDVFT

SEQ ID NO: 9974 - protein, 8 aa, Mycobacterium tuberculosis
AYRDVFTI

SEQ ID NO: 9975 - protein, 8 aa, Mycobacterium tuberculosis
YRDVFTIR

SEQ ID NO: 9976 - protein, 8 aa, Mycobacterium tuberculosis
RDVFTIRV

SEQ ID NO: 9977 - protein, 8 aa, Mycobacterium tuberculosis
DVFTIRVS

SEQ ID NO: 9978 - protein, 8 aa, Mycobacterium tuberculosis
VFTIRVSP

SEQ ID NO: 9979 - protein, 8 aa, Mycobacterium tuberculosis
FTIRVSPA

SEQ ID NO: 9980 - protein, 8 aa, Mycobacterium tuberculosis
TIRVSPAY

SEQ ID NO: 9981 - protein, 8 aa, Mycobacterium tuberculosis
IRVSPAYF

SEQ ID NO: 9982 - protein, 8 aa, Mycobacterium tuberculosis
RVSPAYFF

SEQ ID NO: 9983 - protein, 8 aa, Mycobacterium tuberculosis
VSPAYFFP

SEQ ID NO: 9984 - protein, 8 aa, Mycobacterium tuberculosis
SPAYFFPA

SEQ ID NO: 9985 - protein, 8 aa, Mycobacterium tuberculosis
PAYFFPAT

SEQ ID NO: 9986 - protein, 8 aa, Mycobacterium tuberculosis
AYFFPATD

SEQ ID NO: 9987 - protein, 8 aa, Mycobacterium tuberculosis
YFFPATDH

SEQ ID NO: 9988 - protein, 8 aa, Mycobacterium tuberculosis
FFPATDHT

SEQ ID NO: 9989 - protein, 8 aa, Mycobacterium tuberculosis
FPATDHTR

SEQ ID NO: 9990 - protein, 8 aa, Mycobacterium tuberculosis
PATDHTRL

SEQ ID NO: 9991 - protein, 8 aa, Mycobacterium tuberculosis
ATDHTRLA

SEQ ID NO: 9992 - protein, 8 aa, Mycobacterium tuberculosis
TDHTRLAE

SEQ ID NO: 9993 - protein, 8 aa, Mycobacterium tuberculosis
DHTRLAEI

SEQ ID NO: 9994 - protein, 8 aa, Mycobacterium tuberculosis
HTRLAEIV

SEQ ID NO: 9995 - protein, 8 aa, Mycobacterium tuberculosis
TRLAEIVN

SEQ ID NO: 9996 - protein, 8 aa, Mycobacterium tuberculosis
RLAEIVNA

SEQ ID NO: 9997 - protein, 8 aa, Mycobacterium tuberculosis
LAEIVNAW

SEQ ID NO: 9998 - protein, 8 aa, Mycobacterium tuberculosis
AEIVNAWN

SEQ ID NO: 9999 - protein, 8 aa, Mycobacterium tuberculosis
EIVNAWNL

SEQ ID NO: 10000 - protein, 8 aa, Mycobacterium tuberculosis
IVNAWNLQ

SEQ ID NO: 10001 - protein, 8 aa, Mycobacterium tuberculosis
VNAWNLQN

SEQ ID NO: 10002 - protein, 8 aa, Mycobacterium tuberculosis
NAWNLQNH

SEQ ID NO: 10003 - protein, 8 aa, Mycobacterium tuberculosis
AWNLQNHE

SEQ ID NO: 10004 - protein, 8 aa, Mycobacterium tuberculosis
WNLQNHEV

SEQ ID NO: 10005 - protein, 8 aa, Mycobacterium tuberculosis
NLQNHEVT

SEQ ID NO: 10006 - protein, 8 aa, Mycobacterium tuberculosis
LQNHEVTA

SEQ ID NO: 10007 - protein, 8 aa, Mycobacterium tuberculosis
QNHEVTAI

SEQ ID NO: 10008 - protein, 8 aa, Mycobacterium tuberculosis
NHEVTAIV

SEQ ID NO: 10009 - protein, 8 aa, Mycobacterium tuberculosis
HEVTAIVH

SEQ ID NO: 10010 - protein, 8 aa, Mycobacterium tuberculosis
EVTAIVHG

SEQ ID NO: 10011 - protein, 8 aa, Mycobacterium tuberculosis
VTAIVHGS

SEQ ID NO: 10012 - protein, 8 aa, Mycobacterium tuberculosis
TAIVHGSS

SEQ ID NO: 10013 - protein, 8 aa, Mycobacterium tuberculosis
AIVHGSSD

SEQ ID NO: 10014 - protein, 8 aa, Mycobacterium tuberculosis
IVHGSSDP

SEQ ID NO: 10015 - protein, 8 aa, Mycobacterium tuberculosis
VHGSSDPH

SEQ ID NO: 10016 - protein, 8 aa, Mycobacterium tuberculosis
HGSSDPHR

SEQ ID NO: 10017 - protein, 8 aa, Mycobacterium tuberculosis
GSSDPHRI

SEQ ID NO: 10018 - protein, 8 aa, Mycobacterium tuberculosis
SSDPHRIG

SEQ ID NO: 10019 - protein, 8 aa, Mycobacterium tuberculosis
SDPHRIGV

SEQ ID NO: 10020 - protein, 8 aa, Mycobacterium tuberculosis
DPHRIGVA

SEQ ID NO: 10021 - protein, 8 aa, Mycobacterium tuberculosis
PHRIGVAA

SEQ ID NO: 10022 - protein, 8 aa, Mycobacterium tuberculosis
HRIGVAAE

SEQ ID NO: 10023 - protein, 8 aa, Mycobacterium tuberculosis
RIGVAAER

SEQ ID NO: 10024 - protein, 8 aa, Mycobacterium tuberculosis
IGVAAERS

SEQ ID NO: 10025 - protein, 8 aa, Mycobacterium tuberculosis
GVAAERSL

SEQ ID NO: 10026 - protein, 8 aa, Mycobacterium tuberculosis
VAAERSLI

SEQ ID NO: 10027 - protein, 8 aa, Mycobacterium tuberculosis
AAERSLIR

SEQ ID NO: 10028 - protein, 8 aa, Mycobacterium tuberculosis
AERSLIRD

SEQ ID NO: 10029 - protein, 8 aa, Mycobacterium tuberculosis
ERSLIRDR

SEQ ID NO: 10030 - protein, 8 aa, Mycobacterium tuberculosis
RSLIRDRI

SEQ ID NO: 10031 - protein, 8 aa, Mycobacterium tuberculosis
SLIRDRIR

SEQ ID NO: 10032 - protein, 8 aa, Mycobacterium tuberculosis
LIRDRIRF

SEQ ID NO: 10033 - protein, 8 aa, Mycobacterium tuberculosis
IRDRIRFD

SEQ ID NO: 10034 - protein, 8 aa, Mycobacterium tuberculosis
RDRIRFDD

SEQ ID NO: 10035 - protein, 8 aa, Mycobacterium tuberculosis
DRIRFDDF

SEQ ID NO: 10036 - protein, 8 aa, Mycobacterium tuberculosis
RIRFDDFA

SEQ ID NO: 10037 - protein, 8 aa, Mycobacterium tuberculosis
IRFDDFAT

SEQ ID NO: 10038 - protein, 8 aa, Mycobacterium tuberculosis
RFDDFATF

SEQ ID NO: 10039 - protein, 8 aa, Mycobacterium tuberculosis
FDDFATFV

SEQ ID NO: 10040 - protein, 8 aa, Mycobacterium tuberculosis
DDFATFVD

SEQ ID NO: 10041 - protein, 8 aa, Mycobacterium tuberculosis
DFATFVDN

SEQ ID NO: 10042 - protein, 8 aa, Mycobacterium tuberculosis
FATFVDNA

SEQ ID NO: 10043 - protein, 8 aa, Mycobacterium tuberculosis
ATFVDNAV

SEQ ID NO: 10044 - protein, 8 aa, Mycobacterium tuberculosis
TFVDNAVS

SEQ ID NO: 10045 - protein, 8 aa, Mycobacterium tuberculosis
FVDNAVSA

SEQ ID NO: 10046 - protein, 8 aa, Mycobacterium tuberculosis
VDNAVSAA

SEQ ID NO: 10047 - protein, 8 aa, Mycobacterium tuberculosis
DNAVSAAT

SEQ ID NO: 10048 - protein, 8 aa, Mycobacterium tuberculosis
NAVSAATE

SEQ ID NO: 10049 - protein, 8 aa, Mycobacterium tuberculosis
AVSAATEL

SEQ ID NO: 10050 - protein, 8 aa, Mycobacterium tuberculosis
VSAATELF

SEQ ID NO: 10051 - protein, 8 aa, Mycobacterium tuberculosis
SAATELFG

SEQ ID NO: 10052 - protein, 8 aa, Mycobacterium tuberculosis
AATELFGQ

SEQ ID NO: 10053 - protein, 8 aa, Mycobacterium tuberculosis
ATELFGQL

SEQ ID NO: 10054 - protein, 8 aa, Mycobacterium tuberculosis
TELFGQLT

SEQ ID NO: 10055 - protein, 8 aa, Mycobacterium tuberculosis
ELFGQLTA

SEQ ID NO: 10056 - protein, 8 aa, Mycobacterium tuberculosis
LFGQLTAA

SEQ ID NO: 10057 - protein, 8 aa, Mycobacterium tuberculosis
FGQLTAAG

SEQ ID NO: 10058 - protein, 8 aa, Mycobacterium tuberculosis
GQLTAAGL

SEQ ID NO: 10059 - protein, 8 aa, Mycobacterium tuberculosis
QLTAAGLP

SEQ ID NO: 10060 - protein, 8 aa, Mycobacterium tuberculosis
LTAAGLPP

SEQ ID NO: 10061 - protein, 8 aa, Mycobacterium tuberculosis
TAAGLPPT

SEQ ID NO: 10062 - protein, 8 aa, Mycobacterium tuberculosis
AAGLPPTA

SEQ ID NO: 10063 - protein, 8 aa, Mycobacterium tuberculosis
AGLPPTAT

SEQ ID NO: 10064 - protein, 8 aa, Mycobacterium tuberculosis
GLPPTATP

SEQ ID NO: 10065 - protein, 8 aa, Mycobacterium tuberculosis
LPPTATPP

SEQ ID NO: 10066 - protein, 8 aa, Mycobacterium tuberculosis
PPTATPPL

SEQ ID NO: 10067 - protein, 8 aa, Mycobacterium tuberculosis
PTATPPLL

SEQ ID NO: 10068 - protein, 8 aa, Mycobacterium tuberculosis
TATPPLLR

SEQ ID NO: 10069 - protein, 8 aa, Mycobacterium tuberculosis
ATPPLLRD

SEQ ID NO: 10070 - protein, 8 aa, Mycobacterium tuberculosis
TPPLLRDA

SEQ ID NO: 10071 - protein, 8 aa, Mycobacterium tuberculosis
PPLLRDAG

SEQ ID NO: 10072 - protein, 9 aa, Mycobacterium tuberculosis
MSRRAIHSG

SEQ ID NO: 10073 - protein, 9 aa, Mycobacterium tuberculosis
SRRAIHSGR

SEQ ID NO: 10074 - protein, 9 aa, Mycobacterium tuberculosis
RRAIHSGRA

SEQ ID NO: 10075 - protein, 9 aa, Mycobacterium tuberculosis
RAIHSGRAA

SEQ ID NO: 10076 - protein, 9 aa, Mycobacterium tuberculosis
AIHSGRAAP

SEQ ID NO: 10077 - protein, 9 aa, Mycobacterium tuberculosis
IHSGRAAPR

SEQ ID NO: 10078 - protein, 9 aa, Mycobacterium tuberculosis
HSGRAAPRR

SEQ ID NO: 10079 - protein, 9 aa, Mycobacterium tuberculosis
SGRAAPRRS

SEQ ID NO: 10080 - protein, 9 aa, Mycobacterium tuberculosis
GRAAPRRSG

SEQ ID NO: 10081 - protein, 9 aa, Mycobacterium tuberculosis
RAAPRRSGN

SEQ ID NO: 10082 - protein, 9 aa, Mycobacterium tuberculosis
AAPRRSGNS

SEQ ID NO: 10083 - protein, 9 aa, Mycobacterium tuberculosis
APRRSGNSH

SEQ ID NO: 10084 - protein, 9 aa, Mycobacterium tuberculosis
PRRSGNSHL

SEQ ID NO: 10085 - protein, 9 aa, Mycobacterium tuberculosis
RRSGNSHLV

SEQ ID NO: 10086 - protein, 9 aa, Mycobacterium tuberculosis
RSGNSHLVL

SEQ ID NO: 10087 - protein, 9 aa, Mycobacterium tuberculosis
SGNSHLVLR

SEQ ID NO: 10088 - protein, 9 aa, Mycobacterium tuberculosis
GNSHLVLRN

SEQ ID NO: 10089 - protein, 9 aa, Mycobacterium tuberculosis
NSHLVLRNR

SEQ ID NO: 10090 - protein, 9 aa, Mycobacterium tuberculosis
SHLVLRNRV

SEQ ID NO: 10091 - protein, 9 aa, Mycobacterium tuberculosis
HLVLRNRVP

SEQ ID NO: 10092 - protein, 9 aa, Mycobacterium tuberculosis
LVLRNRVPS

SEQ ID NO: 10093 - protein, 9 aa, Mycobacterium tuberculosis
VLRNRVPSS

SEQ ID NO: 10094 - protein, 9 aa, Mycobacterium tuberculosis
LRNRVPSSK

SEQ ID NO: 10095 - protein, 9 aa, Mycobacterium tuberculosis
RNRVPSSKD

SEQ ID NO: 10096 - protein, 9 aa, Mycobacterium tuberculosis
NRVPSSKDS

SEQ ID NO: 10097 - protein, 9 aa, Mycobacterium tuberculosis
RVPSSKDSP

SEQ ID NO: 10098 - protein, 9 aa, Mycobacterium tuberculosis
VPSSKDSPR

SEQ ID NO: 10099 - protein, 9 aa, Mycobacterium tuberculosis
PSSKDSPRR

SEQ ID NO: 10100 - protein, 9 aa, Mycobacterium tuberculosis
SSKDSPRRR

SEQ ID NO: 10101 - protein, 9 aa, Mycobacterium tuberculosis
SKDSPRRRP

SEQ ID NO: 10102 - protein, 9 aa, Mycobacterium tuberculosis
KDSPRRRPH

SEQ ID NO: 10103 - protein, 9 aa, Mycobacterium tuberculosis
DSPRRRPHH

SEQ ID NO: 10104 - protein, 9 aa, Mycobacterium tuberculosis
SPRRRPHHE

SEQ ID NO: 10105 - protein, 9 aa, Mycobacterium tuberculosis
PRRRPHHEF

SEQ ID NO: 10106 - protein, 9 aa, Mycobacterium tuberculosis
RRRPHHEFM

SEQ ID NO: 10107 - protein, 9 aa, Mycobacterium tuberculosis
RRPHHEFMT

SEQ ID NO: 10108 - protein, 9 aa, Mycobacterium tuberculosis
RPHHEFMTE

SEQ ID NO: 10109 - protein, 9 aa, Mycobacterium tuberculosis
PHHEFMTES

SEQ ID NO: 10110 - protein, 9 aa, Mycobacterium tuberculosis
HHEFMTESI

SEQ ID NO: 10111 - protein, 9 aa, Mycobacterium tuberculosis
HEFMTESIG

SEQ ID NO: 10112 - protein, 9 aa, Mycobacterium tuberculosis
EFMTESIGE

SEQ ID NO: 10113 - protein, 9 aa, Mycobacterium tuberculosis
FMTESIGEP

SEQ ID NO: 10114 - protein, 9 aa, Mycobacterium tuberculosis
MTESIGEPL

SEQ ID NO: 10115 - protein, 9 aa, Mycobacterium tuberculosis
TESIGEPLS

SEQ ID NO: 10116 - protein, 9 aa, Mycobacterium tuberculosis
ESIGEPLST

SEQ ID NO: 10117 - protein, 9 aa, Mycobacterium tuberculosis
SIGEPLSTN

SEQ ID NO: 10118 - protein, 9 aa, Mycobacterium tuberculosis
IGEPLSTNL

SEQ ID NO: 10119 - protein, 9 aa, Mycobacterium tuberculosis
GEPLSTNLI

SEQ ID NO: 10120 - protein, 9 aa, Mycobacterium tuberculosis
EPLSTNLIE

SEQ ID NO: 10121 - protein, 9 aa, Mycobacterium tuberculosis
PLSTNLIER

SEQ ID NO: 10122 - protein, 9 aa, Mycobacterium tuberculosis
LSTNLIERY

SEQ ID NO: 10123 - protein, 9 aa, Mycobacterium tuberculosis
STNLIERYL

SEQ ID NO: 10124 - protein, 9 aa, Mycobacterium tuberculosis
TNLIERYLR

SEQ ID NO: 10125 - protein, 9 aa, Mycobacterium tuberculosis
NLIERYLRA

SEQ ID NO: 10126 - protein, 9 aa, Mycobacterium tuberculosis
LIERYLRAR

SEQ ID NO: 10127 - protein, 9 aa, Mycobacterium tuberculosis
IERYLRARG

SEQ ID NO: 10128 - protein, 9 aa, Mycobacterium tuberculosis
ERYLRARGR

SEQ ID NO: 10129 - protein, 9 aa, Mycobacterium tuberculosis
RYLRARGRR

SEQ ID NO: 10130 - protein, 9 aa, Mycobacterium tuberculosis
YLRARGRRY

SEQ ID NO: 10131 - protein, 9 aa, Mycobacterium tuberculosis
LRARGRRYF

SEQ ID NO: 10132 - protein, 9 aa, Mycobacterium tuberculosis
RARGRRYFR

SEQ ID NO: 10133 - protein, 9 aa, Mycobacterium tuberculosis
ARGRRYFRG

SEQ ID NO: 10134 - protein, 9 aa, Mycobacterium tuberculosis
RGRRYFRGH

SEQ ID NO: 10135 - protein, 9 aa, Mycobacterium tuberculosis
GRRYFRGHH

SEQ ID NO: 10136 - protein, 9 aa, Mycobacterium tuberculosis
RRYFRGHHD

SEQ ID NO: 10137 - protein, 9 aa, Mycobacterium tuberculosis
RYFRGHHDA

SEQ ID NO: 10138 - protein, 9 aa, Mycobacterium tuberculosis
YFRGHHDAE

SEQ ID NO: 10139 - protein, 9 aa, Mycobacterium tuberculosis
FRGHHDAEF

SEQ ID NO: 10140 - protein, 9 aa, Mycobacterium tuberculosis
RGHHDAEFF

SEQ ID NO: 10141 - protein, 9 aa, Mycobacterium tuberculosis
GHHDAEFFF

SEQ ID NO: 10142 - protein, 9 aa, Mycobacterium tuberculosis
HHDAEFFFV

SEQ ID NO: 10143 - protein, 9 aa, Mycobacterium tuberculosis
HDAEFFFVA

SEQ ID NO: 10144 - protein, 9 aa, Mycobacterium tuberculosis
DAEFFFVAN

SEQ ID NO: 10145 - protein, 9 aa, Mycobacterium tuberculosis
AEFFFVANA

SEQ ID NO: 10146 - protein, 9 aa, Mycobacterium tuberculosis
EFFFVANAH

SEQ ID NO: 10147 - protein, 9 aa, Mycobacterium tuberculosis
FFFVANAHL

SEQ ID NO: 10148 - protein, 9 aa, Mycobacterium tuberculosis
FFVANAHLL

SEQ ID NO: 10149 - protein, 9 aa, Mycobacterium tuberculosis
FVANAHLLH

SEQ ID NO: 10150 - protein, 9 aa, Mycobacterium tuberculosis
VANAHLLHV

SEQ ID NO: 10151 - protein, 9 aa, Mycobacterium tuberculosis
ANAHLLHVH

SEQ ID NO: 10152 - protein, 9 aa, Mycobacterium tuberculosis
NAHLLHVHL

SEQ ID NO: 10153 - protein, 9 aa, Mycobacterium tuberculosis
AHLLHVHLE

SEQ ID NO: 10154 - protein, 9 aa, Mycobacterium tuberculosis
HLLHVHLEI

SEQ ID NO: 10155 - protein, 9 aa, Mycobacterium tuberculosis
LLHVHLEIS

SEQ ID NO: 10156 - protein, 9 aa, Mycobacterium tuberculosis
LHVHLEISP

SEQ ID NO: 10157 - protein, 9 aa, Mycobacterium tuberculosis
HVHLEISPA

SEQ ID NO: 10158 - protein, 9 aa, Mycobacterium tuberculosis
VHLEISPAY

SEQ ID NO: 10159 - protein, 9 aa, Mycobacterium tuberculosis
HLEISPAYR

SEQ ID NO: 10160 - protein, 9 aa, Mycobacterium tuberculosis
LEISPAYRD

SEQ ID NO: 10161 - protein, 9 aa, Mycobacterium tuberculosis
EISPAYRDV

SEQ ID NO: 10162 - protein, 9 aa, Mycobacterium tuberculosis
ISPAYRDVF

SEQ ID NO: 10163 - protein, 9 aa, Mycobacterium tuberculosis
SPAYRDVFT

SEQ ID NO: 10164 - protein, 9 aa, Mycobacterium tuberculosis
PAYRDVFTI

SEQ ID NO: 10165 - protein, 9 aa, Mycobacterium tuberculosis
AYRDVFTIR

SEQ ID NO: 10166 - protein, 9 aa, Mycobacterium tuberculosis
YRDVFTIRV

SEQ ID NO: 10167 - protein, 9 aa, Mycobacterium tuberculosis
RDVFTIRVS

SEQ ID NO: 10168 - protein, 9 aa, Mycobacterium tuberculosis
DVFTIRVSP

SEQ ID NO: 10169 - protein, 9 aa, Mycobacterium tuberculosis
VFTIRVSPA

SEQ ID NO: 10170 - protein, 9 aa, Mycobacterium tuberculosis
FTIRVSPAY

SEQ ID NO: 10171 - protein, 9 aa, Mycobacterium tuberculosis
TIRVSPAYF

SEQ ID NO: 10172 - protein, 9 aa, Mycobacterium tuberculosis
IRVSPAYFF

SEQ ID NO: 10173 - protein, 9 aa, Mycobacterium tuberculosis
RVSPAYFFP

SEQ ID NO: 10174 - protein, 9 aa, Mycobacterium tuberculosis
VSPAYFFPA

SEQ ID NO: 10175 - protein, 9 aa, Mycobacterium tuberculosis
SPAYFFPAT

SEQ ID NO: 10176 - protein, 9 aa, Mycobacterium tuberculosis
PAYFFPATD

SEQ ID NO: 10177 - protein, 9 aa, Mycobacterium tuberculosis
AYFFPATDH

SEQ ID NO: 10178 - protein, 9 aa, Mycobacterium tuberculosis
YFFPATDHT

SEQ ID NO: 10179 - protein, 9 aa, Mycobacterium tuberculosis
FFPATDHTR

SEQ ID NO: 10180 - protein, 9 aa, Mycobacterium tuberculosis
FPATDHTRL

SEQ ID NO: 10181 - protein, 9 aa, Mycobacterium tuberculosis
PATDHTRLA

SEQ ID NO: 10182 - protein, 9 aa, Mycobacterium tuberculosis
ATDHTRLAE

SEQ ID NO: 10183 - protein, 9 aa, Mycobacterium tuberculosis
TDHTRLAEI

SEQ ID NO: 10184 - protein, 9 aa, Mycobacterium tuberculosis
DHTRLAEIV

SEQ ID NO: 10185 - protein, 9 aa, Mycobacterium tuberculosis
HTRLAEIVN

SEQ ID NO: 10186 - protein, 9 aa, Mycobacterium tuberculosis
TRLAEIVNA

SEQ ID NO: 10187 - protein, 9 aa, Mycobacterium tuberculosis
RLAEIVNAW

SEQ ID NO: 10188 - protein, 9 aa, Mycobacterium tuberculosis
LAEIVNAWN

SEQ ID NO: 10189 - protein, 9 aa, Mycobacterium tuberculosis
AEIVNAWNL

SEQ ID NO: 10190 - protein, 9 aa, Mycobacterium tuberculosis
EIVNAWNLQ

SEQ ID NO: 10191 - protein, 9 aa, Mycobacterium tuberculosis
IVNAWNLQN

SEQ ID NO: 10192 - protein, 9 aa, Mycobacterium tuberculosis
VNAWNLQNH

SEQ ID NO: 10193 - protein, 9 aa, Mycobacterium tuberculosis
NAWNLQNHE

SEQ ID NO: 10194 - protein, 9 aa, Mycobacterium tuberculosis
AWNLQNHEV

SEQ ID NO: 10195 - protein, 9 aa, Mycobacterium tuberculosis
WNLQNHEVT

SEQ ID NO: 10196 - protein, 9 aa, Mycobacterium tuberculosis
NLQNHEVTA

SEQ ID NO: 10197 - protein, 9 aa, Mycobacterium tuberculosis
LQNHEVTAI

SEQ ID NO: 10198 - protein, 9 aa, Mycobacterium tuberculosis
QNHEVTAIV

SEQ ID NO: 10199 - protein, 9 aa, Mycobacterium tuberculosis
NHEVTAIVH

SEQ ID NO: 10200 - protein, 9 aa, Mycobacterium tuberculosis
HEVTAIVHG

SEQ ID NO: 10201 - protein, 9 aa, Mycobacterium tuberculosis
EVTAIVHGS

SEQ ID NO: 10202 - protein, 9 aa, Mycobacterium tuberculosis
VTAIVHGSS

SEQ ID NO: 10203 - protein, 9 aa, Mycobacterium tuberculosis
TAIVHGSSD

SEQ ID NO: 10204 - protein, 9 aa, Mycobacterium tuberculosis
AIVHGSSDP

SEQ ID NO: 10205 - protein, 9 aa, Mycobacterium tuberculosis
IVHGSSDPH

SEQ ID NO: 10206 - protein, 9 aa, Mycobacterium tuberculosis
VHGSSDPHR

SEQ ID NO: 10207 - protein, 9 aa, Mycobacterium tuberculosis
HGSSDPHRI

SEQ ID NO: 10208 - protein, 9 aa, Mycobacterium tuberculosis
GSSDPHRIG

SEQ ID NO: 10209 - protein, 9 aa, Mycobacterium tuberculosis
SSDPHRIGV

SEQ ID NO: 10210 - protein, 9 aa, Mycobacterium tuberculosis
SDPHRIGVA

SEQ ID NO: 10211 - protein, 9 aa, Mycobacterium tuberculosis
DPHRIGVAA

SEQ ID NO: 10212 - protein, 9 aa, Mycobacterium tuberculosis
PHRIGVAAE

SEQ ID NO: 10213 - protein, 9 aa, Mycobacterium tuberculosis
HRIGVAAER

SEQ ID NO: 10214 - protein, 9 aa, Mycobacterium tuberculosis
RIGVAAERS

SEQ ID NO: 10215 - protein, 9 aa, Mycobacterium tuberculosis
IGVAAERSL

SEQ ID NO: 10216 - protein, 9 aa, Mycobacterium tuberculosis
GVAAERSLI

SEQ ID NO: 10217 - protein, 9 aa, Mycobacterium tuberculosis
VAAERSLIR

SEQ ID NO: 10218 - protein, 9 aa, Mycobacterium tuberculosis
AAERSLIRD

SEQ ID NO: 10219 - protein, 9 aa, Mycobacterium tuberculosis
AERSLIRDR

SEQ ID NO: 10220 - protein, 9 aa, Mycobacterium tuberculosis
ERSLIRDRI

SEQ ID NO: 10221 - protein, 9 aa, Mycobacterium tuberculosis
RSLIRDRIR

SEQ ID NO: 10222 - protein, 9 aa, Mycobacterium tuberculosis
SLIRDRIRF

SEQ ID NO: 10223 - protein, 9 aa, Mycobacterium tuberculosis
LIRDRIRFD

SEQ ID NO: 10224 - protein, 9 aa, Mycobacterium tuberculosis
IRDRIRFDD

SEQ ID NO: 10225 - protein, 9 aa, Mycobacterium tuberculosis
RDRIRFDDF

SEQ ID NO: 10226 - protein, 9 aa, Mycobacterium tuberculosis
DRIRFDDFA

SEQ ID NO: 10227 - protein, 9 aa, Mycobacterium tuberculosis
RIRFDDFAT

SEQ ID NO: 10228 - protein, 9 aa, Mycobacterium tuberculosis
IRFDDFATF

SEQ ID NO: 10229 - protein, 9 aa, Mycobacterium tuberculosis
RFDDFATFV

SEQ ID NO: 10230 - protein, 9 aa, Mycobacterium tuberculosis
FDDFATFVD

SEQ ID NO: 10231 - protein, 9 aa, Mycobacterium tuberculosis
DDFATFVDN

SEQ ID NO: 10232 - protein, 9 aa, Mycobacterium tuberculosis
DFATFVDNA

SEQ ID NO: 10233 - protein, 9 aa, Mycobacterium tuberculosis
FATFVDNAV

SEQ ID NO: 10234 - protein, 9 aa, Mycobacterium tuberculosis
ATFVDNAVS

SEQ ID NO: 10235 - protein, 9 aa, Mycobacterium tuberculosis
TFVDNAVSA

SEQ ID NO: 10236 - protein, 9 aa, Mycobacterium tuberculosis
FVDNAVSAA

SEQ ID NO: 10237 - protein, 9 aa, Mycobacterium tuberculosis
VDNAVSAAT

SEQ ID NO: 10238 - protein, 9 aa, Mycobacterium tuberculosis
DNAVSAATE

SEQ ID NO: 10239 - protein, 9 aa, Mycobacterium tuberculosis
NAVSAATEL

SEQ ID NO: 10240 - protein, 9 aa, Mycobacterium tuberculosis
AVSAATELF

SEQ ID NO: 10241 - protein, 9 aa, Mycobacterium tuberculosis
VSAATELFG

SEQ ID NO: 10242 - protein, 9 aa, Mycobacterium tuberculosis
SAATELFGQ

SEQ ID NO: 10243 - protein, 9 aa, Mycobacterium tuberculosis
AATELFGQL

SEQ ID NO: 10244 - protein, 9 aa, Mycobacterium tuberculosis
ATELFGQLT

SEQ ID NO: 10245 - protein, 9 aa, Mycobacterium tuberculosis
TELFGQLTA

SEQ ID NO: 10246 - protein, 9 aa, Mycobacterium tuberculosis
ELFGQLTAA

SEQ ID NO: 10247 - protein, 9 aa, Mycobacterium tuberculosis
LFGQLTAAG

SEQ ID NO: 10248 - protein, 9 aa, Mycobacterium tuberculosis
FGQLTAAGL

SEQ ID NO: 10249 - protein, 9 aa, Mycobacterium tuberculosis
GQLTAAGLP

SEQ ID NO: 10250 - protein, 9 aa, Mycobacterium tuberculosis
QLTAAGLPP

SEQ ID NO: 10251 - protein, 9 aa, Mycobacterium tuberculosis
LTAAGLPPT

SEQ ID NO: 10252 - protein, 9 aa, Mycobacterium tuberculosis
TAAGLPPTA

SEQ ID NO: 10253 - protein, 9 aa, Mycobacterium tuberculosis
AAGLPPTAT

SEQ ID NO: 10254 - protein, 9 aa, Mycobacterium tuberculosis
AGLPPTATP

SEQ ID NO: 10255 - protein, 9 aa, Mycobacterium tuberculosis
GLPPTATPP

SEQ ID NO: 10256 - protein, 9 aa, Mycobacterium tuberculosis
LPPTATPPL

SEQ ID NO: 10257 - protein, 9 aa, Mycobacterium tuberculosis
PPTATPPLL

SEQ ID NO: 10258 - protein, 9 aa, Mycobacterium tuberculosis
PTATPPLLR

SEQ ID NO: 10259 - protein, 9 aa, Mycobacterium tuberculosis
TATPPLLRD

SEQ ID NO: 10260 - protein, 9 aa, Mycobacterium tuberculosis
ATPPLLRDA

SEQ ID NO: 10261 - protein, 9 aa, Mycobacterium tuberculosis
TPPLLRDAG

SEQ ID NO: 10262 - protein, 10 aa, Mycobacterium tuberculosis
MSRRAIHSGR

SEQ ID NO: 10263 - protein, 10 aa, Mycobacterium tuberculosis
SRRAIHSGRA

SEQ ID NO: 10264 - protein, 10 aa, Mycobacterium tuberculosis
RRAIHSGRAA

SEQ ID NO: 10265 - protein, 10 aa, Mycobacterium tuberculosis
RAIHSGRAAP

SEQ ID NO: 10266 - protein, 10 aa, Mycobacterium tuberculosis
AIHSGRAAPR

SEQ ID NO: 10267 - protein, 10 aa, Mycobacterium tuberculosis
IHSGRAAPRR

SEQ ID NO: 10268 - protein, 10 aa, Mycobacterium tuberculosis
HSGRAAPRRS

SEQ ID NO: 10269 - protein, 10 aa, Mycobacterium tuberculosis
SGRAAPRRSG

SEQ ID NO: 10270 - protein, 10 aa, Mycobacterium tuberculosis
GRAAPRRSGN

SEQ ID NO: 10271 - protein, 10 aa, Mycobacterium tuberculosis
RAAPRRSGNS

SEQ ID NO: 10272 - protein, 10 aa, Mycobacterium tuberculosis
AAPRRSGNSH

SEQ ID NO: 10273 - protein, 10 aa, Mycobacterium tuberculosis
APRRSGNSHL

SEQ ID NO: 10274 - protein, 10 aa, Mycobacterium tuberculosis
PRRSGNSHLV

SEQ ID NO: 10275 - protein, 10 aa, Mycobacterium tuberculosis
RRSGNSHLVL

SEQ ID NO: 10276 - protein, 10 aa, Mycobacterium tuberculosis
RSGNSHLVLR

SEQ ID NO: 10277 - protein, 10 aa, Mycobacterium tuberculosis
SGNSHLVLRN

SEQ ID NO: 10278 - protein, 10 aa, Mycobacterium tuberculosis
GNSHLVLRNR

SEQ ID NO: 10279 - protein, 10 aa, Mycobacterium tuberculosis
NSHLVLRNRV

SEQ ID NO: 10280 - protein, 10 aa, Mycobacterium tuberculosis
SHLVLRNRVP

SEQ ID NO: 10281 - protein, 10 aa, Mycobacterium tuberculosis
HLVLRNRVPS

SEQ ID NO: 10282 - protein, 10 aa, Mycobacterium tuberculosis
LVLRNRVPSS

SEQ ID NO: 10283 - protein, 10 aa, Mycobacterium tuberculosis
VLRNRVPSSK

SEQ ID NO: 10284 - protein, 10 aa, Mycobacterium tuberculosis
LRNRVPSSKD

SEQ ID NO: 10285 - protein, 10 aa, Mycobacterium tuberculosis
RNRVPSSKDS

SEQ ID NO: 10286 - protein, 10 aa, Mycobacterium tuberculosis
NRVPSSKDSP

SEQ ID NO: 10287 - protein, 10 aa, Mycobacterium tuberculosis
RVPSSKDSPR

SEQ ID NO: 10288 - protein, 10 aa, Mycobacterium tuberculosis
VPSSKDSPRR

SEQ ID NO: 10289 - protein, 10 aa, Mycobacterium tuberculosis
PSSKDSPRRR

SEQ ID NO: 10290 - protein, 10 aa, Mycobacterium tuberculosis
SSKDSPRRRP

SEQ ID NO: 10291 - protein, 10 aa, Mycobacterium tuberculosis
SKDSPRRRPH

SEQ ID NO: 10292 - protein, 10 aa, Mycobacterium tuberculosis
KDSPRRRPHH

SEQ ID NO: 10293 - protein, 10 aa, Mycobacterium tuberculosis
DSPRRRPHHE

SEQ ID NO: 10294 - protein, 10 aa, Mycobacterium tuberculosis
SPRRRPHHEF

SEQ ID NO: 10295 - protein, 10 aa, Mycobacterium tuberculosis
PRRRPHHEFM

SEQ ID NO: 10296 - protein, 10 aa, Mycobacterium tuberculosis
RRRPHHEFMT

SEQ ID NO: 10297 - protein, 10 aa, Mycobacterium tuberculosis
RRPHHEFMTE

SEQ ID NO: 10298 - protein, 10 aa, Mycobacterium tuberculosis
RPHHEFMTES

SEQ ID NO: 10299 - protein, 10 aa, Mycobacterium tuberculosis
PHHEFMTESI

SEQ ID NO: 10300 - protein, 10 aa, Mycobacterium tuberculosis
HHEFMTESIG

SEQ ID NO: 10301 - protein, 10 aa, Mycobacterium tuberculosis
HEFMTESIGE

SEQ ID NO: 10302 - protein, 10 aa, Mycobacterium tuberculosis
EFMTESIGEP

SEQ ID NO: 10303 - protein, 10 aa, Mycobacterium tuberculosis
FMTESIGEPL

SEQ ID NO: 10304 - protein, 10 aa, Mycobacterium tuberculosis
MTESIGEPLS

SEQ ID NO: 10305 - protein, 10 aa, Mycobacterium tuberculosis
TESIGEPLST

SEQ ID NO: 10306 - protein, 10 aa, Mycobacterium tuberculosis
ESIGEPLSTN

SEQ ID NO: 10307 - protein, 10 aa, Mycobacterium tuberculosis
SIGEPLSTNL

SEQ ID NO: 10308 - protein, 10 aa, Mycobacterium tuberculosis
IGEPLSTNLI

SEQ ID NO: 10309 - protein, 10 aa, Mycobacterium tuberculosis
GEPLSTNLIE

SEQ ID NO: 10310 - protein, 10 aa, Mycobacterium tuberculosis
EPLSTNLIER

SEQ ID NO: 10311 - protein, 10 aa, Mycobacterium tuberculosis
PLSTNLIERY

SEQ ID NO: 10312 - protein, 10 aa, Mycobacterium tuberculosis
LSTNLIERYL

SEQ ID NO: 10313 - protein, 10 aa, Mycobacterium tuberculosis
STNLIERYLR

SEQ ID NO: 10314 - protein, 10 aa, Mycobacterium tuberculosis
TNLIERYLRA

SEQ ID NO: 10315 - protein, 10 aa, Mycobacterium tuberculosis
NLIERYLRAR

SEQ ID NO: 10316 - protein, 10 aa, Mycobacterium tuberculosis
LIERYLRARG

SEQ ID NO: 10317 - protein, 10 aa, Mycobacterium tuberculosis
IERYLRARGR

SEQ ID NO: 10318 - protein, 10 aa, Mycobacterium tuberculosis
ERYLRARGRR

SEQ ID NO: 10319 - protein, 10 aa, Mycobacterium tuberculosis
RYLRARGRRY

SEQ ID NO: 10320 - protein, 10 aa, Mycobacterium tuberculosis
YLRARGRRYF

SEQ ID NO: 10321 - protein, 10 aa, Mycobacterium tuberculosis
LRARGRRYFR

SEQ ID NO: 10322 - protein, 10 aa, Mycobacterium tuberculosis
RARGRRYFRG

SEQ ID NO: 10323 - protein, 10 aa, Mycobacterium tuberculosis
ARGRRYFRGH

SEQ ID NO: 10324 - protein, 10 aa, Mycobacterium tuberculosis
RGRRYFRGHH

SEQ ID NO: 10325 - protein, 10 aa, Mycobacterium tuberculosis
GRRYFRGHHD

SEQ ID NO: 10326 - protein, 10 aa, Mycobacterium tuberculosis
RRYFRGHHDA

SEQ ID NO: 10327 - protein, 10 aa, Mycobacterium tuberculosis
RYFRGHHDAE

SEQ ID NO: 10328 - protein, 10 aa, Mycobacterium tuberculosis
YFRGHHDAEF

SEQ ID NO: 10329 - protein, 10 aa, Mycobacterium tuberculosis
FRGHHDAEFF

SEQ ID NO: 10330 - protein, 10 aa, Mycobacterium tuberculosis
RGHHDAEFFF

SEQ ID NO: 10331 - protein, 10 aa, Mycobacterium tuberculosis
GHHDAEFFFV

SEQ ID NO: 10332 - protein, 10 aa, Mycobacterium tuberculosis
HHDAEFFFVA

SEQ ID NO: 10333 - protein, 10 aa, Mycobacterium tuberculosis
HDAEFFFVAN

SEQ ID NO: 10334 - protein, 10 aa, Mycobacterium tuberculosis
DAEFFFVANA

SEQ ID NO: 10335 - protein, 10 aa, Mycobacterium tuberculosis
AEFFFVANAH

SEQ ID NO: 10336 - protein, 10 aa, Mycobacterium tuberculosis
EFFFVANAHL

SEQ ID NO: 10337 - protein, 10 aa, Mycobacterium tuberculosis
FFFVANAHLL

SEQ ID NO: 10338 - protein, 10 aa, Mycobacterium tuberculosis
FFVANAHLLH

SEQ ID NO: 10339 - protein, 10 aa, Mycobacterium tuberculosis
FVANAHLLHV

SEQ ID NO: 10340 - protein, 10 aa, Mycobacterium tuberculosis
VANAHLLHVH

SEQ ID NO: 10341 - protein, 10 aa, Mycobacterium tuberculosis
ANAHLLHVHL

SEQ ID NO: 10342 - protein, 10 aa, Mycobacterium tuberculosis
NAHLLHVHLE

SEQ ID NO: 10343 - protein, 10 aa, Mycobacterium tuberculosis
AHLLHVHLEI

SEQ ID NO: 10344 - protein, 10 aa, Mycobacterium tuberculosis
HLLHVHLEIS

SEQ ID NO: 10345 - protein, 10 aa, Mycobacterium tuberculosis
LLHVHLEISP

SEQ ID NO: 10346 - protein, 10 aa, Mycobacterium tuberculosis
LHVHLEISPA

SEQ ID NO: 10347 - protein, 10 aa, Mycobacterium tuberculosis
HVHLEISPAY

SEQ ID NO: 10348 - protein, 10 aa, Mycobacterium tuberculosis
VHLEISPAYR

SEQ ID NO: 10349 - protein, 10 aa, Mycobacterium tuberculosis
HLEISPAYRD

SEQ ID NO: 10350 - protein, 10 aa, Mycobacterium tuberculosis
LEISPAYRDV

SEQ ID NO: 10351 - protein, 10 aa, Mycobacterium tuberculosis
EISPAYRDVF

SEQ ID NO: 10352 - protein, 10 aa, Mycobacterium tuberculosis
ISPAYRDVFT

SEQ ID NO: 10353 - protein, 10 aa, Mycobacterium tuberculosis
SPAYRDVFTI

SEQ ID NO: 10354 - protein, 10 aa, Mycobacterium tuberculosis
PAYRDVFTIR

SEQ ID NO: 10355 - protein, 10 aa, Mycobacterium tuberculosis
AYRDVFTIRV

SEQ ID NO: 10356 - protein, 10 aa, Mycobacterium tuberculosis
YRDVFTIRVS

SEQ ID NO: 10357 - protein, 10 aa, Mycobacterium tuberculosis
RDVFTIRVSP

SEQ ID NO: 10358 - protein, 10 aa, Mycobacterium tuberculosis
DVFTIRVSPA

SEQ ID NO: 10359 - protein, 10 aa, Mycobacterium tuberculosis
VFTIRVSPAY

SEQ ID NO: 10360 - protein, 10 aa, Mycobacterium tuberculosis
FTIRVSPAYF

SEQ ID NO: 10361 - protein, 10 aa, Mycobacterium tuberculosis
TIRVSPAYFF

SEQ ID NO: 10362 - protein, 10 aa, Mycobacterium tuberculosis
IRVSPAYFFP

SEQ ID NO: 10363 - protein, 10 aa, Mycobacterium tuberculosis
RVSPAYFFPA

SEQ ID NO: 10364 - protein, 10 aa, Mycobacterium tuberculosis
VSPAYFFPAT

SEQ ID NO: 10365 - protein, 10 aa, Mycobacterium tuberculosis
SPAYFFPATD

SEQ ID NO: 10366 - protein, 10 aa, Mycobacterium tuberculosis
PAYFFPATDH

SEQ ID NO: 10367 - protein, 10 aa, Mycobacterium tuberculosis
AYFFPATDHT

SEQ ID NO: 10368 - protein, 10 aa, Mycobacterium tuberculosis
YFFPATDHTR

SEQ ID NO: 10369 - protein, 10 aa, Mycobacterium tuberculosis
FFPATDHTRL

SEQ ID NO: 10370 - protein, 10 aa, Mycobacterium tuberculosis
FPATDHTRLA

SEQ ID NO: 10371 - protein, 10 aa, Mycobacterium tuberculosis
PATDHTRLAE

SEQ ID NO: 10372 - protein, 10 aa, Mycobacterium tuberculosis
ATDHTRLAEI

SEQ ID NO: 10373 - protein, 10 aa, Mycobacterium tuberculosis
TDHTRLAEIV

SEQ ID NO: 10374 - protein, 10 aa, Mycobacterium tuberculosis
DHTRLAEIVN

SEQ ID NO: 10375 - protein, 10 aa, Mycobacterium tuberculosis
HTRLAEIVNA

SEQ ID NO: 10376 - protein, 10 aa, Mycobacterium tuberculosis
TRLAEIVNAW

SEQ ID NO: 10377 - protein, 10 aa, Mycobacterium tuberculosis
RLAEIVNAWN

SEQ ID NO: 10378 - protein, 10 aa, Mycobacterium tuberculosis
LAEIVNAWNL

SEQ ID NO: 10379 - protein, 10 aa, Mycobacterium tuberculosis
AEIVNAWNLQ

SEQ ID NO: 10380 - protein, 10 aa, Mycobacterium tuberculosis
EIVNAWNLQN

SEQ ID NO: 10381 - protein, 10 aa, Mycobacterium tuberculosis
IVNAWNLQNH

SEQ ID NO: 10382 - protein, 10 aa, Mycobacterium tuberculosis
VNAWNLQNHE

SEQ ID NO: 10383 - protein, 10 aa, Mycobacterium tuberculosis
NAWNLQNHEV

SEQ ID NO: 10384 - protein, 10 aa, Mycobacterium tuberculosis
AWNLQNHEVT

SEQ ID NO: 10385 - protein, 10 aa, Mycobacterium tuberculosis
WNLQNHEVTA

SEQ ID NO: 10386 - protein, 10 aa, Mycobacterium tuberculosis
NLQNHEVTAI

SEQ ID NO: 10387 - protein, 10 aa, Mycobacterium tuberculosis
LQNHEVTAIV

SEQ ID NO: 10388 - protein, 10 aa, Mycobacterium tuberculosis
QNHEVTAIVH

SEQ ID NO: 10389 - protein, 10 aa, Mycobacterium tuberculosis
NHEVTAIVHG

SEQ ID NO: 10390 - protein, 10 aa, Mycobacterium tuberculosis
HEVTAIVHGS

SEQ ID NO: 10391 - protein, 10 aa, Mycobacterium tuberculosis
EVTAIVHGSS

SEQ ID NO: 10392 - protein, 10 aa, Mycobacterium tuberculosis
VTAIVHGSSD

SEQ ID NO: 10393 - protein, 10 aa, Mycobacterium tuberculosis
TAIVHGSSDP

SEQ ID NO: 10394 - protein, 10 aa, Mycobacterium tuberculosis
AIVHGSSDPH

SEQ ID NO: 10395 - protein, 10 aa, Mycobacterium tuberculosis
IVHGSSDPHR

SEQ ID NO: 10396 - protein, 10 aa, Mycobacterium tuberculosis
VHGSSDPHRI

SEQ ID NO: 10397 - protein, 10 aa, Mycobacterium tuberculosis
HGSSDPHRIG

SEQ ID NO: 10398 - protein, 10 aa, Mycobacterium tuberculosis
GSSDPHRIGV

SEQ ID NO: 10399 - protein, 10 aa, Mycobacterium tuberculosis
SSDPHRIGVA

SEQ ID NO: 10400 - protein, 10 aa, Mycobacterium tuberculosis
SDPHRIGVAA

SEQ ID NO: 10401 - protein, 10 aa, Mycobacterium tuberculosis
DPHRIGVAAE

SEQ ID NO: 10402 - protein, 10 aa, Mycobacterium tuberculosis
PHRIGVAAER

SEQ ID NO: 10403 - protein, 10 aa, Mycobacterium tuberculosis
HRIGVAAERS

SEQ ID NO: 10404 - protein, 10 aa, Mycobacterium tuberculosis
RIGVAAERSL

SEQ ID NO: 10405 - protein, 10 aa, Mycobacterium tuberculosis
IGVAAERSLI

SEQ ID NO: 10406 - protein, 10 aa, Mycobacterium tuberculosis
GVAAERSLIR

SEQ ID NO: 10407 - protein, 10 aa, Mycobacterium tuberculosis
VAAERSLIRD

SEQ ID NO: 10408 - protein, 10 aa, Mycobacterium tuberculosis
AAERSLIRDR

SEQ ID NO: 10409 - protein, 10 aa, Mycobacterium tuberculosis
AERSLIRDRI

SEQ ID NO: 10410 - protein, 10 aa, Mycobacterium tuberculosis
ERSLIRDRIR

SEQ ID NO: 10411 - protein, 10 aa, Mycobacterium tuberculosis
RSLIRDRIRF

SEQ ID NO: 10412 - protein, 10 aa, Mycobacterium tuberculosis
SLIRDRIRFD

SEQ ID NO: 10413 - protein, 10 aa, Mycobacterium tuberculosis
LIRDRIRFDD

SEQ ID NO: 10414 - protein, 10 aa, Mycobacterium tuberculosis
IRDRIRFDDF

SEQ ID NO: 10415 - protein, 10 aa, Mycobacterium tuberculosis
RDRIRFDDFA

SEQ ID NO: 10416 - protein, 10 aa, Mycobacterium tuberculosis
DRIRFDDFAT

SEQ ID NO: 10417 - protein, 10 aa, Mycobacterium tuberculosis
RIRFDDFATF

SEQ ID NO: 10418 - protein, 10 aa, Mycobacterium tuberculosis
IRFDDFATFV

SEQ ID NO: 10419 - protein, 10 aa, Mycobacterium tuberculosis
RFDDFATFVD

SEQ ID NO: 10420 - protein, 10 aa, Mycobacterium tuberculosis
FDDFATFVDN

SEQ ID NO: 10421 - protein, 10 aa, Mycobacterium tuberculosis
DDFATFVDNA

SEQ ID NO: 10422 - protein, 10 aa, Mycobacterium tuberculosis
DFATFVDNAV

SEQ ID NO: 10423 - protein, 10 aa, Mycobacterium tuberculosis
FATFVDNAVS

SEQ ID NO: 10424 - protein, 10 aa, Mycobacterium tuberculosis
ATFVDNAVSA

SEQ ID NO: 10425 - protein, 10 aa, Mycobacterium tuberculosis
TFVDNAVSAA

SEQ ID NO: 10426 - protein, 10 aa, Mycobacterium tuberculosis
FVDNAVSAAT

SEQ ID NO: 10427 - protein, 10 aa, Mycobacterium tuberculosis
VDNAVSAATE

SEQ ID NO: 10428 - protein, 10 aa, Mycobacterium tuberculosis
DNAVSAATEL

SEQ ID NO: 10429 - protein, 10 aa, Mycobacterium tuberculosis
NAVSAATELF

SEQ ID NO: 10430 - protein, 10 aa, Mycobacterium tuberculosis
AVSAATELFG

SEQ ID NO: 10431 - protein, 10 aa, Mycobacterium tuberculosis
VSAATELFGQ

SEQ ID NO: 10432 - protein, 10 aa, Mycobacterium tuberculosis
SAATELFGQL

SEQ ID NO: 10433 - protein, 10 aa, Mycobacterium tuberculosis
AATELFGQLT

SEQ ID NO: 10434 - protein, 10 aa, Mycobacterium tuberculosis
ATELFGQLTA

SEQ ID NO: 10435 - protein, 10 aa, Mycobacterium tuberculosis
TELFGQLTAA

SEQ ID NO: 10436 - protein, 10 aa, Mycobacterium tuberculosis
ELFGQLTAAG

SEQ ID NO: 10437 - protein, 10 aa, Mycobacterium tuberculosis
LFGQLTAAGL

SEQ ID NO: 10438 - protein, 10 aa, Mycobacterium tuberculosis
FGQLTAAGLP

SEQ ID NO: 10439 - protein, 10 aa, Mycobacterium tuberculosis
GQLTAAGLPP

SEQ ID NO: 10440 - protein, 10 aa, Mycobacterium tuberculosis
QLTAAGLPPT

SEQ ID NO: 10441 - protein, 10 aa, Mycobacterium tuberculosis
LTAAGLPPTA

SEQ ID NO: 10442 - protein, 10 aa, Mycobacterium tuberculosis
TAAGLPPTAT

SEQ ID NO: 10443 - protein, 10 aa, Mycobacterium tuberculosis
AAGLPPTATP

SEQ ID NO: 10444 - protein, 10 aa, Mycobacterium tuberculosis
AGLPPTATPP

SEQ ID NO: 10445 - protein, 10 aa, Mycobacterium tuberculosis
GLPPTATPPL

SEQ ID NO: 10446 - protein, 10 aa, Mycobacterium tuberculosis
LPPTATPPLL

SEQ ID NO: 10447 - protein, 10 aa, Mycobacterium tuberculosis
PPTATPPLLR

SEQ ID NO: 10448 - protein, 10 aa, Mycobacterium tuberculosis
PTATPPLLRD

SEQ ID NO: 10449 - protein, 10 aa, Mycobacterium tuberculosis
TATPPLLRDA

SEQ ID NO: 10450 - protein, 10 aa, Mycobacterium tuberculosis
ATPPLLRDAG

SEQ ID NO: 10451 - protein, 11 aa, Mycobacterium tuberculosis
MSRRAIHSGRA

SEQ ID NO: 10452 - protein, 11 aa, Mycobacterium tuberculosis
SRRAIHSGRAA

SEQ ID NO: 10453 - protein, 11 aa, Mycobacterium tuberculosis
RRAIHSGRAAP

SEQ ID NO: 10454 - protein, 11 aa, Mycobacterium tuberculosis
RAIHSGRAAPR

SEQ ID NO: 10455 - protein, 11 aa, Mycobacterium tuberculosis
AIHSGRAAPRR

SEQ ID NO: 10456 - protein, 11 aa, Mycobacterium tuberculosis
IHSGRAAPRRS

SEQ ID NO: 10457 - protein, 11 aa, Mycobacterium tuberculosis
HSGRAAPRRSG

SEQ ID NO: 10458 - protein, 11 aa, Mycobacterium tuberculosis
SGRAAPRRSGN

SEQ ID NO: 10459 - protein, 11 aa, Mycobacterium tuberculosis
GRAAPRRSGNS

SEQ ID NO: 10460 - protein, 11 aa, Mycobacterium tuberculosis
RAAPRRSGNSH

SEQ ID NO: 10461 - protein, 11 aa, Mycobacterium tuberculosis
AAPRRSGNSHL

SEQ ID NO: 10462 - protein, 11 aa, Mycobacterium tuberculosis
APRRSGNSHLV

SEQ ID NO: 10463 - protein, 11 aa, Mycobacterium tuberculosis
PRRSGNSHLVL

SEQ ID NO: 10464 - protein, 11 aa, Mycobacterium tuberculosis
RRSGNSHLVLR

SEQ ID NO: 10465 - protein, 11 aa, Mycobacterium tuberculosis
RSGNSHLVLRN

SEQ ID NO: 10466 - protein, 11 aa, Mycobacterium tuberculosis
SGNSHLVLRNR

SEQ ID NO: 10467 - protein, 11 aa, Mycobacterium tuberculosis
GNSHLVLRNRV

SEQ ID NO: 10468 - protein, 11 aa, Mycobacterium tuberculosis
NSHLVLRNRVP

SEQ ID NO: 10469 - protein, 11 aa, Mycobacterium tuberculosis
SHLVLRNRVPS

SEQ ID NO: 10470 - protein, 11 aa, Mycobacterium tuberculosis
HLVLRNRVPSS

SEQ ID NO: 10471 - protein, 11 aa, Mycobacterium tuberculosis
LVLRNRVPSSK

SEQ ID NO: 10472 - protein, 11 aa, Mycobacterium tuberculosis
VLRNRVPSSKD

SEQ ID NO: 10473 - protein, 11 aa, Mycobacterium tuberculosis
LRNRVPSSKDS

SEQ ID NO: 10474 - protein, 11 aa, Mycobacterium tuberculosis
RNRVPSSKDSP

SEQ ID NO: 10475 - protein, 11 aa, Mycobacterium tuberculosis
NRVPSSKDSPR

SEQ ID NO: 10476 - protein, 11 aa, Mycobacterium tuberculosis
RVPSSKDSPRR

SEQ ID NO: 10477 - protein, 11 aa, Mycobacterium tuberculosis
VPSSKDSPRRR

SEQ ID NO: 10478 - protein, 11 aa, Mycobacterium tuberculosis
PSSKDSPRRRP

SEQ ID NO: 10479 - protein, 11 aa, Mycobacterium tuberculosis
SSKDSPRRRPH

SEQ ID NO: 10480 - protein, 11 aa, Mycobacterium tuberculosis
SKDSPRRRPHH

SEQ ID NO: 10481 - protein, 11 aa, Mycobacterium tuberculosis
KDSPRRRPHHE

SEQ ID NO: 10482 - protein, 11 aa, Mycobacterium tuberculosis
DSPRRRPHHEF

SEQ ID NO: 10483 - protein, 11 aa, Mycobacterium tuberculosis
SPRRRPHHEFM

SEQ ID NO: 10484 - protein, 11 aa, Mycobacterium tuberculosis
PRRRPHHEFMT

SEQ ID NO: 10485 - protein, 11 aa, Mycobacterium tuberculosis
RRRPHHEFMTE

SEQ ID NO: 10486 - protein, 11 aa, Mycobacterium tuberculosis
RRPHHEFMTES

SEQ ID NO: 10487 - protein, 11 aa, Mycobacterium tuberculosis
RPHHEFMTESI

SEQ ID NO: 10488 - protein, 11 aa, Mycobacterium tuberculosis
PHHEFMTESIG

SEQ ID NO: 10489 - protein, 11 aa, Mycobacterium tuberculosis
HHEFMTESIGE

SEQ ID NO: 10490 - protein, 11 aa, Mycobacterium tuberculosis
HEFMTESIGEP

SEQ ID NO: 10491 - protein, 11 aa, Mycobacterium tuberculosis
EFMTESIGEPL

SEQ ID NO: 10492 - protein, 11 aa, Mycobacterium tuberculosis
FMTESIGEPLS

SEQ ID NO: 10493 - protein, 11 aa, Mycobacterium tuberculosis
MTESIGEPLST

SEQ ID NO: 10494 - protein, 11 aa, Mycobacterium tuberculosis
TESIGEPLSTN

SEQ ID NO: 10495 - protein, 11 aa, Mycobacterium tuberculosis
ESIGEPLSTNL

SEQ ID NO: 10496 - protein, 11 aa, Mycobacterium tuberculosis
SIGEPLSTNLI

SEQ ID NO: 10497 - protein, 11 aa, Mycobacterium tuberculosis
IGEPLSTNLIE

SEQ ID NO: 10498 - protein, 11 aa, Mycobacterium tuberculosis
GEPLSTNLIER

SEQ ID NO: 10499 - protein, 11 aa, Mycobacterium tuberculosis
EPLSTNLIERY

SEQ ID NO: 10500 - protein, 11 aa, Mycobacterium tuberculosis
PLSTNLIERYL

SEQ ID NO: 10501 - protein, 11 aa, Mycobacterium tuberculosis
LSTNLIERYLR

SEQ ID NO: 10502 - protein, 11 aa, Mycobacterium tuberculosis
STNLIERYLRA

SEQ ID NO: 10503 - protein, 11 aa, Mycobacterium tuberculosis
TNLIERYLRAR

SEQ ID NO: 10504 - protein, 11 aa, Mycobacterium tuberculosis
NLIERYLRARG

SEQ ID NO: 10505 - protein, 11 aa, Mycobacterium tuberculosis
LIERYLRARGR

SEQ ID NO: 10506 - protein, 11 aa, Mycobacterium tuberculosis
IERYLRARGRR

SEQ ID NO: 10507 - protein, 11 aa, Mycobacterium tuberculosis
ERYLRARGRRY

SEQ ID NO: 10508 - protein, 11 aa, Mycobacterium tuberculosis
RYLRARGRRYF

SEQ ID NO: 10509 - protein, 11 aa, Mycobacterium tuberculosis
YLRARGRRYFR

SEQ ID NO: 10510 - protein, 11 aa, Mycobacterium tuberculosis
LRARGRRYFRG

SEQ ID NO: 10511 - protein, 11 aa, Mycobacterium tuberculosis
RARGRRYFRGH

SEQ ID NO: 10512 - protein, 11 aa, Mycobacterium tuberculosis
ARGRRYFRGHH

SEQ ID NO: 10513 - protein, 11 aa, Mycobacterium tuberculosis
RGRRYFRGHHD

SEQ ID NO: 10514 - protein, 11 aa, Mycobacterium tuberculosis
GRRYFRGHHDA

SEQ ID NO: 10515 - protein, 11 aa, Mycobacterium tuberculosis
RRYFRGHHDAE

SEQ ID NO: 10516 - protein, 11 aa, Mycobacterium tuberculosis
RYFRGHHDAEF

SEQ ID NO: 10517 - protein, 11 aa, Mycobacterium tuberculosis
YFRGHHDAEFF

SEQ ID NO: 10518 - protein, 11 aa, Mycobacterium tuberculosis
FRGHHDAEFFF

SEQ ID NO: 10519 - protein, 11 aa, Mycobacterium tuberculosis
RGHHDAEFFFV

SEQ ID NO: 10520 - protein, 11 aa, Mycobacterium tuberculosis
GHHDAEFFFVA

SEQ ID NO: 10521 - protein, 11 aa, Mycobacterium tuberculosis
HHDAEFFFVAN

SEQ ID NO: 10522 - protein, 11 aa, Mycobacterium tuberculosis
HDAEFFFVANA

SEQ ID NO: 10523 - protein, 11 aa, Mycobacterium tuberculosis
DAEFFFVANAH

SEQ ID NO: 10524 - protein, 11 aa, Mycobacterium tuberculosis
AEFFFVANAHL

SEQ ID NO: 10525 - protein, 11 aa, Mycobacterium tuberculosis
EFFFVANAHLL

SEQ ID NO: 10526 - protein, 11 aa, Mycobacterium tuberculosis
FFFVANAHLLH

SEQ ID NO: 10527 - protein, 11 aa, Mycobacterium tuberculosis
FFVANAHLLHV

SEQ ID NO: 10528 - protein, 11 aa, Mycobacterium tuberculosis
FVANAHLLHVH

SEQ ID NO: 10529 - protein, 11 aa, Mycobacterium tuberculosis
VANAHLLHVHL

SEQ ID NO: 10530 - protein, 11 aa, Mycobacterium tuberculosis
ANAHLLHVHLE

SEQ ID NO: 10531 - protein, 11 aa, Mycobacterium tuberculosis
NAHLLHVHLEI

SEQ ID NO: 10532 - protein, 11 aa, Mycobacterium tuberculosis
AHLLHVHLEIS

SEQ ID NO: 10533 - protein, 11 aa, Mycobacterium tuberculosis
HLLHVHLEISP

SEQ ID NO: 10534 - protein, 11 aa, Mycobacterium tuberculosis
LLHVHLEISPA

SEQ ID NO: 10535 - protein, 11 aa, Mycobacterium tuberculosis
LHVHLEISPAY

SEQ ID NO: 10536 - protein, 11 aa, Mycobacterium tuberculosis
HVHLEISPAYR

SEQ ID NO: 10537 - protein, 11 aa, Mycobacterium tuberculosis
VHLEISPAYRD

SEQ ID NO: 10538 - protein, 11 aa, Mycobacterium tuberculosis
HLEISPAYRDV

SEQ ID NO: 10539 - protein, 11 aa, Mycobacterium tuberculosis
LEISPAYRDVF

SEQ ID NO: 10540 - protein, 11 aa, Mycobacterium tuberculosis
EISPAYRDVFT

SEQ ID NO: 10541 - protein, 11 aa, Mycobacterium tuberculosis
ISPAYRDVFTI

SEQ ID NO: 10542 - protein, 11 aa, Mycobacterium tuberculosis
SPAYRDVFTIR

SEQ ID NO: 10543 - protein, 11 aa, Mycobacterium tuberculosis
PAYRDVFTIRV

SEQ ID NO: 10544 - protein, 11 aa, Mycobacterium tuberculosis
AYRDVFTIRVS

SEQ ID NO: 10545 - protein, 11 aa, Mycobacterium tuberculosis
YRDVFTIRVSP

SEQ ID NO: 10546 - protein, 11 aa, Mycobacterium tuberculosis
RDVFTIRVSPA

SEQ ID NO: 10547 - protein, 11 aa, Mycobacterium tuberculosis
DVFTIRVSPAY

SEQ ID NO: 10548 - protein, 11 aa, Mycobacterium tuberculosis
VFTIRVSPAYF

SEQ ID NO: 10549 - protein, 11 aa, Mycobacterium tuberculosis
FTIRVSPAYFF

SEQ ID NO: 10550 - protein, 11 aa, Mycobacterium tuberculosis
TIRVSPAYFFP

SEQ ID NO: 10551 - protein, 11 aa, Mycobacterium tuberculosis
IRVSPAYFFPA

SEQ ID NO: 10552 - protein, 11 aa, Mycobacterium tuberculosis
RVSPAYFFPAT

SEQ ID NO: 10553 - protein, 11 aa, Mycobacterium tuberculosis
VSPAYFFPATD

SEQ ID NO: 10554 - protein, 11 aa, Mycobacterium tuberculosis
SPAYFFPATDH

SEQ ID NO: 10555 - protein, 11 aa, Mycobacterium tuberculosis
PAYFFPATDHT

SEQ ID NO: 10556 - protein, 11 aa, Mycobacterium tuberculosis
AYFFPATDHTR

SEQ ID NO: 10557 - protein, 11 aa, Mycobacterium tuberculosis
YFFPATDHTRL

SEQ ID NO: 10558 - protein, 11 aa, Mycobacterium tuberculosis
FFPATDHTRLA

SEQ ID NO: 10559 - protein, 11 aa, Mycobacterium tuberculosis
FPATDHTRLAE

SEQ ID NO: 10560 - protein, 11 aa, Mycobacterium tuberculosis
PATDHTRLAEI

SEQ ID NO: 10561 - protein, 11 aa, Mycobacterium tuberculosis
ATDHTRLAEIV

SEQ ID NO: 10562 - protein, 11 aa, Mycobacterium tuberculosis
TDHTRLAEIVN

SEQ ID NO: 10563 - protein, 11 aa, Mycobacterium tuberculosis
DHTRLAEIVNA

SEQ ID NO: 10564 - protein, 11 aa, Mycobacterium tuberculosis
HTRLAEIVNAW

SEQ ID NO: 10565 - protein, 11 aa, Mycobacterium tuberculosis
TRLAEIVNAWN

SEQ ID NO: 10566 - protein, 11 aa, Mycobacterium tuberculosis
RLAEIVNAWNL

SEQ ID NO: 10567 - protein, 11 aa, Mycobacterium tuberculosis
LAEIVNAWNLQ

SEQ ID NO: 10568 - protein, 11 aa, Mycobacterium tuberculosis
AEIVNAWNLQN

SEQ ID NO: 10569 - protein, 11 aa, Mycobacterium tuberculosis
EIVNAWNLQNH

SEQ ID NO: 10570 - protein, 11 aa, Mycobacterium tuberculosis
IVNAWNLQNHE

SEQ ID NO: 10571 - protein, 11 aa, Mycobacterium tuberculosis
VNAWNLQNHEV

SEQ ID NO: 10572 - protein, 11 aa, Mycobacterium tuberculosis
NAWNLQNHEVT

SEQ ID NO: 10573 - protein, 11 aa, Mycobacterium tuberculosis
AWNLQNHEVTA

SEQ ID NO: 10574 - protein, 11 aa, Mycobacterium tuberculosis
WNLQNHEVTAI

SEQ ID NO: 10575 - protein, 11 aa, Mycobacterium tuberculosis
NLQNHEVTAIV

SEQ ID NO: 10576 - protein, 11 aa, Mycobacterium tuberculosis
LQNHEVTAIVH

SEQ ID NO: 10577 - protein, 11 aa, Mycobacterium tuberculosis
QNHEVTAIVHG

SEQ ID NO: 10578 - protein, 11 aa, Mycobacterium tuberculosis
NHEVTAIVHGS

SEQ ID NO: 10579 - protein, 11 aa, Mycobacterium tuberculosis
HEVTAIVHGSS

SEQ ID NO: 10580 - protein, 11 aa, Mycobacterium tuberculosis
EVTAIVHGSSD

SEQ ID NO: 10581 - protein, 11 aa, Mycobacterium tuberculosis
VTAIVHGSSDP

SEQ ID NO: 10582 - protein, 11 aa, Mycobacterium tuberculosis
TAIVHGSSDPH

SEQ ID NO: 10583 - protein, 11 aa, Mycobacterium tuberculosis
AIVHGSSDPHR

SEQ ID NO: 10584 - protein, 11 aa, Mycobacterium tuberculosis
IVHGSSDPHRI

SEQ ID NO: 10585 - protein, 11 aa, Mycobacterium tuberculosis
VHGSSDPHRIG

SEQ ID NO: 10586 - protein, 11 aa, Mycobacterium tuberculosis
HGSSDPHRIGV

SEQ ID NO: 10587 - protein, 11 aa, Mycobacterium tuberculosis
GSSDPHRIGVA

SEQ ID NO: 10588 - protein, 11 aa, Mycobacterium tuberculosis
SSDPHRIGVAA

SEQ ID NO: 10589 - protein, 11 aa, Mycobacterium tuberculosis
SDPHRIGVAAE

SEQ ID NO: 10590 - protein, 11 aa, Mycobacterium tuberculosis
DPHRIGVAAER

SEQ ID NO: 10591 - protein, 11 aa, Mycobacterium tuberculosis
PHRIGVAAERS

SEQ ID NO: 10592 - protein, 11 aa, Mycobacterium tuberculosis
HRIGVAAERSL

SEQ ID NO: 10593 - protein, 11 aa, Mycobacterium tuberculosis
RIGVAAERSLI

SEQ ID NO: 10594 - protein, 11 aa, Mycobacterium tuberculosis
IGVAAERSLIR

SEQ ID NO: 10595 - protein, 11 aa, Mycobacterium tuberculosis
GVAAERSLIRD

SEQ ID NO: 10596 - protein, 11 aa, Mycobacterium tuberculosis
VAAERSLIRDR

SEQ ID NO: 10597 - protein, 11 aa, Mycobacterium tuberculosis
AAERSLIRDRI

SEQ ID NO: 10598 - protein, 11 aa, Mycobacterium tuberculosis
AERSLIRDRIR

SEQ ID NO: 10599 - protein, 11 aa, Mycobacterium tuberculosis
ERSLIRDRIRF

SEQ ID NO: 10600 - protein, 11 aa, Mycobacterium tuberculosis
RSLIRDRIRFD

SEQ ID NO: 10601 - protein, 11 aa, Mycobacterium tuberculosis
SLIRDRIRFDD

SEQ ID NO: 10602 - protein, 11 aa, Mycobacterium tuberculosis
LIRDRIRFDDF

SEQ ID NO: 10603 - protein, 11 aa, Mycobacterium tuberculosis
IRDRIRFDDFA

SEQ ID NO: 10604 - protein, 11 aa, Mycobacterium tuberculosis
RDRIRFDDFAT

SEQ ID NO: 10605 - protein, 11 aa, Mycobacterium tuberculosis
DRIRFDDFATF

SEQ ID NO: 10606 - protein, 11 aa, Mycobacterium tuberculosis
RIRFDDFATFV

SEQ ID NO: 10607 - protein, 11 aa, Mycobacterium tuberculosis
IRFDDFATFVD

SEQ ID NO: 10608 - protein, 11 aa, Mycobacterium tuberculosis
RFDDFATFVDN

SEQ ID NO: 10609 - protein, 11 aa, Mycobacterium tuberculosis
FDDFATFVDNA

SEQ ID NO: 10610 - protein, 11 aa, Mycobacterium tuberculosis
DDFATFVDNAV

SEQ ID NO: 10611 - protein, 11 aa, Mycobacterium tuberculosis
DFATFVDNAVS

SEQ ID NO: 10612 - protein, 11 aa, Mycobacterium tuberculosis
FATFVDNAVSA

SEQ ID NO: 10613 - protein, 11 aa, Mycobacterium tuberculosis
ATFVDNAVSAA

SEQ ID NO: 10614 - protein, 11 aa, Mycobacterium tuberculosis
TFVDNAVSAAT

SEQ ID NO: 10615 - protein, 11 aa, Mycobacterium tuberculosis
FVDNAVSAATE

SEQ ID NO: 10616 - protein, 11 aa, Mycobacterium tuberculosis
VDNAVSAATEL

SEQ ID NO: 10617 - protein, 11 aa, Mycobacterium tuberculosis
DNAVSAATELF

SEQ ID NO: 10618 - protein, 11 aa, Mycobacterium tuberculosis
NAVSAATELFG

SEQ ID NO: 10619 - protein, 11 aa, Mycobacterium tuberculosis
AVSAATELFGQ

SEQ ID NO: 10620 - protein, 11 aa, Mycobacterium tuberculosis
VSAATELFGQL

SEQ ID NO: 10621 - protein, 11 aa, Mycobacterium tuberculosis
SAATELFGQLT

SEQ ID NO: 10622 - protein, 11 aa, Mycobacterium tuberculosis
AATELFGQLTA

SEQ ID NO: 10623 - protein, 11 aa, Mycobacterium tuberculosis
ATELFGQLTAA

SEQ ID NO: 10624 - protein, 11 aa, Mycobacterium tuberculosis
TELFGQLTAAG

SEQ ID NO: 10625 - protein, 11 aa, Mycobacterium tuberculosis
ELFGQLTAAGL

SEQ ID NO: 10626 - protein, 11 aa, Mycobacterium tuberculosis
LFGQLTAAGLP

SEQ ID NO: 10627 - protein, 11 aa, Mycobacterium tuberculosis
FGQLTAAGLPP

SEQ ID NO: 10628 - protein, 11 aa, Mycobacterium tuberculosis
GQLTAAGLPPT

SEQ ID NO: 10629 - protein, 11 aa, Mycobacterium tuberculosis
QLTAAGLPPTA

SEQ ID NO: 10630 - protein, 11 aa, Mycobacterium tuberculosis
LTAAGLPPTAT

SEQ ID NO: 10631 - protein, 11 aa, Mycobacterium tuberculosis
TAAGLPPTATP

SEQ ID NO: 10632 - protein, 11 aa, Mycobacterium tuberculosis
AAGLPPTATPP

SEQ ID NO: 10633 - protein, 11 aa, Mycobacterium tuberculosis
AGLPPTATPPL

SEQ ID NO: 10634 - protein, 11 aa, Mycobacterium tuberculosis
GLPPTATPPLL

SEQ ID NO: 10635 - protein, 11 aa, Mycobacterium tuberculosis
LPPTATPPLLR

SEQ ID NO: 10636 - protein, 11 aa, Mycobacterium tuberculosis
PPTATPPLLRD

SEQ ID NO: 10637 - protein, 11 aa, Mycobacterium tuberculosis
PTATPPLLRDA

SEQ ID NO: 10638 - protein, 11 aa, Mycobacterium tuberculosis
TATPPLLRDAG

SEQ ID NO: 10639 - protein, 8 aa, Mycobacterium tuberculosis
MHRAGAAV

SEQ ID NO: 10640 - protein, 8 aa, Mycobacterium tuberculosis
HRAGAAVT

SEQ ID NO: 10641 - protein, 8 aa, Mycobacterium tuberculosis
RAGAAVTA

SEQ ID NO: 10642 - protein, 8 aa, Mycobacterium tuberculosis
AGAAVTAN

SEQ ID NO: 10643 - protein, 8 aa, Mycobacterium tuberculosis
GAAVTANV

SEQ ID NO: 10644 - protein, 8 aa, Mycobacterium tuberculosis
AAVTANVW

SEQ ID NO: 10645 - protein, 8 aa, Mycobacterium tuberculosis
AVTANVWC

SEQ ID NO: 10646 - protein, 8 aa, Mycobacterium tuberculosis
VTANVWCR

SEQ ID NO: 10647 - protein, 8 aa, Mycobacterium tuberculosis
TANVWCRA

SEQ ID NO: 10648 - protein, 8 aa, Mycobacterium tuberculosis
ANVWCRAG

SEQ ID NO: 10649 - protein, 8 aa, Mycobacterium tuberculosis
NVWCRAGG

SEQ ID NO: 10650 - protein, 8 aa, Mycobacterium tuberculosis
VWCRAGGI

SEQ ID NO: 10651 - protein, 8 aa, Mycobacterium tuberculosis
WCRAGGIR

SEQ ID NO: 10652 - protein, 8 aa, Mycobacterium tuberculosis
CRAGGIRM

SEQ ID NO: 10653 - protein, 8 aa, Mycobacterium tuberculosis
RAGGIRMA

SEQ ID NO: 10654 - protein, 8 aa, Mycobacterium tuberculosis
AGGIRMAP

SEQ ID NO: 10655 - protein, 8 aa, Mycobacterium tuberculosis
GGIRMAPR

SEQ ID NO: 10656 - protein, 8 aa, Mycobacterium tuberculosis
GIRMAPRP

SEQ ID NO: 10657 - protein, 8 aa, Mycobacterium tuberculosis
IRMAPRPV

SEQ ID NO: 10658 - protein, 8 aa, Mycobacterium tuberculosis
RMAPRPVI

SEQ ID NO: 10659 - protein, 8 aa, Mycobacterium tuberculosis
MAPRPVIP

SEQ ID NO: 10660 - protein, 8 aa, Mycobacterium tuberculosis
APRPVIPV

SEQ ID NO: 10661 - protein, 8 aa, Mycobacterium tuberculosis
PRPVIPVA

SEQ ID NO: 10662 - protein, 8 aa, Mycobacterium tuberculosis
RPVIPVAT

SEQ ID NO: 10663 - protein, 8 aa, Mycobacterium tuberculosis
PVIPVATQ

SEQ ID NO: 10664 - protein, 8 aa, Mycobacterium tuberculosis
VIPVATQQ

SEQ ID NO: 10665 - protein, 8 aa, Mycobacterium tuberculosis
IPVATQQR

SEQ ID NO: 10666 - protein, 8 aa, Mycobacterium tuberculosis
PVATQQRL

SEQ ID NO: 10667 - protein, 8 aa, Mycobacterium tuberculosis
VATQQRLR

SEQ ID NO: 10668 - protein, 8 aa, Mycobacterium tuberculosis
ATQQRLRR

SEQ ID NO: 10669 - protein, 8 aa, Mycobacterium tuberculosis
TQQRLRRQ

SEQ ID NO: 10670 - protein, 8 aa, Mycobacterium tuberculosis
QQRLRRQA

SEQ ID NO: 10671 - protein, 8 aa, Mycobacterium tuberculosis
QRLRRQAD

SEQ ID NO: 10672 - protein, 8 aa, Mycobacterium tuberculosis
RLRRQADR

SEQ ID NO: 10673 - protein, 8 aa, Mycobacterium tuberculosis
LRRQADRQ

SEQ ID NO: 10674 - protein, 8 aa, Mycobacterium tuberculosis
RRQADRQS

SEQ ID NO: 10675 - protein, 8 aa, Mycobacterium tuberculosis
RQADRQSL

SEQ ID NO: 10676 - protein, 8 aa, Mycobacterium tuberculosis
QADRQSLG

SEQ ID NO: 10677 - protein, 8 aa, Mycobacterium tuberculosis
ADRQSLGS

SEQ ID NO: 10678 - protein, 8 aa, Mycobacterium tuberculosis
DRQSLGSS

SEQ ID NO: 10679 - protein, 8 aa, Mycobacterium tuberculosis
RQSLGSSG

SEQ ID NO: 10680 - protein, 8 aa, Mycobacterium tuberculosis
QSLGSSGL

SEQ ID NO: 10681 - protein, 8 aa, Mycobacterium tuberculosis
SLGSSGLP

SEQ ID NO: 10682 - protein, 8 aa, Mycobacterium tuberculosis
LGSSGLPA

SEQ ID NO: 10683 - protein, 8 aa, Mycobacterium tuberculosis
GSSGLPAL

SEQ ID NO: 10684 - protein, 8 aa, Mycobacterium tuberculosis
SSGLPALN

SEQ ID NO: 10685 - protein, 8 aa, Mycobacterium tuberculosis
SGLPALNC

SEQ ID NO: 10686 - protein, 8 aa, Mycobacterium tuberculosis
GLPALNCT

SEQ ID NO: 10687 - protein, 8 aa, Mycobacterium tuberculosis
LPALNCTP

SEQ ID NO: 10688 - protein, 8 aa, Mycobacterium tuberculosis
PALNCTPI

SEQ ID NO: 10689 - protein, 8 aa, Mycobacterium tuberculosis
ALNCTPIR

SEQ ID NO: 10690 - protein, 8 aa, Mycobacterium tuberculosis
LNCTPIRH

SEQ ID NO: 10691 - protein, 8 aa, Mycobacterium tuberculosis
NCTPIRHT

SEQ ID NO: 10692 - protein, 8 aa, Mycobacterium tuberculosis
CTPIRHTI

SEQ ID NO: 10693 - protein, 8 aa, Mycobacterium tuberculosis
TPIRHTID

SEQ ID NO: 10694 - protein, 8 aa, Mycobacterium tuberculosis
PIRHTIDV

SEQ ID NO: 10695 - protein, 8 aa, Mycobacterium tuberculosis
IRHTIDVM

SEQ ID NO: 10696 - protein, 8 aa, Mycobacterium tuberculosis
RHTIDVMA

SEQ ID NO: 10697 - protein, 8 aa, Mycobacterium tuberculosis
HTIDVMAT

SEQ ID NO: 10698 - protein, 8 aa, Mycobacterium tuberculosis
TIDVMATK

SEQ ID NO: 10699 - protein, 8 aa, Mycobacterium tuberculosis
IDVMATKP

SEQ ID NO: 10700 - protein, 8 aa, Mycobacterium tuberculosis
DVMATKPE

SEQ ID NO: 10701 - protein, 8 aa, Mycobacterium tuberculosis
VMATKPER

SEQ ID NO: 10702 - protein, 8 aa, Mycobacterium tuberculosis
MATKPERK

SEQ ID NO: 10703 - protein, 8 aa, Mycobacterium tuberculosis
ATKPERKT

SEQ ID NO: 10704 - protein, 8 aa, Mycobacterium tuberculosis
TKPERKTE

SEQ ID NO: 10705 - protein, 8 aa, Mycobacterium tuberculosis
KPERKTER

SEQ ID NO: 10706 - protein, 8 aa, Mycobacterium tuberculosis
PERKTERL

SEQ ID NO: 10707 - protein, 8 aa, Mycobacterium tuberculosis
ERKTERLA

SEQ ID NO: 10708 - protein, 8 aa, Mycobacterium tuberculosis
RKTERLAA

SEQ ID NO: 10709 - protein, 8 aa, Mycobacterium tuberculosis
KTERLAAR

SEQ ID NO: 10710 - protein, 8 aa, Mycobacterium tuberculosis
TERLAARL

SEQ ID NO: 10711 - protein, 8 aa, Mycobacterium tuberculosis
ERLAARLT

SEQ ID NO: 10712 - protein, 8 aa, Mycobacterium tuberculosis
RLAARLTP

SEQ ID NO: 10713 - protein, 8 aa, Mycobacterium tuberculosis
LAARLTPE

SEQ ID NO: 10714 - protein, 8 aa, Mycobacterium tuberculosis
AARLTPEQ

SEQ ID NO: 10715 - protein, 8 aa, Mycobacterium tuberculosis
ARLTPEQD

SEQ ID NO: 10716 - protein, 8 aa, Mycobacterium tuberculosis
RLTPEQDA

SEQ ID NO: 10717 - protein, 8 aa, Mycobacterium tuberculosis
LTPEQDAL

SEQ ID NO: 10718 - protein, 8 aa, Mycobacterium tuberculosis
TPEQDALI

SEQ ID NO: 10719 - protein, 8 aa, Mycobacterium tuberculosis
PEQDALIR

SEQ ID NO: 10720 - protein, 8 aa, Mycobacterium tuberculosis
EQDALIRR

SEQ ID NO: 10721 - protein, 8 aa, Mycobacterium tuberculosis
QDALIRRA

SEQ ID NO: 10722 - protein, 8 aa, Mycobacterium tuberculosis
DALIRRAA

SEQ ID NO: 10723 - protein, 8 aa, Mycobacterium tuberculosis
ALIRRAAE

SEQ ID NO: 10724 - protein, 8 aa, Mycobacterium tuberculosis
LIRRAAEA

SEQ ID NO: 10725 - protein, 8 aa, Mycobacterium tuberculosis
IRRAAEAE

SEQ ID NO: 10726 - protein, 8 aa, Mycobacterium tuberculosis
RRAAEAEG

SEQ ID NO: 10727 - protein, 8 aa, Mycobacterium tuberculosis
RAAEAEGT

SEQ ID NO: 10728 - protein, 8 aa, Mycobacterium tuberculosis
AAEAEGTD

SEQ ID NO: 10729 - protein, 8 aa, Mycobacterium tuberculosis
AEAEGTDL

SEQ ID NO: 10730 - protein, 8 aa, Mycobacterium tuberculosis
EAEGTDLT

SEQ ID NO: 10731 - protein, 8 aa, Mycobacterium tuberculosis
AEGTDLTN

SEQ ID NO: 10732 - protein, 8 aa, Mycobacterium tuberculosis
EGTDLTNF

SEQ ID NO: 10733 - protein, 8 aa, Mycobacterium tuberculosis
GTDLTNFT

SEQ ID NO: 10734 - protein, 8 aa, Mycobacterium tuberculosis
TDLTNFTV

SEQ ID NO: 10735 - protein, 8 aa, Mycobacterium tuberculosis
DLTNFTVT

SEQ ID NO: 10736 - protein, 8 aa, Mycobacterium tuberculosis
LTNFTVTA

SEQ ID NO: 10737 - protein, 8 aa, Mycobacterium tuberculosis
TNFTVTAA

SEQ ID NO: 10738 - protein, 8 aa, Mycobacterium tuberculosis
NFTVTAAL

SEQ ID NO: 10739 - protein, 8 aa, Mycobacterium tuberculosis
FTVTAALA

SEQ ID NO: 10740 - protein, 8 aa, Mycobacterium tuberculosis
TVTAALAH

SEQ ID NO: 10741 - protein, 8 aa, Mycobacterium tuberculosis
VTAALAHA

SEQ ID NO: 10742 - protein, 8 aa, Mycobacterium tuberculosis
TAALAHAR

SEQ ID NO: 10743 - protein, 8 aa, Mycobacterium tuberculosis
AALAHARD

SEQ ID NO: 10744 - protein, 8 aa, Mycobacterium tuberculosis
ALAHARDV

SEQ ID NO: 10745 - protein, 8 aa, Mycobacterium tuberculosis
LAHARDVL

SEQ ID NO: 10746 - protein, 8 aa, Mycobacterium tuberculosis
AHARDVLA

SEQ ID NO: 10747 - protein, 8 aa, Mycobacterium tuberculosis
HARDVLAD

SEQ ID NO: 10748 - protein, 8 aa, Mycobacterium tuberculosis
ARDVLADR

SEQ ID NO: 10749 - protein, 8 aa, Mycobacterium tuberculosis
RDVLADRR

SEQ ID NO: 10750 - protein, 8 aa, Mycobacterium tuberculosis
DVLADRRL

SEQ ID NO: 10751 - protein, 8 aa, Mycobacterium tuberculosis
VLADRRLF

SEQ ID NO: 10752 - protein, 8 aa, Mycobacterium tuberculosis
LADRRLFV

SEQ ID NO: 10753 - protein, 8 aa, Mycobacterium tuberculosis
ADRRLFVL

SEQ ID NO: 10754 - protein, 8 aa, Mycobacterium tuberculosis
DRRLFVLT

SEQ ID NO: 10755 - protein, 8 aa, Mycobacterium tuberculosis
RRLFVLTD

SEQ ID NO: 10756 - protein, 8 aa, Mycobacterium tuberculosis
RLFVLTDA

SEQ ID NO: 10757 - protein, 8 aa, Mycobacterium tuberculosis
LFVLTDAA

SEQ ID NO: 10758 - protein, 8 aa, Mycobacterium tuberculosis
FVLTDAAW

SEQ ID NO: 10759 - protein, 8 aa, Mycobacterium tuberculosis
VLTDAAWT

SEQ ID NO: 10760 - protein, 8 aa, Mycobacterium tuberculosis
LTDAAWTE

SEQ ID NO: 10761 - protein, 8 aa, Mycobacterium tuberculosis
TDAAWTEF

SEQ ID NO: 10762 - protein, 8 aa, Mycobacterium tuberculosis
DAAWTEFL

SEQ ID NO: 10763 - protein, 8 aa, Mycobacterium tuberculosis
AAWTEFLA

SEQ ID NO: 10764 - protein, 8 aa, Mycobacterium tuberculosis
AWTEFLAA

SEQ ID NO: 10765 - protein, 8 aa, Mycobacterium tuberculosis
WTEFLAAL

SEQ ID NO: 10766 - protein, 8 aa, Mycobacterium tuberculosis
TEFLAALD

SEQ ID NO: 10767 - protein, 8 aa, Mycobacterium tuberculosis
EFLAALDR

SEQ ID NO: 10768 - protein, 8 aa, Mycobacterium tuberculosis
FLAALDRP

SEQ ID NO: 10769 - protein, 8 aa, Mycobacterium tuberculosis
LAALDRPV

SEQ ID NO: 10770 - protein, 8 aa, Mycobacterium tuberculosis
AALDRPVS

SEQ ID NO: 10771 - protein, 8 aa, Mycobacterium tuberculosis
ALDRPVSH

SEQ ID NO: 10772 - protein, 8 aa, Mycobacterium tuberculosis
LDRPVSHK

SEQ ID NO: 10773 - protein, 8 aa, Mycobacterium tuberculosis
DRPVSHKP

SEQ ID NO: 10774 - protein, 8 aa, Mycobacterium tuberculosis
RPVSHKPR

SEQ ID NO: 10775 - protein, 8 aa, Mycobacterium tuberculosis
PVSHKPRL

SEQ ID NO: 10776 - protein, 8 aa, Mycobacterium tuberculosis
VSHKPRLE

SEQ ID NO: 10777 - protein, 8 aa, Mycobacterium tuberculosis
SHKPRLEK

SEQ ID NO: 10778 - protein, 8 aa, Mycobacterium tuberculosis
HKPRLEKL

SEQ ID NO: 10779 - protein, 8 aa, Mycobacterium tuberculosis
KPRLEKLF

SEQ ID NO: 10780 - protein, 8 aa, Mycobacterium tuberculosis
PRLEKLFA

SEQ ID NO: 10781 - protein, 8 aa, Mycobacterium tuberculosis
RLEKLFAA

SEQ ID NO: 10782 - protein, 8 aa, Mycobacterium tuberculosis
LEKLFAAR

SEQ ID NO: 10783 - protein, 8 aa, Mycobacterium tuberculosis
EKLFAARS

SEQ ID NO: 10784 - protein, 8 aa, Mycobacterium tuberculosis
KLFAARSI

SEQ ID NO: 10785 - protein, 8 aa, Mycobacterium tuberculosis
LFAARSIF

SEQ ID NO: 10786 - protein, 8 aa, Mycobacterium tuberculosis
FAARSIFD

SEQ ID NO: 10787 - protein, 8 aa, Mycobacterium tuberculosis
AARSIFDT

SEQ ID NO: 10788 - protein, 8 aa, Mycobacterium tuberculosis
ARSIFDTE

SEQ ID NO: 10789 - protein, 8 aa, Mycobacterium tuberculosis
RSIFDTEG

SEQ ID NO: 10790 - protein, 9 aa, Mycobacterium tuberculosis
MHRAGAAVT

SEQ ID NO: 10791 - protein, 9 aa, Mycobacterium tuberculosis
HRAGAAVTA

SEQ ID NO: 10792 - protein, 9 aa, Mycobacterium tuberculosis
RAGAAVTAN

SEQ ID NO: 10793 - protein, 9 aa, Mycobacterium tuberculosis
AGAAVTANV

SEQ ID NO: 10794 - protein, 9 aa, Mycobacterium tuberculosis
GAAVTANVW

SEQ ID NO: 10795 - protein, 9 aa, Mycobacterium tuberculosis
AAVTANVWC

SEQ ID NO: 10796 - protein, 9 aa, Mycobacterium tuberculosis
AVTANVWCR

SEQ ID NO: 10797 - protein, 9 aa, Mycobacterium tuberculosis
VTANVWCRA

SEQ ID NO: 10798 - protein, 9 aa, Mycobacterium tuberculosis
TANVWCRAG

SEQ ID NO: 10799 - protein, 9 aa, Mycobacterium tuberculosis
ANVWCRAGG

SEQ ID NO: 10800 - protein, 9 aa, Mycobacterium tuberculosis
NVWCRAGGI

SEQ ID NO: 10801 - protein, 9 aa, Mycobacterium tuberculosis
VWCRAGGIR

SEQ ID NO: 10802 - protein, 9 aa, Mycobacterium tuberculosis
WCRAGGIRM

SEQ ID NO: 10803 - protein, 9 aa, Mycobacterium tuberculosis
CRAGGIRMA

SEQ ID NO: 10804 - protein, 9 aa, Mycobacterium tuberculosis
RAGGIRMAP

SEQ ID NO: 10805 - protein, 9 aa, Mycobacterium tuberculosis
AGGIRMAPR

SEQ ID NO: 10806 - protein, 9 aa, Mycobacterium tuberculosis
GGIRMAPRP

SEQ ID NO: 10807 - protein, 9 aa, Mycobacterium tuberculosis
GIRMAPRPV

SEQ ID NO: 10808 - protein, 9 aa, Mycobacterium tuberculosis
IRMAPRPVI

SEQ ID NO: 10809 - protein, 9 aa, Mycobacterium tuberculosis
RMAPRPVIP

SEQ ID NO: 10810 - protein, 9 aa, Mycobacterium tuberculosis
MAPRPVIPV

SEQ ID NO: 10811 - protein, 9 aa, Mycobacterium tuberculosis
APRPVIPVA

SEQ ID NO: 10812 - protein, 9 aa, Mycobacterium tuberculosis
PRPVIPVAT

SEQ ID NO: 10813 - protein, 9 aa, Mycobacterium tuberculosis
RPVIPVATQ

SEQ ID NO: 10814 - protein, 9 aa, Mycobacterium tuberculosis
PVIPVATQQ

SEQ ID NO: 10815 - protein, 9 aa, Mycobacterium tuberculosis
VIPVATQQR

SEQ ID NO: 10816 - protein, 9 aa, Mycobacterium tuberculosis
IPVATQQRL

SEQ ID NO: 10817 - protein, 9 aa, Mycobacterium tuberculosis
PVATQQRLR

SEQ ID NO: 10818 - protein, 9 aa, Mycobacterium tuberculosis
VATQQRLRR

SEQ ID NO: 10819 - protein, 9 aa, Mycobacterium tuberculosis
ATQQRLRRQ

SEQ ID NO: 10820 - protein, 9 aa, Mycobacterium tuberculosis
TQQRLRRQA

SEQ ID NO: 10821 - protein, 9 aa, Mycobacterium tuberculosis
QQRLRRQAD

SEQ ID NO: 10822 - protein, 9 aa, Mycobacterium tuberculosis
QRLRRQADR

SEQ ID NO: 10823 - protein, 9 aa, Mycobacterium tuberculosis
RLRRQADRQ

SEQ ID NO: 10824 - protein, 9 aa, Mycobacterium tuberculosis
LRRQADRQS

SEQ ID NO: 10825 - protein, 9 aa, Mycobacterium tuberculosis
RRQADRQSL

SEQ ID NO: 10826 - protein, 9 aa, Mycobacterium tuberculosis
RQADRQSLG

SEQ ID NO: 10827 - protein, 9 aa, Mycobacterium tuberculosis
QADRQSLGS

SEQ ID NO: 10828 - protein, 9 aa, Mycobacterium tuberculosis
ADRQSLGSS

SEQ ID NO: 10829 - protein, 9 aa, Mycobacterium tuberculosis
DRQSLGSSG

SEQ ID NO: 10830 - protein, 9 aa, Mycobacterium tuberculosis
RQSLGSSGL

SEQ ID NO: 10831 - protein, 9 aa, Mycobacterium tuberculosis
QSLGSSGLP

SEQ ID NO: 10832 - protein, 9 aa, Mycobacterium tuberculosis
SLGSSGLPA

SEQ ID NO: 10833 - protein, 9 aa, Mycobacterium tuberculosis
LGSSGLPAL

SEQ ID NO: 10834 - protein, 9 aa, Mycobacterium tuberculosis
GSSGLPALN

SEQ ID NO: 10835 - protein, 9 aa, Mycobacterium tuberculosis
SSGLPALNC

SEQ ID NO: 10836 - protein, 9 aa, Mycobacterium tuberculosis
SGLPALNCT

SEQ ID NO: 10837 - protein, 9 aa, Mycobacterium tuberculosis
GLPALNCTP

SEQ ID NO: 10838 - protein, 9 aa, Mycobacterium tuberculosis
LPALNCTPI

SEQ ID NO: 10839 - protein, 9 aa, Mycobacterium tuberculosis
PALNCTPIR

SEQ ID NO: 10840 - protein, 9 aa, Mycobacterium tuberculosis
ALNCTPIRH

SEQ ID NO: 10841 - protein, 9 aa, Mycobacterium tuberculosis
LNCTPIRHT

SEQ ID NO: 10842 - protein, 9 aa, Mycobacterium tuberculosis
NCTPIRHTI

SEQ ID NO: 10843 - protein, 9 aa, Mycobacterium tuberculosis
CTPIRHTID

SEQ ID NO: 10844 - protein, 9 aa, Mycobacterium tuberculosis
TPIRHTIDV

SEQ ID NO: 10845 - protein, 9 aa, Mycobacterium tuberculosis
PIRHTIDVM

SEQ ID NO: 10846 - protein, 9 aa, Mycobacterium tuberculosis
IRHTIDVMA

SEQ ID NO: 10847 - protein, 9 aa, Mycobacterium tuberculosis
RHTIDVMAT

SEQ ID NO: 10848 - protein, 9 aa, Mycobacterium tuberculosis
HTIDVMATK

SEQ ID NO: 10849 - protein, 9 aa, Mycobacterium tuberculosis
TIDVMATKP

SEQ ID NO: 10850 - protein, 9 aa, Mycobacterium tuberculosis
IDVMATKPE

SEQ ID NO: 10851 - protein, 9 aa, Mycobacterium tuberculosis
DVMATKPER

SEQ ID NO: 10852 - protein, 9 aa, Mycobacterium tuberculosis
VMATKPERK

SEQ ID NO: 10853 - protein, 9 aa, Mycobacterium tuberculosis
MATKPERKT

SEQ ID NO: 10854 - protein, 9 aa, Mycobacterium tuberculosis
ATKPERKTE

SEQ ID NO: 10855 - protein, 9 aa, Mycobacterium tuberculosis
TKPERKTER

SEQ ID NO: 10856 - protein, 9 aa, Mycobacterium tuberculosis
KPERKTERL

SEQ ID NO: 10857 - protein, 9 aa, Mycobacterium tuberculosis
PERKTERLA

SEQ ID NO: 10858 - protein, 9 aa, Mycobacterium tuberculosis
ERKTERLAA

SEQ ID NO: 10859 - protein, 9 aa, Mycobacterium tuberculosis
RKTERLAAR

SEQ ID NO: 10860 - protein, 9 aa, Mycobacterium tuberculosis
KTERLAARL

SEQ ID NO: 10861 - protein, 9 aa, Mycobacterium tuberculosis
TERLAARLT

SEQ ID NO: 10862 - protein, 9 aa, Mycobacterium tuberculosis
ERLAARLTP

SEQ ID NO: 10863 - protein, 9 aa, Mycobacterium tuberculosis
RLAARLTPE

SEQ ID NO: 10864 - protein, 9 aa, Mycobacterium tuberculosis
LAARLTPEQ

SEQ ID NO: 10865 - protein, 9 aa, Mycobacterium tuberculosis
AARLTPEQD

SEQ ID NO: 10866 - protein, 9 aa, Mycobacterium tuberculosis
ARLTPEQDA

SEQ ID NO: 10867 - protein, 9 aa, Mycobacterium tuberculosis
RLTPEQDAL

SEQ ID NO: 10868 - protein, 9 aa, Mycobacterium tuberculosis
LTPEQDALI

SEQ ID NO: 10869 - protein, 9 aa, Mycobacterium tuberculosis
TPEQDALIR

SEQ ID NO: 10870 - protein, 9 aa, Mycobacterium tuberculosis
PEQDALIRR

SEQ ID NO: 10871 - protein, 9 aa, Mycobacterium tuberculosis
EQDALIRRA

SEQ ID NO: 10872 - protein, 9 aa, Mycobacterium tuberculosis
QDALIRRAA

SEQ ID NO: 10873 - protein, 9 aa, Mycobacterium tuberculosis
DALIRRAAE

SEQ ID NO: 10874 - protein, 9 aa, Mycobacterium tuberculosis
ALIRRAAEA

SEQ ID NO: 10875 - protein, 9 aa, Mycobacterium tuberculosis
LIRRAAEAE

SEQ ID NO: 10876 - protein, 9 aa, Mycobacterium tuberculosis
IRRAAEAEG

SEQ ID NO: 10877 - protein, 9 aa, Mycobacterium tuberculosis
RRAAEAEGT

SEQ ID NO: 10878 - protein, 9 aa, Mycobacterium tuberculosis
RAAEAEGTD

SEQ ID NO: 10879 - protein, 9 aa, Mycobacterium tuberculosis
AAEAEGTDL

SEQ ID NO: 10880 - protein, 9 aa, Mycobacterium tuberculosis
AEAEGTDLT

SEQ ID NO: 10881 - protein, 9 aa, Mycobacterium tuberculosis
EAEGTDLTN

SEQ ID NO: 10882 - protein, 9 aa, Mycobacterium tuberculosis
AEGTDLTNF

SEQ ID NO: 10883 - protein, 9 aa, Mycobacterium tuberculosis
EGTDLTNFT

SEQ ID NO: 10884 - protein, 9 aa, Mycobacterium tuberculosis
GTDLTNFTV

SEQ ID NO: 10885 - protein, 9 aa, Mycobacterium tuberculosis
TDLTNFTVT

SEQ ID NO: 10886 - protein, 9 aa, Mycobacterium tuberculosis
DLTNFTVTA

SEQ ID NO: 10887 - protein, 9 aa, Mycobacterium tuberculosis
LTNFTVTAA

SEQ ID NO: 10888 - protein, 9 aa, Mycobacterium tuberculosis
TNFTVTAAL

SEQ ID NO: 10889 - protein, 9 aa, Mycobacterium tuberculosis
NFTVTAALA

SEQ ID NO: 10890 - protein, 9 aa, Mycobacterium tuberculosis
FTVTAALAH

SEQ ID NO: 10891 - protein, 9 aa, Mycobacterium tuberculosis
TVTAALAHA

SEQ ID NO: 10892 - protein, 9 aa, Mycobacterium tuberculosis
VTAALAHAR

SEQ ID NO: 10893 - protein, 9 aa, Mycobacterium tuberculosis
TAALAHARD

SEQ ID NO: 10894 - protein, 9 aa, Mycobacterium tuberculosis
AALAHARDV

SEQ ID NO: 10895 - protein, 9 aa, Mycobacterium tuberculosis
ALAHARDVL

SEQ ID NO: 10896 - protein, 9 aa, Mycobacterium tuberculosis
LAHARDVLA

SEQ ID NO: 10897 - protein, 9 aa, Mycobacterium tuberculosis
AHARDVLAD

SEQ ID NO: 10898 - protein, 9 aa, Mycobacterium tuberculosis
HARDVLADR

SEQ ID NO: 10899 - protein, 9 aa, Mycobacterium tuberculosis
ARDVLADRR

SEQ ID NO: 10900 - protein, 9 aa, Mycobacterium tuberculosis
RDVLADRRL

SEQ ID NO: 10901 - protein, 9 aa, Mycobacterium tuberculosis
DVLADRRLF

SEQ ID NO: 10902 - protein, 9 aa, Mycobacterium tuberculosis
VLADRRLFV

SEQ ID NO: 10903 - protein, 9 aa, Mycobacterium tuberculosis
LADRRLFVL

SEQ ID NO: 10904 - protein, 9 aa, Mycobacterium tuberculosis
ADRRLFVLT

SEQ ID NO: 10905 - protein, 9 aa, Mycobacterium tuberculosis
DRRLFVLTD

SEQ ID NO: 10906 - protein, 9 aa, Mycobacterium tuberculosis
RRLFVLTDA

SEQ ID NO: 10907 - protein, 9 aa, Mycobacterium tuberculosis
RLFVLTDAA

SEQ ID NO: 10908 - protein, 9 aa, Mycobacterium tuberculosis
LFVLTDAAW

SEQ ID NO: 10909 - protein, 9 aa, Mycobacterium tuberculosis
FVLTDAAWT

SEQ ID NO: 10910 - protein, 9 aa, Mycobacterium tuberculosis
VLTDAAWTE

SEQ ID NO: 10911 - protein, 9 aa, Mycobacterium tuberculosis
LTDAAWTEF

SEQ ID NO: 10912 - protein, 9 aa, Mycobacterium tuberculosis
TDAAWTEFL

SEQ ID NO: 10913 - protein, 9 aa, Mycobacterium tuberculosis
DAAWTEFLA

SEQ ID NO: 10914 - protein, 9 aa, Mycobacterium tuberculosis
AAWTEFLAA

SEQ ID NO: 10915 - protein, 9 aa, Mycobacterium tuberculosis
AWTEFLAAL

SEQ ID NO: 10916 - protein, 9 aa, Mycobacterium tuberculosis
WTEFLAALD

SEQ ID NO: 10917 - protein, 9 aa, Mycobacterium tuberculosis
TEFLAALDR

SEQ ID NO: 10918 - protein, 9 aa, Mycobacterium tuberculosis
EFLAALDRP

SEQ ID NO: 10919 - protein, 9 aa, Mycobacterium tuberculosis
FLAALDRPV

SEQ ID NO: 10920 - protein, 9 aa, Mycobacterium tuberculosis
LAALDRPVS

SEQ ID NO: 10921 - protein, 9 aa, Mycobacterium tuberculosis
AALDRPVSH

SEQ ID NO: 10922 - protein, 9 aa, Mycobacterium tuberculosis
ALDRPVSHK

SEQ ID NO: 10923 - protein, 9 aa, Mycobacterium tuberculosis
LDRPVSHKP

SEQ ID NO: 10924 - protein, 9 aa, Mycobacterium tuberculosis
DRPVSHKPR

SEQ ID NO: 10925 - protein, 9 aa, Mycobacterium tuberculosis
RPVSHKPRL

SEQ ID NO: 10926 - protein, 9 aa, Mycobacterium tuberculosis
PVSHKPRLE

SEQ ID NO: 10927 - protein, 9 aa, Mycobacterium tuberculosis
VSHKPRLEK

SEQ ID NO: 10928 - protein, 9 aa, Mycobacterium tuberculosis
SHKPRLEKL

SEQ ID NO: 10929 - protein, 9 aa, Mycobacterium tuberculosis
HKPRLEKLF

SEQ ID NO: 10930 - protein, 9 aa, Mycobacterium tuberculosis
KPRLEKLFA

SEQ ID NO: 10931 - protein, 9 aa, Mycobacterium tuberculosis
PRLEKLFAA

SEQ ID NO: 10932 - protein, 9 aa, Mycobacterium tuberculosis
RLEKLFAAR

SEQ ID NO: 10933 - protein, 9 aa, Mycobacterium tuberculosis
LEKLFAARS

SEQ ID NO: 10934 - protein, 9 aa, Mycobacterium tuberculosis
EKLFAARSI

SEQ ID NO: 10935 - protein, 9 aa, Mycobacterium tuberculosis
KLFAARSIF

SEQ ID NO: 10936 - protein, 9 aa, Mycobacterium tuberculosis
LFAARSIFD

SEQ ID NO: 10937 - protein, 9 aa, Mycobacterium tuberculosis
FAARSIFDT

SEQ ID NO: 10938 - protein, 9 aa, Mycobacterium tuberculosis
AARSIFDTE

SEQ ID NO: 10939 - protein, 9 aa, Mycobacterium tuberculosis
ARSIFDTEG

SEQ ID NO: 10940 - protein, 10 aa, Mycobacterium tuberculosis
MHRAGAAVTA

SEQ ID NO: 10941 - protein, 10 aa, Mycobacterium tuberculosis
HRAGAAVTAN

SEQ ID NO: 10942 - protein, 10 aa, Mycobacterium tuberculosis
RAGAAVTANV

SEQ ID NO: 10943 - protein, 10 aa, Mycobacterium tuberculosis
AGAAVTANVW

SEQ ID NO: 10944 - protein, 10 aa, Mycobacterium tuberculosis
GAAVTANVWC

SEQ ID NO: 10945 - protein, 10 aa, Mycobacterium tuberculosis
AAVTANVWCR

SEQ ID NO: 10946 - protein, 10 aa, Mycobacterium tuberculosis
AVTANVWCRA

SEQ ID NO: 10947 - protein, 10 aa, Mycobacterium tuberculosis
VTANVWCRAG

SEQ ID NO: 10948 - protein, 10 aa, Mycobacterium tuberculosis
TANVWCRAGG

SEQ ID NO: 10949 - protein, 10 aa, Mycobacterium tuberculosis
ANVWCRAGGI

SEQ ID NO: 10950 - protein, 10 aa, Mycobacterium tuberculosis
NVWCRAGGIR

SEQ ID NO: 10951 - protein, 10 aa, Mycobacterium tuberculosis
VWCRAGGIRM

SEQ ID NO: 10952 - protein, 10 aa, Mycobacterium tuberculosis
WCRAGGIRMA

SEQ ID NO: 10953 - protein, 10 aa, Mycobacterium tuberculosis
CRAGGIRMAP

SEQ ID NO: 10954 - protein, 10 aa, Mycobacterium tuberculosis
RAGGIRMAPR

SEQ ID NO: 10955 - protein, 10 aa, Mycobacterium tuberculosis
AGGIRMAPRP

SEQ ID NO: 10956 - protein, 10 aa, Mycobacterium tuberculosis
GGIRMAPRPV

SEQ ID NO: 10957 - protein, 10 aa, Mycobacterium tuberculosis
GIRMAPRPVI

SEQ ID NO: 10958 - protein, 10 aa, Mycobacterium tuberculosis
IRMAPRPVIP

SEQ ID NO: 10959 - protein, 10 aa, Mycobacterium tuberculosis
RMAPRPVIPV

SEQ ID NO: 10960 - protein, 10 aa, Mycobacterium tuberculosis
MAPRPVIPVA

SEQ ID NO: 10961 - protein, 10 aa, Mycobacterium tuberculosis
APRPVIPVAT

SEQ ID NO: 10962 - protein, 10 aa, Mycobacterium tuberculosis
PRPVIPVATQ

SEQ ID NO: 10963 - protein, 10 aa, Mycobacterium tuberculosis
RPVIPVATQQ

SEQ ID NO: 10964 - protein, 10 aa, Mycobacterium tuberculosis
PVIPVATQQR

SEQ ID NO: 10965 - protein, 10 aa, Mycobacterium tuberculosis
VIPVATQQRL

SEQ ID NO: 10966 - protein, 10 aa, Mycobacterium tuberculosis
IPVATQQRLR

SEQ ID NO: 10967 - protein, 10 aa, Mycobacterium tuberculosis
PVATQQRLRR

SEQ ID NO: 10968 - protein, 10 aa, Mycobacterium tuberculosis
VATQQRLRRQ

SEQ ID NO: 10969 - protein, 10 aa, Mycobacterium tuberculosis
ATQQRLRRQA

SEQ ID NO: 10970 - protein, 10 aa, Mycobacterium tuberculosis
TQQRLRRQAD

SEQ ID NO: 10971 - protein, 10 aa, Mycobacterium tuberculosis
QQRLRRQADR

SEQ ID NO: 10972 - protein, 10 aa, Mycobacterium tuberculosis
QRLRRQADRQ

SEQ ID NO: 10973 - protein, 10 aa, Mycobacterium tuberculosis
RLRRQADRQS

SEQ ID NO: 10974 - protein, 10 aa, Mycobacterium tuberculosis
LRRQADRQSL

SEQ ID NO: 10975 - protein, 10 aa, Mycobacterium tuberculosis
RRQADRQSLG

SEQ ID NO: 10976 - protein, 10 aa, Mycobacterium tuberculosis
RQADRQSLGS

SEQ ID NO: 10977 - protein, 10 aa, Mycobacterium tuberculosis
QADRQSLGSS

SEQ ID NO: 10978 - protein, 10 aa, Mycobacterium tuberculosis
ADRQSLGSSG

SEQ ID NO: 10979 - protein, 10 aa, Mycobacterium tuberculosis
DRQSLGSSGL

SEQ ID NO: 10980 - protein, 10 aa, Mycobacterium tuberculosis
RQSLGSSGLP

SEQ ID NO: 10981 - protein, 10 aa, Mycobacterium tuberculosis
QSLGSSGLPA

SEQ ID NO: 10982 - protein, 10 aa, Mycobacterium tuberculosis
SLGSSGLPAL

SEQ ID NO: 10983 - protein, 10 aa, Mycobacterium tuberculosis
LGSSGLPALN

SEQ ID NO: 10984 - protein, 10 aa, Mycobacterium tuberculosis
GSSGLPALNC

SEQ ID NO: 10985 - protein, 10 aa, Mycobacterium tuberculosis
SSGLPALNCT

SEQ ID NO: 10986 - protein, 10 aa, Mycobacterium tuberculosis
SGLPALNCTP

SEQ ID NO: 10987 - protein, 10 aa, Mycobacterium tuberculosis
GLPALNCTPI

SEQ ID NO: 10988 - protein, 10 aa, Mycobacterium tuberculosis
LPALNCTPIR

SEQ ID NO: 10989 - protein, 10 aa, Mycobacterium tuberculosis
PALNCTPIRH

SEQ ID NO: 10990 - protein, 10 aa, Mycobacterium tuberculosis
ALNCTPIRHT

SEQ ID NO: 10991 - protein, 10 aa, Mycobacterium tuberculosis
LNCTPIRHTI

SEQ ID NO: 10992 - protein, 10 aa, Mycobacterium tuberculosis
NCTPIRHTID

SEQ ID NO: 10993 - protein, 10 aa, Mycobacterium tuberculosis
CTPIRHTIDV

SEQ ID NO: 10994 - protein, 10 aa, Mycobacterium tuberculosis
TPIRHTIDVM

SEQ ID NO: 10995 - protein, 10 aa, Mycobacterium tuberculosis
PIRHTIDVMA

SEQ ID NO: 10996 - protein, 10 aa, Mycobacterium tuberculosis
IRHTIDVMAT

SEQ ID NO: 10997 - protein, 10 aa, Mycobacterium tuberculosis
RHTIDVMATK

SEQ ID NO: 10998 - protein, 10 aa, Mycobacterium tuberculosis
HTIDVMATKP

SEQ ID NO: 10999 - protein, 10 aa, Mycobacterium tuberculosis
TIDVMATKPE

SEQ ID NO: 11000 - protein, 10 aa, Mycobacterium tuberculosis
IDVMATKPER

SEQ ID NO: 11001 - protein, 10 aa, Mycobacterium tuberculosis
DVMATKPERK

SEQ ID NO: 11002 - protein, 10 aa, Mycobacterium tuberculosis
VMATKPERKT

SEQ ID NO: 11003 - protein, 10 aa, Mycobacterium tuberculosis
MATKPERKTE

SEQ ID NO: 11004 - protein, 10 aa, Mycobacterium tuberculosis
ATKPERKTER

SEQ ID NO: 11005 - protein, 10 aa, Mycobacterium tuberculosis
TKPERKTERL

SEQ ID NO: 11006 - protein, 10 aa, Mycobacterium tuberculosis
KPERKTERLA

SEQ ID NO: 11007 - protein, 10 aa, Mycobacterium tuberculosis
PERKTERLAA

SEQ ID NO: 11008 - protein, 10 aa, Mycobacterium tuberculosis
ERKTERLAAR

SEQ ID NO: 11009 - protein, 10 aa, Mycobacterium tuberculosis
RKTERLAARL

SEQ ID NO: 11010 - protein, 10 aa, Mycobacterium tuberculosis
KTERLAARLT

SEQ ID NO: 11011 - protein, 10 aa, Mycobacterium tuberculosis
TERLAARLTP

SEQ ID NO: 11012 - protein, 10 aa, Mycobacterium tuberculosis
ERLAARLTPE

SEQ ID NO: 11013 - protein, 10 aa, Mycobacterium tuberculosis
RLAARLTPEQ

SEQ ID NO: 11014 - protein, 10 aa, Mycobacterium tuberculosis
LAARLTPEQD

SEQ ID NO: 11015 - protein, 10 aa, Mycobacterium tuberculosis
AARLTPEQDA

SEQ ID NO: 11016 - protein, 10 aa, Mycobacterium tuberculosis
ARLTPEQDAL

SEQ ID NO: 11017 - protein, 10 aa, Mycobacterium tuberculosis
RLTPEQDALI

SEQ ID NO: 11018 - protein, 10 aa, Mycobacterium tuberculosis
LTPEQDALIR

SEQ ID NO: 11019 - protein, 10 aa, Mycobacterium tuberculosis
TPEQDALIRR

SEQ ID NO: 11020 - protein, 10 aa, Mycobacterium tuberculosis
PEQDALIRRA

SEQ ID NO: 11021 - protein, 10 aa, Mycobacterium tuberculosis
EQDALIRRAA

SEQ ID NO: 11022 - protein, 10 aa, Mycobacterium tuberculosis
QDALIRRAAE

SEQ ID NO: 11023 - protein, 10 aa, Mycobacterium tuberculosis
DALIRRAAEA

SEQ ID NO: 11024 - protein, 10 aa, Mycobacterium tuberculosis
ALIRRAAEAE

SEQ ID NO: 11025 - protein, 10 aa, Mycobacterium tuberculosis
LIRRAAEAEG

SEQ ID NO: 11026 - protein, 10 aa, Mycobacterium tuberculosis
IRRAAEAEGT

SEQ ID NO: 11027 - protein, 10 aa, Mycobacterium tuberculosis
RRAAEAEGTD

SEQ ID NO: 11028 - protein, 10 aa, Mycobacterium tuberculosis
RAAEAEGTDL

SEQ ID NO: 11029 - protein, 10 aa, Mycobacterium tuberculosis
AAEAEGTDLT

SEQ ID NO: 11030 - protein, 10 aa, Mycobacterium tuberculosis
AEAEGTDLTN

SEQ ID NO: 11031 - protein, 10 aa, Mycobacterium tuberculosis
EAEGTDLTNF

SEQ ID NO: 11032 - protein, 10 aa, Mycobacterium tuberculosis
AEGTDLTNFT

SEQ ID NO: 11033 - protein, 10 aa, Mycobacterium tuberculosis
EGTDLTNFTV

SEQ ID NO: 11034 - protein, 10 aa, Mycobacterium tuberculosis
GTDLTNFTVT

SEQ ID NO: 11035 - protein, 10 aa, Mycobacterium tuberculosis
TDLTNFTVTA

SEQ ID NO: 11036 - protein, 10 aa, Mycobacterium tuberculosis
DLTNFTVTAA

SEQ ID NO: 11037 - protein, 10 aa, Mycobacterium tuberculosis
LTNFTVTAAL

SEQ ID NO: 11038 - protein, 10 aa, Mycobacterium tuberculosis
TNFTVTAALA

SEQ ID NO: 11039 - protein, 10 aa, Mycobacterium tuberculosis
NFTVTAALAH

SEQ ID NO: 11040 - protein, 10 aa, Mycobacterium tuberculosis
FTVTAALAHA

SEQ ID NO: 11041 - protein, 10 aa, Mycobacterium tuberculosis
TVTAALAHAR

SEQ ID NO: 11042 - protein, 10 aa, Mycobacterium tuberculosis
VTAALAHARD

SEQ ID NO: 11043 - protein, 10 aa, Mycobacterium tuberculosis
TAALAHARDV

SEQ ID NO: 11044 - protein, 10 aa, Mycobacterium tuberculosis
AALAHARDVL

SEQ ID NO: 11045 - protein, 10 aa, Mycobacterium tuberculosis
ALAHARDVLA

SEQ ID NO: 11046 - protein, 10 aa, Mycobacterium tuberculosis
LAHARDVLAD

SEQ ID NO: 11047 - protein, 10 aa, Mycobacterium tuberculosis
AHARDVLADR

SEQ ID NO: 11048 - protein, 10 aa, Mycobacterium tuberculosis
HARDVLADRR

SEQ ID NO: 11049 - protein, 10 aa, Mycobacterium tuberculosis
ARDVLADRRL

SEQ ID NO: 11050 - protein, 10 aa, Mycobacterium tuberculosis
RDVLADRRLF

SEQ ID NO: 11051 - protein, 10 aa, Mycobacterium tuberculosis
DVLADRRLFV

SEQ ID NO: 11052 - protein, 10 aa, Mycobacterium tuberculosis
VLADRRLFVL

SEQ ID NO: 11053 - protein, 10 aa, Mycobacterium tuberculosis
LADRRLFVLT

SEQ ID NO: 11054 - protein, 10 aa, Mycobacterium tuberculosis
ADRRLFVLTD

SEQ ID NO: 11055 - protein, 10 aa, Mycobacterium tuberculosis
DRRLFVLTDA

SEQ ID NO: 11056 - protein, 10 aa, Mycobacterium tuberculosis
RRLFVLTDAA

SEQ ID NO: 11057 - protein, 10 aa, Mycobacterium tuberculosis
RLFVLTDAAW

SEQ ID NO: 11058 - protein, 10 aa, Mycobacterium tuberculosis
LFVLTDAAWT

SEQ ID NO: 11059 - protein, 10 aa, Mycobacterium tuberculosis
FVLTDAAWTE

SEQ ID NO: 11060 - protein, 10 aa, Mycobacterium tuberculosis
VLTDAAWTEF

SEQ ID NO: 11061 - protein, 10 aa, Mycobacterium tuberculosis
LTDAAWTEFL

SEQ ID NO: 11062 - protein, 10 aa, Mycobacterium tuberculosis
TDAAWTEFLA

SEQ ID NO: 11063 - protein, 10 aa, Mycobacterium tuberculosis
DAAWTEFLAA

SEQ ID NO: 11064 - protein, 10 aa, Mycobacterium tuberculosis
AAWTEFLAAL

SEQ ID NO: 11065 - protein, 10 aa, Mycobacterium tuberculosis
AWTEFLAALD

SEQ ID NO: 11066 - protein, 10 aa, Mycobacterium tuberculosis
WTEFLAALDR

SEQ ID NO: 11067 - protein, 10 aa, Mycobacterium tuberculosis
TEFLAALDRP

SEQ ID NO: 11068 - protein, 10 aa, Mycobacterium tuberculosis
EFLAALDRPV

SEQ ID NO: 11069 - protein, 10 aa, Mycobacterium tuberculosis
FLAALDRPVS

SEQ ID NO: 11070 - protein, 10 aa, Mycobacterium tuberculosis
LAALDRPVSH

SEQ ID NO: 11071 - protein, 10 aa, Mycobacterium tuberculosis
AALDRPVSHK

SEQ ID NO: 11072 - protein, 10 aa, Mycobacterium tuberculosis
ALDRPVSHKP

SEQ ID NO: 11073 - protein, 10 aa, Mycobacterium tuberculosis
LDRPVSHKPR

SEQ ID NO: 11074 - protein, 10 aa, Mycobacterium tuberculosis
DRPVSHKPRL

SEQ ID NO: 11075 - protein, 10 aa, Mycobacterium tuberculosis
RPVSHKPRLE

SEQ ID NO: 11076 - protein, 10 aa, Mycobacterium tuberculosis
PVSHKPRLEK

SEQ ID NO: 11077 - protein, 10 aa, Mycobacterium tuberculosis
VSHKPRLEKL

SEQ ID NO: 11078 - protein, 10 aa, Mycobacterium tuberculosis
SHKPRLEKLF

SEQ ID NO: 11079 - protein, 10 aa, Mycobacterium tuberculosis
HKPRLEKLFA

SEQ ID NO: 11080 - protein, 10 aa, Mycobacterium tuberculosis
KPRLEKLFAA

SEQ ID NO: 11081 - protein, 10 aa, Mycobacterium tuberculosis
PRLEKLFAAR

SEQ ID NO: 11082 - protein, 10 aa, Mycobacterium tuberculosis
RLEKLFAARS

SEQ ID NO: 11083 - protein, 10 aa, Mycobacterium tuberculosis
LEKLFAARSI

SEQ ID NO: 11084 - protein, 10 aa, Mycobacterium tuberculosis
EKLFAARSIF

SEQ ID NO: 11085 - protein, 10 aa, Mycobacterium tuberculosis
KLFAARSIFD

SEQ ID NO: 11086 - protein, 10 aa, Mycobacterium tuberculosis
LFAARSIFDT

SEQ ID NO: 11087 - protein, 10 aa, Mycobacterium tuberculosis
FAARSIFDTE

SEQ ID NO: 11088 - protein, 10 aa, Mycobacterium tuberculosis
AARSIFDTEG

SEQ ID NO: 11089 - protein, 11 aa, Mycobacterium tuberculosis
MHRAGAAVTAN

SEQ ID NO: 11090 - protein, 11 aa, Mycobacterium tuberculosis
HRAGAAVTANV

SEQ ID NO: 11091 - protein, 11 aa, Mycobacterium tuberculosis
RAGAAVTANVW

SEQ ID NO: 11092 - protein, 11 aa, Mycobacterium tuberculosis
AGAAVTANVWC

SEQ ID NO: 11093 - protein, 11 aa, Mycobacterium tuberculosis
GAAVTANVWCR

SEQ ID NO: 11094 - protein, 11 aa, Mycobacterium tuberculosis
AAVTANVWCRA

SEQ ID NO: 11095 - protein, 11 aa, Mycobacterium tuberculosis
AVTANVWCRAG

SEQ ID NO: 11096 - protein, 11 aa, Mycobacterium tuberculosis
VTANVWCRAGG

SEQ ID NO: 11097 - protein, 11 aa, Mycobacterium tuberculosis
TANVWCRAGGI

SEQ ID NO: 11098 - protein, 11 aa, Mycobacterium tuberculosis
ANVWCRAGGIR

SEQ ID NO: 11099 - protein, 11 aa, Mycobacterium tuberculosis
NVWCRAGGIRM

SEQ ID NO: 11100 - protein, 11 aa, Mycobacterium tuberculosis
VWCRAGGIRMA

SEQ ID NO: 11101 - protein, 11 aa, Mycobacterium tuberculosis
WCRAGGIRMAP

SEQ ID NO: 11102 - protein, 11 aa, Mycobacterium tuberculosis
CRAGGIRMAPR

SEQ ID NO: 11103 - protein, 11 aa, Mycobacterium tuberculosis
RAGGIRMAPRP

SEQ ID NO: 11104 - protein, 11 aa, Mycobacterium tuberculosis
AGGIRMAPRPV

SEQ ID NO: 11105 - protein, 11 aa, Mycobacterium tuberculosis
GGIRMAPRPVI

SEQ ID NO: 11106 - protein, 11 aa, Mycobacterium tuberculosis
GIRMAPRPVIP

SEQ ID NO: 11107 - protein, 11 aa, Mycobacterium tuberculosis
IRMAPRPVIPV

SEQ ID NO: 11108 - protein, 11 aa, Mycobacterium tuberculosis
RMAPRPVIPVA

SEQ ID NO: 11109 - protein, 11 aa, Mycobacterium tuberculosis
MAPRPVIPVAT

SEQ ID NO: 11110 - protein, 11 aa, Mycobacterium tuberculosis
APRPVIPVATQ

SEQ ID NO: 11111 - protein, 11 aa, Mycobacterium tuberculosis
PRPVIPVATQQ

SEQ ID NO: 11112 - protein, 11 aa, Mycobacterium tuberculosis
RPVIPVATQQR

SEQ ID NO: 11113 - protein, 11 aa, Mycobacterium tuberculosis
PVIPVATQQRL

SEQ ID NO: 11114 - protein, 11 aa, Mycobacterium tuberculosis
VIPVATQQRLR

SEQ ID NO: 11115 - protein, 11 aa, Mycobacterium tuberculosis
IPVATQQRLRR

SEQ ID NO: 11116 - protein, 11 aa, Mycobacterium tuberculosis
PVATQQRLRRQ

SEQ ID NO: 11117 - protein, 11 aa, Mycobacterium tuberculosis
VATQQRLRRQA

SEQ ID NO: 11118 - protein, 11 aa, Mycobacterium tuberculosis
ATQQRLRRQAD

SEQ ID NO: 11119 - protein, 11 aa, Mycobacterium tuberculosis
TQQRLRRQADR

SEQ ID NO: 11120 - protein, 11 aa, Mycobacterium tuberculosis
QQRLRRQADRQ

SEQ ID NO: 11121 - protein, 11 aa, Mycobacterium tuberculosis
QRLRRQADRQS

SEQ ID NO: 11122 - protein, 11 aa, Mycobacterium tuberculosis
RLRRQADRQSL

SEQ ID NO: 11123 - protein, 11 aa, Mycobacterium tuberculosis
LRRQADRQSLG

SEQ ID NO: 11124 - protein, 11 aa, Mycobacterium tuberculosis
RRQADRQSLGS

SEQ ID NO: 11125 - protein, 11 aa, Mycobacterium tuberculosis
RQADRQSLGSS

SEQ ID NO: 11126 - protein, 11 aa, Mycobacterium tuberculosis
QADRQSLGSSG

SEQ ID NO: 11127 - protein, 11 aa, Mycobacterium tuberculosis
ADRQSLGSSGL

SEQ ID NO: 11128 - protein, 11 aa, Mycobacterium tuberculosis
DRQSLGSSGLP

SEQ ID NO: 11129 - protein, 11 aa, Mycobacterium tuberculosis
RQSLGSSGLPA

SEQ ID NO: 11130 - protein, 11 aa, Mycobacterium tuberculosis
QSLGSSGLPAL

SEQ ID NO: 11131 - protein, 11 aa, Mycobacterium tuberculosis
SLGSSGLPALN

SEQ ID NO: 11132 - protein, 11 aa, Mycobacterium tuberculosis
LGSSGLPALNC

SEQ ID NO: 11133 - protein, 11 aa, Mycobacterium tuberculosis
GSSGLPALNCT

SEQ ID NO: 11134 - protein, 11 aa, Mycobacterium tuberculosis
SSGLPALNCTP

SEQ ID NO: 11135 - protein, 11 aa, Mycobacterium tuberculosis
SGLPALNCTPI

SEQ ID NO: 11136 - protein, 11 aa, Mycobacterium tuberculosis
GLPALNCTPIR

SEQ ID NO: 11137 - protein, 11 aa, Mycobacterium tuberculosis
LPALNCTPIRH

SEQ ID NO: 11138 - protein, 11 aa, Mycobacterium tuberculosis
PALNCTPIRHT

SEQ ID NO: 11139 - protein, 11 aa, Mycobacterium tuberculosis
ALNCTPIRHTI

SEQ ID NO: 11140 - protein, 11 aa, Mycobacterium tuberculosis
LNCTPIRHTID

SEQ ID NO: 11141 - protein, 11 aa, Mycobacterium tuberculosis
NCTPIRHTIDV

SEQ ID NO: 11142 - protein, 11 aa, Mycobacterium tuberculosis
CTPIRHTIDVM

SEQ ID NO: 11143 - protein, 11 aa, Mycobacterium tuberculosis
TPIRHTIDVMA

SEQ ID NO: 11144 - protein, 11 aa, Mycobacterium tuberculosis
PIRHTIDVMAT

SEQ ID NO: 11145 - protein, 11 aa, Mycobacterium tuberculosis
IRHTIDVMATK

SEQ ID NO: 11146 - protein, 11 aa, Mycobacterium tuberculosis
RHTIDVMATKP

SEQ ID NO: 11147 - protein, 11 aa, Mycobacterium tuberculosis
HTIDVMATKPE

SEQ ID NO: 11148 - protein, 11 aa, Mycobacterium tuberculosis
TIDVMATKPER

SEQ ID NO: 11149 - protein, 11 aa, Mycobacterium tuberculosis
IDVMATKPERK

SEQ ID NO: 11150 - protein, 11 aa, Mycobacterium tuberculosis
DVMATKPERKT

SEQ ID NO: 11151 - protein, 11 aa, Mycobacterium tuberculosis
VMATKPERKTE

SEQ ID NO: 11152 - protein, 11 aa, Mycobacterium tuberculosis
MATKPERKTER

SEQ ID NO: 11153 - protein, 11 aa, Mycobacterium tuberculosis
ATKPERKTERL

SEQ ID NO: 11154 - protein, 11 aa, Mycobacterium tuberculosis
TKPERKTERLA

SEQ ID NO: 11155 - protein, 11 aa, Mycobacterium tuberculosis
KPERKTERLAA

SEQ ID NO: 11156 - protein, 11 aa, Mycobacterium tuberculosis
PERKTERLAAR

SEQ ID NO: 11157 - protein, 11 aa, Mycobacterium tuberculosis
ERKTERLAARL

SEQ ID NO: 11158 - protein, 11 aa, Mycobacterium tuberculosis
RKTERLAARLT

SEQ ID NO: 11159 - protein, 11 aa, Mycobacterium tuberculosis
KTERLAARLTP

SEQ ID NO: 11160 - protein, 11 aa, Mycobacterium tuberculosis
TERLAARLTPE

SEQ ID NO: 11161 - protein, 11 aa, Mycobacterium tuberculosis
ERLAARLTPEQ

SEQ ID NO: 11162 - protein, 11 aa, Mycobacterium tuberculosis
RLAARLTPEQD

SEQ ID NO: 11163 - protein, 11 aa, Mycobacterium tuberculosis
LAARLTPEQDA

SEQ ID NO: 11164 - protein, 11 aa, Mycobacterium tuberculosis
AARLTPEQDAL

SEQ ID NO: 11165 - protein, 11 aa, Mycobacterium tuberculosis
ARLTPEQDALI

SEQ ID NO: 11166 - protein, 11 aa, Mycobacterium tuberculosis
RLTPEQDALIR

SEQ ID NO: 11167 - protein, 11 aa, Mycobacterium tuberculosis
LTPEQDALIRR

SEQ ID NO: 11168 - protein, 11 aa, Mycobacterium tuberculosis
TPEQDALIRRA

SEQ ID NO: 11169 - protein, 11 aa, Mycobacterium tuberculosis
PEQDALIRRAA

SEQ ID NO: 11170 - protein, 11 aa, Mycobacterium tuberculosis
EQDALIRRAAE

SEQ ID NO: 11171 - protein, 11 aa, Mycobacterium tuberculosis
QDALIRRAAEA

SEQ ID NO: 11172 - protein, 11 aa, Mycobacterium tuberculosis
DALIRRAAEAE

SEQ ID NO: 11173 - protein, 11 aa, Mycobacterium tuberculosis
ALIRRAAEAEG

SEQ ID NO: 11174 - protein, 11 aa, Mycobacterium tuberculosis
LIRRAAEAEGT

SEQ ID NO: 11175 - protein, 11 aa, Mycobacterium tuberculosis
IRRAAEAEGTD

SEQ ID NO: 11176 - protein, 11 aa, Mycobacterium tuberculosis
RRAAEAEGTDL

SEQ ID NO: 11177 - protein, 11 aa, Mycobacterium tuberculosis
RAAEAEGTDLT

SEQ ID NO: 11178 - protein, 11 aa, Mycobacterium tuberculosis
AAEAEGTDLTN

SEQ ID NO: 11179 - protein, 11 aa, Mycobacterium tuberculosis
AEAEGTDLTNF

SEQ ID NO: 11180 - protein, 11 aa, Mycobacterium tuberculosis
EAEGTDLTNFT

SEQ ID NO: 11181 - protein, 11 aa, Mycobacterium tuberculosis
AEGTDLTNFTV

SEQ ID NO: 11182 - protein, 11 aa, Mycobacterium tuberculosis
EGTDLTNFTVT

SEQ ID NO: 11183 - protein, 11 aa, Mycobacterium tuberculosis
GTDLTNFTVTA

SEQ ID NO: 11184 - protein, 11 aa, Mycobacterium tuberculosis
TDLTNFTVTAA

SEQ ID NO: 11185 - protein, 11 aa, Mycobacterium tuberculosis
DLTNFTVTAAL

SEQ ID NO: 11186 - protein, 11 aa, Mycobacterium tuberculosis
LTNFTVTAALA

SEQ ID NO: 11187 - protein, 11 aa, Mycobacterium tuberculosis
TNFTVTAALAH

SEQ ID NO: 11188 - protein, 11 aa, Mycobacterium tuberculosis
NFTVTAALAHA

SEQ ID NO: 11189 - protein, 11 aa, Mycobacterium tuberculosis
FTVTAALAHAR

SEQ ID NO: 11190 - protein, 11 aa, Mycobacterium tuberculosis
TVTAALAHARD

SEQ ID NO: 11191 - protein, 11 aa, Mycobacterium tuberculosis
VTAALAHARDV

SEQ ID NO: 11192 - protein, 11 aa, Mycobacterium tuberculosis
TAALAHARDVL

SEQ ID NO: 11193 - protein, 11 aa, Mycobacterium tuberculosis
AALAHARDVLA

SEQ ID NO: 11194 - protein, 11 aa, Mycobacterium tuberculosis
ALAHARDVLAD

SEQ ID NO: 11195 - protein, 11 aa, Mycobacterium tuberculosis
LAHARDVLADR

SEQ ID NO: 11196 - protein, 11 aa, Mycobacterium tuberculosis
AHARDVLADRR

SEQ ID NO: 11197 - protein, 11 aa, Mycobacterium tuberculosis
HARDVLADRRL

SEQ ID NO: 11198 - protein, 11 aa, Mycobacterium tuberculosis
ARDVLADRRLF

SEQ ID NO: 11199 - protein, 11 aa, Mycobacterium tuberculosis
RDVLADRRLFV

SEQ ID NO: 11200 - protein, 11 aa, Mycobacterium tuberculosis
DVLADRRLFVL

SEQ ID NO: 11201 - protein, 11 aa, Mycobacterium tuberculosis
VLADRRLFVLT

SEQ ID NO: 11202 - protein, 11 aa, Mycobacterium tuberculosis
LADRRLFVLTD

SEQ ID NO: 11203 - protein, 11 aa, Mycobacterium tuberculosis
ADRRLFVLTDA

SEQ ID NO: 11204 - protein, 11 aa, Mycobacterium tuberculosis
DRRLFVLTDAA

SEQ ID NO: 11205 - protein, 11 aa, Mycobacterium tuberculosis
RRLFVLTDAAW

SEQ ID NO: 11206 - protein, 11 aa, Mycobacterium tuberculosis
RLFVLTDAAWT

SEQ ID NO: 11207 - protein, 11 aa, Mycobacterium tuberculosis
LFVLTDAAWTE

SEQ ID NO: 11208 - protein, 11 aa, Mycobacterium tuberculosis
FVLTDAAWTEF

SEQ ID NO: 11209 - protein, 11 aa, Mycobacterium tuberculosis
VLTDAAWTEFL

SEQ ID NO: 11210 - protein, 11 aa, Mycobacterium tuberculosis
LTDAAWTEFLA

SEQ ID NO: 11211 - protein, 11 aa, Mycobacterium tuberculosis
TDAAWTEFLAA

SEQ ID NO: 11212 - protein, 11 aa, Mycobacterium tuberculosis
DAAWTEFLAAL

SEQ ID NO: 11213 - protein, 11 aa, Mycobacterium tuberculosis
AAWTEFLAALD

SEQ ID NO: 11214 - protein, 11 aa, Mycobacterium tuberculosis
AWTEFLAALDR

SEQ ID NO: 11215 - protein, 11 aa, Mycobacterium tuberculosis
WTEFLAALDRP

SEQ ID NO: 11216 - protein, 11 aa, Mycobacterium tuberculosis
TEFLAALDRPV

SEQ ID NO: 11217 - protein, 11 aa, Mycobacterium tuberculosis
EFLAALDRPVS

SEQ ID NO: 11218 - protein, 11 aa, Mycobacterium tuberculosis
FLAALDRPVSH

SEQ ID NO: 11219 - protein, 11 aa, Mycobacterium tuberculosis
LAALDRPVSHK

SEQ ID NO: 11220 - protein, 11 aa, Mycobacterium tuberculosis
AALDRPVSHKP

SEQ ID NO: 11221 - protein, 11 aa, Mycobacterium tuberculosis
ALDRPVSHKPR

SEQ ID NO: 11222 - protein, 11 aa, Mycobacterium tuberculosis
LDRPVSHKPRL

SEQ ID NO: 11223 - protein, 11 aa, Mycobacterium tuberculosis
DRPVSHKPRLE

SEQ ID NO: 11224 - protein, 11 aa, Mycobacterium tuberculosis
RPVSHKPRLEK

SEQ ID NO: 11225 - protein, 11 aa, Mycobacterium tuberculosis
PVSHKPRLEKL

SEQ ID NO: 11226 - protein, 11 aa, Mycobacterium tuberculosis
VSHKPRLEKLF

SEQ ID NO: 11227 - protein, 11 aa, Mycobacterium tuberculosis
SHKPRLEKLFA

SEQ ID NO: 11228 - protein, 11 aa, Mycobacterium tuberculosis
HKPRLEKLFAA

SEQ ID NO: 11229 - protein, 11 aa, Mycobacterium tuberculosis
KPRLEKLFAAR

SEQ ID NO: 11230 - protein, 11 aa, Mycobacterium tuberculosis
PRLEKLFAARS

SEQ ID NO: 11231 - protein, 11 aa, Mycobacterium tuberculosis
RLEKLFAARSI

SEQ ID NO: 11232 - protein, 11 aa, Mycobacterium tuberculosis
LEKLFAARSIF

SEQ ID NO: 11233 - protein, 11 aa, Mycobacterium tuberculosis
EKLFAARSIFD

SEQ ID NO: 11234 - protein, 11 aa, Mycobacterium tuberculosis
KLFAARSIFDT

SEQ ID NO: 11235 - protein, 11 aa, Mycobacterium tuberculosis
LFAARSIFDTE

SEQ ID NO: 11236 - protein, 11 aa, Mycobacterium tuberculosis
FAARSIFDTEG

SEQ ID NO: 11237 - protein, 8 aa, Mycobacterium tuberculosis
MFRTVGDQ

SEQ ID NO: 11238 - protein, 8 aa, Mycobacterium tuberculosis
FRTVGDQA

SEQ ID NO: 11239 - protein, 8 aa, Mycobacterium tuberculosis
RTVGDQAS

SEQ ID NO: 11240 - protein, 8 aa, Mycobacterium tuberculosis
TVGDQASL

SEQ ID NO: 11241 - protein, 8 aa, Mycobacterium tuberculosis
VGDQASLW

SEQ ID NO: 11242 - protein, 8 aa, Mycobacterium tuberculosis
GDQASLWE

SEQ ID NO: 11243 - protein, 8 aa, Mycobacterium tuberculosis
DQASLWES

SEQ ID NO: 11244 - protein, 8 aa, Mycobacterium tuberculosis
QASLWESV

SEQ ID NO: 11245 - protein, 8 aa, Mycobacterium tuberculosis
ASLWESVL

SEQ ID NO: 11246 - protein, 8 aa, Mycobacterium tuberculosis
SLWESVLP

SEQ ID NO: 11247 - protein, 8 aa, Mycobacterium tuberculosis
LWESVLPE

SEQ ID NO: 11248 - protein, 8 aa, Mycobacterium tuberculosis
WESVLPEE

SEQ ID NO: 11249 - protein, 8 aa, Mycobacterium tuberculosis
ESVLPEEL

SEQ ID NO: 11250 - protein, 8 aa, Mycobacterium tuberculosis
SVLPEELR

SEQ ID NO: 11251 - protein, 8 aa, Mycobacterium tuberculosis
VLPEELRR

SEQ ID NO: 11252 - protein, 8 aa, Mycobacterium tuberculosis
LPEELRRL

SEQ ID NO: 11253 - protein, 8 aa, Mycobacterium tuberculosis
PEELRRLP

SEQ ID NO: 11254 - protein, 8 aa, Mycobacterium tuberculosis
EELRRLPE

SEQ ID NO: 11255 - protein, 8 aa, Mycobacterium tuberculosis
ELRRLPEE

SEQ ID NO: 11256 - protein, 8 aa, Mycobacterium tuberculosis
LRRLPEEL

SEQ ID NO: 11257 - protein, 8 aa, Mycobacterium tuberculosis
RRLPEELA

SEQ ID NO: 11258 - protein, 8 aa, Mycobacterium tuberculosis
RLPEELAR

SEQ ID NO: 11259 - protein, 8 aa, Mycobacterium tuberculosis
LPEELARV

SEQ ID NO: 11260 - protein, 8 aa, Mycobacterium tuberculosis
PEELARVD

SEQ ID NO: 11261 - protein, 8 aa, Mycobacterium tuberculosis
EELARVDA

SEQ ID NO: 11262 - protein, 8 aa, Mycobacterium tuberculosis
ELARVDAL

SEQ ID NO: 11263 - protein, 8 aa, Mycobacterium tuberculosis
LARVDALL

SEQ ID NO: 11264 - protein, 8 aa, Mycobacterium tuberculosis
ARVDALLD

SEQ ID NO: 11265 - protein, 8 aa, Mycobacterium tuberculosis
RVDALLDD

SEQ ID NO: 11266 - protein, 8 aa, Mycobacterium tuberculosis
VDALLDDS

SEQ ID NO: 11267 - protein, 8 aa, Mycobacterium tuberculosis
DALLDDSA

SEQ ID NO: 11268 - protein, 8 aa, Mycobacterium tuberculosis
ALLDDSAF

SEQ ID NO: 11269 - protein, 8 aa, Mycobacterium tuberculosis
LLDDSAFF

SEQ ID NO: 11270 - protein, 8 aa, Mycobacterium tuberculosis
LDDSAFFC

SEQ ID NO: 11271 - protein, 8 aa, Mycobacterium tuberculosis
DDSAFFCP

SEQ ID NO: 11272 - protein, 8 aa, Mycobacterium tuberculosis
DSAFFCPF

SEQ ID NO: 11273 - protein, 8 aa, Mycobacterium tuberculosis
SAFFCPFV

SEQ ID NO: 11274 - protein, 8 aa, Mycobacterium tuberculosis
AFFCPFVP

SEQ ID NO: 11275 - protein, 8 aa, Mycobacterium tuberculosis
FFCPFVPF

SEQ ID NO: 11276 - protein, 8 aa, Mycobacterium tuberculosis
FCPFVPFF

SEQ ID NO: 11277 - protein, 8 aa, Mycobacterium tuberculosis
CPFVPFFD

SEQ ID NO: 11278 - protein, 8 aa, Mycobacterium tuberculosis
PFVPFFDP

SEQ ID NO: 11279 - protein, 8 aa, Mycobacterium tuberculosis
FVPFFDPR

SEQ ID NO: 11280 - protein, 8 aa, Mycobacterium tuberculosis
VPFFDPRM

SEQ ID NO: 11281 - protein, 8 aa, Mycobacterium tuberculosis
PFFDPRMG

SEQ ID NO: 11282 - protein, 8 aa, Mycobacterium tuberculosis
FFDPRMGR

SEQ ID NO: 11283 - protein, 8 aa, Mycobacterium tuberculosis
FDPRMGRP

SEQ ID NO: 11284 - protein, 8 aa, Mycobacterium tuberculosis
DPRMGRPS

SEQ ID NO: 11285 - protein, 8 aa, Mycobacterium tuberculosis
PRMGRPSI

SEQ ID NO: 11286 - protein, 8 aa, Mycobacterium tuberculosis
RMGRPSIP

SEQ ID NO: 11287 - protein, 8 aa, Mycobacterium tuberculosis
MGRPSIPM

SEQ ID NO: 11288 - protein, 8 aa, Mycobacterium tuberculosis
GRPSIPME

SEQ ID NO: 11289 - protein, 8 aa, Mycobacterium tuberculosis
RPSIPMET

SEQ ID NO: 11290 - protein, 8 aa, Mycobacterium tuberculosis
PSIPMETY

SEQ ID NO: 11291 - protein, 8 aa, Mycobacterium tuberculosis
SIPMETYL

SEQ ID NO: 11292 - protein, 8 aa, Mycobacterium tuberculosis
IPMETYLR

SEQ ID NO: 11293 - protein, 8 aa, Mycobacterium tuberculosis
PMETYLRL

SEQ ID NO: 11294 - protein, 8 aa, Mycobacterium tuberculosis
METYLRLM

SEQ ID NO: 11295 - protein, 8 aa, Mycobacterium tuberculosis
ETYLRLMF

SEQ ID NO: 11296 - protein, 8 aa, Mycobacterium tuberculosis
TYLRLMFL

SEQ ID NO: 11297 - protein, 8 aa, Mycobacterium tuberculosis
YLRLMFLK

SEQ ID NO: 11298 - protein, 8 aa, Mycobacterium tuberculosis
LRLMFLKF

SEQ ID NO: 11299 - protein, 8 aa, Mycobacterium tuberculosis
RLMFLKFR

SEQ ID NO: 11300 - protein, 8 aa, Mycobacterium tuberculosis
LMFLKFRY

SEQ ID NO: 11301 - protein, 8 aa, Mycobacterium tuberculosis
MFLKFRYR

SEQ ID NO: 11302 - protein, 8 aa, Mycobacterium tuberculosis
FLKFRYRL

SEQ ID NO: 11303 - protein, 8 aa, Mycobacterium tuberculosis
LKFRYRLG

SEQ ID NO: 11304 - protein, 8 aa, Mycobacterium tuberculosis
KFRYRLGY

SEQ ID NO: 11305 - protein, 8 aa, Mycobacterium tuberculosis
FRYRLGYE

SEQ ID NO: 11306 - protein, 8 aa, Mycobacterium tuberculosis
RYRLGYES

SEQ ID NO: 11307 - protein, 8 aa, Mycobacterium tuberculosis
YRLGYESL

SEQ ID NO: 11308 - protein, 8 aa, Mycobacterium tuberculosis
RLGYESLC

SEQ ID NO: 11309 - protein, 8 aa, Mycobacterium tuberculosis
LGYESLCR

SEQ ID NO: 11310 - protein, 8 aa, Mycobacterium tuberculosis
GYESLCRE

SEQ ID NO: 11311 - protein, 8 aa, Mycobacterium tuberculosis
YESLCREV

SEQ ID NO: 11312 - protein, 8 aa, Mycobacterium tuberculosis
ESLCREVT

SEQ ID NO: 11313 - protein, 8 aa, Mycobacterium tuberculosis
SLCREVTD

SEQ ID NO: 11314 - protein, 8 aa, Mycobacterium tuberculosis
LCREVTDS

SEQ ID NO: 11315 - protein, 8 aa, Mycobacterium tuberculosis
CREVTDSI

SEQ ID NO: 11316 - protein, 8 aa, Mycobacterium tuberculosis
REVTDSIT

SEQ ID NO: 11317 - protein, 8 aa, Mycobacterium tuberculosis
EVTDSITW

SEQ ID NO: 11318 - protein, 8 aa, Mycobacterium tuberculosis
VTDSITWR

SEQ ID NO: 11319 - protein, 8 aa, Mycobacterium tuberculosis
TDSITWRR

SEQ ID NO: 11320 - protein, 8 aa, Mycobacterium tuberculosis
DSITWRRF

SEQ ID NO: 11321 - protein, 8 aa, Mycobacterium tuberculosis
SITWRRFC

SEQ ID NO: 11322 - protein, 8 aa, Mycobacterium tuberculosis
ITWRRFCR

SEQ ID NO: 11323 - protein, 8 aa, Mycobacterium tuberculosis
TWRRFCRI

SEQ ID NO: 11324 - protein, 8 aa, Mycobacterium tuberculosis
WRRFCRIP

SEQ ID NO: 11325 - protein, 8 aa, Mycobacterium tuberculosis
RRFCRIPL

SEQ ID NO: 11326 - protein, 8 aa, Mycobacterium tuberculosis
RFCRIPLE

SEQ ID NO: 11327 - protein, 8 aa, Mycobacterium tuberculosis
FCRIPLEG

SEQ ID NO: 11328 - protein, 8 aa, Mycobacterium tuberculosis
CRIPLEGS

SEQ ID NO: 11329 - protein, 8 aa, Mycobacterium tuberculosis
RIPLEGSV

SEQ ID NO: 11330 - protein, 8 aa, Mycobacterium tuberculosis
IPLEGSVP

SEQ ID NO: 11331 - protein, 8 aa, Mycobacterium tuberculosis
PLEGSVPH

SEQ ID NO: 11332 - protein, 8 aa, Mycobacterium tuberculosis
LEGSVPHP

SEQ ID NO: 11333 - protein, 8 aa, Mycobacterium tuberculosis
EGSVPHPT

SEQ ID NO: 11334 - protein, 8 aa, Mycobacterium tuberculosis
GSVPHPTT

SEQ ID NO: 11335 - protein, 8 aa, Mycobacterium tuberculosis
SVPHPTTL

SEQ ID NO: 11336 - protein, 8 aa, Mycobacterium tuberculosis
VPHPTTLM

SEQ ID NO: 11337 - protein, 8 aa, Mycobacterium tuberculosis
PHPTTLMK

SEQ ID NO: 11338 - protein, 8 aa, Mycobacterium tuberculosis
HPTTLMKL

SEQ ID NO: 11339 - protein, 8 aa, Mycobacterium tuberculosis
PTTLMKLT

SEQ ID NO: 11340 - protein, 8 aa, Mycobacterium tuberculosis
TTLMKLTT

SEQ ID NO: 11341 - protein, 8 aa, Mycobacterium tuberculosis
TLMKLTTR

SEQ ID NO: 11342 - protein, 8 aa, Mycobacterium tuberculosis
LMKLTTRC

SEQ ID NO: 11343 - protein, 8 aa, Mycobacterium tuberculosis
MKLTTRCG

SEQ ID NO: 11344 - protein, 8 aa, Mycobacterium tuberculosis
KLTTRCGE

SEQ ID NO: 11345 - protein, 8 aa, Mycobacterium tuberculosis
LTTRCGED

SEQ ID NO: 11346 - protein, 8 aa, Mycobacterium tuberculosis
TTRCGEDA

SEQ ID NO: 11347 - protein, 8 aa, Mycobacterium tuberculosis
TRCGEDAV

SEQ ID NO: 11348 - protein, 8 aa, Mycobacterium tuberculosis
RCGEDAVA

SEQ ID NO: 11349 - protein, 8 aa, Mycobacterium tuberculosis
CGEDAVAG

SEQ ID NO: 11350 - protein, 8 aa, Mycobacterium tuberculosis
GEDAVAGL

SEQ ID NO: 11351 - protein, 8 aa, Mycobacterium tuberculosis
EDAVAGLN

SEQ ID NO: 11352 - protein, 8 aa, Mycobacterium tuberculosis
DAVAGLNE

SEQ ID NO: 11353 - protein, 8 aa, Mycobacterium tuberculosis
AVAGLNEA

SEQ ID NO: 11354 - protein, 8 aa, Mycobacterium tuberculosis
VAGLNEAL

SEQ ID NO: 11355 - protein, 8 aa, Mycobacterium tuberculosis
AGLNEALL

SEQ ID NO: 11356 - protein, 8 aa, Mycobacterium tuberculosis
GLNEALLA

SEQ ID NO: 11357 - protein, 8 aa, Mycobacterium tuberculosis
LNEALLAK

SEQ ID NO: 11358 - protein, 8 aa, Mycobacterium tuberculosis
NEALLAKA

SEQ ID NO: 11359 - protein, 8 aa, Mycobacterium tuberculosis
EALLAKAA

SEQ ID NO: 11360 - protein, 8 aa, Mycobacterium tuberculosis
ALLAKAAS

SEQ ID NO: 11361 - protein, 8 aa, Mycobacterium tuberculosis
LLAKAASE

SEQ ID NO: 11362 - protein, 8 aa, Mycobacterium tuberculosis
LAKAASEK

SEQ ID NO: 11363 - protein, 8 aa, Mycobacterium tuberculosis
AKAASEKL

SEQ ID NO: 11364 - protein, 8 aa, Mycobacterium tuberculosis
KAASEKLL

SEQ ID NO: 11365 - protein, 8 aa, Mycobacterium tuberculosis
AASEKLLR

SEQ ID NO: 11366 - protein, 8 aa, Mycobacterium tuberculosis
ASEKLLRT

SEQ ID NO: 11367 - protein, 8 aa, Mycobacterium tuberculosis
SEKLLRTN

SEQ ID NO: 11368 - protein, 8 aa, Mycobacterium tuberculosis
EKLLRTNK

SEQ ID NO: 11369 - protein, 8 aa, Mycobacterium tuberculosis
KLLRTNKV

SEQ ID NO: 11370 - protein, 8 aa, Mycobacterium tuberculosis
LLRTNKVR

SEQ ID NO: 11371 - protein, 8 aa, Mycobacterium tuberculosis
LRTNKVRA

SEQ ID NO: 11372 - protein, 8 aa, Mycobacterium tuberculosis
RTNKVRAD

SEQ ID NO: 11373 - protein, 8 aa, Mycobacterium tuberculosis
TNKVRADT

SEQ ID NO: 11374 - protein, 8 aa, Mycobacterium tuberculosis
NKVRADTT

SEQ ID NO: 11375 - protein, 8 aa, Mycobacterium tuberculosis
KVRADTTV

SEQ ID NO: 11376 - protein, 8 aa, Mycobacterium tuberculosis
VRADTTVV

SEQ ID NO: 11377 - protein, 8 aa, Mycobacterium tuberculosis
RADTTVVE

SEQ ID NO: 11378 - protein, 8 aa, Mycobacterium tuberculosis
ADTTVVEG

SEQ ID NO: 11379 - protein, 8 aa, Mycobacterium tuberculosis
DTTVVEGD

SEQ ID NO: 11380 - protein, 8 aa, Mycobacterium tuberculosis
TTVVEGDV

SEQ ID NO: 11381 - protein, 8 aa, Mycobacterium tuberculosis
TVVEGDVG

SEQ ID NO: 11382 - protein, 8 aa, Mycobacterium tuberculosis
VVEGDVGY

SEQ ID NO: 11383 - protein, 8 aa, Mycobacterium tuberculosis
VEGDVGYP

SEQ ID NO: 11384 - protein, 8 aa, Mycobacterium tuberculosis
EGDVGYPT

SEQ ID NO: 11385 - protein, 8 aa, Mycobacterium tuberculosis
GDVGYPTD

SEQ ID NO: 11386 - protein, 8 aa, Mycobacterium tuberculosis
DVGYPTDT

SEQ ID NO: 11387 - protein, 8 aa, Mycobacterium tuberculosis
VGYPTDTG

SEQ ID NO: 11388 - protein, 8 aa, Mycobacterium tuberculosis
GYPTDTGL

SEQ ID NO: 11389 - protein, 8 aa, Mycobacterium tuberculosis
YPTDTGLL

SEQ ID NO: 11390 - protein, 8 aa, Mycobacterium tuberculosis
PTDTGLLA

SEQ ID NO: 11391 - protein, 8 aa, Mycobacterium tuberculosis
TDTGLLAK

SEQ ID NO: 11392 - protein, 8 aa, Mycobacterium tuberculosis
DTGLLAKA

SEQ ID NO: 11393 - protein, 8 aa, Mycobacterium tuberculosis
TGLLAKAV

SEQ ID NO: 11394 - protein, 8 aa, Mycobacterium tuberculosis
GLLAKAVG

SEQ ID NO: 11395 - protein, 8 aa, Mycobacterium tuberculosis
LLAKAVGS

SEQ ID NO: 11396 - protein, 8 aa, Mycobacterium tuberculosis
LAKAVGSM

SEQ ID NO: 11397 - protein, 8 aa, Mycobacterium tuberculosis
AKAVGSMA

SEQ ID NO: 11398 - protein, 8 aa, Mycobacterium tuberculosis
KAVGSMAR

SEQ ID NO: 11399 - protein, 8 aa, Mycobacterium tuberculosis
AVGSMART

SEQ ID NO: 11400 - protein, 8 aa, Mycobacterium tuberculosis
VGSMARTV

SEQ ID NO: 11401 - protein, 8 aa, Mycobacterium tuberculosis
GSMARTVA

SEQ ID NO: 11402 - protein, 8 aa, Mycobacterium tuberculosis
SMARTVAR

SEQ ID NO: 11403 - protein, 8 aa, Mycobacterium tuberculosis
MARTVARI

SEQ ID NO: 11404 - protein, 8 aa, Mycobacterium tuberculosis
ARTVARIK

SEQ ID NO: 11405 - protein, 8 aa, Mycobacterium tuberculosis
RTVARIKA

SEQ ID NO: 11406 - protein, 8 aa, Mycobacterium tuberculosis
TVARIKAA

SEQ ID NO: 11407 - protein, 8 aa, Mycobacterium tuberculosis
VARIKAAD

SEQ ID NO: 11408 - protein, 8 aa, Mycobacterium tuberculosis
ARIKAADA

SEQ ID NO: 11409 - protein, 8 aa, Mycobacterium tuberculosis
RIKAADAG

SEQ ID NO: 11410 - protein, 8 aa, Mycobacterium tuberculosis
IKAADAGS

SEQ ID NO: 11411 - protein, 8 aa, Mycobacterium tuberculosis
KAADAGSA

SEQ ID NO: 11412 - protein, 8 aa, Mycobacterium tuberculosis
AADAGSAP

SEQ ID NO: 11413 - protein, 8 aa, Mycobacterium tuberculosis
ADAGSAPL

SEQ ID NO: 11414 - protein, 8 aa, Mycobacterium tuberculosis
DAGSAPLG

SEQ ID NO: 11415 - protein, 8 aa, Mycobacterium tuberculosis
AGSAPLGG

SEQ ID NO: 11416 - protein, 8 aa, Mycobacterium tuberculosis
GSAPLGGS

SEQ ID NO: 11417 - protein, 8 aa, Mycobacterium tuberculosis
SAPLGGSS

SEQ ID NO: 11418 - protein, 8 aa, Mycobacterium tuberculosis
APLGGSSG

SEQ ID NO: 11419 - protein, 8 aa, Mycobacterium tuberculosis
PLGGSSGP

SEQ ID NO: 11420 - protein, 8 aa, Mycobacterium tuberculosis
LGGSSGPR

SEQ ID NO: 11421 - protein, 8 aa, Mycobacterium tuberculosis
GGSSGPRD

SEQ ID NO: 11422 - protein, 8 aa, Mycobacterium tuberculosis
GSSGPRDR

SEQ ID NO: 11423 - protein, 8 aa, Mycobacterium tuberculosis
SSGPRDRL

SEQ ID NO: 11424 - protein, 8 aa, Mycobacterium tuberculosis
SGPRDRLQ

SEQ ID NO: 11425 - protein, 8 aa, Mycobacterium tuberculosis
GPRDRLQA

SEQ ID NO: 11426 - protein, 8 aa, Mycobacterium tuberculosis
PRDRLQAA

SEQ ID NO: 11427 - protein, 8 aa, Mycobacterium tuberculosis
RDRLQAAV

SEQ ID NO: 11428 - protein, 8 aa, Mycobacterium tuberculosis
DRLQAAVT

SEQ ID NO: 11429 - protein, 8 aa, Mycobacterium tuberculosis
RLQAAVTR

SEQ ID NO: 11430 - protein, 8 aa, Mycobacterium tuberculosis
LQAAVTRR

SEQ ID NO: 11431 - protein, 8 aa, Mycobacterium tuberculosis
QAAVTRRA

SEQ ID NO: 11432 - protein, 8 aa, Mycobacterium tuberculosis
AAVTRRAA

SEQ ID NO: 11433 - protein, 8 aa, Mycobacterium tuberculosis
AVTRRAAT

SEQ ID NO: 11434 - protein, 8 aa, Mycobacterium tuberculosis
VTRRAATR

SEQ ID NO: 11435 - protein, 8 aa, Mycobacterium tuberculosis
TRRAATRS

SEQ ID NO: 11436 - protein, 8 aa, Mycobacterium tuberculosis
RRAATRSG

SEQ ID NO: 11437 - protein, 8 aa, Mycobacterium tuberculosis
RAATRSGA

SEQ ID NO: 11438 - protein, 8 aa, Mycobacterium tuberculosis
AATRSGAG

SEQ ID NO: 11439 - protein, 8 aa, Mycobacterium tuberculosis
ATRSGAGL

SEQ ID NO: 11440 - protein, 8 aa, Mycobacterium tuberculosis
TRSGAGLR

SEQ ID NO: 11441 - protein, 8 aa, Mycobacterium tuberculosis
RSGAGLRA

SEQ ID NO: 11442 - protein, 8 aa, Mycobacterium tuberculosis
SGAGLRAP

SEQ ID NO: 11443 - protein, 8 aa, Mycobacterium tuberculosis
GAGLRAPD

SEQ ID NO: 11444 - protein, 8 aa, Mycobacterium tuberculosis
AGLRAPDH

SEQ ID NO: 11445 - protein, 8 aa, Mycobacterium tuberculosis
GLRAPDHR

SEQ ID NO: 11446 - protein, 8 aa, Mycobacterium tuberculosis
LRAPDHRG

SEQ ID NO: 11447 - protein, 8 aa, Mycobacterium tuberculosis
RAPDHRGA

SEQ ID NO: 11448 - protein, 8 aa, Mycobacterium tuberculosis
APDHRGAS

SEQ ID NO: 11449 - protein, 8 aa, Mycobacterium tuberculosis
PDHRGASR

SEQ ID NO: 11450 - protein, 8 aa, Mycobacterium tuberculosis
DHRGASRD

SEQ ID NO: 11451 - protein, 8 aa, Mycobacterium tuberculosis
HRGASRDR

SEQ ID NO: 11452 - protein, 8 aa, Mycobacterium tuberculosis
RGASRDRR

SEQ ID NO: 11453 - protein, 8 aa, Mycobacterium tuberculosis
GASRDRRA

SEQ ID NO: 11454 - protein, 8 aa, Mycobacterium tuberculosis
ASRDRRAG

SEQ ID NO: 11455 - protein, 8 aa, Mycobacterium tuberculosis
SRDRRAGA

SEQ ID NO: 11456 - protein, 8 aa, Mycobacterium tuberculosis
RDRRAGAD

SEQ ID NO: 11457 - protein, 8 aa, Mycobacterium tuberculosis
DRRAGADR

SEQ ID NO: 11458 - protein, 8 aa, Mycobacterium tuberculosis
RRAGADRG

SEQ ID NO: 11459 - protein, 8 aa, Mycobacterium tuberculosis
RAGADRGC

SEQ ID NO: 11460 - protein, 8 aa, Mycobacterium tuberculosis
AGADRGCR

SEQ ID NO: 11461 - protein, 8 aa, Mycobacterium tuberculosis
GADRGCRG

SEQ ID NO: 11462 - protein, 8 aa, Mycobacterium tuberculosis
ADRGCRGG

SEQ ID NO: 11463 - protein, 8 aa, Mycobacterium tuberculosis
DRGCRGGT

SEQ ID NO: 11464 - protein, 9 aa, Mycobacterium tuberculosis
MFRTVGDQA

SEQ ID NO: 11465 - protein, 9 aa, Mycobacterium tuberculosis
FRTVGDQAS

SEQ ID NO: 11466 - protein, 9 aa, Mycobacterium tuberculosis
RTVGDQASL

SEQ ID NO: 11467 - protein, 9 aa, Mycobacterium tuberculosis
TVGDQASLW

SEQ ID NO: 11468 - protein, 9 aa, Mycobacterium tuberculosis
VGDQASLWE

SEQ ID NO: 11469 - protein, 9 aa, Mycobacterium tuberculosis
GDQASLWES

SEQ ID NO: 11470 - protein, 9 aa, Mycobacterium tuberculosis
DQASLWESV

SEQ ID NO: 11471 - protein, 9 aa, Mycobacterium tuberculosis
QASLWESVL

SEQ ID NO: 11472 - protein, 9 aa, Mycobacterium tuberculosis
ASLWESVLP

SEQ ID NO: 11473 - protein, 9 aa, Mycobacterium tuberculosis
SLWESVLPE

SEQ ID NO: 11474 - protein, 9 aa, Mycobacterium tuberculosis
LWESVLPEE

SEQ ID NO: 11475 - protein, 9 aa, Mycobacterium tuberculosis
WESVLPEEL

SEQ ID NO: 11476 - protein, 9 aa, Mycobacterium tuberculosis
ESVLPEELR

SEQ ID NO: 11477 - protein, 9 aa, Mycobacterium tuberculosis
SVLPEELRR

SEQ ID NO: 11478 - protein, 9 aa, Mycobacterium tuberculosis
VLPEELRRL

SEQ ID NO: 11479 - protein, 9 aa, Mycobacterium tuberculosis
LPEELRRLP

SEQ ID NO: 11480 - protein, 9 aa, Mycobacterium tuberculosis
PEELRRLPE

SEQ ID NO: 11481 - protein, 9 aa, Mycobacterium tuberculosis
EELRRLPEE

SEQ ID NO: 11482 - protein, 9 aa, Mycobacterium tuberculosis
ELRRLPEEL

SEQ ID NO: 11483 - protein, 9 aa, Mycobacterium tuberculosis
LRRLPEELA

SEQ ID NO: 11484 - protein, 9 aa, Mycobacterium tuberculosis
RRLPEELAR

SEQ ID NO: 11485 - protein, 9 aa, Mycobacterium tuberculosis
RLPEELARV

SEQ ID NO: 11486 - protein, 9 aa, Mycobacterium tuberculosis
LPEELARVD

SEQ ID NO: 11487 - protein, 9 aa, Mycobacterium tuberculosis
PEELARVDA

SEQ ID NO: 11488 - protein, 9 aa, Mycobacterium tuberculosis
EELARVDAL

SEQ ID NO: 11489 - protein, 9 aa, Mycobacterium tuberculosis
ELARVDALL

SEQ ID NO: 11490 - protein, 9 aa, Mycobacterium tuberculosis
LARVDALLD

SEQ ID NO: 11491 - protein, 9 aa, Mycobacterium tuberculosis
ARVDALLDD

SEQ ID NO: 11492 - protein, 9 aa, Mycobacterium tuberculosis
RVDALLDDS

SEQ ID NO: 11493 - protein, 9 aa, Mycobacterium tuberculosis
VDALLDDSA

SEQ ID NO: 11494 - protein, 9 aa, Mycobacterium tuberculosis
DALLDDSAF

SEQ ID NO: 11495 - protein, 9 aa, Mycobacterium tuberculosis
ALLDDSAFF

SEQ ID NO: 11496 - protein, 9 aa, Mycobacterium tuberculosis
LLDDSAFFC

SEQ ID NO: 11497 - protein, 9 aa, Mycobacterium tuberculosis
LDDSAFFCP

SEQ ID NO: 11498 - protein, 9 aa, Mycobacterium tuberculosis
DDSAFFCPF

SEQ ID NO: 11499 - protein, 9 aa, Mycobacterium tuberculosis
DSAFFCPFV

SEQ ID NO: 11500 - protein, 9 aa, Mycobacterium tuberculosis
SAFFCPFVP

SEQ ID NO: 11501 - protein, 9 aa, Mycobacterium tuberculosis
AFFCPFVPF

SEQ ID NO: 11502 - protein, 9 aa, Mycobacterium tuberculosis
FFCPFVPFF

SEQ ID NO: 11503 - protein, 9 aa, Mycobacterium tuberculosis
FCPFVPFFD

SEQ ID NO: 11504 - protein, 9 aa, Mycobacterium tuberculosis
CPFVPFFDP

SEQ ID NO: 11505 - protein, 9 aa, Mycobacterium tuberculosis
PFVPFFDPR

SEQ ID NO: 11506 - protein, 9 aa, Mycobacterium tuberculosis
FVPFFDPRM

SEQ ID NO: 11507 - protein, 9 aa, Mycobacterium tuberculosis
VPFFDPRMG

SEQ ID NO: 11508 - protein, 9 aa, Mycobacterium tuberculosis
PFFDPRMGR

SEQ ID NO: 11509 - protein, 9 aa, Mycobacterium tuberculosis
FFDPRMGRP

SEQ ID NO: 11510 - protein, 9 aa, Mycobacterium tuberculosis
FDPRMGRPS

SEQ ID NO: 11511 - protein, 9 aa, Mycobacterium tuberculosis
DPRMGRPSI

SEQ ID NO: 11512 - protein, 9 aa, Mycobacterium tuberculosis
PRMGRPSIP

SEQ ID NO: 11513 - protein, 9 aa, Mycobacterium tuberculosis
RMGRPSIPM

SEQ ID NO: 11514 - protein, 9 aa, Mycobacterium tuberculosis
MGRPSIPME

SEQ ID NO: 11515 - protein, 9 aa, Mycobacterium tuberculosis
GRPSIPMET

SEQ ID NO: 11516 - protein, 9 aa, Mycobacterium tuberculosis
RPSIPMETY

SEQ ID NO: 11517 - protein, 9 aa, Mycobacterium tuberculosis
PSIPMETYL

SEQ ID NO: 11518 - protein, 9 aa, Mycobacterium tuberculosis
SIPMETYLR

SEQ ID NO: 11519 - protein, 9 aa, Mycobacterium tuberculosis
IPMETYLRL

SEQ ID NO: 11520 - protein, 9 aa, Mycobacterium tuberculosis
PMETYLRLM

SEQ ID NO: 11521 - protein, 9 aa, Mycobacterium tuberculosis
METYLRLMF

SEQ ID NO: 11522 - protein, 9 aa, Mycobacterium tuberculosis
ETYLRLMFL

SEQ ID NO: 11523 - protein, 9 aa, Mycobacterium tuberculosis
TYLRLMFLK

SEQ ID NO: 11524 - protein, 9 aa, Mycobacterium tuberculosis
YLRLMFLKF

SEQ ID NO: 11525 - protein, 9 aa, Mycobacterium tuberculosis
LRLMFLKFR

SEQ ID NO: 11526 - protein, 9 aa, Mycobacterium tuberculosis
RLMFLKFRY

SEQ ID NO: 11527 - protein, 9 aa, Mycobacterium tuberculosis
LMFLKFRYR

SEQ ID NO: 11528 - protein, 9 aa, Mycobacterium tuberculosis
MFLKFRYRL

SEQ ID NO: 11529 - protein, 9 aa, Mycobacterium tuberculosis
FLKFRYRLG

SEQ ID NO: 11530 - protein, 9 aa, Mycobacterium tuberculosis
LKFRYRLGY

SEQ ID NO: 11531 - protein, 9 aa, Mycobacterium tuberculosis
KFRYRLGYE

SEQ ID NO: 11532 - protein, 9 aa, Mycobacterium tuberculosis
FRYRLGYES

SEQ ID NO: 11533 - protein, 9 aa, Mycobacterium tuberculosis
RYRLGYESL

SEQ ID NO: 11534 - protein, 9 aa, Mycobacterium tuberculosis
YRLGYESLC

SEQ ID NO: 11535 - protein, 9 aa, Mycobacterium tuberculosis
RLGYESLCR

SEQ ID NO: 11536 - protein, 9 aa, Mycobacterium tuberculosis
LGYESLCRE

SEQ ID NO: 11537 - protein, 9 aa, Mycobacterium tuberculosis
GYESLCREV

SEQ ID NO: 11538 - protein, 9 aa, Mycobacterium tuberculosis
YESLCREVT

SEQ ID NO: 11539 - protein, 9 aa, Mycobacterium tuberculosis
ESLCREVTD

SEQ ID NO: 11540 - protein, 9 aa, Mycobacterium tuberculosis
SLCREVTDS

SEQ ID NO: 11541 - protein, 9 aa, Mycobacterium tuberculosis
LCREVTDSI

SEQ ID NO: 11542 - protein, 9 aa, Mycobacterium tuberculosis
CREVTDSIT

SEQ ID NO: 11543 - protein, 9 aa, Mycobacterium tuberculosis
REVTDSITW

SEQ ID NO: 11544 - protein, 9 aa, Mycobacterium tuberculosis
EVTDSITWR

SEQ ID NO: 11545 - protein, 9 aa, Mycobacterium tuberculosis
VTDSITWRR

SEQ ID NO: 11546 - protein, 9 aa, Mycobacterium tuberculosis
TDSITWRRF

SEQ ID NO: 11547 - protein, 9 aa, Mycobacterium tuberculosis
DSITWRRFC

SEQ ID NO: 11548 - protein, 9 aa, Mycobacterium tuberculosis
SITWRRFCR

SEQ ID NO: 11549 - protein, 9 aa, Mycobacterium tuberculosis
ITWRRFCRI

SEQ ID NO: 11550 - protein, 9 aa, Mycobacterium tuberculosis
TWRRFCRIP

SEQ ID NO: 11551 - protein, 9 aa, Mycobacterium tuberculosis
WRRFCRIPL

SEQ ID NO: 11552 - protein, 9 aa, Mycobacterium tuberculosis
RRFCRIPLE

SEQ ID NO: 11553 - protein, 9 aa, Mycobacterium tuberculosis
RFCRIPLEG

SEQ ID NO: 11554 - protein, 9 aa, Mycobacterium tuberculosis
FCRIPLEGS

SEQ ID NO: 11555 - protein, 9 aa, Mycobacterium tuberculosis
CRIPLEGSV

SEQ ID NO: 11556 - protein, 9 aa, Mycobacterium tuberculosis
RIPLEGSVP

SEQ ID NO: 11557 - protein, 9 aa, Mycobacterium tuberculosis
IPLEGSVPH

SEQ ID NO: 11558 - protein, 9 aa, Mycobacterium tuberculosis
PLEGSVPHP

SEQ ID NO: 11559 - protein, 9 aa, Mycobacterium tuberculosis
LEGSVPHPT

SEQ ID NO: 11560 - protein, 9 aa, Mycobacterium tuberculosis
EGSVPHPTT

SEQ ID NO: 11561 - protein, 9 aa, Mycobacterium tuberculosis
GSVPHPTTL

SEQ ID NO: 11562 - protein, 9 aa, Mycobacterium tuberculosis
SVPHPTTLM

SEQ ID NO: 11563 - protein, 9 aa, Mycobacterium tuberculosis
VPHPTTLMK

SEQ ID NO: 11564 - protein, 9 aa, Mycobacterium tuberculosis
PHPTTLMKL

SEQ ID NO: 11565 - protein, 9 aa, Mycobacterium tuberculosis
HPTTLMKLT

SEQ ID NO: 11566 - protein, 9 aa, Mycobacterium tuberculosis
PTTLMKLTT

SEQ ID NO: 11567 - protein, 9 aa, Mycobacterium tuberculosis
TTLMKLTTR

SEQ ID NO: 11568 - protein, 9 aa, Mycobacterium tuberculosis
TLMKLTTRC

SEQ ID NO: 11569 - protein, 9 aa, Mycobacterium tuberculosis
LMKLTTRCG

SEQ ID NO: 11570 - protein, 9 aa, Mycobacterium tuberculosis
MKLTTRCGE

SEQ ID NO: 11571 - protein, 9 aa, Mycobacterium tuberculosis
KLTTRCGED

SEQ ID NO: 11572 - protein, 9 aa, Mycobacterium tuberculosis
LTTRCGEDA

SEQ ID NO: 11573 - protein, 9 aa, Mycobacterium tuberculosis
TTRCGEDAV

SEQ ID NO: 11574 - protein, 9 aa, Mycobacterium tuberculosis
TRCGEDAVA

SEQ ID NO: 11575 - protein, 9 aa, Mycobacterium tuberculosis
RCGEDAVAG

SEQ ID NO: 11576 - protein, 9 aa, Mycobacterium tuberculosis
CGEDAVAGL

SEQ ID NO: 11577 - protein, 9 aa, Mycobacterium tuberculosis
GEDAVAGLN

SEQ ID NO: 11578 - protein, 9 aa, Mycobacterium tuberculosis
EDAVAGLNE

SEQ ID NO: 11579 - protein, 9 aa, Mycobacterium tuberculosis
DAVAGLNEA

SEQ ID NO: 11580 - protein, 9 aa, Mycobacterium tuberculosis
AVAGLNEAL

SEQ ID NO: 11581 - protein, 9 aa, Mycobacterium tuberculosis
VAGLNEALL

SEQ ID NO: 11582 - protein, 9 aa, Mycobacterium tuberculosis
AGLNEALLA

SEQ ID NO: 11583 - protein, 9 aa, Mycobacterium tuberculosis
GLNEALLAK

SEQ ID NO: 11584 - protein, 9 aa, Mycobacterium tuberculosis
LNEALLAKA

SEQ ID NO: 11585 - protein, 9 aa, Mycobacterium tuberculosis
NEALLAKAA

SEQ ID NO: 11586 - protein, 9 aa, Mycobacterium tuberculosis
EALLAKAAS

SEQ ID NO: 11587 - protein, 9 aa, Mycobacterium tuberculosis
ALLAKAASE

SEQ ID NO: 11588 - protein, 9 aa, Mycobacterium tuberculosis
LLAKAASEK

SEQ ID NO: 11589 - protein, 9 aa, Mycobacterium tuberculosis
LAKAASEKL

SEQ ID NO: 11590 - protein, 9 aa, Mycobacterium tuberculosis
AKAASEKLL

SEQ ID NO: 11591 - protein, 9 aa, Mycobacterium tuberculosis
KAASEKLLR

SEQ ID NO: 11592 - protein, 9 aa, Mycobacterium tuberculosis
AASEKLLRT

SEQ ID NO: 11593 - protein, 9 aa, Mycobacterium tuberculosis
ASEKLLRTN

SEQ ID NO: 11594 - protein, 9 aa, Mycobacterium tuberculosis
SEKLLRTNK

SEQ ID NO: 11595 - protein, 9 aa, Mycobacterium tuberculosis
EKLLRTNKV

SEQ ID NO: 11596 - protein, 9 aa, Mycobacterium tuberculosis
KLLRTNKVR

SEQ ID NO: 11597 - protein, 9 aa, Mycobacterium tuberculosis
LLRTNKVRA

SEQ ID NO: 11598 - protein, 9 aa, Mycobacterium tuberculosis
LRTNKVRAD

SEQ ID NO: 11599 - protein, 9 aa, Mycobacterium tuberculosis
RTNKVRADT

SEQ ID NO: 11600 - protein, 9 aa, Mycobacterium tuberculosis
TNKVRADTT

SEQ ID NO: 11601 - protein, 9 aa, Mycobacterium tuberculosis
NKVRADTTV

SEQ ID NO: 11602 - protein, 9 aa, Mycobacterium tuberculosis
KVRADTTVV

SEQ ID NO: 11603 - protein, 9 aa, Mycobacterium tuberculosis
VRADTTVVE

SEQ ID NO: 11604 - protein, 9 aa, Mycobacterium tuberculosis
RADTTVVEG

SEQ ID NO: 11605 - protein, 9 aa, Mycobacterium tuberculosis
ADTTVVEGD

SEQ ID NO: 11606 - protein, 9 aa, Mycobacterium tuberculosis
DTTVVEGDV

SEQ ID NO: 11607 - protein, 9 aa, Mycobacterium tuberculosis
TTVVEGDVG

SEQ ID NO: 11608 - protein, 9 aa, Mycobacterium tuberculosis
TVVEGDVGY

SEQ ID NO: 11609 - protein, 9 aa, Mycobacterium tuberculosis
VVEGDVGYP

SEQ ID NO: 11610 - protein, 9 aa, Mycobacterium tuberculosis
VEGDVGYPT

SEQ ID NO: 11611 - protein, 9 aa, Mycobacterium tuberculosis
EGDVGYPTD

SEQ ID NO: 11612 - protein, 9 aa, Mycobacterium tuberculosis
GDVGYPTDT

SEQ ID NO: 11613 - protein, 9 aa, Mycobacterium tuberculosis
DVGYPTDTG

SEQ ID NO: 11614 - protein, 9 aa, Mycobacterium tuberculosis
VGYPTDTGL

SEQ ID NO: 11615 - protein, 9 aa, Mycobacterium tuberculosis
GYPTDTGLL

SEQ ID NO: 11616 - protein, 9 aa, Mycobacterium tuberculosis
YPTDTGLLA

SEQ ID NO: 11617 - protein, 9 aa, Mycobacterium tuberculosis
PTDTGLLAK

SEQ ID NO: 11618 - protein, 9 aa, Mycobacterium tuberculosis
TDTGLLAKA

SEQ ID NO: 11619 - protein, 9 aa, Mycobacterium tuberculosis
DTGLLAKAV

SEQ ID NO: 11620 - protein, 9 aa, Mycobacterium tuberculosis
TGLLAKAVG

SEQ ID NO: 11621 - protein, 9 aa, Mycobacterium tuberculosis
GLLAKAVGS

SEQ ID NO: 11622 - protein, 9 aa, Mycobacterium tuberculosis
LLAKAVGSM

SEQ ID NO: 11623 - protein, 9 aa, Mycobacterium tuberculosis
LAKAVGSMA

SEQ ID NO: 11624 - protein, 9 aa, Mycobacterium tuberculosis
AKAVGSMAR

SEQ ID NO: 11625 - protein, 9 aa, Mycobacterium tuberculosis
KAVGSMART

SEQ ID NO: 11626 - protein, 9 aa, Mycobacterium tuberculosis
AVGSMARTV

SEQ ID NO: 11627 - protein, 9 aa, Mycobacterium tuberculosis
VGSMARTVA

SEQ ID NO: 11628 - protein, 9 aa, Mycobacterium tuberculosis
GSMARTVAR

SEQ ID NO: 11629 - protein, 9 aa, Mycobacterium tuberculosis
SMARTVARI

SEQ ID NO: 11630 - protein, 9 aa, Mycobacterium tuberculosis
MARTVARIK

SEQ ID NO: 11631 - protein, 9 aa, Mycobacterium tuberculosis
ARTVARIKA

SEQ ID NO: 11632 - protein, 9 aa, Mycobacterium tuberculosis
RTVARIKAA

SEQ ID NO: 11633 - protein, 9 aa, Mycobacterium tuberculosis
TVARIKAAD

SEQ ID NO: 11634 - protein, 9 aa, Mycobacterium tuberculosis
VARIKAADA

SEQ ID NO: 11635 - protein, 9 aa, Mycobacterium tuberculosis
ARIKAADAG

SEQ ID NO: 11636 - protein, 9 aa, Mycobacterium tuberculosis
RIKAADAGS

SEQ ID NO: 11637 - protein, 9 aa, Mycobacterium tuberculosis
IKAADAGSA

SEQ ID NO: 11638 - protein, 9 aa, Mycobacterium tuberculosis
KAADAGSAP

SEQ ID NO: 11639 - protein, 9 aa, Mycobacterium tuberculosis
AADAGSAPL

SEQ ID NO: 11640 - protein, 9 aa, Mycobacterium tuberculosis
ADAGSAPLG

SEQ ID NO: 11641 - protein, 9 aa, Mycobacterium tuberculosis
DAGSAPLGG

SEQ ID NO: 11642 - protein, 9 aa, Mycobacterium tuberculosis
AGSAPLGGS

SEQ ID NO: 11643 - protein, 9 aa, Mycobacterium tuberculosis
GSAPLGGSS

SEQ ID NO: 11644 - protein, 9 aa, Mycobacterium tuberculosis
SAPLGGSSG

SEQ ID NO: 11645 - protein, 9 aa, Mycobacterium tuberculosis
APLGGSSGP

SEQ ID NO: 11646 - protein, 9 aa, Mycobacterium tuberculosis
PLGGSSGPR

SEQ ID NO: 11647 - protein, 9 aa, Mycobacterium tuberculosis
LGGSSGPRD

SEQ ID NO: 11648 - protein, 9 aa, Mycobacterium tuberculosis
GGSSGPRDR

SEQ ID NO: 11649 - protein, 9 aa, Mycobacterium tuberculosis
GSSGPRDRL

SEQ ID NO: 11650 - protein, 9 aa, Mycobacterium tuberculosis
SSGPRDRLQ

SEQ ID NO: 11651 - protein, 9 aa, Mycobacterium tuberculosis
SGPRDRLQA

SEQ ID NO: 11652 - protein, 9 aa, Mycobacterium tuberculosis
GPRDRLQAA

SEQ ID NO: 11653 - protein, 9 aa, Mycobacterium tuberculosis
PRDRLQAAV

SEQ ID NO: 11654 - protein, 9 aa, Mycobacterium tuberculosis
RDRLQAAVT

SEQ ID NO: 11655 - protein, 9 aa, Mycobacterium tuberculosis
DRLQAAVTR

SEQ ID NO: 11656 - protein, 9 aa, Mycobacterium tuberculosis
RLQAAVTRR

SEQ ID NO: 11657 - protein, 9 aa, Mycobacterium tuberculosis
LQAAVTRRA

SEQ ID NO: 11658 - protein, 9 aa, Mycobacterium tuberculosis
QAAVTRRAA

SEQ ID NO: 11659 - protein, 9 aa, Mycobacterium tuberculosis
AAVTRRAAT

SEQ ID NO: 11660 - protein, 9 aa, Mycobacterium tuberculosis
AVTRRAATR

SEQ ID NO: 11661 - protein, 9 aa, Mycobacterium tuberculosis
VTRRAATRS

SEQ ID NO: 11662 - protein, 9 aa, Mycobacterium tuberculosis
TRRAATRSG

SEQ ID NO: 11663 - protein, 9 aa, Mycobacterium tuberculosis
RRAATRSGA

SEQ ID NO: 11664 - protein, 9 aa, Mycobacterium tuberculosis
RAATRSGAG

SEQ ID NO: 11665 - protein, 9 aa, Mycobacterium tuberculosis
AATRSGAGL

SEQ ID NO: 11666 - protein, 9 aa, Mycobacterium tuberculosis
ATRSGAGLR

SEQ ID NO: 11667 - protein, 9 aa, Mycobacterium tuberculosis
TRSGAGLRA

SEQ ID NO: 11668 - protein, 9 aa, Mycobacterium tuberculosis
RSGAGLRAP

SEQ ID NO: 11669 - protein, 9 aa, Mycobacterium tuberculosis
SGAGLRAPD

SEQ ID NO: 11670 - protein, 9 aa, Mycobacterium tuberculosis
GAGLRAPDH

SEQ ID NO: 11671 - protein, 9 aa, Mycobacterium tuberculosis
AGLRAPDHR

SEQ ID NO: 11672 - protein, 9 aa, Mycobacterium tuberculosis
GLRAPDHRG

SEQ ID NO: 11673 - protein, 9 aa, Mycobacterium tuberculosis
LRAPDHRGA

SEQ ID NO: 11674 - protein, 9 aa, Mycobacterium tuberculosis
RAPDHRGAS

SEQ ID NO: 11675 - protein, 9 aa, Mycobacterium tuberculosis
APDHRGASR

SEQ ID NO: 11676 - protein, 9 aa, Mycobacterium tuberculosis
PDHRGASRD

SEQ ID NO: 11677 - protein, 9 aa, Mycobacterium tuberculosis
DHRGASRDR

SEQ ID NO: 11678 - protein, 9 aa, Mycobacterium tuberculosis
HRGASRDRR

SEQ ID NO: 11679 - protein, 9 aa, Mycobacterium tuberculosis
RGASRDRRA

SEQ ID NO: 11680 - protein, 9 aa, Mycobacterium tuberculosis
GASRDRRAG

SEQ ID NO: 11681 - protein, 9 aa, Mycobacterium tuberculosis
ASRDRRAGA

SEQ ID NO: 11682 - protein, 9 aa, Mycobacterium tuberculosis
SRDRRAGAD

SEQ ID NO: 11683 - protein, 9 aa, Mycobacterium tuberculosis
RDRRAGADR

SEQ ID NO: 11684 - protein, 9 aa, Mycobacterium tuberculosis
DRRAGADRG

SEQ ID NO: 11685 - protein, 9 aa, Mycobacterium tuberculosis
RRAGADRGC

SEQ ID NO: 11686 - protein, 9 aa, Mycobacterium tuberculosis
RAGADRGCR

SEQ ID NO: 11687 - protein, 9 aa, Mycobacterium tuberculosis
AGADRGCRG

SEQ ID NO: 11688 - protein, 9 aa, Mycobacterium tuberculosis
GADRGCRGG

SEQ ID NO: 11689 - protein, 9 aa, Mycobacterium tuberculosis
ADRGCRGGT

SEQ ID NO: 11690 - protein, 10 aa, Mycobacterium tuberculosis
MFRTVGDQAS

SEQ ID NO: 11691 - protein, 10 aa, Mycobacterium tuberculosis
FRTVGDQASL

SEQ ID NO: 11692 - protein, 10 aa, Mycobacterium tuberculosis
RTVGDQASLW

SEQ ID NO: 11693 - protein, 10 aa, Mycobacterium tuberculosis
TVGDQASLWE

SEQ ID NO: 11694 - protein, 10 aa, Mycobacterium tuberculosis
VGDQASLWES

SEQ ID NO: 11695 - protein, 10 aa, Mycobacterium tuberculosis
GDQASLWESV

SEQ ID NO: 11696 - protein, 10 aa, Mycobacterium tuberculosis
DQASLWESVL

SEQ ID NO: 11697 - protein, 10 aa, Mycobacterium tuberculosis
QASLWESVLP

SEQ ID NO: 11698 - protein, 10 aa, Mycobacterium tuberculosis
ASLWESVLPE

SEQ ID NO: 11699 - protein, 10 aa, Mycobacterium tuberculosis
SLWESVLPEE

SEQ ID NO: 11700 - protein, 10 aa, Mycobacterium tuberculosis
LWESVLPEEL

SEQ ID NO: 11701 - protein, 10 aa, Mycobacterium tuberculosis
WESVLPEELR

SEQ ID NO: 11702 - protein, 10 aa, Mycobacterium tuberculosis
ESVLPEELRR

SEQ ID NO: 11703 - protein, 10 aa, Mycobacterium tuberculosis
SVLPEELRRL

SEQ ID NO: 11704 - protein, 10 aa, Mycobacterium tuberculosis
VLPEELRRLP

SEQ ID NO: 11705 - protein, 10 aa, Mycobacterium tuberculosis
LPEELRRLPE

SEQ ID NO: 11706 - protein, 10 aa, Mycobacterium tuberculosis
PEELRRLPEE

SEQ ID NO: 11707 - protein, 10 aa, Mycobacterium tuberculosis
EELRRLPEEL

SEQ ID NO: 11708 - protein, 10 aa, Mycobacterium tuberculosis
ELRRLPEELA

SEQ ID NO: 11709 - protein, 10 aa, Mycobacterium tuberculosis
LRRLPEELAR

SEQ ID NO: 11710 - protein, 10 aa, Mycobacterium tuberculosis
RRLPEELARV

SEQ ID NO: 11711 - protein, 10 aa, Mycobacterium tuberculosis
RLPEELARVD

SEQ ID NO: 11712 - protein, 10 aa, Mycobacterium tuberculosis
LPEELARVDA

SEQ ID NO: 11713 - protein, 10 aa, Mycobacterium tuberculosis
PEELARVDAL

SEQ ID NO: 11714 - protein, 10 aa, Mycobacterium tuberculosis
EELARVDALL

SEQ ID NO: 11715 - protein, 10 aa, Mycobacterium tuberculosis
ELARVDALLD

SEQ ID NO: 11716 - protein, 10 aa, Mycobacterium tuberculosis
LARVDALLDD

SEQ ID NO: 11717 - protein, 10 aa, Mycobacterium tuberculosis
ARVDALLDDS

SEQ ID NO: 11718 - protein, 10 aa, Mycobacterium tuberculosis
RVDALLDDSA

SEQ ID NO: 11719 - protein, 10 aa, Mycobacterium tuberculosis
VDALLDDSAF

SEQ ID NO: 11720 - protein, 10 aa, Mycobacterium tuberculosis
DALLDDSAFF

SEQ ID NO: 11721 - protein, 10 aa, Mycobacterium tuberculosis
ALLDDSAFFC

SEQ ID NO: 11722 - protein, 10 aa, Mycobacterium tuberculosis
LLDDSAFFCP

SEQ ID NO: 11723 - protein, 10 aa, Mycobacterium tuberculosis
LDDSAFFCPF

SEQ ID NO: 11724 - protein, 10 aa, Mycobacterium tuberculosis
DDSAFFCPFV

SEQ ID NO: 11725 - protein, 10 aa, Mycobacterium tuberculosis
DSAFFCPFVP

SEQ ID NO: 11726 - protein, 10 aa, Mycobacterium tuberculosis
SAFFCPFVPF

SEQ ID NO: 11727 - protein, 10 aa, Mycobacterium tuberculosis
AFFCPFVPFF

SEQ ID NO: 11728 - protein, 10 aa, Mycobacterium tuberculosis
FFCPFVPFFD

SEQ ID NO: 11729 - protein, 10 aa, Mycobacterium tuberculosis
FCPFVPFFDP

SEQ ID NO: 11730 - protein, 10 aa, Mycobacterium tuberculosis
CPFVPFFDPR

SEQ ID NO: 11731 - protein, 10 aa, Mycobacterium tuberculosis
PFVPFFDPRM

SEQ ID NO: 11732 - protein, 10 aa, Mycobacterium tuberculosis
FVPFFDPRMG

SEQ ID NO: 11733 - protein, 10 aa, Mycobacterium tuberculosis
VPFFDPRMGR

SEQ ID NO: 11734 - protein, 10 aa, Mycobacterium tuberculosis
PFFDPRMGRP

SEQ ID NO: 11735 - protein, 10 aa, Mycobacterium tuberculosis
FFDPRMGRPS

SEQ ID NO: 11736 - protein, 10 aa, Mycobacterium tuberculosis
FDPRMGRPSI

SEQ ID NO: 11737 - protein, 10 aa, Mycobacterium tuberculosis
DPRMGRPSIP

SEQ ID NO: 11738 - protein, 10 aa, Mycobacterium tuberculosis
PRMGRPSIPM

SEQ ID NO: 11739 - protein, 10 aa, Mycobacterium tuberculosis
RMGRPSIPME

SEQ ID NO: 11740 - protein, 10 aa, Mycobacterium tuberculosis
MGRPSIPMET

SEQ ID NO: 11741 - protein, 10 aa, Mycobacterium tuberculosis
GRPSIPMETY

SEQ ID NO: 11742 - protein, 10 aa, Mycobacterium tuberculosis
RPSIPMETYL

SEQ ID NO: 11743 - protein, 10 aa, Mycobacterium tuberculosis
PSIPMETYLR

SEQ ID NO: 11744 - protein, 10 aa, Mycobacterium tuberculosis
SIPMETYLRL

SEQ ID NO: 11745 - protein, 10 aa, Mycobacterium tuberculosis
IPMETYLRLM

SEQ ID NO: 11746 - protein, 10 aa, Mycobacterium tuberculosis
PMETYLRLMF

SEQ ID NO: 11747 - protein, 10 aa, Mycobacterium tuberculosis
METYLRLMFL

SEQ ID NO: 11748 - protein, 10 aa, Mycobacterium tuberculosis
ETYLRLMFLK

SEQ ID NO: 11749 - protein, 10 aa, Mycobacterium tuberculosis
TYLRLMFLKF

SEQ ID NO: 11750 - protein, 10 aa, Mycobacterium tuberculosis
YLRLMFLKFR

SEQ ID NO: 11751 - protein, 10 aa, Mycobacterium tuberculosis
LRLMFLKFRY

SEQ ID NO: 11752 - protein, 10 aa, Mycobacterium tuberculosis
RLMFLKFRYR

SEQ ID NO: 11753 - protein, 10 aa, Mycobacterium tuberculosis
LMFLKFRYRL

SEQ ID NO: 11754 - protein, 10 aa, Mycobacterium tuberculosis
MFLKFRYRLG

SEQ ID NO: 11755 - protein, 10 aa, Mycobacterium tuberculosis
FLKFRYRLGY

SEQ ID NO: 11756 - protein, 10 aa, Mycobacterium tuberculosis
LKFRYRLGYE

SEQ ID NO: 11757 - protein, 10 aa, Mycobacterium tuberculosis
KFRYRLGYES

SEQ ID NO: 11758 - protein, 10 aa, Mycobacterium tuberculosis
FRYRLGYESL

SEQ ID NO: 11759 - protein, 10 aa, Mycobacterium tuberculosis
RYRLGYESLC

SEQ ID NO: 11760 - protein, 10 aa, Mycobacterium tuberculosis
YRLGYESLCR

SEQ ID NO: 11761 - protein, 10 aa, Mycobacterium tuberculosis
RLGYESLCRE

SEQ ID NO: 11762 - protein, 10 aa, Mycobacterium tuberculosis
LGYESLCREV

SEQ ID NO: 11763 - protein, 10 aa, Mycobacterium tuberculosis
GYESLCREVT

SEQ ID NO: 11764 - protein, 10 aa, Mycobacterium tuberculosis
YESLCREVTD

SEQ ID NO: 11765 - protein, 10 aa, Mycobacterium tuberculosis
ESLCREVTDS

SEQ ID NO: 11766 - protein, 10 aa, Mycobacterium tuberculosis
SLCREVTDSI

SEQ ID NO: 11767 - protein, 10 aa, Mycobacterium tuberculosis
LCREVTDSIT

SEQ ID NO: 11768 - protein, 10 aa, Mycobacterium tuberculosis
CREVTDSITW

SEQ ID NO: 11769 - protein, 10 aa, Mycobacterium tuberculosis
REVTDSITWR

SEQ ID NO: 11770 - protein, 10 aa, Mycobacterium tuberculosis
EVTDSITWRR

SEQ ID NO: 11771 - protein, 10 aa, Mycobacterium tuberculosis
VTDSITWRRF

SEQ ID NO: 11772 - protein, 10 aa, Mycobacterium tuberculosis
TDSITWRRFC

SEQ ID NO: 11773 - protein, 10 aa, Mycobacterium tuberculosis
DSITWRRFCR

SEQ ID NO: 11774 - protein, 10 aa, Mycobacterium tuberculosis
SITWRRFCRI

SEQ ID NO: 11775 - protein, 10 aa, Mycobacterium tuberculosis
ITWRRFCRIP

SEQ ID NO: 11776 - protein, 10 aa, Mycobacterium tuberculosis
TWRRFCRIPL

SEQ ID NO: 11777 - protein, 10 aa, Mycobacterium tuberculosis
WRRFCRIPLE

SEQ ID NO: 11778 - protein, 10 aa, Mycobacterium tuberculosis
RRFCRIPLEG

SEQ ID NO: 11779 - protein, 10 aa, Mycobacterium tuberculosis
RFCRIPLEGS

SEQ ID NO: 11780 - protein, 10 aa, Mycobacterium tuberculosis
FCRIPLEGSV

SEQ ID NO: 11781 - protein, 10 aa, Mycobacterium tuberculosis
CRIPLEGSVP

SEQ ID NO: 11782 - protein, 10 aa, Mycobacterium tuberculosis
RIPLEGSVPH

SEQ ID NO: 11783 - protein, 10 aa, Mycobacterium tuberculosis
IPLEGSVPHP

SEQ ID NO: 11784 - protein, 10 aa, Mycobacterium tuberculosis
PLEGSVPHPT

SEQ ID NO: 11785 - protein, 10 aa, Mycobacterium tuberculosis
LEGSVPHPTT

SEQ ID NO: 11786 - protein, 10 aa, Mycobacterium tuberculosis
EGSVPHPTTL

SEQ ID NO: 11787 - protein, 10 aa, Mycobacterium tuberculosis
GSVPHPTTLM

SEQ ID NO: 11788 - protein, 10 aa, Mycobacterium tuberculosis
SVPHPTTLMK

SEQ ID NO: 11789 - protein, 10 aa, Mycobacterium tuberculosis
VPHPTTLMKL

SEQ ID NO: 11790 - protein, 10 aa, Mycobacterium tuberculosis
PHPTTLMKLT

SEQ ID NO: 11791 - protein, 10 aa, Mycobacterium tuberculosis
HPTTLMKLTT

SEQ ID NO: 11792 - protein, 10 aa, Mycobacterium tuberculosis
PTTLMKLTTR

SEQ ID NO: 11793 - protein, 10 aa, Mycobacterium tuberculosis
TTLMKLTTRC

SEQ ID NO: 11794 - protein, 10 aa, Mycobacterium tuberculosis
TLMKLTTRCG

SEQ ID NO: 11795 - protein, 10 aa, Mycobacterium tuberculosis
LMKLTTRCGE

SEQ ID NO: 11796 - protein, 10 aa, Mycobacterium tuberculosis
MKLTTRCGED

SEQ ID NO: 11797 - protein, 10 aa, Mycobacterium tuberculosis
KLTTRCGEDA

SEQ ID NO: 11798 - protein, 10 aa, Mycobacterium tuberculosis
LTTRCGEDAV

SEQ ID NO: 11799 - protein, 10 aa, Mycobacterium tuberculosis
TTRCGEDAVA

SEQ ID NO: 11800 - protein, 10 aa, Mycobacterium tuberculosis
TRCGEDAVAG

SEQ ID NO: 11801 - protein, 10 aa, Mycobacterium tuberculosis
RCGEDAVAGL

SEQ ID NO: 11802 - protein, 10 aa, Mycobacterium tuberculosis
CGEDAVAGLN

SEQ ID NO: 11803 - protein, 10 aa, Mycobacterium tuberculosis
GEDAVAGLNE

SEQ ID NO: 11804 - protein, 10 aa, Mycobacterium tuberculosis
EDAVAGLNEA

SEQ ID NO: 11805 - protein, 10 aa, Mycobacterium tuberculosis
DAVAGLNEAL

SEQ ID NO: 11806 - protein, 10 aa, Mycobacterium tuberculosis
AVAGLNEALL

SEQ ID NO: 11807 - protein, 10 aa, Mycobacterium tuberculosis
VAGLNEALLA

SEQ ID NO: 11808 - protein, 10 aa, Mycobacterium tuberculosis
AGLNEALLAK

SEQ ID NO: 11809 - protein, 10 aa, Mycobacterium tuberculosis
GLNEALLAKA

SEQ ID NO: 11810 - protein, 10 aa, Mycobacterium tuberculosis
LNEALLAKAA

SEQ ID NO: 11811 - protein, 10 aa, Mycobacterium tuberculosis
NEALLAKAAS

SEQ ID NO: 11812 - protein, 10 aa, Mycobacterium tuberculosis
EALLAKAASE

SEQ ID NO: 11813 - protein, 10 aa, Mycobacterium tuberculosis
ALLAKAASEK

SEQ ID NO: 11814 - protein, 10 aa, Mycobacterium tuberculosis
LLAKAASEKL

SEQ ID NO: 11815 - protein, 10 aa, Mycobacterium tuberculosis
LAKAASEKLL

SEQ ID NO: 11816 - protein, 10 aa, Mycobacterium tuberculosis
AKAASEKLLR

SEQ ID NO: 11817 - protein, 10 aa, Mycobacterium tuberculosis
KAASEKLLRT

SEQ ID NO: 11818 - protein, 10 aa, Mycobacterium tuberculosis
AASEKLLRTN

SEQ ID NO: 11819 - protein, 10 aa, Mycobacterium tuberculosis
ASEKLLRTNK

SEQ ID NO: 11820 - protein, 10 aa, Mycobacterium tuberculosis
SEKLLRTNKV

SEQ ID NO: 11821 - protein, 10 aa, Mycobacterium tuberculosis
EKLLRTNKVR

SEQ ID NO: 11822 - protein, 10 aa, Mycobacterium tuberculosis
KLLRTNKVRA

SEQ ID NO: 11823 - protein, 10 aa, Mycobacterium tuberculosis
LLRTNKVRAD

SEQ ID NO: 11824 - protein, 10 aa, Mycobacterium tuberculosis
LRTNKVRADT

SEQ ID NO: 11825 - protein, 10 aa, Mycobacterium tuberculosis
RTNKVRADTT

SEQ ID NO: 11826 - protein, 10 aa, Mycobacterium tuberculosis
TNKVRADTTV

SEQ ID NO: 11827 - protein, 10 aa, Mycobacterium tuberculosis
NKVRADTTVV

SEQ ID NO: 11828 - protein, 10 aa, Mycobacterium tuberculosis
KVRADTTVVE

SEQ ID NO: 11829 - protein, 10 aa, Mycobacterium tuberculosis
VRADTTVVEG

SEQ ID NO: 11830 - protein, 10 aa, Mycobacterium tuberculosis
RADTTVVEGD

SEQ ID NO: 11831 - protein, 10 aa, Mycobacterium tuberculosis
ADTTVVEGDV

SEQ ID NO: 11832 - protein, 10 aa, Mycobacterium tuberculosis
DTTVVEGDVG

SEQ ID NO: 11833 - protein, 10 aa, Mycobacterium tuberculosis
TTVVEGDVGY

SEQ ID NO: 11834 - protein, 10 aa, Mycobacterium tuberculosis
TVVEGDVGYP

SEQ ID NO: 11835 - protein, 10 aa, Mycobacterium tuberculosis
VVEGDVGYPT

SEQ ID NO: 11836 - protein, 10 aa, Mycobacterium tuberculosis
VEGDVGYPTD

SEQ ID NO: 11837 - protein, 10 aa, Mycobacterium tuberculosis
EGDVGYPTDT

SEQ ID NO: 11838 - protein, 10 aa, Mycobacterium tuberculosis
GDVGYPTDTG

SEQ ID NO: 11839 - protein, 10 aa, Mycobacterium tuberculosis
DVGYPTDTGL

SEQ ID NO: 11840 - protein, 10 aa, Mycobacterium tuberculosis
VGYPTDTGLL

SEQ ID NO: 11841 - protein, 10 aa, Mycobacterium tuberculosis
GYPTDTGLLA

SEQ ID NO: 11842 - protein, 10 aa, Mycobacterium tuberculosis
YPTDTGLLAK

SEQ ID NO: 11843 - protein, 10 aa, Mycobacterium tuberculosis
PTDTGLLAKA

SEQ ID NO: 11844 - protein, 10 aa, Mycobacterium tuberculosis
TDTGLLAKAV

SEQ ID NO: 11845 - protein, 10 aa, Mycobacterium tuberculosis
DTGLLAKAVG

SEQ ID NO: 11846 - protein, 10 aa, Mycobacterium tuberculosis
TGLLAKAVGS

SEQ ID NO: 11847 - protein, 10 aa, Mycobacterium tuberculosis
GLLAKAVGSM

SEQ ID NO: 11848 - protein, 10 aa, Mycobacterium tuberculosis
LLAKAVGSMA

SEQ ID NO: 11849 - protein, 10 aa, Mycobacterium tuberculosis
LAKAVGSMAR

SEQ ID NO: 11850 - protein, 10 aa, Mycobacterium tuberculosis
AKAVGSMART

SEQ ID NO: 11851 - protein, 10 aa, Mycobacterium tuberculosis
KAVGSMARTV

SEQ ID NO: 11852 - protein, 10 aa, Mycobacterium tuberculosis
AVGSMARTVA

SEQ ID NO: 11853 - protein, 10 aa, Mycobacterium tuberculosis
VGSMARTVAR

SEQ ID NO: 11854 - protein, 10 aa, Mycobacterium tuberculosis
GSMARTVARI

SEQ ID NO: 11855 - protein, 10 aa, Mycobacterium tuberculosis
SMARTVARIK

SEQ ID NO: 11856 - protein, 10 aa, Mycobacterium tuberculosis
MARTVARIKA

SEQ ID NO: 11857 - protein, 10 aa, Mycobacterium tuberculosis
ARTVARIKAA

SEQ ID NO: 11858 - protein, 10 aa, Mycobacterium tuberculosis
RTVARIKAAD

SEQ ID NO: 11859 - protein, 10 aa, Mycobacterium tuberculosis
TVARIKAADA

SEQ ID NO: 11860 - protein, 10 aa, Mycobacterium tuberculosis
VARIKAADAG

SEQ ID NO: 11861 - protein, 10 aa, Mycobacterium tuberculosis
ARIKAADAGS

SEQ ID NO: 11862 - protein, 10 aa, Mycobacterium tuberculosis
RIKAADAGSA

SEQ ID NO: 11863 - protein, 10 aa, Mycobacterium tuberculosis
IKAADAGSAP

SEQ ID NO: 11864 - protein, 10 aa, Mycobacterium tuberculosis
KAADAGSAPL

SEQ ID NO: 11865 - protein, 10 aa, Mycobacterium tuberculosis
AADAGSAPLG

SEQ ID NO: 11866 - protein, 10 aa, Mycobacterium tuberculosis
ADAGSAPLGG

SEQ ID NO: 11867 - protein, 10 aa, Mycobacterium tuberculosis
DAGSAPLGGS

SEQ ID NO: 11868 - protein, 10 aa, Mycobacterium tuberculosis
AGSAPLGGSS

SEQ ID NO: 11869 - protein, 10 aa, Mycobacterium tuberculosis
GSAPLGGSSG

SEQ ID NO: 11870 - protein, 10 aa, Mycobacterium tuberculosis
SAPLGGSSGP

SEQ ID NO: 11871 - protein, 10 aa, Mycobacterium tuberculosis
APLGGSSGPR

SEQ ID NO: 11872 - protein, 10 aa, Mycobacterium tuberculosis
PLGGSSGPRD

SEQ ID NO: 11873 - protein, 10 aa, Mycobacterium tuberculosis
LGGSSGPRDR

SEQ ID NO: 11874 - protein, 10 aa, Mycobacterium tuberculosis
GGSSGPRDRL

SEQ ID NO: 11875 - protein, 10 aa, Mycobacterium tuberculosis
GSSGPRDRLQ

SEQ ID NO: 11876 - protein, 10 aa, Mycobacterium tuberculosis
SSGPRDRLQA

SEQ ID NO: 11877 - protein, 10 aa, Mycobacterium tuberculosis
SGPRDRLQAA

SEQ ID NO: 11878 - protein, 10 aa, Mycobacterium tuberculosis
GPRDRLQAAV

SEQ ID NO: 11879 - protein, 10 aa, Mycobacterium tuberculosis
PRDRLQAAVT

SEQ ID NO: 11880 - protein, 10 aa, Mycobacterium tuberculosis
RDRLQAAVTR

SEQ ID NO: 11881 - protein, 10 aa, Mycobacterium tuberculosis
DRLQAAVTRR

SEQ ID NO: 11882 - protein, 10 aa, Mycobacterium tuberculosis
RLQAAVTRRA

SEQ ID NO: 11883 - protein, 10 aa, Mycobacterium tuberculosis
LQAAVTRRAA

SEQ ID NO: 11884 - protein, 10 aa, Mycobacterium tuberculosis
QAAVTRRAAT

SEQ ID NO: 11885 - protein, 10 aa, Mycobacterium tuberculosis
AAVTRRAATR

SEQ ID NO: 11886 - protein, 10 aa, Mycobacterium tuberculosis
AVTRRAATRS

SEQ ID NO: 11887 - protein, 10 aa, Mycobacterium tuberculosis
VTRRAATRSG

SEQ ID NO: 11888 - protein, 10 aa, Mycobacterium tuberculosis
TRRAATRSGA

SEQ ID NO: 11889 - protein, 10 aa, Mycobacterium tuberculosis
RRAATRSGAG

SEQ ID NO: 11890 - protein, 10 aa, Mycobacterium tuberculosis
RAATRSGAGL

SEQ ID NO: 11891 - protein, 10 aa, Mycobacterium tuberculosis
AATRSGAGLR

SEQ ID NO: 11892 - protein, 10 aa, Mycobacterium tuberculosis
ATRSGAGLRA

SEQ ID NO: 11893 - protein, 10 aa, Mycobacterium tuberculosis
TRSGAGLRAP

SEQ ID NO: 11894 - protein, 10 aa, Mycobacterium tuberculosis
RSGAGLRAPD

SEQ ID NO: 11895 - protein, 10 aa, Mycobacterium tuberculosis
SGAGLRAPDH

SEQ ID NO: 11896 - protein, 10 aa, Mycobacterium tuberculosis
GAGLRAPDHR

SEQ ID NO: 11897 - protein, 10 aa, Mycobacterium tuberculosis
AGLRAPDHRG

SEQ ID NO: 11898 - protein, 10 aa, Mycobacterium tuberculosis
GLRAPDHRGA

SEQ ID NO: 11899 - protein, 10 aa, Mycobacterium tuberculosis
LRAPDHRGAS

SEQ ID NO: 11900 - protein, 10 aa, Mycobacterium tuberculosis
RAPDHRGASR

SEQ ID NO: 11901 - protein, 10 aa, Mycobacterium tuberculosis
APDHRGASRD

SEQ ID NO: 11902 - protein, 10 aa, Mycobacterium tuberculosis
PDHRGASRDR

SEQ ID NO: 11903 - protein, 10 aa, Mycobacterium tuberculosis
DHRGASRDRR

SEQ ID NO: 11904 - protein, 10 aa, Mycobacterium tuberculosis
HRGASRDRRA

SEQ ID NO: 11905 - protein, 10 aa, Mycobacterium tuberculosis
RGASRDRRAG

SEQ ID NO: 11906 - protein, 10 aa, Mycobacterium tuberculosis
GASRDRRAGA

SEQ ID NO: 11907 - protein, 10 aa, Mycobacterium tuberculosis
ASRDRRAGAD

SEQ ID NO: 11908 - protein, 10 aa, Mycobacterium tuberculosis
SRDRRAGADR

SEQ ID NO: 11909 - protein, 10 aa, Mycobacterium tuberculosis
RDRRAGADRG

SEQ ID NO: 11910 - protein, 10 aa, Mycobacterium tuberculosis
DRRAGADRGC

SEQ ID NO: 11911 - protein, 10 aa, Mycobacterium tuberculosis
RRAGADRGCR

SEQ ID NO: 11912 - protein, 10 aa, Mycobacterium tuberculosis
RAGADRGCRG

SEQ ID NO: 11913 - protein, 10 aa, Mycobacterium tuberculosis
AGADRGCRGG

SEQ ID NO: 11914 - protein, 10 aa, Mycobacterium tuberculosis
GADRGCRGGT

SEQ ID NO: 11915 - protein, 11 aa, Mycobacterium tuberculosis
MFRTVGDQASL

SEQ ID NO: 11916 - protein, 11 aa, Mycobacterium tuberculosis
FRTVGDQASLW

SEQ ID NO: 11917 - protein, 11 aa, Mycobacterium tuberculosis
RTVGDQASLWE

SEQ ID NO: 11918 - protein, 11 aa, Mycobacterium tuberculosis
TVGDQASLWES

SEQ ID NO: 11919 - protein, 11 aa, Mycobacterium tuberculosis
VGDQASLWESV

SEQ ID NO: 11920 - protein, 11 aa, Mycobacterium tuberculosis
GDQASLWESVL

SEQ ID NO: 11921 - protein, 11 aa, Mycobacterium tuberculosis
DQASLWESVLP

SEQ ID NO: 11922 - protein, 11 aa, Mycobacterium tuberculosis
QASLWESVLPE

SEQ ID NO: 11923 - protein, 11 aa, Mycobacterium tuberculosis
ASLWESVLPEE

SEQ ID NO: 11924 - protein, 11 aa, Mycobacterium tuberculosis
SLWESVLPEEL

SEQ ID NO: 11925 - protein, 11 aa, Mycobacterium tuberculosis
LWESVLPEELR

SEQ ID NO: 11926 - protein, 11 aa, Mycobacterium tuberculosis
WESVLPEELRR

SEQ ID NO: 11927 - protein, 11 aa, Mycobacterium tuberculosis
ESVLPEELRRL

SEQ ID NO: 11928 - protein, 11 aa, Mycobacterium tuberculosis
SVLPEELRRLP

SEQ ID NO: 11929 - protein, 11 aa, Mycobacterium tuberculosis
VLPEELRRLPE

SEQ ID NO: 11930 - protein, 11 aa, Mycobacterium tuberculosis
LPEELRRLPEE

SEQ ID NO: 11931 - protein, 11 aa, Mycobacterium tuberculosis
PEELRRLPEEL

SEQ ID NO: 11932 - protein, 11 aa, Mycobacterium tuberculosis
EELRRLPEELA

SEQ ID NO: 11933 - protein, 11 aa, Mycobacterium tuberculosis
ELRRLPEELAR

SEQ ID NO: 11934 - protein, 11 aa, Mycobacterium tuberculosis
LRRLPEELARV

SEQ ID NO: 11935 - protein, 11 aa, Mycobacterium tuberculosis
RRLPEELARVD

SEQ ID NO: 11936 - protein, 11 aa, Mycobacterium tuberculosis
RLPEELARVDA

SEQ ID NO: 11937 - protein, 11 aa, Mycobacterium tuberculosis
LPEELARVDAL

SEQ ID NO: 11938 - protein, 11 aa, Mycobacterium tuberculosis
PEELARVDALL

SEQ ID NO: 11939 - protein, 11 aa, Mycobacterium tuberculosis
EELARVDALLD

SEQ ID NO: 11940 - protein, 11 aa, Mycobacterium tuberculosis
ELARVDALLDD

SEQ ID NO: 11941 - protein, 11 aa, Mycobacterium tuberculosis
LARVDALLDDS

SEQ ID NO: 11942 - protein, 11 aa, Mycobacterium tuberculosis
ARVDALLDDSA

SEQ ID NO: 11943 - protein, 11 aa, Mycobacterium tuberculosis
RVDALLDDSAF

SEQ ID NO: 11944 - protein, 11 aa, Mycobacterium tuberculosis
VDALLDDSAFF

SEQ ID NO: 11945 - protein, 11 aa, Mycobacterium tuberculosis
DALLDDSAFFC

SEQ ID NO: 11946 - protein, 11 aa, Mycobacterium tuberculosis
ALLDDSAFFCP

SEQ ID NO: 11947 - protein, 11 aa, Mycobacterium tuberculosis
LLDDSAFFCPF

SEQ ID NO: 11948 - protein, 11 aa, Mycobacterium tuberculosis
LDDSAFFCPFV

SEQ ID NO: 11949 - protein, 11 aa, Mycobacterium tuberculosis
DDSAFFCPFVP

SEQ ID NO: 11950 - protein, 11 aa, Mycobacterium tuberculosis
DSAFFCPFVPF

SEQ ID NO: 11951 - protein, 11 aa, Mycobacterium tuberculosis
SAFFCPFVPFF

SEQ ID NO: 11952 - protein, 11 aa, Mycobacterium tuberculosis
AFFCPFVPFFD

SEQ ID NO: 11953 - protein, 11 aa, Mycobacterium tuberculosis
FFCPFVPFFDP

SEQ ID NO: 11954 - protein, 11 aa, Mycobacterium tuberculosis
FCPFVPFFDPR

SEQ ID NO: 11955 - protein, 11 aa, Mycobacterium tuberculosis
CPFVPFFDPRM

SEQ ID NO: 11956 - protein, 11 aa, Mycobacterium tuberculosis
PFVPFFDPRMG

SEQ ID NO: 11957 - protein, 11 aa, Mycobacterium tuberculosis
FVPFFDPRMGR

SEQ ID NO: 11958 - protein, 11 aa, Mycobacterium tuberculosis
VPFFDPRMGRP

SEQ ID NO: 11959 - protein, 11 aa, Mycobacterium tuberculosis
PFFDPRMGRPS

SEQ ID NO: 11960 - protein, 11 aa, Mycobacterium tuberculosis
FFDPRMGRPSI

SEQ ID NO: 11961 - protein, 11 aa, Mycobacterium tuberculosis
FDPRMGRPSIP

SEQ ID NO: 11962 - protein, 11 aa, Mycobacterium tuberculosis
DPRMGRPSIPM

SEQ ID NO: 11963 - protein, 11 aa, Mycobacterium tuberculosis
PRMGRPSIPME

SEQ ID NO: 11964 - protein, 11 aa, Mycobacterium tuberculosis
RMGRPSIPMET

SEQ ID NO: 11965 - protein, 11 aa, Mycobacterium tuberculosis
MGRPSIPMETY

SEQ ID NO: 11966 - protein, 11 aa, Mycobacterium tuberculosis
GRPSIPMETYL

SEQ ID NO: 11967 - protein, 11 aa, Mycobacterium tuberculosis
RPSIPMETYLR

SEQ ID NO: 11968 - protein, 11 aa, Mycobacterium tuberculosis
PSIPMETYLRL

SEQ ID NO: 11969 - protein, 11 aa, Mycobacterium tuberculosis
SIPMETYLRLM

SEQ ID NO: 11970 - protein, 11 aa, Mycobacterium tuberculosis
IPMETYLRLMF

SEQ ID NO: 11971 - protein, 11 aa, Mycobacterium tuberculosis
PMETYLRLMFL

SEQ ID NO: 11972 - protein, 11 aa, Mycobacterium tuberculosis
METYLRLMFLK

SEQ ID NO: 11973 - protein, 11 aa, Mycobacterium tuberculosis
ETYLRLMFLKF

SEQ ID NO: 11974 - protein, 11 aa, Mycobacterium tuberculosis
TYLRLMFLKFR

SEQ ID NO: 11975 - protein, 11 aa, Mycobacterium tuberculosis
YLRLMFLKFRY

SEQ ID NO: 11976 - protein, 11 aa, Mycobacterium tuberculosis
LRLMFLKFRYR

SEQ ID NO: 11977 - protein, 11 aa, Mycobacterium tuberculosis
RLMFLKFRYRL

SEQ ID NO: 11978 - protein, 11 aa, Mycobacterium tuberculosis
LMFLKFRYRLG

SEQ ID NO: 11979 - protein, 11 aa, Mycobacterium tuberculosis
MFLKFRYRLGY

SEQ ID NO: 11980 - protein, 11 aa, Mycobacterium tuberculosis
FLKFRYRLGYE

SEQ ID NO: 11981 - protein, 11 aa, Mycobacterium tuberculosis
LKFRYRLGYES

SEQ ID NO: 11982 - protein, 11 aa, Mycobacterium tuberculosis
KFRYRLGYESL

SEQ ID NO: 11983 - protein, 11 aa, Mycobacterium tuberculosis
FRYRLGYESLC

SEQ ID NO: 11984 - protein, 11 aa, Mycobacterium tuberculosis
RYRLGYESLCR

SEQ ID NO: 11985 - protein, 11 aa, Mycobacterium tuberculosis
YRLGYESLCRE

SEQ ID NO: 11986 - protein, 11 aa, Mycobacterium tuberculosis
RLGYESLCREV

SEQ ID NO: 11987 - protein, 11 aa, Mycobacterium tuberculosis
LGYESLCREVT

SEQ ID NO: 11988 - protein, 11 aa, Mycobacterium tuberculosis
GYESLCREVTD

SEQ ID NO: 11989 - protein, 11 aa, Mycobacterium tuberculosis
YESLCREVTDS

SEQ ID NO: 11990 - protein, 11 aa, Mycobacterium tuberculosis
ESLCREVTDSI

SEQ ID NO: 11991 - protein, 11 aa, Mycobacterium tuberculosis
SLCREVTDSIT

SEQ ID NO: 11992 - protein, 11 aa, Mycobacterium tuberculosis
LCREVTDSITW

SEQ ID NO: 11993 - protein, 11 aa, Mycobacterium tuberculosis
CREVTDSITWR

SEQ ID NO: 11994 - protein, 11 aa, Mycobacterium tuberculosis
REVTDSITWRR

SEQ ID NO: 11995 - protein, 11 aa, Mycobacterium tuberculosis
EVTDSITWRRF

SEQ ID NO: 11996 - protein, 11 aa, Mycobacterium tuberculosis
VTDSITWRRFC

SEQ ID NO: 11997 - protein, 11 aa, Mycobacterium tuberculosis
TDSITWRRFCR

SEQ ID NO: 11998 - protein, 11 aa, Mycobacterium tuberculosis
DSITWRRFCRI

SEQ ID NO: 11999 - protein, 11 aa, Mycobacterium tuberculosis
SITWRRFCRIP

SEQ ID NO: 12000 - protein, 11 aa, Mycobacterium tuberculosis
ITWRRFCRIPL

SEQ ID NO: 12001 - protein, 11 aa, Mycobacterium tuberculosis
TWRRFCRIPLE

SEQ ID NO: 12002 - protein, 11 aa, Mycobacterium tuberculosis
WRRFCRIPLEG

SEQ ID NO: 12003 - protein, 11 aa, Mycobacterium tuberculosis
RRFCRIPLEGS

SEQ ID NO: 12004 - protein, 11 aa, Mycobacterium tuberculosis
RFCRIPLEGSV

SEQ ID NO: 12005 - protein, 11 aa, Mycobacterium tuberculosis
FCRIPLEGSVP

SEQ ID NO: 12006 - protein, 11 aa, Mycobacterium tuberculosis
CRIPLEGSVPH

SEQ ID NO: 12007 - protein, 11 aa, Mycobacterium tuberculosis
RIPLEGSVPHP

SEQ ID NO: 12008 - protein, 11 aa, Mycobacterium tuberculosis
IPLEGSVPHPT

SEQ ID NO: 12009 - protein, 11 aa, Mycobacterium tuberculosis
PLEGSVPHPTT

SEQ ID NO: 12010 - protein, 11 aa, Mycobacterium tuberculosis
LEGSVPHPTTL

SEQ ID NO: 12011 - protein, 11 aa, Mycobacterium tuberculosis
EGSVPHPTTLM

SEQ ID NO: 12012 - protein, 11 aa, Mycobacterium tuberculosis
GSVPHPTTLMK

SEQ ID NO: 12013 - protein, 11 aa, Mycobacterium tuberculosis
SVPHPTTLMKL

SEQ ID NO: 12014 - protein, 11 aa, Mycobacterium tuberculosis
VPHPTTLMKLT

SEQ ID NO: 12015 - protein, 11 aa, Mycobacterium tuberculosis
PHPTTLMKLTT

SEQ ID NO: 12016 - protein, 11 aa, Mycobacterium tuberculosis
HPTTLMKLTTR

SEQ ID NO: 12017 - protein, 11 aa, Mycobacterium tuberculosis
PTTLMKLTTRC

SEQ ID NO: 12018 - protein, 11 aa, Mycobacterium tuberculosis
TTLMKLTTRCG

SEQ ID NO: 12019 - protein, 11 aa, Mycobacterium tuberculosis
TLMKLTTRCGE

SEQ ID NO: 12020 - protein, 11 aa, Mycobacterium tuberculosis
LMKLTTRCGED

SEQ ID NO: 12021 - protein, 11 aa, Mycobacterium tuberculosis
MKLTTRCGEDA

SEQ ID NO: 12022 - protein, 11 aa, Mycobacterium tuberculosis
KLTTRCGEDAV

SEQ ID NO: 12023 - protein, 11 aa, Mycobacterium tuberculosis
LTTRCGEDAVA

SEQ ID NO: 12024 - protein, 11 aa, Mycobacterium tuberculosis
TTRCGEDAVAG

SEQ ID NO: 12025 - protein, 11 aa, Mycobacterium tuberculosis
TRCGEDAVAGL

SEQ ID NO: 12026 - protein, 11 aa, Mycobacterium tuberculosis
RCGEDAVAGLN

SEQ ID NO: 12027 - protein, 11 aa, Mycobacterium tuberculosis
CGEDAVAGLNE

SEQ ID NO: 12028 - protein, 11 aa, Mycobacterium tuberculosis
GEDAVAGLNEA

SEQ ID NO: 12029 - protein, 11 aa, Mycobacterium tuberculosis
EDAVAGLNEAL

SEQ ID NO: 12030 - protein, 11 aa, Mycobacterium tuberculosis
DAVAGLNEALL

SEQ ID NO: 12031 - protein, 11 aa, Mycobacterium tuberculosis
AVAGLNEALLA

SEQ ID NO: 12032 - protein, 11 aa, Mycobacterium tuberculosis
VAGLNEALLAK

SEQ ID NO: 12033 - protein, 11 aa, Mycobacterium tuberculosis
AGLNEALLAKA

SEQ ID NO: 12034 - protein, 11 aa, Mycobacterium tuberculosis
GLNEALLAKAA

SEQ ID NO: 12035 - protein, 11 aa, Mycobacterium tuberculosis
LNEALLAKAAS

SEQ ID NO: 12036 - protein, 11 aa, Mycobacterium tuberculosis
NEALLAKAASE

SEQ ID NO: 12037 - protein, 11 aa, Mycobacterium tuberculosis
EALLAKAASEK

SEQ ID NO: 12038 - protein, 11 aa, Mycobacterium tuberculosis
ALLAKAASEKL

SEQ ID NO: 12039 - protein, 11 aa, Mycobacterium tuberculosis
LLAKAASEKLL

SEQ ID NO: 12040 - protein, 11 aa, Mycobacterium tuberculosis
LAKAASEKLLR

SEQ ID NO: 12041 - protein, 11 aa, Mycobacterium tuberculosis
AKAASEKLLRT

SEQ ID NO: 12042 - protein, 11 aa, Mycobacterium tuberculosis
KAASEKLLRTN

SEQ ID NO: 12043 - protein, 11 aa, Mycobacterium tuberculosis
AASEKLLRTNK

SEQ ID NO: 12044 - protein, 11 aa, Mycobacterium tuberculosis
ASEKLLRTNKV

SEQ ID NO: 12045 - protein, 11 aa, Mycobacterium tuberculosis
SEKLLRTNKVR

SEQ ID NO: 12046 - protein, 11 aa, Mycobacterium tuberculosis
EKLLRTNKVRA

SEQ ID NO: 12047 - protein, 11 aa, Mycobacterium tuberculosis
KLLRTNKVRAD

SEQ ID NO: 12048 - protein, 11 aa, Mycobacterium tuberculosis
LLRTNKVRADT

SEQ ID NO: 12049 - protein, 11 aa, Mycobacterium tuberculosis
LRTNKVRADTT

SEQ ID NO: 12050 - protein, 11 aa, Mycobacterium tuberculosis
RTNKVRADTTV

SEQ ID NO: 12051 - protein, 11 aa, Mycobacterium tuberculosis
TNKVRADTTVV

SEQ ID NO: 12052 - protein, 11 aa, Mycobacterium tuberculosis
NKVRADTTVVE

SEQ ID NO: 12053 - protein, 11 aa, Mycobacterium tuberculosis
KVRADTTVVEG

SEQ ID NO: 12054 - protein, 11 aa, Mycobacterium tuberculosis
VRADTTVVEGD

SEQ ID NO: 12055 - protein, 11 aa, Mycobacterium tuberculosis
RADTTVVEGDV

SEQ ID NO: 12056 - protein, 11 aa, Mycobacterium tuberculosis
ADTTVVEGDVG

SEQ ID NO: 12057 - protein, 11 aa, Mycobacterium tuberculosis
DTTVVEGDVGY

SEQ ID NO: 12058 - protein, 11 aa, Mycobacterium tuberculosis
TTVVEGDVGYP

SEQ ID NO: 12059 - protein, 11 aa, Mycobacterium tuberculosis
TVVEGDVGYPT

SEQ ID NO: 12060 - protein, 11 aa, Mycobacterium tuberculosis
VVEGDVGYPTD

SEQ ID NO: 12061 - protein, 11 aa, Mycobacterium tuberculosis
VEGDVGYPTDT

SEQ ID NO: 12062 - protein, 11 aa, Mycobacterium tuberculosis
EGDVGYPTDTG

SEQ ID NO: 12063 - protein, 11 aa, Mycobacterium tuberculosis
GDVGYPTDTGL

SEQ ID NO: 12064 - protein, 11 aa, Mycobacterium tuberculosis
DVGYPTDTGLL

SEQ ID NO: 12065 - protein, 11 aa, Mycobacterium tuberculosis
VGYPTDTGLLA

SEQ ID NO: 12066 - protein, 11 aa, Mycobacterium tuberculosis
GYPTDTGLLAK

SEQ ID NO: 12067 - protein, 11 aa, Mycobacterium tuberculosis
YPTDTGLLAKA

SEQ ID NO: 12068 - protein, 11 aa, Mycobacterium tuberculosis
PTDTGLLAKAV

SEQ ID NO: 12069 - protein, 11 aa, Mycobacterium tuberculosis
TDTGLLAKAVG

SEQ ID NO: 12070 - protein, 11 aa, Mycobacterium tuberculosis
DTGLLAKAVGS

SEQ ID NO: 12071 - protein, 11 aa, Mycobacterium tuberculosis
TGLLAKAVGSM

SEQ ID NO: 12072 - protein, 11 aa, Mycobacterium tuberculosis
GLLAKAVGSMA

SEQ ID NO: 12073 - protein, 11 aa, Mycobacterium tuberculosis
LLAKAVGSMAR

SEQ ID NO: 12074 - protein, 11 aa, Mycobacterium tuberculosis
LAKAVGSMART

SEQ ID NO: 12075 - protein, 11 aa, Mycobacterium tuberculosis
AKAVGSMARTV

SEQ ID NO: 12076 - protein, 11 aa, Mycobacterium tuberculosis
KAVGSMARTVA

SEQ ID NO: 12077 - protein, 11 aa, Mycobacterium tuberculosis
AVGSMARTVAR

SEQ ID NO: 12078 - protein, 11 aa, Mycobacterium tuberculosis
VGSMARTVARI

SEQ ID NO: 12079 - protein, 11 aa, Mycobacterium tuberculosis
GSMARTVARIK

SEQ ID NO: 12080 - protein, 11 aa, Mycobacterium tuberculosis
SMARTVARIKA

SEQ ID NO: 12081 - protein, 11 aa, Mycobacterium tuberculosis
MARTVARIKAA

SEQ ID NO: 12082 - protein, 11 aa, Mycobacterium tuberculosis
ARTVARIKAAD

SEQ ID NO: 12083 - protein, 11 aa, Mycobacterium tuberculosis
RTVARIKAADA

SEQ ID NO: 12084 - protein, 11 aa, Mycobacterium tuberculosis
TVARIKAADAG

SEQ ID NO: 12085 - protein, 11 aa, Mycobacterium tuberculosis
VARIKAADAGS

SEQ ID NO: 12086 - protein, 11 aa, Mycobacterium tuberculosis
ARIKAADAGSA

SEQ ID NO: 12087 - protein, 11 aa, Mycobacterium tuberculosis
RIKAADAGSAP

SEQ ID NO: 12088 - protein, 11 aa, Mycobacterium tuberculosis
IKAADAGSAPL

SEQ ID NO: 12089 - protein, 11 aa, Mycobacterium tuberculosis
KAADAGSAPLG

SEQ ID NO: 12090 - protein, 11 aa, Mycobacterium tuberculosis
AADAGSAPLGG

SEQ ID NO: 12091 - protein, 11 aa, Mycobacterium tuberculosis
ADAGSAPLGGS

SEQ ID NO: 12092 - protein, 11 aa, Mycobacterium tuberculosis
DAGSAPLGGSS

SEQ ID NO: 12093 - protein, 11 aa, Mycobacterium tuberculosis
AGSAPLGGSSG

SEQ ID NO: 12094 - protein, 11 aa, Mycobacterium tuberculosis
GSAPLGGSSGP

SEQ ID NO: 12095 - protein, 11 aa, Mycobacterium tuberculosis
SAPLGGSSGPR

SEQ ID NO: 12096 - protein, 11 aa, Mycobacterium tuberculosis
APLGGSSGPRD

SEQ ID NO: 12097 - protein, 11 aa, Mycobacterium tuberculosis
PLGGSSGPRDR

SEQ ID NO: 12098 - protein, 11 aa, Mycobacterium tuberculosis
LGGSSGPRDRL

SEQ ID NO: 12099 - protein, 11 aa, Mycobacterium tuberculosis
GGSSGPRDRLQ

SEQ ID NO: 12100 - protein, 11 aa, Mycobacterium tuberculosis
GSSGPRDRLQA

SEQ ID NO: 12101 - protein, 11 aa, Mycobacterium tuberculosis
SSGPRDRLQAA

SEQ ID NO: 12102 - protein, 11 aa, Mycobacterium tuberculosis
SGPRDRLQAAV

SEQ ID NO: 12103 - protein, 11 aa, Mycobacterium tuberculosis
GPRDRLQAAVT

SEQ ID NO: 12104 - protein, 11 aa, Mycobacterium tuberculosis
PRDRLQAAVTR

SEQ ID NO: 12105 - protein, 11 aa, Mycobacterium tuberculosis
RDRLQAAVTRR

SEQ ID NO: 12106 - protein, 11 aa, Mycobacterium tuberculosis
DRLQAAVTRRA

SEQ ID NO: 12107 - protein, 11 aa, Mycobacterium tuberculosis
RLQAAVTRRAA

SEQ ID NO: 12108 - protein, 11 aa, Mycobacterium tuberculosis
LQAAVTRRAAT

SEQ ID NO: 12109 - protein, 11 aa, Mycobacterium tuberculosis
QAAVTRRAATR

SEQ ID NO: 12110 - protein, 11 aa, Mycobacterium tuberculosis
AAVTRRAATRS

SEQ ID NO: 12111 - protein, 11 aa, Mycobacterium tuberculosis
AVTRRAATRSG

SEQ ID NO: 12112 - protein, 11 aa, Mycobacterium tuberculosis
VTRRAATRSGA

SEQ ID NO: 12113 - protein, 11 aa, Mycobacterium tuberculosis
TRRAATRSGAG

SEQ ID NO: 12114 - protein, 11 aa, Mycobacterium tuberculosis
RRAATRSGAGL

SEQ ID NO: 12115 - protein, 11 aa, Mycobacterium tuberculosis
RAATRSGAGLR

SEQ ID NO: 12116 - protein, 11 aa, Mycobacterium tuberculosis
AATRSGAGLRA

SEQ ID NO: 12117 - protein, 11 aa, Mycobacterium tuberculosis
ATRSGAGLRAP

SEQ ID NO: 12118 - protein, 11 aa, Mycobacterium tuberculosis
TRSGAGLRAPD

SEQ ID NO: 12119 - protein, 11 aa, Mycobacterium tuberculosis
RSGAGLRAPDH

SEQ ID NO: 12120 - protein, 11 aa, Mycobacterium tuberculosis
SGAGLRAPDHR

SEQ ID NO: 12121 - protein, 11 aa, Mycobacterium tuberculosis
GAGLRAPDHRG

SEQ ID NO: 12122 - protein, 11 aa, Mycobacterium tuberculosis
AGLRAPDHRGA

SEQ ID NO: 12123 - protein, 11 aa, Mycobacterium tuberculosis
GLRAPDHRGAS

SEQ ID NO: 12124 - protein, 11 aa, Mycobacterium tuberculosis
LRAPDHRGASR

SEQ ID NO: 12125 - protein, 11 aa, Mycobacterium tuberculosis
RAPDHRGASRD

SEQ ID NO: 12126 - protein, 11 aa, Mycobacterium tuberculosis
APDHRGASRDR

SEQ ID NO: 12127 - protein, 11 aa, Mycobacterium tuberculosis
PDHRGASRDRR

SEQ ID NO: 12128 - protein, 11 aa, Mycobacterium tuberculosis
DHRGASRDRRA

SEQ ID NO: 12129 - protein, 11 aa, Mycobacterium tuberculosis
HRGASRDRRAG

SEQ ID NO: 12130 - protein, 11 aa, Mycobacterium tuberculosis
RGASRDRRAGA

SEQ ID NO: 12131 - protein, 11 aa, Mycobacterium tuberculosis
GASRDRRAGAD

SEQ ID NO: 12132 - protein, 11 aa, Mycobacterium tuberculosis
ASRDRRAGADR

SEQ ID NO: 12133 - protein, 11 aa, Mycobacterium tuberculosis
SRDRRAGADRG

SEQ ID NO: 12134 - protein, 11 aa, Mycobacterium tuberculosis
RDRRAGADRGC

SEQ ID NO: 12135 - protein, 11 aa, Mycobacterium tuberculosis
DRRAGADRGCR

SEQ ID NO: 12136 - protein, 11 aa, Mycobacterium tuberculosis
RRAGADRGCRG

SEQ ID NO: 12137 - protein, 11 aa, Mycobacterium tuberculosis
RAGADRGCRGG

SEQ ID NO: 12138 - protein, 11 aa, Mycobacterium tuberculosis
AGADRGCRGGT

SEQ ID NO: 12139 - protein, 8 aa, Mycobacterium tuberculosis
MTINYQFG

SEQ ID NO: 12140 - protein, 8 aa, Mycobacterium tuberculosis
TINYQFGD

SEQ ID NO: 12141 - protein, 8 aa, Mycobacterium tuberculosis
INYQFGDV

SEQ ID NO: 12142 - protein, 8 aa, Mycobacterium tuberculosis
NYQFGDVD

SEQ ID NO: 12143 - protein, 8 aa, Mycobacterium tuberculosis
YQFGDVDA

SEQ ID NO: 12144 - protein, 8 aa, Mycobacterium tuberculosis
QFGDVDAH

SEQ ID NO: 12145 - protein, 8 aa, Mycobacterium tuberculosis
FGDVDAHG

SEQ ID NO: 12146 - protein, 8 aa, Mycobacterium tuberculosis
GDVDAHGA

SEQ ID NO: 12147 - protein, 8 aa, Mycobacterium tuberculosis
DVDAHGAM

SEQ ID NO: 12148 - protein, 8 aa, Mycobacterium tuberculosis
VDAHGAMI

SEQ ID NO: 12149 - protein, 8 aa, Mycobacterium tuberculosis
DAHGAMIR

SEQ ID NO: 12150 - protein, 8 aa, Mycobacterium tuberculosis
AHGAMIRA

SEQ ID NO: 12151 - protein, 8 aa, Mycobacterium tuberculosis
HGAMIRAQ

SEQ ID NO: 12152 - protein, 8 aa, Mycobacterium tuberculosis
GAMIRAQA

SEQ ID NO: 12153 - protein, 8 aa, Mycobacterium tuberculosis
AMIRAQAG

SEQ ID NO: 12154 - protein, 8 aa, Mycobacterium tuberculosis
MIRAQAGS

SEQ ID NO: 12155 - protein, 8 aa, Mycobacterium tuberculosis
IRAQAGSL

SEQ ID NO: 12156 - protein, 8 aa, Mycobacterium tuberculosis
RAQAGSLE

SEQ ID NO: 12157 - protein, 8 aa, Mycobacterium tuberculosis
AQAGSLEA

SEQ ID NO: 12158 - protein, 8 aa, Mycobacterium tuberculosis
QAGSLEAE

SEQ ID NO: 12159 - protein, 8 aa, Mycobacterium tuberculosis
AGSLEAEH

SEQ ID NO: 12160 - protein, 8 aa, Mycobacterium tuberculosis
GSLEAEHQ

SEQ ID NO: 12161 - protein, 8 aa, Mycobacterium tuberculosis
SLEAEHQA

SEQ ID NO: 12162 - protein, 8 aa, Mycobacterium tuberculosis
LEAEHQAI

SEQ ID NO: 12163 - protein, 8 aa, Mycobacterium tuberculosis
EAEHQAII

SEQ ID NO: 12164 - protein, 8 aa, Mycobacterium tuberculosis
AEHQAIIS

SEQ ID NO: 12165 - protein, 8 aa, Mycobacterium tuberculosis
EHQAIISD

SEQ ID NO: 12166 - protein, 8 aa, Mycobacterium tuberculosis
HQAIISDV

SEQ ID NO: 12167 - protein, 8 aa, Mycobacterium tuberculosis
QAIISDVL

SEQ ID NO: 12168 - protein, 8 aa, Mycobacterium tuberculosis
AIISDVLT

SEQ ID NO: 12169 - protein, 8 aa, Mycobacterium tuberculosis
IISDVLTA

SEQ ID NO: 12170 - protein, 8 aa, Mycobacterium tuberculosis
ISDVLTAS

SEQ ID NO: 12171 - protein, 8 aa, Mycobacterium tuberculosis
SDVLTASD

SEQ ID NO: 12172 - protein, 8 aa, Mycobacterium tuberculosis
DVLTASDF

SEQ ID NO: 12173 - protein, 8 aa, Mycobacterium tuberculosis
VLTASDFW

SEQ ID NO: 12174 - protein, 8 aa, Mycobacterium tuberculosis
LTASDFWG

SEQ ID NO: 12175 - protein, 8 aa, Mycobacterium tuberculosis
TASDFWGG

SEQ ID NO: 12176 - protein, 8 aa, Mycobacterium tuberculosis
ASDFWGGA

SEQ ID NO: 12177 - protein, 8 aa, Mycobacterium tuberculosis
SDFWGGAG

SEQ ID NO: 12178 - protein, 8 aa, Mycobacterium tuberculosis
DFWGGAGS

SEQ ID NO: 12179 - protein, 8 aa, Mycobacterium tuberculosis
FWGGAGSA

SEQ ID NO: 12180 - protein, 8 aa, Mycobacterium tuberculosis
WGGAGSAA

SEQ ID NO: 12181 - protein, 8 aa, Mycobacterium tuberculosis
GGAGSAAC

SEQ ID NO: 12182 - protein, 8 aa, Mycobacterium tuberculosis
GAGSAACQ

SEQ ID NO: 12183 - protein, 8 aa, Mycobacterium tuberculosis
AGSAACQG

SEQ ID NO: 12184 - protein, 8 aa, Mycobacterium tuberculosis
GSAACQGF

SEQ ID NO: 12185 - protein, 8 aa, Mycobacterium tuberculosis
SAACQGFI

SEQ ID NO: 12186 - protein, 8 aa, Mycobacterium tuberculosis
AACQGFIT

SEQ ID NO: 12187 - protein, 8 aa, Mycobacterium tuberculosis
ACQGFITQ

SEQ ID NO: 12188 - protein, 8 aa, Mycobacterium tuberculosis
CQGFITQL

SEQ ID NO: 12189 - protein, 8 aa, Mycobacterium tuberculosis
QGFITQLG

SEQ ID NO: 12190 - protein, 8 aa, Mycobacterium tuberculosis
GFITQLGR

SEQ ID NO: 12191 - protein, 8 aa, Mycobacterium tuberculosis
FITQLGRN

SEQ ID NO: 12192 - protein, 8 aa, Mycobacterium tuberculosis
ITQLGRNF

SEQ ID NO: 12193 - protein, 8 aa, Mycobacterium tuberculosis
TQLGRNFQ

SEQ ID NO: 12194 - protein, 8 aa, Mycobacterium tuberculosis
QLGRNFQV

SEQ ID NO: 12195 - protein, 8 aa, Mycobacterium tuberculosis
LGRNFQVI

SEQ ID NO: 12196 - protein, 8 aa, Mycobacterium tuberculosis
GRNFQVIY

SEQ ID NO: 12197 - protein, 8 aa, Mycobacterium tuberculosis
RNFQVIYE

SEQ ID NO: 12198 - protein, 8 aa, Mycobacterium tuberculosis
NFQVIYEQ

SEQ ID NO: 12199 - protein, 8 aa, Mycobacterium tuberculosis
FQVIYEQA

SEQ ID NO: 12200 - protein, 8 aa, Mycobacterium tuberculosis
QVIYEQAN

SEQ ID NO: 12201 - protein, 8 aa, Mycobacterium tuberculosis
VIYEQANA

SEQ ID NO: 12202 - protein, 8 aa, Mycobacterium tuberculosis
IYEQANAH

SEQ ID NO: 12203 - protein, 8 aa, Mycobacterium tuberculosis
YEQANAHG

SEQ ID NO: 12204 - protein, 8 aa, Mycobacterium tuberculosis
EQANAHGQ

SEQ ID NO: 12205 - protein, 8 aa, Mycobacterium tuberculosis
QANAHGQK

SEQ ID NO: 12206 - protein, 8 aa, Mycobacterium tuberculosis
ANAHGQKV

SEQ ID NO: 12207 - protein, 8 aa, Mycobacterium tuberculosis
NAHGQKVQ

SEQ ID NO: 12208 - protein, 8 aa, Mycobacterium tuberculosis
AHGQKVQA

SEQ ID NO: 12209 - protein, 8 aa, Mycobacterium tuberculosis
HGQKVQAA

SEQ ID NO: 12210 - protein, 8 aa, Mycobacterium tuberculosis
GQKVQAAG

SEQ ID NO: 12211 - protein, 8 aa, Mycobacterium tuberculosis
QKVQAAGN

SEQ ID NO: 12212 - protein, 8 aa, Mycobacterium tuberculosis
KVQAAGNN

SEQ ID NO: 12213 - protein, 8 aa, Mycobacterium tuberculosis
VQAAGNNM

SEQ ID NO: 12214 - protein, 8 aa, Mycobacterium tuberculosis
QAAGNNMA

SEQ ID NO: 12215 - protein, 8 aa, Mycobacterium tuberculosis
AAGNNMAQ

SEQ ID NO: 12216 - protein, 8 aa, Mycobacterium tuberculosis
AGNNMAQT

SEQ ID NO: 12217 - protein, 8 aa, Mycobacterium tuberculosis
GNNMAQTD

SEQ ID NO: 12218 - protein, 8 aa, Mycobacterium tuberculosis
NNMAQTDS

SEQ ID NO: 12219 - protein, 8 aa, Mycobacterium tuberculosis
NMAQTDSA

SEQ ID NO: 12220 - protein, 8 aa, Mycobacterium tuberculosis
MAQTDSAV

SEQ ID NO: 12221 - protein, 8 aa, Mycobacterium tuberculosis
AQTDSAVG

SEQ ID NO: 12222 - protein, 8 aa, Mycobacterium tuberculosis
QTDSAVGS

SEQ ID NO: 12223 - protein, 8 aa, Mycobacterium tuberculosis
TDSAVGSS

SEQ ID NO: 12224 - protein, 8 aa, Mycobacterium tuberculosis
DSAVGSSW

SEQ ID NO: 12225 - protein, 8 aa, Mycobacterium tuberculosis
SAVGSSWA

SEQ ID NO: 12226 - protein, 9 aa, Mycobacterium tuberculosis
MTINYQFGD

SEQ ID NO: 12227 - protein, 9 aa, Mycobacterium tuberculosis
TINYQFGDV

SEQ ID NO: 12228 - protein, 9 aa, Mycobacterium tuberculosis
INYQFGDVD

SEQ ID NO: 12229 - protein, 9 aa, Mycobacterium tuberculosis
NYQFGDVDA

SEQ ID NO: 12230 - protein, 9 aa, Mycobacterium tuberculosis
YQFGDVDAH

SEQ ID NO: 12231 - protein, 9 aa, Mycobacterium tuberculosis
QFGDVDAHG

SEQ ID NO: 12232 - protein, 9 aa, Mycobacterium tuberculosis
FGDVDAHGA

SEQ ID NO: 12233 - protein, 9 aa, Mycobacterium tuberculosis
GDVDAHGAM

SEQ ID NO: 12234 - protein, 9 aa, Mycobacterium tuberculosis
DVDAHGAMI

SEQ ID NO: 12235 - protein, 9 aa, Mycobacterium tuberculosis
VDAHGAMIR

SEQ ID NO: 12236 - protein, 9 aa, Mycobacterium tuberculosis
DAHGAMIRA

SEQ ID NO: 12237 - protein, 9 aa, Mycobacterium tuberculosis
AHGAMIRAQ

SEQ ID NO: 12238 - protein, 9 aa, Mycobacterium tuberculosis
HGAMIRAQA

SEQ ID NO: 12239 - protein, 9 aa, Mycobacterium tuberculosis
GAMIRAQAG

SEQ ID NO: 12240 - protein, 9 aa, Mycobacterium tuberculosis
AMIRAQAGS

SEQ ID NO: 12241 - protein, 9 aa, Mycobacterium tuberculosis
MIRAQAGSL

SEQ ID NO: 12242 - protein, 9 aa, Mycobacterium tuberculosis
IRAQAGSLE

SEQ ID NO: 12243 - protein, 9 aa, Mycobacterium tuberculosis
RAQAGSLEA

SEQ ID NO: 12244 - protein, 9 aa, Mycobacterium tuberculosis
AQAGSLEAE

SEQ ID NO: 12245 - protein, 9 aa, Mycobacterium tuberculosis
QAGSLEAEH

SEQ ID NO: 12246 - protein, 9 aa, Mycobacterium tuberculosis
AGSLEAEHQ

SEQ ID NO: 12247 - protein, 9 aa, Mycobacterium tuberculosis
GSLEAEHQA

SEQ ID NO: 12248 - protein, 9 aa, Mycobacterium tuberculosis
SLEAEHQAI

SEQ ID NO: 12249 - protein, 9 aa, Mycobacterium tuberculosis
LEAEHQAII

SEQ ID NO: 12250 - protein, 9 aa, Mycobacterium tuberculosis
EAEHQAIIS

SEQ ID NO: 12251 - protein, 9 aa, Mycobacterium tuberculosis
AEHQAIISD

SEQ ID NO: 12252 - protein, 9 aa, Mycobacterium tuberculosis
EHQAIISDV

SEQ ID NO: 12253 - protein, 9 aa, Mycobacterium tuberculosis
HQAIISDVL

SEQ ID NO: 12254 - protein, 9 aa, Mycobacterium tuberculosis
QAIISDVLT

SEQ ID NO: 12255 - protein, 9 aa, Mycobacterium tuberculosis
AIISDVLTA

SEQ ID NO: 12256 - protein, 9 aa, Mycobacterium tuberculosis
IISDVLTAS

SEQ ID NO: 12257 - protein, 9 aa, Mycobacterium tuberculosis
ISDVLTASD

SEQ ID NO: 12258 - protein, 9 aa, Mycobacterium tuberculosis
SDVLTASDF

SEQ ID NO: 12259 - protein, 9 aa, Mycobacterium tuberculosis
DVLTASDFW

SEQ ID NO: 12260 - protein, 9 aa, Mycobacterium tuberculosis
VLTASDFWG

SEQ ID NO: 12261 - protein, 9 aa, Mycobacterium tuberculosis
LTASDFWGG

SEQ ID NO: 12262 - protein, 9 aa, Mycobacterium tuberculosis
TASDFWGGA

SEQ ID NO: 12263 - protein, 9 aa, Mycobacterium tuberculosis
ASDFWGGAG

SEQ ID NO: 12264 - protein, 9 aa, Mycobacterium tuberculosis
SDFWGGAGS

SEQ ID NO: 12265 - protein, 9 aa, Mycobacterium tuberculosis
DFWGGAGSA

SEQ ID NO: 12266 - protein, 9 aa, Mycobacterium tuberculosis
FWGGAGSAA

SEQ ID NO: 12267 - protein, 9 aa, Mycobacterium tuberculosis
WGGAGSAAC

SEQ ID NO: 12268 - protein, 9 aa, Mycobacterium tuberculosis
GGAGSAACQ

SEQ ID NO: 12269 - protein, 9 aa, Mycobacterium tuberculosis
GAGSAACQG

SEQ ID NO: 12270 - protein, 9 aa, Mycobacterium tuberculosis
AGSAACQGF

SEQ ID NO: 12271 - protein, 9 aa, Mycobacterium tuberculosis
GSAACQGFI

SEQ ID NO: 12272 - protein, 9 aa, Mycobacterium tuberculosis
SAACQGFIT

SEQ ID NO: 12273 - protein, 9 aa, Mycobacterium tuberculosis
AACQGFITQ

SEQ ID NO: 12274 - protein, 9 aa, Mycobacterium tuberculosis
ACQGFITQL

SEQ ID NO: 12275 - protein, 9 aa, Mycobacterium tuberculosis
CQGFITQLG

SEQ ID NO: 12276 - protein, 9 aa, Mycobacterium tuberculosis
QGFITQLGR

SEQ ID NO: 12277 - protein, 9 aa, Mycobacterium tuberculosis
GFITQLGRN

SEQ ID NO: 12278 - protein, 9 aa, Mycobacterium tuberculosis
FITQLGRNF

SEQ ID NO: 12279 - protein, 9 aa, Mycobacterium tuberculosis
ITQLGRNFQ

SEQ ID NO: 12280 - protein, 9 aa, Mycobacterium tuberculosis
TQLGRNFQV

SEQ ID NO: 12281 - protein, 9 aa, Mycobacterium tuberculosis
QLGRNFQVI

SEQ ID NO: 12282 - protein, 9 aa, Mycobacterium tuberculosis
LGRNFQVIY

SEQ ID NO: 12283 - protein, 9 aa, Mycobacterium tuberculosis
GRNFQVIYE

SEQ ID NO: 12284 - protein, 9 aa, Mycobacterium tuberculosis
RNFQVIYEQ

SEQ ID NO: 12285 - protein, 9 aa, Mycobacterium tuberculosis
NFQVIYEQA

SEQ ID NO: 12286 - protein, 9 aa, Mycobacterium tuberculosis
FQVIYEQAN

SEQ ID NO: 12287 - protein, 9 aa, Mycobacterium tuberculosis
QVIYEQANA

SEQ ID NO: 12288 - protein, 9 aa, Mycobacterium tuberculosis
VIYEQANAH

SEQ ID NO: 12289 - protein, 9 aa, Mycobacterium tuberculosis
IYEQANAHG

SEQ ID NO: 12290 - protein, 9 aa, Mycobacterium tuberculosis
YEQANAHGQ

SEQ ID NO: 12291 - protein, 9 aa, Mycobacterium tuberculosis
EQANAHGQK

SEQ ID NO: 12292 - protein, 9 aa, Mycobacterium tuberculosis
QANAHGQKV

SEQ ID NO: 12293 - protein, 9 aa, Mycobacterium tuberculosis
ANAHGQKVQ

SEQ ID NO: 12294 - protein, 9 aa, Mycobacterium tuberculosis
NAHGQKVQA

SEQ ID NO: 12295 - protein, 9 aa, Mycobacterium tuberculosis
AHGQKVQAA

SEQ ID NO: 12296 - protein, 9 aa, Mycobacterium tuberculosis
HGQKVQAAG

SEQ ID NO: 12297 - protein, 9 aa, Mycobacterium tuberculosis
GQKVQAAGN

SEQ ID NO: 12298 - protein, 9 aa, Mycobacterium tuberculosis
QKVQAAGNN

SEQ ID NO: 12299 - protein, 9 aa, Mycobacterium tuberculosis
KVQAAGNNM

SEQ ID NO: 12300 - protein, 9 aa, Mycobacterium tuberculosis
VQAAGNNMA

SEQ ID NO: 12301 - protein, 9 aa, Mycobacterium tuberculosis
QAAGNNMAQ

SEQ ID NO: 12302 - protein, 9 aa, Mycobacterium tuberculosis
AAGNNMAQT

SEQ ID NO: 12303 - protein, 9 aa, Mycobacterium tuberculosis
AGNNMAQTD

SEQ ID NO: 12304 - protein, 9 aa, Mycobacterium tuberculosis
GNNMAQTDS

SEQ ID NO: 12305 - protein, 9 aa, Mycobacterium tuberculosis
NNMAQTDSA

SEQ ID NO: 12306 - protein, 9 aa, Mycobacterium tuberculosis
NMAQTDSAV

SEQ ID NO: 12307 - protein, 9 aa, Mycobacterium tuberculosis
MAQTDSAVG

SEQ ID NO: 12308 - protein, 9 aa, Mycobacterium tuberculosis
AQTDSAVGS

SEQ ID NO: 12309 - protein, 9 aa, Mycobacterium tuberculosis
QTDSAVGSS

SEQ ID NO: 12310 - protein, 9 aa, Mycobacterium tuberculosis
TDSAVGSSW

SEQ ID NO: 12311 - protein, 9 aa, Mycobacterium tuberculosis
DSAVGSSWA

SEQ ID NO: 12312 - protein, 10 aa, Mycobacterium tuberculosis
MTINYQFGDV

SEQ ID NO: 12313 - protein, 10 aa, Mycobacterium tuberculosis
TINYQFGDVD

SEQ ID NO: 12314 - protein, 10 aa, Mycobacterium tuberculosis
INYQFGDVDA

SEQ ID NO: 12315 - protein, 10 aa, Mycobacterium tuberculosis
NYQFGDVDAH

SEQ ID NO: 12316 - protein, 10 aa, Mycobacterium tuberculosis
YQFGDVDAHG

SEQ ID NO: 12317 - protein, 10 aa, Mycobacterium tuberculosis
QFGDVDAHGA

SEQ ID NO: 12318 - protein, 10 aa, Mycobacterium tuberculosis
FGDVDAHGAM

SEQ ID NO: 12319 - protein, 10 aa, Mycobacterium tuberculosis
GDVDAHGAMI

SEQ ID NO: 12320 - protein, 10 aa, Mycobacterium tuberculosis
DVDAHGAMIR

SEQ ID NO: 12321 - protein, 10 aa, Mycobacterium tuberculosis
VDAHGAMIRA

SEQ ID NO: 12322 - protein, 10 aa, Mycobacterium tuberculosis
DAHGAMIRAQ

SEQ ID NO: 12323 - protein, 10 aa, Mycobacterium tuberculosis
AHGAMIRAQA

SEQ ID NO: 12324 - protein, 10 aa, Mycobacterium tuberculosis
HGAMIRAQAG

SEQ ID NO: 12325 - protein, 10 aa, Mycobacterium tuberculosis
GAMIRAQAGS

SEQ ID NO: 12326 - protein, 10 aa, Mycobacterium tuberculosis
AMIRAQAGSL

SEQ ID NO: 12327 - protein, 10 aa, Mycobacterium tuberculosis
MIRAQAGSLE

SEQ ID NO: 12328 - protein, 10 aa, Mycobacterium tuberculosis
IRAQAGSLEA

SEQ ID NO: 12329 - protein, 10 aa, Mycobacterium tuberculosis
RAQAGSLEAE

SEQ ID NO: 12330 - protein, 10 aa, Mycobacterium tuberculosis
AQAGSLEAEH

SEQ ID NO: 12331 - protein, 10 aa, Mycobacterium tuberculosis
QAGSLEAEHQ

SEQ ID NO: 12332 - protein, 10 aa, Mycobacterium tuberculosis
AGSLEAEHQA

SEQ ID NO: 12333 - protein, 10 aa, Mycobacterium tuberculosis
GSLEAEHQAI

SEQ ID NO: 12334 - protein, 10 aa, Mycobacterium tuberculosis
SLEAEHQAII

SEQ ID NO: 12335 - protein, 10 aa, Mycobacterium tuberculosis
LEAEHQAIIS

SEQ ID NO: 12336 - protein, 10 aa, Mycobacterium tuberculosis
EAEHQAIISD

SEQ ID NO: 12337 - protein, 10 aa, Mycobacterium tuberculosis
AEHQAIISDV

SEQ ID NO: 12338 - protein, 10 aa, Mycobacterium tuberculosis
EHQAIISDVL

SEQ ID NO: 12339 - protein, 10 aa, Mycobacterium tuberculosis
HQAIISDVLT

SEQ ID NO: 12340 - protein, 10 aa, Mycobacterium tuberculosis
QAIISDVLTA

SEQ ID NO: 12341 - protein, 10 aa, Mycobacterium tuberculosis
AIISDVLTAS

SEQ ID NO: 12342 - protein, 10 aa, Mycobacterium tuberculosis
IISDVLTASD

SEQ ID NO: 12343 - protein, 10 aa, Mycobacterium tuberculosis
ISDVLTASDF

SEQ ID NO: 12344 - protein, 10 aa, Mycobacterium tuberculosis
SDVLTASDFW

SEQ ID NO: 12345 - protein, 10 aa, Mycobacterium tuberculosis
DVLTASDFWG

SEQ ID NO: 12346 - protein, 10 aa, Mycobacterium tuberculosis
VLTASDFWGG

SEQ ID NO: 12347 - protein, 10 aa, Mycobacterium tuberculosis
LTASDFWGGA

SEQ ID NO: 12348 - protein, 10 aa, Mycobacterium tuberculosis
TASDFWGGAG

SEQ ID NO: 12349 - protein, 10 aa, Mycobacterium tuberculosis
ASDFWGGAGS

SEQ ID NO: 12350 - protein, 10 aa, Mycobacterium tuberculosis
SDFWGGAGSA

SEQ ID NO: 12351 - protein, 10 aa, Mycobacterium tuberculosis
DFWGGAGSAA

SEQ ID NO: 12352 - protein, 10 aa, Mycobacterium tuberculosis
FWGGAGSAAC

SEQ ID NO: 12353 - protein, 10 aa, Mycobacterium tuberculosis
WGGAGSAACQ

SEQ ID NO: 12354 - protein, 10 aa, Mycobacterium tuberculosis
GGAGSAACQG

SEQ ID NO: 12355 - protein, 10 aa, Mycobacterium tuberculosis
GAGSAACQGF

SEQ ID NO: 12356 - protein, 10 aa, Mycobacterium tuberculosis
AGSAACQGFI

SEQ ID NO: 12357 - protein, 10 aa, Mycobacterium tuberculosis
GSAACQGFIT

SEQ ID NO: 12358 - protein, 10 aa, Mycobacterium tuberculosis
SAACQGFITQ

SEQ ID NO: 12359 - protein, 10 aa, Mycobacterium tuberculosis
AACQGFITQL

SEQ ID NO: 12360 - protein, 10 aa, Mycobacterium tuberculosis
ACQGFITQLG

SEQ ID NO: 12361 - protein, 10 aa, Mycobacterium tuberculosis
CQGFITQLGR

SEQ ID NO: 12362 - protein, 10 aa, Mycobacterium tuberculosis
QGFITQLGRN

SEQ ID NO: 12363 - protein, 10 aa, Mycobacterium tuberculosis
GFITQLGRNF

SEQ ID NO: 12364 - protein, 10 aa, Mycobacterium tuberculosis
FITQLGRNFQ

SEQ ID NO: 12365 - protein, 10 aa, Mycobacterium tuberculosis
ITQLGRNFQV

SEQ ID NO: 12366 - protein, 10 aa, Mycobacterium tuberculosis
TQLGRNFQVI

SEQ ID NO: 12367 - protein, 10 aa, Mycobacterium tuberculosis
QLGRNFQVIY

SEQ ID NO: 12368 - protein, 10 aa, Mycobacterium tuberculosis
LGRNFQVIYE

SEQ ID NO: 12369 - protein, 10 aa, Mycobacterium tuberculosis
GRNFQVIYEQ

SEQ ID NO: 12370 - protein, 10 aa, Mycobacterium tuberculosis
RNFQVIYEQA

SEQ ID NO: 12371 - protein, 10 aa, Mycobacterium tuberculosis
NFQVIYEQAN

SEQ ID NO: 12372 - protein, 10 aa, Mycobacterium tuberculosis
FQVIYEQANA

SEQ ID NO: 12373 - protein, 10 aa, Mycobacterium tuberculosis
QVIYEQANAH

SEQ ID NO: 12374 - protein, 10 aa, Mycobacterium tuberculosis
VIYEQANAHG

SEQ ID NO: 12375 - protein, 10 aa, Mycobacterium tuberculosis
IYEQANAHGQ

SEQ ID NO: 12376 - protein, 10 aa, Mycobacterium tuberculosis
YEQANAHGQK

SEQ ID NO: 12377 - protein, 10 aa, Mycobacterium tuberculosis
EQANAHGQKV

SEQ ID NO: 12378 - protein, 10 aa, Mycobacterium tuberculosis
QANAHGQKVQ

SEQ ID NO: 12379 - protein, 10 aa, Mycobacterium tuberculosis
ANAHGQKVQA

SEQ ID NO: 12380 - protein, 10 aa, Mycobacterium tuberculosis
NAHGQKVQAA

SEQ ID NO: 12381 - protein, 10 aa, Mycobacterium tuberculosis
AHGQKVQAAG

SEQ ID NO: 12382 - protein, 10 aa, Mycobacterium tuberculosis
HGQKVQAAGN

SEQ ID NO: 12383 - protein, 10 aa, Mycobacterium tuberculosis
GQKVQAAGNN

SEQ ID NO: 12384 - protein, 10 aa, Mycobacterium tuberculosis
QKVQAAGNNM

SEQ ID NO: 12385 - protein, 10 aa, Mycobacterium tuberculosis
KVQAAGNNMA

SEQ ID NO: 12386 - protein, 10 aa, Mycobacterium tuberculosis
VQAAGNNMAQ

SEQ ID NO: 12387 - protein, 10 aa, Mycobacterium tuberculosis
QAAGNNMAQT

SEQ ID NO: 12388 - protein, 10 aa, Mycobacterium tuberculosis
AAGNNMAQTD

SEQ ID NO: 12389 - protein, 10 aa, Mycobacterium tuberculosis
AGNNMAQTDS

SEQ ID NO: 12390 - protein, 10 aa, Mycobacterium tuberculosis
GNNMAQTDSA

SEQ ID NO: 12391 - protein, 10 aa, Mycobacterium tuberculosis
NNMAQTDSAV

SEQ ID NO: 12392 - protein, 10 aa, Mycobacterium tuberculosis
NMAQTDSAVG

SEQ ID NO: 12393 - protein, 10 aa, Mycobacterium tuberculosis
MAQTDSAVGS

SEQ ID NO: 12394 - protein, 10 aa, Mycobacterium tuberculosis
AQTDSAVGSS

SEQ ID NO: 12395 - protein, 10 aa, Mycobacterium tuberculosis
QTDSAVGSSW

SEQ ID NO: 12396 - protein, 10 aa, Mycobacterium tuberculosis
TDSAVGSSWA

SEQ ID NO: 12397 - protein, 11 aa, Mycobacterium tuberculosis
MTINYQFGDVD

SEQ ID NO: 12398 - protein, 11 aa, Mycobacterium tuberculosis
TINYQFGDVDA

SEQ ID NO: 12399 - protein, 11 aa, Mycobacterium tuberculosis
INYQFGDVDAH

SEQ ID NO: 12400 - protein, 11 aa, Mycobacterium tuberculosis
NYQFGDVDAHG

SEQ ID NO: 12401 - protein, 11 aa, Mycobacterium tuberculosis
YQFGDVDAHGA

SEQ ID NO: 12402 - protein, 11 aa, Mycobacterium tuberculosis
QFGDVDAHGAM

SEQ ID NO: 12403 - protein, 11 aa, Mycobacterium tuberculosis
FGDVDAHGAMI

SEQ ID NO: 12404 - protein, 11 aa, Mycobacterium tuberculosis
GDVDAHGAMIR

SEQ ID NO: 12405 - protein, 11 aa, Mycobacterium tuberculosis
DVDAHGAMIRA

SEQ ID NO: 12406 - protein, 11 aa, Mycobacterium tuberculosis
VDAHGAMIRAQ

SEQ ID NO: 12407 - protein, 11 aa, Mycobacterium tuberculosis
DAHGAMIRAQA

SEQ ID NO: 12408 - protein, 11 aa, Mycobacterium tuberculosis
AHGAMIRAQAG

SEQ ID NO: 12409 - protein, 11 aa, Mycobacterium tuberculosis
HGAMIRAQAGS

SEQ ID NO: 12410 - protein, 11 aa, Mycobacterium tuberculosis
GAMIRAQAGSL

SEQ ID NO: 12411 - protein, 11 aa, Mycobacterium tuberculosis
AMIRAQAGSLE

SEQ ID NO: 12412 - protein, 11 aa, Mycobacterium tuberculosis
MIRAQAGSLEA

SEQ ID NO: 12413 - protein, 11 aa, Mycobacterium tuberculosis
IRAQAGSLEAE

SEQ ID NO: 12414 - protein, 11 aa, Mycobacterium tuberculosis
RAQAGSLEAEH

SEQ ID NO: 12415 - protein, 11 aa, Mycobacterium tuberculosis
AQAGSLEAEHQ

SEQ ID NO: 12416 - protein, 11 aa, Mycobacterium tuberculosis
QAGSLEAEHQA

SEQ ID NO: 12417 - protein, 11 aa, Mycobacterium tuberculosis
AGSLEAEHQAI

SEQ ID NO: 12418 - protein, 11 aa, Mycobacterium tuberculosis
GSLEAEHQAII

SEQ ID NO: 12419 - protein, 11 aa, Mycobacterium tuberculosis
SLEAEHQAIIS

SEQ ID NO: 12420 - protein, 11 aa, Mycobacterium tuberculosis
LEAEHQAIISD

SEQ ID NO: 12421 - protein, 11 aa, Mycobacterium tuberculosis
EAEHQAIISDV

SEQ ID NO: 12422 - protein, 11 aa, Mycobacterium tuberculosis
AEHQAIISDVL

SEQ ID NO: 12423 - protein, 11 aa, Mycobacterium tuberculosis
EHQAIISDVLT

SEQ ID NO: 12424 - protein, 11 aa, Mycobacterium tuberculosis
HQAIISDVLTA

SEQ ID NO: 12425 - protein, 11 aa, Mycobacterium tuberculosis
QAIISDVLTAS

SEQ ID NO: 12426 - protein, 11 aa, Mycobacterium tuberculosis
AIISDVLTASD

SEQ ID NO: 12427 - protein, 11 aa, Mycobacterium tuberculosis
IISDVLTASDF

SEQ ID NO: 12428 - protein, 11 aa, Mycobacterium tuberculosis
ISDVLTASDFW

SEQ ID NO: 12429 - protein, 11 aa, Mycobacterium tuberculosis
SDVLTASDFWG

SEQ ID NO: 12430 - protein, 11 aa, Mycobacterium tuberculosis
DVLTASDFWGG

SEQ ID NO: 12431 - protein, 11 aa, Mycobacterium tuberculosis
VLTASDFWGGA

SEQ ID NO: 12432 - protein, 11 aa, Mycobacterium tuberculosis
LTASDFWGGAG

SEQ ID NO: 12433 - protein, 11 aa, Mycobacterium tuberculosis
TASDFWGGAGS

SEQ ID NO: 12434 - protein, 11 aa, Mycobacterium tuberculosis
ASDFWGGAGSA

SEQ ID NO: 12435 - protein, 11 aa, Mycobacterium tuberculosis
SDFWGGAGSAA

SEQ ID NO: 12436 - protein, 11 aa, Mycobacterium tuberculosis
DFWGGAGSAAC

SEQ ID NO: 12437 - protein, 11 aa, Mycobacterium tuberculosis
FWGGAGSAACQ

SEQ ID NO: 12438 - protein, 11 aa, Mycobacterium tuberculosis
WGGAGSAACQG

SEQ ID NO: 12439 - protein, 11 aa, Mycobacterium tuberculosis
GGAGSAACQGF

SEQ ID NO: 12440 - protein, 11 aa, Mycobacterium tuberculosis
GAGSAACQGFI

SEQ ID NO: 12441 - protein, 11 aa, Mycobacterium tuberculosis
AGSAACQGFIT

SEQ ID NO: 12442 - protein, 11 aa, Mycobacterium tuberculosis
GSAACQGFITQ

SEQ ID NO: 12443 - protein, 11 aa, Mycobacterium tuberculosis
SAACQGFITQL

SEQ ID NO: 12444 - protein, 11 aa, Mycobacterium tuberculosis
AACQGFITQLG

SEQ ID NO: 12445 - protein, 11 aa, Mycobacterium tuberculosis
ACQGFITQLGR

SEQ ID NO: 12446 - protein, 11 aa, Mycobacterium tuberculosis
CQGFITQLGRN

SEQ ID NO: 12447 - protein, 11 aa, Mycobacterium tuberculosis
QGFITQLGRNF

SEQ ID NO: 12448 - protein, 11 aa, Mycobacterium tuberculosis
GFITQLGRNFQ

SEQ ID NO: 12449 - protein, 11 aa, Mycobacterium tuberculosis
FITQLGRNFQV

SEQ ID NO: 12450 - protein, 11 aa, Mycobacterium tuberculosis
ITQLGRNFQVI

SEQ ID NO: 12451 - protein, 11 aa, Mycobacterium tuberculosis
TQLGRNFQVIY

SEQ ID NO: 12452 - protein, 11 aa, Mycobacterium tuberculosis
QLGRNFQVIYE

SEQ ID NO: 12453 - protein, 11 aa, Mycobacterium tuberculosis
LGRNFQVIYEQ

SEQ ID NO: 12454 - protein, 11 aa, Mycobacterium tuberculosis
GRNFQVIYEQA

SEQ ID NO: 12455 - protein, 11 aa, Mycobacterium tuberculosis
RNFQVIYEQAN

SEQ ID NO: 12456 - protein, 11 aa, Mycobacterium tuberculosis
NFQVIYEQANA

SEQ ID NO: 12457 - protein, 11 aa, Mycobacterium tuberculosis
FQVIYEQANAH

SEQ ID NO: 12458 - protein, 11 aa, Mycobacterium tuberculosis
QVIYEQANAHG

SEQ ID NO: 12459 - protein, 11 aa, Mycobacterium tuberculosis
VIYEQANAHGQ

SEQ ID NO: 12460 - protein, 11 aa, Mycobacterium tuberculosis
IYEQANAHGQK

SEQ ID NO: 12461 - protein, 11 aa, Mycobacterium tuberculosis
YEQANAHGQKV

SEQ ID NO: 12462 - protein, 11 aa, Mycobacterium tuberculosis
EQANAHGQKVQ

SEQ ID NO: 12463 - protein, 11 aa, Mycobacterium tuberculosis
QANAHGQKVQA

SEQ ID NO: 12464 - protein, 11 aa, Mycobacterium tuberculosis
ANAHGQKVQAA

SEQ ID NO: 12465 - protein, 11 aa, Mycobacterium tuberculosis
NAHGQKVQAAG

SEQ ID NO: 12466 - protein, 11 aa, Mycobacterium tuberculosis
AHGQKVQAAGN

SEQ ID NO: 12467 - protein, 11 aa, Mycobacterium tuberculosis
HGQKVQAAGNN

SEQ ID NO: 12468 - protein, 11 aa, Mycobacterium tuberculosis
GQKVQAAGNNM

SEQ ID NO: 12469 - protein, 11 aa, Mycobacterium tuberculosis
QKVQAAGNNMA

SEQ ID NO: 12470 - protein, 11 aa, Mycobacterium tuberculosis
KVQAAGNNMAQ

SEQ ID NO: 12471 - protein, 11 aa, Mycobacterium tuberculosis
VQAAGNNMAQT

SEQ ID NO: 12472 - protein, 11 aa, Mycobacterium tuberculosis
QAAGNNMAQTD

SEQ ID NO: 12473 - protein, 11 aa, Mycobacterium tuberculosis
AAGNNMAQTDS

SEQ ID NO: 12474 - protein, 11 aa, Mycobacterium tuberculosis
AGNNMAQTDSA

SEQ ID NO: 12475 - protein, 11 aa, Mycobacterium tuberculosis
GNNMAQTDSAV

SEQ ID NO: 12476 - protein, 11 aa, Mycobacterium tuberculosis
NNMAQTDSAVG

SEQ ID NO: 12477 - protein, 11 aa, Mycobacterium tuberculosis
NMAQTDSAVGS

SEQ ID NO: 12478 - protein, 11 aa, Mycobacterium tuberculosis
MAQTDSAVGSS

SEQ ID NO: 12479 - protein, 11 aa, Mycobacterium tuberculosis
AQTDSAVGSSW

SEQ ID NO: 12480 - protein, 11 aa, Mycobacterium tuberculosis
QTDSAVGSSWA

SEQ ID NO: 12481 - protein, 8 aa, Mycobacterium tuberculosis
MASRFMTD

SEQ ID NO: 12482 - protein, 8 aa, Mycobacterium tuberculosis
ASRFMTDP

SEQ ID NO: 12483 - protein, 8 aa, Mycobacterium tuberculosis
SRFMTDPH

SEQ ID NO: 12484 - protein, 8 aa, Mycobacterium tuberculosis
RFMTDPHA

SEQ ID NO: 12485 - protein, 8 aa, Mycobacterium tuberculosis
FMTDPHAM

SEQ ID NO: 12486 - protein, 8 aa, Mycobacterium tuberculosis
MTDPHAMR

SEQ ID NO: 12487 - protein, 8 aa, Mycobacterium tuberculosis
TDPHAMRD

SEQ ID NO: 12488 - protein, 8 aa, Mycobacterium tuberculosis
DPHAMRDM

SEQ ID NO: 12489 - protein, 8 aa, Mycobacterium tuberculosis
PHAMRDMA

SEQ ID NO: 12490 - protein, 8 aa, Mycobacterium tuberculosis
HAMRDMAG

SEQ ID NO: 12491 - protein, 8 aa, Mycobacterium tuberculosis
AMRDMAGR

SEQ ID NO: 12492 - protein, 8 aa, Mycobacterium tuberculosis
MRDMAGRF

SEQ ID NO: 12493 - protein, 8 aa, Mycobacterium tuberculosis
RDMAGRFE

SEQ ID NO: 12494 - protein, 8 aa, Mycobacterium tuberculosis
DMAGRFEV

SEQ ID NO: 12495 - protein, 8 aa, Mycobacterium tuberculosis
MAGRFEVH

SEQ ID NO: 12496 - protein, 8 aa, Mycobacterium tuberculosis
AGRFEVHA

SEQ ID NO: 12497 - protein, 8 aa, Mycobacterium tuberculosis
GRFEVHAQ

SEQ ID NO: 12498 - protein, 8 aa, Mycobacterium tuberculosis
RFEVHAQT

SEQ ID NO: 12499 - protein, 8 aa, Mycobacterium tuberculosis
FEVHAQTV

SEQ ID NO: 12500 - protein, 8 aa, Mycobacterium tuberculosis
EVHAQTVE

SEQ ID NO: 12501 - protein, 8 aa, Mycobacterium tuberculosis
VHAQTVED

SEQ ID NO: 12502 - protein, 8 aa, Mycobacterium tuberculosis
HAQTVEDE

SEQ ID NO: 12503 - protein, 8 aa, Mycobacterium tuberculosis
AQTVEDEA

SEQ ID NO: 12504 - protein, 8 aa, Mycobacterium tuberculosis
QTVEDEAR

SEQ ID NO: 12505 - protein, 8 aa, Mycobacterium tuberculosis
TVEDEARR

SEQ ID NO: 12506 - protein, 8 aa, Mycobacterium tuberculosis
VEDEARRM

SEQ ID NO: 12507 - protein, 8 aa, Mycobacterium tuberculosis
EDEARRMW

SEQ ID NO: 12508 - protein, 8 aa, Mycobacterium tuberculosis
DEARRMWA

SEQ ID NO: 12509 - protein, 8 aa, Mycobacterium tuberculosis
EARRMWAS

SEQ ID NO: 12510 - protein, 8 aa, Mycobacterium tuberculosis
ARRMWASA

SEQ ID NO: 12511 - protein, 8 aa, Mycobacterium tuberculosis
RRMWASAQ

SEQ ID NO: 12512 - protein, 8 aa, Mycobacterium tuberculosis
RMWASAQN

SEQ ID NO: 12513 - protein, 8 aa, Mycobacterium tuberculosis
MWASAQNI

SEQ ID NO: 12514 - protein, 8 aa, Mycobacterium tuberculosis
WASAQNIS

SEQ ID NO: 12515 - protein, 8 aa, Mycobacterium tuberculosis
ASAQNISG

SEQ ID NO: 12516 - protein, 8 aa, Mycobacterium tuberculosis
SAQNISGA

SEQ ID NO: 12517 - protein, 8 aa, Mycobacterium tuberculosis
AQNISGAG

SEQ ID NO: 12518 - protein, 8 aa, Mycobacterium tuberculosis
QNISGAGW

SEQ ID NO: 12519 - protein, 8 aa, Mycobacterium tuberculosis
NISGAGWS

SEQ ID NO: 12520 - protein, 8 aa, Mycobacterium tuberculosis
ISGAGWSG

SEQ ID NO: 12521 - protein, 8 aa, Mycobacterium tuberculosis
SGAGWSGM

SEQ ID NO: 12522 - protein, 8 aa, Mycobacterium tuberculosis
GAGWSGMA

SEQ ID NO: 12523 - protein, 8 aa, Mycobacterium tuberculosis
AGWSGMAE

SEQ ID NO: 12524 - protein, 8 aa, Mycobacterium tuberculosis
GWSGMAEA

SEQ ID NO: 12525 - protein, 8 aa, Mycobacterium tuberculosis
WSGMAEAT

SEQ ID NO: 12526 - protein, 8 aa, Mycobacterium tuberculosis
SGMAEATS

SEQ ID NO: 12527 - protein, 8 aa, Mycobacterium tuberculosis
GMAEATSL

SEQ ID NO: 12528 - protein, 8 aa, Mycobacterium tuberculosis
MAEATSLD

SEQ ID NO: 12529 - protein, 8 aa, Mycobacterium tuberculosis
AEATSLDT

SEQ ID NO: 12530 - protein, 8 aa, Mycobacterium tuberculosis
EATSLDTM

SEQ ID NO: 12531 - protein, 8 aa, Mycobacterium tuberculosis
ATSLDTMT

SEQ ID NO: 12532 - protein, 8 aa, Mycobacterium tuberculosis
TSLDTMTQ

SEQ ID NO: 12533 - protein, 8 aa, Mycobacterium tuberculosis
SLDTMTQM

SEQ ID NO: 12534 - protein, 8 aa, Mycobacterium tuberculosis
LDTMTQMN

SEQ ID NO: 12535 - protein, 8 aa, Mycobacterium tuberculosis
DTMTQMNQ

SEQ ID NO: 12536 - protein, 8 aa, Mycobacterium tuberculosis
TMTQMNQA

SEQ ID NO: 12537 - protein, 8 aa, Mycobacterium tuberculosis
MTQMNQAF

SEQ ID NO: 12538 - protein, 8 aa, Mycobacterium tuberculosis
TQMNQAFR

SEQ ID NO: 12539 - protein, 8 aa, Mycobacterium tuberculosis
QMNQAFRN

SEQ ID NO: 12540 - protein, 8 aa, Mycobacterium tuberculosis
MNQAFRNI

SEQ ID NO: 12541 - protein, 8 aa, Mycobacterium tuberculosis
NQAFRNIV

SEQ ID NO: 12542 - protein, 8 aa, Mycobacterium tuberculosis
QAFRNIVN

SEQ ID NO: 12543 - protein, 8 aa, Mycobacterium tuberculosis
AFRNIVNM

SEQ ID NO: 12544 - protein, 8 aa, Mycobacterium tuberculosis
FRNIVNML

SEQ ID NO: 12545 - protein, 8 aa, Mycobacterium tuberculosis
RNIVNMLH

SEQ ID NO: 12546 - protein, 8 aa, Mycobacterium tuberculosis
NIVNMLHG

SEQ ID NO: 12547 - protein, 8 aa, Mycobacterium tuberculosis
IVNMLHGV

SEQ ID NO: 12548 - protein, 8 aa, Mycobacterium tuberculosis
VNMLHGVR

SEQ ID NO: 12549 - protein, 8 aa, Mycobacterium tuberculosis
NMLHGVRD

SEQ ID NO: 12550 - protein, 8 aa, Mycobacterium tuberculosis
MLHGVRDG

SEQ ID NO: 12551 - protein, 8 aa, Mycobacterium tuberculosis
LHGVRDGL

SEQ ID NO: 12552 - protein, 8 aa, Mycobacterium tuberculosis
HGVRDGLV

SEQ ID NO: 12553 - protein, 8 aa, Mycobacterium tuberculosis
GVRDGLVR

SEQ ID NO: 12554 - protein, 8 aa, Mycobacterium tuberculosis
VRDGLVRD

SEQ ID NO: 12555 - protein, 8 aa, Mycobacterium tuberculosis
RDGLVRDA

SEQ ID NO: 12556 - protein, 8 aa, Mycobacterium tuberculosis
DGLVRDAN

SEQ ID NO: 12557 - protein, 8 aa, Mycobacterium tuberculosis
GLVRDANN

SEQ ID NO: 12558 - protein, 8 aa, Mycobacterium tuberculosis
LVRDANNY

SEQ ID NO: 12559 - protein, 8 aa, Mycobacterium tuberculosis
VRDANNYE

SEQ ID NO: 12560 - protein, 8 aa, Mycobacterium tuberculosis
RDANNYEQ

SEQ ID NO: 12561 - protein, 8 aa, Mycobacterium tuberculosis
DANNYEQQ

SEQ ID NO: 12562 - protein, 8 aa, Mycobacterium tuberculosis
ANNYEQQE

SEQ ID NO: 12563 - protein, 8 aa, Mycobacterium tuberculosis
NNYEQQEQ

SEQ ID NO: 12564 - protein, 8 aa, Mycobacterium tuberculosis
NYEQQEQA

SEQ ID NO: 12565 - protein, 8 aa, Mycobacterium tuberculosis
YEQQEQAS

SEQ ID NO: 12566 - protein, 8 aa, Mycobacterium tuberculosis
EQQEQASQ

SEQ ID NO: 12567 - protein, 8 aa, Mycobacterium tuberculosis
QQEQASQQ

SEQ ID NO: 12568 - protein, 8 aa, Mycobacterium tuberculosis
QEQASQQI

SEQ ID NO: 12569 - protein, 8 aa, Mycobacterium tuberculosis
EQASQQIL

SEQ ID NO: 12570 - protein, 8 aa, Mycobacterium tuberculosis
QASQQILS

SEQ ID NO: 12571 - protein, 8 aa, Mycobacterium tuberculosis
ASQQILSS

SEQ ID NO: 12572 - protein, 9 aa, Mycobacterium tuberculosis
MASRFMTDP

SEQ ID NO: 12573 - protein, 9 aa, Mycobacterium tuberculosis
ASRFMTDPH

SEQ ID NO: 12574 - protein, 9 aa, Mycobacterium tuberculosis
SRFMTDPHA

SEQ ID NO: 12575 - protein, 9 aa, Mycobacterium tuberculosis
RFMTDPHAM

SEQ ID NO: 12576 - protein, 9 aa, Mycobacterium tuberculosis
FMTDPHAMR

SEQ ID NO: 12577 - protein, 9 aa, Mycobacterium tuberculosis
MTDPHAMRD

SEQ ID NO: 12578 - protein, 9 aa, Mycobacterium tuberculosis
TDPHAMRDM

SEQ ID NO: 12579 - protein, 9 aa, Mycobacterium tuberculosis
DPHAMRDMA

SEQ ID NO: 12580 - protein, 9 aa, Mycobacterium tuberculosis
PHAMRDMAG

SEQ ID NO: 12581 - protein, 9 aa, Mycobacterium tuberculosis
HAMRDMAGR

SEQ ID NO: 12582 - protein, 9 aa, Mycobacterium tuberculosis
AMRDMAGRF

SEQ ID NO: 12583 - protein, 9 aa, Mycobacterium tuberculosis
MRDMAGRFE

SEQ ID NO: 12584 - protein, 9 aa, Mycobacterium tuberculosis
RDMAGRFEV

SEQ ID NO: 12585 - protein, 9 aa, Mycobacterium tuberculosis
DMAGRFEVH

SEQ ID NO: 12586 - protein, 9 aa, Mycobacterium tuberculosis
MAGRFEVHA

SEQ ID NO: 12587 - protein, 9 aa, Mycobacterium tuberculosis
AGRFEVHAQ

SEQ ID NO: 12588 - protein, 9 aa, Mycobacterium tuberculosis
GRFEVHAQT

SEQ ID NO: 12589 - protein, 9 aa, Mycobacterium tuberculosis
RFEVHAQTV

SEQ ID NO: 12590 - protein, 9 aa, Mycobacterium tuberculosis
FEVHAQTVE

SEQ ID NO: 12591 - protein, 9 aa, Mycobacterium tuberculosis
EVHAQTVED

SEQ ID NO: 12592 - protein, 9 aa, Mycobacterium tuberculosis
VHAQTVEDE

SEQ ID NO: 12593 - protein, 9 aa, Mycobacterium tuberculosis
HAQTVEDEA

SEQ ID NO: 12594 - protein, 9 aa, Mycobacterium tuberculosis
AQTVEDEAR

SEQ ID NO: 12595 - protein, 9 aa, Mycobacterium tuberculosis
QTVEDEARR

SEQ ID NO: 12596 - protein, 9 aa, Mycobacterium tuberculosis
TVEDEARRM

SEQ ID NO: 12597 - protein, 9 aa, Mycobacterium tuberculosis
VEDEARRMW

SEQ ID NO: 12598 - protein, 9 aa, Mycobacterium tuberculosis
EDEARRMWA

SEQ ID NO: 12599 - protein, 9 aa, Mycobacterium tuberculosis
DEARRMWAS

SEQ ID NO: 12600 - protein, 9 aa, Mycobacterium tuberculosis
EARRMWASA

SEQ ID NO: 12601 - protein, 9 aa, Mycobacterium tuberculosis
ARRMWASAQ

SEQ ID NO: 12602 - protein, 9 aa, Mycobacterium tuberculosis
RRMWASAQN

SEQ ID NO: 12603 - protein, 9 aa, Mycobacterium tuberculosis
RMWASAQNI

SEQ ID NO: 12604 - protein, 9 aa, Mycobacterium tuberculosis
MWASAQNIS

SEQ ID NO: 12605 - protein, 9 aa, Mycobacterium tuberculosis
WASAQNISG

SEQ ID NO: 12606 - protein, 9 aa, Mycobacterium tuberculosis
ASAQNISGA

SEQ ID NO: 12607 - protein, 9 aa, Mycobacterium tuberculosis
SAQNISGAG

SEQ ID NO: 12608 - protein, 9 aa, Mycobacterium tuberculosis
AQNISGAGW

SEQ ID NO: 12609 - protein, 9 aa, Mycobacterium tuberculosis
QNISGAGWS

SEQ ID NO: 12610 - protein, 9 aa, Mycobacterium tuberculosis
NISGAGWSG

SEQ ID NO: 12611 - protein, 9 aa, Mycobacterium tuberculosis
ISGAGWSGM

SEQ ID NO: 12612 - protein, 9 aa, Mycobacterium tuberculosis
SGAGWSGMA

SEQ ID NO: 12613 - protein, 9 aa, Mycobacterium tuberculosis
GAGWSGMAE

SEQ ID NO: 12614 - protein, 9 aa, Mycobacterium tuberculosis
AGWSGMAEA

SEQ ID NO: 12615 - protein, 9 aa, Mycobacterium tuberculosis
GWSGMAEAT

SEQ ID NO: 12616 - protein, 9 aa, Mycobacterium tuberculosis
WSGMAEATS

SEQ ID NO: 12617 - protein, 9 aa, Mycobacterium tuberculosis
SGMAEATSL

SEQ ID NO: 12618 - protein, 9 aa, Mycobacterium tuberculosis
GMAEATSLD

SEQ ID NO: 12619 - protein, 9 aa, Mycobacterium tuberculosis
MAEATSLDT

SEQ ID NO: 12620 - protein, 9 aa, Mycobacterium tuberculosis
AEATSLDTM

SEQ ID NO: 12621 - protein, 9 aa, Mycobacterium tuberculosis
EATSLDTMT

SEQ ID NO: 12622 - protein, 9 aa, Mycobacterium tuberculosis
ATSLDTMTQ

SEQ ID NO: 12623 - protein, 9 aa, Mycobacterium tuberculosis
TSLDTMTQM

SEQ ID NO: 12624 - protein, 9 aa, Mycobacterium tuberculosis
SLDTMTQMN

SEQ ID NO: 12625 - protein, 9 aa, Mycobacterium tuberculosis
LDTMTQMNQ

SEQ ID NO: 12626 - protein, 9 aa, Mycobacterium tuberculosis
DTMTQMNQA

SEQ ID NO: 12627 - protein, 9 aa, Mycobacterium tuberculosis
TMTQMNQAF

SEQ ID NO: 12628 - protein, 9 aa, Mycobacterium tuberculosis
MTQMNQAFR

SEQ ID NO: 12629 - protein, 9 aa, Mycobacterium tuberculosis
TQMNQAFRN

SEQ ID NO: 12630 - protein, 9 aa, Mycobacterium tuberculosis
QMNQAFRNI

SEQ ID NO: 12631 - protein, 9 aa, Mycobacterium tuberculosis
MNQAFRNIV

SEQ ID NO: 12632 - protein, 9 aa, Mycobacterium tuberculosis
NQAFRNIVN

SEQ ID NO: 12633 - protein, 9 aa, Mycobacterium tuberculosis
QAFRNIVNM

SEQ ID NO: 12634 - protein, 9 aa, Mycobacterium tuberculosis
AFRNIVNML

SEQ ID NO: 12635 - protein, 9 aa, Mycobacterium tuberculosis
FRNIVNMLH

SEQ ID NO: 12636 - protein, 9 aa, Mycobacterium tuberculosis
RNIVNMLHG

SEQ ID NO: 12637 - protein, 9 aa, Mycobacterium tuberculosis
NIVNMLHGV

SEQ ID NO: 12638 - protein, 9 aa, Mycobacterium tuberculosis
IVNMLHGVR

SEQ ID NO: 12639 - protein, 9 aa, Mycobacterium tuberculosis
VNMLHGVRD

SEQ ID NO: 12640 - protein, 9 aa, Mycobacterium tuberculosis
NMLHGVRDG

SEQ ID NO: 12641 - protein, 9 aa, Mycobacterium tuberculosis
MLHGVRDGL

SEQ ID NO: 12642 - protein, 9 aa, Mycobacterium tuberculosis
LHGVRDGLV

SEQ ID NO: 12643 - protein, 9 aa, Mycobacterium tuberculosis
HGVRDGLVR

SEQ ID NO: 12644 - protein, 9 aa, Mycobacterium tuberculosis
GVRDGLVRD

SEQ ID NO: 12645 - protein, 9 aa, Mycobacterium tuberculosis
VRDGLVRDA

SEQ ID NO: 12646 - protein, 9 aa, Mycobacterium tuberculosis
RDGLVRDAN

SEQ ID NO: 12647 - protein, 9 aa, Mycobacterium tuberculosis
DGLVRDANN

SEQ ID NO: 12648 - protein, 9 aa, Mycobacterium tuberculosis
GLVRDANNY

SEQ ID NO: 12649 - protein, 9 aa, Mycobacterium tuberculosis
LVRDANNYE

SEQ ID NO: 12650 - protein, 9 aa, Mycobacterium tuberculosis
VRDANNYEQ

SEQ ID NO: 12651 - protein, 9 aa, Mycobacterium tuberculosis
RDANNYEQQ

SEQ ID NO: 12652 - protein, 9 aa, Mycobacterium tuberculosis
DANNYEQQE

SEQ ID NO: 12653 - protein, 9 aa, Mycobacterium tuberculosis
ANNYEQQEQ

SEQ ID NO: 12654 - protein, 9 aa, Mycobacterium tuberculosis
NNYEQQEQA

SEQ ID NO: 12655 - protein, 9 aa, Mycobacterium tuberculosis
NYEQQEQAS

SEQ ID NO: 12656 - protein, 9 aa, Mycobacterium tuberculosis
YEQQEQASQ

SEQ ID NO: 12657 - protein, 9 aa, Mycobacterium tuberculosis
EQQEQASQQ

SEQ ID NO: 12658 - protein, 9 aa, Mycobacterium tuberculosis
QQEQASQQI

SEQ ID NO: 12659 - protein, 9 aa, Mycobacterium tuberculosis
QEQASQQIL

SEQ ID NO: 12660 - protein, 9 aa, Mycobacterium tuberculosis
EQASQQILS

SEQ ID NO: 12661 - protein, 9 aa, Mycobacterium tuberculosis
QASQQILSS

SEQ ID NO: 12662 - protein, 10 aa, Mycobacterium tuberculosis
MASRFMTDPH

SEQ ID NO: 12663 - protein, 10 aa, Mycobacterium tuberculosis
ASRFMTDPHA

SEQ ID NO: 12664 - protein, 10 aa, Mycobacterium tuberculosis
SRFMTDPHAM

SEQ ID NO: 12665 - protein, 10 aa, Mycobacterium tuberculosis
RFMTDPHAMR

SEQ ID NO: 12666 - protein, 10 aa, Mycobacterium tuberculosis
FMTDPHAMRD

SEQ ID NO: 12667 - protein, 10 aa, Mycobacterium tuberculosis
MTDPHAMRDM

SEQ ID NO: 12668 - protein, 10 aa, Mycobacterium tuberculosis
TDPHAMRDMA

SEQ ID NO: 12669 - protein, 10 aa, Mycobacterium tuberculosis
DPHAMRDMAG

SEQ ID NO: 12670 - protein, 10 aa, Mycobacterium tuberculosis
PHAMRDMAGR

SEQ ID NO: 12671 - protein, 10 aa, Mycobacterium tuberculosis
HAMRDMAGRF

SEQ ID NO: 12672 - protein, 10 aa, Mycobacterium tuberculosis
AMRDMAGRFE

SEQ ID NO: 12673 - protein, 10 aa, Mycobacterium tuberculosis
MRDMAGRFEV

SEQ ID NO: 12674 - protein, 10 aa, Mycobacterium tuberculosis
RDMAGRFEVH

SEQ ID NO: 12675 - protein, 10 aa, Mycobacterium tuberculosis
DMAGRFEVHA

SEQ ID NO: 12676 - protein, 10 aa, Mycobacterium tuberculosis
MAGRFEVHAQ

SEQ ID NO: 12677 - protein, 10 aa, Mycobacterium tuberculosis
AGRFEVHAQT

SEQ ID NO: 12678 - protein, 10 aa, Mycobacterium tuberculosis
GRFEVHAQTV

SEQ ID NO: 12679 - protein, 10 aa, Mycobacterium tuberculosis
RFEVHAQTVE

SEQ ID NO: 12680 - protein, 10 aa, Mycobacterium tuberculosis
FEVHAQTVED

SEQ ID NO: 12681 - protein, 10 aa, Mycobacterium tuberculosis
EVHAQTVEDE

SEQ ID NO: 12682 - protein, 10 aa, Mycobacterium tuberculosis
VHAQTVEDEA

SEQ ID NO: 12683 - protein, 10 aa, Mycobacterium tuberculosis
HAQTVEDEAR

SEQ ID NO: 12684 - protein, 10 aa, Mycobacterium tuberculosis
AQTVEDEARR

SEQ ID NO: 12685 - protein, 10 aa, Mycobacterium tuberculosis
QTVEDEARRM

SEQ ID NO: 12686 - protein, 10 aa, Mycobacterium tuberculosis
TVEDEARRMW

SEQ ID NO: 12687 - protein, 10 aa, Mycobacterium tuberculosis
VEDEARRMWA

SEQ ID NO: 12688 - protein, 10 aa, Mycobacterium tuberculosis
EDEARRMWAS

SEQ ID NO: 12689 - protein, 10 aa, Mycobacterium tuberculosis
DEARRMWASA

SEQ ID NO: 12690 - protein, 10 aa, Mycobacterium tuberculosis
EARRMWASAQ

SEQ ID NO: 12691 - protein, 10 aa, Mycobacterium tuberculosis
ARRMWASAQN

SEQ ID NO: 12692 - protein, 10 aa, Mycobacterium tuberculosis
RRMWASAQNI

SEQ ID NO: 12693 - protein, 10 aa, Mycobacterium tuberculosis
RMWASAQNIS

SEQ ID NO: 12694 - protein, 10 aa, Mycobacterium tuberculosis
MWASAQNISG

SEQ ID NO: 12695 - protein, 10 aa, Mycobacterium tuberculosis
WASAQNISGA

SEQ ID NO: 12696 - protein, 10 aa, Mycobacterium tuberculosis
ASAQNISGAG

SEQ ID NO: 12697 - protein, 10 aa, Mycobacterium tuberculosis
SAQNISGAGW

SEQ ID NO: 12698 - protein, 10 aa, Mycobacterium tuberculosis
AQNISGAGWS

SEQ ID NO: 12699 - protein, 10 aa, Mycobacterium tuberculosis
QNISGAGWSG

SEQ ID NO: 12700 - protein, 10 aa, Mycobacterium tuberculosis
NISGAGWSGM

SEQ ID NO: 12701 - protein, 10 aa, Mycobacterium tuberculosis
ISGAGWSGMA

SEQ ID NO: 12702 - protein, 10 aa, Mycobacterium tuberculosis
SGAGWSGMAE

SEQ ID NO: 12703 - protein, 10 aa, Mycobacterium tuberculosis
GAGWSGMAEA

SEQ ID NO: 12704 - protein, 10 aa, Mycobacterium tuberculosis
AGWSGMAEAT

SEQ ID NO: 12705 - protein, 10 aa, Mycobacterium tuberculosis
GWSGMAEATS

SEQ ID NO: 12706 - protein, 10 aa, Mycobacterium tuberculosis
WSGMAEATSL

SEQ ID NO: 12707 - protein, 10 aa, Mycobacterium tuberculosis
SGMAEATSLD

SEQ ID NO: 12708 - protein, 10 aa, Mycobacterium tuberculosis
GMAEATSLDT

SEQ ID NO: 12709 - protein, 10 aa, Mycobacterium tuberculosis
MAEATSLDTM

SEQ ID NO: 12710 - protein, 10 aa, Mycobacterium tuberculosis
AEATSLDTMT

SEQ ID NO: 12711 - protein, 10 aa, Mycobacterium tuberculosis
EATSLDTMTQ

SEQ ID NO: 12712 - protein, 10 aa, Mycobacterium tuberculosis
ATSLDTMTQM

SEQ ID NO: 12713 - protein, 10 aa, Mycobacterium tuberculosis
TSLDTMTQMN

SEQ ID NO: 12714 - protein, 10 aa, Mycobacterium tuberculosis
SLDTMTQMNQ

SEQ ID NO: 12715 - protein, 10 aa, Mycobacterium tuberculosis
LDTMTQMNQA

SEQ ID NO: 12716 - protein, 10 aa, Mycobacterium tuberculosis
DTMTQMNQAF

SEQ ID NO: 12717 - protein, 10 aa, Mycobacterium tuberculosis
TMTQMNQAFR

SEQ ID NO: 12718 - protein, 10 aa, Mycobacterium tuberculosis
MTQMNQAFRN

SEQ ID NO: 12719 - protein, 10 aa, Mycobacterium tuberculosis
TQMNQAFRNI

SEQ ID NO: 12720 - protein, 10 aa, Mycobacterium tuberculosis
QMNQAFRNIV

SEQ ID NO: 12721 - protein, 10 aa, Mycobacterium tuberculosis
MNQAFRNIVN

SEQ ID NO: 12722 - protein, 10 aa, Mycobacterium tuberculosis
NQAFRNIVNM

SEQ ID NO: 12723 - protein, 10 aa, Mycobacterium tuberculosis
QAFRNIVNML

SEQ ID NO: 12724 - protein, 10 aa, Mycobacterium tuberculosis
AFRNIVNMLH

SEQ ID NO: 12725 - protein, 10 aa, Mycobacterium tuberculosis
FRNIVNMLHG

SEQ ID NO: 12726 - protein, 10 aa, Mycobacterium tuberculosis
RNIVNMLHGV

SEQ ID NO: 12727 - protein, 10 aa, Mycobacterium tuberculosis
NIVNMLHGVR

SEQ ID NO: 12728 - protein, 10 aa, Mycobacterium tuberculosis
IVNMLHGVRD

SEQ ID NO: 12729 - protein, 10 aa, Mycobacterium tuberculosis
VNMLHGVRDG

SEQ ID NO: 12730 - protein, 10 aa, Mycobacterium tuberculosis
NMLHGVRDGL

SEQ ID NO: 12731 - protein, 10 aa, Mycobacterium tuberculosis
MLHGVRDGLV

SEQ ID NO: 12732 - protein, 10 aa, Mycobacterium tuberculosis
LHGVRDGLVR

SEQ ID NO: 12733 - protein, 10 aa, Mycobacterium tuberculosis
HGVRDGLVRD

SEQ ID NO: 12734 - protein, 10 aa, Mycobacterium tuberculosis
GVRDGLVRDA

SEQ ID NO: 12735 - protein, 10 aa, Mycobacterium tuberculosis
VRDGLVRDAN

SEQ ID NO: 12736 - protein, 10 aa, Mycobacterium tuberculosis
RDGLVRDANN

SEQ ID NO: 12737 - protein, 10 aa, Mycobacterium tuberculosis
DGLVRDANNY

SEQ ID NO: 12738 - protein, 10 aa, Mycobacterium tuberculosis
GLVRDANNYE

SEQ ID NO: 12739 - protein, 10 aa, Mycobacterium tuberculosis
LVRDANNYEQ

SEQ ID NO: 12740 - protein, 10 aa, Mycobacterium tuberculosis
VRDANNYEQQ

SEQ ID NO: 12741 - protein, 10 aa, Mycobacterium tuberculosis
RDANNYEQQE

SEQ ID NO: 12742 - protein, 10 aa, Mycobacterium tuberculosis
DANNYEQQEQ

SEQ ID NO: 12743 - protein, 10 aa, Mycobacterium tuberculosis
ANNYEQQEQA

SEQ ID NO: 12744 - protein, 10 aa, Mycobacterium tuberculosis
NNYEQQEQAS

SEQ ID NO: 12745 - protein, 10 aa, Mycobacterium tuberculosis
NYEQQEQASQ

SEQ ID NO: 12746 - protein, 10 aa, Mycobacterium tuberculosis
YEQQEQASQQ

SEQ ID NO: 12747 - protein, 10 aa, Mycobacterium tuberculosis
EQQEQASQQI

SEQ ID NO: 12748 - protein, 10 aa, Mycobacterium tuberculosis
QQEQASQQIL

SEQ ID NO: 12749 - protein, 10 aa, Mycobacterium tuberculosis
QEQASQQILS

SEQ ID NO: 12750 - protein, 10 aa, Mycobacterium tuberculosis
EQASQQILSS

SEQ ID NO: 12751 - protein, 11 aa, Mycobacterium tuberculosis
MASRFMTDPHA

SEQ ID NO: 12752 - protein, 11 aa, Mycobacterium tuberculosis
ASRFMTDPHAM

SEQ ID NO: 12753 - protein, 11 aa, Mycobacterium tuberculosis
SRFMTDPHAMR

SEQ ID NO: 12754 - protein, 11 aa, Mycobacterium tuberculosis
RFMTDPHAMRD

SEQ ID NO: 12755 - protein, 11 aa, Mycobacterium tuberculosis
FMTDPHAMRDM

SEQ ID NO: 12756 - protein, 11 aa, Mycobacterium tuberculosis
MTDPHAMRDMA

SEQ ID NO: 12757 - protein, 11 aa, Mycobacterium tuberculosis
TDPHAMRDMAG

SEQ ID NO: 12758 - protein, 11 aa, Mycobacterium tuberculosis
DPHAMRDMAGR

SEQ ID NO: 12759 - protein, 11 aa, Mycobacterium tuberculosis
PHAMRDMAGRF

SEQ ID NO: 12760 - protein, 11 aa, Mycobacterium tuberculosis
HAMRDMAGRFE

SEQ ID NO: 12761 - protein, 11 aa, Mycobacterium tuberculosis
AMRDMAGRFEV

SEQ ID NO: 12762 - protein, 11 aa, Mycobacterium tuberculosis
MRDMAGRFEVH

SEQ ID NO: 12763 - protein, 11 aa, Mycobacterium tuberculosis
RDMAGRFEVHA

SEQ ID NO: 12764 - protein, 11 aa, Mycobacterium tuberculosis
DMAGRFEVHAQ

SEQ ID NO: 12765 - protein, 11 aa, Mycobacterium tuberculosis
MAGRFEVHAQT

SEQ ID NO: 12766 - protein, 11 aa, Mycobacterium tuberculosis
AGRFEVHAQTV

SEQ ID NO: 12767 - protein, 11 aa, Mycobacterium tuberculosis
GRFEVHAQTVE

SEQ ID NO: 12768 - protein, 11 aa, Mycobacterium tuberculosis
RFEVHAQTVED

SEQ ID NO: 12769 - protein, 11 aa, Mycobacterium tuberculosis
FEVHAQTVEDE

SEQ ID NO: 12770 - protein, 11 aa, Mycobacterium tuberculosis
EVHAQTVEDEA

SEQ ID NO: 12771 - protein, 11 aa, Mycobacterium tuberculosis
VHAQTVEDEAR

SEQ ID NO: 12772 - protein, 11 aa, Mycobacterium tuberculosis
HAQTVEDEARR

SEQ ID NO: 12773 - protein, 11 aa, Mycobacterium tuberculosis
AQTVEDEARRM

SEQ ID NO: 12774 - protein, 11 aa, Mycobacterium tuberculosis
QTVEDEARRMW

SEQ ID NO: 12775 - protein, 11 aa, Mycobacterium tuberculosis
TVEDEARRMWA

SEQ ID NO: 12776 - protein, 11 aa, Mycobacterium tuberculosis
VEDEARRMWAS

SEQ ID NO: 12777 - protein, 11 aa, Mycobacterium tuberculosis
EDEARRMWASA

SEQ ID NO: 12778 - protein, 11 aa, Mycobacterium tuberculosis
DEARRMWASAQ

SEQ ID NO: 12779 - protein, 11 aa, Mycobacterium tuberculosis
EARRMWASAQN

SEQ ID NO: 12780 - protein, 11 aa, Mycobacterium tuberculosis
ARRMWASAQNI

SEQ ID NO: 12781 - protein, 11 aa, Mycobacterium tuberculosis
RRMWASAQNIS

SEQ ID NO: 12782 - protein, 11 aa, Mycobacterium tuberculosis
RMWASAQNISG

SEQ ID NO: 12783 - protein, 11 aa, Mycobacterium tuberculosis
MWASAQNISGA

SEQ ID NO: 12784 - protein, 11 aa, Mycobacterium tuberculosis
WASAQNISGAG

SEQ ID NO: 12785 - protein, 11 aa, Mycobacterium tuberculosis
ASAQNISGAGW

SEQ ID NO: 12786 - protein, 11 aa, Mycobacterium tuberculosis
SAQNISGAGWS

SEQ ID NO: 12787 - protein, 11 aa, Mycobacterium tuberculosis
AQNISGAGWSG

SEQ ID NO: 12788 - protein, 11 aa, Mycobacterium tuberculosis
QNISGAGWSGM

SEQ ID NO: 12789 - protein, 11 aa, Mycobacterium tuberculosis
NISGAGWSGMA

SEQ ID NO: 12790 - protein, 11 aa, Mycobacterium tuberculosis
ISGAGWSGMAE

SEQ ID NO: 12791 - protein, 11 aa, Mycobacterium tuberculosis
SGAGWSGMAEA

SEQ ID NO: 12792 - protein, 11 aa, Mycobacterium tuberculosis
GAGWSGMAEAT

SEQ ID NO: 12793 - protein, 11 aa, Mycobacterium tuberculosis
AGWSGMAEATS

SEQ ID NO: 12794 - protein, 11 aa, Mycobacterium tuberculosis
GWSGMAEATSL

SEQ ID NO: 12795 - protein, 11 aa, Mycobacterium tuberculosis
WSGMAEATSLD

SEQ ID NO: 12796 - protein, 11 aa, Mycobacterium tuberculosis
SGMAEATSLDT

SEQ ID NO: 12797 - protein, 11 aa, Mycobacterium tuberculosis
GMAEATSLDTM

SEQ ID NO: 12798 - protein, 11 aa, Mycobacterium tuberculosis
MAEATSLDTMT

SEQ ID NO: 12799 - protein, 11 aa, Mycobacterium tuberculosis
AEATSLDTMTQ

SEQ ID NO: 12800 - protein, 11 aa, Mycobacterium tuberculosis
EATSLDTMTQM

SEQ ID NO: 12801 - protein, 11 aa, Mycobacterium tuberculosis
ATSLDTMTQMN

SEQ ID NO: 12802 - protein, 11 aa, Mycobacterium tuberculosis
TSLDTMTQMNQ

SEQ ID NO: 12803 - protein, 11 aa, Mycobacterium tuberculosis
SLDTMTQMNQA

SEQ ID NO: 12804 - protein, 11 aa, Mycobacterium tuberculosis
LDTMTQMNQAF

SEQ ID NO: 12805 - protein, 11 aa, Mycobacterium tuberculosis
DTMTQMNQAFR

SEQ ID NO: 12806 - protein, 11 aa, Mycobacterium tuberculosis
TMTQMNQAFRN

SEQ ID NO: 12807 - protein, 11 aa, Mycobacterium tuberculosis
MTQMNQAFRNI

SEQ ID NO: 12808 - protein, 11 aa, Mycobacterium tuberculosis
TQMNQAFRNIV

SEQ ID NO: 12809 - protein, 11 aa, Mycobacterium tuberculosis
QMNQAFRNIVN

SEQ ID NO: 12810 - protein, 11 aa, Mycobacterium tuberculosis
MNQAFRNIVNM

SEQ ID NO: 12811 - protein, 11 aa, Mycobacterium tuberculosis
NQAFRNIVNML

SEQ ID NO: 12812 - protein, 11 aa, Mycobacterium tuberculosis
QAFRNIVNMLH

SEQ ID NO: 12813 - protein, 11 aa, Mycobacterium tuberculosis
AFRNIVNMLHG

SEQ ID NO: 12814 - protein, 11 aa, Mycobacterium tuberculosis
FRNIVNMLHGV

SEQ ID NO: 12815 - protein, 11 aa, Mycobacterium tuberculosis
RNIVNMLHGVR

SEQ ID NO: 12816 - protein, 11 aa, Mycobacterium tuberculosis
NIVNMLHGVRD

SEQ ID NO: 12817 - protein, 11 aa, Mycobacterium tuberculosis
IVNMLHGVRDG

SEQ ID NO: 12818 - protein, 11 aa, Mycobacterium tuberculosis
VNMLHGVRDGL

SEQ ID NO: 12819 - protein, 11 aa, Mycobacterium tuberculosis
NMLHGVRDGLV

SEQ ID NO: 12820 - protein, 11 aa, Mycobacterium tuberculosis
MLHGVRDGLVR

SEQ ID NO: 12821 - protein, 11 aa, Mycobacterium tuberculosis
LHGVRDGLVRD

SEQ ID NO: 12822 - protein, 11 aa, Mycobacterium tuberculosis
HGVRDGLVRDA

SEQ ID NO: 12823 - protein, 11 aa, Mycobacterium tuberculosis
GVRDGLVRDAN

SEQ ID NO: 12824 - protein, 11 aa, Mycobacterium tuberculosis
VRDGLVRDANN

SEQ ID NO: 12825 - protein, 11 aa, Mycobacterium tuberculosis
RDGLVRDANNY

SEQ ID NO: 12826 - protein, 11 aa, Mycobacterium tuberculosis
DGLVRDANNYE

SEQ ID NO: 12827 - protein, 11 aa, Mycobacterium tuberculosis
GLVRDANNYEQ

SEQ ID NO: 12828 - protein, 11 aa, Mycobacterium tuberculosis
LVRDANNYEQQ

SEQ ID NO: 12829 - protein, 11 aa, Mycobacterium tuberculosis
VRDANNYEQQE

SEQ ID NO: 12830 - protein, 11 aa, Mycobacterium tuberculosis
RDANNYEQQEQ

SEQ ID NO: 12831 - protein, 11 aa, Mycobacterium tuberculosis
DANNYEQQEQA

SEQ ID NO: 12832 - protein, 11 aa, Mycobacterium tuberculosis
ANNYEQQEQAS

SEQ ID NO: 12833 - protein, 11 aa, Mycobacterium tuberculosis
NNYEQQEQASQ

SEQ ID NO: 12834 - protein, 11 aa, Mycobacterium tuberculosis
NYEQQEQASQQ

SEQ ID NO: 12835 - protein, 11 aa, Mycobacterium tuberculosis
YEQQEQASQQI

SEQ ID NO: 12836 - protein, 11 aa, Mycobacterium tuberculosis
EQQEQASQQIL

SEQ ID NO: 12837 - protein, 11 aa, Mycobacterium tuberculosis
QQEQASQQILS

SEQ ID NO: 12838 - protein, 11 aa, Mycobacterium tuberculosis
QEQASQQILSS

SEQ ID NO: 12839 - protein, 8 aa, Mycobacterium tuberculosis
MELRDWLR

SEQ ID NO: 12840 - protein, 8 aa, Mycobacterium tuberculosis
ELRDWLRV

SEQ ID NO: 12841 - protein, 8 aa, Mycobacterium tuberculosis
LRDWLRVD

SEQ ID NO: 12842 - protein, 8 aa, Mycobacterium tuberculosis
RDWLRVDV

SEQ ID NO: 12843 - protein, 8 aa, Mycobacterium tuberculosis
DWLRVDVK

SEQ ID NO: 12844 - protein, 8 aa, Mycobacterium tuberculosis
WLRVDVKA

SEQ ID NO: 12845 - protein, 8 aa, Mycobacterium tuberculosis
LRVDVKAG

SEQ ID NO: 12846 - protein, 8 aa, Mycobacterium tuberculosis
RVDVKAGK

SEQ ID NO: 12847 - protein, 8 aa, Mycobacterium tuberculosis
VDVKAGKP

SEQ ID NO: 12848 - protein, 8 aa, Mycobacterium tuberculosis
DVKAGKPL

SEQ ID NO: 12849 - protein, 8 aa, Mycobacterium tuberculosis
VKAGKPLF

SEQ ID NO: 12850 - protein, 8 aa, Mycobacterium tuberculosis
KAGKPLFD

SEQ ID NO: 12851 - protein, 8 aa, Mycobacterium tuberculosis
AGKPLFDQ

SEQ ID NO: 12852 - protein, 8 aa, Mycobacterium tuberculosis
GKPLFDQL

SEQ ID NO: 12853 - protein, 8 aa, Mycobacterium tuberculosis
KPLFDQLR

SEQ ID NO: 12854 - protein, 8 aa, Mycobacterium tuberculosis
PLFDQLRT

SEQ ID NO: 12855 - protein, 8 aa, Mycobacterium tuberculosis
LFDQLRTQ

SEQ ID NO: 12856 - protein, 8 aa, Mycobacterium tuberculosis
FDQLRTQV

SEQ ID NO: 12857 - protein, 8 aa, Mycobacterium tuberculosis
DQLRTQVI

SEQ ID NO: 12858 - protein, 8 aa, Mycobacterium tuberculosis
QLRTQVID

SEQ ID NO: 12859 - protein, 8 aa, Mycobacterium tuberculosis
LRTQVIDG

SEQ ID NO: 12860 - protein, 8 aa, Mycobacterium tuberculosis
RTQVIDGV

SEQ ID NO: 12861 - protein, 8 aa, Mycobacterium tuberculosis
TQVIDGVR

SEQ ID NO: 12862 - protein, 8 aa, Mycobacterium tuberculosis
QVIDGVRA

SEQ ID NO: 12863 - protein, 8 aa, Mycobacterium tuberculosis
VIDGVRAG

SEQ ID NO: 12864 - protein, 8 aa, Mycobacterium tuberculosis
IDGVRAGA

SEQ ID NO: 12865 - protein, 8 aa, Mycobacterium tuberculosis
DGVRAGAL

SEQ ID NO: 12866 - protein, 8 aa, Mycobacterium tuberculosis
GVRAGALP

SEQ ID NO: 12867 - protein, 8 aa, Mycobacterium tuberculosis
VRAGALPP

SEQ ID NO: 12868 - protein, 8 aa, Mycobacterium tuberculosis
RAGALPPG

SEQ ID NO: 12869 - protein, 8 aa, Mycobacterium tuberculosis
AGALPPGT

SEQ ID NO: 12870 - protein, 8 aa, Mycobacterium tuberculosis
GALPPGTR

SEQ ID NO: 12871 - protein, 8 aa, Mycobacterium tuberculosis
ALPPGTRL

SEQ ID NO: 12872 - protein, 8 aa, Mycobacterium tuberculosis
LPPGTRLP

SEQ ID NO: 12873 - protein, 8 aa, Mycobacterium tuberculosis
PPGTRLPT

SEQ ID NO: 12874 - protein, 8 aa, Mycobacterium tuberculosis
PGTRLPTV

SEQ ID NO: 12875 - protein, 8 aa, Mycobacterium tuberculosis
GTRLPTVR

SEQ ID NO: 12876 - protein, 8 aa, Mycobacterium tuberculosis
TRLPTVRD

SEQ ID NO: 12877 - protein, 8 aa, Mycobacterium tuberculosis
RLPTVRDL

SEQ ID NO: 12878 - protein, 8 aa, Mycobacterium tuberculosis
LPTVRDLA

SEQ ID NO: 12879 - protein, 8 aa, Mycobacterium tuberculosis
PTVRDLAG

SEQ ID NO: 12880 - protein, 8 aa, Mycobacterium tuberculosis
TVRDLAGQ

SEQ ID NO: 12881 - protein, 8 aa, Mycobacterium tuberculosis
VRDLAGQL

SEQ ID NO: 12882 - protein, 8 aa, Mycobacterium tuberculosis
RDLAGQLG

SEQ ID NO: 12883 - protein, 8 aa, Mycobacterium tuberculosis
DLAGQLGV

SEQ ID NO: 12884 - protein, 8 aa, Mycobacterium tuberculosis
LAGQLGVA

SEQ ID NO: 12885 - protein, 8 aa, Mycobacterium tuberculosis
AGQLGVAA

SEQ ID NO: 12886 - protein, 8 aa, Mycobacterium tuberculosis
GQLGVAAN

SEQ ID NO: 12887 - protein, 8 aa, Mycobacterium tuberculosis
QLGVAANT

SEQ ID NO: 12888 - protein, 8 aa, Mycobacterium tuberculosis
LGVAANTV

SEQ ID NO: 12889 - protein, 8 aa, Mycobacterium tuberculosis
GVAANTVA

SEQ ID NO: 12890 - protein, 8 aa, Mycobacterium tuberculosis
VAANTVAR

SEQ ID NO: 12891 - protein, 8 aa, Mycobacterium tuberculosis
AANTVARA

SEQ ID NO: 12892 - protein, 8 aa, Mycobacterium tuberculosis
ANTVARAY

SEQ ID NO: 12893 - protein, 8 aa, Mycobacterium tuberculosis
NTVARAYR

SEQ ID NO: 12894 - protein, 8 aa, Mycobacterium tuberculosis
TVARAYRE

SEQ ID NO: 12895 - protein, 8 aa, Mycobacterium tuberculosis
VARAYREL

SEQ ID NO: 12896 - protein, 8 aa, Mycobacterium tuberculosis
ARAYRELE

SEQ ID NO: 12897 - protein, 8 aa, Mycobacterium tuberculosis
RAYRELES

SEQ ID NO: 12898 - protein, 8 aa, Mycobacterium tuberculosis
AYRELESA

SEQ ID NO: 12899 - protein, 8 aa, Mycobacterium tuberculosis
YRELESAA

SEQ ID NO: 12900 - protein, 8 aa, Mycobacterium tuberculosis
RELESAAI

SEQ ID NO: 12901 - protein, 8 aa, Mycobacterium tuberculosis
ELESAAIV

SEQ ID NO: 12902 - protein, 8 aa, Mycobacterium tuberculosis
LESAAIVE

SEQ ID NO: 12903 - protein, 8 aa, Mycobacterium tuberculosis
ESAAIVET

SEQ ID NO: 12904 - protein, 8 aa, Mycobacterium tuberculosis
SAAIVETR

SEQ ID NO: 12905 - protein, 8 aa, Mycobacterium tuberculosis
AAIVETRG

SEQ ID NO: 12906 - protein, 8 aa, Mycobacterium tuberculosis
AIVETRGR

SEQ ID NO: 12907 - protein, 8 aa, Mycobacterium tuberculosis
IVETRGRF

SEQ ID NO: 12908 - protein, 8 aa, Mycobacterium tuberculosis
VETRGRFG

SEQ ID NO: 12909 - protein, 8 aa, Mycobacterium tuberculosis
ETRGRFGT

SEQ ID NO: 12910 - protein, 8 aa, Mycobacterium tuberculosis
TRGRFGTF

SEQ ID NO: 12911 - protein, 8 aa, Mycobacterium tuberculosis
RGRFGTFI

SEQ ID NO: 12912 - protein, 8 aa, Mycobacterium tuberculosis
GRFGTFIS

SEQ ID NO: 12913 - protein, 8 aa, Mycobacterium tuberculosis
RFGTFISR

SEQ ID NO: 12914 - protein, 8 aa, Mycobacterium tuberculosis
FGTFISRF

SEQ ID NO: 12915 - protein, 8 aa, Mycobacterium tuberculosis
GTFISRFD

SEQ ID NO: 12916 - protein, 8 aa, Mycobacterium tuberculosis
TFISRFDP

SEQ ID NO: 12917 - protein, 8 aa, Mycobacterium tuberculosis
FISRFDPT

SEQ ID NO: 12918 - protein, 8 aa, Mycobacterium tuberculosis
ISRFDPTD

SEQ ID NO: 12919 - protein, 8 aa, Mycobacterium tuberculosis
SRFDPTDA

SEQ ID NO: 12920 - protein, 8 aa, Mycobacterium tuberculosis
RFDPTDAA

SEQ ID NO: 12921 - protein, 8 aa, Mycobacterium tuberculosis
FDPTDAAM

SEQ ID NO: 12922 - protein, 8 aa, Mycobacterium tuberculosis
DPTDAAMA

SEQ ID NO: 12923 - protein, 8 aa, Mycobacterium tuberculosis
PTDAAMAA

SEQ ID NO: 12924 - protein, 8 aa, Mycobacterium tuberculosis
TDAAMAAA

SEQ ID NO: 12925 - protein, 8 aa, Mycobacterium tuberculosis
DAAMAAAA

SEQ ID NO: 12926 - protein, 8 aa, Mycobacterium tuberculosis
AAMAAAAK

SEQ ID NO: 12927 - protein, 8 aa, Mycobacterium tuberculosis
AMAAAAKE

SEQ ID NO: 12928 - protein, 8 aa, Mycobacterium tuberculosis
MAAAAKEY

SEQ ID NO: 12929 - protein, 8 aa, Mycobacterium tuberculosis
AAAAKEYV

SEQ ID NO: 12930 - protein, 8 aa, Mycobacterium tuberculosis
AAAKEYVG

SEQ ID NO: 12931 - protein, 8 aa, Mycobacterium tuberculosis
AAKEYVGV

SEQ ID NO: 12932 - protein, 8 aa, Mycobacterium tuberculosis
AKEYVGVA

SEQ ID NO: 12933 - protein, 8 aa, Mycobacterium tuberculosis
KEYVGVAR

SEQ ID NO: 12934 - protein, 8 aa, Mycobacterium tuberculosis
EYVGVARA

SEQ ID NO: 12935 - protein, 8 aa, Mycobacterium tuberculosis
YVGVARAL

SEQ ID NO: 12936 - protein, 8 aa, Mycobacterium tuberculosis
VGVARALG

SEQ ID NO: 12937 - protein, 8 aa, Mycobacterium tuberculosis
GVARALGL

SEQ ID NO: 12938 - protein, 8 aa, Mycobacterium tuberculosis
VARALGLT

SEQ ID NO: 12939 - protein, 8 aa, Mycobacterium tuberculosis
ARALGLTK

SEQ ID NO: 12940 - protein, 8 aa, Mycobacterium tuberculosis
RALGLTKS

SEQ ID NO: 12941 - protein, 8 aa, Mycobacterium tuberculosis
ALGLTKSD

SEQ ID NO: 12942 - protein, 8 aa, Mycobacterium tuberculosis
LGLTKSDA

SEQ ID NO: 12943 - protein, 8 aa, Mycobacterium tuberculosis
GLTKSDAM

SEQ ID NO: 12944 - protein, 8 aa, Mycobacterium tuberculosis
LTKSDAMR

SEQ ID NO: 12945 - protein, 8 aa, Mycobacterium tuberculosis
TKSDAMRY

SEQ ID NO: 12946 - protein, 8 aa, Mycobacterium tuberculosis
KSDAMRYL

SEQ ID NO: 12947 - protein, 8 aa, Mycobacterium tuberculosis
SDAMRYLT

SEQ ID NO: 12948 - protein, 8 aa, Mycobacterium tuberculosis
DAMRYLTH

SEQ ID NO: 12949 - protein, 8 aa, Mycobacterium tuberculosis
AMRYLTHV

SEQ ID NO: 12950 - protein, 8 aa, Mycobacterium tuberculosis
MRYLTHVP

SEQ ID NO: 12951 - protein, 8 aa, Mycobacterium tuberculosis
RYLTHVPD

SEQ ID NO: 12952 - protein, 8 aa, Mycobacterium tuberculosis
YLTHVPDD

SEQ ID NO: 12953 - protein, 9 aa, Mycobacterium tuberculosis
MELRDWLRV

SEQ ID NO: 12954 - protein, 9 aa, Mycobacterium tuberculosis
ELRDWLRVD

SEQ ID NO: 12955 - protein, 9 aa, Mycobacterium tuberculosis
LRDWLRVDV

SEQ ID NO: 12956 - protein, 9 aa, Mycobacterium tuberculosis
RDWLRVDVK

SEQ ID NO: 12957 - protein, 9 aa, Mycobacterium tuberculosis
DWLRVDVKA

SEQ ID NO: 12958 - protein, 9 aa, Mycobacterium tuberculosis
WLRVDVKAG

SEQ ID NO: 12959 - protein, 9 aa, Mycobacterium tuberculosis
LRVDVKAGK

SEQ ID NO: 12960 - protein, 9 aa, Mycobacterium tuberculosis
RVDVKAGKP

SEQ ID NO: 12961 - protein, 9 aa, Mycobacterium tuberculosis
VDVKAGKPL

SEQ ID NO: 12962 - protein, 9 aa, Mycobacterium tuberculosis
DVKAGKPLF

SEQ ID NO: 12963 - protein, 9 aa, Mycobacterium tuberculosis
VKAGKPLFD

SEQ ID NO: 12964 - protein, 9 aa, Mycobacterium tuberculosis
KAGKPLFDQ

SEQ ID NO: 12965 - protein, 9 aa, Mycobacterium tuberculosis
AGKPLFDQL

SEQ ID NO: 12966 - protein, 9 aa, Mycobacterium tuberculosis
GKPLFDQLR

SEQ ID NO: 12967 - protein, 9 aa, Mycobacterium tuberculosis
KPLFDQLRT

SEQ ID NO: 12968 - protein, 9 aa, Mycobacterium tuberculosis
PLFDQLRTQ

SEQ ID NO: 12969 - protein, 9 aa, Mycobacterium tuberculosis
LFDQLRTQV

SEQ ID NO: 12970 - protein, 9 aa, Mycobacterium tuberculosis
FDQLRTQVI

SEQ ID NO: 12971 - protein, 9 aa, Mycobacterium tuberculosis
DQLRTQVID

SEQ ID NO: 12972 - protein, 9 aa, Mycobacterium tuberculosis
QLRTQVIDG

SEQ ID NO: 12973 - protein, 9 aa, Mycobacterium tuberculosis
LRTQVIDGV

SEQ ID NO: 12974 - protein, 9 aa, Mycobacterium tuberculosis
RTQVIDGVR

SEQ ID NO: 12975 - protein, 9 aa, Mycobacterium tuberculosis
TQVIDGVRA

SEQ ID NO: 12976 - protein, 9 aa, Mycobacterium tuberculosis
QVIDGVRAG

SEQ ID NO: 12977 - protein, 9 aa, Mycobacterium tuberculosis
VIDGVRAGA

SEQ ID NO: 12978 - protein, 9 aa, Mycobacterium tuberculosis
IDGVRAGAL

SEQ ID NO: 12979 - protein, 9 aa, Mycobacterium tuberculosis
DGVRAGALP

SEQ ID NO: 12980 - protein, 9 aa, Mycobacterium tuberculosis
GVRAGALPP

SEQ ID NO: 12981 - protein, 9 aa, Mycobacterium tuberculosis
VRAGALPPG

SEQ ID NO: 12982 - protein, 9 aa, Mycobacterium tuberculosis
RAGALPPGT

SEQ ID NO: 12983 - protein, 9 aa, Mycobacterium tuberculosis
AGALPPGTR

SEQ ID NO: 12984 - protein, 9 aa, Mycobacterium tuberculosis
GALPPGTRL

SEQ ID NO: 12985 - protein, 9 aa, Mycobacterium tuberculosis
ALPPGTRLP

SEQ ID NO: 12986 - protein, 9 aa, Mycobacterium tuberculosis
LPPGTRLPT

SEQ ID NO: 12987 - protein, 9 aa, Mycobacterium tuberculosis
PPGTRLPTV

SEQ ID NO: 12988 - protein, 9 aa, Mycobacterium tuberculosis
PGTRLPTVR

SEQ ID NO: 12989 - protein, 9 aa, Mycobacterium tuberculosis
GTRLPTVRD

SEQ ID NO: 12990 - protein, 9 aa, Mycobacterium tuberculosis
TRLPTVRDL

SEQ ID NO: 12991 - protein, 9 aa, Mycobacterium tuberculosis
RLPTVRDLA

SEQ ID NO: 12992 - protein, 9 aa, Mycobacterium tuberculosis
LPTVRDLAG

SEQ ID NO: 12993 - protein, 9 aa, Mycobacterium tuberculosis
PTVRDLAGQ

SEQ ID NO: 12994 - protein, 9 aa, Mycobacterium tuberculosis
TVRDLAGQL

SEQ ID NO: 12995 - protein, 9 aa, Mycobacterium tuberculosis
VRDLAGQLG

SEQ ID NO: 12996 - protein, 9 aa, Mycobacterium tuberculosis
RDLAGQLGV

SEQ ID NO: 12997 - protein, 9 aa, Mycobacterium tuberculosis
DLAGQLGVA

SEQ ID NO: 12998 - protein, 9 aa, Mycobacterium tuberculosis
LAGQLGVAA

SEQ ID NO: 12999 - protein, 9 aa, Mycobacterium tuberculosis
AGQLGVAAN

SEQ ID NO: 13000 - protein, 9 aa, Mycobacterium tuberculosis
GQLGVAANT

SEQ ID NO: 13001 - protein, 9 aa, Mycobacterium tuberculosis
QLGVAANTV

SEQ ID NO: 13002 - protein, 9 aa, Mycobacterium tuberculosis
LGVAANTVA

SEQ ID NO: 13003 - protein, 9 aa, Mycobacterium tuberculosis
GVAANTVAR

SEQ ID NO: 13004 - protein, 9 aa, Mycobacterium tuberculosis
VAANTVARA

SEQ ID NO: 13005 - protein, 9 aa, Mycobacterium tuberculosis
AANTVARAY

SEQ ID NO: 13006 - protein, 9 aa, Mycobacterium tuberculosis
ANTVARAYR

SEQ ID NO: 13007 - protein, 9 aa, Mycobacterium tuberculosis
NTVARAYRE

SEQ ID NO: 13008 - protein, 9 aa, Mycobacterium tuberculosis
TVARAYREL

SEQ ID NO: 13009 - protein, 9 aa, Mycobacterium tuberculosis
VARAYRELE

SEQ ID NO: 13010 - protein, 9 aa, Mycobacterium tuberculosis
ARAYRELES

SEQ ID NO: 13011 - protein, 9 aa, Mycobacterium tuberculosis
RAYRELESA

SEQ ID NO: 13012 - protein, 9 aa, Mycobacterium tuberculosis
AYRELESAA

SEQ ID NO: 13013 - protein, 9 aa, Mycobacterium tuberculosis
YRELESAAI

SEQ ID NO: 13014 - protein, 9 aa, Mycobacterium tuberculosis
RELESAAIV

SEQ ID NO: 13015 - protein, 9 aa, Mycobacterium tuberculosis
ELESAAIVE

SEQ ID NO: 13016 - protein, 9 aa, Mycobacterium tuberculosis
LESAAIVET

SEQ ID NO: 13017 - protein, 9 aa, Mycobacterium tuberculosis
ESAAIVETR

SEQ ID NO: 13018 - protein, 9 aa, Mycobacterium tuberculosis
SAAIVETRG

SEQ ID NO: 13019 - protein, 9 aa, Mycobacterium tuberculosis
AAIVETRGR

SEQ ID NO: 13020 - protein, 9 aa, Mycobacterium tuberculosis
AIVETRGRF

SEQ ID NO: 13021 - protein, 9 aa, Mycobacterium tuberculosis
IVETRGRFG

SEQ ID NO: 13022 - protein, 9 aa, Mycobacterium tuberculosis
VETRGRFGT

SEQ ID NO: 13023 - protein, 9 aa, Mycobacterium tuberculosis
ETRGRFGTF

SEQ ID NO: 13024 - protein, 9 aa, Mycobacterium tuberculosis
TRGRFGTFI

SEQ ID NO: 13025 - protein, 9 aa, Mycobacterium tuberculosis
RGRFGTFIS

SEQ ID NO: 13026 - protein, 9 aa, Mycobacterium tuberculosis
GRFGTFISR

SEQ ID NO: 13027 - protein, 9 aa, Mycobacterium tuberculosis
RFGTFISRF

SEQ ID NO: 13028 - protein, 9 aa, Mycobacterium tuberculosis
FGTFISRFD

SEQ ID NO: 13029 - protein, 9 aa, Mycobacterium tuberculosis
GTFISRFDP

SEQ ID NO: 13030 - protein, 9 aa, Mycobacterium tuberculosis
TFISRFDPT

SEQ ID NO: 13031 - protein, 9 aa, Mycobacterium tuberculosis
FISRFDPTD

SEQ ID NO: 13032 - protein, 9 aa, Mycobacterium tuberculosis
ISRFDPTDA

SEQ ID NO: 13033 - protein, 9 aa, Mycobacterium tuberculosis
SRFDPTDAA

SEQ ID NO: 13034 - protein, 9 aa, Mycobacterium tuberculosis
RFDPTDAAM

SEQ ID NO: 13035 - protein, 9 aa, Mycobacterium tuberculosis
FDPTDAAMA

SEQ ID NO: 13036 - protein, 9 aa, Mycobacterium tuberculosis
DPTDAAMAA

SEQ ID NO: 13037 - protein, 9 aa, Mycobacterium tuberculosis
PTDAAMAAA

SEQ ID NO: 13038 - protein, 9 aa, Mycobacterium tuberculosis
TDAAMAAAA

SEQ ID NO: 13039 - protein, 9 aa, Mycobacterium tuberculosis
DAAMAAAAK

SEQ ID NO: 13040 - protein, 9 aa, Mycobacterium tuberculosis
AAMAAAAKE

SEQ ID NO: 13041 - protein, 9 aa, Mycobacterium tuberculosis
AMAAAAKEY

SEQ ID NO: 13042 - protein, 9 aa, Mycobacterium tuberculosis
MAAAAKEYV

SEQ ID NO: 13043 - protein, 9 aa, Mycobacterium tuberculosis
AAAAKEYVG

SEQ ID NO: 13044 - protein, 9 aa, Mycobacterium tuberculosis
AAAKEYVGV

SEQ ID NO: 13045 - protein, 9 aa, Mycobacterium tuberculosis
AAKEYVGVA

SEQ ID NO: 13046 - protein, 9 aa, Mycobacterium tuberculosis
AKEYVGVAR

SEQ ID NO: 13047 - protein, 9 aa, Mycobacterium tuberculosis
KEYVGVARA

SEQ ID NO: 13048 - protein, 9 aa, Mycobacterium tuberculosis
EYVGVARAL

SEQ ID NO: 13049 - protein, 9 aa, Mycobacterium tuberculosis
YVGVARALG

SEQ ID NO: 13050 - protein, 9 aa, Mycobacterium tuberculosis
VGVARALGL

SEQ ID NO: 13051 - protein, 9 aa, Mycobacterium tuberculosis
GVARALGLT

SEQ ID NO: 13052 - protein, 9 aa, Mycobacterium tuberculosis
VARALGLTK

SEQ ID NO: 13053 - protein, 9 aa, Mycobacterium tuberculosis
ARALGLTKS

SEQ ID NO: 13054 - protein, 9 aa, Mycobacterium tuberculosis
RALGLTKSD

SEQ ID NO: 13055 - protein, 9 aa, Mycobacterium tuberculosis
ALGLTKSDA

SEQ ID NO: 13056 - protein, 9 aa, Mycobacterium tuberculosis
LGLTKSDAM

SEQ ID NO: 13057 - protein, 9 aa, Mycobacterium tuberculosis
GLTKSDAMR

SEQ ID NO: 13058 - protein, 9 aa, Mycobacterium tuberculosis
LTKSDAMRY

SEQ ID NO: 13059 - protein, 9 aa, Mycobacterium tuberculosis
TKSDAMRYL

SEQ ID NO: 13060 - protein, 9 aa, Mycobacterium tuberculosis
KSDAMRYLT

SEQ ID NO: 13061 - protein, 9 aa, Mycobacterium tuberculosis
SDAMRYLTH

SEQ ID NO: 13062 - protein, 9 aa, Mycobacterium tuberculosis
DAMRYLTHV

SEQ ID NO: 13063 - protein, 9 aa, Mycobacterium tuberculosis
AMRYLTHVP

SEQ ID NO: 13064 - protein, 9 aa, Mycobacterium tuberculosis
MRYLTHVPD

SEQ ID NO: 13065 - protein, 9 aa, Mycobacterium tuberculosis
RYLTHVPDD

SEQ ID NO: 13066 - protein, 10 aa, Mycobacterium tuberculosis
MELRDWLRVD

SEQ ID NO: 13067 - protein, 10 aa, Mycobacterium tuberculosis
ELRDWLRVDV

SEQ ID NO: 13068 - protein, 10 aa, Mycobacterium tuberculosis
LRDWLRVDVK

SEQ ID NO: 13069 - protein, 10 aa, Mycobacterium tuberculosis
RDWLRVDVKA

SEQ ID NO: 13070 - protein, 10 aa, Mycobacterium tuberculosis
DWLRVDVKAG

SEQ ID NO: 13071 - protein, 10 aa, Mycobacterium tuberculosis
WLRVDVKAGK

SEQ ID NO: 13072 - protein, 10 aa, Mycobacterium tuberculosis
LRVDVKAGKP

SEQ ID NO: 13073 - protein, 10 aa, Mycobacterium tuberculosis
RVDVKAGKPL

SEQ ID NO: 13074 - protein, 10 aa, Mycobacterium tuberculosis
VDVKAGKPLF

SEQ ID NO: 13075 - protein, 10 aa, Mycobacterium tuberculosis
DVKAGKPLFD

SEQ ID NO: 13076 - protein, 10 aa, Mycobacterium tuberculosis
VKAGKPLFDQ

SEQ ID NO: 13077 - protein, 10 aa, Mycobacterium tuberculosis
KAGKPLFDQL

SEQ ID NO: 13078 - protein, 10 aa, Mycobacterium tuberculosis
AGKPLFDQLR

SEQ ID NO: 13079 - protein, 10 aa, Mycobacterium tuberculosis
GKPLFDQLRT

SEQ ID NO: 13080 - protein, 10 aa, Mycobacterium tuberculosis
KPLFDQLRTQ

SEQ ID NO: 13081 - protein, 10 aa, Mycobacterium tuberculosis
PLFDQLRTQV

SEQ ID NO: 13082 - protein, 10 aa, Mycobacterium tuberculosis
LFDQLRTQVI

SEQ ID NO: 13083 - protein, 10 aa, Mycobacterium tuberculosis
FDQLRTQVID

SEQ ID NO: 13084 - protein, 10 aa, Mycobacterium tuberculosis
DQLRTQVIDG

SEQ ID NO: 13085 - protein, 10 aa, Mycobacterium tuberculosis
QLRTQVIDGV

SEQ ID NO: 13086 - protein, 10 aa, Mycobacterium tuberculosis
LRTQVIDGVR

SEQ ID NO: 13087 - protein, 10 aa, Mycobacterium tuberculosis
RTQVIDGVRA

SEQ ID NO: 13088 - protein, 10 aa, Mycobacterium tuberculosis
TQVIDGVRAG

SEQ ID NO: 13089 - protein, 10 aa, Mycobacterium tuberculosis
QVIDGVRAGA

SEQ ID NO: 13090 - protein, 10 aa, Mycobacterium tuberculosis
VIDGVRAGAL

SEQ ID NO: 13091 - protein, 10 aa, Mycobacterium tuberculosis
IDGVRAGALP

SEQ ID NO: 13092 - protein, 10 aa, Mycobacterium tuberculosis
DGVRAGALPP

SEQ ID NO: 13093 - protein, 10 aa, Mycobacterium tuberculosis
GVRAGALPPG

SEQ ID NO: 13094 - protein, 10 aa, Mycobacterium tuberculosis
VRAGALPPGT

SEQ ID NO: 13095 - protein, 10 aa, Mycobacterium tuberculosis
RAGALPPGTR

SEQ ID NO: 13096 - protein, 10 aa, Mycobacterium tuberculosis
AGALPPGTRL

SEQ ID NO: 13097 - protein, 10 aa, Mycobacterium tuberculosis
GALPPGTRLP

SEQ ID NO: 13098 - protein, 10 aa, Mycobacterium tuberculosis
ALPPGTRLPT

SEQ ID NO: 13099 - protein, 10 aa, Mycobacterium tuberculosis
LPPGTRLPTV

SEQ ID NO: 13100 - protein, 10 aa, Mycobacterium tuberculosis
PPGTRLPTVR

SEQ ID NO: 13101 - protein, 10 aa, Mycobacterium tuberculosis
PGTRLPTVRD

SEQ ID NO: 13102 - protein, 10 aa, Mycobacterium tuberculosis
GTRLPTVRDL

SEQ ID NO: 13103 - protein, 10 aa, Mycobacterium tuberculosis
TRLPTVRDLA

SEQ ID NO: 13104 - protein, 10 aa, Mycobacterium tuberculosis
RLPTVRDLAG

SEQ ID NO: 13105 - protein, 10 aa, Mycobacterium tuberculosis
LPTVRDLAGQ

SEQ ID NO: 13106 - protein, 10 aa, Mycobacterium tuberculosis
PTVRDLAGQL

SEQ ID NO: 13107 - protein, 10 aa, Mycobacterium tuberculosis
TVRDLAGQLG

SEQ ID NO: 13108 - protein, 10 aa, Mycobacterium tuberculosis
VRDLAGQLGV

SEQ ID NO: 13109 - protein, 10 aa, Mycobacterium tuberculosis
RDLAGQLGVA

SEQ ID NO: 13110 - protein, 10 aa, Mycobacterium tuberculosis
DLAGQLGVAA

SEQ ID NO: 13111 - protein, 10 aa, Mycobacterium tuberculosis
LAGQLGVAAN

SEQ ID NO: 13112 - protein, 10 aa, Mycobacterium tuberculosis
AGQLGVAANT

SEQ ID NO: 13113 - protein, 10 aa, Mycobacterium tuberculosis
GQLGVAANTV

SEQ ID NO: 13114 - protein, 10 aa, Mycobacterium tuberculosis
QLGVAANTVA

SEQ ID NO: 13115 - protein, 10 aa, Mycobacterium tuberculosis
LGVAANTVAR

SEQ ID NO: 13116 - protein, 10 aa, Mycobacterium tuberculosis
GVAANTVARA

SEQ ID NO: 13117 - protein, 10 aa, Mycobacterium tuberculosis
VAANTVARAY

SEQ ID NO: 13118 - protein, 10 aa, Mycobacterium tuberculosis
AANTVARAYR

SEQ ID NO: 13119 - protein, 10 aa, Mycobacterium tuberculosis
ANTVARAYRE

SEQ ID NO: 13120 - protein, 10 aa, Mycobacterium tuberculosis
NTVARAYREL

SEQ ID NO: 13121 - protein, 10 aa, Mycobacterium tuberculosis
TVARAYRELE

SEQ ID NO: 13122 - protein, 10 aa, Mycobacterium tuberculosis
VARAYRELES

SEQ ID NO: 13123 - protein, 10 aa, Mycobacterium tuberculosis
ARAYRELESA

SEQ ID NO: 13124 - protein, 10 aa, Mycobacterium tuberculosis
RAYRELESAA

SEQ ID NO: 13125 - protein, 10 aa, Mycobacterium tuberculosis
AYRELESAAI

SEQ ID NO: 13126 - protein, 10 aa, Mycobacterium tuberculosis
YRELESAAIV

SEQ ID NO: 13127 - protein, 10 aa, Mycobacterium tuberculosis
RELESAAIVE

SEQ ID NO: 13128 - protein, 10 aa, Mycobacterium tuberculosis
ELESAAIVET

SEQ ID NO: 13129 - protein, 10 aa, Mycobacterium tuberculosis
LESAAIVETR

SEQ ID NO: 13130 - protein, 10 aa, Mycobacterium tuberculosis
ESAAIVETRG

SEQ ID NO: 13131 - protein, 10 aa, Mycobacterium tuberculosis
SAAIVETRGR

SEQ ID NO: 13132 - protein, 10 aa, Mycobacterium tuberculosis
AAIVETRGRF

SEQ ID NO: 13133 - protein, 10 aa, Mycobacterium tuberculosis
AIVETRGRFG

SEQ ID NO: 13134 - protein, 10 aa, Mycobacterium tuberculosis
IVETRGRFGT

SEQ ID NO: 13135 - protein, 10 aa, Mycobacterium tuberculosis
VETRGRFGTF

SEQ ID NO: 13136 - protein, 10 aa, Mycobacterium tuberculosis
ETRGRFGTFI

SEQ ID NO: 13137 - protein, 10 aa, Mycobacterium tuberculosis
TRGRFGTFIS

SEQ ID NO: 13138 - protein, 10 aa, Mycobacterium tuberculosis
RGRFGTFISR

SEQ ID NO: 13139 - protein, 10 aa, Mycobacterium tuberculosis
GRFGTFISRF

SEQ ID NO: 13140 - protein, 10 aa, Mycobacterium tuberculosis
RFGTFISRFD

SEQ ID NO: 13141 - protein, 10 aa, Mycobacterium tuberculosis
FGTFISRFDP

SEQ ID NO: 13142 - protein, 10 aa, Mycobacterium tuberculosis
GTFISRFDPT

SEQ ID NO: 13143 - protein, 10 aa, Mycobacterium tuberculosis
TFISRFDPTD

SEQ ID NO: 13144 - protein, 10 aa, Mycobacterium tuberculosis
FISRFDPTDA

SEQ ID NO: 13145 - protein, 10 aa, Mycobacterium tuberculosis
ISRFDPTDAA

SEQ ID NO: 13146 - protein, 10 aa, Mycobacterium tuberculosis
SRFDPTDAAM

SEQ ID NO: 13147 - protein, 10 aa, Mycobacterium tuberculosis
RFDPTDAAMA

SEQ ID NO: 13148 - protein, 10 aa, Mycobacterium tuberculosis
FDPTDAAMAA

SEQ ID NO: 13149 - protein, 10 aa, Mycobacterium tuberculosis
DPTDAAMAAA

SEQ ID NO: 13150 - protein, 10 aa, Mycobacterium tuberculosis
PTDAAMAAAA

SEQ ID NO: 13151 - protein, 10 aa, Mycobacterium tuberculosis
TDAAMAAAAK

SEQ ID NO: 13152 - protein, 10 aa, Mycobacterium tuberculosis
DAAMAAAAKE

SEQ ID NO: 13153 - protein, 10 aa, Mycobacterium tuberculosis
AAMAAAAKEY

SEQ ID NO: 13154 - protein, 10 aa, Mycobacterium tuberculosis
AMAAAAKEYV

SEQ ID NO: 13155 - protein, 10 aa, Mycobacterium tuberculosis
MAAAAKEYVG

SEQ ID NO: 13156 - protein, 10 aa, Mycobacterium tuberculosis
AAAAKEYVGV

SEQ ID NO: 13157 - protein, 10 aa, Mycobacterium tuberculosis
AAAKEYVGVA

SEQ ID NO: 13158 - protein, 10 aa, Mycobacterium tuberculosis
AAKEYVGVAR

SEQ ID NO: 13159 - protein, 10 aa, Mycobacterium tuberculosis
AKEYVGVARA

SEQ ID NO: 13160 - protein, 10 aa, Mycobacterium tuberculosis
KEYVGVARAL

SEQ ID NO: 13161 - protein, 10 aa, Mycobacterium tuberculosis
EYVGVARALG

SEQ ID NO: 13162 - protein, 10 aa, Mycobacterium tuberculosis
YVGVARALGL

SEQ ID NO: 13163 - protein, 10 aa, Mycobacterium tuberculosis
VGVARALGLT

SEQ ID NO: 13164 - protein, 10 aa, Mycobacterium tuberculosis
GVARALGLTK

SEQ ID NO: 13165 - protein, 10 aa, Mycobacterium tuberculosis
VARALGLTKS

SEQ ID NO: 13166 - protein, 10 aa, Mycobacterium tuberculosis
ARALGLTKSD

SEQ ID NO: 13167 - protein, 10 aa, Mycobacterium tuberculosis
RALGLTKSDA

SEQ ID NO: 13168 - protein, 10 aa, Mycobacterium tuberculosis
ALGLTKSDAM

SEQ ID NO: 13169 - protein, 10 aa, Mycobacterium tuberculosis
LGLTKSDAMR

SEQ ID NO: 13170 - protein, 10 aa, Mycobacterium tuberculosis
GLTKSDAMRY

SEQ ID NO: 13171 - protein, 10 aa, Mycobacterium tuberculosis
LTKSDAMRYL

SEQ ID NO: 13172 - protein, 10 aa, Mycobacterium tuberculosis
TKSDAMRYLT

SEQ ID NO: 13173 - protein, 10 aa, Mycobacterium tuberculosis
KSDAMRYLTH

SEQ ID NO: 13174 - protein, 10 aa, Mycobacterium tuberculosis
SDAMRYLTHV

SEQ ID NO: 13175 - protein, 10 aa, Mycobacterium tuberculosis
DAMRYLTHVP

SEQ ID NO: 13176 - protein, 11 aa, Mycobacterium tuberculosis
MELRDWLRVDV

SEQ ID NO: 13177 - protein, 11 aa, Mycobacterium tuberculosis
ELRDWLRVDVK

SEQ ID NO: 13178 - protein, 11 aa, Mycobacterium tuberculosis
LRDWLRVDVKA

SEQ ID NO: 13179 - protein, 11 aa, Mycobacterium tuberculosis
RDWLRVDVKAG

SEQ ID NO: 13180 - protein, 11 aa, Mycobacterium tuberculosis
DWLRVDVKAGK

SEQ ID NO: 13181 - protein, 11 aa, Mycobacterium tuberculosis
WLRVDVKAGKP

SEQ ID NO: 13182 - protein, 11 aa, Mycobacterium tuberculosis
LRVDVKAGKPL

SEQ ID NO: 13183 - protein, 11 aa, Mycobacterium tuberculosis
RVDVKAGKPLF

SEQ ID NO: 13184 - protein, 11 aa, Mycobacterium tuberculosis
VDVKAGKPLFD

SEQ ID NO: 13185 - protein, 11 aa, Mycobacterium tuberculosis
DVKAGKPLFDQ

SEQ ID NO: 13186 - protein, 11 aa, Mycobacterium tuberculosis
VKAGKPLFDQL

SEQ ID NO: 13187 - protein, 11 aa, Mycobacterium tuberculosis
KAGKPLFDQLR

SEQ ID NO: 13188 - protein, 11 aa, Mycobacterium tuberculosis
AGKPLFDQLRT

SEQ ID NO: 13189 - protein, 11 aa, Mycobacterium tuberculosis
GKPLFDQLRTQ

SEQ ID NO: 13190 - protein, 11 aa, Mycobacterium tuberculosis
KPLFDQLRTQV

SEQ ID NO: 13191 - protein, 11 aa, Mycobacterium tuberculosis
PLFDQLRTQVI

SEQ ID NO: 13192 - protein, 11 aa, Mycobacterium tuberculosis
LFDQLRTQVID

SEQ ID NO: 13193 - protein, 11 aa, Mycobacterium tuberculosis
FDQLRTQVIDG

SEQ ID NO: 13194 - protein, 11 aa, Mycobacterium tuberculosis
DQLRTQVIDGV

SEQ ID NO: 13195 - protein, 11 aa, Mycobacterium tuberculosis
QLRTQVIDGVR

SEQ ID NO: 13196 - protein, 11 aa, Mycobacterium tuberculosis
LRTQVIDGVRA

SEQ ID NO: 13197 - protein, 11 aa, Mycobacterium tuberculosis
RTQVIDGVRAG

SEQ ID NO: 13198 - protein, 11 aa, Mycobacterium tuberculosis
TQVIDGVRAGA

SEQ ID NO: 13199 - protein, 11 aa, Mycobacterium tuberculosis
QVIDGVRAGAL

SEQ ID NO: 13200 - protein, 11 aa, Mycobacterium tuberculosis
VIDGVRAGALP

SEQ ID NO: 13201 - protein, 11 aa, Mycobacterium tuberculosis
IDGVRAGALPP

SEQ ID NO: 13202 - protein, 11 aa, Mycobacterium tuberculosis
DGVRAGALPPG

SEQ ID NO: 13203 - protein, 11 aa, Mycobacterium tuberculosis
GVRAGALPPGT

SEQ ID NO: 13204 - protein, 11 aa, Mycobacterium tuberculosis
VRAGALPPGTR

SEQ ID NO: 13205 - protein, 11 aa, Mycobacterium tuberculosis
RAGALPPGTRL

SEQ ID NO: 13206 - protein, 11 aa, Mycobacterium tuberculosis
AGALPPGTRLP

SEQ ID NO: 13207 - protein, 11 aa, Mycobacterium tuberculosis
GALPPGTRLPT

SEQ ID NO: 13208 - protein, 11 aa, Mycobacterium tuberculosis
ALPPGTRLPTV

SEQ ID NO: 13209 - protein, 11 aa, Mycobacterium tuberculosis
LPPGTRLPTVR

SEQ ID NO: 13210 - protein, 11 aa, Mycobacterium tuberculosis
PPGTRLPTVRD

SEQ ID NO: 13211 - protein, 11 aa, Mycobacterium tuberculosis
PGTRLPTVRDL

SEQ ID NO: 13212 - protein, 11 aa, Mycobacterium tuberculosis
GTRLPTVRDLA

SEQ ID NO: 13213 - protein, 11 aa, Mycobacterium tuberculosis
TRLPTVRDLAG

SEQ ID NO: 13214 - protein, 11 aa, Mycobacterium tuberculosis
RLPTVRDLAGQ

SEQ ID NO: 13215 - protein, 11 aa, Mycobacterium tuberculosis
LPTVRDLAGQL

SEQ ID NO: 13216 - protein, 11 aa, Mycobacterium tuberculosis
PTVRDLAGQLG

SEQ ID NO: 13217 - protein, 11 aa, Mycobacterium tuberculosis
TVRDLAGQLGV

SEQ ID NO: 13218 - protein, 11 aa, Mycobacterium tuberculosis
VRDLAGQLGVA

SEQ ID NO: 13219 - protein, 11 aa, Mycobacterium tuberculosis
RDLAGQLGVAA

SEQ ID NO: 13220 - protein, 11 aa, Mycobacterium tuberculosis
DLAGQLGVAAN

SEQ ID NO: 13221 - protein, 11 aa, Mycobacterium tuberculosis
LAGQLGVAANT

SEQ ID NO: 13222 - protein, 11 aa, Mycobacterium tuberculosis
AGQLGVAANTV

SEQ ID NO: 13223 - protein, 11 aa, Mycobacterium tuberculosis
GQLGVAANTVA

SEQ ID NO: 13224 - protein, 11 aa, Mycobacterium tuberculosis
QLGVAANTVAR

SEQ ID NO: 13225 - protein, 11 aa, Mycobacterium tuberculosis
LGVAANTVARA

SEQ ID NO: 13226 - protein, 11 aa, Mycobacterium tuberculosis
GVAANTVARAY

SEQ ID NO: 13227 - protein, 11 aa, Mycobacterium tuberculosis
VAANTVARAYR

SEQ ID NO: 13228 - protein, 11 aa, Mycobacterium tuberculosis
AANTVARAYRE

SEQ ID NO: 13229 - protein, 11 aa, Mycobacterium tuberculosis
ANTVARAYREL

SEQ ID NO: 13230 - protein, 11 aa, Mycobacterium tuberculosis
NTVARAYRELE

SEQ ID NO: 13231 - protein, 11 aa, Mycobacterium tuberculosis
TVARAYRELES

SEQ ID NO: 13232 - protein, 11 aa, Mycobacterium tuberculosis
VARAYRELESA

SEQ ID NO: 13233 - protein, 11 aa, Mycobacterium tuberculosis
ARAYRELESAA

SEQ ID NO: 13234 - protein, 11 aa, Mycobacterium tuberculosis
RAYRELESAAI

SEQ ID NO: 13235 - protein, 11 aa, Mycobacterium tuberculosis
AYRELESAAIV

SEQ ID NO: 13236 - protein, 11 aa, Mycobacterium tuberculosis
YRELESAAIVE

SEQ ID NO: 13237 - protein, 11 aa, Mycobacterium tuberculosis
RELESAAIVET

SEQ ID NO: 13238 - protein, 11 aa, Mycobacterium tuberculosis
ELESAAIVETR

SEQ ID NO: 13239 - protein, 11 aa, Mycobacterium tuberculosis
LESAAIVETRG

SEQ ID NO: 13240 - protein, 11 aa, Mycobacterium tuberculosis
ESAAIVETRGR

SEQ ID NO: 13241 - protein, 11 aa, Mycobacterium tuberculosis
SAAIVETRGRF

SEQ ID NO: 13242 - protein, 11 aa, Mycobacterium tuberculosis
AAIVETRGRFG

SEQ ID NO: 13243 - protein, 11 aa, Mycobacterium tuberculosis
AIVETRGRFGT

SEQ ID NO: 13244 - protein, 11 aa, Mycobacterium tuberculosis
IVETRGRFGTF

SEQ ID NO: 13245 - protein, 11 aa, Mycobacterium tuberculosis
VETRGRFGTFI

SEQ ID NO: 13246 - protein, 11 aa, Mycobacterium tuberculosis
ETRGRFGTFIS

SEQ ID NO: 13247 - protein, 11 aa, Mycobacterium tuberculosis
TRGRFGTFISR

SEQ ID NO: 13248 - protein, 11 aa, Mycobacterium tuberculosis
RGRFGTFISRF

SEQ ID NO: 13249 - protein, 11 aa, Mycobacterium tuberculosis
GRFGTFISRFD

SEQ ID NO: 13250 - protein, 11 aa, Mycobacterium tuberculosis
RFGTFISRFDP

SEQ ID NO: 13251 - protein, 11 aa, Mycobacterium tuberculosis
FGTFISRFDPT

SEQ ID NO: 13252 - protein, 11 aa, Mycobacterium tuberculosis
GTFISRFDPTD

SEQ ID NO: 13253 - protein, 11 aa, Mycobacterium tuberculosis
TFISRFDPTDA

SEQ ID NO: 13254 - protein, 11 aa, Mycobacterium tuberculosis
FISRFDPTDAA

SEQ ID NO: 13255 - protein, 11 aa, Mycobacterium tuberculosis
ISRFDPTDAAM

SEQ ID NO: 13256 - protein, 11 aa, Mycobacterium tuberculosis
SRFDPTDAAMA

SEQ ID NO: 13257 - protein, 11 aa, Mycobacterium tuberculosis
RFDPTDAAMAA

SEQ ID NO: 13258 - protein, 11 aa, Mycobacterium tuberculosis
FDPTDAAMAAA

SEQ ID NO: 13259 - protein, 11 aa, Mycobacterium tuberculosis
DPTDAAMAAAA

SEQ ID NO: 13260 - protein, 11 aa, Mycobacterium tuberculosis
PTDAAMAAAAK

SEQ ID NO: 13261 - protein, 11 aa, Mycobacterium tuberculosis
TDAAMAAAAKE

SEQ ID NO: 13262 - protein, 11 aa, Mycobacterium tuberculosis
DAAMAAAAKEY

SEQ ID NO: 13263 - protein, 11 aa, Mycobacterium tuberculosis
AAMAAAAKEYV

SEQ ID NO: 13264 - protein, 11 aa, Mycobacterium tuberculosis
AMAAAAKEYVG

SEQ ID NO: 13265 - protein, 11 aa, Mycobacterium tuberculosis
MAAAAKEYVGV

SEQ ID NO: 13266 - protein, 11 aa, Mycobacterium tuberculosis
AAAAKEYVGVA

SEQ ID NO: 13267 - protein, 11 aa, Mycobacterium tuberculosis
AAAKEYVGVAR

SEQ ID NO: 13268 - protein, 11 aa, Mycobacterium tuberculosis
AAKEYVGVARA

SEQ ID NO: 13269 - protein, 11 aa, Mycobacterium tuberculosis
AKEYVGVARAL

SEQ ID NO: 13270 - protein, 11 aa, Mycobacterium tuberculosis
KEYVGVARALG

SEQ ID NO: 13271 - protein, 11 aa, Mycobacterium tuberculosis
EYVGVARALGL

SEQ ID NO: 13272 - protein, 11 aa, Mycobacterium tuberculosis
YVGVARALGLT

SEQ ID NO: 13273 - protein, 11 aa, Mycobacterium tuberculosis
VGVARALGLTK

SEQ ID NO: 13274 - protein, 11 aa, Mycobacterium tuberculosis
GVARALGLTKS

SEQ ID NO: 13275 - protein, 11 aa, Mycobacterium tuberculosis
VARALGLTKSD

SEQ ID NO: 13276 - protein, 11 aa, Mycobacterium tuberculosis
ARALGLTKSDA

SEQ ID NO: 13277 - protein, 11 aa, Mycobacterium tuberculosis
RALGLTKSDAM

SEQ ID NO: 13278 - protein, 11 aa, Mycobacterium tuberculosis
ALGLTKSDAMR

SEQ ID NO: 13279 - protein, 11 aa, Mycobacterium tuberculosis
LGLTKSDAMRY

SEQ ID NO: 13280 - protein, 11 aa, Mycobacterium tuberculosis
GLTKSDAMRYL

SEQ ID NO: 13281 - protein, 11 aa, Mycobacterium tuberculosis
LTKSDAMRYLT

SEQ ID NO: 13282 - protein, 11 aa, Mycobacterium tuberculosis
TKSDAMRYLTH

SEQ ID NO: 13283 - protein, 11 aa, Mycobacterium tuberculosis
KSDAMRYLTHV

SEQ ID NO: 13284 - protein, 11 aa, Mycobacterium tuberculosis
SDAMRYLTHVP

SEQ ID NO: 13285 - protein, 11 aa, Mycobacterium tuberculosis
DAMRYLTHVPD

SEQ ID NO: 13286 - protein, 11 aa, Mycobacterium tuberculosis
AMRYLTHVPDD

SEQ ID NO: 13287 - protein, 8 aa, Mycobacterium tuberculosis
MSFVMAYP

SEQ ID NO: 13288 - protein, 8 aa, Mycobacterium tuberculosis
SFVMAYPE

SEQ ID NO: 13289 - protein, 8 aa, Mycobacterium tuberculosis
FVMAYPEM

SEQ ID NO: 13290 - protein, 8 aa, Mycobacterium tuberculosis
VMAYPEML

SEQ ID NO: 13291 - protein, 8 aa, Mycobacterium tuberculosis
MAYPEMLA

SEQ ID NO: 13292 - protein, 8 aa, Mycobacterium tuberculosis
AYPEMLAA

SEQ ID NO: 13293 - protein, 8 aa, Mycobacterium tuberculosis
YPEMLAAA

SEQ ID NO: 13294 - protein, 8 aa, Mycobacterium tuberculosis
PEMLAAAA

SEQ ID NO: 13295 - protein, 8 aa, Mycobacterium tuberculosis
EMLAAAAD

SEQ ID NO: 13296 - protein, 8 aa, Mycobacterium tuberculosis
MLAAAADT

SEQ ID NO: 13297 - protein, 8 aa, Mycobacterium tuberculosis
LAAAADTL

SEQ ID NO: 13298 - protein, 8 aa, Mycobacterium tuberculosis
AAAADTLQ

SEQ ID NO: 13299 - protein, 8 aa, Mycobacterium tuberculosis
AAADTLQS

SEQ ID NO: 13300 - protein, 8 aa, Mycobacterium tuberculosis
AADTLQSI

SEQ ID NO: 13301 - protein, 8 aa, Mycobacterium tuberculosis
ADTLQSIG

SEQ ID NO: 13302 - protein, 8 aa, Mycobacterium tuberculosis
DTLQSIGA

SEQ ID NO: 13303 - protein, 8 aa, Mycobacterium tuberculosis
TLQSIGAT

SEQ ID NO: 13304 - protein, 8 aa, Mycobacterium tuberculosis
LQSIGATT

SEQ ID NO: 13305 - protein, 8 aa, Mycobacterium tuberculosis
QSIGATTV

SEQ ID NO: 13306 - protein, 8 aa, Mycobacterium tuberculosis
SIGATTVA

SEQ ID NO: 13307 - protein, 8 aa, Mycobacterium tuberculosis
IGATTVAS

SEQ ID NO: 13308 - protein, 8 aa, Mycobacterium tuberculosis
GATTVASN

SEQ ID NO: 13309 - protein, 8 aa, Mycobacterium tuberculosis
ATTVASNA

SEQ ID NO: 13310 - protein, 8 aa, Mycobacterium tuberculosis
TTVASNAA

SEQ ID NO: 13311 - protein, 8 aa, Mycobacterium tuberculosis
TVASNAAA

SEQ ID NO: 13312 - protein, 8 aa, Mycobacterium tuberculosis
VASNAAAA

SEQ ID NO: 13313 - protein, 8 aa, Mycobacterium tuberculosis
ASNAAAAA

SEQ ID NO: 13314 - protein, 8 aa, Mycobacterium tuberculosis
SNAAAAAP

SEQ ID NO: 13315 - protein, 8 aa, Mycobacterium tuberculosis
NAAAAAPT

SEQ ID NO: 13316 - protein, 8 aa, Mycobacterium tuberculosis
AAAAAPTT

SEQ ID NO: 13317 - protein, 8 aa, Mycobacterium tuberculosis
AAAAPTTG

SEQ ID NO: 13318 - protein, 8 aa, Mycobacterium tuberculosis
AAAPTTGV

SEQ ID NO: 13319 - protein, 8 aa, Mycobacterium tuberculosis
AAPTTGVV

SEQ ID NO: 13320 - protein, 8 aa, Mycobacterium tuberculosis
APTTGVVP

SEQ ID NO: 13321 - protein, 8 aa, Mycobacterium tuberculosis
PTTGVVPP

SEQ ID NO: 13322 - protein, 8 aa, Mycobacterium tuberculosis
TTGVVPPA

SEQ ID NO: 13323 - protein, 8 aa, Mycobacterium tuberculosis
TGVVPPAA

SEQ ID NO: 13324 - protein, 8 aa, Mycobacterium tuberculosis
GVVPPAAD

SEQ ID NO: 13325 - protein, 8 aa, Mycobacterium tuberculosis
VVPPAADE

SEQ ID NO: 13326 - protein, 8 aa, Mycobacterium tuberculosis
VPPAADEV

SEQ ID NO: 13327 - protein, 8 aa, Mycobacterium tuberculosis
PPAADEVS

SEQ ID NO: 13328 - protein, 8 aa, Mycobacterium tuberculosis
PAADEVSA

SEQ ID NO: 13329 - protein, 8 aa, Mycobacterium tuberculosis
AADEVSAL

SEQ ID NO: 13330 - protein, 8 aa, Mycobacterium tuberculosis
ADEVSALT

SEQ ID NO: 13331 - protein, 8 aa, Mycobacterium tuberculosis
DEVSALTA

SEQ ID NO: 13332 - protein, 8 aa, Mycobacterium tuberculosis
EVSALTAA

SEQ ID NO: 13333 - protein, 8 aa, Mycobacterium tuberculosis
VSALTAAH

SEQ ID NO: 13334 - protein, 8 aa, Mycobacterium tuberculosis
SALTAAHF

SEQ ID NO: 13335 - protein, 8 aa, Mycobacterium tuberculosis
ALTAAHFA

SEQ ID NO: 13336 - protein, 8 aa, Mycobacterium tuberculosis
LTAAHFAA

SEQ ID NO: 13337 - protein, 8 aa, Mycobacterium tuberculosis
TAAHFAAH

SEQ ID NO: 13338 - protein, 8 aa, Mycobacterium tuberculosis
AAHFAAHA

SEQ ID NO: 13339 - protein, 8 aa, Mycobacterium tuberculosis
AHFAAHAA

SEQ ID NO: 13340 - protein, 8 aa, Mycobacterium tuberculosis
HFAAHAAM

SEQ ID NO: 13341 - protein, 8 aa, Mycobacterium tuberculosis
FAAHAAMY

SEQ ID NO: 13342 - protein, 8 aa, Mycobacterium tuberculosis
AAHAAMYQ

SEQ ID NO: 13343 - protein, 8 aa, Mycobacterium tuberculosis
AHAAMYQS

SEQ ID NO: 13344 - protein, 8 aa, Mycobacterium tuberculosis
HAAMYQSV

SEQ ID NO: 13345 - protein, 8 aa, Mycobacterium tuberculosis
AAMYQSVS

SEQ ID NO: 13346 - protein, 8 aa, Mycobacterium tuberculosis
AMYQSVSA

SEQ ID NO: 13347 - protein, 8 aa, Mycobacterium tuberculosis
MYQSVSAR

SEQ ID NO: 13348 - protein, 8 aa, Mycobacterium tuberculosis
YQSVSARA

SEQ ID NO: 13349 - protein, 8 aa, Mycobacterium tuberculosis
QSVSARAA

SEQ ID NO: 13350 - protein, 8 aa, Mycobacterium tuberculosis
SVSARAAA

SEQ ID NO: 13351 - protein, 8 aa, Mycobacterium tuberculosis
VSARAAAI

SEQ ID NO: 13352 - protein, 8 aa, Mycobacterium tuberculosis
SARAAAIH

SEQ ID NO: 13353 - protein, 8 aa, Mycobacterium tuberculosis
ARAAAIHD

SEQ ID NO: 13354 - protein, 8 aa, Mycobacterium tuberculosis
RAAAIHDQ

SEQ ID NO: 13355 - protein, 8 aa, Mycobacterium tuberculosis
AAAIHDQF

SEQ ID NO: 13356 - protein, 8 aa, Mycobacterium tuberculosis
AAIHDQFV

SEQ ID NO: 13357 - protein, 8 aa, Mycobacterium tuberculosis
AIHDQFVA

SEQ ID NO: 13358 - protein, 8 aa, Mycobacterium tuberculosis
IHDQFVAT

SEQ ID NO: 13359 - protein, 8 aa, Mycobacterium tuberculosis
HDQFVATL

SEQ ID NO: 13360 - protein, 8 aa, Mycobacterium tuberculosis
DQFVATLA

SEQ ID NO: 13361 - protein, 8 aa, Mycobacterium tuberculosis
QFVATLAS

SEQ ID NO: 13362 - protein, 8 aa, Mycobacterium tuberculosis
FVATLASS

SEQ ID NO: 13363 - protein, 8 aa, Mycobacterium tuberculosis
VATLASSA

SEQ ID NO: 13364 - protein, 8 aa, Mycobacterium tuberculosis
ATLASSAS

SEQ ID NO: 13365 - protein, 8 aa, Mycobacterium tuberculosis
TLASSASS

SEQ ID NO: 13366 - protein, 8 aa, Mycobacterium tuberculosis
LASSASSY

SEQ ID NO: 13367 - protein, 8 aa, Mycobacterium tuberculosis
ASSASSYA

SEQ ID NO: 13368 - protein, 8 aa, Mycobacterium tuberculosis
SSASSYAA

SEQ ID NO: 13369 - protein, 8 aa, Mycobacterium tuberculosis
SASSYAAT

SEQ ID NO: 13370 - protein, 8 aa, Mycobacterium tuberculosis
ASSYAATE

SEQ ID NO: 13371 - protein, 8 aa, Mycobacterium tuberculosis
SSYAATEV

SEQ ID NO: 13372 - protein, 8 aa, Mycobacterium tuberculosis
SYAATEVA

SEQ ID NO: 13373 - protein, 8 aa, Mycobacterium tuberculosis
YAATEVAN

SEQ ID NO: 13374 - protein, 8 aa, Mycobacterium tuberculosis
AATEVANA

SEQ ID NO: 13375 - protein, 8 aa, Mycobacterium tuberculosis
ATEVANAA

SEQ ID NO: 13376 - protein, 8 aa, Mycobacterium tuberculosis
TEVANAAA

SEQ ID NO: 13377 - protein, 8 aa, Mycobacterium tuberculosis
EVANAAAA

SEQ ID NO: 13378 - protein, 8 aa, Mycobacterium tuberculosis
VANAAAAS

SEQ ID NO: 13379 - protein, 9 aa, Mycobacterium tuberculosis
MSFVMAYPE

SEQ ID NO: 13380 - protein, 9 aa, Mycobacterium tuberculosis
SFVMAYPEM

SEQ ID NO: 13381 - protein, 9 aa, Mycobacterium tuberculosis
FVMAYPEML

SEQ ID NO: 13382 - protein, 9 aa, Mycobacterium tuberculosis
VMAYPEMLA

SEQ ID NO: 13383 - protein, 9 aa, Mycobacterium tuberculosis
MAYPEMLAA

SEQ ID NO: 13384 - protein, 9 aa, Mycobacterium tuberculosis
AYPEMLAAA

SEQ ID NO: 13385 - protein, 9 aa, Mycobacterium tuberculosis
YPEMLAAAA

SEQ ID NO: 13386 - protein, 9 aa, Mycobacterium tuberculosis
PEMLAAAAD

SEQ ID NO: 13387 - protein, 9 aa, Mycobacterium tuberculosis
EMLAAAADT

SEQ ID NO: 13388 - protein, 9 aa, Mycobacterium tuberculosis
MLAAAADTL

SEQ ID NO: 13389 - protein, 9 aa, Mycobacterium tuberculosis
LAAAADTLQ

SEQ ID NO: 13390 - protein, 9 aa, Mycobacterium tuberculosis
AAAADTLQS

SEQ ID NO: 13391 - protein, 9 aa, Mycobacterium tuberculosis
AAADTLQSI

SEQ ID NO: 13392 - protein, 9 aa, Mycobacterium tuberculosis
AADTLQSIG

SEQ ID NO: 13393 - protein, 9 aa, Mycobacterium tuberculosis
ADTLQSIGA

SEQ ID NO: 13394 - protein, 9 aa, Mycobacterium tuberculosis
DTLQSIGAT

SEQ ID NO: 13395 - protein, 9 aa, Mycobacterium tuberculosis
TLQSIGATT

SEQ ID NO: 13396 - protein, 9 aa, Mycobacterium tuberculosis
LQSIGATTV

SEQ ID NO: 13397 - protein, 9 aa, Mycobacterium tuberculosis
QSIGATTVA

SEQ ID NO: 13398 - protein, 9 aa, Mycobacterium tuberculosis
SIGATTVAS

SEQ ID NO: 13399 - protein, 9 aa, Mycobacterium tuberculosis
IGATTVASN

SEQ ID NO: 13400 - protein, 9 aa, Mycobacterium tuberculosis
GATTVASNA

SEQ ID NO: 13401 - protein, 9 aa, Mycobacterium tuberculosis
ATTVASNAA

SEQ ID NO: 13402 - protein, 9 aa, Mycobacterium tuberculosis
TTVASNAAA

SEQ ID NO: 13403 - protein, 9 aa, Mycobacterium tuberculosis
TVASNAAAA

SEQ ID NO: 13404 - protein, 9 aa, Mycobacterium tuberculosis
VASNAAAAA

SEQ ID NO: 13405 - protein, 9 aa, Mycobacterium tuberculosis
ASNAAAAAP

SEQ ID NO: 13406 - protein, 9 aa, Mycobacterium tuberculosis
SNAAAAAPT

SEQ ID NO: 13407 - protein, 9 aa, Mycobacterium tuberculosis
NAAAAAPTT

SEQ ID NO: 13408 - protein, 9 aa, Mycobacterium tuberculosis
AAAAAPTTG

SEQ ID NO: 13409 - protein, 9 aa, Mycobacterium tuberculosis
AAAAPTTGV

SEQ ID NO: 13410 - protein, 9 aa, Mycobacterium tuberculosis
AAAPTTGVV

SEQ ID NO: 13411 - protein, 9 aa, Mycobacterium tuberculosis
AAPTTGVVP

SEQ ID NO: 13412 - protein, 9 aa, Mycobacterium tuberculosis
APTTGVVPP

SEQ ID NO: 13413 - protein, 9 aa, Mycobacterium tuberculosis
PTTGVVPPA

SEQ ID NO: 13414 - protein, 9 aa, Mycobacterium tuberculosis
TTGVVPPAA

SEQ ID NO: 13415 - protein, 9 aa, Mycobacterium tuberculosis
TGVVPPAAD

SEQ ID NO: 13416 - protein, 9 aa, Mycobacterium tuberculosis
GVVPPAADE

SEQ ID NO: 13417 - protein, 9 aa, Mycobacterium tuberculosis
VVPPAADEV

SEQ ID NO: 13418 - protein, 9 aa, Mycobacterium tuberculosis
VPPAADEVS

SEQ ID NO: 13419 - protein, 9 aa, Mycobacterium tuberculosis
PPAADEVSA

SEQ ID NO: 13420 - protein, 9 aa, Mycobacterium tuberculosis
PAADEVSAL

SEQ ID NO: 13421 - protein, 9 aa, Mycobacterium tuberculosis
AADEVSALT

SEQ ID NO: 13422 - protein, 9 aa, Mycobacterium tuberculosis
ADEVSALTA

SEQ ID NO: 13423 - protein, 9 aa, Mycobacterium tuberculosis
DEVSALTAA

SEQ ID NO: 13424 - protein, 9 aa, Mycobacterium tuberculosis
EVSALTAAH

SEQ ID NO: 13425 - protein, 9 aa, Mycobacterium tuberculosis
VSALTAAHF

SEQ ID NO: 13426 - protein, 9 aa, Mycobacterium tuberculosis
SALTAAHFA

SEQ ID NO: 13427 - protein, 9 aa, Mycobacterium tuberculosis
ALTAAHFAA

SEQ ID NO: 13428 - protein, 9 aa, Mycobacterium tuberculosis
LTAAHFAAH

SEQ ID NO: 13429 - protein, 9 aa, Mycobacterium tuberculosis
TAAHFAAHA

SEQ ID NO: 13430 - protein, 9 aa, Mycobacterium tuberculosis
AAHFAAHAA

SEQ ID NO: 13431 - protein, 9 aa, Mycobacterium tuberculosis
AHFAAHAAM

SEQ ID NO: 13432 - protein, 9 aa, Mycobacterium tuberculosis
HFAAHAAMY

SEQ ID NO: 13433 - protein, 9 aa, Mycobacterium tuberculosis
FAAHAAMYQ

SEQ ID NO: 13434 - protein, 9 aa, Mycobacterium tuberculosis
AAHAAMYQS

SEQ ID NO: 13435 - protein, 9 aa, Mycobacterium tuberculosis
AHAAMYQSV

SEQ ID NO: 13436 - protein, 9 aa, Mycobacterium tuberculosis
HAAMYQSVS

SEQ ID NO: 13437 - protein, 9 aa, Mycobacterium tuberculosis
AAMYQSVSA

SEQ ID NO: 13438 - protein, 9 aa, Mycobacterium tuberculosis
AMYQSVSAR

SEQ ID NO: 13439 - protein, 9 aa, Mycobacterium tuberculosis
MYQSVSARA

SEQ ID NO: 13440 - protein, 9 aa, Mycobacterium tuberculosis
YQSVSARAA

SEQ ID NO: 13441 - protein, 9 aa, Mycobacterium tuberculosis
QSVSARAAA

SEQ ID NO: 13442 - protein, 9 aa, Mycobacterium tuberculosis
SVSARAAAI

SEQ ID NO: 13443 - protein, 9 aa, Mycobacterium tuberculosis
VSARAAAIH

SEQ ID NO: 13444 - protein, 9 aa, Mycobacterium tuberculosis
SARAAAIHD

SEQ ID NO: 13445 - protein, 9 aa, Mycobacterium tuberculosis
ARAAAIHDQ

SEQ ID NO: 13446 - protein, 9 aa, Mycobacterium tuberculosis
RAAAIHDQF

SEQ ID NO: 13447 - protein, 9 aa, Mycobacterium tuberculosis
AAAIHDQFV

SEQ ID NO: 13448 - protein, 9 aa, Mycobacterium tuberculosis
AAIHDQFVA

SEQ ID NO: 13449 - protein, 9 aa, Mycobacterium tuberculosis
AIHDQFVAT

SEQ ID NO: 13450 - protein, 9 aa, Mycobacterium tuberculosis
IHDQFVATL

SEQ ID NO: 13451 - protein, 9 aa, Mycobacterium tuberculosis
HDQFVATLA

SEQ ID NO: 13452 - protein, 9 aa, Mycobacterium tuberculosis
DQFVATLAS

SEQ ID NO: 13453 - protein, 9 aa, Mycobacterium tuberculosis
QFVATLASS

SEQ ID NO: 13454 - protein, 9 aa, Mycobacterium tuberculosis
FVATLASSA

SEQ ID NO: 13455 - protein, 9 aa, Mycobacterium tuberculosis
VATLASSAS

SEQ ID NO: 13456 - protein, 9 aa, Mycobacterium tuberculosis
ATLASSASS

SEQ ID NO: 13457 - protein, 9 aa, Mycobacterium tuberculosis
TLASSASSY

SEQ ID NO: 13458 - protein, 9 aa, Mycobacterium tuberculosis
LASSASSYA

SEQ ID NO: 13459 - protein, 9 aa, Mycobacterium tuberculosis
ASSASSYAA

SEQ ID NO: 13460 - protein, 9 aa, Mycobacterium tuberculosis
SSASSYAAT

SEQ ID NO: 13461 - protein, 9 aa, Mycobacterium tuberculosis
SASSYAATE

SEQ ID NO: 13462 - protein, 9 aa, Mycobacterium tuberculosis
ASSYAATEV

SEQ ID NO: 13463 - protein, 9 aa, Mycobacterium tuberculosis
SSYAATEVA

SEQ ID NO: 13464 - protein, 9 aa, Mycobacterium tuberculosis
SYAATEVAN

SEQ ID NO: 13465 - protein, 9 aa, Mycobacterium tuberculosis
YAATEVANA

SEQ ID NO: 13466 - protein, 9 aa, Mycobacterium tuberculosis
AATEVANAA

SEQ ID NO: 13467 - protein, 9 aa, Mycobacterium tuberculosis
ATEVANAAA

SEQ ID NO: 13468 - protein, 9 aa, Mycobacterium tuberculosis
TEVANAAAA

SEQ ID NO: 13469 - protein, 9 aa, Mycobacterium tuberculosis
EVANAAAAS

SEQ ID NO: 13470 - protein, 8 aa, Mycobacterium tuberculosis
VANAAAAS

SEQ ID NO: 13471 - protein, 10 aa, Mycobacterium tuberculosis
MSFVMAYPEM

SEQ ID NO: 13472 - protein, 10 aa, Mycobacterium tuberculosis
SFVMAYPEML

SEQ ID NO: 13473 - protein, 10 aa, Mycobacterium tuberculosis
FVMAYPEMLA

SEQ ID NO: 13474 - protein, 10 aa, Mycobacterium tuberculosis
VMAYPEMLAA

SEQ ID NO: 13475 - protein, 10 aa, Mycobacterium tuberculosis
MAYPEMLAAA

SEQ ID NO: 13476 - protein, 10 aa, Mycobacterium tuberculosis
AYPEMLAAAA

SEQ ID NO: 13477 - protein, 10 aa, Mycobacterium tuberculosis
YPEMLAAAAD

SEQ ID NO: 13478 - protein, 10 aa, Mycobacterium tuberculosis
PEMLAAAADT

SEQ ID NO: 13479 - protein, 10 aa, Mycobacterium tuberculosis
EMLAAAADTL

SEQ ID NO: 13480 - protein, 10 aa, Mycobacterium tuberculosis
MLAAAADTLQ

SEQ ID NO: 13481 - protein, 10 aa, Mycobacterium tuberculosis
LAAAADTLQS

SEQ ID NO: 13482 - protein, 10 aa, Mycobacterium tuberculosis
AAAADTLQSI

SEQ ID NO: 13483 - protein, 10 aa, Mycobacterium tuberculosis
AAADTLQSIG

SEQ ID NO: 13484 - protein, 10 aa, Mycobacterium tuberculosis
AADTLQSIGA

SEQ ID NO: 13485 - protein, 10 aa, Mycobacterium tuberculosis
ADTLQSIGAT

SEQ ID NO: 13486 - protein, 10 aa, Mycobacterium tuberculosis
DTLQSIGATT

SEQ ID NO: 13487 - protein, 10 aa, Mycobacterium tuberculosis
TLQSIGATTV

SEQ ID NO: 13488 - protein, 10 aa, Mycobacterium tuberculosis
LQSIGATTVA

SEQ ID NO: 13489 - protein, 10 aa, Mycobacterium tuberculosis
QSIGATTVAS

SEQ ID NO: 13490 - protein, 10 aa, Mycobacterium tuberculosis
SIGATTVASN

SEQ ID NO: 13491 - protein, 10 aa, Mycobacterium tuberculosis
IGATTVASNA

SEQ ID NO: 13492 - protein, 10 aa, Mycobacterium tuberculosis
GATTVASNAA

SEQ ID NO: 13493 - protein, 10 aa, Mycobacterium tuberculosis
ATTVASNAAA

SEQ ID NO: 13494 - protein, 10 aa, Mycobacterium tuberculosis
TTVASNAAAA

SEQ ID NO: 13495 - protein, 10 aa, Mycobacterium tuberculosis
TVASNAAAAA

SEQ ID NO: 13496 - protein, 10 aa, Mycobacterium tuberculosis
VASNAAAAAP

SEQ ID NO: 13497 - protein, 10 aa, Mycobacterium tuberculosis
ASNAAAAAPT

SEQ ID NO: 13498 - protein, 10 aa, Mycobacterium tuberculosis
SNAAAAAPTT

SEQ ID NO: 13499 - protein, 10 aa, Mycobacterium tuberculosis
NAAAAAPTTG

SEQ ID NO: 13500 - protein, 10 aa, Mycobacterium tuberculosis
AAAAAPTTGV

SEQ ID NO: 13501 - protein, 10 aa, Mycobacterium tuberculosis
AAAAPTTGVV

SEQ ID NO: 13502 - protein, 10 aa, Mycobacterium tuberculosis
AAAPTTGVVP

SEQ ID NO: 13503 - protein, 10 aa, Mycobacterium tuberculosis
AAPTTGVVPP

SEQ ID NO: 13504 - protein, 10 aa, Mycobacterium tuberculosis
APTTGVVPPA

SEQ ID NO: 13505 - protein, 10 aa, Mycobacterium tuberculosis
PTTGVVPPAA

SEQ ID NO: 13506 - protein, 10 aa, Mycobacterium tuberculosis
TTGVVPPAAD

SEQ ID NO: 13507 - protein, 10 aa, Mycobacterium tuberculosis
TGVVPPAADE

SEQ ID NO: 13508 - protein, 10 aa, Mycobacterium tuberculosis
GVVPPAADEV

SEQ ID NO: 13509 - protein, 10 aa, Mycobacterium tuberculosis
VVPPAADEVS

SEQ ID NO: 13510 - protein, 10 aa, Mycobacterium tuberculosis
VPPAADEVSA

SEQ ID NO: 13511 - protein, 10 aa, Mycobacterium tuberculosis
PPAADEVSAL

SEQ ID NO: 13512 - protein, 10 aa, Mycobacterium tuberculosis
PAADEVSALT

SEQ ID NO: 13513 - protein, 10 aa, Mycobacterium tuberculosis
AADEVSALTA

SEQ ID NO: 13514 - protein, 10 aa, Mycobacterium tuberculosis
ADEVSALTAA

SEQ ID NO: 13515 - protein, 10 aa, Mycobacterium tuberculosis
DEVSALTAAH

SEQ ID NO: 13516 - protein, 10 aa, Mycobacterium tuberculosis
EVSALTAAHF

SEQ ID NO: 13517 - protein, 10 aa, Mycobacterium tuberculosis
VSALTAAHFA

SEQ ID NO: 13518 - protein, 10 aa, Mycobacterium tuberculosis
SALTAAHFAA

SEQ ID NO: 13519 - protein, 10 aa, Mycobacterium tuberculosis
ALTAAHFAAH

SEQ ID NO: 13520 - protein, 10 aa, Mycobacterium tuberculosis
LTAAHFAAHA

SEQ ID NO: 13521 - protein, 10 aa, Mycobacterium tuberculosis
TAAHFAAHAA

SEQ ID NO: 13522 - protein, 10 aa, Mycobacterium tuberculosis
AAHFAAHAAM

SEQ ID NO: 13523 - protein, 10 aa, Mycobacterium tuberculosis
AHFAAHAAMY

SEQ ID NO: 13524 - protein, 10 aa, Mycobacterium tuberculosis
HFAAHAAMYQ

SEQ ID NO: 13525 - protein, 10 aa, Mycobacterium tuberculosis
FAAHAAMYQS

SEQ ID NO: 13526 - protein, 10 aa, Mycobacterium tuberculosis
AAHAAMYQSV

SEQ ID NO: 13527 - protein, 10 aa, Mycobacterium tuberculosis
AHAAMYQSVS

SEQ ID NO: 13528 - protein, 10 aa, Mycobacterium tuberculosis
HAAMYQSVSA

SEQ ID NO: 13529 - protein, 10 aa, Mycobacterium tuberculosis
AAMYQSVSAR

SEQ ID NO: 13530 - protein, 10 aa, Mycobacterium tuberculosis
AMYQSVSARA

SEQ ID NO: 13531 - protein, 10 aa, Mycobacterium tuberculosis
MYQSVSARAA

SEQ ID NO: 13532 - protein, 10 aa, Mycobacterium tuberculosis
YQSVSARAAA

SEQ ID NO: 13533 - protein, 10 aa, Mycobacterium tuberculosis
QSVSARAAAI

SEQ ID NO: 13534 - protein, 10 aa, Mycobacterium tuberculosis
SVSARAAAIH

SEQ ID NO: 13535 - protein, 10 aa, Mycobacterium tuberculosis
VSARAAAIHD

SEQ ID NO: 13536 - protein, 10 aa, Mycobacterium tuberculosis
SARAAAIHDQ

SEQ ID NO: 13537 - protein, 10 aa, Mycobacterium tuberculosis
ARAAAIHDQF

SEQ ID NO: 13538 - protein, 10 aa, Mycobacterium tuberculosis
RAAAIHDQFV

SEQ ID NO: 13539 - protein, 10 aa, Mycobacterium tuberculosis
AAAIHDQFVA

SEQ ID NO: 13540 - protein, 10 aa, Mycobacterium tuberculosis
AAIHDQFVAT

SEQ ID NO: 13541 - protein, 10 aa, Mycobacterium tuberculosis
AIHDQFVATL

SEQ ID NO: 13542 - protein, 10 aa, Mycobacterium tuberculosis
IHDQFVATLA

SEQ ID NO: 13543 - protein, 10 aa, Mycobacterium tuberculosis
HDQFVATLAS

SEQ ID NO: 13544 - protein, 10 aa, Mycobacterium tuberculosis
DQFVATLASS

SEQ ID NO: 13545 - protein, 10 aa, Mycobacterium tuberculosis
QFVATLASSA

SEQ ID NO: 13546 - protein, 10 aa, Mycobacterium tuberculosis
FVATLASSAS

SEQ ID NO: 13547 - protein, 10 aa, Mycobacterium tuberculosis
VATLASSASS

SEQ ID NO: 13548 - protein, 10 aa, Mycobacterium tuberculosis
ATLASSASSY

SEQ ID NO: 13549 - protein, 10 aa, Mycobacterium tuberculosis
TLASSASSYA

SEQ ID NO: 13550 - protein, 10 aa, Mycobacterium tuberculosis
LASSASSYAA

SEQ ID NO: 13551 - protein, 10 aa, Mycobacterium tuberculosis
ASSASSYAAT

SEQ ID NO: 13552 - protein, 10 aa, Mycobacterium tuberculosis
SSASSYAATE

SEQ ID NO: 13553 - protein, 10 aa, Mycobacterium tuberculosis
SASSYAATEV

SEQ ID NO: 13554 - protein, 10 aa, Mycobacterium tuberculosis
ASSYAATEVA

SEQ ID NO: 13555 - protein, 10 aa, Mycobacterium tuberculosis
SSYAATEVAN

SEQ ID NO: 13556 - protein, 10 aa, Mycobacterium tuberculosis
SYAATEVANA

SEQ ID NO: 13557 - protein, 10 aa, Mycobacterium tuberculosis
YAATEVANAA

SEQ ID NO: 13558 - protein, 10 aa, Mycobacterium tuberculosis
AATEVANAAA

SEQ ID NO: 13559 - protein, 10 aa, Mycobacterium tuberculosis
ATEVANAAAA

SEQ ID NO: 13560 - protein, 10 aa, Mycobacterium tuberculosis
TEVANAAAAS

SEQ ID NO: 13561 - protein, 11 aa, Mycobacterium tuberculosis
MSFVMAYPEML

SEQ ID NO: 13562 - protein, 11 aa, Mycobacterium tuberculosis
SFVMAYPEMLA

SEQ ID NO: 13563 - protein, 11 aa, Mycobacterium tuberculosis
FVMAYPEMLAA

SEQ ID NO: 13564 - protein, 11 aa, Mycobacterium tuberculosis
VMAYPEMLAAA

SEQ ID NO: 13565 - protein, 11 aa, Mycobacterium tuberculosis
MAYPEMLAAAA

SEQ ID NO: 13566 - protein, 11 aa, Mycobacterium tuberculosis
AYPEMLAAAAD

SEQ ID NO: 13567 - protein, 11 aa, Mycobacterium tuberculosis
YPEMLAAAADT

SEQ ID NO: 13568 - protein, 11 aa, Mycobacterium tuberculosis
PEMLAAAADTL

SEQ ID NO: 13569 - protein, 11 aa, Mycobacterium tuberculosis
EMLAAAADTLQ

SEQ ID NO: 13570 - protein, 11 aa, Mycobacterium tuberculosis
MLAAAADTLQS

SEQ ID NO: 13571 - protein, 11 aa, Mycobacterium tuberculosis
LAAAADTLQSI

SEQ ID NO: 13572 - protein, 11 aa, Mycobacterium tuberculosis
AAAADTLQSIG

SEQ ID NO: 13573 - protein, 11 aa, Mycobacterium tuberculosis
AAADTLQSIGA

SEQ ID NO: 13574 - protein, 11 aa, Mycobacterium tuberculosis
AADTLQSIGAT

SEQ ID NO: 13575 - protein, 11 aa, Mycobacterium tuberculosis
ADTLQSIGATT

SEQ ID NO: 13576 - protein, 11 aa, Mycobacterium tuberculosis
DTLQSIGATTV

SEQ ID NO: 13577 - protein, 11 aa, Mycobacterium tuberculosis
TLQSIGATTVA

SEQ ID NO: 13578 - protein, 11 aa, Mycobacterium tuberculosis
LQSIGATTVAS

SEQ ID NO: 13579 - protein, 11 aa, Mycobacterium tuberculosis
QSIGATTVASN

SEQ ID NO: 13580 - protein, 11 aa, Mycobacterium tuberculosis
SIGATTVASNA

SEQ ID NO: 13581 - protein, 11 aa, Mycobacterium tuberculosis
IGATTVASNAA

SEQ ID NO: 13582 - protein, 11 aa, Mycobacterium tuberculosis
GATTVASNAAA

SEQ ID NO: 13583 - protein, 11 aa, Mycobacterium tuberculosis
ATTVASNAAAA

SEQ ID NO: 13584 - protein, 11 aa, Mycobacterium tuberculosis
TTVASNAAAAA

SEQ ID NO: 13585 - protein, 11 aa, Mycobacterium tuberculosis
TVASNAAAAAP

SEQ ID NO: 13586 - protein, 11 aa, Mycobacterium tuberculosis
VASNAAAAAPT

SEQ ID NO: 13587 - protein, 11 aa, Mycobacterium tuberculosis
ASNAAAAAPTT

SEQ ID NO: 13588 - protein, 11 aa, Mycobacterium tuberculosis
SNAAAAAPTTG

SEQ ID NO: 13589 - protein, 11 aa, Mycobacterium tuberculosis
NAAAAAPTTGV

SEQ ID NO: 13590 - protein, 11 aa, Mycobacterium tuberculosis
AAAAAPTTGVV

SEQ ID NO: 13591 - protein, 11 aa, Mycobacterium tuberculosis
AAAAPTTGVVP

SEQ ID NO: 13592 - protein, 11 aa, Mycobacterium tuberculosis
AAAPTTGVVPP

SEQ ID NO: 13593 - protein, 11 aa, Mycobacterium tuberculosis
AAPTTGVVPPA

SEQ ID NO: 13594 - protein, 11 aa, Mycobacterium tuberculosis
APTTGVVPPAA

SEQ ID NO: 13595 - protein, 11 aa, Mycobacterium tuberculosis
PTTGVVPPAAD

SEQ ID NO: 13596 - protein, 11 aa, Mycobacterium tuberculosis
TTGVVPPAADE

SEQ ID NO: 13597 - protein, 11 aa, Mycobacterium tuberculosis
TGVVPPAADEV

SEQ ID NO: 13598 - protein, 11 aa, Mycobacterium tuberculosis
GVVPPAADEVS

SEQ ID NO: 13599 - protein, 11 aa, Mycobacterium tuberculosis
VVPPAADEVSA

SEQ ID NO: 13600 - protein, 11 aa, Mycobacterium tuberculosis
VPPAADEVSAL

SEQ ID NO: 13601 - protein, 11 aa, Mycobacterium tuberculosis
PPAADEVSALT

SEQ ID NO: 13602 - protein, 11 aa, Mycobacterium tuberculosis
PAADEVSALTA

SEQ ID NO: 13603 - protein, 11 aa, Mycobacterium tuberculosis
AADEVSALTAA

SEQ ID NO: 13604 - protein, 11 aa, Mycobacterium tuberculosis
ADEVSALTAAH

SEQ ID NO: 13605 - protein, 11 aa, Mycobacterium tuberculosis
DEVSALTAAHF

SEQ ID NO: 13606 - protein, 11 aa, Mycobacterium tuberculosis
EVSALTAAHFA

SEQ ID NO: 13607 - protein, 11 aa, Mycobacterium tuberculosis
VSALTAAHFAA

SEQ ID NO: 13608 - protein, 11 aa, Mycobacterium tuberculosis
SALTAAHFAAH

SEQ ID NO: 13609 - protein, 11 aa, Mycobacterium tuberculosis
ALTAAHFAAHA

SEQ ID NO: 13610 - protein, 11 aa, Mycobacterium tuberculosis
LTAAHFAAHAA

SEQ ID NO: 13611 - protein, 11 aa, Mycobacterium tuberculosis
TAAHFAAHAAM

SEQ ID NO: 13612 - protein, 11 aa, Mycobacterium tuberculosis
AAHFAAHAAMY

SEQ ID NO: 13613 - protein, 11 aa, Mycobacterium tuberculosis
AHFAAHAAMYQ

SEQ ID NO: 13614 - protein, 11 aa, Mycobacterium tuberculosis
HFAAHAAMYQS

SEQ ID NO: 13615 - protein, 11 aa, Mycobacterium tuberculosis
FAAHAAMYQSV

SEQ ID NO: 13616 - protein, 11 aa, Mycobacterium tuberculosis
AAHAAMYQSVS

SEQ ID NO: 13617 - protein, 11 aa, Mycobacterium tuberculosis
AHAAMYQSVSA

SEQ ID NO: 13618 - protein, 11 aa, Mycobacterium tuberculosis
HAAMYQSVSAR

SEQ ID NO: 13619 - protein, 11 aa, Mycobacterium tuberculosis
AAMYQSVSARA

SEQ ID NO: 13620 - protein, 11 aa, Mycobacterium tuberculosis
AMYQSVSARAA

SEQ ID NO: 13621 - protein, 11 aa, Mycobacterium tuberculosis
MYQSVSARAAA

SEQ ID NO: 13622 - protein, 11 aa, Mycobacterium tuberculosis
YQSVSARAAAI

SEQ ID NO: 13623 - protein, 11 aa, Mycobacterium tuberculosis
QSVSARAAAIH

SEQ ID NO: 13624 - protein, 11 aa, Mycobacterium tuberculosis
SVSARAAAIHD

SEQ ID NO: 13625 - protein, 11 aa, Mycobacterium tuberculosis
VSARAAAIHDQ

SEQ ID NO: 13626 - protein, 11 aa, Mycobacterium tuberculosis
SARAAAIHDQF

SEQ ID NO: 13627 - protein, 11 aa, Mycobacterium tuberculosis
ARAAAIHDQFV

SEQ ID NO: 13628 - protein, 11 aa, Mycobacterium tuberculosis
RAAAIHDQFVA

SEQ ID NO: 13629 - protein, 11 aa, Mycobacterium tuberculosis
AAAIHDQFVAT

SEQ ID NO: 13630 - protein, 11 aa, Mycobacterium tuberculosis
AAIHDQFVATL

SEQ ID NO: 13631 - protein, 11 aa, Mycobacterium tuberculosis
AIHDQFVATLA

SEQ ID NO: 13632 - protein, 11 aa, Mycobacterium tuberculosis
IHDQFVATLAS

SEQ ID NO: 13633 - protein, 11 aa, Mycobacterium tuberculosis
HDQFVATLASS

SEQ ID NO: 13634 - protein, 11 aa, Mycobacterium tuberculosis
DQFVATLASSA

SEQ ID NO: 13635 - protein, 11 aa, Mycobacterium tuberculosis
QFVATLASSAS

SEQ ID NO: 13636 - protein, 11 aa, Mycobacterium tuberculosis
FVATLASSASS

SEQ ID NO: 13637 - protein, 11 aa, Mycobacterium tuberculosis
VATLASSASSY

SEQ ID NO: 13638 - protein, 11 aa, Mycobacterium tuberculosis
ATLASSASSYA

SEQ ID NO: 13639 - protein, 11 aa, Mycobacterium tuberculosis
TLASSASSYAA

SEQ ID NO: 13640 - protein, 11 aa, Mycobacterium tuberculosis
LASSASSYAAT

SEQ ID NO: 13641 - protein, 11 aa, Mycobacterium tuberculosis
ASSASSYAATE

SEQ ID NO: 13642 - protein, 11 aa, Mycobacterium tuberculosis
SSASSYAATEV

SEQ ID NO: 13643 - protein, 11 aa, Mycobacterium tuberculosis
SASSYAATEVA

SEQ ID NO: 13644 - protein, 11 aa, Mycobacterium tuberculosis
ASSYAATEVAN

SEQ ID NO: 13645 - protein, 11 aa, Mycobacterium tuberculosis
SSYAATEVANA

SEQ ID NO: 13646 - protein, 11 aa, Mycobacterium tuberculosis
SYAATEVANAA

SEQ ID NO: 13647 - protein, 11 aa, Mycobacterium tuberculosis
YAATEVANAAA

SEQ ID NO: 13648 - protein, 11 aa, Mycobacterium tuberculosis
AATEVANAAAA

SEQ ID NO: 13649 - protein, 11 aa, Mycobacterium tuberculosis
ATEVANAAAAS

SEQ ID NO: 13650 - protein, 8 aa, Mycobacterium tuberculosis
MASRFMTD

SEQ ID NO: 13651 - protein, 8 aa, Mycobacterium tuberculosis
ASRFMTDP

SEQ ID NO: 13652 - protein, 8 aa, Mycobacterium tuberculosis
SRFMTDPH

SEQ ID NO: 13653 - protein, 8 aa, Mycobacterium tuberculosis
RFMTDPHA

SEQ ID NO: 13654 - protein, 8 aa, Mycobacterium tuberculosis
FMTDPHAM

SEQ ID NO: 13655 - protein, 8 aa, Mycobacterium tuberculosis
MTDPHAMR

SEQ ID NO: 13656 - protein, 8 aa, Mycobacterium tuberculosis
TDPHAMRD

SEQ ID NO: 13657 - protein, 8 aa, Mycobacterium tuberculosis
DPHAMRDM

SEQ ID NO: 13658 - protein, 8 aa, Mycobacterium tuberculosis
PHAMRDMA

SEQ ID NO: 13659 - protein, 8 aa, Mycobacterium tuberculosis
HAMRDMAG

SEQ ID NO: 13660 - protein, 8 aa, Mycobacterium tuberculosis
AMRDMAGR

SEQ ID NO: 13661 - protein, 8 aa, Mycobacterium tuberculosis
MRDMAGRF

SEQ ID NO: 13662 - protein, 8 aa, Mycobacterium tuberculosis
RDMAGRFE

SEQ ID NO: 13663 - protein, 8 aa, Mycobacterium tuberculosis
DMAGRFEV

SEQ ID NO: 13664 - protein, 8 aa, Mycobacterium tuberculosis
MAGRFEVH

SEQ ID NO: 13665 - protein, 8 aa, Mycobacterium tuberculosis
AGRFEVHA

SEQ ID NO: 13666 - protein, 8 aa, Mycobacterium tuberculosis
GRFEVHAQ

SEQ ID NO: 13667 - protein, 8 aa, Mycobacterium tuberculosis
RFEVHAQT

SEQ ID NO: 13668 - protein, 8 aa, Mycobacterium tuberculosis
FEVHAQTV

SEQ ID NO: 13669 - protein, 8 aa, Mycobacterium tuberculosis
EVHAQTVE

SEQ ID NO: 13670 - protein, 8 aa, Mycobacterium tuberculosis
VHAQTVED

SEQ ID NO: 13671 - protein, 8 aa, Mycobacterium tuberculosis
HAQTVEDE

SEQ ID NO: 13672 - protein, 8 aa, Mycobacterium tuberculosis
AQTVEDEA

SEQ ID NO: 13673 - protein, 8 aa, Mycobacterium tuberculosis
QTVEDEAR

SEQ ID NO: 13674 - protein, 8 aa, Mycobacterium tuberculosis
TVEDEARR

SEQ ID NO: 13675 - protein, 8 aa, Mycobacterium tuberculosis
VEDEARRM

SEQ ID NO: 13676 - protein, 8 aa, Mycobacterium tuberculosis
EDEARRMW

SEQ ID NO: 13677 - protein, 8 aa, Mycobacterium tuberculosis
DEARRMWA

SEQ ID NO: 13678 - protein, 8 aa, Mycobacterium tuberculosis
EARRMWAS

SEQ ID NO: 13679 - protein, 8 aa, Mycobacterium tuberculosis
ARRMWASA

SEQ ID NO: 13680 - protein, 8 aa, Mycobacterium tuberculosis
RRMWASAQ

SEQ ID NO: 13681 - protein, 8 aa, Mycobacterium tuberculosis
RMWASAQN

SEQ ID NO: 13682 - protein, 8 aa, Mycobacterium tuberculosis
MWASAQNI

SEQ ID NO: 13683 - protein, 8 aa, Mycobacterium tuberculosis
WASAQNIS

SEQ ID NO: 13684 - protein, 8 aa, Mycobacterium tuberculosis
ASAQNISG

SEQ ID NO: 13685 - protein, 8 aa, Mycobacterium tuberculosis
SAQNISGA

SEQ ID NO: 13686 - protein, 8 aa, Mycobacterium tuberculosis
AQNISGAG

SEQ ID NO: 13687 - protein, 8 aa, Mycobacterium tuberculosis
QNISGAGW

SEQ ID NO: 13688 - protein, 8 aa, Mycobacterium tuberculosis
NISGAGWS

SEQ ID NO: 13689 - protein, 8 aa, Mycobacterium tuberculosis
ISGAGWSG

SEQ ID NO: 13690 - protein, 8 aa, Mycobacterium tuberculosis
SGAGWSGM

SEQ ID NO: 13691 - protein, 8 aa, Mycobacterium tuberculosis
GAGWSGMA

SEQ ID NO: 13692 - protein, 8 aa, Mycobacterium tuberculosis
AGWSGMAE

SEQ ID NO: 13693 - protein, 8 aa, Mycobacterium tuberculosis
GWSGMAEA

SEQ ID NO: 13694 - protein, 8 aa, Mycobacterium tuberculosis
WSGMAEAT

SEQ ID NO: 13695 - protein, 8 aa, Mycobacterium tuberculosis
SGMAEATS

SEQ ID NO: 13696 - protein, 8 aa, Mycobacterium tuberculosis
GMAEATSL

SEQ ID NO: 13697 - protein, 8 aa, Mycobacterium tuberculosis
MAEATSLD

SEQ ID NO: 13698 - protein, 8 aa, Mycobacterium tuberculosis
AEATSLDT

SEQ ID NO: 13699 - protein, 8 aa, Mycobacterium tuberculosis
EATSLDTM

SEQ ID NO: 13700 - protein, 8 aa, Mycobacterium tuberculosis
ATSLDTMA

SEQ ID NO: 13701 - protein, 8 aa, Mycobacterium tuberculosis
TSLDTMAQ

SEQ ID NO: 13702 - protein, 8 aa, Mycobacterium tuberculosis
SLDTMAQM

SEQ ID NO: 13703 - protein, 8 aa, Mycobacterium tuberculosis
LDTMAQMN

SEQ ID NO: 13704 - protein, 8 aa, Mycobacterium tuberculosis
DTMAQMNQ

SEQ ID NO: 13705 - protein, 8 aa, Mycobacterium tuberculosis
TMAQMNQA

SEQ ID NO: 13706 - protein, 8 aa, Mycobacterium tuberculosis
MAQMNQAF

SEQ ID NO: 13707 - protein, 8 aa, Mycobacterium tuberculosis
AQMNQAFR

SEQ ID NO: 13708 - protein, 8 aa, Mycobacterium tuberculosis
QMNQAFRN

SEQ ID NO: 13709 - protein, 8 aa, Mycobacterium tuberculosis
MNQAFRNI

SEQ ID NO: 13710 - protein, 8 aa, Mycobacterium tuberculosis
NQAFRNIV

SEQ ID NO: 13711 - protein, 8 aa, Mycobacterium tuberculosis
QAFRNIVN

SEQ ID NO: 13712 - protein, 8 aa, Mycobacterium tuberculosis
AFRNIVNM

SEQ ID NO: 13713 - protein, 8 aa, Mycobacterium tuberculosis
FRNIVNML

SEQ ID NO: 13714 - protein, 8 aa, Mycobacterium tuberculosis
RNIVNMLH

SEQ ID NO: 13715 - protein, 8 aa, Mycobacterium tuberculosis
NIVNMLHG

SEQ ID NO: 13716 - protein, 8 aa, Mycobacterium tuberculosis
IVNMLHGV

SEQ ID NO: 13717 - protein, 8 aa, Mycobacterium tuberculosis
VNMLHGVR

SEQ ID NO: 13718 - protein, 8 aa, Mycobacterium tuberculosis
NMLHGVRD

SEQ ID NO: 13719 - protein, 8 aa, Mycobacterium tuberculosis
MLHGVRDG

SEQ ID NO: 13720 - protein, 8 aa, Mycobacterium tuberculosis
LHGVRDGL

SEQ ID NO: 13721 - protein, 8 aa, Mycobacterium tuberculosis
HGVRDGLV

SEQ ID NO: 13722 - protein, 8 aa, Mycobacterium tuberculosis
GVRDGLVR

SEQ ID NO: 13723 - protein, 8 aa, Mycobacterium tuberculosis
VRDGLVRD

SEQ ID NO: 13724 - protein, 8 aa, Mycobacterium tuberculosis
RDGLVRDA

SEQ ID NO: 13725 - protein, 8 aa, Mycobacterium tuberculosis
DGLVRDAN

SEQ ID NO: 13726 - protein, 8 aa, Mycobacterium tuberculosis
GLVRDANN

SEQ ID NO: 13727 - protein, 8 aa, Mycobacterium tuberculosis
LVRDANNY

SEQ ID NO: 13728 - protein, 8 aa, Mycobacterium tuberculosis
VRDANNYE

SEQ ID NO: 13729 - protein, 8 aa, Mycobacterium tuberculosis
RDANNYEQ

SEQ ID NO: 13730 - protein, 8 aa, Mycobacterium tuberculosis
DANNYEQQ

SEQ ID NO: 13731 - protein, 8 aa, Mycobacterium tuberculosis
ANNYEQQE

SEQ ID NO: 13732 - protein, 8 aa, Mycobacterium tuberculosis
NNYEQQEQ

SEQ ID NO: 13733 - protein, 8 aa, Mycobacterium tuberculosis
NYEQQEQA

SEQ ID NO: 13734 - protein, 8 aa, Mycobacterium tuberculosis
YEQQEQAS

SEQ ID NO: 13735 - protein, 8 aa, Mycobacterium tuberculosis
EQQEQASQ

SEQ ID NO: 13736 - protein, 8 aa, Mycobacterium tuberculosis
QQEQASQQ

SEQ ID NO: 13737 - protein, 8 aa, Mycobacterium tuberculosis
QEQASQQI

SEQ ID NO: 13738 - protein, 8 aa, Mycobacterium tuberculosis
EQASQQIL

SEQ ID NO: 13739 - protein, 8 aa, Mycobacterium tuberculosis
QASQQILS

SEQ ID NO: 13740 - protein, 8 aa, Mycobacterium tuberculosis
ASQQILSS

SEQ ID NO: 13741 - protein, 9 aa, Mycobacterium tuberculosis
MASRFMTDP

SEQ ID NO: 13742 - protein, 9 aa, Mycobacterium tuberculosis
ASRFMTDPH

SEQ ID NO: 13743 - protein, 9 aa, Mycobacterium tuberculosis
SRFMTDPHA

SEQ ID NO: 13744 - protein, 9 aa, Mycobacterium tuberculosis
RFMTDPHAM

SEQ ID NO: 13745 - protein, 9 aa, Mycobacterium tuberculosis
FMTDPHAMR

SEQ ID NO: 13746 - protein, 9 aa, Mycobacterium tuberculosis
MTDPHAMRD

SEQ ID NO: 13747 - protein, 9 aa, Mycobacterium tuberculosis
TDPHAMRDM

SEQ ID NO: 13748 - protein, 9 aa, Mycobacterium tuberculosis
DPHAMRDMA

SEQ ID NO: 13749 - protein, 9 aa, Mycobacterium tuberculosis
PHAMRDMAG

SEQ ID NO: 13750 - protein, 9 aa, Mycobacterium tuberculosis
HAMRDMAGR

SEQ ID NO: 13751 - protein, 9 aa, Mycobacterium tuberculosis
AMRDMAGRF

SEQ ID NO: 13752 - protein, 9 aa, Mycobacterium tuberculosis
MRDMAGRFE

SEQ ID NO: 13753 - protein, 9 aa, Mycobacterium tuberculosis
RDMAGRFEV

SEQ ID NO: 13754 - protein, 9 aa, Mycobacterium tuberculosis
DMAGRFEVH

SEQ ID NO: 13755 - protein, 9 aa, Mycobacterium tuberculosis
MAGRFEVHA

SEQ ID NO: 13756 - protein, 9 aa, Mycobacterium tuberculosis
AGRFEVHAQ

SEQ ID NO: 13757 - protein, 9 aa, Mycobacterium tuberculosis
GRFEVHAQT

SEQ ID NO: 13758 - protein, 9 aa, Mycobacterium tuberculosis
RFEVHAQTV

SEQ ID NO: 13759 - protein, 9 aa, Mycobacterium tuberculosis
FEVHAQTVE

SEQ ID NO: 13760 - protein, 9 aa, Mycobacterium tuberculosis
EVHAQTVED

SEQ ID NO: 13761 - protein, 9 aa, Mycobacterium tuberculosis
VHAQTVEDE

SEQ ID NO: 13762 - protein, 9 aa, Mycobacterium tuberculosis
HAQTVEDEA

SEQ ID NO: 13763 - protein, 9 aa, Mycobacterium tuberculosis
AQTVEDEAR

SEQ ID NO: 13764 - protein, 9 aa, Mycobacterium tuberculosis
QTVEDEARR

SEQ ID NO: 13765 - protein, 9 aa, Mycobacterium tuberculosis
TVEDEARRM

SEQ ID NO: 13766 - protein, 9 aa, Mycobacterium tuberculosis
VEDEARRMW

SEQ ID NO: 13767 - protein, 9 aa, Mycobacterium tuberculosis
EDEARRMWA

SEQ ID NO: 13768 - protein, 9 aa, Mycobacterium tuberculosis
DEARRMWAS

SEQ ID NO: 13769 - protein, 9 aa, Mycobacterium tuberculosis
EARRMWASA

SEQ ID NO: 13770 - protein, 9 aa, Mycobacterium tuberculosis
ARRMWASAQ

SEQ ID NO: 13771 - protein, 9 aa, Mycobacterium tuberculosis
RRMWASAQN

SEQ ID NO: 13772 - protein, 9 aa, Mycobacterium tuberculosis
RMWASAQNI

SEQ ID NO: 13773 - protein, 9 aa, Mycobacterium tuberculosis
MWASAQNIS

SEQ ID NO: 13774 - protein, 9 aa, Mycobacterium tuberculosis
WASAQNISG

SEQ ID NO: 13775 - protein, 9 aa, Mycobacterium tuberculosis
ASAQNISGA

SEQ ID NO: 13776 - protein, 9 aa, Mycobacterium tuberculosis
SAQNISGAG

SEQ ID NO: 13777 - protein, 9 aa, Mycobacterium tuberculosis
AQNISGAGW

SEQ ID NO: 13778 - protein, 9 aa, Mycobacterium tuberculosis
QNISGAGWS

SEQ ID NO: 13779 - protein, 9 aa, Mycobacterium tuberculosis
NISGAGWSG

SEQ ID NO: 13780 - protein, 9 aa, Mycobacterium tuberculosis
ISGAGWSGM

SEQ ID NO: 13781 - protein, 9 aa, Mycobacterium tuberculosis
SGAGWSGMA

SEQ ID NO: 13782 - protein, 9 aa, Mycobacterium tuberculosis
GAGWSGMAE

SEQ ID NO: 13783 - protein, 9 aa, Mycobacterium tuberculosis
AGWSGMAEA

SEQ ID NO: 13784 - protein, 9 aa, Mycobacterium tuberculosis
GWSGMAEAT

SEQ ID NO: 13785 - protein, 9 aa, Mycobacterium tuberculosis
WSGMAEATS

SEQ ID NO: 13786 - protein, 9 aa, Mycobacterium tuberculosis
SGMAEATSL

SEQ ID NO: 13787 - protein, 9 aa, Mycobacterium tuberculosis
GMAEATSLD

SEQ ID NO: 13788 - protein, 9 aa, Mycobacterium tuberculosis
MAEATSLDT

SEQ ID NO: 13789 - protein, 9 aa, Mycobacterium tuberculosis
AEATSLDTM

SEQ ID NO: 13790 - protein, 9 aa, Mycobacterium tuberculosis
EATSLDTMA

SEQ ID NO: 13791 - protein, 9 aa, Mycobacterium tuberculosis
ATSLDTMAQ

SEQ ID NO: 13792 - protein, 9 aa, Mycobacterium tuberculosis
TSLDTMAQM

SEQ ID NO: 13793 - protein, 9 aa, Mycobacterium tuberculosis
SLDTMAQMN

SEQ ID NO: 13794 - protein, 9 aa, Mycobacterium tuberculosis
LDTMAQMNQ

SEQ ID NO: 13795 - protein, 9 aa, Mycobacterium tuberculosis
DTMAQMNQA

SEQ ID NO: 13796 - protein, 9 aa, Mycobacterium tuberculosis
TMAQMNQAF

SEQ ID NO: 13797 - protein, 9 aa, Mycobacterium tuberculosis
MAQMNQAFR

SEQ ID NO: 13798 - protein, 9 aa, Mycobacterium tuberculosis
AQMNQAFRN

SEQ ID NO: 13799 - protein, 9 aa, Mycobacterium tuberculosis
QMNQAFRNI

SEQ ID NO: 13800 - protein, 9 aa, Mycobacterium tuberculosis
MNQAFRNIV

SEQ ID NO: 13801 - protein, 9 aa, Mycobacterium tuberculosis
NQAFRNIVN

SEQ ID NO: 13802 - protein, 9 aa, Mycobacterium tuberculosis
QAFRNIVNM

SEQ ID NO: 13803 - protein, 9 aa, Mycobacterium tuberculosis
AFRNIVNML

SEQ ID NO: 13804 - protein, 9 aa, Mycobacterium tuberculosis
FRNIVNMLH

SEQ ID NO: 13805 - protein, 9 aa, Mycobacterium tuberculosis
RNIVNMLHG

SEQ ID NO: 13806 - protein, 9 aa, Mycobacterium tuberculosis
NIVNMLHGV

SEQ ID NO: 13807 - protein, 9 aa, Mycobacterium tuberculosis
IVNMLHGVR

SEQ ID NO: 13808 - protein, 9 aa, Mycobacterium tuberculosis
VNMLHGVRD

SEQ ID NO: 13809 - protein, 9 aa, Mycobacterium tuberculosis
NMLHGVRDG

SEQ ID NO: 13810 - protein, 9 aa, Mycobacterium tuberculosis
MLHGVRDGL

SEQ ID NO: 13811 - protein, 9 aa, Mycobacterium tuberculosis
LHGVRDGLV

SEQ ID NO: 13812 - protein, 9 aa, Mycobacterium tuberculosis
HGVRDGLVR

SEQ ID NO: 13813 - protein, 9 aa, Mycobacterium tuberculosis
GVRDGLVRD

SEQ ID NO: 13814 - protein, 9 aa, Mycobacterium tuberculosis
VRDGLVRDA

SEQ ID NO: 13815 - protein, 9 aa, Mycobacterium tuberculosis
RDGLVRDAN

SEQ ID NO: 13816 - protein, 9 aa, Mycobacterium tuberculosis
DGLVRDANN

SEQ ID NO: 13817 - protein, 9 aa, Mycobacterium tuberculosis
GLVRDANNY

SEQ ID NO: 13818 - protein, 9 aa, Mycobacterium tuberculosis
LVRDANNYE

SEQ ID NO: 13819 - protein, 9 aa, Mycobacterium tuberculosis
VRDANNYEQ

SEQ ID NO: 13820 - protein, 9 aa, Mycobacterium tuberculosis
RDANNYEQQ

SEQ ID NO: 13821 - protein, 9 aa, Mycobacterium tuberculosis
DANNYEQQE

SEQ ID NO: 13822 - protein, 9 aa, Mycobacterium tuberculosis
ANNYEQQEQ

SEQ ID NO: 13823 - protein, 9 aa, Mycobacterium tuberculosis
NNYEQQEQA

SEQ ID NO: 13824 - protein, 9 aa, Mycobacterium tuberculosis
NYEQQEQAS

SEQ ID NO: 13825 - protein, 9 aa, Mycobacterium tuberculosis
YEQQEQASQ

SEQ ID NO: 13826 - protein, 9 aa, Mycobacterium tuberculosis
EQQEQASQQ

SEQ ID NO: 13827 - protein, 9 aa, Mycobacterium tuberculosis
QQEQASQQI

SEQ ID NO: 13828 - protein, 9 aa, Mycobacterium tuberculosis
QEQASQQIL

SEQ ID NO: 13829 - protein, 9 aa, Mycobacterium tuberculosis
EQASQQILS

SEQ ID NO: 13830 - protein, 9 aa, Mycobacterium tuberculosis
QASQQILSS

SEQ ID NO: 13831 - protein, 10 aa, Mycobacterium tuberculosis
MASRFMTDPH

SEQ ID NO: 13832 - protein, 10 aa, Mycobacterium tuberculosis
ASRFMTDPHA

SEQ ID NO: 13833 - protein, 10 aa, Mycobacterium tuberculosis
SRFMTDPHAM

SEQ ID NO: 13834 - protein, 10 aa, Mycobacterium tuberculosis
RFMTDPHAMR

SEQ ID NO: 13835 - protein, 10 aa, Mycobacterium tuberculosis
FMTDPHAMRD

SEQ ID NO: 13836 - protein, 10 aa, Mycobacterium tuberculosis
MTDPHAMRDM

SEQ ID NO: 13837 - protein, 10 aa, Mycobacterium tuberculosis
TDPHAMRDMA

SEQ ID NO: 13838 - protein, 10 aa, Mycobacterium tuberculosis
DPHAMRDMAG

SEQ ID NO: 13839 - protein, 10 aa, Mycobacterium tuberculosis
PHAMRDMAGR

SEQ ID NO: 13840 - protein, 10 aa, Mycobacterium tuberculosis
HAMRDMAGRF

SEQ ID NO: 13841 - protein, 10 aa, Mycobacterium tuberculosis
AMRDMAGRFE

SEQ ID NO: 13842 - protein, 10 aa, Mycobacterium tuberculosis
MRDMAGRFEV

SEQ ID NO: 13843 - protein, 10 aa, Mycobacterium tuberculosis
RDMAGRFEVH

SEQ ID NO: 13844 - protein, 10 aa, Mycobacterium tuberculosis
DMAGRFEVHA

SEQ ID NO: 13845 - protein, 10 aa, Mycobacterium tuberculosis
MAGRFEVHAQ

SEQ ID NO: 13846 - protein, 10 aa, Mycobacterium tuberculosis
AGRFEVHAQT

SEQ ID NO: 13847 - protein, 10 aa, Mycobacterium tuberculosis
GRFEVHAQTV

SEQ ID NO: 13848 - protein, 10 aa, Mycobacterium tuberculosis
RFEVHAQTVE

SEQ ID NO: 13849 - protein, 10 aa, Mycobacterium tuberculosis
FEVHAQTVED

SEQ ID NO: 13850 - protein, 10 aa, Mycobacterium tuberculosis
EVHAQTVEDE

SEQ ID NO: 13851 - protein, 10 aa, Mycobacterium tuberculosis
VHAQTVEDEA

SEQ ID NO: 13852 - protein, 10 aa, Mycobacterium tuberculosis
HAQTVEDEAR

SEQ ID NO: 13853 - protein, 10 aa, Mycobacterium tuberculosis
AQTVEDEARR

SEQ ID NO: 13854 - protein, 10 aa, Mycobacterium tuberculosis
QTVEDEARRM

SEQ ID NO: 13855 - protein, 10 aa, Mycobacterium tuberculosis
TVEDEARRMW

SEQ ID NO: 13856 - protein, 10 aa, Mycobacterium tuberculosis
VEDEARRMWA

SEQ ID NO: 13857 - protein, 10 aa, Mycobacterium tuberculosis
EDEARRMWAS

SEQ ID NO: 13858 - protein, 10 aa, Mycobacterium tuberculosis
DEARRMWASA

SEQ ID NO: 13859 - protein, 10 aa, Mycobacterium tuberculosis
EARRMWASAQ

SEQ ID NO: 13860 - protein, 10 aa, Mycobacterium tuberculosis
ARRMWASAQN

SEQ ID NO: 13861 - protein, 10 aa, Mycobacterium tuberculosis
RRMWASAQNI

SEQ ID NO: 13862 - protein, 10 aa, Mycobacterium tuberculosis
RMWASAQNIS

SEQ ID NO: 13863 - protein, 10 aa, Mycobacterium tuberculosis
MWASAQNISG

SEQ ID NO: 13864 - protein, 10 aa, Mycobacterium tuberculosis
WASAQNISGA

SEQ ID NO: 13865 - protein, 10 aa, Mycobacterium tuberculosis
ASAQNISGAG

SEQ ID NO: 13866 - protein, 10 aa, Mycobacterium tuberculosis
SAQNISGAGW

SEQ ID NO: 13867 - protein, 10 aa, Mycobacterium tuberculosis
AQNISGAGWS

SEQ ID NO: 13868 - protein, 10 aa, Mycobacterium tuberculosis
QNISGAGWSG

SEQ ID NO: 13869 - protein, 10 aa, Mycobacterium tuberculosis
NISGAGWSGM

SEQ ID NO: 13870 - protein, 10 aa, Mycobacterium tuberculosis
ISGAGWSGMA

SEQ ID NO: 13871 - protein, 10 aa, Mycobacterium tuberculosis
SGAGWSGMAE

SEQ ID NO: 13872 - protein, 10 aa, Mycobacterium tuberculosis
GAGWSGMAEA

SEQ ID NO: 13873 - protein, 10 aa, Mycobacterium tuberculosis
AGWSGMAEAT

SEQ ID NO: 13874 - protein, 10 aa, Mycobacterium tuberculosis
GWSGMAEATS

SEQ ID NO: 13875 - protein, 10 aa, Mycobacterium tuberculosis
WSGMAEATSL

SEQ ID NO: 13876 - protein, 10 aa, Mycobacterium tuberculosis
SGMAEATSLD

SEQ ID NO: 13877 - protein, 10 aa, Mycobacterium tuberculosis
GMAEATSLDT

SEQ ID NO: 13878 - protein, 10 aa, Mycobacterium tuberculosis
MAEATSLDTM

SEQ ID NO: 13879 - protein, 10 aa, Mycobacterium tuberculosis
AEATSLDTMA

SEQ ID NO: 13880 - protein, 10 aa, Mycobacterium tuberculosis
EATSLDTMAQ

SEQ ID NO: 13881 - protein, 10 aa, Mycobacterium tuberculosis
ATSLDTMAQM

SEQ ID NO: 13882 - protein, 10 aa, Mycobacterium tuberculosis
TSLDTMAQMN

SEQ ID NO: 13883 - protein, 10 aa, Mycobacterium tuberculosis
SLDTMAQMNQ

SEQ ID NO: 13884 - protein, 10 aa, Mycobacterium tuberculosis
LDTMAQMNQA

SEQ ID NO: 13885 - protein, 10 aa, Mycobacterium tuberculosis
DTMAQMNQAF

SEQ ID NO: 13886 - protein, 10 aa, Mycobacterium tuberculosis
TMAQMNQAFR

SEQ ID NO: 13887 - protein, 10 aa, Mycobacterium tuberculosis
MAQMNQAFRN

SEQ ID NO: 13888 - protein, 10 aa, Mycobacterium tuberculosis
AQMNQAFRNI

SEQ ID NO: 13889 - protein, 10 aa, Mycobacterium tuberculosis
QMNQAFRNIV

SEQ ID NO: 13890 - protein, 10 aa, Mycobacterium tuberculosis
MNQAFRNIVN

SEQ ID NO: 13891 - protein, 10 aa, Mycobacterium tuberculosis
NQAFRNIVNM

SEQ ID NO: 13892 - protein, 10 aa, Mycobacterium tuberculosis
QAFRNIVNML

SEQ ID NO: 13893 - protein, 10 aa, Mycobacterium tuberculosis
AFRNIVNMLH

SEQ ID NO: 13894 - protein, 10 aa, Mycobacterium tuberculosis
FRNIVNMLHG

SEQ ID NO: 13895 - protein, 10 aa, Mycobacterium tuberculosis
RNIVNMLHGV

SEQ ID NO: 13896 - protein, 10 aa, Mycobacterium tuberculosis
NIVNMLHGVR

SEQ ID NO: 13897 - protein, 10 aa, Mycobacterium tuberculosis
IVNMLHGVRD

SEQ ID NO: 13898 - protein, 10 aa, Mycobacterium tuberculosis
VNMLHGVRDG

SEQ ID NO: 13899 - protein, 10 aa, Mycobacterium tuberculosis
NMLHGVRDGL

SEQ ID NO: 13900 - protein, 10 aa, Mycobacterium tuberculosis
MLHGVRDGLV

SEQ ID NO: 13901 - protein, 10 aa, Mycobacterium tuberculosis
LHGVRDGLVR

SEQ ID NO: 13902 - protein, 10 aa, Mycobacterium tuberculosis
HGVRDGLVRD

SEQ ID NO: 13903 - protein, 10 aa, Mycobacterium tuberculosis
GVRDGLVRDA

SEQ ID NO: 13904 - protein, 10 aa, Mycobacterium tuberculosis
VRDGLVRDAN

SEQ ID NO: 13905 - protein, 10 aa, Mycobacterium tuberculosis
RDGLVRDANN

SEQ ID NO: 13906 - protein, 10 aa, Mycobacterium tuberculosis
DGLVRDANNY

SEQ ID NO: 13907 - protein, 10 aa, Mycobacterium tuberculosis
GLVRDANNYE

SEQ ID NO: 13908 - protein, 10 aa, Mycobacterium tuberculosis
LVRDANNYEQ

SEQ ID NO: 13909 - protein, 10 aa, Mycobacterium tuberculosis
VRDANNYEQQ

SEQ ID NO: 13910 - protein, 10 aa, Mycobacterium tuberculosis
RDANNYEQQE

SEQ ID NO: 13911 - protein, 10 aa, Mycobacterium tuberculosis
DANNYEQQEQ

SEQ ID NO: 13912 - protein, 10 aa, Mycobacterium tuberculosis
ANNYEQQEQA

SEQ ID NO: 13913 - protein, 10 aa, Mycobacterium tuberculosis
NNYEQQEQAS

SEQ ID NO: 13914 - protein, 10 aa, Mycobacterium tuberculosis
NYEQQEQASQ

SEQ ID NO: 13915 - protein, 10 aa, Mycobacterium tuberculosis
YEQQEQASQQ

SEQ ID NO: 13916 - protein, 10 aa, Mycobacterium tuberculosis
EQQEQASQQI

SEQ ID NO: 13917 - protein, 10 aa, Mycobacterium tuberculosis
QQEQASQQIL

SEQ ID NO: 13918 - protein, 10 aa, Mycobacterium tuberculosis
QEQASQQILS

SEQ ID NO: 13919 - protein, 10 aa, Mycobacterium tuberculosis
EQASQQILSS

SEQ ID NO: 13920 - protein, 11 aa, Mycobacterium tuberculosis
MASRFMTDPHA

SEQ ID NO: 13921 - protein, 11 aa, Mycobacterium tuberculosis
ASRFMTDPHAM

SEQ ID NO: 13922 - protein, 11 aa, Mycobacterium tuberculosis
SRFMTDPHAMR

SEQ ID NO: 13923 - protein, 11 aa, Mycobacterium tuberculosis
RFMTDPHAMRD

SEQ ID NO: 13924 - protein, 11 aa, Mycobacterium tuberculosis
FMTDPHAMRDM

SEQ ID NO: 13925 - protein, 11 aa, Mycobacterium tuberculosis
MTDPHAMRDMA

SEQ ID NO: 13926 - protein, 11 aa, Mycobacterium tuberculosis
TDPHAMRDMAG

SEQ ID NO: 13927 - protein, 11 aa, Mycobacterium tuberculosis
DPHAMRDMAGR

SEQ ID NO: 13928 - protein, 11 aa, Mycobacterium tuberculosis
PHAMRDMAGRF

SEQ ID NO: 13929 - protein, 11 aa, Mycobacterium tuberculosis
HAMRDMAGRFE

SEQ ID NO: 13930 - protein, 11 aa, Mycobacterium tuberculosis
AMRDMAGRFEV

SEQ ID NO: 13931 - protein, 11 aa, Mycobacterium tuberculosis
MRDMAGRFEVH

SEQ ID NO: 13932 - protein, 11 aa, Mycobacterium tuberculosis
RDMAGRFEVHA

SEQ ID NO: 13933 - protein, 11 aa, Mycobacterium tuberculosis
DMAGRFEVHAQ

SEQ ID NO: 13934 - protein, 11 aa, Mycobacterium tuberculosis
MAGRFEVHAQT

SEQ ID NO: 13935 - protein, 11 aa, Mycobacterium tuberculosis
AGRFEVHAQTV

SEQ ID NO: 13936 - protein, 11 aa, Mycobacterium tuberculosis
GRFEVHAQTVE

SEQ ID NO: 13937 - protein, 11 aa, Mycobacterium tuberculosis
RFEVHAQTVED

SEQ ID NO: 13938 - protein, 11 aa, Mycobacterium tuberculosis
FEVHAQTVEDE

SEQ ID NO: 13939 - protein, 11 aa, Mycobacterium tuberculosis
EVHAQTVEDEA

SEQ ID NO: 13940 - protein, 11 aa, Mycobacterium tuberculosis
VHAQTVEDEAR

SEQ ID NO: 13941 - protein, 11 aa, Mycobacterium tuberculosis
HAQTVEDEARR

SEQ ID NO: 13942 - protein, 11 aa, Mycobacterium tuberculosis
AQTVEDEARRM

SEQ ID NO: 13943 - protein, 11 aa, Mycobacterium tuberculosis
QTVEDEARRMW

SEQ ID NO: 13944 - protein, 11 aa, Mycobacterium tuberculosis
TVEDEARRMWA

SEQ ID NO: 13945 - protein, 11 aa, Mycobacterium tuberculosis
VEDEARRMWAS

SEQ ID NO: 13946 - protein, 11 aa, Mycobacterium tuberculosis
EDEARRMWASA

SEQ ID NO: 13947 - protein, 11 aa, Mycobacterium tuberculosis
DEARRMWASAQ

SEQ ID NO: 13948 - protein, 11 aa, Mycobacterium tuberculosis
EARRMWASAQN

SEQ ID NO: 13949 - protein, 11 aa, Mycobacterium tuberculosis
ARRMWASAQNI

SEQ ID NO: 13950 - protein, 11 aa, Mycobacterium tuberculosis
RRMWASAQNIS

SEQ ID NO: 13951 - protein, 11 aa, Mycobacterium tuberculosis
RMWASAQNISG

SEQ ID NO: 13952 - protein, 11 aa, Mycobacterium tuberculosis
MWASAQNISGA

SEQ ID NO: 13953 - protein, 11 aa, Mycobacterium tuberculosis
WASAQNISGAG

SEQ ID NO: 13954 - protein, 11 aa, Mycobacterium tuberculosis
ASAQNISGAGW

SEQ ID NO: 13955 - protein, 11 aa, Mycobacterium tuberculosis
SAQNISGAGWS

SEQ ID NO: 13956 - protein, 11 aa, Mycobacterium tuberculosis
AQNISGAGWSG

SEQ ID NO: 13957 - protein, 11 aa, Mycobacterium tuberculosis
QNISGAGWSGM

SEQ ID NO: 13958 - protein, 11 aa, Mycobacterium tuberculosis
NISGAGWSGMA

SEQ ID NO: 13959 - protein, 11 aa, Mycobacterium tuberculosis
ISGAGWSGMAE

SEQ ID NO: 13960 - protein, 11 aa, Mycobacterium tuberculosis
SGAGWSGMAEA

SEQ ID NO: 13961 - protein, 11 aa, Mycobacterium tuberculosis
GAGWSGMAEAT

SEQ ID NO: 13962 - protein, 11 aa, Mycobacterium tuberculosis
AGWSGMAEATS

SEQ ID NO: 13963 - protein, 11 aa, Mycobacterium tuberculosis
GWSGMAEATSL

SEQ ID NO: 13964 - protein, 11 aa, Mycobacterium tuberculosis
WSGMAEATSLD

SEQ ID NO: 13965 - protein, 11 aa, Mycobacterium tuberculosis
SGMAEATSLDT

SEQ ID NO: 13966 - protein, 11 aa, Mycobacterium tuberculosis
GMAEATSLDTM

SEQ ID NO: 13967 - protein, 11 aa, Mycobacterium tuberculosis
MAEATSLDTMA

SEQ ID NO: 13968 - protein, 11 aa, Mycobacterium tuberculosis
AEATSLDTMAQ

SEQ ID NO: 13969 - protein, 11 aa, Mycobacterium tuberculosis
EATSLDTMAQM

SEQ ID NO: 13970 - protein, 11 aa, Mycobacterium tuberculosis
ATSLDTMAQMN

SEQ ID NO: 13971 - protein, 11 aa, Mycobacterium tuberculosis
TSLDTMAQMNQ

SEQ ID NO: 13972 - protein, 11 aa, Mycobacterium tuberculosis
SLDTMAQMNQA

SEQ ID NO: 13973 - protein, 11 aa, Mycobacterium tuberculosis
LDTMAQMNQAF

SEQ ID NO: 13974 - protein, 11 aa, Mycobacterium tuberculosis
DTMAQMNQAFR

SEQ ID NO: 13975 - protein, 11 aa, Mycobacterium tuberculosis
TMAQMNQAFRN

SEQ ID NO: 13976 - protein, 11 aa, Mycobacterium tuberculosis
MAQMNQAFRNI

SEQ ID NO: 13977 - protein, 11 aa, Mycobacterium tuberculosis
AQMNQAFRNIV

SEQ ID NO: 13978 - protein, 11 aa, Mycobacterium tuberculosis
QMNQAFRNIVN

SEQ ID NO: 13979 - protein, 11 aa, Mycobacterium tuberculosis
MNQAFRNIVNM

SEQ ID NO: 13980 - protein, 11 aa, Mycobacterium tuberculosis
NQAFRNIVNML

SEQ ID NO: 13981 - protein, 11 aa, Mycobacterium tuberculosis
QAFRNIVNMLH

SEQ ID NO: 13982 - protein, 11 aa, Mycobacterium tuberculosis
AFRNIVNMLHG

SEQ ID NO: 13983 - protein, 11 aa, Mycobacterium tuberculosis
FRNIVNMLHGV

SEQ ID NO: 13984 - protein, 11 aa, Mycobacterium tuberculosis
RNIVNMLHGVR

SEQ ID NO: 13985 - protein, 11 aa, Mycobacterium tuberculosis
NIVNMLHGVRD

SEQ ID NO: 13986 - protein, 11 aa, Mycobacterium tuberculosis
IVNMLHGVRDG

SEQ ID NO: 13987 - protein, 11 aa, Mycobacterium tuberculosis
VNMLHGVRDGL

SEQ ID NO: 13988 - protein, 11 aa, Mycobacterium tuberculosis
NMLHGVRDGLV

SEQ ID NO: 13989 - protein, 11 aa, Mycobacterium tuberculosis
MLHGVRDGLVR

SEQ ID NO: 13990 - protein, 11 aa, Mycobacterium tuberculosis
LHGVRDGLVRD

SEQ ID NO: 13991 - protein, 11 aa, Mycobacterium tuberculosis
HGVRDGLVRDA

SEQ ID NO: 13992 - protein, 11 aa, Mycobacterium tuberculosis
GVRDGLVRDAN

SEQ ID NO: 13993 - protein, 11 aa, Mycobacterium tuberculosis
VRDGLVRDANN

SEQ ID NO: 13994 - protein, 11 aa, Mycobacterium tuberculosis
RDGLVRDANNY

SEQ ID NO: 13995 - protein, 11 aa, Mycobacterium tuberculosis
DGLVRDANNYE

SEQ ID NO: 13996 - protein, 11 aa, Mycobacterium tuberculosis
GLVRDANNYEQ

SEQ ID NO: 13997 - protein, 11 aa, Mycobacterium tuberculosis
LVRDANNYEQQ

SEQ ID NO: 13998 - protein, 11 aa, Mycobacterium tuberculosis
VRDANNYEQQE

SEQ ID NO: 13999 - protein, 11 aa, Mycobacterium tuberculosis
RDANNYEQQEQ

SEQ ID NO: 14000 - protein, 11 aa, Mycobacterium tuberculosis
DANNYEQQEQA

SEQ ID NO: 14001 - protein, 11 aa, Mycobacterium tuberculosis
ANNYEQQEQAS

SEQ ID NO: 14002 - protein, 11 aa, Mycobacterium tuberculosis
NNYEQQEQASQ

SEQ ID NO: 14003 - protein, 11 aa, Mycobacterium tuberculosis
NYEQQEQASQQ

SEQ ID NO: 14004 - protein, 11 aa, Mycobacterium tuberculosis
YEQQEQASQQI

SEQ ID NO: 14005 - protein, 11 aa, Mycobacterium tuberculosis
EQQEQASQQIL

SEQ ID NO: 14006 - protein, 11 aa, Mycobacterium tuberculosis
QQEQASQQILS

SEQ ID NO: 14007 - protein, 11 aa, Mycobacterium tuberculosis
QEQASQQILSS

SEQ ID NO: 14008 - protein, 8 aa, Mycobacterium tuberculosis
MTINYQFG

SEQ ID NO: 14009 - protein, 8 aa, Mycobacterium tuberculosis
TINYQFGD

SEQ ID NO: 14010 - protein, 8 aa, Mycobacterium tuberculosis
INYQFGDV

SEQ ID NO: 14011 - protein, 8 aa, Mycobacterium tuberculosis
NYQFGDVD

SEQ ID NO: 14012 - protein, 8 aa, Mycobacterium tuberculosis
YQFGDVDA

SEQ ID NO: 14013 - protein, 8 aa, Mycobacterium tuberculosis
QFGDVDAH

SEQ ID NO: 14014 - protein, 8 aa, Mycobacterium tuberculosis
FGDVDAHG

SEQ ID NO: 14015 - protein, 8 aa, Mycobacterium tuberculosis
GDVDAHGA

SEQ ID NO: 14016 - protein, 8 aa, Mycobacterium tuberculosis
DVDAHGAM

SEQ ID NO: 14017 - protein, 8 aa, Mycobacterium tuberculosis
VDAHGAMI

SEQ ID NO: 14018 - protein, 8 aa, Mycobacterium tuberculosis
DAHGAMIR

SEQ ID NO: 14019 - protein, 8 aa, Mycobacterium tuberculosis
AHGAMIRA

SEQ ID NO: 14020 - protein, 8 aa, Mycobacterium tuberculosis
HGAMIRAQ

SEQ ID NO: 14021 - protein, 8 aa, Mycobacterium tuberculosis
GAMIRAQA

SEQ ID NO: 14022 - protein, 8 aa, Mycobacterium tuberculosis
AMIRAQAG

SEQ ID NO: 14023 - protein, 8 aa, Mycobacterium tuberculosis
MIRAQAGS

SEQ ID NO: 14024 - protein, 8 aa, Mycobacterium tuberculosis
IRAQAGSL

SEQ ID NO: 14025 - protein, 8 aa, Mycobacterium tuberculosis
RAQAGSLE

SEQ ID NO: 14026 - protein, 8 aa, Mycobacterium tuberculosis
AQAGSLEA

SEQ ID NO: 14027 - protein, 8 aa, Mycobacterium tuberculosis
QAGSLEAE

SEQ ID NO: 14028 - protein, 8 aa, Mycobacterium tuberculosis
AGSLEAEH

SEQ ID NO: 14029 - protein, 8 aa, Mycobacterium tuberculosis
GSLEAEHQ

SEQ ID NO: 14030 - protein, 8 aa, Mycobacterium tuberculosis
SLEAEHQA

SEQ ID NO: 14031 - protein, 8 aa, Mycobacterium tuberculosis
LEAEHQAI

SEQ ID NO: 14032 - protein, 8 aa, Mycobacterium tuberculosis
EAEHQAII

SEQ ID NO: 14033 - protein, 8 aa, Mycobacterium tuberculosis
AEHQAIIS

SEQ ID NO: 14034 - protein, 8 aa, Mycobacterium tuberculosis
EHQAIISD

SEQ ID NO: 14035 - protein, 8 aa, Mycobacterium tuberculosis
HQAIISDV

SEQ ID NO: 14036 - protein, 8 aa, Mycobacterium tuberculosis
QAIISDVL

SEQ ID NO: 14037 - protein, 8 aa, Mycobacterium tuberculosis
AIISDVLT

SEQ ID NO: 14038 - protein, 8 aa, Mycobacterium tuberculosis
IISDVLTA

SEQ ID NO: 14039 - protein, 8 aa, Mycobacterium tuberculosis
ISDVLTAS

SEQ ID NO: 14040 - protein, 8 aa, Mycobacterium tuberculosis
SDVLTASD

SEQ ID NO: 14041 - protein, 8 aa, Mycobacterium tuberculosis
DVLTASDF

SEQ ID NO: 14042 - protein, 8 aa, Mycobacterium tuberculosis
VLTASDFW

SEQ ID NO: 14043 - protein, 8 aa, Mycobacterium tuberculosis
LTASDFWG

SEQ ID NO: 14044 - protein, 8 aa, Mycobacterium tuberculosis
TASDFWGG

SEQ ID NO: 14045 - protein, 8 aa, Mycobacterium tuberculosis
ASDFWGGA

SEQ ID NO: 14046 - protein, 8 aa, Mycobacterium tuberculosis
SDFWGGAG

SEQ ID NO: 14047 - protein, 8 aa, Mycobacterium tuberculosis
DFWGGAGS

SEQ ID NO: 14048 - protein, 8 aa, Mycobacterium tuberculosis
FWGGAGSA

SEQ ID NO: 14049 - protein, 8 aa, Mycobacterium tuberculosis
WGGAGSAA

SEQ ID NO: 14050 - protein, 8 aa, Mycobacterium tuberculosis
GGAGSAAC

SEQ ID NO: 14051 - protein, 8 aa, Mycobacterium tuberculosis
GAGSAACQ

SEQ ID NO: 14052 - protein, 8 aa, Mycobacterium tuberculosis
AGSAACQG

SEQ ID NO: 14053 - protein, 8 aa, Mycobacterium tuberculosis
GSAACQGF

SEQ ID NO: 14054 - protein, 8 aa, Mycobacterium tuberculosis
SAACQGFI

SEQ ID NO: 14055 - protein, 8 aa, Mycobacterium tuberculosis
AACQGFIT

SEQ ID NO: 14056 - protein, 8 aa, Mycobacterium tuberculosis
ACQGFITQ

SEQ ID NO: 14057 - protein, 8 aa, Mycobacterium tuberculosis
CQGFITQL

SEQ ID NO: 14058 - protein, 8 aa, Mycobacterium tuberculosis
QGFITQLG

SEQ ID NO: 14059 - protein, 8 aa, Mycobacterium tuberculosis
GFITQLGR

SEQ ID NO: 14060 - protein, 8 aa, Mycobacterium tuberculosis
FITQLGRN

SEQ ID NO: 14061 - protein, 8 aa, Mycobacterium tuberculosis
ITQLGRNF

SEQ ID NO: 14062 - protein, 8 aa, Mycobacterium tuberculosis
TQLGRNFQ

SEQ ID NO: 14063 - protein, 8 aa, Mycobacterium tuberculosis
QLGRNFQV

SEQ ID NO: 14064 - protein, 8 aa, Mycobacterium tuberculosis
LGRNFQVI

SEQ ID NO: 14065 - protein, 8 aa, Mycobacterium tuberculosis
GRNFQVIY

SEQ ID NO: 14066 - protein, 8 aa, Mycobacterium tuberculosis
RNFQVIYE

SEQ ID NO: 14067 - protein, 8 aa, Mycobacterium tuberculosis
NFQVIYEQ

SEQ ID NO: 14068 - protein, 8 aa, Mycobacterium tuberculosis
FQVIYEQA

SEQ ID NO: 14069 - protein, 8 aa, Mycobacterium tuberculosis
QVIYEQAN

SEQ ID NO: 14070 - protein, 8 aa, Mycobacterium tuberculosis
VIYEQANA

SEQ ID NO: 14071 - protein, 8 aa, Mycobacterium tuberculosis
IYEQANAH

SEQ ID NO: 14072 - protein, 8 aa, Mycobacterium tuberculosis
YEQANAHG

SEQ ID NO: 14073 - protein, 8 aa, Mycobacterium tuberculosis
EQANAHGQ

SEQ ID NO: 14074 - protein, 8 aa, Mycobacterium tuberculosis
QANAHGQK

SEQ ID NO: 14075 - protein, 8 aa, Mycobacterium tuberculosis
ANAHGQKV

SEQ ID NO: 14076 - protein, 8 aa, Mycobacterium tuberculosis
NAHGQKVQ

SEQ ID NO: 14077 - protein, 8 aa, Mycobacterium tuberculosis
AHGQKVQA

SEQ ID NO: 14078 - protein, 8 aa, Mycobacterium tuberculosis
HGQKVQAA

SEQ ID NO: 14079 - protein, 8 aa, Mycobacterium tuberculosis
GQKVQAAG

SEQ ID NO: 14080 - protein, 8 aa, Mycobacterium tuberculosis
QKVQAAGN

SEQ ID NO: 14081 - protein, 8 aa, Mycobacterium tuberculosis
KVQAAGNN

SEQ ID NO: 14082 - protein, 8 aa, Mycobacterium tuberculosis
VQAAGNNM

SEQ ID NO: 14083 - protein, 8 aa, Mycobacterium tuberculosis
QAAGNNMA

SEQ ID NO: 14084 - protein, 8 aa, Mycobacterium tuberculosis
AAGNNMAQ

SEQ ID NO: 14085 - protein, 8 aa, Mycobacterium tuberculosis
AGNNMAQT

SEQ ID NO: 14086 - protein, 8 aa, Mycobacterium tuberculosis
GNNMAQTD

SEQ ID NO: 14087 - protein, 8 aa, Mycobacterium tuberculosis
NNMAQTDS

SEQ ID NO: 14088 - protein, 8 aa, Mycobacterium tuberculosis
NMAQTDSA

SEQ ID NO: 14089 - protein, 8 aa, Mycobacterium tuberculosis
MAQTDSAV

SEQ ID NO: 14090 - protein, 8 aa, Mycobacterium tuberculosis
AQTDSAVG

SEQ ID NO: 14091 - protein, 8 aa, Mycobacterium tuberculosis
QTDSAVGS

SEQ ID NO: 14092 - protein, 8 aa, Mycobacterium tuberculosis
TDSAVGSS

SEQ ID NO: 14093 - protein, 8 aa, Mycobacterium tuberculosis
DSAVGSSW

SEQ ID NO: 14094 - protein, 8 aa, Mycobacterium tuberculosis
SAVGSSWA

SEQ ID NO: 14095 - protein, 9 aa, Mycobacterium tuberculosis
MTINYQFGD

SEQ ID NO: 14096 - protein, 9 aa, Mycobacterium tuberculosis
TINYQFGDV

SEQ ID NO: 14097 - protein, 9 aa, Mycobacterium tuberculosis
INYQFGDVD

SEQ ID NO: 14098 - protein, 9 aa, Mycobacterium tuberculosis
NYQFGDVDA

SEQ ID NO: 14099 - protein, 9 aa, Mycobacterium tuberculosis
YQFGDVDAH

SEQ ID NO: 14100 - protein, 9 aa, Mycobacterium tuberculosis
QFGDVDAHG

SEQ ID NO: 14101 - protein, 9 aa, Mycobacterium tuberculosis
FGDVDAHGA

SEQ ID NO: 14102 - protein, 9 aa, Mycobacterium tuberculosis
GDVDAHGAM

SEQ ID NO: 14103 - protein, 9 aa, Mycobacterium tuberculosis
DVDAHGAMI

SEQ ID NO: 14104 - protein, 9 aa, Mycobacterium tuberculosis
VDAHGAMIR

SEQ ID NO: 14105 - protein, 9 aa, Mycobacterium tuberculosis
DAHGAMIRA

SEQ ID NO: 14106 - protein, 9 aa, Mycobacterium tuberculosis
AHGAMIRAQ

SEQ ID NO: 14107 - protein, 9 aa, Mycobacterium tuberculosis
HGAMIRAQA

SEQ ID NO: 14108 - protein, 9 aa, Mycobacterium tuberculosis
GAMIRAQAG

SEQ ID NO: 14109 - protein, 9 aa, Mycobacterium tuberculosis
AMIRAQAGS

SEQ ID NO: 14110 - protein, 9 aa, Mycobacterium tuberculosis
MIRAQAGSL

SEQ ID NO: 14111 - protein, 9 aa, Mycobacterium tuberculosis
IRAQAGSLE

SEQ ID NO: 14112 - protein, 9 aa, Mycobacterium tuberculosis
RAQAGSLEA

SEQ ID NO: 14113 - protein, 9 aa, Mycobacterium tuberculosis
AQAGSLEAE

SEQ ID NO: 14114 - protein, 9 aa, Mycobacterium tuberculosis
QAGSLEAEH

SEQ ID NO: 14115 - protein, 9 aa, Mycobacterium tuberculosis
AGSLEAEHQ

SEQ ID NO: 14116 - protein, 9 aa, Mycobacterium tuberculosis
GSLEAEHQA

SEQ ID NO: 14117 - protein, 9 aa, Mycobacterium tuberculosis
SLEAEHQAI

SEQ ID NO: 14118 - protein, 9 aa, Mycobacterium tuberculosis
LEAEHQAII

SEQ ID NO: 14119 - protein, 9 aa, Mycobacterium tuberculosis
EAEHQAIIS

SEQ ID NO: 14120 - protein, 9 aa, Mycobacterium tuberculosis
AEHQAIISD

SEQ ID NO: 14121 - protein, 9 aa, Mycobacterium tuberculosis
EHQAIISDV

SEQ ID NO: 14122 - protein, 9 aa, Mycobacterium tuberculosis
HQAIISDVL

SEQ ID NO: 14123 - protein, 9 aa, Mycobacterium tuberculosis
QAIISDVLT

SEQ ID NO: 14124 - protein, 9 aa, Mycobacterium tuberculosis
AIISDVLTA

SEQ ID NO: 14125 - protein, 9 aa, Mycobacterium tuberculosis
IISDVLTAS

SEQ ID NO: 14126 - protein, 9 aa, Mycobacterium tuberculosis
ISDVLTASD

SEQ ID NO: 14127 - protein, 9 aa, Mycobacterium tuberculosis
SDVLTASDF

SEQ ID NO: 14128 - protein, 9 aa, Mycobacterium tuberculosis
DVLTASDFW

SEQ ID NO: 14129 - protein, 9 aa, Mycobacterium tuberculosis
VLTASDFWG

SEQ ID NO: 14130 - protein, 9 aa, Mycobacterium tuberculosis
LTASDFWGG

SEQ ID NO: 14131 - protein, 9 aa, Mycobacterium tuberculosis
TASDFWGGA

SEQ ID NO: 14132 - protein, 9 aa, Mycobacterium tuberculosis
ASDFWGGAG

SEQ ID NO: 14133 - protein, 9 aa, Mycobacterium tuberculosis
SDFWGGAGS

SEQ ID NO: 14134 - protein, 9 aa, Mycobacterium tuberculosis
DFWGGAGSA

SEQ ID NO: 14135 - protein, 9 aa, Mycobacterium tuberculosis
FWGGAGSAA

SEQ ID NO: 14136 - protein, 9 aa, Mycobacterium tuberculosis
WGGAGSAAC

SEQ ID NO: 14137 - protein, 9 aa, Mycobacterium tuberculosis
GGAGSAACQ

SEQ ID NO: 14138 - protein, 9 aa, Mycobacterium tuberculosis
GAGSAACQG

SEQ ID NO: 14139 - protein, 9 aa, Mycobacterium tuberculosis
AGSAACQGF

SEQ ID NO: 14140 - protein, 9 aa, Mycobacterium tuberculosis
GSAACQGFI

SEQ ID NO: 14141 - protein, 9 aa, Mycobacterium tuberculosis
SAACQGFIT

SEQ ID NO: 14142 - protein, 9 aa, Mycobacterium tuberculosis
AACQGFITQ

SEQ ID NO: 14143 - protein, 9 aa, Mycobacterium tuberculosis
ACQGFITQL

SEQ ID NO: 14144 - protein, 9 aa, Mycobacterium tuberculosis
CQGFITQLG

SEQ ID NO: 14145 - protein, 9 aa, Mycobacterium tuberculosis
QGFITQLGR

SEQ ID NO: 14146 - protein, 9 aa, Mycobacterium tuberculosis
GFITQLGRN

SEQ ID NO: 14147 - protein, 9 aa, Mycobacterium tuberculosis
FITQLGRNF

SEQ ID NO: 14148 - protein, 9 aa, Mycobacterium tuberculosis
ITQLGRNFQ

SEQ ID NO: 14149 - protein, 9 aa, Mycobacterium tuberculosis
TQLGRNFQV

SEQ ID NO: 14150 - protein, 9 aa, Mycobacterium tuberculosis
QLGRNFQVI

SEQ ID NO: 14151 - protein, 9 aa, Mycobacterium tuberculosis
LGRNFQVIY

SEQ ID NO: 14152 - protein, 9 aa, Mycobacterium tuberculosis
GRNFQVIYE

SEQ ID NO: 14153 - protein, 9 aa, Mycobacterium tuberculosis
RNFQVIYEQ

SEQ ID NO: 14154 - protein, 9 aa, Mycobacterium tuberculosis
NFQVIYEQA

SEQ ID NO: 14155 - protein, 9 aa, Mycobacterium tuberculosis
FQVIYEQAN

SEQ ID NO: 14156 - protein, 9 aa, Mycobacterium tuberculosis
QVIYEQANA

SEQ ID NO: 14157 - protein, 9 aa, Mycobacterium tuberculosis
VIYEQANAH

SEQ ID NO: 14158 - protein, 9 aa, Mycobacterium tuberculosis
IYEQANAHG

SEQ ID NO: 14159 - protein, 9 aa, Mycobacterium tuberculosis
YEQANAHGQ

SEQ ID NO: 14160 - protein, 9 aa, Mycobacterium tuberculosis
EQANAHGQK

SEQ ID NO: 14161 - protein, 9 aa, Mycobacterium tuberculosis
QANAHGQKV

SEQ ID NO: 14162 - protein, 9 aa, Mycobacterium tuberculosis
ANAHGQKVQ

SEQ ID NO: 14163 - protein, 9 aa, Mycobacterium tuberculosis
NAHGQKVQA

SEQ ID NO: 14164 - protein, 9 aa, Mycobacterium tuberculosis
AHGQKVQAA

SEQ ID NO: 14165 - protein, 9 aa, Mycobacterium tuberculosis
HGQKVQAAG

SEQ ID NO: 14166 - protein, 9 aa, Mycobacterium tuberculosis
GQKVQAAGN

SEQ ID NO: 14167 - protein, 9 aa, Mycobacterium tuberculosis
QKVQAAGNN

SEQ ID NO: 14168 - protein, 9 aa, Mycobacterium tuberculosis
KVQAAGNNM

SEQ ID NO: 14169 - protein, 9 aa, Mycobacterium tuberculosis
VQAAGNNMA

SEQ ID NO: 14170 - protein, 9 aa, Mycobacterium tuberculosis
QAAGNNMAQ

SEQ ID NO: 14171 - protein, 9 aa, Mycobacterium tuberculosis
AAGNNMAQT

SEQ ID NO: 14172 - protein, 9 aa, Mycobacterium tuberculosis
AGNNMAQTD

SEQ ID NO: 14173 - protein, 9 aa, Mycobacterium tuberculosis
GNNMAQTDS

SEQ ID NO: 14174 - protein, 9 aa, Mycobacterium tuberculosis
NNMAQTDSA

SEQ ID NO: 14175 - protein, 9 aa, Mycobacterium tuberculosis
NMAQTDSAV

SEQ ID NO: 14176 - protein, 9 aa, Mycobacterium tuberculosis
MAQTDSAVG

SEQ ID NO: 14177 - protein, 9 aa, Mycobacterium tuberculosis
AQTDSAVGS

SEQ ID NO: 14178 - protein, 9 aa, Mycobacterium tuberculosis
QTDSAVGSS

SEQ ID NO: 14179 - protein, 9 aa, Mycobacterium tuberculosis
TDSAVGSSW

SEQ ID NO: 14180 - protein, 9 aa, Mycobacterium tuberculosis
DSAVGSSWA

SEQ ID NO: 14181 - protein, 10 aa, Mycobacterium tuberculosis
MTINYQFGDV

SEQ ID NO: 14182 - protein, 10 aa, Mycobacterium tuberculosis
TINYQFGDVD

SEQ ID NO: 14183 - protein, 10 aa, Mycobacterium tuberculosis
INYQFGDVDA

SEQ ID NO: 14184 - protein, 10 aa, Mycobacterium tuberculosis
NYQFGDVDAH

SEQ ID NO: 14185 - protein, 10 aa, Mycobacterium tuberculosis
YQFGDVDAHG

SEQ ID NO: 14186 - protein, 10 aa, Mycobacterium tuberculosis
QFGDVDAHGA

SEQ ID NO: 14187 - protein, 10 aa, Mycobacterium tuberculosis
FGDVDAHGAM

SEQ ID NO: 14188 - protein, 10 aa, Mycobacterium tuberculosis
GDVDAHGAMI

SEQ ID NO: 14189 - protein, 10 aa, Mycobacterium tuberculosis
DVDAHGAMIR

SEQ ID NO: 14190 - protein, 10 aa, Mycobacterium tuberculosis
VDAHGAMIRA

SEQ ID NO: 14191 - protein, 10 aa, Mycobacterium tuberculosis
DAHGAMIRAQ

SEQ ID NO: 14192 - protein, 10 aa, Mycobacterium tuberculosis
AHGAMIRAQA

SEQ ID NO: 14193 - protein, 10 aa, Mycobacterium tuberculosis
HGAMIRAQAG

SEQ ID NO: 14194 - protein, 10 aa, Mycobacterium tuberculosis
GAMIRAQAGS

SEQ ID NO: 14195 - protein, 10 aa, Mycobacterium tuberculosis
AMIRAQAGSL

SEQ ID NO: 14196 - protein, 10 aa, Mycobacterium tuberculosis
MIRAQAGSLE

SEQ ID NO: 14197 - protein, 10 aa, Mycobacterium tuberculosis
IRAQAGSLEA

SEQ ID NO: 14198 - protein, 10 aa, Mycobacterium tuberculosis
RAQAGSLEAE

SEQ ID NO: 14199 - protein, 10 aa, Mycobacterium tuberculosis
AQAGSLEAEH

SEQ ID NO: 14200 - protein, 10 aa, Mycobacterium tuberculosis
QAGSLEAEHQ

SEQ ID NO: 14201 - protein, 10 aa, Mycobacterium tuberculosis
AGSLEAEHQA

SEQ ID NO: 14202 - protein, 10 aa, Mycobacterium tuberculosis
GSLEAEHQAI

SEQ ID NO: 14203 - protein, 10 aa, Mycobacterium tuberculosis
SLEAEHQAII

SEQ ID NO: 14204 - protein, 10 aa, Mycobacterium tuberculosis
LEAEHQAIIS

SEQ ID NO: 14205 - protein, 10 aa, Mycobacterium tuberculosis
EAEHQAIISD

SEQ ID NO: 14206 - protein, 10 aa, Mycobacterium tuberculosis
AEHQAIISDV

SEQ ID NO: 14207 - protein, 10 aa, Mycobacterium tuberculosis
EHQAIISDVL

SEQ ID NO: 14208 - protein, 10 aa, Mycobacterium tuberculosis
HQAIISDVLT

SEQ ID NO: 14209 - protein, 10 aa, Mycobacterium tuberculosis
QAIISDVLTA

SEQ ID NO: 14210 - protein, 10 aa, Mycobacterium tuberculosis
AIISDVLTAS

SEQ ID NO: 14211 - protein, 10 aa, Mycobacterium tuberculosis
IISDVLTASD

SEQ ID NO: 14212 - protein, 10 aa, Mycobacterium tuberculosis
ISDVLTASDF

SEQ ID NO: 14213 - protein, 10 aa, Mycobacterium tuberculosis
SDVLTASDFW

SEQ ID NO: 14214 - protein, 10 aa, Mycobacterium tuberculosis
DVLTASDFWG

SEQ ID NO: 14215 - protein, 10 aa, Mycobacterium tuberculosis
VLTASDFWGG

SEQ ID NO: 14216 - protein, 10 aa, Mycobacterium tuberculosis
LTASDFWGGA

SEQ ID NO: 14217 - protein, 10 aa, Mycobacterium tuberculosis
TASDFWGGAG

SEQ ID NO: 14218 - protein, 10 aa, Mycobacterium tuberculosis
ASDFWGGAGS

SEQ ID NO: 14219 - protein, 10 aa, Mycobacterium tuberculosis
SDFWGGAGSA

SEQ ID NO: 14220 - protein, 10 aa, Mycobacterium tuberculosis
DFWGGAGSAA

SEQ ID NO: 14221 - protein, 10 aa, Mycobacterium tuberculosis
FWGGAGSAAC

SEQ ID NO: 14222 - protein, 10 aa, Mycobacterium tuberculosis
WGGAGSAACQ

SEQ ID NO: 14223 - protein, 10 aa, Mycobacterium tuberculosis
GGAGSAACQG

SEQ ID NO: 14224 - protein, 10 aa, Mycobacterium tuberculosis
GAGSAACQGF

SEQ ID NO: 14225 - protein, 10 aa, Mycobacterium tuberculosis
AGSAACQGFI

SEQ ID NO: 14226 - protein, 10 aa, Mycobacterium tuberculosis
GSAACQGFIT

SEQ ID NO: 14227 - protein, 10 aa, Mycobacterium tuberculosis
SAACQGFITQ

SEQ ID NO: 14228 - protein, 10 aa, Mycobacterium tuberculosis
AACQGFITQL

SEQ ID NO: 14229 - protein, 10 aa, Mycobacterium tuberculosis
ACQGFITQLG

SEQ ID NO: 14230 - protein, 10 aa, Mycobacterium tuberculosis
CQGFITQLGR

SEQ ID NO: 14231 - protein, 10 aa, Mycobacterium tuberculosis
QGFITQLGRN

SEQ ID NO: 14232 - protein, 10 aa, Mycobacterium tuberculosis
GFITQLGRNF

SEQ ID NO: 14233 - protein, 10 aa, Mycobacterium tuberculosis
FITQLGRNFQ

SEQ ID NO: 14234 - protein, 10 aa, Mycobacterium tuberculosis
ITQLGRNFQV

SEQ ID NO: 14235 - protein, 10 aa, Mycobacterium tuberculosis
TQLGRNFQVI

SEQ ID NO: 14236 - protein, 10 aa, Mycobacterium tuberculosis
QLGRNFQVIY

SEQ ID NO: 14237 - protein, 10 aa, Mycobacterium tuberculosis
LGRNFQVIYE

SEQ ID NO: 14238 - protein, 10 aa, Mycobacterium tuberculosis
GRNFQVIYEQ

SEQ ID NO: 14239 - protein, 10 aa, Mycobacterium tuberculosis
RNFQVIYEQA

SEQ ID NO: 14240 - protein, 10 aa, Mycobacterium tuberculosis
NFQVIYEQAN

SEQ ID NO: 14241 - protein, 10 aa, Mycobacterium tuberculosis
FQVIYEQANA

SEQ ID NO: 14242 - protein, 10 aa, Mycobacterium tuberculosis
QVIYEQANAH

SEQ ID NO: 14243 - protein, 10 aa, Mycobacterium tuberculosis
VIYEQANAHG

SEQ ID NO: 14244 - protein, 10 aa, Mycobacterium tuberculosis
IYEQANAHGQ

SEQ ID NO: 14245 - protein, 10 aa, Mycobacterium tuberculosis
YEQANAHGQK

SEQ ID NO: 14246 - protein, 10 aa, Mycobacterium tuberculosis
EQANAHGQKV

SEQ ID NO: 14247 - protein, 10 aa, Mycobacterium tuberculosis
QANAHGQKVQ

SEQ ID NO: 14248 - protein, 10 aa, Mycobacterium tuberculosis
ANAHGQKVQA

SEQ ID NO: 14249 - protein, 10 aa, Mycobacterium tuberculosis
NAHGQKVQAA

SEQ ID NO: 14250 - protein, 10 aa, Mycobacterium tuberculosis
AHGQKVQAAG

SEQ ID NO: 14251 - protein, 10 aa, Mycobacterium tuberculosis
HGQKVQAAGN

SEQ ID NO: 14252 - protein, 10 aa, Mycobacterium tuberculosis
GQKVQAAGNN

SEQ ID NO: 14253 - protein, 10 aa, Mycobacterium tuberculosis
QKVQAAGNNM

SEQ ID NO: 14254 - protein, 10 aa, Mycobacterium tuberculosis
KVQAAGNNMA

SEQ ID NO: 14255 - protein, 10 aa, Mycobacterium tuberculosis
VQAAGNNMAQ

SEQ ID NO: 14256 - protein, 10 aa, Mycobacterium tuberculosis
QAAGNNMAQT

SEQ ID NO: 14257 - protein, 10 aa, Mycobacterium tuberculosis
AAGNNMAQTD

SEQ ID NO: 14258 - protein, 10 aa, Mycobacterium tuberculosis
AGNNMAQTDS

SEQ ID NO: 14259 - protein, 10 aa, Mycobacterium tuberculosis
GNNMAQTDSA

SEQ ID NO: 14260 - protein, 10 aa, Mycobacterium tuberculosis
NNMAQTDSAV

SEQ ID NO: 14261 - protein, 10 aa, Mycobacterium tuberculosis
NMAQTDSAVG

SEQ ID NO: 14262 - protein, 10 aa, Mycobacterium tuberculosis
MAQTDSAVGS

SEQ ID NO: 14263 - protein, 10 aa, Mycobacterium tuberculosis
AQTDSAVGSS

SEQ ID NO: 14264 - protein, 10 aa, Mycobacterium tuberculosis
QTDSAVGSSW

SEQ ID NO: 14265 - protein, 10 aa, Mycobacterium tuberculosis
TDSAVGSSWA

SEQ ID NO: 14266 - protein, 11 aa, Mycobacterium tuberculosis
MTINYQFGDVD

SEQ ID NO: 14267 - protein, 11 aa, Mycobacterium tuberculosis
TINYQFGDVDA

SEQ ID NO: 14268 - protein, 11 aa, Mycobacterium tuberculosis
INYQFGDVDAH

SEQ ID NO: 14269 - protein, 11 aa, Mycobacterium tuberculosis
NYQFGDVDAHG

SEQ ID NO: 14270 - protein, 11 aa, Mycobacterium tuberculosis
YQFGDVDAHGA

SEQ ID NO: 14271 - protein, 11 aa, Mycobacterium tuberculosis
QFGDVDAHGAM

SEQ ID NO: 14272 - protein, 11 aa, Mycobacterium tuberculosis
FGDVDAHGAMI

SEQ ID NO: 14273 - protein, 11 aa, Mycobacterium tuberculosis
GDVDAHGAMIR

SEQ ID NO: 14274 - protein, 11 aa, Mycobacterium tuberculosis
DVDAHGAMIRA

SEQ ID NO: 14275 - protein, 11 aa, Mycobacterium tuberculosis
VDAHGAMIRAQ

SEQ ID NO: 14276 - protein, 11 aa, Mycobacterium tuberculosis
DAHGAMIRAQA

SEQ ID NO: 14277 - protein, 11 aa, Mycobacterium tuberculosis
AHGAMIRAQAG

SEQ ID NO: 14278 - protein, 11 aa, Mycobacterium tuberculosis
HGAMIRAQAGS

SEQ ID NO: 14279 - protein, 11 aa, Mycobacterium tuberculosis
GAMIRAQAGSL

SEQ ID NO: 14280 - protein, 11 aa, Mycobacterium tuberculosis
AMIRAQAGSLE

SEQ ID NO: 14281 - protein, 11 aa, Mycobacterium tuberculosis
MIRAQAGSLEA

SEQ ID NO: 14282 - protein, 11 aa, Mycobacterium tuberculosis
IRAQAGSLEAE

SEQ ID NO: 14283 - protein, 11 aa, Mycobacterium tuberculosis
RAQAGSLEAEH

SEQ ID NO: 14284 - protein, 11 aa, Mycobacterium tuberculosis
AQAGSLEAEHQ

SEQ ID NO: 14285 - protein, 11 aa, Mycobacterium tuberculosis
QAGSLEAEHQA

SEQ ID NO: 14286 - protein, 11 aa, Mycobacterium tuberculosis
AGSLEAEHQAI

SEQ ID NO: 14287 - protein, 11 aa, Mycobacterium tuberculosis
GSLEAEHQAII

SEQ ID NO: 14288 - protein, 11 aa, Mycobacterium tuberculosis
SLEAEHQAIIS

SEQ ID NO: 14289 - protein, 11 aa, Mycobacterium tuberculosis
LEAEHQAIISD

SEQ ID NO: 14290 - protein, 11 aa, Mycobacterium tuberculosis
EAEHQAIISDV

SEQ ID NO: 14291 - protein, 11 aa, Mycobacterium tuberculosis
AEHQAIISDVL

SEQ ID NO: 14292 - protein, 11 aa, Mycobacterium tuberculosis
EHQAIISDVLT

SEQ ID NO: 14293 - protein, 11 aa, Mycobacterium tuberculosis
HQAIISDVLTA

SEQ ID NO: 14294 - protein, 11 aa, Mycobacterium tuberculosis
QAIISDVLTAS

SEQ ID NO: 14295 - protein, 11 aa, Mycobacterium tuberculosis
AIISDVLTASD

SEQ ID NO: 14296 - protein, 11 aa, Mycobacterium tuberculosis
IISDVLTASDF

SEQ ID NO: 14297 - protein, 11 aa, Mycobacterium tuberculosis
ISDVLTASDFW

SEQ ID NO: 14298 - protein, 11 aa, Mycobacterium tuberculosis
SDVLTASDFWG

SEQ ID NO: 14299 - protein, 11 aa, Mycobacterium tuberculosis
DVLTASDFWGG

SEQ ID NO: 14300 - protein, 11 aa, Mycobacterium tuberculosis
VLTASDFWGGA

SEQ ID NO: 14301 - protein, 11 aa, Mycobacterium tuberculosis
LTASDFWGGAG

SEQ ID NO: 14302 - protein, 11 aa, Mycobacterium tuberculosis
TASDFWGGAGS

SEQ ID NO: 14303 - protein, 11 aa, Mycobacterium tuberculosis
ASDFWGGAGSA

SEQ ID NO: 14304 - protein, 11 aa, Mycobacterium tuberculosis
SDFWGGAGSAA

SEQ ID NO: 14305 - protein, 11 aa, Mycobacterium tuberculosis
DFWGGAGSAAC

SEQ ID NO: 14306 - protein, 11 aa, Mycobacterium tuberculosis
FWGGAGSAACQ

SEQ ID NO: 14307 - protein, 11 aa, Mycobacterium tuberculosis
WGGAGSAACQG

SEQ ID NO: 14308 - protein, 11 aa, Mycobacterium tuberculosis
GGAGSAACQGF

SEQ ID NO: 14309 - protein, 11 aa, Mycobacterium tuberculosis
GAGSAACQGFI

SEQ ID NO: 14310 - protein, 11 aa, Mycobacterium tuberculosis
AGSAACQGFIT

SEQ ID NO: 14311 - protein, 11 aa, Mycobacterium tuberculosis
GSAACQGFITQ

SEQ ID NO: 14312 - protein, 11 aa, Mycobacterium tuberculosis
SAACQGFITQL

SEQ ID NO: 14313 - protein, 11 aa, Mycobacterium tuberculosis
AACQGFITQLG

SEQ ID NO: 14314 - protein, 11 aa, Mycobacterium tuberculosis
ACQGFITQLGR

SEQ ID NO: 14315 - protein, 11 aa, Mycobacterium tuberculosis
CQGFITQLGRN

SEQ ID NO: 14316 - protein, 11 aa, Mycobacterium tuberculosis
QGFITQLGRNF

SEQ ID NO: 14317 - protein, 11 aa, Mycobacterium tuberculosis
GFITQLGRNFQ

SEQ ID NO: 14318 - protein, 11 aa, Mycobacterium tuberculosis
FITQLGRNFQV

SEQ ID NO: 14319 - protein, 11 aa, Mycobacterium tuberculosis
ITQLGRNFQVI

SEQ ID NO: 14320 - protein, 11 aa, Mycobacterium tuberculosis
TQLGRNFQVIY

SEQ ID NO: 14321 - protein, 11 aa, Mycobacterium tuberculosis
QLGRNFQVIYE

SEQ ID NO: 14322 - protein, 11 aa, Mycobacterium tuberculosis
LGRNFQVIYEQ

SEQ ID NO: 14323 - protein, 11 aa, Mycobacterium tuberculosis
GRNFQVIYEQA

SEQ ID NO: 14324 - protein, 11 aa, Mycobacterium tuberculosis
RNFQVIYEQAN

SEQ ID NO: 14325 - protein, 11 aa, Mycobacterium tuberculosis
NFQVIYEQANA

SEQ ID NO: 14326 - protein, 11 aa, Mycobacterium tuberculosis
FQVIYEQANAH

SEQ ID NO: 14327 - protein, 11 aa, Mycobacterium tuberculosis
QVIYEQANAHG

SEQ ID NO: 14328 - protein, 11 aa, Mycobacterium tuberculosis
VIYEQANAHGQ

SEQ ID NO: 14329 - protein, 11 aa, Mycobacterium tuberculosis
IYEQANAHGQK

SEQ ID NO: 14330 - protein, 11 aa, Mycobacterium tuberculosis
YEQANAHGQKV

SEQ ID NO: 14331 - protein, 11 aa, Mycobacterium tuberculosis
EQANAHGQKVQ

SEQ ID NO: 14332 - protein, 11 aa, Mycobacterium tuberculosis
QANAHGQKVQA

SEQ ID NO: 14333 - protein, 11 aa, Mycobacterium tuberculosis
ANAHGQKVQAA

SEQ ID NO: 14334 - protein, 11 aa, Mycobacterium tuberculosis
NAHGQKVQAAG

SEQ ID NO: 14335 - protein, 11 aa, Mycobacterium tuberculosis
AHGQKVQAAGN

SEQ ID NO: 14336 - protein, 11 aa, Mycobacterium tuberculosis
HGQKVQAAGNN

SEQ ID NO: 14337 - protein, 11 aa, Mycobacterium tuberculosis
GQKVQAAGNNM

SEQ ID NO: 14338 - protein, 11 aa, Mycobacterium tuberculosis
QKVQAAGNNMA

SEQ ID NO: 14339 - protein, 11 aa, Mycobacterium tuberculosis
KVQAAGNNMAQ

SEQ ID NO: 14340 - protein, 11 aa, Mycobacterium tuberculosis
VQAAGNNMAQT

SEQ ID NO: 14341 - protein, 11 aa, Mycobacterium tuberculosis
QAAGNNMAQTD

SEQ ID NO: 14342 - protein, 11 aa, Mycobacterium tuberculosis
AAGNNMAQTDS

SEQ ID NO: 14343 - protein, 11 aa, Mycobacterium tuberculosis
AGNNMAQTDSA

SEQ ID NO: 14344 - protein, 11 aa, Mycobacterium tuberculosis
GNNMAQTDSAV

SEQ ID NO: 14345 - protein, 11 aa, Mycobacterium tuberculosis
NNMAQTDSAVG

SEQ ID NO: 14346 - protein, 11 aa, Mycobacterium tuberculosis
NMAQTDSAVGS

SEQ ID NO: 14347 - protein, 11 aa, Mycobacterium tuberculosis
MAQTDSAVGSS

SEQ ID NO: 14348 - protein, 11 aa, Mycobacterium tuberculosis
AQTDSAVGSSW

SEQ ID NO: 14349 - protein, 11 aa, Mycobacterium tuberculosis
QTDSAVGSSWA

SEQ ID NO: 14350 - protein, 8 aa, Mycobacterium tuberculosis
MTTAIRRA

SEQ ID NO: 14351 - protein, 8 aa, Mycobacterium tuberculosis
TTAIRRAA

SEQ ID NO: 14352 - protein, 8 aa, Mycobacterium tuberculosis
TAIRRAAG

SEQ ID NO: 14353 - protein, 8 aa, Mycobacterium tuberculosis
AIRRAAGS

SEQ ID NO: 14354 - protein, 8 aa, Mycobacterium tuberculosis
IRRAAGSS

SEQ ID NO: 14355 - protein, 8 aa, Mycobacterium tuberculosis
RRAAGSSY

SEQ ID NO: 14356 - protein, 8 aa, Mycobacterium tuberculosis
RAAGSSYF

SEQ ID NO: 14357 - protein, 8 aa, Mycobacterium tuberculosis
AAGSSYFR

SEQ ID NO: 14358 - protein, 8 aa, Mycobacterium tuberculosis
AGSSYFRN

SEQ ID NO: 14359 - protein, 8 aa, Mycobacterium tuberculosis
GSSYFRNP

SEQ ID NO: 14360 - protein, 8 aa, Mycobacterium tuberculosis
SSYFRNPW

SEQ ID NO: 14361 - protein, 8 aa, Mycobacterium tuberculosis
SYFRNPWP

SEQ ID NO: 14362 - protein, 8 aa, Mycobacterium tuberculosis
YFRNPWPA

SEQ ID NO: 14363 - protein, 8 aa, Mycobacterium tuberculosis
FRNPWPAL

SEQ ID NO: 14364 - protein, 8 aa, Mycobacterium tuberculosis
RNPWPALW

SEQ ID NO: 14365 - protein, 8 aa, Mycobacterium tuberculosis
NPWPALWA

SEQ ID NO: 14366 - protein, 8 aa, Mycobacterium tuberculosis
PWPALWAM

SEQ ID NO: 14367 - protein, 8 aa, Mycobacterium tuberculosis
WPALWAMM

SEQ ID NO: 14368 - protein, 8 aa, Mycobacterium tuberculosis
PALWAMMV

SEQ ID NO: 14369 - protein, 8 aa, Mycobacterium tuberculosis
ALWAMMVG

SEQ ID NO: 14370 - protein, 8 aa, Mycobacterium tuberculosis
LWAMMVGF

SEQ ID NO: 14371 - protein, 8 aa, Mycobacterium tuberculosis
WAMMVGFF

SEQ ID NO: 14372 - protein, 8 aa, Mycobacterium tuberculosis
AMMVGFFM

SEQ ID NO: 14373 - protein, 8 aa, Mycobacterium tuberculosis
MMVGFFMI

SEQ ID NO: 14374 - protein, 8 aa, Mycobacterium tuberculosis
MVGFFMIM

SEQ ID NO: 14375 - protein, 8 aa, Mycobacterium tuberculosis
VGFFMIML

SEQ ID NO: 14376 - protein, 8 aa, Mycobacterium tuberculosis
GFFMIMLD

SEQ ID NO: 14377 - protein, 8 aa, Mycobacterium tuberculosis
FFMIMLDS

SEQ ID NO: 14378 - protein, 8 aa, Mycobacterium tuberculosis
FMIMLDST

SEQ ID NO: 14379 - protein, 8 aa, Mycobacterium tuberculosis
MIMLDSTV

SEQ ID NO: 14380 - protein, 8 aa, Mycobacterium tuberculosis
IMLDSTVV

SEQ ID NO: 14381 - protein, 8 aa, Mycobacterium tuberculosis
MLDSTVVA

SEQ ID NO: 14382 - protein, 8 aa, Mycobacterium tuberculosis
LDSTVVAI

SEQ ID NO: 14383 - protein, 8 aa, Mycobacterium tuberculosis
DSTVVAIA

SEQ ID NO: 14384 - protein, 8 aa, Mycobacterium tuberculosis
STVVAIAN

SEQ ID NO: 14385 - protein, 8 aa, Mycobacterium tuberculosis
TVVAIANP

SEQ ID NO: 14386 - protein, 8 aa, Mycobacterium tuberculosis
VVAIANPT

SEQ ID NO: 14387 - protein, 8 aa, Mycobacterium tuberculosis
VAIANPTI

SEQ ID NO: 14388 - protein, 8 aa, Mycobacterium tuberculosis
AIANPTIM

SEQ ID NO: 14389 - protein, 8 aa, Mycobacterium tuberculosis
IANPTIMA

SEQ ID NO: 14390 - protein, 8 aa, Mycobacterium tuberculosis
ANPTIMAQ

SEQ ID NO: 14391 - protein, 8 aa, Mycobacterium tuberculosis
NPTIMAQL

SEQ ID NO: 14392 - protein, 8 aa, Mycobacterium tuberculosis
PTIMAQLR

SEQ ID NO: 14393 - protein, 8 aa, Mycobacterium tuberculosis
TIMAQLRI

SEQ ID NO: 14394 - protein, 8 aa, Mycobacterium tuberculosis
IMAQLRIG

SEQ ID NO: 14395 - protein, 8 aa, Mycobacterium tuberculosis
MAQLRIGY

SEQ ID NO: 14396 - protein, 8 aa, Mycobacterium tuberculosis
AQLRIGYA

SEQ ID NO: 14397 - protein, 8 aa, Mycobacterium tuberculosis
QLRIGYAT

SEQ ID NO: 14398 - protein, 8 aa, Mycobacterium tuberculosis
LRIGYATV

SEQ ID NO: 14399 - protein, 8 aa, Mycobacterium tuberculosis
RIGYATVV

SEQ ID NO: 14400 - protein, 8 aa, Mycobacterium tuberculosis
IGYATVVW

SEQ ID NO: 14401 - protein, 8 aa, Mycobacterium tuberculosis
GYATVVWV

SEQ ID NO: 14402 - protein, 8 aa, Mycobacterium tuberculosis
YATVVWVT

SEQ ID NO: 14403 - protein, 8 aa, Mycobacterium tuberculosis
ATVVWVTS

SEQ ID NO: 14404 - protein, 8 aa, Mycobacterium tuberculosis
TVVWVTSA

SEQ ID NO: 14405 - protein, 8 aa, Mycobacterium tuberculosis
VVWVTSAY

SEQ ID NO: 14406 - protein, 8 aa, Mycobacterium tuberculosis
VWVTSAYL

SEQ ID NO: 14407 - protein, 8 aa, Mycobacterium tuberculosis
WVTSAYLL

SEQ ID NO: 14408 - protein, 8 aa, Mycobacterium tuberculosis
VTSAYLLA

SEQ ID NO: 14409 - protein, 8 aa, Mycobacterium tuberculosis
TSAYLLAY

SEQ ID NO: 14410 - protein, 8 aa, Mycobacterium tuberculosis
SAYLLAYA

SEQ ID NO: 14411 - protein, 8 aa, Mycobacterium tuberculosis
AYLLAYAV

SEQ ID NO: 14412 - protein, 8 aa, Mycobacterium tuberculosis
YLLAYAVP

SEQ ID NO: 14413 - protein, 8 aa, Mycobacterium tuberculosis
LLAYAVPM

SEQ ID NO: 14414 - protein, 8 aa, Mycobacterium tuberculosis
LAYAVPML

SEQ ID NO: 14415 - protein, 8 aa, Mycobacterium tuberculosis
AYAVPMLV

SEQ ID NO: 14416 - protein, 8 aa, Mycobacterium tuberculosis
YAVPMLVA

SEQ ID NO: 14417 - protein, 8 aa, Mycobacterium tuberculosis
AVPMLVAG

SEQ ID NO: 14418 - protein, 8 aa, Mycobacterium tuberculosis
VPMLVAGR

SEQ ID NO: 14419 - protein, 8 aa, Mycobacterium tuberculosis
PMLVAGRL

SEQ ID NO: 14420 - protein, 8 aa, Mycobacterium tuberculosis
MLVAGRLG

SEQ ID NO: 14421 - protein, 8 aa, Mycobacterium tuberculosis
LVAGRLGD

SEQ ID NO: 14422 - protein, 8 aa, Mycobacterium tuberculosis
VAGRLGDR

SEQ ID NO: 14423 - protein, 8 aa, Mycobacterium tuberculosis
AGRLGDRF

SEQ ID NO: 14424 - protein, 8 aa, Mycobacterium tuberculosis
GRLGDRFG

SEQ ID NO: 14425 - protein, 8 aa, Mycobacterium tuberculosis
RLGDRFGP

SEQ ID NO: 14426 - protein, 8 aa, Mycobacterium tuberculosis
LGDRFGPK

SEQ ID NO: 14427 - protein, 8 aa, Mycobacterium tuberculosis
GDRFGPKN

SEQ ID NO: 14428 - protein, 8 aa, Mycobacterium tuberculosis
DRFGPKNL

SEQ ID NO: 14429 - protein, 8 aa, Mycobacterium tuberculosis
RFGPKNLY

SEQ ID NO: 14430 - protein, 8 aa, Mycobacterium tuberculosis
FGPKNLYL

SEQ ID NO: 14431 - protein, 8 aa, Mycobacterium tuberculosis
GPKNLYLI

SEQ ID NO: 14432 - protein, 8 aa, Mycobacterium tuberculosis
PKNLYLIG

SEQ ID NO: 14433 - protein, 8 aa, Mycobacterium tuberculosis
KNLYLIGL

SEQ ID NO: 14434 - protein, 8 aa, Mycobacterium tuberculosis
NLYLIGLG

SEQ ID NO: 14435 - protein, 8 aa, Mycobacterium tuberculosis
LYLIGLGV

SEQ ID NO: 14436 - protein, 8 aa, Mycobacterium tuberculosis
YLIGLGVF

SEQ ID NO: 14437 - protein, 8 aa, Mycobacterium tuberculosis
LIGLGVFT

SEQ ID NO: 14438 - protein, 8 aa, Mycobacterium tuberculosis
IGLGVFTV

SEQ ID NO: 14439 - protein, 8 aa, Mycobacterium tuberculosis
GLGVFTVA

SEQ ID NO: 14440 - protein, 8 aa, Mycobacterium tuberculosis
LGVFTVAS

SEQ ID NO: 14441 - protein, 8 aa, Mycobacterium tuberculosis
GVFTVASL

SEQ ID NO: 14442 - protein, 8 aa, Mycobacterium tuberculosis
VFTVASLG

SEQ ID NO: 14443 - protein, 8 aa, Mycobacterium tuberculosis
FTVASLGC

SEQ ID NO: 14444 - protein, 8 aa, Mycobacterium tuberculosis
TVASLGCG

SEQ ID NO: 14445 - protein, 8 aa, Mycobacterium tuberculosis
VASLGCGL

SEQ ID NO: 14446 - protein, 8 aa, Mycobacterium tuberculosis
ASLGCGLS

SEQ ID NO: 14447 - protein, 8 aa, Mycobacterium tuberculosis
SLGCGLSS

SEQ ID NO: 14448 - protein, 8 aa, Mycobacterium tuberculosis
LGCGLSSG

SEQ ID NO: 14449 - protein, 8 aa, Mycobacterium tuberculosis
GCGLSSGA

SEQ ID NO: 14450 - protein, 8 aa, Mycobacterium tuberculosis
CGLSSGAG

SEQ ID NO: 14451 - protein, 8 aa, Mycobacterium tuberculosis
GLSSGAGM

SEQ ID NO: 14452 - protein, 8 aa, Mycobacterium tuberculosis
LSSGAGML

SEQ ID NO: 14453 - protein, 8 aa, Mycobacterium tuberculosis
SSGAGMLI

SEQ ID NO: 14454 - protein, 8 aa, Mycobacterium tuberculosis
SGAGMLIA

SEQ ID NO: 14455 - protein, 8 aa, Mycobacterium tuberculosis
GAGMLIAA

SEQ ID NO: 14456 - protein, 8 aa, Mycobacterium tuberculosis
AGMLIAAR

SEQ ID NO: 14457 - protein, 8 aa, Mycobacterium tuberculosis
GMLIAARV

SEQ ID NO: 14458 - protein, 8 aa, Mycobacterium tuberculosis
MLIAARVV

SEQ ID NO: 14459 - protein, 8 aa, Mycobacterium tuberculosis
LIAARVVQ

SEQ ID NO: 14460 - protein, 8 aa, Mycobacterium tuberculosis
IAARVVQG

SEQ ID NO: 14461 - protein, 8 aa, Mycobacterium tuberculosis
AARVVQGV

SEQ ID NO: 14462 - protein, 8 aa, Mycobacterium tuberculosis
ARVVQGVG

SEQ ID NO: 14463 - protein, 8 aa, Mycobacterium tuberculosis
RVVQGVGA

SEQ ID NO: 14464 - protein, 8 aa, Mycobacterium tuberculosis
VVQGVGAG

SEQ ID NO: 14465 - protein, 8 aa, Mycobacterium tuberculosis
VQGVGAGL

SEQ ID NO: 14466 - protein, 8 aa, Mycobacterium tuberculosis
QGVGAGLL

SEQ ID NO: 14467 - protein, 8 aa, Mycobacterium tuberculosis
GVGAGLLT

SEQ ID NO: 14468 - protein, 8 aa, Mycobacterium tuberculosis
VGAGLLTP

SEQ ID NO: 14469 - protein, 8 aa, Mycobacterium tuberculosis
GAGLLTPQ

SEQ ID NO: 14470 - protein, 8 aa, Mycobacterium tuberculosis
AGLLTPQT

SEQ ID NO: 14471 - protein, 8 aa, Mycobacterium tuberculosis
GLLTPQTL

SEQ ID NO: 14472 - protein, 8 aa, Mycobacterium tuberculosis
LLTPQTLS

SEQ ID NO: 14473 - protein, 8 aa, Mycobacterium tuberculosis
LTPQTLST

SEQ ID NO: 14474 - protein, 8 aa, Mycobacterium tuberculosis
TPQTLSTI

SEQ ID NO: 14475 - protein, 8 aa, Mycobacterium tuberculosis
PQTLSTIT

SEQ ID NO: 14476 - protein, 8 aa, Mycobacterium tuberculosis
QTLSTITR

SEQ ID NO: 14477 - protein, 8 aa, Mycobacterium tuberculosis
TLSTITRI

SEQ ID NO: 14478 - protein, 8 aa, Mycobacterium tuberculosis
LSTITRIF

SEQ ID NO: 14479 - protein, 8 aa, Mycobacterium tuberculosis
STITRIFP

SEQ ID NO: 14480 - protein, 8 aa, Mycobacterium tuberculosis
TITRIFPA

SEQ ID NO: 14481 - protein, 8 aa, Mycobacterium tuberculosis
ITRIFPAH

SEQ ID NO: 14482 - protein, 8 aa, Mycobacterium tuberculosis
TRIFPAHR

SEQ ID NO: 14483 - protein, 8 aa, Mycobacterium tuberculosis
RIFPAHRR

SEQ ID NO: 14484 - protein, 8 aa, Mycobacterium tuberculosis
IFPAHRRG

SEQ ID NO: 14485 - protein, 8 aa, Mycobacterium tuberculosis
FPAHRRGV

SEQ ID NO: 14486 - protein, 8 aa, Mycobacterium tuberculosis
PAHRRGVA

SEQ ID NO: 14487 - protein, 8 aa, Mycobacterium tuberculosis
AHRRGVAL

SEQ ID NO: 14488 - protein, 8 aa, Mycobacterium tuberculosis
HRRGVALG

SEQ ID NO: 14489 - protein, 8 aa, Mycobacterium tuberculosis
RRGVALGA

SEQ ID NO: 14490 - protein, 8 aa, Mycobacterium tuberculosis
RGVALGAW

SEQ ID NO: 14491 - protein, 8 aa, Mycobacterium tuberculosis
GVALGAWG

SEQ ID NO: 14492 - protein, 8 aa, Mycobacterium tuberculosis
VALGAWGT

SEQ ID NO: 14493 - protein, 8 aa, Mycobacterium tuberculosis
ALGAWGTV

SEQ ID NO: 14494 - protein, 8 aa, Mycobacterium tuberculosis
LGAWGTVA

SEQ ID NO: 14495 - protein, 8 aa, Mycobacterium tuberculosis
GAWGTVAS

SEQ ID NO: 14496 - protein, 8 aa, Mycobacterium tuberculosis
AWGTVASV

SEQ ID NO: 14497 - protein, 8 aa, Mycobacterium tuberculosis
WGTVASVA

SEQ ID NO: 14498 - protein, 8 aa, Mycobacterium tuberculosis
GTVASVAS

SEQ ID NO: 14499 - protein, 8 aa, Mycobacterium tuberculosis
TVASVASL

SEQ ID NO: 14500 - protein, 8 aa, Mycobacterium tuberculosis
VASVASLV

SEQ ID NO: 14501 - protein, 8 aa, Mycobacterium tuberculosis
ASVASLVG

SEQ ID NO: 14502 - protein, 8 aa, Mycobacterium tuberculosis
SVASLVGP

SEQ ID NO: 14503 - protein, 8 aa, Mycobacterium tuberculosis
VASLVGPL

SEQ ID NO: 14504 - protein, 8 aa, Mycobacterium tuberculosis
ASLVGPLA

SEQ ID NO: 14505 - protein, 8 aa, Mycobacterium tuberculosis
SLVGPLAG

SEQ ID NO: 14506 - protein, 8 aa, Mycobacterium tuberculosis
LVGPLAGG

SEQ ID NO: 14507 - protein, 8 aa, Mycobacterium tuberculosis
VGPLAGGA

SEQ ID NO: 14508 - protein, 8 aa, Mycobacterium tuberculosis
GPLAGGAL

SEQ ID NO: 14509 - protein, 8 aa, Mycobacterium tuberculosis
PLAGGALV

SEQ ID NO: 14510 - protein, 8 aa, Mycobacterium tuberculosis
LAGGALVD

SEQ ID NO: 14511 - protein, 8 aa, Mycobacterium tuberculosis
AGGALVDS

SEQ ID NO: 14512 - protein, 8 aa, Mycobacterium tuberculosis
GGALVDSM

SEQ ID NO: 14513 - protein, 8 aa, Mycobacterium tuberculosis
GALVDSMG

SEQ ID NO: 14514 - protein, 8 aa, Mycobacterium tuberculosis
ALVDSMGW

SEQ ID NO: 14515 - protein, 8 aa, Mycobacterium tuberculosis
LVDSMGWE

SEQ ID NO: 14516 - protein, 8 aa, Mycobacterium tuberculosis
VDSMGWEW

SEQ ID NO: 14517 - protein, 8 aa, Mycobacterium tuberculosis
DSMGWEWI

SEQ ID NO: 14518 - protein, 8 aa, Mycobacterium tuberculosis
SMGWEWIF

SEQ ID NO: 14519 - protein, 8 aa, Mycobacterium tuberculosis
MGWEWIFF

SEQ ID NO: 14520 - protein, 8 aa, Mycobacterium tuberculosis
GWEWIFFV

SEQ ID NO: 14521 - protein, 8 aa, Mycobacterium tuberculosis
WEWIFFVN

SEQ ID NO: 14522 - protein, 8 aa, Mycobacterium tuberculosis
EWIFFVNV

SEQ ID NO: 14523 - protein, 8 aa, Mycobacterium tuberculosis
WIFFVNVP

SEQ ID NO: 14524 - protein, 8 aa, Mycobacterium tuberculosis
IFFVNVPV

SEQ ID NO: 14525 - protein, 8 aa, Mycobacterium tuberculosis
FFVNVPVG

SEQ ID NO: 14526 - protein, 8 aa, Mycobacterium tuberculosis
FVNVPVGV

SEQ ID NO: 14527 - protein, 8 aa, Mycobacterium tuberculosis
VNVPVGVI

SEQ ID NO: 14528 - protein, 8 aa, Mycobacterium tuberculosis
NVPVGVIG

SEQ ID NO: 14529 - protein, 8 aa, Mycobacterium tuberculosis
VPVGVIGL

SEQ ID NO: 14530 - protein, 8 aa, Mycobacterium tuberculosis
PVGVIGLI

SEQ ID NO: 14531 - protein, 8 aa, Mycobacterium tuberculosis
VGVIGLIL

SEQ ID NO: 14532 - protein, 8 aa, Mycobacterium tuberculosis
GVIGLILA

SEQ ID NO: 14533 - protein, 8 aa, Mycobacterium tuberculosis
VIGLILAA

SEQ ID NO: 14534 - protein, 8 aa, Mycobacterium tuberculosis
IGLILAAY

SEQ ID NO: 14535 - protein, 8 aa, Mycobacterium tuberculosis
GLILAAYL

SEQ ID NO: 14536 - protein, 8 aa, Mycobacterium tuberculosis
LILAAYLI

SEQ ID NO: 14537 - protein, 8 aa, Mycobacterium tuberculosis
ILAAYLIP

SEQ ID NO: 14538 - protein, 8 aa, Mycobacterium tuberculosis
LAAYLIPA

SEQ ID NO: 14539 - protein, 8 aa, Mycobacterium tuberculosis
AAYLIPAL

SEQ ID NO: 14540 - protein, 8 aa, Mycobacterium tuberculosis
AYLIPALP

SEQ ID NO: 14541 - protein, 8 aa, Mycobacterium tuberculosis
YLIPALPH

SEQ ID NO: 14542 - protein, 8 aa, Mycobacterium tuberculosis
LIPALPHH

SEQ ID NO: 14543 - protein, 8 aa, Mycobacterium tuberculosis
IPALPHHP

SEQ ID NO: 14544 - protein, 8 aa, Mycobacterium tuberculosis
PALPHHPH

SEQ ID NO: 14545 - protein, 8 aa, Mycobacterium tuberculosis
ALPHHPHR

SEQ ID NO: 14546 - protein, 8 aa, Mycobacterium tuberculosis
LPHHPHRF

SEQ ID NO: 14547 - protein, 8 aa, Mycobacterium tuberculosis
PHHPHRFD

SEQ ID NO: 14548 - protein, 8 aa, Mycobacterium tuberculosis
HHPHRFDW

SEQ ID NO: 14549 - protein, 8 aa, Mycobacterium tuberculosis
HPHRFDWF

SEQ ID NO: 14550 - protein, 8 aa, Mycobacterium tuberculosis
PHRFDWFG

SEQ ID NO: 14551 - protein, 8 aa, Mycobacterium tuberculosis
HRFDWFGV

SEQ ID NO: 14552 - protein, 8 aa, Mycobacterium tuberculosis
RFDWFGVG

SEQ ID NO: 14553 - protein, 8 aa, Mycobacterium tuberculosis
FDWFGVGL

SEQ ID NO: 14554 - protein, 8 aa, Mycobacterium tuberculosis
DWFGVGLS

SEQ ID NO: 14555 - protein, 8 aa, Mycobacterium tuberculosis
WFGVGLSG

SEQ ID NO: 14556 - protein, 8 aa, Mycobacterium tuberculosis
FGVGLSGA

SEQ ID NO: 14557 - protein, 8 aa, Mycobacterium tuberculosis
GVGLSGAG

SEQ ID NO: 14558 - protein, 8 aa, Mycobacterium tuberculosis
VGLSGAGM

SEQ ID NO: 14559 - protein, 8 aa, Mycobacterium tuberculosis
GLSGAGMF

SEQ ID NO: 14560 - protein, 8 aa, Mycobacterium tuberculosis
LSGAGMFL

SEQ ID NO: 14561 - protein, 8 aa, Mycobacterium tuberculosis
SGAGMFLI

SEQ ID NO: 14562 - protein, 8 aa, Mycobacterium tuberculosis
GAGMFLIV

SEQ ID NO: 14563 - protein, 8 aa, Mycobacterium tuberculosis
AGMFLIVF

SEQ ID NO: 14564 - protein, 8 aa, Mycobacterium tuberculosis
GMFLIVFG

SEQ ID NO: 14565 - protein, 8 aa, Mycobacterium tuberculosis
MFLIVFGL

SEQ ID NO: 14566 - protein, 8 aa, Mycobacterium tuberculosis
FLIVFGLQ

SEQ ID NO: 14567 - protein, 8 aa, Mycobacterium tuberculosis
LIVFGLQQ

SEQ ID NO: 14568 - protein, 8 aa, Mycobacterium tuberculosis
IVFGLQQG

SEQ ID NO: 14569 - protein, 8 aa, Mycobacterium tuberculosis
VFGLQQGQ

SEQ ID NO: 14570 - protein, 8 aa, Mycobacterium tuberculosis
FGLQQGQS

SEQ ID NO: 14571 - protein, 8 aa, Mycobacterium tuberculosis
GLQQGQSA

SEQ ID NO: 14572 - protein, 8 aa, Mycobacterium tuberculosis
LQQGQSAN

SEQ ID NO: 14573 - protein, 8 aa, Mycobacterium tuberculosis
QQGQSANW

SEQ ID NO: 14574 - protein, 8 aa, Mycobacterium tuberculosis
QGQSANWQ

SEQ ID NO: 14575 - protein, 8 aa, Mycobacterium tuberculosis
GQSANWQP

SEQ ID NO: 14576 - protein, 8 aa, Mycobacterium tuberculosis
QSANWQPW

SEQ ID NO: 14577 - protein, 8 aa, Mycobacterium tuberculosis
SANWQPWI

SEQ ID NO: 14578 - protein, 8 aa, Mycobacterium tuberculosis
ANWQPWIW

SEQ ID NO: 14579 - protein, 8 aa, Mycobacterium tuberculosis
NWQPWIWA

SEQ ID NO: 14580 - protein, 8 aa, Mycobacterium tuberculosis
WQPWIWAV

SEQ ID NO: 14581 - protein, 8 aa, Mycobacterium tuberculosis
QPWIWAVI

SEQ ID NO: 14582 - protein, 8 aa, Mycobacterium tuberculosis
PWIWAVIV

SEQ ID NO: 14583 - protein, 8 aa, Mycobacterium tuberculosis
WIWAVIVG

SEQ ID NO: 14584 - protein, 8 aa, Mycobacterium tuberculosis
IWAVIVGG

SEQ ID NO: 14585 - protein, 8 aa, Mycobacterium tuberculosis
WAVIVGGI

SEQ ID NO: 14586 - protein, 8 aa, Mycobacterium tuberculosis
AVIVGGIG

SEQ ID NO: 14587 - protein, 8 aa, Mycobacterium tuberculosis
VIVGGIGF

SEQ ID NO: 14588 - protein, 8 aa, Mycobacterium tuberculosis
IVGGIGFM

SEQ ID NO: 14589 - protein, 8 aa, Mycobacterium tuberculosis
VGGIGFMS

SEQ ID NO: 14590 - protein, 8 aa, Mycobacterium tuberculosis
GGIGFMSL

SEQ ID NO: 14591 - protein, 8 aa, Mycobacterium tuberculosis
GIGFMSLF

SEQ ID NO: 14592 - protein, 8 aa, Mycobacterium tuberculosis
IGFMSLFV

SEQ ID NO: 14593 - protein, 8 aa, Mycobacterium tuberculosis
GFMSLFVY

SEQ ID NO: 14594 - protein, 8 aa, Mycobacterium tuberculosis
FMSLFVYW

SEQ ID NO: 14595 - protein, 8 aa, Mycobacterium tuberculosis
MSLFVYWQ

SEQ ID NO: 14596 - protein, 8 aa, Mycobacterium tuberculosis
SLFVYWQA

SEQ ID NO: 14597 - protein, 8 aa, Mycobacterium tuberculosis
LFVYWQAR

SEQ ID NO: 14598 - protein, 8 aa, Mycobacterium tuberculosis
FVYWQARN

SEQ ID NO: 14599 - protein, 8 aa, Mycobacterium tuberculosis
VYWQARNA

SEQ ID NO: 14600 - protein, 8 aa, Mycobacterium tuberculosis
YWQARNAR

SEQ ID NO: 14601 - protein, 8 aa, Mycobacterium tuberculosis
WQARNARE

SEQ ID NO: 14602 - protein, 8 aa, Mycobacterium tuberculosis
QARNAREP

SEQ ID NO: 14603 - protein, 8 aa, Mycobacterium tuberculosis
ARNAREPL

SEQ ID NO: 14604 - protein, 8 aa, Mycobacterium tuberculosis
RNAREPLI

SEQ ID NO: 14605 - protein, 8 aa, Mycobacterium tuberculosis
NAREPLIP

SEQ ID NO: 14606 - protein, 8 aa, Mycobacterium tuberculosis
AREPLIPL

SEQ ID NO: 14607 - protein, 8 aa, Mycobacterium tuberculosis
REPLIPLE

SEQ ID NO: 14608 - protein, 8 aa, Mycobacterium tuberculosis
EPLIPLEV

SEQ ID NO: 14609 - protein, 8 aa, Mycobacterium tuberculosis
PLIPLEVF

SEQ ID NO: 14610 - protein, 8 aa, Mycobacterium tuberculosis
LIPLEVFN

SEQ ID NO: 14611 - protein, 8 aa, Mycobacterium tuberculosis
IPLEVFND

SEQ ID NO: 14612 - protein, 8 aa, Mycobacterium tuberculosis
PLEVFNDR

SEQ ID NO: 14613 - protein, 8 aa, Mycobacterium tuberculosis
LEVFNDRN

SEQ ID NO: 14614 - protein, 8 aa, Mycobacterium tuberculosis
EVFNDRNF

SEQ ID NO: 14615 - protein, 8 aa, Mycobacterium tuberculosis
VFNDRNFS

SEQ ID NO: 14616 - protein, 8 aa, Mycobacterium tuberculosis
FNDRNFSL

SEQ ID NO: 14617 - protein, 8 aa, Mycobacterium tuberculosis
NDRNFSLS

SEQ ID NO: 14618 - protein, 8 aa, Mycobacterium tuberculosis
DRNFSLSN

SEQ ID NO: 14619 - protein, 8 aa, Mycobacterium tuberculosis
RNFSLSNL

SEQ ID NO: 14620 - protein, 8 aa, Mycobacterium tuberculosis
NFSLSNLR

SEQ ID NO: 14621 - protein, 8 aa, Mycobacterium tuberculosis
FSLSNLRI

SEQ ID NO: 14622 - protein, 8 aa, Mycobacterium tuberculosis
SLSNLRIA

SEQ ID NO: 14623 - protein, 8 aa, Mycobacterium tuberculosis
LSNLRIAI

SEQ ID NO: 14624 - protein, 8 aa, Mycobacterium tuberculosis
SNLRIAII

SEQ ID NO: 14625 - protein, 8 aa, Mycobacterium tuberculosis
NLRIAIIA

SEQ ID NO: 14626 - protein, 8 aa, Mycobacterium tuberculosis
LRIAIIAF

SEQ ID NO: 14627 - protein, 8 aa, Mycobacterium tuberculosis
RIAIIAFA

SEQ ID NO: 14628 - protein, 8 aa, Mycobacterium tuberculosis
IAIIAFAG

SEQ ID NO: 14629 - protein, 8 aa, Mycobacterium tuberculosis
AIIAFAGT

SEQ ID NO: 14630 - protein, 8 aa, Mycobacterium tuberculosis
IIAFAGTG

SEQ ID NO: 14631 - protein, 8 aa, Mycobacterium tuberculosis
IAFAGTGM

SEQ ID NO: 14632 - protein, 8 aa, Mycobacterium tuberculosis
AFAGTGMM

SEQ ID NO: 14633 - protein, 8 aa, Mycobacterium tuberculosis
FAGTGMML

SEQ ID NO: 14634 - protein, 8 aa, Mycobacterium tuberculosis
AGTGMMLP

SEQ ID NO: 14635 - protein, 8 aa, Mycobacterium tuberculosis
GTGMMLPV

SEQ ID NO: 14636 - protein, 8 aa, Mycobacterium tuberculosis
TGMMLPVT

SEQ ID NO: 14637 - protein, 8 aa, Mycobacterium tuberculosis
GMMLPVTF

SEQ ID NO: 14638 - protein, 8 aa, Mycobacterium tuberculosis
MMLPVTFY

SEQ ID NO: 14639 - protein, 8 aa, Mycobacterium tuberculosis
MLPVTFYA

SEQ ID NO: 14640 - protein, 8 aa, Mycobacterium tuberculosis
LPVTFYAQ

SEQ ID NO: 14641 - protein, 8 aa, Mycobacterium tuberculosis
PVTFYAQA

SEQ ID NO: 14642 - protein, 8 aa, Mycobacterium tuberculosis
VTFYAQAV

SEQ ID NO: 14643 - protein, 8 aa, Mycobacterium tuberculosis
TFYAQAVC

SEQ ID NO: 14644 - protein, 8 aa, Mycobacterium tuberculosis
FYAQAVCG

SEQ ID NO: 14645 - protein, 8 aa, Mycobacterium tuberculosis
YAQAVCGL

SEQ ID NO: 14646 - protein, 8 aa, Mycobacterium tuberculosis
AQAVCGLS

SEQ ID NO: 14647 - protein, 8 aa, Mycobacterium tuberculosis
QAVCGLSP

SEQ ID NO: 14648 - protein, 8 aa, Mycobacterium tuberculosis
AVCGLSPT

SEQ ID NO: 14649 - protein, 8 aa, Mycobacterium tuberculosis
VCGLSPTH

SEQ ID NO: 14650 - protein, 8 aa, Mycobacterium tuberculosis
CGLSPTHT

SEQ ID NO: 14651 - protein, 8 aa, Mycobacterium tuberculosis
GLSPTHTA

SEQ ID NO: 14652 - protein, 8 aa, Mycobacterium tuberculosis
LSPTHTAV

SEQ ID NO: 14653 - protein, 8 aa, Mycobacterium tuberculosis
SPTHTAVL

SEQ ID NO: 14654 - protein, 8 aa, Mycobacterium tuberculosis
PTHTAVLF

SEQ ID NO: 14655 - protein, 8 aa, Mycobacterium tuberculosis
THTAVLFA

SEQ ID NO: 14656 - protein, 8 aa, Mycobacterium tuberculosis
HTAVLFAP

SEQ ID NO: 14657 - protein, 8 aa, Mycobacterium tuberculosis
TAVLFAPT

SEQ ID NO: 14658 - protein, 8 aa, Mycobacterium tuberculosis
AVLFAPTA

SEQ ID NO: 14659 - protein, 8 aa, Mycobacterium tuberculosis
VLFAPTAI

SEQ ID NO: 14660 - protein, 8 aa, Mycobacterium tuberculosis
LFAPTAIV

SEQ ID NO: 14661 - protein, 8 aa, Mycobacterium tuberculosis
FAPTAIVG

SEQ ID NO: 14662 - protein, 8 aa, Mycobacterium tuberculosis
APTAIVGG

SEQ ID NO: 14663 - protein, 8 aa, Mycobacterium tuberculosis
PTAIVGGV

SEQ ID NO: 14664 - protein, 8 aa, Mycobacterium tuberculosis
TAIVGGVL

SEQ ID NO: 14665 - protein, 8 aa, Mycobacterium tuberculosis
AIVGGVLA

SEQ ID NO: 14666 - protein, 8 aa, Mycobacterium tuberculosis
IVGGVLAP

SEQ ID NO: 14667 - protein, 8 aa, Mycobacterium tuberculosis
VGGVLAPF

SEQ ID NO: 14668 - protein, 8 aa, Mycobacterium tuberculosis
GGVLAPFV

SEQ ID NO: 14669 - protein, 8 aa, Mycobacterium tuberculosis
GVLAPFVG

SEQ ID NO: 14670 - protein, 8 aa, Mycobacterium tuberculosis
VLAPFVGM

SEQ ID NO: 14671 - protein, 8 aa, Mycobacterium tuberculosis
LAPFVGMI

SEQ ID NO: 14672 - protein, 8 aa, Mycobacterium tuberculosis
APFVGMII

SEQ ID NO: 14673 - protein, 8 aa, Mycobacterium tuberculosis
PFVGMIID

SEQ ID NO: 14674 - protein, 8 aa, Mycobacterium tuberculosis
FVGMIIDR

SEQ ID NO: 14675 - protein, 8 aa, Mycobacterium tuberculosis
VGMIIDRS

SEQ ID NO: 14676 - protein, 8 aa, Mycobacterium tuberculosis
GMIIDRSH

SEQ ID NO: 14677 - protein, 8 aa, Mycobacterium tuberculosis
MIIDRSHP

SEQ ID NO: 14678 - protein, 8 aa, Mycobacterium tuberculosis
IIDRSHPL

SEQ ID NO: 14679 - protein, 8 aa, Mycobacterium tuberculosis
IDRSHPLC

SEQ ID NO: 14680 - protein, 8 aa, Mycobacterium tuberculosis
DRSHPLCV

SEQ ID NO: 14681 - protein, 8 aa, Mycobacterium tuberculosis
RSHPLCVL

SEQ ID NO: 14682 - protein, 8 aa, Mycobacterium tuberculosis
SHPLCVLG

SEQ ID NO: 14683 - protein, 8 aa, Mycobacterium tuberculosis
HPLCVLGF

SEQ ID NO: 14684 - protein, 8 aa, Mycobacterium tuberculosis
PLCVLGFG

SEQ ID NO: 14685 - protein, 8 aa, Mycobacterium tuberculosis
LCVLGFGF

SEQ ID NO: 14686 - protein, 8 aa, Mycobacterium tuberculosis
CVLGFGFS

SEQ ID NO: 14687 - protein, 8 aa, Mycobacterium tuberculosis
VLGFGFSV

SEQ ID NO: 14688 - protein, 8 aa, Mycobacterium tuberculosis
LGFGFSVL

SEQ ID NO: 14689 - protein, 8 aa, Mycobacterium tuberculosis
GFGFSVLA

SEQ ID NO: 14690 - protein, 8 aa, Mycobacterium tuberculosis
FGFSVLAI

SEQ ID NO: 14691 - protein, 8 aa, Mycobacterium tuberculosis
GFSVLAIA

SEQ ID NO: 14692 - protein, 8 aa, Mycobacterium tuberculosis
FSVLAIAM

SEQ ID NO: 14693 - protein, 8 aa, Mycobacterium tuberculosis
SVLAIAMT

SEQ ID NO: 14694 - protein, 8 aa, Mycobacterium tuberculosis
VLAIAMTW

SEQ ID NO: 14695 - protein, 8 aa, Mycobacterium tuberculosis
LAIAMTWL

SEQ ID NO: 14696 - protein, 8 aa, Mycobacterium tuberculosis
AIAMTWLL

SEQ ID NO: 14697 - protein, 8 aa, Mycobacterium tuberculosis
IAMTWLLC

SEQ ID NO: 14698 - protein, 8 aa, Mycobacterium tuberculosis
AMTWLLCE

SEQ ID NO: 14699 - protein, 8 aa, Mycobacterium tuberculosis
MTWLLCEM

SEQ ID NO: 14700 - protein, 8 aa, Mycobacterium tuberculosis
TWLLCEMA

SEQ ID NO: 14701 - protein, 8 aa, Mycobacterium tuberculosis
WLLCEMAP

SEQ ID NO: 14702 - protein, 8 aa, Mycobacterium tuberculosis
LLCEMAPG

SEQ ID NO: 14703 - protein, 8 aa, Mycobacterium tuberculosis
LCEMAPGT

SEQ ID NO: 14704 - protein, 8 aa, Mycobacterium tuberculosis
CEMAPGTP

SEQ ID NO: 14705 - protein, 8 aa, Mycobacterium tuberculosis
EMAPGTPI

SEQ ID NO: 14706 - protein, 8 aa, Mycobacterium tuberculosis
MAPGTPIW

SEQ ID NO: 14707 - protein, 8 aa, Mycobacterium tuberculosis
APGTPIWR

SEQ ID NO: 14708 - protein, 8 aa, Mycobacterium tuberculosis
PGTPIWRL

SEQ ID NO: 14709 - protein, 8 aa, Mycobacterium tuberculosis
GTPIWRLV

SEQ ID NO: 14710 - protein, 8 aa, Mycobacterium tuberculosis
TPIWRLVL

SEQ ID NO: 14711 - protein, 8 aa, Mycobacterium tuberculosis
PIWRLVLP

SEQ ID NO: 14712 - protein, 8 aa, Mycobacterium tuberculosis
IWRLVLPF

SEQ ID NO: 14713 - protein, 8 aa, Mycobacterium tuberculosis
WRLVLPFI

SEQ ID NO: 14714 - protein, 8 aa, Mycobacterium tuberculosis
RLVLPFIA

SEQ ID NO: 14715 - protein, 8 aa, Mycobacterium tuberculosis
LVLPFIAL

SEQ ID NO: 14716 - protein, 8 aa, Mycobacterium tuberculosis
VLPFIALG

SEQ ID NO: 14717 - protein, 8 aa, Mycobacterium tuberculosis
LPFIALGV

SEQ ID NO: 14718 - protein, 8 aa, Mycobacterium tuberculosis
PFIALGVA

SEQ ID NO: 14719 - protein, 8 aa, Mycobacterium tuberculosis
FIALGVAG

SEQ ID NO: 14720 - protein, 8 aa, Mycobacterium tuberculosis
IALGVAGA

SEQ ID NO: 14721 - protein, 8 aa, Mycobacterium tuberculosis
ALGVAGAF

SEQ ID NO: 14722 - protein, 8 aa, Mycobacterium tuberculosis
LGVAGAFV

SEQ ID NO: 14723 - protein, 8 aa, Mycobacterium tuberculosis
GVAGAFVW

SEQ ID NO: 14724 - protein, 8 aa, Mycobacterium tuberculosis
VAGAFVWS

SEQ ID NO: 14725 - protein, 8 aa, Mycobacterium tuberculosis
AGAFVWSP

SEQ ID NO: 14726 - protein, 8 aa, Mycobacterium tuberculosis
GAFVWSPL

SEQ ID NO: 14727 - protein, 8 aa, Mycobacterium tuberculosis
AFVWSPLT

SEQ ID NO: 14728 - protein, 8 aa, Mycobacterium tuberculosis
FVWSPLTV

SEQ ID NO: 14729 - protein, 8 aa, Mycobacterium tuberculosis
VWSPLTVT

SEQ ID NO: 14730 - protein, 8 aa, Mycobacterium tuberculosis
WSPLTVTA

SEQ ID NO: 14731 - protein, 8 aa, Mycobacterium tuberculosis
SPLTVTAT

SEQ ID NO: 14732 - protein, 8 aa, Mycobacterium tuberculosis
PLTVTATR

SEQ ID NO: 14733 - protein, 8 aa, Mycobacterium tuberculosis
LTVTATRN

SEQ ID NO: 14734 - protein, 8 aa, Mycobacterium tuberculosis
TVTATRNL

SEQ ID NO: 14735 - protein, 8 aa, Mycobacterium tuberculosis
VTATRNLR

SEQ ID NO: 14736 - protein, 8 aa, Mycobacterium tuberculosis
TATRNLRP

SEQ ID NO: 14737 - protein, 8 aa, Mycobacterium tuberculosis
ATRNLRPH

SEQ ID NO: 14738 - protein, 8 aa, Mycobacterium tuberculosis
TRNLRPHL

SEQ ID NO: 14739 - protein, 8 aa, Mycobacterium tuberculosis
RNLRPHLA

SEQ ID NO: 14740 - protein, 8 aa, Mycobacterium tuberculosis
NLRPHLAG

SEQ ID NO: 14741 - protein, 8 aa, Mycobacterium tuberculosis
LRPHLAGA

SEQ ID NO: 14742 - protein, 8 aa, Mycobacterium tuberculosis
RPHLAGAS

SEQ ID NO: 14743 - protein, 8 aa, Mycobacterium tuberculosis
PHLAGASS

SEQ ID NO: 14744 - protein, 8 aa, Mycobacterium tuberculosis
HLAGASSG

SEQ ID NO: 14745 - protein, 8 aa, Mycobacterium tuberculosis
LAGASSGV

SEQ ID NO: 14746 - protein, 8 aa, Mycobacterium tuberculosis
AGASSGVF

SEQ ID NO: 14747 - protein, 8 aa, Mycobacterium tuberculosis
GASSGVFN

SEQ ID NO: 14748 - protein, 8 aa, Mycobacterium tuberculosis
ASSGVFNA

SEQ ID NO: 14749 - protein, 8 aa, Mycobacterium tuberculosis
SSGVFNAV

SEQ ID NO: 14750 - protein, 8 aa, Mycobacterium tuberculosis
SGVFNAVR

SEQ ID NO: 14751 - protein, 8 aa, Mycobacterium tuberculosis
GVFNAVRQ

SEQ ID NO: 14752 - protein, 8 aa, Mycobacterium tuberculosis
VFNAVRQL

SEQ ID NO: 14753 - protein, 8 aa, Mycobacterium tuberculosis
FNAVRQLG

SEQ ID NO: 14754 - protein, 8 aa, Mycobacterium tuberculosis
NAVRQLGA

SEQ ID NO: 14755 - protein, 8 aa, Mycobacterium tuberculosis
AVRQLGAV

SEQ ID NO: 14756 - protein, 8 aa, Mycobacterium tuberculosis
VRQLGAVL

SEQ ID NO: 14757 - protein, 8 aa, Mycobacterium tuberculosis
RQLGAVLG

SEQ ID NO: 14758 - protein, 8 aa, Mycobacterium tuberculosis
QLGAVLGS

SEQ ID NO: 14759 - protein, 8 aa, Mycobacterium tuberculosis
LGAVLGSA

SEQ ID NO: 14760 - protein, 8 aa, Mycobacterium tuberculosis
GAVLGSAS

SEQ ID NO: 14761 - protein, 8 aa, Mycobacterium tuberculosis
AVLGSASM

SEQ ID NO: 14762 - protein, 8 aa, Mycobacterium tuberculosis
VLGSASMA

SEQ ID NO: 14763 - protein, 8 aa, Mycobacterium tuberculosis
LGSASMAA

SEQ ID NO: 14764 - protein, 8 aa, Mycobacterium tuberculosis
GSASMAAF

SEQ ID NO: 14765 - protein, 8 aa, Mycobacterium tuberculosis
SASMAAFM

SEQ ID NO: 14766 - protein, 8 aa, Mycobacterium tuberculosis
ASMAAFMT

SEQ ID NO: 14767 - protein, 8 aa, Mycobacterium tuberculosis
SMAAFMTS

SEQ ID NO: 14768 - protein, 8 aa, Mycobacterium tuberculosis
MAAFMTSR

SEQ ID NO: 14769 - protein, 8 aa, Mycobacterium tuberculosis
AAFMTSRI

SEQ ID NO: 14770 - protein, 8 aa, Mycobacterium tuberculosis
AFMTSRIA

SEQ ID NO: 14771 - protein, 8 aa, Mycobacterium tuberculosis
FMTSRIAA

SEQ ID NO: 14772 - protein, 8 aa, Mycobacterium tuberculosis
MTSRIAAE

SEQ ID NO: 14773 - protein, 8 aa, Mycobacterium tuberculosis
TSRIAAEM

SEQ ID NO: 14774 - protein, 8 aa, Mycobacterium tuberculosis
SRIAAEMP

SEQ ID NO: 14775 - protein, 8 aa, Mycobacterium tuberculosis
RIAAEMPG

SEQ ID NO: 14776 - protein, 8 aa, Mycobacterium tuberculosis
IAAEMPGG

SEQ ID NO: 14777 - protein, 8 aa, Mycobacterium tuberculosis
AAEMPGGV

SEQ ID NO: 14778 - protein, 8 aa, Mycobacterium tuberculosis
AEMPGGVD

SEQ ID NO: 14779 - protein, 8 aa, Mycobacterium tuberculosis
EMPGGVDA

SEQ ID NO: 14780 - protein, 8 aa, Mycobacterium tuberculosis
MPGGVDAL

SEQ ID NO: 14781 - protein, 8 aa, Mycobacterium tuberculosis
PGGVDALT

SEQ ID NO: 14782 - protein, 8 aa, Mycobacterium tuberculosis
GGVDALTG

SEQ ID NO: 14783 - protein, 8 aa, Mycobacterium tuberculosis
GVDALTGP

SEQ ID NO: 14784 - protein, 8 aa, Mycobacterium tuberculosis
VDALTGPA

SEQ ID NO: 14785 - protein, 8 aa, Mycobacterium tuberculosis
DALTGPAG

SEQ ID NO: 14786 - protein, 8 aa, Mycobacterium tuberculosis
ALTGPAGQ

SEQ ID NO: 14787 - protein, 8 aa, Mycobacterium tuberculosis
LTGPAGQD

SEQ ID NO: 14788 - protein, 8 aa, Mycobacterium tuberculosis
TGPAGQDA

SEQ ID NO: 14789 - protein, 8 aa, Mycobacterium tuberculosis
GPAGQDAT

SEQ ID NO: 14790 - protein, 8 aa, Mycobacterium tuberculosis
PAGQDATV

SEQ ID NO: 14791 - protein, 8 aa, Mycobacterium tuberculosis
AGQDATVL

SEQ ID NO: 14792 - protein, 8 aa, Mycobacterium tuberculosis
GQDATVLQ

SEQ ID NO: 14793 - protein, 8 aa, Mycobacterium tuberculosis
QDATVLQL

SEQ ID NO: 14794 - protein, 8 aa, Mycobacterium tuberculosis
DATVLQLP

SEQ ID NO: 14795 - protein, 8 aa, Mycobacterium tuberculosis
ATVLQLPE

SEQ ID NO: 14796 - protein, 8 aa, Mycobacterium tuberculosis
TVLQLPEF

SEQ ID NO: 14797 - protein, 8 aa, Mycobacterium tuberculosis
VLQLPEFV

SEQ ID NO: 14798 - protein, 8 aa, Mycobacterium tuberculosis
LQLPEFVR

SEQ ID NO: 14799 - protein, 8 aa, Mycobacterium tuberculosis
QLPEFVRE

SEQ ID NO: 14800 - protein, 8 aa, Mycobacterium tuberculosis
LPEFVREP

SEQ ID NO: 14801 - protein, 8 aa, Mycobacterium tuberculosis
PEFVREPF

SEQ ID NO: 14802 - protein, 8 aa, Mycobacterium tuberculosis
EFVREPFA

SEQ ID NO: 14803 - protein, 8 aa, Mycobacterium tuberculosis
FVREPFAA

SEQ ID NO: 14804 - protein, 8 aa, Mycobacterium tuberculosis
VREPFAAA

SEQ ID NO: 14805 - protein, 8 aa, Mycobacterium tuberculosis
REPFAAAM

SEQ ID NO: 14806 - protein, 8 aa, Mycobacterium tuberculosis
EPFAAAMS

SEQ ID NO: 14807 - protein, 8 aa, Mycobacterium tuberculosis
PFAAAMSQ

SEQ ID NO: 14808 - protein, 8 aa, Mycobacterium tuberculosis
FAAAMSQS

SEQ ID NO: 14809 - protein, 8 aa, Mycobacterium tuberculosis
AAAMSQSM

SEQ ID NO: 14810 - protein, 8 aa, Mycobacterium tuberculosis
AAMSQSML

SEQ ID NO: 14811 - protein, 8 aa, Mycobacterium tuberculosis
AMSQSMLL

SEQ ID NO: 14812 - protein, 8 aa, Mycobacterium tuberculosis
MSQSMLLP

SEQ ID NO: 14813 - protein, 8 aa, Mycobacterium tuberculosis
SQSMLLPA

SEQ ID NO: 14814 - protein, 8 aa, Mycobacterium tuberculosis
QSMLLPAF

SEQ ID NO: 14815 - protein, 8 aa, Mycobacterium tuberculosis
SMLLPAFV

SEQ ID NO: 14816 - protein, 8 aa, Mycobacterium tuberculosis
MLLPAFVA

SEQ ID NO: 14817 - protein, 8 aa, Mycobacterium tuberculosis
LLPAFVAL

SEQ ID NO: 14818 - protein, 8 aa, Mycobacterium tuberculosis
LPAFVALF

SEQ ID NO: 14819 - protein, 8 aa, Mycobacterium tuberculosis
PAFVALFG

SEQ ID NO: 14820 - protein, 8 aa, Mycobacterium tuberculosis
AFVALFGI

SEQ ID NO: 14821 - protein, 8 aa, Mycobacterium tuberculosis
FVALFGIV

SEQ ID NO: 14822 - protein, 8 aa, Mycobacterium tuberculosis
VALFGIVA

SEQ ID NO: 14823 - protein, 8 aa, Mycobacterium tuberculosis
ALFGIVAA

SEQ ID NO: 14824 - protein, 8 aa, Mycobacterium tuberculosis
LFGIVAAL

SEQ ID NO: 14825 - protein, 8 aa, Mycobacterium tuberculosis
FGIVAALF

SEQ ID NO: 14826 - protein, 8 aa, Mycobacterium tuberculosis
GIVAALFL

SEQ ID NO: 14827 - protein, 8 aa, Mycobacterium tuberculosis
IVAALFLV

SEQ ID NO: 14828 - protein, 8 aa, Mycobacterium tuberculosis
VAALFLVD

SEQ ID NO: 14829 - protein, 8 aa, Mycobacterium tuberculosis
AALFLVDF

SEQ ID NO: 14830 - protein, 8 aa, Mycobacterium tuberculosis
ALFLVDFT

SEQ ID NO: 14831 - protein, 8 aa, Mycobacterium tuberculosis
LFLVDFTG

SEQ ID NO: 14832 - protein, 8 aa, Mycobacterium tuberculosis
FLVDFTGA

SEQ ID NO: 14833 - protein, 8 aa, Mycobacterium tuberculosis
LVDFTGAA

SEQ ID NO: 14834 - protein, 8 aa, Mycobacterium tuberculosis
VDFTGAAV

SEQ ID NO: 14835 - protein, 8 aa, Mycobacterium tuberculosis
DFTGAAVA

SEQ ID NO: 14836 - protein, 8 aa, Mycobacterium tuberculosis
FTGAAVAK

SEQ ID NO: 14837 - protein, 8 aa, Mycobacterium tuberculosis
TGAAVAKE

SEQ ID NO: 14838 - protein, 8 aa, Mycobacterium tuberculosis
GAAVAKEP

SEQ ID NO: 14839 - protein, 8 aa, Mycobacterium tuberculosis
AAVAKEPL

SEQ ID NO: 14840 - protein, 8 aa, Mycobacterium tuberculosis
AVAKEPLP

SEQ ID NO: 14841 - protein, 8 aa, Mycobacterium tuberculosis
VAKEPLPE

SEQ ID NO: 14842 - protein, 8 aa, Mycobacterium tuberculosis
AKEPLPES

SEQ ID NO: 14843 - protein, 8 aa, Mycobacterium tuberculosis
KEPLPESD

SEQ ID NO: 14844 - protein, 8 aa, Mycobacterium tuberculosis
EPLPESDG

SEQ ID NO: 14845 - protein, 8 aa, Mycobacterium tuberculosis
PLPESDGD

SEQ ID NO: 14846 - protein, 8 aa, Mycobacterium tuberculosis
LPESDGDA

SEQ ID NO: 14847 - protein, 8 aa, Mycobacterium tuberculosis
PESDGDAD

SEQ ID NO: 14848 - protein, 8 aa, Mycobacterium tuberculosis
ESDGDADD

SEQ ID NO: 14849 - protein, 8 aa, Mycobacterium tuberculosis
SDGDADDD

SEQ ID NO: 14850 - protein, 8 aa, Mycobacterium tuberculosis
DGDADDDD

SEQ ID NO: 14851 - protein, 8 aa, Mycobacterium tuberculosis
GDADDDDY

SEQ ID NO: 14852 - protein, 8 aa, Mycobacterium tuberculosis
DADDDDYV

SEQ ID NO: 14853 - protein, 8 aa, Mycobacterium tuberculosis
ADDDDYVE

SEQ ID NO: 14854 - protein, 8 aa, Mycobacterium tuberculosis
DDDDYVEY

SEQ ID NO: 14855 - protein, 8 aa, Mycobacterium tuberculosis
DDDYVEYI

SEQ ID NO: 14856 - protein, 8 aa, Mycobacterium tuberculosis
DDYVEYIL

SEQ ID NO: 14857 - protein, 8 aa, Mycobacterium tuberculosis
DYVEYILR

SEQ ID NO: 14858 - protein, 8 aa, Mycobacterium tuberculosis
YVEYILRR

SEQ ID NO: 14859 - protein, 8 aa, Mycobacterium tuberculosis
VEYILRRE

SEQ ID NO: 14860 - protein, 8 aa, Mycobacterium tuberculosis
EYILRREP

SEQ ID NO: 14861 - protein, 8 aa, Mycobacterium tuberculosis
YILRREPE

SEQ ID NO: 14862 - protein, 8 aa, Mycobacterium tuberculosis
ILRREPEE

SEQ ID NO: 14863 - protein, 8 aa, Mycobacterium tuberculosis
LRREPEED

SEQ ID NO: 14864 - protein, 8 aa, Mycobacterium tuberculosis
RREPEEDC

SEQ ID NO: 14865 - protein, 8 aa, Mycobacterium tuberculosis
REPEEDCD

SEQ ID NO: 14866 - protein, 8 aa, Mycobacterium tuberculosis
EPEEDCDT

SEQ ID NO: 14867 - protein, 8 aa, Mycobacterium tuberculosis
PEEDCDTQ

SEQ ID NO: 14868 - protein, 8 aa, Mycobacterium tuberculosis
EEDCDTQP

SEQ ID NO: 14869 - protein, 8 aa, Mycobacterium tuberculosis
EDCDTQPL

SEQ ID NO: 14870 - protein, 8 aa, Mycobacterium tuberculosis
DCDTQPLR

SEQ ID NO: 14871 - protein, 8 aa, Mycobacterium tuberculosis
CDTQPLRA

SEQ ID NO: 14872 - protein, 8 aa, Mycobacterium tuberculosis
DTQPLRAS

SEQ ID NO: 14873 - protein, 8 aa, Mycobacterium tuberculosis
TQPLRASR

SEQ ID NO: 14874 - protein, 8 aa, Mycobacterium tuberculosis
QPLRASRP

SEQ ID NO: 14875 - protein, 8 aa, Mycobacterium tuberculosis
PLRASRPA

SEQ ID NO: 14876 - protein, 8 aa, Mycobacterium tuberculosis
LRASRPAA

SEQ ID NO: 14877 - protein, 8 aa, Mycobacterium tuberculosis
RASRPAAA

SEQ ID NO: 14878 - protein, 8 aa, Mycobacterium tuberculosis
ASRPAAAA

SEQ ID NO: 14879 - protein, 8 aa, Mycobacterium tuberculosis
SRPAAAAA

SEQ ID NO: 14880 - protein, 8 aa, Mycobacterium tuberculosis
RPAAAAAS

SEQ ID NO: 14881 - protein, 8 aa, Mycobacterium tuberculosis
PAAAAASR

SEQ ID NO: 14882 - protein, 8 aa, Mycobacterium tuberculosis
AAAAASRS

SEQ ID NO: 14883 - protein, 8 aa, Mycobacterium tuberculosis
AAAASRSG

SEQ ID NO: 14884 - protein, 8 aa, Mycobacterium tuberculosis
AAASRSGA

SEQ ID NO: 14885 - protein, 8 aa, Mycobacterium tuberculosis
AASRSGAG

SEQ ID NO: 14886 - protein, 8 aa, Mycobacterium tuberculosis
ASRSGAGG

SEQ ID NO: 14887 - protein, 8 aa, Mycobacterium tuberculosis
SRSGAGGP

SEQ ID NO: 14888 - protein, 8 aa, Mycobacterium tuberculosis
RSGAGGPL

SEQ ID NO: 14889 - protein, 8 aa, Mycobacterium tuberculosis
SGAGGPLA

SEQ ID NO: 14890 - protein, 8 aa, Mycobacterium tuberculosis
GAGGPLAV

SEQ ID NO: 14891 - protein, 8 aa, Mycobacterium tuberculosis
AGGPLAVS

SEQ ID NO: 14892 - protein, 8 aa, Mycobacterium tuberculosis
GGPLAVSW

SEQ ID NO: 14893 - protein, 8 aa, Mycobacterium tuberculosis
GPLAVSWS

SEQ ID NO: 14894 - protein, 8 aa, Mycobacterium tuberculosis
PLAVSWST

SEQ ID NO: 14895 - protein, 8 aa, Mycobacterium tuberculosis
LAVSWSTS

SEQ ID NO: 14896 - protein, 8 aa, Mycobacterium tuberculosis
AVSWSTSA

SEQ ID NO: 14897 - protein, 8 aa, Mycobacterium tuberculosis
VSWSTSAQ

SEQ ID NO: 14898 - protein, 8 aa, Mycobacterium tuberculosis
SWSTSAQG

SEQ ID NO: 14899 - protein, 8 aa, Mycobacterium tuberculosis
WSTSAQGM

SEQ ID NO: 14900 - protein, 8 aa, Mycobacterium tuberculosis
STSAQGMP

SEQ ID NO: 14901 - protein, 8 aa, Mycobacterium tuberculosis
TSAQGMPP

SEQ ID NO: 14902 - protein, 8 aa, Mycobacterium tuberculosis
SAQGMPPG

SEQ ID NO: 14903 - protein, 8 aa, Mycobacterium tuberculosis
AQGMPPGP

SEQ ID NO: 14904 - protein, 8 aa, Mycobacterium tuberculosis
QGMPPGPP

SEQ ID NO: 14905 - protein, 8 aa, Mycobacterium tuberculosis
GMPPGPPG

SEQ ID NO: 14906 - protein, 8 aa, Mycobacterium tuberculosis
MPPGPPGR

SEQ ID NO: 14907 - protein, 8 aa, Mycobacterium tuberculosis
PPGPPGRR

SEQ ID NO: 14908 - protein, 8 aa, Mycobacterium tuberculosis
PGPPGRRA

SEQ ID NO: 14909 - protein, 8 aa, Mycobacterium tuberculosis
GPPGRRAW

SEQ ID NO: 14910 - protein, 8 aa, Mycobacterium tuberculosis
PPGRRAWQ

SEQ ID NO: 14911 - protein, 8 aa, Mycobacterium tuberculosis
PGRRAWQA

SEQ ID NO: 14912 - protein, 8 aa, Mycobacterium tuberculosis
GRRAWQAD

SEQ ID NO: 14913 - protein, 8 aa, Mycobacterium tuberculosis
RRAWQADT

SEQ ID NO: 14914 - protein, 8 aa, Mycobacterium tuberculosis
RAWQADTE

SEQ ID NO: 14915 - protein, 8 aa, Mycobacterium tuberculosis
AWQADTES

SEQ ID NO: 14916 - protein, 8 aa, Mycobacterium tuberculosis
WQADTEST

SEQ ID NO: 14917 - protein, 8 aa, Mycobacterium tuberculosis
QADTESTA

SEQ ID NO: 14918 - protein, 8 aa, Mycobacterium tuberculosis
ADTESTAP

SEQ ID NO: 14919 - protein, 8 aa, Mycobacterium tuberculosis
DTESTAPS

SEQ ID NO: 14920 - protein, 8 aa, Mycobacterium tuberculosis
TESTAPSA

SEQ ID NO: 14921 - protein, 9 aa, Mycobacterium tuberculosis
MTTAIRRAA

SEQ ID NO: 14922 - protein, 9 aa, Mycobacterium tuberculosis
TTAIRRAAG

SEQ ID NO: 14923 - protein, 9 aa, Mycobacterium tuberculosis
TAIRRAAGS

SEQ ID NO: 14924 - protein, 9 aa, Mycobacterium tuberculosis
AIRRAAGSS

SEQ ID NO: 14925 - protein, 9 aa, Mycobacterium tuberculosis
IRRAAGSSY

SEQ ID NO: 14926 - protein, 9 aa, Mycobacterium tuberculosis
RRAAGSSYF

SEQ ID NO: 14927 - protein, 9 aa, Mycobacterium tuberculosis
RAAGSSYFR

SEQ ID NO: 14928 - protein, 9 aa, Mycobacterium tuberculosis
AAGSSYFRN

SEQ ID NO: 14929 - protein, 9 aa, Mycobacterium tuberculosis
AGSSYFRNP

SEQ ID NO: 14930 - protein, 9 aa, Mycobacterium tuberculosis
GSSYFRNPW

SEQ ID NO: 14931 - protein, 9 aa, Mycobacterium tuberculosis
SSYFRNPWP

SEQ ID NO: 14932 - protein, 9 aa, Mycobacterium tuberculosis
SYFRNPWPA

SEQ ID NO: 14933 - protein, 9 aa, Mycobacterium tuberculosis
YFRNPWPAL

SEQ ID NO: 14934 - protein, 9 aa, Mycobacterium tuberculosis
FRNPWPALW

SEQ ID NO: 14935 - protein, 9 aa, Mycobacterium tuberculosis
RNPWPALWA

SEQ ID NO: 14936 - protein, 9 aa, Mycobacterium tuberculosis
NPWPALWAM

SEQ ID NO: 14937 - protein, 9 aa, Mycobacterium tuberculosis
PWPALWAMM

SEQ ID NO: 14938 - protein, 9 aa, Mycobacterium tuberculosis
WPALWAMMV

SEQ ID NO: 14939 - protein, 9 aa, Mycobacterium tuberculosis
PALWAMMVG

SEQ ID NO: 14940 - protein, 9 aa, Mycobacterium tuberculosis
ALWAMMVGF

SEQ ID NO: 14941 - protein, 9 aa, Mycobacterium tuberculosis
LWAMMVGFF

SEQ ID NO: 14942 - protein, 9 aa, Mycobacterium tuberculosis
WAMMVGFFM

SEQ ID NO: 14943 - protein, 9 aa, Mycobacterium tuberculosis
AMMVGFFMI

SEQ ID NO: 14944 - protein, 9 aa, Mycobacterium tuberculosis
MMVGFFMIM

SEQ ID NO: 14945 - protein, 9 aa, Mycobacterium tuberculosis
MVGFFMIML

SEQ ID NO: 14946 - protein, 9 aa, Mycobacterium tuberculosis
VGFFMIMLD

SEQ ID NO: 14947 - protein, 9 aa, Mycobacterium tuberculosis
GFFMIMLDS

SEQ ID NO: 14948 - protein, 9 aa, Mycobacterium tuberculosis
FFMIMLDST

SEQ ID NO: 14949 - protein, 9 aa, Mycobacterium tuberculosis
FMIMLDSTV

SEQ ID NO: 14950 - protein, 9 aa, Mycobacterium tuberculosis
MIMLDSTVV

SEQ ID NO: 14951 - protein, 9 aa, Mycobacterium tuberculosis
IMLDSTVVA

SEQ ID NO: 14952 - protein, 9 aa, Mycobacterium tuberculosis
MLDSTVVAI

SEQ ID NO: 14953 - protein, 9 aa, Mycobacterium tuberculosis
LDSTVVAIA

SEQ ID NO: 14954 - protein, 9 aa, Mycobacterium tuberculosis
DSTVVAIAN

SEQ ID NO: 14955 - protein, 9 aa, Mycobacterium tuberculosis
STVVAIANP

SEQ ID NO: 14956 - protein, 9 aa, Mycobacterium tuberculosis
TVVAIANPT

SEQ ID NO: 14957 - protein, 9 aa, Mycobacterium tuberculosis
VVAIANPTI

SEQ ID NO: 14958 - protein, 9 aa, Mycobacterium tuberculosis
VAIANPTIM

SEQ ID NO: 14959 - protein, 9 aa, Mycobacterium tuberculosis
AIANPTIMA

SEQ ID NO: 14960 - protein, 9 aa, Mycobacterium tuberculosis
IANPTIMAQ

SEQ ID NO: 14961 - protein, 9 aa, Mycobacterium tuberculosis
ANPTIMAQL

SEQ ID NO: 14962 - protein, 9 aa, Mycobacterium tuberculosis
NPTIMAQLR

SEQ ID NO: 14963 - protein, 9 aa, Mycobacterium tuberculosis
PTIMAQLRI

SEQ ID NO: 14964 - protein, 9 aa, Mycobacterium tuberculosis
TIMAQLRIG

SEQ ID NO: 14965 - protein, 9 aa, Mycobacterium tuberculosis
IMAQLRIGY

SEQ ID NO: 14966 - protein, 9 aa, Mycobacterium tuberculosis
MAQLRIGYA

SEQ ID NO: 14967 - protein, 9 aa, Mycobacterium tuberculosis
AQLRIGYAT

SEQ ID NO: 14968 - protein, 9 aa, Mycobacterium tuberculosis
QLRIGYATV

SEQ ID NO: 14969 - protein, 9 aa, Mycobacterium tuberculosis
LRIGYATVV

SEQ ID NO: 14970 - protein, 9 aa, Mycobacterium tuberculosis
RIGYATVVW

SEQ ID NO: 14971 - protein, 9 aa, Mycobacterium tuberculosis
IGYATVVWV

SEQ ID NO: 14972 - protein, 9 aa, Mycobacterium tuberculosis
GYATVVWVT

SEQ ID NO: 14973 - protein, 9 aa, Mycobacterium tuberculosis
YATVVWVTS

SEQ ID NO: 14974 - protein, 9 aa, Mycobacterium tuberculosis
ATVVWVTSA

SEQ ID NO: 14975 - protein, 9 aa, Mycobacterium tuberculosis
TVVWVTSAY

SEQ ID NO: 14976 - protein, 9 aa, Mycobacterium tuberculosis
VVWVTSAYL

SEQ ID NO: 14977 - protein, 9 aa, Mycobacterium tuberculosis
VWVTSAYLL

SEQ ID NO: 14978 - protein, 9 aa, Mycobacterium tuberculosis
WVTSAYLLA

SEQ ID NO: 14979 - protein, 9 aa, Mycobacterium tuberculosis
VTSAYLLAY

SEQ ID NO: 14980 - protein, 9 aa, Mycobacterium tuberculosis
TSAYLLAYA

SEQ ID NO: 14981 - protein, 9 aa, Mycobacterium tuberculosis
SAYLLAYAV

SEQ ID NO: 14982 - protein, 9 aa, Mycobacterium tuberculosis
AYLLAYAVP

SEQ ID NO: 14983 - protein, 9 aa, Mycobacterium tuberculosis
YLLAYAVPM

SEQ ID NO: 14984 - protein, 9 aa, Mycobacterium tuberculosis
LLAYAVPML

SEQ ID NO: 14985 - protein, 9 aa, Mycobacterium tuberculosis
LAYAVPMLV

SEQ ID NO: 14986 - protein, 9 aa, Mycobacterium tuberculosis
AYAVPMLVA

SEQ ID NO: 14987 - protein, 9 aa, Mycobacterium tuberculosis
YAVPMLVAG

SEQ ID NO: 14988 - protein, 9 aa, Mycobacterium tuberculosis
AVPMLVAGR

SEQ ID NO: 14989 - protein, 9 aa, Mycobacterium tuberculosis
VPMLVAGRL

SEQ ID NO: 14990 - protein, 9 aa, Mycobacterium tuberculosis
PMLVAGRLG

SEQ ID NO: 14991 - protein, 9 aa, Mycobacterium tuberculosis
MLVAGRLGD

SEQ ID NO: 14992 - protein, 9 aa, Mycobacterium tuberculosis
LVAGRLGDR

SEQ ID NO: 14993 - protein, 9 aa, Mycobacterium tuberculosis
VAGRLGDRF

SEQ ID NO: 14994 - protein, 9 aa, Mycobacterium tuberculosis
AGRLGDRFG

SEQ ID NO: 14995 - protein, 9 aa, Mycobacterium tuberculosis
GRLGDRFGP

SEQ ID NO: 14996 - protein, 9 aa, Mycobacterium tuberculosis
RLGDRFGPK

SEQ ID NO: 14997 - protein, 9 aa, Mycobacterium tuberculosis
LGDRFGPKN

SEQ ID NO: 14998 - protein, 9 aa, Mycobacterium tuberculosis
GDRFGPKNL

SEQ ID NO: 14999 - protein, 9 aa, Mycobacterium tuberculosis
DRFGPKNLY

SEQ ID NO: 15000 - protein, 9 aa, Mycobacterium tuberculosis
RFGPKNLYL

SEQ ID NO: 15001 - protein, 9 aa, Mycobacterium tuberculosis
FGPKNLYLI

SEQ ID NO: 15002 - protein, 9 aa, Mycobacterium tuberculosis
GPKNLYLIG

SEQ ID NO: 15003 - protein, 9 aa, Mycobacterium tuberculosis
PKNLYLIGL

SEQ ID NO: 15004 - protein, 9 aa, Mycobacterium tuberculosis
KNLYLIGLG

SEQ ID NO: 15005 - protein, 9 aa, Mycobacterium tuberculosis
NLYLIGLGV

SEQ ID NO: 15006 - protein, 9 aa, Mycobacterium tuberculosis
LYLIGLGVF

SEQ ID NO: 15007 - protein, 9 aa, Mycobacterium tuberculosis
YLIGLGVFT

SEQ ID NO: 15008 - protein, 9 aa, Mycobacterium tuberculosis
LIGLGVFTV

SEQ ID NO: 15009 - protein, 9 aa, Mycobacterium tuberculosis
IGLGVFTVA

SEQ ID NO: 15010 - protein, 9 aa, Mycobacterium tuberculosis
GLGVFTVAS

SEQ ID NO: 15011 - protein, 9 aa, Mycobacterium tuberculosis
LGVFTVASL

SEQ ID NO: 15012 - protein, 9 aa, Mycobacterium tuberculosis
GVFTVASLG

SEQ ID NO: 15013 - protein, 9 aa, Mycobacterium tuberculosis
VFTVASLGC

SEQ ID NO: 15014 - protein, 9 aa, Mycobacterium tuberculosis
FTVASLGCG

SEQ ID NO: 15015 - protein, 9 aa, Mycobacterium tuberculosis
TVASLGCGL

SEQ ID NO: 15016 - protein, 9 aa, Mycobacterium tuberculosis
VASLGCGLS

SEQ ID NO: 15017 - protein, 9 aa, Mycobacterium tuberculosis
ASLGCGLSS

SEQ ID NO: 15018 - protein, 9 aa, Mycobacterium tuberculosis
SLGCGLSSG

SEQ ID NO: 15019 - protein, 9 aa, Mycobacterium tuberculosis
LGCGLSSGA

SEQ ID NO: 15020 - protein, 9 aa, Mycobacterium tuberculosis
GCGLSSGAG

SEQ ID NO: 15021 - protein, 9 aa, Mycobacterium tuberculosis
CGLSSGAGM

SEQ ID NO: 15022 - protein, 9 aa, Mycobacterium tuberculosis
GLSSGAGML

SEQ ID NO: 15023 - protein, 9 aa, Mycobacterium tuberculosis
LSSGAGMLI

SEQ ID NO: 15024 - protein, 9 aa, Mycobacterium tuberculosis
SSGAGMLIA

SEQ ID NO: 15025 - protein, 9 aa, Mycobacterium tuberculosis
SGAGMLIAA

SEQ ID NO: 15026 - protein, 9 aa, Mycobacterium tuberculosis
GAGMLIAAR

SEQ ID NO: 15027 - protein, 9 aa, Mycobacterium tuberculosis
AGMLIAARV

SEQ ID NO: 15028 - protein, 9 aa, Mycobacterium tuberculosis
GMLIAARVV

SEQ ID NO: 15029 - protein, 9 aa, Mycobacterium tuberculosis
MLIAARVVQ

SEQ ID NO: 15030 - protein, 9 aa, Mycobacterium tuberculosis
LIAARVVQG

SEQ ID NO: 15031 - protein, 9 aa, Mycobacterium tuberculosis
IAARVVQGV

SEQ ID NO: 15032 - protein, 9 aa, Mycobacterium tuberculosis
AARVVQGVG

SEQ ID NO: 15033 - protein, 9 aa, Mycobacterium tuberculosis
ARVVQGVGA

SEQ ID NO: 15034 - protein, 9 aa, Mycobacterium tuberculosis
RVVQGVGAG

SEQ ID NO: 15035 - protein, 9 aa, Mycobacterium tuberculosis
VVQGVGAGL

SEQ ID NO: 15036 - protein, 9 aa, Mycobacterium tuberculosis
VQGVGAGLL

SEQ ID NO: 15037 - protein, 9 aa, Mycobacterium tuberculosis
QGVGAGLLT

SEQ ID NO: 15038 - protein, 9 aa, Mycobacterium tuberculosis
GVGAGLLTP

SEQ ID NO: 15039 - protein, 9 aa, Mycobacterium tuberculosis
VGAGLLTPQ

SEQ ID NO: 15040 - protein, 9 aa, Mycobacterium tuberculosis
GAGLLTPQT

SEQ ID NO: 15041 - protein, 9 aa, Mycobacterium tuberculosis
AGLLTPQTL

SEQ ID NO: 15042 - protein, 9 aa, Mycobacterium tuberculosis
GLLTPQTLS

SEQ ID NO: 15043 - protein, 9 aa, Mycobacterium tuberculosis
LLTPQTLST

SEQ ID NO: 15044 - protein, 9 aa, Mycobacterium tuberculosis
LTPQTLSTI

SEQ ID NO: 15045 - protein, 9 aa, Mycobacterium tuberculosis
TPQTLSTIT

SEQ ID NO: 15046 - protein, 9 aa, Mycobacterium tuberculosis
PQTLSTITR

SEQ ID NO: 15047 - protein, 9 aa, Mycobacterium tuberculosis
QTLSTITRI

SEQ ID NO: 15048 - protein, 9 aa, Mycobacterium tuberculosis
TLSTITRIF

SEQ ID NO: 15049 - protein, 9 aa, Mycobacterium tuberculosis
LSTITRIFP

SEQ ID NO: 15050 - protein, 9 aa, Mycobacterium tuberculosis
STITRIFPA

SEQ ID NO: 15051 - protein, 9 aa, Mycobacterium tuberculosis
TITRIFPAH

SEQ ID NO: 15052 - protein, 9 aa, Mycobacterium tuberculosis
ITRIFPAHR

SEQ ID NO: 15053 - protein, 9 aa, Mycobacterium tuberculosis
TRIFPAHRR

SEQ ID NO: 15054 - protein, 9 aa, Mycobacterium tuberculosis
RIFPAHRRG

SEQ ID NO: 15055 - protein, 9 aa, Mycobacterium tuberculosis
IFPAHRRGV

SEQ ID NO: 15056 - protein, 9 aa, Mycobacterium tuberculosis
FPAHRRGVA

SEQ ID NO: 15057 - protein, 9 aa, Mycobacterium tuberculosis
PAHRRGVAL

SEQ ID NO: 15058 - protein, 9 aa, Mycobacterium tuberculosis
AHRRGVALG

SEQ ID NO: 15059 - protein, 9 aa, Mycobacterium tuberculosis
HRRGVALGA

SEQ ID NO: 15060 - protein, 9 aa, Mycobacterium tuberculosis
RRGVALGAW

SEQ ID NO: 15061 - protein, 9 aa, Mycobacterium tuberculosis
RGVALGAWG

SEQ ID NO: 15062 - protein, 9 aa, Mycobacterium tuberculosis
GVALGAWGT

SEQ ID NO: 15063 - protein, 9 aa, Mycobacterium tuberculosis
VALGAWGTV

SEQ ID NO: 15064 - protein, 9 aa, Mycobacterium tuberculosis
ALGAWGTVA

SEQ ID NO: 15065 - protein, 9 aa, Mycobacterium tuberculosis
LGAWGTVAS

SEQ ID NO: 15066 - protein, 9 aa, Mycobacterium tuberculosis
GAWGTVASV

SEQ ID NO: 15067 - protein, 9 aa, Mycobacterium tuberculosis
AWGTVASVA

SEQ ID NO: 15068 - protein, 9 aa, Mycobacterium tuberculosis
WGTVASVAS

SEQ ID NO: 15069 - protein, 9 aa, Mycobacterium tuberculosis
GTVASVASL

SEQ ID NO: 15070 - protein, 9 aa, Mycobacterium tuberculosis
TVASVASLV

SEQ ID NO: 15071 - protein, 9 aa, Mycobacterium tuberculosis
VASVASLVG

SEQ ID NO: 15072 - protein, 9 aa, Mycobacterium tuberculosis
ASVASLVGP

SEQ ID NO: 15073 - protein, 9 aa, Mycobacterium tuberculosis
SVASLVGPL

SEQ ID NO: 15074 - protein, 9 aa, Mycobacterium tuberculosis
VASLVGPLA

SEQ ID NO: 15075 - protein, 9 aa, Mycobacterium tuberculosis
ASLVGPLAG

SEQ ID NO: 15076 - protein, 9 aa, Mycobacterium tuberculosis
SLVGPLAGG

SEQ ID NO: 15077 - protein, 9 aa, Mycobacterium tuberculosis
LVGPLAGGA

SEQ ID NO: 15078 - protein, 9 aa, Mycobacterium tuberculosis
VGPLAGGAL

SEQ ID NO: 15079 - protein, 9 aa, Mycobacterium tuberculosis
GPLAGGALV

SEQ ID NO: 15080 - protein, 9 aa, Mycobacterium tuberculosis
PLAGGALVD

SEQ ID NO: 15081 - protein, 9 aa, Mycobacterium tuberculosis
LAGGALVDS

SEQ ID NO: 15082 - protein, 9 aa, Mycobacterium tuberculosis
AGGALVDSM

SEQ ID NO: 15083 - protein, 9 aa, Mycobacterium tuberculosis
GGALVDSMG

SEQ ID NO: 15084 - protein, 9 aa, Mycobacterium tuberculosis
GALVDSMGW

SEQ ID NO: 15085 - protein, 9 aa, Mycobacterium tuberculosis
ALVDSMGWE

SEQ ID NO: 15086 - protein, 9 aa, Mycobacterium tuberculosis
LVDSMGWEW

SEQ ID NO: 15087 - protein, 9 aa, Mycobacterium tuberculosis
VDSMGWEWI

SEQ ID NO: 15088 - protein, 9 aa, Mycobacterium tuberculosis
DSMGWEWIF

SEQ ID NO: 15089 - protein, 9 aa, Mycobacterium tuberculosis
SMGWEWIFF

SEQ ID NO: 15090 - protein, 9 aa, Mycobacterium tuberculosis
MGWEWIFFV

SEQ ID NO: 15091 - protein, 9 aa, Mycobacterium tuberculosis
GWEWIFFVN

SEQ ID NO: 15092 - protein, 9 aa, Mycobacterium tuberculosis
WEWIFFVNV

SEQ ID NO: 15093 - protein, 9 aa, Mycobacterium tuberculosis
EWIFFVNVP

SEQ ID NO: 15094 - protein, 9 aa, Mycobacterium tuberculosis
WIFFVNVPV

SEQ ID NO: 15095 - protein, 9 aa, Mycobacterium tuberculosis
IFFVNVPVG

SEQ ID NO: 15096 - protein, 9 aa, Mycobacterium tuberculosis
FFVNVPVGV

SEQ ID NO: 15097 - protein, 9 aa, Mycobacterium tuberculosis
FVNVPVGVI

SEQ ID NO: 15098 - protein, 9 aa, Mycobacterium tuberculosis
VNVPVGVIG

SEQ ID NO: 15099 - protein, 9 aa, Mycobacterium tuberculosis
NVPVGVIGL

SEQ ID NO: 15100 - protein, 9 aa, Mycobacterium tuberculosis
VPVGVIGLI

SEQ ID NO: 15101 - protein, 9 aa, Mycobacterium tuberculosis
PVGVIGLIL

SEQ ID NO: 15102 - protein, 9 aa, Mycobacterium tuberculosis
VGVIGLILA

SEQ ID NO: 15103 - protein, 9 aa, Mycobacterium tuberculosis
GVIGLILAA

SEQ ID NO: 15104 - protein, 9 aa, Mycobacterium tuberculosis
VIGLILAAY

SEQ ID NO: 15105 - protein, 9 aa, Mycobacterium tuberculosis
IGLILAAYL

SEQ ID NO: 15106 - protein, 9 aa, Mycobacterium tuberculosis
GLILAAYLI

SEQ ID NO: 15107 - protein, 9 aa, Mycobacterium tuberculosis
LILAAYLIP

SEQ ID NO: 15108 - protein, 9 aa, Mycobacterium tuberculosis
ILAAYLIPA

SEQ ID NO: 15109 - protein, 9 aa, Mycobacterium tuberculosis
LAAYLIPAL

SEQ ID NO: 15110 - protein, 9 aa, Mycobacterium tuberculosis
AAYLIPALP

SEQ ID NO: 15111 - protein, 9 aa, Mycobacterium tuberculosis
AYLIPALPH

SEQ ID NO: 15112 - protein, 9 aa, Mycobacterium tuberculosis
YLIPALPHH

SEQ ID NO: 15113 - protein, 9 aa, Mycobacterium tuberculosis
LIPALPHHP

SEQ ID NO: 15114 - protein, 9 aa, Mycobacterium tuberculosis
IPALPHHPH

SEQ ID NO: 15115 - protein, 9 aa, Mycobacterium tuberculosis
PALPHHPHR

SEQ ID NO: 15116 - protein, 9 aa, Mycobacterium tuberculosis
ALPHHPHRF

SEQ ID NO: 15117 - protein, 9 aa, Mycobacterium tuberculosis
LPHHPHRFD

SEQ ID NO: 15118 - protein, 9 aa, Mycobacterium tuberculosis
PHHPHRFDW

SEQ ID NO: 15119 - protein, 9 aa, Mycobacterium tuberculosis
HHPHRFDWF

SEQ ID NO: 15120 - protein, 9 aa, Mycobacterium tuberculosis
HPHRFDWFG

SEQ ID NO: 15121 - protein, 9 aa, Mycobacterium tuberculosis
PHRFDWFGV

SEQ ID NO: 15122 - protein, 9 aa, Mycobacterium tuberculosis
HRFDWFGVG

SEQ ID NO: 15123 - protein, 9 aa, Mycobacterium tuberculosis
RFDWFGVGL

SEQ ID NO: 15124 - protein, 9 aa, Mycobacterium tuberculosis
FDWFGVGLS

SEQ ID NO: 15125 - protein, 9 aa, Mycobacterium tuberculosis
DWFGVGLSG

SEQ ID NO: 15126 - protein, 9 aa, Mycobacterium tuberculosis
WFGVGLSGA

SEQ ID NO: 15127 - protein, 9 aa, Mycobacterium tuberculosis
FGVGLSGAG

SEQ ID NO: 15128 - protein, 9 aa, Mycobacterium tuberculosis
GVGLSGAGM

SEQ ID NO: 15129 - protein, 9 aa, Mycobacterium tuberculosis
VGLSGAGMF

SEQ ID NO: 15130 - protein, 9 aa, Mycobacterium tuberculosis
GLSGAGMFL

SEQ ID NO: 15131 - protein, 9 aa, Mycobacterium tuberculosis
LSGAGMFLI

SEQ ID NO: 15132 - protein, 9 aa, Mycobacterium tuberculosis
SGAGMFLIV

SEQ ID NO: 15133 - protein, 9 aa, Mycobacterium tuberculosis
GAGMFLIVF

SEQ ID NO: 15134 - protein, 9 aa, Mycobacterium tuberculosis
AGMFLIVFG

SEQ ID NO: 15135 - protein, 9 aa, Mycobacterium tuberculosis
GMFLIVFGL

SEQ ID NO: 15136 - protein, 9 aa, Mycobacterium tuberculosis
MFLIVFGLQ

SEQ ID NO: 15137 - protein, 9 aa, Mycobacterium tuberculosis
FLIVFGLQQ

SEQ ID NO: 15138 - protein, 9 aa, Mycobacterium tuberculosis
LIVFGLQQG

SEQ ID NO: 15139 - protein, 9 aa, Mycobacterium tuberculosis
IVFGLQQGQ

SEQ ID NO: 15140 - protein, 9 aa, Mycobacterium tuberculosis
VFGLQQGQS

SEQ ID NO: 15141 - protein, 9 aa, Mycobacterium tuberculosis
FGLQQGQSA

SEQ ID NO: 15142 - protein, 9 aa, Mycobacterium tuberculosis
GLQQGQSAN

SEQ ID NO: 15143 - protein, 9 aa, Mycobacterium tuberculosis
LQQGQSANW

SEQ ID NO: 15144 - protein, 9 aa, Mycobacterium tuberculosis
QQGQSANWQ

SEQ ID NO: 15145 - protein, 9 aa, Mycobacterium tuberculosis
QGQSANWQP

SEQ ID NO: 15146 - protein, 9 aa, Mycobacterium tuberculosis
GQSANWQPW

SEQ ID NO: 15147 - protein, 9 aa, Mycobacterium tuberculosis
QSANWQPWI

SEQ ID NO: 15148 - protein, 9 aa, Mycobacterium tuberculosis
SANWQPWIW

SEQ ID NO: 15149 - protein, 9 aa, Mycobacterium tuberculosis
ANWQPWIWA

SEQ ID NO: 15150 - protein, 9 aa, Mycobacterium tuberculosis
NWQPWIWAV

SEQ ID NO: 15151 - protein, 9 aa, Mycobacterium tuberculosis
WQPWIWAVI

SEQ ID NO: 15152 - protein, 9 aa, Mycobacterium tuberculosis
QPWIWAVIV

SEQ ID NO: 15153 - protein, 9 aa, Mycobacterium tuberculosis
PWIWAVIVG

SEQ ID NO: 15154 - protein, 9 aa, Mycobacterium tuberculosis
WIWAVIVGG

SEQ ID NO: 15155 - protein, 9 aa, Mycobacterium tuberculosis
IWAVIVGGI

SEQ ID NO: 15156 - protein, 9 aa, Mycobacterium tuberculosis
WAVIVGGIG

SEQ ID NO: 15157 - protein, 9 aa, Mycobacterium tuberculosis
AVIVGGIGF

SEQ ID NO: 15158 - protein, 9 aa, Mycobacterium tuberculosis
VIVGGIGFM

SEQ ID NO: 15159 - protein, 9 aa, Mycobacterium tuberculosis
IVGGIGFMS

SEQ ID NO: 15160 - protein, 9 aa, Mycobacterium tuberculosis
VGGIGFMSL

SEQ ID NO: 15161 - protein, 9 aa, Mycobacterium tuberculosis
GGIGFMSLF

SEQ ID NO: 15162 - protein, 9 aa, Mycobacterium tuberculosis
GIGFMSLFV

SEQ ID NO: 15163 - protein, 9 aa, Mycobacterium tuberculosis
IGFMSLFVY

SEQ ID NO: 15164 - protein, 9 aa, Mycobacterium tuberculosis
GFMSLFVYW

SEQ ID NO: 15165 - protein, 9 aa, Mycobacterium tuberculosis
FMSLFVYWQ

SEQ ID NO: 15166 - protein, 9 aa, Mycobacterium tuberculosis
MSLFVYWQA

SEQ ID NO: 15167 - protein, 9 aa, Mycobacterium tuberculosis
SLFVYWQAR

SEQ ID NO: 15168 - protein, 9 aa, Mycobacterium tuberculosis
LFVYWQARN

SEQ ID NO: 15169 - protein, 9 aa, Mycobacterium tuberculosis
FVYWQARNA

SEQ ID NO: 15170 - protein, 9 aa, Mycobacterium tuberculosis
VYWQARNAR

SEQ ID NO: 15171 - protein, 9 aa, Mycobacterium tuberculosis
YWQARNARE

SEQ ID NO: 15172 - protein, 9 aa, Mycobacterium tuberculosis
WQARNAREP

SEQ ID NO: 15173 - protein, 9 aa, Mycobacterium tuberculosis
QARNAREPL

SEQ ID NO: 15174 - protein, 9 aa, Mycobacterium tuberculosis
ARNAREPLI

SEQ ID NO: 15175 - protein, 9 aa, Mycobacterium tuberculosis
RNAREPLIP

SEQ ID NO: 15176 - protein, 9 aa, Mycobacterium tuberculosis
NAREPLIPL

SEQ ID NO: 15177 - protein, 9 aa, Mycobacterium tuberculosis
AREPLIPLE

SEQ ID NO: 15178 - protein, 9 aa, Mycobacterium tuberculosis
REPLIPLEV

SEQ ID NO: 15179 - protein, 9 aa, Mycobacterium tuberculosis
EPLIPLEVF

SEQ ID NO: 15180 - protein, 9 aa, Mycobacterium tuberculosis
PLIPLEVFN

SEQ ID NO: 15181 - protein, 9 aa, Mycobacterium tuberculosis
LIPLEVFND

SEQ ID NO: 15182 - protein, 9 aa, Mycobacterium tuberculosis
IPLEVFNDR

SEQ ID NO: 15183 - protein, 9 aa, Mycobacterium tuberculosis
PLEVFNDRN

SEQ ID NO: 15184 - protein, 9 aa, Mycobacterium tuberculosis
LEVFNDRNF

SEQ ID NO: 15185 - protein, 9 aa, Mycobacterium tuberculosis
EVFNDRNFS

SEQ ID NO: 15186 - protein, 9 aa, Mycobacterium tuberculosis
VFNDRNFSL

SEQ ID NO: 15187 - protein, 9 aa, Mycobacterium tuberculosis
FNDRNFSLS

SEQ ID NO: 15188 - protein, 9 aa, Mycobacterium tuberculosis
NDRNFSLSN

SEQ ID NO: 15189 - protein, 9 aa, Mycobacterium tuberculosis
DRNFSLSNL

SEQ ID NO: 15190 - protein, 9 aa, Mycobacterium tuberculosis
RNFSLSNLR

SEQ ID NO: 15191 - protein, 9 aa, Mycobacterium tuberculosis
NFSLSNLRI

SEQ ID NO: 15192 - protein, 9 aa, Mycobacterium tuberculosis
FSLSNLRIA

SEQ ID NO: 15193 - protein, 9 aa, Mycobacterium tuberculosis
SLSNLRIAI

SEQ ID NO: 15194 - protein, 9 aa, Mycobacterium tuberculosis
LSNLRIAII

SEQ ID NO: 15195 - protein, 9 aa, Mycobacterium tuberculosis
SNLRIAIIA

SEQ ID NO: 15196 - protein, 9 aa, Mycobacterium tuberculosis
NLRIAIIAF

SEQ ID NO: 15197 - protein, 9 aa, Mycobacterium tuberculosis
LRIAIIAFA

SEQ ID NO: 15198 - protein, 9 aa, Mycobacterium tuberculosis
RIAIIAFAG

SEQ ID NO: 15199 - protein, 9 aa, Mycobacterium tuberculosis
IAIIAFAGT

SEQ ID NO: 15200 - protein, 9 aa, Mycobacterium tuberculosis
AIIAFAGTG

SEQ ID NO: 15201 - protein, 9 aa, Mycobacterium tuberculosis
IIAFAGTGM

SEQ ID NO: 15202 - protein, 9 aa, Mycobacterium tuberculosis
IAFAGTGMM

SEQ ID NO: 15203 - protein, 9 aa, Mycobacterium tuberculosis
AFAGTGMML

SEQ ID NO: 15204 - protein, 9 aa, Mycobacterium tuberculosis
FAGTGMMLP

SEQ ID NO: 15205 - protein, 9 aa, Mycobacterium tuberculosis
AGTGMMLPV

SEQ ID NO: 15206 - protein, 9 aa, Mycobacterium tuberculosis
GTGMMLPVT

SEQ ID NO: 15207 - protein, 9 aa, Mycobacterium tuberculosis
TGMMLPVTF

SEQ ID NO: 15208 - protein, 9 aa, Mycobacterium tuberculosis
GMMLPVTFY

SEQ ID NO: 15209 - protein, 9 aa, Mycobacterium tuberculosis
MMLPVTFYA

SEQ ID NO: 15210 - protein, 9 aa, Mycobacterium tuberculosis
MLPVTFYAQ

SEQ ID NO: 15211 - protein, 9 aa, Mycobacterium tuberculosis
LPVTFYAQA

SEQ ID NO: 15212 - protein, 9 aa, Mycobacterium tuberculosis
PVTFYAQAV

SEQ ID NO: 15213 - protein, 9 aa, Mycobacterium tuberculosis
VTFYAQAVC

SEQ ID NO: 15214 - protein, 9 aa, Mycobacterium tuberculosis
TFYAQAVCG

SEQ ID NO: 15215 - protein, 9 aa, Mycobacterium tuberculosis
FYAQAVCGL

SEQ ID NO: 15216 - protein, 9 aa, Mycobacterium tuberculosis
YAQAVCGLS

SEQ ID NO: 15217 - protein, 9 aa, Mycobacterium tuberculosis
AQAVCGLSP

SEQ ID NO: 15218 - protein, 9 aa, Mycobacterium tuberculosis
QAVCGLSPT

SEQ ID NO: 15219 - protein, 9 aa, Mycobacterium tuberculosis
AVCGLSPTH

SEQ ID NO: 15220 - protein, 9 aa, Mycobacterium tuberculosis
VCGLSPTHT

SEQ ID NO: 15221 - protein, 9 aa, Mycobacterium tuberculosis
CGLSPTHTA

SEQ ID NO: 15222 - protein, 9 aa, Mycobacterium tuberculosis
GLSPTHTAV

SEQ ID NO: 15223 - protein, 9 aa, Mycobacterium tuberculosis
LSPTHTAVL

SEQ ID NO: 15224 - protein, 9 aa, Mycobacterium tuberculosis
SPTHTAVLF

SEQ ID NO: 15225 - protein, 9 aa, Mycobacterium tuberculosis
PTHTAVLFA

SEQ ID NO: 15226 - protein, 9 aa, Mycobacterium tuberculosis
THTAVLFAP

SEQ ID NO: 15227 - protein, 9 aa, Mycobacterium tuberculosis
HTAVLFAPT

SEQ ID NO: 15228 - protein, 9 aa, Mycobacterium tuberculosis
TAVLFAPTA

SEQ ID NO: 15229 - protein, 9 aa, Mycobacterium tuberculosis
AVLFAPTAI

SEQ ID NO: 15230 - protein, 9 aa, Mycobacterium tuberculosis
VLFAPTAIV

SEQ ID NO: 15231 - protein, 9 aa, Mycobacterium tuberculosis
LFAPTAIVG

SEQ ID NO: 15232 - protein, 9 aa, Mycobacterium tuberculosis
FAPTAIVGG

SEQ ID NO: 15233 - protein, 9 aa, Mycobacterium tuberculosis
APTAIVGGV

SEQ ID NO: 15234 - protein, 9 aa, Mycobacterium tuberculosis
PTAIVGGVL

SEQ ID NO: 15235 - protein, 9 aa, Mycobacterium tuberculosis
TAIVGGVLA

SEQ ID NO: 15236 - protein, 9 aa, Mycobacterium tuberculosis
AIVGGVLAP

SEQ ID NO: 15237 - protein, 9 aa, Mycobacterium tuberculosis
IVGGVLAPF

SEQ ID NO: 15238 - protein, 9 aa, Mycobacterium tuberculosis
VGGVLAPFV

SEQ ID NO: 15239 - protein, 9 aa, Mycobacterium tuberculosis
GGVLAPFVG

SEQ ID NO: 15240 - protein, 9 aa, Mycobacterium tuberculosis
GVLAPFVGM

SEQ ID NO: 15241 - protein, 9 aa, Mycobacterium tuberculosis
VLAPFVGMI

SEQ ID NO: 15242 - protein, 9 aa, Mycobacterium tuberculosis
LAPFVGMII

SEQ ID NO: 15243 - protein, 9 aa, Mycobacterium tuberculosis
APFVGMIID

SEQ ID NO: 15244 - protein, 9 aa, Mycobacterium tuberculosis
PFVGMIIDR

SEQ ID NO: 15245 - protein, 9 aa, Mycobacterium tuberculosis
FVGMIIDRS

SEQ ID NO: 15246 - protein, 9 aa, Mycobacterium tuberculosis
VGMIIDRSH

SEQ ID NO: 15247 - protein, 9 aa, Mycobacterium tuberculosis
GMIIDRSHP

SEQ ID NO: 15248 - protein, 9 aa, Mycobacterium tuberculosis
MIIDRSHPL

SEQ ID NO: 15249 - protein, 9 aa, Mycobacterium tuberculosis
IIDRSHPLC

SEQ ID NO: 15250 - protein, 9 aa, Mycobacterium tuberculosis
IDRSHPLCV

SEQ ID NO: 15251 - protein, 9 aa, Mycobacterium tuberculosis
DRSHPLCVL

SEQ ID NO: 15252 - protein, 9 aa, Mycobacterium tuberculosis
RSHPLCVLG

SEQ ID NO: 15253 - protein, 9 aa, Mycobacterium tuberculosis
SHPLCVLGF

SEQ ID NO: 15254 - protein, 9 aa, Mycobacterium tuberculosis
HPLCVLGFG

SEQ ID NO: 15255 - protein, 9 aa, Mycobacterium tuberculosis
PLCVLGFGF

SEQ ID NO: 15256 - protein, 9 aa, Mycobacterium tuberculosis
LCVLGFGFS

SEQ ID NO: 15257 - protein, 9 aa, Mycobacterium tuberculosis
CVLGFGFSV

SEQ ID NO: 15258 - protein, 9 aa, Mycobacterium tuberculosis
VLGFGFSVL

SEQ ID NO: 15259 - protein, 9 aa, Mycobacterium tuberculosis
LGFGFSVLA

SEQ ID NO: 15260 - protein, 9 aa, Mycobacterium tuberculosis
GFGFSVLAI

SEQ ID NO: 15261 - protein, 9 aa, Mycobacterium tuberculosis
FGFSVLAIA

SEQ ID NO: 15262 - protein, 9 aa, Mycobacterium tuberculosis
GFSVLAIAM

SEQ ID NO: 15263 - protein, 9 aa, Mycobacterium tuberculosis
FSVLAIAMT

SEQ ID NO: 15264 - protein, 9 aa, Mycobacterium tuberculosis
SVLAIAMTW

SEQ ID NO: 15265 - protein, 9 aa, Mycobacterium tuberculosis
VLAIAMTWL

SEQ ID NO: 15266 - protein, 9 aa, Mycobacterium tuberculosis
LAIAMTWLL

SEQ ID NO: 15267 - protein, 9 aa, Mycobacterium tuberculosis
AIAMTWLLC

SEQ ID NO: 15268 - protein, 9 aa, Mycobacterium tuberculosis
IAMTWLLCE

SEQ ID NO: 15269 - protein, 9 aa, Mycobacterium tuberculosis
AMTWLLCEM

SEQ ID NO: 15270 - protein, 9 aa, Mycobacterium tuberculosis
MTWLLCEMA

SEQ ID NO: 15271 - protein, 9 aa, Mycobacterium tuberculosis
TWLLCEMAP

SEQ ID NO: 15272 - protein, 9 aa, Mycobacterium tuberculosis
WLLCEMAPG

SEQ ID NO: 15273 - protein, 9 aa, Mycobacterium tuberculosis
LLCEMAPGT

SEQ ID NO: 15274 - protein, 9 aa, Mycobacterium tuberculosis
LCEMAPGTP

SEQ ID NO: 15275 - protein, 9 aa, Mycobacterium tuberculosis
CEMAPGTPI

SEQ ID NO: 15276 - protein, 9 aa, Mycobacterium tuberculosis
EMAPGTPIW

SEQ ID NO: 15277 - protein, 9 aa, Mycobacterium tuberculosis
MAPGTPIWR

SEQ ID NO: 15278 - protein, 9 aa, Mycobacterium tuberculosis
APGTPIWRL

SEQ ID NO: 15279 - protein, 9 aa, Mycobacterium tuberculosis
PGTPIWRLV

SEQ ID NO: 15280 - protein, 9 aa, Mycobacterium tuberculosis
GTPIWRLVL

SEQ ID NO: 15281 - protein, 9 aa, Mycobacterium tuberculosis
TPIWRLVLP

SEQ ID NO: 15282 - protein, 9 aa, Mycobacterium tuberculosis
PIWRLVLPF

SEQ ID NO: 15283 - protein, 9 aa, Mycobacterium tuberculosis
IWRLVLPFI

SEQ ID NO: 15284 - protein, 9 aa, Mycobacterium tuberculosis
WRLVLPFIA

SEQ ID NO: 15285 - protein, 9 aa, Mycobacterium tuberculosis
RLVLPFIAL

SEQ ID NO: 15286 - protein, 9 aa, Mycobacterium tuberculosis
LVLPFIALG

SEQ ID NO: 15287 - protein, 9 aa, Mycobacterium tuberculosis
VLPFIALGV

SEQ ID NO: 15288 - protein, 9 aa, Mycobacterium tuberculosis
LPFIALGVA

SEQ ID NO: 15289 - protein, 9 aa, Mycobacterium tuberculosis
PFIALGVAG

SEQ ID NO: 15290 - protein, 9 aa, Mycobacterium tuberculosis
FIALGVAGA

SEQ ID NO: 15291 - protein, 9 aa, Mycobacterium tuberculosis
IALGVAGAF

SEQ ID NO: 15292 - protein, 9 aa, Mycobacterium tuberculosis
ALGVAGAFV

SEQ ID NO: 15293 - protein, 9 aa, Mycobacterium tuberculosis
LGVAGAFVW

SEQ ID NO: 15294 - protein, 9 aa, Mycobacterium tuberculosis
GVAGAFVWS

SEQ ID NO: 15295 - protein, 9 aa, Mycobacterium tuberculosis
VAGAFVWSP

SEQ ID NO: 15296 - protein, 9 aa, Mycobacterium tuberculosis
AGAFVWSPL

SEQ ID NO: 15297 - protein, 9 aa, Mycobacterium tuberculosis
GAFVWSPLT

SEQ ID NO: 15298 - protein, 9 aa, Mycobacterium tuberculosis
AFVWSPLTV

SEQ ID NO: 15299 - protein, 9 aa, Mycobacterium tuberculosis
FVWSPLTVT

SEQ ID NO: 15300 - protein, 9 aa, Mycobacterium tuberculosis
VWSPLTVTA

SEQ ID NO: 15301 - protein, 9 aa, Mycobacterium tuberculosis
WSPLTVTAT

SEQ ID NO: 15302 - protein, 9 aa, Mycobacterium tuberculosis
SPLTVTATR

SEQ ID NO: 15303 - protein, 9 aa, Mycobacterium tuberculosis
PLTVTATRN

SEQ ID NO: 15304 - protein, 9 aa, Mycobacterium tuberculosis
LTVTATRNL

SEQ ID NO: 15305 - protein, 9 aa, Mycobacterium tuberculosis
TVTATRNLR

SEQ ID NO: 15306 - protein, 9 aa, Mycobacterium tuberculosis
VTATRNLRP

SEQ ID NO: 15307 - protein, 9 aa, Mycobacterium tuberculosis
TATRNLRPH

SEQ ID NO: 15308 - protein, 9 aa, Mycobacterium tuberculosis
ATRNLRPHL

SEQ ID NO: 15309 - protein, 9 aa, Mycobacterium tuberculosis
TRNLRPHLA

SEQ ID NO: 15310 - protein, 9 aa, Mycobacterium tuberculosis
RNLRPHLAG

SEQ ID NO: 15311 - protein, 9 aa, Mycobacterium tuberculosis
NLRPHLAGA

SEQ ID NO: 15312 - protein, 9 aa, Mycobacterium tuberculosis
LRPHLAGAS

SEQ ID NO: 15313 - protein, 9 aa, Mycobacterium tuberculosis
RPHLAGASS

SEQ ID NO: 15314 - protein, 9 aa, Mycobacterium tuberculosis
PHLAGASSG

SEQ ID NO: 15315 - protein, 9 aa, Mycobacterium tuberculosis
HLAGASSGV

SEQ ID NO: 15316 - protein, 9 aa, Mycobacterium tuberculosis
LAGASSGVF

SEQ ID NO: 15317 - protein, 9 aa, Mycobacterium tuberculosis
AGASSGVFN

SEQ ID NO: 15318 - protein, 9 aa, Mycobacterium tuberculosis
GASSGVFNA

SEQ ID NO: 15319 - protein, 9 aa, Mycobacterium tuberculosis
ASSGVFNAV

SEQ ID NO: 15320 - protein, 9 aa, Mycobacterium tuberculosis
SSGVFNAVR

SEQ ID NO: 15321 - protein, 9 aa, Mycobacterium tuberculosis
SGVFNAVRQ

SEQ ID NO: 15322 - protein, 9 aa, Mycobacterium tuberculosis
GVFNAVRQL

SEQ ID NO: 15323 - protein, 9 aa, Mycobacterium tuberculosis
VFNAVRQLG

SEQ ID NO: 15324 - protein, 9 aa, Mycobacterium tuberculosis
FNAVRQLGA

SEQ ID NO: 15325 - protein, 9 aa, Mycobacterium tuberculosis
NAVRQLGAV

SEQ ID NO: 15326 - protein, 9 aa, Mycobacterium tuberculosis
AVRQLGAVL

SEQ ID NO: 15327 - protein, 9 aa, Mycobacterium tuberculosis
VRQLGAVLG

SEQ ID NO: 15328 - protein, 9 aa, Mycobacterium tuberculosis
RQLGAVLGS

SEQ ID NO: 15329 - protein, 9 aa, Mycobacterium tuberculosis
QLGAVLGSA

SEQ ID NO: 15330 - protein, 9 aa, Mycobacterium tuberculosis
LGAVLGSAS

SEQ ID NO: 15331 - protein, 9 aa, Mycobacterium tuberculosis
GAVLGSASM

SEQ ID NO: 15332 - protein, 9 aa, Mycobacterium tuberculosis
AVLGSASMA

SEQ ID NO: 15333 - protein, 9 aa, Mycobacterium tuberculosis
VLGSASMAA

SEQ ID NO: 15334 - protein, 9 aa, Mycobacterium tuberculosis
LGSASMAAF

SEQ ID NO: 15335 - protein, 9 aa, Mycobacterium tuberculosis
GSASMAAFM

SEQ ID NO: 15336 - protein, 9 aa, Mycobacterium tuberculosis
SASMAAFMT

SEQ ID NO: 15337 - protein, 9 aa, Mycobacterium tuberculosis
ASMAAFMTS

SEQ ID NO: 15338 - protein, 9 aa, Mycobacterium tuberculosis
SMAAFMTSR

SEQ ID NO: 15339 - protein, 9 aa, Mycobacterium tuberculosis
MAAFMTSRI

SEQ ID NO: 15340 - protein, 9 aa, Mycobacterium tuberculosis
AAFMTSRIA

SEQ ID NO: 15341 - protein, 9 aa, Mycobacterium tuberculosis
AFMTSRIAA

SEQ ID NO: 15342 - protein, 9 aa, Mycobacterium tuberculosis
FMTSRIAAE

SEQ ID NO: 15343 - protein, 9 aa, Mycobacterium tuberculosis
MTSRIAAEM

SEQ ID NO: 15344 - protein, 9 aa, Mycobacterium tuberculosis
TSRIAAEMP

SEQ ID NO: 15345 - protein, 9 aa, Mycobacterium tuberculosis
SRIAAEMPG

SEQ ID NO: 15346 - protein, 9 aa, Mycobacterium tuberculosis
RIAAEMPGG

SEQ ID NO: 15347 - protein, 9 aa, Mycobacterium tuberculosis
IAAEMPGGV

SEQ ID NO: 15348 - protein, 9 aa, Mycobacterium tuberculosis
AAEMPGGVD

SEQ ID NO: 15349 - protein, 9 aa, Mycobacterium tuberculosis
AEMPGGVDA

SEQ ID NO: 15350 - protein, 9 aa, Mycobacterium tuberculosis
EMPGGVDAL

SEQ ID NO: 15351 - protein, 9 aa, Mycobacterium tuberculosis
MPGGVDALT

SEQ ID NO: 15352 - protein, 9 aa, Mycobacterium tuberculosis
PGGVDALTG

SEQ ID NO: 15353 - protein, 9 aa, Mycobacterium tuberculosis
GGVDALTGP

SEQ ID NO: 15354 - protein, 9 aa, Mycobacterium tuberculosis
GVDALTGPA

SEQ ID NO: 15355 - protein, 9 aa, Mycobacterium tuberculosis
VDALTGPAG

SEQ ID NO: 15356 - protein, 9 aa, Mycobacterium tuberculosis
DALTGPAGQ

SEQ ID NO: 15357 - protein, 9 aa, Mycobacterium tuberculosis
ALTGPAGQD

SEQ ID NO: 15358 - protein, 9 aa, Mycobacterium tuberculosis
LTGPAGQDA

SEQ ID NO: 15359 - protein, 9 aa, Mycobacterium tuberculosis
TGPAGQDAT

SEQ ID NO: 15360 - protein, 9 aa, Mycobacterium tuberculosis
GPAGQDATV

SEQ ID NO: 15361 - protein, 9 aa, Mycobacterium tuberculosis
PAGQDATVL

SEQ ID NO: 15362 - protein, 9 aa, Mycobacterium tuberculosis
AGQDATVLQ

SEQ ID NO: 15363 - protein, 9 aa, Mycobacterium tuberculosis
GQDATVLQL

SEQ ID NO: 15364 - protein, 9 aa, Mycobacterium tuberculosis
QDATVLQLP

SEQ ID NO: 15365 - protein, 9 aa, Mycobacterium tuberculosis
DATVLQLPE

SEQ ID NO: 15366 - protein, 9 aa, Mycobacterium tuberculosis
ATVLQLPEF

SEQ ID NO: 15367 - protein, 9 aa, Mycobacterium tuberculosis
TVLQLPEFV

SEQ ID NO: 15368 - protein, 9 aa, Mycobacterium tuberculosis
VLQLPEFVR

SEQ ID NO: 15369 - protein, 9 aa, Mycobacterium tuberculosis
LQLPEFVRE

SEQ ID NO: 15370 - protein, 9 aa, Mycobacterium tuberculosis
QLPEFVREP

SEQ ID NO: 15371 - protein, 9 aa, Mycobacterium tuberculosis
LPEFVREPF

SEQ ID NO: 15372 - protein, 9 aa, Mycobacterium tuberculosis
PEFVREPFA

SEQ ID NO: 15373 - protein, 9 aa, Mycobacterium tuberculosis
EFVREPFAA

SEQ ID NO: 15374 - protein, 9 aa, Mycobacterium tuberculosis
FVREPFAAA

SEQ ID NO: 15375 - protein, 9 aa, Mycobacterium tuberculosis
VREPFAAAM

SEQ ID NO: 15376 - protein, 9 aa, Mycobacterium tuberculosis
REPFAAAMS

SEQ ID NO: 15377 - protein, 9 aa, Mycobacterium tuberculosis
EPFAAAMSQ

SEQ ID NO: 15378 - protein, 9 aa, Mycobacterium tuberculosis
PFAAAMSQS

SEQ ID NO: 15379 - protein, 9 aa, Mycobacterium tuberculosis
FAAAMSQSM

SEQ ID NO: 15380 - protein, 9 aa, Mycobacterium tuberculosis
AAAMSQSML

SEQ ID NO: 15381 - protein, 9 aa, Mycobacterium tuberculosis
AAMSQSMLL

SEQ ID NO: 15382 - protein, 9 aa, Mycobacterium tuberculosis
AMSQSMLLP

SEQ ID NO: 15383 - protein, 9 aa, Mycobacterium tuberculosis
MSQSMLLPA

SEQ ID NO: 15384 - protein, 9 aa, Mycobacterium tuberculosis
SQSMLLPAF

SEQ ID NO: 15385 - protein, 9 aa, Mycobacterium tuberculosis
QSMLLPAFV

SEQ ID NO: 15386 - protein, 9 aa, Mycobacterium tuberculosis
SMLLPAFVA

SEQ ID NO: 15387 - protein, 9 aa, Mycobacterium tuberculosis
MLLPAFVAL

SEQ ID NO: 15388 - protein, 9 aa, Mycobacterium tuberculosis
LLPAFVALF

SEQ ID NO: 15389 - protein, 9 aa, Mycobacterium tuberculosis
LPAFVALFG

SEQ ID NO: 15390 - protein, 9 aa, Mycobacterium tuberculosis
PAFVALFGI

SEQ ID NO: 15391 - protein, 9 aa, Mycobacterium tuberculosis
AFVALFGIV

SEQ ID NO: 15392 - protein, 9 aa, Mycobacterium tuberculosis
FVALFGIVA

SEQ ID NO: 15393 - protein, 9 aa, Mycobacterium tuberculosis
VALFGIVAA

SEQ ID NO: 15394 - protein, 9 aa, Mycobacterium tuberculosis
ALFGIVAAL

SEQ ID NO: 15395 - protein, 9 aa, Mycobacterium tuberculosis
LFGIVAALF

SEQ ID NO: 15396 - protein, 9 aa, Mycobacterium tuberculosis
FGIVAALFL

SEQ ID NO: 15397 - protein, 9 aa, Mycobacterium tuberculosis
GIVAALFLV

SEQ ID NO: 15398 - protein, 9 aa, Mycobacterium tuberculosis
IVAALFLVD

SEQ ID NO: 15399 - protein, 9 aa, Mycobacterium tuberculosis
VAALFLVDF

SEQ ID NO: 15400 - protein, 9 aa, Mycobacterium tuberculosis
AALFLVDFT

SEQ ID NO: 15401 - protein, 9 aa, Mycobacterium tuberculosis
ALFLVDFTG

SEQ ID NO: 15402 - protein, 9 aa, Mycobacterium tuberculosis
LFLVDFTGA

SEQ ID NO: 15403 - protein, 9 aa, Mycobacterium tuberculosis
FLVDFTGAA

SEQ ID NO: 15404 - protein, 9 aa, Mycobacterium tuberculosis
LVDFTGAAV

SEQ ID NO: 15405 - protein, 9 aa, Mycobacterium tuberculosis
VDFTGAAVA

SEQ ID NO: 15406 - protein, 9 aa, Mycobacterium tuberculosis
DFTGAAVAK

SEQ ID NO: 15407 - protein, 9 aa, Mycobacterium tuberculosis
FTGAAVAKE

SEQ ID NO: 15408 - protein, 9 aa, Mycobacterium tuberculosis
TGAAVAKEP

SEQ ID NO: 15409 - protein, 9 aa, Mycobacterium tuberculosis
GAAVAKEPL

SEQ ID NO: 15410 - protein, 9 aa, Mycobacterium tuberculosis
AAVAKEPLP

SEQ ID NO: 15411 - protein, 9 aa, Mycobacterium tuberculosis
AVAKEPLPE

SEQ ID NO: 15412 - protein, 9 aa, Mycobacterium tuberculosis
VAKEPLPES

SEQ ID NO: 15413 - protein, 9 aa, Mycobacterium tuberculosis
AKEPLPESD

SEQ ID NO: 15414 - protein, 9 aa, Mycobacterium tuberculosis
KEPLPESDG

SEQ ID NO: 15415 - protein, 9 aa, Mycobacterium tuberculosis
EPLPESDGD

SEQ ID NO: 15416 - protein, 9 aa, Mycobacterium tuberculosis
PLPESDGDA

SEQ ID NO: 15417 - protein, 9 aa, Mycobacterium tuberculosis
LPESDGDAD

SEQ ID NO: 15418 - protein, 9 aa, Mycobacterium tuberculosis
PESDGDADD

SEQ ID NO: 15419 - protein, 9 aa, Mycobacterium tuberculosis
ESDGDADDD

SEQ ID NO: 15420 - protein, 9 aa, Mycobacterium tuberculosis
SDGDADDDD

SEQ ID NO: 15421 - protein, 9 aa, Mycobacterium tuberculosis
DGDADDDDY

SEQ ID NO: 15422 - protein, 9 aa, Mycobacterium tuberculosis
GDADDDDYV

SEQ ID NO: 15423 - protein, 9 aa, Mycobacterium tuberculosis
DADDDDYVE

SEQ ID NO: 15424 - protein, 9 aa, Mycobacterium tuberculosis
ADDDDYVEY

SEQ ID NO: 15425 - protein, 9 aa, Mycobacterium tuberculosis
DDDDYVEYI

SEQ ID NO: 15426 - protein, 9 aa, Mycobacterium tuberculosis
DDDYVEYIL

SEQ ID NO: 15427 - protein, 9 aa, Mycobacterium tuberculosis
DDYVEYILR

SEQ ID NO: 15428 - protein, 9 aa, Mycobacterium tuberculosis
DYVEYILRR

SEQ ID NO: 15429 - protein, 9 aa, Mycobacterium tuberculosis
YVEYILRRE

SEQ ID NO: 15430 - protein, 9 aa, Mycobacterium tuberculosis
VEYILRREP

SEQ ID NO: 15431 - protein, 9 aa, Mycobacterium tuberculosis
EYILRREPE

SEQ ID NO: 15432 - protein, 9 aa, Mycobacterium tuberculosis
YILRREPEE

SEQ ID NO: 15433 - protein, 9 aa, Mycobacterium tuberculosis
ILRREPEED

SEQ ID NO: 15434 - protein, 9 aa, Mycobacterium tuberculosis
LRREPEEDC

SEQ ID NO: 15435 - protein, 9 aa, Mycobacterium tuberculosis
RREPEEDCD

SEQ ID NO: 15436 - protein, 9 aa, Mycobacterium tuberculosis
REPEEDCDT

SEQ ID NO: 15437 - protein, 9 aa, Mycobacterium tuberculosis
EPEEDCDTQ

SEQ ID NO: 15438 - protein, 9 aa, Mycobacterium tuberculosis
PEEDCDTQP

SEQ ID NO: 15439 - protein, 9 aa, Mycobacterium tuberculosis
EEDCDTQPL

SEQ ID NO: 15440 - protein, 9 aa, Mycobacterium tuberculosis
EDCDTQPLR

SEQ ID NO: 15441 - protein, 9 aa, Mycobacterium tuberculosis
DCDTQPLRA

SEQ ID NO: 15442 - protein, 9 aa, Mycobacterium tuberculosis
CDTQPLRAS

SEQ ID NO: 15443 - protein, 9 aa, Mycobacterium tuberculosis
DTQPLRASR

SEQ ID NO: 15444 - protein, 9 aa, Mycobacterium tuberculosis
TQPLRASRP

SEQ ID NO: 15445 - protein, 9 aa, Mycobacterium tuberculosis
QPLRASRPA

SEQ ID NO: 15446 - protein, 9 aa, Mycobacterium tuberculosis
PLRASRPAA

SEQ ID NO: 15447 - protein, 9 aa, Mycobacterium tuberculosis
LRASRPAAA

SEQ ID NO: 15448 - protein, 9 aa, Mycobacterium tuberculosis
RASRPAAAA

SEQ ID NO: 15449 - protein, 9 aa, Mycobacterium tuberculosis
ASRPAAAAA

SEQ ID NO: 15450 - protein, 9 aa, Mycobacterium tuberculosis
SRPAAAAAS

SEQ ID NO: 15451 - protein, 9 aa, Mycobacterium tuberculosis
RPAAAAASR

SEQ ID NO: 15452 - protein, 9 aa, Mycobacterium tuberculosis
PAAAAASRS

SEQ ID NO: 15453 - protein, 9 aa, Mycobacterium tuberculosis
AAAAASRSG

SEQ ID NO: 15454 - protein, 9 aa, Mycobacterium tuberculosis
AAAASRSGA

SEQ ID NO: 15455 - protein, 9 aa, Mycobacterium tuberculosis
AAASRSGAG

SEQ ID NO: 15456 - protein, 9 aa, Mycobacterium tuberculosis
AASRSGAGG

SEQ ID NO: 15457 - protein, 9 aa, Mycobacterium tuberculosis
ASRSGAGGP

SEQ ID NO: 15458 - protein, 9 aa, Mycobacterium tuberculosis
SRSGAGGPL

SEQ ID NO: 15459 - protein, 9 aa, Mycobacterium tuberculosis
RSGAGGPLA

SEQ ID NO: 15460 - protein, 9 aa, Mycobacterium tuberculosis
SGAGGPLAV

SEQ ID NO: 15461 - protein, 9 aa, Mycobacterium tuberculosis
GAGGPLAVS

SEQ ID NO: 15462 - protein, 9 aa, Mycobacterium tuberculosis
AGGPLAVSW

SEQ ID NO: 15463 - protein, 9 aa, Mycobacterium tuberculosis
GGPLAVSWS

SEQ ID NO: 15464 - protein, 9 aa, Mycobacterium tuberculosis
GPLAVSWST

SEQ ID NO: 15465 - protein, 9 aa, Mycobacterium tuberculosis
PLAVSWSTS

SEQ ID NO: 15466 - protein, 9 aa, Mycobacterium tuberculosis
LAVSWSTSA

SEQ ID NO: 15467 - protein, 9 aa, Mycobacterium tuberculosis
AVSWSTSAQ

SEQ ID NO: 15468 - protein, 9 aa, Mycobacterium tuberculosis
VSWSTSAQG

SEQ ID NO: 15469 - protein, 9 aa, Mycobacterium tuberculosis
SWSTSAQGM

SEQ ID NO: 15470 - protein, 9 aa, Mycobacterium tuberculosis
WSTSAQGMP

SEQ ID NO: 15471 - protein, 9 aa, Mycobacterium tuberculosis
STSAQGMPP

SEQ ID NO: 15472 - protein, 9 aa, Mycobacterium tuberculosis
TSAQGMPPG

SEQ ID NO: 15473 - protein, 9 aa, Mycobacterium tuberculosis
SAQGMPPGP

SEQ ID NO: 15474 - protein, 9 aa, Mycobacterium tuberculosis
AQGMPPGPP

SEQ ID NO: 15475 - protein, 9 aa, Mycobacterium tuberculosis
QGMPPGPPG

SEQ ID NO: 15476 - protein, 9 aa, Mycobacterium tuberculosis
GMPPGPPGR

SEQ ID NO: 15477 - protein, 9 aa, Mycobacterium tuberculosis
MPPGPPGRR

SEQ ID NO: 15478 - protein, 9 aa, Mycobacterium tuberculosis
PPGPPGRRA

SEQ ID NO: 15479 - protein, 9 aa, Mycobacterium tuberculosis
PGPPGRRAW

SEQ ID NO: 15480 - protein, 9 aa, Mycobacterium tuberculosis
GPPGRRAWQ

SEQ ID NO: 15481 - protein, 9 aa, Mycobacterium tuberculosis
PPGRRAWQA

SEQ ID NO: 15482 - protein, 9 aa, Mycobacterium tuberculosis
PGRRAWQAD

SEQ ID NO: 15483 - protein, 9 aa, Mycobacterium tuberculosis
GRRAWQADT

SEQ ID NO: 15484 - protein, 9 aa, Mycobacterium tuberculosis
RRAWQADTE

SEQ ID NO: 15485 - protein, 9 aa, Mycobacterium tuberculosis
RAWQADTES

SEQ ID NO: 15486 - protein, 9 aa, Mycobacterium tuberculosis
AWQADTEST

SEQ ID NO: 15487 - protein, 9 aa, Mycobacterium tuberculosis
WQADTESTA

SEQ ID NO: 15488 - protein, 9 aa, Mycobacterium tuberculosis
QADTESTAP

SEQ ID NO: 15489 - protein, 9 aa, Mycobacterium tuberculosis
ADTESTAPS

SEQ ID NO: 15490 - protein, 9 aa, Mycobacterium tuberculosis
DTESTAPSA

SEQ ID NO: 15491 - protein, 10 aa, Mycobacterium tuberculosis
MTTAIRRAAG

SEQ ID NO: 15492 - protein, 10 aa, Mycobacterium tuberculosis
TTAIRRAAGS

SEQ ID NO: 15493 - protein, 10 aa, Mycobacterium tuberculosis
TAIRRAAGSS

SEQ ID NO: 15494 - protein, 10 aa, Mycobacterium tuberculosis
AIRRAAGSSY

SEQ ID NO: 15495 - protein, 10 aa, Mycobacterium tuberculosis
IRRAAGSSYF

SEQ ID NO: 15496 - protein, 10 aa, Mycobacterium tuberculosis
RRAAGSSYFR

SEQ ID NO: 15497 - protein, 10 aa, Mycobacterium tuberculosis
RAAGSSYFRN

SEQ ID NO: 15498 - protein, 10 aa, Mycobacterium tuberculosis
AAGSSYFRNP

SEQ ID NO: 15499 - protein, 10 aa, Mycobacterium tuberculosis
AGSSYFRNPW

SEQ ID NO: 15500 - protein, 10 aa, Mycobacterium tuberculosis
GSSYFRNPWP

SEQ ID NO: 15501 - protein, 10 aa, Mycobacterium tuberculosis
SSYFRNPWPA

SEQ ID NO: 15502 - protein, 10 aa, Mycobacterium tuberculosis
SYFRNPWPAL

SEQ ID NO: 15503 - protein, 10 aa, Mycobacterium tuberculosis
YFRNPWPALW

SEQ ID NO: 15504 - protein, 10 aa, Mycobacterium tuberculosis
FRNPWPALWA

SEQ ID NO: 15505 - protein, 10 aa, Mycobacterium tuberculosis
RNPWPALWAM

SEQ ID NO: 15506 - protein, 10 aa, Mycobacterium tuberculosis
NPWPALWAMM

SEQ ID NO: 15507 - protein, 10 aa, Mycobacterium tuberculosis
PWPALWAMMV

SEQ ID NO: 15508 - protein, 10 aa, Mycobacterium tuberculosis
WPALWAMMVG

SEQ ID NO: 15509 - protein, 10 aa, Mycobacterium tuberculosis
PALWAMMVGF

SEQ ID NO: 15510 - protein, 10 aa, Mycobacterium tuberculosis
ALWAMMVGFF

SEQ ID NO: 15511 - protein, 10 aa, Mycobacterium tuberculosis
LWAMMVGFFM

SEQ ID NO: 15512 - protein, 10 aa, Mycobacterium tuberculosis
WAMMVGFFMI

SEQ ID NO: 15513 - protein, 10 aa, Mycobacterium tuberculosis
AMMVGFFMIM

SEQ ID NO: 15514 - protein, 10 aa, Mycobacterium tuberculosis
MMVGFFMIML

SEQ ID NO: 15515 - protein, 10 aa, Mycobacterium tuberculosis
MVGFFMIMLD

SEQ ID NO: 15516 - protein, 10 aa, Mycobacterium tuberculosis
VGFFMIMLDS

SEQ ID NO: 15517 - protein, 10 aa, Mycobacterium tuberculosis
GFFMIMLDST

SEQ ID NO: 15518 - protein, 10 aa, Mycobacterium tuberculosis
FFMIMLDSTV

SEQ ID NO: 15519 - protein, 10 aa, Mycobacterium tuberculosis
FMIMLDSTVV

SEQ ID NO: 15520 - protein, 10 aa, Mycobacterium tuberculosis
MIMLDSTVVA

SEQ ID NO: 15521 - protein, 10 aa, Mycobacterium tuberculosis
IMLDSTVVAI

SEQ ID NO: 15522 - protein, 10 aa, Mycobacterium tuberculosis
MLDSTVVAIA

SEQ ID NO: 15523 - protein, 10 aa, Mycobacterium tuberculosis
LDSTVVAIAN

SEQ ID NO: 15524 - protein, 10 aa, Mycobacterium tuberculosis
DSTVVAIANP

SEQ ID NO: 15525 - protein, 10 aa, Mycobacterium tuberculosis
STVVAIANPT

SEQ ID NO: 15526 - protein, 10 aa, Mycobacterium tuberculosis
TVVAIANPTI

SEQ ID NO: 15527 - protein, 10 aa, Mycobacterium tuberculosis
VVAIANPTIM

SEQ ID NO: 15528 - protein, 10 aa, Mycobacterium tuberculosis
VAIANPTIMA

SEQ ID NO: 15529 - protein, 10 aa, Mycobacterium tuberculosis
AIANPTIMAQ

SEQ ID NO: 15530 - protein, 10 aa, Mycobacterium tuberculosis
IANPTIMAQL

SEQ ID NO: 15531 - protein, 10 aa, Mycobacterium tuberculosis
ANPTIMAQLR

SEQ ID NO: 15532 - protein, 10 aa, Mycobacterium tuberculosis
NPTIMAQLRI

SEQ ID NO: 15533 - protein, 10 aa, Mycobacterium tuberculosis
PTIMAQLRIG

SEQ ID NO: 15534 - protein, 10 aa, Mycobacterium tuberculosis
TIMAQLRIGY

SEQ ID NO: 15535 - protein, 10 aa, Mycobacterium tuberculosis
IMAQLRIGYA

SEQ ID NO: 15536 - protein, 10 aa, Mycobacterium tuberculosis
MAQLRIGYAT

SEQ ID NO: 15537 - protein, 10 aa, Mycobacterium tuberculosis
AQLRIGYATV

SEQ ID NO: 15538 - protein, 10 aa, Mycobacterium tuberculosis
QLRIGYATVV

SEQ ID NO: 15539 - protein, 10 aa, Mycobacterium tuberculosis
LRIGYATVVW

SEQ ID NO: 15540 - protein, 10 aa, Mycobacterium tuberculosis
RIGYATVVWV

SEQ ID NO: 15541 - protein, 10 aa, Mycobacterium tuberculosis
IGYATVVWVT

SEQ ID NO: 15542 - protein, 10 aa, Mycobacterium tuberculosis
GYATVVWVTS

SEQ ID NO: 15543 - protein, 10 aa, Mycobacterium tuberculosis
YATVVWVTSA

SEQ ID NO: 15544 - protein, 10 aa, Mycobacterium tuberculosis
ATVVWVTSAY

SEQ ID NO: 15545 - protein, 10 aa, Mycobacterium tuberculosis
TVVWVTSAYL

SEQ ID NO: 15546 - protein, 10 aa, Mycobacterium tuberculosis
VVWVTSAYLL

SEQ ID NO: 15547 - protein, 10 aa, Mycobacterium tuberculosis
VWVTSAYLLA

SEQ ID NO: 15548 - protein, 10 aa, Mycobacterium tuberculosis
WVTSAYLLAY

SEQ ID NO: 15549 - protein, 10 aa, Mycobacterium tuberculosis
VTSAYLLAYA

SEQ ID NO: 15550 - protein, 10 aa, Mycobacterium tuberculosis
TSAYLLAYAV

SEQ ID NO: 15551 - protein, 10 aa, Mycobacterium tuberculosis
SAYLLAYAVP

SEQ ID NO: 15552 - protein, 10 aa, Mycobacterium tuberculosis
AYLLAYAVPM

SEQ ID NO: 15553 - protein, 10 aa, Mycobacterium tuberculosis
YLLAYAVPML

SEQ ID NO: 15554 - protein, 10 aa, Mycobacterium tuberculosis
LLAYAVPMLV

SEQ ID NO: 15555 - protein, 10 aa, Mycobacterium tuberculosis
LAYAVPMLVA

SEQ ID NO: 15556 - protein, 10 aa, Mycobacterium tuberculosis
AYAVPMLVAG

SEQ ID NO: 15557 - protein, 10 aa, Mycobacterium tuberculosis
YAVPMLVAGR

SEQ ID NO: 15558 - protein, 10 aa, Mycobacterium tuberculosis
AVPMLVAGRL

SEQ ID NO: 15559 - protein, 10 aa, Mycobacterium tuberculosis
VPMLVAGRLG

SEQ ID NO: 15560 - protein, 10 aa, Mycobacterium tuberculosis
PMLVAGRLGD

SEQ ID NO: 15561 - protein, 10 aa, Mycobacterium tuberculosis
MLVAGRLGDR

SEQ ID NO: 15562 - protein, 10 aa, Mycobacterium tuberculosis
LVAGRLGDRF

SEQ ID NO: 15563 - protein, 10 aa, Mycobacterium tuberculosis
VAGRLGDRFG

SEQ ID NO: 15564 - protein, 10 aa, Mycobacterium tuberculosis
AGRLGDRFGP

SEQ ID NO: 15565 - protein, 10 aa, Mycobacterium tuberculosis
GRLGDRFGPK

SEQ ID NO: 15566 - protein, 10 aa, Mycobacterium tuberculosis
RLGDRFGPKN

SEQ ID NO: 15567 - protein, 10 aa, Mycobacterium tuberculosis
LGDRFGPKNL

SEQ ID NO: 15568 - protein, 10 aa, Mycobacterium tuberculosis
GDRFGPKNLY

SEQ ID NO: 15569 - protein, 10 aa, Mycobacterium tuberculosis
DRFGPKNLYL

SEQ ID NO: 15570 - protein, 10 aa, Mycobacterium tuberculosis
RFGPKNLYLI

SEQ ID NO: 15571 - protein, 10 aa, Mycobacterium tuberculosis
FGPKNLYLIG

SEQ ID NO: 15572 - protein, 10 aa, Mycobacterium tuberculosis
GPKNLYLIGL

SEQ ID NO: 15573 - protein, 10 aa, Mycobacterium tuberculosis
PKNLYLIGLG

SEQ ID NO: 15574 - protein, 10 aa, Mycobacterium tuberculosis
KNLYLIGLGV

SEQ ID NO: 15575 - protein, 10 aa, Mycobacterium tuberculosis
NLYLIGLGVF

SEQ ID NO: 15576 - protein, 10 aa, Mycobacterium tuberculosis
LYLIGLGVFT

SEQ ID NO: 15577 - protein, 10 aa, Mycobacterium tuberculosis
YLIGLGVFTV

SEQ ID NO: 15578 - protein, 10 aa, Mycobacterium tuberculosis
LIGLGVFTVA

SEQ ID NO: 15579 - protein, 10 aa, Mycobacterium tuberculosis
IGLGVFTVAS

SEQ ID NO: 15580 - protein, 10 aa, Mycobacterium tuberculosis
GLGVFTVASL

SEQ ID NO: 15581 - protein, 10 aa, Mycobacterium tuberculosis
LGVFTVASLG

SEQ ID NO: 15582 - protein, 10 aa, Mycobacterium tuberculosis
GVFTVASLGC

SEQ ID NO: 15583 - protein, 10 aa, Mycobacterium tuberculosis
VFTVASLGCG

SEQ ID NO: 15584 - protein, 10 aa, Mycobacterium tuberculosis
FTVASLGCGL

SEQ ID NO: 15585 - protein, 10 aa, Mycobacterium tuberculosis
TVASLGCGLS

SEQ ID NO: 15586 - protein, 10 aa, Mycobacterium tuberculosis
VASLGCGLSS

SEQ ID NO: 15587 - protein, 10 aa, Mycobacterium tuberculosis
ASLGCGLSSG

SEQ ID NO: 15588 - protein, 10 aa, Mycobacterium tuberculosis
SLGCGLSSGA

SEQ ID NO: 15589 - protein, 10 aa, Mycobacterium tuberculosis
LGCGLSSGAG

SEQ ID NO: 15590 - protein, 10 aa, Mycobacterium tuberculosis
GCGLSSGAGM

SEQ ID NO: 15591 - protein, 10 aa, Mycobacterium tuberculosis
CGLSSGAGML

SEQ ID NO: 15592 - protein, 10 aa, Mycobacterium tuberculosis
GLSSGAGMLI

SEQ ID NO: 15593 - protein, 10 aa, Mycobacterium tuberculosis
LSSGAGMLIA

SEQ ID NO: 15594 - protein, 10 aa, Mycobacterium tuberculosis
SSGAGMLIAA

SEQ ID NO: 15595 - protein, 10 aa, Mycobacterium tuberculosis
SGAGMLIAAR

SEQ ID NO: 15596 - protein, 10 aa, Mycobacterium tuberculosis
GAGMLIAARV

SEQ ID NO: 15597 - protein, 10 aa, Mycobacterium tuberculosis
AGMLIAARVV

SEQ ID NO: 15598 - protein, 10 aa, Mycobacterium tuberculosis
GMLIAARVVQ

SEQ ID NO: 15599 - protein, 10 aa, Mycobacterium tuberculosis
MLIAARVVQG

SEQ ID NO: 15600 - protein, 10 aa, Mycobacterium tuberculosis
LIAARVVQGV

SEQ ID NO: 15601 - protein, 10 aa, Mycobacterium tuberculosis
IAARVVQGVG

SEQ ID NO: 15602 - protein, 10 aa, Mycobacterium tuberculosis
AARVVQGVGA

SEQ ID NO: 15603 - protein, 10 aa, Mycobacterium tuberculosis
ARVVQGVGAG

SEQ ID NO: 15604 - protein, 10 aa, Mycobacterium tuberculosis
RVVQGVGAGL

SEQ ID NO: 15605 - protein, 10 aa, Mycobacterium tuberculosis
VVQGVGAGLL

SEQ ID NO: 15606 - protein, 10 aa, Mycobacterium tuberculosis
VQGVGAGLLT

SEQ ID NO: 15607 - protein, 10 aa, Mycobacterium tuberculosis
QGVGAGLLTP

SEQ ID NO: 15608 - protein, 10 aa, Mycobacterium tuberculosis
GVGAGLLTPQ

SEQ ID NO: 15609 - protein, 10 aa, Mycobacterium tuberculosis
VGAGLLTPQT

SEQ ID NO: 15610 - protein, 10 aa, Mycobacterium tuberculosis
GAGLLTPQTL

SEQ ID NO: 15611 - protein, 10 aa, Mycobacterium tuberculosis
AGLLTPQTLS

SEQ ID NO: 15612 - protein, 10 aa, Mycobacterium tuberculosis
GLLTPQTLST

SEQ ID NO: 15613 - protein, 10 aa, Mycobacterium tuberculosis
LLTPQTLSTI

SEQ ID NO: 15614 - protein, 10 aa, Mycobacterium tuberculosis
LTPQTLSTIT

SEQ ID NO: 15615 - protein, 10 aa, Mycobacterium tuberculosis
TPQTLSTITR

SEQ ID NO: 15616 - protein, 10 aa, Mycobacterium tuberculosis
PQTLSTITRI

SEQ ID NO: 15617 - protein, 10 aa, Mycobacterium tuberculosis
QTLSTITRIF

SEQ ID NO: 15618 - protein, 10 aa, Mycobacterium tuberculosis
TLSTITRIFP

SEQ ID NO: 15619 - protein, 10 aa, Mycobacterium tuberculosis
LSTITRIFPA

SEQ ID NO: 15620 - protein, 10 aa, Mycobacterium tuberculosis
STITRIFPAH

SEQ ID NO: 15621 - protein, 10 aa, Mycobacterium tuberculosis
TITRIFPAHR

SEQ ID NO: 15622 - protein, 10 aa, Mycobacterium tuberculosis
ITRIFPAHRR

SEQ ID NO: 15623 - protein, 10 aa, Mycobacterium tuberculosis
TRIFPAHRRG

SEQ ID NO: 15624 - protein, 10 aa, Mycobacterium tuberculosis
RIFPAHRRGV

SEQ ID NO: 15625 - protein, 10 aa, Mycobacterium tuberculosis
IFPAHRRGVA

SEQ ID NO: 15626 - protein, 10 aa, Mycobacterium tuberculosis
FPAHRRGVAL

SEQ ID NO: 15627 - protein, 10 aa, Mycobacterium tuberculosis
PAHRRGVALG

SEQ ID NO: 15628 - protein, 10 aa, Mycobacterium tuberculosis
AHRRGVALGA

SEQ ID NO: 15629 - protein, 10 aa, Mycobacterium tuberculosis
HRRGVALGAW

SEQ ID NO: 15630 - protein, 10 aa, Mycobacterium tuberculosis
RRGVALGAWG

SEQ ID NO: 15631 - protein, 10 aa, Mycobacterium tuberculosis
RGVALGAWGT

SEQ ID NO: 15632 - protein, 10 aa, Mycobacterium tuberculosis
GVALGAWGTV

SEQ ID NO: 15633 - protein, 10 aa, Mycobacterium tuberculosis
VALGAWGTVA

SEQ ID NO: 15634 - protein, 10 aa, Mycobacterium tuberculosis
ALGAWGTVAS

SEQ ID NO: 15635 - protein, 10 aa, Mycobacterium tuberculosis
LGAWGTVASV

SEQ ID NO: 15636 - protein, 10 aa, Mycobacterium tuberculosis
GAWGTVASVA

SEQ ID NO: 15637 - protein, 10 aa, Mycobacterium tuberculosis
AWGTVASVAS

SEQ ID NO: 15638 - protein, 10 aa, Mycobacterium tuberculosis
WGTVASVASL

SEQ ID NO: 15639 - protein, 10 aa, Mycobacterium tuberculosis
GTVASVASLV

SEQ ID NO: 15640 - protein, 10 aa, Mycobacterium tuberculosis
TVASVASLVG

SEQ ID NO: 15641 - protein, 10 aa, Mycobacterium tuberculosis
VASVASLVGP

SEQ ID NO: 15642 - protein, 10 aa, Mycobacterium tuberculosis
ASVASLVGPL

SEQ ID NO: 15643 - protein, 10 aa, Mycobacterium tuberculosis
SVASLVGPLA

SEQ ID NO: 15644 - protein, 10 aa, Mycobacterium tuberculosis
VASLVGPLAG

SEQ ID NO: 15645 - protein, 10 aa, Mycobacterium tuberculosis
ASLVGPLAGG

SEQ ID NO: 15646 - protein, 10 aa, Mycobacterium tuberculosis
SLVGPLAGGA

SEQ ID NO: 15647 - protein, 10 aa, Mycobacterium tuberculosis
LVGPLAGGAL

SEQ ID NO: 15648 - protein, 10 aa, Mycobacterium tuberculosis
VGPLAGGALV

SEQ ID NO: 15649 - protein, 10 aa, Mycobacterium tuberculosis
GPLAGGALVD

SEQ ID NO: 15650 - protein, 10 aa, Mycobacterium tuberculosis
PLAGGALVDS

SEQ ID NO: 15651 - protein, 10 aa, Mycobacterium tuberculosis
LAGGALVDSM

SEQ ID NO: 15652 - protein, 10 aa, Mycobacterium tuberculosis
AGGALVDSMG

SEQ ID NO: 15653 - protein, 10 aa, Mycobacterium tuberculosis
GGALVDSMGW

SEQ ID NO: 15654 - protein, 10 aa, Mycobacterium tuberculosis
GALVDSMGWE

SEQ ID NO: 15655 - protein, 10 aa, Mycobacterium tuberculosis
ALVDSMGWEW

SEQ ID NO: 15656 - protein, 10 aa, Mycobacterium tuberculosis
LVDSMGWEWI

SEQ ID NO: 15657 - protein, 10 aa, Mycobacterium tuberculosis
VDSMGWEWIF

SEQ ID NO: 15658 - protein, 10 aa, Mycobacterium tuberculosis
DSMGWEWIFF

SEQ ID NO: 15659 - protein, 10 aa, Mycobacterium tuberculosis
SMGWEWIFFV

SEQ ID NO: 15660 - protein, 10 aa, Mycobacterium tuberculosis
MGWEWIFFVN

SEQ ID NO: 15661 - protein, 10 aa, Mycobacterium tuberculosis
GWEWIFFVNV

SEQ ID NO: 15662 - protein, 10 aa, Mycobacterium tuberculosis
WEWIFFVNVP

SEQ ID NO: 15663 - protein, 10 aa, Mycobacterium tuberculosis
EWIFFVNVPV

SEQ ID NO: 15664 - protein, 10 aa, Mycobacterium tuberculosis
WIFFVNVPVG

SEQ ID NO: 15665 - protein, 10 aa, Mycobacterium tuberculosis
IFFVNVPVGV

SEQ ID NO: 15666 - protein, 10 aa, Mycobacterium tuberculosis
FFVNVPVGVI

SEQ ID NO: 15667 - protein, 10 aa, Mycobacterium tuberculosis
FVNVPVGVIG

SEQ ID NO: 15668 - protein, 10 aa, Mycobacterium tuberculosis
VNVPVGVIGL

SEQ ID NO: 15669 - protein, 10 aa, Mycobacterium tuberculosis
NVPVGVIGLI

SEQ ID NO: 15670 - protein, 10 aa, Mycobacterium tuberculosis
VPVGVIGLIL

SEQ ID NO: 15671 - protein, 10 aa, Mycobacterium tuberculosis
PVGVIGLILA

SEQ ID NO: 15672 - protein, 10 aa, Mycobacterium tuberculosis
VGVIGLILAA

SEQ ID NO: 15673 - protein, 10 aa, Mycobacterium tuberculosis
GVIGLILAAY

SEQ ID NO: 15674 - protein, 10 aa, Mycobacterium tuberculosis
VIGLILAAYL

SEQ ID NO: 15675 - protein, 10 aa, Mycobacterium tuberculosis
IGLILAAYLI

SEQ ID NO: 15676 - protein, 10 aa, Mycobacterium tuberculosis
GLILAAYLIP

SEQ ID NO: 15677 - protein, 10 aa, Mycobacterium tuberculosis
LILAAYLIPA

SEQ ID NO: 15678 - protein, 10 aa, Mycobacterium tuberculosis
ILAAYLIPAL

SEQ ID NO: 15679 - protein, 10 aa, Mycobacterium tuberculosis
LAAYLIPALP

SEQ ID NO: 15680 - protein, 10 aa, Mycobacterium tuberculosis
AAYLIPALPH

SEQ ID NO: 15681 - protein, 10 aa, Mycobacterium tuberculosis
AYLIPALPHH

SEQ ID NO: 15682 - protein, 10 aa, Mycobacterium tuberculosis
YLIPALPHHP

SEQ ID NO: 15683 - protein, 10 aa, Mycobacterium tuberculosis
LIPALPHHPH

SEQ ID NO: 15684 - protein, 10 aa, Mycobacterium tuberculosis
IPALPHHPHR

SEQ ID NO: 15685 - protein, 10 aa, Mycobacterium tuberculosis
PALPHHPHRF

SEQ ID NO: 15686 - protein, 10 aa, Mycobacterium tuberculosis
ALPHHPHRFD

SEQ ID NO: 15687 - protein, 10 aa, Mycobacterium tuberculosis
LPHHPHRFDW

SEQ ID NO: 15688 - protein, 10 aa, Mycobacterium tuberculosis
PHHPHRFDWF

SEQ ID NO: 15689 - protein, 10 aa, Mycobacterium tuberculosis
HHPHRFDWFG

SEQ ID NO: 15690 - protein, 10 aa, Mycobacterium tuberculosis
HPHRFDWFGV

SEQ ID NO: 15691 - protein, 10 aa, Mycobacterium tuberculosis
PHRFDWFGVG

SEQ ID NO: 15692 - protein, 10 aa, Mycobacterium tuberculosis
HRFDWFGVGL

SEQ ID NO: 15693 - protein, 10 aa, Mycobacterium tuberculosis
RFDWFGVGLS

SEQ ID NO: 15694 - protein, 10 aa, Mycobacterium tuberculosis
FDWFGVGLSG

SEQ ID NO: 15695 - protein, 10 aa, Mycobacterium tuberculosis
DWFGVGLSGA

SEQ ID NO: 15696 - protein, 10 aa, Mycobacterium tuberculosis
WFGVGLSGAG

SEQ ID NO: 15697 - protein, 10 aa, Mycobacterium tuberculosis
FGVGLSGAGM

SEQ ID NO: 15698 - protein, 10 aa, Mycobacterium tuberculosis
GVGLSGAGMF

SEQ ID NO: 15699 - protein, 10 aa, Mycobacterium tuberculosis
VGLSGAGMFL

SEQ ID NO: 15700 - protein, 10 aa, Mycobacterium tuberculosis
GLSGAGMFLI

SEQ ID NO: 15701 - protein, 10 aa, Mycobacterium tuberculosis
LSGAGMFLIV

SEQ ID NO: 15702 - protein, 10 aa, Mycobacterium tuberculosis
SGAGMFLIVF

SEQ ID NO: 15703 - protein, 10 aa, Mycobacterium tuberculosis
GAGMFLIVFG

SEQ ID NO: 15704 - protein, 10 aa, Mycobacterium tuberculosis
AGMFLIVFGL

SEQ ID NO: 15705 - protein, 10 aa, Mycobacterium tuberculosis
GMFLIVFGLQ

SEQ ID NO: 15706 - protein, 10 aa, Mycobacterium tuberculosis
MFLIVFGLQQ

SEQ ID NO: 15707 - protein, 10 aa, Mycobacterium tuberculosis
FLIVFGLQQG

SEQ ID NO: 15708 - protein, 10 aa, Mycobacterium tuberculosis
LIVFGLQQGQ

SEQ ID NO: 15709 - protein, 10 aa, Mycobacterium tuberculosis
IVFGLQQGQS

SEQ ID NO: 15710 - protein, 10 aa, Mycobacterium tuberculosis
VFGLQQGQSA

SEQ ID NO: 15711 - protein, 10 aa, Mycobacterium tuberculosis
FGLQQGQSAN

SEQ ID NO: 15712 - protein, 10 aa, Mycobacterium tuberculosis
GLQQGQSANW

SEQ ID NO: 15713 - protein, 10 aa, Mycobacterium tuberculosis
LQQGQSANWQ

SEQ ID NO: 15714 - protein, 10 aa, Mycobacterium tuberculosis
QQGQSANWQP

SEQ ID NO: 15715 - protein, 10 aa, Mycobacterium tuberculosis
QGQSANWQPW

SEQ ID NO: 15716 - protein, 10 aa, Mycobacterium tuberculosis
GQSANWQPWI

SEQ ID NO: 15717 - protein, 10 aa, Mycobacterium tuberculosis
QSANWQPWIW

SEQ ID NO: 15718 - protein, 10 aa, Mycobacterium tuberculosis
SANWQPWIWA

SEQ ID NO: 15719 - protein, 10 aa, Mycobacterium tuberculosis
ANWQPWIWAV

SEQ ID NO: 15720 - protein, 10 aa, Mycobacterium tuberculosis
NWQPWIWAVI

SEQ ID NO: 15721 - protein, 10 aa, Mycobacterium tuberculosis
WQPWIWAVIV

SEQ ID NO: 15722 - protein, 10 aa, Mycobacterium tuberculosis
QPWIWAVIVG

SEQ ID NO: 15723 - protein, 10 aa, Mycobacterium tuberculosis
PWIWAVIVGG

SEQ ID NO: 15724 - protein, 10 aa, Mycobacterium tuberculosis
WIWAVIVGGI

SEQ ID NO: 15725 - protein, 10 aa, Mycobacterium tuberculosis
IWAVIVGGIG

SEQ ID NO: 15726 - protein, 10 aa, Mycobacterium tuberculosis
WAVIVGGIGF

SEQ ID NO: 15727 - protein, 10 aa, Mycobacterium tuberculosis
AVIVGGIGFM

SEQ ID NO: 15728 - protein, 10 aa, Mycobacterium tuberculosis
VIVGGIGFMS

SEQ ID NO: 15729 - protein, 10 aa, Mycobacterium tuberculosis
IVGGIGFMSL

SEQ ID NO: 15730 - protein, 10 aa, Mycobacterium tuberculosis
VGGIGFMSLF

SEQ ID NO: 15731 - protein, 10 aa, Mycobacterium tuberculosis
GGIGFMSLFV

SEQ ID NO: 15732 - protein, 10 aa, Mycobacterium tuberculosis
GIGFMSLFVY

SEQ ID NO: 15733 - protein, 10 aa, Mycobacterium tuberculosis
IGFMSLFVYW

SEQ ID NO: 15734 - protein, 10 aa, Mycobacterium tuberculosis
GFMSLFVYWQ

SEQ ID NO: 15735 - protein, 10 aa, Mycobacterium tuberculosis
FMSLFVYWQA

SEQ ID NO: 15736 - protein, 10 aa, Mycobacterium tuberculosis
MSLFVYWQAR

SEQ ID NO: 15737 - protein, 10 aa, Mycobacterium tuberculosis
SLFVYWQARN

SEQ ID NO: 15738 - protein, 10 aa, Mycobacterium tuberculosis
LFVYWQARNA

SEQ ID NO: 15739 - protein, 10 aa, Mycobacterium tuberculosis
FVYWQARNAR

SEQ ID NO: 15740 - protein, 10 aa, Mycobacterium tuberculosis
VYWQARNARE

SEQ ID NO: 15741 - protein, 10 aa, Mycobacterium tuberculosis
YWQARNAREP

SEQ ID NO: 15742 - protein, 10 aa, Mycobacterium tuberculosis
WQARNAREPL

SEQ ID NO: 15743 - protein, 10 aa, Mycobacterium tuberculosis
QARNAREPLI

SEQ ID NO: 15744 - protein, 10 aa, Mycobacterium tuberculosis
ARNAREPLIP

SEQ ID NO: 15745 - protein, 10 aa, Mycobacterium tuberculosis
RNAREPLIPL

SEQ ID NO: 15746 - protein, 10 aa, Mycobacterium tuberculosis
NAREPLIPLE

SEQ ID NO: 15747 - protein, 10 aa, Mycobacterium tuberculosis
AREPLIPLEV

SEQ ID NO: 15748 - protein, 10 aa, Mycobacterium tuberculosis
REPLIPLEVF

SEQ ID NO: 15749 - protein, 10 aa, Mycobacterium tuberculosis
EPLIPLEVFN

SEQ ID NO: 15750 - protein, 10 aa, Mycobacterium tuberculosis
PLIPLEVFND

SEQ ID NO: 15751 - protein, 10 aa, Mycobacterium tuberculosis
LIPLEVFNDR

SEQ ID NO: 15752 - protein, 10 aa, Mycobacterium tuberculosis
IPLEVFNDRN

SEQ ID NO: 15753 - protein, 10 aa, Mycobacterium tuberculosis
PLEVFNDRNF

SEQ ID NO: 15754 - protein, 10 aa, Mycobacterium tuberculosis
LEVFNDRNFS

SEQ ID NO: 15755 - protein, 10 aa, Mycobacterium tuberculosis
EVFNDRNFSL

SEQ ID NO: 15756 - protein, 10 aa, Mycobacterium tuberculosis
VFNDRNFSLS

SEQ ID NO: 15757 - protein, 10 aa, Mycobacterium tuberculosis
FNDRNFSLSN

SEQ ID NO: 15758 - protein, 10 aa, Mycobacterium tuberculosis
NDRNFSLSNL

SEQ ID NO: 15759 - protein, 10 aa, Mycobacterium tuberculosis
DRNFSLSNLR

SEQ ID NO: 15760 - protein, 10 aa, Mycobacterium tuberculosis
RNFSLSNLRI

SEQ ID NO: 15761 - protein, 10 aa, Mycobacterium tuberculosis
NFSLSNLRIA

SEQ ID NO: 15762 - protein, 10 aa, Mycobacterium tuberculosis
FSLSNLRIAI

SEQ ID NO: 15763 - protein, 10 aa, Mycobacterium tuberculosis
SLSNLRIAII

SEQ ID NO: 15764 - protein, 10 aa, Mycobacterium tuberculosis
LSNLRIAIIA

SEQ ID NO: 15765 - protein, 10 aa, Mycobacterium tuberculosis
SNLRIAIIAF

SEQ ID NO: 15766 - protein, 10 aa, Mycobacterium tuberculosis
NLRIAIIAFA

SEQ ID NO: 15767 - protein, 10 aa, Mycobacterium tuberculosis
LRIAIIAFAG

SEQ ID NO: 15768 - protein, 10 aa, Mycobacterium tuberculosis
RIAIIAFAGT

SEQ ID NO: 15769 - protein, 10 aa, Mycobacterium tuberculosis
IAIIAFAGTG

SEQ ID NO: 15770 - protein, 10 aa, Mycobacterium tuberculosis
AIIAFAGTGM

SEQ ID NO: 15771 - protein, 10 aa, Mycobacterium tuberculosis
IIAFAGTGMM

SEQ ID NO: 15772 - protein, 10 aa, Mycobacterium tuberculosis
IAFAGTGMML

SEQ ID NO: 15773 - protein, 10 aa, Mycobacterium tuberculosis
AFAGTGMMLP

SEQ ID NO: 15774 - protein, 10 aa, Mycobacterium tuberculosis
FAGTGMMLPV

SEQ ID NO: 15775 - protein, 10 aa, Mycobacterium tuberculosis
AGTGMMLPVT

SEQ ID NO: 15776 - protein, 10 aa, Mycobacterium tuberculosis
GTGMMLPVTF

SEQ ID NO: 15777 - protein, 10 aa, Mycobacterium tuberculosis
TGMMLPVTFY

SEQ ID NO: 15778 - protein, 10 aa, Mycobacterium tuberculosis
GMMLPVTFYA

SEQ ID NO: 15779 - protein, 10 aa, Mycobacterium tuberculosis
MMLPVTFYAQ

SEQ ID NO: 15780 - protein, 10 aa, Mycobacterium tuberculosis
MLPVTFYAQA

SEQ ID NO: 15781 - protein, 10 aa, Mycobacterium tuberculosis
LPVTFYAQAV

SEQ ID NO: 15782 - protein, 10 aa, Mycobacterium tuberculosis
PVTFYAQAVC

SEQ ID NO: 15783 - protein, 10 aa, Mycobacterium tuberculosis
VTFYAQAVCG

SEQ ID NO: 15784 - protein, 10 aa, Mycobacterium tuberculosis
TFYAQAVCGL

SEQ ID NO: 15785 - protein, 10 aa, Mycobacterium tuberculosis
FYAQAVCGLS

SEQ ID NO: 15786 - protein, 10 aa, Mycobacterium tuberculosis
YAQAVCGLSP

SEQ ID NO: 15787 - protein, 10 aa, Mycobacterium tuberculosis
AQAVCGLSPT

SEQ ID NO: 15788 - protein, 10 aa, Mycobacterium tuberculosis
QAVCGLSPTH

SEQ ID NO: 15789 - protein, 10 aa, Mycobacterium tuberculosis
AVCGLSPTHT

SEQ ID NO: 15790 - protein, 10 aa, Mycobacterium tuberculosis
VCGLSPTHTA

SEQ ID NO: 15791 - protein, 10 aa, Mycobacterium tuberculosis
CGLSPTHTAV

SEQ ID NO: 15792 - protein, 10 aa, Mycobacterium tuberculosis
GLSPTHTAVL

SEQ ID NO: 15793 - protein, 10 aa, Mycobacterium tuberculosis
LSPTHTAVLF

SEQ ID NO: 15794 - protein, 10 aa, Mycobacterium tuberculosis
SPTHTAVLFA

SEQ ID NO: 15795 - protein, 10 aa, Mycobacterium tuberculosis
PTHTAVLFAP

SEQ ID NO: 15796 - protein, 10 aa, Mycobacterium tuberculosis
THTAVLFAPT

SEQ ID NO: 15797 - protein, 10 aa, Mycobacterium tuberculosis
HTAVLFAPTA

SEQ ID NO: 15798 - protein, 10 aa, Mycobacterium tuberculosis
TAVLFAPTAI

SEQ ID NO: 15799 - protein, 10 aa, Mycobacterium tuberculosis
AVLFAPTAIV

SEQ ID NO: 15800 - protein, 10 aa, Mycobacterium tuberculosis
VLFAPTAIVG

SEQ ID NO: 15801 - protein, 10 aa, Mycobacterium tuberculosis
LFAPTAIVGG

SEQ ID NO: 15802 - protein, 10 aa, Mycobacterium tuberculosis
FAPTAIVGGV

SEQ ID NO: 15803 - protein, 10 aa, Mycobacterium tuberculosis
APTAIVGGVL

SEQ ID NO: 15804 - protein, 10 aa, Mycobacterium tuberculosis
PTAIVGGVLA

SEQ ID NO: 15805 - protein, 10 aa, Mycobacterium tuberculosis
TAIVGGVLAP

SEQ ID NO: 15806 - protein, 10 aa, Mycobacterium tuberculosis
AIVGGVLAPF

SEQ ID NO: 15807 - protein, 10 aa, Mycobacterium tuberculosis
IVGGVLAPFV

SEQ ID NO: 15808 - protein, 10 aa, Mycobacterium tuberculosis
VGGVLAPFVG

SEQ ID NO: 15809 - protein, 10 aa, Mycobacterium tuberculosis
GGVLAPFVGM

SEQ ID NO: 15810 - protein, 10 aa, Mycobacterium tuberculosis
GVLAPFVGMI

SEQ ID NO: 15811 - protein, 10 aa, Mycobacterium tuberculosis
VLAPFVGMII

SEQ ID NO: 15812 - protein, 10 aa, Mycobacterium tuberculosis
LAPFVGMIID

SEQ ID NO: 15813 - protein, 10 aa, Mycobacterium tuberculosis
APFVGMIIDR

SEQ ID NO: 15814 - protein, 10 aa, Mycobacterium tuberculosis
PFVGMIIDRS

SEQ ID NO: 15815 - protein, 10 aa, Mycobacterium tuberculosis
FVGMIIDRSH

SEQ ID NO: 15816 - protein, 10 aa, Mycobacterium tuberculosis
VGMIIDRSHP

SEQ ID NO: 15817 - protein, 10 aa, Mycobacterium tuberculosis
GMIIDRSHPL

SEQ ID NO: 15818 - protein, 10 aa, Mycobacterium tuberculosis
MIIDRSHPLC

SEQ ID NO: 15819 - protein, 10 aa, Mycobacterium tuberculosis
IIDRSHPLCV

SEQ ID NO: 15820 - protein, 10 aa, Mycobacterium tuberculosis
IDRSHPLCVL

SEQ ID NO: 15821 - protein, 10 aa, Mycobacterium tuberculosis
DRSHPLCVLG

SEQ ID NO: 15822 - protein, 10 aa, Mycobacterium tuberculosis
RSHPLCVLGF

SEQ ID NO: 15823 - protein, 10 aa, Mycobacterium tuberculosis
SHPLCVLGFG

SEQ ID NO: 15824 - protein, 10 aa, Mycobacterium tuberculosis
HPLCVLGFGF

SEQ ID NO: 15825 - protein, 10 aa, Mycobacterium tuberculosis
PLCVLGFGFS

SEQ ID NO: 15826 - protein, 10 aa, Mycobacterium tuberculosis
LCVLGFGFSV

SEQ ID NO: 15827 - protein, 10 aa, Mycobacterium tuberculosis
CVLGFGFSVL

SEQ ID NO: 15828 - protein, 10 aa, Mycobacterium tuberculosis
VLGFGFSVLA

SEQ ID NO: 15829 - protein, 10 aa, Mycobacterium tuberculosis
LGFGFSVLAI

SEQ ID NO: 15830 - protein, 10 aa, Mycobacterium tuberculosis
GFGFSVLAIA

SEQ ID NO: 15831 - protein, 10 aa, Mycobacterium tuberculosis
FGFSVLAIAM

SEQ ID NO: 15832 - protein, 10 aa, Mycobacterium tuberculosis
GFSVLAIAMT

SEQ ID NO: 15833 - protein, 10 aa, Mycobacterium tuberculosis
FSVLAIAMTW

SEQ ID NO: 15834 - protein, 10 aa, Mycobacterium tuberculosis
SVLAIAMTWL

SEQ ID NO: 15835 - protein, 10 aa, Mycobacterium tuberculosis
VLAIAMTWLL

SEQ ID NO: 15836 - protein, 10 aa, Mycobacterium tuberculosis
LAIAMTWLLC

SEQ ID NO: 15837 - protein, 10 aa, Mycobacterium tuberculosis
AIAMTWLLCE

SEQ ID NO: 15838 - protein, 10 aa, Mycobacterium tuberculosis
IAMTWLLCEM

SEQ ID NO: 15839 - protein, 10 aa, Mycobacterium tuberculosis
AMTWLLCEMA

SEQ ID NO: 15840 - protein, 10 aa, Mycobacterium tuberculosis
MTWLLCEMAP

SEQ ID NO: 15841 - protein, 10 aa, Mycobacterium tuberculosis
TWLLCEMAPG

SEQ ID NO: 15842 - protein, 10 aa, Mycobacterium tuberculosis
WLLCEMAPGT

SEQ ID NO: 15843 - protein, 10 aa, Mycobacterium tuberculosis
LLCEMAPGTP

SEQ ID NO: 15844 - protein, 10 aa, Mycobacterium tuberculosis
LCEMAPGTPI

SEQ ID NO: 15845 - protein, 10 aa, Mycobacterium tuberculosis
CEMAPGTPIW

SEQ ID NO: 15846 - protein, 10 aa, Mycobacterium tuberculosis
EMAPGTPIWR

SEQ ID NO: 15847 - protein, 10 aa, Mycobacterium tuberculosis
MAPGTPIWRL

SEQ ID NO: 15848 - protein, 10 aa, Mycobacterium tuberculosis
APGTPIWRLV

SEQ ID NO: 15849 - protein, 10 aa, Mycobacterium tuberculosis
PGTPIWRLVL

SEQ ID NO: 15850 - protein, 10 aa, Mycobacterium tuberculosis
GTPIWRLVLP

SEQ ID NO: 15851 - protein, 10 aa, Mycobacterium tuberculosis
TPIWRLVLPF

SEQ ID NO: 15852 - protein, 10 aa, Mycobacterium tuberculosis
PIWRLVLPFI

SEQ ID NO: 15853 - protein, 10 aa, Mycobacterium tuberculosis
IWRLVLPFIA

SEQ ID NO: 15854 - protein, 10 aa, Mycobacterium tuberculosis
WRLVLPFIAL

SEQ ID NO: 15855 - protein, 10 aa, Mycobacterium tuberculosis
RLVLPFIALG

SEQ ID NO: 15856 - protein, 10 aa, Mycobacterium tuberculosis
LVLPFIALGV

SEQ ID NO: 15857 - protein, 10 aa, Mycobacterium tuberculosis
VLPFIALGVA

SEQ ID NO: 15858 - protein, 10 aa, Mycobacterium tuberculosis
LPFIALGVAG

SEQ ID NO: 15859 - protein, 10 aa, Mycobacterium tuberculosis
PFIALGVAGA

SEQ ID NO: 15860 - protein, 10 aa, Mycobacterium tuberculosis
FIALGVAGAF

SEQ ID NO: 15861 - protein, 10 aa, Mycobacterium tuberculosis
IALGVAGAFV

SEQ ID NO: 15862 - protein, 10 aa, Mycobacterium tuberculosis
ALGVAGAFVW

SEQ ID NO: 15863 - protein, 10 aa, Mycobacterium tuberculosis
LGVAGAFVWS

SEQ ID NO: 15864 - protein, 10 aa, Mycobacterium tuberculosis
GVAGAFVWSP

SEQ ID NO: 15865 - protein, 10 aa, Mycobacterium tuberculosis
VAGAFVWSPL

SEQ ID NO: 15866 - protein, 10 aa, Mycobacterium tuberculosis
AGAFVWSPLT

SEQ ID NO: 15867 - protein, 10 aa, Mycobacterium tuberculosis
GAFVWSPLTV

SEQ ID NO: 15868 - protein, 10 aa, Mycobacterium tuberculosis
AFVWSPLTVT

SEQ ID NO: 15869 - protein, 10 aa, Mycobacterium tuberculosis
FVWSPLTVTA

SEQ ID NO: 15870 - protein, 10 aa, Mycobacterium tuberculosis
VWSPLTVTAT

SEQ ID NO: 15871 - protein, 10 aa, Mycobacterium tuberculosis
WSPLTVTATR

SEQ ID NO: 15872 - protein, 10 aa, Mycobacterium tuberculosis
SPLTVTATRN

SEQ ID NO: 15873 - protein, 10 aa, Mycobacterium tuberculosis
PLTVTATRNL

SEQ ID NO: 15874 - protein, 10 aa, Mycobacterium tuberculosis
LTVTATRNLR

SEQ ID NO: 15875 - protein, 10 aa, Mycobacterium tuberculosis
TVTATRNLRP

SEQ ID NO: 15876 - protein, 10 aa, Mycobacterium tuberculosis
VTATRNLRPH

SEQ ID NO: 15877 - protein, 10 aa, Mycobacterium tuberculosis
TATRNLRPHL

SEQ ID NO: 15878 - protein, 10 aa, Mycobacterium tuberculosis
ATRNLRPHLA

SEQ ID NO: 15879 - protein, 10 aa, Mycobacterium tuberculosis
TRNLRPHLAG

SEQ ID NO: 15880 - protein, 10 aa, Mycobacterium tuberculosis
RNLRPHLAGA

SEQ ID NO: 15881 - protein, 10 aa, Mycobacterium tuberculosis
NLRPHLAGAS

SEQ ID NO: 15882 - protein, 10 aa, Mycobacterium tuberculosis
LRPHLAGASS

SEQ ID NO: 15883 - protein, 10 aa, Mycobacterium tuberculosis
RPHLAGASSG

SEQ ID NO: 15884 - protein, 10 aa, Mycobacterium tuberculosis
PHLAGASSGV

SEQ ID NO: 15885 - protein, 10 aa, Mycobacterium tuberculosis
HLAGASSGVF

SEQ ID NO: 15886 - protein, 10 aa, Mycobacterium tuberculosis
LAGASSGVFN

SEQ ID NO: 15887 - protein, 10 aa, Mycobacterium tuberculosis
AGASSGVFNA

SEQ ID NO: 15888 - protein, 10 aa, Mycobacterium tuberculosis
GASSGVFNAV

SEQ ID NO: 15889 - protein, 10 aa, Mycobacterium tuberculosis
ASSGVFNAVR

SEQ ID NO: 15890 - protein, 10 aa, Mycobacterium tuberculosis
SSGVFNAVRQ

SEQ ID NO: 15891 - protein, 10 aa, Mycobacterium tuberculosis
SGVFNAVRQL

SEQ ID NO: 15892 - protein, 10 aa, Mycobacterium tuberculosis
GVFNAVRQLG

SEQ ID NO: 15893 - protein, 10 aa, Mycobacterium tuberculosis
VFNAVRQLGA

SEQ ID NO: 15894 - protein, 10 aa, Mycobacterium tuberculosis
FNAVRQLGAV

SEQ ID NO: 15895 - protein, 10 aa, Mycobacterium tuberculosis
NAVRQLGAVL

SEQ ID NO: 15896 - protein, 10 aa, Mycobacterium tuberculosis
AVRQLGAVLG

SEQ ID NO: 15897 - protein, 10 aa, Mycobacterium tuberculosis
VRQLGAVLGS

SEQ ID NO: 15898 - protein, 10 aa, Mycobacterium tuberculosis
RQLGAVLGSA

SEQ ID NO: 15899 - protein, 10 aa, Mycobacterium tuberculosis
QLGAVLGSAS

SEQ ID NO: 15900 - protein, 10 aa, Mycobacterium tuberculosis
LGAVLGSASM

SEQ ID NO: 15901 - protein, 10 aa, Mycobacterium tuberculosis
GAVLGSASMA

SEQ ID NO: 15902 - protein, 10 aa, Mycobacterium tuberculosis
AVLGSASMAA

SEQ ID NO: 15903 - protein, 10 aa, Mycobacterium tuberculosis
VLGSASMAAF

SEQ ID NO: 15904 - protein, 10 aa, Mycobacterium tuberculosis
LGSASMAAFM

SEQ ID NO: 15905 - protein, 10 aa, Mycobacterium tuberculosis
GSASMAAFMT

SEQ ID NO: 15906 - protein, 10 aa, Mycobacterium tuberculosis
SASMAAFMTS

SEQ ID NO: 15907 - protein, 10 aa, Mycobacterium tuberculosis
ASMAAFMTSR

SEQ ID NO: 15908 - protein, 10 aa, Mycobacterium tuberculosis
SMAAFMTSRI

SEQ ID NO: 15909 - protein, 10 aa, Mycobacterium tuberculosis
MAAFMTSRIA

SEQ ID NO: 15910 - protein, 10 aa, Mycobacterium tuberculosis
AAFMTSRIAA

SEQ ID NO: 15911 - protein, 10 aa, Mycobacterium tuberculosis
AFMTSRIAAE

SEQ ID NO: 15912 - protein, 10 aa, Mycobacterium tuberculosis
FMTSRIAAEM

SEQ ID NO: 15913 - protein, 10 aa, Mycobacterium tuberculosis
MTSRIAAEMP

SEQ ID NO: 15914 - protein, 10 aa, Mycobacterium tuberculosis
TSRIAAEMPG

SEQ ID NO: 15915 - protein, 10 aa, Mycobacterium tuberculosis
SRIAAEMPGG

SEQ ID NO: 15916 - protein, 10 aa, Mycobacterium tuberculosis
RIAAEMPGGV

SEQ ID NO: 15917 - protein, 10 aa, Mycobacterium tuberculosis
IAAEMPGGVD

SEQ ID NO: 15918 - protein, 10 aa, Mycobacterium tuberculosis
AAEMPGGVDA

SEQ ID NO: 15919 - protein, 10 aa, Mycobacterium tuberculosis
AEMPGGVDAL

SEQ ID NO: 15920 - protein, 10 aa, Mycobacterium tuberculosis
EMPGGVDALT

SEQ ID NO: 15921 - protein, 10 aa, Mycobacterium tuberculosis
MPGGVDALTG

SEQ ID NO: 15922 - protein, 10 aa, Mycobacterium tuberculosis
PGGVDALTGP

SEQ ID NO: 15923 - protein, 10 aa, Mycobacterium tuberculosis
GGVDALTGPA

SEQ ID NO: 15924 - protein, 10 aa, Mycobacterium tuberculosis
GVDALTGPAG

SEQ ID NO: 15925 - protein, 10 aa, Mycobacterium tuberculosis
VDALTGPAGQ

SEQ ID NO: 15926 - protein, 10 aa, Mycobacterium tuberculosis
DALTGPAGQD

SEQ ID NO: 15927 - protein, 10 aa, Mycobacterium tuberculosis
ALTGPAGQDA

SEQ ID NO: 15928 - protein, 10 aa, Mycobacterium tuberculosis
LTGPAGQDAT

SEQ ID NO: 15929 - protein, 10 aa, Mycobacterium tuberculosis
TGPAGQDATV

SEQ ID NO: 15930 - protein, 10 aa, Mycobacterium tuberculosis
GPAGQDATVL

SEQ ID NO: 15931 - protein, 10 aa, Mycobacterium tuberculosis
PAGQDATVLQ

SEQ ID NO: 15932 - protein, 10 aa, Mycobacterium tuberculosis
AGQDATVLQL

SEQ ID NO: 15933 - protein, 10 aa, Mycobacterium tuberculosis
GQDATVLQLP

SEQ ID NO: 15934 - protein, 10 aa, Mycobacterium tuberculosis
QDATVLQLPE

SEQ ID NO: 15935 - protein, 10 aa, Mycobacterium tuberculosis
DATVLQLPEF

SEQ ID NO: 15936 - protein, 10 aa, Mycobacterium tuberculosis
ATVLQLPEFV

SEQ ID NO: 15937 - protein, 10 aa, Mycobacterium tuberculosis
TVLQLPEFVR

SEQ ID NO: 15938 - protein, 10 aa, Mycobacterium tuberculosis
VLQLPEFVRE

SEQ ID NO: 15939 - protein, 10 aa, Mycobacterium tuberculosis
LQLPEFVREP

SEQ ID NO: 15940 - protein, 10 aa, Mycobacterium tuberculosis
QLPEFVREPF

SEQ ID NO: 15941 - protein, 10 aa, Mycobacterium tuberculosis
LPEFVREPFA

SEQ ID NO: 15942 - protein, 10 aa, Mycobacterium tuberculosis
PEFVREPFAA

SEQ ID NO: 15943 - protein, 10 aa, Mycobacterium tuberculosis
EFVREPFAAA

SEQ ID NO: 15944 - protein, 10 aa, Mycobacterium tuberculosis
FVREPFAAAM

SEQ ID NO: 15945 - protein, 10 aa, Mycobacterium tuberculosis
VREPFAAAMS

SEQ ID NO: 15946 - protein, 10 aa, Mycobacterium tuberculosis
REPFAAAMSQ

SEQ ID NO: 15947 - protein, 10 aa, Mycobacterium tuberculosis
EPFAAAMSQS

SEQ ID NO: 15948 - protein, 10 aa, Mycobacterium tuberculosis
PFAAAMSQSM

SEQ ID NO: 15949 - protein, 10 aa, Mycobacterium tuberculosis
FAAAMSQSML

SEQ ID NO: 15950 - protein, 10 aa, Mycobacterium tuberculosis
AAAMSQSMLL

SEQ ID NO: 15951 - protein, 10 aa, Mycobacterium tuberculosis
AAMSQSMLLP

SEQ ID NO: 15952 - protein, 10 aa, Mycobacterium tuberculosis
AMSQSMLLPA

SEQ ID NO: 15953 - protein, 10 aa, Mycobacterium tuberculosis
MSQSMLLPAF

SEQ ID NO: 15954 - protein, 10 aa, Mycobacterium tuberculosis
SQSMLLPAFV

SEQ ID NO: 15955 - protein, 10 aa, Mycobacterium tuberculosis
QSMLLPAFVA

SEQ ID NO: 15956 - protein, 10 aa, Mycobacterium tuberculosis
SMLLPAFVAL

SEQ ID NO: 15957 - protein, 10 aa, Mycobacterium tuberculosis
MLLPAFVALF

SEQ ID NO: 15958 - protein, 10 aa, Mycobacterium tuberculosis
LLPAFVALFG

SEQ ID NO: 15959 - protein, 10 aa, Mycobacterium tuberculosis
LPAFVALFGI

SEQ ID NO: 15960 - protein, 10 aa, Mycobacterium tuberculosis
PAFVALFGIV

SEQ ID NO: 15961 - protein, 10 aa, Mycobacterium tuberculosis
AFVALFGIVA

SEQ ID NO: 15962 - protein, 10 aa, Mycobacterium tuberculosis
FVALFGIVAA

SEQ ID NO: 15963 - protein, 10 aa, Mycobacterium tuberculosis
VALFGIVAAL

SEQ ID NO: 15964 - protein, 10 aa, Mycobacterium tuberculosis
ALFGIVAALF

SEQ ID NO: 15965 - protein, 10 aa, Mycobacterium tuberculosis
LFGIVAALFL

SEQ ID NO: 15966 - protein, 10 aa, Mycobacterium tuberculosis
FGIVAALFLV

SEQ ID NO: 15967 - protein, 10 aa, Mycobacterium tuberculosis
GIVAALFLVD

SEQ ID NO: 15968 - protein, 10 aa, Mycobacterium tuberculosis
IVAALFLVDF

SEQ ID NO: 15969 - protein, 10 aa, Mycobacterium tuberculosis
VAALFLVDFT

SEQ ID NO: 15970 - protein, 10 aa, Mycobacterium tuberculosis
AALFLVDFTG

SEQ ID NO: 15971 - protein, 10 aa, Mycobacterium tuberculosis
ALFLVDFTGA

SEQ ID NO: 15972 - protein, 10 aa, Mycobacterium tuberculosis
LFLVDFTGAA

SEQ ID NO: 15973 - protein, 10 aa, Mycobacterium tuberculosis
FLVDFTGAAV

SEQ ID NO: 15974 - protein, 10 aa, Mycobacterium tuberculosis
LVDFTGAAVA

SEQ ID NO: 15975 - protein, 10 aa, Mycobacterium tuberculosis
VDFTGAAVAK

SEQ ID NO: 15976 - protein, 10 aa, Mycobacterium tuberculosis
DFTGAAVAKE

SEQ ID NO: 15977 - protein, 10 aa, Mycobacterium tuberculosis
FTGAAVAKEP

SEQ ID NO: 15978 - protein, 10 aa, Mycobacterium tuberculosis
TGAAVAKEPL

SEQ ID NO: 15979 - protein, 10 aa, Mycobacterium tuberculosis
GAAVAKEPLP

SEQ ID NO: 15980 - protein, 10 aa, Mycobacterium tuberculosis
AAVAKEPLPE

SEQ ID NO: 15981 - protein, 10 aa, Mycobacterium tuberculosis
AVAKEPLPES

SEQ ID NO: 15982 - protein, 10 aa, Mycobacterium tuberculosis
VAKEPLPESD

SEQ ID NO: 15983 - protein, 10 aa, Mycobacterium tuberculosis
AKEPLPESDG

SEQ ID NO: 15984 - protein, 10 aa, Mycobacterium tuberculosis
KEPLPESDGD

SEQ ID NO: 15985 - protein, 10 aa, Mycobacterium tuberculosis
EPLPESDGDA

SEQ ID NO: 15986 - protein, 10 aa, Mycobacterium tuberculosis
PLPESDGDAD

SEQ ID NO: 15987 - protein, 10 aa, Mycobacterium tuberculosis
LPESDGDADD

SEQ ID NO: 15988 - protein, 10 aa, Mycobacterium tuberculosis
PESDGDADDD

SEQ ID NO: 15989 - protein, 10 aa, Mycobacterium tuberculosis
ESDGDADDDD

SEQ ID NO: 15990 - protein, 10 aa, Mycobacterium tuberculosis
SDGDADDDDY

SEQ ID NO: 15991 - protein, 10 aa, Mycobacterium tuberculosis
DGDADDDDYV

SEQ ID NO: 15992 - protein, 10 aa, Mycobacterium tuberculosis
GDADDDDYVE

SEQ ID NO: 15993 - protein, 10 aa, Mycobacterium tuberculosis
DADDDDYVEY

SEQ ID NO: 15994 - protein, 10 aa, Mycobacterium tuberculosis
ADDDDYVEYI

SEQ ID NO: 15995 - protein, 10 aa, Mycobacterium tuberculosis
DDDDYVEYIL

SEQ ID NO: 15996 - protein, 10 aa, Mycobacterium tuberculosis
DDDYVEYILR

SEQ ID NO: 15997 - protein, 10 aa, Mycobacterium tuberculosis
DDYVEYILRR

SEQ ID NO: 15998 - protein, 10 aa, Mycobacterium tuberculosis
DYVEYILRRE

SEQ ID NO: 15999 - protein, 10 aa, Mycobacterium tuberculosis
YVEYILRREP

SEQ ID NO: 16000 - protein, 10 aa, Mycobacterium tuberculosis
VEYILRREPE

SEQ ID NO: 16001 - protein, 10 aa, Mycobacterium tuberculosis
EYILRREPEE

SEQ ID NO: 16002 - protein, 10 aa, Mycobacterium tuberculosis
YILRREPEED

SEQ ID NO: 16003 - protein, 10 aa, Mycobacterium tuberculosis
ILRREPEEDC

SEQ ID NO: 16004 - protein, 10 aa, Mycobacterium tuberculosis
LRREPEEDCD

SEQ ID NO: 16005 - protein, 10 aa, Mycobacterium tuberculosis
RREPEEDCDT

SEQ ID NO: 16006 - protein, 10 aa, Mycobacterium tuberculosis
REPEEDCDTQ

SEQ ID NO: 16007 - protein, 10 aa, Mycobacterium tuberculosis
EPEEDCDTQP

SEQ ID NO: 16008 - protein, 10 aa, Mycobacterium tuberculosis
PEEDCDTQPL

SEQ ID NO: 16009 - protein, 10 aa, Mycobacterium tuberculosis
EEDCDTQPLR

SEQ ID NO: 16010 - protein, 10 aa, Mycobacterium tuberculosis
EDCDTQPLRA

SEQ ID NO: 16011 - protein, 10 aa, Mycobacterium tuberculosis
DCDTQPLRAS

SEQ ID NO: 16012 - protein, 10 aa, Mycobacterium tuberculosis
CDTQPLRASR

SEQ ID NO: 16013 - protein, 10 aa, Mycobacterium tuberculosis
DTQPLRASRP

SEQ ID NO: 16014 - protein, 10 aa, Mycobacterium tuberculosis
TQPLRASRPA

SEQ ID NO: 16015 - protein, 10 aa, Mycobacterium tuberculosis
QPLRASRPAA

SEQ ID NO: 16016 - protein, 10 aa, Mycobacterium tuberculosis
PLRASRPAAA

SEQ ID NO: 16017 - protein, 10 aa, Mycobacterium tuberculosis
LRASRPAAAA

SEQ ID NO: 16018 - protein, 10 aa, Mycobacterium tuberculosis
RASRPAAAAA

SEQ ID NO: 16019 - protein, 10 aa, Mycobacterium tuberculosis
ASRPAAAAAS

SEQ ID NO: 16020 - protein, 10 aa, Mycobacterium tuberculosis
SRPAAAAASR

SEQ ID NO: 16021 - protein, 10 aa, Mycobacterium tuberculosis
RPAAAAASRS

SEQ ID NO: 16022 - protein, 10 aa, Mycobacterium tuberculosis
PAAAAASRSG

SEQ ID NO: 16023 - protein, 10 aa, Mycobacterium tuberculosis
AAAAASRSGA

SEQ ID NO: 16024 - protein, 10 aa, Mycobacterium tuberculosis
AAAASRSGAG

SEQ ID NO: 16025 - protein, 10 aa, Mycobacterium tuberculosis
AAASRSGAGG

SEQ ID NO: 16026 - protein, 10 aa, Mycobacterium tuberculosis
AASRSGAGGP

SEQ ID NO: 16027 - protein, 10 aa, Mycobacterium tuberculosis
ASRSGAGGPL

SEQ ID NO: 16028 - protein, 10 aa, Mycobacterium tuberculosis
SRSGAGGPLA

SEQ ID NO: 16029 - protein, 10 aa, Mycobacterium tuberculosis
RSGAGGPLAV

SEQ ID NO: 16030 - protein, 10 aa, Mycobacterium tuberculosis
SGAGGPLAVS

SEQ ID NO: 16031 - protein, 10 aa, Mycobacterium tuberculosis
GAGGPLAVSW

SEQ ID NO: 16032 - protein, 10 aa, Mycobacterium tuberculosis
AGGPLAVSWS

SEQ ID NO: 16033 - protein, 10 aa, Mycobacterium tuberculosis
GGPLAVSWST

SEQ ID NO: 16034 - protein, 10 aa, Mycobacterium tuberculosis
GPLAVSWSTS

SEQ ID NO: 16035 - protein, 10 aa, Mycobacterium tuberculosis
PLAVSWSTSA

SEQ ID NO: 16036 - protein, 10 aa, Mycobacterium tuberculosis
LAVSWSTSAQ

SEQ ID NO: 16037 - protein, 10 aa, Mycobacterium tuberculosis
AVSWSTSAQG

SEQ ID NO: 16038 - protein, 10 aa, Mycobacterium tuberculosis
VSWSTSAQGM

SEQ ID NO: 16039 - protein, 10 aa, Mycobacterium tuberculosis
SWSTSAQGMP

SEQ ID NO: 16040 - protein, 10 aa, Mycobacterium tuberculosis
WSTSAQGMPP

SEQ ID NO: 16041 - protein, 10 aa, Mycobacterium tuberculosis
STSAQGMPPG

SEQ ID NO: 16042 - protein, 10 aa, Mycobacterium tuberculosis
TSAQGMPPGP

SEQ ID NO: 16043 - protein, 10 aa, Mycobacterium tuberculosis
SAQGMPPGPP

SEQ ID NO: 16044 - protein, 10 aa, Mycobacterium tuberculosis
AQGMPPGPPG

SEQ ID NO: 16045 - protein, 10 aa, Mycobacterium tuberculosis
QGMPPGPPGR

SEQ ID NO: 16046 - protein, 10 aa, Mycobacterium tuberculosis
GMPPGPPGRR

SEQ ID NO: 16047 - protein, 10 aa, Mycobacterium tuberculosis
MPPGPPGRRA

SEQ ID NO: 16048 - protein, 10 aa, Mycobacterium tuberculosis
PPGPPGRRAW

SEQ ID NO: 16049 - protein, 10 aa, Mycobacterium tuberculosis
PGPPGRRAWQ

SEQ ID NO: 16050 - protein, 10 aa, Mycobacterium tuberculosis
GPPGRRAWQA

SEQ ID NO: 16051 - protein, 10 aa, Mycobacterium tuberculosis
PPGRRAWQAD

SEQ ID NO: 16052 - protein, 10 aa, Mycobacterium tuberculosis
PGRRAWQADT

SEQ ID NO: 16053 - protein, 10 aa, Mycobacterium tuberculosis
GRRAWQADTE

SEQ ID NO: 16054 - protein, 10 aa, Mycobacterium tuberculosis
RRAWQADTES

SEQ ID NO: 16055 - protein, 10 aa, Mycobacterium tuberculosis
RAWQADTEST

SEQ ID NO: 16056 - protein, 10 aa, Mycobacterium tuberculosis
AWQADTESTA

SEQ ID NO: 16057 - protein, 10 aa, Mycobacterium tuberculosis
WQADTESTAP

SEQ ID NO: 16058 - protein, 10 aa, Mycobacterium tuberculosis
QADTESTAPS

SEQ ID NO: 16059 - protein, 10 aa, Mycobacterium tuberculosis
ADTESTAPSA

SEQ ID NO: 16060 - protein, 10 aa, Mycobacterium tuberculosis
DTESTAPSAL

SEQ ID NO: 16061 - protein, 11 aa, Mycobacterium tuberculosis
MTTAIRRAAGS

SEQ ID NO: 16062 - protein, 11 aa, Mycobacterium tuberculosis
TTAIRRAAGSS

SEQ ID NO: 16063 - protein, 11 aa, Mycobacterium tuberculosis
TAIRRAAGSSY

SEQ ID NO: 16064 - protein, 11 aa, Mycobacterium tuberculosis
AIRRAAGSSYF

SEQ ID NO: 16065 - protein, 11 aa, Mycobacterium tuberculosis
IRRAAGSSYFR

SEQ ID NO: 16066 - protein, 11 aa, Mycobacterium tuberculosis
RRAAGSSYFRN

SEQ ID NO: 16067 - protein, 11 aa, Mycobacterium tuberculosis
RAAGSSYFRNP

SEQ ID NO: 16068 - protein, 11 aa, Mycobacterium tuberculosis
AAGSSYFRNPW

SEQ ID NO: 16069 - protein, 11 aa, Mycobacterium tuberculosis
AGSSYFRNPWP

SEQ ID NO: 16070 - protein, 11 aa, Mycobacterium tuberculosis
GSSYFRNPWPA

SEQ ID NO: 16071 - protein, 11 aa, Mycobacterium tuberculosis
SSYFRNPWPAL

SEQ ID NO: 16072 - protein, 11 aa, Mycobacterium tuberculosis
SYFRNPWPALW

SEQ ID NO: 16073 - protein, 11 aa, Mycobacterium tuberculosis
YFRNPWPALWA

SEQ ID NO: 16074 - protein, 11 aa, Mycobacterium tuberculosis
FRNPWPALWAM

SEQ ID NO: 16075 - protein, 11 aa, Mycobacterium tuberculosis
RNPWPALWAMM

SEQ ID NO: 16076 - protein, 11 aa, Mycobacterium tuberculosis
NPWPALWAMMV

SEQ ID NO: 16077 - protein, 11 aa, Mycobacterium tuberculosis
PWPALWAMMVG

SEQ ID NO: 16078 - protein, 11 aa, Mycobacterium tuberculosis
WPALWAMMVGF

SEQ ID NO: 16079 - protein, 11 aa, Mycobacterium tuberculosis
PALWAMMVGFF

SEQ ID NO: 16080 - protein, 11 aa, Mycobacterium tuberculosis
ALWAMMVGFFM

SEQ ID NO: 16081 - protein, 11 aa, Mycobacterium tuberculosis
LWAMMVGFFMI

SEQ ID NO: 16082 - protein, 11 aa, Mycobacterium tuberculosis
WAMMVGFFMIM

SEQ ID NO: 16083 - protein, 11 aa, Mycobacterium tuberculosis
AMMVGFFMIML

SEQ ID NO: 16084 - protein, 11 aa, Mycobacterium tuberculosis
MMVGFFMIMLD

SEQ ID NO: 16085 - protein, 11 aa, Mycobacterium tuberculosis
MVGFFMIMLDS

SEQ ID NO: 16086 - protein, 11 aa, Mycobacterium tuberculosis
VGFFMIMLDST

SEQ ID NO: 16087 - protein, 11 aa, Mycobacterium tuberculosis
GFFMIMLDSTV

SEQ ID NO: 16088 - protein, 11 aa, Mycobacterium tuberculosis
FFMIMLDSTVV

SEQ ID NO: 16089 - protein, 11 aa, Mycobacterium tuberculosis
FMIMLDSTVVA

SEQ ID NO: 16090 - protein, 11 aa, Mycobacterium tuberculosis
MIMLDSTVVAI

SEQ ID NO: 16091 - protein, 11 aa, Mycobacterium tuberculosis
IMLDSTVVAIA

SEQ ID NO: 16092 - protein, 11 aa, Mycobacterium tuberculosis
MLDSTVVAIAN

SEQ ID NO: 16093 - protein, 11 aa, Mycobacterium tuberculosis
LDSTVVAIANP

SEQ ID NO: 16094 - protein, 11 aa, Mycobacterium tuberculosis
DSTVVAIANPT

SEQ ID NO: 16095 - protein, 11 aa, Mycobacterium tuberculosis
STVVAIANPTI

SEQ ID NO: 16096 - protein, 11 aa, Mycobacterium tuberculosis
TVVAIANPTIM

SEQ ID NO: 16097 - protein, 11 aa, Mycobacterium tuberculosis
VVAIANPTIMA

SEQ ID NO: 16098 - protein, 11 aa, Mycobacterium tuberculosis
VAIANPTIMAQ

SEQ ID NO: 16099 - protein, 11 aa, Mycobacterium tuberculosis
AIANPTIMAQL

SEQ ID NO: 16100 - protein, 11 aa, Mycobacterium tuberculosis
IANPTIMAQLR

SEQ ID NO: 16101 - protein, 11 aa, Mycobacterium tuberculosis
ANPTIMAQLRI

SEQ ID NO: 16102 - protein, 11 aa, Mycobacterium tuberculosis
NPTIMAQLRIG

SEQ ID NO: 16103 - protein, 11 aa, Mycobacterium tuberculosis
PTIMAQLRIGY

SEQ ID NO: 16104 - protein, 11 aa, Mycobacterium tuberculosis
TIMAQLRIGYA

SEQ ID NO: 16105 - protein, 11 aa, Mycobacterium tuberculosis
IMAQLRIGYAT

SEQ ID NO: 16106 - protein, 11 aa, Mycobacterium tuberculosis
MAQLRIGYATV

SEQ ID NO: 16107 - protein, 11 aa, Mycobacterium tuberculosis
AQLRIGYATVV

SEQ ID NO: 16108 - protein, 11 aa, Mycobacterium tuberculosis
QLRIGYATVVW

SEQ ID NO: 16109 - protein, 11 aa, Mycobacterium tuberculosis
LRIGYATVVWV

SEQ ID NO: 16110 - protein, 11 aa, Mycobacterium tuberculosis
RIGYATVVWVT

SEQ ID NO: 16111 - protein, 11 aa, Mycobacterium tuberculosis
IGYATVVWVTS

SEQ ID NO: 16112 - protein, 11 aa, Mycobacterium tuberculosis
GYATVVWVTSA

SEQ ID NO: 16113 - protein, 11 aa, Mycobacterium tuberculosis
YATVVWVTSAY

SEQ ID NO: 16114 - protein, 11 aa, Mycobacterium tuberculosis
ATVVWVTSAYL

SEQ ID NO: 16115 - protein, 11 aa, Mycobacterium tuberculosis
TVVWVTSAYLL

SEQ ID NO: 16116 - protein, 11 aa, Mycobacterium tuberculosis
VVWVTSAYLLA

SEQ ID NO: 16117 - protein, 11 aa, Mycobacterium tuberculosis
VWVTSAYLLAY

SEQ ID NO: 16118 - protein, 11 aa, Mycobacterium tuberculosis
WVTSAYLLAYA

SEQ ID NO: 16119 - protein, 11 aa, Mycobacterium tuberculosis
VTSAYLLAYAV

SEQ ID NO: 16120 - protein, 11 aa, Mycobacterium tuberculosis
TSAYLLAYAVP

SEQ ID NO: 16121 - protein, 11 aa, Mycobacterium tuberculosis
SAYLLAYAVPM

SEQ ID NO: 16122 - protein, 11 aa, Mycobacterium tuberculosis
AYLLAYAVPML

SEQ ID NO: 16123 - protein, 11 aa, Mycobacterium tuberculosis
YLLAYAVPMLV

SEQ ID NO: 16124 - protein, 11 aa, Mycobacterium tuberculosis
LLAYAVPMLVA

SEQ ID NO: 16125 - protein, 11 aa, Mycobacterium tuberculosis
LAYAVPMLVAG

SEQ ID NO: 16126 - protein, 11 aa, Mycobacterium tuberculosis
AYAVPMLVAGR

SEQ ID NO: 16127 - protein, 11 aa, Mycobacterium tuberculosis
YAVPMLVAGRL

SEQ ID NO: 16128 - protein, 11 aa, Mycobacterium tuberculosis
AVPMLVAGRLG

SEQ ID NO: 16129 - protein, 11 aa, Mycobacterium tuberculosis
VPMLVAGRLGD

SEQ ID NO: 16130 - protein, 11 aa, Mycobacterium tuberculosis
PMLVAGRLGDR

SEQ ID NO: 16131 - protein, 11 aa, Mycobacterium tuberculosis
MLVAGRLGDRF

SEQ ID NO: 16132 - protein, 11 aa, Mycobacterium tuberculosis
LVAGRLGDRFG

SEQ ID NO: 16133 - protein, 11 aa, Mycobacterium tuberculosis
VAGRLGDRFGP

SEQ ID NO: 16134 - protein, 11 aa, Mycobacterium tuberculosis
AGRLGDRFGPK

SEQ ID NO: 16135 - protein, 11 aa, Mycobacterium tuberculosis
GRLGDRFGPKN

SEQ ID NO: 16136 - protein, 11 aa, Mycobacterium tuberculosis
RLGDRFGPKNL

SEQ ID NO: 16137 - protein, 11 aa, Mycobacterium tuberculosis
LGDRFGPKNLY

SEQ ID NO: 16138 - protein, 11 aa, Mycobacterium tuberculosis
GDRFGPKNLYL

SEQ ID NO: 16139 - protein, 11 aa, Mycobacterium tuberculosis
DRFGPKNLYLI

SEQ ID NO: 16140 - protein, 11 aa, Mycobacterium tuberculosis
RFGPKNLYLIG

SEQ ID NO: 16141 - protein, 11 aa, Mycobacterium tuberculosis
FGPKNLYLIGL

SEQ ID NO: 16142 - protein, 11 aa, Mycobacterium tuberculosis
GPKNLYLIGLG

SEQ ID NO: 16143 - protein, 11 aa, Mycobacterium tuberculosis
PKNLYLIGLGV

SEQ ID NO: 16144 - protein, 11 aa, Mycobacterium tuberculosis
KNLYLIGLGVF

SEQ ID NO: 16145 - protein, 11 aa, Mycobacterium tuberculosis
NLYLIGLGVFT

SEQ ID NO: 16146 - protein, 11 aa, Mycobacterium tuberculosis
LYLIGLGVFTV

SEQ ID NO: 16147 - protein, 11 aa, Mycobacterium tuberculosis
YLIGLGVFTVA

SEQ ID NO: 16148 - protein, 11 aa, Mycobacterium tuberculosis
LIGLGVFTVAS

SEQ ID NO: 16149 - protein, 11 aa, Mycobacterium tuberculosis
IGLGVFTVASL

SEQ ID NO: 16150 - protein, 11 aa, Mycobacterium tuberculosis
GLGVFTVASLG

SEQ ID NO: 16151 - protein, 11 aa, Mycobacterium tuberculosis
LGVFTVASLGC

SEQ ID NO: 16152 - protein, 11 aa, Mycobacterium tuberculosis
GVFTVASLGCG

SEQ ID NO: 16153 - protein, 11 aa, Mycobacterium tuberculosis
VFTVASLGCGL

SEQ ID NO: 16154 - protein, 11 aa, Mycobacterium tuberculosis
FTVASLGCGLS

SEQ ID NO: 16155 - protein, 11 aa, Mycobacterium tuberculosis
TVASLGCGLSS

SEQ ID NO: 16156 - protein, 11 aa, Mycobacterium tuberculosis
VASLGCGLSSG

SEQ ID NO: 16157 - protein, 11 aa, Mycobacterium tuberculosis
ASLGCGLSSGA

SEQ ID NO: 16158 - protein, 11 aa, Mycobacterium tuberculosis
SLGCGLSSGAG

SEQ ID NO: 16159 - protein, 11 aa, Mycobacterium tuberculosis
LGCGLSSGAGM

SEQ ID NO: 16160 - protein, 11 aa, Mycobacterium tuberculosis
GCGLSSGAGML

SEQ ID NO: 16161 - protein, 11 aa, Mycobacterium tuberculosis
CGLSSGAGMLI

SEQ ID NO: 16162 - protein, 11 aa, Mycobacterium tuberculosis
GLSSGAGMLIA

SEQ ID NO: 16163 - protein, 11 aa, Mycobacterium tuberculosis
LSSGAGMLIAA

SEQ ID NO: 16164 - protein, 11 aa, Mycobacterium tuberculosis
SSGAGMLIAAR

SEQ ID NO: 16165 - protein, 11 aa, Mycobacterium tuberculosis
SGAGMLIAARV

SEQ ID NO: 16166 - protein, 11 aa, Mycobacterium tuberculosis
GAGMLIAARVV

SEQ ID NO: 16167 - protein, 11 aa, Mycobacterium tuberculosis
AGMLIAARVVQ

SEQ ID NO: 16168 - protein, 11 aa, Mycobacterium tuberculosis
GMLIAARVVQG

SEQ ID NO: 16169 - protein, 11 aa, Mycobacterium tuberculosis
MLIAARVVQGV

SEQ ID NO: 16170 - protein, 11 aa, Mycobacterium tuberculosis
LIAARVVQGVG

SEQ ID NO: 16171 - protein, 11 aa, Mycobacterium tuberculosis
IAARVVQGVGA

SEQ ID NO: 16172 - protein, 11 aa, Mycobacterium tuberculosis
AARVVQGVGAG

SEQ ID NO: 16173 - protein, 11 aa, Mycobacterium tuberculosis
ARVVQGVGAGL

SEQ ID NO: 16174 - protein, 11 aa, Mycobacterium tuberculosis
RVVQGVGAGLL

SEQ ID NO: 16175 - protein, 11 aa, Mycobacterium tuberculosis
VVQGVGAGLLT

SEQ ID NO: 16176 - protein, 11 aa, Mycobacterium tuberculosis
VQGVGAGLLTP

SEQ ID NO: 16177 - protein, 11 aa, Mycobacterium tuberculosis
QGVGAGLLTPQ

SEQ ID NO: 16178 - protein, 11 aa, Mycobacterium tuberculosis
GVGAGLLTPQT

SEQ ID NO: 16179 - protein, 11 aa, Mycobacterium tuberculosis
VGAGLLTPQTL

SEQ ID NO: 16180 - protein, 11 aa, Mycobacterium tuberculosis
GAGLLTPQTLS

SEQ ID NO: 16181 - protein, 11 aa, Mycobacterium tuberculosis
AGLLTPQTLST

SEQ ID NO: 16182 - protein, 11 aa, Mycobacterium tuberculosis
GLLTPQTLSTI

SEQ ID NO: 16183 - protein, 11 aa, Mycobacterium tuberculosis
LLTPQTLSTIT

SEQ ID NO: 16184 - protein, 11 aa, Mycobacterium tuberculosis
LTPQTLSTITR

SEQ ID NO: 16185 - protein, 11 aa, Mycobacterium tuberculosis
TPQTLSTITRI

SEQ ID NO: 16186 - protein, 11 aa, Mycobacterium tuberculosis
PQTLSTITRIF

SEQ ID NO: 16187 - protein, 11 aa, Mycobacterium tuberculosis
QTLSTITRIFP

SEQ ID NO: 16188 - protein, 11 aa, Mycobacterium tuberculosis
TLSTITRIFPA

SEQ ID NO: 16189 - protein, 11 aa, Mycobacterium tuberculosis
LSTITRIFPAH

SEQ ID NO: 16190 - protein, 11 aa, Mycobacterium tuberculosis
STITRIFPAHR

SEQ ID NO: 16191 - protein, 11 aa, Mycobacterium tuberculosis
TITRIFPAHRR

SEQ ID NO: 16192 - protein, 11 aa, Mycobacterium tuberculosis
ITRIFPAHRRG

SEQ ID NO: 16193 - protein, 11 aa, Mycobacterium tuberculosis
TRIFPAHRRGV

SEQ ID NO: 16194 - protein, 11 aa, Mycobacterium tuberculosis
RIFPAHRRGVA

SEQ ID NO: 16195 - protein, 11 aa, Mycobacterium tuberculosis
IFPAHRRGVAL

SEQ ID NO: 16196 - protein, 11 aa, Mycobacterium tuberculosis
FPAHRRGVALG

SEQ ID NO: 16197 - protein, 11 aa, Mycobacterium tuberculosis
PAHRRGVALGA

SEQ ID NO: 16198 - protein, 11 aa, Mycobacterium tuberculosis
AHRRGVALGAW

SEQ ID NO: 16199 - protein, 11 aa, Mycobacterium tuberculosis
HRRGVALGAWG

SEQ ID NO: 16200 - protein, 11 aa, Mycobacterium tuberculosis
RRGVALGAWGT

SEQ ID NO: 16201 - protein, 11 aa, Mycobacterium tuberculosis
RGVALGAWGTV

SEQ ID NO: 16202 - protein, 11 aa, Mycobacterium tuberculosis
GVALGAWGTVA

SEQ ID NO: 16203 - protein, 11 aa, Mycobacterium tuberculosis
VALGAWGTVAS

SEQ ID NO: 16204 - protein, 11 aa, Mycobacterium tuberculosis
ALGAWGTVASV

SEQ ID NO: 16205 - protein, 11 aa, Mycobacterium tuberculosis
LGAWGTVASVA

SEQ ID NO: 16206 - protein, 11 aa, Mycobacterium tuberculosis
GAWGTVASVAS

SEQ ID NO: 16207 - protein, 11 aa, Mycobacterium tuberculosis
AWGTVASVASL

SEQ ID NO: 16208 - protein, 11 aa, Mycobacterium tuberculosis
WGTVASVASLV

SEQ ID NO: 16209 - protein, 11 aa, Mycobacterium tuberculosis
GTVASVASLVG

SEQ ID NO: 16210 - protein, 11 aa, Mycobacterium tuberculosis
TVASVASLVGP

SEQ ID NO: 16211 - protein, 11 aa, Mycobacterium tuberculosis
VASVASLVGPL

SEQ ID NO: 16212 - protein, 11 aa, Mycobacterium tuberculosis
ASVASLVGPLA

SEQ ID NO: 16213 - protein, 11 aa, Mycobacterium tuberculosis
SVASLVGPLAG

SEQ ID NO: 16214 - protein, 11 aa, Mycobacterium tuberculosis
VASLVGPLAGG

SEQ ID NO: 16215 - protein, 11 aa, Mycobacterium tuberculosis
ASLVGPLAGGA

SEQ ID NO: 16216 - protein, 11 aa, Mycobacterium tuberculosis
SLVGPLAGGAL

SEQ ID NO: 16217 - protein, 11 aa, Mycobacterium tuberculosis
LVGPLAGGALV

SEQ ID NO: 16218 - protein, 11 aa, Mycobacterium tuberculosis
VGPLAGGALVD

SEQ ID NO: 16219 - protein, 11 aa, Mycobacterium tuberculosis
GPLAGGALVDS

SEQ ID NO: 16220 - protein, 11 aa, Mycobacterium tuberculosis
PLAGGALVDSM

SEQ ID NO: 16221 - protein, 11 aa, Mycobacterium tuberculosis
LAGGALVDSMG

SEQ ID NO: 16222 - protein, 11 aa, Mycobacterium tuberculosis
AGGALVDSMGW

SEQ ID NO: 16223 - protein, 11 aa, Mycobacterium tuberculosis
GGALVDSMGWE

SEQ ID NO: 16224 - protein, 11 aa, Mycobacterium tuberculosis
GALVDSMGWEW

SEQ ID NO: 16225 - protein, 11 aa, Mycobacterium tuberculosis
ALVDSMGWEWI

SEQ ID NO: 16226 - protein, 11 aa, Mycobacterium tuberculosis
LVDSMGWEWIF

SEQ ID NO: 16227 - protein, 11 aa, Mycobacterium tuberculosis
VDSMGWEWIFF

SEQ ID NO: 16228 - protein, 11 aa, Mycobacterium tuberculosis
DSMGWEWIFFV

SEQ ID NO: 16229 - protein, 11 aa, Mycobacterium tuberculosis
SMGWEWIFFVN

SEQ ID NO: 16230 - protein, 11 aa, Mycobacterium tuberculosis
MGWEWIFFVNV

SEQ ID NO: 16231 - protein, 11 aa, Mycobacterium tuberculosis
GWEWIFFVNVP

SEQ ID NO: 16232 - protein, 11 aa, Mycobacterium tuberculosis
WEWIFFVNVPV

SEQ ID NO: 16233 - protein, 11 aa, Mycobacterium tuberculosis
EWIFFVNVPVG

SEQ ID NO: 16234 - protein, 11 aa, Mycobacterium tuberculosis
WIFFVNVPVGV

SEQ ID NO: 16235 - protein, 11 aa, Mycobacterium tuberculosis
IFFVNVPVGVI

SEQ ID NO: 16236 - protein, 11 aa, Mycobacterium tuberculosis
FFVNVPVGVIG

SEQ ID NO: 16237 - protein, 11 aa, Mycobacterium tuberculosis
FVNVPVGVIGL

SEQ ID NO: 16238 - protein, 11 aa, Mycobacterium tuberculosis
VNVPVGVIGLI

SEQ ID NO: 16239 - protein, 11 aa, Mycobacterium tuberculosis
NVPVGVIGLIL

SEQ ID NO: 16240 - protein, 11 aa, Mycobacterium tuberculosis
VPVGVIGLILA

SEQ ID NO: 16241 - protein, 11 aa, Mycobacterium tuberculosis
PVGVIGLILAA

SEQ ID NO: 16242 - protein, 11 aa, Mycobacterium tuberculosis
VGVIGLILAAY

SEQ ID NO: 16243 - protein, 11 aa, Mycobacterium tuberculosis
GVIGLILAAYL

SEQ ID NO: 16244 - protein, 11 aa, Mycobacterium tuberculosis
VIGLILAAYLI

SEQ ID NO: 16245 - protein, 11 aa, Mycobacterium tuberculosis
IGLILAAYLIP

SEQ ID NO: 16246 - protein, 11 aa, Mycobacterium tuberculosis
GLILAAYLIPA

SEQ ID NO: 16247 - protein, 11 aa, Mycobacterium tuberculosis
LILAAYLIPAL

SEQ ID NO: 16248 - protein, 11 aa, Mycobacterium tuberculosis
ILAAYLIPALP

SEQ ID NO: 16249 - protein, 11 aa, Mycobacterium tuberculosis
LAAYLIPALPH

SEQ ID NO: 16250 - protein, 11 aa, Mycobacterium tuberculosis
AAYLIPALPHH

SEQ ID NO: 16251 - protein, 11 aa, Mycobacterium tuberculosis
AYLIPALPHHP

SEQ ID NO: 16252 - protein, 11 aa, Mycobacterium tuberculosis
YLIPALPHHPH

SEQ ID NO: 16253 - protein, 11 aa, Mycobacterium tuberculosis
LIPALPHHPHR

SEQ ID NO: 16254 - protein, 11 aa, Mycobacterium tuberculosis
IPALPHHPHRF

SEQ ID NO: 16255 - protein, 11 aa, Mycobacterium tuberculosis
PALPHHPHRFD

SEQ ID NO: 16256 - protein, 11 aa, Mycobacterium tuberculosis
ALPHHPHRFDW

SEQ ID NO: 16257 - protein, 11 aa, Mycobacterium tuberculosis
LPHHPHRFDWF

SEQ ID NO: 16258 - protein, 11 aa, Mycobacterium tuberculosis
PHHPHRFDWFG

SEQ ID NO: 16259 - protein, 11 aa, Mycobacterium tuberculosis
HHPHRFDWFGV

SEQ ID NO: 16260 - protein, 11 aa, Mycobacterium tuberculosis
HPHRFDWFGVG

SEQ ID NO: 16261 - protein, 11 aa, Mycobacterium tuberculosis
PHRFDWFGVGL

SEQ ID NO: 16262 - protein, 11 aa, Mycobacterium tuberculosis
HRFDWFGVGLS

SEQ ID NO: 16263 - protein, 11 aa, Mycobacterium tuberculosis
RFDWFGVGLSG

SEQ ID NO: 16264 - protein, 11 aa, Mycobacterium tuberculosis
FDWFGVGLSGA

SEQ ID NO: 16265 - protein, 11 aa, Mycobacterium tuberculosis
DWFGVGLSGAG

SEQ ID NO: 16266 - protein, 11 aa, Mycobacterium tuberculosis
WFGVGLSGAGM

SEQ ID NO: 16267 - protein, 11 aa, Mycobacterium tuberculosis
FGVGLSGAGMF

SEQ ID NO: 16268 - protein, 11 aa, Mycobacterium tuberculosis
GVGLSGAGMFL

SEQ ID NO: 16269 - protein, 11 aa, Mycobacterium tuberculosis
VGLSGAGMFLI

SEQ ID NO: 16270 - protein, 11 aa, Mycobacterium tuberculosis
GLSGAGMFLIV

SEQ ID NO: 16271 - protein, 11 aa, Mycobacterium tuberculosis
LSGAGMFLIVF

SEQ ID NO: 16272 - protein, 11 aa, Mycobacterium tuberculosis
SGAGMFLIVFG

SEQ ID NO: 16273 - protein, 11 aa, Mycobacterium tuberculosis
GAGMFLIVFGL

SEQ ID NO: 16274 - protein, 11 aa, Mycobacterium tuberculosis
AGMFLIVFGLQ

SEQ ID NO: 16275 - protein, 11 aa, Mycobacterium tuberculosis
GMFLIVFGLQQ

SEQ ID NO: 16276 - protein, 11 aa, Mycobacterium tuberculosis
MFLIVFGLQQG

SEQ ID NO: 16277 - protein, 11 aa, Mycobacterium tuberculosis
FLIVFGLQQGQ

SEQ ID NO: 16278 - protein, 11 aa, Mycobacterium tuberculosis
LIVFGLQQGQS

SEQ ID NO: 16279 - protein, 11 aa, Mycobacterium tuberculosis
IVFGLQQGQSA

SEQ ID NO: 16280 - protein, 11 aa, Mycobacterium tuberculosis
VFGLQQGQSAN

SEQ ID NO: 16281 - protein, 11 aa, Mycobacterium tuberculosis
FGLQQGQSANW

SEQ ID NO: 16282 - protein, 11 aa, Mycobacterium tuberculosis
GLQQGQSANWQ

SEQ ID NO: 16283 - protein, 11 aa, Mycobacterium tuberculosis
LQQGQSANWQP

SEQ ID NO: 16284 - protein, 11 aa, Mycobacterium tuberculosis
QQGQSANWQPW

SEQ ID NO: 16285 - protein, 11 aa, Mycobacterium tuberculosis
QGQSANWQPWI

SEQ ID NO: 16286 - protein, 11 aa, Mycobacterium tuberculosis
GQSANWQPWIW

SEQ ID NO: 16287 - protein, 11 aa, Mycobacterium tuberculosis
QSANWQPWIWA

SEQ ID NO: 16288 - protein, 11 aa, Mycobacterium tuberculosis
SANWQPWIWAV

SEQ ID NO: 16289 - protein, 11 aa, Mycobacterium tuberculosis
ANWQPWIWAVI

SEQ ID NO: 16290 - protein, 11 aa, Mycobacterium tuberculosis
NWQPWIWAVIV

SEQ ID NO: 16291 - protein, 11 aa, Mycobacterium tuberculosis
WQPWIWAVIVG

SEQ ID NO: 16292 - protein, 11 aa, Mycobacterium tuberculosis
QPWIWAVIVGG

SEQ ID NO: 16293 - protein, 11 aa, Mycobacterium tuberculosis
PWIWAVIVGGI

SEQ ID NO: 16294 - protein, 11 aa, Mycobacterium tuberculosis
WIWAVIVGGIG

SEQ ID NO: 16295 - protein, 11 aa, Mycobacterium tuberculosis
IWAVIVGGIGF

SEQ ID NO: 16296 - protein, 11 aa, Mycobacterium tuberculosis
WAVIVGGIGFM

SEQ ID NO: 16297 - protein, 11 aa, Mycobacterium tuberculosis
AVIVGGIGFMS

SEQ ID NO: 16298 - protein, 11 aa, Mycobacterium tuberculosis
VIVGGIGFMSL

SEQ ID NO: 16299 - protein, 11 aa, Mycobacterium tuberculosis
IVGGIGFMSLF

SEQ ID NO: 16300 - protein, 11 aa, Mycobacterium tuberculosis
VGGIGFMSLFV

SEQ ID NO: 16301 - protein, 11 aa, Mycobacterium tuberculosis
GGIGFMSLFVY

SEQ ID NO: 16302 - protein, 11 aa, Mycobacterium tuberculosis
GIGFMSLFVYW

SEQ ID NO: 16303 - protein, 11 aa, Mycobacterium tuberculosis
IGFMSLFVYWQ

SEQ ID NO: 16304 - protein, 11 aa, Mycobacterium tuberculosis
GFMSLFVYWQA

SEQ ID NO: 16305 - protein, 11 aa, Mycobacterium tuberculosis
FMSLFVYWQAR

SEQ ID NO: 16306 - protein, 11 aa, Mycobacterium tuberculosis
MSLFVYWQARN

SEQ ID NO: 16307 - protein, 11 aa, Mycobacterium tuberculosis
SLFVYWQARNA

SEQ ID NO: 16308 - protein, 11 aa, Mycobacterium tuberculosis
LFVYWQARNAR

SEQ ID NO: 16309 - protein, 11 aa, Mycobacterium tuberculosis
FVYWQARNARE

SEQ ID NO: 16310 - protein, 11 aa, Mycobacterium tuberculosis
VYWQARNAREP

SEQ ID NO: 16311 - protein, 11 aa, Mycobacterium tuberculosis
YWQARNAREPL

SEQ ID NO: 16312 - protein, 11 aa, Mycobacterium tuberculosis
WQARNAREPLI

SEQ ID NO: 16313 - protein, 11 aa, Mycobacterium tuberculosis
QARNAREPLIP

SEQ ID NO: 16314 - protein, 11 aa, Mycobacterium tuberculosis
ARNAREPLIPL

SEQ ID NO: 16315 - protein, 11 aa, Mycobacterium tuberculosis
RNAREPLIPLE

SEQ ID NO: 16316 - protein, 11 aa, Mycobacterium tuberculosis
NAREPLIPLEV

SEQ ID NO: 16317 - protein, 11 aa, Mycobacterium tuberculosis
AREPLIPLEVF

SEQ ID NO: 16318 - protein, 11 aa, Mycobacterium tuberculosis
REPLIPLEVFN

SEQ ID NO: 16319 - protein, 11 aa, Mycobacterium tuberculosis
EPLIPLEVFND

SEQ ID NO: 16320 - protein, 11 aa, Mycobacterium tuberculosis
PLIPLEVFNDR

SEQ ID NO: 16321 - protein, 11 aa, Mycobacterium tuberculosis
LIPLEVFNDRN

SEQ ID NO: 16322 - protein, 11 aa, Mycobacterium tuberculosis
IPLEVFNDRNF

SEQ ID NO: 16323 - protein, 11 aa, Mycobacterium tuberculosis
PLEVFNDRNFS

SEQ ID NO: 16324 - protein, 11 aa, Mycobacterium tuberculosis
LEVFNDRNFSL

SEQ ID NO: 16325 - protein, 11 aa, Mycobacterium tuberculosis
EVFNDRNFSLS

SEQ ID NO: 16326 - protein, 11 aa, Mycobacterium tuberculosis
VFNDRNFSLSN

SEQ ID NO: 16327 - protein, 11 aa, Mycobacterium tuberculosis
FNDRNFSLSNL

SEQ ID NO: 16328 - protein, 11 aa, Mycobacterium tuberculosis
NDRNFSLSNLR

SEQ ID NO: 16329 - protein, 11 aa, Mycobacterium tuberculosis
DRNFSLSNLRI

SEQ ID NO: 16330 - protein, 11 aa, Mycobacterium tuberculosis
RNFSLSNLRIA

SEQ ID NO: 16331 - protein, 11 aa, Mycobacterium tuberculosis
NFSLSNLRIAI

SEQ ID NO: 16332 - protein, 11 aa, Mycobacterium tuberculosis
FSLSNLRIAII

SEQ ID NO: 16333 - protein, 11 aa, Mycobacterium tuberculosis
SLSNLRIAIIA

SEQ ID NO: 16334 - protein, 11 aa, Mycobacterium tuberculosis
LSNLRIAIIAF

SEQ ID NO: 16335 - protein, 11 aa, Mycobacterium tuberculosis
SNLRIAIIAFA

SEQ ID NO: 16336 - protein, 11 aa, Mycobacterium tuberculosis
NLRIAIIAFAG

SEQ ID NO: 16337 - protein, 11 aa, Mycobacterium tuberculosis
LRIAIIAFAGT

SEQ ID NO: 16338 - protein, 11 aa, Mycobacterium tuberculosis
RIAIIAFAGTG

SEQ ID NO: 16339 - protein, 11 aa, Mycobacterium tuberculosis
IAIIAFAGTGM

SEQ ID NO: 16340 - protein, 11 aa, Mycobacterium tuberculosis
AIIAFAGTGMM

SEQ ID NO: 16341 - protein, 11 aa, Mycobacterium tuberculosis
IIAFAGTGMML

SEQ ID NO: 16342 - protein, 11 aa, Mycobacterium tuberculosis
IAFAGTGMMLP

SEQ ID NO: 16343 - protein, 11 aa, Mycobacterium tuberculosis
AFAGTGMMLPV

SEQ ID NO: 16344 - protein, 11 aa, Mycobacterium tuberculosis
FAGTGMMLPVT

SEQ ID NO: 16345 - protein, 11 aa, Mycobacterium tuberculosis
AGTGMMLPVTF

SEQ ID NO: 16346 - protein, 11 aa, Mycobacterium tuberculosis
GTGMMLPVTFY

SEQ ID NO: 16347 - protein, 11 aa, Mycobacterium tuberculosis
TGMMLPVTFYA

SEQ ID NO: 16348 - protein, 11 aa, Mycobacterium tuberculosis
GMMLPVTFYAQ

SEQ ID NO: 16349 - protein, 11 aa, Mycobacterium tuberculosis
MMLPVTFYAQA

SEQ ID NO: 16350 - protein, 11 aa, Mycobacterium tuberculosis
MLPVTFYAQAV

SEQ ID NO: 16351 - protein, 11 aa, Mycobacterium tuberculosis
LPVTFYAQAVC

SEQ ID NO: 16352 - protein, 11 aa, Mycobacterium tuberculosis
PVTFYAQAVCG

SEQ ID NO: 16353 - protein, 11 aa, Mycobacterium tuberculosis
VTFYAQAVCGL

SEQ ID NO: 16354 - protein, 11 aa, Mycobacterium tuberculosis
TFYAQAVCGLS

SEQ ID NO: 16355 - protein, 11 aa, Mycobacterium tuberculosis
FYAQAVCGLSP

SEQ ID NO: 16356 - protein, 11 aa, Mycobacterium tuberculosis
YAQAVCGLSPT

SEQ ID NO: 16357 - protein, 11 aa, Mycobacterium tuberculosis
AQAVCGLSPTH

SEQ ID NO: 16358 - protein, 11 aa, Mycobacterium tuberculosis
QAVCGLSPTHT

SEQ ID NO: 16359 - protein, 11 aa, Mycobacterium tuberculosis
AVCGLSPTHTA

SEQ ID NO: 16360 - protein, 11 aa, Mycobacterium tuberculosis
VCGLSPTHTAV

SEQ ID NO: 16361 - protein, 11 aa, Mycobacterium tuberculosis
CGLSPTHTAVL

SEQ ID NO: 16362 - protein, 11 aa, Mycobacterium tuberculosis
GLSPTHTAVLF

SEQ ID NO: 16363 - protein, 11 aa, Mycobacterium tuberculosis
LSPTHTAVLFA

SEQ ID NO: 16364 - protein, 11 aa, Mycobacterium tuberculosis
SPTHTAVLFAP

SEQ ID NO: 16365 - protein, 11 aa, Mycobacterium tuberculosis
PTHTAVLFAPT

SEQ ID NO: 16366 - protein, 11 aa, Mycobacterium tuberculosis
THTAVLFAPTA

SEQ ID NO: 16367 - protein, 11 aa, Mycobacterium tuberculosis
HTAVLFAPTAI

SEQ ID NO: 16368 - protein, 11 aa, Mycobacterium tuberculosis
TAVLFAPTAIV

SEQ ID NO: 16369 - protein, 11 aa, Mycobacterium tuberculosis
AVLFAPTAIVG

SEQ ID NO: 16370 - protein, 11 aa, Mycobacterium tuberculosis
VLFAPTAIVGG

SEQ ID NO: 16371 - protein, 11 aa, Mycobacterium tuberculosis
LFAPTAIVGGV

SEQ ID NO: 16372 - protein, 11 aa, Mycobacterium tuberculosis
FAPTAIVGGVL

SEQ ID NO: 16373 - protein, 11 aa, Mycobacterium tuberculosis
APTAIVGGVLA

SEQ ID NO: 16374 - protein, 11 aa, Mycobacterium tuberculosis
PTAIVGGVLAP

SEQ ID NO: 16375 - protein, 11 aa, Mycobacterium tuberculosis
TAIVGGVLAPF

SEQ ID NO: 16376 - protein, 11 aa, Mycobacterium tuberculosis
AIVGGVLAPFV

SEQ ID NO: 16377 - protein, 11 aa, Mycobacterium tuberculosis
IVGGVLAPFVG

SEQ ID NO: 16378 - protein, 11 aa, Mycobacterium tuberculosis
VGGVLAPFVGM

SEQ ID NO: 16379 - protein, 11 aa, Mycobacterium tuberculosis
GGVLAPFVGMI

SEQ ID NO: 16380 - protein, 11 aa, Mycobacterium tuberculosis
GVLAPFVGMII

SEQ ID NO: 16381 - protein, 11 aa, Mycobacterium tuberculosis
VLAPFVGMIID

SEQ ID NO: 16382 - protein, 11 aa, Mycobacterium tuberculosis
LAPFVGMIIDR

SEQ ID NO: 16383 - protein, 11 aa, Mycobacterium tuberculosis
APFVGMIIDRS

SEQ ID NO: 16384 - protein, 11 aa, Mycobacterium tuberculosis
PFVGMIIDRSH

SEQ ID NO: 16385 - protein, 11 aa, Mycobacterium tuberculosis
FVGMIIDRSHP

SEQ ID NO: 16386 - protein, 11 aa, Mycobacterium tuberculosis
VGMIIDRSHPL

SEQ ID NO: 16387 - protein, 11 aa, Mycobacterium tuberculosis
GMIIDRSHPLC

SEQ ID NO: 16388 - protein, 11 aa, Mycobacterium tuberculosis
MIIDRSHPLCV

SEQ ID NO: 16389 - protein, 11 aa, Mycobacterium tuberculosis
IIDRSHPLCVL

SEQ ID NO: 16390 - protein, 11 aa, Mycobacterium tuberculosis
IDRSHPLCVLG

SEQ ID NO: 16391 - protein, 11 aa, Mycobacterium tuberculosis
DRSHPLCVLGF

SEQ ID NO: 16392 - protein, 11 aa, Mycobacterium tuberculosis
RSHPLCVLGFG

SEQ ID NO: 16393 - protein, 11 aa, Mycobacterium tuberculosis
SHPLCVLGFGF

SEQ ID NO: 16394 - protein, 11 aa, Mycobacterium tuberculosis
HPLCVLGFGFS

SEQ ID NO: 16395 - protein, 11 aa, Mycobacterium tuberculosis
PLCVLGFGFSV

SEQ ID NO: 16396 - protein, 11 aa, Mycobacterium tuberculosis
LCVLGFGFSVL

SEQ ID NO: 16397 - protein, 11 aa, Mycobacterium tuberculosis
CVLGFGFSVLA

SEQ ID NO: 16398 - protein, 11 aa, Mycobacterium tuberculosis
VLGFGFSVLAI

SEQ ID NO: 16399 - protein, 11 aa, Mycobacterium tuberculosis
LGFGFSVLAIA

SEQ ID NO: 16400 - protein, 11 aa, Mycobacterium tuberculosis
GFGFSVLAIAM

SEQ ID NO: 16401 - protein, 11 aa, Mycobacterium tuberculosis
FGFSVLAIAMT

SEQ ID NO: 16402 - protein, 11 aa, Mycobacterium tuberculosis
GFSVLAIAMTW

SEQ ID NO: 16403 - protein, 11 aa, Mycobacterium tuberculosis
FSVLAIAMTWL

SEQ ID NO: 16404 - protein, 11 aa, Mycobacterium tuberculosis
SVLAIAMTWLL

SEQ ID NO: 16405 - protein, 11 aa, Mycobacterium tuberculosis
VLAIAMTWLLC

SEQ ID NO: 16406 - protein, 11 aa, Mycobacterium tuberculosis
LAIAMTWLLCE

SEQ ID NO: 16407 - protein, 11 aa, Mycobacterium tuberculosis
AIAMTWLLCEM

SEQ ID NO: 16408 - protein, 11 aa, Mycobacterium tuberculosis
IAMTWLLCEMA

SEQ ID NO: 16409 - protein, 11 aa, Mycobacterium tuberculosis
AMTWLLCEMAP

SEQ ID NO: 16410 - protein, 11 aa, Mycobacterium tuberculosis
MTWLLCEMAPG

SEQ ID NO: 16411 - protein, 11 aa, Mycobacterium tuberculosis
TWLLCEMAPGT

SEQ ID NO: 16412 - protein, 11 aa, Mycobacterium tuberculosis
WLLCEMAPGTP

SEQ ID NO: 16413 - protein, 11 aa, Mycobacterium tuberculosis
LLCEMAPGTPI

SEQ ID NO: 16414 - protein, 11 aa, Mycobacterium tuberculosis
LCEMAPGTPIW

SEQ ID NO: 16415 - protein, 11 aa, Mycobacterium tuberculosis
CEMAPGTPIWR

SEQ ID NO: 16416 - protein, 11 aa, Mycobacterium tuberculosis
EMAPGTPIWRL

SEQ ID NO: 16417 - protein, 11 aa, Mycobacterium tuberculosis
MAPGTPIWRLV

SEQ ID NO: 16418 - protein, 11 aa, Mycobacterium tuberculosis
APGTPIWRLVL

SEQ ID NO: 16419 - protein, 11 aa, Mycobacterium tuberculosis
PGTPIWRLVLP

SEQ ID NO: 16420 - protein, 11 aa, Mycobacterium tuberculosis
GTPIWRLVLPF

SEQ ID NO: 16421 - protein, 11 aa, Mycobacterium tuberculosis
TPIWRLVLPFI

SEQ ID NO: 16422 - protein, 11 aa, Mycobacterium tuberculosis
PIWRLVLPFIA

SEQ ID NO: 16423 - protein, 11 aa, Mycobacterium tuberculosis
IWRLVLPFIAL

SEQ ID NO: 16424 - protein, 11 aa, Mycobacterium tuberculosis
WRLVLPFIALG

SEQ ID NO: 16425 - protein, 11 aa, Mycobacterium tuberculosis
RLVLPFIALGV

SEQ ID NO: 16426 - protein, 11 aa, Mycobacterium tuberculosis
LVLPFIALGVA

SEQ ID NO: 16427 - protein, 11 aa, Mycobacterium tuberculosis
VLPFIALGVAG

SEQ ID NO: 16428 - protein, 11 aa, Mycobacterium tuberculosis
LPFIALGVAGA

SEQ ID NO: 16429 - protein, 11 aa, Mycobacterium tuberculosis
PFIALGVAGAF

SEQ ID NO: 16430 - protein, 11 aa, Mycobacterium tuberculosis
FIALGVAGAFV

SEQ ID NO: 16431 - protein, 11 aa, Mycobacterium tuberculosis
IALGVAGAFVW

SEQ ID NO: 16432 - protein, 11 aa, Mycobacterium tuberculosis
ALGVAGAFVWS

SEQ ID NO: 16433 - protein, 11 aa, Mycobacterium tuberculosis
LGVAGAFVWSP

SEQ ID NO: 16434 - protein, 11 aa, Mycobacterium tuberculosis
GVAGAFVWSPL

SEQ ID NO: 16435 - protein, 11 aa, Mycobacterium tuberculosis
VAGAFVWSPLT

SEQ ID NO: 16436 - protein, 11 aa, Mycobacterium tuberculosis
AGAFVWSPLTV

SEQ ID NO: 16437 - protein, 11 aa, Mycobacterium tuberculosis
GAFVWSPLTVT

SEQ ID NO: 16438 - protein, 11 aa, Mycobacterium tuberculosis
AFVWSPLTVTA

SEQ ID NO: 16439 - protein, 11 aa, Mycobacterium tuberculosis
FVWSPLTVTAT

SEQ ID NO: 16440 - protein, 11 aa, Mycobacterium tuberculosis
VWSPLTVTATR

SEQ ID NO: 16441 - protein, 11 aa, Mycobacterium tuberculosis
WSPLTVTATRN

SEQ ID NO: 16442 - protein, 11 aa, Mycobacterium tuberculosis
SPLTVTATRNL

SEQ ID NO: 16443 - protein, 11 aa, Mycobacterium tuberculosis
PLTVTATRNLR

SEQ ID NO: 16444 - protein, 11 aa, Mycobacterium tuberculosis
LTVTATRNLRP

SEQ ID NO: 16445 - protein, 11 aa, Mycobacterium tuberculosis
TVTATRNLRPH

SEQ ID NO: 16446 - protein, 11 aa, Mycobacterium tuberculosis
VTATRNLRPHL

SEQ ID NO: 16447 - protein, 11 aa, Mycobacterium tuberculosis
TATRNLRPHLA

SEQ ID NO: 16448 - protein, 11 aa, Mycobacterium tuberculosis
ATRNLRPHLAG

SEQ ID NO: 16449 - protein, 11 aa, Mycobacterium tuberculosis
TRNLRPHLAGA

SEQ ID NO: 16450 - protein, 11 aa, Mycobacterium tuberculosis
RNLRPHLAGAS

SEQ ID NO: 16451 - protein, 11 aa, Mycobacterium tuberculosis
NLRPHLAGASS

SEQ ID NO: 16452 - protein, 11 aa, Mycobacterium tuberculosis
LRPHLAGASSG

SEQ ID NO: 16453 - protein, 11 aa, Mycobacterium tuberculosis
RPHLAGASSGV

SEQ ID NO: 16454 - protein, 11 aa, Mycobacterium tuberculosis
PHLAGASSGVF

SEQ ID NO: 16455 - protein, 11 aa, Mycobacterium tuberculosis
HLAGASSGVFN

SEQ ID NO: 16456 - protein, 11 aa, Mycobacterium tuberculosis
LAGASSGVFNA

SEQ ID NO: 16457 - protein, 11 aa, Mycobacterium tuberculosis
AGASSGVFNAV

SEQ ID NO: 16458 - protein, 11 aa, Mycobacterium tuberculosis
GASSGVFNAVR

SEQ ID NO: 16459 - protein, 11 aa, Mycobacterium tuberculosis
ASSGVFNAVRQ

SEQ ID NO: 16460 - protein, 11 aa, Mycobacterium tuberculosis
SSGVFNAVRQL

SEQ ID NO: 16461 - protein, 11 aa, Mycobacterium tuberculosis
SGVFNAVRQLG

SEQ ID NO: 16462 - protein, 11 aa, Mycobacterium tuberculosis
GVFNAVRQLGA

SEQ ID NO: 16463 - protein, 11 aa, Mycobacterium tuberculosis
VFNAVRQLGAV

SEQ ID NO: 16464 - protein, 11 aa, Mycobacterium tuberculosis
FNAVRQLGAVL

SEQ ID NO: 16465 - protein, 11 aa, Mycobacterium tuberculosis
NAVRQLGAVLG

SEQ ID NO: 16466 - protein, 11 aa, Mycobacterium tuberculosis
AVRQLGAVLGS

SEQ ID NO: 16467 - protein, 11 aa, Mycobacterium tuberculosis
VRQLGAVLGSA

SEQ ID NO: 16468 - protein, 11 aa, Mycobacterium tuberculosis
RQLGAVLGSAS

SEQ ID NO: 16469 - protein, 11 aa, Mycobacterium tuberculosis
QLGAVLGSASM

SEQ ID NO: 16470 - protein, 11 aa, Mycobacterium tuberculosis
LGAVLGSASMA

SEQ ID NO: 16471 - protein, 11 aa, Mycobacterium tuberculosis
GAVLGSASMAA

SEQ ID NO: 16472 - protein, 11 aa, Mycobacterium tuberculosis
AVLGSASMAAF

SEQ ID NO: 16473 - protein, 11 aa, Mycobacterium tuberculosis
VLGSASMAAFM

SEQ ID NO: 16474 - protein, 11 aa, Mycobacterium tuberculosis
LGSASMAAFMT

SEQ ID NO: 16475 - protein, 11 aa, Mycobacterium tuberculosis
GSASMAAFMTS

SEQ ID NO: 16476 - protein, 11 aa, Mycobacterium tuberculosis
SASMAAFMTSR

SEQ ID NO: 16477 - protein, 11 aa, Mycobacterium tuberculosis
ASMAAFMTSRI

SEQ ID NO: 16478 - protein, 11 aa, Mycobacterium tuberculosis
SMAAFMTSRIA

SEQ ID NO: 16479 - protein, 11 aa, Mycobacterium tuberculosis
MAAFMTSRIAA

SEQ ID NO: 16480 - protein, 11 aa, Mycobacterium tuberculosis
AAFMTSRIAAE

SEQ ID NO: 16481 - protein, 11 aa, Mycobacterium tuberculosis
AFMTSRIAAEM

SEQ ID NO: 16482 - protein, 11 aa, Mycobacterium tuberculosis
FMTSRIAAEMP

SEQ ID NO: 16483 - protein, 11 aa, Mycobacterium tuberculosis
MTSRIAAEMPG

SEQ ID NO: 16484 - protein, 11 aa, Mycobacterium tuberculosis
TSRIAAEMPGG

SEQ ID NO: 16485 - protein, 11 aa, Mycobacterium tuberculosis
SRIAAEMPGGV

SEQ ID NO: 16486 - protein, 11 aa, Mycobacterium tuberculosis
RIAAEMPGGVD

SEQ ID NO: 16487 - protein, 11 aa, Mycobacterium tuberculosis
IAAEMPGGVDA

SEQ ID NO: 16488 - protein, 11 aa, Mycobacterium tuberculosis
AAEMPGGVDAL

SEQ ID NO: 16489 - protein, 11 aa, Mycobacterium tuberculosis
AEMPGGVDALT

SEQ ID NO: 16490 - protein, 11 aa, Mycobacterium tuberculosis
EMPGGVDALTG

SEQ ID NO: 16491 - protein, 11 aa, Mycobacterium tuberculosis
MPGGVDALTGP

SEQ ID NO: 16492 - protein, 11 aa, Mycobacterium tuberculosis
PGGVDALTGPA

SEQ ID NO: 16493 - protein, 11 aa, Mycobacterium tuberculosis
GGVDALTGPAG

SEQ ID NO: 16494 - protein, 11 aa, Mycobacterium tuberculosis
GVDALTGPAGQ

SEQ ID NO: 16495 - protein, 11 aa, Mycobacterium tuberculosis
VDALTGPAGQD

SEQ ID NO: 16496 - protein, 11 aa, Mycobacterium tuberculosis
DALTGPAGQDA

SEQ ID NO: 16497 - protein, 11 aa, Mycobacterium tuberculosis
ALTGPAGQDAT

SEQ ID NO: 16498 - protein, 11 aa, Mycobacterium tuberculosis
LTGPAGQDATV

SEQ ID NO: 16499 - protein, 11 aa, Mycobacterium tuberculosis
TGPAGQDATVL

SEQ ID NO: 16500 - protein, 11 aa, Mycobacterium tuberculosis
GPAGQDATVLQ

SEQ ID NO: 16501 - protein, 11 aa, Mycobacterium tuberculosis
PAGQDATVLQL

SEQ ID NO: 16502 - protein, 11 aa, Mycobacterium tuberculosis
AGQDATVLQLP

SEQ ID NO: 16503 - protein, 11 aa, Mycobacterium tuberculosis
GQDATVLQLPE

SEQ ID NO: 16504 - protein, 11 aa, Mycobacterium tuberculosis
QDATVLQLPEF

SEQ ID NO: 16505 - protein, 11 aa, Mycobacterium tuberculosis
DATVLQLPEFV

SEQ ID NO: 16506 - protein, 11 aa, Mycobacterium tuberculosis
ATVLQLPEFVR

SEQ ID NO: 16507 - protein, 11 aa, Mycobacterium tuberculosis
TVLQLPEFVRE

SEQ ID NO: 16508 - protein, 11 aa, Mycobacterium tuberculosis
VLQLPEFVREP

SEQ ID NO: 16509 - protein, 11 aa, Mycobacterium tuberculosis
LQLPEFVREPF

SEQ ID NO: 16510 - protein, 11 aa, Mycobacterium tuberculosis
QLPEFVREPFA

SEQ ID NO: 16511 - protein, 11 aa, Mycobacterium tuberculosis
LPEFVREPFAA

SEQ ID NO: 16512 - protein, 11 aa, Mycobacterium tuberculosis
PEFVREPFAAA

SEQ ID NO: 16513 - protein, 11 aa, Mycobacterium tuberculosis
EFVREPFAAAM

SEQ ID NO: 16514 - protein, 11 aa, Mycobacterium tuberculosis
FVREPFAAAMS

SEQ ID NO: 16515 - protein, 11 aa, Mycobacterium tuberculosis
VREPFAAAMSQ

SEQ ID NO: 16516 - protein, 11 aa, Mycobacterium tuberculosis
REPFAAAMSQS

SEQ ID NO: 16517 - protein, 11 aa, Mycobacterium tuberculosis
EPFAAAMSQSM

SEQ ID NO: 16518 - protein, 11 aa, Mycobacterium tuberculosis
PFAAAMSQSML

SEQ ID NO: 16519 - protein, 11 aa, Mycobacterium tuberculosis
FAAAMSQSMLL

SEQ ID NO: 16520 - protein, 11 aa, Mycobacterium tuberculosis
AAAMSQSMLLP

SEQ ID NO: 16521 - protein, 11 aa, Mycobacterium tuberculosis
AAMSQSMLLPA

SEQ ID NO: 16522 - protein, 11 aa, Mycobacterium tuberculosis
AMSQSMLLPAF

SEQ ID NO: 16523 - protein, 11 aa, Mycobacterium tuberculosis
MSQSMLLPAFV

SEQ ID NO: 16524 - protein, 11 aa, Mycobacterium tuberculosis
SQSMLLPAFVA

SEQ ID NO: 16525 - protein, 11 aa, Mycobacterium tuberculosis
QSMLLPAFVAL

SEQ ID NO: 16526 - protein, 11 aa, Mycobacterium tuberculosis
SMLLPAFVALF

SEQ ID NO: 16527 - protein, 11 aa, Mycobacterium tuberculosis
MLLPAFVALFG

SEQ ID NO: 16528 - protein, 11 aa, Mycobacterium tuberculosis
LLPAFVALFGI

SEQ ID NO: 16529 - protein, 11 aa, Mycobacterium tuberculosis
LPAFVALFGIV

SEQ ID NO: 16530 - protein, 11 aa, Mycobacterium tuberculosis
PAFVALFGIVA

SEQ ID NO: 16531 - protein, 11 aa, Mycobacterium tuberculosis
AFVALFGIVAA

SEQ ID NO: 16532 - protein, 11 aa, Mycobacterium tuberculosis
FVALFGIVAAL

SEQ ID NO: 16533 - protein, 11 aa, Mycobacterium tuberculosis
VALFGIVAALF

SEQ ID NO: 16534 - protein, 11 aa, Mycobacterium tuberculosis
ALFGIVAALFL

SEQ ID NO: 16535 - protein, 11 aa, Mycobacterium tuberculosis
LFGIVAALFLV

SEQ ID NO: 16536 - protein, 11 aa, Mycobacterium tuberculosis
FGIVAALFLVD

SEQ ID NO: 16537 - protein, 11 aa, Mycobacterium tuberculosis
GIVAALFLVDF

SEQ ID NO: 16538 - protein, 11 aa, Mycobacterium tuberculosis
IVAALFLVDFT

SEQ ID NO: 16539 - protein, 11 aa, Mycobacterium tuberculosis
VAALFLVDFTG

SEQ ID NO: 16540 - protein, 11 aa, Mycobacterium tuberculosis
AALFLVDFTGA

SEQ ID NO: 16541 - protein, 11 aa, Mycobacterium tuberculosis
ALFLVDFTGAA

SEQ ID NO: 16542 - protein, 11 aa, Mycobacterium tuberculosis
LFLVDFTGAAV

SEQ ID NO: 16543 - protein, 11 aa, Mycobacterium tuberculosis
FLVDFTGAAVA

SEQ ID NO: 16544 - protein, 11 aa, Mycobacterium tuberculosis
LVDFTGAAVAK

SEQ ID NO: 16545 - protein, 11 aa, Mycobacterium tuberculosis
VDFTGAAVAKE

SEQ ID NO: 16546 - protein, 11 aa, Mycobacterium tuberculosis
DFTGAAVAKEP

SEQ ID NO: 16547 - protein, 11 aa, Mycobacterium tuberculosis
FTGAAVAKEPL

SEQ ID NO: 16548 - protein, 11 aa, Mycobacterium tuberculosis
TGAAVAKEPLP

SEQ ID NO: 16549 - protein, 11 aa, Mycobacterium tuberculosis
GAAVAKEPLPE

SEQ ID NO: 16550 - protein, 11 aa, Mycobacterium tuberculosis
AAVAKEPLPES

SEQ ID NO: 16551 - protein, 11 aa, Mycobacterium tuberculosis
AVAKEPLPESD

SEQ ID NO: 16552 - protein, 11 aa, Mycobacterium tuberculosis
VAKEPLPESDG

SEQ ID NO: 16553 - protein, 11 aa, Mycobacterium tuberculosis
AKEPLPESDGD

SEQ ID NO: 16554 - protein, 11 aa, Mycobacterium tuberculosis
KEPLPESDGDA

SEQ ID NO: 16555 - protein, 11 aa, Mycobacterium tuberculosis
EPLPESDGDAD

SEQ ID NO: 16556 - protein, 11 aa, Mycobacterium tuberculosis
PLPESDGDADD

SEQ ID NO: 16557 - protein, 11 aa, Mycobacterium tuberculosis
LPESDGDADDD

SEQ ID NO: 16558 - protein, 11 aa, Mycobacterium tuberculosis
PESDGDADDDD

SEQ ID NO: 16559 - protein, 11 aa, Mycobacterium tuberculosis
ESDGDADDDDY

SEQ ID NO: 16560 - protein, 11 aa, Mycobacterium tuberculosis
SDGDADDDDYV

SEQ ID NO: 16561 - protein, 11 aa, Mycobacterium tuberculosis
DGDADDDDYVE

SEQ ID NO: 16562 - protein, 11 aa, Mycobacterium tuberculosis
GDADDDDYVEY

SEQ ID NO: 16563 - protein, 11 aa, Mycobacterium tuberculosis
DADDDDYVEYI

SEQ ID NO: 16564 - protein, 11 aa, Mycobacterium tuberculosis
ADDDDYVEYIL

SEQ ID NO: 16565 - protein, 11 aa, Mycobacterium tuberculosis
DDDDYVEYILR

SEQ ID NO: 16566 - protein, 11 aa, Mycobacterium tuberculosis
DDDYVEYILRR

SEQ ID NO: 16567 - protein, 11 aa, Mycobacterium tuberculosis
DDYVEYILRRE

SEQ ID NO: 16568 - protein, 11 aa, Mycobacterium tuberculosis
DYVEYILRREP

SEQ ID NO: 16569 - protein, 11 aa, Mycobacterium tuberculosis
YVEYILRREPE

SEQ ID NO: 16570 - protein, 11 aa, Mycobacterium tuberculosis
VEYILRREPEE

SEQ ID NO: 16571 - protein, 11 aa, Mycobacterium tuberculosis
EYILRREPEED

SEQ ID NO: 16572 - protein, 11 aa, Mycobacterium tuberculosis
YILRREPEEDC

SEQ ID NO: 16573 - protein, 11 aa, Mycobacterium tuberculosis
ILRREPEEDCD

SEQ ID NO: 16574 - protein, 11 aa, Mycobacterium tuberculosis
LRREPEEDCDT

SEQ ID NO: 16575 - protein, 11 aa, Mycobacterium tuberculosis
RREPEEDCDTQ

SEQ ID NO: 16576 - protein, 11 aa, Mycobacterium tuberculosis
REPEEDCDTQP

SEQ ID NO: 16577 - protein, 11 aa, Mycobacterium tuberculosis
EPEEDCDTQPL

SEQ ID NO: 16578 - protein, 11 aa, Mycobacterium tuberculosis
PEEDCDTQPLR

SEQ ID NO: 16579 - protein, 11 aa, Mycobacterium tuberculosis
EEDCDTQPLRA

SEQ ID NO: 16580 - protein, 11 aa, Mycobacterium tuberculosis
EDCDTQPLRAS

SEQ ID NO: 16581 - protein, 11 aa, Mycobacterium tuberculosis
DCDTQPLRASR

SEQ ID NO: 16582 - protein, 11 aa, Mycobacterium tuberculosis
CDTQPLRASRP

SEQ ID NO: 16583 - protein, 11 aa, Mycobacterium tuberculosis
DTQPLRASRPA

SEQ ID NO: 16584 - protein, 11 aa, Mycobacterium tuberculosis
TQPLRASRPAA

SEQ ID NO: 16585 - protein, 11 aa, Mycobacterium tuberculosis
QPLRASRPAAA

SEQ ID NO: 16586 - protein, 11 aa, Mycobacterium tuberculosis
PLRASRPAAAA

SEQ ID NO: 16587 - protein, 11 aa, Mycobacterium tuberculosis
LRASRPAAAAA

SEQ ID NO: 16588 - protein, 11 aa, Mycobacterium tuberculosis
RASRPAAAAAS

SEQ ID NO: 16589 - protein, 11 aa, Mycobacterium tuberculosis
ASRPAAAAASR

SEQ ID NO: 16590 - protein, 11 aa, Mycobacterium tuberculosis
SRPAAAAASRS

SEQ ID NO: 16591 - protein, 11 aa, Mycobacterium tuberculosis
RPAAAAASRSG

SEQ ID NO: 16592 - protein, 11 aa, Mycobacterium tuberculosis
PAAAAASRSGA

SEQ ID NO: 16593 - protein, 11 aa, Mycobacterium tuberculosis
AAAAASRSGAG

SEQ ID NO: 16594 - protein, 11 aa, Mycobacterium tuberculosis
AAAASRSGAGG

SEQ ID NO: 16595 - protein, 11 aa, Mycobacterium tuberculosis
AAASRSGAGGP

SEQ ID NO: 16596 - protein, 11 aa, Mycobacterium tuberculosis
AASRSGAGGPL

SEQ ID NO: 16597 - protein, 11 aa, Mycobacterium tuberculosis
ASRSGAGGPLA

SEQ ID NO: 16598 - protein, 11 aa, Mycobacterium tuberculosis
SRSGAGGPLAV

SEQ ID NO: 16599 - protein, 11 aa, Mycobacterium tuberculosis
RSGAGGPLAVS

SEQ ID NO: 16600 - protein, 11 aa, Mycobacterium tuberculosis
SGAGGPLAVSW

SEQ ID NO: 16601 - protein, 11 aa, Mycobacterium tuberculosis
GAGGPLAVSWS

SEQ ID NO: 16602 - protein, 11 aa, Mycobacterium tuberculosis
AGGPLAVSWST

SEQ ID NO: 16603 - protein, 11 aa, Mycobacterium tuberculosis
GGPLAVSWSTS

SEQ ID NO: 16604 - protein, 11 aa, Mycobacterium tuberculosis
GPLAVSWSTSA

SEQ ID NO: 16605 - protein, 11 aa, Mycobacterium tuberculosis
PLAVSWSTSAQ

SEQ ID NO: 16606 - protein, 11 aa, Mycobacterium tuberculosis
LAVSWSTSAQG

SEQ ID NO: 16607 - protein, 11 aa, Mycobacterium tuberculosis
AVSWSTSAQGM

SEQ ID NO: 16608 - protein, 11 aa, Mycobacterium tuberculosis
VSWSTSAQGMP

SEQ ID NO: 16609 - protein, 11 aa, Mycobacterium tuberculosis
SWSTSAQGMPP

SEQ ID NO: 16610 - protein, 11 aa, Mycobacterium tuberculosis
WSTSAQGMPPG

SEQ ID NO: 16611 - protein, 11 aa, Mycobacterium tuberculosis
STSAQGMPPGP

SEQ ID NO: 16612 - protein, 11 aa, Mycobacterium tuberculosis
TSAQGMPPGPP

SEQ ID NO: 16613 - protein, 11 aa, Mycobacterium tuberculosis
SAQGMPPGPPG

SEQ ID NO: 16614 - protein, 11 aa, Mycobacterium tuberculosis
AQGMPPGPPGR

SEQ ID NO: 16615 - protein, 11 aa, Mycobacterium tuberculosis
QGMPPGPPGRR

SEQ ID NO: 16616 - protein, 11 aa, Mycobacterium tuberculosis
GMPPGPPGRRA

SEQ ID NO: 16617 - protein, 11 aa, Mycobacterium tuberculosis
MPPGPPGRRAW

SEQ ID NO: 16618 - protein, 11 aa, Mycobacterium tuberculosis
PPGPPGRRAWQ

SEQ ID NO: 16619 - protein, 11 aa, Mycobacterium tuberculosis
PGPPGRRAWQA

SEQ ID NO: 16620 - protein, 11 aa, Mycobacterium tuberculosis
GPPGRRAWQAD

SEQ ID NO: 16621 - protein, 11 aa, Mycobacterium tuberculosis
PPGRRAWQADT

SEQ ID NO: 16622 - protein, 11 aa, Mycobacterium tuberculosis
PGRRAWQADTE

SEQ ID NO: 16623 - protein, 11 aa, Mycobacterium tuberculosis
GRRAWQADTES

SEQ ID NO: 16624 - protein, 11 aa, Mycobacterium tuberculosis
RRAWQADTEST

SEQ ID NO: 16625 - protein, 11 aa, Mycobacterium tuberculosis
RAWQADTESTA

SEQ ID NO: 16626 - protein, 11 aa, Mycobacterium tuberculosis
AWQADTESTAP

SEQ ID NO: 16627 - protein, 11 aa, Mycobacterium tuberculosis
WQADTESTAPS

SEQ ID NO: 16628 - protein, 11 aa, Mycobacterium tuberculosis
QADTESTAPSA

SEQ ID NO: 16629 - protein, 11 aa, Mycobacterium tuberculosis
ADTESTAPSAL

SEQ ID NO: 16630 - protein, 8 aa, Mycobacterium tuberculosis
MTVTDDYL

SEQ ID NO: 16631 - protein, 8 aa, Mycobacterium tuberculosis
TVTDDYLA

SEQ ID NO: 16632 - protein, 8 aa, Mycobacterium tuberculosis
VTDDYLAN

SEQ ID NO: 16633 - protein, 8 aa, Mycobacterium tuberculosis
TDDYLANN

SEQ ID NO: 16634 - protein, 8 aa, Mycobacterium tuberculosis
DDYLANNV

SEQ ID NO: 16635 - protein, 8 aa, Mycobacterium tuberculosis
DYLANNVD

SEQ ID NO: 16636 - protein, 8 aa, Mycobacterium tuberculosis
YLANNVDY

SEQ ID NO: 16637 - protein, 8 aa, Mycobacterium tuberculosis
LANNVDYA

SEQ ID NO: 16638 - protein, 8 aa, Mycobacterium tuberculosis
ANNVDYAS

SEQ ID NO: 16639 - protein, 8 aa, Mycobacterium tuberculosis
NNVDYASG

SEQ ID NO: 16640 - protein, 8 aa, Mycobacterium tuberculosis
NVDYASGF

SEQ ID NO: 16641 - protein, 8 aa, Mycobacterium tuberculosis
VDYASGFK

SEQ ID NO: 16642 - protein, 8 aa, Mycobacterium tuberculosis
DYASGFKG

SEQ ID NO: 16643 - protein, 8 aa, Mycobacterium tuberculosis
YASGFKGP

SEQ ID NO: 16644 - protein, 8 aa, Mycobacterium tuberculosis
ASGFKGPL

SEQ ID NO: 16645 - protein, 8 aa, Mycobacterium tuberculosis
SGFKGPLP

SEQ ID NO: 16646 - protein, 8 aa, Mycobacterium tuberculosis
GFKGPLPM

SEQ ID NO: 16647 - protein, 8 aa, Mycobacterium tuberculosis
FKGPLPMP

SEQ ID NO: 16648 - protein, 8 aa, Mycobacterium tuberculosis
KGPLPMPP

SEQ ID NO: 16649 - protein, 8 aa, Mycobacterium tuberculosis
GPLPMPPS

SEQ ID NO: 16650 - protein, 8 aa, Mycobacterium tuberculosis
PLPMPPSK

SEQ ID NO: 16651 - protein, 8 aa, Mycobacterium tuberculosis
LPMPPSKH

SEQ ID NO: 16652 - protein, 8 aa, Mycobacterium tuberculosis
PMPPSKHI

SEQ ID NO: 16653 - protein, 8 aa, Mycobacterium tuberculosis
MPPSKHIA

SEQ ID NO: 16654 - protein, 8 aa, Mycobacterium tuberculosis
PPSKHIAI

SEQ ID NO: 16655 - protein, 8 aa, Mycobacterium tuberculosis
PSKHIAIV

SEQ ID NO: 16656 - protein, 8 aa, Mycobacterium tuberculosis
SKHIAIVA

SEQ ID NO: 16657 - protein, 8 aa, Mycobacterium tuberculosis
KHIAIVAC

SEQ ID NO: 16658 - protein, 8 aa, Mycobacterium tuberculosis
HIAIVACM

SEQ ID NO: 16659 - protein, 8 aa, Mycobacterium tuberculosis
IAIVACMD

SEQ ID NO: 16660 - protein, 8 aa, Mycobacterium tuberculosis
AIVACMDA

SEQ ID NO: 16661 - protein, 8 aa, Mycobacterium tuberculosis
IVACMDAR

SEQ ID NO: 16662 - protein, 8 aa, Mycobacterium tuberculosis
VACMDARL

SEQ ID NO: 16663 - protein, 8 aa, Mycobacterium tuberculosis
ACMDARLD

SEQ ID NO: 16664 - protein, 8 aa, Mycobacterium tuberculosis
CMDARLDV

SEQ ID NO: 16665 - protein, 8 aa, Mycobacterium tuberculosis
MDARLDVY

SEQ ID NO: 16666 - protein, 8 aa, Mycobacterium tuberculosis
DARLDVYR

SEQ ID NO: 16667 - protein, 8 aa, Mycobacterium tuberculosis
ARLDVYRM

SEQ ID NO: 16668 - protein, 8 aa, Mycobacterium tuberculosis
RLDVYRML

SEQ ID NO: 16669 - protein, 8 aa, Mycobacterium tuberculosis
LDVYRMLG

SEQ ID NO: 16670 - protein, 8 aa, Mycobacterium tuberculosis
DVYRMLGI

SEQ ID NO: 16671 - protein, 8 aa, Mycobacterium tuberculosis
VYRMLGIK

SEQ ID NO: 16672 - protein, 8 aa, Mycobacterium tuberculosis
YRMLGIKE

SEQ ID NO: 16673 - protein, 8 aa, Mycobacterium tuberculosis
RMLGIKEG

SEQ ID NO: 16674 - protein, 8 aa, Mycobacterium tuberculosis
MLGIKEGE

SEQ ID NO: 16675 - protein, 8 aa, Mycobacterium tuberculosis
LGIKEGEA

SEQ ID NO: 16676 - protein, 8 aa, Mycobacterium tuberculosis
GIKEGEAH

SEQ ID NO: 16677 - protein, 8 aa, Mycobacterium tuberculosis
IKEGEAHV

SEQ ID NO: 16678 - protein, 8 aa, Mycobacterium tuberculosis
KEGEAHVI

SEQ ID NO: 16679 - protein, 8 aa, Mycobacterium tuberculosis
EGEAHVIR

SEQ ID NO: 16680 - protein, 8 aa, Mycobacterium tuberculosis
GEAHVIRN

SEQ ID NO: 16681 - protein, 8 aa, Mycobacterium tuberculosis
EAHVIRNA

SEQ ID NO: 16682 - protein, 8 aa, Mycobacterium tuberculosis
AHVIRNAG

SEQ ID NO: 16683 - protein, 8 aa, Mycobacterium tuberculosis
HVIRNAGC

SEQ ID NO: 16684 - protein, 8 aa, Mycobacterium tuberculosis
VIRNAGCV

SEQ ID NO: 16685 - protein, 8 aa, Mycobacterium tuberculosis
IRNAGCVV

SEQ ID NO: 16686 - protein, 8 aa, Mycobacterium tuberculosis
RNAGCVVT

SEQ ID NO: 16687 - protein, 8 aa, Mycobacterium tuberculosis
NAGCVVTD

SEQ ID NO: 16688 - protein, 8 aa, Mycobacterium tuberculosis
AGCVVTDD

SEQ ID NO: 16689 - protein, 8 aa, Mycobacterium tuberculosis
GCVVTDDV

SEQ ID NO: 16690 - protein, 8 aa, Mycobacterium tuberculosis
CVVTDDVI

SEQ ID NO: 16691 - protein, 8 aa, Mycobacterium tuberculosis
VVTDDVIR

SEQ ID NO: 16692 - protein, 8 aa, Mycobacterium tuberculosis
VTDDVIRS

SEQ ID NO: 16693 - protein, 8 aa, Mycobacterium tuberculosis
TDDVIRSL

SEQ ID NO: 16694 - protein, 8 aa, Mycobacterium tuberculosis
DDVIRSLA

SEQ ID NO: 16695 - protein, 8 aa, Mycobacterium tuberculosis
DVIRSLAI

SEQ ID NO: 16696 - protein, 8 aa, Mycobacterium tuberculosis
VIRSLAIS

SEQ ID NO: 16697 - protein, 8 aa, Mycobacterium tuberculosis
IRSLAISQ

SEQ ID NO: 16698 - protein, 8 aa, Mycobacterium tuberculosis
RSLAISQR

SEQ ID NO: 16699 - protein, 8 aa, Mycobacterium tuberculosis
SLAISQRL

SEQ ID NO: 16700 - protein, 8 aa, Mycobacterium tuberculosis
LAISQRLL

SEQ ID NO: 16701 - protein, 8 aa, Mycobacterium tuberculosis
AISQRLLG

SEQ ID NO: 16702 - protein, 8 aa, Mycobacterium tuberculosis
ISQRLLGT

SEQ ID NO: 16703 - protein, 8 aa, Mycobacterium tuberculosis
SQRLLGTR

SEQ ID NO: 16704 - protein, 8 aa, Mycobacterium tuberculosis
QRLLGTRE

SEQ ID NO: 16705 - protein, 8 aa, Mycobacterium tuberculosis
RLLGTREI

SEQ ID NO: 16706 - protein, 8 aa, Mycobacterium tuberculosis
LLGTREII

SEQ ID NO: 16707 - protein, 8 aa, Mycobacterium tuberculosis
LGTREIIL

SEQ ID NO: 16708 - protein, 8 aa, Mycobacterium tuberculosis
GTREIILL

SEQ ID NO: 16709 - protein, 8 aa, Mycobacterium tuberculosis
TREIILLH

SEQ ID NO: 16710 - protein, 8 aa, Mycobacterium tuberculosis
REIILLHH

SEQ ID NO: 16711 - protein, 8 aa, Mycobacterium tuberculosis
EIILLHHT

SEQ ID NO: 16712 - protein, 8 aa, Mycobacterium tuberculosis
IILLHHTD

SEQ ID NO: 16713 - protein, 8 aa, Mycobacterium tuberculosis
ILLHHTDC

SEQ ID NO: 16714 - protein, 8 aa, Mycobacterium tuberculosis
LLHHTDCG

SEQ ID NO: 16715 - protein, 8 aa, Mycobacterium tuberculosis
LHHTDCGM

SEQ ID NO: 16716 - protein, 8 aa, Mycobacterium tuberculosis
HHTDCGML

SEQ ID NO: 16717 - protein, 8 aa, Mycobacterium tuberculosis
HTDCGMLT

SEQ ID NO: 16718 - protein, 8 aa, Mycobacterium tuberculosis
TDCGMLTF

SEQ ID NO: 16719 - protein, 8 aa, Mycobacterium tuberculosis
DCGMLTFT

SEQ ID NO: 16720 - protein, 8 aa, Mycobacterium tuberculosis
CGMLTFTD

SEQ ID NO: 16721 - protein, 8 aa, Mycobacterium tuberculosis
GMLTFTDD

SEQ ID NO: 16722 - protein, 8 aa, Mycobacterium tuberculosis
MLTFTDDD

SEQ ID NO: 16723 - protein, 8 aa, Mycobacterium tuberculosis
LTFTDDDF

SEQ ID NO: 16724 - protein, 8 aa, Mycobacterium tuberculosis
TFTDDDFK

SEQ ID NO: 16725 - protein, 8 aa, Mycobacterium tuberculosis
FTDDDFKR

SEQ ID NO: 16726 - protein, 8 aa, Mycobacterium tuberculosis
TDDDFKRA

SEQ ID NO: 16727 - protein, 8 aa, Mycobacterium tuberculosis
DDDFKRAI

SEQ ID NO: 16728 - protein, 8 aa, Mycobacterium tuberculosis
DDFKRAIQ

SEQ ID NO: 16729 - protein, 8 aa, Mycobacterium tuberculosis
DFKRAIQD

SEQ ID NO: 16730 - protein, 8 aa, Mycobacterium tuberculosis
FKRAIQDE

SEQ ID NO: 16731 - protein, 8 aa, Mycobacterium tuberculosis
KRAIQDET

SEQ ID NO: 16732 - protein, 8 aa, Mycobacterium tuberculosis
RAIQDETG

SEQ ID NO: 16733 - protein, 8 aa, Mycobacterium tuberculosis
AIQDETGI

SEQ ID NO: 16734 - protein, 8 aa, Mycobacterium tuberculosis
IQDETGIR

SEQ ID NO: 16735 - protein, 8 aa, Mycobacterium tuberculosis
QDETGIRP

SEQ ID NO: 16736 - protein, 8 aa, Mycobacterium tuberculosis
DETGIRPT

SEQ ID NO: 16737 - protein, 8 aa, Mycobacterium tuberculosis
ETGIRPTW

SEQ ID NO: 16738 - protein, 8 aa, Mycobacterium tuberculosis
TGIRPTWS

SEQ ID NO: 16739 - protein, 8 aa, Mycobacterium tuberculosis
GIRPTWSP

SEQ ID NO: 16740 - protein, 8 aa, Mycobacterium tuberculosis
IRPTWSPE

SEQ ID NO: 16741 - protein, 8 aa, Mycobacterium tuberculosis
RPTWSPES

SEQ ID NO: 16742 - protein, 8 aa, Mycobacterium tuberculosis
PTWSPESY

SEQ ID NO: 16743 - protein, 8 aa, Mycobacterium tuberculosis
TWSPESYP

SEQ ID NO: 16744 - protein, 8 aa, Mycobacterium tuberculosis
WSPESYPD

SEQ ID NO: 16745 - protein, 8 aa, Mycobacterium tuberculosis
SPESYPDA

SEQ ID NO: 16746 - protein, 8 aa, Mycobacterium tuberculosis
PESYPDAV

SEQ ID NO: 16747 - protein, 8 aa, Mycobacterium tuberculosis
ESYPDAVE

SEQ ID NO: 16748 - protein, 8 aa, Mycobacterium tuberculosis
SYPDAVED

SEQ ID NO: 16749 - protein, 8 aa, Mycobacterium tuberculosis
YPDAVEDV

SEQ ID NO: 16750 - protein, 8 aa, Mycobacterium tuberculosis
PDAVEDVR

SEQ ID NO: 16751 - protein, 8 aa, Mycobacterium tuberculosis
DAVEDVRQ

SEQ ID NO: 16752 - protein, 8 aa, Mycobacterium tuberculosis
AVEDVRQS

SEQ ID NO: 16753 - protein, 8 aa, Mycobacterium tuberculosis
VEDVRQSL

SEQ ID NO: 16754 - protein, 8 aa, Mycobacterium tuberculosis
EDVRQSLR

SEQ ID NO: 16755 - protein, 8 aa, Mycobacterium tuberculosis
DVRQSLRR

SEQ ID NO: 16756 - protein, 8 aa, Mycobacterium tuberculosis
VRQSLRRI

SEQ ID NO: 16757 - protein, 8 aa, Mycobacterium tuberculosis
RQSLRRIE

SEQ ID NO: 16758 - protein, 8 aa, Mycobacterium tuberculosis
QSLRRIEV

SEQ ID NO: 16759 - protein, 8 aa, Mycobacterium tuberculosis
SLRRIEVN

SEQ ID NO: 16760 - protein, 8 aa, Mycobacterium tuberculosis
LRRIEVNP

SEQ ID NO: 16761 - protein, 8 aa, Mycobacterium tuberculosis
RRIEVNPF

SEQ ID NO: 16762 - protein, 8 aa, Mycobacterium tuberculosis
RIEVNPFV

SEQ ID NO: 16763 - protein, 8 aa, Mycobacterium tuberculosis
IEVNPFVT

SEQ ID NO: 16764 - protein, 8 aa, Mycobacterium tuberculosis
EVNPFVTK

SEQ ID NO: 16765 - protein, 8 aa, Mycobacterium tuberculosis
VNPFVTKH

SEQ ID NO: 16766 - protein, 8 aa, Mycobacterium tuberculosis
NPFVTKHT

SEQ ID NO: 16767 - protein, 8 aa, Mycobacterium tuberculosis
PFVTKHTS

SEQ ID NO: 16768 - protein, 8 aa, Mycobacterium tuberculosis
FVTKHTSL

SEQ ID NO: 16769 - protein, 8 aa, Mycobacterium tuberculosis
VTKHTSLR

SEQ ID NO: 16770 - protein, 8 aa, Mycobacterium tuberculosis
TKHTSLRG

SEQ ID NO: 16771 - protein, 8 aa, Mycobacterium tuberculosis
KHTSLRGF

SEQ ID NO: 16772 - protein, 8 aa, Mycobacterium tuberculosis
HTSLRGFV

SEQ ID NO: 16773 - protein, 8 aa, Mycobacterium tuberculosis
TSLRGFVF

SEQ ID NO: 16774 - protein, 8 aa, Mycobacterium tuberculosis
SLRGFVFD

SEQ ID NO: 16775 - protein, 8 aa, Mycobacterium tuberculosis
LRGFVFDV

SEQ ID NO: 16776 - protein, 8 aa, Mycobacterium tuberculosis
RGFVFDVA

SEQ ID NO: 16777 - protein, 8 aa, Mycobacterium tuberculosis
GFVFDVAT

SEQ ID NO: 16778 - protein, 8 aa, Mycobacterium tuberculosis
FVFDVATG

SEQ ID NO: 16779 - protein, 8 aa, Mycobacterium tuberculosis
VFDVATGK

SEQ ID NO: 16780 - protein, 8 aa, Mycobacterium tuberculosis
FDVATGKL

SEQ ID NO: 16781 - protein, 8 aa, Mycobacterium tuberculosis
DVATGKLN

SEQ ID NO: 16782 - protein, 8 aa, Mycobacterium tuberculosis
VATGKLNE

SEQ ID NO: 16783 - protein, 8 aa, Mycobacterium tuberculosis
ATGKLNEV

SEQ ID NO: 16784 - protein, 8 aa, Mycobacterium tuberculosis
TGKLNEVT

SEQ ID NO: 16785 - protein, 8 aa, Mycobacterium tuberculosis
GKLNEVTP

SEQ ID NO: 16786 - protein, 9 aa, Mycobacterium tuberculosis
MTVTDDYLA

SEQ ID NO: 16787 - protein, 9 aa, Mycobacterium tuberculosis
TVTDDYLAN

SEQ ID NO: 16788 - protein, 9 aa, Mycobacterium tuberculosis
VTDDYLANN

SEQ ID NO: 16789 - protein, 9 aa, Mycobacterium tuberculosis
TDDYLANNV

SEQ ID NO: 16790 - protein, 9 aa, Mycobacterium tuberculosis
DDYLANNVD

SEQ ID NO: 16791 - protein, 9 aa, Mycobacterium tuberculosis
DYLANNVDY

SEQ ID NO: 16792 - protein, 9 aa, Mycobacterium tuberculosis
YLANNVDYA

SEQ ID NO: 16793 - protein, 9 aa, Mycobacterium tuberculosis
LANNVDYAS

SEQ ID NO: 16794 - protein, 9 aa, Mycobacterium tuberculosis
ANNVDYASG

SEQ ID NO: 16795 - protein, 9 aa, Mycobacterium tuberculosis
NNVDYASGF

SEQ ID NO: 16796 - protein, 9 aa, Mycobacterium tuberculosis
NVDYASGFK

SEQ ID NO: 16797 - protein, 9 aa, Mycobacterium tuberculosis
VDYASGFKG

SEQ ID NO: 16798 - protein, 9 aa, Mycobacterium tuberculosis
DYASGFKGP

SEQ ID NO: 16799 - protein, 9 aa, Mycobacterium tuberculosis
YASGFKGPL

SEQ ID NO: 16800 - protein, 9 aa, Mycobacterium tuberculosis
ASGFKGPLP

SEQ ID NO: 16801 - protein, 9 aa, Mycobacterium tuberculosis
SGFKGPLPM

SEQ ID NO: 16802 - protein, 9 aa, Mycobacterium tuberculosis
GFKGPLPMP

SEQ ID NO: 16803 - protein, 9 aa, Mycobacterium tuberculosis
FKGPLPMPP

SEQ ID NO: 16804 - protein, 9 aa, Mycobacterium tuberculosis
KGPLPMPPS

SEQ ID NO: 16805 - protein, 9 aa, Mycobacterium tuberculosis
GPLPMPPSK

SEQ ID NO: 16806 - protein, 9 aa, Mycobacterium tuberculosis
PLPMPPSKH

SEQ ID NO: 16807 - protein, 9 aa, Mycobacterium tuberculosis
LPMPPSKHI

SEQ ID NO: 16808 - protein, 9 aa, Mycobacterium tuberculosis
PMPPSKHIA

SEQ ID NO: 16809 - protein, 9 aa, Mycobacterium tuberculosis
MPPSKHIAI

SEQ ID NO: 16810 - protein, 9 aa, Mycobacterium tuberculosis
PPSKHIAIV

SEQ ID NO: 16811 - protein, 9 aa, Mycobacterium tuberculosis
PSKHIAIVA

SEQ ID NO: 16812 - protein, 9 aa, Mycobacterium tuberculosis
SKHIAIVAC

SEQ ID NO: 16813 - protein, 9 aa, Mycobacterium tuberculosis
KHIAIVACM

SEQ ID NO: 16814 - protein, 9 aa, Mycobacterium tuberculosis
HIAIVACMD

SEQ ID NO: 16815 - protein, 9 aa, Mycobacterium tuberculosis
IAIVACMDA

SEQ ID NO: 16816 - protein, 9 aa, Mycobacterium tuberculosis
AIVACMDAR

SEQ ID NO: 16817 - protein, 9 aa, Mycobacterium tuberculosis
IVACMDARL

SEQ ID NO: 16818 - protein, 9 aa, Mycobacterium tuberculosis
VACMDARLD

SEQ ID NO: 16819 - protein, 9 aa, Mycobacterium tuberculosis
ACMDARLDV

SEQ ID NO: 16820 - protein, 9 aa, Mycobacterium tuberculosis
CMDARLDVY

SEQ ID NO: 16821 - protein, 9 aa, Mycobacterium tuberculosis
MDARLDVYR

SEQ ID NO: 16822 - protein, 9 aa, Mycobacterium tuberculosis
DARLDVYRM

SEQ ID NO: 16823 - protein, 9 aa, Mycobacterium tuberculosis
ARLDVYRML

SEQ ID NO: 16824 - protein, 9 aa, Mycobacterium tuberculosis
RLDVYRMLG

SEQ ID NO: 16825 - protein, 9 aa, Mycobacterium tuberculosis
LDVYRMLGI

SEQ ID NO: 16826 - protein, 9 aa, Mycobacterium tuberculosis
DVYRMLGIK

SEQ ID NO: 16827 - protein, 9 aa, Mycobacterium tuberculosis
VYRMLGIKE

SEQ ID NO: 16828 - protein, 9 aa, Mycobacterium tuberculosis
YRMLGIKEG

SEQ ID NO: 16829 - protein, 9 aa, Mycobacterium tuberculosis
RMLGIKEGE

SEQ ID NO: 16830 - protein, 9 aa, Mycobacterium tuberculosis
MLGIKEGEA

SEQ ID NO: 16831 - protein, 9 aa, Mycobacterium tuberculosis
LGIKEGEAH

SEQ ID NO: 16832 - protein, 9 aa, Mycobacterium tuberculosis
GIKEGEAHV

SEQ ID NO: 16833 - protein, 9 aa, Mycobacterium tuberculosis
IKEGEAHVI

SEQ ID NO: 16834 - protein, 9 aa, Mycobacterium tuberculosis
KEGEAHVIR

SEQ ID NO: 16835 - protein, 9 aa, Mycobacterium tuberculosis
EGEAHVIRN

SEQ ID NO: 16836 - protein, 9 aa, Mycobacterium tuberculosis
GEAHVIRNA

SEQ ID NO: 16837 - protein, 9 aa, Mycobacterium tuberculosis
EAHVIRNAG

SEQ ID NO: 16838 - protein, 9 aa, Mycobacterium tuberculosis
AHVIRNAGC

SEQ ID NO: 16839 - protein, 9 aa, Mycobacterium tuberculosis
HVIRNAGCV

SEQ ID NO: 16840 - protein, 9 aa, Mycobacterium tuberculosis
VIRNAGCVV

SEQ ID NO: 16841 - protein, 9 aa, Mycobacterium tuberculosis
IRNAGCVVT

SEQ ID NO: 16842 - protein, 9 aa, Mycobacterium tuberculosis
RNAGCVVTD

SEQ ID NO: 16843 - protein, 9 aa, Mycobacterium tuberculosis
NAGCVVTDD

SEQ ID NO: 16844 - protein, 9 aa, Mycobacterium tuberculosis
AGCVVTDDV

SEQ ID NO: 16845 - protein, 9 aa, Mycobacterium tuberculosis
GCVVTDDVI

SEQ ID NO: 16846 - protein, 9 aa, Mycobacterium tuberculosis
CVVTDDVIR

SEQ ID NO: 16847 - protein, 9 aa, Mycobacterium tuberculosis
VVTDDVIRS

SEQ ID NO: 16848 - protein, 9 aa, Mycobacterium tuberculosis
VTDDVIRSL

SEQ ID NO: 16849 - protein, 9 aa, Mycobacterium tuberculosis
TDDVIRSLA

SEQ ID NO: 16850 - protein, 9 aa, Mycobacterium tuberculosis
DDVIRSLAI

SEQ ID NO: 16851 - protein, 9 aa, Mycobacterium tuberculosis
DVIRSLAIS

SEQ ID NO: 16852 - protein, 9 aa, Mycobacterium tuberculosis
VIRSLAISQ

SEQ ID NO: 16853 - protein, 9 aa, Mycobacterium tuberculosis
IRSLAISQR

SEQ ID NO: 16854 - protein, 9 aa, Mycobacterium tuberculosis
RSLAISQRL

SEQ ID NO: 16855 - protein, 9 aa, Mycobacterium tuberculosis
SLAISQRLL

SEQ ID NO: 16856 - protein, 9 aa, Mycobacterium tuberculosis
LAISQRLLG

SEQ ID NO: 16857 - protein, 9 aa, Mycobacterium tuberculosis
AISQRLLGT

SEQ ID NO: 16858 - protein, 9 aa, Mycobacterium tuberculosis
ISQRLLGTR

SEQ ID NO: 16859 - protein, 9 aa, Mycobacterium tuberculosis
SQRLLGTRE

SEQ ID NO: 16860 - protein, 9 aa, Mycobacterium tuberculosis
QRLLGTREI

SEQ ID NO: 16861 - protein, 9 aa, Mycobacterium tuberculosis
RLLGTREII

SEQ ID NO: 16862 - protein, 9 aa, Mycobacterium tuberculosis
LLGTREIIL

SEQ ID NO: 16863 - protein, 9 aa, Mycobacterium tuberculosis
LGTREIILL

SEQ ID NO: 16864 - protein, 9 aa, Mycobacterium tuberculosis
GTREIILLH

SEQ ID NO: 16865 - protein, 9 aa, Mycobacterium tuberculosis
TREIILLHH

SEQ ID NO: 16866 - protein, 9 aa, Mycobacterium tuberculosis
REIILLHHT

SEQ ID NO: 16867 - protein, 9 aa, Mycobacterium tuberculosis
EIILLHHTD

SEQ ID NO: 16868 - protein, 9 aa, Mycobacterium tuberculosis
IILLHHTDC

SEQ ID NO: 16869 - protein, 9 aa, Mycobacterium tuberculosis
ILLHHTDCG

SEQ ID NO: 16870 - protein, 9 aa, Mycobacterium tuberculosis
LLHHTDCGM

SEQ ID NO: 16871 - protein, 9 aa, Mycobacterium tuberculosis
LHHTDCGML

SEQ ID NO: 16872 - protein, 9 aa, Mycobacterium tuberculosis
HHTDCGMLT

SEQ ID NO: 16873 - protein, 9 aa, Mycobacterium tuberculosis
HTDCGMLTF

SEQ ID NO: 16874 - protein, 9 aa, Mycobacterium tuberculosis
TDCGMLTFT

SEQ ID NO: 16875 - protein, 9 aa, Mycobacterium tuberculosis
DCGMLTFTD

SEQ ID NO: 16876 - protein, 9 aa, Mycobacterium tuberculosis
CGMLTFTDD

SEQ ID NO: 16877 - protein, 9 aa, Mycobacterium tuberculosis
GMLTFTDDD

SEQ ID NO: 16878 - protein, 9 aa, Mycobacterium tuberculosis
MLTFTDDDF

SEQ ID NO: 16879 - protein, 9 aa, Mycobacterium tuberculosis
LTFTDDDFK

SEQ ID NO: 16880 - protein, 9 aa, Mycobacterium tuberculosis
TFTDDDFKR

SEQ ID NO: 16881 - protein, 9 aa, Mycobacterium tuberculosis
FTDDDFKRA

SEQ ID NO: 16882 - protein, 9 aa, Mycobacterium tuberculosis
TDDDFKRAI

SEQ ID NO: 16883 - protein, 9 aa, Mycobacterium tuberculosis
DDDFKRAIQ

SEQ ID NO: 16884 - protein, 9 aa, Mycobacterium tuberculosis
DDFKRAIQD

SEQ ID NO: 16885 - protein, 9 aa, Mycobacterium tuberculosis
DFKRAIQDE

SEQ ID NO: 16886 - protein, 9 aa, Mycobacterium tuberculosis
FKRAIQDET

SEQ ID NO: 16887 - protein, 9 aa, Mycobacterium tuberculosis
KRAIQDETG

SEQ ID NO: 16888 - protein, 9 aa, Mycobacterium tuberculosis
RAIQDETGI

SEQ ID NO: 16889 - protein, 9 aa, Mycobacterium tuberculosis
AIQDETGIR

SEQ ID NO: 16890 - protein, 9 aa, Mycobacterium tuberculosis
IQDETGIRP

SEQ ID NO: 16891 - protein, 9 aa, Mycobacterium tuberculosis
QDETGIRPT

SEQ ID NO: 16892 - protein, 9 aa, Mycobacterium tuberculosis
DETGIRPTW

SEQ ID NO: 16893 - protein, 9 aa, Mycobacterium tuberculosis
ETGIRPTWS

SEQ ID NO: 16894 - protein, 9 aa, Mycobacterium tuberculosis
TGIRPTWSP

SEQ ID NO: 16895 - protein, 9 aa, Mycobacterium tuberculosis
GIRPTWSPE

SEQ ID NO: 16896 - protein, 9 aa, Mycobacterium tuberculosis
IRPTWSPES

SEQ ID NO: 16897 - protein, 9 aa, Mycobacterium tuberculosis
RPTWSPESY

SEQ ID NO: 16898 - protein, 9 aa, Mycobacterium tuberculosis
PTWSPESYP

SEQ ID NO: 16899 - protein, 9 aa, Mycobacterium tuberculosis
TWSPESYPD

SEQ ID NO: 16900 - protein, 9 aa, Mycobacterium tuberculosis
WSPESYPDA

SEQ ID NO: 16901 - protein, 9 aa, Mycobacterium tuberculosis
SPESYPDAV

SEQ ID NO: 16902 - protein, 9 aa, Mycobacterium tuberculosis
PESYPDAVE

SEQ ID NO: 16903 - protein, 9 aa, Mycobacterium tuberculosis
ESYPDAVED

SEQ ID NO: 16904 - protein, 9 aa, Mycobacterium tuberculosis
SYPDAVEDV

SEQ ID NO: 16905 - protein, 9 aa, Mycobacterium tuberculosis
YPDAVEDVR

SEQ ID NO: 16906 - protein, 9 aa, Mycobacterium tuberculosis
PDAVEDVRQ

SEQ ID NO: 16907 - protein, 9 aa, Mycobacterium tuberculosis
DAVEDVRQS

SEQ ID NO: 16908 - protein, 9 aa, Mycobacterium tuberculosis
AVEDVRQSL

SEQ ID NO: 16909 - protein, 9 aa, Mycobacterium tuberculosis
VEDVRQSLR

SEQ ID NO: 16910 - protein, 9 aa, Mycobacterium tuberculosis
EDVRQSLRR

SEQ ID NO: 16911 - protein, 9 aa, Mycobacterium tuberculosis
DVRQSLRRI

SEQ ID NO: 16912 - protein, 9 aa, Mycobacterium tuberculosis
VRQSLRRIE

SEQ ID NO: 16913 - protein, 9 aa, Mycobacterium tuberculosis
RQSLRRIEV

SEQ ID NO: 16914 - protein, 9 aa, Mycobacterium tuberculosis
QSLRRIEVN

SEQ ID NO: 16915 - protein, 9 aa, Mycobacterium tuberculosis
SLRRIEVNP

SEQ ID NO: 16916 - protein, 9 aa, Mycobacterium tuberculosis
LRRIEVNPF

SEQ ID NO: 16917 - protein, 9 aa, Mycobacterium tuberculosis
RRIEVNPFV

SEQ ID NO: 16918 - protein, 9 aa, Mycobacterium tuberculosis
RIEVNPFVT

SEQ ID NO: 16919 - protein, 9 aa, Mycobacterium tuberculosis
IEVNPFVTK

SEQ ID NO: 16920 - protein, 9 aa, Mycobacterium tuberculosis
EVNPFVTKH

SEQ ID NO: 16921 - protein, 9 aa, Mycobacterium tuberculosis
VNPFVTKHT

SEQ ID NO: 16922 - protein, 9 aa, Mycobacterium tuberculosis
NPFVTKHTS

SEQ ID NO: 16923 - protein, 9 aa, Mycobacterium tuberculosis
PFVTKHTSL

SEQ ID NO: 16924 - protein, 9 aa, Mycobacterium tuberculosis
FVTKHTSLR

SEQ ID NO: 16925 - protein, 9 aa, Mycobacterium tuberculosis
VTKHTSLRG

SEQ ID NO: 16926 - protein, 9 aa, Mycobacterium tuberculosis
TKHTSLRGF

SEQ ID NO: 16927 - protein, 9 aa, Mycobacterium tuberculosis
KHTSLRGFV

SEQ ID NO: 16928 - protein, 9 aa, Mycobacterium tuberculosis
HTSLRGFVF

SEQ ID NO: 16929 - protein, 9 aa, Mycobacterium tuberculosis
TSLRGFVFD

SEQ ID NO: 16930 - protein, 9 aa, Mycobacterium tuberculosis
SLRGFVFDV

SEQ ID NO: 16931 - protein, 9 aa, Mycobacterium tuberculosis
LRGFVFDVA

SEQ ID NO: 16932 - protein, 9 aa, Mycobacterium tuberculosis
RGFVFDVAT

SEQ ID NO: 16933 - protein, 9 aa, Mycobacterium tuberculosis
GFVFDVATG

SEQ ID NO: 16934 - protein, 9 aa, Mycobacterium tuberculosis
FVFDVATGK

SEQ ID NO: 16935 - protein, 9 aa, Mycobacterium tuberculosis
VFDVATGKL

SEQ ID NO: 16936 - protein, 9 aa, Mycobacterium tuberculosis
FDVATGKLN

SEQ ID NO: 16937 - protein, 9 aa, Mycobacterium tuberculosis
DVATGKLNE

SEQ ID NO: 16938 - protein, 9 aa, Mycobacterium tuberculosis
VATGKLNEV

SEQ ID NO: 16939 - protein, 9 aa, Mycobacterium tuberculosis
ATGKLNEVT

SEQ ID NO: 16940 - protein, 9 aa, Mycobacterium tuberculosis
TGKLNEVTP

SEQ ID NO: 16941 - protein, 10 aa, Mycobacterium tuberculosis
MTVTDDYLAN

SEQ ID NO: 16942 - protein, 10 aa, Mycobacterium tuberculosis
TVTDDYLANN

SEQ ID NO: 16943 - protein, 10 aa, Mycobacterium tuberculosis
VTDDYLANNV

SEQ ID NO: 16944 - protein, 10 aa, Mycobacterium tuberculosis
TDDYLANNVD

SEQ ID NO: 16945 - protein, 10 aa, Mycobacterium tuberculosis
DDYLANNVDY

SEQ ID NO: 16946 - protein, 10 aa, Mycobacterium tuberculosis
DYLANNVDYA

SEQ ID NO: 16947 - protein, 10 aa, Mycobacterium tuberculosis
YLANNVDYAS

SEQ ID NO: 16948 - protein, 10 aa, Mycobacterium tuberculosis
LANNVDYASG

SEQ ID NO: 16949 - protein, 10 aa, Mycobacterium tuberculosis
ANNVDYASGF

SEQ ID NO: 16950 - protein, 10 aa, Mycobacterium tuberculosis
NNVDYASGFK

SEQ ID NO: 16951 - protein, 10 aa, Mycobacterium tuberculosis
NVDYASGFKG

SEQ ID NO: 16952 - protein, 10 aa, Mycobacterium tuberculosis
VDYASGFKGP

SEQ ID NO: 16953 - protein, 10 aa, Mycobacterium tuberculosis
DYASGFKGPL

SEQ ID NO: 16954 - protein, 10 aa, Mycobacterium tuberculosis
YASGFKGPLP

SEQ ID NO: 16955 - protein, 10 aa, Mycobacterium tuberculosis
ASGFKGPLPM

SEQ ID NO: 16956 - protein, 10 aa, Mycobacterium tuberculosis
SGFKGPLPMP

SEQ ID NO: 16957 - protein, 10 aa, Mycobacterium tuberculosis
GFKGPLPMPP

SEQ ID NO: 16958 - protein, 10 aa, Mycobacterium tuberculosis
FKGPLPMPPS

SEQ ID NO: 16959 - protein, 10 aa, Mycobacterium tuberculosis
KGPLPMPPSK

SEQ ID NO: 16960 - protein, 10 aa, Mycobacterium tuberculosis
GPLPMPPSKH

SEQ ID NO: 16961 - protein, 10 aa, Mycobacterium tuberculosis
PLPMPPSKHI

SEQ ID NO: 16962 - protein, 10 aa, Mycobacterium tuberculosis
LPMPPSKHIA

SEQ ID NO: 16963 - protein, 10 aa, Mycobacterium tuberculosis
PMPPSKHIAI

SEQ ID NO: 16964 - protein, 10 aa, Mycobacterium tuberculosis
MPPSKHIAIV

SEQ ID NO: 16965 - protein, 10 aa, Mycobacterium tuberculosis
PPSKHIAIVA

SEQ ID NO: 16966 - protein, 10 aa, Mycobacterium tuberculosis
PSKHIAIVAC

SEQ ID NO: 16967 - protein, 10 aa, Mycobacterium tuberculosis
SKHIAIVACM

SEQ ID NO: 16968 - protein, 10 aa, Mycobacterium tuberculosis
KHIAIVACMD

SEQ ID NO: 16969 - protein, 10 aa, Mycobacterium tuberculosis
HIAIVACMDA

SEQ ID NO: 16970 - protein, 10 aa, Mycobacterium tuberculosis
IAIVACMDAR

SEQ ID NO: 16971 - protein, 10 aa, Mycobacterium tuberculosis
AIVACMDARL

SEQ ID NO: 16972 - protein, 10 aa, Mycobacterium tuberculosis
IVACMDARLD

SEQ ID NO: 16973 - protein, 10 aa, Mycobacterium tuberculosis
VACMDARLDV

SEQ ID NO: 16974 - protein, 10 aa, Mycobacterium tuberculosis
ACMDARLDVY

SEQ ID NO: 16975 - protein, 10 aa, Mycobacterium tuberculosis
CMDARLDVYR

SEQ ID NO: 16976 - protein, 10 aa, Mycobacterium tuberculosis
MDARLDVYRM

SEQ ID NO: 16977 - protein, 10 aa, Mycobacterium tuberculosis
DARLDVYRML

SEQ ID NO: 16978 - protein, 10 aa, Mycobacterium tuberculosis
ARLDVYRMLG

SEQ ID NO: 16979 - protein, 10 aa, Mycobacterium tuberculosis
RLDVYRMLGI

SEQ ID NO: 16980 - protein, 10 aa, Mycobacterium tuberculosis
LDVYRMLGIK

SEQ ID NO: 16981 - protein, 10 aa, Mycobacterium tuberculosis
DVYRMLGIKE

SEQ ID NO: 16982 - protein, 10 aa, Mycobacterium tuberculosis
VYRMLGIKEG

SEQ ID NO: 16983 - protein, 10 aa, Mycobacterium tuberculosis
YRMLGIKEGE

SEQ ID NO: 16984 - protein, 10 aa, Mycobacterium tuberculosis
RMLGIKEGEA

SEQ ID NO: 16985 - protein, 10 aa, Mycobacterium tuberculosis
MLGIKEGEAH

SEQ ID NO: 16986 - protein, 10 aa, Mycobacterium tuberculosis
LGIKEGEAHV

SEQ ID NO: 16987 - protein, 10 aa, Mycobacterium tuberculosis
GIKEGEAHVI

SEQ ID NO: 16988 - protein, 10 aa, Mycobacterium tuberculosis
IKEGEAHVIR

SEQ ID NO: 16989 - protein, 10 aa, Mycobacterium tuberculosis
KEGEAHVIRN

SEQ ID NO: 16990 - protein, 10 aa, Mycobacterium tuberculosis
EGEAHVIRNA

SEQ ID NO: 16991 - protein, 10 aa, Mycobacterium tuberculosis
GEAHVIRNAG

SEQ ID NO: 16992 - protein, 10 aa, Mycobacterium tuberculosis
EAHVIRNAGC

SEQ ID NO: 16993 - protein, 10 aa, Mycobacterium tuberculosis
AHVIRNAGCV

SEQ ID NO: 16994 - protein, 10 aa, Mycobacterium tuberculosis
HVIRNAGCVV

SEQ ID NO: 16995 - protein, 10 aa, Mycobacterium tuberculosis
VIRNAGCVVT

SEQ ID NO: 16996 - protein, 10 aa, Mycobacterium tuberculosis
IRNAGCVVTD

SEQ ID NO: 16997 - protein, 10 aa, Mycobacterium tuberculosis
RNAGCVVTDD

SEQ ID NO: 16998 - protein, 10 aa, Mycobacterium tuberculosis
NAGCVVTDDV

SEQ ID NO: 16999 - protein, 10 aa, Mycobacterium tuberculosis
AGCVVTDDVI

SEQ ID NO: 17000 - protein, 10 aa, Mycobacterium tuberculosis
GCVVTDDVIR

SEQ ID NO: 17001 - protein, 10 aa, Mycobacterium tuberculosis
CVVTDDVIRS

SEQ ID NO: 17002 - protein, 10 aa, Mycobacterium tuberculosis
VVTDDVIRSL

SEQ ID NO: 17003 - protein, 10 aa, Mycobacterium tuberculosis
VTDDVIRSLA

SEQ ID NO: 17004 - protein, 10 aa, Mycobacterium tuberculosis
TDDVIRSLAI

SEQ ID NO: 17005 - protein, 10 aa, Mycobacterium tuberculosis
DDVIRSLAIS

SEQ ID NO: 17006 - protein, 10 aa, Mycobacterium tuberculosis
DVIRSLAISQ

SEQ ID NO: 17007 - protein, 10 aa, Mycobacterium tuberculosis
VIRSLAISQR

SEQ ID NO: 17008 - protein, 10 aa, Mycobacterium tuberculosis
IRSLAISQRL

SEQ ID NO: 17009 - protein, 10 aa, Mycobacterium tuberculosis
RSLAISQRLL

SEQ ID NO: 17010 - protein, 10 aa, Mycobacterium tuberculosis
SLAISQRLLG

SEQ ID NO: 17011 - protein, 10 aa, Mycobacterium tuberculosis
LAISQRLLGT

SEQ ID NO: 17012 - protein, 10 aa, Mycobacterium tuberculosis
AISQRLLGTR

SEQ ID NO: 17013 - protein, 10 aa, Mycobacterium tuberculosis
ISQRLLGTRE

SEQ ID NO: 17014 - protein, 10 aa, Mycobacterium tuberculosis
SQRLLGTREI

SEQ ID NO: 17015 - protein, 10 aa, Mycobacterium tuberculosis
QRLLGTREII

SEQ ID NO: 17016 - protein, 10 aa, Mycobacterium tuberculosis
RLLGTREIIL

SEQ ID NO: 17017 - protein, 10 aa, Mycobacterium tuberculosis
LLGTREIILL

SEQ ID NO: 17018 - protein, 10 aa, Mycobacterium tuberculosis
LGTREIILLH

SEQ ID NO: 17019 - protein, 10 aa, Mycobacterium tuberculosis
GTREIILLHH

SEQ ID NO: 17020 - protein, 10 aa, Mycobacterium tuberculosis
TREIILLHHT

SEQ ID NO: 17021 - protein, 10 aa, Mycobacterium tuberculosis
REIILLHHTD

SEQ ID NO: 17022 - protein, 10 aa, Mycobacterium tuberculosis
EIILLHHTDC

SEQ ID NO: 17023 - protein, 10 aa, Mycobacterium tuberculosis
IILLHHTDCG

SEQ ID NO: 17024 - protein, 10 aa, Mycobacterium tuberculosis
ILLHHTDCGM

SEQ ID NO: 17025 - protein, 10 aa, Mycobacterium tuberculosis
LLHHTDCGML

SEQ ID NO: 17026 - protein, 10 aa, Mycobacterium tuberculosis
LHHTDCGMLT

SEQ ID NO: 17027 - protein, 10 aa, Mycobacterium tuberculosis
HHTDCGMLTF

SEQ ID NO: 17028 - protein, 10 aa, Mycobacterium tuberculosis
HTDCGMLTFT

SEQ ID NO: 17029 - protein, 10 aa, Mycobacterium tuberculosis
TDCGMLTFTD

SEQ ID NO: 17030 - protein, 10 aa, Mycobacterium tuberculosis
DCGMLTFTDD

SEQ ID NO: 17031 - protein, 10 aa, Mycobacterium tuberculosis
CGMLTFTDDD

SEQ ID NO: 17032 - protein, 10 aa, Mycobacterium tuberculosis
GMLTFTDDDF

SEQ ID NO: 17033 - protein, 10 aa, Mycobacterium tuberculosis
MLTFTDDDFK

SEQ ID NO: 17034 - protein, 10 aa, Mycobacterium tuberculosis
LTFTDDDFKR

SEQ ID NO: 17035 - protein, 10 aa, Mycobacterium tuberculosis
TFTDDDFKRA

SEQ ID NO: 17036 - protein, 10 aa, Mycobacterium tuberculosis
FTDDDFKRAI

SEQ ID NO: 17037 - protein, 10 aa, Mycobacterium tuberculosis
TDDDFKRAIQ

SEQ ID NO: 17038 - protein, 10 aa, Mycobacterium tuberculosis
DDDFKRAIQD

SEQ ID NO: 17039 - protein, 10 aa, Mycobacterium tuberculosis
DDFKRAIQDE

SEQ ID NO: 17040 - protein, 10 aa, Mycobacterium tuberculosis
DFKRAIQDET

SEQ ID NO: 17041 - protein, 10 aa, Mycobacterium tuberculosis
FKRAIQDETG

SEQ ID NO: 17042 - protein, 10 aa, Mycobacterium tuberculosis
KRAIQDETGI

SEQ ID NO: 17043 - protein, 10 aa, Mycobacterium tuberculosis
RAIQDETGIR

SEQ ID NO: 17044 - protein, 10 aa, Mycobacterium tuberculosis
AIQDETGIRP

SEQ ID NO: 17045 - protein, 10 aa, Mycobacterium tuberculosis
IQDETGIRPT

SEQ ID NO: 17046 - protein, 10 aa, Mycobacterium tuberculosis
QDETGIRPTW

SEQ ID NO: 17047 - protein, 10 aa, Mycobacterium tuberculosis
DETGIRPTWS

SEQ ID NO: 17048 - protein, 10 aa, Mycobacterium tuberculosis
ETGIRPTWSP

SEQ ID NO: 17049 - protein, 10 aa, Mycobacterium tuberculosis
TGIRPTWSPE

SEQ ID NO: 17050 - protein, 10 aa, Mycobacterium tuberculosis
GIRPTWSPES

SEQ ID NO: 17051 - protein, 10 aa, Mycobacterium tuberculosis
IRPTWSPESY

SEQ ID NO: 17052 - protein, 10 aa, Mycobacterium tuberculosis
RPTWSPESYP

SEQ ID NO: 17053 - protein, 10 aa, Mycobacterium tuberculosis
PTWSPESYPD

SEQ ID NO: 17054 - protein, 10 aa, Mycobacterium tuberculosis
TWSPESYPDA

SEQ ID NO: 17055 - protein, 10 aa, Mycobacterium tuberculosis
WSPESYPDAV

SEQ ID NO: 17056 - protein, 10 aa, Mycobacterium tuberculosis
SPESYPDAVE

SEQ ID NO: 17057 - protein, 10 aa, Mycobacterium tuberculosis
PESYPDAVED

SEQ ID NO: 17058 - protein, 10 aa, Mycobacterium tuberculosis
ESYPDAVEDV

SEQ ID NO: 17059 - protein, 10 aa, Mycobacterium tuberculosis
SYPDAVEDVR

SEQ ID NO: 17060 - protein, 10 aa, Mycobacterium tuberculosis
YPDAVEDVRQ

SEQ ID NO: 17061 - protein, 10 aa, Mycobacterium tuberculosis
PDAVEDVRQS

SEQ ID NO: 17062 - protein, 10 aa, Mycobacterium tuberculosis
DAVEDVRQSL

SEQ ID NO: 17063 - protein, 10 aa, Mycobacterium tuberculosis
AVEDVRQSLR

SEQ ID NO: 17064 - protein, 10 aa, Mycobacterium tuberculosis
VEDVRQSLRR

SEQ ID NO: 17065 - protein, 10 aa, Mycobacterium tuberculosis
EDVRQSLRRI

SEQ ID NO: 17066 - protein, 10 aa, Mycobacterium tuberculosis
DVRQSLRRIE

SEQ ID NO: 17067 - protein, 10 aa, Mycobacterium tuberculosis
VRQSLRRIEV

SEQ ID NO: 17068 - protein, 10 aa, Mycobacterium tuberculosis
RQSLRRIEVN

SEQ ID NO: 17069 - protein, 10 aa, Mycobacterium tuberculosis
QSLRRIEVNP

SEQ ID NO: 17070 - protein, 10 aa, Mycobacterium tuberculosis
SLRRIEVNPF

SEQ ID NO: 17071 - protein, 10 aa, Mycobacterium tuberculosis
LRRIEVNPFV

SEQ ID NO: 17072 - protein, 10 aa, Mycobacterium tuberculosis
RRIEVNPFVT

SEQ ID NO: 17073 - protein, 10 aa, Mycobacterium tuberculosis
RIEVNPFVTK

SEQ ID NO: 17074 - protein, 10 aa, Mycobacterium tuberculosis
IEVNPFVTKH

SEQ ID NO: 17075 - protein, 10 aa, Mycobacterium tuberculosis
EVNPFVTKHT

SEQ ID NO: 17076 - protein, 10 aa, Mycobacterium tuberculosis
VNPFVTKHTS

SEQ ID NO: 17077 - protein, 10 aa, Mycobacterium tuberculosis
NPFVTKHTSL

SEQ ID NO: 17078 - protein, 10 aa, Mycobacterium tuberculosis
PFVTKHTSLR

SEQ ID NO: 17079 - protein, 10 aa, Mycobacterium tuberculosis
FVTKHTSLRG

SEQ ID NO: 17080 - protein, 10 aa, Mycobacterium tuberculosis
VTKHTSLRGF

SEQ ID NO: 17081 - protein, 10 aa, Mycobacterium tuberculosis
TKHTSLRGFV

SEQ ID NO: 17082 - protein, 10 aa, Mycobacterium tuberculosis
KHTSLRGFVF

SEQ ID NO: 17083 - protein, 10 aa, Mycobacterium tuberculosis
HTSLRGFVFD

SEQ ID NO: 17084 - protein, 10 aa, Mycobacterium tuberculosis
TSLRGFVFDV

SEQ ID NO: 17085 - protein, 10 aa, Mycobacterium tuberculosis
SLRGFVFDVA

SEQ ID NO: 17086 - protein, 10 aa, Mycobacterium tuberculosis
LRGFVFDVAT

SEQ ID NO: 17087 - protein, 10 aa, Mycobacterium tuberculosis
RGFVFDVATG

SEQ ID NO: 17088 - protein, 10 aa, Mycobacterium tuberculosis
GFVFDVATGK

SEQ ID NO: 17089 - protein, 10 aa, Mycobacterium tuberculosis
FVFDVATGKL

SEQ ID NO: 17090 - protein, 10 aa, Mycobacterium tuberculosis
VFDVATGKLN

SEQ ID NO: 17091 - protein, 10 aa, Mycobacterium tuberculosis
FDVATGKLNE

SEQ ID NO: 17092 - protein, 10 aa, Mycobacterium tuberculosis
DVATGKLNEV

SEQ ID NO: 17093 - protein, 10 aa, Mycobacterium tuberculosis
VATGKLNEVT

SEQ ID NO: 17094 - protein, 10 aa, Mycobacterium tuberculosis
ATGKLNEVTP

SEQ ID NO: 17095 - protein, 11 aa, Mycobacterium tuberculosis
MTVTDDYLANN

SEQ ID NO: 17096 - protein, 11 aa, Mycobacterium tuberculosis
TVTDDYLANNV

SEQ ID NO: 17097 - protein, 11 aa, Mycobacterium tuberculosis
VTDDYLANNVD

SEQ ID NO: 17098 - protein, 11 aa, Mycobacterium tuberculosis
TDDYLANNVDY

SEQ ID NO: 17099 - protein, 11 aa, Mycobacterium tuberculosis
DDYLANNVDYA

SEQ ID NO: 17100 - protein, 11 aa, Mycobacterium tuberculosis
DYLANNVDYAS

SEQ ID NO: 17101 - protein, 11 aa, Mycobacterium tuberculosis
YLANNVDYASG

SEQ ID NO: 17102 - protein, 11 aa, Mycobacterium tuberculosis
LANNVDYASGF

SEQ ID NO: 17103 - protein, 11 aa, Mycobacterium tuberculosis
ANNVDYASGFK

SEQ ID NO: 17104 - protein, 11 aa, Mycobacterium tuberculosis
NNVDYASGFKG

SEQ ID NO: 17105 - protein, 11 aa, Mycobacterium tuberculosis
NVDYASGFKGP

SEQ ID NO: 17106 - protein, 11 aa, Mycobacterium tuberculosis
VDYASGFKGPL

SEQ ID NO: 17107 - protein, 11 aa, Mycobacterium tuberculosis
DYASGFKGPLP

SEQ ID NO: 17108 - protein, 11 aa, Mycobacterium tuberculosis
YASGFKGPLPM

SEQ ID NO: 17109 - protein, 11 aa, Mycobacterium tuberculosis
ASGFKGPLPMP

SEQ ID NO: 17110 - protein, 11 aa, Mycobacterium tuberculosis
SGFKGPLPMPP

SEQ ID NO: 17111 - protein, 11 aa, Mycobacterium tuberculosis
GFKGPLPMPPS

SEQ ID NO: 17112 - protein, 11 aa, Mycobacterium tuberculosis
FKGPLPMPPSK

SEQ ID NO: 17113 - protein, 11 aa, Mycobacterium tuberculosis
KGPLPMPPSKH

SEQ ID NO: 17114 - protein, 11 aa, Mycobacterium tuberculosis
GPLPMPPSKHI

SEQ ID NO: 17115 - protein, 11 aa, Mycobacterium tuberculosis
PLPMPPSKHIA

SEQ ID NO: 17116 - protein, 11 aa, Mycobacterium tuberculosis
LPMPPSKHIAI

SEQ ID NO: 17117 - protein, 11 aa, Mycobacterium tuberculosis
PMPPSKHIAIV

SEQ ID NO: 17118 - protein, 11 aa, Mycobacterium tuberculosis
MPPSKHIAIVA

SEQ ID NO: 17119 - protein, 11 aa, Mycobacterium tuberculosis
PPSKHIAIVAC

SEQ ID NO: 17120 - protein, 11 aa, Mycobacterium tuberculosis
PSKHIAIVACM

SEQ ID NO: 17121 - protein, 11 aa, Mycobacterium tuberculosis
SKHIAIVACMD

SEQ ID NO: 17122 - protein, 11 aa, Mycobacterium tuberculosis
KHIAIVACMDA

SEQ ID NO: 17123 - protein, 11 aa, Mycobacterium tuberculosis
HIAIVACMDAR

SEQ ID NO: 17124 - protein, 11 aa, Mycobacterium tuberculosis
IAIVACMDARL

SEQ ID NO: 17125 - protein, 11 aa, Mycobacterium tuberculosis
AIVACMDARLD

SEQ ID NO: 17126 - protein, 11 aa, Mycobacterium tuberculosis
IVACMDARLDV

SEQ ID NO: 17127 - protein, 11 aa, Mycobacterium tuberculosis
VACMDARLDVY

SEQ ID NO: 17128 - protein, 11 aa, Mycobacterium tuberculosis
ACMDARLDVYR

SEQ ID NO: 17129 - protein, 11 aa, Mycobacterium tuberculosis
CMDARLDVYRM

SEQ ID NO: 17130 - protein, 11 aa, Mycobacterium tuberculosis
MDARLDVYRML

SEQ ID NO: 17131 - protein, 11 aa, Mycobacterium tuberculosis
DARLDVYRMLG

SEQ ID NO: 17132 - protein, 11 aa, Mycobacterium tuberculosis
ARLDVYRMLGI

SEQ ID NO: 17133 - protein, 11 aa, Mycobacterium tuberculosis
RLDVYRMLGIK

SEQ ID NO: 17134 - protein, 11 aa, Mycobacterium tuberculosis
LDVYRMLGIKE

SEQ ID NO: 17135 - protein, 11 aa, Mycobacterium tuberculosis
DVYRMLGIKEG

SEQ ID NO: 17136 - protein, 11 aa, Mycobacterium tuberculosis
VYRMLGIKEGE

SEQ ID NO: 17137 - protein, 11 aa, Mycobacterium tuberculosis
YRMLGIKEGEA

SEQ ID NO: 17138 - protein, 11 aa, Mycobacterium tuberculosis
RMLGIKEGEAH

SEQ ID NO: 17139 - protein, 11 aa, Mycobacterium tuberculosis
MLGIKEGEAHV

SEQ ID NO: 17140 - protein, 11 aa, Mycobacterium tuberculosis
LGIKEGEAHVI

SEQ ID NO: 17141 - protein, 11 aa, Mycobacterium tuberculosis
GIKEGEAHVIR

SEQ ID NO: 17142 - protein, 11 aa, Mycobacterium tuberculosis
IKEGEAHVIRN

SEQ ID NO: 17143 - protein, 11 aa, Mycobacterium tuberculosis
KEGEAHVIRNA

SEQ ID NO: 17144 - protein, 11 aa, Mycobacterium tuberculosis
EGEAHVIRNAG

SEQ ID NO: 17145 - protein, 11 aa, Mycobacterium tuberculosis
GEAHVIRNAGC

SEQ ID NO: 17146 - protein, 11 aa, Mycobacterium tuberculosis
EAHVIRNAGCV

SEQ ID NO: 17147 - protein, 11 aa, Mycobacterium tuberculosis
AHVIRNAGCVV

SEQ ID NO: 17148 - protein, 11 aa, Mycobacterium tuberculosis
HVIRNAGCVVT

SEQ ID NO: 17149 - protein, 11 aa, Mycobacterium tuberculosis
VIRNAGCVVTD

SEQ ID NO: 17150 - protein, 11 aa, Mycobacterium tuberculosis
IRNAGCVVTDD

SEQ ID NO: 17151 - protein, 11 aa, Mycobacterium tuberculosis
RNAGCVVTDDV

SEQ ID NO: 17152 - protein, 11 aa, Mycobacterium tuberculosis
NAGCVVTDDVI

SEQ ID NO: 17153 - protein, 11 aa, Mycobacterium tuberculosis
AGCVVTDDVIR

SEQ ID NO: 17154 - protein, 11 aa, Mycobacterium tuberculosis
GCVVTDDVIRS

SEQ ID NO: 17155 - protein, 11 aa, Mycobacterium tuberculosis
CVVTDDVIRSL

SEQ ID NO: 17156 - protein, 11 aa, Mycobacterium tuberculosis
VVTDDVIRSLA

SEQ ID NO: 17157 - protein, 11 aa, Mycobacterium tuberculosis
VTDDVIRSLAI

SEQ ID NO: 17158 - protein, 11 aa, Mycobacterium tuberculosis
TDDVIRSLAIS

SEQ ID NO: 17159 - protein, 11 aa, Mycobacterium tuberculosis
DDVIRSLAISQ

SEQ ID NO: 17160 - protein, 11 aa, Mycobacterium tuberculosis
DVIRSLAISQR

SEQ ID NO: 17161 - protein, 11 aa, Mycobacterium tuberculosis
VIRSLAISQRL

SEQ ID NO: 17162 - protein, 11 aa, Mycobacterium tuberculosis
IRSLAISQRLL

SEQ ID NO: 17163 - protein, 11 aa, Mycobacterium tuberculosis
RSLAISQRLLG

SEQ ID NO: 17164 - protein, 11 aa, Mycobacterium tuberculosis
SLAISQRLLGT

SEQ ID NO: 17165 - protein, 11 aa, Mycobacterium tuberculosis
LAISQRLLGTR

SEQ ID NO: 17166 - protein, 11 aa, Mycobacterium tuberculosis
AISQRLLGTRE

SEQ ID NO: 17167 - protein, 11 aa, Mycobacterium tuberculosis
ISQRLLGTREI

SEQ ID NO: 17168 - protein, 11 aa, Mycobacterium tuberculosis
SQRLLGTREII

SEQ ID NO: 17169 - protein, 11 aa, Mycobacterium tuberculosis
QRLLGTREIIL

SEQ ID NO: 17170 - protein, 11 aa, Mycobacterium tuberculosis
RLLGTREIILL

SEQ ID NO: 17171 - protein, 11 aa, Mycobacterium tuberculosis
LLGTREIILLH

SEQ ID NO: 17172 - protein, 11 aa, Mycobacterium tuberculosis
LGTREIILLHH

SEQ ID NO: 17173 - protein, 11 aa, Mycobacterium tuberculosis
GTREIILLHHT

SEQ ID NO: 17174 - protein, 11 aa, Mycobacterium tuberculosis
TREIILLHHTD

SEQ ID NO: 17175 - protein, 11 aa, Mycobacterium tuberculosis
REIILLHHTDC

SEQ ID NO: 17176 - protein, 11 aa, Mycobacterium tuberculosis
EIILLHHTDCG

SEQ ID NO: 17177 - protein, 11 aa, Mycobacterium tuberculosis
IILLHHTDCGM

SEQ ID NO: 17178 - protein, 11 aa, Mycobacterium tuberculosis
ILLHHTDCGML

SEQ ID NO: 17179 - protein, 11 aa, Mycobacterium tuberculosis
LLHHTDCGMLT

SEQ ID NO: 17180 - protein, 11 aa, Mycobacterium tuberculosis
LHHTDCGMLTF

SEQ ID NO: 17181 - protein, 11 aa, Mycobacterium tuberculosis
HHTDCGMLTFT

SEQ ID NO: 17182 - protein, 11 aa, Mycobacterium tuberculosis
HTDCGMLTFTD

SEQ ID NO: 17183 - protein, 11 aa, Mycobacterium tuberculosis
TDCGMLTFTDD

SEQ ID NO: 17184 - protein, 11 aa, Mycobacterium tuberculosis
DCGMLTFTDDD

SEQ ID NO: 17185 - protein, 11 aa, Mycobacterium tuberculosis
CGMLTFTDDDF

SEQ ID NO: 17186 - protein, 11 aa, Mycobacterium tuberculosis
GMLTFTDDDFK

SEQ ID NO: 17187 - protein, 11 aa, Mycobacterium tuberculosis
MLTFTDDDFKR

SEQ ID NO: 17188 - protein, 11 aa, Mycobacterium tuberculosis
LTFTDDDFKRA

SEQ ID NO: 17189 - protein, 11 aa, Mycobacterium tuberculosis
TFTDDDFKRAI

SEQ ID NO: 17190 - protein, 11 aa, Mycobacterium tuberculosis
FTDDDFKRAIQ

SEQ ID NO: 17191 - protein, 11 aa, Mycobacterium tuberculosis
TDDDFKRAIQD

SEQ ID NO: 17192 - protein, 11 aa, Mycobacterium tuberculosis
DDDFKRAIQDE

SEQ ID NO: 17193 - protein, 11 aa, Mycobacterium tuberculosis
DDFKRAIQDET

SEQ ID NO: 17194 - protein, 11 aa, Mycobacterium tuberculosis
DFKRAIQDETG

SEQ ID NO: 17195 - protein, 11 aa, Mycobacterium tuberculosis
FKRAIQDETGI

SEQ ID NO: 17196 - protein, 11 aa, Mycobacterium tuberculosis
KRAIQDETGIR

SEQ ID NO: 17197 - protein, 11 aa, Mycobacterium tuberculosis
RAIQDETGIRP

SEQ ID NO: 17198 - protein, 11 aa, Mycobacterium tuberculosis
AIQDETGIRPT

SEQ ID NO: 17199 - protein, 11 aa, Mycobacterium tuberculosis
IQDETGIRPTW

SEQ ID NO: 17200 - protein, 11 aa, Mycobacterium tuberculosis
QDETGIRPTWS

SEQ ID NO: 17201 - protein, 11 aa, Mycobacterium tuberculosis
DETGIRPTWSP

SEQ ID NO: 17202 - protein, 11 aa, Mycobacterium tuberculosis
ETGIRPTWSPE

SEQ ID NO: 17203 - protein, 11 aa, Mycobacterium tuberculosis
TGIRPTWSPES

SEQ ID NO: 17204 - protein, 11 aa, Mycobacterium tuberculosis
GIRPTWSPESY

SEQ ID NO: 17205 - protein, 11 aa, Mycobacterium tuberculosis
IRPTWSPESYP

SEQ ID NO: 17206 - protein, 11 aa, Mycobacterium tuberculosis
RPTWSPESYPD

SEQ ID NO: 17207 - protein, 11 aa, Mycobacterium tuberculosis
PTWSPESYPDA

SEQ ID NO: 17208 - protein, 11 aa, Mycobacterium tuberculosis
TWSPESYPDAV

SEQ ID NO: 17209 - protein, 11 aa, Mycobacterium tuberculosis
WSPESYPDAVE

SEQ ID NO: 17210 - protein, 11 aa, Mycobacterium tuberculosis
SPESYPDAVED

SEQ ID NO: 17211 - protein, 11 aa, Mycobacterium tuberculosis
PESYPDAVEDV

SEQ ID NO: 17212 - protein, 11 aa, Mycobacterium tuberculosis
ESYPDAVEDVR

SEQ ID NO: 17213 - protein, 11 aa, Mycobacterium tuberculosis
SYPDAVEDVRQ

SEQ ID NO: 17214 - protein, 11 aa, Mycobacterium tuberculosis
YPDAVEDVRQS

SEQ ID NO: 17215 - protein, 11 aa, Mycobacterium tuberculosis
PDAVEDVRQSL

SEQ ID NO: 17216 - protein, 11 aa, Mycobacterium tuberculosis
DAVEDVRQSLR

SEQ ID NO: 17217 - protein, 11 aa, Mycobacterium tuberculosis
AVEDVRQSLRR

SEQ ID NO: 17218 - protein, 11 aa, Mycobacterium tuberculosis
VEDVRQSLRRI

SEQ ID NO: 17219 - protein, 11 aa, Mycobacterium tuberculosis
EDVRQSLRRIE

SEQ ID NO: 17220 - protein, 11 aa, Mycobacterium tuberculosis
DVRQSLRRIEV

SEQ ID NO: 17221 - protein, 11 aa, Mycobacterium tuberculosis
VRQSLRRIEVN

SEQ ID NO: 17222 - protein, 11 aa, Mycobacterium tuberculosis
RQSLRRIEVNP

SEQ ID NO: 17223 - protein, 11 aa, Mycobacterium tuberculosis
QSLRRIEVNPF

SEQ ID NO: 17224 - protein, 11 aa, Mycobacterium tuberculosis
SLRRIEVNPFV

SEQ ID NO: 17225 - protein, 11 aa, Mycobacterium tuberculosis
LRRIEVNPFVT

SEQ ID NO: 17226 - protein, 11 aa, Mycobacterium tuberculosis
RRIEVNPFVTK

SEQ ID NO: 17227 - protein, 11 aa, Mycobacterium tuberculosis
RIEVNPFVTKH

SEQ ID NO: 17228 - protein, 11 aa, Mycobacterium tuberculosis
IEVNPFVTKHT

SEQ ID NO: 17229 - protein, 11 aa, Mycobacterium tuberculosis
EVNPFVTKHTS

SEQ ID NO: 17230 - protein, 11 aa, Mycobacterium tuberculosis
VNPFVTKHTSL

SEQ ID NO: 17231 - protein, 11 aa, Mycobacterium tuberculosis
NPFVTKHTSLR

SEQ ID NO: 17232 - protein, 11 aa, Mycobacterium tuberculosis
PFVTKHTSLRG

SEQ ID NO: 17233 - protein, 11 aa, Mycobacterium tuberculosis
FVTKHTSLRGF

SEQ ID NO: 17234 - protein, 11 aa, Mycobacterium tuberculosis
VTKHTSLRGFV

SEQ ID NO: 17235 - protein, 11 aa, Mycobacterium tuberculosis
TKHTSLRGFVF

SEQ ID NO: 17236 - protein, 11 aa, Mycobacterium tuberculosis
KHTSLRGFVFD

SEQ ID NO: 17237 - protein, 11 aa, Mycobacterium tuberculosis
HTSLRGFVFDV

SEQ ID NO: 17238 - protein, 11 aa, Mycobacterium tuberculosis
TSLRGFVFDVA

SEQ ID NO: 17239 - protein, 11 aa, Mycobacterium tuberculosis
SLRGFVFDVAT

SEQ ID NO: 17240 - protein, 11 aa, Mycobacterium tuberculosis
LRGFVFDVATG

SEQ ID NO: 17241 - protein, 11 aa, Mycobacterium tuberculosis
RGFVFDVATGK

SEQ ID NO: 17242 - protein, 11 aa, Mycobacterium tuberculosis
GFVFDVATGKL

SEQ ID NO: 17243 - protein, 11 aa, Mycobacterium tuberculosis
FVFDVATGKLN

SEQ ID NO: 17244 - protein, 11 aa, Mycobacterium tuberculosis
VFDVATGKLNE

SEQ ID NO: 17245 - protein, 11 aa, Mycobacterium tuberculosis
FDVATGKLNEV

SEQ ID NO: 17246 - protein, 11 aa, Mycobacterium tuberculosis
DVATGKLNEVT

SEQ ID NO: 17247 - protein, 11 aa, Mycobacterium tuberculosis
VATGKLNEVTP

SEQ ID NO: 17248 - protein, 8 aa, Mycobacterium tuberculosis
MTLRVVPE

SEQ ID NO: 17249 - protein, 8 aa, Mycobacterium tuberculosis
TLRVVPES

SEQ ID NO: 17250 - protein, 8 aa, Mycobacterium tuberculosis
LRVVPESL

SEQ ID NO: 17251 - protein, 8 aa, Mycobacterium tuberculosis
RVVPESLA

SEQ ID NO: 17252 - protein, 8 aa, Mycobacterium tuberculosis
VVPESLAG

SEQ ID NO: 17253 - protein, 8 aa, Mycobacterium tuberculosis
VPESLAGA

SEQ ID NO: 17254 - protein, 8 aa, Mycobacterium tuberculosis
PESLAGAS

SEQ ID NO: 17255 - protein, 8 aa, Mycobacterium tuberculosis
ESLAGASA

SEQ ID NO: 17256 - protein, 8 aa, Mycobacterium tuberculosis
SLAGASAA

SEQ ID NO: 17257 - protein, 8 aa, Mycobacterium tuberculosis
LAGASAAI

SEQ ID NO: 17258 - protein, 8 aa, Mycobacterium tuberculosis
AGASAAIE

SEQ ID NO: 17259 - protein, 8 aa, Mycobacterium tuberculosis
GASAAIEA

SEQ ID NO: 17260 - protein, 8 aa, Mycobacterium tuberculosis
ASAAIEAV

SEQ ID NO: 17261 - protein, 8 aa, Mycobacterium tuberculosis
SAAIEAVT

SEQ ID NO: 17262 - protein, 8 aa, Mycobacterium tuberculosis
AAIEAVTA

SEQ ID NO: 17263 - protein, 8 aa, Mycobacterium tuberculosis
AIEAVTAR

SEQ ID NO: 17264 - protein, 8 aa, Mycobacterium tuberculosis
IEAVTARL

SEQ ID NO: 17265 - protein, 8 aa, Mycobacterium tuberculosis
EAVTARLA

SEQ ID NO: 17266 - protein, 8 aa, Mycobacterium tuberculosis
AVTARLAA

SEQ ID NO: 17267 - protein, 8 aa, Mycobacterium tuberculosis
VTARLAAA

SEQ ID NO: 17268 - protein, 8 aa, Mycobacterium tuberculosis
TARLAAAH

SEQ ID NO: 17269 - protein, 8 aa, Mycobacterium tuberculosis
ARLAAAHA

SEQ ID NO: 17270 - protein, 8 aa, Mycobacterium tuberculosis
RLAAAHAA

SEQ ID NO: 17271 - protein, 8 aa, Mycobacterium tuberculosis
LAAAHAAA

SEQ ID NO: 17272 - protein, 8 aa, Mycobacterium tuberculosis
AAAHAAAA

SEQ ID NO: 17273 - protein, 8 aa, Mycobacterium tuberculosis
AAHAAAAP

SEQ ID NO: 17274 - protein, 8 aa, Mycobacterium tuberculosis
AHAAAAPF

SEQ ID NO: 17275 - protein, 8 aa, Mycobacterium tuberculosis
HAAAAPFI

SEQ ID NO: 17276 - protein, 8 aa, Mycobacterium tuberculosis
AAAAPFIA

SEQ ID NO: 17277 - protein, 8 aa, Mycobacterium tuberculosis
AAAPFIAA

SEQ ID NO: 17278 - protein, 8 aa, Mycobacterium tuberculosis
AAPFIAAV

SEQ ID NO: 17279 - protein, 8 aa, Mycobacterium tuberculosis
APFIAAVI

SEQ ID NO: 17280 - protein, 8 aa, Mycobacterium tuberculosis
PFIAAVIP

SEQ ID NO: 17281 - protein, 8 aa, Mycobacterium tuberculosis
FIAAVIPP

SEQ ID NO: 17282 - protein, 8 aa, Mycobacterium tuberculosis
IAAVIPPG

SEQ ID NO: 17283 - protein, 8 aa, Mycobacterium tuberculosis
AAVIPPGS

SEQ ID NO: 17284 - protein, 8 aa, Mycobacterium tuberculosis
AVIPPGSD

SEQ ID NO: 17285 - protein, 8 aa, Mycobacterium tuberculosis
VIPPGSDS

SEQ ID NO: 17286 - protein, 8 aa, Mycobacterium tuberculosis
IPPGSDSV

SEQ ID NO: 17287 - protein, 8 aa, Mycobacterium tuberculosis
PPGSDSVS

SEQ ID NO: 17288 - protein, 8 aa, Mycobacterium tuberculosis
PGSDSVSV

SEQ ID NO: 17289 - protein, 8 aa, Mycobacterium tuberculosis
GSDSVSVC

SEQ ID NO: 17290 - protein, 8 aa, Mycobacterium tuberculosis
SDSVSVCN

SEQ ID NO: 17291 - protein, 8 aa, Mycobacterium tuberculosis
DSVSVCNA

SEQ ID NO: 17292 - protein, 8 aa, Mycobacterium tuberculosis
SVSVCNAV

SEQ ID NO: 17293 - protein, 8 aa, Mycobacterium tuberculosis
VSVCNAVE

SEQ ID NO: 17294 - protein, 8 aa, Mycobacterium tuberculosis
SVCNAVEF

SEQ ID NO: 17295 - protein, 8 aa, Mycobacterium tuberculosis
VCNAVEFS

SEQ ID NO: 17296 - protein, 8 aa, Mycobacterium tuberculosis
CNAVEFSV

SEQ ID NO: 17297 - protein, 8 aa, Mycobacterium tuberculosis
NAVEFSVH

SEQ ID NO: 17298 - protein, 8 aa, Mycobacterium tuberculosis
AVEFSVHG

SEQ ID NO: 17299 - protein, 8 aa, Mycobacterium tuberculosis
VEFSVHGS

SEQ ID NO: 17300 - protein, 8 aa, Mycobacterium tuberculosis
EFSVHGSQ

SEQ ID NO: 17301 - protein, 8 aa, Mycobacterium tuberculosis
FSVHGSQH

SEQ ID NO: 17302 - protein, 8 aa, Mycobacterium tuberculosis
SVHGSQHV

SEQ ID NO: 17303 - protein, 8 aa, Mycobacterium tuberculosis
VHGSQHVA

SEQ ID NO: 17304 - protein, 8 aa, Mycobacterium tuberculosis
HGSQHVAM

SEQ ID NO: 17305 - protein, 8 aa, Mycobacterium tuberculosis
GSQHVAMA

SEQ ID NO: 17306 - protein, 8 aa, Mycobacterium tuberculosis
SQHVAMAA

SEQ ID NO: 17307 - protein, 8 aa, Mycobacterium tuberculosis
QHVAMAAQ

SEQ ID NO: 17308 - protein, 8 aa, Mycobacterium tuberculosis
HVAMAAQG

SEQ ID NO: 17309 - protein, 8 aa, Mycobacterium tuberculosis
VAMAAQGV

SEQ ID NO: 17310 - protein, 8 aa, Mycobacterium tuberculosis
AMAAQGVE

SEQ ID NO: 17311 - protein, 8 aa, Mycobacterium tuberculosis
MAAQGVEE

SEQ ID NO: 17312 - protein, 8 aa, Mycobacterium tuberculosis
AAQGVEEL

SEQ ID NO: 17313 - protein, 8 aa, Mycobacterium tuberculosis
AQGVEELG

SEQ ID NO: 17314 - protein, 8 aa, Mycobacterium tuberculosis
QGVEELGR

SEQ ID NO: 17315 - protein, 8 aa, Mycobacterium tuberculosis
GVEELGRS

SEQ ID NO: 17316 - protein, 8 aa, Mycobacterium tuberculosis
VEELGRSG

SEQ ID NO: 17317 - protein, 8 aa, Mycobacterium tuberculosis
EELGRSGV

SEQ ID NO: 17318 - protein, 8 aa, Mycobacterium tuberculosis
ELGRSGVG

SEQ ID NO: 17319 - protein, 8 aa, Mycobacterium tuberculosis
LGRSGVGV

SEQ ID NO: 17320 - protein, 8 aa, Mycobacterium tuberculosis
GRSGVGVA

SEQ ID NO: 17321 - protein, 8 aa, Mycobacterium tuberculosis
RSGVGVAE

SEQ ID NO: 17322 - protein, 8 aa, Mycobacterium tuberculosis
SGVGVAES

SEQ ID NO: 17323 - protein, 8 aa, Mycobacterium tuberculosis
GVGVAESG

SEQ ID NO: 17324 - protein, 8 aa, Mycobacterium tuberculosis
VGVAESGA

SEQ ID NO: 17325 - protein, 8 aa, Mycobacterium tuberculosis
GVAESGAS

SEQ ID NO: 17326 - protein, 8 aa, Mycobacterium tuberculosis
VAESGASY

SEQ ID NO: 17327 - protein, 8 aa, Mycobacterium tuberculosis
AESGASYA

SEQ ID NO: 17328 - protein, 8 aa, Mycobacterium tuberculosis
ESGASYAA

SEQ ID NO: 17329 - protein, 8 aa, Mycobacterium tuberculosis
SGASYAAR

SEQ ID NO: 17330 - protein, 8 aa, Mycobacterium tuberculosis
GASYAARD

SEQ ID NO: 17331 - protein, 8 aa, Mycobacterium tuberculosis
ASYAARDA

SEQ ID NO: 17332 - protein, 8 aa, Mycobacterium tuberculosis
SYAARDAL

SEQ ID NO: 17333 - protein, 8 aa, Mycobacterium tuberculosis
YAARDALA

SEQ ID NO: 17334 - protein, 8 aa, Mycobacterium tuberculosis
AARDALAA

SEQ ID NO: 17335 - protein, 8 aa, Mycobacterium tuberculosis
ARDALAAA

SEQ ID NO: 17336 - protein, 8 aa, Mycobacterium tuberculosis
RDALAAAS

SEQ ID NO: 17337 - protein, 8 aa, Mycobacterium tuberculosis
DALAAASY

SEQ ID NO: 17338 - protein, 8 aa, Mycobacterium tuberculosis
ALAAASYL

SEQ ID NO: 17339 - protein, 8 aa, Mycobacterium tuberculosis
LAAASYLS

SEQ ID NO: 17340 - protein, 8 aa, Mycobacterium tuberculosis
AAASYLSG

SEQ ID NO: 17341 - protein, 8 aa, Mycobacterium tuberculosis
AASYLSGG

SEQ ID NO: 17342 - protein, 8 aa, Mycobacterium tuberculosis
ASYLSGGL

SEQ ID NO: 17343 - protein, 9 aa, Mycobacterium tuberculosis
MTLRVVPES

SEQ ID NO: 17344 - protein, 9 aa, Mycobacterium tuberculosis
TLRVVPESL

SEQ ID NO: 17345 - protein, 9 aa, Mycobacterium tuberculosis
LRVVPESLA

SEQ ID NO: 17346 - protein, 9 aa, Mycobacterium tuberculosis
RVVPESLAG

SEQ ID NO: 17347 - protein, 9 aa, Mycobacterium tuberculosis
VVPESLAGA

SEQ ID NO: 17348 - protein, 9 aa, Mycobacterium tuberculosis
VPESLAGAS

SEQ ID NO: 17349 - protein, 9 aa, Mycobacterium tuberculosis
PESLAGASA

SEQ ID NO: 17350 - protein, 9 aa, Mycobacterium tuberculosis
ESLAGASAA

SEQ ID NO: 17351 - protein, 9 aa, Mycobacterium tuberculosis
SLAGASAAI

SEQ ID NO: 17352 - protein, 9 aa, Mycobacterium tuberculosis
LAGASAAIE

SEQ ID NO: 17353 - protein, 9 aa, Mycobacterium tuberculosis
AGASAAIEA

SEQ ID NO: 17354 - protein, 9 aa, Mycobacterium tuberculosis
GASAAIEAV

SEQ ID NO: 17355 - protein, 9 aa, Mycobacterium tuberculosis
ASAAIEAVT

SEQ ID NO: 17356 - protein, 9 aa, Mycobacterium tuberculosis
SAAIEAVTA

SEQ ID NO: 17357 - protein, 9 aa, Mycobacterium tuberculosis
AAIEAVTAR

SEQ ID NO: 17358 - protein, 9 aa, Mycobacterium tuberculosis
AIEAVTARL

SEQ ID NO: 17359 - protein, 9 aa, Mycobacterium tuberculosis
IEAVTARLA

SEQ ID NO: 17360 - protein, 9 aa, Mycobacterium tuberculosis
EAVTARLAA

SEQ ID NO: 17361 - protein, 9 aa, Mycobacterium tuberculosis
AVTARLAAA

SEQ ID NO: 17362 - protein, 9 aa, Mycobacterium tuberculosis
VTARLAAAH

SEQ ID NO: 17363 - protein, 9 aa, Mycobacterium tuberculosis
TARLAAAHA

SEQ ID NO: 17364 - protein, 9 aa, Mycobacterium tuberculosis
ARLAAAHAA

SEQ ID NO: 17365 - protein, 9 aa, Mycobacterium tuberculosis
RLAAAHAAA

SEQ ID NO: 17366 - protein, 9 aa, Mycobacterium tuberculosis
LAAAHAAAA

SEQ ID NO: 17367 - protein, 9 aa, Mycobacterium tuberculosis
AAAHAAAAP

SEQ ID NO: 17368 - protein, 9 aa, Mycobacterium tuberculosis
AAHAAAAPF

SEQ ID NO: 17369 - protein, 9 aa, Mycobacterium tuberculosis
AHAAAAPFI

SEQ ID NO: 17370 - protein, 9 aa, Mycobacterium tuberculosis
HAAAAPFIA

SEQ ID NO: 17371 - protein, 9 aa, Mycobacterium tuberculosis
AAAAPFIAA

SEQ ID NO: 17372 - protein, 9 aa, Mycobacterium tuberculosis
AAAPFIAAV

SEQ ID NO: 17373 - protein, 9 aa, Mycobacterium tuberculosis
AAPFIAAVI

SEQ ID NO: 17374 - protein, 9 aa, Mycobacterium tuberculosis
APFIAAVIP

SEQ ID NO: 17375 - protein, 9 aa, Mycobacterium tuberculosis
PFIAAVIPP

SEQ ID NO: 17376 - protein, 9 aa, Mycobacterium tuberculosis
FIAAVIPPG

SEQ ID NO: 17377 - protein, 9 aa, Mycobacterium tuberculosis
IAAVIPPGS

SEQ ID NO: 17378 - protein, 9 aa, Mycobacterium tuberculosis
AAVIPPGSD

SEQ ID NO: 17379 - protein, 9 aa, Mycobacterium tuberculosis
AVIPPGSDS

SEQ ID NO: 17380 - protein, 9 aa, Mycobacterium tuberculosis
VIPPGSDSV

SEQ ID NO: 17381 - protein, 9 aa, Mycobacterium tuberculosis
IPPGSDSVS

SEQ ID NO: 17382 - protein, 9 aa, Mycobacterium tuberculosis
PPGSDSVSV

SEQ ID NO: 17383 - protein, 9 aa, Mycobacterium tuberculosis
PGSDSVSVC

SEQ ID NO: 17384 - protein, 9 aa, Mycobacterium tuberculosis
GSDSVSVCN

SEQ ID NO: 17385 - protein, 9 aa, Mycobacterium tuberculosis
SDSVSVCNA

SEQ ID NO: 17386 - protein, 9 aa, Mycobacterium tuberculosis
DSVSVCNAV

SEQ ID NO: 17387 - protein, 9 aa, Mycobacterium tuberculosis
SVSVCNAVE

SEQ ID NO: 17388 - protein, 9 aa, Mycobacterium tuberculosis
VSVCNAVEF

SEQ ID NO: 17389 - protein, 9 aa, Mycobacterium tuberculosis
SVCNAVEFS

SEQ ID NO: 17390 - protein, 9 aa, Mycobacterium tuberculosis
VCNAVEFSV

SEQ ID NO: 17391 - protein, 9 aa, Mycobacterium tuberculosis
CNAVEFSVH

SEQ ID NO: 17392 - protein, 9 aa, Mycobacterium tuberculosis
NAVEFSVHG

SEQ ID NO: 17393 - protein, 9 aa, Mycobacterium tuberculosis
AVEFSVHGS

SEQ ID NO: 17394 - protein, 9 aa, Mycobacterium tuberculosis
VEFSVHGSQ

SEQ ID NO: 17395 - protein, 9 aa, Mycobacterium tuberculosis
EFSVHGSQH

SEQ ID NO: 17396 - protein, 9 aa, Mycobacterium tuberculosis
FSVHGSQHV

SEQ ID NO: 17397 - protein, 9 aa, Mycobacterium tuberculosis
SVHGSQHVA

SEQ ID NO: 17398 - protein, 9 aa, Mycobacterium tuberculosis
VHGSQHVAM

SEQ ID NO: 17399 - protein, 9 aa, Mycobacterium tuberculosis
HGSQHVAMA

SEQ ID NO: 17400 - protein, 9 aa, Mycobacterium tuberculosis
GSQHVAMAA

SEQ ID NO: 17401 - protein, 9 aa, Mycobacterium tuberculosis
SQHVAMAAQ

SEQ ID NO: 17402 - protein, 9 aa, Mycobacterium tuberculosis
QHVAMAAQG

SEQ ID NO: 17403 - protein, 9 aa, Mycobacterium tuberculosis
HVAMAAQGV

SEQ ID NO: 17404 - protein, 9 aa, Mycobacterium tuberculosis
VAMAAQGVE

SEQ ID NO: 17405 - protein, 9 aa, Mycobacterium tuberculosis
AMAAQGVEE

SEQ ID NO: 17406 - protein, 9 aa, Mycobacterium tuberculosis
MAAQGVEEL

SEQ ID NO: 17407 - protein, 9 aa, Mycobacterium tuberculosis
AAQGVEELG

SEQ ID NO: 17408 - protein, 9 aa, Mycobacterium tuberculosis
AQGVEELGR

SEQ ID NO: 17409 - protein, 9 aa, Mycobacterium tuberculosis
QGVEELGRS

SEQ ID NO: 17410 - protein, 9 aa, Mycobacterium tuberculosis
GVEELGRSG

SEQ ID NO: 17411 - protein, 9 aa, Mycobacterium tuberculosis
VEELGRSGV

SEQ ID NO: 17412 - protein, 9 aa, Mycobacterium tuberculosis
EELGRSGVG

SEQ ID NO: 17413 - protein, 9 aa, Mycobacterium tuberculosis
ELGRSGVGV

SEQ ID NO: 17414 - protein, 9 aa, Mycobacterium tuberculosis
LGRSGVGVA

SEQ ID NO: 17415 - protein, 9 aa, Mycobacterium tuberculosis
GRSGVGVAE

SEQ ID NO: 17416 - protein, 9 aa, Mycobacterium tuberculosis
RSGVGVAES

SEQ ID NO: 17417 - protein, 9 aa, Mycobacterium tuberculosis
SGVGVAESG

SEQ ID NO: 17418 - protein, 9 aa, Mycobacterium tuberculosis
GVGVAESGA

SEQ ID NO: 17419 - protein, 9 aa, Mycobacterium tuberculosis
VGVAESGAS

SEQ ID NO: 17420 - protein, 9 aa, Mycobacterium tuberculosis
GVAESGASY

SEQ ID NO: 17421 - protein, 9 aa, Mycobacterium tuberculosis
VAESGASYA

SEQ ID NO: 17422 - protein, 9 aa, Mycobacterium tuberculosis
AESGASYAA

SEQ ID NO: 17423 - protein, 9 aa, Mycobacterium tuberculosis
ESGASYAAR

SEQ ID NO: 17424 - protein, 9 aa, Mycobacterium tuberculosis
SGASYAARD

SEQ ID NO: 17425 - protein, 9 aa, Mycobacterium tuberculosis
GASYAARDA

SEQ ID NO: 17426 - protein, 9 aa, Mycobacterium tuberculosis
ASYAARDAL

SEQ ID NO: 17427 - protein, 9 aa, Mycobacterium tuberculosis
SYAARDALA

SEQ ID NO: 17428 - protein, 9 aa, Mycobacterium tuberculosis
YAARDALAA

SEQ ID NO: 17429 - protein, 9 aa, Mycobacterium tuberculosis
AARDALAAA

SEQ ID NO: 17430 - protein, 9 aa, Mycobacterium tuberculosis
ARDALAAAS

SEQ ID NO: 17431 - protein, 9 aa, Mycobacterium tuberculosis
RDALAAASY

SEQ ID NO: 17432 - protein, 9 aa, Mycobacterium tuberculosis
DALAAASYL

SEQ ID NO: 17433 - protein, 9 aa, Mycobacterium tuberculosis
ALAAASYLS

SEQ ID NO: 17434 - protein, 9 aa, Mycobacterium tuberculosis
LAAASYLSG

SEQ ID NO: 17435 - protein, 9 aa, Mycobacterium tuberculosis
AAASYLSGG

SEQ ID NO: 17436 - protein, 9 aa, Mycobacterium tuberculosis
AASYLSGGL

SEQ ID NO: 17437 - protein, 10 aa, Mycobacterium tuberculosis
MTLRVVPESL

SEQ ID NO: 17438 - protein, 10 aa, Mycobacterium tuberculosis
TLRVVPESLA

SEQ ID NO: 17439 - protein, 10 aa, Mycobacterium tuberculosis
LRVVPESLAG

SEQ ID NO: 17440 - protein, 10 aa, Mycobacterium tuberculosis
RVVPESLAGA

SEQ ID NO: 17441 - protein, 10 aa, Mycobacterium tuberculosis
VVPESLAGAS

SEQ ID NO: 17442 - protein, 10 aa, Mycobacterium tuberculosis
VPESLAGASA

SEQ ID NO: 17443 - protein, 10 aa, Mycobacterium tuberculosis
PESLAGASAA

SEQ ID NO: 17444 - protein, 10 aa, Mycobacterium tuberculosis
ESLAGASAAI

SEQ ID NO: 17445 - protein, 10 aa, Mycobacterium tuberculosis
SLAGASAAIE

SEQ ID NO: 17446 - protein, 10 aa, Mycobacterium tuberculosis
LAGASAAIEA

SEQ ID NO: 17447 - protein, 10 aa, Mycobacterium tuberculosis
AGASAAIEAV

SEQ ID NO: 17448 - protein, 10 aa, Mycobacterium tuberculosis
GASAAIEAVT

SEQ ID NO: 17449 - protein, 10 aa, Mycobacterium tuberculosis
ASAAIEAVTA

SEQ ID NO: 17450 - protein, 10 aa, Mycobacterium tuberculosis
SAAIEAVTAR

SEQ ID NO: 17451 - protein, 10 aa, Mycobacterium tuberculosis
AAIEAVTARL

SEQ ID NO: 17452 - protein, 10 aa, Mycobacterium tuberculosis
AIEAVTARLA

SEQ ID NO: 17453 - protein, 10 aa, Mycobacterium tuberculosis
IEAVTARLAA

SEQ ID NO: 17454 - protein, 10 aa, Mycobacterium tuberculosis
EAVTARLAAA

SEQ ID NO: 17455 - protein, 10 aa, Mycobacterium tuberculosis
AVTARLAAAH

SEQ ID NO: 17456 - protein, 10 aa, Mycobacterium tuberculosis
VTARLAAAHA

SEQ ID NO: 17457 - protein, 10 aa, Mycobacterium tuberculosis
TARLAAAHAA

SEQ ID NO: 17458 - protein, 10 aa, Mycobacterium tuberculosis
ARLAAAHAAA

SEQ ID NO: 17459 - protein, 10 aa, Mycobacterium tuberculosis
RLAAAHAAAA

SEQ ID NO: 17460 - protein, 10 aa, Mycobacterium tuberculosis
LAAAHAAAAP

SEQ ID NO: 17461 - protein, 10 aa, Mycobacterium tuberculosis
AAAHAAAAPF

SEQ ID NO: 17462 - protein, 10 aa, Mycobacterium tuberculosis
AAHAAAAPFI

SEQ ID NO: 17463 - protein, 10 aa, Mycobacterium tuberculosis
AHAAAAPFIA

SEQ ID NO: 17464 - protein, 10 aa, Mycobacterium tuberculosis
HAAAAPFIAA

SEQ ID NO: 17465 - protein, 10 aa, Mycobacterium tuberculosis
AAAAPFIAAV

SEQ ID NO: 17466 - protein, 10 aa, Mycobacterium tuberculosis
AAAPFIAAVI

SEQ ID NO: 17467 - protein, 10 aa, Mycobacterium tuberculosis
AAPFIAAVIP

SEQ ID NO: 17468 - protein, 10 aa, Mycobacterium tuberculosis
APFIAAVIPP

SEQ ID NO: 17469 - protein, 10 aa, Mycobacterium tuberculosis
PFIAAVIPPG

SEQ ID NO: 17470 - protein, 10 aa, Mycobacterium tuberculosis
FIAAVIPPGS

SEQ ID NO: 17471 - protein, 10 aa, Mycobacterium tuberculosis
IAAVIPPGSD

SEQ ID NO: 17472 - protein, 10 aa, Mycobacterium tuberculosis
AAVIPPGSDS

SEQ ID NO: 17473 - protein, 10 aa, Mycobacterium tuberculosis
AVIPPGSDSV

SEQ ID NO: 17474 - protein, 10 aa, Mycobacterium tuberculosis
VIPPGSDSVS

SEQ ID NO: 17475 - protein, 10 aa, Mycobacterium tuberculosis
IPPGSDSVSV

SEQ ID NO: 17476 - protein, 10 aa, Mycobacterium tuberculosis
PPGSDSVSVC

SEQ ID NO: 17477 - protein, 10 aa, Mycobacterium tuberculosis
PGSDSVSVCN

SEQ ID NO: 17478 - protein, 10 aa, Mycobacterium tuberculosis
GSDSVSVCNA

SEQ ID NO: 17479 - protein, 10 aa, Mycobacterium tuberculosis
SDSVSVCNAV

SEQ ID NO: 17480 - protein, 10 aa, Mycobacterium tuberculosis
DSVSVCNAVE

SEQ ID NO: 17481 - protein, 10 aa, Mycobacterium tuberculosis
SVSVCNAVEF

SEQ ID NO: 17482 - protein, 10 aa, Mycobacterium tuberculosis
VSVCNAVEFS

SEQ ID NO: 17483 - protein, 10 aa, Mycobacterium tuberculosis
SVCNAVEFSV

SEQ ID NO: 17484 - protein, 10 aa, Mycobacterium tuberculosis
VCNAVEFSVH

SEQ ID NO: 17485 - protein, 10 aa, Mycobacterium tuberculosis
CNAVEFSVHG

SEQ ID NO: 17486 - protein, 10 aa, Mycobacterium tuberculosis
NAVEFSVHGS

SEQ ID NO: 17487 - protein, 10 aa, Mycobacterium tuberculosis
AVEFSVHGSQ

SEQ ID NO: 17488 - protein, 10 aa, Mycobacterium tuberculosis
VEFSVHGSQH

SEQ ID NO: 17489 - protein, 10 aa, Mycobacterium tuberculosis
EFSVHGSQHV

SEQ ID NO: 17490 - protein, 10 aa, Mycobacterium tuberculosis
FSVHGSQHVA

SEQ ID NO: 17491 - protein, 10 aa, Mycobacterium tuberculosis
SVHGSQHVAM

SEQ ID NO: 17492 - protein, 10 aa, Mycobacterium tuberculosis
VHGSQHVAMA

SEQ ID NO: 17493 - protein, 10 aa, Mycobacterium tuberculosis
HGSQHVAMAA

SEQ ID NO: 17494 - protein, 10 aa, Mycobacterium tuberculosis
GSQHVAMAAQ

SEQ ID NO: 17495 - protein, 10 aa, Mycobacterium tuberculosis
SQHVAMAAQG

SEQ ID NO: 17496 - protein, 10 aa, Mycobacterium tuberculosis
QHVAMAAQGV

SEQ ID NO: 17497 - protein, 10 aa, Mycobacterium tuberculosis
HVAMAAQGVE

SEQ ID NO: 17498 - protein, 10 aa, Mycobacterium tuberculosis
VAMAAQGVEE

SEQ ID NO: 17499 - protein, 10 aa, Mycobacterium tuberculosis
AMAAQGVEEL

SEQ ID NO: 17500 - protein, 10 aa, Mycobacterium tuberculosis
MAAQGVEELG

SEQ ID NO: 17501 - protein, 10 aa, Mycobacterium tuberculosis
AAQGVEELGR

SEQ ID NO: 17502 - protein, 10 aa, Mycobacterium tuberculosis
AQGVEELGRS

SEQ ID NO: 17503 - protein, 10 aa, Mycobacterium tuberculosis
QGVEELGRSG

SEQ ID NO: 17504 - protein, 10 aa, Mycobacterium tuberculosis
GVEELGRSGV

SEQ ID NO: 17505 - protein, 10 aa, Mycobacterium tuberculosis
VEELGRSGVG

SEQ ID NO: 17506 - protein, 10 aa, Mycobacterium tuberculosis
EELGRSGVGV

SEQ ID NO: 17507 - protein, 10 aa, Mycobacterium tuberculosis
ELGRSGVGVA

SEQ ID NO: 17508 - protein, 10 aa, Mycobacterium tuberculosis
LGRSGVGVAE

SEQ ID NO: 17509 - protein, 10 aa, Mycobacterium tuberculosis
GRSGVGVAES

SEQ ID NO: 17510 - protein, 10 aa, Mycobacterium tuberculosis
RSGVGVAESG

SEQ ID NO: 17511 - protein, 10 aa, Mycobacterium tuberculosis
SGVGVAESGA

SEQ ID NO: 17512 - protein, 10 aa, Mycobacterium tuberculosis
GVGVAESGAS

SEQ ID NO: 17513 - protein, 10 aa, Mycobacterium tuberculosis
VGVAESGASY

SEQ ID NO: 17514 - protein, 10 aa, Mycobacterium tuberculosis
GVAESGASYA

SEQ ID NO: 17515 - protein, 10 aa, Mycobacterium tuberculosis
VAESGASYAA

SEQ ID NO: 17516 - protein, 10 aa, Mycobacterium tuberculosis
AESGASYAAR

SEQ ID NO: 17517 - protein, 10 aa, Mycobacterium tuberculosis
ESGASYAARD

SEQ ID NO: 17518 - protein, 10 aa, Mycobacterium tuberculosis
SGASYAARDA

SEQ ID NO: 17519 - protein, 10 aa, Mycobacterium tuberculosis
GASYAARDAL

SEQ ID NO: 17520 - protein, 10 aa, Mycobacterium tuberculosis
ASYAARDALA

SEQ ID NO: 17521 - protein, 10 aa, Mycobacterium tuberculosis
SYAARDALAA

SEQ ID NO: 17522 - protein, 10 aa, Mycobacterium tuberculosis
YAARDALAAA

SEQ ID NO: 17523 - protein, 10 aa, Mycobacterium tuberculosis
AARDALAAAS

SEQ ID NO: 17524 - protein, 10 aa, Mycobacterium tuberculosis
ARDALAAASY

SEQ ID NO: 17525 - protein, 10 aa, Mycobacterium tuberculosis
RDALAAASYL

SEQ ID NO: 17526 - protein, 10 aa, Mycobacterium tuberculosis
DALAAASYLS

SEQ ID NO: 17527 - protein, 10 aa, Mycobacterium tuberculosis
ALAAASYLSG

SEQ ID NO: 17528 - protein, 10 aa, Mycobacterium tuberculosis
LAAASYLSGG

SEQ ID NO: 17529 - protein, 10 aa, Mycobacterium tuberculosis
AAASYLSGGL

SEQ ID NO: 17530 - protein, 11 aa, Mycobacterium tuberculosis
MTLRVVPESLA

SEQ ID NO: 17531 - protein, 11 aa, Mycobacterium tuberculosis
TLRVVPESLAG

SEQ ID NO: 17532 - protein, 11 aa, Mycobacterium tuberculosis
LRVVPESLAGA

SEQ ID NO: 17533 - protein, 11 aa, Mycobacterium tuberculosis
RVVPESLAGAS

SEQ ID NO: 17534 - protein, 11 aa, Mycobacterium tuberculosis
VVPESLAGASA

SEQ ID NO: 17535 - protein, 11 aa, Mycobacterium tuberculosis
VPESLAGASAA

SEQ ID NO: 17536 - protein, 11 aa, Mycobacterium tuberculosis
PESLAGASAAI

SEQ ID NO: 17537 - protein, 11 aa, Mycobacterium tuberculosis
ESLAGASAAIE

SEQ ID NO: 17538 - protein, 11 aa, Mycobacterium tuberculosis
SLAGASAAIEA

SEQ ID NO: 17539 - protein, 11 aa, Mycobacterium tuberculosis
LAGASAAIEAV

SEQ ID NO: 17540 - protein, 11 aa, Mycobacterium tuberculosis
AGASAAIEAVT

SEQ ID NO: 17541 - protein, 11 aa, Mycobacterium tuberculosis
GASAAIEAVTA

SEQ ID NO: 17542 - protein, 11 aa, Mycobacterium tuberculosis
ASAAIEAVTAR

SEQ ID NO: 17543 - protein, 11 aa, Mycobacterium tuberculosis
SAAIEAVTARL

SEQ ID NO: 17544 - protein, 11 aa, Mycobacterium tuberculosis
AAIEAVTARLA

SEQ ID NO: 17545 - protein, 11 aa, Mycobacterium tuberculosis
AIEAVTARLAA

SEQ ID NO: 17546 - protein, 11 aa, Mycobacterium tuberculosis
IEAVTARLAAA

SEQ ID NO: 17547 - protein, 11 aa, Mycobacterium tuberculosis
EAVTARLAAAH

SEQ ID NO: 17548 - protein, 11 aa, Mycobacterium tuberculosis
AVTARLAAAHA

SEQ ID NO: 17549 - protein, 11 aa, Mycobacterium tuberculosis
VTARLAAAHAA

SEQ ID NO: 17550 - protein, 11 aa, Mycobacterium tuberculosis
TARLAAAHAAA

SEQ ID NO: 17551 - protein, 11 aa, Mycobacterium tuberculosis
ARLAAAHAAAA

SEQ ID NO: 17552 - protein, 11 aa, Mycobacterium tuberculosis
RLAAAHAAAAP

SEQ ID NO: 17553 - protein, 11 aa, Mycobacterium tuberculosis
LAAAHAAAAPF

SEQ ID NO: 17554 - protein, 11 aa, Mycobacterium tuberculosis
AAAHAAAAPFI

SEQ ID NO: 17555 - protein, 11 aa, Mycobacterium tuberculosis
AAHAAAAPFIA

SEQ ID NO: 17556 - protein, 11 aa, Mycobacterium tuberculosis
AHAAAAPFIAA

SEQ ID NO: 17557 - protein, 11 aa, Mycobacterium tuberculosis
HAAAAPFIAAV

SEQ ID NO: 17558 - protein, 11 aa, Mycobacterium tuberculosis
AAAAPFIAAVI

SEQ ID NO: 17559 - protein, 11 aa, Mycobacterium tuberculosis
AAAPFIAAVIP

SEQ ID NO: 17560 - protein, 11 aa, Mycobacterium tuberculosis
AAPFIAAVIPP

SEQ ID NO: 17561 - protein, 11 aa, Mycobacterium tuberculosis
APFIAAVIPPG

SEQ ID NO: 17562 - protein, 11 aa, Mycobacterium tuberculosis
PFIAAVIPPGS

SEQ ID NO: 17563 - protein, 11 aa, Mycobacterium tuberculosis
FIAAVIPPGSD

SEQ ID NO: 17564 - protein, 11 aa, Mycobacterium tuberculosis
IAAVIPPGSDS

SEQ ID NO: 17565 - protein, 11 aa, Mycobacterium tuberculosis
AAVIPPGSDSV

SEQ ID NO: 17566 - protein, 11 aa, Mycobacterium tuberculosis
AVIPPGSDSVS

SEQ ID NO: 17567 - protein, 11 aa, Mycobacterium tuberculosis
VIPPGSDSVSV

SEQ ID NO: 17568 - protein, 11 aa, Mycobacterium tuberculosis
IPPGSDSVSVC

SEQ ID NO: 17569 - protein, 11 aa, Mycobacterium tuberculosis
PPGSDSVSVCN

SEQ ID NO: 17570 - protein, 11 aa, Mycobacterium tuberculosis
PGSDSVSVCNA

SEQ ID NO: 17571 - protein, 11 aa, Mycobacterium tuberculosis
GSDSVSVCNAV

SEQ ID NO: 17572 - protein, 11 aa, Mycobacterium tuberculosis
SDSVSVCNAVE

SEQ ID NO: 17573 - protein, 11 aa, Mycobacterium tuberculosis
DSVSVCNAVEF

SEQ ID NO: 17574 - protein, 11 aa, Mycobacterium tuberculosis
SVSVCNAVEFS

SEQ ID NO: 17575 - protein, 11 aa, Mycobacterium tuberculosis
VSVCNAVEFSV

SEQ ID NO: 17576 - protein, 11 aa, Mycobacterium tuberculosis
SVCNAVEFSVH

SEQ ID NO: 17577 - protein, 11 aa, Mycobacterium tuberculosis
VCNAVEFSVHG

SEQ ID NO: 17578 - protein, 11 aa, Mycobacterium tuberculosis
CNAVEFSVHGS

SEQ ID NO: 17579 - protein, 11 aa, Mycobacterium tuberculosis
NAVEFSVHGSQ

SEQ ID NO: 17580 - protein, 11 aa, Mycobacterium tuberculosis
AVEFSVHGSQH

SEQ ID NO: 17581 - protein, 11 aa, Mycobacterium tuberculosis
VEFSVHGSQHV

SEQ ID NO: 17582 - protein, 11 aa, Mycobacterium tuberculosis
EFSVHGSQHVA

SEQ ID NO: 17583 - protein, 11 aa, Mycobacterium tuberculosis
FSVHGSQHVAM

SEQ ID NO: 17584 - protein, 11 aa, Mycobacterium tuberculosis
SVHGSQHVAMA

SEQ ID NO: 17585 - protein, 11 aa, Mycobacterium tuberculosis
VHGSQHVAMAA

SEQ ID NO: 17586 - protein, 11 aa, Mycobacterium tuberculosis
HGSQHVAMAAQ

SEQ ID NO: 17587 - protein, 11 aa, Mycobacterium tuberculosis
GSQHVAMAAQG

SEQ ID NO: 17588 - protein, 11 aa, Mycobacterium tuberculosis
SQHVAMAAQGV

SEQ ID NO: 17589 - protein, 11 aa, Mycobacterium tuberculosis
QHVAMAAQGVE

SEQ ID NO: 17590 - protein, 11 aa, Mycobacterium tuberculosis
HVAMAAQGVEE

SEQ ID NO: 17591 - protein, 11 aa, Mycobacterium tuberculosis
VAMAAQGVEEL

SEQ ID NO: 17592 - protein, 11 aa, Mycobacterium tuberculosis
AMAAQGVEELG

SEQ ID NO: 17593 - protein, 11 aa, Mycobacterium tuberculosis
MAAQGVEELGR

SEQ ID NO: 17594 - protein, 11 aa, Mycobacterium tuberculosis
AAQGVEELGRS

SEQ ID NO: 17595 - protein, 11 aa, Mycobacterium tuberculosis
AQGVEELGRSG

SEQ ID NO: 17596 - protein, 11 aa, Mycobacterium tuberculosis
QGVEELGRSGV

SEQ ID NO: 17597 - protein, 11 aa, Mycobacterium tuberculosis
GVEELGRSGVG

SEQ ID NO: 17598 - protein, 11 aa, Mycobacterium tuberculosis
VEELGRSGVGV

SEQ ID NO: 17599 - protein, 11 aa, Mycobacterium tuberculosis
EELGRSGVGVA

SEQ ID NO: 17600 - protein, 11 aa, Mycobacterium tuberculosis
ELGRSGVGVAE

SEQ ID NO: 17601 - protein, 11 aa, Mycobacterium tuberculosis
LGRSGVGVAES

SEQ ID NO: 17602 - protein, 11 aa, Mycobacterium tuberculosis
GRSGVGVAESG

SEQ ID NO: 17603 - protein, 11 aa, Mycobacterium tuberculosis
RSGVGVAESGA

SEQ ID NO: 17604 - protein, 11 aa, Mycobacterium tuberculosis
SGVGVAESGAS

SEQ ID NO: 17605 - protein, 11 aa, Mycobacterium tuberculosis
GVGVAESGASY

SEQ ID NO: 17606 - protein, 11 aa, Mycobacterium tuberculosis
VGVAESGASYA

SEQ ID NO: 17607 - protein, 11 aa, Mycobacterium tuberculosis
GVAESGASYAA

SEQ ID NO: 17608 - protein, 11 aa, Mycobacterium tuberculosis
VAESGASYAAR

SEQ ID NO: 17609 - protein, 11 aa, Mycobacterium tuberculosis
AESGASYAARD

SEQ ID NO: 17610 - protein, 11 aa, Mycobacterium tuberculosis
ESGASYAARDA

SEQ ID NO: 17611 - protein, 11 aa, Mycobacterium tuberculosis
SGASYAARDAL

SEQ ID NO: 17612 - protein, 11 aa, Mycobacterium tuberculosis
GASYAARDALA

SEQ ID NO: 17613 - protein, 11 aa, Mycobacterium tuberculosis
ASYAARDALAA

SEQ ID NO: 17614 - protein, 11 aa, Mycobacterium tuberculosis
SYAARDALAAA

SEQ ID NO: 17615 - protein, 11 aa, Mycobacterium tuberculosis
YAARDALAAAS

SEQ ID NO: 17616 - protein, 11 aa, Mycobacterium tuberculosis
AARDALAAASY

SEQ ID NO: 17617 - protein, 11 aa, Mycobacterium tuberculosis
ARDALAAASYL

SEQ ID NO: 17618 - protein, 11 aa, Mycobacterium tuberculosis
RDALAAASYLS

SEQ ID NO: 17619 - protein, 11 aa, Mycobacterium tuberculosis
DALAAASYLSG

SEQ ID NO: 17620 - protein, 11 aa, Mycobacterium tuberculosis
ALAAASYLSGG

SEQ ID NO: 17621 - protein, 11 aa, Mycobacterium tuberculosis
LAAASYLSGGL

SEQ ID NO: 17622 - protein, 8 aa, Mycobacterium tuberculosis
MPHRCAAQ

SEQ ID NO: 17623 - protein, 8 aa, Mycobacterium tuberculosis
PHRCAAQV

SEQ ID NO: 17624 - protein, 8 aa, Mycobacterium tuberculosis
HRCAAQVV

SEQ ID NO: 17625 - protein, 8 aa, Mycobacterium tuberculosis
RCAAQVVA

SEQ ID NO: 17626 - protein, 8 aa, Mycobacterium tuberculosis
CAAQVVAG

SEQ ID NO: 17627 - protein, 8 aa, Mycobacterium tuberculosis
AAQVVAGY

SEQ ID NO: 17628 - protein, 8 aa, Mycobacterium tuberculosis
AQVVAGYR

SEQ ID NO: 17629 - protein, 8 aa, Mycobacterium tuberculosis
QVVAGYRS

SEQ ID NO: 17630 - protein, 8 aa, Mycobacterium tuberculosis
VVAGYRST

SEQ ID NO: 17631 - protein, 8 aa, Mycobacterium tuberculosis
VAGYRSTV

SEQ ID NO: 17632 - protein, 8 aa, Mycobacterium tuberculosis
AGYRSTVS

SEQ ID NO: 17633 - protein, 8 aa, Mycobacterium tuberculosis
GYRSTVSL

SEQ ID NO: 17634 - protein, 8 aa, Mycobacterium tuberculosis
YRSTVSLV

SEQ ID NO: 17635 - protein, 8 aa, Mycobacterium tuberculosis
RSTVSLVL

SEQ ID NO: 17636 - protein, 8 aa, Mycobacterium tuberculosis
STVSLVLV

SEQ ID NO: 17637 - protein, 8 aa, Mycobacterium tuberculosis
TVSLVLVE

SEQ ID NO: 17638 - protein, 8 aa, Mycobacterium tuberculosis
VSLVLVEH

SEQ ID NO: 17639 - protein, 8 aa, Mycobacterium tuberculosis
SLVLVEHP

SEQ ID NO: 17640 - protein, 8 aa, Mycobacterium tuberculosis
LVLVEHPR

SEQ ID NO: 17641 - protein, 8 aa, Mycobacterium tuberculosis
VLVEHPRP

SEQ ID NO: 17642 - protein, 8 aa, Mycobacterium tuberculosis
LVEHPRPE

SEQ ID NO: 17643 - protein, 8 aa, Mycobacterium tuberculosis
VEHPRPEI

SEQ ID NO: 17644 - protein, 8 aa, Mycobacterium tuberculosis
EHPRPEIA

SEQ ID NO: 17645 - protein, 8 aa, Mycobacterium tuberculosis
HPRPEIAQ

SEQ ID NO: 17646 - protein, 8 aa, Mycobacterium tuberculosis
PRPEIAQI

SEQ ID NO: 17647 - protein, 8 aa, Mycobacterium tuberculosis
RPEIAQIT

SEQ ID NO: 17648 - protein, 8 aa, Mycobacterium tuberculosis
PEIAQITL

SEQ ID NO: 17649 - protein, 8 aa, Mycobacterium tuberculosis
EIAQITLN

SEQ ID NO: 17650 - protein, 8 aa, Mycobacterium tuberculosis
IAQITLNR

SEQ ID NO: 17651 - protein, 8 aa, Mycobacterium tuberculosis
AQITLNRP

SEQ ID NO: 17652 - protein, 8 aa, Mycobacterium tuberculosis
QITLNRPE

SEQ ID NO: 17653 - protein, 8 aa, Mycobacterium tuberculosis
ITLNRPER

SEQ ID NO: 17654 - protein, 8 aa, Mycobacterium tuberculosis
TLNRPERM

SEQ ID NO: 17655 - protein, 8 aa, Mycobacterium tuberculosis
LNRPERMN

SEQ ID NO: 17656 - protein, 8 aa, Mycobacterium tuberculosis
NRPERMNS

SEQ ID NO: 17657 - protein, 8 aa, Mycobacterium tuberculosis
RPERMNSM

SEQ ID NO: 17658 - protein, 8 aa, Mycobacterium tuberculosis
PERMNSMA

SEQ ID NO: 17659 - protein, 8 aa, Mycobacterium tuberculosis
ERMNSMAF

SEQ ID NO: 17660 - protein, 8 aa, Mycobacterium tuberculosis
RMNSMAFD

SEQ ID NO: 17661 - protein, 8 aa, Mycobacterium tuberculosis
MNSMAFDV

SEQ ID NO: 17662 - protein, 8 aa, Mycobacterium tuberculosis
NSMAFDVM

SEQ ID NO: 17663 - protein, 8 aa, Mycobacterium tuberculosis
SMAFDVMV

SEQ ID NO: 17664 - protein, 8 aa, Mycobacterium tuberculosis
MAFDVMVP

SEQ ID NO: 17665 - protein, 8 aa, Mycobacterium tuberculosis
AFDVMVPL

SEQ ID NO: 17666 - protein, 8 aa, Mycobacterium tuberculosis
FDVMVPLK

SEQ ID NO: 17667 - protein, 8 aa, Mycobacterium tuberculosis
DVMVPLKE

SEQ ID NO: 17668 - protein, 8 aa, Mycobacterium tuberculosis
VMVPLKEA

SEQ ID NO: 17669 - protein, 8 aa, Mycobacterium tuberculosis
MVPLKEAL

SEQ ID NO: 17670 - protein, 8 aa, Mycobacterium tuberculosis
VPLKEALA

SEQ ID NO: 17671 - protein, 8 aa, Mycobacterium tuberculosis
PLKEALAQ

SEQ ID NO: 17672 - protein, 8 aa, Mycobacterium tuberculosis
LKEALAQV

SEQ ID NO: 17673 - protein, 8 aa, Mycobacterium tuberculosis
KEALAQVS

SEQ ID NO: 17674 - protein, 8 aa, Mycobacterium tuberculosis
EALAQVSY

SEQ ID NO: 17675 - protein, 8 aa, Mycobacterium tuberculosis
ALAQVSYD

SEQ ID NO: 17676 - protein, 8 aa, Mycobacterium tuberculosis
LAQVSYDN

SEQ ID NO: 17677 - protein, 8 aa, Mycobacterium tuberculosis
AQVSYDNS

SEQ ID NO: 17678 - protein, 8 aa, Mycobacterium tuberculosis
QVSYDNSV

SEQ ID NO: 17679 - protein, 8 aa, Mycobacterium tuberculosis
VSYDNSVR

SEQ ID NO: 17680 - protein, 8 aa, Mycobacterium tuberculosis
SYDNSVRV

SEQ ID NO: 17681 - protein, 8 aa, Mycobacterium tuberculosis
YDNSVRVV

SEQ ID NO: 17682 - protein, 8 aa, Mycobacterium tuberculosis
DNSVRVVV

SEQ ID NO: 17683 - protein, 8 aa, Mycobacterium tuberculosis
NSVRVVVL

SEQ ID NO: 17684 - protein, 8 aa, Mycobacterium tuberculosis
SVRVVVLT

SEQ ID NO: 17685 - protein, 8 aa, Mycobacterium tuberculosis
VRVVVLTG

SEQ ID NO: 17686 - protein, 8 aa, Mycobacterium tuberculosis
RVVVLTGA

SEQ ID NO: 17687 - protein, 8 aa, Mycobacterium tuberculosis
VVVLTGAG

SEQ ID NO: 17688 - protein, 8 aa, Mycobacterium tuberculosis
VVLTGAGR

SEQ ID NO: 17689 - protein, 8 aa, Mycobacterium tuberculosis
VLTGAGRG

SEQ ID NO: 17690 - protein, 8 aa, Mycobacterium tuberculosis
LTGAGRGF

SEQ ID NO: 17691 - protein, 8 aa, Mycobacterium tuberculosis
TGAGRGFS

SEQ ID NO: 17692 - protein, 8 aa, Mycobacterium tuberculosis
GAGRGFSP

SEQ ID NO: 17693 - protein, 8 aa, Mycobacterium tuberculosis
AGRGFSPG

SEQ ID NO: 17694 - protein, 8 aa, Mycobacterium tuberculosis
GRGFSPGA

SEQ ID NO: 17695 - protein, 8 aa, Mycobacterium tuberculosis
RGFSPGAD

SEQ ID NO: 17696 - protein, 8 aa, Mycobacterium tuberculosis
GFSPGADH

SEQ ID NO: 17697 - protein, 8 aa, Mycobacterium tuberculosis
FSPGADHK

SEQ ID NO: 17698 - protein, 8 aa, Mycobacterium tuberculosis
SPGADHKS

SEQ ID NO: 17699 - protein, 8 aa, Mycobacterium tuberculosis
PGADHKSA

SEQ ID NO: 17700 - protein, 8 aa, Mycobacterium tuberculosis
GADHKSAG

SEQ ID NO: 17701 - protein, 8 aa, Mycobacterium tuberculosis
ADHKSAGV

SEQ ID NO: 17702 - protein, 8 aa, Mycobacterium tuberculosis
DHKSAGVV

SEQ ID NO: 17703 - protein, 8 aa, Mycobacterium tuberculosis
HKSAGVVP

SEQ ID NO: 17704 - protein, 8 aa, Mycobacterium tuberculosis
KSAGVVPH

SEQ ID NO: 17705 - protein, 8 aa, Mycobacterium tuberculosis
SAGVVPHV

SEQ ID NO: 17706 - protein, 8 aa, Mycobacterium tuberculosis
AGVVPHVE

SEQ ID NO: 17707 - protein, 8 aa, Mycobacterium tuberculosis
GVVPHVEN

SEQ ID NO: 17708 - protein, 8 aa, Mycobacterium tuberculosis
VVPHVENL

SEQ ID NO: 17709 - protein, 8 aa, Mycobacterium tuberculosis
VPHVENLT

SEQ ID NO: 17710 - protein, 8 aa, Mycobacterium tuberculosis
PHVENLTR

SEQ ID NO: 17711 - protein, 8 aa, Mycobacterium tuberculosis
HVENLTRP

SEQ ID NO: 17712 - protein, 8 aa, Mycobacterium tuberculosis
VENLTRPT

SEQ ID NO: 17713 - protein, 8 aa, Mycobacterium tuberculosis
ENLTRPTY

SEQ ID NO: 17714 - protein, 8 aa, Mycobacterium tuberculosis
NLTRPTYA

SEQ ID NO: 17715 - protein, 8 aa, Mycobacterium tuberculosis
LTRPTYAL

SEQ ID NO: 17716 - protein, 8 aa, Mycobacterium tuberculosis
TRPTYALR

SEQ ID NO: 17717 - protein, 8 aa, Mycobacterium tuberculosis
RPTYALRS

SEQ ID NO: 17718 - protein, 8 aa, Mycobacterium tuberculosis
PTYALRSM

SEQ ID NO: 17719 - protein, 8 aa, Mycobacterium tuberculosis
TYALRSME

SEQ ID NO: 17720 - protein, 8 aa, Mycobacterium tuberculosis
YALRSMEL

SEQ ID NO: 17721 - protein, 8 aa, Mycobacterium tuberculosis
ALRSMELL

SEQ ID NO: 17722 - protein, 8 aa, Mycobacterium tuberculosis
LRSMELLD

SEQ ID NO: 17723 - protein, 8 aa, Mycobacterium tuberculosis
RSMELLDD

SEQ ID NO: 17724 - protein, 8 aa, Mycobacterium tuberculosis
SMELLDDV

SEQ ID NO: 17725 - protein, 8 aa, Mycobacterium tuberculosis
MELLDDVI

SEQ ID NO: 17726 - protein, 8 aa, Mycobacterium tuberculosis
ELLDDVIL

SEQ ID NO: 17727 - protein, 8 aa, Mycobacterium tuberculosis
LLDDVILM

SEQ ID NO: 17728 - protein, 8 aa, Mycobacterium tuberculosis
LDDVILML

SEQ ID NO: 17729 - protein, 8 aa, Mycobacterium tuberculosis
DDVILMLR

SEQ ID NO: 17730 - protein, 8 aa, Mycobacterium tuberculosis
DVILMLRR

SEQ ID NO: 17731 - protein, 8 aa, Mycobacterium tuberculosis
VILMLRRL

SEQ ID NO: 17732 - protein, 8 aa, Mycobacterium tuberculosis
ILMLRRLH

SEQ ID NO: 17733 - protein, 8 aa, Mycobacterium tuberculosis
LMLRRLHQ

SEQ ID NO: 17734 - protein, 8 aa, Mycobacterium tuberculosis
MLRRLHQP

SEQ ID NO: 17735 - protein, 8 aa, Mycobacterium tuberculosis
LRRLHQPV

SEQ ID NO: 17736 - protein, 8 aa, Mycobacterium tuberculosis
RRLHQPVI

SEQ ID NO: 17737 - protein, 8 aa, Mycobacterium tuberculosis
RLHQPVIA

SEQ ID NO: 17738 - protein, 8 aa, Mycobacterium tuberculosis
LHQPVIAA

SEQ ID NO: 17739 - protein, 8 aa, Mycobacterium tuberculosis
HQPVIAAV

SEQ ID NO: 17740 - protein, 8 aa, Mycobacterium tuberculosis
QPVIAAVN

SEQ ID NO: 17741 - protein, 8 aa, Mycobacterium tuberculosis
PVIAAVNG

SEQ ID NO: 17742 - protein, 8 aa, Mycobacterium tuberculosis
VIAAVNGP

SEQ ID NO: 17743 - protein, 8 aa, Mycobacterium tuberculosis
IAAVNGPA

SEQ ID NO: 17744 - protein, 8 aa, Mycobacterium tuberculosis
AAVNGPAI

SEQ ID NO: 17745 - protein, 8 aa, Mycobacterium tuberculosis
AVNGPAIG

SEQ ID NO: 17746 - protein, 8 aa, Mycobacterium tuberculosis
VNGPAIGG

SEQ ID NO: 17747 - protein, 8 aa, Mycobacterium tuberculosis
NGPAIGGG

SEQ ID NO: 17748 - protein, 8 aa, Mycobacterium tuberculosis
GPAIGGGL

SEQ ID NO: 17749 - protein, 8 aa, Mycobacterium tuberculosis
PAIGGGLC

SEQ ID NO: 17750 - protein, 8 aa, Mycobacterium tuberculosis
AIGGGLCL

SEQ ID NO: 17751 - protein, 8 aa, Mycobacterium tuberculosis
IGGGLCLA

SEQ ID NO: 17752 - protein, 8 aa, Mycobacterium tuberculosis
GGGLCLAL

SEQ ID NO: 17753 - protein, 8 aa, Mycobacterium tuberculosis
GGLCLALA

SEQ ID NO: 17754 - protein, 8 aa, Mycobacterium tuberculosis
GLCLALAA

SEQ ID NO: 17755 - protein, 8 aa, Mycobacterium tuberculosis
LCLALAAD

SEQ ID NO: 17756 - protein, 8 aa, Mycobacterium tuberculosis
CLALAADI

SEQ ID NO: 17757 - protein, 8 aa, Mycobacterium tuberculosis
LALAADIR

SEQ ID NO: 17758 - protein, 8 aa, Mycobacterium tuberculosis
ALAADIRV

SEQ ID NO: 17759 - protein, 8 aa, Mycobacterium tuberculosis
LAADIRVA

SEQ ID NO: 17760 - protein, 8 aa, Mycobacterium tuberculosis
AADIRVAS

SEQ ID NO: 17761 - protein, 8 aa, Mycobacterium tuberculosis
ADIRVASS

SEQ ID NO: 17762 - protein, 8 aa, Mycobacterium tuberculosis
DIRVASSS

SEQ ID NO: 17763 - protein, 8 aa, Mycobacterium tuberculosis
IRVASSSA

SEQ ID NO: 17764 - protein, 8 aa, Mycobacterium tuberculosis
RVASSSAY

SEQ ID NO: 17765 - protein, 8 aa, Mycobacterium tuberculosis
VASSSAYF

SEQ ID NO: 17766 - protein, 8 aa, Mycobacterium tuberculosis
ASSSAYFR

SEQ ID NO: 17767 - protein, 8 aa, Mycobacterium tuberculosis
SSSAYFRA

SEQ ID NO: 17768 - protein, 8 aa, Mycobacterium tuberculosis
SSAYFRAA

SEQ ID NO: 17769 - protein, 8 aa, Mycobacterium tuberculosis
SAYFRAAG

SEQ ID NO: 17770 - protein, 8 aa, Mycobacterium tuberculosis
AYFRAAGI

SEQ ID NO: 17771 - protein, 8 aa, Mycobacterium tuberculosis
YFRAAGIN

SEQ ID NO: 17772 - protein, 8 aa, Mycobacterium tuberculosis
FRAAGINN

SEQ ID NO: 17773 - protein, 8 aa, Mycobacterium tuberculosis
RAAGINNG

SEQ ID NO: 17774 - protein, 8 aa, Mycobacterium tuberculosis
AAGINNGL

SEQ ID NO: 17775 - protein, 8 aa, Mycobacterium tuberculosis
AGINNGLT

SEQ ID NO: 17776 - protein, 8 aa, Mycobacterium tuberculosis
GINNGLTA

SEQ ID NO: 17777 - protein, 8 aa, Mycobacterium tuberculosis
INNGLTAS

SEQ ID NO: 17778 - protein, 8 aa, Mycobacterium tuberculosis
NNGLTASE

SEQ ID NO: 17779 - protein, 8 aa, Mycobacterium tuberculosis
NGLTASEL

SEQ ID NO: 17780 - protein, 8 aa, Mycobacterium tuberculosis
GLTASELG

SEQ ID NO: 17781 - protein, 8 aa, Mycobacterium tuberculosis
LTASELGL

SEQ ID NO: 17782 - protein, 8 aa, Mycobacterium tuberculosis
TASELGLS

SEQ ID NO: 17783 - protein, 8 aa, Mycobacterium tuberculosis
ASELGLSY

SEQ ID NO: 17784 - protein, 8 aa, Mycobacterium tuberculosis
SELGLSYL

SEQ ID NO: 17785 - protein, 8 aa, Mycobacterium tuberculosis
ELGLSYLL

SEQ ID NO: 17786 - protein, 8 aa, Mycobacterium tuberculosis
LGLSYLLP

SEQ ID NO: 17787 - protein, 8 aa, Mycobacterium tuberculosis
GLSYLLPR

SEQ ID NO: 17788 - protein, 8 aa, Mycobacterium tuberculosis
LSYLLPRA

SEQ ID NO: 17789 - protein, 8 aa, Mycobacterium tuberculosis
SYLLPRAI

SEQ ID NO: 17790 - protein, 8 aa, Mycobacterium tuberculosis
YLLPRAIG

SEQ ID NO: 17791 - protein, 8 aa, Mycobacterium tuberculosis
LLPRAIGS

SEQ ID NO: 17792 - protein, 8 aa, Mycobacterium tuberculosis
LPRAIGSS

SEQ ID NO: 17793 - protein, 8 aa, Mycobacterium tuberculosis
PRAIGSSR

SEQ ID NO: 17794 - protein, 8 aa, Mycobacterium tuberculosis
RAIGSSRA

SEQ ID NO: 17795 - protein, 8 aa, Mycobacterium tuberculosis
AIGSSRAF

SEQ ID NO: 17796 - protein, 8 aa, Mycobacterium tuberculosis
IGSSRAFE

SEQ ID NO: 17797 - protein, 8 aa, Mycobacterium tuberculosis
GSSRAFEI

SEQ ID NO: 17798 - protein, 8 aa, Mycobacterium tuberculosis
SSRAFEIM

SEQ ID NO: 17799 - protein, 8 aa, Mycobacterium tuberculosis
SRAFEIML

SEQ ID NO: 17800 - protein, 8 aa, Mycobacterium tuberculosis
RAFEIMLT

SEQ ID NO: 17801 - protein, 8 aa, Mycobacterium tuberculosis
AFEIMLTG

SEQ ID NO: 17802 - protein, 8 aa, Mycobacterium tuberculosis
FEIMLTGR

SEQ ID NO: 17803 - protein, 8 aa, Mycobacterium tuberculosis
EIMLTGRD

SEQ ID NO: 17804 - protein, 8 aa, Mycobacterium tuberculosis
IMLTGRDV

SEQ ID NO: 17805 - protein, 8 aa, Mycobacterium tuberculosis
MLTGRDVS

SEQ ID NO: 17806 - protein, 8 aa, Mycobacterium tuberculosis
LTGRDVSA

SEQ ID NO: 17807 - protein, 8 aa, Mycobacterium tuberculosis
TGRDVSAE

SEQ ID NO: 17808 - protein, 8 aa, Mycobacterium tuberculosis
GRDVSAEE

SEQ ID NO: 17809 - protein, 8 aa, Mycobacterium tuberculosis
RDVSAEEA

SEQ ID NO: 17810 - protein, 8 aa, Mycobacterium tuberculosis
DVSAEEAE

SEQ ID NO: 17811 - protein, 8 aa, Mycobacterium tuberculosis
VSAEEAER

SEQ ID NO: 17812 - protein, 8 aa, Mycobacterium tuberculosis
SAEEAERI

SEQ ID NO: 17813 - protein, 8 aa, Mycobacterium tuberculosis
AEEAERIG

SEQ ID NO: 17814 - protein, 8 aa, Mycobacterium tuberculosis
EEAERIGL

SEQ ID NO: 17815 - protein, 8 aa, Mycobacterium tuberculosis
EAERIGLV

SEQ ID NO: 17816 - protein, 8 aa, Mycobacterium tuberculosis
AERIGLVS

SEQ ID NO: 17817 - protein, 8 aa, Mycobacterium tuberculosis
ERIGLVSR

SEQ ID NO: 17818 - protein, 8 aa, Mycobacterium tuberculosis
RIGLVSRQ

SEQ ID NO: 17819 - protein, 8 aa, Mycobacterium tuberculosis
IGLVSRQV

SEQ ID NO: 17820 - protein, 8 aa, Mycobacterium tuberculosis
GLVSRQVP

SEQ ID NO: 17821 - protein, 8 aa, Mycobacterium tuberculosis
LVSRQVPD

SEQ ID NO: 17822 - protein, 8 aa, Mycobacterium tuberculosis
VSRQVPDE

SEQ ID NO: 17823 - protein, 8 aa, Mycobacterium tuberculosis
SRQVPDEQ

SEQ ID NO: 17824 - protein, 8 aa, Mycobacterium tuberculosis
RQVPDEQL

SEQ ID NO: 17825 - protein, 8 aa, Mycobacterium tuberculosis
QVPDEQLL

SEQ ID NO: 17826 - protein, 8 aa, Mycobacterium tuberculosis
VPDEQLLD

SEQ ID NO: 17827 - protein, 8 aa, Mycobacterium tuberculosis
PDEQLLDA

SEQ ID NO: 17828 - protein, 8 aa, Mycobacterium tuberculosis
DEQLLDAC

SEQ ID NO: 17829 - protein, 8 aa, Mycobacterium tuberculosis
EQLLDACY

SEQ ID NO: 17830 - protein, 8 aa, Mycobacterium tuberculosis
QLLDACYA

SEQ ID NO: 17831 - protein, 8 aa, Mycobacterium tuberculosis
LLDACYAI

SEQ ID NO: 17832 - protein, 8 aa, Mycobacterium tuberculosis
LDACYAIA

SEQ ID NO: 17833 - protein, 8 aa, Mycobacterium tuberculosis
DACYAIAA

SEQ ID NO: 17834 - protein, 8 aa, Mycobacterium tuberculosis
ACYAIAAR

SEQ ID NO: 17835 - protein, 8 aa, Mycobacterium tuberculosis
CYAIAARM

SEQ ID NO: 17836 - protein, 8 aa, Mycobacterium tuberculosis
YAIAARMA

SEQ ID NO: 17837 - protein, 8 aa, Mycobacterium tuberculosis
AIAARMAG

SEQ ID NO: 17838 - protein, 8 aa, Mycobacterium tuberculosis
IAARMAGF

SEQ ID NO: 17839 - protein, 8 aa, Mycobacterium tuberculosis
AARMAGFS

SEQ ID NO: 17840 - protein, 8 aa, Mycobacterium tuberculosis
ARMAGFSR

SEQ ID NO: 17841 - protein, 8 aa, Mycobacterium tuberculosis
RMAGFSRP

SEQ ID NO: 17842 - protein, 8 aa, Mycobacterium tuberculosis
MAGFSRPG

SEQ ID NO: 17843 - protein, 8 aa, Mycobacterium tuberculosis
AGFSRPGI

SEQ ID NO: 17844 - protein, 8 aa, Mycobacterium tuberculosis
GFSRPGIE

SEQ ID NO: 17845 - protein, 8 aa, Mycobacterium tuberculosis
FSRPGIEL

SEQ ID NO: 17846 - protein, 8 aa, Mycobacterium tuberculosis
SRPGIELT

SEQ ID NO: 17847 - protein, 8 aa, Mycobacterium tuberculosis
RPGIELTK

SEQ ID NO: 17848 - protein, 8 aa, Mycobacterium tuberculosis
PGIELTKR

SEQ ID NO: 17849 - protein, 8 aa, Mycobacterium tuberculosis
GIELTKRT

SEQ ID NO: 17850 - protein, 8 aa, Mycobacterium tuberculosis
IELTKRTL

SEQ ID NO: 17851 - protein, 8 aa, Mycobacterium tuberculosis
ELTKRTLW

SEQ ID NO: 17852 - protein, 8 aa, Mycobacterium tuberculosis
LTKRTLWS

SEQ ID NO: 17853 - protein, 8 aa, Mycobacterium tuberculosis
TKRTLWSG

SEQ ID NO: 17854 - protein, 8 aa, Mycobacterium tuberculosis
KRTLWSGL

SEQ ID NO: 17855 - protein, 8 aa, Mycobacterium tuberculosis
RTLWSGLD

SEQ ID NO: 17856 - protein, 8 aa, Mycobacterium tuberculosis
TLWSGLDA

SEQ ID NO: 17857 - protein, 8 aa, Mycobacterium tuberculosis
LWSGLDAA

SEQ ID NO: 17858 - protein, 8 aa, Mycobacterium tuberculosis
WSGLDAAS

SEQ ID NO: 17859 - protein, 8 aa, Mycobacterium tuberculosis
SGLDAASL

SEQ ID NO: 17860 - protein, 8 aa, Mycobacterium tuberculosis
GLDAASLE

SEQ ID NO: 17861 - protein, 8 aa, Mycobacterium tuberculosis
LDAASLEA

SEQ ID NO: 17862 - protein, 8 aa, Mycobacterium tuberculosis
DAASLEAH

SEQ ID NO: 17863 - protein, 8 aa, Mycobacterium tuberculosis
AASLEAHM

SEQ ID NO: 17864 - protein, 8 aa, Mycobacterium tuberculosis
ASLEAHMQ

SEQ ID NO: 17865 - protein, 8 aa, Mycobacterium tuberculosis
SLEAHMQA

SEQ ID NO: 17866 - protein, 8 aa, Mycobacterium tuberculosis
LEAHMQAE

SEQ ID NO: 17867 - protein, 8 aa, Mycobacterium tuberculosis
EAHMQAEG

SEQ ID NO: 17868 - protein, 8 aa, Mycobacterium tuberculosis
AHMQAEGL

SEQ ID NO: 17869 - protein, 8 aa, Mycobacterium tuberculosis
HMQAEGLG

SEQ ID NO: 17870 - protein, 8 aa, Mycobacterium tuberculosis
MQAEGLGQ

SEQ ID NO: 17871 - protein, 8 aa, Mycobacterium tuberculosis
QAEGLGQL

SEQ ID NO: 17872 - protein, 8 aa, Mycobacterium tuberculosis
AEGLGQLF

SEQ ID NO: 17873 - protein, 8 aa, Mycobacterium tuberculosis
EGLGQLFV

SEQ ID NO: 17874 - protein, 8 aa, Mycobacterium tuberculosis
GLGQLFVR

SEQ ID NO: 17875 - protein, 8 aa, Mycobacterium tuberculosis
LGQLFVRL

SEQ ID NO: 17876 - protein, 8 aa, Mycobacterium tuberculosis
GQLFVRLL

SEQ ID NO: 17877 - protein, 8 aa, Mycobacterium tuberculosis
QLFVRLLT

SEQ ID NO: 17878 - protein, 8 aa, Mycobacterium tuberculosis
LFVRLLTA

SEQ ID NO: 17879 - protein, 8 aa, Mycobacterium tuberculosis
FVRLLTAN

SEQ ID NO: 17880 - protein, 8 aa, Mycobacterium tuberculosis
VRLLTANF

SEQ ID NO: 17881 - protein, 8 aa, Mycobacterium tuberculosis
RLLTANFE

SEQ ID NO: 17882 - protein, 8 aa, Mycobacterium tuberculosis
LLTANFEE

SEQ ID NO: 17883 - protein, 8 aa, Mycobacterium tuberculosis
LTANFEEA

SEQ ID NO: 17884 - protein, 8 aa, Mycobacterium tuberculosis
TANFEEAV

SEQ ID NO: 17885 - protein, 8 aa, Mycobacterium tuberculosis
ANFEEAVA

SEQ ID NO: 17886 - protein, 8 aa, Mycobacterium tuberculosis
NFEEAVAA

SEQ ID NO: 17887 - protein, 8 aa, Mycobacterium tuberculosis
FEEAVAAR

SEQ ID NO: 17888 - protein, 8 aa, Mycobacterium tuberculosis
EEAVAARA

SEQ ID NO: 17889 - protein, 8 aa, Mycobacterium tuberculosis
EAVAARAE

SEQ ID NO: 17890 - protein, 8 aa, Mycobacterium tuberculosis
AVAARAEQ

SEQ ID NO: 17891 - protein, 8 aa, Mycobacterium tuberculosis
VAARAEQR

SEQ ID NO: 17892 - protein, 8 aa, Mycobacterium tuberculosis
AARAEQRA

SEQ ID NO: 17893 - protein, 8 aa, Mycobacterium tuberculosis
ARAEQRAP

SEQ ID NO: 17894 - protein, 8 aa, Mycobacterium tuberculosis
RAEQRAPV

SEQ ID NO: 17895 - protein, 8 aa, Mycobacterium tuberculosis
AEQRAPVF

SEQ ID NO: 17896 - protein, 8 aa, Mycobacterium tuberculosis
EQRAPVFT

SEQ ID NO: 17897 - protein, 8 aa, Mycobacterium tuberculosis
QRAPVFTD

SEQ ID NO: 17898 - protein, 8 aa, Mycobacterium tuberculosis
RAPVFTDD

SEQ ID NO: 17899 - protein, 8 aa, Mycobacterium tuberculosis
APVFTDDT

SEQ ID NO: 17900 - protein, 9 aa, Mycobacterium tuberculosis
MPHRCAAQV

SEQ ID NO: 17901 - protein, 9 aa, Mycobacterium tuberculosis
PHRCAAQVV

SEQ ID NO: 17902 - protein, 9 aa, Mycobacterium tuberculosis
HRCAAQVVA

SEQ ID NO: 17903 - protein, 9 aa, Mycobacterium tuberculosis
RCAAQVVAG

SEQ ID NO: 17904 - protein, 9 aa, Mycobacterium tuberculosis
CAAQVVAGY

SEQ ID NO: 17905 - protein, 9 aa, Mycobacterium tuberculosis
AAQVVAGYR

SEQ ID NO: 17906 - protein, 9 aa, Mycobacterium tuberculosis
AQVVAGYRS

SEQ ID NO: 17907 - protein, 9 aa, Mycobacterium tuberculosis
QVVAGYRST

SEQ ID NO: 17908 - protein, 9 aa, Mycobacterium tuberculosis
VVAGYRSTV

SEQ ID NO: 17909 - protein, 9 aa, Mycobacterium tuberculosis
VAGYRSTVS

SEQ ID NO: 17910 - protein, 9 aa, Mycobacterium tuberculosis
AGYRSTVSL

SEQ ID NO: 17911 - protein, 9 aa, Mycobacterium tuberculosis
GYRSTVSLV

SEQ ID NO: 17912 - protein, 9 aa, Mycobacterium tuberculosis
YRSTVSLVL

SEQ ID NO: 17913 - protein, 9 aa, Mycobacterium tuberculosis
RSTVSLVLV

SEQ ID NO: 17914 - protein, 9 aa, Mycobacterium tuberculosis
STVSLVLVE

SEQ ID NO: 17915 - protein, 9 aa, Mycobacterium tuberculosis
TVSLVLVEH

SEQ ID NO: 17916 - protein, 9 aa, Mycobacterium tuberculosis
VSLVLVEHP

SEQ ID NO: 17917 - protein, 9 aa, Mycobacterium tuberculosis
SLVLVEHPR

SEQ ID NO: 17918 - protein, 9 aa, Mycobacterium tuberculosis
LVLVEHPRP

SEQ ID NO: 17919 - protein, 9 aa, Mycobacterium tuberculosis
VLVEHPRPE

SEQ ID NO: 17920 - protein, 9 aa, Mycobacterium tuberculosis
LVEHPRPEI

SEQ ID NO: 17921 - protein, 9 aa, Mycobacterium tuberculosis
VEHPRPEIA

SEQ ID NO: 17922 - protein, 9 aa, Mycobacterium tuberculosis
EHPRPEIAQ

SEQ ID NO: 17923 - protein, 9 aa, Mycobacterium tuberculosis
HPRPEIAQI

SEQ ID NO: 17924 - protein, 9 aa, Mycobacterium tuberculosis
PRPEIAQIT

SEQ ID NO: 17925 - protein, 9 aa, Mycobacterium tuberculosis
RPEIAQITL

SEQ ID NO: 17926 - protein, 9 aa, Mycobacterium tuberculosis
PEIAQITLN

SEQ ID NO: 17927 - protein, 9 aa, Mycobacterium tuberculosis
EIAQITLNR

SEQ ID NO: 17928 - protein, 9 aa, Mycobacterium tuberculosis
IAQITLNRP

SEQ ID NO: 17929 - protein, 9 aa, Mycobacterium tuberculosis
AQITLNRPE

SEQ ID NO: 17930 - protein, 9 aa, Mycobacterium tuberculosis
QITLNRPER

SEQ ID NO: 17931 - protein, 9 aa, Mycobacterium tuberculosis
ITLNRPERM

SEQ ID NO: 17932 - protein, 9 aa, Mycobacterium tuberculosis
TLNRPERMN

SEQ ID NO: 17933 - protein, 9 aa, Mycobacterium tuberculosis
LNRPERMNS

SEQ ID NO: 17934 - protein, 9 aa, Mycobacterium tuberculosis
NRPERMNSM

SEQ ID NO: 17935 - protein, 9 aa, Mycobacterium tuberculosis
RPERMNSMA

SEQ ID NO: 17936 - protein, 9 aa, Mycobacterium tuberculosis
PERMNSMAF

SEQ ID NO: 17937 - protein, 9 aa, Mycobacterium tuberculosis
ERMNSMAFD

SEQ ID NO: 17938 - protein, 9 aa, Mycobacterium tuberculosis
RMNSMAFDV

SEQ ID NO: 17939 - protein, 9 aa, Mycobacterium tuberculosis
MNSMAFDVM

SEQ ID NO: 17940 - protein, 9 aa, Mycobacterium tuberculosis
NSMAFDVMV

SEQ ID NO: 17941 - protein, 9 aa, Mycobacterium tuberculosis
SMAFDVMVP

SEQ ID NO: 17942 - protein, 9 aa, Mycobacterium tuberculosis
MAFDVMVPL

SEQ ID NO: 17943 - protein, 9 aa, Mycobacterium tuberculosis
AFDVMVPLK

SEQ ID NO: 17944 - protein, 9 aa, Mycobacterium tuberculosis
FDVMVPLKE

SEQ ID NO: 17945 - protein, 9 aa, Mycobacterium tuberculosis
DVMVPLKEA

SEQ ID NO: 17946 - protein, 9 aa, Mycobacterium tuberculosis
VMVPLKEAL

SEQ ID NO: 17947 - protein, 9 aa, Mycobacterium tuberculosis
MVPLKEALA

SEQ ID NO: 17948 - protein, 9 aa, Mycobacterium tuberculosis
VPLKEALAQ

SEQ ID NO: 17949 - protein, 9 aa, Mycobacterium tuberculosis
PLKEALAQV

SEQ ID NO: 17950 - protein, 9 aa, Mycobacterium tuberculosis
LKEALAQVS

SEQ ID NO: 17951 - protein, 9 aa, Mycobacterium tuberculosis
KEALAQVSY

SEQ ID NO: 17952 - protein, 9 aa, Mycobacterium tuberculosis
EALAQVSYD

SEQ ID NO: 17953 - protein, 9 aa, Mycobacterium tuberculosis
ALAQVSYDN

SEQ ID NO: 17954 - protein, 9 aa, Mycobacterium tuberculosis
LAQVSYDNS

SEQ ID NO: 17955 - protein, 9 aa, Mycobacterium tuberculosis
AQVSYDNSV

SEQ ID NO: 17956 - protein, 9 aa, Mycobacterium tuberculosis
QVSYDNSVR

SEQ ID NO: 17957 - protein, 9 aa, Mycobacterium tuberculosis
VSYDNSVRV

SEQ ID NO: 17958 - protein, 9 aa, Mycobacterium tuberculosis
SYDNSVRVV

SEQ ID NO: 17959 - protein, 9 aa, Mycobacterium tuberculosis
YDNSVRVVV

SEQ ID NO: 17960 - protein, 9 aa, Mycobacterium tuberculosis
DNSVRVVVL

SEQ ID NO: 17961 - protein, 9 aa, Mycobacterium tuberculosis
NSVRVVVLT

SEQ ID NO: 17962 - protein, 9 aa, Mycobacterium tuberculosis
SVRVVVLTG

SEQ ID NO: 17963 - protein, 9 aa, Mycobacterium tuberculosis
VRVVVLTGA

SEQ ID NO: 17964 - protein, 9 aa, Mycobacterium tuberculosis
RVVVLTGAG

SEQ ID NO: 17965 - protein, 9 aa, Mycobacterium tuberculosis
VVVLTGAGR

SEQ ID NO: 17966 - protein, 9 aa, Mycobacterium tuberculosis
VVLTGAGRG

SEQ ID NO: 17967 - protein, 9 aa, Mycobacterium tuberculosis
VLTGAGRGF

SEQ ID NO: 17968 - protein, 9 aa, Mycobacterium tuberculosis
LTGAGRGFS

SEQ ID NO: 17969 - protein, 9 aa, Mycobacterium tuberculosis
TGAGRGFSP

SEQ ID NO: 17970 - protein, 9 aa, Mycobacterium tuberculosis
GAGRGFSPG

SEQ ID NO: 17971 - protein, 9 aa, Mycobacterium tuberculosis
AGRGFSPGA

SEQ ID NO: 17972 - protein, 9 aa, Mycobacterium tuberculosis
GRGFSPGAD

SEQ ID NO: 17973 - protein, 9 aa, Mycobacterium tuberculosis
RGFSPGADH

SEQ ID NO: 17974 - protein, 9 aa, Mycobacterium tuberculosis
GFSPGADHK

SEQ ID NO: 17975 - protein, 9 aa, Mycobacterium tuberculosis
FSPGADHKS

SEQ ID NO: 17976 - protein, 9 aa, Mycobacterium tuberculosis
SPGADHKSA

SEQ ID NO: 17977 - protein, 9 aa, Mycobacterium tuberculosis
PGADHKSAG

SEQ ID NO: 17978 - protein, 9 aa, Mycobacterium tuberculosis
GADHKSAGV

SEQ ID NO: 17979 - protein, 9 aa, Mycobacterium tuberculosis
ADHKSAGVV

SEQ ID NO: 17980 - protein, 9 aa, Mycobacterium tuberculosis
DHKSAGVVP

SEQ ID NO: 17981 - protein, 9 aa, Mycobacterium tuberculosis
HKSAGVVPH

SEQ ID NO: 17982 - protein, 9 aa, Mycobacterium tuberculosis
KSAGVVPHV

SEQ ID NO: 17983 - protein, 9 aa, Mycobacterium tuberculosis
SAGVVPHVE

SEQ ID NO: 17984 - protein, 9 aa, Mycobacterium tuberculosis
AGVVPHVEN

SEQ ID NO: 17985 - protein, 9 aa, Mycobacterium tuberculosis
GVVPHVENL

SEQ ID NO: 17986 - protein, 9 aa, Mycobacterium tuberculosis
VVPHVENLT

SEQ ID NO: 17987 - protein, 9 aa, Mycobacterium tuberculosis
VPHVENLTR

SEQ ID NO: 17988 - protein, 9 aa, Mycobacterium tuberculosis
PHVENLTRP

SEQ ID NO: 17989 - protein, 9 aa, Mycobacterium tuberculosis
HVENLTRPT

SEQ ID NO: 17990 - protein, 9 aa, Mycobacterium tuberculosis
VENLTRPTY

SEQ ID NO: 17991 - protein, 9 aa, Mycobacterium tuberculosis
ENLTRPTYA

SEQ ID NO: 17992 - protein, 9 aa, Mycobacterium tuberculosis
NLTRPTYAL

SEQ ID NO: 17993 - protein, 9 aa, Mycobacterium tuberculosis
LTRPTYALR

SEQ ID NO: 17994 - protein, 9 aa, Mycobacterium tuberculosis
TRPTYALRS

SEQ ID NO: 17995 - protein, 9 aa, Mycobacterium tuberculosis
RPTYALRSM

SEQ ID NO: 17996 - protein, 9 aa, Mycobacterium tuberculosis
PTYALRSME

SEQ ID NO: 17997 - protein, 9 aa, Mycobacterium tuberculosis
TYALRSMEL

SEQ ID NO: 17998 - protein, 9 aa, Mycobacterium tuberculosis
YALRSMELL

SEQ ID NO: 17999 - protein, 9 aa, Mycobacterium tuberculosis
ALRSMELLD

SEQ ID NO: 18000 - protein, 9 aa, Mycobacterium tuberculosis
LRSMELLDD

SEQ ID NO: 18001 - protein, 9 aa, Mycobacterium tuberculosis
RSMELLDDV

SEQ ID NO: 18002 - protein, 9 aa, Mycobacterium tuberculosis
SMELLDDVI

SEQ ID NO: 18003 - protein, 9 aa, Mycobacterium tuberculosis
MELLDDVIL

SEQ ID NO: 18004 - protein, 9 aa, Mycobacterium tuberculosis
ELLDDVILM

SEQ ID NO: 18005 - protein, 9 aa, Mycobacterium tuberculosis
LLDDVILML

SEQ ID NO: 18006 - protein, 9 aa, Mycobacterium tuberculosis
LDDVILMLR

SEQ ID NO: 18007 - protein, 9 aa, Mycobacterium tuberculosis
DDVILMLRR

SEQ ID NO: 18008 - protein, 9 aa, Mycobacterium tuberculosis
DVILMLRRL

SEQ ID NO: 18009 - protein, 9 aa, Mycobacterium tuberculosis
VILMLRRLH

SEQ ID NO: 18010 - protein, 9 aa, Mycobacterium tuberculosis
ILMLRRLHQ

SEQ ID NO: 18011 - protein, 9 aa, Mycobacterium tuberculosis
LMLRRLHQP

SEQ ID NO: 18012 - protein, 9 aa, Mycobacterium tuberculosis
MLRRLHQPV

SEQ ID NO: 18013 - protein, 9 aa, Mycobacterium tuberculosis
LRRLHQPVI

SEQ ID NO: 18014 - protein, 9 aa, Mycobacterium tuberculosis
RRLHQPVIA

SEQ ID NO: 18015 - protein, 9 aa, Mycobacterium tuberculosis
RLHQPVIAA

SEQ ID NO: 18016 - protein, 9 aa, Mycobacterium tuberculosis
LHQPVIAAV

SEQ ID NO: 18017 - protein, 9 aa, Mycobacterium tuberculosis
HQPVIAAVN

SEQ ID NO: 18018 - protein, 9 aa, Mycobacterium tuberculosis
QPVIAAVNG

SEQ ID NO: 18019 - protein, 9 aa, Mycobacterium tuberculosis
PVIAAVNGP

SEQ ID NO: 18020 - protein, 9 aa, Mycobacterium tuberculosis
VIAAVNGPA

SEQ ID NO: 18021 - protein, 9 aa, Mycobacterium tuberculosis
IAAVNGPAI

SEQ ID NO: 18022 - protein, 9 aa, Mycobacterium tuberculosis
AAVNGPAIG

SEQ ID NO: 18023 - protein, 9 aa, Mycobacterium tuberculosis
AVNGPAIGG

SEQ ID NO: 18024 - protein, 9 aa, Mycobacterium tuberculosis
VNGPAIGGG

SEQ ID NO: 18025 - protein, 9 aa, Mycobacterium tuberculosis
NGPAIGGGL

SEQ ID NO: 18026 - protein, 9 aa, Mycobacterium tuberculosis
GPAIGGGLC

SEQ ID NO: 18027 - protein, 9 aa, Mycobacterium tuberculosis
PAIGGGLCL

SEQ ID NO: 18028 - protein, 9 aa, Mycobacterium tuberculosis
AIGGGLCLA

SEQ ID NO: 18029 - protein, 9 aa, Mycobacterium tuberculosis
IGGGLCLAL

SEQ ID NO: 18030 - protein, 9 aa, Mycobacterium tuberculosis
GGGLCLALA

SEQ ID NO: 18031 - protein, 9 aa, Mycobacterium tuberculosis
GGLCLALAA

SEQ ID NO: 18032 - protein, 9 aa, Mycobacterium tuberculosis
GLCLALAAD

SEQ ID NO: 18033 - protein, 9 aa, Mycobacterium tuberculosis
LCLALAADI

SEQ ID NO: 18034 - protein, 9 aa, Mycobacterium tuberculosis
CLALAADIR

SEQ ID NO: 18035 - protein, 9 aa, Mycobacterium tuberculosis
LALAADIRV

SEQ ID NO: 18036 - protein, 9 aa, Mycobacterium tuberculosis
ALAADIRVA

SEQ ID NO: 18037 - protein, 9 aa, Mycobacterium tuberculosis
LAADIRVAS

SEQ ID NO: 18038 - protein, 9 aa, Mycobacterium tuberculosis
AADIRVASS

SEQ ID NO: 18039 - protein, 9 aa, Mycobacterium tuberculosis
ADIRVASSS

SEQ ID NO: 18040 - protein, 9 aa, Mycobacterium tuberculosis
DIRVASSSA

SEQ ID NO: 18041 - protein, 9 aa, Mycobacterium tuberculosis
IRVASSSAY

SEQ ID NO: 18042 - protein, 9 aa, Mycobacterium tuberculosis
RVASSSAYF

SEQ ID NO: 18043 - protein, 9 aa, Mycobacterium tuberculosis
VASSSAYFR

SEQ ID NO: 18044 - protein, 9 aa, Mycobacterium tuberculosis
ASSSAYFRA

SEQ ID NO: 18045 - protein, 9 aa, Mycobacterium tuberculosis
SSSAYFRAA

SEQ ID NO: 18046 - protein, 9 aa, Mycobacterium tuberculosis
SSAYFRAAG

SEQ ID NO: 18047 - protein, 9 aa, Mycobacterium tuberculosis
SAYFRAAGI

SEQ ID NO: 18048 - protein, 9 aa, Mycobacterium tuberculosis
AYFRAAGIN

SEQ ID NO: 18049 - protein, 9 aa, Mycobacterium tuberculosis
YFRAAGINN

SEQ ID NO: 18050 - protein, 9 aa, Mycobacterium tuberculosis
FRAAGINNG

SEQ ID NO: 18051 - protein, 9 aa, Mycobacterium tuberculosis
RAAGINNGL

SEQ ID NO: 18052 - protein, 9 aa, Mycobacterium tuberculosis
AAGINNGLT

SEQ ID NO: 18053 - protein, 9 aa, Mycobacterium tuberculosis
AGINNGLTA

SEQ ID NO: 18054 - protein, 9 aa, Mycobacterium tuberculosis
GINNGLTAS

SEQ ID NO: 18055 - protein, 9 aa, Mycobacterium tuberculosis
INNGLTASE

SEQ ID NO: 18056 - protein, 9 aa, Mycobacterium tuberculosis
NNGLTASEL

SEQ ID NO: 18057 - protein, 9 aa, Mycobacterium tuberculosis
NGLTASELG

SEQ ID NO: 18058 - protein, 9 aa, Mycobacterium tuberculosis
GLTASELGL

SEQ ID NO: 18059 - protein, 9 aa, Mycobacterium tuberculosis
LTASELGLS

SEQ ID NO: 18060 - protein, 9 aa, Mycobacterium tuberculosis
TASELGLSY

SEQ ID NO: 18061 - protein, 9 aa, Mycobacterium tuberculosis
ASELGLSYL

SEQ ID NO: 18062 - protein, 9 aa, Mycobacterium tuberculosis
SELGLSYLL

SEQ ID NO: 18063 - protein, 9 aa, Mycobacterium tuberculosis
ELGLSYLLP

SEQ ID NO: 18064 - protein, 9 aa, Mycobacterium tuberculosis
LGLSYLLPR

SEQ ID NO: 18065 - protein, 9 aa, Mycobacterium tuberculosis
GLSYLLPRA

SEQ ID NO: 18066 - protein, 9 aa, Mycobacterium tuberculosis
LSYLLPRAI

SEQ ID NO: 18067 - protein, 9 aa, Mycobacterium tuberculosis
SYLLPRAIG

SEQ ID NO: 18068 - protein, 9 aa, Mycobacterium tuberculosis
YLLPRAIGS

SEQ ID NO: 18069 - protein, 9 aa, Mycobacterium tuberculosis
LLPRAIGSS

SEQ ID NO: 18070 - protein, 9 aa, Mycobacterium tuberculosis
LPRAIGSSR

SEQ ID NO: 18071 - protein, 9 aa, Mycobacterium tuberculosis
PRAIGSSRA

SEQ ID NO: 18072 - protein, 9 aa, Mycobacterium tuberculosis
RAIGSSRAF

SEQ ID NO: 18073 - protein, 9 aa, Mycobacterium tuberculosis
AIGSSRAFE

SEQ ID NO: 18074 - protein, 9 aa, Mycobacterium tuberculosis
IGSSRAFEI

SEQ ID NO: 18075 - protein, 9 aa, Mycobacterium tuberculosis
GSSRAFEIM

SEQ ID NO: 18076 - protein, 9 aa, Mycobacterium tuberculosis
SSRAFEIML

SEQ ID NO: 18077 - protein, 9 aa, Mycobacterium tuberculosis
SRAFEIMLT

SEQ ID NO: 18078 - protein, 9 aa, Mycobacterium tuberculosis
RAFEIMLTG

SEQ ID NO: 18079 - protein, 9 aa, Mycobacterium tuberculosis
AFEIMLTGR

SEQ ID NO: 18080 - protein, 9 aa, Mycobacterium tuberculosis
FEIMLTGRD

SEQ ID NO: 18081 - protein, 9 aa, Mycobacterium tuberculosis
EIMLTGRDV

SEQ ID NO: 18082 - protein, 9 aa, Mycobacterium tuberculosis
IMLTGRDVS

SEQ ID NO: 18083 - protein, 9 aa, Mycobacterium tuberculosis
MLTGRDVSA

SEQ ID NO: 18084 - protein, 9 aa, Mycobacterium tuberculosis
LTGRDVSAE

SEQ ID NO: 18085 - protein, 9 aa, Mycobacterium tuberculosis
TGRDVSAEE

SEQ ID NO: 18086 - protein, 9 aa, Mycobacterium tuberculosis
GRDVSAEEA

SEQ ID NO: 18087 - protein, 9 aa, Mycobacterium tuberculosis
RDVSAEEAE

SEQ ID NO: 18088 - protein, 9 aa, Mycobacterium tuberculosis
DVSAEEAER

SEQ ID NO: 18089 - protein, 9 aa, Mycobacterium tuberculosis
VSAEEAERI

SEQ ID NO: 18090 - protein, 9 aa, Mycobacterium tuberculosis
SAEEAERIG

SEQ ID NO: 18091 - protein, 9 aa, Mycobacterium tuberculosis
AEEAERIGL

SEQ ID NO: 18092 - protein, 9 aa, Mycobacterium tuberculosis
EEAERIGLV

SEQ ID NO: 18093 - protein, 9 aa, Mycobacterium tuberculosis
EAERIGLVS

SEQ ID NO: 18094 - protein, 9 aa, Mycobacterium tuberculosis
AERIGLVSR

SEQ ID NO: 18095 - protein, 9 aa, Mycobacterium tuberculosis
ERIGLVSRQ

SEQ ID NO: 18096 - protein, 9 aa, Mycobacterium tuberculosis
RIGLVSRQV

SEQ ID NO: 18097 - protein, 9 aa, Mycobacterium tuberculosis
IGLVSRQVP

SEQ ID NO: 18098 - protein, 9 aa, Mycobacterium tuberculosis
GLVSRQVPD

SEQ ID NO: 18099 - protein, 9 aa, Mycobacterium tuberculosis
LVSRQVPDE

SEQ ID NO: 18100 - protein, 9 aa, Mycobacterium tuberculosis
VSRQVPDEQ

SEQ ID NO: 18101 - protein, 9 aa, Mycobacterium tuberculosis
SRQVPDEQL

SEQ ID NO: 18102 - protein, 9 aa, Mycobacterium tuberculosis
RQVPDEQLL

SEQ ID NO: 18103 - protein, 9 aa, Mycobacterium tuberculosis
QVPDEQLLD

SEQ ID NO: 18104 - protein, 9 aa, Mycobacterium tuberculosis
VPDEQLLDA

SEQ ID NO: 18105 - protein, 9 aa, Mycobacterium tuberculosis
PDEQLLDAC

SEQ ID NO: 18106 - protein, 9 aa, Mycobacterium tuberculosis
DEQLLDACY

SEQ ID NO: 18107 - protein, 9 aa, Mycobacterium tuberculosis
EQLLDACYA

SEQ ID NO: 18108 - protein, 9 aa, Mycobacterium tuberculosis
QLLDACYAI

SEQ ID NO: 18109 - protein, 9 aa, Mycobacterium tuberculosis
LLDACYAIA

SEQ ID NO: 18110 - protein, 9 aa, Mycobacterium tuberculosis
LDACYAIAA

SEQ ID NO: 18111 - protein, 9 aa, Mycobacterium tuberculosis
DACYAIAAR

SEQ ID NO: 18112 - protein, 9 aa, Mycobacterium tuberculosis
ACYAIAARM

SEQ ID NO: 18113 - protein, 9 aa, Mycobacterium tuberculosis
CYAIAARMA

SEQ ID NO: 18114 - protein, 9 aa, Mycobacterium tuberculosis
YAIAARMAG

SEQ ID NO: 18115 - protein, 9 aa, Mycobacterium tuberculosis
AIAARMAGF

SEQ ID NO: 18116 - protein, 9 aa, Mycobacterium tuberculosis
IAARMAGFS

SEQ ID NO: 18117 - protein, 9 aa, Mycobacterium tuberculosis
AARMAGFSR

SEQ ID NO: 18118 - protein, 9 aa, Mycobacterium tuberculosis
ARMAGFSRP

SEQ ID NO: 18119 - protein, 9 aa, Mycobacterium tuberculosis
RMAGFSRPG

SEQ ID NO: 18120 - protein, 9 aa, Mycobacterium tuberculosis
MAGFSRPGI

SEQ ID NO: 18121 - protein, 9 aa, Mycobacterium tuberculosis
AGFSRPGIE

SEQ ID NO: 18122 - protein, 9 aa, Mycobacterium tuberculosis
GFSRPGIEL

SEQ ID NO: 18123 - protein, 9 aa, Mycobacterium tuberculosis
FSRPGIELT

SEQ ID NO: 18124 - protein, 9 aa, Mycobacterium tuberculosis
SRPGIELTK

SEQ ID NO: 18125 - protein, 9 aa, Mycobacterium tuberculosis
RPGIELTKR

SEQ ID NO: 18126 - protein, 9 aa, Mycobacterium tuberculosis
PGIELTKRT

SEQ ID NO: 18127 - protein, 9 aa, Mycobacterium tuberculosis
GIELTKRTL

SEQ ID NO: 18128 - protein, 9 aa, Mycobacterium tuberculosis
IELTKRTLW

SEQ ID NO: 18129 - protein, 9 aa, Mycobacterium tuberculosis
ELTKRTLWS

SEQ ID NO: 18130 - protein, 9 aa, Mycobacterium tuberculosis
LTKRTLWSG

SEQ ID NO: 18131 - protein, 9 aa, Mycobacterium tuberculosis
TKRTLWSGL

SEQ ID NO: 18132 - protein, 9 aa, Mycobacterium tuberculosis
KRTLWSGLD

SEQ ID NO: 18133 - protein, 9 aa, Mycobacterium tuberculosis
RTLWSGLDA

SEQ ID NO: 18134 - protein, 9 aa, Mycobacterium tuberculosis
TLWSGLDAA

SEQ ID NO: 18135 - protein, 9 aa, Mycobacterium tuberculosis
LWSGLDAAS

SEQ ID NO: 18136 - protein, 9 aa, Mycobacterium tuberculosis
WSGLDAASL

SEQ ID NO: 18137 - protein, 9 aa, Mycobacterium tuberculosis
SGLDAASLE

SEQ ID NO: 18138 - protein, 9 aa, Mycobacterium tuberculosis
GLDAASLEA

SEQ ID NO: 18139 - protein, 9 aa, Mycobacterium tuberculosis
LDAASLEAH

SEQ ID NO: 18140 - protein, 9 aa, Mycobacterium tuberculosis
DAASLEAHM

SEQ ID NO: 18141 - protein, 9 aa, Mycobacterium tuberculosis
AASLEAHMQ

SEQ ID NO: 18142 - protein, 9 aa, Mycobacterium tuberculosis
ASLEAHMQA

SEQ ID NO: 18143 - protein, 9 aa, Mycobacterium tuberculosis
SLEAHMQAE

SEQ ID NO: 18144 - protein, 9 aa, Mycobacterium tuberculosis
LEAHMQAEG

SEQ ID NO: 18145 - protein, 9 aa, Mycobacterium tuberculosis
EAHMQAEGL

SEQ ID NO: 18146 - protein, 9 aa, Mycobacterium tuberculosis
AHMQAEGLG

SEQ ID NO: 18147 - protein, 9 aa, Mycobacterium tuberculosis
HMQAEGLGQ

SEQ ID NO: 18148 - protein, 9 aa, Mycobacterium tuberculosis
MQAEGLGQL

SEQ ID NO: 18149 - protein, 9 aa, Mycobacterium tuberculosis
QAEGLGQLF

SEQ ID NO: 18150 - protein, 9 aa, Mycobacterium tuberculosis
AEGLGQLFV

SEQ ID NO: 18151 - protein, 9 aa, Mycobacterium tuberculosis
EGLGQLFVR

SEQ ID NO: 18152 - protein, 9 aa, Mycobacterium tuberculosis
GLGQLFVRL

SEQ ID NO: 18153 - protein, 9 aa, Mycobacterium tuberculosis
LGQLFVRLL

SEQ ID NO: 18154 - protein, 9 aa, Mycobacterium tuberculosis
GQLFVRLLT

SEQ ID NO: 18155 - protein, 9 aa, Mycobacterium tuberculosis
QLFVRLLTA

SEQ ID NO: 18156 - protein, 9 aa, Mycobacterium tuberculosis
LFVRLLTAN

SEQ ID NO: 18157 - protein, 9 aa, Mycobacterium tuberculosis
FVRLLTANF

SEQ ID NO: 18158 - protein, 9 aa, Mycobacterium tuberculosis
VRLLTANFE

SEQ ID NO: 18159 - protein, 9 aa, Mycobacterium tuberculosis
RLLTANFEE

SEQ ID NO: 18160 - protein, 9 aa, Mycobacterium tuberculosis
LLTANFEEA

SEQ ID NO: 18161 - protein, 9 aa, Mycobacterium tuberculosis
LTANFEEAV

SEQ ID NO: 18162 - protein, 9 aa, Mycobacterium tuberculosis
TANFEEAVA

SEQ ID NO: 18163 - protein, 9 aa, Mycobacterium tuberculosis
ANFEEAVAA

SEQ ID NO: 18164 - protein, 9 aa, Mycobacterium tuberculosis
NFEEAVAAR

SEQ ID NO: 18165 - protein, 9 aa, Mycobacterium tuberculosis
FEEAVAARA

SEQ ID NO: 18166 - protein, 9 aa, Mycobacterium tuberculosis
EEAVAARAE

SEQ ID NO: 18167 - protein, 9 aa, Mycobacterium tuberculosis
EAVAARAEQ

SEQ ID NO: 18168 - protein, 9 aa, Mycobacterium tuberculosis
AVAARAEQR

SEQ ID NO: 18169 - protein, 9 aa, Mycobacterium tuberculosis
VAARAEQRA

SEQ ID NO: 18170 - protein, 9 aa, Mycobacterium tuberculosis
AARAEQRAP

SEQ ID NO: 18171 - protein, 9 aa, Mycobacterium tuberculosis
ARAEQRAPV

SEQ ID NO: 18172 - protein, 9 aa, Mycobacterium tuberculosis
RAEQRAPVF

SEQ ID NO: 18173 - protein, 9 aa, Mycobacterium tuberculosis
AEQRAPVFT

SEQ ID NO: 18174 - protein, 9 aa, Mycobacterium tuberculosis
EQRAPVFTD

SEQ ID NO: 18175 - protein, 9 aa, Mycobacterium tuberculosis
QRAPVFTDD

SEQ ID NO: 18176 - protein, 9 aa, Mycobacterium tuberculosis
RAPVFTDDT

SEQ ID NO: 18177 - protein, 10 aa, Mycobacterium tuberculosis
MPHRCAAQVV

SEQ ID NO: 18178 - protein, 10 aa, Mycobacterium tuberculosis
PHRCAAQVVA

SEQ ID NO: 18179 - protein, 10 aa, Mycobacterium tuberculosis
HRCAAQVVAG

SEQ ID NO: 18180 - protein, 10 aa, Mycobacterium tuberculosis
RCAAQVVAGY

SEQ ID NO: 18181 - protein, 10 aa, Mycobacterium tuberculosis
CAAQVVAGYR

SEQ ID NO: 18182 - protein, 10 aa, Mycobacterium tuberculosis
AAQVVAGYRS

SEQ ID NO: 18183 - protein, 10 aa, Mycobacterium tuberculosis
AQVVAGYRST

SEQ ID NO: 18184 - protein, 10 aa, Mycobacterium tuberculosis
QVVAGYRSTV

SEQ ID NO: 18185 - protein, 10 aa, Mycobacterium tuberculosis
VVAGYRSTVS

SEQ ID NO: 18186 - protein, 10 aa, Mycobacterium tuberculosis
VAGYRSTVSL

SEQ ID NO: 18187 - protein, 10 aa, Mycobacterium tuberculosis
AGYRSTVSLV

SEQ ID NO: 18188 - protein, 10 aa, Mycobacterium tuberculosis
GYRSTVSLVL

SEQ ID NO: 18189 - protein, 10 aa, Mycobacterium tuberculosis
YRSTVSLVLV

SEQ ID NO: 18190 - protein, 10 aa, Mycobacterium tuberculosis
RSTVSLVLVE

SEQ ID NO: 18191 - protein, 10 aa, Mycobacterium tuberculosis
STVSLVLVEH

SEQ ID NO: 18192 - protein, 10 aa, Mycobacterium tuberculosis
TVSLVLVEHP

SEQ ID NO: 18193 - protein, 10 aa, Mycobacterium tuberculosis
VSLVLVEHPR

SEQ ID NO: 18194 - protein, 10 aa, Mycobacterium tuberculosis
SLVLVEHPRP

SEQ ID NO: 18195 - protein, 10 aa, Mycobacterium tuberculosis
LVLVEHPRPE

SEQ ID NO: 18196 - protein, 10 aa, Mycobacterium tuberculosis
VLVEHPRPEI

SEQ ID NO: 18197 - protein, 10 aa, Mycobacterium tuberculosis
LVEHPRPEIA

SEQ ID NO: 18198 - protein, 10 aa, Mycobacterium tuberculosis
VEHPRPEIAQ

SEQ ID NO: 18199 - protein, 10 aa, Mycobacterium tuberculosis
EHPRPEIAQI

SEQ ID NO: 18200 - protein, 10 aa, Mycobacterium tuberculosis
HPRPEIAQIT

SEQ ID NO: 18201 - protein, 10 aa, Mycobacterium tuberculosis
PRPEIAQITL

SEQ ID NO: 18202 - protein, 10 aa, Mycobacterium tuberculosis
RPEIAQITLN

SEQ ID NO: 18203 - protein, 10 aa, Mycobacterium tuberculosis
PEIAQITLNR

SEQ ID NO: 18204 - protein, 10 aa, Mycobacterium tuberculosis
EIAQITLNRP

SEQ ID NO: 18205 - protein, 10 aa, Mycobacterium tuberculosis
IAQITLNRPE

SEQ ID NO: 18206 - protein, 10 aa, Mycobacterium tuberculosis
AQITLNRPER

SEQ ID NO: 18207 - protein, 10 aa, Mycobacterium tuberculosis
QITLNRPERM

SEQ ID NO: 18208 - protein, 10 aa, Mycobacterium tuberculosis
ITLNRPERMN

SEQ ID NO: 18209 - protein, 10 aa, Mycobacterium tuberculosis
TLNRPERMNS

SEQ ID NO: 18210 - protein, 10 aa, Mycobacterium tuberculosis
LNRPERMNSM

SEQ ID NO: 18211 - protein, 10 aa, Mycobacterium tuberculosis
NRPERMNSMA

SEQ ID NO: 18212 - protein, 10 aa, Mycobacterium tuberculosis
RPERMNSMAF

SEQ ID NO: 18213 - protein, 10 aa, Mycobacterium tuberculosis
PERMNSMAFD

SEQ ID NO: 18214 - protein, 10 aa, Mycobacterium tuberculosis
ERMNSMAFDV

SEQ ID NO: 18215 - protein, 10 aa, Mycobacterium tuberculosis
RMNSMAFDVM

SEQ ID NO: 18216 - protein, 10 aa, Mycobacterium tuberculosis
MNSMAFDVMV

SEQ ID NO: 18217 - protein, 10 aa, Mycobacterium tuberculosis
NSMAFDVMVP

SEQ ID NO: 18218 - protein, 10 aa, Mycobacterium tuberculosis
SMAFDVMVPL

SEQ ID NO: 18219 - protein, 10 aa, Mycobacterium tuberculosis
MAFDVMVPLK

SEQ ID NO: 18220 - protein, 10 aa, Mycobacterium tuberculosis
AFDVMVPLKE

SEQ ID NO: 18221 - protein, 10 aa, Mycobacterium tuberculosis
FDVMVPLKEA

SEQ ID NO: 18222 - protein, 10 aa, Mycobacterium tuberculosis
DVMVPLKEAL

SEQ ID NO: 18223 - protein, 10 aa, Mycobacterium tuberculosis
VMVPLKEALA

SEQ ID NO: 18224 - protein, 10 aa, Mycobacterium tuberculosis
MVPLKEALAQ

SEQ ID NO: 18225 - protein, 10 aa, Mycobacterium tuberculosis
VPLKEALAQV

SEQ ID NO: 18226 - protein, 10 aa, Mycobacterium tuberculosis
PLKEALAQVS

SEQ ID NO: 18227 - protein, 10 aa, Mycobacterium tuberculosis
LKEALAQVSY

SEQ ID NO: 18228 - protein, 10 aa, Mycobacterium tuberculosis
KEALAQVSYD

SEQ ID NO: 18229 - protein, 10 aa, Mycobacterium tuberculosis
EALAQVSYDN

SEQ ID NO: 18230 - protein, 10 aa, Mycobacterium tuberculosis
ALAQVSYDNS

SEQ ID NO: 18231 - protein, 10 aa, Mycobacterium tuberculosis
LAQVSYDNSV

SEQ ID NO: 18232 - protein, 10 aa, Mycobacterium tuberculosis
AQVSYDNSVR

SEQ ID NO: 18233 - protein, 10 aa, Mycobacterium tuberculosis
QVSYDNSVRV

SEQ ID NO: 18234 - protein, 10 aa, Mycobacterium tuberculosis
VSYDNSVRVV

SEQ ID NO: 18235 - protein, 10 aa, Mycobacterium tuberculosis
SYDNSVRVVV

SEQ ID NO: 18236 - protein, 10 aa, Mycobacterium tuberculosis
YDNSVRVVVL

SEQ ID NO: 18237 - protein, 10 aa, Mycobacterium tuberculosis
DNSVRVVVLT

SEQ ID NO: 18238 - protein, 10 aa, Mycobacterium tuberculosis
NSVRVVVLTG

SEQ ID NO: 18239 - protein, 10 aa, Mycobacterium tuberculosis
SVRVVVLTGA

SEQ ID NO: 18240 - protein, 10 aa, Mycobacterium tuberculosis
VRVVVLTGAG

SEQ ID NO: 18241 - protein, 10 aa, Mycobacterium tuberculosis
RVVVLTGAGR

SEQ ID NO: 18242 - protein, 10 aa, Mycobacterium tuberculosis
VVVLTGAGRG

SEQ ID NO: 18243 - protein, 10 aa, Mycobacterium tuberculosis
VVLTGAGRGF

SEQ ID NO: 18244 - protein, 10 aa, Mycobacterium tuberculosis
VLTGAGRGFS

SEQ ID NO: 18245 - protein, 10 aa, Mycobacterium tuberculosis
LTGAGRGFSP

SEQ ID NO: 18246 - protein, 10 aa, Mycobacterium tuberculosis
TGAGRGFSPG

SEQ ID NO: 18247 - protein, 10 aa, Mycobacterium tuberculosis
GAGRGFSPGA

SEQ ID NO: 18248 - protein, 10 aa, Mycobacterium tuberculosis
AGRGFSPGAD

SEQ ID NO: 18249 - protein, 10 aa, Mycobacterium tuberculosis
GRGFSPGADH

SEQ ID NO: 18250 - protein, 10 aa, Mycobacterium tuberculosis
RGFSPGADHK

SEQ ID NO: 18251 - protein, 10 aa, Mycobacterium tuberculosis
GFSPGADHKS

SEQ ID NO: 18252 - protein, 10 aa, Mycobacterium tuberculosis
FSPGADHKSA

SEQ ID NO: 18253 - protein, 10 aa, Mycobacterium tuberculosis
SPGADHKSAG

SEQ ID NO: 18254 - protein, 10 aa, Mycobacterium tuberculosis
PGADHKSAGV

SEQ ID NO: 18255 - protein, 10 aa, Mycobacterium tuberculosis
GADHKSAGVV

SEQ ID NO: 18256 - protein, 10 aa, Mycobacterium tuberculosis
ADHKSAGVVP

SEQ ID NO: 18257 - protein, 10 aa, Mycobacterium tuberculosis
DHKSAGVVPH

SEQ ID NO: 18258 - protein, 10 aa, Mycobacterium tuberculosis
HKSAGVVPHV

SEQ ID NO: 18259 - protein, 10 aa, Mycobacterium tuberculosis
KSAGVVPHVE

SEQ ID NO: 18260 - protein, 10 aa, Mycobacterium tuberculosis
SAGVVPHVEN

SEQ ID NO: 18261 - protein, 10 aa, Mycobacterium tuberculosis
AGVVPHVENL

SEQ ID NO: 18262 - protein, 10 aa, Mycobacterium tuberculosis
GVVPHVENLT

SEQ ID NO: 18263 - protein, 10 aa, Mycobacterium tuberculosis
VVPHVENLTR

SEQ ID NO: 18264 - protein, 10 aa, Mycobacterium tuberculosis
VPHVENLTRP

SEQ ID NO: 18265 - protein, 10 aa, Mycobacterium tuberculosis
PHVENLTRPT

SEQ ID NO: 18266 - protein, 10 aa, Mycobacterium tuberculosis
HVENLTRPTY

SEQ ID NO: 18267 - protein, 10 aa, Mycobacterium tuberculosis
VENLTRPTYA

SEQ ID NO: 18268 - protein, 10 aa, Mycobacterium tuberculosis
ENLTRPTYAL

SEQ ID NO: 18269 - protein, 10 aa, Mycobacterium tuberculosis
NLTRPTYALR

SEQ ID NO: 18270 - protein, 10 aa, Mycobacterium tuberculosis
LTRPTYALRS

SEQ ID NO: 18271 - protein, 10 aa, Mycobacterium tuberculosis
TRPTYALRSM

SEQ ID NO: 18272 - protein, 10 aa, Mycobacterium tuberculosis
RPTYALRSME

SEQ ID NO: 18273 - protein, 10 aa, Mycobacterium tuberculosis
PTYALRSMEL

SEQ ID NO: 18274 - protein, 10 aa, Mycobacterium tuberculosis
TYALRSMELL

SEQ ID NO: 18275 - protein, 10 aa, Mycobacterium tuberculosis
YALRSMELLD

SEQ ID NO: 18276 - protein, 10 aa, Mycobacterium tuberculosis
ALRSMELLDD

SEQ ID NO: 18277 - protein, 10 aa, Mycobacterium tuberculosis
LRSMELLDDV

SEQ ID NO: 18278 - protein, 10 aa, Mycobacterium tuberculosis
RSMELLDDVI

SEQ ID NO: 18279 - protein, 10 aa, Mycobacterium tuberculosis
SMELLDDVIL

SEQ ID NO: 18280 - protein, 10 aa, Mycobacterium tuberculosis
MELLDDVILM

SEQ ID NO: 18281 - protein, 10 aa, Mycobacterium tuberculosis
ELLDDVILML

SEQ ID NO: 18282 - protein, 10 aa, Mycobacterium tuberculosis
LLDDVILMLR

SEQ ID NO: 18283 - protein, 10 aa, Mycobacterium tuberculosis
LDDVILMLRR

SEQ ID NO: 18284 - protein, 10 aa, Mycobacterium tuberculosis
DDVILMLRRL

SEQ ID NO: 18285 - protein, 10 aa, Mycobacterium tuberculosis
DVILMLRRLH

SEQ ID NO: 18286 - protein, 10 aa, Mycobacterium tuberculosis
VILMLRRLHQ

SEQ ID NO: 18287 - protein, 10 aa, Mycobacterium tuberculosis
ILMLRRLHQP

SEQ ID NO: 18288 - protein, 10 aa, Mycobacterium tuberculosis
LMLRRLHQPV

SEQ ID NO: 18289 - protein, 10 aa, Mycobacterium tuberculosis
MLRRLHQPVI

SEQ ID NO: 18290 - protein, 10 aa, Mycobacterium tuberculosis
LRRLHQPVIA

SEQ ID NO: 18291 - protein, 10 aa, Mycobacterium tuberculosis
RRLHQPVIAA

SEQ ID NO: 18292 - protein, 10 aa, Mycobacterium tuberculosis
RLHQPVIAAV

SEQ ID NO: 18293 - protein, 10 aa, Mycobacterium tuberculosis
LHQPVIAAVN

SEQ ID NO: 18294 - protein, 10 aa, Mycobacterium tuberculosis
HQPVIAAVNG

SEQ ID NO: 18295 - protein, 10 aa, Mycobacterium tuberculosis
QPVIAAVNGP

SEQ ID NO: 18296 - protein, 10 aa, Mycobacterium tuberculosis
PVIAAVNGPA

SEQ ID NO: 18297 - protein, 10 aa, Mycobacterium tuberculosis
VIAAVNGPAI

SEQ ID NO: 18298 - protein, 10 aa, Mycobacterium tuberculosis
IAAVNGPAIG

SEQ ID NO: 18299 - protein, 10 aa, Mycobacterium tuberculosis
AAVNGPAIGG

SEQ ID NO: 18300 - protein, 10 aa, Mycobacterium tuberculosis
AVNGPAIGGG

SEQ ID NO: 18301 - protein, 10 aa, Mycobacterium tuberculosis
VNGPAIGGGL

SEQ ID NO: 18302 - protein, 10 aa, Mycobacterium tuberculosis
NGPAIGGGLC

SEQ ID NO: 18303 - protein, 10 aa, Mycobacterium tuberculosis
GPAIGGGLCL

SEQ ID NO: 18304 - protein, 10 aa, Mycobacterium tuberculosis
PAIGGGLCLA

SEQ ID NO: 18305 - protein, 10 aa, Mycobacterium tuberculosis
AIGGGLCLAL

SEQ ID NO: 18306 - protein, 10 aa, Mycobacterium tuberculosis
IGGGLCLALA

SEQ ID NO: 18307 - protein, 10 aa, Mycobacterium tuberculosis
GGGLCLALAA

SEQ ID NO: 18308 - protein, 10 aa, Mycobacterium tuberculosis
GGLCLALAAD

SEQ ID NO: 18309 - protein, 10 aa, Mycobacterium tuberculosis
GLCLALAADI

SEQ ID NO: 18310 - protein, 10 aa, Mycobacterium tuberculosis
LCLALAADIR

SEQ ID NO: 18311 - protein, 10 aa, Mycobacterium tuberculosis
CLALAADIRV

SEQ ID NO: 18312 - protein, 10 aa, Mycobacterium tuberculosis
LALAADIRVA

SEQ ID NO: 18313 - protein, 10 aa, Mycobacterium tuberculosis
ALAADIRVAS

SEQ ID NO: 18314 - protein, 10 aa, Mycobacterium tuberculosis
LAADIRVASS

SEQ ID NO: 18315 - protein, 10 aa, Mycobacterium tuberculosis
AADIRVASSS

SEQ ID NO: 18316 - protein, 10 aa, Mycobacterium tuberculosis
ADIRVASSSA

SEQ ID NO: 18317 - protein, 10 aa, Mycobacterium tuberculosis
DIRVASSSAY

SEQ ID NO: 18318 - protein, 10 aa, Mycobacterium tuberculosis
IRVASSSAYF

SEQ ID NO: 18319 - protein, 10 aa, Mycobacterium tuberculosis
RVASSSAYFR

SEQ ID NO: 18320 - protein, 10 aa, Mycobacterium tuberculosis
VASSSAYFRA

SEQ ID NO: 18321 - protein, 10 aa, Mycobacterium tuberculosis
ASSSAYFRAA

SEQ ID NO: 18322 - protein, 10 aa, Mycobacterium tuberculosis
SSSAYFRAAG

SEQ ID NO: 18323 - protein, 10 aa, Mycobacterium tuberculosis
SSAYFRAAGI

SEQ ID NO: 18324 - protein, 10 aa, Mycobacterium tuberculosis
SAYFRAAGIN

SEQ ID NO: 18325 - protein, 10 aa, Mycobacterium tuberculosis
AYFRAAGINN

SEQ ID NO: 18326 - protein, 10 aa, Mycobacterium tuberculosis
YFRAAGINNG

SEQ ID NO: 18327 - protein, 10 aa, Mycobacterium tuberculosis
FRAAGINNGL

SEQ ID NO: 18328 - protein, 10 aa, Mycobacterium tuberculosis
RAAGINNGLT

SEQ ID NO: 18329 - protein, 10 aa, Mycobacterium tuberculosis
AAGINNGLTA

SEQ ID NO: 18330 - protein, 10 aa, Mycobacterium tuberculosis
AGINNGLTAS

SEQ ID NO: 18331 - protein, 10 aa, Mycobacterium tuberculosis
GINNGLTASE

SEQ ID NO: 18332 - protein, 10 aa, Mycobacterium tuberculosis
INNGLTASEL

SEQ ID NO: 18333 - protein, 10 aa, Mycobacterium tuberculosis
NNGLTASELG

SEQ ID NO: 18334 - protein, 10 aa, Mycobacterium tuberculosis
NGLTASELGL

SEQ ID NO: 18335 - protein, 10 aa, Mycobacterium tuberculosis
GLTASELGLS

SEQ ID NO: 18336 - protein, 10 aa, Mycobacterium tuberculosis
LTASELGLSY

SEQ ID NO: 18337 - protein, 10 aa, Mycobacterium tuberculosis
TASELGLSYL

SEQ ID NO: 18338 - protein, 10 aa, Mycobacterium tuberculosis
ASELGLSYLL

SEQ ID NO: 18339 - protein, 10 aa, Mycobacterium tuberculosis
SELGLSYLLP

SEQ ID NO: 18340 - protein, 10 aa, Mycobacterium tuberculosis
ELGLSYLLPR

SEQ ID NO: 18341 - protein, 10 aa, Mycobacterium tuberculosis
LGLSYLLPRA

SEQ ID NO: 18342 - protein, 10 aa, Mycobacterium tuberculosis
GLSYLLPRAI

SEQ ID NO: 18343 - protein, 10 aa, Mycobacterium tuberculosis
LSYLLPRAIG

SEQ ID NO: 18344 - protein, 10 aa, Mycobacterium tuberculosis
SYLLPRAIGS

SEQ ID NO: 18345 - protein, 10 aa, Mycobacterium tuberculosis
YLLPRAIGSS

SEQ ID NO: 18346 - protein, 10 aa, Mycobacterium tuberculosis
LLPRAIGSSR

SEQ ID NO: 18347 - protein, 10 aa, Mycobacterium tuberculosis
LPRAIGSSRA

SEQ ID NO: 18348 - protein, 10 aa, Mycobacterium tuberculosis
PRAIGSSRAF

SEQ ID NO: 18349 - protein, 10 aa, Mycobacterium tuberculosis
RAIGSSRAFE

SEQ ID NO: 18350 - protein, 10 aa, Mycobacterium tuberculosis
AIGSSRAFEI

SEQ ID NO: 18351 - protein, 10 aa, Mycobacterium tuberculosis
IGSSRAFEIM

SEQ ID NO: 18352 - protein, 10 aa, Mycobacterium tuberculosis
GSSRAFEIML

SEQ ID NO: 18353 - protein, 10 aa, Mycobacterium tuberculosis
SSRAFEIMLT

SEQ ID NO: 18354 - protein, 10 aa, Mycobacterium tuberculosis
SRAFEIMLTG

SEQ ID NO: 18355 - protein, 10 aa, Mycobacterium tuberculosis
RAFEIMLTGR

SEQ ID NO: 18356 - protein, 10 aa, Mycobacterium tuberculosis
AFEIMLTGRD

SEQ ID NO: 18357 - protein, 10 aa, Mycobacterium tuberculosis
FEIMLTGRDV

SEQ ID NO: 18358 - protein, 10 aa, Mycobacterium tuberculosis
EIMLTGRDVS

SEQ ID NO: 18359 - protein, 10 aa, Mycobacterium tuberculosis
IMLTGRDVSA

SEQ ID NO: 18360 - protein, 10 aa, Mycobacterium tuberculosis
MLTGRDVSAE

SEQ ID NO: 18361 - protein, 10 aa, Mycobacterium tuberculosis
LTGRDVSAEE

SEQ ID NO: 18362 - protein, 10 aa, Mycobacterium tuberculosis
TGRDVSAEEA

SEQ ID NO: 18363 - protein, 10 aa, Mycobacterium tuberculosis
GRDVSAEEAE

SEQ ID NO: 18364 - protein, 10 aa, Mycobacterium tuberculosis
RDVSAEEAER

SEQ ID NO: 18365 - protein, 10 aa, Mycobacterium tuberculosis
DVSAEEAERI

SEQ ID NO: 18366 - protein, 10 aa, Mycobacterium tuberculosis
VSAEEAERIG

SEQ ID NO: 18367 - protein, 10 aa, Mycobacterium tuberculosis
SAEEAERIGL

SEQ ID NO: 18368 - protein, 10 aa, Mycobacterium tuberculosis
AEEAERIGLV

SEQ ID NO: 18369 - protein, 10 aa, Mycobacterium tuberculosis
EEAERIGLVS

SEQ ID NO: 18370 - protein, 10 aa, Mycobacterium tuberculosis
EAERIGLVSR

SEQ ID NO: 18371 - protein, 10 aa, Mycobacterium tuberculosis
AERIGLVSRQ

SEQ ID NO: 18372 - protein, 10 aa, Mycobacterium tuberculosis
ERIGLVSRQV

SEQ ID NO: 18373 - protein, 10 aa, Mycobacterium tuberculosis
RIGLVSRQVP

SEQ ID NO: 18374 - protein, 10 aa, Mycobacterium tuberculosis
IGLVSRQVPD

SEQ ID NO: 18375 - protein, 10 aa, Mycobacterium tuberculosis
GLVSRQVPDE

SEQ ID NO: 18376 - protein, 10 aa, Mycobacterium tuberculosis
LVSRQVPDEQ

SEQ ID NO: 18377 - protein, 10 aa, Mycobacterium tuberculosis
VSRQVPDEQL

SEQ ID NO: 18378 - protein, 10 aa, Mycobacterium tuberculosis
SRQVPDEQLL

SEQ ID NO: 18379 - protein, 10 aa, Mycobacterium tuberculosis
RQVPDEQLLD

SEQ ID NO: 18380 - protein, 10 aa, Mycobacterium tuberculosis
QVPDEQLLDA

SEQ ID NO: 18381 - protein, 10 aa, Mycobacterium tuberculosis
VPDEQLLDAC

SEQ ID NO: 18382 - protein, 10 aa, Mycobacterium tuberculosis
PDEQLLDACY

SEQ ID NO: 18383 - protein, 10 aa, Mycobacterium tuberculosis
DEQLLDACYA

SEQ ID NO: 18384 - protein, 10 aa, Mycobacterium tuberculosis
EQLLDACYAI

SEQ ID NO: 18385 - protein, 10 aa, Mycobacterium tuberculosis
QLLDACYAIA

SEQ ID NO: 18386 - protein, 10 aa, Mycobacterium tuberculosis
LLDACYAIAA

SEQ ID NO: 18387 - protein, 10 aa, Mycobacterium tuberculosis
LDACYAIAAR

SEQ ID NO: 18388 - protein, 10 aa, Mycobacterium tuberculosis
DACYAIAARM

SEQ ID NO: 18389 - protein, 10 aa, Mycobacterium tuberculosis
ACYAIAARMA

SEQ ID NO: 18390 - protein, 10 aa, Mycobacterium tuberculosis
CYAIAARMAG

SEQ ID NO: 18391 - protein, 10 aa, Mycobacterium tuberculosis
YAIAARMAGF

SEQ ID NO: 18392 - protein, 10 aa, Mycobacterium tuberculosis
AIAARMAGFS

SEQ ID NO: 18393 - protein, 10 aa, Mycobacterium tuberculosis
IAARMAGFSR

SEQ ID NO: 18394 - protein, 10 aa, Mycobacterium tuberculosis
AARMAGFSRP

SEQ ID NO: 18395 - protein, 10 aa, Mycobacterium tuberculosis
ARMAGFSRPG

SEQ ID NO: 18396 - protein, 10 aa, Mycobacterium tuberculosis
RMAGFSRPGI

SEQ ID NO: 18397 - protein, 10 aa, Mycobacterium tuberculosis
MAGFSRPGIE

SEQ ID NO: 18398 - protein, 10 aa, Mycobacterium tuberculosis
AGFSRPGIEL

SEQ ID NO: 18399 - protein, 10 aa, Mycobacterium tuberculosis
GFSRPGIELT

SEQ ID NO: 18400 - protein, 10 aa, Mycobacterium tuberculosis
FSRPGIELTK

SEQ ID NO: 18401 - protein, 10 aa, Mycobacterium tuberculosis
SRPGIELTKR

SEQ ID NO: 18402 - protein, 10 aa, Mycobacterium tuberculosis
RPGIELTKRT

SEQ ID NO: 18403 - protein, 10 aa, Mycobacterium tuberculosis
PGIELTKRTL

SEQ ID NO: 18404 - protein, 10 aa, Mycobacterium tuberculosis
GIELTKRTLW

SEQ ID NO: 18405 - protein, 10 aa, Mycobacterium tuberculosis
IELTKRTLWS

SEQ ID NO: 18406 - protein, 10 aa, Mycobacterium tuberculosis
ELTKRTLWSG

SEQ ID NO: 18407 - protein, 10 aa, Mycobacterium tuberculosis
LTKRTLWSGL

SEQ ID NO: 18408 - protein, 10 aa, Mycobacterium tuberculosis
TKRTLWSGLD

SEQ ID NO: 18409 - protein, 10 aa, Mycobacterium tuberculosis
KRTLWSGLDA

SEQ ID NO: 18410 - protein, 10 aa, Mycobacterium tuberculosis
RTLWSGLDAA

SEQ ID NO: 18411 - protein, 10 aa, Mycobacterium tuberculosis
TLWSGLDAAS

SEQ ID NO: 18412 - protein, 10 aa, Mycobacterium tuberculosis
LWSGLDAASL

SEQ ID NO: 18413 - protein, 10 aa, Mycobacterium tuberculosis
WSGLDAASLE

SEQ ID NO: 18414 - protein, 10 aa, Mycobacterium tuberculosis
SGLDAASLEA

SEQ ID NO: 18415 - protein, 10 aa, Mycobacterium tuberculosis
GLDAASLEAH

SEQ ID NO: 18416 - protein, 10 aa, Mycobacterium tuberculosis
LDAASLEAHM

SEQ ID NO: 18417 - protein, 10 aa, Mycobacterium tuberculosis
DAASLEAHMQ

SEQ ID NO: 18418 - protein, 10 aa, Mycobacterium tuberculosis
AASLEAHMQA

SEQ ID NO: 18419 - protein, 10 aa, Mycobacterium tuberculosis
ASLEAHMQAE

SEQ ID NO: 18420 - protein, 10 aa, Mycobacterium tuberculosis
SLEAHMQAEG

SEQ ID NO: 18421 - protein, 10 aa, Mycobacterium tuberculosis
LEAHMQAEGL

SEQ ID NO: 18422 - protein, 10 aa, Mycobacterium tuberculosis
EAHMQAEGLG

SEQ ID NO: 18423 - protein, 10 aa, Mycobacterium tuberculosis
AHMQAEGLGQ

SEQ ID NO: 18424 - protein, 10 aa, Mycobacterium tuberculosis
HMQAEGLGQL

SEQ ID NO: 18425 - protein, 10 aa, Mycobacterium tuberculosis
MQAEGLGQLF

SEQ ID NO: 18426 - protein, 10 aa, Mycobacterium tuberculosis
QAEGLGQLFV

SEQ ID NO: 18427 - protein, 10 aa, Mycobacterium tuberculosis
AEGLGQLFVR

SEQ ID NO: 18428 - protein, 10 aa, Mycobacterium tuberculosis
EGLGQLFVRL

SEQ ID NO: 18429 - protein, 10 aa, Mycobacterium tuberculosis
GLGQLFVRLL

SEQ ID NO: 18430 - protein, 10 aa, Mycobacterium tuberculosis
LGQLFVRLLT

SEQ ID NO: 18431 - protein, 10 aa, Mycobacterium tuberculosis
GQLFVRLLTA

SEQ ID NO: 18432 - protein, 10 aa, Mycobacterium tuberculosis
QLFVRLLTAN

SEQ ID NO: 18433 - protein, 10 aa, Mycobacterium tuberculosis
LFVRLLTANF

SEQ ID NO: 18434 - protein, 10 aa, Mycobacterium tuberculosis
FVRLLTANFE

SEQ ID NO: 18435 - protein, 10 aa, Mycobacterium tuberculosis
VRLLTANFEE

SEQ ID NO: 18436 - protein, 10 aa, Mycobacterium tuberculosis
RLLTANFEEA

SEQ ID NO: 18437 - protein, 10 aa, Mycobacterium tuberculosis
LLTANFEEAV

SEQ ID NO: 18438 - protein, 10 aa, Mycobacterium tuberculosis
LTANFEEAVA

SEQ ID NO: 18439 - protein, 10 aa, Mycobacterium tuberculosis
TANFEEAVAA

SEQ ID NO: 18440 - protein, 10 aa, Mycobacterium tuberculosis
ANFEEAVAAR

SEQ ID NO: 18441 - protein, 10 aa, Mycobacterium tuberculosis
NFEEAVAARA

SEQ ID NO: 18442 - protein, 10 aa, Mycobacterium tuberculosis
FEEAVAARAE

SEQ ID NO: 18443 - protein, 10 aa, Mycobacterium tuberculosis
EEAVAARAEQ

SEQ ID NO: 18444 - protein, 10 aa, Mycobacterium tuberculosis
EAVAARAEQR

SEQ ID NO: 18445 - protein, 10 aa, Mycobacterium tuberculosis
AVAARAEQRA

SEQ ID NO: 18446 - protein, 10 aa, Mycobacterium tuberculosis
VAARAEQRAP

SEQ ID NO: 18447 - protein, 10 aa, Mycobacterium tuberculosis
AARAEQRAPV

SEQ ID NO: 18448 - protein, 10 aa, Mycobacterium tuberculosis
ARAEQRAPVF

SEQ ID NO: 18449 - protein, 10 aa, Mycobacterium tuberculosis
RAEQRAPVFT

SEQ ID NO: 18450 - protein, 10 aa, Mycobacterium tuberculosis
AEQRAPVFTD

SEQ ID NO: 18451 - protein, 10 aa, Mycobacterium tuberculosis
EQRAPVFTDD

SEQ ID NO: 18452 - protein, 10 aa, Mycobacterium tuberculosis
QRAPVFTDDT

SEQ ID NO: 18453 - protein, 11 aa, Mycobacterium tuberculosis
MPHRCAAQVVA

SEQ ID NO: 18454 - protein, 11 aa, Mycobacterium tuberculosis
PHRCAAQVVAG

SEQ ID NO: 18455 - protein, 11 aa, Mycobacterium tuberculosis
HRCAAQVVAGY

SEQ ID NO: 18456 - protein, 11 aa, Mycobacterium tuberculosis
RCAAQVVAGYR

SEQ ID NO: 18457 - protein, 11 aa, Mycobacterium tuberculosis
CAAQVVAGYRS

SEQ ID NO: 18458 - protein, 11 aa, Mycobacterium tuberculosis
AAQVVAGYRST

SEQ ID NO: 18459 - protein, 11 aa, Mycobacterium tuberculosis
AQVVAGYRSTV

SEQ ID NO: 18460 - protein, 11 aa, Mycobacterium tuberculosis
QVVAGYRSTVS

SEQ ID NO: 18461 - protein, 11 aa, Mycobacterium tuberculosis
VVAGYRSTVSL

SEQ ID NO: 18462 - protein, 11 aa, Mycobacterium tuberculosis
VAGYRSTVSLV

SEQ ID NO: 18463 - protein, 11 aa, Mycobacterium tuberculosis
AGYRSTVSLVL

SEQ ID NO: 18464 - protein, 11 aa, Mycobacterium tuberculosis
GYRSTVSLVLV

SEQ ID NO: 18465 - protein, 11 aa, Mycobacterium tuberculosis
YRSTVSLVLVE

SEQ ID NO: 18466 - protein, 11 aa, Mycobacterium tuberculosis
RSTVSLVLVEH

SEQ ID NO: 18467 - protein, 11 aa, Mycobacterium tuberculosis
STVSLVLVEHP

SEQ ID NO: 18468 - protein, 11 aa, Mycobacterium tuberculosis
TVSLVLVEHPR

SEQ ID NO: 18469 - protein, 11 aa, Mycobacterium tuberculosis
VSLVLVEHPRP

SEQ ID NO: 18470 - protein, 11 aa, Mycobacterium tuberculosis
SLVLVEHPRPE

SEQ ID NO: 18471 - protein, 11 aa, Mycobacterium tuberculosis
LVLVEHPRPEI

SEQ ID NO: 18472 - protein, 11 aa, Mycobacterium tuberculosis
VLVEHPRPEIA

SEQ ID NO: 18473 - protein, 11 aa, Mycobacterium tuberculosis
LVEHPRPEIAQ

SEQ ID NO: 18474 - protein, 11 aa, Mycobacterium tuberculosis
VEHPRPEIAQI

SEQ ID NO: 18475 - protein, 11 aa, Mycobacterium tuberculosis
EHPRPEIAQIT

SEQ ID NO: 18476 - protein, 11 aa, Mycobacterium tuberculosis
HPRPEIAQITL

SEQ ID NO: 18477 - protein, 11 aa, Mycobacterium tuberculosis
PRPEIAQITLN

SEQ ID NO: 18478 - protein, 11 aa, Mycobacterium tuberculosis
RPEIAQITLNR

SEQ ID NO: 18479 - protein, 11 aa, Mycobacterium tuberculosis
PEIAQITLNRP

SEQ ID NO: 18480 - protein, 11 aa, Mycobacterium tuberculosis
EIAQITLNRPE

SEQ ID NO: 18481 - protein, 11 aa, Mycobacterium tuberculosis
IAQITLNRPER

SEQ ID NO: 18482 - protein, 11 aa, Mycobacterium tuberculosis
AQITLNRPERM

SEQ ID NO: 18483 - protein, 11 aa, Mycobacterium tuberculosis
QITLNRPERMN

SEQ ID NO: 18484 - protein, 11 aa, Mycobacterium tuberculosis
ITLNRPERMNS

SEQ ID NO: 18485 - protein, 11 aa, Mycobacterium tuberculosis
TLNRPERMNSM

SEQ ID NO: 18486 - protein, 11 aa, Mycobacterium tuberculosis
LNRPERMNSMA

SEQ ID NO: 18487 - protein, 11 aa, Mycobacterium tuberculosis
NRPERMNSMAF

SEQ ID NO: 18488 - protein, 11 aa, Mycobacterium tuberculosis
RPERMNSMAFD

SEQ ID NO: 18489 - protein, 11 aa, Mycobacterium tuberculosis
PERMNSMAFDV

SEQ ID NO: 18490 - protein, 11 aa, Mycobacterium tuberculosis
ERMNSMAFDVM

SEQ ID NO: 18491 - protein, 11 aa, Mycobacterium tuberculosis
RMNSMAFDVMV

SEQ ID NO: 18492 - protein, 11 aa, Mycobacterium tuberculosis
MNSMAFDVMVP

SEQ ID NO: 18493 - protein, 11 aa, Mycobacterium tuberculosis
NSMAFDVMVPL

SEQ ID NO: 18494 - protein, 11 aa, Mycobacterium tuberculosis
SMAFDVMVPLK

SEQ ID NO: 18495 - protein, 11 aa, Mycobacterium tuberculosis
MAFDVMVPLKE

SEQ ID NO: 18496 - protein, 11 aa, Mycobacterium tuberculosis
AFDVMVPLKEA

SEQ ID NO: 18497 - protein, 11 aa, Mycobacterium tuberculosis
FDVMVPLKEAL

SEQ ID NO: 18498 - protein, 11 aa, Mycobacterium tuberculosis
DVMVPLKEALA

SEQ ID NO: 18499 - protein, 11 aa, Mycobacterium tuberculosis
VMVPLKEALAQ

SEQ ID NO: 18500 - protein, 11 aa, Mycobacterium tuberculosis
MVPLKEALAQV

SEQ ID NO: 18501 - protein, 11 aa, Mycobacterium tuberculosis
VPLKEALAQVS

SEQ ID NO: 18502 - protein, 11 aa, Mycobacterium tuberculosis
PLKEALAQVSY

SEQ ID NO: 18503 - protein, 11 aa, Mycobacterium tuberculosis
LKEALAQVSYD

SEQ ID NO: 18504 - protein, 11 aa, Mycobacterium tuberculosis
KEALAQVSYDN

SEQ ID NO: 18505 - protein, 11 aa, Mycobacterium tuberculosis
EALAQVSYDNS

SEQ ID NO: 18506 - protein, 11 aa, Mycobacterium tuberculosis
ALAQVSYDNSV

SEQ ID NO: 18507 - protein, 11 aa, Mycobacterium tuberculosis
LAQVSYDNSVR

SEQ ID NO: 18508 - protein, 11 aa, Mycobacterium tuberculosis
AQVSYDNSVRV

SEQ ID NO: 18509 - protein, 11 aa, Mycobacterium tuberculosis
QVSYDNSVRVV

SEQ ID NO: 18510 - protein, 11 aa, Mycobacterium tuberculosis
VSYDNSVRVVV

SEQ ID NO: 18511 - protein, 11 aa, Mycobacterium tuberculosis
SYDNSVRVVVL

SEQ ID NO: 18512 - protein, 11 aa, Mycobacterium tuberculosis
YDNSVRVVVLT

SEQ ID NO: 18513 - protein, 11 aa, Mycobacterium tuberculosis
DNSVRVVVLTG

SEQ ID NO: 18514 - protein, 11 aa, Mycobacterium tuberculosis
NSVRVVVLTGA

SEQ ID NO: 18515 - protein, 11 aa, Mycobacterium tuberculosis
SVRVVVLTGAG

SEQ ID NO: 18516 - protein, 11 aa, Mycobacterium tuberculosis
VRVVVLTGAGR

SEQ ID NO: 18517 - protein, 11 aa, Mycobacterium tuberculosis
RVVVLTGAGRG

SEQ ID NO: 18518 - protein, 11 aa, Mycobacterium tuberculosis
VVVLTGAGRGF

SEQ ID NO: 18519 - protein, 11 aa, Mycobacterium tuberculosis
VVLTGAGRGFS

SEQ ID NO: 18520 - protein, 11 aa, Mycobacterium tuberculosis
VLTGAGRGFSP

SEQ ID NO: 18521 - protein, 11 aa, Mycobacterium tuberculosis
LTGAGRGFSPG

SEQ ID NO: 18522 - protein, 11 aa, Mycobacterium tuberculosis
TGAGRGFSPGA

SEQ ID NO: 18523 - protein, 11 aa, Mycobacterium tuberculosis
GAGRGFSPGAD

SEQ ID NO: 18524 - protein, 11 aa, Mycobacterium tuberculosis
AGRGFSPGADH

SEQ ID NO: 18525 - protein, 11 aa, Mycobacterium tuberculosis
GRGFSPGADHK

SEQ ID NO: 18526 - protein, 11 aa, Mycobacterium tuberculosis
RGFSPGADHKS

SEQ ID NO: 18527 - protein, 11 aa, Mycobacterium tuberculosis
GFSPGADHKSA

SEQ ID NO: 18528 - protein, 11 aa, Mycobacterium tuberculosis
FSPGADHKSAG

SEQ ID NO: 18529 - protein, 11 aa, Mycobacterium tuberculosis
SPGADHKSAGV

SEQ ID NO: 18530 - protein, 11 aa, Mycobacterium tuberculosis
PGADHKSAGVV

SEQ ID NO: 18531 - protein, 11 aa, Mycobacterium tuberculosis
GADHKSAGVVP

SEQ ID NO: 18532 - protein, 11 aa, Mycobacterium tuberculosis
ADHKSAGVVPH

SEQ ID NO: 18533 - protein, 11 aa, Mycobacterium tuberculosis
DHKSAGVVPHV

SEQ ID NO: 18534 - protein, 11 aa, Mycobacterium tuberculosis
HKSAGVVPHVE

SEQ ID NO: 18535 - protein, 11 aa, Mycobacterium tuberculosis
KSAGVVPHVEN

SEQ ID NO: 18536 - protein, 11 aa, Mycobacterium tuberculosis
SAGVVPHVENL

SEQ ID NO: 18537 - protein, 11 aa, Mycobacterium tuberculosis
AGVVPHVENLT

SEQ ID NO: 18538 - protein, 11 aa, Mycobacterium tuberculosis
GVVPHVENLTR

SEQ ID NO: 18539 - protein, 11 aa, Mycobacterium tuberculosis
VVPHVENLTRP

SEQ ID NO: 18540 - protein, 11 aa, Mycobacterium tuberculosis
VPHVENLTRPT

SEQ ID NO: 18541 - protein, 11 aa, Mycobacterium tuberculosis
PHVENLTRPTY

SEQ ID NO: 18542 - protein, 11 aa, Mycobacterium tuberculosis
HVENLTRPTYA

SEQ ID NO: 18543 - protein, 11 aa, Mycobacterium tuberculosis
VENLTRPTYAL

SEQ ID NO: 18544 - protein, 11 aa, Mycobacterium tuberculosis
ENLTRPTYALR

SEQ ID NO: 18545 - protein, 11 aa, Mycobacterium tuberculosis
NLTRPTYALRS

SEQ ID NO: 18546 - protein, 11 aa, Mycobacterium tuberculosis
LTRPTYALRSM

SEQ ID NO: 18547 - protein, 11 aa, Mycobacterium tuberculosis
TRPTYALRSME

SEQ ID NO: 18548 - protein, 11 aa, Mycobacterium tuberculosis
RPTYALRSMEL

SEQ ID NO: 18549 - protein, 11 aa, Mycobacterium tuberculosis
PTYALRSMELL

SEQ ID NO: 18550 - protein, 11 aa, Mycobacterium tuberculosis
TYALRSMELLD

SEQ ID NO: 18551 - protein, 11 aa, Mycobacterium tuberculosis
YALRSMELLDD

SEQ ID NO: 18552 - protein, 11 aa, Mycobacterium tuberculosis
ALRSMELLDDV

SEQ ID NO: 18553 - protein, 11 aa, Mycobacterium tuberculosis
LRSMELLDDVI

SEQ ID NO: 18554 - protein, 11 aa, Mycobacterium tuberculosis
RSMELLDDVIL

SEQ ID NO: 18555 - protein, 11 aa, Mycobacterium tuberculosis
SMELLDDVILM

SEQ ID NO: 18556 - protein, 11 aa, Mycobacterium tuberculosis
MELLDDVILML

SEQ ID NO: 18557 - protein, 11 aa, Mycobacterium tuberculosis
ELLDDVILMLR

SEQ ID NO: 18558 - protein, 11 aa, Mycobacterium tuberculosis
LLDDVILMLRR

SEQ ID NO: 18559 - protein, 11 aa, Mycobacterium tuberculosis
LDDVILMLRRL

SEQ ID NO: 18560 - protein, 11 aa, Mycobacterium tuberculosis
DDVILMLRRLH

SEQ ID NO: 18561 - protein, 11 aa, Mycobacterium tuberculosis
DVILMLRRLHQ

SEQ ID NO: 18562 - protein, 11 aa, Mycobacterium tuberculosis
VILMLRRLHQP

SEQ ID NO: 18563 - protein, 11 aa, Mycobacterium tuberculosis
ILMLRRLHQPV

SEQ ID NO: 18564 - protein, 11 aa, Mycobacterium tuberculosis
LMLRRLHQPVI

SEQ ID NO: 18565 - protein, 11 aa, Mycobacterium tuberculosis
MLRRLHQPVIA

SEQ ID NO: 18566 - protein, 11 aa, Mycobacterium tuberculosis
LRRLHQPVIAA

SEQ ID NO: 18567 - protein, 11 aa, Mycobacterium tuberculosis
RRLHQPVIAAV

SEQ ID NO: 18568 - protein, 11 aa, Mycobacterium tuberculosis
RLHQPVIAAVN

SEQ ID NO: 18569 - protein, 11 aa, Mycobacterium tuberculosis
LHQPVIAAVNG

SEQ ID NO: 18570 - protein, 11 aa, Mycobacterium tuberculosis
HQPVIAAVNGP

SEQ ID NO: 18571 - protein, 11 aa, Mycobacterium tuberculosis
QPVIAAVNGPA

SEQ ID NO: 18572 - protein, 11 aa, Mycobacterium tuberculosis
PVIAAVNGPAI

SEQ ID NO: 18573 - protein, 11 aa, Mycobacterium tuberculosis
VIAAVNGPAIG

SEQ ID NO: 18574 - protein, 11 aa, Mycobacterium tuberculosis
IAAVNGPAIGG

SEQ ID NO: 18575 - protein, 11 aa, Mycobacterium tuberculosis
AAVNGPAIGGG

SEQ ID NO: 18576 - protein, 11 aa, Mycobacterium tuberculosis
AVNGPAIGGGL

SEQ ID NO: 18577 - protein, 11 aa, Mycobacterium tuberculosis
VNGPAIGGGLC

SEQ ID NO: 18578 - protein, 11 aa, Mycobacterium tuberculosis
NGPAIGGGLCL

SEQ ID NO: 18579 - protein, 11 aa, Mycobacterium tuberculosis
GPAIGGGLCLA

SEQ ID NO: 18580 - protein, 11 aa, Mycobacterium tuberculosis
PAIGGGLCLAL

SEQ ID NO: 18581 - protein, 11 aa, Mycobacterium tuberculosis
AIGGGLCLALA

SEQ ID NO: 18582 - protein, 11 aa, Mycobacterium tuberculosis
IGGGLCLALAA

SEQ ID NO: 18583 - protein, 11 aa, Mycobacterium tuberculosis
GGGLCLALAAD

SEQ ID NO: 18584 - protein, 11 aa, Mycobacterium tuberculosis
GGLCLALAADI

SEQ ID NO: 18585 - protein, 11 aa, Mycobacterium tuberculosis
GLCLALAADIR

SEQ ID NO: 18586 - protein, 11 aa, Mycobacterium tuberculosis
LCLALAADIRV

SEQ ID NO: 18587 - protein, 11 aa, Mycobacterium tuberculosis
CLALAADIRVA

SEQ ID NO: 18588 - protein, 11 aa, Mycobacterium tuberculosis
LALAADIRVAS

SEQ ID NO: 18589 - protein, 11 aa, Mycobacterium tuberculosis
ALAADIRVASS

SEQ ID NO: 18590 - protein, 11 aa, Mycobacterium tuberculosis
LAADIRVASSS

SEQ ID NO: 18591 - protein, 11 aa, Mycobacterium tuberculosis
AADIRVASSSA

SEQ ID NO: 18592 - protein, 11 aa, Mycobacterium tuberculosis
ADIRVASSSAY

SEQ ID NO: 18593 - protein, 11 aa, Mycobacterium tuberculosis
DIRVASSSAYF

SEQ ID NO: 18594 - protein, 11 aa, Mycobacterium tuberculosis
IRVASSSAYFR

SEQ ID NO: 18595 - protein, 11 aa, Mycobacterium tuberculosis
RVASSSAYFRA

SEQ ID NO: 18596 - protein, 11 aa, Mycobacterium tuberculosis
VASSSAYFRAA

SEQ ID NO: 18597 - protein, 11 aa, Mycobacterium tuberculosis
ASSSAYFRAAG

SEQ ID NO: 18598 - protein, 11 aa, Mycobacterium tuberculosis
SSSAYFRAAGI

SEQ ID NO: 18599 - protein, 11 aa, Mycobacterium tuberculosis
SSAYFRAAGIN

SEQ ID NO: 18600 - protein, 11 aa, Mycobacterium tuberculosis
SAYFRAAGINN

SEQ ID NO: 18601 - protein, 11 aa, Mycobacterium tuberculosis
AYFRAAGINNG

SEQ ID NO: 18602 - protein, 11 aa, Mycobacterium tuberculosis
YFRAAGINNGL

SEQ ID NO: 18603 - protein, 11 aa, Mycobacterium tuberculosis
FRAAGINNGLT

SEQ ID NO: 18604 - protein, 11 aa, Mycobacterium tuberculosis
RAAGINNGLTA

SEQ ID NO: 18605 - protein, 11 aa, Mycobacterium tuberculosis
AAGINNGLTAS

SEQ ID NO: 18606 - protein, 11 aa, Mycobacterium tuberculosis
AGINNGLTASE

SEQ ID NO: 18607 - protein, 11 aa, Mycobacterium tuberculosis
GINNGLTASEL

SEQ ID NO: 18608 - protein, 11 aa, Mycobacterium tuberculosis
INNGLTASELG

SEQ ID NO: 18609 - protein, 11 aa, Mycobacterium tuberculosis
NNGLTASELGL

SEQ ID NO: 18610 - protein, 11 aa, Mycobacterium tuberculosis
NGLTASELGLS

SEQ ID NO: 18611 - protein, 11 aa, Mycobacterium tuberculosis
GLTASELGLSY

SEQ ID NO: 18612 - protein, 11 aa, Mycobacterium tuberculosis
LTASELGLSYL

SEQ ID NO: 18613 - protein, 11 aa, Mycobacterium tuberculosis
TASELGLSYLL

SEQ ID NO: 18614 - protein, 11 aa, Mycobacterium tuberculosis
ASELGLSYLLP

SEQ ID NO: 18615 - protein, 11 aa, Mycobacterium tuberculosis
SELGLSYLLPR

SEQ ID NO: 18616 - protein, 11 aa, Mycobacterium tuberculosis
ELGLSYLLPRA

SEQ ID NO: 18617 - protein, 11 aa, Mycobacterium tuberculosis
LGLSYLLPRAI

SEQ ID NO: 18618 - protein, 11 aa, Mycobacterium tuberculosis
GLSYLLPRAIG

SEQ ID NO: 18619 - protein, 11 aa, Mycobacterium tuberculosis
LSYLLPRAIGS

SEQ ID NO: 18620 - protein, 11 aa, Mycobacterium tuberculosis
SYLLPRAIGSS

SEQ ID NO: 18621 - protein, 11 aa, Mycobacterium tuberculosis
YLLPRAIGSSR

SEQ ID NO: 18622 - protein, 11 aa, Mycobacterium tuberculosis
LLPRAIGSSRA

SEQ ID NO: 18623 - protein, 11 aa, Mycobacterium tuberculosis
LPRAIGSSRAF

SEQ ID NO: 18624 - protein, 11 aa, Mycobacterium tuberculosis
PRAIGSSRAFE

SEQ ID NO: 18625 - protein, 11 aa, Mycobacterium tuberculosis
RAIGSSRAFEI

SEQ ID NO: 18626 - protein, 11 aa, Mycobacterium tuberculosis
AIGSSRAFEIM

SEQ ID NO: 18627 - protein, 11 aa, Mycobacterium tuberculosis
IGSSRAFEIML

SEQ ID NO: 18628 - protein, 11 aa, Mycobacterium tuberculosis
GSSRAFEIMLT

SEQ ID NO: 18629 - protein, 11 aa, Mycobacterium tuberculosis
SSRAFEIMLTG

SEQ ID NO: 18630 - protein, 11 aa, Mycobacterium tuberculosis
SRAFEIMLTGR

SEQ ID NO: 18631 - protein, 11 aa, Mycobacterium tuberculosis
RAFEIMLTGRD

SEQ ID NO: 18632 - protein, 11 aa, Mycobacterium tuberculosis
AFEIMLTGRDV

SEQ ID NO: 18633 - protein, 11 aa, Mycobacterium tuberculosis
FEIMLTGRDVS

SEQ ID NO: 18634 - protein, 11 aa, Mycobacterium tuberculosis
EIMLTGRDVSA

SEQ ID NO: 18635 - protein, 11 aa, Mycobacterium tuberculosis
IMLTGRDVSAE

SEQ ID NO: 18636 - protein, 11 aa, Mycobacterium tuberculosis
MLTGRDVSAEE

SEQ ID NO: 18637 - protein, 11 aa, Mycobacterium tuberculosis
LTGRDVSAEEA

SEQ ID NO: 18638 - protein, 11 aa, Mycobacterium tuberculosis
TGRDVSAEEAE

SEQ ID NO: 18639 - protein, 11 aa, Mycobacterium tuberculosis
GRDVSAEEAER

SEQ ID NO: 18640 - protein, 11 aa, Mycobacterium tuberculosis
RDVSAEEAERI

SEQ ID NO: 18641 - protein, 11 aa, Mycobacterium tuberculosis
DVSAEEAERIG

SEQ ID NO: 18642 - protein, 11 aa, Mycobacterium tuberculosis
VSAEEAERIGL

SEQ ID NO: 18643 - protein, 11 aa, Mycobacterium tuberculosis
SAEEAERIGLV

SEQ ID NO: 18644 - protein, 11 aa, Mycobacterium tuberculosis
AEEAERIGLVS

SEQ ID NO: 18645 - protein, 11 aa, Mycobacterium tuberculosis
EEAERIGLVSR

SEQ ID NO: 18646 - protein, 11 aa, Mycobacterium tuberculosis
EAERIGLVSRQ

SEQ ID NO: 18647 - protein, 11 aa, Mycobacterium tuberculosis
AERIGLVSRQV

SEQ ID NO: 18648 - protein, 11 aa, Mycobacterium tuberculosis
ERIGLVSRQVP

SEQ ID NO: 18649 - protein, 11 aa, Mycobacterium tuberculosis
RIGLVSRQVPD

SEQ ID NO: 18650 - protein, 11 aa, Mycobacterium tuberculosis
IGLVSRQVPDE

SEQ ID NO: 18651 - protein, 11 aa, Mycobacterium tuberculosis
GLVSRQVPDEQ

SEQ ID NO: 18652 - protein, 11 aa, Mycobacterium tuberculosis
LVSRQVPDEQL

SEQ ID NO: 18653 - protein, 11 aa, Mycobacterium tuberculosis
VSRQVPDEQLL

SEQ ID NO: 18654 - protein, 11 aa, Mycobacterium tuberculosis
SRQVPDEQLLD

SEQ ID NO: 18655 - protein, 11 aa, Mycobacterium tuberculosis
RQVPDEQLLDA

SEQ ID NO: 18656 - protein, 11 aa, Mycobacterium tuberculosis
QVPDEQLLDAC

SEQ ID NO: 18657 - protein, 11 aa, Mycobacterium tuberculosis
VPDEQLLDACY

SEQ ID NO: 18658 - protein, 11 aa, Mycobacterium tuberculosis
PDEQLLDACYA

SEQ ID NO: 18659 - protein, 11 aa, Mycobacterium tuberculosis
DEQLLDACYAI

SEQ ID NO: 18660 - protein, 11 aa, Mycobacterium tuberculosis
EQLLDACYAIA

SEQ ID NO: 18661 - protein, 11 aa, Mycobacterium tuberculosis
QLLDACYAIAA

SEQ ID NO: 18662 - protein, 11 aa, Mycobacterium tuberculosis
LLDACYAIAAR

SEQ ID NO: 18663 - protein, 11 aa, Mycobacterium tuberculosis
LDACYAIAARM

SEQ ID NO: 18664 - protein, 11 aa, Mycobacterium tuberculosis
DACYAIAARMA

SEQ ID NO: 18665 - protein, 11 aa, Mycobacterium tuberculosis
ACYAIAARMAG

SEQ ID NO: 18666 - protein, 11 aa, Mycobacterium tuberculosis
CYAIAARMAGF

SEQ ID NO: 18667 - protein, 11 aa, Mycobacterium tuberculosis
YAIAARMAGFS

SEQ ID NO: 18668 - protein, 11 aa, Mycobacterium tuberculosis
AIAARMAGFSR

SEQ ID NO: 18669 - protein, 11 aa, Mycobacterium tuberculosis
IAARMAGFSRP

SEQ ID NO: 18670 - protein, 11 aa, Mycobacterium tuberculosis
AARMAGFSRPG

SEQ ID NO: 18671 - protein, 11 aa, Mycobacterium tuberculosis
ARMAGFSRPGI

SEQ ID NO: 18672 - protein, 11 aa, Mycobacterium tuberculosis
RMAGFSRPGIE

SEQ ID NO: 18673 - protein, 11 aa, Mycobacterium tuberculosis
MAGFSRPGIEL

SEQ ID NO: 18674 - protein, 11 aa, Mycobacterium tuberculosis
AGFSRPGIELT

SEQ ID NO: 18675 - protein, 11 aa, Mycobacterium tuberculosis
GFSRPGIELTK

SEQ ID NO: 18676 - protein, 11 aa, Mycobacterium tuberculosis
FSRPGIELTKR

SEQ ID NO: 18677 - protein, 11 aa, Mycobacterium tuberculosis
SRPGIELTKRT

SEQ ID NO: 18678 - protein, 11 aa, Mycobacterium tuberculosis
RPGIELTKRTL

SEQ ID NO: 18679 - protein, 11 aa, Mycobacterium tuberculosis
PGIELTKRTLW

SEQ ID NO: 18680 - protein, 11 aa, Mycobacterium tuberculosis
GIELTKRTLWS

SEQ ID NO: 18681 - protein, 11 aa, Mycobacterium tuberculosis
IELTKRTLWSG

SEQ ID NO: 18682 - protein, 11 aa, Mycobacterium tuberculosis
ELTKRTLWSGL

SEQ ID NO: 18683 - protein, 11 aa, Mycobacterium tuberculosis
LTKRTLWSGLD

SEQ ID NO: 18684 - protein, 11 aa, Mycobacterium tuberculosis
TKRTLWSGLDA

SEQ ID NO: 18685 - protein, 11 aa, Mycobacterium tuberculosis
KRTLWSGLDAA

SEQ ID NO: 18686 - protein, 11 aa, Mycobacterium tuberculosis
RTLWSGLDAAS

SEQ ID NO: 18687 - protein, 11 aa, Mycobacterium tuberculosis
TLWSGLDAASL

SEQ ID NO: 18688 - protein, 11 aa, Mycobacterium tuberculosis
LWSGLDAASLE

SEQ ID NO: 18689 - protein, 11 aa, Mycobacterium tuberculosis
WSGLDAASLEA

SEQ ID NO: 18690 - protein, 11 aa, Mycobacterium tuberculosis
SGLDAASLEAH

SEQ ID NO: 18691 - protein, 11 aa, Mycobacterium tuberculosis
GLDAASLEAHM

SEQ ID NO: 18692 - protein, 11 aa, Mycobacterium tuberculosis
LDAASLEAHMQ

SEQ ID NO: 18693 - protein, 11 aa, Mycobacterium tuberculosis
DAASLEAHMQA

SEQ ID NO: 18694 - protein, 11 aa, Mycobacterium tuberculosis
AASLEAHMQAE

SEQ ID NO: 18695 - protein, 11 aa, Mycobacterium tuberculosis
ASLEAHMQAEG

SEQ ID NO: 18696 - protein, 11 aa, Mycobacterium tuberculosis
SLEAHMQAEGL

SEQ ID NO: 18697 - protein, 11 aa, Mycobacterium tuberculosis
LEAHMQAEGLG

SEQ ID NO: 18698 - protein, 11 aa, Mycobacterium tuberculosis
EAHMQAEGLGQ

SEQ ID NO: 18699 - protein, 11 aa, Mycobacterium tuberculosis
AHMQAEGLGQL

SEQ ID NO: 18700 - protein, 11 aa, Mycobacterium tuberculosis
HMQAEGLGQLF

SEQ ID NO: 18701 - protein, 11 aa, Mycobacterium tuberculosis
MQAEGLGQLFV

SEQ ID NO: 18702 - protein, 11 aa, Mycobacterium tuberculosis
QAEGLGQLFVR

SEQ ID NO: 18703 - protein, 11 aa, Mycobacterium tuberculosis
AEGLGQLFVRL

SEQ ID NO: 18704 - protein, 11 aa, Mycobacterium tuberculosis
EGLGQLFVRLL

SEQ ID NO: 18705 - protein, 11 aa, Mycobacterium tuberculosis
GLGQLFVRLLT

SEQ ID NO: 18706 - protein, 11 aa, Mycobacterium tuberculosis
LGQLFVRLLTA

SEQ ID NO: 18707 - protein, 11 aa, Mycobacterium tuberculosis
GQLFVRLLTAN

SEQ ID NO: 18708 - protein, 11 aa, Mycobacterium tuberculosis
QLFVRLLTANF

SEQ ID NO: 18709 - protein, 11 aa, Mycobacterium tuberculosis
LFVRLLTANFE

SEQ ID NO: 18710 - protein, 11 aa, Mycobacterium tuberculosis
FVRLLTANFEE

SEQ ID NO: 18711 - protein, 11 aa, Mycobacterium tuberculosis
VRLLTANFEEA

SEQ ID NO: 18712 - protein, 11 aa, Mycobacterium tuberculosis
RLLTANFEEAV

SEQ ID NO: 18713 - protein, 11 aa, Mycobacterium tuberculosis
LLTANFEEAVA

SEQ ID NO: 18714 - protein, 11 aa, Mycobacterium tuberculosis
LTANFEEAVAA

SEQ ID NO: 18715 - protein, 11 aa, Mycobacterium tuberculosis
TANFEEAVAAR

SEQ ID NO: 18716 - protein, 11 aa, Mycobacterium tuberculosis
ANFEEAVAARA

SEQ ID NO: 18717 - protein, 11 aa, Mycobacterium tuberculosis
NFEEAVAARAE

SEQ ID NO: 18718 - protein, 11 aa, Mycobacterium tuberculosis
FEEAVAARAEQ

SEQ ID NO: 18719 - protein, 11 aa, Mycobacterium tuberculosis
EEAVAARAEQR

SEQ ID NO: 18720 - protein, 11 aa, Mycobacterium tuberculosis
EAVAARAEQRA

SEQ ID NO: 18721 - protein, 11 aa, Mycobacterium tuberculosis
AVAARAEQRAP

SEQ ID NO: 18722 - protein, 11 aa, Mycobacterium tuberculosis
VAARAEQRAPV

SEQ ID NO: 18723 - protein, 11 aa, Mycobacterium tuberculosis
AARAEQRAPVF

SEQ ID NO: 18724 - protein, 11 aa, Mycobacterium tuberculosis
ARAEQRAPVFT

SEQ ID NO: 18725 - protein, 11 aa, Mycobacterium tuberculosis
RAEQRAPVFTD

SEQ ID NO: 18726 - protein, 11 aa, Mycobacterium tuberculosis
AEQRAPVFTDD

SEQ ID NO: 18727 - protein, 11 aa, Mycobacterium tuberculosis
EQRAPVFTDDT

SEQ ID NO: 18728 - protein, 8 aa, Mycobacterium tuberculosis
MTAQHNIV

SEQ ID NO: 18729 - protein, 8 aa, Mycobacterium tuberculosis
TAQHNIVV

SEQ ID NO: 18730 - protein, 8 aa, Mycobacterium tuberculosis
AQHNIVVI

SEQ ID NO: 18731 - protein, 8 aa, Mycobacterium tuberculosis
QHNIVVIG

SEQ ID NO: 18732 - protein, 8 aa, Mycobacterium tuberculosis
HNIVVIGG

SEQ ID NO: 18733 - protein, 8 aa, Mycobacterium tuberculosis
NIVVIGGG

SEQ ID NO: 18734 - protein, 8 aa, Mycobacterium tuberculosis
IVVIGGGG

SEQ ID NO: 18735 - protein, 8 aa, Mycobacterium tuberculosis
VVIGGGGA

SEQ ID NO: 18736 - protein, 8 aa, Mycobacterium tuberculosis
VIGGGGAG

SEQ ID NO: 18737 - protein, 8 aa, Mycobacterium tuberculosis
IGGGGAGL

SEQ ID NO: 18738 - protein, 8 aa, Mycobacterium tuberculosis
GGGGAGLR

SEQ ID NO: 18739 - protein, 8 aa, Mycobacterium tuberculosis
GGGAGLRA

SEQ ID NO: 18740 - protein, 8 aa, Mycobacterium tuberculosis
GGAGLRAA

SEQ ID NO: 18741 - protein, 8 aa, Mycobacterium tuberculosis
GAGLRAAI

SEQ ID NO: 18742 - protein, 8 aa, Mycobacterium tuberculosis
AGLRAAIA

SEQ ID NO: 18743 - protein, 8 aa, Mycobacterium tuberculosis
GLRAAIAI

SEQ ID NO: 18744 - protein, 8 aa, Mycobacterium tuberculosis
LRAAIAIA

SEQ ID NO: 18745 - protein, 8 aa, Mycobacterium tuberculosis
RAAIAIAE

SEQ ID NO: 18746 - protein, 8 aa, Mycobacterium tuberculosis
AAIAIAET

SEQ ID NO: 18747 - protein, 8 aa, Mycobacterium tuberculosis
AIAIAETN

SEQ ID NO: 18748 - protein, 8 aa, Mycobacterium tuberculosis
IAIAETNP

SEQ ID NO: 18749 - protein, 8 aa, Mycobacterium tuberculosis
AIAETNPH

SEQ ID NO: 18750 - protein, 8 aa, Mycobacterium tuberculosis
IAETNPHL

SEQ ID NO: 18751 - protein, 8 aa, Mycobacterium tuberculosis
AETNPHLD

SEQ ID NO: 18752 - protein, 8 aa, Mycobacterium tuberculosis
ETNPHLDV

SEQ ID NO: 18753 - protein, 8 aa, Mycobacterium tuberculosis
TNPHLDVA

SEQ ID NO: 18754 - protein, 8 aa, Mycobacterium tuberculosis
NPHLDVAI

SEQ ID NO: 18755 - protein, 8 aa, Mycobacterium tuberculosis
PHLDVAIV

SEQ ID NO: 18756 - protein, 8 aa, Mycobacterium tuberculosis
HLDVAIVS

SEQ ID NO: 18757 - protein, 8 aa, Mycobacterium tuberculosis
LDVAIVSK

SEQ ID NO: 18758 - protein, 8 aa, Mycobacterium tuberculosis
DVAIVSKV

SEQ ID NO: 18759 - protein, 8 aa, Mycobacterium tuberculosis
VAIVSKVY

SEQ ID NO: 18760 - protein, 8 aa, Mycobacterium tuberculosis
AIVSKVYP

SEQ ID NO: 18761 - protein, 8 aa, Mycobacterium tuberculosis
IVSKVYPM

SEQ ID NO: 18762 - protein, 8 aa, Mycobacterium tuberculosis
VSKVYPMR

SEQ ID NO: 18763 - protein, 8 aa, Mycobacterium tuberculosis
SKVYPMRS

SEQ ID NO: 18764 - protein, 8 aa, Mycobacterium tuberculosis
KVYPMRSH

SEQ ID NO: 18765 - protein, 8 aa, Mycobacterium tuberculosis
VYPMRSHT

SEQ ID NO: 18766 - protein, 8 aa, Mycobacterium tuberculosis
YPMRSHTV

SEQ ID NO: 18767 - protein, 8 aa, Mycobacterium tuberculosis
PMRSHTVS

SEQ ID NO: 18768 - protein, 8 aa, Mycobacterium tuberculosis
MRSHTVSA

SEQ ID NO: 18769 - protein, 8 aa, Mycobacterium tuberculosis
RSHTVSAE

SEQ ID NO: 18770 - protein, 8 aa, Mycobacterium tuberculosis
SHTVSAEG

SEQ ID NO: 18771 - protein, 8 aa, Mycobacterium tuberculosis
HTVSAEGG

SEQ ID NO: 18772 - protein, 8 aa, Mycobacterium tuberculosis
TVSAEGGA

SEQ ID NO: 18773 - protein, 8 aa, Mycobacterium tuberculosis
VSAEGGAA

SEQ ID NO: 18774 - protein, 8 aa, Mycobacterium tuberculosis
SAEGGAAA

SEQ ID NO: 18775 - protein, 8 aa, Mycobacterium tuberculosis
AEGGAAAV

SEQ ID NO: 18776 - protein, 8 aa, Mycobacterium tuberculosis
EGGAAAVT

SEQ ID NO: 18777 - protein, 8 aa, Mycobacterium tuberculosis
GGAAAVTG

SEQ ID NO: 18778 - protein, 8 aa, Mycobacterium tuberculosis
GAAAVTGD

SEQ ID NO: 18779 - protein, 8 aa, Mycobacterium tuberculosis
AAAVTGDD

SEQ ID NO: 18780 - protein, 8 aa, Mycobacterium tuberculosis
AAVTGDDD

SEQ ID NO: 18781 - protein, 8 aa, Mycobacterium tuberculosis
AVTGDDDS

SEQ ID NO: 18782 - protein, 8 aa, Mycobacterium tuberculosis
VTGDDDSL

SEQ ID NO: 18783 - protein, 8 aa, Mycobacterium tuberculosis
TGDDDSLD

SEQ ID NO: 18784 - protein, 8 aa, Mycobacterium tuberculosis
GDDDSLDE

SEQ ID NO: 18785 - protein, 8 aa, Mycobacterium tuberculosis
DDDSLDEH

SEQ ID NO: 18786 - protein, 8 aa, Mycobacterium tuberculosis
DDSLDEHA

SEQ ID NO: 18787 - protein, 8 aa, Mycobacterium tuberculosis
DSLDEHAH

SEQ ID NO: 18788 - protein, 8 aa, Mycobacterium tuberculosis
SLDEHAHD

SEQ ID NO: 18789 - protein, 8 aa, Mycobacterium tuberculosis
LDEHAHDT

SEQ ID NO: 18790 - protein, 8 aa, Mycobacterium tuberculosis
DEHAHDTV

SEQ ID NO: 18791 - protein, 8 aa, Mycobacterium tuberculosis
EHAHDTVS

SEQ ID NO: 18792 - protein, 8 aa, Mycobacterium tuberculosis
HAHDTVSG

SEQ ID NO: 18793 - protein, 8 aa, Mycobacterium tuberculosis
AHDTVSGG

SEQ ID NO: 18794 - protein, 8 aa, Mycobacterium tuberculosis
HDTVSGGD

SEQ ID NO: 18795 - protein, 8 aa, Mycobacterium tuberculosis
DTVSGGDW

SEQ ID NO: 18796 - protein, 8 aa, Mycobacterium tuberculosis
TVSGGDWL

SEQ ID NO: 18797 - protein, 8 aa, Mycobacterium tuberculosis
VSGGDWLC

SEQ ID NO: 18798 - protein, 8 aa, Mycobacterium tuberculosis
SGGDWLCD

SEQ ID NO: 18799 - protein, 8 aa, Mycobacterium tuberculosis
GGDWLCDQ

SEQ ID NO: 18800 - protein, 8 aa, Mycobacterium tuberculosis
GDWLCDQD

SEQ ID NO: 18801 - protein, 8 aa, Mycobacterium tuberculosis
DWLCDQDA

SEQ ID NO: 18802 - protein, 8 aa, Mycobacterium tuberculosis
WLCDQDAV

SEQ ID NO: 18803 - protein, 8 aa, Mycobacterium tuberculosis
LCDQDAVE

SEQ ID NO: 18804 - protein, 8 aa, Mycobacterium tuberculosis
CDQDAVEA

SEQ ID NO: 18805 - protein, 8 aa, Mycobacterium tuberculosis
DQDAVEAF

SEQ ID NO: 18806 - protein, 8 aa, Mycobacterium tuberculosis
QDAVEAFV

SEQ ID NO: 18807 - protein, 8 aa, Mycobacterium tuberculosis
DAVEAFVA

SEQ ID NO: 18808 - protein, 8 aa, Mycobacterium tuberculosis
AVEAFVAE

SEQ ID NO: 18809 - protein, 8 aa, Mycobacterium tuberculosis
VEAFVAEA

SEQ ID NO: 18810 - protein, 8 aa, Mycobacterium tuberculosis
EAFVAEAP

SEQ ID NO: 18811 - protein, 8 aa, Mycobacterium tuberculosis
AFVAEAPK

SEQ ID NO: 18812 - protein, 8 aa, Mycobacterium tuberculosis
FVAEAPKE

SEQ ID NO: 18813 - protein, 8 aa, Mycobacterium tuberculosis
VAEAPKEL

SEQ ID NO: 18814 - protein, 8 aa, Mycobacterium tuberculosis
AEAPKELV

SEQ ID NO: 18815 - protein, 8 aa, Mycobacterium tuberculosis
EAPKELVQ

SEQ ID NO: 18816 - protein, 8 aa, Mycobacterium tuberculosis
APKELVQL

SEQ ID NO: 18817 - protein, 8 aa, Mycobacterium tuberculosis
PKELVQLE

SEQ ID NO: 18818 - protein, 8 aa, Mycobacterium tuberculosis
KELVQLEH

SEQ ID NO: 18819 - protein, 8 aa, Mycobacterium tuberculosis
ELVQLEHW

SEQ ID NO: 18820 - protein, 8 aa, Mycobacterium tuberculosis
LVQLEHWG

SEQ ID NO: 18821 - protein, 8 aa, Mycobacterium tuberculosis
VQLEHWGC

SEQ ID NO: 18822 - protein, 8 aa, Mycobacterium tuberculosis
QLEHWGCP

SEQ ID NO: 18823 - protein, 8 aa, Mycobacterium tuberculosis
LEHWGCPW

SEQ ID NO: 18824 - protein, 8 aa, Mycobacterium tuberculosis
EHWGCPWS

SEQ ID NO: 18825 - protein, 8 aa, Mycobacterium tuberculosis
HWGCPWSR

SEQ ID NO: 18826 - protein, 8 aa, Mycobacterium tuberculosis
WGCPWSRK

SEQ ID NO: 18827 - protein, 8 aa, Mycobacterium tuberculosis
GCPWSRKP

SEQ ID NO: 18828 - protein, 8 aa, Mycobacterium tuberculosis
CPWSRKPD

SEQ ID NO: 18829 - protein, 8 aa, Mycobacterium tuberculosis
PWSRKPDG

SEQ ID NO: 18830 - protein, 8 aa, Mycobacterium tuberculosis
WSRKPDGR

SEQ ID NO: 18831 - protein, 8 aa, Mycobacterium tuberculosis
SRKPDGRV

SEQ ID NO: 18832 - protein, 8 aa, Mycobacterium tuberculosis
RKPDGRVA

SEQ ID NO: 18833 - protein, 8 aa, Mycobacterium tuberculosis
KPDGRVAV

SEQ ID NO: 18834 - protein, 8 aa, Mycobacterium tuberculosis
PDGRVAVR

SEQ ID NO: 18835 - protein, 8 aa, Mycobacterium tuberculosis
DGRVAVRP

SEQ ID NO: 18836 - protein, 8 aa, Mycobacterium tuberculosis
GRVAVRPF

SEQ ID NO: 18837 - protein, 8 aa, Mycobacterium tuberculosis
RVAVRPFG

SEQ ID NO: 18838 - protein, 8 aa, Mycobacterium tuberculosis
VAVRPFGG

SEQ ID NO: 18839 - protein, 8 aa, Mycobacterium tuberculosis
AVRPFGGM

SEQ ID NO: 18840 - protein, 8 aa, Mycobacterium tuberculosis
VRPFGGMK

SEQ ID NO: 18841 - protein, 8 aa, Mycobacterium tuberculosis
RPFGGMKK

SEQ ID NO: 18842 - protein, 8 aa, Mycobacterium tuberculosis
PFGGMKKL

SEQ ID NO: 18843 - protein, 8 aa, Mycobacterium tuberculosis
FGGMKKLR

SEQ ID NO: 18844 - protein, 8 aa, Mycobacterium tuberculosis
GGMKKLRT

SEQ ID NO: 18845 - protein, 8 aa, Mycobacterium tuberculosis
GMKKLRTW

SEQ ID NO: 18846 - protein, 8 aa, Mycobacterium tuberculosis
MKKLRTWF

SEQ ID NO: 18847 - protein, 8 aa, Mycobacterium tuberculosis
KKLRTWFA

SEQ ID NO: 18848 - protein, 8 aa, Mycobacterium tuberculosis
KLRTWFAA

SEQ ID NO: 18849 - protein, 8 aa, Mycobacterium tuberculosis
LRTWFAAD

SEQ ID NO: 18850 - protein, 8 aa, Mycobacterium tuberculosis
RTWFAADK

SEQ ID NO: 18851 - protein, 8 aa, Mycobacterium tuberculosis
TWFAADKT

SEQ ID NO: 18852 - protein, 8 aa, Mycobacterium tuberculosis
WFAADKTG

SEQ ID NO: 18853 - protein, 8 aa, Mycobacterium tuberculosis
FAADKTGF

SEQ ID NO: 18854 - protein, 8 aa, Mycobacterium tuberculosis
AADKTGFH

SEQ ID NO: 18855 - protein, 8 aa, Mycobacterium tuberculosis
ADKTGFHL

SEQ ID NO: 18856 - protein, 8 aa, Mycobacterium tuberculosis
DKTGFHLL

SEQ ID NO: 18857 - protein, 8 aa, Mycobacterium tuberculosis
KTGFHLLH

SEQ ID NO: 18858 - protein, 8 aa, Mycobacterium tuberculosis
TGFHLLHT

SEQ ID NO: 18859 - protein, 8 aa, Mycobacterium tuberculosis
GFHLLHTL

SEQ ID NO: 18860 - protein, 8 aa, Mycobacterium tuberculosis
FHLLHTLF

SEQ ID NO: 18861 - protein, 8 aa, Mycobacterium tuberculosis
HLLHTLFQ

SEQ ID NO: 18862 - protein, 8 aa, Mycobacterium tuberculosis
LLHTLFQR

SEQ ID NO: 18863 - protein, 8 aa, Mycobacterium tuberculosis
LHTLFQRL

SEQ ID NO: 18864 - protein, 8 aa, Mycobacterium tuberculosis
HTLFQRLL

SEQ ID NO: 18865 - protein, 8 aa, Mycobacterium tuberculosis
TLFQRLLT

SEQ ID NO: 18866 - protein, 8 aa, Mycobacterium tuberculosis
LFQRLLTY

SEQ ID NO: 18867 - protein, 8 aa, Mycobacterium tuberculosis
FQRLLTYS

SEQ ID NO: 18868 - protein, 8 aa, Mycobacterium tuberculosis
QRLLTYSD

SEQ ID NO: 18869 - protein, 8 aa, Mycobacterium tuberculosis
RLLTYSDV

SEQ ID NO: 18870 - protein, 8 aa, Mycobacterium tuberculosis
LLTYSDVM

SEQ ID NO: 18871 - protein, 8 aa, Mycobacterium tuberculosis
LTYSDVMR

SEQ ID NO: 18872 - protein, 8 aa, Mycobacterium tuberculosis
TYSDVMRY

SEQ ID NO: 18873 - protein, 8 aa, Mycobacterium tuberculosis
YSDVMRYD

SEQ ID NO: 18874 - protein, 8 aa, Mycobacterium tuberculosis
SDVMRYDE

SEQ ID NO: 18875 - protein, 8 aa, Mycobacterium tuberculosis
DVMRYDEW

SEQ ID NO: 18876 - protein, 8 aa, Mycobacterium tuberculosis
VMRYDEWF

SEQ ID NO: 18877 - protein, 8 aa, Mycobacterium tuberculosis
MRYDEWFA

SEQ ID NO: 18878 - protein, 8 aa, Mycobacterium tuberculosis
RYDEWFAT

SEQ ID NO: 18879 - protein, 8 aa, Mycobacterium tuberculosis
YDEWFATT

SEQ ID NO: 18880 - protein, 8 aa, Mycobacterium tuberculosis
DEWFATTL

SEQ ID NO: 18881 - protein, 8 aa, Mycobacterium tuberculosis
EWFATTLL

SEQ ID NO: 18882 - protein, 8 aa, Mycobacterium tuberculosis
WFATTLLV

SEQ ID NO: 18883 - protein, 8 aa, Mycobacterium tuberculosis
FATTLLVD

SEQ ID NO: 18884 - protein, 8 aa, Mycobacterium tuberculosis
ATTLLVDD

SEQ ID NO: 18885 - protein, 8 aa, Mycobacterium tuberculosis
TTLLVDDG

SEQ ID NO: 18886 - protein, 8 aa, Mycobacterium tuberculosis
TLLVDDGR

SEQ ID NO: 18887 - protein, 8 aa, Mycobacterium tuberculosis
LLVDDGRV

SEQ ID NO: 18888 - protein, 8 aa, Mycobacterium tuberculosis
LVDDGRVC

SEQ ID NO: 18889 - protein, 8 aa, Mycobacterium tuberculosis
VDDGRVCG

SEQ ID NO: 18890 - protein, 8 aa, Mycobacterium tuberculosis
DDGRVCGL

SEQ ID NO: 18891 - protein, 8 aa, Mycobacterium tuberculosis
DGRVCGLV

SEQ ID NO: 18892 - protein, 8 aa, Mycobacterium tuberculosis
GRVCGLVA

SEQ ID NO: 18893 - protein, 8 aa, Mycobacterium tuberculosis
RVCGLVAI

SEQ ID NO: 18894 - protein, 8 aa, Mycobacterium tuberculosis
VCGLVAIE

SEQ ID NO: 18895 - protein, 8 aa, Mycobacterium tuberculosis
CGLVAIEL

SEQ ID NO: 18896 - protein, 8 aa, Mycobacterium tuberculosis
GLVAIELA

SEQ ID NO: 18897 - protein, 8 aa, Mycobacterium tuberculosis
LVAIELAT

SEQ ID NO: 18898 - protein, 8 aa, Mycobacterium tuberculosis
VAIELATG

SEQ ID NO: 18899 - protein, 8 aa, Mycobacterium tuberculosis
AIELATGR

SEQ ID NO: 18900 - protein, 8 aa, Mycobacterium tuberculosis
IELATGRI

SEQ ID NO: 18901 - protein, 8 aa, Mycobacterium tuberculosis
ELATGRIE

SEQ ID NO: 18902 - protein, 8 aa, Mycobacterium tuberculosis
LATGRIET

SEQ ID NO: 18903 - protein, 8 aa, Mycobacterium tuberculosis
ATGRIETI

SEQ ID NO: 18904 - protein, 8 aa, Mycobacterium tuberculosis
TGRIETIL

SEQ ID NO: 18905 - protein, 8 aa, Mycobacterium tuberculosis
GRIETILA

SEQ ID NO: 18906 - protein, 8 aa, Mycobacterium tuberculosis
RIETILAD

SEQ ID NO: 18907 - protein, 8 aa, Mycobacterium tuberculosis
IETILADA

SEQ ID NO: 18908 - protein, 8 aa, Mycobacterium tuberculosis
ETILADAV

SEQ ID NO: 18909 - protein, 8 aa, Mycobacterium tuberculosis
TILADAVI

SEQ ID NO: 18910 - protein, 8 aa, Mycobacterium tuberculosis
ILADAVIL

SEQ ID NO: 18911 - protein, 8 aa, Mycobacterium tuberculosis
LADAVILC

SEQ ID NO: 18912 - protein, 8 aa, Mycobacterium tuberculosis
ADAVILCT

SEQ ID NO: 18913 - protein, 8 aa, Mycobacterium tuberculosis
DAVILCTG

SEQ ID NO: 18914 - protein, 8 aa, Mycobacterium tuberculosis
AVILCTGG

SEQ ID NO: 18915 - protein, 8 aa, Mycobacterium tuberculosis
VILCTGGC

SEQ ID NO: 18916 - protein, 8 aa, Mycobacterium tuberculosis
ILCTGGCG

SEQ ID NO: 18917 - protein, 8 aa, Mycobacterium tuberculosis
LCTGGCGR

SEQ ID NO: 18918 - protein, 8 aa, Mycobacterium tuberculosis
CTGGCGRV

SEQ ID NO: 18919 - protein, 8 aa, Mycobacterium tuberculosis
TGGCGRVF

SEQ ID NO: 18920 - protein, 8 aa, Mycobacterium tuberculosis
GGCGRVFP

SEQ ID NO: 18921 - protein, 8 aa, Mycobacterium tuberculosis
GCGRVFPF

SEQ ID NO: 18922 - protein, 8 aa, Mycobacterium tuberculosis
CGRVFPFT

SEQ ID NO: 18923 - protein, 8 aa, Mycobacterium tuberculosis
GRVFPFTT

SEQ ID NO: 18924 - protein, 8 aa, Mycobacterium tuberculosis
RVFPFTTN

SEQ ID NO: 18925 - protein, 8 aa, Mycobacterium tuberculosis
VFPFTTNA

SEQ ID NO: 18926 - protein, 8 aa, Mycobacterium tuberculosis
FPFTTNAN

SEQ ID NO: 18927 - protein, 8 aa, Mycobacterium tuberculosis
PFTTNANI

SEQ ID NO: 18928 - protein, 8 aa, Mycobacterium tuberculosis
FTTNANIK

SEQ ID NO: 18929 - protein, 8 aa, Mycobacterium tuberculosis
TTNANIKT

SEQ ID NO: 18930 - protein, 8 aa, Mycobacterium tuberculosis
TNANIKTG

SEQ ID NO: 18931 - protein, 8 aa, Mycobacterium tuberculosis
NANIKTGD

SEQ ID NO: 18932 - protein, 8 aa, Mycobacterium tuberculosis
ANIKTGDG

SEQ ID NO: 18933 - protein, 8 aa, Mycobacterium tuberculosis
NIKTGDGM

SEQ ID NO: 18934 - protein, 8 aa, Mycobacterium tuberculosis
IKTGDGMA

SEQ ID NO: 18935 - protein, 8 aa, Mycobacterium tuberculosis
KTGDGMAL

SEQ ID NO: 18936 - protein, 8 aa, Mycobacterium tuberculosis
TGDGMALA

SEQ ID NO: 18937 - protein, 8 aa, Mycobacterium tuberculosis
GDGMALAF

SEQ ID NO: 18938 - protein, 8 aa, Mycobacterium tuberculosis
DGMALAFR

SEQ ID NO: 18939 - protein, 8 aa, Mycobacterium tuberculosis
GMALAFRA

SEQ ID NO: 18940 - protein, 8 aa, Mycobacterium tuberculosis
MALAFRAG

SEQ ID NO: 18941 - protein, 8 aa, Mycobacterium tuberculosis
ALAFRAGA

SEQ ID NO: 18942 - protein, 8 aa, Mycobacterium tuberculosis
LAFRAGAP

SEQ ID NO: 18943 - protein, 8 aa, Mycobacterium tuberculosis
AFRAGAPL

SEQ ID NO: 18944 - protein, 8 aa, Mycobacterium tuberculosis
FRAGAPLK

SEQ ID NO: 18945 - protein, 8 aa, Mycobacterium tuberculosis
RAGAPLKD

SEQ ID NO: 18946 - protein, 8 aa, Mycobacterium tuberculosis
AGAPLKDM

SEQ ID NO: 18947 - protein, 8 aa, Mycobacterium tuberculosis
GAPLKDME

SEQ ID NO: 18948 - protein, 8 aa, Mycobacterium tuberculosis
APLKDMEF

SEQ ID NO: 18949 - protein, 8 aa, Mycobacterium tuberculosis
PLKDMEFV

SEQ ID NO: 18950 - protein, 8 aa, Mycobacterium tuberculosis
LKDMEFVQ

SEQ ID NO: 18951 - protein, 8 aa, Mycobacterium tuberculosis
KDMEFVQY

SEQ ID NO: 18952 - protein, 8 aa, Mycobacterium tuberculosis
DMEFVQYH

SEQ ID NO: 18953 - protein, 8 aa, Mycobacterium tuberculosis
MEFVQYHP

SEQ ID NO: 18954 - protein, 8 aa, Mycobacterium tuberculosis
EFVQYHPT

SEQ ID NO: 18955 - protein, 8 aa, Mycobacterium tuberculosis
FVQYHPTG

SEQ ID NO: 18956 - protein, 8 aa, Mycobacterium tuberculosis
VQYHPTGL

SEQ ID NO: 18957 - protein, 8 aa, Mycobacterium tuberculosis
QYHPTGLP

SEQ ID NO: 18958 - protein, 8 aa, Mycobacterium tuberculosis
YHPTGLPF

SEQ ID NO: 18959 - protein, 8 aa, Mycobacterium tuberculosis
HPTGLPFT

SEQ ID NO: 18960 - protein, 8 aa, Mycobacterium tuberculosis
PTGLPFTG

SEQ ID NO: 18961 - protein, 8 aa, Mycobacterium tuberculosis
TGLPFTGI

SEQ ID NO: 18962 - protein, 8 aa, Mycobacterium tuberculosis
GLPFTGIL

SEQ ID NO: 18963 - protein, 8 aa, Mycobacterium tuberculosis
LPFTGILI

SEQ ID NO: 18964 - protein, 8 aa, Mycobacterium tuberculosis
PFTGILIT

SEQ ID NO: 18965 - protein, 8 aa, Mycobacterium tuberculosis
FTGILITE

SEQ ID NO: 18966 - protein, 8 aa, Mycobacterium tuberculosis
TGILITEA

SEQ ID NO: 18967 - protein, 8 aa, Mycobacterium tuberculosis
GILITEAA

SEQ ID NO: 18968 - protein, 8 aa, Mycobacterium tuberculosis
ILITEAAR

SEQ ID NO: 18969 - protein, 8 aa, Mycobacterium tuberculosis
LITEAARA

SEQ ID NO: 18970 - protein, 8 aa, Mycobacterium tuberculosis
ITEAARAE

SEQ ID NO: 18971 - protein, 8 aa, Mycobacterium tuberculosis
TEAARAEG

SEQ ID NO: 18972 - protein, 8 aa, Mycobacterium tuberculosis
EAARAEGG

SEQ ID NO: 18973 - protein, 8 aa, Mycobacterium tuberculosis
AARAEGGW

SEQ ID NO: 18974 - protein, 8 aa, Mycobacterium tuberculosis
ARAEGGWL

SEQ ID NO: 18975 - protein, 8 aa, Mycobacterium tuberculosis
RAEGGWLL

SEQ ID NO: 18976 - protein, 8 aa, Mycobacterium tuberculosis
AEGGWLLN

SEQ ID NO: 18977 - protein, 8 aa, Mycobacterium tuberculosis
EGGWLLNK

SEQ ID NO: 18978 - protein, 8 aa, Mycobacterium tuberculosis
GGWLLNKD

SEQ ID NO: 18979 - protein, 8 aa, Mycobacterium tuberculosis
GWLLNKDG

SEQ ID NO: 18980 - protein, 8 aa, Mycobacterium tuberculosis
WLLNKDGY

SEQ ID NO: 18981 - protein, 8 aa, Mycobacterium tuberculosis
LLNKDGYR

SEQ ID NO: 18982 - protein, 8 aa, Mycobacterium tuberculosis
LNKDGYRY

SEQ ID NO: 18983 - protein, 8 aa, Mycobacterium tuberculosis
NKDGYRYL

SEQ ID NO: 18984 - protein, 8 aa, Mycobacterium tuberculosis
KDGYRYLQ

SEQ ID NO: 18985 - protein, 8 aa, Mycobacterium tuberculosis
DGYRYLQD

SEQ ID NO: 18986 - protein, 8 aa, Mycobacterium tuberculosis
GYRYLQDY

SEQ ID NO: 18987 - protein, 8 aa, Mycobacterium tuberculosis
YRYLQDYD

SEQ ID NO: 18988 - protein, 8 aa, Mycobacterium tuberculosis
RYLQDYDL

SEQ ID NO: 18989 - protein, 8 aa, Mycobacterium tuberculosis
YLQDYDLG

SEQ ID NO: 18990 - protein, 8 aa, Mycobacterium tuberculosis
LQDYDLGK

SEQ ID NO: 18991 - protein, 8 aa, Mycobacterium tuberculosis
QDYDLGKP

SEQ ID NO: 18992 - protein, 8 aa, Mycobacterium tuberculosis
DYDLGKPT

SEQ ID NO: 18993 - protein, 8 aa, Mycobacterium tuberculosis
YDLGKPTP

SEQ ID NO: 18994 - protein, 8 aa, Mycobacterium tuberculosis
DLGKPTPE

SEQ ID NO: 18995 - protein, 8 aa, Mycobacterium tuberculosis
LGKPTPEP

SEQ ID NO: 18996 - protein, 8 aa, Mycobacterium tuberculosis
GKPTPEPR

SEQ ID NO: 18997 - protein, 8 aa, Mycobacterium tuberculosis
KPTPEPRL

SEQ ID NO: 18998 - protein, 8 aa, Mycobacterium tuberculosis
PTPEPRLR

SEQ ID NO: 18999 - protein, 8 aa, Mycobacterium tuberculosis
TPEPRLRS

SEQ ID NO: 19000 - protein, 8 aa, Mycobacterium tuberculosis
PEPRLRSM

SEQ ID NO: 19001 - protein, 8 aa, Mycobacterium tuberculosis
EPRLRSME

SEQ ID NO: 19002 - protein, 8 aa, Mycobacterium tuberculosis
PRLRSMEL

SEQ ID NO: 19003 - protein, 8 aa, Mycobacterium tuberculosis
RLRSMELG

SEQ ID NO: 19004 - protein, 8 aa, Mycobacterium tuberculosis
LRSMELGP

SEQ ID NO: 19005 - protein, 8 aa, Mycobacterium tuberculosis
RSMELGPR

SEQ ID NO: 19006 - protein, 8 aa, Mycobacterium tuberculosis
SMELGPRD

SEQ ID NO: 19007 - protein, 8 aa, Mycobacterium tuberculosis
MELGPRDR

SEQ ID NO: 19008 - protein, 8 aa, Mycobacterium tuberculosis
ELGPRDRL

SEQ ID NO: 19009 - protein, 8 aa, Mycobacterium tuberculosis
LGPRDRLS

SEQ ID NO: 19010 - protein, 8 aa, Mycobacterium tuberculosis
GPRDRLSQ

SEQ ID NO: 19011 - protein, 8 aa, Mycobacterium tuberculosis
PRDRLSQA

SEQ ID NO: 19012 - protein, 8 aa, Mycobacterium tuberculosis
RDRLSQAF

SEQ ID NO: 19013 - protein, 8 aa, Mycobacterium tuberculosis
DRLSQAFV

SEQ ID NO: 19014 - protein, 8 aa, Mycobacterium tuberculosis
RLSQAFVH

SEQ ID NO: 19015 - protein, 8 aa, Mycobacterium tuberculosis
LSQAFVHE

SEQ ID NO: 19016 - protein, 8 aa, Mycobacterium tuberculosis
SQAFVHEH

SEQ ID NO: 19017 - protein, 8 aa, Mycobacterium tuberculosis
QAFVHEHN

SEQ ID NO: 19018 - protein, 8 aa, Mycobacterium tuberculosis
AFVHEHNK

SEQ ID NO: 19019 - protein, 8 aa, Mycobacterium tuberculosis
FVHEHNKG

SEQ ID NO: 19020 - protein, 8 aa, Mycobacterium tuberculosis
VHEHNKGR

SEQ ID NO: 19021 - protein, 8 aa, Mycobacterium tuberculosis
HEHNKGRT

SEQ ID NO: 19022 - protein, 8 aa, Mycobacterium tuberculosis
EHNKGRTV

SEQ ID NO: 19023 - protein, 8 aa, Mycobacterium tuberculosis
HNKGRTVD

SEQ ID NO: 19024 - protein, 8 aa, Mycobacterium tuberculosis
NKGRTVDT

SEQ ID NO: 19025 - protein, 8 aa, Mycobacterium tuberculosis
KGRTVDTP

SEQ ID NO: 19026 - protein, 8 aa, Mycobacterium tuberculosis
GRTVDTPY

SEQ ID NO: 19027 - protein, 8 aa, Mycobacterium tuberculosis
RTVDTPYG

SEQ ID NO: 19028 - protein, 8 aa, Mycobacterium tuberculosis
TVDTPYGP

SEQ ID NO: 19029 - protein, 8 aa, Mycobacterium tuberculosis
VDTPYGPV

SEQ ID NO: 19030 - protein, 8 aa, Mycobacterium tuberculosis
DTPYGPVV

SEQ ID NO: 19031 - protein, 8 aa, Mycobacterium tuberculosis
TPYGPVVY

SEQ ID NO: 19032 - protein, 8 aa, Mycobacterium tuberculosis
PYGPVVYL

SEQ ID NO: 19033 - protein, 8 aa, Mycobacterium tuberculosis
YGPVVYLD

SEQ ID NO: 19034 - protein, 8 aa, Mycobacterium tuberculosis
GPVVYLDL

SEQ ID NO: 19035 - protein, 8 aa, Mycobacterium tuberculosis
PVVYLDLR

SEQ ID NO: 19036 - protein, 8 aa, Mycobacterium tuberculosis
VVYLDLRH

SEQ ID NO: 19037 - protein, 8 aa, Mycobacterium tuberculosis
VYLDLRHL

SEQ ID NO: 19038 - protein, 8 aa, Mycobacterium tuberculosis
YLDLRHLG

SEQ ID NO: 19039 - protein, 8 aa, Mycobacterium tuberculosis
LDLRHLGA

SEQ ID NO: 19040 - protein, 8 aa, Mycobacterium tuberculosis
DLRHLGAD

SEQ ID NO: 19041 - protein, 8 aa, Mycobacterium tuberculosis
LRHLGADL

SEQ ID NO: 19042 - protein, 8 aa, Mycobacterium tuberculosis
RHLGADLI

SEQ ID NO: 19043 - protein, 8 aa, Mycobacterium tuberculosis
HLGADLID

SEQ ID NO: 19044 - protein, 8 aa, Mycobacterium tuberculosis
LGADLIDA

SEQ ID NO: 19045 - protein, 8 aa, Mycobacterium tuberculosis
GADLIDAK

SEQ ID NO: 19046 - protein, 8 aa, Mycobacterium tuberculosis
ADLIDAKL

SEQ ID NO: 19047 - protein, 8 aa, Mycobacterium tuberculosis
DLIDAKLP

SEQ ID NO: 19048 - protein, 8 aa, Mycobacterium tuberculosis
LIDAKLPF

SEQ ID NO: 19049 - protein, 8 aa, Mycobacterium tuberculosis
IDAKLPFV

SEQ ID NO: 19050 - protein, 8 aa, Mycobacterium tuberculosis
DAKLPFVR

SEQ ID NO: 19051 - protein, 8 aa, Mycobacterium tuberculosis
AKLPFVRE

SEQ ID NO: 19052 - protein, 8 aa, Mycobacterium tuberculosis
KLPFVREL

SEQ ID NO: 19053 - protein, 8 aa, Mycobacterium tuberculosis
LPFVRELC

SEQ ID NO: 19054 - protein, 8 aa, Mycobacterium tuberculosis
PFVRELCR

SEQ ID NO: 19055 - protein, 8 aa, Mycobacterium tuberculosis
FVRELCRD

SEQ ID NO: 19056 - protein, 8 aa, Mycobacterium tuberculosis
VRELCRDY

SEQ ID NO: 19057 - protein, 8 aa, Mycobacterium tuberculosis
RELCRDYQ

SEQ ID NO: 19058 - protein, 8 aa, Mycobacterium tuberculosis
ELCRDYQH

SEQ ID NO: 19059 - protein, 8 aa, Mycobacterium tuberculosis
LCRDYQHI

SEQ ID NO: 19060 - protein, 8 aa, Mycobacterium tuberculosis
CRDYQHID

SEQ ID NO: 19061 - protein, 8 aa, Mycobacterium tuberculosis
RDYQHIDP

SEQ ID NO: 19062 - protein, 8 aa, Mycobacterium tuberculosis
DYQHIDPV

SEQ ID NO: 19063 - protein, 8 aa, Mycobacterium tuberculosis
YQHIDPVV

SEQ ID NO: 19064 - protein, 8 aa, Mycobacterium tuberculosis
QHIDPVVE

SEQ ID NO: 19065 - protein, 8 aa, Mycobacterium tuberculosis
HIDPVVEL

SEQ ID NO: 19066 - protein, 8 aa, Mycobacterium tuberculosis
IDPVVELV

SEQ ID NO: 19067 - protein, 8 aa, Mycobacterium tuberculosis
DPVVELVP

SEQ ID NO: 19068 - protein, 8 aa, Mycobacterium tuberculosis
PVVELVPV

SEQ ID NO: 19069 - protein, 8 aa, Mycobacterium tuberculosis
VVELVPVR

SEQ ID NO: 19070 - protein, 8 aa, Mycobacterium tuberculosis
VELVPVRP

SEQ ID NO: 19071 - protein, 8 aa, Mycobacterium tuberculosis
ELVPVRPV

SEQ ID NO: 19072 - protein, 8 aa, Mycobacterium tuberculosis
LVPVRPVV

SEQ ID NO: 19073 - protein, 8 aa, Mycobacterium tuberculosis
VPVRPVVH

SEQ ID NO: 19074 - protein, 8 aa, Mycobacterium tuberculosis
PVRPVVHY

SEQ ID NO: 19075 - protein, 8 aa, Mycobacterium tuberculosis
VRPVVHYM

SEQ ID NO: 19076 - protein, 8 aa, Mycobacterium tuberculosis
RPVVHYMM

SEQ ID NO: 19077 - protein, 8 aa, Mycobacterium tuberculosis
PVVHYMMG

SEQ ID NO: 19078 - protein, 8 aa, Mycobacterium tuberculosis
VVHYMMGG

SEQ ID NO: 19079 - protein, 8 aa, Mycobacterium tuberculosis
VHYMMGGV

SEQ ID NO: 19080 - protein, 8 aa, Mycobacterium tuberculosis
HYMMGGVH

SEQ ID NO: 19081 - protein, 8 aa, Mycobacterium tuberculosis
YMMGGVHT

SEQ ID NO: 19082 - protein, 8 aa, Mycobacterium tuberculosis
MMGGVHTD

SEQ ID NO: 19083 - protein, 8 aa, Mycobacterium tuberculosis
MGGVHTDI

SEQ ID NO: 19084 - protein, 8 aa, Mycobacterium tuberculosis
GGVHTDIN

SEQ ID NO: 19085 - protein, 8 aa, Mycobacterium tuberculosis
GVHTDING

SEQ ID NO: 19086 - protein, 8 aa, Mycobacterium tuberculosis
VHTDINGA

SEQ ID NO: 19087 - protein, 8 aa, Mycobacterium tuberculosis
HTDINGAT

SEQ ID NO: 19088 - protein, 8 aa, Mycobacterium tuberculosis
TDINGATT

SEQ ID NO: 19089 - protein, 8 aa, Mycobacterium tuberculosis
DINGATTL

SEQ ID NO: 19090 - protein, 8 aa, Mycobacterium tuberculosis
INGATTLP

SEQ ID NO: 19091 - protein, 8 aa, Mycobacterium tuberculosis
NGATTLPG

SEQ ID NO: 19092 - protein, 8 aa, Mycobacterium tuberculosis
GATTLPGL

SEQ ID NO: 19093 - protein, 8 aa, Mycobacterium tuberculosis
ATTLPGLY

SEQ ID NO: 19094 - protein, 8 aa, Mycobacterium tuberculosis
TTLPGLYA

SEQ ID NO: 19095 - protein, 8 aa, Mycobacterium tuberculosis
TLPGLYAA

SEQ ID NO: 19096 - protein, 8 aa, Mycobacterium tuberculosis
LPGLYAAG

SEQ ID NO: 19097 - protein, 8 aa, Mycobacterium tuberculosis
PGLYAAGE

SEQ ID NO: 19098 - protein, 8 aa, Mycobacterium tuberculosis
GLYAAGET

SEQ ID NO: 19099 - protein, 8 aa, Mycobacterium tuberculosis
LYAAGETA

SEQ ID NO: 19100 - protein, 8 aa, Mycobacterium tuberculosis
YAAGETAC

SEQ ID NO: 19101 - protein, 8 aa, Mycobacterium tuberculosis
AAGETACV

SEQ ID NO: 19102 - protein, 8 aa, Mycobacterium tuberculosis
AGETACVS

SEQ ID NO: 19103 - protein, 8 aa, Mycobacterium tuberculosis
GETACVSI

SEQ ID NO: 19104 - protein, 8 aa, Mycobacterium tuberculosis
ETACVSIN

SEQ ID NO: 19105 - protein, 8 aa, Mycobacterium tuberculosis
TACVSING

SEQ ID NO: 19106 - protein, 8 aa, Mycobacterium tuberculosis
ACVSINGA

SEQ ID NO: 19107 - protein, 8 aa, Mycobacterium tuberculosis
CVSINGAN

SEQ ID NO: 19108 - protein, 8 aa, Mycobacterium tuberculosis
VSINGANR

SEQ ID NO: 19109 - protein, 8 aa, Mycobacterium tuberculosis
SINGANRL

SEQ ID NO: 19110 - protein, 8 aa, Mycobacterium tuberculosis
INGANRLG

SEQ ID NO: 19111 - protein, 8 aa, Mycobacterium tuberculosis
NGANRLGS

SEQ ID NO: 19112 - protein, 8 aa, Mycobacterium tuberculosis
GANRLGSN

SEQ ID NO: 19113 - protein, 8 aa, Mycobacterium tuberculosis
ANRLGSNS

SEQ ID NO: 19114 - protein, 8 aa, Mycobacterium tuberculosis
NRLGSNSL

SEQ ID NO: 19115 - protein, 8 aa, Mycobacterium tuberculosis
RLGSNSLP

SEQ ID NO: 19116 - protein, 8 aa, Mycobacterium tuberculosis
LGSNSLPE

SEQ ID NO: 19117 - protein, 8 aa, Mycobacterium tuberculosis
GSNSLPEL

SEQ ID NO: 19118 - protein, 8 aa, Mycobacterium tuberculosis
SNSLPELL

SEQ ID NO: 19119 - protein, 8 aa, Mycobacterium tuberculosis
NSLPELLV

SEQ ID NO: 19120 - protein, 8 aa, Mycobacterium tuberculosis
SLPELLVF

SEQ ID NO: 19121 - protein, 8 aa, Mycobacterium tuberculosis
LPELLVFG

SEQ ID NO: 19122 - protein, 8 aa, Mycobacterium tuberculosis
PELLVFGA

SEQ ID NO: 19123 - protein, 8 aa, Mycobacterium tuberculosis
ELLVFGAR

SEQ ID NO: 19124 - protein, 8 aa, Mycobacterium tuberculosis
LLVFGARA

SEQ ID NO: 19125 - protein, 8 aa, Mycobacterium tuberculosis
LVFGARAG

SEQ ID NO: 19126 - protein, 8 aa, Mycobacterium tuberculosis
VFGARAGR

SEQ ID NO: 19127 - protein, 8 aa, Mycobacterium tuberculosis
FGARAGRA

SEQ ID NO: 19128 - protein, 8 aa, Mycobacterium tuberculosis
GARAGRAA

SEQ ID NO: 19129 - protein, 8 aa, Mycobacterium tuberculosis
ARAGRAAA

SEQ ID NO: 19130 - protein, 8 aa, Mycobacterium tuberculosis
RAGRAAAD

SEQ ID NO: 19131 - protein, 8 aa, Mycobacterium tuberculosis
AGRAAADY

SEQ ID NO: 19132 - protein, 8 aa, Mycobacterium tuberculosis
GRAAADYA

SEQ ID NO: 19133 - protein, 8 aa, Mycobacterium tuberculosis
RAAADYAA

SEQ ID NO: 19134 - protein, 8 aa, Mycobacterium tuberculosis
AAADYAAR

SEQ ID NO: 19135 - protein, 8 aa, Mycobacterium tuberculosis
AADYAARH

SEQ ID NO: 19136 - protein, 8 aa, Mycobacterium tuberculosis
ADYAARHQ

SEQ ID NO: 19137 - protein, 8 aa, Mycobacterium tuberculosis
DYAARHQK

SEQ ID NO: 19138 - protein, 8 aa, Mycobacterium tuberculosis
YAARHQKS

SEQ ID NO: 19139 - protein, 8 aa, Mycobacterium tuberculosis
AARHQKSD

SEQ ID NO: 19140 - protein, 8 aa, Mycobacterium tuberculosis
ARHQKSDR

SEQ ID NO: 19141 - protein, 8 aa, Mycobacterium tuberculosis
RHQKSDRG

SEQ ID NO: 19142 - protein, 8 aa, Mycobacterium tuberculosis
HQKSDRGP

SEQ ID NO: 19143 - protein, 8 aa, Mycobacterium tuberculosis
QKSDRGPS

SEQ ID NO: 19144 - protein, 8 aa, Mycobacterium tuberculosis
KSDRGPSS

SEQ ID NO: 19145 - protein, 8 aa, Mycobacterium tuberculosis
SDRGPSSA

SEQ ID NO: 19146 - protein, 8 aa, Mycobacterium tuberculosis
DRGPSSAV

SEQ ID NO: 19147 - protein, 8 aa, Mycobacterium tuberculosis
RGPSSAVR

SEQ ID NO: 19148 - protein, 8 aa, Mycobacterium tuberculosis
GPSSAVRA

SEQ ID NO: 19149 - protein, 8 aa, Mycobacterium tuberculosis
PSSAVRAQ

SEQ ID NO: 19150 - protein, 8 aa, Mycobacterium tuberculosis
SSAVRAQA

SEQ ID NO: 19151 - protein, 8 aa, Mycobacterium tuberculosis
SAVRAQAR

SEQ ID NO: 19152 - protein, 8 aa, Mycobacterium tuberculosis
AVRAQART

SEQ ID NO: 19153 - protein, 8 aa, Mycobacterium tuberculosis
VRAQARTE

SEQ ID NO: 19154 - protein, 8 aa, Mycobacterium tuberculosis
RAQARTEA

SEQ ID NO: 19155 - protein, 8 aa, Mycobacterium tuberculosis
AQARTEAL

SEQ ID NO: 19156 - protein, 8 aa, Mycobacterium tuberculosis
QARTEALR

SEQ ID NO: 19157 - protein, 8 aa, Mycobacterium tuberculosis
ARTEALRL

SEQ ID NO: 19158 - protein, 8 aa, Mycobacterium tuberculosis
RTEALRLE

SEQ ID NO: 19159 - protein, 8 aa, Mycobacterium tuberculosis
TEALRLER

SEQ ID NO: 19160 - protein, 8 aa, Mycobacterium tuberculosis
EALRLERE

SEQ ID NO: 19161 - protein, 8 aa, Mycobacterium tuberculosis
ALRLEREL

SEQ ID NO: 19162 - protein, 8 aa, Mycobacterium tuberculosis
LRLERELS

SEQ ID NO: 19163 - protein, 8 aa, Mycobacterium tuberculosis
RLERELSR

SEQ ID NO: 19164 - protein, 8 aa, Mycobacterium tuberculosis
LERELSRH

SEQ ID NO: 19165 - protein, 8 aa, Mycobacterium tuberculosis
ERELSRHG

SEQ ID NO: 19166 - protein, 8 aa, Mycobacterium tuberculosis
RELSRHGQ

SEQ ID NO: 19167 - protein, 8 aa, Mycobacterium tuberculosis
ELSRHGQG

SEQ ID NO: 19168 - protein, 8 aa, Mycobacterium tuberculosis
LSRHGQGG

SEQ ID NO: 19169 - protein, 8 aa, Mycobacterium tuberculosis
SRHGQGGE

SEQ ID NO: 19170 - protein, 8 aa, Mycobacterium tuberculosis
RHGQGGER

SEQ ID NO: 19171 - protein, 8 aa, Mycobacterium tuberculosis
HGQGGERI

SEQ ID NO: 19172 - protein, 8 aa, Mycobacterium tuberculosis
GQGGERIA

SEQ ID NO: 19173 - protein, 8 aa, Mycobacterium tuberculosis
QGGERIAD

SEQ ID NO: 19174 - protein, 8 aa, Mycobacterium tuberculosis
GGERIADI

SEQ ID NO: 19175 - protein, 8 aa, Mycobacterium tuberculosis
GERIADIR

SEQ ID NO: 19176 - protein, 8 aa, Mycobacterium tuberculosis
ERIADIRA

SEQ ID NO: 19177 - protein, 8 aa, Mycobacterium tuberculosis
RIADIRAD

SEQ ID NO: 19178 - protein, 8 aa, Mycobacterium tuberculosis
IADIRADM

SEQ ID NO: 19179 - protein, 8 aa, Mycobacterium tuberculosis
ADIRADMQ

SEQ ID NO: 19180 - protein, 8 aa, Mycobacterium tuberculosis
DIRADMQA

SEQ ID NO: 19181 - protein, 8 aa, Mycobacterium tuberculosis
IRADMQAT

SEQ ID NO: 19182 - protein, 8 aa, Mycobacterium tuberculosis
RADMQATL

SEQ ID NO: 19183 - protein, 8 aa, Mycobacterium tuberculosis
ADMQATLE

SEQ ID NO: 19184 - protein, 8 aa, Mycobacterium tuberculosis
DMQATLES

SEQ ID NO: 19185 - protein, 8 aa, Mycobacterium tuberculosis
MQATLESA

SEQ ID NO: 19186 - protein, 8 aa, Mycobacterium tuberculosis
QATLESAA

SEQ ID NO: 19187 - protein, 8 aa, Mycobacterium tuberculosis
ATLESAAG

SEQ ID NO: 19188 - protein, 8 aa, Mycobacterium tuberculosis
TLESAAGI

SEQ ID NO: 19189 - protein, 8 aa, Mycobacterium tuberculosis
LESAAGIY

SEQ ID NO: 19190 - protein, 8 aa, Mycobacterium tuberculosis
ESAAGIYR

SEQ ID NO: 19191 - protein, 8 aa, Mycobacterium tuberculosis
SAAGIYRD

SEQ ID NO: 19192 - protein, 8 aa, Mycobacterium tuberculosis
AAGIYRDG

SEQ ID NO: 19193 - protein, 8 aa, Mycobacterium tuberculosis
AGIYRDGP

SEQ ID NO: 19194 - protein, 8 aa, Mycobacterium tuberculosis
GIYRDGPT

SEQ ID NO: 19195 - protein, 8 aa, Mycobacterium tuberculosis
IYRDGPTL

SEQ ID NO: 19196 - protein, 8 aa, Mycobacterium tuberculosis
YRDGPTLT

SEQ ID NO: 19197 - protein, 8 aa, Mycobacterium tuberculosis
RDGPTLTK

SEQ ID NO: 19198 - protein, 8 aa, Mycobacterium tuberculosis
DGPTLTKA

SEQ ID NO: 19199 - protein, 8 aa, Mycobacterium tuberculosis
GPTLTKAV

SEQ ID NO: 19200 - protein, 8 aa, Mycobacterium tuberculosis
PTLTKAVE

SEQ ID NO: 19201 - protein, 8 aa, Mycobacterium tuberculosis
TLTKAVEE

SEQ ID NO: 19202 - protein, 8 aa, Mycobacterium tuberculosis
LTKAVEEI

SEQ ID NO: 19203 - protein, 8 aa, Mycobacterium tuberculosis
TKAVEEIR

SEQ ID NO: 19204 - protein, 8 aa, Mycobacterium tuberculosis
KAVEEIRV

SEQ ID NO: 19205 - protein, 8 aa, Mycobacterium tuberculosis
AVEEIRVL

SEQ ID NO: 19206 - protein, 8 aa, Mycobacterium tuberculosis
VEEIRVLQ

SEQ ID NO: 19207 - protein, 8 aa, Mycobacterium tuberculosis
EEIRVLQE

SEQ ID NO: 19208 - protein, 8 aa, Mycobacterium tuberculosis
EIRVLQER

SEQ ID NO: 19209 - protein, 8 aa, Mycobacterium tuberculosis
IRVLQERF

SEQ ID NO: 19210 - protein, 8 aa, Mycobacterium tuberculosis
RVLQERFA

SEQ ID NO: 19211 - protein, 8 aa, Mycobacterium tuberculosis
VLQERFAT

SEQ ID NO: 19212 - protein, 8 aa, Mycobacterium tuberculosis
LQERFATA

SEQ ID NO: 19213 - protein, 8 aa, Mycobacterium tuberculosis
QERFATAG

SEQ ID NO: 19214 - protein, 8 aa, Mycobacterium tuberculosis
ERFATAGI

SEQ ID NO: 19215 - protein, 8 aa, Mycobacterium tuberculosis
RFATAGID

SEQ ID NO: 19216 - protein, 8 aa, Mycobacterium tuberculosis
FATAGIDD

SEQ ID NO: 19217 - protein, 8 aa, Mycobacterium tuberculosis
ATAGIDDH

SEQ ID NO: 19218 - protein, 8 aa, Mycobacterium tuberculosis
TAGIDDHS

SEQ ID NO: 19219 - protein, 8 aa, Mycobacterium tuberculosis
AGIDDHSR

SEQ ID NO: 19220 - protein, 8 aa, Mycobacterium tuberculosis
GIDDHSRT

SEQ ID NO: 19221 - protein, 8 aa, Mycobacterium tuberculosis
IDDHSRTF

SEQ ID NO: 19222 - protein, 8 aa, Mycobacterium tuberculosis
DDHSRTFN

SEQ ID NO: 19223 - protein, 8 aa, Mycobacterium tuberculosis
DHSRTFNT

SEQ ID NO: 19224 - protein, 8 aa, Mycobacterium tuberculosis
HSRTFNTE

SEQ ID NO: 19225 - protein, 8 aa, Mycobacterium tuberculosis
SRTFNTEL

SEQ ID NO: 19226 - protein, 8 aa, Mycobacterium tuberculosis
RTFNTELT

SEQ ID NO: 19227 - protein, 8 aa, Mycobacterium tuberculosis
TFNTELTA

SEQ ID NO: 19228 - protein, 8 aa, Mycobacterium tuberculosis
FNTELTAL

SEQ ID NO: 19229 - protein, 8 aa, Mycobacterium tuberculosis
NTELTALL

SEQ ID NO: 19230 - protein, 8 aa, Mycobacterium tuberculosis
TELTALLE

SEQ ID NO: 19231 - protein, 8 aa, Mycobacterium tuberculosis
ELTALLEL

SEQ ID NO: 19232 - protein, 8 aa, Mycobacterium tuberculosis
LTALLELS

SEQ ID NO: 19233 - protein, 8 aa, Mycobacterium tuberculosis
TALLELSG

SEQ ID NO: 19234 - protein, 8 aa, Mycobacterium tuberculosis
ALLELSGM

SEQ ID NO: 19235 - protein, 8 aa, Mycobacterium tuberculosis
LLELSGML

SEQ ID NO: 19236 - protein, 8 aa, Mycobacterium tuberculosis
LELSGMLD

SEQ ID NO: 19237 - protein, 8 aa, Mycobacterium tuberculosis
ELSGMLDV

SEQ ID NO: 19238 - protein, 8 aa, Mycobacterium tuberculosis
LSGMLDVA

SEQ ID NO: 19239 - protein, 8 aa, Mycobacterium tuberculosis
SGMLDVAL

SEQ ID NO: 19240 - protein, 8 aa, Mycobacterium tuberculosis
GMLDVALA

SEQ ID NO: 19241 - protein, 8 aa, Mycobacterium tuberculosis
MLDVALAI

SEQ ID NO: 19242 - protein, 8 aa, Mycobacterium tuberculosis
LDVALAIV

SEQ ID NO: 19243 - protein, 8 aa, Mycobacterium tuberculosis
DVALAIVE

SEQ ID NO: 19244 - protein, 8 aa, Mycobacterium tuberculosis
VALAIVES

SEQ ID NO: 19245 - protein, 8 aa, Mycobacterium tuberculosis
ALAIVESG

SEQ ID NO: 19246 - protein, 8 aa, Mycobacterium tuberculosis
LAIVESGL

SEQ ID NO: 19247 - protein, 8 aa, Mycobacterium tuberculosis
AIVESGLR

SEQ ID NO: 19248 - protein, 8 aa, Mycobacterium tuberculosis
IVESGLRR

SEQ ID NO: 19249 - protein, 8 aa, Mycobacterium tuberculosis
VESGLRRE

SEQ ID NO: 19250 - protein, 8 aa, Mycobacterium tuberculosis
ESGLRREE

SEQ ID NO: 19251 - protein, 8 aa, Mycobacterium tuberculosis
SGLRREES

SEQ ID NO: 19252 - protein, 8 aa, Mycobacterium tuberculosis
GLRREESR

SEQ ID NO: 19253 - protein, 8 aa, Mycobacterium tuberculosis
LRREESRG

SEQ ID NO: 19254 - protein, 8 aa, Mycobacterium tuberculosis
RREESRGA

SEQ ID NO: 19255 - protein, 8 aa, Mycobacterium tuberculosis
REESRGAH

SEQ ID NO: 19256 - protein, 8 aa, Mycobacterium tuberculosis
EESRGAHQ

SEQ ID NO: 19257 - protein, 8 aa, Mycobacterium tuberculosis
ESRGAHQR

SEQ ID NO: 19258 - protein, 8 aa, Mycobacterium tuberculosis
SRGAHQRT

SEQ ID NO: 19259 - protein, 8 aa, Mycobacterium tuberculosis
RGAHQRTD

SEQ ID NO: 19260 - protein, 8 aa, Mycobacterium tuberculosis
GAHQRTDF

SEQ ID NO: 19261 - protein, 8 aa, Mycobacterium tuberculosis
AHQRTDFP

SEQ ID NO: 19262 - protein, 8 aa, Mycobacterium tuberculosis
HQRTDFPN

SEQ ID NO: 19263 - protein, 8 aa, Mycobacterium tuberculosis
QRTDFPNR

SEQ ID NO: 19264 - protein, 8 aa, Mycobacterium tuberculosis
RTDFPNRD

SEQ ID NO: 19265 - protein, 8 aa, Mycobacterium tuberculosis
TDFPNRDD

SEQ ID NO: 19266 - protein, 8 aa, Mycobacterium tuberculosis
DFPNRDDE

SEQ ID NO: 19267 - protein, 8 aa, Mycobacterium tuberculosis
FPNRDDEH

SEQ ID NO: 19268 - protein, 8 aa, Mycobacterium tuberculosis
PNRDDEHF

SEQ ID NO: 19269 - protein, 8 aa, Mycobacterium tuberculosis
NRDDEHFL

SEQ ID NO: 19270 - protein, 8 aa, Mycobacterium tuberculosis
RDDEHFLA

SEQ ID NO: 19271 - protein, 8 aa, Mycobacterium tuberculosis
DDEHFLAH

SEQ ID NO: 19272 - protein, 8 aa, Mycobacterium tuberculosis
DEHFLAHT

SEQ ID NO: 19273 - protein, 8 aa, Mycobacterium tuberculosis
EHFLAHTL

SEQ ID NO: 19274 - protein, 8 aa, Mycobacterium tuberculosis
HFLAHTLV

SEQ ID NO: 19275 - protein, 8 aa, Mycobacterium tuberculosis
FLAHTLVH

SEQ ID NO: 19276 - protein, 8 aa, Mycobacterium tuberculosis
LAHTLVHR

SEQ ID NO: 19277 - protein, 8 aa, Mycobacterium tuberculosis
AHTLVHRE

SEQ ID NO: 19278 - protein, 8 aa, Mycobacterium tuberculosis
HTLVHRES

SEQ ID NO: 19279 - protein, 8 aa, Mycobacterium tuberculosis
TLVHRESD

SEQ ID NO: 19280 - protein, 8 aa, Mycobacterium tuberculosis
LVHRESDG

SEQ ID NO: 19281 - protein, 8 aa, Mycobacterium tuberculosis
VHRESDGT

SEQ ID NO: 19282 - protein, 8 aa, Mycobacterium tuberculosis
HRESDGTL

SEQ ID NO: 19283 - protein, 8 aa, Mycobacterium tuberculosis
RESDGTLR

SEQ ID NO: 19284 - protein, 8 aa, Mycobacterium tuberculosis
ESDGTLRV

SEQ ID NO: 19285 - protein, 8 aa, Mycobacterium tuberculosis
SDGTLRVG

SEQ ID NO: 19286 - protein, 8 aa, Mycobacterium tuberculosis
DGTLRVGY

SEQ ID NO: 19287 - protein, 8 aa, Mycobacterium tuberculosis
GTLRVGYL

SEQ ID NO: 19288 - protein, 8 aa, Mycobacterium tuberculosis
TLRVGYLP

SEQ ID NO: 19289 - protein, 8 aa, Mycobacterium tuberculosis
LRVGYLPV

SEQ ID NO: 19290 - protein, 8 aa, Mycobacterium tuberculosis
RVGYLPVT

SEQ ID NO: 19291 - protein, 8 aa, Mycobacterium tuberculosis
VGYLPVTI

SEQ ID NO: 19292 - protein, 8 aa, Mycobacterium tuberculosis
GYLPVTIT

SEQ ID NO: 19293 - protein, 8 aa, Mycobacterium tuberculosis
YLPVTITR

SEQ ID NO: 19294 - protein, 8 aa, Mycobacterium tuberculosis
LPVTITRW

SEQ ID NO: 19295 - protein, 8 aa, Mycobacterium tuberculosis
PVTITRWP

SEQ ID NO: 19296 - protein, 8 aa, Mycobacterium tuberculosis
VTITRWPP

SEQ ID NO: 19297 - protein, 8 aa, Mycobacterium tuberculosis
TITRWPPG

SEQ ID NO: 19298 - protein, 8 aa, Mycobacterium tuberculosis
ITRWPPGE

SEQ ID NO: 19299 - protein, 8 aa, Mycobacterium tuberculosis
TRWPPGER

SEQ ID NO: 19300 - protein, 8 aa, Mycobacterium tuberculosis
RWPPGERV

SEQ ID NO: 19301 - protein, 8 aa, Mycobacterium tuberculosis
WPPGERVY

SEQ ID NO: 19302 - protein, 8 aa, Mycobacterium tuberculosis
PPGERVYG

SEQ ID NO: 19303 - protein, 8 aa, Mycobacterium tuberculosis
PGERVYGR

SEQ ID NO: 19304 - protein, 9 aa, Mycobacterium tuberculosis
MTAQHNIVV

SEQ ID NO: 19305 - protein, 9 aa, Mycobacterium tuberculosis
TAQHNIVVI

SEQ ID NO: 19306 - protein, 9 aa, Mycobacterium tuberculosis
AQHNIVVIG

SEQ ID NO: 19307 - protein, 9 aa, Mycobacterium tuberculosis
QHNIVVIGG

SEQ ID NO: 19308 - protein, 9 aa, Mycobacterium tuberculosis
HNIVVIGGG

SEQ ID NO: 19309 - protein, 9 aa, Mycobacterium tuberculosis
NIVVIGGGG

SEQ ID NO: 19310 - protein, 9 aa, Mycobacterium tuberculosis
IVVIGGGGA

SEQ ID NO: 19311 - protein, 9 aa, Mycobacterium tuberculosis
VVIGGGGAG

SEQ ID NO: 19312 - protein, 9 aa, Mycobacterium tuberculosis
VIGGGGAGL

SEQ ID NO: 19313 - protein, 9 aa, Mycobacterium tuberculosis
IGGGGAGLR

SEQ ID NO: 19314 - protein, 9 aa, Mycobacterium tuberculosis
GGGGAGLRA

SEQ ID NO: 19315 - protein, 9 aa, Mycobacterium tuberculosis
GGGAGLRAA

SEQ ID NO: 19316 - protein, 9 aa, Mycobacterium tuberculosis
GGAGLRAAI

SEQ ID NO: 19317 - protein, 9 aa, Mycobacterium tuberculosis
GAGLRAAIA

SEQ ID NO: 19318 - protein, 9 aa, Mycobacterium tuberculosis
AGLRAAIAI

SEQ ID NO: 19319 - protein, 9 aa, Mycobacterium tuberculosis
GLRAAIAIA

SEQ ID NO: 19320 - protein, 9 aa, Mycobacterium tuberculosis
LRAAIAIAE

SEQ ID NO: 19321 - protein, 9 aa, Mycobacterium tuberculosis
RAAIAIAET

SEQ ID NO: 19322 - protein, 9 aa, Mycobacterium tuberculosis
AAIAIAETN

SEQ ID NO: 19323 - protein, 9 aa, Mycobacterium tuberculosis
AIAIAETNP

SEQ ID NO: 19324 - protein, 9 aa, Mycobacterium tuberculosis
IAIAETNPH

SEQ ID NO: 19325 - protein, 9 aa, Mycobacterium tuberculosis
AIAETNPHL

SEQ ID NO: 19326 - protein, 9 aa, Mycobacterium tuberculosis
IAETNPHLD

SEQ ID NO: 19327 - protein, 9 aa, Mycobacterium tuberculosis
AETNPHLDV

SEQ ID NO: 19328 - protein, 9 aa, Mycobacterium tuberculosis
ETNPHLDVA

SEQ ID NO: 19329 - protein, 9 aa, Mycobacterium tuberculosis
TNPHLDVAI

SEQ ID NO: 19330 - protein, 9 aa, Mycobacterium tuberculosis
NPHLDVAIV

SEQ ID NO: 19331 - protein, 9 aa, Mycobacterium tuberculosis
PHLDVAIVS

SEQ ID NO: 19332 - protein, 9 aa, Mycobacterium tuberculosis
HLDVAIVSK

SEQ ID NO: 19333 - protein, 9 aa, Mycobacterium tuberculosis
LDVAIVSKV

SEQ ID NO: 19334 - protein, 9 aa, Mycobacterium tuberculosis
DVAIVSKVY

SEQ ID NO: 19335 - protein, 9 aa, Mycobacterium tuberculosis
VAIVSKVYP

SEQ ID NO: 19336 - protein, 9 aa, Mycobacterium tuberculosis
AIVSKVYPM

SEQ ID NO: 19337 - protein, 9 aa, Mycobacterium tuberculosis
IVSKVYPMR

SEQ ID NO: 19338 - protein, 9 aa, Mycobacterium tuberculosis
VSKVYPMRS

SEQ ID NO: 19339 - protein, 9 aa, Mycobacterium tuberculosis
SKVYPMRSH

SEQ ID NO: 19340 - protein, 9 aa, Mycobacterium tuberculosis
KVYPMRSHT

SEQ ID NO: 19341 - protein, 9 aa, Mycobacterium tuberculosis
VYPMRSHTV

SEQ ID NO: 19342 - protein, 9 aa, Mycobacterium tuberculosis
YPMRSHTVS

SEQ ID NO: 19343 - protein, 9 aa, Mycobacterium tuberculosis
PMRSHTVSA

SEQ ID NO: 19344 - protein, 9 aa, Mycobacterium tuberculosis
MRSHTVSAE

SEQ ID NO: 19345 - protein, 9 aa, Mycobacterium tuberculosis
RSHTVSAEG

SEQ ID NO: 19346 - protein, 9 aa, Mycobacterium tuberculosis
SHTVSAEGG

SEQ ID NO: 19347 - protein, 9 aa, Mycobacterium tuberculosis
HTVSAEGGA

SEQ ID NO: 19348 - protein, 9 aa, Mycobacterium tuberculosis
TVSAEGGAA

SEQ ID NO: 19349 - protein, 9 aa, Mycobacterium tuberculosis
VSAEGGAAA

SEQ ID NO: 19350 - protein, 9 aa, Mycobacterium tuberculosis
SAEGGAAAV

SEQ ID NO: 19351 - protein, 9 aa, Mycobacterium tuberculosis
AEGGAAAVT

SEQ ID NO: 19352 - protein, 9 aa, Mycobacterium tuberculosis
EGGAAAVTG

SEQ ID NO: 19353 - protein, 9 aa, Mycobacterium tuberculosis
GGAAAVTGD

SEQ ID NO: 19354 - protein, 9 aa, Mycobacterium tuberculosis
GAAAVTGDD

SEQ ID NO: 19355 - protein, 9 aa, Mycobacterium tuberculosis
AAAVTGDDD

SEQ ID NO: 19356 - protein, 9 aa, Mycobacterium tuberculosis
AAVTGDDDS

SEQ ID NO: 19357 - protein, 9 aa, Mycobacterium tuberculosis
AVTGDDDSL

SEQ ID NO: 19358 - protein, 9 aa, Mycobacterium tuberculosis
VTGDDDSLD

SEQ ID NO: 19359 - protein, 9 aa, Mycobacterium tuberculosis
TGDDDSLDE

SEQ ID NO: 19360 - protein, 9 aa, Mycobacterium tuberculosis
GDDDSLDEH

SEQ ID NO: 19361 - protein, 9 aa, Mycobacterium tuberculosis
DDDSLDEHA

SEQ ID NO: 19362 - protein, 9 aa, Mycobacterium tuberculosis
DDSLDEHAH

SEQ ID NO: 19363 - protein, 9 aa, Mycobacterium tuberculosis
DSLDEHAHD

SEQ ID NO: 19364 - protein, 9 aa, Mycobacterium tuberculosis
SLDEHAHDT

SEQ ID NO: 19365 - protein, 9 aa, Mycobacterium tuberculosis
LDEHAHDTV

SEQ ID NO: 19366 - protein, 9 aa, Mycobacterium tuberculosis
DEHAHDTVS

SEQ ID NO: 19367 - protein, 9 aa, Mycobacterium tuberculosis
EHAHDTVSG

SEQ ID NO: 19368 - protein, 9 aa, Mycobacterium tuberculosis
HAHDTVSGG

SEQ ID NO: 19369 - protein, 9 aa, Mycobacterium tuberculosis
AHDTVSGGD

SEQ ID NO: 19370 - protein, 9 aa, Mycobacterium tuberculosis
HDTVSGGDW

SEQ ID NO: 19371 - protein, 9 aa, Mycobacterium tuberculosis
DTVSGGDWL

SEQ ID NO: 19372 - protein, 9 aa, Mycobacterium tuberculosis
TVSGGDWLC

SEQ ID NO: 19373 - protein, 9 aa, Mycobacterium tuberculosis
VSGGDWLCD

SEQ ID NO: 19374 - protein, 9 aa, Mycobacterium tuberculosis
SGGDWLCDQ

SEQ ID NO: 19375 - protein, 9 aa, Mycobacterium tuberculosis
GGDWLCDQD

SEQ ID NO: 19376 - protein, 9 aa, Mycobacterium tuberculosis
GDWLCDQDA

SEQ ID NO: 19377 - protein, 9 aa, Mycobacterium tuberculosis
DWLCDQDAV

SEQ ID NO: 19378 - protein, 9 aa, Mycobacterium tuberculosis
WLCDQDAVE

SEQ ID NO: 19379 - protein, 9 aa, Mycobacterium tuberculosis
LCDQDAVEA

SEQ ID NO: 19380 - protein, 9 aa, Mycobacterium tuberculosis
CDQDAVEAF

SEQ ID NO: 19381 - protein, 9 aa, Mycobacterium tuberculosis
DQDAVEAFV

SEQ ID NO: 19382 - protein, 9 aa, Mycobacterium tuberculosis
QDAVEAFVA

SEQ ID NO: 19383 - protein, 9 aa, Mycobacterium tuberculosis
DAVEAFVAE

SEQ ID NO: 19384 - protein, 9 aa, Mycobacterium tuberculosis
AVEAFVAEA

SEQ ID NO: 19385 - protein, 9 aa, Mycobacterium tuberculosis
VEAFVAEAP

SEQ ID NO: 19386 - protein, 9 aa, Mycobacterium tuberculosis
EAFVAEAPK

SEQ ID NO: 19387 - protein, 9 aa, Mycobacterium tuberculosis
AFVAEAPKE

SEQ ID NO: 19388 - protein, 9 aa, Mycobacterium tuberculosis
FVAEAPKEL

SEQ ID NO: 19389 - protein, 9 aa, Mycobacterium tuberculosis
VAEAPKELV

SEQ ID NO: 19390 - protein, 9 aa, Mycobacterium tuberculosis
AEAPKELVQ

SEQ ID NO: 19391 - protein, 9 aa, Mycobacterium tuberculosis
EAPKELVQL

SEQ ID NO: 19392 - protein, 9 aa, Mycobacterium tuberculosis
APKELVQLE

SEQ ID NO: 19393 - protein, 9 aa, Mycobacterium tuberculosis
PKELVQLEH

SEQ ID NO: 19394 - protein, 9 aa, Mycobacterium tuberculosis
KELVQLEHW

SEQ ID NO: 19395 - protein, 9 aa, Mycobacterium tuberculosis
ELVQLEHWG

SEQ ID NO: 19396 - protein, 9 aa, Mycobacterium tuberculosis
LVQLEHWGC

SEQ ID NO: 19397 - protein, 9 aa, Mycobacterium tuberculosis
VQLEHWGCP

SEQ ID NO: 19398 - protein, 9 aa, Mycobacterium tuberculosis
QLEHWGCPW

SEQ ID NO: 19399 - protein, 9 aa, Mycobacterium tuberculosis
LEHWGCPWS

SEQ ID NO: 19400 - protein, 9 aa, Mycobacterium tuberculosis
EHWGCPWSR

SEQ ID NO: 19401 - protein, 9 aa, Mycobacterium tuberculosis
HWGCPWSRK

SEQ ID NO: 19402 - protein, 9 aa, Mycobacterium tuberculosis
WGCPWSRKP

SEQ ID NO: 19403 - protein, 9 aa, Mycobacterium tuberculosis
GCPWSRKPD

SEQ ID NO: 19404 - protein, 9 aa, Mycobacterium tuberculosis
CPWSRKPDG

SEQ ID NO: 19405 - protein, 9 aa, Mycobacterium tuberculosis
PWSRKPDGR

SEQ ID NO: 19406 - protein, 9 aa, Mycobacterium tuberculosis
WSRKPDGRV

SEQ ID NO: 19407 - protein, 9 aa, Mycobacterium tuberculosis
SRKPDGRVA

SEQ ID NO: 19408 - protein, 9 aa, Mycobacterium tuberculosis
RKPDGRVAV

SEQ ID NO: 19409 - protein, 9 aa, Mycobacterium tuberculosis
KPDGRVAVR

SEQ ID NO: 19410 - protein, 9 aa, Mycobacterium tuberculosis
PDGRVAVRP

SEQ ID NO: 19411 - protein, 9 aa, Mycobacterium tuberculosis
DGRVAVRPF

SEQ ID NO: 19412 - protein, 9 aa, Mycobacterium tuberculosis
GRVAVRPFG

SEQ ID NO: 19413 - protein, 9 aa, Mycobacterium tuberculosis
RVAVRPFGG

SEQ ID NO: 19414 - protein, 9 aa, Mycobacterium tuberculosis
VAVRPFGGM

SEQ ID NO: 19415 - protein, 9 aa, Mycobacterium tuberculosis
AVRPFGGMK

SEQ ID NO: 19416 - protein, 9 aa, Mycobacterium tuberculosis
VRPFGGMKK

SEQ ID NO: 19417 - protein, 9 aa, Mycobacterium tuberculosis
RPFGGMKKL

SEQ ID NO: 19418 - protein, 9 aa, Mycobacterium tuberculosis
PFGGMKKLR

SEQ ID NO: 19419 - protein, 9 aa, Mycobacterium tuberculosis
FGGMKKLRT

SEQ ID NO: 19420 - protein, 9 aa, Mycobacterium tuberculosis
GGMKKLRTW

SEQ ID NO: 19421 - protein, 9 aa, Mycobacterium tuberculosis
GMKKLRTWF

SEQ ID NO: 19422 - protein, 9 aa, Mycobacterium tuberculosis
MKKLRTWFA

SEQ ID NO: 19423 - protein, 9 aa, Mycobacterium tuberculosis
KKLRTWFAA

SEQ ID NO: 19424 - protein, 9 aa, Mycobacterium tuberculosis
KLRTWFAAD

SEQ ID NO: 19425 - protein, 9 aa, Mycobacterium tuberculosis
LRTWFAADK

SEQ ID NO: 19426 - protein, 9 aa, Mycobacterium tuberculosis
RTWFAADKT

SEQ ID NO: 19427 - protein, 9 aa, Mycobacterium tuberculosis
TWFAADKTG

SEQ ID NO: 19428 - protein, 9 aa, Mycobacterium tuberculosis
WFAADKTGF

SEQ ID NO: 19429 - protein, 9 aa, Mycobacterium tuberculosis
FAADKTGFH

SEQ ID NO: 19430 - protein, 9 aa, Mycobacterium tuberculosis
AADKTGFHL

SEQ ID NO: 19431 - protein, 9 aa, Mycobacterium tuberculosis
ADKTGFHLL

SEQ ID NO: 19432 - protein, 9 aa, Mycobacterium tuberculosis
DKTGFHLLH

SEQ ID NO: 19433 - protein, 9 aa, Mycobacterium tuberculosis
KTGFHLLHT

SEQ ID NO: 19434 - protein, 9 aa, Mycobacterium tuberculosis
TGFHLLHTL

SEQ ID NO: 19435 - protein, 9 aa, Mycobacterium tuberculosis
GFHLLHTLF

SEQ ID NO: 19436 - protein, 9 aa, Mycobacterium tuberculosis
FHLLHTLFQ

SEQ ID NO: 19437 - protein, 9 aa, Mycobacterium tuberculosis
HLLHTLFQR

SEQ ID NO: 19438 - protein, 9 aa, Mycobacterium tuberculosis
LLHTLFQRL

SEQ ID NO: 19439 - protein, 9 aa, Mycobacterium tuberculosis
LHTLFQRLL

SEQ ID NO: 19440 - protein, 9 aa, Mycobacterium tuberculosis
HTLFQRLLT

SEQ ID NO: 19441 - protein, 9 aa, Mycobacterium tuberculosis
TLFQRLLTY

SEQ ID NO: 19442 - protein, 9 aa, Mycobacterium tuberculosis
LFQRLLTYS

SEQ ID NO: 19443 - protein, 9 aa, Mycobacterium tuberculosis
FQRLLTYSD

SEQ ID NO: 19444 - protein, 9 aa, Mycobacterium tuberculosis
QRLLTYSDV

SEQ ID NO: 19445 - protein, 9 aa, Mycobacterium tuberculosis
RLLTYSDVM

SEQ ID NO: 19446 - protein, 9 aa, Mycobacterium tuberculosis
LLTYSDVMR

SEQ ID NO: 19447 - protein, 9 aa, Mycobacterium tuberculosis
LTYSDVMRY

SEQ ID NO: 19448 - protein, 9 aa, Mycobacterium tuberculosis
TYSDVMRYD

SEQ ID NO: 19449 - protein, 9 aa, Mycobacterium tuberculosis
YSDVMRYDE

SEQ ID NO: 19450 - protein, 9 aa, Mycobacterium tuberculosis
SDVMRYDEW

SEQ ID NO: 19451 - protein, 9 aa, Mycobacterium tuberculosis
DVMRYDEWF

SEQ ID NO: 19452 - protein, 9 aa, Mycobacterium tuberculosis
VMRYDEWFA

SEQ ID NO: 19453 - protein, 9 aa, Mycobacterium tuberculosis
MRYDEWFAT

SEQ ID NO: 19454 - protein, 9 aa, Mycobacterium tuberculosis
RYDEWFATT

SEQ ID NO: 19455 - protein, 9 aa, Mycobacterium tuberculosis
YDEWFATTL

SEQ ID NO: 19456 - protein, 9 aa, Mycobacterium tuberculosis
DEWFATTLL

SEQ ID NO: 19457 - protein, 9 aa, Mycobacterium tuberculosis
EWFATTLLV

SEQ ID NO: 19458 - protein, 9 aa, Mycobacterium tuberculosis
WFATTLLVD

SEQ ID NO: 19459 - protein, 9 aa, Mycobacterium tuberculosis
FATTLLVDD

SEQ ID NO: 19460 - protein, 9 aa, Mycobacterium tuberculosis
ATTLLVDDG

SEQ ID NO: 19461 - protein, 9 aa, Mycobacterium tuberculosis
TTLLVDDGR

SEQ ID NO: 19462 - protein, 9 aa, Mycobacterium tuberculosis
TLLVDDGRV

SEQ ID NO: 19463 - protein, 9 aa, Mycobacterium tuberculosis
LLVDDGRVC

SEQ ID NO: 19464 - protein, 9 aa, Mycobacterium tuberculosis
LVDDGRVCG

SEQ ID NO: 19465 - protein, 9 aa, Mycobacterium tuberculosis
VDDGRVCGL

SEQ ID NO: 19466 - protein, 9 aa, Mycobacterium tuberculosis
DDGRVCGLV

SEQ ID NO: 19467 - protein, 9 aa, Mycobacterium tuberculosis
DGRVCGLVA

SEQ ID NO: 19468 - protein, 9 aa, Mycobacterium tuberculosis
GRVCGLVAI

SEQ ID NO: 19469 - protein, 9 aa, Mycobacterium tuberculosis
RVCGLVAIE

SEQ ID NO: 19470 - protein, 9 aa, Mycobacterium tuberculosis
VCGLVAIEL

SEQ ID NO: 19471 - protein, 9 aa, Mycobacterium tuberculosis
CGLVAIELA

SEQ ID NO: 19472 - protein, 9 aa, Mycobacterium tuberculosis
GLVAIELAT

SEQ ID NO: 19473 - protein, 9 aa, Mycobacterium tuberculosis
LVAIELATG

SEQ ID NO: 19474 - protein, 9 aa, Mycobacterium tuberculosis
VAIELATGR

SEQ ID NO: 19475 - protein, 9 aa, Mycobacterium tuberculosis
AIELATGRI

SEQ ID NO: 19476 - protein, 9 aa, Mycobacterium tuberculosis
IELATGRIE

SEQ ID NO: 19477 - protein, 9 aa, Mycobacterium tuberculosis
ELATGRIET

SEQ ID NO: 19478 - protein, 9 aa, Mycobacterium tuberculosis
LATGRIETI

SEQ ID NO: 19479 - protein, 9 aa, Mycobacterium tuberculosis
ATGRIETIL

SEQ ID NO: 19480 - protein, 9 aa, Mycobacterium tuberculosis
TGRIETILA

SEQ ID NO: 19481 - protein, 9 aa, Mycobacterium tuberculosis
GRIETILAD

SEQ ID NO: 19482 - protein, 9 aa, Mycobacterium tuberculosis
RIETILADA

SEQ ID NO: 19483 - protein, 9 aa, Mycobacterium tuberculosis
IETILADAV

SEQ ID NO: 19484 - protein, 9 aa, Mycobacterium tuberculosis
ETILADAVI

SEQ ID NO: 19485 - protein, 9 aa, Mycobacterium tuberculosis
TILADAVIL

SEQ ID NO: 19486 - protein, 9 aa, Mycobacterium tuberculosis
ILADAVILC

SEQ ID NO: 19487 - protein, 9 aa, Mycobacterium tuberculosis
LADAVILCT

SEQ ID NO: 19488 - protein, 9 aa, Mycobacterium tuberculosis
ADAVILCTG

SEQ ID NO: 19489 - protein, 9 aa, Mycobacterium tuberculosis
DAVILCTGG

SEQ ID NO: 19490 - protein, 9 aa, Mycobacterium tuberculosis
AVILCTGGC

SEQ ID NO: 19491 - protein, 9 aa, Mycobacterium tuberculosis
VILCTGGCG

SEQ ID NO: 19492 - protein, 9 aa, Mycobacterium tuberculosis
ILCTGGCGR

SEQ ID NO: 19493 - protein, 9 aa, Mycobacterium tuberculosis
LCTGGCGRV

SEQ ID NO: 19494 - protein, 9 aa, Mycobacterium tuberculosis
CTGGCGRVF

SEQ ID NO: 19495 - protein, 9 aa, Mycobacterium tuberculosis
TGGCGRVFP

SEQ ID NO: 19496 - protein, 9 aa, Mycobacterium tuberculosis
GGCGRVFPF

SEQ ID NO: 19497 - protein, 9 aa, Mycobacterium tuberculosis
GCGRVFPFT

SEQ ID NO: 19498 - protein, 9 aa, Mycobacterium tuberculosis
CGRVFPFTT

SEQ ID NO: 19499 - protein, 9 aa, Mycobacterium tuberculosis
GRVFPFTTN

SEQ ID NO: 19500 - protein, 9 aa, Mycobacterium tuberculosis
RVFPFTTNA

SEQ ID NO: 19501 - protein, 9 aa, Mycobacterium tuberculosis
VFPFTTNAN

SEQ ID NO: 19502 - protein, 9 aa, Mycobacterium tuberculosis
FPFTTNANI

SEQ ID NO: 19503 - protein, 9 aa, Mycobacterium tuberculosis
PFTTNANIK

SEQ ID NO: 19504 - protein, 9 aa, Mycobacterium tuberculosis
FTTNANIKT

SEQ ID NO: 19505 - protein, 9 aa, Mycobacterium tuberculosis
TTNANIKTG

SEQ ID NO: 19506 - protein, 9 aa, Mycobacterium tuberculosis
TNANIKTGD

SEQ ID NO: 19507 - protein, 9 aa, Mycobacterium tuberculosis
NANIKTGDG

SEQ ID NO: 19508 - protein, 9 aa, Mycobacterium tuberculosis
ANIKTGDGM

SEQ ID NO: 19509 - protein, 9 aa, Mycobacterium tuberculosis
NIKTGDGMA

SEQ ID NO: 19510 - protein, 9 aa, Mycobacterium tuberculosis
IKTGDGMAL

SEQ ID NO: 19511 - protein, 9 aa, Mycobacterium tuberculosis
KTGDGMALA

SEQ ID NO: 19512 - protein, 9 aa, Mycobacterium tuberculosis
TGDGMALAF

SEQ ID NO: 19513 - protein, 9 aa, Mycobacterium tuberculosis
GDGMALAFR

SEQ ID NO: 19514 - protein, 9 aa, Mycobacterium tuberculosis
DGMALAFRA

SEQ ID NO: 19515 - protein, 9 aa, Mycobacterium tuberculosis
GMALAFRAG

SEQ ID NO: 19516 - protein, 9 aa, Mycobacterium tuberculosis
MALAFRAGA

SEQ ID NO: 19517 - protein, 9 aa, Mycobacterium tuberculosis
ALAFRAGAP

SEQ ID NO: 19518 - protein, 9 aa, Mycobacterium tuberculosis
LAFRAGAPL

SEQ ID NO: 19519 - protein, 9 aa, Mycobacterium tuberculosis
AFRAGAPLK

SEQ ID NO: 19520 - protein, 9 aa, Mycobacterium tuberculosis
FRAGAPLKD

SEQ ID NO: 19521 - protein, 9 aa, Mycobacterium tuberculosis
RAGAPLKDM

SEQ ID NO: 19522 - protein, 9 aa, Mycobacterium tuberculosis
AGAPLKDME

SEQ ID NO: 19523 - protein, 9 aa, Mycobacterium tuberculosis
GAPLKDMEF

SEQ ID NO: 19524 - protein, 9 aa, Mycobacterium tuberculosis
APLKDMEFV

SEQ ID NO: 19525 - protein, 9 aa, Mycobacterium tuberculosis
PLKDMEFVQ

SEQ ID NO: 19526 - protein, 9 aa, Mycobacterium tuberculosis
LKDMEFVQY

SEQ ID NO: 19527 - protein, 9 aa, Mycobacterium tuberculosis
KDMEFVQYH

SEQ ID NO: 19528 - protein, 9 aa, Mycobacterium tuberculosis
DMEFVQYHP

SEQ ID NO: 19529 - protein, 9 aa, Mycobacterium tuberculosis
MEFVQYHPT

SEQ ID NO: 19530 - protein, 9 aa, Mycobacterium tuberculosis
EFVQYHPTG

SEQ ID NO: 19531 - protein, 9 aa, Mycobacterium tuberculosis
FVQYHPTGL

SEQ ID NO: 19532 - protein, 9 aa, Mycobacterium tuberculosis
VQYHPTGLP

SEQ ID NO: 19533 - protein, 9 aa, Mycobacterium tuberculosis
QYHPTGLPF

SEQ ID NO: 19534 - protein, 9 aa, Mycobacterium tuberculosis
YHPTGLPFT

SEQ ID NO: 19535 - protein, 9 aa, Mycobacterium tuberculosis
HPTGLPFTG

SEQ ID NO: 19536 - protein, 9 aa, Mycobacterium tuberculosis
PTGLPFTGI

SEQ ID NO: 19537 - protein, 9 aa, Mycobacterium tuberculosis
TGLPFTGIL

SEQ ID NO: 19538 - protein, 9 aa, Mycobacterium tuberculosis
GLPFTGILI

SEQ ID NO: 19539 - protein, 9 aa, Mycobacterium tuberculosis
LPFTGILIT

SEQ ID NO: 19540 - protein, 9 aa, Mycobacterium tuberculosis
PFTGILITE

SEQ ID NO: 19541 - protein, 9 aa, Mycobacterium tuberculosis
FTGILITEA

SEQ ID NO: 19542 - protein, 9 aa, Mycobacterium tuberculosis
TGILITEAA

SEQ ID NO: 19543 - protein, 9 aa, Mycobacterium tuberculosis
GILITEAAR

SEQ ID NO: 19544 - protein, 9 aa, Mycobacterium tuberculosis
ILITEAARA

SEQ ID NO: 19545 - protein, 9 aa, Mycobacterium tuberculosis
LITEAARAE

SEQ ID NO: 19546 - protein, 9 aa, Mycobacterium tuberculosis
ITEAARAEG

SEQ ID NO: 19547 - protein, 9 aa, Mycobacterium tuberculosis
TEAARAEGG

SEQ ID NO: 19548 - protein, 9 aa, Mycobacterium tuberculosis
EAARAEGGW

SEQ ID NO: 19549 - protein, 9 aa, Mycobacterium tuberculosis
AARAEGGWL

SEQ ID NO: 19550 - protein, 9 aa, Mycobacterium tuberculosis
ARAEGGWLL

SEQ ID NO: 19551 - protein, 9 aa, Mycobacterium tuberculosis
RAEGGWLLN

SEQ ID NO: 19552 - protein, 9 aa, Mycobacterium tuberculosis
AEGGWLLNK

SEQ ID NO: 19553 - protein, 9 aa, Mycobacterium tuberculosis
EGGWLLNKD

SEQ ID NO: 19554 - protein, 9 aa, Mycobacterium tuberculosis
GGWLLNKDG

SEQ ID NO: 19555 - protein, 9 aa, Mycobacterium tuberculosis
GWLLNKDGY

SEQ ID NO: 19556 - protein, 9 aa, Mycobacterium tuberculosis
WLLNKDGYR

SEQ ID NO: 19557 - protein, 9 aa, Mycobacterium tuberculosis
LLNKDGYRY

SEQ ID NO: 19558 - protein, 9 aa, Mycobacterium tuberculosis
LNKDGYRYL

SEQ ID NO: 19559 - protein, 9 aa, Mycobacterium tuberculosis
NKDGYRYLQ

SEQ ID NO: 19560 - protein, 9 aa, Mycobacterium tuberculosis
KDGYRYLQD

SEQ ID NO: 19561 - protein, 9 aa, Mycobacterium tuberculosis
DGYRYLQDY

SEQ ID NO: 19562 - protein, 9 aa, Mycobacterium tuberculosis
GYRYLQDYD

SEQ ID NO: 19563 - protein, 9 aa, Mycobacterium tuberculosis
YRYLQDYDL

SEQ ID NO: 19564 - protein, 9 aa, Mycobacterium tuberculosis
RYLQDYDLG

SEQ ID NO: 19565 - protein, 9 aa, Mycobacterium tuberculosis
YLQDYDLGK

SEQ ID NO: 19566 - protein, 9 aa, Mycobacterium tuberculosis
LQDYDLGKP

SEQ ID NO: 19567 - protein, 9 aa, Mycobacterium tuberculosis
QDYDLGKPT

SEQ ID NO: 19568 - protein, 9 aa, Mycobacterium tuberculosis
DYDLGKPTP

SEQ ID NO: 19569 - protein, 9 aa, Mycobacterium tuberculosis
YDLGKPTPE

SEQ ID NO: 19570 - protein, 9 aa, Mycobacterium tuberculosis
DLGKPTPEP

SEQ ID NO: 19571 - protein, 9 aa, Mycobacterium tuberculosis
LGKPTPEPR

SEQ ID NO: 19572 - protein, 9 aa, Mycobacterium tuberculosis
GKPTPEPRL

SEQ ID NO: 19573 - protein, 9 aa, Mycobacterium tuberculosis
KPTPEPRLR

SEQ ID NO: 19574 - protein, 9 aa, Mycobacterium tuberculosis
PTPEPRLRS

SEQ ID NO: 19575 - protein, 9 aa, Mycobacterium tuberculosis
TPEPRLRSM

SEQ ID NO: 19576 - protein, 9 aa, Mycobacterium tuberculosis
PEPRLRSME

SEQ ID NO: 19577 - protein, 9 aa, Mycobacterium tuberculosis
EPRLRSMEL

SEQ ID NO: 19578 - protein, 9 aa, Mycobacterium tuberculosis
PRLRSMELG

SEQ ID NO: 19579 - protein, 9 aa, Mycobacterium tuberculosis
RLRSMELGP

SEQ ID NO: 19580 - protein, 9 aa, Mycobacterium tuberculosis
LRSMELGPR

SEQ ID NO: 19581 - protein, 9 aa, Mycobacterium tuberculosis
RSMELGPRD

SEQ ID NO: 19582 - protein, 9 aa, Mycobacterium tuberculosis
SMELGPRDR

SEQ ID NO: 19583 - protein, 9 aa, Mycobacterium tuberculosis
MELGPRDRL

SEQ ID NO: 19584 - protein, 9 aa, Mycobacterium tuberculosis
ELGPRDRLS

SEQ ID NO: 19585 - protein, 9 aa, Mycobacterium tuberculosis
LGPRDRLSQ

SEQ ID NO: 19586 - protein, 9 aa, Mycobacterium tuberculosis
GPRDRLSQA

SEQ ID NO: 19587 - protein, 9 aa, Mycobacterium tuberculosis
PRDRLSQAF

SEQ ID NO: 19588 - protein, 9 aa, Mycobacterium tuberculosis
RDRLSQAFV

SEQ ID NO: 19589 - protein, 9 aa, Mycobacterium tuberculosis
DRLSQAFVH

SEQ ID NO: 19590 - protein, 9 aa, Mycobacterium tuberculosis
RLSQAFVHE

SEQ ID NO: 19591 - protein, 9 aa, Mycobacterium tuberculosis
LSQAFVHEH

SEQ ID NO: 19592 - protein, 9 aa, Mycobacterium tuberculosis
SQAFVHEHN

SEQ ID NO: 19593 - protein, 9 aa, Mycobacterium tuberculosis
QAFVHEHNK

SEQ ID NO: 19594 - protein, 9 aa, Mycobacterium tuberculosis
AFVHEHNKG

SEQ ID NO: 19595 - protein, 9 aa, Mycobacterium tuberculosis
FVHEHNKGR

SEQ ID NO: 19596 - protein, 9 aa, Mycobacterium tuberculosis
VHEHNKGRT

SEQ ID NO: 19597 - protein, 9 aa, Mycobacterium tuberculosis
HEHNKGRTV

SEQ ID NO: 19598 - protein, 9 aa, Mycobacterium tuberculosis
EHNKGRTVD

SEQ ID NO: 19599 - protein, 9 aa, Mycobacterium tuberculosis
HNKGRTVDT

SEQ ID NO: 19600 - protein, 9 aa, Mycobacterium tuberculosis
NKGRTVDTP

SEQ ID NO: 19601 - protein, 9 aa, Mycobacterium tuberculosis
KGRTVDTPY

SEQ ID NO: 19602 - protein, 9 aa, Mycobacterium tuberculosis
GRTVDTPYG

SEQ ID NO: 19603 - protein, 9 aa, Mycobacterium tuberculosis
RTVDTPYGP

SEQ ID NO: 19604 - protein, 9 aa, Mycobacterium tuberculosis
TVDTPYGPV

SEQ ID NO: 19605 - protein, 9 aa, Mycobacterium tuberculosis
VDTPYGPVV

SEQ ID NO: 19606 - protein, 9 aa, Mycobacterium tuberculosis
DTPYGPVVY

SEQ ID NO: 19607 - protein, 9 aa, Mycobacterium tuberculosis
TPYGPVVYL

SEQ ID NO: 19608 - protein, 9 aa, Mycobacterium tuberculosis
PYGPVVYLD

SEQ ID NO: 19609 - protein, 9 aa, Mycobacterium tuberculosis
YGPVVYLDL

SEQ ID NO: 19610 - protein, 9 aa, Mycobacterium tuberculosis
GPVVYLDLR

SEQ ID NO: 19611 - protein, 9 aa, Mycobacterium tuberculosis
PVVYLDLRH

SEQ ID NO: 19612 - protein, 9 aa, Mycobacterium tuberculosis
VVYLDLRHL

SEQ ID NO: 19613 - protein, 9 aa, Mycobacterium tuberculosis
VYLDLRHLG

SEQ ID NO: 19614 - protein, 9 aa, Mycobacterium tuberculosis
YLDLRHLGA

SEQ ID NO: 19615 - protein, 9 aa, Mycobacterium tuberculosis
LDLRHLGAD

SEQ ID NO: 19616 - protein, 9 aa, Mycobacterium tuberculosis
DLRHLGADL

SEQ ID NO: 19617 - protein, 9 aa, Mycobacterium tuberculosis
LRHLGADLI

SEQ ID NO: 19618 - protein, 9 aa, Mycobacterium tuberculosis
RHLGADLID

SEQ ID NO: 19619 - protein, 9 aa, Mycobacterium tuberculosis
HLGADLIDA

SEQ ID NO: 19620 - protein, 9 aa, Mycobacterium tuberculosis
LGADLIDAK

SEQ ID NO: 19621 - protein, 9 aa, Mycobacterium tuberculosis
GADLIDAKL

SEQ ID NO: 19622 - protein, 9 aa, Mycobacterium tuberculosis
ADLIDAKLP

SEQ ID NO: 19623 - protein, 9 aa, Mycobacterium tuberculosis
DLIDAKLPF

SEQ ID NO: 19624 - protein, 9 aa, Mycobacterium tuberculosis
LIDAKLPFV

SEQ ID NO: 19625 - protein, 9 aa, Mycobacterium tuberculosis
IDAKLPFVR

SEQ ID NO: 19626 - protein, 9 aa, Mycobacterium tuberculosis
DAKLPFVRE

SEQ ID NO: 19627 - protein, 9 aa, Mycobacterium tuberculosis
AKLPFVREL

SEQ ID NO: 19628 - protein, 9 aa, Mycobacterium tuberculosis
KLPFVRELC

SEQ ID NO: 19629 - protein, 9 aa, Mycobacterium tuberculosis
LPFVRELCR

SEQ ID NO: 19630 - protein, 9 aa, Mycobacterium tuberculosis
PFVRELCRD

SEQ ID NO: 19631 - protein, 9 aa, Mycobacterium tuberculosis
FVRELCRDY

SEQ ID NO: 19632 - protein, 9 aa, Mycobacterium tuberculosis
VRELCRDYQ

SEQ ID NO: 19633 - protein, 9 aa, Mycobacterium tuberculosis
RELCRDYQH

SEQ ID NO: 19634 - protein, 9 aa, Mycobacterium tuberculosis
ELCRDYQHI

SEQ ID NO: 19635 - protein, 9 aa, Mycobacterium tuberculosis
LCRDYQHID

SEQ ID NO: 19636 - protein, 9 aa, Mycobacterium tuberculosis
CRDYQHIDP

SEQ ID NO: 19637 - protein, 9 aa, Mycobacterium tuberculosis
RDYQHIDPV

SEQ ID NO: 19638 - protein, 9 aa, Mycobacterium tuberculosis
DYQHIDPVV

SEQ ID NO: 19639 - protein, 9 aa, Mycobacterium tuberculosis
YQHIDPVVE

SEQ ID NO: 19640 - protein, 9 aa, Mycobacterium tuberculosis
QHIDPVVEL

SEQ ID NO: 19641 - protein, 9 aa, Mycobacterium tuberculosis
HIDPVVELV

SEQ ID NO: 19642 - protein, 9 aa, Mycobacterium tuberculosis
IDPVVELVP

SEQ ID NO: 19643 - protein, 9 aa, Mycobacterium tuberculosis
DPVVELVPV

SEQ ID NO: 19644 - protein, 9 aa, Mycobacterium tuberculosis
PVVELVPVR

SEQ ID NO: 19645 - protein, 9 aa, Mycobacterium tuberculosis
VVELVPVRP

SEQ ID NO: 19646 - protein, 9 aa, Mycobacterium tuberculosis
VELVPVRPV

SEQ ID NO: 19647 - protein, 9 aa, Mycobacterium tuberculosis
ELVPVRPVV

SEQ ID NO: 19648 - protein, 9 aa, Mycobacterium tuberculosis
LVPVRPVVH

SEQ ID NO: 19649 - protein, 9 aa, Mycobacterium tuberculosis
VPVRPVVHY

SEQ ID NO: 19650 - protein, 9 aa, Mycobacterium tuberculosis
PVRPVVHYM

SEQ ID NO: 19651 - protein, 9 aa, Mycobacterium tuberculosis
VRPVVHYMM

SEQ ID NO: 19652 - protein, 9 aa, Mycobacterium tuberculosis
RPVVHYMMG

SEQ ID NO: 19653 - protein, 9 aa, Mycobacterium tuberculosis
PVVHYMMGG

SEQ ID NO: 19654 - protein, 9 aa, Mycobacterium tuberculosis
VVHYMMGGV

SEQ ID NO: 19655 - protein, 9 aa, Mycobacterium tuberculosis
VHYMMGGVH

SEQ ID NO: 19656 - protein, 9 aa, Mycobacterium tuberculosis
HYMMGGVHT

SEQ ID NO: 19657 - protein, 9 aa, Mycobacterium tuberculosis
YMMGGVHTD

SEQ ID NO: 19658 - protein, 9 aa, Mycobacterium tuberculosis
MMGGVHTDI

SEQ ID NO: 19659 - protein, 9 aa, Mycobacterium tuberculosis
MGGVHTDIN

SEQ ID NO: 19660 - protein, 9 aa, Mycobacterium tuberculosis
GGVHTDING

SEQ ID NO: 19661 - protein, 9 aa, Mycobacterium tuberculosis
GVHTDINGA

SEQ ID NO: 19662 - protein, 9 aa, Mycobacterium tuberculosis
VHTDINGAT

SEQ ID NO: 19663 - protein, 9 aa, Mycobacterium tuberculosis
HTDINGATT

SEQ ID NO: 19664 - protein, 9 aa, Mycobacterium tuberculosis
TDINGATTL

SEQ ID NO: 19665 - protein, 9 aa, Mycobacterium tuberculosis
DINGATTLP

SEQ ID NO: 19666 - protein, 9 aa, Mycobacterium tuberculosis
INGATTLPG

SEQ ID NO: 19667 - protein, 9 aa, Mycobacterium tuberculosis
NGATTLPGL

SEQ ID NO: 19668 - protein, 9 aa, Mycobacterium tuberculosis
GATTLPGLY

SEQ ID NO: 19669 - protein, 9 aa, Mycobacterium tuberculosis
ATTLPGLYA

SEQ ID NO: 19670 - protein, 9 aa, Mycobacterium tuberculosis
TTLPGLYAA

SEQ ID NO: 19671 - protein, 9 aa, Mycobacterium tuberculosis
TLPGLYAAG

SEQ ID NO: 19672 - protein, 9 aa, Mycobacterium tuberculosis
LPGLYAAGE

SEQ ID NO: 19673 - protein, 9 aa, Mycobacterium tuberculosis
PGLYAAGET

SEQ ID NO: 19674 - protein, 9 aa, Mycobacterium tuberculosis
GLYAAGETA

SEQ ID NO: 19675 - protein, 9 aa, Mycobacterium tuberculosis
LYAAGETAC

SEQ ID NO: 19676 - protein, 9 aa, Mycobacterium tuberculosis
YAAGETACV

SEQ ID NO: 19677 - protein, 9 aa, Mycobacterium tuberculosis
AAGETACVS

SEQ ID NO: 19678 - protein, 9 aa, Mycobacterium tuberculosis
AGETACVSI

SEQ ID NO: 19679 - protein, 9 aa, Mycobacterium tuberculosis
GETACVSIN

SEQ ID NO: 19680 - protein, 9 aa, Mycobacterium tuberculosis
ETACVSING

SEQ ID NO: 19681 - protein, 9 aa, Mycobacterium tuberculosis
TACVSINGA

SEQ ID NO: 19682 - protein, 9 aa, Mycobacterium tuberculosis
ACVSINGAN

SEQ ID NO: 19683 - protein, 9 aa, Mycobacterium tuberculosis
CVSINGANR

SEQ ID NO: 19684 - protein, 9 aa, Mycobacterium tuberculosis
VSINGANRL

SEQ ID NO: 19685 - protein, 9 aa, Mycobacterium tuberculosis
SINGANRLG

SEQ ID NO: 19686 - protein, 9 aa, Mycobacterium tuberculosis
INGANRLGS

SEQ ID NO: 19687 - protein, 9 aa, Mycobacterium tuberculosis
NGANRLGSN

SEQ ID NO: 19688 - protein, 9 aa, Mycobacterium tuberculosis
GANRLGSNS

SEQ ID NO: 19689 - protein, 9 aa, Mycobacterium tuberculosis
ANRLGSNSL

SEQ ID NO: 19690 - protein, 9 aa, Mycobacterium tuberculosis
NRLGSNSLP

SEQ ID NO: 19691 - protein, 9 aa, Mycobacterium tuberculosis
RLGSNSLPE

SEQ ID NO: 19692 - protein, 9 aa, Mycobacterium tuberculosis
LGSNSLPEL

SEQ ID NO: 19693 - protein, 9 aa, Mycobacterium tuberculosis
GSNSLPELL

SEQ ID NO: 19694 - protein, 9 aa, Mycobacterium tuberculosis
SNSLPELLV

SEQ ID NO: 19695 - protein, 9 aa, Mycobacterium tuberculosis
NSLPELLVF

SEQ ID NO: 19696 - protein, 9 aa, Mycobacterium tuberculosis
SLPELLVFG

SEQ ID NO: 19697 - protein, 9 aa, Mycobacterium tuberculosis
LPELLVFGA

SEQ ID NO: 19698 - protein, 9 aa, Mycobacterium tuberculosis
PELLVFGAR

SEQ ID NO: 19699 - protein, 9 aa, Mycobacterium tuberculosis
ELLVFGARA

SEQ ID NO: 19700 - protein, 9 aa, Mycobacterium tuberculosis
LLVFGARAG

SEQ ID NO: 19701 - protein, 9 aa, Mycobacterium tuberculosis
LVFGARAGR

SEQ ID NO: 19702 - protein, 9 aa, Mycobacterium tuberculosis
VFGARAGRA

SEQ ID NO: 19703 - protein, 9 aa, Mycobacterium tuberculosis
FGARAGRAA

SEQ ID NO: 19704 - protein, 9 aa, Mycobacterium tuberculosis
GARAGRAAA

SEQ ID NO: 19705 - protein, 9 aa, Mycobacterium tuberculosis
ARAGRAAAD

SEQ ID NO: 19706 - protein, 9 aa, Mycobacterium tuberculosis
RAGRAAADY

SEQ ID NO: 19707 - protein, 9 aa, Mycobacterium tuberculosis
AGRAAADYA

SEQ ID NO: 19708 - protein, 9 aa, Mycobacterium tuberculosis
GRAAADYAA

SEQ ID NO: 19709 - protein, 9 aa, Mycobacterium tuberculosis
RAAADYAAR

SEQ ID NO: 19710 - protein, 9 aa, Mycobacterium tuberculosis
AAADYAARH

SEQ ID NO: 19711 - protein, 9 aa, Mycobacterium tuberculosis
AADYAARHQ

SEQ ID NO: 19712 - protein, 9 aa, Mycobacterium tuberculosis
ADYAARHQK

SEQ ID NO: 19713 - protein, 9 aa, Mycobacterium tuberculosis
DYAARHQKS

SEQ ID NO: 19714 - protein, 9 aa, Mycobacterium tuberculosis
YAARHQKSD

SEQ ID NO: 19715 - protein, 9 aa, Mycobacterium tuberculosis
AARHQKSDR

SEQ ID NO: 19716 - protein, 9 aa, Mycobacterium tuberculosis
ARHQKSDRG

SEQ ID NO: 19717 - protein, 9 aa, Mycobacterium tuberculosis
RHQKSDRGP

SEQ ID NO: 19718 - protein, 9 aa, Mycobacterium tuberculosis
HQKSDRGPS

SEQ ID NO: 19719 - protein, 9 aa, Mycobacterium tuberculosis
QKSDRGPSS

SEQ ID NO: 19720 - protein, 9 aa, Mycobacterium tuberculosis
KSDRGPSSA

SEQ ID NO: 19721 - protein, 9 aa, Mycobacterium tuberculosis
SDRGPSSAV

SEQ ID NO: 19722 - protein, 9 aa, Mycobacterium tuberculosis
DRGPSSAVR

SEQ ID NO: 19723 - protein, 9 aa, Mycobacterium tuberculosis
RGPSSAVRA

SEQ ID NO: 19724 - protein, 9 aa, Mycobacterium tuberculosis
GPSSAVRAQ

SEQ ID NO: 19725 - protein, 9 aa, Mycobacterium tuberculosis
PSSAVRAQA

SEQ ID NO: 19726 - protein, 9 aa, Mycobacterium tuberculosis
SSAVRAQAR

SEQ ID NO: 19727 - protein, 9 aa, Mycobacterium tuberculosis
SAVRAQART

SEQ ID NO: 19728 - protein, 9 aa, Mycobacterium tuberculosis
AVRAQARTE

SEQ ID NO: 19729 - protein, 9 aa, Mycobacterium tuberculosis
VRAQARTEA

SEQ ID NO: 19730 - protein, 9 aa, Mycobacterium tuberculosis
RAQARTEAL

SEQ ID NO: 19731 - protein, 9 aa, Mycobacterium tuberculosis
AQARTEALR

SEQ ID NO: 19732 - protein, 9 aa, Mycobacterium tuberculosis
QARTEALRL

SEQ ID NO: 19733 - protein, 9 aa, Mycobacterium tuberculosis
ARTEALRLE

SEQ ID NO: 19734 - protein, 9 aa, Mycobacterium tuberculosis
RTEALRLER

SEQ ID NO: 19735 - protein, 9 aa, Mycobacterium tuberculosis
TEALRLERE

SEQ ID NO: 19736 - protein, 9 aa, Mycobacterium tuberculosis
EALRLEREL

SEQ ID NO: 19737 - protein, 9 aa, Mycobacterium tuberculosis
ALRLERELS

SEQ ID NO: 19738 - protein, 9 aa, Mycobacterium tuberculosis
LRLERELSR

SEQ ID NO: 19739 - protein, 9 aa, Mycobacterium tuberculosis
RLERELSRH

SEQ ID NO: 19740 - protein, 9 aa, Mycobacterium tuberculosis
LERELSRHG

SEQ ID NO: 19741 - protein, 9 aa, Mycobacterium tuberculosis
ERELSRHGQ

SEQ ID NO: 19742 - protein, 9 aa, Mycobacterium tuberculosis
RELSRHGQG

SEQ ID NO: 19743 - protein, 9 aa, Mycobacterium tuberculosis
ELSRHGQGG

SEQ ID NO: 19744 - protein, 9 aa, Mycobacterium tuberculosis
LSRHGQGGE

SEQ ID NO: 19745 - protein, 9 aa, Mycobacterium tuberculosis
SRHGQGGER

SEQ ID NO: 19746 - protein, 9 aa, Mycobacterium tuberculosis
RHGQGGERI

SEQ ID NO: 19747 - protein, 9 aa, Mycobacterium tuberculosis
HGQGGERIA

SEQ ID NO: 19748 - protein, 9 aa, Mycobacterium tuberculosis
GQGGERIAD

SEQ ID NO: 19749 - protein, 9 aa, Mycobacterium tuberculosis
QGGERIADI

SEQ ID NO: 19750 - protein, 9 aa, Mycobacterium tuberculosis
GGERIADIR

SEQ ID NO: 19751 - protein, 9 aa, Mycobacterium tuberculosis
GERIADIRA

SEQ ID NO: 19752 - protein, 9 aa, Mycobacterium tuberculosis
ERIADIRAD

SEQ ID NO: 19753 - protein, 9 aa, Mycobacterium tuberculosis
RIADIRADM

SEQ ID NO: 19754 - protein, 9 aa, Mycobacterium tuberculosis
IADIRADMQ

SEQ ID NO: 19755 - protein, 9 aa, Mycobacterium tuberculosis
ADIRADMQA

SEQ ID NO: 19756 - protein, 9 aa, Mycobacterium tuberculosis
DIRADMQAT

SEQ ID NO: 19757 - protein, 9 aa, Mycobacterium tuberculosis
IRADMQATL

SEQ ID NO: 19758 - protein, 9 aa, Mycobacterium tuberculosis
RADMQATLE

SEQ ID NO: 19759 - protein, 9 aa, Mycobacterium tuberculosis
ADMQATLES

SEQ ID NO: 19760 - protein, 9 aa, Mycobacterium tuberculosis
DMQATLESA

SEQ ID NO: 19761 - protein, 9 aa, Mycobacterium tuberculosis
MQATLESAA

SEQ ID NO: 19762 - protein, 9 aa, Mycobacterium tuberculosis
QATLESAAG

SEQ ID NO: 19763 - protein, 9 aa, Mycobacterium tuberculosis
ATLESAAGI

SEQ ID NO: 19764 - protein, 9 aa, Mycobacterium tuberculosis
TLESAAGIY

SEQ ID NO: 19765 - protein, 9 aa, Mycobacterium tuberculosis
LESAAGIYR

SEQ ID NO: 19766 - protein, 9 aa, Mycobacterium tuberculosis
ESAAGIYRD

SEQ ID NO: 19767 - protein, 9 aa, Mycobacterium tuberculosis
SAAGIYRDG

SEQ ID NO: 19768 - protein, 9 aa, Mycobacterium tuberculosis
AAGIYRDGP

SEQ ID NO: 19769 - protein, 9 aa, Mycobacterium tuberculosis
AGIYRDGPT

SEQ ID NO: 19770 - protein, 9 aa, Mycobacterium tuberculosis
GIYRDGPTL

SEQ ID NO: 19771 - protein, 9 aa, Mycobacterium tuberculosis
IYRDGPTLT

SEQ ID NO: 19772 - protein, 9 aa, Mycobacterium tuberculosis
YRDGPTLTK

SEQ ID NO: 19773 - protein, 9 aa, Mycobacterium tuberculosis
RDGPTLTKA

SEQ ID NO: 19774 - protein, 9 aa, Mycobacterium tuberculosis
DGPTLTKAV

SEQ ID NO: 19775 - protein, 9 aa, Mycobacterium tuberculosis
GPTLTKAVE

SEQ ID NO: 19776 - protein, 9 aa, Mycobacterium tuberculosis
PTLTKAVEE

SEQ ID NO: 19777 - protein, 9 aa, Mycobacterium tuberculosis
TLTKAVEEI

SEQ ID NO: 19778 - protein, 9 aa, Mycobacterium tuberculosis
LTKAVEEIR

SEQ ID NO: 19779 - protein, 9 aa, Mycobacterium tuberculosis
TKAVEEIRV

SEQ ID NO: 19780 - protein, 9 aa, Mycobacterium tuberculosis
KAVEEIRVL

SEQ ID NO: 19781 - protein, 9 aa, Mycobacterium tuberculosis
AVEEIRVLQ

SEQ ID NO: 19782 - protein, 9 aa, Mycobacterium tuberculosis
VEEIRVLQE

SEQ ID NO: 19783 - protein, 9 aa, Mycobacterium tuberculosis
EEIRVLQER

SEQ ID NO: 19784 - protein, 9 aa, Mycobacterium tuberculosis
EIRVLQERF

SEQ ID NO: 19785 - protein, 9 aa, Mycobacterium tuberculosis
IRVLQERFA

SEQ ID NO: 19786 - protein, 9 aa, Mycobacterium tuberculosis
RVLQERFAT

SEQ ID NO: 19787 - protein, 9 aa, Mycobacterium tuberculosis
VLQERFATA

SEQ ID NO: 19788 - protein, 9 aa, Mycobacterium tuberculosis
LQERFATAG

SEQ ID NO: 19789 - protein, 9 aa, Mycobacterium tuberculosis
QERFATAGI

SEQ ID NO: 19790 - protein, 9 aa, Mycobacterium tuberculosis
ERFATAGID

SEQ ID NO: 19791 - protein, 9 aa, Mycobacterium tuberculosis
RFATAGIDD

SEQ ID NO: 19792 - protein, 9 aa, Mycobacterium tuberculosis
FATAGIDDH

SEQ ID NO: 19793 - protein, 9 aa, Mycobacterium tuberculosis
ATAGIDDHS

SEQ ID NO: 19794 - protein, 9 aa, Mycobacterium tuberculosis
TAGIDDHSR

SEQ ID NO: 19795 - protein, 9 aa, Mycobacterium tuberculosis
AGIDDHSRT

SEQ ID NO: 19796 - protein, 9 aa, Mycobacterium tuberculosis
GIDDHSRTF

SEQ ID NO: 19797 - protein, 9 aa, Mycobacterium tuberculosis
IDDHSRTFN

SEQ ID NO: 19798 - protein, 9 aa, Mycobacterium tuberculosis
DDHSRTFNT

SEQ ID NO: 19799 - protein, 9 aa, Mycobacterium tuberculosis
DHSRTFNTE

SEQ ID NO: 19800 - protein, 9 aa, Mycobacterium tuberculosis
HSRTFNTEL

SEQ ID NO: 19801 - protein, 9 aa, Mycobacterium tuberculosis
SRTFNTELT

SEQ ID NO: 19802 - protein, 9 aa, Mycobacterium tuberculosis
RTFNTELTA

SEQ ID NO: 19803 - protein, 9 aa, Mycobacterium tuberculosis
TFNTELTAL

SEQ ID NO: 19804 - protein, 9 aa, Mycobacterium tuberculosis
FNTELTALL

SEQ ID NO: 19805 - protein, 9 aa, Mycobacterium tuberculosis
NTELTALLE

SEQ ID NO: 19806 - protein, 9 aa, Mycobacterium tuberculosis
TELTALLEL

SEQ ID NO: 19807 - protein, 9 aa, Mycobacterium tuberculosis
ELTALLELS

SEQ ID NO: 19808 - protein, 9 aa, Mycobacterium tuberculosis
LTALLELSG

SEQ ID NO: 19809 - protein, 9 aa, Mycobacterium tuberculosis
TALLELSGM

SEQ ID NO: 19810 - protein, 9 aa, Mycobacterium tuberculosis
ALLELSGML

SEQ ID NO: 19811 - protein, 9 aa, Mycobacterium tuberculosis
LLELSGMLD

SEQ ID NO: 19812 - protein, 9 aa, Mycobacterium tuberculosis
LELSGMLDV

SEQ ID NO: 19813 - protein, 9 aa, Mycobacterium tuberculosis
ELSGMLDVA

SEQ ID NO: 19814 - protein, 9 aa, Mycobacterium tuberculosis
LSGMLDVAL

SEQ ID NO: 19815 - protein, 9 aa, Mycobacterium tuberculosis
SGMLDVALA

SEQ ID NO: 19816 - protein, 9 aa, Mycobacterium tuberculosis
GMLDVALAI

SEQ ID NO: 19817 - protein, 9 aa, Mycobacterium tuberculosis
MLDVALAIV

SEQ ID NO: 19818 - protein, 9 aa, Mycobacterium tuberculosis
LDVALAIVE

SEQ ID NO: 19819 - protein, 9 aa, Mycobacterium tuberculosis
DVALAIVES

SEQ ID NO: 19820 - protein, 9 aa, Mycobacterium tuberculosis
VALAIVESG

SEQ ID NO: 19821 - protein, 9 aa, Mycobacterium tuberculosis
ALAIVESGL

SEQ ID NO: 19822 - protein, 9 aa, Mycobacterium tuberculosis
LAIVESGLR

SEQ ID NO: 19823 - protein, 9 aa, Mycobacterium tuberculosis
AIVESGLRR

SEQ ID NO: 19824 - protein, 9 aa, Mycobacterium tuberculosis
IVESGLRRE

SEQ ID NO: 19825 - protein, 9 aa, Mycobacterium tuberculosis
VESGLRREE

SEQ ID NO: 19826 - protein, 9 aa, Mycobacterium tuberculosis
ESGLRREES

SEQ ID NO: 19827 - protein, 9 aa, Mycobacterium tuberculosis
SGLRREESR

SEQ ID NO: 19828 - protein, 9 aa, Mycobacterium tuberculosis
GLRREESRG

SEQ ID NO: 19829 - protein, 9 aa, Mycobacterium tuberculosis
LRREESRGA

SEQ ID NO: 19830 - protein, 9 aa, Mycobacterium tuberculosis
RREESRGAH

SEQ ID NO: 19831 - protein, 9 aa, Mycobacterium tuberculosis
REESRGAHQ

SEQ ID NO: 19832 - protein, 9 aa, Mycobacterium tuberculosis
EESRGAHQR

SEQ ID NO: 19833 - protein, 9 aa, Mycobacterium tuberculosis
ESRGAHQRT

SEQ ID NO: 19834 - protein, 9 aa, Mycobacterium tuberculosis
SRGAHQRTD

SEQ ID NO: 19835 - protein, 9 aa, Mycobacterium tuberculosis
RGAHQRTDF

SEQ ID NO: 19836 - protein, 9 aa, Mycobacterium tuberculosis
GAHQRTDFP

SEQ ID NO: 19837 - protein, 9 aa, Mycobacterium tuberculosis
AHQRTDFPN

SEQ ID NO: 19838 - protein, 9 aa, Mycobacterium tuberculosis
HQRTDFPNR

SEQ ID NO: 19839 - protein, 9 aa, Mycobacterium tuberculosis
QRTDFPNRD

SEQ ID NO: 19840 - protein, 9 aa, Mycobacterium tuberculosis
RTDFPNRDD

SEQ ID NO: 19841 - protein, 9 aa, Mycobacterium tuberculosis
TDFPNRDDE

SEQ ID NO: 19842 - protein, 9 aa, Mycobacterium tuberculosis
DFPNRDDEH

SEQ ID NO: 19843 - protein, 9 aa, Mycobacterium tuberculosis
FPNRDDEHF

SEQ ID NO: 19844 - protein, 9 aa, Mycobacterium tuberculosis
PNRDDEHFL

SEQ ID NO: 19845 - protein, 9 aa, Mycobacterium tuberculosis
NRDDEHFLA

SEQ ID NO: 19846 - protein, 9 aa, Mycobacterium tuberculosis
RDDEHFLAH

SEQ ID NO: 19847 - protein, 9 aa, Mycobacterium tuberculosis
DDEHFLAHT

SEQ ID NO: 19848 - protein, 9 aa, Mycobacterium tuberculosis
DEHFLAHTL

SEQ ID NO: 19849 - protein, 9 aa, Mycobacterium tuberculosis
EHFLAHTLV

SEQ ID NO: 19850 - protein, 9 aa, Mycobacterium tuberculosis
HFLAHTLVH

SEQ ID NO: 19851 - protein, 9 aa, Mycobacterium tuberculosis
FLAHTLVHR

SEQ ID NO: 19852 - protein, 9 aa, Mycobacterium tuberculosis
LAHTLVHRE

SEQ ID NO: 19853 - protein, 9 aa, Mycobacterium tuberculosis
AHTLVHRES

SEQ ID NO: 19854 - protein, 9 aa, Mycobacterium tuberculosis
HTLVHRESD

SEQ ID NO: 19855 - protein, 9 aa, Mycobacterium tuberculosis
TLVHRESDG

SEQ ID NO: 19856 - protein, 9 aa, Mycobacterium tuberculosis
LVHRESDGT

SEQ ID NO: 19857 - protein, 9 aa, Mycobacterium tuberculosis
VHRESDGTL

SEQ ID NO: 19858 - protein, 9 aa, Mycobacterium tuberculosis
HRESDGTLR

SEQ ID NO: 19859 - protein, 9 aa, Mycobacterium tuberculosis
RESDGTLRV

SEQ ID NO: 19860 - protein, 9 aa, Mycobacterium tuberculosis
ESDGTLRVG

SEQ ID NO: 19861 - protein, 9 aa, Mycobacterium tuberculosis
SDGTLRVGY

SEQ ID NO: 19862 - protein, 9 aa, Mycobacterium tuberculosis
DGTLRVGYL

SEQ ID NO: 19863 - protein, 9 aa, Mycobacterium tuberculosis
GTLRVGYLP

SEQ ID NO: 19864 - protein, 9 aa, Mycobacterium tuberculosis
TLRVGYLPV

SEQ ID NO: 19865 - protein, 9 aa, Mycobacterium tuberculosis
LRVGYLPVT

SEQ ID NO: 19866 - protein, 9 aa, Mycobacterium tuberculosis
RVGYLPVTI

SEQ ID NO: 19867 - protein, 9 aa, Mycobacterium tuberculosis
VGYLPVTIT

SEQ ID NO: 19868 - protein, 9 aa, Mycobacterium tuberculosis
GYLPVTITR

SEQ ID NO: 19869 - protein, 9 aa, Mycobacterium tuberculosis
YLPVTITRW

SEQ ID NO: 19870 - protein, 9 aa, Mycobacterium tuberculosis
LPVTITRWP

SEQ ID NO: 19871 - protein, 9 aa, Mycobacterium tuberculosis
PVTITRWPP

SEQ ID NO: 19872 - protein, 9 aa, Mycobacterium tuberculosis
VTITRWPPG

SEQ ID NO: 19873 - protein, 9 aa, Mycobacterium tuberculosis
TITRWPPGE

SEQ ID NO: 19874 - protein, 9 aa, Mycobacterium tuberculosis
ITRWPPGER

SEQ ID NO: 19875 - protein, 9 aa, Mycobacterium tuberculosis
TRWPPGERV

SEQ ID NO: 19876 - protein, 9 aa, Mycobacterium tuberculosis
RWPPGERVY

SEQ ID NO: 19877 - protein, 9 aa, Mycobacterium tuberculosis
WPPGERVYG

SEQ ID NO: 19878 - protein, 9 aa, Mycobacterium tuberculosis
PPGERVYGR

SEQ ID NO: 19879 - protein, 10 aa, Mycobacterium tuberculosis
MTAQHNIVVI

SEQ ID NO: 19880 - protein, 10 aa, Mycobacterium tuberculosis
TAQHNIVVIG

SEQ ID NO: 19881 - protein, 10 aa, Mycobacterium tuberculosis
AQHNIVVIGG

SEQ ID NO: 19882 - protein, 10 aa, Mycobacterium tuberculosis
QHNIVVIGGG

SEQ ID NO: 19883 - protein, 10 aa, Mycobacterium tuberculosis
HNIVVIGGGG

SEQ ID NO: 19884 - protein, 10 aa, Mycobacterium tuberculosis
NIVVIGGGGA

SEQ ID NO: 19885 - protein, 10 aa, Mycobacterium tuberculosis
IVVIGGGGAG

SEQ ID NO: 19886 - protein, 10 aa, Mycobacterium tuberculosis
VVIGGGGAGL

SEQ ID NO: 19887 - protein, 10 aa, Mycobacterium tuberculosis
VIGGGGAGLR

SEQ ID NO: 19888 - protein, 10 aa, Mycobacterium tuberculosis
IGGGGAGLRA

SEQ ID NO: 19889 - protein, 10 aa, Mycobacterium tuberculosis
GGGGAGLRAA

SEQ ID NO: 19890 - protein, 10 aa, Mycobacterium tuberculosis
GGGAGLRAAI

SEQ ID NO: 19891 - protein, 10 aa, Mycobacterium tuberculosis
GGAGLRAAIA

SEQ ID NO: 19892 - protein, 10 aa, Mycobacterium tuberculosis
GAGLRAAIAI

SEQ ID NO: 19893 - protein, 10 aa, Mycobacterium tuberculosis
AGLRAAIAIA

SEQ ID NO: 19894 - protein, 10 aa, Mycobacterium tuberculosis
GLRAAIAIAE

SEQ ID NO: 19895 - protein, 10 aa, Mycobacterium tuberculosis
LRAAIAIAET

SEQ ID NO: 19896 - protein, 10 aa, Mycobacterium tuberculosis
RAAIAIAETN

SEQ ID NO: 19897 - protein, 10 aa, Mycobacterium tuberculosis
AAIAIAETNP

SEQ ID NO: 19898 - protein, 10 aa, Mycobacterium tuberculosis
AIAIAETNPH

SEQ ID NO: 19899 - protein, 10 aa, Mycobacterium tuberculosis
IAIAETNPHL

SEQ ID NO: 19900 - protein, 10 aa, Mycobacterium tuberculosis
AIAETNPHLD

SEQ ID NO: 19901 - protein, 10 aa, Mycobacterium tuberculosis
IAETNPHLDV

SEQ ID NO: 19902 - protein, 10 aa, Mycobacterium tuberculosis
AETNPHLDVA

SEQ ID NO: 19903 - protein, 10 aa, Mycobacterium tuberculosis
ETNPHLDVAI

SEQ ID NO: 19904 - protein, 10 aa, Mycobacterium tuberculosis
TNPHLDVAIV

SEQ ID NO: 19905 - protein, 10 aa, Mycobacterium tuberculosis
NPHLDVAIVS

SEQ ID NO: 19906 - protein, 10 aa, Mycobacterium tuberculosis
PHLDVAIVSK

SEQ ID NO: 19907 - protein, 10 aa, Mycobacterium tuberculosis
HLDVAIVSKV

SEQ ID NO: 19908 - protein, 10 aa, Mycobacterium tuberculosis
LDVAIVSKVY

SEQ ID NO: 19909 - protein, 10 aa, Mycobacterium tuberculosis
DVAIVSKVYP

SEQ ID NO: 19910 - protein, 10 aa, Mycobacterium tuberculosis
VAIVSKVYPM

SEQ ID NO: 19911 - protein, 10 aa, Mycobacterium tuberculosis
AIVSKVYPMR

SEQ ID NO: 19912 - protein, 10 aa, Mycobacterium tuberculosis
IVSKVYPMRS

SEQ ID NO: 19913 - protein, 10 aa, Mycobacterium tuberculosis
VSKVYPMRSH

SEQ ID NO: 19914 - protein, 10 aa, Mycobacterium tuberculosis
SKVYPMRSHT

SEQ ID NO: 19915 - protein, 10 aa, Mycobacterium tuberculosis
KVYPMRSHTV

SEQ ID NO: 19916 - protein, 10 aa, Mycobacterium tuberculosis
VYPMRSHTVS

SEQ ID NO: 19917 - protein, 10 aa, Mycobacterium tuberculosis
YPMRSHTVSA

SEQ ID NO: 19918 - protein, 10 aa, Mycobacterium tuberculosis
PMRSHTVSAE

SEQ ID NO: 19919 - protein, 10 aa, Mycobacterium tuberculosis
MRSHTVSAEG

SEQ ID NO: 19920 - protein, 10 aa, Mycobacterium tuberculosis
RSHTVSAEGG

SEQ ID NO: 19921 - protein, 10 aa, Mycobacterium tuberculosis
SHTVSAEGGA

SEQ ID NO: 19922 - protein, 10 aa, Mycobacterium tuberculosis
HTVSAEGGAA

SEQ ID NO: 19923 - protein, 10 aa, Mycobacterium tuberculosis
TVSAEGGAAA

SEQ ID NO: 19924 - protein, 10 aa, Mycobacterium tuberculosis
VSAEGGAAAV

SEQ ID NO: 19925 - protein, 10 aa, Mycobacterium tuberculosis
SAEGGAAAVT

SEQ ID NO: 19926 - protein, 10 aa, Mycobacterium tuberculosis
AEGGAAAVTG

SEQ ID NO: 19927 - protein, 10 aa, Mycobacterium tuberculosis
EGGAAAVTGD

SEQ ID NO: 19928 - protein, 10 aa, Mycobacterium tuberculosis
GGAAAVTGDD

SEQ ID NO: 19929 - protein, 10 aa, Mycobacterium tuberculosis
GAAAVTGDDD

SEQ ID NO: 19930 - protein, 10 aa, Mycobacterium tuberculosis
AAAVTGDDDS

SEQ ID NO: 19931 - protein, 10 aa, Mycobacterium tuberculosis
AAVTGDDDSL

SEQ ID NO: 19932 - protein, 10 aa, Mycobacterium tuberculosis
AVTGDDDSLD

SEQ ID NO: 19933 - protein, 10 aa, Mycobacterium tuberculosis
VTGDDDSLDE

SEQ ID NO: 19934 - protein, 10 aa, Mycobacterium tuberculosis
TGDDDSLDEH

SEQ ID NO: 19935 - protein, 10 aa, Mycobacterium tuberculosis
GDDDSLDEHA

SEQ ID NO: 19936 - protein, 10 aa, Mycobacterium tuberculosis
DDDSLDEHAH

SEQ ID NO: 19937 - protein, 10 aa, Mycobacterium tuberculosis
DDSLDEHAHD

SEQ ID NO: 19938 - protein, 10 aa, Mycobacterium tuberculosis
DSLDEHAHDT

SEQ ID NO: 19939 - protein, 10 aa, Mycobacterium tuberculosis
SLDEHAHDTV

SEQ ID NO: 19940 - protein, 10 aa, Mycobacterium tuberculosis
LDEHAHDTVS

SEQ ID NO: 19941 - protein, 10 aa, Mycobacterium tuberculosis
DEHAHDTVSG

SEQ ID NO: 19942 - protein, 10 aa, Mycobacterium tuberculosis
EHAHDTVSGG

SEQ ID NO: 19943 - protein, 10 aa, Mycobacterium tuberculosis
HAHDTVSGGD

SEQ ID NO: 19944 - protein, 10 aa, Mycobacterium tuberculosis
AHDTVSGGDW

SEQ ID NO: 19945 - protein, 10 aa, Mycobacterium tuberculosis
HDTVSGGDWL

SEQ ID NO: 19946 - protein, 10 aa, Mycobacterium tuberculosis
DTVSGGDWLC

SEQ ID NO: 19947 - protein, 10 aa, Mycobacterium tuberculosis
TVSGGDWLCD

SEQ ID NO: 19948 - protein, 10 aa, Mycobacterium tuberculosis
VSGGDWLCDQ

SEQ ID NO: 19949 - protein, 10 aa, Mycobacterium tuberculosis
SGGDWLCDQD

SEQ ID NO: 19950 - protein, 10 aa, Mycobacterium tuberculosis
GGDWLCDQDA

SEQ ID NO: 19951 - protein, 10 aa, Mycobacterium tuberculosis
GDWLCDQDAV

SEQ ID NO: 19952 - protein, 10 aa, Mycobacterium tuberculosis
DWLCDQDAVE

SEQ ID NO: 19953 - protein, 10 aa, Mycobacterium tuberculosis
WLCDQDAVEA

SEQ ID NO: 19954 - protein, 10 aa, Mycobacterium tuberculosis
LCDQDAVEAF

SEQ ID NO: 19955 - protein, 10 aa, Mycobacterium tuberculosis
CDQDAVEAFV

SEQ ID NO: 19956 - protein, 10 aa, Mycobacterium tuberculosis
DQDAVEAFVA

SEQ ID NO: 19957 - protein, 10 aa, Mycobacterium tuberculosis
QDAVEAFVAE

SEQ ID NO: 19958 - protein, 10 aa, Mycobacterium tuberculosis
DAVEAFVAEA

SEQ ID NO: 19959 - protein, 10 aa, Mycobacterium tuberculosis
AVEAFVAEAP

SEQ ID NO: 19960 - protein, 10 aa, Mycobacterium tuberculosis
VEAFVAEAPK

SEQ ID NO: 19961 - protein, 10 aa, Mycobacterium tuberculosis
EAFVAEAPKE

SEQ ID NO: 19962 - protein, 10 aa, Mycobacterium tuberculosis
AFVAEAPKEL

SEQ ID NO: 19963 - protein, 10 aa, Mycobacterium tuberculosis
FVAEAPKELV

SEQ ID NO: 19964 - protein, 10 aa, Mycobacterium tuberculosis
VAEAPKELVQ

SEQ ID NO: 19965 - protein, 10 aa, Mycobacterium tuberculosis
AEAPKELVQL

SEQ ID NO: 19966 - protein, 10 aa, Mycobacterium tuberculosis
EAPKELVQLE

SEQ ID NO: 19967 - protein, 10 aa, Mycobacterium tuberculosis
APKELVQLEH

SEQ ID NO: 19968 - protein, 10 aa, Mycobacterium tuberculosis
PKELVQLEHW

SEQ ID NO: 19969 - protein, 10 aa, Mycobacterium tuberculosis
KELVQLEHWG

SEQ ID NO: 19970 - protein, 10 aa, Mycobacterium tuberculosis
ELVQLEHWGC

SEQ ID NO: 19971 - protein, 10 aa, Mycobacterium tuberculosis
LVQLEHWGCP

SEQ ID NO: 19972 - protein, 10 aa, Mycobacterium tuberculosis
VQLEHWGCPW

SEQ ID NO: 19973 - protein, 10 aa, Mycobacterium tuberculosis
QLEHWGCPWS

SEQ ID NO: 19974 - protein, 10 aa, Mycobacterium tuberculosis
LEHWGCPWSR

SEQ ID NO: 19975 - protein, 10 aa, Mycobacterium tuberculosis
EHWGCPWSRK

SEQ ID NO: 19976 - protein, 10 aa, Mycobacterium tuberculosis
HWGCPWSRKP

SEQ ID NO: 19977 - protein, 10 aa, Mycobacterium tuberculosis
WGCPWSRKPD

SEQ ID NO: 19978 - protein, 10 aa, Mycobacterium tuberculosis
GCPWSRKPDG

SEQ ID NO: 19979 - protein, 10 aa, Mycobacterium tuberculosis
CPWSRKPDGR

SEQ ID NO: 19980 - protein, 10 aa, Mycobacterium tuberculosis
PWSRKPDGRV

SEQ ID NO: 19981 - protein, 10 aa, Mycobacterium tuberculosis
WSRKPDGRVA

SEQ ID NO: 19982 - protein, 10 aa, Mycobacterium tuberculosis
SRKPDGRVAV

SEQ ID NO: 19983 - protein, 10 aa, Mycobacterium tuberculosis
RKPDGRVAVR

SEQ ID NO: 19984 - protein, 10 aa, Mycobacterium tuberculosis
KPDGRVAVRP

SEQ ID NO: 19985 - protein, 10 aa, Mycobacterium tuberculosis
PDGRVAVRPF

SEQ ID NO: 19986 - protein, 10 aa, Mycobacterium tuberculosis
DGRVAVRPFG

SEQ ID NO: 19987 - protein, 10 aa, Mycobacterium tuberculosis
GRVAVRPFGG

SEQ ID NO: 19988 - protein, 10 aa, Mycobacterium tuberculosis
RVAVRPFGGM

SEQ ID NO: 19989 - protein, 10 aa, Mycobacterium tuberculosis
VAVRPFGGMK

SEQ ID NO: 19990 - protein, 10 aa, Mycobacterium tuberculosis
AVRPFGGMKK

SEQ ID NO: 19991 - protein, 10 aa, Mycobacterium tuberculosis
VRPFGGMKKL

SEQ ID NO: 19992 - protein, 10 aa, Mycobacterium tuberculosis
RPFGGMKKLR

SEQ ID NO: 19993 - protein, 10 aa, Mycobacterium tuberculosis
PFGGMKKLRT

SEQ ID NO: 19994 - protein, 10 aa, Mycobacterium tuberculosis
FGGMKKLRTW

SEQ ID NO: 19995 - protein, 10 aa, Mycobacterium tuberculosis
GGMKKLRTWF

SEQ ID NO: 19996 - protein, 10 aa, Mycobacterium tuberculosis
GMKKLRTWFA

SEQ ID NO: 19997 - protein, 10 aa, Mycobacterium tuberculosis
MKKLRTWFAA

SEQ ID NO: 19998 - protein, 10 aa, Mycobacterium tuberculosis
KKLRTWFAAD

SEQ ID NO: 19999 - protein, 10 aa, Mycobacterium tuberculosis
KLRTWFAADK

SEQ ID NO: 20000 - protein, 10 aa, Mycobacterium tuberculosis
LRTWFAADKT

SEQ ID NO: 20001 - protein, 10 aa, Mycobacterium tuberculosis
RTWFAADKTG

SEQ ID NO: 20002 - protein, 10 aa, Mycobacterium tuberculosis
TWFAADKTGF

SEQ ID NO: 20003 - protein, 10 aa, Mycobacterium tuberculosis
WFAADKTGFH

SEQ ID NO: 20004 - protein, 10 aa, Mycobacterium tuberculosis
FAADKTGFHL

SEQ ID NO: 20005 - protein, 10 aa, Mycobacterium tuberculosis
AADKTGFHLL

SEQ ID NO: 20006 - protein, 10 aa, Mycobacterium tuberculosis
ADKTGFHLLH

SEQ ID NO: 20007 - protein, 10 aa, Mycobacterium tuberculosis
DKTGFHLLHT

SEQ ID NO: 20008 - protein, 10 aa, Mycobacterium tuberculosis
KTGFHLLHTL

SEQ ID NO: 20009 - protein, 10 aa, Mycobacterium tuberculosis
TGFHLLHTLF

SEQ ID NO: 20010 - protein, 10 aa, Mycobacterium tuberculosis
GFHLLHTLFQ

SEQ ID NO: 20011 - protein, 10 aa, Mycobacterium tuberculosis
FHLLHTLFQR

SEQ ID NO: 20012 - protein, 10 aa, Mycobacterium tuberculosis
HLLHTLFQRL

SEQ ID NO: 20013 - protein, 10 aa, Mycobacterium tuberculosis
LLHTLFQRLL

SEQ ID NO: 20014 - protein, 10 aa, Mycobacterium tuberculosis
LHTLFQRLLT

SEQ ID NO: 20015 - protein, 10 aa, Mycobacterium tuberculosis
HTLFQRLLTY

SEQ ID NO: 20016 - protein, 10 aa, Mycobacterium tuberculosis
TLFQRLLTYS

SEQ ID NO: 20017 - protein, 10 aa, Mycobacterium tuberculosis
LFQRLLTYSD

SEQ ID NO: 20018 - protein, 10 aa, Mycobacterium tuberculosis
FQRLLTYSDV

SEQ ID NO: 20019 - protein, 10 aa, Mycobacterium tuberculosis
QRLLTYSDVM

SEQ ID NO: 20020 - protein, 10 aa, Mycobacterium tuberculosis
RLLTYSDVMR

SEQ ID NO: 20021 - protein, 10 aa, Mycobacterium tuberculosis
LLTYSDVMRY

SEQ ID NO: 20022 - protein, 10 aa, Mycobacterium tuberculosis
LTYSDVMRYD

SEQ ID NO: 20023 - protein, 10 aa, Mycobacterium tuberculosis
TYSDVMRYDE

SEQ ID NO: 20024 - protein, 10 aa, Mycobacterium tuberculosis
YSDVMRYDEW

SEQ ID NO: 20025 - protein, 10 aa, Mycobacterium tuberculosis
SDVMRYDEWF

SEQ ID NO: 20026 - protein, 10 aa, Mycobacterium tuberculosis
DVMRYDEWFA

SEQ ID NO: 20027 - protein, 10 aa, Mycobacterium tuberculosis
VMRYDEWFAT

SEQ ID NO: 20028 - protein, 10 aa, Mycobacterium tuberculosis
MRYDEWFATT

SEQ ID NO: 20029 - protein, 10 aa, Mycobacterium tuberculosis
RYDEWFATTL

SEQ ID NO: 20030 - protein, 10 aa, Mycobacterium tuberculosis
YDEWFATTLL

SEQ ID NO: 20031 - protein, 10 aa, Mycobacterium tuberculosis
DEWFATTLLV

SEQ ID NO: 20032 - protein, 10 aa, Mycobacterium tuberculosis
EWFATTLLVD

SEQ ID NO: 20033 - protein, 10 aa, Mycobacterium tuberculosis
WFATTLLVDD

SEQ ID NO: 20034 - protein, 10 aa, Mycobacterium tuberculosis
FATTLLVDDG

SEQ ID NO: 20035 - protein, 10 aa, Mycobacterium tuberculosis
ATTLLVDDGR

SEQ ID NO: 20036 - protein, 10 aa, Mycobacterium tuberculosis
TTLLVDDGRV

SEQ ID NO: 20037 - protein, 10 aa, Mycobacterium tuberculosis
TLLVDDGRVC

SEQ ID NO: 20038 - protein, 10 aa, Mycobacterium tuberculosis
LLVDDGRVCG

SEQ ID NO: 20039 - protein, 10 aa, Mycobacterium tuberculosis
LVDDGRVCGL

SEQ ID NO: 20040 - protein, 10 aa, Mycobacterium tuberculosis
VDDGRVCGLV

SEQ ID NO: 20041 - protein, 10 aa, Mycobacterium tuberculosis
DDGRVCGLVA

SEQ ID NO: 20042 - protein, 10 aa, Mycobacterium tuberculosis
DGRVCGLVAI

SEQ ID NO: 20043 - protein, 10 aa, Mycobacterium tuberculosis
GRVCGLVAIE

SEQ ID NO: 20044 - protein, 10 aa, Mycobacterium tuberculosis
RVCGLVAIEL

SEQ ID NO: 20045 - protein, 10 aa, Mycobacterium tuberculosis
VCGLVAIELA

SEQ ID NO: 20046 - protein, 10 aa, Mycobacterium tuberculosis
CGLVAIELAT

SEQ ID NO: 20047 - protein, 10 aa, Mycobacterium tuberculosis
GLVAIELATG

SEQ ID NO: 20048 - protein, 10 aa, Mycobacterium tuberculosis
LVAIELATGR

SEQ ID NO: 20049 - protein, 10 aa, Mycobacterium tuberculosis
VAIELATGRI

SEQ ID NO: 20050 - protein, 10 aa, Mycobacterium tuberculosis
AIELATGRIE

SEQ ID NO: 20051 - protein, 10 aa, Mycobacterium tuberculosis
IELATGRIET

SEQ ID NO: 20052 - protein, 10 aa, Mycobacterium tuberculosis
ELATGRIETI

SEQ ID NO: 20053 - protein, 10 aa, Mycobacterium tuberculosis
LATGRIETIL

SEQ ID NO: 20054 - protein, 10 aa, Mycobacterium tuberculosis
ATGRIETILA

SEQ ID NO: 20055 - protein, 10 aa, Mycobacterium tuberculosis
TGRIETILAD

SEQ ID NO: 20056 - protein, 10 aa, Mycobacterium tuberculosis
GRIETILADA

SEQ ID NO: 20057 - protein, 10 aa, Mycobacterium tuberculosis
RIETILADAV

SEQ ID NO: 20058 - protein, 10 aa, Mycobacterium tuberculosis
IETILADAVI

SEQ ID NO: 20059 - protein, 10 aa, Mycobacterium tuberculosis
ETILADAVIL

SEQ ID NO: 20060 - protein, 10 aa, Mycobacterium tuberculosis
TILADAVILC

SEQ ID NO: 20061 - protein, 10 aa, Mycobacterium tuberculosis
ILADAVILCT

SEQ ID NO: 20062 - protein, 10 aa, Mycobacterium tuberculosis
LADAVILCTG

SEQ ID NO: 20063 - protein, 10 aa, Mycobacterium tuberculosis
ADAVILCTGG

SEQ ID NO: 20064 - protein, 10 aa, Mycobacterium tuberculosis
DAVILCTGGC

SEQ ID NO: 20065 - protein, 10 aa, Mycobacterium tuberculosis
AVILCTGGCG

SEQ ID NO: 20066 - protein, 10 aa, Mycobacterium tuberculosis
VILCTGGCGR

SEQ ID NO: 20067 - protein, 10 aa, Mycobacterium tuberculosis
ILCTGGCGRV

SEQ ID NO: 20068 - protein, 10 aa, Mycobacterium tuberculosis
LCTGGCGRVF

SEQ ID NO: 20069 - protein, 10 aa, Mycobacterium tuberculosis
CTGGCGRVFP

SEQ ID NO: 20070 - protein, 10 aa, Mycobacterium tuberculosis
TGGCGRVFPF

SEQ ID NO: 20071 - protein, 10 aa, Mycobacterium tuberculosis
GGCGRVFPFT

SEQ ID NO: 20072 - protein, 10 aa, Mycobacterium tuberculosis
GCGRVFPFTT

SEQ ID NO: 20073 - protein, 10 aa, Mycobacterium tuberculosis
CGRVFPFTTN

SEQ ID NO: 20074 - protein, 10 aa, Mycobacterium tuberculosis
GRVFPFTTNA

SEQ ID NO: 20075 - protein, 10 aa, Mycobacterium tuberculosis
RVFPFTTNAN

SEQ ID NO: 20076 - protein, 10 aa, Mycobacterium tuberculosis
VFPFTTNANI

SEQ ID NO: 20077 - protein, 10 aa, Mycobacterium tuberculosis
FPFTTNANIK

SEQ ID NO: 20078 - protein, 10 aa, Mycobacterium tuberculosis
PFTTNANIKT

SEQ ID NO: 20079 - protein, 10 aa, Mycobacterium tuberculosis
FTTNANIKTG

SEQ ID NO: 20080 - protein, 10 aa, Mycobacterium tuberculosis
TTNANIKTGD

SEQ ID NO: 20081 - protein, 10 aa, Mycobacterium tuberculosis
TNANIKTGDG

SEQ ID NO: 20082 - protein, 10 aa, Mycobacterium tuberculosis
NANIKTGDGM

SEQ ID NO: 20083 - protein, 10 aa, Mycobacterium tuberculosis
ANIKTGDGMA

SEQ ID NO: 20084 - protein, 10 aa, Mycobacterium tuberculosis
NIKTGDGMAL

SEQ ID NO: 20085 - protein, 10 aa, Mycobacterium tuberculosis
IKTGDGMALA

SEQ ID NO: 20086 - protein, 10 aa, Mycobacterium tuberculosis
KTGDGMALAF

SEQ ID NO: 20087 - protein, 10 aa, Mycobacterium tuberculosis
TGDGMALAFR

SEQ ID NO: 20088 - protein, 10 aa, Mycobacterium tuberculosis
GDGMALAFRA

SEQ ID NO: 20089 - protein, 10 aa, Mycobacterium tuberculosis
DGMALAFRAG

SEQ ID NO: 20090 - protein, 10 aa, Mycobacterium tuberculosis
GMALAFRAGA

SEQ ID NO: 20091 - protein, 10 aa, Mycobacterium tuberculosis
MALAFRAGAP

SEQ ID NO: 20092 - protein, 10 aa, Mycobacterium tuberculosis
ALAFRAGAPL

SEQ ID NO: 20093 - protein, 10 aa, Mycobacterium tuberculosis
LAFRAGAPLK

SEQ ID NO: 20094 - protein, 10 aa, Mycobacterium tuberculosis
AFRAGAPLKD

SEQ ID NO: 20095 - protein, 10 aa, Mycobacterium tuberculosis
FRAGAPLKDM

SEQ ID NO: 20096 - protein, 10 aa, Mycobacterium tuberculosis
RAGAPLKDME

SEQ ID NO: 20097 - protein, 10 aa, Mycobacterium tuberculosis
AGAPLKDMEF

SEQ ID NO: 20098 - protein, 10 aa, Mycobacterium tuberculosis
GAPLKDMEFV

SEQ ID NO: 20099 - protein, 10 aa, Mycobacterium tuberculosis
APLKDMEFVQ

SEQ ID NO: 20100 - protein, 10 aa, Mycobacterium tuberculosis
PLKDMEFVQY

SEQ ID NO: 20101 - protein, 10 aa, Mycobacterium tuberculosis
LKDMEFVQYH

SEQ ID NO: 20102 - protein, 10 aa, Mycobacterium tuberculosis
KDMEFVQYHP

SEQ ID NO: 20103 - protein, 10 aa, Mycobacterium tuberculosis
DMEFVQYHPT

SEQ ID NO: 20104 - protein, 10 aa, Mycobacterium tuberculosis
MEFVQYHPTG

SEQ ID NO: 20105 - protein, 10 aa, Mycobacterium tuberculosis
EFVQYHPTGL

SEQ ID NO: 20106 - protein, 10 aa, Mycobacterium tuberculosis
FVQYHPTGLP

SEQ ID NO: 20107 - protein, 10 aa, Mycobacterium tuberculosis
VQYHPTGLPF

SEQ ID NO: 20108 - protein, 10 aa, Mycobacterium tuberculosis
QYHPTGLPFT

SEQ ID NO: 20109 - protein, 10 aa, Mycobacterium tuberculosis
YHPTGLPFTG

SEQ ID NO: 20110 - protein, 10 aa, Mycobacterium tuberculosis
HPTGLPFTGI

SEQ ID NO: 20111 - protein, 10 aa, Mycobacterium tuberculosis
PTGLPFTGIL

SEQ ID NO: 20112 - protein, 10 aa, Mycobacterium tuberculosis
TGLPFTGILI

SEQ ID NO: 20113 - protein, 10 aa, Mycobacterium tuberculosis
GLPFTGILIT

SEQ ID NO: 20114 - protein, 10 aa, Mycobacterium tuberculosis
LPFTGILITE

SEQ ID NO: 20115 - protein, 10 aa, Mycobacterium tuberculosis
PFTGILITEA

SEQ ID NO: 20116 - protein, 10 aa, Mycobacterium tuberculosis
FTGILITEAA

SEQ ID NO: 20117 - protein, 10 aa, Mycobacterium tuberculosis
TGILITEAAR

SEQ ID NO: 20118 - protein, 10 aa, Mycobacterium tuberculosis
GILITEAARA

SEQ ID NO: 20119 - protein, 10 aa, Mycobacterium tuberculosis
ILITEAARAE

SEQ ID NO: 20120 - protein, 10 aa, Mycobacterium tuberculosis
LITEAARAEG

SEQ ID NO: 20121 - protein, 10 aa, Mycobacterium tuberculosis
ITEAARAEGG

SEQ ID NO: 20122 - protein, 10 aa, Mycobacterium tuberculosis
TEAARAEGGW

SEQ ID NO: 20123 - protein, 10 aa, Mycobacterium tuberculosis
EAARAEGGWL

SEQ ID NO: 20124 - protein, 10 aa, Mycobacterium tuberculosis
AARAEGGWLL

SEQ ID NO: 20125 - protein, 10 aa, Mycobacterium tuberculosis
ARAEGGWLLN

SEQ ID NO: 20126 - protein, 10 aa, Mycobacterium tuberculosis
RAEGGWLLNK

SEQ ID NO: 20127 - protein, 10 aa, Mycobacterium tuberculosis
AEGGWLLNKD

SEQ ID NO: 20128 - protein, 10 aa, Mycobacterium tuberculosis
EGGWLLNKDG

SEQ ID NO: 20129 - protein, 10 aa, Mycobacterium tuberculosis
GGWLLNKDGY

SEQ ID NO: 20130 - protein, 10 aa, Mycobacterium tuberculosis
GWLLNKDGYR

SEQ ID NO: 20131 - protein, 10 aa, Mycobacterium tuberculosis
WLLNKDGYRY

SEQ ID NO: 20132 - protein, 10 aa, Mycobacterium tuberculosis
LLNKDGYRYL

SEQ ID NO: 20133 - protein, 10 aa, Mycobacterium tuberculosis
LNKDGYRYLQ

SEQ ID NO: 20134 - protein, 10 aa, Mycobacterium tuberculosis
NKDGYRYLQD

SEQ ID NO: 20135 - protein, 10 aa, Mycobacterium tuberculosis
KDGYRYLQDY

SEQ ID NO: 20136 - protein, 10 aa, Mycobacterium tuberculosis
DGYRYLQDYD

SEQ ID NO: 20137 - protein, 10 aa, Mycobacterium tuberculosis
GYRYLQDYDL

SEQ ID NO: 20138 - protein, 10 aa, Mycobacterium tuberculosis
YRYLQDYDLG

SEQ ID NO: 20139 - protein, 10 aa, Mycobacterium tuberculosis
RYLQDYDLGK

SEQ ID NO: 20140 - protein, 10 aa, Mycobacterium tuberculosis
YLQDYDLGKP

SEQ ID NO: 20141 - protein, 10 aa, Mycobacterium tuberculosis
LQDYDLGKPT

SEQ ID NO: 20142 - protein, 10 aa, Mycobacterium tuberculosis
QDYDLGKPTP

SEQ ID NO: 20143 - protein, 10 aa, Mycobacterium tuberculosis
DYDLGKPTPE

SEQ ID NO: 20144 - protein, 10 aa, Mycobacterium tuberculosis
YDLGKPTPEP

SEQ ID NO: 20145 - protein, 10 aa, Mycobacterium tuberculosis
DLGKPTPEPR

SEQ ID NO: 20146 - protein, 10 aa, Mycobacterium tuberculosis
LGKPTPEPRL

SEQ ID NO: 20147 - protein, 10 aa, Mycobacterium tuberculosis
GKPTPEPRLR

SEQ ID NO: 20148 - protein, 10 aa, Mycobacterium tuberculosis
KPTPEPRLRS

SEQ ID NO: 20149 - protein, 10 aa, Mycobacterium tuberculosis
PTPEPRLRSM

SEQ ID NO: 20150 - protein, 10 aa, Mycobacterium tuberculosis
TPEPRLRSME

SEQ ID NO: 20151 - protein, 10 aa, Mycobacterium tuberculosis
PEPRLRSMEL

SEQ ID NO: 20152 - protein, 10 aa, Mycobacterium tuberculosis
EPRLRSMELG

SEQ ID NO: 20153 - protein, 10 aa, Mycobacterium tuberculosis
PRLRSMELGP

SEQ ID NO: 20154 - protein, 10 aa, Mycobacterium tuberculosis
RLRSMELGPR

SEQ ID NO: 20155 - protein, 10 aa, Mycobacterium tuberculosis
LRSMELGPRD

SEQ ID NO: 20156 - protein, 10 aa, Mycobacterium tuberculosis
RSMELGPRDR

SEQ ID NO: 20157 - protein, 10 aa, Mycobacterium tuberculosis
SMELGPRDRL

SEQ ID NO: 20158 - protein, 10 aa, Mycobacterium tuberculosis
MELGPRDRLS

SEQ ID NO: 20159 - protein, 10 aa, Mycobacterium tuberculosis
ELGPRDRLSQ

SEQ ID NO: 20160 - protein, 10 aa, Mycobacterium tuberculosis
LGPRDRLSQA

SEQ ID NO: 20161 - protein, 10 aa, Mycobacterium tuberculosis
GPRDRLSQAF

SEQ ID NO: 20162 - protein, 10 aa, Mycobacterium tuberculosis
PRDRLSQAFV

SEQ ID NO: 20163 - protein, 10 aa, Mycobacterium tuberculosis
RDRLSQAFVH

SEQ ID NO: 20164 - protein, 10 aa, Mycobacterium tuberculosis
DRLSQAFVHE

SEQ ID NO: 20165 - protein, 10 aa, Mycobacterium tuberculosis
RLSQAFVHEH

SEQ ID NO: 20166 - protein, 10 aa, Mycobacterium tuberculosis
LSQAFVHEHN

SEQ ID NO: 20167 - protein, 10 aa, Mycobacterium tuberculosis
SQAFVHEHNK

SEQ ID NO: 20168 - protein, 10 aa, Mycobacterium tuberculosis
QAFVHEHNKG

SEQ ID NO: 20169 - protein, 10 aa, Mycobacterium tuberculosis
AFVHEHNKGR

SEQ ID NO: 20170 - protein, 10 aa, Mycobacterium tuberculosis
FVHEHNKGRT

SEQ ID NO: 20171 - protein, 10 aa, Mycobacterium tuberculosis
VHEHNKGRTV

SEQ ID NO: 20172 - protein, 10 aa, Mycobacterium tuberculosis
HEHNKGRTVD

SEQ ID NO: 20173 - protein, 10 aa, Mycobacterium tuberculosis
EHNKGRTVDT

SEQ ID NO: 20174 - protein, 10 aa, Mycobacterium tuberculosis
HNKGRTVDTP

SEQ ID NO: 20175 - protein, 10 aa, Mycobacterium tuberculosis
NKGRTVDTPY

SEQ ID NO: 20176 - protein, 10 aa, Mycobacterium tuberculosis
KGRTVDTPYG

SEQ ID NO: 20177 - protein, 10 aa, Mycobacterium tuberculosis
GRTVDTPYGP

SEQ ID NO: 20178 - protein, 10 aa, Mycobacterium tuberculosis
RTVDTPYGPV

SEQ ID NO: 20179 - protein, 10 aa, Mycobacterium tuberculosis
TVDTPYGPVV

SEQ ID NO: 20180 - protein, 10 aa, Mycobacterium tuberculosis
VDTPYGPVVY

SEQ ID NO: 20181 - protein, 10 aa, Mycobacterium tuberculosis
DTPYGPVVYL

SEQ ID NO: 20182 - protein, 10 aa, Mycobacterium tuberculosis
TPYGPVVYLD

SEQ ID NO: 20183 - protein, 10 aa, Mycobacterium tuberculosis
PYGPVVYLDL

SEQ ID NO: 20184 - protein, 10 aa, Mycobacterium tuberculosis
YGPVVYLDLR

SEQ ID NO: 20185 - protein, 10 aa, Mycobacterium tuberculosis
GPVVYLDLRH

SEQ ID NO: 20186 - protein, 10 aa, Mycobacterium tuberculosis
PVVYLDLRHL

SEQ ID NO: 20187 - protein, 10 aa, Mycobacterium tuberculosis
VVYLDLRHLG

SEQ ID NO: 20188 - protein, 10 aa, Mycobacterium tuberculosis
VYLDLRHLGA

SEQ ID NO: 20189 - protein, 10 aa, Mycobacterium tuberculosis
YLDLRHLGAD

SEQ ID NO: 20190 - protein, 10 aa, Mycobacterium tuberculosis
LDLRHLGADL

SEQ ID NO: 20191 - protein, 10 aa, Mycobacterium tuberculosis
DLRHLGADLI

SEQ ID NO: 20192 - protein, 10 aa, Mycobacterium tuberculosis
LRHLGADLID

SEQ ID NO: 20193 - protein, 10 aa, Mycobacterium tuberculosis
RHLGADLIDA

SEQ ID NO: 20194 - protein, 10 aa, Mycobacterium tuberculosis
HLGADLIDAK

SEQ ID NO: 20195 - protein, 10 aa, Mycobacterium tuberculosis
LGADLIDAKL

SEQ ID NO: 20196 - protein, 10 aa, Mycobacterium tuberculosis
GADLIDAKLP

SEQ ID NO: 20197 - protein, 10 aa, Mycobacterium tuberculosis
ADLIDAKLPF

SEQ ID NO: 20198 - protein, 10 aa, Mycobacterium tuberculosis
DLIDAKLPFV

SEQ ID NO: 20199 - protein, 10 aa, Mycobacterium tuberculosis
LIDAKLPFVR

SEQ ID NO: 20200 - protein, 10 aa, Mycobacterium tuberculosis
IDAKLPFVRE

SEQ ID NO: 20201 - protein, 10 aa, Mycobacterium tuberculosis
DAKLPFVREL

SEQ ID NO: 20202 - protein, 10 aa, Mycobacterium tuberculosis
AKLPFVRELC

SEQ ID NO: 20203 - protein, 10 aa, Mycobacterium tuberculosis
KLPFVRELCR

SEQ ID NO: 20204 - protein, 10 aa, Mycobacterium tuberculosis
LPFVRELCRD

SEQ ID NO: 20205 - protein, 10 aa, Mycobacterium tuberculosis
PFVRELCRDY

SEQ ID NO: 20206 - protein, 10 aa, Mycobacterium tuberculosis
FVRELCRDYQ

SEQ ID NO: 20207 - protein, 10 aa, Mycobacterium tuberculosis
VRELCRDYQH

SEQ ID NO: 20208 - protein, 10 aa, Mycobacterium tuberculosis
RELCRDYQHI

SEQ ID NO: 20209 - protein, 10 aa, Mycobacterium tuberculosis
ELCRDYQHID

SEQ ID NO: 20210 - protein, 10 aa, Mycobacterium tuberculosis
LCRDYQHIDP

SEQ ID NO: 20211 - protein, 10 aa, Mycobacterium tuberculosis
CRDYQHIDPV

SEQ ID NO: 20212 - protein, 10 aa, Mycobacterium tuberculosis
RDYQHIDPVV

SEQ ID NO: 20213 - protein, 10 aa, Mycobacterium tuberculosis
DYQHIDPVVE

SEQ ID NO: 20214 - protein, 10 aa, Mycobacterium tuberculosis
YQHIDPVVEL

SEQ ID NO: 20215 - protein, 10 aa, Mycobacterium tuberculosis
QHIDPVVELV

SEQ ID NO: 20216 - protein, 10 aa, Mycobacterium tuberculosis
HIDPVVELVP

SEQ ID NO: 20217 - protein, 10 aa, Mycobacterium tuberculosis
IDPVVELVPV

SEQ ID NO: 20218 - protein, 10 aa, Mycobacterium tuberculosis
DPVVELVPVR

SEQ ID NO: 20219 - protein, 10 aa, Mycobacterium tuberculosis
PVVELVPVRP

SEQ ID NO: 20220 - protein, 10 aa, Mycobacterium tuberculosis
VVELVPVRPV

SEQ ID NO: 20221 - protein, 10 aa, Mycobacterium tuberculosis
VELVPVRPVV

SEQ ID NO: 20222 - protein, 10 aa, Mycobacterium tuberculosis
ELVPVRPVVH

SEQ ID NO: 20223 - protein, 10 aa, Mycobacterium tuberculosis
LVPVRPVVHY

SEQ ID NO: 20224 - protein, 10 aa, Mycobacterium tuberculosis
VPVRPVVHYM

SEQ ID NO: 20225 - protein, 10 aa, Mycobacterium tuberculosis
PVRPVVHYMM

SEQ ID NO: 20226 - protein, 10 aa, Mycobacterium tuberculosis
VRPVVHYMMG

SEQ ID NO: 20227 - protein, 10 aa, Mycobacterium tuberculosis
RPVVHYMMGG

SEQ ID NO: 20228 - protein, 10 aa, Mycobacterium tuberculosis
PVVHYMMGGV

SEQ ID NO: 20229 - protein, 10 aa, Mycobacterium tuberculosis
VVHYMMGGVH

SEQ ID NO: 20230 - protein, 10 aa, Mycobacterium tuberculosis
VHYMMGGVHT

SEQ ID NO: 20231 - protein, 10 aa, Mycobacterium tuberculosis
HYMMGGVHTD

SEQ ID NO: 20232 - protein, 10 aa, Mycobacterium tuberculosis
YMMGGVHTDI

SEQ ID NO: 20233 - protein, 10 aa, Mycobacterium tuberculosis
MMGGVHTDIN

SEQ ID NO: 20234 - protein, 10 aa, Mycobacterium tuberculosis
MGGVHTDING

SEQ ID NO: 20235 - protein, 10 aa, Mycobacterium tuberculosis
GGVHTDINGA

SEQ ID NO: 20236 - protein, 10 aa, Mycobacterium tuberculosis
GVHTDINGAT

SEQ ID NO: 20237 - protein, 10 aa, Mycobacterium tuberculosis
VHTDINGATT

SEQ ID NO: 20238 - protein, 10 aa, Mycobacterium tuberculosis
HTDINGATTL

SEQ ID NO: 20239 - protein, 10 aa, Mycobacterium tuberculosis
TDINGATTLP

SEQ ID NO: 20240 - protein, 10 aa, Mycobacterium tuberculosis
DINGATTLPG

SEQ ID NO: 20241 - protein, 10 aa, Mycobacterium tuberculosis
INGATTLPGL

SEQ ID NO: 20242 - protein, 10 aa, Mycobacterium tuberculosis
NGATTLPGLY

SEQ ID NO: 20243 - protein, 10 aa, Mycobacterium tuberculosis
GATTLPGLYA

SEQ ID NO: 20244 - protein, 10 aa, Mycobacterium tuberculosis
ATTLPGLYAA

SEQ ID NO: 20245 - protein, 10 aa, Mycobacterium tuberculosis
TTLPGLYAAG

SEQ ID NO: 20246 - protein, 10 aa, Mycobacterium tuberculosis
TLPGLYAAGE

SEQ ID NO: 20247 - protein, 10 aa, Mycobacterium tuberculosis
LPGLYAAGET

SEQ ID NO: 20248 - protein, 10 aa, Mycobacterium tuberculosis
PGLYAAGETA

SEQ ID NO: 20249 - protein, 10 aa, Mycobacterium tuberculosis
GLYAAGETAC

SEQ ID NO: 20250 - protein, 10 aa, Mycobacterium tuberculosis
LYAAGETACV

SEQ ID NO: 20251 - protein, 10 aa, Mycobacterium tuberculosis
YAAGETACVS

SEQ ID NO: 20252 - protein, 10 aa, Mycobacterium tuberculosis
AAGETACVSI

SEQ ID NO: 20253 - protein, 10 aa, Mycobacterium tuberculosis
AGETACVSIN

SEQ ID NO: 20254 - protein, 10 aa, Mycobacterium tuberculosis
GETACVSING

SEQ ID NO: 20255 - protein, 10 aa, Mycobacterium tuberculosis
ETACVSINGA

SEQ ID NO: 20256 - protein, 10 aa, Mycobacterium tuberculosis
TACVSINGAN

SEQ ID NO: 20257 - protein, 10 aa, Mycobacterium tuberculosis
ACVSINGANR

SEQ ID NO: 20258 - protein, 10 aa, Mycobacterium tuberculosis
CVSINGANRL

SEQ ID NO: 20259 - protein, 10 aa, Mycobacterium tuberculosis
VSINGANRLG

SEQ ID NO: 20260 - protein, 10 aa, Mycobacterium tuberculosis
SINGANRLGS

SEQ ID NO: 20261 - protein, 10 aa, Mycobacterium tuberculosis
INGANRLGSN

SEQ ID NO: 20262 - protein, 10 aa, Mycobacterium tuberculosis
NGANRLGSNS

SEQ ID NO: 20263 - protein, 10 aa, Mycobacterium tuberculosis
GANRLGSNSL

SEQ ID NO: 20264 - protein, 10 aa, Mycobacterium tuberculosis
ANRLGSNSLP

SEQ ID NO: 20265 - protein, 10 aa, Mycobacterium tuberculosis
NRLGSNSLPE

SEQ ID NO: 20266 - protein, 10 aa, Mycobacterium tuberculosis
RLGSNSLPEL

SEQ ID NO: 20267 - protein, 10 aa, Mycobacterium tuberculosis
LGSNSLPELL

SEQ ID NO: 20268 - protein, 10 aa, Mycobacterium tuberculosis
GSNSLPELLV

SEQ ID NO: 20269 - protein, 10 aa, Mycobacterium tuberculosis
SNSLPELLVF

SEQ ID NO: 20270 - protein, 10 aa, Mycobacterium tuberculosis
NSLPELLVFG

SEQ ID NO: 20271 - protein, 10 aa, Mycobacterium tuberculosis
SLPELLVFGA

SEQ ID NO: 20272 - protein, 10 aa, Mycobacterium tuberculosis
LPELLVFGAR

SEQ ID NO: 20273 - protein, 10 aa, Mycobacterium tuberculosis
PELLVFGARA

SEQ ID NO: 20274 - protein, 10 aa, Mycobacterium tuberculosis
ELLVFGARAG

SEQ ID NO: 20275 - protein, 10 aa, Mycobacterium tuberculosis
LLVFGARAGR

SEQ ID NO: 20276 - protein, 10 aa, Mycobacterium tuberculosis
LVFGARAGRA

SEQ ID NO: 20277 - protein, 10 aa, Mycobacterium tuberculosis
VFGARAGRAA

SEQ ID NO: 20278 - protein, 10 aa, Mycobacterium tuberculosis
FGARAGRAAA

SEQ ID NO: 20279 - protein, 10 aa, Mycobacterium tuberculosis
GARAGRAAAD

SEQ ID NO: 20280 - protein, 10 aa, Mycobacterium tuberculosis
ARAGRAAADY

SEQ ID NO: 20281 - protein, 10 aa, Mycobacterium tuberculosis
RAGRAAADYA

SEQ ID NO: 20282 - protein, 10 aa, Mycobacterium tuberculosis
AGRAAADYAA

SEQ ID NO: 20283 - protein, 10 aa, Mycobacterium tuberculosis
GRAAADYAAR

SEQ ID NO: 20284 - protein, 10 aa, Mycobacterium tuberculosis
RAAADYAARH

SEQ ID NO: 20285 - protein, 10 aa, Mycobacterium tuberculosis
AAADYAARHQ

SEQ ID NO: 20286 - protein, 10 aa, Mycobacterium tuberculosis
AADYAARHQK

SEQ ID NO: 20287 - protein, 10 aa, Mycobacterium tuberculosis
ADYAARHQKS

SEQ ID NO: 20288 - protein, 10 aa, Mycobacterium tuberculosis
DYAARHQKSD

SEQ ID NO: 20289 - protein, 10 aa, Mycobacterium tuberculosis
YAARHQKSDR

SEQ ID NO: 20290 - protein, 10 aa, Mycobacterium tuberculosis
AARHQKSDRG

SEQ ID NO: 20291 - protein, 10 aa, Mycobacterium tuberculosis
ARHQKSDRGP

SEQ ID NO: 20292 - protein, 10 aa, Mycobacterium tuberculosis
RHQKSDRGPS

SEQ ID NO: 20293 - protein, 10 aa, Mycobacterium tuberculosis
HQKSDRGPSS

SEQ ID NO: 20294 - protein, 10 aa, Mycobacterium tuberculosis
QKSDRGPSSA

SEQ ID NO: 20295 - protein, 10 aa, Mycobacterium tuberculosis
KSDRGPSSAV

SEQ ID NO: 20296 - protein, 10 aa, Mycobacterium tuberculosis
SDRGPSSAVR

SEQ ID NO: 20297 - protein, 10 aa, Mycobacterium tuberculosis
DRGPSSAVRA

SEQ ID NO: 20298 - protein, 10 aa, Mycobacterium tuberculosis
RGPSSAVRAQ

SEQ ID NO: 20299 - protein, 10 aa, Mycobacterium tuberculosis
GPSSAVRAQA

SEQ ID NO: 20300 - protein, 10 aa, Mycobacterium tuberculosis
PSSAVRAQAR

SEQ ID NO: 20301 - protein, 10 aa, Mycobacterium tuberculosis
SSAVRAQART

SEQ ID NO: 20302 - protein, 10 aa, Mycobacterium tuberculosis
SAVRAQARTE

SEQ ID NO: 20303 - protein, 10 aa, Mycobacterium tuberculosis
AVRAQARTEA

SEQ ID NO: 20304 - protein, 10 aa, Mycobacterium tuberculosis
VRAQARTEAL

SEQ ID NO: 20305 - protein, 10 aa, Mycobacterium tuberculosis
RAQARTEALR

SEQ ID NO: 20306 - protein, 10 aa, Mycobacterium tuberculosis
AQARTEALRL

SEQ ID NO: 20307 - protein, 10 aa, Mycobacterium tuberculosis
QARTEALRLE

SEQ ID NO: 20308 - protein, 10 aa, Mycobacterium tuberculosis
ARTEALRLER

SEQ ID NO: 20309 - protein, 10 aa, Mycobacterium tuberculosis
RTEALRLERE

SEQ ID NO: 20310 - protein, 10 aa, Mycobacterium tuberculosis
TEALRLEREL

SEQ ID NO: 20311 - protein, 10 aa, Mycobacterium tuberculosis
EALRLERELS

SEQ ID NO: 20312 - protein, 10 aa, Mycobacterium tuberculosis
ALRLERELSR

SEQ ID NO: 20313 - protein, 10 aa, Mycobacterium tuberculosis
LRLERELSRH

SEQ ID NO: 20314 - protein, 10 aa, Mycobacterium tuberculosis
RLERELSRHG

SEQ ID NO: 20315 - protein, 10 aa, Mycobacterium tuberculosis
LERELSRHGQ

SEQ ID NO: 20316 - protein, 10 aa, Mycobacterium tuberculosis
ERELSRHGQG

SEQ ID NO: 20317 - protein, 10 aa, Mycobacterium tuberculosis
RELSRHGQGG

SEQ ID NO: 20318 - protein, 10 aa, Mycobacterium tuberculosis
ELSRHGQGGE

SEQ ID NO: 20319 - protein, 10 aa, Mycobacterium tuberculosis
LSRHGQGGER

SEQ ID NO: 20320 - protein, 10 aa, Mycobacterium tuberculosis
SRHGQGGERI

SEQ ID NO: 20321 - protein, 10 aa, Mycobacterium tuberculosis
RHGQGGERIA

SEQ ID NO: 20322 - protein, 10 aa, Mycobacterium tuberculosis
HGQGGERIAD

SEQ ID NO: 20323 - protein, 10 aa, Mycobacterium tuberculosis
GQGGERIADI

SEQ ID NO: 20324 - protein, 10 aa, Mycobacterium tuberculosis
QGGERIADIR

SEQ ID NO: 20325 - protein, 10 aa, Mycobacterium tuberculosis
GGERIADIRA

SEQ ID NO: 20326 - protein, 10 aa, Mycobacterium tuberculosis
GERIADIRAD

SEQ ID NO: 20327 - protein, 10 aa, Mycobacterium tuberculosis
ERIADIRADM

SEQ ID NO: 20328 - protein, 10 aa, Mycobacterium tuberculosis
RIADIRADMQ

SEQ ID NO: 20329 - protein, 10 aa, Mycobacterium tuberculosis
IADIRADMQA

SEQ ID NO: 20330 - protein, 10 aa, Mycobacterium tuberculosis
ADIRADMQAT

SEQ ID NO: 20331 - protein, 10 aa, Mycobacterium tuberculosis
DIRADMQATL

SEQ ID NO: 20332 - protein, 10 aa, Mycobacterium tuberculosis
IRADMQATLE

SEQ ID NO: 20333 - protein, 10 aa, Mycobacterium tuberculosis
RADMQATLES

SEQ ID NO: 20334 - protein, 10 aa, Mycobacterium tuberculosis
ADMQATLESA

SEQ ID NO: 20335 - protein, 10 aa, Mycobacterium tuberculosis
DMQATLESAA

SEQ ID NO: 20336 - protein, 10 aa, Mycobacterium tuberculosis
MQATLESAAG

SEQ ID NO: 20337 - protein, 10 aa, Mycobacterium tuberculosis
QATLESAAGI

SEQ ID NO: 20338 - protein, 10 aa, Mycobacterium tuberculosis
ATLESAAGIY

SEQ ID NO: 20339 - protein, 10 aa, Mycobacterium tuberculosis
TLESAAGIYR

SEQ ID NO: 20340 - protein, 10 aa, Mycobacterium tuberculosis
LESAAGIYRD

SEQ ID NO: 20341 - protein, 10 aa, Mycobacterium tuberculosis
ESAAGIYRDG

SEQ ID NO: 20342 - protein, 10 aa, Mycobacterium tuberculosis
SAAGIYRDGP

SEQ ID NO: 20343 - protein, 10 aa, Mycobacterium tuberculosis
AAGIYRDGPT

SEQ ID NO: 20344 - protein, 10 aa, Mycobacterium tuberculosis
AGIYRDGPTL

SEQ ID NO: 20345 - protein, 10 aa, Mycobacterium tuberculosis
GIYRDGPTLT

SEQ ID NO: 20346 - protein, 10 aa, Mycobacterium tuberculosis
IYRDGPTLTK

SEQ ID NO: 20347 - protein, 10 aa, Mycobacterium tuberculosis
YRDGPTLTKA

SEQ ID NO: 20348 - protein, 10 aa, Mycobacterium tuberculosis
RDGPTLTKAV

SEQ ID NO: 20349 - protein, 10 aa, Mycobacterium tuberculosis
DGPTLTKAVE

SEQ ID NO: 20350 - protein, 10 aa, Mycobacterium tuberculosis
GPTLTKAVEE

SEQ ID NO: 20351 - protein, 10 aa, Mycobacterium tuberculosis
PTLTKAVEEI

SEQ ID NO: 20352 - protein, 10 aa, Mycobacterium tuberculosis
TLTKAVEEIR

SEQ ID NO: 20353 - protein, 10 aa, Mycobacterium tuberculosis
LTKAVEEIRV

SEQ ID NO: 20354 - protein, 10 aa, Mycobacterium tuberculosis
TKAVEEIRVL

SEQ ID NO: 20355 - protein, 10 aa, Mycobacterium tuberculosis
KAVEEIRVLQ

SEQ ID NO: 20356 - protein, 10 aa, Mycobacterium tuberculosis
AVEEIRVLQE

SEQ ID NO: 20357 - protein, 10 aa, Mycobacterium tuberculosis
VEEIRVLQER

SEQ ID NO: 20358 - protein, 10 aa, Mycobacterium tuberculosis
EEIRVLQERF

SEQ ID NO: 20359 - protein, 10 aa, Mycobacterium tuberculosis
EIRVLQERFA

SEQ ID NO: 20360 - protein, 10 aa, Mycobacterium tuberculosis
IRVLQERFAT

SEQ ID NO: 20361 - protein, 10 aa, Mycobacterium tuberculosis
RVLQERFATA

SEQ ID NO: 20362 - protein, 10 aa, Mycobacterium tuberculosis
VLQERFATAG

SEQ ID NO: 20363 - protein, 10 aa, Mycobacterium tuberculosis
LQERFATAGI

SEQ ID NO: 20364 - protein, 10 aa, Mycobacterium tuberculosis
QERFATAGID

SEQ ID NO: 20365 - protein, 10 aa, Mycobacterium tuberculosis
ERFATAGIDD

SEQ ID NO: 20366 - protein, 10 aa, Mycobacterium tuberculosis
RFATAGIDDH

SEQ ID NO: 20367 - protein, 10 aa, Mycobacterium tuberculosis
FATAGIDDHS

SEQ ID NO: 20368 - protein, 10 aa, Mycobacterium tuberculosis
ATAGIDDHSR

SEQ ID NO: 20369 - protein, 10 aa, Mycobacterium tuberculosis
TAGIDDHSRT

SEQ ID NO: 20370 - protein, 10 aa, Mycobacterium tuberculosis
AGIDDHSRTF

SEQ ID NO: 20371 - protein, 10 aa, Mycobacterium tuberculosis
GIDDHSRTFN

SEQ ID NO: 20372 - protein, 10 aa, Mycobacterium tuberculosis
IDDHSRTFNT

SEQ ID NO: 20373 - protein, 10 aa, Mycobacterium tuberculosis
DDHSRTFNTE

SEQ ID NO: 20374 - protein, 10 aa, Mycobacterium tuberculosis
DHSRTFNTEL

SEQ ID NO: 20375 - protein, 10 aa, Mycobacterium tuberculosis
HSRTFNTELT

SEQ ID NO: 20376 - protein, 10 aa, Mycobacterium tuberculosis
SRTFNTELTA

SEQ ID NO: 20377 - protein, 10 aa, Mycobacterium tuberculosis
RTFNTELTAL

SEQ ID NO: 20378 - protein, 10 aa, Mycobacterium tuberculosis
TFNTELTALL

SEQ ID NO: 20379 - protein, 10 aa, Mycobacterium tuberculosis
FNTELTALLE

SEQ ID NO: 20380 - protein, 10 aa, Mycobacterium tuberculosis
NTELTALLEL

SEQ ID NO: 20381 - protein, 10 aa, Mycobacterium tuberculosis
TELTALLELS

SEQ ID NO: 20382 - protein, 10 aa, Mycobacterium tuberculosis
ELTALLELSG

SEQ ID NO: 20383 - protein, 10 aa, Mycobacterium tuberculosis
LTALLELSGM

SEQ ID NO: 20384 - protein, 10 aa, Mycobacterium tuberculosis
TALLELSGML

SEQ ID NO: 20385 - protein, 10 aa, Mycobacterium tuberculosis
ALLELSGMLD

SEQ ID NO: 20386 - protein, 10 aa, Mycobacterium tuberculosis
LLELSGMLDV

SEQ ID NO: 20387 - protein, 10 aa, Mycobacterium tuberculosis
LELSGMLDVA

SEQ ID NO: 20388 - protein, 10 aa, Mycobacterium tuberculosis
ELSGMLDVAL

SEQ ID NO: 20389 - protein, 10 aa, Mycobacterium tuberculosis
LSGMLDVALA

SEQ ID NO: 20390 - protein, 10 aa, Mycobacterium tuberculosis
SGMLDVALAI

SEQ ID NO: 20391 - protein, 10 aa, Mycobacterium tuberculosis
GMLDVALAIV

SEQ ID NO: 20392 - protein, 10 aa, Mycobacterium tuberculosis
MLDVALAIVE

SEQ ID NO: 20393 - protein, 10 aa, Mycobacterium tuberculosis
LDVALAIVES

SEQ ID NO: 20394 - protein, 10 aa, Mycobacterium tuberculosis
DVALAIVESG

SEQ ID NO: 20395 - protein, 10 aa, Mycobacterium tuberculosis
VALAIVESGL

SEQ ID NO: 20396 - protein, 10 aa, Mycobacterium tuberculosis
ALAIVESGLR

SEQ ID NO: 20397 - protein, 10 aa, Mycobacterium tuberculosis
LAIVESGLRR

SEQ ID NO: 20398 - protein, 10 aa, Mycobacterium tuberculosis
AIVESGLRRE

SEQ ID NO: 20399 - protein, 10 aa, Mycobacterium tuberculosis
IVESGLRREE

SEQ ID NO: 20400 - protein, 10 aa, Mycobacterium tuberculosis
VESGLRREES

SEQ ID NO: 20401 - protein, 10 aa, Mycobacterium tuberculosis
ESGLRREESR

SEQ ID NO: 20402 - protein, 10 aa, Mycobacterium tuberculosis
SGLRREESRG

SEQ ID NO: 20403 - protein, 10 aa, Mycobacterium tuberculosis
GLRREESRGA

SEQ ID NO: 20404 - protein, 10 aa, Mycobacterium tuberculosis
LRREESRGAH

SEQ ID NO: 20405 - protein, 10 aa, Mycobacterium tuberculosis
RREESRGAHQ

SEQ ID NO: 20406 - protein, 10 aa, Mycobacterium tuberculosis
REESRGAHQR

SEQ ID NO: 20407 - protein, 10 aa, Mycobacterium tuberculosis
EESRGAHQRT

SEQ ID NO: 20408 - protein, 10 aa, Mycobacterium tuberculosis
ESRGAHQRTD

SEQ ID NO: 20409 - protein, 10 aa, Mycobacterium tuberculosis
SRGAHQRTDF

SEQ ID NO: 20410 - protein, 10 aa, Mycobacterium tuberculosis
RGAHQRTDFP

SEQ ID NO: 20411 - protein, 10 aa, Mycobacterium tuberculosis
GAHQRTDFPN

SEQ ID NO: 20412 - protein, 10 aa, Mycobacterium tuberculosis
AHQRTDFPNR

SEQ ID NO: 20413 - protein, 10 aa, Mycobacterium tuberculosis
HQRTDFPNRD

SEQ ID NO: 20414 - protein, 10 aa, Mycobacterium tuberculosis
QRTDFPNRDD

SEQ ID NO: 20415 - protein, 10 aa, Mycobacterium tuberculosis
RTDFPNRDDE

SEQ ID NO: 20416 - protein, 10 aa, Mycobacterium tuberculosis
TDFPNRDDEH

SEQ ID NO: 20417 - protein, 10 aa, Mycobacterium tuberculosis
DFPNRDDEHF

SEQ ID NO: 20418 - protein, 10 aa, Mycobacterium tuberculosis
FPNRDDEHFL

SEQ ID NO: 20419 - protein, 10 aa, Mycobacterium tuberculosis
PNRDDEHFLA

SEQ ID NO: 20420 - protein, 10 aa, Mycobacterium tuberculosis
NRDDEHFLAH

SEQ ID NO: 20421 - protein, 10 aa, Mycobacterium tuberculosis
RDDEHFLAHT

SEQ ID NO: 20422 - protein, 10 aa, Mycobacterium tuberculosis
DDEHFLAHTL

SEQ ID NO: 20423 - protein, 10 aa, Mycobacterium tuberculosis
DEHFLAHTLV

SEQ ID NO: 20424 - protein, 10 aa, Mycobacterium tuberculosis
EHFLAHTLVH

SEQ ID NO: 20425 - protein, 10 aa, Mycobacterium tuberculosis
HFLAHTLVHR

SEQ ID NO: 20426 - protein, 10 aa, Mycobacterium tuberculosis
FLAHTLVHRE

SEQ ID NO: 20427 - protein, 10 aa, Mycobacterium tuberculosis
LAHTLVHRES

SEQ ID NO: 20428 - protein, 10 aa, Mycobacterium tuberculosis
AHTLVHRESD

SEQ ID NO: 20429 - protein, 10 aa, Mycobacterium tuberculosis
HTLVHRESDG

SEQ ID NO: 20430 - protein, 10 aa, Mycobacterium tuberculosis
TLVHRESDGT

SEQ ID NO: 20431 - protein, 10 aa, Mycobacterium tuberculosis
LVHRESDGTL

SEQ ID NO: 20432 - protein, 10 aa, Mycobacterium tuberculosis
VHRESDGTLR

SEQ ID NO: 20433 - protein, 10 aa, Mycobacterium tuberculosis
HRESDGTLRV

SEQ ID NO: 20434 - protein, 10 aa, Mycobacterium tuberculosis
RESDGTLRVG

SEQ ID NO: 20435 - protein, 10 aa, Mycobacterium tuberculosis
ESDGTLRVGY

SEQ ID NO: 20436 - protein, 10 aa, Mycobacterium tuberculosis
SDGTLRVGYL

SEQ ID NO: 20437 - protein, 10 aa, Mycobacterium tuberculosis
DGTLRVGYLP

SEQ ID NO: 20438 - protein, 10 aa, Mycobacterium tuberculosis
GTLRVGYLPV

SEQ ID NO: 20439 - protein, 10 aa, Mycobacterium tuberculosis
TLRVGYLPVT

SEQ ID NO: 20440 - protein, 10 aa, Mycobacterium tuberculosis
LRVGYLPVTI

SEQ ID NO: 20441 - protein, 10 aa, Mycobacterium tuberculosis
RVGYLPVTIT

SEQ ID NO: 20442 - protein, 10 aa, Mycobacterium tuberculosis
VGYLPVTITR

SEQ ID NO: 20443 - protein, 10 aa, Mycobacterium tuberculosis
GYLPVTITRW

SEQ ID NO: 20444 - protein, 10 aa, Mycobacterium tuberculosis
YLPVTITRWP

SEQ ID NO: 20445 - protein, 10 aa, Mycobacterium tuberculosis
LPVTITRWPP

SEQ ID NO: 20446 - protein, 10 aa, Mycobacterium tuberculosis
PVTITRWPPG

SEQ ID NO: 20447 - protein, 10 aa, Mycobacterium tuberculosis
VTITRWPPGE

SEQ ID NO: 20448 - protein, 10 aa, Mycobacterium tuberculosis
TITRWPPGER

SEQ ID NO: 20449 - protein, 10 aa, Mycobacterium tuberculosis
ITRWPPGERV

SEQ ID NO: 20450 - protein, 10 aa, Mycobacterium tuberculosis
TRWPPGERVY

SEQ ID NO: 20451 - protein, 10 aa, Mycobacterium tuberculosis
RWPPGERVYG

SEQ ID NO: 20452 - protein, 10 aa, Mycobacterium tuberculosis
WPPGERVYGR

SEQ ID NO: 20453 - protein, 11 aa, Mycobacterium tuberculosis
MTAQHNIVVIG

SEQ ID NO: 20454 - protein, 11 aa, Mycobacterium tuberculosis
TAQHNIVVIGG

SEQ ID NO: 20455 - protein, 11 aa, Mycobacterium tuberculosis
AQHNIVVIGGG

SEQ ID NO: 20456 - protein, 11 aa, Mycobacterium tuberculosis
QHNIVVIGGGG

SEQ ID NO: 20457 - protein, 11 aa, Mycobacterium tuberculosis
HNIVVIGGGGA

SEQ ID NO: 20458 - protein, 11 aa, Mycobacterium tuberculosis
NIVVIGGGGAG

SEQ ID NO: 20459 - protein, 11 aa, Mycobacterium tuberculosis
IVVIGGGGAGL

SEQ ID NO: 20460 - protein, 11 aa, Mycobacterium tuberculosis
VVIGGGGAGLR

SEQ ID NO: 20461 - protein, 11 aa, Mycobacterium tuberculosis
VIGGGGAGLRA

SEQ ID NO: 20462 - protein, 11 aa, Mycobacterium tuberculosis
IGGGGAGLRAA

SEQ ID NO: 20463 - protein, 11 aa, Mycobacterium tuberculosis
GGGGAGLRAAI

SEQ ID NO: 20464 - protein, 11 aa, Mycobacterium tuberculosis
GGGAGLRAAIA

SEQ ID NO: 20465 - protein, 11 aa, Mycobacterium tuberculosis
GGAGLRAAIAI

SEQ ID NO: 20466 - protein, 11 aa, Mycobacterium tuberculosis
GAGLRAAIAIA

SEQ ID NO: 20467 - protein, 11 aa, Mycobacterium tuberculosis
AGLRAAIAIAE

SEQ ID NO: 20468 - protein, 11 aa, Mycobacterium tuberculosis
GLRAAIAIAET

SEQ ID NO: 20469 - protein, 11 aa, Mycobacterium tuberculosis
LRAAIAIAETN

SEQ ID NO: 20470 - protein, 11 aa, Mycobacterium tuberculosis
RAAIAIAETNP

SEQ ID NO: 20471 - protein, 11 aa, Mycobacterium tuberculosis
AAIAIAETNPH

SEQ ID NO: 20472 - protein, 11 aa, Mycobacterium tuberculosis
AIAIAETNPHL

SEQ ID NO: 20473 - protein, 11 aa, Mycobacterium tuberculosis
IAIAETNPHLD

SEQ ID NO: 20474 - protein, 11 aa, Mycobacterium tuberculosis
AIAETNPHLDV

SEQ ID NO: 20475 - protein, 11 aa, Mycobacterium tuberculosis
IAETNPHLDVA

SEQ ID NO: 20476 - protein, 11 aa, Mycobacterium tuberculosis
AETNPHLDVAI

SEQ ID NO: 20477 - protein, 11 aa, Mycobacterium tuberculosis
ETNPHLDVAIV

SEQ ID NO: 20478 - protein, 11 aa, Mycobacterium tuberculosis
TNPHLDVAIVS

SEQ ID NO: 20479 - protein, 11 aa, Mycobacterium tuberculosis
NPHLDVAIVSK

SEQ ID NO: 20480 - protein, 11 aa, Mycobacterium tuberculosis
PHLDVAIVSKV

SEQ ID NO: 20481 - protein, 11 aa, Mycobacterium tuberculosis
HLDVAIVSKVY

SEQ ID NO: 20482 - protein, 11 aa, Mycobacterium tuberculosis
LDVAIVSKVYP

SEQ ID NO: 20483 - protein, 11 aa, Mycobacterium tuberculosis
DVAIVSKVYPM

SEQ ID NO: 20484 - protein, 11 aa, Mycobacterium tuberculosis
VAIVSKVYPMR

SEQ ID NO: 20485 - protein, 11 aa, Mycobacterium tuberculosis
AIVSKVYPMRS

SEQ ID NO: 20486 - protein, 11 aa, Mycobacterium tuberculosis
IVSKVYPMRSH

SEQ ID NO: 20487 - protein, 11 aa, Mycobacterium tuberculosis
VSKVYPMRSHT

SEQ ID NO: 20488 - protein, 11 aa, Mycobacterium tuberculosis
SKVYPMRSHTV

SEQ ID NO: 20489 - protein, 11 aa, Mycobacterium tuberculosis
KVYPMRSHTVS

SEQ ID NO: 20490 - protein, 11 aa, Mycobacterium tuberculosis
VYPMRSHTVSA

SEQ ID NO: 20491 - protein, 11 aa, Mycobacterium tuberculosis
YPMRSHTVSAE

SEQ ID NO: 20492 - protein, 11 aa, Mycobacterium tuberculosis
PMRSHTVSAEG

SEQ ID NO: 20493 - protein, 11 aa, Mycobacterium tuberculosis
MRSHTVSAEGG

SEQ ID NO: 20494 - protein, 11 aa, Mycobacterium tuberculosis
RSHTVSAEGGA

SEQ ID NO: 20495 - protein, 11 aa, Mycobacterium tuberculosis
SHTVSAEGGAA

SEQ ID NO: 20496 - protein, 11 aa, Mycobacterium tuberculosis
HTVSAEGGAAA

SEQ ID NO: 20497 - protein, 11 aa, Mycobacterium tuberculosis
TVSAEGGAAAV

SEQ ID NO: 20498 - protein, 11 aa, Mycobacterium tuberculosis
VSAEGGAAAVT

SEQ ID NO: 20499 - protein, 11 aa, Mycobacterium tuberculosis
SAEGGAAAVTG

SEQ ID NO: 20500 - protein, 11 aa, Mycobacterium tuberculosis
AEGGAAAVTGD

SEQ ID NO: 20501 - protein, 11 aa, Mycobacterium tuberculosis
EGGAAAVTGDD

SEQ ID NO: 20502 - protein, 11 aa, Mycobacterium tuberculosis
GGAAAVTGDDD

SEQ ID NO: 20503 - protein, 11 aa, Mycobacterium tuberculosis
GAAAVTGDDDS

SEQ ID NO: 20504 - protein, 11 aa, Mycobacterium tuberculosis
AAAVTGDDDSL

SEQ ID NO: 20505 - protein, 11 aa, Mycobacterium tuberculosis
AAVTGDDDSLD

SEQ ID NO: 20506 - protein, 11 aa, Mycobacterium tuberculosis
AVTGDDDSLDE

SEQ ID NO: 20507 - protein, 11 aa, Mycobacterium tuberculosis
VTGDDDSLDEH

SEQ ID NO: 20508 - protein, 11 aa, Mycobacterium tuberculosis
TGDDDSLDEHA

SEQ ID NO: 20509 - protein, 11 aa, Mycobacterium tuberculosis
GDDDSLDEHAH

SEQ ID NO: 20510 - protein, 11 aa, Mycobacterium tuberculosis
DDDSLDEHAHD

SEQ ID NO: 20511 - protein, 11 aa, Mycobacterium tuberculosis
DDSLDEHAHDT

SEQ ID NO: 20512 - protein, 11 aa, Mycobacterium tuberculosis
DSLDEHAHDTV

SEQ ID NO: 20513 - protein, 11 aa, Mycobacterium tuberculosis
SLDEHAHDTVS

SEQ ID NO: 20514 - protein, 11 aa, Mycobacterium tuberculosis
LDEHAHDTVSG

SEQ ID NO: 20515 - protein, 11 aa, Mycobacterium tuberculosis
DEHAHDTVSGG

SEQ ID NO: 20516 - protein, 11 aa, Mycobacterium tuberculosis
EHAHDTVSGGD

SEQ ID NO: 20517 - protein, 11 aa, Mycobacterium tuberculosis
HAHDTVSGGDW

SEQ ID NO: 20518 - protein, 11 aa, Mycobacterium tuberculosis
AHDTVSGGDWL

SEQ ID NO: 20519 - protein, 11 aa, Mycobacterium tuberculosis
HDTVSGGDWLC

SEQ ID NO: 20520 - protein, 11 aa, Mycobacterium tuberculosis
DTVSGGDWLCD

SEQ ID NO: 20521 - protein, 11 aa, Mycobacterium tuberculosis
TVSGGDWLCDQ

SEQ ID NO: 20522 - protein, 11 aa, Mycobacterium tuberculosis
VSGGDWLCDQD

SEQ ID NO: 20523 - protein, 11 aa, Mycobacterium tuberculosis
SGGDWLCDQDA

SEQ ID NO: 20524 - protein, 11 aa, Mycobacterium tuberculosis
GGDWLCDQDAV

SEQ ID NO: 20525 - protein, 11 aa, Mycobacterium tuberculosis
GDWLCDQDAVE

SEQ ID NO: 20526 - protein, 11 aa, Mycobacterium tuberculosis
DWLCDQDAVEA

SEQ ID NO: 20527 - protein, 11 aa, Mycobacterium tuberculosis
WLCDQDAVEAF

SEQ ID NO: 20528 - protein, 11 aa, Mycobacterium tuberculosis
LCDQDAVEAFV

SEQ ID NO: 20529 - protein, 11 aa, Mycobacterium tuberculosis
CDQDAVEAFVA

SEQ ID NO: 20530 - protein, 11 aa, Mycobacterium tuberculosis
DQDAVEAFVAE

SEQ ID NO: 20531 - protein, 11 aa, Mycobacterium tuberculosis
QDAVEAFVAEA

SEQ ID NO: 20532 - protein, 11 aa, Mycobacterium tuberculosis
DAVEAFVAEAP

SEQ ID NO: 20533 - protein, 11 aa, Mycobacterium tuberculosis
AVEAFVAEAPK

SEQ ID NO: 20534 - protein, 11 aa, Mycobacterium tuberculosis
VEAFVAEAPKE

SEQ ID NO: 20535 - protein, 11 aa, Mycobacterium tuberculosis
EAFVAEAPKEL

SEQ ID NO: 20536 - protein, 11 aa, Mycobacterium tuberculosis
AFVAEAPKELV

SEQ ID NO: 20537 - protein, 11 aa, Mycobacterium tuberculosis
FVAEAPKELVQ

SEQ ID NO: 20538 - protein, 11 aa, Mycobacterium tuberculosis
VAEAPKELVQL

SEQ ID NO: 20539 - protein, 11 aa, Mycobacterium tuberculosis
AEAPKELVQLE

SEQ ID NO: 20540 - protein, 11 aa, Mycobacterium tuberculosis
EAPKELVQLEH

SEQ ID NO: 20541 - protein, 11 aa, Mycobacterium tuberculosis
APKELVQLEHW

SEQ ID NO: 20542 - protein, 11 aa, Mycobacterium tuberculosis
PKELVQLEHWG

SEQ ID NO: 20543 - protein, 11 aa, Mycobacterium tuberculosis
KELVQLEHWGC

SEQ ID NO: 20544 - protein, 11 aa, Mycobacterium tuberculosis
ELVQLEHWGCP

SEQ ID NO: 20545 - protein, 11 aa, Mycobacterium tuberculosis
LVQLEHWGCPW

SEQ ID NO: 20546 - protein, 11 aa, Mycobacterium tuberculosis
VQLEHWGCPWS

SEQ ID NO: 20547 - protein, 11 aa, Mycobacterium tuberculosis
QLEHWGCPWSR

SEQ ID NO: 20548 - protein, 11 aa, Mycobacterium tuberculosis
LEHWGCPWSRK

SEQ ID NO: 20549 - protein, 11 aa, Mycobacterium tuberculosis
EHWGCPWSRKP

SEQ ID NO: 20550 - protein, 11 aa, Mycobacterium tuberculosis
HWGCPWSRKPD

SEQ ID NO: 20551 - protein, 11 aa, Mycobacterium tuberculosis
WGCPWSRKPDG

SEQ ID NO: 20552 - protein, 11 aa, Mycobacterium tuberculosis
GCPWSRKPDGR

SEQ ID NO: 20553 - protein, 11 aa, Mycobacterium tuberculosis
CPWSRKPDGRV

SEQ ID NO: 20554 - protein, 11 aa, Mycobacterium tuberculosis
PWSRKPDGRVA

SEQ ID NO: 20555 - protein, 11 aa, Mycobacterium tuberculosis
WSRKPDGRVAV

SEQ ID NO: 20556 - protein, 11 aa, Mycobacterium tuberculosis
SRKPDGRVAVR

SEQ ID NO: 20557 - protein, 11 aa, Mycobacterium tuberculosis
RKPDGRVAVRP

SEQ ID NO: 20558 - protein, 11 aa, Mycobacterium tuberculosis
KPDGRVAVRPF

SEQ ID NO: 20559 - protein, 11 aa, Mycobacterium tuberculosis
PDGRVAVRPFG

SEQ ID NO: 20560 - protein, 11 aa, Mycobacterium tuberculosis
DGRVAVRPFGG

SEQ ID NO: 20561 - protein, 11 aa, Mycobacterium tuberculosis
GRVAVRPFGGM

SEQ ID NO: 20562 - protein, 11 aa, Mycobacterium tuberculosis
RVAVRPFGGMK

SEQ ID NO: 20563 - protein, 11 aa, Mycobacterium tuberculosis
VAVRPFGGMKK

SEQ ID NO: 20564 - protein, 11 aa, Mycobacterium tuberculosis
AVRPFGGMKKL

SEQ ID NO: 20565 - protein, 11 aa, Mycobacterium tuberculosis
VRPFGGMKKLR

SEQ ID NO: 20566 - protein, 11 aa, Mycobacterium tuberculosis
RPFGGMKKLRT

SEQ ID NO: 20567 - protein, 11 aa, Mycobacterium tuberculosis
PFGGMKKLRTW

SEQ ID NO: 20568 - protein, 11 aa, Mycobacterium tuberculosis
FGGMKKLRTWF

SEQ ID NO: 20569 - protein, 11 aa, Mycobacterium tuberculosis
GGMKKLRTWFA

SEQ ID NO: 20570 - protein, 11 aa, Mycobacterium tuberculosis
GMKKLRTWFAA

SEQ ID NO: 20571 - protein, 11 aa, Mycobacterium tuberculosis
MKKLRTWFAAD

SEQ ID NO: 20572 - protein, 11 aa, Mycobacterium tuberculosis
KKLRTWFAADK

SEQ ID NO: 20573 - protein, 11 aa, Mycobacterium tuberculosis
KLRTWFAADKT

SEQ ID NO: 20574 - protein, 11 aa, Mycobacterium tuberculosis
LRTWFAADKTG

SEQ ID NO: 20575 - protein, 11 aa, Mycobacterium tuberculosis
RTWFAADKTGF

SEQ ID NO: 20576 - protein, 11 aa, Mycobacterium tuberculosis
TWFAADKTGFH

SEQ ID NO: 20577 - protein, 11 aa, Mycobacterium tuberculosis
WFAADKTGFHL

SEQ ID NO: 20578 - protein, 11 aa, Mycobacterium tuberculosis
FAADKTGFHLL

SEQ ID NO: 20579 - protein, 11 aa, Mycobacterium tuberculosis
AADKTGFHLLH

SEQ ID NO: 20580 - protein, 11 aa, Mycobacterium tuberculosis
ADKTGFHLLHT

SEQ ID NO: 20581 - protein, 11 aa, Mycobacterium tuberculosis
DKTGFHLLHTL

SEQ ID NO: 20582 - protein, 11 aa, Mycobacterium tuberculosis
KTGFHLLHTLF

SEQ ID NO: 20583 - protein, 11 aa, Mycobacterium tuberculosis
TGFHLLHTLFQ

SEQ ID NO: 20584 - protein, 11 aa, Mycobacterium tuberculosis
GFHLLHTLFQR

SEQ ID NO: 20585 - protein, 11 aa, Mycobacterium tuberculosis
FHLLHTLFQRL

SEQ ID NO: 20586 - protein, 11 aa, Mycobacterium tuberculosis
HLLHTLFQRLL

SEQ ID NO: 20587 - protein, 11 aa, Mycobacterium tuberculosis
LLHTLFQRLLT

SEQ ID NO: 20588 - protein, 11 aa, Mycobacterium tuberculosis
LHTLFQRLLTY

SEQ ID NO: 20589 - protein, 11 aa, Mycobacterium tuberculosis
HTLFQRLLTYS

SEQ ID NO: 20590 - protein, 11 aa, Mycobacterium tuberculosis
TLFQRLLTYSD

SEQ ID NO: 20591 - protein, 11 aa, Mycobacterium tuberculosis
LFQRLLTYSDV

SEQ ID NO: 20592 - protein, 11 aa, Mycobacterium tuberculosis
FQRLLTYSDVM

SEQ ID NO: 20593 - protein, 11 aa, Mycobacterium tuberculosis
QRLLTYSDVMR

SEQ ID NO: 20594 - protein, 11 aa, Mycobacterium tuberculosis
RLLTYSDVMRY

SEQ ID NO: 20595 - protein, 11 aa, Mycobacterium tuberculosis
LLTYSDVMRYD

SEQ ID NO: 20596 - protein, 11 aa, Mycobacterium tuberculosis
LTYSDVMRYDE

SEQ ID NO: 20597 - protein, 11 aa, Mycobacterium tuberculosis
TYSDVMRYDEW

SEQ ID NO: 20598 - protein, 11 aa, Mycobacterium tuberculosis
YSDVMRYDEWF

SEQ ID NO: 20599 - protein, 11 aa, Mycobacterium tuberculosis
SDVMRYDEWFA

SEQ ID NO: 20600 - protein, 11 aa, Mycobacterium tuberculosis
DVMRYDEWFAT

SEQ ID NO: 20601 - protein, 11 aa, Mycobacterium tuberculosis
VMRYDEWFATT

SEQ ID NO: 20602 - protein, 11 aa, Mycobacterium tuberculosis
MRYDEWFATTL

SEQ ID NO: 20603 - protein, 11 aa, Mycobacterium tuberculosis
RYDEWFATTLL

SEQ ID NO: 20604 - protein, 11 aa, Mycobacterium tuberculosis
YDEWFATTLLV

SEQ ID NO: 20605 - protein, 11 aa, Mycobacterium tuberculosis
DEWFATTLLVD

SEQ ID NO: 20606 - protein, 11 aa, Mycobacterium tuberculosis
EWFATTLLVDD

SEQ ID NO: 20607 - protein, 11 aa, Mycobacterium tuberculosis
WFATTLLVDDG

SEQ ID NO: 20608 - protein, 11 aa, Mycobacterium tuberculosis
FATTLLVDDGR

SEQ ID NO: 20609 - protein, 11 aa, Mycobacterium tuberculosis
ATTLLVDDGRV

SEQ ID NO: 20610 - protein, 11 aa, Mycobacterium tuberculosis
TTLLVDDGRVC

SEQ ID NO: 20611 - protein, 11 aa, Mycobacterium tuberculosis
TLLVDDGRVCG

SEQ ID NO: 20612 - protein, 11 aa, Mycobacterium tuberculosis
LLVDDGRVCGL

SEQ ID NO: 20613 - protein, 11 aa, Mycobacterium tuberculosis
LVDDGRVCGLV

SEQ ID NO: 20614 - protein, 11 aa, Mycobacterium tuberculosis
VDDGRVCGLVA

SEQ ID NO: 20615 - protein, 11 aa, Mycobacterium tuberculosis
DDGRVCGLVAI

SEQ ID NO: 20616 - protein, 11 aa, Mycobacterium tuberculosis
DGRVCGLVAIE

SEQ ID NO: 20617 - protein, 11 aa, Mycobacterium tuberculosis
GRVCGLVAIEL

SEQ ID NO: 20618 - protein, 11 aa, Mycobacterium tuberculosis
RVCGLVAIELA

SEQ ID NO: 20619 - protein, 11 aa, Mycobacterium tuberculosis
VCGLVAIELAT

SEQ ID NO: 20620 - protein, 11 aa, Mycobacterium tuberculosis
CGLVAIELATG

SEQ ID NO: 20621 - protein, 11 aa, Mycobacterium tuberculosis
GLVAIELATGR

SEQ ID NO: 20622 - protein, 11 aa, Mycobacterium tuberculosis
LVAIELATGRI

SEQ ID NO: 20623 - protein, 11 aa, Mycobacterium tuberculosis
VAIELATGRIE

SEQ ID NO: 20624 - protein, 11 aa, Mycobacterium tuberculosis
AIELATGRIET

SEQ ID NO: 20625 - protein, 11 aa, Mycobacterium tuberculosis
IELATGRIETI

SEQ ID NO: 20626 - protein, 11 aa, Mycobacterium tuberculosis
ELATGRIETIL

SEQ ID NO: 20627 - protein, 11 aa, Mycobacterium tuberculosis
LATGRIETILA

SEQ ID NO: 20628 - protein, 11 aa, Mycobacterium tuberculosis
ATGRIETILAD

SEQ ID NO: 20629 - protein, 11 aa, Mycobacterium tuberculosis
TGRIETILADA

SEQ ID NO: 20630 - protein, 11 aa, Mycobacterium tuberculosis
GRIETILADAV

SEQ ID NO: 20631 - protein, 11 aa, Mycobacterium tuberculosis
RIETILADAVI

SEQ ID NO: 20632 - protein, 11 aa, Mycobacterium tuberculosis
IETILADAVIL

SEQ ID NO: 20633 - protein, 11 aa, Mycobacterium tuberculosis
ETILADAVILC

SEQ ID NO: 20634 - protein, 11 aa, Mycobacterium tuberculosis
TILADAVILCT

SEQ ID NO: 20635 - protein, 11 aa, Mycobacterium tuberculosis
ILADAVILCTG

SEQ ID NO: 20636 - protein, 11 aa, Mycobacterium tuberculosis
LADAVILCTGG

SEQ ID NO: 20637 - protein, 11 aa, Mycobacterium tuberculosis
ADAVILCTGGC

SEQ ID NO: 20638 - protein, 11 aa, Mycobacterium tuberculosis
DAVILCTGGCG

SEQ ID NO: 20639 - protein, 11 aa, Mycobacterium tuberculosis
AVILCTGGCGR

SEQ ID NO: 20640 - protein, 11 aa, Mycobacterium tuberculosis
VILCTGGCGRV

SEQ ID NO: 20641 - protein, 11 aa, Mycobacterium tuberculosis
ILCTGGCGRVF

SEQ ID NO: 20642 - protein, 11 aa, Mycobacterium tuberculosis
LCTGGCGRVFP

SEQ ID NO: 20643 - protein, 11 aa, Mycobacterium tuberculosis
CTGGCGRVFPF

SEQ ID NO: 20644 - protein, 11 aa, Mycobacterium tuberculosis
TGGCGRVFPFT

SEQ ID NO: 20645 - protein, 11 aa, Mycobacterium tuberculosis
GGCGRVFPFTT

SEQ ID NO: 20646 - protein, 11 aa, Mycobacterium tuberculosis
GCGRVFPFTTN

SEQ ID NO: 20647 - protein, 11 aa, Mycobacterium tuberculosis
CGRVFPFTTNA

SEQ ID NO: 20648 - protein, 11 aa, Mycobacterium tuberculosis
GRVFPFTTNAN

SEQ ID NO: 20649 - protein, 11 aa, Mycobacterium tuberculosis
RVFPFTTNANI

SEQ ID NO: 20650 - protein, 11 aa, Mycobacterium tuberculosis
VFPFTTNANIK

SEQ ID NO: 20651 - protein, 11 aa, Mycobacterium tuberculosis
FPFTTNANIKT

SEQ ID NO: 20652 - protein, 11 aa, Mycobacterium tuberculosis
PFTTNANIKTG

SEQ ID NO: 20653 - protein, 11 aa, Mycobacterium tuberculosis
FTTNANIKTGD

SEQ ID NO: 20654 - protein, 11 aa, Mycobacterium tuberculosis
TTNANIKTGDG

SEQ ID NO: 20655 - protein, 11 aa, Mycobacterium tuberculosis
TNANIKTGDGM

SEQ ID NO: 20656 - protein, 11 aa, Mycobacterium tuberculosis
NANIKTGDGMA

SEQ ID NO: 20657 - protein, 11 aa, Mycobacterium tuberculosis
ANIKTGDGMAL

SEQ ID NO: 20658 - protein, 11 aa, Mycobacterium tuberculosis
NIKTGDGMALA

SEQ ID NO: 20659 - protein, 11 aa, Mycobacterium tuberculosis
IKTGDGMALAF

SEQ ID NO: 20660 - protein, 11 aa, Mycobacterium tuberculosis
KTGDGMALAFR

SEQ ID NO: 20661 - protein, 11 aa, Mycobacterium tuberculosis
TGDGMALAFRA

SEQ ID NO: 20662 - protein, 11 aa, Mycobacterium tuberculosis
GDGMALAFRAG

SEQ ID NO: 20663 - protein, 11 aa, Mycobacterium tuberculosis
DGMALAFRAGA

SEQ ID NO: 20664 - protein, 11 aa, Mycobacterium tuberculosis
GMALAFRAGAP

SEQ ID NO: 20665 - protein, 11 aa, Mycobacterium tuberculosis
MALAFRAGAPL

SEQ ID NO: 20666 - protein, 11 aa, Mycobacterium tuberculosis
ALAFRAGAPLK

SEQ ID NO: 20667 - protein, 11 aa, Mycobacterium tuberculosis
LAFRAGAPLKD

SEQ ID NO: 20668 - protein, 11 aa, Mycobacterium tuberculosis
AFRAGAPLKDM

SEQ ID NO: 20669 - protein, 11 aa, Mycobacterium tuberculosis
FRAGAPLKDME

SEQ ID NO: 20670 - protein, 11 aa, Mycobacterium tuberculosis
RAGAPLKDMEF

SEQ ID NO: 20671 - protein, 11 aa, Mycobacterium tuberculosis
AGAPLKDMEFV

SEQ ID NO: 20672 - protein, 11 aa, Mycobacterium tuberculosis
GAPLKDMEFVQ

SEQ ID NO: 20673 - protein, 11 aa, Mycobacterium tuberculosis
APLKDMEFVQY

SEQ ID NO: 20674 - protein, 11 aa, Mycobacterium tuberculosis
PLKDMEFVQYH

SEQ ID NO: 20675 - protein, 11 aa, Mycobacterium tuberculosis
LKDMEFVQYHP

SEQ ID NO: 20676 - protein, 11 aa, Mycobacterium tuberculosis
KDMEFVQYHPT

SEQ ID NO: 20677 - protein, 11 aa, Mycobacterium tuberculosis
DMEFVQYHPTG

SEQ ID NO: 20678 - protein, 11 aa, Mycobacterium tuberculosis
MEFVQYHPTGL

SEQ ID NO: 20679 - protein, 11 aa, Mycobacterium tuberculosis
EFVQYHPTGLP

SEQ ID NO: 20680 - protein, 11 aa, Mycobacterium tuberculosis
FVQYHPTGLPF

SEQ ID NO: 20681 - protein, 11 aa, Mycobacterium tuberculosis
VQYHPTGLPFT

SEQ ID NO: 20682 - protein, 11 aa, Mycobacterium tuberculosis
QYHPTGLPFTG

SEQ ID NO: 20683 - protein, 11 aa, Mycobacterium tuberculosis
YHPTGLPFTGI

SEQ ID NO: 20684 - protein, 11 aa, Mycobacterium tuberculosis
HPTGLPFTGIL

SEQ ID NO: 20685 - protein, 11 aa, Mycobacterium tuberculosis
PTGLPFTGILI

SEQ ID NO: 20686 - protein, 11 aa, Mycobacterium tuberculosis
TGLPFTGILIT

SEQ ID NO: 20687 - protein, 11 aa, Mycobacterium tuberculosis
GLPFTGILITE

SEQ ID NO: 20688 - protein, 11 aa, Mycobacterium tuberculosis
LPFTGILITEA

SEQ ID NO: 20689 - protein, 11 aa, Mycobacterium tuberculosis
PFTGILITEAA

SEQ ID NO: 20690 - protein, 11 aa, Mycobacterium tuberculosis
FTGILITEAAR

SEQ ID NO: 20691 - protein, 11 aa, Mycobacterium tuberculosis
TGILITEAARA

SEQ ID NO: 20692 - protein, 11 aa, Mycobacterium tuberculosis
GILITEAARAE

SEQ ID NO: 20693 - protein, 11 aa, Mycobacterium tuberculosis
ILITEAARAEG

SEQ ID NO: 20694 - protein, 11 aa, Mycobacterium tuberculosis
LITEAARAEGG

SEQ ID NO: 20695 - protein, 11 aa, Mycobacterium tuberculosis
ITEAARAEGGW

SEQ ID NO: 20696 - protein, 11 aa, Mycobacterium tuberculosis
TEAARAEGGWL

SEQ ID NO: 20697 - protein, 11 aa, Mycobacterium tuberculosis
EAARAEGGWLL

SEQ ID NO: 20698 - protein, 11 aa, Mycobacterium tuberculosis
AARAEGGWLLN

SEQ ID NO: 20699 - protein, 11 aa, Mycobacterium tuberculosis
ARAEGGWLLNK

SEQ ID NO: 20700 - protein, 11 aa, Mycobacterium tuberculosis
RAEGGWLLNKD

SEQ ID NO: 20701 - protein, 11 aa, Mycobacterium tuberculosis
AEGGWLLNKDG

SEQ ID NO: 20702 - protein, 11 aa, Mycobacterium tuberculosis
EGGWLLNKDGY

SEQ ID NO: 20703 - protein, 11 aa, Mycobacterium tuberculosis
GGWLLNKDGYR

SEQ ID NO: 20704 - protein, 11 aa, Mycobacterium tuberculosis
GWLLNKDGYRY

SEQ ID NO: 20705 - protein, 11 aa, Mycobacterium tuberculosis
WLLNKDGYRYL

SEQ ID NO: 20706 - protein, 11 aa, Mycobacterium tuberculosis
LLNKDGYRYLQ

SEQ ID NO: 20707 - protein, 11 aa, Mycobacterium tuberculosis
LNKDGYRYLQD

SEQ ID NO: 20708 - protein, 11 aa, Mycobacterium tuberculosis
NKDGYRYLQDY

SEQ ID NO: 20709 - protein, 11 aa, Mycobacterium tuberculosis
KDGYRYLQDYD

SEQ ID NO: 20710 - protein, 11 aa, Mycobacterium tuberculosis
DGYRYLQDYDL

SEQ ID NO: 20711 - protein, 11 aa, Mycobacterium tuberculosis
GYRYLQDYDLG

SEQ ID NO: 20712 - protein, 11 aa, Mycobacterium tuberculosis
YRYLQDYDLGK

SEQ ID NO: 20713 - protein, 11 aa, Mycobacterium tuberculosis
RYLQDYDLGKP

SEQ ID NO: 20714 - protein, 11 aa, Mycobacterium tuberculosis
YLQDYDLGKPT

SEQ ID NO: 20715 - protein, 11 aa, Mycobacterium tuberculosis
LQDYDLGKPTP

SEQ ID NO: 20716 - protein, 11 aa, Mycobacterium tuberculosis
QDYDLGKPTPE

SEQ ID NO: 20717 - protein, 11 aa, Mycobacterium tuberculosis
DYDLGKPTPEP

SEQ ID NO: 20718 - protein, 11 aa, Mycobacterium tuberculosis
YDLGKPTPEPR

SEQ ID NO: 20719 - protein, 11 aa, Mycobacterium tuberculosis
DLGKPTPEPRL

SEQ ID NO: 20720 - protein, 11 aa, Mycobacterium tuberculosis
LGKPTPEPRLR

SEQ ID NO: 20721 - protein, 11 aa, Mycobacterium tuberculosis
GKPTPEPRLRS

SEQ ID NO: 20722 - protein, 11 aa, Mycobacterium tuberculosis
KPTPEPRLRSM

SEQ ID NO: 20723 - protein, 11 aa, Mycobacterium tuberculosis
PTPEPRLRSME

SEQ ID NO: 20724 - protein, 11 aa, Mycobacterium tuberculosis
TPEPRLRSMEL

SEQ ID NO: 20725 - protein, 11 aa, Mycobacterium tuberculosis
PEPRLRSMELG

SEQ ID NO: 20726 - protein, 11 aa, Mycobacterium tuberculosis
EPRLRSMELGP

SEQ ID NO: 20727 - protein, 11 aa, Mycobacterium tuberculosis
PRLRSMELGPR

SEQ ID NO: 20728 - protein, 11 aa, Mycobacterium tuberculosis
RLRSMELGPRD

SEQ ID NO: 20729 - protein, 11 aa, Mycobacterium tuberculosis
LRSMELGPRDR

SEQ ID NO: 20730 - protein, 11 aa, Mycobacterium tuberculosis
RSMELGPRDRL

SEQ ID NO: 20731 - protein, 11 aa, Mycobacterium tuberculosis
SMELGPRDRLS

SEQ ID NO: 20732 - protein, 11 aa, Mycobacterium tuberculosis
MELGPRDRLSQ

SEQ ID NO: 20733 - protein, 11 aa, Mycobacterium tuberculosis
ELGPRDRLSQA

SEQ ID NO: 20734 - protein, 11 aa, Mycobacterium tuberculosis
LGPRDRLSQAF

SEQ ID NO: 20735 - protein, 11 aa, Mycobacterium tuberculosis
GPRDRLSQAFV

SEQ ID NO: 20736 - protein, 11 aa, Mycobacterium tuberculosis
PRDRLSQAFVH

SEQ ID NO: 20737 - protein, 11 aa, Mycobacterium tuberculosis
RDRLSQAFVHE

SEQ ID NO: 20738 - protein, 11 aa, Mycobacterium tuberculosis
DRLSQAFVHEH

SEQ ID NO: 20739 - protein, 11 aa, Mycobacterium tuberculosis
RLSQAFVHEHN

SEQ ID NO: 20740 - protein, 11 aa, Mycobacterium tuberculosis
LSQAFVHEHNK

SEQ ID NO: 20741 - protein, 11 aa, Mycobacterium tuberculosis
SQAFVHEHNKG

SEQ ID NO: 20742 - protein, 11 aa, Mycobacterium tuberculosis
QAFVHEHNKGR

SEQ ID NO: 20743 - protein, 11 aa, Mycobacterium tuberculosis
AFVHEHNKGRT

SEQ ID NO: 20744 - protein, 11 aa, Mycobacterium tuberculosis
FVHEHNKGRTV

SEQ ID NO: 20745 - protein, 11 aa, Mycobacterium tuberculosis
VHEHNKGRTVD

SEQ ID NO: 20746 - protein, 11 aa, Mycobacterium tuberculosis
HEHNKGRTVDT

SEQ ID NO: 20747 - protein, 11 aa, Mycobacterium tuberculosis
EHNKGRTVDTP

SEQ ID NO: 20748 - protein, 11 aa, Mycobacterium tuberculosis
HNKGRTVDTPY

SEQ ID NO: 20749 - protein, 11 aa, Mycobacterium tuberculosis
NKGRTVDTPYG

SEQ ID NO: 20750 - protein, 11 aa, Mycobacterium tuberculosis
KGRTVDTPYGP

SEQ ID NO: 20751 - protein, 11 aa, Mycobacterium tuberculosis
GRTVDTPYGPV

SEQ ID NO: 20752 - protein, 11 aa, Mycobacterium tuberculosis
RTVDTPYGPVV

SEQ ID NO: 20753 - protein, 11 aa, Mycobacterium tuberculosis
TVDTPYGPVVY

SEQ ID NO: 20754 - protein, 11 aa, Mycobacterium tuberculosis
VDTPYGPVVYL

SEQ ID NO: 20755 - protein, 11 aa, Mycobacterium tuberculosis
DTPYGPVVYLD

SEQ ID NO: 20756 - protein, 11 aa, Mycobacterium tuberculosis
TPYGPVVYLDL

SEQ ID NO: 20757 - protein, 11 aa, Mycobacterium tuberculosis
PYGPVVYLDLR

SEQ ID NO: 20758 - protein, 11 aa, Mycobacterium tuberculosis
YGPVVYLDLRH

SEQ ID NO: 20759 - protein, 11 aa, Mycobacterium tuberculosis
GPVVYLDLRHL

SEQ ID NO: 20760 - protein, 11 aa, Mycobacterium tuberculosis
PVVYLDLRHLG

SEQ ID NO: 20761 - protein, 11 aa, Mycobacterium tuberculosis
VVYLDLRHLGA

SEQ ID NO: 20762 - protein, 11 aa, Mycobacterium tuberculosis
VYLDLRHLGAD

SEQ ID NO: 20763 - protein, 11 aa, Mycobacterium tuberculosis
YLDLRHLGADL

SEQ ID NO: 20764 - protein, 11 aa, Mycobacterium tuberculosis
LDLRHLGADLI

SEQ ID NO: 20765 - protein, 11 aa, Mycobacterium tuberculosis
DLRHLGADLID

SEQ ID NO: 20766 - protein, 11 aa, Mycobacterium tuberculosis
LRHLGADLIDA

SEQ ID NO: 20767 - protein, 11 aa, Mycobacterium tuberculosis
RHLGADLIDAK

SEQ ID NO: 20768 - protein, 11 aa, Mycobacterium tuberculosis
HLGADLIDAKL

SEQ ID NO: 20769 - protein, 11 aa, Mycobacterium tuberculosis
LGADLIDAKLP

SEQ ID NO: 20770 - protein, 11 aa, Mycobacterium tuberculosis
GADLIDAKLPF

SEQ ID NO: 20771 - protein, 11 aa, Mycobacterium tuberculosis
ADLIDAKLPFV

SEQ ID NO: 20772 - protein, 11 aa, Mycobacterium tuberculosis
DLIDAKLPFVR

SEQ ID NO: 20773 - protein, 11 aa, Mycobacterium tuberculosis
LIDAKLPFVRE

SEQ ID NO: 20774 - protein, 11 aa, Mycobacterium tuberculosis
IDAKLPFVREL

SEQ ID NO: 20775 - protein, 11 aa, Mycobacterium tuberculosis
DAKLPFVRELC

SEQ ID NO: 20776 - protein, 11 aa, Mycobacterium tuberculosis
AKLPFVRELCR

SEQ ID NO: 20777 - protein, 11 aa, Mycobacterium tuberculosis
KLPFVRELCRD

SEQ ID NO: 20778 - protein, 11 aa, Mycobacterium tuberculosis
LPFVRELCRDY

SEQ ID NO: 20779 - protein, 11 aa, Mycobacterium tuberculosis
PFVRELCRDYQ

SEQ ID NO: 20780 - protein, 11 aa, Mycobacterium tuberculosis
FVRELCRDYQH

SEQ ID NO: 20781 - protein, 11 aa, Mycobacterium tuberculosis
VRELCRDYQHI

SEQ ID NO: 20782 - protein, 11 aa, Mycobacterium tuberculosis
RELCRDYQHID

SEQ ID NO: 20783 - protein, 11 aa, Mycobacterium tuberculosis
ELCRDYQHIDP

SEQ ID NO: 20784 - protein, 11 aa, Mycobacterium tuberculosis
LCRDYQHIDPV

SEQ ID NO: 20785 - protein, 11 aa, Mycobacterium tuberculosis
CRDYQHIDPVV

SEQ ID NO: 20786 - protein, 11 aa, Mycobacterium tuberculosis
RDYQHIDPVVE

SEQ ID NO: 20787 - protein, 11 aa, Mycobacterium tuberculosis
DYQHIDPVVEL

SEQ ID NO: 20788 - protein, 11 aa, Mycobacterium tuberculosis
YQHIDPVVELV

SEQ ID NO: 20789 - protein, 11 aa, Mycobacterium tuberculosis
QHIDPVVELVP

SEQ ID NO: 20790 - protein, 11 aa, Mycobacterium tuberculosis
HIDPVVELVPV

SEQ ID NO: 20791 - protein, 11 aa, Mycobacterium tuberculosis
IDPVVELVPVR

SEQ ID NO: 20792 - protein, 11 aa, Mycobacterium tuberculosis
DPVVELVPVRP

SEQ ID NO: 20793 - protein, 11 aa, Mycobacterium tuberculosis
PVVELVPVRPV

SEQ ID NO: 20794 - protein, 11 aa, Mycobacterium tuberculosis
VVELVPVRPVV

SEQ ID NO: 20795 - protein, 11 aa, Mycobacterium tuberculosis
VELVPVRPVVH

SEQ ID NO: 20796 - protein, 11 aa, Mycobacterium tuberculosis
ELVPVRPVVHY

SEQ ID NO: 20797 - protein, 11 aa, Mycobacterium tuberculosis
LVPVRPVVHYM

SEQ ID NO: 20798 - protein, 11 aa, Mycobacterium tuberculosis
VPVRPVVHYMM

SEQ ID NO: 20799 - protein, 11 aa, Mycobacterium tuberculosis
PVRPVVHYMMG

SEQ ID NO: 20800 - protein, 11 aa, Mycobacterium tuberculosis
VRPVVHYMMGG

SEQ ID NO: 20801 - protein, 11 aa, Mycobacterium tuberculosis
RPVVHYMMGGV

SEQ ID NO: 20802 - protein, 11 aa, Mycobacterium tuberculosis
PVVHYMMGGVH

SEQ ID NO: 20803 - protein, 11 aa, Mycobacterium tuberculosis
VVHYMMGGVHT

SEQ ID NO: 20804 - protein, 11 aa, Mycobacterium tuberculosis
VHYMMGGVHTD

SEQ ID NO: 20805 - protein, 11 aa, Mycobacterium tuberculosis
HYMMGGVHTDI

SEQ ID NO: 20806 - protein, 11 aa, Mycobacterium tuberculosis
YMMGGVHTDIN

SEQ ID NO: 20807 - protein, 11 aa, Mycobacterium tuberculosis
MMGGVHTDING

SEQ ID NO: 20808 - protein, 11 aa, Mycobacterium tuberculosis
MGGVHTDINGA

SEQ ID NO: 20809 - protein, 11 aa, Mycobacterium tuberculosis
GGVHTDINGAT

SEQ ID NO: 20810 - protein, 11 aa, Mycobacterium tuberculosis
GVHTDINGATT

SEQ ID NO: 20811 - protein, 11 aa, Mycobacterium tuberculosis
VHTDINGATTL

SEQ ID NO: 20812 - protein, 11 aa, Mycobacterium tuberculosis
HTDINGATTLP

SEQ ID NO: 20813 - protein, 11 aa, Mycobacterium tuberculosis
TDINGATTLPG

SEQ ID NO: 20814 - protein, 11 aa, Mycobacterium tuberculosis
DINGATTLPGL

SEQ ID NO: 20815 - protein, 11 aa, Mycobacterium tuberculosis
INGATTLPGLY

SEQ ID NO: 20816 - protein, 11 aa, Mycobacterium tuberculosis
NGATTLPGLYA

SEQ ID NO: 20817 - protein, 11 aa, Mycobacterium tuberculosis
GATTLPGLYAA

SEQ ID NO: 20818 - protein, 11 aa, Mycobacterium tuberculosis
ATTLPGLYAAG

SEQ ID NO: 20819 - protein, 11 aa, Mycobacterium tuberculosis
TTLPGLYAAGE

SEQ ID NO: 20820 - protein, 11 aa, Mycobacterium tuberculosis
TLPGLYAAGET

SEQ ID NO: 20821 - protein, 11 aa, Mycobacterium tuberculosis
LPGLYAAGETA

SEQ ID NO: 20822 - protein, 11 aa, Mycobacterium tuberculosis
PGLYAAGETAC

SEQ ID NO: 20823 - protein, 11 aa, Mycobacterium tuberculosis
GLYAAGETACV

SEQ ID NO: 20824 - protein, 11 aa, Mycobacterium tuberculosis
LYAAGETACVS

SEQ ID NO: 20825 - protein, 11 aa, Mycobacterium tuberculosis
YAAGETACVSI

SEQ ID NO: 20826 - protein, 11 aa, Mycobacterium tuberculosis
AAGETACVSIN

SEQ ID NO: 20827 - protein, 11 aa, Mycobacterium tuberculosis
AGETACVSING

SEQ ID NO: 20828 - protein, 11 aa, Mycobacterium tuberculosis
GETACVSINGA

SEQ ID NO: 20829 - protein, 11 aa, Mycobacterium tuberculosis
ETACVSINGAN

SEQ ID NO: 20830 - protein, 11 aa, Mycobacterium tuberculosis
TACVSINGANR

SEQ ID NO: 20831 - protein, 11 aa, Mycobacterium tuberculosis
ACVSINGANRL

SEQ ID NO: 20832 - protein, 11 aa, Mycobacterium tuberculosis
CVSINGANRLG

SEQ ID NO: 20833 - protein, 11 aa, Mycobacterium tuberculosis
VSINGANRLGS

SEQ ID NO: 20834 - protein, 11 aa, Mycobacterium tuberculosis
SINGANRLGSN

SEQ ID NO: 20835 - protein, 11 aa, Mycobacterium tuberculosis
INGANRLGSNS

SEQ ID NO: 20836 - protein, 11 aa, Mycobacterium tuberculosis
NGANRLGSNSL

SEQ ID NO: 20837 - protein, 11 aa, Mycobacterium tuberculosis
GANRLGSNSLP

SEQ ID NO: 20838 - protein, 11 aa, Mycobacterium tuberculosis
ANRLGSNSLPE

SEQ ID NO: 20839 - protein, 11 aa, Mycobacterium tuberculosis
NRLGSNSLPEL

SEQ ID NO: 20840 - protein, 11 aa, Mycobacterium tuberculosis
RLGSNSLPELL

SEQ ID NO: 20841 - protein, 11 aa, Mycobacterium tuberculosis
LGSNSLPELLV

SEQ ID NO: 20842 - protein, 11 aa, Mycobacterium tuberculosis
GSNSLPELLVF

SEQ ID NO: 20843 - protein, 11 aa, Mycobacterium tuberculosis
SNSLPELLVFG

SEQ ID NO: 20844 - protein, 11 aa, Mycobacterium tuberculosis
NSLPELLVFGA

SEQ ID NO: 20845 - protein, 11 aa, Mycobacterium tuberculosis
SLPELLVFGAR

SEQ ID NO: 20846 - protein, 11 aa, Mycobacterium tuberculosis
LPELLVFGARA

SEQ ID NO: 20847 - protein, 11 aa, Mycobacterium tuberculosis
PELLVFGARAG

SEQ ID NO: 20848 - protein, 11 aa, Mycobacterium tuberculosis
ELLVFGARAGR

SEQ ID NO: 20849 - protein, 11 aa, Mycobacterium tuberculosis
LLVFGARAGRA

SEQ ID NO: 20850 - protein, 11 aa, Mycobacterium tuberculosis
LVFGARAGRAA

SEQ ID NO: 20851 - protein, 11 aa, Mycobacterium tuberculosis
VFGARAGRAAA

SEQ ID NO: 20852 - protein, 11 aa, Mycobacterium tuberculosis
FGARAGRAAAD

SEQ ID NO: 20853 - protein, 11 aa, Mycobacterium tuberculosis
GARAGRAAADY

SEQ ID NO: 20854 - protein, 11 aa, Mycobacterium tuberculosis
ARAGRAAADYA

SEQ ID NO: 20855 - protein, 11 aa, Mycobacterium tuberculosis
RAGRAAADYAA

SEQ ID NO: 20856 - protein, 11 aa, Mycobacterium tuberculosis
AGRAAADYAAR

SEQ ID NO: 20857 - protein, 11 aa, Mycobacterium tuberculosis
GRAAADYAARH

SEQ ID NO: 20858 - protein, 11 aa, Mycobacterium tuberculosis
RAAADYAARHQ

SEQ ID NO: 20859 - protein, 11 aa, Mycobacterium tuberculosis
AAADYAARHQK

SEQ ID NO: 20860 - protein, 11 aa, Mycobacterium tuberculosis
AADYAARHQKS

SEQ ID NO: 20861 - protein, 11 aa, Mycobacterium tuberculosis
ADYAARHQKSD

SEQ ID NO: 20862 - protein, 11 aa, Mycobacterium tuberculosis
DYAARHQKSDR

SEQ ID NO: 20863 - protein, 11 aa, Mycobacterium tuberculosis
YAARHQKSDRG

SEQ ID NO: 20864 - protein, 11 aa, Mycobacterium tuberculosis
AARHQKSDRGP

SEQ ID NO: 20865 - protein, 11 aa, Mycobacterium tuberculosis
ARHQKSDRGPS

SEQ ID NO: 20866 - protein, 11 aa, Mycobacterium tuberculosis
RHQKSDRGPSS

SEQ ID NO: 20867 - protein, 11 aa, Mycobacterium tuberculosis
HQKSDRGPSSA

SEQ ID NO: 20868 - protein, 11 aa, Mycobacterium tuberculosis
QKSDRGPSSAV

SEQ ID NO: 20869 - protein, 11 aa, Mycobacterium tuberculosis
KSDRGPSSAVR

SEQ ID NO: 20870 - protein, 11 aa, Mycobacterium tuberculosis
SDRGPSSAVRA

SEQ ID NO: 20871 - protein, 11 aa, Mycobacterium tuberculosis
DRGPSSAVRAQ

SEQ ID NO: 20872 - protein, 11 aa, Mycobacterium tuberculosis
RGPSSAVRAQA

SEQ ID NO: 20873 - protein, 11 aa, Mycobacterium tuberculosis
GPSSAVRAQAR

SEQ ID NO: 20874 - protein, 11 aa, Mycobacterium tuberculosis
PSSAVRAQART

SEQ ID NO: 20875 - protein, 11 aa, Mycobacterium tuberculosis
SSAVRAQARTE

SEQ ID NO: 20876 - protein, 11 aa, Mycobacterium tuberculosis
SAVRAQARTEA

SEQ ID NO: 20877 - protein, 11 aa, Mycobacterium tuberculosis
AVRAQARTEAL

SEQ ID NO: 20878 - protein, 11 aa, Mycobacterium tuberculosis
VRAQARTEALR

SEQ ID NO: 20879 - protein, 11 aa, Mycobacterium tuberculosis
RAQARTEALRL

SEQ ID NO: 20880 - protein, 11 aa, Mycobacterium tuberculosis
AQARTEALRLE

SEQ ID NO: 20881 - protein, 11 aa, Mycobacterium tuberculosis
QARTEALRLER

SEQ ID NO: 20882 - protein, 11 aa, Mycobacterium tuberculosis
ARTEALRLERE

SEQ ID NO: 20883 - protein, 11 aa, Mycobacterium tuberculosis
RTEALRLEREL

SEQ ID NO: 20884 - protein, 11 aa, Mycobacterium tuberculosis
TEALRLERELS

SEQ ID NO: 20885 - protein, 11 aa, Mycobacterium tuberculosis
EALRLERELSR

SEQ ID NO: 20886 - protein, 11 aa, Mycobacterium tuberculosis
ALRLERELSRH

SEQ ID NO: 20887 - protein, 11 aa, Mycobacterium tuberculosis
LRLERELSRHG

SEQ ID NO: 20888 - protein, 11 aa, Mycobacterium tuberculosis
RLERELSRHGQ

SEQ ID NO: 20889 - protein, 11 aa, Mycobacterium tuberculosis
LERELSRHGQG

SEQ ID NO: 20890 - protein, 11 aa, Mycobacterium tuberculosis
ERELSRHGQGG

SEQ ID NO: 20891 - protein, 11 aa, Mycobacterium tuberculosis
RELSRHGQGGE

SEQ ID NO: 20892 - protein, 11 aa, Mycobacterium tuberculosis
ELSRHGQGGER

SEQ ID NO: 20893 - protein, 11 aa, Mycobacterium tuberculosis
LSRHGQGGERI

SEQ ID NO: 20894 - protein, 11 aa, Mycobacterium tuberculosis
SRHGQGGERIA

SEQ ID NO: 20895 - protein, 11 aa, Mycobacterium tuberculosis
RHGQGGERIAD

SEQ ID NO: 20896 - protein, 11 aa, Mycobacterium tuberculosis
HGQGGERIADI

SEQ ID NO: 20897 - protein, 11 aa, Mycobacterium tuberculosis
GQGGERIADIR

SEQ ID NO: 20898 - protein, 11 aa, Mycobacterium tuberculosis
QGGERIADIRA

SEQ ID NO: 20899 - protein, 11 aa, Mycobacterium tuberculosis
GGERIADIRAD

SEQ ID NO: 20900 - protein, 11 aa, Mycobacterium tuberculosis
GERIADIRADM

SEQ ID NO: 20901 - protein, 11 aa, Mycobacterium tuberculosis
ERIADIRADMQ

SEQ ID NO: 20902 - protein, 11 aa, Mycobacterium tuberculosis
RIADIRADMQA

SEQ ID NO: 20903 - protein, 11 aa, Mycobacterium tuberculosis
IADIRADMQAT

SEQ ID NO: 20904 - protein, 11 aa, Mycobacterium tuberculosis
ADIRADMQATL

SEQ ID NO: 20905 - protein, 11 aa, Mycobacterium tuberculosis
DIRADMQATLE

SEQ ID NO: 20906 - protein, 11 aa, Mycobacterium tuberculosis
IRADMQATLES

SEQ ID NO: 20907 - protein, 11 aa, Mycobacterium tuberculosis
RADMQATLESA

SEQ ID NO: 20908 - protein, 11 aa, Mycobacterium tuberculosis
ADMQATLESAA

SEQ ID NO: 20909 - protein, 11 aa, Mycobacterium tuberculosis
DMQATLESAAG

SEQ ID NO: 20910 - protein, 11 aa, Mycobacterium tuberculosis
MQATLESAAGI

SEQ ID NO: 20911 - protein, 11 aa, Mycobacterium tuberculosis
QATLESAAGIY

SEQ ID NO: 20912 - protein, 11 aa, Mycobacterium tuberculosis
ATLESAAGIYR

SEQ ID NO: 20913 - protein, 11 aa, Mycobacterium tuberculosis
TLESAAGIYRD

SEQ ID NO: 20914 - protein, 11 aa, Mycobacterium tuberculosis
LESAAGIYRDG

SEQ ID NO: 20915 - protein, 11 aa, Mycobacterium tuberculosis
ESAAGIYRDGP

SEQ ID NO: 20916 - protein, 11 aa, Mycobacterium tuberculosis
SAAGIYRDGPT

SEQ ID NO: 20917 - protein, 11 aa, Mycobacterium tuberculosis
AAGIYRDGPTL

SEQ ID NO: 20918 - protein, 11 aa, Mycobacterium tuberculosis
AGIYRDGPTLT

SEQ ID NO: 20919 - protein, 11 aa, Mycobacterium tuberculosis
GIYRDGPTLTK

SEQ ID NO: 20920 - protein, 11 aa, Mycobacterium tuberculosis
IYRDGPTLTKA

SEQ ID NO: 20921 - protein, 11 aa, Mycobacterium tuberculosis
YRDGPTLTKAV

SEQ ID NO: 20922 - protein, 11 aa, Mycobacterium tuberculosis
RDGPTLTKAVE

SEQ ID NO: 20923 - protein, 11 aa, Mycobacterium tuberculosis
DGPTLTKAVEE

SEQ ID NO: 20924 - protein, 11 aa, Mycobacterium tuberculosis
GPTLTKAVEEI

SEQ ID NO: 20925 - protein, 11 aa, Mycobacterium tuberculosis
PTLTKAVEEIR

SEQ ID NO: 20926 - protein, 11 aa, Mycobacterium tuberculosis
TLTKAVEEIRV

SEQ ID NO: 20927 - protein, 11 aa, Mycobacterium tuberculosis
LTKAVEEIRVL

SEQ ID NO: 20928 - protein, 11 aa, Mycobacterium tuberculosis
TKAVEEIRVLQ

SEQ ID NO: 20929 - protein, 11 aa, Mycobacterium tuberculosis
KAVEEIRVLQE

SEQ ID NO: 20930 - protein, 11 aa, Mycobacterium tuberculosis
AVEEIRVLQER

SEQ ID NO: 20931 - protein, 11 aa, Mycobacterium tuberculosis
VEEIRVLQERF

SEQ ID NO: 20932 - protein, 11 aa, Mycobacterium tuberculosis
EEIRVLQERFA

SEQ ID NO: 20933 - protein, 11 aa, Mycobacterium tuberculosis
EIRVLQERFAT

SEQ ID NO: 20934 - protein, 11 aa, Mycobacterium tuberculosis
IRVLQERFATA

SEQ ID NO: 20935 - protein, 11 aa, Mycobacterium tuberculosis
RVLQERFATAG

SEQ ID NO: 20936 - protein, 11 aa, Mycobacterium tuberculosis
VLQERFATAGI

SEQ ID NO: 20937 - protein, 11 aa, Mycobacterium tuberculosis
LQERFATAGID

SEQ ID NO: 20938 - protein, 11 aa, Mycobacterium tuberculosis
QERFATAGIDD

SEQ ID NO: 20939 - protein, 11 aa, Mycobacterium tuberculosis
ERFATAGIDDH

SEQ ID NO: 20940 - protein, 11 aa, Mycobacterium tuberculosis
RFATAGIDDHS

SEQ ID NO: 20941 - protein, 11 aa, Mycobacterium tuberculosis
FATAGIDDHSR

SEQ ID NO: 20942 - protein, 11 aa, Mycobacterium tuberculosis
ATAGIDDHSRT

SEQ ID NO: 20943 - protein, 11 aa, Mycobacterium tuberculosis
TAGIDDHSRTF

SEQ ID NO: 20944 - protein, 11 aa, Mycobacterium tuberculosis
AGIDDHSRTFN

SEQ ID NO: 20945 - protein, 11 aa, Mycobacterium tuberculosis
GIDDHSRTFNT

SEQ ID NO: 20946 - protein, 11 aa, Mycobacterium tuberculosis
IDDHSRTFNTE

SEQ ID NO: 20947 - protein, 11 aa, Mycobacterium tuberculosis
DDHSRTFNTEL

SEQ ID NO: 20948 - protein, 11 aa, Mycobacterium tuberculosis
DHSRTFNTELT

SEQ ID NO: 20949 - protein, 11 aa, Mycobacterium tuberculosis
HSRTFNTELTA

SEQ ID NO: 20950 - protein, 11 aa, Mycobacterium tuberculosis
SRTFNTELTAL

SEQ ID NO: 20951 - protein, 11 aa, Mycobacterium tuberculosis
RTFNTELTALL

SEQ ID NO: 20952 - protein, 11 aa, Mycobacterium tuberculosis
TFNTELTALLE

SEQ ID NO: 20953 - protein, 11 aa, Mycobacterium tuberculosis
FNTELTALLEL

SEQ ID NO: 20954 - protein, 11 aa, Mycobacterium tuberculosis
NTELTALLELS

SEQ ID NO: 20955 - protein, 11 aa, Mycobacterium tuberculosis
TELTALLELSG

SEQ ID NO: 20956 - protein, 11 aa, Mycobacterium tuberculosis
ELTALLELSGM

SEQ ID NO: 20957 - protein, 11 aa, Mycobacterium tuberculosis
LTALLELSGML

SEQ ID NO: 20958 - protein, 11 aa, Mycobacterium tuberculosis
TALLELSGMLD

SEQ ID NO: 20959 - protein, 11 aa, Mycobacterium tuberculosis
ALLELSGMLDV

SEQ ID NO: 20960 - protein, 11 aa, Mycobacterium tuberculosis
LLELSGMLDVA

SEQ ID NO: 20961 - protein, 11 aa, Mycobacterium tuberculosis
LELSGMLDVAL

SEQ ID NO: 20962 - protein, 11 aa, Mycobacterium tuberculosis
ELSGMLDVALA

SEQ ID NO: 20963 - protein, 11 aa, Mycobacterium tuberculosis
LSGMLDVALAI

SEQ ID NO: 20964 - protein, 11 aa, Mycobacterium tuberculosis
SGMLDVALAIV

SEQ ID NO: 20965 - protein, 11 aa, Mycobacterium tuberculosis
GMLDVALAIVE

SEQ ID NO: 20966 - protein, 11 aa, Mycobacterium tuberculosis
MLDVALAIVES

SEQ ID NO: 20967 - protein, 11 aa, Mycobacterium tuberculosis
LDVALAIVESG

SEQ ID NO: 20968 - protein, 11 aa, Mycobacterium tuberculosis
DVALAIVESGL

SEQ ID NO: 20969 - protein, 11 aa, Mycobacterium tuberculosis
VALAIVESGLR

SEQ ID NO: 20970 - protein, 11 aa, Mycobacterium tuberculosis
ALAIVESGLRR

SEQ ID NO: 20971 - protein, 11 aa, Mycobacterium tuberculosis
LAIVESGLRRE

SEQ ID NO: 20972 - protein, 11 aa, Mycobacterium tuberculosis
AIVESGLRREE

SEQ ID NO: 20973 - protein, 11 aa, Mycobacterium tuberculosis
IVESGLRREES

SEQ ID NO: 20974 - protein, 11 aa, Mycobacterium tuberculosis
VESGLRREESR

SEQ ID NO: 20975 - protein, 11 aa, Mycobacterium tuberculosis
ESGLRREESRG

SEQ ID NO: 20976 - protein, 11 aa, Mycobacterium tuberculosis
SGLRREESRGA

SEQ ID NO: 20977 - protein, 11 aa, Mycobacterium tuberculosis
GLRREESRGAH

SEQ ID NO: 20978 - protein, 11 aa, Mycobacterium tuberculosis
LRREESRGAHQ

SEQ ID NO: 20979 - protein, 11 aa, Mycobacterium tuberculosis
RREESRGAHQR

SEQ ID NO: 20980 - protein, 11 aa, Mycobacterium tuberculosis
REESRGAHQRT

SEQ ID NO: 20981 - protein, 11 aa, Mycobacterium tuberculosis
EESRGAHQRTD

SEQ ID NO: 20982 - protein, 11 aa, Mycobacterium tuberculosis
ESRGAHQRTDF

SEQ ID NO: 20983 - protein, 11 aa, Mycobacterium tuberculosis
SRGAHQRTDFP

SEQ ID NO: 20984 - protein, 11 aa, Mycobacterium tuberculosis
RGAHQRTDFPN

SEQ ID NO: 20985 - protein, 11 aa, Mycobacterium tuberculosis
GAHQRTDFPNR

SEQ ID NO: 20986 - protein, 11 aa, Mycobacterium tuberculosis
AHQRTDFPNRD

SEQ ID NO: 20987 - protein, 11 aa, Mycobacterium tuberculosis
HQRTDFPNRDD

SEQ ID NO: 20988 - protein, 11 aa, Mycobacterium tuberculosis
QRTDFPNRDDE

SEQ ID NO: 20989 - protein, 11 aa, Mycobacterium tuberculosis
RTDFPNRDDEH

SEQ ID NO: 20990 - protein, 11 aa, Mycobacterium tuberculosis
TDFPNRDDEHF

SEQ ID NO: 20991 - protein, 11 aa, Mycobacterium tuberculosis
DFPNRDDEHFL

SEQ ID NO: 20992 - protein, 11 aa, Mycobacterium tuberculosis
FPNRDDEHFLA

SEQ ID NO: 20993 - protein, 11 aa, Mycobacterium tuberculosis
PNRDDEHFLAH

SEQ ID NO: 20994 - protein, 11 aa, Mycobacterium tuberculosis
NRDDEHFLAHT

SEQ ID NO: 20995 - protein, 11 aa, Mycobacterium tuberculosis
RDDEHFLAHTL

SEQ ID NO: 20996 - protein, 11 aa, Mycobacterium tuberculosis
DDEHFLAHTLV

SEQ ID NO: 20997 - protein, 11 aa, Mycobacterium tuberculosis
DEHFLAHTLVH

SEQ ID NO: 20998 - protein, 11 aa, Mycobacterium tuberculosis
EHFLAHTLVHR

SEQ ID NO: 20999 - protein, 11 aa, Mycobacterium tuberculosis
HFLAHTLVHRE

SEQ ID NO: 21000 - protein, 11 aa, Mycobacterium tuberculosis
FLAHTLVHRES

SEQ ID NO: 21001 - protein, 11 aa, Mycobacterium tuberculosis
LAHTLVHRESD

SEQ ID NO: 21002 - protein, 11 aa, Mycobacterium tuberculosis
AHTLVHRESDG

SEQ ID NO: 21003 - protein, 11 aa, Mycobacterium tuberculosis
HTLVHRESDGT

SEQ ID NO: 21004 - protein, 11 aa, Mycobacterium tuberculosis
TLVHRESDGTL

SEQ ID NO: 21005 - protein, 11 aa, Mycobacterium tuberculosis
LVHRESDGTLR

SEQ ID NO: 21006 - protein, 11 aa, Mycobacterium tuberculosis
VHRESDGTLRV

SEQ ID NO: 21007 - protein, 11 aa, Mycobacterium tuberculosis
HRESDGTLRVG

SEQ ID NO: 21008 - protein, 11 aa, Mycobacterium tuberculosis
RESDGTLRVGY

SEQ ID NO: 21009 - protein, 11 aa, Mycobacterium tuberculosis
ESDGTLRVGYL

SEQ ID NO: 21010 - protein, 11 aa, Mycobacterium tuberculosis
SDGTLRVGYLP

SEQ ID NO: 21011 - protein, 11 aa, Mycobacterium tuberculosis
DGTLRVGYLPV

SEQ ID NO: 21012 - protein, 11 aa, Mycobacterium tuberculosis
GTLRVGYLPVT

SEQ ID NO: 21013 - protein, 11 aa, Mycobacterium tuberculosis
TLRVGYLPVTI

SEQ ID NO: 21014 - protein, 11 aa, Mycobacterium tuberculosis
LRVGYLPVTIT

SEQ ID NO: 21015 - protein, 11 aa, Mycobacterium tuberculosis
RVGYLPVTITR

SEQ ID NO: 21016 - protein, 11 aa, Mycobacterium tuberculosis
VGYLPVTITRW

SEQ ID NO: 21017 - protein, 11 aa, Mycobacterium tuberculosis
GYLPVTITRWP

SEQ ID NO: 21018 - protein, 11 aa, Mycobacterium tuberculosis
YLPVTITRWPP

SEQ ID NO: 21019 - protein, 11 aa, Mycobacterium tuberculosis
LPVTITRWPPG

SEQ ID NO: 21020 - protein, 11 aa, Mycobacterium tuberculosis
PVTITRWPPGE

SEQ ID NO: 21021 - protein, 11 aa, Mycobacterium tuberculosis
VTITRWPPGER

SEQ ID NO: 21022 - protein, 11 aa, Mycobacterium tuberculosis
TITRWPPGERV

SEQ ID NO: 21023 - protein, 11 aa, Mycobacterium tuberculosis
ITRWPPGERVY

SEQ ID NO: 21024 - protein, 11 aa, Mycobacterium tuberculosis
TRWPPGERVYG

SEQ ID NO: 21025 - protein, 11 aa, Mycobacterium tuberculosis
RWPPGERVYGR

SEQ ID NO: 21026 - protein, 8 aa, Mycobacterium tuberculosis
MSVIAGVF

SEQ ID NO: 21027 - protein, 8 aa, Mycobacterium tuberculosis
SVIAGVFG

SEQ ID NO: 21028 - protein, 8 aa, Mycobacterium tuberculosis
VIAGVFGA

SEQ ID NO: 21029 - protein, 8 aa, Mycobacterium tuberculosis
IAGVFGAL

SEQ ID NO: 21030 - protein, 8 aa, Mycobacterium tuberculosis
AGVFGALP

SEQ ID NO: 21031 - protein, 8 aa, Mycobacterium tuberculosis
GVFGALPP

SEQ ID NO: 21032 - protein, 8 aa, Mycobacterium tuberculosis
VFGALPPY

SEQ ID NO: 21033 - protein, 8 aa, Mycobacterium tuberculosis
FGALPPYR

SEQ ID NO: 21034 - protein, 8 aa, Mycobacterium tuberculosis
GALPPYRY

SEQ ID NO: 21035 - protein, 8 aa, Mycobacterium tuberculosis
ALPPYRYS

SEQ ID NO: 21036 - protein, 8 aa, Mycobacterium tuberculosis
LPPYRYSQ

SEQ ID NO: 21037 - protein, 8 aa, Mycobacterium tuberculosis
PPYRYSQR

SEQ ID NO: 21038 - protein, 8 aa, Mycobacterium tuberculosis
PYRYSQRE

SEQ ID NO: 21039 - protein, 8 aa, Mycobacterium tuberculosis
YRYSQREL

SEQ ID NO: 21040 - protein, 8 aa, Mycobacterium tuberculosis
RYSQRELT

SEQ ID NO: 21041 - protein, 8 aa, Mycobacterium tuberculosis
YSQRELTD

SEQ ID NO: 21042 - protein, 8 aa, Mycobacterium tuberculosis
SQRELTDS

SEQ ID NO: 21043 - protein, 8 aa, Mycobacterium tuberculosis
QRELTDSF

SEQ ID NO: 21044 - protein, 8 aa, Mycobacterium tuberculosis
RELTDSFV

SEQ ID NO: 21045 - protein, 8 aa, Mycobacterium tuberculosis
ELTDSFVS

SEQ ID NO: 21046 - protein, 8 aa, Mycobacterium tuberculosis
LTDSFVSI

SEQ ID NO: 21047 - protein, 8 aa, Mycobacterium tuberculosis
TDSFVSIP

SEQ ID NO: 21048 - protein, 8 aa, Mycobacterium tuberculosis
DSFVSIPD

SEQ ID NO: 21049 - protein, 8 aa, Mycobacterium tuberculosis
SFVSIPDF

SEQ ID NO: 21050 - protein, 8 aa, Mycobacterium tuberculosis
FVSIPDFE

SEQ ID NO: 21051 - protein, 8 aa, Mycobacterium tuberculosis
VSIPDFEG

SEQ ID NO: 21052 - protein, 8 aa, Mycobacterium tuberculosis
SIPDFEGY

SEQ ID NO: 21053 - protein, 8 aa, Mycobacterium tuberculosis
IPDFEGYE

SEQ ID NO: 21054 - protein, 8 aa, Mycobacterium tuberculosis
PDFEGYED

SEQ ID NO: 21055 - protein, 8 aa, Mycobacterium tuberculosis
DFEGYEDI

SEQ ID NO: 21056 - protein, 8 aa, Mycobacterium tuberculosis
FEGYEDIV

SEQ ID NO: 21057 - protein, 8 aa, Mycobacterium tuberculosis
EGYEDIVR

SEQ ID NO: 21058 - protein, 8 aa, Mycobacterium tuberculosis
GYEDIVRQ

SEQ ID NO: 21059 - protein, 8 aa, Mycobacterium tuberculosis
YEDIVRQL

SEQ ID NO: 21060 - protein, 8 aa, Mycobacterium tuberculosis
EDIVRQLH

SEQ ID NO: 21061 - protein, 8 aa, Mycobacterium tuberculosis
DIVRQLHA

SEQ ID NO: 21062 - protein, 8 aa, Mycobacterium tuberculosis
IVRQLHAS

SEQ ID NO: 21063 - protein, 8 aa, Mycobacterium tuberculosis
VRQLHASA

SEQ ID NO: 21064 - protein, 8 aa, Mycobacterium tuberculosis
RQLHASAK

SEQ ID NO: 21065 - protein, 8 aa, Mycobacterium tuberculosis
QLHASAKV

SEQ ID NO: 21066 - protein, 8 aa, Mycobacterium tuberculosis
LHASAKVN

SEQ ID NO: 21067 - protein, 8 aa, Mycobacterium tuberculosis
HASAKVNS

SEQ ID NO: 21068 - protein, 8 aa, Mycobacterium tuberculosis
ASAKVNSR

SEQ ID NO: 21069 - protein, 8 aa, Mycobacterium tuberculosis
SAKVNSRH

SEQ ID NO: 21070 - protein, 8 aa, Mycobacterium tuberculosis
AKVNSRHL

SEQ ID NO: 21071 - protein, 8 aa, Mycobacterium tuberculosis
KVNSRHLV

SEQ ID NO: 21072 - protein, 8 aa, Mycobacterium tuberculosis
VNSRHLVL

SEQ ID NO: 21073 - protein, 8 aa, Mycobacterium tuberculosis
NSRHLVLP

SEQ ID NO: 21074 - protein, 8 aa, Mycobacterium tuberculosis
SRHLVLPL

SEQ ID NO: 21075 - protein, 8 aa, Mycobacterium tuberculosis
RHLVLPLE

SEQ ID NO: 21076 - protein, 8 aa, Mycobacterium tuberculosis
HLVLPLEK

SEQ ID NO: 21077 - protein, 8 aa, Mycobacterium tuberculosis
LVLPLEKY

SEQ ID NO: 21078 - protein, 8 aa, Mycobacterium tuberculosis
VLPLEKYP

SEQ ID NO: 21079 - protein, 8 aa, Mycobacterium tuberculosis
LPLEKYPK

SEQ ID NO: 21080 - protein, 8 aa, Mycobacterium tuberculosis
PLEKYPKL

SEQ ID NO: 21081 - protein, 8 aa, Mycobacterium tuberculosis
LEKYPKLT

SEQ ID NO: 21082 - protein, 8 aa, Mycobacterium tuberculosis
EKYPKLTD

SEQ ID NO: 21083 - protein, 8 aa, Mycobacterium tuberculosis
KYPKLTDF

SEQ ID NO: 21084 - protein, 8 aa, Mycobacterium tuberculosis
YPKLTDFG

SEQ ID NO: 21085 - protein, 8 aa, Mycobacterium tuberculosis
PKLTDFGE

SEQ ID NO: 21086 - protein, 8 aa, Mycobacterium tuberculosis
KLTDFGEA

SEQ ID NO: 21087 - protein, 8 aa, Mycobacterium tuberculosis
LTDFGEAN

SEQ ID NO: 21088 - protein, 8 aa, Mycobacterium tuberculosis
TDFGEANK

SEQ ID NO: 21089 - protein, 8 aa, Mycobacterium tuberculosis
DFGEANKI

SEQ ID NO: 21090 - protein, 8 aa, Mycobacterium tuberculosis
FGEANKIF

SEQ ID NO: 21091 - protein, 8 aa, Mycobacterium tuberculosis
GEANKIFI

SEQ ID NO: 21092 - protein, 8 aa, Mycobacterium tuberculosis
EANKIFIE

SEQ ID NO: 21093 - protein, 8 aa, Mycobacterium tuberculosis
ANKIFIEK

SEQ ID NO: 21094 - protein, 8 aa, Mycobacterium tuberculosis
NKIFIEKA

SEQ ID NO: 21095 - protein, 8 aa, Mycobacterium tuberculosis
KIFIEKAV

SEQ ID NO: 21096 - protein, 8 aa, Mycobacterium tuberculosis
IFIEKAVD

SEQ ID NO: 21097 - protein, 8 aa, Mycobacterium tuberculosis
FIEKAVDL

SEQ ID NO: 21098 - protein, 8 aa, Mycobacterium tuberculosis
IEKAVDLG

SEQ ID NO: 21099 - protein, 8 aa, Mycobacterium tuberculosis
EKAVDLGV

SEQ ID NO: 21100 - protein, 8 aa, Mycobacterium tuberculosis
KAVDLGVQ

SEQ ID NO: 21101 - protein, 8 aa, Mycobacterium tuberculosis
AVDLGVQA

SEQ ID NO: 21102 - protein, 8 aa, Mycobacterium tuberculosis
VDLGVQAL

SEQ ID NO: 21103 - protein, 8 aa, Mycobacterium tuberculosis
DLGVQALA

SEQ ID NO: 21104 - protein, 8 aa, Mycobacterium tuberculosis
LGVQALAG

SEQ ID NO: 21105 - protein, 8 aa, Mycobacterium tuberculosis
GVQALAGA

SEQ ID NO: 21106 - protein, 8 aa, Mycobacterium tuberculosis
VQALAGAL

SEQ ID NO: 21107 - protein, 8 aa, Mycobacterium tuberculosis
QALAGALD

SEQ ID NO: 21108 - protein, 8 aa, Mycobacterium tuberculosis
ALAGALDE

SEQ ID NO: 21109 - protein, 8 aa, Mycobacterium tuberculosis
LAGALDES

SEQ ID NO: 21110 - protein, 8 aa, Mycobacterium tuberculosis
AGALDESG

SEQ ID NO: 21111 - protein, 8 aa, Mycobacterium tuberculosis
GALDESGL

SEQ ID NO: 21112 - protein, 8 aa, Mycobacterium tuberculosis
ALDESGLR

SEQ ID NO: 21113 - protein, 8 aa, Mycobacterium tuberculosis
LDESGLRP

SEQ ID NO: 21114 - protein, 8 aa, Mycobacterium tuberculosis
DESGLRPE

SEQ ID NO: 21115 - protein, 8 aa, Mycobacterium tuberculosis
ESGLRPED

SEQ ID NO: 21116 - protein, 8 aa, Mycobacterium tuberculosis
SGLRPEDL

SEQ ID NO: 21117 - protein, 8 aa, Mycobacterium tuberculosis
GLRPEDLD

SEQ ID NO: 21118 - protein, 8 aa, Mycobacterium tuberculosis
LRPEDLDV

SEQ ID NO: 21119 - protein, 8 aa, Mycobacterium tuberculosis
RPEDLDVL

SEQ ID NO: 21120 - protein, 8 aa, Mycobacterium tuberculosis
PEDLDVLI

SEQ ID NO: 21121 - protein, 8 aa, Mycobacterium tuberculosis
EDLDVLIT

SEQ ID NO: 21122 - protein, 8 aa, Mycobacterium tuberculosis
DLDVLITA

SEQ ID NO: 21123 - protein, 8 aa, Mycobacterium tuberculosis
LDVLITAT

SEQ ID NO: 21124 - protein, 8 aa, Mycobacterium tuberculosis
DVLITATV

SEQ ID NO: 21125 - protein, 8 aa, Mycobacterium tuberculosis
VLITATVT

SEQ ID NO: 21126 - protein, 8 aa, Mycobacterium tuberculosis
LITATVTG

SEQ ID NO: 21127 - protein, 8 aa, Mycobacterium tuberculosis
ITATVTGL

SEQ ID NO: 21128 - protein, 8 aa, Mycobacterium tuberculosis
TATVTGLA

SEQ ID NO: 21129 - protein, 8 aa, Mycobacterium tuberculosis
ATVTGLAV

SEQ ID NO: 21130 - protein, 8 aa, Mycobacterium tuberculosis
TVTGLAVP

SEQ ID NO: 21131 - protein, 8 aa, Mycobacterium tuberculosis
VTGLAVPS

SEQ ID NO: 21132 - protein, 8 aa, Mycobacterium tuberculosis
TGLAVPSL

SEQ ID NO: 21133 - protein, 8 aa, Mycobacterium tuberculosis
GLAVPSLD

SEQ ID NO: 21134 - protein, 8 aa, Mycobacterium tuberculosis
LAVPSLDA

SEQ ID NO: 21135 - protein, 8 aa, Mycobacterium tuberculosis
AVPSLDAR

SEQ ID NO: 21136 - protein, 8 aa, Mycobacterium tuberculosis
VPSLDARI

SEQ ID NO: 21137 - protein, 8 aa, Mycobacterium tuberculosis
PSLDARIA

SEQ ID NO: 21138 - protein, 8 aa, Mycobacterium tuberculosis
SLDARIAG

SEQ ID NO: 21139 - protein, 8 aa, Mycobacterium tuberculosis
LDARIAGR

SEQ ID NO: 21140 - protein, 8 aa, Mycobacterium tuberculosis
DARIAGRL

SEQ ID NO: 21141 - protein, 8 aa, Mycobacterium tuberculosis
ARIAGRLG

SEQ ID NO: 21142 - protein, 8 aa, Mycobacterium tuberculosis
RIAGRLGL

SEQ ID NO: 21143 - protein, 8 aa, Mycobacterium tuberculosis
IAGRLGLR

SEQ ID NO: 21144 - protein, 8 aa, Mycobacterium tuberculosis
AGRLGLRA

SEQ ID NO: 21145 - protein, 8 aa, Mycobacterium tuberculosis
GRLGLRAD

SEQ ID NO: 21146 - protein, 8 aa, Mycobacterium tuberculosis
RLGLRADV

SEQ ID NO: 21147 - protein, 8 aa, Mycobacterium tuberculosis
LGLRADVR

SEQ ID NO: 21148 - protein, 8 aa, Mycobacterium tuberculosis
GLRADVRR

SEQ ID NO: 21149 - protein, 8 aa, Mycobacterium tuberculosis
LRADVRRV

SEQ ID NO: 21150 - protein, 8 aa, Mycobacterium tuberculosis
RADVRRVP

SEQ ID NO: 21151 - protein, 8 aa, Mycobacterium tuberculosis
ADVRRVPL

SEQ ID NO: 21152 - protein, 8 aa, Mycobacterium tuberculosis
DVRRVPLF

SEQ ID NO: 21153 - protein, 8 aa, Mycobacterium tuberculosis
VRRVPLFG

SEQ ID NO: 21154 - protein, 8 aa, Mycobacterium tuberculosis
RRVPLFGL

SEQ ID NO: 21155 - protein, 8 aa, Mycobacterium tuberculosis
RVPLFGLG

SEQ ID NO: 21156 - protein, 8 aa, Mycobacterium tuberculosis
VPLFGLGC

SEQ ID NO: 21157 - protein, 8 aa, Mycobacterium tuberculosis
PLFGLGCV

SEQ ID NO: 21158 - protein, 8 aa, Mycobacterium tuberculosis
LFGLGCVA

SEQ ID NO: 21159 - protein, 8 aa, Mycobacterium tuberculosis
FGLGCVAG

SEQ ID NO: 21160 - protein, 8 aa, Mycobacterium tuberculosis
GLGCVAGA

SEQ ID NO: 21161 - protein, 8 aa, Mycobacterium tuberculosis
LGCVAGAA

SEQ ID NO: 21162 - protein, 8 aa, Mycobacterium tuberculosis
GCVAGAAG

SEQ ID NO: 21163 - protein, 8 aa, Mycobacterium tuberculosis
CVAGAAGV

SEQ ID NO: 21164 - protein, 8 aa, Mycobacterium tuberculosis
VAGAAGVA

SEQ ID NO: 21165 - protein, 8 aa, Mycobacterium tuberculosis
AGAAGVAR

SEQ ID NO: 21166 - protein, 8 aa, Mycobacterium tuberculosis
GAAGVARL

SEQ ID NO: 21167 - protein, 8 aa, Mycobacterium tuberculosis
AAGVARLH

SEQ ID NO: 21168 - protein, 8 aa, Mycobacterium tuberculosis
AGVARLHD

SEQ ID NO: 21169 - protein, 8 aa, Mycobacterium tuberculosis
GVARLHDY

SEQ ID NO: 21170 - protein, 8 aa, Mycobacterium tuberculosis
VARLHDYL

SEQ ID NO: 21171 - protein, 8 aa, Mycobacterium tuberculosis
ARLHDYLR

SEQ ID NO: 21172 - protein, 8 aa, Mycobacterium tuberculosis
RLHDYLRG

SEQ ID NO: 21173 - protein, 8 aa, Mycobacterium tuberculosis
LHDYLRGA

SEQ ID NO: 21174 - protein, 8 aa, Mycobacterium tuberculosis
HDYLRGAP

SEQ ID NO: 21175 - protein, 8 aa, Mycobacterium tuberculosis
DYLRGAPD

SEQ ID NO: 21176 - protein, 8 aa, Mycobacterium tuberculosis
YLRGAPDG

SEQ ID NO: 21177 - protein, 8 aa, Mycobacterium tuberculosis
LRGAPDGV

SEQ ID NO: 21178 - protein, 8 aa, Mycobacterium tuberculosis
RGAPDGVA

SEQ ID NO: 21179 - protein, 8 aa, Mycobacterium tuberculosis
GAPDGVAA

SEQ ID NO: 21180 - protein, 8 aa, Mycobacterium tuberculosis
APDGVAAL

SEQ ID NO: 21181 - protein, 8 aa, Mycobacterium tuberculosis
PDGVAALV

SEQ ID NO: 21182 - protein, 8 aa, Mycobacterium tuberculosis
DGVAALVS

SEQ ID NO: 21183 - protein, 8 aa, Mycobacterium tuberculosis
GVAALVSV

SEQ ID NO: 21184 - protein, 8 aa, Mycobacterium tuberculosis
VAALVSVE

SEQ ID NO: 21185 - protein, 8 aa, Mycobacterium tuberculosis
AALVSVEL

SEQ ID NO: 21186 - protein, 8 aa, Mycobacterium tuberculosis
ALVSVELC

SEQ ID NO: 21187 - protein, 8 aa, Mycobacterium tuberculosis
LVSVELCS

SEQ ID NO: 21188 - protein, 8 aa, Mycobacterium tuberculosis
VSVELCSL

SEQ ID NO: 21189 - protein, 8 aa, Mycobacterium tuberculosis
SVELCSLT

SEQ ID NO: 21190 - protein, 8 aa, Mycobacterium tuberculosis
VELCSLTY

SEQ ID NO: 21191 - protein, 8 aa, Mycobacterium tuberculosis
ELCSLTYP

SEQ ID NO: 21192 - protein, 8 aa, Mycobacterium tuberculosis
LCSLTYPG

SEQ ID NO: 21193 - protein, 8 aa, Mycobacterium tuberculosis
CSLTYPGY

SEQ ID NO: 21194 - protein, 8 aa, Mycobacterium tuberculosis
SLTYPGYK

SEQ ID NO: 21195 - protein, 8 aa, Mycobacterium tuberculosis
LTYPGYKP

SEQ ID NO: 21196 - protein, 8 aa, Mycobacterium tuberculosis
TYPGYKPT

SEQ ID NO: 21197 - protein, 8 aa, Mycobacterium tuberculosis
YPGYKPTL

SEQ ID NO: 21198 - protein, 8 aa, Mycobacterium tuberculosis
PGYKPTLP

SEQ ID NO: 21199 - protein, 8 aa, Mycobacterium tuberculosis
GYKPTLPG

SEQ ID NO: 21200 - protein, 8 aa, Mycobacterium tuberculosis
YKPTLPGL

SEQ ID NO: 21201 - protein, 8 aa, Mycobacterium tuberculosis
KPTLPGLV

SEQ ID NO: 21202 - protein, 8 aa, Mycobacterium tuberculosis
PTLPGLVG

SEQ ID NO: 21203 - protein, 8 aa, Mycobacterium tuberculosis
TLPGLVGS

SEQ ID NO: 21204 - protein, 8 aa, Mycobacterium tuberculosis
LPGLVGSA

SEQ ID NO: 21205 - protein, 8 aa, Mycobacterium tuberculosis
PGLVGSAL

SEQ ID NO: 21206 - protein, 8 aa, Mycobacterium tuberculosis
GLVGSALF

SEQ ID NO: 21207 - protein, 8 aa, Mycobacterium tuberculosis
LVGSALFA

SEQ ID NO: 21208 - protein, 8 aa, Mycobacterium tuberculosis
VGSALFAD

SEQ ID NO: 21209 - protein, 8 aa, Mycobacterium tuberculosis
GSALFADG

SEQ ID NO: 21210 - protein, 8 aa, Mycobacterium tuberculosis
SALFADGA

SEQ ID NO: 21211 - protein, 8 aa, Mycobacterium tuberculosis
ALFADGAA

SEQ ID NO: 21212 - protein, 8 aa, Mycobacterium tuberculosis
LFADGAAA

SEQ ID NO: 21213 - protein, 8 aa, Mycobacterium tuberculosis
FADGAAAV

SEQ ID NO: 21214 - protein, 8 aa, Mycobacterium tuberculosis
ADGAAAVV

SEQ ID NO: 21215 - protein, 8 aa, Mycobacterium tuberculosis
DGAAAVVA

SEQ ID NO: 21216 - protein, 8 aa, Mycobacterium tuberculosis
GAAAVVAA

SEQ ID NO: 21217 - protein, 8 aa, Mycobacterium tuberculosis
AAAVVAAG

SEQ ID NO: 21218 - protein, 8 aa, Mycobacterium tuberculosis
AAVVAAGV

SEQ ID NO: 21219 - protein, 8 aa, Mycobacterium tuberculosis
AVVAAGVK

SEQ ID NO: 21220 - protein, 8 aa, Mycobacterium tuberculosis
VVAAGVKR

SEQ ID NO: 21221 - protein, 8 aa, Mycobacterium tuberculosis
VAAGVKRA

SEQ ID NO: 21222 - protein, 8 aa, Mycobacterium tuberculosis
AAGVKRAQ

SEQ ID NO: 21223 - protein, 8 aa, Mycobacterium tuberculosis
AGVKRAQD

SEQ ID NO: 21224 - protein, 8 aa, Mycobacterium tuberculosis
GVKRAQDI

SEQ ID NO: 21225 - protein, 8 aa, Mycobacterium tuberculosis
VKRAQDIG

SEQ ID NO: 21226 - protein, 8 aa, Mycobacterium tuberculosis
KRAQDIGA

SEQ ID NO: 21227 - protein, 8 aa, Mycobacterium tuberculosis
RAQDIGAD

SEQ ID NO: 21228 - protein, 8 aa, Mycobacterium tuberculosis
AQDIGADG

SEQ ID NO: 21229 - protein, 8 aa, Mycobacterium tuberculosis
QDIGADGP

SEQ ID NO: 21230 - protein, 8 aa, Mycobacterium tuberculosis
DIGADGPD

SEQ ID NO: 21231 - protein, 8 aa, Mycobacterium tuberculosis
IGADGPDI

SEQ ID NO: 21232 - protein, 8 aa, Mycobacterium tuberculosis
GADGPDIL

SEQ ID NO: 21233 - protein, 8 aa, Mycobacterium tuberculosis
ADGPDILD

SEQ ID NO: 21234 - protein, 8 aa, Mycobacterium tuberculosis
DGPDILDS

SEQ ID NO: 21235 - protein, 8 aa, Mycobacterium tuberculosis
GPDILDSR

SEQ ID NO: 21236 - protein, 8 aa, Mycobacterium tuberculosis
PDILDSRS

SEQ ID NO: 21237 - protein, 8 aa, Mycobacterium tuberculosis
DILDSRSH

SEQ ID NO: 21238 - protein, 8 aa, Mycobacterium tuberculosis
ILDSRSHL

SEQ ID NO: 21239 - protein, 8 aa, Mycobacterium tuberculosis
LDSRSHLY

SEQ ID NO: 21240 - protein, 8 aa, Mycobacterium tuberculosis
DSRSHLYP

SEQ ID NO: 21241 - protein, 8 aa, Mycobacterium tuberculosis
SRSHLYPD

SEQ ID NO: 21242 - protein, 8 aa, Mycobacterium tuberculosis
RSHLYPDS

SEQ ID NO: 21243 - protein, 8 aa, Mycobacterium tuberculosis
SHLYPDSL

SEQ ID NO: 21244 - protein, 8 aa, Mycobacterium tuberculosis
HLYPDSLR

SEQ ID NO: 21245 - protein, 8 aa, Mycobacterium tuberculosis
LYPDSLRT

SEQ ID NO: 21246 - protein, 8 aa, Mycobacterium tuberculosis
YPDSLRTM

SEQ ID NO: 21247 - protein, 8 aa, Mycobacterium tuberculosis
PDSLRTMG

SEQ ID NO: 21248 - protein, 8 aa, Mycobacterium tuberculosis
DSLRTMGY

SEQ ID NO: 21249 - protein, 8 aa, Mycobacterium tuberculosis
SLRTMGYD

SEQ ID NO: 21250 - protein, 8 aa, Mycobacterium tuberculosis
LRTMGYDV

SEQ ID NO: 21251 - protein, 8 aa, Mycobacterium tuberculosis
RTMGYDVG

SEQ ID NO: 21252 - protein, 8 aa, Mycobacterium tuberculosis
TMGYDVGS

SEQ ID NO: 21253 - protein, 8 aa, Mycobacterium tuberculosis
MGYDVGSA

SEQ ID NO: 21254 - protein, 8 aa, Mycobacterium tuberculosis
GYDVGSAG

SEQ ID NO: 21255 - protein, 8 aa, Mycobacterium tuberculosis
YDVGSAGF

SEQ ID NO: 21256 - protein, 8 aa, Mycobacterium tuberculosis
DVGSAGFE

SEQ ID NO: 21257 - protein, 8 aa, Mycobacterium tuberculosis
VGSAGFEL

SEQ ID NO: 21258 - protein, 8 aa, Mycobacterium tuberculosis
GSAGFELV

SEQ ID NO: 21259 - protein, 8 aa, Mycobacterium tuberculosis
SAGFELVL

SEQ ID NO: 21260 - protein, 8 aa, Mycobacterium tuberculosis
AGFELVLS

SEQ ID NO: 21261 - protein, 8 aa, Mycobacterium tuberculosis
GFELVLSR

SEQ ID NO: 21262 - protein, 8 aa, Mycobacterium tuberculosis
FELVLSRD

SEQ ID NO: 21263 - protein, 8 aa, Mycobacterium tuberculosis
ELVLSRDL

SEQ ID NO: 21264 - protein, 8 aa, Mycobacterium tuberculosis
LVLSRDLA

SEQ ID NO: 21265 - protein, 8 aa, Mycobacterium tuberculosis
VLSRDLAA

SEQ ID NO: 21266 - protein, 8 aa, Mycobacterium tuberculosis
LSRDLAAV

SEQ ID NO: 21267 - protein, 8 aa, Mycobacterium tuberculosis
SRDLAAVV

SEQ ID NO: 21268 - protein, 8 aa, Mycobacterium tuberculosis
RDLAAVVE

SEQ ID NO: 21269 - protein, 8 aa, Mycobacterium tuberculosis
DLAAVVEQ

SEQ ID NO: 21270 - protein, 8 aa, Mycobacterium tuberculosis
LAAVVEQY

SEQ ID NO: 21271 - protein, 8 aa, Mycobacterium tuberculosis
AAVVEQYL

SEQ ID NO: 21272 - protein, 8 aa, Mycobacterium tuberculosis
AVVEQYLG

SEQ ID NO: 21273 - protein, 8 aa, Mycobacterium tuberculosis
VVEQYLGN

SEQ ID NO: 21274 - protein, 8 aa, Mycobacterium tuberculosis
VEQYLGND

SEQ ID NO: 21275 - protein, 8 aa, Mycobacterium tuberculosis
EQYLGNDV

SEQ ID NO: 21276 - protein, 8 aa, Mycobacterium tuberculosis
QYLGNDVT

SEQ ID NO: 21277 - protein, 8 aa, Mycobacterium tuberculosis
YLGNDVTT

SEQ ID NO: 21278 - protein, 8 aa, Mycobacterium tuberculosis
LGNDVTTF

SEQ ID NO: 21279 - protein, 8 aa, Mycobacterium tuberculosis
GNDVTTFL

SEQ ID NO: 21280 - protein, 8 aa, Mycobacterium tuberculosis
NDVTTFLA

SEQ ID NO: 21281 - protein, 8 aa, Mycobacterium tuberculosis
DVTTFLAS

SEQ ID NO: 21282 - protein, 8 aa, Mycobacterium tuberculosis
VTTFLASH

SEQ ID NO: 21283 - protein, 8 aa, Mycobacterium tuberculosis
TTFLASHG

SEQ ID NO: 21284 - protein, 8 aa, Mycobacterium tuberculosis
TFLASHGL

SEQ ID NO: 21285 - protein, 8 aa, Mycobacterium tuberculosis
FLASHGLS

SEQ ID NO: 21286 - protein, 8 aa, Mycobacterium tuberculosis
LASHGLST

SEQ ID NO: 21287 - protein, 8 aa, Mycobacterium tuberculosis
ASHGLSTT

SEQ ID NO: 21288 - protein, 8 aa, Mycobacterium tuberculosis
SHGLSTTD

SEQ ID NO: 21289 - protein, 8 aa, Mycobacterium tuberculosis
HGLSTTDV

SEQ ID NO: 21290 - protein, 8 aa, Mycobacterium tuberculosis
GLSTTDVG

SEQ ID NO: 21291 - protein, 8 aa, Mycobacterium tuberculosis
LSTTDVGA

SEQ ID NO: 21292 - protein, 8 aa, Mycobacterium tuberculosis
STTDVGAW

SEQ ID NO: 21293 - protein, 8 aa, Mycobacterium tuberculosis
TTDVGAWV

SEQ ID NO: 21294 - protein, 8 aa, Mycobacterium tuberculosis
TDVGAWVT

SEQ ID NO: 21295 - protein, 8 aa, Mycobacterium tuberculosis
DVGAWVTH

SEQ ID NO: 21296 - protein, 8 aa, Mycobacterium tuberculosis
VGAWVTHP

SEQ ID NO: 21297 - protein, 8 aa, Mycobacterium tuberculosis
GAWVTHPG

SEQ ID NO: 21298 - protein, 8 aa, Mycobacterium tuberculosis
AWVTHPGG

SEQ ID NO: 21299 - protein, 8 aa, Mycobacterium tuberculosis
WVTHPGGP

SEQ ID NO: 21300 - protein, 8 aa, Mycobacterium tuberculosis
VTHPGGPK

SEQ ID NO: 21301 - protein, 8 aa, Mycobacterium tuberculosis
THPGGPKI

SEQ ID NO: 21302 - protein, 8 aa, Mycobacterium tuberculosis
HPGGPKII

SEQ ID NO: 21303 - protein, 8 aa, Mycobacterium tuberculosis
PGGPKIIN

SEQ ID NO: 21304 - protein, 8 aa, Mycobacterium tuberculosis
GGPKIINA

SEQ ID NO: 21305 - protein, 8 aa, Mycobacterium tuberculosis
GPKIINAI

SEQ ID NO: 21306 - protein, 8 aa, Mycobacterium tuberculosis
PKIINAIT

SEQ ID NO: 21307 - protein, 8 aa, Mycobacterium tuberculosis
KIINAITE

SEQ ID NO: 21308 - protein, 8 aa, Mycobacterium tuberculosis
IINAITET

SEQ ID NO: 21309 - protein, 8 aa, Mycobacterium tuberculosis
INAITETL

SEQ ID NO: 21310 - protein, 8 aa, Mycobacterium tuberculosis
NAITETLD

SEQ ID NO: 21311 - protein, 8 aa, Mycobacterium tuberculosis
AITETLDL

SEQ ID NO: 21312 - protein, 8 aa, Mycobacterium tuberculosis
ITETLDLS

SEQ ID NO: 21313 - protein, 8 aa, Mycobacterium tuberculosis
TETLDLSP

SEQ ID NO: 21314 - protein, 8 aa, Mycobacterium tuberculosis
ETLDLSPQ

SEQ ID NO: 21315 - protein, 8 aa, Mycobacterium tuberculosis
TLDLSPQA

SEQ ID NO: 21316 - protein, 8 aa, Mycobacterium tuberculosis
LDLSPQAL

SEQ ID NO: 21317 - protein, 8 aa, Mycobacterium tuberculosis
DLSPQALE

SEQ ID NO: 21318 - protein, 8 aa, Mycobacterium tuberculosis
LSPQALEL

SEQ ID NO: 21319 - protein, 8 aa, Mycobacterium tuberculosis
SPQALELT

SEQ ID NO: 21320 - protein, 8 aa, Mycobacterium tuberculosis
PQALELTW

SEQ ID NO: 21321 - protein, 8 aa, Mycobacterium tuberculosis
QALELTWR

SEQ ID NO: 21322 - protein, 8 aa, Mycobacterium tuberculosis
ALELTWRS

SEQ ID NO: 21323 - protein, 8 aa, Mycobacterium tuberculosis
LELTWRSL

SEQ ID NO: 21324 - protein, 8 aa, Mycobacterium tuberculosis
ELTWRSLG

SEQ ID NO: 21325 - protein, 8 aa, Mycobacterium tuberculosis
LTWRSLGE

SEQ ID NO: 21326 - protein, 8 aa, Mycobacterium tuberculosis
TWRSLGEI

SEQ ID NO: 21327 - protein, 8 aa, Mycobacterium tuberculosis
WRSLGEIG

SEQ ID NO: 21328 - protein, 8 aa, Mycobacterium tuberculosis
RSLGEIGN

SEQ ID NO: 21329 - protein, 8 aa, Mycobacterium tuberculosis
SLGEIGNL

SEQ ID NO: 21330 - protein, 8 aa, Mycobacterium tuberculosis
LGEIGNLS

SEQ ID NO: 21331 - protein, 8 aa, Mycobacterium tuberculosis
GEIGNLSS

SEQ ID NO: 21332 - protein, 8 aa, Mycobacterium tuberculosis
EIGNLSSA

SEQ ID NO: 21333 - protein, 8 aa, Mycobacterium tuberculosis
IGNLSSAS

SEQ ID NO: 21334 - protein, 8 aa, Mycobacterium tuberculosis
GNLSSASV

SEQ ID NO: 21335 - protein, 8 aa, Mycobacterium tuberculosis
NLSSASVL

SEQ ID NO: 21336 - protein, 8 aa, Mycobacterium tuberculosis
LSSASVLH

SEQ ID NO: 21337 - protein, 8 aa, Mycobacterium tuberculosis
SSASVLHV

SEQ ID NO: 21338 - protein, 8 aa, Mycobacterium tuberculosis
SASVLHVL

SEQ ID NO: 21339 - protein, 8 aa, Mycobacterium tuberculosis
ASVLHVLR

SEQ ID NO: 21340 - protein, 8 aa, Mycobacterium tuberculosis
SVLHVLRD

SEQ ID NO: 21341 - protein, 8 aa, Mycobacterium tuberculosis
VLHVLRDT

SEQ ID NO: 21342 - protein, 8 aa, Mycobacterium tuberculosis
LHVLRDTI

SEQ ID NO: 21343 - protein, 8 aa, Mycobacterium tuberculosis
HVLRDTIA

SEQ ID NO: 21344 - protein, 8 aa, Mycobacterium tuberculosis
VLRDTIAK

SEQ ID NO: 21345 - protein, 8 aa, Mycobacterium tuberculosis
LRDTIAKP

SEQ ID NO: 21346 - protein, 8 aa, Mycobacterium tuberculosis
RDTIAKPP

SEQ ID NO: 21347 - protein, 8 aa, Mycobacterium tuberculosis
DTIAKPPP

SEQ ID NO: 21348 - protein, 8 aa, Mycobacterium tuberculosis
TIAKPPPS

SEQ ID NO: 21349 - protein, 8 aa, Mycobacterium tuberculosis
IAKPPPSG

SEQ ID NO: 21350 - protein, 8 aa, Mycobacterium tuberculosis
AKPPPSGS

SEQ ID NO: 21351 - protein, 8 aa, Mycobacterium tuberculosis
KPPPSGSP

SEQ ID NO: 21352 - protein, 8 aa, Mycobacterium tuberculosis
PPPSGSPG

SEQ ID NO: 21353 - protein, 8 aa, Mycobacterium tuberculosis
PPSGSPGL

SEQ ID NO: 21354 - protein, 8 aa, Mycobacterium tuberculosis
PSGSPGLM

SEQ ID NO: 21355 - protein, 8 aa, Mycobacterium tuberculosis
SGSPGLMI

SEQ ID NO: 21356 - protein, 8 aa, Mycobacterium tuberculosis
GSPGLMIA

SEQ ID NO: 21357 - protein, 8 aa, Mycobacterium tuberculosis
SPGLMIAM

SEQ ID NO: 21358 - protein, 8 aa, Mycobacterium tuberculosis
PGLMIAMG

SEQ ID NO: 21359 - protein, 8 aa, Mycobacterium tuberculosis
GLMIAMGP

SEQ ID NO: 21360 - protein, 8 aa, Mycobacterium tuberculosis
LMIAMGPG

SEQ ID NO: 21361 - protein, 8 aa, Mycobacterium tuberculosis
MIAMGPGF

SEQ ID NO: 21362 - protein, 8 aa, Mycobacterium tuberculosis
IAMGPGFC

SEQ ID NO: 21363 - protein, 8 aa, Mycobacterium tuberculosis
AMGPGFCS

SEQ ID NO: 21364 - protein, 8 aa, Mycobacterium tuberculosis
MGPGFCSE

SEQ ID NO: 21365 - protein, 8 aa, Mycobacterium tuberculosis
GPGFCSEL

SEQ ID NO: 21366 - protein, 8 aa, Mycobacterium tuberculosis
PGFCSELV

SEQ ID NO: 21367 - protein, 8 aa, Mycobacterium tuberculosis
GFCSELVL

SEQ ID NO: 21368 - protein, 8 aa, Mycobacterium tuberculosis
FCSELVLL

SEQ ID NO: 21369 - protein, 8 aa, Mycobacterium tuberculosis
CSELVLLR

SEQ ID NO: 21370 - protein, 8 aa, Mycobacterium tuberculosis
SELVLLRW

SEQ ID NO: 21371 - protein, 8 aa, Mycobacterium tuberculosis
ELVLLRWH

SEQ ID NO: 21372 - protein, 9 aa, Mycobacterium tuberculosis
MSVIAGVFG

SEQ ID NO: 21373 - protein, 9 aa, Mycobacterium tuberculosis
SVIAGVFGA

SEQ ID NO: 21374 - protein, 9 aa, Mycobacterium tuberculosis
VIAGVFGAL

SEQ ID NO: 21375 - protein, 9 aa, Mycobacterium tuberculosis
IAGVFGALP

SEQ ID NO: 21376 - protein, 9 aa, Mycobacterium tuberculosis
AGVFGALPP

SEQ ID NO: 21377 - protein, 9 aa, Mycobacterium tuberculosis
GVFGALPPY

SEQ ID NO: 21378 - protein, 9 aa, Mycobacterium tuberculosis
VFGALPPYR

SEQ ID NO: 21379 - protein, 9 aa, Mycobacterium tuberculosis
FGALPPYRY

SEQ ID NO: 21380 - protein, 9 aa, Mycobacterium tuberculosis
GALPPYRYS

SEQ ID NO: 21381 - protein, 9 aa, Mycobacterium tuberculosis
ALPPYRYSQ

SEQ ID NO: 21382 - protein, 9 aa, Mycobacterium tuberculosis
LPPYRYSQR

SEQ ID NO: 21383 - protein, 9 aa, Mycobacterium tuberculosis
PPYRYSQRE

SEQ ID NO: 21384 - protein, 9 aa, Mycobacterium tuberculosis
PYRYSQREL

SEQ ID NO: 21385 - protein, 9 aa, Mycobacterium tuberculosis
YRYSQRELT

SEQ ID NO: 21386 - protein, 9 aa, Mycobacterium tuberculosis
RYSQRELTD

SEQ ID NO: 21387 - protein, 9 aa, Mycobacterium tuberculosis
YSQRELTDS

SEQ ID NO: 21388 - protein, 9 aa, Mycobacterium tuberculosis
SQRELTDSF

SEQ ID NO: 21389 - protein, 9 aa, Mycobacterium tuberculosis
QRELTDSFV

SEQ ID NO: 21390 - protein, 9 aa, Mycobacterium tuberculosis
RELTDSFVS

SEQ ID NO: 21391 - protein, 9 aa, Mycobacterium tuberculosis
ELTDSFVSI

SEQ ID NO: 21392 - protein, 9 aa, Mycobacterium tuberculosis
LTDSFVSIP

SEQ ID NO: 21393 - protein, 9 aa, Mycobacterium tuberculosis
TDSFVSIPD

SEQ ID NO: 21394 - protein, 9 aa, Mycobacterium tuberculosis
DSFVSIPDF

SEQ ID NO: 21395 - protein, 9 aa, Mycobacterium tuberculosis
SFVSIPDFE

SEQ ID NO: 21396 - protein, 9 aa, Mycobacterium tuberculosis
FVSIPDFEG

SEQ ID NO: 21397 - protein, 9 aa, Mycobacterium tuberculosis
VSIPDFEGY

SEQ ID NO: 21398 - protein, 9 aa, Mycobacterium tuberculosis
SIPDFEGYE

SEQ ID NO: 21399 - protein, 9 aa, Mycobacterium tuberculosis
IPDFEGYED

SEQ ID NO: 21400 - protein, 9 aa, Mycobacterium tuberculosis
PDFEGYEDI

SEQ ID NO: 21401 - protein, 9 aa, Mycobacterium tuberculosis
DFEGYEDIV

SEQ ID NO: 21402 - protein, 9 aa, Mycobacterium tuberculosis
FEGYEDIVR

SEQ ID NO: 21403 - protein, 9 aa, Mycobacterium tuberculosis
EGYEDIVRQ

SEQ ID NO: 21404 - protein, 9 aa, Mycobacterium tuberculosis
GYEDIVRQL

SEQ ID NO: 21405 - protein, 9 aa, Mycobacterium tuberculosis
YEDIVRQLH

SEQ ID NO: 21406 - protein, 9 aa, Mycobacterium tuberculosis
EDIVRQLHA

SEQ ID NO: 21407 - protein, 9 aa, Mycobacterium tuberculosis
DIVRQLHAS

SEQ ID NO: 21408 - protein, 9 aa, Mycobacterium tuberculosis
IVRQLHASA

SEQ ID NO: 21409 - protein, 9 aa, Mycobacterium tuberculosis
VRQLHASAK

SEQ ID NO: 21410 - protein, 9 aa, Mycobacterium tuberculosis
RQLHASAKV

SEQ ID NO: 21411 - protein, 9 aa, Mycobacterium tuberculosis
QLHASAKVN

SEQ ID NO: 21412 - protein, 9 aa, Mycobacterium tuberculosis
LHASAKVNS

SEQ ID NO: 21413 - protein, 9 aa, Mycobacterium tuberculosis
HASAKVNSR

SEQ ID NO: 21414 - protein, 9 aa, Mycobacterium tuberculosis
ASAKVNSRH

SEQ ID NO: 21415 - protein, 9 aa, Mycobacterium tuberculosis
SAKVNSRHL

SEQ ID NO: 21416 - protein, 9 aa, Mycobacterium tuberculosis
AKVNSRHLV

SEQ ID NO: 21417 - protein, 9 aa, Mycobacterium tuberculosis
KVNSRHLVL

SEQ ID NO: 21418 - protein, 9 aa, Mycobacterium tuberculosis
VNSRHLVLP

SEQ ID NO: 21419 - protein, 9 aa, Mycobacterium tuberculosis
NSRHLVLPL

SEQ ID NO: 21420 - protein, 9 aa, Mycobacterium tuberculosis
SRHLVLPLE

SEQ ID NO: 21421 - protein, 9 aa, Mycobacterium tuberculosis
RHLVLPLEK

SEQ ID NO: 21422 - protein, 9 aa, Mycobacterium tuberculosis
HLVLPLEKY

SEQ ID NO: 21423 - protein, 9 aa, Mycobacterium tuberculosis
LVLPLEKYP

SEQ ID NO: 21424 - protein, 9 aa, Mycobacterium tuberculosis
VLPLEKYPK

SEQ ID NO: 21425 - protein, 9 aa, Mycobacterium tuberculosis
LPLEKYPKL

SEQ ID NO: 21426 - protein, 9 aa, Mycobacterium tuberculosis
PLEKYPKLT

SEQ ID NO: 21427 - protein, 9 aa, Mycobacterium tuberculosis
LEKYPKLTD

SEQ ID NO: 21428 - protein, 9 aa, Mycobacterium tuberculosis
EKYPKLTDF

SEQ ID NO: 21429 - protein, 9 aa, Mycobacterium tuberculosis
KYPKLTDFG

SEQ ID NO: 21430 - protein, 9 aa, Mycobacterium tuberculosis
YPKLTDFGE

SEQ ID NO: 21431 - protein, 9 aa, Mycobacterium tuberculosis
PKLTDFGEA

SEQ ID NO: 21432 - protein, 9 aa, Mycobacterium tuberculosis
KLTDFGEAN

SEQ ID NO: 21433 - protein, 9 aa, Mycobacterium tuberculosis
LTDFGEANK

SEQ ID NO: 21434 - protein, 9 aa, Mycobacterium tuberculosis
TDFGEANKI

SEQ ID NO: 21435 - protein, 9 aa, Mycobacterium tuberculosis
DFGEANKIF

SEQ ID NO: 21436 - protein, 9 aa, Mycobacterium tuberculosis
FGEANKIFI

SEQ ID NO: 21437 - protein, 9 aa, Mycobacterium tuberculosis
GEANKIFIE

SEQ ID NO: 21438 - protein, 9 aa, Mycobacterium tuberculosis
EANKIFIEK

SEQ ID NO: 21439 - protein, 9 aa, Mycobacterium tuberculosis
ANKIFIEKA

SEQ ID NO: 21440 - protein, 9 aa, Mycobacterium tuberculosis
NKIFIEKAV

SEQ ID NO: 21441 - protein, 9 aa, Mycobacterium tuberculosis
KIFIEKAVD

SEQ ID NO: 21442 - protein, 9 aa, Mycobacterium tuberculosis
IFIEKAVDL

SEQ ID NO: 21443 - protein, 9 aa, Mycobacterium tuberculosis
FIEKAVDLG

SEQ ID NO: 21444 - protein, 9 aa, Mycobacterium tuberculosis
IEKAVDLGV

SEQ ID NO: 21445 - protein, 9 aa, Mycobacterium tuberculosis
EKAVDLGVQ

SEQ ID NO: 21446 - protein, 9 aa, Mycobacterium tuberculosis
KAVDLGVQA

SEQ ID NO: 21447 - protein, 9 aa, Mycobacterium tuberculosis
AVDLGVQAL

SEQ ID NO: 21448 - protein, 9 aa, Mycobacterium tuberculosis
VDLGVQALA

SEQ ID NO: 21449 - protein, 9 aa, Mycobacterium tuberculosis
DLGVQALAG

SEQ ID NO: 21450 - protein, 9 aa, Mycobacterium tuberculosis
LGVQALAGA

SEQ ID NO: 21451 - protein, 9 aa, Mycobacterium tuberculosis
GVQALAGAL

SEQ ID NO: 21452 - protein, 9 aa, Mycobacterium tuberculosis
VQALAGALD

SEQ ID NO: 21453 - protein, 9 aa, Mycobacterium tuberculosis
QALAGALDE

SEQ ID NO: 21454 - protein, 9 aa, Mycobacterium tuberculosis
ALAGALDES

SEQ ID NO: 21455 - protein, 9 aa, Mycobacterium tuberculosis
LAGALDESG

SEQ ID NO: 21456 - protein, 9 aa, Mycobacterium tuberculosis
AGALDESGL

SEQ ID NO: 21457 - protein, 9 aa, Mycobacterium tuberculosis
GALDESGLR

SEQ ID NO: 21458 - protein, 9 aa, Mycobacterium tuberculosis
ALDESGLRP

SEQ ID NO: 21459 - protein, 9 aa, Mycobacterium tuberculosis
LDESGLRPE

SEQ ID NO: 21460 - protein, 9 aa, Mycobacterium tuberculosis
DESGLRPED

SEQ ID NO: 21461 - protein, 9 aa, Mycobacterium tuberculosis
ESGLRPEDL

SEQ ID NO: 21462 - protein, 9 aa, Mycobacterium tuberculosis
SGLRPEDLD

SEQ ID NO: 21463 - protein, 9 aa, Mycobacterium tuberculosis
GLRPEDLDV

SEQ ID NO: 21464 - protein, 9 aa, Mycobacterium tuberculosis
LRPEDLDVL

SEQ ID NO: 21465 - protein, 9 aa, Mycobacterium tuberculosis
RPEDLDVLI

SEQ ID NO: 21466 - protein, 9 aa, Mycobacterium tuberculosis
PEDLDVLIT

SEQ ID NO: 21467 - protein, 9 aa, Mycobacterium tuberculosis
EDLDVLITA

SEQ ID NO: 21468 - protein, 9 aa, Mycobacterium tuberculosis
DLDVLITAT

SEQ ID NO: 21469 - protein, 9 aa, Mycobacterium tuberculosis
LDVLITATV

SEQ ID NO: 21470 - protein, 9 aa, Mycobacterium tuberculosis
DVLITATVT

SEQ ID NO: 21471 - protein, 9 aa, Mycobacterium tuberculosis
VLITATVTG

SEQ ID NO: 21472 - protein, 9 aa, Mycobacterium tuberculosis
LITATVTGL

SEQ ID NO: 21473 - protein, 9 aa, Mycobacterium tuberculosis
ITATVTGLA

SEQ ID NO: 21474 - protein, 9 aa, Mycobacterium tuberculosis
TATVTGLAV

SEQ ID NO: 21475 - protein, 9 aa, Mycobacterium tuberculosis
ATVTGLAVP

SEQ ID NO: 21476 - protein, 9 aa, Mycobacterium tuberculosis
TVTGLAVPS

SEQ ID NO: 21477 - protein, 9 aa, Mycobacterium tuberculosis
VTGLAVPSL

SEQ ID NO: 21478 - protein, 9 aa, Mycobacterium tuberculosis
TGLAVPSLD

SEQ ID NO: 21479 - protein, 9 aa, Mycobacterium tuberculosis
GLAVPSLDA

SEQ ID NO: 21480 - protein, 9 aa, Mycobacterium tuberculosis
LAVPSLDAR

SEQ ID NO: 21481 - protein, 9 aa, Mycobacterium tuberculosis
AVPSLDARI

SEQ ID NO: 21482 - protein, 9 aa, Mycobacterium tuberculosis
VPSLDARIA

SEQ ID NO: 21483 - protein, 9 aa, Mycobacterium tuberculosis
PSLDARIAG

SEQ ID NO: 21484 - protein, 9 aa, Mycobacterium tuberculosis
SLDARIAGR

SEQ ID NO: 21485 - protein, 9 aa, Mycobacterium tuberculosis
LDARIAGRL

SEQ ID NO: 21486 - protein, 9 aa, Mycobacterium tuberculosis
DARIAGRLG

SEQ ID NO: 21487 - protein, 9 aa, Mycobacterium tuberculosis
ARIAGRLGL

SEQ ID NO: 21488 - protein, 9 aa, Mycobacterium tuberculosis
RIAGRLGLR

SEQ ID NO: 21489 - protein, 9 aa, Mycobacterium tuberculosis
IAGRLGLRA

SEQ ID NO: 21490 - protein, 9 aa, Mycobacterium tuberculosis
AGRLGLRAD

SEQ ID NO: 21491 - protein, 9 aa, Mycobacterium tuberculosis
GRLGLRADV

SEQ ID NO: 21492 - protein, 9 aa, Mycobacterium tuberculosis
RLGLRADVR

SEQ ID NO: 21493 - protein, 9 aa, Mycobacterium tuberculosis
LGLRADVRR

SEQ ID NO: 21494 - protein, 9 aa, Mycobacterium tuberculosis
GLRADVRRV

SEQ ID NO: 21495 - protein, 9 aa, Mycobacterium tuberculosis
LRADVRRVP

SEQ ID NO: 21496 - protein, 9 aa, Mycobacterium tuberculosis
RADVRRVPL

SEQ ID NO: 21497 - protein, 9 aa, Mycobacterium tuberculosis
ADVRRVPLF

SEQ ID NO: 21498 - protein, 9 aa, Mycobacterium tuberculosis
DVRRVPLFG

SEQ ID NO: 21499 - protein, 9 aa, Mycobacterium tuberculosis
VRRVPLFGL

SEQ ID NO: 21500 - protein, 9 aa, Mycobacterium tuberculosis
RRVPLFGLG

SEQ ID NO: 21501 - protein, 9 aa, Mycobacterium tuberculosis
RVPLFGLGC

SEQ ID NO: 21502 - protein, 9 aa, Mycobacterium tuberculosis
VPLFGLGCV

SEQ ID NO: 21503 - protein, 9 aa, Mycobacterium tuberculosis
PLFGLGCVA

SEQ ID NO: 21504 - protein, 9 aa, Mycobacterium tuberculosis
LFGLGCVAG

SEQ ID NO: 21505 - protein, 9 aa, Mycobacterium tuberculosis
FGLGCVAGA

SEQ ID NO: 21506 - protein, 9 aa, Mycobacterium tuberculosis
GLGCVAGAA

SEQ ID NO: 21507 - protein, 9 aa, Mycobacterium tuberculosis
LGCVAGAAG

SEQ ID NO: 21508 - protein, 9 aa, Mycobacterium tuberculosis
GCVAGAAGV

SEQ ID NO: 21509 - protein, 9 aa, Mycobacterium tuberculosis
CVAGAAGVA

SEQ ID NO: 21510 - protein, 9 aa, Mycobacterium tuberculosis
VAGAAGVAR

SEQ ID NO: 21511 - protein, 9 aa, Mycobacterium tuberculosis
AGAAGVARL

SEQ ID NO: 21512 - protein, 9 aa, Mycobacterium tuberculosis
GAAGVARLH

SEQ ID NO: 21513 - protein, 9 aa, Mycobacterium tuberculosis
AAGVARLHD

SEQ ID NO: 21514 - protein, 9 aa, Mycobacterium tuberculosis
AGVARLHDY

SEQ ID NO: 21515 - protein, 9 aa, Mycobacterium tuberculosis
GVARLHDYL

SEQ ID NO: 21516 - protein, 9 aa, Mycobacterium tuberculosis
VARLHDYLR

SEQ ID NO: 21517 - protein, 9 aa, Mycobacterium tuberculosis
ARLHDYLRG

SEQ ID NO: 21518 - protein, 9 aa, Mycobacterium tuberculosis
RLHDYLRGA

SEQ ID NO: 21519 - protein, 9 aa, Mycobacterium tuberculosis
LHDYLRGAP

SEQ ID NO: 21520 - protein, 9 aa, Mycobacterium tuberculosis
HDYLRGAPD

SEQ ID NO: 21521 - protein, 9 aa, Mycobacterium tuberculosis
DYLRGAPDG

SEQ ID NO: 21522 - protein, 9 aa, Mycobacterium tuberculosis
YLRGAPDGV

SEQ ID NO: 21523 - protein, 9 aa, Mycobacterium tuberculosis
LRGAPDGVA

SEQ ID NO: 21524 - protein, 9 aa, Mycobacterium tuberculosis
RGAPDGVAA

SEQ ID NO: 21525 - protein, 9 aa, Mycobacterium tuberculosis
GAPDGVAAL

SEQ ID NO: 21526 - protein, 9 aa, Mycobacterium tuberculosis
APDGVAALV

SEQ ID NO: 21527 - protein, 9 aa, Mycobacterium tuberculosis
PDGVAALVS

SEQ ID NO: 21528 - protein, 9 aa, Mycobacterium tuberculosis
DGVAALVSV

SEQ ID NO: 21529 - protein, 9 aa, Mycobacterium tuberculosis
GVAALVSVE

SEQ ID NO: 21530 - protein, 9 aa, Mycobacterium tuberculosis
VAALVSVEL

SEQ ID NO: 21531 - protein, 9 aa, Mycobacterium tuberculosis
AALVSVELC

SEQ ID NO: 21532 - protein, 9 aa, Mycobacterium tuberculosis
ALVSVELCS

SEQ ID NO: 21533 - protein, 9 aa, Mycobacterium tuberculosis
LVSVELCSL

SEQ ID NO: 21534 - protein, 9 aa, Mycobacterium tuberculosis
VSVELCSLT

SEQ ID NO: 21535 - protein, 9 aa, Mycobacterium tuberculosis
SVELCSLTY

SEQ ID NO: 21536 - protein, 9 aa, Mycobacterium tuberculosis
VELCSLTYP

SEQ ID NO: 21537 - protein, 9 aa, Mycobacterium tuberculosis
ELCSLTYPG

SEQ ID NO: 21538 - protein, 9 aa, Mycobacterium tuberculosis
LCSLTYPGY

SEQ ID NO: 21539 - protein, 9 aa, Mycobacterium tuberculosis
CSLTYPGYK

SEQ ID NO: 21540 - protein, 9 aa, Mycobacterium tuberculosis
SLTYPGYKP

SEQ ID NO: 21541 - protein, 9 aa, Mycobacterium tuberculosis
LTYPGYKPT

SEQ ID NO: 21542 - protein, 9 aa, Mycobacterium tuberculosis
TYPGYKPTL

SEQ ID NO: 21543 - protein, 9 aa, Mycobacterium tuberculosis
YPGYKPTLP

SEQ ID NO: 21544 - protein, 9 aa, Mycobacterium tuberculosis
PGYKPTLPG

SEQ ID NO: 21545 - protein, 9 aa, Mycobacterium tuberculosis
GYKPTLPGL

SEQ ID NO: 21546 - protein, 9 aa, Mycobacterium tuberculosis
YKPTLPGLV

SEQ ID NO: 21547 - protein, 9 aa, Mycobacterium tuberculosis
KPTLPGLVG

SEQ ID NO: 21548 - protein, 9 aa, Mycobacterium tuberculosis
PTLPGLVGS

SEQ ID NO: 21549 - protein, 9 aa, Mycobacterium tuberculosis
TLPGLVGSA

SEQ ID NO: 21550 - protein, 9 aa, Mycobacterium tuberculosis
LPGLVGSAL

SEQ ID NO: 21551 - protein, 9 aa, Mycobacterium tuberculosis
PGLVGSALF

SEQ ID NO: 21552 - protein, 9 aa, Mycobacterium tuberculosis
GLVGSALFA

SEQ ID NO: 21553 - protein, 9 aa, Mycobacterium tuberculosis
LVGSALFAD

SEQ ID NO: 21554 - protein, 9 aa, Mycobacterium tuberculosis
VGSALFADG

SEQ ID NO: 21555 - protein, 9 aa, Mycobacterium tuberculosis
GSALFADGA

SEQ ID NO: 21556 - protein, 9 aa, Mycobacterium tuberculosis
SALFADGAA

SEQ ID NO: 21557 - protein, 9 aa, Mycobacterium tuberculosis
ALFADGAAA

SEQ ID NO: 21558 - protein, 9 aa, Mycobacterium tuberculosis
LFADGAAAV

SEQ ID NO: 21559 - protein, 9 aa, Mycobacterium tuberculosis
FADGAAAVV

SEQ ID NO: 21560 - protein, 9 aa, Mycobacterium tuberculosis
ADGAAAVVA

SEQ ID NO: 21561 - protein, 9 aa, Mycobacterium tuberculosis
DGAAAVVAA

SEQ ID NO: 21562 - protein, 9 aa, Mycobacterium tuberculosis
GAAAVVAAG

SEQ ID NO: 21563 - protein, 9 aa, Mycobacterium tuberculosis
AAAVVAAGV

SEQ ID NO: 21564 - protein, 9 aa, Mycobacterium tuberculosis
AAVVAAGVK

SEQ ID NO: 21565 - protein, 9 aa, Mycobacterium tuberculosis
AVVAAGVKR

SEQ ID NO: 21566 - protein, 9 aa, Mycobacterium tuberculosis
VVAAGVKRA

SEQ ID NO: 21567 - protein, 9 aa, Mycobacterium tuberculosis
VAAGVKRAQ

SEQ ID NO: 21568 - protein, 9 aa, Mycobacterium tuberculosis
AAGVKRAQD

SEQ ID NO: 21569 - protein, 9 aa, Mycobacterium tuberculosis
AGVKRAQDI

SEQ ID NO: 21570 - protein, 9 aa, Mycobacterium tuberculosis
GVKRAQDIG

SEQ ID NO: 21571 - protein, 9 aa, Mycobacterium tuberculosis
VKRAQDIGA

SEQ ID NO: 21572 - protein, 9 aa, Mycobacterium tuberculosis
KRAQDIGAD

SEQ ID NO: 21573 - protein, 9 aa, Mycobacterium tuberculosis
RAQDIGADG

SEQ ID NO: 21574 - protein, 9 aa, Mycobacterium tuberculosis
AQDIGADGP

SEQ ID NO: 21575 - protein, 9 aa, Mycobacterium tuberculosis
QDIGADGPD

SEQ ID NO: 21576 - protein, 9 aa, Mycobacterium tuberculosis
DIGADGPDI

SEQ ID NO: 21577 - protein, 9 aa, Mycobacterium tuberculosis
IGADGPDIL

SEQ ID NO: 21578 - protein, 9 aa, Mycobacterium tuberculosis
GADGPDILD

SEQ ID NO: 21579 - protein, 9 aa, Mycobacterium tuberculosis
ADGPDILDS

SEQ ID NO: 21580 - protein, 9 aa, Mycobacterium tuberculosis
DGPDILDSR

SEQ ID NO: 21581 - protein, 9 aa, Mycobacterium tuberculosis
GPDILDSRS

SEQ ID NO: 21582 - protein, 9 aa, Mycobacterium tuberculosis
PDILDSRSH

SEQ ID NO: 21583 - protein, 9 aa, Mycobacterium tuberculosis
DILDSRSHL

SEQ ID NO: 21584 - protein, 9 aa, Mycobacterium tuberculosis
ILDSRSHLY

SEQ ID NO: 21585 - protein, 9 aa, Mycobacterium tuberculosis
LDSRSHLYP

SEQ ID NO: 21586 - protein, 9 aa, Mycobacterium tuberculosis
DSRSHLYPD

SEQ ID NO: 21587 - protein, 9 aa, Mycobacterium tuberculosis
SRSHLYPDS

SEQ ID NO: 21588 - protein, 9 aa, Mycobacterium tuberculosis
RSHLYPDSL

SEQ ID NO: 21589 - protein, 9 aa, Mycobacterium tuberculosis
SHLYPDSLR

SEQ ID NO: 21590 - protein, 9 aa, Mycobacterium tuberculosis
HLYPDSLRT

SEQ ID NO: 21591 - protein, 9 aa, Mycobacterium tuberculosis
LYPDSLRTM

SEQ ID NO: 21592 - protein, 9 aa, Mycobacterium tuberculosis
YPDSLRTMG

SEQ ID NO: 21593 - protein, 9 aa, Mycobacterium tuberculosis
PDSLRTMGY

SEQ ID NO: 21594 - protein, 9 aa, Mycobacterium tuberculosis
DSLRTMGYD

SEQ ID NO: 21595 - protein, 9 aa, Mycobacterium tuberculosis
SLRTMGYDV

SEQ ID NO: 21596 - protein, 9 aa, Mycobacterium tuberculosis
LRTMGYDVG

SEQ ID NO: 21597 - protein, 9 aa, Mycobacterium tuberculosis
RTMGYDVGS

SEQ ID NO: 21598 - protein, 9 aa, Mycobacterium tuberculosis
TMGYDVGSA

SEQ ID NO: 21599 - protein, 9 aa, Mycobacterium tuberculosis
MGYDVGSAG

SEQ ID NO: 21600 - protein, 9 aa, Mycobacterium tuberculosis
GYDVGSAGF

SEQ ID NO: 21601 - protein, 9 aa, Mycobacterium tuberculosis
YDVGSAGFE

SEQ ID NO: 21602 - protein, 9 aa, Mycobacterium tuberculosis
DVGSAGFEL

SEQ ID NO: 21603 - protein, 9 aa, Mycobacterium tuberculosis
VGSAGFELV

SEQ ID NO: 21604 - protein, 9 aa, Mycobacterium tuberculosis
GSAGFELVL

SEQ ID NO: 21605 - protein, 9 aa, Mycobacterium tuberculosis
SAGFELVLS

SEQ ID NO: 21606 - protein, 9 aa, Mycobacterium tuberculosis
AGFELVLSR

SEQ ID NO: 21607 - protein, 9 aa, Mycobacterium tuberculosis
GFELVLSRD

SEQ ID NO: 21608 - protein, 9 aa, Mycobacterium tuberculosis
FELVLSRDL

SEQ ID NO: 21609 - protein, 9 aa, Mycobacterium tuberculosis
ELVLSRDLA

SEQ ID NO: 21610 - protein, 9 aa, Mycobacterium tuberculosis
LVLSRDLAA

SEQ ID NO: 21611 - protein, 9 aa, Mycobacterium tuberculosis
VLSRDLAAV

SEQ ID NO: 21612 - protein, 9 aa, Mycobacterium tuberculosis
LSRDLAAVV

SEQ ID NO: 21613 - protein, 9 aa, Mycobacterium tuberculosis
SRDLAAVVE

SEQ ID NO: 21614 - protein, 9 aa, Mycobacterium tuberculosis
RDLAAVVEQ

SEQ ID NO: 21615 - protein, 9 aa, Mycobacterium tuberculosis
DLAAVVEQY

SEQ ID NO: 21616 - protein, 9 aa, Mycobacterium tuberculosis
LAAVVEQYL

SEQ ID NO: 21617 - protein, 9 aa, Mycobacterium tuberculosis
AAVVEQYLG

SEQ ID NO: 21618 - protein, 9 aa, Mycobacterium tuberculosis
AVVEQYLGN

SEQ ID NO: 21619 - protein, 9 aa, Mycobacterium tuberculosis
VVEQYLGND

SEQ ID NO: 21620 - protein, 9 aa, Mycobacterium tuberculosis
VEQYLGNDV

SEQ ID NO: 21621 - protein, 9 aa, Mycobacterium tuberculosis
EQYLGNDVT

SEQ ID NO: 21622 - protein, 9 aa, Mycobacterium tuberculosis
QYLGNDVTT

SEQ ID NO: 21623 - protein, 9 aa, Mycobacterium tuberculosis
YLGNDVTTF

SEQ ID NO: 21624 - protein, 9 aa, Mycobacterium tuberculosis
LGNDVTTFL

SEQ ID NO: 21625 - protein, 9 aa, Mycobacterium tuberculosis
GNDVTTFLA

SEQ ID NO: 21626 - protein, 9 aa, Mycobacterium tuberculosis
NDVTTFLAS

SEQ ID NO: 21627 - protein, 9 aa, Mycobacterium tuberculosis
DVTTFLASH

SEQ ID NO: 21628 - protein, 9 aa, Mycobacterium tuberculosis
VTTFLASHG

SEQ ID NO: 21629 - protein, 9 aa, Mycobacterium tuberculosis
TTFLASHGL

SEQ ID NO: 21630 - protein, 9 aa, Mycobacterium tuberculosis
TFLASHGLS

SEQ ID NO: 21631 - protein, 9 aa, Mycobacterium tuberculosis
FLASHGLST

SEQ ID NO: 21632 - protein, 9 aa, Mycobacterium tuberculosis
LASHGLSTT

SEQ ID NO: 21633 - protein, 9 aa, Mycobacterium tuberculosis
ASHGLSTTD

SEQ ID NO: 21634 - protein, 9 aa, Mycobacterium tuberculosis
SHGLSTTDV

SEQ ID NO: 21635 - protein, 9 aa, Mycobacterium tuberculosis
HGLSTTDVG

SEQ ID NO: 21636 - protein, 9 aa, Mycobacterium tuberculosis
GLSTTDVGA

SEQ ID NO: 21637 - protein, 9 aa, Mycobacterium tuberculosis
LSTTDVGAW

SEQ ID NO: 21638 - protein, 9 aa, Mycobacterium tuberculosis
STTDVGAWV

SEQ ID NO: 21639 - protein, 9 aa, Mycobacterium tuberculosis
TTDVGAWVT

SEQ ID NO: 21640 - protein, 9 aa, Mycobacterium tuberculosis
TDVGAWVTH

SEQ ID NO: 21641 - protein, 9 aa, Mycobacterium tuberculosis
DVGAWVTHP

SEQ ID NO: 21642 - protein, 9 aa, Mycobacterium tuberculosis
VGAWVTHPG

SEQ ID NO: 21643 - protein, 9 aa, Mycobacterium tuberculosis
GAWVTHPGG

SEQ ID NO: 21644 - protein, 9 aa, Mycobacterium tuberculosis
AWVTHPGGP

SEQ ID NO: 21645 - protein, 9 aa, Mycobacterium tuberculosis
WVTHPGGPK

SEQ ID NO: 21646 - protein, 9 aa, Mycobacterium tuberculosis
VTHPGGPKI

SEQ ID NO: 21647 - protein, 9 aa, Mycobacterium tuberculosis
THPGGPKII

SEQ ID NO: 21648 - protein, 9 aa, Mycobacterium tuberculosis
HPGGPKIIN

SEQ ID NO: 21649 - protein, 9 aa, Mycobacterium tuberculosis
PGGPKIINA

SEQ ID NO: 21650 - protein, 9 aa, Mycobacterium tuberculosis
GGPKIINAI

SEQ ID NO: 21651 - protein, 9 aa, Mycobacterium tuberculosis
GPKIINAIT

SEQ ID NO: 21652 - protein, 9 aa, Mycobacterium tuberculosis
PKIINAITE

SEQ ID NO: 21653 - protein, 9 aa, Mycobacterium tuberculosis
KIINAITET

SEQ ID NO: 21654 - protein, 9 aa, Mycobacterium tuberculosis
IINAITETL

SEQ ID NO: 21655 - protein, 9 aa, Mycobacterium tuberculosis
INAITETLD

SEQ ID NO: 21656 - protein, 9 aa, Mycobacterium tuberculosis
NAITETLDL

SEQ ID NO: 21657 - protein, 9 aa, Mycobacterium tuberculosis
AITETLDLS

SEQ ID NO: 21658 - protein, 9 aa, Mycobacterium tuberculosis
ITETLDLSP

SEQ ID NO: 21659 - protein, 9 aa, Mycobacterium tuberculosis
TETLDLSPQ

SEQ ID NO: 21660 - protein, 9 aa, Mycobacterium tuberculosis
ETLDLSPQA

SEQ ID NO: 21661 - protein, 9 aa, Mycobacterium tuberculosis
TLDLSPQAL

SEQ ID NO: 21662 - protein, 9 aa, Mycobacterium tuberculosis
LDLSPQALE

SEQ ID NO: 21663 - protein, 9 aa, Mycobacterium tuberculosis
DLSPQALEL

SEQ ID NO: 21664 - protein, 9 aa, Mycobacterium tuberculosis
LSPQALELT

SEQ ID NO: 21665 - protein, 9 aa, Mycobacterium tuberculosis
SPQALELTW

SEQ ID NO: 21666 - protein, 9 aa, Mycobacterium tuberculosis
PQALELTWR

SEQ ID NO: 21667 - protein, 9 aa, Mycobacterium tuberculosis
QALELTWRS

SEQ ID NO: 21668 - protein, 9 aa, Mycobacterium tuberculosis
ALELTWRSL

SEQ ID NO: 21669 - protein, 9 aa, Mycobacterium tuberculosis
LELTWRSLG

SEQ ID NO: 21670 - protein, 9 aa, Mycobacterium tuberculosis
ELTWRSLGE

SEQ ID NO: 21671 - protein, 9 aa, Mycobacterium tuberculosis
LTWRSLGEI

SEQ ID NO: 21672 - protein, 9 aa, Mycobacterium tuberculosis
TWRSLGEIG

SEQ ID NO: 21673 - protein, 9 aa, Mycobacterium tuberculosis
WRSLGEIGN

SEQ ID NO: 21674 - protein, 9 aa, Mycobacterium tuberculosis
RSLGEIGNL

SEQ ID NO: 21675 - protein, 9 aa, Mycobacterium tuberculosis
SLGEIGNLS

SEQ ID NO: 21676 - protein, 9 aa, Mycobacterium tuberculosis
LGEIGNLSS

SEQ ID NO: 21677 - protein, 9 aa, Mycobacterium tuberculosis
GEIGNLSSA

SEQ ID NO: 21678 - protein, 9 aa, Mycobacterium tuberculosis
EIGNLSSAS

SEQ ID NO: 21679 - protein, 9 aa, Mycobacterium tuberculosis
IGNLSSASV

SEQ ID NO: 21680 - protein, 9 aa, Mycobacterium tuberculosis
GNLSSASVL

SEQ ID NO: 21681 - protein, 9 aa, Mycobacterium tuberculosis
NLSSASVLH

SEQ ID NO: 21682 - protein, 9 aa, Mycobacterium tuberculosis
LSSASVLHV

SEQ ID NO: 21683 - protein, 9 aa, Mycobacterium tuberculosis
SSASVLHVL

SEQ ID NO: 21684 - protein, 9 aa, Mycobacterium tuberculosis
SASVLHVLR

SEQ ID NO: 21685 - protein, 9 aa, Mycobacterium tuberculosis
ASVLHVLRD

SEQ ID NO: 21686 - protein, 9 aa, Mycobacterium tuberculosis
SVLHVLRDT

SEQ ID NO: 21687 - protein, 9 aa, Mycobacterium tuberculosis
VLHVLRDTI

SEQ ID NO: 21688 - protein, 9 aa, Mycobacterium tuberculosis
LHVLRDTIA

SEQ ID NO: 21689 - protein, 9 aa, Mycobacterium tuberculosis
HVLRDTIAK

SEQ ID NO: 21690 - protein, 9 aa, Mycobacterium tuberculosis
VLRDTIAKP

SEQ ID NO: 21691 - protein, 9 aa, Mycobacterium tuberculosis
LRDTIAKPP

SEQ ID NO: 21692 - protein, 9 aa, Mycobacterium tuberculosis
RDTIAKPPP

SEQ ID NO: 21693 - protein, 9 aa, Mycobacterium tuberculosis
DTIAKPPPS

SEQ ID NO: 21694 - protein, 9 aa, Mycobacterium tuberculosis
TIAKPPPSG

SEQ ID NO: 21695 - protein, 9 aa, Mycobacterium tuberculosis
IAKPPPSGS

SEQ ID NO: 21696 - protein, 9 aa, Mycobacterium tuberculosis
AKPPPSGSP

SEQ ID NO: 21697 - protein, 9 aa, Mycobacterium tuberculosis
KPPPSGSPG

SEQ ID NO: 21698 - protein, 9 aa, Mycobacterium tuberculosis
PPPSGSPGL

SEQ ID NO: 21699 - protein, 9 aa, Mycobacterium tuberculosis
PPSGSPGLM

SEQ ID NO: 21700 - protein, 9 aa, Mycobacterium tuberculosis
PSGSPGLMI

SEQ ID NO: 21701 - protein, 9 aa, Mycobacterium tuberculosis
SGSPGLMIA

SEQ ID NO: 21702 - protein, 9 aa, Mycobacterium tuberculosis
GSPGLMIAM

SEQ ID NO: 21703 - protein, 9 aa, Mycobacterium tuberculosis
SPGLMIAMG

SEQ ID NO: 21704 - protein, 9 aa, Mycobacterium tuberculosis
PGLMIAMGP

SEQ ID NO: 21705 - protein, 9 aa, Mycobacterium tuberculosis
GLMIAMGPG

SEQ ID NO: 21706 - protein, 9 aa, Mycobacterium tuberculosis
LMIAMGPGF

SEQ ID NO: 21707 - protein, 9 aa, Mycobacterium tuberculosis
MIAMGPGFC

SEQ ID NO: 21708 - protein, 9 aa, Mycobacterium tuberculosis
IAMGPGFCS

SEQ ID NO: 21709 - protein, 9 aa, Mycobacterium tuberculosis
AMGPGFCSE

SEQ ID NO: 21710 - protein, 9 aa, Mycobacterium tuberculosis
MGPGFCSEL

SEQ ID NO: 21711 - protein, 9 aa, Mycobacterium tuberculosis
GPGFCSELV

SEQ ID NO: 21712 - protein, 9 aa, Mycobacterium tuberculosis
PGFCSELVL

SEQ ID NO: 21713 - protein, 9 aa, Mycobacterium tuberculosis
GFCSELVLL

SEQ ID NO: 21714 - protein, 9 aa, Mycobacterium tuberculosis
FCSELVLLR

SEQ ID NO: 21715 - protein, 9 aa, Mycobacterium tuberculosis
CSELVLLRW

SEQ ID NO: 21716 - protein, 9 aa, Mycobacterium tuberculosis
SELVLLRWH

SEQ ID NO: 21717 - protein, 10 aa, Mycobacterium tuberculosis
MSVIAGVFGA

SEQ ID NO: 21718 - protein, 10 aa, Mycobacterium tuberculosis
SVIAGVFGAL

SEQ ID NO: 21719 - protein, 10 aa, Mycobacterium tuberculosis
VIAGVFGALP

SEQ ID NO: 21720 - protein, 10 aa, Mycobacterium tuberculosis
IAGVFGALPP

SEQ ID NO: 21721 - protein, 10 aa, Mycobacterium tuberculosis
AGVFGALPPY

SEQ ID NO: 21722 - protein, 10 aa, Mycobacterium tuberculosis
GVFGALPPYR

SEQ ID NO: 21723 - protein, 10 aa, Mycobacterium tuberculosis
VFGALPPYRY

SEQ ID NO: 21724 - protein, 10 aa, Mycobacterium tuberculosis
FGALPPYRYS

SEQ ID NO: 21725 - protein, 10 aa, Mycobacterium tuberculosis
GALPPYRYSQ

SEQ ID NO: 21726 - protein, 10 aa, Mycobacterium tuberculosis
ALPPYRYSQR

SEQ ID NO: 21727 - protein, 10 aa, Mycobacterium tuberculosis
LPPYRYSQRE

SEQ ID NO: 21728 - protein, 10 aa, Mycobacterium tuberculosis
PPYRYSQREL

SEQ ID NO: 21729 - protein, 10 aa, Mycobacterium tuberculosis
PYRYSQRELT

SEQ ID NO: 21730 - protein, 10 aa, Mycobacterium tuberculosis
YRYSQRELTD

SEQ ID NO: 21731 - protein, 10 aa, Mycobacterium tuberculosis
RYSQRELTDS

SEQ ID NO: 21732 - protein, 10 aa, Mycobacterium tuberculosis
YSQRELTDSF

SEQ ID NO: 21733 - protein, 10 aa, Mycobacterium tuberculosis
SQRELTDSFV

SEQ ID NO: 21734 - protein, 10 aa, Mycobacterium tuberculosis
QRELTDSFVS

SEQ ID NO: 21735 - protein, 10 aa, Mycobacterium tuberculosis
RELTDSFVSI

SEQ ID NO: 21736 - protein, 10 aa, Mycobacterium tuberculosis
ELTDSFVSIP

SEQ ID NO: 21737 - protein, 10 aa, Mycobacterium tuberculosis
LTDSFVSIPD

SEQ ID NO: 21738 - protein, 10 aa, Mycobacterium tuberculosis
TDSFVSIPDF

SEQ ID NO: 21739 - protein, 10 aa, Mycobacterium tuberculosis
DSFVSIPDFE

SEQ ID NO: 21740 - protein, 10 aa, Mycobacterium tuberculosis
SFVSIPDFEG

SEQ ID NO: 21741 - protein, 10 aa, Mycobacterium tuberculosis
FVSIPDFEGY

SEQ ID NO: 21742 - protein, 10 aa, Mycobacterium tuberculosis
VSIPDFEGYE

SEQ ID NO: 21743 - protein, 10 aa, Mycobacterium tuberculosis
SIPDFEGYED

SEQ ID NO: 21744 - protein, 10 aa, Mycobacterium tuberculosis
IPDFEGYEDI

SEQ ID NO: 21745 - protein, 10 aa, Mycobacterium tuberculosis
PDFEGYEDIV

SEQ ID NO: 21746 - protein, 10 aa, Mycobacterium tuberculosis
DFEGYEDIVR

SEQ ID NO: 21747 - protein, 10 aa, Mycobacterium tuberculosis
FEGYEDIVRQ

SEQ ID NO: 21748 - protein, 10 aa, Mycobacterium tuberculosis
EGYEDIVRQL

SEQ ID NO: 21749 - protein, 10 aa, Mycobacterium tuberculosis
GYEDIVRQLH

SEQ ID NO: 21750 - protein, 10 aa, Mycobacterium tuberculosis
YEDIVRQLHA

SEQ ID NO: 21751 - protein, 10 aa, Mycobacterium tuberculosis
EDIVRQLHAS

SEQ ID NO: 21752 - protein, 10 aa, Mycobacterium tuberculosis
DIVRQLHASA

SEQ ID NO: 21753 - protein, 10 aa, Mycobacterium tuberculosis
IVRQLHASAK

SEQ ID NO: 21754 - protein, 10 aa, Mycobacterium tuberculosis
VRQLHASAKV

SEQ ID NO: 21755 - protein, 10 aa, Mycobacterium tuberculosis
RQLHASAKVN

SEQ ID NO: 21756 - protein, 10 aa, Mycobacterium tuberculosis
QLHASAKVNS

SEQ ID NO: 21757 - protein, 10 aa, Mycobacterium tuberculosis
LHASAKVNSR

SEQ ID NO: 21758 - protein, 10 aa, Mycobacterium tuberculosis
HASAKVNSRH

SEQ ID NO: 21759 - protein, 10 aa, Mycobacterium tuberculosis
ASAKVNSRHL

SEQ ID NO: 21760 - protein, 10 aa, Mycobacterium tuberculosis
SAKVNSRHLV

SEQ ID NO: 21761 - protein, 10 aa, Mycobacterium tuberculosis
AKVNSRHLVL

SEQ ID NO: 21762 - protein, 10 aa, Mycobacterium tuberculosis
KVNSRHLVLP

SEQ ID NO: 21763 - protein, 10 aa, Mycobacterium tuberculosis
VNSRHLVLPL

SEQ ID NO: 21764 - protein, 10 aa, Mycobacterium tuberculosis
NSRHLVLPLE

SEQ ID NO: 21765 - protein, 10 aa, Mycobacterium tuberculosis
SRHLVLPLEK

SEQ ID NO: 21766 - protein, 10 aa, Mycobacterium tuberculosis
RHLVLPLEKY

SEQ ID NO: 21767 - protein, 10 aa, Mycobacterium tuberculosis
HLVLPLEKYP

SEQ ID NO: 21768 - protein, 10 aa, Mycobacterium tuberculosis
LVLPLEKYPK

SEQ ID NO: 21769 - protein, 10 aa, Mycobacterium tuberculosis
VLPLEKYPKL

SEQ ID NO: 21770 - protein, 10 aa, Mycobacterium tuberculosis
LPLEKYPKLT

SEQ ID NO: 21771 - protein, 10 aa, Mycobacterium tuberculosis
PLEKYPKLTD

SEQ ID NO: 21772 - protein, 10 aa, Mycobacterium tuberculosis
LEKYPKLTDF

SEQ ID NO: 21773 - protein, 10 aa, Mycobacterium tuberculosis
EKYPKLTDFG

SEQ ID NO: 21774 - protein, 10 aa, Mycobacterium tuberculosis
KYPKLTDFGE

SEQ ID NO: 21775 - protein, 10 aa, Mycobacterium tuberculosis
YPKLTDFGEA

SEQ ID NO: 21776 - protein, 10 aa, Mycobacterium tuberculosis
PKLTDFGEAN

SEQ ID NO: 21777 - protein, 10 aa, Mycobacterium tuberculosis
KLTDFGEANK

SEQ ID NO: 21778 - protein, 10 aa, Mycobacterium tuberculosis
LTDFGEANKI

SEQ ID NO: 21779 - protein, 10 aa, Mycobacterium tuberculosis
TDFGEANKIF

SEQ ID NO: 21780 - protein, 10 aa, Mycobacterium tuberculosis
DFGEANKIFI

SEQ ID NO: 21781 - protein, 10 aa, Mycobacterium tuberculosis
FGEANKIFIE

SEQ ID NO: 21782 - protein, 10 aa, Mycobacterium tuberculosis
GEANKIFIEK

SEQ ID NO: 21783 - protein, 10 aa, Mycobacterium tuberculosis
EANKIFIEKA

SEQ ID NO: 21784 - protein, 10 aa, Mycobacterium tuberculosis
ANKIFIEKAV

SEQ ID NO: 21785 - protein, 10 aa, Mycobacterium tuberculosis
NKIFIEKAVD

SEQ ID NO: 21786 - protein, 10 aa, Mycobacterium tuberculosis
KIFIEKAVDL

SEQ ID NO: 21787 - protein, 10 aa, Mycobacterium tuberculosis
IFIEKAVDLG

SEQ ID NO: 21788 - protein, 10 aa, Mycobacterium tuberculosis
FIEKAVDLGV

SEQ ID NO: 21789 - protein, 10 aa, Mycobacterium tuberculosis
IEKAVDLGVQ

SEQ ID NO: 21790 - protein, 10 aa, Mycobacterium tuberculosis
EKAVDLGVQA

SEQ ID NO: 21791 - protein, 10 aa, Mycobacterium tuberculosis
KAVDLGVQAL

SEQ ID NO: 21792 - protein, 10 aa, Mycobacterium tuberculosis
AVDLGVQALA

SEQ ID NO: 21793 - protein, 10 aa, Mycobacterium tuberculosis
VDLGVQALAG

SEQ ID NO: 21794 - protein, 10 aa, Mycobacterium tuberculosis
DLGVQALAGA

SEQ ID NO: 21795 - protein, 10 aa, Mycobacterium tuberculosis
LGVQALAGAL

SEQ ID NO: 21796 - protein, 10 aa, Mycobacterium tuberculosis
GVQALAGALD

SEQ ID NO: 21797 - protein, 10 aa, Mycobacterium tuberculosis
VQALAGALDE

SEQ ID NO: 21798 - protein, 10 aa, Mycobacterium tuberculosis
QALAGALDES

SEQ ID NO: 21799 - protein, 10 aa, Mycobacterium tuberculosis
ALAGALDESG

SEQ ID NO: 21800 - protein, 10 aa, Mycobacterium tuberculosis
LAGALDESGL

SEQ ID NO: 21801 - protein, 10 aa, Mycobacterium tuberculosis
AGALDESGLR

SEQ ID NO: 21802 - protein, 10 aa, Mycobacterium tuberculosis
GALDESGLRP

SEQ ID NO: 21803 - protein, 10 aa, Mycobacterium tuberculosis
ALDESGLRPE

SEQ ID NO: 21804 - protein, 10 aa, Mycobacterium tuberculosis
LDESGLRPED

SEQ ID NO: 21805 - protein, 10 aa, Mycobacterium tuberculosis
DESGLRPEDL

SEQ ID NO: 21806 - protein, 10 aa, Mycobacterium tuberculosis
ESGLRPEDLD

SEQ ID NO: 21807 - protein, 10 aa, Mycobacterium tuberculosis
SGLRPEDLDV

SEQ ID NO: 21808 - protein, 10 aa, Mycobacterium tuberculosis
GLRPEDLDVL

SEQ ID NO: 21809 - protein, 10 aa, Mycobacterium tuberculosis
LRPEDLDVLI

SEQ ID NO: 21810 - protein, 10 aa, Mycobacterium tuberculosis
RPEDLDVLIT

SEQ ID NO: 21811 - protein, 10 aa, Mycobacterium tuberculosis
PEDLDVLITA

SEQ ID NO: 21812 - protein, 10 aa, Mycobacterium tuberculosis
EDLDVLITAT

SEQ ID NO: 21813 - protein, 10 aa, Mycobacterium tuberculosis
DLDVLITATV

SEQ ID NO: 21814 - protein, 10 aa, Mycobacterium tuberculosis
LDVLITATVT

SEQ ID NO: 21815 - protein, 10 aa, Mycobacterium tuberculosis
DVLITATVTG

SEQ ID NO: 21816 - protein, 10 aa, Mycobacterium tuberculosis
VLITATVTGL

SEQ ID NO: 21817 - protein, 10 aa, Mycobacterium tuberculosis
LITATVTGLA

SEQ ID NO: 21818 - protein, 10 aa, Mycobacterium tuberculosis
ITATVTGLAV

SEQ ID NO: 21819 - protein, 10 aa, Mycobacterium tuberculosis
TATVTGLAVP

SEQ ID NO: 21820 - protein, 10 aa, Mycobacterium tuberculosis
ATVTGLAVPS

SEQ ID NO: 21821 - protein, 10 aa, Mycobacterium tuberculosis
TVTGLAVPSL

SEQ ID NO: 21822 - protein, 10 aa, Mycobacterium tuberculosis
VTGLAVPSLD

SEQ ID NO: 21823 - protein, 10 aa, Mycobacterium tuberculosis
TGLAVPSLDA

SEQ ID NO: 21824 - protein, 10 aa, Mycobacterium tuberculosis
GLAVPSLDAR

SEQ ID NO: 21825 - protein, 10 aa, Mycobacterium tuberculosis
LAVPSLDARI

SEQ ID NO: 21826 - protein, 10 aa, Mycobacterium tuberculosis
AVPSLDARIA

SEQ ID NO: 21827 - protein, 10 aa, Mycobacterium tuberculosis
VPSLDARIAG

SEQ ID NO: 21828 - protein, 10 aa, Mycobacterium tuberculosis
PSLDARIAGR

SEQ ID NO: 21829 - protein, 10 aa, Mycobacterium tuberculosis
SLDARIAGRL

SEQ ID NO: 21830 - protein, 10 aa, Mycobacterium tuberculosis
LDARIAGRLG

SEQ ID NO: 21831 - protein, 10 aa, Mycobacterium tuberculosis
DARIAGRLGL

SEQ ID NO: 21832 - protein, 10 aa, Mycobacterium tuberculosis
ARIAGRLGLR

SEQ ID NO: 21833 - protein, 10 aa, Mycobacterium tuberculosis
RIAGRLGLRA

SEQ ID NO: 21834 - protein, 10 aa, Mycobacterium tuberculosis
IAGRLGLRAD

SEQ ID NO: 21835 - protein, 10 aa, Mycobacterium tuberculosis
AGRLGLRADV

SEQ ID NO: 21836 - protein, 10 aa, Mycobacterium tuberculosis
GRLGLRADVR

SEQ ID NO: 21837 - protein, 10 aa, Mycobacterium tuberculosis
RLGLRADVRR

SEQ ID NO: 21838 - protein, 10 aa, Mycobacterium tuberculosis
LGLRADVRRV

SEQ ID NO: 21839 - protein, 10 aa, Mycobacterium tuberculosis
GLRADVRRVP

SEQ ID NO: 21840 - protein, 10 aa, Mycobacterium tuberculosis
LRADVRRVPL

SEQ ID NO: 21841 - protein, 10 aa, Mycobacterium tuberculosis
RADVRRVPLF

SEQ ID NO: 21842 - protein, 10 aa, Mycobacterium tuberculosis
ADVRRVPLFG

SEQ ID NO: 21843 - protein, 10 aa, Mycobacterium tuberculosis
DVRRVPLFGL

SEQ ID NO: 21844 - protein, 10 aa, Mycobacterium tuberculosis
VRRVPLFGLG

SEQ ID NO: 21845 - protein, 10 aa, Mycobacterium tuberculosis
RRVPLFGLGC

SEQ ID NO: 21846 - protein, 10 aa, Mycobacterium tuberculosis
RVPLFGLGCV

SEQ ID NO: 21847 - protein, 10 aa, Mycobacterium tuberculosis
VPLFGLGCVA

SEQ ID NO: 21848 - protein, 10 aa, Mycobacterium tuberculosis
PLFGLGCVAG

SEQ ID NO: 21849 - protein, 10 aa, Mycobacterium tuberculosis
LFGLGCVAGA

SEQ ID NO: 21850 - protein, 10 aa, Mycobacterium tuberculosis
FGLGCVAGAA

SEQ ID NO: 21851 - protein, 10 aa, Mycobacterium tuberculosis
GLGCVAGAAG

SEQ ID NO: 21852 - protein, 10 aa, Mycobacterium tuberculosis
LGCVAGAAGV

SEQ ID NO: 21853 - protein, 10 aa, Mycobacterium tuberculosis
GCVAGAAGVA

SEQ ID NO: 21854 - protein, 10 aa, Mycobacterium tuberculosis
CVAGAAGVAR

SEQ ID NO: 21855 - protein, 10 aa, Mycobacterium tuberculosis
VAGAAGVARL

SEQ ID NO: 21856 - protein, 10 aa, Mycobacterium tuberculosis
AGAAGVARLH

SEQ ID NO: 21857 - protein, 10 aa, Mycobacterium tuberculosis
GAAGVARLHD

SEQ ID NO: 21858 - protein, 10 aa, Mycobacterium tuberculosis
AAGVARLHDY

SEQ ID NO: 21859 - protein, 10 aa, Mycobacterium tuberculosis
AGVARLHDYL

SEQ ID NO: 21860 - protein, 10 aa, Mycobacterium tuberculosis
GVARLHDYLR

SEQ ID NO: 21861 - protein, 10 aa, Mycobacterium tuberculosis
VARLHDYLRG

SEQ ID NO: 21862 - protein, 10 aa, Mycobacterium tuberculosis
ARLHDYLRGA

SEQ ID NO: 21863 - protein, 10 aa, Mycobacterium tuberculosis
RLHDYLRGAP

SEQ ID NO: 21864 - protein, 10 aa, Mycobacterium tuberculosis
LHDYLRGAPD

SEQ ID NO: 21865 - protein, 10 aa, Mycobacterium tuberculosis
HDYLRGAPDG

SEQ ID NO: 21866 - protein, 10 aa, Mycobacterium tuberculosis
DYLRGAPDGV

SEQ ID NO: 21867 - protein, 10 aa, Mycobacterium tuberculosis
YLRGAPDGVA

SEQ ID NO: 21868 - protein, 10 aa, Mycobacterium tuberculosis
LRGAPDGVAA

SEQ ID NO: 21869 - protein, 10 aa, Mycobacterium tuberculosis
RGAPDGVAAL

SEQ ID NO: 21870 - protein, 10 aa, Mycobacterium tuberculosis
GAPDGVAALV

SEQ ID NO: 21871 - protein, 10 aa, Mycobacterium tuberculosis
APDGVAALVS

SEQ ID NO: 21872 - protein, 10 aa, Mycobacterium tuberculosis
PDGVAALVSV

SEQ ID NO: 21873 - protein, 10 aa, Mycobacterium tuberculosis
DGVAALVSVE

SEQ ID NO: 21874 - protein, 10 aa, Mycobacterium tuberculosis
GVAALVSVEL

SEQ ID NO: 21875 - protein, 10 aa, Mycobacterium tuberculosis
VAALVSVELC

SEQ ID NO: 21876 - protein, 10 aa, Mycobacterium tuberculosis
AALVSVELCS

SEQ ID NO: 21877 - protein, 10 aa, Mycobacterium tuberculosis
ALVSVELCSL

SEQ ID NO: 21878 - protein, 10 aa, Mycobacterium tuberculosis
LVSVELCSLT

SEQ ID NO: 21879 - protein, 10 aa, Mycobacterium tuberculosis
VSVELCSLTY

SEQ ID NO: 21880 - protein, 10 aa, Mycobacterium tuberculosis
SVELCSLTYP

SEQ ID NO: 21881 - protein, 10 aa, Mycobacterium tuberculosis
VELCSLTYPG

SEQ ID NO: 21882 - protein, 10 aa, Mycobacterium tuberculosis
ELCSLTYPGY

SEQ ID NO: 21883 - protein, 10 aa, Mycobacterium tuberculosis
LCSLTYPGYK

SEQ ID NO: 21884 - protein, 10 aa, Mycobacterium tuberculosis
CSLTYPGYKP

SEQ ID NO: 21885 - protein, 10 aa, Mycobacterium tuberculosis
SLTYPGYKPT

SEQ ID NO: 21886 - protein, 10 aa, Mycobacterium tuberculosis
LTYPGYKPTL

SEQ ID NO: 21887 - protein, 10 aa, Mycobacterium tuberculosis
TYPGYKPTLP

SEQ ID NO: 21888 - protein, 10 aa, Mycobacterium tuberculosis
YPGYKPTLPG

SEQ ID NO: 21889 - protein, 10 aa, Mycobacterium tuberculosis
PGYKPTLPGL

SEQ ID NO: 21890 - protein, 10 aa, Mycobacterium tuberculosis
GYKPTLPGLV

SEQ ID NO: 21891 - protein, 10 aa, Mycobacterium tuberculosis
YKPTLPGLVG

SEQ ID NO: 21892 - protein, 10 aa, Mycobacterium tuberculosis
KPTLPGLVGS

SEQ ID NO: 21893 - protein, 10 aa, Mycobacterium tuberculosis
PTLPGLVGSA

SEQ ID NO: 21894 - protein, 10 aa, Mycobacterium tuberculosis
TLPGLVGSAL

SEQ ID NO: 21895 - protein, 10 aa, Mycobacterium tuberculosis
LPGLVGSALF

SEQ ID NO: 21896 - protein, 10 aa, Mycobacterium tuberculosis
PGLVGSALFA

SEQ ID NO: 21897 - protein, 10 aa, Mycobacterium tuberculosis
GLVGSALFAD

SEQ ID NO: 21898 - protein, 10 aa, Mycobacterium tuberculosis
LVGSALFADG

SEQ ID NO: 21899 - protein, 10 aa, Mycobacterium tuberculosis
VGSALFADGA

SEQ ID NO: 21900 - protein, 10 aa, Mycobacterium tuberculosis
GSALFADGAA

SEQ ID NO: 21901 - protein, 10 aa, Mycobacterium tuberculosis
SALFADGAAA

SEQ ID NO: 21902 - protein, 10 aa, Mycobacterium tuberculosis
ALFADGAAAV

SEQ ID NO: 21903 - protein, 10 aa, Mycobacterium tuberculosis
LFADGAAAVV

SEQ ID NO: 21904 - protein, 10 aa, Mycobacterium tuberculosis
FADGAAAVVA

SEQ ID NO: 21905 - protein, 10 aa, Mycobacterium tuberculosis
ADGAAAVVAA

SEQ ID NO: 21906 - protein, 10 aa, Mycobacterium tuberculosis
DGAAAVVAAG

SEQ ID NO: 21907 - protein, 10 aa, Mycobacterium tuberculosis
GAAAVVAAGV

SEQ ID NO: 21908 - protein, 10 aa, Mycobacterium tuberculosis
AAAVVAAGVK

SEQ ID NO: 21909 - protein, 10 aa, Mycobacterium tuberculosis
AAVVAAGVKR

SEQ ID NO: 21910 - protein, 10 aa, Mycobacterium tuberculosis
AVVAAGVKRA

SEQ ID NO: 21911 - protein, 10 aa, Mycobacterium tuberculosis
VVAAGVKRAQ

SEQ ID NO: 21912 - protein, 10 aa, Mycobacterium tuberculosis
VAAGVKRAQD

SEQ ID NO: 21913 - protein, 10 aa, Mycobacterium tuberculosis
AAGVKRAQDI

SEQ ID NO: 21914 - protein, 10 aa, Mycobacterium tuberculosis
AGVKRAQDIG

SEQ ID NO: 21915 - protein, 10 aa, Mycobacterium tuberculosis
GVKRAQDIGA

SEQ ID NO: 21916 - protein, 10 aa, Mycobacterium tuberculosis
VKRAQDIGAD

SEQ ID NO: 21917 - protein, 10 aa, Mycobacterium tuberculosis
KRAQDIGADG

SEQ ID NO: 21918 - protein, 10 aa, Mycobacterium tuberculosis
RAQDIGADGP

SEQ ID NO: 21919 - protein, 10 aa, Mycobacterium tuberculosis
AQDIGADGPD

SEQ ID NO: 21920 - protein, 10 aa, Mycobacterium tuberculosis
QDIGADGPDI

SEQ ID NO: 21921 - protein, 10 aa, Mycobacterium tuberculosis
DIGADGPDIL

SEQ ID NO: 21922 - protein, 10 aa, Mycobacterium tuberculosis
IGADGPDILD

SEQ ID NO: 21923 - protein, 10 aa, Mycobacterium tuberculosis
GADGPDILDS

SEQ ID NO: 21924 - protein, 10 aa, Mycobacterium tuberculosis
ADGPDILDSR

SEQ ID NO: 21925 - protein, 10 aa, Mycobacterium tuberculosis
DGPDILDSRS

SEQ ID NO: 21926 - protein, 10 aa, Mycobacterium tuberculosis
GPDILDSRSH

SEQ ID NO: 21927 - protein, 10 aa, Mycobacterium tuberculosis
PDILDSRSHL

SEQ ID NO: 21928 - protein, 10 aa, Mycobacterium tuberculosis
DILDSRSHLY

SEQ ID NO: 21929 - protein, 10 aa, Mycobacterium tuberculosis
ILDSRSHLYP

SEQ ID NO: 21930 - protein, 10 aa, Mycobacterium tuberculosis
LDSRSHLYPD

SEQ ID NO: 21931 - protein, 10 aa, Mycobacterium tuberculosis
DSRSHLYPDS

SEQ ID NO: 21932 - protein, 10 aa, Mycobacterium tuberculosis
SRSHLYPDSL

SEQ ID NO: 21933 - protein, 10 aa, Mycobacterium tuberculosis
RSHLYPDSLR

SEQ ID NO: 21934 - protein, 10 aa, Mycobacterium tuberculosis
SHLYPDSLRT

SEQ ID NO: 21935 - protein, 10 aa, Mycobacterium tuberculosis
HLYPDSLRTM

SEQ ID NO: 21936 - protein, 10 aa, Mycobacterium tuberculosis
LYPDSLRTMG

SEQ ID NO: 21937 - protein, 10 aa, Mycobacterium tuberculosis
YPDSLRTMGY

SEQ ID NO: 21938 - protein, 10 aa, Mycobacterium tuberculosis
PDSLRTMGYD

SEQ ID NO: 21939 - protein, 10 aa, Mycobacterium tuberculosis
DSLRTMGYDV

SEQ ID NO: 21940 - protein, 10 aa, Mycobacterium tuberculosis
SLRTMGYDVG

SEQ ID NO: 21941 - protein, 10 aa, Mycobacterium tuberculosis
LRTMGYDVGS

SEQ ID NO: 21942 - protein, 10 aa, Mycobacterium tuberculosis
RTMGYDVGSA

SEQ ID NO: 21943 - protein, 10 aa, Mycobacterium tuberculosis
TMGYDVGSAG

SEQ ID NO: 21944 - protein, 10 aa, Mycobacterium tuberculosis
MGYDVGSAGF

SEQ ID NO: 21945 - protein, 10 aa, Mycobacterium tuberculosis
GYDVGSAGFE

SEQ ID NO: 21946 - protein, 10 aa, Mycobacterium tuberculosis
YDVGSAGFEL

SEQ ID NO: 21947 - protein, 10 aa, Mycobacterium tuberculosis
DVGSAGFELV

SEQ ID NO: 21948 - protein, 10 aa, Mycobacterium tuberculosis
VGSAGFELVL

SEQ ID NO: 21949 - protein, 10 aa, Mycobacterium tuberculosis
GSAGFELVLS

SEQ ID NO: 21950 - protein, 10 aa, Mycobacterium tuberculosis
SAGFELVLSR

SEQ ID NO: 21951 - protein, 10 aa, Mycobacterium tuberculosis
AGFELVLSRD

SEQ ID NO: 21952 - protein, 10 aa, Mycobacterium tuberculosis
GFELVLSRDL

SEQ ID NO: 21953 - protein, 10 aa, Mycobacterium tuberculosis
FELVLSRDLA

SEQ ID NO: 21954 - protein, 10 aa, Mycobacterium tuberculosis
ELVLSRDLAA

SEQ ID NO: 21955 - protein, 10 aa, Mycobacterium tuberculosis
LVLSRDLAAV

SEQ ID NO: 21956 - protein, 10 aa, Mycobacterium tuberculosis
VLSRDLAAVV

SEQ ID NO: 21957 - protein, 10 aa, Mycobacterium tuberculosis
LSRDLAAVVE

SEQ ID NO: 21958 - protein, 10 aa, Mycobacterium tuberculosis
SRDLAAVVEQ

SEQ ID NO: 21959 - protein, 10 aa, Mycobacterium tuberculosis
RDLAAVVEQY

SEQ ID NO: 21960 - protein, 10 aa, Mycobacterium tuberculosis
DLAAVVEQYL

SEQ ID NO: 21961 - protein, 10 aa, Mycobacterium tuberculosis
LAAVVEQYLG

SEQ ID NO: 21962 - protein, 10 aa, Mycobacterium tuberculosis
AAVVEQYLGN

SEQ ID NO: 21963 - protein, 10 aa, Mycobacterium tuberculosis
AVVEQYLGND

SEQ ID NO: 21964 - protein, 10 aa, Mycobacterium tuberculosis
VVEQYLGNDV

SEQ ID NO: 21965 - protein, 10 aa, Mycobacterium tuberculosis
VEQYLGNDVT

SEQ ID NO: 21966 - protein, 10 aa, Mycobacterium tuberculosis
EQYLGNDVTT

SEQ ID NO: 21967 - protein, 10 aa, Mycobacterium tuberculosis
QYLGNDVTTF

SEQ ID NO: 21968 - protein, 10 aa, Mycobacterium tuberculosis
YLGNDVTTFL

SEQ ID NO: 21969 - protein, 10 aa, Mycobacterium tuberculosis
LGNDVTTFLA

SEQ ID NO: 21970 - protein, 10 aa, Mycobacterium tuberculosis
GNDVTTFLAS

SEQ ID NO: 21971 - protein, 10 aa, Mycobacterium tuberculosis
NDVTTFLASH

SEQ ID NO: 21972 - protein, 10 aa, Mycobacterium tuberculosis
DVTTFLASHG

SEQ ID NO: 21973 - protein, 10 aa, Mycobacterium tuberculosis
VTTFLASHGL

SEQ ID NO: 21974 - protein, 10 aa, Mycobacterium tuberculosis
TTFLASHGLS

SEQ ID NO: 21975 - protein, 10 aa, Mycobacterium tuberculosis
TFLASHGLST

SEQ ID NO: 21976 - protein, 10 aa, Mycobacterium tuberculosis
FLASHGLSTT

SEQ ID NO: 21977 - protein, 10 aa, Mycobacterium tuberculosis
LASHGLSTTD

SEQ ID NO: 21978 - protein, 10 aa, Mycobacterium tuberculosis
ASHGLSTTDV

SEQ ID NO: 21979 - protein, 10 aa, Mycobacterium tuberculosis
SHGLSTTDVG

SEQ ID NO: 21980 - protein, 10 aa, Mycobacterium tuberculosis
HGLSTTDVGA

SEQ ID NO: 21981 - protein, 10 aa, Mycobacterium tuberculosis
GLSTTDVGAW

SEQ ID NO: 21982 - protein, 10 aa, Mycobacterium tuberculosis
LSTTDVGAWV

SEQ ID NO: 21983 - protein, 10 aa, Mycobacterium tuberculosis
STTDVGAWVT

SEQ ID NO: 21984 - protein, 10 aa, Mycobacterium tuberculosis
TTDVGAWVTH

SEQ ID NO: 21985 - protein, 10 aa, Mycobacterium tuberculosis
TDVGAWVTHP

SEQ ID NO: 21986 - protein, 10 aa, Mycobacterium tuberculosis
DVGAWVTHPG

SEQ ID NO: 21987 - protein, 10 aa, Mycobacterium tuberculosis
VGAWVTHPGG

SEQ ID NO: 21988 - protein, 10 aa, Mycobacterium tuberculosis
GAWVTHPGGP

SEQ ID NO: 21989 - protein, 10 aa, Mycobacterium tuberculosis
AWVTHPGGPK

SEQ ID NO: 21990 - protein, 10 aa, Mycobacterium tuberculosis
WVTHPGGPKI

SEQ ID NO: 21991 - protein, 10 aa, Mycobacterium tuberculosis
VTHPGGPKII

SEQ ID NO: 21992 - protein, 10 aa, Mycobacterium tuberculosis
THPGGPKIIN

SEQ ID NO: 21993 - protein, 10 aa, Mycobacterium tuberculosis
HPGGPKIINA

SEQ ID NO: 21994 - protein, 10 aa, Mycobacterium tuberculosis
PGGPKIINAI

SEQ ID NO: 21995 - protein, 10 aa, Mycobacterium tuberculosis
GGPKIINAIT

SEQ ID NO: 21996 - protein, 10 aa, Mycobacterium tuberculosis
GPKIINAITE

SEQ ID NO: 21997 - protein, 10 aa, Mycobacterium tuberculosis
PKIINAITET

SEQ ID NO: 21998 - protein, 10 aa, Mycobacterium tuberculosis
KIINAITETL

SEQ ID NO: 21999 - protein, 10 aa, Mycobacterium tuberculosis
IINAITETLD

SEQ ID NO: 22000 - protein, 10 aa, Mycobacterium tuberculosis
INAITETLDL

SEQ ID NO: 22001 - protein, 10 aa, Mycobacterium tuberculosis
NAITETLDLS

SEQ ID NO: 22002 - protein, 10 aa, Mycobacterium tuberculosis
AITETLDLSP

SEQ ID NO: 22003 - protein, 10 aa, Mycobacterium tuberculosis
ITETLDLSPQ

SEQ ID NO: 22004 - protein, 10 aa, Mycobacterium tuberculosis
TETLDLSPQA

SEQ ID NO: 22005 - protein, 10 aa, Mycobacterium tuberculosis
ETLDLSPQAL

SEQ ID NO: 22006 - protein, 10 aa, Mycobacterium tuberculosis
TLDLSPQALE

SEQ ID NO: 22007 - protein, 10 aa, Mycobacterium tuberculosis
LDLSPQALEL

SEQ ID NO: 22008 - protein, 10 aa, Mycobacterium tuberculosis
DLSPQALELT

SEQ ID NO: 22009 - protein, 10 aa, Mycobacterium tuberculosis
LSPQALELTW

SEQ ID NO: 22010 - protein, 10 aa, Mycobacterium tuberculosis
SPQALELTWR

SEQ ID NO: 22011 - protein, 10 aa, Mycobacterium tuberculosis
PQALELTWRS

SEQ ID NO: 22012 - protein, 10 aa, Mycobacterium tuberculosis
QALELTWRSL

SEQ ID NO: 22013 - protein, 10 aa, Mycobacterium tuberculosis
ALELTWRSLG

SEQ ID NO: 22014 - protein, 10 aa, Mycobacterium tuberculosis
LELTWRSLGE

SEQ ID NO: 22015 - protein, 10 aa, Mycobacterium tuberculosis
ELTWRSLGEI

SEQ ID NO: 22016 - protein, 10 aa, Mycobacterium tuberculosis
LTWRSLGEIG

SEQ ID NO: 22017 - protein, 10 aa, Mycobacterium tuberculosis
TWRSLGEIGN

SEQ ID NO: 22018 - protein, 10 aa, Mycobacterium tuberculosis
WRSLGEIGNL

SEQ ID NO: 22019 - protein, 10 aa, Mycobacterium tuberculosis
RSLGEIGNLS

SEQ ID NO: 22020 - protein, 10 aa, Mycobacterium tuberculosis
SLGEIGNLSS

SEQ ID NO: 22021 - protein, 10 aa, Mycobacterium tuberculosis
LGEIGNLSSA

SEQ ID NO: 22022 - protein, 10 aa, Mycobacterium tuberculosis
GEIGNLSSAS

SEQ ID NO: 22023 - protein, 10 aa, Mycobacterium tuberculosis
EIGNLSSASV

SEQ ID NO: 22024 - protein, 10 aa, Mycobacterium tuberculosis
IGNLSSASVL

SEQ ID NO: 22025 - protein, 10 aa, Mycobacterium tuberculosis
GNLSSASVLH

SEQ ID NO: 22026 - protein, 10 aa, Mycobacterium tuberculosis
NLSSASVLHV

SEQ ID NO: 22027 - protein, 10 aa, Mycobacterium tuberculosis
LSSASVLHVL

SEQ ID NO: 22028 - protein, 10 aa, Mycobacterium tuberculosis
SSASVLHVLR

SEQ ID NO: 22029 - protein, 10 aa, Mycobacterium tuberculosis
SASVLHVLRD

SEQ ID NO: 22030 - protein, 10 aa, Mycobacterium tuberculosis
ASVLHVLRDT

SEQ ID NO: 22031 - protein, 10 aa, Mycobacterium tuberculosis
SVLHVLRDTI

SEQ ID NO: 22032 - protein, 10 aa, Mycobacterium tuberculosis
VLHVLRDTIA

SEQ ID NO: 22033 - protein, 10 aa, Mycobacterium tuberculosis
LHVLRDTIAK

SEQ ID NO: 22034 - protein, 10 aa, Mycobacterium tuberculosis
HVLRDTIAKP

SEQ ID NO: 22035 - protein, 10 aa, Mycobacterium tuberculosis
VLRDTIAKPP

SEQ ID NO: 22036 - protein, 10 aa, Mycobacterium tuberculosis
LRDTIAKPPP

SEQ ID NO: 22037 - protein, 10 aa, Mycobacterium tuberculosis
RDTIAKPPPS

SEQ ID NO: 22038 - protein, 10 aa, Mycobacterium tuberculosis
DTIAKPPPSG

SEQ ID NO: 22039 - protein, 10 aa, Mycobacterium tuberculosis
TIAKPPPSGS

SEQ ID NO: 22040 - protein, 10 aa, Mycobacterium tuberculosis
IAKPPPSGSP

SEQ ID NO: 22041 - protein, 10 aa, Mycobacterium tuberculosis
AKPPPSGSPG

SEQ ID NO: 22042 - protein, 10 aa, Mycobacterium tuberculosis
KPPPSGSPGL

SEQ ID NO: 22043 - protein, 10 aa, Mycobacterium tuberculosis
PPPSGSPGLM

SEQ ID NO: 22044 - protein, 10 aa, Mycobacterium tuberculosis
PPSGSPGLMI

SEQ ID NO: 22045 - protein, 10 aa, Mycobacterium tuberculosis
PSGSPGLMIA

SEQ ID NO: 22046 - protein, 10 aa, Mycobacterium tuberculosis
SGSPGLMIAM

SEQ ID NO: 22047 - protein, 10 aa, Mycobacterium tuberculosis
GSPGLMIAMG

SEQ ID NO: 22048 - protein, 10 aa, Mycobacterium tuberculosis
SPGLMIAMGP

SEQ ID NO: 22049 - protein, 10 aa, Mycobacterium tuberculosis
PGLMIAMGPG

SEQ ID NO: 22050 - protein, 10 aa, Mycobacterium tuberculosis
GLMIAMGPGF

SEQ ID NO: 22051 - protein, 10 aa, Mycobacterium tuberculosis
LMIAMGPGFC

SEQ ID NO: 22052 - protein, 10 aa, Mycobacterium tuberculosis
MIAMGPGFCS

SEQ ID NO: 22053 - protein, 10 aa, Mycobacterium tuberculosis
IAMGPGFCSE

SEQ ID NO: 22054 - protein, 10 aa, Mycobacterium tuberculosis
AMGPGFCSEL

SEQ ID NO: 22055 - protein, 10 aa, Mycobacterium tuberculosis
MGPGFCSELV

SEQ ID NO: 22056 - protein, 10 aa, Mycobacterium tuberculosis
GPGFCSELVL

SEQ ID NO: 22057 - protein, 10 aa, Mycobacterium tuberculosis
PGFCSELVLL

SEQ ID NO: 22058 - protein, 10 aa, Mycobacterium tuberculosis
GFCSELVLLR

SEQ ID NO: 22059 - protein, 10 aa, Mycobacterium tuberculosis
FCSELVLLRW

SEQ ID NO: 22060 - protein, 10 aa, Mycobacterium tuberculosis
CSELVLLRWH

SEQ ID NO: 22061 - protein, 11 aa, Mycobacterium tuberculosis
MSVIAGVFGAL

SEQ ID NO: 22062 - protein, 11 aa, Mycobacterium tuberculosis
SVIAGVFGALP

SEQ ID NO: 22063 - protein, 11 aa, Mycobacterium tuberculosis
VIAGVFGALPP

SEQ ID NO: 22064 - protein, 11 aa, Mycobacterium tuberculosis
IAGVFGALPPY

SEQ ID NO: 22065 - protein, 11 aa, Mycobacterium tuberculosis
AGVFGALPPYR

SEQ ID NO: 22066 - protein, 11 aa, Mycobacterium tuberculosis
GVFGALPPYRY

SEQ ID NO: 22067 - protein, 11 aa, Mycobacterium tuberculosis
VFGALPPYRYS

SEQ ID NO: 22068 - protein, 11 aa, Mycobacterium tuberculosis
FGALPPYRYSQ

SEQ ID NO: 22069 - protein, 11 aa, Mycobacterium tuberculosis
GALPPYRYSQR

SEQ ID NO: 22070 - protein, 11 aa, Mycobacterium tuberculosis
ALPPYRYSQRE

SEQ ID NO: 22071 - protein, 11 aa, Mycobacterium tuberculosis
LPPYRYSQREL

SEQ ID NO: 22072 - protein, 11 aa, Mycobacterium tuberculosis
PPYRYSQRELT

SEQ ID NO: 22073 - protein, 11 aa, Mycobacterium tuberculosis
PYRYSQRELTD

SEQ ID NO: 22074 - protein, 11 aa, Mycobacterium tuberculosis
YRYSQRELTDS

SEQ ID NO: 22075 - protein, 11 aa, Mycobacterium tuberculosis
RYSQRELTDSF

SEQ ID NO: 22076 - protein, 11 aa, Mycobacterium tuberculosis
YSQRELTDSFV

SEQ ID NO: 22077 - protein, 11 aa, Mycobacterium tuberculosis
SQRELTDSFVS

SEQ ID NO: 22078 - protein, 11 aa, Mycobacterium tuberculosis
QRELTDSFVSI

SEQ ID NO: 22079 - protein, 11 aa, Mycobacterium tuberculosis
RELTDSFVSIP

SEQ ID NO: 22080 - protein, 11 aa, Mycobacterium tuberculosis
ELTDSFVSIPD

SEQ ID NO: 22081 - protein, 11 aa, Mycobacterium tuberculosis
LTDSFVSIPDF

SEQ ID NO: 22082 - protein, 11 aa, Mycobacterium tuberculosis
TDSFVSIPDFE

SEQ ID NO: 22083 - protein, 11 aa, Mycobacterium tuberculosis
DSFVSIPDFEG

SEQ ID NO: 22084 - protein, 11 aa, Mycobacterium tuberculosis
SFVSIPDFEGY

SEQ ID NO: 22085 - protein, 11 aa, Mycobacterium tuberculosis
FVSIPDFEGYE

SEQ ID NO: 22086 - protein, 11 aa, Mycobacterium tuberculosis
VSIPDFEGYED

SEQ ID NO: 22087 - protein, 11 aa, Mycobacterium tuberculosis
SIPDFEGYEDI

SEQ ID NO: 22088 - protein, 11 aa, Mycobacterium tuberculosis
IPDFEGYEDIV

SEQ ID NO: 22089 - protein, 11 aa, Mycobacterium tuberculosis
PDFEGYEDIVR

SEQ ID NO: 22090 - protein, 11 aa, Mycobacterium tuberculosis
DFEGYEDIVRQ

SEQ ID NO: 22091 - protein, 11 aa, Mycobacterium tuberculosis
FEGYEDIVRQL

SEQ ID NO: 22092 - protein, 11 aa, Mycobacterium tuberculosis
EGYEDIVRQLH

SEQ ID NO: 22093 - protein, 11 aa, Mycobacterium tuberculosis
GYEDIVRQLHA

SEQ ID NO: 22094 - protein, 11 aa, Mycobacterium tuberculosis
YEDIVRQLHAS

SEQ ID NO: 22095 - protein, 11 aa, Mycobacterium tuberculosis
EDIVRQLHASA

SEQ ID NO: 22096 - protein, 11 aa, Mycobacterium tuberculosis
DIVRQLHASAK

SEQ ID NO: 22097 - protein, 11 aa, Mycobacterium tuberculosis
IVRQLHASAKV

SEQ ID NO: 22098 - protein, 11 aa, Mycobacterium tuberculosis
VRQLHASAKVN

SEQ ID NO: 22099 - protein, 11 aa, Mycobacterium tuberculosis
RQLHASAKVNS

SEQ ID NO: 22100 - protein, 11 aa, Mycobacterium tuberculosis
QLHASAKVNSR

SEQ ID NO: 22101 - protein, 11 aa, Mycobacterium tuberculosis
LHASAKVNSRH

SEQ ID NO: 22102 - protein, 11 aa, Mycobacterium tuberculosis
HASAKVNSRHL

SEQ ID NO: 22103 - protein, 11 aa, Mycobacterium tuberculosis
ASAKVNSRHLV

SEQ ID NO: 22104 - protein, 11 aa, Mycobacterium tuberculosis
SAKVNSRHLVL

SEQ ID NO: 22105 - protein, 11 aa, Mycobacterium tuberculosis
AKVNSRHLVLP

SEQ ID NO: 22106 - protein, 11 aa, Mycobacterium tuberculosis
KVNSRHLVLPL

SEQ ID NO: 22107 - protein, 11 aa, Mycobacterium tuberculosis
VNSRHLVLPLE

SEQ ID NO: 22108 - protein, 11 aa, Mycobacterium tuberculosis
NSRHLVLPLEK

SEQ ID NO: 22109 - protein, 11 aa, Mycobacterium tuberculosis
SRHLVLPLEKY

SEQ ID NO: 22110 - protein, 11 aa, Mycobacterium tuberculosis
RHLVLPLEKYP

SEQ ID NO: 22111 - protein, 11 aa, Mycobacterium tuberculosis
HLVLPLEKYPK

SEQ ID NO: 22112 - protein, 11 aa, Mycobacterium tuberculosis
LVLPLEKYPKL

SEQ ID NO: 22113 - protein, 11 aa, Mycobacterium tuberculosis
VLPLEKYPKLT

SEQ ID NO: 22114 - protein, 11 aa, Mycobacterium tuberculosis
LPLEKYPKLTD

SEQ ID NO: 22115 - protein, 11 aa, Mycobacterium tuberculosis
PLEKYPKLTDF

SEQ ID NO: 22116 - protein, 11 aa, Mycobacterium tuberculosis
LEKYPKLTDFG

SEQ ID NO: 22117 - protein, 11 aa, Mycobacterium tuberculosis
EKYPKLTDFGE

SEQ ID NO: 22118 - protein, 11 aa, Mycobacterium tuberculosis
KYPKLTDFGEA

SEQ ID NO: 22119 - protein, 11 aa, Mycobacterium tuberculosis
YPKLTDFGEAN

SEQ ID NO: 22120 - protein, 11 aa, Mycobacterium tuberculosis
PKLTDFGEANK

SEQ ID NO: 22121 - protein, 11 aa, Mycobacterium tuberculosis
KLTDFGEANKI

SEQ ID NO: 22122 - protein, 11 aa, Mycobacterium tuberculosis
LTDFGEANKIF

SEQ ID NO: 22123 - protein, 11 aa, Mycobacterium tuberculosis
TDFGEANKIFI

SEQ ID NO: 22124 - protein, 11 aa, Mycobacterium tuberculosis
DFGEANKIFIE

SEQ ID NO: 22125 - protein, 11 aa, Mycobacterium tuberculosis
FGEANKIFIEK

SEQ ID NO: 22126 - protein, 11 aa, Mycobacterium tuberculosis
GEANKIFIEKA

SEQ ID NO: 22127 - protein, 11 aa, Mycobacterium tuberculosis
EANKIFIEKAV

SEQ ID NO: 22128 - protein, 11 aa, Mycobacterium tuberculosis
ANKIFIEKAVD

SEQ ID NO: 22129 - protein, 11 aa, Mycobacterium tuberculosis
NKIFIEKAVDL

SEQ ID NO: 22130 - protein, 11 aa, Mycobacterium tuberculosis
KIFIEKAVDLG

SEQ ID NO: 22131 - protein, 11 aa, Mycobacterium tuberculosis
IFIEKAVDLGV

SEQ ID NO: 22132 - protein, 11 aa, Mycobacterium tuberculosis
FIEKAVDLGVQ

SEQ ID NO: 22133 - protein, 11 aa, Mycobacterium tuberculosis
IEKAVDLGVQA

SEQ ID NO: 22134 - protein, 11 aa, Mycobacterium tuberculosis
EKAVDLGVQAL

SEQ ID NO: 22135 - protein, 11 aa, Mycobacterium tuberculosis
KAVDLGVQALA

SEQ ID NO: 22136 - protein, 11 aa, Mycobacterium tuberculosis
AVDLGVQALAG

SEQ ID NO: 22137 - protein, 11 aa, Mycobacterium tuberculosis
VDLGVQALAGA

SEQ ID NO: 22138 - protein, 11 aa, Mycobacterium tuberculosis
DLGVQALAGAL

SEQ ID NO: 22139 - protein, 11 aa, Mycobacterium tuberculosis
LGVQALAGALD

SEQ ID NO: 22140 - protein, 11 aa, Mycobacterium tuberculosis
GVQALAGALDE

SEQ ID NO: 22141 - protein, 11 aa, Mycobacterium tuberculosis
VQALAGALDES

SEQ ID NO: 22142 - protein, 11 aa, Mycobacterium tuberculosis
QALAGALDESG

SEQ ID NO: 22143 - protein, 11 aa, Mycobacterium tuberculosis
ALAGALDESGL

SEQ ID NO: 22144 - protein, 11 aa, Mycobacterium tuberculosis
LAGALDESGLR

SEQ ID NO: 22145 - protein, 11 aa, Mycobacterium tuberculosis
AGALDESGLRP

SEQ ID NO: 22146 - protein, 11 aa, Mycobacterium tuberculosis
GALDESGLRPE

SEQ ID NO: 22147 - protein, 11 aa, Mycobacterium tuberculosis
ALDESGLRPED

SEQ ID NO: 22148 - protein, 11 aa, Mycobacterium tuberculosis
LDESGLRPEDL

SEQ ID NO: 22149 - protein, 11 aa, Mycobacterium tuberculosis
DESGLRPEDLD

SEQ ID NO: 22150 - protein, 11 aa, Mycobacterium tuberculosis
ESGLRPEDLDV

SEQ ID NO: 22151 - protein, 11 aa, Mycobacterium tuberculosis
SGLRPEDLDVL

SEQ ID NO: 22152 - protein, 11 aa, Mycobacterium tuberculosis
GLRPEDLDVLI

SEQ ID NO: 22153 - protein, 11 aa, Mycobacterium tuberculosis
LRPEDLDVLIT

SEQ ID NO: 22154 - protein, 11 aa, Mycobacterium tuberculosis
RPEDLDVLITA

SEQ ID NO: 22155 - protein, 11 aa, Mycobacterium tuberculosis
PEDLDVLITAT

SEQ ID NO: 22156 - protein, 11 aa, Mycobacterium tuberculosis
EDLDVLITATV

SEQ ID NO: 22157 - protein, 11 aa, Mycobacterium tuberculosis
DLDVLITATVT

SEQ ID NO: 22158 - protein, 11 aa, Mycobacterium tuberculosis
LDVLITATVTG

SEQ ID NO: 22159 - protein, 11 aa, Mycobacterium tuberculosis
DVLITATVTGL

SEQ ID NO: 22160 - protein, 11 aa, Mycobacterium tuberculosis
VLITATVTGLA

SEQ ID NO: 22161 - protein, 11 aa, Mycobacterium tuberculosis
LITATVTGLAV

SEQ ID NO: 22162 - protein, 11 aa, Mycobacterium tuberculosis
ITATVTGLAVP

SEQ ID NO: 22163 - protein, 11 aa, Mycobacterium tuberculosis
TATVTGLAVPS

SEQ ID NO: 22164 - protein, 11 aa, Mycobacterium tuberculosis
ATVTGLAVPSL

SEQ ID NO: 22165 - protein, 11 aa, Mycobacterium tuberculosis
TVTGLAVPSLD

SEQ ID NO: 22166 - protein, 11 aa, Mycobacterium tuberculosis
VTGLAVPSLDA

SEQ ID NO: 22167 - protein, 11 aa, Mycobacterium tuberculosis
TGLAVPSLDAR

SEQ ID NO: 22168 - protein, 11 aa, Mycobacterium tuberculosis
GLAVPSLDARI

SEQ ID NO: 22169 - protein, 11 aa, Mycobacterium tuberculosis
LAVPSLDARIA

SEQ ID NO: 22170 - protein, 11 aa, Mycobacterium tuberculosis
AVPSLDARIAG

SEQ ID NO: 22171 - protein, 11 aa, Mycobacterium tuberculosis
VPSLDARIAGR

SEQ ID NO: 22172 - protein, 11 aa, Mycobacterium tuberculosis
PSLDARIAGRL

SEQ ID NO: 22173 - protein, 11 aa, Mycobacterium tuberculosis
SLDARIAGRLG

SEQ ID NO: 22174 - protein, 11 aa, Mycobacterium tuberculosis
LDARIAGRLGL

SEQ ID NO: 22175 - protein, 11 aa, Mycobacterium tuberculosis
DARIAGRLGLR

SEQ ID NO: 22176 - protein, 11 aa, Mycobacterium tuberculosis
ARIAGRLGLRA

SEQ ID NO: 22177 - protein, 11 aa, Mycobacterium tuberculosis
RIAGRLGLRAD

SEQ ID NO: 22178 - protein, 11 aa, Mycobacterium tuberculosis
IAGRLGLRADV

SEQ ID NO: 22179 - protein, 11 aa, Mycobacterium tuberculosis
AGRLGLRADVR

SEQ ID NO: 22180 - protein, 11 aa, Mycobacterium tuberculosis
GRLGLRADVRR

SEQ ID NO: 22181 - protein, 11 aa, Mycobacterium tuberculosis
RLGLRADVRRV

SEQ ID NO: 22182 - protein, 11 aa, Mycobacterium tuberculosis
LGLRADVRRVP

SEQ ID NO: 22183 - protein, 11 aa, Mycobacterium tuberculosis
GLRADVRRVPL

SEQ ID NO: 22184 - protein, 11 aa, Mycobacterium tuberculosis
LRADVRRVPLF

SEQ ID NO: 22185 - protein, 11 aa, Mycobacterium tuberculosis
RADVRRVPLFG

SEQ ID NO: 22186 - protein, 11 aa, Mycobacterium tuberculosis
ADVRRVPLFGL

SEQ ID NO: 22187 - protein, 11 aa, Mycobacterium tuberculosis
DVRRVPLFGLG

SEQ ID NO: 22188 - protein, 11 aa, Mycobacterium tuberculosis
VRRVPLFGLGC

SEQ ID NO: 22189 - protein, 11 aa, Mycobacterium tuberculosis
RRVPLFGLGCV

SEQ ID NO: 22190 - protein, 11 aa, Mycobacterium tuberculosis
RVPLFGLGCVA

SEQ ID NO: 22191 - protein, 11 aa, Mycobacterium tuberculosis
VPLFGLGCVAG

SEQ ID NO: 22192 - protein, 11 aa, Mycobacterium tuberculosis
PLFGLGCVAGA

SEQ ID NO: 22193 - protein, 11 aa, Mycobacterium tuberculosis
LFGLGCVAGAA

SEQ ID NO: 22194 - protein, 11 aa, Mycobacterium tuberculosis
FGLGCVAGAAG

SEQ ID NO: 22195 - protein, 11 aa, Mycobacterium tuberculosis
GLGCVAGAAGV

SEQ ID NO: 22196 - protein, 11 aa, Mycobacterium tuberculosis
LGCVAGAAGVA

SEQ ID NO: 22197 - protein, 11 aa, Mycobacterium tuberculosis
GCVAGAAGVAR

SEQ ID NO: 22198 - protein, 11 aa, Mycobacterium tuberculosis
CVAGAAGVARL

SEQ ID NO: 22199 - protein, 11 aa, Mycobacterium tuberculosis
VAGAAGVARLH

SEQ ID NO: 22200 - protein, 11 aa, Mycobacterium tuberculosis
AGAAGVARLHD

SEQ ID NO: 22201 - protein, 11 aa, Mycobacterium tuberculosis
GAAGVARLHDY

SEQ ID NO: 22202 - protein, 11 aa, Mycobacterium tuberculosis
AAGVARLHDYL

SEQ ID NO: 22203 - protein, 11 aa, Mycobacterium tuberculosis
AGVARLHDYLR

SEQ ID NO: 22204 - protein, 11 aa, Mycobacterium tuberculosis
GVARLHDYLRG

SEQ ID NO: 22205 - protein, 11 aa, Mycobacterium tuberculosis
VARLHDYLRGA

SEQ ID NO: 22206 - protein, 11 aa, Mycobacterium tuberculosis
ARLHDYLRGAP

SEQ ID NO: 22207 - protein, 11 aa, Mycobacterium tuberculosis
RLHDYLRGAPD

SEQ ID NO: 22208 - protein, 11 aa, Mycobacterium tuberculosis
LHDYLRGAPDG

SEQ ID NO: 22209 - protein, 11 aa, Mycobacterium tuberculosis
HDYLRGAPDGV

SEQ ID NO: 22210 - protein, 11 aa, Mycobacterium tuberculosis
DYLRGAPDGVA

SEQ ID NO: 22211 - protein, 11 aa, Mycobacterium tuberculosis
YLRGAPDGVAA

SEQ ID NO: 22212 - protein, 11 aa, Mycobacterium tuberculosis
LRGAPDGVAAL

SEQ ID NO: 22213 - protein, 11 aa, Mycobacterium tuberculosis
RGAPDGVAALV

SEQ ID NO: 22214 - protein, 11 aa, Mycobacterium tuberculosis
GAPDGVAALVS

SEQ ID NO: 22215 - protein, 11 aa, Mycobacterium tuberculosis
APDGVAALVSV

SEQ ID NO: 22216 - protein, 11 aa, Mycobacterium tuberculosis
PDGVAALVSVE

SEQ ID NO: 22217 - protein, 11 aa, Mycobacterium tuberculosis
DGVAALVSVEL

SEQ ID NO: 22218 - protein, 11 aa, Mycobacterium tuberculosis
GVAALVSVELC

SEQ ID NO: 22219 - protein, 11 aa, Mycobacterium tuberculosis
VAALVSVELCS

SEQ ID NO: 22220 - protein, 11 aa, Mycobacterium tuberculosis
AALVSVELCSL

SEQ ID NO: 22221 - protein, 11 aa, Mycobacterium tuberculosis
ALVSVELCSLT

SEQ ID NO: 22222 - protein, 11 aa, Mycobacterium tuberculosis
LVSVELCSLTY

SEQ ID NO: 22223 - protein, 11 aa, Mycobacterium tuberculosis
VSVELCSLTYP

SEQ ID NO: 22224 - protein, 11 aa, Mycobacterium tuberculosis
SVELCSLTYPG

SEQ ID NO: 22225 - protein, 11 aa, Mycobacterium tuberculosis
VELCSLTYPGY

SEQ ID NO: 22226 - protein, 11 aa, Mycobacterium tuberculosis
ELCSLTYPGYK

SEQ ID NO: 22227 - protein, 11 aa, Mycobacterium tuberculosis
LCSLTYPGYKP

SEQ ID NO: 22228 - protein, 11 aa, Mycobacterium tuberculosis
CSLTYPGYKPT

SEQ ID NO: 22229 - protein, 11 aa, Mycobacterium tuberculosis
SLTYPGYKPTL

SEQ ID NO: 22230 - protein, 11 aa, Mycobacterium tuberculosis
LTYPGYKPTLP

SEQ ID NO: 22231 - protein, 11 aa, Mycobacterium tuberculosis
TYPGYKPTLPG

SEQ ID NO: 22232 - protein, 11 aa, Mycobacterium tuberculosis
YPGYKPTLPGL

SEQ ID NO: 22233 - protein, 11 aa, Mycobacterium tuberculosis
PGYKPTLPGLV

SEQ ID NO: 22234 - protein, 11 aa, Mycobacterium tuberculosis
GYKPTLPGLVG

SEQ ID NO: 22235 - protein, 11 aa, Mycobacterium tuberculosis
YKPTLPGLVGS

SEQ ID NO: 22236 - protein, 11 aa, Mycobacterium tuberculosis
KPTLPGLVGSA

SEQ ID NO: 22237 - protein, 11 aa, Mycobacterium tuberculosis
PTLPGLVGSAL

SEQ ID NO: 22238 - protein, 11 aa, Mycobacterium tuberculosis
TLPGLVGSALF

SEQ ID NO: 22239 - protein, 11 aa, Mycobacterium tuberculosis
LPGLVGSALFA

SEQ ID NO: 22240 - protein, 11 aa, Mycobacterium tuberculosis
PGLVGSALFAD

SEQ ID NO: 22241 - protein, 11 aa, Mycobacterium tuberculosis
GLVGSALFADG

SEQ ID NO: 22242 - protein, 11 aa, Mycobacterium tuberculosis
LVGSALFADGA

SEQ ID NO: 22243 - protein, 11 aa, Mycobacterium tuberculosis
VGSALFADGAA

SEQ ID NO: 22244 - protein, 11 aa, Mycobacterium tuberculosis
GSALFADGAAA

SEQ ID NO: 22245 - protein, 11 aa, Mycobacterium tuberculosis
SALFADGAAAV

SEQ ID NO: 22246 - protein, 11 aa, Mycobacterium tuberculosis
ALFADGAAAVV

SEQ ID NO: 22247 - protein, 11 aa, Mycobacterium tuberculosis
LFADGAAAVVA

SEQ ID NO: 22248 - protein, 11 aa, Mycobacterium tuberculosis
FADGAAAVVAA

SEQ ID NO: 22249 - protein, 11 aa, Mycobacterium tuberculosis
ADGAAAVVAAG

SEQ ID NO: 22250 - protein, 11 aa, Mycobacterium tuberculosis
DGAAAVVAAGV

SEQ ID NO: 22251 - protein, 11 aa, Mycobacterium tuberculosis
GAAAVVAAGVK

SEQ ID NO: 22252 - protein, 11 aa, Mycobacterium tuberculosis
AAAVVAAGVKR

SEQ ID NO: 22253 - protein, 11 aa, Mycobacterium tuberculosis
AAVVAAGVKRA

SEQ ID NO: 22254 - protein, 11 aa, Mycobacterium tuberculosis
AVVAAGVKRAQ

SEQ ID NO: 22255 - protein, 11 aa, Mycobacterium tuberculosis
VVAAGVKRAQD

SEQ ID NO: 22256 - protein, 11 aa, Mycobacterium tuberculosis
VAAGVKRAQDI

SEQ ID NO: 22257 - protein, 11 aa, Mycobacterium tuberculosis
AAGVKRAQDIG

SEQ ID NO: 22258 - protein, 11 aa, Mycobacterium tuberculosis
AGVKRAQDIGA

SEQ ID NO: 22259 - protein, 11 aa, Mycobacterium tuberculosis
GVKRAQDIGAD

SEQ ID NO: 22260 - protein, 11 aa, Mycobacterium tuberculosis
VKRAQDIGADG

SEQ ID NO: 22261 - protein, 11 aa, Mycobacterium tuberculosis
KRAQDIGADGP

SEQ ID NO: 22262 - protein, 11 aa, Mycobacterium tuberculosis
RAQDIGADGPD

SEQ ID NO: 22263 - protein, 11 aa, Mycobacterium tuberculosis
AQDIGADGPDI

SEQ ID NO: 22264 - protein, 11 aa, Mycobacterium tuberculosis
QDIGADGPDIL

SEQ ID NO: 22265 - protein, 11 aa, Mycobacterium tuberculosis
DIGADGPDILD

SEQ ID NO: 22266 - protein, 11 aa, Mycobacterium tuberculosis
IGADGPDILDS

SEQ ID NO: 22267 - protein, 11 aa, Mycobacterium tuberculosis
GADGPDILDSR

SEQ ID NO: 22268 - protein, 11 aa, Mycobacterium tuberculosis
ADGPDILDSRS

SEQ ID NO: 22269 - protein, 11 aa, Mycobacterium tuberculosis
DGPDILDSRSH

SEQ ID NO: 22270 - protein, 11 aa, Mycobacterium tuberculosis
GPDILDSRSHL

SEQ ID NO: 22271 - protein, 11 aa, Mycobacterium tuberculosis
PDILDSRSHLY

SEQ ID NO: 22272 - protein, 11 aa, Mycobacterium tuberculosis
DILDSRSHLYP

SEQ ID NO: 22273 - protein, 11 aa, Mycobacterium tuberculosis
ILDSRSHLYPD

SEQ ID NO: 22274 - protein, 11 aa, Mycobacterium tuberculosis
LDSRSHLYPDS

SEQ ID NO: 22275 - protein, 11 aa, Mycobacterium tuberculosis
DSRSHLYPDSL

SEQ ID NO: 22276 - protein, 11 aa, Mycobacterium tuberculosis
SRSHLYPDSLR

SEQ ID NO: 22277 - protein, 11 aa, Mycobacterium tuberculosis
RSHLYPDSLRT

SEQ ID NO: 22278 - protein, 11 aa, Mycobacterium tuberculosis
SHLYPDSLRTM

SEQ ID NO: 22279 - protein, 11 aa, Mycobacterium tuberculosis
HLYPDSLRTMG

SEQ ID NO: 22280 - protein, 11 aa, Mycobacterium tuberculosis
LYPDSLRTMGY

SEQ ID NO: 22281 - protein, 11 aa, Mycobacterium tuberculosis
YPDSLRTMGYD

SEQ ID NO: 22282 - protein, 11 aa, Mycobacterium tuberculosis
PDSLRTMGYDV

SEQ ID NO: 22283 - protein, 11 aa, Mycobacterium tuberculosis
DSLRTMGYDVG

SEQ ID NO: 22284 - protein, 11 aa, Mycobacterium tuberculosis
SLRTMGYDVGS

SEQ ID NO: 22285 - protein, 11 aa, Mycobacterium tuberculosis
LRTMGYDVGSA

SEQ ID NO: 22286 - protein, 11 aa, Mycobacterium tuberculosis
RTMGYDVGSAG

SEQ ID NO: 22287 - protein, 11 aa, Mycobacterium tuberculosis
TMGYDVGSAGF

SEQ ID NO: 22288 - protein, 11 aa, Mycobacterium tuberculosis
MGYDVGSAGFE

SEQ ID NO: 22289 - protein, 11 aa, Mycobacterium tuberculosis
GYDVGSAGFEL

SEQ ID NO: 22290 - protein, 11 aa, Mycobacterium tuberculosis
YDVGSAGFELV

SEQ ID NO: 22291 - protein, 11 aa, Mycobacterium tuberculosis
DVGSAGFELVL

SEQ ID NO: 22292 - protein, 11 aa, Mycobacterium tuberculosis
VGSAGFELVLS

SEQ ID NO: 22293 - protein, 11 aa, Mycobacterium tuberculosis
GSAGFELVLSR

SEQ ID NO: 22294 - protein, 11 aa, Mycobacterium tuberculosis
SAGFELVLSRD

SEQ ID NO: 22295 - protein, 11 aa, Mycobacterium tuberculosis
AGFELVLSRDL

SEQ ID NO: 22296 - protein, 11 aa, Mycobacterium tuberculosis
GFELVLSRDLA

SEQ ID NO: 22297 - protein, 11 aa, Mycobacterium tuberculosis
FELVLSRDLAA

SEQ ID NO: 22298 - protein, 11 aa, Mycobacterium tuberculosis
ELVLSRDLAAV

SEQ ID NO: 22299 - protein, 11 aa, Mycobacterium tuberculosis
LVLSRDLAAVV

SEQ ID NO: 22300 - protein, 11 aa, Mycobacterium tuberculosis
VLSRDLAAVVE

SEQ ID NO: 22301 - protein, 11 aa, Mycobacterium tuberculosis
LSRDLAAVVEQ

SEQ ID NO: 22302 - protein, 11 aa, Mycobacterium tuberculosis
SRDLAAVVEQY

SEQ ID NO: 22303 - protein, 11 aa, Mycobacterium tuberculosis
RDLAAVVEQYL

SEQ ID NO: 22304 - protein, 11 aa, Mycobacterium tuberculosis
DLAAVVEQYLG

SEQ ID NO: 22305 - protein, 11 aa, Mycobacterium tuberculosis
LAAVVEQYLGN

SEQ ID NO: 22306 - protein, 11 aa, Mycobacterium tuberculosis
AAVVEQYLGND

SEQ ID NO: 22307 - protein, 11 aa, Mycobacterium tuberculosis
AVVEQYLGNDV

SEQ ID NO: 22308 - protein, 11 aa, Mycobacterium tuberculosis
VVEQYLGNDVT

SEQ ID NO: 22309 - protein, 11 aa, Mycobacterium tuberculosis
VEQYLGNDVTT

SEQ ID NO: 22310 - protein, 11 aa, Mycobacterium tuberculosis
EQYLGNDVTTF

SEQ ID NO: 22311 - protein, 11 aa, Mycobacterium tuberculosis
QYLGNDVTTFL

SEQ ID NO: 22312 - protein, 11 aa, Mycobacterium tuberculosis
YLGNDVTTFLA

SEQ ID NO: 22313 - protein, 11 aa, Mycobacterium tuberculosis
LGNDVTTFLAS

SEQ ID NO: 22314 - protein, 11 aa, Mycobacterium tuberculosis
GNDVTTFLASH

SEQ ID NO: 22315 - protein, 11 aa, Mycobacterium tuberculosis
NDVTTFLASHG

SEQ ID NO: 22316 - protein, 11 aa, Mycobacterium tuberculosis
DVTTFLASHGL

SEQ ID NO: 22317 - protein, 11 aa, Mycobacterium tuberculosis
VTTFLASHGLS

SEQ ID NO: 22318 - protein, 11 aa, Mycobacterium tuberculosis
TTFLASHGLST

SEQ ID NO: 22319 - protein, 11 aa, Mycobacterium tuberculosis
TFLASHGLSTT

SEQ ID NO: 22320 - protein, 11 aa, Mycobacterium tuberculosis
FLASHGLSTTD

SEQ ID NO: 22321 - protein, 11 aa, Mycobacterium tuberculosis
LASHGLSTTDV

SEQ ID NO: 22322 - protein, 11 aa, Mycobacterium tuberculosis
ASHGLSTTDVG

SEQ ID NO: 22323 - protein, 11 aa, Mycobacterium tuberculosis
SHGLSTTDVGA

SEQ ID NO: 22324 - protein, 11 aa, Mycobacterium tuberculosis
HGLSTTDVGAW

SEQ ID NO: 22325 - protein, 11 aa, Mycobacterium tuberculosis
GLSTTDVGAWV

SEQ ID NO: 22326 - protein, 11 aa, Mycobacterium tuberculosis
LSTTDVGAWVT

SEQ ID NO: 22327 - protein, 11 aa, Mycobacterium tuberculosis
STTDVGAWVTH

SEQ ID NO: 22328 - protein, 11 aa, Mycobacterium tuberculosis
TTDVGAWVTHP

SEQ ID NO: 22329 - protein, 11 aa, Mycobacterium tuberculosis
TDVGAWVTHPG

SEQ ID NO: 22330 - protein, 11 aa, Mycobacterium tuberculosis
DVGAWVTHPGG

SEQ ID NO: 22331 - protein, 11 aa, Mycobacterium tuberculosis
VGAWVTHPGGP

SEQ ID NO: 22332 - protein, 11 aa, Mycobacterium tuberculosis
GAWVTHPGGPK

SEQ ID NO: 22333 - protein, 11 aa, Mycobacterium tuberculosis
AWVTHPGGPKI

SEQ ID NO: 22334 - protein, 11 aa, Mycobacterium tuberculosis
WVTHPGGPKII

SEQ ID NO: 22335 - protein, 11 aa, Mycobacterium tuberculosis
VTHPGGPKIIN

SEQ ID NO: 22336 - protein, 11 aa, Mycobacterium tuberculosis
THPGGPKIINA

SEQ ID NO: 22337 - protein, 11 aa, Mycobacterium tuberculosis
HPGGPKIINAI

SEQ ID NO: 22338 - protein, 11 aa, Mycobacterium tuberculosis
PGGPKIINAIT

SEQ ID NO: 22339 - protein, 11 aa, Mycobacterium tuberculosis
GGPKIINAITE

SEQ ID NO: 22340 - protein, 11 aa, Mycobacterium tuberculosis
GPKIINAITET

SEQ ID NO: 22341 - protein, 11 aa, Mycobacterium tuberculosis
PKIINAITETL

SEQ ID NO: 22342 - protein, 11 aa, Mycobacterium tuberculosis
KIINAITETLD

SEQ ID NO: 22343 - protein, 11 aa, Mycobacterium tuberculosis
IINAITETLDL

SEQ ID NO: 22344 - protein, 11 aa, Mycobacterium tuberculosis
INAITETLDLS

SEQ ID NO: 22345 - protein, 11 aa, Mycobacterium tuberculosis
NAITETLDLSP

SEQ ID NO: 22346 - protein, 11 aa, Mycobacterium tuberculosis
AITETLDLSPQ

SEQ ID NO: 22347 - protein, 11 aa, Mycobacterium tuberculosis
ITETLDLSPQA

SEQ ID NO: 22348 - protein, 11 aa, Mycobacterium tuberculosis
TETLDLSPQAL

SEQ ID NO: 22349 - protein, 11 aa, Mycobacterium tuberculosis
ETLDLSPQALE

SEQ ID NO: 22350 - protein, 11 aa, Mycobacterium tuberculosis
TLDLSPQALEL

SEQ ID NO: 22351 - protein, 11 aa, Mycobacterium tuberculosis
LDLSPQALELT

SEQ ID NO: 22352 - protein, 11 aa, Mycobacterium tuberculosis
DLSPQALELTW

SEQ ID NO: 22353 - protein, 11 aa, Mycobacterium tuberculosis
LSPQALELTWR

SEQ ID NO: 22354 - protein, 11 aa, Mycobacterium tuberculosis
SPQALELTWRS

SEQ ID NO: 22355 - protein, 11 aa, Mycobacterium tuberculosis
PQALELTWRSL

SEQ ID NO: 22356 - protein, 11 aa, Mycobacterium tuberculosis
QALELTWRSLG

SEQ ID NO: 22357 - protein, 11 aa, Mycobacterium tuberculosis
ALELTWRSLGE

SEQ ID NO: 22358 - protein, 11 aa, Mycobacterium tuberculosis
LELTWRSLGEI

SEQ ID NO: 22359 - protein, 11 aa, Mycobacterium tuberculosis
ELTWRSLGEIG

SEQ ID NO: 22360 - protein, 11 aa, Mycobacterium tuberculosis
LTWRSLGEIGN

SEQ ID NO: 22361 - protein, 11 aa, Mycobacterium tuberculosis
TWRSLGEIGNL

SEQ ID NO: 22362 - protein, 11 aa, Mycobacterium tuberculosis
WRSLGEIGNLS

SEQ ID NO: 22363 - protein, 11 aa, Mycobacterium tuberculosis
RSLGEIGNLSS

SEQ ID NO: 22364 - protein, 11 aa, Mycobacterium tuberculosis
SLGEIGNLSSA

SEQ ID NO: 22365 - protein, 11 aa, Mycobacterium tuberculosis
LGEIGNLSSAS

SEQ ID NO: 22366 - protein, 11 aa, Mycobacterium tuberculosis
GEIGNLSSASV

SEQ ID NO: 22367 - protein, 11 aa, Mycobacterium tuberculosis
EIGNLSSASVL

SEQ ID NO: 22368 - protein, 11 aa, Mycobacterium tuberculosis
IGNLSSASVLH

SEQ ID NO: 22369 - protein, 11 aa, Mycobacterium tuberculosis
GNLSSASVLHV

SEQ ID NO: 22370 - protein, 11 aa, Mycobacterium tuberculosis
NLSSASVLHVL

SEQ ID NO: 22371 - protein, 11 aa, Mycobacterium tuberculosis
LSSASVLHVLR

SEQ ID NO: 22372 - protein, 11 aa, Mycobacterium tuberculosis
SSASVLHVLRD

SEQ ID NO: 22373 - protein, 11 aa, Mycobacterium tuberculosis
SASVLHVLRDT

SEQ ID NO: 22374 - protein, 11 aa, Mycobacterium tuberculosis
ASVLHVLRDTI

SEQ ID NO: 22375 - protein, 11 aa, Mycobacterium tuberculosis
SVLHVLRDTIA

SEQ ID NO: 22376 - protein, 11 aa, Mycobacterium tuberculosis
VLHVLRDTIAK

SEQ ID NO: 22377 - protein, 11 aa, Mycobacterium tuberculosis
LHVLRDTIAKP

SEQ ID NO: 22378 - protein, 11 aa, Mycobacterium tuberculosis
HVLRDTIAKPP

SEQ ID NO: 22379 - protein, 11 aa, Mycobacterium tuberculosis
VLRDTIAKPPP

SEQ ID NO: 22380 - protein, 11 aa, Mycobacterium tuberculosis
LRDTIAKPPPS

SEQ ID NO: 22381 - protein, 11 aa, Mycobacterium tuberculosis
RDTIAKPPPSG

SEQ ID NO: 22382 - protein, 11 aa, Mycobacterium tuberculosis
DTIAKPPPSGS

SEQ ID NO: 22383 - protein, 11 aa, Mycobacterium tuberculosis
TIAKPPPSGSP

SEQ ID NO: 22384 - protein, 11 aa, Mycobacterium tuberculosis
IAKPPPSGSPG

SEQ ID NO: 22385 - protein, 11 aa, Mycobacterium tuberculosis
AKPPPSGSPGL

SEQ ID NO: 22386 - protein, 11 aa, Mycobacterium tuberculosis
KPPPSGSPGLM

SEQ ID NO: 22387 - protein, 11 aa, Mycobacterium tuberculosis
PPPSGSPGLMI

SEQ ID NO: 22388 - protein, 11 aa, Mycobacterium tuberculosis
PPSGSPGLMIA

SEQ ID NO: 22389 - protein, 11 aa, Mycobacterium tuberculosis
PSGSPGLMIAM

SEQ ID NO: 22390 - protein, 11 aa, Mycobacterium tuberculosis
SGSPGLMIAMG

SEQ ID NO: 22391 - protein, 11 aa, Mycobacterium tuberculosis
GSPGLMIAMGP

SEQ ID NO: 22392 - protein, 11 aa, Mycobacterium tuberculosis
SPGLMIAMGPG

SEQ ID NO: 22393 - protein, 11 aa, Mycobacterium tuberculosis
PGLMIAMGPGF

SEQ ID NO: 22394 - protein, 11 aa, Mycobacterium tuberculosis
GLMIAMGPGFC

SEQ ID NO: 22395 - protein, 11 aa, Mycobacterium tuberculosis
LMIAMGPGFCS

SEQ ID NO: 22396 - protein, 11 aa, Mycobacterium tuberculosis
MIAMGPGFCSE

SEQ ID NO: 22397 - protein, 11 aa, Mycobacterium tuberculosis
IAMGPGFCSEL

SEQ ID NO: 22398 - protein, 11 aa, Mycobacterium tuberculosis
AMGPGFCSELV

SEQ ID NO: 22399 - protein, 11 aa, Mycobacterium tuberculosis
MGPGFCSELVL

SEQ ID NO: 22400 - protein, 11 aa, Mycobacterium tuberculosis
GPGFCSELVLL

SEQ ID NO: 22401 - protein, 11 aa, Mycobacterium tuberculosis
PGFCSELVLLR

SEQ ID NO: 22402 - protein, 11 aa, Mycobacterium tuberculosis
GFCSELVLLRW

SEQ ID NO: 22403 - protein, 11 aa, Mycobacterium tuberculosis
FCSELVLLRWH

SEQ ID NO: 22404 - protein, 8 aa, Mycobacterium tuberculosis
MATRFMTD

SEQ ID NO: 22405 - protein, 8 aa, Mycobacterium tuberculosis
ATRFMTDP

SEQ ID NO: 22406 - protein, 8 aa, Mycobacterium tuberculosis
TRFMTDPH

SEQ ID NO: 22407 - protein, 8 aa, Mycobacterium tuberculosis
RFMTDPHA

SEQ ID NO: 22408 - protein, 8 aa, Mycobacterium tuberculosis
FMTDPHAM

SEQ ID NO: 22409 - protein, 8 aa, Mycobacterium tuberculosis
MTDPHAMR

SEQ ID NO: 22410 - protein, 8 aa, Mycobacterium tuberculosis
TDPHAMRD

SEQ ID NO: 22411 - protein, 8 aa, Mycobacterium tuberculosis
DPHAMRDM

SEQ ID NO: 22412 - protein, 8 aa, Mycobacterium tuberculosis
PHAMRDMA

SEQ ID NO: 22413 - protein, 8 aa, Mycobacterium tuberculosis
HAMRDMAG

SEQ ID NO: 22414 - protein, 8 aa, Mycobacterium tuberculosis
AMRDMAGR

SEQ ID NO: 22415 - protein, 8 aa, Mycobacterium tuberculosis
MRDMAGRF

SEQ ID NO: 22416 - protein, 8 aa, Mycobacterium tuberculosis
RDMAGRFE

SEQ ID NO: 22417 - protein, 8 aa, Mycobacterium tuberculosis
DMAGRFEV

SEQ ID NO: 22418 - protein, 8 aa, Mycobacterium tuberculosis
MAGRFEVH

SEQ ID NO: 22419 - protein, 8 aa, Mycobacterium tuberculosis
AGRFEVHA

SEQ ID NO: 22420 - protein, 8 aa, Mycobacterium tuberculosis
GRFEVHAQ

SEQ ID NO: 22421 - protein, 8 aa, Mycobacterium tuberculosis
RFEVHAQT

SEQ ID NO: 22422 - protein, 8 aa, Mycobacterium tuberculosis
FEVHAQTV

SEQ ID NO: 22423 - protein, 8 aa, Mycobacterium tuberculosis
EVHAQTVE

SEQ ID NO: 22424 - protein, 8 aa, Mycobacterium tuberculosis
VHAQTVED

SEQ ID NO: 22425 - protein, 8 aa, Mycobacterium tuberculosis
HAQTVEDE

SEQ ID NO: 22426 - protein, 8 aa, Mycobacterium tuberculosis
AQTVEDEA

SEQ ID NO: 22427 - protein, 8 aa, Mycobacterium tuberculosis
QTVEDEAR

SEQ ID NO: 22428 - protein, 8 aa, Mycobacterium tuberculosis
TVEDEARR

SEQ ID NO: 22429 - protein, 8 aa, Mycobacterium tuberculosis
VEDEARRM

SEQ ID NO: 22430 - protein, 8 aa, Mycobacterium tuberculosis
EDEARRMW

SEQ ID NO: 22431 - protein, 8 aa, Mycobacterium tuberculosis
DEARRMWA

SEQ ID NO: 22432 - protein, 8 aa, Mycobacterium tuberculosis
EARRMWAS

SEQ ID NO: 22433 - protein, 8 aa, Mycobacterium tuberculosis
ARRMWASA

SEQ ID NO: 22434 - protein, 8 aa, Mycobacterium tuberculosis
RRMWASAQ

SEQ ID NO: 22435 - protein, 8 aa, Mycobacterium tuberculosis
RMWASAQN

SEQ ID NO: 22436 - protein, 8 aa, Mycobacterium tuberculosis
MWASAQNI

SEQ ID NO: 22437 - protein, 8 aa, Mycobacterium tuberculosis
WASAQNIS

SEQ ID NO: 22438 - protein, 8 aa, Mycobacterium tuberculosis
ASAQNISG

SEQ ID NO: 22439 - protein, 8 aa, Mycobacterium tuberculosis
SAQNISGA

SEQ ID NO: 22440 - protein, 8 aa, Mycobacterium tuberculosis
AQNISGAG

SEQ ID NO: 22441 - protein, 8 aa, Mycobacterium tuberculosis
QNISGAGW

SEQ ID NO: 22442 - protein, 8 aa, Mycobacterium tuberculosis
NISGAGWS

SEQ ID NO: 22443 - protein, 8 aa, Mycobacterium tuberculosis
ISGAGWSG

SEQ ID NO: 22444 - protein, 8 aa, Mycobacterium tuberculosis
SGAGWSGM

SEQ ID NO: 22445 - protein, 8 aa, Mycobacterium tuberculosis
GAGWSGMA

SEQ ID NO: 22446 - protein, 8 aa, Mycobacterium tuberculosis
AGWSGMAE

SEQ ID NO: 22447 - protein, 8 aa, Mycobacterium tuberculosis
GWSGMAEA

SEQ ID NO: 22448 - protein, 8 aa, Mycobacterium tuberculosis
WSGMAEAT

SEQ ID NO: 22449 - protein, 8 aa, Mycobacterium tuberculosis
SGMAEATS

SEQ ID NO: 22450 - protein, 8 aa, Mycobacterium tuberculosis
GMAEATSL

SEQ ID NO: 22451 - protein, 8 aa, Mycobacterium tuberculosis
MAEATSLD

SEQ ID NO: 22452 - protein, 8 aa, Mycobacterium tuberculosis
AEATSLDT

SEQ ID NO: 22453 - protein, 8 aa, Mycobacterium tuberculosis
EATSLDTM

SEQ ID NO: 22454 - protein, 8 aa, Mycobacterium tuberculosis
ATSLDTMA

SEQ ID NO: 22455 - protein, 8 aa, Mycobacterium tuberculosis
TSLDTMAQ

SEQ ID NO: 22456 - protein, 8 aa, Mycobacterium tuberculosis
SLDTMAQM

SEQ ID NO: 22457 - protein, 8 aa, Mycobacterium tuberculosis
LDTMAQMN

SEQ ID NO: 22458 - protein, 8 aa, Mycobacterium tuberculosis
DTMAQMNQ

SEQ ID NO: 22459 - protein, 8 aa, Mycobacterium tuberculosis
TMAQMNQA

SEQ ID NO: 22460 - protein, 8 aa, Mycobacterium tuberculosis
MAQMNQAF

SEQ ID NO: 22461 - protein, 8 aa, Mycobacterium tuberculosis
AQMNQAFR

SEQ ID NO: 22462 - protein, 8 aa, Mycobacterium tuberculosis
QMNQAFRN

SEQ ID NO: 22463 - protein, 8 aa, Mycobacterium tuberculosis
MNQAFRNI

SEQ ID NO: 22464 - protein, 8 aa, Mycobacterium tuberculosis
NQAFRNIV

SEQ ID NO: 22465 - protein, 8 aa, Mycobacterium tuberculosis
QAFRNIVN

SEQ ID NO: 22466 - protein, 8 aa, Mycobacterium tuberculosis
AFRNIVNM

SEQ ID NO: 22467 - protein, 8 aa, Mycobacterium tuberculosis
FRNIVNML

SEQ ID NO: 22468 - protein, 8 aa, Mycobacterium tuberculosis
RNIVNMLH

SEQ ID NO: 22469 - protein, 8 aa, Mycobacterium tuberculosis
NIVNMLHG

SEQ ID NO: 22470 - protein, 8 aa, Mycobacterium tuberculosis
IVNMLHGV

SEQ ID NO: 22471 - protein, 8 aa, Mycobacterium tuberculosis
VNMLHGVR

SEQ ID NO: 22472 - protein, 8 aa, Mycobacterium tuberculosis
NMLHGVRD

SEQ ID NO: 22473 - protein, 8 aa, Mycobacterium tuberculosis
MLHGVRDG

SEQ ID NO: 22474 - protein, 8 aa, Mycobacterium tuberculosis
LHGVRDGL

SEQ ID NO: 22475 - protein, 8 aa, Mycobacterium tuberculosis
HGVRDGLV

SEQ ID NO: 22476 - protein, 8 aa, Mycobacterium tuberculosis
GVRDGLVR

SEQ ID NO: 22477 - protein, 8 aa, Mycobacterium tuberculosis
VRDGLVRD

SEQ ID NO: 22478 - protein, 8 aa, Mycobacterium tuberculosis
RDGLVRDA

SEQ ID NO: 22479 - protein, 8 aa, Mycobacterium tuberculosis
DGLVRDAN

SEQ ID NO: 22480 - protein, 8 aa, Mycobacterium tuberculosis
GLVRDANN

SEQ ID NO: 22481 - protein, 8 aa, Mycobacterium tuberculosis
LVRDANNY

SEQ ID NO: 22482 - protein, 8 aa, Mycobacterium tuberculosis
VRDANNYE

SEQ ID NO: 22483 - protein, 8 aa, Mycobacterium tuberculosis
RDANNYEQ

SEQ ID NO: 22484 - protein, 8 aa, Mycobacterium tuberculosis
DANNYEQQ

SEQ ID NO: 22485 - protein, 8 aa, Mycobacterium tuberculosis
ANNYEQQE

SEQ ID NO: 22486 - protein, 8 aa, Mycobacterium tuberculosis
NNYEQQEQ

SEQ ID NO: 22487 - protein, 8 aa, Mycobacterium tuberculosis
NYEQQEQA

SEQ ID NO: 22488 - protein, 8 aa, Mycobacterium tuberculosis
YEQQEQAS

SEQ ID NO: 22489 - protein, 8 aa, Mycobacterium tuberculosis
EQQEQASQ

SEQ ID NO: 22490 - protein, 8 aa, Mycobacterium tuberculosis
QQEQASQQ

SEQ ID NO: 22491 - protein, 8 aa, Mycobacterium tuberculosis
QEQASQQI

SEQ ID NO: 22492 - protein, 8 aa, Mycobacterium tuberculosis
EQASQQIL

SEQ ID NO: 22493 - protein, 8 aa, Mycobacterium tuberculosis
QASQQILS

SEQ ID NO: 22494 - protein, 8 aa, Mycobacterium tuberculosis
ASQQILSS

SEQ ID NO: 22495 - protein, 9 aa, Mycobacterium tuberculosis
MATRFMTDP

SEQ ID NO: 22496 - protein, 9 aa, Mycobacterium tuberculosis
ATRFMTDPH

SEQ ID NO: 22497 - protein, 9 aa, Mycobacterium tuberculosis
TRFMTDPHA

SEQ ID NO: 22498 - protein, 9 aa, Mycobacterium tuberculosis
RFMTDPHAM

SEQ ID NO: 22499 - protein, 9 aa, Mycobacterium tuberculosis
FMTDPHAMR

SEQ ID NO: 22500 - protein, 9 aa, Mycobacterium tuberculosis
MTDPHAMRD

SEQ ID NO: 22501 - protein, 9 aa, Mycobacterium tuberculosis
TDPHAMRDM

SEQ ID NO: 22502 - protein, 9 aa, Mycobacterium tuberculosis
DPHAMRDMA

SEQ ID NO: 22503 - protein, 9 aa, Mycobacterium tuberculosis
PHAMRDMAG

SEQ ID NO: 22504 - protein, 9 aa, Mycobacterium tuberculosis
HAMRDMAGR

SEQ ID NO: 22505 - protein, 9 aa, Mycobacterium tuberculosis
AMRDMAGRF

SEQ ID NO: 22506 - protein, 9 aa, Mycobacterium tuberculosis
MRDMAGRFE

SEQ ID NO: 22507 - protein, 9 aa, Mycobacterium tuberculosis
RDMAGRFEV

SEQ ID NO: 22508 - protein, 9 aa, Mycobacterium tuberculosis
DMAGRFEVH

SEQ ID NO: 22509 - protein, 9 aa, Mycobacterium tuberculosis
MAGRFEVHA

SEQ ID NO: 22510 - protein, 9 aa, Mycobacterium tuberculosis
AGRFEVHAQ

SEQ ID NO: 22511 - protein, 9 aa, Mycobacterium tuberculosis
GRFEVHAQT

SEQ ID NO: 22512 - protein, 9 aa, Mycobacterium tuberculosis
RFEVHAQTV

SEQ ID NO: 22513 - protein, 9 aa, Mycobacterium tuberculosis
FEVHAQTVE

SEQ ID NO: 22514 - protein, 9 aa, Mycobacterium tuberculosis
EVHAQTVED

SEQ ID NO: 22515 - protein, 9 aa, Mycobacterium tuberculosis
VHAQTVEDE

SEQ ID NO: 22516 - protein, 9 aa, Mycobacterium tuberculosis
HAQTVEDEA

SEQ ID NO: 22517 - protein, 9 aa, Mycobacterium tuberculosis
AQTVEDEAR

SEQ ID NO: 22518 - protein, 9 aa, Mycobacterium tuberculosis
QTVEDEARR

SEQ ID NO: 22519 - protein, 9 aa, Mycobacterium tuberculosis
TVEDEARRM

SEQ ID NO: 22520 - protein, 9 aa, Mycobacterium tuberculosis
VEDEARRMW

SEQ ID NO: 22521 - protein, 9 aa, Mycobacterium tuberculosis
EDEARRMWA

SEQ ID NO: 22522 - protein, 9 aa, Mycobacterium tuberculosis
DEARRMWAS

SEQ ID NO: 22523 - protein, 9 aa, Mycobacterium tuberculosis
EARRMWASA

SEQ ID NO: 22524 - protein, 9 aa, Mycobacterium tuberculosis
ARRMWASAQ

SEQ ID NO: 22525 - protein, 9 aa, Mycobacterium tuberculosis
RRMWASAQN

SEQ ID NO: 22526 - protein, 9 aa, Mycobacterium tuberculosis
RMWASAQNI

SEQ ID NO: 22527 - protein, 9 aa, Mycobacterium tuberculosis
MWASAQNIS

SEQ ID NO: 22528 - protein, 9 aa, Mycobacterium tuberculosis
WASAQNISG

SEQ ID NO: 22529 - protein, 9 aa, Mycobacterium tuberculosis
ASAQNISGA

SEQ ID NO: 22530 - protein, 9 aa, Mycobacterium tuberculosis
SAQNISGAG

SEQ ID NO: 22531 - protein, 9 aa, Mycobacterium tuberculosis
AQNISGAGW

SEQ ID NO: 22532 - protein, 9 aa, Mycobacterium tuberculosis
QNISGAGWS

SEQ ID NO: 22533 - protein, 9 aa, Mycobacterium tuberculosis
NISGAGWSG

SEQ ID NO: 22534 - protein, 9 aa, Mycobacterium tuberculosis
ISGAGWSGM

SEQ ID NO: 22535 - protein, 9 aa, Mycobacterium tuberculosis
SGAGWSGMA

SEQ ID NO: 22536 - protein, 9 aa, Mycobacterium tuberculosis
GAGWSGMAE

SEQ ID NO: 22537 - protein, 9 aa, Mycobacterium tuberculosis
AGWSGMAEA

SEQ ID NO: 22538 - protein, 9 aa, Mycobacterium tuberculosis
GWSGMAEAT

SEQ ID NO: 22539 - protein, 9 aa, Mycobacterium tuberculosis
WSGMAEATS

SEQ ID NO: 22540 - protein, 9 aa, Mycobacterium tuberculosis
SGMAEATSL

SEQ ID NO: 22541 - protein, 9 aa, Mycobacterium tuberculosis
GMAEATSLD

SEQ ID NO: 22542 - protein, 9 aa, Mycobacterium tuberculosis
MAEATSLDT

SEQ ID NO: 22543 - protein, 9 aa, Mycobacterium tuberculosis
AEATSLDTM

SEQ ID NO: 22544 - protein, 9 aa, Mycobacterium tuberculosis
EATSLDTMA

SEQ ID NO: 22545 - protein, 9 aa, Mycobacterium tuberculosis
ATSLDTMAQ

SEQ ID NO: 22546 - protein, 9 aa, Mycobacterium tuberculosis
TSLDTMAQM

SEQ ID NO: 22547 - protein, 9 aa, Mycobacterium tuberculosis
SLDTMAQMN

SEQ ID NO: 22548 - protein, 9 aa, Mycobacterium tuberculosis
LDTMAQMNQ

SEQ ID NO: 22549 - protein, 9 aa, Mycobacterium tuberculosis
DTMAQMNQA

SEQ ID NO: 22550 - protein, 9 aa, Mycobacterium tuberculosis
TMAQMNQAF

SEQ ID NO: 22551 - protein, 9 aa, Mycobacterium tuberculosis
MAQMNQAFR

SEQ ID NO: 22552 - protein, 9 aa, Mycobacterium tuberculosis
AQMNQAFRN

SEQ ID NO: 22553 - protein, 9 aa, Mycobacterium tuberculosis
QMNQAFRNI

SEQ ID NO: 22554 - protein, 9 aa, Mycobacterium tuberculosis
MNQAFRNIV

SEQ ID NO: 22555 - protein, 9 aa, Mycobacterium tuberculosis
NQAFRNIVN

SEQ ID NO: 22556 - protein, 9 aa, Mycobacterium tuberculosis
QAFRNIVNM

SEQ ID NO: 22557 - protein, 9 aa, Mycobacterium tuberculosis
AFRNIVNML

SEQ ID NO: 22558 - protein, 9 aa, Mycobacterium tuberculosis
FRNIVNMLH

SEQ ID NO: 22559 - protein, 9 aa, Mycobacterium tuberculosis
RNIVNMLHG

SEQ ID NO: 22560 - protein, 9 aa, Mycobacterium tuberculosis
NIVNMLHGV

SEQ ID NO: 22561 - protein, 9 aa, Mycobacterium tuberculosis
IVNMLHGVR

SEQ ID NO: 22562 - protein, 9 aa, Mycobacterium tuberculosis
VNMLHGVRD

SEQ ID NO: 22563 - protein, 9 aa, Mycobacterium tuberculosis
NMLHGVRDG

SEQ ID NO: 22564 - protein, 9 aa, Mycobacterium tuberculosis
MLHGVRDGL

SEQ ID NO: 22565 - protein, 9 aa, Mycobacterium tuberculosis
LHGVRDGLV

SEQ ID NO: 22566 - protein, 9 aa, Mycobacterium tuberculosis
HGVRDGLVR

SEQ ID NO: 22567 - protein, 9 aa, Mycobacterium tuberculosis
GVRDGLVRD

SEQ ID NO: 22568 - protein, 9 aa, Mycobacterium tuberculosis
VRDGLVRDA

SEQ ID NO: 22569 - protein, 9 aa, Mycobacterium tuberculosis
RDGLVRDAN

SEQ ID NO: 22570 - protein, 9 aa, Mycobacterium tuberculosis
DGLVRDANN

SEQ ID NO: 22571 - protein, 9 aa, Mycobacterium tuberculosis
GLVRDANNY

SEQ ID NO: 22572 - protein, 9 aa, Mycobacterium tuberculosis
LVRDANNYE

SEQ ID NO: 22573 - protein, 9 aa, Mycobacterium tuberculosis
VRDANNYEQ

SEQ ID NO: 22574 - protein, 9 aa, Mycobacterium tuberculosis
RDANNYEQQ

SEQ ID NO: 22575 - protein, 9 aa, Mycobacterium tuberculosis
DANNYEQQE

SEQ ID NO: 22576 - protein, 9 aa, Mycobacterium tuberculosis
ANNYEQQEQ

SEQ ID NO: 22577 - protein, 9 aa, Mycobacterium tuberculosis
NNYEQQEQA

SEQ ID NO: 22578 - protein, 9 aa, Mycobacterium tuberculosis
NYEQQEQAS

SEQ ID NO: 22579 - protein, 9 aa, Mycobacterium tuberculosis
YEQQEQASQ

SEQ ID NO: 22580 - protein, 9 aa, Mycobacterium tuberculosis
EQQEQASQQ

SEQ ID NO: 22581 - protein, 9 aa, Mycobacterium tuberculosis
QQEQASQQI

SEQ ID NO: 22582 - protein, 9 aa, Mycobacterium tuberculosis
QEQASQQIL

SEQ ID NO: 22583 - protein, 9 aa, Mycobacterium tuberculosis
EQASQQILS

SEQ ID NO: 22584 - protein, 9 aa, Mycobacterium tuberculosis
QASQQILSS

SEQ ID NO: 22585 - protein, 10 aa, Mycobacterium tuberculosis
MATRFMTDPH

SEQ ID NO: 22586 - protein, 10 aa, Mycobacterium tuberculosis
ATRFMTDPHA

SEQ ID NO: 22587 - protein, 10 aa, Mycobacterium tuberculosis
TRFMTDPHAM

SEQ ID NO: 22588 - protein, 10 aa, Mycobacterium tuberculosis
RFMTDPHAMR

SEQ ID NO: 22589 - protein, 10 aa, Mycobacterium tuberculosis
FMTDPHAMRD

SEQ ID NO: 22590 - protein, 10 aa, Mycobacterium tuberculosis
MTDPHAMRDM

SEQ ID NO: 22591 - protein, 10 aa, Mycobacterium tuberculosis
TDPHAMRDMA

SEQ ID NO: 22592 - protein, 10 aa, Mycobacterium tuberculosis
DPHAMRDMAG

SEQ ID NO: 22593 - protein, 10 aa, Mycobacterium tuberculosis
PHAMRDMAGR

SEQ ID NO: 22594 - protein, 10 aa, Mycobacterium tuberculosis
HAMRDMAGRF

SEQ ID NO: 22595 - protein, 10 aa, Mycobacterium tuberculosis
AMRDMAGRFE

SEQ ID NO: 22596 - protein, 10 aa, Mycobacterium tuberculosis
MRDMAGRFEV

SEQ ID NO: 22597 - protein, 10 aa, Mycobacterium tuberculosis
RDMAGRFEVH

SEQ ID NO: 22598 - protein, 10 aa, Mycobacterium tuberculosis
DMAGRFEVHA

SEQ ID NO: 22599 - protein, 10 aa, Mycobacterium tuberculosis
MAGRFEVHAQ

SEQ ID NO: 22600 - protein, 10 aa, Mycobacterium tuberculosis
AGRFEVHAQT

SEQ ID NO: 22601 - protein, 10 aa, Mycobacterium tuberculosis
GRFEVHAQTV

SEQ ID NO: 22602 - protein, 10 aa, Mycobacterium tuberculosis
RFEVHAQTVE

SEQ ID NO: 22603 - protein, 10 aa, Mycobacterium tuberculosis
FEVHAQTVED

SEQ ID NO: 22604 - protein, 10 aa, Mycobacterium tuberculosis
EVHAQTVEDE

SEQ ID NO: 22605 - protein, 10 aa, Mycobacterium tuberculosis
VHAQTVEDEA

SEQ ID NO: 22606 - protein, 10 aa, Mycobacterium tuberculosis
HAQTVEDEAR

SEQ ID NO: 22607 - protein, 10 aa, Mycobacterium tuberculosis
AQTVEDEARR

SEQ ID NO: 22608 - protein, 10 aa, Mycobacterium tuberculosis
QTVEDEARRM

SEQ ID NO: 22609 - protein, 10 aa, Mycobacterium tuberculosis
TVEDEARRMW

SEQ ID NO: 22610 - protein, 10 aa, Mycobacterium tuberculosis
VEDEARRMWA

SEQ ID NO: 22611 - protein, 10 aa, Mycobacterium tuberculosis
EDEARRMWAS

SEQ ID NO: 22612 - protein, 10 aa, Mycobacterium tuberculosis
DEARRMWASA

SEQ ID NO: 22613 - protein, 10 aa, Mycobacterium tuberculosis
EARRMWASAQ

SEQ ID NO: 22614 - protein, 10 aa, Mycobacterium tuberculosis
ARRMWASAQN

SEQ ID NO: 22615 - protein, 10 aa, Mycobacterium tuberculosis
RRMWASAQNI

SEQ ID NO: 22616 - protein, 10 aa, Mycobacterium tuberculosis
RMWASAQNIS

SEQ ID NO: 22617 - protein, 10 aa, Mycobacterium tuberculosis
MWASAQNISG

SEQ ID NO: 22618 - protein, 10 aa, Mycobacterium tuberculosis
WASAQNISGA

SEQ ID NO: 22619 - protein, 10 aa, Mycobacterium tuberculosis
ASAQNISGAG

SEQ ID NO: 22620 - protein, 10 aa, Mycobacterium tuberculosis
SAQNISGAGW

SEQ ID NO: 22621 - protein, 10 aa, Mycobacterium tuberculosis
AQNISGAGWS

SEQ ID NO: 22622 - protein, 10 aa, Mycobacterium tuberculosis
QNISGAGWSG

SEQ ID NO: 22623 - protein, 10 aa, Mycobacterium tuberculosis
NISGAGWSGM

SEQ ID NO: 22624 - protein, 10 aa, Mycobacterium tuberculosis
ISGAGWSGMA

SEQ ID NO: 22625 - protein, 10 aa, Mycobacterium tuberculosis
SGAGWSGMAE

SEQ ID NO: 22626 - protein, 10 aa, Mycobacterium tuberculosis
GAGWSGMAEA

SEQ ID NO: 22627 - protein, 10 aa, Mycobacterium tuberculosis
AGWSGMAEAT

SEQ ID NO: 22628 - protein, 10 aa, Mycobacterium tuberculosis
GWSGMAEATS

SEQ ID NO: 22629 - protein, 10 aa, Mycobacterium tuberculosis
WSGMAEATSL

SEQ ID NO: 22630 - protein, 10 aa, Mycobacterium tuberculosis
SGMAEATSLD

SEQ ID NO: 22631 - protein, 10 aa, Mycobacterium tuberculosis
GMAEATSLDT

SEQ ID NO: 22632 - protein, 10 aa, Mycobacterium tuberculosis
MAEATSLDTM

SEQ ID NO: 22633 - protein, 10 aa, Mycobacterium tuberculosis
AEATSLDTMA

SEQ ID NO: 22634 - protein, 10 aa, Mycobacterium tuberculosis
EATSLDTMAQ

SEQ ID NO: 22635 - protein, 10 aa, Mycobacterium tuberculosis
ATSLDTMAQM

SEQ ID NO: 22636 - protein, 10 aa, Mycobacterium tuberculosis
TSLDTMAQMN

SEQ ID NO: 22637 - protein, 10 aa, Mycobacterium tuberculosis
SLDTMAQMNQ

SEQ ID NO: 22638 - protein, 10 aa, Mycobacterium tuberculosis
LDTMAQMNQA

SEQ ID NO: 22639 - protein, 10 aa, Mycobacterium tuberculosis
DTMAQMNQAF

SEQ ID NO: 22640 - protein, 10 aa, Mycobacterium tuberculosis
TMAQMNQAFR

SEQ ID NO: 22641 - protein, 10 aa, Mycobacterium tuberculosis
MAQMNQAFRN

SEQ ID NO: 22642 - protein, 10 aa, Mycobacterium tuberculosis
AQMNQAFRNI

SEQ ID NO: 22643 - protein, 10 aa, Mycobacterium tuberculosis
QMNQAFRNIV

SEQ ID NO: 22644 - protein, 10 aa, Mycobacterium tuberculosis
MNQAFRNIVN

SEQ ID NO: 22645 - protein, 10 aa, Mycobacterium tuberculosis
NQAFRNIVNM

SEQ ID NO: 22646 - protein, 10 aa, Mycobacterium tuberculosis
QAFRNIVNML

SEQ ID NO: 22647 - protein, 10 aa, Mycobacterium tuberculosis
AFRNIVNMLH

SEQ ID NO: 22648 - protein, 10 aa, Mycobacterium tuberculosis
FRNIVNMLHG

SEQ ID NO: 22649 - protein, 10 aa, Mycobacterium tuberculosis
RNIVNMLHGV

SEQ ID NO: 22650 - protein, 10 aa, Mycobacterium tuberculosis
NIVNMLHGVR

SEQ ID NO: 22651 - protein, 10 aa, Mycobacterium tuberculosis
IVNMLHGVRD

SEQ ID NO: 22652 - protein, 10 aa, Mycobacterium tuberculosis
VNMLHGVRDG

SEQ ID NO: 22653 - protein, 10 aa, Mycobacterium tuberculosis
NMLHGVRDGL

SEQ ID NO: 22654 - protein, 10 aa, Mycobacterium tuberculosis
MLHGVRDGLV

SEQ ID NO: 22655 - protein, 10 aa, Mycobacterium tuberculosis
LHGVRDGLVR

SEQ ID NO: 22656 - protein, 10 aa, Mycobacterium tuberculosis
HGVRDGLVRD

SEQ ID NO: 22657 - protein, 10 aa, Mycobacterium tuberculosis
GVRDGLVRDA

SEQ ID NO: 22658 - protein, 10 aa, Mycobacterium tuberculosis
VRDGLVRDAN

SEQ ID NO: 22659 - protein, 10 aa, Mycobacterium tuberculosis
RDGLVRDANN

SEQ ID NO: 22660 - protein, 10 aa, Mycobacterium tuberculosis
DGLVRDANNY

SEQ ID NO: 22661 - protein, 10 aa, Mycobacterium tuberculosis
GLVRDANNYE

SEQ ID NO: 22662 - protein, 10 aa, Mycobacterium tuberculosis
LVRDANNYEQ

SEQ ID NO: 22663 - protein, 10 aa, Mycobacterium tuberculosis
VRDANNYEQQ

SEQ ID NO: 22664 - protein, 10 aa, Mycobacterium tuberculosis
RDANNYEQQE

SEQ ID NO: 22665 - protein, 10 aa, Mycobacterium tuberculosis
DANNYEQQEQ

SEQ ID NO: 22666 - protein, 10 aa, Mycobacterium tuberculosis
ANNYEQQEQA

SEQ ID NO: 22667 - protein, 10 aa, Mycobacterium tuberculosis
NNYEQQEQAS

SEQ ID NO: 22668 - protein, 10 aa, Mycobacterium tuberculosis
NYEQQEQASQ

SEQ ID NO: 22669 - protein, 10 aa, Mycobacterium tuberculosis
YEQQEQASQQ

SEQ ID NO: 22670 - protein, 10 aa, Mycobacterium tuberculosis
EQQEQASQQI

SEQ ID NO: 22671 - protein, 10 aa, Mycobacterium tuberculosis
QQEQASQQIL

SEQ ID NO: 22672 - protein, 10 aa, Mycobacterium tuberculosis
QEQASQQILS

SEQ ID NO: 22673 - protein, 10 aa, Mycobacterium tuberculosis
EQASQQILSS

SEQ ID NO: 22674 - protein, 11 aa, Mycobacterium tuberculosis
MATRFMTDPHA

SEQ ID NO: 22675 - protein, 11 aa, Mycobacterium tuberculosis
ATRFMTDPHAM

SEQ ID NO: 22676 - protein, 11 aa, Mycobacterium tuberculosis
TRFMTDPHAMR

SEQ ID NO: 22677 - protein, 11 aa, Mycobacterium tuberculosis
RFMTDPHAMRD

SEQ ID NO: 22678 - protein, 11 aa, Mycobacterium tuberculosis
FMTDPHAMRDM

SEQ ID NO: 22679 - protein, 11 aa, Mycobacterium tuberculosis
MTDPHAMRDMA

SEQ ID NO: 22680 - protein, 11 aa, Mycobacterium tuberculosis
TDPHAMRDMAG

SEQ ID NO: 22681 - protein, 11 aa, Mycobacterium tuberculosis
DPHAMRDMAGR

SEQ ID NO: 22682 - protein, 11 aa, Mycobacterium tuberculosis
PHAMRDMAGRF

SEQ ID NO: 22683 - protein, 11 aa, Mycobacterium tuberculosis
HAMRDMAGRFE

SEQ ID NO: 22684 - protein, 11 aa, Mycobacterium tuberculosis
AMRDMAGRFEV

SEQ ID NO: 22685 - protein, 11 aa, Mycobacterium tuberculosis
MRDMAGRFEVH

SEQ ID NO: 22686 - protein, 11 aa, Mycobacterium tuberculosis
RDMAGRFEVHA

SEQ ID NO: 22687 - protein, 11 aa, Mycobacterium tuberculosis
DMAGRFEVHAQ

SEQ ID NO: 22688 - protein, 11 aa, Mycobacterium tuberculosis
MAGRFEVHAQT

SEQ ID NO: 22689 - protein, 11 aa, Mycobacterium tuberculosis
AGRFEVHAQTV

SEQ ID NO: 22690 - protein, 11 aa, Mycobacterium tuberculosis
GRFEVHAQTVE

SEQ ID NO: 22691 - protein, 11 aa, Mycobacterium tuberculosis
RFEVHAQTVED

SEQ ID NO: 22692 - protein, 11 aa, Mycobacterium tuberculosis
FEVHAQTVEDE

SEQ ID NO: 22693 - protein, 11 aa, Mycobacterium tuberculosis
EVHAQTVEDEA

SEQ ID NO: 22694 - protein, 11 aa, Mycobacterium tuberculosis
VHAQTVEDEAR

SEQ ID NO: 22695 - protein, 11 aa, Mycobacterium tuberculosis
HAQTVEDEARR

SEQ ID NO: 22696 - protein, 11 aa, Mycobacterium tuberculosis
AQTVEDEARRM

SEQ ID NO: 22697 - protein, 11 aa, Mycobacterium tuberculosis
QTVEDEARRMW

SEQ ID NO: 22698 - protein, 11 aa, Mycobacterium tuberculosis
TVEDEARRMWA

SEQ ID NO: 22699 - protein, 11 aa, Mycobacterium tuberculosis
VEDEARRMWAS

SEQ ID NO: 22700 - protein, 11 aa, Mycobacterium tuberculosis
EDEARRMWASA

SEQ ID NO: 22701 - protein, 11 aa, Mycobacterium tuberculosis
DEARRMWASAQ

SEQ ID NO: 22702 - protein, 11 aa, Mycobacterium tuberculosis
EARRMWASAQN

SEQ ID NO: 22703 - protein, 11 aa, Mycobacterium tuberculosis
ARRMWASAQNI

SEQ ID NO: 22704 - protein, 11 aa, Mycobacterium tuberculosis
RRMWASAQNIS

SEQ ID NO: 22705 - protein, 11 aa, Mycobacterium tuberculosis
RMWASAQNISG

SEQ ID NO: 22706 - protein, 11 aa, Mycobacterium tuberculosis
MWASAQNISGA

SEQ ID NO: 22707 - protein, 11 aa, Mycobacterium tuberculosis
WASAQNISGAG

SEQ ID NO: 22708 - protein, 11 aa, Mycobacterium tuberculosis
ASAQNISGAGW

SEQ ID NO: 22709 - protein, 11 aa, Mycobacterium tuberculosis
SAQNISGAGWS

SEQ ID NO: 22710 - protein, 11 aa, Mycobacterium tuberculosis
AQNISGAGWSG

SEQ ID NO: 22711 - protein, 11 aa, Mycobacterium tuberculosis
QNISGAGWSGM

SEQ ID NO: 22712 - protein, 11 aa, Mycobacterium tuberculosis
NISGAGWSGMA

SEQ ID NO: 22713 - protein, 11 aa, Mycobacterium tuberculosis
ISGAGWSGMAE

SEQ ID NO: 22714 - protein, 11 aa, Mycobacterium tuberculosis
SGAGWSGMAEA

SEQ ID NO: 22715 - protein, 11 aa, Mycobacterium tuberculosis
GAGWSGMAEAT

SEQ ID NO: 22716 - protein, 11 aa, Mycobacterium tuberculosis
AGWSGMAEATS

SEQ ID NO: 22717 - protein, 11 aa, Mycobacterium tuberculosis
GWSGMAEATSL

SEQ ID NO: 22718 - protein, 11 aa, Mycobacterium tuberculosis
WSGMAEATSLD

SEQ ID NO: 22719 - protein, 11 aa, Mycobacterium tuberculosis
SGMAEATSLDT

SEQ ID NO: 22720 - protein, 11 aa, Mycobacterium tuberculosis
GMAEATSLDTM

SEQ ID NO: 22721 - protein, 11 aa, Mycobacterium tuberculosis
MAEATSLDTMA

SEQ ID NO: 22722 - protein, 11 aa, Mycobacterium tuberculosis
AEATSLDTMAQ

SEQ ID NO: 22723 - protein, 11 aa, Mycobacterium tuberculosis
EATSLDTMAQM

SEQ ID NO: 22724 - protein, 11 aa, Mycobacterium tuberculosis
ATSLDTMAQMN

SEQ ID NO: 22725 - protein, 11 aa, Mycobacterium tuberculosis
TSLDTMAQMNQ

SEQ ID NO: 22726 - protein, 11 aa, Mycobacterium tuberculosis
SLDTMAQMNQA

SEQ ID NO: 22727 - protein, 11 aa, Mycobacterium tuberculosis
LDTMAQMNQAF

SEQ ID NO: 22728 - protein, 11 aa, Mycobacterium tuberculosis
DTMAQMNQAFR

SEQ ID NO: 22729 - protein, 11 aa, Mycobacterium tuberculosis
TMAQMNQAFRN

SEQ ID NO: 22730 - protein, 11 aa, Mycobacterium tuberculosis
MAQMNQAFRNI

SEQ ID NO: 22731 - protein, 11 aa, Mycobacterium tuberculosis
AQMNQAFRNIV

SEQ ID NO: 22732 - protein, 11 aa, Mycobacterium tuberculosis
QMNQAFRNIVN

SEQ ID NO: 22733 - protein, 11 aa, Mycobacterium tuberculosis
MNQAFRNIVNM

SEQ ID NO: 22734 - protein, 11 aa, Mycobacterium tuberculosis
NQAFRNIVNML

SEQ ID NO: 22735 - protein, 11 aa, Mycobacterium tuberculosis
QAFRNIVNMLH

SEQ ID NO: 22736 - protein, 11 aa, Mycobacterium tuberculosis
AFRNIVNMLHG

SEQ ID NO: 22737 - protein, 11 aa, Mycobacterium tuberculosis
FRNIVNMLHGV

SEQ ID NO: 22738 - protein, 11 aa, Mycobacterium tuberculosis
RNIVNMLHGVR

SEQ ID NO: 22739 - protein, 11 aa, Mycobacterium tuberculosis
NIVNMLHGVRD

SEQ ID NO: 22740 - protein, 11 aa, Mycobacterium tuberculosis
IVNMLHGVRDG

SEQ ID NO: 22741 - protein, 11 aa, Mycobacterium tuberculosis
VNMLHGVRDGL

SEQ ID NO: 22742 - protein, 11 aa, Mycobacterium tuberculosis
NMLHGVRDGLV

SEQ ID NO: 22743 - protein, 11 aa, Mycobacterium tuberculosis
MLHGVRDGLVR

SEQ ID NO: 22744 - protein, 11 aa, Mycobacterium tuberculosis
LHGVRDGLVRD

SEQ ID NO: 22745 - protein, 11 aa, Mycobacterium tuberculosis
HGVRDGLVRDA

SEQ ID NO: 22746 - protein, 11 aa, Mycobacterium tuberculosis
GVRDGLVRDAN

SEQ ID NO: 22747 - protein, 11 aa, Mycobacterium tuberculosis
VRDGLVRDANN

SEQ ID NO: 22748 - protein, 11 aa, Mycobacterium tuberculosis
RDGLVRDANNY

SEQ ID NO: 22749 - protein, 11 aa, Mycobacterium tuberculosis
DGLVRDANNYE

SEQ ID NO: 22750 - protein, 11 aa, Mycobacterium tuberculosis
GLVRDANNYEQ

SEQ ID NO: 22751 - protein, 11 aa, Mycobacterium tuberculosis
LVRDANNYEQQ

SEQ ID NO: 22752 - protein, 11 aa, Mycobacterium tuberculosis
VRDANNYEQQE

SEQ ID NO: 22753 - protein, 11 aa, Mycobacterium tuberculosis
RDANNYEQQEQ

SEQ ID NO: 22754 - protein, 11 aa, Mycobacterium tuberculosis
DANNYEQQEQA

SEQ ID NO: 22755 - protein, 11 aa, Mycobacterium tuberculosis
ANNYEQQEQAS

SEQ ID NO: 22756 - protein, 11 aa, Mycobacterium tuberculosis
NNYEQQEQASQ

SEQ ID NO: 22757 - protein, 11 aa, Mycobacterium tuberculosis
NYEQQEQASQQ

SEQ ID NO: 22758 - protein, 11 aa, Mycobacterium tuberculosis
YEQQEQASQQI

SEQ ID NO: 22759 - protein, 11 aa, Mycobacterium tuberculosis
EQQEQASQQIL

SEQ ID NO: 22760 - protein, 11 aa, Mycobacterium tuberculosis
QQEQASQQILS

SEQ ID NO: 22761 - protein, 11 aa, Mycobacterium tuberculosis
QEQASQQILSS

SEQ ID NO: 22762 - protein, 8 aa, Mycobacterium tuberculosis
MTINYQFG

SEQ ID NO: 22763 - protein, 8 aa, Mycobacterium tuberculosis
TINYQFGD

SEQ ID NO: 22764 - protein, 8 aa, Mycobacterium tuberculosis
INYQFGDV

SEQ ID NO: 22765 - protein, 8 aa, Mycobacterium tuberculosis
NYQFGDVD

SEQ ID NO: 22766 - protein, 8 aa, Mycobacterium tuberculosis
YQFGDVDA

SEQ ID NO: 22767 - protein, 8 aa, Mycobacterium tuberculosis
QFGDVDAH

SEQ ID NO: 22768 - protein, 8 aa, Mycobacterium tuberculosis
FGDVDAHG

SEQ ID NO: 22769 - protein, 8 aa, Mycobacterium tuberculosis
GDVDAHGA

SEQ ID NO: 22770 - protein, 8 aa, Mycobacterium tuberculosis
DVDAHGAM

SEQ ID NO: 22771 - protein, 8 aa, Mycobacterium tuberculosis
VDAHGAMI

SEQ ID NO: 22772 - protein, 8 aa, Mycobacterium tuberculosis
DAHGAMIR

SEQ ID NO: 22773 - protein, 8 aa, Mycobacterium tuberculosis
AHGAMIRA

SEQ ID NO: 22774 - protein, 8 aa, Mycobacterium tuberculosis
HGAMIRAQ

SEQ ID NO: 22775 - protein, 8 aa, Mycobacterium tuberculosis
GAMIRAQA

SEQ ID NO: 22776 - protein, 8 aa, Mycobacterium tuberculosis
AMIRAQAA

SEQ ID NO: 22777 - protein, 8 aa, Mycobacterium tuberculosis
MIRAQAAS

SEQ ID NO: 22778 - protein, 8 aa, Mycobacterium tuberculosis
IRAQAASL

SEQ ID NO: 22779 - protein, 8 aa, Mycobacterium tuberculosis
RAQAASLE

SEQ ID NO: 22780 - protein, 8 aa, Mycobacterium tuberculosis
AQAASLEA

SEQ ID NO: 22781 - protein, 8 aa, Mycobacterium tuberculosis
QAASLEAE

SEQ ID NO: 22782 - protein, 8 aa, Mycobacterium tuberculosis
AASLEAEH

SEQ ID NO: 22783 - protein, 8 aa, Mycobacterium tuberculosis
ASLEAEHQ

SEQ ID NO: 22784 - protein, 8 aa, Mycobacterium tuberculosis
SLEAEHQA

SEQ ID NO: 22785 - protein, 8 aa, Mycobacterium tuberculosis
LEAEHQAI

SEQ ID NO: 22786 - protein, 8 aa, Mycobacterium tuberculosis
EAEHQAIV

SEQ ID NO: 22787 - protein, 8 aa, Mycobacterium tuberculosis
AEHQAIVR

SEQ ID NO: 22788 - protein, 8 aa, Mycobacterium tuberculosis
EHQAIVRD

SEQ ID NO: 22789 - protein, 8 aa, Mycobacterium tuberculosis
HQAIVRDV

SEQ ID NO: 22790 - protein, 8 aa, Mycobacterium tuberculosis
QAIVRDVL

SEQ ID NO: 22791 - protein, 8 aa, Mycobacterium tuberculosis
AIVRDVLA

SEQ ID NO: 22792 - protein, 8 aa, Mycobacterium tuberculosis
IVRDVLAA

SEQ ID NO: 22793 - protein, 8 aa, Mycobacterium tuberculosis
VRDVLAAG

SEQ ID NO: 22794 - protein, 8 aa, Mycobacterium tuberculosis
RDVLAAGD

SEQ ID NO: 22795 - protein, 8 aa, Mycobacterium tuberculosis
DVLAAGDF

SEQ ID NO: 22796 - protein, 8 aa, Mycobacterium tuberculosis
VLAAGDFW

SEQ ID NO: 22797 - protein, 8 aa, Mycobacterium tuberculosis
LAAGDFWG

SEQ ID NO: 22798 - protein, 8 aa, Mycobacterium tuberculosis
AAGDFWGG

SEQ ID NO: 22799 - protein, 8 aa, Mycobacterium tuberculosis
AGDFWGGA

SEQ ID NO: 22800 - protein, 8 aa, Mycobacterium tuberculosis
GDFWGGAG

SEQ ID NO: 22801 - protein, 8 aa, Mycobacterium tuberculosis
DFWGGAGS

SEQ ID NO: 22802 - protein, 8 aa, Mycobacterium tuberculosis
FWGGAGSV

SEQ ID NO: 22803 - protein, 8 aa, Mycobacterium tuberculosis
WGGAGSVA

SEQ ID NO: 22804 - protein, 8 aa, Mycobacterium tuberculosis
GGAGSVAC

SEQ ID NO: 22805 - protein, 8 aa, Mycobacterium tuberculosis
GAGSVACQ

SEQ ID NO: 22806 - protein, 8 aa, Mycobacterium tuberculosis
AGSVACQE

SEQ ID NO: 22807 - protein, 8 aa, Mycobacterium tuberculosis
GSVACQEF

SEQ ID NO: 22808 - protein, 8 aa, Mycobacterium tuberculosis
SVACQEFI

SEQ ID NO: 22809 - protein, 8 aa, Mycobacterium tuberculosis
VACQEFIT

SEQ ID NO: 22810 - protein, 8 aa, Mycobacterium tuberculosis
ACQEFITQ

SEQ ID NO: 22811 - protein, 8 aa, Mycobacterium tuberculosis
CQEFITQL

SEQ ID NO: 22812 - protein, 8 aa, Mycobacterium tuberculosis
QEFITQLG

SEQ ID NO: 22813 - protein, 8 aa, Mycobacterium tuberculosis
EFITQLGR

SEQ ID NO: 22814 - protein, 8 aa, Mycobacterium tuberculosis
FITQLGRN

SEQ ID NO: 22815 - protein, 8 aa, Mycobacterium tuberculosis
ITQLGRNF

SEQ ID NO: 22816 - protein, 8 aa, Mycobacterium tuberculosis
TQLGRNFQ

SEQ ID NO: 22817 - protein, 8 aa, Mycobacterium tuberculosis
QLGRNFQV

SEQ ID NO: 22818 - protein, 8 aa, Mycobacterium tuberculosis
LGRNFQVI

SEQ ID NO: 22819 - protein, 8 aa, Mycobacterium tuberculosis
GRNFQVIY

SEQ ID NO: 22820 - protein, 8 aa, Mycobacterium tuberculosis
RNFQVIYE

SEQ ID NO: 22821 - protein, 8 aa, Mycobacterium tuberculosis
NFQVIYEQ

SEQ ID NO: 22822 - protein, 8 aa, Mycobacterium tuberculosis
FQVIYEQA

SEQ ID NO: 22823 - protein, 8 aa, Mycobacterium tuberculosis
QVIYEQAN

SEQ ID NO: 22824 - protein, 8 aa, Mycobacterium tuberculosis
VIYEQANA

SEQ ID NO: 22825 - protein, 8 aa, Mycobacterium tuberculosis
IYEQANAH

SEQ ID NO: 22826 - protein, 8 aa, Mycobacterium tuberculosis
YEQANAHG

SEQ ID NO: 22827 - protein, 8 aa, Mycobacterium tuberculosis
EQANAHGQ

SEQ ID NO: 22828 - protein, 8 aa, Mycobacterium tuberculosis
QANAHGQK

SEQ ID NO: 22829 - protein, 8 aa, Mycobacterium tuberculosis
ANAHGQKV

SEQ ID NO: 22830 - protein, 8 aa, Mycobacterium tuberculosis
NAHGQKVQ

SEQ ID NO: 22831 - protein, 8 aa, Mycobacterium tuberculosis
AHGQKVQA

SEQ ID NO: 22832 - protein, 8 aa, Mycobacterium tuberculosis
HGQKVQAA

SEQ ID NO: 22833 - protein, 8 aa, Mycobacterium tuberculosis
GQKVQAAG

SEQ ID NO: 22834 - protein, 8 aa, Mycobacterium tuberculosis
QKVQAAGN

SEQ ID NO: 22835 - protein, 8 aa, Mycobacterium tuberculosis
KVQAAGNN

SEQ ID NO: 22836 - protein, 8 aa, Mycobacterium tuberculosis
VQAAGNNM

SEQ ID NO: 22837 - protein, 8 aa, Mycobacterium tuberculosis
QAAGNNMA

SEQ ID NO: 22838 - protein, 8 aa, Mycobacterium tuberculosis
AAGNNMAQ

SEQ ID NO: 22839 - protein, 8 aa, Mycobacterium tuberculosis
AGNNMAQT

SEQ ID NO: 22840 - protein, 8 aa, Mycobacterium tuberculosis
GNNMAQTD

SEQ ID NO: 22841 - protein, 8 aa, Mycobacterium tuberculosis
NNMAQTDS

SEQ ID NO: 22842 - protein, 8 aa, Mycobacterium tuberculosis
NMAQTDSA

SEQ ID NO: 22843 - protein, 8 aa, Mycobacterium tuberculosis
MAQTDSAV

SEQ ID NO: 22844 - protein, 8 aa, Mycobacterium tuberculosis
AQTDSAVG

SEQ ID NO: 22845 - protein, 8 aa, Mycobacterium tuberculosis
QTDSAVGS

SEQ ID NO: 22846 - protein, 8 aa, Mycobacterium tuberculosis
TDSAVGSS

SEQ ID NO: 22847 - protein, 8 aa, Mycobacterium tuberculosis
DSAVGSSW

SEQ ID NO: 22848 - protein, 8 aa, Mycobacterium tuberculosis
SAVGSSWA

SEQ ID NO: 22849 - protein, 9 aa, Mycobacterium tuberculosis
MTINYQFGD

SEQ ID NO: 22850 - protein, 9 aa, Mycobacterium tuberculosis
TINYQFGDV

SEQ ID NO: 22851 - protein, 9 aa, Mycobacterium tuberculosis
INYQFGDVD

SEQ ID NO: 22852 - protein, 9 aa, Mycobacterium tuberculosis
NYQFGDVDA

SEQ ID NO: 22853 - protein, 9 aa, Mycobacterium tuberculosis
YQFGDVDAH

SEQ ID NO: 22854 - protein, 9 aa, Mycobacterium tuberculosis
QFGDVDAHG

SEQ ID NO: 22855 - protein, 9 aa, Mycobacterium tuberculosis
FGDVDAHGA

SEQ ID NO: 22856 - protein, 9 aa, Mycobacterium tuberculosis
GDVDAHGAM

SEQ ID NO: 22857 - protein, 9 aa, Mycobacterium tuberculosis
DVDAHGAMI

SEQ ID NO: 22858 - protein, 9 aa, Mycobacterium tuberculosis
VDAHGAMIR

SEQ ID NO: 22859 - protein, 9 aa, Mycobacterium tuberculosis
DAHGAMIRA

SEQ ID NO: 22860 - protein, 9 aa, Mycobacterium tuberculosis
AHGAMIRAQ

SEQ ID NO: 22861 - protein, 9 aa, Mycobacterium tuberculosis
HGAMIRAQA

SEQ ID NO: 22862 - protein, 9 aa, Mycobacterium tuberculosis
GAMIRAQAA

SEQ ID NO: 22863 - protein, 9 aa, Mycobacterium tuberculosis
AMIRAQAAS

SEQ ID NO: 22864 - protein, 9 aa, Mycobacterium tuberculosis
MIRAQAASL

SEQ ID NO: 22865 - protein, 9 aa, Mycobacterium tuberculosis
IRAQAASLE

SEQ ID NO: 22866 - protein, 9 aa, Mycobacterium tuberculosis
RAQAASLEA

SEQ ID NO: 22867 - protein, 9 aa, Mycobacterium tuberculosis
AQAASLEAE

SEQ ID NO: 22868 - protein, 9 aa, Mycobacterium tuberculosis
QAASLEAEH

SEQ ID NO: 22869 - protein, 9 aa, Mycobacterium tuberculosis
AASLEAEHQ

SEQ ID NO: 22870 - protein, 9 aa, Mycobacterium tuberculosis
ASLEAEHQA

SEQ ID NO: 22871 - protein, 9 aa, Mycobacterium tuberculosis
SLEAEHQAI

SEQ ID NO: 22872 - protein, 9 aa, Mycobacterium tuberculosis
LEAEHQAIV

SEQ ID NO: 22873 - protein, 9 aa, Mycobacterium tuberculosis
EAEHQAIVR

SEQ ID NO: 22874 - protein, 9 aa, Mycobacterium tuberculosis
AEHQAIVRD

SEQ ID NO: 22875 - protein, 9 aa, Mycobacterium tuberculosis
EHQAIVRDV

SEQ ID NO: 22876 - protein, 9 aa, Mycobacterium tuberculosis
HQAIVRDVL

SEQ ID NO: 22877 - protein, 9 aa, Mycobacterium tuberculosis
QAIVRDVLA

SEQ ID NO: 22878 - protein, 9 aa, Mycobacterium tuberculosis
AIVRDVLAA

SEQ ID NO: 22879 - protein, 9 aa, Mycobacterium tuberculosis
IVRDVLAAG

SEQ ID NO: 22880 - protein, 9 aa, Mycobacterium tuberculosis
VRDVLAAGD

SEQ ID NO: 22881 - protein, 9 aa, Mycobacterium tuberculosis
RDVLAAGDF

SEQ ID NO: 22882 - protein, 9 aa, Mycobacterium tuberculosis
DVLAAGDFW

SEQ ID NO: 22883 - protein, 9 aa, Mycobacterium tuberculosis
VLAAGDFWG

SEQ ID NO: 22884 - protein, 9 aa, Mycobacterium tuberculosis
LAAGDFWGG

SEQ ID NO: 22885 - protein, 9 aa, Mycobacterium tuberculosis
AAGDFWGGA

SEQ ID NO: 22886 - protein, 9 aa, Mycobacterium tuberculosis
AGDFWGGAG

SEQ ID NO: 22887 - protein, 9 aa, Mycobacterium tuberculosis
GDFWGGAGS

SEQ ID NO: 22888 - protein, 9 aa, Mycobacterium tuberculosis
DFWGGAGSV

SEQ ID NO: 22889 - protein, 9 aa, Mycobacterium tuberculosis
FWGGAGSVA

SEQ ID NO: 22890 - protein, 9 aa, Mycobacterium tuberculosis
WGGAGSVAC

SEQ ID NO: 22891 - protein, 9 aa, Mycobacterium tuberculosis
GGAGSVACQ

SEQ ID NO: 22892 - protein, 9 aa, Mycobacterium tuberculosis
GAGSVACQE

SEQ ID NO: 22893 - protein, 9 aa, Mycobacterium tuberculosis
AGSVACQEF

SEQ ID NO: 22894 - protein, 9 aa, Mycobacterium tuberculosis
GSVACQEFI

SEQ ID NO: 22895 - protein, 9 aa, Mycobacterium tuberculosis
SVACQEFIT

SEQ ID NO: 22896 - protein, 9 aa, Mycobacterium tuberculosis
VACQEFITQ

SEQ ID NO: 22897 - protein, 9 aa, Mycobacterium tuberculosis
ACQEFITQL

SEQ ID NO: 22898 - protein, 9 aa, Mycobacterium tuberculosis
CQEFITQLG

SEQ ID NO: 22899 - protein, 9 aa, Mycobacterium tuberculosis
QEFITQLGR

SEQ ID NO: 22900 - protein, 9 aa, Mycobacterium tuberculosis
EFITQLGRN

SEQ ID NO: 22901 - protein, 9 aa, Mycobacterium tuberculosis
FITQLGRNF

SEQ ID NO: 22902 - protein, 9 aa, Mycobacterium tuberculosis
ITQLGRNFQ

SEQ ID NO: 22903 - protein, 9 aa, Mycobacterium tuberculosis
TQLGRNFQV

SEQ ID NO: 22904 - protein, 9 aa, Mycobacterium tuberculosis
QLGRNFQVI

SEQ ID NO: 22905 - protein, 9 aa, Mycobacterium tuberculosis
LGRNFQVIY

SEQ ID NO: 22906 - protein, 9 aa, Mycobacterium tuberculosis
GRNFQVIYE

SEQ ID NO: 22907 - protein, 9 aa, Mycobacterium tuberculosis
RNFQVIYEQ

SEQ ID NO: 22908 - protein, 9 aa, Mycobacterium tuberculosis
NFQVIYEQA

SEQ ID NO: 22909 - protein, 9 aa, Mycobacterium tuberculosis
FQVIYEQAN

SEQ ID NO: 22910 - protein, 9 aa, Mycobacterium tuberculosis
QVIYEQANA

SEQ ID NO: 22911 - protein, 9 aa, Mycobacterium tuberculosis
VIYEQANAH

SEQ ID NO: 22912 - protein, 9 aa, Mycobacterium tuberculosis
IYEQANAHG

SEQ ID NO: 22913 - protein, 9 aa, Mycobacterium tuberculosis
YEQANAHGQ

SEQ ID NO: 22914 - protein, 9 aa, Mycobacterium tuberculosis
EQANAHGQK

SEQ ID NO: 22915 - protein, 9 aa, Mycobacterium tuberculosis
QANAHGQKV

SEQ ID NO: 22916 - protein, 9 aa, Mycobacterium tuberculosis
ANAHGQKVQ

SEQ ID NO: 22917 - protein, 9 aa, Mycobacterium tuberculosis
NAHGQKVQA

SEQ ID NO: 22918 - protein, 9 aa, Mycobacterium tuberculosis
AHGQKVQAA

SEQ ID NO: 22919 - protein, 9 aa, Mycobacterium tuberculosis
HGQKVQAAG

SEQ ID NO: 22920 - protein, 9 aa, Mycobacterium tuberculosis
GQKVQAAGN

SEQ ID NO: 22921 - protein, 9 aa, Mycobacterium tuberculosis
QKVQAAGNN

SEQ ID NO: 22922 - protein, 9 aa, Mycobacterium tuberculosis
KVQAAGNNM

SEQ ID NO: 22923 - protein, 9 aa, Mycobacterium tuberculosis
VQAAGNNMA

SEQ ID NO: 22924 - protein, 9 aa, Mycobacterium tuberculosis
QAAGNNMAQ

SEQ ID NO: 22925 - protein, 9 aa, Mycobacterium tuberculosis
AAGNNMAQT

SEQ ID NO: 22926 - protein, 9 aa, Mycobacterium tuberculosis
AGNNMAQTD

SEQ ID NO: 22927 - protein, 9 aa, Mycobacterium tuberculosis
GNNMAQTDS

SEQ ID NO: 22928 - protein, 9 aa, Mycobacterium tuberculosis
NNMAQTDSA

SEQ ID NO: 22929 - protein, 9 aa, Mycobacterium tuberculosis
NMAQTDSAV

SEQ ID NO: 22930 - protein, 9 aa, Mycobacterium tuberculosis
MAQTDSAVG

SEQ ID NO: 22931 - protein, 9 aa, Mycobacterium tuberculosis
AQTDSAVGS

SEQ ID NO: 22932 - protein, 9 aa, Mycobacterium tuberculosis
QTDSAVGSS

SEQ ID NO: 22933 - protein, 9 aa, Mycobacterium tuberculosis
TDSAVGSSW

SEQ ID NO: 22934 - protein, 9 aa, Mycobacterium tuberculosis
DSAVGSSWA

SEQ ID NO: 22935 - protein, 10 aa, Mycobacterium tuberculosis
MTINYQFGDV

SEQ ID NO: 22936 - protein, 10 aa, Mycobacterium tuberculosis
TINYQFGDVD

SEQ ID NO: 22937 - protein, 10 aa, Mycobacterium tuberculosis
INYQFGDVDA

SEQ ID NO: 22938 - protein, 10 aa, Mycobacterium tuberculosis
NYQFGDVDAH

SEQ ID NO: 22939 - protein, 10 aa, Mycobacterium tuberculosis
YQFGDVDAHG

SEQ ID NO: 22940 - protein, 10 aa, Mycobacterium tuberculosis
QFGDVDAHGA

SEQ ID NO: 22941 - protein, 10 aa, Mycobacterium tuberculosis
FGDVDAHGAM

SEQ ID NO: 22942 - protein, 10 aa, Mycobacterium tuberculosis
GDVDAHGAMI

SEQ ID NO: 22943 - protein, 10 aa, Mycobacterium tuberculosis
DVDAHGAMIR

SEQ ID NO: 22944 - protein, 10 aa, Mycobacterium tuberculosis
VDAHGAMIRA

SEQ ID NO: 22945 - protein, 10 aa, Mycobacterium tuberculosis
DAHGAMIRAQ

SEQ ID NO: 22946 - protein, 10 aa, Mycobacterium tuberculosis
AHGAMIRAQA

SEQ ID NO: 22947 - protein, 10 aa, Mycobacterium tuberculosis
HGAMIRAQAA

SEQ ID NO: 22948 - protein, 10 aa, Mycobacterium tuberculosis
GAMIRAQAAS

SEQ ID NO: 22949 - protein, 10 aa, Mycobacterium tuberculosis
AMIRAQAASL

SEQ ID NO: 22950 - protein, 10 aa, Mycobacterium tuberculosis
MIRAQAASLE

SEQ ID NO: 22951 - protein, 10 aa, Mycobacterium tuberculosis
IRAQAASLEA

SEQ ID NO: 22952 - protein, 10 aa, Mycobacterium tuberculosis
RAQAASLEAE

SEQ ID NO: 22953 - protein, 10 aa, Mycobacterium tuberculosis
AQAASLEAEH

SEQ ID NO: 22954 - protein, 10 aa, Mycobacterium tuberculosis
QAASLEAEHQ

SEQ ID NO: 22955 - protein, 10 aa, Mycobacterium tuberculosis
AASLEAEHQA

SEQ ID NO: 22956 - protein, 10 aa, Mycobacterium tuberculosis
ASLEAEHQAI

SEQ ID NO: 22957 - protein, 10 aa, Mycobacterium tuberculosis
SLEAEHQAIV

SEQ ID NO: 22958 - protein, 10 aa, Mycobacterium tuberculosis
LEAEHQAIVR

SEQ ID NO: 22959 - protein, 10 aa, Mycobacterium tuberculosis
EAEHQAIVRD

SEQ ID NO: 22960 - protein, 10 aa, Mycobacterium tuberculosis
AEHQAIVRDV

SEQ ID NO: 22961 - protein, 10 aa, Mycobacterium tuberculosis
EHQAIVRDVL

SEQ ID NO: 22962 - protein, 10 aa, Mycobacterium tuberculosis
HQAIVRDVLA

SEQ ID NO: 22963 - protein, 10 aa, Mycobacterium tuberculosis
QAIVRDVLAA

SEQ ID NO: 22964 - protein, 10 aa, Mycobacterium tuberculosis
AIVRDVLAAG

SEQ ID NO: 22965 - protein, 10 aa, Mycobacterium tuberculosis
IVRDVLAAGD

SEQ ID NO: 22966 - protein, 10 aa, Mycobacterium tuberculosis
VRDVLAAGDF

SEQ ID NO: 22967 - protein, 10 aa, Mycobacterium tuberculosis
RDVLAAGDFW

SEQ ID NO: 22968 - protein, 10 aa, Mycobacterium tuberculosis
DVLAAGDFWG

SEQ ID NO: 22969 - protein, 10 aa, Mycobacterium tuberculosis
VLAAGDFWGG

SEQ ID NO: 22970 - protein, 10 aa, Mycobacterium tuberculosis
LAAGDFWGGA

SEQ ID NO: 22971 - protein, 10 aa, Mycobacterium tuberculosis
AAGDFWGGAG

SEQ ID NO: 22972 - protein, 10 aa, Mycobacterium tuberculosis
AGDFWGGAGS

SEQ ID NO: 22973 - protein, 10 aa, Mycobacterium tuberculosis
GDFWGGAGSV

SEQ ID NO: 22974 - protein, 10 aa, Mycobacterium tuberculosis
DFWGGAGSVA

SEQ ID NO: 22975 - protein, 10 aa, Mycobacterium tuberculosis
FWGGAGSVAC

SEQ ID NO: 22976 - protein, 10 aa, Mycobacterium tuberculosis
WGGAGSVACQ

SEQ ID NO: 22977 - protein, 10 aa, Mycobacterium tuberculosis
GGAGSVACQE

SEQ ID NO: 22978 - protein, 10 aa, Mycobacterium tuberculosis
GAGSVACQEF

SEQ ID NO: 22979 - protein, 10 aa, Mycobacterium tuberculosis
AGSVACQEFI

SEQ ID NO: 22980 - protein, 10 aa, Mycobacterium tuberculosis
GSVACQEFIT

SEQ ID NO: 22981 - protein, 10 aa, Mycobacterium tuberculosis
SVACQEFITQ

SEQ ID NO: 22982 - protein, 10 aa, Mycobacterium tuberculosis
VACQEFITQL

SEQ ID NO: 22983 - protein, 10 aa, Mycobacterium tuberculosis
ACQEFITQLG

SEQ ID NO: 22984 - protein, 10 aa, Mycobacterium tuberculosis
CQEFITQLGR

SEQ ID NO: 22985 - protein, 10 aa, Mycobacterium tuberculosis
QEFITQLGRN

SEQ ID NO: 22986 - protein, 10 aa, Mycobacterium tuberculosis
EFITQLGRNF

SEQ ID NO: 22987 - protein, 10 aa, Mycobacterium tuberculosis
FITQLGRNFQ

SEQ ID NO: 22988 - protein, 10 aa, Mycobacterium tuberculosis
ITQLGRNFQV

SEQ ID NO: 22989 - protein, 10 aa, Mycobacterium tuberculosis
TQLGRNFQVI

SEQ ID NO: 22990 - protein, 10 aa, Mycobacterium tuberculosis
QLGRNFQVIY

SEQ ID NO: 22991 - protein, 10 aa, Mycobacterium tuberculosis
LGRNFQVIYE

SEQ ID NO: 22992 - protein, 10 aa, Mycobacterium tuberculosis
GRNFQVIYEQ

SEQ ID NO: 22993 - protein, 10 aa, Mycobacterium tuberculosis
RNFQVIYEQA

SEQ ID NO: 22994 - protein, 10 aa, Mycobacterium tuberculosis
NFQVIYEQAN

SEQ ID NO: 22995 - protein, 10 aa, Mycobacterium tuberculosis
FQVIYEQANA

SEQ ID NO: 22996 - protein, 10 aa, Mycobacterium tuberculosis
QVIYEQANAH

SEQ ID NO: 22997 - protein, 10 aa, Mycobacterium tuberculosis
VIYEQANAHG

SEQ ID NO: 22998 - protein, 10 aa, Mycobacterium tuberculosis
IYEQANAHGQ

SEQ ID NO: 22999 - protein, 10 aa, Mycobacterium tuberculosis
YEQANAHGQK

SEQ ID NO: 23000 - protein, 10 aa, Mycobacterium tuberculosis
EQANAHGQKV

SEQ ID NO: 23001 - protein, 10 aa, Mycobacterium tuberculosis
QANAHGQKVQ

SEQ ID NO: 23002 - protein, 10 aa, Mycobacterium tuberculosis
ANAHGQKVQA

SEQ ID NO: 23003 - protein, 10 aa, Mycobacterium tuberculosis
NAHGQKVQAA

SEQ ID NO: 23004 - protein, 10 aa, Mycobacterium tuberculosis
AHGQKVQAAG

SEQ ID NO: 23005 - protein, 10 aa, Mycobacterium tuberculosis
HGQKVQAAGN

SEQ ID NO: 23006 - protein, 10 aa, Mycobacterium tuberculosis
GQKVQAAGNN

SEQ ID NO: 23007 - protein, 10 aa, Mycobacterium tuberculosis
QKVQAAGNNM

SEQ ID NO: 23008 - protein, 10 aa, Mycobacterium tuberculosis
KVQAAGNNMA

SEQ ID NO: 23009 - protein, 10 aa, Mycobacterium tuberculosis
VQAAGNNMAQ

SEQ ID NO: 23010 - protein, 10 aa, Mycobacterium tuberculosis
QAAGNNMAQT

SEQ ID NO: 23011 - protein, 10 aa, Mycobacterium tuberculosis
AAGNNMAQTD

SEQ ID NO: 23012 - protein, 10 aa, Mycobacterium tuberculosis
AGNNMAQTDS

SEQ ID NO: 23013 - protein, 10 aa, Mycobacterium tuberculosis
GNNMAQTDSA

SEQ ID NO: 23014 - protein, 10 aa, Mycobacterium tuberculosis
NNMAQTDSAV

SEQ ID NO: 23015 - protein, 10 aa, Mycobacterium tuberculosis
NMAQTDSAVG

SEQ ID NO: 23016 - protein, 10 aa, Mycobacterium tuberculosis
MAQTDSAVGS

SEQ ID NO: 23017 - protein, 10 aa, Mycobacterium tuberculosis
AQTDSAVGSS

SEQ ID NO: 23018 - protein, 10 aa, Mycobacterium tuberculosis
QTDSAVGSSW

SEQ ID NO: 23019 - protein, 10 aa, Mycobacterium tuberculosis
TDSAVGSSWA

SEQ ID NO: 23020 - protein, 11 aa, Mycobacterium tuberculosis
MTINYQFGDVD

SEQ ID NO: 23021 - protein, 11 aa, Mycobacterium tuberculosis
TINYQFGDVDA

SEQ ID NO: 23022 - protein, 11 aa, Mycobacterium tuberculosis
INYQFGDVDAH

SEQ ID NO: 23023 - protein, 11 aa, Mycobacterium tuberculosis
NYQFGDVDAHG

SEQ ID NO: 23024 - protein, 11 aa, Mycobacterium tuberculosis
YQFGDVDAHGA

SEQ ID NO: 23025 - protein, 11 aa, Mycobacterium tuberculosis
QFGDVDAHGAM

SEQ ID NO: 23026 - protein, 11 aa, Mycobacterium tuberculosis
FGDVDAHGAMI

SEQ ID NO: 23027 - protein, 11 aa, Mycobacterium tuberculosis
GDVDAHGAMIR

SEQ ID NO: 23028 - protein, 11 aa, Mycobacterium tuberculosis
DVDAHGAMIRA

SEQ ID NO: 23029 - protein, 11 aa, Mycobacterium tuberculosis
VDAHGAMIRAQ

SEQ ID NO: 23030 - protein, 11 aa, Mycobacterium tuberculosis
DAHGAMIRAQA

SEQ ID NO: 23031 - protein, 11 aa, Mycobacterium tuberculosis
AHGAMIRAQAA

SEQ ID NO: 23032 - protein, 11 aa, Mycobacterium tuberculosis
HGAMIRAQAAS

SEQ ID NO: 23033 - protein, 11 aa, Mycobacterium tuberculosis
GAMIRAQAASL

SEQ ID NO: 23034 - protein, 11 aa, Mycobacterium tuberculosis
AMIRAQAASLE

SEQ ID NO: 23035 - protein, 11 aa, Mycobacterium tuberculosis
MIRAQAASLEA

SEQ ID NO: 23036 - protein, 11 aa, Mycobacterium tuberculosis
IRAQAASLEAE

SEQ ID NO: 23037 - protein, 11 aa, Mycobacterium tuberculosis
RAQAASLEAEH

SEQ ID NO: 23038 - protein, 11 aa, Mycobacterium tuberculosis
AQAASLEAEHQ

SEQ ID NO: 23039 - protein, 11 aa, Mycobacterium tuberculosis
QAASLEAEHQA

SEQ ID NO: 23040 - protein, 11 aa, Mycobacterium tuberculosis
AASLEAEHQAI

SEQ ID NO: 23041 - protein, 11 aa, Mycobacterium tuberculosis
ASLEAEHQAIV

SEQ ID NO: 23042 - protein, 11 aa, Mycobacterium tuberculosis
SLEAEHQAIVR

SEQ ID NO: 23043 - protein, 11 aa, Mycobacterium tuberculosis
LEAEHQAIVRD

SEQ ID NO: 23044 - protein, 11 aa, Mycobacterium tuberculosis
EAEHQAIVRDV

SEQ ID NO: 23045 - protein, 11 aa, Mycobacterium tuberculosis
AEHQAIVRDVL

SEQ ID NO: 23046 - protein, 11 aa, Mycobacterium tuberculosis
EHQAIVRDVLA

SEQ ID NO: 23047 - protein, 11 aa, Mycobacterium tuberculosis
HQAIVRDVLAA

SEQ ID NO: 23048 - protein, 11 aa, Mycobacterium tuberculosis
QAIVRDVLAAG

SEQ ID NO: 23049 - protein, 11 aa, Mycobacterium tuberculosis
AIVRDVLAAGD

SEQ ID NO: 23050 - protein, 11 aa, Mycobacterium tuberculosis
IVRDVLAAGDF

SEQ ID NO: 23051 - protein, 11 aa, Mycobacterium tuberculosis
VRDVLAAGDFW

SEQ ID NO: 23052 - protein, 11 aa, Mycobacterium tuberculosis
RDVLAAGDFWG

SEQ ID NO: 23053 - protein, 11 aa, Mycobacterium tuberculosis
DVLAAGDFWGG

SEQ ID NO: 23054 - protein, 11 aa, Mycobacterium tuberculosis
VLAAGDFWGGA

SEQ ID NO: 23055 - protein, 11 aa, Mycobacterium tuberculosis
LAAGDFWGGAG

SEQ ID NO: 23056 - protein, 11 aa, Mycobacterium tuberculosis
AAGDFWGGAGS

SEQ ID NO: 23057 - protein, 11 aa, Mycobacterium tuberculosis
AGDFWGGAGSV

SEQ ID NO: 23058 - protein, 11 aa, Mycobacterium tuberculosis
GDFWGGAGSVA

SEQ ID NO: 23059 - protein, 11 aa, Mycobacterium tuberculosis
DFWGGAGSVAC

SEQ ID NO: 23060 - protein, 11 aa, Mycobacterium tuberculosis
FWGGAGSVACQ

SEQ ID NO: 23061 - protein, 11 aa, Mycobacterium tuberculosis
WGGAGSVACQE

SEQ ID NO: 23062 - protein, 11 aa, Mycobacterium tuberculosis
GGAGSVACQEF

SEQ ID NO: 23063 - protein, 11 aa, Mycobacterium tuberculosis
GAGSVACQEFI

SEQ ID NO: 23064 - protein, 11 aa, Mycobacterium tuberculosis
AGSVACQEFIT

SEQ ID NO: 23065 - protein, 11 aa, Mycobacterium tuberculosis
GSVACQEFITQ

SEQ ID NO: 23066 - protein, 11 aa, Mycobacterium tuberculosis
SVACQEFITQL

SEQ ID NO: 23067 - protein, 11 aa, Mycobacterium tuberculosis
VACQEFITQLG

SEQ ID NO: 23068 - protein, 11 aa, Mycobacterium tuberculosis
ACQEFITQLGR

SEQ ID NO: 23069 - protein, 11 aa, Mycobacterium tuberculosis
CQEFITQLGRN

SEQ ID NO: 23070 - protein, 11 aa, Mycobacterium tuberculosis
QEFITQLGRNF

SEQ ID NO: 23071 - protein, 11 aa, Mycobacterium tuberculosis
EFITQLGRNFQ

SEQ ID NO: 23072 - protein, 11 aa, Mycobacterium tuberculosis
FITQLGRNFQV

SEQ ID NO: 23073 - protein, 11 aa, Mycobacterium tuberculosis
ITQLGRNFQVI

SEQ ID NO: 23074 - protein, 11 aa, Mycobacterium tuberculosis
TQLGRNFQVIY

SEQ ID NO: 23075 - protein, 11 aa, Mycobacterium tuberculosis
QLGRNFQVIYE

SEQ ID NO: 23076 - protein, 11 aa, Mycobacterium tuberculosis
LGRNFQVIYEQ

SEQ ID NO: 23077 - protein, 11 aa, Mycobacterium tuberculosis
GRNFQVIYEQA

SEQ ID NO: 23078 - protein, 11 aa, Mycobacterium tuberculosis
RNFQVIYEQAN

SEQ ID NO: 23079 - protein, 11 aa, Mycobacterium tuberculosis
NFQVIYEQANA

SEQ ID NO: 23080 - protein, 11 aa, Mycobacterium tuberculosis
FQVIYEQANAH

SEQ ID NO: 23081 - protein, 11 aa, Mycobacterium tuberculosis
QVIYEQANAHG

SEQ ID NO: 23082 - protein, 11 aa, Mycobacterium tuberculosis
VIYEQANAHGQ

SEQ ID NO: 23083 - protein, 11 aa, Mycobacterium tuberculosis
IYEQANAHGQK

SEQ ID NO: 23084 - protein, 11 aa, Mycobacterium tuberculosis
YEQANAHGQKV

SEQ ID NO: 23085 - protein, 11 aa, Mycobacterium tuberculosis
EQANAHGQKVQ

SEQ ID NO: 23086 - protein, 11 aa, Mycobacterium tuberculosis
QANAHGQKVQA

SEQ ID NO: 23087 - protein, 11 aa, Mycobacterium tuberculosis
ANAHGQKVQAA

SEQ ID NO: 23088 - protein, 11 aa, Mycobacterium tuberculosis
NAHGQKVQAAG

SEQ ID NO: 23089 - protein, 11 aa, Mycobacterium tuberculosis
AHGQKVQAAGN

SEQ ID NO: 23090 - protein, 11 aa, Mycobacterium tuberculosis
HGQKVQAAGNN

SEQ ID NO: 23091 - protein, 11 aa, Mycobacterium tuberculosis
GQKVQAAGNNM

SEQ ID NO: 23092 - protein, 11 aa, Mycobacterium tuberculosis
QKVQAAGNNMA

SEQ ID NO: 23093 - protein, 11 aa, Mycobacterium tuberculosis
KVQAAGNNMAQ

SEQ ID NO: 23094 - protein, 11 aa, Mycobacterium tuberculosis
VQAAGNNMAQT

SEQ ID NO: 23095 - protein, 11 aa, Mycobacterium tuberculosis
QAAGNNMAQTD

SEQ ID NO: 23096 - protein, 11 aa, Mycobacterium tuberculosis
AAGNNMAQTDS

SEQ ID NO: 23097 - protein, 11 aa, Mycobacterium tuberculosis
AGNNMAQTDSA

SEQ ID NO: 23098 - protein, 11 aa, Mycobacterium tuberculosis
GNNMAQTDSAV

SEQ ID NO: 23099 - protein, 11 aa, Mycobacterium tuberculosis
NNMAQTDSAVG

SEQ ID NO: 23100 - protein, 11 aa, Mycobacterium tuberculosis
NMAQTDSAVGS

SEQ ID NO: 23101 - protein, 11 aa, Mycobacterium tuberculosis
MAQTDSAVGSS

SEQ ID NO: 23102 - protein, 11 aa, Mycobacterium tuberculosis
AQTDSAVGSSW

SEQ ID NO: 23103 - protein, 11 aa, Mycobacterium tuberculosis
QTDSAVGSSWA

SEQ ID NO: 23104 - protein, 8 aa, Mycobacterium tuberculosis
MDFGLQPP

SEQ ID NO: 23105 - protein, 8 aa, Mycobacterium tuberculosis
DFGLQPPE

SEQ ID NO: 23106 - protein, 8 aa, Mycobacterium tuberculosis
FGLQPPEI

SEQ ID NO: 23107 - protein, 8 aa, Mycobacterium tuberculosis
GLQPPEIT

SEQ ID NO: 23108 - protein, 8 aa, Mycobacterium tuberculosis
LQPPEITS

SEQ ID NO: 23109 - protein, 8 aa, Mycobacterium tuberculosis
QPPEITSG

SEQ ID NO: 23110 - protein, 8 aa, Mycobacterium tuberculosis
PPEITSGE

SEQ ID NO: 23111 - protein, 8 aa, Mycobacterium tuberculosis
PEITSGEM

SEQ ID NO: 23112 - protein, 8 aa, Mycobacterium tuberculosis
EITSGEMY

SEQ ID NO: 23113 - protein, 8 aa, Mycobacterium tuberculosis
ITSGEMYL

SEQ ID NO: 23114 - protein, 8 aa, Mycobacterium tuberculosis
TSGEMYLG

SEQ ID NO: 23115 - protein, 8 aa, Mycobacterium tuberculosis
SGEMYLGP

SEQ ID NO: 23116 - protein, 8 aa, Mycobacterium tuberculosis
GEMYLGPG

SEQ ID NO: 23117 - protein, 8 aa, Mycobacterium tuberculosis
EMYLGPGA

SEQ ID NO: 23118 - protein, 8 aa, Mycobacterium tuberculosis
MYLGPGAG

SEQ ID NO: 23119 - protein, 8 aa, Mycobacterium tuberculosis
YLGPGAGP

SEQ ID NO: 23120 - protein, 8 aa, Mycobacterium tuberculosis
LGPGAGPM

SEQ ID NO: 23121 - protein, 8 aa, Mycobacterium tuberculosis
GPGAGPML

SEQ ID NO: 23122 - protein, 8 aa, Mycobacterium tuberculosis
PGAGPMLA

SEQ ID NO: 23123 - protein, 8 aa, Mycobacterium tuberculosis
GAGPMLAA

SEQ ID NO: 23124 - protein, 8 aa, Mycobacterium tuberculosis
AGPMLAAA

SEQ ID NO: 23125 - protein, 8 aa, Mycobacterium tuberculosis
GPMLAAAV

SEQ ID NO: 23126 - protein, 8 aa, Mycobacterium tuberculosis
PMLAAAVA

SEQ ID NO: 23127 - protein, 8 aa, Mycobacterium tuberculosis
MLAAAVAW

SEQ ID NO: 23128 - protein, 8 aa, Mycobacterium tuberculosis
LAAAVAWD

SEQ ID NO: 23129 - protein, 8 aa, Mycobacterium tuberculosis
AAAVAWDG

SEQ ID NO: 23130 - protein, 8 aa, Mycobacterium tuberculosis
AAVAWDGL

SEQ ID NO: 23131 - protein, 8 aa, Mycobacterium tuberculosis
AVAWDGLA

SEQ ID NO: 23132 - protein, 8 aa, Mycobacterium tuberculosis
VAWDGLAA

SEQ ID NO: 23133 - protein, 8 aa, Mycobacterium tuberculosis
AWDGLAAE

SEQ ID NO: 23134 - protein, 8 aa, Mycobacterium tuberculosis
WDGLAAEL

SEQ ID NO: 23135 - protein, 8 aa, Mycobacterium tuberculosis
DGLAAELQ

SEQ ID NO: 23136 - protein, 8 aa, Mycobacterium tuberculosis
GLAAELQS

SEQ ID NO: 23137 - protein, 8 aa, Mycobacterium tuberculosis
LAAELQSM

SEQ ID NO: 23138 - protein, 8 aa, Mycobacterium tuberculosis
AAELQSMA

SEQ ID NO: 23139 - protein, 8 aa, Mycobacterium tuberculosis
AELQSMAA

SEQ ID NO: 23140 - protein, 8 aa, Mycobacterium tuberculosis
ELQSMAAS

SEQ ID NO: 23141 - protein, 8 aa, Mycobacterium tuberculosis
LQSMAASY

SEQ ID NO: 23142 - protein, 8 aa, Mycobacterium tuberculosis
QSMAASYA

SEQ ID NO: 23143 - protein, 8 aa, Mycobacterium tuberculosis
SMAASYAS

SEQ ID NO: 23144 - protein, 8 aa, Mycobacterium tuberculosis
MAASYASI

SEQ ID NO: 23145 - protein, 8 aa, Mycobacterium tuberculosis
AASYASIV

SEQ ID NO: 23146 - protein, 8 aa, Mycobacterium tuberculosis
ASYASIVE

SEQ ID NO: 23147 - protein, 8 aa, Mycobacterium tuberculosis
SYASIVEG

SEQ ID NO: 23148 - protein, 8 aa, Mycobacterium tuberculosis
YASIVEGM

SEQ ID NO: 23149 - protein, 8 aa, Mycobacterium tuberculosis
ASIVEGMA

SEQ ID NO: 23150 - protein, 8 aa, Mycobacterium tuberculosis
SIVEGMAS

SEQ ID NO: 23151 - protein, 8 aa, Mycobacterium tuberculosis
IVEGMASE

SEQ ID NO: 23152 - protein, 8 aa, Mycobacterium tuberculosis
VEGMASES

SEQ ID NO: 23153 - protein, 8 aa, Mycobacterium tuberculosis
EGMASESW

SEQ ID NO: 23154 - protein, 8 aa, Mycobacterium tuberculosis
GMASESWL

SEQ ID NO: 23155 - protein, 8 aa, Mycobacterium tuberculosis
MASESWLG

SEQ ID NO: 23156 - protein, 8 aa, Mycobacterium tuberculosis
ASESWLGP

SEQ ID NO: 23157 - protein, 8 aa, Mycobacterium tuberculosis
SESWLGPS

SEQ ID NO: 23158 - protein, 8 aa, Mycobacterium tuberculosis
ESWLGPSS

SEQ ID NO: 23159 - protein, 8 aa, Mycobacterium tuberculosis
SWLGPSSA

SEQ ID NO: 23160 - protein, 8 aa, Mycobacterium tuberculosis
WLGPSSAG

SEQ ID NO: 23161 - protein, 8 aa, Mycobacterium tuberculosis
LGPSSAGM

SEQ ID NO: 23162 - protein, 8 aa, Mycobacterium tuberculosis
GPSSAGMA

SEQ ID NO: 23163 - protein, 8 aa, Mycobacterium tuberculosis
PSSAGMAA

SEQ ID NO: 23164 - protein, 8 aa, Mycobacterium tuberculosis
SSAGMAAA

SEQ ID NO: 23165 - protein, 8 aa, Mycobacterium tuberculosis
SAGMAAAA

SEQ ID NO: 23166 - protein, 8 aa, Mycobacterium tuberculosis
AGMAAAAA

SEQ ID NO: 23167 - protein, 8 aa, Mycobacterium tuberculosis
GMAAAAAP

SEQ ID NO: 23168 - protein, 8 aa, Mycobacterium tuberculosis
MAAAAAPY

SEQ ID NO: 23169 - protein, 8 aa, Mycobacterium tuberculosis
AAAAAPYV

SEQ ID NO: 23170 - protein, 8 aa, Mycobacterium tuberculosis
AAAAPYVT

SEQ ID NO: 23171 - protein, 8 aa, Mycobacterium tuberculosis
AAAPYVTW

SEQ ID NO: 23172 - protein, 8 aa, Mycobacterium tuberculosis
AAPYVTWM

SEQ ID NO: 23173 - protein, 8 aa, Mycobacterium tuberculosis
APYVTWMS

SEQ ID NO: 23174 - protein, 8 aa, Mycobacterium tuberculosis
PYVTWMSG

SEQ ID NO: 23175 - protein, 8 aa, Mycobacterium tuberculosis
YVTWMSGT

SEQ ID NO: 23176 - protein, 8 aa, Mycobacterium tuberculosis
VTWMSGTS

SEQ ID NO: 23177 - protein, 8 aa, Mycobacterium tuberculosis
TWMSGTSA

SEQ ID NO: 23178 - protein, 8 aa, Mycobacterium tuberculosis
WMSGTSAQ

SEQ ID NO: 23179 - protein, 8 aa, Mycobacterium tuberculosis
MSGTSAQA

SEQ ID NO: 23180 - protein, 8 aa, Mycobacterium tuberculosis
SGTSAQAK

SEQ ID NO: 23181 - protein, 8 aa, Mycobacterium tuberculosis
GTSAQAKA

SEQ ID NO: 23182 - protein, 8 aa, Mycobacterium tuberculosis
TSAQAKAA

SEQ ID NO: 23183 - protein, 8 aa, Mycobacterium tuberculosis
SAQAKAAA

SEQ ID NO: 23184 - protein, 8 aa, Mycobacterium tuberculosis
AQAKAAAD

SEQ ID NO: 23185 - protein, 8 aa, Mycobacterium tuberculosis
QAKAAADQ

SEQ ID NO: 23186 - protein, 8 aa, Mycobacterium tuberculosis
AKAAADQA

SEQ ID NO: 23187 - protein, 8 aa, Mycobacterium tuberculosis
KAAADQAR

SEQ ID NO: 23188 - protein, 8 aa, Mycobacterium tuberculosis
AAADQARA

SEQ ID NO: 23189 - protein, 8 aa, Mycobacterium tuberculosis
AADQARAA

SEQ ID NO: 23190 - protein, 8 aa, Mycobacterium tuberculosis
ADQARAAV

SEQ ID NO: 23191 - protein, 8 aa, Mycobacterium tuberculosis
DQARAAVV

SEQ ID NO: 23192 - protein, 8 aa, Mycobacterium tuberculosis
QARAAVVA

SEQ ID NO: 23193 - protein, 8 aa, Mycobacterium tuberculosis
ARAAVVAY

SEQ ID NO: 23194 - protein, 8 aa, Mycobacterium tuberculosis
RAAVVAYE

SEQ ID NO: 23195 - protein, 8 aa, Mycobacterium tuberculosis
AAVVAYET

SEQ ID NO: 23196 - protein, 8 aa, Mycobacterium tuberculosis
AVVAYETA

SEQ ID NO: 23197 - protein, 8 aa, Mycobacterium tuberculosis
VVAYETAF

SEQ ID NO: 23198 - protein, 8 aa, Mycobacterium tuberculosis
VAYETAFA

SEQ ID NO: 23199 - protein, 8 aa, Mycobacterium tuberculosis
AYETAFAA

SEQ ID NO: 23200 - protein, 8 aa, Mycobacterium tuberculosis
YETAFAAV

SEQ ID NO: 23201 - protein, 8 aa, Mycobacterium tuberculosis
ETAFAAVV

SEQ ID NO: 23202 - protein, 8 aa, Mycobacterium tuberculosis
TAFAAVVP

SEQ ID NO: 23203 - protein, 8 aa, Mycobacterium tuberculosis
AFAAVVPP

SEQ ID NO: 23204 - protein, 8 aa, Mycobacterium tuberculosis
FAAVVPPP

SEQ ID NO: 23205 - protein, 8 aa, Mycobacterium tuberculosis
AAVVPPPQ

SEQ ID NO: 23206 - protein, 8 aa, Mycobacterium tuberculosis
AVVPPPQI

SEQ ID NO: 23207 - protein, 8 aa, Mycobacterium tuberculosis
VVPPPQIA

SEQ ID NO: 23208 - protein, 8 aa, Mycobacterium tuberculosis
VPPPQIAA

SEQ ID NO: 23209 - protein, 8 aa, Mycobacterium tuberculosis
PPPQIAAN

SEQ ID NO: 23210 - protein, 8 aa, Mycobacterium tuberculosis
PPQIAANR

SEQ ID NO: 23211 - protein, 8 aa, Mycobacterium tuberculosis
PQIAANRS

SEQ ID NO: 23212 - protein, 8 aa, Mycobacterium tuberculosis
QIAANRSQ

SEQ ID NO: 23213 - protein, 8 aa, Mycobacterium tuberculosis
IAANRSQL

SEQ ID NO: 23214 - protein, 8 aa, Mycobacterium tuberculosis
AANRSQLI

SEQ ID NO: 23215 - protein, 8 aa, Mycobacterium tuberculosis
ANRSQLIS

SEQ ID NO: 23216 - protein, 8 aa, Mycobacterium tuberculosis
NRSQLISL

SEQ ID NO: 23217 - protein, 8 aa, Mycobacterium tuberculosis
RSQLISLV

SEQ ID NO: 23218 - protein, 8 aa, Mycobacterium tuberculosis
SQLISLVA

SEQ ID NO: 23219 - protein, 8 aa, Mycobacterium tuberculosis
QLISLVAT

SEQ ID NO: 23220 - protein, 8 aa, Mycobacterium tuberculosis
LISLVATN

SEQ ID NO: 23221 - protein, 8 aa, Mycobacterium tuberculosis
ISLVATNI

SEQ ID NO: 23222 - protein, 8 aa, Mycobacterium tuberculosis
SLVATNIF

SEQ ID NO: 23223 - protein, 8 aa, Mycobacterium tuberculosis
LVATNIFG

SEQ ID NO: 23224 - protein, 8 aa, Mycobacterium tuberculosis
VATNIFGQ

SEQ ID NO: 23225 - protein, 8 aa, Mycobacterium tuberculosis
ATNIFGQN

SEQ ID NO: 23226 - protein, 8 aa, Mycobacterium tuberculosis
TNIFGQNT

SEQ ID NO: 23227 - protein, 8 aa, Mycobacterium tuberculosis
NIFGQNTA

SEQ ID NO: 23228 - protein, 8 aa, Mycobacterium tuberculosis
IFGQNTAA

SEQ ID NO: 23229 - protein, 8 aa, Mycobacterium tuberculosis
FGQNTAAI

SEQ ID NO: 23230 - protein, 8 aa, Mycobacterium tuberculosis
GQNTAAIA

SEQ ID NO: 23231 - protein, 8 aa, Mycobacterium tuberculosis
QNTAAIAA

SEQ ID NO: 23232 - protein, 8 aa, Mycobacterium tuberculosis
NTAAIAAT

SEQ ID NO: 23233 - protein, 8 aa, Mycobacterium tuberculosis
TAAIAATE

SEQ ID NO: 23234 - protein, 8 aa, Mycobacterium tuberculosis
AAIAATEA

SEQ ID NO: 23235 - protein, 8 aa, Mycobacterium tuberculosis
AIAATEAE

SEQ ID NO: 23236 - protein, 8 aa, Mycobacterium tuberculosis
IAATEAEY

SEQ ID NO: 23237 - protein, 8 aa, Mycobacterium tuberculosis
AATEAEYG

SEQ ID NO: 23238 - protein, 8 aa, Mycobacterium tuberculosis
ATEAEYGE

SEQ ID NO: 23239 - protein, 8 aa, Mycobacterium tuberculosis
TEAEYGEM

SEQ ID NO: 23240 - protein, 8 aa, Mycobacterium tuberculosis
EAEYGEMW

SEQ ID NO: 23241 - protein, 8 aa, Mycobacterium tuberculosis
AEYGEMWA

SEQ ID NO: 23242 - protein, 8 aa, Mycobacterium tuberculosis
EYGEMWAQ

SEQ ID NO: 23243 - protein, 8 aa, Mycobacterium tuberculosis
YGEMWAQD

SEQ ID NO: 23244 - protein, 8 aa, Mycobacterium tuberculosis
GEMWAQDT

SEQ ID NO: 23245 - protein, 8 aa, Mycobacterium tuberculosis
EMWAQDTM

SEQ ID NO: 23246 - protein, 8 aa, Mycobacterium tuberculosis
MWAQDTMA

SEQ ID NO: 23247 - protein, 8 aa, Mycobacterium tuberculosis
WAQDTMAM

SEQ ID NO: 23248 - protein, 8 aa, Mycobacterium tuberculosis
AQDTMAMF

SEQ ID NO: 23249 - protein, 8 aa, Mycobacterium tuberculosis
QDTMAMFG

SEQ ID NO: 23250 - protein, 8 aa, Mycobacterium tuberculosis
DTMAMFGY

SEQ ID NO: 23251 - protein, 8 aa, Mycobacterium tuberculosis
TMAMFGYA

SEQ ID NO: 23252 - protein, 8 aa, Mycobacterium tuberculosis
MAMFGYAS

SEQ ID NO: 23253 - protein, 8 aa, Mycobacterium tuberculosis
AMFGYASS

SEQ ID NO: 23254 - protein, 8 aa, Mycobacterium tuberculosis
MFGYASSS

SEQ ID NO: 23255 - protein, 8 aa, Mycobacterium tuberculosis
FGYASSSA

SEQ ID NO: 23256 - protein, 8 aa, Mycobacterium tuberculosis
GYASSSAT

SEQ ID NO: 23257 - protein, 8 aa, Mycobacterium tuberculosis
YASSSATA

SEQ ID NO: 23258 - protein, 8 aa, Mycobacterium tuberculosis
ASSSATAS

SEQ ID NO: 23259 - protein, 8 aa, Mycobacterium tuberculosis
SSSATASR

SEQ ID NO: 23260 - protein, 8 aa, Mycobacterium tuberculosis
SSATASRL

SEQ ID NO: 23261 - protein, 8 aa, Mycobacterium tuberculosis
SATASRLT

SEQ ID NO: 23262 - protein, 8 aa, Mycobacterium tuberculosis
ATASRLTP

SEQ ID NO: 23263 - protein, 8 aa, Mycobacterium tuberculosis
TASRLTPF

SEQ ID NO: 23264 - protein, 8 aa, Mycobacterium tuberculosis
ASRLTPFT

SEQ ID NO: 23265 - protein, 8 aa, Mycobacterium tuberculosis
SRLTPFTA

SEQ ID NO: 23266 - protein, 8 aa, Mycobacterium tuberculosis
RLTPFTAP

SEQ ID NO: 23267 - protein, 8 aa, Mycobacterium tuberculosis
LTPFTAPP

SEQ ID NO: 23268 - protein, 8 aa, Mycobacterium tuberculosis
TPFTAPPQ

SEQ ID NO: 23269 - protein, 8 aa, Mycobacterium tuberculosis
PFTAPPQT

SEQ ID NO: 23270 - protein, 8 aa, Mycobacterium tuberculosis
FTAPPQTT

SEQ ID NO: 23271 - protein, 8 aa, Mycobacterium tuberculosis
TAPPQTTN

SEQ ID NO: 23272 - protein, 8 aa, Mycobacterium tuberculosis
APPQTTNP

SEQ ID NO: 23273 - protein, 8 aa, Mycobacterium tuberculosis
PPQTTNPS

SEQ ID NO: 23274 - protein, 8 aa, Mycobacterium tuberculosis
PQTTNPSG

SEQ ID NO: 23275 - protein, 8 aa, Mycobacterium tuberculosis
QTTNPSGL

SEQ ID NO: 23276 - protein, 8 aa, Mycobacterium tuberculosis
TTNPSGLA

SEQ ID NO: 23277 - protein, 8 aa, Mycobacterium tuberculosis
TNPSGLAG

SEQ ID NO: 23278 - protein, 8 aa, Mycobacterium tuberculosis
NPSGLAGQ

SEQ ID NO: 23279 - protein, 8 aa, Mycobacterium tuberculosis
PSGLAGQA

SEQ ID NO: 23280 - protein, 8 aa, Mycobacterium tuberculosis
SGLAGQAA

SEQ ID NO: 23281 - protein, 8 aa, Mycobacterium tuberculosis
GLAGQAAA

SEQ ID NO: 23282 - protein, 8 aa, Mycobacterium tuberculosis
LAGQAAAT

SEQ ID NO: 23283 - protein, 8 aa, Mycobacterium tuberculosis
AGQAAATG

SEQ ID NO: 23284 - protein, 8 aa, Mycobacterium tuberculosis
GQAAATGQ

SEQ ID NO: 23285 - protein, 8 aa, Mycobacterium tuberculosis
QAAATGQA

SEQ ID NO: 23286 - protein, 8 aa, Mycobacterium tuberculosis
AAATGQAT

SEQ ID NO: 23287 - protein, 8 aa, Mycobacterium tuberculosis
AATGQATA

SEQ ID NO: 23288 - protein, 8 aa, Mycobacterium tuberculosis
ATGQATAL

SEQ ID NO: 23289 - protein, 8 aa, Mycobacterium tuberculosis
TGQATALA

SEQ ID NO: 23290 - protein, 8 aa, Mycobacterium tuberculosis
GQATALAS

SEQ ID NO: 23291 - protein, 8 aa, Mycobacterium tuberculosis
QATALASG

SEQ ID NO: 23292 - protein, 8 aa, Mycobacterium tuberculosis
ATALASGT

SEQ ID NO: 23293 - protein, 8 aa, Mycobacterium tuberculosis
TALASGTN

SEQ ID NO: 23294 - protein, 8 aa, Mycobacterium tuberculosis
ALASGTNA

SEQ ID NO: 23295 - protein, 8 aa, Mycobacterium tuberculosis
LASGTNAV

SEQ ID NO: 23296 - protein, 8 aa, Mycobacterium tuberculosis
ASGTNAVT

SEQ ID NO: 23297 - protein, 8 aa, Mycobacterium tuberculosis
SGTNAVTT

SEQ ID NO: 23298 - protein, 8 aa, Mycobacterium tuberculosis
GTNAVTTA

SEQ ID NO: 23299 - protein, 8 aa, Mycobacterium tuberculosis
TNAVTTAL

SEQ ID NO: 23300 - protein, 8 aa, Mycobacterium tuberculosis
NAVTTALS

SEQ ID NO: 23301 - protein, 8 aa, Mycobacterium tuberculosis
AVTTALSS

SEQ ID NO: 23302 - protein, 8 aa, Mycobacterium tuberculosis
VTTALSSA

SEQ ID NO: 23303 - protein, 8 aa, Mycobacterium tuberculosis
TTALSSAA

SEQ ID NO: 23304 - protein, 8 aa, Mycobacterium tuberculosis
TALSSAAA

SEQ ID NO: 23305 - protein, 8 aa, Mycobacterium tuberculosis
ALSSAAAQ

SEQ ID NO: 23306 - protein, 8 aa, Mycobacterium tuberculosis
LSSAAAQF

SEQ ID NO: 23307 - protein, 8 aa, Mycobacterium tuberculosis
SSAAAQFP

SEQ ID NO: 23308 - protein, 8 aa, Mycobacterium tuberculosis
SAAAQFPF

SEQ ID NO: 23309 - protein, 8 aa, Mycobacterium tuberculosis
AAAQFPFD

SEQ ID NO: 23310 - protein, 8 aa, Mycobacterium tuberculosis
AAQFPFDI

SEQ ID NO: 23311 - protein, 8 aa, Mycobacterium tuberculosis
AQFPFDII

SEQ ID NO: 23312 - protein, 8 aa, Mycobacterium tuberculosis
QFPFDIIP

SEQ ID NO: 23313 - protein, 8 aa, Mycobacterium tuberculosis
FPFDIIPT

SEQ ID NO: 23314 - protein, 8 aa, Mycobacterium tuberculosis
PFDIIPTL

SEQ ID NO: 23315 - protein, 8 aa, Mycobacterium tuberculosis
FDIIPTLL

SEQ ID NO: 23316 - protein, 8 aa, Mycobacterium tuberculosis
DIIPTLLQ

SEQ ID NO: 23317 - protein, 8 aa, Mycobacterium tuberculosis
IIPTLLQG

SEQ ID NO: 23318 - protein, 8 aa, Mycobacterium tuberculosis
IPTLLQGL

SEQ ID NO: 23319 - protein, 8 aa, Mycobacterium tuberculosis
PTLLQGLA

SEQ ID NO: 23320 - protein, 8 aa, Mycobacterium tuberculosis
TLLQGLAT

SEQ ID NO: 23321 - protein, 8 aa, Mycobacterium tuberculosis
LLQGLATL

SEQ ID NO: 23322 - protein, 8 aa, Mycobacterium tuberculosis
LQGLATLS

SEQ ID NO: 23323 - protein, 8 aa, Mycobacterium tuberculosis
QGLATLST

SEQ ID NO: 23324 - protein, 8 aa, Mycobacterium tuberculosis
GLATLSTQ

SEQ ID NO: 23325 - protein, 8 aa, Mycobacterium tuberculosis
LATLSTQY

SEQ ID NO: 23326 - protein, 8 aa, Mycobacterium tuberculosis
ATLSTQYT

SEQ ID NO: 23327 - protein, 8 aa, Mycobacterium tuberculosis
TLSTQYTQ

SEQ ID NO: 23328 - protein, 8 aa, Mycobacterium tuberculosis
LSTQYTQL

SEQ ID NO: 23329 - protein, 8 aa, Mycobacterium tuberculosis
STQYTQLM

SEQ ID NO: 23330 - protein, 8 aa, Mycobacterium tuberculosis
TQYTQLMG

SEQ ID NO: 23331 - protein, 8 aa, Mycobacterium tuberculosis
QYTQLMGQ

SEQ ID NO: 23332 - protein, 8 aa, Mycobacterium tuberculosis
YTQLMGQL

SEQ ID NO: 23333 - protein, 8 aa, Mycobacterium tuberculosis
TQLMGQLI

SEQ ID NO: 23334 - protein, 8 aa, Mycobacterium tuberculosis
QLMGQLIN

SEQ ID NO: 23335 - protein, 8 aa, Mycobacterium tuberculosis
LMGQLINA

SEQ ID NO: 23336 - protein, 8 aa, Mycobacterium tuberculosis
MGQLINAI

SEQ ID NO: 23337 - protein, 8 aa, Mycobacterium tuberculosis
GQLINAIF

SEQ ID NO: 23338 - protein, 8 aa, Mycobacterium tuberculosis
QLINAIFG

SEQ ID NO: 23339 - protein, 8 aa, Mycobacterium tuberculosis
LINAIFGP

SEQ ID NO: 23340 - protein, 8 aa, Mycobacterium tuberculosis
INAIFGPT

SEQ ID NO: 23341 - protein, 8 aa, Mycobacterium tuberculosis
NAIFGPTG

SEQ ID NO: 23342 - protein, 8 aa, Mycobacterium tuberculosis
AIFGPTGA

SEQ ID NO: 23343 - protein, 8 aa, Mycobacterium tuberculosis
IFGPTGAT

SEQ ID NO: 23344 - protein, 8 aa, Mycobacterium tuberculosis
FGPTGATT

SEQ ID NO: 23345 - protein, 8 aa, Mycobacterium tuberculosis
GPTGATTY

SEQ ID NO: 23346 - protein, 8 aa, Mycobacterium tuberculosis
PTGATTYQ

SEQ ID NO: 23347 - protein, 8 aa, Mycobacterium tuberculosis
TGATTYQN

SEQ ID NO: 23348 - protein, 8 aa, Mycobacterium tuberculosis
GATTYQNV

SEQ ID NO: 23349 - protein, 8 aa, Mycobacterium tuberculosis
ATTYQNVF

SEQ ID NO: 23350 - protein, 8 aa, Mycobacterium tuberculosis
TTYQNVFV

SEQ ID NO: 23351 - protein, 8 aa, Mycobacterium tuberculosis
TYQNVFVT

SEQ ID NO: 23352 - protein, 8 aa, Mycobacterium tuberculosis
YQNVFVTA

SEQ ID NO: 23353 - protein, 8 aa, Mycobacterium tuberculosis
QNVFVTAA

SEQ ID NO: 23354 - protein, 8 aa, Mycobacterium tuberculosis
NVFVTAAN

SEQ ID NO: 23355 - protein, 8 aa, Mycobacterium tuberculosis
VFVTAANV

SEQ ID NO: 23356 - protein, 8 aa, Mycobacterium tuberculosis
FVTAANVT

SEQ ID NO: 23357 - protein, 8 aa, Mycobacterium tuberculosis
VTAANVTK

SEQ ID NO: 23358 - protein, 8 aa, Mycobacterium tuberculosis
TAANVTKF

SEQ ID NO: 23359 - protein, 8 aa, Mycobacterium tuberculosis
AANVTKFS

SEQ ID NO: 23360 - protein, 8 aa, Mycobacterium tuberculosis
ANVTKFST

SEQ ID NO: 23361 - protein, 8 aa, Mycobacterium tuberculosis
NVTKFSTW

SEQ ID NO: 23362 - protein, 8 aa, Mycobacterium tuberculosis
VTKFSTWA

SEQ ID NO: 23363 - protein, 8 aa, Mycobacterium tuberculosis
TKFSTWAN

SEQ ID NO: 23364 - protein, 8 aa, Mycobacterium tuberculosis
KFSTWAND

SEQ ID NO: 23365 - protein, 8 aa, Mycobacterium tuberculosis
FSTWANDA

SEQ ID NO: 23366 - protein, 8 aa, Mycobacterium tuberculosis
STWANDAM

SEQ ID NO: 23367 - protein, 8 aa, Mycobacterium tuberculosis
TWANDAMS

SEQ ID NO: 23368 - protein, 8 aa, Mycobacterium tuberculosis
WANDAMSA

SEQ ID NO: 23369 - protein, 8 aa, Mycobacterium tuberculosis
ANDAMSAP

SEQ ID NO: 23370 - protein, 8 aa, Mycobacterium tuberculosis
NDAMSAPN

SEQ ID NO: 23371 - protein, 8 aa, Mycobacterium tuberculosis
DAMSAPNL

SEQ ID NO: 23372 - protein, 8 aa, Mycobacterium tuberculosis
AMSAPNLG

SEQ ID NO: 23373 - protein, 8 aa, Mycobacterium tuberculosis
MSAPNLGM

SEQ ID NO: 23374 - protein, 8 aa, Mycobacterium tuberculosis
SAPNLGMT

SEQ ID NO: 23375 - protein, 8 aa, Mycobacterium tuberculosis
APNLGMTE

SEQ ID NO: 23376 - protein, 8 aa, Mycobacterium tuberculosis
PNLGMTEF

SEQ ID NO: 23377 - protein, 8 aa, Mycobacterium tuberculosis
NLGMTEFK

SEQ ID NO: 23378 - protein, 8 aa, Mycobacterium tuberculosis
LGMTEFKV

SEQ ID NO: 23379 - protein, 8 aa, Mycobacterium tuberculosis
GMTEFKVF

SEQ ID NO: 23380 - protein, 8 aa, Mycobacterium tuberculosis
MTEFKVFW

SEQ ID NO: 23381 - protein, 8 aa, Mycobacterium tuberculosis
TEFKVFWQ

SEQ ID NO: 23382 - protein, 8 aa, Mycobacterium tuberculosis
EFKVFWQP

SEQ ID NO: 23383 - protein, 8 aa, Mycobacterium tuberculosis
FKVFWQPP

SEQ ID NO: 23384 - protein, 8 aa, Mycobacterium tuberculosis
KVFWQPPP

SEQ ID NO: 23385 - protein, 8 aa, Mycobacterium tuberculosis
VFWQPPPA

SEQ ID NO: 23386 - protein, 8 aa, Mycobacterium tuberculosis
FWQPPPAP

SEQ ID NO: 23387 - protein, 8 aa, Mycobacterium tuberculosis
WQPPPAPE

SEQ ID NO: 23388 - protein, 8 aa, Mycobacterium tuberculosis
QPPPAPEI

SEQ ID NO: 23389 - protein, 8 aa, Mycobacterium tuberculosis
PPPAPEIP

SEQ ID NO: 23390 - protein, 8 aa, Mycobacterium tuberculosis
PPAPEIPK

SEQ ID NO: 23391 - protein, 8 aa, Mycobacterium tuberculosis
PAPEIPKS

SEQ ID NO: 23392 - protein, 8 aa, Mycobacterium tuberculosis
APEIPKSS

SEQ ID NO: 23393 - protein, 8 aa, Mycobacterium tuberculosis
PEIPKSSL

SEQ ID NO: 23394 - protein, 8 aa, Mycobacterium tuberculosis
EIPKSSLG

SEQ ID NO: 23395 - protein, 8 aa, Mycobacterium tuberculosis
IPKSSLGA

SEQ ID NO: 23396 - protein, 8 aa, Mycobacterium tuberculosis
PKSSLGAG

SEQ ID NO: 23397 - protein, 8 aa, Mycobacterium tuberculosis
KSSLGAGL

SEQ ID NO: 23398 - protein, 8 aa, Mycobacterium tuberculosis
SSLGAGLG

SEQ ID NO: 23399 - protein, 8 aa, Mycobacterium tuberculosis
SLGAGLGL

SEQ ID NO: 23400 - protein, 8 aa, Mycobacterium tuberculosis
LGAGLGLR

SEQ ID NO: 23401 - protein, 8 aa, Mycobacterium tuberculosis
GAGLGLRS

SEQ ID NO: 23402 - protein, 8 aa, Mycobacterium tuberculosis
AGLGLRSG

SEQ ID NO: 23403 - protein, 8 aa, Mycobacterium tuberculosis
GLGLRSGL

SEQ ID NO: 23404 - protein, 8 aa, Mycobacterium tuberculosis
LGLRSGLS

SEQ ID NO: 23405 - protein, 8 aa, Mycobacterium tuberculosis
GLRSGLSA

SEQ ID NO: 23406 - protein, 8 aa, Mycobacterium tuberculosis
LRSGLSAG

SEQ ID NO: 23407 - protein, 8 aa, Mycobacterium tuberculosis
RSGLSAGL

SEQ ID NO: 23408 - protein, 8 aa, Mycobacterium tuberculosis
SGLSAGLA

SEQ ID NO: 23409 - protein, 8 aa, Mycobacterium tuberculosis
GLSAGLAH

SEQ ID NO: 23410 - protein, 8 aa, Mycobacterium tuberculosis
LSAGLAHA

SEQ ID NO: 23411 - protein, 8 aa, Mycobacterium tuberculosis
SAGLAHAA

SEQ ID NO: 23412 - protein, 8 aa, Mycobacterium tuberculosis
AGLAHAAS

SEQ ID NO: 23413 - protein, 8 aa, Mycobacterium tuberculosis
GLAHAASA

SEQ ID NO: 23414 - protein, 8 aa, Mycobacterium tuberculosis
LAHAASAG

SEQ ID NO: 23415 - protein, 8 aa, Mycobacterium tuberculosis
AHAASAGL

SEQ ID NO: 23416 - protein, 8 aa, Mycobacterium tuberculosis
HAASAGLG

SEQ ID NO: 23417 - protein, 8 aa, Mycobacterium tuberculosis
AASAGLGQ

SEQ ID NO: 23418 - protein, 8 aa, Mycobacterium tuberculosis
ASAGLGQA

SEQ ID NO: 23419 - protein, 8 aa, Mycobacterium tuberculosis
SAGLGQAN

SEQ ID NO: 23420 - protein, 8 aa, Mycobacterium tuberculosis
AGLGQANL

SEQ ID NO: 23421 - protein, 8 aa, Mycobacterium tuberculosis
GLGQANLV

SEQ ID NO: 23422 - protein, 8 aa, Mycobacterium tuberculosis
LGQANLVG

SEQ ID NO: 23423 - protein, 8 aa, Mycobacterium tuberculosis
GQANLVGD

SEQ ID NO: 23424 - protein, 8 aa, Mycobacterium tuberculosis
QANLVGDL

SEQ ID NO: 23425 - protein, 8 aa, Mycobacterium tuberculosis
ANLVGDLS

SEQ ID NO: 23426 - protein, 8 aa, Mycobacterium tuberculosis
NLVGDLSV

SEQ ID NO: 23427 - protein, 8 aa, Mycobacterium tuberculosis
LVGDLSVP

SEQ ID NO: 23428 - protein, 8 aa, Mycobacterium tuberculosis
VGDLSVPP

SEQ ID NO: 23429 - protein, 8 aa, Mycobacterium tuberculosis
GDLSVPPS

SEQ ID NO: 23430 - protein, 8 aa, Mycobacterium tuberculosis
DLSVPPSW

SEQ ID NO: 23431 - protein, 8 aa, Mycobacterium tuberculosis
LSVPPSWA

SEQ ID NO: 23432 - protein, 8 aa, Mycobacterium tuberculosis
SVPPSWAS

SEQ ID NO: 23433 - protein, 8 aa, Mycobacterium tuberculosis
VPPSWASA

SEQ ID NO: 23434 - protein, 8 aa, Mycobacterium tuberculosis
PPSWASAT

SEQ ID NO: 23435 - protein, 8 aa, Mycobacterium tuberculosis
PSWASATP

SEQ ID NO: 23436 - protein, 8 aa, Mycobacterium tuberculosis
SWASATPA

SEQ ID NO: 23437 - protein, 8 aa, Mycobacterium tuberculosis
WASATPAV

SEQ ID NO: 23438 - protein, 8 aa, Mycobacterium tuberculosis
ASATPAVR

SEQ ID NO: 23439 - protein, 8 aa, Mycobacterium tuberculosis
SATPAVRL

SEQ ID NO: 23440 - protein, 8 aa, Mycobacterium tuberculosis
ATPAVRLV

SEQ ID NO: 23441 - protein, 8 aa, Mycobacterium tuberculosis
TPAVRLVA

SEQ ID NO: 23442 - protein, 8 aa, Mycobacterium tuberculosis
PAVRLVAN

SEQ ID NO: 23443 - protein, 8 aa, Mycobacterium tuberculosis
AVRLVANT

SEQ ID NO: 23444 - protein, 8 aa, Mycobacterium tuberculosis
VRLVANTL

SEQ ID NO: 23445 - protein, 8 aa, Mycobacterium tuberculosis
RLVANTLP

SEQ ID NO: 23446 - protein, 8 aa, Mycobacterium tuberculosis
LVANTLPA

SEQ ID NO: 23447 - protein, 8 aa, Mycobacterium tuberculosis
VANTLPAT

SEQ ID NO: 23448 - protein, 8 aa, Mycobacterium tuberculosis
ANTLPATS

SEQ ID NO: 23449 - protein, 8 aa, Mycobacterium tuberculosis
NTLPATSL

SEQ ID NO: 23450 - protein, 8 aa, Mycobacterium tuberculosis
TLPATSLA

SEQ ID NO: 23451 - protein, 8 aa, Mycobacterium tuberculosis
LPATSLAA

SEQ ID NO: 23452 - protein, 8 aa, Mycobacterium tuberculosis
PATSLAAA

SEQ ID NO: 23453 - protein, 8 aa, Mycobacterium tuberculosis
ATSLAAAP

SEQ ID NO: 23454 - protein, 8 aa, Mycobacterium tuberculosis
TSLAAAPA

SEQ ID NO: 23455 - protein, 8 aa, Mycobacterium tuberculosis
SLAAAPAT

SEQ ID NO: 23456 - protein, 8 aa, Mycobacterium tuberculosis
LAAAPATQ

SEQ ID NO: 23457 - protein, 8 aa, Mycobacterium tuberculosis
AAAPATQI

SEQ ID NO: 23458 - protein, 8 aa, Mycobacterium tuberculosis
AAPATQIP

SEQ ID NO: 23459 - protein, 8 aa, Mycobacterium tuberculosis
APATQIPA

SEQ ID NO: 23460 - protein, 8 aa, Mycobacterium tuberculosis
PATQIPAN

SEQ ID NO: 23461 - protein, 8 aa, Mycobacterium tuberculosis
ATQIPANL

SEQ ID NO: 23462 - protein, 8 aa, Mycobacterium tuberculosis
TQIPANLL

SEQ ID NO: 23463 - protein, 8 aa, Mycobacterium tuberculosis
QIPANLLG

SEQ ID NO: 23464 - protein, 8 aa, Mycobacterium tuberculosis
IPANLLGQ

SEQ ID NO: 23465 - protein, 8 aa, Mycobacterium tuberculosis
PANLLGQM

SEQ ID NO: 23466 - protein, 8 aa, Mycobacterium tuberculosis
ANLLGQMA

SEQ ID NO: 23467 - protein, 8 aa, Mycobacterium tuberculosis
NLLGQMAL

SEQ ID NO: 23468 - protein, 8 aa, Mycobacterium tuberculosis
LLGQMALG

SEQ ID NO: 23469 - protein, 8 aa, Mycobacterium tuberculosis
LGQMALGS

SEQ ID NO: 23470 - protein, 8 aa, Mycobacterium tuberculosis
GQMALGSM

SEQ ID NO: 23471 - protein, 8 aa, Mycobacterium tuberculosis
QMALGSMT

SEQ ID NO: 23472 - protein, 8 aa, Mycobacterium tuberculosis
MALGSMTG

SEQ ID NO: 23473 - protein, 8 aa, Mycobacterium tuberculosis
ALGSMTGG

SEQ ID NO: 23474 - protein, 8 aa, Mycobacterium tuberculosis
LGSMTGGA

SEQ ID NO: 23475 - protein, 8 aa, Mycobacterium tuberculosis
GSMTGGAL

SEQ ID NO: 23476 - protein, 8 aa, Mycobacterium tuberculosis
SMTGGALG

SEQ ID NO: 23477 - protein, 8 aa, Mycobacterium tuberculosis
MTGGALGA

SEQ ID NO: 23478 - protein, 8 aa, Mycobacterium tuberculosis
TGGALGAA

SEQ ID NO: 23479 - protein, 8 aa, Mycobacterium tuberculosis
GGALGAAA

SEQ ID NO: 23480 - protein, 8 aa, Mycobacterium tuberculosis
GALGAAAP

SEQ ID NO: 23481 - protein, 8 aa, Mycobacterium tuberculosis
ALGAAAPA

SEQ ID NO: 23482 - protein, 8 aa, Mycobacterium tuberculosis
LGAAAPAI

SEQ ID NO: 23483 - protein, 8 aa, Mycobacterium tuberculosis
GAAAPAIY

SEQ ID NO: 23484 - protein, 8 aa, Mycobacterium tuberculosis
AAAPAIYT

SEQ ID NO: 23485 - protein, 8 aa, Mycobacterium tuberculosis
AAPAIYTG

SEQ ID NO: 23486 - protein, 8 aa, Mycobacterium tuberculosis
APAIYTGS

SEQ ID NO: 23487 - protein, 8 aa, Mycobacterium tuberculosis
PAIYTGSG

SEQ ID NO: 23488 - protein, 8 aa, Mycobacterium tuberculosis
AIYTGSGA

SEQ ID NO: 23489 - protein, 8 aa, Mycobacterium tuberculosis
IYTGSGAR

SEQ ID NO: 23490 - protein, 8 aa, Mycobacterium tuberculosis
YTGSGARA

SEQ ID NO: 23491 - protein, 8 aa, Mycobacterium tuberculosis
TGSGARAR

SEQ ID NO: 23492 - protein, 8 aa, Mycobacterium tuberculosis
GSGARARA

SEQ ID NO: 23493 - protein, 8 aa, Mycobacterium tuberculosis
SGARARAN

SEQ ID NO: 23494 - protein, 8 aa, Mycobacterium tuberculosis
GARARANG

SEQ ID NO: 23495 - protein, 8 aa, Mycobacterium tuberculosis
ARARANGG

SEQ ID NO: 23496 - protein, 8 aa, Mycobacterium tuberculosis
RARANGGT

SEQ ID NO: 23497 - protein, 8 aa, Mycobacterium tuberculosis
ARANGGTP

SEQ ID NO: 23498 - protein, 8 aa, Mycobacterium tuberculosis
RANGGTPS

SEQ ID NO: 23499 - protein, 8 aa, Mycobacterium tuberculosis
ANGGTPSA

SEQ ID NO: 23500 - protein, 8 aa, Mycobacterium tuberculosis
NGGTPSAE

SEQ ID NO: 23501 - protein, 8 aa, Mycobacterium tuberculosis
GGTPSAEP

SEQ ID NO: 23502 - protein, 8 aa, Mycobacterium tuberculosis
GTPSAEPV

SEQ ID NO: 23503 - protein, 8 aa, Mycobacterium tuberculosis
TPSAEPVK

SEQ ID NO: 23504 - protein, 8 aa, Mycobacterium tuberculosis
PSAEPVKL

SEQ ID NO: 23505 - protein, 8 aa, Mycobacterium tuberculosis
SAEPVKLE

SEQ ID NO: 23506 - protein, 8 aa, Mycobacterium tuberculosis
AEPVKLEA

SEQ ID NO: 23507 - protein, 8 aa, Mycobacterium tuberculosis
EPVKLEAV

SEQ ID NO: 23508 - protein, 8 aa, Mycobacterium tuberculosis
PVKLEAVI

SEQ ID NO: 23509 - protein, 8 aa, Mycobacterium tuberculosis
VKLEAVIA

SEQ ID NO: 23510 - protein, 8 aa, Mycobacterium tuberculosis
KLEAVIAQ

SEQ ID NO: 23511 - protein, 8 aa, Mycobacterium tuberculosis
LEAVIAQL

SEQ ID NO: 23512 - protein, 8 aa, Mycobacterium tuberculosis
EAVIAQLQ

SEQ ID NO: 23513 - protein, 8 aa, Mycobacterium tuberculosis
AVIAQLQK

SEQ ID NO: 23514 - protein, 8 aa, Mycobacterium tuberculosis
VIAQLQKQ

SEQ ID NO: 23515 - protein, 8 aa, Mycobacterium tuberculosis
IAQLQKQP

SEQ ID NO: 23516 - protein, 8 aa, Mycobacterium tuberculosis
AQLQKQPD

SEQ ID NO: 23517 - protein, 8 aa, Mycobacterium tuberculosis
QLQKQPDA

SEQ ID NO: 23518 - protein, 8 aa, Mycobacterium tuberculosis
LQKQPDAV

SEQ ID NO: 23519 - protein, 8 aa, Mycobacterium tuberculosis
QKQPDAVR

SEQ ID NO: 23520 - protein, 8 aa, Mycobacterium tuberculosis
KQPDAVRH

SEQ ID NO: 23521 - protein, 8 aa, Mycobacterium tuberculosis
QPDAVRHW

SEQ ID NO: 23522 - protein, 8 aa, Mycobacterium tuberculosis
PDAVRHWN

SEQ ID NO: 23523 - protein, 8 aa, Mycobacterium tuberculosis
DAVRHWNV

SEQ ID NO: 23524 - protein, 8 aa, Mycobacterium tuberculosis
AVRHWNVD

SEQ ID NO: 23525 - protein, 8 aa, Mycobacterium tuberculosis
VRHWNVDK

SEQ ID NO: 23526 - protein, 8 aa, Mycobacterium tuberculosis
RHWNVDKA

SEQ ID NO: 23527 - protein, 8 aa, Mycobacterium tuberculosis
HWNVDKAD

SEQ ID NO: 23528 - protein, 8 aa, Mycobacterium tuberculosis
WNVDKADL

SEQ ID NO: 23529 - protein, 8 aa, Mycobacterium tuberculosis
NVDKADLD

SEQ ID NO: 23530 - protein, 8 aa, Mycobacterium tuberculosis
VDKADLDG

SEQ ID NO: 23531 - protein, 8 aa, Mycobacterium tuberculosis
DKADLDGL

SEQ ID NO: 23532 - protein, 8 aa, Mycobacterium tuberculosis
KADLDGLL

SEQ ID NO: 23533 - protein, 8 aa, Mycobacterium tuberculosis
ADLDGLLD

SEQ ID NO: 23534 - protein, 8 aa, Mycobacterium tuberculosis
DLDGLLDR

SEQ ID NO: 23535 - protein, 8 aa, Mycobacterium tuberculosis
LDGLLDRL

SEQ ID NO: 23536 - protein, 8 aa, Mycobacterium tuberculosis
DGLLDRLS

SEQ ID NO: 23537 - protein, 8 aa, Mycobacterium tuberculosis
GLLDRLSK

SEQ ID NO: 23538 - protein, 8 aa, Mycobacterium tuberculosis
LLDRLSKQ

SEQ ID NO: 23539 - protein, 8 aa, Mycobacterium tuberculosis
LDRLSKQP

SEQ ID NO: 23540 - protein, 8 aa, Mycobacterium tuberculosis
DRLSKQPG

SEQ ID NO: 23541 - protein, 8 aa, Mycobacterium tuberculosis
RLSKQPGI

SEQ ID NO: 23542 - protein, 8 aa, Mycobacterium tuberculosis
LSKQPGIH

SEQ ID NO: 23543 - protein, 8 aa, Mycobacterium tuberculosis
SKQPGIHA

SEQ ID NO: 23544 - protein, 8 aa, Mycobacterium tuberculosis
KQPGIHAV

SEQ ID NO: 23545 - protein, 8 aa, Mycobacterium tuberculosis
QPGIHAVH

SEQ ID NO: 23546 - protein, 8 aa, Mycobacterium tuberculosis
PGIHAVHV

SEQ ID NO: 23547 - protein, 8 aa, Mycobacterium tuberculosis
GIHAVHVS

SEQ ID NO: 23548 - protein, 8 aa, Mycobacterium tuberculosis
IHAVHVSN

SEQ ID NO: 23549 - protein, 8 aa, Mycobacterium tuberculosis
HAVHVSNG

SEQ ID NO: 23550 - protein, 8 aa, Mycobacterium tuberculosis
AVHVSNGD

SEQ ID NO: 23551 - protein, 8 aa, Mycobacterium tuberculosis
VHVSNGDK

SEQ ID NO: 23552 - protein, 8 aa, Mycobacterium tuberculosis
HVSNGDKP

SEQ ID NO: 23553 - protein, 8 aa, Mycobacterium tuberculosis
VSNGDKPK

SEQ ID NO: 23554 - protein, 8 aa, Mycobacterium tuberculosis
SNGDKPKV

SEQ ID NO: 23555 - protein, 8 aa, Mycobacterium tuberculosis
NGDKPKVA

SEQ ID NO: 23556 - protein, 8 aa, Mycobacterium tuberculosis
GDKPKVAL

SEQ ID NO: 23557 - protein, 8 aa, Mycobacterium tuberculosis
DKPKVALP

SEQ ID NO: 23558 - protein, 8 aa, Mycobacterium tuberculosis
KPKVALPD

SEQ ID NO: 23559 - protein, 8 aa, Mycobacterium tuberculosis
PKVALPDT

SEQ ID NO: 23560 - protein, 8 aa, Mycobacterium tuberculosis
KVALPDTQ

SEQ ID NO: 23561 - protein, 8 aa, Mycobacterium tuberculosis
VALPDTQL

SEQ ID NO: 23562 - protein, 8 aa, Mycobacterium tuberculosis
ALPDTQLG

SEQ ID NO: 23563 - protein, 8 aa, Mycobacterium tuberculosis
LPDTQLGS

SEQ ID NO: 23564 - protein, 8 aa, Mycobacterium tuberculosis
PDTQLGSH

SEQ ID NO: 23565 - protein, 9 aa, Mycobacterium tuberculosis
MDFGLQPPE

SEQ ID NO: 23566 - protein, 9 aa, Mycobacterium tuberculosis
DFGLQPPEI

SEQ ID NO: 23567 - protein, 9 aa, Mycobacterium tuberculosis
FGLQPPEIT

SEQ ID NO: 23568 - protein, 9 aa, Mycobacterium tuberculosis
GLQPPEITS

SEQ ID NO: 23569 - protein, 9 aa, Mycobacterium tuberculosis
LQPPEITSG

SEQ ID NO: 23570 - protein, 9 aa, Mycobacterium tuberculosis
QPPEITSGE

SEQ ID NO: 23571 - protein, 9 aa, Mycobacterium tuberculosis
PPEITSGEM

SEQ ID NO: 23572 - protein, 9 aa, Mycobacterium tuberculosis
PEITSGEMY

SEQ ID NO: 23573 - protein, 9 aa, Mycobacterium tuberculosis
EITSGEMYL

SEQ ID NO: 23574 - protein, 9 aa, Mycobacterium tuberculosis
ITSGEMYLG

SEQ ID NO: 23575 - protein, 9 aa, Mycobacterium tuberculosis
TSGEMYLGP

SEQ ID NO: 23576 - protein, 9 aa, Mycobacterium tuberculosis
SGEMYLGPG

SEQ ID NO: 23577 - protein, 9 aa, Mycobacterium tuberculosis
GEMYLGPGA

SEQ ID NO: 23578 - protein, 9 aa, Mycobacterium tuberculosis
EMYLGPGAG

SEQ ID NO: 23579 - protein, 9 aa, Mycobacterium tuberculosis
MYLGPGAGP

SEQ ID NO: 23580 - protein, 9 aa, Mycobacterium tuberculosis
YLGPGAGPM

SEQ ID NO: 23581 - protein, 9 aa, Mycobacterium tuberculosis
LGPGAGPML

SEQ ID NO: 23582 - protein, 9 aa, Mycobacterium tuberculosis
GPGAGPMLA

SEQ ID NO: 23583 - protein, 9 aa, Mycobacterium tuberculosis
PGAGPMLAA

SEQ ID NO: 23584 - protein, 9 aa, Mycobacterium tuberculosis
GAGPMLAAA

SEQ ID NO: 23585 - protein, 9 aa, Mycobacterium tuberculosis
AGPMLAAAV

SEQ ID NO: 23586 - protein, 9 aa, Mycobacterium tuberculosis
GPMLAAAVA

SEQ ID NO: 23587 - protein, 9 aa, Mycobacterium tuberculosis
PMLAAAVAW

SEQ ID NO: 23588 - protein, 9 aa, Mycobacterium tuberculosis
MLAAAVAWD

SEQ ID NO: 23589 - protein, 9 aa, Mycobacterium tuberculosis
LAAAVAWDG

SEQ ID NO: 23590 - protein, 9 aa, Mycobacterium tuberculosis
AAAVAWDGL

SEQ ID NO: 23591 - protein, 9 aa, Mycobacterium tuberculosis
AAVAWDGLA

SEQ ID NO: 23592 - protein, 9 aa, Mycobacterium tuberculosis
AVAWDGLAA

SEQ ID NO: 23593 - protein, 9 aa, Mycobacterium tuberculosis
VAWDGLAAE

SEQ ID NO: 23594 - protein, 9 aa, Mycobacterium tuberculosis
AWDGLAAEL

SEQ ID NO: 23595 - protein, 9 aa, Mycobacterium tuberculosis
WDGLAAELQ

SEQ ID NO: 23596 - protein, 9 aa, Mycobacterium tuberculosis
DGLAAELQS

SEQ ID NO: 23597 - protein, 9 aa, Mycobacterium tuberculosis
GLAAELQSM

SEQ ID NO: 23598 - protein, 9 aa, Mycobacterium tuberculosis
LAAELQSMA

SEQ ID NO: 23599 - protein, 9 aa, Mycobacterium tuberculosis
AAELQSMAA

SEQ ID NO: 23600 - protein, 9 aa, Mycobacterium tuberculosis
AELQSMAAS

SEQ ID NO: 23601 - protein, 9 aa, Mycobacterium tuberculosis
ELQSMAASY

SEQ ID NO: 23602 - protein, 9 aa, Mycobacterium tuberculosis
LQSMAASYA

SEQ ID NO: 23603 - protein, 9 aa, Mycobacterium tuberculosis
QSMAASYAS

SEQ ID NO: 23604 - protein, 9 aa, Mycobacterium tuberculosis
SMAASYASI

SEQ ID NO: 23605 - protein, 9 aa, Mycobacterium tuberculosis
MAASYASIV

SEQ ID NO: 23606 - protein, 9 aa, Mycobacterium tuberculosis
AASYASIVE

SEQ ID NO: 23607 - protein, 9 aa, Mycobacterium tuberculosis
ASYASIVEG

SEQ ID NO: 23608 - protein, 9 aa, Mycobacterium tuberculosis
SYASIVEGM

SEQ ID NO: 23609 - protein, 9 aa, Mycobacterium tuberculosis
YASIVEGMA

SEQ ID NO: 23610 - protein, 9 aa, Mycobacterium tuberculosis
ASIVEGMAS

SEQ ID NO: 23611 - protein, 9 aa, Mycobacterium tuberculosis
SIVEGMASE

SEQ ID NO: 23612 - protein, 9 aa, Mycobacterium tuberculosis
IVEGMASES

SEQ ID NO: 23613 - protein, 9 aa, Mycobacterium tuberculosis
VEGMASESW

SEQ ID NO: 23614 - protein, 9 aa, Mycobacterium tuberculosis
EGMASESWL

SEQ ID NO: 23615 - protein, 9 aa, Mycobacterium tuberculosis
GMASESWLG

SEQ ID NO: 23616 - protein, 9 aa, Mycobacterium tuberculosis
MASESWLGP

SEQ ID NO: 23617 - protein, 9 aa, Mycobacterium tuberculosis
ASESWLGPS

SEQ ID NO: 23618 - protein, 9 aa, Mycobacterium tuberculosis
SESWLGPSS

SEQ ID NO: 23619 - protein, 9 aa, Mycobacterium tuberculosis
ESWLGPSSA

SEQ ID NO: 23620 - protein, 9 aa, Mycobacterium tuberculosis
SWLGPSSAG

SEQ ID NO: 23621 - protein, 9 aa, Mycobacterium tuberculosis
WLGPSSAGM

SEQ ID NO: 23622 - protein, 9 aa, Mycobacterium tuberculosis
LGPSSAGMA

SEQ ID NO: 23623 - protein, 9 aa, Mycobacterium tuberculosis
GPSSAGMAA

SEQ ID NO: 23624 - protein, 9 aa, Mycobacterium tuberculosis
PSSAGMAAA

SEQ ID NO: 23625 - protein, 9 aa, Mycobacterium tuberculosis
SSAGMAAAA

SEQ ID NO: 23626 - protein, 9 aa, Mycobacterium tuberculosis
SAGMAAAAA

SEQ ID NO: 23627 - protein, 9 aa, Mycobacterium tuberculosis
AGMAAAAAP

SEQ ID NO: 23628 - protein, 9 aa, Mycobacterium tuberculosis
GMAAAAAPY

SEQ ID NO: 23629 - protein, 9 aa, Mycobacterium tuberculosis
MAAAAAPYV

SEQ ID NO: 23630 - protein, 9 aa, Mycobacterium tuberculosis
AAAAAPYVT

SEQ ID NO: 23631 - protein, 9 aa, Mycobacterium tuberculosis
AAAAPYVTW

SEQ ID NO: 23632 - protein, 9 aa, Mycobacterium tuberculosis
AAAPYVTWM

SEQ ID NO: 23633 - protein, 9 aa, Mycobacterium tuberculosis
AAPYVTWMS

SEQ ID NO: 23634 - protein, 9 aa, Mycobacterium tuberculosis
APYVTWMSG

SEQ ID NO: 23635 - protein, 9 aa, Mycobacterium tuberculosis
PYVTWMSGT

SEQ ID NO: 23636 - protein, 9 aa, Mycobacterium tuberculosis
YVTWMSGTS

SEQ ID NO: 23637 - protein, 9 aa, Mycobacterium tuberculosis
VTWMSGTSA

SEQ ID NO: 23638 - protein, 9 aa, Mycobacterium tuberculosis
TWMSGTSAQ

SEQ ID NO: 23639 - protein, 9 aa, Mycobacterium tuberculosis
WMSGTSAQA

SEQ ID NO: 23640 - protein, 9 aa, Mycobacterium tuberculosis
MSGTSAQAK

SEQ ID NO: 23641 - protein, 9 aa, Mycobacterium tuberculosis
SGTSAQAKA

SEQ ID NO: 23642 - protein, 9 aa, Mycobacterium tuberculosis
GTSAQAKAA

SEQ ID NO: 23643 - protein, 9 aa, Mycobacterium tuberculosis
TSAQAKAAA

SEQ ID NO: 23644 - protein, 9 aa, Mycobacterium tuberculosis
SAQAKAAAD

SEQ ID NO: 23645 - protein, 9 aa, Mycobacterium tuberculosis
AQAKAAADQ

SEQ ID NO: 23646 - protein, 9 aa, Mycobacterium tuberculosis
QAKAAADQA

SEQ ID NO: 23647 - protein, 9 aa, Mycobacterium tuberculosis
AKAAADQAR

SEQ ID NO: 23648 - protein, 9 aa, Mycobacterium tuberculosis
KAAADQARA

SEQ ID NO: 23649 - protein, 9 aa, Mycobacterium tuberculosis
AAADQARAA

SEQ ID NO: 23650 - protein, 9 aa, Mycobacterium tuberculosis
AADQARAAV

SEQ ID NO: 23651 - protein, 9 aa, Mycobacterium tuberculosis
ADQARAAVV

SEQ ID NO: 23652 - protein, 9 aa, Mycobacterium tuberculosis
DQARAAVVA

SEQ ID NO: 23653 - protein, 9 aa, Mycobacterium tuberculosis
QARAAVVAY

SEQ ID NO: 23654 - protein, 9 aa, Mycobacterium tuberculosis
ARAAVVAYE

SEQ ID NO: 23655 - protein, 9 aa, Mycobacterium tuberculosis
RAAVVAYET

SEQ ID NO: 23656 - protein, 9 aa, Mycobacterium tuberculosis
AAVVAYETA

SEQ ID NO: 23657 - protein, 9 aa, Mycobacterium tuberculosis
AVVAYETAF

SEQ ID NO: 23658 - protein, 9 aa, Mycobacterium tuberculosis
VVAYETAFA

SEQ ID NO: 23659 - protein, 9 aa, Mycobacterium tuberculosis
VAYETAFAA

SEQ ID NO: 23660 - protein, 9 aa, Mycobacterium tuberculosis
AYETAFAAV

SEQ ID NO: 23661 - protein, 9 aa, Mycobacterium tuberculosis
YETAFAAVV

SEQ ID NO: 23662 - protein, 9 aa, Mycobacterium tuberculosis
ETAFAAVVP

SEQ ID NO: 23663 - protein, 9 aa, Mycobacterium tuberculosis
TAFAAVVPP

SEQ ID NO: 23664 - protein, 9 aa, Mycobacterium tuberculosis
AFAAVVPPP

SEQ ID NO: 23665 - protein, 9 aa, Mycobacterium tuberculosis
FAAVVPPPQ

SEQ ID NO: 23666 - protein, 9 aa, Mycobacterium tuberculosis
AAVVPPPQI

SEQ ID NO: 23667 - protein, 9 aa, Mycobacterium tuberculosis
AVVPPPQIA

SEQ ID NO: 23668 - protein, 9 aa, Mycobacterium tuberculosis
VVPPPQIAA

SEQ ID NO: 23669 - protein, 9 aa, Mycobacterium tuberculosis
VPPPQIAAN

SEQ ID NO: 23670 - protein, 9 aa, Mycobacterium tuberculosis
PPPQIAANR

SEQ ID NO: 23671 - protein, 9 aa, Mycobacterium tuberculosis
PPQIAANRS

SEQ ID NO: 23672 - protein, 9 aa, Mycobacterium tuberculosis
PQIAANRSQ

SEQ ID NO: 23673 - protein, 9 aa, Mycobacterium tuberculosis
QIAANRSQL

SEQ ID NO: 23674 - protein, 9 aa, Mycobacterium tuberculosis
IAANRSQLI

SEQ ID NO: 23675 - protein, 9 aa, Mycobacterium tuberculosis
AANRSQLIS

SEQ ID NO: 23676 - protein, 9 aa, Mycobacterium tuberculosis
ANRSQLISL

SEQ ID NO: 23677 - protein, 9 aa, Mycobacterium tuberculosis
NRSQLISLV

SEQ ID NO: 23678 - protein, 9 aa, Mycobacterium tuberculosis
RSQLISLVA

SEQ ID NO: 23679 - protein, 9 aa, Mycobacterium tuberculosis
SQLISLVAT

SEQ ID NO: 23680 - protein, 9 aa, Mycobacterium tuberculosis
QLISLVATN

SEQ ID NO: 23681 - protein, 9 aa, Mycobacterium tuberculosis
LISLVATNI

SEQ ID NO: 23682 - protein, 9 aa, Mycobacterium tuberculosis
ISLVATNIF

SEQ ID NO: 23683 - protein, 9 aa, Mycobacterium tuberculosis
SLVATNIFG

SEQ ID NO: 23684 - protein, 9 aa, Mycobacterium tuberculosis
LVATNIFGQ

SEQ ID NO: 23685 - protein, 9 aa, Mycobacterium tuberculosis
VATNIFGQN

SEQ ID NO: 23686 - protein, 9 aa, Mycobacterium tuberculosis
ATNIFGQNT

SEQ ID NO: 23687 - protein, 9 aa, Mycobacterium tuberculosis
TNIFGQNTA

SEQ ID NO: 23688 - protein, 9 aa, Mycobacterium tuberculosis
NIFGQNTAA

SEQ ID NO: 23689 - protein, 9 aa, Mycobacterium tuberculosis
IFGQNTAAI

SEQ ID NO: 23690 - protein, 9 aa, Mycobacterium tuberculosis
FGQNTAAIA

SEQ ID NO: 23691 - protein, 9 aa, Mycobacterium tuberculosis
GQNTAAIAA

SEQ ID NO: 23692 - protein, 9 aa, Mycobacterium tuberculosis
QNTAAIAAT

SEQ ID NO: 23693 - protein, 9 aa, Mycobacterium tuberculosis
NTAAIAATE

SEQ ID NO: 23694 - protein, 9 aa, Mycobacterium tuberculosis
TAAIAATEA

SEQ ID NO: 23695 - protein, 9 aa, Mycobacterium tuberculosis
AAIAATEAE

SEQ ID NO: 23696 - protein, 9 aa, Mycobacterium tuberculosis
AIAATEAEY

SEQ ID NO: 23697 - protein, 9 aa, Mycobacterium tuberculosis
IAATEAEYG

SEQ ID NO: 23698 - protein, 9 aa, Mycobacterium tuberculosis
AATEAEYGE

SEQ ID NO: 23699 - protein, 9 aa, Mycobacterium tuberculosis
ATEAEYGEM

SEQ ID NO: 23700 - protein, 9 aa, Mycobacterium tuberculosis
TEAEYGEMW

SEQ ID NO: 23701 - protein, 9 aa, Mycobacterium tuberculosis
EAEYGEMWA

SEQ ID NO: 23702 - protein, 9 aa, Mycobacterium tuberculosis
AEYGEMWAQ

SEQ ID NO: 23703 - protein, 9 aa, Mycobacterium tuberculosis
EYGEMWAQD

SEQ ID NO: 23704 - protein, 9 aa, Mycobacterium tuberculosis
YGEMWAQDT

SEQ ID NO: 23705 - protein, 9 aa, Mycobacterium tuberculosis
GEMWAQDTM

SEQ ID NO: 23706 - protein, 9 aa, Mycobacterium tuberculosis
EMWAQDTMA

SEQ ID NO: 23707 - protein, 9 aa, Mycobacterium tuberculosis
MWAQDTMAM

SEQ ID NO: 23708 - protein, 9 aa, Mycobacterium tuberculosis
WAQDTMAMF

SEQ ID NO: 23709 - protein, 9 aa, Mycobacterium tuberculosis
AQDTMAMFG

SEQ ID NO: 23710 - protein, 9 aa, Mycobacterium tuberculosis
QDTMAMFGY

SEQ ID NO: 23711 - protein, 9 aa, Mycobacterium tuberculosis
DTMAMFGYA

SEQ ID NO: 23712 - protein, 9 aa, Mycobacterium tuberculosis
TMAMFGYAS

SEQ ID NO: 23713 - protein, 9 aa, Mycobacterium tuberculosis
MAMFGYASS

SEQ ID NO: 23714 - protein, 9 aa, Mycobacterium tuberculosis
AMFGYASSS

SEQ ID NO: 23715 - protein, 9 aa, Mycobacterium tuberculosis
MFGYASSSA

SEQ ID NO: 23716 - protein, 9 aa, Mycobacterium tuberculosis
FGYASSSAT

SEQ ID NO: 23717 - protein, 9 aa, Mycobacterium tuberculosis
GYASSSATA

SEQ ID NO: 23718 - protein, 9 aa, Mycobacterium tuberculosis
YASSSATAS

SEQ ID NO: 23719 - protein, 9 aa, Mycobacterium tuberculosis
ASSSATASR

SEQ ID NO: 23720 - protein, 9 aa, Mycobacterium tuberculosis
SSSATASRL

SEQ ID NO: 23721 - protein, 9 aa, Mycobacterium tuberculosis
SSATASRLT

SEQ ID NO: 23722 - protein, 9 aa, Mycobacterium tuberculosis
SATASRLTP

SEQ ID NO: 23723 - protein, 9 aa, Mycobacterium tuberculosis
ATASRLTPF

SEQ ID NO: 23724 - protein, 9 aa, Mycobacterium tuberculosis
TASRLTPFT

SEQ ID NO: 23725 - protein, 9 aa, Mycobacterium tuberculosis
ASRLTPFTA

SEQ ID NO: 23726 - protein, 9 aa, Mycobacterium tuberculosis
SRLTPFTAP

SEQ ID NO: 23727 - protein, 9 aa, Mycobacterium tuberculosis
RLTPFTAPP

SEQ ID NO: 23728 - protein, 9 aa, Mycobacterium tuberculosis
LTPFTAPPQ

SEQ ID NO: 23729 - protein, 9 aa, Mycobacterium tuberculosis
TPFTAPPQT

SEQ ID NO: 23730 - protein, 9 aa, Mycobacterium tuberculosis
PFTAPPQTT

SEQ ID NO: 23731 - protein, 9 aa, Mycobacterium tuberculosis
FTAPPQTTN

SEQ ID NO: 23732 - protein, 9 aa, Mycobacterium tuberculosis
TAPPQTTNP

SEQ ID NO: 23733 - protein, 9 aa, Mycobacterium tuberculosis
APPQTTNPS

SEQ ID NO: 23734 - protein, 9 aa, Mycobacterium tuberculosis
PPQTTNPSG

SEQ ID NO: 23735 - protein, 9 aa, Mycobacterium tuberculosis
PQTTNPSGL

SEQ ID NO: 23736 - protein, 9 aa, Mycobacterium tuberculosis
QTTNPSGLA

SEQ ID NO: 23737 - protein, 9 aa, Mycobacterium tuberculosis
TTNPSGLAG

SEQ ID NO: 23738 - protein, 9 aa, Mycobacterium tuberculosis
TNPSGLAGQ

SEQ ID NO: 23739 - protein, 9 aa, Mycobacterium tuberculosis
NPSGLAGQA

SEQ ID NO: 23740 - protein, 9 aa, Mycobacterium tuberculosis
PSGLAGQAA

SEQ ID NO: 23741 - protein, 9 aa, Mycobacterium tuberculosis
SGLAGQAAA

SEQ ID NO: 23742 - protein, 9 aa, Mycobacterium tuberculosis
GLAGQAAAT

SEQ ID NO: 23743 - protein, 9 aa, Mycobacterium tuberculosis
LAGQAAATG

SEQ ID NO: 23744 - protein, 9 aa, Mycobacterium tuberculosis
AGQAAATGQ

SEQ ID NO: 23745 - protein, 9 aa, Mycobacterium tuberculosis
GQAAATGQA

SEQ ID NO: 23746 - protein, 9 aa, Mycobacterium tuberculosis
QAAATGQAT

SEQ ID NO: 23747 - protein, 9 aa, Mycobacterium tuberculosis
AAATGQATA

SEQ ID NO: 23748 - protein, 9 aa, Mycobacterium tuberculosis
AATGQATAL

SEQ ID NO: 23749 - protein, 9 aa, Mycobacterium tuberculosis
ATGQATALA

SEQ ID NO: 23750 - protein, 9 aa, Mycobacterium tuberculosis
TGQATALAS

SEQ ID NO: 23751 - protein, 9 aa, Mycobacterium tuberculosis
GQATALASG

SEQ ID NO: 23752 - protein, 9 aa, Mycobacterium tuberculosis
QATALASGT

SEQ ID NO: 23753 - protein, 9 aa, Mycobacterium tuberculosis
ATALASGTN

SEQ ID NO: 23754 - protein, 9 aa, Mycobacterium tuberculosis
TALASGTNA

SEQ ID NO: 23755 - protein, 9 aa, Mycobacterium tuberculosis
ALASGTNAV

SEQ ID NO: 23756 - protein, 9 aa, Mycobacterium tuberculosis
LASGTNAVT

SEQ ID NO: 23757 - protein, 9 aa, Mycobacterium tuberculosis
ASGTNAVTT

SEQ ID NO: 23758 - protein, 9 aa, Mycobacterium tuberculosis
SGTNAVTTA

SEQ ID NO: 23759 - protein, 9 aa, Mycobacterium tuberculosis
GTNAVTTAL

SEQ ID NO: 23760 - protein, 9 aa, Mycobacterium tuberculosis
TNAVTTALS

SEQ ID NO: 23761 - protein, 9 aa, Mycobacterium tuberculosis
NAVTTALSS

SEQ ID NO: 23762 - protein, 9 aa, Mycobacterium tuberculosis
AVTTALSSA

SEQ ID NO: 23763 - protein, 9 aa, Mycobacterium tuberculosis
VTTALSSAA

SEQ ID NO: 23764 - protein, 9 aa, Mycobacterium tuberculosis
TTALSSAAA

SEQ ID NO: 23765 - protein, 9 aa, Mycobacterium tuberculosis
TALSSAAAQ

SEQ ID NO: 23766 - protein, 9 aa, Mycobacterium tuberculosis
ALSSAAAQF

SEQ ID NO: 23767 - protein, 9 aa, Mycobacterium tuberculosis
LSSAAAQFP

SEQ ID NO: 23768 - protein, 9 aa, Mycobacterium tuberculosis
SSAAAQFPF

SEQ ID NO: 23769 - protein, 9 aa, Mycobacterium tuberculosis
SAAAQFPFD

SEQ ID NO: 23770 - protein, 9 aa, Mycobacterium tuberculosis
AAAQFPFDI

SEQ ID NO: 23771 - protein, 9 aa, Mycobacterium tuberculosis
AAQFPFDII

SEQ ID NO: 23772 - protein, 9 aa, Mycobacterium tuberculosis
AQFPFDIIP

SEQ ID NO: 23773 - protein, 9 aa, Mycobacterium tuberculosis
QFPFDIIPT

SEQ ID NO: 23774 - protein, 9 aa, Mycobacterium tuberculosis
FPFDIIPTL

SEQ ID NO: 23775 - protein, 9 aa, Mycobacterium tuberculosis
PFDIIPTLL

SEQ ID NO: 23776 - protein, 9 aa, Mycobacterium tuberculosis
FDIIPTLLQ

SEQ ID NO: 23777 - protein, 9 aa, Mycobacterium tuberculosis
DIIPTLLQG

SEQ ID NO: 23778 - protein, 9 aa, Mycobacterium tuberculosis
IIPTLLQGL

SEQ ID NO: 23779 - protein, 9 aa, Mycobacterium tuberculosis
IPTLLQGLA

SEQ ID NO: 23780 - protein, 9 aa, Mycobacterium tuberculosis
PTLLQGLAT

SEQ ID NO: 23781 - protein, 9 aa, Mycobacterium tuberculosis
TLLQGLATL

SEQ ID NO: 23782 - protein, 9 aa, Mycobacterium tuberculosis
LLQGLATLS

SEQ ID NO: 23783 - protein, 9 aa, Mycobacterium tuberculosis
LQGLATLST

SEQ ID NO: 23784 - protein, 9 aa, Mycobacterium tuberculosis
QGLATLSTQ

SEQ ID NO: 23785 - protein, 9 aa, Mycobacterium tuberculosis
GLATLSTQY

SEQ ID NO: 23786 - protein, 9 aa, Mycobacterium tuberculosis
LATLSTQYT

SEQ ID NO: 23787 - protein, 9 aa, Mycobacterium tuberculosis
ATLSTQYTQ

SEQ ID NO: 23788 - protein, 9 aa, Mycobacterium tuberculosis
TLSTQYTQL

SEQ ID NO: 23789 - protein, 9 aa, Mycobacterium tuberculosis
LSTQYTQLM

SEQ ID NO: 23790 - protein, 9 aa, Mycobacterium tuberculosis
STQYTQLMG

SEQ ID NO: 23791 - protein, 9 aa, Mycobacterium tuberculosis
TQYTQLMGQ

SEQ ID NO: 23792 - protein, 9 aa, Mycobacterium tuberculosis
QYTQLMGQL

SEQ ID NO: 23793 - protein, 9 aa, Mycobacterium tuberculosis
YTQLMGQLI

SEQ ID NO: 23794 - protein, 9 aa, Mycobacterium tuberculosis
TQLMGQLIN

SEQ ID NO: 23795 - protein, 9 aa, Mycobacterium tuberculosis
QLMGQLINA

SEQ ID NO: 23796 - protein, 9 aa, Mycobacterium tuberculosis
LMGQLINAI

SEQ ID NO: 23797 - protein, 9 aa, Mycobacterium tuberculosis
MGQLINAIF

SEQ ID NO: 23798 - protein, 9 aa, Mycobacterium tuberculosis
GQLINAIFG

SEQ ID NO: 23799 - protein, 9 aa, Mycobacterium tuberculosis
QLINAIFGP

SEQ ID NO: 23800 - protein, 9 aa, Mycobacterium tuberculosis
LINAIFGPT

SEQ ID NO: 23801 - protein, 9 aa, Mycobacterium tuberculosis
INAIFGPTG

SEQ ID NO: 23802 - protein, 9 aa, Mycobacterium tuberculosis
NAIFGPTGA

SEQ ID NO: 23803 - protein, 9 aa, Mycobacterium tuberculosis
AIFGPTGAT

SEQ ID NO: 23804 - protein, 9 aa, Mycobacterium tuberculosis
IFGPTGATT

SEQ ID NO: 23805 - protein, 9 aa, Mycobacterium tuberculosis
FGPTGATTY

SEQ ID NO: 23806 - protein, 9 aa, Mycobacterium tuberculosis
GPTGATTYQ

SEQ ID NO: 23807 - protein, 9 aa, Mycobacterium tuberculosis
PTGATTYQN

SEQ ID NO: 23808 - protein, 9 aa, Mycobacterium tuberculosis
TGATTYQNV

SEQ ID NO: 23809 - protein, 9 aa, Mycobacterium tuberculosis
GATTYQNVF

SEQ ID NO: 23810 - protein, 9 aa, Mycobacterium tuberculosis
ATTYQNVFV

SEQ ID NO: 23811 - protein, 9 aa, Mycobacterium tuberculosis
TTYQNVFVT

SEQ ID NO: 23812 - protein, 9 aa, Mycobacterium tuberculosis
TYQNVFVTA

SEQ ID NO: 23813 - protein, 9 aa, Mycobacterium tuberculosis
YQNVFVTAA

SEQ ID NO: 23814 - protein, 9 aa, Mycobacterium tuberculosis
QNVFVTAAN

SEQ ID NO: 23815 - protein, 9 aa, Mycobacterium tuberculosis
NVFVTAANV

SEQ ID NO: 23816 - protein, 9 aa, Mycobacterium tuberculosis
VFVTAANVT

SEQ ID NO: 23817 - protein, 9 aa, Mycobacterium tuberculosis
FVTAANVTK

SEQ ID NO: 23818 - protein, 9 aa, Mycobacterium tuberculosis
VTAANVTKF

SEQ ID NO: 23819 - protein, 9 aa, Mycobacterium tuberculosis
TAANVTKFS

SEQ ID NO: 23820 - protein, 9 aa, Mycobacterium tuberculosis
AANVTKFST

SEQ ID NO: 23821 - protein, 9 aa, Mycobacterium tuberculosis
ANVTKFSTW

SEQ ID NO: 23822 - protein, 9 aa, Mycobacterium tuberculosis
NVTKFSTWA

SEQ ID NO: 23823 - protein, 9 aa, Mycobacterium tuberculosis
VTKFSTWAN

SEQ ID NO: 23824 - protein, 9 aa, Mycobacterium tuberculosis
TKFSTWAND

SEQ ID NO: 23825 - protein, 9 aa, Mycobacterium tuberculosis
KFSTWANDA

SEQ ID NO: 23826 - protein, 9 aa, Mycobacterium tuberculosis
FSTWANDAM

SEQ ID NO: 23827 - protein, 9 aa, Mycobacterium tuberculosis
STWANDAMS

SEQ ID NO: 23828 - protein, 9 aa, Mycobacterium tuberculosis
TWANDAMSA

SEQ ID NO: 23829 - protein, 9 aa, Mycobacterium tuberculosis
WANDAMSAP

SEQ ID NO: 23830 - protein, 9 aa, Mycobacterium tuberculosis
ANDAMSAPN

SEQ ID NO: 23831 - protein, 9 aa, Mycobacterium tuberculosis
NDAMSAPNL

SEQ ID NO: 23832 - protein, 9 aa, Mycobacterium tuberculosis
DAMSAPNLG

SEQ ID NO: 23833 - protein, 9 aa, Mycobacterium tuberculosis
AMSAPNLGM

SEQ ID NO: 23834 - protein, 9 aa, Mycobacterium tuberculosis
MSAPNLGMT

SEQ ID NO: 23835 - protein, 9 aa, Mycobacterium tuberculosis
SAPNLGMTE

SEQ ID NO: 23836 - protein, 9 aa, Mycobacterium tuberculosis
APNLGMTEF

SEQ ID NO: 23837 - protein, 9 aa, Mycobacterium tuberculosis
PNLGMTEFK

SEQ ID NO: 23838 - protein, 9 aa, Mycobacterium tuberculosis
NLGMTEFKV

SEQ ID NO: 23839 - protein, 9 aa, Mycobacterium tuberculosis
LGMTEFKVF

SEQ ID NO: 23840 - protein, 9 aa, Mycobacterium tuberculosis
GMTEFKVFW

SEQ ID NO: 23841 - protein, 9 aa, Mycobacterium tuberculosis
MTEFKVFWQ

SEQ ID NO: 23842 - protein, 9 aa, Mycobacterium tuberculosis
TEFKVFWQP

SEQ ID NO: 23843 - protein, 9 aa, Mycobacterium tuberculosis
EFKVFWQPP

SEQ ID NO: 23844 - protein, 9 aa, Mycobacterium tuberculosis
FKVFWQPPP

SEQ ID NO: 23845 - protein, 9 aa, Mycobacterium tuberculosis
KVFWQPPPA

SEQ ID NO: 23846 - protein, 9 aa, Mycobacterium tuberculosis
VFWQPPPAP

SEQ ID NO: 23847 - protein, 9 aa, Mycobacterium tuberculosis
FWQPPPAPE

SEQ ID NO: 23848 - protein, 9 aa, Mycobacterium tuberculosis
WQPPPAPEI

SEQ ID NO: 23849 - protein, 9 aa, Mycobacterium tuberculosis
QPPPAPEIP

SEQ ID NO: 23850 - protein, 9 aa, Mycobacterium tuberculosis
PPPAPEIPK

SEQ ID NO: 23851 - protein, 9 aa, Mycobacterium tuberculosis
PPAPEIPKS

SEQ ID NO: 23852 - protein, 9 aa, Mycobacterium tuberculosis
PAPEIPKSS

SEQ ID NO: 23853 - protein, 9 aa, Mycobacterium tuberculosis
APEIPKSSL

SEQ ID NO: 23854 - protein, 9 aa, Mycobacterium tuberculosis
PEIPKSSLG

SEQ ID NO: 23855 - protein, 9 aa, Mycobacterium tuberculosis
EIPKSSLGA

SEQ ID NO: 23856 - protein, 9 aa, Mycobacterium tuberculosis
IPKSSLGAG

SEQ ID NO: 23857 - protein, 9 aa, Mycobacterium tuberculosis
PKSSLGAGL

SEQ ID NO: 23858 - protein, 9 aa, Mycobacterium tuberculosis
KSSLGAGLG

SEQ ID NO: 23859 - protein, 9 aa, Mycobacterium tuberculosis
SSLGAGLGL

SEQ ID NO: 23860 - protein, 9 aa, Mycobacterium tuberculosis
SLGAGLGLR

SEQ ID NO: 23861 - protein, 9 aa, Mycobacterium tuberculosis
LGAGLGLRS

SEQ ID NO: 23862 - protein, 9 aa, Mycobacterium tuberculosis
GAGLGLRSG

SEQ ID NO: 23863 - protein, 9 aa, Mycobacterium tuberculosis
AGLGLRSGL

SEQ ID NO: 23864 - protein, 9 aa, Mycobacterium tuberculosis
GLGLRSGLS

SEQ ID NO: 23865 - protein, 9 aa, Mycobacterium tuberculosis
LGLRSGLSA

SEQ ID NO: 23866 - protein, 9 aa, Mycobacterium tuberculosis
GLRSGLSAG

SEQ ID NO: 23867 - protein, 9 aa, Mycobacterium tuberculosis
LRSGLSAGL

SEQ ID NO: 23868 - protein, 9 aa, Mycobacterium tuberculosis
RSGLSAGLA

SEQ ID NO: 23869 - protein, 9 aa, Mycobacterium tuberculosis
SGLSAGLAH

SEQ ID NO: 23870 - protein, 9 aa, Mycobacterium tuberculosis
GLSAGLAHA

SEQ ID NO: 23871 - protein, 9 aa, Mycobacterium tuberculosis
LSAGLAHAA

SEQ ID NO: 23872 - protein, 9 aa, Mycobacterium tuberculosis
SAGLAHAAS

SEQ ID NO: 23873 - protein, 9 aa, Mycobacterium tuberculosis
AGLAHAASA

SEQ ID NO: 23874 - protein, 9 aa, Mycobacterium tuberculosis
GLAHAASAG

SEQ ID NO: 23875 - protein, 9 aa, Mycobacterium tuberculosis
LAHAASAGL

SEQ ID NO: 23876 - protein, 9 aa, Mycobacterium tuberculosis
AHAASAGLG

SEQ ID NO: 23877 - protein, 9 aa, Mycobacterium tuberculosis
HAASAGLGQ

SEQ ID NO: 23878 - protein, 9 aa, Mycobacterium tuberculosis
AASAGLGQA

SEQ ID NO: 23879 - protein, 9 aa, Mycobacterium tuberculosis
ASAGLGQAN

SEQ ID NO: 23880 - protein, 9 aa, Mycobacterium tuberculosis
SAGLGQANL

SEQ ID NO: 23881 - protein, 9 aa, Mycobacterium tuberculosis
AGLGQANLV

SEQ ID NO: 23882 - protein, 9 aa, Mycobacterium tuberculosis
GLGQANLVG

SEQ ID NO: 23883 - protein, 9 aa, Mycobacterium tuberculosis
LGQANLVGD

SEQ ID NO: 23884 - protein, 9 aa, Mycobacterium tuberculosis
GQANLVGDL

SEQ ID NO: 23885 - protein, 9 aa, Mycobacterium tuberculosis
QANLVGDLS

SEQ ID NO: 23886 - protein, 9 aa, Mycobacterium tuberculosis
ANLVGDLSV

SEQ ID NO: 23887 - protein, 9 aa, Mycobacterium tuberculosis
NLVGDLSVP

SEQ ID NO: 23888 - protein, 9 aa, Mycobacterium tuberculosis
LVGDLSVPP

SEQ ID NO: 23889 - protein, 9 aa, Mycobacterium tuberculosis
VGDLSVPPS

SEQ ID NO: 23890 - protein, 9 aa, Mycobacterium tuberculosis
GDLSVPPSW

SEQ ID NO: 23891 - protein, 9 aa, Mycobacterium tuberculosis
DLSVPPSWA

SEQ ID NO: 23892 - protein, 9 aa, Mycobacterium tuberculosis
LSVPPSWAS

SEQ ID NO: 23893 - protein, 9 aa, Mycobacterium tuberculosis
SVPPSWASA

SEQ ID NO: 23894 - protein, 9 aa, Mycobacterium tuberculosis
VPPSWASAT

SEQ ID NO: 23895 - protein, 9 aa, Mycobacterium tuberculosis
PPSWASATP

SEQ ID NO: 23896 - protein, 9 aa, Mycobacterium tuberculosis
PSWASATPA

SEQ ID NO: 23897 - protein, 9 aa, Mycobacterium tuberculosis
SWASATPAV

SEQ ID NO: 23898 - protein, 9 aa, Mycobacterium tuberculosis
WASATPAVR

SEQ ID NO: 23899 - protein, 9 aa, Mycobacterium tuberculosis
ASATPAVRL

SEQ ID NO: 23900 - protein, 9 aa, Mycobacterium tuberculosis
SATPAVRLV

SEQ ID NO: 23901 - protein, 9 aa, Mycobacterium tuberculosis
ATPAVRLVA

SEQ ID NO: 23902 - protein, 9 aa, Mycobacterium tuberculosis
TPAVRLVAN

SEQ ID NO: 23903 - protein, 9 aa, Mycobacterium tuberculosis
PAVRLVANT

SEQ ID NO: 23904 - protein, 9 aa, Mycobacterium tuberculosis
AVRLVANTL

SEQ ID NO: 23905 - protein, 9 aa, Mycobacterium tuberculosis
VRLVANTLP

SEQ ID NO: 23906 - protein, 9 aa, Mycobacterium tuberculosis
RLVANTLPA

SEQ ID NO: 23907 - protein, 9 aa, Mycobacterium tuberculosis
LVANTLPAT

SEQ ID NO: 23908 - protein, 9 aa, Mycobacterium tuberculosis
VANTLPATS

SEQ ID NO: 23909 - protein, 9 aa, Mycobacterium tuberculosis
ANTLPATSL

SEQ ID NO: 23910 - protein, 9 aa, Mycobacterium tuberculosis
NTLPATSLA

SEQ ID NO: 23911 - protein, 9 aa, Mycobacterium tuberculosis
TLPATSLAA

SEQ ID NO: 23912 - protein, 9 aa, Mycobacterium tuberculosis
LPATSLAAA

SEQ ID NO: 23913 - protein, 9 aa, Mycobacterium tuberculosis
PATSLAAAP

SEQ ID NO: 23914 - protein, 9 aa, Mycobacterium tuberculosis
ATSLAAAPA

SEQ ID NO: 23915 - protein, 9 aa, Mycobacterium tuberculosis
TSLAAAPAT

SEQ ID NO: 23916 - protein, 9 aa, Mycobacterium tuberculosis
SLAAAPATQ

SEQ ID NO: 23917 - protein, 9 aa, Mycobacterium tuberculosis
LAAAPATQI

SEQ ID NO: 23918 - protein, 9 aa, Mycobacterium tuberculosis
AAAPATQIP

SEQ ID NO: 23919 - protein, 9 aa, Mycobacterium tuberculosis
AAPATQIPA

SEQ ID NO: 23920 - protein, 9 aa, Mycobacterium tuberculosis
APATQIPAN

SEQ ID NO: 23921 - protein, 9 aa, Mycobacterium tuberculosis
PATQIPANL

SEQ ID NO: 23922 - protein, 9 aa, Mycobacterium tuberculosis
ATQIPANLL

SEQ ID NO: 23923 - protein, 9 aa, Mycobacterium tuberculosis
TQIPANLLG

SEQ ID NO: 23924 - protein, 9 aa, Mycobacterium tuberculosis
QIPANLLGQ

SEQ ID NO: 23925 - protein, 9 aa, Mycobacterium tuberculosis
IPANLLGQM

SEQ ID NO: 23926 - protein, 9 aa, Mycobacterium tuberculosis
PANLLGQMA

SEQ ID NO: 23927 - protein, 9 aa, Mycobacterium tuberculosis
ANLLGQMAL

SEQ ID NO: 23928 - protein, 9 aa, Mycobacterium tuberculosis
NLLGQMALG

SEQ ID NO: 23929 - protein, 9 aa, Mycobacterium tuberculosis
LLGQMALGS

SEQ ID NO: 23930 - protein, 9 aa, Mycobacterium tuberculosis
LGQMALGSM

SEQ ID NO: 23931 - protein, 9 aa, Mycobacterium tuberculosis
GQMALGSMT

SEQ ID NO: 23932 - protein, 9 aa, Mycobacterium tuberculosis
QMALGSMTG

SEQ ID NO: 23933 - protein, 9 aa, Mycobacterium tuberculosis
MALGSMTGG

SEQ ID NO: 23934 - protein, 9 aa, Mycobacterium tuberculosis
ALGSMTGGA

SEQ ID NO: 23935 - protein, 9 aa, Mycobacterium tuberculosis
LGSMTGGAL

SEQ ID NO: 23936 - protein, 9 aa, Mycobacterium tuberculosis
GSMTGGALG

SEQ ID NO: 23937 - protein, 9 aa, Mycobacterium tuberculosis
SMTGGALGA

SEQ ID NO: 23938 - protein, 9 aa, Mycobacterium tuberculosis
MTGGALGAA

SEQ ID NO: 23939 - protein, 9 aa, Mycobacterium tuberculosis
TGGALGAAA

SEQ ID NO: 23940 - protein, 9 aa, Mycobacterium tuberculosis
GGALGAAAP

SEQ ID NO: 23941 - protein, 9 aa, Mycobacterium tuberculosis
GALGAAAPA

SEQ ID NO: 23942 - protein, 9 aa, Mycobacterium tuberculosis
ALGAAAPAI

SEQ ID NO: 23943 - protein, 9 aa, Mycobacterium tuberculosis
LGAAAPAIY

SEQ ID NO: 23944 - protein, 9 aa, Mycobacterium tuberculosis
GAAAPAIYT

SEQ ID NO: 23945 - protein, 9 aa, Mycobacterium tuberculosis
AAAPAIYTG

SEQ ID NO: 23946 - protein, 9 aa, Mycobacterium tuberculosis
AAPAIYTGS

SEQ ID NO: 23947 - protein, 9 aa, Mycobacterium tuberculosis
APAIYTGSG

SEQ ID NO: 23948 - protein, 9 aa, Mycobacterium tuberculosis
PAIYTGSGA

SEQ ID NO: 23949 - protein, 9 aa, Mycobacterium tuberculosis
AIYTGSGAR

SEQ ID NO: 23950 - protein, 9 aa, Mycobacterium tuberculosis
IYTGSGARA

SEQ ID NO: 23951 - protein, 9 aa, Mycobacterium tuberculosis
YTGSGARAR

SEQ ID NO: 23952 - protein, 9 aa, Mycobacterium tuberculosis
TGSGARARA

SEQ ID NO: 23953 - protein, 9 aa, Mycobacterium tuberculosis
GSGARARAN

SEQ ID NO: 23954 - protein, 9 aa, Mycobacterium tuberculosis
SGARARANG

SEQ ID NO: 23955 - protein, 9 aa, Mycobacterium tuberculosis
GARARANGG

SEQ ID NO: 23956 - protein, 9 aa, Mycobacterium tuberculosis
ARARANGGT

SEQ ID NO: 23957 - protein, 9 aa, Mycobacterium tuberculosis
RARANGGTP

SEQ ID NO: 23958 - protein, 9 aa, Mycobacterium tuberculosis
ARANGGTPS

SEQ ID NO: 23959 - protein, 9 aa, Mycobacterium tuberculosis
RANGGTPSA

SEQ ID NO: 23960 - protein, 9 aa, Mycobacterium tuberculosis
ANGGTPSAE

SEQ ID NO: 23961 - protein, 9 aa, Mycobacterium tuberculosis
NGGTPSAEP

SEQ ID NO: 23962 - protein, 9 aa, Mycobacterium tuberculosis
GGTPSAEPV

SEQ ID NO: 23963 - protein, 9 aa, Mycobacterium tuberculosis
GTPSAEPVK

SEQ ID NO: 23964 - protein, 9 aa, Mycobacterium tuberculosis
TPSAEPVKL

SEQ ID NO: 23965 - protein, 9 aa, Mycobacterium tuberculosis
PSAEPVKLE

SEQ ID NO: 23966 - protein, 9 aa, Mycobacterium tuberculosis
SAEPVKLEA

SEQ ID NO: 23967 - protein, 9 aa, Mycobacterium tuberculosis
AEPVKLEAV

SEQ ID NO: 23968 - protein, 9 aa, Mycobacterium tuberculosis
EPVKLEAVI

SEQ ID NO: 23969 - protein, 9 aa, Mycobacterium tuberculosis
PVKLEAVIA

SEQ ID NO: 23970 - protein, 9 aa, Mycobacterium tuberculosis
VKLEAVIAQ

SEQ ID NO: 23971 - protein, 9 aa, Mycobacterium tuberculosis
KLEAVIAQL

SEQ ID NO: 23972 - protein, 9 aa, Mycobacterium tuberculosis
LEAVIAQLQ

SEQ ID NO: 23973 - protein, 9 aa, Mycobacterium tuberculosis
EAVIAQLQK

SEQ ID NO: 23974 - protein, 9 aa, Mycobacterium tuberculosis
AVIAQLQKQ

SEQ ID NO: 23975 - protein, 9 aa, Mycobacterium tuberculosis
VIAQLQKQP

SEQ ID NO: 23976 - protein, 9 aa, Mycobacterium tuberculosis
IAQLQKQPD

SEQ ID NO: 23977 - protein, 9 aa, Mycobacterium tuberculosis
AQLQKQPDA

SEQ ID NO: 23978 - protein, 9 aa, Mycobacterium tuberculosis
QLQKQPDAV

SEQ ID NO: 23979 - protein, 9 aa, Mycobacterium tuberculosis
LQKQPDAVR

SEQ ID NO: 23980 - protein, 9 aa, Mycobacterium tuberculosis
QKQPDAVRH

SEQ ID NO: 23981 - protein, 9 aa, Mycobacterium tuberculosis
KQPDAVRHW

SEQ ID NO: 23982 - protein, 9 aa, Mycobacterium tuberculosis
QPDAVRHWN

SEQ ID NO: 23983 - protein, 9 aa, Mycobacterium tuberculosis
PDAVRHWNV

SEQ ID NO: 23984 - protein, 9 aa, Mycobacterium tuberculosis
DAVRHWNVD

SEQ ID NO: 23985 - protein, 9 aa, Mycobacterium tuberculosis
AVRHWNVDK

SEQ ID NO: 23986 - protein, 9 aa, Mycobacterium tuberculosis
VRHWNVDKA

SEQ ID NO: 23987 - protein, 9 aa, Mycobacterium tuberculosis
RHWNVDKAD

SEQ ID NO: 23988 - protein, 9 aa, Mycobacterium tuberculosis
HWNVDKADL

SEQ ID NO: 23989 - protein, 9 aa, Mycobacterium tuberculosis
WNVDKADLD

SEQ ID NO: 23990 - protein, 9 aa, Mycobacterium tuberculosis
NVDKADLDG

SEQ ID NO: 23991 - protein, 9 aa, Mycobacterium tuberculosis
VDKADLDGL

SEQ ID NO: 23992 - protein, 9 aa, Mycobacterium tuberculosis
DKADLDGLL

SEQ ID NO: 23993 - protein, 9 aa, Mycobacterium tuberculosis
KADLDGLLD

SEQ ID NO: 23994 - protein, 9 aa, Mycobacterium tuberculosis
ADLDGLLDR

SEQ ID NO: 23995 - protein, 9 aa, Mycobacterium tuberculosis
DLDGLLDRL

SEQ ID NO: 23996 - protein, 9 aa, Mycobacterium tuberculosis
LDGLLDRLS

SEQ ID NO: 23997 - protein, 9 aa, Mycobacterium tuberculosis
DGLLDRLSK

SEQ ID NO: 23998 - protein, 9 aa, Mycobacterium tuberculosis
GLLDRLSKQ

SEQ ID NO: 23999 - protein, 9 aa, Mycobacterium tuberculosis
LLDRLSKQP

SEQ ID NO: 24000 - protein, 9 aa, Mycobacterium tuberculosis
LDRLSKQPG

SEQ ID NO: 24001 - protein, 9 aa, Mycobacterium tuberculosis
DRLSKQPGI

SEQ ID NO: 24002 - protein, 9 aa, Mycobacterium tuberculosis
RLSKQPGIH

SEQ ID NO: 24003 - protein, 9 aa, Mycobacterium tuberculosis
LSKQPGIHA

SEQ ID NO: 24004 - protein, 9 aa, Mycobacterium tuberculosis
SKQPGIHAV

SEQ ID NO: 24005 - protein, 9 aa, Mycobacterium tuberculosis
KQPGIHAVH

SEQ ID NO: 24006 - protein, 9 aa, Mycobacterium tuberculosis
QPGIHAVHV

SEQ ID NO: 24007 - protein, 9 aa, Mycobacterium tuberculosis
PGIHAVHVS

SEQ ID NO: 24008 - protein, 9 aa, Mycobacterium tuberculosis
GIHAVHVSN

SEQ ID NO: 24009 - protein, 9 aa, Mycobacterium tuberculosis
IHAVHVSNG

SEQ ID NO: 24010 - protein, 9 aa, Mycobacterium tuberculosis
HAVHVSNGD

SEQ ID NO: 24011 - protein, 9 aa, Mycobacterium tuberculosis
AVHVSNGDK

SEQ ID NO: 24012 - protein, 9 aa, Mycobacterium tuberculosis
VHVSNGDKP

SEQ ID NO: 24013 - protein, 9 aa, Mycobacterium tuberculosis
HVSNGDKPK

SEQ ID NO: 24014 - protein, 9 aa, Mycobacterium tuberculosis
VSNGDKPKV

SEQ ID NO: 24015 - protein, 9 aa, Mycobacterium tuberculosis
SNGDKPKVA

SEQ ID NO: 24016 - protein, 9 aa, Mycobacterium tuberculosis
NGDKPKVAL

SEQ ID NO: 24017 - protein, 9 aa, Mycobacterium tuberculosis
GDKPKVALP

SEQ ID NO: 24018 - protein, 9 aa, Mycobacterium tuberculosis
DKPKVALPD

SEQ ID NO: 24019 - protein, 9 aa, Mycobacterium tuberculosis
KPKVALPDT

SEQ ID NO: 24020 - protein, 9 aa, Mycobacterium tuberculosis
PKVALPDTQ

SEQ ID NO: 24021 - protein, 9 aa, Mycobacterium tuberculosis
KVALPDTQL

SEQ ID NO: 24022 - protein, 9 aa, Mycobacterium tuberculosis
VALPDTQLG

SEQ ID NO: 24023 - protein, 9 aa, Mycobacterium tuberculosis
ALPDTQLGS

SEQ ID NO: 24024 - protein, 9 aa, Mycobacterium tuberculosis
LPDTQLGSH

SEQ ID NO: 24025 - protein, 10 aa, Mycobacterium tuberculosis
MDFGLQPPEI

SEQ ID NO: 24026 - protein, 10 aa, Mycobacterium tuberculosis
DFGLQPPEIT

SEQ ID NO: 24027 - protein, 10 aa, Mycobacterium tuberculosis
FGLQPPEITS

SEQ ID NO: 24028 - protein, 10 aa, Mycobacterium tuberculosis
GLQPPEITSG

SEQ ID NO: 24029 - protein, 10 aa, Mycobacterium tuberculosis
LQPPEITSGE

SEQ ID NO: 24030 - protein, 10 aa, Mycobacterium tuberculosis
QPPEITSGEM

SEQ ID NO: 24031 - protein, 10 aa, Mycobacterium tuberculosis
PPEITSGEMY

SEQ ID NO: 24032 - protein, 10 aa, Mycobacterium tuberculosis
PEITSGEMYL

SEQ ID NO: 24033 - protein, 10 aa, Mycobacterium tuberculosis
EITSGEMYLG

SEQ ID NO: 24034 - protein, 10 aa, Mycobacterium tuberculosis
ITSGEMYLGP

SEQ ID NO: 24035 - protein, 10 aa, Mycobacterium tuberculosis
TSGEMYLGPG

SEQ ID NO: 24036 - protein, 10 aa, Mycobacterium tuberculosis
SGEMYLGPGA

SEQ ID NO: 24037 - protein, 10 aa, Mycobacterium tuberculosis
GEMYLGPGAG

SEQ ID NO: 24038 - protein, 10 aa, Mycobacterium tuberculosis
EMYLGPGAGP

SEQ ID NO: 24039 - protein, 10 aa, Mycobacterium tuberculosis
MYLGPGAGPM

SEQ ID NO: 24040 - protein, 10 aa, Mycobacterium tuberculosis
YLGPGAGPML

SEQ ID NO: 24041 - protein, 10 aa, Mycobacterium tuberculosis
LGPGAGPMLA

SEQ ID NO: 24042 - protein, 10 aa, Mycobacterium tuberculosis
GPGAGPMLAA

SEQ ID NO: 24043 - protein, 10 aa, Mycobacterium tuberculosis
PGAGPMLAAA

SEQ ID NO: 24044 - protein, 10 aa, Mycobacterium tuberculosis
GAGPMLAAAV

SEQ ID NO: 24045 - protein, 10 aa, Mycobacterium tuberculosis
AGPMLAAAVA

SEQ ID NO: 24046 - protein, 10 aa, Mycobacterium tuberculosis
GPMLAAAVAW

SEQ ID NO: 24047 - protein, 10 aa, Mycobacterium tuberculosis
PMLAAAVAWD

SEQ ID NO: 24048 - protein, 10 aa, Mycobacterium tuberculosis
MLAAAVAWDG

SEQ ID NO: 24049 - protein, 10 aa, Mycobacterium tuberculosis
LAAAVAWDGL

SEQ ID NO: 24050 - protein, 10 aa, Mycobacterium tuberculosis
AAAVAWDGLA

SEQ ID NO: 24051 - protein, 10 aa, Mycobacterium tuberculosis
AAVAWDGLAA

SEQ ID NO: 24052 - protein, 10 aa, Mycobacterium tuberculosis
AVAWDGLAAE

SEQ ID NO: 24053 - protein, 10 aa, Mycobacterium tuberculosis
VAWDGLAAEL

SEQ ID NO: 24054 - protein, 10 aa, Mycobacterium tuberculosis
AWDGLAAELQ

SEQ ID NO: 24055 - protein, 10 aa, Mycobacterium tuberculosis
WDGLAAELQS

SEQ ID NO: 24056 - protein, 10 aa, Mycobacterium tuberculosis
DGLAAELQSM

SEQ ID NO: 24057 - protein, 10 aa, Mycobacterium tuberculosis
GLAAELQSMA

SEQ ID NO: 24058 - protein, 10 aa, Mycobacterium tuberculosis
LAAELQSMAA

SEQ ID NO: 24059 - protein, 10 aa, Mycobacterium tuberculosis
AAELQSMAAS

SEQ ID NO: 24060 - protein, 10 aa, Mycobacterium tuberculosis
AELQSMAASY

SEQ ID NO: 24061 - protein, 10 aa, Mycobacterium tuberculosis
ELQSMAASYA

SEQ ID NO: 24062 - protein, 10 aa, Mycobacterium tuberculosis
LQSMAASYAS

SEQ ID NO: 24063 - protein, 10 aa, Mycobacterium tuberculosis
QSMAASYASI

SEQ ID NO: 24064 - protein, 10 aa, Mycobacterium tuberculosis
SMAASYASIV

SEQ ID NO: 24065 - protein, 10 aa, Mycobacterium tuberculosis
MAASYASIVE

SEQ ID NO: 24066 - protein, 10 aa, Mycobacterium tuberculosis
AASYASIVEG

SEQ ID NO: 24067 - protein, 10 aa, Mycobacterium tuberculosis
ASYASIVEGM

SEQ ID NO: 24068 - protein, 10 aa, Mycobacterium tuberculosis
SYASIVEGMA

SEQ ID NO: 24069 - protein, 10 aa, Mycobacterium tuberculosis
YASIVEGMAS

SEQ ID NO: 24070 - protein, 10 aa, Mycobacterium tuberculosis
ASIVEGMASE

SEQ ID NO: 24071 - protein, 10 aa, Mycobacterium tuberculosis
SIVEGMASES

SEQ ID NO: 24072 - protein, 10 aa, Mycobacterium tuberculosis
IVEGMASESW

SEQ ID NO: 24073 - protein, 10 aa, Mycobacterium tuberculosis
VEGMASESWL

SEQ ID NO: 24074 - protein, 10 aa, Mycobacterium tuberculosis
EGMASESWLG

SEQ ID NO: 24075 - protein, 10 aa, Mycobacterium tuberculosis
GMASESWLGP

SEQ ID NO: 24076 - protein, 10 aa, Mycobacterium tuberculosis
MASESWLGPS

SEQ ID NO: 24077 - protein, 10 aa, Mycobacterium tuberculosis
ASESWLGPSS

SEQ ID NO: 24078 - protein, 10 aa, Mycobacterium tuberculosis
SESWLGPSSA

SEQ ID NO: 24079 - protein, 10 aa, Mycobacterium tuberculosis
ESWLGPSSAG

SEQ ID NO: 24080 - protein, 10 aa, Mycobacterium tuberculosis
SWLGPSSAGM

SEQ ID NO: 24081 - protein, 10 aa, Mycobacterium tuberculosis
WLGPSSAGMA

SEQ ID NO: 24082 - protein, 10 aa, Mycobacterium tuberculosis
LGPSSAGMAA

SEQ ID NO: 24083 - protein, 10 aa, Mycobacterium tuberculosis
GPSSAGMAAA

SEQ ID NO: 24084 - protein, 10 aa, Mycobacterium tuberculosis
PSSAGMAAAA

SEQ ID NO: 24085 - protein, 10 aa, Mycobacterium tuberculosis
SSAGMAAAAA

SEQ ID NO: 24086 - protein, 10 aa, Mycobacterium tuberculosis
SAGMAAAAAP

SEQ ID NO: 24087 - protein, 10 aa, Mycobacterium tuberculosis
AGMAAAAAPY

SEQ ID NO: 24088 - protein, 10 aa, Mycobacterium tuberculosis
GMAAAAAPYV

SEQ ID NO: 24089 - protein, 10 aa, Mycobacterium tuberculosis
MAAAAAPYVT

SEQ ID NO: 24090 - protein, 10 aa, Mycobacterium tuberculosis
AAAAAPYVTW

SEQ ID NO: 24091 - protein, 10 aa, Mycobacterium tuberculosis
AAAAPYVTWM

SEQ ID NO: 24092 - protein, 10 aa, Mycobacterium tuberculosis
AAAPYVTWMS

SEQ ID NO: 24093 - protein, 10 aa, Mycobacterium tuberculosis
AAPYVTWMSG

SEQ ID NO: 24094 - protein, 10 aa, Mycobacterium tuberculosis
APYVTWMSGT

SEQ ID NO: 24095 - protein, 10 aa, Mycobacterium tuberculosis
PYVTWMSGTS

SEQ ID NO: 24096 - protein, 10 aa, Mycobacterium tuberculosis
YVTWMSGTSA

SEQ ID NO: 24097 - protein, 10 aa, Mycobacterium tuberculosis
VTWMSGTSAQ

SEQ ID NO: 24098 - protein, 10 aa, Mycobacterium tuberculosis
TWMSGTSAQA

SEQ ID NO: 24099 - protein, 10 aa, Mycobacterium tuberculosis
WMSGTSAQAK

SEQ ID NO: 24100 - protein, 10 aa, Mycobacterium tuberculosis
MSGTSAQAKA

SEQ ID NO: 24101 - protein, 10 aa, Mycobacterium tuberculosis
SGTSAQAKAA

SEQ ID NO: 24102 - protein, 10 aa, Mycobacterium tuberculosis
GTSAQAKAAA

SEQ ID NO: 24103 - protein, 10 aa, Mycobacterium tuberculosis
TSAQAKAAAD

SEQ ID NO: 24104 - protein, 10 aa, Mycobacterium tuberculosis
SAQAKAAADQ

SEQ ID NO: 24105 - protein, 10 aa, Mycobacterium tuberculosis
AQAKAAADQA

SEQ ID NO: 24106 - protein, 10 aa, Mycobacterium tuberculosis
QAKAAADQAR

SEQ ID NO: 24107 - protein, 10 aa, Mycobacterium tuberculosis
AKAAADQARA

SEQ ID NO: 24108 - protein, 10 aa, Mycobacterium tuberculosis
KAAADQARAA

SEQ ID NO: 24109 - protein, 10 aa, Mycobacterium tuberculosis
AAADQARAAV

SEQ ID NO: 24110 - protein, 10 aa, Mycobacterium tuberculosis
AADQARAAVV

SEQ ID NO: 24111 - protein, 10 aa, Mycobacterium tuberculosis
ADQARAAVVA

SEQ ID NO: 24112 - protein, 10 aa, Mycobacterium tuberculosis
DQARAAVVAY

SEQ ID NO: 24113 - protein, 10 aa, Mycobacterium tuberculosis
QARAAVVAYE

SEQ ID NO: 24114 - protein, 10 aa, Mycobacterium tuberculosis
ARAAVVAYET

SEQ ID NO: 24115 - protein, 10 aa, Mycobacterium tuberculosis
RAAVVAYETA

SEQ ID NO: 24116 - protein, 10 aa, Mycobacterium tuberculosis
AAVVAYETAF

SEQ ID NO: 24117 - protein, 10 aa, Mycobacterium tuberculosis
AVVAYETAFA

SEQ ID NO: 24118 - protein, 10 aa, Mycobacterium tuberculosis
VVAYETAFAA

SEQ ID NO: 24119 - protein, 10 aa, Mycobacterium tuberculosis
VAYETAFAAV

SEQ ID NO: 24120 - protein, 10 aa, Mycobacterium tuberculosis
AYETAFAAVV

SEQ ID NO: 24121 - protein, 10 aa, Mycobacterium tuberculosis
YETAFAAVVP

SEQ ID NO: 24122 - protein, 10 aa, Mycobacterium tuberculosis
ETAFAAVVPP

SEQ ID NO: 24123 - protein, 10 aa, Mycobacterium tuberculosis
TAFAAVVPPP

SEQ ID NO: 24124 - protein, 10 aa, Mycobacterium tuberculosis
AFAAVVPPPQ

SEQ ID NO: 24125 - protein, 10 aa, Mycobacterium tuberculosis
FAAVVPPPQI

SEQ ID NO: 24126 - protein, 10 aa, Mycobacterium tuberculosis
AAVVPPPQIA

SEQ ID NO: 24127 - protein, 10 aa, Mycobacterium tuberculosis
AVVPPPQIAA

SEQ ID NO: 24128 - protein, 10 aa, Mycobacterium tuberculosis
VVPPPQIAAN

SEQ ID NO: 24129 - protein, 10 aa, Mycobacterium tuberculosis
VPPPQIAANR

SEQ ID NO: 24130 - protein, 10 aa, Mycobacterium tuberculosis
PPPQIAANRS

SEQ ID NO: 24131 - protein, 10 aa, Mycobacterium tuberculosis
PPQIAANRSQ

SEQ ID NO: 24132 - protein, 10 aa, Mycobacterium tuberculosis
PQIAANRSQL

SEQ ID NO: 24133 - protein, 10 aa, Mycobacterium tuberculosis
QIAANRSQLI

SEQ ID NO: 24134 - protein, 10 aa, Mycobacterium tuberculosis
IAANRSQLIS

SEQ ID NO: 24135 - protein, 10 aa, Mycobacterium tuberculosis
AANRSQLISL

SEQ ID NO: 24136 - protein, 10 aa, Mycobacterium tuberculosis
ANRSQLISLV

SEQ ID NO: 24137 - protein, 10 aa, Mycobacterium tuberculosis
NRSQLISLVA

SEQ ID NO: 24138 - protein, 10 aa, Mycobacterium tuberculosis
RSQLISLVAT

SEQ ID NO: 24139 - protein, 10 aa, Mycobacterium tuberculosis
SQLISLVATN

SEQ ID NO: 24140 - protein, 10 aa, Mycobacterium tuberculosis
QLISLVATNI

SEQ ID NO: 24141 - protein, 10 aa, Mycobacterium tuberculosis
LISLVATNIF

SEQ ID NO: 24142 - protein, 10 aa, Mycobacterium tuberculosis
ISLVATNIFG

SEQ ID NO: 24143 - protein, 10 aa, Mycobacterium tuberculosis
SLVATNIFGQ

SEQ ID NO: 24144 - protein, 10 aa, Mycobacterium tuberculosis
LVATNIFGQN

SEQ ID NO: 24145 - protein, 10 aa, Mycobacterium tuberculosis
VATNIFGQNT

SEQ ID NO: 24146 - protein, 10 aa, Mycobacterium tuberculosis
ATNIFGQNTA

SEQ ID NO: 24147 - protein, 10 aa, Mycobacterium tuberculosis
TNIFGQNTAA

SEQ ID NO: 24148 - protein, 10 aa, Mycobacterium tuberculosis
NIFGQNTAAI

SEQ ID NO: 24149 - protein, 10 aa, Mycobacterium tuberculosis
IFGQNTAAIA

SEQ ID NO: 24150 - protein, 10 aa, Mycobacterium tuberculosis
FGQNTAAIAA

SEQ ID NO: 24151 - protein, 10 aa, Mycobacterium tuberculosis
GQNTAAIAAT

SEQ ID NO: 24152 - protein, 10 aa, Mycobacterium tuberculosis
QNTAAIAATE

SEQ ID NO: 24153 - protein, 10 aa, Mycobacterium tuberculosis
NTAAIAATEA

SEQ ID NO: 24154 - protein, 10 aa, Mycobacterium tuberculosis
TAAIAATEAE

SEQ ID NO: 24155 - protein, 10 aa, Mycobacterium tuberculosis
AAIAATEAEY

SEQ ID NO: 24156 - protein, 10 aa, Mycobacterium tuberculosis
AIAATEAEYG

SEQ ID NO: 24157 - protein, 10 aa, Mycobacterium tuberculosis
IAATEAEYGE

SEQ ID NO: 24158 - protein, 10 aa, Mycobacterium tuberculosis
AATEAEYGEM

SEQ ID NO: 24159 - protein, 10 aa, Mycobacterium tuberculosis
ATEAEYGEMW

SEQ ID NO: 24160 - protein, 10 aa, Mycobacterium tuberculosis
TEAEYGEMWA

SEQ ID NO: 24161 - protein, 10 aa, Mycobacterium tuberculosis
EAEYGEMWAQ

SEQ ID NO: 24162 - protein, 10 aa, Mycobacterium tuberculosis
AEYGEMWAQD

SEQ ID NO: 24163 - protein, 10 aa, Mycobacterium tuberculosis
EYGEMWAQDT

SEQ ID NO: 24164 - protein, 10 aa, Mycobacterium tuberculosis
YGEMWAQDTM

SEQ ID NO: 24165 - protein, 10 aa, Mycobacterium tuberculosis
GEMWAQDTMA

SEQ ID NO: 24166 - protein, 10 aa, Mycobacterium tuberculosis
EMWAQDTMAM

SEQ ID NO: 24167 - protein, 10 aa, Mycobacterium tuberculosis
MWAQDTMAMF

SEQ ID NO: 24168 - protein, 10 aa, Mycobacterium tuberculosis
WAQDTMAMFG

SEQ ID NO: 24169 - protein, 10 aa, Mycobacterium tuberculosis
AQDTMAMFGY

SEQ ID NO: 24170 - protein, 10 aa, Mycobacterium tuberculosis
QDTMAMFGYA

SEQ ID NO: 24171 - protein, 10 aa, Mycobacterium tuberculosis
DTMAMFGYAS

SEQ ID NO: 24172 - protein, 10 aa, Mycobacterium tuberculosis
TMAMFGYASS

SEQ ID NO: 24173 - protein, 10 aa, Mycobacterium tuberculosis
MAMFGYASSS

SEQ ID NO: 24174 - protein, 10 aa, Mycobacterium tuberculosis
AMFGYASSSA

SEQ ID NO: 24175 - protein, 10 aa, Mycobacterium tuberculosis
MFGYASSSAT

SEQ ID NO: 24176 - protein, 10 aa, Mycobacterium tuberculosis
FGYASSSATA

SEQ ID NO: 24177 - protein, 10 aa, Mycobacterium tuberculosis
GYASSSATAS

SEQ ID NO: 24178 - protein, 10 aa, Mycobacterium tuberculosis
YASSSATASR

SEQ ID NO: 24179 - protein, 10 aa, Mycobacterium tuberculosis
ASSSATASRL

SEQ ID NO: 24180 - protein, 10 aa, Mycobacterium tuberculosis
SSSATASRLT

SEQ ID NO: 24181 - protein, 10 aa, Mycobacterium tuberculosis
SSATASRLTP

SEQ ID NO: 24182 - protein, 10 aa, Mycobacterium tuberculosis
SATASRLTPF

SEQ ID NO: 24183 - protein, 10 aa, Mycobacterium tuberculosis
ATASRLTPFT

SEQ ID NO: 24184 - protein, 10 aa, Mycobacterium tuberculosis
TASRLTPFTA

SEQ ID NO: 24185 - protein, 10 aa, Mycobacterium tuberculosis
ASRLTPFTAP

SEQ ID NO: 24186 - protein, 10 aa, Mycobacterium tuberculosis
SRLTPFTAPP

SEQ ID NO: 24187 - protein, 10 aa, Mycobacterium tuberculosis
RLTPFTAPPQ

SEQ ID NO: 24188 - protein, 10 aa, Mycobacterium tuberculosis
LTPFTAPPQT

SEQ ID NO: 24189 - protein, 10 aa, Mycobacterium tuberculosis
TPFTAPPQTT

SEQ ID NO: 24190 - protein, 10 aa, Mycobacterium tuberculosis
PFTAPPQTTN

SEQ ID NO: 24191 - protein, 10 aa, Mycobacterium tuberculosis
FTAPPQTTNP

SEQ ID NO: 24192 - protein, 10 aa, Mycobacterium tuberculosis
TAPPQTTNPS

SEQ ID NO: 24193 - protein, 10 aa, Mycobacterium tuberculosis
APPQTTNPSG

SEQ ID NO: 24194 - protein, 10 aa, Mycobacterium tuberculosis
PPQTTNPSGL

SEQ ID NO: 24195 - protein, 10 aa, Mycobacterium tuberculosis
PQTTNPSGLA

SEQ ID NO: 24196 - protein, 10 aa, Mycobacterium tuberculosis
QTTNPSGLAG

SEQ ID NO: 24197 - protein, 10 aa, Mycobacterium tuberculosis
TTNPSGLAGQ

SEQ ID NO: 24198 - protein, 10 aa, Mycobacterium tuberculosis
TNPSGLAGQA

SEQ ID NO: 24199 - protein, 10 aa, Mycobacterium tuberculosis
NPSGLAGQAA

SEQ ID NO: 24200 - protein, 10 aa, Mycobacterium tuberculosis
PSGLAGQAAA

SEQ ID NO: 24201 - protein, 10 aa, Mycobacterium tuberculosis
SGLAGQAAAT

SEQ ID NO: 24202 - protein, 10 aa, Mycobacterium tuberculosis
GLAGQAAATG

SEQ ID NO: 24203 - protein, 10 aa, Mycobacterium tuberculosis
LAGQAAATGQ

SEQ ID NO: 24204 - protein, 10 aa, Mycobacterium tuberculosis
AGQAAATGQA

SEQ ID NO: 24205 - protein, 10 aa, Mycobacterium tuberculosis
GQAAATGQAT

SEQ ID NO: 24206 - protein, 10 aa, Mycobacterium tuberculosis
QAAATGQATA

SEQ ID NO: 24207 - protein, 10 aa, Mycobacterium tuberculosis
AAATGQATAL

SEQ ID NO: 24208 - protein, 10 aa, Mycobacterium tuberculosis
AATGQATALA

SEQ ID NO: 24209 - protein, 10 aa, Mycobacterium tuberculosis
ATGQATALAS

SEQ ID NO: 24210 - protein, 10 aa, Mycobacterium tuberculosis
TGQATALASG

SEQ ID NO: 24211 - protein, 10 aa, Mycobacterium tuberculosis
GQATALASGT

SEQ ID NO: 24212 - protein, 10 aa, Mycobacterium tuberculosis
QATALASGTN

SEQ ID NO: 24213 - protein, 10 aa, Mycobacterium tuberculosis
ATALASGTNA

SEQ ID NO: 24214 - protein, 10 aa, Mycobacterium tuberculosis
TALASGTNAV

SEQ ID NO: 24215 - protein, 10 aa, Mycobacterium tuberculosis
ALASGTNAVT

SEQ ID NO: 24216 - protein, 10 aa, Mycobacterium tuberculosis
LASGTNAVTT

SEQ ID NO: 24217 - protein, 10 aa, Mycobacterium tuberculosis
ASGTNAVTTA

SEQ ID NO: 24218 - protein, 10 aa, Mycobacterium tuberculosis
SGTNAVTTAL

SEQ ID NO: 24219 - protein, 10 aa, Mycobacterium tuberculosis
GTNAVTTALS

SEQ ID NO: 24220 - protein, 10 aa, Mycobacterium tuberculosis
TNAVTTALSS

SEQ ID NO: 24221 - protein, 10 aa, Mycobacterium tuberculosis
NAVTTALSSA

SEQ ID NO: 24222 - protein, 10 aa, Mycobacterium tuberculosis
AVTTALSSAA

SEQ ID NO: 24223 - protein, 10 aa, Mycobacterium tuberculosis
VTTALSSAAA

SEQ ID NO: 24224 - protein, 10 aa, Mycobacterium tuberculosis
TTALSSAAAQ

SEQ ID NO: 24225 - protein, 10 aa, Mycobacterium tuberculosis
TALSSAAAQF

SEQ ID NO: 24226 - protein, 10 aa, Mycobacterium tuberculosis
ALSSAAAQFP

SEQ ID NO: 24227 - protein, 10 aa, Mycobacterium tuberculosis
LSSAAAQFPF

SEQ ID NO: 24228 - protein, 10 aa, Mycobacterium tuberculosis
SSAAAQFPFD

SEQ ID NO: 24229 - protein, 10 aa, Mycobacterium tuberculosis
SAAAQFPFDI

SEQ ID NO: 24230 - protein, 10 aa, Mycobacterium tuberculosis
AAAQFPFDII

SEQ ID NO: 24231 - protein, 10 aa, Mycobacterium tuberculosis
AAQFPFDIIP

SEQ ID NO: 24232 - protein, 10 aa, Mycobacterium tuberculosis
AQFPFDIIPT

SEQ ID NO: 24233 - protein, 10 aa, Mycobacterium tuberculosis
QFPFDIIPTL

SEQ ID NO: 24234 - protein, 10 aa, Mycobacterium tuberculosis
FPFDIIPTLL

SEQ ID NO: 24235 - protein, 10 aa, Mycobacterium tuberculosis
PFDIIPTLLQ

SEQ ID NO: 24236 - protein, 10 aa, Mycobacterium tuberculosis
FDIIPTLLQG

SEQ ID NO: 24237 - protein, 10 aa, Mycobacterium tuberculosis
DIIPTLLQGL

SEQ ID NO: 24238 - protein, 10 aa, Mycobacterium tuberculosis
IIPTLLQGLA

SEQ ID NO: 24239 - protein, 10 aa, Mycobacterium tuberculosis
IPTLLQGLAT

SEQ ID NO: 24240 - protein, 10 aa, Mycobacterium tuberculosis
PTLLQGLATL

SEQ ID NO: 24241 - protein, 10 aa, Mycobacterium tuberculosis
TLLQGLATLS

SEQ ID NO: 24242 - protein, 10 aa, Mycobacterium tuberculosis
LLQGLATLST

SEQ ID NO: 24243 - protein, 10 aa, Mycobacterium tuberculosis
LQGLATLSTQ

SEQ ID NO: 24244 - protein, 10 aa, Mycobacterium tuberculosis
QGLATLSTQY

SEQ ID NO: 24245 - protein, 10 aa, Mycobacterium tuberculosis
GLATLSTQYT

SEQ ID NO: 24246 - protein, 10 aa, Mycobacterium tuberculosis
LATLSTQYTQ

SEQ ID NO: 24247 - protein, 10 aa, Mycobacterium tuberculosis
ATLSTQYTQL

SEQ ID NO: 24248 - protein, 10 aa, Mycobacterium tuberculosis
TLSTQYTQLM

SEQ ID NO: 24249 - protein, 10 aa, Mycobacterium tuberculosis
LSTQYTQLMG

SEQ ID NO: 24250 - protein, 10 aa, Mycobacterium tuberculosis
STQYTQLMGQ

SEQ ID NO: 24251 - protein, 10 aa, Mycobacterium tuberculosis
TQYTQLMGQL

SEQ ID NO: 24252 - protein, 10 aa, Mycobacterium tuberculosis
QYTQLMGQLI

SEQ ID NO: 24253 - protein, 10 aa, Mycobacterium tuberculosis
YTQLMGQLIN

SEQ ID NO: 24254 - protein, 10 aa, Mycobacterium tuberculosis
TQLMGQLINA

SEQ ID NO: 24255 - protein, 10 aa, Mycobacterium tuberculosis
QLMGQLINAI

SEQ ID NO: 24256 - protein, 10 aa, Mycobacterium tuberculosis
LMGQLINAIF

SEQ ID NO: 24257 - protein, 10 aa, Mycobacterium tuberculosis
MGQLINAIFG

SEQ ID NO: 24258 - protein, 10 aa, Mycobacterium tuberculosis
GQLINAIFGP

SEQ ID NO: 24259 - protein, 10 aa, Mycobacterium tuberculosis
QLINAIFGPT

SEQ ID NO: 24260 - protein, 10 aa, Mycobacterium tuberculosis
LINAIFGPTG

SEQ ID NO: 24261 - protein, 10 aa, Mycobacterium tuberculosis
INAIFGPTGA

SEQ ID NO: 24262 - protein, 10 aa, Mycobacterium tuberculosis
NAIFGPTGAT

SEQ ID NO: 24263 - protein, 10 aa, Mycobacterium tuberculosis
AIFGPTGATT

SEQ ID NO: 24264 - protein, 10 aa, Mycobacterium tuberculosis
IFGPTGATTY

SEQ ID NO: 24265 - protein, 10 aa, Mycobacterium tuberculosis
FGPTGATTYQ

SEQ ID NO: 24266 - protein, 10 aa, Mycobacterium tuberculosis
GPTGATTYQN

SEQ ID NO: 24267 - protein, 10 aa, Mycobacterium tuberculosis
PTGATTYQNV

SEQ ID NO: 24268 - protein, 10 aa, Mycobacterium tuberculosis
TGATTYQNVF

SEQ ID NO: 24269 - protein, 10 aa, Mycobacterium tuberculosis
GATTYQNVFV

SEQ ID NO: 24270 - protein, 10 aa, Mycobacterium tuberculosis
ATTYQNVFVT

SEQ ID NO: 24271 - protein, 10 aa, Mycobacterium tuberculosis
TTYQNVFVTA

SEQ ID NO: 24272 - protein, 10 aa, Mycobacterium tuberculosis
TYQNVFVTAA

SEQ ID NO: 24273 - protein, 10 aa, Mycobacterium tuberculosis
YQNVFVTAAN

SEQ ID NO: 24274 - protein, 10 aa, Mycobacterium tuberculosis
QNVFVTAANV

SEQ ID NO: 24275 - protein, 10 aa, Mycobacterium tuberculosis
NVFVTAANVT

SEQ ID NO: 24276 - protein, 10 aa, Mycobacterium tuberculosis
VFVTAANVTK

SEQ ID NO: 24277 - protein, 10 aa, Mycobacterium tuberculosis
FVTAANVTKF

SEQ ID NO: 24278 - protein, 10 aa, Mycobacterium tuberculosis
VTAANVTKFS

SEQ ID NO: 24279 - protein, 10 aa, Mycobacterium tuberculosis
TAANVTKFST

SEQ ID NO: 24280 - protein, 10 aa, Mycobacterium tuberculosis
AANVTKFSTW

SEQ ID NO: 24281 - protein, 10 aa, Mycobacterium tuberculosis
ANVTKFSTWA

SEQ ID NO: 24282 - protein, 10 aa, Mycobacterium tuberculosis
NVTKFSTWAN

SEQ ID NO: 24283 - protein, 10 aa, Mycobacterium tuberculosis
VTKFSTWAND

SEQ ID NO: 24284 - protein, 10 aa, Mycobacterium tuberculosis
TKFSTWANDA

SEQ ID NO: 24285 - protein, 10 aa, Mycobacterium tuberculosis
KFSTWANDAM

SEQ ID NO: 24286 - protein, 10 aa, Mycobacterium tuberculosis
FSTWANDAMS

SEQ ID NO: 24287 - protein, 10 aa, Mycobacterium tuberculosis
STWANDAMSA

SEQ ID NO: 24288 - protein, 10 aa, Mycobacterium tuberculosis
TWANDAMSAP

SEQ ID NO: 24289 - protein, 10 aa, Mycobacterium tuberculosis
WANDAMSAPN

SEQ ID NO: 24290 - protein, 10 aa, Mycobacterium tuberculosis
ANDAMSAPNL

SEQ ID NO: 24291 - protein, 10 aa, Mycobacterium tuberculosis
NDAMSAPNLG

SEQ ID NO: 24292 - protein, 10 aa, Mycobacterium tuberculosis
DAMSAPNLGM

SEQ ID NO: 24293 - protein, 10 aa, Mycobacterium tuberculosis
AMSAPNLGMT

SEQ ID NO: 24294 - protein, 10 aa, Mycobacterium tuberculosis
MSAPNLGMTE

SEQ ID NO: 24295 - protein, 10 aa, Mycobacterium tuberculosis
SAPNLGMTEF

SEQ ID NO: 24296 - protein, 10 aa, Mycobacterium tuberculosis
APNLGMTEFK

SEQ ID NO: 24297 - protein, 10 aa, Mycobacterium tuberculosis
PNLGMTEFKV

SEQ ID NO: 24298 - protein, 10 aa, Mycobacterium tuberculosis
NLGMTEFKVF

SEQ ID NO: 24299 - protein, 10 aa, Mycobacterium tuberculosis
LGMTEFKVFW

SEQ ID NO: 24300 - protein, 10 aa, Mycobacterium tuberculosis
GMTEFKVFWQ

SEQ ID NO: 24301 - protein, 10 aa, Mycobacterium tuberculosis
MTEFKVFWQP

SEQ ID NO: 24302 - protein, 10 aa, Mycobacterium tuberculosis
TEFKVFWQPP

SEQ ID NO: 24303 - protein, 10 aa, Mycobacterium tuberculosis
EFKVFWQPPP

SEQ ID NO: 24304 - protein, 10 aa, Mycobacterium tuberculosis
FKVFWQPPPA

SEQ ID NO: 24305 - protein, 10 aa, Mycobacterium tuberculosis
KVFWQPPPAP

SEQ ID NO: 24306 - protein, 10 aa, Mycobacterium tuberculosis
VFWQPPPAPE

SEQ ID NO: 24307 - protein, 10 aa, Mycobacterium tuberculosis
FWQPPPAPEI

SEQ ID NO: 24308 - protein, 10 aa, Mycobacterium tuberculosis
WQPPPAPEIP

SEQ ID NO: 24309 - protein, 10 aa, Mycobacterium tuberculosis
QPPPAPEIPK

SEQ ID NO: 24310 - protein, 10 aa, Mycobacterium tuberculosis
PPPAPEIPKS

SEQ ID NO: 24311 - protein, 10 aa, Mycobacterium tuberculosis
PPAPEIPKSS

SEQ ID NO: 24312 - protein, 10 aa, Mycobacterium tuberculosis
PAPEIPKSSL

SEQ ID NO: 24313 - protein, 10 aa, Mycobacterium tuberculosis
APEIPKSSLG

SEQ ID NO: 24314 - protein, 10 aa, Mycobacterium tuberculosis
PEIPKSSLGA

SEQ ID NO: 24315 - protein, 10 aa, Mycobacterium tuberculosis
EIPKSSLGAG

SEQ ID NO: 24316 - protein, 10 aa, Mycobacterium tuberculosis
IPKSSLGAGL

SEQ ID NO: 24317 - protein, 10 aa, Mycobacterium tuberculosis
PKSSLGAGLG

SEQ ID NO: 24318 - protein, 10 aa, Mycobacterium tuberculosis
KSSLGAGLGL

SEQ ID NO: 24319 - protein, 10 aa, Mycobacterium tuberculosis
SSLGAGLGLR

SEQ ID NO: 24320 - protein, 10 aa, Mycobacterium tuberculosis
SLGAGLGLRS

SEQ ID NO: 24321 - protein, 10 aa, Mycobacterium tuberculosis
LGAGLGLRSG

SEQ ID NO: 24322 - protein, 10 aa, Mycobacterium tuberculosis
GAGLGLRSGL

SEQ ID NO: 24323 - protein, 10 aa, Mycobacterium tuberculosis
AGLGLRSGLS

SEQ ID NO: 24324 - protein, 10 aa, Mycobacterium tuberculosis
GLGLRSGLSA

SEQ ID NO: 24325 - protein, 10 aa, Mycobacterium tuberculosis
LGLRSGLSAG

SEQ ID NO: 24326 - protein, 10 aa, Mycobacterium tuberculosis
GLRSGLSAGL

SEQ ID NO: 24327 - protein, 10 aa, Mycobacterium tuberculosis
LRSGLSAGLA

SEQ ID NO: 24328 - protein, 10 aa, Mycobacterium tuberculosis
RSGLSAGLAH

SEQ ID NO: 24329 - protein, 10 aa, Mycobacterium tuberculosis
SGLSAGLAHA

SEQ ID NO: 24330 - protein, 10 aa, Mycobacterium tuberculosis
GLSAGLAHAA

SEQ ID NO: 24331 - protein, 10 aa, Mycobacterium tuberculosis
LSAGLAHAAS

SEQ ID NO: 24332 - protein, 10 aa, Mycobacterium tuberculosis
SAGLAHAASA

SEQ ID NO: 24333 - protein, 10 aa, Mycobacterium tuberculosis
AGLAHAASAG

SEQ ID NO: 24334 - protein, 10 aa, Mycobacterium tuberculosis
GLAHAASAGL

SEQ ID NO: 24335 - protein, 10 aa, Mycobacterium tuberculosis
LAHAASAGLG

SEQ ID NO: 24336 - protein, 10 aa, Mycobacterium tuberculosis
AHAASAGLGQ

SEQ ID NO: 24337 - protein, 10 aa, Mycobacterium tuberculosis
HAASAGLGQA

SEQ ID NO: 24338 - protein, 10 aa, Mycobacterium tuberculosis
AASAGLGQAN

SEQ ID NO: 24339 - protein, 10 aa, Mycobacterium tuberculosis
ASAGLGQANL

SEQ ID NO: 24340 - protein, 10 aa, Mycobacterium tuberculosis
SAGLGQANLV

SEQ ID NO: 24341 - protein, 10 aa, Mycobacterium tuberculosis
AGLGQANLVG

SEQ ID NO: 24342 - protein, 10 aa, Mycobacterium tuberculosis
GLGQANLVGD

SEQ ID NO: 24343 - protein, 10 aa, Mycobacterium tuberculosis
LGQANLVGDL

SEQ ID NO: 24344 - protein, 10 aa, Mycobacterium tuberculosis
GQANLVGDLS

SEQ ID NO: 24345 - protein, 10 aa, Mycobacterium tuberculosis
QANLVGDLSV

SEQ ID NO: 24346 - protein, 10 aa, Mycobacterium tuberculosis
ANLVGDLSVP

SEQ ID NO: 24347 - protein, 10 aa, Mycobacterium tuberculosis
NLVGDLSVPP

SEQ ID NO: 24348 - protein, 10 aa, Mycobacterium tuberculosis
LVGDLSVPPS

SEQ ID NO: 24349 - protein, 10 aa, Mycobacterium tuberculosis
VGDLSVPPSW

SEQ ID NO: 24350 - protein, 10 aa, Mycobacterium tuberculosis
GDLSVPPSWA

SEQ ID NO: 24351 - protein, 10 aa, Mycobacterium tuberculosis
DLSVPPSWAS

SEQ ID NO: 24352 - protein, 10 aa, Mycobacterium tuberculosis
LSVPPSWASA

SEQ ID NO: 24353 - protein, 10 aa, Mycobacterium tuberculosis
SVPPSWASAT

SEQ ID NO: 24354 - protein, 10 aa, Mycobacterium tuberculosis
VPPSWASATP

SEQ ID NO: 24355 - protein, 10 aa, Mycobacterium tuberculosis
PPSWASATPA

SEQ ID NO: 24356 - protein, 10 aa, Mycobacterium tuberculosis
PSWASATPAV

SEQ ID NO: 24357 - protein, 10 aa, Mycobacterium tuberculosis
SWASATPAVR

SEQ ID NO: 24358 - protein, 10 aa, Mycobacterium tuberculosis
WASATPAVRL

SEQ ID NO: 24359 - protein, 10 aa, Mycobacterium tuberculosis
ASATPAVRLV

SEQ ID NO: 24360 - protein, 10 aa, Mycobacterium tuberculosis
SATPAVRLVA

SEQ ID NO: 24361 - protein, 10 aa, Mycobacterium tuberculosis
ATPAVRLVAN

SEQ ID NO: 24362 - protein, 10 aa, Mycobacterium tuberculosis
TPAVRLVANT

SEQ ID NO: 24363 - protein, 10 aa, Mycobacterium tuberculosis
PAVRLVANTL

SEQ ID NO: 24364 - protein, 10 aa, Mycobacterium tuberculosis
AVRLVANTLP

SEQ ID NO: 24365 - protein, 10 aa, Mycobacterium tuberculosis
VRLVANTLPA

SEQ ID NO: 24366 - protein, 10 aa, Mycobacterium tuberculosis
RLVANTLPAT

SEQ ID NO: 24367 - protein, 10 aa, Mycobacterium tuberculosis
LVANTLPATS

SEQ ID NO: 24368 - protein, 10 aa, Mycobacterium tuberculosis
VANTLPATSL

SEQ ID NO: 24369 - protein, 10 aa, Mycobacterium tuberculosis
ANTLPATSLA

SEQ ID NO: 24370 - protein, 10 aa, Mycobacterium tuberculosis
NTLPATSLAA

SEQ ID NO: 24371 - protein, 10 aa, Mycobacterium tuberculosis
TLPATSLAAA

SEQ ID NO: 24372 - protein, 10 aa, Mycobacterium tuberculosis
LPATSLAAAP

SEQ ID NO: 24373 - protein, 10 aa, Mycobacterium tuberculosis
PATSLAAAPA

SEQ ID NO: 24374 - protein, 10 aa, Mycobacterium tuberculosis
ATSLAAAPAT

SEQ ID NO: 24375 - protein, 10 aa, Mycobacterium tuberculosis
TSLAAAPATQ

SEQ ID NO: 24376 - protein, 10 aa, Mycobacterium tuberculosis
SLAAAPATQI

SEQ ID NO: 24377 - protein, 10 aa, Mycobacterium tuberculosis
LAAAPATQIP

SEQ ID NO: 24378 - protein, 10 aa, Mycobacterium tuberculosis
AAAPATQIPA

SEQ ID NO: 24379 - protein, 10 aa, Mycobacterium tuberculosis
AAPATQIPAN

SEQ ID NO: 24380 - protein, 10 aa, Mycobacterium tuberculosis
APATQIPANL

SEQ ID NO: 24381 - protein, 10 aa, Mycobacterium tuberculosis
PATQIPANLL

SEQ ID NO: 24382 - protein, 10 aa, Mycobacterium tuberculosis
ATQIPANLLG

SEQ ID NO: 24383 - protein, 10 aa, Mycobacterium tuberculosis
TQIPANLLGQ

SEQ ID NO: 24384 - protein, 10 aa, Mycobacterium tuberculosis
QIPANLLGQM

SEQ ID NO: 24385 - protein, 10 aa, Mycobacterium tuberculosis
IPANLLGQMA

SEQ ID NO: 24386 - protein, 10 aa, Mycobacterium tuberculosis
PANLLGQMAL

SEQ ID NO: 24387 - protein, 10 aa, Mycobacterium tuberculosis
ANLLGQMALG

SEQ ID NO: 24388 - protein, 10 aa, Mycobacterium tuberculosis
NLLGQMALGS

SEQ ID NO: 24389 - protein, 10 aa, Mycobacterium tuberculosis
LLGQMALGSM

SEQ ID NO: 24390 - protein, 10 aa, Mycobacterium tuberculosis
LGQMALGSMT

SEQ ID NO: 24391 - protein, 10 aa, Mycobacterium tuberculosis
GQMALGSMTG

SEQ ID NO: 24392 - protein, 10 aa, Mycobacterium tuberculosis
QMALGSMTGG

SEQ ID NO: 24393 - protein, 10 aa, Mycobacterium tuberculosis
MALGSMTGGA

SEQ ID NO: 24394 - protein, 10 aa, Mycobacterium tuberculosis
ALGSMTGGAL

SEQ ID NO: 24395 - protein, 10 aa, Mycobacterium tuberculosis
LGSMTGGALG

SEQ ID NO: 24396 - protein, 10 aa, Mycobacterium tuberculosis
GSMTGGALGA

SEQ ID NO: 24397 - protein, 10 aa, Mycobacterium tuberculosis
SMTGGALGAA

SEQ ID NO: 24398 - protein, 10 aa, Mycobacterium tuberculosis
MTGGALGAAA

SEQ ID NO: 24399 - protein, 10 aa, Mycobacterium tuberculosis
TGGALGAAAP

SEQ ID NO: 24400 - protein, 10 aa, Mycobacterium tuberculosis
GGALGAAAPA

SEQ ID NO: 24401 - protein, 10 aa, Mycobacterium tuberculosis
GALGAAAPAI

SEQ ID NO: 24402 - protein, 10 aa, Mycobacterium tuberculosis
ALGAAAPAIY

SEQ ID NO: 24403 - protein, 10 aa, Mycobacterium tuberculosis
LGAAAPAIYT

SEQ ID NO: 24404 - protein, 10 aa, Mycobacterium tuberculosis
GAAAPAIYTG

SEQ ID NO: 24405 - protein, 10 aa, Mycobacterium tuberculosis
AAAPAIYTGS

SEQ ID NO: 24406 - protein, 10 aa, Mycobacterium tuberculosis
AAPAIYTGSG

SEQ ID NO: 24407 - protein, 10 aa, Mycobacterium tuberculosis
APAIYTGSGA

SEQ ID NO: 24408 - protein, 10 aa, Mycobacterium tuberculosis
PAIYTGSGAR

SEQ ID NO: 24409 - protein, 10 aa, Mycobacterium tuberculosis
AIYTGSGARA

SEQ ID NO: 24410 - protein, 10 aa, Mycobacterium tuberculosis
IYTGSGARAR

SEQ ID NO: 24411 - protein, 10 aa, Mycobacterium tuberculosis
YTGSGARARA

SEQ ID NO: 24412 - protein, 10 aa, Mycobacterium tuberculosis
TGSGARARAN

SEQ ID NO: 24413 - protein, 10 aa, Mycobacterium tuberculosis
GSGARARANG

SEQ ID NO: 24414 - protein, 10 aa, Mycobacterium tuberculosis
SGARARANGG

SEQ ID NO: 24415 - protein, 10 aa, Mycobacterium tuberculosis
GARARANGGT

SEQ ID NO: 24416 - protein, 10 aa, Mycobacterium tuberculosis
ARARANGGTP

SEQ ID NO: 24417 - protein, 10 aa, Mycobacterium tuberculosis
RARANGGTPS

SEQ ID NO: 24418 - protein, 10 aa, Mycobacterium tuberculosis
ARANGGTPSA

SEQ ID NO: 24419 - protein, 10 aa, Mycobacterium tuberculosis
RANGGTPSAE

SEQ ID NO: 24420 - protein, 10 aa, Mycobacterium tuberculosis
ANGGTPSAEP

SEQ ID NO: 24421 - protein, 10 aa, Mycobacterium tuberculosis
NGGTPSAEPV

SEQ ID NO: 24422 - protein, 10 aa, Mycobacterium tuberculosis
GGTPSAEPVK

SEQ ID NO: 24423 - protein, 10 aa, Mycobacterium tuberculosis
GTPSAEPVKL

SEQ ID NO: 24424 - protein, 10 aa, Mycobacterium tuberculosis
TPSAEPVKLE

SEQ ID NO: 24425 - protein, 10 aa, Mycobacterium tuberculosis
PSAEPVKLEA

SEQ ID NO: 24426 - protein, 10 aa, Mycobacterium tuberculosis
SAEPVKLEAV

SEQ ID NO: 24427 - protein, 10 aa, Mycobacterium tuberculosis
AEPVKLEAVI

SEQ ID NO: 24428 - protein, 10 aa, Mycobacterium tuberculosis
EPVKLEAVIA

SEQ ID NO: 24429 - protein, 10 aa, Mycobacterium tuberculosis
PVKLEAVIAQ

SEQ ID NO: 24430 - protein, 10 aa, Mycobacterium tuberculosis
VKLEAVIAQL

SEQ ID NO: 24431 - protein, 10 aa, Mycobacterium tuberculosis
KLEAVIAQLQ

SEQ ID NO: 24432 - protein, 10 aa, Mycobacterium tuberculosis
LEAVIAQLQK

SEQ ID NO: 24433 - protein, 10 aa, Mycobacterium tuberculosis
EAVIAQLQKQ

SEQ ID NO: 24434 - protein, 10 aa, Mycobacterium tuberculosis
AVIAQLQKQP

SEQ ID NO: 24435 - protein, 10 aa, Mycobacterium tuberculosis
VIAQLQKQPD

SEQ ID NO: 24436 - protein, 10 aa, Mycobacterium tuberculosis
IAQLQKQPDA

SEQ ID NO: 24437 - protein, 10 aa, Mycobacterium tuberculosis
AQLQKQPDAV

SEQ ID NO: 24438 - protein, 10 aa, Mycobacterium tuberculosis
QLQKQPDAVR

SEQ ID NO: 24439 - protein, 10 aa, Mycobacterium tuberculosis
LQKQPDAVRH

SEQ ID NO: 24440 - protein, 10 aa, Mycobacterium tuberculosis
QKQPDAVRHW

SEQ ID NO: 24441 - protein, 10 aa, Mycobacterium tuberculosis
KQPDAVRHWN

SEQ ID NO: 24442 - protein, 10 aa, Mycobacterium tuberculosis
QPDAVRHWNV

SEQ ID NO: 24443 - protein, 10 aa, Mycobacterium tuberculosis
PDAVRHWNVD

SEQ ID NO: 24444 - protein, 10 aa, Mycobacterium tuberculosis
DAVRHWNVDK

SEQ ID NO: 24445 - protein, 10 aa, Mycobacterium tuberculosis
AVRHWNVDKA

SEQ ID NO: 24446 - protein, 10 aa, Mycobacterium tuberculosis
VRHWNVDKAD

SEQ ID NO: 24447 - protein, 10 aa, Mycobacterium tuberculosis
RHWNVDKADL

SEQ ID NO: 24448 - protein, 10 aa, Mycobacterium tuberculosis
HWNVDKADLD

SEQ ID NO: 24449 - protein, 10 aa, Mycobacterium tuberculosis
WNVDKADLDG

SEQ ID NO: 24450 - protein, 10 aa, Mycobacterium tuberculosis
NVDKADLDGL

SEQ ID NO: 24451 - protein, 10 aa, Mycobacterium tuberculosis
VDKADLDGLL

SEQ ID NO: 24452 - protein, 10 aa, Mycobacterium tuberculosis
DKADLDGLLD

SEQ ID NO: 24453 - protein, 10 aa, Mycobacterium tuberculosis
KADLDGLLDR

SEQ ID NO: 24454 - protein, 10 aa, Mycobacterium tuberculosis
ADLDGLLDRL

SEQ ID NO: 24455 - protein, 10 aa, Mycobacterium tuberculosis
DLDGLLDRLS

SEQ ID NO: 24456 - protein, 10 aa, Mycobacterium tuberculosis
LDGLLDRLSK

SEQ ID NO: 24457 - protein, 10 aa, Mycobacterium tuberculosis
DGLLDRLSKQ

SEQ ID NO: 24458 - protein, 10 aa, Mycobacterium tuberculosis
GLLDRLSKQP

SEQ ID NO: 24459 - protein, 10 aa, Mycobacterium tuberculosis
LLDRLSKQPG

SEQ ID NO: 24460 - protein, 10 aa, Mycobacterium tuberculosis
LDRLSKQPGI

SEQ ID NO: 24461 - protein, 10 aa, Mycobacterium tuberculosis
DRLSKQPGIH

SEQ ID NO: 24462 - protein, 10 aa, Mycobacterium tuberculosis
RLSKQPGIHA

SEQ ID NO: 24463 - protein, 10 aa, Mycobacterium tuberculosis
LSKQPGIHAV

SEQ ID NO: 24464 - protein, 10 aa, Mycobacterium tuberculosis
SKQPGIHAVH

SEQ ID NO: 24465 - protein, 10 aa, Mycobacterium tuberculosis
KQPGIHAVHV

SEQ ID NO: 24466 - protein, 10 aa, Mycobacterium tuberculosis
QPGIHAVHVS

SEQ ID NO: 24467 - protein, 10 aa, Mycobacterium tuberculosis
PGIHAVHVSN

SEQ ID NO: 24468 - protein, 10 aa, Mycobacterium tuberculosis
GIHAVHVSNG

SEQ ID NO: 24469 - protein, 10 aa, Mycobacterium tuberculosis
IHAVHVSNGD

SEQ ID NO: 24470 - protein, 10 aa, Mycobacterium tuberculosis
HAVHVSNGDK

SEQ ID NO: 24471 - protein, 10 aa, Mycobacterium tuberculosis
AVHVSNGDKP

SEQ ID NO: 24472 - protein, 10 aa, Mycobacterium tuberculosis
VHVSNGDKPK

SEQ ID NO: 24473 - protein, 10 aa, Mycobacterium tuberculosis
HVSNGDKPKV

SEQ ID NO: 24474 - protein, 10 aa, Mycobacterium tuberculosis
VSNGDKPKVA

SEQ ID NO: 24475 - protein, 10 aa, Mycobacterium tuberculosis
SNGDKPKVAL

SEQ ID NO: 24476 - protein, 10 aa, Mycobacterium tuberculosis
NGDKPKVALP

SEQ ID NO: 24477 - protein, 10 aa, Mycobacterium tuberculosis
GDKPKVALPD

SEQ ID NO: 24478 - protein, 10 aa, Mycobacterium tuberculosis
DKPKVALPDT

SEQ ID NO: 24479 - protein, 10 aa, Mycobacterium tuberculosis
KPKVALPDTQ

SEQ ID NO: 24480 - protein, 10 aa, Mycobacterium tuberculosis
PKVALPDTQL

SEQ ID NO: 24481 - protein, 10 aa, Mycobacterium tuberculosis
KVALPDTQLG

SEQ ID NO: 24482 - protein, 10 aa, Mycobacterium tuberculosis
VALPDTQLGS

SEQ ID NO: 24483 - protein, 10 aa, Mycobacterium tuberculosis
ALPDTQLGSH

SEQ ID NO: 24484 - protein, 11 aa, Mycobacterium tuberculosis
MDFGLQPPEIT

SEQ ID NO: 24485 - protein, 11 aa, Mycobacterium tuberculosis
DFGLQPPEITS

SEQ ID NO: 24486 - protein, 11 aa, Mycobacterium tuberculosis
FGLQPPEITSG

SEQ ID NO: 24487 - protein, 11 aa, Mycobacterium tuberculosis
GLQPPEITSGE

SEQ ID NO: 24488 - protein, 11 aa, Mycobacterium tuberculosis
LQPPEITSGEM

SEQ ID NO: 24489 - protein, 11 aa, Mycobacterium tuberculosis
QPPEITSGEMY

SEQ ID NO: 24490 - protein, 11 aa, Mycobacterium tuberculosis
PPEITSGEMYL

SEQ ID NO: 24491 - protein, 11 aa, Mycobacterium tuberculosis
PEITSGEMYLG

SEQ ID NO: 24492 - protein, 11 aa, Mycobacterium tuberculosis
EITSGEMYLGP

SEQ ID NO: 24493 - protein, 11 aa, Mycobacterium tuberculosis
ITSGEMYLGPG

SEQ ID NO: 24494 - protein, 11 aa, Mycobacterium tuberculosis
TSGEMYLGPGA

SEQ ID NO: 24495 - protein, 11 aa, Mycobacterium tuberculosis
SGEMYLGPGAG

SEQ ID NO: 24496 - protein, 11 aa, Mycobacterium tuberculosis
GEMYLGPGAGP

SEQ ID NO: 24497 - protein, 11 aa, Mycobacterium tuberculosis
EMYLGPGAGPM

SEQ ID NO: 24498 - protein, 11 aa, Mycobacterium tuberculosis
MYLGPGAGPML

SEQ ID NO: 24499 - protein, 11 aa, Mycobacterium tuberculosis
YLGPGAGPMLA

SEQ ID NO: 24500 - protein, 11 aa, Mycobacterium tuberculosis
LGPGAGPMLAA

SEQ ID NO: 24501 - protein, 11 aa, Mycobacterium tuberculosis
GPGAGPMLAAA

SEQ ID NO: 24502 - protein, 11 aa, Mycobacterium tuberculosis
PGAGPMLAAAV

SEQ ID NO: 24503 - protein, 11 aa, Mycobacterium tuberculosis
GAGPMLAAAVA

SEQ ID NO: 24504 - protein, 11 aa, Mycobacterium tuberculosis
AGPMLAAAVAW

SEQ ID NO: 24505 - protein, 11 aa, Mycobacterium tuberculosis
GPMLAAAVAWD

SEQ ID NO: 24506 - protein, 11 aa, Mycobacterium tuberculosis
PMLAAAVAWDG

SEQ ID NO: 24507 - protein, 11 aa, Mycobacterium tuberculosis
MLAAAVAWDGL

SEQ ID NO: 24508 - protein, 11 aa, Mycobacterium tuberculosis
LAAAVAWDGLA

SEQ ID NO: 24509 - protein, 11 aa, Mycobacterium tuberculosis
AAAVAWDGLAA

SEQ ID NO: 24510 - protein, 11 aa, Mycobacterium tuberculosis
AAVAWDGLAAE

SEQ ID NO: 24511 - protein, 11 aa, Mycobacterium tuberculosis
AVAWDGLAAEL

SEQ ID NO: 24512 - protein, 11 aa, Mycobacterium tuberculosis
VAWDGLAAELQ

SEQ ID NO: 24513 - protein, 11 aa, Mycobacterium tuberculosis
AWDGLAAELQS

SEQ ID NO: 24514 - protein, 11 aa, Mycobacterium tuberculosis
WDGLAAELQSM

SEQ ID NO: 24515 - protein, 11 aa, Mycobacterium tuberculosis
DGLAAELQSMA

SEQ ID NO: 24516 - protein, 11 aa, Mycobacterium tuberculosis
GLAAELQSMAA

SEQ ID NO: 24517 - protein, 11 aa, Mycobacterium tuberculosis
LAAELQSMAAS

SEQ ID NO: 24518 - protein, 11 aa, Mycobacterium tuberculosis
AAELQSMAASY

SEQ ID NO: 24519 - protein, 11 aa, Mycobacterium tuberculosis
AELQSMAASYA

SEQ ID NO: 24520 - protein, 11 aa, Mycobacterium tuberculosis
ELQSMAASYAS

SEQ ID NO: 24521 - protein, 11 aa, Mycobacterium tuberculosis
LQSMAASYASI

SEQ ID NO: 24522 - protein, 11 aa, Mycobacterium tuberculosis
QSMAASYASIV

SEQ ID NO: 24523 - protein, 11 aa, Mycobacterium tuberculosis
SMAASYASIVE

SEQ ID NO: 24524 - protein, 11 aa, Mycobacterium tuberculosis
MAASYASIVEG

SEQ ID NO: 24525 - protein, 11 aa, Mycobacterium tuberculosis
AASYASIVEGM

SEQ ID NO: 24526 - protein, 11 aa, Mycobacterium tuberculosis
ASYASIVEGMA

SEQ ID NO: 24527 - protein, 11 aa, Mycobacterium tuberculosis
SYASIVEGMAS

SEQ ID NO: 24528 - protein, 11 aa, Mycobacterium tuberculosis
YASIVEGMASE

SEQ ID NO: 24529 - protein, 11 aa, Mycobacterium tuberculosis
ASIVEGMASES

SEQ ID NO: 24530 - protein, 11 aa, Mycobacterium tuberculosis
SIVEGMASESW

SEQ ID NO: 24531 - protein, 11 aa, Mycobacterium tuberculosis
IVEGMASESWL

SEQ ID NO: 24532 - protein, 11 aa, Mycobacterium tuberculosis
VEGMASESWLG

SEQ ID NO: 24533 - protein, 11 aa, Mycobacterium tuberculosis
EGMASESWLGP

SEQ ID NO: 24534 - protein, 11 aa, Mycobacterium tuberculosis
GMASESWLGPS

SEQ ID NO: 24535 - protein, 11 aa, Mycobacterium tuberculosis
MASESWLGPSS

SEQ ID NO: 24536 - protein, 11 aa, Mycobacterium tuberculosis
ASESWLGPSSA

SEQ ID NO: 24537 - protein, 11 aa, Mycobacterium tuberculosis
SESWLGPSSAG

SEQ ID NO: 24538 - protein, 11 aa, Mycobacterium tuberculosis
ESWLGPSSAGM

SEQ ID NO: 24539 - protein, 11 aa, Mycobacterium tuberculosis
SWLGPSSAGMA

SEQ ID NO: 24540 - protein, 11 aa, Mycobacterium tuberculosis
WLGPSSAGMAA

SEQ ID NO: 24541 - protein, 11 aa, Mycobacterium tuberculosis
LGPSSAGMAAA

SEQ ID NO: 24542 - protein, 11 aa, Mycobacterium tuberculosis
GPSSAGMAAAA

SEQ ID NO: 24543 - protein, 11 aa, Mycobacterium tuberculosis
PSSAGMAAAAA

SEQ ID NO: 24544 - protein, 11 aa, Mycobacterium tuberculosis
SSAGMAAAAAP

SEQ ID NO: 24545 - protein, 11 aa, Mycobacterium tuberculosis
SAGMAAAAAPY

SEQ ID NO: 24546 - protein, 11 aa, Mycobacterium tuberculosis
AGMAAAAAPYV

SEQ ID NO: 24547 - protein, 11 aa, Mycobacterium tuberculosis
GMAAAAAPYVT

SEQ ID NO: 24548 - protein, 11 aa, Mycobacterium tuberculosis
MAAAAAPYVTW

SEQ ID NO: 24549 - protein, 11 aa, Mycobacterium tuberculosis
AAAAAPYVTWM

SEQ ID NO: 24550 - protein, 11 aa, Mycobacterium tuberculosis
AAAAPYVTWMS

SEQ ID NO: 24551 - protein, 11 aa, Mycobacterium tuberculosis
AAAPYVTWMSG

SEQ ID NO: 24552 - protein, 11 aa, Mycobacterium tuberculosis
AAPYVTWMSGT

SEQ ID NO: 24553 - protein, 11 aa, Mycobacterium tuberculosis
APYVTWMSGTS

SEQ ID NO: 24554 - protein, 11 aa, Mycobacterium tuberculosis
PYVTWMSGTSA

SEQ ID NO: 24555 - protein, 11 aa, Mycobacterium tuberculosis
YVTWMSGTSAQ

SEQ ID NO: 24556 - protein, 11 aa, Mycobacterium tuberculosis
VTWMSGTSAQA

SEQ ID NO: 24557 - protein, 11 aa, Mycobacterium tuberculosis
TWMSGTSAQAK

SEQ ID NO: 24558 - protein, 11 aa, Mycobacterium tuberculosis
WMSGTSAQAKA

SEQ ID NO: 24559 - protein, 11 aa, Mycobacterium tuberculosis
MSGTSAQAKAA

SEQ ID NO: 24560 - protein, 11 aa, Mycobacterium tuberculosis
SGTSAQAKAAA

SEQ ID NO: 24561 - protein, 11 aa, Mycobacterium tuberculosis
GTSAQAKAAAD

SEQ ID NO: 24562 - protein, 11 aa, Mycobacterium tuberculosis
TSAQAKAAADQ

SEQ ID NO: 24563 - protein, 11 aa, Mycobacterium tuberculosis
SAQAKAAADQA

SEQ ID NO: 24564 - protein, 11 aa, Mycobacterium tuberculosis
AQAKAAADQAR

SEQ ID NO: 24565 - protein, 11 aa, Mycobacterium tuberculosis
QAKAAADQARA

SEQ ID NO: 24566 - protein, 11 aa, Mycobacterium tuberculosis
AKAAADQARAA

SEQ ID NO: 24567 - protein, 11 aa, Mycobacterium tuberculosis
KAAADQARAAV

SEQ ID NO: 24568 - protein, 11 aa, Mycobacterium tuberculosis
AAADQARAAVV

SEQ ID NO: 24569 - protein, 11 aa, Mycobacterium tuberculosis
AADQARAAVVA

SEQ ID NO: 24570 - protein, 11 aa, Mycobacterium tuberculosis
ADQARAAVVAY

SEQ ID NO: 24571 - protein, 11 aa, Mycobacterium tuberculosis
DQARAAVVAYE

SEQ ID NO: 24572 - protein, 11 aa, Mycobacterium tuberculosis
QARAAVVAYET

SEQ ID NO: 24573 - protein, 11 aa, Mycobacterium tuberculosis
ARAAVVAYETA

SEQ ID NO: 24574 - protein, 11 aa, Mycobacterium tuberculosis
RAAVVAYETAF

SEQ ID NO: 24575 - protein, 11 aa, Mycobacterium tuberculosis
AAVVAYETAFA

SEQ ID NO: 24576 - protein, 11 aa, Mycobacterium tuberculosis
AVVAYETAFAA

SEQ ID NO: 24577 - protein, 11 aa, Mycobacterium tuberculosis
VVAYETAFAAV

SEQ ID NO: 24578 - protein, 11 aa, Mycobacterium tuberculosis
VAYETAFAAVV

SEQ ID NO: 24579 - protein, 11 aa, Mycobacterium tuberculosis
AYETAFAAVVP

SEQ ID NO: 24580 - protein, 11 aa, Mycobacterium tuberculosis
YETAFAAVVPP

SEQ ID NO: 24581 - protein, 11 aa, Mycobacterium tuberculosis
ETAFAAVVPPP

SEQ ID NO: 24582 - protein, 11 aa, Mycobacterium tuberculosis
TAFAAVVPPPQ

SEQ ID NO: 24583 - protein, 11 aa, Mycobacterium tuberculosis
AFAAVVPPPQI

SEQ ID NO: 24584 - protein, 11 aa, Mycobacterium tuberculosis
FAAVVPPPQIA

SEQ ID NO: 24585 - protein, 11 aa, Mycobacterium tuberculosis
AAVVPPPQIAA

SEQ ID NO: 24586 - protein, 11 aa, Mycobacterium tuberculosis
AVVPPPQIAAN

SEQ ID NO: 24587 - protein, 11 aa, Mycobacterium tuberculosis
VVPPPQIAANR

SEQ ID NO: 24588 - protein, 11 aa, Mycobacterium tuberculosis
VPPPQIAANRS

SEQ ID NO: 24589 - protein, 11 aa, Mycobacterium tuberculosis
PPPQIAANRSQ

SEQ ID NO: 24590 - protein, 11 aa, Mycobacterium tuberculosis
PPQIAANRSQL

SEQ ID NO: 24591 - protein, 11 aa, Mycobacterium tuberculosis
PQIAANRSQLI

SEQ ID NO: 24592 - protein, 11 aa, Mycobacterium tuberculosis
QIAANRSQLIS

SEQ ID NO: 24593 - protein, 11 aa, Mycobacterium tuberculosis
IAANRSQLISL

SEQ ID NO: 24594 - protein, 11 aa, Mycobacterium tuberculosis
AANRSQLISLV

SEQ ID NO: 24595 - protein, 11 aa, Mycobacterium tuberculosis
ANRSQLISLVA

SEQ ID NO: 24596 - protein, 11 aa, Mycobacterium tuberculosis
NRSQLISLVAT

SEQ ID NO: 24597 - protein, 11 aa, Mycobacterium tuberculosis
RSQLISLVATN

SEQ ID NO: 24598 - protein, 11 aa, Mycobacterium tuberculosis
SQLISLVATNI

SEQ ID NO: 24599 - protein, 11 aa, Mycobacterium tuberculosis
QLISLVATNIF

SEQ ID NO: 24600 - protein, 11 aa, Mycobacterium tuberculosis
LISLVATNIFG

SEQ ID NO: 24601 - protein, 11 aa, Mycobacterium tuberculosis
ISLVATNIFGQ

SEQ ID NO: 24602 - protein, 11 aa, Mycobacterium tuberculosis
SLVATNIFGQN

SEQ ID NO: 24603 - protein, 11 aa, Mycobacterium tuberculosis
LVATNIFGQNT

SEQ ID NO: 24604 - protein, 11 aa, Mycobacterium tuberculosis
VATNIFGQNTA

SEQ ID NO: 24605 - protein, 11 aa, Mycobacterium tuberculosis
ATNIFGQNTAA

SEQ ID NO: 24606 - protein, 11 aa, Mycobacterium tuberculosis
TNIFGQNTAAI

SEQ ID NO: 24607 - protein, 11 aa, Mycobacterium tuberculosis
NIFGQNTAAIA

SEQ ID NO: 24608 - protein, 11 aa, Mycobacterium tuberculosis
IFGQNTAAIAA

SEQ ID NO: 24609 - protein, 11 aa, Mycobacterium tuberculosis
FGQNTAAIAAT

SEQ ID NO: 24610 - protein, 11 aa, Mycobacterium tuberculosis
GQNTAAIAATE

SEQ ID NO: 24611 - protein, 11 aa, Mycobacterium tuberculosis
QNTAAIAATEA

SEQ ID NO: 24612 - protein, 11 aa, Mycobacterium tuberculosis
NTAAIAATEAE

SEQ ID NO: 24613 - protein, 11 aa, Mycobacterium tuberculosis
TAAIAATEAEY

SEQ ID NO: 24614 - protein, 11 aa, Mycobacterium tuberculosis
AAIAATEAEYG

SEQ ID NO: 24615 - protein, 11 aa, Mycobacterium tuberculosis
AIAATEAEYGE

SEQ ID NO: 24616 - protein, 11 aa, Mycobacterium tuberculosis
IAATEAEYGEM

SEQ ID NO: 24617 - protein, 11 aa, Mycobacterium tuberculosis
AATEAEYGEMW

SEQ ID NO: 24618 - protein, 11 aa, Mycobacterium tuberculosis
ATEAEYGEMWA

SEQ ID NO: 24619 - protein, 11 aa, Mycobacterium tuberculosis
TEAEYGEMWAQ

SEQ ID NO: 24620 - protein, 11 aa, Mycobacterium tuberculosis
EAEYGEMWAQD

SEQ ID NO: 24621 - protein, 11 aa, Mycobacterium tuberculosis
AEYGEMWAQDT

SEQ ID NO: 24622 - protein, 11 aa, Mycobacterium tuberculosis
EYGEMWAQDTM

SEQ ID NO: 24623 - protein, 11 aa, Mycobacterium tuberculosis
YGEMWAQDTMA

SEQ ID NO: 24624 - protein, 11 aa, Mycobacterium tuberculosis
GEMWAQDTMAM

SEQ ID NO: 24625 - protein, 11 aa, Mycobacterium tuberculosis
EMWAQDTMAMF

SEQ ID NO: 24626 - protein, 11 aa, Mycobacterium tuberculosis
MWAQDTMAMFG

SEQ ID NO: 24627 - protein, 11 aa, Mycobacterium tuberculosis
WAQDTMAMFGY

SEQ ID NO: 24628 - protein, 11 aa, Mycobacterium tuberculosis
AQDTMAMFGYA

SEQ ID NO: 24629 - protein, 11 aa, Mycobacterium tuberculosis
QDTMAMFGYAS

SEQ ID NO: 24630 - protein, 11 aa, Mycobacterium tuberculosis
DTMAMFGYASS

SEQ ID NO: 24631 - protein, 11 aa, Mycobacterium tuberculosis
TMAMFGYASSS

SEQ ID NO: 24632 - protein, 11 aa, Mycobacterium tuberculosis
MAMFGYASSSA

SEQ ID NO: 24633 - protein, 11 aa, Mycobacterium tuberculosis
AMFGYASSSAT

SEQ ID NO: 24634 - protein, 11 aa, Mycobacterium tuberculosis
MFGYASSSATA

SEQ ID NO: 24635 - protein, 11 aa, Mycobacterium tuberculosis
FGYASSSATAS

SEQ ID NO: 24636 - protein, 11 aa, Mycobacterium tuberculosis
GYASSSATASR

SEQ ID NO: 24637 - protein, 11 aa, Mycobacterium tuberculosis
YASSSATASRL

SEQ ID NO: 24638 - protein, 11 aa, Mycobacterium tuberculosis
ASSSATASRLT

SEQ ID NO: 24639 - protein, 11 aa, Mycobacterium tuberculosis
SSSATASRLTP

SEQ ID NO: 24640 - protein, 11 aa, Mycobacterium tuberculosis
SSATASRLTPF

SEQ ID NO: 24641 - protein, 11 aa, Mycobacterium tuberculosis
SATASRLTPFT

SEQ ID NO: 24642 - protein, 11 aa, Mycobacterium tuberculosis
ATASRLTPFTA

SEQ ID NO: 24643 - protein, 11 aa, Mycobacterium tuberculosis
TASRLTPFTAP

SEQ ID NO: 24644 - protein, 11 aa, Mycobacterium tuberculosis
ASRLTPFTAPP

SEQ ID NO: 24645 - protein, 11 aa, Mycobacterium tuberculosis
SRLTPFTAPPQ

SEQ ID NO: 24646 - protein, 11 aa, Mycobacterium tuberculosis
RLTPFTAPPQT

SEQ ID NO: 24647 - protein, 11 aa, Mycobacterium tuberculosis
LTPFTAPPQTT

SEQ ID NO: 24648 - protein, 11 aa, Mycobacterium tuberculosis
TPFTAPPQTTN

SEQ ID NO: 24649 - protein, 11 aa, Mycobacterium tuberculosis
PFTAPPQTTNP

SEQ ID NO: 24650 - protein, 11 aa, Mycobacterium tuberculosis
FTAPPQTTNPS

SEQ ID NO: 24651 - protein, 11 aa, Mycobacterium tuberculosis
TAPPQTTNPSG

SEQ ID NO: 24652 - protein, 11 aa, Mycobacterium tuberculosis
APPQTTNPSGL

SEQ ID NO: 24653 - protein, 11 aa, Mycobacterium tuberculosis
PPQTTNPSGLA

SEQ ID NO: 24654 - protein, 11 aa, Mycobacterium tuberculosis
PQTTNPSGLAG

SEQ ID NO: 24655 - protein, 11 aa, Mycobacterium tuberculosis
QTTNPSGLAGQ

SEQ ID NO: 24656 - protein, 11 aa, Mycobacterium tuberculosis
TTNPSGLAGQA

SEQ ID NO: 24657 - protein, 11 aa, Mycobacterium tuberculosis
TNPSGLAGQAA

SEQ ID NO: 24658 - protein, 11 aa, Mycobacterium tuberculosis
NPSGLAGQAAA

SEQ ID NO: 24659 - protein, 11 aa, Mycobacterium tuberculosis
PSGLAGQAAAT

SEQ ID NO: 24660 - protein, 11 aa, Mycobacterium tuberculosis
SGLAGQAAATG

SEQ ID NO: 24661 - protein, 11 aa, Mycobacterium tuberculosis
GLAGQAAATGQ

SEQ ID NO: 24662 - protein, 11 aa, Mycobacterium tuberculosis
LAGQAAATGQA

SEQ ID NO: 24663 - protein, 11 aa, Mycobacterium tuberculosis
AGQAAATGQAT

SEQ ID NO: 24664 - protein, 11 aa, Mycobacterium tuberculosis
GQAAATGQATA

SEQ ID NO: 24665 - protein, 11 aa, Mycobacterium tuberculosis
QAAATGQATAL

SEQ ID NO: 24666 - protein, 11 aa, Mycobacterium tuberculosis
AAATGQATALA

SEQ ID NO: 24667 - protein, 11 aa, Mycobacterium tuberculosis
AATGQATALAS

SEQ ID NO: 24668 - protein, 11 aa, Mycobacterium tuberculosis
ATGQATALASG

SEQ ID NO: 24669 - protein, 11 aa, Mycobacterium tuberculosis
TGQATALASGT

SEQ ID NO: 24670 - protein, 11 aa, Mycobacterium tuberculosis
GQATALASGTN

SEQ ID NO: 24671 - protein, 11 aa, Mycobacterium tuberculosis
QATALASGTNA

SEQ ID NO: 24672 - protein, 11 aa, Mycobacterium tuberculosis
ATALASGTNAV

SEQ ID NO: 24673 - protein, 11 aa, Mycobacterium tuberculosis
TALASGTNAVT

SEQ ID NO: 24674 - protein, 11 aa, Mycobacterium tuberculosis
ALASGTNAVTT

SEQ ID NO: 24675 - protein, 11 aa, Mycobacterium tuberculosis
LASGTNAVTTA

SEQ ID NO: 24676 - protein, 11 aa, Mycobacterium tuberculosis
ASGTNAVTTAL

SEQ ID NO: 24677 - protein, 11 aa, Mycobacterium tuberculosis
SGTNAVTTALS

SEQ ID NO: 24678 - protein, 11 aa, Mycobacterium tuberculosis
GTNAVTTALSS

SEQ ID NO: 24679 - protein, 11 aa, Mycobacterium tuberculosis
TNAVTTALSSA

SEQ ID NO: 24680 - protein, 11 aa, Mycobacterium tuberculosis
NAVTTALSSAA

SEQ ID NO: 24681 - protein, 11 aa, Mycobacterium tuberculosis
AVTTALSSAAA

SEQ ID NO: 24682 - protein, 11 aa, Mycobacterium tuberculosis
VTTALSSAAAQ

SEQ ID NO: 24683 - protein, 11 aa, Mycobacterium tuberculosis
TTALSSAAAQF

SEQ ID NO: 24684 - protein, 11 aa, Mycobacterium tuberculosis
TALSSAAAQFP

SEQ ID NO: 24685 - protein, 11 aa, Mycobacterium tuberculosis
ALSSAAAQFPF

SEQ ID NO: 24686 - protein, 11 aa, Mycobacterium tuberculosis
LSSAAAQFPFD

SEQ ID NO: 24687 - protein, 11 aa, Mycobacterium tuberculosis
SSAAAQFPFDI

SEQ ID NO: 24688 - protein, 11 aa, Mycobacterium tuberculosis
SAAAQFPFDII

SEQ ID NO: 24689 - protein, 11 aa, Mycobacterium tuberculosis
AAAQFPFDIIP

SEQ ID NO: 24690 - protein, 11 aa, Mycobacterium tuberculosis
AAQFPFDIIPT

SEQ ID NO: 24691 - protein, 11 aa, Mycobacterium tuberculosis
AQFPFDIIPTL

SEQ ID NO: 24692 - protein, 11 aa, Mycobacterium tuberculosis
QFPFDIIPTLL

SEQ ID NO: 24693 - protein, 11 aa, Mycobacterium tuberculosis
FPFDIIPTLLQ

SEQ ID NO: 24694 - protein, 11 aa, Mycobacterium tuberculosis
PFDIIPTLLQG

SEQ ID NO: 24695 - protein, 11 aa, Mycobacterium tuberculosis
FDIIPTLLQGL

SEQ ID NO: 24696 - protein, 11 aa, Mycobacterium tuberculosis
DIIPTLLQGLA

SEQ ID NO: 24697 - protein, 11 aa, Mycobacterium tuberculosis
IIPTLLQGLAT

SEQ ID NO: 24698 - protein, 11 aa, Mycobacterium tuberculosis
IPTLLQGLATL

SEQ ID NO: 24699 - protein, 11 aa, Mycobacterium tuberculosis
PTLLQGLATLS

SEQ ID NO: 24700 - protein, 11 aa, Mycobacterium tuberculosis
TLLQGLATLST

SEQ ID NO: 24701 - protein, 11 aa, Mycobacterium tuberculosis
LLQGLATLSTQ

SEQ ID NO: 24702 - protein, 11 aa, Mycobacterium tuberculosis
LQGLATLSTQY

SEQ ID NO: 24703 - protein, 11 aa, Mycobacterium tuberculosis
QGLATLSTQYT

SEQ ID NO: 24704 - protein, 11 aa, Mycobacterium tuberculosis
GLATLSTQYTQ

SEQ ID NO: 24705 - protein, 11 aa, Mycobacterium tuberculosis
LATLSTQYTQL

SEQ ID NO: 24706 - protein, 11 aa, Mycobacterium tuberculosis
ATLSTQYTQLM

SEQ ID NO: 24707 - protein, 11 aa, Mycobacterium tuberculosis
TLSTQYTQLMG

SEQ ID NO: 24708 - protein, 11 aa, Mycobacterium tuberculosis
LSTQYTQLMGQ

SEQ ID NO: 24709 - protein, 11 aa, Mycobacterium tuberculosis
STQYTQLMGQL

SEQ ID NO: 24710 - protein, 11 aa, Mycobacterium tuberculosis
TQYTQLMGQLI

SEQ ID NO: 24711 - protein, 11 aa, Mycobacterium tuberculosis
QYTQLMGQLIN

SEQ ID NO: 24712 - protein, 11 aa, Mycobacterium tuberculosis
YTQLMGQLINA

SEQ ID NO: 24713 - protein, 11 aa, Mycobacterium tuberculosis
TQLMGQLINAI

SEQ ID NO: 24714 - protein, 11 aa, Mycobacterium tuberculosis
QLMGQLINAIF

SEQ ID NO: 24715 - protein, 11 aa, Mycobacterium tuberculosis
LMGQLINAIFG

SEQ ID NO: 24716 - protein, 11 aa, Mycobacterium tuberculosis
MGQLINAIFGP

SEQ ID NO: 24717 - protein, 11 aa, Mycobacterium tuberculosis
GQLINAIFGPT

SEQ ID NO: 24718 - protein, 11 aa, Mycobacterium tuberculosis
QLINAIFGPTG

SEQ ID NO: 24719 - protein, 11 aa, Mycobacterium tuberculosis
LINAIFGPTGA

SEQ ID NO: 24720 - protein, 11 aa, Mycobacterium tuberculosis
INAIFGPTGAT

SEQ ID NO: 24721 - protein, 11 aa, Mycobacterium tuberculosis
NAIFGPTGATT

SEQ ID NO: 24722 - protein, 11 aa, Mycobacterium tuberculosis
AIFGPTGATTY

SEQ ID NO: 24723 - protein, 11 aa, Mycobacterium tuberculosis
IFGPTGATTYQ

SEQ ID NO: 24724 - protein, 11 aa, Mycobacterium tuberculosis
FGPTGATTYQN

SEQ ID NO: 24725 - protein, 11 aa, Mycobacterium tuberculosis
GPTGATTYQNV

SEQ ID NO: 24726 - protein, 11 aa, Mycobacterium tuberculosis
PTGATTYQNVF

SEQ ID NO: 24727 - protein, 11 aa, Mycobacterium tuberculosis
TGATTYQNVFV

SEQ ID NO: 24728 - protein, 11 aa, Mycobacterium tuberculosis
GATTYQNVFVT

SEQ ID NO: 24729 - protein, 11 aa, Mycobacterium tuberculosis
ATTYQNVFVTA

SEQ ID NO: 24730 - protein, 11 aa, Mycobacterium tuberculosis
TTYQNVFVTAA

SEQ ID NO: 24731 - protein, 11 aa, Mycobacterium tuberculosis
TYQNVFVTAAN

SEQ ID NO: 24732 - protein, 11 aa, Mycobacterium tuberculosis
YQNVFVTAANV

SEQ ID NO: 24733 - protein, 11 aa, Mycobacterium tuberculosis
QNVFVTAANVT

SEQ ID NO: 24734 - protein, 11 aa, Mycobacterium tuberculosis
NVFVTAANVTK

SEQ ID NO: 24735 - protein, 11 aa, Mycobacterium tuberculosis
VFVTAANVTKF

SEQ ID NO: 24736 - protein, 11 aa, Mycobacterium tuberculosis
FVTAANVTKFS

SEQ ID NO: 24737 - protein, 11 aa, Mycobacterium tuberculosis
VTAANVTKFST

SEQ ID NO: 24738 - protein, 11 aa, Mycobacterium tuberculosis
TAANVTKFSTW

SEQ ID NO: 24739 - protein, 11 aa, Mycobacterium tuberculosis
AANVTKFSTWA

SEQ ID NO: 24740 - protein, 11 aa, Mycobacterium tuberculosis
ANVTKFSTWAN

SEQ ID NO: 24741 - protein, 11 aa, Mycobacterium tuberculosis
NVTKFSTWAND

SEQ ID NO: 24742 - protein, 11 aa, Mycobacterium tuberculosis
VTKFSTWANDA

SEQ ID NO: 24743 - protein, 11 aa, Mycobacterium tuberculosis
TKFSTWANDAM

SEQ ID NO: 24744 - protein, 11 aa, Mycobacterium tuberculosis
KFSTWANDAMS

SEQ ID NO: 24745 - protein, 11 aa, Mycobacterium tuberculosis
FSTWANDAMSA

SEQ ID NO: 24746 - protein, 11 aa, Mycobacterium tuberculosis
STWANDAMSAP

SEQ ID NO: 24747 - protein, 11 aa, Mycobacterium tuberculosis
TWANDAMSAPN

SEQ ID NO: 24748 - protein, 11 aa, Mycobacterium tuberculosis
WANDAMSAPNL

SEQ ID NO: 24749 - protein, 11 aa, Mycobacterium tuberculosis
ANDAMSAPNLG

SEQ ID NO: 24750 - protein, 11 aa, Mycobacterium tuberculosis
NDAMSAPNLGM

SEQ ID NO: 24751 - protein, 11 aa, Mycobacterium tuberculosis
DAMSAPNLGMT

SEQ ID NO: 24752 - protein, 11 aa, Mycobacterium tuberculosis
AMSAPNLGMTE

SEQ ID NO: 24753 - protein, 11 aa, Mycobacterium tuberculosis
MSAPNLGMTEF

SEQ ID NO: 24754 - protein, 11 aa, Mycobacterium tuberculosis
SAPNLGMTEFK

SEQ ID NO: 24755 - protein, 11 aa, Mycobacterium tuberculosis
APNLGMTEFKV

SEQ ID NO: 24756 - protein, 11 aa, Mycobacterium tuberculosis
PNLGMTEFKVF

SEQ ID NO: 24757 - protein, 11 aa, Mycobacterium tuberculosis
NLGMTEFKVFW

SEQ ID NO: 24758 - protein, 11 aa, Mycobacterium tuberculosis
LGMTEFKVFWQ

SEQ ID NO: 24759 - protein, 11 aa, Mycobacterium tuberculosis
GMTEFKVFWQP

SEQ ID NO: 24760 - protein, 11 aa, Mycobacterium tuberculosis
MTEFKVFWQPP

SEQ ID NO: 24761 - protein, 11 aa, Mycobacterium tuberculosis
TEFKVFWQPPP

SEQ ID NO: 24762 - protein, 11 aa, Mycobacterium tuberculosis
EFKVFWQPPPA

SEQ ID NO: 24763 - protein, 11 aa, Mycobacterium tuberculosis
FKVFWQPPPAP

SEQ ID NO: 24764 - protein, 11 aa, Mycobacterium tuberculosis
KVFWQPPPAPE

SEQ ID NO: 24765 - protein, 11 aa, Mycobacterium tuberculosis
VFWQPPPAPEI

SEQ ID NO: 24766 - protein, 11 aa, Mycobacterium tuberculosis
FWQPPPAPEIP

SEQ ID NO: 24767 - protein, 11 aa, Mycobacterium tuberculosis
WQPPPAPEIPK

SEQ ID NO: 24768 - protein, 11 aa, Mycobacterium tuberculosis
QPPPAPEIPKS

SEQ ID NO: 24769 - protein, 11 aa, Mycobacterium tuberculosis
PPPAPEIPKSS

SEQ ID NO: 24770 - protein, 11 aa, Mycobacterium tuberculosis
PPAPEIPKSSL

SEQ ID NO: 24771 - protein, 11 aa, Mycobacterium tuberculosis
PAPEIPKSSLG

SEQ ID NO: 24772 - protein, 11 aa, Mycobacterium tuberculosis
APEIPKSSLGA

SEQ ID NO: 24773 - protein, 11 aa, Mycobacterium tuberculosis
PEIPKSSLGAG

SEQ ID NO: 24774 - protein, 11 aa, Mycobacterium tuberculosis
EIPKSSLGAGL

SEQ ID NO: 24775 - protein, 11 aa, Mycobacterium tuberculosis
IPKSSLGAGLG

SEQ ID NO: 24776 - protein, 11 aa, Mycobacterium tuberculosis
PKSSLGAGLGL

SEQ ID NO: 24777 - protein, 11 aa, Mycobacterium tuberculosis
KSSLGAGLGLR

SEQ ID NO: 24778 - protein, 11 aa, Mycobacterium tuberculosis
SSLGAGLGLRS

SEQ ID NO: 24779 - protein, 11 aa, Mycobacterium tuberculosis
SLGAGLGLRSG

SEQ ID NO: 24780 - protein, 11 aa, Mycobacterium tuberculosis
LGAGLGLRSGL

SEQ ID NO: 24781 - protein, 11 aa, Mycobacterium tuberculosis
GAGLGLRSGLS

SEQ ID NO: 24782 - protein, 11 aa, Mycobacterium tuberculosis
AGLGLRSGLSA

SEQ ID NO: 24783 - protein, 11 aa, Mycobacterium tuberculosis
GLGLRSGLSAG

SEQ ID NO: 24784 - protein, 11 aa, Mycobacterium tuberculosis
LGLRSGLSAGL

SEQ ID NO: 24785 - protein, 11 aa, Mycobacterium tuberculosis
GLRSGLSAGLA

SEQ ID NO: 24786 - protein, 11 aa, Mycobacterium tuberculosis
LRSGLSAGLAH

SEQ ID NO: 24787 - protein, 11 aa, Mycobacterium tuberculosis
RSGLSAGLAHA

SEQ ID NO: 24788 - protein, 11 aa, Mycobacterium tuberculosis
SGLSAGLAHAA

SEQ ID NO: 24789 - protein, 11 aa, Mycobacterium tuberculosis
GLSAGLAHAAS

SEQ ID NO: 24790 - protein, 11 aa, Mycobacterium tuberculosis
LSAGLAHAASA

SEQ ID NO: 24791 - protein, 11 aa, Mycobacterium tuberculosis
SAGLAHAASAG

SEQ ID NO: 24792 - protein, 11 aa, Mycobacterium tuberculosis
AGLAHAASAGL

SEQ ID NO: 24793 - protein, 11 aa, Mycobacterium tuberculosis
GLAHAASAGLG

SEQ ID NO: 24794 - protein, 11 aa, Mycobacterium tuberculosis
LAHAASAGLGQ

SEQ ID NO: 24795 - protein, 11 aa, Mycobacterium tuberculosis
AHAASAGLGQA

SEQ ID NO: 24796 - protein, 11 aa, Mycobacterium tuberculosis
HAASAGLGQAN

SEQ ID NO: 24797 - protein, 11 aa, Mycobacterium tuberculosis
AASAGLGQANL

SEQ ID NO: 24798 - protein, 11 aa, Mycobacterium tuberculosis
ASAGLGQANLV

SEQ ID NO: 24799 - protein, 11 aa, Mycobacterium tuberculosis
SAGLGQANLVG

SEQ ID NO: 24800 - protein, 11 aa, Mycobacterium tuberculosis
AGLGQANLVGD

SEQ ID NO: 24801 - protein, 11 aa, Mycobacterium tuberculosis
GLGQANLVGDL

SEQ ID NO: 24802 - protein, 11 aa, Mycobacterium tuberculosis
LGQANLVGDLS

SEQ ID NO: 24803 - protein, 11 aa, Mycobacterium tuberculosis
GQANLVGDLSV

SEQ ID NO: 24804 - protein, 11 aa, Mycobacterium tuberculosis
QANLVGDLSVP

SEQ ID NO: 24805 - protein, 11 aa, Mycobacterium tuberculosis
ANLVGDLSVPP

SEQ ID NO: 24806 - protein, 11 aa, Mycobacterium tuberculosis
NLVGDLSVPPS

SEQ ID NO: 24807 - protein, 11 aa, Mycobacterium tuberculosis
LVGDLSVPPSW

SEQ ID NO: 24808 - protein, 11 aa, Mycobacterium tuberculosis
VGDLSVPPSWA

SEQ ID NO: 24809 - protein, 11 aa, Mycobacterium tuberculosis
GDLSVPPSWAS

SEQ ID NO: 24810 - protein, 11 aa, Mycobacterium tuberculosis
DLSVPPSWASA

SEQ ID NO: 24811 - protein, 11 aa, Mycobacterium tuberculosis
LSVPPSWASAT

SEQ ID NO: 24812 - protein, 11 aa, Mycobacterium tuberculosis
SVPPSWASATP

SEQ ID NO: 24813 - protein, 11 aa, Mycobacterium tuberculosis
VPPSWASATPA

SEQ ID NO: 24814 - protein, 11 aa, Mycobacterium tuberculosis
PPSWASATPAV

SEQ ID NO: 24815 - protein, 11 aa, Mycobacterium tuberculosis
PSWASATPAVR

SEQ ID NO: 24816 - protein, 11 aa, Mycobacterium tuberculosis
SWASATPAVRL

SEQ ID NO: 24817 - protein, 11 aa, Mycobacterium tuberculosis
WASATPAVRLV

SEQ ID NO: 24818 - protein, 11 aa, Mycobacterium tuberculosis
ASATPAVRLVA

SEQ ID NO: 24819 - protein, 11 aa, Mycobacterium tuberculosis
SATPAVRLVAN

SEQ ID NO: 24820 - protein, 11 aa, Mycobacterium tuberculosis
ATPAVRLVANT

SEQ ID NO: 24821 - protein, 11 aa, Mycobacterium tuberculosis
TPAVRLVANTL

SEQ ID NO: 24822 - protein, 11 aa, Mycobacterium tuberculosis
PAVRLVANTLP

SEQ ID NO: 24823 - protein, 11 aa, Mycobacterium tuberculosis
AVRLVANTLPA

SEQ ID NO: 24824 - protein, 11 aa, Mycobacterium tuberculosis
VRLVANTLPAT

SEQ ID NO: 24825 - protein, 11 aa, Mycobacterium tuberculosis
RLVANTLPATS

SEQ ID NO: 24826 - protein, 11 aa, Mycobacterium tuberculosis
LVANTLPATSL

SEQ ID NO: 24827 - protein, 11 aa, Mycobacterium tuberculosis
VANTLPATSLA

SEQ ID NO: 24828 - protein, 11 aa, Mycobacterium tuberculosis
ANTLPATSLAA

SEQ ID NO: 24829 - protein, 11 aa, Mycobacterium tuberculosis
NTLPATSLAAA

SEQ ID NO: 24830 - protein, 11 aa, Mycobacterium tuberculosis
TLPATSLAAAP

SEQ ID NO: 24831 - protein, 11 aa, Mycobacterium tuberculosis
LPATSLAAAPA

SEQ ID NO: 24832 - protein, 11 aa, Mycobacterium tuberculosis
PATSLAAAPAT

SEQ ID NO: 24833 - protein, 11 aa, Mycobacterium tuberculosis
ATSLAAAPATQ

SEQ ID NO: 24834 - protein, 11 aa, Mycobacterium tuberculosis
TSLAAAPATQI

SEQ ID NO: 24835 - protein, 11 aa, Mycobacterium tuberculosis
SLAAAPATQIP

SEQ ID NO: 24836 - protein, 11 aa, Mycobacterium tuberculosis
LAAAPATQIPA

SEQ ID NO: 24837 - protein, 11 aa, Mycobacterium tuberculosis
AAAPATQIPAN

SEQ ID NO: 24838 - protein, 11 aa, Mycobacterium tuberculosis
AAPATQIPANL

SEQ ID NO: 24839 - protein, 11 aa, Mycobacterium tuberculosis
APATQIPANLL

SEQ ID NO: 24840 - protein, 11 aa, Mycobacterium tuberculosis
PATQIPANLLG

SEQ ID NO: 24841 - protein, 11 aa, Mycobacterium tuberculosis
ATQIPANLLGQ

SEQ ID NO: 24842 - protein, 11 aa, Mycobacterium tuberculosis
TQIPANLLGQM

SEQ ID NO: 24843 - protein, 11 aa, Mycobacterium tuberculosis
QIPANLLGQMA

SEQ ID NO: 24844 - protein, 11 aa, Mycobacterium tuberculosis
IPANLLGQMAL

SEQ ID NO: 24845 - protein, 11 aa, Mycobacterium tuberculosis
PANLLGQMALG

SEQ ID NO: 24846 - protein, 11 aa, Mycobacterium tuberculosis
ANLLGQMALGS

SEQ ID NO: 24847 - protein, 11 aa, Mycobacterium tuberculosis
NLLGQMALGSM

SEQ ID NO: 24848 - protein, 11 aa, Mycobacterium tuberculosis
LLGQMALGSMT

SEQ ID NO: 24849 - protein, 11 aa, Mycobacterium tuberculosis
LGQMALGSMTG

SEQ ID NO: 24850 - protein, 11 aa, Mycobacterium tuberculosis
GQMALGSMTGG

SEQ ID NO: 24851 - protein, 11 aa, Mycobacterium tuberculosis
QMALGSMTGGA

SEQ ID NO: 24852 - protein, 11 aa, Mycobacterium tuberculosis
MALGSMTGGAL

SEQ ID NO: 24853 - protein, 11 aa, Mycobacterium tuberculosis
ALGSMTGGALG

SEQ ID NO: 24854 - protein, 11 aa, Mycobacterium tuberculosis
LGSMTGGALGA

SEQ ID NO: 24855 - protein, 11 aa, Mycobacterium tuberculosis
GSMTGGALGAA

SEQ ID NO: 24856 - protein, 11 aa, Mycobacterium tuberculosis
SMTGGALGAAA

SEQ ID NO: 24857 - protein, 11 aa, Mycobacterium tuberculosis
MTGGALGAAAP

SEQ ID NO: 24858 - protein, 11 aa, Mycobacterium tuberculosis
TGGALGAAAPA

SEQ ID NO: 24859 - protein, 11 aa, Mycobacterium tuberculosis
GGALGAAAPAI

SEQ ID NO: 24860 - protein, 11 aa, Mycobacterium tuberculosis
GALGAAAPAIY

SEQ ID NO: 24861 - protein, 11 aa, Mycobacterium tuberculosis
ALGAAAPAIYT

SEQ ID NO: 24862 - protein, 11 aa, Mycobacterium tuberculosis
LGAAAPAIYTG

SEQ ID NO: 24863 - protein, 11 aa, Mycobacterium tuberculosis
GAAAPAIYTGS

SEQ ID NO: 24864 - protein, 11 aa, Mycobacterium tuberculosis
AAAPAIYTGSG

SEQ ID NO: 24865 - protein, 11 aa, Mycobacterium tuberculosis
AAPAIYTGSGA

SEQ ID NO: 24866 - protein, 11 aa, Mycobacterium tuberculosis
APAIYTGSGAR

SEQ ID NO: 24867 - protein, 11 aa, Mycobacterium tuberculosis
PAIYTGSGARA

SEQ ID NO: 24868 - protein, 11 aa, Mycobacterium tuberculosis
AIYTGSGARAR

SEQ ID NO: 24869 - protein, 11 aa, Mycobacterium tuberculosis
IYTGSGARARA

SEQ ID NO: 24870 - protein, 11 aa, Mycobacterium tuberculosis
YTGSGARARAN

SEQ ID NO: 24871 - protein, 11 aa, Mycobacterium tuberculosis
TGSGARARANG

SEQ ID NO: 24872 - protein, 11 aa, Mycobacterium tuberculosis
GSGARARANGG

SEQ ID NO: 24873 - protein, 11 aa, Mycobacterium tuberculosis
SGARARANGGT

SEQ ID NO: 24874 - protein, 11 aa, Mycobacterium tuberculosis
GARARANGGTP

SEQ ID NO: 24875 - protein, 11 aa, Mycobacterium tuberculosis
ARARANGGTPS

SEQ ID NO: 24876 - protein, 11 aa, Mycobacterium tuberculosis
RARANGGTPSA

SEQ ID NO: 24877 - protein, 11 aa, Mycobacterium tuberculosis
ARANGGTPSAE

SEQ ID NO: 24878 - protein, 11 aa, Mycobacterium tuberculosis
RANGGTPSAEP

SEQ ID NO: 24879 - protein, 11 aa, Mycobacterium tuberculosis
ANGGTPSAEPV

SEQ ID NO: 24880 - protein, 11 aa, Mycobacterium tuberculosis
NGGTPSAEPVK

SEQ ID NO: 24881 - protein, 11 aa, Mycobacterium tuberculosis
GGTPSAEPVKL

SEQ ID NO: 24882 - protein, 11 aa, Mycobacterium tuberculosis
GTPSAEPVKLE

SEQ ID NO: 24883 - protein, 11 aa, Mycobacterium tuberculosis
TPSAEPVKLEA

SEQ ID NO: 24884 - protein, 11 aa, Mycobacterium tuberculosis
PSAEPVKLEAV

SEQ ID NO: 24885 - protein, 11 aa, Mycobacterium tuberculosis
SAEPVKLEAVI

SEQ ID NO: 24886 - protein, 11 aa, Mycobacterium tuberculosis
AEPVKLEAVIA

SEQ ID NO: 24887 - protein, 11 aa, Mycobacterium tuberculosis
EPVKLEAVIAQ

SEQ ID NO: 24888 - protein, 11 aa, Mycobacterium tuberculosis
PVKLEAVIAQL

SEQ ID NO: 24889 - protein, 11 aa, Mycobacterium tuberculosis
VKLEAVIAQLQ

SEQ ID NO: 24890 - protein, 11 aa, Mycobacterium tuberculosis
KLEAVIAQLQK

SEQ ID NO: 24891 - protein, 11 aa, Mycobacterium tuberculosis
LEAVIAQLQKQ

SEQ ID NO: 24892 - protein, 11 aa, Mycobacterium tuberculosis
EAVIAQLQKQP

SEQ ID NO: 24893 - protein, 11 aa, Mycobacterium tuberculosis
AVIAQLQKQPD

SEQ ID NO: 24894 - protein, 11 aa, Mycobacterium tuberculosis
VIAQLQKQPDA

SEQ ID NO: 24895 - protein, 11 aa, Mycobacterium tuberculosis
IAQLQKQPDAV

SEQ ID NO: 24896 - protein, 11 aa, Mycobacterium tuberculosis
AQLQKQPDAVR

SEQ ID NO: 24897 - protein, 11 aa, Mycobacterium tuberculosis
QLQKQPDAVRH

SEQ ID NO: 24898 - protein, 11 aa, Mycobacterium tuberculosis
LQKQPDAVRHW

SEQ ID NO: 24899 - protein, 11 aa, Mycobacterium tuberculosis
QKQPDAVRHWN

SEQ ID NO: 24900 - protein, 11 aa, Mycobacterium tuberculosis
KQPDAVRHWNV

SEQ ID NO: 24901 - protein, 11 aa, Mycobacterium tuberculosis
QPDAVRHWNVD

SEQ ID NO: 24902 - protein, 11 aa, Mycobacterium tuberculosis
PDAVRHWNVDK

SEQ ID NO: 24903 - protein, 11 aa, Mycobacterium tuberculosis
DAVRHWNVDKA

SEQ ID NO: 24904 - protein, 11 aa, Mycobacterium tuberculosis
AVRHWNVDKAD

SEQ ID NO: 24905 - protein, 11 aa, Mycobacterium tuberculosis
VRHWNVDKADL

SEQ ID NO: 24906 - protein, 11 aa, Mycobacterium tuberculosis
RHWNVDKADLD

SEQ ID NO: 24907 - protein, 11 aa, Mycobacterium tuberculosis
HWNVDKADLDG

SEQ ID NO: 24908 - protein, 11 aa, Mycobacterium tuberculosis
WNVDKADLDGL

SEQ ID NO: 24909 - protein, 11 aa, Mycobacterium tuberculosis
NVDKADLDGLL

SEQ ID NO: 24910 - protein, 11 aa, Mycobacterium tuberculosis
VDKADLDGLLD

SEQ ID NO: 24911 - protein, 11 aa, Mycobacterium tuberculosis
DKADLDGLLDR

SEQ ID NO: 24912 - protein, 11 aa, Mycobacterium tuberculosis
KADLDGLLDRL

SEQ ID NO: 24913 - protein, 11 aa, Mycobacterium tuberculosis
ADLDGLLDRLS

SEQ ID NO: 24914 - protein, 11 aa, Mycobacterium tuberculosis
DLDGLLDRLSK

SEQ ID NO: 24915 - protein, 11 aa, Mycobacterium tuberculosis
LDGLLDRLSKQ

SEQ ID NO: 24916 - protein, 11 aa, Mycobacterium tuberculosis
DGLLDRLSKQP

SEQ ID NO: 24917 - protein, 11 aa, Mycobacterium tuberculosis
GLLDRLSKQPG

SEQ ID NO: 24918 - protein, 11 aa, Mycobacterium tuberculosis
LLDRLSKQPGI

SEQ ID NO: 24919 - protein, 11 aa, Mycobacterium tuberculosis
LDRLSKQPGIH

SEQ ID NO: 24920 - protein, 11 aa, Mycobacterium tuberculosis
DRLSKQPGIHA

SEQ ID NO: 24921 - protein, 11 aa, Mycobacterium tuberculosis
RLSKQPGIHAV

SEQ ID NO: 24922 - protein, 11 aa, Mycobacterium tuberculosis
LSKQPGIHAVH

SEQ ID NO: 24923 - protein, 11 aa, Mycobacterium tuberculosis
SKQPGIHAVHV

SEQ ID NO: 24924 - protein, 11 aa, Mycobacterium tuberculosis
KQPGIHAVHVS

SEQ ID NO: 24925 - protein, 11 aa, Mycobacterium tuberculosis
QPGIHAVHVSN

SEQ ID NO: 24926 - protein, 11 aa, Mycobacterium tuberculosis
PGIHAVHVSNG

SEQ ID NO: 24927 - protein, 11 aa, Mycobacterium tuberculosis
GIHAVHVSNGD

SEQ ID NO: 24928 - protein, 11 aa, Mycobacterium tuberculosis
IHAVHVSNGDK

SEQ ID NO: 24929 - protein, 11 aa, Mycobacterium tuberculosis
HAVHVSNGDKP

SEQ ID NO: 24930 - protein, 11 aa, Mycobacterium tuberculosis
AVHVSNGDKPK

SEQ ID NO: 24931 - protein, 11 aa, Mycobacterium tuberculosis
VHVSNGDKPKV

SEQ ID NO: 24932 - protein, 11 aa, Mycobacterium tuberculosis
HVSNGDKPKVA

SEQ ID NO: 24933 - protein, 11 aa, Mycobacterium tuberculosis
VSNGDKPKVAL

SEQ ID NO: 24934 - protein, 11 aa, Mycobacterium tuberculosis
SNGDKPKVALP

SEQ ID NO: 24935 - protein, 11 aa, Mycobacterium tuberculosis
NGDKPKVALPD

SEQ ID NO: 24936 - protein, 11 aa, Mycobacterium tuberculosis
GDKPKVALPDT

SEQ ID NO: 24937 - protein, 11 aa, Mycobacterium tuberculosis
DKPKVALPDTQ

SEQ ID NO: 24938 - protein, 11 aa, Mycobacterium tuberculosis
KPKVALPDTQL

SEQ ID NO: 24939 - protein, 11 aa, Mycobacterium tuberculosis
PKVALPDTQLG

SEQ ID NO: 24940 - protein, 11 aa, Mycobacterium tuberculosis
KVALPDTQLGS

SEQ ID NO: 24941 - protein, 11 aa, Mycobacterium tuberculosis
VALPDTQLGSH

SEQ ID NO: 24942 - protein, 8 aa, Mycobacterium tuberculosis
MAAGSGGG

SEQ ID NO: 24943 - protein, 8 aa, Mycobacterium tuberculosis
AAGSGGGT

SEQ ID NO: 24944 - protein, 8 aa, Mycobacterium tuberculosis
AGSGGGTV

SEQ ID NO: 24945 - protein, 8 aa, Mycobacterium tuberculosis
GSGGGTVG

SEQ ID NO: 24946 - protein, 8 aa, Mycobacterium tuberculosis
SGGGTVGL

SEQ ID NO: 24947 - protein, 8 aa, Mycobacterium tuberculosis
GGGTVGLV

SEQ ID NO: 24948 - protein, 8 aa, Mycobacterium tuberculosis
GGTVGLVL

SEQ ID NO: 24949 - protein, 8 aa, Mycobacterium tuberculosis
GTVGLVLP

SEQ ID NO: 24950 - protein, 8 aa, Mycobacterium tuberculosis
TVGLVLPR

SEQ ID NO: 24951 - protein, 8 aa, Mycobacterium tuberculosis
VGLVLPRV

SEQ ID NO: 24952 - protein, 8 aa, Mycobacterium tuberculosis
GLVLPRVA

SEQ ID NO: 24953 - protein, 8 aa, Mycobacterium tuberculosis
LVLPRVAS

SEQ ID NO: 24954 - protein, 8 aa, Mycobacterium tuberculosis
VLPRVASL

SEQ ID NO: 24955 - protein, 8 aa, Mycobacterium tuberculosis
LPRVASLS

SEQ ID NO: 24956 - protein, 8 aa, Mycobacterium tuberculosis
PRVASLSG

SEQ ID NO: 24957 - protein, 8 aa, Mycobacterium tuberculosis
RVASLSGL

SEQ ID NO: 24958 - protein, 8 aa, Mycobacterium tuberculosis
VASLSGLD

SEQ ID NO: 24959 - protein, 8 aa, Mycobacterium tuberculosis
ASLSGLDG

SEQ ID NO: 24960 - protein, 8 aa, Mycobacterium tuberculosis
SLSGLDGA

SEQ ID NO: 24961 - protein, 8 aa, Mycobacterium tuberculosis
LSGLDGAP

SEQ ID NO: 24962 - protein, 8 aa, Mycobacterium tuberculosis
SGLDGAPT

SEQ ID NO: 24963 - protein, 8 aa, Mycobacterium tuberculosis
GLDGAPTV

SEQ ID NO: 24964 - protein, 8 aa, Mycobacterium tuberculosis
LDGAPTVP

SEQ ID NO: 24965 - protein, 8 aa, Mycobacterium tuberculosis
DGAPTVPE

SEQ ID NO: 24966 - protein, 8 aa, Mycobacterium tuberculosis
GAPTVPEG

SEQ ID NO: 24967 - protein, 8 aa, Mycobacterium tuberculosis
APTVPEGS

SEQ ID NO: 24968 - protein, 8 aa, Mycobacterium tuberculosis
PTVPEGSD

SEQ ID NO: 24969 - protein, 8 aa, Mycobacterium tuberculosis
TVPEGSDK

SEQ ID NO: 24970 - protein, 8 aa, Mycobacterium tuberculosis
VPEGSDKA

SEQ ID NO: 24971 - protein, 8 aa, Mycobacterium tuberculosis
PEGSDKAL

SEQ ID NO: 24972 - protein, 8 aa, Mycobacterium tuberculosis
EGSDKALM

SEQ ID NO: 24973 - protein, 8 aa, Mycobacterium tuberculosis
GSDKALMH

SEQ ID NO: 24974 - protein, 8 aa, Mycobacterium tuberculosis
SDKALMHL

SEQ ID NO: 24975 - protein, 8 aa, Mycobacterium tuberculosis
DKALMHLG

SEQ ID NO: 24976 - protein, 8 aa, Mycobacterium tuberculosis
KALMHLGD

SEQ ID NO: 24977 - protein, 8 aa, Mycobacterium tuberculosis
ALMHLGDP

SEQ ID NO: 24978 - protein, 8 aa, Mycobacterium tuberculosis
LMHLGDPP

SEQ ID NO: 24979 - protein, 8 aa, Mycobacterium tuberculosis
MHLGDPPR

SEQ ID NO: 24980 - protein, 8 aa, Mycobacterium tuberculosis
HLGDPPRR

SEQ ID NO: 24981 - protein, 8 aa, Mycobacterium tuberculosis
LGDPPRRC

SEQ ID NO: 24982 - protein, 8 aa, Mycobacterium tuberculosis
GDPPRRCD

SEQ ID NO: 24983 - protein, 8 aa, Mycobacterium tuberculosis
DPPRRCDT

SEQ ID NO: 24984 - protein, 8 aa, Mycobacterium tuberculosis
PPRRCDTH

SEQ ID NO: 24985 - protein, 8 aa, Mycobacterium tuberculosis
PRRCDTHP

SEQ ID NO: 24986 - protein, 8 aa, Mycobacterium tuberculosis
RRCDTHPD

SEQ ID NO: 24987 - protein, 8 aa, Mycobacterium tuberculosis
RCDTHPDG

SEQ ID NO: 24988 - protein, 8 aa, Mycobacterium tuberculosis
CDTHPDGT

SEQ ID NO: 24989 - protein, 8 aa, Mycobacterium tuberculosis
DTHPDGTS

SEQ ID NO: 24990 - protein, 8 aa, Mycobacterium tuberculosis
THPDGTSS

SEQ ID NO: 24991 - protein, 8 aa, Mycobacterium tuberculosis
HPDGTSSA

SEQ ID NO: 24992 - protein, 8 aa, Mycobacterium tuberculosis
PDGTSSAA

SEQ ID NO: 24993 - protein, 8 aa, Mycobacterium tuberculosis
DGTSSAAA

SEQ ID NO: 24994 - protein, 8 aa, Mycobacterium tuberculosis
GTSSAAAA

SEQ ID NO: 24995 - protein, 8 aa, Mycobacterium tuberculosis
TSSAAAAL

SEQ ID NO: 24996 - protein, 8 aa, Mycobacterium tuberculosis
SSAAAALV

SEQ ID NO: 24997 - protein, 8 aa, Mycobacterium tuberculosis
SAAAALVL

SEQ ID NO: 24998 - protein, 8 aa, Mycobacterium tuberculosis
AAAALVLR

SEQ ID NO: 24999 - protein, 8 aa, Mycobacterium tuberculosis
AAALVLRR

SEQ ID NO: 25000 - protein, 8 aa, Mycobacterium tuberculosis
AALVLRRI

SEQ ID NO: 25001 - protein, 8 aa, Mycobacterium tuberculosis
ALVLRRID

SEQ ID NO: 25002 - protein, 8 aa, Mycobacterium tuberculosis
LVLRRIDV

SEQ ID NO: 25003 - protein, 8 aa, Mycobacterium tuberculosis
VLRRIDVH

SEQ ID NO: 25004 - protein, 8 aa, Mycobacterium tuberculosis
LRRIDVHP

SEQ ID NO: 25005 - protein, 8 aa, Mycobacterium tuberculosis
RRIDVHPL

SEQ ID NO: 25006 - protein, 8 aa, Mycobacterium tuberculosis
RIDVHPLL

SEQ ID NO: 25007 - protein, 8 aa, Mycobacterium tuberculosis
IDVHPLLT

SEQ ID NO: 25008 - protein, 8 aa, Mycobacterium tuberculosis
DVHPLLTG

SEQ ID NO: 25009 - protein, 8 aa, Mycobacterium tuberculosis
VHPLLTGL

SEQ ID NO: 25010 - protein, 8 aa, Mycobacterium tuberculosis
HPLLTGLG

SEQ ID NO: 25011 - protein, 8 aa, Mycobacterium tuberculosis
PLLTGLGR

SEQ ID NO: 25012 - protein, 8 aa, Mycobacterium tuberculosis
LLTGLGRG

SEQ ID NO: 25013 - protein, 8 aa, Mycobacterium tuberculosis
LTGLGRGR

SEQ ID NO: 25014 - protein, 8 aa, Mycobacterium tuberculosis
TGLGRGRQ

SEQ ID NO: 25015 - protein, 8 aa, Mycobacterium tuberculosis
GLGRGRQT

SEQ ID NO: 25016 - protein, 8 aa, Mycobacterium tuberculosis
LGRGRQTV

SEQ ID NO: 25017 - protein, 8 aa, Mycobacterium tuberculosis
GRGRQTVS

SEQ ID NO: 25018 - protein, 8 aa, Mycobacterium tuberculosis
RGRQTVSL

SEQ ID NO: 25019 - protein, 8 aa, Mycobacterium tuberculosis
GRQTVSLR

SEQ ID NO: 25020 - protein, 8 aa, Mycobacterium tuberculosis
RQTVSLRN

SEQ ID NO: 25021 - protein, 8 aa, Mycobacterium tuberculosis
QTVSLRNG

SEQ ID NO: 25022 - protein, 8 aa, Mycobacterium tuberculosis
TVSLRNGH

SEQ ID NO: 25023 - protein, 8 aa, Mycobacterium tuberculosis
VSLRNGHL

SEQ ID NO: 25024 - protein, 8 aa, Mycobacterium tuberculosis
SLRNGHLV

SEQ ID NO: 25025 - protein, 8 aa, Mycobacterium tuberculosis
LRNGHLVA

SEQ ID NO: 25026 - protein, 8 aa, Mycobacterium tuberculosis
RNGHLVAT

SEQ ID NO: 25027 - protein, 8 aa, Mycobacterium tuberculosis
NGHLVATA

SEQ ID NO: 25028 - protein, 8 aa, Mycobacterium tuberculosis
GHLVATAN

SEQ ID NO: 25029 - protein, 8 aa, Mycobacterium tuberculosis
HLVATANR

SEQ ID NO: 25030 - protein, 8 aa, Mycobacterium tuberculosis
LVATANRA

SEQ ID NO: 25031 - protein, 8 aa, Mycobacterium tuberculosis
VATANRAI

SEQ ID NO: 25032 - protein, 8 aa, Mycobacterium tuberculosis
ATANRAIL

SEQ ID NO: 25033 - protein, 8 aa, Mycobacterium tuberculosis
TANRAILS

SEQ ID NO: 25034 - protein, 8 aa, Mycobacterium tuberculosis
ANRAILSR

SEQ ID NO: 25035 - protein, 8 aa, Mycobacterium tuberculosis
NRAILSRR

SEQ ID NO: 25036 - protein, 8 aa, Mycobacterium tuberculosis
RAILSRRR

SEQ ID NO: 25037 - protein, 8 aa, Mycobacterium tuberculosis
AILSRRRS

SEQ ID NO: 25038 - protein, 8 aa, Mycobacterium tuberculosis
ILSRRRSR

SEQ ID NO: 25039 - protein, 8 aa, Mycobacterium tuberculosis
LSRRRSRL

SEQ ID NO: 25040 - protein, 8 aa, Mycobacterium tuberculosis
SRRRSRLT

SEQ ID NO: 25041 - protein, 8 aa, Mycobacterium tuberculosis
RRRSRLTR

SEQ ID NO: 25042 - protein, 8 aa, Mycobacterium tuberculosis
RRSRLTRG

SEQ ID NO: 25043 - protein, 8 aa, Mycobacterium tuberculosis
RSRLTRGR

SEQ ID NO: 25044 - protein, 8 aa, Mycobacterium tuberculosis
SRLTRGRS

SEQ ID NO: 25045 - protein, 8 aa, Mycobacterium tuberculosis
RLTRGRSF

SEQ ID NO: 25046 - protein, 8 aa, Mycobacterium tuberculosis
LTRGRSFT

SEQ ID NO: 25047 - protein, 8 aa, Mycobacterium tuberculosis
TRGRSFTS

SEQ ID NO: 25048 - protein, 8 aa, Mycobacterium tuberculosis
RGRSFTSH

SEQ ID NO: 25049 - protein, 8 aa, Mycobacterium tuberculosis
GRSFTSHL

SEQ ID NO: 25050 - protein, 8 aa, Mycobacterium tuberculosis
RSFTSHLI

SEQ ID NO: 25051 - protein, 8 aa, Mycobacterium tuberculosis
SFTSHLIT

SEQ ID NO: 25052 - protein, 8 aa, Mycobacterium tuberculosis
FTSHLITS

SEQ ID NO: 25053 - protein, 8 aa, Mycobacterium tuberculosis
TSHLITSC

SEQ ID NO: 25054 - protein, 8 aa, Mycobacterium tuberculosis
SHLITSCP

SEQ ID NO: 25055 - protein, 8 aa, Mycobacterium tuberculosis
HLITSCPR

SEQ ID NO: 25056 - protein, 8 aa, Mycobacterium tuberculosis
LITSCPRL

SEQ ID NO: 25057 - protein, 8 aa, Mycobacterium tuberculosis
ITSCPRLD

SEQ ID NO: 25058 - protein, 8 aa, Mycobacterium tuberculosis
TSCPRLDD

SEQ ID NO: 25059 - protein, 8 aa, Mycobacterium tuberculosis
SCPRLDDH

SEQ ID NO: 25060 - protein, 8 aa, Mycobacterium tuberculosis
CPRLDDHQ

SEQ ID NO: 25061 - protein, 8 aa, Mycobacterium tuberculosis
PRLDDHQH

SEQ ID NO: 25062 - protein, 8 aa, Mycobacterium tuberculosis
RLDDHQHR

SEQ ID NO: 25063 - protein, 8 aa, Mycobacterium tuberculosis
LDDHQHRH

SEQ ID NO: 25064 - protein, 8 aa, Mycobacterium tuberculosis
DDHQHRHP

SEQ ID NO: 25065 - protein, 8 aa, Mycobacterium tuberculosis
DHQHRHPT

SEQ ID NO: 25066 - protein, 8 aa, Mycobacterium tuberculosis
HQHRHPTR

SEQ ID NO: 25067 - protein, 8 aa, Mycobacterium tuberculosis
QHRHPTRC

SEQ ID NO: 25068 - protein, 8 aa, Mycobacterium tuberculosis
HRHPTRCR

SEQ ID NO: 25069 - protein, 8 aa, Mycobacterium tuberculosis
RHPTRCRA

SEQ ID NO: 25070 - protein, 8 aa, Mycobacterium tuberculosis
HPTRCRAE

SEQ ID NO: 25071 - protein, 8 aa, Mycobacterium tuberculosis
PTRCRAEH

SEQ ID NO: 25072 - protein, 8 aa, Mycobacterium tuberculosis
TRCRAEHA

SEQ ID NO: 25073 - protein, 8 aa, Mycobacterium tuberculosis
RCRAEHAG

SEQ ID NO: 25074 - protein, 8 aa, Mycobacterium tuberculosis
CRAEHAGC

SEQ ID NO: 25075 - protein, 8 aa, Mycobacterium tuberculosis
RAEHAGCT

SEQ ID NO: 25076 - protein, 8 aa, Mycobacterium tuberculosis
AEHAGCTV

SEQ ID NO: 25077 - protein, 8 aa, Mycobacterium tuberculosis
EHAGCTVA

SEQ ID NO: 25078 - protein, 8 aa, Mycobacterium tuberculosis
HAGCTVAT

SEQ ID NO: 25079 - protein, 8 aa, Mycobacterium tuberculosis
AGCTVATC

SEQ ID NO: 25080 - protein, 8 aa, Mycobacterium tuberculosis
GCTVATCI

SEQ ID NO: 25081 - protein, 8 aa, Mycobacterium tuberculosis
CTVATCIP

SEQ ID NO: 25082 - protein, 8 aa, Mycobacterium tuberculosis
TVATCIPN

SEQ ID NO: 25083 - protein, 8 aa, Mycobacterium tuberculosis
VATCIPNA

SEQ ID NO: 25084 - protein, 8 aa, Mycobacterium tuberculosis
ATCIPNAH

SEQ ID NO: 25085 - protein, 8 aa, Mycobacterium tuberculosis
TCIPNAHD

SEQ ID NO: 25086 - protein, 8 aa, Mycobacterium tuberculosis
CIPNAHDP

SEQ ID NO: 25087 - protein, 8 aa, Mycobacterium tuberculosis
IPNAHDPA

SEQ ID NO: 25088 - protein, 8 aa, Mycobacterium tuberculosis
PNAHDPAP

SEQ ID NO: 25089 - protein, 8 aa, Mycobacterium tuberculosis
NAHDPAPG

SEQ ID NO: 25090 - protein, 8 aa, Mycobacterium tuberculosis
AHDPAPGH

SEQ ID NO: 25091 - protein, 8 aa, Mycobacterium tuberculosis
HDPAPGHQ

SEQ ID NO: 25092 - protein, 8 aa, Mycobacterium tuberculosis
DPAPGHQT

SEQ ID NO: 25093 - protein, 8 aa, Mycobacterium tuberculosis
PAPGHQTP

SEQ ID NO: 25094 - protein, 8 aa, Mycobacterium tuberculosis
APGHQTPR

SEQ ID NO: 25095 - protein, 8 aa, Mycobacterium tuberculosis
PGHQTPRW

SEQ ID NO: 25096 - protein, 8 aa, Mycobacterium tuberculosis
GHQTPRWG

SEQ ID NO: 25097 - protein, 8 aa, Mycobacterium tuberculosis
HQTPRWGP

SEQ ID NO: 25098 - protein, 8 aa, Mycobacterium tuberculosis
QTPRWGPF

SEQ ID NO: 25099 - protein, 8 aa, Mycobacterium tuberculosis
TPRWGPFR

SEQ ID NO: 25100 - protein, 8 aa, Mycobacterium tuberculosis
PRWGPFRL

SEQ ID NO: 25101 - protein, 8 aa, Mycobacterium tuberculosis
RWGPFRLK

SEQ ID NO: 25102 - protein, 8 aa, Mycobacterium tuberculosis
WGPFRLKP

SEQ ID NO: 25103 - protein, 8 aa, Mycobacterium tuberculosis
GPFRLKPA

SEQ ID NO: 25104 - protein, 8 aa, Mycobacterium tuberculosis
PFRLKPAY

SEQ ID NO: 25105 - protein, 8 aa, Mycobacterium tuberculosis
FRLKPAYT

SEQ ID NO: 25106 - protein, 8 aa, Mycobacterium tuberculosis
RLKPAYTR

SEQ ID NO: 25107 - protein, 8 aa, Mycobacterium tuberculosis
LKPAYTRI

SEQ ID NO: 25108 - protein, 9 aa, Mycobacterium tuberculosis
MAAGSGGGT

SEQ ID NO: 25109 - protein, 9 aa, Mycobacterium tuberculosis
AAGSGGGTV

SEQ ID NO: 25110 - protein, 9 aa, Mycobacterium tuberculosis
AGSGGGTVG

SEQ ID NO: 25111 - protein, 9 aa, Mycobacterium tuberculosis
GSGGGTVGL

SEQ ID NO: 25112 - protein, 9 aa, Mycobacterium tuberculosis
SGGGTVGLV

SEQ ID NO: 25113 - protein, 9 aa, Mycobacterium tuberculosis
GGGTVGLVL

SEQ ID NO: 25114 - protein, 9 aa, Mycobacterium tuberculosis
GGTVGLVLP

SEQ ID NO: 25115 - protein, 9 aa, Mycobacterium tuberculosis
GTVGLVLPR

SEQ ID NO: 25116 - protein, 9 aa, Mycobacterium tuberculosis
TVGLVLPRV

SEQ ID NO: 25117 - protein, 9 aa, Mycobacterium tuberculosis
VGLVLPRVA

SEQ ID NO: 25118 - protein, 9 aa, Mycobacterium tuberculosis
GLVLPRVAS

SEQ ID NO: 25119 - protein, 9 aa, Mycobacterium tuberculosis
LVLPRVASL

SEQ ID NO: 25120 - protein, 9 aa, Mycobacterium tuberculosis
VLPRVASLS

SEQ ID NO: 25121 - protein, 9 aa, Mycobacterium tuberculosis
LPRVASLSG

SEQ ID NO: 25122 - protein, 9 aa, Mycobacterium tuberculosis
PRVASLSGL

SEQ ID NO: 25123 - protein, 9 aa, Mycobacterium tuberculosis
RVASLSGLD

SEQ ID NO: 25124 - protein, 9 aa, Mycobacterium tuberculosis
VASLSGLDG

SEQ ID NO: 25125 - protein, 9 aa, Mycobacterium tuberculosis
ASLSGLDGA

SEQ ID NO: 25126 - protein, 9 aa, Mycobacterium tuberculosis
SLSGLDGAP

SEQ ID NO: 25127 - protein, 9 aa, Mycobacterium tuberculosis
LSGLDGAPT

SEQ ID NO: 25128 - protein, 9 aa, Mycobacterium tuberculosis
SGLDGAPTV

SEQ ID NO: 25129 - protein, 9 aa, Mycobacterium tuberculosis
GLDGAPTVP

SEQ ID NO: 25130 - protein, 9 aa, Mycobacterium tuberculosis
LDGAPTVPE

SEQ ID NO: 25131 - protein, 9 aa, Mycobacterium tuberculosis
DGAPTVPEG

SEQ ID NO: 25132 - protein, 9 aa, Mycobacterium tuberculosis
GAPTVPEGS

SEQ ID NO: 25133 - protein, 9 aa, Mycobacterium tuberculosis
APTVPEGSD

SEQ ID NO: 25134 - protein, 9 aa, Mycobacterium tuberculosis
PTVPEGSDK

SEQ ID NO: 25135 - protein, 9 aa, Mycobacterium tuberculosis
TVPEGSDKA

SEQ ID NO: 25136 - protein, 9 aa, Mycobacterium tuberculosis
VPEGSDKAL

SEQ ID NO: 25137 - protein, 9 aa, Mycobacterium tuberculosis
PEGSDKALM

SEQ ID NO: 25138 - protein, 9 aa, Mycobacterium tuberculosis
EGSDKALMH

SEQ ID NO: 25139 - protein, 9 aa, Mycobacterium tuberculosis
GSDKALMHL

SEQ ID NO: 25140 - protein, 9 aa, Mycobacterium tuberculosis
SDKALMHLG

SEQ ID NO: 25141 - protein, 9 aa, Mycobacterium tuberculosis
DKALMHLGD

SEQ ID NO: 25142 - protein, 9 aa, Mycobacterium tuberculosis
KALMHLGDP

SEQ ID NO: 25143 - protein, 9 aa, Mycobacterium tuberculosis
ALMHLGDPP

SEQ ID NO: 25144 - protein, 9 aa, Mycobacterium tuberculosis
LMHLGDPPR

SEQ ID NO: 25145 - protein, 9 aa, Mycobacterium tuberculosis
MHLGDPPRR

SEQ ID NO: 25146 - protein, 9 aa, Mycobacterium tuberculosis
HLGDPPRRC

SEQ ID NO: 25147 - protein, 9 aa, Mycobacterium tuberculosis
LGDPPRRCD

SEQ ID NO: 25148 - protein, 9 aa, Mycobacterium tuberculosis
GDPPRRCDT

SEQ ID NO: 25149 - protein, 9 aa, Mycobacterium tuberculosis
DPPRRCDTH

SEQ ID NO: 25150 - protein, 9 aa, Mycobacterium tuberculosis
PPRRCDTHP

SEQ ID NO: 25151 - protein, 9 aa, Mycobacterium tuberculosis
PRRCDTHPD

SEQ ID NO: 25152 - protein, 9 aa, Mycobacterium tuberculosis
RRCDTHPDG

SEQ ID NO: 25153 - protein, 9 aa, Mycobacterium tuberculosis
RCDTHPDGT

SEQ ID NO: 25154 - protein, 9 aa, Mycobacterium tuberculosis
CDTHPDGTS

SEQ ID NO: 25155 - protein, 9 aa, Mycobacterium tuberculosis
DTHPDGTSS

SEQ ID NO: 25156 - protein, 9 aa, Mycobacterium tuberculosis
THPDGTSSA

SEQ ID NO: 25157 - protein, 9 aa, Mycobacterium tuberculosis
HPDGTSSAA

SEQ ID NO: 25158 - protein, 9 aa, Mycobacterium tuberculosis
PDGTSSAAA

SEQ ID NO: 25159 - protein, 9 aa, Mycobacterium tuberculosis
DGTSSAAAA

SEQ ID NO: 25160 - protein, 9 aa, Mycobacterium tuberculosis
GTSSAAAAL

SEQ ID NO: 25161 - protein, 9 aa, Mycobacterium tuberculosis
TSSAAAALV

SEQ ID NO: 25162 - protein, 9 aa, Mycobacterium tuberculosis
SSAAAALVL

SEQ ID NO: 25163 - protein, 9 aa, Mycobacterium tuberculosis
SAAAALVLR

SEQ ID NO: 25164 - protein, 9 aa, Mycobacterium tuberculosis
AAAALVLRR

SEQ ID NO: 25165 - protein, 9 aa, Mycobacterium tuberculosis
AAALVLRRI

SEQ ID NO: 25166 - protein, 9 aa, Mycobacterium tuberculosis
AALVLRRID

SEQ ID NO: 25167 - protein, 9 aa, Mycobacterium tuberculosis
ALVLRRIDV

SEQ ID NO: 25168 - protein, 9 aa, Mycobacterium tuberculosis
LVLRRIDVH

SEQ ID NO: 25169 - protein, 9 aa, Mycobacterium tuberculosis
VLRRIDVHP

SEQ ID NO: 25170 - protein, 9 aa, Mycobacterium tuberculosis
LRRIDVHPL

SEQ ID NO: 25171 - protein, 9 aa, Mycobacterium tuberculosis
RRIDVHPLL

SEQ ID NO: 25172 - protein, 9 aa, Mycobacterium tuberculosis
RIDVHPLLT

SEQ ID NO: 25173 - protein, 9 aa, Mycobacterium tuberculosis
IDVHPLLTG

SEQ ID NO: 25174 - protein, 9 aa, Mycobacterium tuberculosis
DVHPLLTGL

SEQ ID NO: 25175 - protein, 9 aa, Mycobacterium tuberculosis
VHPLLTGLG

SEQ ID NO: 25176 - protein, 9 aa, Mycobacterium tuberculosis
HPLLTGLGR

SEQ ID NO: 25177 - protein, 9 aa, Mycobacterium tuberculosis
PLLTGLGRG

SEQ ID NO: 25178 - protein, 9 aa, Mycobacterium tuberculosis
LLTGLGRGR

SEQ ID NO: 25179 - protein, 9 aa, Mycobacterium tuberculosis
LTGLGRGRQ

SEQ ID NO: 25180 - protein, 9 aa, Mycobacterium tuberculosis
TGLGRGRQT

SEQ ID NO: 25181 - protein, 9 aa, Mycobacterium tuberculosis
GLGRGRQTV

SEQ ID NO: 25182 - protein, 9 aa, Mycobacterium tuberculosis
LGRGRQTVS

SEQ ID NO: 25183 - protein, 9 aa, Mycobacterium tuberculosis
GRGRQTVSL

SEQ ID NO: 25184 - protein, 9 aa, Mycobacterium tuberculosis
RGRQTVSLR

SEQ ID NO: 25185 - protein, 9 aa, Mycobacterium tuberculosis
GRQTVSLRN

SEQ ID NO: 25186 - protein, 9 aa, Mycobacterium tuberculosis
RQTVSLRNG

SEQ ID NO: 25187 - protein, 9 aa, Mycobacterium tuberculosis
QTVSLRNGH

SEQ ID NO: 25188 - protein, 9 aa, Mycobacterium tuberculosis
TVSLRNGHL

SEQ ID NO: 25189 - protein, 9 aa, Mycobacterium tuberculosis
VSLRNGHLV

SEQ ID NO: 25190 - protein, 9 aa, Mycobacterium tuberculosis
SLRNGHLVA

SEQ ID NO: 25191 - protein, 9 aa, Mycobacterium tuberculosis
LRNGHLVAT

SEQ ID NO: 25192 - protein, 9 aa, Mycobacterium tuberculosis
RNGHLVATA

SEQ ID NO: 25193 - protein, 9 aa, Mycobacterium tuberculosis
NGHLVATAN

SEQ ID NO: 25194 - protein, 9 aa, Mycobacterium tuberculosis
GHLVATANR

SEQ ID NO: 25195 - protein, 9 aa, Mycobacterium tuberculosis
HLVATANRA

SEQ ID NO: 25196 - protein, 9 aa, Mycobacterium tuberculosis
LVATANRAI

SEQ ID NO: 25197 - protein, 9 aa, Mycobacterium tuberculosis
VATANRAIL

SEQ ID NO: 25198 - protein, 9 aa, Mycobacterium tuberculosis
ATANRAILS

SEQ ID NO: 25199 - protein, 9 aa, Mycobacterium tuberculosis
TANRAILSR

SEQ ID NO: 25200 - protein, 9 aa, Mycobacterium tuberculosis
ANRAILSRR

SEQ ID NO: 25201 - protein, 9 aa, Mycobacterium tuberculosis
NRAILSRRR

SEQ ID NO: 25202 - protein, 9 aa, Mycobacterium tuberculosis
RAILSRRRS

SEQ ID NO: 25203 - protein, 9 aa, Mycobacterium tuberculosis
AILSRRRSR

SEQ ID NO: 25204 - protein, 9 aa, Mycobacterium tuberculosis
ILSRRRSRL

SEQ ID NO: 25205 - protein, 9 aa, Mycobacterium tuberculosis
LSRRRSRLT

SEQ ID NO: 25206 - protein, 9 aa, Mycobacterium tuberculosis
SRRRSRLTR

SEQ ID NO: 25207 - protein, 9 aa, Mycobacterium tuberculosis
RRRSRLTRG

SEQ ID NO: 25208 - protein, 9 aa, Mycobacterium tuberculosis
RRSRLTRGR

SEQ ID NO: 25209 - protein, 9 aa, Mycobacterium tuberculosis
RSRLTRGRS

SEQ ID NO: 25210 - protein, 9 aa, Mycobacterium tuberculosis
SRLTRGRSF

SEQ ID NO: 25211 - protein, 9 aa, Mycobacterium tuberculosis
RLTRGRSFT

SEQ ID NO: 25212 - protein, 9 aa, Mycobacterium tuberculosis
LTRGRSFTS

SEQ ID NO: 25213 - protein, 9 aa, Mycobacterium tuberculosis
TRGRSFTSH

SEQ ID NO: 25214 - protein, 9 aa, Mycobacterium tuberculosis
RGRSFTSHL

SEQ ID NO: 25215 - protein, 9 aa, Mycobacterium tuberculosis
GRSFTSHLI

SEQ ID NO: 25216 - protein, 9 aa, Mycobacterium tuberculosis
RSFTSHLIT

SEQ ID NO: 25217 - protein, 9 aa, Mycobacterium tuberculosis
SFTSHLITS

SEQ ID NO: 25218 - protein, 9 aa, Mycobacterium tuberculosis
FTSHLITSC

SEQ ID NO: 25219 - protein, 9 aa, Mycobacterium tuberculosis
TSHLITSCP

SEQ ID NO: 25220 - protein, 9 aa, Mycobacterium tuberculosis
SHLITSCPR

SEQ ID NO: 25221 - protein, 9 aa, Mycobacterium tuberculosis
HLITSCPRL

SEQ ID NO: 25222 - protein, 9 aa, Mycobacterium tuberculosis
LITSCPRLD

SEQ ID NO: 25223 - protein, 9 aa, Mycobacterium tuberculosis
ITSCPRLDD

SEQ ID NO: 25224 - protein, 9 aa, Mycobacterium tuberculosis
TSCPRLDDH

SEQ ID NO: 25225 - protein, 9 aa, Mycobacterium tuberculosis
SCPRLDDHQ

SEQ ID NO: 25226 - protein, 9 aa, Mycobacterium tuberculosis
CPRLDDHQH

SEQ ID NO: 25227 - protein, 9 aa, Mycobacterium tuberculosis
PRLDDHQHR

SEQ ID NO: 25228 - protein, 9 aa, Mycobacterium tuberculosis
RLDDHQHRH

SEQ ID NO: 25229 - protein, 9 aa, Mycobacterium tuberculosis
LDDHQHRHP

SEQ ID NO: 25230 - protein, 9 aa, Mycobacterium tuberculosis
DDHQHRHPT

SEQ ID NO: 25231 - protein, 9 aa, Mycobacterium tuberculosis
DHQHRHPTR

SEQ ID NO: 25232 - protein, 9 aa, Mycobacterium tuberculosis
HQHRHPTRC

SEQ ID NO: 25233 - protein, 9 aa, Mycobacterium tuberculosis
QHRHPTRCR

SEQ ID NO: 25234 - protein, 9 aa, Mycobacterium tuberculosis
HRHPTRCRA

SEQ ID NO: 25235 - protein, 9 aa, Mycobacterium tuberculosis
RHPTRCRAE

SEQ ID NO: 25236 - protein, 9 aa, Mycobacterium tuberculosis
HPTRCRAEH

SEQ ID NO: 25237 - protein, 9 aa, Mycobacterium tuberculosis
PTRCRAEHA

SEQ ID NO: 25238 - protein, 9 aa, Mycobacterium tuberculosis
TRCRAEHAG

SEQ ID NO: 25239 - protein, 9 aa, Mycobacterium tuberculosis
RCRAEHAGC

SEQ ID NO: 25240 - protein, 9 aa, Mycobacterium tuberculosis
CRAEHAGCT

SEQ ID NO: 25241 - protein, 9 aa, Mycobacterium tuberculosis
RAEHAGCTV

SEQ ID NO: 25242 - protein, 9 aa, Mycobacterium tuberculosis
AEHAGCTVA

SEQ ID NO: 25243 - protein, 9 aa, Mycobacterium tuberculosis
EHAGCTVAT

SEQ ID NO: 25244 - protein, 9 aa, Mycobacterium tuberculosis
HAGCTVATC

SEQ ID NO: 25245 - protein, 9 aa, Mycobacterium tuberculosis
AGCTVATCI

SEQ ID NO: 25246 - protein, 9 aa, Mycobacterium tuberculosis
GCTVATCIP

SEQ ID NO: 25247 - protein, 9 aa, Mycobacterium tuberculosis
CTVATCIPN

SEQ ID NO: 25248 - protein, 9 aa, Mycobacterium tuberculosis
TVATCIPNA

SEQ ID NO: 25249 - protein, 9 aa, Mycobacterium tuberculosis
VATCIPNAH

SEQ ID NO: 25250 - protein, 9 aa, Mycobacterium tuberculosis
ATCIPNAHD

SEQ ID NO: 25251 - protein, 9 aa, Mycobacterium tuberculosis
TCIPNAHDP

SEQ ID NO: 25252 - protein, 9 aa, Mycobacterium tuberculosis
CIPNAHDPA

SEQ ID NO: 25253 - protein, 9 aa, Mycobacterium tuberculosis
IPNAHDPAP

SEQ ID NO: 25254 - protein, 9 aa, Mycobacterium tuberculosis
PNAHDPAPG

SEQ ID NO: 25255 - protein, 9 aa, Mycobacterium tuberculosis
NAHDPAPGH

SEQ ID NO: 25256 - protein, 9 aa, Mycobacterium tuberculosis
AHDPAPGHQ

SEQ ID NO: 25257 - protein, 9 aa, Mycobacterium tuberculosis
HDPAPGHQT

SEQ ID NO: 25258 - protein, 9 aa, Mycobacterium tuberculosis
DPAPGHQTP

SEQ ID NO: 25259 - protein, 9 aa, Mycobacterium tuberculosis
PAPGHQTPR

SEQ ID NO: 25260 - protein, 9 aa, Mycobacterium tuberculosis
APGHQTPRW

SEQ ID NO: 25261 - protein, 9 aa, Mycobacterium tuberculosis
PGHQTPRWG

SEQ ID NO: 25262 - protein, 9 aa, Mycobacterium tuberculosis
GHQTPRWGP

SEQ ID NO: 25263 - protein, 9 aa, Mycobacterium tuberculosis
HQTPRWGPF

SEQ ID NO: 25264 - protein, 9 aa, Mycobacterium tuberculosis
QTPRWGPFR

SEQ ID NO: 25265 - protein, 9 aa, Mycobacterium tuberculosis
TPRWGPFRL

SEQ ID NO: 25266 - protein, 9 aa, Mycobacterium tuberculosis
PRWGPFRLK

SEQ ID NO: 25267 - protein, 9 aa, Mycobacterium tuberculosis
RWGPFRLKP

SEQ ID NO: 25268 - protein, 9 aa, Mycobacterium tuberculosis
WGPFRLKPA

SEQ ID NO: 25269 - protein, 9 aa, Mycobacterium tuberculosis
GPFRLKPAY

SEQ ID NO: 25270 - protein, 9 aa, Mycobacterium tuberculosis
PFRLKPAYT

SEQ ID NO: 25271 - protein, 9 aa, Mycobacterium tuberculosis
FRLKPAYTR

SEQ ID NO: 25272 - protein, 10 aa, Mycobacterium tuberculosis
MAAGSGGGTV

SEQ ID NO: 25273 - protein, 10 aa, Mycobacterium tuberculosis
AAGSGGGTVG

SEQ ID NO: 25274 - protein, 10 aa, Mycobacterium tuberculosis
AGSGGGTVGL

SEQ ID NO: 25275 - protein, 10 aa, Mycobacterium tuberculosis
GSGGGTVGLV

SEQ ID NO: 25276 - protein, 10 aa, Mycobacterium tuberculosis
SGGGTVGLVL

SEQ ID NO: 25277 - protein, 10 aa, Mycobacterium tuberculosis
GGGTVGLVLP

SEQ ID NO: 25278 - protein, 10 aa, Mycobacterium tuberculosis
GGTVGLVLPR

SEQ ID NO: 25279 - protein, 10 aa, Mycobacterium tuberculosis
GTVGLVLPRV

SEQ ID NO: 25280 - protein, 10 aa, Mycobacterium tuberculosis
TVGLVLPRVA

SEQ ID NO: 25281 - protein, 10 aa, Mycobacterium tuberculosis
VGLVLPRVAS

SEQ ID NO: 25282 - protein, 10 aa, Mycobacterium tuberculosis
GLVLPRVASL

SEQ ID NO: 25283 - protein, 10 aa, Mycobacterium tuberculosis
LVLPRVASLS

SEQ ID NO: 25284 - protein, 10 aa, Mycobacterium tuberculosis
VLPRVASLSG

SEQ ID NO: 25285 - protein, 10 aa, Mycobacterium tuberculosis
LPRVASLSGL

SEQ ID NO: 25286 - protein, 10 aa, Mycobacterium tuberculosis
PRVASLSGLD

SEQ ID NO: 25287 - protein, 10 aa, Mycobacterium tuberculosis
RVASLSGLDG

SEQ ID NO: 25288 - protein, 10 aa, Mycobacterium tuberculosis
VASLSGLDGA

SEQ ID NO: 25289 - protein, 10 aa, Mycobacterium tuberculosis
ASLSGLDGAP

SEQ ID NO: 25290 - protein, 10 aa, Mycobacterium tuberculosis
SLSGLDGAPT

SEQ ID NO: 25291 - protein, 10 aa, Mycobacterium tuberculosis
LSGLDGAPTV

SEQ ID NO: 25292 - protein, 10 aa, Mycobacterium tuberculosis
SGLDGAPTVP

SEQ ID NO: 25293 - protein, 10 aa, Mycobacterium tuberculosis
GLDGAPTVPE

SEQ ID NO: 25294 - protein, 10 aa, Mycobacterium tuberculosis
LDGAPTVPEG

SEQ ID NO: 25295 - protein, 10 aa, Mycobacterium tuberculosis
DGAPTVPEGS

SEQ ID NO: 25296 - protein, 10 aa, Mycobacterium tuberculosis
GAPTVPEGSD

SEQ ID NO: 25297 - protein, 10 aa, Mycobacterium tuberculosis
APTVPEGSDK

SEQ ID NO: 25298 - protein, 10 aa, Mycobacterium tuberculosis
PTVPEGSDKA

SEQ ID NO: 25299 - protein, 10 aa, Mycobacterium tuberculosis
TVPEGSDKAL

SEQ ID NO: 25300 - protein, 10 aa, Mycobacterium tuberculosis
VPEGSDKALM

SEQ ID NO: 25301 - protein, 10 aa, Mycobacterium tuberculosis
PEGSDKALMH

SEQ ID NO: 25302 - protein, 10 aa, Mycobacterium tuberculosis
EGSDKALMHL

SEQ ID NO: 25303 - protein, 10 aa, Mycobacterium tuberculosis
GSDKALMHLG

SEQ ID NO: 25304 - protein, 10 aa, Mycobacterium tuberculosis
SDKALMHLGD

SEQ ID NO: 25305 - protein, 10 aa, Mycobacterium tuberculosis
DKALMHLGDP

SEQ ID NO: 25306 - protein, 10 aa, Mycobacterium tuberculosis
KALMHLGDPP

SEQ ID NO: 25307 - protein, 10 aa, Mycobacterium tuberculosis
ALMHLGDPPR

SEQ ID NO: 25308 - protein, 10 aa, Mycobacterium tuberculosis
LMHLGDPPRR

SEQ ID NO: 25309 - protein, 10 aa, Mycobacterium tuberculosis
MHLGDPPRRC

SEQ ID NO: 25310 - protein, 10 aa, Mycobacterium tuberculosis
HLGDPPRRCD

SEQ ID NO: 25311 - protein, 10 aa, Mycobacterium tuberculosis
LGDPPRRCDT

SEQ ID NO: 25312 - protein, 10 aa, Mycobacterium tuberculosis
GDPPRRCDTH

SEQ ID NO: 25313 - protein, 10 aa, Mycobacterium tuberculosis
DPPRRCDTHP

SEQ ID NO: 25314 - protein, 10 aa, Mycobacterium tuberculosis
PPRRCDTHPD

SEQ ID NO: 25315 - protein, 10 aa, Mycobacterium tuberculosis
PRRCDTHPDG

SEQ ID NO: 25316 - protein, 10 aa, Mycobacterium tuberculosis
RRCDTHPDGT

SEQ ID NO: 25317 - protein, 10 aa, Mycobacterium tuberculosis
RCDTHPDGTS

SEQ ID NO: 25318 - protein, 10 aa, Mycobacterium tuberculosis
CDTHPDGTSS

SEQ ID NO: 25319 - protein, 10 aa, Mycobacterium tuberculosis
DTHPDGTSSA

SEQ ID NO: 25320 - protein, 10 aa, Mycobacterium tuberculosis
THPDGTSSAA

SEQ ID NO: 25321 - protein, 10 aa, Mycobacterium tuberculosis
HPDGTSSAAA

SEQ ID NO: 25322 - protein, 10 aa, Mycobacterium tuberculosis
PDGTSSAAAA

SEQ ID NO: 25323 - protein, 10 aa, Mycobacterium tuberculosis
DGTSSAAAAL

SEQ ID NO: 25324 - protein, 10 aa, Mycobacterium tuberculosis
GTSSAAAALV

SEQ ID NO: 25325 - protein, 10 aa, Mycobacterium tuberculosis
TSSAAAALVL

SEQ ID NO: 25326 - protein, 10 aa, Mycobacterium tuberculosis
SSAAAALVLR

SEQ ID NO: 25327 - protein, 10 aa, Mycobacterium tuberculosis
SAAAALVLRR

SEQ ID NO: 25328 - protein, 10 aa, Mycobacterium tuberculosis
AAAALVLRRI

SEQ ID NO: 25329 - protein, 10 aa, Mycobacterium tuberculosis
AAALVLRRID

SEQ ID NO: 25330 - protein, 10 aa, Mycobacterium tuberculosis
AALVLRRIDV

SEQ ID NO: 25331 - protein, 10 aa, Mycobacterium tuberculosis
ALVLRRIDVH

SEQ ID NO: 25332 - protein, 10 aa, Mycobacterium tuberculosis
LVLRRIDVHP

SEQ ID NO: 25333 - protein, 10 aa, Mycobacterium tuberculosis
VLRRIDVHPL

SEQ ID NO: 25334 - protein, 10 aa, Mycobacterium tuberculosis
LRRIDVHPLL

SEQ ID NO: 25335 - protein, 10 aa, Mycobacterium tuberculosis
RRIDVHPLLT

SEQ ID NO: 25336 - protein, 10 aa, Mycobacterium tuberculosis
RIDVHPLLTG

SEQ ID NO: 25337 - protein, 10 aa, Mycobacterium tuberculosis
IDVHPLLTGL

SEQ ID NO: 25338 - protein, 10 aa, Mycobacterium tuberculosis
DVHPLLTGLG

SEQ ID NO: 25339 - protein, 10 aa, Mycobacterium tuberculosis
VHPLLTGLGR

SEQ ID NO: 25340 - protein, 10 aa, Mycobacterium tuberculosis
HPLLTGLGRG

SEQ ID NO: 25341 - protein, 10 aa, Mycobacterium tuberculosis
PLLTGLGRGR

SEQ ID NO: 25342 - protein, 10 aa, Mycobacterium tuberculosis
LLTGLGRGRQ

SEQ ID NO: 25343 - protein, 10 aa, Mycobacterium tuberculosis
LTGLGRGRQT

SEQ ID NO: 25344 - protein, 10 aa, Mycobacterium tuberculosis
TGLGRGRQTV

SEQ ID NO: 25345 - protein, 10 aa, Mycobacterium tuberculosis
GLGRGRQTVS

SEQ ID NO: 25346 - protein, 10 aa, Mycobacterium tuberculosis
LGRGRQTVSL

SEQ ID NO: 25347 - protein, 10 aa, Mycobacterium tuberculosis
GRGRQTVSLR

SEQ ID NO: 25348 - protein, 10 aa, Mycobacterium tuberculosis
RGRQTVSLRN

SEQ ID NO: 25349 - protein, 10 aa, Mycobacterium tuberculosis
GRQTVSLRNG

SEQ ID NO: 25350 - protein, 10 aa, Mycobacterium tuberculosis
RQTVSLRNGH

SEQ ID NO: 25351 - protein, 10 aa, Mycobacterium tuberculosis
QTVSLRNGHL

SEQ ID NO: 25352 - protein, 10 aa, Mycobacterium tuberculosis
TVSLRNGHLV

SEQ ID NO: 25353 - protein, 10 aa, Mycobacterium tuberculosis
VSLRNGHLVA

SEQ ID NO: 25354 - protein, 10 aa, Mycobacterium tuberculosis
SLRNGHLVAT

SEQ ID NO: 25355 - protein, 10 aa, Mycobacterium tuberculosis
LRNGHLVATA

SEQ ID NO: 25356 - protein, 10 aa, Mycobacterium tuberculosis
RNGHLVATAN

SEQ ID NO: 25357 - protein, 10 aa, Mycobacterium tuberculosis
NGHLVATANR

SEQ ID NO: 25358 - protein, 10 aa, Mycobacterium tuberculosis
GHLVATANRA

SEQ ID NO: 25359 - protein, 10 aa, Mycobacterium tuberculosis
HLVATANRAI

SEQ ID NO: 25360 - protein, 10 aa, Mycobacterium tuberculosis
LVATANRAIL

SEQ ID NO: 25361 - protein, 10 aa, Mycobacterium tuberculosis
VATANRAILS

SEQ ID NO: 25362 - protein, 10 aa, Mycobacterium tuberculosis
ATANRAILSR

SEQ ID NO: 25363 - protein, 10 aa, Mycobacterium tuberculosis
TANRAILSRR

SEQ ID NO: 25364 - protein, 10 aa, Mycobacterium tuberculosis
ANRAILSRRR

SEQ ID NO: 25365 - protein, 10 aa, Mycobacterium tuberculosis
NRAILSRRRS

SEQ ID NO: 25366 - protein, 10 aa, Mycobacterium tuberculosis
RAILSRRRSR

SEQ ID NO: 25367 - protein, 10 aa, Mycobacterium tuberculosis
AILSRRRSRL

SEQ ID NO: 25368 - protein, 10 aa, Mycobacterium tuberculosis
ILSRRRSRLT

SEQ ID NO: 25369 - protein, 10 aa, Mycobacterium tuberculosis
LSRRRSRLTR

SEQ ID NO: 25370 - protein, 10 aa, Mycobacterium tuberculosis
SRRRSRLTRG

SEQ ID NO: 25371 - protein, 10 aa, Mycobacterium tuberculosis
RRRSRLTRGR

SEQ ID NO: 25372 - protein, 10 aa, Mycobacterium tuberculosis
RRSRLTRGRS

SEQ ID NO: 25373 - protein, 10 aa, Mycobacterium tuberculosis
RSRLTRGRSF

SEQ ID NO: 25374 - protein, 10 aa, Mycobacterium tuberculosis
SRLTRGRSFT

SEQ ID NO: 25375 - protein, 10 aa, Mycobacterium tuberculosis
RLTRGRSFTS

SEQ ID NO: 25376 - protein, 10 aa, Mycobacterium tuberculosis
LTRGRSFTSH

SEQ ID NO: 25377 - protein, 10 aa, Mycobacterium tuberculosis
TRGRSFTSHL

SEQ ID NO: 25378 - protein, 10 aa, Mycobacterium tuberculosis
RGRSFTSHLI

SEQ ID NO: 25379 - protein, 10 aa, Mycobacterium tuberculosis
GRSFTSHLIT

SEQ ID NO: 25380 - protein, 10 aa, Mycobacterium tuberculosis
RSFTSHLITS

SEQ ID NO: 25381 - protein, 10 aa, Mycobacterium tuberculosis
SFTSHLITSC

SEQ ID NO: 25382 - protein, 10 aa, Mycobacterium tuberculosis
FTSHLITSCP

SEQ ID NO: 25383 - protein, 10 aa, Mycobacterium tuberculosis
TSHLITSCPR

SEQ ID NO: 25384 - protein, 10 aa, Mycobacterium tuberculosis
SHLITSCPRL

SEQ ID NO: 25385 - protein, 10 aa, Mycobacterium tuberculosis
HLITSCPRLD

SEQ ID NO: 25386 - protein, 10 aa, Mycobacterium tuberculosis
LITSCPRLDD

SEQ ID NO: 25387 - protein, 10 aa, Mycobacterium tuberculosis
ITSCPRLDDH

SEQ ID NO: 25388 - protein, 10 aa, Mycobacterium tuberculosis
TSCPRLDDHQ

SEQ ID NO: 25389 - protein, 10 aa, Mycobacterium tuberculosis
SCPRLDDHQH

SEQ ID NO: 25390 - protein, 10 aa, Mycobacterium tuberculosis
CPRLDDHQHR

SEQ ID NO: 25391 - protein, 10 aa, Mycobacterium tuberculosis
PRLDDHQHRH

SEQ ID NO: 25392 - protein, 10 aa, Mycobacterium tuberculosis
RLDDHQHRHP

SEQ ID NO: 25393 - protein, 10 aa, Mycobacterium tuberculosis
LDDHQHRHPT

SEQ ID NO: 25394 - protein, 10 aa, Mycobacterium tuberculosis
DDHQHRHPTR

SEQ ID NO: 25395 - protein, 10 aa, Mycobacterium tuberculosis
DHQHRHPTRC

SEQ ID NO: 25396 - protein, 10 aa, Mycobacterium tuberculosis
HQHRHPTRCR

SEQ ID NO: 25397 - protein, 10 aa, Mycobacterium tuberculosis
QHRHPTRCRA

SEQ ID NO: 25398 - protein, 10 aa, Mycobacterium tuberculosis
HRHPTRCRAE

SEQ ID NO: 25399 - protein, 10 aa, Mycobacterium tuberculosis
RHPTRCRAEH

SEQ ID NO: 25400 - protein, 10 aa, Mycobacterium tuberculosis
HPTRCRAEHA

SEQ ID NO: 25401 - protein, 10 aa, Mycobacterium tuberculosis
PTRCRAEHAG

SEQ ID NO: 25402 - protein, 10 aa, Mycobacterium tuberculosis
TRCRAEHAGC

SEQ ID NO: 25403 - protein, 10 aa, Mycobacterium tuberculosis
RCRAEHAGCT

SEQ ID NO: 25404 - protein, 10 aa, Mycobacterium tuberculosis
CRAEHAGCTV

SEQ ID NO: 25405 - protein, 10 aa, Mycobacterium tuberculosis
RAEHAGCTVA

SEQ ID NO: 25406 - protein, 10 aa, Mycobacterium tuberculosis
AEHAGCTVAT

SEQ ID NO: 25407 - protein, 10 aa, Mycobacterium tuberculosis
EHAGCTVATC

SEQ ID NO: 25408 - protein, 10 aa, Mycobacterium tuberculosis
HAGCTVATCI

SEQ ID NO: 25409 - protein, 10 aa, Mycobacterium tuberculosis
AGCTVATCIP

SEQ ID NO: 25410 - protein, 10 aa, Mycobacterium tuberculosis
GCTVATCIPN

SEQ ID NO: 25411 - protein, 10 aa, Mycobacterium tuberculosis
CTVATCIPNA

SEQ ID NO: 25412 - protein, 10 aa, Mycobacterium tuberculosis
TVATCIPNAH

SEQ ID NO: 25413 - protein, 10 aa, Mycobacterium tuberculosis
VATCIPNAHD

SEQ ID NO: 25414 - protein, 10 aa, Mycobacterium tuberculosis
ATCIPNAHDP

SEQ ID NO: 25415 - protein, 10 aa, Mycobacterium tuberculosis
TCIPNAHDPA

SEQ ID NO: 25416 - protein, 10 aa, Mycobacterium tuberculosis
CIPNAHDPAP

SEQ ID NO: 25417 - protein, 10 aa, Mycobacterium tuberculosis
IPNAHDPAPG

SEQ ID NO: 25418 - protein, 10 aa, Mycobacterium tuberculosis
PNAHDPAPGH

SEQ ID NO: 25419 - protein, 10 aa, Mycobacterium tuberculosis
NAHDPAPGHQ

SEQ ID NO: 25420 - protein, 10 aa, Mycobacterium tuberculosis
AHDPAPGHQT

SEQ ID NO: 25421 - protein, 10 aa, Mycobacterium tuberculosis
HDPAPGHQTP

SEQ ID NO: 25422 - protein, 10 aa, Mycobacterium tuberculosis
DPAPGHQTPR

SEQ ID NO: 25423 - protein, 10 aa, Mycobacterium tuberculosis
PAPGHQTPRW

SEQ ID NO: 25424 - protein, 10 aa, Mycobacterium tuberculosis
APGHQTPRWG

SEQ ID NO: 25425 - protein, 10 aa, Mycobacterium tuberculosis
PGHQTPRWGP

SEQ ID NO: 25426 - protein, 10 aa, Mycobacterium tuberculosis
GHQTPRWGPF

SEQ ID NO: 25427 - protein, 10 aa, Mycobacterium tuberculosis
HQTPRWGPFR

SEQ ID NO: 25428 - protein, 10 aa, Mycobacterium tuberculosis
QTPRWGPFRL

SEQ ID NO: 25429 - protein, 10 aa, Mycobacterium tuberculosis
TPRWGPFRLK

SEQ ID NO: 25430 - protein, 10 aa, Mycobacterium tuberculosis
PRWGPFRLKP

SEQ ID NO: 25431 - protein, 10 aa, Mycobacterium tuberculosis
RWGPFRLKPA

SEQ ID NO: 25432 - protein, 10 aa, Mycobacterium tuberculosis
WGPFRLKPAY

SEQ ID NO: 25433 - protein, 10 aa, Mycobacterium tuberculosis
GPFRLKPAYT

SEQ ID NO: 25434 - protein, 10 aa, Mycobacterium tuberculosis
PFRLKPAYTR

SEQ ID NO: 25435 - protein, 10 aa, Mycobacterium tuberculosis
FRLKPAYTRI

SEQ ID NO: 25436 - protein, 11 aa, Mycobacterium tuberculosis
MAAGSGGGTVG

SEQ ID NO: 25437 - protein, 11 aa, Mycobacterium tuberculosis
AAGSGGGTVGL

SEQ ID NO: 25438 - protein, 11 aa, Mycobacterium tuberculosis
AGSGGGTVGLV

SEQ ID NO: 25439 - protein, 11 aa, Mycobacterium tuberculosis
GSGGGTVGLVL

SEQ ID NO: 25440 - protein, 11 aa, Mycobacterium tuberculosis
SGGGTVGLVLP

SEQ ID NO: 25441 - protein, 11 aa, Mycobacterium tuberculosis
GGGTVGLVLPR

SEQ ID NO: 25442 - protein, 11 aa, Mycobacterium tuberculosis
GGTVGLVLPRV

SEQ ID NO: 25443 - protein, 11 aa, Mycobacterium tuberculosis
GTVGLVLPRVA

SEQ ID NO: 25444 - protein, 11 aa, Mycobacterium tuberculosis
TVGLVLPRVAS

SEQ ID NO: 25445 - protein, 11 aa, Mycobacterium tuberculosis
VGLVLPRVASL

SEQ ID NO: 25446 - protein, 11 aa, Mycobacterium tuberculosis
GLVLPRVASLS

SEQ ID NO: 25447 - protein, 11 aa, Mycobacterium tuberculosis
LVLPRVASLSG

SEQ ID NO: 25448 - protein, 11 aa, Mycobacterium tuberculosis
VLPRVASLSGL

SEQ ID NO: 25449 - protein, 11 aa, Mycobacterium tuberculosis
LPRVASLSGLD

SEQ ID NO: 25450 - protein, 11 aa, Mycobacterium tuberculosis
PRVASLSGLDG

SEQ ID NO: 25451 - protein, 11 aa, Mycobacterium tuberculosis
RVASLSGLDGA

SEQ ID NO: 25452 - protein, 11 aa, Mycobacterium tuberculosis
VASLSGLDGAP

SEQ ID NO: 25453 - protein, 11 aa, Mycobacterium tuberculosis
ASLSGLDGAPT

SEQ ID NO: 25454 - protein, 11 aa, Mycobacterium tuberculosis
SLSGLDGAPTV

SEQ ID NO: 25455 - protein, 11 aa, Mycobacterium tuberculosis
LSGLDGAPTVP

SEQ ID NO: 25456 - protein, 11 aa, Mycobacterium tuberculosis
SGLDGAPTVPE

SEQ ID NO: 25457 - protein, 11 aa, Mycobacterium tuberculosis
GLDGAPTVPEG

SEQ ID NO: 25458 - protein, 11 aa, Mycobacterium tuberculosis
LDGAPTVPEGS

SEQ ID NO: 25459 - protein, 11 aa, Mycobacterium tuberculosis
DGAPTVPEGSD

SEQ ID NO: 25460 - protein, 11 aa, Mycobacterium tuberculosis
GAPTVPEGSDK

SEQ ID NO: 25461 - protein, 11 aa, Mycobacterium tuberculosis
APTVPEGSDKA

SEQ ID NO: 25462 - protein, 11 aa, Mycobacterium tuberculosis
PTVPEGSDKAL

SEQ ID NO: 25463 - protein, 11 aa, Mycobacterium tuberculosis
TVPEGSDKALM

SEQ ID NO: 25464 - protein, 11 aa, Mycobacterium tuberculosis
VPEGSDKALMH

SEQ ID NO: 25465 - protein, 11 aa, Mycobacterium tuberculosis
PEGSDKALMHL

SEQ ID NO: 25466 - protein, 11 aa, Mycobacterium tuberculosis
EGSDKALMHLG

SEQ ID NO: 25467 - protein, 11 aa, Mycobacterium tuberculosis
GSDKALMHLGD

SEQ ID NO: 25468 - protein, 11 aa, Mycobacterium tuberculosis
SDKALMHLGDP

SEQ ID NO: 25469 - protein, 11 aa, Mycobacterium tuberculosis
DKALMHLGDPP

SEQ ID NO: 25470 - protein, 11 aa, Mycobacterium tuberculosis
KALMHLGDPPR

SEQ ID NO: 25471 - protein, 11 aa, Mycobacterium tuberculosis
ALMHLGDPPRR

SEQ ID NO: 25472 - protein, 11 aa, Mycobacterium tuberculosis
LMHLGDPPRRC

SEQ ID NO: 25473 - protein, 11 aa, Mycobacterium tuberculosis
MHLGDPPRRCD

SEQ ID NO: 25474 - protein, 11 aa, Mycobacterium tuberculosis
HLGDPPRRCDT

SEQ ID NO: 25475 - protein, 11 aa, Mycobacterium tuberculosis
LGDPPRRCDTH

SEQ ID NO: 25476 - protein, 11 aa, Mycobacterium tuberculosis
GDPPRRCDTHP

SEQ ID NO: 25477 - protein, 11 aa, Mycobacterium tuberculosis
DPPRRCDTHPD

SEQ ID NO: 25478 - protein, 11 aa, Mycobacterium tuberculosis
PPRRCDTHPDG

SEQ ID NO: 25479 - protein, 11 aa, Mycobacterium tuberculosis
PRRCDTHPDGT

SEQ ID NO: 25480 - protein, 11 aa, Mycobacterium tuberculosis
RRCDTHPDGTS

SEQ ID NO: 25481 - protein, 11 aa, Mycobacterium tuberculosis
RCDTHPDGTSS

SEQ ID NO: 25482 - protein, 11 aa, Mycobacterium tuberculosis
CDTHPDGTSSA

SEQ ID NO: 25483 - protein, 11 aa, Mycobacterium tuberculosis
DTHPDGTSSAA

SEQ ID NO: 25484 - protein, 11 aa, Mycobacterium tuberculosis
THPDGTSSAAA

SEQ ID NO: 25485 - protein, 11 aa, Mycobacterium tuberculosis
HPDGTSSAAAA

SEQ ID NO: 25486 - protein, 11 aa, Mycobacterium tuberculosis
PDGTSSAAAAL

SEQ ID NO: 25487 - protein, 11 aa, Mycobacterium tuberculosis
DGTSSAAAALV

SEQ ID NO: 25488 - protein, 11 aa, Mycobacterium tuberculosis
GTSSAAAALVL

SEQ ID NO: 25489 - protein, 11 aa, Mycobacterium tuberculosis
TSSAAAALVLR

SEQ ID NO: 25490 - protein, 11 aa, Mycobacterium tuberculosis
SSAAAALVLRR

SEQ ID NO: 25491 - protein, 11 aa, Mycobacterium tuberculosis
SAAAALVLRRI

SEQ ID NO: 25492 - protein, 11 aa, Mycobacterium tuberculosis
AAAALVLRRID

SEQ ID NO: 25493 - protein, 11 aa, Mycobacterium tuberculosis
AAALVLRRIDV

SEQ ID NO: 25494 - protein, 11 aa, Mycobacterium tuberculosis
AALVLRRIDVH

SEQ ID NO: 25495 - protein, 11 aa, Mycobacterium tuberculosis
ALVLRRIDVHP

SEQ ID NO: 25496 - protein, 11 aa, Mycobacterium tuberculosis
LVLRRIDVHPL

SEQ ID NO: 25497 - protein, 11 aa, Mycobacterium tuberculosis
VLRRIDVHPLL

SEQ ID NO: 25498 - protein, 11 aa, Mycobacterium tuberculosis
LRRIDVHPLLT

SEQ ID NO: 25499 - protein, 11 aa, Mycobacterium tuberculosis
RRIDVHPLLTG

SEQ ID NO: 25500 - protein, 11 aa, Mycobacterium tuberculosis
RIDVHPLLTGL

SEQ ID NO: 25501 - protein, 11 aa, Mycobacterium tuberculosis
IDVHPLLTGLG

SEQ ID NO: 25502 - protein, 11 aa, Mycobacterium tuberculosis
DVHPLLTGLGR

SEQ ID NO: 25503 - protein, 11 aa, Mycobacterium tuberculosis
VHPLLTGLGRG

SEQ ID NO: 25504 - protein, 11 aa, Mycobacterium tuberculosis
HPLLTGLGRGR

SEQ ID NO: 25505 - protein, 11 aa, Mycobacterium tuberculosis
PLLTGLGRGRQ

SEQ ID NO: 25506 - protein, 11 aa, Mycobacterium tuberculosis
LLTGLGRGRQT

SEQ ID NO: 25507 - protein, 11 aa, Mycobacterium tuberculosis
LTGLGRGRQTV

SEQ ID NO: 25508 - protein, 11 aa, Mycobacterium tuberculosis
TGLGRGRQTVS

SEQ ID NO: 25509 - protein, 11 aa, Mycobacterium tuberculosis
GLGRGRQTVSL

SEQ ID NO: 25510 - protein, 11 aa, Mycobacterium tuberculosis
LGRGRQTVSLR

SEQ ID NO: 25511 - protein, 11 aa, Mycobacterium tuberculosis
GRGRQTVSLRN

SEQ ID NO: 25512 - protein, 11 aa, Mycobacterium tuberculosis
RGRQTVSLRNG

SEQ ID NO: 25513 - protein, 11 aa, Mycobacterium tuberculosis
GRQTVSLRNGH

SEQ ID NO: 25514 - protein, 11 aa, Mycobacterium tuberculosis
RQTVSLRNGHL

SEQ ID NO: 25515 - protein, 11 aa, Mycobacterium tuberculosis
QTVSLRNGHLV

SEQ ID NO: 25516 - protein, 11 aa, Mycobacterium tuberculosis
TVSLRNGHLVA

SEQ ID NO: 25517 - protein, 11 aa, Mycobacterium tuberculosis
VSLRNGHLVAT

SEQ ID NO: 25518 - protein, 11 aa, Mycobacterium tuberculosis
SLRNGHLVATA

SEQ ID NO: 25519 - protein, 11 aa, Mycobacterium tuberculosis
LRNGHLVATAN

SEQ ID NO: 25520 - protein, 11 aa, Mycobacterium tuberculosis
RNGHLVATANR

SEQ ID NO: 25521 - protein, 11 aa, Mycobacterium tuberculosis
NGHLVATANRA

SEQ ID NO: 25522 - protein, 11 aa, Mycobacterium tuberculosis
GHLVATANRAI

SEQ ID NO: 25523 - protein, 11 aa, Mycobacterium tuberculosis
HLVATANRAIL

SEQ ID NO: 25524 - protein, 11 aa, Mycobacterium tuberculosis
LVATANRAILS

SEQ ID NO: 25525 - protein, 11 aa, Mycobacterium tuberculosis
VATANRAILSR

SEQ ID NO: 25526 - protein, 11 aa, Mycobacterium tuberculosis
ATANRAILSRR

SEQ ID NO: 25527 - protein, 11 aa, Mycobacterium tuberculosis
TANRAILSRRR

SEQ ID NO: 25528 - protein, 11 aa, Mycobacterium tuberculosis
ANRAILSRRRS

SEQ ID NO: 25529 - protein, 11 aa, Mycobacterium tuberculosis
NRAILSRRRSR

SEQ ID NO: 25530 - protein, 11 aa, Mycobacterium tuberculosis
RAILSRRRSRL

SEQ ID NO: 25531 - protein, 11 aa, Mycobacterium tuberculosis
AILSRRRSRLT

SEQ ID NO: 25532 - protein, 11 aa, Mycobacterium tuberculosis
ILSRRRSRLTR

SEQ ID NO: 25533 - protein, 11 aa, Mycobacterium tuberculosis
LSRRRSRLTRG

SEQ ID NO: 25534 - protein, 11 aa, Mycobacterium tuberculosis
SRRRSRLTRGR

SEQ ID NO: 25535 - protein, 11 aa, Mycobacterium tuberculosis
RRRSRLTRGRS

SEQ ID NO: 25536 - protein, 11 aa, Mycobacterium tuberculosis
RRSRLTRGRSF

SEQ ID NO: 25537 - protein, 11 aa, Mycobacterium tuberculosis
RSRLTRGRSFT

SEQ ID NO: 25538 - protein, 11 aa, Mycobacterium tuberculosis
SRLTRGRSFTS

SEQ ID NO: 25539 - protein, 11 aa, Mycobacterium tuberculosis
RLTRGRSFTSH

SEQ ID NO: 25540 - protein, 11 aa, Mycobacterium tuberculosis
LTRGRSFTSHL

SEQ ID NO: 25541 - protein, 11 aa, Mycobacterium tuberculosis
TRGRSFTSHLI

SEQ ID NO: 25542 - protein, 11 aa, Mycobacterium tuberculosis
RGRSFTSHLIT

SEQ ID NO: 25543 - protein, 11 aa, Mycobacterium tuberculosis
GRSFTSHLITS

SEQ ID NO: 25544 - protein, 11 aa, Mycobacterium tuberculosis
RSFTSHLITSC

SEQ ID NO: 25545 - protein, 11 aa, Mycobacterium tuberculosis
SFTSHLITSCP

SEQ ID NO: 25546 - protein, 11 aa, Mycobacterium tuberculosis
FTSHLITSCPR

SEQ ID NO: 25547 - protein, 11 aa, Mycobacterium tuberculosis
TSHLITSCPRL

SEQ ID NO: 25548 - protein, 11 aa, Mycobacterium tuberculosis
SHLITSCPRLD

SEQ ID NO: 25549 - protein, 11 aa, Mycobacterium tuberculosis
HLITSCPRLDD

SEQ ID NO: 25550 - protein, 11 aa, Mycobacterium tuberculosis
LITSCPRLDDH

SEQ ID NO: 25551 - protein, 11 aa, Mycobacterium tuberculosis
ITSCPRLDDHQ

SEQ ID NO: 25552 - protein, 11 aa, Mycobacterium tuberculosis
TSCPRLDDHQH

SEQ ID NO: 25553 - protein, 11 aa, Mycobacterium tuberculosis
SCPRLDDHQHR

SEQ ID NO: 25554 - protein, 11 aa, Mycobacterium tuberculosis
CPRLDDHQHRH

SEQ ID NO: 25555 - protein, 11 aa, Mycobacterium tuberculosis
PRLDDHQHRHP

SEQ ID NO: 25556 - protein, 11 aa, Mycobacterium tuberculosis
RLDDHQHRHPT

SEQ ID NO: 25557 - protein, 11 aa, Mycobacterium tuberculosis
LDDHQHRHPTR

SEQ ID NO: 25558 - protein, 11 aa, Mycobacterium tuberculosis
DDHQHRHPTRC

SEQ ID NO: 25559 - protein, 11 aa, Mycobacterium tuberculosis
DHQHRHPTRCR

SEQ ID NO: 25560 - protein, 11 aa, Mycobacterium tuberculosis
HQHRHPTRCRA

SEQ ID NO: 25561 - protein, 11 aa, Mycobacterium tuberculosis
QHRHPTRCRAE

SEQ ID NO: 25562 - protein, 11 aa, Mycobacterium tuberculosis
HRHPTRCRAEH

SEQ ID NO: 25563 - protein, 11 aa, Mycobacterium tuberculosis
RHPTRCRAEHA

SEQ ID NO: 25564 - protein, 11 aa, Mycobacterium tuberculosis
HPTRCRAEHAG

SEQ ID NO: 25565 - protein, 11 aa, Mycobacterium tuberculosis
PTRCRAEHAGC

SEQ ID NO: 25566 - protein, 11 aa, Mycobacterium tuberculosis
TRCRAEHAGCT

SEQ ID NO: 25567 - protein, 11 aa, Mycobacterium tuberculosis
RCRAEHAGCTV

SEQ ID NO: 25568 - protein, 11 aa, Mycobacterium tuberculosis
CRAEHAGCTVA

SEQ ID NO: 25569 - protein, 11 aa, Mycobacterium tuberculosis
RAEHAGCTVAT

SEQ ID NO: 25570 - protein, 11 aa, Mycobacterium tuberculosis
AEHAGCTVATC

SEQ ID NO: 25571 - protein, 11 aa, Mycobacterium tuberculosis
EHAGCTVATCI

SEQ ID NO: 25572 - protein, 11 aa, Mycobacterium tuberculosis
HAGCTVATCIP

SEQ ID NO: 25573 - protein, 11 aa, Mycobacterium tuberculosis
AGCTVATCIPN

SEQ ID NO: 25574 - protein, 11 aa, Mycobacterium tuberculosis
GCTVATCIPNA

SEQ ID NO: 25575 - protein, 11 aa, Mycobacterium tuberculosis
CTVATCIPNAH

SEQ ID NO: 25576 - protein, 11 aa, Mycobacterium tuberculosis
TVATCIPNAHD

SEQ ID NO: 25577 - protein, 11 aa, Mycobacterium tuberculosis
VATCIPNAHDP

SEQ ID NO: 25578 - protein, 11 aa, Mycobacterium tuberculosis
ATCIPNAHDPA

SEQ ID NO: 25579 - protein, 11 aa, Mycobacterium tuberculosis
TCIPNAHDPAP

SEQ ID NO: 25580 - protein, 11 aa, Mycobacterium tuberculosis
CIPNAHDPAPG

SEQ ID NO: 25581 - protein, 11 aa, Mycobacterium tuberculosis
IPNAHDPAPGH

SEQ ID NO: 25582 - protein, 11 aa, Mycobacterium tuberculosis
PNAHDPAPGHQ

SEQ ID NO: 25583 - protein, 11 aa, Mycobacterium tuberculosis
NAHDPAPGHQT

SEQ ID NO: 25584 - protein, 11 aa, Mycobacterium tuberculosis
AHDPAPGHQTP

SEQ ID NO: 25585 - protein, 11 aa, Mycobacterium tuberculosis
HDPAPGHQTPR

SEQ ID NO: 25586 - protein, 11 aa, Mycobacterium tuberculosis
DPAPGHQTPRW

SEQ ID NO: 25587 - protein, 11 aa, Mycobacterium tuberculosis
PAPGHQTPRWG

SEQ ID NO: 25588 - protein, 11 aa, Mycobacterium tuberculosis
APGHQTPRWGP

SEQ ID NO: 25589 - protein, 11 aa, Mycobacterium tuberculosis
PGHQTPRWGPF

SEQ ID NO: 25590 - protein, 11 aa, Mycobacterium tuberculosis
GHQTPRWGPFR

SEQ ID NO: 25591 - protein, 11 aa, Mycobacterium tuberculosis
HQTPRWGPFRL

SEQ ID NO: 25592 - protein, 11 aa, Mycobacterium tuberculosis
QTPRWGPFRLK

SEQ ID NO: 25593 - protein, 11 aa, Mycobacterium tuberculosis
TPRWGPFRLKP

SEQ ID NO: 25594 - protein, 11 aa, Mycobacterium tuberculosis
PRWGPFRLKPA

SEQ ID NO: 25595 - protein, 11 aa, Mycobacterium tuberculosis
RWGPFRLKPAY

SEQ ID NO: 25596 - protein, 11 aa, Mycobacterium tuberculosis
WGPFRLKPAYT

SEQ ID NO: 25597 - protein, 11 aa, Mycobacterium tuberculosis
GPFRLKPAYTR

SEQ ID NO: 25598 - protein, 11 aa, Mycobacterium tuberculosis
PFRLKPAYTRI

SEQ ID NO: 25599 - protein, 8 aa, Mycobacterium tuberculosis
MPSGWVSH

SEQ ID NO: 25600 - protein, 8 aa, Mycobacterium tuberculosis
PSGWVSHR

SEQ ID NO: 25601 - protein, 8 aa, Mycobacterium tuberculosis
SGWVSHRL

SEQ ID NO: 25602 - protein, 8 aa, Mycobacterium tuberculosis
GWVSHRLG

SEQ ID NO: 25603 - protein, 8 aa, Mycobacterium tuberculosis
WVSHRLGG

SEQ ID NO: 25604 - protein, 8 aa, Mycobacterium tuberculosis
VSHRLGGS

SEQ ID NO: 25605 - protein, 8 aa, Mycobacterium tuberculosis
SHRLGGSP

SEQ ID NO: 25606 - protein, 8 aa, Mycobacterium tuberculosis
HRLGGSPK

SEQ ID NO: 25607 - protein, 8 aa, Mycobacterium tuberculosis
RLGGSPKC

SEQ ID NO: 25608 - protein, 8 aa, Mycobacterium tuberculosis
LGGSPKCI

SEQ ID NO: 25609 - protein, 8 aa, Mycobacterium tuberculosis
GGSPKCIS

SEQ ID NO: 25610 - protein, 8 aa, Mycobacterium tuberculosis
GSPKCISA

SEQ ID NO: 25611 - protein, 8 aa, Mycobacterium tuberculosis
SPKCISAL

SEQ ID NO: 25612 - protein, 8 aa, Mycobacterium tuberculosis
PKCISALS

SEQ ID NO: 25613 - protein, 8 aa, Mycobacterium tuberculosis
KCISALSL

SEQ ID NO: 25614 - protein, 8 aa, Mycobacterium tuberculosis
CISALSLP

SEQ ID NO: 25615 - protein, 8 aa, Mycobacterium tuberculosis
ISALSLPS

SEQ ID NO: 25616 - protein, 8 aa, Mycobacterium tuberculosis
SALSLPSG

SEQ ID NO: 25617 - protein, 8 aa, Mycobacterium tuberculosis
ALSLPSGT

SEQ ID NO: 25618 - protein, 8 aa, Mycobacterium tuberculosis
LSLPSGTV

SEQ ID NO: 25619 - protein, 8 aa, Mycobacterium tuberculosis
SLPSGTVG

SEQ ID NO: 25620 - protein, 8 aa, Mycobacterium tuberculosis
LPSGTVGA

SEQ ID NO: 25621 - protein, 8 aa, Mycobacterium tuberculosis
PSGTVGAP

SEQ ID NO: 25622 - protein, 8 aa, Mycobacterium tuberculosis
SGTVGAPS

SEQ ID NO: 25623 - protein, 8 aa, Mycobacterium tuberculosis
GTVGAPSK

SEQ ID NO: 25624 - protein, 8 aa, Mycobacterium tuberculosis
TVGAPSKP

SEQ ID NO: 25625 - protein, 8 aa, Mycobacterium tuberculosis
VGAPSKPD

SEQ ID NO: 25626 - protein, 8 aa, Mycobacterium tuberculosis
GAPSKPDN

SEQ ID NO: 25627 - protein, 8 aa, Mycobacterium tuberculosis
APSKPDND

SEQ ID NO: 25628 - protein, 8 aa, Mycobacterium tuberculosis
PSKPDNDA

SEQ ID NO: 25629 - protein, 8 aa, Mycobacterium tuberculosis
SKPDNDAT

SEQ ID NO: 25630 - protein, 8 aa, Mycobacterium tuberculosis
KPDNDATR

SEQ ID NO: 25631 - protein, 8 aa, Mycobacterium tuberculosis
PDNDATRG

SEQ ID NO: 25632 - protein, 8 aa, Mycobacterium tuberculosis
DNDATRGR

SEQ ID NO: 25633 - protein, 8 aa, Mycobacterium tuberculosis
NDATRGRT

SEQ ID NO: 25634 - protein, 8 aa, Mycobacterium tuberculosis
DATRGRTR

SEQ ID NO: 25635 - protein, 8 aa, Mycobacterium tuberculosis
ATRGRTRP

SEQ ID NO: 25636 - protein, 8 aa, Mycobacterium tuberculosis
TRGRTRPT

SEQ ID NO: 25637 - protein, 8 aa, Mycobacterium tuberculosis
RGRTRPTV

SEQ ID NO: 25638 - protein, 8 aa, Mycobacterium tuberculosis
GRTRPTVP

SEQ ID NO: 25639 - protein, 8 aa, Mycobacterium tuberculosis
RTRPTVPP

SEQ ID NO: 25640 - protein, 8 aa, Mycobacterium tuberculosis
TRPTVPPP

SEQ ID NO: 25641 - protein, 8 aa, Mycobacterium tuberculosis
RPTVPPPD

SEQ ID NO: 25642 - protein, 8 aa, Mycobacterium tuberculosis
PTVPPPDP

SEQ ID NO: 25643 - protein, 8 aa, Mycobacterium tuberculosis
TVPPPDPA

SEQ ID NO: 25644 - protein, 8 aa, Mycobacterium tuberculosis
VPPPDPAA

SEQ ID NO: 25645 - protein, 8 aa, Mycobacterium tuberculosis
PPPDPAAM

SEQ ID NO: 25646 - protein, 8 aa, Mycobacterium tuberculosis
PPDPAAMG

SEQ ID NO: 25647 - protein, 8 aa, Mycobacterium tuberculosis
PDPAAMGT

SEQ ID NO: 25648 - protein, 8 aa, Mycobacterium tuberculosis
DPAAMGTW

SEQ ID NO: 25649 - protein, 8 aa, Mycobacterium tuberculosis
PAAMGTWK

SEQ ID NO: 25650 - protein, 8 aa, Mycobacterium tuberculosis
AAMGTWKF

SEQ ID NO: 25651 - protein, 8 aa, Mycobacterium tuberculosis
AMGTWKFF

SEQ ID NO: 25652 - protein, 8 aa, Mycobacterium tuberculosis
MGTWKFFR

SEQ ID NO: 25653 - protein, 8 aa, Mycobacterium tuberculosis
GTWKFFRA

SEQ ID NO: 25654 - protein, 8 aa, Mycobacterium tuberculosis
TWKFFRAS

SEQ ID NO: 25655 - protein, 8 aa, Mycobacterium tuberculosis
WKFFRASV

SEQ ID NO: 25656 - protein, 8 aa, Mycobacterium tuberculosis
KFFRASVD

SEQ ID NO: 25657 - protein, 8 aa, Mycobacterium tuberculosis
FFRASVDG

SEQ ID NO: 25658 - protein, 8 aa, Mycobacterium tuberculosis
FRASVDGR

SEQ ID NO: 25659 - protein, 8 aa, Mycobacterium tuberculosis
RASVDGRP

SEQ ID NO: 25660 - protein, 8 aa, Mycobacterium tuberculosis
ASVDGRPV

SEQ ID NO: 25661 - protein, 8 aa, Mycobacterium tuberculosis
SVDGRPVF

SEQ ID NO: 25662 - protein, 8 aa, Mycobacterium tuberculosis
VDGRPVFK

SEQ ID NO: 25663 - protein, 8 aa, Mycobacterium tuberculosis
DGRPVFKK

SEQ ID NO: 25664 - protein, 8 aa, Mycobacterium tuberculosis
GRPVFKKE

SEQ ID NO: 25665 - protein, 8 aa, Mycobacterium tuberculosis
RPVFKKEF

SEQ ID NO: 25666 - protein, 8 aa, Mycobacterium tuberculosis
PVFKKEFD

SEQ ID NO: 25667 - protein, 8 aa, Mycobacterium tuberculosis
VFKKEFDK

SEQ ID NO: 25668 - protein, 8 aa, Mycobacterium tuberculosis
FKKEFDKL

SEQ ID NO: 25669 - protein, 8 aa, Mycobacterium tuberculosis
KKEFDKLP

SEQ ID NO: 25670 - protein, 8 aa, Mycobacterium tuberculosis
KEFDKLPD

SEQ ID NO: 25671 - protein, 8 aa, Mycobacterium tuberculosis
EFDKLPDQ

SEQ ID NO: 25672 - protein, 8 aa, Mycobacterium tuberculosis
FDKLPDQA

SEQ ID NO: 25673 - protein, 8 aa, Mycobacterium tuberculosis
DKLPDQAR

SEQ ID NO: 25674 - protein, 8 aa, Mycobacterium tuberculosis
KLPDQARA

SEQ ID NO: 25675 - protein, 8 aa, Mycobacterium tuberculosis
LPDQARAA

SEQ ID NO: 25676 - protein, 8 aa, Mycobacterium tuberculosis
PDQARAAL

SEQ ID NO: 25677 - protein, 8 aa, Mycobacterium tuberculosis
DQARAALI

SEQ ID NO: 25678 - protein, 8 aa, Mycobacterium tuberculosis
QARAALIV

SEQ ID NO: 25679 - protein, 8 aa, Mycobacterium tuberculosis
ARAALIVL

SEQ ID NO: 25680 - protein, 8 aa, Mycobacterium tuberculosis
RAALIVLM

SEQ ID NO: 25681 - protein, 8 aa, Mycobacterium tuberculosis
AALIVLMQ

SEQ ID NO: 25682 - protein, 8 aa, Mycobacterium tuberculosis
ALIVLMQR

SEQ ID NO: 25683 - protein, 8 aa, Mycobacterium tuberculosis
LIVLMQRY

SEQ ID NO: 25684 - protein, 8 aa, Mycobacterium tuberculosis
IVLMQRYL

SEQ ID NO: 25685 - protein, 8 aa, Mycobacterium tuberculosis
VLMQRYLV

SEQ ID NO: 25686 - protein, 8 aa, Mycobacterium tuberculosis
LMQRYLVG

SEQ ID NO: 25687 - protein, 8 aa, Mycobacterium tuberculosis
MQRYLVGD

SEQ ID NO: 25688 - protein, 8 aa, Mycobacterium tuberculosis
QRYLVGDL

SEQ ID NO: 25689 - protein, 8 aa, Mycobacterium tuberculosis
RYLVGDLA

SEQ ID NO: 25690 - protein, 8 aa, Mycobacterium tuberculosis
YLVGDLAA

SEQ ID NO: 25691 - protein, 8 aa, Mycobacterium tuberculosis
LVGDLAAG

SEQ ID NO: 25692 - protein, 8 aa, Mycobacterium tuberculosis
VGDLAAGS

SEQ ID NO: 25693 - protein, 8 aa, Mycobacterium tuberculosis
GDLAAGSI

SEQ ID NO: 25694 - protein, 8 aa, Mycobacterium tuberculosis
DLAAGSIK

SEQ ID NO: 25695 - protein, 8 aa, Mycobacterium tuberculosis
LAAGSIKP

SEQ ID NO: 25696 - protein, 8 aa, Mycobacterium tuberculosis
AAGSIKPI

SEQ ID NO: 25697 - protein, 8 aa, Mycobacterium tuberculosis
AGSIKPIR

SEQ ID NO: 25698 - protein, 8 aa, Mycobacterium tuberculosis
GSIKPIRG

SEQ ID NO: 25699 - protein, 8 aa, Mycobacterium tuberculosis
SIKPIRGD

SEQ ID NO: 25700 - protein, 8 aa, Mycobacterium tuberculosis
IKPIRGDI

SEQ ID NO: 25701 - protein, 8 aa, Mycobacterium tuberculosis
KPIRGDIL

SEQ ID NO: 25702 - protein, 8 aa, Mycobacterium tuberculosis
PIRGDILE

SEQ ID NO: 25703 - protein, 8 aa, Mycobacterium tuberculosis
IRGDILEL

SEQ ID NO: 25704 - protein, 8 aa, Mycobacterium tuberculosis
RGDILELR

SEQ ID NO: 25705 - protein, 8 aa, Mycobacterium tuberculosis
GDILELRW

SEQ ID NO: 25706 - protein, 8 aa, Mycobacterium tuberculosis
DILELRWH

SEQ ID NO: 25707 - protein, 8 aa, Mycobacterium tuberculosis
ILELRWHE

SEQ ID NO: 25708 - protein, 8 aa, Mycobacterium tuberculosis
LELRWHEA

SEQ ID NO: 25709 - protein, 8 aa, Mycobacterium tuberculosis
ELRWHEAN

SEQ ID NO: 25710 - protein, 8 aa, Mycobacterium tuberculosis
LRWHEANN

SEQ ID NO: 25711 - protein, 8 aa, Mycobacterium tuberculosis
RWHEANNH

SEQ ID NO: 25712 - protein, 8 aa, Mycobacterium tuberculosis
WHEANNHF

SEQ ID NO: 25713 - protein, 8 aa, Mycobacterium tuberculosis
HEANNHFR

SEQ ID NO: 25714 - protein, 8 aa, Mycobacterium tuberculosis
EANNHFRV

SEQ ID NO: 25715 - protein, 8 aa, Mycobacterium tuberculosis
ANNHFRVL

SEQ ID NO: 25716 - protein, 8 aa, Mycobacterium tuberculosis
NNHFRVLF

SEQ ID NO: 25717 - protein, 8 aa, Mycobacterium tuberculosis
NHFRVLFF

SEQ ID NO: 25718 - protein, 8 aa, Mycobacterium tuberculosis
HFRVLFFR

SEQ ID NO: 25719 - protein, 8 aa, Mycobacterium tuberculosis
FRVLFFRW

SEQ ID NO: 25720 - protein, 8 aa, Mycobacterium tuberculosis
RVLFFRWG

SEQ ID NO: 25721 - protein, 8 aa, Mycobacterium tuberculosis
VLFFRWGQ

SEQ ID NO: 25722 - protein, 8 aa, Mycobacterium tuberculosis
LFFRWGQH

SEQ ID NO: 25723 - protein, 8 aa, Mycobacterium tuberculosis
FFRWGQHP

SEQ ID NO: 25724 - protein, 8 aa, Mycobacterium tuberculosis
FRWGQHPV

SEQ ID NO: 25725 - protein, 8 aa, Mycobacterium tuberculosis
RWGQHPVA

SEQ ID NO: 25726 - protein, 8 aa, Mycobacterium tuberculosis
WGQHPVAL

SEQ ID NO: 25727 - protein, 8 aa, Mycobacterium tuberculosis
GQHPVALT

SEQ ID NO: 25728 - protein, 8 aa, Mycobacterium tuberculosis
QHPVALTA

SEQ ID NO: 25729 - protein, 8 aa, Mycobacterium tuberculosis
HPVALTAF

SEQ ID NO: 25730 - protein, 8 aa, Mycobacterium tuberculosis
PVALTAFY

SEQ ID NO: 25731 - protein, 8 aa, Mycobacterium tuberculosis
VALTAFYK

SEQ ID NO: 25732 - protein, 8 aa, Mycobacterium tuberculosis
ALTAFYKN

SEQ ID NO: 25733 - protein, 8 aa, Mycobacterium tuberculosis
LTAFYKNQ

SEQ ID NO: 25734 - protein, 8 aa, Mycobacterium tuberculosis
TAFYKNQQ

SEQ ID NO: 25735 - protein, 8 aa, Mycobacterium tuberculosis
AFYKNQQK

SEQ ID NO: 25736 - protein, 8 aa, Mycobacterium tuberculosis
FYKNQQKT

SEQ ID NO: 25737 - protein, 8 aa, Mycobacterium tuberculosis
YKNQQKTP

SEQ ID NO: 25738 - protein, 8 aa, Mycobacterium tuberculosis
KNQQKTPK

SEQ ID NO: 25739 - protein, 8 aa, Mycobacterium tuberculosis
NQQKTPKT

SEQ ID NO: 25740 - protein, 8 aa, Mycobacterium tuberculosis
QQKTPKTK

SEQ ID NO: 25741 - protein, 8 aa, Mycobacterium tuberculosis
QKTPKTKI

SEQ ID NO: 25742 - protein, 8 aa, Mycobacterium tuberculosis
KTPKTKIE

SEQ ID NO: 25743 - protein, 8 aa, Mycobacterium tuberculosis
TPKTKIET

SEQ ID NO: 25744 - protein, 8 aa, Mycobacterium tuberculosis
PKTKIETA

SEQ ID NO: 25745 - protein, 8 aa, Mycobacterium tuberculosis
KTKIETAL

SEQ ID NO: 25746 - protein, 8 aa, Mycobacterium tuberculosis
TKIETALD

SEQ ID NO: 25747 - protein, 8 aa, Mycobacterium tuberculosis
KIETALDR

SEQ ID NO: 25748 - protein, 8 aa, Mycobacterium tuberculosis
IETALDRQ

SEQ ID NO: 25749 - protein, 8 aa, Mycobacterium tuberculosis
ETALDRQK

SEQ ID NO: 25750 - protein, 8 aa, Mycobacterium tuberculosis
TALDRQKI

SEQ ID NO: 25751 - protein, 8 aa, Mycobacterium tuberculosis
ALDRQKIW

SEQ ID NO: 25752 - protein, 8 aa, Mycobacterium tuberculosis
LDRQKIWK

SEQ ID NO: 25753 - protein, 8 aa, Mycobacterium tuberculosis
DRQKIWKR

SEQ ID NO: 25754 - protein, 8 aa, Mycobacterium tuberculosis
RQKIWKRA

SEQ ID NO: 25755 - protein, 8 aa, Mycobacterium tuberculosis
QKIWKRAF

SEQ ID NO: 25756 - protein, 8 aa, Mycobacterium tuberculosis
KIWKRAFG

SEQ ID NO: 25757 - protein, 8 aa, Mycobacterium tuberculosis
IWKRAFGD

SEQ ID NO: 25758 - protein, 8 aa, Mycobacterium tuberculosis
WKRAFGDT

SEQ ID NO: 25759 - protein, 8 aa, Mycobacterium tuberculosis
KRAFGDTP

SEQ ID NO: 25760 - protein, 8 aa, Mycobacterium tuberculosis
RAFGDTPP

SEQ ID NO: 25761 - protein, 8 aa, Mycobacterium tuberculosis
AFGDTPPI

SEQ ID NO: 25762 - protein, 9 aa, Mycobacterium tuberculosis
MPSGWVSHR

SEQ ID NO: 25763 - protein, 9 aa, Mycobacterium tuberculosis
PSGWVSHRL

SEQ ID NO: 25764 - protein, 9 aa, Mycobacterium tuberculosis
SGWVSHRLG

SEQ ID NO: 25765 - protein, 9 aa, Mycobacterium tuberculosis
GWVSHRLGG

SEQ ID NO: 25766 - protein, 9 aa, Mycobacterium tuberculosis
WVSHRLGGS

SEQ ID NO: 25767 - protein, 9 aa, Mycobacterium tuberculosis
VSHRLGGSP

SEQ ID NO: 25768 - protein, 9 aa, Mycobacterium tuberculosis
SHRLGGSPK

SEQ ID NO: 25769 - protein, 9 aa, Mycobacterium tuberculosis
HRLGGSPKC

SEQ ID NO: 25770 - protein, 9 aa, Mycobacterium tuberculosis
RLGGSPKCI

SEQ ID NO: 25771 - protein, 9 aa, Mycobacterium tuberculosis
LGGSPKCIS

SEQ ID NO: 25772 - protein, 9 aa, Mycobacterium tuberculosis
GGSPKCISA

SEQ ID NO: 25773 - protein, 9 aa, Mycobacterium tuberculosis
GSPKCISAL

SEQ ID NO: 25774 - protein, 9 aa, Mycobacterium tuberculosis
SPKCISALS

SEQ ID NO: 25775 - protein, 9 aa, Mycobacterium tuberculosis
PKCISALSL

SEQ ID NO: 25776 - protein, 9 aa, Mycobacterium tuberculosis
KCISALSLP

SEQ ID NO: 25777 - protein, 9 aa, Mycobacterium tuberculosis
CISALSLPS

SEQ ID NO: 25778 - protein, 9 aa, Mycobacterium tuberculosis
ISALSLPSG

SEQ ID NO: 25779 - protein, 9 aa, Mycobacterium tuberculosis
SALSLPSGT

SEQ ID NO: 25780 - protein, 9 aa, Mycobacterium tuberculosis
ALSLPSGTV

SEQ ID NO: 25781 - protein, 9 aa, Mycobacterium tuberculosis
LSLPSGTVG

SEQ ID NO: 25782 - protein, 9 aa, Mycobacterium tuberculosis
SLPSGTVGA

SEQ ID NO: 25783 - protein, 9 aa, Mycobacterium tuberculosis
LPSGTVGAP

SEQ ID NO: 25784 - protein, 9 aa, Mycobacterium tuberculosis
PSGTVGAPS

SEQ ID NO: 25785 - protein, 9 aa, Mycobacterium tuberculosis
SGTVGAPSK

SEQ ID NO: 25786 - protein, 9 aa, Mycobacterium tuberculosis
GTVGAPSKP

SEQ ID NO: 25787 - protein, 9 aa, Mycobacterium tuberculosis
TVGAPSKPD

SEQ ID NO: 25788 - protein, 9 aa, Mycobacterium tuberculosis
VGAPSKPDN

SEQ ID NO: 25789 - protein, 9 aa, Mycobacterium tuberculosis
GAPSKPDND

SEQ ID NO: 25790 - protein, 9 aa, Mycobacterium tuberculosis
APSKPDNDA

SEQ ID NO: 25791 - protein, 9 aa, Mycobacterium tuberculosis
PSKPDNDAT

SEQ ID NO: 25792 - protein, 9 aa, Mycobacterium tuberculosis
SKPDNDATR

SEQ ID NO: 25793 - protein, 9 aa, Mycobacterium tuberculosis
KPDNDATRG

SEQ ID NO: 25794 - protein, 9 aa, Mycobacterium tuberculosis
PDNDATRGR

SEQ ID NO: 25795 - protein, 9 aa, Mycobacterium tuberculosis
DNDATRGRT

SEQ ID NO: 25796 - protein, 9 aa, Mycobacterium tuberculosis
NDATRGRTR

SEQ ID NO: 25797 - protein, 9 aa, Mycobacterium tuberculosis
DATRGRTRP

SEQ ID NO: 25798 - protein, 9 aa, Mycobacterium tuberculosis
ATRGRTRPT

SEQ ID NO: 25799 - protein, 9 aa, Mycobacterium tuberculosis
TRGRTRPTV

SEQ ID NO: 25800 - protein, 9 aa, Mycobacterium tuberculosis
RGRTRPTVP

SEQ ID NO: 25801 - protein, 9 aa, Mycobacterium tuberculosis
GRTRPTVPP

SEQ ID NO: 25802 - protein, 9 aa, Mycobacterium tuberculosis
RTRPTVPPP

SEQ ID NO: 25803 - protein, 9 aa, Mycobacterium tuberculosis
TRPTVPPPD

SEQ ID NO: 25804 - protein, 9 aa, Mycobacterium tuberculosis
RPTVPPPDP

SEQ ID NO: 25805 - protein, 9 aa, Mycobacterium tuberculosis
PTVPPPDPA

SEQ ID NO: 25806 - protein, 9 aa, Mycobacterium tuberculosis
TVPPPDPAA

SEQ ID NO: 25807 - protein, 9 aa, Mycobacterium tuberculosis
VPPPDPAAM

SEQ ID NO: 25808 - protein, 9 aa, Mycobacterium tuberculosis
PPPDPAAMG

SEQ ID NO: 25809 - protein, 9 aa, Mycobacterium tuberculosis
PPDPAAMGT

SEQ ID NO: 25810 - protein, 9 aa, Mycobacterium tuberculosis
PDPAAMGTW

SEQ ID NO: 25811 - protein, 9 aa, Mycobacterium tuberculosis
DPAAMGTWK

SEQ ID NO: 25812 - protein, 9 aa, Mycobacterium tuberculosis
PAAMGTWKF

SEQ ID NO: 25813 - protein, 9 aa, Mycobacterium tuberculosis
AAMGTWKFF

SEQ ID NO: 25814 - protein, 9 aa, Mycobacterium tuberculosis
AMGTWKFFR

SEQ ID NO: 25815 - protein, 9 aa, Mycobacterium tuberculosis
MGTWKFFRA

SEQ ID NO: 25816 - protein, 9 aa, Mycobacterium tuberculosis
GTWKFFRAS

SEQ ID NO: 25817 - protein, 9 aa, Mycobacterium tuberculosis
TWKFFRASV

SEQ ID NO: 25818 - protein, 9 aa, Mycobacterium tuberculosis
WKFFRASVD

SEQ ID NO: 25819 - protein, 9 aa, Mycobacterium tuberculosis
KFFRASVDG

SEQ ID NO: 25820 - protein, 9 aa, Mycobacterium tuberculosis
FFRASVDGR

SEQ ID NO: 25821 - protein, 9 aa, Mycobacterium tuberculosis
FRASVDGRP

SEQ ID NO: 25822 - protein, 9 aa, Mycobacterium tuberculosis
RASVDGRPV

SEQ ID NO: 25823 - protein, 9 aa, Mycobacterium tuberculosis
ASVDGRPVF

SEQ ID NO: 25824 - protein, 9 aa, Mycobacterium tuberculosis
SVDGRPVFK

SEQ ID NO: 25825 - protein, 9 aa, Mycobacterium tuberculosis
VDGRPVFKK

SEQ ID NO: 25826 - protein, 9 aa, Mycobacterium tuberculosis
DGRPVFKKE

SEQ ID NO: 25827 - protein, 9 aa, Mycobacterium tuberculosis
GRPVFKKEF

SEQ ID NO: 25828 - protein, 9 aa, Mycobacterium tuberculosis
RPVFKKEFD

SEQ ID NO: 25829 - protein, 9 aa, Mycobacterium tuberculosis
PVFKKEFDK

SEQ ID NO: 25830 - protein, 9 aa, Mycobacterium tuberculosis
VFKKEFDKL

SEQ ID NO: 25831 - protein, 9 aa, Mycobacterium tuberculosis
FKKEFDKLP

SEQ ID NO: 25832 - protein, 9 aa, Mycobacterium tuberculosis
KKEFDKLPD

SEQ ID NO: 25833 - protein, 9 aa, Mycobacterium tuberculosis
KEFDKLPDQ

SEQ ID NO: 25834 - protein, 9 aa, Mycobacterium tuberculosis
EFDKLPDQA

SEQ ID NO: 25835 - protein, 9 aa, Mycobacterium tuberculosis
FDKLPDQAR

SEQ ID NO: 25836 - protein, 9 aa, Mycobacterium tuberculosis
DKLPDQARA

SEQ ID NO: 25837 - protein, 9 aa, Mycobacterium tuberculosis
KLPDQARAA

SEQ ID NO: 25838 - protein, 9 aa, Mycobacterium tuberculosis
LPDQARAAL

SEQ ID NO: 25839 - protein, 9 aa, Mycobacterium tuberculosis
PDQARAALI

SEQ ID NO: 25840 - protein, 9 aa, Mycobacterium tuberculosis
DQARAALIV

SEQ ID NO: 25841 - protein, 9 aa, Mycobacterium tuberculosis
QARAALIVL

SEQ ID NO: 25842 - protein, 9 aa, Mycobacterium tuberculosis
ARAALIVLM

SEQ ID NO: 25843 - protein, 9 aa, Mycobacterium tuberculosis
RAALIVLMQ

SEQ ID NO: 25844 - protein, 9 aa, Mycobacterium tuberculosis
AALIVLMQR

SEQ ID NO: 25845 - protein, 9 aa, Mycobacterium tuberculosis
ALIVLMQRY

SEQ ID NO: 25846 - protein, 9 aa, Mycobacterium tuberculosis
LIVLMQRYL

SEQ ID NO: 25847 - protein, 9 aa, Mycobacterium tuberculosis
IVLMQRYLV

SEQ ID NO: 25848 - protein, 9 aa, Mycobacterium tuberculosis
VLMQRYLVG

SEQ ID NO: 25849 - protein, 9 aa, Mycobacterium tuberculosis
LMQRYLVGD

SEQ ID NO: 25850 - protein, 9 aa, Mycobacterium tuberculosis
MQRYLVGDL

SEQ ID NO: 25851 - protein, 9 aa, Mycobacterium tuberculosis
QRYLVGDLA

SEQ ID NO: 25852 - protein, 9 aa, Mycobacterium tuberculosis
RYLVGDLAA

SEQ ID NO: 25853 - protein, 9 aa, Mycobacterium tuberculosis
YLVGDLAAG

SEQ ID NO: 25854 - protein, 9 aa, Mycobacterium tuberculosis
LVGDLAAGS

SEQ ID NO: 25855 - protein, 9 aa, Mycobacterium tuberculosis
VGDLAAGSI

SEQ ID NO: 25856 - protein, 9 aa, Mycobacterium tuberculosis
GDLAAGSIK

SEQ ID NO: 25857 - protein, 9 aa, Mycobacterium tuberculosis
DLAAGSIKP

SEQ ID NO: 25858 - protein, 9 aa, Mycobacterium tuberculosis
LAAGSIKPI

SEQ ID NO: 25859 - protein, 9 aa, Mycobacterium tuberculosis
AAGSIKPIR

SEQ ID NO: 25860 - protein, 9 aa, Mycobacterium tuberculosis
AGSIKPIRG

SEQ ID NO: 25861 - protein, 9 aa, Mycobacterium tuberculosis
GSIKPIRGD

SEQ ID NO: 25862 - protein, 9 aa, Mycobacterium tuberculosis
SIKPIRGDI

SEQ ID NO: 25863 - protein, 9 aa, Mycobacterium tuberculosis
IKPIRGDIL

SEQ ID NO: 25864 - protein, 9 aa, Mycobacterium tuberculosis
KPIRGDILE

SEQ ID NO: 25865 - protein, 9 aa, Mycobacterium tuberculosis
PIRGDILEL

SEQ ID NO: 25866 - protein, 9 aa, Mycobacterium tuberculosis
IRGDILELR

SEQ ID NO: 25867 - protein, 9 aa, Mycobacterium tuberculosis
RGDILELRW

SEQ ID NO: 25868 - protein, 9 aa, Mycobacterium tuberculosis
GDILELRWH

SEQ ID NO: 25869 - protein, 9 aa, Mycobacterium tuberculosis
DILELRWHE

SEQ ID NO: 25870 - protein, 9 aa, Mycobacterium tuberculosis
ILELRWHEA

SEQ ID NO: 25871 - protein, 9 aa, Mycobacterium tuberculosis
LELRWHEAN

SEQ ID NO: 25872 - protein, 9 aa, Mycobacterium tuberculosis
ELRWHEANN

SEQ ID NO: 25873 - protein, 9 aa, Mycobacterium tuberculosis
LRWHEANNH

SEQ ID NO: 25874 - protein, 9 aa, Mycobacterium tuberculosis
RWHEANNHF

SEQ ID NO: 25875 - protein, 9 aa, Mycobacterium tuberculosis
WHEANNHFR

SEQ ID NO: 25876 - protein, 9 aa, Mycobacterium tuberculosis
HEANNHFRV

SEQ ID NO: 25877 - protein, 9 aa, Mycobacterium tuberculosis
EANNHFRVL

SEQ ID NO: 25878 - protein, 9 aa, Mycobacterium tuberculosis
ANNHFRVLF

SEQ ID NO: 25879 - protein, 9 aa, Mycobacterium tuberculosis
NNHFRVLFF

SEQ ID NO: 25880 - protein, 9 aa, Mycobacterium tuberculosis
NHFRVLFFR

SEQ ID NO: 25881 - protein, 9 aa, Mycobacterium tuberculosis
HFRVLFFRW

SEQ ID NO: 25882 - protein, 9 aa, Mycobacterium tuberculosis
FRVLFFRWG

SEQ ID NO: 25883 - protein, 9 aa, Mycobacterium tuberculosis
RVLFFRWGQ

SEQ ID NO: 25884 - protein, 9 aa, Mycobacterium tuberculosis
VLFFRWGQH

SEQ ID NO: 25885 - protein, 9 aa, Mycobacterium tuberculosis
LFFRWGQHP

SEQ ID NO: 25886 - protein, 9 aa, Mycobacterium tuberculosis
FFRWGQHPV

SEQ ID NO: 25887 - protein, 9 aa, Mycobacterium tuberculosis
FRWGQHPVA

SEQ ID NO: 25888 - protein, 9 aa, Mycobacterium tuberculosis
RWGQHPVAL

SEQ ID NO: 25889 - protein, 9 aa, Mycobacterium tuberculosis
WGQHPVALT

SEQ ID NO: 25890 - protein, 9 aa, Mycobacterium tuberculosis
GQHPVALTA

SEQ ID NO: 25891 - protein, 9 aa, Mycobacterium tuberculosis
QHPVALTAF

SEQ ID NO: 25892 - protein, 9 aa, Mycobacterium tuberculosis
HPVALTAFY

SEQ ID NO: 25893 - protein, 9 aa, Mycobacterium tuberculosis
PVALTAFYK

SEQ ID NO: 25894 - protein, 9 aa, Mycobacterium tuberculosis
VALTAFYKN

SEQ ID NO: 25895 - protein, 9 aa, Mycobacterium tuberculosis
ALTAFYKNQ

SEQ ID NO: 25896 - protein, 9 aa, Mycobacterium tuberculosis
LTAFYKNQQ

SEQ ID NO: 25897 - protein, 9 aa, Mycobacterium tuberculosis
TAFYKNQQK

SEQ ID NO: 25898 - protein, 9 aa, Mycobacterium tuberculosis
AFYKNQQKT

SEQ ID NO: 25899 - protein, 9 aa, Mycobacterium tuberculosis
FYKNQQKTP

SEQ ID NO: 25900 - protein, 9 aa, Mycobacterium tuberculosis
YKNQQKTPK

SEQ ID NO: 25901 - protein, 9 aa, Mycobacterium tuberculosis
KNQQKTPKT

SEQ ID NO: 25902 - protein, 9 aa, Mycobacterium tuberculosis
NQQKTPKTK

SEQ ID NO: 25903 - protein, 9 aa, Mycobacterium tuberculosis
QQKTPKTKI

SEQ ID NO: 25904 - protein, 9 aa, Mycobacterium tuberculosis
QKTPKTKIE

SEQ ID NO: 25905 - protein, 9 aa, Mycobacterium tuberculosis
KTPKTKIET

SEQ ID NO: 25906 - protein, 9 aa, Mycobacterium tuberculosis
TPKTKIETA

SEQ ID NO: 25907 - protein, 9 aa, Mycobacterium tuberculosis
PKTKIETAL

SEQ ID NO: 25908 - protein, 9 aa, Mycobacterium tuberculosis
KTKIETALD

SEQ ID NO: 25909 - protein, 9 aa, Mycobacterium tuberculosis
TKIETALDR

SEQ ID NO: 25910 - protein, 9 aa, Mycobacterium tuberculosis
KIETALDRQ

SEQ ID NO: 25911 - protein, 9 aa, Mycobacterium tuberculosis
IETALDRQK

SEQ ID NO: 25912 - protein, 9 aa, Mycobacterium tuberculosis
ETALDRQKI

SEQ ID NO: 25913 - protein, 9 aa, Mycobacterium tuberculosis
TALDRQKIW

SEQ ID NO: 25914 - protein, 9 aa, Mycobacterium tuberculosis
ALDRQKIWK

SEQ ID NO: 25915 - protein, 9 aa, Mycobacterium tuberculosis
LDRQKIWKR

SEQ ID NO: 25916 - protein, 9 aa, Mycobacterium tuberculosis
DRQKIWKRA

SEQ ID NO: 25917 - protein, 9 aa, Mycobacterium tuberculosis
RQKIWKRAF

SEQ ID NO: 25918 - protein, 9 aa, Mycobacterium tuberculosis
QKIWKRAFG

SEQ ID NO: 25919 - protein, 9 aa, Mycobacterium tuberculosis
KIWKRAFGD

SEQ ID NO: 25920 - protein, 9 aa, Mycobacterium tuberculosis
IWKRAFGDT

SEQ ID NO: 25921 - protein, 9 aa, Mycobacterium tuberculosis
WKRAFGDTP

SEQ ID NO: 25922 - protein, 9 aa, Mycobacterium tuberculosis
KRAFGDTPP

SEQ ID NO: 25923 - protein, 10 aa, Mycobacterium tuberculosis
MPSGWVSHRL

SEQ ID NO: 25924 - protein, 10 aa, Mycobacterium tuberculosis
PSGWVSHRLG

SEQ ID NO: 25925 - protein, 10 aa, Mycobacterium tuberculosis
SGWVSHRLGG

SEQ ID NO: 25926 - protein, 10 aa, Mycobacterium tuberculosis
GWVSHRLGGS

SEQ ID NO: 25927 - protein, 10 aa, Mycobacterium tuberculosis
WVSHRLGGSP

SEQ ID NO: 25928 - protein, 10 aa, Mycobacterium tuberculosis
VSHRLGGSPK

SEQ ID NO: 25929 - protein, 10 aa, Mycobacterium tuberculosis
SHRLGGSPKC

SEQ ID NO: 25930 - protein, 10 aa, Mycobacterium tuberculosis
HRLGGSPKCI

SEQ ID NO: 25931 - protein, 10 aa, Mycobacterium tuberculosis
RLGGSPKCIS

SEQ ID NO: 25932 - protein, 10 aa, Mycobacterium tuberculosis
LGGSPKCISA

SEQ ID NO: 25933 - protein, 10 aa, Mycobacterium tuberculosis
GGSPKCISAL

SEQ ID NO: 25934 - protein, 10 aa, Mycobacterium tuberculosis
GSPKCISALS

SEQ ID NO: 25935 - protein, 10 aa, Mycobacterium tuberculosis
SPKCISALSL

SEQ ID NO: 25936 - protein, 10 aa, Mycobacterium tuberculosis
PKCISALSLP

SEQ ID NO: 25937 - protein, 10 aa, Mycobacterium tuberculosis
KCISALSLPS

SEQ ID NO: 25938 - protein, 10 aa, Mycobacterium tuberculosis
CISALSLPSG

SEQ ID NO: 25939 - protein, 10 aa, Mycobacterium tuberculosis
ISALSLPSGT

SEQ ID NO: 25940 - protein, 10 aa, Mycobacterium tuberculosis
SALSLPSGTV

SEQ ID NO: 25941 - protein, 10 aa, Mycobacterium tuberculosis
ALSLPSGTVG

SEQ ID NO: 25942 - protein, 10 aa, Mycobacterium tuberculosis
LSLPSGTVGA

SEQ ID NO: 25943 - protein, 10 aa, Mycobacterium tuberculosis
SLPSGTVGAP

SEQ ID NO: 25944 - protein, 10 aa, Mycobacterium tuberculosis
LPSGTVGAPS

SEQ ID NO: 25945 - protein, 10 aa, Mycobacterium tuberculosis
PSGTVGAPSK

SEQ ID NO: 25946 - protein, 10 aa, Mycobacterium tuberculosis
SGTVGAPSKP

SEQ ID NO: 25947 - protein, 10 aa, Mycobacterium tuberculosis
GTVGAPSKPD

SEQ ID NO: 25948 - protein, 10 aa, Mycobacterium tuberculosis
TVGAPSKPDN

SEQ ID NO: 25949 - protein, 10 aa, Mycobacterium tuberculosis
VGAPSKPDND

SEQ ID NO: 25950 - protein, 10 aa, Mycobacterium tuberculosis
GAPSKPDNDA

SEQ ID NO: 25951 - protein, 10 aa, Mycobacterium tuberculosis
APSKPDNDAT

SEQ ID NO: 25952 - protein, 10 aa, Mycobacterium tuberculosis
PSKPDNDATR

SEQ ID NO: 25953 - protein, 10 aa, Mycobacterium tuberculosis
SKPDNDATRG

SEQ ID NO: 25954 - protein, 10 aa, Mycobacterium tuberculosis
KPDNDATRGR

SEQ ID NO: 25955 - protein, 10 aa, Mycobacterium tuberculosis
PDNDATRGRT

SEQ ID NO: 25956 - protein, 10 aa, Mycobacterium tuberculosis
DNDATRGRTR

SEQ ID NO: 25957 - protein, 10 aa, Mycobacterium tuberculosis
NDATRGRTRP

SEQ ID NO: 25958 - protein, 10 aa, Mycobacterium tuberculosis
DATRGRTRPT

SEQ ID NO: 25959 - protein, 10 aa, Mycobacterium tuberculosis
ATRGRTRPTV

SEQ ID NO: 25960 - protein, 10 aa, Mycobacterium tuberculosis
TRGRTRPTVP

SEQ ID NO: 25961 - protein, 10 aa, Mycobacterium tuberculosis
RGRTRPTVPP

SEQ ID NO: 25962 - protein, 10 aa, Mycobacterium tuberculosis
GRTRPTVPPP

SEQ ID NO: 25963 - protein, 10 aa, Mycobacterium tuberculosis
RTRPTVPPPD

SEQ ID NO: 25964 - protein, 10 aa, Mycobacterium tuberculosis
TRPTVPPPDP

SEQ ID NO: 25965 - protein, 10 aa, Mycobacterium tuberculosis
RPTVPPPDPA

SEQ ID NO: 25966 - protein, 10 aa, Mycobacterium tuberculosis
PTVPPPDPAA

SEQ ID NO: 25967 - protein, 10 aa, Mycobacterium tuberculosis
TVPPPDPAAM

SEQ ID NO: 25968 - protein, 10 aa, Mycobacterium tuberculosis
VPPPDPAAMG

SEQ ID NO: 25969 - protein, 10 aa, Mycobacterium tuberculosis
PPPDPAAMGT

SEQ ID NO: 25970 - protein, 10 aa, Mycobacterium tuberculosis
PPDPAAMGTW

SEQ ID NO: 25971 - protein, 10 aa, Mycobacterium tuberculosis
PDPAAMGTWK

SEQ ID NO: 25972 - protein, 10 aa, Mycobacterium tuberculosis
DPAAMGTWKF

SEQ ID NO: 25973 - protein, 10 aa, Mycobacterium tuberculosis
PAAMGTWKFF

SEQ ID NO: 25974 - protein, 10 aa, Mycobacterium tuberculosis
AAMGTWKFFR

SEQ ID NO: 25975 - protein, 10 aa, Mycobacterium tuberculosis
AMGTWKFFRA

SEQ ID NO: 25976 - protein, 10 aa, Mycobacterium tuberculosis
MGTWKFFRAS

SEQ ID NO: 25977 - protein, 10 aa, Mycobacterium tuberculosis
GTWKFFRASV

SEQ ID NO: 25978 - protein, 10 aa, Mycobacterium tuberculosis
TWKFFRASVD

SEQ ID NO: 25979 - protein, 10 aa, Mycobacterium tuberculosis
WKFFRASVDG

SEQ ID NO: 25980 - protein, 10 aa, Mycobacterium tuberculosis
KFFRASVDGR

SEQ ID NO: 25981 - protein, 10 aa, Mycobacterium tuberculosis
FFRASVDGRP

SEQ ID NO: 25982 - protein, 10 aa, Mycobacterium tuberculosis
FRASVDGRPV

SEQ ID NO: 25983 - protein, 10 aa, Mycobacterium tuberculosis
RASVDGRPVF

SEQ ID NO: 25984 - protein, 10 aa, Mycobacterium tuberculosis
ASVDGRPVFK

SEQ ID NO: 25985 - protein, 10 aa, Mycobacterium tuberculosis
SVDGRPVFKK

SEQ ID NO: 25986 - protein, 10 aa, Mycobacterium tuberculosis
VDGRPVFKKE

SEQ ID NO: 25987 - protein, 10 aa, Mycobacterium tuberculosis
DGRPVFKKEF

SEQ ID NO: 25988 - protein, 10 aa, Mycobacterium tuberculosis
GRPVFKKEFD

SEQ ID NO: 25989 - protein, 10 aa, Mycobacterium tuberculosis
RPVFKKEFDK

SEQ ID NO: 25990 - protein, 10 aa, Mycobacterium tuberculosis
PVFKKEFDKL

SEQ ID NO: 25991 - protein, 10 aa, Mycobacterium tuberculosis
VFKKEFDKLP

SEQ ID NO: 25992 - protein, 10 aa, Mycobacterium tuberculosis
FKKEFDKLPD

SEQ ID NO: 25993 - protein, 10 aa, Mycobacterium tuberculosis
KKEFDKLPDQ

SEQ ID NO: 25994 - protein, 10 aa, Mycobacterium tuberculosis
KEFDKLPDQA

SEQ ID NO: 25995 - protein, 10 aa, Mycobacterium tuberculosis
EFDKLPDQAR

SEQ ID NO: 25996 - protein, 10 aa, Mycobacterium tuberculosis
FDKLPDQARA

SEQ ID NO: 25997 - protein, 10 aa, Mycobacterium tuberculosis
DKLPDQARAA

SEQ ID NO: 25998 - protein, 10 aa, Mycobacterium tuberculosis
KLPDQARAAL

SEQ ID NO: 25999 - protein, 10 aa, Mycobacterium tuberculosis
LPDQARAALI

SEQ ID NO: 26000 - protein, 10 aa, Mycobacterium tuberculosis
PDQARAALIV

SEQ ID NO: 26001 - protein, 10 aa, Mycobacterium tuberculosis
DQARAALIVL

SEQ ID NO: 26002 - protein, 10 aa, Mycobacterium tuberculosis
QARAALIVLM

SEQ ID NO: 26003 - protein, 10 aa, Mycobacterium tuberculosis
ARAALIVLMQ

SEQ ID NO: 26004 - protein, 10 aa, Mycobacterium tuberculosis
RAALIVLMQR

SEQ ID NO: 26005 - protein, 10 aa, Mycobacterium tuberculosis
AALIVLMQRY

SEQ ID NO: 26006 - protein, 10 aa, Mycobacterium tuberculosis
ALIVLMQRYL

SEQ ID NO: 26007 - protein, 10 aa, Mycobacterium tuberculosis
LIVLMQRYLV

SEQ ID NO: 26008 - protein, 10 aa, Mycobacterium tuberculosis
IVLMQRYLVG

SEQ ID NO: 26009 - protein, 10 aa, Mycobacterium tuberculosis
VLMQRYLVGD

SEQ ID NO: 26010 - protein, 10 aa, Mycobacterium tuberculosis
LMQRYLVGDL

SEQ ID NO: 26011 - protein, 10 aa, Mycobacterium tuberculosis
MQRYLVGDLA

SEQ ID NO: 26012 - protein, 10 aa, Mycobacterium tuberculosis
QRYLVGDLAA

SEQ ID NO: 26013 - protein, 10 aa, Mycobacterium tuberculosis
RYLVGDLAAG

SEQ ID NO: 26014 - protein, 10 aa, Mycobacterium tuberculosis
YLVGDLAAGS

SEQ ID NO: 26015 - protein, 10 aa, Mycobacterium tuberculosis
LVGDLAAGSI

SEQ ID NO: 26016 - protein, 10 aa, Mycobacterium tuberculosis
VGDLAAGSIK

SEQ ID NO: 26017 - protein, 10 aa, Mycobacterium tuberculosis
GDLAAGSIKP

SEQ ID NO: 26018 - protein, 10 aa, Mycobacterium tuberculosis
DLAAGSIKPI

SEQ ID NO: 26019 - protein, 10 aa, Mycobacterium tuberculosis
LAAGSIKPIR

SEQ ID NO: 26020 - protein, 10 aa, Mycobacterium tuberculosis
AAGSIKPIRG

SEQ ID NO: 26021 - protein, 10 aa, Mycobacterium tuberculosis
AGSIKPIRGD

SEQ ID NO: 26022 - protein, 10 aa, Mycobacterium tuberculosis
GSIKPIRGDI

SEQ ID NO: 26023 - protein, 10 aa, Mycobacterium tuberculosis
SIKPIRGDIL

SEQ ID NO: 26024 - protein, 10 aa, Mycobacterium tuberculosis
IKPIRGDILE

SEQ ID NO: 26025 - protein, 10 aa, Mycobacterium tuberculosis
KPIRGDILEL

SEQ ID NO: 26026 - protein, 10 aa, Mycobacterium tuberculosis
PIRGDILELR

SEQ ID NO: 26027 - protein, 10 aa, Mycobacterium tuberculosis
IRGDILELRW

SEQ ID NO: 26028 - protein, 10 aa, Mycobacterium tuberculosis
RGDILELRWH

SEQ ID NO: 26029 - protein, 10 aa, Mycobacterium tuberculosis
GDILELRWHE

SEQ ID NO: 26030 - protein, 10 aa, Mycobacterium tuberculosis
DILELRWHEA

SEQ ID NO: 26031 - protein, 10 aa, Mycobacterium tuberculosis
ILELRWHEAN

SEQ ID NO: 26032 - protein, 10 aa, Mycobacterium tuberculosis
LELRWHEANN

SEQ ID NO: 26033 - protein, 10 aa, Mycobacterium tuberculosis
ELRWHEANNH

SEQ ID NO: 26034 - protein, 10 aa, Mycobacterium tuberculosis
LRWHEANNHF

SEQ ID NO: 26035 - protein, 10 aa, Mycobacterium tuberculosis
RWHEANNHFR

SEQ ID NO: 26036 - protein, 10 aa, Mycobacterium tuberculosis
WHEANNHFRV

SEQ ID NO: 26037 - protein, 10 aa, Mycobacterium tuberculosis
HEANNHFRVL

SEQ ID NO: 26038 - protein, 10 aa, Mycobacterium tuberculosis
EANNHFRVLF

SEQ ID NO: 26039 - protein, 10 aa, Mycobacterium tuberculosis
ANNHFRVLFF

SEQ ID NO: 26040 - protein, 10 aa, Mycobacterium tuberculosis
NNHFRVLFFR

SEQ ID NO: 26041 - protein, 10 aa, Mycobacterium tuberculosis
NHFRVLFFRW

SEQ ID NO: 26042 - protein, 10 aa, Mycobacterium tuberculosis
HFRVLFFRWG

SEQ ID NO: 26043 - protein, 10 aa, Mycobacterium tuberculosis
FRVLFFRWGQ

SEQ ID NO: 26044 - protein, 10 aa, Mycobacterium tuberculosis
RVLFFRWGQH

SEQ ID NO: 26045 - protein, 10 aa, Mycobacterium tuberculosis
VLFFRWGQHP

SEQ ID NO: 26046 - protein, 10 aa, Mycobacterium tuberculosis
LFFRWGQHPV

SEQ ID NO: 26047 - protein, 10 aa, Mycobacterium tuberculosis
FFRWGQHPVA

SEQ ID NO: 26048 - protein, 10 aa, Mycobacterium tuberculosis
FRWGQHPVAL

SEQ ID NO: 26049 - protein, 10 aa, Mycobacterium tuberculosis
RWGQHPVALT

SEQ ID NO: 26050 - protein, 10 aa, Mycobacterium tuberculosis
WGQHPVALTA

SEQ ID NO: 26051 - protein, 10 aa, Mycobacterium tuberculosis
GQHPVALTAF

SEQ ID NO: 26052 - protein, 10 aa, Mycobacterium tuberculosis
QHPVALTAFY

SEQ ID NO: 26053 - protein, 10 aa, Mycobacterium tuberculosis
HPVALTAFYK

SEQ ID NO: 26054 - protein, 10 aa, Mycobacterium tuberculosis
PVALTAFYKN

SEQ ID NO: 26055 - protein, 10 aa, Mycobacterium tuberculosis
VALTAFYKNQ

SEQ ID NO: 26056 - protein, 10 aa, Mycobacterium tuberculosis
ALTAFYKNQQ

SEQ ID NO: 26057 - protein, 10 aa, Mycobacterium tuberculosis
LTAFYKNQQK

SEQ ID NO: 26058 - protein, 10 aa, Mycobacterium tuberculosis
TAFYKNQQKT

SEQ ID NO: 26059 - protein, 10 aa, Mycobacterium tuberculosis
AFYKNQQKTP

SEQ ID NO: 26060 - protein, 10 aa, Mycobacterium tuberculosis
FYKNQQKTPK

SEQ ID NO: 26061 - protein, 10 aa, Mycobacterium tuberculosis
YKNQQKTPKT

SEQ ID NO: 26062 - protein, 10 aa, Mycobacterium tuberculosis
KNQQKTPKTK

SEQ ID NO: 26063 - protein, 10 aa, Mycobacterium tuberculosis
NQQKTPKTKI

SEQ ID NO: 26064 - protein, 10 aa, Mycobacterium tuberculosis
QQKTPKTKIE

SEQ ID NO: 26065 - protein, 10 aa, Mycobacterium tuberculosis
QKTPKTKIET

SEQ ID NO: 26066 - protein, 10 aa, Mycobacterium tuberculosis
KTPKTKIETA

SEQ ID NO: 26067 - protein, 10 aa, Mycobacterium tuberculosis
TPKTKIETAL

SEQ ID NO: 26068 - protein, 10 aa, Mycobacterium tuberculosis
PKTKIETALD

SEQ ID NO: 26069 - protein, 10 aa, Mycobacterium tuberculosis
KTKIETALDR

SEQ ID NO: 26070 - protein, 10 aa, Mycobacterium tuberculosis
TKIETALDRQ

SEQ ID NO: 26071 - protein, 10 aa, Mycobacterium tuberculosis
KIETALDRQK

SEQ ID NO: 26072 - protein, 10 aa, Mycobacterium tuberculosis
IETALDRQKI

SEQ ID NO: 26073 - protein, 10 aa, Mycobacterium tuberculosis
ETALDRQKIW

SEQ ID NO: 26074 - protein, 10 aa, Mycobacterium tuberculosis
TALDRQKIWK

SEQ ID NO: 26075 - protein, 10 aa, Mycobacterium tuberculosis
ALDRQKIWKR

SEQ ID NO: 26076 - protein, 10 aa, Mycobacterium tuberculosis
LDRQKIWKRA

SEQ ID NO: 26077 - protein, 10 aa, Mycobacterium tuberculosis
DRQKIWKRAF

SEQ ID NO: 26078 - protein, 10 aa, Mycobacterium tuberculosis
RQKIWKRAFG

SEQ ID NO: 26079 - protein, 10 aa, Mycobacterium tuberculosis
QKIWKRAFGD

SEQ ID NO: 26080 - protein, 10 aa, Mycobacterium tuberculosis
KIWKRAFGDT

SEQ ID NO: 26081 - protein, 10 aa, Mycobacterium tuberculosis
IWKRAFGDTP

SEQ ID NO: 26082 - protein, 10 aa, Mycobacterium tuberculosis
WKRAFGDTPP

SEQ ID NO: 26083 - protein, 10 aa, Mycobacterium tuberculosis
KRAFGDTPPI

SEQ ID NO: 26084 - protein, 11 aa, Mycobacterium tuberculosis
MPSGWVSHRLG

SEQ ID NO: 26085 - protein, 11 aa, Mycobacterium tuberculosis
PSGWVSHRLGG

SEQ ID NO: 26086 - protein, 11 aa, Mycobacterium tuberculosis
SGWVSHRLGGS

SEQ ID NO: 26087 - protein, 11 aa, Mycobacterium tuberculosis
GWVSHRLGGSP

SEQ ID NO: 26088 - protein, 11 aa, Mycobacterium tuberculosis
WVSHRLGGSPK

SEQ ID NO: 26089 - protein, 11 aa, Mycobacterium tuberculosis
VSHRLGGSPKC

SEQ ID NO: 26090 - protein, 11 aa, Mycobacterium tuberculosis
SHRLGGSPKCI

SEQ ID NO: 26091 - protein, 11 aa, Mycobacterium tuberculosis
HRLGGSPKCIS

SEQ ID NO: 26092 - protein, 11 aa, Mycobacterium tuberculosis
RLGGSPKCISA

SEQ ID NO: 26093 - protein, 11 aa, Mycobacterium tuberculosis
LGGSPKCISAL

SEQ ID NO: 26094 - protein, 11 aa, Mycobacterium tuberculosis
GGSPKCISALS

SEQ ID NO: 26095 - protein, 11 aa, Mycobacterium tuberculosis
GSPKCISALSL

SEQ ID NO: 26096 - protein, 11 aa, Mycobacterium tuberculosis
SPKCISALSLP

SEQ ID NO: 26097 - protein, 11 aa, Mycobacterium tuberculosis
PKCISALSLPS

SEQ ID NO: 26098 - protein, 11 aa, Mycobacterium tuberculosis
KCISALSLPSG

SEQ ID NO: 26099 - protein, 11 aa, Mycobacterium tuberculosis
CISALSLPSGT

SEQ ID NO: 26100 - protein, 11 aa, Mycobacterium tuberculosis
ISALSLPSGTV

SEQ ID NO: 26101 - protein, 11 aa, Mycobacterium tuberculosis
SALSLPSGTVG

SEQ ID NO: 26102 - protein, 11 aa, Mycobacterium tuberculosis
ALSLPSGTVGA

SEQ ID NO: 26103 - protein, 11 aa, Mycobacterium tuberculosis
LSLPSGTVGAP

SEQ ID NO: 26104 - protein, 11 aa, Mycobacterium tuberculosis
SLPSGTVGAPS

SEQ ID NO: 26105 - protein, 11 aa, Mycobacterium tuberculosis
LPSGTVGAPSK

SEQ ID NO: 26106 - protein, 11 aa, Mycobacterium tuberculosis
PSGTVGAPSKP

SEQ ID NO: 26107 - protein, 11 aa, Mycobacterium tuberculosis
SGTVGAPSKPD

SEQ ID NO: 26108 - protein, 11 aa, Mycobacterium tuberculosis
GTVGAPSKPDN

SEQ ID NO: 26109 - protein, 11 aa, Mycobacterium tuberculosis
TVGAPSKPDND

SEQ ID NO: 26110 - protein, 11 aa, Mycobacterium tuberculosis
VGAPSKPDNDA

SEQ ID NO: 26111 - protein, 11 aa, Mycobacterium tuberculosis
GAPSKPDNDAT

SEQ ID NO: 26112 - protein, 11 aa, Mycobacterium tuberculosis
APSKPDNDATR

SEQ ID NO: 26113 - protein, 11 aa, Mycobacterium tuberculosis
PSKPDNDATRG

SEQ ID NO: 26114 - protein, 11 aa, Mycobacterium tuberculosis
SKPDNDATRGR

SEQ ID NO: 26115 - protein, 11 aa, Mycobacterium tuberculosis
KPDNDATRGRT

SEQ ID NO: 26116 - protein, 11 aa, Mycobacterium tuberculosis
PDNDATRGRTR

SEQ ID NO: 26117 - protein, 11 aa, Mycobacterium tuberculosis
DNDATRGRTRP

SEQ ID NO: 26118 - protein, 11 aa, Mycobacterium tuberculosis
NDATRGRTRPT

SEQ ID NO: 26119 - protein, 11 aa, Mycobacterium tuberculosis
DATRGRTRPTV

SEQ ID NO: 26120 - protein, 11 aa, Mycobacterium tuberculosis
ATRGRTRPTVP

SEQ ID NO: 26121 - protein, 11 aa, Mycobacterium tuberculosis
TRGRTRPTVPP

SEQ ID NO: 26122 - protein, 11 aa, Mycobacterium tuberculosis
RGRTRPTVPPP

SEQ ID NO: 26123 - protein, 11 aa, Mycobacterium tuberculosis
GRTRPTVPPPD

SEQ ID NO: 26124 - protein, 11 aa, Mycobacterium tuberculosis
RTRPTVPPPDP

SEQ ID NO: 26125 - protein, 11 aa, Mycobacterium tuberculosis
TRPTVPPPDPA

SEQ ID NO: 26126 - protein, 11 aa, Mycobacterium tuberculosis
RPTVPPPDPAA

SEQ ID NO: 26127 - protein, 11 aa, Mycobacterium tuberculosis
PTVPPPDPAAM

SEQ ID NO: 26128 - protein, 11 aa, Mycobacterium tuberculosis
TVPPPDPAAMG

SEQ ID NO: 26129 - protein, 11 aa, Mycobacterium tuberculosis
VPPPDPAAMGT

SEQ ID NO: 26130 - protein, 11 aa, Mycobacterium tuberculosis
PPPDPAAMGTW

SEQ ID NO: 26131 - protein, 11 aa, Mycobacterium tuberculosis
PPDPAAMGTWK

SEQ ID NO: 26132 - protein, 11 aa, Mycobacterium tuberculosis
PDPAAMGTWKF

SEQ ID NO: 26133 - protein, 11 aa, Mycobacterium tuberculosis
DPAAMGTWKFF

SEQ ID NO: 26134 - protein, 11 aa, Mycobacterium tuberculosis
PAAMGTWKFFR

SEQ ID NO: 26135 - protein, 11 aa, Mycobacterium tuberculosis
AAMGTWKFFRA

SEQ ID NO: 26136 - protein, 11 aa, Mycobacterium tuberculosis
AMGTWKFFRAS

SEQ ID NO: 26137 - protein, 11 aa, Mycobacterium tuberculosis
MGTWKFFRASV

SEQ ID NO: 26138 - protein, 11 aa, Mycobacterium tuberculosis
GTWKFFRASVD

SEQ ID NO: 26139 - protein, 11 aa, Mycobacterium tuberculosis
TWKFFRASVDG

SEQ ID NO: 26140 - protein, 11 aa, Mycobacterium tuberculosis
WKFFRASVDGR

SEQ ID NO: 26141 - protein, 11 aa, Mycobacterium tuberculosis
KFFRASVDGRP

SEQ ID NO: 26142 - protein, 11 aa, Mycobacterium tuberculosis
FFRASVDGRPV

SEQ ID NO: 26143 - protein, 11 aa, Mycobacterium tuberculosis
FRASVDGRPVF

SEQ ID NO: 26144 - protein, 11 aa, Mycobacterium tuberculosis
RASVDGRPVFK

SEQ ID NO: 26145 - protein, 11 aa, Mycobacterium tuberculosis
ASVDGRPVFKK

SEQ ID NO: 26146 - protein, 11 aa, Mycobacterium tuberculosis
SVDGRPVFKKE

SEQ ID NO: 26147 - protein, 11 aa, Mycobacterium tuberculosis
VDGRPVFKKEF

SEQ ID NO: 26148 - protein, 11 aa, Mycobacterium tuberculosis
DGRPVFKKEFD

SEQ ID NO: 26149 - protein, 11 aa, Mycobacterium tuberculosis
GRPVFKKEFDK

SEQ ID NO: 26150 - protein, 11 aa, Mycobacterium tuberculosis
RPVFKKEFDKL

SEQ ID NO: 26151 - protein, 11 aa, Mycobacterium tuberculosis
PVFKKEFDKLP

SEQ ID NO: 26152 - protein, 11 aa, Mycobacterium tuberculosis
VFKKEFDKLPD

SEQ ID NO: 26153 - protein, 11 aa, Mycobacterium tuberculosis
FKKEFDKLPDQ

SEQ ID NO: 26154 - protein, 11 aa, Mycobacterium tuberculosis
KKEFDKLPDQA

SEQ ID NO: 26155 - protein, 11 aa, Mycobacterium tuberculosis
KEFDKLPDQAR

SEQ ID NO: 26156 - protein, 11 aa, Mycobacterium tuberculosis
EFDKLPDQARA

SEQ ID NO: 26157 - protein, 11 aa, Mycobacterium tuberculosis
FDKLPDQARAA

SEQ ID NO: 26158 - protein, 11 aa, Mycobacterium tuberculosis
DKLPDQARAAL

SEQ ID NO: 26159 - protein, 11 aa, Mycobacterium tuberculosis
KLPDQARAALI

SEQ ID NO: 26160 - protein, 11 aa, Mycobacterium tuberculosis
LPDQARAALIV

SEQ ID NO: 26161 - protein, 11 aa, Mycobacterium tuberculosis
PDQARAALIVL

SEQ ID NO: 26162 - protein, 11 aa, Mycobacterium tuberculosis
DQARAALIVLM

SEQ ID NO: 26163 - protein, 11 aa, Mycobacterium tuberculosis
QARAALIVLMQ

SEQ ID NO: 26164 - protein, 11 aa, Mycobacterium tuberculosis
ARAALIVLMQR

SEQ ID NO: 26165 - protein, 11 aa, Mycobacterium tuberculosis
RAALIVLMQRY

SEQ ID NO: 26166 - protein, 11 aa, Mycobacterium tuberculosis
AALIVLMQRYL

SEQ ID NO: 26167 - protein, 11 aa, Mycobacterium tuberculosis
ALIVLMQRYLV

SEQ ID NO: 26168 - protein, 11 aa, Mycobacterium tuberculosis
LIVLMQRYLVG

SEQ ID NO: 26169 - protein, 11 aa, Mycobacterium tuberculosis
IVLMQRYLVGD

SEQ ID NO: 26170 - protein, 11 aa, Mycobacterium tuberculosis
VLMQRYLVGDL

SEQ ID NO: 26171 - protein, 11 aa, Mycobacterium tuberculosis
LMQRYLVGDLA

SEQ ID NO: 26172 - protein, 11 aa, Mycobacterium tuberculosis
MQRYLVGDLAA

SEQ ID NO: 26173 - protein, 11 aa, Mycobacterium tuberculosis
QRYLVGDLAAG

SEQ ID NO: 26174 - protein, 11 aa, Mycobacterium tuberculosis
RYLVGDLAAGS

SEQ ID NO: 26175 - protein, 11 aa, Mycobacterium tuberculosis
YLVGDLAAGSI

SEQ ID NO: 26176 - protein, 11 aa, Mycobacterium tuberculosis
LVGDLAAGSIK

SEQ ID NO: 26177 - protein, 11 aa, Mycobacterium tuberculosis
VGDLAAGSIKP

SEQ ID NO: 26178 - protein, 11 aa, Mycobacterium tuberculosis
GDLAAGSIKPI

SEQ ID NO: 26179 - protein, 11 aa, Mycobacterium tuberculosis
DLAAGSIKPIR

SEQ ID NO: 26180 - protein, 11 aa, Mycobacterium tuberculosis
LAAGSIKPIRG

SEQ ID NO: 26181 - protein, 11 aa, Mycobacterium tuberculosis
AAGSIKPIRGD

SEQ ID NO: 26182 - protein, 11 aa, Mycobacterium tuberculosis
AGSIKPIRGDI

SEQ ID NO: 26183 - protein, 11 aa, Mycobacterium tuberculosis
GSIKPIRGDIL

SEQ ID NO: 26184 - protein, 11 aa, Mycobacterium tuberculosis
SIKPIRGDILE

SEQ ID NO: 26185 - protein, 11 aa, Mycobacterium tuberculosis
IKPIRGDILEL

SEQ ID NO: 26186 - protein, 11 aa, Mycobacterium tuberculosis
KPIRGDILELR

SEQ ID NO: 26187 - protein, 11 aa, Mycobacterium tuberculosis
PIRGDILELRW

SEQ ID NO: 26188 - protein, 11 aa, Mycobacterium tuberculosis
IRGDILELRWH

SEQ ID NO: 26189 - protein, 11 aa, Mycobacterium tuberculosis
RGDILELRWHE

SEQ ID NO: 26190 - protein, 11 aa, Mycobacterium tuberculosis
GDILELRWHEA

SEQ ID NO: 26191 - protein, 11 aa, Mycobacterium tuberculosis
DILELRWHEAN

SEQ ID NO: 26192 - protein, 11 aa, Mycobacterium tuberculosis
ILELRWHEANN

SEQ ID NO: 26193 - protein, 11 aa, Mycobacterium tuberculosis
LELRWHEANNH

SEQ ID NO: 26194 - protein, 11 aa, Mycobacterium tuberculosis
ELRWHEANNHF

SEQ ID NO: 26195 - protein, 11 aa, Mycobacterium tuberculosis
LRWHEANNHFR

SEQ ID NO: 26196 - protein, 11 aa, Mycobacterium tuberculosis
RWHEANNHFRV

SEQ ID NO: 26197 - protein, 11 aa, Mycobacterium tuberculosis
WHEANNHFRVL

SEQ ID NO: 26198 - protein, 11 aa, Mycobacterium tuberculosis
HEANNHFRVLF

SEQ ID NO: 26199 - protein, 11 aa, Mycobacterium tuberculosis
EANNHFRVLFF

SEQ ID NO: 26200 - protein, 11 aa, Mycobacterium tuberculosis
ANNHFRVLFFR

SEQ ID NO: 26201 - protein, 11 aa, Mycobacterium tuberculosis
NNHFRVLFFRW

SEQ ID NO: 26202 - protein, 11 aa, Mycobacterium tuberculosis
NHFRVLFFRWG

SEQ ID NO: 26203 - protein, 11 aa, Mycobacterium tuberculosis
HFRVLFFRWGQ

SEQ ID NO: 26204 - protein, 11 aa, Mycobacterium tuberculosis
FRVLFFRWGQH

SEQ ID NO: 26205 - protein, 11 aa, Mycobacterium tuberculosis
RVLFFRWGQHP

SEQ ID NO: 26206 - protein, 11 aa, Mycobacterium tuberculosis
VLFFRWGQHPV

SEQ ID NO: 26207 - protein, 11 aa, Mycobacterium tuberculosis
LFFRWGQHPVA

SEQ ID NO: 26208 - protein, 11 aa, Mycobacterium tuberculosis
FFRWGQHPVAL

SEQ ID NO: 26209 - protein, 11 aa, Mycobacterium tuberculosis
FRWGQHPVALT

SEQ ID NO: 26210 - protein, 11 aa, Mycobacterium tuberculosis
RWGQHPVALTA

SEQ ID NO: 26211 - protein, 11 aa, Mycobacterium tuberculosis
WGQHPVALTAF

SEQ ID NO: 26212 - protein, 11 aa, Mycobacterium tuberculosis
GQHPVALTAFY

SEQ ID NO: 26213 - protein, 11 aa, Mycobacterium tuberculosis
QHPVALTAFYK

SEQ ID NO: 26214 - protein, 11 aa, Mycobacterium tuberculosis
HPVALTAFYKN

SEQ ID NO: 26215 - protein, 11 aa, Mycobacterium tuberculosis
PVALTAFYKNQ

SEQ ID NO: 26216 - protein, 11 aa, Mycobacterium tuberculosis
VALTAFYKNQQ

SEQ ID NO: 26217 - protein, 11 aa, Mycobacterium tuberculosis
ALTAFYKNQQK

SEQ ID NO: 26218 - protein, 11 aa, Mycobacterium tuberculosis
LTAFYKNQQKT

SEQ ID NO: 26219 - protein, 11 aa, Mycobacterium tuberculosis
TAFYKNQQKTP

SEQ ID NO: 26220 - protein, 11 aa, Mycobacterium tuberculosis
AFYKNQQKTPK

SEQ ID NO: 26221 - protein, 11 aa, Mycobacterium tuberculosis
FYKNQQKTPKT

SEQ ID NO: 26222 - protein, 11 aa, Mycobacterium tuberculosis
YKNQQKTPKTK

SEQ ID NO: 26223 - protein, 11 aa, Mycobacterium tuberculosis
KNQQKTPKTKI

SEQ ID NO: 26224 - protein, 11 aa, Mycobacterium tuberculosis
NQQKTPKTKIE

SEQ ID NO: 26225 - protein, 11 aa, Mycobacterium tuberculosis
QQKTPKTKIET

SEQ ID NO: 26226 - protein, 11 aa, Mycobacterium tuberculosis
QKTPKTKIETA

SEQ ID NO: 26227 - protein, 11 aa, Mycobacterium tuberculosis
KTPKTKIETAL

SEQ ID NO: 26228 - protein, 11 aa, Mycobacterium tuberculosis
TPKTKIETALD

SEQ ID NO: 26229 - protein, 11 aa, Mycobacterium tuberculosis
PKTKIETALDR

SEQ ID NO: 26230 - protein, 11 aa, Mycobacterium tuberculosis
KTKIETALDRQ

SEQ ID NO: 26231 - protein, 11 aa, Mycobacterium tuberculosis
TKIETALDRQK

SEQ ID NO: 26232 - protein, 11 aa, Mycobacterium tuberculosis
KIETALDRQKI

SEQ ID NO: 26233 - protein, 11 aa, Mycobacterium tuberculosis
IETALDRQKIW

SEQ ID NO: 26234 - protein, 11 aa, Mycobacterium tuberculosis
ETALDRQKIWK

SEQ ID NO: 26235 - protein, 11 aa, Mycobacterium tuberculosis
TALDRQKIWKR

SEQ ID NO: 26236 - protein, 11 aa, Mycobacterium tuberculosis
ALDRQKIWKRA

SEQ ID NO: 26237 - protein, 11 aa, Mycobacterium tuberculosis
LDRQKIWKRAF

SEQ ID NO: 26238 - protein, 11 aa, Mycobacterium tuberculosis
DRQKIWKRAFG

SEQ ID NO: 26239 - protein, 11 aa, Mycobacterium tuberculosis
RQKIWKRAFGD

SEQ ID NO: 26240 - protein, 11 aa, Mycobacterium tuberculosis
QKIWKRAFGDT

SEQ ID NO: 26241 - protein, 11 aa, Mycobacterium tuberculosis
KIWKRAFGDTP

SEQ ID NO: 26242 - protein, 11 aa, Mycobacterium tuberculosis
IWKRAFGDTPP

SEQ ID NO: 26243 - protein, 11 aa, Mycobacterium tuberculosis
WKRAFGDTPPI

SEQ ID NO: 26244 - protein, 8 aa, Mycobacterium tuberculosis
MSTYRSPD

SEQ ID NO: 26245 - protein, 8 aa, Mycobacterium tuberculosis
STYRSPDR

SEQ ID NO: 26246 - protein, 8 aa, Mycobacterium tuberculosis
TYRSPDRA

SEQ ID NO: 26247 - protein, 8 aa, Mycobacterium tuberculosis
YRSPDRAW

SEQ ID NO: 26248 - protein, 8 aa, Mycobacterium tuberculosis
RSPDRAWQ

SEQ ID NO: 26249 - protein, 8 aa, Mycobacterium tuberculosis
SPDRAWQA

SEQ ID NO: 26250 - protein, 8 aa, Mycobacterium tuberculosis
PDRAWQAL

SEQ ID NO: 26251 - protein, 8 aa, Mycobacterium tuberculosis
DRAWQALA

SEQ ID NO: 26252 - protein, 8 aa, Mycobacterium tuberculosis
RAWQALAD

SEQ ID NO: 26253 - protein, 8 aa, Mycobacterium tuberculosis
AWQALADG

SEQ ID NO: 26254 - protein, 8 aa, Mycobacterium tuberculosis
WQALADGT

SEQ ID NO: 26255 - protein, 8 aa, Mycobacterium tuberculosis
QALADGTR

SEQ ID NO: 26256 - protein, 8 aa, Mycobacterium tuberculosis
ALADGTRR

SEQ ID NO: 26257 - protein, 8 aa, Mycobacterium tuberculosis
LADGTRRA

SEQ ID NO: 26258 - protein, 8 aa, Mycobacterium tuberculosis
ADGTRRAI

SEQ ID NO: 26259 - protein, 8 aa, Mycobacterium tuberculosis
DGTRRAIV

SEQ ID NO: 26260 - protein, 8 aa, Mycobacterium tuberculosis
GTRRAIVE

SEQ ID NO: 26261 - protein, 8 aa, Mycobacterium tuberculosis
TRRAIVER

SEQ ID NO: 26262 - protein, 8 aa, Mycobacterium tuberculosis
RRAIVERL

SEQ ID NO: 26263 - protein, 8 aa, Mycobacterium tuberculosis
RAIVERLA

SEQ ID NO: 26264 - protein, 8 aa, Mycobacterium tuberculosis
AIVERLAH

SEQ ID NO: 26265 - protein, 8 aa, Mycobacterium tuberculosis
IVERLAHG

SEQ ID NO: 26266 - protein, 8 aa, Mycobacterium tuberculosis
VERLAHGP

SEQ ID NO: 26267 - protein, 8 aa, Mycobacterium tuberculosis
ERLAHGPL

SEQ ID NO: 26268 - protein, 8 aa, Mycobacterium tuberculosis
RLAHGPLA

SEQ ID NO: 26269 - protein, 8 aa, Mycobacterium tuberculosis
LAHGPLAV

SEQ ID NO: 26270 - protein, 8 aa, Mycobacterium tuberculosis
AHGPLAVG

SEQ ID NO: 26271 - protein, 8 aa, Mycobacterium tuberculosis
HGPLAVGE

SEQ ID NO: 26272 - protein, 8 aa, Mycobacterium tuberculosis
GPLAVGEL

SEQ ID NO: 26273 - protein, 8 aa, Mycobacterium tuberculosis
PLAVGELA

SEQ ID NO: 26274 - protein, 8 aa, Mycobacterium tuberculosis
LAVGELAR

SEQ ID NO: 26275 - protein, 8 aa, Mycobacterium tuberculosis
AVGELARD

SEQ ID NO: 26276 - protein, 8 aa, Mycobacterium tuberculosis
VGELARDL

SEQ ID NO: 26277 - protein, 8 aa, Mycobacterium tuberculosis
GELARDLP

SEQ ID NO: 26278 - protein, 8 aa, Mycobacterium tuberculosis
ELARDLPV

SEQ ID NO: 26279 - protein, 8 aa, Mycobacterium tuberculosis
LARDLPVS

SEQ ID NO: 26280 - protein, 8 aa, Mycobacterium tuberculosis
ARDLPVSR

SEQ ID NO: 26281 - protein, 8 aa, Mycobacterium tuberculosis
RDLPVSRP

SEQ ID NO: 26282 - protein, 8 aa, Mycobacterium tuberculosis
DLPVSRPA

SEQ ID NO: 26283 - protein, 8 aa, Mycobacterium tuberculosis
LPVSRPAV

SEQ ID NO: 26284 - protein, 8 aa, Mycobacterium tuberculosis
PVSRPAVS

SEQ ID NO: 26285 - protein, 8 aa, Mycobacterium tuberculosis
VSRPAVSQ

SEQ ID NO: 26286 - protein, 8 aa, Mycobacterium tuberculosis
SRPAVSQH

SEQ ID NO: 26287 - protein, 8 aa, Mycobacterium tuberculosis
RPAVSQHL

SEQ ID NO: 26288 - protein, 8 aa, Mycobacterium tuberculosis
PAVSQHLK

SEQ ID NO: 26289 - protein, 8 aa, Mycobacterium tuberculosis
AVSQHLKV

SEQ ID NO: 26290 - protein, 8 aa, Mycobacterium tuberculosis
VSQHLKVL

SEQ ID NO: 26291 - protein, 8 aa, Mycobacterium tuberculosis
SQHLKVLK

SEQ ID NO: 26292 - protein, 8 aa, Mycobacterium tuberculosis
QHLKVLKT

SEQ ID NO: 26293 - protein, 8 aa, Mycobacterium tuberculosis
HLKVLKTA

SEQ ID NO: 26294 - protein, 8 aa, Mycobacterium tuberculosis
LKVLKTAR

SEQ ID NO: 26295 - protein, 8 aa, Mycobacterium tuberculosis
KVLKTARL

SEQ ID NO: 26296 - protein, 8 aa, Mycobacterium tuberculosis
VLKTARLV

SEQ ID NO: 26297 - protein, 8 aa, Mycobacterium tuberculosis
LKTARLVC

SEQ ID NO: 26298 - protein, 8 aa, Mycobacterium tuberculosis
KTARLVCD

SEQ ID NO: 26299 - protein, 8 aa, Mycobacterium tuberculosis
TARLVCDR

SEQ ID NO: 26300 - protein, 8 aa, Mycobacterium tuberculosis
ARLVCDRP

SEQ ID NO: 26301 - protein, 8 aa, Mycobacterium tuberculosis
RLVCDRPA

SEQ ID NO: 26302 - protein, 8 aa, Mycobacterium tuberculosis
LVCDRPAG

SEQ ID NO: 26303 - protein, 8 aa, Mycobacterium tuberculosis
VCDRPAGT

SEQ ID NO: 26304 - protein, 8 aa, Mycobacterium tuberculosis
CDRPAGTR

SEQ ID NO: 26305 - protein, 8 aa, Mycobacterium tuberculosis
DRPAGTRR

SEQ ID NO: 26306 - protein, 8 aa, Mycobacterium tuberculosis
RPAGTRRV

SEQ ID NO: 26307 - protein, 8 aa, Mycobacterium tuberculosis
PAGTRRVY

SEQ ID NO: 26308 - protein, 8 aa, Mycobacterium tuberculosis
AGTRRVYQ

SEQ ID NO: 26309 - protein, 8 aa, Mycobacterium tuberculosis
GTRRVYQL

SEQ ID NO: 26310 - protein, 8 aa, Mycobacterium tuberculosis
TRRVYQLD

SEQ ID NO: 26311 - protein, 8 aa, Mycobacterium tuberculosis
RRVYQLDP

SEQ ID NO: 26312 - protein, 8 aa, Mycobacterium tuberculosis
RVYQLDPT

SEQ ID NO: 26313 - protein, 8 aa, Mycobacterium tuberculosis
VYQLDPTG

SEQ ID NO: 26314 - protein, 8 aa, Mycobacterium tuberculosis
YQLDPTGL

SEQ ID NO: 26315 - protein, 8 aa, Mycobacterium tuberculosis
QLDPTGLA

SEQ ID NO: 26316 - protein, 8 aa, Mycobacterium tuberculosis
LDPTGLAA

SEQ ID NO: 26317 - protein, 8 aa, Mycobacterium tuberculosis
DPTGLAAL

SEQ ID NO: 26318 - protein, 8 aa, Mycobacterium tuberculosis
PTGLAALR

SEQ ID NO: 26319 - protein, 8 aa, Mycobacterium tuberculosis
TGLAALRT

SEQ ID NO: 26320 - protein, 8 aa, Mycobacterium tuberculosis
GLAALRTD

SEQ ID NO: 26321 - protein, 8 aa, Mycobacterium tuberculosis
LAALRTDL

SEQ ID NO: 26322 - protein, 8 aa, Mycobacterium tuberculosis
AALRTDLD

SEQ ID NO: 26323 - protein, 8 aa, Mycobacterium tuberculosis
ALRTDLDR

SEQ ID NO: 26324 - protein, 8 aa, Mycobacterium tuberculosis
LRTDLDRF

SEQ ID NO: 26325 - protein, 8 aa, Mycobacterium tuberculosis
RTDLDRFW

SEQ ID NO: 26326 - protein, 8 aa, Mycobacterium tuberculosis
TDLDRFWT

SEQ ID NO: 26327 - protein, 8 aa, Mycobacterium tuberculosis
DLDRFWTR

SEQ ID NO: 26328 - protein, 8 aa, Mycobacterium tuberculosis
LDRFWTRA

SEQ ID NO: 26329 - protein, 8 aa, Mycobacterium tuberculosis
DRFWTRAL

SEQ ID NO: 26330 - protein, 8 aa, Mycobacterium tuberculosis
RFWTRALT

SEQ ID NO: 26331 - protein, 8 aa, Mycobacterium tuberculosis
FWTRALTG

SEQ ID NO: 26332 - protein, 8 aa, Mycobacterium tuberculosis
WTRALTGY

SEQ ID NO: 26333 - protein, 8 aa, Mycobacterium tuberculosis
TRALTGYA

SEQ ID NO: 26334 - protein, 8 aa, Mycobacterium tuberculosis
RALTGYAQ

SEQ ID NO: 26335 - protein, 8 aa, Mycobacterium tuberculosis
ALTGYAQL

SEQ ID NO: 26336 - protein, 8 aa, Mycobacterium tuberculosis
LTGYAQLI

SEQ ID NO: 26337 - protein, 8 aa, Mycobacterium tuberculosis
TGYAQLID

SEQ ID NO: 26338 - protein, 8 aa, Mycobacterium tuberculosis
GYAQLIDS

SEQ ID NO: 26339 - protein, 8 aa, Mycobacterium tuberculosis
YAQLIDSE

SEQ ID NO: 26340 - protein, 8 aa, Mycobacterium tuberculosis
AQLIDSEG

SEQ ID NO: 26341 - protein, 8 aa, Mycobacterium tuberculosis
QLIDSEGD

SEQ ID NO: 26342 - protein, 8 aa, Mycobacterium tuberculosis
LIDSEGDD

SEQ ID NO: 26343 - protein, 8 aa, Mycobacterium tuberculosis
IDSEGDDT

SEQ ID NO: 26344 - protein, 9 aa, Mycobacterium tuberculosis
MSTYRSPDR

SEQ ID NO: 26345 - protein, 9 aa, Mycobacterium tuberculosis
STYRSPDRA

SEQ ID NO: 26346 - protein, 9 aa, Mycobacterium tuberculosis
TYRSPDRAW

SEQ ID NO: 26347 - protein, 9 aa, Mycobacterium tuberculosis
YRSPDRAWQ

SEQ ID NO: 26348 - protein, 9 aa, Mycobacterium tuberculosis
RSPDRAWQA

SEQ ID NO: 26349 - protein, 9 aa, Mycobacterium tuberculosis
SPDRAWQAL

SEQ ID NO: 26350 - protein, 9 aa, Mycobacterium tuberculosis
PDRAWQALA

SEQ ID NO: 26351 - protein, 9 aa, Mycobacterium tuberculosis
DRAWQALAD

SEQ ID NO: 26352 - protein, 9 aa, Mycobacterium tuberculosis
RAWQALADG

SEQ ID NO: 26353 - protein, 9 aa, Mycobacterium tuberculosis
AWQALADGT

SEQ ID NO: 26354 - protein, 9 aa, Mycobacterium tuberculosis
WQALADGTR

SEQ ID NO: 26355 - protein, 9 aa, Mycobacterium tuberculosis
QALADGTRR

SEQ ID NO: 26356 - protein, 9 aa, Mycobacterium tuberculosis
ALADGTRRA

SEQ ID NO: 26357 - protein, 9 aa, Mycobacterium tuberculosis
LADGTRRAI

SEQ ID NO: 26358 - protein, 9 aa, Mycobacterium tuberculosis
ADGTRRAIV

SEQ ID NO: 26359 - protein, 9 aa, Mycobacterium tuberculosis
DGTRRAIVE

SEQ ID NO: 26360 - protein, 9 aa, Mycobacterium tuberculosis
GTRRAIVER

SEQ ID NO: 26361 - protein, 9 aa, Mycobacterium tuberculosis
TRRAIVERL

SEQ ID NO: 26362 - protein, 9 aa, Mycobacterium tuberculosis
RRAIVERLA

SEQ ID NO: 26363 - protein, 9 aa, Mycobacterium tuberculosis
RAIVERLAH

SEQ ID NO: 26364 - protein, 9 aa, Mycobacterium tuberculosis
AIVERLAHG

SEQ ID NO: 26365 - protein, 9 aa, Mycobacterium tuberculosis
IVERLAHGP

SEQ ID NO: 26366 - protein, 9 aa, Mycobacterium tuberculosis
VERLAHGPL

SEQ ID NO: 26367 - protein, 9 aa, Mycobacterium tuberculosis
ERLAHGPLA

SEQ ID NO: 26368 - protein, 9 aa, Mycobacterium tuberculosis
RLAHGPLAV

SEQ ID NO: 26369 - protein, 9 aa, Mycobacterium tuberculosis
LAHGPLAVG

SEQ ID NO: 26370 - protein, 9 aa, Mycobacterium tuberculosis
AHGPLAVGE

SEQ ID NO: 26371 - protein, 9 aa, Mycobacterium tuberculosis
HGPLAVGEL

SEQ ID NO: 26372 - protein, 9 aa, Mycobacterium tuberculosis
GPLAVGELA

SEQ ID NO: 26373 - protein, 9 aa, Mycobacterium tuberculosis
PLAVGELAR

SEQ ID NO: 26374 - protein, 9 aa, Mycobacterium tuberculosis
LAVGELARD

SEQ ID NO: 26375 - protein, 9 aa, Mycobacterium tuberculosis
AVGELARDL

SEQ ID NO: 26376 - protein, 9 aa, Mycobacterium tuberculosis
VGELARDLP

SEQ ID NO: 26377 - protein, 9 aa, Mycobacterium tuberculosis
GELARDLPV

SEQ ID NO: 26378 - protein, 9 aa, Mycobacterium tuberculosis
ELARDLPVS

SEQ ID NO: 26379 - protein, 9 aa, Mycobacterium tuberculosis
LARDLPVSR

SEQ ID NO: 26380 - protein, 9 aa, Mycobacterium tuberculosis
ARDLPVSRP

SEQ ID NO: 26381 - protein, 9 aa, Mycobacterium tuberculosis
RDLPVSRPA

SEQ ID NO: 26382 - protein, 9 aa, Mycobacterium tuberculosis
DLPVSRPAV

SEQ ID NO: 26383 - protein, 9 aa, Mycobacterium tuberculosis
LPVSRPAVS

SEQ ID NO: 26384 - protein, 9 aa, Mycobacterium tuberculosis
PVSRPAVSQ

SEQ ID NO: 26385 - protein, 9 aa, Mycobacterium tuberculosis
VSRPAVSQH

SEQ ID NO: 26386 - protein, 9 aa, Mycobacterium tuberculosis
SRPAVSQHL

SEQ ID NO: 26387 - protein, 9 aa, Mycobacterium tuberculosis
RPAVSQHLK

SEQ ID NO: 26388 - protein, 9 aa, Mycobacterium tuberculosis
PAVSQHLKV

SEQ ID NO: 26389 - protein, 9 aa, Mycobacterium tuberculosis
AVSQHLKVL

SEQ ID NO: 26390 - protein, 9 aa, Mycobacterium tuberculosis
VSQHLKVLK

SEQ ID NO: 26391 - protein, 9 aa, Mycobacterium tuberculosis
SQHLKVLKT

SEQ ID NO: 26392 - protein, 9 aa, Mycobacterium tuberculosis
QHLKVLKTA

SEQ ID NO: 26393 - protein, 9 aa, Mycobacterium tuberculosis
HLKVLKTAR

SEQ ID NO: 26394 - protein, 9 aa, Mycobacterium tuberculosis
LKVLKTARL

SEQ ID NO: 26395 - protein, 9 aa, Mycobacterium tuberculosis
KVLKTARLV

SEQ ID NO: 26396 - protein, 9 aa, Mycobacterium tuberculosis
VLKTARLVC

SEQ ID NO: 26397 - protein, 9 aa, Mycobacterium tuberculosis
LKTARLVCD

SEQ ID NO: 26398 - protein, 9 aa, Mycobacterium tuberculosis
KTARLVCDR

SEQ ID NO: 26399 - protein, 9 aa, Mycobacterium tuberculosis
TARLVCDRP

SEQ ID NO: 26400 - protein, 9 aa, Mycobacterium tuberculosis
ARLVCDRPA

SEQ ID NO: 26401 - protein, 9 aa, Mycobacterium tuberculosis
RLVCDRPAG

SEQ ID NO: 26402 - protein, 9 aa, Mycobacterium tuberculosis
LVCDRPAGT

SEQ ID NO: 26403 - protein, 9 aa, Mycobacterium tuberculosis
VCDRPAGTR

SEQ ID NO: 26404 - protein, 9 aa, Mycobacterium tuberculosis
CDRPAGTRR

SEQ ID NO: 26405 - protein, 9 aa, Mycobacterium tuberculosis
DRPAGTRRV

SEQ ID NO: 26406 - protein, 9 aa, Mycobacterium tuberculosis
RPAGTRRVY

SEQ ID NO: 26407 - protein, 9 aa, Mycobacterium tuberculosis
PAGTRRVYQ

SEQ ID NO: 26408 - protein, 9 aa, Mycobacterium tuberculosis
AGTRRVYQL

SEQ ID NO: 26409 - protein, 9 aa, Mycobacterium tuberculosis
GTRRVYQLD

SEQ ID NO: 26410 - protein, 9 aa, Mycobacterium tuberculosis
TRRVYQLDP

SEQ ID NO: 26411 - protein, 9 aa, Mycobacterium tuberculosis
RRVYQLDPT

SEQ ID NO: 26412 - protein, 9 aa, Mycobacterium tuberculosis
RVYQLDPTG

SEQ ID NO: 26413 - protein, 9 aa, Mycobacterium tuberculosis
VYQLDPTGL

SEQ ID NO: 26414 - protein, 9 aa, Mycobacterium tuberculosis
YQLDPTGLA

SEQ ID NO: 26415 - protein, 9 aa, Mycobacterium tuberculosis
QLDPTGLAA

SEQ ID NO: 26416 - protein, 9 aa, Mycobacterium tuberculosis
LDPTGLAAL

SEQ ID NO: 26417 - protein, 9 aa, Mycobacterium tuberculosis
DPTGLAALR

SEQ ID NO: 26418 - protein, 9 aa, Mycobacterium tuberculosis
PTGLAALRT

SEQ ID NO: 26419 - protein, 9 aa, Mycobacterium tuberculosis
TGLAALRTD

SEQ ID NO: 26420 - protein, 9 aa, Mycobacterium tuberculosis
GLAALRTDL

SEQ ID NO: 26421 - protein, 9 aa, Mycobacterium tuberculosis
LAALRTDLD

SEQ ID NO: 26422 - protein, 9 aa, Mycobacterium tuberculosis
AALRTDLDR

SEQ ID NO: 26423 - protein, 9 aa, Mycobacterium tuberculosis
ALRTDLDRF

SEQ ID NO: 26424 - protein, 9 aa, Mycobacterium tuberculosis
LRTDLDRFW

SEQ ID NO: 26425 - protein, 9 aa, Mycobacterium tuberculosis
RTDLDRFWT

SEQ ID NO: 26426 - protein, 9 aa, Mycobacterium tuberculosis
TDLDRFWTR

SEQ ID NO: 26427 - protein, 9 aa, Mycobacterium tuberculosis
DLDRFWTRA

SEQ ID NO: 26428 - protein, 9 aa, Mycobacterium tuberculosis
LDRFWTRAL

SEQ ID NO: 26429 - protein, 9 aa, Mycobacterium tuberculosis
DRFWTRALT

SEQ ID NO: 26430 - protein, 9 aa, Mycobacterium tuberculosis
RFWTRALTG

SEQ ID NO: 26431 - protein, 9 aa, Mycobacterium tuberculosis
FWTRALTGY

SEQ ID NO: 26432 - protein, 9 aa, Mycobacterium tuberculosis
WTRALTGYA

SEQ ID NO: 26433 - protein, 9 aa, Mycobacterium tuberculosis
TRALTGYAQ

SEQ ID NO: 26434 - protein, 9 aa, Mycobacterium tuberculosis
RALTGYAQL

SEQ ID NO: 26435 - protein, 9 aa, Mycobacterium tuberculosis
ALTGYAQLI

SEQ ID NO: 26436 - protein, 9 aa, Mycobacterium tuberculosis
LTGYAQLID

SEQ ID NO: 26437 - protein, 9 aa, Mycobacterium tuberculosis
TGYAQLIDS

SEQ ID NO: 26438 - protein, 9 aa, Mycobacterium tuberculosis
GYAQLIDSE

SEQ ID NO: 26439 - protein, 9 aa, Mycobacterium tuberculosis
YAQLIDSEG

SEQ ID NO: 26440 - protein, 9 aa, Mycobacterium tuberculosis
AQLIDSEGD

SEQ ID NO: 26441 - protein, 9 aa, Mycobacterium tuberculosis
QLIDSEGDD

SEQ ID NO: 26442 - protein, 9 aa, Mycobacterium tuberculosis
LIDSEGDDT

SEQ ID NO: 26443 - protein, 10 aa, Mycobacterium tuberculosis
MSTYRSPDRA

SEQ ID NO: 26444 - protein, 10 aa, Mycobacterium tuberculosis
STYRSPDRAW

SEQ ID NO: 26445 - protein, 10 aa, Mycobacterium tuberculosis
TYRSPDRAWQ

SEQ ID NO: 26446 - protein, 10 aa, Mycobacterium tuberculosis
YRSPDRAWQA

SEQ ID NO: 26447 - protein, 10 aa, Mycobacterium tuberculosis
RSPDRAWQAL

SEQ ID NO: 26448 - protein, 10 aa, Mycobacterium tuberculosis
SPDRAWQALA

SEQ ID NO: 26449 - protein, 10 aa, Mycobacterium tuberculosis
PDRAWQALAD

SEQ ID NO: 26450 - protein, 10 aa, Mycobacterium tuberculosis
DRAWQALADG

SEQ ID NO: 26451 - protein, 10 aa, Mycobacterium tuberculosis
RAWQALADGT

SEQ ID NO: 26452 - protein, 10 aa, Mycobacterium tuberculosis
AWQALADGTR

SEQ ID NO: 26453 - protein, 10 aa, Mycobacterium tuberculosis
WQALADGTRR

SEQ ID NO: 26454 - protein, 10 aa, Mycobacterium tuberculosis
QALADGTRRA

SEQ ID NO: 26455 - protein, 10 aa, Mycobacterium tuberculosis
ALADGTRRAI

SEQ ID NO: 26456 - protein, 10 aa, Mycobacterium tuberculosis
LADGTRRAIV

SEQ ID NO: 26457 - protein, 10 aa, Mycobacterium tuberculosis
ADGTRRAIVE

SEQ ID NO: 26458 - protein, 10 aa, Mycobacterium tuberculosis
DGTRRAIVER

SEQ ID NO: 26459 - protein, 10 aa, Mycobacterium tuberculosis
GTRRAIVERL

SEQ ID NO: 26460 - protein, 10 aa, Mycobacterium tuberculosis
TRRAIVERLA

SEQ ID NO: 26461 - protein, 10 aa, Mycobacterium tuberculosis
RRAIVERLAH

SEQ ID NO: 26462 - protein, 10 aa, Mycobacterium tuberculosis
RAIVERLAHG

SEQ ID NO: 26463 - protein, 10 aa, Mycobacterium tuberculosis
AIVERLAHGP

SEQ ID NO: 26464 - protein, 10 aa, Mycobacterium tuberculosis
IVERLAHGPL

SEQ ID NO: 26465 - protein, 10 aa, Mycobacterium tuberculosis
VERLAHGPLA

SEQ ID NO: 26466 - protein, 10 aa, Mycobacterium tuberculosis
ERLAHGPLAV

SEQ ID NO: 26467 - protein, 10 aa, Mycobacterium tuberculosis
RLAHGPLAVG

SEQ ID NO: 26468 - protein, 10 aa, Mycobacterium tuberculosis
LAHGPLAVGE

SEQ ID NO: 26469 - protein, 10 aa, Mycobacterium tuberculosis
AHGPLAVGEL

SEQ ID NO: 26470 - protein, 10 aa, Mycobacterium tuberculosis
HGPLAVGELA

SEQ ID NO: 26471 - protein, 10 aa, Mycobacterium tuberculosis
GPLAVGELAR

SEQ ID NO: 26472 - protein, 10 aa, Mycobacterium tuberculosis
PLAVGELARD

SEQ ID NO: 26473 - protein, 10 aa, Mycobacterium tuberculosis
LAVGELARDL

SEQ ID NO: 26474 - protein, 10 aa, Mycobacterium tuberculosis
AVGELARDLP

SEQ ID NO: 26475 - protein, 10 aa, Mycobacterium tuberculosis
VGELARDLPV

SEQ ID NO: 26476 - protein, 10 aa, Mycobacterium tuberculosis
GELARDLPVS

SEQ ID NO: 26477 - protein, 10 aa, Mycobacterium tuberculosis
ELARDLPVSR

SEQ ID NO: 26478 - protein, 10 aa, Mycobacterium tuberculosis
LARDLPVSRP

SEQ ID NO: 26479 - protein, 10 aa, Mycobacterium tuberculosis
ARDLPVSRPA

SEQ ID NO: 26480 - protein, 10 aa, Mycobacterium tuberculosis
RDLPVSRPAV

SEQ ID NO: 26481 - protein, 10 aa, Mycobacterium tuberculosis
DLPVSRPAVS

SEQ ID NO: 26482 - protein, 10 aa, Mycobacterium tuberculosis
LPVSRPAVSQ

SEQ ID NO: 26483 - protein, 10 aa, Mycobacterium tuberculosis
PVSRPAVSQH

SEQ ID NO: 26484 - protein, 10 aa, Mycobacterium tuberculosis
VSRPAVSQHL

SEQ ID NO: 26485 - protein, 10 aa, Mycobacterium tuberculosis
SRPAVSQHLK

SEQ ID NO: 26486 - protein, 10 aa, Mycobacterium tuberculosis
RPAVSQHLKV

SEQ ID NO: 26487 - protein, 10 aa, Mycobacterium tuberculosis
PAVSQHLKVL

SEQ ID NO: 26488 - protein, 10 aa, Mycobacterium tuberculosis
AVSQHLKVLK

SEQ ID NO: 26489 - protein, 10 aa, Mycobacterium tuberculosis
VSQHLKVLKT

SEQ ID NO: 26490 - protein, 10 aa, Mycobacterium tuberculosis
SQHLKVLKTA

SEQ ID NO: 26491 - protein, 10 aa, Mycobacterium tuberculosis
QHLKVLKTAR

SEQ ID NO: 26492 - protein, 10 aa, Mycobacterium tuberculosis
HLKVLKTARL

SEQ ID NO: 26493 - protein, 10 aa, Mycobacterium tuberculosis
LKVLKTARLV

SEQ ID NO: 26494 - protein, 10 aa, Mycobacterium tuberculosis
KVLKTARLVC

SEQ ID NO: 26495 - protein, 10 aa, Mycobacterium tuberculosis
VLKTARLVCD

SEQ ID NO: 26496 - protein, 10 aa, Mycobacterium tuberculosis
LKTARLVCDR

SEQ ID NO: 26497 - protein, 10 aa, Mycobacterium tuberculosis
KTARLVCDRP

SEQ ID NO: 26498 - protein, 10 aa, Mycobacterium tuberculosis
TARLVCDRPA

SEQ ID NO: 26499 - protein, 10 aa, Mycobacterium tuberculosis
ARLVCDRPAG

SEQ ID NO: 26500 - protein, 10 aa, Mycobacterium tuberculosis
RLVCDRPAGT

SEQ ID NO: 26501 - protein, 10 aa, Mycobacterium tuberculosis
LVCDRPAGTR

SEQ ID NO: 26502 - protein, 10 aa, Mycobacterium tuberculosis
VCDRPAGTRR

SEQ ID NO: 26503 - protein, 10 aa, Mycobacterium tuberculosis
CDRPAGTRRV

SEQ ID NO: 26504 - protein, 10 aa, Mycobacterium tuberculosis
DRPAGTRRVY

SEQ ID NO: 26505 - protein, 10 aa, Mycobacterium tuberculosis
RPAGTRRVYQ

SEQ ID NO: 26506 - protein, 10 aa, Mycobacterium tuberculosis
PAGTRRVYQL

SEQ ID NO: 26507 - protein, 10 aa, Mycobacterium tuberculosis
AGTRRVYQLD

SEQ ID NO: 26508 - protein, 10 aa, Mycobacterium tuberculosis
GTRRVYQLDP

SEQ ID NO: 26509 - protein, 10 aa, Mycobacterium tuberculosis
TRRVYQLDPT

SEQ ID NO: 26510 - protein, 10 aa, Mycobacterium tuberculosis
RRVYQLDPTG

SEQ ID NO: 26511 - protein, 10 aa, Mycobacterium tuberculosis
RVYQLDPTGL

SEQ ID NO: 26512 - protein, 10 aa, Mycobacterium tuberculosis
VYQLDPTGLA

SEQ ID NO: 26513 - protein, 10 aa, Mycobacterium tuberculosis
YQLDPTGLAA

SEQ ID NO: 26514 - protein, 10 aa, Mycobacterium tuberculosis
QLDPTGLAAL

SEQ ID NO: 26515 - protein, 10 aa, Mycobacterium tuberculosis
LDPTGLAALR

SEQ ID NO: 26516 - protein, 10 aa, Mycobacterium tuberculosis
DPTGLAALRT

SEQ ID NO: 26517 - protein, 10 aa, Mycobacterium tuberculosis
PTGLAALRTD

SEQ ID NO: 26518 - protein, 10 aa, Mycobacterium tuberculosis
TGLAALRTDL

SEQ ID NO: 26519 - protein, 10 aa, Mycobacterium tuberculosis
GLAALRTDLD

SEQ ID NO: 26520 - protein, 10 aa, Mycobacterium tuberculosis
LAALRTDLDR

SEQ ID NO: 26521 - protein, 10 aa, Mycobacterium tuberculosis
AALRTDLDRF

SEQ ID NO: 26522 - protein, 10 aa, Mycobacterium tuberculosis
ALRTDLDRFW

SEQ ID NO: 26523 - protein, 10 aa, Mycobacterium tuberculosis
LRTDLDRFWT

SEQ ID NO: 26524 - protein, 10 aa, Mycobacterium tuberculosis
RTDLDRFWTR

SEQ ID NO: 26525 - protein, 10 aa, Mycobacterium tuberculosis
TDLDRFWTRA

SEQ ID NO: 26526 - protein, 10 aa, Mycobacterium tuberculosis
DLDRFWTRAL

SEQ ID NO: 26527 - protein, 10 aa, Mycobacterium tuberculosis
LDRFWTRALT

SEQ ID NO: 26528 - protein, 10 aa, Mycobacterium tuberculosis
DRFWTRALTG

SEQ ID NO: 26529 - protein, 10 aa, Mycobacterium tuberculosis
RFWTRALTGY

SEQ ID NO: 26530 - protein, 10 aa, Mycobacterium tuberculosis
FWTRALTGYA

SEQ ID NO: 26531 - protein, 10 aa, Mycobacterium tuberculosis
WTRALTGYAQ

SEQ ID NO: 26532 - protein, 10 aa, Mycobacterium tuberculosis
TRALTGYAQL

SEQ ID NO: 26533 - protein, 10 aa, Mycobacterium tuberculosis
RALTGYAQLI

SEQ ID NO: 26534 - protein, 10 aa, Mycobacterium tuberculosis
ALTGYAQLID

SEQ ID NO: 26535 - protein, 10 aa, Mycobacterium tuberculosis
LTGYAQLIDS

SEQ ID NO: 26536 - protein, 10 aa, Mycobacterium tuberculosis
TGYAQLIDSE

SEQ ID NO: 26537 - protein, 10 aa, Mycobacterium tuberculosis
GYAQLIDSEG

SEQ ID NO: 26538 - protein, 10 aa, Mycobacterium tuberculosis
YAQLIDSEGD

SEQ ID NO: 26539 - protein, 10 aa, Mycobacterium tuberculosis
AQLIDSEGDD

SEQ ID NO: 26540 - protein, 10 aa, Mycobacterium tuberculosis
QLIDSEGDDT

SEQ ID NO: 26541 - protein, 11 aa, Mycobacterium tuberculosis
MSTYRSPDRAW

SEQ ID NO: 26542 - protein, 11 aa, Mycobacterium tuberculosis
STYRSPDRAWQ

SEQ ID NO: 26543 - protein, 11 aa, Mycobacterium tuberculosis
TYRSPDRAWQA

SEQ ID NO: 26544 - protein, 11 aa, Mycobacterium tuberculosis
YRSPDRAWQAL

SEQ ID NO: 26545 - protein, 11 aa, Mycobacterium tuberculosis
RSPDRAWQALA

SEQ ID NO: 26546 - protein, 11 aa, Mycobacterium tuberculosis
SPDRAWQALAD

SEQ ID NO: 26547 - protein, 11 aa, Mycobacterium tuberculosis
PDRAWQALADG

SEQ ID NO: 26548 - protein, 11 aa, Mycobacterium tuberculosis
DRAWQALADGT

SEQ ID NO: 26549 - protein, 11 aa, Mycobacterium tuberculosis
RAWQALADGTR

SEQ ID NO: 26550 - protein, 11 aa, Mycobacterium tuberculosis
AWQALADGTRR

SEQ ID NO: 26551 - protein, 11 aa, Mycobacterium tuberculosis
WQALADGTRRA

SEQ ID NO: 26552 - protein, 11 aa, Mycobacterium tuberculosis
QALADGTRRAI

SEQ ID NO: 26553 - protein, 11 aa, Mycobacterium tuberculosis
ALADGTRRAIV

SEQ ID NO: 26554 - protein, 11 aa, Mycobacterium tuberculosis
LADGTRRAIVE

SEQ ID NO: 26555 - protein, 11 aa, Mycobacterium tuberculosis
ADGTRRAIVER

SEQ ID NO: 26556 - protein, 11 aa, Mycobacterium tuberculosis
DGTRRAIVERL

SEQ ID NO: 26557 - protein, 11 aa, Mycobacterium tuberculosis
GTRRAIVERLA

SEQ ID NO: 26558 - protein, 11 aa, Mycobacterium tuberculosis
TRRAIVERLAH

SEQ ID NO: 26559 - protein, 11 aa, Mycobacterium tuberculosis
RRAIVERLAHG

SEQ ID NO: 26560 - protein, 11 aa, Mycobacterium tuberculosis
RAIVERLAHGP

SEQ ID NO: 26561 - protein, 11 aa, Mycobacterium tuberculosis
AIVERLAHGPL

SEQ ID NO: 26562 - protein, 11 aa, Mycobacterium tuberculosis
IVERLAHGPLA

SEQ ID NO: 26563 - protein, 11 aa, Mycobacterium tuberculosis
VERLAHGPLAV

SEQ ID NO: 26564 - protein, 11 aa, Mycobacterium tuberculosis
ERLAHGPLAVG

SEQ ID NO: 26565 - protein, 11 aa, Mycobacterium tuberculosis
RLAHGPLAVGE

SEQ ID NO: 26566 - protein, 11 aa, Mycobacterium tuberculosis
LAHGPLAVGEL

SEQ ID NO: 26567 - protein, 11 aa, Mycobacterium tuberculosis
AHGPLAVGELA

SEQ ID NO: 26568 - protein, 11 aa, Mycobacterium tuberculosis
HGPLAVGELAR

SEQ ID NO: 26569 - protein, 11 aa, Mycobacterium tuberculosis
GPLAVGELARD

SEQ ID NO: 26570 - protein, 11 aa, Mycobacterium tuberculosis
PLAVGELARDL

SEQ ID NO: 26571 - protein, 11 aa, Mycobacterium tuberculosis
LAVGELARDLP

SEQ ID NO: 26572 - protein, 11 aa, Mycobacterium tuberculosis
AVGELARDLPV

SEQ ID NO: 26573 - protein, 11 aa, Mycobacterium tuberculosis
VGELARDLPVS

SEQ ID NO: 26574 - protein, 11 aa, Mycobacterium tuberculosis
GELARDLPVSR

SEQ ID NO: 26575 - protein, 11 aa, Mycobacterium tuberculosis
ELARDLPVSRP

SEQ ID NO: 26576 - protein, 11 aa, Mycobacterium tuberculosis
LARDLPVSRPA

SEQ ID NO: 26577 - protein, 11 aa, Mycobacterium tuberculosis
ARDLPVSRPAV

SEQ ID NO: 26578 - protein, 11 aa, Mycobacterium tuberculosis
RDLPVSRPAVS

SEQ ID NO: 26579 - protein, 11 aa, Mycobacterium tuberculosis
DLPVSRPAVSQ

SEQ ID NO: 26580 - protein, 11 aa, Mycobacterium tuberculosis
LPVSRPAVSQH

SEQ ID NO: 26581 - protein, 11 aa, Mycobacterium tuberculosis
PVSRPAVSQHL

SEQ ID NO: 26582 - protein, 11 aa, Mycobacterium tuberculosis
VSRPAVSQHLK

SEQ ID NO: 26583 - protein, 11 aa, Mycobacterium tuberculosis
SRPAVSQHLKV

SEQ ID NO: 26584 - protein, 11 aa, Mycobacterium tuberculosis
RPAVSQHLKVL

SEQ ID NO: 26585 - protein, 11 aa, Mycobacterium tuberculosis
PAVSQHLKVLK

SEQ ID NO: 26586 - protein, 11 aa, Mycobacterium tuberculosis
AVSQHLKVLKT

SEQ ID NO: 26587 - protein, 11 aa, Mycobacterium tuberculosis
VSQHLKVLKTA

SEQ ID NO: 26588 - protein, 11 aa, Mycobacterium tuberculosis
SQHLKVLKTAR

SEQ ID NO: 26589 - protein, 11 aa, Mycobacterium tuberculosis
QHLKVLKTARL

SEQ ID NO: 26590 - protein, 11 aa, Mycobacterium tuberculosis
HLKVLKTARLV

SEQ ID NO: 26591 - protein, 11 aa, Mycobacterium tuberculosis
LKVLKTARLVC

SEQ ID NO: 26592 - protein, 11 aa, Mycobacterium tuberculosis
KVLKTARLVCD

SEQ ID NO: 26593 - protein, 11 aa, Mycobacterium tuberculosis
VLKTARLVCDR

SEQ ID NO: 26594 - protein, 11 aa, Mycobacterium tuberculosis
LKTARLVCDRP

SEQ ID NO: 26595 - protein, 11 aa, Mycobacterium tuberculosis
KTARLVCDRPA

SEQ ID NO: 26596 - protein, 11 aa, Mycobacterium tuberculosis
TARLVCDRPAG

SEQ ID NO: 26597 - protein, 11 aa, Mycobacterium tuberculosis
ARLVCDRPAGT

SEQ ID NO: 26598 - protein, 11 aa, Mycobacterium tuberculosis
RLVCDRPAGTR

SEQ ID NO: 26599 - protein, 11 aa, Mycobacterium tuberculosis
LVCDRPAGTRR

SEQ ID NO: 26600 - protein, 11 aa, Mycobacterium tuberculosis
VCDRPAGTRRV

SEQ ID NO: 26601 - protein, 11 aa, Mycobacterium tuberculosis
CDRPAGTRRVY

SEQ ID NO: 26602 - protein, 11 aa, Mycobacterium tuberculosis
DRPAGTRRVYQ

SEQ ID NO: 26603 - protein, 11 aa, Mycobacterium tuberculosis
RPAGTRRVYQL

SEQ ID NO: 26604 - protein, 11 aa, Mycobacterium tuberculosis
PAGTRRVYQLD

SEQ ID NO: 26605 - protein, 11 aa, Mycobacterium tuberculosis
AGTRRVYQLDP

SEQ ID NO: 26606 - protein, 11 aa, Mycobacterium tuberculosis
GTRRVYQLDPT

SEQ ID NO: 26607 - protein, 11 aa, Mycobacterium tuberculosis
TRRVYQLDPTG

SEQ ID NO: 26608 - protein, 11 aa, Mycobacterium tuberculosis
RRVYQLDPTGL

SEQ ID NO: 26609 - protein, 11 aa, Mycobacterium tuberculosis
RVYQLDPTGLA

SEQ ID NO: 26610 - protein, 11 aa, Mycobacterium tuberculosis
VYQLDPTGLAA

SEQ ID NO: 26611 - protein, 11 aa, Mycobacterium tuberculosis
YQLDPTGLAAL

SEQ ID NO: 26612 - protein, 11 aa, Mycobacterium tuberculosis
QLDPTGLAALR

SEQ ID NO: 26613 - protein, 11 aa, Mycobacterium tuberculosis
LDPTGLAALRT

SEQ ID NO: 26614 - protein, 11 aa, Mycobacterium tuberculosis
DPTGLAALRTD

SEQ ID NO: 26615 - protein, 11 aa, Mycobacterium tuberculosis
PTGLAALRTDL

SEQ ID NO: 26616 - protein, 11 aa, Mycobacterium tuberculosis
TGLAALRTDLD

SEQ ID NO: 26617 - protein, 11 aa, Mycobacterium tuberculosis
GLAALRTDLDR

SEQ ID NO: 26618 - protein, 11 aa, Mycobacterium tuberculosis
LAALRTDLDRF

SEQ ID NO: 26619 - protein, 11 aa, Mycobacterium tuberculosis
AALRTDLDRFW

SEQ ID NO: 26620 - protein, 11 aa, Mycobacterium tuberculosis
ALRTDLDRFWT

SEQ ID NO: 26621 - protein, 11 aa, Mycobacterium tuberculosis
LRTDLDRFWTR

SEQ ID NO: 26622 - protein, 11 aa, Mycobacterium tuberculosis
RTDLDRFWTRA

SEQ ID NO: 26623 - protein, 11 aa, Mycobacterium tuberculosis
TDLDRFWTRAL

SEQ ID NO: 26624 - protein, 11 aa, Mycobacterium tuberculosis
DLDRFWTRALT

SEQ ID NO: 26625 - protein, 11 aa, Mycobacterium tuberculosis
LDRFWTRALTG

SEQ ID NO: 26626 - protein, 11 aa, Mycobacterium tuberculosis
DRFWTRALTGY

SEQ ID NO: 26627 - protein, 11 aa, Mycobacterium tuberculosis
RFWTRALTGYA

SEQ ID NO: 26628 - protein, 11 aa, Mycobacterium tuberculosis
FWTRALTGYAQ

SEQ ID NO: 26629 - protein, 11 aa, Mycobacterium tuberculosis
WTRALTGYAQL

SEQ ID NO: 26630 - protein, 11 aa, Mycobacterium tuberculosis
TRALTGYAQLI

SEQ ID NO: 26631 - protein, 11 aa, Mycobacterium tuberculosis
RALTGYAQLID

SEQ ID NO: 26632 - protein, 11 aa, Mycobacterium tuberculosis
ALTGYAQLIDS

SEQ ID NO: 26633 - protein, 11 aa, Mycobacterium tuberculosis
LTGYAQLIDSE

SEQ ID NO: 26634 - protein, 11 aa, Mycobacterium tuberculosis
TGYAQLIDSEG

SEQ ID NO: 26635 - protein, 11 aa, Mycobacterium tuberculosis
GYAQLIDSEGD

SEQ ID NO: 26636 - protein, 11 aa, Mycobacterium tuberculosis
YAQLIDSEGDD

SEQ ID NO: 26637 - protein, 11 aa, Mycobacterium tuberculosis
AQLIDSEGDDT

SEQ ID NO: 26638 - protein, 8 aa, Mycobacterium tuberculosis
MADRVLRG

SEQ ID NO: 26639 - protein, 8 aa, Mycobacterium tuberculosis
ADRVLRGS

SEQ ID NO: 26640 - protein, 8 aa, Mycobacterium tuberculosis
DRVLRGSR

SEQ ID NO: 26641 - protein, 8 aa, Mycobacterium tuberculosis
RVLRGSRL

SEQ ID NO: 26642 - protein, 8 aa, Mycobacterium tuberculosis
VLRGSRLG

SEQ ID NO: 26643 - protein, 8 aa, Mycobacterium tuberculosis
LRGSRLGA

SEQ ID NO: 26644 - protein, 8 aa, Mycobacterium tuberculosis
RGSRLGAV

SEQ ID NO: 26645 - protein, 8 aa, Mycobacterium tuberculosis
GSRLGAVS

SEQ ID NO: 26646 - protein, 8 aa, Mycobacterium tuberculosis
SRLGAVSY

SEQ ID NO: 26647 - protein, 8 aa, Mycobacterium tuberculosis
RLGAVSYE

SEQ ID NO: 26648 - protein, 8 aa, Mycobacterium tuberculosis
LGAVSYET

SEQ ID NO: 26649 - protein, 8 aa, Mycobacterium tuberculosis
GAVSYETD

SEQ ID NO: 26650 - protein, 8 aa, Mycobacterium tuberculosis
AVSYETDR

SEQ ID NO: 26651 - protein, 8 aa, Mycobacterium tuberculosis
VSYETDRN

SEQ ID NO: 26652 - protein, 8 aa, Mycobacterium tuberculosis
SYETDRNH

SEQ ID NO: 26653 - protein, 8 aa, Mycobacterium tuberculosis
YETDRNHD

SEQ ID NO: 26654 - protein, 8 aa, Mycobacterium tuberculosis
ETDRNHDL

SEQ ID NO: 26655 - protein, 8 aa, Mycobacterium tuberculosis
TDRNHDLA

SEQ ID NO: 26656 - protein, 8 aa, Mycobacterium tuberculosis
DRNHDLAP

SEQ ID NO: 26657 - protein, 8 aa, Mycobacterium tuberculosis
RNHDLAPR

SEQ ID NO: 26658 - protein, 8 aa, Mycobacterium tuberculosis
NHDLAPRQ

SEQ ID NO: 26659 - protein, 8 aa, Mycobacterium tuberculosis
HDLAPRQI

SEQ ID NO: 26660 - protein, 8 aa, Mycobacterium tuberculosis
DLAPRQIA

SEQ ID NO: 26661 - protein, 8 aa, Mycobacterium tuberculosis
LAPRQIAR

SEQ ID NO: 26662 - protein, 8 aa, Mycobacterium tuberculosis
APRQIARY

SEQ ID NO: 26663 - protein, 8 aa, Mycobacterium tuberculosis
PRQIARYR

SEQ ID NO: 26664 - protein, 8 aa, Mycobacterium tuberculosis
RQIARYRT

SEQ ID NO: 26665 - protein, 8 aa, Mycobacterium tuberculosis
QIARYRTD

SEQ ID NO: 26666 - protein, 8 aa, Mycobacterium tuberculosis
IARYRTDN

SEQ ID NO: 26667 - protein, 8 aa, Mycobacterium tuberculosis
ARYRTDNG

SEQ ID NO: 26668 - protein, 8 aa, Mycobacterium tuberculosis
RYRTDNGE

SEQ ID NO: 26669 - protein, 8 aa, Mycobacterium tuberculosis
YRTDNGEE

SEQ ID NO: 26670 - protein, 8 aa, Mycobacterium tuberculosis
RTDNGEEF

SEQ ID NO: 26671 - protein, 8 aa, Mycobacterium tuberculosis
TDNGEEFE

SEQ ID NO: 26672 - protein, 8 aa, Mycobacterium tuberculosis
DNGEEFEV

SEQ ID NO: 26673 - protein, 8 aa, Mycobacterium tuberculosis
NGEEFEVP

SEQ ID NO: 26674 - protein, 8 aa, Mycobacterium tuberculosis
GEEFEVPF

SEQ ID NO: 26675 - protein, 8 aa, Mycobacterium tuberculosis
EEFEVPFA

SEQ ID NO: 26676 - protein, 8 aa, Mycobacterium tuberculosis
EFEVPFAD

SEQ ID NO: 26677 - protein, 8 aa, Mycobacterium tuberculosis
FEVPFADD

SEQ ID NO: 26678 - protein, 8 aa, Mycobacterium tuberculosis
EVPFADDA

SEQ ID NO: 26679 - protein, 8 aa, Mycobacterium tuberculosis
VPFADDAE

SEQ ID NO: 26680 - protein, 8 aa, Mycobacterium tuberculosis
PFADDAEI

SEQ ID NO: 26681 - protein, 8 aa, Mycobacterium tuberculosis
FADDAEIP

SEQ ID NO: 26682 - protein, 8 aa, Mycobacterium tuberculosis
ADDAEIPG

SEQ ID NO: 26683 - protein, 8 aa, Mycobacterium tuberculosis
DDAEIPGT

SEQ ID NO: 26684 - protein, 8 aa, Mycobacterium tuberculosis
DAEIPGTW

SEQ ID NO: 26685 - protein, 8 aa, Mycobacterium tuberculosis
AEIPGTWL

SEQ ID NO: 26686 - protein, 8 aa, Mycobacterium tuberculosis
EIPGTWLC

SEQ ID NO: 26687 - protein, 8 aa, Mycobacterium tuberculosis
IPGTWLCR

SEQ ID NO: 26688 - protein, 8 aa, Mycobacterium tuberculosis
PGTWLCRN

SEQ ID NO: 26689 - protein, 8 aa, Mycobacterium tuberculosis
GTWLCRNG

SEQ ID NO: 26690 - protein, 8 aa, Mycobacterium tuberculosis
TWLCRNGM

SEQ ID NO: 26691 - protein, 8 aa, Mycobacterium tuberculosis
WLCRNGME

SEQ ID NO: 26692 - protein, 8 aa, Mycobacterium tuberculosis
LCRNGMEG

SEQ ID NO: 26693 - protein, 8 aa, Mycobacterium tuberculosis
CRNGMEGT

SEQ ID NO: 26694 - protein, 8 aa, Mycobacterium tuberculosis
RNGMEGTL

SEQ ID NO: 26695 - protein, 8 aa, Mycobacterium tuberculosis
NGMEGTLI

SEQ ID NO: 26696 - protein, 8 aa, Mycobacterium tuberculosis
GMEGTLIE

SEQ ID NO: 26697 - protein, 8 aa, Mycobacterium tuberculosis
MEGTLIEG

SEQ ID NO: 26698 - protein, 8 aa, Mycobacterium tuberculosis
EGTLIEGD

SEQ ID NO: 26699 - protein, 8 aa, Mycobacterium tuberculosis
GTLIEGDL

SEQ ID NO: 26700 - protein, 8 aa, Mycobacterium tuberculosis
TLIEGDLP

SEQ ID NO: 26701 - protein, 8 aa, Mycobacterium tuberculosis
LIEGDLPE

SEQ ID NO: 26702 - protein, 8 aa, Mycobacterium tuberculosis
IEGDLPEP

SEQ ID NO: 26703 - protein, 8 aa, Mycobacterium tuberculosis
EGDLPEPK

SEQ ID NO: 26704 - protein, 8 aa, Mycobacterium tuberculosis
GDLPEPKK

SEQ ID NO: 26705 - protein, 8 aa, Mycobacterium tuberculosis
DLPEPKKV

SEQ ID NO: 26706 - protein, 8 aa, Mycobacterium tuberculosis
LPEPKKVK

SEQ ID NO: 26707 - protein, 8 aa, Mycobacterium tuberculosis
PEPKKVKP

SEQ ID NO: 26708 - protein, 8 aa, Mycobacterium tuberculosis
EPKKVKPP

SEQ ID NO: 26709 - protein, 8 aa, Mycobacterium tuberculosis
PKKVKPPR

SEQ ID NO: 26710 - protein, 8 aa, Mycobacterium tuberculosis
KKVKPPRT

SEQ ID NO: 26711 - protein, 8 aa, Mycobacterium tuberculosis
KVKPPRTH

SEQ ID NO: 26712 - protein, 8 aa, Mycobacterium tuberculosis
VKPPRTHW

SEQ ID NO: 26713 - protein, 8 aa, Mycobacterium tuberculosis
KPPRTHWD

SEQ ID NO: 26714 - protein, 8 aa, Mycobacterium tuberculosis
PPRTHWDM

SEQ ID NO: 26715 - protein, 8 aa, Mycobacterium tuberculosis
PRTHWDML

SEQ ID NO: 26716 - protein, 8 aa, Mycobacterium tuberculosis
RTHWDMLL

SEQ ID NO: 26717 - protein, 8 aa, Mycobacterium tuberculosis
THWDMLLE

SEQ ID NO: 26718 - protein, 8 aa, Mycobacterium tuberculosis
HWDMLLER

SEQ ID NO: 26719 - protein, 8 aa, Mycobacterium tuberculosis
WDMLLERR

SEQ ID NO: 26720 - protein, 8 aa, Mycobacterium tuberculosis
DMLLERRS

SEQ ID NO: 26721 - protein, 8 aa, Mycobacterium tuberculosis
MLLERRSI

SEQ ID NO: 26722 - protein, 8 aa, Mycobacterium tuberculosis
LLERRSIE

SEQ ID NO: 26723 - protein, 8 aa, Mycobacterium tuberculosis
LERRSIEE

SEQ ID NO: 26724 - protein, 8 aa, Mycobacterium tuberculosis
ERRSIEEL

SEQ ID NO: 26725 - protein, 8 aa, Mycobacterium tuberculosis
RRSIEELE

SEQ ID NO: 26726 - protein, 8 aa, Mycobacterium tuberculosis
RSIEELEE

SEQ ID NO: 26727 - protein, 8 aa, Mycobacterium tuberculosis
SIEELEEL

SEQ ID NO: 26728 - protein, 8 aa, Mycobacterium tuberculosis
IEELEELL

SEQ ID NO: 26729 - protein, 8 aa, Mycobacterium tuberculosis
EELEELLK

SEQ ID NO: 26730 - protein, 8 aa, Mycobacterium tuberculosis
ELEELLKE

SEQ ID NO: 26731 - protein, 8 aa, Mycobacterium tuberculosis
LEELLKER

SEQ ID NO: 26732 - protein, 8 aa, Mycobacterium tuberculosis
EELLKERL

SEQ ID NO: 26733 - protein, 8 aa, Mycobacterium tuberculosis
ELLKERLE

SEQ ID NO: 26734 - protein, 8 aa, Mycobacterium tuberculosis
LLKERLEL

SEQ ID NO: 26735 - protein, 8 aa, Mycobacterium tuberculosis
LKERLELI

SEQ ID NO: 26736 - protein, 8 aa, Mycobacterium tuberculosis
KERLELIR

SEQ ID NO: 26737 - protein, 8 aa, Mycobacterium tuberculosis
ERLELIRS

SEQ ID NO: 26738 - protein, 8 aa, Mycobacterium tuberculosis
RLELIRSR

SEQ ID NO: 26739 - protein, 8 aa, Mycobacterium tuberculosis
LELIRSRR

SEQ ID NO: 26740 - protein, 8 aa, Mycobacterium tuberculosis
ELIRSRRR

SEQ ID NO: 26741 - protein, 8 aa, Mycobacterium tuberculosis
LIRSRRRG

SEQ ID NO: 26742 - protein, 9 aa, Mycobacterium tuberculosis
MADRVLRGS

SEQ ID NO: 26743 - protein, 9 aa, Mycobacterium tuberculosis
ADRVLRGSR

SEQ ID NO: 26744 - protein, 9 aa, Mycobacterium tuberculosis
DRVLRGSRL

SEQ ID NO: 26745 - protein, 9 aa, Mycobacterium tuberculosis
RVLRGSRLG

SEQ ID NO: 26746 - protein, 9 aa, Mycobacterium tuberculosis
VLRGSRLGA

SEQ ID NO: 26747 - protein, 9 aa, Mycobacterium tuberculosis
LRGSRLGAV

SEQ ID NO: 26748 - protein, 9 aa, Mycobacterium tuberculosis
RGSRLGAVS

SEQ ID NO: 26749 - protein, 9 aa, Mycobacterium tuberculosis
GSRLGAVSY

SEQ ID NO: 26750 - protein, 9 aa, Mycobacterium tuberculosis
SRLGAVSYE

SEQ ID NO: 26751 - protein, 9 aa, Mycobacterium tuberculosis
RLGAVSYET

SEQ ID NO: 26752 - protein, 9 aa, Mycobacterium tuberculosis
LGAVSYETD

SEQ ID NO: 26753 - protein, 9 aa, Mycobacterium tuberculosis
GAVSYETDR

SEQ ID NO: 26754 - protein, 9 aa, Mycobacterium tuberculosis
AVSYETDRN

SEQ ID NO: 26755 - protein, 9 aa, Mycobacterium tuberculosis
VSYETDRNH

SEQ ID NO: 26756 - protein, 9 aa, Mycobacterium tuberculosis
SYETDRNHD

SEQ ID NO: 26757 - protein, 9 aa, Mycobacterium tuberculosis
YETDRNHDL

SEQ ID NO: 26758 - protein, 9 aa, Mycobacterium tuberculosis
ETDRNHDLA

SEQ ID NO: 26759 - protein, 9 aa, Mycobacterium tuberculosis
TDRNHDLAP

SEQ ID NO: 26760 - protein, 9 aa, Mycobacterium tuberculosis
DRNHDLAPR

SEQ ID NO: 26761 - protein, 9 aa, Mycobacterium tuberculosis
RNHDLAPRQ

SEQ ID NO: 26762 - protein, 9 aa, Mycobacterium tuberculosis
NHDLAPRQI

SEQ ID NO: 26763 - protein, 9 aa, Mycobacterium tuberculosis
HDLAPRQIA

SEQ ID NO: 26764 - protein, 9 aa, Mycobacterium tuberculosis
DLAPRQIAR

SEQ ID NO: 26765 - protein, 9 aa, Mycobacterium tuberculosis
LAPRQIARY

SEQ ID NO: 26766 - protein, 9 aa, Mycobacterium tuberculosis
APRQIARYR

SEQ ID NO: 26767 - protein, 9 aa, Mycobacterium tuberculosis
PRQIARYRT

SEQ ID NO: 26768 - protein, 9 aa, Mycobacterium tuberculosis
RQIARYRTD

SEQ ID NO: 26769 - protein, 9 aa, Mycobacterium tuberculosis
QIARYRTDN

SEQ ID NO: 26770 - protein, 9 aa, Mycobacterium tuberculosis
IARYRTDNG

SEQ ID NO: 26771 - protein, 9 aa, Mycobacterium tuberculosis
ARYRTDNGE

SEQ ID NO: 26772 - protein, 9 aa, Mycobacterium tuberculosis
RYRTDNGEE

SEQ ID NO: 26773 - protein, 9 aa, Mycobacterium tuberculosis
YRTDNGEEF

SEQ ID NO: 26774 - protein, 9 aa, Mycobacterium tuberculosis
RTDNGEEFE

SEQ ID NO: 26775 - protein, 9 aa, Mycobacterium tuberculosis
TDNGEEFEV

SEQ ID NO: 26776 - protein, 9 aa, Mycobacterium tuberculosis
DNGEEFEVP

SEQ ID NO: 26777 - protein, 9 aa, Mycobacterium tuberculosis
NGEEFEVPF

SEQ ID NO: 26778 - protein, 9 aa, Mycobacterium tuberculosis
GEEFEVPFA

SEQ ID NO: 26779 - protein, 9 aa, Mycobacterium tuberculosis
EEFEVPFAD

SEQ ID NO: 26780 - protein, 9 aa, Mycobacterium tuberculosis
EFEVPFADD

SEQ ID NO: 26781 - protein, 9 aa, Mycobacterium tuberculosis
FEVPFADDA

SEQ ID NO: 26782 - protein, 9 aa, Mycobacterium tuberculosis
EVPFADDAE

SEQ ID NO: 26783 - protein, 9 aa, Mycobacterium tuberculosis
VPFADDAEI

SEQ ID NO: 26784 - protein, 9 aa, Mycobacterium tuberculosis
PFADDAEIP

SEQ ID NO: 26785 - protein, 9 aa, Mycobacterium tuberculosis
FADDAEIPG

SEQ ID NO: 26786 - protein, 9 aa, Mycobacterium tuberculosis
ADDAEIPGT

SEQ ID NO: 26787 - protein, 9 aa, Mycobacterium tuberculosis
DDAEIPGTW

SEQ ID NO: 26788 - protein, 9 aa, Mycobacterium tuberculosis
DAEIPGTWL

SEQ ID NO: 26789 - protein, 9 aa, Mycobacterium tuberculosis
AEIPGTWLC

SEQ ID NO: 26790 - protein, 9 aa, Mycobacterium tuberculosis
EIPGTWLCR

SEQ ID NO: 26791 - protein, 9 aa, Mycobacterium tuberculosis
IPGTWLCRN

SEQ ID NO: 26792 - protein, 9 aa, Mycobacterium tuberculosis
PGTWLCRNG

SEQ ID NO: 26793 - protein, 9 aa, Mycobacterium tuberculosis
GTWLCRNGM

SEQ ID NO: 26794 - protein, 9 aa, Mycobacterium tuberculosis
TWLCRNGME

SEQ ID NO: 26795 - protein, 9 aa, Mycobacterium tuberculosis
WLCRNGMEG

SEQ ID NO: 26796 - protein, 9 aa, Mycobacterium tuberculosis
LCRNGMEGT

SEQ ID NO: 26797 - protein, 9 aa, Mycobacterium tuberculosis
CRNGMEGTL

SEQ ID NO: 26798 - protein, 9 aa, Mycobacterium tuberculosis
RNGMEGTLI

SEQ ID NO: 26799 - protein, 9 aa, Mycobacterium tuberculosis
NGMEGTLIE

SEQ ID NO: 26800 - protein, 9 aa, Mycobacterium tuberculosis
GMEGTLIEG

SEQ ID NO: 26801 - protein, 9 aa, Mycobacterium tuberculosis
MEGTLIEGD

SEQ ID NO: 26802 - protein, 9 aa, Mycobacterium tuberculosis
EGTLIEGDL

SEQ ID NO: 26803 - protein, 9 aa, Mycobacterium tuberculosis
GTLIEGDLP

SEQ ID NO: 26804 - protein, 9 aa, Mycobacterium tuberculosis
TLIEGDLPE

SEQ ID NO: 26805 - protein, 9 aa, Mycobacterium tuberculosis
LIEGDLPEP

SEQ ID NO: 26806 - protein, 9 aa, Mycobacterium tuberculosis
IEGDLPEPK

SEQ ID NO: 26807 - protein, 9 aa, Mycobacterium tuberculosis
EGDLPEPKK

SEQ ID NO: 26808 - protein, 9 aa, Mycobacterium tuberculosis
GDLPEPKKV

SEQ ID NO: 26809 - protein, 9 aa, Mycobacterium tuberculosis
DLPEPKKVK

SEQ ID NO: 26810 - protein, 9 aa, Mycobacterium tuberculosis
LPEPKKVKP

SEQ ID NO: 26811 - protein, 9 aa, Mycobacterium tuberculosis
PEPKKVKPP

SEQ ID NO: 26812 - protein, 9 aa, Mycobacterium tuberculosis
EPKKVKPPR

SEQ ID NO: 26813 - protein, 9 aa, Mycobacterium tuberculosis
PKKVKPPRT

SEQ ID NO: 26814 - protein, 9 aa, Mycobacterium tuberculosis
KKVKPPRTH

SEQ ID NO: 26815 - protein, 9 aa, Mycobacterium tuberculosis
KVKPPRTHW

SEQ ID NO: 26816 - protein, 9 aa, Mycobacterium tuberculosis
VKPPRTHWD

SEQ ID NO: 26817 - protein, 9 aa, Mycobacterium tuberculosis
KPPRTHWDM

SEQ ID NO: 26818 - protein, 9 aa, Mycobacterium tuberculosis
PPRTHWDML

SEQ ID NO: 26819 - protein, 9 aa, Mycobacterium tuberculosis
PRTHWDMLL

SEQ ID NO: 26820 - protein, 9 aa, Mycobacterium tuberculosis
RTHWDMLLE

SEQ ID NO: 26821 - protein, 9 aa, Mycobacterium tuberculosis
THWDMLLER

SEQ ID NO: 26822 - protein, 9 aa, Mycobacterium tuberculosis
HWDMLLERR

SEQ ID NO: 26823 - protein, 9 aa, Mycobacterium tuberculosis
WDMLLERRS

SEQ ID NO: 26824 - protein, 9 aa, Mycobacterium tuberculosis
DMLLERRSI

SEQ ID NO: 26825 - protein, 9 aa, Mycobacterium tuberculosis
MLLERRSIE

SEQ ID NO: 26826 - protein, 9 aa, Mycobacterium tuberculosis
LLERRSIEE

SEQ ID NO: 26827 - protein, 9 aa, Mycobacterium tuberculosis
LERRSIEEL

SEQ ID NO: 26828 - protein, 9 aa, Mycobacterium tuberculosis
ERRSIEELE

SEQ ID NO: 26829 - protein, 9 aa, Mycobacterium tuberculosis
RRSIEELEE

SEQ ID NO: 26830 - protein, 9 aa, Mycobacterium tuberculosis
RSIEELEEL

SEQ ID NO: 26831 - protein, 9 aa, Mycobacterium tuberculosis
SIEELEELL

SEQ ID NO: 26832 - protein, 9 aa, Mycobacterium tuberculosis
IEELEELLK

SEQ ID NO: 26833 - protein, 9 aa, Mycobacterium tuberculosis
EELEELLKE

SEQ ID NO: 26834 - protein, 9 aa, Mycobacterium tuberculosis
ELEELLKER

SEQ ID NO: 26835 - protein, 9 aa, Mycobacterium tuberculosis
LEELLKERL

SEQ ID NO: 26836 - protein, 9 aa, Mycobacterium tuberculosis
EELLKERLE

SEQ ID NO: 26837 - protein, 9 aa, Mycobacterium tuberculosis
ELLKERLEL

SEQ ID NO: 26838 - protein, 9 aa, Mycobacterium tuberculosis
LLKERLELI

SEQ ID NO: 26839 - protein, 9 aa, Mycobacterium tuberculosis
LKERLELIR

SEQ ID NO: 26840 - protein, 9 aa, Mycobacterium tuberculosis
KERLELIRS

SEQ ID NO: 26841 - protein, 9 aa, Mycobacterium tuberculosis
ERLELIRSR

SEQ ID NO: 26842 - protein, 9 aa, Mycobacterium tuberculosis
RLELIRSRR

SEQ ID NO: 26843 - protein, 9 aa, Mycobacterium tuberculosis
LELIRSRRR

SEQ ID NO: 26844 - protein, 9 aa, Mycobacterium tuberculosis
ELIRSRRRG

SEQ ID NO: 26845 - protein, 10 aa, Mycobacterium tuberculosis
MADRVLRGSR

SEQ ID NO: 26846 - protein, 10 aa, Mycobacterium tuberculosis
ADRVLRGSRL

SEQ ID NO: 26847 - protein, 10 aa, Mycobacterium tuberculosis
DRVLRGSRLG

SEQ ID NO: 26848 - protein, 10 aa, Mycobacterium tuberculosis
RVLRGSRLGA

SEQ ID NO: 26849 - protein, 10 aa, Mycobacterium tuberculosis
VLRGSRLGAV

SEQ ID NO: 26850 - protein, 10 aa, Mycobacterium tuberculosis
LRGSRLGAVS

SEQ ID NO: 26851 - protein, 10 aa, Mycobacterium tuberculosis
RGSRLGAVSY

SEQ ID NO: 26852 - protein, 10 aa, Mycobacterium tuberculosis
GSRLGAVSYE

SEQ ID NO: 26853 - protein, 10 aa, Mycobacterium tuberculosis
SRLGAVSYET

SEQ ID NO: 26854 - protein, 10 aa, Mycobacterium tuberculosis
RLGAVSYETD

SEQ ID NO: 26855 - protein, 10 aa, Mycobacterium tuberculosis
LGAVSYETDR

SEQ ID NO: 26856 - protein, 10 aa, Mycobacterium tuberculosis
GAVSYETDRN

SEQ ID NO: 26857 - protein, 10 aa, Mycobacterium tuberculosis
AVSYETDRNH

SEQ ID NO: 26858 - protein, 10 aa, Mycobacterium tuberculosis
VSYETDRNHD

SEQ ID NO: 26859 - protein, 10 aa, Mycobacterium tuberculosis
SYETDRNHDL

SEQ ID NO: 26860 - protein, 10 aa, Mycobacterium tuberculosis
YETDRNHDLA

SEQ ID NO: 26861 - protein, 10 aa, Mycobacterium tuberculosis
ETDRNHDLAP

SEQ ID NO: 26862 - protein, 10 aa, Mycobacterium tuberculosis
TDRNHDLAPR

SEQ ID NO: 26863 - protein, 10 aa, Mycobacterium tuberculosis
DRNHDLAPRQ

SEQ ID NO: 26864 - protein, 10 aa, Mycobacterium tuberculosis
RNHDLAPRQI

SEQ ID NO: 26865 - protein, 10 aa, Mycobacterium tuberculosis
NHDLAPRQIA

SEQ ID NO: 26866 - protein, 10 aa, Mycobacterium tuberculosis
HDLAPRQIAR

SEQ ID NO: 26867 - protein, 10 aa, Mycobacterium tuberculosis
DLAPRQIARY

SEQ ID NO: 26868 - protein, 10 aa, Mycobacterium tuberculosis
LAPRQIARYR

SEQ ID NO: 26869 - protein, 10 aa, Mycobacterium tuberculosis
APRQIARYRT

SEQ ID NO: 26870 - protein, 10 aa, Mycobacterium tuberculosis
PRQIARYRTD

SEQ ID NO: 26871 - protein, 10 aa, Mycobacterium tuberculosis
RQIARYRTDN

SEQ ID NO: 26872 - protein, 10 aa, Mycobacterium tuberculosis
QIARYRTDNG

SEQ ID NO: 26873 - protein, 10 aa, Mycobacterium tuberculosis
IARYRTDNGE

SEQ ID NO: 26874 - protein, 10 aa, Mycobacterium tuberculosis
ARYRTDNGEE

SEQ ID NO: 26875 - protein, 10 aa, Mycobacterium tuberculosis
RYRTDNGEEF

SEQ ID NO: 26876 - protein, 10 aa, Mycobacterium tuberculosis
YRTDNGEEFE

SEQ ID NO: 26877 - protein, 10 aa, Mycobacterium tuberculosis
RTDNGEEFEV

SEQ ID NO: 26878 - protein, 10 aa, Mycobacterium tuberculosis
TDNGEEFEVP

SEQ ID NO: 26879 - protein, 10 aa, Mycobacterium tuberculosis
DNGEEFEVPF

SEQ ID NO: 26880 - protein, 10 aa, Mycobacterium tuberculosis
NGEEFEVPFA

SEQ ID NO: 26881 - protein, 10 aa, Mycobacterium tuberculosis
GEEFEVPFAD

SEQ ID NO: 26882 - protein, 10 aa, Mycobacterium tuberculosis
EEFEVPFADD

SEQ ID NO: 26883 - protein, 10 aa, Mycobacterium tuberculosis
EFEVPFADDA

SEQ ID NO: 26884 - protein, 10 aa, Mycobacterium tuberculosis
FEVPFADDAE

SEQ ID NO: 26885 - protein, 10 aa, Mycobacterium tuberculosis
EVPFADDAEI

SEQ ID NO: 26886 - protein, 10 aa, Mycobacterium tuberculosis
VPFADDAEIP

SEQ ID NO: 26887 - protein, 10 aa, Mycobacterium tuberculosis
PFADDAEIPG

SEQ ID NO: 26888 - protein, 10 aa, Mycobacterium tuberculosis
FADDAEIPGT

SEQ ID NO: 26889 - protein, 10 aa, Mycobacterium tuberculosis
ADDAEIPGTW

SEQ ID NO: 26890 - protein, 10 aa, Mycobacterium tuberculosis
DDAEIPGTWL

SEQ ID NO: 26891 - protein, 10 aa, Mycobacterium tuberculosis
DAEIPGTWLC

SEQ ID NO: 26892 - protein, 10 aa, Mycobacterium tuberculosis
AEIPGTWLCR

SEQ ID NO: 26893 - protein, 10 aa, Mycobacterium tuberculosis
EIPGTWLCRN

SEQ ID NO: 26894 - protein, 10 aa, Mycobacterium tuberculosis
IPGTWLCRNG

SEQ ID NO: 26895 - protein, 10 aa, Mycobacterium tuberculosis
PGTWLCRNGM

SEQ ID NO: 26896 - protein, 10 aa, Mycobacterium tuberculosis
GTWLCRNGME

SEQ ID NO: 26897 - protein, 10 aa, Mycobacterium tuberculosis
TWLCRNGMEG

SEQ ID NO: 26898 - protein, 10 aa, Mycobacterium tuberculosis
WLCRNGMEGT

SEQ ID NO: 26899 - protein, 10 aa, Mycobacterium tuberculosis
LCRNGMEGTL

SEQ ID NO: 26900 - protein, 10 aa, Mycobacterium tuberculosis
CRNGMEGTLI

SEQ ID NO: 26901 - protein, 10 aa, Mycobacterium tuberculosis
RNGMEGTLIE

SEQ ID NO: 26902 - protein, 10 aa, Mycobacterium tuberculosis
NGMEGTLIEG

SEQ ID NO: 26903 - protein, 10 aa, Mycobacterium tuberculosis
GMEGTLIEGD

SEQ ID NO: 26904 - protein, 10 aa, Mycobacterium tuberculosis
MEGTLIEGDL

SEQ ID NO: 26905 - protein, 10 aa, Mycobacterium tuberculosis
EGTLIEGDLP

SEQ ID NO: 26906 - protein, 10 aa, Mycobacterium tuberculosis
GTLIEGDLPE

SEQ ID NO: 26907 - protein, 10 aa, Mycobacterium tuberculosis
TLIEGDLPEP

SEQ ID NO: 26908 - protein, 10 aa, Mycobacterium tuberculosis
LIEGDLPEPK

SEQ ID NO: 26909 - protein, 10 aa, Mycobacterium tuberculosis
IEGDLPEPKK

SEQ ID NO: 26910 - protein, 10 aa, Mycobacterium tuberculosis
EGDLPEPKKV

SEQ ID NO: 26911 - protein, 10 aa, Mycobacterium tuberculosis
GDLPEPKKVK

SEQ ID NO: 26912 - protein, 10 aa, Mycobacterium tuberculosis
DLPEPKKVKP

SEQ ID NO: 26913 - protein, 10 aa, Mycobacterium tuberculosis
LPEPKKVKPP

SEQ ID NO: 26914 - protein, 10 aa, Mycobacterium tuberculosis
PEPKKVKPPR

SEQ ID NO: 26915 - protein, 10 aa, Mycobacterium tuberculosis
EPKKVKPPRT

SEQ ID NO: 26916 - protein, 10 aa, Mycobacterium tuberculosis
PKKVKPPRTH

SEQ ID NO: 26917 - protein, 10 aa, Mycobacterium tuberculosis
KKVKPPRTHW

SEQ ID NO: 26918 - protein, 10 aa, Mycobacterium tuberculosis
KVKPPRTHWD

SEQ ID NO: 26919 - protein, 10 aa, Mycobacterium tuberculosis
VKPPRTHWDM

SEQ ID NO: 26920 - protein, 10 aa, Mycobacterium tuberculosis
KPPRTHWDML

SEQ ID NO: 26921 - protein, 10 aa, Mycobacterium tuberculosis
PPRTHWDMLL

SEQ ID NO: 26922 - protein, 10 aa, Mycobacterium tuberculosis
PRTHWDMLLE

SEQ ID NO: 26923 - protein, 10 aa, Mycobacterium tuberculosis
RTHWDMLLER

SEQ ID NO: 26924 - protein, 10 aa, Mycobacterium tuberculosis
THWDMLLERR

SEQ ID NO: 26925 - protein, 10 aa, Mycobacterium tuberculosis
HWDMLLERRS

SEQ ID NO: 26926 - protein, 10 aa, Mycobacterium tuberculosis
WDMLLERRSI

SEQ ID NO: 26927 - protein, 10 aa, Mycobacterium tuberculosis
DMLLERRSIE

SEQ ID NO: 26928 - protein, 10 aa, Mycobacterium tuberculosis
MLLERRSIEE

SEQ ID NO: 26929 - protein, 10 aa, Mycobacterium tuberculosis
LLERRSIEEL

SEQ ID NO: 26930 - protein, 10 aa, Mycobacterium tuberculosis
LERRSIEELE

SEQ ID NO: 26931 - protein, 10 aa, Mycobacterium tuberculosis
ERRSIEELEE

SEQ ID NO: 26932 - protein, 10 aa, Mycobacterium tuberculosis
RRSIEELEEL

SEQ ID NO: 26933 - protein, 10 aa, Mycobacterium tuberculosis
RSIEELEELL

SEQ ID NO: 26934 - protein, 10 aa, Mycobacterium tuberculosis
SIEELEELLK

SEQ ID NO: 26935 - protein, 10 aa, Mycobacterium tuberculosis
IEELEELLKE

SEQ ID NO: 26936 - protein, 10 aa, Mycobacterium tuberculosis
EELEELLKER

SEQ ID NO: 26937 - protein, 10 aa, Mycobacterium tuberculosis
ELEELLKERL

SEQ ID NO: 26938 - protein, 10 aa, Mycobacterium tuberculosis
LEELLKERLE

SEQ ID NO: 26939 - protein, 10 aa, Mycobacterium tuberculosis
EELLKERLEL

SEQ ID NO: 26940 - protein, 10 aa, Mycobacterium tuberculosis
ELLKERLELI

SEQ ID NO: 26941 - protein, 10 aa, Mycobacterium tuberculosis
LLKERLELIR

SEQ ID NO: 26942 - protein, 10 aa, Mycobacterium tuberculosis
LKERLELIRS

SEQ ID NO: 26943 - protein, 10 aa, Mycobacterium tuberculosis
KERLELIRSR

SEQ ID NO: 26944 - protein, 10 aa, Mycobacterium tuberculosis
ERLELIRSRR

SEQ ID NO: 26945 - protein, 10 aa, Mycobacterium tuberculosis
RLELIRSRRR

SEQ ID NO: 26946 - protein, 10 aa, Mycobacterium tuberculosis
LELIRSRRRG

SEQ ID NO: 26947 - protein, 11 aa, Mycobacterium tuberculosis
MADRVLRGSRL

SEQ ID NO: 26948 - protein, 11 aa, Mycobacterium tuberculosis
ADRVLRGSRLG

SEQ ID NO: 26949 - protein, 11 aa, Mycobacterium tuberculosis
DRVLRGSRLGA

SEQ ID NO: 26950 - protein, 11 aa, Mycobacterium tuberculosis
RVLRGSRLGAV

SEQ ID NO: 26951 - protein, 11 aa, Mycobacterium tuberculosis
VLRGSRLGAVS

SEQ ID NO: 26952 - protein, 11 aa, Mycobacterium tuberculosis
LRGSRLGAVSY

SEQ ID NO: 26953 - protein, 11 aa, Mycobacterium tuberculosis
RGSRLGAVSYE

SEQ ID NO: 26954 - protein, 11 aa, Mycobacterium tuberculosis
GSRLGAVSYET

SEQ ID NO: 26955 - protein, 11 aa, Mycobacterium tuberculosis
SRLGAVSYETD

SEQ ID NO: 26956 - protein, 11 aa, Mycobacterium tuberculosis
RLGAVSYETDR

SEQ ID NO: 26957 - protein, 11 aa, Mycobacterium tuberculosis
LGAVSYETDRN

SEQ ID NO: 26958 - protein, 11 aa, Mycobacterium tuberculosis
GAVSYETDRNH

SEQ ID NO: 26959 - protein, 11 aa, Mycobacterium tuberculosis
AVSYETDRNHD

SEQ ID NO: 26960 - protein, 11 aa, Mycobacterium tuberculosis
VSYETDRNHDL

SEQ ID NO: 26961 - protein, 11 aa, Mycobacterium tuberculosis
SYETDRNHDLA

SEQ ID NO: 26962 - protein, 11 aa, Mycobacterium tuberculosis
YETDRNHDLAP

SEQ ID NO: 26963 - protein, 11 aa, Mycobacterium tuberculosis
ETDRNHDLAPR

SEQ ID NO: 26964 - protein, 11 aa, Mycobacterium tuberculosis
TDRNHDLAPRQ

SEQ ID NO: 26965 - protein, 11 aa, Mycobacterium tuberculosis
DRNHDLAPRQI

SEQ ID NO: 26966 - protein, 11 aa, Mycobacterium tuberculosis
RNHDLAPRQIA

SEQ ID NO: 26967 - protein, 11 aa, Mycobacterium tuberculosis
NHDLAPRQIAR

SEQ ID NO: 26968 - protein, 11 aa, Mycobacterium tuberculosis
HDLAPRQIARY

SEQ ID NO: 26969 - protein, 11 aa, Mycobacterium tuberculosis
DLAPRQIARYR

SEQ ID NO: 26970 - protein, 11 aa, Mycobacterium tuberculosis
LAPRQIARYRT

SEQ ID NO: 26971 - protein, 11 aa, Mycobacterium tuberculosis
APRQIARYRTD

SEQ ID NO: 26972 - protein, 11 aa, Mycobacterium tuberculosis
PRQIARYRTDN

SEQ ID NO: 26973 - protein, 11 aa, Mycobacterium tuberculosis
RQIARYRTDNG

SEQ ID NO: 26974 - protein, 11 aa, Mycobacterium tuberculosis
QIARYRTDNGE

SEQ ID NO: 26975 - protein, 11 aa, Mycobacterium tuberculosis
IARYRTDNGEE

SEQ ID NO: 26976 - protein, 11 aa, Mycobacterium tuberculosis
ARYRTDNGEEF

SEQ ID NO: 26977 - protein, 11 aa, Mycobacterium tuberculosis
RYRTDNGEEFE

SEQ ID NO: 26978 - protein, 11 aa, Mycobacterium tuberculosis
YRTDNGEEFEV

SEQ ID NO: 26979 - protein, 11 aa, Mycobacterium tuberculosis
RTDNGEEFEVP

SEQ ID NO: 26980 - protein, 11 aa, Mycobacterium tuberculosis
TDNGEEFEVPF

SEQ ID NO: 26981 - protein, 11 aa, Mycobacterium tuberculosis
DNGEEFEVPFA

SEQ ID NO: 26982 - protein, 11 aa, Mycobacterium tuberculosis
NGEEFEVPFAD

SEQ ID NO: 26983 - protein, 11 aa, Mycobacterium tuberculosis
GEEFEVPFADD

SEQ ID NO: 26984 - protein, 11 aa, Mycobacterium tuberculosis
EEFEVPFADDA

SEQ ID NO: 26985 - protein, 11 aa, Mycobacterium tuberculosis
EFEVPFADDAE

SEQ ID NO: 26986 - protein, 11 aa, Mycobacterium tuberculosis
FEVPFADDAEI

SEQ ID NO: 26987 - protein, 11 aa, Mycobacterium tuberculosis
EVPFADDAEIP

SEQ ID NO: 26988 - protein, 11 aa, Mycobacterium tuberculosis
VPFADDAEIPG

SEQ ID NO: 26989 - protein, 11 aa, Mycobacterium tuberculosis
PFADDAEIPGT

SEQ ID NO: 26990 - protein, 11 aa, Mycobacterium tuberculosis
FADDAEIPGTW

SEQ ID NO: 26991 - protein, 11 aa, Mycobacterium tuberculosis
ADDAEIPGTWL

SEQ ID NO: 26992 - protein, 11 aa, Mycobacterium tuberculosis
DDAEIPGTWLC

SEQ ID NO: 26993 - protein, 11 aa, Mycobacterium tuberculosis
DAEIPGTWLCR

SEQ ID NO: 26994 - protein, 11 aa, Mycobacterium tuberculosis
AEIPGTWLCRN

SEQ ID NO: 26995 - protein, 11 aa, Mycobacterium tuberculosis
EIPGTWLCRNG

SEQ ID NO: 26996 - protein, 11 aa, Mycobacterium tuberculosis
IPGTWLCRNGM

SEQ ID NO: 26997 - protein, 11 aa, Mycobacterium tuberculosis
PGTWLCRNGME

SEQ ID NO: 26998 - protein, 11 aa, Mycobacterium tuberculosis
GTWLCRNGMEG

SEQ ID NO: 26999 - protein, 11 aa, Mycobacterium tuberculosis
TWLCRNGMEGT

SEQ ID NO: 27000 - protein, 11 aa, Mycobacterium tuberculosis
WLCRNGMEGTL

SEQ ID NO: 27001 - protein, 11 aa, Mycobacterium tuberculosis
LCRNGMEGTLI

SEQ ID NO: 27002 - protein, 11 aa, Mycobacterium tuberculosis
CRNGMEGTLIE

SEQ ID NO: 27003 - protein, 11 aa, Mycobacterium tuberculosis
RNGMEGTLIEG

SEQ ID NO: 27004 - protein, 11 aa, Mycobacterium tuberculosis
NGMEGTLIEGD

SEQ ID NO: 27005 - protein, 11 aa, Mycobacterium tuberculosis
GMEGTLIEGDL

SEQ ID NO: 27006 - protein, 11 aa, Mycobacterium tuberculosis
MEGTLIEGDLP

SEQ ID NO: 27007 - protein, 11 aa, Mycobacterium tuberculosis
EGTLIEGDLPE

SEQ ID NO: 27008 - protein, 11 aa, Mycobacterium tuberculosis
GTLIEGDLPEP

SEQ ID NO: 27009 - protein, 11 aa, Mycobacterium tuberculosis
TLIEGDLPEPK

SEQ ID NO: 27010 - protein, 11 aa, Mycobacterium tuberculosis
LIEGDLPEPKK

SEQ ID NO: 27011 - protein, 11 aa, Mycobacterium tuberculosis
IEGDLPEPKKV

SEQ ID NO: 27012 - protein, 11 aa, Mycobacterium tuberculosis
EGDLPEPKKVK

SEQ ID NO: 27013 - protein, 11 aa, Mycobacterium tuberculosis
GDLPEPKKVKP

SEQ ID NO: 27014 - protein, 11 aa, Mycobacterium tuberculosis
DLPEPKKVKPP

SEQ ID NO: 27015 - protein, 11 aa, Mycobacterium tuberculosis
LPEPKKVKPPR

SEQ ID NO: 27016 - protein, 11 aa, Mycobacterium tuberculosis
PEPKKVKPPRT

SEQ ID NO: 27017 - protein, 11 aa, Mycobacterium tuberculosis
EPKKVKPPRTH

SEQ ID NO: 27018 - protein, 11 aa, Mycobacterium tuberculosis
PKKVKPPRTHW

SEQ ID NO: 27019 - protein, 11 aa, Mycobacterium tuberculosis
KKVKPPRTHWD

SEQ ID NO: 27020 - protein, 11 aa, Mycobacterium tuberculosis
KVKPPRTHWDM

SEQ ID NO: 27021 - protein, 11 aa, Mycobacterium tuberculosis
VKPPRTHWDML

SEQ ID NO: 27022 - protein, 11 aa, Mycobacterium tuberculosis
KPPRTHWDMLL

SEQ ID NO: 27023 - protein, 11 aa, Mycobacterium tuberculosis
PPRTHWDMLLE

SEQ ID NO: 27024 - protein, 11 aa, Mycobacterium tuberculosis
PRTHWDMLLER

SEQ ID NO: 27025 - protein, 11 aa, Mycobacterium tuberculosis
RTHWDMLLERR

SEQ ID NO: 27026 - protein, 11 aa, Mycobacterium tuberculosis
THWDMLLERRS

SEQ ID NO: 27027 - protein, 11 aa, Mycobacterium tuberculosis
HWDMLLERRSI

SEQ ID NO: 27028 - protein, 11 aa, Mycobacterium tuberculosis
WDMLLERRSIE

SEQ ID NO: 27029 - protein, 11 aa, Mycobacterium tuberculosis
DMLLERRSIEE

SEQ ID NO: 27030 - protein, 11 aa, Mycobacterium tuberculosis
MLLERRSIEEL

SEQ ID NO: 27031 - protein, 11 aa, Mycobacterium tuberculosis
LLERRSIEELE

SEQ ID NO: 27032 - protein, 11 aa, Mycobacterium tuberculosis
LERRSIEELEE

SEQ ID NO: 27033 - protein, 11 aa, Mycobacterium tuberculosis
ERRSIEELEEL

SEQ ID NO: 27034 - protein, 11 aa, Mycobacterium tuberculosis
RRSIEELEELL

SEQ ID NO: 27035 - protein, 11 aa, Mycobacterium tuberculosis
RSIEELEELLK

SEQ ID NO: 27036 - protein, 11 aa, Mycobacterium tuberculosis
SIEELEELLKE

SEQ ID NO: 27037 - protein, 11 aa, Mycobacterium tuberculosis
IEELEELLKER

SEQ ID NO: 27038 - protein, 11 aa, Mycobacterium tuberculosis
EELEELLKERL

SEQ ID NO: 27039 - protein, 11 aa, Mycobacterium tuberculosis
ELEELLKERLE

SEQ ID NO: 27040 - protein, 11 aa, Mycobacterium tuberculosis
LEELLKERLEL

SEQ ID NO: 27041 - protein, 11 aa, Mycobacterium tuberculosis
EELLKERLELI

SEQ ID NO: 27042 - protein, 11 aa, Mycobacterium tuberculosis
ELLKERLELIR

SEQ ID NO: 27043 - protein, 11 aa, Mycobacterium tuberculosis
LLKERLELIRS

SEQ ID NO: 27044 - protein, 11 aa, Mycobacterium tuberculosis
LKERLELIRSR

SEQ ID NO: 27045 - protein, 11 aa, Mycobacterium tuberculosis
KERLELIRSRR

SEQ ID NO: 27046 - protein, 11 aa, Mycobacterium tuberculosis
ERLELIRSRRR

SEQ ID NO: 27047 - protein, 11 aa, Mycobacterium tuberculosis
RLELIRSRRRG

SEQ ID NO: 27048 - protein, 8 aa, Mycobacterium tuberculosis
MPLSDHEQ

SEQ ID NO: 27049 - protein, 8 aa, Mycobacterium tuberculosis
PLSDHEQR

SEQ ID NO: 27050 - protein, 8 aa, Mycobacterium tuberculosis
LSDHEQRM

SEQ ID NO: 27051 - protein, 8 aa, Mycobacterium tuberculosis
SDHEQRML

SEQ ID NO: 27052 - protein, 8 aa, Mycobacterium tuberculosis
DHEQRMLD

SEQ ID NO: 27053 - protein, 8 aa, Mycobacterium tuberculosis
HEQRMLDQ

SEQ ID NO: 27054 - protein, 8 aa, Mycobacterium tuberculosis
EQRMLDQI

SEQ ID NO: 27055 - protein, 8 aa, Mycobacterium tuberculosis
QRMLDQIE

SEQ ID NO: 27056 - protein, 8 aa, Mycobacterium tuberculosis
RMLDQIES

SEQ ID NO: 27057 - protein, 8 aa, Mycobacterium tuberculosis
MLDQIESA

SEQ ID NO: 27058 - protein, 8 aa, Mycobacterium tuberculosis
LDQIESAL

SEQ ID NO: 27059 - protein, 8 aa, Mycobacterium tuberculosis
DQIESALY

SEQ ID NO: 27060 - protein, 8 aa, Mycobacterium tuberculosis
QIESALYA

SEQ ID NO: 27061 - protein, 8 aa, Mycobacterium tuberculosis
IESALYAE

SEQ ID NO: 27062 - protein, 8 aa, Mycobacterium tuberculosis
ESALYAED

SEQ ID NO: 27063 - protein, 8 aa, Mycobacterium tuberculosis
SALYAEDP

SEQ ID NO: 27064 - protein, 8 aa, Mycobacterium tuberculosis
ALYAEDPK

SEQ ID NO: 27065 - protein, 8 aa, Mycobacterium tuberculosis
LYAEDPKF

SEQ ID NO: 27066 - protein, 8 aa, Mycobacterium tuberculosis
YAEDPKFA

SEQ ID NO: 27067 - protein, 8 aa, Mycobacterium tuberculosis
AEDPKFAS

SEQ ID NO: 27068 - protein, 8 aa, Mycobacterium tuberculosis
EDPKFASS

SEQ ID NO: 27069 - protein, 8 aa, Mycobacterium tuberculosis
DPKFASSV

SEQ ID NO: 27070 - protein, 8 aa, Mycobacterium tuberculosis
PKFASSVR

SEQ ID NO: 27071 - protein, 8 aa, Mycobacterium tuberculosis
KFASSVRG

SEQ ID NO: 27072 - protein, 8 aa, Mycobacterium tuberculosis
FASSVRGG

SEQ ID NO: 27073 - protein, 8 aa, Mycobacterium tuberculosis
ASSVRGGG

SEQ ID NO: 27074 - protein, 8 aa, Mycobacterium tuberculosis
SSVRGGGF

SEQ ID NO: 27075 - protein, 8 aa, Mycobacterium tuberculosis
SVRGGGFR

SEQ ID NO: 27076 - protein, 8 aa, Mycobacterium tuberculosis
VRGGGFRA

SEQ ID NO: 27077 - protein, 8 aa, Mycobacterium tuberculosis
RGGGFRAP

SEQ ID NO: 27078 - protein, 8 aa, Mycobacterium tuberculosis
GGGFRAPT

SEQ ID NO: 27079 - protein, 8 aa, Mycobacterium tuberculosis
GGFRAPTA

SEQ ID NO: 27080 - protein, 8 aa, Mycobacterium tuberculosis
GFRAPTAR

SEQ ID NO: 27081 - protein, 8 aa, Mycobacterium tuberculosis
FRAPTARR

SEQ ID NO: 27082 - protein, 8 aa, Mycobacterium tuberculosis
RAPTARRR

SEQ ID NO: 27083 - protein, 8 aa, Mycobacterium tuberculosis
APTARRRL

SEQ ID NO: 27084 - protein, 8 aa, Mycobacterium tuberculosis
PTARRRLQ

SEQ ID NO: 27085 - protein, 8 aa, Mycobacterium tuberculosis
TARRRLQG

SEQ ID NO: 27086 - protein, 8 aa, Mycobacterium tuberculosis
ARRRLQGA

SEQ ID NO: 27087 - protein, 8 aa, Mycobacterium tuberculosis
RRRLQGAA

SEQ ID NO: 27088 - protein, 8 aa, Mycobacterium tuberculosis
RRLQGAAL

SEQ ID NO: 27089 - protein, 8 aa, Mycobacterium tuberculosis
RLQGAALF

SEQ ID NO: 27090 - protein, 8 aa, Mycobacterium tuberculosis
LQGAALFI

SEQ ID NO: 27091 - protein, 8 aa, Mycobacterium tuberculosis
QGAALFII

SEQ ID NO: 27092 - protein, 8 aa, Mycobacterium tuberculosis
GAALFIIG

SEQ ID NO: 27093 - protein, 8 aa, Mycobacterium tuberculosis
AALFIIGL

SEQ ID NO: 27094 - protein, 8 aa, Mycobacterium tuberculosis
ALFIIGLG

SEQ ID NO: 27095 - protein, 8 aa, Mycobacterium tuberculosis
LFIIGLGM

SEQ ID NO: 27096 - protein, 8 aa, Mycobacterium tuberculosis
FIIGLGML

SEQ ID NO: 27097 - protein, 8 aa, Mycobacterium tuberculosis
IIGLGMLV

SEQ ID NO: 27098 - protein, 8 aa, Mycobacterium tuberculosis
IGLGMLVS

SEQ ID NO: 27099 - protein, 8 aa, Mycobacterium tuberculosis
GLGMLVSG

SEQ ID NO: 27100 - protein, 8 aa, Mycobacterium tuberculosis
LGMLVSGV

SEQ ID NO: 27101 - protein, 8 aa, Mycobacterium tuberculosis
GMLVSGVA

SEQ ID NO: 27102 - protein, 8 aa, Mycobacterium tuberculosis
MLVSGVAF

SEQ ID NO: 27103 - protein, 8 aa, Mycobacterium tuberculosis
LVSGVAFK

SEQ ID NO: 27104 - protein, 8 aa, Mycobacterium tuberculosis
VSGVAFKE

SEQ ID NO: 27105 - protein, 8 aa, Mycobacterium tuberculosis
SGVAFKET

SEQ ID NO: 27106 - protein, 8 aa, Mycobacterium tuberculosis
GVAFKETM

SEQ ID NO: 27107 - protein, 8 aa, Mycobacterium tuberculosis
VAFKETMI

SEQ ID NO: 27108 - protein, 8 aa, Mycobacterium tuberculosis
AFKETMIG

SEQ ID NO: 27109 - protein, 8 aa, Mycobacterium tuberculosis
FKETMIGS

SEQ ID NO: 27110 - protein, 8 aa, Mycobacterium tuberculosis
KETMIGSF

SEQ ID NO: 27111 - protein, 8 aa, Mycobacterium tuberculosis
ETMIGSFP

SEQ ID NO: 27112 - protein, 8 aa, Mycobacterium tuberculosis
TMIGSFPI

SEQ ID NO: 27113 - protein, 8 aa, Mycobacterium tuberculosis
MIGSFPIL

SEQ ID NO: 27114 - protein, 8 aa, Mycobacterium tuberculosis
IGSFPILS

SEQ ID NO: 27115 - protein, 8 aa, Mycobacterium tuberculosis
GSFPILSV

SEQ ID NO: 27116 - protein, 8 aa, Mycobacterium tuberculosis
SFPILSVF

SEQ ID NO: 27117 - protein, 8 aa, Mycobacterium tuberculosis
FPILSVFG

SEQ ID NO: 27118 - protein, 8 aa, Mycobacterium tuberculosis
PILSVFGF

SEQ ID NO: 27119 - protein, 8 aa, Mycobacterium tuberculosis
ILSVFGFV

SEQ ID NO: 27120 - protein, 8 aa, Mycobacterium tuberculosis
LSVFGFVV

SEQ ID NO: 27121 - protein, 8 aa, Mycobacterium tuberculosis
SVFGFVVM

SEQ ID NO: 27122 - protein, 8 aa, Mycobacterium tuberculosis
VFGFVVMF

SEQ ID NO: 27123 - protein, 8 aa, Mycobacterium tuberculosis
FGFVVMFG

SEQ ID NO: 27124 - protein, 8 aa, Mycobacterium tuberculosis
GFVVMFGG

SEQ ID NO: 27125 - protein, 8 aa, Mycobacterium tuberculosis
FVVMFGGV

SEQ ID NO: 27126 - protein, 8 aa, Mycobacterium tuberculosis
VVMFGGVV

SEQ ID NO: 27127 - protein, 8 aa, Mycobacterium tuberculosis
VMFGGVVY

SEQ ID NO: 27128 - protein, 8 aa, Mycobacterium tuberculosis
MFGGVVYA

SEQ ID NO: 27129 - protein, 8 aa, Mycobacterium tuberculosis
FGGVVYAI

SEQ ID NO: 27130 - protein, 8 aa, Mycobacterium tuberculosis
GGVVYAIT

SEQ ID NO: 27131 - protein, 8 aa, Mycobacterium tuberculosis
GVVYAITG

SEQ ID NO: 27132 - protein, 8 aa, Mycobacterium tuberculosis
VVYAITGP

SEQ ID NO: 27133 - protein, 8 aa, Mycobacterium tuberculosis
VYAITGPR

SEQ ID NO: 27134 - protein, 8 aa, Mycobacterium tuberculosis
YAITGPRL

SEQ ID NO: 27135 - protein, 8 aa, Mycobacterium tuberculosis
AITGPRLS

SEQ ID NO: 27136 - protein, 8 aa, Mycobacterium tuberculosis
ITGPRLSG

SEQ ID NO: 27137 - protein, 8 aa, Mycobacterium tuberculosis
TGPRLSGR

SEQ ID NO: 27138 - protein, 8 aa, Mycobacterium tuberculosis
GPRLSGRM

SEQ ID NO: 27139 - protein, 8 aa, Mycobacterium tuberculosis
PRLSGRMD

SEQ ID NO: 27140 - protein, 8 aa, Mycobacterium tuberculosis
RLSGRMDR

SEQ ID NO: 27141 - protein, 8 aa, Mycobacterium tuberculosis
LSGRMDRG

SEQ ID NO: 27142 - protein, 8 aa, Mycobacterium tuberculosis
SGRMDRGG

SEQ ID NO: 27143 - protein, 8 aa, Mycobacterium tuberculosis
GRMDRGGS

SEQ ID NO: 27144 - protein, 8 aa, Mycobacterium tuberculosis
RMDRGGSA

SEQ ID NO: 27145 - protein, 8 aa, Mycobacterium tuberculosis
MDRGGSAA

SEQ ID NO: 27146 - protein, 8 aa, Mycobacterium tuberculosis
DRGGSAAG

SEQ ID NO: 27147 - protein, 8 aa, Mycobacterium tuberculosis
RGGSAAGA

SEQ ID NO: 27148 - protein, 8 aa, Mycobacterium tuberculosis
GGSAAGAS

SEQ ID NO: 27149 - protein, 8 aa, Mycobacterium tuberculosis
GSAAGASR

SEQ ID NO: 27150 - protein, 8 aa, Mycobacterium tuberculosis
SAAGASRQ

SEQ ID NO: 27151 - protein, 8 aa, Mycobacterium tuberculosis
AAGASRQR

SEQ ID NO: 27152 - protein, 8 aa, Mycobacterium tuberculosis
AGASRQRR

SEQ ID NO: 27153 - protein, 8 aa, Mycobacterium tuberculosis
GASRQRRT

SEQ ID NO: 27154 - protein, 8 aa, Mycobacterium tuberculosis
ASRQRRTK

SEQ ID NO: 27155 - protein, 8 aa, Mycobacterium tuberculosis
SRQRRTKG

SEQ ID NO: 27156 - protein, 8 aa, Mycobacterium tuberculosis
RQRRTKGA

SEQ ID NO: 27157 - protein, 8 aa, Mycobacterium tuberculosis
QRRTKGAG

SEQ ID NO: 27158 - protein, 8 aa, Mycobacterium tuberculosis
RRTKGAGG

SEQ ID NO: 27159 - protein, 8 aa, Mycobacterium tuberculosis
RTKGAGGS

SEQ ID NO: 27160 - protein, 8 aa, Mycobacterium tuberculosis
TKGAGGSF

SEQ ID NO: 27161 - protein, 8 aa, Mycobacterium tuberculosis
KGAGGSFT

SEQ ID NO: 27162 - protein, 8 aa, Mycobacterium tuberculosis
GAGGSFTS

SEQ ID NO: 27163 - protein, 8 aa, Mycobacterium tuberculosis
AGGSFTSR

SEQ ID NO: 27164 - protein, 8 aa, Mycobacterium tuberculosis
GGSFTSRM

SEQ ID NO: 27165 - protein, 8 aa, Mycobacterium tuberculosis
GSFTSRME

SEQ ID NO: 27166 - protein, 8 aa, Mycobacterium tuberculosis
SFTSRMED

SEQ ID NO: 27167 - protein, 8 aa, Mycobacterium tuberculosis
FTSRMEDR

SEQ ID NO: 27168 - protein, 8 aa, Mycobacterium tuberculosis
TSRMEDRF

SEQ ID NO: 27169 - protein, 8 aa, Mycobacterium tuberculosis
SRMEDRFR

SEQ ID NO: 27170 - protein, 8 aa, Mycobacterium tuberculosis
RMEDRFRR

SEQ ID NO: 27171 - protein, 8 aa, Mycobacterium tuberculosis
MEDRFRRR

SEQ ID NO: 27172 - protein, 8 aa, Mycobacterium tuberculosis
EDRFRRRF

SEQ ID NO: 27173 - protein, 8 aa, Mycobacterium tuberculosis
DRFRRRFD

SEQ ID NO: 27174 - protein, 8 aa, Mycobacterium tuberculosis
RFRRRFDE

SEQ ID NO: 27175 - protein, 9 aa, Mycobacterium tuberculosis
MPLSDHEQR

SEQ ID NO: 27176 - protein, 9 aa, Mycobacterium tuberculosis
PLSDHEQRM

SEQ ID NO: 27177 - protein, 9 aa, Mycobacterium tuberculosis
LSDHEQRML

SEQ ID NO: 27178 - protein, 9 aa, Mycobacterium tuberculosis
SDHEQRMLD

SEQ ID NO: 27179 - protein, 9 aa, Mycobacterium tuberculosis
DHEQRMLDQ

SEQ ID NO: 27180 - protein, 9 aa, Mycobacterium tuberculosis
HEQRMLDQI

SEQ ID NO: 27181 - protein, 9 aa, Mycobacterium tuberculosis
EQRMLDQIE

SEQ ID NO: 27182 - protein, 9 aa, Mycobacterium tuberculosis
QRMLDQIES

SEQ ID NO: 27183 - protein, 9 aa, Mycobacterium tuberculosis
RMLDQIESA

SEQ ID NO: 27184 - protein, 9 aa, Mycobacterium tuberculosis
MLDQIESAL

SEQ ID NO: 27185 - protein, 9 aa, Mycobacterium tuberculosis
LDQIESALY

SEQ ID NO: 27186 - protein, 9 aa, Mycobacterium tuberculosis
DQIESALYA

SEQ ID NO: 27187 - protein, 9 aa, Mycobacterium tuberculosis
QIESALYAE

SEQ ID NO: 27188 - protein, 9 aa, Mycobacterium tuberculosis
IESALYAED

SEQ ID NO: 27189 - protein, 9 aa, Mycobacterium tuberculosis
ESALYAEDP

SEQ ID NO: 27190 - protein, 9 aa, Mycobacterium tuberculosis
SALYAEDPK

SEQ ID NO: 27191 - protein, 9 aa, Mycobacterium tuberculosis
ALYAEDPKF

SEQ ID NO: 27192 - protein, 9 aa, Mycobacterium tuberculosis
LYAEDPKFA

SEQ ID NO: 27193 - protein, 9 aa, Mycobacterium tuberculosis
YAEDPKFAS

SEQ ID NO: 27194 - protein, 9 aa, Mycobacterium tuberculosis
AEDPKFASS

SEQ ID NO: 27195 - protein, 9 aa, Mycobacterium tuberculosis
EDPKFASSV

SEQ ID NO: 27196 - protein, 9 aa, Mycobacterium tuberculosis
DPKFASSVR

SEQ ID NO: 27197 - protein, 9 aa, Mycobacterium tuberculosis
PKFASSVRG

SEQ ID NO: 27198 - protein, 9 aa, Mycobacterium tuberculosis
KFASSVRGG

SEQ ID NO: 27199 - protein, 9 aa, Mycobacterium tuberculosis
FASSVRGGG

SEQ ID NO: 27200 - protein, 9 aa, Mycobacterium tuberculosis
ASSVRGGGF

SEQ ID NO: 27201 - protein, 9 aa, Mycobacterium tuberculosis
SSVRGGGFR

SEQ ID NO: 27202 - protein, 9 aa, Mycobacterium tuberculosis
SVRGGGFRA

SEQ ID NO: 27203 - protein, 9 aa, Mycobacterium tuberculosis
VRGGGFRAP

SEQ ID NO: 27204 - protein, 9 aa, Mycobacterium tuberculosis
RGGGFRAPT

SEQ ID NO: 27205 - protein, 9 aa, Mycobacterium tuberculosis
GGGFRAPTA

SEQ ID NO: 27206 - protein, 9 aa, Mycobacterium tuberculosis
GGFRAPTAR

SEQ ID NO: 27207 - protein, 9 aa, Mycobacterium tuberculosis
GFRAPTARR

SEQ ID NO: 27208 - protein, 9 aa, Mycobacterium tuberculosis
FRAPTARRR

SEQ ID NO: 27209 - protein, 9 aa, Mycobacterium tuberculosis
RAPTARRRL

SEQ ID NO: 27210 - protein, 9 aa, Mycobacterium tuberculosis
APTARRRLQ

SEQ ID NO: 27211 - protein, 9 aa, Mycobacterium tuberculosis
PTARRRLQG

SEQ ID NO: 27212 - protein, 9 aa, Mycobacterium tuberculosis
TARRRLQGA

SEQ ID NO: 27213 - protein, 9 aa, Mycobacterium tuberculosis
ARRRLQGAA

SEQ ID NO: 27214 - protein, 9 aa, Mycobacterium tuberculosis
RRRLQGAAL

SEQ ID NO: 27215 - protein, 9 aa, Mycobacterium tuberculosis
RRLQGAALF

SEQ ID NO: 27216 - protein, 9 aa, Mycobacterium tuberculosis
RLQGAALFI

SEQ ID NO: 27217 - protein, 9 aa, Mycobacterium tuberculosis
LQGAALFII

SEQ ID NO: 27218 - protein, 9 aa, Mycobacterium tuberculosis
QGAALFIIG

SEQ ID NO: 27219 - protein, 9 aa, Mycobacterium tuberculosis
GAALFIIGL

SEQ ID NO: 27220 - protein, 9 aa, Mycobacterium tuberculosis
AALFIIGLG

SEQ ID NO: 27221 - protein, 9 aa, Mycobacterium tuberculosis
ALFIIGLGM

SEQ ID NO: 27222 - protein, 9 aa, Mycobacterium tuberculosis
LFIIGLGML

SEQ ID NO: 27223 - protein, 9 aa, Mycobacterium tuberculosis
FIIGLGMLV

SEQ ID NO: 27224 - protein, 9 aa, Mycobacterium tuberculosis
IIGLGMLVS

SEQ ID NO: 27225 - protein, 9 aa, Mycobacterium tuberculosis
IGLGMLVSG

SEQ ID NO: 27226 - protein, 9 aa, Mycobacterium tuberculosis
GLGMLVSGV

SEQ ID NO: 27227 - protein, 9 aa, Mycobacterium tuberculosis
LGMLVSGVA

SEQ ID NO: 27228 - protein, 9 aa, Mycobacterium tuberculosis
GMLVSGVAF

SEQ ID NO: 27229 - protein, 9 aa, Mycobacterium tuberculosis
MLVSGVAFK

SEQ ID NO: 27230 - protein, 9 aa, Mycobacterium tuberculosis
LVSGVAFKE

SEQ ID NO: 27231 - protein, 9 aa, Mycobacterium tuberculosis
VSGVAFKET

SEQ ID NO: 27232 - protein, 9 aa, Mycobacterium tuberculosis
SGVAFKETM

SEQ ID NO: 27233 - protein, 9 aa, Mycobacterium tuberculosis
GVAFKETMI

SEQ ID NO: 27234 - protein, 9 aa, Mycobacterium tuberculosis
VAFKETMIG

SEQ ID NO: 27235 - protein, 9 aa, Mycobacterium tuberculosis
AFKETMIGS

SEQ ID NO: 27236 - protein, 9 aa, Mycobacterium tuberculosis
FKETMIGSF

SEQ ID NO: 27237 - protein, 9 aa, Mycobacterium tuberculosis
KETMIGSFP

SEQ ID NO: 27238 - protein, 9 aa, Mycobacterium tuberculosis
ETMIGSFPI

SEQ ID NO: 27239 - protein, 9 aa, Mycobacterium tuberculosis
TMIGSFPIL

SEQ ID NO: 27240 - protein, 9 aa, Mycobacterium tuberculosis
MIGSFPILS

SEQ ID NO: 27241 - protein, 9 aa, Mycobacterium tuberculosis
IGSFPILSV

SEQ ID NO: 27242 - protein, 9 aa, Mycobacterium tuberculosis
GSFPILSVF

SEQ ID NO: 27243 - protein, 9 aa, Mycobacterium tuberculosis
SFPILSVFG

SEQ ID NO: 27244 - protein, 9 aa, Mycobacterium tuberculosis
FPILSVFGF

SEQ ID NO: 27245 - protein, 9 aa, Mycobacterium tuberculosis
PILSVFGFV

SEQ ID NO: 27246 - protein, 9 aa, Mycobacterium tuberculosis
ILSVFGFVV

SEQ ID NO: 27247 - protein, 9 aa, Mycobacterium tuberculosis
LSVFGFVVM

SEQ ID NO: 27248 - protein, 9 aa, Mycobacterium tuberculosis
SVFGFVVMF

SEQ ID NO: 27249 - protein, 9 aa, Mycobacterium tuberculosis
VFGFVVMFG

SEQ ID NO: 27250 - protein, 9 aa, Mycobacterium tuberculosis
FGFVVMFGG

SEQ ID NO: 27251 - protein, 9 aa, Mycobacterium tuberculosis
GFVVMFGGV

SEQ ID NO: 27252 - protein, 9 aa, Mycobacterium tuberculosis
FVVMFGGVV

SEQ ID NO: 27253 - protein, 9 aa, Mycobacterium tuberculosis
VVMFGGVVY

SEQ ID NO: 27254 - protein, 9 aa, Mycobacterium tuberculosis
VMFGGVVYA

SEQ ID NO: 27255 - protein, 9 aa, Mycobacterium tuberculosis
MFGGVVYAI

SEQ ID NO: 27256 - protein, 9 aa, Mycobacterium tuberculosis
FGGVVYAIT

SEQ ID NO: 27257 - protein, 9 aa, Mycobacterium tuberculosis
GGVVYAITG

SEQ ID NO: 27258 - protein, 9 aa, Mycobacterium tuberculosis
GVVYAITGP

SEQ ID NO: 27259 - protein, 9 aa, Mycobacterium tuberculosis
VVYAITGPR

SEQ ID NO: 27260 - protein, 9 aa, Mycobacterium tuberculosis
VYAITGPRL

SEQ ID NO: 27261 - protein, 9 aa, Mycobacterium tuberculosis
YAITGPRLS

SEQ ID NO: 27262 - protein, 9 aa, Mycobacterium tuberculosis
AITGPRLSG

SEQ ID NO: 27263 - protein, 9 aa, Mycobacterium tuberculosis
ITGPRLSGR

SEQ ID NO: 27264 - protein, 9 aa, Mycobacterium tuberculosis
TGPRLSGRM

SEQ ID NO: 27265 - protein, 9 aa, Mycobacterium tuberculosis
GPRLSGRMD

SEQ ID NO: 27266 - protein, 9 aa, Mycobacterium tuberculosis
PRLSGRMDR

SEQ ID NO: 27267 - protein, 9 aa, Mycobacterium tuberculosis
RLSGRMDRG

SEQ ID NO: 27268 - protein, 9 aa, Mycobacterium tuberculosis
LSGRMDRGG

SEQ ID NO: 27269 - protein, 9 aa, Mycobacterium tuberculosis
SGRMDRGGS

SEQ ID NO: 27270 - protein, 9 aa, Mycobacterium tuberculosis
GRMDRGGSA

SEQ ID NO: 27271 - protein, 9 aa, Mycobacterium tuberculosis
RMDRGGSAA

SEQ ID NO: 27272 - protein, 9 aa, Mycobacterium tuberculosis
MDRGGSAAG

SEQ ID NO: 27273 - protein, 9 aa, Mycobacterium tuberculosis
DRGGSAAGA

SEQ ID NO: 27274 - protein, 9 aa, Mycobacterium tuberculosis
RGGSAAGAS

SEQ ID NO: 27275 - protein, 9 aa, Mycobacterium tuberculosis
GGSAAGASR

SEQ ID NO: 27276 - protein, 9 aa, Mycobacterium tuberculosis
GSAAGASRQ

SEQ ID NO: 27277 - protein, 9 aa, Mycobacterium tuberculosis
SAAGASRQR

SEQ ID NO: 27278 - protein, 9 aa, Mycobacterium tuberculosis
AAGASRQRR

SEQ ID NO: 27279 - protein, 9 aa, Mycobacterium tuberculosis
AGASRQRRT

SEQ ID NO: 27280 - protein, 9 aa, Mycobacterium tuberculosis
GASRQRRTK

SEQ ID NO: 27281 - protein, 9 aa, Mycobacterium tuberculosis
ASRQRRTKG

SEQ ID NO: 27282 - protein, 9 aa, Mycobacterium tuberculosis
SRQRRTKGA

SEQ ID NO: 27283 - protein, 9 aa, Mycobacterium tuberculosis
RQRRTKGAG

SEQ ID NO: 27284 - protein, 9 aa, Mycobacterium tuberculosis
QRRTKGAGG

SEQ ID NO: 27285 - protein, 9 aa, Mycobacterium tuberculosis
RRTKGAGGS

SEQ ID NO: 27286 - protein, 9 aa, Mycobacterium tuberculosis
RTKGAGGSF

SEQ ID NO: 27287 - protein, 9 aa, Mycobacterium tuberculosis
TKGAGGSFT

SEQ ID NO: 27288 - protein, 9 aa, Mycobacterium tuberculosis
KGAGGSFTS

SEQ ID NO: 27289 - protein, 9 aa, Mycobacterium tuberculosis
GAGGSFTSR

SEQ ID NO: 27290 - protein, 9 aa, Mycobacterium tuberculosis
AGGSFTSRM

SEQ ID NO: 27291 - protein, 9 aa, Mycobacterium tuberculosis
GGSFTSRME

SEQ ID NO: 27292 - protein, 9 aa, Mycobacterium tuberculosis
GSFTSRMED

SEQ ID NO: 27293 - protein, 9 aa, Mycobacterium tuberculosis
SFTSRMEDR

SEQ ID NO: 27294 - protein, 9 aa, Mycobacterium tuberculosis
FTSRMEDRF

SEQ ID NO: 27295 - protein, 9 aa, Mycobacterium tuberculosis
TSRMEDRFR

SEQ ID NO: 27296 - protein, 9 aa, Mycobacterium tuberculosis
SRMEDRFRR

SEQ ID NO: 27297 - protein, 9 aa, Mycobacterium tuberculosis
RMEDRFRRR

SEQ ID NO: 27298 - protein, 9 aa, Mycobacterium tuberculosis
MEDRFRRRF

SEQ ID NO: 27299 - protein, 9 aa, Mycobacterium tuberculosis
EDRFRRRFD

SEQ ID NO: 27300 - protein, 9 aa, Mycobacterium tuberculosis
DRFRRRFDE

SEQ ID NO: 27301 - protein, 10 aa, Mycobacterium tuberculosis
MPLSDHEQRM

SEQ ID NO: 27302 - protein, 10 aa, Mycobacterium tuberculosis
PLSDHEQRML

SEQ ID NO: 27303 - protein, 10 aa, Mycobacterium tuberculosis
LSDHEQRMLD

SEQ ID NO: 27304 - protein, 10 aa, Mycobacterium tuberculosis
SDHEQRMLDQ

SEQ ID NO: 27305 - protein, 10 aa, Mycobacterium tuberculosis
DHEQRMLDQI

SEQ ID NO: 27306 - protein, 10 aa, Mycobacterium tuberculosis
HEQRMLDQIE

SEQ ID NO: 27307 - protein, 10 aa, Mycobacterium tuberculosis
EQRMLDQIES

SEQ ID NO: 27308 - protein, 10 aa, Mycobacterium tuberculosis
QRMLDQIESA

SEQ ID NO: 27309 - protein, 10 aa, Mycobacterium tuberculosis
RMLDQIESAL

SEQ ID NO: 27310 - protein, 10 aa, Mycobacterium tuberculosis
MLDQIESALY

SEQ ID NO: 27311 - protein, 10 aa, Mycobacterium tuberculosis
LDQIESALYA

SEQ ID NO: 27312 - protein, 10 aa, Mycobacterium tuberculosis
DQIESALYAE

SEQ ID NO: 27313 - protein, 10 aa, Mycobacterium tuberculosis
QIESALYAED

SEQ ID NO: 27314 - protein, 10 aa, Mycobacterium tuberculosis
IESALYAEDP

SEQ ID NO: 27315 - protein, 10 aa, Mycobacterium tuberculosis
ESALYAEDPK

SEQ ID NO: 27316 - protein, 10 aa, Mycobacterium tuberculosis
SALYAEDPKF

SEQ ID NO: 27317 - protein, 10 aa, Mycobacterium tuberculosis
ALYAEDPKFA

SEQ ID NO: 27318 - protein, 10 aa, Mycobacterium tuberculosis
LYAEDPKFAS

SEQ ID NO: 27319 - protein, 10 aa, Mycobacterium tuberculosis
YAEDPKFASS

SEQ ID NO: 27320 - protein, 10 aa, Mycobacterium tuberculosis
AEDPKFASSV

SEQ ID NO: 27321 - protein, 10 aa, Mycobacterium tuberculosis
EDPKFASSVR

SEQ ID NO: 27322 - protein, 10 aa, Mycobacterium tuberculosis
DPKFASSVRG

SEQ ID NO: 27323 - protein, 10 aa, Mycobacterium tuberculosis
PKFASSVRGG

SEQ ID NO: 27324 - protein, 10 aa, Mycobacterium tuberculosis
KFASSVRGGG

SEQ ID NO: 27325 - protein, 10 aa, Mycobacterium tuberculosis
FASSVRGGGF

SEQ ID NO: 27326 - protein, 10 aa, Mycobacterium tuberculosis
ASSVRGGGFR

SEQ ID NO: 27327 - protein, 10 aa, Mycobacterium tuberculosis
SSVRGGGFRA

SEQ ID NO: 27328 - protein, 10 aa, Mycobacterium tuberculosis
SVRGGGFRAP

SEQ ID NO: 27329 - protein, 10 aa, Mycobacterium tuberculosis
VRGGGFRAPT

SEQ ID NO: 27330 - protein, 10 aa, Mycobacterium tuberculosis
RGGGFRAPTA

SEQ ID NO: 27331 - protein, 10 aa, Mycobacterium tuberculosis
GGGFRAPTAR

SEQ ID NO: 27332 - protein, 10 aa, Mycobacterium tuberculosis
GGFRAPTARR

SEQ ID NO: 27333 - protein, 10 aa, Mycobacterium tuberculosis
GFRAPTARRR

SEQ ID NO: 27334 - protein, 10 aa, Mycobacterium tuberculosis
FRAPTARRRL

SEQ ID NO: 27335 - protein, 10 aa, Mycobacterium tuberculosis
RAPTARRRLQ

SEQ ID NO: 27336 - protein, 10 aa, Mycobacterium tuberculosis
APTARRRLQG

SEQ ID NO: 27337 - protein, 10 aa, Mycobacterium tuberculosis
PTARRRLQGA

SEQ ID NO: 27338 - protein, 10 aa, Mycobacterium tuberculosis
TARRRLQGAA

SEQ ID NO: 27339 - protein, 10 aa, Mycobacterium tuberculosis
ARRRLQGAAL

SEQ ID NO: 27340 - protein, 10 aa, Mycobacterium tuberculosis
RRRLQGAALF

SEQ ID NO: 27341 - protein, 10 aa, Mycobacterium tuberculosis
RRLQGAALFI

SEQ ID NO: 27342 - protein, 10 aa, Mycobacterium tuberculosis
RLQGAALFII

SEQ ID NO: 27343 - protein, 10 aa, Mycobacterium tuberculosis
LQGAALFIIG

SEQ ID NO: 27344 - protein, 10 aa, Mycobacterium tuberculosis
QGAALFIIGL

SEQ ID NO: 27345 - protein, 10 aa, Mycobacterium tuberculosis
GAALFIIGLG

SEQ ID NO: 27346 - protein, 10 aa, Mycobacterium tuberculosis
AALFIIGLGM

SEQ ID NO: 27347 - protein, 10 aa, Mycobacterium tuberculosis
ALFIIGLGML

SEQ ID NO: 27348 - protein, 10 aa, Mycobacterium tuberculosis
LFIIGLGMLV

SEQ ID NO: 27349 - protein, 10 aa, Mycobacterium tuberculosis
FIIGLGMLVS

SEQ ID NO: 27350 - protein, 10 aa, Mycobacterium tuberculosis
IIGLGMLVSG

SEQ ID NO: 27351 - protein, 10 aa, Mycobacterium tuberculosis
IGLGMLVSGV

SEQ ID NO: 27352 - protein, 10 aa, Mycobacterium tuberculosis
GLGMLVSGVA

SEQ ID NO: 27353 - protein, 10 aa, Mycobacterium tuberculosis
LGMLVSGVAF

SEQ ID NO: 27354 - protein, 10 aa, Mycobacterium tuberculosis
GMLVSGVAFK

SEQ ID NO: 27355 - protein, 10 aa, Mycobacterium tuberculosis
MLVSGVAFKE

SEQ ID NO: 27356 - protein, 10 aa, Mycobacterium tuberculosis
LVSGVAFKET

SEQ ID NO: 27357 - protein, 10 aa, Mycobacterium tuberculosis
VSGVAFKETM

SEQ ID NO: 27358 - protein, 10 aa, Mycobacterium tuberculosis
SGVAFKETMI

SEQ ID NO: 27359 - protein, 10 aa, Mycobacterium tuberculosis
GVAFKETMIG

SEQ ID NO: 27360 - protein, 10 aa, Mycobacterium tuberculosis
VAFKETMIGS

SEQ ID NO: 27361 - protein, 10 aa, Mycobacterium tuberculosis
AFKETMIGSF

SEQ ID NO: 27362 - protein, 10 aa, Mycobacterium tuberculosis
FKETMIGSFP

SEQ ID NO: 27363 - protein, 10 aa, Mycobacterium tuberculosis
KETMIGSFPI

SEQ ID NO: 27364 - protein, 10 aa, Mycobacterium tuberculosis
ETMIGSFPIL

SEQ ID NO: 27365 - protein, 10 aa, Mycobacterium tuberculosis
TMIGSFPILS

SEQ ID NO: 27366 - protein, 10 aa, Mycobacterium tuberculosis
MIGSFPILSV

SEQ ID NO: 27367 - protein, 10 aa, Mycobacterium tuberculosis
IGSFPILSVF

SEQ ID NO: 27368 - protein, 10 aa, Mycobacterium tuberculosis
GSFPILSVFG

SEQ ID NO: 27369 - protein, 10 aa, Mycobacterium tuberculosis
SFPILSVFGF

SEQ ID NO: 27370 - protein, 10 aa, Mycobacterium tuberculosis
FPILSVFGFV

SEQ ID NO: 27371 - protein, 10 aa, Mycobacterium tuberculosis
PILSVFGFVV

SEQ ID NO: 27372 - protein, 10 aa, Mycobacterium tuberculosis
ILSVFGFVVM

SEQ ID NO: 27373 - protein, 10 aa, Mycobacterium tuberculosis
LSVFGFVVMF

SEQ ID NO: 27374 - protein, 10 aa, Mycobacterium tuberculosis
SVFGFVVMFG

SEQ ID NO: 27375 - protein, 10 aa, Mycobacterium tuberculosis
VFGFVVMFGG

SEQ ID NO: 27376 - protein, 10 aa, Mycobacterium tuberculosis
FGFVVMFGGV

SEQ ID NO: 27377 - protein, 10 aa, Mycobacterium tuberculosis
GFVVMFGGVV

SEQ ID NO: 27378 - protein, 10 aa, Mycobacterium tuberculosis
FVVMFGGVVY

SEQ ID NO: 27379 - protein, 10 aa, Mycobacterium tuberculosis
VVMFGGVVYA

SEQ ID NO: 27380 - protein, 10 aa, Mycobacterium tuberculosis
VMFGGVVYAI

SEQ ID NO: 27381 - protein, 10 aa, Mycobacterium tuberculosis
MFGGVVYAIT

SEQ ID NO: 27382 - protein, 10 aa, Mycobacterium tuberculosis
FGGVVYAITG

SEQ ID NO: 27383 - protein, 10 aa, Mycobacterium tuberculosis
GGVVYAITGP

SEQ ID NO: 27384 - protein, 10 aa, Mycobacterium tuberculosis
GVVYAITGPR

SEQ ID NO: 27385 - protein, 10 aa, Mycobacterium tuberculosis
VVYAITGPRL

SEQ ID NO: 27386 - protein, 10 aa, Mycobacterium tuberculosis
VYAITGPRLS

SEQ ID NO: 27387 - protein, 10 aa, Mycobacterium tuberculosis
YAITGPRLSG

SEQ ID NO: 27388 - protein, 10 aa, Mycobacterium tuberculosis
AITGPRLSGR

SEQ ID NO: 27389 - protein, 10 aa, Mycobacterium tuberculosis
ITGPRLSGRM

SEQ ID NO: 27390 - protein, 10 aa, Mycobacterium tuberculosis
TGPRLSGRMD

SEQ ID NO: 27391 - protein, 10 aa, Mycobacterium tuberculosis
GPRLSGRMDR

SEQ ID NO: 27392 - protein, 10 aa, Mycobacterium tuberculosis
PRLSGRMDRG

SEQ ID NO: 27393 - protein, 10 aa, Mycobacterium tuberculosis
RLSGRMDRGG

SEQ ID NO: 27394 - protein, 10 aa, Mycobacterium tuberculosis
LSGRMDRGGS

SEQ ID NO: 27395 - protein, 10 aa, Mycobacterium tuberculosis
SGRMDRGGSA

SEQ ID NO: 27396 - protein, 10 aa, Mycobacterium tuberculosis
GRMDRGGSAA

SEQ ID NO: 27397 - protein, 10 aa, Mycobacterium tuberculosis
RMDRGGSAAG

SEQ ID NO: 27398 - protein, 10 aa, Mycobacterium tuberculosis
MDRGGSAAGA

SEQ ID NO: 27399 - protein, 10 aa, Mycobacterium tuberculosis
DRGGSAAGAS

SEQ ID NO: 27400 - protein, 10 aa, Mycobacterium tuberculosis
RGGSAAGASR

SEQ ID NO: 27401 - protein, 10 aa, Mycobacterium tuberculosis
GGSAAGASRQ

SEQ ID NO: 27402 - protein, 10 aa, Mycobacterium tuberculosis
GSAAGASRQR

SEQ ID NO: 27403 - protein, 10 aa, Mycobacterium tuberculosis
SAAGASRQRR

SEQ ID NO: 27404 - protein, 10 aa, Mycobacterium tuberculosis
AAGASRQRRT

SEQ ID NO: 27405 - protein, 10 aa, Mycobacterium tuberculosis
AGASRQRRTK

SEQ ID NO: 27406 - protein, 10 aa, Mycobacterium tuberculosis
GASRQRRTKG

SEQ ID NO: 27407 - protein, 10 aa, Mycobacterium tuberculosis
ASRQRRTKGA

SEQ ID NO: 27408 - protein, 10 aa, Mycobacterium tuberculosis
SRQRRTKGAG

SEQ ID NO: 27409 - protein, 10 aa, Mycobacterium tuberculosis
RQRRTKGAGG

SEQ ID NO: 27410 - protein, 10 aa, Mycobacterium tuberculosis
QRRTKGAGGS

SEQ ID NO: 27411 - protein, 10 aa, Mycobacterium tuberculosis
RRTKGAGGSF

SEQ ID NO: 27412 - protein, 10 aa, Mycobacterium tuberculosis
RTKGAGGSFT

SEQ ID NO: 27413 - protein, 10 aa, Mycobacterium tuberculosis
TKGAGGSFTS

SEQ ID NO: 27414 - protein, 10 aa, Mycobacterium tuberculosis
KGAGGSFTSR

SEQ ID NO: 27415 - protein, 10 aa, Mycobacterium tuberculosis
GAGGSFTSRM

SEQ ID NO: 27416 - protein, 10 aa, Mycobacterium tuberculosis
AGGSFTSRME

SEQ ID NO: 27417 - protein, 10 aa, Mycobacterium tuberculosis
GGSFTSRMED

SEQ ID NO: 27418 - protein, 10 aa, Mycobacterium tuberculosis
GSFTSRMEDR

SEQ ID NO: 27419 - protein, 10 aa, Mycobacterium tuberculosis
SFTSRMEDRF

SEQ ID NO: 27420 - protein, 10 aa, Mycobacterium tuberculosis
FTSRMEDRFR

SEQ ID NO: 27421 - protein, 10 aa, Mycobacterium tuberculosis
TSRMEDRFRR

SEQ ID NO: 27422 - protein, 10 aa, Mycobacterium tuberculosis
SRMEDRFRRR

SEQ ID NO: 27423 - protein, 10 aa, Mycobacterium tuberculosis
RMEDRFRRRF

SEQ ID NO: 27424 - protein, 10 aa, Mycobacterium tuberculosis
MEDRFRRRFD

SEQ ID NO: 27425 - protein, 10 aa, Mycobacterium tuberculosis
EDRFRRRFDE

SEQ ID NO: 27426 - protein, 11 aa, Mycobacterium tuberculosis
MPLSDHEQRML

SEQ ID NO: 27427 - protein, 11 aa, Mycobacterium tuberculosis
PLSDHEQRMLD

SEQ ID NO: 27428 - protein, 11 aa, Mycobacterium tuberculosis
LSDHEQRMLDQ

SEQ ID NO: 27429 - protein, 11 aa, Mycobacterium tuberculosis
SDHEQRMLDQI

SEQ ID NO: 27430 - protein, 11 aa, Mycobacterium tuberculosis
DHEQRMLDQIE

SEQ ID NO: 27431 - protein, 11 aa, Mycobacterium tuberculosis
HEQRMLDQIES

SEQ ID NO: 27432 - protein, 11 aa, Mycobacterium tuberculosis
EQRMLDQIESA

SEQ ID NO: 27433 - protein, 11 aa, Mycobacterium tuberculosis
QRMLDQIESAL

SEQ ID NO: 27434 - protein, 11 aa, Mycobacterium tuberculosis
RMLDQIESALY

SEQ ID NO: 27435 - protein, 11 aa, Mycobacterium tuberculosis
MLDQIESALYA

SEQ ID NO: 27436 - protein, 11 aa, Mycobacterium tuberculosis
LDQIESALYAE

SEQ ID NO: 27437 - protein, 11 aa, Mycobacterium tuberculosis
DQIESALYAED

SEQ ID NO: 27438 - protein, 11 aa, Mycobacterium tuberculosis
QIESALYAEDP

SEQ ID NO: 27439 - protein, 11 aa, Mycobacterium tuberculosis
IESALYAEDPK

SEQ ID NO: 27440 - protein, 11 aa, Mycobacterium tuberculosis
ESALYAEDPKF

SEQ ID NO: 27441 - protein, 11 aa, Mycobacterium tuberculosis
SALYAEDPKFA

SEQ ID NO: 27442 - protein, 11 aa, Mycobacterium tuberculosis
ALYAEDPKFAS

SEQ ID NO: 27443 - protein, 11 aa, Mycobacterium tuberculosis
LYAEDPKFASS

SEQ ID NO: 27444 - protein, 11 aa, Mycobacterium tuberculosis
YAEDPKFASSV

SEQ ID NO: 27445 - protein, 11 aa, Mycobacterium tuberculosis
AEDPKFASSVR

SEQ ID NO: 27446 - protein, 11 aa, Mycobacterium tuberculosis
EDPKFASSVRG

SEQ ID NO: 27447 - protein, 11 aa, Mycobacterium tuberculosis
DPKFASSVRGG

SEQ ID NO: 27448 - protein, 11 aa, Mycobacterium tuberculosis
PKFASSVRGGG

SEQ ID NO: 27449 - protein, 11 aa, Mycobacterium tuberculosis
KFASSVRGGGF

SEQ ID NO: 27450 - protein, 11 aa, Mycobacterium tuberculosis
FASSVRGGGFR

SEQ ID NO: 27451 - protein, 11 aa, Mycobacterium tuberculosis
ASSVRGGGFRA

SEQ ID NO: 27452 - protein, 11 aa, Mycobacterium tuberculosis
SSVRGGGFRAP

SEQ ID NO: 27453 - protein, 11 aa, Mycobacterium tuberculosis
SVRGGGFRAPT

SEQ ID NO: 27454 - protein, 11 aa, Mycobacterium tuberculosis
VRGGGFRAPTA

SEQ ID NO: 27455 - protein, 11 aa, Mycobacterium tuberculosis
RGGGFRAPTAR

SEQ ID NO: 27456 - protein, 11 aa, Mycobacterium tuberculosis
GGGFRAPTARR

SEQ ID NO: 27457 - protein, 11 aa, Mycobacterium tuberculosis
GGFRAPTARRR

SEQ ID NO: 27458 - protein, 11 aa, Mycobacterium tuberculosis
GFRAPTARRRL

SEQ ID NO: 27459 - protein, 11 aa, Mycobacterium tuberculosis
FRAPTARRRLQ

SEQ ID NO: 27460 - protein, 11 aa, Mycobacterium tuberculosis
RAPTARRRLQG

SEQ ID NO: 27461 - protein, 11 aa, Mycobacterium tuberculosis
APTARRRLQGA

SEQ ID NO: 27462 - protein, 11 aa, Mycobacterium tuberculosis
PTARRRLQGAA

SEQ ID NO: 27463 - protein, 11 aa, Mycobacterium tuberculosis
TARRRLQGAAL

SEQ ID NO: 27464 - protein, 11 aa, Mycobacterium tuberculosis
ARRRLQGAALF

SEQ ID NO: 27465 - protein, 11 aa, Mycobacterium tuberculosis
RRRLQGAALFI

SEQ ID NO: 27466 - protein, 11 aa, Mycobacterium tuberculosis
RRLQGAALFII

SEQ ID NO: 27467 - protein, 11 aa, Mycobacterium tuberculosis
RLQGAALFIIG

SEQ ID NO: 27468 - protein, 11 aa, Mycobacterium tuberculosis
LQGAALFIIGL

SEQ ID NO: 27469 - protein, 11 aa, Mycobacterium tuberculosis
QGAALFIIGLG

SEQ ID NO: 27470 - protein, 11 aa, Mycobacterium tuberculosis
GAALFIIGLGM

SEQ ID NO: 27471 - protein, 11 aa, Mycobacterium tuberculosis
AALFIIGLGML

SEQ ID NO: 27472 - protein, 11 aa, Mycobacterium tuberculosis
ALFIIGLGMLV

SEQ ID NO: 27473 - protein, 11 aa, Mycobacterium tuberculosis
LFIIGLGMLVS

SEQ ID NO: 27474 - protein, 11 aa, Mycobacterium tuberculosis
FIIGLGMLVSG

SEQ ID NO: 27475 - protein, 11 aa, Mycobacterium tuberculosis
IIGLGMLVSGV

SEQ ID NO: 27476 - protein, 11 aa, Mycobacterium tuberculosis
IGLGMLVSGVA

SEQ ID NO: 27477 - protein, 11 aa, Mycobacterium tuberculosis
GLGMLVSGVAF

SEQ ID NO: 27478 - protein, 11 aa, Mycobacterium tuberculosis
LGMLVSGVAFK

SEQ ID NO: 27479 - protein, 11 aa, Mycobacterium tuberculosis
GMLVSGVAFKE

SEQ ID NO: 27480 - protein, 11 aa, Mycobacterium tuberculosis
MLVSGVAFKET

SEQ ID NO: 27481 - protein, 11 aa, Mycobacterium tuberculosis
LVSGVAFKETM

SEQ ID NO: 27482 - protein, 11 aa, Mycobacterium tuberculosis
VSGVAFKETMI

SEQ ID NO: 27483 - protein, 11 aa, Mycobacterium tuberculosis
SGVAFKETMIG

SEQ ID NO: 27484 - protein, 11 aa, Mycobacterium tuberculosis
GVAFKETMIGS

SEQ ID NO: 27485 - protein, 11 aa, Mycobacterium tuberculosis
VAFKETMIGSF

SEQ ID NO: 27486 - protein, 11 aa, Mycobacterium tuberculosis
AFKETMIGSFP

SEQ ID NO: 27487 - protein, 11 aa, Mycobacterium tuberculosis
FKETMIGSFPI

SEQ ID NO: 27488 - protein, 11 aa, Mycobacterium tuberculosis
KETMIGSFPIL

SEQ ID NO: 27489 - protein, 11 aa, Mycobacterium tuberculosis
ETMIGSFPILS

SEQ ID NO: 27490 - protein, 11 aa, Mycobacterium tuberculosis
TMIGSFPILSV

SEQ ID NO: 27491 - protein, 11 aa, Mycobacterium tuberculosis
MIGSFPILSVF

SEQ ID NO: 27492 - protein, 11 aa, Mycobacterium tuberculosis
IGSFPILSVFG

SEQ ID NO: 27493 - protein, 11 aa, Mycobacterium tuberculosis
GSFPILSVFGF

SEQ ID NO: 27494 - protein, 11 aa, Mycobacterium tuberculosis
SFPILSVFGFV

SEQ ID NO: 27495 - protein, 11 aa, Mycobacterium tuberculosis
FPILSVFGFVV

SEQ ID NO: 27496 - protein, 11 aa, Mycobacterium tuberculosis
PILSVFGFVVM

SEQ ID NO: 27497 - protein, 11 aa, Mycobacterium tuberculosis
ILSVFGFVVMF

SEQ ID NO: 27498 - protein, 11 aa, Mycobacterium tuberculosis
LSVFGFVVMFG

SEQ ID NO: 27499 - protein, 11 aa, Mycobacterium tuberculosis
SVFGFVVMFGG

SEQ ID NO: 27500 - protein, 11 aa, Mycobacterium tuberculosis
VFGFVVMFGGV

SEQ ID NO: 27501 - protein, 11 aa, Mycobacterium tuberculosis
FGFVVMFGGVV

SEQ ID NO: 27502 - protein, 11 aa, Mycobacterium tuberculosis
GFVVMFGGVVY

SEQ ID NO: 27503 - protein, 11 aa, Mycobacterium tuberculosis
FVVMFGGVVYA

SEQ ID NO: 27504 - protein, 11 aa, Mycobacterium tuberculosis
VVMFGGVVYAI

SEQ ID NO: 27505 - protein, 11 aa, Mycobacterium tuberculosis
VMFGGVVYAIT

SEQ ID NO: 27506 - protein, 11 aa, Mycobacterium tuberculosis
MFGGVVYAITG

SEQ ID NO: 27507 - protein, 11 aa, Mycobacterium tuberculosis
FGGVVYAITGP

SEQ ID NO: 27508 - protein, 11 aa, Mycobacterium tuberculosis
GGVVYAITGPR

SEQ ID NO: 27509 - protein, 11 aa, Mycobacterium tuberculosis
GVVYAITGPRL

SEQ ID NO: 27510 - protein, 11 aa, Mycobacterium tuberculosis
VVYAITGPRLS

SEQ ID NO: 27511 - protein, 11 aa, Mycobacterium tuberculosis
VYAITGPRLSG

SEQ ID NO: 27512 - protein, 11 aa, Mycobacterium tuberculosis
YAITGPRLSGR

SEQ ID NO: 27513 - protein, 11 aa, Mycobacterium tuberculosis
AITGPRLSGRM

SEQ ID NO: 27514 - protein, 11 aa, Mycobacterium tuberculosis
ITGPRLSGRMD

SEQ ID NO: 27515 - protein, 11 aa, Mycobacterium tuberculosis
TGPRLSGRMDR

SEQ ID NO: 27516 - protein, 11 aa, Mycobacterium tuberculosis
GPRLSGRMDRG

SEQ ID NO: 27517 - protein, 11 aa, Mycobacterium tuberculosis
PRLSGRMDRGG

SEQ ID NO: 27518 - protein, 11 aa, Mycobacterium tuberculosis
RLSGRMDRGGS

SEQ ID NO: 27519 - protein, 11 aa, Mycobacterium tuberculosis
LSGRMDRGGSA

SEQ ID NO: 27520 - protein, 11 aa, Mycobacterium tuberculosis
SGRMDRGGSAA

SEQ ID NO: 27521 - protein, 11 aa, Mycobacterium tuberculosis
GRMDRGGSAAG

SEQ ID NO: 27522 - protein, 11 aa, Mycobacterium tuberculosis
RMDRGGSAAGA

SEQ ID NO: 27523 - protein, 11 aa, Mycobacterium tuberculosis
MDRGGSAAGAS

SEQ ID NO: 27524 - protein, 11 aa, Mycobacterium tuberculosis
DRGGSAAGASR

SEQ ID NO: 27525 - protein, 11 aa, Mycobacterium tuberculosis
RGGSAAGASRQ

SEQ ID NO: 27526 - protein, 11 aa, Mycobacterium tuberculosis
GGSAAGASRQR

SEQ ID NO: 27527 - protein, 11 aa, Mycobacterium tuberculosis
GSAAGASRQRR

SEQ ID NO: 27528 - protein, 11 aa, Mycobacterium tuberculosis
SAAGASRQRRT

SEQ ID NO: 27529 - protein, 11 aa, Mycobacterium tuberculosis
AAGASRQRRTK

SEQ ID NO: 27530 - protein, 11 aa, Mycobacterium tuberculosis
AGASRQRRTKG

SEQ ID NO: 27531 - protein, 11 aa, Mycobacterium tuberculosis
GASRQRRTKGA

SEQ ID NO: 27532 - protein, 11 aa, Mycobacterium tuberculosis
ASRQRRTKGAG

SEQ ID NO: 27533 - protein, 11 aa, Mycobacterium tuberculosis
SRQRRTKGAGG

SEQ ID NO: 27534 - protein, 11 aa, Mycobacterium tuberculosis
RQRRTKGAGGS

SEQ ID NO: 27535 - protein, 11 aa, Mycobacterium tuberculosis
QRRTKGAGGSF

SEQ ID NO: 27536 - protein, 11 aa, Mycobacterium tuberculosis
RRTKGAGGSFT

SEQ ID NO: 27537 - protein, 11 aa, Mycobacterium tuberculosis
RTKGAGGSFTS

SEQ ID NO: 27538 - protein, 11 aa, Mycobacterium tuberculosis
TKGAGGSFTSR

SEQ ID NO: 27539 - protein, 11 aa, Mycobacterium tuberculosis
KGAGGSFTSRM

SEQ ID NO: 27540 - protein, 11 aa, Mycobacterium tuberculosis
GAGGSFTSRME

SEQ ID NO: 27541 - protein, 11 aa, Mycobacterium tuberculosis
AGGSFTSRMED

SEQ ID NO: 27542 - protein, 11 aa, Mycobacterium tuberculosis
GGSFTSRMEDR

SEQ ID NO: 27543 - protein, 11 aa, Mycobacterium tuberculosis
GSFTSRMEDRF

SEQ ID NO: 27544 - protein, 11 aa, Mycobacterium tuberculosis
SFTSRMEDRFR

SEQ ID NO: 27545 - protein, 11 aa, Mycobacterium tuberculosis
FTSRMEDRFRR

SEQ ID NO: 27546 - protein, 11 aa, Mycobacterium tuberculosis
TSRMEDRFRRR

SEQ ID NO: 27547 - protein, 11 aa, Mycobacterium tuberculosis
SRMEDRFRRRF

SEQ ID NO: 27548 - protein, 11 aa, Mycobacterium tuberculosis
RMEDRFRRRFD

SEQ ID NO: 27549 - protein, 11 aa, Mycobacterium tuberculosis
MEDRFRRRFDE

SEQ ID NO: 27550 - protein, 8 aa, Mycobacterium tuberculosis
MRLPGRHV

SEQ ID NO: 27551 - protein, 8 aa, Mycobacterium tuberculosis
RLPGRHVL

SEQ ID NO: 27552 - protein, 8 aa, Mycobacterium tuberculosis
LPGRHVLY

SEQ ID NO: 27553 - protein, 8 aa, Mycobacterium tuberculosis
PGRHVLYA

SEQ ID NO: 27554 - protein, 8 aa, Mycobacterium tuberculosis
GRHVLYAL

SEQ ID NO: 27555 - protein, 8 aa, Mycobacterium tuberculosis
RHVLYALS

SEQ ID NO: 27556 - protein, 8 aa, Mycobacterium tuberculosis
HVLYALSA

SEQ ID NO: 27557 - protein, 8 aa, Mycobacterium tuberculosis
VLYALSAV

SEQ ID NO: 27558 - protein, 8 aa, Mycobacterium tuberculosis
LYALSAVT

SEQ ID NO: 27559 - protein, 8 aa, Mycobacterium tuberculosis
YALSAVTM

SEQ ID NO: 27560 - protein, 8 aa, Mycobacterium tuberculosis
ALSAVTML

SEQ ID NO: 27561 - protein, 8 aa, Mycobacterium tuberculosis
LSAVTMLA

SEQ ID NO: 27562 - protein, 8 aa, Mycobacterium tuberculosis
SAVTMLAA

SEQ ID NO: 27563 - protein, 8 aa, Mycobacterium tuberculosis
AVTMLAAC

SEQ ID NO: 27564 - protein, 8 aa, Mycobacterium tuberculosis
VTMLAACS

SEQ ID NO: 27565 - protein, 8 aa, Mycobacterium tuberculosis
TMLAACSS

SEQ ID NO: 27566 - protein, 8 aa, Mycobacterium tuberculosis
MLAACSSN

SEQ ID NO: 27567 - protein, 8 aa, Mycobacterium tuberculosis
LAACSSNG

SEQ ID NO: 27568 - protein, 8 aa, Mycobacterium tuberculosis
AACSSNGA

SEQ ID NO: 27569 - protein, 8 aa, Mycobacterium tuberculosis
ACSSNGAR

SEQ ID NO: 27570 - protein, 8 aa, Mycobacterium tuberculosis
CSSNGARG

SEQ ID NO: 27571 - protein, 8 aa, Mycobacterium tuberculosis
SSNGARGG

SEQ ID NO: 27572 - protein, 8 aa, Mycobacterium tuberculosis
SNGARGGI

SEQ ID NO: 27573 - protein, 8 aa, Mycobacterium tuberculosis
NGARGGIA

SEQ ID NO: 27574 - protein, 8 aa, Mycobacterium tuberculosis
GARGGIAS

SEQ ID NO: 27575 - protein, 8 aa, Mycobacterium tuberculosis
ARGGIAST

SEQ ID NO: 27576 - protein, 8 aa, Mycobacterium tuberculosis
RGGIASTN

SEQ ID NO: 27577 - protein, 8 aa, Mycobacterium tuberculosis
GGIASTNM

SEQ ID NO: 27578 - protein, 8 aa, Mycobacterium tuberculosis
GIASTNMN

SEQ ID NO: 27579 - protein, 8 aa, Mycobacterium tuberculosis
IASTNMNP

SEQ ID NO: 27580 - protein, 8 aa, Mycobacterium tuberculosis
ASTNMNPT

SEQ ID NO: 27581 - protein, 8 aa, Mycobacterium tuberculosis
STNMNPTN

SEQ ID NO: 27582 - protein, 8 aa, Mycobacterium tuberculosis
TNMNPTNP

SEQ ID NO: 27583 - protein, 8 aa, Mycobacterium tuberculosis
NMNPTNPP

SEQ ID NO: 27584 - protein, 8 aa, Mycobacterium tuberculosis
MNPTNPPA

SEQ ID NO: 27585 - protein, 8 aa, Mycobacterium tuberculosis
NPTNPPAT

SEQ ID NO: 27586 - protein, 8 aa, Mycobacterium tuberculosis
PTNPPATA

SEQ ID NO: 27587 - protein, 8 aa, Mycobacterium tuberculosis
TNPPATAE

SEQ ID NO: 27588 - protein, 8 aa, Mycobacterium tuberculosis
NPPATAET

SEQ ID NO: 27589 - protein, 8 aa, Mycobacterium tuberculosis
PPATAETA

SEQ ID NO: 27590 - protein, 8 aa, Mycobacterium tuberculosis
PATAETAT

SEQ ID NO: 27591 - protein, 8 aa, Mycobacterium tuberculosis
ATAETATV

SEQ ID NO: 27592 - protein, 8 aa, Mycobacterium tuberculosis
TAETATVS

SEQ ID NO: 27593 - protein, 8 aa, Mycobacterium tuberculosis
AETATVSP

SEQ ID NO: 27594 - protein, 8 aa, Mycobacterium tuberculosis
ETATVSPT

SEQ ID NO: 27595 - protein, 8 aa, Mycobacterium tuberculosis
TATVSPTP

SEQ ID NO: 27596 - protein, 8 aa, Mycobacterium tuberculosis
ATVSPTPA

SEQ ID NO: 27597 - protein, 8 aa, Mycobacterium tuberculosis
TVSPTPAP

SEQ ID NO: 27598 - protein, 8 aa, Mycobacterium tuberculosis
VSPTPAPQ

SEQ ID NO: 27599 - protein, 8 aa, Mycobacterium tuberculosis
SPTPAPQS

SEQ ID NO: 27600 - protein, 8 aa, Mycobacterium tuberculosis
PTPAPQSA

SEQ ID NO: 27601 - protein, 8 aa, Mycobacterium tuberculosis
TPAPQSAR

SEQ ID NO: 27602 - protein, 8 aa, Mycobacterium tuberculosis
PAPQSART

SEQ ID NO: 27603 - protein, 8 aa, Mycobacterium tuberculosis
APQSARTE

SEQ ID NO: 27604 - protein, 8 aa, Mycobacterium tuberculosis
PQSARTET

SEQ ID NO: 27605 - protein, 8 aa, Mycobacterium tuberculosis
QSARTETW

SEQ ID NO: 27606 - protein, 8 aa, Mycobacterium tuberculosis
SARTETWI

SEQ ID NO: 27607 - protein, 8 aa, Mycobacterium tuberculosis
ARTETWIN

SEQ ID NO: 27608 - protein, 8 aa, Mycobacterium tuberculosis
RTETWINL

SEQ ID NO: 27609 - protein, 8 aa, Mycobacterium tuberculosis
TETWINLQ

SEQ ID NO: 27610 - protein, 8 aa, Mycobacterium tuberculosis
ETWINLQV

SEQ ID NO: 27611 - protein, 8 aa, Mycobacterium tuberculosis
TWINLQVG

SEQ ID NO: 27612 - protein, 8 aa, Mycobacterium tuberculosis
WINLQVGD

SEQ ID NO: 27613 - protein, 8 aa, Mycobacterium tuberculosis
INLQVGDC

SEQ ID NO: 27614 - protein, 8 aa, Mycobacterium tuberculosis
NLQVGDCL

SEQ ID NO: 27615 - protein, 8 aa, Mycobacterium tuberculosis
LQVGDCLA

SEQ ID NO: 27616 - protein, 8 aa, Mycobacterium tuberculosis
QVGDCLAD

SEQ ID NO: 27617 - protein, 8 aa, Mycobacterium tuberculosis
VGDCLADL

SEQ ID NO: 27618 - protein, 8 aa, Mycobacterium tuberculosis
GDCLADLP

SEQ ID NO: 27619 - protein, 8 aa, Mycobacterium tuberculosis
DCLADLPP

SEQ ID NO: 27620 - protein, 8 aa, Mycobacterium tuberculosis
CLADLPPA

SEQ ID NO: 27621 - protein, 8 aa, Mycobacterium tuberculosis
LADLPPAD

SEQ ID NO: 27622 - protein, 8 aa, Mycobacterium tuberculosis
ADLPPADL

SEQ ID NO: 27623 - protein, 8 aa, Mycobacterium tuberculosis
DLPPADLS

SEQ ID NO: 27624 - protein, 8 aa, Mycobacterium tuberculosis
LPPADLSR

SEQ ID NO: 27625 - protein, 8 aa, Mycobacterium tuberculosis
PPADLSRI

SEQ ID NO: 27626 - protein, 8 aa, Mycobacterium tuberculosis
PADLSRIT

SEQ ID NO: 27627 - protein, 8 aa, Mycobacterium tuberculosis
ADLSRITV

SEQ ID NO: 27628 - protein, 8 aa, Mycobacterium tuberculosis
DLSRITVT

SEQ ID NO: 27629 - protein, 8 aa, Mycobacterium tuberculosis
LSRITVTI

SEQ ID NO: 27630 - protein, 8 aa, Mycobacterium tuberculosis
SRITVTIV

SEQ ID NO: 27631 - protein, 8 aa, Mycobacterium tuberculosis
RITVTIVD

SEQ ID NO: 27632 - protein, 8 aa, Mycobacterium tuberculosis
ITVTIVDC

SEQ ID NO: 27633 - protein, 8 aa, Mycobacterium tuberculosis
TVTIVDCA

SEQ ID NO: 27634 - protein, 8 aa, Mycobacterium tuberculosis
VTIVDCAT

SEQ ID NO: 27635 - protein, 8 aa, Mycobacterium tuberculosis
TIVDCATA

SEQ ID NO: 27636 - protein, 8 aa, Mycobacterium tuberculosis
IVDCATAH

SEQ ID NO: 27637 - protein, 8 aa, Mycobacterium tuberculosis
VDCATAHS

SEQ ID NO: 27638 - protein, 8 aa, Mycobacterium tuberculosis
DCATAHSA

SEQ ID NO: 27639 - protein, 8 aa, Mycobacterium tuberculosis
CATAHSAE

SEQ ID NO: 27640 - protein, 8 aa, Mycobacterium tuberculosis
ATAHSAEV

SEQ ID NO: 27641 - protein, 8 aa, Mycobacterium tuberculosis
TAHSAEVY

SEQ ID NO: 27642 - protein, 8 aa, Mycobacterium tuberculosis
AHSAEVYL

SEQ ID NO: 27643 - protein, 8 aa, Mycobacterium tuberculosis
HSAEVYLR

SEQ ID NO: 27644 - protein, 8 aa, Mycobacterium tuberculosis
SAEVYLRA

SEQ ID NO: 27645 - protein, 8 aa, Mycobacterium tuberculosis
AEVYLRAP

SEQ ID NO: 27646 - protein, 8 aa, Mycobacterium tuberculosis
EVYLRAPV

SEQ ID NO: 27647 - protein, 8 aa, Mycobacterium tuberculosis
VYLRAPVA

SEQ ID NO: 27648 - protein, 8 aa, Mycobacterium tuberculosis
YLRAPVAV

SEQ ID NO: 27649 - protein, 8 aa, Mycobacterium tuberculosis
LRAPVAVD

SEQ ID NO: 27650 - protein, 8 aa, Mycobacterium tuberculosis
RAPVAVDA

SEQ ID NO: 27651 - protein, 8 aa, Mycobacterium tuberculosis
APVAVDAA

SEQ ID NO: 27652 - protein, 8 aa, Mycobacterium tuberculosis
PVAVDAAV

SEQ ID NO: 27653 - protein, 8 aa, Mycobacterium tuberculosis
VAVDAAVV

SEQ ID NO: 27654 - protein, 8 aa, Mycobacterium tuberculosis
AVDAAVVS

SEQ ID NO: 27655 - protein, 8 aa, Mycobacterium tuberculosis
VDAAVVSM

SEQ ID NO: 27656 - protein, 8 aa, Mycobacterium tuberculosis
DAAVVSMA

SEQ ID NO: 27657 - protein, 8 aa, Mycobacterium tuberculosis
AAVVSMAN

SEQ ID NO: 27658 - protein, 8 aa, Mycobacterium tuberculosis
AVVSMANR

SEQ ID NO: 27659 - protein, 8 aa, Mycobacterium tuberculosis
VVSMANRD

SEQ ID NO: 27660 - protein, 8 aa, Mycobacterium tuberculosis
VSMANRDC

SEQ ID NO: 27661 - protein, 8 aa, Mycobacterium tuberculosis
SMANRDCA

SEQ ID NO: 27662 - protein, 8 aa, Mycobacterium tuberculosis
MANRDCAA

SEQ ID NO: 27663 - protein, 8 aa, Mycobacterium tuberculosis
ANRDCAAG

SEQ ID NO: 27664 - protein, 8 aa, Mycobacterium tuberculosis
NRDCAAGF

SEQ ID NO: 27665 - protein, 8 aa, Mycobacterium tuberculosis
RDCAAGFA

SEQ ID NO: 27666 - protein, 8 aa, Mycobacterium tuberculosis
DCAAGFAP

SEQ ID NO: 27667 - protein, 8 aa, Mycobacterium tuberculosis
CAAGFAPY

SEQ ID NO: 27668 - protein, 8 aa, Mycobacterium tuberculosis
AAGFAPYT

SEQ ID NO: 27669 - protein, 8 aa, Mycobacterium tuberculosis
AGFAPYTG

SEQ ID NO: 27670 - protein, 8 aa, Mycobacterium tuberculosis
GFAPYTGQ

SEQ ID NO: 27671 - protein, 8 aa, Mycobacterium tuberculosis
FAPYTGQS

SEQ ID NO: 27672 - protein, 8 aa, Mycobacterium tuberculosis
APYTGQSV

SEQ ID NO: 27673 - protein, 8 aa, Mycobacterium tuberculosis
PYTGQSVD

SEQ ID NO: 27674 - protein, 8 aa, Mycobacterium tuberculosis
YTGQSVDT

SEQ ID NO: 27675 - protein, 8 aa, Mycobacterium tuberculosis
TGQSVDTS

SEQ ID NO: 27676 - protein, 8 aa, Mycobacterium tuberculosis
GQSVDTSP

SEQ ID NO: 27677 - protein, 8 aa, Mycobacterium tuberculosis
QSVDTSPY

SEQ ID NO: 27678 - protein, 8 aa, Mycobacterium tuberculosis
SVDTSPYS

SEQ ID NO: 27679 - protein, 8 aa, Mycobacterium tuberculosis
VDTSPYSV

SEQ ID NO: 27680 - protein, 8 aa, Mycobacterium tuberculosis
DTSPYSVA

SEQ ID NO: 27681 - protein, 8 aa, Mycobacterium tuberculosis
TSPYSVAY

SEQ ID NO: 27682 - protein, 8 aa, Mycobacterium tuberculosis
SPYSVAYL

SEQ ID NO: 27683 - protein, 8 aa, Mycobacterium tuberculosis
PYSVAYLI

SEQ ID NO: 27684 - protein, 8 aa, Mycobacterium tuberculosis
YSVAYLID

SEQ ID NO: 27685 - protein, 8 aa, Mycobacterium tuberculosis
SVAYLIDS

SEQ ID NO: 27686 - protein, 8 aa, Mycobacterium tuberculosis
VAYLIDSH

SEQ ID NO: 27687 - protein, 8 aa, Mycobacterium tuberculosis
AYLIDSHQ

SEQ ID NO: 27688 - protein, 8 aa, Mycobacterium tuberculosis
YLIDSHQD

SEQ ID NO: 27689 - protein, 8 aa, Mycobacterium tuberculosis
LIDSHQDR

SEQ ID NO: 27690 - protein, 8 aa, Mycobacterium tuberculosis
IDSHQDRT

SEQ ID NO: 27691 - protein, 8 aa, Mycobacterium tuberculosis
DSHQDRTG

SEQ ID NO: 27692 - protein, 8 aa, Mycobacterium tuberculosis
SHQDRTGA

SEQ ID NO: 27693 - protein, 8 aa, Mycobacterium tuberculosis
HQDRTGAD

SEQ ID NO: 27694 - protein, 8 aa, Mycobacterium tuberculosis
QDRTGADP

SEQ ID NO: 27695 - protein, 8 aa, Mycobacterium tuberculosis
DRTGADPT

SEQ ID NO: 27696 - protein, 8 aa, Mycobacterium tuberculosis
RTGADPTP

SEQ ID NO: 27697 - protein, 8 aa, Mycobacterium tuberculosis
TGADPTPS

SEQ ID NO: 27698 - protein, 8 aa, Mycobacterium tuberculosis
GADPTPST

SEQ ID NO: 27699 - protein, 8 aa, Mycobacterium tuberculosis
ADPTPSTV

SEQ ID NO: 27700 - protein, 8 aa, Mycobacterium tuberculosis
DPTPSTVI

SEQ ID NO: 27701 - protein, 8 aa, Mycobacterium tuberculosis
PTPSTVIC

SEQ ID NO: 27702 - protein, 8 aa, Mycobacterium tuberculosis
TPSTVICL

SEQ ID NO: 27703 - protein, 8 aa, Mycobacterium tuberculosis
PSTVICLL

SEQ ID NO: 27704 - protein, 8 aa, Mycobacterium tuberculosis
STVICLLQ

SEQ ID NO: 27705 - protein, 8 aa, Mycobacterium tuberculosis
TVICLLQP

SEQ ID NO: 27706 - protein, 8 aa, Mycobacterium tuberculosis
VICLLQPA

SEQ ID NO: 27707 - protein, 8 aa, Mycobacterium tuberculosis
ICLLQPAN

SEQ ID NO: 27708 - protein, 8 aa, Mycobacterium tuberculosis
CLLQPANG

SEQ ID NO: 27709 - protein, 8 aa, Mycobacterium tuberculosis
LLQPANGQ

SEQ ID NO: 27710 - protein, 8 aa, Mycobacterium tuberculosis
LQPANGQL

SEQ ID NO: 27711 - protein, 8 aa, Mycobacterium tuberculosis
QPANGQLL

SEQ ID NO: 27712 - protein, 8 aa, Mycobacterium tuberculosis
PANGQLLT

SEQ ID NO: 27713 - protein, 8 aa, Mycobacterium tuberculosis
ANGQLLTG

SEQ ID NO: 27714 - protein, 8 aa, Mycobacterium tuberculosis
NGQLLTGS

SEQ ID NO: 27715 - protein, 8 aa, Mycobacterium tuberculosis
GQLLTGSA

SEQ ID NO: 27716 - protein, 8 aa, Mycobacterium tuberculosis
QLLTGSAR

SEQ ID NO: 27717 - protein, 8 aa, Mycobacterium tuberculosis
LLTGSARR

SEQ ID NO: 27718 - protein, 9 aa, Mycobacterium tuberculosis
MRLPGRHVL

SEQ ID NO: 27719 - protein, 9 aa, Mycobacterium tuberculosis
RLPGRHVLY

SEQ ID NO: 27720 - protein, 9 aa, Mycobacterium tuberculosis
LPGRHVLYA

SEQ ID NO: 27721 - protein, 9 aa, Mycobacterium tuberculosis
PGRHVLYAL

SEQ ID NO: 27722 - protein, 9 aa, Mycobacterium tuberculosis
GRHVLYALS

SEQ ID NO: 27723 - protein, 9 aa, Mycobacterium tuberculosis
RHVLYALSA

SEQ ID NO: 27724 - protein, 9 aa, Mycobacterium tuberculosis
HVLYALSAV

SEQ ID NO: 27725 - protein, 9 aa, Mycobacterium tuberculosis
VLYALSAVT

SEQ ID NO: 27726 - protein, 9 aa, Mycobacterium tuberculosis
LYALSAVTM

SEQ ID NO: 27727 - protein, 9 aa, Mycobacterium tuberculosis
YALSAVTML

SEQ ID NO: 27728 - protein, 9 aa, Mycobacterium tuberculosis
ALSAVTMLA

SEQ ID NO: 27729 - protein, 9 aa, Mycobacterium tuberculosis
LSAVTMLAA

SEQ ID NO: 27730 - protein, 9 aa, Mycobacterium tuberculosis
SAVTMLAAC

SEQ ID NO: 27731 - protein, 9 aa, Mycobacterium tuberculosis
AVTMLAACS

SEQ ID NO: 27732 - protein, 9 aa, Mycobacterium tuberculosis
VTMLAACSS

SEQ ID NO: 27733 - protein, 9 aa, Mycobacterium tuberculosis
TMLAACSSN

SEQ ID NO: 27734 - protein, 9 aa, Mycobacterium tuberculosis
MLAACSSNG

SEQ ID NO: 27735 - protein, 9 aa, Mycobacterium tuberculosis
LAACSSNGA

SEQ ID NO: 27736 - protein, 9 aa, Mycobacterium tuberculosis
AACSSNGAR

SEQ ID NO: 27737 - protein, 9 aa, Mycobacterium tuberculosis
ACSSNGARG

SEQ ID NO: 27738 - protein, 9 aa, Mycobacterium tuberculosis
CSSNGARGG

SEQ ID NO: 27739 - protein, 9 aa, Mycobacterium tuberculosis
SSNGARGGI

SEQ ID NO: 27740 - protein, 9 aa, Mycobacterium tuberculosis
SNGARGGIA

SEQ ID NO: 27741 - protein, 9 aa, Mycobacterium tuberculosis
NGARGGIAS

SEQ ID NO: 27742 - protein, 9 aa, Mycobacterium tuberculosis
GARGGIAST

SEQ ID NO: 27743 - protein, 9 aa, Mycobacterium tuberculosis
ARGGIASTN

SEQ ID NO: 27744 - protein, 9 aa, Mycobacterium tuberculosis
RGGIASTNM

SEQ ID NO: 27745 - protein, 9 aa, Mycobacterium tuberculosis
GGIASTNMN

SEQ ID NO: 27746 - protein, 9 aa, Mycobacterium tuberculosis
GIASTNMNP

SEQ ID NO: 27747 - protein, 9 aa, Mycobacterium tuberculosis
IASTNMNPT

SEQ ID NO: 27748 - protein, 9 aa, Mycobacterium tuberculosis
ASTNMNPTN

SEQ ID NO: 27749 - protein, 9 aa, Mycobacterium tuberculosis
STNMNPTNP

SEQ ID NO: 27750 - protein, 9 aa, Mycobacterium tuberculosis
TNMNPTNPP

SEQ ID NO: 27751 - protein, 9 aa, Mycobacterium tuberculosis
NMNPTNPPA

SEQ ID NO: 27752 - protein, 9 aa, Mycobacterium tuberculosis
MNPTNPPAT

SEQ ID NO: 27753 - protein, 9 aa, Mycobacterium tuberculosis
NPTNPPATA

SEQ ID NO: 27754 - protein, 9 aa, Mycobacterium tuberculosis
PTNPPATAE

SEQ ID NO: 27755 - protein, 9 aa, Mycobacterium tuberculosis
TNPPATAET

SEQ ID NO: 27756 - protein, 9 aa, Mycobacterium tuberculosis
NPPATAETA

SEQ ID NO: 27757 - protein, 9 aa, Mycobacterium tuberculosis
PPATAETAT

SEQ ID NO: 27758 - protein, 9 aa, Mycobacterium tuberculosis
PATAETATV

SEQ ID NO: 27759 - protein, 9 aa, Mycobacterium tuberculosis
ATAETATVS

SEQ ID NO: 27760 - protein, 9 aa, Mycobacterium tuberculosis
TAETATVSP

SEQ ID NO: 27761 - protein, 9 aa, Mycobacterium tuberculosis
AETATVSPT

SEQ ID NO: 27762 - protein, 9 aa, Mycobacterium tuberculosis
ETATVSPTP

SEQ ID NO: 27763 - protein, 9 aa, Mycobacterium tuberculosis
TATVSPTPA

SEQ ID NO: 27764 - protein, 9 aa, Mycobacterium tuberculosis
ATVSPTPAP

SEQ ID NO: 27765 - protein, 9 aa, Mycobacterium tuberculosis
TVSPTPAPQ

SEQ ID NO: 27766 - protein, 9 aa, Mycobacterium tuberculosis
VSPTPAPQS

SEQ ID NO: 27767 - protein, 9 aa, Mycobacterium tuberculosis
SPTPAPQSA

SEQ ID NO: 27768 - protein, 9 aa, Mycobacterium tuberculosis
PTPAPQSAR

SEQ ID NO: 27769 - protein, 9 aa, Mycobacterium tuberculosis
TPAPQSART

SEQ ID NO: 27770 - protein, 9 aa, Mycobacterium tuberculosis
PAPQSARTE

SEQ ID NO: 27771 - protein, 9 aa, Mycobacterium tuberculosis
APQSARTET

SEQ ID NO: 27772 - protein, 9 aa, Mycobacterium tuberculosis
PQSARTETW

SEQ ID NO: 27773 - protein, 9 aa, Mycobacterium tuberculosis
QSARTETWI

SEQ ID NO: 27774 - protein, 9 aa, Mycobacterium tuberculosis
SARTETWIN

SEQ ID NO: 27775 - protein, 9 aa, Mycobacterium tuberculosis
ARTETWINL

SEQ ID NO: 27776 - protein, 9 aa, Mycobacterium tuberculosis
RTETWINLQ

SEQ ID NO: 27777 - protein, 9 aa, Mycobacterium tuberculosis
TETWINLQV

SEQ ID NO: 27778 - protein, 9 aa, Mycobacterium tuberculosis
ETWINLQVG

SEQ ID NO: 27779 - protein, 9 aa, Mycobacterium tuberculosis
TWINLQVGD

SEQ ID NO: 27780 - protein, 9 aa, Mycobacterium tuberculosis
WINLQVGDC

SEQ ID NO: 27781 - protein, 9 aa, Mycobacterium tuberculosis
INLQVGDCL

SEQ ID NO: 27782 - protein, 9 aa, Mycobacterium tuberculosis
NLQVGDCLA

SEQ ID NO: 27783 - protein, 9 aa, Mycobacterium tuberculosis
LQVGDCLAD

SEQ ID NO: 27784 - protein, 9 aa, Mycobacterium tuberculosis
QVGDCLADL

SEQ ID NO: 27785 - protein, 9 aa, Mycobacterium tuberculosis
VGDCLADLP

SEQ ID NO: 27786 - protein, 9 aa, Mycobacterium tuberculosis
GDCLADLPP

SEQ ID NO: 27787 - protein, 9 aa, Mycobacterium tuberculosis
DCLADLPPA

SEQ ID NO: 27788 - protein, 9 aa, Mycobacterium tuberculosis
CLADLPPAD

SEQ ID NO: 27789 - protein, 9 aa, Mycobacterium tuberculosis
LADLPPADL

SEQ ID NO: 27790 - protein, 9 aa, Mycobacterium tuberculosis
ADLPPADLS

SEQ ID NO: 27791 - protein, 9 aa, Mycobacterium tuberculosis
DLPPADLSR

SEQ ID NO: 27792 - protein, 9 aa, Mycobacterium tuberculosis
LPPADLSRI

SEQ ID NO: 27793 - protein, 9 aa, Mycobacterium tuberculosis
PPADLSRIT

SEQ ID NO: 27794 - protein, 9 aa, Mycobacterium tuberculosis
PADLSRITV

SEQ ID NO: 27795 - protein, 9 aa, Mycobacterium tuberculosis
ADLSRITVT

SEQ ID NO: 27796 - protein, 9 aa, Mycobacterium tuberculosis
DLSRITVTI

SEQ ID NO: 27797 - protein, 9 aa, Mycobacterium tuberculosis
LSRITVTIV

SEQ ID NO: 27798 - protein, 9 aa, Mycobacterium tuberculosis
SRITVTIVD

SEQ ID NO: 27799 - protein, 9 aa, Mycobacterium tuberculosis
RITVTIVDC

SEQ ID NO: 27800 - protein, 9 aa, Mycobacterium tuberculosis
ITVTIVDCA

SEQ ID NO: 27801 - protein, 9 aa, Mycobacterium tuberculosis
TVTIVDCAT

SEQ ID NO: 27802 - protein, 9 aa, Mycobacterium tuberculosis
VTIVDCATA

SEQ ID NO: 27803 - protein, 9 aa, Mycobacterium tuberculosis
TIVDCATAH

SEQ ID NO: 27804 - protein, 9 aa, Mycobacterium tuberculosis
IVDCATAHS

SEQ ID NO: 27805 - protein, 9 aa, Mycobacterium tuberculosis
VDCATAHSA

SEQ ID NO: 27806 - protein, 9 aa, Mycobacterium tuberculosis
DCATAHSAE

SEQ ID NO: 27807 - protein, 9 aa, Mycobacterium tuberculosis
CATAHSAEV

SEQ ID NO: 27808 - protein, 9 aa, Mycobacterium tuberculosis
ATAHSAEVY

SEQ ID NO: 27809 - protein, 9 aa, Mycobacterium tuberculosis
TAHSAEVYL

SEQ ID NO: 27810 - protein, 9 aa, Mycobacterium tuberculosis
AHSAEVYLR

SEQ ID NO: 27811 - protein, 9 aa, Mycobacterium tuberculosis
HSAEVYLRA

SEQ ID NO: 27812 - protein, 9 aa, Mycobacterium tuberculosis
SAEVYLRAP

SEQ ID NO: 27813 - protein, 9 aa, Mycobacterium tuberculosis
AEVYLRAPV

SEQ ID NO: 27814 - protein, 9 aa, Mycobacterium tuberculosis
EVYLRAPVA

SEQ ID NO: 27815 - protein, 9 aa, Mycobacterium tuberculosis
VYLRAPVAV

SEQ ID NO: 27816 - protein, 9 aa, Mycobacterium tuberculosis
YLRAPVAVD

SEQ ID NO: 27817 - protein, 9 aa, Mycobacterium tuberculosis
LRAPVAVDA

SEQ ID NO: 27818 - protein, 9 aa, Mycobacterium tuberculosis
RAPVAVDAA

SEQ ID NO: 27819 - protein, 9 aa, Mycobacterium tuberculosis
APVAVDAAV

SEQ ID NO: 27820 - protein, 9 aa, Mycobacterium tuberculosis
PVAVDAAVV

SEQ ID NO: 27821 - protein, 9 aa, Mycobacterium tuberculosis
VAVDAAVVS

SEQ ID NO: 27822 - protein, 9 aa, Mycobacterium tuberculosis
AVDAAVVSM

SEQ ID NO: 27823 - protein, 9 aa, Mycobacterium tuberculosis
VDAAVVSMA

SEQ ID NO: 27824 - protein, 9 aa, Mycobacterium tuberculosis
DAAVVSMAN

SEQ ID NO: 27825 - protein, 9 aa, Mycobacterium tuberculosis
AAVVSMANR

SEQ ID NO: 27826 - protein, 9 aa, Mycobacterium tuberculosis
AVVSMANRD

SEQ ID NO: 27827 - protein, 9 aa, Mycobacterium tuberculosis
VVSMANRDC

SEQ ID NO: 27828 - protein, 9 aa, Mycobacterium tuberculosis
VSMANRDCA

SEQ ID NO: 27829 - protein, 9 aa, Mycobacterium tuberculosis
SMANRDCAA

SEQ ID NO: 27830 - protein, 9 aa, Mycobacterium tuberculosis
MANRDCAAG

SEQ ID NO: 27831 - protein, 9 aa, Mycobacterium tuberculosis
ANRDCAAGF

SEQ ID NO: 27832 - protein, 9 aa, Mycobacterium tuberculosis
NRDCAAGFA

SEQ ID NO: 27833 - protein, 9 aa, Mycobacterium tuberculosis
RDCAAGFAP

SEQ ID NO: 27834 - protein, 9 aa, Mycobacterium tuberculosis
DCAAGFAPY

SEQ ID NO: 27835 - protein, 9 aa, Mycobacterium tuberculosis
CAAGFAPYT

SEQ ID NO: 27836 - protein, 9 aa, Mycobacterium tuberculosis
AAGFAPYTG

SEQ ID NO: 27837 - protein, 9 aa, Mycobacterium tuberculosis
AGFAPYTGQ

SEQ ID NO: 27838 - protein, 9 aa, Mycobacterium tuberculosis
GFAPYTGQS

SEQ ID NO: 27839 - protein, 9 aa, Mycobacterium tuberculosis
FAPYTGQSV

SEQ ID NO: 27840 - protein, 9 aa, Mycobacterium tuberculosis
APYTGQSVD

SEQ ID NO: 27841 - protein, 9 aa, Mycobacterium tuberculosis
PYTGQSVDT

SEQ ID NO: 27842 - protein, 9 aa, Mycobacterium tuberculosis
YTGQSVDTS

SEQ ID NO: 27843 - protein, 9 aa, Mycobacterium tuberculosis
TGQSVDTSP

SEQ ID NO: 27844 - protein, 9 aa, Mycobacterium tuberculosis
GQSVDTSPY

SEQ ID NO: 27845 - protein, 9 aa, Mycobacterium tuberculosis
QSVDTSPYS

SEQ ID NO: 27846 - protein, 9 aa, Mycobacterium tuberculosis
SVDTSPYSV

SEQ ID NO: 27847 - protein, 9 aa, Mycobacterium tuberculosis
VDTSPYSVA

SEQ ID NO: 27848 - protein, 9 aa, Mycobacterium tuberculosis
DTSPYSVAY

SEQ ID NO: 27849 - protein, 9 aa, Mycobacterium tuberculosis
TSPYSVAYL

SEQ ID NO: 27850 - protein, 9 aa, Mycobacterium tuberculosis
SPYSVAYLI

SEQ ID NO: 27851 - protein, 9 aa, Mycobacterium tuberculosis
PYSVAYLID

SEQ ID NO: 27852 - protein, 9 aa, Mycobacterium tuberculosis
YSVAYLIDS

SEQ ID NO: 27853 - protein, 9 aa, Mycobacterium tuberculosis
SVAYLIDSH

SEQ ID NO: 27854 - protein, 9 aa, Mycobacterium tuberculosis
VAYLIDSHQ

SEQ ID NO: 27855 - protein, 9 aa, Mycobacterium tuberculosis
AYLIDSHQD

SEQ ID NO: 27856 - protein, 9 aa, Mycobacterium tuberculosis
YLIDSHQDR

SEQ ID NO: 27857 - protein, 9 aa, Mycobacterium tuberculosis
LIDSHQDRT

SEQ ID NO: 27858 - protein, 9 aa, Mycobacterium tuberculosis
IDSHQDRTG

SEQ ID NO: 27859 - protein, 9 aa, Mycobacterium tuberculosis
DSHQDRTGA

SEQ ID NO: 27860 - protein, 9 aa, Mycobacterium tuberculosis
SHQDRTGAD

SEQ ID NO: 27861 - protein, 9 aa, Mycobacterium tuberculosis
HQDRTGADP

SEQ ID NO: 27862 - protein, 9 aa, Mycobacterium tuberculosis
QDRTGADPT

SEQ ID NO: 27863 - protein, 9 aa, Mycobacterium tuberculosis
DRTGADPTP

SEQ ID NO: 27864 - protein, 9 aa, Mycobacterium tuberculosis
RTGADPTPS

SEQ ID NO: 27865 - protein, 9 aa, Mycobacterium tuberculosis
TGADPTPST

SEQ ID NO: 27866 - protein, 9 aa, Mycobacterium tuberculosis
GADPTPSTV

SEQ ID NO: 27867 - protein, 9 aa, Mycobacterium tuberculosis
ADPTPSTVI

SEQ ID NO: 27868 - protein, 9 aa, Mycobacterium tuberculosis
DPTPSTVIC

SEQ ID NO: 27869 - protein, 9 aa, Mycobacterium tuberculosis
PTPSTVICL

SEQ ID NO: 27870 - protein, 9 aa, Mycobacterium tuberculosis
TPSTVICLL

SEQ ID NO: 27871 - protein, 9 aa, Mycobacterium tuberculosis
PSTVICLLQ

SEQ ID NO: 27872 - protein, 9 aa, Mycobacterium tuberculosis
STVICLLQP

SEQ ID NO: 27873 - protein, 9 aa, Mycobacterium tuberculosis
TVICLLQPA

SEQ ID NO: 27874 - protein, 9 aa, Mycobacterium tuberculosis
VICLLQPAN

SEQ ID NO: 27875 - protein, 9 aa, Mycobacterium tuberculosis
ICLLQPANG

SEQ ID NO: 27876 - protein, 9 aa, Mycobacterium tuberculosis
CLLQPANGQ

SEQ ID NO: 27877 - protein, 9 aa, Mycobacterium tuberculosis
LLQPANGQL

SEQ ID NO: 27878 - protein, 9 aa, Mycobacterium tuberculosis
LQPANGQLL

SEQ ID NO: 27879 - protein, 9 aa, Mycobacterium tuberculosis
QPANGQLLT

SEQ ID NO: 27880 - protein, 9 aa, Mycobacterium tuberculosis
PANGQLLTG

SEQ ID NO: 27881 - protein, 9 aa, Mycobacterium tuberculosis
ANGQLLTGS

SEQ ID NO: 27882 - protein, 9 aa, Mycobacterium tuberculosis
NGQLLTGSA

SEQ ID NO: 27883 - protein, 9 aa, Mycobacterium tuberculosis
GQLLTGSAR

SEQ ID NO: 27884 - protein, 9 aa, Mycobacterium tuberculosis
QLLTGSARR

SEQ ID NO: 27885 - protein, 10 aa, Mycobacterium tuberculosis
MRLPGRHVLY

SEQ ID NO: 27886 - protein, 10 aa, Mycobacterium tuberculosis
RLPGRHVLYA

SEQ ID NO: 27887 - protein, 10 aa, Mycobacterium tuberculosis
LPGRHVLYAL

SEQ ID NO: 27888 - protein, 10 aa, Mycobacterium tuberculosis
PGRHVLYALS

SEQ ID NO: 27889 - protein, 10 aa, Mycobacterium tuberculosis
GRHVLYALSA

SEQ ID NO: 27890 - protein, 10 aa, Mycobacterium tuberculosis
RHVLYALSAV

SEQ ID NO: 27891 - protein, 10 aa, Mycobacterium tuberculosis
HVLYALSAVT

SEQ ID NO: 27892 - protein, 10 aa, Mycobacterium tuberculosis
VLYALSAVTM

SEQ ID NO: 27893 - protein, 10 aa, Mycobacterium tuberculosis
LYALSAVTML

SEQ ID NO: 27894 - protein, 10 aa, Mycobacterium tuberculosis
YALSAVTMLA

SEQ ID NO: 27895 - protein, 10 aa, Mycobacterium tuberculosis
ALSAVTMLAA

SEQ ID NO: 27896 - protein, 10 aa, Mycobacterium tuberculosis
LSAVTMLAAC

SEQ ID NO: 27897 - protein, 10 aa, Mycobacterium tuberculosis
SAVTMLAACS

SEQ ID NO: 27898 - protein, 10 aa, Mycobacterium tuberculosis
AVTMLAACSS

SEQ ID NO: 27899 - protein, 10 aa, Mycobacterium tuberculosis
VTMLAACSSN

SEQ ID NO: 27900 - protein, 10 aa, Mycobacterium tuberculosis
TMLAACSSNG

SEQ ID NO: 27901 - protein, 10 aa, Mycobacterium tuberculosis
MLAACSSNGA

SEQ ID NO: 27902 - protein, 10 aa, Mycobacterium tuberculosis
LAACSSNGAR

SEQ ID NO: 27903 - protein, 10 aa, Mycobacterium tuberculosis
AACSSNGARG

SEQ ID NO: 27904 - protein, 10 aa, Mycobacterium tuberculosis
ACSSNGARGG

SEQ ID NO: 27905 - protein, 10 aa, Mycobacterium tuberculosis
CSSNGARGGI

SEQ ID NO: 27906 - protein, 10 aa, Mycobacterium tuberculosis
SSNGARGGIA

SEQ ID NO: 27907 - protein, 10 aa, Mycobacterium tuberculosis
SNGARGGIAS

SEQ ID NO: 27908 - protein, 10 aa, Mycobacterium tuberculosis
NGARGGIAST

SEQ ID NO: 27909 - protein, 10 aa, Mycobacterium tuberculosis
GARGGIASTN

SEQ ID NO: 27910 - protein, 10 aa, Mycobacterium tuberculosis
ARGGIASTNM

SEQ ID NO: 27911 - protein, 10 aa, Mycobacterium tuberculosis
RGGIASTNMN

SEQ ID NO: 27912 - protein, 10 aa, Mycobacterium tuberculosis
GGIASTNMNP

SEQ ID NO: 27913 - protein, 10 aa, Mycobacterium tuberculosis
GIASTNMNPT

SEQ ID NO: 27914 - protein, 10 aa, Mycobacterium tuberculosis
IASTNMNPTN

SEQ ID NO: 27915 - protein, 10 aa, Mycobacterium tuberculosis
ASTNMNPTNP

SEQ ID NO: 27916 - protein, 10 aa, Mycobacterium tuberculosis
STNMNPTNPP

SEQ ID NO: 27917 - protein, 10 aa, Mycobacterium tuberculosis
TNMNPTNPPA

SEQ ID NO: 27918 - protein, 10 aa, Mycobacterium tuberculosis
NMNPTNPPAT

SEQ ID NO: 27919 - protein, 10 aa, Mycobacterium tuberculosis
MNPTNPPATA

SEQ ID NO: 27920 - protein, 10 aa, Mycobacterium tuberculosis
NPTNPPATAE

SEQ ID NO: 27921 - protein, 10 aa, Mycobacterium tuberculosis
PTNPPATAET

SEQ ID NO: 27922 - protein, 10 aa, Mycobacterium tuberculosis
TNPPATAETA

SEQ ID NO: 27923 - protein, 10 aa, Mycobacterium tuberculosis
NPPATAETAT

SEQ ID NO: 27924 - protein, 10 aa, Mycobacterium tuberculosis
PPATAETATV

SEQ ID NO: 27925 - protein, 10 aa, Mycobacterium tuberculosis
PATAETATVS

SEQ ID NO: 27926 - protein, 10 aa, Mycobacterium tuberculosis
ATAETATVSP

SEQ ID NO: 27927 - protein, 10 aa, Mycobacterium tuberculosis
TAETATVSPT

SEQ ID NO: 27928 - protein, 10 aa, Mycobacterium tuberculosis
AETATVSPTP

SEQ ID NO: 27929 - protein, 10 aa, Mycobacterium tuberculosis
ETATVSPTPA

SEQ ID NO: 27930 - protein, 10 aa, Mycobacterium tuberculosis
TATVSPTPAP

SEQ ID NO: 27931 - protein, 10 aa, Mycobacterium tuberculosis
ATVSPTPAPQ

SEQ ID NO: 27932 - protein, 10 aa, Mycobacterium tuberculosis
TVSPTPAPQS

SEQ ID NO: 27933 - protein, 10 aa, Mycobacterium tuberculosis
VSPTPAPQSA

SEQ ID NO: 27934 - protein, 10 aa, Mycobacterium tuberculosis
SPTPAPQSAR

SEQ ID NO: 27935 - protein, 10 aa, Mycobacterium tuberculosis
PTPAPQSART

SEQ ID NO: 27936 - protein, 10 aa, Mycobacterium tuberculosis
TPAPQSARTE

SEQ ID NO: 27937 - protein, 10 aa, Mycobacterium tuberculosis
PAPQSARTET

SEQ ID NO: 27938 - protein, 10 aa, Mycobacterium tuberculosis
APQSARTETW

SEQ ID NO: 27939 - protein, 10 aa, Mycobacterium tuberculosis
PQSARTETWI

SEQ ID NO: 27940 - protein, 10 aa, Mycobacterium tuberculosis
QSARTETWIN

SEQ ID NO: 27941 - protein, 10 aa, Mycobacterium tuberculosis
SARTETWINL

SEQ ID NO: 27942 - protein, 10 aa, Mycobacterium tuberculosis
ARTETWINLQ

SEQ ID NO: 27943 - protein, 10 aa, Mycobacterium tuberculosis
RTETWINLQV

SEQ ID NO: 27944 - protein, 10 aa, Mycobacterium tuberculosis
TETWINLQVG

SEQ ID NO: 27945 - protein, 10 aa, Mycobacterium tuberculosis
ETWINLQVGD

SEQ ID NO: 27946 - protein, 10 aa, Mycobacterium tuberculosis
TWINLQVGDC

SEQ ID NO: 27947 - protein, 10 aa, Mycobacterium tuberculosis
WINLQVGDCL

SEQ ID NO: 27948 - protein, 10 aa, Mycobacterium tuberculosis
INLQVGDCLA

SEQ ID NO: 27949 - protein, 10 aa, Mycobacterium tuberculosis
NLQVGDCLAD

SEQ ID NO: 27950 - protein, 10 aa, Mycobacterium tuberculosis
LQVGDCLADL

SEQ ID NO: 27951 - protein, 10 aa, Mycobacterium tuberculosis
QVGDCLADLP

SEQ ID NO: 27952 - protein, 10 aa, Mycobacterium tuberculosis
VGDCLADLPP

SEQ ID NO: 27953 - protein, 10 aa, Mycobacterium tuberculosis
GDCLADLPPA

SEQ ID NO: 27954 - protein, 10 aa, Mycobacterium tuberculosis
DCLADLPPAD

SEQ ID NO: 27955 - protein, 10 aa, Mycobacterium tuberculosis
CLADLPPADL

SEQ ID NO: 27956 - protein, 10 aa, Mycobacterium tuberculosis
LADLPPADLS

SEQ ID NO: 27957 - protein, 10 aa, Mycobacterium tuberculosis
ADLPPADLSR

SEQ ID NO: 27958 - protein, 10 aa, Mycobacterium tuberculosis
DLPPADLSRI

SEQ ID NO: 27959 - protein, 10 aa, Mycobacterium tuberculosis
LPPADLSRIT

SEQ ID NO: 27960 - protein, 10 aa, Mycobacterium tuberculosis
PPADLSRITV

SEQ ID NO: 27961 - protein, 10 aa, Mycobacterium tuberculosis
PADLSRITVT

SEQ ID NO: 27962 - protein, 10 aa, Mycobacterium tuberculosis
ADLSRITVTI

SEQ ID NO: 27963 - protein, 10 aa, Mycobacterium tuberculosis
DLSRITVTIV

SEQ ID NO: 27964 - protein, 10 aa, Mycobacterium tuberculosis
LSRITVTIVD

SEQ ID NO: 27965 - protein, 10 aa, Mycobacterium tuberculosis
SRITVTIVDC

SEQ ID NO: 27966 - protein, 10 aa, Mycobacterium tuberculosis
RITVTIVDCA

SEQ ID NO: 27967 - protein, 10 aa, Mycobacterium tuberculosis
ITVTIVDCAT

SEQ ID NO: 27968 - protein, 10 aa, Mycobacterium tuberculosis
TVTIVDCATA

SEQ ID NO: 27969 - protein, 10 aa, Mycobacterium tuberculosis
VTIVDCATAH

SEQ ID NO: 27970 - protein, 10 aa, Mycobacterium tuberculosis
TIVDCATAHS

SEQ ID NO: 27971 - protein, 10 aa, Mycobacterium tuberculosis
IVDCATAHSA

SEQ ID NO: 27972 - protein, 10 aa, Mycobacterium tuberculosis
VDCATAHSAE

SEQ ID NO: 27973 - protein, 10 aa, Mycobacterium tuberculosis
DCATAHSAEV

SEQ ID NO: 27974 - protein, 10 aa, Mycobacterium tuberculosis
CATAHSAEVY

SEQ ID NO: 27975 - protein, 10 aa, Mycobacterium tuberculosis
ATAHSAEVYL

SEQ ID NO: 27976 - protein, 10 aa, Mycobacterium tuberculosis
TAHSAEVYLR

SEQ ID NO: 27977 - protein, 10 aa, Mycobacterium tuberculosis
AHSAEVYLRA

SEQ ID NO: 27978 - protein, 10 aa, Mycobacterium tuberculosis
HSAEVYLRAP

SEQ ID NO: 27979 - protein, 10 aa, Mycobacterium tuberculosis
SAEVYLRAPV

SEQ ID NO: 27980 - protein, 10 aa, Mycobacterium tuberculosis
AEVYLRAPVA

SEQ ID NO: 27981 - protein, 10 aa, Mycobacterium tuberculosis
EVYLRAPVAV

SEQ ID NO: 27982 - protein, 10 aa, Mycobacterium tuberculosis
VYLRAPVAVD

SEQ ID NO: 27983 - protein, 10 aa, Mycobacterium tuberculosis
YLRAPVAVDA

SEQ ID NO: 27984 - protein, 10 aa, Mycobacterium tuberculosis
LRAPVAVDAA

SEQ ID NO: 27985 - protein, 10 aa, Mycobacterium tuberculosis
RAPVAVDAAV

SEQ ID NO: 27986 - protein, 10 aa, Mycobacterium tuberculosis
APVAVDAAVV

SEQ ID NO: 27987 - protein, 10 aa, Mycobacterium tuberculosis
PVAVDAAVVS

SEQ ID NO: 27988 - protein, 10 aa, Mycobacterium tuberculosis
VAVDAAVVSM

SEQ ID NO: 27989 - protein, 10 aa, Mycobacterium tuberculosis
AVDAAVVSMA

SEQ ID NO: 27990 - protein, 10 aa, Mycobacterium tuberculosis
VDAAVVSMAN

SEQ ID NO: 27991 - protein, 10 aa, Mycobacterium tuberculosis
DAAVVSMANR

SEQ ID NO: 27992 - protein, 10 aa, Mycobacterium tuberculosis
AAVVSMANRD

SEQ ID NO: 27993 - protein, 10 aa, Mycobacterium tuberculosis
AVVSMANRDC

SEQ ID NO: 27994 - protein, 10 aa, Mycobacterium tuberculosis
VVSMANRDCA

SEQ ID NO: 27995 - protein, 10 aa, Mycobacterium tuberculosis
VSMANRDCAA

SEQ ID NO: 27996 - protein, 10 aa, Mycobacterium tuberculosis
SMANRDCAAG

SEQ ID NO: 27997 - protein, 10 aa, Mycobacterium tuberculosis
MANRDCAAGF

SEQ ID NO: 27998 - protein, 10 aa, Mycobacterium tuberculosis
ANRDCAAGFA

SEQ ID NO: 27999 - protein, 10 aa, Mycobacterium tuberculosis
NRDCAAGFAP

SEQ ID NO: 28000 - protein, 10 aa, Mycobacterium tuberculosis
RDCAAGFAPY

SEQ ID NO: 28001 - protein, 10 aa, Mycobacterium tuberculosis
DCAAGFAPYT

SEQ ID NO: 28002 - protein, 10 aa, Mycobacterium tuberculosis
CAAGFAPYTG

SEQ ID NO: 28003 - protein, 10 aa, Mycobacterium tuberculosis
AAGFAPYTGQ

SEQ ID NO: 28004 - protein, 10 aa, Mycobacterium tuberculosis
AGFAPYTGQS

SEQ ID NO: 28005 - protein, 10 aa, Mycobacterium tuberculosis
GFAPYTGQSV

SEQ ID NO: 28006 - protein, 10 aa, Mycobacterium tuberculosis
FAPYTGQSVD

SEQ ID NO: 28007 - protein, 10 aa, Mycobacterium tuberculosis
APYTGQSVDT

SEQ ID NO: 28008 - protein, 10 aa, Mycobacterium tuberculosis
PYTGQSVDTS

SEQ ID NO: 28009 - protein, 10 aa, Mycobacterium tuberculosis
YTGQSVDTSP

SEQ ID NO: 28010 - protein, 10 aa, Mycobacterium tuberculosis
TGQSVDTSPY

SEQ ID NO: 28011 - protein, 10 aa, Mycobacterium tuberculosis
GQSVDTSPYS

SEQ ID NO: 28012 - protein, 10 aa, Mycobacterium tuberculosis
QSVDTSPYSV

SEQ ID NO: 28013 - protein, 10 aa, Mycobacterium tuberculosis
SVDTSPYSVA

SEQ ID NO: 28014 - protein, 10 aa, Mycobacterium tuberculosis
VDTSPYSVAY

SEQ ID NO: 28015 - protein, 10 aa, Mycobacterium tuberculosis
DTSPYSVAYL

SEQ ID NO: 28016 - protein, 10 aa, Mycobacterium tuberculosis
TSPYSVAYLI

SEQ ID NO: 28017 - protein, 10 aa, Mycobacterium tuberculosis
SPYSVAYLID

SEQ ID NO: 28018 - protein, 10 aa, Mycobacterium tuberculosis
PYSVAYLIDS

SEQ ID NO: 28019 - protein, 10 aa, Mycobacterium tuberculosis
YSVAYLIDSH

SEQ ID NO: 28020 - protein, 10 aa, Mycobacterium tuberculosis
SVAYLIDSHQ

SEQ ID NO: 28021 - protein, 10 aa, Mycobacterium tuberculosis
VAYLIDSHQD

SEQ ID NO: 28022 - protein, 10 aa, Mycobacterium tuberculosis
AYLIDSHQDR

SEQ ID NO: 28023 - protein, 10 aa, Mycobacterium tuberculosis
YLIDSHQDRT

SEQ ID NO: 28024 - protein, 10 aa, Mycobacterium tuberculosis
LIDSHQDRTG

SEQ ID NO: 28025 - protein, 10 aa, Mycobacterium tuberculosis
IDSHQDRTGA

SEQ ID NO: 28026 - protein, 10 aa, Mycobacterium tuberculosis
DSHQDRTGAD

SEQ ID NO: 28027 - protein, 10 aa, Mycobacterium tuberculosis
SHQDRTGADP

SEQ ID NO: 28028 - protein, 10 aa, Mycobacterium tuberculosis
HQDRTGADPT

SEQ ID NO: 28029 - protein, 10 aa, Mycobacterium tuberculosis
QDRTGADPTP

SEQ ID NO: 28030 - protein, 10 aa, Mycobacterium tuberculosis
DRTGADPTPS

SEQ ID NO: 28031 - protein, 10 aa, Mycobacterium tuberculosis
RTGADPTPST

SEQ ID NO: 28032 - protein, 10 aa, Mycobacterium tuberculosis
TGADPTPSTV

SEQ ID NO: 28033 - protein, 10 aa, Mycobacterium tuberculosis
GADPTPSTVI

SEQ ID NO: 28034 - protein, 10 aa, Mycobacterium tuberculosis
ADPTPSTVIC

SEQ ID NO: 28035 - protein, 10 aa, Mycobacterium tuberculosis
DPTPSTVICL

SEQ ID NO: 28036 - protein, 10 aa, Mycobacterium tuberculosis
PTPSTVICLL

SEQ ID NO: 28037 - protein, 10 aa, Mycobacterium tuberculosis
TPSTVICLLQ

SEQ ID NO: 28038 - protein, 10 aa, Mycobacterium tuberculosis
PSTVICLLQP

SEQ ID NO: 28039 - protein, 10 aa, Mycobacterium tuberculosis
STVICLLQPA

SEQ ID NO: 28040 - protein, 10 aa, Mycobacterium tuberculosis
TVICLLQPAN

SEQ ID NO: 28041 - protein, 10 aa, Mycobacterium tuberculosis
VICLLQPANG

SEQ ID NO: 28042 - protein, 10 aa, Mycobacterium tuberculosis
ICLLQPANGQ

SEQ ID NO: 28043 - protein, 10 aa, Mycobacterium tuberculosis
CLLQPANGQL

SEQ ID NO: 28044 - protein, 10 aa, Mycobacterium tuberculosis
LLQPANGQLL

SEQ ID NO: 28045 - protein, 10 aa, Mycobacterium tuberculosis
LQPANGQLLT

SEQ ID NO: 28046 - protein, 10 aa, Mycobacterium tuberculosis
QPANGQLLTG

SEQ ID NO: 28047 - protein, 10 aa, Mycobacterium tuberculosis
PANGQLLTGS

SEQ ID NO: 28048 - protein, 10 aa, Mycobacterium tuberculosis
ANGQLLTGSA

SEQ ID NO: 28049 - protein, 10 aa, Mycobacterium tuberculosis
NGQLLTGSAR

SEQ ID NO: 28050 - protein, 10 aa, Mycobacterium tuberculosis
GQLLTGSARR

SEQ ID NO: 28051 - protein, 11 aa, Mycobacterium tuberculosis
MRLPGRHVLYA

SEQ ID NO: 28052 - protein, 11 aa, Mycobacterium tuberculosis
RLPGRHVLYAL

SEQ ID NO: 28053 - protein, 11 aa, Mycobacterium tuberculosis
LPGRHVLYALS

SEQ ID NO: 28054 - protein, 11 aa, Mycobacterium tuberculosis
PGRHVLYALSA

SEQ ID NO: 28055 - protein, 11 aa, Mycobacterium tuberculosis
GRHVLYALSAV

SEQ ID NO: 28056 - protein, 11 aa, Mycobacterium tuberculosis
RHVLYALSAVT

SEQ ID NO: 28057 - protein, 11 aa, Mycobacterium tuberculosis
HVLYALSAVTM

SEQ ID NO: 28058 - protein, 11 aa, Mycobacterium tuberculosis
VLYALSAVTML

SEQ ID NO: 28059 - protein, 11 aa, Mycobacterium tuberculosis
LYALSAVTMLA

SEQ ID NO: 28060 - protein, 11 aa, Mycobacterium tuberculosis
YALSAVTMLAA

SEQ ID NO: 28061 - protein, 11 aa, Mycobacterium tuberculosis
ALSAVTMLAAC

SEQ ID NO: 28062 - protein, 11 aa, Mycobacterium tuberculosis
LSAVTMLAACS

SEQ ID NO: 28063 - protein, 11 aa, Mycobacterium tuberculosis
SAVTMLAACSS

SEQ ID NO: 28064 - protein, 11 aa, Mycobacterium tuberculosis
AVTMLAACSSN

SEQ ID NO: 28065 - protein, 11 aa, Mycobacterium tuberculosis
VTMLAACSSNG

SEQ ID NO: 28066 - protein, 11 aa, Mycobacterium tuberculosis
TMLAACSSNGA

SEQ ID NO: 28067 - protein, 11 aa, Mycobacterium tuberculosis
MLAACSSNGAR

SEQ ID NO: 28068 - protein, 11 aa, Mycobacterium tuberculosis
LAACSSNGARG

SEQ ID NO: 28069 - protein, 11 aa, Mycobacterium tuberculosis
AACSSNGARGG

SEQ ID NO: 28070 - protein, 11 aa, Mycobacterium tuberculosis
ACSSNGARGGI

SEQ ID NO: 28071 - protein, 11 aa, Mycobacterium tuberculosis
CSSNGARGGIA

SEQ ID NO: 28072 - protein, 11 aa, Mycobacterium tuberculosis
SSNGARGGIAS

SEQ ID NO: 28073 - protein, 11 aa, Mycobacterium tuberculosis
SNGARGGIAST

SEQ ID NO: 28074 - protein, 11 aa, Mycobacterium tuberculosis
NGARGGIASTN

SEQ ID NO: 28075 - protein, 11 aa, Mycobacterium tuberculosis
GARGGIASTNM

SEQ ID NO: 28076 - protein, 11 aa, Mycobacterium tuberculosis
ARGGIASTNMN

SEQ ID NO: 28077 - protein, 11 aa, Mycobacterium tuberculosis
RGGIASTNMNP

SEQ ID NO: 28078 - protein, 11 aa, Mycobacterium tuberculosis
GGIASTNMNPT

SEQ ID NO: 28079 - protein, 11 aa, Mycobacterium tuberculosis
GIASTNMNPTN

SEQ ID NO: 28080 - protein, 11 aa, Mycobacterium tuberculosis
IASTNMNPTNP

SEQ ID NO: 28081 - protein, 11 aa, Mycobacterium tuberculosis
ASTNMNPTNPP

SEQ ID NO: 28082 - protein, 11 aa, Mycobacterium tuberculosis
STNMNPTNPPA

SEQ ID NO: 28083 - protein, 11 aa, Mycobacterium tuberculosis
TNMNPTNPPAT

SEQ ID NO: 28084 - protein, 11 aa, Mycobacterium tuberculosis
NMNPTNPPATA

SEQ ID NO: 28085 - protein, 11 aa, Mycobacterium tuberculosis
MNPTNPPATAE

SEQ ID NO: 28086 - protein, 11 aa, Mycobacterium tuberculosis
NPTNPPATAET

SEQ ID NO: 28087 - protein, 11 aa, Mycobacterium tuberculosis
PTNPPATAETA

SEQ ID NO: 28088 - protein, 11 aa, Mycobacterium tuberculosis
TNPPATAETAT

SEQ ID NO: 28089 - protein, 11 aa, Mycobacterium tuberculosis
NPPATAETATV

SEQ ID NO: 28090 - protein, 11 aa, Mycobacterium tuberculosis
PPATAETATVS

SEQ ID NO: 28091 - protein, 11 aa, Mycobacterium tuberculosis
PATAETATVSP

SEQ ID NO: 28092 - protein, 11 aa, Mycobacterium tuberculosis
ATAETATVSPT

SEQ ID NO: 28093 - protein, 11 aa, Mycobacterium tuberculosis
TAETATVSPTP

SEQ ID NO: 28094 - protein, 11 aa, Mycobacterium tuberculosis
AETATVSPTPA

SEQ ID NO: 28095 - protein, 11 aa, Mycobacterium tuberculosis
ETATVSPTPAP

SEQ ID NO: 28096 - protein, 11 aa, Mycobacterium tuberculosis
TATVSPTPAPQ

SEQ ID NO: 28097 - protein, 11 aa, Mycobacterium tuberculosis
ATVSPTPAPQS

SEQ ID NO: 28098 - protein, 11 aa, Mycobacterium tuberculosis
TVSPTPAPQSA

SEQ ID NO: 28099 - protein, 11 aa, Mycobacterium tuberculosis
VSPTPAPQSAR

SEQ ID NO: 28100 - protein, 11 aa, Mycobacterium tuberculosis
SPTPAPQSART

SEQ ID NO: 28101 - protein, 11 aa, Mycobacterium tuberculosis
PTPAPQSARTE

SEQ ID NO: 28102 - protein, 11 aa, Mycobacterium tuberculosis
TPAPQSARTET

SEQ ID NO: 28103 - protein, 11 aa, Mycobacterium tuberculosis
PAPQSARTETW

SEQ ID NO: 28104 - protein, 11 aa, Mycobacterium tuberculosis
APQSARTETWI

SEQ ID NO: 28105 - protein, 11 aa, Mycobacterium tuberculosis
PQSARTETWIN

SEQ ID NO: 28106 - protein, 11 aa, Mycobacterium tuberculosis
QSARTETWINL

SEQ ID NO: 28107 - protein, 11 aa, Mycobacterium tuberculosis
SARTETWINLQ

SEQ ID NO: 28108 - protein, 11 aa, Mycobacterium tuberculosis
ARTETWINLQV

SEQ ID NO: 28109 - protein, 11 aa, Mycobacterium tuberculosis
RTETWINLQVG

SEQ ID NO: 28110 - protein, 11 aa, Mycobacterium tuberculosis
TETWINLQVGD

SEQ ID NO: 28111 - protein, 11 aa, Mycobacterium tuberculosis
ETWINLQVGDC

SEQ ID NO: 28112 - protein, 11 aa, Mycobacterium tuberculosis
TWINLQVGDCL

SEQ ID NO: 28113 - protein, 11 aa, Mycobacterium tuberculosis
WINLQVGDCLA

SEQ ID NO: 28114 - protein, 11 aa, Mycobacterium tuberculosis
INLQVGDCLAD

SEQ ID NO: 28115 - protein, 11 aa, Mycobacterium tuberculosis
NLQVGDCLADL

SEQ ID NO: 28116 - protein, 11 aa, Mycobacterium tuberculosis
LQVGDCLADLP

SEQ ID NO: 28117 - protein, 11 aa, Mycobacterium tuberculosis
QVGDCLADLPP

SEQ ID NO: 28118 - protein, 11 aa, Mycobacterium tuberculosis
VGDCLADLPPA

SEQ ID NO: 28119 - protein, 11 aa, Mycobacterium tuberculosis
GDCLADLPPAD

SEQ ID NO: 28120 - protein, 11 aa, Mycobacterium tuberculosis
DCLADLPPADL

SEQ ID NO: 28121 - protein, 11 aa, Mycobacterium tuberculosis
CLADLPPADLS

SEQ ID NO: 28122 - protein, 11 aa, Mycobacterium tuberculosis
LADLPPADLSR

SEQ ID NO: 28123 - protein, 11 aa, Mycobacterium tuberculosis
ADLPPADLSRI

SEQ ID NO: 28124 - protein, 11 aa, Mycobacterium tuberculosis
DLPPADLSRIT

SEQ ID NO: 28125 - protein, 11 aa, Mycobacterium tuberculosis
LPPADLSRITV

SEQ ID NO: 28126 - protein, 11 aa, Mycobacterium tuberculosis
PPADLSRITVT

SEQ ID NO: 28127 - protein, 11 aa, Mycobacterium tuberculosis
PADLSRITVTI

SEQ ID NO: 28128 - protein, 11 aa, Mycobacterium tuberculosis
ADLSRITVTIV

SEQ ID NO: 28129 - protein, 11 aa, Mycobacterium tuberculosis
DLSRITVTIVD

SEQ ID NO: 28130 - protein, 11 aa, Mycobacterium tuberculosis
LSRITVTIVDC

SEQ ID NO: 28131 - protein, 11 aa, Mycobacterium tuberculosis
SRITVTIVDCA

SEQ ID NO: 28132 - protein, 11 aa, Mycobacterium tuberculosis
RITVTIVDCAT

SEQ ID NO: 28133 - protein, 11 aa, Mycobacterium tuberculosis
ITVTIVDCATA

SEQ ID NO: 28134 - protein, 11 aa, Mycobacterium tuberculosis
TVTIVDCATAH

SEQ ID NO: 28135 - protein, 11 aa, Mycobacterium tuberculosis
VTIVDCATAHS

SEQ ID NO: 28136 - protein, 11 aa, Mycobacterium tuberculosis
TIVDCATAHSA

SEQ ID NO: 28137 - protein, 11 aa, Mycobacterium tuberculosis
IVDCATAHSAE

SEQ ID NO: 28138 - protein, 11 aa, Mycobacterium tuberculosis
VDCATAHSAEV

SEQ ID NO: 28139 - protein, 11 aa, Mycobacterium tuberculosis
DCATAHSAEVY

SEQ ID NO: 28140 - protein, 11 aa, Mycobacterium tuberculosis
CATAHSAEVYL

SEQ ID NO: 28141 - protein, 11 aa, Mycobacterium tuberculosis
ATAHSAEVYLR

SEQ ID NO: 28142 - protein, 11 aa, Mycobacterium tuberculosis
TAHSAEVYLRA

SEQ ID NO: 28143 - protein, 11 aa, Mycobacterium tuberculosis
AHSAEVYLRAP

SEQ ID NO: 28144 - protein, 11 aa, Mycobacterium tuberculosis
HSAEVYLRAPV

SEQ ID NO: 28145 - protein, 11 aa, Mycobacterium tuberculosis
SAEVYLRAPVA

SEQ ID NO: 28146 - protein, 11 aa, Mycobacterium tuberculosis
AEVYLRAPVAV

SEQ ID NO: 28147 - protein, 11 aa, Mycobacterium tuberculosis
EVYLRAPVAVD

SEQ ID NO: 28148 - protein, 11 aa, Mycobacterium tuberculosis
VYLRAPVAVDA

SEQ ID NO: 28149 - protein, 11 aa, Mycobacterium tuberculosis
YLRAPVAVDAA

SEQ ID NO: 28150 - protein, 11 aa, Mycobacterium tuberculosis
LRAPVAVDAAV

SEQ ID NO: 28151 - protein, 11 aa, Mycobacterium tuberculosis
RAPVAVDAAVV

SEQ ID NO: 28152 - protein, 11 aa, Mycobacterium tuberculosis
APVAVDAAVVS

SEQ ID NO: 28153 - protein, 11 aa, Mycobacterium tuberculosis
PVAVDAAVVSM

SEQ ID NO: 28154 - protein, 11 aa, Mycobacterium tuberculosis
VAVDAAVVSMA

SEQ ID NO: 28155 - protein, 11 aa, Mycobacterium tuberculosis
AVDAAVVSMAN

SEQ ID NO: 28156 - protein, 11 aa, Mycobacterium tuberculosis
VDAAVVSMANR

SEQ ID NO: 28157 - protein, 11 aa, Mycobacterium tuberculosis
DAAVVSMANRD

SEQ ID NO: 28158 - protein, 11 aa, Mycobacterium tuberculosis
AAVVSMANRDC

SEQ ID NO: 28159 - protein, 11 aa, Mycobacterium tuberculosis
AVVSMANRDCA

SEQ ID NO: 28160 - protein, 11 aa, Mycobacterium tuberculosis
VVSMANRDCAA

SEQ ID NO: 28161 - protein, 11 aa, Mycobacterium tuberculosis
VSMANRDCAAG

SEQ ID NO: 28162 - protein, 11 aa, Mycobacterium tuberculosis
SMANRDCAAGF

SEQ ID NO: 28163 - protein, 11 aa, Mycobacterium tuberculosis
MANRDCAAGFA

SEQ ID NO: 28164 - protein, 11 aa, Mycobacterium tuberculosis
ANRDCAAGFAP

SEQ ID NO: 28165 - protein, 11 aa, Mycobacterium tuberculosis
NRDCAAGFAPY

SEQ ID NO: 28166 - protein, 11 aa, Mycobacterium tuberculosis
RDCAAGFAPYT

SEQ ID NO: 28167 - protein, 11 aa, Mycobacterium tuberculosis
DCAAGFAPYTG

SEQ ID NO: 28168 - protein, 11 aa, Mycobacterium tuberculosis
CAAGFAPYTGQ

SEQ ID NO: 28169 - protein, 11 aa, Mycobacterium tuberculosis
AAGFAPYTGQS

SEQ ID NO: 28170 - protein, 11 aa, Mycobacterium tuberculosis
AGFAPYTGQSV

SEQ ID NO: 28171 - protein, 11 aa, Mycobacterium tuberculosis
GFAPYTGQSVD

SEQ ID NO: 28172 - protein, 11 aa, Mycobacterium tuberculosis
FAPYTGQSVDT

SEQ ID NO: 28173 - protein, 11 aa, Mycobacterium tuberculosis
APYTGQSVDTS

SEQ ID NO: 28174 - protein, 11 aa, Mycobacterium tuberculosis
PYTGQSVDTSP

SEQ ID NO: 28175 - protein, 11 aa, Mycobacterium tuberculosis
YTGQSVDTSPY

SEQ ID NO: 28176 - protein, 11 aa, Mycobacterium tuberculosis
TGQSVDTSPYS

SEQ ID NO: 28177 - protein, 11 aa, Mycobacterium tuberculosis
GQSVDTSPYSV

SEQ ID NO: 28178 - protein, 11 aa, Mycobacterium tuberculosis
QSVDTSPYSVA

SEQ ID NO: 28179 - protein, 11 aa, Mycobacterium tuberculosis
SVDTSPYSVAY

SEQ ID NO: 28180 - protein, 11 aa, Mycobacterium tuberculosis
VDTSPYSVAYL

SEQ ID NO: 28181 - protein, 11 aa, Mycobacterium tuberculosis
DTSPYSVAYLI

SEQ ID NO: 28182 - protein, 11 aa, Mycobacterium tuberculosis
TSPYSVAYLID

SEQ ID NO: 28183 - protein, 11 aa, Mycobacterium tuberculosis
SPYSVAYLIDS

SEQ ID NO: 28184 - protein, 11 aa, Mycobacterium tuberculosis
PYSVAYLIDSH

SEQ ID NO: 28185 - protein, 11 aa, Mycobacterium tuberculosis
YSVAYLIDSHQ

SEQ ID NO: 28186 - protein, 11 aa, Mycobacterium tuberculosis
SVAYLIDSHQD

SEQ ID NO: 28187 - protein, 11 aa, Mycobacterium tuberculosis
VAYLIDSHQDR

SEQ ID NO: 28188 - protein, 11 aa, Mycobacterium tuberculosis
AYLIDSHQDRT

SEQ ID NO: 28189 - protein, 11 aa, Mycobacterium tuberculosis
YLIDSHQDRTG

SEQ ID NO: 28190 - protein, 11 aa, Mycobacterium tuberculosis
LIDSHQDRTGA

SEQ ID NO: 28191 - protein, 11 aa, Mycobacterium tuberculosis
IDSHQDRTGAD

SEQ ID NO: 28192 - protein, 11 aa, Mycobacterium tuberculosis
DSHQDRTGADP

SEQ ID NO: 28193 - protein, 11 aa, Mycobacterium tuberculosis
SHQDRTGADPT

SEQ ID NO: 28194 - protein, 11 aa, Mycobacterium tuberculosis
HQDRTGADPTP

SEQ ID NO: 28195 - protein, 11 aa, Mycobacterium tuberculosis
QDRTGADPTPS

SEQ ID NO: 28196 - protein, 11 aa, Mycobacterium tuberculosis
DRTGADPTPST

SEQ ID NO: 28197 - protein, 11 aa, Mycobacterium tuberculosis
RTGADPTPSTV

SEQ ID NO: 28198 - protein, 11 aa, Mycobacterium tuberculosis
TGADPTPSTVI

SEQ ID NO: 28199 - protein, 11 aa, Mycobacterium tuberculosis
GADPTPSTVIC

SEQ ID NO: 28200 - protein, 11 aa, Mycobacterium tuberculosis
ADPTPSTVICL

SEQ ID NO: 28201 - protein, 11 aa, Mycobacterium tuberculosis
DPTPSTVICLL

SEQ ID NO: 28202 - protein, 11 aa, Mycobacterium tuberculosis
PTPSTVICLLQ

SEQ ID NO: 28203 - protein, 11 aa, Mycobacterium tuberculosis
TPSTVICLLQP

SEQ ID NO: 28204 - protein, 11 aa, Mycobacterium tuberculosis
PSTVICLLQPA

SEQ ID NO: 28205 - protein, 11 aa, Mycobacterium tuberculosis
STVICLLQPAN

SEQ ID NO: 28206 - protein, 11 aa, Mycobacterium tuberculosis
TVICLLQPANG

SEQ ID NO: 28207 - protein, 11 aa, Mycobacterium tuberculosis
VICLLQPANGQ

SEQ ID NO: 28208 - protein, 11 aa, Mycobacterium tuberculosis
ICLLQPANGQL

SEQ ID NO: 28209 - protein, 11 aa, Mycobacterium tuberculosis
CLLQPANGQLL

SEQ ID NO: 28210 - protein, 11 aa, Mycobacterium tuberculosis
LLQPANGQLLT

SEQ ID NO: 28211 - protein, 11 aa, Mycobacterium tuberculosis
LQPANGQLLTG

SEQ ID NO: 28212 - protein, 11 aa, Mycobacterium tuberculosis
QPANGQLLTGS

SEQ ID NO: 28213 - protein, 11 aa, Mycobacterium tuberculosis
PANGQLLTGSA

SEQ ID NO: 28214 - protein, 11 aa, Mycobacterium tuberculosis
ANGQLLTGSAR

SEQ ID NO: 28215 - protein, 11 aa, Mycobacterium tuberculosis
NGQLLTGSARR

SEQ ID NO: 28216 - protein, 8 aa, Mycobacterium tuberculosis
MHAKVGDY

SEQ ID NO: 28217 - protein, 8 aa, Mycobacterium tuberculosis
HAKVGDYL

SEQ ID NO: 28218 - protein, 8 aa, Mycobacterium tuberculosis
AKVGDYLV

SEQ ID NO: 28219 - protein, 8 aa, Mycobacterium tuberculosis
KVGDYLVV

SEQ ID NO: 28220 - protein, 8 aa, Mycobacterium tuberculosis
VGDYLVVK

SEQ ID NO: 28221 - protein, 8 aa, Mycobacterium tuberculosis
GDYLVVKG

SEQ ID NO: 28222 - protein, 8 aa, Mycobacterium tuberculosis
DYLVVKGT

SEQ ID NO: 28223 - protein, 8 aa, Mycobacterium tuberculosis
YLVVKGTT

SEQ ID NO: 28224 - protein, 8 aa, Mycobacterium tuberculosis
LVVKGTTT

SEQ ID NO: 28225 - protein, 8 aa, Mycobacterium tuberculosis
VVKGTTTE

SEQ ID NO: 28226 - protein, 8 aa, Mycobacterium tuberculosis
VKGTTTER

SEQ ID NO: 28227 - protein, 8 aa, Mycobacterium tuberculosis
KGTTTERH

SEQ ID NO: 28228 - protein, 8 aa, Mycobacterium tuberculosis
GTTTERHD

SEQ ID NO: 28229 - protein, 8 aa, Mycobacterium tuberculosis
TTTERHDQ

SEQ ID NO: 28230 - protein, 8 aa, Mycobacterium tuberculosis
TTERHDQH

SEQ ID NO: 28231 - protein, 8 aa, Mycobacterium tuberculosis
TERHDQHA

SEQ ID NO: 28232 - protein, 8 aa, Mycobacterium tuberculosis
ERHDQHAE

SEQ ID NO: 28233 - protein, 8 aa, Mycobacterium tuberculosis
RHDQHAEI

SEQ ID NO: 28234 - protein, 8 aa, Mycobacterium tuberculosis
HDQHAEII

SEQ ID NO: 28235 - protein, 8 aa, Mycobacterium tuberculosis
DQHAEIIE

SEQ ID NO: 28236 - protein, 8 aa, Mycobacterium tuberculosis
QHAEIIEV

SEQ ID NO: 28237 - protein, 8 aa, Mycobacterium tuberculosis
HAEIIEVR

SEQ ID NO: 28238 - protein, 8 aa, Mycobacterium tuberculosis
AEIIEVRS

SEQ ID NO: 28239 - protein, 8 aa, Mycobacterium tuberculosis
EIIEVRSA

SEQ ID NO: 28240 - protein, 8 aa, Mycobacterium tuberculosis
IIEVRSAD

SEQ ID NO: 28241 - protein, 8 aa, Mycobacterium tuberculosis
IEVRSADG

SEQ ID NO: 28242 - protein, 8 aa, Mycobacterium tuberculosis
EVRSADGS

SEQ ID NO: 28243 - protein, 8 aa, Mycobacterium tuberculosis
VRSADGSP

SEQ ID NO: 28244 - protein, 8 aa, Mycobacterium tuberculosis
RSADGSPP

SEQ ID NO: 28245 - protein, 8 aa, Mycobacterium tuberculosis
SADGSPPY

SEQ ID NO: 28246 - protein, 8 aa, Mycobacterium tuberculosis
ADGSPPYV

SEQ ID NO: 28247 - protein, 8 aa, Mycobacterium tuberculosis
DGSPPYVV

SEQ ID NO: 28248 - protein, 8 aa, Mycobacterium tuberculosis
GSPPYVVR

SEQ ID NO: 28249 - protein, 8 aa, Mycobacterium tuberculosis
SPPYVVRW

SEQ ID NO: 28250 - protein, 8 aa, Mycobacterium tuberculosis
PPYVVRWL

SEQ ID NO: 28251 - protein, 8 aa, Mycobacterium tuberculosis
PYVVRWLV

SEQ ID NO: 28252 - protein, 8 aa, Mycobacterium tuberculosis
YVVRWLVN

SEQ ID NO: 28253 - protein, 8 aa, Mycobacterium tuberculosis
VVRWLVNG

SEQ ID NO: 28254 - protein, 8 aa, Mycobacterium tuberculosis
VRWLVNGH

SEQ ID NO: 28255 - protein, 8 aa, Mycobacterium tuberculosis
RWLVNGHE

SEQ ID NO: 28256 - protein, 8 aa, Mycobacterium tuberculosis
WLVNGHET

SEQ ID NO: 28257 - protein, 8 aa, Mycobacterium tuberculosis
LVNGHETT

SEQ ID NO: 28258 - protein, 8 aa, Mycobacterium tuberculosis
VNGHETTV

SEQ ID NO: 28259 - protein, 8 aa, Mycobacterium tuberculosis
NGHETTVY

SEQ ID NO: 28260 - protein, 8 aa, Mycobacterium tuberculosis
GHETTVYP

SEQ ID NO: 28261 - protein, 8 aa, Mycobacterium tuberculosis
HETTVYPG

SEQ ID NO: 28262 - protein, 8 aa, Mycobacterium tuberculosis
ETTVYPGS

SEQ ID NO: 28263 - protein, 8 aa, Mycobacterium tuberculosis
TTVYPGSD

SEQ ID NO: 28264 - protein, 8 aa, Mycobacterium tuberculosis
TVYPGSDA

SEQ ID NO: 28265 - protein, 8 aa, Mycobacterium tuberculosis
VYPGSDAV

SEQ ID NO: 28266 - protein, 8 aa, Mycobacterium tuberculosis
YPGSDAVV

SEQ ID NO: 28267 - protein, 8 aa, Mycobacterium tuberculosis
PGSDAVVV

SEQ ID NO: 28268 - protein, 8 aa, Mycobacterium tuberculosis
GSDAVVVT

SEQ ID NO: 28269 - protein, 8 aa, Mycobacterium tuberculosis
SDAVVVTA

SEQ ID NO: 28270 - protein, 8 aa, Mycobacterium tuberculosis
DAVVVTAT

SEQ ID NO: 28271 - protein, 8 aa, Mycobacterium tuberculosis
AVVVTATE

SEQ ID NO: 28272 - protein, 8 aa, Mycobacterium tuberculosis
VVVTATEH

SEQ ID NO: 28273 - protein, 8 aa, Mycobacterium tuberculosis
VVTATEHA

SEQ ID NO: 28274 - protein, 8 aa, Mycobacterium tuberculosis
VTATEHAE

SEQ ID NO: 28275 - protein, 8 aa, Mycobacterium tuberculosis
TATEHAEA

SEQ ID NO: 28276 - protein, 8 aa, Mycobacterium tuberculosis
ATEHAEAE

SEQ ID NO: 28277 - protein, 8 aa, Mycobacterium tuberculosis
TEHAEAEK

SEQ ID NO: 28278 - protein, 8 aa, Mycobacterium tuberculosis
EHAEAEKR

SEQ ID NO: 28279 - protein, 8 aa, Mycobacterium tuberculosis
HAEAEKRA

SEQ ID NO: 28280 - protein, 8 aa, Mycobacterium tuberculosis
AEAEKRAA

SEQ ID NO: 28281 - protein, 8 aa, Mycobacterium tuberculosis
EAEKRAAA

SEQ ID NO: 28282 - protein, 8 aa, Mycobacterium tuberculosis
AEKRAAAR

SEQ ID NO: 28283 - protein, 8 aa, Mycobacterium tuberculosis
EKRAAARA

SEQ ID NO: 28284 - protein, 8 aa, Mycobacterium tuberculosis
KRAAARAG

SEQ ID NO: 28285 - protein, 8 aa, Mycobacterium tuberculosis
RAAARAGH

SEQ ID NO: 28286 - protein, 8 aa, Mycobacterium tuberculosis
AAARAGHA

SEQ ID NO: 28287 - protein, 8 aa, Mycobacterium tuberculosis
AARAGHAA

SEQ ID NO: 28288 - protein, 8 aa, Mycobacterium tuberculosis
ARAGHAAT

SEQ ID NO: 28289 - protein, 9 aa, Mycobacterium tuberculosis
MHAKVGDYL

SEQ ID NO: 28290 - protein, 9 aa, Mycobacterium tuberculosis
HAKVGDYLV

SEQ ID NO: 28291 - protein, 9 aa, Mycobacterium tuberculosis
AKVGDYLVV

SEQ ID NO: 28292 - protein, 9 aa, Mycobacterium tuberculosis
KVGDYLVVK

SEQ ID NO: 28293 - protein, 9 aa, Mycobacterium tuberculosis
VGDYLVVKG

SEQ ID NO: 28294 - protein, 9 aa, Mycobacterium tuberculosis
GDYLVVKGT

SEQ ID NO: 28295 - protein, 9 aa, Mycobacterium tuberculosis
DYLVVKGTT

SEQ ID NO: 28296 - protein, 9 aa, Mycobacterium tuberculosis
YLVVKGTTT

SEQ ID NO: 28297 - protein, 9 aa, Mycobacterium tuberculosis
LVVKGTTTE

SEQ ID NO: 28298 - protein, 9 aa, Mycobacterium tuberculosis
VVKGTTTER

SEQ ID NO: 28299 - protein, 9 aa, Mycobacterium tuberculosis
VKGTTTERH

SEQ ID NO: 28300 - protein, 9 aa, Mycobacterium tuberculosis
KGTTTERHD

SEQ ID NO: 28301 - protein, 9 aa, Mycobacterium tuberculosis
GTTTERHDQ

SEQ ID NO: 28302 - protein, 9 aa, Mycobacterium tuberculosis
TTTERHDQH

SEQ ID NO: 28303 - protein, 9 aa, Mycobacterium tuberculosis
TTERHDQHA

SEQ ID NO: 28304 - protein, 9 aa, Mycobacterium tuberculosis
TERHDQHAE

SEQ ID NO: 28305 - protein, 9 aa, Mycobacterium tuberculosis
ERHDQHAEI

SEQ ID NO: 28306 - protein, 9 aa, Mycobacterium tuberculosis
RHDQHAEII

SEQ ID NO: 28307 - protein, 9 aa, Mycobacterium tuberculosis
HDQHAEIIE

SEQ ID NO: 28308 - protein, 9 aa, Mycobacterium tuberculosis
DQHAEIIEV

SEQ ID NO: 28309 - protein, 9 aa, Mycobacterium tuberculosis
QHAEIIEVR

SEQ ID NO: 28310 - protein, 9 aa, Mycobacterium tuberculosis
HAEIIEVRS

SEQ ID NO: 28311 - protein, 9 aa, Mycobacterium tuberculosis
AEIIEVRSA

SEQ ID NO: 28312 - protein, 9 aa, Mycobacterium tuberculosis
EIIEVRSAD

SEQ ID NO: 28313 - protein, 9 aa, Mycobacterium tuberculosis
IIEVRSADG

SEQ ID NO: 28314 - protein, 9 aa, Mycobacterium tuberculosis
IEVRSADGS

SEQ ID NO: 28315 - protein, 9 aa, Mycobacterium tuberculosis
EVRSADGSP

SEQ ID NO: 28316 - protein, 9 aa, Mycobacterium tuberculosis
VRSADGSPP

SEQ ID NO: 28317 - protein, 9 aa, Mycobacterium tuberculosis
RSADGSPPY

SEQ ID NO: 28318 - protein, 9 aa, Mycobacterium tuberculosis
SADGSPPYV

SEQ ID NO: 28319 - protein, 9 aa, Mycobacterium tuberculosis
ADGSPPYVV

SEQ ID NO: 28320 - protein, 9 aa, Mycobacterium tuberculosis
DGSPPYVVR

SEQ ID NO: 28321 - protein, 9 aa, Mycobacterium tuberculosis
GSPPYVVRW

SEQ ID NO: 28322 - protein, 9 aa, Mycobacterium tuberculosis
SPPYVVRWL

SEQ ID NO: 28323 - protein, 9 aa, Mycobacterium tuberculosis
PPYVVRWLV

SEQ ID NO: 28324 - protein, 9 aa, Mycobacterium tuberculosis
PYVVRWLVN

SEQ ID NO: 28325 - protein, 9 aa, Mycobacterium tuberculosis
YVVRWLVNG

SEQ ID NO: 28326 - protein, 9 aa, Mycobacterium tuberculosis
VVRWLVNGH

SEQ ID NO: 28327 - protein, 9 aa, Mycobacterium tuberculosis
VRWLVNGHE

SEQ ID NO: 28328 - protein, 9 aa, Mycobacterium tuberculosis
RWLVNGHET

SEQ ID NO: 28329 - protein, 9 aa, Mycobacterium tuberculosis
WLVNGHETT

SEQ ID NO: 28330 - protein, 9 aa, Mycobacterium tuberculosis
LVNGHETTV

SEQ ID NO: 28331 - protein, 9 aa, Mycobacterium tuberculosis
VNGHETTVY

SEQ ID NO: 28332 - protein, 9 aa, Mycobacterium tuberculosis
NGHETTVYP

SEQ ID NO: 28333 - protein, 9 aa, Mycobacterium tuberculosis
GHETTVYPG

SEQ ID NO: 28334 - protein, 9 aa, Mycobacterium tuberculosis
HETTVYPGS

SEQ ID NO: 28335 - protein, 9 aa, Mycobacterium tuberculosis
ETTVYPGSD

SEQ ID NO: 28336 - protein, 9 aa, Mycobacterium tuberculosis
TTVYPGSDA

SEQ ID NO: 28337 - protein, 9 aa, Mycobacterium tuberculosis
TVYPGSDAV

SEQ ID NO: 28338 - protein, 9 aa, Mycobacterium tuberculosis
VYPGSDAVV

SEQ ID NO: 28339 - protein, 9 aa, Mycobacterium tuberculosis
YPGSDAVVV

SEQ ID NO: 28340 - protein, 9 aa, Mycobacterium tuberculosis
PGSDAVVVT

SEQ ID NO: 28341 - protein, 9 aa, Mycobacterium tuberculosis
GSDAVVVTA

SEQ ID NO: 28342 - protein, 9 aa, Mycobacterium tuberculosis
SDAVVVTAT

SEQ ID NO: 28343 - protein, 9 aa, Mycobacterium tuberculosis
DAVVVTATE

SEQ ID NO: 28344 - protein, 9 aa, Mycobacterium tuberculosis
AVVVTATEH

SEQ ID NO: 28345 - protein, 9 aa, Mycobacterium tuberculosis
VVVTATEHA

SEQ ID NO: 28346 - protein, 9 aa, Mycobacterium tuberculosis
VVTATEHAE

SEQ ID NO: 28347 - protein, 9 aa, Mycobacterium tuberculosis
VTATEHAEA

SEQ ID NO: 28348 - protein, 9 aa, Mycobacterium tuberculosis
TATEHAEAE

SEQ ID NO: 28349 - protein, 9 aa, Mycobacterium tuberculosis
ATEHAEAEK

SEQ ID NO: 28350 - protein, 9 aa, Mycobacterium tuberculosis
TEHAEAEKR

SEQ ID NO: 28351 - protein, 9 aa, Mycobacterium tuberculosis
EHAEAEKRA

SEQ ID NO: 28352 - protein, 9 aa, Mycobacterium tuberculosis
HAEAEKRAA

SEQ ID NO: 28353 - protein, 9 aa, Mycobacterium tuberculosis
AEAEKRAAA

SEQ ID NO: 28354 - protein, 9 aa, Mycobacterium tuberculosis
EAEKRAAAR

SEQ ID NO: 28355 - protein, 9 aa, Mycobacterium tuberculosis
AEKRAAARA

SEQ ID NO: 28356 - protein, 9 aa, Mycobacterium tuberculosis
EKRAAARAG

SEQ ID NO: 28357 - protein, 9 aa, Mycobacterium tuberculosis
KRAAARAGH

SEQ ID NO: 28358 - protein, 9 aa, Mycobacterium tuberculosis
RAAARAGHA

SEQ ID NO: 28359 - protein, 9 aa, Mycobacterium tuberculosis
AAARAGHAA

SEQ ID NO: 28360 - protein, 9 aa, Mycobacterium tuberculosis
AARAGHAAT

SEQ ID NO: 28361 - protein, 10 aa, Mycobacterium tuberculosis
MHAKVGDYLV

SEQ ID NO: 28362 - protein, 10 aa, Mycobacterium tuberculosis
HAKVGDYLVV

SEQ ID NO: 28363 - protein, 10 aa, Mycobacterium tuberculosis
AKVGDYLVVK

SEQ ID NO: 28364 - protein, 10 aa, Mycobacterium tuberculosis
KVGDYLVVKG

SEQ ID NO: 28365 - protein, 10 aa, Mycobacterium tuberculosis
VGDYLVVKGT

SEQ ID NO: 28366 - protein, 10 aa, Mycobacterium tuberculosis
GDYLVVKGTT

SEQ ID NO: 28367 - protein, 10 aa, Mycobacterium tuberculosis
DYLVVKGTTT

SEQ ID NO: 28368 - protein, 10 aa, Mycobacterium tuberculosis
YLVVKGTTTE

SEQ ID NO: 28369 - protein, 10 aa, Mycobacterium tuberculosis
LVVKGTTTER

SEQ ID NO: 28370 - protein, 10 aa, Mycobacterium tuberculosis
VVKGTTTERH

SEQ ID NO: 28371 - protein, 10 aa, Mycobacterium tuberculosis
VKGTTTERHD

SEQ ID NO: 28372 - protein, 10 aa, Mycobacterium tuberculosis
KGTTTERHDQ

SEQ ID NO: 28373 - protein, 10 aa, Mycobacterium tuberculosis
GTTTERHDQH

SEQ ID NO: 28374 - protein, 10 aa, Mycobacterium tuberculosis
TTTERHDQHA

SEQ ID NO: 28375 - protein, 10 aa, Mycobacterium tuberculosis
TTERHDQHAE

SEQ ID NO: 28376 - protein, 10 aa, Mycobacterium tuberculosis
TERHDQHAEI

SEQ ID NO: 28377 - protein, 10 aa, Mycobacterium tuberculosis
ERHDQHAEII

SEQ ID NO: 28378 - protein, 10 aa, Mycobacterium tuberculosis
RHDQHAEIIE

SEQ ID NO: 28379 - protein, 10 aa, Mycobacterium tuberculosis
HDQHAEIIEV

SEQ ID NO: 28380 - protein, 10 aa, Mycobacterium tuberculosis
DQHAEIIEVR

SEQ ID NO: 28381 - protein, 10 aa, Mycobacterium tuberculosis
QHAEIIEVRS

SEQ ID NO: 28382 - protein, 10 aa, Mycobacterium tuberculosis
HAEIIEVRSA

SEQ ID NO: 28383 - protein, 10 aa, Mycobacterium tuberculosis
AEIIEVRSAD

SEQ ID NO: 28384 - protein, 10 aa, Mycobacterium tuberculosis
EIIEVRSADG

SEQ ID NO: 28385 - protein, 10 aa, Mycobacterium tuberculosis
IIEVRSADGS

SEQ ID NO: 28386 - protein, 10 aa, Mycobacterium tuberculosis
IEVRSADGSP

SEQ ID NO: 28387 - protein, 10 aa, Mycobacterium tuberculosis
EVRSADGSPP

SEQ ID NO: 28388 - protein, 10 aa, Mycobacterium tuberculosis
VRSADGSPPY

SEQ ID NO: 28389 - protein, 10 aa, Mycobacterium tuberculosis
RSADGSPPYV

SEQ ID NO: 28390 - protein, 10 aa, Mycobacterium tuberculosis
SADGSPPYVV

SEQ ID NO: 28391 - protein, 10 aa, Mycobacterium tuberculosis
ADGSPPYVVR

SEQ ID NO: 28392 - protein, 10 aa, Mycobacterium tuberculosis
DGSPPYVVRW

SEQ ID NO: 28393 - protein, 10 aa, Mycobacterium tuberculosis
GSPPYVVRWL

SEQ ID NO: 28394 - protein, 10 aa, Mycobacterium tuberculosis
SPPYVVRWLV

SEQ ID NO: 28395 - protein, 10 aa, Mycobacterium tuberculosis
PPYVVRWLVN

SEQ ID NO: 28396 - protein, 10 aa, Mycobacterium tuberculosis
PYVVRWLVNG

SEQ ID NO: 28397 - protein, 10 aa, Mycobacterium tuberculosis
YVVRWLVNGH

SEQ ID NO: 28398 - protein, 10 aa, Mycobacterium tuberculosis
VVRWLVNGHE

SEQ ID NO: 28399 - protein, 10 aa, Mycobacterium tuberculosis
VRWLVNGHET

SEQ ID NO: 28400 - protein, 10 aa, Mycobacterium tuberculosis
RWLVNGHETT

SEQ ID NO: 28401 - protein, 10 aa, Mycobacterium tuberculosis
WLVNGHETTV

SEQ ID NO: 28402 - protein, 10 aa, Mycobacterium tuberculosis
LVNGHETTVY

SEQ ID NO: 28403 - protein, 10 aa, Mycobacterium tuberculosis
VNGHETTVYP

SEQ ID NO: 28404 - protein, 10 aa, Mycobacterium tuberculosis
NGHETTVYPG

SEQ ID NO: 28405 - protein, 10 aa, Mycobacterium tuberculosis
GHETTVYPGS

SEQ ID NO: 28406 - protein, 10 aa, Mycobacterium tuberculosis
HETTVYPGSD

SEQ ID NO: 28407 - protein, 10 aa, Mycobacterium tuberculosis
ETTVYPGSDA

SEQ ID NO: 28408 - protein, 10 aa, Mycobacterium tuberculosis
TTVYPGSDAV

SEQ ID NO: 28409 - protein, 10 aa, Mycobacterium tuberculosis
TVYPGSDAVV

SEQ ID NO: 28410 - protein, 10 aa, Mycobacterium tuberculosis
VYPGSDAVVV

SEQ ID NO: 28411 - protein, 10 aa, Mycobacterium tuberculosis
YPGSDAVVVT

SEQ ID NO: 28412 - protein, 10 aa, Mycobacterium tuberculosis
PGSDAVVVTA

SEQ ID NO: 28413 - protein, 10 aa, Mycobacterium tuberculosis
GSDAVVVTAT

SEQ ID NO: 28414 - protein, 10 aa, Mycobacterium tuberculosis
SDAVVVTATE

SEQ ID NO: 28415 - protein, 10 aa, Mycobacterium tuberculosis
DAVVVTATEH

SEQ ID NO: 28416 - protein, 10 aa, Mycobacterium tuberculosis
AVVVTATEHA

SEQ ID NO: 28417 - protein, 10 aa, Mycobacterium tuberculosis
VVVTATEHAE

SEQ ID NO: 28418 - protein, 10 aa, Mycobacterium tuberculosis
VVTATEHAEA

SEQ ID NO: 28419 - protein, 10 aa, Mycobacterium tuberculosis
VTATEHAEAE

SEQ ID NO: 28420 - protein, 10 aa, Mycobacterium tuberculosis
TATEHAEAEK

SEQ ID NO: 28421 - protein, 10 aa, Mycobacterium tuberculosis
ATEHAEAEKR

SEQ ID NO: 28422 - protein, 10 aa, Mycobacterium tuberculosis
TEHAEAEKRA

SEQ ID NO: 28423 - protein, 10 aa, Mycobacterium tuberculosis
EHAEAEKRAA

SEQ ID NO: 28424 - protein, 10 aa, Mycobacterium tuberculosis
HAEAEKRAAA

SEQ ID NO: 28425 - protein, 10 aa, Mycobacterium tuberculosis
AEAEKRAAAR

SEQ ID NO: 28426 - protein, 10 aa, Mycobacterium tuberculosis
EAEKRAAARA

SEQ ID NO: 28427 - protein, 10 aa, Mycobacterium tuberculosis
AEKRAAARAG

SEQ ID NO: 28428 - protein, 10 aa, Mycobacterium tuberculosis
EKRAAARAGH

SEQ ID NO: 28429 - protein, 10 aa, Mycobacterium tuberculosis
KRAAARAGHA

SEQ ID NO: 28430 - protein, 10 aa, Mycobacterium tuberculosis
RAAARAGHAA

SEQ ID NO: 28431 - protein, 10 aa, Mycobacterium tuberculosis
AAARAGHAAT

SEQ ID NO: 28432 - protein, 11 aa, Mycobacterium tuberculosis
MHAKVGDYLVV

SEQ ID NO: 28433 - protein, 11 aa, Mycobacterium tuberculosis
HAKVGDYLVVK

SEQ ID NO: 28434 - protein, 11 aa, Mycobacterium tuberculosis
AKVGDYLVVKG

SEQ ID NO: 28435 - protein, 11 aa, Mycobacterium tuberculosis
KVGDYLVVKGT

SEQ ID NO: 28436 - protein, 11 aa, Mycobacterium tuberculosis
VGDYLVVKGTT

SEQ ID NO: 28437 - protein, 11 aa, Mycobacterium tuberculosis
GDYLVVKGTTT

SEQ ID NO: 28438 - protein, 11 aa, Mycobacterium tuberculosis
DYLVVKGTTTE

SEQ ID NO: 28439 - protein, 11 aa, Mycobacterium tuberculosis
YLVVKGTTTER

SEQ ID NO: 28440 - protein, 11 aa, Mycobacterium tuberculosis
LVVKGTTTERH

SEQ ID NO: 28441 - protein, 11 aa, Mycobacterium tuberculosis
VVKGTTTERHD

SEQ ID NO: 28442 - protein, 11 aa, Mycobacterium tuberculosis
VKGTTTERHDQ

SEQ ID NO: 28443 - protein, 11 aa, Mycobacterium tuberculosis
KGTTTERHDQH

SEQ ID NO: 28444 - protein, 11 aa, Mycobacterium tuberculosis
GTTTERHDQHA

SEQ ID NO: 28445 - protein, 11 aa, Mycobacterium tuberculosis
TTTERHDQHAE

SEQ ID NO: 28446 - protein, 11 aa, Mycobacterium tuberculosis
TTERHDQHAEI

SEQ ID NO: 28447 - protein, 11 aa, Mycobacterium tuberculosis
TERHDQHAEII

SEQ ID NO: 28448 - protein, 11 aa, Mycobacterium tuberculosis
ERHDQHAEIIE

SEQ ID NO: 28449 - protein, 11 aa, Mycobacterium tuberculosis
RHDQHAEIIEV

SEQ ID NO: 28450 - protein, 11 aa, Mycobacterium tuberculosis
HDQHAEIIEVR

SEQ ID NO: 28451 - protein, 11 aa, Mycobacterium tuberculosis
DQHAEIIEVRS

SEQ ID NO: 28452 - protein, 11 aa, Mycobacterium tuberculosis
QHAEIIEVRSA

SEQ ID NO: 28453 - protein, 11 aa, Mycobacterium tuberculosis
HAEIIEVRSAD

SEQ ID NO: 28454 - protein, 11 aa, Mycobacterium tuberculosis
AEIIEVRSADG

SEQ ID NO: 28455 - protein, 11 aa, Mycobacterium tuberculosis
EIIEVRSADGS

SEQ ID NO: 28456 - protein, 11 aa, Mycobacterium tuberculosis
IIEVRSADGSP

SEQ ID NO: 28457 - protein, 11 aa, Mycobacterium tuberculosis
IEVRSADGSPP

SEQ ID NO: 28458 - protein, 11 aa, Mycobacterium tuberculosis
EVRSADGSPPY

SEQ ID NO: 28459 - protein, 11 aa, Mycobacterium tuberculosis
VRSADGSPPYV

SEQ ID NO: 28460 - protein, 11 aa, Mycobacterium tuberculosis
RSADGSPPYVV

SEQ ID NO: 28461 - protein, 11 aa, Mycobacterium tuberculosis
SADGSPPYVVR

SEQ ID NO: 28462 - protein, 11 aa, Mycobacterium tuberculosis
ADGSPPYVVRW

SEQ ID NO: 28463 - protein, 11 aa, Mycobacterium tuberculosis
DGSPPYVVRWL

SEQ ID NO: 28464 - protein, 11 aa, Mycobacterium tuberculosis
GSPPYVVRWLV

SEQ ID NO: 28465 - protein, 11 aa, Mycobacterium tuberculosis
SPPYVVRWLVN

SEQ ID NO: 28466 - protein, 11 aa, Mycobacterium tuberculosis
PPYVVRWLVNG

SEQ ID NO: 28467 - protein, 11 aa, Mycobacterium tuberculosis
PYVVRWLVNGH

SEQ ID NO: 28468 - protein, 11 aa, Mycobacterium tuberculosis
YVVRWLVNGHE

SEQ ID NO: 28469 - protein, 11 aa, Mycobacterium tuberculosis
VVRWLVNGHET

SEQ ID NO: 28470 - protein, 11 aa, Mycobacterium tuberculosis
VRWLVNGHETT

SEQ ID NO: 28471 - protein, 11 aa, Mycobacterium tuberculosis
RWLVNGHETTV

SEQ ID NO: 28472 - protein, 11 aa, Mycobacterium tuberculosis
WLVNGHETTVY

SEQ ID NO: 28473 - protein, 11 aa, Mycobacterium tuberculosis
LVNGHETTVYP

SEQ ID NO: 28474 - protein, 11 aa, Mycobacterium tuberculosis
VNGHETTVYPG

SEQ ID NO: 28475 - protein, 11 aa, Mycobacterium tuberculosis
NGHETTVYPGS

SEQ ID NO: 28476 - protein, 11 aa, Mycobacterium tuberculosis
GHETTVYPGSD

SEQ ID NO: 28477 - protein, 11 aa, Mycobacterium tuberculosis
HETTVYPGSDA

SEQ ID NO: 28478 - protein, 11 aa, Mycobacterium tuberculosis
ETTVYPGSDAV

SEQ ID NO: 28479 - protein, 11 aa, Mycobacterium tuberculosis
TTVYPGSDAVV

SEQ ID NO: 28480 - protein, 11 aa, Mycobacterium tuberculosis
TVYPGSDAVVV

SEQ ID NO: 28481 - protein, 11 aa, Mycobacterium tuberculosis
VYPGSDAVVVT

SEQ ID NO: 28482 - protein, 11 aa, Mycobacterium tuberculosis
YPGSDAVVVTA

SEQ ID NO: 28483 - protein, 11 aa, Mycobacterium tuberculosis
PGSDAVVVTAT

SEQ ID NO: 28484 - protein, 11 aa, Mycobacterium tuberculosis
GSDAVVVTATE

SEQ ID NO: 28485 - protein, 11 aa, Mycobacterium tuberculosis
SDAVVVTATEH

SEQ ID NO: 28486 - protein, 11 aa, Mycobacterium tuberculosis
DAVVVTATEHA

SEQ ID NO: 28487 - protein, 11 aa, Mycobacterium tuberculosis
AVVVTATEHAE

SEQ ID NO: 28488 - protein, 11 aa, Mycobacterium tuberculosis
VVVTATEHAEA

SEQ ID NO: 28489 - protein, 11 aa, Mycobacterium tuberculosis
VVTATEHAEAE

SEQ ID NO: 28490 - protein, 11 aa, Mycobacterium tuberculosis
VTATEHAEAEK

SEQ ID NO: 28491 - protein, 11 aa, Mycobacterium tuberculosis
TATEHAEAEKR

SEQ ID NO: 28492 - protein, 11 aa, Mycobacterium tuberculosis
ATEHAEAEKRA

SEQ ID NO: 28493 - protein, 11 aa, Mycobacterium tuberculosis
TEHAEAEKRAA

SEQ ID NO: 28494 - protein, 11 aa, Mycobacterium tuberculosis
EHAEAEKRAAA

SEQ ID NO: 28495 - protein, 11 aa, Mycobacterium tuberculosis
HAEAEKRAAAR

SEQ ID NO: 28496 - protein, 11 aa, Mycobacterium tuberculosis
AEAEKRAAARA

SEQ ID NO: 28497 - protein, 11 aa, Mycobacterium tuberculosis
EAEKRAAARAG

SEQ ID NO: 28498 - protein, 11 aa, Mycobacterium tuberculosis
AEKRAAARAGH

SEQ ID NO: 28499 - protein, 11 aa, Mycobacterium tuberculosis
EKRAAARAGHA

SEQ ID NO: 28500 - protein, 11 aa, Mycobacterium tuberculosis
KRAAARAGHAA

SEQ ID NO: 28501 - protein, 11 aa, Mycobacterium tuberculosis
RAAARAGHAAT

SEQ ID NO: 28502 - protein, 8 aa, Mycobacterium tuberculosis
MTINYQFG

SEQ ID NO: 28503 - protein, 8 aa, Mycobacterium tuberculosis
TINYQFGD

SEQ ID NO: 28504 - protein, 8 aa, Mycobacterium tuberculosis
INYQFGDV

SEQ ID NO: 28505 - protein, 8 aa, Mycobacterium tuberculosis
NYQFGDVD

SEQ ID NO: 28506 - protein, 8 aa, Mycobacterium tuberculosis
YQFGDVDA

SEQ ID NO: 28507 - protein, 8 aa, Mycobacterium tuberculosis
QFGDVDAH

SEQ ID NO: 28508 - protein, 8 aa, Mycobacterium tuberculosis
FGDVDAHG

SEQ ID NO: 28509 - protein, 8 aa, Mycobacterium tuberculosis
GDVDAHGA

SEQ ID NO: 28510 - protein, 8 aa, Mycobacterium tuberculosis
DVDAHGAM

SEQ ID NO: 28511 - protein, 8 aa, Mycobacterium tuberculosis
VDAHGAMI

SEQ ID NO: 28512 - protein, 8 aa, Mycobacterium tuberculosis
DAHGAMIR

SEQ ID NO: 28513 - protein, 8 aa, Mycobacterium tuberculosis
AHGAMIRA

SEQ ID NO: 28514 - protein, 8 aa, Mycobacterium tuberculosis
HGAMIRAQ

SEQ ID NO: 28515 - protein, 8 aa, Mycobacterium tuberculosis
GAMIRAQA

SEQ ID NO: 28516 - protein, 8 aa, Mycobacterium tuberculosis
AMIRAQAG

SEQ ID NO: 28517 - protein, 8 aa, Mycobacterium tuberculosis
MIRAQAGL

SEQ ID NO: 28518 - protein, 8 aa, Mycobacterium tuberculosis
IRAQAGLL

SEQ ID NO: 28519 - protein, 8 aa, Mycobacterium tuberculosis
RAQAGLLE

SEQ ID NO: 28520 - protein, 8 aa, Mycobacterium tuberculosis
AQAGLLEA

SEQ ID NO: 28521 - protein, 8 aa, Mycobacterium tuberculosis
QAGLLEAE

SEQ ID NO: 28522 - protein, 8 aa, Mycobacterium tuberculosis
AGLLEAEH

SEQ ID NO: 28523 - protein, 8 aa, Mycobacterium tuberculosis
GLLEAEHQ

SEQ ID NO: 28524 - protein, 8 aa, Mycobacterium tuberculosis
LLEAEHQA

SEQ ID NO: 28525 - protein, 8 aa, Mycobacterium tuberculosis
LEAEHQAI

SEQ ID NO: 28526 - protein, 8 aa, Mycobacterium tuberculosis
EAEHQAIV

SEQ ID NO: 28527 - protein, 8 aa, Mycobacterium tuberculosis
AEHQAIVR

SEQ ID NO: 28528 - protein, 8 aa, Mycobacterium tuberculosis
EHQAIVRD

SEQ ID NO: 28529 - protein, 8 aa, Mycobacterium tuberculosis
HQAIVRDV

SEQ ID NO: 28530 - protein, 8 aa, Mycobacterium tuberculosis
QAIVRDVL

SEQ ID NO: 28531 - protein, 8 aa, Mycobacterium tuberculosis
AIVRDVLA

SEQ ID NO: 28532 - protein, 8 aa, Mycobacterium tuberculosis
IVRDVLAA

SEQ ID NO: 28533 - protein, 8 aa, Mycobacterium tuberculosis
VRDVLAAG

SEQ ID NO: 28534 - protein, 8 aa, Mycobacterium tuberculosis
RDVLAAGD

SEQ ID NO: 28535 - protein, 8 aa, Mycobacterium tuberculosis
DVLAAGDF

SEQ ID NO: 28536 - protein, 8 aa, Mycobacterium tuberculosis
VLAAGDFW

SEQ ID NO: 28537 - protein, 8 aa, Mycobacterium tuberculosis
LAAGDFWG

SEQ ID NO: 28538 - protein, 8 aa, Mycobacterium tuberculosis
AAGDFWGG

SEQ ID NO: 28539 - protein, 8 aa, Mycobacterium tuberculosis
AGDFWGGA

SEQ ID NO: 28540 - protein, 8 aa, Mycobacterium tuberculosis
GDFWGGAG

SEQ ID NO: 28541 - protein, 8 aa, Mycobacterium tuberculosis
DFWGGAGS

SEQ ID NO: 28542 - protein, 8 aa, Mycobacterium tuberculosis
FWGGAGSV

SEQ ID NO: 28543 - protein, 8 aa, Mycobacterium tuberculosis
WGGAGSVA

SEQ ID NO: 28544 - protein, 8 aa, Mycobacterium tuberculosis
GGAGSVAC

SEQ ID NO: 28545 - protein, 8 aa, Mycobacterium tuberculosis
GAGSVACQ

SEQ ID NO: 28546 - protein, 8 aa, Mycobacterium tuberculosis
AGSVACQE

SEQ ID NO: 28547 - protein, 8 aa, Mycobacterium tuberculosis
GSVACQEF

SEQ ID NO: 28548 - protein, 8 aa, Mycobacterium tuberculosis
SVACQEFI

SEQ ID NO: 28549 - protein, 8 aa, Mycobacterium tuberculosis
VACQEFIT

SEQ ID NO: 28550 - protein, 8 aa, Mycobacterium tuberculosis
ACQEFITQ

SEQ ID NO: 28551 - protein, 8 aa, Mycobacterium tuberculosis
CQEFITQL

SEQ ID NO: 28552 - protein, 8 aa, Mycobacterium tuberculosis
QEFITQLG

SEQ ID NO: 28553 - protein, 8 aa, Mycobacterium tuberculosis
EFITQLGR

SEQ ID NO: 28554 - protein, 8 aa, Mycobacterium tuberculosis
FITQLGRN

SEQ ID NO: 28555 - protein, 8 aa, Mycobacterium tuberculosis
ITQLGRNF

SEQ ID NO: 28556 - protein, 8 aa, Mycobacterium tuberculosis
TQLGRNFQ

SEQ ID NO: 28557 - protein, 8 aa, Mycobacterium tuberculosis
QLGRNFQV

SEQ ID NO: 28558 - protein, 8 aa, Mycobacterium tuberculosis
LGRNFQVI

SEQ ID NO: 28559 - protein, 8 aa, Mycobacterium tuberculosis
GRNFQVIY

SEQ ID NO: 28560 - protein, 8 aa, Mycobacterium tuberculosis
RNFQVIYE

SEQ ID NO: 28561 - protein, 8 aa, Mycobacterium tuberculosis
NFQVIYEQ

SEQ ID NO: 28562 - protein, 8 aa, Mycobacterium tuberculosis
FQVIYEQA

SEQ ID NO: 28563 - protein, 8 aa, Mycobacterium tuberculosis
QVIYEQAN

SEQ ID NO: 28564 - protein, 8 aa, Mycobacterium tuberculosis
VIYEQANA

SEQ ID NO: 28565 - protein, 8 aa, Mycobacterium tuberculosis
IYEQANAH

SEQ ID NO: 28566 - protein, 8 aa, Mycobacterium tuberculosis
YEQANAHG

SEQ ID NO: 28567 - protein, 8 aa, Mycobacterium tuberculosis
EQANAHGQ

SEQ ID NO: 28568 - protein, 8 aa, Mycobacterium tuberculosis
QANAHGQK

SEQ ID NO: 28569 - protein, 8 aa, Mycobacterium tuberculosis
ANAHGQKV

SEQ ID NO: 28570 - protein, 8 aa, Mycobacterium tuberculosis
NAHGQKVQ

SEQ ID NO: 28571 - protein, 8 aa, Mycobacterium tuberculosis
AHGQKVQA

SEQ ID NO: 28572 - protein, 8 aa, Mycobacterium tuberculosis
HGQKVQAA

SEQ ID NO: 28573 - protein, 8 aa, Mycobacterium tuberculosis
GQKVQAAG

SEQ ID NO: 28574 - protein, 8 aa, Mycobacterium tuberculosis
QKVQAAGN

SEQ ID NO: 28575 - protein, 8 aa, Mycobacterium tuberculosis
KVQAAGNN

SEQ ID NO: 28576 - protein, 8 aa, Mycobacterium tuberculosis
VQAAGNNM

SEQ ID NO: 28577 - protein, 8 aa, Mycobacterium tuberculosis
QAAGNNMA

SEQ ID NO: 28578 - protein, 8 aa, Mycobacterium tuberculosis
AAGNNMAQ

SEQ ID NO: 28579 - protein, 8 aa, Mycobacterium tuberculosis
AGNNMAQT

SEQ ID NO: 28580 - protein, 8 aa, Mycobacterium tuberculosis
GNNMAQTD

SEQ ID NO: 28581 - protein, 8 aa, Mycobacterium tuberculosis
NNMAQTDS

SEQ ID NO: 28582 - protein, 8 aa, Mycobacterium tuberculosis
NMAQTDSA

SEQ ID NO: 28583 - protein, 8 aa, Mycobacterium tuberculosis
MAQTDSAV

SEQ ID NO: 28584 - protein, 8 aa, Mycobacterium tuberculosis
AQTDSAVG

SEQ ID NO: 28585 - protein, 8 aa, Mycobacterium tuberculosis
QTDSAVGS

SEQ ID NO: 28586 - protein, 8 aa, Mycobacterium tuberculosis
TDSAVGSS

SEQ ID NO: 28587 - protein, 8 aa, Mycobacterium tuberculosis
DSAVGSSW

SEQ ID NO: 28588 - protein, 8 aa, Mycobacterium tuberculosis
SAVGSSWA

SEQ ID NO: 28589 - protein, 9 aa, Mycobacterium tuberculosis
MTINYQFGD

SEQ ID NO: 28590 - protein, 9 aa, Mycobacterium tuberculosis
TINYQFGDV

SEQ ID NO: 28591 - protein, 9 aa, Mycobacterium tuberculosis
INYQFGDVD

SEQ ID NO: 28592 - protein, 9 aa, Mycobacterium tuberculosis
NYQFGDVDA

SEQ ID NO: 28593 - protein, 9 aa, Mycobacterium tuberculosis
YQFGDVDAH

SEQ ID NO: 28594 - protein, 9 aa, Mycobacterium tuberculosis
QFGDVDAHG

SEQ ID NO: 28595 - protein, 9 aa, Mycobacterium tuberculosis
FGDVDAHGA

SEQ ID NO: 28596 - protein, 9 aa, Mycobacterium tuberculosis
GDVDAHGAM

SEQ ID NO: 28597 - protein, 9 aa, Mycobacterium tuberculosis
DVDAHGAMI

SEQ ID NO: 28598 - protein, 9 aa, Mycobacterium tuberculosis
VDAHGAMIR

SEQ ID NO: 28599 - protein, 9 aa, Mycobacterium tuberculosis
DAHGAMIRA

SEQ ID NO: 28600 - protein, 9 aa, Mycobacterium tuberculosis
AHGAMIRAQ

SEQ ID NO: 28601 - protein, 9 aa, Mycobacterium tuberculosis
HGAMIRAQA

SEQ ID NO: 28602 - protein, 9 aa, Mycobacterium tuberculosis
GAMIRAQAG

SEQ ID NO: 28603 - protein, 9 aa, Mycobacterium tuberculosis
AMIRAQAGL

SEQ ID NO: 28604 - protein, 9 aa, Mycobacterium tuberculosis
MIRAQAGLL

SEQ ID NO: 28605 - protein, 9 aa, Mycobacterium tuberculosis
IRAQAGLLE

SEQ ID NO: 28606 - protein, 9 aa, Mycobacterium tuberculosis
RAQAGLLEA

SEQ ID NO: 28607 - protein, 9 aa, Mycobacterium tuberculosis
AQAGLLEAE

SEQ ID NO: 28608 - protein, 9 aa, Mycobacterium tuberculosis
QAGLLEAEH

SEQ ID NO: 28609 - protein, 9 aa, Mycobacterium tuberculosis
AGLLEAEHQ

SEQ ID NO: 28610 - protein, 9 aa, Mycobacterium tuberculosis
GLLEAEHQA

SEQ ID NO: 28611 - protein, 9 aa, Mycobacterium tuberculosis
LLEAEHQAI

SEQ ID NO: 28612 - protein, 9 aa, Mycobacterium tuberculosis
LEAEHQAIV

SEQ ID NO: 28613 - protein, 9 aa, Mycobacterium tuberculosis
EAEHQAIVR

SEQ ID NO: 28614 - protein, 9 aa, Mycobacterium tuberculosis
AEHQAIVRD

SEQ ID NO: 28615 - protein, 9 aa, Mycobacterium tuberculosis
EHQAIVRDV

SEQ ID NO: 28616 - protein, 9 aa, Mycobacterium tuberculosis
HQAIVRDVL

SEQ ID NO: 28617 - protein, 9 aa, Mycobacterium tuberculosis
QAIVRDVLA

SEQ ID NO: 28618 - protein, 9 aa, Mycobacterium tuberculosis
AIVRDVLAA

SEQ ID NO: 28619 - protein, 9 aa, Mycobacterium tuberculosis
IVRDVLAAG

SEQ ID NO: 28620 - protein, 9 aa, Mycobacterium tuberculosis
VRDVLAAGD

SEQ ID NO: 28621 - protein, 9 aa, Mycobacterium tuberculosis
RDVLAAGDF

SEQ ID NO: 28622 - protein, 9 aa, Mycobacterium tuberculosis
DVLAAGDFW

SEQ ID NO: 28623 - protein, 9 aa, Mycobacterium tuberculosis
VLAAGDFWG

SEQ ID NO: 28624 - protein, 9 aa, Mycobacterium tuberculosis
LAAGDFWGG

SEQ ID NO: 28625 - protein, 9 aa, Mycobacterium tuberculosis
AAGDFWGGA

SEQ ID NO: 28626 - protein, 9 aa, Mycobacterium tuberculosis
AGDFWGGAG

SEQ ID NO: 28627 - protein, 9 aa, Mycobacterium tuberculosis
GDFWGGAGS

SEQ ID NO: 28628 - protein, 9 aa, Mycobacterium tuberculosis
DFWGGAGSV

SEQ ID NO: 28629 - protein, 9 aa, Mycobacterium tuberculosis
FWGGAGSVA

SEQ ID NO: 28630 - protein, 9 aa, Mycobacterium tuberculosis
WGGAGSVAC

SEQ ID NO: 28631 - protein, 9 aa, Mycobacterium tuberculosis
GGAGSVACQ

SEQ ID NO: 28632 - protein, 9 aa, Mycobacterium tuberculosis
GAGSVACQE

SEQ ID NO: 28633 - protein, 9 aa, Mycobacterium tuberculosis
AGSVACQEF

SEQ ID NO: 28634 - protein, 9 aa, Mycobacterium tuberculosis
GSVACQEFI

SEQ ID NO: 28635 - protein, 9 aa, Mycobacterium tuberculosis
SVACQEFIT

SEQ ID NO: 28636 - protein, 9 aa, Mycobacterium tuberculosis
VACQEFITQ

SEQ ID NO: 28637 - protein, 9 aa, Mycobacterium tuberculosis
ACQEFITQL

SEQ ID NO: 28638 - protein, 9 aa, Mycobacterium tuberculosis
CQEFITQLG

SEQ ID NO: 28639 - protein, 9 aa, Mycobacterium tuberculosis
QEFITQLGR

SEQ ID NO: 28640 - protein, 9 aa, Mycobacterium tuberculosis
EFITQLGRN

SEQ ID NO: 28641 - protein, 9 aa, Mycobacterium tuberculosis
FITQLGRNF

SEQ ID NO: 28642 - protein, 9 aa, Mycobacterium tuberculosis
ITQLGRNFQ

SEQ ID NO: 28643 - protein, 9 aa, Mycobacterium tuberculosis
TQLGRNFQV

SEQ ID NO: 28644 - protein, 9 aa, Mycobacterium tuberculosis
QLGRNFQVI

SEQ ID NO: 28645 - protein, 9 aa, Mycobacterium tuberculosis
LGRNFQVIY

SEQ ID NO: 28646 - protein, 9 aa, Mycobacterium tuberculosis
GRNFQVIYE

SEQ ID NO: 28647 - protein, 9 aa, Mycobacterium tuberculosis
RNFQVIYEQ

SEQ ID NO: 28648 - protein, 9 aa, Mycobacterium tuberculosis
NFQVIYEQA

SEQ ID NO: 28649 - protein, 9 aa, Mycobacterium tuberculosis
FQVIYEQAN

SEQ ID NO: 28650 - protein, 9 aa, Mycobacterium tuberculosis
QVIYEQANA

SEQ ID NO: 28651 - protein, 9 aa, Mycobacterium tuberculosis
VIYEQANAH

SEQ ID NO: 28652 - protein, 9 aa, Mycobacterium tuberculosis
IYEQANAHG

SEQ ID NO: 28653 - protein, 9 aa, Mycobacterium tuberculosis
YEQANAHGQ

SEQ ID NO: 28654 - protein, 9 aa, Mycobacterium tuberculosis
EQANAHGQK

SEQ ID NO: 28655 - protein, 9 aa, Mycobacterium tuberculosis
QANAHGQKV

SEQ ID NO: 28656 - protein, 9 aa, Mycobacterium tuberculosis
ANAHGQKVQ

SEQ ID NO: 28657 - protein, 9 aa, Mycobacterium tuberculosis
NAHGQKVQA

SEQ ID NO: 28658 - protein, 9 aa, Mycobacterium tuberculosis
AHGQKVQAA

SEQ ID NO: 28659 - protein, 9 aa, Mycobacterium tuberculosis
HGQKVQAAG

SEQ ID NO: 28660 - protein, 9 aa, Mycobacterium tuberculosis
GQKVQAAGN

SEQ ID NO: 28661 - protein, 9 aa, Mycobacterium tuberculosis
QKVQAAGNN

SEQ ID NO: 28662 - protein, 9 aa, Mycobacterium tuberculosis
KVQAAGNNM

SEQ ID NO: 28663 - protein, 9 aa, Mycobacterium tuberculosis
VQAAGNNMA

SEQ ID NO: 28664 - protein, 9 aa, Mycobacterium tuberculosis
QAAGNNMAQ

SEQ ID NO: 28665 - protein, 9 aa, Mycobacterium tuberculosis
AAGNNMAQT

SEQ ID NO: 28666 - protein, 9 aa, Mycobacterium tuberculosis
AGNNMAQTD

SEQ ID NO: 28667 - protein, 9 aa, Mycobacterium tuberculosis
GNNMAQTDS

SEQ ID NO: 28668 - protein, 9 aa, Mycobacterium tuberculosis
NNMAQTDSA

SEQ ID NO: 28669 - protein, 9 aa, Mycobacterium tuberculosis
NMAQTDSAV

SEQ ID NO: 28670 - protein, 9 aa, Mycobacterium tuberculosis
MAQTDSAVG

SEQ ID NO: 28671 - protein, 9 aa, Mycobacterium tuberculosis
AQTDSAVGS

SEQ ID NO: 28672 - protein, 9 aa, Mycobacterium tuberculosis
QTDSAVGSS

SEQ ID NO: 28673 - protein, 9 aa, Mycobacterium tuberculosis
TDSAVGSSW

SEQ ID NO: 28674 - protein, 9 aa, Mycobacterium tuberculosis
DSAVGSSWA

SEQ ID NO: 28675 - protein, 10 aa, Mycobacterium tuberculosis
MTINYQFGDV

SEQ ID NO: 28676 - protein, 10 aa, Mycobacterium tuberculosis
TINYQFGDVD

SEQ ID NO: 28677 - protein, 10 aa, Mycobacterium tuberculosis
INYQFGDVDA

SEQ ID NO: 28678 - protein, 10 aa, Mycobacterium tuberculosis
NYQFGDVDAH

SEQ ID NO: 28679 - protein, 10 aa, Mycobacterium tuberculosis
YQFGDVDAHG

SEQ ID NO: 28680 - protein, 10 aa, Mycobacterium tuberculosis
QFGDVDAHGA

SEQ ID NO: 28681 - protein, 10 aa, Mycobacterium tuberculosis
FGDVDAHGAM

SEQ ID NO: 28682 - protein, 10 aa, Mycobacterium tuberculosis
GDVDAHGAMI

SEQ ID NO: 28683 - protein, 10 aa, Mycobacterium tuberculosis
DVDAHGAMIR

SEQ ID NO: 28684 - protein, 10 aa, Mycobacterium tuberculosis
VDAHGAMIRA

SEQ ID NO: 28685 - protein, 10 aa, Mycobacterium tuberculosis
DAHGAMIRAQ

SEQ ID NO: 28686 - protein, 10 aa, Mycobacterium tuberculosis
AHGAMIRAQA

SEQ ID NO: 28687 - protein, 10 aa, Mycobacterium tuberculosis
HGAMIRAQAG

SEQ ID NO: 28688 - protein, 10 aa, Mycobacterium tuberculosis
GAMIRAQAGL

SEQ ID NO: 28689 - protein, 10 aa, Mycobacterium tuberculosis
AMIRAQAGLL

SEQ ID NO: 28690 - protein, 10 aa, Mycobacterium tuberculosis
MIRAQAGLLE

SEQ ID NO: 28691 - protein, 10 aa, Mycobacterium tuberculosis
IRAQAGLLEA

SEQ ID NO: 28692 - protein, 10 aa, Mycobacterium tuberculosis
RAQAGLLEAE

SEQ ID NO: 28693 - protein, 10 aa, Mycobacterium tuberculosis
AQAGLLEAEH

SEQ ID NO: 28694 - protein, 10 aa, Mycobacterium tuberculosis
QAGLLEAEHQ

SEQ ID NO: 28695 - protein, 10 aa, Mycobacterium tuberculosis
AGLLEAEHQA

SEQ ID NO: 28696 - protein, 10 aa, Mycobacterium tuberculosis
GLLEAEHQAI

SEQ ID NO: 28697 - protein, 10 aa, Mycobacterium tuberculosis
LLEAEHQAIV

SEQ ID NO: 28698 - protein, 10 aa, Mycobacterium tuberculosis
LEAEHQAIVR

SEQ ID NO: 28699 - protein, 10 aa, Mycobacterium tuberculosis
EAEHQAIVRD

SEQ ID NO: 28700 - protein, 10 aa, Mycobacterium tuberculosis
AEHQAIVRDV

SEQ ID NO: 28701 - protein, 10 aa, Mycobacterium tuberculosis
EHQAIVRDVL

SEQ ID NO: 28702 - protein, 10 aa, Mycobacterium tuberculosis
HQAIVRDVLA

SEQ ID NO: 28703 - protein, 10 aa, Mycobacterium tuberculosis
QAIVRDVLAA

SEQ ID NO: 28704 - protein, 10 aa, Mycobacterium tuberculosis
AIVRDVLAAG

SEQ ID NO: 28705 - protein, 10 aa, Mycobacterium tuberculosis
IVRDVLAAGD

SEQ ID NO: 28706 - protein, 10 aa, Mycobacterium tuberculosis
VRDVLAAGDF

SEQ ID NO: 28707 - protein, 10 aa, Mycobacterium tuberculosis
RDVLAAGDFW

SEQ ID NO: 28708 - protein, 10 aa, Mycobacterium tuberculosis
DVLAAGDFWG

SEQ ID NO: 28709 - protein, 10 aa, Mycobacterium tuberculosis
VLAAGDFWGG

SEQ ID NO: 28710 - protein, 10 aa, Mycobacterium tuberculosis
LAAGDFWGGA

SEQ ID NO: 28711 - protein, 10 aa, Mycobacterium tuberculosis
AAGDFWGGAG

SEQ ID NO: 28712 - protein, 10 aa, Mycobacterium tuberculosis
AGDFWGGAGS

SEQ ID NO: 28713 - protein, 10 aa, Mycobacterium tuberculosis
GDFWGGAGSV

SEQ ID NO: 28714 - protein, 10 aa, Mycobacterium tuberculosis
DFWGGAGSVA

SEQ ID NO: 28715 - protein, 10 aa, Mycobacterium tuberculosis
FWGGAGSVAC

SEQ ID NO: 28716 - protein, 10 aa, Mycobacterium tuberculosis
WGGAGSVACQ

SEQ ID NO: 28717 - protein, 10 aa, Mycobacterium tuberculosis
GGAGSVACQE

SEQ ID NO: 28718 - protein, 10 aa, Mycobacterium tuberculosis
GAGSVACQEF

SEQ ID NO: 28719 - protein, 10 aa, Mycobacterium tuberculosis
AGSVACQEFI

SEQ ID NO: 28720 - protein, 10 aa, Mycobacterium tuberculosis
GSVACQEFIT

SEQ ID NO: 28721 - protein, 10 aa, Mycobacterium tuberculosis
SVACQEFITQ

SEQ ID NO: 28722 - protein, 10 aa, Mycobacterium tuberculosis
VACQEFITQL

SEQ ID NO: 28723 - protein, 10 aa, Mycobacterium tuberculosis
ACQEFITQLG

SEQ ID NO: 28724 - protein, 10 aa, Mycobacterium tuberculosis
CQEFITQLGR

SEQ ID NO: 28725 - protein, 10 aa, Mycobacterium tuberculosis
QEFITQLGRN

SEQ ID NO: 28726 - protein, 10 aa, Mycobacterium tuberculosis
EFITQLGRNF

SEQ ID NO: 28727 - protein, 10 aa, Mycobacterium tuberculosis
FITQLGRNFQ

SEQ ID NO: 28728 - protein, 10 aa, Mycobacterium tuberculosis
ITQLGRNFQV

SEQ ID NO: 28729 - protein, 10 aa, Mycobacterium tuberculosis
TQLGRNFQVI

SEQ ID NO: 28730 - protein, 10 aa, Mycobacterium tuberculosis
QLGRNFQVIY

SEQ ID NO: 28731 - protein, 10 aa, Mycobacterium tuberculosis
LGRNFQVIYE

SEQ ID NO: 28732 - protein, 10 aa, Mycobacterium tuberculosis
GRNFQVIYEQ

SEQ ID NO: 28733 - protein, 10 aa, Mycobacterium tuberculosis
RNFQVIYEQA

SEQ ID NO: 28734 - protein, 10 aa, Mycobacterium tuberculosis
NFQVIYEQAN

SEQ ID NO: 28735 - protein, 10 aa, Mycobacterium tuberculosis
FQVIYEQANA

SEQ ID NO: 28736 - protein, 10 aa, Mycobacterium tuberculosis
QVIYEQANAH

SEQ ID NO: 28737 - protein, 10 aa, Mycobacterium tuberculosis
VIYEQANAHG

SEQ ID NO: 28738 - protein, 10 aa, Mycobacterium tuberculosis
IYEQANAHGQ

SEQ ID NO: 28739 - protein, 10 aa, Mycobacterium tuberculosis
YEQANAHGQK

SEQ ID NO: 28740 - protein, 10 aa, Mycobacterium tuberculosis
EQANAHGQKV

SEQ ID NO: 28741 - protein, 10 aa, Mycobacterium tuberculosis
QANAHGQKVQ

SEQ ID NO: 28742 - protein, 10 aa, Mycobacterium tuberculosis
ANAHGQKVQA

SEQ ID NO: 28743 - protein, 10 aa, Mycobacterium tuberculosis
NAHGQKVQAA

SEQ ID NO: 28744 - protein, 10 aa, Mycobacterium tuberculosis
AHGQKVQAAG

SEQ ID NO: 28745 - protein, 10 aa, Mycobacterium tuberculosis
HGQKVQAAGN

SEQ ID NO: 28746 - protein, 10 aa, Mycobacterium tuberculosis
GQKVQAAGNN

SEQ ID NO: 28747 - protein, 10 aa, Mycobacterium tuberculosis
QKVQAAGNNM

SEQ ID NO: 28748 - protein, 10 aa, Mycobacterium tuberculosis
KVQAAGNNMA

SEQ ID NO: 28749 - protein, 10 aa, Mycobacterium tuberculosis
VQAAGNNMAQ

SEQ ID NO: 28750 - protein, 10 aa, Mycobacterium tuberculosis
QAAGNNMAQT

SEQ ID NO: 28751 - protein, 10 aa, Mycobacterium tuberculosis
AAGNNMAQTD

SEQ ID NO: 28752 - protein, 10 aa, Mycobacterium tuberculosis
AGNNMAQTDS

SEQ ID NO: 28753 - protein, 10 aa, Mycobacterium tuberculosis
GNNMAQTDSA

SEQ ID NO: 28754 - protein, 10 aa, Mycobacterium tuberculosis
NNMAQTDSAV

SEQ ID NO: 28755 - protein, 10 aa, Mycobacterium tuberculosis
NMAQTDSAVG

SEQ ID NO: 28756 - protein, 10 aa, Mycobacterium tuberculosis
MAQTDSAVGS

SEQ ID NO: 28757 - protein, 10 aa, Mycobacterium tuberculosis
AQTDSAVGSS

SEQ ID NO: 28758 - protein, 10 aa, Mycobacterium tuberculosis
QTDSAVGSSW

SEQ ID NO: 28759 - protein, 10 aa, Mycobacterium tuberculosis
TDSAVGSSWA

SEQ ID NO: 28760 - protein, 11 aa, Mycobacterium tuberculosis
MTINYQFGDVD

SEQ ID NO: 28761 - protein, 11 aa, Mycobacterium tuberculosis
TINYQFGDVDA

SEQ ID NO: 28762 - protein, 11 aa, Mycobacterium tuberculosis
INYQFGDVDAH

SEQ ID NO: 28763 - protein, 11 aa, Mycobacterium tuberculosis
NYQFGDVDAHG

SEQ ID NO: 28764 - protein, 11 aa, Mycobacterium tuberculosis
YQFGDVDAHGA

SEQ ID NO: 28765 - protein, 11 aa, Mycobacterium tuberculosis
QFGDVDAHGAM

SEQ ID NO: 28766 - protein, 11 aa, Mycobacterium tuberculosis
FGDVDAHGAMI

SEQ ID NO: 28767 - protein, 11 aa, Mycobacterium tuberculosis
GDVDAHGAMIR

SEQ ID NO: 28768 - protein, 11 aa, Mycobacterium tuberculosis
DVDAHGAMIRA

SEQ ID NO: 28769 - protein, 11 aa, Mycobacterium tuberculosis
VDAHGAMIRAQ

SEQ ID NO: 28770 - protein, 11 aa, Mycobacterium tuberculosis
DAHGAMIRAQA

SEQ ID NO: 28771 - protein, 11 aa, Mycobacterium tuberculosis
AHGAMIRAQAG

SEQ ID NO: 28772 - protein, 11 aa, Mycobacterium tuberculosis
HGAMIRAQAGL

SEQ ID NO: 28773 - protein, 11 aa, Mycobacterium tuberculosis
GAMIRAQAGLL

SEQ ID NO: 28774 - protein, 11 aa, Mycobacterium tuberculosis
AMIRAQAGLLE

SEQ ID NO: 28775 - protein, 11 aa, Mycobacterium tuberculosis
MIRAQAGLLEA

SEQ ID NO: 28776 - protein, 11 aa, Mycobacterium tuberculosis
IRAQAGLLEAE

SEQ ID NO: 28777 - protein, 11 aa, Mycobacterium tuberculosis
RAQAGLLEAEH

SEQ ID NO: 28778 - protein, 11 aa, Mycobacterium tuberculosis
AQAGLLEAEHQ

SEQ ID NO: 28779 - protein, 11 aa, Mycobacterium tuberculosis
QAGLLEAEHQA

SEQ ID NO: 28780 - protein, 11 aa, Mycobacterium tuberculosis
AGLLEAEHQAI

SEQ ID NO: 28781 - protein, 11 aa, Mycobacterium tuberculosis
GLLEAEHQAIV

SEQ ID NO: 28782 - protein, 11 aa, Mycobacterium tuberculosis
LLEAEHQAIVR

SEQ ID NO: 28783 - protein, 11 aa, Mycobacterium tuberculosis
LEAEHQAIVRD

SEQ ID NO: 28784 - protein, 11 aa, Mycobacterium tuberculosis
EAEHQAIVRDV

SEQ ID NO: 28785 - protein, 11 aa, Mycobacterium tuberculosis
AEHQAIVRDVL

SEQ ID NO: 28786 - protein, 11 aa, Mycobacterium tuberculosis
EHQAIVRDVLA

SEQ ID NO: 28787 - protein, 11 aa, Mycobacterium tuberculosis
HQAIVRDVLAA

SEQ ID NO: 28788 - protein, 11 aa, Mycobacterium tuberculosis
QAIVRDVLAAG

SEQ ID NO: 28789 - protein, 11 aa, Mycobacterium tuberculosis
AIVRDVLAAGD

SEQ ID NO: 28790 - protein, 11 aa, Mycobacterium tuberculosis
IVRDVLAAGDF

SEQ ID NO: 28791 - protein, 11 aa, Mycobacterium tuberculosis
VRDVLAAGDFW

SEQ ID NO: 28792 - protein, 11 aa, Mycobacterium tuberculosis
RDVLAAGDFWG

SEQ ID NO: 28793 - protein, 11 aa, Mycobacterium tuberculosis
DVLAAGDFWGG

SEQ ID NO: 28794 - protein, 11 aa, Mycobacterium tuberculosis
VLAAGDFWGGA

SEQ ID NO: 28795 - protein, 11 aa, Mycobacterium tuberculosis
LAAGDFWGGAG

SEQ ID NO: 28796 - protein, 11 aa, Mycobacterium tuberculosis
AAGDFWGGAGS

SEQ ID NO: 28797 - protein, 11 aa, Mycobacterium tuberculosis
AGDFWGGAGSV

SEQ ID NO: 28798 - protein, 11 aa, Mycobacterium tuberculosis
GDFWGGAGSVA

SEQ ID NO: 28799 - protein, 11 aa, Mycobacterium tuberculosis
DFWGGAGSVAC

SEQ ID NO: 28800 - protein, 11 aa, Mycobacterium tuberculosis
FWGGAGSVACQ

SEQ ID NO: 28801 - protein, 11 aa, Mycobacterium tuberculosis
WGGAGSVACQE

SEQ ID NO: 28802 - protein, 11 aa, Mycobacterium tuberculosis
GGAGSVACQEF

SEQ ID NO: 28803 - protein, 11 aa, Mycobacterium tuberculosis
GAGSVACQEFI

SEQ ID NO: 28804 - protein, 11 aa, Mycobacterium tuberculosis
AGSVACQEFIT

SEQ ID NO: 28805 - protein, 11 aa, Mycobacterium tuberculosis
GSVACQEFITQ

SEQ ID NO: 28806 - protein, 11 aa, Mycobacterium tuberculosis
SVACQEFITQL

SEQ ID NO: 28807 - protein, 11 aa, Mycobacterium tuberculosis
VACQEFITQLG

SEQ ID NO: 28808 - protein, 11 aa, Mycobacterium tuberculosis
ACQEFITQLGR

SEQ ID NO: 28809 - protein, 11 aa, Mycobacterium tuberculosis
CQEFITQLGRN

SEQ ID NO: 28810 - protein, 11 aa, Mycobacterium tuberculosis
QEFITQLGRNF

SEQ ID NO: 28811 - protein, 11 aa, Mycobacterium tuberculosis
EFITQLGRNFQ

SEQ ID NO: 28812 - protein, 11 aa, Mycobacterium tuberculosis
FITQLGRNFQV

SEQ ID NO: 28813 - protein, 11 aa, Mycobacterium tuberculosis
ITQLGRNFQVI

SEQ ID NO: 28814 - protein, 11 aa, Mycobacterium tuberculosis
TQLGRNFQVIY

SEQ ID NO: 28815 - protein, 11 aa, Mycobacterium tuberculosis
QLGRNFQVIYE

SEQ ID NO: 28816 - protein, 11 aa, Mycobacterium tuberculosis
LGRNFQVIYEQ

SEQ ID NO: 28817 - protein, 11 aa, Mycobacterium tuberculosis
GRNFQVIYEQA

SEQ ID NO: 28818 - protein, 11 aa, Mycobacterium tuberculosis
RNFQVIYEQAN

SEQ ID NO: 28819 - protein, 11 aa, Mycobacterium tuberculosis
NFQVIYEQANA

SEQ ID NO: 28820 - protein, 11 aa, Mycobacterium tuberculosis
FQVIYEQANAH

SEQ ID NO: 28821 - protein, 11 aa, Mycobacterium tuberculosis
QVIYEQANAHG

SEQ ID NO: 28822 - protein, 11 aa, Mycobacterium tuberculosis
VIYEQANAHGQ

SEQ ID NO: 28823 - protein, 11 aa, Mycobacterium tuberculosis
IYEQANAHGQK

SEQ ID NO: 28824 - protein, 11 aa, Mycobacterium tuberculosis
YEQANAHGQKV

SEQ ID NO: 28825 - protein, 11 aa, Mycobacterium tuberculosis
EQANAHGQKVQ

SEQ ID NO: 28826 - protein, 11 aa, Mycobacterium tuberculosis
QANAHGQKVQA

SEQ ID NO: 28827 - protein, 11 aa, Mycobacterium tuberculosis
ANAHGQKVQAA

SEQ ID NO: 28828 - protein, 11 aa, Mycobacterium tuberculosis
NAHGQKVQAAG

SEQ ID NO: 28829 - protein, 11 aa, Mycobacterium tuberculosis
AHGQKVQAAGN

SEQ ID NO: 28830 - protein, 11 aa, Mycobacterium tuberculosis
HGQKVQAAGNN

SEQ ID NO: 28831 - protein, 11 aa, Mycobacterium tuberculosis
GQKVQAAGNNM

SEQ ID NO: 28832 - protein, 11 aa, Mycobacterium tuberculosis
QKVQAAGNNMA

SEQ ID NO: 28833 - protein, 11 aa, Mycobacterium tuberculosis
KVQAAGNNMAQ

SEQ ID NO: 28834 - protein, 11 aa, Mycobacterium tuberculosis
VQAAGNNMAQT

SEQ ID NO: 28835 - protein, 11 aa, Mycobacterium tuberculosis
QAAGNNMAQTD

SEQ ID NO: 28836 - protein, 11 aa, Mycobacterium tuberculosis
AAGNNMAQTDS

SEQ ID NO: 28837 - protein, 11 aa, Mycobacterium tuberculosis
AGNNMAQTDSA

SEQ ID NO: 28838 - protein, 11 aa, Mycobacterium tuberculosis
GNNMAQTDSAV

SEQ ID NO: 28839 - protein, 11 aa, Mycobacterium tuberculosis
NNMAQTDSAVG

SEQ ID NO: 28840 - protein, 11 aa, Mycobacterium tuberculosis
NMAQTDSAVGS

SEQ ID NO: 28841 - protein, 11 aa, Mycobacterium tuberculosis
MAQTDSAVGSS

SEQ ID NO: 28842 - protein, 11 aa, Mycobacterium tuberculosis
AQTDSAVGSSW

SEQ ID NO: 28843 - protein, 11 aa, Mycobacterium tuberculosis
QTDSAVGSSWA

SEQ ID NO: 28844 - protein, 8 aa, Mycobacterium tuberculosis
MATRFMTD

SEQ ID NO: 28845 - protein, 8 aa, Mycobacterium tuberculosis
ATRFMTDP

SEQ ID NO: 28846 - protein, 8 aa, Mycobacterium tuberculosis
TRFMTDPH

SEQ ID NO: 28847 - protein, 8 aa, Mycobacterium tuberculosis
RFMTDPHA

SEQ ID NO: 28848 - protein, 8 aa, Mycobacterium tuberculosis
FMTDPHAM

SEQ ID NO: 28849 - protein, 8 aa, Mycobacterium tuberculosis
MTDPHAMR

SEQ ID NO: 28850 - protein, 8 aa, Mycobacterium tuberculosis
TDPHAMRD

SEQ ID NO: 28851 - protein, 8 aa, Mycobacterium tuberculosis
DPHAMRDM

SEQ ID NO: 28852 - protein, 8 aa, Mycobacterium tuberculosis
PHAMRDMA

SEQ ID NO: 28853 - protein, 8 aa, Mycobacterium tuberculosis
HAMRDMAG

SEQ ID NO: 28854 - protein, 8 aa, Mycobacterium tuberculosis
AMRDMAGR

SEQ ID NO: 28855 - protein, 8 aa, Mycobacterium tuberculosis
MRDMAGRF

SEQ ID NO: 28856 - protein, 8 aa, Mycobacterium tuberculosis
RDMAGRFE

SEQ ID NO: 28857 - protein, 8 aa, Mycobacterium tuberculosis
DMAGRFEV

SEQ ID NO: 28858 - protein, 8 aa, Mycobacterium tuberculosis
MAGRFEVH

SEQ ID NO: 28859 - protein, 8 aa, Mycobacterium tuberculosis
AGRFEVHA

SEQ ID NO: 28860 - protein, 8 aa, Mycobacterium tuberculosis
GRFEVHAQ

SEQ ID NO: 28861 - protein, 8 aa, Mycobacterium tuberculosis
RFEVHAQT

SEQ ID NO: 28862 - protein, 8 aa, Mycobacterium tuberculosis
FEVHAQTV

SEQ ID NO: 28863 - protein, 8 aa, Mycobacterium tuberculosis
EVHAQTVE

SEQ ID NO: 28864 - protein, 8 aa, Mycobacterium tuberculosis
VHAQTVED

SEQ ID NO: 28865 - protein, 8 aa, Mycobacterium tuberculosis
HAQTVEDE

SEQ ID NO: 28866 - protein, 8 aa, Mycobacterium tuberculosis
AQTVEDEA

SEQ ID NO: 28867 - protein, 8 aa, Mycobacterium tuberculosis
QTVEDEAR

SEQ ID NO: 28868 - protein, 8 aa, Mycobacterium tuberculosis
TVEDEARR

SEQ ID NO: 28869 - protein, 8 aa, Mycobacterium tuberculosis
VEDEARRM

SEQ ID NO: 28870 - protein, 8 aa, Mycobacterium tuberculosis
EDEARRMW

SEQ ID NO: 28871 - protein, 8 aa, Mycobacterium tuberculosis
DEARRMWA

SEQ ID NO: 28872 - protein, 8 aa, Mycobacterium tuberculosis
EARRMWAS

SEQ ID NO: 28873 - protein, 8 aa, Mycobacterium tuberculosis
ARRMWASA

SEQ ID NO: 28874 - protein, 8 aa, Mycobacterium tuberculosis
RRMWASAQ

SEQ ID NO: 28875 - protein, 8 aa, Mycobacterium tuberculosis
RMWASAQN

SEQ ID NO: 28876 - protein, 8 aa, Mycobacterium tuberculosis
MWASAQNI

SEQ ID NO: 28877 - protein, 8 aa, Mycobacterium tuberculosis
WASAQNIS

SEQ ID NO: 28878 - protein, 8 aa, Mycobacterium tuberculosis
ASAQNISG

SEQ ID NO: 28879 - protein, 8 aa, Mycobacterium tuberculosis
SAQNISGA

SEQ ID NO: 28880 - protein, 8 aa, Mycobacterium tuberculosis
AQNISGAG

SEQ ID NO: 28881 - protein, 8 aa, Mycobacterium tuberculosis
QNISGAGW

SEQ ID NO: 28882 - protein, 8 aa, Mycobacterium tuberculosis
NISGAGWS

SEQ ID NO: 28883 - protein, 8 aa, Mycobacterium tuberculosis
ISGAGWSG

SEQ ID NO: 28884 - protein, 8 aa, Mycobacterium tuberculosis
SGAGWSGM

SEQ ID NO: 28885 - protein, 8 aa, Mycobacterium tuberculosis
GAGWSGMA

SEQ ID NO: 28886 - protein, 8 aa, Mycobacterium tuberculosis
AGWSGMAE

SEQ ID NO: 28887 - protein, 8 aa, Mycobacterium tuberculosis
GWSGMAEA

SEQ ID NO: 28888 - protein, 8 aa, Mycobacterium tuberculosis
WSGMAEAT

SEQ ID NO: 28889 - protein, 8 aa, Mycobacterium tuberculosis
SGMAEATS

SEQ ID NO: 28890 - protein, 8 aa, Mycobacterium tuberculosis
GMAEATSL

SEQ ID NO: 28891 - protein, 8 aa, Mycobacterium tuberculosis
MAEATSLD

SEQ ID NO: 28892 - protein, 8 aa, Mycobacterium tuberculosis
AEATSLDT

SEQ ID NO: 28893 - protein, 8 aa, Mycobacterium tuberculosis
EATSLDTM

SEQ ID NO: 28894 - protein, 8 aa, Mycobacterium tuberculosis
ATSLDTMA

SEQ ID NO: 28895 - protein, 8 aa, Mycobacterium tuberculosis
TSLDTMAQ

SEQ ID NO: 28896 - protein, 8 aa, Mycobacterium tuberculosis
SLDTMAQM

SEQ ID NO: 28897 - protein, 8 aa, Mycobacterium tuberculosis
LDTMAQMN

SEQ ID NO: 28898 - protein, 8 aa, Mycobacterium tuberculosis
DTMAQMNQ

SEQ ID NO: 28899 - protein, 8 aa, Mycobacterium tuberculosis
TMAQMNQA

SEQ ID NO: 28900 - protein, 8 aa, Mycobacterium tuberculosis
MAQMNQAF

SEQ ID NO: 28901 - protein, 8 aa, Mycobacterium tuberculosis
AQMNQAFR

SEQ ID NO: 28902 - protein, 8 aa, Mycobacterium tuberculosis
QMNQAFRN

SEQ ID NO: 28903 - protein, 8 aa, Mycobacterium tuberculosis
MNQAFRNI

SEQ ID NO: 28904 - protein, 8 aa, Mycobacterium tuberculosis
NQAFRNIV

SEQ ID NO: 28905 - protein, 8 aa, Mycobacterium tuberculosis
QAFRNIVN

SEQ ID NO: 28906 - protein, 8 aa, Mycobacterium tuberculosis
AFRNIVNM

SEQ ID NO: 28907 - protein, 8 aa, Mycobacterium tuberculosis
FRNIVNML

SEQ ID NO: 28908 - protein, 8 aa, Mycobacterium tuberculosis
RNIVNMLH

SEQ ID NO: 28909 - protein, 8 aa, Mycobacterium tuberculosis
NIVNMLHG

SEQ ID NO: 28910 - protein, 8 aa, Mycobacterium tuberculosis
IVNMLHGV

SEQ ID NO: 28911 - protein, 8 aa, Mycobacterium tuberculosis
VNMLHGVR

SEQ ID NO: 28912 - protein, 8 aa, Mycobacterium tuberculosis
NMLHGVRD

SEQ ID NO: 28913 - protein, 8 aa, Mycobacterium tuberculosis
MLHGVRDG

SEQ ID NO: 28914 - protein, 8 aa, Mycobacterium tuberculosis
LHGVRDGL

SEQ ID NO: 28915 - protein, 8 aa, Mycobacterium tuberculosis
HGVRDGLV

SEQ ID NO: 28916 - protein, 8 aa, Mycobacterium tuberculosis
GVRDGLVR

SEQ ID NO: 28917 - protein, 8 aa, Mycobacterium tuberculosis
VRDGLVRD

SEQ ID NO: 28918 - protein, 8 aa, Mycobacterium tuberculosis
RDGLVRDA

SEQ ID NO: 28919 - protein, 8 aa, Mycobacterium tuberculosis
DGLVRDAN

SEQ ID NO: 28920 - protein, 8 aa, Mycobacterium tuberculosis
GLVRDANN

SEQ ID NO: 28921 - protein, 8 aa, Mycobacterium tuberculosis
LVRDANNY

SEQ ID NO: 28922 - protein, 8 aa, Mycobacterium tuberculosis
VRDANNYE

SEQ ID NO: 28923 - protein, 8 aa, Mycobacterium tuberculosis
RDANNYEQ

SEQ ID NO: 28924 - protein, 8 aa, Mycobacterium tuberculosis
DANNYEQQ

SEQ ID NO: 28925 - protein, 8 aa, Mycobacterium tuberculosis
ANNYEQQE

SEQ ID NO: 28926 - protein, 8 aa, Mycobacterium tuberculosis
NNYEQQEQ

SEQ ID NO: 28927 - protein, 8 aa, Mycobacterium tuberculosis
NYEQQEQA

SEQ ID NO: 28928 - protein, 8 aa, Mycobacterium tuberculosis
YEQQEQAS

SEQ ID NO: 28929 - protein, 8 aa, Mycobacterium tuberculosis
EQQEQASQ

SEQ ID NO: 28930 - protein, 8 aa, Mycobacterium tuberculosis
QQEQASQQ

SEQ ID NO: 28931 - protein, 8 aa, Mycobacterium tuberculosis
QEQASQQI

SEQ ID NO: 28932 - protein, 8 aa, Mycobacterium tuberculosis
EQASQQIL

SEQ ID NO: 28933 - protein, 8 aa, Mycobacterium tuberculosis
QASQQILS

SEQ ID NO: 28934 - protein, 8 aa, Mycobacterium tuberculosis
ASQQILSS

SEQ ID NO: 28935 - protein, 9 aa, Mycobacterium tuberculosis
MATRFMTDP

SEQ ID NO: 28936 - protein, 9 aa, Mycobacterium tuberculosis
ATRFMTDPH

SEQ ID NO: 28937 - protein, 9 aa, Mycobacterium tuberculosis
TRFMTDPHA

SEQ ID NO: 28938 - protein, 9 aa, Mycobacterium tuberculosis
RFMTDPHAM

SEQ ID NO: 28939 - protein, 9 aa, Mycobacterium tuberculosis
FMTDPHAMR

SEQ ID NO: 28940 - protein, 9 aa, Mycobacterium tuberculosis
MTDPHAMRD

SEQ ID NO: 28941 - protein, 9 aa, Mycobacterium tuberculosis
TDPHAMRDM

SEQ ID NO: 28942 - protein, 9 aa, Mycobacterium tuberculosis
DPHAMRDMA

SEQ ID NO: 28943 - protein, 9 aa, Mycobacterium tuberculosis
PHAMRDMAG

SEQ ID NO: 28944 - protein, 9 aa, Mycobacterium tuberculosis
HAMRDMAGR

SEQ ID NO: 28945 - protein, 9 aa, Mycobacterium tuberculosis
AMRDMAGRF

SEQ ID NO: 28946 - protein, 9 aa, Mycobacterium tuberculosis
MRDMAGRFE

SEQ ID NO: 28947 - protein, 9 aa, Mycobacterium tuberculosis
RDMAGRFEV

SEQ ID NO: 28948 - protein, 9 aa, Mycobacterium tuberculosis
DMAGRFEVH

SEQ ID NO: 28949 - protein, 9 aa, Mycobacterium tuberculosis
MAGRFEVHA

SEQ ID NO: 28950 - protein, 9 aa, Mycobacterium tuberculosis
AGRFEVHAQ

SEQ ID NO: 28951 - protein, 9 aa, Mycobacterium tuberculosis
GRFEVHAQT

SEQ ID NO: 28952 - protein, 9 aa, Mycobacterium tuberculosis
RFEVHAQTV

SEQ ID NO: 28953 - protein, 9 aa, Mycobacterium tuberculosis
FEVHAQTVE

SEQ ID NO: 28954 - protein, 9 aa, Mycobacterium tuberculosis
EVHAQTVED

SEQ ID NO: 28955 - protein, 9 aa, Mycobacterium tuberculosis
VHAQTVEDE

SEQ ID NO: 28956 - protein, 9 aa, Mycobacterium tuberculosis
HAQTVEDEA

SEQ ID NO: 28957 - protein, 9 aa, Mycobacterium tuberculosis
AQTVEDEAR

SEQ ID NO: 28958 - protein, 9 aa, Mycobacterium tuberculosis
QTVEDEARR

SEQ ID NO: 28959 - protein, 9 aa, Mycobacterium tuberculosis
TVEDEARRM

SEQ ID NO: 28960 - protein, 9 aa, Mycobacterium tuberculosis
VEDEARRMW

SEQ ID NO: 28961 - protein, 9 aa, Mycobacterium tuberculosis
EDEARRMWA

SEQ ID NO: 28962 - protein, 9 aa, Mycobacterium tuberculosis
DEARRMWAS

SEQ ID NO: 28963 - protein, 9 aa, Mycobacterium tuberculosis
EARRMWASA

SEQ ID NO: 28964 - protein, 9 aa, Mycobacterium tuberculosis
ARRMWASAQ

SEQ ID NO: 28965 - protein, 9 aa, Mycobacterium tuberculosis
RRMWASAQN

SEQ ID NO: 28966 - protein, 9 aa, Mycobacterium tuberculosis
RMWASAQNI

SEQ ID NO: 28967 - protein, 9 aa, Mycobacterium tuberculosis
MWASAQNIS

SEQ ID NO: 28968 - protein, 9 aa, Mycobacterium tuberculosis
WASAQNISG

SEQ ID NO: 28969 - protein, 9 aa, Mycobacterium tuberculosis
ASAQNISGA

SEQ ID NO: 28970 - protein, 9 aa, Mycobacterium tuberculosis
SAQNISGAG

SEQ ID NO: 28971 - protein, 9 aa, Mycobacterium tuberculosis
AQNISGAGW

SEQ ID NO: 28972 - protein, 9 aa, Mycobacterium tuberculosis
QNISGAGWS

SEQ ID NO: 28973 - protein, 9 aa, Mycobacterium tuberculosis
NISGAGWSG

SEQ ID NO: 28974 - protein, 9 aa, Mycobacterium tuberculosis
ISGAGWSGM

SEQ ID NO: 28975 - protein, 9 aa, Mycobacterium tuberculosis
SGAGWSGMA

SEQ ID NO: 28976 - protein, 9 aa, Mycobacterium tuberculosis
GAGWSGMAE

SEQ ID NO: 28977 - protein, 9 aa, Mycobacterium tuberculosis
AGWSGMAEA

SEQ ID NO: 28978 - protein, 9 aa, Mycobacterium tuberculosis
GWSGMAEAT

SEQ ID NO: 28979 - protein, 9 aa, Mycobacterium tuberculosis
WSGMAEATS

SEQ ID NO: 28980 - protein, 9 aa, Mycobacterium tuberculosis
SGMAEATSL

SEQ ID NO: 28981 - protein, 9 aa, Mycobacterium tuberculosis
GMAEATSLD

SEQ ID NO: 28982 - protein, 9 aa, Mycobacterium tuberculosis
MAEATSLDT

SEQ ID NO: 28983 - protein, 9 aa, Mycobacterium tuberculosis
AEATSLDTM

SEQ ID NO: 28984 - protein, 9 aa, Mycobacterium tuberculosis
EATSLDTMA

SEQ ID NO: 28985 - protein, 9 aa, Mycobacterium tuberculosis
ATSLDTMAQ

SEQ ID NO: 28986 - protein, 9 aa, Mycobacterium tuberculosis
TSLDTMAQM

SEQ ID NO: 28987 - protein, 9 aa, Mycobacterium tuberculosis
SLDTMAQMN

SEQ ID NO: 28988 - protein, 9 aa, Mycobacterium tuberculosis
LDTMAQMNQ

SEQ ID NO: 28989 - protein, 9 aa, Mycobacterium tuberculosis
DTMAQMNQA

SEQ ID NO: 28990 - protein, 9 aa, Mycobacterium tuberculosis
TMAQMNQAF

SEQ ID NO: 28991 - protein, 9 aa, Mycobacterium tuberculosis
MAQMNQAFR

SEQ ID NO: 28992 - protein, 9 aa, Mycobacterium tuberculosis
AQMNQAFRN

SEQ ID NO: 28993 - protein, 9 aa, Mycobacterium tuberculosis
QMNQAFRNI

SEQ ID NO: 28994 - protein, 9 aa, Mycobacterium tuberculosis
MNQAFRNIV

SEQ ID NO: 28995 - protein, 9 aa, Mycobacterium tuberculosis
NQAFRNIVN

SEQ ID NO: 28996 - protein, 9 aa, Mycobacterium tuberculosis
QAFRNIVNM

SEQ ID NO: 28997 - protein, 9 aa, Mycobacterium tuberculosis
AFRNIVNML

SEQ ID NO: 28998 - protein, 9 aa, Mycobacterium tuberculosis
FRNIVNMLH

SEQ ID NO: 28999 - protein, 9 aa, Mycobacterium tuberculosis
RNIVNMLHG

SEQ ID NO: 29000 - protein, 9 aa, Mycobacterium tuberculosis
NIVNMLHGV

SEQ ID NO: 29001 - protein, 9 aa, Mycobacterium tuberculosis
IVNMLHGVR

SEQ ID NO: 29002 - protein, 9 aa, Mycobacterium tuberculosis
VNMLHGVRD

SEQ ID NO: 29003 - protein, 9 aa, Mycobacterium tuberculosis
NMLHGVRDG

SEQ ID NO: 29004 - protein, 9 aa, Mycobacterium tuberculosis
MLHGVRDGL

SEQ ID NO: 29005 - protein, 9 aa, Mycobacterium tuberculosis
LHGVRDGLV

SEQ ID NO: 29006 - protein, 9 aa, Mycobacterium tuberculosis
HGVRDGLVR

SEQ ID NO: 29007 - protein, 9 aa, Mycobacterium tuberculosis
GVRDGLVRD

SEQ ID NO: 29008 - protein, 9 aa, Mycobacterium tuberculosis
VRDGLVRDA

SEQ ID NO: 29009 - protein, 9 aa, Mycobacterium tuberculosis
RDGLVRDAN

SEQ ID NO: 29010 - protein, 9 aa, Mycobacterium tuberculosis
DGLVRDANN

SEQ ID NO: 29011 - protein, 9 aa, Mycobacterium tuberculosis
GLVRDANNY

SEQ ID NO: 29012 - protein, 9 aa, Mycobacterium tuberculosis
LVRDANNYE

SEQ ID NO: 29013 - protein, 9 aa, Mycobacterium tuberculosis
VRDANNYEQ

SEQ ID NO: 29014 - protein, 9 aa, Mycobacterium tuberculosis
RDANNYEQQ

SEQ ID NO: 29015 - protein, 9 aa, Mycobacterium tuberculosis
DANNYEQQE

SEQ ID NO: 29016 - protein, 9 aa, Mycobacterium tuberculosis
ANNYEQQEQ

SEQ ID NO: 29017 - protein, 9 aa, Mycobacterium tuberculosis
NNYEQQEQA

SEQ ID NO: 29018 - protein, 9 aa, Mycobacterium tuberculosis
NYEQQEQAS

SEQ ID NO: 29019 - protein, 9 aa, Mycobacterium tuberculosis
YEQQEQASQ

SEQ ID NO: 29020 - protein, 9 aa, Mycobacterium tuberculosis
EQQEQASQQ

SEQ ID NO: 29021 - protein, 9 aa, Mycobacterium tuberculosis
QQEQASQQI

SEQ ID NO: 29022 - protein, 9 aa, Mycobacterium tuberculosis
QEQASQQIL

SEQ ID NO: 29023 - protein, 9 aa, Mycobacterium tuberculosis
EQASQQILS

SEQ ID NO: 29024 - protein, 9 aa, Mycobacterium tuberculosis
QASQQILSS

SEQ ID NO: 29025 - protein, 10 aa, Mycobacterium tuberculosis
MATRFMTDPH

SEQ ID NO: 29026 - protein, 10 aa, Mycobacterium tuberculosis
ATRFMTDPHA

SEQ ID NO: 29027 - protein, 10 aa, Mycobacterium tuberculosis
TRFMTDPHAM

SEQ ID NO: 29028 - protein, 10 aa, Mycobacterium tuberculosis
RFMTDPHAMR

SEQ ID NO: 29029 - protein, 10 aa, Mycobacterium tuberculosis
FMTDPHAMRD

SEQ ID NO: 29030 - protein, 10 aa, Mycobacterium tuberculosis
MTDPHAMRDM

SEQ ID NO: 29031 - protein, 10 aa, Mycobacterium tuberculosis
TDPHAMRDMA

SEQ ID NO: 29032 - protein, 10 aa, Mycobacterium tuberculosis
DPHAMRDMAG

SEQ ID NO: 29033 - protein, 10 aa, Mycobacterium tuberculosis
PHAMRDMAGR

SEQ ID NO: 29034 - protein, 10 aa, Mycobacterium tuberculosis
HAMRDMAGRF

SEQ ID NO: 29035 - protein, 10 aa, Mycobacterium tuberculosis
AMRDMAGRFE

SEQ ID NO: 29036 - protein, 10 aa, Mycobacterium tuberculosis
MRDMAGRFEV

SEQ ID NO: 29037 - protein, 10 aa, Mycobacterium tuberculosis
RDMAGRFEVH

SEQ ID NO: 29038 - protein, 10 aa, Mycobacterium tuberculosis
DMAGRFEVHA

SEQ ID NO: 29039 - protein, 10 aa, Mycobacterium tuberculosis
MAGRFEVHAQ

SEQ ID NO: 29040 - protein, 10 aa, Mycobacterium tuberculosis
AGRFEVHAQT

SEQ ID NO: 29041 - protein, 10 aa, Mycobacterium tuberculosis
GRFEVHAQTV

SEQ ID NO: 29042 - protein, 10 aa, Mycobacterium tuberculosis
RFEVHAQTVE

SEQ ID NO: 29043 - protein, 10 aa, Mycobacterium tuberculosis
FEVHAQTVED

SEQ ID NO: 29044 - protein, 10 aa, Mycobacterium tuberculosis
EVHAQTVEDE

SEQ ID NO: 29045 - protein, 10 aa, Mycobacterium tuberculosis
VHAQTVEDEA

SEQ ID NO: 29046 - protein, 10 aa, Mycobacterium tuberculosis
HAQTVEDEAR

SEQ ID NO: 29047 - protein, 10 aa, Mycobacterium tuberculosis
AQTVEDEARR

SEQ ID NO: 29048 - protein, 10 aa, Mycobacterium tuberculosis
QTVEDEARRM

SEQ ID NO: 29049 - protein, 10 aa, Mycobacterium tuberculosis
TVEDEARRMW

SEQ ID NO: 29050 - protein, 10 aa, Mycobacterium tuberculosis
VEDEARRMWA

SEQ ID NO: 29051 - protein, 10 aa, Mycobacterium tuberculosis
EDEARRMWAS

SEQ ID NO: 29052 - protein, 10 aa, Mycobacterium tuberculosis
DEARRMWASA

SEQ ID NO: 29053 - protein, 10 aa, Mycobacterium tuberculosis
EARRMWASAQ

SEQ ID NO: 29054 - protein, 10 aa, Mycobacterium tuberculosis
ARRMWASAQN

SEQ ID NO: 29055 - protein, 10 aa, Mycobacterium tuberculosis
RRMWASAQNI

SEQ ID NO: 29056 - protein, 10 aa, Mycobacterium tuberculosis
RMWASAQNIS

SEQ ID NO: 29057 - protein, 10 aa, Mycobacterium tuberculosis
MWASAQNISG

SEQ ID NO: 29058 - protein, 10 aa, Mycobacterium tuberculosis
WASAQNISGA

SEQ ID NO: 29059 - protein, 10 aa, Mycobacterium tuberculosis
ASAQNISGAG

SEQ ID NO: 29060 - protein, 10 aa, Mycobacterium tuberculosis
SAQNISGAGW

SEQ ID NO: 29061 - protein, 10 aa, Mycobacterium tuberculosis
AQNISGAGWS

SEQ ID NO: 29062 - protein, 10 aa, Mycobacterium tuberculosis
QNISGAGWSG

SEQ ID NO: 29063 - protein, 10 aa, Mycobacterium tuberculosis
NISGAGWSGM

SEQ ID NO: 29064 - protein, 10 aa, Mycobacterium tuberculosis
ISGAGWSGMA

SEQ ID NO: 29065 - protein, 10 aa, Mycobacterium tuberculosis
SGAGWSGMAE

SEQ ID NO: 29066 - protein, 10 aa, Mycobacterium tuberculosis
GAGWSGMAEA

SEQ ID NO: 29067 - protein, 10 aa, Mycobacterium tuberculosis
AGWSGMAEAT

SEQ ID NO: 29068 - protein, 10 aa, Mycobacterium tuberculosis
GWSGMAEATS

SEQ ID NO: 29069 - protein, 10 aa, Mycobacterium tuberculosis
WSGMAEATSL

SEQ ID NO: 29070 - protein, 10 aa, Mycobacterium tuberculosis
SGMAEATSLD

SEQ ID NO: 29071 - protein, 10 aa, Mycobacterium tuberculosis
GMAEATSLDT

SEQ ID NO: 29072 - protein, 10 aa, Mycobacterium tuberculosis
MAEATSLDTM

SEQ ID NO: 29073 - protein, 10 aa, Mycobacterium tuberculosis
AEATSLDTMA

SEQ ID NO: 29074 - protein, 10 aa, Mycobacterium tuberculosis
EATSLDTMAQ

SEQ ID NO: 29075 - protein, 10 aa, Mycobacterium tuberculosis
ATSLDTMAQM

SEQ ID NO: 29076 - protein, 10 aa, Mycobacterium tuberculosis
TSLDTMAQMN

SEQ ID NO: 29077 - protein, 10 aa, Mycobacterium tuberculosis
SLDTMAQMNQ

SEQ ID NO: 29078 - protein, 10 aa, Mycobacterium tuberculosis
LDTMAQMNQA

SEQ ID NO: 29079 - protein, 10 aa, Mycobacterium tuberculosis
DTMAQMNQAF

SEQ ID NO: 29080 - protein, 10 aa, Mycobacterium tuberculosis
TMAQMNQAFR

SEQ ID NO: 29081 - protein, 10 aa, Mycobacterium tuberculosis
MAQMNQAFRN

SEQ ID NO: 29082 - protein, 10 aa, Mycobacterium tuberculosis
AQMNQAFRNI

SEQ ID NO: 29083 - protein, 10 aa, Mycobacterium tuberculosis
QMNQAFRNIV

SEQ ID NO: 29084 - protein, 10 aa, Mycobacterium tuberculosis
MNQAFRNIVN

SEQ ID NO: 29085 - protein, 10 aa, Mycobacterium tuberculosis
NQAFRNIVNM

SEQ ID NO: 29086 - protein, 10 aa, Mycobacterium tuberculosis
QAFRNIVNML

SEQ ID NO: 29087 - protein, 10 aa, Mycobacterium tuberculosis
AFRNIVNMLH

SEQ ID NO: 29088 - protein, 10 aa, Mycobacterium tuberculosis
FRNIVNMLHG

SEQ ID NO: 29089 - protein, 10 aa, Mycobacterium tuberculosis
RNIVNMLHGV

SEQ ID NO: 29090 - protein, 10 aa, Mycobacterium tuberculosis
NIVNMLHGVR

SEQ ID NO: 29091 - protein, 10 aa, Mycobacterium tuberculosis
IVNMLHGVRD

SEQ ID NO: 29092 - protein, 10 aa, Mycobacterium tuberculosis
VNMLHGVRDG

SEQ ID NO: 29093 - protein, 10 aa, Mycobacterium tuberculosis
NMLHGVRDGL

SEQ ID NO: 29094 - protein, 10 aa, Mycobacterium tuberculosis
MLHGVRDGLV

SEQ ID NO: 29095 - protein, 10 aa, Mycobacterium tuberculosis
LHGVRDGLVR

SEQ ID NO: 29096 - protein, 10 aa, Mycobacterium tuberculosis
HGVRDGLVRD

SEQ ID NO: 29097 - protein, 10 aa, Mycobacterium tuberculosis
GVRDGLVRDA

SEQ ID NO: 29098 - protein, 10 aa, Mycobacterium tuberculosis
VRDGLVRDAN

SEQ ID NO: 29099 - protein, 10 aa, Mycobacterium tuberculosis
RDGLVRDANN

SEQ ID NO: 29100 - protein, 10 aa, Mycobacterium tuberculosis
DGLVRDANNY

SEQ ID NO: 29101 - protein, 10 aa, Mycobacterium tuberculosis
GLVRDANNYE

SEQ ID NO: 29102 - protein, 10 aa, Mycobacterium tuberculosis
LVRDANNYEQ

SEQ ID NO: 29103 - protein, 10 aa, Mycobacterium tuberculosis
VRDANNYEQQ

SEQ ID NO: 29104 - protein, 10 aa, Mycobacterium tuberculosis
RDANNYEQQE

SEQ ID NO: 29105 - protein, 10 aa, Mycobacterium tuberculosis
DANNYEQQEQ

SEQ ID NO: 29106 - protein, 10 aa, Mycobacterium tuberculosis
ANNYEQQEQA

SEQ ID NO: 29107 - protein, 10 aa, Mycobacterium tuberculosis
NNYEQQEQAS

SEQ ID NO: 29108 - protein, 10 aa, Mycobacterium tuberculosis
NYEQQEQASQ

SEQ ID NO: 29109 - protein, 10 aa, Mycobacterium tuberculosis
YEQQEQASQQ

SEQ ID NO: 29110 - protein, 10 aa, Mycobacterium tuberculosis
EQQEQASQQI

SEQ ID NO: 29111 - protein, 10 aa, Mycobacterium tuberculosis
QQEQASQQIL

SEQ ID NO: 29112 - protein, 10 aa, Mycobacterium tuberculosis
QEQASQQILS

SEQ ID NO: 29113 - protein, 10 aa, Mycobacterium tuberculosis
EQASQQILSS

SEQ ID NO: 29114 - protein, 11 aa, Mycobacterium tuberculosis
MATRFMTDPHA

SEQ ID NO: 29115 - protein, 11 aa, Mycobacterium tuberculosis
ATRFMTDPHAM

SEQ ID NO: 29116 - protein, 11 aa, Mycobacterium tuberculosis
TRFMTDPHAMR

SEQ ID NO: 29117 - protein, 11 aa, Mycobacterium tuberculosis
RFMTDPHAMRD

SEQ ID NO: 29118 - protein, 11 aa, Mycobacterium tuberculosis
FMTDPHAMRDM

SEQ ID NO: 29119 - protein, 11 aa, Mycobacterium tuberculosis
MTDPHAMRDMA

SEQ ID NO: 29120 - protein, 11 aa, Mycobacterium tuberculosis
TDPHAMRDMAG

SEQ ID NO: 29121 - protein, 11 aa, Mycobacterium tuberculosis
DPHAMRDMAGR

SEQ ID NO: 29122 - protein, 11 aa, Mycobacterium tuberculosis
PHAMRDMAGRF

SEQ ID NO: 29123 - protein, 11 aa, Mycobacterium tuberculosis
HAMRDMAGRFE

SEQ ID NO: 29124 - protein, 11 aa, Mycobacterium tuberculosis
AMRDMAGRFEV

SEQ ID NO: 29125 - protein, 11 aa, Mycobacterium tuberculosis
MRDMAGRFEVH

SEQ ID NO: 29126 - protein, 11 aa, Mycobacterium tuberculosis
RDMAGRFEVHA

SEQ ID NO: 29127 - protein, 11 aa, Mycobacterium tuberculosis
DMAGRFEVHAQ

SEQ ID NO: 29128 - protein, 11 aa, Mycobacterium tuberculosis
MAGRFEVHAQT

SEQ ID NO: 29129 - protein, 11 aa, Mycobacterium tuberculosis
AGRFEVHAQTV

SEQ ID NO: 29130 - protein, 11 aa, Mycobacterium tuberculosis
GRFEVHAQTVE

SEQ ID NO: 29131 - protein, 11 aa, Mycobacterium tuberculosis
RFEVHAQTVED

SEQ ID NO: 29132 - protein, 11 aa, Mycobacterium tuberculosis
FEVHAQTVEDE

SEQ ID NO: 29133 - protein, 11 aa, Mycobacterium tuberculosis
EVHAQTVEDEA

SEQ ID NO: 29134 - protein, 11 aa, Mycobacterium tuberculosis
VHAQTVEDEAR

SEQ ID NO: 29135 - protein, 11 aa, Mycobacterium tuberculosis
HAQTVEDEARR

SEQ ID NO: 29136 - protein, 11 aa, Mycobacterium tuberculosis
AQTVEDEARRM

SEQ ID NO: 29137 - protein, 11 aa, Mycobacterium tuberculosis
QTVEDEARRMW

SEQ ID NO: 29138 - protein, 11 aa, Mycobacterium tuberculosis
TVEDEARRMWA

SEQ ID NO: 29139 - protein, 11 aa, Mycobacterium tuberculosis
VEDEARRMWAS

SEQ ID NO: 29140 - protein, 11 aa, Mycobacterium tuberculosis
EDEARRMWASA

SEQ ID NO: 29141 - protein, 11 aa, Mycobacterium tuberculosis
DEARRMWASAQ

SEQ ID NO: 29142 - protein, 11 aa, Mycobacterium tuberculosis
EARRMWASAQN

SEQ ID NO: 29143 - protein, 11 aa, Mycobacterium tuberculosis
ARRMWASAQNI

SEQ ID NO: 29144 - protein, 11 aa, Mycobacterium tuberculosis
RRMWASAQNIS

SEQ ID NO: 29145 - protein, 11 aa, Mycobacterium tuberculosis
RMWASAQNISG

SEQ ID NO: 29146 - protein, 11 aa, Mycobacterium tuberculosis
MWASAQNISGA

SEQ ID NO: 29147 - protein, 11 aa, Mycobacterium tuberculosis
WASAQNISGAG

SEQ ID NO: 29148 - protein, 11 aa, Mycobacterium tuberculosis
ASAQNISGAGW

SEQ ID NO: 29149 - protein, 11 aa, Mycobacterium tuberculosis
SAQNISGAGWS

SEQ ID NO: 29150 - protein, 11 aa, Mycobacterium tuberculosis
AQNISGAGWSG

SEQ ID NO: 29151 - protein, 11 aa, Mycobacterium tuberculosis
QNISGAGWSGM

SEQ ID NO: 29152 - protein, 11 aa, Mycobacterium tuberculosis
NISGAGWSGMA

SEQ ID NO: 29153 - protein, 11 aa, Mycobacterium tuberculosis
ISGAGWSGMAE

SEQ ID NO: 29154 - protein, 11 aa, Mycobacterium tuberculosis
SGAGWSGMAEA

SEQ ID NO: 29155 - protein, 11 aa, Mycobacterium tuberculosis
GAGWSGMAEAT

SEQ ID NO: 29156 - protein, 11 aa, Mycobacterium tuberculosis
AGWSGMAEATS

SEQ ID NO: 29157 - protein, 11 aa, Mycobacterium tuberculosis
GWSGMAEATSL

SEQ ID NO: 29158 - protein, 11 aa, Mycobacterium tuberculosis
WSGMAEATSLD

SEQ ID NO: 29159 - protein, 11 aa, Mycobacterium tuberculosis
SGMAEATSLDT

SEQ ID NO: 29160 - protein, 11 aa, Mycobacterium tuberculosis
GMAEATSLDTM

SEQ ID NO: 29161 - protein, 11 aa, Mycobacterium tuberculosis
MAEATSLDTMA

SEQ ID NO: 29162 - protein, 11 aa, Mycobacterium tuberculosis
AEATSLDTMAQ

SEQ ID NO: 29163 - protein, 11 aa, Mycobacterium tuberculosis
EATSLDTMAQM

SEQ ID NO: 29164 - protein, 11 aa, Mycobacterium tuberculosis
ATSLDTMAQMN

SEQ ID NO: 29165 - protein, 11 aa, Mycobacterium tuberculosis
TSLDTMAQMNQ

SEQ ID NO: 29166 - protein, 11 aa, Mycobacterium tuberculosis
SLDTMAQMNQA

SEQ ID NO: 29167 - protein, 11 aa, Mycobacterium tuberculosis
LDTMAQMNQAF

SEQ ID NO: 29168 - protein, 11 aa, Mycobacterium tuberculosis
DTMAQMNQAFR

SEQ ID NO: 29169 - protein, 11 aa, Mycobacterium tuberculosis
TMAQMNQAFRN

SEQ ID NO: 29170 - protein, 11 aa, Mycobacterium tuberculosis
MAQMNQAFRNI

SEQ ID NO: 29171 - protein, 11 aa, Mycobacterium tuberculosis
AQMNQAFRNIV

SEQ ID NO: 29172 - protein, 11 aa, Mycobacterium tuberculosis
QMNQAFRNIVN

SEQ ID NO: 29173 - protein, 11 aa, Mycobacterium tuberculosis
MNQAFRNIVNM

SEQ ID NO: 29174 - protein, 11 aa, Mycobacterium tuberculosis
NQAFRNIVNML

SEQ ID NO: 29175 - protein, 11 aa, Mycobacterium tuberculosis
QAFRNIVNMLH

SEQ ID NO: 29176 - protein, 11 aa, Mycobacterium tuberculosis
AFRNIVNMLHG

SEQ ID NO: 29177 - protein, 11 aa, Mycobacterium tuberculosis
FRNIVNMLHGV

SEQ ID NO: 29178 - protein, 11 aa, Mycobacterium tuberculosis
RNIVNMLHGVR

SEQ ID NO: 29179 - protein, 11 aa, Mycobacterium tuberculosis
NIVNMLHGVRD

SEQ ID NO: 29180 - protein, 11 aa, Mycobacterium tuberculosis
IVNMLHGVRDG

SEQ ID NO: 29181 - protein, 11 aa, Mycobacterium tuberculosis
VNMLHGVRDGL

SEQ ID NO: 29182 - protein, 11 aa, Mycobacterium tuberculosis
NMLHGVRDGLV

SEQ ID NO: 29183 - protein, 11 aa, Mycobacterium tuberculosis
MLHGVRDGLVR

SEQ ID NO: 29184 - protein, 11 aa, Mycobacterium tuberculosis
LHGVRDGLVRD

SEQ ID NO: 29185 - protein, 11 aa, Mycobacterium tuberculosis
HGVRDGLVRDA

SEQ ID NO: 29186 - protein, 11 aa, Mycobacterium tuberculosis
GVRDGLVRDAN

SEQ ID NO: 29187 - protein, 11 aa, Mycobacterium tuberculosis
VRDGLVRDANN

SEQ ID NO: 29188 - protein, 11 aa, Mycobacterium tuberculosis
RDGLVRDANNY

SEQ ID NO: 29189 - protein, 11 aa, Mycobacterium tuberculosis
DGLVRDANNYE

SEQ ID NO: 29190 - protein, 11 aa, Mycobacterium tuberculosis
GLVRDANNYEQ

SEQ ID NO: 29191 - protein, 11 aa, Mycobacterium tuberculosis
LVRDANNYEQQ

SEQ ID NO: 29192 - protein, 11 aa, Mycobacterium tuberculosis
VRDANNYEQQE

SEQ ID NO: 29193 - protein, 11 aa, Mycobacterium tuberculosis
RDANNYEQQEQ

SEQ ID NO: 29194 - protein, 11 aa, Mycobacterium tuberculosis
DANNYEQQEQA

SEQ ID NO: 29195 - protein, 11 aa, Mycobacterium tuberculosis
ANNYEQQEQAS

SEQ ID NO: 29196 - protein, 11 aa, Mycobacterium tuberculosis
NNYEQQEQASQ

SEQ ID NO: 29197 - protein, 11 aa, Mycobacterium tuberculosis
NYEQQEQASQQ

SEQ ID NO: 29198 - protein, 11 aa, Mycobacterium tuberculosis
YEQQEQASQQI

SEQ ID NO: 29199 - protein, 11 aa, Mycobacterium tuberculosis
EQQEQASQQIL

SEQ ID NO: 29200 - protein, 11 aa, Mycobacterium tuberculosis
QQEQASQQILS

SEQ ID NO: 29201 - protein, 11 aa, Mycobacterium tuberculosis
QEQASQQILSS

SEQ ID NO: 29202 - protein, 8 aa, Mycobacterium tuberculosis
MLLPLGPP

SEQ ID NO: 29203 - protein, 8 aa, Mycobacterium tuberculosis
LLPLGPPL

SEQ ID NO: 29204 - protein, 8 aa, Mycobacterium tuberculosis
LPLGPPLP

SEQ ID NO: 29205 - protein, 8 aa, Mycobacterium tuberculosis
PLGPPLPP

SEQ ID NO: 29206 - protein, 8 aa, Mycobacterium tuberculosis
LGPPLPPD

SEQ ID NO: 29207 - protein, 8 aa, Mycobacterium tuberculosis
GPPLPPDA

SEQ ID NO: 29208 - protein, 8 aa, Mycobacterium tuberculosis
PPLPPDAV

SEQ ID NO: 29209 - protein, 8 aa, Mycobacterium tuberculosis
PLPPDAVV

SEQ ID NO: 29210 - protein, 8 aa, Mycobacterium tuberculosis
LPPDAVVA

SEQ ID NO: 29211 - protein, 8 aa, Mycobacterium tuberculosis
PPDAVVAK

SEQ ID NO: 29212 - protein, 8 aa, Mycobacterium tuberculosis
PDAVVAKR

SEQ ID NO: 29213 - protein, 8 aa, Mycobacterium tuberculosis
DAVVAKRA

SEQ ID NO: 29214 - protein, 8 aa, Mycobacterium tuberculosis
AVVAKRAE

SEQ ID NO: 29215 - protein, 8 aa, Mycobacterium tuberculosis
VVAKRAES

SEQ ID NO: 29216 - protein, 8 aa, Mycobacterium tuberculosis
VAKRAESG

SEQ ID NO: 29217 - protein, 8 aa, Mycobacterium tuberculosis
AKRAESGM

SEQ ID NO: 29218 - protein, 8 aa, Mycobacterium tuberculosis
KRAESGML

SEQ ID NO: 29219 - protein, 8 aa, Mycobacterium tuberculosis
RAESGMLG

SEQ ID NO: 29220 - protein, 8 aa, Mycobacterium tuberculosis
AESGMLGG

SEQ ID NO: 29221 - protein, 8 aa, Mycobacterium tuberculosis
ESGMLGGL

SEQ ID NO: 29222 - protein, 8 aa, Mycobacterium tuberculosis
SGMLGGLS

SEQ ID NO: 29223 - protein, 8 aa, Mycobacterium tuberculosis
GMLGGLSV

SEQ ID NO: 29224 - protein, 8 aa, Mycobacterium tuberculosis
MLGGLSVP

SEQ ID NO: 29225 - protein, 8 aa, Mycobacterium tuberculosis
LGGLSVPL

SEQ ID NO: 29226 - protein, 8 aa, Mycobacterium tuberculosis
GGLSVPLS

SEQ ID NO: 29227 - protein, 8 aa, Mycobacterium tuberculosis
GLSVPLSW

SEQ ID NO: 29228 - protein, 8 aa, Mycobacterium tuberculosis
LSVPLSWG

SEQ ID NO: 29229 - protein, 8 aa, Mycobacterium tuberculosis
SVPLSWGV

SEQ ID NO: 29230 - protein, 8 aa, Mycobacterium tuberculosis
VPLSWGVA

SEQ ID NO: 29231 - protein, 8 aa, Mycobacterium tuberculosis
PLSWGVAV

SEQ ID NO: 29232 - protein, 8 aa, Mycobacterium tuberculosis
LSWGVAVP

SEQ ID NO: 29233 - protein, 8 aa, Mycobacterium tuberculosis
SWGVAVPP

SEQ ID NO: 29234 - protein, 8 aa, Mycobacterium tuberculosis
WGVAVPPD

SEQ ID NO: 29235 - protein, 8 aa, Mycobacterium tuberculosis
GVAVPPDD

SEQ ID NO: 29236 - protein, 8 aa, Mycobacterium tuberculosis
VAVPPDDY

SEQ ID NO: 29237 - protein, 8 aa, Mycobacterium tuberculosis
AVPPDDYD

SEQ ID NO: 29238 - protein, 8 aa, Mycobacterium tuberculosis
VPPDDYDH

SEQ ID NO: 29239 - protein, 8 aa, Mycobacterium tuberculosis
PPDDYDHW

SEQ ID NO: 29240 - protein, 8 aa, Mycobacterium tuberculosis
PDDYDHWA

SEQ ID NO: 29241 - protein, 8 aa, Mycobacterium tuberculosis
DDYDHWAP

SEQ ID NO: 29242 - protein, 8 aa, Mycobacterium tuberculosis
DYDHWAPA

SEQ ID NO: 29243 - protein, 8 aa, Mycobacterium tuberculosis
YDHWAPAP

SEQ ID NO: 29244 - protein, 8 aa, Mycobacterium tuberculosis
DHWAPAPE

SEQ ID NO: 29245 - protein, 8 aa, Mycobacterium tuberculosis
HWAPAPED

SEQ ID NO: 29246 - protein, 8 aa, Mycobacterium tuberculosis
WAPAPEDG

SEQ ID NO: 29247 - protein, 8 aa, Mycobacterium tuberculosis
APAPEDGA

SEQ ID NO: 29248 - protein, 8 aa, Mycobacterium tuberculosis
PAPEDGAD

SEQ ID NO: 29249 - protein, 8 aa, Mycobacterium tuberculosis
APEDGADV

SEQ ID NO: 29250 - protein, 8 aa, Mycobacterium tuberculosis
PEDGADVD

SEQ ID NO: 29251 - protein, 8 aa, Mycobacterium tuberculosis
EDGADVDV

SEQ ID NO: 29252 - protein, 8 aa, Mycobacterium tuberculosis
DGADVDVQ

SEQ ID NO: 29253 - protein, 8 aa, Mycobacterium tuberculosis
GADVDVQA

SEQ ID NO: 29254 - protein, 8 aa, Mycobacterium tuberculosis
ADVDVQAA

SEQ ID NO: 29255 - protein, 8 aa, Mycobacterium tuberculosis
DVDVQAAE

SEQ ID NO: 29256 - protein, 8 aa, Mycobacterium tuberculosis
VDVQAAEG

SEQ ID NO: 29257 - protein, 8 aa, Mycobacterium tuberculosis
DVQAAEGA

SEQ ID NO: 29258 - protein, 8 aa, Mycobacterium tuberculosis
VQAAEGAD

SEQ ID NO: 29259 - protein, 8 aa, Mycobacterium tuberculosis
QAAEGADA

SEQ ID NO: 29260 - protein, 8 aa, Mycobacterium tuberculosis
AAEGADAE

SEQ ID NO: 29261 - protein, 8 aa, Mycobacterium tuberculosis
AEGADAEA

SEQ ID NO: 29262 - protein, 8 aa, Mycobacterium tuberculosis
EGADAEAA

SEQ ID NO: 29263 - protein, 8 aa, Mycobacterium tuberculosis
GADAEAAA

SEQ ID NO: 29264 - protein, 8 aa, Mycobacterium tuberculosis
ADAEAAAM

SEQ ID NO: 29265 - protein, 8 aa, Mycobacterium tuberculosis
DAEAAAMD

SEQ ID NO: 29266 - protein, 8 aa, Mycobacterium tuberculosis
AEAAAMDE

SEQ ID NO: 29267 - protein, 8 aa, Mycobacterium tuberculosis
EAAAMDEW

SEQ ID NO: 29268 - protein, 8 aa, Mycobacterium tuberculosis
AAAMDEWD

SEQ ID NO: 29269 - protein, 8 aa, Mycobacterium tuberculosis
AAMDEWDE

SEQ ID NO: 29270 - protein, 8 aa, Mycobacterium tuberculosis
AMDEWDEW

SEQ ID NO: 29271 - protein, 8 aa, Mycobacterium tuberculosis
MDEWDEWQ

SEQ ID NO: 29272 - protein, 8 aa, Mycobacterium tuberculosis
DEWDEWQA

SEQ ID NO: 29273 - protein, 8 aa, Mycobacterium tuberculosis
EWDEWQAW

SEQ ID NO: 29274 - protein, 8 aa, Mycobacterium tuberculosis
WDEWQAWN

SEQ ID NO: 29275 - protein, 8 aa, Mycobacterium tuberculosis
DEWQAWNE

SEQ ID NO: 29276 - protein, 8 aa, Mycobacterium tuberculosis
EWQAWNEW

SEQ ID NO: 29277 - protein, 8 aa, Mycobacterium tuberculosis
WQAWNEWV

SEQ ID NO: 29278 - protein, 8 aa, Mycobacterium tuberculosis
QAWNEWVA

SEQ ID NO: 29279 - protein, 8 aa, Mycobacterium tuberculosis
AWNEWVAE

SEQ ID NO: 29280 - protein, 8 aa, Mycobacterium tuberculosis
WNEWVAEN

SEQ ID NO: 29281 - protein, 8 aa, Mycobacterium tuberculosis
NEWVAENA

SEQ ID NO: 29282 - protein, 8 aa, Mycobacterium tuberculosis
EWVAENAE

SEQ ID NO: 29283 - protein, 8 aa, Mycobacterium tuberculosis
WVAENAEP

SEQ ID NO: 29284 - protein, 8 aa, Mycobacterium tuberculosis
VAENAEPR

SEQ ID NO: 29285 - protein, 8 aa, Mycobacterium tuberculosis
AENAEPRF

SEQ ID NO: 29286 - protein, 8 aa, Mycobacterium tuberculosis
ENAEPRFE

SEQ ID NO: 29287 - protein, 8 aa, Mycobacterium tuberculosis
NAEPRFEV

SEQ ID NO: 29288 - protein, 8 aa, Mycobacterium tuberculosis
AEPRFEVP

SEQ ID NO: 29289 - protein, 8 aa, Mycobacterium tuberculosis
EPRFEVPR

SEQ ID NO: 29290 - protein, 8 aa, Mycobacterium tuberculosis
PRFEVPRS

SEQ ID NO: 29291 - protein, 8 aa, Mycobacterium tuberculosis
RFEVPRSS

SEQ ID NO: 29292 - protein, 8 aa, Mycobacterium tuberculosis
FEVPRSSS

SEQ ID NO: 29293 - protein, 8 aa, Mycobacterium tuberculosis
EVPRSSSS

SEQ ID NO: 29294 - protein, 8 aa, Mycobacterium tuberculosis
VPRSSSSV

SEQ ID NO: 29295 - protein, 8 aa, Mycobacterium tuberculosis
PRSSSSVI

SEQ ID NO: 29296 - protein, 8 aa, Mycobacterium tuberculosis
RSSSSVIP

SEQ ID NO: 29297 - protein, 8 aa, Mycobacterium tuberculosis
SSSSVIPH

SEQ ID NO: 29298 - protein, 8 aa, Mycobacterium tuberculosis
SSSVIPHS

SEQ ID NO: 29299 - protein, 8 aa, Mycobacterium tuberculosis
SSVIPHSP

SEQ ID NO: 29300 - protein, 8 aa, Mycobacterium tuberculosis
SVIPHSPA

SEQ ID NO: 29301 - protein, 8 aa, Mycobacterium tuberculosis
VIPHSPAA

SEQ ID NO: 29302 - protein, 8 aa, Mycobacterium tuberculosis
IPHSPAAG

SEQ ID NO: 29303 - protein, 9 aa, Mycobacterium tuberculosis
MLLPLGPPL

SEQ ID NO: 29304 - protein, 9 aa, Mycobacterium tuberculosis
LLPLGPPLP

SEQ ID NO: 29305 - protein, 9 aa, Mycobacterium tuberculosis
LPLGPPLPP

SEQ ID NO: 29306 - protein, 9 aa, Mycobacterium tuberculosis
PLGPPLPPD

SEQ ID NO: 29307 - protein, 9 aa, Mycobacterium tuberculosis
LGPPLPPDA

SEQ ID NO: 29308 - protein, 9 aa, Mycobacterium tuberculosis
GPPLPPDAV

SEQ ID NO: 29309 - protein, 9 aa, Mycobacterium tuberculosis
PPLPPDAVV

SEQ ID NO: 29310 - protein, 9 aa, Mycobacterium tuberculosis
PLPPDAVVA

SEQ ID NO: 29311 - protein, 9 aa, Mycobacterium tuberculosis
LPPDAVVAK

SEQ ID NO: 29312 - protein, 9 aa, Mycobacterium tuberculosis
PPDAVVAKR

SEQ ID NO: 29313 - protein, 9 aa, Mycobacterium tuberculosis
PDAVVAKRA

SEQ ID NO: 29314 - protein, 9 aa, Mycobacterium tuberculosis
DAVVAKRAE

SEQ ID NO: 29315 - protein, 9 aa, Mycobacterium tuberculosis
AVVAKRAES

SEQ ID NO: 29316 - protein, 9 aa, Mycobacterium tuberculosis
VVAKRAESG

SEQ ID NO: 29317 - protein, 9 aa, Mycobacterium tuberculosis
VAKRAESGM

SEQ ID NO: 29318 - protein, 9 aa, Mycobacterium tuberculosis
AKRAESGML

SEQ ID NO: 29319 - protein, 9 aa, Mycobacterium tuberculosis
KRAESGMLG

SEQ ID NO: 29320 - protein, 9 aa, Mycobacterium tuberculosis
RAESGMLGG

SEQ ID NO: 29321 - protein, 9 aa, Mycobacterium tuberculosis
AESGMLGGL

SEQ ID NO: 29322 - protein, 9 aa, Mycobacterium tuberculosis
ESGMLGGLS

SEQ ID NO: 29323 - protein, 9 aa, Mycobacterium tuberculosis
SGMLGGLSV

SEQ ID NO: 29324 - protein, 9 aa, Mycobacterium tuberculosis
GMLGGLSVP

SEQ ID NO: 29325 - protein, 9 aa, Mycobacterium tuberculosis
MLGGLSVPL

SEQ ID NO: 29326 - protein, 9 aa, Mycobacterium tuberculosis
LGGLSVPLS

SEQ ID NO: 29327 - protein, 9 aa, Mycobacterium tuberculosis
GGLSVPLSW

SEQ ID NO: 29328 - protein, 9 aa, Mycobacterium tuberculosis
GLSVPLSWG

SEQ ID NO: 29329 - protein, 9 aa, Mycobacterium tuberculosis
LSVPLSWGV

SEQ ID NO: 29330 - protein, 9 aa, Mycobacterium tuberculosis
SVPLSWGVA

SEQ ID NO: 29331 - protein, 9 aa, Mycobacterium tuberculosis
VPLSWGVAV

SEQ ID NO: 29332 - protein, 9 aa, Mycobacterium tuberculosis
PLSWGVAVP

SEQ ID NO: 29333 - protein, 9 aa, Mycobacterium tuberculosis
LSWGVAVPP

SEQ ID NO: 29334 - protein, 9 aa, Mycobacterium tuberculosis
SWGVAVPPD

SEQ ID NO: 29335 - protein, 9 aa, Mycobacterium tuberculosis
WGVAVPPDD

SEQ ID NO: 29336 - protein, 9 aa, Mycobacterium tuberculosis
GVAVPPDDY

SEQ ID NO: 29337 - protein, 9 aa, Mycobacterium tuberculosis
VAVPPDDYD

SEQ ID NO: 29338 - protein, 9 aa, Mycobacterium tuberculosis
AVPPDDYDH

SEQ ID NO: 29339 - protein, 9 aa, Mycobacterium tuberculosis
VPPDDYDHW

SEQ ID NO: 29340 - protein, 9 aa, Mycobacterium tuberculosis
PPDDYDHWA

SEQ ID NO: 29341 - protein, 9 aa, Mycobacterium tuberculosis
PDDYDHWAP

SEQ ID NO: 29342 - protein, 9 aa, Mycobacterium tuberculosis
DDYDHWAPA

SEQ ID NO: 29343 - protein, 9 aa, Mycobacterium tuberculosis
DYDHWAPAP

SEQ ID NO: 29344 - protein, 9 aa, Mycobacterium tuberculosis
YDHWAPAPE

SEQ ID NO: 29345 - protein, 9 aa, Mycobacterium tuberculosis
DHWAPAPED

SEQ ID NO: 29346 - protein, 9 aa, Mycobacterium tuberculosis
HWAPAPEDG

SEQ ID NO: 29347 - protein, 9 aa, Mycobacterium tuberculosis
WAPAPEDGA

SEQ ID NO: 29348 - protein, 9 aa, Mycobacterium tuberculosis
APAPEDGAD

SEQ ID NO: 29349 - protein, 9 aa, Mycobacterium tuberculosis
PAPEDGADV

SEQ ID NO: 29350 - protein, 9 aa, Mycobacterium tuberculosis
APEDGADVD

SEQ ID NO: 29351 - protein, 9 aa, Mycobacterium tuberculosis
PEDGADVDV

SEQ ID NO: 29352 - protein, 9 aa, Mycobacterium tuberculosis
EDGADVDVQ

SEQ ID NO: 29353 - protein, 9 aa, Mycobacterium tuberculosis
DGADVDVQA

SEQ ID NO: 29354 - protein, 9 aa, Mycobacterium tuberculosis
GADVDVQAA

SEQ ID NO: 29355 - protein, 9 aa, Mycobacterium tuberculosis
ADVDVQAAE

SEQ ID NO: 29356 - protein, 9 aa, Mycobacterium tuberculosis
DVDVQAAEG

SEQ ID NO: 29357 - protein, 9 aa, Mycobacterium tuberculosis
VDVQAAEGA

SEQ ID NO: 29358 - protein, 9 aa, Mycobacterium tuberculosis
DVQAAEGAD

SEQ ID NO: 29359 - protein, 9 aa, Mycobacterium tuberculosis
VQAAEGADA

SEQ ID NO: 29360 - protein, 9 aa, Mycobacterium tuberculosis
QAAEGADAE

SEQ ID NO: 29361 - protein, 9 aa, Mycobacterium tuberculosis
AAEGADAEA

SEQ ID NO: 29362 - protein, 9 aa, Mycobacterium tuberculosis
AEGADAEAA

SEQ ID NO: 29363 - protein, 9 aa, Mycobacterium tuberculosis
EGADAEAAA

SEQ ID NO: 29364 - protein, 9 aa, Mycobacterium tuberculosis
GADAEAAAM

SEQ ID NO: 29365 - protein, 9 aa, Mycobacterium tuberculosis
ADAEAAAMD

SEQ ID NO: 29366 - protein, 9 aa, Mycobacterium tuberculosis
DAEAAAMDE

SEQ ID NO: 29367 - protein, 9 aa, Mycobacterium tuberculosis
AEAAAMDEW

SEQ ID NO: 29368 - protein, 9 aa, Mycobacterium tuberculosis
EAAAMDEWD

SEQ ID NO: 29369 - protein, 9 aa, Mycobacterium tuberculosis
AAAMDEWDE

SEQ ID NO: 29370 - protein, 9 aa, Mycobacterium tuberculosis
AAMDEWDEW

SEQ ID NO: 29371 - protein, 9 aa, Mycobacterium tuberculosis
AMDEWDEWQ

SEQ ID NO: 29372 - protein, 9 aa, Mycobacterium tuberculosis
MDEWDEWQA

SEQ ID NO: 29373 - protein, 9 aa, Mycobacterium tuberculosis
DEWDEWQAW

SEQ ID NO: 29374 - protein, 9 aa, Mycobacterium tuberculosis
EWDEWQAWN

SEQ ID NO: 29375 - protein, 9 aa, Mycobacterium tuberculosis
WDEWQAWNE

SEQ ID NO: 29376 - protein, 9 aa, Mycobacterium tuberculosis
DEWQAWNEW

SEQ ID NO: 29377 - protein, 9 aa, Mycobacterium tuberculosis
EWQAWNEWV

SEQ ID NO: 29378 - protein, 9 aa, Mycobacterium tuberculosis
WQAWNEWVA

SEQ ID NO: 29379 - protein, 9 aa, Mycobacterium tuberculosis
QAWNEWVAE

SEQ ID NO: 29380 - protein, 9 aa, Mycobacterium tuberculosis
AWNEWVAEN

SEQ ID NO: 29381 - protein, 9 aa, Mycobacterium tuberculosis
WNEWVAENA

SEQ ID NO: 29382 - protein, 9 aa, Mycobacterium tuberculosis
NEWVAENAE

SEQ ID NO: 29383 - protein, 9 aa, Mycobacterium tuberculosis
EWVAENAEP

SEQ ID NO: 29384 - protein, 9 aa, Mycobacterium tuberculosis
WVAENAEPR

SEQ ID NO: 29385 - protein, 9 aa, Mycobacterium tuberculosis
VAENAEPRF

SEQ ID NO: 29386 - protein, 9 aa, Mycobacterium tuberculosis
AENAEPRFE

SEQ ID NO: 29387 - protein, 9 aa, Mycobacterium tuberculosis
ENAEPRFEV

SEQ ID NO: 29388 - protein, 9 aa, Mycobacterium tuberculosis
NAEPRFEVP

SEQ ID NO: 29389 - protein, 9 aa, Mycobacterium tuberculosis
AEPRFEVPR

SEQ ID NO: 29390 - protein, 9 aa, Mycobacterium tuberculosis
EPRFEVPRS

SEQ ID NO: 29391 - protein, 9 aa, Mycobacterium tuberculosis
PRFEVPRSS

SEQ ID NO: 29392 - protein, 9 aa, Mycobacterium tuberculosis
RFEVPRSSS

SEQ ID NO: 29393 - protein, 9 aa, Mycobacterium tuberculosis
FEVPRSSSS

SEQ ID NO: 29394 - protein, 9 aa, Mycobacterium tuberculosis
EVPRSSSSV

SEQ ID NO: 29395 - protein, 9 aa, Mycobacterium tuberculosis
VPRSSSSVI

SEQ ID NO: 29396 - protein, 9 aa, Mycobacterium tuberculosis
PRSSSSVIP

SEQ ID NO: 29397 - protein, 9 aa, Mycobacterium tuberculosis
RSSSSVIPH

SEQ ID NO: 29398 - protein, 9 aa, Mycobacterium tuberculosis
SSSSVIPHS

SEQ ID NO: 29399 - protein, 9 aa, Mycobacterium tuberculosis
SSSVIPHSP

SEQ ID NO: 29400 - protein, 9 aa, Mycobacterium tuberculosis
SSVIPHSPA

SEQ ID NO: 29401 - protein, 9 aa, Mycobacterium tuberculosis
SVIPHSPAA

SEQ ID NO: 29402 - protein, 9 aa, Mycobacterium tuberculosis
VIPHSPAAG

SEQ ID NO: 29403 - protein, 10 aa, Mycobacterium tuberculosis
MLLPLGPPLP

SEQ ID NO: 29404 - protein, 10 aa, Mycobacterium tuberculosis
LLPLGPPLPP

SEQ ID NO: 29405 - protein, 10 aa, Mycobacterium tuberculosis
LPLGPPLPPD

SEQ ID NO: 29406 - protein, 10 aa, Mycobacterium tuberculosis
PLGPPLPPDA

SEQ ID NO: 29407 - protein, 10 aa, Mycobacterium tuberculosis
LGPPLPPDAV

SEQ ID NO: 29408 - protein, 10 aa, Mycobacterium tuberculosis
GPPLPPDAVV

SEQ ID NO: 29409 - protein, 10 aa, Mycobacterium tuberculosis
PPLPPDAVVA

SEQ ID NO: 29410 - protein, 10 aa, Mycobacterium tuberculosis
PLPPDAVVAK

SEQ ID NO: 29411 - protein, 10 aa, Mycobacterium tuberculosis
LPPDAVVAKR

SEQ ID NO: 29412 - protein, 10 aa, Mycobacterium tuberculosis
PPDAVVAKRA

SEQ ID NO: 29413 - protein, 10 aa, Mycobacterium tuberculosis
PDAVVAKRAE

SEQ ID NO: 29414 - protein, 10 aa, Mycobacterium tuberculosis
DAVVAKRAES

SEQ ID NO: 29415 - protein, 10 aa, Mycobacterium tuberculosis
AVVAKRAESG

SEQ ID NO: 29416 - protein, 10 aa, Mycobacterium tuberculosis
VVAKRAESGM

SEQ ID NO: 29417 - protein, 10 aa, Mycobacterium tuberculosis
VAKRAESGML

SEQ ID NO: 29418 - protein, 10 aa, Mycobacterium tuberculosis
AKRAESGMLG

SEQ ID NO: 29419 - protein, 10 aa, Mycobacterium tuberculosis
KRAESGMLGG

SEQ ID NO: 29420 - protein, 10 aa, Mycobacterium tuberculosis
RAESGMLGGL

SEQ ID NO: 29421 - protein, 10 aa, Mycobacterium tuberculosis
AESGMLGGLS

SEQ ID NO: 29422 - protein, 10 aa, Mycobacterium tuberculosis
ESGMLGGLSV

SEQ ID NO: 29423 - protein, 10 aa, Mycobacterium tuberculosis
SGMLGGLSVP

SEQ ID NO: 29424 - protein, 10 aa, Mycobacterium tuberculosis
GMLGGLSVPL

SEQ ID NO: 29425 - protein, 10 aa, Mycobacterium tuberculosis
MLGGLSVPLS

SEQ ID NO: 29426 - protein, 10 aa, Mycobacterium tuberculosis
LGGLSVPLSW

SEQ ID NO: 29427 - protein, 10 aa, Mycobacterium tuberculosis
GGLSVPLSWG

SEQ ID NO: 29428 - protein, 10 aa, Mycobacterium tuberculosis
GLSVPLSWGV

SEQ ID NO: 29429 - protein, 10 aa, Mycobacterium tuberculosis
LSVPLSWGVA

SEQ ID NO: 29430 - protein, 10 aa, Mycobacterium tuberculosis
SVPLSWGVAV

SEQ ID NO: 29431 - protein, 10 aa, Mycobacterium tuberculosis
VPLSWGVAVP

SEQ ID NO: 29432 - protein, 10 aa, Mycobacterium tuberculosis
PLSWGVAVPP

SEQ ID NO: 29433 - protein, 10 aa, Mycobacterium tuberculosis
LSWGVAVPPD

SEQ ID NO: 29434 - protein, 10 aa, Mycobacterium tuberculosis
SWGVAVPPDD

SEQ ID NO: 29435 - protein, 10 aa, Mycobacterium tuberculosis
WGVAVPPDDY

SEQ ID NO: 29436 - protein, 10 aa, Mycobacterium tuberculosis
GVAVPPDDYD

SEQ ID NO: 29437 - protein, 10 aa, Mycobacterium tuberculosis
VAVPPDDYDH

SEQ ID NO: 29438 - protein, 10 aa, Mycobacterium tuberculosis
AVPPDDYDHW

SEQ ID NO: 29439 - protein, 10 aa, Mycobacterium tuberculosis
VPPDDYDHWA

SEQ ID NO: 29440 - protein, 10 aa, Mycobacterium tuberculosis
PPDDYDHWAP

SEQ ID NO: 29441 - protein, 10 aa, Mycobacterium tuberculosis
PDDYDHWAPA

SEQ ID NO: 29442 - protein, 10 aa, Mycobacterium tuberculosis
DDYDHWAPAP

SEQ ID NO: 29443 - protein, 10 aa, Mycobacterium tuberculosis
DYDHWAPAPE

SEQ ID NO: 29444 - protein, 10 aa, Mycobacterium tuberculosis
YDHWAPAPED

SEQ ID NO: 29445 - protein, 10 aa, Mycobacterium tuberculosis
DHWAPAPEDG

SEQ ID NO: 29446 - protein, 10 aa, Mycobacterium tuberculosis
HWAPAPEDGA

SEQ ID NO: 29447 - protein, 10 aa, Mycobacterium tuberculosis
WAPAPEDGAD

SEQ ID NO: 29448 - protein, 10 aa, Mycobacterium tuberculosis
APAPEDGADV

SEQ ID NO: 29449 - protein, 10 aa, Mycobacterium tuberculosis
PAPEDGADVD

SEQ ID NO: 29450 - protein, 10 aa, Mycobacterium tuberculosis
APEDGADVDV

SEQ ID NO: 29451 - protein, 10 aa, Mycobacterium tuberculosis
PEDGADVDVQ

SEQ ID NO: 29452 - protein, 10 aa, Mycobacterium tuberculosis
EDGADVDVQA

SEQ ID NO: 29453 - protein, 10 aa, Mycobacterium tuberculosis
DGADVDVQAA

SEQ ID NO: 29454 - protein, 10 aa, Mycobacterium tuberculosis
GADVDVQAAE

SEQ ID NO: 29455 - protein, 10 aa, Mycobacterium tuberculosis
ADVDVQAAEG

SEQ ID NO: 29456 - protein, 10 aa, Mycobacterium tuberculosis
DVDVQAAEGA

SEQ ID NO: 29457 - protein, 10 aa, Mycobacterium tuberculosis
VDVQAAEGAD

SEQ ID NO: 29458 - protein, 10 aa, Mycobacterium tuberculosis
DVQAAEGADA

SEQ ID NO: 29459 - protein, 10 aa, Mycobacterium tuberculosis
VQAAEGADAE

SEQ ID NO: 29460 - protein, 10 aa, Mycobacterium tuberculosis
QAAEGADAEA

SEQ ID NO: 29461 - protein, 10 aa, Mycobacterium tuberculosis
AAEGADAEAA

SEQ ID NO: 29462 - protein, 10 aa, Mycobacterium tuberculosis
AEGADAEAAA

SEQ ID NO: 29463 - protein, 10 aa, Mycobacterium tuberculosis
EGADAEAAAM

SEQ ID NO: 29464 - protein, 10 aa, Mycobacterium tuberculosis
GADAEAAAMD

SEQ ID NO: 29465 - protein, 10 aa, Mycobacterium tuberculosis
ADAEAAAMDE

SEQ ID NO: 29466 - protein, 10 aa, Mycobacterium tuberculosis
DAEAAAMDEW

SEQ ID NO: 29467 - protein, 10 aa, Mycobacterium tuberculosis
AEAAAMDEWD

SEQ ID NO: 29468 - protein, 10 aa, Mycobacterium tuberculosis
EAAAMDEWDE

SEQ ID NO: 29469 - protein, 10 aa, Mycobacterium tuberculosis
AAAMDEWDEW

SEQ ID NO: 29470 - protein, 10 aa, Mycobacterium tuberculosis
AAMDEWDEWQ

SEQ ID NO: 29471 - protein, 10 aa, Mycobacterium tuberculosis
AMDEWDEWQA

SEQ ID NO: 29472 - protein, 10 aa, Mycobacterium tuberculosis
MDEWDEWQAW

SEQ ID NO: 29473 - protein, 10 aa, Mycobacterium tuberculosis
DEWDEWQAWN

SEQ ID NO: 29474 - protein, 10 aa, Mycobacterium tuberculosis
EWDEWQAWNE

SEQ ID NO: 29475 - protein, 10 aa, Mycobacterium tuberculosis
WDEWQAWNEW

SEQ ID NO: 29476 - protein, 10 aa, Mycobacterium tuberculosis
DEWQAWNEWV

SEQ ID NO: 29477 - protein, 10 aa, Mycobacterium tuberculosis
EWQAWNEWVA

SEQ ID NO: 29478 - protein, 10 aa, Mycobacterium tuberculosis
WQAWNEWVAE

SEQ ID NO: 29479 - protein, 10 aa, Mycobacterium tuberculosis
QAWNEWVAEN

SEQ ID NO: 29480 - protein, 10 aa, Mycobacterium tuberculosis
AWNEWVAENA

SEQ ID NO: 29481 - protein, 10 aa, Mycobacterium tuberculosis
WNEWVAENAE

SEQ ID NO: 29482 - protein, 10 aa, Mycobacterium tuberculosis
NEWVAENAEP

SEQ ID NO: 29483 - protein, 10 aa, Mycobacterium tuberculosis
EWVAENAEPR

SEQ ID NO: 29484 - protein, 10 aa, Mycobacterium tuberculosis
WVAENAEPRF

SEQ ID NO: 29485 - protein, 10 aa, Mycobacterium tuberculosis
VAENAEPRFE

SEQ ID NO: 29486 - protein, 10 aa, Mycobacterium tuberculosis
AENAEPRFEV

SEQ ID NO: 29487 - protein, 10 aa, Mycobacterium tuberculosis
ENAEPRFEVP

SEQ ID NO: 29488 - protein, 10 aa, Mycobacterium tuberculosis
NAEPRFEVPR

SEQ ID NO: 29489 - protein, 10 aa, Mycobacterium tuberculosis
AEPRFEVPRS

SEQ ID NO: 29490 - protein, 10 aa, Mycobacterium tuberculosis
EPRFEVPRSS

SEQ ID NO: 29491 - protein, 10 aa, Mycobacterium tuberculosis
PRFEVPRSSS

SEQ ID NO: 29492 - protein, 10 aa, Mycobacterium tuberculosis
RFEVPRSSSS

SEQ ID NO: 29493 - protein, 10 aa, Mycobacterium tuberculosis
FEVPRSSSSV

SEQ ID NO: 29494 - protein, 10 aa, Mycobacterium tuberculosis
EVPRSSSSVI

SEQ ID NO: 29495 - protein, 10 aa, Mycobacterium tuberculosis
VPRSSSSVIP

SEQ ID NO: 29496 - protein, 10 aa, Mycobacterium tuberculosis
PRSSSSVIPH

SEQ ID NO: 29497 - protein, 10 aa, Mycobacterium tuberculosis
RSSSSVIPHS

SEQ ID NO: 29498 - protein, 10 aa, Mycobacterium tuberculosis
SSSSVIPHSP

SEQ ID NO: 29499 - protein, 10 aa, Mycobacterium tuberculosis
SSSVIPHSPA

SEQ ID NO: 29500 - protein, 10 aa, Mycobacterium tuberculosis
SSVIPHSPAA

SEQ ID NO: 29501 - protein, 10 aa, Mycobacterium tuberculosis
SVIPHSPAAG

SEQ ID NO: 29502 - protein, 11 aa, Mycobacterium tuberculosis
MLLPLGPPLPP

SEQ ID NO: 29503 - protein, 11 aa, Mycobacterium tuberculosis
LLPLGPPLPPD

SEQ ID NO: 29504 - protein, 11 aa, Mycobacterium tuberculosis
LPLGPPLPPDA

SEQ ID NO: 29505 - protein, 11 aa, Mycobacterium tuberculosis
PLGPPLPPDAV

SEQ ID NO: 29506 - protein, 11 aa, Mycobacterium tuberculosis
LGPPLPPDAVV

SEQ ID NO: 29507 - protein, 11 aa, Mycobacterium tuberculosis
GPPLPPDAVVA

SEQ ID NO: 29508 - protein, 11 aa, Mycobacterium tuberculosis
PPLPPDAVVAK

SEQ ID NO: 29509 - protein, 11 aa, Mycobacterium tuberculosis
PLPPDAVVAKR

SEQ ID NO: 29510 - protein, 11 aa, Mycobacterium tuberculosis
LPPDAVVAKRA

SEQ ID NO: 29511 - protein, 11 aa, Mycobacterium tuberculosis
PPDAVVAKRAE

SEQ ID NO: 29512 - protein, 11 aa, Mycobacterium tuberculosis
PDAVVAKRAES

SEQ ID NO: 29513 - protein, 11 aa, Mycobacterium tuberculosis
DAVVAKRAESG

SEQ ID NO: 29514 - protein, 11 aa, Mycobacterium tuberculosis
AVVAKRAESGM

SEQ ID NO: 29515 - protein, 11 aa, Mycobacterium tuberculosis
VVAKRAESGML

SEQ ID NO: 29516 - protein, 11 aa, Mycobacterium tuberculosis
VAKRAESGMLG

SEQ ID NO: 29517 - protein, 11 aa, Mycobacterium tuberculosis
AKRAESGMLGG

SEQ ID NO: 29518 - protein, 11 aa, Mycobacterium tuberculosis
KRAESGMLGGL

SEQ ID NO: 29519 - protein, 11 aa, Mycobacterium tuberculosis
RAESGMLGGLS

SEQ ID NO: 29520 - protein, 11 aa, Mycobacterium tuberculosis
AESGMLGGLSV

SEQ ID NO: 29521 - protein, 11 aa, Mycobacterium tuberculosis
ESGMLGGLSVP

SEQ ID NO: 29522 - protein, 11 aa, Mycobacterium tuberculosis
SGMLGGLSVPL

SEQ ID NO: 29523 - protein, 11 aa, Mycobacterium tuberculosis
GMLGGLSVPLS

SEQ ID NO: 29524 - protein, 11 aa, Mycobacterium tuberculosis
MLGGLSVPLSW

SEQ ID NO: 29525 - protein, 11 aa, Mycobacterium tuberculosis
LGGLSVPLSWG

SEQ ID NO: 29526 - protein, 11 aa, Mycobacterium tuberculosis
GGLSVPLSWGV

SEQ ID NO: 29527 - protein, 11 aa, Mycobacterium tuberculosis
GLSVPLSWGVA

SEQ ID NO: 29528 - protein, 11 aa, Mycobacterium tuberculosis
LSVPLSWGVAV

SEQ ID NO: 29529 - protein, 11 aa, Mycobacterium tuberculosis
SVPLSWGVAVP

SEQ ID NO: 29530 - protein, 11 aa, Mycobacterium tuberculosis
VPLSWGVAVPP

SEQ ID NO: 29531 - protein, 11 aa, Mycobacterium tuberculosis
PLSWGVAVPPD

SEQ ID NO: 29532 - protein, 11 aa, Mycobacterium tuberculosis
LSWGVAVPPDD

SEQ ID NO: 29533 - protein, 11 aa, Mycobacterium tuberculosis
SWGVAVPPDDY

SEQ ID NO: 29534 - protein, 11 aa, Mycobacterium tuberculosis
WGVAVPPDDYD

SEQ ID NO: 29535 - protein, 11 aa, Mycobacterium tuberculosis
GVAVPPDDYDH

SEQ ID NO: 29536 - protein, 11 aa, Mycobacterium tuberculosis
VAVPPDDYDHW

SEQ ID NO: 29537 - protein, 11 aa, Mycobacterium tuberculosis
AVPPDDYDHWA

SEQ ID NO: 29538 - protein, 11 aa, Mycobacterium tuberculosis
VPPDDYDHWAP

SEQ ID NO: 29539 - protein, 11 aa, Mycobacterium tuberculosis
PPDDYDHWAPA

SEQ ID NO: 29540 - protein, 11 aa, Mycobacterium tuberculosis
PDDYDHWAPAP

SEQ ID NO: 29541 - protein, 11 aa, Mycobacterium tuberculosis
DDYDHWAPAPE

SEQ ID NO: 29542 - protein, 11 aa, Mycobacterium tuberculosis
DYDHWAPAPED

SEQ ID NO: 29543 - protein, 11 aa, Mycobacterium tuberculosis
YDHWAPAPEDG

SEQ ID NO: 29544 - protein, 11 aa, Mycobacterium tuberculosis
DHWAPAPEDGA

SEQ ID NO: 29545 - protein, 11 aa, Mycobacterium tuberculosis
HWAPAPEDGAD

SEQ ID NO: 29546 - protein, 11 aa, Mycobacterium tuberculosis
WAPAPEDGADV

SEQ ID NO: 29547 - protein, 11 aa, Mycobacterium tuberculosis
APAPEDGADVD

SEQ ID NO: 29548 - protein, 11 aa, Mycobacterium tuberculosis
PAPEDGADVDV

SEQ ID NO: 29549 - protein, 11 aa, Mycobacterium tuberculosis
APEDGADVDVQ

SEQ ID NO: 29550 - protein, 11 aa, Mycobacterium tuberculosis
PEDGADVDVQA

SEQ ID NO: 29551 - protein, 11 aa, Mycobacterium tuberculosis
EDGADVDVQAA

SEQ ID NO: 29552 - protein, 11 aa, Mycobacterium tuberculosis
DGADVDVQAAE

SEQ ID NO: 29553 - protein, 11 aa, Mycobacterium tuberculosis
GADVDVQAAEG

SEQ ID NO: 29554 - protein, 11 aa, Mycobacterium tuberculosis
ADVDVQAAEGA

SEQ ID NO: 29555 - protein, 11 aa, Mycobacterium tuberculosis
DVDVQAAEGAD

SEQ ID NO: 29556 - protein, 11 aa, Mycobacterium tuberculosis
VDVQAAEGADA

SEQ ID NO: 29557 - protein, 11 aa, Mycobacterium tuberculosis
DVQAAEGADAE

SEQ ID NO: 29558 - protein, 11 aa, Mycobacterium tuberculosis
VQAAEGADAEA

SEQ ID NO: 29559 - protein, 11 aa, Mycobacterium tuberculosis
QAAEGADAEAA

SEQ ID NO: 29560 - protein, 11 aa, Mycobacterium tuberculosis
AAEGADAEAAA

SEQ ID NO: 29561 - protein, 11 aa, Mycobacterium tuberculosis
AEGADAEAAAM

SEQ ID NO: 29562 - protein, 11 aa, Mycobacterium tuberculosis
EGADAEAAAMD

SEQ ID NO: 29563 - protein, 11 aa, Mycobacterium tuberculosis
GADAEAAAMDE

SEQ ID NO: 29564 - protein, 11 aa, Mycobacterium tuberculosis
ADAEAAAMDEW

SEQ ID NO: 29565 - protein, 11 aa, Mycobacterium tuberculosis
DAEAAAMDEWD

SEQ ID NO: 29566 - protein, 11 aa, Mycobacterium tuberculosis
AEAAAMDEWDE

SEQ ID NO: 29567 - protein, 11 aa, Mycobacterium tuberculosis
EAAAMDEWDEW

SEQ ID NO: 29568 - protein, 11 aa, Mycobacterium tuberculosis
AAAMDEWDEWQ

SEQ ID NO: 29569 - protein, 11 aa, Mycobacterium tuberculosis
AAMDEWDEWQA

SEQ ID NO: 29570 - protein, 11 aa, Mycobacterium tuberculosis
AMDEWDEWQAW

SEQ ID NO: 29571 - protein, 11 aa, Mycobacterium tuberculosis
MDEWDEWQAWN

SEQ ID NO: 29572 - protein, 11 aa, Mycobacterium tuberculosis
DEWDEWQAWNE

SEQ ID NO: 29573 - protein, 11 aa, Mycobacterium tuberculosis
EWDEWQAWNEW

SEQ ID NO: 29574 - protein, 11 aa, Mycobacterium tuberculosis
WDEWQAWNEWV

SEQ ID NO: 29575 - protein, 11 aa, Mycobacterium tuberculosis
DEWQAWNEWVA

SEQ ID NO: 29576 - protein, 11 aa, Mycobacterium tuberculosis
EWQAWNEWVAE

SEQ ID NO: 29577 - protein, 11 aa, Mycobacterium tuberculosis
WQAWNEWVAEN

SEQ ID NO: 29578 - protein, 11 aa, Mycobacterium tuberculosis
QAWNEWVAENA

SEQ ID NO: 29579 - protein, 11 aa, Mycobacterium tuberculosis
AWNEWVAENAE

SEQ ID NO: 29580 - protein, 11 aa, Mycobacterium tuberculosis
WNEWVAENAEP

SEQ ID NO: 29581 - protein, 11 aa, Mycobacterium tuberculosis
NEWVAENAEPR

SEQ ID NO: 29582 - protein, 11 aa, Mycobacterium tuberculosis
EWVAENAEPRF

SEQ ID NO: 29583 - protein, 11 aa, Mycobacterium tuberculosis
WVAENAEPRFE

SEQ ID NO: 29584 - protein, 11 aa, Mycobacterium tuberculosis
VAENAEPRFEV

SEQ ID NO: 29585 - protein, 11 aa, Mycobacterium tuberculosis
AENAEPRFEVP

SEQ ID NO: 29586 - protein, 11 aa, Mycobacterium tuberculosis
ENAEPRFEVPR

SEQ ID NO: 29587 - protein, 11 aa, Mycobacterium tuberculosis
NAEPRFEVPRS

SEQ ID NO: 29588 - protein, 11 aa, Mycobacterium tuberculosis
AEPRFEVPRSS

SEQ ID NO: 29589 - protein, 11 aa, Mycobacterium tuberculosis
EPRFEVPRSSS

SEQ ID NO: 29590 - protein, 11 aa, Mycobacterium tuberculosis
PRFEVPRSSSS

SEQ ID NO: 29591 - protein, 11 aa, Mycobacterium tuberculosis
RFEVPRSSSSV

SEQ ID NO: 29592 - protein, 11 aa, Mycobacterium tuberculosis
FEVPRSSSSVI

SEQ ID NO: 29593 - protein, 11 aa, Mycobacterium tuberculosis
EVPRSSSSVIP

SEQ ID NO: 29594 - protein, 11 aa, Mycobacterium tuberculosis
VPRSSSSVIPH

SEQ ID NO: 29595 - protein, 11 aa, Mycobacterium tuberculosis
PRSSSSVIPHS

SEQ ID NO: 29596 - protein, 11 aa, Mycobacterium tuberculosis
RSSSSVIPHSP

SEQ ID NO: 29597 - protein, 11 aa, Mycobacterium tuberculosis
SSSSVIPHSPA

SEQ ID NO: 29598 - protein, 11 aa, Mycobacterium tuberculosis
SSSVIPHSPAA

SEQ ID NO: 29599 - protein, 11 aa, Mycobacterium tuberculosis
SSVIPHSPAAG

SEQ ID NO: 29600 - protein, 8 aa, Mycobacterium tuberculosis
MGEGSRRP

SEQ ID NO: 29601 - protein, 8 aa, Mycobacterium tuberculosis
GEGSRRPS

SEQ ID NO: 29602 - protein, 8 aa, Mycobacterium tuberculosis
EGSRRPSG

SEQ ID NO: 29603 - protein, 8 aa, Mycobacterium tuberculosis
GSRRPSGM

SEQ ID NO: 29604 - protein, 8 aa, Mycobacterium tuberculosis
SRRPSGML

SEQ ID NO: 29605 - protein, 8 aa, Mycobacterium tuberculosis
RRPSGMLM

SEQ ID NO: 29606 - protein, 8 aa, Mycobacterium tuberculosis
RPSGMLMS

SEQ ID NO: 29607 - protein, 8 aa, Mycobacterium tuberculosis
PSGMLMSV

SEQ ID NO: 29608 - protein, 8 aa, Mycobacterium tuberculosis
SGMLMSVD

SEQ ID NO: 29609 - protein, 8 aa, Mycobacterium tuberculosis
GMLMSVDL

SEQ ID NO: 29610 - protein, 8 aa, Mycobacterium tuberculosis
MLMSVDLE

SEQ ID NO: 29611 - protein, 8 aa, Mycobacterium tuberculosis
LMSVDLEP

SEQ ID NO: 29612 - protein, 8 aa, Mycobacterium tuberculosis
MSVDLEPV

SEQ ID NO: 29613 - protein, 8 aa, Mycobacterium tuberculosis
SVDLEPVQ

SEQ ID NO: 29614 - protein, 8 aa, Mycobacterium tuberculosis
VDLEPVQL

SEQ ID NO: 29615 - protein, 8 aa, Mycobacterium tuberculosis
DLEPVQLV

SEQ ID NO: 29616 - protein, 8 aa, Mycobacterium tuberculosis
LEPVQLVG

SEQ ID NO: 29617 - protein, 8 aa, Mycobacterium tuberculosis
EPVQLVGP

SEQ ID NO: 29618 - protein, 8 aa, Mycobacterium tuberculosis
PVQLVGPD

SEQ ID NO: 29619 - protein, 8 aa, Mycobacterium tuberculosis
VQLVGPDG

SEQ ID NO: 29620 - protein, 8 aa, Mycobacterium tuberculosis
QLVGPDGT

SEQ ID NO: 29621 - protein, 8 aa, Mycobacterium tuberculosis
LVGPDGTP

SEQ ID NO: 29622 - protein, 8 aa, Mycobacterium tuberculosis
VGPDGTPT

SEQ ID NO: 29623 - protein, 8 aa, Mycobacterium tuberculosis
GPDGTPTA

SEQ ID NO: 29624 - protein, 8 aa, Mycobacterium tuberculosis
PDGTPTAE

SEQ ID NO: 29625 - protein, 8 aa, Mycobacterium tuberculosis
DGTPTAER

SEQ ID NO: 29626 - protein, 8 aa, Mycobacterium tuberculosis
GTPTAERR

SEQ ID NO: 29627 - protein, 8 aa, Mycobacterium tuberculosis
TPTAERRY

SEQ ID NO: 29628 - protein, 8 aa, Mycobacterium tuberculosis
PTAERRYH

SEQ ID NO: 29629 - protein, 8 aa, Mycobacterium tuberculosis
TAERRYHR

SEQ ID NO: 29630 - protein, 8 aa, Mycobacterium tuberculosis
AERRYHRD

SEQ ID NO: 29631 - protein, 8 aa, Mycobacterium tuberculosis
ERRYHRDL

SEQ ID NO: 29632 - protein, 8 aa, Mycobacterium tuberculosis
RRYHRDLP

SEQ ID NO: 29633 - protein, 8 aa, Mycobacterium tuberculosis
RYHRDLPE

SEQ ID NO: 29634 - protein, 8 aa, Mycobacterium tuberculosis
YHRDLPEE

SEQ ID NO: 29635 - protein, 8 aa, Mycobacterium tuberculosis
HRDLPEET

SEQ ID NO: 29636 - protein, 8 aa, Mycobacterium tuberculosis
RDLPEETL

SEQ ID NO: 29637 - protein, 8 aa, Mycobacterium tuberculosis
DLPEETLR

SEQ ID NO: 29638 - protein, 8 aa, Mycobacterium tuberculosis
LPEETLRW

SEQ ID NO: 29639 - protein, 8 aa, Mycobacterium tuberculosis
PEETLRWL

SEQ ID NO: 29640 - protein, 8 aa, Mycobacterium tuberculosis
EETLRWLY

SEQ ID NO: 29641 - protein, 8 aa, Mycobacterium tuberculosis
ETLRWLYE

SEQ ID NO: 29642 - protein, 8 aa, Mycobacterium tuberculosis
TLRWLYEM

SEQ ID NO: 29643 - protein, 8 aa, Mycobacterium tuberculosis
LRWLYEMM

SEQ ID NO: 29644 - protein, 8 aa, Mycobacterium tuberculosis
RWLYEMMV

SEQ ID NO: 29645 - protein, 8 aa, Mycobacterium tuberculosis
WLYEMMVV

SEQ ID NO: 29646 - protein, 8 aa, Mycobacterium tuberculosis
LYEMMVVT

SEQ ID NO: 29647 - protein, 8 aa, Mycobacterium tuberculosis
YEMMVVTR

SEQ ID NO: 29648 - protein, 8 aa, Mycobacterium tuberculosis
EMMVVTRE

SEQ ID NO: 29649 - protein, 8 aa, Mycobacterium tuberculosis
MMVVTREL

SEQ ID NO: 29650 - protein, 8 aa, Mycobacterium tuberculosis
MVVTRELD

SEQ ID NO: 29651 - protein, 8 aa, Mycobacterium tuberculosis
VVTRELDT

SEQ ID NO: 29652 - protein, 8 aa, Mycobacterium tuberculosis
VTRELDTE

SEQ ID NO: 29653 - protein, 8 aa, Mycobacterium tuberculosis
TRELDTEF

SEQ ID NO: 29654 - protein, 8 aa, Mycobacterium tuberculosis
RELDTEFV

SEQ ID NO: 29655 - protein, 8 aa, Mycobacterium tuberculosis
ELDTEFVN

SEQ ID NO: 29656 - protein, 8 aa, Mycobacterium tuberculosis
LDTEFVNL

SEQ ID NO: 29657 - protein, 8 aa, Mycobacterium tuberculosis
DTEFVNLQ

SEQ ID NO: 29658 - protein, 8 aa, Mycobacterium tuberculosis
TEFVNLQR

SEQ ID NO: 29659 - protein, 8 aa, Mycobacterium tuberculosis
EFVNLQRQ

SEQ ID NO: 29660 - protein, 8 aa, Mycobacterium tuberculosis
FVNLQRQG

SEQ ID NO: 29661 - protein, 8 aa, Mycobacterium tuberculosis
VNLQRQGE

SEQ ID NO: 29662 - protein, 8 aa, Mycobacterium tuberculosis
NLQRQGEL

SEQ ID NO: 29663 - protein, 8 aa, Mycobacterium tuberculosis
LQRQGELA

SEQ ID NO: 29664 - protein, 8 aa, Mycobacterium tuberculosis
QRQGELAL

SEQ ID NO: 29665 - protein, 8 aa, Mycobacterium tuberculosis
RQGELALY

SEQ ID NO: 29666 - protein, 8 aa, Mycobacterium tuberculosis
QGELALYT

SEQ ID NO: 29667 - protein, 8 aa, Mycobacterium tuberculosis
GELALYTP

SEQ ID NO: 29668 - protein, 8 aa, Mycobacterium tuberculosis
ELALYTPC

SEQ ID NO: 29669 - protein, 8 aa, Mycobacterium tuberculosis
LALYTPCR

SEQ ID NO: 29670 - protein, 8 aa, Mycobacterium tuberculosis
ALYTPCRG

SEQ ID NO: 29671 - protein, 8 aa, Mycobacterium tuberculosis
LYTPCRGQ

SEQ ID NO: 29672 - protein, 8 aa, Mycobacterium tuberculosis
YTPCRGQE

SEQ ID NO: 29673 - protein, 8 aa, Mycobacterium tuberculosis
TPCRGQEA

SEQ ID NO: 29674 - protein, 8 aa, Mycobacterium tuberculosis
PCRGQEAA

SEQ ID NO: 29675 - protein, 8 aa, Mycobacterium tuberculosis
CRGQEAAQ

SEQ ID NO: 29676 - protein, 8 aa, Mycobacterium tuberculosis
RGQEAAQV

SEQ ID NO: 29677 - protein, 8 aa, Mycobacterium tuberculosis
GQEAAQVG

SEQ ID NO: 29678 - protein, 8 aa, Mycobacterium tuberculosis
QEAAQVGA

SEQ ID NO: 29679 - protein, 8 aa, Mycobacterium tuberculosis
EAAQVGAA

SEQ ID NO: 29680 - protein, 8 aa, Mycobacterium tuberculosis
AAQVGAAA

SEQ ID NO: 29681 - protein, 8 aa, Mycobacterium tuberculosis
AQVGAAAC

SEQ ID NO: 29682 - protein, 8 aa, Mycobacterium tuberculosis
QVGAAACL

SEQ ID NO: 29683 - protein, 8 aa, Mycobacterium tuberculosis
VGAAACLR

SEQ ID NO: 29684 - protein, 8 aa, Mycobacterium tuberculosis
GAAACLRK

SEQ ID NO: 29685 - protein, 8 aa, Mycobacterium tuberculosis
AAACLRKT

SEQ ID NO: 29686 - protein, 8 aa, Mycobacterium tuberculosis
AACLRKTD

SEQ ID NO: 29687 - protein, 8 aa, Mycobacterium tuberculosis
ACLRKTDW

SEQ ID NO: 29688 - protein, 8 aa, Mycobacterium tuberculosis
CLRKTDWL

SEQ ID NO: 29689 - protein, 8 aa, Mycobacterium tuberculosis
LRKTDWLF

SEQ ID NO: 29690 - protein, 8 aa, Mycobacterium tuberculosis
RKTDWLFP

SEQ ID NO: 29691 - protein, 8 aa, Mycobacterium tuberculosis
KTDWLFPQ

SEQ ID NO: 29692 - protein, 8 aa, Mycobacterium tuberculosis
TDWLFPQY

SEQ ID NO: 29693 - protein, 8 aa, Mycobacterium tuberculosis
DWLFPQYR

SEQ ID NO: 29694 - protein, 8 aa, Mycobacterium tuberculosis
WLFPQYRE

SEQ ID NO: 29695 - protein, 8 aa, Mycobacterium tuberculosis
LFPQYREL

SEQ ID NO: 29696 - protein, 8 aa, Mycobacterium tuberculosis
FPQYRELG

SEQ ID NO: 29697 - protein, 8 aa, Mycobacterium tuberculosis
PQYRELGV

SEQ ID NO: 29698 - protein, 8 aa, Mycobacterium tuberculosis
QYRELGVY

SEQ ID NO: 29699 - protein, 8 aa, Mycobacterium tuberculosis
YRELGVYL

SEQ ID NO: 29700 - protein, 8 aa, Mycobacterium tuberculosis
RELGVYLV

SEQ ID NO: 29701 - protein, 8 aa, Mycobacterium tuberculosis
ELGVYLVR

SEQ ID NO: 29702 - protein, 8 aa, Mycobacterium tuberculosis
LGVYLVRG

SEQ ID NO: 29703 - protein, 8 aa, Mycobacterium tuberculosis
GVYLVRGI

SEQ ID NO: 29704 - protein, 8 aa, Mycobacterium tuberculosis
VYLVRGIP

SEQ ID NO: 29705 - protein, 8 aa, Mycobacterium tuberculosis
YLVRGIPP

SEQ ID NO: 29706 - protein, 8 aa, Mycobacterium tuberculosis
LVRGIPPG

SEQ ID NO: 29707 - protein, 8 aa, Mycobacterium tuberculosis
VRGIPPGH

SEQ ID NO: 29708 - protein, 8 aa, Mycobacterium tuberculosis
RGIPPGHV

SEQ ID NO: 29709 - protein, 8 aa, Mycobacterium tuberculosis
GIPPGHVG

SEQ ID NO: 29710 - protein, 8 aa, Mycobacterium tuberculosis
IPPGHVGV

SEQ ID NO: 29711 - protein, 8 aa, Mycobacterium tuberculosis
PPGHVGVA

SEQ ID NO: 29712 - protein, 8 aa, Mycobacterium tuberculosis
PGHVGVAW

SEQ ID NO: 29713 - protein, 8 aa, Mycobacterium tuberculosis
GHVGVAWR

SEQ ID NO: 29714 - protein, 8 aa, Mycobacterium tuberculosis
HVGVAWRG

SEQ ID NO: 29715 - protein, 8 aa, Mycobacterium tuberculosis
VGVAWRGT

SEQ ID NO: 29716 - protein, 8 aa, Mycobacterium tuberculosis
GVAWRGTW

SEQ ID NO: 29717 - protein, 8 aa, Mycobacterium tuberculosis
VAWRGTWH

SEQ ID NO: 29718 - protein, 8 aa, Mycobacterium tuberculosis
AWRGTWHG

SEQ ID NO: 29719 - protein, 8 aa, Mycobacterium tuberculosis
WRGTWHGG

SEQ ID NO: 29720 - protein, 8 aa, Mycobacterium tuberculosis
RGTWHGGL

SEQ ID NO: 29721 - protein, 8 aa, Mycobacterium tuberculosis
GTWHGGLQ

SEQ ID NO: 29722 - protein, 8 aa, Mycobacterium tuberculosis
TWHGGLQF

SEQ ID NO: 29723 - protein, 8 aa, Mycobacterium tuberculosis
WHGGLQFT

SEQ ID NO: 29724 - protein, 8 aa, Mycobacterium tuberculosis
HGGLQFTT

SEQ ID NO: 29725 - protein, 8 aa, Mycobacterium tuberculosis
GGLQFTTK

SEQ ID NO: 29726 - protein, 8 aa, Mycobacterium tuberculosis
GLQFTTKC

SEQ ID NO: 29727 - protein, 8 aa, Mycobacterium tuberculosis
LQFTTKCC

SEQ ID NO: 29728 - protein, 8 aa, Mycobacterium tuberculosis
QFTTKCCA

SEQ ID NO: 29729 - protein, 8 aa, Mycobacterium tuberculosis
FTTKCCAP

SEQ ID NO: 29730 - protein, 8 aa, Mycobacterium tuberculosis
TTKCCAPM

SEQ ID NO: 29731 - protein, 8 aa, Mycobacterium tuberculosis
TKCCAPMS

SEQ ID NO: 29732 - protein, 8 aa, Mycobacterium tuberculosis
KCCAPMSV

SEQ ID NO: 29733 - protein, 8 aa, Mycobacterium tuberculosis
CCAPMSVP

SEQ ID NO: 29734 - protein, 8 aa, Mycobacterium tuberculosis
CAPMSVPI

SEQ ID NO: 29735 - protein, 8 aa, Mycobacterium tuberculosis
APMSVPIG

SEQ ID NO: 29736 - protein, 8 aa, Mycobacterium tuberculosis
PMSVPIGT

SEQ ID NO: 29737 - protein, 8 aa, Mycobacterium tuberculosis
MSVPIGTQ

SEQ ID NO: 29738 - protein, 8 aa, Mycobacterium tuberculosis
SVPIGTQT

SEQ ID NO: 29739 - protein, 8 aa, Mycobacterium tuberculosis
VPIGTQTL

SEQ ID NO: 29740 - protein, 8 aa, Mycobacterium tuberculosis
PIGTQTLH

SEQ ID NO: 29741 - protein, 8 aa, Mycobacterium tuberculosis
IGTQTLHA

SEQ ID NO: 29742 - protein, 8 aa, Mycobacterium tuberculosis
GTQTLHAV

SEQ ID NO: 29743 - protein, 8 aa, Mycobacterium tuberculosis
TQTLHAVG

SEQ ID NO: 29744 - protein, 8 aa, Mycobacterium tuberculosis
QTLHAVGA

SEQ ID NO: 29745 - protein, 8 aa, Mycobacterium tuberculosis
TLHAVGAA

SEQ ID NO: 29746 - protein, 8 aa, Mycobacterium tuberculosis
LHAVGAAM

SEQ ID NO: 29747 - protein, 8 aa, Mycobacterium tuberculosis
HAVGAAMA

SEQ ID NO: 29748 - protein, 8 aa, Mycobacterium tuberculosis
AVGAAMAA

SEQ ID NO: 29749 - protein, 8 aa, Mycobacterium tuberculosis
VGAAMAAQ

SEQ ID NO: 29750 - protein, 8 aa, Mycobacterium tuberculosis
GAAMAAQR

SEQ ID NO: 29751 - protein, 8 aa, Mycobacterium tuberculosis
AAMAAQRL

SEQ ID NO: 29752 - protein, 8 aa, Mycobacterium tuberculosis
AMAAQRLD

SEQ ID NO: 29753 - protein, 8 aa, Mycobacterium tuberculosis
MAAQRLDE

SEQ ID NO: 29754 - protein, 8 aa, Mycobacterium tuberculosis
AAQRLDED

SEQ ID NO: 29755 - protein, 8 aa, Mycobacterium tuberculosis
AQRLDEDS

SEQ ID NO: 29756 - protein, 8 aa, Mycobacterium tuberculosis
QRLDEDSV

SEQ ID NO: 29757 - protein, 8 aa, Mycobacterium tuberculosis
RLDEDSVT

SEQ ID NO: 29758 - protein, 8 aa, Mycobacterium tuberculosis
LDEDSVTV

SEQ ID NO: 29759 - protein, 8 aa, Mycobacterium tuberculosis
DEDSVTVA

SEQ ID NO: 29760 - protein, 8 aa, Mycobacterium tuberculosis
EDSVTVAF

SEQ ID NO: 29761 - protein, 8 aa, Mycobacterium tuberculosis
DSVTVAFL

SEQ ID NO: 29762 - protein, 8 aa, Mycobacterium tuberculosis
SVTVAFLG

SEQ ID NO: 29763 - protein, 8 aa, Mycobacterium tuberculosis
VTVAFLGD

SEQ ID NO: 29764 - protein, 8 aa, Mycobacterium tuberculosis
TVAFLGDG

SEQ ID NO: 29765 - protein, 8 aa, Mycobacterium tuberculosis
VAFLGDGA

SEQ ID NO: 29766 - protein, 8 aa, Mycobacterium tuberculosis
AFLGDGAT

SEQ ID NO: 29767 - protein, 8 aa, Mycobacterium tuberculosis
FLGDGATS

SEQ ID NO: 29768 - protein, 8 aa, Mycobacterium tuberculosis
LGDGATSE

SEQ ID NO: 29769 - protein, 8 aa, Mycobacterium tuberculosis
GDGATSEG

SEQ ID NO: 29770 - protein, 8 aa, Mycobacterium tuberculosis
DGATSEGD

SEQ ID NO: 29771 - protein, 8 aa, Mycobacterium tuberculosis
GATSEGDV

SEQ ID NO: 29772 - protein, 8 aa, Mycobacterium tuberculosis
ATSEGDVH

SEQ ID NO: 29773 - protein, 8 aa, Mycobacterium tuberculosis
TSEGDVHE

SEQ ID NO: 29774 - protein, 8 aa, Mycobacterium tuberculosis
SEGDVHEA

SEQ ID NO: 29775 - protein, 8 aa, Mycobacterium tuberculosis
EGDVHEAL

SEQ ID NO: 29776 - protein, 8 aa, Mycobacterium tuberculosis
GDVHEALN

SEQ ID NO: 29777 - protein, 8 aa, Mycobacterium tuberculosis
DVHEALNF

SEQ ID NO: 29778 - protein, 8 aa, Mycobacterium tuberculosis
VHEALNFA

SEQ ID NO: 29779 - protein, 8 aa, Mycobacterium tuberculosis
HEALNFAA

SEQ ID NO: 29780 - protein, 8 aa, Mycobacterium tuberculosis
EALNFAAV

SEQ ID NO: 29781 - protein, 8 aa, Mycobacterium tuberculosis
ALNFAAVF

SEQ ID NO: 29782 - protein, 8 aa, Mycobacterium tuberculosis
LNFAAVFT

SEQ ID NO: 29783 - protein, 8 aa, Mycobacterium tuberculosis
NFAAVFTT

SEQ ID NO: 29784 - protein, 8 aa, Mycobacterium tuberculosis
FAAVFTTP

SEQ ID NO: 29785 - protein, 8 aa, Mycobacterium tuberculosis
AAVFTTPC

SEQ ID NO: 29786 - protein, 8 aa, Mycobacterium tuberculosis
AVFTTPCV

SEQ ID NO: 29787 - protein, 8 aa, Mycobacterium tuberculosis
VFTTPCVF

SEQ ID NO: 29788 - protein, 8 aa, Mycobacterium tuberculosis
FTTPCVFY

SEQ ID NO: 29789 - protein, 8 aa, Mycobacterium tuberculosis
TTPCVFYV

SEQ ID NO: 29790 - protein, 8 aa, Mycobacterium tuberculosis
TPCVFYVQ

SEQ ID NO: 29791 - protein, 8 aa, Mycobacterium tuberculosis
PCVFYVQN

SEQ ID NO: 29792 - protein, 8 aa, Mycobacterium tuberculosis
CVFYVQNN

SEQ ID NO: 29793 - protein, 8 aa, Mycobacterium tuberculosis
VFYVQNNQ

SEQ ID NO: 29794 - protein, 8 aa, Mycobacterium tuberculosis
FYVQNNQW

SEQ ID NO: 29795 - protein, 8 aa, Mycobacterium tuberculosis
YVQNNQWA

SEQ ID NO: 29796 - protein, 8 aa, Mycobacterium tuberculosis
VQNNQWAI

SEQ ID NO: 29797 - protein, 8 aa, Mycobacterium tuberculosis
QNNQWAIS

SEQ ID NO: 29798 - protein, 8 aa, Mycobacterium tuberculosis
NNQWAISM

SEQ ID NO: 29799 - protein, 8 aa, Mycobacterium tuberculosis
NQWAISMP

SEQ ID NO: 29800 - protein, 8 aa, Mycobacterium tuberculosis
QWAISMPV

SEQ ID NO: 29801 - protein, 8 aa, Mycobacterium tuberculosis
WAISMPVS

SEQ ID NO: 29802 - protein, 8 aa, Mycobacterium tuberculosis
AISMPVSR

SEQ ID NO: 29803 - protein, 8 aa, Mycobacterium tuberculosis
ISMPVSRQ

SEQ ID NO: 29804 - protein, 8 aa, Mycobacterium tuberculosis
SMPVSRQT

SEQ ID NO: 29805 - protein, 8 aa, Mycobacterium tuberculosis
MPVSRQTA

SEQ ID NO: 29806 - protein, 8 aa, Mycobacterium tuberculosis
PVSRQTAA

SEQ ID NO: 29807 - protein, 8 aa, Mycobacterium tuberculosis
VSRQTAAP

SEQ ID NO: 29808 - protein, 8 aa, Mycobacterium tuberculosis
SRQTAAPS

SEQ ID NO: 29809 - protein, 8 aa, Mycobacterium tuberculosis
RQTAAPSI

SEQ ID NO: 29810 - protein, 8 aa, Mycobacterium tuberculosis
QTAAPSIA

SEQ ID NO: 29811 - protein, 8 aa, Mycobacterium tuberculosis
TAAPSIAH

SEQ ID NO: 29812 - protein, 8 aa, Mycobacterium tuberculosis
AAPSIAHK

SEQ ID NO: 29813 - protein, 8 aa, Mycobacterium tuberculosis
APSIAHKA

SEQ ID NO: 29814 - protein, 8 aa, Mycobacterium tuberculosis
PSIAHKAI

SEQ ID NO: 29815 - protein, 8 aa, Mycobacterium tuberculosis
SIAHKAIG

SEQ ID NO: 29816 - protein, 8 aa, Mycobacterium tuberculosis
IAHKAIGY

SEQ ID NO: 29817 - protein, 8 aa, Mycobacterium tuberculosis
AHKAIGYG

SEQ ID NO: 29818 - protein, 8 aa, Mycobacterium tuberculosis
HKAIGYGM

SEQ ID NO: 29819 - protein, 8 aa, Mycobacterium tuberculosis
KAIGYGMP

SEQ ID NO: 29820 - protein, 8 aa, Mycobacterium tuberculosis
AIGYGMPG

SEQ ID NO: 29821 - protein, 8 aa, Mycobacterium tuberculosis
IGYGMPGI

SEQ ID NO: 29822 - protein, 8 aa, Mycobacterium tuberculosis
GYGMPGIR

SEQ ID NO: 29823 - protein, 8 aa, Mycobacterium tuberculosis
YGMPGIRV

SEQ ID NO: 29824 - protein, 8 aa, Mycobacterium tuberculosis
GMPGIRVD

SEQ ID NO: 29825 - protein, 8 aa, Mycobacterium tuberculosis
MPGIRVDG

SEQ ID NO: 29826 - protein, 8 aa, Mycobacterium tuberculosis
PGIRVDGN

SEQ ID NO: 29827 - protein, 8 aa, Mycobacterium tuberculosis
GIRVDGND

SEQ ID NO: 29828 - protein, 8 aa, Mycobacterium tuberculosis
IRVDGNDV

SEQ ID NO: 29829 - protein, 8 aa, Mycobacterium tuberculosis
RVDGNDVL

SEQ ID NO: 29830 - protein, 8 aa, Mycobacterium tuberculosis
VDGNDVLA

SEQ ID NO: 29831 - protein, 8 aa, Mycobacterium tuberculosis
DGNDVLAC

SEQ ID NO: 29832 - protein, 8 aa, Mycobacterium tuberculosis
GNDVLACY

SEQ ID NO: 29833 - protein, 8 aa, Mycobacterium tuberculosis
NDVLACYA

SEQ ID NO: 29834 - protein, 8 aa, Mycobacterium tuberculosis
DVLACYAV

SEQ ID NO: 29835 - protein, 8 aa, Mycobacterium tuberculosis
VLACYAVM

SEQ ID NO: 29836 - protein, 8 aa, Mycobacterium tuberculosis
LACYAVMA

SEQ ID NO: 29837 - protein, 8 aa, Mycobacterium tuberculosis
ACYAVMAE

SEQ ID NO: 29838 - protein, 8 aa, Mycobacterium tuberculosis
CYAVMAEA

SEQ ID NO: 29839 - protein, 8 aa, Mycobacterium tuberculosis
YAVMAEAA

SEQ ID NO: 29840 - protein, 8 aa, Mycobacterium tuberculosis
AVMAEAAA

SEQ ID NO: 29841 - protein, 8 aa, Mycobacterium tuberculosis
VMAEAAAR

SEQ ID NO: 29842 - protein, 8 aa, Mycobacterium tuberculosis
MAEAAARA

SEQ ID NO: 29843 - protein, 8 aa, Mycobacterium tuberculosis
AEAAARAR

SEQ ID NO: 29844 - protein, 8 aa, Mycobacterium tuberculosis
EAAARARA

SEQ ID NO: 29845 - protein, 8 aa, Mycobacterium tuberculosis
AAARARAG

SEQ ID NO: 29846 - protein, 8 aa, Mycobacterium tuberculosis
AARARAGD

SEQ ID NO: 29847 - protein, 8 aa, Mycobacterium tuberculosis
ARARAGDG

SEQ ID NO: 29848 - protein, 8 aa, Mycobacterium tuberculosis
RARAGDGP

SEQ ID NO: 29849 - protein, 8 aa, Mycobacterium tuberculosis
ARAGDGPT

SEQ ID NO: 29850 - protein, 8 aa, Mycobacterium tuberculosis
RAGDGPTL

SEQ ID NO: 29851 - protein, 8 aa, Mycobacterium tuberculosis
AGDGPTLI

SEQ ID NO: 29852 - protein, 8 aa, Mycobacterium tuberculosis
GDGPTLIE

SEQ ID NO: 29853 - protein, 8 aa, Mycobacterium tuberculosis
DGPTLIEA

SEQ ID NO: 29854 - protein, 8 aa, Mycobacterium tuberculosis
GPTLIEAV

SEQ ID NO: 29855 - protein, 8 aa, Mycobacterium tuberculosis
PTLIEAVT

SEQ ID NO: 29856 - protein, 8 aa, Mycobacterium tuberculosis
TLIEAVTY

SEQ ID NO: 29857 - protein, 8 aa, Mycobacterium tuberculosis
LIEAVTYR

SEQ ID NO: 29858 - protein, 8 aa, Mycobacterium tuberculosis
IEAVTYRL

SEQ ID NO: 29859 - protein, 8 aa, Mycobacterium tuberculosis
EAVTYRLG

SEQ ID NO: 29860 - protein, 8 aa, Mycobacterium tuberculosis
AVTYRLGP

SEQ ID NO: 29861 - protein, 8 aa, Mycobacterium tuberculosis
VTYRLGPH

SEQ ID NO: 29862 - protein, 8 aa, Mycobacterium tuberculosis
TYRLGPHT

SEQ ID NO: 29863 - protein, 8 aa, Mycobacterium tuberculosis
YRLGPHTT

SEQ ID NO: 29864 - protein, 8 aa, Mycobacterium tuberculosis
RLGPHTTA

SEQ ID NO: 29865 - protein, 8 aa, Mycobacterium tuberculosis
LGPHTTAD

SEQ ID NO: 29866 - protein, 8 aa, Mycobacterium tuberculosis
GPHTTADD

SEQ ID NO: 29867 - protein, 8 aa, Mycobacterium tuberculosis
PHTTADDP

SEQ ID NO: 29868 - protein, 8 aa, Mycobacterium tuberculosis
HTTADDPT

SEQ ID NO: 29869 - protein, 8 aa, Mycobacterium tuberculosis
TTADDPTR

SEQ ID NO: 29870 - protein, 8 aa, Mycobacterium tuberculosis
TADDPTRY

SEQ ID NO: 29871 - protein, 8 aa, Mycobacterium tuberculosis
ADDPTRYR

SEQ ID NO: 29872 - protein, 8 aa, Mycobacterium tuberculosis
DDPTRYRS

SEQ ID NO: 29873 - protein, 8 aa, Mycobacterium tuberculosis
DPTRYRSQ

SEQ ID NO: 29874 - protein, 8 aa, Mycobacterium tuberculosis
PTRYRSQE

SEQ ID NO: 29875 - protein, 8 aa, Mycobacterium tuberculosis
TRYRSQEE

SEQ ID NO: 29876 - protein, 8 aa, Mycobacterium tuberculosis
RYRSQEEV

SEQ ID NO: 29877 - protein, 8 aa, Mycobacterium tuberculosis
YRSQEEVD

SEQ ID NO: 29878 - protein, 8 aa, Mycobacterium tuberculosis
RSQEEVDR

SEQ ID NO: 29879 - protein, 8 aa, Mycobacterium tuberculosis
SQEEVDRW

SEQ ID NO: 29880 - protein, 8 aa, Mycobacterium tuberculosis
QEEVDRWA

SEQ ID NO: 29881 - protein, 8 aa, Mycobacterium tuberculosis
EEVDRWAT

SEQ ID NO: 29882 - protein, 8 aa, Mycobacterium tuberculosis
EVDRWATL

SEQ ID NO: 29883 - protein, 8 aa, Mycobacterium tuberculosis
VDRWATLD

SEQ ID NO: 29884 - protein, 8 aa, Mycobacterium tuberculosis
DRWATLDP

SEQ ID NO: 29885 - protein, 8 aa, Mycobacterium tuberculosis
RWATLDPI

SEQ ID NO: 29886 - protein, 8 aa, Mycobacterium tuberculosis
WATLDPIP

SEQ ID NO: 29887 - protein, 8 aa, Mycobacterium tuberculosis
ATLDPIPR

SEQ ID NO: 29888 - protein, 8 aa, Mycobacterium tuberculosis
TLDPIPRY

SEQ ID NO: 29889 - protein, 8 aa, Mycobacterium tuberculosis
LDPIPRYR

SEQ ID NO: 29890 - protein, 8 aa, Mycobacterium tuberculosis
DPIPRYRT

SEQ ID NO: 29891 - protein, 8 aa, Mycobacterium tuberculosis
PIPRYRTY

SEQ ID NO: 29892 - protein, 8 aa, Mycobacterium tuberculosis
IPRYRTYL

SEQ ID NO: 29893 - protein, 8 aa, Mycobacterium tuberculosis
PRYRTYLQ

SEQ ID NO: 29894 - protein, 8 aa, Mycobacterium tuberculosis
RYRTYLQD

SEQ ID NO: 29895 - protein, 8 aa, Mycobacterium tuberculosis
YRTYLQDQ

SEQ ID NO: 29896 - protein, 8 aa, Mycobacterium tuberculosis
RTYLQDQG

SEQ ID NO: 29897 - protein, 8 aa, Mycobacterium tuberculosis
TYLQDQGL

SEQ ID NO: 29898 - protein, 8 aa, Mycobacterium tuberculosis
YLQDQGLW

SEQ ID NO: 29899 - protein, 8 aa, Mycobacterium tuberculosis
LQDQGLWS

SEQ ID NO: 29900 - protein, 8 aa, Mycobacterium tuberculosis
QDQGLWSQ

SEQ ID NO: 29901 - protein, 8 aa, Mycobacterium tuberculosis
DQGLWSQR

SEQ ID NO: 29902 - protein, 8 aa, Mycobacterium tuberculosis
QGLWSQRL

SEQ ID NO: 29903 - protein, 8 aa, Mycobacterium tuberculosis
GLWSQRLE

SEQ ID NO: 29904 - protein, 8 aa, Mycobacterium tuberculosis
LWSQRLEE

SEQ ID NO: 29905 - protein, 8 aa, Mycobacterium tuberculosis
WSQRLEEQ

SEQ ID NO: 29906 - protein, 8 aa, Mycobacterium tuberculosis
SQRLEEQV

SEQ ID NO: 29907 - protein, 8 aa, Mycobacterium tuberculosis
QRLEEQVT

SEQ ID NO: 29908 - protein, 8 aa, Mycobacterium tuberculosis
RLEEQVTA

SEQ ID NO: 29909 - protein, 8 aa, Mycobacterium tuberculosis
LEEQVTAR

SEQ ID NO: 29910 - protein, 8 aa, Mycobacterium tuberculosis
EEQVTARA

SEQ ID NO: 29911 - protein, 8 aa, Mycobacterium tuberculosis
EQVTARAK

SEQ ID NO: 29912 - protein, 8 aa, Mycobacterium tuberculosis
QVTARAKH

SEQ ID NO: 29913 - protein, 8 aa, Mycobacterium tuberculosis
VTARAKHV

SEQ ID NO: 29914 - protein, 8 aa, Mycobacterium tuberculosis
TARAKHVR

SEQ ID NO: 29915 - protein, 8 aa, Mycobacterium tuberculosis
ARAKHVRS

SEQ ID NO: 29916 - protein, 8 aa, Mycobacterium tuberculosis
RAKHVRSE

SEQ ID NO: 29917 - protein, 8 aa, Mycobacterium tuberculosis
AKHVRSEL

SEQ ID NO: 29918 - protein, 8 aa, Mycobacterium tuberculosis
KHVRSELR

SEQ ID NO: 29919 - protein, 8 aa, Mycobacterium tuberculosis
HVRSELRD

SEQ ID NO: 29920 - protein, 8 aa, Mycobacterium tuberculosis
VRSELRDA

SEQ ID NO: 29921 - protein, 8 aa, Mycobacterium tuberculosis
RSELRDAV

SEQ ID NO: 29922 - protein, 8 aa, Mycobacterium tuberculosis
SELRDAVF

SEQ ID NO: 29923 - protein, 8 aa, Mycobacterium tuberculosis
ELRDAVFD

SEQ ID NO: 29924 - protein, 8 aa, Mycobacterium tuberculosis
LRDAVFDA

SEQ ID NO: 29925 - protein, 8 aa, Mycobacterium tuberculosis
RDAVFDAP

SEQ ID NO: 29926 - protein, 8 aa, Mycobacterium tuberculosis
DAVFDAPD

SEQ ID NO: 29927 - protein, 8 aa, Mycobacterium tuberculosis
AVFDAPDF

SEQ ID NO: 29928 - protein, 8 aa, Mycobacterium tuberculosis
VFDAPDFD

SEQ ID NO: 29929 - protein, 8 aa, Mycobacterium tuberculosis
FDAPDFDV

SEQ ID NO: 29930 - protein, 8 aa, Mycobacterium tuberculosis
DAPDFDVD

SEQ ID NO: 29931 - protein, 8 aa, Mycobacterium tuberculosis
APDFDVDE

SEQ ID NO: 29932 - protein, 8 aa, Mycobacterium tuberculosis
PDFDVDEV

SEQ ID NO: 29933 - protein, 8 aa, Mycobacterium tuberculosis
DFDVDEVF

SEQ ID NO: 29934 - protein, 8 aa, Mycobacterium tuberculosis
FDVDEVFT

SEQ ID NO: 29935 - protein, 8 aa, Mycobacterium tuberculosis
DVDEVFTT

SEQ ID NO: 29936 - protein, 8 aa, Mycobacterium tuberculosis
VDEVFTTV

SEQ ID NO: 29937 - protein, 8 aa, Mycobacterium tuberculosis
DEVFTTVY

SEQ ID NO: 29938 - protein, 8 aa, Mycobacterium tuberculosis
EVFTTVYA

SEQ ID NO: 29939 - protein, 8 aa, Mycobacterium tuberculosis
VFTTVYAE

SEQ ID NO: 29940 - protein, 8 aa, Mycobacterium tuberculosis
FTTVYAEI

SEQ ID NO: 29941 - protein, 8 aa, Mycobacterium tuberculosis
TTVYAEIT

SEQ ID NO: 29942 - protein, 8 aa, Mycobacterium tuberculosis
TVYAEITP

SEQ ID NO: 29943 - protein, 8 aa, Mycobacterium tuberculosis
VYAEITPG

SEQ ID NO: 29944 - protein, 8 aa, Mycobacterium tuberculosis
YAEITPGL

SEQ ID NO: 29945 - protein, 8 aa, Mycobacterium tuberculosis
AEITPGLQ

SEQ ID NO: 29946 - protein, 8 aa, Mycobacterium tuberculosis
EITPGLQA

SEQ ID NO: 29947 - protein, 8 aa, Mycobacterium tuberculosis
ITPGLQAQ

SEQ ID NO: 29948 - protein, 8 aa, Mycobacterium tuberculosis
TPGLQAQR

SEQ ID NO: 29949 - protein, 8 aa, Mycobacterium tuberculosis
PGLQAQRE

SEQ ID NO: 29950 - protein, 8 aa, Mycobacterium tuberculosis
GLQAQREQ

SEQ ID NO: 29951 - protein, 8 aa, Mycobacterium tuberculosis
LQAQREQL

SEQ ID NO: 29952 - protein, 8 aa, Mycobacterium tuberculosis
QAQREQLR

SEQ ID NO: 29953 - protein, 8 aa, Mycobacterium tuberculosis
AQREQLRA

SEQ ID NO: 29954 - protein, 8 aa, Mycobacterium tuberculosis
QREQLRAE

SEQ ID NO: 29955 - protein, 8 aa, Mycobacterium tuberculosis
REQLRAEL

SEQ ID NO: 29956 - protein, 8 aa, Mycobacterium tuberculosis
EQLRAELA

SEQ ID NO: 29957 - protein, 8 aa, Mycobacterium tuberculosis
QLRAELAR

SEQ ID NO: 29958 - protein, 8 aa, Mycobacterium tuberculosis
LRAELART

SEQ ID NO: 29959 - protein, 8 aa, Mycobacterium tuberculosis
RAELARTD

SEQ ID NO: 29960 - protein, 9 aa, Mycobacterium tuberculosis
MGEGSRRPS

SEQ ID NO: 29961 - protein, 9 aa, Mycobacterium tuberculosis
GEGSRRPSG

SEQ ID NO: 29962 - protein, 9 aa, Mycobacterium tuberculosis
EGSRRPSGM

SEQ ID NO: 29963 - protein, 9 aa, Mycobacterium tuberculosis
GSRRPSGML

SEQ ID NO: 29964 - protein, 9 aa, Mycobacterium tuberculosis
SRRPSGMLM

SEQ ID NO: 29965 - protein, 9 aa, Mycobacterium tuberculosis
RRPSGMLMS

SEQ ID NO: 29966 - protein, 9 aa, Mycobacterium tuberculosis
RPSGMLMSV

SEQ ID NO: 29967 - protein, 9 aa, Mycobacterium tuberculosis
PSGMLMSVD

SEQ ID NO: 29968 - protein, 9 aa, Mycobacterium tuberculosis
SGMLMSVDL

SEQ ID NO: 29969 - protein, 9 aa, Mycobacterium tuberculosis
GMLMSVDLE

SEQ ID NO: 29970 - protein, 9 aa, Mycobacterium tuberculosis
MLMSVDLEP

SEQ ID NO: 29971 - protein, 9 aa, Mycobacterium tuberculosis
LMSVDLEPV

SEQ ID NO: 29972 - protein, 9 aa, Mycobacterium tuberculosis
MSVDLEPVQ

SEQ ID NO: 29973 - protein, 9 aa, Mycobacterium tuberculosis
SVDLEPVQL

SEQ ID NO: 29974 - protein, 9 aa, Mycobacterium tuberculosis
VDLEPVQLV

SEQ ID NO: 29975 - protein, 9 aa, Mycobacterium tuberculosis
DLEPVQLVG

SEQ ID NO: 29976 - protein, 9 aa, Mycobacterium tuberculosis
LEPVQLVGP

SEQ ID NO: 29977 - protein, 9 aa, Mycobacterium tuberculosis
EPVQLVGPD

SEQ ID NO: 29978 - protein, 9 aa, Mycobacterium tuberculosis
PVQLVGPDG

SEQ ID NO: 29979 - protein, 9 aa, Mycobacterium tuberculosis
VQLVGPDGT

SEQ ID NO: 29980 - protein, 9 aa, Mycobacterium tuberculosis
QLVGPDGTP

SEQ ID NO: 29981 - protein, 9 aa, Mycobacterium tuberculosis
LVGPDGTPT

SEQ ID NO: 29982 - protein, 9 aa, Mycobacterium tuberculosis
VGPDGTPTA

SEQ ID NO: 29983 - protein, 9 aa, Mycobacterium tuberculosis
GPDGTPTAE

SEQ ID NO: 29984 - protein, 9 aa, Mycobacterium tuberculosis
PDGTPTAER

SEQ ID NO: 29985 - protein, 9 aa, Mycobacterium tuberculosis
DGTPTAERR

SEQ ID NO: 29986 - protein, 9 aa, Mycobacterium tuberculosis
GTPTAERRY

SEQ ID NO: 29987 - protein, 9 aa, Mycobacterium tuberculosis
TPTAERRYH

SEQ ID NO: 29988 - protein, 9 aa, Mycobacterium tuberculosis
PTAERRYHR

SEQ ID NO: 29989 - protein, 9 aa, Mycobacterium tuberculosis
TAERRYHRD

SEQ ID NO: 29990 - protein, 9 aa, Mycobacterium tuberculosis
AERRYHRDL

SEQ ID NO: 29991 - protein, 9 aa, Mycobacterium tuberculosis
ERRYHRDLP

SEQ ID NO: 29992 - protein, 9 aa, Mycobacterium tuberculosis
RRYHRDLPE

SEQ ID NO: 29993 - protein, 9 aa, Mycobacterium tuberculosis
RYHRDLPEE

SEQ ID NO: 29994 - protein, 9 aa, Mycobacterium tuberculosis
YHRDLPEET

SEQ ID NO: 29995 - protein, 9 aa, Mycobacterium tuberculosis
HRDLPEETL

SEQ ID NO: 29996 - protein, 9 aa, Mycobacterium tuberculosis
RDLPEETLR

SEQ ID NO: 29997 - protein, 9 aa, Mycobacterium tuberculosis
DLPEETLRW

SEQ ID NO: 29998 - protein, 9 aa, Mycobacterium tuberculosis
LPEETLRWL

SEQ ID NO: 29999 - protein, 9 aa, Mycobacterium tuberculosis
PEETLRWLY

SEQ ID NO: 30000 - protein, 9 aa, Mycobacterium tuberculosis
EETLRWLYE

SEQ ID NO: 30001 - protein, 9 aa, Mycobacterium tuberculosis
ETLRWLYEM

SEQ ID NO: 30002 - protein, 9 aa, Mycobacterium tuberculosis
TLRWLYEMM

SEQ ID NO: 30003 - protein, 9 aa, Mycobacterium tuberculosis
LRWLYEMMV

SEQ ID NO: 30004 - protein, 9 aa, Mycobacterium tuberculosis
RWLYEMMVV

SEQ ID NO: 30005 - protein, 9 aa, Mycobacterium tuberculosis
WLYEMMVVT

SEQ ID NO: 30006 - protein, 9 aa, Mycobacterium tuberculosis
LYEMMVVTR

SEQ ID NO: 30007 - protein, 9 aa, Mycobacterium tuberculosis
YEMMVVTRE

SEQ ID NO: 30008 - protein, 9 aa, Mycobacterium tuberculosis
EMMVVTREL

SEQ ID NO: 30009 - protein, 9 aa, Mycobacterium tuberculosis
MMVVTRELD

SEQ ID NO: 30010 - protein, 9 aa, Mycobacterium tuberculosis
MVVTRELDT

SEQ ID NO: 30011 - protein, 9 aa, Mycobacterium tuberculosis
VVTRELDTE

SEQ ID NO: 30012 - protein, 9 aa, Mycobacterium tuberculosis
VTRELDTEF

SEQ ID NO: 30013 - protein, 9 aa, Mycobacterium tuberculosis
TRELDTEFV

SEQ ID NO: 30014 - protein, 9 aa, Mycobacterium tuberculosis
RELDTEFVN

SEQ ID NO: 30015 - protein, 9 aa, Mycobacterium tuberculosis
ELDTEFVNL

SEQ ID NO: 30016 - protein, 9 aa, Mycobacterium tuberculosis
LDTEFVNLQ

SEQ ID NO: 30017 - protein, 9 aa, Mycobacterium tuberculosis
DTEFVNLQR

SEQ ID NO: 30018 - protein, 9 aa, Mycobacterium tuberculosis
TEFVNLQRQ

SEQ ID NO: 30019 - protein, 9 aa, Mycobacterium tuberculosis
EFVNLQRQG

SEQ ID NO: 30020 - protein, 9 aa, Mycobacterium tuberculosis
FVNLQRQGE

SEQ ID NO: 30021 - protein, 9 aa, Mycobacterium tuberculosis
VNLQRQGEL

SEQ ID NO: 30022 - protein, 9 aa, Mycobacterium tuberculosis
NLQRQGELA

SEQ ID NO: 30023 - protein, 9 aa, Mycobacterium tuberculosis
LQRQGELAL

SEQ ID NO: 30024 - protein, 9 aa, Mycobacterium tuberculosis
QRQGELALY

SEQ ID NO: 30025 - protein, 9 aa, Mycobacterium tuberculosis
RQGELALYT

SEQ ID NO: 30026 - protein, 9 aa, Mycobacterium tuberculosis
QGELALYTP

SEQ ID NO: 30027 - protein, 9 aa, Mycobacterium tuberculosis
GELALYTPC

SEQ ID NO: 30028 - protein, 9 aa, Mycobacterium tuberculosis
ELALYTPCR

SEQ ID NO: 30029 - protein, 9 aa, Mycobacterium tuberculosis
LALYTPCRG

SEQ ID NO: 30030 - protein, 9 aa, Mycobacterium tuberculosis
ALYTPCRGQ

SEQ ID NO: 30031 - protein, 9 aa, Mycobacterium tuberculosis
LYTPCRGQE

SEQ ID NO: 30032 - protein, 9 aa, Mycobacterium tuberculosis
YTPCRGQEA

SEQ ID NO: 30033 - protein, 9 aa, Mycobacterium tuberculosis
TPCRGQEAA

SEQ ID NO: 30034 - protein, 9 aa, Mycobacterium tuberculosis
PCRGQEAAQ

SEQ ID NO: 30035 - protein, 9 aa, Mycobacterium tuberculosis
CRGQEAAQV

SEQ ID NO: 30036 - protein, 9 aa, Mycobacterium tuberculosis
RGQEAAQVG

SEQ ID NO: 30037 - protein, 9 aa, Mycobacterium tuberculosis
GQEAAQVGA

SEQ ID NO: 30038 - protein, 9 aa, Mycobacterium tuberculosis
QEAAQVGAA

SEQ ID NO: 30039 - protein, 9 aa, Mycobacterium tuberculosis
EAAQVGAAA

SEQ ID NO: 30040 - protein, 9 aa, Mycobacterium tuberculosis
AAQVGAAAC

SEQ ID NO: 30041 - protein, 9 aa, Mycobacterium tuberculosis
AQVGAAACL

SEQ ID NO: 30042 - protein, 9 aa, Mycobacterium tuberculosis
QVGAAACLR

SEQ ID NO: 30043 - protein, 9 aa, Mycobacterium tuberculosis
VGAAACLRK

SEQ ID NO: 30044 - protein, 9 aa, Mycobacterium tuberculosis
GAAACLRKT

SEQ ID NO: 30045 - protein, 9 aa, Mycobacterium tuberculosis
AAACLRKTD

SEQ ID NO: 30046 - protein, 9 aa, Mycobacterium tuberculosis
AACLRKTDW

SEQ ID NO: 30047 - protein, 9 aa, Mycobacterium tuberculosis
ACLRKTDWL

SEQ ID NO: 30048 - protein, 9 aa, Mycobacterium tuberculosis
CLRKTDWLF

SEQ ID NO: 30049 - protein, 9 aa, Mycobacterium tuberculosis
LRKTDWLFP

SEQ ID NO: 30050 - protein, 9 aa, Mycobacterium tuberculosis
RKTDWLFPQ

SEQ ID NO: 30051 - protein, 9 aa, Mycobacterium tuberculosis
KTDWLFPQY

SEQ ID NO: 30052 - protein, 9 aa, Mycobacterium tuberculosis
TDWLFPQYR

SEQ ID NO: 30053 - protein, 9 aa, Mycobacterium tuberculosis
DWLFPQYRE

SEQ ID NO: 30054 - protein, 9 aa, Mycobacterium tuberculosis
WLFPQYREL

SEQ ID NO: 30055 - protein, 9 aa, Mycobacterium tuberculosis
LFPQYRELG

SEQ ID NO: 30056 - protein, 9 aa, Mycobacterium tuberculosis
FPQYRELGV

SEQ ID NO: 30057 - protein, 9 aa, Mycobacterium tuberculosis
PQYRELGVY

SEQ ID NO: 30058 - protein, 9 aa, Mycobacterium tuberculosis
QYRELGVYL

SEQ ID NO: 30059 - protein, 9 aa, Mycobacterium tuberculosis
YRELGVYLV

SEQ ID NO: 30060 - protein, 9 aa, Mycobacterium tuberculosis
RELGVYLVR

SEQ ID NO: 30061 - protein, 9 aa, Mycobacterium tuberculosis
ELGVYLVRG

SEQ ID NO: 30062 - protein, 9 aa, Mycobacterium tuberculosis
LGVYLVRGI

SEQ ID NO: 30063 - protein, 9 aa, Mycobacterium tuberculosis
GVYLVRGIP

SEQ ID NO: 30064 - protein, 9 aa, Mycobacterium tuberculosis
VYLVRGIPP

SEQ ID NO: 30065 - protein, 9 aa, Mycobacterium tuberculosis
YLVRGIPPG

SEQ ID NO: 30066 - protein, 9 aa, Mycobacterium tuberculosis
LVRGIPPGH

SEQ ID NO: 30067 - protein, 9 aa, Mycobacterium tuberculosis
VRGIPPGHV

SEQ ID NO: 30068 - protein, 9 aa, Mycobacterium tuberculosis
RGIPPGHVG

SEQ ID NO: 30069 - protein, 9 aa, Mycobacterium tuberculosis
GIPPGHVGV

SEQ ID NO: 30070 - protein, 9 aa, Mycobacterium tuberculosis
IPPGHVGVA

SEQ ID NO: 30071 - protein, 9 aa, Mycobacterium tuberculosis
PPGHVGVAW

SEQ ID NO: 30072 - protein, 9 aa, Mycobacterium tuberculosis
PGHVGVAWR

SEQ ID NO: 30073 - protein, 9 aa, Mycobacterium tuberculosis
GHVGVAWRG

SEQ ID NO: 30074 - protein, 9 aa, Mycobacterium tuberculosis
HVGVAWRGT

SEQ ID NO: 30075 - protein, 9 aa, Mycobacterium tuberculosis
VGVAWRGTW

SEQ ID NO: 30076 - protein, 9 aa, Mycobacterium tuberculosis
GVAWRGTWH

SEQ ID NO: 30077 - protein, 9 aa, Mycobacterium tuberculosis
VAWRGTWHG

SEQ ID NO: 30078 - protein, 9 aa, Mycobacterium tuberculosis
AWRGTWHGG

SEQ ID NO: 30079 - protein, 9 aa, Mycobacterium tuberculosis
WRGTWHGGL

SEQ ID NO: 30080 - protein, 9 aa, Mycobacterium tuberculosis
RGTWHGGLQ

SEQ ID NO: 30081 - protein, 9 aa, Mycobacterium tuberculosis
GTWHGGLQF

SEQ ID NO: 30082 - protein, 9 aa, Mycobacterium tuberculosis
TWHGGLQFT

SEQ ID NO: 30083 - protein, 9 aa, Mycobacterium tuberculosis
WHGGLQFTT

SEQ ID NO: 30084 - protein, 9 aa, Mycobacterium tuberculosis
HGGLQFTTK

SEQ ID NO: 30085 - protein, 9 aa, Mycobacterium tuberculosis
GGLQFTTKC

SEQ ID NO: 30086 - protein, 9 aa, Mycobacterium tuberculosis
GLQFTTKCC

SEQ ID NO: 30087 - protein, 9 aa, Mycobacterium tuberculosis
LQFTTKCCA

SEQ ID NO: 30088 - protein, 9 aa, Mycobacterium tuberculosis
QFTTKCCAP

SEQ ID NO: 30089 - protein, 9 aa, Mycobacterium tuberculosis
FTTKCCAPM

SEQ ID NO: 30090 - protein, 9 aa, Mycobacterium tuberculosis
TTKCCAPMS

SEQ ID NO: 30091 - protein, 9 aa, Mycobacterium tuberculosis
TKCCAPMSV

SEQ ID NO: 30092 - protein, 9 aa, Mycobacterium tuberculosis
KCCAPMSVP

SEQ ID NO: 30093 - protein, 9 aa, Mycobacterium tuberculosis
CCAPMSVPI

SEQ ID NO: 30094 - protein, 9 aa, Mycobacterium tuberculosis
CAPMSVPIG

SEQ ID NO: 30095 - protein, 9 aa, Mycobacterium tuberculosis
APMSVPIGT

SEQ ID NO: 30096 - protein, 9 aa, Mycobacterium tuberculosis
PMSVPIGTQ

SEQ ID NO: 30097 - protein, 9 aa, Mycobacterium tuberculosis
MSVPIGTQT

SEQ ID NO: 30098 - protein, 9 aa, Mycobacterium tuberculosis
SVPIGTQTL

SEQ ID NO: 30099 - protein, 9 aa, Mycobacterium tuberculosis
VPIGTQTLH

SEQ ID NO: 30100 - protein, 9 aa, Mycobacterium tuberculosis
PIGTQTLHA

SEQ ID NO: 30101 - protein, 9 aa, Mycobacterium tuberculosis
IGTQTLHAV

SEQ ID NO: 30102 - protein, 9 aa, Mycobacterium tuberculosis
GTQTLHAVG

SEQ ID NO: 30103 - protein, 9 aa, Mycobacterium tuberculosis
TQTLHAVGA

SEQ ID NO: 30104 - protein, 9 aa, Mycobacterium tuberculosis
QTLHAVGAA

SEQ ID NO: 30105 - protein, 9 aa, Mycobacterium tuberculosis
TLHAVGAAM

SEQ ID NO: 30106 - protein, 9 aa, Mycobacterium tuberculosis
LHAVGAAMA

SEQ ID NO: 30107 - protein, 9 aa, Mycobacterium tuberculosis
HAVGAAMAA

SEQ ID NO: 30108 - protein, 9 aa, Mycobacterium tuberculosis
AVGAAMAAQ

SEQ ID NO: 30109 - protein, 9 aa, Mycobacterium tuberculosis
VGAAMAAQR

SEQ ID NO: 30110 - protein, 9 aa, Mycobacterium tuberculosis
GAAMAAQRL

SEQ ID NO: 30111 - protein, 9 aa, Mycobacterium tuberculosis
AAMAAQRLD

SEQ ID NO: 30112 - protein, 9 aa, Mycobacterium tuberculosis
AMAAQRLDE

SEQ ID NO: 30113 - protein, 9 aa, Mycobacterium tuberculosis
MAAQRLDED

SEQ ID NO: 30114 - protein, 9 aa, Mycobacterium tuberculosis
AAQRLDEDS

SEQ ID NO: 30115 - protein, 9 aa, Mycobacterium tuberculosis
AQRLDEDSV

SEQ ID NO: 30116 - protein, 9 aa, Mycobacterium tuberculosis
QRLDEDSVT

SEQ ID NO: 30117 - protein, 9 aa, Mycobacterium tuberculosis
RLDEDSVTV

SEQ ID NO: 30118 - protein, 9 aa, Mycobacterium tuberculosis
LDEDSVTVA

SEQ ID NO: 30119 - protein, 9 aa, Mycobacterium tuberculosis
DEDSVTVAF

SEQ ID NO: 30120 - protein, 9 aa, Mycobacterium tuberculosis
EDSVTVAFL

SEQ ID NO: 30121 - protein, 9 aa, Mycobacterium tuberculosis
DSVTVAFLG

SEQ ID NO: 30122 - protein, 9 aa, Mycobacterium tuberculosis
SVTVAFLGD

SEQ ID NO: 30123 - protein, 9 aa, Mycobacterium tuberculosis
VTVAFLGDG

SEQ ID NO: 30124 - protein, 9 aa, Mycobacterium tuberculosis
TVAFLGDGA

SEQ ID NO: 30125 - protein, 9 aa, Mycobacterium tuberculosis
VAFLGDGAT

SEQ ID NO: 30126 - protein, 9 aa, Mycobacterium tuberculosis
AFLGDGATS

SEQ ID NO: 30127 - protein, 9 aa, Mycobacterium tuberculosis
FLGDGATSE

SEQ ID NO: 30128 - protein, 9 aa, Mycobacterium tuberculosis
LGDGATSEG

SEQ ID NO: 30129 - protein, 9 aa, Mycobacterium tuberculosis
GDGATSEGD

SEQ ID NO: 30130 - protein, 9 aa, Mycobacterium tuberculosis
DGATSEGDV

SEQ ID NO: 30131 - protein, 9 aa, Mycobacterium tuberculosis
GATSEGDVH

SEQ ID NO: 30132 - protein, 9 aa, Mycobacterium tuberculosis
ATSEGDVHE

SEQ ID NO: 30133 - protein, 9 aa, Mycobacterium tuberculosis
TSEGDVHEA

SEQ ID NO: 30134 - protein, 9 aa, Mycobacterium tuberculosis
SEGDVHEAL

SEQ ID NO: 30135 - protein, 9 aa, Mycobacterium tuberculosis
EGDVHEALN

SEQ ID NO: 30136 - protein, 9 aa, Mycobacterium tuberculosis
GDVHEALNF

SEQ ID NO: 30137 - protein, 9 aa, Mycobacterium tuberculosis
DVHEALNFA

SEQ ID NO: 30138 - protein, 9 aa, Mycobacterium tuberculosis
VHEALNFAA

SEQ ID NO: 30139 - protein, 9 aa, Mycobacterium tuberculosis
HEALNFAAV

SEQ ID NO: 30140 - protein, 9 aa, Mycobacterium tuberculosis
EALNFAAVF

SEQ ID NO: 30141 - protein, 9 aa, Mycobacterium tuberculosis
ALNFAAVFT

SEQ ID NO: 30142 - protein, 9 aa, Mycobacterium tuberculosis
LNFAAVFTT

SEQ ID NO: 30143 - protein, 9 aa, Mycobacterium tuberculosis
NFAAVFTTP

SEQ ID NO: 30144 - protein, 9 aa, Mycobacterium tuberculosis
FAAVFTTPC

SEQ ID NO: 30145 - protein, 9 aa, Mycobacterium tuberculosis
AAVFTTPCV

SEQ ID NO: 30146 - protein, 9 aa, Mycobacterium tuberculosis
AVFTTPCVF

SEQ ID NO: 30147 - protein, 9 aa, Mycobacterium tuberculosis
VFTTPCVFY

SEQ ID NO: 30148 - protein, 9 aa, Mycobacterium tuberculosis
FTTPCVFYV

SEQ ID NO: 30149 - protein, 9 aa, Mycobacterium tuberculosis
TTPCVFYVQ

SEQ ID NO: 30150 - protein, 9 aa, Mycobacterium tuberculosis
TPCVFYVQN

SEQ ID NO: 30151 - protein, 9 aa, Mycobacterium tuberculosis
PCVFYVQNN

SEQ ID NO: 30152 - protein, 9 aa, Mycobacterium tuberculosis
CVFYVQNNQ

SEQ ID NO: 30153 - protein, 9 aa, Mycobacterium tuberculosis
VFYVQNNQW

SEQ ID NO: 30154 - protein, 9 aa, Mycobacterium tuberculosis
FYVQNNQWA

SEQ ID NO: 30155 - protein, 9 aa, Mycobacterium tuberculosis
YVQNNQWAI

SEQ ID NO: 30156 - protein, 9 aa, Mycobacterium tuberculosis
VQNNQWAIS

SEQ ID NO: 30157 - protein, 9 aa, Mycobacterium tuberculosis
QNNQWAISM

SEQ ID NO: 30158 - protein, 9 aa, Mycobacterium tuberculosis
NNQWAISMP

SEQ ID NO: 30159 - protein, 9 aa, Mycobacterium tuberculosis
NQWAISMPV

SEQ ID NO: 30160 - protein, 9 aa, Mycobacterium tuberculosis
QWAISMPVS

SEQ ID NO: 30161 - protein, 9 aa, Mycobacterium tuberculosis
WAISMPVSR

SEQ ID NO: 30162 - protein, 9 aa, Mycobacterium tuberculosis
AISMPVSRQ

SEQ ID NO: 30163 - protein, 9 aa, Mycobacterium tuberculosis
ISMPVSRQT

SEQ ID NO: 30164 - protein, 9 aa, Mycobacterium tuberculosis
SMPVSRQTA

SEQ ID NO: 30165 - protein, 9 aa, Mycobacterium tuberculosis
MPVSRQTAA

SEQ ID NO: 30166 - protein, 9 aa, Mycobacterium tuberculosis
PVSRQTAAP

SEQ ID NO: 30167 - protein, 9 aa, Mycobacterium tuberculosis
VSRQTAAPS

SEQ ID NO: 30168 - protein, 9 aa, Mycobacterium tuberculosis
SRQTAAPSI

SEQ ID NO: 30169 - protein, 9 aa, Mycobacterium tuberculosis
RQTAAPSIA

SEQ ID NO: 30170 - protein, 9 aa, Mycobacterium tuberculosis
QTAAPSIAH

SEQ ID NO: 30171 - protein, 9 aa, Mycobacterium tuberculosis
TAAPSIAHK

SEQ ID NO: 30172 - protein, 9 aa, Mycobacterium tuberculosis
AAPSIAHKA

SEQ ID NO: 30173 - protein, 9 aa, Mycobacterium tuberculosis
APSIAHKAI

SEQ ID NO: 30174 - protein, 9 aa, Mycobacterium tuberculosis
PSIAHKAIG

SEQ ID NO: 30175 - protein, 9 aa, Mycobacterium tuberculosis
SIAHKAIGY

SEQ ID NO: 30176 - protein, 9 aa, Mycobacterium tuberculosis
IAHKAIGYG

SEQ ID NO: 30177 - protein, 9 aa, Mycobacterium tuberculosis
AHKAIGYGM

SEQ ID NO: 30178 - protein, 9 aa, Mycobacterium tuberculosis
HKAIGYGMP

SEQ ID NO: 30179 - protein, 9 aa, Mycobacterium tuberculosis
KAIGYGMPG

SEQ ID NO: 30180 - protein, 9 aa, Mycobacterium tuberculosis
AIGYGMPGI

SEQ ID NO: 30181 - protein, 9 aa, Mycobacterium tuberculosis
IGYGMPGIR

SEQ ID NO: 30182 - protein, 9 aa, Mycobacterium tuberculosis
GYGMPGIRV

SEQ ID NO: 30183 - protein, 9 aa, Mycobacterium tuberculosis
YGMPGIRVD

SEQ ID NO: 30184 - protein, 9 aa, Mycobacterium tuberculosis
GMPGIRVDG

SEQ ID NO: 30185 - protein, 9 aa, Mycobacterium tuberculosis
MPGIRVDGN

SEQ ID NO: 30186 - protein, 9 aa, Mycobacterium tuberculosis
PGIRVDGND

SEQ ID NO: 30187 - protein, 9 aa, Mycobacterium tuberculosis
GIRVDGNDV

SEQ ID NO: 30188 - protein, 9 aa, Mycobacterium tuberculosis
IRVDGNDVL

SEQ ID NO: 30189 - protein, 9 aa, Mycobacterium tuberculosis
RVDGNDVLA

SEQ ID NO: 30190 - protein, 9 aa, Mycobacterium tuberculosis
VDGNDVLAC

SEQ ID NO: 30191 - protein, 9 aa, Mycobacterium tuberculosis
DGNDVLACY

SEQ ID NO: 30192 - protein, 9 aa, Mycobacterium tuberculosis
GNDVLACYA

SEQ ID NO: 30193 - protein, 9 aa, Mycobacterium tuberculosis
NDVLACYAV

SEQ ID NO: 30194 - protein, 9 aa, Mycobacterium tuberculosis
DVLACYAVM

SEQ ID NO: 30195 - protein, 9 aa, Mycobacterium tuberculosis
VLACYAVMA

SEQ ID NO: 30196 - protein, 9 aa, Mycobacterium tuberculosis
LACYAVMAE

SEQ ID NO: 30197 - protein, 9 aa, Mycobacterium tuberculosis
ACYAVMAEA

SEQ ID NO: 30198 - protein, 9 aa, Mycobacterium tuberculosis
CYAVMAEAA

SEQ ID NO: 30199 - protein, 9 aa, Mycobacterium tuberculosis
YAVMAEAAA

SEQ ID NO: 30200 - protein, 9 aa, Mycobacterium tuberculosis
AVMAEAAAR

SEQ ID NO: 30201 - protein, 9 aa, Mycobacterium tuberculosis
VMAEAAARA

SEQ ID NO: 30202 - protein, 9 aa, Mycobacterium tuberculosis
MAEAAARAR

SEQ ID NO: 30203 - protein, 9 aa, Mycobacterium tuberculosis
AEAAARARA

SEQ ID NO: 30204 - protein, 9 aa, Mycobacterium tuberculosis
EAAARARAG

SEQ ID NO: 30205 - protein, 9 aa, Mycobacterium tuberculosis
AAARARAGD

SEQ ID NO: 30206 - protein, 9 aa, Mycobacterium tuberculosis
AARARAGDG

SEQ ID NO: 30207 - protein, 9 aa, Mycobacterium tuberculosis
ARARAGDGP

SEQ ID NO: 30208 - protein, 9 aa, Mycobacterium tuberculosis
RARAGDGPT

SEQ ID NO: 30209 - protein, 9 aa, Mycobacterium tuberculosis
ARAGDGPTL

SEQ ID NO: 30210 - protein, 9 aa, Mycobacterium tuberculosis
RAGDGPTLI

SEQ ID NO: 30211 - protein, 9 aa, Mycobacterium tuberculosis
AGDGPTLIE

SEQ ID NO: 30212 - protein, 9 aa, Mycobacterium tuberculosis
GDGPTLIEA

SEQ ID NO: 30213 - protein, 9 aa, Mycobacterium tuberculosis
DGPTLIEAV

SEQ ID NO: 30214 - protein, 9 aa, Mycobacterium tuberculosis
GPTLIEAVT

SEQ ID NO: 30215 - protein, 9 aa, Mycobacterium tuberculosis
PTLIEAVTY

SEQ ID NO: 30216 - protein, 9 aa, Mycobacterium tuberculosis
TLIEAVTYR

SEQ ID NO: 30217 - protein, 9 aa, Mycobacterium tuberculosis
LIEAVTYRL

SEQ ID NO: 30218 - protein, 9 aa, Mycobacterium tuberculosis
IEAVTYRLG

SEQ ID NO: 30219 - protein, 9 aa, Mycobacterium tuberculosis
EAVTYRLGP

SEQ ID NO: 30220 - protein, 9 aa, Mycobacterium tuberculosis
AVTYRLGPH

SEQ ID NO: 30221 - protein, 9 aa, Mycobacterium tuberculosis
VTYRLGPHT

SEQ ID NO: 30222 - protein, 9 aa, Mycobacterium tuberculosis
TYRLGPHTT

SEQ ID NO: 30223 - protein, 9 aa, Mycobacterium tuberculosis
YRLGPHTTA

SEQ ID NO: 30224 - protein, 9 aa, Mycobacterium tuberculosis
RLGPHTTAD

SEQ ID NO: 30225 - protein, 9 aa, Mycobacterium tuberculosis
LGPHTTADD

SEQ ID NO: 30226 - protein, 9 aa, Mycobacterium tuberculosis
GPHTTADDP

SEQ ID NO: 30227 - protein, 9 aa, Mycobacterium tuberculosis
PHTTADDPT

SEQ ID NO: 30228 - protein, 9 aa, Mycobacterium tuberculosis
HTTADDPTR

SEQ ID NO: 30229 - protein, 9 aa, Mycobacterium tuberculosis
TTADDPTRY

SEQ ID NO: 30230 - protein, 9 aa, Mycobacterium tuberculosis
TADDPTRYR

SEQ ID NO: 30231 - protein, 9 aa, Mycobacterium tuberculosis
ADDPTRYRS

SEQ ID NO: 30232 - protein, 9 aa, Mycobacterium tuberculosis
DDPTRYRSQ

SEQ ID NO: 30233 - protein, 9 aa, Mycobacterium tuberculosis
DPTRYRSQE

SEQ ID NO: 30234 - protein, 9 aa, Mycobacterium tuberculosis
PTRYRSQEE

SEQ ID NO: 30235 - protein, 9 aa, Mycobacterium tuberculosis
TRYRSQEEV

SEQ ID NO: 30236 - protein, 9 aa, Mycobacterium tuberculosis
RYRSQEEVD

SEQ ID NO: 30237 - protein, 9 aa, Mycobacterium tuberculosis
YRSQEEVDR

SEQ ID NO: 30238 - protein, 9 aa, Mycobacterium tuberculosis
RSQEEVDRW

SEQ ID NO: 30239 - protein, 9 aa, Mycobacterium tuberculosis
SQEEVDRWA

SEQ ID NO: 30240 - protein, 9 aa, Mycobacterium tuberculosis
QEEVDRWAT

SEQ ID NO: 30241 - protein, 9 aa, Mycobacterium tuberculosis
EEVDRWATL

SEQ ID NO: 30242 - protein, 9 aa, Mycobacterium tuberculosis
EVDRWATLD

SEQ ID NO: 30243 - protein, 9 aa, Mycobacterium tuberculosis
VDRWATLDP

SEQ ID NO: 30244 - protein, 9 aa, Mycobacterium tuberculosis
DRWATLDPI

SEQ ID NO: 30245 - protein, 9 aa, Mycobacterium tuberculosis
RWATLDPIP

SEQ ID NO: 30246 - protein, 9 aa, Mycobacterium tuberculosis
WATLDPIPR

SEQ ID NO: 30247 - protein, 9 aa, Mycobacterium tuberculosis
ATLDPIPRY

SEQ ID NO: 30248 - protein, 9 aa, Mycobacterium tuberculosis
TLDPIPRYR

SEQ ID NO: 30249 - protein, 9 aa, Mycobacterium tuberculosis
LDPIPRYRT

SEQ ID NO: 30250 - protein, 9 aa, Mycobacterium tuberculosis
DPIPRYRTY

SEQ ID NO: 30251 - protein, 9 aa, Mycobacterium tuberculosis
PIPRYRTYL

SEQ ID NO: 30252 - protein, 9 aa, Mycobacterium tuberculosis
IPRYRTYLQ

SEQ ID NO: 30253 - protein, 9 aa, Mycobacterium tuberculosis
PRYRTYLQD

SEQ ID NO: 30254 - protein, 9 aa, Mycobacterium tuberculosis
RYRTYLQDQ

SEQ ID NO: 30255 - protein, 9 aa, Mycobacterium tuberculosis
YRTYLQDQG

SEQ ID NO: 30256 - protein, 9 aa, Mycobacterium tuberculosis
RTYLQDQGL

SEQ ID NO: 30257 - protein, 9 aa, Mycobacterium tuberculosis
TYLQDQGLW

SEQ ID NO: 30258 - protein, 9 aa, Mycobacterium tuberculosis
YLQDQGLWS

SEQ ID NO: 30259 - protein, 9 aa, Mycobacterium tuberculosis
LQDQGLWSQ

SEQ ID NO: 30260 - protein, 9 aa, Mycobacterium tuberculosis
QDQGLWSQR

SEQ ID NO: 30261 - protein, 9 aa, Mycobacterium tuberculosis
DQGLWSQRL

SEQ ID NO: 30262 - protein, 9 aa, Mycobacterium tuberculosis
QGLWSQRLE

SEQ ID NO: 30263 - protein, 9 aa, Mycobacterium tuberculosis
GLWSQRLEE

SEQ ID NO: 30264 - protein, 9 aa, Mycobacterium tuberculosis
LWSQRLEEQ

SEQ ID NO: 30265 - protein, 9 aa, Mycobacterium tuberculosis
WSQRLEEQV

SEQ ID NO: 30266 - protein, 9 aa, Mycobacterium tuberculosis
SQRLEEQVT

SEQ ID NO: 30267 - protein, 9 aa, Mycobacterium tuberculosis
QRLEEQVTA

SEQ ID NO: 30268 - protein, 9 aa, Mycobacterium tuberculosis
RLEEQVTAR

SEQ ID NO: 30269 - protein, 9 aa, Mycobacterium tuberculosis
LEEQVTARA

SEQ ID NO: 30270 - protein, 9 aa, Mycobacterium tuberculosis
EEQVTARAK

SEQ ID NO: 30271 - protein, 9 aa, Mycobacterium tuberculosis
EQVTARAKH

SEQ ID NO: 30272 - protein, 9 aa, Mycobacterium tuberculosis
QVTARAKHV

SEQ ID NO: 30273 - protein, 9 aa, Mycobacterium tuberculosis
VTARAKHVR

SEQ ID NO: 30274 - protein, 9 aa, Mycobacterium tuberculosis
TARAKHVRS

SEQ ID NO: 30275 - protein, 9 aa, Mycobacterium tuberculosis
ARAKHVRSE

SEQ ID NO: 30276 - protein, 9 aa, Mycobacterium tuberculosis
RAKHVRSEL

SEQ ID NO: 30277 - protein, 9 aa, Mycobacterium tuberculosis
AKHVRSELR

SEQ ID NO: 30278 - protein, 9 aa, Mycobacterium tuberculosis
KHVRSELRD

SEQ ID NO: 30279 - protein, 9 aa, Mycobacterium tuberculosis
HVRSELRDA

SEQ ID NO: 30280 - protein, 9 aa, Mycobacterium tuberculosis
VRSELRDAV

SEQ ID NO: 30281 - protein, 9 aa, Mycobacterium tuberculosis
RSELRDAVF

SEQ ID NO: 30282 - protein, 9 aa, Mycobacterium tuberculosis
SELRDAVFD

SEQ ID NO: 30283 - protein, 9 aa, Mycobacterium tuberculosis
ELRDAVFDA

SEQ ID NO: 30284 - protein, 9 aa, Mycobacterium tuberculosis
LRDAVFDAP

SEQ ID NO: 30285 - protein, 9 aa, Mycobacterium tuberculosis
RDAVFDAPD

SEQ ID NO: 30286 - protein, 9 aa, Mycobacterium tuberculosis
DAVFDAPDF

SEQ ID NO: 30287 - protein, 9 aa, Mycobacterium tuberculosis
AVFDAPDFD

SEQ ID NO: 30288 - protein, 9 aa, Mycobacterium tuberculosis
VFDAPDFDV

SEQ ID NO: 30289 - protein, 9 aa, Mycobacterium tuberculosis
FDAPDFDVD

SEQ ID NO: 30290 - protein, 9 aa, Mycobacterium tuberculosis
DAPDFDVDE

SEQ ID NO: 30291 - protein, 9 aa, Mycobacterium tuberculosis
APDFDVDEV

SEQ ID NO: 30292 - protein, 9 aa, Mycobacterium tuberculosis
PDFDVDEVF

SEQ ID NO: 30293 - protein, 9 aa, Mycobacterium tuberculosis
DFDVDEVFT

SEQ ID NO: 30294 - protein, 9 aa, Mycobacterium tuberculosis
FDVDEVFTT

SEQ ID NO: 30295 - protein, 9 aa, Mycobacterium tuberculosis
DVDEVFTTV

SEQ ID NO: 30296 - protein, 9 aa, Mycobacterium tuberculosis
VDEVFTTVY

SEQ ID NO: 30297 - protein, 9 aa, Mycobacterium tuberculosis
DEVFTTVYA

SEQ ID NO: 30298 - protein, 9 aa, Mycobacterium tuberculosis
EVFTTVYAE

SEQ ID NO: 30299 - protein, 9 aa, Mycobacterium tuberculosis
VFTTVYAEI

SEQ ID NO: 30300 - protein, 9 aa, Mycobacterium tuberculosis
FTTVYAEIT

SEQ ID NO: 30301 - protein, 9 aa, Mycobacterium tuberculosis
TTVYAEITP

SEQ ID NO: 30302 - protein, 9 aa, Mycobacterium tuberculosis
TVYAEITPG

SEQ ID NO: 30303 - protein, 9 aa, Mycobacterium tuberculosis
VYAEITPGL

SEQ ID NO: 30304 - protein, 9 aa, Mycobacterium tuberculosis
YAEITPGLQ

SEQ ID NO: 30305 - protein, 9 aa, Mycobacterium tuberculosis
AEITPGLQA

SEQ ID NO: 30306 - protein, 9 aa, Mycobacterium tuberculosis
EITPGLQAQ

SEQ ID NO: 30307 - protein, 9 aa, Mycobacterium tuberculosis
ITPGLQAQR

SEQ ID NO: 30308 - protein, 9 aa, Mycobacterium tuberculosis
TPGLQAQRE

SEQ ID NO: 30309 - protein, 9 aa, Mycobacterium tuberculosis
PGLQAQREQ

SEQ ID NO: 30310 - protein, 9 aa, Mycobacterium tuberculosis
GLQAQREQL

SEQ ID NO: 30311 - protein, 9 aa, Mycobacterium tuberculosis
LQAQREQLR

SEQ ID NO: 30312 - protein, 9 aa, Mycobacterium tuberculosis
QAQREQLRA

SEQ ID NO: 30313 - protein, 9 aa, Mycobacterium tuberculosis
AQREQLRAE

SEQ ID NO: 30314 - protein, 9 aa, Mycobacterium tuberculosis
QREQLRAEL

SEQ ID NO: 30315 - protein, 9 aa, Mycobacterium tuberculosis
REQLRAELA

SEQ ID NO: 30316 - protein, 9 aa, Mycobacterium tuberculosis
EQLRAELAR

SEQ ID NO: 30317 - protein, 9 aa, Mycobacterium tuberculosis
QLRAELART

SEQ ID NO: 30318 - protein, 9 aa, Mycobacterium tuberculosis
LRAELARTD

SEQ ID NO: 30319 - protein, 10 aa, Mycobacterium tuberculosis
MGEGSRRPSG

SEQ ID NO: 30320 - protein, 10 aa, Mycobacterium tuberculosis
GEGSRRPSGM

SEQ ID NO: 30321 - protein, 10 aa, Mycobacterium tuberculosis
EGSRRPSGML

SEQ ID NO: 30322 - protein, 10 aa, Mycobacterium tuberculosis
GSRRPSGMLM

SEQ ID NO: 30323 - protein, 10 aa, Mycobacterium tuberculosis
SRRPSGMLMS

SEQ ID NO: 30324 - protein, 10 aa, Mycobacterium tuberculosis
RRPSGMLMSV

SEQ ID NO: 30325 - protein, 10 aa, Mycobacterium tuberculosis
RPSGMLMSVD

SEQ ID NO: 30326 - protein, 10 aa, Mycobacterium tuberculosis
PSGMLMSVDL

SEQ ID NO: 30327 - protein, 10 aa, Mycobacterium tuberculosis
SGMLMSVDLE

SEQ ID NO: 30328 - protein, 10 aa, Mycobacterium tuberculosis
GMLMSVDLEP

SEQ ID NO: 30329 - protein, 10 aa, Mycobacterium tuberculosis
MLMSVDLEPV

SEQ ID NO: 30330 - protein, 10 aa, Mycobacterium tuberculosis
LMSVDLEPVQ

SEQ ID NO: 30331 - protein, 10 aa, Mycobacterium tuberculosis
MSVDLEPVQL

SEQ ID NO: 30332 - protein, 10 aa, Mycobacterium tuberculosis
SVDLEPVQLV

SEQ ID NO: 30333 - protein, 10 aa, Mycobacterium tuberculosis
VDLEPVQLVG

SEQ ID NO: 30334 - protein, 10 aa, Mycobacterium tuberculosis
DLEPVQLVGP

SEQ ID NO: 30335 - protein, 10 aa, Mycobacterium tuberculosis
LEPVQLVGPD

SEQ ID NO: 30336 - protein, 10 aa, Mycobacterium tuberculosis
EPVQLVGPDG

SEQ ID NO: 30337 - protein, 10 aa, Mycobacterium tuberculosis
PVQLVGPDGT

SEQ ID NO: 30338 - protein, 10 aa, Mycobacterium tuberculosis
VQLVGPDGTP

SEQ ID NO: 30339 - protein, 10 aa, Mycobacterium tuberculosis
QLVGPDGTPT

SEQ ID NO: 30340 - protein, 10 aa, Mycobacterium tuberculosis
LVGPDGTPTA

SEQ ID NO: 30341 - protein, 10 aa, Mycobacterium tuberculosis
VGPDGTPTAE

SEQ ID NO: 30342 - protein, 10 aa, Mycobacterium tuberculosis
GPDGTPTAER

SEQ ID NO: 30343 - protein, 10 aa, Mycobacterium tuberculosis
PDGTPTAERR

SEQ ID NO: 30344 - protein, 10 aa, Mycobacterium tuberculosis
DGTPTAERRY

SEQ ID NO: 30345 - protein, 10 aa, Mycobacterium tuberculosis
GTPTAERRYH

SEQ ID NO: 30346 - protein, 10 aa, Mycobacterium tuberculosis
TPTAERRYHR

SEQ ID NO: 30347 - protein, 10 aa, Mycobacterium tuberculosis
PTAERRYHRD

SEQ ID NO: 30348 - protein, 10 aa, Mycobacterium tuberculosis
TAERRYHRDL

SEQ ID NO: 30349 - protein, 10 aa, Mycobacterium tuberculosis
AERRYHRDLP

SEQ ID NO: 30350 - protein, 10 aa, Mycobacterium tuberculosis
ERRYHRDLPE

SEQ ID NO: 30351 - protein, 10 aa, Mycobacterium tuberculosis
RRYHRDLPEE

SEQ ID NO: 30352 - protein, 10 aa, Mycobacterium tuberculosis
RYHRDLPEET

SEQ ID NO: 30353 - protein, 10 aa, Mycobacterium tuberculosis
YHRDLPEETL

SEQ ID NO: 30354 - protein, 10 aa, Mycobacterium tuberculosis
HRDLPEETLR

SEQ ID NO: 30355 - protein, 10 aa, Mycobacterium tuberculosis
RDLPEETLRW

SEQ ID NO: 30356 - protein, 10 aa, Mycobacterium tuberculosis
DLPEETLRWL

SEQ ID NO: 30357 - protein, 10 aa, Mycobacterium tuberculosis
LPEETLRWLY

SEQ ID NO: 30358 - protein, 10 aa, Mycobacterium tuberculosis
PEETLRWLYE

SEQ ID NO: 30359 - protein, 10 aa, Mycobacterium tuberculosis
EETLRWLYEM

SEQ ID NO: 30360 - protein, 10 aa, Mycobacterium tuberculosis
ETLRWLYEMM

SEQ ID NO: 30361 - protein, 10 aa, Mycobacterium tuberculosis
TLRWLYEMMV

SEQ ID NO: 30362 - protein, 10 aa, Mycobacterium tuberculosis
LRWLYEMMVV

SEQ ID NO: 30363 - protein, 10 aa, Mycobacterium tuberculosis
RWLYEMMVVT

SEQ ID NO: 30364 - protein, 10 aa, Mycobacterium tuberculosis
WLYEMMVVTR

SEQ ID NO: 30365 - protein, 10 aa, Mycobacterium tuberculosis
LYEMMVVTRE

SEQ ID NO: 30366 - protein, 10 aa, Mycobacterium tuberculosis
YEMMVVTREL

SEQ ID NO: 30367 - protein, 10 aa, Mycobacterium tuberculosis
EMMVVTRELD

SEQ ID NO: 30368 - protein, 10 aa, Mycobacterium tuberculosis
MMVVTRELDT

SEQ ID NO: 30369 - protein, 10 aa, Mycobacterium tuberculosis
MVVTRELDTE

SEQ ID NO: 30370 - protein, 10 aa, Mycobacterium tuberculosis
VVTRELDTEF

SEQ ID NO: 30371 - protein, 10 aa, Mycobacterium tuberculosis
VTRELDTEFV

SEQ ID NO: 30372 - protein, 10 aa, Mycobacterium tuberculosis
TRELDTEFVN

SEQ ID NO: 30373 - protein, 10 aa, Mycobacterium tuberculosis
RELDTEFVNL

SEQ ID NO: 30374 - protein, 10 aa, Mycobacterium tuberculosis
ELDTEFVNLQ

SEQ ID NO: 30375 - protein, 10 aa, Mycobacterium tuberculosis
LDTEFVNLQR

SEQ ID NO: 30376 - protein, 10 aa, Mycobacterium tuberculosis
DTEFVNLQRQ

SEQ ID NO: 30377 - protein, 10 aa, Mycobacterium tuberculosis
TEFVNLQRQG

SEQ ID NO: 30378 - protein, 10 aa, Mycobacterium tuberculosis
EFVNLQRQGE

SEQ ID NO: 30379 - protein, 10 aa, Mycobacterium tuberculosis
FVNLQRQGEL

SEQ ID NO: 30380 - protein, 10 aa, Mycobacterium tuberculosis
VNLQRQGELA

SEQ ID NO: 30381 - protein, 10 aa, Mycobacterium tuberculosis
NLQRQGELAL

SEQ ID NO: 30382 - protein, 10 aa, Mycobacterium tuberculosis
LQRQGELALY

SEQ ID NO: 30383 - protein, 10 aa, Mycobacterium tuberculosis
QRQGELALYT

SEQ ID NO: 30384 - protein, 10 aa, Mycobacterium tuberculosis
RQGELALYTP

SEQ ID NO: 30385 - protein, 10 aa, Mycobacterium tuberculosis
QGELALYTPC

SEQ ID NO: 30386 - protein, 10 aa, Mycobacterium tuberculosis
GELALYTPCR

SEQ ID NO: 30387 - protein, 10 aa, Mycobacterium tuberculosis
ELALYTPCRG

SEQ ID NO: 30388 - protein, 10 aa, Mycobacterium tuberculosis
LALYTPCRGQ

SEQ ID NO: 30389 - protein, 10 aa, Mycobacterium tuberculosis
ALYTPCRGQE

SEQ ID NO: 30390 - protein, 10 aa, Mycobacterium tuberculosis
LYTPCRGQEA

SEQ ID NO: 30391 - protein, 10 aa, Mycobacterium tuberculosis
YTPCRGQEAA

SEQ ID NO: 30392 - protein, 10 aa, Mycobacterium tuberculosis
TPCRGQEAAQ

SEQ ID NO: 30393 - protein, 10 aa, Mycobacterium tuberculosis
PCRGQEAAQV

SEQ ID NO: 30394 - protein, 10 aa, Mycobacterium tuberculosis
CRGQEAAQVG

SEQ ID NO: 30395 - protein, 10 aa, Mycobacterium tuberculosis
RGQEAAQVGA

SEQ ID NO: 30396 - protein, 10 aa, Mycobacterium tuberculosis
GQEAAQVGAA

SEQ ID NO: 30397 - protein, 10 aa, Mycobacterium tuberculosis
QEAAQVGAAA

SEQ ID NO: 30398 - protein, 10 aa, Mycobacterium tuberculosis
EAAQVGAAAC

SEQ ID NO: 30399 - protein, 10 aa, Mycobacterium tuberculosis
AAQVGAAACL

SEQ ID NO: 30400 - protein, 10 aa, Mycobacterium tuberculosis
AQVGAAACLR

SEQ ID NO: 30401 - protein, 10 aa, Mycobacterium tuberculosis
QVGAAACLRK

SEQ ID NO: 30402 - protein, 10 aa, Mycobacterium tuberculosis
VGAAACLRKT

SEQ ID NO: 30403 - protein, 10 aa, Mycobacterium tuberculosis
GAAACLRKTD

SEQ ID NO: 30404 - protein, 10 aa, Mycobacterium tuberculosis
AAACLRKTDW

SEQ ID NO: 30405 - protein, 10 aa, Mycobacterium tuberculosis
AACLRKTDWL

SEQ ID NO: 30406 - protein, 10 aa, Mycobacterium tuberculosis
ACLRKTDWLF

SEQ ID NO: 30407 - protein, 10 aa, Mycobacterium tuberculosis
CLRKTDWLFP

SEQ ID NO: 30408 - protein, 10 aa, Mycobacterium tuberculosis
LRKTDWLFPQ

SEQ ID NO: 30409 - protein, 10 aa, Mycobacterium tuberculosis
RKTDWLFPQY

SEQ ID NO: 30410 - protein, 10 aa, Mycobacterium tuberculosis
KTDWLFPQYR

SEQ ID NO: 30411 - protein, 10 aa, Mycobacterium tuberculosis
TDWLFPQYRE

SEQ ID NO: 30412 - protein, 10 aa, Mycobacterium tuberculosis
DWLFPQYREL

SEQ ID NO: 30413 - protein, 10 aa, Mycobacterium tuberculosis
WLFPQYRELG

SEQ ID NO: 30414 - protein, 10 aa, Mycobacterium tuberculosis
LFPQYRELGV

SEQ ID NO: 30415 - protein, 10 aa, Mycobacterium tuberculosis
FPQYRELGVY

SEQ ID NO: 30416 - protein, 10 aa, Mycobacterium tuberculosis
PQYRELGVYL

SEQ ID NO: 30417 - protein, 10 aa, Mycobacterium tuberculosis
QYRELGVYLV

SEQ ID NO: 30418 - protein, 10 aa, Mycobacterium tuberculosis
YRELGVYLVR

SEQ ID NO: 30419 - protein, 10 aa, Mycobacterium tuberculosis
RELGVYLVRG

SEQ ID NO: 30420 - protein, 10 aa, Mycobacterium tuberculosis
ELGVYLVRGI

SEQ ID NO: 30421 - protein, 10 aa, Mycobacterium tuberculosis
LGVYLVRGIP

SEQ ID NO: 30422 - protein, 10 aa, Mycobacterium tuberculosis
GVYLVRGIPP

SEQ ID NO: 30423 - protein, 10 aa, Mycobacterium tuberculosis
VYLVRGIPPG

SEQ ID NO: 30424 - protein, 10 aa, Mycobacterium tuberculosis
YLVRGIPPGH

SEQ ID NO: 30425 - protein, 10 aa, Mycobacterium tuberculosis
LVRGIPPGHV

SEQ ID NO: 30426 - protein, 10 aa, Mycobacterium tuberculosis
VRGIPPGHVG

SEQ ID NO: 30427 - protein, 10 aa, Mycobacterium tuberculosis
RGIPPGHVGV

SEQ ID NO: 30428 - protein, 10 aa, Mycobacterium tuberculosis
GIPPGHVGVA

SEQ ID NO: 30429 - protein, 10 aa, Mycobacterium tuberculosis
IPPGHVGVAW

SEQ ID NO: 30430 - protein, 10 aa, Mycobacterium tuberculosis
PPGHVGVAWR

SEQ ID NO: 30431 - protein, 10 aa, Mycobacterium tuberculosis
PGHVGVAWRG

SEQ ID NO: 30432 - protein, 10 aa, Mycobacterium tuberculosis
GHVGVAWRGT

SEQ ID NO: 30433 - protein, 10 aa, Mycobacterium tuberculosis
HVGVAWRGTW

SEQ ID NO: 30434 - protein, 10 aa, Mycobacterium tuberculosis
VGVAWRGTWH

SEQ ID NO: 30435 - protein, 10 aa, Mycobacterium tuberculosis
GVAWRGTWHG

SEQ ID NO: 30436 - protein, 10 aa, Mycobacterium tuberculosis
VAWRGTWHGG

SEQ ID NO: 30437 - protein, 10 aa, Mycobacterium tuberculosis
AWRGTWHGGL

SEQ ID NO: 30438 - protein, 10 aa, Mycobacterium tuberculosis
WRGTWHGGLQ

SEQ ID NO: 30439 - protein, 10 aa, Mycobacterium tuberculosis
RGTWHGGLQF

SEQ ID NO: 30440 - protein, 10 aa, Mycobacterium tuberculosis
GTWHGGLQFT

SEQ ID NO: 30441 - protein, 10 aa, Mycobacterium tuberculosis
TWHGGLQFTT

SEQ ID NO: 30442 - protein, 10 aa, Mycobacterium tuberculosis
WHGGLQFTTK

SEQ ID NO: 30443 - protein, 10 aa, Mycobacterium tuberculosis
HGGLQFTTKC

SEQ ID NO: 30444 - protein, 10 aa, Mycobacterium tuberculosis
GGLQFTTKCC

SEQ ID NO: 30445 - protein, 10 aa, Mycobacterium tuberculosis
GLQFTTKCCA

SEQ ID NO: 30446 - protein, 10 aa, Mycobacterium tuberculosis
LQFTTKCCAP

SEQ ID NO: 30447 - protein, 10 aa, Mycobacterium tuberculosis
QFTTKCCAPM

SEQ ID NO: 30448 - protein, 10 aa, Mycobacterium tuberculosis
FTTKCCAPMS

SEQ ID NO: 30449 - protein, 10 aa, Mycobacterium tuberculosis
TTKCCAPMSV

SEQ ID NO: 30450 - protein, 10 aa, Mycobacterium tuberculosis
TKCCAPMSVP

SEQ ID NO: 30451 - protein, 10 aa, Mycobacterium tuberculosis
KCCAPMSVPI

SEQ ID NO: 30452 - protein, 10 aa, Mycobacterium tuberculosis
CCAPMSVPIG

SEQ ID NO: 30453 - protein, 10 aa, Mycobacterium tuberculosis
CAPMSVPIGT

SEQ ID NO: 30454 - protein, 10 aa, Mycobacterium tuberculosis
APMSVPIGTQ

SEQ ID NO: 30455 - protein, 10 aa, Mycobacterium tuberculosis
PMSVPIGTQT

SEQ ID NO: 30456 - protein, 10 aa, Mycobacterium tuberculosis
MSVPIGTQTL

SEQ ID NO: 30457 - protein, 10 aa, Mycobacterium tuberculosis
SVPIGTQTLH

SEQ ID NO: 30458 - protein, 10 aa, Mycobacterium tuberculosis
VPIGTQTLHA

SEQ ID NO: 30459 - protein, 10 aa, Mycobacterium tuberculosis
PIGTQTLHAV

SEQ ID NO: 30460 - protein, 10 aa, Mycobacterium tuberculosis
IGTQTLHAVG

SEQ ID NO: 30461 - protein, 10 aa, Mycobacterium tuberculosis
GTQTLHAVGA

SEQ ID NO: 30462 - protein, 10 aa, Mycobacterium tuberculosis
TQTLHAVGAA

SEQ ID NO: 30463 - protein, 10 aa, Mycobacterium tuberculosis
QTLHAVGAAM

SEQ ID NO: 30464 - protein, 10 aa, Mycobacterium tuberculosis
TLHAVGAAMA

SEQ ID NO: 30465 - protein, 10 aa, Mycobacterium tuberculosis
LHAVGAAMAA

SEQ ID NO: 30466 - protein, 10 aa, Mycobacterium tuberculosis
HAVGAAMAAQ

SEQ ID NO: 30467 - protein, 10 aa, Mycobacterium tuberculosis
AVGAAMAAQR

SEQ ID NO: 30468 - protein, 10 aa, Mycobacterium tuberculosis
VGAAMAAQRL

SEQ ID NO: 30469 - protein, 10 aa, Mycobacterium tuberculosis
GAAMAAQRLD

SEQ ID NO: 30470 - protein, 10 aa, Mycobacterium tuberculosis
AAMAAQRLDE

SEQ ID NO: 30471 - protein, 10 aa, Mycobacterium tuberculosis
AMAAQRLDED

SEQ ID NO: 30472 - protein, 10 aa, Mycobacterium tuberculosis
MAAQRLDEDS

SEQ ID NO: 30473 - protein, 10 aa, Mycobacterium tuberculosis
AAQRLDEDSV

SEQ ID NO: 30474 - protein, 10 aa, Mycobacterium tuberculosis
AQRLDEDSVT

SEQ ID NO: 30475 - protein, 10 aa, Mycobacterium tuberculosis
QRLDEDSVTV

SEQ ID NO: 30476 - protein, 10 aa, Mycobacterium tuberculosis
RLDEDSVTVA

SEQ ID NO: 30477 - protein, 10 aa, Mycobacterium tuberculosis
LDEDSVTVAF

SEQ ID NO: 30478 - protein, 10 aa, Mycobacterium tuberculosis
DEDSVTVAFL

SEQ ID NO: 30479 - protein, 10 aa, Mycobacterium tuberculosis
EDSVTVAFLG

SEQ ID NO: 30480 - protein, 10 aa, Mycobacterium tuberculosis
DSVTVAFLGD

SEQ ID NO: 30481 - protein, 10 aa, Mycobacterium tuberculosis
SVTVAFLGDG

SEQ ID NO: 30482 - protein, 10 aa, Mycobacterium tuberculosis
VTVAFLGDGA

SEQ ID NO: 30483 - protein, 10 aa, Mycobacterium tuberculosis
TVAFLGDGAT

SEQ ID NO: 30484 - protein, 10 aa, Mycobacterium tuberculosis
VAFLGDGATS

SEQ ID NO: 30485 - protein, 10 aa, Mycobacterium tuberculosis
AFLGDGATSE

SEQ ID NO: 30486 - protein, 10 aa, Mycobacterium tuberculosis
FLGDGATSEG

SEQ ID NO: 30487 - protein, 10 aa, Mycobacterium tuberculosis
LGDGATSEGD

SEQ ID NO: 30488 - protein, 10 aa, Mycobacterium tuberculosis
GDGATSEGDV

SEQ ID NO: 30489 - protein, 10 aa, Mycobacterium tuberculosis
DGATSEGDVH

SEQ ID NO: 30490 - protein, 10 aa, Mycobacterium tuberculosis
GATSEGDVHE

SEQ ID NO: 30491 - protein, 10 aa, Mycobacterium tuberculosis
ATSEGDVHEA

SEQ ID NO: 30492 - protein, 10 aa, Mycobacterium tuberculosis
TSEGDVHEAL

SEQ ID NO: 30493 - protein, 10 aa, Mycobacterium tuberculosis
SEGDVHEALN

SEQ ID NO: 30494 - protein, 10 aa, Mycobacterium tuberculosis
EGDVHEALNF

SEQ ID NO: 30495 - protein, 10 aa, Mycobacterium tuberculosis
GDVHEALNFA

SEQ ID NO: 30496 - protein, 10 aa, Mycobacterium tuberculosis
DVHEALNFAA

SEQ ID NO: 30497 - protein, 10 aa, Mycobacterium tuberculosis
VHEALNFAAV

SEQ ID NO: 30498 - protein, 10 aa, Mycobacterium tuberculosis
HEALNFAAVF

SEQ ID NO: 30499 - protein, 10 aa, Mycobacterium tuberculosis
EALNFAAVFT

SEQ ID NO: 30500 - protein, 10 aa, Mycobacterium tuberculosis
ALNFAAVFTT

SEQ ID NO: 30501 - protein, 10 aa, Mycobacterium tuberculosis
LNFAAVFTTP

SEQ ID NO: 30502 - protein, 10 aa, Mycobacterium tuberculosis
NFAAVFTTPC

SEQ ID NO: 30503 - protein, 10 aa, Mycobacterium tuberculosis
FAAVFTTPCV

SEQ ID NO: 30504 - protein, 10 aa, Mycobacterium tuberculosis
AAVFTTPCVF

SEQ ID NO: 30505 - protein, 10 aa, Mycobacterium tuberculosis
AVFTTPCVFY

SEQ ID NO: 30506 - protein, 10 aa, Mycobacterium tuberculosis
VFTTPCVFYV

SEQ ID NO: 30507 - protein, 10 aa, Mycobacterium tuberculosis
FTTPCVFYVQ

SEQ ID NO: 30508 - protein, 10 aa, Mycobacterium tuberculosis
TTPCVFYVQN

SEQ ID NO: 30509 - protein, 10 aa, Mycobacterium tuberculosis
TPCVFYVQNN

SEQ ID NO: 30510 - protein, 10 aa, Mycobacterium tuberculosis
PCVFYVQNNQ

SEQ ID NO: 30511 - protein, 10 aa, Mycobacterium tuberculosis
CVFYVQNNQW

SEQ ID NO: 30512 - protein, 10 aa, Mycobacterium tuberculosis
VFYVQNNQWA

SEQ ID NO: 30513 - protein, 10 aa, Mycobacterium tuberculosis
FYVQNNQWAI

SEQ ID NO: 30514 - protein, 10 aa, Mycobacterium tuberculosis
YVQNNQWAIS

SEQ ID NO: 30515 - protein, 10 aa, Mycobacterium tuberculosis
VQNNQWAISM

SEQ ID NO: 30516 - protein, 10 aa, Mycobacterium tuberculosis
QNNQWAISMP

SEQ ID NO: 30517 - protein, 10 aa, Mycobacterium tuberculosis
NNQWAISMPV

SEQ ID NO: 30518 - protein, 10 aa, Mycobacterium tuberculosis
NQWAISMPVS

SEQ ID NO: 30519 - protein, 10 aa, Mycobacterium tuberculosis
QWAISMPVSR

SEQ ID NO: 30520 - protein, 10 aa, Mycobacterium tuberculosis
WAISMPVSRQ

SEQ ID NO: 30521 - protein, 10 aa, Mycobacterium tuberculosis
AISMPVSRQT

SEQ ID NO: 30522 - protein, 10 aa, Mycobacterium tuberculosis
ISMPVSRQTA

SEQ ID NO: 30523 - protein, 10 aa, Mycobacterium tuberculosis
SMPVSRQTAA

SEQ ID NO: 30524 - protein, 10 aa, Mycobacterium tuberculosis
MPVSRQTAAP

SEQ ID NO: 30525 - protein, 10 aa, Mycobacterium tuberculosis
PVSRQTAAPS

SEQ ID NO: 30526 - protein, 10 aa, Mycobacterium tuberculosis
VSRQTAAPSI

SEQ ID NO: 30527 - protein, 10 aa, Mycobacterium tuberculosis
SRQTAAPSIA

SEQ ID NO: 30528 - protein, 10 aa, Mycobacterium tuberculosis
RQTAAPSIAH

SEQ ID NO: 30529 - protein, 10 aa, Mycobacterium tuberculosis
QTAAPSIAHK

SEQ ID NO: 30530 - protein, 10 aa, Mycobacterium tuberculosis
TAAPSIAHKA

SEQ ID NO: 30531 - protein, 10 aa, Mycobacterium tuberculosis
AAPSIAHKAI

SEQ ID NO: 30532 - protein, 10 aa, Mycobacterium tuberculosis
APSIAHKAIG

SEQ ID NO: 30533 - protein, 10 aa, Mycobacterium tuberculosis
PSIAHKAIGY

SEQ ID NO: 30534 - protein, 10 aa, Mycobacterium tuberculosis
SIAHKAIGYG

SEQ ID NO: 30535 - protein, 10 aa, Mycobacterium tuberculosis
IAHKAIGYGM

SEQ ID NO: 30536 - protein, 10 aa, Mycobacterium tuberculosis
AHKAIGYGMP

SEQ ID NO: 30537 - protein, 10 aa, Mycobacterium tuberculosis
HKAIGYGMPG

SEQ ID NO: 30538 - protein, 10 aa, Mycobacterium tuberculosis
KAIGYGMPGI

SEQ ID NO: 30539 - protein, 10 aa, Mycobacterium tuberculosis
AIGYGMPGIR

SEQ ID NO: 30540 - protein, 10 aa, Mycobacterium tuberculosis
IGYGMPGIRV

SEQ ID NO: 30541 - protein, 10 aa, Mycobacterium tuberculosis
GYGMPGIRVD

SEQ ID NO: 30542 - protein, 10 aa, Mycobacterium tuberculosis
YGMPGIRVDG

SEQ ID NO: 30543 - protein, 10 aa, Mycobacterium tuberculosis
GMPGIRVDGN

SEQ ID NO: 30544 - protein, 10 aa, Mycobacterium tuberculosis
MPGIRVDGND

SEQ ID NO: 30545 - protein, 10 aa, Mycobacterium tuberculosis
PGIRVDGNDV

SEQ ID NO: 30546 - protein, 10 aa, Mycobacterium tuberculosis
GIRVDGNDVL

SEQ ID NO: 30547 - protein, 10 aa, Mycobacterium tuberculosis
IRVDGNDVLA

SEQ ID NO: 30548 - protein, 10 aa, Mycobacterium tuberculosis
RVDGNDVLAC

SEQ ID NO: 30549 - protein, 10 aa, Mycobacterium tuberculosis
VDGNDVLACY

SEQ ID NO: 30550 - protein, 10 aa, Mycobacterium tuberculosis
DGNDVLACYA

SEQ ID NO: 30551 - protein, 10 aa, Mycobacterium tuberculosis
GNDVLACYAV

SEQ ID NO: 30552 - protein, 10 aa, Mycobacterium tuberculosis
NDVLACYAVM

SEQ ID NO: 30553 - protein, 10 aa, Mycobacterium tuberculosis
DVLACYAVMA

SEQ ID NO: 30554 - protein, 10 aa, Mycobacterium tuberculosis
VLACYAVMAE

SEQ ID NO: 30555 - protein, 10 aa, Mycobacterium tuberculosis
LACYAVMAEA

SEQ ID NO: 30556 - protein, 10 aa, Mycobacterium tuberculosis
ACYAVMAEAA

SEQ ID NO: 30557 - protein, 10 aa, Mycobacterium tuberculosis
CYAVMAEAAA

SEQ ID NO: 30558 - protein, 10 aa, Mycobacterium tuberculosis
YAVMAEAAAR

SEQ ID NO: 30559 - protein, 10 aa, Mycobacterium tuberculosis
AVMAEAAARA

SEQ ID NO: 30560 - protein, 10 aa, Mycobacterium tuberculosis
VMAEAAARAR

SEQ ID NO: 30561 - protein, 10 aa, Mycobacterium tuberculosis
MAEAAARARA

SEQ ID NO: 30562 - protein, 10 aa, Mycobacterium tuberculosis
AEAAARARAG

SEQ ID NO: 30563 - protein, 10 aa, Mycobacterium tuberculosis
EAAARARAGD

SEQ ID NO: 30564 - protein, 10 aa, Mycobacterium tuberculosis
AAARARAGDG

SEQ ID NO: 30565 - protein, 10 aa, Mycobacterium tuberculosis
AARARAGDGP

SEQ ID NO: 30566 - protein, 10 aa, Mycobacterium tuberculosis
ARARAGDGPT

SEQ ID NO: 30567 - protein, 10 aa, Mycobacterium tuberculosis
RARAGDGPTL

SEQ ID NO: 30568 - protein, 10 aa, Mycobacterium tuberculosis
ARAGDGPTLI

SEQ ID NO: 30569 - protein, 10 aa, Mycobacterium tuberculosis
RAGDGPTLIE

SEQ ID NO: 30570 - protein, 10 aa, Mycobacterium tuberculosis
AGDGPTLIEA

SEQ ID NO: 30571 - protein, 10 aa, Mycobacterium tuberculosis
GDGPTLIEAV

SEQ ID NO: 30572 - protein, 10 aa, Mycobacterium tuberculosis
DGPTLIEAVT

SEQ ID NO: 30573 - protein, 10 aa, Mycobacterium tuberculosis
GPTLIEAVTY

SEQ ID NO: 30574 - protein, 10 aa, Mycobacterium tuberculosis
PTLIEAVTYR

SEQ ID NO: 30575 - protein, 10 aa, Mycobacterium tuberculosis
TLIEAVTYRL

SEQ ID NO: 30576 - protein, 10 aa, Mycobacterium tuberculosis
LIEAVTYRLG

SEQ ID NO: 30577 - protein, 10 aa, Mycobacterium tuberculosis
IEAVTYRLGP

SEQ ID NO: 30578 - protein, 10 aa, Mycobacterium tuberculosis
EAVTYRLGPH

SEQ ID NO: 30579 - protein, 10 aa, Mycobacterium tuberculosis
AVTYRLGPHT

SEQ ID NO: 30580 - protein, 10 aa, Mycobacterium tuberculosis
VTYRLGPHTT

SEQ ID NO: 30581 - protein, 10 aa, Mycobacterium tuberculosis
TYRLGPHTTA

SEQ ID NO: 30582 - protein, 10 aa, Mycobacterium tuberculosis
YRLGPHTTAD

SEQ ID NO: 30583 - protein, 10 aa, Mycobacterium tuberculosis
RLGPHTTADD

SEQ ID NO: 30584 - protein, 10 aa, Mycobacterium tuberculosis
LGPHTTADDP

SEQ ID NO: 30585 - protein, 10 aa, Mycobacterium tuberculosis
GPHTTADDPT

SEQ ID NO: 30586 - protein, 10 aa, Mycobacterium tuberculosis
PHTTADDPTR

SEQ ID NO: 30587 - protein, 10 aa, Mycobacterium tuberculosis
HTTADDPTRY

SEQ ID NO: 30588 - protein, 10 aa, Mycobacterium tuberculosis
TTADDPTRYR

SEQ ID NO: 30589 - protein, 10 aa, Mycobacterium tuberculosis
TADDPTRYRS

SEQ ID NO: 30590 - protein, 10 aa, Mycobacterium tuberculosis
ADDPTRYRSQ

SEQ ID NO: 30591 - protein, 10 aa, Mycobacterium tuberculosis
DDPTRYRSQE

SEQ ID NO: 30592 - protein, 10 aa, Mycobacterium tuberculosis
DPTRYRSQEE

SEQ ID NO: 30593 - protein, 10 aa, Mycobacterium tuberculosis
PTRYRSQEEV

SEQ ID NO: 30594 - protein, 10 aa, Mycobacterium tuberculosis
TRYRSQEEVD

SEQ ID NO: 30595 - protein, 10 aa, Mycobacterium tuberculosis
RYRSQEEVDR

SEQ ID NO: 30596 - protein, 10 aa, Mycobacterium tuberculosis
YRSQEEVDRW

SEQ ID NO: 30597 - protein, 10 aa, Mycobacterium tuberculosis
RSQEEVDRWA

SEQ ID NO: 30598 - protein, 10 aa, Mycobacterium tuberculosis
SQEEVDRWAT

SEQ ID NO: 30599 - protein, 10 aa, Mycobacterium tuberculosis
QEEVDRWATL

SEQ ID NO: 30600 - protein, 10 aa, Mycobacterium tuberculosis
EEVDRWATLD

SEQ ID NO: 30601 - protein, 10 aa, Mycobacterium tuberculosis
EVDRWATLDP

SEQ ID NO: 30602 - protein, 10 aa, Mycobacterium tuberculosis
VDRWATLDPI

SEQ ID NO: 30603 - protein, 10 aa, Mycobacterium tuberculosis
DRWATLDPIP

SEQ ID NO: 30604 - protein, 10 aa, Mycobacterium tuberculosis
RWATLDPIPR

SEQ ID NO: 30605 - protein, 10 aa, Mycobacterium tuberculosis
WATLDPIPRY

SEQ ID NO: 30606 - protein, 10 aa, Mycobacterium tuberculosis
ATLDPIPRYR

SEQ ID NO: 30607 - protein, 10 aa, Mycobacterium tuberculosis
TLDPIPRYRT

SEQ ID NO: 30608 - protein, 10 aa, Mycobacterium tuberculosis
LDPIPRYRTY

SEQ ID NO: 30609 - protein, 10 aa, Mycobacterium tuberculosis
DPIPRYRTYL

SEQ ID NO: 30610 - protein, 10 aa, Mycobacterium tuberculosis
PIPRYRTYLQ

SEQ ID NO: 30611 - protein, 10 aa, Mycobacterium tuberculosis
IPRYRTYLQD

SEQ ID NO: 30612 - protein, 10 aa, Mycobacterium tuberculosis
PRYRTYLQDQ

SEQ ID NO: 30613 - protein, 10 aa, Mycobacterium tuberculosis
RYRTYLQDQG

SEQ ID NO: 30614 - protein, 10 aa, Mycobacterium tuberculosis
YRTYLQDQGL

SEQ ID NO: 30615 - protein, 10 aa, Mycobacterium tuberculosis
RTYLQDQGLW

SEQ ID NO: 30616 - protein, 10 aa, Mycobacterium tuberculosis
TYLQDQGLWS

SEQ ID NO: 30617 - protein, 10 aa, Mycobacterium tuberculosis
YLQDQGLWSQ

SEQ ID NO: 30618 - protein, 10 aa, Mycobacterium tuberculosis
LQDQGLWSQR

SEQ ID NO: 30619 - protein, 10 aa, Mycobacterium tuberculosis
QDQGLWSQRL

SEQ ID NO: 30620 - protein, 10 aa, Mycobacterium tuberculosis
DQGLWSQRLE

SEQ ID NO: 30621 - protein, 10 aa, Mycobacterium tuberculosis
QGLWSQRLEE

SEQ ID NO: 30622 - protein, 10 aa, Mycobacterium tuberculosis
GLWSQRLEEQ

SEQ ID NO: 30623 - protein, 10 aa, Mycobacterium tuberculosis
LWSQRLEEQV

SEQ ID NO: 30624 - protein, 10 aa, Mycobacterium tuberculosis
WSQRLEEQVT

SEQ ID NO: 30625 - protein, 10 aa, Mycobacterium tuberculosis
SQRLEEQVTA

SEQ ID NO: 30626 - protein, 10 aa, Mycobacterium tuberculosis
QRLEEQVTAR

SEQ ID NO: 30627 - protein, 10 aa, Mycobacterium tuberculosis
RLEEQVTARA

SEQ ID NO: 30628 - protein, 10 aa, Mycobacterium tuberculosis
LEEQVTARAK

SEQ ID NO: 30629 - protein, 10 aa, Mycobacterium tuberculosis
EEQVTARAKH

SEQ ID NO: 30630 - protein, 10 aa, Mycobacterium tuberculosis
EQVTARAKHV

SEQ ID NO: 30631 - protein, 10 aa, Mycobacterium tuberculosis
QVTARAKHVR

SEQ ID NO: 30632 - protein, 10 aa, Mycobacterium tuberculosis
VTARAKHVRS

SEQ ID NO: 30633 - protein, 10 aa, Mycobacterium tuberculosis
TARAKHVRSE

SEQ ID NO: 30634 - protein, 10 aa, Mycobacterium tuberculosis
ARAKHVRSEL

SEQ ID NO: 30635 - protein, 10 aa, Mycobacterium tuberculosis
RAKHVRSELR

SEQ ID NO: 30636 - protein, 10 aa, Mycobacterium tuberculosis
AKHVRSELRD

SEQ ID NO: 30637 - protein, 10 aa, Mycobacterium tuberculosis
KHVRSELRDA

SEQ ID NO: 30638 - protein, 10 aa, Mycobacterium tuberculosis
HVRSELRDAV

SEQ ID NO: 30639 - protein, 10 aa, Mycobacterium tuberculosis
VRSELRDAVF

SEQ ID NO: 30640 - protein, 10 aa, Mycobacterium tuberculosis
RSELRDAVFD

SEQ ID NO: 30641 - protein, 10 aa, Mycobacterium tuberculosis
SELRDAVFDA

SEQ ID NO: 30642 - protein, 10 aa, Mycobacterium tuberculosis
ELRDAVFDAP

SEQ ID NO: 30643 - protein, 10 aa, Mycobacterium tuberculosis
LRDAVFDAPD

SEQ ID NO: 30644 - protein, 10 aa, Mycobacterium tuberculosis
RDAVFDAPDF

SEQ ID NO: 30645 - protein, 10 aa, Mycobacterium tuberculosis
DAVFDAPDFD

SEQ ID NO: 30646 - protein, 10 aa, Mycobacterium tuberculosis
AVFDAPDFDV

SEQ ID NO: 30647 - protein, 10 aa, Mycobacterium tuberculosis
VFDAPDFDVD

SEQ ID NO: 30648 - protein, 10 aa, Mycobacterium tuberculosis
FDAPDFDVDE

SEQ ID NO: 30649 - protein, 10 aa, Mycobacterium tuberculosis
DAPDFDVDEV

SEQ ID NO: 30650 - protein, 10 aa, Mycobacterium tuberculosis
APDFDVDEVF

SEQ ID NO: 30651 - protein, 10 aa, Mycobacterium tuberculosis
PDFDVDEVFT

SEQ ID NO: 30652 - protein, 10 aa, Mycobacterium tuberculosis
DFDVDEVFTT

SEQ ID NO: 30653 - protein, 10 aa, Mycobacterium tuberculosis
FDVDEVFTTV

SEQ ID NO: 30654 - protein, 10 aa, Mycobacterium tuberculosis
DVDEVFTTVY

SEQ ID NO: 30655 - protein, 10 aa, Mycobacterium tuberculosis
VDEVFTTVYA

SEQ ID NO: 30656 - protein, 10 aa, Mycobacterium tuberculosis
DEVFTTVYAE

SEQ ID NO: 30657 - protein, 10 aa, Mycobacterium tuberculosis
EVFTTVYAEI

SEQ ID NO: 30658 - protein, 10 aa, Mycobacterium tuberculosis
VFTTVYAEIT

SEQ ID NO: 30659 - protein, 10 aa, Mycobacterium tuberculosis
FTTVYAEITP

SEQ ID NO: 30660 - protein, 10 aa, Mycobacterium tuberculosis
TTVYAEITPG

SEQ ID NO: 30661 - protein, 10 aa, Mycobacterium tuberculosis
TVYAEITPGL

SEQ ID NO: 30662 - protein, 10 aa, Mycobacterium tuberculosis
VYAEITPGLQ

SEQ ID NO: 30663 - protein, 10 aa, Mycobacterium tuberculosis
YAEITPGLQA

SEQ ID NO: 30664 - protein, 10 aa, Mycobacterium tuberculosis
AEITPGLQAQ

SEQ ID NO: 30665 - protein, 10 aa, Mycobacterium tuberculosis
EITPGLQAQR

SEQ ID NO: 30666 - protein, 10 aa, Mycobacterium tuberculosis
ITPGLQAQRE

SEQ ID NO: 30667 - protein, 10 aa, Mycobacterium tuberculosis
TPGLQAQREQ

SEQ ID NO: 30668 - protein, 10 aa, Mycobacterium tuberculosis
PGLQAQREQL

SEQ ID NO: 30669 - protein, 10 aa, Mycobacterium tuberculosis
GLQAQREQLR

SEQ ID NO: 30670 - protein, 10 aa, Mycobacterium tuberculosis
LQAQREQLRA

SEQ ID NO: 30671 - protein, 10 aa, Mycobacterium tuberculosis
QAQREQLRAE

SEQ ID NO: 30672 - protein, 10 aa, Mycobacterium tuberculosis
AQREQLRAEL

SEQ ID NO: 30673 - protein, 10 aa, Mycobacterium tuberculosis
QREQLRAELA

SEQ ID NO: 30674 - protein, 10 aa, Mycobacterium tuberculosis
REQLRAELAR

SEQ ID NO: 30675 - protein, 10 aa, Mycobacterium tuberculosis
EQLRAELART

SEQ ID NO: 30676 - protein, 10 aa, Mycobacterium tuberculosis
QLRAELARTD

SEQ ID NO: 30677 - protein, 11 aa, Mycobacterium tuberculosis
MGEGSRRPSGM

SEQ ID NO: 30678 - protein, 11 aa, Mycobacterium tuberculosis
GEGSRRPSGML

SEQ ID NO: 30679 - protein, 11 aa, Mycobacterium tuberculosis
EGSRRPSGMLM

SEQ ID NO: 30680 - protein, 11 aa, Mycobacterium tuberculosis
GSRRPSGMLMS

SEQ ID NO: 30681 - protein, 11 aa, Mycobacterium tuberculosis
SRRPSGMLMSV

SEQ ID NO: 30682 - protein, 11 aa, Mycobacterium tuberculosis
RRPSGMLMSVD

SEQ ID NO: 30683 - protein, 11 aa, Mycobacterium tuberculosis
RPSGMLMSVDL

SEQ ID NO: 30684 - protein, 11 aa, Mycobacterium tuberculosis
PSGMLMSVDLE

SEQ ID NO: 30685 - protein, 11 aa, Mycobacterium tuberculosis
SGMLMSVDLEP

SEQ ID NO: 30686 - protein, 11 aa, Mycobacterium tuberculosis
GMLMSVDLEPV

SEQ ID NO: 30687 - protein, 11 aa, Mycobacterium tuberculosis
MLMSVDLEPVQ

SEQ ID NO: 30688 - protein, 11 aa, Mycobacterium tuberculosis
LMSVDLEPVQL

SEQ ID NO: 30689 - protein, 11 aa, Mycobacterium tuberculosis
MSVDLEPVQLV

SEQ ID NO: 30690 - protein, 11 aa, Mycobacterium tuberculosis
SVDLEPVQLVG

SEQ ID NO: 30691 - protein, 11 aa, Mycobacterium tuberculosis
VDLEPVQLVGP

SEQ ID NO: 30692 - protein, 11 aa, Mycobacterium tuberculosis
DLEPVQLVGPD

SEQ ID NO: 30693 - protein, 11 aa, Mycobacterium tuberculosis
LEPVQLVGPDG

SEQ ID NO: 30694 - protein, 11 aa, Mycobacterium tuberculosis
EPVQLVGPDGT

SEQ ID NO: 30695 - protein, 11 aa, Mycobacterium tuberculosis
PVQLVGPDGTP

SEQ ID NO: 30696 - protein, 11 aa, Mycobacterium tuberculosis
VQLVGPDGTPT

SEQ ID NO: 30697 - protein, 11 aa, Mycobacterium tuberculosis
QLVGPDGTPTA

SEQ ID NO: 30698 - protein, 11 aa, Mycobacterium tuberculosis
LVGPDGTPTAE

SEQ ID NO: 30699 - protein, 11 aa, Mycobacterium tuberculosis
VGPDGTPTAER

SEQ ID NO: 30700 - protein, 11 aa, Mycobacterium tuberculosis
GPDGTPTAERR

SEQ ID NO: 30701 - protein, 11 aa, Mycobacterium tuberculosis
PDGTPTAERRY

SEQ ID NO: 30702 - protein, 11 aa, Mycobacterium tuberculosis
DGTPTAERRYH

SEQ ID NO: 30703 - protein, 11 aa, Mycobacterium tuberculosis
GTPTAERRYHR

SEQ ID NO: 30704 - protein, 11 aa, Mycobacterium tuberculosis
TPTAERRYHRD

SEQ ID NO: 30705 - protein, 11 aa, Mycobacterium tuberculosis
PTAERRYHRDL

SEQ ID NO: 30706 - protein, 11 aa, Mycobacterium tuberculosis
TAERRYHRDLP

SEQ ID NO: 30707 - protein, 11 aa, Mycobacterium tuberculosis
AERRYHRDLPE

SEQ ID NO: 30708 - protein, 11 aa, Mycobacterium tuberculosis
ERRYHRDLPEE

SEQ ID NO: 30709 - protein, 11 aa, Mycobacterium tuberculosis
RRYHRDLPEET

SEQ ID NO: 30710 - protein, 11 aa, Mycobacterium tuberculosis
RYHRDLPEETL

SEQ ID NO: 30711 - protein, 11 aa, Mycobacterium tuberculosis
YHRDLPEETLR

SEQ ID NO: 30712 - protein, 11 aa, Mycobacterium tuberculosis
HRDLPEETLRW

SEQ ID NO: 30713 - protein, 11 aa, Mycobacterium tuberculosis
RDLPEETLRWL

SEQ ID NO: 30714 - protein, 11 aa, Mycobacterium tuberculosis
DLPEETLRWLY

SEQ ID NO: 30715 - protein, 11 aa, Mycobacterium tuberculosis
LPEETLRWLYE

SEQ ID NO: 30716 - protein, 11 aa, Mycobacterium tuberculosis
PEETLRWLYEM

SEQ ID NO: 30717 - protein, 11 aa, Mycobacterium tuberculosis
EETLRWLYEMM

SEQ ID NO: 30718 - protein, 11 aa, Mycobacterium tuberculosis
ETLRWLYEMMV

SEQ ID NO: 30719 - protein, 11 aa, Mycobacterium tuberculosis
TLRWLYEMMVV

SEQ ID NO: 30720 - protein, 11 aa, Mycobacterium tuberculosis
LRWLYEMMVVT

SEQ ID NO: 30721 - protein, 11 aa, Mycobacterium tuberculosis
RWLYEMMVVTR

SEQ ID NO: 30722 - protein, 11 aa, Mycobacterium tuberculosis
WLYEMMVVTRE

SEQ ID NO: 30723 - protein, 11 aa, Mycobacterium tuberculosis
LYEMMVVTREL

SEQ ID NO: 30724 - protein, 11 aa, Mycobacterium tuberculosis
YEMMVVTRELD

SEQ ID NO: 30725 - protein, 11 aa, Mycobacterium tuberculosis
EMMVVTRELDT

SEQ ID NO: 30726 - protein, 11 aa, Mycobacterium tuberculosis
MMVVTRELDTE

SEQ ID NO: 30727 - protein, 11 aa, Mycobacterium tuberculosis
MVVTRELDTEF

SEQ ID NO: 30728 - protein, 11 aa, Mycobacterium tuberculosis
VVTRELDTEFV

SEQ ID NO: 30729 - protein, 11 aa, Mycobacterium tuberculosis
VTRELDTEFVN

SEQ ID NO: 30730 - protein, 11 aa, Mycobacterium tuberculosis
TRELDTEFVNL

SEQ ID NO: 30731 - protein, 11 aa, Mycobacterium tuberculosis
RELDTEFVNLQ

SEQ ID NO: 30732 - protein, 11 aa, Mycobacterium tuberculosis
ELDTEFVNLQR

SEQ ID NO: 30733 - protein, 11 aa, Mycobacterium tuberculosis
LDTEFVNLQRQ

SEQ ID NO: 30734 - protein, 11 aa, Mycobacterium tuberculosis
DTEFVNLQRQG

SEQ ID NO: 30735 - protein, 11 aa, Mycobacterium tuberculosis
TEFVNLQRQGE

SEQ ID NO: 30736 - protein, 11 aa, Mycobacterium tuberculosis
EFVNLQRQGEL

SEQ ID NO: 30737 - protein, 11 aa, Mycobacterium tuberculosis
FVNLQRQGELA

SEQ ID NO: 30738 - protein, 11 aa, Mycobacterium tuberculosis
VNLQRQGELAL

SEQ ID NO: 30739 - protein, 11 aa, Mycobacterium tuberculosis
NLQRQGELALY

SEQ ID NO: 30740 - protein, 11 aa, Mycobacterium tuberculosis
LQRQGELALYT

SEQ ID NO: 30741 - protein, 11 aa, Mycobacterium tuberculosis
QRQGELALYTP

SEQ ID NO: 30742 - protein, 11 aa, Mycobacterium tuberculosis
RQGELALYTPC

SEQ ID NO: 30743 - protein, 11 aa, Mycobacterium tuberculosis
QGELALYTPCR

SEQ ID NO: 30744 - protein, 11 aa, Mycobacterium tuberculosis
GELALYTPCRG

SEQ ID NO: 30745 - protein, 11 aa, Mycobacterium tuberculosis
ELALYTPCRGQ

SEQ ID NO: 30746 - protein, 11 aa, Mycobacterium tuberculosis
LALYTPCRGQE

SEQ ID NO: 30747 - protein, 11 aa, Mycobacterium tuberculosis
ALYTPCRGQEA

SEQ ID NO: 30748 - protein, 11 aa, Mycobacterium tuberculosis
LYTPCRGQEAA

SEQ ID NO: 30749 - protein, 11 aa, Mycobacterium tuberculosis
YTPCRGQEAAQ

SEQ ID NO: 30750 - protein, 11 aa, Mycobacterium tuberculosis
TPCRGQEAAQV

SEQ ID NO: 30751 - protein, 11 aa, Mycobacterium tuberculosis
PCRGQEAAQVG

SEQ ID NO: 30752 - protein, 11 aa, Mycobacterium tuberculosis
CRGQEAAQVGA

SEQ ID NO: 30753 - protein, 11 aa, Mycobacterium tuberculosis
RGQEAAQVGAA

SEQ ID NO: 30754 - protein, 11 aa, Mycobacterium tuberculosis
GQEAAQVGAAA

SEQ ID NO: 30755 - protein, 11 aa, Mycobacterium tuberculosis
QEAAQVGAAAC

SEQ ID NO: 30756 - protein, 11 aa, Mycobacterium tuberculosis
EAAQVGAAACL

SEQ ID NO: 30757 - protein, 11 aa, Mycobacterium tuberculosis
AAQVGAAACLR

SEQ ID NO: 30758 - protein, 11 aa, Mycobacterium tuberculosis
AQVGAAACLRK

SEQ ID NO: 30759 - protein, 11 aa, Mycobacterium tuberculosis
QVGAAACLRKT

SEQ ID NO: 30760 - protein, 11 aa, Mycobacterium tuberculosis
VGAAACLRKTD

SEQ ID NO: 30761 - protein, 11 aa, Mycobacterium tuberculosis
GAAACLRKTDW

SEQ ID NO: 30762 - protein, 11 aa, Mycobacterium tuberculosis
AAACLRKTDWL

SEQ ID NO: 30763 - protein, 11 aa, Mycobacterium tuberculosis
AACLRKTDWLF

SEQ ID NO: 30764 - protein, 11 aa, Mycobacterium tuberculosis
ACLRKTDWLFP

SEQ ID NO: 30765 - protein, 11 aa, Mycobacterium tuberculosis
CLRKTDWLFPQ

SEQ ID NO: 30766 - protein, 11 aa, Mycobacterium tuberculosis
LRKTDWLFPQY

SEQ ID NO: 30767 - protein, 11 aa, Mycobacterium tuberculosis
RKTDWLFPQYR

SEQ ID NO: 30768 - protein, 11 aa, Mycobacterium tuberculosis
KTDWLFPQYRE

SEQ ID NO: 30769 - protein, 11 aa, Mycobacterium tuberculosis
TDWLFPQYREL

SEQ ID NO: 30770 - protein, 11 aa, Mycobacterium tuberculosis
DWLFPQYRELG

SEQ ID NO: 30771 - protein, 11 aa, Mycobacterium tuberculosis
WLFPQYRELGV

SEQ ID NO: 30772 - protein, 11 aa, Mycobacterium tuberculosis
LFPQYRELGVY

SEQ ID NO: 30773 - protein, 11 aa, Mycobacterium tuberculosis
FPQYRELGVYL

SEQ ID NO: 30774 - protein, 11 aa, Mycobacterium tuberculosis
PQYRELGVYLV

SEQ ID NO: 30775 - protein, 11 aa, Mycobacterium tuberculosis
QYRELGVYLVR

SEQ ID NO: 30776 - protein, 11 aa, Mycobacterium tuberculosis
YRELGVYLVRG

SEQ ID NO: 30777 - protein, 11 aa, Mycobacterium tuberculosis
RELGVYLVRGI

SEQ ID NO: 30778 - protein, 11 aa, Mycobacterium tuberculosis
ELGVYLVRGIP

SEQ ID NO: 30779 - protein, 11 aa, Mycobacterium tuberculosis
LGVYLVRGIPP

SEQ ID NO: 30780 - protein, 11 aa, Mycobacterium tuberculosis
GVYLVRGIPPG

SEQ ID NO: 30781 - protein, 11 aa, Mycobacterium tuberculosis
VYLVRGIPPGH

SEQ ID NO: 30782 - protein, 11 aa, Mycobacterium tuberculosis
YLVRGIPPGHV

SEQ ID NO: 30783 - protein, 11 aa, Mycobacterium tuberculosis
LVRGIPPGHVG

SEQ ID NO: 30784 - protein, 11 aa, Mycobacterium tuberculosis
VRGIPPGHVGV

SEQ ID NO: 30785 - protein, 11 aa, Mycobacterium tuberculosis
RGIPPGHVGVA

SEQ ID NO: 30786 - protein, 11 aa, Mycobacterium tuberculosis
GIPPGHVGVAW

SEQ ID NO: 30787 - protein, 11 aa, Mycobacterium tuberculosis
IPPGHVGVAWR

SEQ ID NO: 30788 - protein, 11 aa, Mycobacterium tuberculosis
PPGHVGVAWRG

SEQ ID NO: 30789 - protein, 11 aa, Mycobacterium tuberculosis
PGHVGVAWRGT

SEQ ID NO: 30790 - protein, 11 aa, Mycobacterium tuberculosis
GHVGVAWRGTW

SEQ ID NO: 30791 - protein, 11 aa, Mycobacterium tuberculosis
HVGVAWRGTWH

SEQ ID NO: 30792 - protein, 11 aa, Mycobacterium tuberculosis
VGVAWRGTWHG

SEQ ID NO: 30793 - protein, 11 aa, Mycobacterium tuberculosis
GVAWRGTWHGG

SEQ ID NO: 30794 - protein, 11 aa, Mycobacterium tuberculosis
VAWRGTWHGGL

SEQ ID NO: 30795 - protein, 11 aa, Mycobacterium tuberculosis
AWRGTWHGGLQ

SEQ ID NO: 30796 - protein, 11 aa, Mycobacterium tuberculosis
WRGTWHGGLQF

SEQ ID NO: 30797 - protein, 11 aa, Mycobacterium tuberculosis
RGTWHGGLQFT

SEQ ID NO: 30798 - protein, 11 aa, Mycobacterium tuberculosis
GTWHGGLQFTT

SEQ ID NO: 30799 - protein, 11 aa, Mycobacterium tuberculosis
TWHGGLQFTTK

SEQ ID NO: 30800 - protein, 11 aa, Mycobacterium tuberculosis
WHGGLQFTTKC

SEQ ID NO: 30801 - protein, 11 aa, Mycobacterium tuberculosis
HGGLQFTTKCC

SEQ ID NO: 30802 - protein, 11 aa, Mycobacterium tuberculosis
GGLQFTTKCCA

SEQ ID NO: 30803 - protein, 11 aa, Mycobacterium tuberculosis
GLQFTTKCCAP

SEQ ID NO: 30804 - protein, 11 aa, Mycobacterium tuberculosis
LQFTTKCCAPM

SEQ ID NO: 30805 - protein, 11 aa, Mycobacterium tuberculosis
QFTTKCCAPMS

SEQ ID NO: 30806 - protein, 11 aa, Mycobacterium tuberculosis
FTTKCCAPMSV

SEQ ID NO: 30807 - protein, 11 aa, Mycobacterium tuberculosis
TTKCCAPMSVP

SEQ ID NO: 30808 - protein, 11 aa, Mycobacterium tuberculosis
TKCCAPMSVPI

SEQ ID NO: 30809 - protein, 11 aa, Mycobacterium tuberculosis
KCCAPMSVPIG

SEQ ID NO: 30810 - protein, 11 aa, Mycobacterium tuberculosis
CCAPMSVPIGT

SEQ ID NO: 30811 - protein, 11 aa, Mycobacterium tuberculosis
CAPMSVPIGTQ

SEQ ID NO: 30812 - protein, 11 aa, Mycobacterium tuberculosis
APMSVPIGTQT

SEQ ID NO: 30813 - protein, 11 aa, Mycobacterium tuberculosis
PMSVPIGTQTL

SEQ ID NO: 30814 - protein, 11 aa, Mycobacterium tuberculosis
MSVPIGTQTLH

SEQ ID NO: 30815 - protein, 11 aa, Mycobacterium tuberculosis
SVPIGTQTLHA

SEQ ID NO: 30816 - protein, 11 aa, Mycobacterium tuberculosis
VPIGTQTLHAV

SEQ ID NO: 30817 - protein, 11 aa, Mycobacterium tuberculosis
PIGTQTLHAVG

SEQ ID NO: 30818 - protein, 11 aa, Mycobacterium tuberculosis
IGTQTLHAVGA

SEQ ID NO: 30819 - protein, 11 aa, Mycobacterium tuberculosis
GTQTLHAVGAA

SEQ ID NO: 30820 - protein, 11 aa, Mycobacterium tuberculosis
TQTLHAVGAAM

SEQ ID NO: 30821 - protein, 11 aa, Mycobacterium tuberculosis
QTLHAVGAAMA

SEQ ID NO: 30822 - protein, 11 aa, Mycobacterium tuberculosis
TLHAVGAAMAA

SEQ ID NO: 30823 - protein, 11 aa, Mycobacterium tuberculosis
LHAVGAAMAAQ

SEQ ID NO: 30824 - protein, 11 aa, Mycobacterium tuberculosis
HAVGAAMAAQR

SEQ ID NO: 30825 - protein, 11 aa, Mycobacterium tuberculosis
AVGAAMAAQRL

SEQ ID NO: 30826 - protein, 11 aa, Mycobacterium tuberculosis
VGAAMAAQRLD

SEQ ID NO: 30827 - protein, 11 aa, Mycobacterium tuberculosis
GAAMAAQRLDE

SEQ ID NO: 30828 - protein, 11 aa, Mycobacterium tuberculosis
AAMAAQRLDED

SEQ ID NO: 30829 - protein, 11 aa, Mycobacterium tuberculosis
AMAAQRLDEDS

SEQ ID NO: 30830 - protein, 11 aa, Mycobacterium tuberculosis
MAAQRLDEDSV

SEQ ID NO: 30831 - protein, 11 aa, Mycobacterium tuberculosis
AAQRLDEDSVT

SEQ ID NO: 30832 - protein, 11 aa, Mycobacterium tuberculosis
AQRLDEDSVTV

SEQ ID NO: 30833 - protein, 11 aa, Mycobacterium tuberculosis
QRLDEDSVTVA

SEQ ID NO: 30834 - protein, 11 aa, Mycobacterium tuberculosis
RLDEDSVTVAF

SEQ ID NO: 30835 - protein, 11 aa, Mycobacterium tuberculosis
LDEDSVTVAFL

SEQ ID NO: 30836 - protein, 11 aa, Mycobacterium tuberculosis
DEDSVTVAFLG

SEQ ID NO: 30837 - protein, 11 aa, Mycobacterium tuberculosis
EDSVTVAFLGD

SEQ ID NO: 30838 - protein, 11 aa, Mycobacterium tuberculosis
DSVTVAFLGDG

SEQ ID NO: 30839 - protein, 11 aa, Mycobacterium tuberculosis
SVTVAFLGDGA

SEQ ID NO: 30840 - protein, 11 aa, Mycobacterium tuberculosis
VTVAFLGDGAT

SEQ ID NO: 30841 - protein, 11 aa, Mycobacterium tuberculosis
TVAFLGDGATS

SEQ ID NO: 30842 - protein, 11 aa, Mycobacterium tuberculosis
VAFLGDGATSE

SEQ ID NO: 30843 - protein, 11 aa, Mycobacterium tuberculosis
AFLGDGATSEG

SEQ ID NO: 30844 - protein, 11 aa, Mycobacterium tuberculosis
FLGDGATSEGD

SEQ ID NO: 30845 - protein, 11 aa, Mycobacterium tuberculosis
LGDGATSEGDV

SEQ ID NO: 30846 - protein, 11 aa, Mycobacterium tuberculosis
GDGATSEGDVH

SEQ ID NO: 30847 - protein, 11 aa, Mycobacterium tuberculosis
DGATSEGDVHE

SEQ ID NO: 30848 - protein, 11 aa, Mycobacterium tuberculosis
GATSEGDVHEA

SEQ ID NO: 30849 - protein, 11 aa, Mycobacterium tuberculosis
ATSEGDVHEAL

SEQ ID NO: 30850 - protein, 11 aa, Mycobacterium tuberculosis
TSEGDVHEALN

SEQ ID NO: 30851 - protein, 11 aa, Mycobacterium tuberculosis
SEGDVHEALNF

SEQ ID NO: 30852 - protein, 11 aa, Mycobacterium tuberculosis
EGDVHEALNFA

SEQ ID NO: 30853 - protein, 11 aa, Mycobacterium tuberculosis
GDVHEALNFAA

SEQ ID NO: 30854 - protein, 11 aa, Mycobacterium tuberculosis
DVHEALNFAAV

SEQ ID NO: 30855 - protein, 11 aa, Mycobacterium tuberculosis
VHEALNFAAVF

SEQ ID NO: 30856 - protein, 11 aa, Mycobacterium tuberculosis
HEALNFAAVFT

SEQ ID NO: 30857 - protein, 11 aa, Mycobacterium tuberculosis
EALNFAAVFTT

SEQ ID NO: 30858 - protein, 11 aa, Mycobacterium tuberculosis
ALNFAAVFTTP

SEQ ID NO: 30859 - protein, 11 aa, Mycobacterium tuberculosis
LNFAAVFTTPC

SEQ ID NO: 30860 - protein, 11 aa, Mycobacterium tuberculosis
NFAAVFTTPCV

SEQ ID NO: 30861 - protein, 11 aa, Mycobacterium tuberculosis
FAAVFTTPCVF

SEQ ID NO: 30862 - protein, 11 aa, Mycobacterium tuberculosis
AAVFTTPCVFY

SEQ ID NO: 30863 - protein, 11 aa, Mycobacterium tuberculosis
AVFTTPCVFYV

SEQ ID NO: 30864 - protein, 11 aa, Mycobacterium tuberculosis
VFTTPCVFYVQ

SEQ ID NO: 30865 - protein, 11 aa, Mycobacterium tuberculosis
FTTPCVFYVQN

SEQ ID NO: 30866 - protein, 11 aa, Mycobacterium tuberculosis
TTPCVFYVQNN

SEQ ID NO: 30867 - protein, 11 aa, Mycobacterium tuberculosis
TPCVFYVQNNQ

SEQ ID NO: 30868 - protein, 11 aa, Mycobacterium tuberculosis
PCVFYVQNNQW

SEQ ID NO: 30869 - protein, 11 aa, Mycobacterium tuberculosis
CVFYVQNNQWA

SEQ ID NO: 30870 - protein, 11 aa, Mycobacterium tuberculosis
VFYVQNNQWAI

SEQ ID NO: 30871 - protein, 11 aa, Mycobacterium tuberculosis
FYVQNNQWAIS

SEQ ID NO: 30872 - protein, 11 aa, Mycobacterium tuberculosis
YVQNNQWAISM

SEQ ID NO: 30873 - protein, 11 aa, Mycobacterium tuberculosis
VQNNQWAISMP

SEQ ID NO: 30874 - protein, 11 aa, Mycobacterium tuberculosis
QNNQWAISMPV

SEQ ID NO: 30875 - protein, 11 aa, Mycobacterium tuberculosis
NNQWAISMPVS

SEQ ID NO: 30876 - protein, 11 aa, Mycobacterium tuberculosis
NQWAISMPVSR

SEQ ID NO: 30877 - protein, 11 aa, Mycobacterium tuberculosis
QWAISMPVSRQ

SEQ ID NO: 30878 - protein, 11 aa, Mycobacterium tuberculosis
WAISMPVSRQT

SEQ ID NO: 30879 - protein, 11 aa, Mycobacterium tuberculosis
AISMPVSRQTA

SEQ ID NO: 30880 - protein, 11 aa, Mycobacterium tuberculosis
ISMPVSRQTAA

SEQ ID NO: 30881 - protein, 11 aa, Mycobacterium tuberculosis
SMPVSRQTAAP

SEQ ID NO: 30882 - protein, 11 aa, Mycobacterium tuberculosis
MPVSRQTAAPS

SEQ ID NO: 30883 - protein, 11 aa, Mycobacterium tuberculosis
PVSRQTAAPSI

SEQ ID NO: 30884 - protein, 11 aa, Mycobacterium tuberculosis
VSRQTAAPSIA

SEQ ID NO: 30885 - protein, 11 aa, Mycobacterium tuberculosis
SRQTAAPSIAH

SEQ ID NO: 30886 - protein, 11 aa, Mycobacterium tuberculosis
RQTAAPSIAHK

SEQ ID NO: 30887 - protein, 11 aa, Mycobacterium tuberculosis
QTAAPSIAHKA

SEQ ID NO: 30888 - protein, 11 aa, Mycobacterium tuberculosis
TAAPSIAHKAI

SEQ ID NO: 30889 - protein, 11 aa, Mycobacterium tuberculosis
AAPSIAHKAIG

SEQ ID NO: 30890 - protein, 11 aa, Mycobacterium tuberculosis
APSIAHKAIGY

SEQ ID NO: 30891 - protein, 11 aa, Mycobacterium tuberculosis
PSIAHKAIGYG

SEQ ID NO: 30892 - protein, 11 aa, Mycobacterium tuberculosis
SIAHKAIGYGM

SEQ ID NO: 30893 - protein, 11 aa, Mycobacterium tuberculosis
IAHKAIGYGMP

SEQ ID NO: 30894 - protein, 11 aa, Mycobacterium tuberculosis
AHKAIGYGMPG

SEQ ID NO: 30895 - protein, 11 aa, Mycobacterium tuberculosis
HKAIGYGMPGI

SEQ ID NO: 30896 - protein, 11 aa, Mycobacterium tuberculosis
KAIGYGMPGIR

SEQ ID NO: 30897 - protein, 11 aa, Mycobacterium tuberculosis
AIGYGMPGIRV

SEQ ID NO: 30898 - protein, 11 aa, Mycobacterium tuberculosis
IGYGMPGIRVD

SEQ ID NO: 30899 - protein, 11 aa, Mycobacterium tuberculosis
GYGMPGIRVDG

SEQ ID NO: 30900 - protein, 11 aa, Mycobacterium tuberculosis
YGMPGIRVDGN

SEQ ID NO: 30901 - protein, 11 aa, Mycobacterium tuberculosis
GMPGIRVDGND

SEQ ID NO: 30902 - protein, 11 aa, Mycobacterium tuberculosis
MPGIRVDGNDV

SEQ ID NO: 30903 - protein, 11 aa, Mycobacterium tuberculosis
PGIRVDGNDVL

SEQ ID NO: 30904 - protein, 11 aa, Mycobacterium tuberculosis
GIRVDGNDVLA

SEQ ID NO: 30905 - protein, 11 aa, Mycobacterium tuberculosis
IRVDGNDVLAC

SEQ ID NO: 30906 - protein, 11 aa, Mycobacterium tuberculosis
RVDGNDVLACY

SEQ ID NO: 30907 - protein, 11 aa, Mycobacterium tuberculosis
VDGNDVLACYA

SEQ ID NO: 30908 - protein, 11 aa, Mycobacterium tuberculosis
DGNDVLACYAV

SEQ ID NO: 30909 - protein, 11 aa, Mycobacterium tuberculosis
GNDVLACYAVM

SEQ ID NO: 30910 - protein, 11 aa, Mycobacterium tuberculosis
NDVLACYAVMA

SEQ ID NO: 30911 - protein, 11 aa, Mycobacterium tuberculosis
DVLACYAVMAE

SEQ ID NO: 30912 - protein, 11 aa, Mycobacterium tuberculosis
VLACYAVMAEA

SEQ ID NO: 30913 - protein, 11 aa, Mycobacterium tuberculosis
LACYAVMAEAA

SEQ ID NO: 30914 - protein, 11 aa, Mycobacterium tuberculosis
ACYAVMAEAAA

SEQ ID NO: 30915 - protein, 11 aa, Mycobacterium tuberculosis
CYAVMAEAAAR

SEQ ID NO: 30916 - protein, 11 aa, Mycobacterium tuberculosis
YAVMAEAAARA

SEQ ID NO: 30917 - protein, 11 aa, Mycobacterium tuberculosis
AVMAEAAARAR

SEQ ID NO: 30918 - protein, 11 aa, Mycobacterium tuberculosis
VMAEAAARARA

SEQ ID NO: 30919 - protein, 11 aa, Mycobacterium tuberculosis
MAEAAARARAG

SEQ ID NO: 30920 - protein, 11 aa, Mycobacterium tuberculosis
AEAAARARAGD

SEQ ID NO: 30921 - protein, 11 aa, Mycobacterium tuberculosis
EAAARARAGDG

SEQ ID NO: 30922 - protein, 11 aa, Mycobacterium tuberculosis
AAARARAGDGP

SEQ ID NO: 30923 - protein, 11 aa, Mycobacterium tuberculosis
AARARAGDGPT

SEQ ID NO: 30924 - protein, 11 aa, Mycobacterium tuberculosis
ARARAGDGPTL

SEQ ID NO: 30925 - protein, 11 aa, Mycobacterium tuberculosis
RARAGDGPTLI

SEQ ID NO: 30926 - protein, 11 aa, Mycobacterium tuberculosis
ARAGDGPTLIE

SEQ ID NO: 30927 - protein, 11 aa, Mycobacterium tuberculosis
RAGDGPTLIEA

SEQ ID NO: 30928 - protein, 11 aa, Mycobacterium tuberculosis
AGDGPTLIEAV

SEQ ID NO: 30929 - protein, 11 aa, Mycobacterium tuberculosis
GDGPTLIEAVT

SEQ ID NO: 30930 - protein, 11 aa, Mycobacterium tuberculosis
DGPTLIEAVTY

SEQ ID NO: 30931 - protein, 11 aa, Mycobacterium tuberculosis
GPTLIEAVTYR

SEQ ID NO: 30932 - protein, 11 aa, Mycobacterium tuberculosis
PTLIEAVTYRL

SEQ ID NO: 30933 - protein, 11 aa, Mycobacterium tuberculosis
TLIEAVTYRLG

SEQ ID NO: 30934 - protein, 11 aa, Mycobacterium tuberculosis
LIEAVTYRLGP

SEQ ID NO: 30935 - protein, 11 aa, Mycobacterium tuberculosis
IEAVTYRLGPH

SEQ ID NO: 30936 - protein, 11 aa, Mycobacterium tuberculosis
EAVTYRLGPHT

SEQ ID NO: 30937 - protein, 11 aa, Mycobacterium tuberculosis
AVTYRLGPHTT

SEQ ID NO: 30938 - protein, 11 aa, Mycobacterium tuberculosis
VTYRLGPHTTA

SEQ ID NO: 30939 - protein, 11 aa, Mycobacterium tuberculosis
TYRLGPHTTAD

SEQ ID NO: 30940 - protein, 11 aa, Mycobacterium tuberculosis
YRLGPHTTADD

SEQ ID NO: 30941 - protein, 11 aa, Mycobacterium tuberculosis
RLGPHTTADDP

SEQ ID NO: 30942 - protein, 11 aa, Mycobacterium tuberculosis
LGPHTTADDPT

SEQ ID NO: 30943 - protein, 11 aa, Mycobacterium tuberculosis
GPHTTADDPTR

SEQ ID NO: 30944 - protein, 11 aa, Mycobacterium tuberculosis
PHTTADDPTRY

SEQ ID NO: 30945 - protein, 11 aa, Mycobacterium tuberculosis
HTTADDPTRYR

SEQ ID NO: 30946 - protein, 11 aa, Mycobacterium tuberculosis
TTADDPTRYRS

SEQ ID NO: 30947 - protein, 11 aa, Mycobacterium tuberculosis
TADDPTRYRSQ

SEQ ID NO: 30948 - protein, 11 aa, Mycobacterium tuberculosis
ADDPTRYRSQE

SEQ ID NO: 30949 - protein, 11 aa, Mycobacterium tuberculosis
DDPTRYRSQEE

SEQ ID NO: 30950 - protein, 11 aa, Mycobacterium tuberculosis
DPTRYRSQEEV

SEQ ID NO: 30951 - protein, 11 aa, Mycobacterium tuberculosis
PTRYRSQEEVD

SEQ ID NO: 30952 - protein, 11 aa, Mycobacterium tuberculosis
TRYRSQEEVDR

SEQ ID NO: 30953 - protein, 11 aa, Mycobacterium tuberculosis
RYRSQEEVDRW

SEQ ID NO: 30954 - protein, 11 aa, Mycobacterium tuberculosis
YRSQEEVDRWA

SEQ ID NO: 30955 - protein, 11 aa, Mycobacterium tuberculosis
RSQEEVDRWAT

SEQ ID NO: 30956 - protein, 11 aa, Mycobacterium tuberculosis
SQEEVDRWATL

SEQ ID NO: 30957 - protein, 11 aa, Mycobacterium tuberculosis
QEEVDRWATLD

SEQ ID NO: 30958 - protein, 11 aa, Mycobacterium tuberculosis
EEVDRWATLDP

SEQ ID NO: 30959 - protein, 11 aa, Mycobacterium tuberculosis
EVDRWATLDPI

SEQ ID NO: 30960 - protein, 11 aa, Mycobacterium tuberculosis
VDRWATLDPIP

SEQ ID NO: 30961 - protein, 11 aa, Mycobacterium tuberculosis
DRWATLDPIPR

SEQ ID NO: 30962 - protein, 11 aa, Mycobacterium tuberculosis
RWATLDPIPRY

SEQ ID NO: 30963 - protein, 11 aa, Mycobacterium tuberculosis
WATLDPIPRYR

SEQ ID NO: 30964 - protein, 11 aa, Mycobacterium tuberculosis
ATLDPIPRYRT

SEQ ID NO: 30965 - protein, 11 aa, Mycobacterium tuberculosis
TLDPIPRYRTY

SEQ ID NO: 30966 - protein, 11 aa, Mycobacterium tuberculosis
LDPIPRYRTYL

SEQ ID NO: 30967 - protein, 11 aa, Mycobacterium tuberculosis
DPIPRYRTYLQ

SEQ ID NO: 30968 - protein, 11 aa, Mycobacterium tuberculosis
PIPRYRTYLQD

SEQ ID NO: 30969 - protein, 11 aa, Mycobacterium tuberculosis
IPRYRTYLQDQ

SEQ ID NO: 30970 - protein, 11 aa, Mycobacterium tuberculosis
PRYRTYLQDQG

SEQ ID NO: 30971 - protein, 11 aa, Mycobacterium tuberculosis
RYRTYLQDQGL

SEQ ID NO: 30972 - protein, 11 aa, Mycobacterium tuberculosis
YRTYLQDQGLW

SEQ ID NO: 30973 - protein, 11 aa, Mycobacterium tuberculosis
RTYLQDQGLWS

SEQ ID NO: 30974 - protein, 11 aa, Mycobacterium tuberculosis
TYLQDQGLWSQ

SEQ ID NO: 30975 - protein, 11 aa, Mycobacterium tuberculosis
YLQDQGLWSQR

SEQ ID NO: 30976 - protein, 11 aa, Mycobacterium tuberculosis
LQDQGLWSQRL

SEQ ID NO: 30977 - protein, 11 aa, Mycobacterium tuberculosis
QDQGLWSQRLE

SEQ ID NO: 30978 - protein, 11 aa, Mycobacterium tuberculosis
DQGLWSQRLEE

SEQ ID NO: 30979 - protein, 11 aa, Mycobacterium tuberculosis
QGLWSQRLEEQ

SEQ ID NO: 30980 - protein, 11 aa, Mycobacterium tuberculosis
GLWSQRLEEQV

SEQ ID NO: 30981 - protein, 11 aa, Mycobacterium tuberculosis
LWSQRLEEQVT

SEQ ID NO: 30982 - protein, 11 aa, Mycobacterium tuberculosis
WSQRLEEQVTA

SEQ ID NO: 30983 - protein, 11 aa, Mycobacterium tuberculosis
SQRLEEQVTAR

SEQ ID NO: 30984 - protein, 11 aa, Mycobacterium tuberculosis
QRLEEQVTARA

SEQ ID NO: 30985 - protein, 11 aa, Mycobacterium tuberculosis
RLEEQVTARAK

SEQ ID NO: 30986 - protein, 11 aa, Mycobacterium tuberculosis
LEEQVTARAKH

SEQ ID NO: 30987 - protein, 11 aa, Mycobacterium tuberculosis
EEQVTARAKHV

SEQ ID NO: 30988 - protein, 11 aa, Mycobacterium tuberculosis
EQVTARAKHVR

SEQ ID NO: 30989 - protein, 11 aa, Mycobacterium tuberculosis
QVTARAKHVRS

SEQ ID NO: 30990 - protein, 11 aa, Mycobacterium tuberculosis
VTARAKHVRSE

SEQ ID NO: 30991 - protein, 11 aa, Mycobacterium tuberculosis
TARAKHVRSEL

SEQ ID NO: 30992 - protein, 11 aa, Mycobacterium tuberculosis
ARAKHVRSELR

SEQ ID NO: 30993 - protein, 11 aa, Mycobacterium tuberculosis
RAKHVRSELRD

SEQ ID NO: 30994 - protein, 11 aa, Mycobacterium tuberculosis
AKHVRSELRDA

SEQ ID NO: 30995 - protein, 11 aa, Mycobacterium tuberculosis
KHVRSELRDAV

SEQ ID NO: 30996 - protein, 11 aa, Mycobacterium tuberculosis
HVRSELRDAVF

SEQ ID NO: 30997 - protein, 11 aa, Mycobacterium tuberculosis
VRSELRDAVFD

SEQ ID NO: 30998 - protein, 11 aa, Mycobacterium tuberculosis
RSELRDAVFDA

SEQ ID NO: 30999 - protein, 11 aa, Mycobacterium tuberculosis
SELRDAVFDAP

SEQ ID NO: 31000 - protein, 11 aa, Mycobacterium tuberculosis
ELRDAVFDAPD

SEQ ID NO: 31001 - protein, 11 aa, Mycobacterium tuberculosis
LRDAVFDAPDF

SEQ ID NO: 31002 - protein, 11 aa, Mycobacterium tuberculosis
RDAVFDAPDFD

SEQ ID NO: 31003 - protein, 11 aa, Mycobacterium tuberculosis
DAVFDAPDFDV

SEQ ID NO: 31004 - protein, 11 aa, Mycobacterium tuberculosis
AVFDAPDFDVD

SEQ ID NO: 31005 - protein, 11 aa, Mycobacterium tuberculosis
VFDAPDFDVDE

SEQ ID NO: 31006 - protein, 11 aa, Mycobacterium tuberculosis
FDAPDFDVDEV

SEQ ID NO: 31007 - protein, 11 aa, Mycobacterium tuberculosis
DAPDFDVDEVF

SEQ ID NO: 31008 - protein, 11 aa, Mycobacterium tuberculosis
APDFDVDEVFT

SEQ ID NO: 31009 - protein, 11 aa, Mycobacterium tuberculosis
PDFDVDEVFTT

SEQ ID NO: 31010 - protein, 11 aa, Mycobacterium tuberculosis
DFDVDEVFTTV

SEQ ID NO: 31011 - protein, 11 aa, Mycobacterium tuberculosis
FDVDEVFTTVY

SEQ ID NO: 31012 - protein, 11 aa, Mycobacterium tuberculosis
DVDEVFTTVYA

SEQ ID NO: 31013 - protein, 11 aa, Mycobacterium tuberculosis
VDEVFTTVYAE

SEQ ID NO: 31014 - protein, 11 aa, Mycobacterium tuberculosis
DEVFTTVYAEI

SEQ ID NO: 31015 - protein, 11 aa, Mycobacterium tuberculosis
EVFTTVYAEIT

SEQ ID NO: 31016 - protein, 11 aa, Mycobacterium tuberculosis
VFTTVYAEITP

SEQ ID NO: 31017 - protein, 11 aa, Mycobacterium tuberculosis
FTTVYAEITPG

SEQ ID NO: 31018 - protein, 11 aa, Mycobacterium tuberculosis
TTVYAEITPGL

SEQ ID NO: 31019 - protein, 11 aa, Mycobacterium tuberculosis
TVYAEITPGLQ

SEQ ID NO: 31020 - protein, 11 aa, Mycobacterium tuberculosis
VYAEITPGLQA

SEQ ID NO: 31021 - protein, 11 aa, Mycobacterium tuberculosis
YAEITPGLQAQ

SEQ ID NO: 31022 - protein, 11 aa, Mycobacterium tuberculosis
AEITPGLQAQR

SEQ ID NO: 31023 - protein, 11 aa, Mycobacterium tuberculosis
EITPGLQAQRE

SEQ ID NO: 31024 - protein, 11 aa, Mycobacterium tuberculosis
ITPGLQAQREQ

SEQ ID NO: 31025 - protein, 11 aa, Mycobacterium tuberculosis
TPGLQAQREQL

SEQ ID NO: 31026 - protein, 11 aa, Mycobacterium tuberculosis
PGLQAQREQLR

SEQ ID NO: 31027 - protein, 11 aa, Mycobacterium tuberculosis
GLQAQREQLRA

SEQ ID NO: 31028 - protein, 11 aa, Mycobacterium tuberculosis
LQAQREQLRAE

SEQ ID NO: 31029 - protein, 11 aa, Mycobacterium tuberculosis
QAQREQLRAEL

SEQ ID NO: 31030 - protein, 11 aa, Mycobacterium tuberculosis
AQREQLRAELA

SEQ ID NO: 31031 - protein, 11 aa, Mycobacterium tuberculosis
QREQLRAELAR

SEQ ID NO: 31032 - protein, 11 aa, Mycobacterium tuberculosis
REQLRAELART

SEQ ID NO: 31033 - protein, 11 aa, Mycobacterium tuberculosis
EQLRAELARTD

SEQ ID NO: 31034 - protein, 8 aa, Mycobacterium tuberculosis
MNSAIIKI

SEQ ID NO: 31035 - protein, 8 aa, Mycobacterium tuberculosis
NSAIIKIA

SEQ ID NO: 31036 - protein, 8 aa, Mycobacterium tuberculosis
SAIIKIAK

SEQ ID NO: 31037 - protein, 8 aa, Mycobacterium tuberculosis
AIIKIAKW

SEQ ID NO: 31038 - protein, 8 aa, Mycobacterium tuberculosis
IIKIAKWA

SEQ ID NO: 31039 - protein, 8 aa, Mycobacterium tuberculosis
IKIAKWAQ

SEQ ID NO: 31040 - protein, 8 aa, Mycobacterium tuberculosis
KIAKWAQS

SEQ ID NO: 31041 - protein, 8 aa, Mycobacterium tuberculosis
IAKWAQSQ

SEQ ID NO: 31042 - protein, 8 aa, Mycobacterium tuberculosis
AKWAQSQQ

SEQ ID NO: 31043 - protein, 8 aa, Mycobacterium tuberculosis
KWAQSQQW

SEQ ID NO: 31044 - protein, 8 aa, Mycobacterium tuberculosis
WAQSQQWT

SEQ ID NO: 31045 - protein, 8 aa, Mycobacterium tuberculosis
AQSQQWTV

SEQ ID NO: 31046 - protein, 8 aa, Mycobacterium tuberculosis
QSQQWTVE

SEQ ID NO: 31047 - protein, 8 aa, Mycobacterium tuberculosis
SQQWTVED

SEQ ID NO: 31048 - protein, 8 aa, Mycobacterium tuberculosis
QQWTVEDD

SEQ ID NO: 31049 - protein, 8 aa, Mycobacterium tuberculosis
QWTVEDDA

SEQ ID NO: 31050 - protein, 8 aa, Mycobacterium tuberculosis
WTVEDDAS

SEQ ID NO: 31051 - protein, 8 aa, Mycobacterium tuberculosis
TVEDDASG

SEQ ID NO: 31052 - protein, 8 aa, Mycobacterium tuberculosis
VEDDASGY

SEQ ID NO: 31053 - protein, 8 aa, Mycobacterium tuberculosis
EDDASGYT

SEQ ID NO: 31054 - protein, 8 aa, Mycobacterium tuberculosis
DDASGYTR

SEQ ID NO: 31055 - protein, 8 aa, Mycobacterium tuberculosis
DASGYTRF

SEQ ID NO: 31056 - protein, 8 aa, Mycobacterium tuberculosis
ASGYTRFY

SEQ ID NO: 31057 - protein, 8 aa, Mycobacterium tuberculosis
SGYTRFYN

SEQ ID NO: 31058 - protein, 8 aa, Mycobacterium tuberculosis
GYTRFYNP

SEQ ID NO: 31059 - protein, 8 aa, Mycobacterium tuberculosis
YTRFYNPQ

SEQ ID NO: 31060 - protein, 8 aa, Mycobacterium tuberculosis
TRFYNPQG

SEQ ID NO: 31061 - protein, 8 aa, Mycobacterium tuberculosis
RFYNPQGV

SEQ ID NO: 31062 - protein, 8 aa, Mycobacterium tuberculosis
FYNPQGVY

SEQ ID NO: 31063 - protein, 8 aa, Mycobacterium tuberculosis
YNPQGVYI

SEQ ID NO: 31064 - protein, 8 aa, Mycobacterium tuberculosis
NPQGVYIA

SEQ ID NO: 31065 - protein, 8 aa, Mycobacterium tuberculosis
PQGVYIAR

SEQ ID NO: 31066 - protein, 8 aa, Mycobacterium tuberculosis
QGVYIARF

SEQ ID NO: 31067 - protein, 8 aa, Mycobacterium tuberculosis
GVYIARFP

SEQ ID NO: 31068 - protein, 8 aa, Mycobacterium tuberculosis
VYIARFPA

SEQ ID NO: 31069 - protein, 8 aa, Mycobacterium tuberculosis
YIARFPAT

SEQ ID NO: 31070 - protein, 8 aa, Mycobacterium tuberculosis
IARFPATP

SEQ ID NO: 31071 - protein, 8 aa, Mycobacterium tuberculosis
ARFPATPS

SEQ ID NO: 31072 - protein, 8 aa, Mycobacterium tuberculosis
RFPATPSN

SEQ ID NO: 31073 - protein, 8 aa, Mycobacterium tuberculosis
FPATPSNE

SEQ ID NO: 31074 - protein, 8 aa, Mycobacterium tuberculosis
PATPSNEY

SEQ ID NO: 31075 - protein, 8 aa, Mycobacterium tuberculosis
ATPSNEYR

SEQ ID NO: 31076 - protein, 8 aa, Mycobacterium tuberculosis
TPSNEYRR

SEQ ID NO: 31077 - protein, 8 aa, Mycobacterium tuberculosis
PSNEYRRM

SEQ ID NO: 31078 - protein, 8 aa, Mycobacterium tuberculosis
SNEYRRMR

SEQ ID NO: 31079 - protein, 8 aa, Mycobacterium tuberculosis
NEYRRMRD

SEQ ID NO: 31080 - protein, 8 aa, Mycobacterium tuberculosis
EYRRMRDL

SEQ ID NO: 31081 - protein, 8 aa, Mycobacterium tuberculosis
YRRMRDLL

SEQ ID NO: 31082 - protein, 8 aa, Mycobacterium tuberculosis
RRMRDLLG

SEQ ID NO: 31083 - protein, 8 aa, Mycobacterium tuberculosis
RMRDLLGA

SEQ ID NO: 31084 - protein, 8 aa, Mycobacterium tuberculosis
MRDLLGAL

SEQ ID NO: 31085 - protein, 8 aa, Mycobacterium tuberculosis
RDLLGALK

SEQ ID NO: 31086 - protein, 8 aa, Mycobacterium tuberculosis
DLLGALKK

SEQ ID NO: 31087 - protein, 8 aa, Mycobacterium tuberculosis
LLGALKKA

SEQ ID NO: 31088 - protein, 8 aa, Mycobacterium tuberculosis
LGALKKAG

SEQ ID NO: 31089 - protein, 8 aa, Mycobacterium tuberculosis
GALKKAGL

SEQ ID NO: 31090 - protein, 8 aa, Mycobacterium tuberculosis
ALKKAGLT

SEQ ID NO: 31091 - protein, 8 aa, Mycobacterium tuberculosis
LKKAGLTW

SEQ ID NO: 31092 - protein, 8 aa, Mycobacterium tuberculosis
KKAGLTWP

SEQ ID NO: 31093 - protein, 8 aa, Mycobacterium tuberculosis
KAGLTWPP

SEQ ID NO: 31094 - protein, 8 aa, Mycobacterium tuberculosis
AGLTWPPP

SEQ ID NO: 31095 - protein, 8 aa, Mycobacterium tuberculosis
GLTWPPPS

SEQ ID NO: 31096 - protein, 8 aa, Mycobacterium tuberculosis
LTWPPPSK

SEQ ID NO: 31097 - protein, 8 aa, Mycobacterium tuberculosis
TWPPPSKK

SEQ ID NO: 31098 - protein, 8 aa, Mycobacterium tuberculosis
WPPPSKKE

SEQ ID NO: 31099 - protein, 8 aa, Mycobacterium tuberculosis
PPPSKKER

SEQ ID NO: 31100 - protein, 8 aa, Mycobacterium tuberculosis
PPSKKERR

SEQ ID NO: 31101 - protein, 8 aa, Mycobacterium tuberculosis
PSKKERRA

SEQ ID NO: 31102 - protein, 8 aa, Mycobacterium tuberculosis
SKKERRAQ

SEQ ID NO: 31103 - protein, 8 aa, Mycobacterium tuberculosis
KKERRAQH

SEQ ID NO: 31104 - protein, 8 aa, Mycobacterium tuberculosis
KERRAQHR

SEQ ID NO: 31105 - protein, 8 aa, Mycobacterium tuberculosis
ERRAQHRK

SEQ ID NO: 31106 - protein, 8 aa, Mycobacterium tuberculosis
RRAQHRKE

SEQ ID NO: 31107 - protein, 8 aa, Mycobacterium tuberculosis
RAQHRKEG

SEQ ID NO: 31108 - protein, 8 aa, Mycobacterium tuberculosis
AQHRKEGA

SEQ ID NO: 31109 - protein, 8 aa, Mycobacterium tuberculosis
QHRKEGAQ

SEQ ID NO: 31110 - protein, 9 aa, Mycobacterium tuberculosis
MNSAIIKIA

SEQ ID NO: 31111 - protein, 9 aa, Mycobacterium tuberculosis
NSAIIKIAK

SEQ ID NO: 31112 - protein, 9 aa, Mycobacterium tuberculosis
SAIIKIAKW

SEQ ID NO: 31113 - protein, 9 aa, Mycobacterium tuberculosis
AIIKIAKWA

SEQ ID NO: 31114 - protein, 9 aa, Mycobacterium tuberculosis
IIKIAKWAQ

SEQ ID NO: 31115 - protein, 9 aa, Mycobacterium tuberculosis
IKIAKWAQS

SEQ ID NO: 31116 - protein, 9 aa, Mycobacterium tuberculosis
KIAKWAQSQ

SEQ ID NO: 31117 - protein, 9 aa, Mycobacterium tuberculosis
IAKWAQSQQ

SEQ ID NO: 31118 - protein, 9 aa, Mycobacterium tuberculosis
AKWAQSQQW

SEQ ID NO: 31119 - protein, 9 aa, Mycobacterium tuberculosis
KWAQSQQWT

SEQ ID NO: 31120 - protein, 9 aa, Mycobacterium tuberculosis
WAQSQQWTV

SEQ ID NO: 31121 - protein, 9 aa, Mycobacterium tuberculosis
AQSQQWTVE

SEQ ID NO: 31122 - protein, 9 aa, Mycobacterium tuberculosis
QSQQWTVED

SEQ ID NO: 31123 - protein, 9 aa, Mycobacterium tuberculosis
SQQWTVEDD

SEQ ID NO: 31124 - protein, 9 aa, Mycobacterium tuberculosis
QQWTVEDDA

SEQ ID NO: 31125 - protein, 9 aa, Mycobacterium tuberculosis
QWTVEDDAS

SEQ ID NO: 31126 - protein, 9 aa, Mycobacterium tuberculosis
WTVEDDASG

SEQ ID NO: 31127 - protein, 9 aa, Mycobacterium tuberculosis
TVEDDASGY

SEQ ID NO: 31128 - protein, 9 aa, Mycobacterium tuberculosis
VEDDASGYT

SEQ ID NO: 31129 - protein, 9 aa, Mycobacterium tuberculosis
EDDASGYTR

SEQ ID NO: 31130 - protein, 9 aa, Mycobacterium tuberculosis
DDASGYTRF

SEQ ID NO: 31131 - protein, 9 aa, Mycobacterium tuberculosis
DASGYTRFY

SEQ ID NO: 31132 - protein, 9 aa, Mycobacterium tuberculosis
ASGYTRFYN

SEQ ID NO: 31133 - protein, 9 aa, Mycobacterium tuberculosis
SGYTRFYNP

SEQ ID NO: 31134 - protein, 9 aa, Mycobacterium tuberculosis
GYTRFYNPQ

SEQ ID NO: 31135 - protein, 9 aa, Mycobacterium tuberculosis
YTRFYNPQG

SEQ ID NO: 31136 - protein, 9 aa, Mycobacterium tuberculosis
TRFYNPQGV

SEQ ID NO: 31137 - protein, 9 aa, Mycobacterium tuberculosis
RFYNPQGVY

SEQ ID NO: 31138 - protein, 9 aa, Mycobacterium tuberculosis
FYNPQGVYI

SEQ ID NO: 31139 - protein, 9 aa, Mycobacterium tuberculosis
YNPQGVYIA

SEQ ID NO: 31140 - protein, 9 aa, Mycobacterium tuberculosis
NPQGVYIAR

SEQ ID NO: 31141 - protein, 9 aa, Mycobacterium tuberculosis
PQGVYIARF

SEQ ID NO: 31142 - protein, 9 aa, Mycobacterium tuberculosis
QGVYIARFP

SEQ ID NO: 31143 - protein, 9 aa, Mycobacterium tuberculosis
GVYIARFPA

SEQ ID NO: 31144 - protein, 9 aa, Mycobacterium tuberculosis
VYIARFPAT

SEQ ID NO: 31145 - protein, 9 aa, Mycobacterium tuberculosis
YIARFPATP

SEQ ID NO: 31146 - protein, 9 aa, Mycobacterium tuberculosis
IARFPATPS

SEQ ID NO: 31147 - protein, 9 aa, Mycobacterium tuberculosis
ARFPATPSN

SEQ ID NO: 31148 - protein, 9 aa, Mycobacterium tuberculosis
RFPATPSNE

SEQ ID NO: 31149 - protein, 9 aa, Mycobacterium tuberculosis
FPATPSNEY

SEQ ID NO: 31150 - protein, 9 aa, Mycobacterium tuberculosis
PATPSNEYR

SEQ ID NO: 31151 - protein, 9 aa, Mycobacterium tuberculosis
ATPSNEYRR

SEQ ID NO: 31152 - protein, 9 aa, Mycobacterium tuberculosis
TPSNEYRRM

SEQ ID NO: 31153 - protein, 9 aa, Mycobacterium tuberculosis
PSNEYRRMR

SEQ ID NO: 31154 - protein, 9 aa, Mycobacterium tuberculosis
SNEYRRMRD

SEQ ID NO: 31155 - protein, 9 aa, Mycobacterium tuberculosis
NEYRRMRDL

SEQ ID NO: 31156 - protein, 9 aa, Mycobacterium tuberculosis
EYRRMRDLL

SEQ ID NO: 31157 - protein, 9 aa, Mycobacterium tuberculosis
YRRMRDLLG

SEQ ID NO: 31158 - protein, 9 aa, Mycobacterium tuberculosis
RRMRDLLGA

SEQ ID NO: 31159 - protein, 9 aa, Mycobacterium tuberculosis
RMRDLLGAL

SEQ ID NO: 31160 - protein, 9 aa, Mycobacterium tuberculosis
MRDLLGALK

SEQ ID NO: 31161 - protein, 9 aa, Mycobacterium tuberculosis
RDLLGALKK

SEQ ID NO: 31162 - protein, 9 aa, Mycobacterium tuberculosis
DLLGALKKA

SEQ ID NO: 31163 - protein, 9 aa, Mycobacterium tuberculosis
LLGALKKAG

SEQ ID NO: 31164 - protein, 9 aa, Mycobacterium tuberculosis
LGALKKAGL

SEQ ID NO: 31165 - protein, 9 aa, Mycobacterium tuberculosis
GALKKAGLT

SEQ ID NO: 31166 - protein, 9 aa, Mycobacterium tuberculosis
ALKKAGLTW

SEQ ID NO: 31167 - protein, 9 aa, Mycobacterium tuberculosis
LKKAGLTWP

SEQ ID NO: 31168 - protein, 9 aa, Mycobacterium tuberculosis
KKAGLTWPP

SEQ ID NO: 31169 - protein, 9 aa, Mycobacterium tuberculosis
KAGLTWPPP

SEQ ID NO: 31170 - protein, 9 aa, Mycobacterium tuberculosis
AGLTWPPPS

SEQ ID NO: 31171 - protein, 9 aa, Mycobacterium tuberculosis
GLTWPPPSK

SEQ ID NO: 31172 - protein, 9 aa, Mycobacterium tuberculosis
LTWPPPSKK

SEQ ID NO: 31173 - protein, 9 aa, Mycobacterium tuberculosis
TWPPPSKKE

SEQ ID NO: 31174 - protein, 9 aa, Mycobacterium tuberculosis
WPPPSKKER

SEQ ID NO: 31175 - protein, 9 aa, Mycobacterium tuberculosis
PPPSKKERR

SEQ ID NO: 31176 - protein, 9 aa, Mycobacterium tuberculosis
PPSKKERRA

SEQ ID NO: 31177 - protein, 9 aa, Mycobacterium tuberculosis
PSKKERRAQ

SEQ ID NO: 31178 - protein, 9 aa, Mycobacterium tuberculosis
SKKERRAQH

SEQ ID NO: 31179 - protein, 9 aa, Mycobacterium tuberculosis
KKERRAQHR

SEQ ID NO: 31180 - protein, 9 aa, Mycobacterium tuberculosis
KERRAQHRK

SEQ ID NO: 31181 - protein, 9 aa, Mycobacterium tuberculosis
ERRAQHRKE

SEQ ID NO: 31182 - protein, 9 aa, Mycobacterium tuberculosis
RRAQHRKEG

SEQ ID NO: 31183 - protein, 9 aa, Mycobacterium tuberculosis
RAQHRKEGA

SEQ ID NO: 31184 - protein, 9 aa, Mycobacterium tuberculosis
AQHRKEGAQ

SEQ ID NO: 31185 - protein, 10 aa, Mycobacterium tuberculosis
MNSAIIKIAK

SEQ ID NO: 31186 - protein, 10 aa, Mycobacterium tuberculosis
NSAIIKIAKW

SEQ ID NO: 31187 - protein, 10 aa, Mycobacterium tuberculosis
SAIIKIAKWA

SEQ ID NO: 31188 - protein, 10 aa, Mycobacterium tuberculosis
AIIKIAKWAQ

SEQ ID NO: 31189 - protein, 10 aa, Mycobacterium tuberculosis
IIKIAKWAQS

SEQ ID NO: 31190 - protein, 10 aa, Mycobacterium tuberculosis
IKIAKWAQSQ

SEQ ID NO: 31191 - protein, 10 aa, Mycobacterium tuberculosis
KIAKWAQSQQ

SEQ ID NO: 31192 - protein, 10 aa, Mycobacterium tuberculosis
IAKWAQSQQW

SEQ ID NO: 31193 - protein, 10 aa, Mycobacterium tuberculosis
AKWAQSQQWT

SEQ ID NO: 31194 - protein, 10 aa, Mycobacterium tuberculosis
KWAQSQQWTV

SEQ ID NO: 31195 - protein, 10 aa, Mycobacterium tuberculosis
WAQSQQWTVE

SEQ ID NO: 31196 - protein, 10 aa, Mycobacterium tuberculosis
AQSQQWTVED

SEQ ID NO: 31197 - protein, 10 aa, Mycobacterium tuberculosis
QSQQWTVEDD

SEQ ID NO: 31198 - protein, 10 aa, Mycobacterium tuberculosis
SQQWTVEDDA

SEQ ID NO: 31199 - protein, 10 aa, Mycobacterium tuberculosis
QQWTVEDDAS

SEQ ID NO: 31200 - protein, 10 aa, Mycobacterium tuberculosis
QWTVEDDASG

SEQ ID NO: 31201 - protein, 10 aa, Mycobacterium tuberculosis
WTVEDDASGY

SEQ ID NO: 31202 - protein, 10 aa, Mycobacterium tuberculosis
TVEDDASGYT

SEQ ID NO: 31203 - protein, 10 aa, Mycobacterium tuberculosis
VEDDASGYTR

SEQ ID NO: 31204 - protein, 10 aa, Mycobacterium tuberculosis
EDDASGYTRF

SEQ ID NO: 31205 - protein, 10 aa, Mycobacterium tuberculosis
DDASGYTRFY

SEQ ID NO: 31206 - protein, 10 aa, Mycobacterium tuberculosis
DASGYTRFYN

SEQ ID NO: 31207 - protein, 10 aa, Mycobacterium tuberculosis
ASGYTRFYNP

SEQ ID NO: 31208 - protein, 10 aa, Mycobacterium tuberculosis
SGYTRFYNPQ

SEQ ID NO: 31209 - protein, 10 aa, Mycobacterium tuberculosis
GYTRFYNPQG

SEQ ID NO: 31210 - protein, 10 aa, Mycobacterium tuberculosis
YTRFYNPQGV

SEQ ID NO: 31211 - protein, 10 aa, Mycobacterium tuberculosis
TRFYNPQGVY

SEQ ID NO: 31212 - protein, 10 aa, Mycobacterium tuberculosis
RFYNPQGVYI

SEQ ID NO: 31213 - protein, 10 aa, Mycobacterium tuberculosis
FYNPQGVYIA

SEQ ID NO: 31214 - protein, 10 aa, Mycobacterium tuberculosis
YNPQGVYIAR

SEQ ID NO: 31215 - protein, 10 aa, Mycobacterium tuberculosis
NPQGVYIARF

SEQ ID NO: 31216 - protein, 10 aa, Mycobacterium tuberculosis
PQGVYIARFP

SEQ ID NO: 31217 - protein, 10 aa, Mycobacterium tuberculosis
QGVYIARFPA

SEQ ID NO: 31218 - protein, 10 aa, Mycobacterium tuberculosis
GVYIARFPAT

SEQ ID NO: 31219 - protein, 10 aa, Mycobacterium tuberculosis
VYIARFPATP

SEQ ID NO: 31220 - protein, 10 aa, Mycobacterium tuberculosis
YIARFPATPS

SEQ ID NO: 31221 - protein, 10 aa, Mycobacterium tuberculosis
IARFPATPSN

SEQ ID NO: 31222 - protein, 10 aa, Mycobacterium tuberculosis
ARFPATPSNE

SEQ ID NO: 31223 - protein, 10 aa, Mycobacterium tuberculosis
RFPATPSNEY

SEQ ID NO: 31224 - protein, 10 aa, Mycobacterium tuberculosis
FPATPSNEYR

SEQ ID NO: 31225 - protein, 10 aa, Mycobacterium tuberculosis
PATPSNEYRR

SEQ ID NO: 31226 - protein, 10 aa, Mycobacterium tuberculosis
ATPSNEYRRM

SEQ ID NO: 31227 - protein, 10 aa, Mycobacterium tuberculosis
TPSNEYRRMR

SEQ ID NO: 31228 - protein, 10 aa, Mycobacterium tuberculosis
PSNEYRRMRD

SEQ ID NO: 31229 - protein, 10 aa, Mycobacterium tuberculosis
SNEYRRMRDL

SEQ ID NO: 31230 - protein, 10 aa, Mycobacterium tuberculosis
NEYRRMRDLL

SEQ ID NO: 31231 - protein, 10 aa, Mycobacterium tuberculosis
EYRRMRDLLG

SEQ ID NO: 31232 - protein, 10 aa, Mycobacterium tuberculosis
YRRMRDLLGA

SEQ ID NO: 31233 - protein, 10 aa, Mycobacterium tuberculosis
RRMRDLLGAL

SEQ ID NO: 31234 - protein, 10 aa, Mycobacterium tuberculosis
RMRDLLGALK

SEQ ID NO: 31235 - protein, 10 aa, Mycobacterium tuberculosis
MRDLLGALKK

SEQ ID NO: 31236 - protein, 10 aa, Mycobacterium tuberculosis
RDLLGALKKA

SEQ ID NO: 31237 - protein, 10 aa, Mycobacterium tuberculosis
DLLGALKKAG

SEQ ID NO: 31238 - protein, 10 aa, Mycobacterium tuberculosis
LLGALKKAGL

SEQ ID NO: 31239 - protein, 10 aa, Mycobacterium tuberculosis
LGALKKAGLT

SEQ ID NO: 31240 - protein, 10 aa, Mycobacterium tuberculosis
GALKKAGLTW

SEQ ID NO: 31241 - protein, 10 aa, Mycobacterium tuberculosis
ALKKAGLTWP

SEQ ID NO: 31242 - protein, 10 aa, Mycobacterium tuberculosis
LKKAGLTWPP

SEQ ID NO: 31243 - protein, 10 aa, Mycobacterium tuberculosis
KKAGLTWPPP

SEQ ID NO: 31244 - protein, 10 aa, Mycobacterium tuberculosis
KAGLTWPPPS

SEQ ID NO: 31245 - protein, 10 aa, Mycobacterium tuberculosis
AGLTWPPPSK

SEQ ID NO: 31246 - protein, 10 aa, Mycobacterium tuberculosis
GLTWPPPSKK

SEQ ID NO: 31247 - protein, 10 aa, Mycobacterium tuberculosis
LTWPPPSKKE

SEQ ID NO: 31248 - protein, 10 aa, Mycobacterium tuberculosis
TWPPPSKKER

SEQ ID NO: 31249 - protein, 10 aa, Mycobacterium tuberculosis
WPPPSKKERR

SEQ ID NO: 31250 - protein, 10 aa, Mycobacterium tuberculosis
PPPSKKERRA

SEQ ID NO: 31251 - protein, 10 aa, Mycobacterium tuberculosis
PPSKKERRAQ

SEQ ID NO: 31252 - protein, 10 aa, Mycobacterium tuberculosis
PSKKERRAQH

SEQ ID NO: 31253 - protein, 10 aa, Mycobacterium tuberculosis
SKKERRAQHR

SEQ ID NO: 31254 - protein, 10 aa, Mycobacterium tuberculosis
KKERRAQHRK

SEQ ID NO: 31255 - protein, 10 aa, Mycobacterium tuberculosis
KERRAQHRKE

SEQ ID NO: 31256 - protein, 10 aa, Mycobacterium tuberculosis
ERRAQHRKEG

SEQ ID NO: 31257 - protein, 10 aa, Mycobacterium tuberculosis
RRAQHRKEGA

SEQ ID NO: 31258 - protein, 10 aa, Mycobacterium tuberculosis
RAQHRKEGAQ

SEQ ID NO: 31259 - protein, 11 aa, Mycobacterium tuberculosis
MNSAIIKIAKW

SEQ ID NO: 31260 - protein, 11 aa, Mycobacterium tuberculosis
NSAIIKIAKWA

SEQ ID NO: 31261 - protein, 11 aa, Mycobacterium tuberculosis
SAIIKIAKWAQ

SEQ ID NO: 31262 - protein, 11 aa, Mycobacterium tuberculosis
AIIKIAKWAQS

SEQ ID NO: 31263 - protein, 11 aa, Mycobacterium tuberculosis
IIKIAKWAQSQ

SEQ ID NO: 31264 - protein, 11 aa, Mycobacterium tuberculosis
IKIAKWAQSQQ

SEQ ID NO: 31265 - protein, 11 aa, Mycobacterium tuberculosis
KIAKWAQSQQW

SEQ ID NO: 31266 - protein, 11 aa, Mycobacterium tuberculosis
IAKWAQSQQWT

SEQ ID NO: 31267 - protein, 11 aa, Mycobacterium tuberculosis
AKWAQSQQWTV

SEQ ID NO: 31268 - protein, 11 aa, Mycobacterium tuberculosis
KWAQSQQWTVE

SEQ ID NO: 31269 - protein, 11 aa, Mycobacterium tuberculosis
WAQSQQWTVED

SEQ ID NO: 31270 - protein, 11 aa, Mycobacterium tuberculosis
AQSQQWTVEDD

SEQ ID NO: 31271 - protein, 11 aa, Mycobacterium tuberculosis
QSQQWTVEDDA

SEQ ID NO: 31272 - protein, 11 aa, Mycobacterium tuberculosis
SQQWTVEDDAS

SEQ ID NO: 31273 - protein, 11 aa, Mycobacterium tuberculosis
QQWTVEDDASG

SEQ ID NO: 31274 - protein, 11 aa, Mycobacterium tuberculosis
QWTVEDDASGY

SEQ ID NO: 31275 - protein, 11 aa, Mycobacterium tuberculosis
WTVEDDASGYT

SEQ ID NO: 31276 - protein, 11 aa, Mycobacterium tuberculosis
TVEDDASGYTR

SEQ ID NO: 31277 - protein, 11 aa, Mycobacterium tuberculosis
VEDDASGYTRF

SEQ ID NO: 31278 - protein, 11 aa, Mycobacterium tuberculosis
EDDASGYTRFY

SEQ ID NO: 31279 - protein, 11 aa, Mycobacterium tuberculosis
DDASGYTRFYN

SEQ ID NO: 31280 - protein, 11 aa, Mycobacterium tuberculosis
DASGYTRFYNP

SEQ ID NO: 31281 - protein, 11 aa, Mycobacterium tuberculosis
ASGYTRFYNPQ

SEQ ID NO: 31282 - protein, 11 aa, Mycobacterium tuberculosis
SGYTRFYNPQG

SEQ ID NO: 31283 - protein, 11 aa, Mycobacterium tuberculosis
GYTRFYNPQGV

SEQ ID NO: 31284 - protein, 11 aa, Mycobacterium tuberculosis
YTRFYNPQGVY

SEQ ID NO: 31285 - protein, 11 aa, Mycobacterium tuberculosis
TRFYNPQGVYI

SEQ ID NO: 31286 - protein, 11 aa, Mycobacterium tuberculosis
RFYNPQGVYIA

SEQ ID NO: 31287 - protein, 11 aa, Mycobacterium tuberculosis
FYNPQGVYIAR

SEQ ID NO: 31288 - protein, 11 aa, Mycobacterium tuberculosis
YNPQGVYIARF

SEQ ID NO: 31289 - protein, 11 aa, Mycobacterium tuberculosis
NPQGVYIARFP

SEQ ID NO: 31290 - protein, 11 aa, Mycobacterium tuberculosis
PQGVYIARFPA

SEQ ID NO: 31291 - protein, 11 aa, Mycobacterium tuberculosis
QGVYIARFPAT

SEQ ID NO: 31292 - protein, 11 aa, Mycobacterium tuberculosis
GVYIARFPATP

SEQ ID NO: 31293 - protein, 11 aa, Mycobacterium tuberculosis
VYIARFPATPS

SEQ ID NO: 31294 - protein, 11 aa, Mycobacterium tuberculosis
YIARFPATPSN

SEQ ID NO: 31295 - protein, 11 aa, Mycobacterium tuberculosis
IARFPATPSNE

SEQ ID NO: 31296 - protein, 11 aa, Mycobacterium tuberculosis
ARFPATPSNEY

SEQ ID NO: 31297 - protein, 11 aa, Mycobacterium tuberculosis
RFPATPSNEYR

SEQ ID NO: 31298 - protein, 11 aa, Mycobacterium tuberculosis
FPATPSNEYRR

SEQ ID NO: 31299 - protein, 11 aa, Mycobacterium tuberculosis
PATPSNEYRRM

SEQ ID NO: 31300 - protein, 11 aa, Mycobacterium tuberculosis
ATPSNEYRRMR

SEQ ID NO: 31301 - protein, 11 aa, Mycobacterium tuberculosis
TPSNEYRRMRD

SEQ ID NO: 31302 - protein, 11 aa, Mycobacterium tuberculosis
PSNEYRRMRDL

SEQ ID NO: 31303 - protein, 11 aa, Mycobacterium tuberculosis
SNEYRRMRDLL

SEQ ID NO: 31304 - protein, 11 aa, Mycobacterium tuberculosis
NEYRRMRDLLG

SEQ ID NO: 31305 - protein, 11 aa, Mycobacterium tuberculosis
EYRRMRDLLGA

SEQ ID NO: 31306 - protein, 11 aa, Mycobacterium tuberculosis
YRRMRDLLGAL

SEQ ID NO: 31307 - protein, 11 aa, Mycobacterium tuberculosis
RRMRDLLGALK

SEQ ID NO: 31308 - protein, 11 aa, Mycobacterium tuberculosis
RMRDLLGALKK

SEQ ID NO: 31309 - protein, 11 aa, Mycobacterium tuberculosis
MRDLLGALKKA

SEQ ID NO: 31310 - protein, 11 aa, Mycobacterium tuberculosis
RDLLGALKKAG

SEQ ID NO: 31311 - protein, 11 aa, Mycobacterium tuberculosis
DLLGALKKAGL

SEQ ID NO: 31312 - protein, 11 aa, Mycobacterium tuberculosis
LLGALKKAGLT

SEQ ID NO: 31313 - protein, 11 aa, Mycobacterium tuberculosis
LGALKKAGLTW

SEQ ID NO: 31314 - protein, 11 aa, Mycobacterium tuberculosis
GALKKAGLTWP

SEQ ID NO: 31315 - protein, 11 aa, Mycobacterium tuberculosis
ALKKAGLTWPP

SEQ ID NO: 31316 - protein, 11 aa, Mycobacterium tuberculosis
LKKAGLTWPPP

SEQ ID NO: 31317 - protein, 11 aa, Mycobacterium tuberculosis
KKAGLTWPPPS

SEQ ID NO: 31318 - protein, 11 aa, Mycobacterium tuberculosis
KAGLTWPPPSK

SEQ ID NO: 31319 - protein, 11 aa, Mycobacterium tuberculosis
AGLTWPPPSKK

SEQ ID NO: 31320 - protein, 11 aa, Mycobacterium tuberculosis
GLTWPPPSKKE

SEQ ID NO: 31321 - protein, 11 aa, Mycobacterium tuberculosis
LTWPPPSKKER

SEQ ID NO: 31322 - protein, 11 aa, Mycobacterium tuberculosis
TWPPPSKKERR

SEQ ID NO: 31323 - protein, 11 aa, Mycobacterium tuberculosis
WPPPSKKERRA

SEQ ID NO: 31324 - protein, 11 aa, Mycobacterium tuberculosis
PPPSKKERRAQ

SEQ ID NO: 31325 - protein, 11 aa, Mycobacterium tuberculosis
PPSKKERRAQH

SEQ ID NO: 31326 - protein, 11 aa, Mycobacterium tuberculosis
PSKKERRAQHR

SEQ ID NO: 31327 - protein, 11 aa, Mycobacterium tuberculosis
SKKERRAQHRK

SEQ ID NO: 31328 - protein, 11 aa, Mycobacterium tuberculosis
KKERRAQHRKE

SEQ ID NO: 31329 - protein, 11 aa, Mycobacterium tuberculosis
KERRAQHRKEG

SEQ ID NO: 31330 - protein, 11 aa, Mycobacterium tuberculosis
ERRAQHRKEGA

SEQ ID NO: 31331 - protein, 11 aa, Mycobacterium tuberculosis
RRAQHRKEGAQ

SEQ ID NO: 31332 - protein, 8 aa, Mycobacterium tuberculosis
MTVKRTTI

SEQ ID NO: 31333 - protein, 8 aa, Mycobacterium tuberculosis
TVKRTTIE

SEQ ID NO: 31334 - protein, 8 aa, Mycobacterium tuberculosis
VKRTTIEL

SEQ ID NO: 31335 - protein, 8 aa, Mycobacterium tuberculosis
KRTTIELD

SEQ ID NO: 31336 - protein, 8 aa, Mycobacterium tuberculosis
RTTIELDE

SEQ ID NO: 31337 - protein, 8 aa, Mycobacterium tuberculosis
TTIELDED

SEQ ID NO: 31338 - protein, 8 aa, Mycobacterium tuberculosis
TIELDEDL

SEQ ID NO: 31339 - protein, 8 aa, Mycobacterium tuberculosis
IELDEDLV

SEQ ID NO: 31340 - protein, 8 aa, Mycobacterium tuberculosis
ELDEDLVR

SEQ ID NO: 31341 - protein, 8 aa, Mycobacterium tuberculosis
LDEDLVRA

SEQ ID NO: 31342 - protein, 8 aa, Mycobacterium tuberculosis
DEDLVRAA

SEQ ID NO: 31343 - protein, 8 aa, Mycobacterium tuberculosis
EDLVRAAQ

SEQ ID NO: 31344 - protein, 8 aa, Mycobacterium tuberculosis
DLVRAAQA

SEQ ID NO: 31345 - protein, 8 aa, Mycobacterium tuberculosis
LVRAAQAV

SEQ ID NO: 31346 - protein, 8 aa, Mycobacterium tuberculosis
VRAAQAVT

SEQ ID NO: 31347 - protein, 8 aa, Mycobacterium tuberculosis
RAAQAVTG

SEQ ID NO: 31348 - protein, 8 aa, Mycobacterium tuberculosis
AAQAVTGE

SEQ ID NO: 31349 - protein, 8 aa, Mycobacterium tuberculosis
AQAVTGET

SEQ ID NO: 31350 - protein, 8 aa, Mycobacterium tuberculosis
QAVTGETL

SEQ ID NO: 31351 - protein, 8 aa, Mycobacterium tuberculosis
AVTGETLR

SEQ ID NO: 31352 - protein, 8 aa, Mycobacterium tuberculosis
VTGETLRA

SEQ ID NO: 31353 - protein, 8 aa, Mycobacterium tuberculosis
TGETLRAT

SEQ ID NO: 31354 - protein, 8 aa, Mycobacterium tuberculosis
GETLRATV

SEQ ID NO: 31355 - protein, 8 aa, Mycobacterium tuberculosis
ETLRATVE

SEQ ID NO: 31356 - protein, 8 aa, Mycobacterium tuberculosis
TLRATVER

SEQ ID NO: 31357 - protein, 8 aa, Mycobacterium tuberculosis
LRATVERA

SEQ ID NO: 31358 - protein, 8 aa, Mycobacterium tuberculosis
RATVERAL

SEQ ID NO: 31359 - protein, 8 aa, Mycobacterium tuberculosis
ATVERALQ

SEQ ID NO: 31360 - protein, 8 aa, Mycobacterium tuberculosis
TVERALQQ

SEQ ID NO: 31361 - protein, 8 aa, Mycobacterium tuberculosis
VERALQQL

SEQ ID NO: 31362 - protein, 8 aa, Mycobacterium tuberculosis
ERALQQLV

SEQ ID NO: 31363 - protein, 8 aa, Mycobacterium tuberculosis
RALQQLVA

SEQ ID NO: 31364 - protein, 8 aa, Mycobacterium tuberculosis
ALQQLVAA

SEQ ID NO: 31365 - protein, 8 aa, Mycobacterium tuberculosis
LQQLVAAA

SEQ ID NO: 31366 - protein, 8 aa, Mycobacterium tuberculosis
QQLVAAAA

SEQ ID NO: 31367 - protein, 8 aa, Mycobacterium tuberculosis
QLVAAAAE

SEQ ID NO: 31368 - protein, 8 aa, Mycobacterium tuberculosis
LVAAAAEQ

SEQ ID NO: 31369 - protein, 8 aa, Mycobacterium tuberculosis
VAAAAEQA

SEQ ID NO: 31370 - protein, 8 aa, Mycobacterium tuberculosis
AAAAEQAA

SEQ ID NO: 31371 - protein, 8 aa, Mycobacterium tuberculosis
AAAEQAAA

SEQ ID NO: 31372 - protein, 8 aa, Mycobacterium tuberculosis
AAEQAAAR

SEQ ID NO: 31373 - protein, 8 aa, Mycobacterium tuberculosis
AEQAAARR

SEQ ID NO: 31374 - protein, 8 aa, Mycobacterium tuberculosis
EQAAARRR

SEQ ID NO: 31375 - protein, 8 aa, Mycobacterium tuberculosis
QAAARRRR

SEQ ID NO: 31376 - protein, 8 aa, Mycobacterium tuberculosis
AAARRRRI

SEQ ID NO: 31377 - protein, 8 aa, Mycobacterium tuberculosis
AARRRRIV

SEQ ID NO: 31378 - protein, 8 aa, Mycobacterium tuberculosis
ARRRRIVD

SEQ ID NO: 31379 - protein, 8 aa, Mycobacterium tuberculosis
RRRRIVDH

SEQ ID NO: 31380 - protein, 8 aa, Mycobacterium tuberculosis
RRRIVDHL

SEQ ID NO: 31381 - protein, 8 aa, Mycobacterium tuberculosis
RRIVDHLA

SEQ ID NO: 31382 - protein, 8 aa, Mycobacterium tuberculosis
RIVDHLAH

SEQ ID NO: 31383 - protein, 8 aa, Mycobacterium tuberculosis
IVDHLAHA

SEQ ID NO: 31384 - protein, 8 aa, Mycobacterium tuberculosis
VDHLAHAG

SEQ ID NO: 31385 - protein, 8 aa, Mycobacterium tuberculosis
DHLAHAGT

SEQ ID NO: 31386 - protein, 8 aa, Mycobacterium tuberculosis
HLAHAGTH

SEQ ID NO: 31387 - protein, 8 aa, Mycobacterium tuberculosis
LAHAGTHV

SEQ ID NO: 31388 - protein, 8 aa, Mycobacterium tuberculosis
AHAGTHVD

SEQ ID NO: 31389 - protein, 8 aa, Mycobacterium tuberculosis
HAGTHVDA

SEQ ID NO: 31390 - protein, 8 aa, Mycobacterium tuberculosis
AGTHVDAD

SEQ ID NO: 31391 - protein, 8 aa, Mycobacterium tuberculosis
GTHVDADV

SEQ ID NO: 31392 - protein, 8 aa, Mycobacterium tuberculosis
THVDADVL

SEQ ID NO: 31393 - protein, 8 aa, Mycobacterium tuberculosis
HVDADVLL

SEQ ID NO: 31394 - protein, 8 aa, Mycobacterium tuberculosis
VDADVLLS

SEQ ID NO: 31395 - protein, 8 aa, Mycobacterium tuberculosis
DADVLLSE

SEQ ID NO: 31396 - protein, 8 aa, Mycobacterium tuberculosis
ADVLLSEQ

SEQ ID NO: 31397 - protein, 8 aa, Mycobacterium tuberculosis
DVLLSEQA

SEQ ID NO: 31398 - protein, 8 aa, Mycobacterium tuberculosis
VLLSEQAW

SEQ ID NO: 31399 - protein, 8 aa, Mycobacterium tuberculosis
LLSEQAWR

SEQ ID NO: 31400 - protein, 9 aa, Mycobacterium tuberculosis
MTVKRTTIE

SEQ ID NO: 31401 - protein, 9 aa, Mycobacterium tuberculosis
TVKRTTIEL

SEQ ID NO: 31402 - protein, 9 aa, Mycobacterium tuberculosis
VKRTTIELD

SEQ ID NO: 31403 - protein, 9 aa, Mycobacterium tuberculosis
KRTTIELDE

SEQ ID NO: 31404 - protein, 9 aa, Mycobacterium tuberculosis
RTTIELDED

SEQ ID NO: 31405 - protein, 9 aa, Mycobacterium tuberculosis
TTIELDEDL

SEQ ID NO: 31406 - protein, 9 aa, Mycobacterium tuberculosis
TIELDEDLV

SEQ ID NO: 31407 - protein, 9 aa, Mycobacterium tuberculosis
IELDEDLVR

SEQ ID NO: 31408 - protein, 9 aa, Mycobacterium tuberculosis
ELDEDLVRA

SEQ ID NO: 31409 - protein, 9 aa, Mycobacterium tuberculosis
LDEDLVRAA

SEQ ID NO: 31410 - protein, 9 aa, Mycobacterium tuberculosis
DEDLVRAAQ

SEQ ID NO: 31411 - protein, 9 aa, Mycobacterium tuberculosis
EDLVRAAQA

SEQ ID NO: 31412 - protein, 9 aa, Mycobacterium tuberculosis
DLVRAAQAV

SEQ ID NO: 31413 - protein, 9 aa, Mycobacterium tuberculosis
LVRAAQAVT

SEQ ID NO: 31414 - protein, 9 aa, Mycobacterium tuberculosis
VRAAQAVTG

SEQ ID NO: 31415 - protein, 9 aa, Mycobacterium tuberculosis
RAAQAVTGE

SEQ ID NO: 31416 - protein, 9 aa, Mycobacterium tuberculosis
AAQAVTGET

SEQ ID NO: 31417 - protein, 9 aa, Mycobacterium tuberculosis
AQAVTGETL

SEQ ID NO: 31418 - protein, 9 aa, Mycobacterium tuberculosis
QAVTGETLR

SEQ ID NO: 31419 - protein, 9 aa, Mycobacterium tuberculosis
AVTGETLRA

SEQ ID NO: 31420 - protein, 9 aa, Mycobacterium tuberculosis
VTGETLRAT

SEQ ID NO: 31421 - protein, 9 aa, Mycobacterium tuberculosis
TGETLRATV

SEQ ID NO: 31422 - protein, 9 aa, Mycobacterium tuberculosis
GETLRATVE

SEQ ID NO: 31423 - protein, 9 aa, Mycobacterium tuberculosis
ETLRATVER

SEQ ID NO: 31424 - protein, 9 aa, Mycobacterium tuberculosis
TLRATVERA

SEQ ID NO: 31425 - protein, 9 aa, Mycobacterium tuberculosis
LRATVERAL

SEQ ID NO: 31426 - protein, 9 aa, Mycobacterium tuberculosis
RATVERALQ

SEQ ID NO: 31427 - protein, 9 aa, Mycobacterium tuberculosis
ATVERALQQ

SEQ ID NO: 31428 - protein, 9 aa, Mycobacterium tuberculosis
TVERALQQL

SEQ ID NO: 31429 - protein, 9 aa, Mycobacterium tuberculosis
VERALQQLV

SEQ ID NO: 31430 - protein, 9 aa, Mycobacterium tuberculosis
ERALQQLVA

SEQ ID NO: 31431 - protein, 9 aa, Mycobacterium tuberculosis
RALQQLVAA

SEQ ID NO: 31432 - protein, 9 aa, Mycobacterium tuberculosis
ALQQLVAAA

SEQ ID NO: 31433 - protein, 9 aa, Mycobacterium tuberculosis
LQQLVAAAA

SEQ ID NO: 31434 - protein, 9 aa, Mycobacterium tuberculosis
QQLVAAAAE

SEQ ID NO: 31435 - protein, 9 aa, Mycobacterium tuberculosis
QLVAAAAEQ

SEQ ID NO: 31436 - protein, 9 aa, Mycobacterium tuberculosis
LVAAAAEQA

SEQ ID NO: 31437 - protein, 9 aa, Mycobacterium tuberculosis
VAAAAEQAA

SEQ ID NO: 31438 - protein, 9 aa, Mycobacterium tuberculosis
AAAAEQAAA

SEQ ID NO: 31439 - protein, 9 aa, Mycobacterium tuberculosis
AAAEQAAAR

SEQ ID NO: 31440 - protein, 9 aa, Mycobacterium tuberculosis
AAEQAAARR

SEQ ID NO: 31441 - protein, 9 aa, Mycobacterium tuberculosis
AEQAAARRR

SEQ ID NO: 31442 - protein, 9 aa, Mycobacterium tuberculosis
EQAAARRRR

SEQ ID NO: 31443 - protein, 9 aa, Mycobacterium tuberculosis
QAAARRRRI

SEQ ID NO: 31444 - protein, 9 aa, Mycobacterium tuberculosis
AAARRRRIV

SEQ ID NO: 31445 - protein, 9 aa, Mycobacterium tuberculosis
AARRRRIVD

SEQ ID NO: 31446 - protein, 9 aa, Mycobacterium tuberculosis
ARRRRIVDH

SEQ ID NO: 31447 - protein, 9 aa, Mycobacterium tuberculosis
RRRRIVDHL

SEQ ID NO: 31448 - protein, 9 aa, Mycobacterium tuberculosis
RRRIVDHLA

SEQ ID NO: 31449 - protein, 9 aa, Mycobacterium tuberculosis
RRIVDHLAH

SEQ ID NO: 31450 - protein, 9 aa, Mycobacterium tuberculosis
RIVDHLAHA

SEQ ID NO: 31451 - protein, 9 aa, Mycobacterium tuberculosis
IVDHLAHAG

SEQ ID NO: 31452 - protein, 9 aa, Mycobacterium tuberculosis
VDHLAHAGT

SEQ ID NO: 31453 - protein, 9 aa, Mycobacterium tuberculosis
DHLAHAGTH

SEQ ID NO: 31454 - protein, 9 aa, Mycobacterium tuberculosis
HLAHAGTHV

SEQ ID NO: 31455 - protein, 9 aa, Mycobacterium tuberculosis
LAHAGTHVD

SEQ ID NO: 31456 - protein, 9 aa, Mycobacterium tuberculosis
AHAGTHVDA

SEQ ID NO: 31457 - protein, 9 aa, Mycobacterium tuberculosis
HAGTHVDAD

SEQ ID NO: 31458 - protein, 9 aa, Mycobacterium tuberculosis
AGTHVDADV

SEQ ID NO: 31459 - protein, 9 aa, Mycobacterium tuberculosis
GTHVDADVL

SEQ ID NO: 31460 - protein, 9 aa, Mycobacterium tuberculosis
THVDADVLL

SEQ ID NO: 31461 - protein, 9 aa, Mycobacterium tuberculosis
HVDADVLLS

SEQ ID NO: 31462 - protein, 9 aa, Mycobacterium tuberculosis
VDADVLLSE

SEQ ID NO: 31463 - protein, 9 aa, Mycobacterium tuberculosis
DADVLLSEQ

SEQ ID NO: 31464 - protein, 9 aa, Mycobacterium tuberculosis
ADVLLSEQA

SEQ ID NO: 31465 - protein, 9 aa, Mycobacterium tuberculosis
DVLLSEQAW

SEQ ID NO: 31466 - protein, 9 aa, Mycobacterium tuberculosis
VLLSEQAWR

SEQ ID NO: 31467 - protein, 10 aa, Mycobacterium tuberculosis
MTVKRTTIEL

SEQ ID NO: 31468 - protein, 10 aa, Mycobacterium tuberculosis
TVKRTTIELD

SEQ ID NO: 31469 - protein, 10 aa, Mycobacterium tuberculosis
VKRTTIELDE

SEQ ID NO: 31470 - protein, 10 aa, Mycobacterium tuberculosis
KRTTIELDED

SEQ ID NO: 31471 - protein, 10 aa, Mycobacterium tuberculosis
RTTIELDEDL

SEQ ID NO: 31472 - protein, 10 aa, Mycobacterium tuberculosis
TTIELDEDLV

SEQ ID NO: 31473 - protein, 10 aa, Mycobacterium tuberculosis
TIELDEDLVR

SEQ ID NO: 31474 - protein, 10 aa, Mycobacterium tuberculosis
IELDEDLVRA

SEQ ID NO: 31475 - protein, 10 aa, Mycobacterium tuberculosis
ELDEDLVRAA

SEQ ID NO: 31476 - protein, 10 aa, Mycobacterium tuberculosis
LDEDLVRAAQ

SEQ ID NO: 31477 - protein, 10 aa, Mycobacterium tuberculosis
DEDLVRAAQA

SEQ ID NO: 31478 - protein, 10 aa, Mycobacterium tuberculosis
EDLVRAAQAV

SEQ ID NO: 31479 - protein, 10 aa, Mycobacterium tuberculosis
DLVRAAQAVT

SEQ ID NO: 31480 - protein, 10 aa, Mycobacterium tuberculosis
LVRAAQAVTG

SEQ ID NO: 31481 - protein, 10 aa, Mycobacterium tuberculosis
VRAAQAVTGE

SEQ ID NO: 31482 - protein, 10 aa, Mycobacterium tuberculosis
RAAQAVTGET

SEQ ID NO: 31483 - protein, 10 aa, Mycobacterium tuberculosis
AAQAVTGETL

SEQ ID NO: 31484 - protein, 10 aa, Mycobacterium tuberculosis
AQAVTGETLR

SEQ ID NO: 31485 - protein, 10 aa, Mycobacterium tuberculosis
QAVTGETLRA

SEQ ID NO: 31486 - protein, 10 aa, Mycobacterium tuberculosis
AVTGETLRAT

SEQ ID NO: 31487 - protein, 10 aa, Mycobacterium tuberculosis
VTGETLRATV

SEQ ID NO: 31488 - protein, 10 aa, Mycobacterium tuberculosis
TGETLRATVE

SEQ ID NO: 31489 - protein, 10 aa, Mycobacterium tuberculosis
GETLRATVER

SEQ ID NO: 31490 - protein, 10 aa, Mycobacterium tuberculosis
ETLRATVERA

SEQ ID NO: 31491 - protein, 10 aa, Mycobacterium tuberculosis
TLRATVERAL

SEQ ID NO: 31492 - protein, 10 aa, Mycobacterium tuberculosis
LRATVERALQ

SEQ ID NO: 31493 - protein, 10 aa, Mycobacterium tuberculosis
RATVERALQQ

SEQ ID NO: 31494 - protein, 10 aa, Mycobacterium tuberculosis
ATVERALQQL

SEQ ID NO: 31495 - protein, 10 aa, Mycobacterium tuberculosis
TVERALQQLV

SEQ ID NO: 31496 - protein, 10 aa, Mycobacterium tuberculosis
VERALQQLVA

SEQ ID NO: 31497 - protein, 10 aa, Mycobacterium tuberculosis
ERALQQLVAA

SEQ ID NO: 31498 - protein, 10 aa, Mycobacterium tuberculosis
RALQQLVAAA

SEQ ID NO: 31499 - protein, 10 aa, Mycobacterium tuberculosis
ALQQLVAAAA

SEQ ID NO: 31500 - protein, 10 aa, Mycobacterium tuberculosis
LQQLVAAAAE

SEQ ID NO: 31501 - protein, 10 aa, Mycobacterium tuberculosis
QQLVAAAAEQ

SEQ ID NO: 31502 - protein, 10 aa, Mycobacterium tuberculosis
QLVAAAAEQA

SEQ ID NO: 31503 - protein, 10 aa, Mycobacterium tuberculosis
LVAAAAEQAA

SEQ ID NO: 31504 - protein, 10 aa, Mycobacterium tuberculosis
VAAAAEQAAA

SEQ ID NO: 31505 - protein, 10 aa, Mycobacterium tuberculosis
AAAAEQAAAR

SEQ ID NO: 31506 - protein, 10 aa, Mycobacterium tuberculosis
AAAEQAAARR

SEQ ID NO: 31507 - protein, 10 aa, Mycobacterium tuberculosis
AAEQAAARRR

SEQ ID NO: 31508 - protein, 10 aa, Mycobacterium tuberculosis
AEQAAARRRR

SEQ ID NO: 31509 - protein, 10 aa, Mycobacterium tuberculosis
EQAAARRRRI

SEQ ID NO: 31510 - protein, 10 aa, Mycobacterium tuberculosis
QAAARRRRIV

SEQ ID NO: 31511 - protein, 10 aa, Mycobacterium tuberculosis
AAARRRRIVD

SEQ ID NO: 31512 - protein, 10 aa, Mycobacterium tuberculosis
AARRRRIVDH

SEQ ID NO: 31513 - protein, 10 aa, Mycobacterium tuberculosis
ARRRRIVDHL

SEQ ID NO: 31514 - protein, 10 aa, Mycobacterium tuberculosis
RRRRIVDHLA

SEQ ID NO: 31515 - protein, 10 aa, Mycobacterium tuberculosis
RRRIVDHLAH

SEQ ID NO: 31516 - protein, 10 aa, Mycobacterium tuberculosis
RRIVDHLAHA

SEQ ID NO: 31517 - protein, 10 aa, Mycobacterium tuberculosis
RIVDHLAHAG

SEQ ID NO: 31518 - protein, 10 aa, Mycobacterium tuberculosis
IVDHLAHAGT

SEQ ID NO: 31519 - protein, 10 aa, Mycobacterium tuberculosis
VDHLAHAGTH

SEQ ID NO: 31520 - protein, 10 aa, Mycobacterium tuberculosis
DHLAHAGTHV

SEQ ID NO: 31521 - protein, 10 aa, Mycobacterium tuberculosis
HLAHAGTHVD

SEQ ID NO: 31522 - protein, 10 aa, Mycobacterium tuberculosis
LAHAGTHVDA

SEQ ID NO: 31523 - protein, 10 aa, Mycobacterium tuberculosis
AHAGTHVDAD

SEQ ID NO: 31524 - protein, 10 aa, Mycobacterium tuberculosis
HAGTHVDADV

SEQ ID NO: 31525 - protein, 10 aa, Mycobacterium tuberculosis
AGTHVDADVL

SEQ ID NO: 31526 - protein, 10 aa, Mycobacterium tuberculosis
GTHVDADVLL

SEQ ID NO: 31527 - protein, 10 aa, Mycobacterium tuberculosis
THVDADVLLS

SEQ ID NO: 31528 - protein, 10 aa, Mycobacterium tuberculosis
HVDADVLLSE

SEQ ID NO: 31529 - protein, 10 aa, Mycobacterium tuberculosis
VDADVLLSEQ

SEQ ID NO: 31530 - protein, 10 aa, Mycobacterium tuberculosis
DADVLLSEQA

SEQ ID NO: 31531 - protein, 10 aa, Mycobacterium tuberculosis
ADVLLSEQAW

SEQ ID NO: 31532 - protein, 10 aa, Mycobacterium tuberculosis
DVLLSEQAWR

SEQ ID NO: 31533 - protein, 11 aa, Mycobacterium tuberculosis
MTVKRTTIELD

SEQ ID NO: 31534 - protein, 11 aa, Mycobacterium tuberculosis
TVKRTTIELDE

SEQ ID NO: 31535 - protein, 11 aa, Mycobacterium tuberculosis
VKRTTIELDED

SEQ ID NO: 31536 - protein, 11 aa, Mycobacterium tuberculosis
KRTTIELDEDL

SEQ ID NO: 31537 - protein, 11 aa, Mycobacterium tuberculosis
RTTIELDEDLV

SEQ ID NO: 31538 - protein, 11 aa, Mycobacterium tuberculosis
TTIELDEDLVR

SEQ ID NO: 31539 - protein, 11 aa, Mycobacterium tuberculosis
TIELDEDLVRA

SEQ ID NO: 31540 - protein, 11 aa, Mycobacterium tuberculosis
IELDEDLVRAA

SEQ ID NO: 31541 - protein, 11 aa, Mycobacterium tuberculosis
ELDEDLVRAAQ

SEQ ID NO: 31542 - protein, 11 aa, Mycobacterium tuberculosis
LDEDLVRAAQA

SEQ ID NO: 31543 - protein, 11 aa, Mycobacterium tuberculosis
DEDLVRAAQAV

SEQ ID NO: 31544 - protein, 11 aa, Mycobacterium tuberculosis
EDLVRAAQAVT

SEQ ID NO: 31545 - protein, 11 aa, Mycobacterium tuberculosis
DLVRAAQAVTG

SEQ ID NO: 31546 - protein, 11 aa, Mycobacterium tuberculosis
LVRAAQAVTGE

SEQ ID NO: 31547 - protein, 11 aa, Mycobacterium tuberculosis
VRAAQAVTGET

SEQ ID NO: 31548 - protein, 11 aa, Mycobacterium tuberculosis
RAAQAVTGETL

SEQ ID NO: 31549 - protein, 11 aa, Mycobacterium tuberculosis
AAQAVTGETLR

SEQ ID NO: 31550 - protein, 11 aa, Mycobacterium tuberculosis
AQAVTGETLRA

SEQ ID NO: 31551 - protein, 11 aa, Mycobacterium tuberculosis
QAVTGETLRAT

SEQ ID NO: 31552 - protein, 11 aa, Mycobacterium tuberculosis
AVTGETLRATV

SEQ ID NO: 31553 - protein, 11 aa, Mycobacterium tuberculosis
VTGETLRATVE

SEQ ID NO: 31554 - protein, 11 aa, Mycobacterium tuberculosis
TGETLRATVER

SEQ ID NO: 31555 - protein, 11 aa, Mycobacterium tuberculosis
GETLRATVERA

SEQ ID NO: 31556 - protein, 11 aa, Mycobacterium tuberculosis
ETLRATVERAL

SEQ ID NO: 31557 - protein, 11 aa, Mycobacterium tuberculosis
TLRATVERALQ

SEQ ID NO: 31558 - protein, 11 aa, Mycobacterium tuberculosis
LRATVERALQQ

SEQ ID NO: 31559 - protein, 11 aa, Mycobacterium tuberculosis
RATVERALQQL

SEQ ID NO: 31560 - protein, 11 aa, Mycobacterium tuberculosis
ATVERALQQLV

SEQ ID NO: 31561 - protein, 11 aa, Mycobacterium tuberculosis
TVERALQQLVA

SEQ ID NO: 31562 - protein, 11 aa, Mycobacterium tuberculosis
VERALQQLVAA

SEQ ID NO: 31563 - protein, 11 aa, Mycobacterium tuberculosis
ERALQQLVAAA

SEQ ID NO: 31564 - protein, 11 aa, Mycobacterium tuberculosis
RALQQLVAAAA

SEQ ID NO: 31565 - protein, 11 aa, Mycobacterium tuberculosis
ALQQLVAAAAE

SEQ ID NO: 31566 - protein, 11 aa, Mycobacterium tuberculosis
LQQLVAAAAEQ

SEQ ID NO: 31567 - protein, 11 aa, Mycobacterium tuberculosis
QQLVAAAAEQA

SEQ ID NO: 31568 - protein, 11 aa, Mycobacterium tuberculosis
QLVAAAAEQAA

SEQ ID NO: 31569 - protein, 11 aa, Mycobacterium tuberculosis
LVAAAAEQAAA

SEQ ID NO: 31570 - protein, 11 aa, Mycobacterium tuberculosis
VAAAAEQAAAR

SEQ ID NO: 31571 - protein, 11 aa, Mycobacterium tuberculosis
AAAAEQAAARR

SEQ ID NO: 31572 - protein, 11 aa, Mycobacterium tuberculosis
AAAEQAAARRR

SEQ ID NO: 31573 - protein, 11 aa, Mycobacterium tuberculosis
AAEQAAARRRR

SEQ ID NO: 31574 - protein, 11 aa, Mycobacterium tuberculosis
AEQAAARRRRI

SEQ ID NO: 31575 - protein, 11 aa, Mycobacterium tuberculosis
EQAAARRRRIV

SEQ ID NO: 31576 - protein, 11 aa, Mycobacterium tuberculosis
QAAARRRRIVD

SEQ ID NO: 31577 - protein, 11 aa, Mycobacterium tuberculosis
AAARRRRIVDH

SEQ ID NO: 31578 - protein, 11 aa, Mycobacterium tuberculosis
AARRRRIVDHL

SEQ ID NO: 31579 - protein, 11 aa, Mycobacterium tuberculosis
ARRRRIVDHLA

SEQ ID NO: 31580 - protein, 11 aa, Mycobacterium tuberculosis
RRRRIVDHLAH

SEQ ID NO: 31581 - protein, 11 aa, Mycobacterium tuberculosis
RRRIVDHLAHA

SEQ ID NO: 31582 - protein, 11 aa, Mycobacterium tuberculosis
RRIVDHLAHAG

SEQ ID NO: 31583 - protein, 11 aa, Mycobacterium tuberculosis
RIVDHLAHAGT

SEQ ID NO: 31584 - protein, 11 aa, Mycobacterium tuberculosis
IVDHLAHAGTH

SEQ ID NO: 31585 - protein, 11 aa, Mycobacterium tuberculosis
VDHLAHAGTHV

SEQ ID NO: 31586 - protein, 11 aa, Mycobacterium tuberculosis
DHLAHAGTHVD

SEQ ID NO: 31587 - protein, 11 aa, Mycobacterium tuberculosis
HLAHAGTHVDA

SEQ ID NO: 31588 - protein, 11 aa, Mycobacterium tuberculosis
LAHAGTHVDAD

SEQ ID NO: 31589 - protein, 11 aa, Mycobacterium tuberculosis
AHAGTHVDADV

SEQ ID NO: 31590 - protein, 11 aa, Mycobacterium tuberculosis
HAGTHVDADVL

SEQ ID NO: 31591 - protein, 11 aa, Mycobacterium tuberculosis
AGTHVDADVLL

SEQ ID NO: 31592 - protein, 11 aa, Mycobacterium tuberculosis
GTHVDADVLLS

SEQ ID NO: 31593 - protein, 11 aa, Mycobacterium tuberculosis
THVDADVLLSE

SEQ ID NO: 31594 - protein, 11 aa, Mycobacterium tuberculosis
HVDADVLLSEQ

SEQ ID NO: 31595 - protein, 11 aa, Mycobacterium tuberculosis
VDADVLLSEQA

SEQ ID NO: 31596 - protein, 11 aa, Mycobacterium tuberculosis
DADVLLSEQAW

SEQ ID NO: 31597 - protein, 11 aa, Mycobacterium tuberculosis
ADVLLSEQAWR

SEQ ID NO: 31598 - protein, 8 aa, Mycobacterium tuberculosis
MTGGATGA

SEQ ID NO: 31599 - protein, 8 aa, Mycobacterium tuberculosis
TGGATGAL

SEQ ID NO: 31600 - protein, 8 aa, Mycobacterium tuberculosis
GGATGALP

SEQ ID NO: 31601 - protein, 8 aa, Mycobacterium tuberculosis
GATGALPR

SEQ ID NO: 31602 - protein, 8 aa, Mycobacterium tuberculosis
ATGALPRT

SEQ ID NO: 31603 - protein, 8 aa, Mycobacterium tuberculosis
TGALPRTM

SEQ ID NO: 31604 - protein, 8 aa, Mycobacterium tuberculosis
GALPRTMK

SEQ ID NO: 31605 - protein, 8 aa, Mycobacterium tuberculosis
ALPRTMKE

SEQ ID NO: 31606 - protein, 8 aa, Mycobacterium tuberculosis
LPRTMKEG

SEQ ID NO: 31607 - protein, 8 aa, Mycobacterium tuberculosis
PRTMKEGW

SEQ ID NO: 31608 - protein, 8 aa, Mycobacterium tuberculosis
RTMKEGWI

SEQ ID NO: 31609 - protein, 8 aa, Mycobacterium tuberculosis
TMKEGWIV

SEQ ID NO: 31610 - protein, 8 aa, Mycobacterium tuberculosis
MKEGWIVY

SEQ ID NO: 31611 - protein, 8 aa, Mycobacterium tuberculosis
KEGWIVYA

SEQ ID NO: 31612 - protein, 8 aa, Mycobacterium tuberculosis
EGWIVYAR

SEQ ID NO: 31613 - protein, 8 aa, Mycobacterium tuberculosis
GWIVYARS

SEQ ID NO: 31614 - protein, 8 aa, Mycobacterium tuberculosis
WIVYARST

SEQ ID NO: 31615 - protein, 8 aa, Mycobacterium tuberculosis
IVYARSTT

SEQ ID NO: 31616 - protein, 8 aa, Mycobacterium tuberculosis
VYARSTTI

SEQ ID NO: 31617 - protein, 8 aa, Mycobacterium tuberculosis
YARSTTIQ

SEQ ID NO: 31618 - protein, 8 aa, Mycobacterium tuberculosis
ARSTTIQA

SEQ ID NO: 31619 - protein, 8 aa, Mycobacterium tuberculosis
RSTTIQAQ

SEQ ID NO: 31620 - protein, 8 aa, Mycobacterium tuberculosis
STTIQAQS

SEQ ID NO: 31621 - protein, 8 aa, Mycobacterium tuberculosis
TTIQAQSE

SEQ ID NO: 31622 - protein, 8 aa, Mycobacterium tuberculosis
TIQAQSEC

SEQ ID NO: 31623 - protein, 8 aa, Mycobacterium tuberculosis
IQAQSECI

SEQ ID NO: 31624 - protein, 8 aa, Mycobacterium tuberculosis
QAQSECID

SEQ ID NO: 31625 - protein, 8 aa, Mycobacterium tuberculosis
AQSECIDT

SEQ ID NO: 31626 - protein, 8 aa, Mycobacterium tuberculosis
QSECIDTG

SEQ ID NO: 31627 - protein, 8 aa, Mycobacterium tuberculosis
SECIDTGI

SEQ ID NO: 31628 - protein, 8 aa, Mycobacterium tuberculosis
ECIDTGIA

SEQ ID NO: 31629 - protein, 8 aa, Mycobacterium tuberculosis
CIDTGIAH

SEQ ID NO: 31630 - protein, 8 aa, Mycobacterium tuberculosis
IDTGIAHV

SEQ ID NO: 31631 - protein, 8 aa, Mycobacterium tuberculosis
DTGIAHVR

SEQ ID NO: 31632 - protein, 8 aa, Mycobacterium tuberculosis
TGIAHVRD

SEQ ID NO: 31633 - protein, 8 aa, Mycobacterium tuberculosis
GIAHVRDV

SEQ ID NO: 31634 - protein, 8 aa, Mycobacterium tuberculosis
IAHVRDVV

SEQ ID NO: 31635 - protein, 8 aa, Mycobacterium tuberculosis
AHVRDVVM

SEQ ID NO: 31636 - protein, 8 aa, Mycobacterium tuberculosis
HVRDVVMP

SEQ ID NO: 31637 - protein, 8 aa, Mycobacterium tuberculosis
VRDVVMPA

SEQ ID NO: 31638 - protein, 8 aa, Mycobacterium tuberculosis
RDVVMPAL

SEQ ID NO: 31639 - protein, 8 aa, Mycobacterium tuberculosis
DVVMPALQ

SEQ ID NO: 31640 - protein, 8 aa, Mycobacterium tuberculosis
VVMPALQG

SEQ ID NO: 31641 - protein, 8 aa, Mycobacterium tuberculosis
VMPALQGM

SEQ ID NO: 31642 - protein, 8 aa, Mycobacterium tuberculosis
MPALQGMD

SEQ ID NO: 31643 - protein, 8 aa, Mycobacterium tuberculosis
PALQGMDG

SEQ ID NO: 31644 - protein, 8 aa, Mycobacterium tuberculosis
ALQGMDGC

SEQ ID NO: 31645 - protein, 8 aa, Mycobacterium tuberculosis
LQGMDGCI

SEQ ID NO: 31646 - protein, 8 aa, Mycobacterium tuberculosis
QGMDGCIG

SEQ ID NO: 31647 - protein, 8 aa, Mycobacterium tuberculosis
GMDGCIGV

SEQ ID NO: 31648 - protein, 8 aa, Mycobacterium tuberculosis
MDGCIGVS

SEQ ID NO: 31649 - protein, 8 aa, Mycobacterium tuberculosis
DGCIGVSL

SEQ ID NO: 31650 - protein, 8 aa, Mycobacterium tuberculosis
GCIGVSLL

SEQ ID NO: 31651 - protein, 8 aa, Mycobacterium tuberculosis
CIGVSLLV

SEQ ID NO: 31652 - protein, 8 aa, Mycobacterium tuberculosis
IGVSLLVD

SEQ ID NO: 31653 - protein, 8 aa, Mycobacterium tuberculosis
GVSLLVDR

SEQ ID NO: 31654 - protein, 8 aa, Mycobacterium tuberculosis
VSLLVDRQ

SEQ ID NO: 31655 - protein, 8 aa, Mycobacterium tuberculosis
SLLVDRQS

SEQ ID NO: 31656 - protein, 8 aa, Mycobacterium tuberculosis
LLVDRQSG

SEQ ID NO: 31657 - protein, 8 aa, Mycobacterium tuberculosis
LVDRQSGR

SEQ ID NO: 31658 - protein, 8 aa, Mycobacterium tuberculosis
VDRQSGRC

SEQ ID NO: 31659 - protein, 8 aa, Mycobacterium tuberculosis
DRQSGRCI

SEQ ID NO: 31660 - protein, 8 aa, Mycobacterium tuberculosis
RQSGRCIA

SEQ ID NO: 31661 - protein, 8 aa, Mycobacterium tuberculosis
QSGRCIAT

SEQ ID NO: 31662 - protein, 8 aa, Mycobacterium tuberculosis
SGRCIATS

SEQ ID NO: 31663 - protein, 8 aa, Mycobacterium tuberculosis
GRCIATSA

SEQ ID NO: 31664 - protein, 8 aa, Mycobacterium tuberculosis
RCIATSAW

SEQ ID NO: 31665 - protein, 8 aa, Mycobacterium tuberculosis
CIATSAWE

SEQ ID NO: 31666 - protein, 8 aa, Mycobacterium tuberculosis
IATSAWET

SEQ ID NO: 31667 - protein, 8 aa, Mycobacterium tuberculosis
ATSAWETA

SEQ ID NO: 31668 - protein, 8 aa, Mycobacterium tuberculosis
TSAWETAE

SEQ ID NO: 31669 - protein, 8 aa, Mycobacterium tuberculosis
SAWETAEA

SEQ ID NO: 31670 - protein, 8 aa, Mycobacterium tuberculosis
AWETAEAM

SEQ ID NO: 31671 - protein, 8 aa, Mycobacterium tuberculosis
WETAEAMH

SEQ ID NO: 31672 - protein, 8 aa, Mycobacterium tuberculosis
ETAEAMHA

SEQ ID NO: 31673 - protein, 8 aa, Mycobacterium tuberculosis
TAEAMHAS

SEQ ID NO: 31674 - protein, 8 aa, Mycobacterium tuberculosis
AEAMHASR

SEQ ID NO: 31675 - protein, 8 aa, Mycobacterium tuberculosis
EAMHASRE

SEQ ID NO: 31676 - protein, 8 aa, Mycobacterium tuberculosis
AMHASREQ

SEQ ID NO: 31677 - protein, 8 aa, Mycobacterium tuberculosis
MHASREQV

SEQ ID NO: 31678 - protein, 8 aa, Mycobacterium tuberculosis
HASREQVT

SEQ ID NO: 31679 - protein, 8 aa, Mycobacterium tuberculosis
ASREQVTP

SEQ ID NO: 31680 - protein, 8 aa, Mycobacterium tuberculosis
SREQVTPI

SEQ ID NO: 31681 - protein, 8 aa, Mycobacterium tuberculosis
REQVTPIR

SEQ ID NO: 31682 - protein, 8 aa, Mycobacterium tuberculosis
EQVTPIRD

SEQ ID NO: 31683 - protein, 8 aa, Mycobacterium tuberculosis
QVTPIRDR

SEQ ID NO: 31684 - protein, 8 aa, Mycobacterium tuberculosis
VTPIRDRC

SEQ ID NO: 31685 - protein, 8 aa, Mycobacterium tuberculosis
TPIRDRCA

SEQ ID NO: 31686 - protein, 8 aa, Mycobacterium tuberculosis
PIRDRCAE

SEQ ID NO: 31687 - protein, 8 aa, Mycobacterium tuberculosis
IRDRCAEM

SEQ ID NO: 31688 - protein, 8 aa, Mycobacterium tuberculosis
RDRCAEMF

SEQ ID NO: 31689 - protein, 8 aa, Mycobacterium tuberculosis
DRCAEMFG

SEQ ID NO: 31690 - protein, 8 aa, Mycobacterium tuberculosis
RCAEMFGG

SEQ ID NO: 31691 - protein, 8 aa, Mycobacterium tuberculosis
CAEMFGGT

SEQ ID NO: 31692 - protein, 8 aa, Mycobacterium tuberculosis
AEMFGGTP

SEQ ID NO: 31693 - protein, 8 aa, Mycobacterium tuberculosis
EMFGGTPA

SEQ ID NO: 31694 - protein, 8 aa, Mycobacterium tuberculosis
MFGGTPAV

SEQ ID NO: 31695 - protein, 8 aa, Mycobacterium tuberculosis
FGGTPAVE

SEQ ID NO: 31696 - protein, 8 aa, Mycobacterium tuberculosis
GGTPAVEE

SEQ ID NO: 31697 - protein, 8 aa, Mycobacterium tuberculosis
GTPAVEEW

SEQ ID NO: 31698 - protein, 8 aa, Mycobacterium tuberculosis
TPAVEEWE

SEQ ID NO: 31699 - protein, 8 aa, Mycobacterium tuberculosis
PAVEEWEI

SEQ ID NO: 31700 - protein, 8 aa, Mycobacterium tuberculosis
AVEEWEIA

SEQ ID NO: 31701 - protein, 8 aa, Mycobacterium tuberculosis
VEEWEIAA

SEQ ID NO: 31702 - protein, 8 aa, Mycobacterium tuberculosis
EEWEIAAM

SEQ ID NO: 31703 - protein, 8 aa, Mycobacterium tuberculosis
EWEIAAMH

SEQ ID NO: 31704 - protein, 8 aa, Mycobacterium tuberculosis
WEIAAMHR

SEQ ID NO: 31705 - protein, 8 aa, Mycobacterium tuberculosis
EIAAMHRD

SEQ ID NO: 31706 - protein, 8 aa, Mycobacterium tuberculosis
IAAMHRDH

SEQ ID NO: 31707 - protein, 8 aa, Mycobacterium tuberculosis
AAMHRDHR

SEQ ID NO: 31708 - protein, 8 aa, Mycobacterium tuberculosis
AMHRDHRS

SEQ ID NO: 31709 - protein, 8 aa, Mycobacterium tuberculosis
MHRDHRSA

SEQ ID NO: 31710 - protein, 8 aa, Mycobacterium tuberculosis
HRDHRSAE

SEQ ID NO: 31711 - protein, 8 aa, Mycobacterium tuberculosis
RDHRSAEG

SEQ ID NO: 31712 - protein, 8 aa, Mycobacterium tuberculosis
DHRSAEGA

SEQ ID NO: 31713 - protein, 8 aa, Mycobacterium tuberculosis
HRSAEGAC

SEQ ID NO: 31714 - protein, 8 aa, Mycobacterium tuberculosis
RSAEGACV

SEQ ID NO: 31715 - protein, 8 aa, Mycobacterium tuberculosis
SAEGACVR

SEQ ID NO: 31716 - protein, 8 aa, Mycobacterium tuberculosis
AEGACVRA

SEQ ID NO: 31717 - protein, 8 aa, Mycobacterium tuberculosis
EGACVRAT

SEQ ID NO: 31718 - protein, 8 aa, Mycobacterium tuberculosis
GACVRATW

SEQ ID NO: 31719 - protein, 8 aa, Mycobacterium tuberculosis
ACVRATWV

SEQ ID NO: 31720 - protein, 8 aa, Mycobacterium tuberculosis
CVRATWVK

SEQ ID NO: 31721 - protein, 8 aa, Mycobacterium tuberculosis
VRATWVKV

SEQ ID NO: 31722 - protein, 8 aa, Mycobacterium tuberculosis
RATWVKVP

SEQ ID NO: 31723 - protein, 8 aa, Mycobacterium tuberculosis
ATWVKVPA

SEQ ID NO: 31724 - protein, 8 aa, Mycobacterium tuberculosis
TWVKVPAD

SEQ ID NO: 31725 - protein, 8 aa, Mycobacterium tuberculosis
WVKVPADQ

SEQ ID NO: 31726 - protein, 8 aa, Mycobacterium tuberculosis
VKVPADQV

SEQ ID NO: 31727 - protein, 8 aa, Mycobacterium tuberculosis
KVPADQVD

SEQ ID NO: 31728 - protein, 8 aa, Mycobacterium tuberculosis
VPADQVDQ

SEQ ID NO: 31729 - protein, 8 aa, Mycobacterium tuberculosis
PADQVDQG

SEQ ID NO: 31730 - protein, 8 aa, Mycobacterium tuberculosis
ADQVDQGI

SEQ ID NO: 31731 - protein, 8 aa, Mycobacterium tuberculosis
DQVDQGIE

SEQ ID NO: 31732 - protein, 8 aa, Mycobacterium tuberculosis
QVDQGIEY

SEQ ID NO: 31733 - protein, 8 aa, Mycobacterium tuberculosis
VDQGIEYY

SEQ ID NO: 31734 - protein, 8 aa, Mycobacterium tuberculosis
DQGIEYYK

SEQ ID NO: 31735 - protein, 8 aa, Mycobacterium tuberculosis
QGIEYYKS

SEQ ID NO: 31736 - protein, 8 aa, Mycobacterium tuberculosis
GIEYYKSS

SEQ ID NO: 31737 - protein, 8 aa, Mycobacterium tuberculosis
IEYYKSSV

SEQ ID NO: 31738 - protein, 8 aa, Mycobacterium tuberculosis
EYYKSSVL

SEQ ID NO: 31739 - protein, 8 aa, Mycobacterium tuberculosis
YYKSSVLP

SEQ ID NO: 31740 - protein, 8 aa, Mycobacterium tuberculosis
YKSSVLPQ

SEQ ID NO: 31741 - protein, 8 aa, Mycobacterium tuberculosis
KSSVLPQI

SEQ ID NO: 31742 - protein, 8 aa, Mycobacterium tuberculosis
SSVLPQIE

SEQ ID NO: 31743 - protein, 8 aa, Mycobacterium tuberculosis
SVLPQIEG

SEQ ID NO: 31744 - protein, 8 aa, Mycobacterium tuberculosis
VLPQIEGL

SEQ ID NO: 31745 - protein, 8 aa, Mycobacterium tuberculosis
LPQIEGLD

SEQ ID NO: 31746 - protein, 8 aa, Mycobacterium tuberculosis
PQIEGLDG

SEQ ID NO: 31747 - protein, 8 aa, Mycobacterium tuberculosis
QIEGLDGF

SEQ ID NO: 31748 - protein, 8 aa, Mycobacterium tuberculosis
IEGLDGFC

SEQ ID NO: 31749 - protein, 8 aa, Mycobacterium tuberculosis
EGLDGFCS

SEQ ID NO: 31750 - protein, 8 aa, Mycobacterium tuberculosis
GLDGFCSA

SEQ ID NO: 31751 - protein, 8 aa, Mycobacterium tuberculosis
LDGFCSAS

SEQ ID NO: 31752 - protein, 8 aa, Mycobacterium tuberculosis
DGFCSASL

SEQ ID NO: 31753 - protein, 8 aa, Mycobacterium tuberculosis
GFCSASLL

SEQ ID NO: 31754 - protein, 8 aa, Mycobacterium tuberculosis
FCSASLLV

SEQ ID NO: 31755 - protein, 8 aa, Mycobacterium tuberculosis
CSASLLVD

SEQ ID NO: 31756 - protein, 8 aa, Mycobacterium tuberculosis
SASLLVDR

SEQ ID NO: 31757 - protein, 8 aa, Mycobacterium tuberculosis
ASLLVDRT

SEQ ID NO: 31758 - protein, 8 aa, Mycobacterium tuberculosis
SLLVDRTS

SEQ ID NO: 31759 - protein, 8 aa, Mycobacterium tuberculosis
LLVDRTSG

SEQ ID NO: 31760 - protein, 8 aa, Mycobacterium tuberculosis
LVDRTSGR

SEQ ID NO: 31761 - protein, 8 aa, Mycobacterium tuberculosis
VDRTSGRA

SEQ ID NO: 31762 - protein, 8 aa, Mycobacterium tuberculosis
DRTSGRAV

SEQ ID NO: 31763 - protein, 8 aa, Mycobacterium tuberculosis
RTSGRAVS

SEQ ID NO: 31764 - protein, 8 aa, Mycobacterium tuberculosis
TSGRAVSS

SEQ ID NO: 31765 - protein, 8 aa, Mycobacterium tuberculosis
SGRAVSSA

SEQ ID NO: 31766 - protein, 8 aa, Mycobacterium tuberculosis
GRAVSSAT

SEQ ID NO: 31767 - protein, 8 aa, Mycobacterium tuberculosis
RAVSSATF

SEQ ID NO: 31768 - protein, 8 aa, Mycobacterium tuberculosis
AVSSATFD

SEQ ID NO: 31769 - protein, 8 aa, Mycobacterium tuberculosis
VSSATFDS

SEQ ID NO: 31770 - protein, 8 aa, Mycobacterium tuberculosis
SSATFDSF

SEQ ID NO: 31771 - protein, 8 aa, Mycobacterium tuberculosis
SATFDSFD

SEQ ID NO: 31772 - protein, 8 aa, Mycobacterium tuberculosis
ATFDSFDA

SEQ ID NO: 31773 - protein, 8 aa, Mycobacterium tuberculosis
TFDSFDAM

SEQ ID NO: 31774 - protein, 8 aa, Mycobacterium tuberculosis
FDSFDAME

SEQ ID NO: 31775 - protein, 8 aa, Mycobacterium tuberculosis
DSFDAMER

SEQ ID NO: 31776 - protein, 8 aa, Mycobacterium tuberculosis
SFDAMERN

SEQ ID NO: 31777 - protein, 8 aa, Mycobacterium tuberculosis
FDAMERNR

SEQ ID NO: 31778 - protein, 8 aa, Mycobacterium tuberculosis
DAMERNRD

SEQ ID NO: 31779 - protein, 8 aa, Mycobacterium tuberculosis
AMERNRDQ

SEQ ID NO: 31780 - protein, 8 aa, Mycobacterium tuberculosis
MERNRDQS

SEQ ID NO: 31781 - protein, 8 aa, Mycobacterium tuberculosis
ERNRDQSN

SEQ ID NO: 31782 - protein, 8 aa, Mycobacterium tuberculosis
RNRDQSNA

SEQ ID NO: 31783 - protein, 8 aa, Mycobacterium tuberculosis
NRDQSNAL

SEQ ID NO: 31784 - protein, 8 aa, Mycobacterium tuberculosis
RDQSNALK

SEQ ID NO: 31785 - protein, 8 aa, Mycobacterium tuberculosis
DQSNALKA

SEQ ID NO: 31786 - protein, 8 aa, Mycobacterium tuberculosis
QSNALKAT

SEQ ID NO: 31787 - protein, 8 aa, Mycobacterium tuberculosis
SNALKATS

SEQ ID NO: 31788 - protein, 8 aa, Mycobacterium tuberculosis
NALKATSL

SEQ ID NO: 31789 - protein, 8 aa, Mycobacterium tuberculosis
ALKATSLR

SEQ ID NO: 31790 - protein, 8 aa, Mycobacterium tuberculosis
LKATSLRE

SEQ ID NO: 31791 - protein, 8 aa, Mycobacterium tuberculosis
KATSLREA

SEQ ID NO: 31792 - protein, 8 aa, Mycobacterium tuberculosis
ATSLREAG

SEQ ID NO: 31793 - protein, 8 aa, Mycobacterium tuberculosis
TSLREAGG

SEQ ID NO: 31794 - protein, 8 aa, Mycobacterium tuberculosis
SLREAGGE

SEQ ID NO: 31795 - protein, 8 aa, Mycobacterium tuberculosis
LREAGGEE

SEQ ID NO: 31796 - protein, 8 aa, Mycobacterium tuberculosis
REAGGEEL

SEQ ID NO: 31797 - protein, 8 aa, Mycobacterium tuberculosis
EAGGEELD

SEQ ID NO: 31798 - protein, 8 aa, Mycobacterium tuberculosis
AGGEELDE

SEQ ID NO: 31799 - protein, 8 aa, Mycobacterium tuberculosis
GGEELDEC

SEQ ID NO: 31800 - protein, 8 aa, Mycobacterium tuberculosis
GEELDECE

SEQ ID NO: 31801 - protein, 8 aa, Mycobacterium tuberculosis
EELDECEF

SEQ ID NO: 31802 - protein, 8 aa, Mycobacterium tuberculosis
ELDECEFE

SEQ ID NO: 31803 - protein, 8 aa, Mycobacterium tuberculosis
LDECEFEL

SEQ ID NO: 31804 - protein, 8 aa, Mycobacterium tuberculosis
DECEFELA

SEQ ID NO: 31805 - protein, 8 aa, Mycobacterium tuberculosis
ECEFELAL

SEQ ID NO: 31806 - protein, 8 aa, Mycobacterium tuberculosis
CEFELALA

SEQ ID NO: 31807 - protein, 8 aa, Mycobacterium tuberculosis
EFELALAH

SEQ ID NO: 31808 - protein, 8 aa, Mycobacterium tuberculosis
FELALAHL

SEQ ID NO: 31809 - protein, 8 aa, Mycobacterium tuberculosis
ELALAHLR

SEQ ID NO: 31810 - protein, 8 aa, Mycobacterium tuberculosis
LALAHLRV

SEQ ID NO: 31811 - protein, 8 aa, Mycobacterium tuberculosis
ALAHLRVP

SEQ ID NO: 31812 - protein, 8 aa, Mycobacterium tuberculosis
LAHLRVPE

SEQ ID NO: 31813 - protein, 8 aa, Mycobacterium tuberculosis
AHLRVPEL

SEQ ID NO: 31814 - protein, 8 aa, Mycobacterium tuberculosis
HLRVPELV

SEQ ID NO: 31815 - protein, 9 aa, Mycobacterium tuberculosis
MTGGATGAL

SEQ ID NO: 31816 - protein, 9 aa, Mycobacterium tuberculosis
TGGATGALP

SEQ ID NO: 31817 - protein, 9 aa, Mycobacterium tuberculosis
GGATGALPR

SEQ ID NO: 31818 - protein, 9 aa, Mycobacterium tuberculosis
GATGALPRT

SEQ ID NO: 31819 - protein, 9 aa, Mycobacterium tuberculosis
ATGALPRTM

SEQ ID NO: 31820 - protein, 9 aa, Mycobacterium tuberculosis
TGALPRTMK

SEQ ID NO: 31821 - protein, 9 aa, Mycobacterium tuberculosis
GALPRTMKE

SEQ ID NO: 31822 - protein, 9 aa, Mycobacterium tuberculosis
ALPRTMKEG

SEQ ID NO: 31823 - protein, 9 aa, Mycobacterium tuberculosis
LPRTMKEGW

SEQ ID NO: 31824 - protein, 9 aa, Mycobacterium tuberculosis
PRTMKEGWI

SEQ ID NO: 31825 - protein, 9 aa, Mycobacterium tuberculosis
RTMKEGWIV

SEQ ID NO: 31826 - protein, 9 aa, Mycobacterium tuberculosis
TMKEGWIVY

SEQ ID NO: 31827 - protein, 9 aa, Mycobacterium tuberculosis
MKEGWIVYA

SEQ ID NO: 31828 - protein, 9 aa, Mycobacterium tuberculosis
KEGWIVYAR

SEQ ID NO: 31829 - protein, 9 aa, Mycobacterium tuberculosis
EGWIVYARS

SEQ ID NO: 31830 - protein, 9 aa, Mycobacterium tuberculosis
GWIVYARST

SEQ ID NO: 31831 - protein, 9 aa, Mycobacterium tuberculosis
WIVYARSTT

SEQ ID NO: 31832 - protein, 9 aa, Mycobacterium tuberculosis
IVYARSTTI

SEQ ID NO: 31833 - protein, 9 aa, Mycobacterium tuberculosis
VYARSTTIQ

SEQ ID NO: 31834 - protein, 9 aa, Mycobacterium tuberculosis
YARSTTIQA

SEQ ID NO: 31835 - protein, 9 aa, Mycobacterium tuberculosis
ARSTTIQAQ

SEQ ID NO: 31836 - protein, 9 aa, Mycobacterium tuberculosis
RSTTIQAQS

SEQ ID NO: 31837 - protein, 9 aa, Mycobacterium tuberculosis
STTIQAQSE

SEQ ID NO: 31838 - protein, 9 aa, Mycobacterium tuberculosis
TTIQAQSEC

SEQ ID NO: 31839 - protein, 9 aa, Mycobacterium tuberculosis
TIQAQSECI

SEQ ID NO: 31840 - protein, 9 aa, Mycobacterium tuberculosis
IQAQSECID

SEQ ID NO: 31841 - protein, 9 aa, Mycobacterium tuberculosis
QAQSECIDT

SEQ ID NO: 31842 - protein, 9 aa, Mycobacterium tuberculosis
AQSECIDTG

SEQ ID NO: 31843 - protein, 9 aa, Mycobacterium tuberculosis
QSECIDTGI

SEQ ID NO: 31844 - protein, 9 aa, Mycobacterium tuberculosis
SECIDTGIA

SEQ ID NO: 31845 - protein, 9 aa, Mycobacterium tuberculosis
ECIDTGIAH

SEQ ID NO: 31846 - protein, 9 aa, Mycobacterium tuberculosis
CIDTGIAHV

SEQ ID NO: 31847 - protein, 9 aa, Mycobacterium tuberculosis
IDTGIAHVR

SEQ ID NO: 31848 - protein, 9 aa, Mycobacterium tuberculosis
DTGIAHVRD

SEQ ID NO: 31849 - protein, 9 aa, Mycobacterium tuberculosis
TGIAHVRDV

SEQ ID NO: 31850 - protein, 9 aa, Mycobacterium tuberculosis
GIAHVRDVV

SEQ ID NO: 31851 - protein, 9 aa, Mycobacterium tuberculosis
IAHVRDVVM

SEQ ID NO: 31852 - protein, 9 aa, Mycobacterium tuberculosis
AHVRDVVMP

SEQ ID NO: 31853 - protein, 9 aa, Mycobacterium tuberculosis
HVRDVVMPA

SEQ ID NO: 31854 - protein, 9 aa, Mycobacterium tuberculosis
VRDVVMPAL

SEQ ID NO: 31855 - protein, 9 aa, Mycobacterium tuberculosis
RDVVMPALQ

SEQ ID NO: 31856 - protein, 9 aa, Mycobacterium tuberculosis
DVVMPALQG

SEQ ID NO: 31857 - protein, 9 aa, Mycobacterium tuberculosis
VVMPALQGM

SEQ ID NO: 31858 - protein, 9 aa, Mycobacterium tuberculosis
VMPALQGMD

SEQ ID NO: 31859 - protein, 9 aa, Mycobacterium tuberculosis
MPALQGMDG

SEQ ID NO: 31860 - protein, 9 aa, Mycobacterium tuberculosis
PALQGMDGC

SEQ ID NO: 31861 - protein, 9 aa, Mycobacterium tuberculosis
ALQGMDGCI

SEQ ID NO: 31862 - protein, 9 aa, Mycobacterium tuberculosis
LQGMDGCIG

SEQ ID NO: 31863 - protein, 9 aa, Mycobacterium tuberculosis
QGMDGCIGV

SEQ ID NO: 31864 - protein, 9 aa, Mycobacterium tuberculosis
GMDGCIGVS

SEQ ID NO: 31865 - protein, 9 aa, Mycobacterium tuberculosis
MDGCIGVSL

SEQ ID NO: 31866 - protein, 9 aa, Mycobacterium tuberculosis
DGCIGVSLL

SEQ ID NO: 31867 - protein, 9 aa, Mycobacterium tuberculosis
GCIGVSLLV

SEQ ID NO: 31868 - protein, 9 aa, Mycobacterium tuberculosis
CIGVSLLVD

SEQ ID NO: 31869 - protein, 9 aa, Mycobacterium tuberculosis
IGVSLLVDR

SEQ ID NO: 31870 - protein, 9 aa, Mycobacterium tuberculosis
GVSLLVDRQ

SEQ ID NO: 31871 - protein, 9 aa, Mycobacterium tuberculosis
VSLLVDRQS

SEQ ID NO: 31872 - protein, 9 aa, Mycobacterium tuberculosis
SLLVDRQSG

SEQ ID NO: 31873 - protein, 9 aa, Mycobacterium tuberculosis
LLVDRQSGR

SEQ ID NO: 31874 - protein, 9 aa, Mycobacterium tuberculosis
LVDRQSGRC

SEQ ID NO: 31875 - protein, 9 aa, Mycobacterium tuberculosis
VDRQSGRCI

SEQ ID NO: 31876 - protein, 9 aa, Mycobacterium tuberculosis
DRQSGRCIA

SEQ ID NO: 31877 - protein, 9 aa, Mycobacterium tuberculosis
RQSGRCIAT

SEQ ID NO: 31878 - protein, 9 aa, Mycobacterium tuberculosis
QSGRCIATS

SEQ ID NO: 31879 - protein, 9 aa, Mycobacterium tuberculosis
SGRCIATSA

SEQ ID NO: 31880 - protein, 9 aa, Mycobacterium tuberculosis
GRCIATSAW

SEQ ID NO: 31881 - protein, 9 aa, Mycobacterium tuberculosis
RCIATSAWE

SEQ ID NO: 31882 - protein, 9 aa, Mycobacterium tuberculosis
CIATSAWET

SEQ ID NO: 31883 - protein, 9 aa, Mycobacterium tuberculosis
IATSAWETA

SEQ ID NO: 31884 - protein, 9 aa, Mycobacterium tuberculosis
ATSAWETAE

SEQ ID NO: 31885 - protein, 9 aa, Mycobacterium tuberculosis
TSAWETAEA

SEQ ID NO: 31886 - protein, 9 aa, Mycobacterium tuberculosis
SAWETAEAM

SEQ ID NO: 31887 - protein, 9 aa, Mycobacterium tuberculosis
AWETAEAMH

SEQ ID NO: 31888 - protein, 9 aa, Mycobacterium tuberculosis
WETAEAMHA

SEQ ID NO: 31889 - protein, 9 aa, Mycobacterium tuberculosis
ETAEAMHAS

SEQ ID NO: 31890 - protein, 9 aa, Mycobacterium tuberculosis
TAEAMHASR

SEQ ID NO: 31891 - protein, 9 aa, Mycobacterium tuberculosis
AEAMHASRE

SEQ ID NO: 31892 - protein, 9 aa, Mycobacterium tuberculosis
EAMHASREQ

SEQ ID NO: 31893 - protein, 9 aa, Mycobacterium tuberculosis
AMHASREQV

SEQ ID NO: 31894 - protein, 9 aa, Mycobacterium tuberculosis
MHASREQVT

SEQ ID NO: 31895 - protein, 9 aa, Mycobacterium tuberculosis
HASREQVTP

SEQ ID NO: 31896 - protein, 9 aa, Mycobacterium tuberculosis
ASREQVTPI

SEQ ID NO: 31897 - protein, 9 aa, Mycobacterium tuberculosis
SREQVTPIR

SEQ ID NO: 31898 - protein, 9 aa, Mycobacterium tuberculosis
REQVTPIRD

SEQ ID NO: 31899 - protein, 9 aa, Mycobacterium tuberculosis
EQVTPIRDR

SEQ ID NO: 31900 - protein, 9 aa, Mycobacterium tuberculosis
QVTPIRDRC

SEQ ID NO: 31901 - protein, 9 aa, Mycobacterium tuberculosis
VTPIRDRCA

SEQ ID NO: 31902 - protein, 9 aa, Mycobacterium tuberculosis
TPIRDRCAE

SEQ ID NO: 31903 - protein, 9 aa, Mycobacterium tuberculosis
PIRDRCAEM

SEQ ID NO: 31904 - protein, 9 aa, Mycobacterium tuberculosis
IRDRCAEMF

SEQ ID NO: 31905 - protein, 9 aa, Mycobacterium tuberculosis
RDRCAEMFG

SEQ ID NO: 31906 - protein, 9 aa, Mycobacterium tuberculosis
DRCAEMFGG

SEQ ID NO: 31907 - protein, 9 aa, Mycobacterium tuberculosis
RCAEMFGGT

SEQ ID NO: 31908 - protein, 9 aa, Mycobacterium tuberculosis
CAEMFGGTP

SEQ ID NO: 31909 - protein, 9 aa, Mycobacterium tuberculosis
AEMFGGTPA

SEQ ID NO: 31910 - protein, 9 aa, Mycobacterium tuberculosis
EMFGGTPAV

SEQ ID NO: 31911 - protein, 9 aa, Mycobacterium tuberculosis
MFGGTPAVE

SEQ ID NO: 31912 - protein, 9 aa, Mycobacterium tuberculosis
FGGTPAVEE

SEQ ID NO: 31913 - protein, 9 aa, Mycobacterium tuberculosis
GGTPAVEEW

SEQ ID NO: 31914 - protein, 9 aa, Mycobacterium tuberculosis
GTPAVEEWE

SEQ ID NO: 31915 - protein, 9 aa, Mycobacterium tuberculosis
TPAVEEWEI

SEQ ID NO: 31916 - protein, 9 aa, Mycobacterium tuberculosis
PAVEEWEIA

SEQ ID NO: 31917 - protein, 9 aa, Mycobacterium tuberculosis
AVEEWEIAA

SEQ ID NO: 31918 - protein, 9 aa, Mycobacterium tuberculosis
VEEWEIAAM

SEQ ID NO: 31919 - protein, 9 aa, Mycobacterium tuberculosis
EEWEIAAMH

SEQ ID NO: 31920 - protein, 9 aa, Mycobacterium tuberculosis
EWEIAAMHR

SEQ ID NO: 31921 - protein, 9 aa, Mycobacterium tuberculosis
WEIAAMHRD

SEQ ID NO: 31922 - protein, 9 aa, Mycobacterium tuberculosis
EIAAMHRDH

SEQ ID NO: 31923 - protein, 9 aa, Mycobacterium tuberculosis
IAAMHRDHR

SEQ ID NO: 31924 - protein, 9 aa, Mycobacterium tuberculosis
AAMHRDHRS

SEQ ID NO: 31925 - protein, 9 aa, Mycobacterium tuberculosis
AMHRDHRSA

SEQ ID NO: 31926 - protein, 9 aa, Mycobacterium tuberculosis
MHRDHRSAE

SEQ ID NO: 31927 - protein, 9 aa, Mycobacterium tuberculosis
HRDHRSAEG

SEQ ID NO: 31928 - protein, 9 aa, Mycobacterium tuberculosis
RDHRSAEGA

SEQ ID NO: 31929 - protein, 9 aa, Mycobacterium tuberculosis
DHRSAEGAC

SEQ ID NO: 31930 - protein, 9 aa, Mycobacterium tuberculosis
HRSAEGACV

SEQ ID NO: 31931 - protein, 9 aa, Mycobacterium tuberculosis
RSAEGACVR

SEQ ID NO: 31932 - protein, 9 aa, Mycobacterium tuberculosis
SAEGACVRA

SEQ ID NO: 31933 - protein, 9 aa, Mycobacterium tuberculosis
AEGACVRAT

SEQ ID NO: 31934 - protein, 9 aa, Mycobacterium tuberculosis
EGACVRATW

SEQ ID NO: 31935 - protein, 9 aa, Mycobacterium tuberculosis
GACVRATWV

SEQ ID NO: 31936 - protein, 9 aa, Mycobacterium tuberculosis
ACVRATWVK

SEQ ID NO: 31937 - protein, 9 aa, Mycobacterium tuberculosis
CVRATWVKV

SEQ ID NO: 31938 - protein, 9 aa, Mycobacterium tuberculosis
VRATWVKVP

SEQ ID NO: 31939 - protein, 9 aa, Mycobacterium tuberculosis
RATWVKVPA

SEQ ID NO: 31940 - protein, 9 aa, Mycobacterium tuberculosis
ATWVKVPAD

SEQ ID NO: 31941 - protein, 9 aa, Mycobacterium tuberculosis
TWVKVPADQ

SEQ ID NO: 31942 - protein, 9 aa, Mycobacterium tuberculosis
WVKVPADQV

SEQ ID NO: 31943 - protein, 9 aa, Mycobacterium tuberculosis
VKVPADQVD

SEQ ID NO: 31944 - protein, 9 aa, Mycobacterium tuberculosis
KVPADQVDQ

SEQ ID NO: 31945 - protein, 9 aa, Mycobacterium tuberculosis
VPADQVDQG

SEQ ID NO: 31946 - protein, 9 aa, Mycobacterium tuberculosis
PADQVDQGI

SEQ ID NO: 31947 - protein, 9 aa, Mycobacterium tuberculosis
ADQVDQGIE

SEQ ID NO: 31948 - protein, 9 aa, Mycobacterium tuberculosis
DQVDQGIEY

SEQ ID NO: 31949 - protein, 9 aa, Mycobacterium tuberculosis
QVDQGIEYY

SEQ ID NO: 31950 - protein, 9 aa, Mycobacterium tuberculosis
VDQGIEYYK

SEQ ID NO: 31951 - protein, 9 aa, Mycobacterium tuberculosis
DQGIEYYKS

SEQ ID NO: 31952 - protein, 9 aa, Mycobacterium tuberculosis
QGIEYYKSS

SEQ ID NO: 31953 - protein, 9 aa, Mycobacterium tuberculosis
GIEYYKSSV

SEQ ID NO: 31954 - protein, 9 aa, Mycobacterium tuberculosis
IEYYKSSVL

SEQ ID NO: 31955 - protein, 9 aa, Mycobacterium tuberculosis
EYYKSSVLP

SEQ ID NO: 31956 - protein, 9 aa, Mycobacterium tuberculosis
YYKSSVLPQ

SEQ ID NO: 31957 - protein, 9 aa, Mycobacterium tuberculosis
YKSSVLPQI

SEQ ID NO: 31958 - protein, 9 aa, Mycobacterium tuberculosis
KSSVLPQIE

SEQ ID NO: 31959 - protein, 9 aa, Mycobacterium tuberculosis
SSVLPQIEG

SEQ ID NO: 31960 - protein, 9 aa, Mycobacterium tuberculosis
SVLPQIEGL

SEQ ID NO: 31961 - protein, 9 aa, Mycobacterium tuberculosis
VLPQIEGLD

SEQ ID NO: 31962 - protein, 9 aa, Mycobacterium tuberculosis
LPQIEGLDG

SEQ ID NO: 31963 - protein, 9 aa, Mycobacterium tuberculosis
PQIEGLDGF

SEQ ID NO: 31964 - protein, 9 aa, Mycobacterium tuberculosis
QIEGLDGFC

SEQ ID NO: 31965 - protein, 9 aa, Mycobacterium tuberculosis
IEGLDGFCS

SEQ ID NO: 31966 - protein, 9 aa, Mycobacterium tuberculosis
EGLDGFCSA

SEQ ID NO: 31967 - protein, 9 aa, Mycobacterium tuberculosis
GLDGFCSAS

SEQ ID NO: 31968 - protein, 9 aa, Mycobacterium tuberculosis
LDGFCSASL

SEQ ID NO: 31969 - protein, 9 aa, Mycobacterium tuberculosis
DGFCSASLL

SEQ ID NO: 31970 - protein, 9 aa, Mycobacterium tuberculosis
GFCSASLLV

SEQ ID NO: 31971 - protein, 9 aa, Mycobacterium tuberculosis
FCSASLLVD

SEQ ID NO: 31972 - protein, 9 aa, Mycobacterium tuberculosis
CSASLLVDR

SEQ ID NO: 31973 - protein, 9 aa, Mycobacterium tuberculosis
SASLLVDRT

SEQ ID NO: 31974 - protein, 9 aa, Mycobacterium tuberculosis
ASLLVDRTS

SEQ ID NO: 31975 - protein, 9 aa, Mycobacterium tuberculosis
SLLVDRTSG

SEQ ID NO: 31976 - protein, 9 aa, Mycobacterium tuberculosis
LLVDRTSGR

SEQ ID NO: 31977 - protein, 9 aa, Mycobacterium tuberculosis
LVDRTSGRA

SEQ ID NO: 31978 - protein, 9 aa, Mycobacterium tuberculosis
VDRTSGRAV

SEQ ID NO: 31979 - protein, 9 aa, Mycobacterium tuberculosis
DRTSGRAVS

SEQ ID NO: 31980 - protein, 9 aa, Mycobacterium tuberculosis
RTSGRAVSS

SEQ ID NO: 31981 - protein, 9 aa, Mycobacterium tuberculosis
TSGRAVSSA

SEQ ID NO: 31982 - protein, 9 aa, Mycobacterium tuberculosis
SGRAVSSAT

SEQ ID NO: 31983 - protein, 9 aa, Mycobacterium tuberculosis
GRAVSSATF

SEQ ID NO: 31984 - protein, 9 aa, Mycobacterium tuberculosis
RAVSSATFD

SEQ ID NO: 31985 - protein, 9 aa, Mycobacterium tuberculosis
AVSSATFDS

SEQ ID NO: 31986 - protein, 9 aa, Mycobacterium tuberculosis
VSSATFDSF

SEQ ID NO: 31987 - protein, 9 aa, Mycobacterium tuberculosis
SSATFDSFD

SEQ ID NO: 31988 - protein, 9 aa, Mycobacterium tuberculosis
SATFDSFDA

SEQ ID NO: 31989 - protein, 9 aa, Mycobacterium tuberculosis
ATFDSFDAM

SEQ ID NO: 31990 - protein, 9 aa, Mycobacterium tuberculosis
TFDSFDAME

SEQ ID NO: 31991 - protein, 9 aa, Mycobacterium tuberculosis
FDSFDAMER

SEQ ID NO: 31992 - protein, 9 aa, Mycobacterium tuberculosis
DSFDAMERN

SEQ ID NO: 31993 - protein, 9 aa, Mycobacterium tuberculosis
SFDAMERNR

SEQ ID NO: 31994 - protein, 9 aa, Mycobacterium tuberculosis
FDAMERNRD

SEQ ID NO: 31995 - protein, 9 aa, Mycobacterium tuberculosis
DAMERNRDQ

SEQ ID NO: 31996 - protein, 9 aa, Mycobacterium tuberculosis
AMERNRDQS

SEQ ID NO: 31997 - protein, 9 aa, Mycobacterium tuberculosis
MERNRDQSN

SEQ ID NO: 31998 - protein, 9 aa, Mycobacterium tuberculosis
ERNRDQSNA

SEQ ID NO: 31999 - protein, 9 aa, Mycobacterium tuberculosis
RNRDQSNAL

SEQ ID NO: 32000 - protein, 9 aa, Mycobacterium tuberculosis
NRDQSNALK

SEQ ID NO: 32001 - protein, 9 aa, Mycobacterium tuberculosis
RDQSNALKA

SEQ ID NO: 32002 - protein, 9 aa, Mycobacterium tuberculosis
DQSNALKAT

SEQ ID NO: 32003 - protein, 9 aa, Mycobacterium tuberculosis
QSNALKATS

SEQ ID NO: 32004 - protein, 9 aa, Mycobacterium tuberculosis
SNALKATSL

SEQ ID NO: 32005 - protein, 9 aa, Mycobacterium tuberculosis
NALKATSLR

SEQ ID NO: 32006 - protein, 9 aa, Mycobacterium tuberculosis
ALKATSLRE

SEQ ID NO: 32007 - protein, 9 aa, Mycobacterium tuberculosis
LKATSLREA

SEQ ID NO: 32008 - protein, 9 aa, Mycobacterium tuberculosis
KATSLREAG

SEQ ID NO: 32009 - protein, 9 aa, Mycobacterium tuberculosis
ATSLREAGG

SEQ ID NO: 32010 - protein, 9 aa, Mycobacterium tuberculosis
TSLREAGGE

SEQ ID NO: 32011 - protein, 9 aa, Mycobacterium tuberculosis
SLREAGGEE

SEQ ID NO: 32012 - protein, 9 aa, Mycobacterium tuberculosis
LREAGGEEL

SEQ ID NO: 32013 - protein, 9 aa, Mycobacterium tuberculosis
REAGGEELD

SEQ ID NO: 32014 - protein, 9 aa, Mycobacterium tuberculosis
EAGGEELDE

SEQ ID NO: 32015 - protein, 9 aa, Mycobacterium tuberculosis
AGGEELDEC

SEQ ID NO: 32016 - protein, 9 aa, Mycobacterium tuberculosis
GGEELDECE

SEQ ID NO: 32017 - protein, 9 aa, Mycobacterium tuberculosis
GEELDECEF

SEQ ID NO: 32018 - protein, 9 aa, Mycobacterium tuberculosis
EELDECEFE

SEQ ID NO: 32019 - protein, 9 aa, Mycobacterium tuberculosis
ELDECEFEL

SEQ ID NO: 32020 - protein, 9 aa, Mycobacterium tuberculosis
LDECEFELA

SEQ ID NO: 32021 - protein, 9 aa, Mycobacterium tuberculosis
DECEFELAL

SEQ ID NO: 32022 - protein, 9 aa, Mycobacterium tuberculosis
ECEFELALA

SEQ ID NO: 32023 - protein, 9 aa, Mycobacterium tuberculosis
CEFELALAH

SEQ ID NO: 32024 - protein, 9 aa, Mycobacterium tuberculosis
EFELALAHL

SEQ ID NO: 32025 - protein, 9 aa, Mycobacterium tuberculosis
FELALAHLR

SEQ ID NO: 32026 - protein, 9 aa, Mycobacterium tuberculosis
ELALAHLRV

SEQ ID NO: 32027 - protein, 9 aa, Mycobacterium tuberculosis
LALAHLRVP

SEQ ID NO: 32028 - protein, 9 aa, Mycobacterium tuberculosis
ALAHLRVPE

SEQ ID NO: 32029 - protein, 9 aa, Mycobacterium tuberculosis
LAHLRVPEL

SEQ ID NO: 32030 - protein, 9 aa, Mycobacterium tuberculosis
AHLRVPELV

SEQ ID NO: 32031 - protein, 10 aa, Mycobacterium tuberculosis
MTGGATGALP

SEQ ID NO: 32032 - protein, 10 aa, Mycobacterium tuberculosis
TGGATGALPR

SEQ ID NO: 32033 - protein, 10 aa, Mycobacterium tuberculosis
GGATGALPRT

SEQ ID NO: 32034 - protein, 10 aa, Mycobacterium tuberculosis
GATGALPRTM

SEQ ID NO: 32035 - protein, 10 aa, Mycobacterium tuberculosis
ATGALPRTMK

SEQ ID NO: 32036 - protein, 10 aa, Mycobacterium tuberculosis
TGALPRTMKE

SEQ ID NO: 32037 - protein, 10 aa, Mycobacterium tuberculosis
GALPRTMKEG

SEQ ID NO: 32038 - protein, 10 aa, Mycobacterium tuberculosis
ALPRTMKEGW

SEQ ID NO: 32039 - protein, 10 aa, Mycobacterium tuberculosis
LPRTMKEGWI

SEQ ID NO: 32040 - protein, 10 aa, Mycobacterium tuberculosis
PRTMKEGWIV

SEQ ID NO: 32041 - protein, 10 aa, Mycobacterium tuberculosis
RTMKEGWIVY

SEQ ID NO: 32042 - protein, 10 aa, Mycobacterium tuberculosis
TMKEGWIVYA

SEQ ID NO: 32043 - protein, 10 aa, Mycobacterium tuberculosis
MKEGWIVYAR

SEQ ID NO: 32044 - protein, 10 aa, Mycobacterium tuberculosis
KEGWIVYARS

SEQ ID NO: 32045 - protein, 10 aa, Mycobacterium tuberculosis
EGWIVYARST

SEQ ID NO: 32046 - protein, 10 aa, Mycobacterium tuberculosis
GWIVYARSTT

SEQ ID NO: 32047 - protein, 10 aa, Mycobacterium tuberculosis
WIVYARSTTI

SEQ ID NO: 32048 - protein, 10 aa, Mycobacterium tuberculosis
IVYARSTTIQ

SEQ ID NO: 32049 - protein, 10 aa, Mycobacterium tuberculosis
VYARSTTIQA

SEQ ID NO: 32050 - protein, 10 aa, Mycobacterium tuberculosis
YARSTTIQAQ

SEQ ID NO: 32051 - protein, 10 aa, Mycobacterium tuberculosis
ARSTTIQAQS

SEQ ID NO: 32052 - protein, 10 aa, Mycobacterium tuberculosis
RSTTIQAQSE

SEQ ID NO: 32053 - protein, 10 aa, Mycobacterium tuberculosis
STTIQAQSEC

SEQ ID NO: 32054 - protein, 10 aa, Mycobacterium tuberculosis
TTIQAQSECI

SEQ ID NO: 32055 - protein, 10 aa, Mycobacterium tuberculosis
TIQAQSECID

SEQ ID NO: 32056 - protein, 10 aa, Mycobacterium tuberculosis
IQAQSECIDT

SEQ ID NO: 32057 - protein, 10 aa, Mycobacterium tuberculosis
QAQSECIDTG

SEQ ID NO: 32058 - protein, 10 aa, Mycobacterium tuberculosis
AQSECIDTGI

SEQ ID NO: 32059 - protein, 10 aa, Mycobacterium tuberculosis
QSECIDTGIA

SEQ ID NO: 32060 - protein, 10 aa, Mycobacterium tuberculosis
SECIDTGIAH

SEQ ID NO: 32061 - protein, 10 aa, Mycobacterium tuberculosis
ECIDTGIAHV

SEQ ID NO: 32062 - protein, 10 aa, Mycobacterium tuberculosis
CIDTGIAHVR

SEQ ID NO: 32063 - protein, 10 aa, Mycobacterium tuberculosis
IDTGIAHVRD

SEQ ID NO: 32064 - protein, 10 aa, Mycobacterium tuberculosis
DTGIAHVRDV

SEQ ID NO: 32065 - protein, 10 aa, Mycobacterium tuberculosis
TGIAHVRDVV

SEQ ID NO: 32066 - protein, 10 aa, Mycobacterium tuberculosis
GIAHVRDVVM

SEQ ID NO: 32067 - protein, 10 aa, Mycobacterium tuberculosis
IAHVRDVVMP

SEQ ID NO: 32068 - protein, 10 aa, Mycobacterium tuberculosis
AHVRDVVMPA

SEQ ID NO: 32069 - protein, 10 aa, Mycobacterium tuberculosis
HVRDVVMPAL

SEQ ID NO: 32070 - protein, 10 aa, Mycobacterium tuberculosis
VRDVVMPALQ

SEQ ID NO: 32071 - protein, 10 aa, Mycobacterium tuberculosis
RDVVMPALQG

SEQ ID NO: 32072 - protein, 10 aa, Mycobacterium tuberculosis
DVVMPALQGM

SEQ ID NO: 32073 - protein, 10 aa, Mycobacterium tuberculosis
VVMPALQGMD

SEQ ID NO: 32074 - protein, 10 aa, Mycobacterium tuberculosis
VMPALQGMDG

SEQ ID NO: 32075 - protein, 10 aa, Mycobacterium tuberculosis
MPALQGMDGC

SEQ ID NO: 32076 - protein, 10 aa, Mycobacterium tuberculosis
PALQGMDGCI

SEQ ID NO: 32077 - protein, 10 aa, Mycobacterium tuberculosis
ALQGMDGCIG

SEQ ID NO: 32078 - protein, 10 aa, Mycobacterium tuberculosis
LQGMDGCIGV

SEQ ID NO: 32079 - protein, 10 aa, Mycobacterium tuberculosis
QGMDGCIGVS

SEQ ID NO: 32080 - protein, 10 aa, Mycobacterium tuberculosis
GMDGCIGVSL

SEQ ID NO: 32081 - protein, 10 aa, Mycobacterium tuberculosis
MDGCIGVSLL

SEQ ID NO: 32082 - protein, 10 aa, Mycobacterium tuberculosis
DGCIGVSLLV

SEQ ID NO: 32083 - protein, 10 aa, Mycobacterium tuberculosis
GCIGVSLLVD

SEQ ID NO: 32084 - protein, 10 aa, Mycobacterium tuberculosis
CIGVSLLVDR

SEQ ID NO: 32085 - protein, 10 aa, Mycobacterium tuberculosis
IGVSLLVDRQ

SEQ ID NO: 32086 - protein, 10 aa, Mycobacterium tuberculosis
GVSLLVDRQS

SEQ ID NO: 32087 - protein, 10 aa, Mycobacterium tuberculosis
VSLLVDRQSG

SEQ ID NO: 32088 - protein, 10 aa, Mycobacterium tuberculosis
SLLVDRQSGR

SEQ ID NO: 32089 - protein, 10 aa, Mycobacterium tuberculosis
LLVDRQSGRC

SEQ ID NO: 32090 - protein, 10 aa, Mycobacterium tuberculosis
LVDRQSGRCI

SEQ ID NO: 32091 - protein, 10 aa, Mycobacterium tuberculosis
VDRQSGRCIA

SEQ ID NO: 32092 - protein, 10 aa, Mycobacterium tuberculosis
DRQSGRCIAT

SEQ ID NO: 32093 - protein, 10 aa, Mycobacterium tuberculosis
RQSGRCIATS

SEQ ID NO: 32094 - protein, 10 aa, Mycobacterium tuberculosis
QSGRCIATSA

SEQ ID NO: 32095 - protein, 10 aa, Mycobacterium tuberculosis
SGRCIATSAW

SEQ ID NO: 32096 - protein, 10 aa, Mycobacterium tuberculosis
GRCIATSAWE

SEQ ID NO: 32097 - protein, 10 aa, Mycobacterium tuberculosis
RCIATSAWET

SEQ ID NO: 32098 - protein, 10 aa, Mycobacterium tuberculosis
CIATSAWETA

SEQ ID NO: 32099 - protein, 10 aa, Mycobacterium tuberculosis
IATSAWETAE

SEQ ID NO: 32100 - protein, 10 aa, Mycobacterium tuberculosis
ATSAWETAEA

SEQ ID NO: 32101 - protein, 10 aa, Mycobacterium tuberculosis
TSAWETAEAM

SEQ ID NO: 32102 - protein, 10 aa, Mycobacterium tuberculosis
SAWETAEAMH

SEQ ID NO: 32103 - protein, 10 aa, Mycobacterium tuberculosis
AWETAEAMHA

SEQ ID NO: 32104 - protein, 10 aa, Mycobacterium tuberculosis
WETAEAMHAS

SEQ ID NO: 32105 - protein, 10 aa, Mycobacterium tuberculosis
ETAEAMHASR

SEQ ID NO: 32106 - protein, 10 aa, Mycobacterium tuberculosis
TAEAMHASRE

SEQ ID NO: 32107 - protein, 10 aa, Mycobacterium tuberculosis
AEAMHASREQ

SEQ ID NO: 32108 - protein, 10 aa, Mycobacterium tuberculosis
EAMHASREQV

SEQ ID NO: 32109 - protein, 10 aa, Mycobacterium tuberculosis
AMHASREQVT

SEQ ID NO: 32110 - protein, 10 aa, Mycobacterium tuberculosis
MHASREQVTP

SEQ ID NO: 32111 - protein, 10 aa, Mycobacterium tuberculosis
HASREQVTPI

SEQ ID NO: 32112 - protein, 10 aa, Mycobacterium tuberculosis
ASREQVTPIR

SEQ ID NO: 32113 - protein, 10 aa, Mycobacterium tuberculosis
SREQVTPIRD

SEQ ID NO: 32114 - protein, 10 aa, Mycobacterium tuberculosis
REQVTPIRDR

SEQ ID NO: 32115 - protein, 10 aa, Mycobacterium tuberculosis
EQVTPIRDRC

SEQ ID NO: 32116 - protein, 10 aa, Mycobacterium tuberculosis
QVTPIRDRCA

SEQ ID NO: 32117 - protein, 10 aa, Mycobacterium tuberculosis
VTPIRDRCAE

SEQ ID NO: 32118 - protein, 10 aa, Mycobacterium tuberculosis
TPIRDRCAEM

SEQ ID NO: 32119 - protein, 10 aa, Mycobacterium tuberculosis
PIRDRCAEMF

SEQ ID NO: 32120 - protein, 10 aa, Mycobacterium tuberculosis
IRDRCAEMFG

SEQ ID NO: 32121 - protein, 10 aa, Mycobacterium tuberculosis
RDRCAEMFGG

SEQ ID NO: 32122 - protein, 10 aa, Mycobacterium tuberculosis
DRCAEMFGGT

SEQ ID NO: 32123 - protein, 10 aa, Mycobacterium tuberculosis
RCAEMFGGTP

SEQ ID NO: 32124 - protein, 10 aa, Mycobacterium tuberculosis
CAEMFGGTPA

SEQ ID NO: 32125 - protein, 10 aa, Mycobacterium tuberculosis
AEMFGGTPAV

SEQ ID NO: 32126 - protein, 10 aa, Mycobacterium tuberculosis
EMFGGTPAVE

SEQ ID NO: 32127 - protein, 10 aa, Mycobacterium tuberculosis
MFGGTPAVEE

SEQ ID NO: 32128 - protein, 10 aa, Mycobacterium tuberculosis
FGGTPAVEEW

SEQ ID NO: 32129 - protein, 10 aa, Mycobacterium tuberculosis
GGTPAVEEWE

SEQ ID NO: 32130 - protein, 10 aa, Mycobacterium tuberculosis
GTPAVEEWEI

SEQ ID NO: 32131 - protein, 10 aa, Mycobacterium tuberculosis
TPAVEEWEIA

SEQ ID NO: 32132 - protein, 10 aa, Mycobacterium tuberculosis
PAVEEWEIAA

SEQ ID NO: 32133 - protein, 10 aa, Mycobacterium tuberculosis
AVEEWEIAAM

SEQ ID NO: 32134 - protein, 10 aa, Mycobacterium tuberculosis
VEEWEIAAMH

SEQ ID NO: 32135 - protein, 10 aa, Mycobacterium tuberculosis
EEWEIAAMHR

SEQ ID NO: 32136 - protein, 10 aa, Mycobacterium tuberculosis
EWEIAAMHRD

SEQ ID NO: 32137 - protein, 10 aa, Mycobacterium tuberculosis
WEIAAMHRDH

SEQ ID NO: 32138 - protein, 10 aa, Mycobacterium tuberculosis
EIAAMHRDHR

SEQ ID NO: 32139 - protein, 10 aa, Mycobacterium tuberculosis
IAAMHRDHRS

SEQ ID NO: 32140 - protein, 10 aa, Mycobacterium tuberculosis
AAMHRDHRSA

SEQ ID NO: 32141 - protein, 10 aa, Mycobacterium tuberculosis
AMHRDHRSAE

SEQ ID NO: 32142 - protein, 10 aa, Mycobacterium tuberculosis
MHRDHRSAEG

SEQ ID NO: 32143 - protein, 10 aa, Mycobacterium tuberculosis
HRDHRSAEGA

SEQ ID NO: 32144 - protein, 10 aa, Mycobacterium tuberculosis
RDHRSAEGAC

SEQ ID NO: 32145 - protein, 10 aa, Mycobacterium tuberculosis
DHRSAEGACV

SEQ ID NO: 32146 - protein, 10 aa, Mycobacterium tuberculosis
HRSAEGACVR

SEQ ID NO: 32147 - protein, 10 aa, Mycobacterium tuberculosis
RSAEGACVRA

SEQ ID NO: 32148 - protein, 10 aa, Mycobacterium tuberculosis
SAEGACVRAT

SEQ ID NO: 32149 - protein, 10 aa, Mycobacterium tuberculosis
AEGACVRATW

SEQ ID NO: 32150 - protein, 10 aa, Mycobacterium tuberculosis
EGACVRATWV

SEQ ID NO: 32151 - protein, 10 aa, Mycobacterium tuberculosis
GACVRATWVK

SEQ ID NO: 32152 - protein, 10 aa, Mycobacterium tuberculosis
ACVRATWVKV

SEQ ID NO: 32153 - protein, 10 aa, Mycobacterium tuberculosis
CVRATWVKVP

SEQ ID NO: 32154 - protein, 10 aa, Mycobacterium tuberculosis
VRATWVKVPA

SEQ ID NO: 32155 - protein, 10 aa, Mycobacterium tuberculosis
RATWVKVPAD

SEQ ID NO: 32156 - protein, 10 aa, Mycobacterium tuberculosis
ATWVKVPADQ

SEQ ID NO: 32157 - protein, 10 aa, Mycobacterium tuberculosis
TWVKVPADQV

SEQ ID NO: 32158 - protein, 10 aa, Mycobacterium tuberculosis
WVKVPADQVD

SEQ ID NO: 32159 - protein, 10 aa, Mycobacterium tuberculosis
VKVPADQVDQ

SEQ ID NO: 32160 - protein, 10 aa, Mycobacterium tuberculosis
KVPADQVDQG

SEQ ID NO: 32161 - protein, 10 aa, Mycobacterium tuberculosis
VPADQVDQGI

SEQ ID NO: 32162 - protein, 10 aa, Mycobacterium tuberculosis
PADQVDQGIE

SEQ ID NO: 32163 - protein, 10 aa, Mycobacterium tuberculosis
ADQVDQGIEY

SEQ ID NO: 32164 - protein, 10 aa, Mycobacterium tuberculosis
DQVDQGIEYY

SEQ ID NO: 32165 - protein, 10 aa, Mycobacterium tuberculosis
QVDQGIEYYK

SEQ ID NO: 32166 - protein, 10 aa, Mycobacterium tuberculosis
VDQGIEYYKS

SEQ ID NO: 32167 - protein, 10 aa, Mycobacterium tuberculosis
DQGIEYYKSS

SEQ ID NO: 32168 - protein, 10 aa, Mycobacterium tuberculosis
QGIEYYKSSV

SEQ ID NO: 32169 - protein, 10 aa, Mycobacterium tuberculosis
GIEYYKSSVL

SEQ ID NO: 32170 - protein, 10 aa, Mycobacterium tuberculosis
IEYYKSSVLP

SEQ ID NO: 32171 - protein, 10 aa, Mycobacterium tuberculosis
EYYKSSVLPQ

SEQ ID NO: 32172 - protein, 10 aa, Mycobacterium tuberculosis
YYKSSVLPQI

SEQ ID NO: 32173 - protein, 10 aa, Mycobacterium tuberculosis
YKSSVLPQIE

SEQ ID NO: 32174 - protein, 10 aa, Mycobacterium tuberculosis
KSSVLPQIEG

SEQ ID NO: 32175 - protein, 10 aa, Mycobacterium tuberculosis
SSVLPQIEGL

SEQ ID NO: 32176 - protein, 10 aa, Mycobacterium tuberculosis
SVLPQIEGLD

SEQ ID NO: 32177 - protein, 10 aa, Mycobacterium tuberculosis
VLPQIEGLDG

SEQ ID NO: 32178 - protein, 10 aa, Mycobacterium tuberculosis
LPQIEGLDGF

SEQ ID NO: 32179 - protein, 10 aa, Mycobacterium tuberculosis
PQIEGLDGFC

SEQ ID NO: 32180 - protein, 10 aa, Mycobacterium tuberculosis
QIEGLDGFCS

SEQ ID NO: 32181 - protein, 10 aa, Mycobacterium tuberculosis
IEGLDGFCSA

SEQ ID NO: 32182 - protein, 10 aa, Mycobacterium tuberculosis
EGLDGFCSAS

SEQ ID NO: 32183 - protein, 10 aa, Mycobacterium tuberculosis
GLDGFCSASL

SEQ ID NO: 32184 - protein, 10 aa, Mycobacterium tuberculosis
LDGFCSASLL

SEQ ID NO: 32185 - protein, 10 aa, Mycobacterium tuberculosis
DGFCSASLLV

SEQ ID NO: 32186 - protein, 10 aa, Mycobacterium tuberculosis
GFCSASLLVD

SEQ ID NO: 32187 - protein, 10 aa, Mycobacterium tuberculosis
FCSASLLVDR

SEQ ID NO: 32188 - protein, 10 aa, Mycobacterium tuberculosis
CSASLLVDRT

SEQ ID NO: 32189 - protein, 10 aa, Mycobacterium tuberculosis
SASLLVDRTS

SEQ ID NO: 32190 - protein, 10 aa, Mycobacterium tuberculosis
ASLLVDRTSG

SEQ ID NO: 32191 - protein, 10 aa, Mycobacterium tuberculosis
SLLVDRTSGR

SEQ ID NO: 32192 - protein, 10 aa, Mycobacterium tuberculosis
LLVDRTSGRA

SEQ ID NO: 32193 - protein, 10 aa, Mycobacterium tuberculosis
LVDRTSGRAV

SEQ ID NO: 32194 - protein, 10 aa, Mycobacterium tuberculosis
VDRTSGRAVS

SEQ ID NO: 32195 - protein, 10 aa, Mycobacterium tuberculosis
DRTSGRAVSS

SEQ ID NO: 32196 - protein, 10 aa, Mycobacterium tuberculosis
RTSGRAVSSA

SEQ ID NO: 32197 - protein, 10 aa, Mycobacterium tuberculosis
TSGRAVSSAT

SEQ ID NO: 32198 - protein, 10 aa, Mycobacterium tuberculosis
SGRAVSSATF

SEQ ID NO: 32199 - protein, 10 aa, Mycobacterium tuberculosis
GRAVSSATFD

SEQ ID NO: 32200 - protein, 10 aa, Mycobacterium tuberculosis
RAVSSATFDS

SEQ ID NO: 32201 - protein, 10 aa, Mycobacterium tuberculosis
AVSSATFDSF

SEQ ID NO: 32202 - protein, 10 aa, Mycobacterium tuberculosis
VSSATFDSFD

SEQ ID NO: 32203 - protein, 10 aa, Mycobacterium tuberculosis
SSATFDSFDA

SEQ ID NO: 32204 - protein, 10 aa, Mycobacterium tuberculosis
SATFDSFDAM

SEQ ID NO: 32205 - protein, 10 aa, Mycobacterium tuberculosis
ATFDSFDAME

SEQ ID NO: 32206 - protein, 10 aa, Mycobacterium tuberculosis
TFDSFDAMER

SEQ ID NO: 32207 - protein, 10 aa, Mycobacterium tuberculosis
FDSFDAMERN

SEQ ID NO: 32208 - protein, 10 aa, Mycobacterium tuberculosis
DSFDAMERNR

SEQ ID NO: 32209 - protein, 10 aa, Mycobacterium tuberculosis
SFDAMERNRD

SEQ ID NO: 32210 - protein, 10 aa, Mycobacterium tuberculosis
FDAMERNRDQ

SEQ ID NO: 32211 - protein, 10 aa, Mycobacterium tuberculosis
DAMERNRDQS

SEQ ID NO: 32212 - protein, 10 aa, Mycobacterium tuberculosis
AMERNRDQSN

SEQ ID NO: 32213 - protein, 10 aa, Mycobacterium tuberculosis
MERNRDQSNA

SEQ ID NO: 32214 - protein, 10 aa, Mycobacterium tuberculosis
ERNRDQSNAL

SEQ ID NO: 32215 - protein, 10 aa, Mycobacterium tuberculosis
RNRDQSNALK

SEQ ID NO: 32216 - protein, 10 aa, Mycobacterium tuberculosis
NRDQSNALKA

SEQ ID NO: 32217 - protein, 10 aa, Mycobacterium tuberculosis
RDQSNALKAT

SEQ ID NO: 32218 - protein, 10 aa, Mycobacterium tuberculosis
DQSNALKATS

SEQ ID NO: 32219 - protein, 10 aa, Mycobacterium tuberculosis
QSNALKATSL

SEQ ID NO: 32220 - protein, 10 aa, Mycobacterium tuberculosis
SNALKATSLR

SEQ ID NO: 32221 - protein, 10 aa, Mycobacterium tuberculosis
NALKATSLRE

SEQ ID NO: 32222 - protein, 10 aa, Mycobacterium tuberculosis
ALKATSLREA

SEQ ID NO: 32223 - protein, 10 aa, Mycobacterium tuberculosis
LKATSLREAG

SEQ ID NO: 32224 - protein, 10 aa, Mycobacterium tuberculosis
KATSLREAGG

SEQ ID NO: 32225 - protein, 10 aa, Mycobacterium tuberculosis
ATSLREAGGE

SEQ ID NO: 32226 - protein, 10 aa, Mycobacterium tuberculosis
TSLREAGGEE

SEQ ID NO: 32227 - protein, 10 aa, Mycobacterium tuberculosis
SLREAGGEEL

SEQ ID NO: 32228 - protein, 10 aa, Mycobacterium tuberculosis
LREAGGEELD

SEQ ID NO: 32229 - protein, 10 aa, Mycobacterium tuberculosis
REAGGEELDE

SEQ ID NO: 32230 - protein, 10 aa, Mycobacterium tuberculosis
EAGGEELDEC

SEQ ID NO: 32231 - protein, 10 aa, Mycobacterium tuberculosis
AGGEELDECE

SEQ ID NO: 32232 - protein, 10 aa, Mycobacterium tuberculosis
GGEELDECEF

SEQ ID NO: 32233 - protein, 10 aa, Mycobacterium tuberculosis
GEELDECEFE

SEQ ID NO: 32234 - protein, 10 aa, Mycobacterium tuberculosis
EELDECEFEL

SEQ ID NO: 32235 - protein, 10 aa, Mycobacterium tuberculosis
ELDECEFELA

SEQ ID NO: 32236 - protein, 10 aa, Mycobacterium tuberculosis
LDECEFELAL

SEQ ID NO: 32237 - protein, 10 aa, Mycobacterium tuberculosis
DECEFELALA

SEQ ID NO: 32238 - protein, 10 aa, Mycobacterium tuberculosis
ECEFELALAH

SEQ ID NO: 32239 - protein, 10 aa, Mycobacterium tuberculosis
CEFELALAHL

SEQ ID NO: 32240 - protein, 10 aa, Mycobacterium tuberculosis
EFELALAHLR

SEQ ID NO: 32241 - protein, 10 aa, Mycobacterium tuberculosis
FELALAHLRV

SEQ ID NO: 32242 - protein, 10 aa, Mycobacterium tuberculosis
ELALAHLRVP

SEQ ID NO: 32243 - protein, 10 aa, Mycobacterium tuberculosis
LALAHLRVPE

SEQ ID NO: 32244 - protein, 10 aa, Mycobacterium tuberculosis
ALAHLRVPEL

SEQ ID NO: 32245 - protein, 10 aa, Mycobacterium tuberculosis
LAHLRVPELV

SEQ ID NO: 32246 - protein, 11 aa, Mycobacterium tuberculosis
MTGGATGALPR

SEQ ID NO: 32247 - protein, 11 aa, Mycobacterium tuberculosis
TGGATGALPRT

SEQ ID NO: 32248 - protein, 11 aa, Mycobacterium tuberculosis
GGATGALPRTM

SEQ ID NO: 32249 - protein, 11 aa, Mycobacterium tuberculosis
GATGALPRTMK

SEQ ID NO: 32250 - protein, 11 aa, Mycobacterium tuberculosis
ATGALPRTMKE

SEQ ID NO: 32251 - protein, 11 aa, Mycobacterium tuberculosis
TGALPRTMKEG

SEQ ID NO: 32252 - protein, 11 aa, Mycobacterium tuberculosis
GALPRTMKEGW

SEQ ID NO: 32253 - protein, 11 aa, Mycobacterium tuberculosis
ALPRTMKEGWI

SEQ ID NO: 32254 - protein, 11 aa, Mycobacterium tuberculosis
LPRTMKEGWIV

SEQ ID NO: 32255 - protein, 11 aa, Mycobacterium tuberculosis
PRTMKEGWIVY

SEQ ID NO: 32256 - protein, 11 aa, Mycobacterium tuberculosis
RTMKEGWIVYA

SEQ ID NO: 32257 - protein, 11 aa, Mycobacterium tuberculosis
TMKEGWIVYAR

SEQ ID NO: 32258 - protein, 11 aa, Mycobacterium tuberculosis
MKEGWIVYARS

SEQ ID NO: 32259 - protein, 11 aa, Mycobacterium tuberculosis
KEGWIVYARST

SEQ ID NO: 32260 - protein, 11 aa, Mycobacterium tuberculosis
EGWIVYARSTT

SEQ ID NO: 32261 - protein, 11 aa, Mycobacterium tuberculosis
GWIVYARSTTI

SEQ ID NO: 32262 - protein, 11 aa, Mycobacterium tuberculosis
WIVYARSTTIQ

SEQ ID NO: 32263 - protein, 11 aa, Mycobacterium tuberculosis
IVYARSTTIQA

SEQ ID NO: 32264 - protein, 11 aa, Mycobacterium tuberculosis
VYARSTTIQAQ

SEQ ID NO: 32265 - protein, 11 aa, Mycobacterium tuberculosis
YARSTTIQAQS

SEQ ID NO: 32266 - protein, 11 aa, Mycobacterium tuberculosis
ARSTTIQAQSE

SEQ ID NO: 32267 - protein, 11 aa, Mycobacterium tuberculosis
RSTTIQAQSEC

SEQ ID NO: 32268 - protein, 11 aa, Mycobacterium tuberculosis
STTIQAQSECI

SEQ ID NO: 32269 - protein, 11 aa, Mycobacterium tuberculosis
TTIQAQSECID

SEQ ID NO: 32270 - protein, 11 aa, Mycobacterium tuberculosis
TIQAQSECIDT

SEQ ID NO: 32271 - protein, 11 aa, Mycobacterium tuberculosis
IQAQSECIDTG

SEQ ID NO: 32272 - protein, 11 aa, Mycobacterium tuberculosis
QAQSECIDTGI

SEQ ID NO: 32273 - protein, 11 aa, Mycobacterium tuberculosis
AQSECIDTGIA

SEQ ID NO: 32274 - protein, 11 aa, Mycobacterium tuberculosis
QSECIDTGIAH

SEQ ID NO: 32275 - protein, 11 aa, Mycobacterium tuberculosis
SECIDTGIAHV

SEQ ID NO: 32276 - protein, 11 aa, Mycobacterium tuberculosis
ECIDTGIAHVR

SEQ ID NO: 32277 - protein, 11 aa, Mycobacterium tuberculosis
CIDTGIAHVRD

SEQ ID NO: 32278 - protein, 11 aa, Mycobacterium tuberculosis
IDTGIAHVRDV

SEQ ID NO: 32279 - protein, 11 aa, Mycobacterium tuberculosis
DTGIAHVRDVV

SEQ ID NO: 32280 - protein, 11 aa, Mycobacterium tuberculosis
TGIAHVRDVVM

SEQ ID NO: 32281 - protein, 11 aa, Mycobacterium tuberculosis
GIAHVRDVVMP

SEQ ID NO: 32282 - protein, 11 aa, Mycobacterium tuberculosis
IAHVRDVVMPA

SEQ ID NO: 32283 - protein, 11 aa, Mycobacterium tuberculosis
AHVRDVVMPAL

SEQ ID NO: 32284 - protein, 11 aa, Mycobacterium tuberculosis
HVRDVVMPALQ

SEQ ID NO: 32285 - protein, 11 aa, Mycobacterium tuberculosis
VRDVVMPALQG

SEQ ID NO: 32286 - protein, 11 aa, Mycobacterium tuberculosis
RDVVMPALQGM

SEQ ID NO: 32287 - protein, 11 aa, Mycobacterium tuberculosis
DVVMPALQGMD

SEQ ID NO: 32288 - protein, 11 aa, Mycobacterium tuberculosis
VVMPALQGMDG

SEQ ID NO: 32289 - protein, 11 aa, Mycobacterium tuberculosis
VMPALQGMDGC

SEQ ID NO: 32290 - protein, 11 aa, Mycobacterium tuberculosis
MPALQGMDGCI

SEQ ID NO: 32291 - protein, 11 aa, Mycobacterium tuberculosis
PALQGMDGCIG

SEQ ID NO: 32292 - protein, 11 aa, Mycobacterium tuberculosis
ALQGMDGCIGV

SEQ ID NO: 32293 - protein, 11 aa, Mycobacterium tuberculosis
LQGMDGCIGVS

SEQ ID NO: 32294 - protein, 11 aa, Mycobacterium tuberculosis
QGMDGCIGVSL

SEQ ID NO: 32295 - protein, 11 aa, Mycobacterium tuberculosis
GMDGCIGVSLL

SEQ ID NO: 32296 - protein, 11 aa, Mycobacterium tuberculosis
MDGCIGVSLLV

SEQ ID NO: 32297 - protein, 11 aa, Mycobacterium tuberculosis
DGCIGVSLLVD

SEQ ID NO: 32298 - protein, 11 aa, Mycobacterium tuberculosis
GCIGVSLLVDR

SEQ ID NO: 32299 - protein, 11 aa, Mycobacterium tuberculosis
CIGVSLLVDRQ

SEQ ID NO: 32300 - protein, 11 aa, Mycobacterium tuberculosis
IGVSLLVDRQS

SEQ ID NO: 32301 - protein, 11 aa, Mycobacterium tuberculosis
GVSLLVDRQSG

SEQ ID NO: 32302 - protein, 11 aa, Mycobacterium tuberculosis
VSLLVDRQSGR

SEQ ID NO: 32303 - protein, 11 aa, Mycobacterium tuberculosis
SLLVDRQSGRC

SEQ ID NO: 32304 - protein, 11 aa, Mycobacterium tuberculosis
LLVDRQSGRCI

SEQ ID NO: 32305 - protein, 11 aa, Mycobacterium tuberculosis
LVDRQSGRCIA

SEQ ID NO: 32306 - protein, 11 aa, Mycobacterium tuberculosis
VDRQSGRCIAT

SEQ ID NO: 32307 - protein, 11 aa, Mycobacterium tuberculosis
DRQSGRCIATS

SEQ ID NO: 32308 - protein, 11 aa, Mycobacterium tuberculosis
RQSGRCIATSA

SEQ ID NO: 32309 - protein, 11 aa, Mycobacterium tuberculosis
QSGRCIATSAW

SEQ ID NO: 32310 - protein, 11 aa, Mycobacterium tuberculosis
SGRCIATSAWE

SEQ ID NO: 32311 - protein, 11 aa, Mycobacterium tuberculosis
GRCIATSAWET

SEQ ID NO: 32312 - protein, 11 aa, Mycobacterium tuberculosis
RCIATSAWETA

SEQ ID NO: 32313 - protein, 11 aa, Mycobacterium tuberculosis
CIATSAWETAE

SEQ ID NO: 32314 - protein, 11 aa, Mycobacterium tuberculosis
IATSAWETAEA

SEQ ID NO: 32315 - protein, 11 aa, Mycobacterium tuberculosis
ATSAWETAEAM

SEQ ID NO: 32316 - protein, 11 aa, Mycobacterium tuberculosis
TSAWETAEAMH

SEQ ID NO: 32317 - protein, 11 aa, Mycobacterium tuberculosis
SAWETAEAMHA

SEQ ID NO: 32318 - protein, 11 aa, Mycobacterium tuberculosis
AWETAEAMHAS

SEQ ID NO: 32319 - protein, 11 aa, Mycobacterium tuberculosis
WETAEAMHASR

SEQ ID NO: 32320 - protein, 11 aa, Mycobacterium tuberculosis
ETAEAMHASRE

SEQ ID NO: 32321 - protein, 11 aa, Mycobacterium tuberculosis
TAEAMHASREQ

SEQ ID NO: 32322 - protein, 11 aa, Mycobacterium tuberculosis
AEAMHASREQV

SEQ ID NO: 32323 - protein, 11 aa, Mycobacterium tuberculosis
EAMHASREQVT

SEQ ID NO: 32324 - protein, 11 aa, Mycobacterium tuberculosis
AMHASREQVTP

SEQ ID NO: 32325 - protein, 11 aa, Mycobacterium tuberculosis
MHASREQVTPI

SEQ ID NO: 32326 - protein, 11 aa, Mycobacterium tuberculosis
HASREQVTPIR

SEQ ID NO: 32327 - protein, 11 aa, Mycobacterium tuberculosis
ASREQVTPIRD

SEQ ID NO: 32328 - protein, 11 aa, Mycobacterium tuberculosis
SREQVTPIRDR

SEQ ID NO: 32329 - protein, 11 aa, Mycobacterium tuberculosis
REQVTPIRDRC

SEQ ID NO: 32330 - protein, 11 aa, Mycobacterium tuberculosis
EQVTPIRDRCA

SEQ ID NO: 32331 - protein, 11 aa, Mycobacterium tuberculosis
QVTPIRDRCAE

SEQ ID NO: 32332 - protein, 11 aa, Mycobacterium tuberculosis
VTPIRDRCAEM

SEQ ID NO: 32333 - protein, 11 aa, Mycobacterium tuberculosis
TPIRDRCAEMF

SEQ ID NO: 32334 - protein, 11 aa, Mycobacterium tuberculosis
PIRDRCAEMFG

SEQ ID NO: 32335 - protein, 11 aa, Mycobacterium tuberculosis
IRDRCAEMFGG

SEQ ID NO: 32336 - protein, 11 aa, Mycobacterium tuberculosis
RDRCAEMFGGT

SEQ ID NO: 32337 - protein, 11 aa, Mycobacterium tuberculosis
DRCAEMFGGTP

SEQ ID NO: 32338 - protein, 11 aa, Mycobacterium tuberculosis
RCAEMFGGTPA

SEQ ID NO: 32339 - protein, 11 aa, Mycobacterium tuberculosis
CAEMFGGTPAV

SEQ ID NO: 32340 - protein, 11 aa, Mycobacterium tuberculosis
AEMFGGTPAVE

SEQ ID NO: 32341 - protein, 11 aa, Mycobacterium tuberculosis
EMFGGTPAVEE

SEQ ID NO: 32342 - protein, 11 aa, Mycobacterium tuberculosis
MFGGTPAVEEW

SEQ ID NO: 32343 - protein, 11 aa, Mycobacterium tuberculosis
FGGTPAVEEWE

SEQ ID NO: 32344 - protein, 11 aa, Mycobacterium tuberculosis
GGTPAVEEWEI

SEQ ID NO: 32345 - protein, 11 aa, Mycobacterium tuberculosis
GTPAVEEWEIA

SEQ ID NO: 32346 - protein, 11 aa, Mycobacterium tuberculosis
TPAVEEWEIAA

SEQ ID NO: 32347 - protein, 11 aa, Mycobacterium tuberculosis
PAVEEWEIAAM

SEQ ID NO: 32348 - protein, 11 aa, Mycobacterium tuberculosis
AVEEWEIAAMH

SEQ ID NO: 32349 - protein, 11 aa, Mycobacterium tuberculosis
VEEWEIAAMHR

SEQ ID NO: 32350 - protein, 11 aa, Mycobacterium tuberculosis
EEWEIAAMHRD

SEQ ID NO: 32351 - protein, 11 aa, Mycobacterium tuberculosis
EWEIAAMHRDH

SEQ ID NO: 32352 - protein, 11 aa, Mycobacterium tuberculosis
WEIAAMHRDHR

SEQ ID NO: 32353 - protein, 11 aa, Mycobacterium tuberculosis
EIAAMHRDHRS

SEQ ID NO: 32354 - protein, 11 aa, Mycobacterium tuberculosis
IAAMHRDHRSA

SEQ ID NO: 32355 - protein, 11 aa, Mycobacterium tuberculosis
AAMHRDHRSAE

SEQ ID NO: 32356 - protein, 11 aa, Mycobacterium tuberculosis
AMHRDHRSAEG

SEQ ID NO: 32357 - protein, 11 aa, Mycobacterium tuberculosis
MHRDHRSAEGA

SEQ ID NO: 32358 - protein, 11 aa, Mycobacterium tuberculosis
HRDHRSAEGAC

SEQ ID NO: 32359 - protein, 11 aa, Mycobacterium tuberculosis
RDHRSAEGACV

SEQ ID NO: 32360 - protein, 11 aa, Mycobacterium tuberculosis
DHRSAEGACVR

SEQ ID NO: 32361 - protein, 11 aa, Mycobacterium tuberculosis
HRSAEGACVRA

SEQ ID NO: 32362 - protein, 11 aa, Mycobacterium tuberculosis
RSAEGACVRAT

SEQ ID NO: 32363 - protein, 11 aa, Mycobacterium tuberculosis
SAEGACVRATW

SEQ ID NO: 32364 - protein, 11 aa, Mycobacterium tuberculosis
AEGACVRATWV

SEQ ID NO: 32365 - protein, 11 aa, Mycobacterium tuberculosis
EGACVRATWVK

SEQ ID NO: 32366 - protein, 11 aa, Mycobacterium tuberculosis
GACVRATWVKV

SEQ ID NO: 32367 - protein, 11 aa, Mycobacterium tuberculosis
ACVRATWVKVP

SEQ ID NO: 32368 - protein, 11 aa, Mycobacterium tuberculosis
CVRATWVKVPA

SEQ ID NO: 32369 - protein, 11 aa, Mycobacterium tuberculosis
VRATWVKVPAD

SEQ ID NO: 32370 - protein, 11 aa, Mycobacterium tuberculosis
RATWVKVPADQ

SEQ ID NO: 32371 - protein, 11 aa, Mycobacterium tuberculosis
ATWVKVPADQV

SEQ ID NO: 32372 - protein, 11 aa, Mycobacterium tuberculosis
TWVKVPADQVD

SEQ ID NO: 32373 - protein, 11 aa, Mycobacterium tuberculosis
WVKVPADQVDQ

SEQ ID NO: 32374 - protein, 11 aa, Mycobacterium tuberculosis
VKVPADQVDQG

SEQ ID NO: 32375 - protein, 11 aa, Mycobacterium tuberculosis
KVPADQVDQGI

SEQ ID NO: 32376 - protein, 11 aa, Mycobacterium tuberculosis
VPADQVDQGIE

SEQ ID NO: 32377 - protein, 11 aa, Mycobacterium tuberculosis
PADQVDQGIEY

SEQ ID NO: 32378 - protein, 11 aa, Mycobacterium tuberculosis
ADQVDQGIEYY

SEQ ID NO: 32379 - protein, 11 aa, Mycobacterium tuberculosis
DQVDQGIEYYK

SEQ ID NO: 32380 - protein, 11 aa, Mycobacterium tuberculosis
QVDQGIEYYKS

SEQ ID NO: 32381 - protein, 11 aa, Mycobacterium tuberculosis
VDQGIEYYKSS

SEQ ID NO: 32382 - protein, 11 aa, Mycobacterium tuberculosis
DQGIEYYKSSV

SEQ ID NO: 32383 - protein, 11 aa, Mycobacterium tuberculosis
QGIEYYKSSVL

SEQ ID NO: 32384 - protein, 11 aa, Mycobacterium tuberculosis
GIEYYKSSVLP

SEQ ID NO: 32385 - protein, 11 aa, Mycobacterium tuberculosis
IEYYKSSVLPQ

SEQ ID NO: 32386 - protein, 11 aa, Mycobacterium tuberculosis
EYYKSSVLPQI

SEQ ID NO: 32387 - protein, 11 aa, Mycobacterium tuberculosis
YYKSSVLPQIE

SEQ ID NO: 32388 - protein, 11 aa, Mycobacterium tuberculosis
YKSSVLPQIEG

SEQ ID NO: 32389 - protein, 11 aa, Mycobacterium tuberculosis
KSSVLPQIEGL

SEQ ID NO: 32390 - protein, 11 aa, Mycobacterium tuberculosis
SSVLPQIEGLD

SEQ ID NO: 32391 - protein, 11 aa, Mycobacterium tuberculosis
SVLPQIEGLDG

SEQ ID NO: 32392 - protein, 11 aa, Mycobacterium tuberculosis
VLPQIEGLDGF

SEQ ID NO: 32393 - protein, 11 aa, Mycobacterium tuberculosis
LPQIEGLDGFC

SEQ ID NO: 32394 - protein, 11 aa, Mycobacterium tuberculosis
PQIEGLDGFCS

SEQ ID NO: 32395 - protein, 11 aa, Mycobacterium tuberculosis
QIEGLDGFCSA

SEQ ID NO: 32396 - protein, 11 aa, Mycobacterium tuberculosis
IEGLDGFCSAS

SEQ ID NO: 32397 - protein, 11 aa, Mycobacterium tuberculosis
EGLDGFCSASL

SEQ ID NO: 32398 - protein, 11 aa, Mycobacterium tuberculosis
GLDGFCSASLL

SEQ ID NO: 32399 - protein, 11 aa, Mycobacterium tuberculosis
LDGFCSASLLV

SEQ ID NO: 32400 - protein, 11 aa, Mycobacterium tuberculosis
DGFCSASLLVD

SEQ ID NO: 32401 - protein, 11 aa, Mycobacterium tuberculosis
GFCSASLLVDR

SEQ ID NO: 32402 - protein, 11 aa, Mycobacterium tuberculosis
FCSASLLVDRT

SEQ ID NO: 32403 - protein, 11 aa, Mycobacterium tuberculosis
CSASLLVDRTS

SEQ ID NO: 32404 - protein, 11 aa, Mycobacterium tuberculosis
SASLLVDRTSG

SEQ ID NO: 32405 - protein, 11 aa, Mycobacterium tuberculosis
ASLLVDRTSGR

SEQ ID NO: 32406 - protein, 11 aa, Mycobacterium tuberculosis
SLLVDRTSGRA

SEQ ID NO: 32407 - protein, 11 aa, Mycobacterium tuberculosis
LLVDRTSGRAV

SEQ ID NO: 32408 - protein, 11 aa, Mycobacterium tuberculosis
LVDRTSGRAVS

SEQ ID NO: 32409 - protein, 11 aa, Mycobacterium tuberculosis
VDRTSGRAVSS

SEQ ID NO: 32410 - protein, 11 aa, Mycobacterium tuberculosis
DRTSGRAVSSA

SEQ ID NO: 32411 - protein, 11 aa, Mycobacterium tuberculosis
RTSGRAVSSAT

SEQ ID NO: 32412 - protein, 11 aa, Mycobacterium tuberculosis
TSGRAVSSATF

SEQ ID NO: 32413 - protein, 11 aa, Mycobacterium tuberculosis
SGRAVSSATFD

SEQ ID NO: 32414 - protein, 11 aa, Mycobacterium tuberculosis
GRAVSSATFDS

SEQ ID NO: 32415 - protein, 11 aa, Mycobacterium tuberculosis
RAVSSATFDSF

SEQ ID NO: 32416 - protein, 11 aa, Mycobacterium tuberculosis
AVSSATFDSFD

SEQ ID NO: 32417 - protein, 11 aa, Mycobacterium tuberculosis
VSSATFDSFDA

SEQ ID NO: 32418 - protein, 11 aa, Mycobacterium tuberculosis
SSATFDSFDAM

SEQ ID NO: 32419 - protein, 11 aa, Mycobacterium tuberculosis
SATFDSFDAME

SEQ ID NO: 32420 - protein, 11 aa, Mycobacterium tuberculosis
ATFDSFDAMER

SEQ ID NO: 32421 - protein, 11 aa, Mycobacterium tuberculosis
TFDSFDAMERN

SEQ ID NO: 32422 - protein, 11 aa, Mycobacterium tuberculosis
FDSFDAMERNR

SEQ ID NO: 32423 - protein, 11 aa, Mycobacterium tuberculosis
DSFDAMERNRD

SEQ ID NO: 32424 - protein, 11 aa, Mycobacterium tuberculosis
SFDAMERNRDQ

SEQ ID NO: 32425 - protein, 11 aa, Mycobacterium tuberculosis
FDAMERNRDQS

SEQ ID NO: 32426 - protein, 11 aa, Mycobacterium tuberculosis
DAMERNRDQSN

SEQ ID NO: 32427 - protein, 11 aa, Mycobacterium tuberculosis
AMERNRDQSNA

SEQ ID NO: 32428 - protein, 11 aa, Mycobacterium tuberculosis
MERNRDQSNAL

SEQ ID NO: 32429 - protein, 11 aa, Mycobacterium tuberculosis
ERNRDQSNALK

SEQ ID NO: 32430 - protein, 11 aa, Mycobacterium tuberculosis
RNRDQSNALKA

SEQ ID NO: 32431 - protein, 11 aa, Mycobacterium tuberculosis
NRDQSNALKAT

SEQ ID NO: 32432 - protein, 11 aa, Mycobacterium tuberculosis
RDQSNALKATS

SEQ ID NO: 32433 - protein, 11 aa, Mycobacterium tuberculosis
DQSNALKATSL

SEQ ID NO: 32434 - protein, 11 aa, Mycobacterium tuberculosis
QSNALKATSLR

SEQ ID NO: 32435 - protein, 11 aa, Mycobacterium tuberculosis
SNALKATSLRE

SEQ ID NO: 32436 - protein, 11 aa, Mycobacterium tuberculosis
NALKATSLREA

SEQ ID NO: 32437 - protein, 11 aa, Mycobacterium tuberculosis
ALKATSLREAG

SEQ ID NO: 32438 - protein, 11 aa, Mycobacterium tuberculosis
LKATSLREAGG

SEQ ID NO: 32439 - protein, 11 aa, Mycobacterium tuberculosis
KATSLREAGGE

SEQ ID NO: 32440 - protein, 11 aa, Mycobacterium tuberculosis
ATSLREAGGEE

SEQ ID NO: 32441 - protein, 11 aa, Mycobacterium tuberculosis
TSLREAGGEEL

SEQ ID NO: 32442 - protein, 11 aa, Mycobacterium tuberculosis
SLREAGGEELD

SEQ ID NO: 32443 - protein, 11 aa, Mycobacterium tuberculosis
LREAGGEELDE

SEQ ID NO: 32444 - protein, 11 aa, Mycobacterium tuberculosis
REAGGEELDEC

SEQ ID NO: 32445 - protein, 11 aa, Mycobacterium tuberculosis
EAGGEELDECE

SEQ ID NO: 32446 - protein, 11 aa, Mycobacterium tuberculosis
AGGEELDECEF

SEQ ID NO: 32447 - protein, 11 aa, Mycobacterium tuberculosis
GGEELDECEFE

SEQ ID NO: 32448 - protein, 11 aa, Mycobacterium tuberculosis
GEELDECEFEL

SEQ ID NO: 32449 - protein, 11 aa, Mycobacterium tuberculosis
EELDECEFELA

SEQ ID NO: 32450 - protein, 11 aa, Mycobacterium tuberculosis
ELDECEFELAL

SEQ ID NO: 32451 - protein, 11 aa, Mycobacterium tuberculosis
LDECEFELALA

SEQ ID NO: 32452 - protein, 11 aa, Mycobacterium tuberculosis
DECEFELALAH

SEQ ID NO: 32453 - protein, 11 aa, Mycobacterium tuberculosis
ECEFELALAHL

SEQ ID NO: 32454 - protein, 11 aa, Mycobacterium tuberculosis
CEFELALAHLR

SEQ ID NO: 32455 - protein, 11 aa, Mycobacterium tuberculosis
EFELALAHLRV

SEQ ID NO: 32456 - protein, 11 aa, Mycobacterium tuberculosis
FELALAHLRVP

SEQ ID NO: 32457 - protein, 11 aa, Mycobacterium tuberculosis
ELALAHLRVPE

SEQ ID NO: 32458 - protein, 11 aa, Mycobacterium tuberculosis
LALAHLRVPEL

SEQ ID NO: 32459 - protein, 11 aa, Mycobacterium tuberculosis
ALAHLRVPELV

SEQ ID NO: 32460 - protein, 8 aa, Mycobacterium tuberculosis
MPGSAGWR

SEQ ID NO: 32461 - protein, 8 aa, Mycobacterium tuberculosis
PGSAGWRK

SEQ ID NO: 32462 - protein, 8 aa, Mycobacterium tuberculosis
GSAGWRKV

SEQ ID NO: 32463 - protein, 8 aa, Mycobacterium tuberculosis
SAGWRKVF

SEQ ID NO: 32464 - protein, 8 aa, Mycobacterium tuberculosis
AGWRKVFG

SEQ ID NO: 32465 - protein, 8 aa, Mycobacterium tuberculosis
GWRKVFGG

SEQ ID NO: 32466 - protein, 8 aa, Mycobacterium tuberculosis
WRKVFGGT

SEQ ID NO: 32467 - protein, 8 aa, Mycobacterium tuberculosis
RKVFGGTG

SEQ ID NO: 32468 - protein, 8 aa, Mycobacterium tuberculosis
KVFGGTGG

SEQ ID NO: 32469 - protein, 8 aa, Mycobacterium tuberculosis
VFGGTGGA

SEQ ID NO: 32470 - protein, 8 aa, Mycobacterium tuberculosis
FGGTGGAT

SEQ ID NO: 32471 - protein, 8 aa, Mycobacterium tuberculosis
GGTGGATG

SEQ ID NO: 32472 - protein, 8 aa, Mycobacterium tuberculosis
GTGGATGA

SEQ ID NO: 32473 - protein, 8 aa, Mycobacterium tuberculosis
TGGATGAL

SEQ ID NO: 32474 - protein, 8 aa, Mycobacterium tuberculosis
GGATGALP

SEQ ID NO: 32475 - protein, 8 aa, Mycobacterium tuberculosis
GATGALPR

SEQ ID NO: 32476 - protein, 8 aa, Mycobacterium tuberculosis
ATGALPRH

SEQ ID NO: 32477 - protein, 8 aa, Mycobacterium tuberculosis
TGALPRHG

SEQ ID NO: 32478 - protein, 8 aa, Mycobacterium tuberculosis
GALPRHGR

SEQ ID NO: 32479 - protein, 8 aa, Mycobacterium tuberculosis
ALPRHGRG

SEQ ID NO: 32480 - protein, 8 aa, Mycobacterium tuberculosis
LPRHGRGS

SEQ ID NO: 32481 - protein, 8 aa, Mycobacterium tuberculosis
PRHGRGSI

SEQ ID NO: 32482 - protein, 8 aa, Mycobacterium tuberculosis
RHGRGSIV

SEQ ID NO: 32483 - protein, 8 aa, Mycobacterium tuberculosis
HGRGSIVY

SEQ ID NO: 32484 - protein, 8 aa, Mycobacterium tuberculosis
GRGSIVYA

SEQ ID NO: 32485 - protein, 8 aa, Mycobacterium tuberculosis
RGSIVYAR

SEQ ID NO: 32486 - protein, 8 aa, Mycobacterium tuberculosis
GSIVYARS

SEQ ID NO: 32487 - protein, 8 aa, Mycobacterium tuberculosis
SIVYARST

SEQ ID NO: 32488 - protein, 8 aa, Mycobacterium tuberculosis
IVYARSTT

SEQ ID NO: 32489 - protein, 8 aa, Mycobacterium tuberculosis
VYARSTTI

SEQ ID NO: 32490 - protein, 8 aa, Mycobacterium tuberculosis
YARSTTIE

SEQ ID NO: 32491 - protein, 8 aa, Mycobacterium tuberculosis
ARSTTIEA

SEQ ID NO: 32492 - protein, 8 aa, Mycobacterium tuberculosis
RSTTIEAQ

SEQ ID NO: 32493 - protein, 8 aa, Mycobacterium tuberculosis
STTIEAQP

SEQ ID NO: 32494 - protein, 8 aa, Mycobacterium tuberculosis
TTIEAQPL

SEQ ID NO: 32495 - protein, 8 aa, Mycobacterium tuberculosis
TIEAQPLS

SEQ ID NO: 32496 - protein, 8 aa, Mycobacterium tuberculosis
IEAQPLSV

SEQ ID NO: 32497 - protein, 8 aa, Mycobacterium tuberculosis
EAQPLSVD

SEQ ID NO: 32498 - protein, 8 aa, Mycobacterium tuberculosis
AQPLSVDI

SEQ ID NO: 32499 - protein, 8 aa, Mycobacterium tuberculosis
QPLSVDIG

SEQ ID NO: 32500 - protein, 8 aa, Mycobacterium tuberculosis
PLSVDIGI

SEQ ID NO: 32501 - protein, 8 aa, Mycobacterium tuberculosis
LSVDIGIA

SEQ ID NO: 32502 - protein, 8 aa, Mycobacterium tuberculosis
SVDIGIAH

SEQ ID NO: 32503 - protein, 8 aa, Mycobacterium tuberculosis
VDIGIAHV

SEQ ID NO: 32504 - protein, 8 aa, Mycobacterium tuberculosis
DIGIAHVR

SEQ ID NO: 32505 - protein, 8 aa, Mycobacterium tuberculosis
IGIAHVRD

SEQ ID NO: 32506 - protein, 8 aa, Mycobacterium tuberculosis
GIAHVRDV

SEQ ID NO: 32507 - protein, 8 aa, Mycobacterium tuberculosis
IAHVRDVV

SEQ ID NO: 32508 - protein, 8 aa, Mycobacterium tuberculosis
AHVRDVVM

SEQ ID NO: 32509 - protein, 8 aa, Mycobacterium tuberculosis
HVRDVVMP

SEQ ID NO: 32510 - protein, 8 aa, Mycobacterium tuberculosis
VRDVVMPA

SEQ ID NO: 32511 - protein, 8 aa, Mycobacterium tuberculosis
RDVVMPAL

SEQ ID NO: 32512 - protein, 8 aa, Mycobacterium tuberculosis
DVVMPALQ

SEQ ID NO: 32513 - protein, 8 aa, Mycobacterium tuberculosis
VVMPALQE

SEQ ID NO: 32514 - protein, 8 aa, Mycobacterium tuberculosis
VMPALQEI

SEQ ID NO: 32515 - protein, 8 aa, Mycobacterium tuberculosis
MPALQEID

SEQ ID NO: 32516 - protein, 8 aa, Mycobacterium tuberculosis
PALQEIDG

SEQ ID NO: 32517 - protein, 8 aa, Mycobacterium tuberculosis
ALQEIDGC

SEQ ID NO: 32518 - protein, 8 aa, Mycobacterium tuberculosis
LQEIDGCV

SEQ ID NO: 32519 - protein, 8 aa, Mycobacterium tuberculosis
QEIDGCVG

SEQ ID NO: 32520 - protein, 8 aa, Mycobacterium tuberculosis
EIDGCVGV

SEQ ID NO: 32521 - protein, 8 aa, Mycobacterium tuberculosis
IDGCVGVS

SEQ ID NO: 32522 - protein, 8 aa, Mycobacterium tuberculosis
DGCVGVSL

SEQ ID NO: 32523 - protein, 8 aa, Mycobacterium tuberculosis
GCVGVSLL

SEQ ID NO: 32524 - protein, 8 aa, Mycobacterium tuberculosis
CVGVSLLV

SEQ ID NO: 32525 - protein, 8 aa, Mycobacterium tuberculosis
VGVSLLVD

SEQ ID NO: 32526 - protein, 8 aa, Mycobacterium tuberculosis
GVSLLVDR

SEQ ID NO: 32527 - protein, 8 aa, Mycobacterium tuberculosis
VSLLVDRQ

SEQ ID NO: 32528 - protein, 8 aa, Mycobacterium tuberculosis
SLLVDRQS

SEQ ID NO: 32529 - protein, 8 aa, Mycobacterium tuberculosis
LLVDRQSG

SEQ ID NO: 32530 - protein, 8 aa, Mycobacterium tuberculosis
LVDRQSGR

SEQ ID NO: 32531 - protein, 8 aa, Mycobacterium tuberculosis
VDRQSGRC

SEQ ID NO: 32532 - protein, 8 aa, Mycobacterium tuberculosis
DRQSGRCI

SEQ ID NO: 32533 - protein, 8 aa, Mycobacterium tuberculosis
RQSGRCIA

SEQ ID NO: 32534 - protein, 8 aa, Mycobacterium tuberculosis
QSGRCIAT

SEQ ID NO: 32535 - protein, 8 aa, Mycobacterium tuberculosis
SGRCIATS

SEQ ID NO: 32536 - protein, 8 aa, Mycobacterium tuberculosis
GRCIATSA

SEQ ID NO: 32537 - protein, 8 aa, Mycobacterium tuberculosis
RCIATSAW

SEQ ID NO: 32538 - protein, 8 aa, Mycobacterium tuberculosis
CIATSAWE

SEQ ID NO: 32539 - protein, 8 aa, Mycobacterium tuberculosis
IATSAWET

SEQ ID NO: 32540 - protein, 8 aa, Mycobacterium tuberculosis
ATSAWETL

SEQ ID NO: 32541 - protein, 8 aa, Mycobacterium tuberculosis
TSAWETLE

SEQ ID NO: 32542 - protein, 8 aa, Mycobacterium tuberculosis
SAWETLEA

SEQ ID NO: 32543 - protein, 8 aa, Mycobacterium tuberculosis
AWETLEAM

SEQ ID NO: 32544 - protein, 8 aa, Mycobacterium tuberculosis
WETLEAMR

SEQ ID NO: 32545 - protein, 8 aa, Mycobacterium tuberculosis
ETLEAMRA

SEQ ID NO: 32546 - protein, 8 aa, Mycobacterium tuberculosis
TLEAMRAS

SEQ ID NO: 32547 - protein, 8 aa, Mycobacterium tuberculosis
LEAMRASV

SEQ ID NO: 32548 - protein, 8 aa, Mycobacterium tuberculosis
EAMRASVE

SEQ ID NO: 32549 - protein, 8 aa, Mycobacterium tuberculosis
AMRASVER

SEQ ID NO: 32550 - protein, 8 aa, Mycobacterium tuberculosis
MRASVERV

SEQ ID NO: 32551 - protein, 8 aa, Mycobacterium tuberculosis
RASVERVA

SEQ ID NO: 32552 - protein, 8 aa, Mycobacterium tuberculosis
ASVERVAP

SEQ ID NO: 32553 - protein, 8 aa, Mycobacterium tuberculosis
SVERVAPI

SEQ ID NO: 32554 - protein, 8 aa, Mycobacterium tuberculosis
VERVAPIR

SEQ ID NO: 32555 - protein, 8 aa, Mycobacterium tuberculosis
ERVAPIRD

SEQ ID NO: 32556 - protein, 8 aa, Mycobacterium tuberculosis
RVAPIRDR

SEQ ID NO: 32557 - protein, 8 aa, Mycobacterium tuberculosis
VAPIRDRA

SEQ ID NO: 32558 - protein, 8 aa, Mycobacterium tuberculosis
APIRDRAA

SEQ ID NO: 32559 - protein, 8 aa, Mycobacterium tuberculosis
PIRDRAAL

SEQ ID NO: 32560 - protein, 8 aa, Mycobacterium tuberculosis
IRDRAALM

SEQ ID NO: 32561 - protein, 8 aa, Mycobacterium tuberculosis
RDRAALMF

SEQ ID NO: 32562 - protein, 8 aa, Mycobacterium tuberculosis
DRAALMFA

SEQ ID NO: 32563 - protein, 8 aa, Mycobacterium tuberculosis
RAALMFAG

SEQ ID NO: 32564 - protein, 8 aa, Mycobacterium tuberculosis
AALMFAGS

SEQ ID NO: 32565 - protein, 8 aa, Mycobacterium tuberculosis
ALMFAGSA

SEQ ID NO: 32566 - protein, 8 aa, Mycobacterium tuberculosis
LMFAGSAR

SEQ ID NO: 32567 - protein, 8 aa, Mycobacterium tuberculosis
MFAGSARV

SEQ ID NO: 32568 - protein, 8 aa, Mycobacterium tuberculosis
FAGSARVE

SEQ ID NO: 32569 - protein, 8 aa, Mycobacterium tuberculosis
AGSARVEE

SEQ ID NO: 32570 - protein, 8 aa, Mycobacterium tuberculosis
GSARVEEW

SEQ ID NO: 32571 - protein, 8 aa, Mycobacterium tuberculosis
SARVEEWD

SEQ ID NO: 32572 - protein, 8 aa, Mycobacterium tuberculosis
ARVEEWDI

SEQ ID NO: 32573 - protein, 8 aa, Mycobacterium tuberculosis
RVEEWDIA

SEQ ID NO: 32574 - protein, 8 aa, Mycobacterium tuberculosis
VEEWDIAL

SEQ ID NO: 32575 - protein, 8 aa, Mycobacterium tuberculosis
EEWDIALL

SEQ ID NO: 32576 - protein, 8 aa, Mycobacterium tuberculosis
EWDIALLH

SEQ ID NO: 32577 - protein, 8 aa, Mycobacterium tuberculosis
WDIALLHR

SEQ ID NO: 32578 - protein, 8 aa, Mycobacterium tuberculosis
DIALLHRD

SEQ ID NO: 32579 - protein, 8 aa, Mycobacterium tuberculosis
IALLHRDH

SEQ ID NO: 32580 - protein, 8 aa, Mycobacterium tuberculosis
ALLHRDHP

SEQ ID NO: 32581 - protein, 8 aa, Mycobacterium tuberculosis
LLHRDHPS

SEQ ID NO: 32582 - protein, 8 aa, Mycobacterium tuberculosis
LHRDHPSH

SEQ ID NO: 32583 - protein, 8 aa, Mycobacterium tuberculosis
HRDHPSHE

SEQ ID NO: 32584 - protein, 8 aa, Mycobacterium tuberculosis
RDHPSHEG

SEQ ID NO: 32585 - protein, 8 aa, Mycobacterium tuberculosis
DHPSHEGA

SEQ ID NO: 32586 - protein, 8 aa, Mycobacterium tuberculosis
HPSHEGAC

SEQ ID NO: 32587 - protein, 8 aa, Mycobacterium tuberculosis
PSHEGACV

SEQ ID NO: 32588 - protein, 8 aa, Mycobacterium tuberculosis
SHEGACVR

SEQ ID NO: 32589 - protein, 8 aa, Mycobacterium tuberculosis
HEGACVRA

SEQ ID NO: 32590 - protein, 8 aa, Mycobacterium tuberculosis
EGACVRAT

SEQ ID NO: 32591 - protein, 8 aa, Mycobacterium tuberculosis
GACVRATW

SEQ ID NO: 32592 - protein, 8 aa, Mycobacterium tuberculosis
ACVRATWL

SEQ ID NO: 32593 - protein, 8 aa, Mycobacterium tuberculosis
CVRATWLK

SEQ ID NO: 32594 - protein, 8 aa, Mycobacterium tuberculosis
VRATWLKV

SEQ ID NO: 32595 - protein, 8 aa, Mycobacterium tuberculosis
RATWLKVV

SEQ ID NO: 32596 - protein, 8 aa, Mycobacterium tuberculosis
ATWLKVVP

SEQ ID NO: 32597 - protein, 8 aa, Mycobacterium tuberculosis
TWLKVVPD

SEQ ID NO: 32598 - protein, 8 aa, Mycobacterium tuberculosis
WLKVVPDQ

SEQ ID NO: 32599 - protein, 8 aa, Mycobacterium tuberculosis
LKVVPDQL

SEQ ID NO: 32600 - protein, 8 aa, Mycobacterium tuberculosis
KVVPDQLG

SEQ ID NO: 32601 - protein, 8 aa, Mycobacterium tuberculosis
VVPDQLGR

SEQ ID NO: 32602 - protein, 8 aa, Mycobacterium tuberculosis
VPDQLGRS

SEQ ID NO: 32603 - protein, 8 aa, Mycobacterium tuberculosis
PDQLGRSL

SEQ ID NO: 32604 - protein, 8 aa, Mycobacterium tuberculosis
DQLGRSLE

SEQ ID NO: 32605 - protein, 8 aa, Mycobacterium tuberculosis
QLGRSLEF

SEQ ID NO: 32606 - protein, 8 aa, Mycobacterium tuberculosis
LGRSLEFY

SEQ ID NO: 32607 - protein, 8 aa, Mycobacterium tuberculosis
GRSLEFYR

SEQ ID NO: 32608 - protein, 8 aa, Mycobacterium tuberculosis
RSLEFYRT

SEQ ID NO: 32609 - protein, 8 aa, Mycobacterium tuberculosis
SLEFYRTS

SEQ ID NO: 32610 - protein, 8 aa, Mycobacterium tuberculosis
LEFYRTSV

SEQ ID NO: 32611 - protein, 8 aa, Mycobacterium tuberculosis
EFYRTSVL

SEQ ID NO: 32612 - protein, 8 aa, Mycobacterium tuberculosis
FYRTSVLP

SEQ ID NO: 32613 - protein, 8 aa, Mycobacterium tuberculosis
YRTSVLPE

SEQ ID NO: 32614 - protein, 8 aa, Mycobacterium tuberculosis
RTSVLPEL

SEQ ID NO: 32615 - protein, 8 aa, Mycobacterium tuberculosis
TSVLPELE

SEQ ID NO: 32616 - protein, 8 aa, Mycobacterium tuberculosis
SVLPELES

SEQ ID NO: 32617 - protein, 8 aa, Mycobacterium tuberculosis
VLPELESL

SEQ ID NO: 32618 - protein, 8 aa, Mycobacterium tuberculosis
LPELESLD

SEQ ID NO: 32619 - protein, 8 aa, Mycobacterium tuberculosis
PELESLDG

SEQ ID NO: 32620 - protein, 8 aa, Mycobacterium tuberculosis
ELESLDGF

SEQ ID NO: 32621 - protein, 8 aa, Mycobacterium tuberculosis
LESLDGFC

SEQ ID NO: 32622 - protein, 8 aa, Mycobacterium tuberculosis
ESLDGFCS

SEQ ID NO: 32623 - protein, 8 aa, Mycobacterium tuberculosis
SLDGFCSA

SEQ ID NO: 32624 - protein, 8 aa, Mycobacterium tuberculosis
LDGFCSAS

SEQ ID NO: 32625 - protein, 8 aa, Mycobacterium tuberculosis
DGFCSASL

SEQ ID NO: 32626 - protein, 8 aa, Mycobacterium tuberculosis
GFCSASLM

SEQ ID NO: 32627 - protein, 8 aa, Mycobacterium tuberculosis
FCSASLMV

SEQ ID NO: 32628 - protein, 8 aa, Mycobacterium tuberculosis
CSASLMVD

SEQ ID NO: 32629 - protein, 8 aa, Mycobacterium tuberculosis
SASLMVDH

SEQ ID NO: 32630 - protein, 8 aa, Mycobacterium tuberculosis
ASLMVDHP

SEQ ID NO: 32631 - protein, 8 aa, Mycobacterium tuberculosis
SLMVDHPA

SEQ ID NO: 32632 - protein, 8 aa, Mycobacterium tuberculosis
LMVDHPAC

SEQ ID NO: 32633 - protein, 8 aa, Mycobacterium tuberculosis
MVDHPACR

SEQ ID NO: 32634 - protein, 8 aa, Mycobacterium tuberculosis
VDHPACRR

SEQ ID NO: 32635 - protein, 8 aa, Mycobacterium tuberculosis
DHPACRRA

SEQ ID NO: 32636 - protein, 8 aa, Mycobacterium tuberculosis
HPACRRAV

SEQ ID NO: 32637 - protein, 8 aa, Mycobacterium tuberculosis
PACRRAVS

SEQ ID NO: 32638 - protein, 8 aa, Mycobacterium tuberculosis
ACRRAVSC

SEQ ID NO: 32639 - protein, 8 aa, Mycobacterium tuberculosis
CRRAVSCS

SEQ ID NO: 32640 - protein, 8 aa, Mycobacterium tuberculosis
RRAVSCST

SEQ ID NO: 32641 - protein, 8 aa, Mycobacterium tuberculosis
RAVSCSTF

SEQ ID NO: 32642 - protein, 8 aa, Mycobacterium tuberculosis
AVSCSTFD

SEQ ID NO: 32643 - protein, 8 aa, Mycobacterium tuberculosis
VSCSTFDS

SEQ ID NO: 32644 - protein, 8 aa, Mycobacterium tuberculosis
SCSTFDSM

SEQ ID NO: 32645 - protein, 8 aa, Mycobacterium tuberculosis
CSTFDSMD

SEQ ID NO: 32646 - protein, 8 aa, Mycobacterium tuberculosis
STFDSMDA

SEQ ID NO: 32647 - protein, 8 aa, Mycobacterium tuberculosis
TFDSMDAM

SEQ ID NO: 32648 - protein, 8 aa, Mycobacterium tuberculosis
FDSMDAMA

SEQ ID NO: 32649 - protein, 8 aa, Mycobacterium tuberculosis
DSMDAMAR

SEQ ID NO: 32650 - protein, 8 aa, Mycobacterium tuberculosis
SMDAMARN

SEQ ID NO: 32651 - protein, 8 aa, Mycobacterium tuberculosis
MDAMARNR

SEQ ID NO: 32652 - protein, 8 aa, Mycobacterium tuberculosis
DAMARNRD

SEQ ID NO: 32653 - protein, 8 aa, Mycobacterium tuberculosis
AMARNRDR

SEQ ID NO: 32654 - protein, 8 aa, Mycobacterium tuberculosis
MARNRDRA

SEQ ID NO: 32655 - protein, 8 aa, Mycobacterium tuberculosis
ARNRDRAS

SEQ ID NO: 32656 - protein, 8 aa, Mycobacterium tuberculosis
RNRDRASE

SEQ ID NO: 32657 - protein, 8 aa, Mycobacterium tuberculosis
NRDRASEL

SEQ ID NO: 32658 - protein, 8 aa, Mycobacterium tuberculosis
RDRASELR

SEQ ID NO: 32659 - protein, 8 aa, Mycobacterium tuberculosis
DRASELRS

SEQ ID NO: 32660 - protein, 8 aa, Mycobacterium tuberculosis
RASELRSR

SEQ ID NO: 32661 - protein, 8 aa, Mycobacterium tuberculosis
ASELRSRR

SEQ ID NO: 32662 - protein, 8 aa, Mycobacterium tuberculosis
SELRSRRV

SEQ ID NO: 32663 - protein, 8 aa, Mycobacterium tuberculosis
ELRSRRVR

SEQ ID NO: 32664 - protein, 8 aa, Mycobacterium tuberculosis
LRSRRVRE

SEQ ID NO: 32665 - protein, 8 aa, Mycobacterium tuberculosis
RSRRVREL

SEQ ID NO: 32666 - protein, 8 aa, Mycobacterium tuberculosis
SRRVRELG

SEQ ID NO: 32667 - protein, 8 aa, Mycobacterium tuberculosis
RRVRELGA

SEQ ID NO: 32668 - protein, 8 aa, Mycobacterium tuberculosis
RVRELGAE

SEQ ID NO: 32669 - protein, 8 aa, Mycobacterium tuberculosis
VRELGAEV

SEQ ID NO: 32670 - protein, 8 aa, Mycobacterium tuberculosis
RELGAEVL

SEQ ID NO: 32671 - protein, 8 aa, Mycobacterium tuberculosis
ELGAEVLD

SEQ ID NO: 32672 - protein, 8 aa, Mycobacterium tuberculosis
LGAEVLDV

SEQ ID NO: 32673 - protein, 8 aa, Mycobacterium tuberculosis
GAEVLDVA

SEQ ID NO: 32674 - protein, 8 aa, Mycobacterium tuberculosis
AEVLDVAE

SEQ ID NO: 32675 - protein, 8 aa, Mycobacterium tuberculosis
EVLDVAEF

SEQ ID NO: 32676 - protein, 8 aa, Mycobacterium tuberculosis
VLDVAEFE

SEQ ID NO: 32677 - protein, 8 aa, Mycobacterium tuberculosis
LDVAEFEL

SEQ ID NO: 32678 - protein, 8 aa, Mycobacterium tuberculosis
DVAEFELA

SEQ ID NO: 32679 - protein, 8 aa, Mycobacterium tuberculosis
VAEFELAI

SEQ ID NO: 32680 - protein, 8 aa, Mycobacterium tuberculosis
AEFELAIA

SEQ ID NO: 32681 - protein, 8 aa, Mycobacterium tuberculosis
EFELAIAH

SEQ ID NO: 32682 - protein, 8 aa, Mycobacterium tuberculosis
FELAIAHL

SEQ ID NO: 32683 - protein, 8 aa, Mycobacterium tuberculosis
ELAIAHLR

SEQ ID NO: 32684 - protein, 8 aa, Mycobacterium tuberculosis
LAIAHLRV

SEQ ID NO: 32685 - protein, 8 aa, Mycobacterium tuberculosis
AIAHLRVP

SEQ ID NO: 32686 - protein, 8 aa, Mycobacterium tuberculosis
IAHLRVPE

SEQ ID NO: 32687 - protein, 8 aa, Mycobacterium tuberculosis
AHLRVPEL

SEQ ID NO: 32688 - protein, 8 aa, Mycobacterium tuberculosis
HLRVPELV

SEQ ID NO: 32689 - protein, 9 aa, Mycobacterium tuberculosis
MPGSAGWRK

SEQ ID NO: 32690 - protein, 9 aa, Mycobacterium tuberculosis
PGSAGWRKV

SEQ ID NO: 32691 - protein, 9 aa, Mycobacterium tuberculosis
GSAGWRKVF

SEQ ID NO: 32692 - protein, 9 aa, Mycobacterium tuberculosis
SAGWRKVFG

SEQ ID NO: 32693 - protein, 9 aa, Mycobacterium tuberculosis
AGWRKVFGG

SEQ ID NO: 32694 - protein, 9 aa, Mycobacterium tuberculosis
GWRKVFGGT

SEQ ID NO: 32695 - protein, 9 aa, Mycobacterium tuberculosis
WRKVFGGTG

SEQ ID NO: 32696 - protein, 9 aa, Mycobacterium tuberculosis
RKVFGGTGG

SEQ ID NO: 32697 - protein, 9 aa, Mycobacterium tuberculosis
KVFGGTGGA

SEQ ID NO: 32698 - protein, 9 aa, Mycobacterium tuberculosis
VFGGTGGAT

SEQ ID NO: 32699 - protein, 9 aa, Mycobacterium tuberculosis
FGGTGGATG

SEQ ID NO: 32700 - protein, 9 aa, Mycobacterium tuberculosis
GGTGGATGA

SEQ ID NO: 32701 - protein, 9 aa, Mycobacterium tuberculosis
GTGGATGAL

SEQ ID NO: 32702 - protein, 9 aa, Mycobacterium tuberculosis
TGGATGALP

SEQ ID NO: 32703 - protein, 9 aa, Mycobacterium tuberculosis
GGATGALPR

SEQ ID NO: 32704 - protein, 9 aa, Mycobacterium tuberculosis
GATGALPRH

SEQ ID NO: 32705 - protein, 9 aa, Mycobacterium tuberculosis
ATGALPRHG

SEQ ID NO: 32706 - protein, 9 aa, Mycobacterium tuberculosis
TGALPRHGR

SEQ ID NO: 32707 - protein, 9 aa, Mycobacterium tuberculosis
GALPRHGRG

SEQ ID NO: 32708 - protein, 9 aa, Mycobacterium tuberculosis
ALPRHGRGS

SEQ ID NO: 32709 - protein, 9 aa, Mycobacterium tuberculosis
LPRHGRGSI

SEQ ID NO: 32710 - protein, 9 aa, Mycobacterium tuberculosis
PRHGRGSIV

SEQ ID NO: 32711 - protein, 9 aa, Mycobacterium tuberculosis
RHGRGSIVY

SEQ ID NO: 32712 - protein, 9 aa, Mycobacterium tuberculosis
HGRGSIVYA

SEQ ID NO: 32713 - protein, 9 aa, Mycobacterium tuberculosis
GRGSIVYAR

SEQ ID NO: 32714 - protein, 9 aa, Mycobacterium tuberculosis
RGSIVYARS

SEQ ID NO: 32715 - protein, 9 aa, Mycobacterium tuberculosis
GSIVYARST

SEQ ID NO: 32716 - protein, 9 aa, Mycobacterium tuberculosis
SIVYARSTT

SEQ ID NO: 32717 - protein, 9 aa, Mycobacterium tuberculosis
IVYARSTTI

SEQ ID NO: 32718 - protein, 9 aa, Mycobacterium tuberculosis
VYARSTTIE

SEQ ID NO: 32719 - protein, 9 aa, Mycobacterium tuberculosis
YARSTTIEA

SEQ ID NO: 32720 - protein, 9 aa, Mycobacterium tuberculosis
ARSTTIEAQ

SEQ ID NO: 32721 - protein, 9 aa, Mycobacterium tuberculosis
RSTTIEAQP

SEQ ID NO: 32722 - protein, 9 aa, Mycobacterium tuberculosis
STTIEAQPL

SEQ ID NO: 32723 - protein, 9 aa, Mycobacterium tuberculosis
TTIEAQPLS

SEQ ID NO: 32724 - protein, 9 aa, Mycobacterium tuberculosis
TIEAQPLSV

SEQ ID NO: 32725 - protein, 9 aa, Mycobacterium tuberculosis
IEAQPLSVD

SEQ ID NO: 32726 - protein, 9 aa, Mycobacterium tuberculosis
EAQPLSVDI

SEQ ID NO: 32727 - protein, 9 aa, Mycobacterium tuberculosis
AQPLSVDIG

SEQ ID NO: 32728 - protein, 9 aa, Mycobacterium tuberculosis
QPLSVDIGI

SEQ ID NO: 32729 - protein, 9 aa, Mycobacterium tuberculosis
PLSVDIGIA

SEQ ID NO: 32730 - protein, 9 aa, Mycobacterium tuberculosis
LSVDIGIAH

SEQ ID NO: 32731 - protein, 9 aa, Mycobacterium tuberculosis
SVDIGIAHV

SEQ ID NO: 32732 - protein, 9 aa, Mycobacterium tuberculosis
VDIGIAHVR

SEQ ID NO: 32733 - protein, 9 aa, Mycobacterium tuberculosis
DIGIAHVRD

SEQ ID NO: 32734 - protein, 9 aa, Mycobacterium tuberculosis
IGIAHVRDV

SEQ ID NO: 32735 - protein, 9 aa, Mycobacterium tuberculosis
GIAHVRDVV

SEQ ID NO: 32736 - protein, 9 aa, Mycobacterium tuberculosis
IAHVRDVVM

SEQ ID NO: 32737 - protein, 9 aa, Mycobacterium tuberculosis
AHVRDVVMP

SEQ ID NO: 32738 - protein, 9 aa, Mycobacterium tuberculosis
HVRDVVMPA

SEQ ID NO: 32739 - protein, 9 aa, Mycobacterium tuberculosis
VRDVVMPAL

SEQ ID NO: 32740 - protein, 9 aa, Mycobacterium tuberculosis
RDVVMPALQ

SEQ ID NO: 32741 - protein, 9 aa, Mycobacterium tuberculosis
DVVMPALQE

SEQ ID NO: 32742 - protein, 9 aa, Mycobacterium tuberculosis
VVMPALQEI

SEQ ID NO: 32743 - protein, 9 aa, Mycobacterium tuberculosis
VMPALQEID

SEQ ID NO: 32744 - protein, 9 aa, Mycobacterium tuberculosis
MPALQEIDG

SEQ ID NO: 32745 - protein, 9 aa, Mycobacterium tuberculosis
PALQEIDGC

SEQ ID NO: 32746 - protein, 9 aa, Mycobacterium tuberculosis
ALQEIDGCV

SEQ ID NO: 32747 - protein, 9 aa, Mycobacterium tuberculosis
LQEIDGCVG

SEQ ID NO: 32748 - protein, 9 aa, Mycobacterium tuberculosis
QEIDGCVGV

SEQ ID NO: 32749 - protein, 9 aa, Mycobacterium tuberculosis
EIDGCVGVS

SEQ ID NO: 32750 - protein, 9 aa, Mycobacterium tuberculosis
IDGCVGVSL

SEQ ID NO: 32751 - protein, 9 aa, Mycobacterium tuberculosis
DGCVGVSLL

SEQ ID NO: 32752 - protein, 9 aa, Mycobacterium tuberculosis
GCVGVSLLV

SEQ ID NO: 32753 - protein, 9 aa, Mycobacterium tuberculosis
CVGVSLLVD

SEQ ID NO: 32754 - protein, 9 aa, Mycobacterium tuberculosis
VGVSLLVDR

SEQ ID NO: 32755 - protein, 9 aa, Mycobacterium tuberculosis
GVSLLVDRQ

SEQ ID NO: 32756 - protein, 9 aa, Mycobacterium tuberculosis
VSLLVDRQS

SEQ ID NO: 32757 - protein, 9 aa, Mycobacterium tuberculosis
SLLVDRQSG

SEQ ID NO: 32758 - protein, 9 aa, Mycobacterium tuberculosis
LLVDRQSGR

SEQ ID NO: 32759 - protein, 9 aa, Mycobacterium tuberculosis
LVDRQSGRC

SEQ ID NO: 32760 - protein, 9 aa, Mycobacterium tuberculosis
VDRQSGRCI

SEQ ID NO: 32761 - protein, 9 aa, Mycobacterium tuberculosis
DRQSGRCIA

SEQ ID NO: 32762 - protein, 9 aa, Mycobacterium tuberculosis
RQSGRCIAT

SEQ ID NO: 32763 - protein, 9 aa, Mycobacterium tuberculosis
QSGRCIATS

SEQ ID NO: 32764 - protein, 9 aa, Mycobacterium tuberculosis
SGRCIATSA

SEQ ID NO: 32765 - protein, 9 aa, Mycobacterium tuberculosis
GRCIATSAW

SEQ ID NO: 32766 - protein, 9 aa, Mycobacterium tuberculosis
RCIATSAWE

SEQ ID NO: 32767 - protein, 9 aa, Mycobacterium tuberculosis
CIATSAWET

SEQ ID NO: 32768 - protein, 9 aa, Mycobacterium tuberculosis
IATSAWETL

SEQ ID NO: 32769 - protein, 9 aa, Mycobacterium tuberculosis
ATSAWETLE

SEQ ID NO: 32770 - protein, 9 aa, Mycobacterium tuberculosis
TSAWETLEA

SEQ ID NO: 32771 - protein, 9 aa, Mycobacterium tuberculosis
SAWETLEAM

SEQ ID NO: 32772 - protein, 9 aa, Mycobacterium tuberculosis
AWETLEAMR

SEQ ID NO: 32773 - protein, 9 aa, Mycobacterium tuberculosis
WETLEAMRA

SEQ ID NO: 32774 - protein, 9 aa, Mycobacterium tuberculosis
ETLEAMRAS

SEQ ID NO: 32775 - protein, 9 aa, Mycobacterium tuberculosis
TLEAMRASV

SEQ ID NO: 32776 - protein, 9 aa, Mycobacterium tuberculosis
LEAMRASVE

SEQ ID NO: 32777 - protein, 9 aa, Mycobacterium tuberculosis
EAMRASVER

SEQ ID NO: 32778 - protein, 9 aa, Mycobacterium tuberculosis
AMRASVERV

SEQ ID NO: 32779 - protein, 9 aa, Mycobacterium tuberculosis
MRASVERVA

SEQ ID NO: 32780 - protein, 9 aa, Mycobacterium tuberculosis
RASVERVAP

SEQ ID NO: 32781 - protein, 9 aa, Mycobacterium tuberculosis
ASVERVAPI

SEQ ID NO: 32782 - protein, 9 aa, Mycobacterium tuberculosis
SVERVAPIR

SEQ ID NO: 32783 - protein, 9 aa, Mycobacterium tuberculosis
VERVAPIRD

SEQ ID NO: 32784 - protein, 9 aa, Mycobacterium tuberculosis
ERVAPIRDR

SEQ ID NO: 32785 - protein, 9 aa, Mycobacterium tuberculosis
RVAPIRDRA

SEQ ID NO: 32786 - protein, 9 aa, Mycobacterium tuberculosis
VAPIRDRAA

SEQ ID NO: 32787 - protein, 9 aa, Mycobacterium tuberculosis
APIRDRAAL

SEQ ID NO: 32788 - protein, 9 aa, Mycobacterium tuberculosis
PIRDRAALM

SEQ ID NO: 32789 - protein, 9 aa, Mycobacterium tuberculosis
IRDRAALMF

SEQ ID NO: 32790 - protein, 9 aa, Mycobacterium tuberculosis
RDRAALMFA

SEQ ID NO: 32791 - protein, 9 aa, Mycobacterium tuberculosis
DRAALMFAG

SEQ ID NO: 32792 - protein, 9 aa, Mycobacterium tuberculosis
RAALMFAGS

SEQ ID NO: 32793 - protein, 9 aa, Mycobacterium tuberculosis
AALMFAGSA

SEQ ID NO: 32794 - protein, 9 aa, Mycobacterium tuberculosis
ALMFAGSAR

SEQ ID NO: 32795 - protein, 9 aa, Mycobacterium tuberculosis
LMFAGSARV

SEQ ID NO: 32796 - protein, 9 aa, Mycobacterium tuberculosis
MFAGSARVE

SEQ ID NO: 32797 - protein, 9 aa, Mycobacterium tuberculosis
FAGSARVEE

SEQ ID NO: 32798 - protein, 9 aa, Mycobacterium tuberculosis
AGSARVEEW

SEQ ID NO: 32799 - protein, 9 aa, Mycobacterium tuberculosis
GSARVEEWD

SEQ ID NO: 32800 - protein, 9 aa, Mycobacterium tuberculosis
SARVEEWDI

SEQ ID NO: 32801 - protein, 9 aa, Mycobacterium tuberculosis
ARVEEWDIA

SEQ ID NO: 32802 - protein, 9 aa, Mycobacterium tuberculosis
RVEEWDIAL

SEQ ID NO: 32803 - protein, 9 aa, Mycobacterium tuberculosis
VEEWDIALL

SEQ ID NO: 32804 - protein, 9 aa, Mycobacterium tuberculosis
EEWDIALLH

SEQ ID NO: 32805 - protein, 9 aa, Mycobacterium tuberculosis
EWDIALLHR

SEQ ID NO: 32806 - protein, 9 aa, Mycobacterium tuberculosis
WDIALLHRD

SEQ ID NO: 32807 - protein, 9 aa, Mycobacterium tuberculosis
DIALLHRDH

SEQ ID NO: 32808 - protein, 9 aa, Mycobacterium tuberculosis
IALLHRDHP

SEQ ID NO: 32809 - protein, 9 aa, Mycobacterium tuberculosis
ALLHRDHPS

SEQ ID NO: 32810 - protein, 9 aa, Mycobacterium tuberculosis
LLHRDHPSH

SEQ ID NO: 32811 - protein, 9 aa, Mycobacterium tuberculosis
LHRDHPSHE

SEQ ID NO: 32812 - protein, 9 aa, Mycobacterium tuberculosis
HRDHPSHEG

SEQ ID NO: 32813 - protein, 9 aa, Mycobacterium tuberculosis
RDHPSHEGA

SEQ ID NO: 32814 - protein, 9 aa, Mycobacterium tuberculosis
DHPSHEGAC

SEQ ID NO: 32815 - protein, 9 aa, Mycobacterium tuberculosis
HPSHEGACV

SEQ ID NO: 32816 - protein, 9 aa, Mycobacterium tuberculosis
PSHEGACVR

SEQ ID NO: 32817 - protein, 9 aa, Mycobacterium tuberculosis
SHEGACVRA

SEQ ID NO: 32818 - protein, 9 aa, Mycobacterium tuberculosis
HEGACVRAT

SEQ ID NO: 32819 - protein, 9 aa, Mycobacterium tuberculosis
EGACVRATW

SEQ ID NO: 32820 - protein, 9 aa, Mycobacterium tuberculosis
GACVRATWL

SEQ ID NO: 32821 - protein, 9 aa, Mycobacterium tuberculosis
ACVRATWLK

SEQ ID NO: 32822 - protein, 9 aa, Mycobacterium tuberculosis
CVRATWLKV

SEQ ID NO: 32823 - protein, 9 aa, Mycobacterium tuberculosis
VRATWLKVV

SEQ ID NO: 32824 - protein, 9 aa, Mycobacterium tuberculosis
RATWLKVVP

SEQ ID NO: 32825 - protein, 9 aa, Mycobacterium tuberculosis
ATWLKVVPD

SEQ ID NO: 32826 - protein, 9 aa, Mycobacterium tuberculosis
TWLKVVPDQ

SEQ ID NO: 32827 - protein, 9 aa, Mycobacterium tuberculosis
WLKVVPDQL

SEQ ID NO: 32828 - protein, 9 aa, Mycobacterium tuberculosis
LKVVPDQLG

SEQ ID NO: 32829 - protein, 9 aa, Mycobacterium tuberculosis
KVVPDQLGR

SEQ ID NO: 32830 - protein, 9 aa, Mycobacterium tuberculosis
VVPDQLGRS

SEQ ID NO: 32831 - protein, 9 aa, Mycobacterium tuberculosis
VPDQLGRSL

SEQ ID NO: 32832 - protein, 9 aa, Mycobacterium tuberculosis
PDQLGRSLE

SEQ ID NO: 32833 - protein, 9 aa, Mycobacterium tuberculosis
DQLGRSLEF

SEQ ID NO: 32834 - protein, 9 aa, Mycobacterium tuberculosis
QLGRSLEFY

SEQ ID NO: 32835 - protein, 9 aa, Mycobacterium tuberculosis
LGRSLEFYR

SEQ ID NO: 32836 - protein, 9 aa, Mycobacterium tuberculosis
GRSLEFYRT

SEQ ID NO: 32837 - protein, 9 aa, Mycobacterium tuberculosis
RSLEFYRTS

SEQ ID NO: 32838 - protein, 9 aa, Mycobacterium tuberculosis
SLEFYRTSV

SEQ ID NO: 32839 - protein, 9 aa, Mycobacterium tuberculosis
LEFYRTSVL

SEQ ID NO: 32840 - protein, 9 aa, Mycobacterium tuberculosis
EFYRTSVLP

SEQ ID NO: 32841 - protein, 9 aa, Mycobacterium tuberculosis
FYRTSVLPE

SEQ ID NO: 32842 - protein, 9 aa, Mycobacterium tuberculosis
YRTSVLPEL

SEQ ID NO: 32843 - protein, 9 aa, Mycobacterium tuberculosis
RTSVLPELE

SEQ ID NO: 32844 - protein, 9 aa, Mycobacterium tuberculosis
TSVLPELES

SEQ ID NO: 32845 - protein, 9 aa, Mycobacterium tuberculosis
SVLPELESL

SEQ ID NO: 32846 - protein, 9 aa, Mycobacterium tuberculosis
VLPELESLD

SEQ ID NO: 32847 - protein, 9 aa, Mycobacterium tuberculosis
LPELESLDG

SEQ ID NO: 32848 - protein, 9 aa, Mycobacterium tuberculosis
PELESLDGF

SEQ ID NO: 32849 - protein, 9 aa, Mycobacterium tuberculosis
ELESLDGFC

SEQ ID NO: 32850 - protein, 9 aa, Mycobacterium tuberculosis
LESLDGFCS

SEQ ID NO: 32851 - protein, 9 aa, Mycobacterium tuberculosis
ESLDGFCSA

SEQ ID NO: 32852 - protein, 9 aa, Mycobacterium tuberculosis
SLDGFCSAS

SEQ ID NO: 32853 - protein, 9 aa, Mycobacterium tuberculosis
LDGFCSASL

SEQ ID NO: 32854 - protein, 9 aa, Mycobacterium tuberculosis
DGFCSASLM

SEQ ID NO: 32855 - protein, 9 aa, Mycobacterium tuberculosis
GFCSASLMV

SEQ ID NO: 32856 - protein, 9 aa, Mycobacterium tuberculosis
FCSASLMVD

SEQ ID NO: 32857 - protein, 9 aa, Mycobacterium tuberculosis
CSASLMVDH

SEQ ID NO: 32858 - protein, 9 aa, Mycobacterium tuberculosis
SASLMVDHP

SEQ ID NO: 32859 - protein, 9 aa, Mycobacterium tuberculosis
ASLMVDHPA

SEQ ID NO: 32860 - protein, 9 aa, Mycobacterium tuberculosis
SLMVDHPAC

SEQ ID NO: 32861 - protein, 9 aa, Mycobacterium tuberculosis
LMVDHPACR

SEQ ID NO: 32862 - protein, 9 aa, Mycobacterium tuberculosis
MVDHPACRR

SEQ ID NO: 32863 - protein, 9 aa, Mycobacterium tuberculosis
VDHPACRRA

SEQ ID NO: 32864 - protein, 9 aa, Mycobacterium tuberculosis
DHPACRRAV

SEQ ID NO: 32865 - protein, 9 aa, Mycobacterium tuberculosis
HPACRRAVS

SEQ ID NO: 32866 - protein, 9 aa, Mycobacterium tuberculosis
PACRRAVSC

SEQ ID NO: 32867 - protein, 9 aa, Mycobacterium tuberculosis
ACRRAVSCS

SEQ ID NO: 32868 - protein, 9 aa, Mycobacterium tuberculosis
CRRAVSCST

SEQ ID NO: 32869 - protein, 9 aa, Mycobacterium tuberculosis
RRAVSCSTF

SEQ ID NO: 32870 - protein, 9 aa, Mycobacterium tuberculosis
RAVSCSTFD

SEQ ID NO: 32871 - protein, 9 aa, Mycobacterium tuberculosis
AVSCSTFDS

SEQ ID NO: 32872 - protein, 9 aa, Mycobacterium tuberculosis
VSCSTFDSM

SEQ ID NO: 32873 - protein, 9 aa, Mycobacterium tuberculosis
SCSTFDSMD

SEQ ID NO: 32874 - protein, 9 aa, Mycobacterium tuberculosis
CSTFDSMDA

SEQ ID NO: 32875 - protein, 9 aa, Mycobacterium tuberculosis
STFDSMDAM

SEQ ID NO: 32876 - protein, 9 aa, Mycobacterium tuberculosis
TFDSMDAMA

SEQ ID NO: 32877 - protein, 9 aa, Mycobacterium tuberculosis
FDSMDAMAR

SEQ ID NO: 32878 - protein, 9 aa, Mycobacterium tuberculosis
DSMDAMARN

SEQ ID NO: 32879 - protein, 9 aa, Mycobacterium tuberculosis
SMDAMARNR

SEQ ID NO: 32880 - protein, 9 aa, Mycobacterium tuberculosis
MDAMARNRD

SEQ ID NO: 32881 - protein, 9 aa, Mycobacterium tuberculosis
DAMARNRDR

SEQ ID NO: 32882 - protein, 9 aa, Mycobacterium tuberculosis
AMARNRDRA

SEQ ID NO: 32883 - protein, 9 aa, Mycobacterium tuberculosis
MARNRDRAS

SEQ ID NO: 32884 - protein, 9 aa, Mycobacterium tuberculosis
ARNRDRASE

SEQ ID NO: 32885 - protein, 9 aa, Mycobacterium tuberculosis
RNRDRASEL

SEQ ID NO: 32886 - protein, 9 aa, Mycobacterium tuberculosis
NRDRASELR

SEQ ID NO: 32887 - protein, 9 aa, Mycobacterium tuberculosis
RDRASELRS

SEQ ID NO: 32888 - protein, 9 aa, Mycobacterium tuberculosis
DRASELRSR

SEQ ID NO: 32889 - protein, 9 aa, Mycobacterium tuberculosis
RASELRSRR

SEQ ID NO: 32890 - protein, 9 aa, Mycobacterium tuberculosis
ASELRSRRV

SEQ ID NO: 32891 - protein, 9 aa, Mycobacterium tuberculosis
SELRSRRVR

SEQ ID NO: 32892 - protein, 9 aa, Mycobacterium tuberculosis
ELRSRRVRE

SEQ ID NO: 32893 - protein, 9 aa, Mycobacterium tuberculosis
LRSRRVREL

SEQ ID NO: 32894 - protein, 9 aa, Mycobacterium tuberculosis
RSRRVRELG

SEQ ID NO: 32895 - protein, 9 aa, Mycobacterium tuberculosis
SRRVRELGA

SEQ ID NO: 32896 - protein, 9 aa, Mycobacterium tuberculosis
RRVRELGAE

SEQ ID NO: 32897 - protein, 9 aa, Mycobacterium tuberculosis
RVRELGAEV

SEQ ID NO: 32898 - protein, 9 aa, Mycobacterium tuberculosis
VRELGAEVL

SEQ ID NO: 32899 - protein, 9 aa, Mycobacterium tuberculosis
RELGAEVLD

SEQ ID NO: 32900 - protein, 9 aa, Mycobacterium tuberculosis
ELGAEVLDV

SEQ ID NO: 32901 - protein, 9 aa, Mycobacterium tuberculosis
LGAEVLDVA

SEQ ID NO: 32902 - protein, 9 aa, Mycobacterium tuberculosis
GAEVLDVAE

SEQ ID NO: 32903 - protein, 9 aa, Mycobacterium tuberculosis
AEVLDVAEF

SEQ ID NO: 32904 - protein, 9 aa, Mycobacterium tuberculosis
EVLDVAEFE

SEQ ID NO: 32905 - protein, 9 aa, Mycobacterium tuberculosis
VLDVAEFEL

SEQ ID NO: 32906 - protein, 9 aa, Mycobacterium tuberculosis
LDVAEFELA

SEQ ID NO: 32907 - protein, 9 aa, Mycobacterium tuberculosis
DVAEFELAI

SEQ ID NO: 32908 - protein, 9 aa, Mycobacterium tuberculosis
VAEFELAIA

SEQ ID NO: 32909 - protein, 9 aa, Mycobacterium tuberculosis
AEFELAIAH

SEQ ID NO: 32910 - protein, 9 aa, Mycobacterium tuberculosis
EFELAIAHL

SEQ ID NO: 32911 - protein, 9 aa, Mycobacterium tuberculosis
FELAIAHLR

SEQ ID NO: 32912 - protein, 9 aa, Mycobacterium tuberculosis
ELAIAHLRV

SEQ ID NO: 32913 - protein, 9 aa, Mycobacterium tuberculosis
LAIAHLRVP

SEQ ID NO: 32914 - protein, 9 aa, Mycobacterium tuberculosis
AIAHLRVPE

SEQ ID NO: 32915 - protein, 9 aa, Mycobacterium tuberculosis
IAHLRVPEL

SEQ ID NO: 32916 - protein, 9 aa, Mycobacterium tuberculosis
AHLRVPELV

SEQ ID NO: 32917 - protein, 10 aa, Mycobacterium tuberculosis
MPGSAGWRKV

SEQ ID NO: 32918 - protein, 10 aa, Mycobacterium tuberculosis
PGSAGWRKVF

SEQ ID NO: 32919 - protein, 10 aa, Mycobacterium tuberculosis
GSAGWRKVFG

SEQ ID NO: 32920 - protein, 10 aa, Mycobacterium tuberculosis
SAGWRKVFGG

SEQ ID NO: 32921 - protein, 10 aa, Mycobacterium tuberculosis
AGWRKVFGGT

SEQ ID NO: 32922 - protein, 10 aa, Mycobacterium tuberculosis
GWRKVFGGTG

SEQ ID NO: 32923 - protein, 10 aa, Mycobacterium tuberculosis
WRKVFGGTGG

SEQ ID NO: 32924 - protein, 10 aa, Mycobacterium tuberculosis
RKVFGGTGGA

SEQ ID NO: 32925 - protein, 10 aa, Mycobacterium tuberculosis
KVFGGTGGAT

SEQ ID NO: 32926 - protein, 10 aa, Mycobacterium tuberculosis
VFGGTGGATG

SEQ ID NO: 32927 - protein, 10 aa, Mycobacterium tuberculosis
FGGTGGATGA

SEQ ID NO: 32928 - protein, 10 aa, Mycobacterium tuberculosis
GGTGGATGAL

SEQ ID NO: 32929 - protein, 10 aa, Mycobacterium tuberculosis
GTGGATGALP

SEQ ID NO: 32930 - protein, 10 aa, Mycobacterium tuberculosis
TGGATGALPR

SEQ ID NO: 32931 - protein, 10 aa, Mycobacterium tuberculosis
GGATGALPRH

SEQ ID NO: 32932 - protein, 10 aa, Mycobacterium tuberculosis
GATGALPRHG

SEQ ID NO: 32933 - protein, 10 aa, Mycobacterium tuberculosis
ATGALPRHGR

SEQ ID NO: 32934 - protein, 10 aa, Mycobacterium tuberculosis
TGALPRHGRG

SEQ ID NO: 32935 - protein, 10 aa, Mycobacterium tuberculosis
GALPRHGRGS

SEQ ID NO: 32936 - protein, 10 aa, Mycobacterium tuberculosis
ALPRHGRGSI

SEQ ID NO: 32937 - protein, 10 aa, Mycobacterium tuberculosis
LPRHGRGSIV

SEQ ID NO: 32938 - protein, 10 aa, Mycobacterium tuberculosis
PRHGRGSIVY

SEQ ID NO: 32939 - protein, 10 aa, Mycobacterium tuberculosis
RHGRGSIVYA

SEQ ID NO: 32940 - protein, 10 aa, Mycobacterium tuberculosis
HGRGSIVYAR

SEQ ID NO: 32941 - protein, 10 aa, Mycobacterium tuberculosis
GRGSIVYARS

SEQ ID NO: 32942 - protein, 10 aa, Mycobacterium tuberculosis
RGSIVYARST

SEQ ID NO: 32943 - protein, 10 aa, Mycobacterium tuberculosis
GSIVYARSTT

SEQ ID NO: 32944 - protein, 10 aa, Mycobacterium tuberculosis
SIVYARSTTI

SEQ ID NO: 32945 - protein, 10 aa, Mycobacterium tuberculosis
IVYARSTTIE

SEQ ID NO: 32946 - protein, 10 aa, Mycobacterium tuberculosis
VYARSTTIEA

SEQ ID NO: 32947 - protein, 10 aa, Mycobacterium tuberculosis
YARSTTIEAQ

SEQ ID NO: 32948 - protein, 10 aa, Mycobacterium tuberculosis
ARSTTIEAQP

SEQ ID NO: 32949 - protein, 10 aa, Mycobacterium tuberculosis
RSTTIEAQPL

SEQ ID NO: 32950 - protein, 10 aa, Mycobacterium tuberculosis
STTIEAQPLS

SEQ ID NO: 32951 - protein, 10 aa, Mycobacterium tuberculosis
TTIEAQPLSV

SEQ ID NO: 32952 - protein, 10 aa, Mycobacterium tuberculosis
TIEAQPLSVD

SEQ ID NO: 32953 - protein, 10 aa, Mycobacterium tuberculosis
IEAQPLSVDI

SEQ ID NO: 32954 - protein, 10 aa, Mycobacterium tuberculosis
EAQPLSVDIG

SEQ ID NO: 32955 - protein, 10 aa, Mycobacterium tuberculosis
AQPLSVDIGI

SEQ ID NO: 32956 - protein, 10 aa, Mycobacterium tuberculosis
QPLSVDIGIA

SEQ ID NO: 32957 - protein, 10 aa, Mycobacterium tuberculosis
PLSVDIGIAH

SEQ ID NO: 32958 - protein, 10 aa, Mycobacterium tuberculosis
LSVDIGIAHV

SEQ ID NO: 32959 - protein, 10 aa, Mycobacterium tuberculosis
SVDIGIAHVR

SEQ ID NO: 32960 - protein, 10 aa, Mycobacterium tuberculosis
VDIGIAHVRD

SEQ ID NO: 32961 - protein, 10 aa, Mycobacterium tuberculosis
DIGIAHVRDV

SEQ ID NO: 32962 - protein, 10 aa, Mycobacterium tuberculosis
IGIAHVRDVV

SEQ ID NO: 32963 - protein, 10 aa, Mycobacterium tuberculosis
GIAHVRDVVM

SEQ ID NO: 32964 - protein, 10 aa, Mycobacterium tuberculosis
IAHVRDVVMP

SEQ ID NO: 32965 - protein, 10 aa, Mycobacterium tuberculosis
AHVRDVVMPA

SEQ ID NO: 32966 - protein, 10 aa, Mycobacterium tuberculosis
HVRDVVMPAL

SEQ ID NO: 32967 - protein, 10 aa, Mycobacterium tuberculosis
VRDVVMPALQ

SEQ ID NO: 32968 - protein, 10 aa, Mycobacterium tuberculosis
RDVVMPALQE

SEQ ID NO: 32969 - protein, 10 aa, Mycobacterium tuberculosis
DVVMPALQEI

SEQ ID NO: 32970 - protein, 10 aa, Mycobacterium tuberculosis
VVMPALQEID

SEQ ID NO: 32971 - protein, 10 aa, Mycobacterium tuberculosis
VMPALQEIDG

SEQ ID NO: 32972 - protein, 10 aa, Mycobacterium tuberculosis
MPALQEIDGC

SEQ ID NO: 32973 - protein, 10 aa, Mycobacterium tuberculosis
PALQEIDGCV

SEQ ID NO: 32974 - protein, 10 aa, Mycobacterium tuberculosis
ALQEIDGCVG

SEQ ID NO: 32975 - protein, 10 aa, Mycobacterium tuberculosis
LQEIDGCVGV

SEQ ID NO: 32976 - protein, 10 aa, Mycobacterium tuberculosis
QEIDGCVGVS

SEQ ID NO: 32977 - protein, 10 aa, Mycobacterium tuberculosis
EIDGCVGVSL

SEQ ID NO: 32978 - protein, 10 aa, Mycobacterium tuberculosis
IDGCVGVSLL

SEQ ID NO: 32979 - protein, 10 aa, Mycobacterium tuberculosis
DGCVGVSLLV

SEQ ID NO: 32980 - protein, 10 aa, Mycobacterium tuberculosis
GCVGVSLLVD

SEQ ID NO: 32981 - protein, 10 aa, Mycobacterium tuberculosis
CVGVSLLVDR

SEQ ID NO: 32982 - protein, 10 aa, Mycobacterium tuberculosis
VGVSLLVDRQ

SEQ ID NO: 32983 - protein, 10 aa, Mycobacterium tuberculosis
GVSLLVDRQS

SEQ ID NO: 32984 - protein, 10 aa, Mycobacterium tuberculosis
VSLLVDRQSG

SEQ ID NO: 32985 - protein, 10 aa, Mycobacterium tuberculosis
SLLVDRQSGR

SEQ ID NO: 32986 - protein, 10 aa, Mycobacterium tuberculosis
LLVDRQSGRC

SEQ ID NO: 32987 - protein, 10 aa, Mycobacterium tuberculosis
LVDRQSGRCI

SEQ ID NO: 32988 - protein, 10 aa, Mycobacterium tuberculosis
VDRQSGRCIA

SEQ ID NO: 32989 - protein, 10 aa, Mycobacterium tuberculosis
DRQSGRCIAT

SEQ ID NO: 32990 - protein, 10 aa, Mycobacterium tuberculosis
RQSGRCIATS

SEQ ID NO: 32991 - protein, 10 aa, Mycobacterium tuberculosis
QSGRCIATSA

SEQ ID NO: 32992 - protein, 10 aa, Mycobacterium tuberculosis
SGRCIATSAW

SEQ ID NO: 32993 - protein, 10 aa, Mycobacterium tuberculosis
GRCIATSAWE

SEQ ID NO: 32994 - protein, 10 aa, Mycobacterium tuberculosis
RCIATSAWET

SEQ ID NO: 32995 - protein, 10 aa, Mycobacterium tuberculosis
CIATSAWETL

SEQ ID NO: 32996 - protein, 10 aa, Mycobacterium tuberculosis
IATSAWETLE

SEQ ID NO: 32997 - protein, 10 aa, Mycobacterium tuberculosis
ATSAWETLEA

SEQ ID NO: 32998 - protein, 10 aa, Mycobacterium tuberculosis
TSAWETLEAM

SEQ ID NO: 32999 - protein, 10 aa, Mycobacterium tuberculosis
SAWETLEAMR

SEQ ID NO: 33000 - protein, 10 aa, Mycobacterium tuberculosis
AWETLEAMRA

SEQ ID NO: 33001 - protein, 10 aa, Mycobacterium tuberculosis
WETLEAMRAS

SEQ ID NO: 33002 - protein, 10 aa, Mycobacterium tuberculosis
ETLEAMRASV

SEQ ID NO: 33003 - protein, 10 aa, Mycobacterium tuberculosis
TLEAMRASVE

SEQ ID NO: 33004 - protein, 10 aa, Mycobacterium tuberculosis
LEAMRASVER

SEQ ID NO: 33005 - protein, 10 aa, Mycobacterium tuberculosis
EAMRASVERV

SEQ ID NO: 33006 - protein, 10 aa, Mycobacterium tuberculosis
AMRASVERVA

SEQ ID NO: 33007 - protein, 10 aa, Mycobacterium tuberculosis
MRASVERVAP

SEQ ID NO: 33008 - protein, 10 aa, Mycobacterium tuberculosis
RASVERVAPI

SEQ ID NO: 33009 - protein, 10 aa, Mycobacterium tuberculosis
ASVERVAPIR

SEQ ID NO: 33010 - protein, 10 aa, Mycobacterium tuberculosis
SVERVAPIRD

SEQ ID NO: 33011 - protein, 10 aa, Mycobacterium tuberculosis
VERVAPIRDR

SEQ ID NO: 33012 - protein, 10 aa, Mycobacterium tuberculosis
ERVAPIRDRA

SEQ ID NO: 33013 - protein, 10 aa, Mycobacterium tuberculosis
RVAPIRDRAA

SEQ ID NO: 33014 - protein, 10 aa, Mycobacterium tuberculosis
VAPIRDRAAL

SEQ ID NO: 33015 - protein, 10 aa, Mycobacterium tuberculosis
APIRDRAALM

SEQ ID NO: 33016 - protein, 10 aa, Mycobacterium tuberculosis
PIRDRAALMF

SEQ ID NO: 33017 - protein, 10 aa, Mycobacterium tuberculosis
IRDRAALMFA

SEQ ID NO: 33018 - protein, 10 aa, Mycobacterium tuberculosis
RDRAALMFAG

SEQ ID NO: 33019 - protein, 10 aa, Mycobacterium tuberculosis
DRAALMFAGS

SEQ ID NO: 33020 - protein, 10 aa, Mycobacterium tuberculosis
RAALMFAGSA

SEQ ID NO: 33021 - protein, 10 aa, Mycobacterium tuberculosis
AALMFAGSAR

SEQ ID NO: 33022 - protein, 10 aa, Mycobacterium tuberculosis
ALMFAGSARV

SEQ ID NO: 33023 - protein, 10 aa, Mycobacterium tuberculosis
LMFAGSARVE

SEQ ID NO: 33024 - protein, 10 aa, Mycobacterium tuberculosis
MFAGSARVEE

SEQ ID NO: 33025 - protein, 10 aa, Mycobacterium tuberculosis
FAGSARVEEW

SEQ ID NO: 33026 - protein, 10 aa, Mycobacterium tuberculosis
AGSARVEEWD

SEQ ID NO: 33027 - protein, 10 aa, Mycobacterium tuberculosis
GSARVEEWDI

SEQ ID NO: 33028 - protein, 10 aa, Mycobacterium tuberculosis
SARVEEWDIA

SEQ ID NO: 33029 - protein, 10 aa, Mycobacterium tuberculosis
ARVEEWDIAL

SEQ ID NO: 33030 - protein, 10 aa, Mycobacterium tuberculosis
RVEEWDIALL

SEQ ID NO: 33031 - protein, 10 aa, Mycobacterium tuberculosis
VEEWDIALLH

SEQ ID NO: 33032 - protein, 10 aa, Mycobacterium tuberculosis
EEWDIALLHR

SEQ ID NO: 33033 - protein, 10 aa, Mycobacterium tuberculosis
EWDIALLHRD

SEQ ID NO: 33034 - protein, 10 aa, Mycobacterium tuberculosis
WDIALLHRDH

SEQ ID NO: 33035 - protein, 10 aa, Mycobacterium tuberculosis
DIALLHRDHP

SEQ ID NO: 33036 - protein, 10 aa, Mycobacterium tuberculosis
IALLHRDHPS

SEQ ID NO: 33037 - protein, 10 aa, Mycobacterium tuberculosis
ALLHRDHPSH

SEQ ID NO: 33038 - protein, 10 aa, Mycobacterium tuberculosis
LLHRDHPSHE

SEQ ID NO: 33039 - protein, 10 aa, Mycobacterium tuberculosis
LHRDHPSHEG

SEQ ID NO: 33040 - protein, 10 aa, Mycobacterium tuberculosis
HRDHPSHEGA

SEQ ID NO: 33041 - protein, 10 aa, Mycobacterium tuberculosis
RDHPSHEGAC

SEQ ID NO: 33042 - protein, 10 aa, Mycobacterium tuberculosis
DHPSHEGACV

SEQ ID NO: 33043 - protein, 10 aa, Mycobacterium tuberculosis
HPSHEGACVR

SEQ ID NO: 33044 - protein, 10 aa, Mycobacterium tuberculosis
PSHEGACVRA

SEQ ID NO: 33045 - protein, 10 aa, Mycobacterium tuberculosis
SHEGACVRAT

SEQ ID NO: 33046 - protein, 10 aa, Mycobacterium tuberculosis
HEGACVRATW

SEQ ID NO: 33047 - protein, 10 aa, Mycobacterium tuberculosis
EGACVRATWL

SEQ ID NO: 33048 - protein, 10 aa, Mycobacterium tuberculosis
GACVRATWLK

SEQ ID NO: 33049 - protein, 10 aa, Mycobacterium tuberculosis
ACVRATWLKV

SEQ ID NO: 33050 - protein, 10 aa, Mycobacterium tuberculosis
CVRATWLKVV

SEQ ID NO: 33051 - protein, 10 aa, Mycobacterium tuberculosis
VRATWLKVVP

SEQ ID NO: 33052 - protein, 10 aa, Mycobacterium tuberculosis
RATWLKVVPD

SEQ ID NO: 33053 - protein, 10 aa, Mycobacterium tuberculosis
ATWLKVVPDQ

SEQ ID NO: 33054 - protein, 10 aa, Mycobacterium tuberculosis
TWLKVVPDQL

SEQ ID NO: 33055 - protein, 10 aa, Mycobacterium tuberculosis
WLKVVPDQLG

SEQ ID NO: 33056 - protein, 10 aa, Mycobacterium tuberculosis
LKVVPDQLGR

SEQ ID NO: 33057 - protein, 10 aa, Mycobacterium tuberculosis
KVVPDQLGRS

SEQ ID NO: 33058 - protein, 10 aa, Mycobacterium tuberculosis
VVPDQLGRSL

SEQ ID NO: 33059 - protein, 10 aa, Mycobacterium tuberculosis
VPDQLGRSLE

SEQ ID NO: 33060 - protein, 10 aa, Mycobacterium tuberculosis
PDQLGRSLEF

SEQ ID NO: 33061 - protein, 10 aa, Mycobacterium tuberculosis
DQLGRSLEFY

SEQ ID NO: 33062 - protein, 10 aa, Mycobacterium tuberculosis
QLGRSLEFYR

SEQ ID NO: 33063 - protein, 10 aa, Mycobacterium tuberculosis
LGRSLEFYRT

SEQ ID NO: 33064 - protein, 10 aa, Mycobacterium tuberculosis
GRSLEFYRTS

SEQ ID NO: 33065 - protein, 10 aa, Mycobacterium tuberculosis
RSLEFYRTSV

SEQ ID NO: 33066 - protein, 10 aa, Mycobacterium tuberculosis
SLEFYRTSVL

SEQ ID NO: 33067 - protein, 10 aa, Mycobacterium tuberculosis
LEFYRTSVLP

SEQ ID NO: 33068 - protein, 10 aa, Mycobacterium tuberculosis
EFYRTSVLPE

SEQ ID NO: 33069 - protein, 10 aa, Mycobacterium tuberculosis
FYRTSVLPEL

SEQ ID NO: 33070 - protein, 10 aa, Mycobacterium tuberculosis
YRTSVLPELE

SEQ ID NO: 33071 - protein, 10 aa, Mycobacterium tuberculosis
RTSVLPELES

SEQ ID NO: 33072 - protein, 10 aa, Mycobacterium tuberculosis
TSVLPELESL

SEQ ID NO: 33073 - protein, 10 aa, Mycobacterium tuberculosis
SVLPELESLD

SEQ ID NO: 33074 - protein, 10 aa, Mycobacterium tuberculosis
VLPELESLDG

SEQ ID NO: 33075 - protein, 10 aa, Mycobacterium tuberculosis
LPELESLDGF

SEQ ID NO: 33076 - protein, 10 aa, Mycobacterium tuberculosis
PELESLDGFC

SEQ ID NO: 33077 - protein, 10 aa, Mycobacterium tuberculosis
ELESLDGFCS

SEQ ID NO: 33078 - protein, 10 aa, Mycobacterium tuberculosis
LESLDGFCSA

SEQ ID NO: 33079 - protein, 10 aa, Mycobacterium tuberculosis
ESLDGFCSAS

SEQ ID NO: 33080 - protein, 10 aa, Mycobacterium tuberculosis
SLDGFCSASL

SEQ ID NO: 33081 - protein, 10 aa, Mycobacterium tuberculosis
LDGFCSASLM

SEQ ID NO: 33082 - protein, 10 aa, Mycobacterium tuberculosis
DGFCSASLMV

SEQ ID NO: 33083 - protein, 10 aa, Mycobacterium tuberculosis
GFCSASLMVD

SEQ ID NO: 33084 - protein, 10 aa, Mycobacterium tuberculosis
FCSASLMVDH

SEQ ID NO: 33085 - protein, 10 aa, Mycobacterium tuberculosis
CSASLMVDHP

SEQ ID NO: 33086 - protein, 10 aa, Mycobacterium tuberculosis
SASLMVDHPA

SEQ ID NO: 33087 - protein, 10 aa, Mycobacterium tuberculosis
ASLMVDHPAC

SEQ ID NO: 33088 - protein, 10 aa, Mycobacterium tuberculosis
SLMVDHPACR

SEQ ID NO: 33089 - protein, 10 aa, Mycobacterium tuberculosis
LMVDHPACRR

SEQ ID NO: 33090 - protein, 10 aa, Mycobacterium tuberculosis
MVDHPACRRA

SEQ ID NO: 33091 - protein, 10 aa, Mycobacterium tuberculosis
VDHPACRRAV

SEQ ID NO: 33092 - protein, 10 aa, Mycobacterium tuberculosis
DHPACRRAVS

SEQ ID NO: 33093 - protein, 10 aa, Mycobacterium tuberculosis
HPACRRAVSC

SEQ ID NO: 33094 - protein, 10 aa, Mycobacterium tuberculosis
PACRRAVSCS

SEQ ID NO: 33095 - protein, 10 aa, Mycobacterium tuberculosis
ACRRAVSCST

SEQ ID NO: 33096 - protein, 10 aa, Mycobacterium tuberculosis
CRRAVSCSTF

SEQ ID NO: 33097 - protein, 10 aa, Mycobacterium tuberculosis
RRAVSCSTFD

SEQ ID NO: 33098 - protein, 10 aa, Mycobacterium tuberculosis
RAVSCSTFDS

SEQ ID NO: 33099 - protein, 10 aa, Mycobacterium tuberculosis
AVSCSTFDSM

SEQ ID NO: 33100 - protein, 10 aa, Mycobacterium tuberculosis
VSCSTFDSMD

SEQ ID NO: 33101 - protein, 10 aa, Mycobacterium tuberculosis
SCSTFDSMDA

SEQ ID NO: 33102 - protein, 10 aa, Mycobacterium tuberculosis
CSTFDSMDAM

SEQ ID NO: 33103 - protein, 10 aa, Mycobacterium tuberculosis
STFDSMDAMA

SEQ ID NO: 33104 - protein, 10 aa, Mycobacterium tuberculosis
TFDSMDAMAR

SEQ ID NO: 33105 - protein, 10 aa, Mycobacterium tuberculosis
FDSMDAMARN

SEQ ID NO: 33106 - protein, 10 aa, Mycobacterium tuberculosis
DSMDAMARNR

SEQ ID NO: 33107 - protein, 10 aa, Mycobacterium tuberculosis
SMDAMARNRD

SEQ ID NO: 33108 - protein, 10 aa, Mycobacterium tuberculosis
MDAMARNRDR

SEQ ID NO: 33109 - protein, 10 aa, Mycobacterium tuberculosis
DAMARNRDRA

SEQ ID NO: 33110 - protein, 10 aa, Mycobacterium tuberculosis
AMARNRDRAS

SEQ ID NO: 33111 - protein, 10 aa, Mycobacterium tuberculosis
MARNRDRASE

SEQ ID NO: 33112 - protein, 10 aa, Mycobacterium tuberculosis
ARNRDRASEL

SEQ ID NO: 33113 - protein, 10 aa, Mycobacterium tuberculosis
RNRDRASELR

SEQ ID NO: 33114 - protein, 10 aa, Mycobacterium tuberculosis
NRDRASELRS

SEQ ID NO: 33115 - protein, 10 aa, Mycobacterium tuberculosis
RDRASELRSR

SEQ ID NO: 33116 - protein, 10 aa, Mycobacterium tuberculosis
DRASELRSRR

SEQ ID NO: 33117 - protein, 10 aa, Mycobacterium tuberculosis
RASELRSRRV

SEQ ID NO: 33118 - protein, 10 aa, Mycobacterium tuberculosis
ASELRSRRVR

SEQ ID NO: 33119 - protein, 10 aa, Mycobacterium tuberculosis
SELRSRRVRE

SEQ ID NO: 33120 - protein, 10 aa, Mycobacterium tuberculosis
ELRSRRVREL

SEQ ID NO: 33121 - protein, 10 aa, Mycobacterium tuberculosis
LRSRRVRELG

SEQ ID NO: 33122 - protein, 10 aa, Mycobacterium tuberculosis
RSRRVRELGA

SEQ ID NO: 33123 - protein, 10 aa, Mycobacterium tuberculosis
SRRVRELGAE

SEQ ID NO: 33124 - protein, 10 aa, Mycobacterium tuberculosis
RRVRELGAEV

SEQ ID NO: 33125 - protein, 10 aa, Mycobacterium tuberculosis
RVRELGAEVL

SEQ ID NO: 33126 - protein, 10 aa, Mycobacterium tuberculosis
VRELGAEVLD

SEQ ID NO: 33127 - protein, 10 aa, Mycobacterium tuberculosis
RELGAEVLDV

SEQ ID NO: 33128 - protein, 10 aa, Mycobacterium tuberculosis
ELGAEVLDVA

SEQ ID NO: 33129 - protein, 10 aa, Mycobacterium tuberculosis
LGAEVLDVAE

SEQ ID NO: 33130 - protein, 10 aa, Mycobacterium tuberculosis
GAEVLDVAEF

SEQ ID NO: 33131 - protein, 10 aa, Mycobacterium tuberculosis
AEVLDVAEFE

SEQ ID NO: 33132 - protein, 10 aa, Mycobacterium tuberculosis
EVLDVAEFEL

SEQ ID NO: 33133 - protein, 10 aa, Mycobacterium tuberculosis
VLDVAEFELA

SEQ ID NO: 33134 - protein, 10 aa, Mycobacterium tuberculosis
LDVAEFELAI

SEQ ID NO: 33135 - protein, 10 aa, Mycobacterium tuberculosis
DVAEFELAIA

SEQ ID NO: 33136 - protein, 10 aa, Mycobacterium tuberculosis
VAEFELAIAH

SEQ ID NO: 33137 - protein, 10 aa, Mycobacterium tuberculosis
AEFELAIAHL

SEQ ID NO: 33138 - protein, 10 aa, Mycobacterium tuberculosis
EFELAIAHLR

SEQ ID NO: 33139 - protein, 10 aa, Mycobacterium tuberculosis
FELAIAHLRV

SEQ ID NO: 33140 - protein, 10 aa, Mycobacterium tuberculosis
ELAIAHLRVP

SEQ ID NO: 33141 - protein, 10 aa, Mycobacterium tuberculosis
LAIAHLRVPE

SEQ ID NO: 33142 - protein, 10 aa, Mycobacterium tuberculosis
AIAHLRVPEL

SEQ ID NO: 33143 - protein, 10 aa, Mycobacterium tuberculosis
IAHLRVPELV

SEQ ID NO: 33144 - protein, 11 aa, Mycobacterium tuberculosis
MPGSAGWRKVF

SEQ ID NO: 33145 - protein, 11 aa, Mycobacterium tuberculosis
PGSAGWRKVFG

SEQ ID NO: 33146 - protein, 11 aa, Mycobacterium tuberculosis
GSAGWRKVFGG

SEQ ID NO: 33147 - protein, 11 aa, Mycobacterium tuberculosis
SAGWRKVFGGT

SEQ ID NO: 33148 - protein, 11 aa, Mycobacterium tuberculosis
AGWRKVFGGTG

SEQ ID NO: 33149 - protein, 11 aa, Mycobacterium tuberculosis
GWRKVFGGTGG

SEQ ID NO: 33150 - protein, 11 aa, Mycobacterium tuberculosis
WRKVFGGTGGA

SEQ ID NO: 33151 - protein, 11 aa, Mycobacterium tuberculosis
RKVFGGTGGAT

SEQ ID NO: 33152 - protein, 11 aa, Mycobacterium tuberculosis
KVFGGTGGATG

SEQ ID NO: 33153 - protein, 11 aa, Mycobacterium tuberculosis
VFGGTGGATGA

SEQ ID NO: 33154 - protein, 11 aa, Mycobacterium tuberculosis
FGGTGGATGAL

SEQ ID NO: 33155 - protein, 11 aa, Mycobacterium tuberculosis
GGTGGATGALP

SEQ ID NO: 33156 - protein, 11 aa, Mycobacterium tuberculosis
GTGGATGALPR

SEQ ID NO: 33157 - protein, 11 aa, Mycobacterium tuberculosis
TGGATGALPRH

SEQ ID NO: 33158 - protein, 11 aa, Mycobacterium tuberculosis
GGATGALPRHG

SEQ ID NO: 33159 - protein, 11 aa, Mycobacterium tuberculosis
GATGALPRHGR

SEQ ID NO: 33160 - protein, 11 aa, Mycobacterium tuberculosis
ATGALPRHGRG

SEQ ID NO: 33161 - protein, 11 aa, Mycobacterium tuberculosis
TGALPRHGRGS

SEQ ID NO: 33162 - protein, 11 aa, Mycobacterium tuberculosis
GALPRHGRGSI

SEQ ID NO: 33163 - protein, 11 aa, Mycobacterium tuberculosis
ALPRHGRGSIV

SEQ ID NO: 33164 - protein, 11 aa, Mycobacterium tuberculosis
LPRHGRGSIVY

SEQ ID NO: 33165 - protein, 11 aa, Mycobacterium tuberculosis
PRHGRGSIVYA

SEQ ID NO: 33166 - protein, 11 aa, Mycobacterium tuberculosis
RHGRGSIVYAR

SEQ ID NO: 33167 - protein, 11 aa, Mycobacterium tuberculosis
HGRGSIVYARS

SEQ ID NO: 33168 - protein, 11 aa, Mycobacterium tuberculosis
GRGSIVYARST

SEQ ID NO: 33169 - protein, 11 aa, Mycobacterium tuberculosis
RGSIVYARSTT

SEQ ID NO: 33170 - protein, 11 aa, Mycobacterium tuberculosis
GSIVYARSTTI

SEQ ID NO: 33171 - protein, 11 aa, Mycobacterium tuberculosis
SIVYARSTTIE

SEQ ID NO: 33172 - protein, 11 aa, Mycobacterium tuberculosis
IVYARSTTIEA

SEQ ID NO: 33173 - protein, 11 aa, Mycobacterium tuberculosis
VYARSTTIEAQ

SEQ ID NO: 33174 - protein, 11 aa, Mycobacterium tuberculosis
YARSTTIEAQP

SEQ ID NO: 33175 - protein, 11 aa, Mycobacterium tuberculosis
ARSTTIEAQPL

SEQ ID NO: 33176 - protein, 11 aa, Mycobacterium tuberculosis
RSTTIEAQPLS

SEQ ID NO: 33177 - protein, 11 aa, Mycobacterium tuberculosis
STTIEAQPLSV

SEQ ID NO: 33178 - protein, 11 aa, Mycobacterium tuberculosis
TTIEAQPLSVD

SEQ ID NO: 33179 - protein, 11 aa, Mycobacterium tuberculosis
TIEAQPLSVDI

SEQ ID NO: 33180 - protein, 11 aa, Mycobacterium tuberculosis
IEAQPLSVDIG

SEQ ID NO: 33181 - protein, 11 aa, Mycobacterium tuberculosis
EAQPLSVDIGI

SEQ ID NO: 33182 - protein, 11 aa, Mycobacterium tuberculosis
AQPLSVDIGIA

SEQ ID NO: 33183 - protein, 11 aa, Mycobacterium tuberculosis
QPLSVDIGIAH

SEQ ID NO: 33184 - protein, 11 aa, Mycobacterium tuberculosis
PLSVDIGIAHV

SEQ ID NO: 33185 - protein, 11 aa, Mycobacterium tuberculosis
LSVDIGIAHVR

SEQ ID NO: 33186 - protein, 11 aa, Mycobacterium tuberculosis
SVDIGIAHVRD

SEQ ID NO: 33187 - protein, 11 aa, Mycobacterium tuberculosis
VDIGIAHVRDV

SEQ ID NO: 33188 - protein, 11 aa, Mycobacterium tuberculosis
DIGIAHVRDVV

SEQ ID NO: 33189 - protein, 11 aa, Mycobacterium tuberculosis
IGIAHVRDVVM

SEQ ID NO: 33190 - protein, 11 aa, Mycobacterium tuberculosis
GIAHVRDVVMP

SEQ ID NO: 33191 - protein, 11 aa, Mycobacterium tuberculosis
IAHVRDVVMPA

SEQ ID NO: 33192 - protein, 11 aa, Mycobacterium tuberculosis
AHVRDVVMPAL

SEQ ID NO: 33193 - protein, 11 aa, Mycobacterium tuberculosis
HVRDVVMPALQ

SEQ ID NO: 33194 - protein, 11 aa, Mycobacterium tuberculosis
VRDVVMPALQE

SEQ ID NO: 33195 - protein, 11 aa, Mycobacterium tuberculosis
RDVVMPALQEI

SEQ ID NO: 33196 - protein, 11 aa, Mycobacterium tuberculosis
DVVMPALQEID

SEQ ID NO: 33197 - protein, 11 aa, Mycobacterium tuberculosis
VVMPALQEIDG

SEQ ID NO: 33198 - protein, 11 aa, Mycobacterium tuberculosis
VMPALQEIDGC

SEQ ID NO: 33199 - protein, 11 aa, Mycobacterium tuberculosis
MPALQEIDGCV

SEQ ID NO: 33200 - protein, 11 aa, Mycobacterium tuberculosis
PALQEIDGCVG

SEQ ID NO: 33201 - protein, 11 aa, Mycobacterium tuberculosis
ALQEIDGCVGV

SEQ ID NO: 33202 - protein, 11 aa, Mycobacterium tuberculosis
LQEIDGCVGVS

SEQ ID NO: 33203 - protein, 11 aa, Mycobacterium tuberculosis
QEIDGCVGVSL

SEQ ID NO: 33204 - protein, 11 aa, Mycobacterium tuberculosis
EIDGCVGVSLL

SEQ ID NO: 33205 - protein, 11 aa, Mycobacterium tuberculosis
IDGCVGVSLLV

SEQ ID NO: 33206 - protein, 11 aa, Mycobacterium tuberculosis
DGCVGVSLLVD

SEQ ID NO: 33207 - protein, 11 aa, Mycobacterium tuberculosis
GCVGVSLLVDR

SEQ ID NO: 33208 - protein, 11 aa, Mycobacterium tuberculosis
CVGVSLLVDRQ

SEQ ID NO: 33209 - protein, 11 aa, Mycobacterium tuberculosis
VGVSLLVDRQS

SEQ ID NO: 33210 - protein, 11 aa, Mycobacterium tuberculosis
GVSLLVDRQSG

SEQ ID NO: 33211 - protein, 11 aa, Mycobacterium tuberculosis
VSLLVDRQSGR

SEQ ID NO: 33212 - protein, 11 aa, Mycobacterium tuberculosis
SLLVDRQSGRC

SEQ ID NO: 33213 - protein, 11 aa, Mycobacterium tuberculosis
LLVDRQSGRCI

SEQ ID NO: 33214 - protein, 11 aa, Mycobacterium tuberculosis
LVDRQSGRCIA

SEQ ID NO: 33215 - protein, 11 aa, Mycobacterium tuberculosis
VDRQSGRCIAT

SEQ ID NO: 33216 - protein, 11 aa, Mycobacterium tuberculosis
DRQSGRCIATS

SEQ ID NO: 33217 - protein, 11 aa, Mycobacterium tuberculosis
RQSGRCIATSA

SEQ ID NO: 33218 - protein, 11 aa, Mycobacterium tuberculosis
QSGRCIATSAW

SEQ ID NO: 33219 - protein, 11 aa, Mycobacterium tuberculosis
SGRCIATSAWE

SEQ ID NO: 33220 - protein, 11 aa, Mycobacterium tuberculosis
GRCIATSAWET

SEQ ID NO: 33221 - protein, 11 aa, Mycobacterium tuberculosis
RCIATSAWETL

SEQ ID NO: 33222 - protein, 11 aa, Mycobacterium tuberculosis
CIATSAWETLE

SEQ ID NO: 33223 - protein, 11 aa, Mycobacterium tuberculosis
IATSAWETLEA

SEQ ID NO: 33224 - protein, 11 aa, Mycobacterium tuberculosis
ATSAWETLEAM

SEQ ID NO: 33225 - protein, 11 aa, Mycobacterium tuberculosis
TSAWETLEAMR

SEQ ID NO: 33226 - protein, 11 aa, Mycobacterium tuberculosis
SAWETLEAMRA

SEQ ID NO: 33227 - protein, 11 aa, Mycobacterium tuberculosis
AWETLEAMRAS

SEQ ID NO: 33228 - protein, 11 aa, Mycobacterium tuberculosis
WETLEAMRASV

SEQ ID NO: 33229 - protein, 11 aa, Mycobacterium tuberculosis
ETLEAMRASVE

SEQ ID NO: 33230 - protein, 11 aa, Mycobacterium tuberculosis
TLEAMRASVER

SEQ ID NO: 33231 - protein, 11 aa, Mycobacterium tuberculosis
LEAMRASVERV

SEQ ID NO: 33232 - protein, 11 aa, Mycobacterium tuberculosis
EAMRASVERVA

SEQ ID NO: 33233 - protein, 11 aa, Mycobacterium tuberculosis
AMRASVERVAP

SEQ ID NO: 33234 - protein, 11 aa, Mycobacterium tuberculosis
MRASVERVAPI

SEQ ID NO: 33235 - protein, 11 aa, Mycobacterium tuberculosis
RASVERVAPIR

SEQ ID NO: 33236 - protein, 11 aa, Mycobacterium tuberculosis
ASVERVAPIRD

SEQ ID NO: 33237 - protein, 11 aa, Mycobacterium tuberculosis
SVERVAPIRDR

SEQ ID NO: 33238 - protein, 11 aa, Mycobacterium tuberculosis
VERVAPIRDRA

SEQ ID NO: 33239 - protein, 11 aa, Mycobacterium tuberculosis
ERVAPIRDRAA

SEQ ID NO: 33240 - protein, 11 aa, Mycobacterium tuberculosis
RVAPIRDRAAL

SEQ ID NO: 33241 - protein, 11 aa, Mycobacterium tuberculosis
VAPIRDRAALM

SEQ ID NO: 33242 - protein, 11 aa, Mycobacterium tuberculosis
APIRDRAALMF

SEQ ID NO: 33243 - protein, 11 aa, Mycobacterium tuberculosis
PIRDRAALMFA

SEQ ID NO: 33244 - protein, 11 aa, Mycobacterium tuberculosis
IRDRAALMFAG

SEQ ID NO: 33245 - protein, 11 aa, Mycobacterium tuberculosis
RDRAALMFAGS

SEQ ID NO: 33246 - protein, 11 aa, Mycobacterium tuberculosis
DRAALMFAGSA

SEQ ID NO: 33247 - protein, 11 aa, Mycobacterium tuberculosis
RAALMFAGSAR

SEQ ID NO: 33248 - protein, 11 aa, Mycobacterium tuberculosis
AALMFAGSARV

SEQ ID NO: 33249 - protein, 11 aa, Mycobacterium tuberculosis
ALMFAGSARVE

SEQ ID NO: 33250 - protein, 11 aa, Mycobacterium tuberculosis
LMFAGSARVEE

SEQ ID NO: 33251 - protein, 11 aa, Mycobacterium tuberculosis
MFAGSARVEEW

SEQ ID NO: 33252 - protein, 11 aa, Mycobacterium tuberculosis
FAGSARVEEWD

SEQ ID NO: 33253 - protein, 11 aa, Mycobacterium tuberculosis
AGSARVEEWDI

SEQ ID NO: 33254 - protein, 11 aa, Mycobacterium tuberculosis
GSARVEEWDIA

SEQ ID NO: 33255 - protein, 11 aa, Mycobacterium tuberculosis
SARVEEWDIAL

SEQ ID NO: 33256 - protein, 11 aa, Mycobacterium tuberculosis
ARVEEWDIALL

SEQ ID NO: 33257 - protein, 11 aa, Mycobacterium tuberculosis
RVEEWDIALLH

SEQ ID NO: 33258 - protein, 11 aa, Mycobacterium tuberculosis
VEEWDIALLHR

SEQ ID NO: 33259 - protein, 11 aa, Mycobacterium tuberculosis
EEWDIALLHRD

SEQ ID NO: 33260 - protein, 11 aa, Mycobacterium tuberculosis
EWDIALLHRDH

SEQ ID NO: 33261 - protein, 11 aa, Mycobacterium tuberculosis
WDIALLHRDHP

SEQ ID NO: 33262 - protein, 11 aa, Mycobacterium tuberculosis
DIALLHRDHPS

SEQ ID NO: 33263 - protein, 11 aa, Mycobacterium tuberculosis
IALLHRDHPSH

SEQ ID NO: 33264 - protein, 11 aa, Mycobacterium tuberculosis
ALLHRDHPSHE

SEQ ID NO: 33265 - protein, 11 aa, Mycobacterium tuberculosis
LLHRDHPSHEG

SEQ ID NO: 33266 - protein, 11 aa, Mycobacterium tuberculosis
LHRDHPSHEGA

SEQ ID NO: 33267 - protein, 11 aa, Mycobacterium tuberculosis
HRDHPSHEGAC

SEQ ID NO: 33268 - protein, 11 aa, Mycobacterium tuberculosis
RDHPSHEGACV

SEQ ID NO: 33269 - protein, 11 aa, Mycobacterium tuberculosis
DHPSHEGACVR

SEQ ID NO: 33270 - protein, 11 aa, Mycobacterium tuberculosis
HPSHEGACVRA

SEQ ID NO: 33271 - protein, 11 aa, Mycobacterium tuberculosis
PSHEGACVRAT

SEQ ID NO: 33272 - protein, 11 aa, Mycobacterium tuberculosis
SHEGACVRATW

SEQ ID NO: 33273 - protein, 11 aa, Mycobacterium tuberculosis
HEGACVRATWL

SEQ ID NO: 33274 - protein, 11 aa, Mycobacterium tuberculosis
EGACVRATWLK

SEQ ID NO: 33275 - protein, 11 aa, Mycobacterium tuberculosis
GACVRATWLKV

SEQ ID NO: 33276 - protein, 11 aa, Mycobacterium tuberculosis
ACVRATWLKVV

SEQ ID NO: 33277 - protein, 11 aa, Mycobacterium tuberculosis
CVRATWLKVVP

SEQ ID NO: 33278 - protein, 11 aa, Mycobacterium tuberculosis
VRATWLKVVPD

SEQ ID NO: 33279 - protein, 11 aa, Mycobacterium tuberculosis
RATWLKVVPDQ

SEQ ID NO: 33280 - protein, 11 aa, Mycobacterium tuberculosis
ATWLKVVPDQL

SEQ ID NO: 33281 - protein, 11 aa, Mycobacterium tuberculosis
TWLKVVPDQLG

SEQ ID NO: 33282 - protein, 11 aa, Mycobacterium tuberculosis
WLKVVPDQLGR

SEQ ID NO: 33283 - protein, 11 aa, Mycobacterium tuberculosis
LKVVPDQLGRS

SEQ ID NO: 33284 - protein, 11 aa, Mycobacterium tuberculosis
KVVPDQLGRSL

SEQ ID NO: 33285 - protein, 11 aa, Mycobacterium tuberculosis
VVPDQLGRSLE

SEQ ID NO: 33286 - protein, 11 aa, Mycobacterium tuberculosis
VPDQLGRSLEF

SEQ ID NO: 33287 - protein, 11 aa, Mycobacterium tuberculosis
PDQLGRSLEFY

SEQ ID NO: 33288 - protein, 11 aa, Mycobacterium tuberculosis
DQLGRSLEFYR

SEQ ID NO: 33289 - protein, 11 aa, Mycobacterium tuberculosis
QLGRSLEFYRT

SEQ ID NO: 33290 - protein, 11 aa, Mycobacterium tuberculosis
LGRSLEFYRTS

SEQ ID NO: 33291 - protein, 11 aa, Mycobacterium tuberculosis
GRSLEFYRTSV

SEQ ID NO: 33292 - protein, 11 aa, Mycobacterium tuberculosis
RSLEFYRTSVL

SEQ ID NO: 33293 - protein, 11 aa, Mycobacterium tuberculosis
SLEFYRTSVLP

SEQ ID NO: 33294 - protein, 11 aa, Mycobacterium tuberculosis
LEFYRTSVLPE

SEQ ID NO: 33295 - protein, 11 aa, Mycobacterium tuberculosis
EFYRTSVLPEL

SEQ ID NO: 33296 - protein, 11 aa, Mycobacterium tuberculosis
FYRTSVLPELE

SEQ ID NO: 33297 - protein, 11 aa, Mycobacterium tuberculosis
YRTSVLPELES

SEQ ID NO: 33298 - protein, 11 aa, Mycobacterium tuberculosis
RTSVLPELESL

SEQ ID NO: 33299 - protein, 11 aa, Mycobacterium tuberculosis
TSVLPELESLD

SEQ ID NO: 33300 - protein, 11 aa, Mycobacterium tuberculosis
SVLPELESLDG

SEQ ID NO: 33301 - protein, 11 aa, Mycobacterium tuberculosis
VLPELESLDGF

SEQ ID NO: 33302 - protein, 11 aa, Mycobacterium tuberculosis
LPELESLDGFC

SEQ ID NO: 33303 - protein, 11 aa, Mycobacterium tuberculosis
PELESLDGFCS

SEQ ID NO: 33304 - protein, 11 aa, Mycobacterium tuberculosis
ELESLDGFCSA

SEQ ID NO: 33305 - protein, 11 aa, Mycobacterium tuberculosis
LESLDGFCSAS

SEQ ID NO: 33306 - protein, 11 aa, Mycobacterium tuberculosis
ESLDGFCSASL

SEQ ID NO: 33307 - protein, 11 aa, Mycobacterium tuberculosis
SLDGFCSASLM

SEQ ID NO: 33308 - protein, 11 aa, Mycobacterium tuberculosis
LDGFCSASLMV

SEQ ID NO: 33309 - protein, 11 aa, Mycobacterium tuberculosis
DGFCSASLMVD

SEQ ID NO: 33310 - protein, 11 aa, Mycobacterium tuberculosis
GFCSASLMVDH

SEQ ID NO: 33311 - protein, 11 aa, Mycobacterium tuberculosis
FCSASLMVDHP

SEQ ID NO: 33312 - protein, 11 aa, Mycobacterium tuberculosis
CSASLMVDHPA

SEQ ID NO: 33313 - protein, 11 aa, Mycobacterium tuberculosis
SASLMVDHPAC

SEQ ID NO: 33314 - protein, 11 aa, Mycobacterium tuberculosis
ASLMVDHPACR

SEQ ID NO: 33315 - protein, 11 aa, Mycobacterium tuberculosis
SLMVDHPACRR

SEQ ID NO: 33316 - protein, 11 aa, Mycobacterium tuberculosis
LMVDHPACRRA

SEQ ID NO: 33317 - protein, 11 aa, Mycobacterium tuberculosis
MVDHPACRRAV

SEQ ID NO: 33318 - protein, 11 aa, Mycobacterium tuberculosis
VDHPACRRAVS

SEQ ID NO: 33319 - protein, 11 aa, Mycobacterium tuberculosis
DHPACRRAVSC

SEQ ID NO: 33320 - protein, 11 aa, Mycobacterium tuberculosis
HPACRRAVSCS

SEQ ID NO: 33321 - protein, 11 aa, Mycobacterium tuberculosis
PACRRAVSCST

SEQ ID NO: 33322 - protein, 11 aa, Mycobacterium tuberculosis
ACRRAVSCSTF

SEQ ID NO: 33323 - protein, 11 aa, Mycobacterium tuberculosis
CRRAVSCSTFD

SEQ ID NO: 33324 - protein, 11 aa, Mycobacterium tuberculosis
RRAVSCSTFDS

SEQ ID NO: 33325 - protein, 11 aa, Mycobacterium tuberculosis
RAVSCSTFDSM

SEQ ID NO: 33326 - protein, 11 aa, Mycobacterium tuberculosis
AVSCSTFDSMD

SEQ ID NO: 33327 - protein, 11 aa, Mycobacterium tuberculosis
VSCSTFDSMDA

SEQ ID NO: 33328 - protein, 11 aa, Mycobacterium tuberculosis
SCSTFDSMDAM

SEQ ID NO: 33329 - protein, 11 aa, Mycobacterium tuberculosis
CSTFDSMDAMA

SEQ ID NO: 33330 - protein, 11 aa, Mycobacterium tuberculosis
STFDSMDAMAR

SEQ ID NO: 33331 - protein, 11 aa, Mycobacterium tuberculosis
TFDSMDAMARN

SEQ ID NO: 33332 - protein, 11 aa, Mycobacterium tuberculosis
FDSMDAMARNR

SEQ ID NO: 33333 - protein, 11 aa, Mycobacterium tuberculosis
DSMDAMARNRD

SEQ ID NO: 33334 - protein, 11 aa, Mycobacterium tuberculosis
SMDAMARNRDR

SEQ ID NO: 33335 - protein, 11 aa, Mycobacterium tuberculosis
MDAMARNRDRA

SEQ ID NO: 33336 - protein, 11 aa, Mycobacterium tuberculosis
DAMARNRDRAS

SEQ ID NO: 33337 - protein, 11 aa, Mycobacterium tuberculosis
AMARNRDRASE

SEQ ID NO: 33338 - protein, 11 aa, Mycobacterium tuberculosis
MARNRDRASEL

SEQ ID NO: 33339 - protein, 11 aa, Mycobacterium tuberculosis
ARNRDRASELR

SEQ ID NO: 33340 - protein, 11 aa, Mycobacterium tuberculosis
RNRDRASELRS

SEQ ID NO: 33341 - protein, 11 aa, Mycobacterium tuberculosis
NRDRASELRSR

SEQ ID NO: 33342 - protein, 11 aa, Mycobacterium tuberculosis
RDRASELRSRR

SEQ ID NO: 33343 - protein, 11 aa, Mycobacterium tuberculosis
DRASELRSRRV

SEQ ID NO: 33344 - protein, 11 aa, Mycobacterium tuberculosis
RASELRSRRVR

SEQ ID NO: 33345 - protein, 11 aa, Mycobacterium tuberculosis
ASELRSRRVRE

SEQ ID NO: 33346 - protein, 11 aa, Mycobacterium tuberculosis
SELRSRRVREL

SEQ ID NO: 33347 - protein, 11 aa, Mycobacterium tuberculosis
ELRSRRVRELG

SEQ ID NO: 33348 - protein, 11 aa, Mycobacterium tuberculosis
LRSRRVRELGA

SEQ ID NO: 33349 - protein, 11 aa, Mycobacterium tuberculosis
RSRRVRELGAE

SEQ ID NO: 33350 - protein, 11 aa, Mycobacterium tuberculosis
SRRVRELGAEV

SEQ ID NO: 33351 - protein, 11 aa, Mycobacterium tuberculosis
RRVRELGAEVL

SEQ ID NO: 33352 - protein, 11 aa, Mycobacterium tuberculosis
RVRELGAEVLD

SEQ ID NO: 33353 - protein, 11 aa, Mycobacterium tuberculosis
VRELGAEVLDV

SEQ ID NO: 33354 - protein, 11 aa, Mycobacterium tuberculosis
RELGAEVLDVA

SEQ ID NO: 33355 - protein, 11 aa, Mycobacterium tuberculosis
ELGAEVLDVAE

SEQ ID NO: 33356 - protein, 11 aa, Mycobacterium tuberculosis
LGAEVLDVAEF

SEQ ID NO: 33357 - protein, 11 aa, Mycobacterium tuberculosis
GAEVLDVAEFE

SEQ ID NO: 33358 - protein, 11 aa, Mycobacterium tuberculosis
AEVLDVAEFEL

SEQ ID NO: 33359 - protein, 11 aa, Mycobacterium tuberculosis
EVLDVAEFELA

SEQ ID NO: 33360 - protein, 11 aa, Mycobacterium tuberculosis
VLDVAEFELAI

SEQ ID NO: 33361 - protein, 11 aa, Mycobacterium tuberculosis
LDVAEFELAIA

SEQ ID NO: 33362 - protein, 11 aa, Mycobacterium tuberculosis
DVAEFELAIAH

SEQ ID NO: 33363 - protein, 11 aa, Mycobacterium tuberculosis
VAEFELAIAHL

SEQ ID NO: 33364 - protein, 11 aa, Mycobacterium tuberculosis
AEFELAIAHLR

SEQ ID NO: 33365 - protein, 11 aa, Mycobacterium tuberculosis
EFELAIAHLRV

SEQ ID NO: 33366 - protein, 11 aa, Mycobacterium tuberculosis
FELAIAHLRVP

SEQ ID NO: 33367 - protein, 11 aa, Mycobacterium tuberculosis
ELAIAHLRVPE

SEQ ID NO: 33368 - protein, 11 aa, Mycobacterium tuberculosis
LAIAHLRVPEL

SEQ ID NO: 33369 - protein, 11 aa, Mycobacterium tuberculosis
AIAHLRVPELV

SEQ ID NO: 33370 - protein, 8 aa, Mycobacterium tuberculosis
MTHKRTKR

SEQ ID NO: 33371 - protein, 8 aa, Mycobacterium tuberculosis
THKRTKRQ

SEQ ID NO: 33372 - protein, 8 aa, Mycobacterium tuberculosis
HKRTKRQP

SEQ ID NO: 33373 - protein, 8 aa, Mycobacterium tuberculosis
KRTKRQPA

SEQ ID NO: 33374 - protein, 8 aa, Mycobacterium tuberculosis
RTKRQPAI

SEQ ID NO: 33375 - protein, 8 aa, Mycobacterium tuberculosis
TKRQPAIA

SEQ ID NO: 33376 - protein, 8 aa, Mycobacterium tuberculosis
KRQPAIAA

SEQ ID NO: 33377 - protein, 8 aa, Mycobacterium tuberculosis
RQPAIAAG

SEQ ID NO: 33378 - protein, 8 aa, Mycobacterium tuberculosis
QPAIAAGL

SEQ ID NO: 33379 - protein, 8 aa, Mycobacterium tuberculosis
PAIAAGLN

SEQ ID NO: 33380 - protein, 8 aa, Mycobacterium tuberculosis
AIAAGLNA

SEQ ID NO: 33381 - protein, 8 aa, Mycobacterium tuberculosis
IAAGLNAP

SEQ ID NO: 33382 - protein, 8 aa, Mycobacterium tuberculosis
AAGLNAPR

SEQ ID NO: 33383 - protein, 8 aa, Mycobacterium tuberculosis
AGLNAPRR

SEQ ID NO: 33384 - protein, 8 aa, Mycobacterium tuberculosis
GLNAPRRN

SEQ ID NO: 33385 - protein, 8 aa, Mycobacterium tuberculosis
LNAPRRNR

SEQ ID NO: 33386 - protein, 8 aa, Mycobacterium tuberculosis
NAPRRNRV

SEQ ID NO: 33387 - protein, 8 aa, Mycobacterium tuberculosis
APRRNRVG

SEQ ID NO: 33388 - protein, 8 aa, Mycobacterium tuberculosis
PRRNRVGR

SEQ ID NO: 33389 - protein, 8 aa, Mycobacterium tuberculosis
RRNRVGRQ

SEQ ID NO: 33390 - protein, 8 aa, Mycobacterium tuberculosis
RNRVGRQH

SEQ ID NO: 33391 - protein, 8 aa, Mycobacterium tuberculosis
NRVGRQHG

SEQ ID NO: 33392 - protein, 8 aa, Mycobacterium tuberculosis
RVGRQHGW

SEQ ID NO: 33393 - protein, 8 aa, Mycobacterium tuberculosis
VGRQHGWP

SEQ ID NO: 33394 - protein, 8 aa, Mycobacterium tuberculosis
GRQHGWPA

SEQ ID NO: 33395 - protein, 8 aa, Mycobacterium tuberculosis
RQHGWPAD

SEQ ID NO: 33396 - protein, 8 aa, Mycobacterium tuberculosis
QHGWPADV

SEQ ID NO: 33397 - protein, 8 aa, Mycobacterium tuberculosis
HGWPADVP

SEQ ID NO: 33398 - protein, 8 aa, Mycobacterium tuberculosis
GWPADVPS

SEQ ID NO: 33399 - protein, 8 aa, Mycobacterium tuberculosis
WPADVPSA

SEQ ID NO: 33400 - protein, 8 aa, Mycobacterium tuberculosis
PADVPSAE

SEQ ID NO: 33401 - protein, 8 aa, Mycobacterium tuberculosis
ADVPSAEQ

SEQ ID NO: 33402 - protein, 8 aa, Mycobacterium tuberculosis
DVPSAEQR

SEQ ID NO: 33403 - protein, 8 aa, Mycobacterium tuberculosis
VPSAEQRR

SEQ ID NO: 33404 - protein, 8 aa, Mycobacterium tuberculosis
PSAEQRRA

SEQ ID NO: 33405 - protein, 8 aa, Mycobacterium tuberculosis
SAEQRRAQ

SEQ ID NO: 33406 - protein, 8 aa, Mycobacterium tuberculosis
AEQRRAQR

SEQ ID NO: 33407 - protein, 8 aa, Mycobacterium tuberculosis
EQRRAQRQ

SEQ ID NO: 33408 - protein, 8 aa, Mycobacterium tuberculosis
QRRAQRQR

SEQ ID NO: 33409 - protein, 8 aa, Mycobacterium tuberculosis
RRAQRQRD

SEQ ID NO: 33410 - protein, 8 aa, Mycobacterium tuberculosis
RAQRQRDL

SEQ ID NO: 33411 - protein, 8 aa, Mycobacterium tuberculosis
AQRQRDLE

SEQ ID NO: 33412 - protein, 8 aa, Mycobacterium tuberculosis
QRQRDLEA

SEQ ID NO: 33413 - protein, 8 aa, Mycobacterium tuberculosis
RQRDLEAI

SEQ ID NO: 33414 - protein, 8 aa, Mycobacterium tuberculosis
QRDLEAIR

SEQ ID NO: 33415 - protein, 8 aa, Mycobacterium tuberculosis
RDLEAIRR

SEQ ID NO: 33416 - protein, 8 aa, Mycobacterium tuberculosis
DLEAIRRA

SEQ ID NO: 33417 - protein, 8 aa, Mycobacterium tuberculosis
LEAIRRAY

SEQ ID NO: 33418 - protein, 8 aa, Mycobacterium tuberculosis
EAIRRAYA

SEQ ID NO: 33419 - protein, 8 aa, Mycobacterium tuberculosis
AIRRAYAE

SEQ ID NO: 33420 - protein, 8 aa, Mycobacterium tuberculosis
IRRAYAEM

SEQ ID NO: 33421 - protein, 8 aa, Mycobacterium tuberculosis
RRAYAEMV

SEQ ID NO: 33422 - protein, 8 aa, Mycobacterium tuberculosis
RAYAEMVA

SEQ ID NO: 33423 - protein, 8 aa, Mycobacterium tuberculosis
AYAEMVAT

SEQ ID NO: 33424 - protein, 8 aa, Mycobacterium tuberculosis
YAEMVATS

SEQ ID NO: 33425 - protein, 8 aa, Mycobacterium tuberculosis
AEMVATSH

SEQ ID NO: 33426 - protein, 8 aa, Mycobacterium tuberculosis
EMVATSHE

SEQ ID NO: 33427 - protein, 8 aa, Mycobacterium tuberculosis
MVATSHEI

SEQ ID NO: 33428 - protein, 8 aa, Mycobacterium tuberculosis
VATSHEID

SEQ ID NO: 33429 - protein, 8 aa, Mycobacterium tuberculosis
ATSHEIDD

SEQ ID NO: 33430 - protein, 8 aa, Mycobacterium tuberculosis
TSHEIDDD

SEQ ID NO: 33431 - protein, 8 aa, Mycobacterium tuberculosis
SHEIDDDT

SEQ ID NO: 33432 - protein, 8 aa, Mycobacterium tuberculosis
HEIDDDTA

SEQ ID NO: 33433 - protein, 8 aa, Mycobacterium tuberculosis
EIDDDTAE

SEQ ID NO: 33434 - protein, 8 aa, Mycobacterium tuberculosis
IDDDTAEL

SEQ ID NO: 33435 - protein, 8 aa, Mycobacterium tuberculosis
DDDTAELA

SEQ ID NO: 33436 - protein, 8 aa, Mycobacterium tuberculosis
DDTAELAL

SEQ ID NO: 33437 - protein, 8 aa, Mycobacterium tuberculosis
DTAELALL

SEQ ID NO: 33438 - protein, 8 aa, Mycobacterium tuberculosis
TAELALLS

SEQ ID NO: 33439 - protein, 8 aa, Mycobacterium tuberculosis
AELALLSM

SEQ ID NO: 33440 - protein, 8 aa, Mycobacterium tuberculosis
ELALLSMH

SEQ ID NO: 33441 - protein, 8 aa, Mycobacterium tuberculosis
LALLSMHL

SEQ ID NO: 33442 - protein, 8 aa, Mycobacterium tuberculosis
ALLSMHLD

SEQ ID NO: 33443 - protein, 8 aa, Mycobacterium tuberculosis
LLSMHLDD

SEQ ID NO: 33444 - protein, 8 aa, Mycobacterium tuberculosis
LSMHLDDE

SEQ ID NO: 33445 - protein, 8 aa, Mycobacterium tuberculosis
SMHLDDEQ

SEQ ID NO: 33446 - protein, 8 aa, Mycobacterium tuberculosis
MHLDDEQR

SEQ ID NO: 33447 - protein, 8 aa, Mycobacterium tuberculosis
HLDDEQRR

SEQ ID NO: 33448 - protein, 8 aa, Mycobacterium tuberculosis
LDDEQRRL

SEQ ID NO: 33449 - protein, 8 aa, Mycobacterium tuberculosis
DDEQRRLE

SEQ ID NO: 33450 - protein, 8 aa, Mycobacterium tuberculosis
DEQRRLEA

SEQ ID NO: 33451 - protein, 8 aa, Mycobacterium tuberculosis
EQRRLEAG

SEQ ID NO: 33452 - protein, 8 aa, Mycobacterium tuberculosis
QRRLEAGM

SEQ ID NO: 33453 - protein, 8 aa, Mycobacterium tuberculosis
RRLEAGMK

SEQ ID NO: 33454 - protein, 8 aa, Mycobacterium tuberculosis
RLEAGMKL

SEQ ID NO: 33455 - protein, 8 aa, Mycobacterium tuberculosis
LEAGMKLG

SEQ ID NO: 33456 - protein, 8 aa, Mycobacterium tuberculosis
EAGMKLGW

SEQ ID NO: 33457 - protein, 8 aa, Mycobacterium tuberculosis
AGMKLGWH

SEQ ID NO: 33458 - protein, 8 aa, Mycobacterium tuberculosis
GMKLGWHP

SEQ ID NO: 33459 - protein, 8 aa, Mycobacterium tuberculosis
MKLGWHPY

SEQ ID NO: 33460 - protein, 8 aa, Mycobacterium tuberculosis
KLGWHPYH

SEQ ID NO: 33461 - protein, 8 aa, Mycobacterium tuberculosis
LGWHPYHF

SEQ ID NO: 33462 - protein, 8 aa, Mycobacterium tuberculosis
GWHPYHFP

SEQ ID NO: 33463 - protein, 8 aa, Mycobacterium tuberculosis
WHPYHFPD

SEQ ID NO: 33464 - protein, 8 aa, Mycobacterium tuberculosis
HPYHFPDE

SEQ ID NO: 33465 - protein, 8 aa, Mycobacterium tuberculosis
PYHFPDEP

SEQ ID NO: 33466 - protein, 8 aa, Mycobacterium tuberculosis
YHFPDEPD

SEQ ID NO: 33467 - protein, 8 aa, Mycobacterium tuberculosis
HFPDEPDS

SEQ ID NO: 33468 - protein, 8 aa, Mycobacterium tuberculosis
FPDEPDSK

SEQ ID NO: 33469 - protein, 8 aa, Mycobacterium tuberculosis
PDEPDSKQ

SEQ ID NO: 33470 - protein, 9 aa, Mycobacterium tuberculosis
MTHKRTKRQ

SEQ ID NO: 33471 - protein, 9 aa, Mycobacterium tuberculosis
THKRTKRQP

SEQ ID NO: 33472 - protein, 9 aa, Mycobacterium tuberculosis
HKRTKRQPA

SEQ ID NO: 33473 - protein, 9 aa, Mycobacterium tuberculosis
KRTKRQPAI

SEQ ID NO: 33474 - protein, 9 aa, Mycobacterium tuberculosis
RTKRQPAIA

SEQ ID NO: 33475 - protein, 9 aa, Mycobacterium tuberculosis
TKRQPAIAA

SEQ ID NO: 33476 - protein, 9 aa, Mycobacterium tuberculosis
KRQPAIAAG

SEQ ID NO: 33477 - protein, 9 aa, Mycobacterium tuberculosis
RQPAIAAGL

SEQ ID NO: 33478 - protein, 9 aa, Mycobacterium tuberculosis
QPAIAAGLN

SEQ ID NO: 33479 - protein, 9 aa, Mycobacterium tuberculosis
PAIAAGLNA

SEQ ID NO: 33480 - protein, 9 aa, Mycobacterium tuberculosis
AIAAGLNAP

SEQ ID NO: 33481 - protein, 9 aa, Mycobacterium tuberculosis
IAAGLNAPR

SEQ ID NO: 33482 - protein, 9 aa, Mycobacterium tuberculosis
AAGLNAPRR

SEQ ID NO: 33483 - protein, 9 aa, Mycobacterium tuberculosis
AGLNAPRRN

SEQ ID NO: 33484 - protein, 9 aa, Mycobacterium tuberculosis
GLNAPRRNR

SEQ ID NO: 33485 - protein, 9 aa, Mycobacterium tuberculosis
LNAPRRNRV

SEQ ID NO: 33486 - protein, 9 aa, Mycobacterium tuberculosis
NAPRRNRVG

SEQ ID NO: 33487 - protein, 9 aa, Mycobacterium tuberculosis
APRRNRVGR

SEQ ID NO: 33488 - protein, 9 aa, Mycobacterium tuberculosis
PRRNRVGRQ

SEQ ID NO: 33489 - protein, 9 aa, Mycobacterium tuberculosis
RRNRVGRQH

SEQ ID NO: 33490 - protein, 9 aa, Mycobacterium tuberculosis
RNRVGRQHG

SEQ ID NO: 33491 - protein, 9 aa, Mycobacterium tuberculosis
NRVGRQHGW

SEQ ID NO: 33492 - protein, 9 aa, Mycobacterium tuberculosis
RVGRQHGWP

SEQ ID NO: 33493 - protein, 9 aa, Mycobacterium tuberculosis
VGRQHGWPA

SEQ ID NO: 33494 - protein, 9 aa, Mycobacterium tuberculosis
GRQHGWPAD

SEQ ID NO: 33495 - protein, 9 aa, Mycobacterium tuberculosis
RQHGWPADV

SEQ ID NO: 33496 - protein, 9 aa, Mycobacterium tuberculosis
QHGWPADVP

SEQ ID NO: 33497 - protein, 9 aa, Mycobacterium tuberculosis
HGWPADVPS

SEQ ID NO: 33498 - protein, 9 aa, Mycobacterium tuberculosis
GWPADVPSA

SEQ ID NO: 33499 - protein, 9 aa, Mycobacterium tuberculosis
WPADVPSAE

SEQ ID NO: 33500 - protein, 9 aa, Mycobacterium tuberculosis
PADVPSAEQ

SEQ ID NO: 33501 - protein, 9 aa, Mycobacterium tuberculosis
ADVPSAEQR

SEQ ID NO: 33502 - protein, 9 aa, Mycobacterium tuberculosis
DVPSAEQRR

SEQ ID NO: 33503 - protein, 9 aa, Mycobacterium tuberculosis
VPSAEQRRA

SEQ ID NO: 33504 - protein, 9 aa, Mycobacterium tuberculosis
PSAEQRRAQ

SEQ ID NO: 33505 - protein, 9 aa, Mycobacterium tuberculosis
SAEQRRAQR

SEQ ID NO: 33506 - protein, 9 aa, Mycobacterium tuberculosis
AEQRRAQRQ

SEQ ID NO: 33507 - protein, 9 aa, Mycobacterium tuberculosis
EQRRAQRQR

SEQ ID NO: 33508 - protein, 9 aa, Mycobacterium tuberculosis
QRRAQRQRD

SEQ ID NO: 33509 - protein, 9 aa, Mycobacterium tuberculosis
RRAQRQRDL

SEQ ID NO: 33510 - protein, 9 aa, Mycobacterium tuberculosis
RAQRQRDLE

SEQ ID NO: 33511 - protein, 9 aa, Mycobacterium tuberculosis
AQRQRDLEA

SEQ ID NO: 33512 - protein, 9 aa, Mycobacterium tuberculosis
QRQRDLEAI

SEQ ID NO: 33513 - protein, 9 aa, Mycobacterium tuberculosis
RQRDLEAIR

SEQ ID NO: 33514 - protein, 9 aa, Mycobacterium tuberculosis
QRDLEAIRR

SEQ ID NO: 33515 - protein, 9 aa, Mycobacterium tuberculosis
RDLEAIRRA

SEQ ID NO: 33516 - protein, 9 aa, Mycobacterium tuberculosis
DLEAIRRAY

SEQ ID NO: 33517 - protein, 9 aa, Mycobacterium tuberculosis
LEAIRRAYA

SEQ ID NO: 33518 - protein, 9 aa, Mycobacterium tuberculosis
EAIRRAYAE

SEQ ID NO: 33519 - protein, 9 aa, Mycobacterium tuberculosis
AIRRAYAEM

SEQ ID NO: 33520 - protein, 9 aa, Mycobacterium tuberculosis
IRRAYAEMV

SEQ ID NO: 33521 - protein, 9 aa, Mycobacterium tuberculosis
RRAYAEMVA

SEQ ID NO: 33522 - protein, 9 aa, Mycobacterium tuberculosis
RAYAEMVAT

SEQ ID NO: 33523 - protein, 9 aa, Mycobacterium tuberculosis
AYAEMVATS

SEQ ID NO: 33524 - protein, 9 aa, Mycobacterium tuberculosis
YAEMVATSH

SEQ ID NO: 33525 - protein, 9 aa, Mycobacterium tuberculosis
AEMVATSHE

SEQ ID NO: 33526 - protein, 9 aa, Mycobacterium tuberculosis
EMVATSHEI

SEQ ID NO: 33527 - protein, 9 aa, Mycobacterium tuberculosis
MVATSHEID

SEQ ID NO: 33528 - protein, 9 aa, Mycobacterium tuberculosis
VATSHEIDD

SEQ ID NO: 33529 - protein, 9 aa, Mycobacterium tuberculosis
ATSHEIDDD

SEQ ID NO: 33530 - protein, 9 aa, Mycobacterium tuberculosis
TSHEIDDDT

SEQ ID NO: 33531 - protein, 9 aa, Mycobacterium tuberculosis
SHEIDDDTA

SEQ ID NO: 33532 - protein, 9 aa, Mycobacterium tuberculosis
HEIDDDTAE

SEQ ID NO: 33533 - protein, 9 aa, Mycobacterium tuberculosis
EIDDDTAEL

SEQ ID NO: 33534 - protein, 9 aa, Mycobacterium tuberculosis
IDDDTAELA

SEQ ID NO: 33535 - protein, 9 aa, Mycobacterium tuberculosis
DDDTAELAL

SEQ ID NO: 33536 - protein, 9 aa, Mycobacterium tuberculosis
DDTAELALL

SEQ ID NO: 33537 - protein, 9 aa, Mycobacterium tuberculosis
DTAELALLS

SEQ ID NO: 33538 - protein, 9 aa, Mycobacterium tuberculosis
TAELALLSM

SEQ ID NO: 33539 - protein, 9 aa, Mycobacterium tuberculosis
AELALLSMH

SEQ ID NO: 33540 - protein, 9 aa, Mycobacterium tuberculosis
ELALLSMHL

SEQ ID NO: 33541 - protein, 9 aa, Mycobacterium tuberculosis
LALLSMHLD

SEQ ID NO: 33542 - protein, 9 aa, Mycobacterium tuberculosis
ALLSMHLDD

SEQ ID NO: 33543 - protein, 9 aa, Mycobacterium tuberculosis
LLSMHLDDE

SEQ ID NO: 33544 - protein, 9 aa, Mycobacterium tuberculosis
LSMHLDDEQ

SEQ ID NO: 33545 - protein, 9 aa, Mycobacterium tuberculosis
SMHLDDEQR

SEQ ID NO: 33546 - protein, 9 aa, Mycobacterium tuberculosis
MHLDDEQRR

SEQ ID NO: 33547 - protein, 9 aa, Mycobacterium tuberculosis
HLDDEQRRL

SEQ ID NO: 33548 - protein, 9 aa, Mycobacterium tuberculosis
LDDEQRRLE

SEQ ID NO: 33549 - protein, 9 aa, Mycobacterium tuberculosis
DDEQRRLEA

SEQ ID NO: 33550 - protein, 9 aa, Mycobacterium tuberculosis
DEQRRLEAG

SEQ ID NO: 33551 - protein, 9 aa, Mycobacterium tuberculosis
EQRRLEAGM

SEQ ID NO: 33552 - protein, 9 aa, Mycobacterium tuberculosis
QRRLEAGMK

SEQ ID NO: 33553 - protein, 9 aa, Mycobacterium tuberculosis
RRLEAGMKL

SEQ ID NO: 33554 - protein, 9 aa, Mycobacterium tuberculosis
RLEAGMKLG

SEQ ID NO: 33555 - protein, 9 aa, Mycobacterium tuberculosis
LEAGMKLGW

SEQ ID NO: 33556 - protein, 9 aa, Mycobacterium tuberculosis
EAGMKLGWH

SEQ ID NO: 33557 - protein, 9 aa, Mycobacterium tuberculosis
AGMKLGWHP

SEQ ID NO: 33558 - protein, 9 aa, Mycobacterium tuberculosis
GMKLGWHPY

SEQ ID NO: 33559 - protein, 9 aa, Mycobacterium tuberculosis
MKLGWHPYH

SEQ ID NO: 33560 - protein, 9 aa, Mycobacterium tuberculosis
KLGWHPYHF

SEQ ID NO: 33561 - protein, 9 aa, Mycobacterium tuberculosis
LGWHPYHFP

SEQ ID NO: 33562 - protein, 9 aa, Mycobacterium tuberculosis
GWHPYHFPD

SEQ ID NO: 33563 - protein, 9 aa, Mycobacterium tuberculosis
WHPYHFPDE

SEQ ID NO: 33564 - protein, 9 aa, Mycobacterium tuberculosis
HPYHFPDEP

SEQ ID NO: 33565 - protein, 9 aa, Mycobacterium tuberculosis
PYHFPDEPD

SEQ ID NO: 33566 - protein, 9 aa, Mycobacterium tuberculosis
YHFPDEPDS

SEQ ID NO: 33567 - protein, 9 aa, Mycobacterium tuberculosis
HFPDEPDSK

SEQ ID NO: 33568 - protein, 9 aa, Mycobacterium tuberculosis
FPDEPDSKQ

SEQ ID NO: 33569 - protein, 10 aa, Mycobacterium tuberculosis
MTHKRTKRQP

SEQ ID NO: 33570 - protein, 10 aa, Mycobacterium tuberculosis
THKRTKRQPA

SEQ ID NO: 33571 - protein, 10 aa, Mycobacterium tuberculosis
HKRTKRQPAI

SEQ ID NO: 33572 - protein, 10 aa, Mycobacterium tuberculosis
KRTKRQPAIA

SEQ ID NO: 33573 - protein, 10 aa, Mycobacterium tuberculosis
RTKRQPAIAA

SEQ ID NO: 33574 - protein, 10 aa, Mycobacterium tuberculosis
TKRQPAIAAG

SEQ ID NO: 33575 - protein, 10 aa, Mycobacterium tuberculosis
KRQPAIAAGL

SEQ ID NO: 33576 - protein, 10 aa, Mycobacterium tuberculosis
RQPAIAAGLN

SEQ ID NO: 33577 - protein, 10 aa, Mycobacterium tuberculosis
QPAIAAGLNA

SEQ ID NO: 33578 - protein, 10 aa, Mycobacterium tuberculosis
PAIAAGLNAP

SEQ ID NO: 33579 - protein, 10 aa, Mycobacterium tuberculosis
AIAAGLNAPR

SEQ ID NO: 33580 - protein, 10 aa, Mycobacterium tuberculosis
IAAGLNAPRR

SEQ ID NO: 33581 - protein, 10 aa, Mycobacterium tuberculosis
AAGLNAPRRN

SEQ ID NO: 33582 - protein, 10 aa, Mycobacterium tuberculosis
AGLNAPRRNR

SEQ ID NO: 33583 - protein, 10 aa, Mycobacterium tuberculosis
GLNAPRRNRV

SEQ ID NO: 33584 - protein, 10 aa, Mycobacterium tuberculosis
LNAPRRNRVG

SEQ ID NO: 33585 - protein, 10 aa, Mycobacterium tuberculosis
NAPRRNRVGR

SEQ ID NO: 33586 - protein, 10 aa, Mycobacterium tuberculosis
APRRNRVGRQ

SEQ ID NO: 33587 - protein, 10 aa, Mycobacterium tuberculosis
PRRNRVGRQH

SEQ ID NO: 33588 - protein, 10 aa, Mycobacterium tuberculosis
RRNRVGRQHG

SEQ ID NO: 33589 - protein, 10 aa, Mycobacterium tuberculosis
RNRVGRQHGW

SEQ ID NO: 33590 - protein, 10 aa, Mycobacterium tuberculosis
NRVGRQHGWP

SEQ ID NO: 33591 - protein, 10 aa, Mycobacterium tuberculosis
RVGRQHGWPA

SEQ ID NO: 33592 - protein, 10 aa, Mycobacterium tuberculosis
VGRQHGWPAD

SEQ ID NO: 33593 - protein, 10 aa, Mycobacterium tuberculosis
GRQHGWPADV

SEQ ID NO: 33594 - protein, 10 aa, Mycobacterium tuberculosis
RQHGWPADVP

SEQ ID NO: 33595 - protein, 10 aa, Mycobacterium tuberculosis
QHGWPADVPS

SEQ ID NO: 33596 - protein, 10 aa, Mycobacterium tuberculosis
HGWPADVPSA

SEQ ID NO: 33597 - protein, 10 aa, Mycobacterium tuberculosis
GWPADVPSAE

SEQ ID NO: 33598 - protein, 10 aa, Mycobacterium tuberculosis
WPADVPSAEQ

SEQ ID NO: 33599 - protein, 10 aa, Mycobacterium tuberculosis
PADVPSAEQR

SEQ ID NO: 33600 - protein, 10 aa, Mycobacterium tuberculosis
ADVPSAEQRR

SEQ ID NO: 33601 - protein, 10 aa, Mycobacterium tuberculosis
DVPSAEQRRA

SEQ ID NO: 33602 - protein, 10 aa, Mycobacterium tuberculosis
VPSAEQRRAQ

SEQ ID NO: 33603 - protein, 10 aa, Mycobacterium tuberculosis
PSAEQRRAQR

SEQ ID NO: 33604 - protein, 10 aa, Mycobacterium tuberculosis
SAEQRRAQRQ

SEQ ID NO: 33605 - protein, 10 aa, Mycobacterium tuberculosis
AEQRRAQRQR

SEQ ID NO: 33606 - protein, 10 aa, Mycobacterium tuberculosis
EQRRAQRQRD

SEQ ID NO: 33607 - protein, 10 aa, Mycobacterium tuberculosis
QRRAQRQRDL

SEQ ID NO: 33608 - protein, 10 aa, Mycobacterium tuberculosis
RRAQRQRDLE

SEQ ID NO: 33609 - protein, 10 aa, Mycobacterium tuberculosis
RAQRQRDLEA

SEQ ID NO: 33610 - protein, 10 aa, Mycobacterium tuberculosis
AQRQRDLEAI

SEQ ID NO: 33611 - protein, 10 aa, Mycobacterium tuberculosis
QRQRDLEAIR

SEQ ID NO: 33612 - protein, 10 aa, Mycobacterium tuberculosis
RQRDLEAIRR

SEQ ID NO: 33613 - protein, 10 aa, Mycobacterium tuberculosis
QRDLEAIRRA

SEQ ID NO: 33614 - protein, 10 aa, Mycobacterium tuberculosis
RDLEAIRRAY

SEQ ID NO: 33615 - protein, 10 aa, Mycobacterium tuberculosis
DLEAIRRAYA

SEQ ID NO: 33616 - protein, 10 aa, Mycobacterium tuberculosis
LEAIRRAYAE

SEQ ID NO: 33617 - protein, 10 aa, Mycobacterium tuberculosis
EAIRRAYAEM

SEQ ID NO: 33618 - protein, 10 aa, Mycobacterium tuberculosis
AIRRAYAEMV

SEQ ID NO: 33619 - protein, 10 aa, Mycobacterium tuberculosis
IRRAYAEMVA

SEQ ID NO: 33620 - protein, 10 aa, Mycobacterium tuberculosis
RRAYAEMVAT

SEQ ID NO: 33621 - protein, 10 aa, Mycobacterium tuberculosis
RAYAEMVATS

SEQ ID NO: 33622 - protein, 10 aa, Mycobacterium tuberculosis
AYAEMVATSH

SEQ ID NO: 33623 - protein, 10 aa, Mycobacterium tuberculosis
YAEMVATSHE

SEQ ID NO: 33624 - protein, 10 aa, Mycobacterium tuberculosis
AEMVATSHEI

SEQ ID NO: 33625 - protein, 10 aa, Mycobacterium tuberculosis
EMVATSHEID

SEQ ID NO: 33626 - protein, 10 aa, Mycobacterium tuberculosis
MVATSHEIDD

SEQ ID NO: 33627 - protein, 10 aa, Mycobacterium tuberculosis
VATSHEIDDD

SEQ ID NO: 33628 - protein, 10 aa, Mycobacterium tuberculosis
ATSHEIDDDT

SEQ ID NO: 33629 - protein, 10 aa, Mycobacterium tuberculosis
TSHEIDDDTA

SEQ ID NO: 33630 - protein, 10 aa, Mycobacterium tuberculosis
SHEIDDDTAE

SEQ ID NO: 33631 - protein, 10 aa, Mycobacterium tuberculosis
HEIDDDTAEL

SEQ ID NO: 33632 - protein, 10 aa, Mycobacterium tuberculosis
EIDDDTAELA

SEQ ID NO: 33633 - protein, 10 aa, Mycobacterium tuberculosis
IDDDTAELAL

SEQ ID NO: 33634 - protein, 10 aa, Mycobacterium tuberculosis
DDDTAELALL

SEQ ID NO: 33635 - protein, 10 aa, Mycobacterium tuberculosis
DDTAELALLS

SEQ ID NO: 33636 - protein, 10 aa, Mycobacterium tuberculosis
DTAELALLSM

SEQ ID NO: 33637 - protein, 10 aa, Mycobacterium tuberculosis
TAELALLSMH

SEQ ID NO: 33638 - protein, 10 aa, Mycobacterium tuberculosis
AELALLSMHL

SEQ ID NO: 33639 - protein, 10 aa, Mycobacterium tuberculosis
ELALLSMHLD

SEQ ID NO: 33640 - protein, 10 aa, Mycobacterium tuberculosis
LALLSMHLDD

SEQ ID NO: 33641 - protein, 10 aa, Mycobacterium tuberculosis
ALLSMHLDDE

SEQ ID NO: 33642 - protein, 10 aa, Mycobacterium tuberculosis
LLSMHLDDEQ

SEQ ID NO: 33643 - protein, 10 aa, Mycobacterium tuberculosis
LSMHLDDEQR

SEQ ID NO: 33644 - protein, 10 aa, Mycobacterium tuberculosis
SMHLDDEQRR

SEQ ID NO: 33645 - protein, 10 aa, Mycobacterium tuberculosis
MHLDDEQRRL

SEQ ID NO: 33646 - protein, 10 aa, Mycobacterium tuberculosis
HLDDEQRRLE

SEQ ID NO: 33647 - protein, 10 aa, Mycobacterium tuberculosis
LDDEQRRLEA

SEQ ID NO: 33648 - protein, 10 aa, Mycobacterium tuberculosis
DDEQRRLEAG

SEQ ID NO: 33649 - protein, 10 aa, Mycobacterium tuberculosis
DEQRRLEAGM

SEQ ID NO: 33650 - protein, 10 aa, Mycobacterium tuberculosis
EQRRLEAGMK

SEQ ID NO: 33651 - protein, 10 aa, Mycobacterium tuberculosis
QRRLEAGMKL

SEQ ID NO: 33652 - protein, 10 aa, Mycobacterium tuberculosis
RRLEAGMKLG

SEQ ID NO: 33653 - protein, 10 aa, Mycobacterium tuberculosis
RLEAGMKLGW

SEQ ID NO: 33654 - protein, 10 aa, Mycobacterium tuberculosis
LEAGMKLGWH

SEQ ID NO: 33655 - protein, 10 aa, Mycobacterium tuberculosis
EAGMKLGWHP

SEQ ID NO: 33656 - protein, 10 aa, Mycobacterium tuberculosis
AGMKLGWHPY

SEQ ID NO: 33657 - protein, 10 aa, Mycobacterium tuberculosis
GMKLGWHPYH

SEQ ID NO: 33658 - protein, 10 aa, Mycobacterium tuberculosis
MKLGWHPYHF

SEQ ID NO: 33659 - protein, 10 aa, Mycobacterium tuberculosis
KLGWHPYHFP

SEQ ID NO: 33660 - protein, 10 aa, Mycobacterium tuberculosis
LGWHPYHFPD

SEQ ID NO: 33661 - protein, 10 aa, Mycobacterium tuberculosis
GWHPYHFPDE

SEQ ID NO: 33662 - protein, 10 aa, Mycobacterium tuberculosis
WHPYHFPDEP

SEQ ID NO: 33663 - protein, 10 aa, Mycobacterium tuberculosis
HPYHFPDEPD

SEQ ID NO: 33664 - protein, 10 aa, Mycobacterium tuberculosis
PYHFPDEPDS

SEQ ID NO: 33665 - protein, 10 aa, Mycobacterium tuberculosis
YHFPDEPDSK

SEQ ID NO: 33666 - protein, 10 aa, Mycobacterium tuberculosis
HFPDEPDSKQ

SEQ ID NO: 33667 - protein, 11 aa, Mycobacterium tuberculosis
MTHKRTKRQPA

SEQ ID NO: 33668 - protein, 11 aa, Mycobacterium tuberculosis
THKRTKRQPAI

SEQ ID NO: 33669 - protein, 11 aa, Mycobacterium tuberculosis
HKRTKRQPAIA

SEQ ID NO: 33670 - protein, 11 aa, Mycobacterium tuberculosis
KRTKRQPAIAA

SEQ ID NO: 33671 - protein, 11 aa, Mycobacterium tuberculosis
RTKRQPAIAAG

SEQ ID NO: 33672 - protein, 11 aa, Mycobacterium tuberculosis
TKRQPAIAAGL

SEQ ID NO: 33673 - protein, 11 aa, Mycobacterium tuberculosis
KRQPAIAAGLN

SEQ ID NO: 33674 - protein, 11 aa, Mycobacterium tuberculosis
RQPAIAAGLNA

SEQ ID NO: 33675 - protein, 11 aa, Mycobacterium tuberculosis
QPAIAAGLNAP

SEQ ID NO: 33676 - protein, 11 aa, Mycobacterium tuberculosis
PAIAAGLNAPR

SEQ ID NO: 33677 - protein, 11 aa, Mycobacterium tuberculosis
AIAAGLNAPRR

SEQ ID NO: 33678 - protein, 11 aa, Mycobacterium tuberculosis
IAAGLNAPRRN

SEQ ID NO: 33679 - protein, 11 aa, Mycobacterium tuberculosis
AAGLNAPRRNR

SEQ ID NO: 33680 - protein, 11 aa, Mycobacterium tuberculosis
AGLNAPRRNRV

SEQ ID NO: 33681 - protein, 11 aa, Mycobacterium tuberculosis
GLNAPRRNRVG

SEQ ID NO: 33682 - protein, 11 aa, Mycobacterium tuberculosis
LNAPRRNRVGR

SEQ ID NO: 33683 - protein, 11 aa, Mycobacterium tuberculosis
NAPRRNRVGRQ

SEQ ID NO: 33684 - protein, 11 aa, Mycobacterium tuberculosis
APRRNRVGRQH

SEQ ID NO: 33685 - protein, 11 aa, Mycobacterium tuberculosis
PRRNRVGRQHG

SEQ ID NO: 33686 - protein, 11 aa, Mycobacterium tuberculosis
RRNRVGRQHGW

SEQ ID NO: 33687 - protein, 11 aa, Mycobacterium tuberculosis
RNRVGRQHGWP

SEQ ID NO: 33688 - protein, 11 aa, Mycobacterium tuberculosis
NRVGRQHGWPA

SEQ ID NO: 33689 - protein, 11 aa, Mycobacterium tuberculosis
RVGRQHGWPAD

SEQ ID NO: 33690 - protein, 11 aa, Mycobacterium tuberculosis
VGRQHGWPADV

SEQ ID NO: 33691 - protein, 11 aa, Mycobacterium tuberculosis
GRQHGWPADVP

SEQ ID NO: 33692 - protein, 11 aa, Mycobacterium tuberculosis
RQHGWPADVPS

SEQ ID NO: 33693 - protein, 11 aa, Mycobacterium tuberculosis
QHGWPADVPSA

SEQ ID NO: 33694 - protein, 11 aa, Mycobacterium tuberculosis
HGWPADVPSAE

SEQ ID NO: 33695 - protein, 11 aa, Mycobacterium tuberculosis
GWPADVPSAEQ

SEQ ID NO: 33696 - protein, 11 aa, Mycobacterium tuberculosis
WPADVPSAEQR

SEQ ID NO: 33697 - protein, 11 aa, Mycobacterium tuberculosis
PADVPSAEQRR

SEQ ID NO: 33698 - protein, 11 aa, Mycobacterium tuberculosis
ADVPSAEQRRA

SEQ ID NO: 33699 - protein, 11 aa, Mycobacterium tuberculosis
DVPSAEQRRAQ

SEQ ID NO: 33700 - protein, 11 aa, Mycobacterium tuberculosis
VPSAEQRRAQR

SEQ ID NO: 33701 - protein, 11 aa, Mycobacterium tuberculosis
PSAEQRRAQRQ

SEQ ID NO: 33702 - protein, 11 aa, Mycobacterium tuberculosis
SAEQRRAQRQR

SEQ ID NO: 33703 - protein, 11 aa, Mycobacterium tuberculosis
AEQRRAQRQRD

SEQ ID NO: 33704 - protein, 11 aa, Mycobacterium tuberculosis
EQRRAQRQRDL

SEQ ID NO: 33705 - protein, 11 aa, Mycobacterium tuberculosis
QRRAQRQRDLE

SEQ ID NO: 33706 - protein, 11 aa, Mycobacterium tuberculosis
RRAQRQRDLEA

SEQ ID NO: 33707 - protein, 11 aa, Mycobacterium tuberculosis
RAQRQRDLEAI

SEQ ID NO: 33708 - protein, 11 aa, Mycobacterium tuberculosis
AQRQRDLEAIR

SEQ ID NO: 33709 - protein, 11 aa, Mycobacterium tuberculosis
QRQRDLEAIRR

SEQ ID NO: 33710 - protein, 11 aa, Mycobacterium tuberculosis
RQRDLEAIRRA

SEQ ID NO: 33711 - protein, 11 aa, Mycobacterium tuberculosis
QRDLEAIRRAY

SEQ ID NO: 33712 - protein, 11 aa, Mycobacterium tuberculosis
RDLEAIRRAYA

SEQ ID NO: 33713 - protein, 11 aa, Mycobacterium tuberculosis
DLEAIRRAYAE

SEQ ID NO: 33714 - protein, 11 aa, Mycobacterium tuberculosis
LEAIRRAYAEM

SEQ ID NO: 33715 - protein, 11 aa, Mycobacterium tuberculosis
EAIRRAYAEMV

SEQ ID NO: 33716 - protein, 11 aa, Mycobacterium tuberculosis
AIRRAYAEMVA

SEQ ID NO: 33717 - protein, 11 aa, Mycobacterium tuberculosis
IRRAYAEMVAT

SEQ ID NO: 33718 - protein, 11 aa, Mycobacterium tuberculosis
RRAYAEMVATS

SEQ ID NO: 33719 - protein, 11 aa, Mycobacterium tuberculosis
RAYAEMVATSH

SEQ ID NO: 33720 - protein, 11 aa, Mycobacterium tuberculosis
AYAEMVATSHE

SEQ ID NO: 33721 - protein, 11 aa, Mycobacterium tuberculosis
YAEMVATSHEI

SEQ ID NO: 33722 - protein, 11 aa, Mycobacterium tuberculosis
AEMVATSHEID

SEQ ID NO: 33723 - protein, 11 aa, Mycobacterium tuberculosis
EMVATSHEIDD

SEQ ID NO: 33724 - protein, 11 aa, Mycobacterium tuberculosis
MVATSHEIDDD

SEQ ID NO: 33725 - protein, 11 aa, Mycobacterium tuberculosis
VATSHEIDDDT

SEQ ID NO: 33726 - protein, 11 aa, Mycobacterium tuberculosis
ATSHEIDDDTA

SEQ ID NO: 33727 - protein, 11 aa, Mycobacterium tuberculosis
TSHEIDDDTAE

SEQ ID NO: 33728 - protein, 11 aa, Mycobacterium tuberculosis
SHEIDDDTAEL

SEQ ID NO: 33729 - protein, 11 aa, Mycobacterium tuberculosis
HEIDDDTAELA

SEQ ID NO: 33730 - protein, 11 aa, Mycobacterium tuberculosis
EIDDDTAELAL

SEQ ID NO: 33731 - protein, 11 aa, Mycobacterium tuberculosis
IDDDTAELALL

SEQ ID NO: 33732 - protein, 11 aa, Mycobacterium tuberculosis
DDDTAELALLS

SEQ ID NO: 33733 - protein, 11 aa, Mycobacterium tuberculosis
DDTAELALLSM

SEQ ID NO: 33734 - protein, 11 aa, Mycobacterium tuberculosis
DTAELALLSMH

SEQ ID NO: 33735 - protein, 11 aa, Mycobacterium tuberculosis
TAELALLSMHL

SEQ ID NO: 33736 - protein, 11 aa, Mycobacterium tuberculosis
AELALLSMHLD

SEQ ID NO: 33737 - protein, 11 aa, Mycobacterium tuberculosis
ELALLSMHLDD

SEQ ID NO: 33738 - protein, 11 aa, Mycobacterium tuberculosis
LALLSMHLDDE

SEQ ID NO: 33739 - protein, 11 aa, Mycobacterium tuberculosis
ALLSMHLDDEQ

SEQ ID NO: 33740 - protein, 11 aa, Mycobacterium tuberculosis
LLSMHLDDEQR

SEQ ID NO: 33741 - protein, 11 aa, Mycobacterium tuberculosis
LSMHLDDEQRR

SEQ ID NO: 33742 - protein, 11 aa, Mycobacterium tuberculosis
SMHLDDEQRRL

SEQ ID NO: 33743 - protein, 11 aa, Mycobacterium tuberculosis
MHLDDEQRRLE

SEQ ID NO: 33744 - protein, 11 aa, Mycobacterium tuberculosis
HLDDEQRRLEA

SEQ ID NO: 33745 - protein, 11 aa, Mycobacterium tuberculosis
LDDEQRRLEAG

SEQ ID NO: 33746 - protein, 11 aa, Mycobacterium tuberculosis
DDEQRRLEAGM

SEQ ID NO: 33747 - protein, 11 aa, Mycobacterium tuberculosis
DEQRRLEAGMK

SEQ ID NO: 33748 - protein, 11 aa, Mycobacterium tuberculosis
EQRRLEAGMKL

SEQ ID NO: 33749 - protein, 11 aa, Mycobacterium tuberculosis
QRRLEAGMKLG

SEQ ID NO: 33750 - protein, 11 aa, Mycobacterium tuberculosis
RRLEAGMKLGW

SEQ ID NO: 33751 - protein, 11 aa, Mycobacterium tuberculosis
RLEAGMKLGWH

SEQ ID NO: 33752 - protein, 11 aa, Mycobacterium tuberculosis
LEAGMKLGWHP

SEQ ID NO: 33753 - protein, 11 aa, Mycobacterium tuberculosis
EAGMKLGWHPY

SEQ ID NO: 33754 - protein, 11 aa, Mycobacterium tuberculosis
AGMKLGWHPYH

SEQ ID NO: 33755 - protein, 11 aa, Mycobacterium tuberculosis
GMKLGWHPYHF

SEQ ID NO: 33756 - protein, 11 aa, Mycobacterium tuberculosis
MKLGWHPYHFP

SEQ ID NO: 33757 - protein, 11 aa, Mycobacterium tuberculosis
KLGWHPYHFPD

SEQ ID NO: 33758 - protein, 11 aa, Mycobacterium tuberculosis
LGWHPYHFPDE

SEQ ID NO: 33759 - protein, 11 aa, Mycobacterium tuberculosis
GWHPYHFPDEP

SEQ ID NO: 33760 - protein, 11 aa, Mycobacterium tuberculosis
WHPYHFPDEPD

SEQ ID NO: 33761 - protein, 11 aa, Mycobacterium tuberculosis
HPYHFPDEPDS

SEQ ID NO: 33762 - protein, 11 aa, Mycobacterium tuberculosis
PYHFPDEPDSK

SEQ ID NO: 33763 - protein, 11 aa, Mycobacterium tuberculosis
YHFPDEPDSKQ

SEQ ID NO: 33764 - protein, 8 aa, Mycobacterium tuberculosis
MSGHALAA

SEQ ID NO: 33765 - protein, 8 aa, Mycobacterium tuberculosis
SGHALAAR

SEQ ID NO: 33766 - protein, 8 aa, Mycobacterium tuberculosis
GHALAART

SEQ ID NO: 33767 - protein, 8 aa, Mycobacterium tuberculosis
HALAARTL

SEQ ID NO: 33768 - protein, 8 aa, Mycobacterium tuberculosis
ALAARTLL

SEQ ID NO: 33769 - protein, 8 aa, Mycobacterium tuberculosis
LAARTLLA

SEQ ID NO: 33770 - protein, 8 aa, Mycobacterium tuberculosis
AARTLLAA

SEQ ID NO: 33771 - protein, 8 aa, Mycobacterium tuberculosis
ARTLLAAA

SEQ ID NO: 33772 - protein, 8 aa, Mycobacterium tuberculosis
RTLLAAAD

SEQ ID NO: 33773 - protein, 8 aa, Mycobacterium tuberculosis
TLLAAADE

SEQ ID NO: 33774 - protein, 8 aa, Mycobacterium tuberculosis
LLAAADEL

SEQ ID NO: 33775 - protein, 8 aa, Mycobacterium tuberculosis
LAAADELV

SEQ ID NO: 33776 - protein, 8 aa, Mycobacterium tuberculosis
AAADELVG

SEQ ID NO: 33777 - protein, 8 aa, Mycobacterium tuberculosis
AADELVGG

SEQ ID NO: 33778 - protein, 8 aa, Mycobacterium tuberculosis
ADELVGGP

SEQ ID NO: 33779 - protein, 8 aa, Mycobacterium tuberculosis
DELVGGPP

SEQ ID NO: 33780 - protein, 8 aa, Mycobacterium tuberculosis
ELVGGPPV

SEQ ID NO: 33781 - protein, 8 aa, Mycobacterium tuberculosis
LVGGPPVE

SEQ ID NO: 33782 - protein, 8 aa, Mycobacterium tuberculosis
VGGPPVEA

SEQ ID NO: 33783 - protein, 8 aa, Mycobacterium tuberculosis
GGPPVEAS

SEQ ID NO: 33784 - protein, 8 aa, Mycobacterium tuberculosis
GPPVEASA

SEQ ID NO: 33785 - protein, 8 aa, Mycobacterium tuberculosis
PPVEASAA

SEQ ID NO: 33786 - protein, 8 aa, Mycobacterium tuberculosis
PVEASAAA

SEQ ID NO: 33787 - protein, 8 aa, Mycobacterium tuberculosis
VEASAAAL

SEQ ID NO: 33788 - protein, 8 aa, Mycobacterium tuberculosis
EASAAALA

SEQ ID NO: 33789 - protein, 8 aa, Mycobacterium tuberculosis
ASAAALAG

SEQ ID NO: 33790 - protein, 8 aa, Mycobacterium tuberculosis
SAAALAGD

SEQ ID NO: 33791 - protein, 8 aa, Mycobacterium tuberculosis
AAALAGDA

SEQ ID NO: 33792 - protein, 8 aa, Mycobacterium tuberculosis
AALAGDAA

SEQ ID NO: 33793 - protein, 8 aa, Mycobacterium tuberculosis
ALAGDAAG

SEQ ID NO: 33794 - protein, 8 aa, Mycobacterium tuberculosis
LAGDAAGA

SEQ ID NO: 33795 - protein, 8 aa, Mycobacterium tuberculosis
AGDAAGAW

SEQ ID NO: 33796 - protein, 8 aa, Mycobacterium tuberculosis
GDAAGAWR

SEQ ID NO: 33797 - protein, 8 aa, Mycobacterium tuberculosis
DAAGAWRT

SEQ ID NO: 33798 - protein, 8 aa, Mycobacterium tuberculosis
AAGAWRTA

SEQ ID NO: 33799 - protein, 8 aa, Mycobacterium tuberculosis
AGAWRTAA

SEQ ID NO: 33800 - protein, 8 aa, Mycobacterium tuberculosis
GAWRTAAV

SEQ ID NO: 33801 - protein, 8 aa, Mycobacterium tuberculosis
AWRTAAVE

SEQ ID NO: 33802 - protein, 8 aa, Mycobacterium tuberculosis
WRTAAVEL

SEQ ID NO: 33803 - protein, 8 aa, Mycobacterium tuberculosis
RTAAVELA

SEQ ID NO: 33804 - protein, 8 aa, Mycobacterium tuberculosis
TAAVELAR

SEQ ID NO: 33805 - protein, 8 aa, Mycobacterium tuberculosis
AAVELARA

SEQ ID NO: 33806 - protein, 8 aa, Mycobacterium tuberculosis
AVELARAL

SEQ ID NO: 33807 - protein, 8 aa, Mycobacterium tuberculosis
VELARALV

SEQ ID NO: 33808 - protein, 8 aa, Mycobacterium tuberculosis
ELARALVR

SEQ ID NO: 33809 - protein, 8 aa, Mycobacterium tuberculosis
LARALVRA

SEQ ID NO: 33810 - protein, 8 aa, Mycobacterium tuberculosis
ARALVRAV

SEQ ID NO: 33811 - protein, 8 aa, Mycobacterium tuberculosis
RALVRAVA

SEQ ID NO: 33812 - protein, 8 aa, Mycobacterium tuberculosis
ALVRAVAE

SEQ ID NO: 33813 - protein, 8 aa, Mycobacterium tuberculosis
LVRAVAES

SEQ ID NO: 33814 - protein, 8 aa, Mycobacterium tuberculosis
VRAVAESH

SEQ ID NO: 33815 - protein, 8 aa, Mycobacterium tuberculosis
RAVAESHG

SEQ ID NO: 33816 - protein, 8 aa, Mycobacterium tuberculosis
AVAESHGV

SEQ ID NO: 33817 - protein, 8 aa, Mycobacterium tuberculosis
VAESHGVA

SEQ ID NO: 33818 - protein, 8 aa, Mycobacterium tuberculosis
AESHGVAA

SEQ ID NO: 33819 - protein, 8 aa, Mycobacterium tuberculosis
ESHGVAAV

SEQ ID NO: 33820 - protein, 8 aa, Mycobacterium tuberculosis
SHGVAAVL

SEQ ID NO: 33821 - protein, 8 aa, Mycobacterium tuberculosis
HGVAAVLF

SEQ ID NO: 33822 - protein, 8 aa, Mycobacterium tuberculosis
GVAAVLFA

SEQ ID NO: 33823 - protein, 8 aa, Mycobacterium tuberculosis
VAAVLFAA

SEQ ID NO: 33824 - protein, 8 aa, Mycobacterium tuberculosis
AAVLFAAT

SEQ ID NO: 33825 - protein, 8 aa, Mycobacterium tuberculosis
AVLFAATA

SEQ ID NO: 33826 - protein, 8 aa, Mycobacterium tuberculosis
VLFAATAA

SEQ ID NO: 33827 - protein, 8 aa, Mycobacterium tuberculosis
LFAATAAA

SEQ ID NO: 33828 - protein, 8 aa, Mycobacterium tuberculosis
FAATAAAA

SEQ ID NO: 33829 - protein, 8 aa, Mycobacterium tuberculosis
AATAAAAA

SEQ ID NO: 33830 - protein, 8 aa, Mycobacterium tuberculosis
ATAAAAAA

SEQ ID NO: 33831 - protein, 8 aa, Mycobacterium tuberculosis
TAAAAAAV

SEQ ID NO: 33832 - protein, 8 aa, Mycobacterium tuberculosis
AAAAAAVD

SEQ ID NO: 33833 - protein, 8 aa, Mycobacterium tuberculosis
AAAAAVDR

SEQ ID NO: 33834 - protein, 8 aa, Mycobacterium tuberculosis
AAAAVDRG

SEQ ID NO: 33835 - protein, 8 aa, Mycobacterium tuberculosis
AAAVDRGD

SEQ ID NO: 33836 - protein, 8 aa, Mycobacterium tuberculosis
AAVDRGDP

SEQ ID NO: 33837 - protein, 8 aa, Mycobacterium tuberculosis
AVDRGDPP

SEQ ID NO: 33838 - protein, 9 aa, Mycobacterium tuberculosis
MSGHALAAR

SEQ ID NO: 33839 - protein, 9 aa, Mycobacterium tuberculosis
SGHALAART

SEQ ID NO: 33840 - protein, 9 aa, Mycobacterium tuberculosis
GHALAARTL

SEQ ID NO: 33841 - protein, 9 aa, Mycobacterium tuberculosis
HALAARTLL

SEQ ID NO: 33842 - protein, 9 aa, Mycobacterium tuberculosis
ALAARTLLA

SEQ ID NO: 33843 - protein, 9 aa, Mycobacterium tuberculosis
LAARTLLAA

SEQ ID NO: 33844 - protein, 9 aa, Mycobacterium tuberculosis
AARTLLAAA

SEQ ID NO: 33845 - protein, 9 aa, Mycobacterium tuberculosis
ARTLLAAAD

SEQ ID NO: 33846 - protein, 9 aa, Mycobacterium tuberculosis
RTLLAAADE

SEQ ID NO: 33847 - protein, 9 aa, Mycobacterium tuberculosis
TLLAAADEL

SEQ ID NO: 33848 - protein, 9 aa, Mycobacterium tuberculosis
LLAAADELV

SEQ ID NO: 33849 - protein, 9 aa, Mycobacterium tuberculosis
LAAADELVG

SEQ ID NO: 33850 - protein, 9 aa, Mycobacterium tuberculosis
AAADELVGG

SEQ ID NO: 33851 - protein, 9 aa, Mycobacterium tuberculosis
AADELVGGP

SEQ ID NO: 33852 - protein, 9 aa, Mycobacterium tuberculosis
ADELVGGPP

SEQ ID NO: 33853 - protein, 9 aa, Mycobacterium tuberculosis
DELVGGPPV

SEQ ID NO: 33854 - protein, 9 aa, Mycobacterium tuberculosis
ELVGGPPVE

SEQ ID NO: 33855 - protein, 9 aa, Mycobacterium tuberculosis
LVGGPPVEA

SEQ ID NO: 33856 - protein, 9 aa, Mycobacterium tuberculosis
VGGPPVEAS

SEQ ID NO: 33857 - protein, 9 aa, Mycobacterium tuberculosis
GGPPVEASA

SEQ ID NO: 33858 - protein, 9 aa, Mycobacterium tuberculosis
GPPVEASAA

SEQ ID NO: 33859 - protein, 9 aa, Mycobacterium tuberculosis
PPVEASAAA

SEQ ID NO: 33860 - protein, 9 aa, Mycobacterium tuberculosis
PVEASAAAL

SEQ ID NO: 33861 - protein, 9 aa, Mycobacterium tuberculosis
VEASAAALA

SEQ ID NO: 33862 - protein, 9 aa, Mycobacterium tuberculosis
EASAAALAG

SEQ ID NO: 33863 - protein, 9 aa, Mycobacterium tuberculosis
ASAAALAGD

SEQ ID NO: 33864 - protein, 9 aa, Mycobacterium tuberculosis
SAAALAGDA

SEQ ID NO: 33865 - protein, 9 aa, Mycobacterium tuberculosis
AAALAGDAA

SEQ ID NO: 33866 - protein, 9 aa, Mycobacterium tuberculosis
AALAGDAAG

SEQ ID NO: 33867 - protein, 9 aa, Mycobacterium tuberculosis
ALAGDAAGA

SEQ ID NO: 33868 - protein, 9 aa, Mycobacterium tuberculosis
LAGDAAGAW

SEQ ID NO: 33869 - protein, 9 aa, Mycobacterium tuberculosis
AGDAAGAWR

SEQ ID NO: 33870 - protein, 9 aa, Mycobacterium tuberculosis
GDAAGAWRT

SEQ ID NO: 33871 - protein, 9 aa, Mycobacterium tuberculosis
DAAGAWRTA

SEQ ID NO: 33872 - protein, 9 aa, Mycobacterium tuberculosis
AAGAWRTAA

SEQ ID NO: 33873 - protein, 9 aa, Mycobacterium tuberculosis
AGAWRTAAV

SEQ ID NO: 33874 - protein, 9 aa, Mycobacterium tuberculosis
GAWRTAAVE

SEQ ID NO: 33875 - protein, 9 aa, Mycobacterium tuberculosis
AWRTAAVEL

SEQ ID NO: 33876 - protein, 9 aa, Mycobacterium tuberculosis
WRTAAVELA

SEQ ID NO: 33877 - protein, 9 aa, Mycobacterium tuberculosis
RTAAVELAR

SEQ ID NO: 33878 - protein, 9 aa, Mycobacterium tuberculosis
TAAVELARA

SEQ ID NO: 33879 - protein, 9 aa, Mycobacterium tuberculosis
AAVELARAL

SEQ ID NO: 33880 - protein, 9 aa, Mycobacterium tuberculosis
AVELARALV

SEQ ID NO: 33881 - protein, 9 aa, Mycobacterium tuberculosis
VELARALVR

SEQ ID NO: 33882 - protein, 9 aa, Mycobacterium tuberculosis
ELARALVRA

SEQ ID NO: 33883 - protein, 9 aa, Mycobacterium tuberculosis
LARALVRAV

SEQ ID NO: 33884 - protein, 9 aa, Mycobacterium tuberculosis
ARALVRAVA

SEQ ID NO: 33885 - protein, 9 aa, Mycobacterium tuberculosis
RALVRAVAE

SEQ ID NO: 33886 - protein, 9 aa, Mycobacterium tuberculosis
ALVRAVAES

SEQ ID NO: 33887 - protein, 9 aa, Mycobacterium tuberculosis
LVRAVAESH

SEQ ID NO: 33888 - protein, 9 aa, Mycobacterium tuberculosis
VRAVAESHG

SEQ ID NO: 33889 - protein, 9 aa, Mycobacterium tuberculosis
RAVAESHGV

SEQ ID NO: 33890 - protein, 9 aa, Mycobacterium tuberculosis
AVAESHGVA

SEQ ID NO: 33891 - protein, 9 aa, Mycobacterium tuberculosis
VAESHGVAA

SEQ ID NO: 33892 - protein, 9 aa, Mycobacterium tuberculosis
AESHGVAAV

SEQ ID NO: 33893 - protein, 9 aa, Mycobacterium tuberculosis
ESHGVAAVL

SEQ ID NO: 33894 - protein, 9 aa, Mycobacterium tuberculosis
SHGVAAVLF

SEQ ID NO: 33895 - protein, 9 aa, Mycobacterium tuberculosis
HGVAAVLFA

SEQ ID NO: 33896 - protein, 9 aa, Mycobacterium tuberculosis
GVAAVLFAA

SEQ ID NO: 33897 - protein, 9 aa, Mycobacterium tuberculosis
VAAVLFAAT

SEQ ID NO: 33898 - protein, 9 aa, Mycobacterium tuberculosis
AAVLFAATA

SEQ ID NO: 33899 - protein, 9 aa, Mycobacterium tuberculosis
AVLFAATAA

SEQ ID NO: 33900 - protein, 9 aa, Mycobacterium tuberculosis
VLFAATAAA

SEQ ID NO: 33901 - protein, 9 aa, Mycobacterium tuberculosis
LFAATAAAA

SEQ ID NO: 33902 - protein, 9 aa, Mycobacterium tuberculosis
FAATAAAAA

SEQ ID NO: 33903 - protein, 9 aa, Mycobacterium tuberculosis
AATAAAAAA

SEQ ID NO: 33904 - protein, 9 aa, Mycobacterium tuberculosis
ATAAAAAAV

SEQ ID NO: 33905 - protein, 9 aa, Mycobacterium tuberculosis
TAAAAAAVD

SEQ ID NO: 33906 - protein, 9 aa, Mycobacterium tuberculosis
AAAAAAVDR

SEQ ID NO: 33907 - protein, 9 aa, Mycobacterium tuberculosis
AAAAAVDRG

SEQ ID NO: 33908 - protein, 9 aa, Mycobacterium tuberculosis
AAAAVDRGD

SEQ ID NO: 33909 - protein, 9 aa, Mycobacterium tuberculosis
AAAVDRGDP

SEQ ID NO: 33910 - protein, 9 aa, Mycobacterium tuberculosis
AAVDRGDPP

SEQ ID NO: 33911 - protein, 10 aa, Mycobacterium tuberculosis
MSGHALAART

SEQ ID NO: 33912 - protein, 10 aa, Mycobacterium tuberculosis
SGHALAARTL

SEQ ID NO: 33913 - protein, 10 aa, Mycobacterium tuberculosis
GHALAARTLL

SEQ ID NO: 33914 - protein, 10 aa, Mycobacterium tuberculosis
HALAARTLLA

SEQ ID NO: 33915 - protein, 10 aa, Mycobacterium tuberculosis
ALAARTLLAA

SEQ ID NO: 33916 - protein, 10 aa, Mycobacterium tuberculosis
LAARTLLAAA

SEQ ID NO: 33917 - protein, 10 aa, Mycobacterium tuberculosis
AARTLLAAAD

SEQ ID NO: 33918 - protein, 10 aa, Mycobacterium tuberculosis
ARTLLAAADE

SEQ ID NO: 33919 - protein, 10 aa, Mycobacterium tuberculosis
RTLLAAADEL

SEQ ID NO: 33920 - protein, 10 aa, Mycobacterium tuberculosis
TLLAAADELV

SEQ ID NO: 33921 - protein, 10 aa, Mycobacterium tuberculosis
LLAAADELVG

SEQ ID NO: 33922 - protein, 10 aa, Mycobacterium tuberculosis
LAAADELVGG

SEQ ID NO: 33923 - protein, 10 aa, Mycobacterium tuberculosis
AAADELVGGP

SEQ ID NO: 33924 - protein, 10 aa, Mycobacterium tuberculosis
AADELVGGPP

SEQ ID NO: 33925 - protein, 10 aa, Mycobacterium tuberculosis
ADELVGGPPV

SEQ ID NO: 33926 - protein, 10 aa, Mycobacterium tuberculosis
DELVGGPPVE

SEQ ID NO: 33927 - protein, 10 aa, Mycobacterium tuberculosis
ELVGGPPVEA

SEQ ID NO: 33928 - protein, 10 aa, Mycobacterium tuberculosis
LVGGPPVEAS

SEQ ID NO: 33929 - protein, 10 aa, Mycobacterium tuberculosis
VGGPPVEASA

SEQ ID NO: 33930 - protein, 10 aa, Mycobacterium tuberculosis
GGPPVEASAA

SEQ ID NO: 33931 - protein, 10 aa, Mycobacterium tuberculosis
GPPVEASAAA

SEQ ID NO: 33932 - protein, 10 aa, Mycobacterium tuberculosis
PPVEASAAAL

SEQ ID NO: 33933 - protein, 10 aa, Mycobacterium tuberculosis
PVEASAAALA

SEQ ID NO: 33934 - protein, 10 aa, Mycobacterium tuberculosis
VEASAAALAG

SEQ ID NO: 33935 - protein, 10 aa, Mycobacterium tuberculosis
EASAAALAGD

SEQ ID NO: 33936 - protein, 10 aa, Mycobacterium tuberculosis
ASAAALAGDA

SEQ ID NO: 33937 - protein, 10 aa, Mycobacterium tuberculosis
SAAALAGDAA

SEQ ID NO: 33938 - protein, 10 aa, Mycobacterium tuberculosis
AAALAGDAAG

SEQ ID NO: 33939 - protein, 10 aa, Mycobacterium tuberculosis
AALAGDAAGA

SEQ ID NO: 33940 - protein, 10 aa, Mycobacterium tuberculosis
ALAGDAAGAW

SEQ ID NO: 33941 - protein, 10 aa, Mycobacterium tuberculosis
LAGDAAGAWR

SEQ ID NO: 33942 - protein, 10 aa, Mycobacterium tuberculosis
AGDAAGAWRT

SEQ ID NO: 33943 - protein, 10 aa, Mycobacterium tuberculosis
GDAAGAWRTA

SEQ ID NO: 33944 - protein, 10 aa, Mycobacterium tuberculosis
DAAGAWRTAA

SEQ ID NO: 33945 - protein, 10 aa, Mycobacterium tuberculosis
AAGAWRTAAV

SEQ ID NO: 33946 - protein, 10 aa, Mycobacterium tuberculosis
AGAWRTAAVE

SEQ ID NO: 33947 - protein, 10 aa, Mycobacterium tuberculosis
GAWRTAAVEL

SEQ ID NO: 33948 - protein, 10 aa, Mycobacterium tuberculosis
AWRTAAVELA

SEQ ID NO: 33949 - protein, 10 aa, Mycobacterium tuberculosis
WRTAAVELAR

SEQ ID NO: 33950 - protein, 10 aa, Mycobacterium tuberculosis
RTAAVELARA

SEQ ID NO: 33951 - protein, 10 aa, Mycobacterium tuberculosis
TAAVELARAL

SEQ ID NO: 33952 - protein, 10 aa, Mycobacterium tuberculosis
AAVELARALV

SEQ ID NO: 33953 - protein, 10 aa, Mycobacterium tuberculosis
AVELARALVR

SEQ ID NO: 33954 - protein, 10 aa, Mycobacterium tuberculosis
VELARALVRA

SEQ ID NO: 33955 - protein, 10 aa, Mycobacterium tuberculosis
ELARALVRAV

SEQ ID NO: 33956 - protein, 10 aa, Mycobacterium tuberculosis
LARALVRAVA

SEQ ID NO: 33957 - protein, 10 aa, Mycobacterium tuberculosis
ARALVRAVAE

SEQ ID NO: 33958 - protein, 10 aa, Mycobacterium tuberculosis
RALVRAVAES

SEQ ID NO: 33959 - protein, 10 aa, Mycobacterium tuberculosis
ALVRAVAESH

SEQ ID NO: 33960 - protein, 10 aa, Mycobacterium tuberculosis
LVRAVAESHG

SEQ ID NO: 33961 - protein, 10 aa, Mycobacterium tuberculosis
VRAVAESHGV

SEQ ID NO: 33962 - protein, 10 aa, Mycobacterium tuberculosis
RAVAESHGVA

SEQ ID NO: 33963 - protein, 10 aa, Mycobacterium tuberculosis
AVAESHGVAA

SEQ ID NO: 33964 - protein, 10 aa, Mycobacterium tuberculosis
VAESHGVAAV

SEQ ID NO: 33965 - protein, 10 aa, Mycobacterium tuberculosis
AESHGVAAVL

SEQ ID NO: 33966 - protein, 10 aa, Mycobacterium tuberculosis
ESHGVAAVLF

SEQ ID NO: 33967 - protein, 10 aa, Mycobacterium tuberculosis
SHGVAAVLFA

SEQ ID NO: 33968 - protein, 10 aa, Mycobacterium tuberculosis
HGVAAVLFAA

SEQ ID NO: 33969 - protein, 10 aa, Mycobacterium tuberculosis
GVAAVLFAAT

SEQ ID NO: 33970 - protein, 10 aa, Mycobacterium tuberculosis
VAAVLFAATA

SEQ ID NO: 33971 - protein, 10 aa, Mycobacterium tuberculosis
AAVLFAATAA

SEQ ID NO: 33972 - protein, 10 aa, Mycobacterium tuberculosis
AVLFAATAAA

SEQ ID NO: 33973 - protein, 10 aa, Mycobacterium tuberculosis
VLFAATAAAA

SEQ ID NO: 33974 - protein, 10 aa, Mycobacterium tuberculosis
LFAATAAAAA

SEQ ID NO: 33975 - protein, 10 aa, Mycobacterium tuberculosis
FAATAAAAAA

SEQ ID NO: 33976 - protein, 10 aa, Mycobacterium tuberculosis
AATAAAAAAV

SEQ ID NO: 33977 - protein, 10 aa, Mycobacterium tuberculosis
ATAAAAAAVD

SEQ ID NO: 33978 - protein, 10 aa, Mycobacterium tuberculosis
TAAAAAAVDR

SEQ ID NO: 33979 - protein, 10 aa, Mycobacterium tuberculosis
AAAAAAVDRG

SEQ ID NO: 33980 - protein, 10 aa, Mycobacterium tuberculosis
AAAAAVDRGD

SEQ ID NO: 33981 - protein, 10 aa, Mycobacterium tuberculosis
AAAAVDRGDP

SEQ ID NO: 33982 - protein, 10 aa, Mycobacterium tuberculosis
AAAVDRGDPP

SEQ ID NO: 33983 - protein, 11 aa, Mycobacterium tuberculosis
MSGHALAARTL

SEQ ID NO: 33984 - protein, 11 aa, Mycobacterium tuberculosis
SGHALAARTLL

SEQ ID NO: 33985 - protein, 11 aa, Mycobacterium tuberculosis
GHALAARTLLA

SEQ ID NO: 33986 - protein, 11 aa, Mycobacterium tuberculosis
HALAARTLLAA

SEQ ID NO: 33987 - protein, 11 aa, Mycobacterium tuberculosis
ALAARTLLAAA

SEQ ID NO: 33988 - protein, 11 aa, Mycobacterium tuberculosis
LAARTLLAAAD

SEQ ID NO: 33989 - protein, 11 aa, Mycobacterium tuberculosis
AARTLLAAADE

SEQ ID NO: 33990 - protein, 11 aa, Mycobacterium tuberculosis
ARTLLAAADEL

SEQ ID NO: 33991 - protein, 11 aa, Mycobacterium tuberculosis
RTLLAAADELV

SEQ ID NO: 33992 - protein, 11 aa, Mycobacterium tuberculosis
TLLAAADELVG

SEQ ID NO: 33993 - protein, 11 aa, Mycobacterium tuberculosis
LLAAADELVGG

SEQ ID NO: 33994 - protein, 11 aa, Mycobacterium tuberculosis
LAAADELVGGP

SEQ ID NO: 33995 - protein, 11 aa, Mycobacterium tuberculosis
AAADELVGGPP

SEQ ID NO: 33996 - protein, 11 aa, Mycobacterium tuberculosis
AADELVGGPPV

SEQ ID NO: 33997 - protein, 11 aa, Mycobacterium tuberculosis
ADELVGGPPVE

SEQ ID NO: 33998 - protein, 11 aa, Mycobacterium tuberculosis
DELVGGPPVEA

SEQ ID NO: 33999 - protein, 11 aa, Mycobacterium tuberculosis
ELVGGPPVEAS

SEQ ID NO: 34000 - protein, 11 aa, Mycobacterium tuberculosis
LVGGPPVEASA

SEQ ID NO: 34001 - protein, 11 aa, Mycobacterium tuberculosis
VGGPPVEASAA

SEQ ID NO: 34002 - protein, 11 aa, Mycobacterium tuberculosis
GGPPVEASAAA

SEQ ID NO: 34003 - protein, 11 aa, Mycobacterium tuberculosis
GPPVEASAAAL

SEQ ID NO: 34004 - protein, 11 aa, Mycobacterium tuberculosis
PPVEASAAALA

SEQ ID NO: 34005 - protein, 11 aa, Mycobacterium tuberculosis
PVEASAAALAG

SEQ ID NO: 34006 - protein, 11 aa, Mycobacterium tuberculosis
VEASAAALAGD

SEQ ID NO: 34007 - protein, 11 aa, Mycobacterium tuberculosis
EASAAALAGDA

SEQ ID NO: 34008 - protein, 11 aa, Mycobacterium tuberculosis
ASAAALAGDAA

SEQ ID NO: 34009 - protein, 11 aa, Mycobacterium tuberculosis
SAAALAGDAAG

SEQ ID NO: 34010 - protein, 11 aa, Mycobacterium tuberculosis
AAALAGDAAGA

SEQ ID NO: 34011 - protein, 11 aa, Mycobacterium tuberculosis
AALAGDAAGAW

SEQ ID NO: 34012 - protein, 11 aa, Mycobacterium tuberculosis
ALAGDAAGAWR

SEQ ID NO: 34013 - protein, 11 aa, Mycobacterium tuberculosis
LAGDAAGAWRT

SEQ ID NO: 34014 - protein, 11 aa, Mycobacterium tuberculosis
AGDAAGAWRTA

SEQ ID NO: 34015 - protein, 11 aa, Mycobacterium tuberculosis
GDAAGAWRTAA

SEQ ID NO: 34016 - protein, 11 aa, Mycobacterium tuberculosis
DAAGAWRTAAV

SEQ ID NO: 34017 - protein, 11 aa, Mycobacterium tuberculosis
AAGAWRTAAVE

SEQ ID NO: 34018 - protein, 11 aa, Mycobacterium tuberculosis
AGAWRTAAVEL

SEQ ID NO: 34019 - protein, 11 aa, Mycobacterium tuberculosis
GAWRTAAVELA

SEQ ID NO: 34020 - protein, 11 aa, Mycobacterium tuberculosis
AWRTAAVELAR

SEQ ID NO: 34021 - protein, 11 aa, Mycobacterium tuberculosis
WRTAAVELARA

SEQ ID NO: 34022 - protein, 11 aa, Mycobacterium tuberculosis
RTAAVELARAL

SEQ ID NO: 34023 - protein, 11 aa, Mycobacterium tuberculosis
TAAVELARALV

SEQ ID NO: 34024 - protein, 11 aa, Mycobacterium tuberculosis
AAVELARALVR

SEQ ID NO: 34025 - protein, 11 aa, Mycobacterium tuberculosis
AVELARALVRA

SEQ ID NO: 34026 - protein, 11 aa, Mycobacterium tuberculosis
VELARALVRAV

SEQ ID NO: 34027 - protein, 11 aa, Mycobacterium tuberculosis
ELARALVRAVA

SEQ ID NO: 34028 - protein, 11 aa, Mycobacterium tuberculosis
LARALVRAVAE

SEQ ID NO: 34029 - protein, 11 aa, Mycobacterium tuberculosis
ARALVRAVAES

SEQ ID NO: 34030 - protein, 11 aa, Mycobacterium tuberculosis
RALVRAVAESH

SEQ ID NO: 34031 - protein, 11 aa, Mycobacterium tuberculosis
ALVRAVAESHG

SEQ ID NO: 34032 - protein, 11 aa, Mycobacterium tuberculosis
LVRAVAESHGV

SEQ ID NO: 34033 - protein, 11 aa, Mycobacterium tuberculosis
VRAVAESHGVA

SEQ ID NO: 34034 - protein, 11 aa, Mycobacterium tuberculosis
RAVAESHGVAA

SEQ ID NO: 34035 - protein, 11 aa, Mycobacterium tuberculosis
AVAESHGVAAV

SEQ ID NO: 34036 - protein, 11 aa, Mycobacterium tuberculosis
VAESHGVAAVL

SEQ ID NO: 34037 - protein, 11 aa, Mycobacterium tuberculosis
AESHGVAAVLF

SEQ ID NO: 34038 - protein, 11 aa, Mycobacterium tuberculosis
ESHGVAAVLFA

SEQ ID NO: 34039 - protein, 11 aa, Mycobacterium tuberculosis
SHGVAAVLFAA

SEQ ID NO: 34040 - protein, 11 aa, Mycobacterium tuberculosis
HGVAAVLFAAT

SEQ ID NO: 34041 - protein, 11 aa, Mycobacterium tuberculosis
GVAAVLFAATA

SEQ ID NO: 34042 - protein, 11 aa, Mycobacterium tuberculosis
VAAVLFAATAA

SEQ ID NO: 34043 - protein, 11 aa, Mycobacterium tuberculosis
AAVLFAATAAA

SEQ ID NO: 34044 - protein, 11 aa, Mycobacterium tuberculosis
AVLFAATAAAA

SEQ ID NO: 34045 - protein, 11 aa, Mycobacterium tuberculosis
VLFAATAAAAA

SEQ ID NO: 34046 - protein, 11 aa, Mycobacterium tuberculosis
LFAATAAAAAA

SEQ ID NO: 34047 - protein, 11 aa, Mycobacterium tuberculosis
FAATAAAAAAV

SEQ ID NO: 34048 - protein, 11 aa, Mycobacterium tuberculosis
AATAAAAAAVD

SEQ ID NO: 34049 - protein, 11 aa, Mycobacterium tuberculosis
ATAAAAAAVDR

SEQ ID NO: 34050 - protein, 11 aa, Mycobacterium tuberculosis
TAAAAAAVDRG

SEQ ID NO: 34051 - protein, 11 aa, Mycobacterium tuberculosis
AAAAAAVDRGD

SEQ ID NO: 34052 - protein, 11 aa, Mycobacterium tuberculosis
AAAAAVDRGDP

SEQ ID NO: 34053 - protein, 11 aa, Mycobacterium tuberculosis
AAAAVDRGDPP

SEQ ID NO: 34054 - protein, 8 aa, Mycobacterium tuberculosis
MADIPYGR

SEQ ID NO: 34055 - protein, 8 aa, Mycobacterium tuberculosis
ADIPYGRD

SEQ ID NO: 34056 - protein, 8 aa, Mycobacterium tuberculosis
DIPYGRDY

SEQ ID NO: 34057 - protein, 8 aa, Mycobacterium tuberculosis
IPYGRDYP

SEQ ID NO: 34058 - protein, 8 aa, Mycobacterium tuberculosis
PYGRDYPD

SEQ ID NO: 34059 - protein, 8 aa, Mycobacterium tuberculosis
YGRDYPDP

SEQ ID NO: 34060 - protein, 8 aa, Mycobacterium tuberculosis
GRDYPDPI

SEQ ID NO: 34061 - protein, 8 aa, Mycobacterium tuberculosis
RDYPDPIW

SEQ ID NO: 34062 - protein, 8 aa, Mycobacterium tuberculosis
DYPDPIWC

SEQ ID NO: 34063 - protein, 8 aa, Mycobacterium tuberculosis
YPDPIWCD

SEQ ID NO: 34064 - protein, 8 aa, Mycobacterium tuberculosis
PDPIWCDE

SEQ ID NO: 34065 - protein, 8 aa, Mycobacterium tuberculosis
DPIWCDED

SEQ ID NO: 34066 - protein, 8 aa, Mycobacterium tuberculosis
PIWCDEDG

SEQ ID NO: 34067 - protein, 8 aa, Mycobacterium tuberculosis
IWCDEDGQ

SEQ ID NO: 34068 - protein, 8 aa, Mycobacterium tuberculosis
WCDEDGQP

SEQ ID NO: 34069 - protein, 8 aa, Mycobacterium tuberculosis
CDEDGQPM

SEQ ID NO: 34070 - protein, 8 aa, Mycobacterium tuberculosis
DEDGQPMP

SEQ ID NO: 34071 - protein, 8 aa, Mycobacterium tuberculosis
EDGQPMPP

SEQ ID NO: 34072 - protein, 8 aa, Mycobacterium tuberculosis
DGQPMPPV

SEQ ID NO: 34073 - protein, 8 aa, Mycobacterium tuberculosis
GQPMPPVG

SEQ ID NO: 34074 - protein, 8 aa, Mycobacterium tuberculosis
QPMPPVGA

SEQ ID NO: 34075 - protein, 8 aa, Mycobacterium tuberculosis
PMPPVGAE

SEQ ID NO: 34076 - protein, 8 aa, Mycobacterium tuberculosis
MPPVGAEL

SEQ ID NO: 34077 - protein, 8 aa, Mycobacterium tuberculosis
PPVGAELL

SEQ ID NO: 34078 - protein, 8 aa, Mycobacterium tuberculosis
PVGAELLD

SEQ ID NO: 34079 - protein, 8 aa, Mycobacterium tuberculosis
VGAELLDD

SEQ ID NO: 34080 - protein, 8 aa, Mycobacterium tuberculosis
GAELLDDI

SEQ ID NO: 34081 - protein, 8 aa, Mycobacterium tuberculosis
AELLDDIR

SEQ ID NO: 34082 - protein, 8 aa, Mycobacterium tuberculosis
ELLDDIRA

SEQ ID NO: 34083 - protein, 8 aa, Mycobacterium tuberculosis
LLDDIRAF

SEQ ID NO: 34084 - protein, 8 aa, Mycobacterium tuberculosis
LDDIRAFL

SEQ ID NO: 34085 - protein, 8 aa, Mycobacterium tuberculosis
DDIRAFLR

SEQ ID NO: 34086 - protein, 8 aa, Mycobacterium tuberculosis
DIRAFLRR

SEQ ID NO: 34087 - protein, 8 aa, Mycobacterium tuberculosis
IRAFLRRF

SEQ ID NO: 34088 - protein, 8 aa, Mycobacterium tuberculosis
RAFLRRFV

SEQ ID NO: 34089 - protein, 8 aa, Mycobacterium tuberculosis
AFLRRFVV

SEQ ID NO: 34090 - protein, 8 aa, Mycobacterium tuberculosis
FLRRFVVY

SEQ ID NO: 34091 - protein, 8 aa, Mycobacterium tuberculosis
LRRFVVYP

SEQ ID NO: 34092 - protein, 8 aa, Mycobacterium tuberculosis
RRFVVYPS

SEQ ID NO: 34093 - protein, 8 aa, Mycobacterium tuberculosis
RFVVYPSD

SEQ ID NO: 34094 - protein, 8 aa, Mycobacterium tuberculosis
FVVYPSDH

SEQ ID NO: 34095 - protein, 8 aa, Mycobacterium tuberculosis
VVYPSDHE

SEQ ID NO: 34096 - protein, 8 aa, Mycobacterium tuberculosis
VYPSDHEL

SEQ ID NO: 34097 - protein, 8 aa, Mycobacterium tuberculosis
YPSDHELI

SEQ ID NO: 34098 - protein, 8 aa, Mycobacterium tuberculosis
PSDHELIA

SEQ ID NO: 34099 - protein, 8 aa, Mycobacterium tuberculosis
SDHELIAH

SEQ ID NO: 34100 - protein, 8 aa, Mycobacterium tuberculosis
DHELIAHT

SEQ ID NO: 34101 - protein, 8 aa, Mycobacterium tuberculosis
HELIAHTL

SEQ ID NO: 34102 - protein, 8 aa, Mycobacterium tuberculosis
ELIAHTLW

SEQ ID NO: 34103 - protein, 8 aa, Mycobacterium tuberculosis
LIAHTLWI

SEQ ID NO: 34104 - protein, 8 aa, Mycobacterium tuberculosis
IAHTLWIA

SEQ ID NO: 34105 - protein, 8 aa, Mycobacterium tuberculosis
AHTLWIAH

SEQ ID NO: 34106 - protein, 8 aa, Mycobacterium tuberculosis
HTLWIAHC

SEQ ID NO: 34107 - protein, 8 aa, Mycobacterium tuberculosis
TLWIAHCW

SEQ ID NO: 34108 - protein, 8 aa, Mycobacterium tuberculosis
LWIAHCWF

SEQ ID NO: 34109 - protein, 8 aa, Mycobacterium tuberculosis
WIAHCWFM

SEQ ID NO: 34110 - protein, 8 aa, Mycobacterium tuberculosis
IAHCWFME

SEQ ID NO: 34111 - protein, 8 aa, Mycobacterium tuberculosis
AHCWFMEA

SEQ ID NO: 34112 - protein, 8 aa, Mycobacterium tuberculosis
HCWFMEAW

SEQ ID NO: 34113 - protein, 8 aa, Mycobacterium tuberculosis
CWFMEAWD

SEQ ID NO: 34114 - protein, 8 aa, Mycobacterium tuberculosis
WFMEAWDS

SEQ ID NO: 34115 - protein, 8 aa, Mycobacterium tuberculosis
FMEAWDST

SEQ ID NO: 34116 - protein, 8 aa, Mycobacterium tuberculosis
MEAWDSTP

SEQ ID NO: 34117 - protein, 8 aa, Mycobacterium tuberculosis
EAWDSTPR

SEQ ID NO: 34118 - protein, 8 aa, Mycobacterium tuberculosis
AWDSTPRI

SEQ ID NO: 34119 - protein, 8 aa, Mycobacterium tuberculosis
WDSTPRIA

SEQ ID NO: 34120 - protein, 8 aa, Mycobacterium tuberculosis
DSTPRIAF

SEQ ID NO: 34121 - protein, 8 aa, Mycobacterium tuberculosis
STPRIAFL

SEQ ID NO: 34122 - protein, 8 aa, Mycobacterium tuberculosis
TPRIAFLS

SEQ ID NO: 34123 - protein, 8 aa, Mycobacterium tuberculosis
PRIAFLSP

SEQ ID NO: 34124 - protein, 8 aa, Mycobacterium tuberculosis
RIAFLSPE

SEQ ID NO: 34125 - protein, 8 aa, Mycobacterium tuberculosis
IAFLSPEP

SEQ ID NO: 34126 - protein, 8 aa, Mycobacterium tuberculosis
AFLSPEPG

SEQ ID NO: 34127 - protein, 8 aa, Mycobacterium tuberculosis
FLSPEPGS

SEQ ID NO: 34128 - protein, 8 aa, Mycobacterium tuberculosis
LSPEPGSG

SEQ ID NO: 34129 - protein, 8 aa, Mycobacterium tuberculosis
SPEPGSGK

SEQ ID NO: 34130 - protein, 8 aa, Mycobacterium tuberculosis
PEPGSGKS

SEQ ID NO: 34131 - protein, 8 aa, Mycobacterium tuberculosis
EPGSGKSR

SEQ ID NO: 34132 - protein, 8 aa, Mycobacterium tuberculosis
PGSGKSRA

SEQ ID NO: 34133 - protein, 8 aa, Mycobacterium tuberculosis
GSGKSRAL

SEQ ID NO: 34134 - protein, 8 aa, Mycobacterium tuberculosis
SGKSRALE

SEQ ID NO: 34135 - protein, 8 aa, Mycobacterium tuberculosis
GKSRALEV

SEQ ID NO: 34136 - protein, 8 aa, Mycobacterium tuberculosis
KSRALEVT

SEQ ID NO: 34137 - protein, 8 aa, Mycobacterium tuberculosis
SRALEVTE

SEQ ID NO: 34138 - protein, 8 aa, Mycobacterium tuberculosis
RALEVTEP

SEQ ID NO: 34139 - protein, 8 aa, Mycobacterium tuberculosis
ALEVTEPL

SEQ ID NO: 34140 - protein, 8 aa, Mycobacterium tuberculosis
LEVTEPLV

SEQ ID NO: 34141 - protein, 8 aa, Mycobacterium tuberculosis
EVTEPLVP

SEQ ID NO: 34142 - protein, 8 aa, Mycobacterium tuberculosis
VTEPLVPR

SEQ ID NO: 34143 - protein, 8 aa, Mycobacterium tuberculosis
TEPLVPRP

SEQ ID NO: 34144 - protein, 8 aa, Mycobacterium tuberculosis
EPLVPRPV

SEQ ID NO: 34145 - protein, 8 aa, Mycobacterium tuberculosis
PLVPRPVH

SEQ ID NO: 34146 - protein, 8 aa, Mycobacterium tuberculosis
LVPRPVHA

SEQ ID NO: 34147 - protein, 8 aa, Mycobacterium tuberculosis
VPRPVHAI

SEQ ID NO: 34148 - protein, 8 aa, Mycobacterium tuberculosis
PRPVHAIN

SEQ ID NO: 34149 - protein, 8 aa, Mycobacterium tuberculosis
RPVHAINC

SEQ ID NO: 34150 - protein, 8 aa, Mycobacterium tuberculosis
PVHAINCT

SEQ ID NO: 34151 - protein, 8 aa, Mycobacterium tuberculosis
VHAINCTP

SEQ ID NO: 34152 - protein, 8 aa, Mycobacterium tuberculosis
HAINCTPA

SEQ ID NO: 34153 - protein, 8 aa, Mycobacterium tuberculosis
AINCTPAY

SEQ ID NO: 34154 - protein, 8 aa, Mycobacterium tuberculosis
INCTPAYL

SEQ ID NO: 34155 - protein, 8 aa, Mycobacterium tuberculosis
NCTPAYLF

SEQ ID NO: 34156 - protein, 8 aa, Mycobacterium tuberculosis
CTPAYLFR

SEQ ID NO: 34157 - protein, 8 aa, Mycobacterium tuberculosis
TPAYLFRR

SEQ ID NO: 34158 - protein, 8 aa, Mycobacterium tuberculosis
PAYLFRRV

SEQ ID NO: 34159 - protein, 8 aa, Mycobacterium tuberculosis
AYLFRRVA

SEQ ID NO: 34160 - protein, 8 aa, Mycobacterium tuberculosis
YLFRRVAD

SEQ ID NO: 34161 - protein, 8 aa, Mycobacterium tuberculosis
LFRRVADP

SEQ ID NO: 34162 - protein, 8 aa, Mycobacterium tuberculosis
FRRVADPV

SEQ ID NO: 34163 - protein, 8 aa, Mycobacterium tuberculosis
RRVADPVG

SEQ ID NO: 34164 - protein, 8 aa, Mycobacterium tuberculosis
RVADPVGR

SEQ ID NO: 34165 - protein, 8 aa, Mycobacterium tuberculosis
VADPVGRP

SEQ ID NO: 34166 - protein, 8 aa, Mycobacterium tuberculosis
ADPVGRPT

SEQ ID NO: 34167 - protein, 8 aa, Mycobacterium tuberculosis
DPVGRPTV

SEQ ID NO: 34168 - protein, 8 aa, Mycobacterium tuberculosis
PVGRPTVL

SEQ ID NO: 34169 - protein, 8 aa, Mycobacterium tuberculosis
VGRPTVLY

SEQ ID NO: 34170 - protein, 8 aa, Mycobacterium tuberculosis
GRPTVLYD

SEQ ID NO: 34171 - protein, 8 aa, Mycobacterium tuberculosis
RPTVLYDE

SEQ ID NO: 34172 - protein, 8 aa, Mycobacterium tuberculosis
PTVLYDEC

SEQ ID NO: 34173 - protein, 8 aa, Mycobacterium tuberculosis
TVLYDECD

SEQ ID NO: 34174 - protein, 8 aa, Mycobacterium tuberculosis
VLYDECDT

SEQ ID NO: 34175 - protein, 8 aa, Mycobacterium tuberculosis
LYDECDTL

SEQ ID NO: 34176 - protein, 8 aa, Mycobacterium tuberculosis
YDECDTLF

SEQ ID NO: 34177 - protein, 8 aa, Mycobacterium tuberculosis
DECDTLFG

SEQ ID NO: 34178 - protein, 8 aa, Mycobacterium tuberculosis
ECDTLFGP

SEQ ID NO: 34179 - protein, 8 aa, Mycobacterium tuberculosis
CDTLFGPK

SEQ ID NO: 34180 - protein, 8 aa, Mycobacterium tuberculosis
DTLFGPKA

SEQ ID NO: 34181 - protein, 8 aa, Mycobacterium tuberculosis
TLFGPKAK

SEQ ID NO: 34182 - protein, 8 aa, Mycobacterium tuberculosis
LFGPKAKE

SEQ ID NO: 34183 - protein, 8 aa, Mycobacterium tuberculosis
FGPKAKEH

SEQ ID NO: 34184 - protein, 8 aa, Mycobacterium tuberculosis
GPKAKEHE

SEQ ID NO: 34185 - protein, 8 aa, Mycobacterium tuberculosis
PKAKEHEE

SEQ ID NO: 34186 - protein, 8 aa, Mycobacterium tuberculosis
KAKEHEEI

SEQ ID NO: 34187 - protein, 8 aa, Mycobacterium tuberculosis
AKEHEEIR

SEQ ID NO: 34188 - protein, 8 aa, Mycobacterium tuberculosis
KEHEEIRG

SEQ ID NO: 34189 - protein, 8 aa, Mycobacterium tuberculosis
EHEEIRGV

SEQ ID NO: 34190 - protein, 8 aa, Mycobacterium tuberculosis
HEEIRGVI

SEQ ID NO: 34191 - protein, 8 aa, Mycobacterium tuberculosis
EEIRGVIN

SEQ ID NO: 34192 - protein, 8 aa, Mycobacterium tuberculosis
EIRGVINA

SEQ ID NO: 34193 - protein, 8 aa, Mycobacterium tuberculosis
IRGVINAG

SEQ ID NO: 34194 - protein, 8 aa, Mycobacterium tuberculosis
RGVINAGH

SEQ ID NO: 34195 - protein, 8 aa, Mycobacterium tuberculosis
GVINAGHR

SEQ ID NO: 34196 - protein, 8 aa, Mycobacterium tuberculosis
VINAGHRK

SEQ ID NO: 34197 - protein, 8 aa, Mycobacterium tuberculosis
INAGHRKG

SEQ ID NO: 34198 - protein, 8 aa, Mycobacterium tuberculosis
NAGHRKGA

SEQ ID NO: 34199 - protein, 8 aa, Mycobacterium tuberculosis
AGHRKGAV

SEQ ID NO: 34200 - protein, 8 aa, Mycobacterium tuberculosis
GHRKGAVA

SEQ ID NO: 34201 - protein, 8 aa, Mycobacterium tuberculosis
HRKGAVAG

SEQ ID NO: 34202 - protein, 8 aa, Mycobacterium tuberculosis
RKGAVAGR

SEQ ID NO: 34203 - protein, 8 aa, Mycobacterium tuberculosis
KGAVAGRC

SEQ ID NO: 34204 - protein, 8 aa, Mycobacterium tuberculosis
GAVAGRCV

SEQ ID NO: 34205 - protein, 8 aa, Mycobacterium tuberculosis
AVAGRCVI

SEQ ID NO: 34206 - protein, 8 aa, Mycobacterium tuberculosis
VAGRCVIR

SEQ ID NO: 34207 - protein, 8 aa, Mycobacterium tuberculosis
AGRCVIRG

SEQ ID NO: 34208 - protein, 8 aa, Mycobacterium tuberculosis
GRCVIRGK

SEQ ID NO: 34209 - protein, 8 aa, Mycobacterium tuberculosis
RCVIRGKI

SEQ ID NO: 34210 - protein, 8 aa, Mycobacterium tuberculosis
CVIRGKIV

SEQ ID NO: 34211 - protein, 8 aa, Mycobacterium tuberculosis
VIRGKIVE

SEQ ID NO: 34212 - protein, 8 aa, Mycobacterium tuberculosis
IRGKIVET

SEQ ID NO: 34213 - protein, 8 aa, Mycobacterium tuberculosis
RGKIVETE

SEQ ID NO: 34214 - protein, 8 aa, Mycobacterium tuberculosis
GKIVETEE

SEQ ID NO: 34215 - protein, 8 aa, Mycobacterium tuberculosis
KIVETEEL

SEQ ID NO: 34216 - protein, 8 aa, Mycobacterium tuberculosis
IVETEELP

SEQ ID NO: 34217 - protein, 8 aa, Mycobacterium tuberculosis
VETEELPA

SEQ ID NO: 34218 - protein, 8 aa, Mycobacterium tuberculosis
ETEELPAY

SEQ ID NO: 34219 - protein, 8 aa, Mycobacterium tuberculosis
TEELPAYC

SEQ ID NO: 34220 - protein, 8 aa, Mycobacterium tuberculosis
EELPAYCA

SEQ ID NO: 34221 - protein, 8 aa, Mycobacterium tuberculosis
ELPAYCAV

SEQ ID NO: 34222 - protein, 8 aa, Mycobacterium tuberculosis
LPAYCAVA

SEQ ID NO: 34223 - protein, 8 aa, Mycobacterium tuberculosis
PAYCAVAL

SEQ ID NO: 34224 - protein, 8 aa, Mycobacterium tuberculosis
AYCAVALA

SEQ ID NO: 34225 - protein, 8 aa, Mycobacterium tuberculosis
YCAVALAG

SEQ ID NO: 34226 - protein, 8 aa, Mycobacterium tuberculosis
CAVALAGL

SEQ ID NO: 34227 - protein, 8 aa, Mycobacterium tuberculosis
AVALAGLD

SEQ ID NO: 34228 - protein, 8 aa, Mycobacterium tuberculosis
VALAGLDD

SEQ ID NO: 34229 - protein, 8 aa, Mycobacterium tuberculosis
ALAGLDDL

SEQ ID NO: 34230 - protein, 8 aa, Mycobacterium tuberculosis
LAGLDDLP

SEQ ID NO: 34231 - protein, 8 aa, Mycobacterium tuberculosis
AGLDDLPD

SEQ ID NO: 34232 - protein, 8 aa, Mycobacterium tuberculosis
GLDDLPDT

SEQ ID NO: 34233 - protein, 8 aa, Mycobacterium tuberculosis
LDDLPDTI

SEQ ID NO: 34234 - protein, 8 aa, Mycobacterium tuberculosis
DDLPDTIM

SEQ ID NO: 34235 - protein, 8 aa, Mycobacterium tuberculosis
DLPDTIMS

SEQ ID NO: 34236 - protein, 8 aa, Mycobacterium tuberculosis
LPDTIMSR

SEQ ID NO: 34237 - protein, 8 aa, Mycobacterium tuberculosis
PDTIMSRS

SEQ ID NO: 34238 - protein, 8 aa, Mycobacterium tuberculosis
DTIMSRSI

SEQ ID NO: 34239 - protein, 8 aa, Mycobacterium tuberculosis
TIMSRSIV

SEQ ID NO: 34240 - protein, 8 aa, Mycobacterium tuberculosis
IMSRSIVV

SEQ ID NO: 34241 - protein, 8 aa, Mycobacterium tuberculosis
MSRSIVVR

SEQ ID NO: 34242 - protein, 8 aa, Mycobacterium tuberculosis
SRSIVVRM

SEQ ID NO: 34243 - protein, 8 aa, Mycobacterium tuberculosis
RSIVVRMR

SEQ ID NO: 34244 - protein, 8 aa, Mycobacterium tuberculosis
SIVVRMRR

SEQ ID NO: 34245 - protein, 8 aa, Mycobacterium tuberculosis
IVVRMRRR

SEQ ID NO: 34246 - protein, 8 aa, Mycobacterium tuberculosis
VVRMRRRA

SEQ ID NO: 34247 - protein, 8 aa, Mycobacterium tuberculosis
VRMRRRAP

SEQ ID NO: 34248 - protein, 8 aa, Mycobacterium tuberculosis
RMRRRAPT

SEQ ID NO: 34249 - protein, 8 aa, Mycobacterium tuberculosis
MRRRAPTE

SEQ ID NO: 34250 - protein, 8 aa, Mycobacterium tuberculosis
RRRAPTEP

SEQ ID NO: 34251 - protein, 8 aa, Mycobacterium tuberculosis
RRAPTEPV

SEQ ID NO: 34252 - protein, 8 aa, Mycobacterium tuberculosis
RAPTEPVE

SEQ ID NO: 34253 - protein, 8 aa, Mycobacterium tuberculosis
APTEPVEP

SEQ ID NO: 34254 - protein, 8 aa, Mycobacterium tuberculosis
PTEPVEPW

SEQ ID NO: 34255 - protein, 8 aa, Mycobacterium tuberculosis
TEPVEPWR

SEQ ID NO: 34256 - protein, 8 aa, Mycobacterium tuberculosis
EPVEPWRP

SEQ ID NO: 34257 - protein, 8 aa, Mycobacterium tuberculosis
PVEPWRPR

SEQ ID NO: 34258 - protein, 8 aa, Mycobacterium tuberculosis
VEPWRPRV

SEQ ID NO: 34259 - protein, 8 aa, Mycobacterium tuberculosis
EPWRPRVN

SEQ ID NO: 34260 - protein, 8 aa, Mycobacterium tuberculosis
PWRPRVNG

SEQ ID NO: 34261 - protein, 8 aa, Mycobacterium tuberculosis
WRPRVNGP

SEQ ID NO: 34262 - protein, 8 aa, Mycobacterium tuberculosis
RPRVNGPE

SEQ ID NO: 34263 - protein, 8 aa, Mycobacterium tuberculosis
PRVNGPEA

SEQ ID NO: 34264 - protein, 8 aa, Mycobacterium tuberculosis
RVNGPEAE

SEQ ID NO: 34265 - protein, 8 aa, Mycobacterium tuberculosis
VNGPEAEK

SEQ ID NO: 34266 - protein, 8 aa, Mycobacterium tuberculosis
NGPEAEKL

SEQ ID NO: 34267 - protein, 8 aa, Mycobacterium tuberculosis
GPEAEKLH

SEQ ID NO: 34268 - protein, 8 aa, Mycobacterium tuberculosis
PEAEKLHD

SEQ ID NO: 34269 - protein, 8 aa, Mycobacterium tuberculosis
EAEKLHDR

SEQ ID NO: 34270 - protein, 8 aa, Mycobacterium tuberculosis
AEKLHDRL

SEQ ID NO: 34271 - protein, 8 aa, Mycobacterium tuberculosis
EKLHDRLA

SEQ ID NO: 34272 - protein, 8 aa, Mycobacterium tuberculosis
KLHDRLAN

SEQ ID NO: 34273 - protein, 8 aa, Mycobacterium tuberculosis
LHDRLANW

SEQ ID NO: 34274 - protein, 8 aa, Mycobacterium tuberculosis
HDRLANWA

SEQ ID NO: 34275 - protein, 8 aa, Mycobacterium tuberculosis
DRLANWAA

SEQ ID NO: 34276 - protein, 8 aa, Mycobacterium tuberculosis
RLANWAAA

SEQ ID NO: 34277 - protein, 8 aa, Mycobacterium tuberculosis
LANWAAAI

SEQ ID NO: 34278 - protein, 8 aa, Mycobacterium tuberculosis
ANWAAAIN

SEQ ID NO: 34279 - protein, 8 aa, Mycobacterium tuberculosis
NWAAAINP

SEQ ID NO: 34280 - protein, 8 aa, Mycobacterium tuberculosis
WAAAINPL

SEQ ID NO: 34281 - protein, 8 aa, Mycobacterium tuberculosis
AAAINPLE

SEQ ID NO: 34282 - protein, 8 aa, Mycobacterium tuberculosis
AAINPLES

SEQ ID NO: 34283 - protein, 8 aa, Mycobacterium tuberculosis
AINPLESG

SEQ ID NO: 34284 - protein, 8 aa, Mycobacterium tuberculosis
INPLESGW

SEQ ID NO: 34285 - protein, 8 aa, Mycobacterium tuberculosis
NPLESGWP

SEQ ID NO: 34286 - protein, 8 aa, Mycobacterium tuberculosis
PLESGWPA

SEQ ID NO: 34287 - protein, 8 aa, Mycobacterium tuberculosis
LESGWPAM

SEQ ID NO: 34288 - protein, 8 aa, Mycobacterium tuberculosis
ESGWPAMP

SEQ ID NO: 34289 - protein, 8 aa, Mycobacterium tuberculosis
SGWPAMPD

SEQ ID NO: 34290 - protein, 8 aa, Mycobacterium tuberculosis
GWPAMPDG

SEQ ID NO: 34291 - protein, 8 aa, Mycobacterium tuberculosis
WPAMPDGV

SEQ ID NO: 34292 - protein, 8 aa, Mycobacterium tuberculosis
PAMPDGVT

SEQ ID NO: 34293 - protein, 8 aa, Mycobacterium tuberculosis
AMPDGVTD

SEQ ID NO: 34294 - protein, 8 aa, Mycobacterium tuberculosis
MPDGVTDR

SEQ ID NO: 34295 - protein, 8 aa, Mycobacterium tuberculosis
PDGVTDRR

SEQ ID NO: 34296 - protein, 8 aa, Mycobacterium tuberculosis
DGVTDRRA

SEQ ID NO: 34297 - protein, 8 aa, Mycobacterium tuberculosis
GVTDRRAD

SEQ ID NO: 34298 - protein, 8 aa, Mycobacterium tuberculosis
VTDRRADV

SEQ ID NO: 34299 - protein, 8 aa, Mycobacterium tuberculosis
TDRRADVW

SEQ ID NO: 34300 - protein, 8 aa, Mycobacterium tuberculosis
DRRADVWE

SEQ ID NO: 34301 - protein, 8 aa, Mycobacterium tuberculosis
RRADVWES

SEQ ID NO: 34302 - protein, 8 aa, Mycobacterium tuberculosis
RADVWESL

SEQ ID NO: 34303 - protein, 8 aa, Mycobacterium tuberculosis
ADVWESLV

SEQ ID NO: 34304 - protein, 8 aa, Mycobacterium tuberculosis
DVWESLVA

SEQ ID NO: 34305 - protein, 8 aa, Mycobacterium tuberculosis
VWESLVAV

SEQ ID NO: 34306 - protein, 8 aa, Mycobacterium tuberculosis
WESLVAVA

SEQ ID NO: 34307 - protein, 8 aa, Mycobacterium tuberculosis
ESLVAVAD

SEQ ID NO: 34308 - protein, 8 aa, Mycobacterium tuberculosis
SLVAVADT

SEQ ID NO: 34309 - protein, 8 aa, Mycobacterium tuberculosis
LVAVADTA

SEQ ID NO: 34310 - protein, 8 aa, Mycobacterium tuberculosis
VAVADTAG

SEQ ID NO: 34311 - protein, 8 aa, Mycobacterium tuberculosis
AVADTAGG

SEQ ID NO: 34312 - protein, 8 aa, Mycobacterium tuberculosis
VADTAGGH

SEQ ID NO: 34313 - protein, 8 aa, Mycobacterium tuberculosis
ADTAGGHW

SEQ ID NO: 34314 - protein, 8 aa, Mycobacterium tuberculosis
DTAGGHWP

SEQ ID NO: 34315 - protein, 8 aa, Mycobacterium tuberculosis
TAGGHWPK

SEQ ID NO: 34316 - protein, 8 aa, Mycobacterium tuberculosis
AGGHWPKT

SEQ ID NO: 34317 - protein, 8 aa, Mycobacterium tuberculosis
GGHWPKTA

SEQ ID NO: 34318 - protein, 8 aa, Mycobacterium tuberculosis
GHWPKTAR

SEQ ID NO: 34319 - protein, 8 aa, Mycobacterium tuberculosis
HWPKTARA

SEQ ID NO: 34320 - protein, 8 aa, Mycobacterium tuberculosis
WPKTARAT

SEQ ID NO: 34321 - protein, 8 aa, Mycobacterium tuberculosis
PKTARATA

SEQ ID NO: 34322 - protein, 8 aa, Mycobacterium tuberculosis
KTARATAE

SEQ ID NO: 34323 - protein, 8 aa, Mycobacterium tuberculosis
TARATAET

SEQ ID NO: 34324 - protein, 8 aa, Mycobacterium tuberculosis
ARATAETD

SEQ ID NO: 34325 - protein, 8 aa, Mycobacterium tuberculosis
RATAETDA

SEQ ID NO: 34326 - protein, 8 aa, Mycobacterium tuberculosis
ATAETDAT

SEQ ID NO: 34327 - protein, 8 aa, Mycobacterium tuberculosis
TAETDATA

SEQ ID NO: 34328 - protein, 8 aa, Mycobacterium tuberculosis
AETDATAN

SEQ ID NO: 34329 - protein, 8 aa, Mycobacterium tuberculosis
ETDATANR

SEQ ID NO: 34330 - protein, 8 aa, Mycobacterium tuberculosis
TDATANRG

SEQ ID NO: 34331 - protein, 8 aa, Mycobacterium tuberculosis
DATANRGA

SEQ ID NO: 34332 - protein, 8 aa, Mycobacterium tuberculosis
ATANRGAK

SEQ ID NO: 34333 - protein, 8 aa, Mycobacterium tuberculosis
TANRGAKP

SEQ ID NO: 34334 - protein, 8 aa, Mycobacterium tuberculosis
ANRGAKPS

SEQ ID NO: 34335 - protein, 8 aa, Mycobacterium tuberculosis
NRGAKPSI

SEQ ID NO: 34336 - protein, 8 aa, Mycobacterium tuberculosis
RGAKPSIG

SEQ ID NO: 34337 - protein, 8 aa, Mycobacterium tuberculosis
GAKPSIGV

SEQ ID NO: 34338 - protein, 8 aa, Mycobacterium tuberculosis
AKPSIGVL

SEQ ID NO: 34339 - protein, 8 aa, Mycobacterium tuberculosis
KPSIGVLL

SEQ ID NO: 34340 - protein, 8 aa, Mycobacterium tuberculosis
PSIGVLLL

SEQ ID NO: 34341 - protein, 8 aa, Mycobacterium tuberculosis
SIGVLLLR

SEQ ID NO: 34342 - protein, 8 aa, Mycobacterium tuberculosis
IGVLLLRD

SEQ ID NO: 34343 - protein, 8 aa, Mycobacterium tuberculosis
GVLLLRDI

SEQ ID NO: 34344 - protein, 8 aa, Mycobacterium tuberculosis
VLLLRDIR

SEQ ID NO: 34345 - protein, 8 aa, Mycobacterium tuberculosis
LLLRDIRR

SEQ ID NO: 34346 - protein, 8 aa, Mycobacterium tuberculosis
LLRDIRRV

SEQ ID NO: 34347 - protein, 8 aa, Mycobacterium tuberculosis
LRDIRRVF

SEQ ID NO: 34348 - protein, 8 aa, Mycobacterium tuberculosis
RDIRRVFS

SEQ ID NO: 34349 - protein, 8 aa, Mycobacterium tuberculosis
DIRRVFSD

SEQ ID NO: 34350 - protein, 8 aa, Mycobacterium tuberculosis
IRRVFSDR

SEQ ID NO: 34351 - protein, 8 aa, Mycobacterium tuberculosis
RRVFSDRD

SEQ ID NO: 34352 - protein, 8 aa, Mycobacterium tuberculosis
RVFSDRDR

SEQ ID NO: 34353 - protein, 8 aa, Mycobacterium tuberculosis
VFSDRDRM

SEQ ID NO: 34354 - protein, 8 aa, Mycobacterium tuberculosis
FSDRDRMR

SEQ ID NO: 34355 - protein, 8 aa, Mycobacterium tuberculosis
SDRDRMRT

SEQ ID NO: 34356 - protein, 8 aa, Mycobacterium tuberculosis
DRDRMRTS

SEQ ID NO: 34357 - protein, 8 aa, Mycobacterium tuberculosis
RDRMRTSD

SEQ ID NO: 34358 - protein, 8 aa, Mycobacterium tuberculosis
DRMRTSDI

SEQ ID NO: 34359 - protein, 8 aa, Mycobacterium tuberculosis
RMRTSDIL

SEQ ID NO: 34360 - protein, 8 aa, Mycobacterium tuberculosis
MRTSDILT

SEQ ID NO: 34361 - protein, 8 aa, Mycobacterium tuberculosis
RTSDILTG

SEQ ID NO: 34362 - protein, 8 aa, Mycobacterium tuberculosis
TSDILTGL

SEQ ID NO: 34363 - protein, 8 aa, Mycobacterium tuberculosis
SDILTGLN

SEQ ID NO: 34364 - protein, 8 aa, Mycobacterium tuberculosis
DILTGLNR

SEQ ID NO: 34365 - protein, 8 aa, Mycobacterium tuberculosis
ILTGLNRM

SEQ ID NO: 34366 - protein, 8 aa, Mycobacterium tuberculosis
LTGLNRME

SEQ ID NO: 34367 - protein, 8 aa, Mycobacterium tuberculosis
TGLNRMEE

SEQ ID NO: 34368 - protein, 8 aa, Mycobacterium tuberculosis
GLNRMEEG

SEQ ID NO: 34369 - protein, 8 aa, Mycobacterium tuberculosis
LNRMEEGP

SEQ ID NO: 34370 - protein, 8 aa, Mycobacterium tuberculosis
NRMEEGPW

SEQ ID NO: 34371 - protein, 8 aa, Mycobacterium tuberculosis
RMEEGPWG

SEQ ID NO: 34372 - protein, 8 aa, Mycobacterium tuberculosis
MEEGPWGS

SEQ ID NO: 34373 - protein, 8 aa, Mycobacterium tuberculosis
EEGPWGSI

SEQ ID NO: 34374 - protein, 8 aa, Mycobacterium tuberculosis
EGPWGSIR

SEQ ID NO: 34375 - protein, 8 aa, Mycobacterium tuberculosis
GPWGSIRR

SEQ ID NO: 34376 - protein, 8 aa, Mycobacterium tuberculosis
PWGSIRRG

SEQ ID NO: 34377 - protein, 8 aa, Mycobacterium tuberculosis
WGSIRRGD

SEQ ID NO: 34378 - protein, 8 aa, Mycobacterium tuberculosis
GSIRRGDP

SEQ ID NO: 34379 - protein, 8 aa, Mycobacterium tuberculosis
SIRRGDPL

SEQ ID NO: 34380 - protein, 8 aa, Mycobacterium tuberculosis
IRRGDPLD

SEQ ID NO: 34381 - protein, 8 aa, Mycobacterium tuberculosis
RRGDPLDA

SEQ ID NO: 34382 - protein, 8 aa, Mycobacterium tuberculosis
RGDPLDAR

SEQ ID NO: 34383 - protein, 8 aa, Mycobacterium tuberculosis
GDPLDARG

SEQ ID NO: 34384 - protein, 8 aa, Mycobacterium tuberculosis
DPLDARGL

SEQ ID NO: 34385 - protein, 8 aa, Mycobacterium tuberculosis
PLDARGLA

SEQ ID NO: 34386 - protein, 8 aa, Mycobacterium tuberculosis
LDARGLAT

SEQ ID NO: 34387 - protein, 8 aa, Mycobacterium tuberculosis
DARGLATR

SEQ ID NO: 34388 - protein, 8 aa, Mycobacterium tuberculosis
ARGLATRL

SEQ ID NO: 34389 - protein, 8 aa, Mycobacterium tuberculosis
RGLATRLG

SEQ ID NO: 34390 - protein, 8 aa, Mycobacterium tuberculosis
GLATRLGR

SEQ ID NO: 34391 - protein, 8 aa, Mycobacterium tuberculosis
LATRLGRY

SEQ ID NO: 34392 - protein, 8 aa, Mycobacterium tuberculosis
ATRLGRYG

SEQ ID NO: 34393 - protein, 8 aa, Mycobacterium tuberculosis
TRLGRYGI

SEQ ID NO: 34394 - protein, 8 aa, Mycobacterium tuberculosis
RLGRYGIG

SEQ ID NO: 34395 - protein, 8 aa, Mycobacterium tuberculosis
LGRYGIGP

SEQ ID NO: 34396 - protein, 8 aa, Mycobacterium tuberculosis
GRYGIGPK

SEQ ID NO: 34397 - protein, 8 aa, Mycobacterium tuberculosis
RYGIGPKF

SEQ ID NO: 34398 - protein, 8 aa, Mycobacterium tuberculosis
YGIGPKFQ

SEQ ID NO: 34399 - protein, 8 aa, Mycobacterium tuberculosis
GIGPKFQH

SEQ ID NO: 34400 - protein, 8 aa, Mycobacterium tuberculosis
IGPKFQHS

SEQ ID NO: 34401 - protein, 8 aa, Mycobacterium tuberculosis
GPKFQHSG

SEQ ID NO: 34402 - protein, 8 aa, Mycobacterium tuberculosis
PKFQHSGG

SEQ ID NO: 34403 - protein, 8 aa, Mycobacterium tuberculosis
KFQHSGGE

SEQ ID NO: 34404 - protein, 8 aa, Mycobacterium tuberculosis
FQHSGGEP

SEQ ID NO: 34405 - protein, 8 aa, Mycobacterium tuberculosis
QHSGGEPP

SEQ ID NO: 34406 - protein, 8 aa, Mycobacterium tuberculosis
HSGGEPPY

SEQ ID NO: 34407 - protein, 8 aa, Mycobacterium tuberculosis
SGGEPPYK

SEQ ID NO: 34408 - protein, 8 aa, Mycobacterium tuberculosis
GGEPPYKG

SEQ ID NO: 34409 - protein, 8 aa, Mycobacterium tuberculosis
GEPPYKGY

SEQ ID NO: 34410 - protein, 8 aa, Mycobacterium tuberculosis
EPPYKGYS

SEQ ID NO: 34411 - protein, 8 aa, Mycobacterium tuberculosis
PPYKGYSR

SEQ ID NO: 34412 - protein, 8 aa, Mycobacterium tuberculosis
PYKGYSRT

SEQ ID NO: 34413 - protein, 8 aa, Mycobacterium tuberculosis
YKGYSRTQ

SEQ ID NO: 34414 - protein, 8 aa, Mycobacterium tuberculosis
KGYSRTQF

SEQ ID NO: 34415 - protein, 8 aa, Mycobacterium tuberculosis
GYSRTQFE

SEQ ID NO: 34416 - protein, 8 aa, Mycobacterium tuberculosis
YSRTQFED

SEQ ID NO: 34417 - protein, 8 aa, Mycobacterium tuberculosis
SRTQFEDA

SEQ ID NO: 34418 - protein, 8 aa, Mycobacterium tuberculosis
RTQFEDAW

SEQ ID NO: 34419 - protein, 8 aa, Mycobacterium tuberculosis
TQFEDAWS

SEQ ID NO: 34420 - protein, 8 aa, Mycobacterium tuberculosis
QFEDAWSR

SEQ ID NO: 34421 - protein, 8 aa, Mycobacterium tuberculosis
FEDAWSRY

SEQ ID NO: 34422 - protein, 8 aa, Mycobacterium tuberculosis
EDAWSRYL

SEQ ID NO: 34423 - protein, 8 aa, Mycobacterium tuberculosis
DAWSRYLS

SEQ ID NO: 34424 - protein, 8 aa, Mycobacterium tuberculosis
AWSRYLSA

SEQ ID NO: 34425 - protein, 8 aa, Mycobacterium tuberculosis
WSRYLSAD

SEQ ID NO: 34426 - protein, 8 aa, Mycobacterium tuberculosis
SRYLSADD

SEQ ID NO: 34427 - protein, 8 aa, Mycobacterium tuberculosis
RYLSADDE

SEQ ID NO: 34428 - protein, 8 aa, Mycobacterium tuberculosis
YLSADDET

SEQ ID NO: 34429 - protein, 8 aa, Mycobacterium tuberculosis
LSADDETP

SEQ ID NO: 34430 - protein, 8 aa, Mycobacterium tuberculosis
SADDETPE

SEQ ID NO: 34431 - protein, 8 aa, Mycobacterium tuberculosis
ADDETPEE

SEQ ID NO: 34432 - protein, 8 aa, Mycobacterium tuberculosis
DDETPEER

SEQ ID NO: 34433 - protein, 8 aa, Mycobacterium tuberculosis
DETPEERD

SEQ ID NO: 34434 - protein, 8 aa, Mycobacterium tuberculosis
ETPEERDL

SEQ ID NO: 34435 - protein, 8 aa, Mycobacterium tuberculosis
TPEERDLS

SEQ ID NO: 34436 - protein, 8 aa, Mycobacterium tuberculosis
PEERDLSV

SEQ ID NO: 34437 - protein, 8 aa, Mycobacterium tuberculosis
EERDLSVS

SEQ ID NO: 34438 - protein, 8 aa, Mycobacterium tuberculosis
ERDLSVSA

SEQ ID NO: 34439 - protein, 8 aa, Mycobacterium tuberculosis
RDLSVSAV

SEQ ID NO: 34440 - protein, 8 aa, Mycobacterium tuberculosis
DLSVSAVS

SEQ ID NO: 34441 - protein, 8 aa, Mycobacterium tuberculosis
LSVSAVSA

SEQ ID NO: 34442 - protein, 8 aa, Mycobacterium tuberculosis
SVSAVSAV

SEQ ID NO: 34443 - protein, 8 aa, Mycobacterium tuberculosis
VSAVSAVS

SEQ ID NO: 34444 - protein, 8 aa, Mycobacterium tuberculosis
SAVSAVSP

SEQ ID NO: 34445 - protein, 8 aa, Mycobacterium tuberculosis
AVSAVSPP

SEQ ID NO: 34446 - protein, 8 aa, Mycobacterium tuberculosis
VSAVSPPV

SEQ ID NO: 34447 - protein, 8 aa, Mycobacterium tuberculosis
SAVSPPVG

SEQ ID NO: 34448 - protein, 8 aa, Mycobacterium tuberculosis
AVSPPVGD

SEQ ID NO: 34449 - protein, 8 aa, Mycobacterium tuberculosis
VSPPVGDP

SEQ ID NO: 34450 - protein, 8 aa, Mycobacterium tuberculosis
SPPVGDPG

SEQ ID NO: 34451 - protein, 8 aa, Mycobacterium tuberculosis
PPVGDPGD

SEQ ID NO: 34452 - protein, 8 aa, Mycobacterium tuberculosis
PVGDPGDA

SEQ ID NO: 34453 - protein, 8 aa, Mycobacterium tuberculosis
VGDPGDAT

SEQ ID NO: 34454 - protein, 8 aa, Mycobacterium tuberculosis
GDPGDATG

SEQ ID NO: 34455 - protein, 8 aa, Mycobacterium tuberculosis
DPGDATGA

SEQ ID NO: 34456 - protein, 8 aa, Mycobacterium tuberculosis
PGDATGAT

SEQ ID NO: 34457 - protein, 8 aa, Mycobacterium tuberculosis
GDATGATD

SEQ ID NO: 34458 - protein, 8 aa, Mycobacterium tuberculosis
DATGATDA

SEQ ID NO: 34459 - protein, 8 aa, Mycobacterium tuberculosis
ATGATDAT

SEQ ID NO: 34460 - protein, 8 aa, Mycobacterium tuberculosis
TGATDATD

SEQ ID NO: 34461 - protein, 8 aa, Mycobacterium tuberculosis
GATDATDL

SEQ ID NO: 34462 - protein, 8 aa, Mycobacterium tuberculosis
ATDATDLP

SEQ ID NO: 34463 - protein, 8 aa, Mycobacterium tuberculosis
TDATDLPE

SEQ ID NO: 34464 - protein, 8 aa, Mycobacterium tuberculosis
DATDLPEA

SEQ ID NO: 34465 - protein, 8 aa, Mycobacterium tuberculosis
ATDLPEAG

SEQ ID NO: 34466 - protein, 8 aa, Mycobacterium tuberculosis
TDLPEAGD

SEQ ID NO: 34467 - protein, 8 aa, Mycobacterium tuberculosis
DLPEAGDL

SEQ ID NO: 34468 - protein, 8 aa, Mycobacterium tuberculosis
LPEAGDLP

SEQ ID NO: 34469 - protein, 8 aa, Mycobacterium tuberculosis
PEAGDLPY

SEQ ID NO: 34470 - protein, 8 aa, Mycobacterium tuberculosis
EAGDLPYE

SEQ ID NO: 34471 - protein, 8 aa, Mycobacterium tuberculosis
AGDLPYEP

SEQ ID NO: 34472 - protein, 8 aa, Mycobacterium tuberculosis
GDLPYEPP

SEQ ID NO: 34473 - protein, 8 aa, Mycobacterium tuberculosis
DLPYEPPA

SEQ ID NO: 34474 - protein, 8 aa, Mycobacterium tuberculosis
LPYEPPAP

SEQ ID NO: 34475 - protein, 8 aa, Mycobacterium tuberculosis
PYEPPAPN

SEQ ID NO: 34476 - protein, 8 aa, Mycobacterium tuberculosis
YEPPAPNG

SEQ ID NO: 34477 - protein, 8 aa, Mycobacterium tuberculosis
EPPAPNGH

SEQ ID NO: 34478 - protein, 8 aa, Mycobacterium tuberculosis
PPAPNGHP

SEQ ID NO: 34479 - protein, 8 aa, Mycobacterium tuberculosis
PAPNGHPN

SEQ ID NO: 34480 - protein, 8 aa, Mycobacterium tuberculosis
APNGHPNG

SEQ ID NO: 34481 - protein, 8 aa, Mycobacterium tuberculosis
PNGHPNGD

SEQ ID NO: 34482 - protein, 8 aa, Mycobacterium tuberculosis
NGHPNGDA

SEQ ID NO: 34483 - protein, 8 aa, Mycobacterium tuberculosis
GHPNGDAP

SEQ ID NO: 34484 - protein, 8 aa, Mycobacterium tuberculosis
HPNGDAPL

SEQ ID NO: 34485 - protein, 8 aa, Mycobacterium tuberculosis
PNGDAPLC

SEQ ID NO: 34486 - protein, 8 aa, Mycobacterium tuberculosis
NGDAPLCS

SEQ ID NO: 34487 - protein, 8 aa, Mycobacterium tuberculosis
GDAPLCSG

SEQ ID NO: 34488 - protein, 8 aa, Mycobacterium tuberculosis
DAPLCSGP

SEQ ID NO: 34489 - protein, 8 aa, Mycobacterium tuberculosis
APLCSGPG

SEQ ID NO: 34490 - protein, 8 aa, Mycobacterium tuberculosis
PLCSGPGC

SEQ ID NO: 34491 - protein, 8 aa, Mycobacterium tuberculosis
LCSGPGCP

SEQ ID NO: 34492 - protein, 8 aa, Mycobacterium tuberculosis
CSGPGCPN

SEQ ID NO: 34493 - protein, 8 aa, Mycobacterium tuberculosis
SGPGCPNK

SEQ ID NO: 34494 - protein, 8 aa, Mycobacterium tuberculosis
GPGCPNKL

SEQ ID NO: 34495 - protein, 8 aa, Mycobacterium tuberculosis
PGCPNKLL

SEQ ID NO: 34496 - protein, 8 aa, Mycobacterium tuberculosis
GCPNKLLS

SEQ ID NO: 34497 - protein, 8 aa, Mycobacterium tuberculosis
CPNKLLST

SEQ ID NO: 34498 - protein, 8 aa, Mycobacterium tuberculosis
PNKLLSTE

SEQ ID NO: 34499 - protein, 8 aa, Mycobacterium tuberculosis
NKLLSTEA

SEQ ID NO: 34500 - protein, 8 aa, Mycobacterium tuberculosis
KLLSTEAK

SEQ ID NO: 34501 - protein, 8 aa, Mycobacterium tuberculosis
LLSTEAKA

SEQ ID NO: 34502 - protein, 8 aa, Mycobacterium tuberculosis
LSTEAKAA

SEQ ID NO: 34503 - protein, 8 aa, Mycobacterium tuberculosis
STEAKAAG

SEQ ID NO: 34504 - protein, 8 aa, Mycobacterium tuberculosis
TEAKAAGK

SEQ ID NO: 34505 - protein, 8 aa, Mycobacterium tuberculosis
EAKAAGKC

SEQ ID NO: 34506 - protein, 8 aa, Mycobacterium tuberculosis
AKAAGKCR

SEQ ID NO: 34507 - protein, 8 aa, Mycobacterium tuberculosis
KAAGKCRP

SEQ ID NO: 34508 - protein, 8 aa, Mycobacterium tuberculosis
AAGKCRPC

SEQ ID NO: 34509 - protein, 8 aa, Mycobacterium tuberculosis
AGKCRPCR

SEQ ID NO: 34510 - protein, 8 aa, Mycobacterium tuberculosis
GKCRPCRG

SEQ ID NO: 34511 - protein, 8 aa, Mycobacterium tuberculosis
KCRPCRGR

SEQ ID NO: 34512 - protein, 8 aa, Mycobacterium tuberculosis
CRPCRGRA

SEQ ID NO: 34513 - protein, 8 aa, Mycobacterium tuberculosis
RPCRGRAA

SEQ ID NO: 34514 - protein, 8 aa, Mycobacterium tuberculosis
PCRGRAAA

SEQ ID NO: 34515 - protein, 8 aa, Mycobacterium tuberculosis
CRGRAAAS

SEQ ID NO: 34516 - protein, 8 aa, Mycobacterium tuberculosis
RGRAAASA

SEQ ID NO: 34517 - protein, 8 aa, Mycobacterium tuberculosis
GRAAASAR

SEQ ID NO: 34518 - protein, 8 aa, Mycobacterium tuberculosis
RAAASARD

SEQ ID NO: 34519 - protein, 8 aa, Mycobacterium tuberculosis
AAASARDG

SEQ ID NO: 34520 - protein, 8 aa, Mycobacterium tuberculosis
AASARDGA

SEQ ID NO: 34521 - protein, 8 aa, Mycobacterium tuberculosis
ASARDGAR

SEQ ID NO: 34522 - protein, 9 aa, Mycobacterium tuberculosis
MADIPYGRD

SEQ ID NO: 34523 - protein, 9 aa, Mycobacterium tuberculosis
ADIPYGRDY

SEQ ID NO: 34524 - protein, 9 aa, Mycobacterium tuberculosis
DIPYGRDYP

SEQ ID NO: 34525 - protein, 9 aa, Mycobacterium tuberculosis
IPYGRDYPD

SEQ ID NO: 34526 - protein, 9 aa, Mycobacterium tuberculosis
PYGRDYPDP

SEQ ID NO: 34527 - protein, 9 aa, Mycobacterium tuberculosis
YGRDYPDPI

SEQ ID NO: 34528 - protein, 9 aa, Mycobacterium tuberculosis
GRDYPDPIW

SEQ ID NO: 34529 - protein, 9 aa, Mycobacterium tuberculosis
RDYPDPIWC

SEQ ID NO: 34530 - protein, 9 aa, Mycobacterium tuberculosis
DYPDPIWCD

SEQ ID NO: 34531 - protein, 9 aa, Mycobacterium tuberculosis
YPDPIWCDE

SEQ ID NO: 34532 - protein, 9 aa, Mycobacterium tuberculosis
PDPIWCDED

SEQ ID NO: 34533 - protein, 9 aa, Mycobacterium tuberculosis
DPIWCDEDG

SEQ ID NO: 34534 - protein, 9 aa, Mycobacterium tuberculosis
PIWCDEDGQ

SEQ ID NO: 34535 - protein, 9 aa, Mycobacterium tuberculosis
IWCDEDGQP

SEQ ID NO: 34536 - protein, 9 aa, Mycobacterium tuberculosis
WCDEDGQPM

SEQ ID NO: 34537 - protein, 9 aa, Mycobacterium tuberculosis
CDEDGQPMP

SEQ ID NO: 34538 - protein, 9 aa, Mycobacterium tuberculosis
DEDGQPMPP

SEQ ID NO: 34539 - protein, 9 aa, Mycobacterium tuberculosis
EDGQPMPPV

SEQ ID NO: 34540 - protein, 9 aa, Mycobacterium tuberculosis
DGQPMPPVG

SEQ ID NO: 34541 - protein, 9 aa, Mycobacterium tuberculosis
GQPMPPVGA

SEQ ID NO: 34542 - protein, 9 aa, Mycobacterium tuberculosis
QPMPPVGAE

SEQ ID NO: 34543 - protein, 9 aa, Mycobacterium tuberculosis
PMPPVGAEL

SEQ ID NO: 34544 - protein, 9 aa, Mycobacterium tuberculosis
MPPVGAELL

SEQ ID NO: 34545 - protein, 9 aa, Mycobacterium tuberculosis
PPVGAELLD

SEQ ID NO: 34546 - protein, 9 aa, Mycobacterium tuberculosis
PVGAELLDD

SEQ ID NO: 34547 - protein, 9 aa, Mycobacterium tuberculosis
VGAELLDDI

SEQ ID NO: 34548 - protein, 9 aa, Mycobacterium tuberculosis
GAELLDDIR

SEQ ID NO: 34549 - protein, 9 aa, Mycobacterium tuberculosis
AELLDDIRA

SEQ ID NO: 34550 - protein, 9 aa, Mycobacterium tuberculosis
ELLDDIRAF

SEQ ID NO: 34551 - protein, 9 aa, Mycobacterium tuberculosis
LLDDIRAFL

SEQ ID NO: 34552 - protein, 9 aa, Mycobacterium tuberculosis
LDDIRAFLR

SEQ ID NO: 34553 - protein, 9 aa, Mycobacterium tuberculosis
DDIRAFLRR

SEQ ID NO: 34554 - protein, 9 aa, Mycobacterium tuberculosis
DIRAFLRRF

SEQ ID NO: 34555 - protein, 9 aa, Mycobacterium tuberculosis
IRAFLRRFV

SEQ ID NO: 34556 - protein, 9 aa, Mycobacterium tuberculosis
RAFLRRFVV

SEQ ID NO: 34557 - protein, 9 aa, Mycobacterium tuberculosis
AFLRRFVVY

SEQ ID NO: 34558 - protein, 9 aa, Mycobacterium tuberculosis
FLRRFVVYP

SEQ ID NO: 34559 - protein, 9 aa, Mycobacterium tuberculosis
LRRFVVYPS

SEQ ID NO: 34560 - protein, 9 aa, Mycobacterium tuberculosis
RRFVVYPSD

SEQ ID NO: 34561 - protein, 9 aa, Mycobacterium tuberculosis
RFVVYPSDH

SEQ ID NO: 34562 - protein, 9 aa, Mycobacterium tuberculosis
FVVYPSDHE

SEQ ID NO: 34563 - protein, 9 aa, Mycobacterium tuberculosis
VVYPSDHEL

SEQ ID NO: 34564 - protein, 9 aa, Mycobacterium tuberculosis
VYPSDHELI

SEQ ID NO: 34565 - protein, 9 aa, Mycobacterium tuberculosis
YPSDHELIA

SEQ ID NO: 34566 - protein, 9 aa, Mycobacterium tuberculosis
PSDHELIAH

SEQ ID NO: 34567 - protein, 9 aa, Mycobacterium tuberculosis
SDHELIAHT

SEQ ID NO: 34568 - protein, 9 aa, Mycobacterium tuberculosis
DHELIAHTL

SEQ ID NO: 34569 - protein, 9 aa, Mycobacterium tuberculosis
HELIAHTLW

SEQ ID NO: 34570 - protein, 9 aa, Mycobacterium tuberculosis
ELIAHTLWI

SEQ ID NO: 34571 - protein, 9 aa, Mycobacterium tuberculosis
LIAHTLWIA

SEQ ID NO: 34572 - protein, 9 aa, Mycobacterium tuberculosis
IAHTLWIAH

SEQ ID NO: 34573 - protein, 9 aa, Mycobacterium tuberculosis
AHTLWIAHC

SEQ ID NO: 34574 - protein, 9 aa, Mycobacterium tuberculosis
HTLWIAHCW

SEQ ID NO: 34575 - protein, 9 aa, Mycobacterium tuberculosis
TLWIAHCWF

SEQ ID NO: 34576 - protein, 9 aa, Mycobacterium tuberculosis
LWIAHCWFM

SEQ ID NO: 34577 - protein, 9 aa, Mycobacterium tuberculosis
WIAHCWFME

SEQ ID NO: 34578 - protein, 9 aa, Mycobacterium tuberculosis
IAHCWFMEA

SEQ ID NO: 34579 - protein, 9 aa, Mycobacterium tuberculosis
AHCWFMEAW

SEQ ID NO: 34580 - protein, 9 aa, Mycobacterium tuberculosis
HCWFMEAWD

SEQ ID NO: 34581 - protein, 9 aa, Mycobacterium tuberculosis
CWFMEAWDS

SEQ ID NO: 34582 - protein, 9 aa, Mycobacterium tuberculosis
WFMEAWDST

SEQ ID NO: 34583 - protein, 9 aa, Mycobacterium tuberculosis
FMEAWDSTP

SEQ ID NO: 34584 - protein, 9 aa, Mycobacterium tuberculosis
MEAWDSTPR

SEQ ID NO: 34585 - protein, 9 aa, Mycobacterium tuberculosis
EAWDSTPRI

SEQ ID NO: 34586 - protein, 9 aa, Mycobacterium tuberculosis
AWDSTPRIA

SEQ ID NO: 34587 - protein, 9 aa, Mycobacterium tuberculosis
WDSTPRIAF

SEQ ID NO: 34588 - protein, 9 aa, Mycobacterium tuberculosis
DSTPRIAFL

SEQ ID NO: 34589 - protein, 9 aa, Mycobacterium tuberculosis
STPRIAFLS

SEQ ID NO: 34590 - protein, 9 aa, Mycobacterium tuberculosis
TPRIAFLSP

SEQ ID NO: 34591 - protein, 9 aa, Mycobacterium tuberculosis
PRIAFLSPE

SEQ ID NO: 34592 - protein, 9 aa, Mycobacterium tuberculosis
RIAFLSPEP

SEQ ID NO: 34593 - protein, 9 aa, Mycobacterium tuberculosis
IAFLSPEPG

SEQ ID NO: 34594 - protein, 9 aa, Mycobacterium tuberculosis
AFLSPEPGS

SEQ ID NO: 34595 - protein, 9 aa, Mycobacterium tuberculosis
FLSPEPGSG

SEQ ID NO: 34596 - protein, 9 aa, Mycobacterium tuberculosis
LSPEPGSGK

SEQ ID NO: 34597 - protein, 9 aa, Mycobacterium tuberculosis
SPEPGSGKS

SEQ ID NO: 34598 - protein, 9 aa, Mycobacterium tuberculosis
PEPGSGKSR

SEQ ID NO: 34599 - protein, 9 aa, Mycobacterium tuberculosis
EPGSGKSRA

SEQ ID NO: 34600 - protein, 9 aa, Mycobacterium tuberculosis
PGSGKSRAL

SEQ ID NO: 34601 - protein, 9 aa, Mycobacterium tuberculosis
GSGKSRALE

SEQ ID NO: 34602 - protein, 9 aa, Mycobacterium tuberculosis
SGKSRALEV

SEQ ID NO: 34603 - protein, 9 aa, Mycobacterium tuberculosis
GKSRALEVT

SEQ ID NO: 34604 - protein, 9 aa, Mycobacterium tuberculosis
KSRALEVTE

SEQ ID NO: 34605 - protein, 9 aa, Mycobacterium tuberculosis
SRALEVTEP

SEQ ID NO: 34606 - protein, 9 aa, Mycobacterium tuberculosis
RALEVTEPL

SEQ ID NO: 34607 - protein, 9 aa, Mycobacterium tuberculosis
ALEVTEPLV

SEQ ID NO: 34608 - protein, 9 aa, Mycobacterium tuberculosis
LEVTEPLVP

SEQ ID NO: 34609 - protein, 9 aa, Mycobacterium tuberculosis
EVTEPLVPR

SEQ ID NO: 34610 - protein, 9 aa, Mycobacterium tuberculosis
VTEPLVPRP

SEQ ID NO: 34611 - protein, 9 aa, Mycobacterium tuberculosis
TEPLVPRPV

SEQ ID NO: 34612 - protein, 9 aa, Mycobacterium tuberculosis
EPLVPRPVH

SEQ ID NO: 34613 - protein, 9 aa, Mycobacterium tuberculosis
PLVPRPVHA

SEQ ID NO: 34614 - protein, 9 aa, Mycobacterium tuberculosis
LVPRPVHAI

SEQ ID NO: 34615 - protein, 9 aa, Mycobacterium tuberculosis
VPRPVHAIN

SEQ ID NO: 34616 - protein, 9 aa, Mycobacterium tuberculosis
PRPVHAINC

SEQ ID NO: 34617 - protein, 9 aa, Mycobacterium tuberculosis
RPVHAINCT

SEQ ID NO: 34618 - protein, 9 aa, Mycobacterium tuberculosis
PVHAINCTP

SEQ ID NO: 34619 - protein, 9 aa, Mycobacterium tuberculosis
VHAINCTPA

SEQ ID NO: 34620 - protein, 9 aa, Mycobacterium tuberculosis
HAINCTPAY

SEQ ID NO: 34621 - protein, 9 aa, Mycobacterium tuberculosis
AINCTPAYL

SEQ ID NO: 34622 - protein, 9 aa, Mycobacterium tuberculosis
INCTPAYLF

SEQ ID NO: 34623 - protein, 9 aa, Mycobacterium tuberculosis
NCTPAYLFR

SEQ ID NO: 34624 - protein, 9 aa, Mycobacterium tuberculosis
CTPAYLFRR

SEQ ID NO: 34625 - protein, 9 aa, Mycobacterium tuberculosis
TPAYLFRRV

SEQ ID NO: 34626 - protein, 9 aa, Mycobacterium tuberculosis
PAYLFRRVA

SEQ ID NO: 34627 - protein, 9 aa, Mycobacterium tuberculosis
AYLFRRVAD

SEQ ID NO: 34628 - protein, 9 aa, Mycobacterium tuberculosis
YLFRRVADP

SEQ ID NO: 34629 - protein, 9 aa, Mycobacterium tuberculosis
LFRRVADPV

SEQ ID NO: 34630 - protein, 9 aa, Mycobacterium tuberculosis
FRRVADPVG

SEQ ID NO: 34631 - protein, 9 aa, Mycobacterium tuberculosis
RRVADPVGR

SEQ ID NO: 34632 - protein, 9 aa, Mycobacterium tuberculosis
RVADPVGRP

SEQ ID NO: 34633 - protein, 9 aa, Mycobacterium tuberculosis
VADPVGRPT

SEQ ID NO: 34634 - protein, 9 aa, Mycobacterium tuberculosis
ADPVGRPTV

SEQ ID NO: 34635 - protein, 9 aa, Mycobacterium tuberculosis
DPVGRPTVL

SEQ ID NO: 34636 - protein, 9 aa, Mycobacterium tuberculosis
PVGRPTVLY

SEQ ID NO: 34637 - protein, 9 aa, Mycobacterium tuberculosis
VGRPTVLYD

SEQ ID NO: 34638 - protein, 9 aa, Mycobacterium tuberculosis
GRPTVLYDE

SEQ ID NO: 34639 - protein, 9 aa, Mycobacterium tuberculosis
RPTVLYDEC

SEQ ID NO: 34640 - protein, 9 aa, Mycobacterium tuberculosis
PTVLYDECD

SEQ ID NO: 34641 - protein, 9 aa, Mycobacterium tuberculosis
TVLYDECDT

SEQ ID NO: 34642 - protein, 9 aa, Mycobacterium tuberculosis
VLYDECDTL

SEQ ID NO: 34643 - protein, 9 aa, Mycobacterium tuberculosis
LYDECDTLF

SEQ ID NO: 34644 - protein, 9 aa, Mycobacterium tuberculosis
YDECDTLFG

SEQ ID NO: 34645 - protein, 9 aa, Mycobacterium tuberculosis
DECDTLFGP

SEQ ID NO: 34646 - protein, 9 aa, Mycobacterium tuberculosis
ECDTLFGPK

SEQ ID NO: 34647 - protein, 9 aa, Mycobacterium tuberculosis
CDTLFGPKA

SEQ ID NO: 34648 - protein, 9 aa, Mycobacterium tuberculosis
DTLFGPKAK

SEQ ID NO: 34649 - protein, 9 aa, Mycobacterium tuberculosis
TLFGPKAKE

SEQ ID NO: 34650 - protein, 9 aa, Mycobacterium tuberculosis
LFGPKAKEH

SEQ ID NO: 34651 - protein, 9 aa, Mycobacterium tuberculosis
FGPKAKEHE

SEQ ID NO: 34652 - protein, 9 aa, Mycobacterium tuberculosis
GPKAKEHEE

SEQ ID NO: 34653 - protein, 9 aa, Mycobacterium tuberculosis
PKAKEHEEI

SEQ ID NO: 34654 - protein, 9 aa, Mycobacterium tuberculosis
KAKEHEEIR

SEQ ID NO: 34655 - protein, 9 aa, Mycobacterium tuberculosis
AKEHEEIRG

SEQ ID NO: 34656 - protein, 9 aa, Mycobacterium tuberculosis
KEHEEIRGV

SEQ ID NO: 34657 - protein, 9 aa, Mycobacterium tuberculosis
EHEEIRGVI

SEQ ID NO: 34658 - protein, 9 aa, Mycobacterium tuberculosis
HEEIRGVIN

SEQ ID NO: 34659 - protein, 9 aa, Mycobacterium tuberculosis
EEIRGVINA

SEQ ID NO: 34660 - protein, 9 aa, Mycobacterium tuberculosis
EIRGVINAG

SEQ ID NO: 34661 - protein, 9 aa, Mycobacterium tuberculosis
IRGVINAGH

SEQ ID NO: 34662 - protein, 9 aa, Mycobacterium tuberculosis
RGVINAGHR

SEQ ID NO: 34663 - protein, 9 aa, Mycobacterium tuberculosis
GVINAGHRK

SEQ ID NO: 34664 - protein, 9 aa, Mycobacterium tuberculosis
VINAGHRKG

SEQ ID NO: 34665 - protein, 9 aa, Mycobacterium tuberculosis
INAGHRKGA

SEQ ID NO: 34666 - protein, 9 aa, Mycobacterium tuberculosis
NAGHRKGAV

SEQ ID NO: 34667 - protein, 9 aa, Mycobacterium tuberculosis
AGHRKGAVA

SEQ ID NO: 34668 - protein, 9 aa, Mycobacterium tuberculosis
GHRKGAVAG

SEQ ID NO: 34669 - protein, 9 aa, Mycobacterium tuberculosis
HRKGAVAGR

SEQ ID NO: 34670 - protein, 9 aa, Mycobacterium tuberculosis
RKGAVAGRC

SEQ ID NO: 34671 - protein, 9 aa, Mycobacterium tuberculosis
KGAVAGRCV

SEQ ID NO: 34672 - protein, 9 aa, Mycobacterium tuberculosis
GAVAGRCVI

SEQ ID NO: 34673 - protein, 9 aa, Mycobacterium tuberculosis
AVAGRCVIR

SEQ ID NO: 34674 - protein, 9 aa, Mycobacterium tuberculosis
VAGRCVIRG

SEQ ID NO: 34675 - protein, 9 aa, Mycobacterium tuberculosis
AGRCVIRGK

SEQ ID NO: 34676 - protein, 9 aa, Mycobacterium tuberculosis
GRCVIRGKI

SEQ ID NO: 34677 - protein, 9 aa, Mycobacterium tuberculosis
RCVIRGKIV

SEQ ID NO: 34678 - protein, 9 aa, Mycobacterium tuberculosis
CVIRGKIVE

SEQ ID NO: 34679 - protein, 9 aa, Mycobacterium tuberculosis
VIRGKIVET

SEQ ID NO: 34680 - protein, 9 aa, Mycobacterium tuberculosis
IRGKIVETE

SEQ ID NO: 34681 - protein, 9 aa, Mycobacterium tuberculosis
RGKIVETEE

SEQ ID NO: 34682 - protein, 9 aa, Mycobacterium tuberculosis
GKIVETEEL

SEQ ID NO: 34683 - protein, 9 aa, Mycobacterium tuberculosis
KIVETEELP

SEQ ID NO: 34684 - protein, 9 aa, Mycobacterium tuberculosis
IVETEELPA

SEQ ID NO: 34685 - protein, 9 aa, Mycobacterium tuberculosis
VETEELPAY

SEQ ID NO: 34686 - protein, 9 aa, Mycobacterium tuberculosis
ETEELPAYC

SEQ ID NO: 34687 - protein, 9 aa, Mycobacterium tuberculosis
TEELPAYCA

SEQ ID NO: 34688 - protein, 9 aa, Mycobacterium tuberculosis
EELPAYCAV

SEQ ID NO: 34689 - protein, 9 aa, Mycobacterium tuberculosis
ELPAYCAVA

SEQ ID NO: 34690 - protein, 9 aa, Mycobacterium tuberculosis
LPAYCAVAL

SEQ ID NO: 34691 - protein, 9 aa, Mycobacterium tuberculosis
PAYCAVALA

SEQ ID NO: 34692 - protein, 9 aa, Mycobacterium tuberculosis
AYCAVALAG

SEQ ID NO: 34693 - protein, 9 aa, Mycobacterium tuberculosis
YCAVALAGL

SEQ ID NO: 34694 - protein, 9 aa, Mycobacterium tuberculosis
CAVALAGLD

SEQ ID NO: 34695 - protein, 9 aa, Mycobacterium tuberculosis
AVALAGLDD

SEQ ID NO: 34696 - protein, 9 aa, Mycobacterium tuberculosis
VALAGLDDL

SEQ ID NO: 34697 - protein, 9 aa, Mycobacterium tuberculosis
ALAGLDDLP

SEQ ID NO: 34698 - protein, 9 aa, Mycobacterium tuberculosis
LAGLDDLPD

SEQ ID NO: 34699 - protein, 9 aa, Mycobacterium tuberculosis
AGLDDLPDT

SEQ ID NO: 34700 - protein, 9 aa, Mycobacterium tuberculosis
GLDDLPDTI

SEQ ID NO: 34701 - protein, 9 aa, Mycobacterium tuberculosis
LDDLPDTIM

SEQ ID NO: 34702 - protein, 9 aa, Mycobacterium tuberculosis
DDLPDTIMS

SEQ ID NO: 34703 - protein, 9 aa, Mycobacterium tuberculosis
DLPDTIMSR

SEQ ID NO: 34704 - protein, 9 aa, Mycobacterium tuberculosis
LPDTIMSRS

SEQ ID NO: 34705 - protein, 9 aa, Mycobacterium tuberculosis
PDTIMSRSI

SEQ ID NO: 34706 - protein, 9 aa, Mycobacterium tuberculosis
DTIMSRSIV

SEQ ID NO: 34707 - protein, 9 aa, Mycobacterium tuberculosis
TIMSRSIVV

SEQ ID NO: 34708 - protein, 9 aa, Mycobacterium tuberculosis
IMSRSIVVR

SEQ ID NO: 34709 - protein, 9 aa, Mycobacterium tuberculosis
MSRSIVVRM

SEQ ID NO: 34710 - protein, 9 aa, Mycobacterium tuberculosis
SRSIVVRMR

SEQ ID NO: 34711 - protein, 9 aa, Mycobacterium tuberculosis
RSIVVRMRR

SEQ ID NO: 34712 - protein, 9 aa, Mycobacterium tuberculosis
SIVVRMRRR

SEQ ID NO: 34713 - protein, 9 aa, Mycobacterium tuberculosis
IVVRMRRRA

SEQ ID NO: 34714 - protein, 9 aa, Mycobacterium tuberculosis
VVRMRRRAP

SEQ ID NO: 34715 - protein, 9 aa, Mycobacterium tuberculosis
VRMRRRAPT

SEQ ID NO: 34716 - protein, 9 aa, Mycobacterium tuberculosis
RMRRRAPTE

SEQ ID NO: 34717 - protein, 9 aa, Mycobacterium tuberculosis
MRRRAPTEP

SEQ ID NO: 34718 - protein, 9 aa, Mycobacterium tuberculosis
RRRAPTEPV

SEQ ID NO: 34719 - protein, 9 aa, Mycobacterium tuberculosis
RRAPTEPVE

SEQ ID NO: 34720 - protein, 9 aa, Mycobacterium tuberculosis
RAPTEPVEP

SEQ ID NO: 34721 - protein, 9 aa, Mycobacterium tuberculosis
APTEPVEPW

SEQ ID NO: 34722 - protein, 9 aa, Mycobacterium tuberculosis
PTEPVEPWR

SEQ ID NO: 34723 - protein, 9 aa, Mycobacterium tuberculosis
TEPVEPWRP

SEQ ID NO: 34724 - protein, 9 aa, Mycobacterium tuberculosis
EPVEPWRPR

SEQ ID NO: 34725 - protein, 9 aa, Mycobacterium tuberculosis
PVEPWRPRV

SEQ ID NO: 34726 - protein, 9 aa, Mycobacterium tuberculosis
VEPWRPRVN

SEQ ID NO: 34727 - protein, 9 aa, Mycobacterium tuberculosis
EPWRPRVNG

SEQ ID NO: 34728 - protein, 9 aa, Mycobacterium tuberculosis
PWRPRVNGP

SEQ ID NO: 34729 - protein, 9 aa, Mycobacterium tuberculosis
WRPRVNGPE

SEQ ID NO: 34730 - protein, 9 aa, Mycobacterium tuberculosis
RPRVNGPEA

SEQ ID NO: 34731 - protein, 9 aa, Mycobacterium tuberculosis
PRVNGPEAE

SEQ ID NO: 34732 - protein, 9 aa, Mycobacterium tuberculosis
RVNGPEAEK

SEQ ID NO: 34733 - protein, 9 aa, Mycobacterium tuberculosis
VNGPEAEKL

SEQ ID NO: 34734 - protein, 9 aa, Mycobacterium tuberculosis
NGPEAEKLH

SEQ ID NO: 34735 - protein, 9 aa, Mycobacterium tuberculosis
GPEAEKLHD

SEQ ID NO: 34736 - protein, 9 aa, Mycobacterium tuberculosis
PEAEKLHDR

SEQ ID NO: 34737 - protein, 9 aa, Mycobacterium tuberculosis
EAEKLHDRL

SEQ ID NO: 34738 - protein, 9 aa, Mycobacterium tuberculosis
AEKLHDRLA

SEQ ID NO: 34739 - protein, 9 aa, Mycobacterium tuberculosis
EKLHDRLAN

SEQ ID NO: 34740 - protein, 9 aa, Mycobacterium tuberculosis
KLHDRLANW

SEQ ID NO: 34741 - protein, 9 aa, Mycobacterium tuberculosis
LHDRLANWA

SEQ ID NO: 34742 - protein, 9 aa, Mycobacterium tuberculosis
HDRLANWAA

SEQ ID NO: 34743 - protein, 9 aa, Mycobacterium tuberculosis
DRLANWAAA

SEQ ID NO: 34744 - protein, 9 aa, Mycobacterium tuberculosis
RLANWAAAI

SEQ ID NO: 34745 - protein, 9 aa, Mycobacterium tuberculosis
LANWAAAIN

SEQ ID NO: 34746 - protein, 9 aa, Mycobacterium tuberculosis
ANWAAAINP

SEQ ID NO: 34747 - protein, 9 aa, Mycobacterium tuberculosis
NWAAAINPL

SEQ ID NO: 34748 - protein, 9 aa, Mycobacterium tuberculosis
WAAAINPLE

SEQ ID NO: 34749 - protein, 9 aa, Mycobacterium tuberculosis
AAAINPLES

SEQ ID NO: 34750 - protein, 9 aa, Mycobacterium tuberculosis
AAINPLESG

SEQ ID NO: 34751 - protein, 9 aa, Mycobacterium tuberculosis
AINPLESGW

SEQ ID NO: 34752 - protein, 9 aa, Mycobacterium tuberculosis
INPLESGWP

SEQ ID NO: 34753 - protein, 9 aa, Mycobacterium tuberculosis
NPLESGWPA

SEQ ID NO: 34754 - protein, 9 aa, Mycobacterium tuberculosis
PLESGWPAM

SEQ ID NO: 34755 - protein, 9 aa, Mycobacterium tuberculosis
LESGWPAMP

SEQ ID NO: 34756 - protein, 9 aa, Mycobacterium tuberculosis
ESGWPAMPD

SEQ ID NO: 34757 - protein, 9 aa, Mycobacterium tuberculosis
SGWPAMPDG

SEQ ID NO: 34758 - protein, 9 aa, Mycobacterium tuberculosis
GWPAMPDGV

SEQ ID NO: 34759 - protein, 9 aa, Mycobacterium tuberculosis
WPAMPDGVT

SEQ ID NO: 34760 - protein, 9 aa, Mycobacterium tuberculosis
PAMPDGVTD

SEQ ID NO: 34761 - protein, 9 aa, Mycobacterium tuberculosis
AMPDGVTDR

SEQ ID NO: 34762 - protein, 9 aa, Mycobacterium tuberculosis
MPDGVTDRR

SEQ ID NO: 34763 - protein, 9 aa, Mycobacterium tuberculosis
PDGVTDRRA

SEQ ID NO: 34764 - protein, 9 aa, Mycobacterium tuberculosis
DGVTDRRAD

SEQ ID NO: 34765 - protein, 9 aa, Mycobacterium tuberculosis
GVTDRRADV

SEQ ID NO: 34766 - protein, 9 aa, Mycobacterium tuberculosis
VTDRRADVW

SEQ ID NO: 34767 - protein, 9 aa, Mycobacterium tuberculosis
TDRRADVWE

SEQ ID NO: 34768 - protein, 9 aa, Mycobacterium tuberculosis
DRRADVWES

SEQ ID NO: 34769 - protein, 9 aa, Mycobacterium tuberculosis
RRADVWESL

SEQ ID NO: 34770 - protein, 9 aa, Mycobacterium tuberculosis
RADVWESLV

SEQ ID NO: 34771 - protein, 9 aa, Mycobacterium tuberculosis
ADVWESLVA

SEQ ID NO: 34772 - protein, 9 aa, Mycobacterium tuberculosis
DVWESLVAV

SEQ ID NO: 34773 - protein, 9 aa, Mycobacterium tuberculosis
VWESLVAVA

SEQ ID NO: 34774 - protein, 9 aa, Mycobacterium tuberculosis
WESLVAVAD

SEQ ID NO: 34775 - protein, 9 aa, Mycobacterium tuberculosis
ESLVAVADT

SEQ ID NO: 34776 - protein, 9 aa, Mycobacterium tuberculosis
SLVAVADTA

SEQ ID NO: 34777 - protein, 9 aa, Mycobacterium tuberculosis
LVAVADTAG

SEQ ID NO: 34778 - protein, 9 aa, Mycobacterium tuberculosis
VAVADTAGG

SEQ ID NO: 34779 - protein, 9 aa, Mycobacterium tuberculosis
AVADTAGGH

SEQ ID NO: 34780 - protein, 9 aa, Mycobacterium tuberculosis
VADTAGGHW

SEQ ID NO: 34781 - protein, 9 aa, Mycobacterium tuberculosis
ADTAGGHWP

SEQ ID NO: 34782 - protein, 9 aa, Mycobacterium tuberculosis
DTAGGHWPK

SEQ ID NO: 34783 - protein, 9 aa, Mycobacterium tuberculosis
TAGGHWPKT

SEQ ID NO: 34784 - protein, 9 aa, Mycobacterium tuberculosis
AGGHWPKTA

SEQ ID NO: 34785 - protein, 9 aa, Mycobacterium tuberculosis
GGHWPKTAR

SEQ ID NO: 34786 - protein, 9 aa, Mycobacterium tuberculosis
GHWPKTARA

SEQ ID NO: 34787 - protein, 9 aa, Mycobacterium tuberculosis
HWPKTARAT

SEQ ID NO: 34788 - protein, 9 aa, Mycobacterium tuberculosis
WPKTARATA

SEQ ID NO: 34789 - protein, 9 aa, Mycobacterium tuberculosis
PKTARATAE

SEQ ID NO: 34790 - protein, 9 aa, Mycobacterium tuberculosis
KTARATAET

SEQ ID NO: 34791 - protein, 9 aa, Mycobacterium tuberculosis
TARATAETD

SEQ ID NO: 34792 - protein, 9 aa, Mycobacterium tuberculosis
ARATAETDA

SEQ ID NO: 34793 - protein, 9 aa, Mycobacterium tuberculosis
RATAETDAT

SEQ ID NO: 34794 - protein, 9 aa, Mycobacterium tuberculosis
ATAETDATA

SEQ ID NO: 34795 - protein, 9 aa, Mycobacterium tuberculosis
TAETDATAN

SEQ ID NO: 34796 - protein, 9 aa, Mycobacterium tuberculosis
AETDATANR

SEQ ID NO: 34797 - protein, 9 aa, Mycobacterium tuberculosis
ETDATANRG

SEQ ID NO: 34798 - protein, 9 aa, Mycobacterium tuberculosis
TDATANRGA

SEQ ID NO: 34799 - protein, 9 aa, Mycobacterium tuberculosis
DATANRGAK

SEQ ID NO: 34800 - protein, 9 aa, Mycobacterium tuberculosis
ATANRGAKP

SEQ ID NO: 34801 - protein, 9 aa, Mycobacterium tuberculosis
TANRGAKPS

SEQ ID NO: 34802 - protein, 9 aa, Mycobacterium tuberculosis
ANRGAKPSI

SEQ ID NO: 34803 - protein, 9 aa, Mycobacterium tuberculosis
NRGAKPSIG

SEQ ID NO: 34804 - protein, 9 aa, Mycobacterium tuberculosis
RGAKPSIGV

SEQ ID NO: 34805 - protein, 9 aa, Mycobacterium tuberculosis
GAKPSIGVL

SEQ ID NO: 34806 - protein, 9 aa, Mycobacterium tuberculosis
AKPSIGVLL

SEQ ID NO: 34807 - protein, 9 aa, Mycobacterium tuberculosis
KPSIGVLLL

SEQ ID NO: 34808 - protein, 9 aa, Mycobacterium tuberculosis
PSIGVLLLR

SEQ ID NO: 34809 - protein, 9 aa, Mycobacterium tuberculosis
SIGVLLLRD

SEQ ID NO: 34810 - protein, 9 aa, Mycobacterium tuberculosis
IGVLLLRDI

SEQ ID NO: 34811 - protein, 9 aa, Mycobacterium tuberculosis
GVLLLRDIR

SEQ ID NO: 34812 - protein, 9 aa, Mycobacterium tuberculosis
VLLLRDIRR

SEQ ID NO: 34813 - protein, 9 aa, Mycobacterium tuberculosis
LLLRDIRRV

SEQ ID NO: 34814 - protein, 9 aa, Mycobacterium tuberculosis
LLRDIRRVF

SEQ ID NO: 34815 - protein, 9 aa, Mycobacterium tuberculosis
LRDIRRVFS

SEQ ID NO: 34816 - protein, 9 aa, Mycobacterium tuberculosis
RDIRRVFSD

SEQ ID NO: 34817 - protein, 9 aa, Mycobacterium tuberculosis
DIRRVFSDR

SEQ ID NO: 34818 - protein, 9 aa, Mycobacterium tuberculosis
IRRVFSDRD

SEQ ID NO: 34819 - protein, 9 aa, Mycobacterium tuberculosis
RRVFSDRDR

SEQ ID NO: 34820 - protein, 9 aa, Mycobacterium tuberculosis
RVFSDRDRM

SEQ ID NO: 34821 - protein, 9 aa, Mycobacterium tuberculosis
VFSDRDRMR

SEQ ID NO: 34822 - protein, 9 aa, Mycobacterium tuberculosis
FSDRDRMRT

SEQ ID NO: 34823 - protein, 9 aa, Mycobacterium tuberculosis
SDRDRMRTS

SEQ ID NO: 34824 - protein, 9 aa, Mycobacterium tuberculosis
DRDRMRTSD

SEQ ID NO: 34825 - protein, 9 aa, Mycobacterium tuberculosis
RDRMRTSDI

SEQ ID NO: 34826 - protein, 9 aa, Mycobacterium tuberculosis
DRMRTSDIL

SEQ ID NO: 34827 - protein, 9 aa, Mycobacterium tuberculosis
RMRTSDILT

SEQ ID NO: 34828 - protein, 9 aa, Mycobacterium tuberculosis
MRTSDILTG

SEQ ID NO: 34829 - protein, 9 aa, Mycobacterium tuberculosis
RTSDILTGL

SEQ ID NO: 34830 - protein, 9 aa, Mycobacterium tuberculosis
TSDILTGLN

SEQ ID NO: 34831 - protein, 9 aa, Mycobacterium tuberculosis
SDILTGLNR

SEQ ID NO: 34832 - protein, 9 aa, Mycobacterium tuberculosis
DILTGLNRM

SEQ ID NO: 34833 - protein, 9 aa, Mycobacterium tuberculosis
ILTGLNRME

SEQ ID NO: 34834 - protein, 9 aa, Mycobacterium tuberculosis
LTGLNRMEE

SEQ ID NO: 34835 - protein, 9 aa, Mycobacterium tuberculosis
TGLNRMEEG

SEQ ID NO: 34836 - protein, 9 aa, Mycobacterium tuberculosis
GLNRMEEGP

SEQ ID NO: 34837 - protein, 9 aa, Mycobacterium tuberculosis
LNRMEEGPW

SEQ ID NO: 34838 - protein, 9 aa, Mycobacterium tuberculosis
NRMEEGPWG

SEQ ID NO: 34839 - protein, 9 aa, Mycobacterium tuberculosis
RMEEGPWGS

SEQ ID NO: 34840 - protein, 9 aa, Mycobacterium tuberculosis
MEEGPWGSI

SEQ ID NO: 34841 - protein, 9 aa, Mycobacterium tuberculosis
EEGPWGSIR

SEQ ID NO: 34842 - protein, 9 aa, Mycobacterium tuberculosis
EGPWGSIRR

SEQ ID NO: 34843 - protein, 9 aa, Mycobacterium tuberculosis
GPWGSIRRG

SEQ ID NO: 34844 - protein, 9 aa, Mycobacterium tuberculosis
PWGSIRRGD

SEQ ID NO: 34845 - protein, 9 aa, Mycobacterium tuberculosis
WGSIRRGDP

SEQ ID NO: 34846 - protein, 9 aa, Mycobacterium tuberculosis
GSIRRGDPL

SEQ ID NO: 34847 - protein, 9 aa, Mycobacterium tuberculosis
SIRRGDPLD

SEQ ID NO: 34848 - protein, 9 aa, Mycobacterium tuberculosis
IRRGDPLDA

SEQ ID NO: 34849 - protein, 9 aa, Mycobacterium tuberculosis
RRGDPLDAR

SEQ ID NO: 34850 - protein, 9 aa, Mycobacterium tuberculosis
RGDPLDARG

SEQ ID NO: 34851 - protein, 9 aa, Mycobacterium tuberculosis
GDPLDARGL

SEQ ID NO: 34852 - protein, 9 aa, Mycobacterium tuberculosis
DPLDARGLA

SEQ ID NO: 34853 - protein, 9 aa, Mycobacterium tuberculosis
PLDARGLAT

SEQ ID NO: 34854 - protein, 9 aa, Mycobacterium tuberculosis
LDARGLATR

SEQ ID NO: 34855 - protein, 9 aa, Mycobacterium tuberculosis
DARGLATRL

SEQ ID NO: 34856 - protein, 9 aa, Mycobacterium tuberculosis
ARGLATRLG

SEQ ID NO: 34857 - protein, 9 aa, Mycobacterium tuberculosis
RGLATRLGR

SEQ ID NO: 34858 - protein, 9 aa, Mycobacterium tuberculosis
GLATRLGRY

SEQ ID NO: 34859 - protein, 9 aa, Mycobacterium tuberculosis
LATRLGRYG

SEQ ID NO: 34860 - protein, 9 aa, Mycobacterium tuberculosis
ATRLGRYGI

SEQ ID NO: 34861 - protein, 9 aa, Mycobacterium tuberculosis
TRLGRYGIG

SEQ ID NO: 34862 - protein, 9 aa, Mycobacterium tuberculosis
RLGRYGIGP

SEQ ID NO: 34863 - protein, 9 aa, Mycobacterium tuberculosis
LGRYGIGPK

SEQ ID NO: 34864 - protein, 9 aa, Mycobacterium tuberculosis
GRYGIGPKF

SEQ ID NO: 34865 - protein, 9 aa, Mycobacterium tuberculosis
RYGIGPKFQ

SEQ ID NO: 34866 - protein, 9 aa, Mycobacterium tuberculosis
YGIGPKFQH

SEQ ID NO: 34867 - protein, 9 aa, Mycobacterium tuberculosis
GIGPKFQHS

SEQ ID NO: 34868 - protein, 9 aa, Mycobacterium tuberculosis
IGPKFQHSG

SEQ ID NO: 34869 - protein, 9 aa, Mycobacterium tuberculosis
GPKFQHSGG

SEQ ID NO: 34870 - protein, 9 aa, Mycobacterium tuberculosis
PKFQHSGGE

SEQ ID NO: 34871 - protein, 9 aa, Mycobacterium tuberculosis
KFQHSGGEP

SEQ ID NO: 34872 - protein, 9 aa, Mycobacterium tuberculosis
FQHSGGEPP

SEQ ID NO: 34873 - protein, 9 aa, Mycobacterium tuberculosis
QHSGGEPPY

SEQ ID NO: 34874 - protein, 9 aa, Mycobacterium tuberculosis
HSGGEPPYK

SEQ ID NO: 34875 - protein, 9 aa, Mycobacterium tuberculosis
SGGEPPYKG

SEQ ID NO: 34876 - protein, 9 aa, Mycobacterium tuberculosis
GGEPPYKGY

SEQ ID NO: 34877 - protein, 9 aa, Mycobacterium tuberculosis
GEPPYKGYS

SEQ ID NO: 34878 - protein, 9 aa, Mycobacterium tuberculosis
EPPYKGYSR

SEQ ID NO: 34879 - protein, 9 aa, Mycobacterium tuberculosis
PPYKGYSRT

SEQ ID NO: 34880 - protein, 9 aa, Mycobacterium tuberculosis
PYKGYSRTQ

SEQ ID NO: 34881 - protein, 9 aa, Mycobacterium tuberculosis
YKGYSRTQF

SEQ ID NO: 34882 - protein, 9 aa, Mycobacterium tuberculosis
KGYSRTQFE

SEQ ID NO: 34883 - protein, 9 aa, Mycobacterium tuberculosis
GYSRTQFED

SEQ ID NO: 34884 - protein, 9 aa, Mycobacterium tuberculosis
YSRTQFEDA

SEQ ID NO: 34885 - protein, 9 aa, Mycobacterium tuberculosis
SRTQFEDAW

SEQ ID NO: 34886 - protein, 9 aa, Mycobacterium tuberculosis
RTQFEDAWS

SEQ ID NO: 34887 - protein, 9 aa, Mycobacterium tuberculosis
TQFEDAWSR

SEQ ID NO: 34888 - protein, 9 aa, Mycobacterium tuberculosis
QFEDAWSRY

SEQ ID NO: 34889 - protein, 9 aa, Mycobacterium tuberculosis
FEDAWSRYL

SEQ ID NO: 34890 - protein, 9 aa, Mycobacterium tuberculosis
EDAWSRYLS

SEQ ID NO: 34891 - protein, 9 aa, Mycobacterium tuberculosis
DAWSRYLSA

SEQ ID NO: 34892 - protein, 9 aa, Mycobacterium tuberculosis
AWSRYLSAD

SEQ ID NO: 34893 - protein, 9 aa, Mycobacterium tuberculosis
WSRYLSADD

SEQ ID NO: 34894 - protein, 9 aa, Mycobacterium tuberculosis
SRYLSADDE

SEQ ID NO: 34895 - protein, 9 aa, Mycobacterium tuberculosis
RYLSADDET

SEQ ID NO: 34896 - protein, 9 aa, Mycobacterium tuberculosis
YLSADDETP

SEQ ID NO: 34897 - protein, 9 aa, Mycobacterium tuberculosis
LSADDETPE

SEQ ID NO: 34898 - protein, 9 aa, Mycobacterium tuberculosis
SADDETPEE

SEQ ID NO: 34899 - protein, 9 aa, Mycobacterium tuberculosis
ADDETPEER

SEQ ID NO: 34900 - protein, 9 aa, Mycobacterium tuberculosis
DDETPEERD

SEQ ID NO: 34901 - protein, 9 aa, Mycobacterium tuberculosis
DETPEERDL

SEQ ID NO: 34902 - protein, 9 aa, Mycobacterium tuberculosis
ETPEERDLS

SEQ ID NO: 34903 - protein, 9 aa, Mycobacterium tuberculosis
TPEERDLSV

SEQ ID NO: 34904 - protein, 9 aa, Mycobacterium tuberculosis
PEERDLSVS

SEQ ID NO: 34905 - protein, 9 aa, Mycobacterium tuberculosis
EERDLSVSA

SEQ ID NO: 34906 - protein, 9 aa, Mycobacterium tuberculosis
ERDLSVSAV

SEQ ID NO: 34907 - protein, 9 aa, Mycobacterium tuberculosis
RDLSVSAVS

SEQ ID NO: 34908 - protein, 9 aa, Mycobacterium tuberculosis
DLSVSAVSA

SEQ ID NO: 34909 - protein, 9 aa, Mycobacterium tuberculosis
LSVSAVSAV

SEQ ID NO: 34910 - protein, 9 aa, Mycobacterium tuberculosis
SVSAVSAVS

SEQ ID NO: 34911 - protein, 9 aa, Mycobacterium tuberculosis
VSAVSAVSP

SEQ ID NO: 34912 - protein, 9 aa, Mycobacterium tuberculosis
SAVSAVSPP

SEQ ID NO: 34913 - protein, 9 aa, Mycobacterium tuberculosis
AVSAVSPPV

SEQ ID NO: 34914 - protein, 9 aa, Mycobacterium tuberculosis
VSAVSPPVG

SEQ ID NO: 34915 - protein, 9 aa, Mycobacterium tuberculosis
SAVSPPVGD

SEQ ID NO: 34916 - protein, 9 aa, Mycobacterium tuberculosis
AVSPPVGDP

SEQ ID NO: 34917 - protein, 9 aa, Mycobacterium tuberculosis
VSPPVGDPG

SEQ ID NO: 34918 - protein, 9 aa, Mycobacterium tuberculosis
SPPVGDPGD

SEQ ID NO: 34919 - protein, 9 aa, Mycobacterium tuberculosis
PPVGDPGDA

SEQ ID NO: 34920 - protein, 9 aa, Mycobacterium tuberculosis
PVGDPGDAT

SEQ ID NO: 34921 - protein, 9 aa, Mycobacterium tuberculosis
VGDPGDATG

SEQ ID NO: 34922 - protein, 9 aa, Mycobacterium tuberculosis
GDPGDATGA

SEQ ID NO: 34923 - protein, 9 aa, Mycobacterium tuberculosis
DPGDATGAT

SEQ ID NO: 34924 - protein, 9 aa, Mycobacterium tuberculosis
PGDATGATD

SEQ ID NO: 34925 - protein, 9 aa, Mycobacterium tuberculosis
GDATGATDA

SEQ ID NO: 34926 - protein, 9 aa, Mycobacterium tuberculosis
DATGATDAT

SEQ ID NO: 34927 - protein, 9 aa, Mycobacterium tuberculosis
ATGATDATD

SEQ ID NO: 34928 - protein, 9 aa, Mycobacterium tuberculosis
TGATDATDL

SEQ ID NO: 34929 - protein, 9 aa, Mycobacterium tuberculosis
GATDATDLP

SEQ ID NO: 34930 - protein, 9 aa, Mycobacterium tuberculosis
ATDATDLPE

SEQ ID NO: 34931 - protein, 9 aa, Mycobacterium tuberculosis
TDATDLPEA

SEQ ID NO: 34932 - protein, 9 aa, Mycobacterium tuberculosis
DATDLPEAG

SEQ ID NO: 34933 - protein, 9 aa, Mycobacterium tuberculosis
ATDLPEAGD

SEQ ID NO: 34934 - protein, 9 aa, Mycobacterium tuberculosis
TDLPEAGDL

SEQ ID NO: 34935 - protein, 9 aa, Mycobacterium tuberculosis
DLPEAGDLP

SEQ ID NO: 34936 - protein, 9 aa, Mycobacterium tuberculosis
LPEAGDLPY

SEQ ID NO: 34937 - protein, 9 aa, Mycobacterium tuberculosis
PEAGDLPYE

SEQ ID NO: 34938 - protein, 9 aa, Mycobacterium tuberculosis
EAGDLPYEP

SEQ ID NO: 34939 - protein, 9 aa, Mycobacterium tuberculosis
AGDLPYEPP

SEQ ID NO: 34940 - protein, 9 aa, Mycobacterium tuberculosis
GDLPYEPPA

SEQ ID NO: 34941 - protein, 9 aa, Mycobacterium tuberculosis
DLPYEPPAP

SEQ ID NO: 34942 - protein, 9 aa, Mycobacterium tuberculosis
LPYEPPAPN

SEQ ID NO: 34943 - protein, 9 aa, Mycobacterium tuberculosis
PYEPPAPNG

SEQ ID NO: 34944 - protein, 9 aa, Mycobacterium tuberculosis
YEPPAPNGH

SEQ ID NO: 34945 - protein, 9 aa, Mycobacterium tuberculosis
EPPAPNGHP

SEQ ID NO: 34946 - protein, 9 aa, Mycobacterium tuberculosis
PPAPNGHPN

SEQ ID NO: 34947 - protein, 9 aa, Mycobacterium tuberculosis
PAPNGHPNG

SEQ ID NO: 34948 - protein, 9 aa, Mycobacterium tuberculosis
APNGHPNGD

SEQ ID NO: 34949 - protein, 9 aa, Mycobacterium tuberculosis
PNGHPNGDA

SEQ ID NO: 34950 - protein, 9 aa, Mycobacterium tuberculosis
NGHPNGDAP

SEQ ID NO: 34951 - protein, 9 aa, Mycobacterium tuberculosis
GHPNGDAPL

SEQ ID NO: 34952 - protein, 9 aa, Mycobacterium tuberculosis
HPNGDAPLC

SEQ ID NO: 34953 - protein, 9 aa, Mycobacterium tuberculosis
PNGDAPLCS

SEQ ID NO: 34954 - protein, 9 aa, Mycobacterium tuberculosis
NGDAPLCSG

SEQ ID NO: 34955 - protein, 9 aa, Mycobacterium tuberculosis
GDAPLCSGP

SEQ ID NO: 34956 - protein, 9 aa, Mycobacterium tuberculosis
DAPLCSGPG

SEQ ID NO: 34957 - protein, 9 aa, Mycobacterium tuberculosis
APLCSGPGC

SEQ ID NO: 34958 - protein, 9 aa, Mycobacterium tuberculosis
PLCSGPGCP

SEQ ID NO: 34959 - protein, 9 aa, Mycobacterium tuberculosis
LCSGPGCPN

SEQ ID NO: 34960 - protein, 9 aa, Mycobacterium tuberculosis
CSGPGCPNK

SEQ ID NO: 34961 - protein, 9 aa, Mycobacterium tuberculosis
SGPGCPNKL

SEQ ID NO: 34962 - protein, 9 aa, Mycobacterium tuberculosis
GPGCPNKLL

SEQ ID NO: 34963 - protein, 9 aa, Mycobacterium tuberculosis
PGCPNKLLS

SEQ ID NO: 34964 - protein, 9 aa, Mycobacterium tuberculosis
GCPNKLLST

SEQ ID NO: 34965 - protein, 9 aa, Mycobacterium tuberculosis
CPNKLLSTE

SEQ ID NO: 34966 - protein, 9 aa, Mycobacterium tuberculosis
PNKLLSTEA

SEQ ID NO: 34967 - protein, 9 aa, Mycobacterium tuberculosis
NKLLSTEAK

SEQ ID NO: 34968 - protein, 9 aa, Mycobacterium tuberculosis
KLLSTEAKA

SEQ ID NO: 34969 - protein, 9 aa, Mycobacterium tuberculosis
LLSTEAKAA

SEQ ID NO: 34970 - protein, 9 aa, Mycobacterium tuberculosis
LSTEAKAAG

SEQ ID NO: 34971 - protein, 9 aa, Mycobacterium tuberculosis
STEAKAAGK

SEQ ID NO: 34972 - protein, 9 aa, Mycobacterium tuberculosis
TEAKAAGKC

SEQ ID NO: 34973 - protein, 9 aa, Mycobacterium tuberculosis
EAKAAGKCR

SEQ ID NO: 34974 - protein, 9 aa, Mycobacterium tuberculosis
AKAAGKCRP

SEQ ID NO: 34975 - protein, 9 aa, Mycobacterium tuberculosis
KAAGKCRPC

SEQ ID NO: 34976 - protein, 9 aa, Mycobacterium tuberculosis
AAGKCRPCR

SEQ ID NO: 34977 - protein, 9 aa, Mycobacterium tuberculosis
AGKCRPCRG

SEQ ID NO: 34978 - protein, 9 aa, Mycobacterium tuberculosis
GKCRPCRGR

SEQ ID NO: 34979 - protein, 9 aa, Mycobacterium tuberculosis
KCRPCRGRA

SEQ ID NO: 34980 - protein, 9 aa, Mycobacterium tuberculosis
CRPCRGRAA

SEQ ID NO: 34981 - protein, 9 aa, Mycobacterium tuberculosis
RPCRGRAAA

SEQ ID NO: 34982 - protein, 9 aa, Mycobacterium tuberculosis
PCRGRAAAS

SEQ ID NO: 34983 - protein, 9 aa, Mycobacterium tuberculosis
CRGRAAASA

SEQ ID NO: 34984 - protein, 9 aa, Mycobacterium tuberculosis
RGRAAASAR

SEQ ID NO: 34985 - protein, 9 aa, Mycobacterium tuberculosis
GRAAASARD

SEQ ID NO: 34986 - protein, 9 aa, Mycobacterium tuberculosis
RAAASARDG

SEQ ID NO: 34987 - protein, 9 aa, Mycobacterium tuberculosis
AAASARDGA

SEQ ID NO: 34988 - protein, 9 aa, Mycobacterium tuberculosis
AASARDGAR

SEQ ID NO: 34989 - protein, 10 aa, Mycobacterium tuberculosis
MADIPYGRDY

SEQ ID NO: 34990 - protein, 10 aa, Mycobacterium tuberculosis
ADIPYGRDYP

SEQ ID NO: 34991 - protein, 10 aa, Mycobacterium tuberculosis
DIPYGRDYPD

SEQ ID NO: 34992 - protein, 10 aa, Mycobacterium tuberculosis
IPYGRDYPDP

SEQ ID NO: 34993 - protein, 10 aa, Mycobacterium tuberculosis
PYGRDYPDPI

SEQ ID NO: 34994 - protein, 10 aa, Mycobacterium tuberculosis
YGRDYPDPIW

SEQ ID NO: 34995 - protein, 10 aa, Mycobacterium tuberculosis
GRDYPDPIWC

SEQ ID NO: 34996 - protein, 10 aa, Mycobacterium tuberculosis
RDYPDPIWCD

SEQ ID NO: 34997 - protein, 10 aa, Mycobacterium tuberculosis
DYPDPIWCDE

SEQ ID NO: 34998 - protein, 10 aa, Mycobacterium tuberculosis
YPDPIWCDED

SEQ ID NO: 34999 - protein, 10 aa, Mycobacterium tuberculosis
PDPIWCDEDG

SEQ ID NO: 35000 - protein, 10 aa, Mycobacterium tuberculosis
DPIWCDEDGQ

SEQ ID NO: 35001 - protein, 10 aa, Mycobacterium tuberculosis
PIWCDEDGQP

SEQ ID NO: 35002 - protein, 10 aa, Mycobacterium tuberculosis
IWCDEDGQPM

SEQ ID NO: 35003 - protein, 10 aa, Mycobacterium tuberculosis
WCDEDGQPMP

SEQ ID NO: 35004 - protein, 10 aa, Mycobacterium tuberculosis
CDEDGQPMPP

SEQ ID NO: 35005 - protein, 10 aa, Mycobacterium tuberculosis
DEDGQPMPPV

SEQ ID NO: 35006 - protein, 10 aa, Mycobacterium tuberculosis
EDGQPMPPVG

SEQ ID NO: 35007 - protein, 10 aa, Mycobacterium tuberculosis
DGQPMPPVGA

SEQ ID NO: 35008 - protein, 10 aa, Mycobacterium tuberculosis
GQPMPPVGAE

SEQ ID NO: 35009 - protein, 10 aa, Mycobacterium tuberculosis
QPMPPVGAEL

SEQ ID NO: 35010 - protein, 10 aa, Mycobacterium tuberculosis
PMPPVGAELL

SEQ ID NO: 35011 - protein, 10 aa, Mycobacterium tuberculosis
MPPVGAELLD

SEQ ID NO: 35012 - protein, 10 aa, Mycobacterium tuberculosis
PPVGAELLDD

SEQ ID NO: 35013 - protein, 10 aa, Mycobacterium tuberculosis
PVGAELLDDI

SEQ ID NO: 35014 - protein, 10 aa, Mycobacterium tuberculosis
VGAELLDDIR

SEQ ID NO: 35015 - protein, 10 aa, Mycobacterium tuberculosis
GAELLDDIRA

SEQ ID NO: 35016 - protein, 10 aa, Mycobacterium tuberculosis
AELLDDIRAF

SEQ ID NO: 35017 - protein, 10 aa, Mycobacterium tuberculosis
ELLDDIRAFL

SEQ ID NO: 35018 - protein, 10 aa, Mycobacterium tuberculosis
LLDDIRAFLR

SEQ ID NO: 35019 - protein, 10 aa, Mycobacterium tuberculosis
LDDIRAFLRR

SEQ ID NO: 35020 - protein, 10 aa, Mycobacterium tuberculosis
DDIRAFLRRF

SEQ ID NO: 35021 - protein, 10 aa, Mycobacterium tuberculosis
DIRAFLRRFV

SEQ ID NO: 35022 - protein, 10 aa, Mycobacterium tuberculosis
IRAFLRRFVV

SEQ ID NO: 35023 - protein, 10 aa, Mycobacterium tuberculosis
RAFLRRFVVY

SEQ ID NO: 35024 - protein, 10 aa, Mycobacterium tuberculosis
AFLRRFVVYP

SEQ ID NO: 35025 - protein, 10 aa, Mycobacterium tuberculosis
FLRRFVVYPS

SEQ ID NO: 35026 - protein, 10 aa, Mycobacterium tuberculosis
LRRFVVYPSD

SEQ ID NO: 35027 - protein, 10 aa, Mycobacterium tuberculosis
RRFVVYPSDH

SEQ ID NO: 35028 - protein, 10 aa, Mycobacterium tuberculosis
RFVVYPSDHE

SEQ ID NO: 35029 - protein, 10 aa, Mycobacterium tuberculosis
FVVYPSDHEL

SEQ ID NO: 35030 - protein, 10 aa, Mycobacterium tuberculosis
VVYPSDHELI

SEQ ID NO: 35031 - protein, 10 aa, Mycobacterium tuberculosis
VYPSDHELIA

SEQ ID NO: 35032 - protein, 10 aa, Mycobacterium tuberculosis
YPSDHELIAH

SEQ ID NO: 35033 - protein, 10 aa, Mycobacterium tuberculosis
PSDHELIAHT

SEQ ID NO: 35034 - protein, 10 aa, Mycobacterium tuberculosis
SDHELIAHTL

SEQ ID NO: 35035 - protein, 10 aa, Mycobacterium tuberculosis
DHELIAHTLW

SEQ ID NO: 35036 - protein, 10 aa, Mycobacterium tuberculosis
HELIAHTLWI

SEQ ID NO: 35037 - protein, 10 aa, Mycobacterium tuberculosis
ELIAHTLWIA

SEQ ID NO: 35038 - protein, 10 aa, Mycobacterium tuberculosis
LIAHTLWIAH

SEQ ID NO: 35039 - protein, 10 aa, Mycobacterium tuberculosis
IAHTLWIAHC

SEQ ID NO: 35040 - protein, 10 aa, Mycobacterium tuberculosis
AHTLWIAHCW

SEQ ID NO: 35041 - protein, 10 aa, Mycobacterium tuberculosis
HTLWIAHCWF

SEQ ID NO: 35042 - protein, 10 aa, Mycobacterium tuberculosis
TLWIAHCWFM

SEQ ID NO: 35043 - protein, 10 aa, Mycobacterium tuberculosis
LWIAHCWFME

SEQ ID NO: 35044 - protein, 10 aa, Mycobacterium tuberculosis
WIAHCWFMEA

SEQ ID NO: 35045 - protein, 10 aa, Mycobacterium tuberculosis
IAHCWFMEAW

SEQ ID NO: 35046 - protein, 10 aa, Mycobacterium tuberculosis
AHCWFMEAWD

SEQ ID NO: 35047 - protein, 10 aa, Mycobacterium tuberculosis
HCWFMEAWDS

SEQ ID NO: 35048 - protein, 10 aa, Mycobacterium tuberculosis
CWFMEAWDST

SEQ ID NO: 35049 - protein, 10 aa, Mycobacterium tuberculosis
WFMEAWDSTP

SEQ ID NO: 35050 - protein, 10 aa, Mycobacterium tuberculosis
FMEAWDSTPR

SEQ ID NO: 35051 - protein, 10 aa, Mycobacterium tuberculosis
MEAWDSTPRI

SEQ ID NO: 35052 - protein, 10 aa, Mycobacterium tuberculosis
EAWDSTPRIA

SEQ ID NO: 35053 - protein, 10 aa, Mycobacterium tuberculosis
AWDSTPRIAF

SEQ ID NO: 35054 - protein, 10 aa, Mycobacterium tuberculosis
WDSTPRIAFL

SEQ ID NO: 35055 - protein, 10 aa, Mycobacterium tuberculosis
DSTPRIAFLS

SEQ ID NO: 35056 - protein, 10 aa, Mycobacterium tuberculosis
STPRIAFLSP

SEQ ID NO: 35057 - protein, 10 aa, Mycobacterium tuberculosis
TPRIAFLSPE

SEQ ID NO: 35058 - protein, 10 aa, Mycobacterium tuberculosis
PRIAFLSPEP

SEQ ID NO: 35059 - protein, 10 aa, Mycobacterium tuberculosis
RIAFLSPEPG

SEQ ID NO: 35060 - protein, 10 aa, Mycobacterium tuberculosis
IAFLSPEPGS

SEQ ID NO: 35061 - protein, 10 aa, Mycobacterium tuberculosis
AFLSPEPGSG

SEQ ID NO: 35062 - protein, 10 aa, Mycobacterium tuberculosis
FLSPEPGSGK

SEQ ID NO: 35063 - protein, 10 aa, Mycobacterium tuberculosis
LSPEPGSGKS

SEQ ID NO: 35064 - protein, 10 aa, Mycobacterium tuberculosis
SPEPGSGKSR

SEQ ID NO: 35065 - protein, 10 aa, Mycobacterium tuberculosis
PEPGSGKSRA

SEQ ID NO: 35066 - protein, 10 aa, Mycobacterium tuberculosis
EPGSGKSRAL

SEQ ID NO: 35067 - protein, 10 aa, Mycobacterium tuberculosis
PGSGKSRALE

SEQ ID NO: 35068 - protein, 10 aa, Mycobacterium tuberculosis
GSGKSRALEV

SEQ ID NO: 35069 - protein, 10 aa, Mycobacterium tuberculosis
SGKSRALEVT

SEQ ID NO: 35070 - protein, 10 aa, Mycobacterium tuberculosis
GKSRALEVTE

SEQ ID NO: 35071 - protein, 10 aa, Mycobacterium tuberculosis
KSRALEVTEP

SEQ ID NO: 35072 - protein, 10 aa, Mycobacterium tuberculosis
SRALEVTEPL

SEQ ID NO: 35073 - protein, 10 aa, Mycobacterium tuberculosis
RALEVTEPLV

SEQ ID NO: 35074 - protein, 10 aa, Mycobacterium tuberculosis
ALEVTEPLVP

SEQ ID NO: 35075 - protein, 10 aa, Mycobacterium tuberculosis
LEVTEPLVPR

SEQ ID NO: 35076 - protein, 10 aa, Mycobacterium tuberculosis
EVTEPLVPRP

SEQ ID NO: 35077 - protein, 10 aa, Mycobacterium tuberculosis
VTEPLVPRPV

SEQ ID NO: 35078 - protein, 10 aa, Mycobacterium tuberculosis
TEPLVPRPVH

SEQ ID NO: 35079 - protein, 10 aa, Mycobacterium tuberculosis
EPLVPRPVHA

SEQ ID NO: 35080 - protein, 10 aa, Mycobacterium tuberculosis
PLVPRPVHAI

SEQ ID NO: 35081 - protein, 10 aa, Mycobacterium tuberculosis
LVPRPVHAIN

SEQ ID NO: 35082 - protein, 10 aa, Mycobacterium tuberculosis
VPRPVHAINC

SEQ ID NO: 35083 - protein, 10 aa, Mycobacterium tuberculosis
PRPVHAINCT

SEQ ID NO: 35084 - protein, 10 aa, Mycobacterium tuberculosis
RPVHAINCTP

SEQ ID NO: 35085 - protein, 10 aa, Mycobacterium tuberculosis
PVHAINCTPA

SEQ ID NO: 35086 - protein, 10 aa, Mycobacterium tuberculosis
VHAINCTPAY

SEQ ID NO: 35087 - protein, 10 aa, Mycobacterium tuberculosis
HAINCTPAYL

SEQ ID NO: 35088 - protein, 10 aa, Mycobacterium tuberculosis
AINCTPAYLF

SEQ ID NO: 35089 - protein, 10 aa, Mycobacterium tuberculosis
INCTPAYLFR

SEQ ID NO: 35090 - protein, 10 aa, Mycobacterium tuberculosis
NCTPAYLFRR

SEQ ID NO: 35091 - protein, 10 aa, Mycobacterium tuberculosis
CTPAYLFRRV

SEQ ID NO: 35092 - protein, 10 aa, Mycobacterium tuberculosis
TPAYLFRRVA

SEQ ID NO: 35093 - protein, 10 aa, Mycobacterium tuberculosis
PAYLFRRVAD

SEQ ID NO: 35094 - protein, 10 aa, Mycobacterium tuberculosis
AYLFRRVADP

SEQ ID NO: 35095 - protein, 10 aa, Mycobacterium tuberculosis
YLFRRVADPV

SEQ ID NO: 35096 - protein, 10 aa, Mycobacterium tuberculosis
LFRRVADPVG

SEQ ID NO: 35097 - protein, 10 aa, Mycobacterium tuberculosis
FRRVADPVGR

SEQ ID NO: 35098 - protein, 10 aa, Mycobacterium tuberculosis
RRVADPVGRP

SEQ ID NO: 35099 - protein, 10 aa, Mycobacterium tuberculosis
RVADPVGRPT

SEQ ID NO: 35100 - protein, 10 aa, Mycobacterium tuberculosis
VADPVGRPTV

SEQ ID NO: 35101 - protein, 10 aa, Mycobacterium tuberculosis
ADPVGRPTVL

SEQ ID NO: 35102 - protein, 10 aa, Mycobacterium tuberculosis
DPVGRPTVLY

SEQ ID NO: 35103 - protein, 10 aa, Mycobacterium tuberculosis
PVGRPTVLYD

SEQ ID NO: 35104 - protein, 10 aa, Mycobacterium tuberculosis
VGRPTVLYDE

SEQ ID NO: 35105 - protein, 10 aa, Mycobacterium tuberculosis
GRPTVLYDEC

SEQ ID NO: 35106 - protein, 10 aa, Mycobacterium tuberculosis
RPTVLYDECD

SEQ ID NO: 35107 - protein, 10 aa, Mycobacterium tuberculosis
PTVLYDECDT

SEQ ID NO: 35108 - protein, 10 aa, Mycobacterium tuberculosis
TVLYDECDTL

SEQ ID NO: 35109 - protein, 10 aa, Mycobacterium tuberculosis
VLYDECDTLF

SEQ ID NO: 35110 - protein, 10 aa, Mycobacterium tuberculosis
LYDECDTLFG

SEQ ID NO: 35111 - protein, 10 aa, Mycobacterium tuberculosis
YDECDTLFGP

SEQ ID NO: 35112 - protein, 10 aa, Mycobacterium tuberculosis
DECDTLFGPK

SEQ ID NO: 35113 - protein, 10 aa, Mycobacterium tuberculosis
ECDTLFGPKA

SEQ ID NO: 35114 - protein, 10 aa, Mycobacterium tuberculosis
CDTLFGPKAK

SEQ ID NO: 35115 - protein, 10 aa, Mycobacterium tuberculosis
DTLFGPKAKE

SEQ ID NO: 35116 - protein, 10 aa, Mycobacterium tuberculosis
TLFGPKAKEH

SEQ ID NO: 35117 - protein, 10 aa, Mycobacterium tuberculosis
LFGPKAKEHE

SEQ ID NO: 35118 - protein, 10 aa, Mycobacterium tuberculosis
FGPKAKEHEE

SEQ ID NO: 35119 - protein, 10 aa, Mycobacterium tuberculosis
GPKAKEHEEI

SEQ ID NO: 35120 - protein, 10 aa, Mycobacterium tuberculosis
PKAKEHEEIR

SEQ ID NO: 35121 - protein, 10 aa, Mycobacterium tuberculosis
KAKEHEEIRG

SEQ ID NO: 35122 - protein, 10 aa, Mycobacterium tuberculosis
AKEHEEIRGV

SEQ ID NO: 35123 - protein, 10 aa, Mycobacterium tuberculosis
KEHEEIRGVI

SEQ ID NO: 35124 - protein, 10 aa, Mycobacterium tuberculosis
EHEEIRGVIN

SEQ ID NO: 35125 - protein, 10 aa, Mycobacterium tuberculosis
HEEIRGVINA

SEQ ID NO: 35126 - protein, 10 aa, Mycobacterium tuberculosis
EEIRGVINAG

SEQ ID NO: 35127 - protein, 10 aa, Mycobacterium tuberculosis
EIRGVINAGH

SEQ ID NO: 35128 - protein, 10 aa, Mycobacterium tuberculosis
IRGVINAGHR

SEQ ID NO: 35129 - protein, 10 aa, Mycobacterium tuberculosis
RGVINAGHRK

SEQ ID NO: 35130 - protein, 10 aa, Mycobacterium tuberculosis
GVINAGHRKG

SEQ ID NO: 35131 - protein, 10 aa, Mycobacterium tuberculosis
VINAGHRKGA

SEQ ID NO: 35132 - protein, 10 aa, Mycobacterium tuberculosis
INAGHRKGAV

SEQ ID NO: 35133 - protein, 10 aa, Mycobacterium tuberculosis
NAGHRKGAVA

SEQ ID NO: 35134 - protein, 10 aa, Mycobacterium tuberculosis
AGHRKGAVAG

SEQ ID NO: 35135 - protein, 10 aa, Mycobacterium tuberculosis
GHRKGAVAGR

SEQ ID NO: 35136 - protein, 10 aa, Mycobacterium tuberculosis
HRKGAVAGRC

SEQ ID NO: 35137 - protein, 10 aa, Mycobacterium tuberculosis
RKGAVAGRCV

SEQ ID NO: 35138 - protein, 10 aa, Mycobacterium tuberculosis
KGAVAGRCVI

SEQ ID NO: 35139 - protein, 10 aa, Mycobacterium tuberculosis
GAVAGRCVIR

SEQ ID NO: 35140 - protein, 10 aa, Mycobacterium tuberculosis
AVAGRCVIRG

SEQ ID NO: 35141 - protein, 10 aa, Mycobacterium tuberculosis
VAGRCVIRGK

SEQ ID NO: 35142 - protein, 10 aa, Mycobacterium tuberculosis
AGRCVIRGKI

SEQ ID NO: 35143 - protein, 10 aa, Mycobacterium tuberculosis
GRCVIRGKIV

SEQ ID NO: 35144 - protein, 10 aa, Mycobacterium tuberculosis
RCVIRGKIVE

SEQ ID NO: 35145 - protein, 10 aa, Mycobacterium tuberculosis
CVIRGKIVET

SEQ ID NO: 35146 - protein, 10 aa, Mycobacterium tuberculosis
VIRGKIVETE

SEQ ID NO: 35147 - protein, 10 aa, Mycobacterium tuberculosis
IRGKIVETEE

SEQ ID NO: 35148 - protein, 10 aa, Mycobacterium tuberculosis
RGKIVETEEL

SEQ ID NO: 35149 - protein, 10 aa, Mycobacterium tuberculosis
GKIVETEELP

SEQ ID NO: 35150 - protein, 10 aa, Mycobacterium tuberculosis
KIVETEELPA

SEQ ID NO: 35151 - protein, 10 aa, Mycobacterium tuberculosis
IVETEELPAY

SEQ ID NO: 35152 - protein, 10 aa, Mycobacterium tuberculosis
VETEELPAYC

SEQ ID NO: 35153 - protein, 10 aa, Mycobacterium tuberculosis
ETEELPAYCA

SEQ ID NO: 35154 - protein, 10 aa, Mycobacterium tuberculosis
TEELPAYCAV

SEQ ID NO: 35155 - protein, 10 aa, Mycobacterium tuberculosis
EELPAYCAVA

SEQ ID NO: 35156 - protein, 10 aa, Mycobacterium tuberculosis
ELPAYCAVAL

SEQ ID NO: 35157 - protein, 10 aa, Mycobacterium tuberculosis
LPAYCAVALA

SEQ ID NO: 35158 - protein, 10 aa, Mycobacterium tuberculosis
PAYCAVALAG

SEQ ID NO: 35159 - protein, 10 aa, Mycobacterium tuberculosis
AYCAVALAGL

SEQ ID NO: 35160 - protein, 10 aa, Mycobacterium tuberculosis
YCAVALAGLD

SEQ ID NO: 35161 - protein, 10 aa, Mycobacterium tuberculosis
CAVALAGLDD

SEQ ID NO: 35162 - protein, 10 aa, Mycobacterium tuberculosis
AVALAGLDDL

SEQ ID NO: 35163 - protein, 10 aa, Mycobacterium tuberculosis
VALAGLDDLP

SEQ ID NO: 35164 - protein, 10 aa, Mycobacterium tuberculosis
ALAGLDDLPD

SEQ ID NO: 35165 - protein, 10 aa, Mycobacterium tuberculosis
LAGLDDLPDT

SEQ ID NO: 35166 - protein, 10 aa, Mycobacterium tuberculosis
AGLDDLPDTI

SEQ ID NO: 35167 - protein, 10 aa, Mycobacterium tuberculosis
GLDDLPDTIM

SEQ ID NO: 35168 - protein, 10 aa, Mycobacterium tuberculosis
LDDLPDTIMS

SEQ ID NO: 35169 - protein, 10 aa, Mycobacterium tuberculosis
DDLPDTIMSR

SEQ ID NO: 35170 - protein, 10 aa, Mycobacterium tuberculosis
DLPDTIMSRS

SEQ ID NO: 35171 - protein, 10 aa, Mycobacterium tuberculosis
LPDTIMSRSI

SEQ ID NO: 35172 - protein, 10 aa, Mycobacterium tuberculosis
PDTIMSRSIV

SEQ ID NO: 35173 - protein, 10 aa, Mycobacterium tuberculosis
DTIMSRSIVV

SEQ ID NO: 35174 - protein, 10 aa, Mycobacterium tuberculosis
TIMSRSIVVR

SEQ ID NO: 35175 - protein, 10 aa, Mycobacterium tuberculosis
IMSRSIVVRM

SEQ ID NO: 35176 - protein, 10 aa, Mycobacterium tuberculosis
MSRSIVVRMR

SEQ ID NO: 35177 - protein, 10 aa, Mycobacterium tuberculosis
SRSIVVRMRR

SEQ ID NO: 35178 - protein, 10 aa, Mycobacterium tuberculosis
RSIVVRMRRR

SEQ ID NO: 35179 - protein, 10 aa, Mycobacterium tuberculosis
SIVVRMRRRA

SEQ ID NO: 35180 - protein, 10 aa, Mycobacterium tuberculosis
IVVRMRRRAP

SEQ ID NO: 35181 - protein, 10 aa, Mycobacterium tuberculosis
VVRMRRRAPT

SEQ ID NO: 35182 - protein, 10 aa, Mycobacterium tuberculosis
VRMRRRAPTE

SEQ ID NO: 35183 - protein, 10 aa, Mycobacterium tuberculosis
RMRRRAPTEP

SEQ ID NO: 35184 - protein, 10 aa, Mycobacterium tuberculosis
MRRRAPTEPV

SEQ ID NO: 35185 - protein, 10 aa, Mycobacterium tuberculosis
RRRAPTEPVE

SEQ ID NO: 35186 - protein, 10 aa, Mycobacterium tuberculosis
RRAPTEPVEP

SEQ ID NO: 35187 - protein, 10 aa, Mycobacterium tuberculosis
RAPTEPVEPW

SEQ ID NO: 35188 - protein, 10 aa, Mycobacterium tuberculosis
APTEPVEPWR

SEQ ID NO: 35189 - protein, 10 aa, Mycobacterium tuberculosis
PTEPVEPWRP

SEQ ID NO: 35190 - protein, 10 aa, Mycobacterium tuberculosis
TEPVEPWRPR

SEQ ID NO: 35191 - protein, 10 aa, Mycobacterium tuberculosis
EPVEPWRPRV

SEQ ID NO: 35192 - protein, 10 aa, Mycobacterium tuberculosis
PVEPWRPRVN

SEQ ID NO: 35193 - protein, 10 aa, Mycobacterium tuberculosis
VEPWRPRVNG

SEQ ID NO: 35194 - protein, 10 aa, Mycobacterium tuberculosis
EPWRPRVNGP

SEQ ID NO: 35195 - protein, 10 aa, Mycobacterium tuberculosis
PWRPRVNGPE

SEQ ID NO: 35196 - protein, 10 aa, Mycobacterium tuberculosis
WRPRVNGPEA

SEQ ID NO: 35197 - protein, 10 aa, Mycobacterium tuberculosis
RPRVNGPEAE

SEQ ID NO: 35198 - protein, 10 aa, Mycobacterium tuberculosis
PRVNGPEAEK

SEQ ID NO: 35199 - protein, 10 aa, Mycobacterium tuberculosis
RVNGPEAEKL

SEQ ID NO: 35200 - protein, 10 aa, Mycobacterium tuberculosis
VNGPEAEKLH

SEQ ID NO: 35201 - protein, 10 aa, Mycobacterium tuberculosis
NGPEAEKLHD

SEQ ID NO: 35202 - protein, 10 aa, Mycobacterium tuberculosis
GPEAEKLHDR

SEQ ID NO: 35203 - protein, 10 aa, Mycobacterium tuberculosis
PEAEKLHDRL

SEQ ID NO: 35204 - protein, 10 aa, Mycobacterium tuberculosis
EAEKLHDRLA

SEQ ID NO: 35205 - protein, 10 aa, Mycobacterium tuberculosis
AEKLHDRLAN

SEQ ID NO: 35206 - protein, 10 aa, Mycobacterium tuberculosis
EKLHDRLANW

SEQ ID NO: 35207 - protein, 10 aa, Mycobacterium tuberculosis
KLHDRLANWA

SEQ ID NO: 35208 - protein, 10 aa, Mycobacterium tuberculosis
LHDRLANWAA

SEQ ID NO: 35209 - protein, 10 aa, Mycobacterium tuberculosis
HDRLANWAAA

SEQ ID NO: 35210 - protein, 10 aa, Mycobacterium tuberculosis
DRLANWAAAI

SEQ ID NO: 35211 - protein, 10 aa, Mycobacterium tuberculosis
RLANWAAAIN

SEQ ID NO: 35212 - protein, 10 aa, Mycobacterium tuberculosis
LANWAAAINP

SEQ ID NO: 35213 - protein, 10 aa, Mycobacterium tuberculosis
ANWAAAINPL

SEQ ID NO: 35214 - protein, 10 aa, Mycobacterium tuberculosis
NWAAAINPLE

SEQ ID NO: 35215 - protein, 10 aa, Mycobacterium tuberculosis
WAAAINPLES

SEQ ID NO: 35216 - protein, 10 aa, Mycobacterium tuberculosis
AAAINPLESG

SEQ ID NO: 35217 - protein, 10 aa, Mycobacterium tuberculosis
AAINPLESGW

SEQ ID NO: 35218 - protein, 10 aa, Mycobacterium tuberculosis
AINPLESGWP

SEQ ID NO: 35219 - protein, 10 aa, Mycobacterium tuberculosis
INPLESGWPA

SEQ ID NO: 35220 - protein, 10 aa, Mycobacterium tuberculosis
NPLESGWPAM

SEQ ID NO: 35221 - protein, 10 aa, Mycobacterium tuberculosis
PLESGWPAMP

SEQ ID NO: 35222 - protein, 10 aa, Mycobacterium tuberculosis
LESGWPAMPD

SEQ ID NO: 35223 - protein, 10 aa, Mycobacterium tuberculosis
ESGWPAMPDG

SEQ ID NO: 35224 - protein, 10 aa, Mycobacterium tuberculosis
SGWPAMPDGV

SEQ ID NO: 35225 - protein, 10 aa, Mycobacterium tuberculosis
GWPAMPDGVT

SEQ ID NO: 35226 - protein, 10 aa, Mycobacterium tuberculosis
WPAMPDGVTD

SEQ ID NO: 35227 - protein, 10 aa, Mycobacterium tuberculosis
PAMPDGVTDR

SEQ ID NO: 35228 - protein, 10 aa, Mycobacterium tuberculosis
AMPDGVTDRR

SEQ ID NO: 35229 - protein, 10 aa, Mycobacterium tuberculosis
MPDGVTDRRA

SEQ ID NO: 35230 - protein, 10 aa, Mycobacterium tuberculosis
PDGVTDRRAD

SEQ ID NO: 35231 - protein, 10 aa, Mycobacterium tuberculosis
DGVTDRRADV

SEQ ID NO: 35232 - protein, 10 aa, Mycobacterium tuberculosis
GVTDRRADVW

SEQ ID NO: 35233 - protein, 10 aa, Mycobacterium tuberculosis
VTDRRADVWE

SEQ ID NO: 35234 - protein, 10 aa, Mycobacterium tuberculosis
TDRRADVWES

SEQ ID NO: 35235 - protein, 10 aa, Mycobacterium tuberculosis
DRRADVWESL

SEQ ID NO: 35236 - protein, 10 aa, Mycobacterium tuberculosis
RRADVWESLV

SEQ ID NO: 35237 - protein, 10 aa, Mycobacterium tuberculosis
RADVWESLVA

SEQ ID NO: 35238 - protein, 10 aa, Mycobacterium tuberculosis
ADVWESLVAV

SEQ ID NO: 35239 - protein, 10 aa, Mycobacterium tuberculosis
DVWESLVAVA

SEQ ID NO: 35240 - protein, 10 aa, Mycobacterium tuberculosis
VWESLVAVAD

SEQ ID NO: 35241 - protein, 10 aa, Mycobacterium tuberculosis
WESLVAVADT

SEQ ID NO: 35242 - protein, 10 aa, Mycobacterium tuberculosis
ESLVAVADTA

SEQ ID NO: 35243 - protein, 10 aa, Mycobacterium tuberculosis
SLVAVADTAG

SEQ ID NO: 35244 - protein, 10 aa, Mycobacterium tuberculosis
LVAVADTAGG

SEQ ID NO: 35245 - protein, 10 aa, Mycobacterium tuberculosis
VAVADTAGGH

SEQ ID NO: 35246 - protein, 10 aa, Mycobacterium tuberculosis
AVADTAGGHW

SEQ ID NO: 35247 - protein, 10 aa, Mycobacterium tuberculosis
VADTAGGHWP

SEQ ID NO: 35248 - protein, 10 aa, Mycobacterium tuberculosis
ADTAGGHWPK

SEQ ID NO: 35249 - protein, 10 aa, Mycobacterium tuberculosis
DTAGGHWPKT

SEQ ID NO: 35250 - protein, 10 aa, Mycobacterium tuberculosis
TAGGHWPKTA

SEQ ID NO: 35251 - protein, 10 aa, Mycobacterium tuberculosis
AGGHWPKTAR

SEQ ID NO: 35252 - protein, 10 aa, Mycobacterium tuberculosis
GGHWPKTARA

SEQ ID NO: 35253 - protein, 10 aa, Mycobacterium tuberculosis
GHWPKTARAT

SEQ ID NO: 35254 - protein, 10 aa, Mycobacterium tuberculosis
HWPKTARATA

SEQ ID NO: 35255 - protein, 10 aa, Mycobacterium tuberculosis
WPKTARATAE

SEQ ID NO: 35256 - protein, 10 aa, Mycobacterium tuberculosis
PKTARATAET

SEQ ID NO: 35257 - protein, 10 aa, Mycobacterium tuberculosis
KTARATAETD

SEQ ID NO: 35258 - protein, 10 aa, Mycobacterium tuberculosis
TARATAETDA

SEQ ID NO: 35259 - protein, 10 aa, Mycobacterium tuberculosis
ARATAETDAT

SEQ ID NO: 35260 - protein, 10 aa, Mycobacterium tuberculosis
RATAETDATA

SEQ ID NO: 35261 - protein, 10 aa, Mycobacterium tuberculosis
ATAETDATAN

SEQ ID NO: 35262 - protein, 10 aa, Mycobacterium tuberculosis
TAETDATANR

SEQ ID NO: 35263 - protein, 10 aa, Mycobacterium tuberculosis
AETDATANRG

SEQ ID NO: 35264 - protein, 10 aa, Mycobacterium tuberculosis
ETDATANRGA

SEQ ID NO: 35265 - protein, 10 aa, Mycobacterium tuberculosis
TDATANRGAK

SEQ ID NO: 35266 - protein, 10 aa, Mycobacterium tuberculosis
DATANRGAKP

SEQ ID NO: 35267 - protein, 10 aa, Mycobacterium tuberculosis
ATANRGAKPS

SEQ ID NO: 35268 - protein, 10 aa, Mycobacterium tuberculosis
TANRGAKPSI

SEQ ID NO: 35269 - protein, 10 aa, Mycobacterium tuberculosis
ANRGAKPSIG

SEQ ID NO: 35270 - protein, 10 aa, Mycobacterium tuberculosis
NRGAKPSIGV

SEQ ID NO: 35271 - protein, 10 aa, Mycobacterium tuberculosis
RGAKPSIGVL

SEQ ID NO: 35272 - protein, 10 aa, Mycobacterium tuberculosis
GAKPSIGVLL

SEQ ID NO: 35273 - protein, 10 aa, Mycobacterium tuberculosis
AKPSIGVLLL

SEQ ID NO: 35274 - protein, 10 aa, Mycobacterium tuberculosis
KPSIGVLLLR

SEQ ID NO: 35275 - protein, 10 aa, Mycobacterium tuberculosis
PSIGVLLLRD

SEQ ID NO: 35276 - protein, 10 aa, Mycobacterium tuberculosis
SIGVLLLRDI

SEQ ID NO: 35277 - protein, 10 aa, Mycobacterium tuberculosis
IGVLLLRDIR

SEQ ID NO: 35278 - protein, 10 aa, Mycobacterium tuberculosis
GVLLLRDIRR

SEQ ID NO: 35279 - protein, 10 aa, Mycobacterium tuberculosis
VLLLRDIRRV

SEQ ID NO: 35280 - protein, 10 aa, Mycobacterium tuberculosis
LLLRDIRRVF

SEQ ID NO: 35281 - protein, 10 aa, Mycobacterium tuberculosis
LLRDIRRVFS

SEQ ID NO: 35282 - protein, 10 aa, Mycobacterium tuberculosis
LRDIRRVFSD

SEQ ID NO: 35283 - protein, 10 aa, Mycobacterium tuberculosis
RDIRRVFSDR

SEQ ID NO: 35284 - protein, 10 aa, Mycobacterium tuberculosis
DIRRVFSDRD

SEQ ID NO: 35285 - protein, 10 aa, Mycobacterium tuberculosis
IRRVFSDRDR

SEQ ID NO: 35286 - protein, 10 aa, Mycobacterium tuberculosis
RRVFSDRDRM

SEQ ID NO: 35287 - protein, 10 aa, Mycobacterium tuberculosis
RVFSDRDRMR

SEQ ID NO: 35288 - protein, 10 aa, Mycobacterium tuberculosis
VFSDRDRMRT

SEQ ID NO: 35289 - protein, 10 aa, Mycobacterium tuberculosis
FSDRDRMRTS

SEQ ID NO: 35290 - protein, 10 aa, Mycobacterium tuberculosis
SDRDRMRTSD

SEQ ID NO: 35291 - protein, 10 aa, Mycobacterium tuberculosis
DRDRMRTSDI

SEQ ID NO: 35292 - protein, 10 aa, Mycobacterium tuberculosis
RDRMRTSDIL

SEQ ID NO: 35293 - protein, 10 aa, Mycobacterium tuberculosis
DRMRTSDILT

SEQ ID NO: 35294 - protein, 10 aa, Mycobacterium tuberculosis
RMRTSDILTG

SEQ ID NO: 35295 - protein, 10 aa, Mycobacterium tuberculosis
MRTSDILTGL

SEQ ID NO: 35296 - protein, 10 aa, Mycobacterium tuberculosis
RTSDILTGLN

SEQ ID NO: 35297 - protein, 10 aa, Mycobacterium tuberculosis
TSDILTGLNR

SEQ ID NO: 35298 - protein, 10 aa, Mycobacterium tuberculosis
SDILTGLNRM

SEQ ID NO: 35299 - protein, 10 aa, Mycobacterium tuberculosis
DILTGLNRME

SEQ ID NO: 35300 - protein, 10 aa, Mycobacterium tuberculosis
ILTGLNRMEE

SEQ ID NO: 35301 - protein, 10 aa, Mycobacterium tuberculosis
LTGLNRMEEG

SEQ ID NO: 35302 - protein, 10 aa, Mycobacterium tuberculosis
TGLNRMEEGP

SEQ ID NO: 35303 - protein, 10 aa, Mycobacterium tuberculosis
GLNRMEEGPW

SEQ ID NO: 35304 - protein, 10 aa, Mycobacterium tuberculosis
LNRMEEGPWG

SEQ ID NO: 35305 - protein, 10 aa, Mycobacterium tuberculosis
NRMEEGPWGS

SEQ ID NO: 35306 - protein, 10 aa, Mycobacterium tuberculosis
RMEEGPWGSI

SEQ ID NO: 35307 - protein, 10 aa, Mycobacterium tuberculosis
MEEGPWGSIR

SEQ ID NO: 35308 - protein, 10 aa, Mycobacterium tuberculosis
EEGPWGSIRR

SEQ ID NO: 35309 - protein, 10 aa, Mycobacterium tuberculosis
EGPWGSIRRG

SEQ ID NO: 35310 - protein, 10 aa, Mycobacterium tuberculosis
GPWGSIRRGD

SEQ ID NO: 35311 - protein, 10 aa, Mycobacterium tuberculosis
PWGSIRRGDP

SEQ ID NO: 35312 - protein, 10 aa, Mycobacterium tuberculosis
WGSIRRGDPL

SEQ ID NO: 35313 - protein, 10 aa, Mycobacterium tuberculosis
GSIRRGDPLD

SEQ ID NO: 35314 - protein, 10 aa, Mycobacterium tuberculosis
SIRRGDPLDA

SEQ ID NO: 35315 - protein, 10 aa, Mycobacterium tuberculosis
IRRGDPLDAR

SEQ ID NO: 35316 - protein, 10 aa, Mycobacterium tuberculosis
RRGDPLDARG

SEQ ID NO: 35317 - protein, 10 aa, Mycobacterium tuberculosis
RGDPLDARGL

SEQ ID NO: 35318 - protein, 10 aa, Mycobacterium tuberculosis
GDPLDARGLA

SEQ ID NO: 35319 - protein, 10 aa, Mycobacterium tuberculosis
DPLDARGLAT

SEQ ID NO: 35320 - protein, 10 aa, Mycobacterium tuberculosis
PLDARGLATR

SEQ ID NO: 35321 - protein, 10 aa, Mycobacterium tuberculosis
LDARGLATRL

SEQ ID NO: 35322 - protein, 10 aa, Mycobacterium tuberculosis
DARGLATRLG

SEQ ID NO: 35323 - protein, 10 aa, Mycobacterium tuberculosis
ARGLATRLGR

SEQ ID NO: 35324 - protein, 10 aa, Mycobacterium tuberculosis
RGLATRLGRY

SEQ ID NO: 35325 - protein, 10 aa, Mycobacterium tuberculosis
GLATRLGRYG

SEQ ID NO: 35326 - protein, 10 aa, Mycobacterium tuberculosis
LATRLGRYGI

SEQ ID NO: 35327 - protein, 10 aa, Mycobacterium tuberculosis
ATRLGRYGIG

SEQ ID NO: 35328 - protein, 10 aa, Mycobacterium tuberculosis
TRLGRYGIGP

SEQ ID NO: 35329 - protein, 10 aa, Mycobacterium tuberculosis
RLGRYGIGPK

SEQ ID NO: 35330 - protein, 10 aa, Mycobacterium tuberculosis
LGRYGIGPKF

SEQ ID NO: 35331 - protein, 10 aa, Mycobacterium tuberculosis
GRYGIGPKFQ

SEQ ID NO: 35332 - protein, 10 aa, Mycobacterium tuberculosis
RYGIGPKFQH

SEQ ID NO: 35333 - protein, 10 aa, Mycobacterium tuberculosis
YGIGPKFQHS

SEQ ID NO: 35334 - protein, 10 aa, Mycobacterium tuberculosis
GIGPKFQHSG

SEQ ID NO: 35335 - protein, 10 aa, Mycobacterium tuberculosis
IGPKFQHSGG

SEQ ID NO: 35336 - protein, 10 aa, Mycobacterium tuberculosis
GPKFQHSGGE

SEQ ID NO: 35337 - protein, 10 aa, Mycobacterium tuberculosis
PKFQHSGGEP

SEQ ID NO: 35338 - protein, 10 aa, Mycobacterium tuberculosis
KFQHSGGEPP

SEQ ID NO: 35339 - protein, 10 aa, Mycobacterium tuberculosis
FQHSGGEPPY

SEQ ID NO: 35340 - protein, 10 aa, Mycobacterium tuberculosis
QHSGGEPPYK

SEQ ID NO: 35341 - protein, 10 aa, Mycobacterium tuberculosis
HSGGEPPYKG

SEQ ID NO: 35342 - protein, 10 aa, Mycobacterium tuberculosis
SGGEPPYKGY

SEQ ID NO: 35343 - protein, 10 aa, Mycobacterium tuberculosis
GGEPPYKGYS

SEQ ID NO: 35344 - protein, 10 aa, Mycobacterium tuberculosis
GEPPYKGYSR

SEQ ID NO: 35345 - protein, 10 aa, Mycobacterium tuberculosis
EPPYKGYSRT

SEQ ID NO: 35346 - protein, 10 aa, Mycobacterium tuberculosis
PPYKGYSRTQ

SEQ ID NO: 35347 - protein, 10 aa, Mycobacterium tuberculosis
PYKGYSRTQF

SEQ ID NO: 35348 - protein, 10 aa, Mycobacterium tuberculosis
YKGYSRTQFE

SEQ ID NO: 35349 - protein, 10 aa, Mycobacterium tuberculosis
KGYSRTQFED

SEQ ID NO: 35350 - protein, 10 aa, Mycobacterium tuberculosis
GYSRTQFEDA

SEQ ID NO: 35351 - protein, 10 aa, Mycobacterium tuberculosis
YSRTQFEDAW

SEQ ID NO: 35352 - protein, 10 aa, Mycobacterium tuberculosis
SRTQFEDAWS

SEQ ID NO: 35353 - protein, 10 aa, Mycobacterium tuberculosis
RTQFEDAWSR

SEQ ID NO: 35354 - protein, 10 aa, Mycobacterium tuberculosis
TQFEDAWSRY

SEQ ID NO: 35355 - protein, 10 aa, Mycobacterium tuberculosis
QFEDAWSRYL

SEQ ID NO: 35356 - protein, 10 aa, Mycobacterium tuberculosis
FEDAWSRYLS

SEQ ID NO: 35357 - protein, 10 aa, Mycobacterium tuberculosis
EDAWSRYLSA

SEQ ID NO: 35358 - protein, 10 aa, Mycobacterium tuberculosis
DAWSRYLSAD

SEQ ID NO: 35359 - protein, 10 aa, Mycobacterium tuberculosis
AWSRYLSADD

SEQ ID NO: 35360 - protein, 10 aa, Mycobacterium tuberculosis
WSRYLSADDE

SEQ ID NO: 35361 - protein, 10 aa, Mycobacterium tuberculosis
SRYLSADDET

SEQ ID NO: 35362 - protein, 10 aa, Mycobacterium tuberculosis
RYLSADDETP

SEQ ID NO: 35363 - protein, 10 aa, Mycobacterium tuberculosis
YLSADDETPE

SEQ ID NO: 35364 - protein, 10 aa, Mycobacterium tuberculosis
LSADDETPEE

SEQ ID NO: 35365 - protein, 10 aa, Mycobacterium tuberculosis
SADDETPEER

SEQ ID NO: 35366 - protein, 10 aa, Mycobacterium tuberculosis
ADDETPEERD

SEQ ID NO: 35367 - protein, 10 aa, Mycobacterium tuberculosis
DDETPEERDL

SEQ ID NO: 35368 - protein, 10 aa, Mycobacterium tuberculosis
DETPEERDLS

SEQ ID NO: 35369 - protein, 10 aa, Mycobacterium tuberculosis
ETPEERDLSV

SEQ ID NO: 35370 - protein, 10 aa, Mycobacterium tuberculosis
TPEERDLSVS

SEQ ID NO: 35371 - protein, 10 aa, Mycobacterium tuberculosis
PEERDLSVSA

SEQ ID NO: 35372 - protein, 10 aa, Mycobacterium tuberculosis
EERDLSVSAV

SEQ ID NO: 35373 - protein, 10 aa, Mycobacterium tuberculosis
ERDLSVSAVS

SEQ ID NO: 35374 - protein, 10 aa, Mycobacterium tuberculosis
RDLSVSAVSA

SEQ ID NO: 35375 - protein, 10 aa, Mycobacterium tuberculosis
DLSVSAVSAV

SEQ ID NO: 35376 - protein, 10 aa, Mycobacterium tuberculosis
LSVSAVSAVS

SEQ ID NO: 35377 - protein, 10 aa, Mycobacterium tuberculosis
SVSAVSAVSP

SEQ ID NO: 35378 - protein, 10 aa, Mycobacterium tuberculosis
VSAVSAVSPP

SEQ ID NO: 35379 - protein, 10 aa, Mycobacterium tuberculosis
SAVSAVSPPV

SEQ ID NO: 35380 - protein, 10 aa, Mycobacterium tuberculosis
AVSAVSPPVG

SEQ ID NO: 35381 - protein, 10 aa, Mycobacterium tuberculosis
VSAVSPPVGD

SEQ ID NO: 35382 - protein, 10 aa, Mycobacterium tuberculosis
SAVSPPVGDP

SEQ ID NO: 35383 - protein, 10 aa, Mycobacterium tuberculosis
AVSPPVGDPG

SEQ ID NO: 35384 - protein, 10 aa, Mycobacterium tuberculosis
VSPPVGDPGD

SEQ ID NO: 35385 - protein, 10 aa, Mycobacterium tuberculosis
SPPVGDPGDA

SEQ ID NO: 35386 - protein, 10 aa, Mycobacterium tuberculosis
PPVGDPGDAT

SEQ ID NO: 35387 - protein, 10 aa, Mycobacterium tuberculosis
PVGDPGDATG

SEQ ID NO: 35388 - protein, 10 aa, Mycobacterium tuberculosis
VGDPGDATGA

SEQ ID NO: 35389 - protein, 10 aa, Mycobacterium tuberculosis
GDPGDATGAT

SEQ ID NO: 35390 - protein, 10 aa, Mycobacterium tuberculosis
DPGDATGATD

SEQ ID NO: 35391 - protein, 10 aa, Mycobacterium tuberculosis
PGDATGATDA

SEQ ID NO: 35392 - protein, 10 aa, Mycobacterium tuberculosis
GDATGATDAT

SEQ ID NO: 35393 - protein, 10 aa, Mycobacterium tuberculosis
DATGATDATD

SEQ ID NO: 35394 - protein, 10 aa, Mycobacterium tuberculosis
ATGATDATDL

SEQ ID NO: 35395 - protein, 10 aa, Mycobacterium tuberculosis
TGATDATDLP

SEQ ID NO: 35396 - protein, 10 aa, Mycobacterium tuberculosis
GATDATDLPE

SEQ ID NO: 35397 - protein, 10 aa, Mycobacterium tuberculosis
ATDATDLPEA

SEQ ID NO: 35398 - protein, 10 aa, Mycobacterium tuberculosis
TDATDLPEAG

SEQ ID NO: 35399 - protein, 10 aa, Mycobacterium tuberculosis
DATDLPEAGD

SEQ ID NO: 35400 - protein, 10 aa, Mycobacterium tuberculosis
ATDLPEAGDL

SEQ ID NO: 35401 - protein, 10 aa, Mycobacterium tuberculosis
TDLPEAGDLP

SEQ ID NO: 35402 - protein, 10 aa, Mycobacterium tuberculosis
DLPEAGDLPY

SEQ ID NO: 35403 - protein, 10 aa, Mycobacterium tuberculosis
LPEAGDLPYE

SEQ ID NO: 35404 - protein, 10 aa, Mycobacterium tuberculosis
PEAGDLPYEP

SEQ ID NO: 35405 - protein, 10 aa, Mycobacterium tuberculosis
EAGDLPYEPP

SEQ ID NO: 35406 - protein, 10 aa, Mycobacterium tuberculosis
AGDLPYEPPA

SEQ ID NO: 35407 - protein, 10 aa, Mycobacterium tuberculosis
GDLPYEPPAP

SEQ ID NO: 35408 - protein, 10 aa, Mycobacterium tuberculosis
DLPYEPPAPN

SEQ ID NO: 35409 - protein, 10 aa, Mycobacterium tuberculosis
LPYEPPAPNG

SEQ ID NO: 35410 - protein, 10 aa, Mycobacterium tuberculosis
PYEPPAPNGH

SEQ ID NO: 35411 - protein, 10 aa, Mycobacterium tuberculosis
YEPPAPNGHP

SEQ ID NO: 35412 - protein, 10 aa, Mycobacterium tuberculosis
EPPAPNGHPN

SEQ ID NO: 35413 - protein, 10 aa, Mycobacterium tuberculosis
PPAPNGHPNG

SEQ ID NO: 35414 - protein, 10 aa, Mycobacterium tuberculosis
PAPNGHPNGD

SEQ ID NO: 35415 - protein, 10 aa, Mycobacterium tuberculosis
APNGHPNGDA

SEQ ID NO: 35416 - protein, 10 aa, Mycobacterium tuberculosis
PNGHPNGDAP

SEQ ID NO: 35417 - protein, 10 aa, Mycobacterium tuberculosis
NGHPNGDAPL

SEQ ID NO: 35418 - protein, 10 aa, Mycobacterium tuberculosis
GHPNGDAPLC

SEQ ID NO: 35419 - protein, 10 aa, Mycobacterium tuberculosis
HPNGDAPLCS

SEQ ID NO: 35420 - protein, 10 aa, Mycobacterium tuberculosis
PNGDAPLCSG

SEQ ID NO: 35421 - protein, 10 aa, Mycobacterium tuberculosis
NGDAPLCSGP

SEQ ID NO: 35422 - protein, 10 aa, Mycobacterium tuberculosis
GDAPLCSGPG

SEQ ID NO: 35423 - protein, 10 aa, Mycobacterium tuberculosis
DAPLCSGPGC

SEQ ID NO: 35424 - protein, 10 aa, Mycobacterium tuberculosis
APLCSGPGCP

SEQ ID NO: 35425 - protein, 10 aa, Mycobacterium tuberculosis
PLCSGPGCPN

SEQ ID NO: 35426 - protein, 10 aa, Mycobacterium tuberculosis
LCSGPGCPNK

SEQ ID NO: 35427 - protein, 10 aa, Mycobacterium tuberculosis
CSGPGCPNKL

SEQ ID NO: 35428 - protein, 10 aa, Mycobacterium tuberculosis
SGPGCPNKLL

SEQ ID NO: 35429 - protein, 10 aa, Mycobacterium tuberculosis
GPGCPNKLLS

SEQ ID NO: 35430 - protein, 10 aa, Mycobacterium tuberculosis
PGCPNKLLST

SEQ ID NO: 35431 - protein, 10 aa, Mycobacterium tuberculosis
GCPNKLLSTE

SEQ ID NO: 35432 - protein, 10 aa, Mycobacterium tuberculosis
CPNKLLSTEA

SEQ ID NO: 35433 - protein, 10 aa, Mycobacterium tuberculosis
PNKLLSTEAK

SEQ ID NO: 35434 - protein, 10 aa, Mycobacterium tuberculosis
NKLLSTEAKA

SEQ ID NO: 35435 - protein, 10 aa, Mycobacterium tuberculosis
KLLSTEAKAA

SEQ ID NO: 35436 - protein, 10 aa, Mycobacterium tuberculosis
LLSTEAKAAG

SEQ ID NO: 35437 - protein, 10 aa, Mycobacterium tuberculosis
LSTEAKAAGK

SEQ ID NO: 35438 - protein, 10 aa, Mycobacterium tuberculosis
STEAKAAGKC

SEQ ID NO: 35439 - protein, 10 aa, Mycobacterium tuberculosis
TEAKAAGKCR

SEQ ID NO: 35440 - protein, 10 aa, Mycobacterium tuberculosis
EAKAAGKCRP

SEQ ID NO: 35441 - protein, 10 aa, Mycobacterium tuberculosis
AKAAGKCRPC

SEQ ID NO: 35442 - protein, 10 aa, Mycobacterium tuberculosis
KAAGKCRPCR

SEQ ID NO: 35443 - protein, 10 aa, Mycobacterium tuberculosis
AAGKCRPCRG

SEQ ID NO: 35444 - protein, 10 aa, Mycobacterium tuberculosis
AGKCRPCRGR

SEQ ID NO: 35445 - protein, 10 aa, Mycobacterium tuberculosis
GKCRPCRGRA

SEQ ID NO: 35446 - protein, 10 aa, Mycobacterium tuberculosis
KCRPCRGRAA

SEQ ID NO: 35447 - protein, 10 aa, Mycobacterium tuberculosis
CRPCRGRAAA

SEQ ID NO: 35448 - protein, 10 aa, Mycobacterium tuberculosis
RPCRGRAAAS

SEQ ID NO: 35449 - protein, 10 aa, Mycobacterium tuberculosis
PCRGRAAASA

SEQ ID NO: 35450 - protein, 10 aa, Mycobacterium tuberculosis
CRGRAAASAR

SEQ ID NO: 35451 - protein, 10 aa, Mycobacterium tuberculosis
RGRAAASARD

SEQ ID NO: 35452 - protein, 10 aa, Mycobacterium tuberculosis
GRAAASARDG

SEQ ID NO: 35453 - protein, 10 aa, Mycobacterium tuberculosis
RAAASARDGA

SEQ ID NO: 35454 - protein, 10 aa, Mycobacterium tuberculosis
AAASARDGAR

SEQ ID NO: 35455 - protein, 11 aa, Mycobacterium tuberculosis
MADIPYGRDYP

SEQ ID NO: 35456 - protein, 11 aa, Mycobacterium tuberculosis
ADIPYGRDYPD

SEQ ID NO: 35457 - protein, 11 aa, Mycobacterium tuberculosis
DIPYGRDYPDP

SEQ ID NO: 35458 - protein, 11 aa, Mycobacterium tuberculosis
IPYGRDYPDPI

SEQ ID NO: 35459 - protein, 11 aa, Mycobacterium tuberculosis
PYGRDYPDPIW

SEQ ID NO: 35460 - protein, 11 aa, Mycobacterium tuberculosis
YGRDYPDPIWC

SEQ ID NO: 35461 - protein, 11 aa, Mycobacterium tuberculosis
GRDYPDPIWCD

SEQ ID NO: 35462 - protein, 11 aa, Mycobacterium tuberculosis
RDYPDPIWCDE

SEQ ID NO: 35463 - protein, 11 aa, Mycobacterium tuberculosis
DYPDPIWCDED

SEQ ID NO: 35464 - protein, 11 aa, Mycobacterium tuberculosis
YPDPIWCDEDG

SEQ ID NO: 35465 - protein, 11 aa, Mycobacterium tuberculosis
PDPIWCDEDGQ

SEQ ID NO: 35466 - protein, 11 aa, Mycobacterium tuberculosis
DPIWCDEDGQP

SEQ ID NO: 35467 - protein, 11 aa, Mycobacterium tuberculosis
PIWCDEDGQPM

SEQ ID NO: 35468 - protein, 11 aa, Mycobacterium tuberculosis
IWCDEDGQPMP

SEQ ID NO: 35469 - protein, 11 aa, Mycobacterium tuberculosis
WCDEDGQPMPP

SEQ ID NO: 35470 - protein, 11 aa, Mycobacterium tuberculosis
CDEDGQPMPPV

SEQ ID NO: 35471 - protein, 11 aa, Mycobacterium tuberculosis
DEDGQPMPPVG

SEQ ID NO: 35472 - protein, 11 aa, Mycobacterium tuberculosis
EDGQPMPPVGA

SEQ ID NO: 35473 - protein, 11 aa, Mycobacterium tuberculosis
DGQPMPPVGAE

SEQ ID NO: 35474 - protein, 11 aa, Mycobacterium tuberculosis
GQPMPPVGAEL

SEQ ID NO: 35475 - protein, 11 aa, Mycobacterium tuberculosis
QPMPPVGAELL

SEQ ID NO: 35476 - protein, 11 aa, Mycobacterium tuberculosis
PMPPVGAELLD

SEQ ID NO: 35477 - protein, 11 aa, Mycobacterium tuberculosis
MPPVGAELLDD

SEQ ID NO: 35478 - protein, 11 aa, Mycobacterium tuberculosis
PPVGAELLDDI

SEQ ID NO: 35479 - protein, 11 aa, Mycobacterium tuberculosis
PVGAELLDDIR

SEQ ID NO: 35480 - protein, 11 aa, Mycobacterium tuberculosis
VGAELLDDIRA

SEQ ID NO: 35481 - protein, 11 aa, Mycobacterium tuberculosis
GAELLDDIRAF

SEQ ID NO: 35482 - protein, 11 aa, Mycobacterium tuberculosis
AELLDDIRAFL

SEQ ID NO: 35483 - protein, 11 aa, Mycobacterium tuberculosis
ELLDDIRAFLR

SEQ ID NO: 35484 - protein, 11 aa, Mycobacterium tuberculosis
LLDDIRAFLRR

SEQ ID NO: 35485 - protein, 11 aa, Mycobacterium tuberculosis
LDDIRAFLRRF

SEQ ID NO: 35486 - protein, 11 aa, Mycobacterium tuberculosis
DDIRAFLRRFV

SEQ ID NO: 35487 - protein, 11 aa, Mycobacterium tuberculosis
DIRAFLRRFVV

SEQ ID NO: 35488 - protein, 11 aa, Mycobacterium tuberculosis
IRAFLRRFVVY

SEQ ID NO: 35489 - protein, 11 aa, Mycobacterium tuberculosis
RAFLRRFVVYP

SEQ ID NO: 35490 - protein, 11 aa, Mycobacterium tuberculosis
AFLRRFVVYPS

SEQ ID NO: 35491 - protein, 11 aa, Mycobacterium tuberculosis
FLRRFVVYPSD

SEQ ID NO: 35492 - protein, 11 aa, Mycobacterium tuberculosis
LRRFVVYPSDH

SEQ ID NO: 35493 - protein, 11 aa, Mycobacterium tuberculosis
RRFVVYPSDHE

SEQ ID NO: 35494 - protein, 11 aa, Mycobacterium tuberculosis
RFVVYPSDHEL

SEQ ID NO: 35495 - protein, 11 aa, Mycobacterium tuberculosis
FVVYPSDHELI

SEQ ID NO: 35496 - protein, 11 aa, Mycobacterium tuberculosis
VVYPSDHELIA

SEQ ID NO: 35497 - protein, 11 aa, Mycobacterium tuberculosis
VYPSDHELIAH

SEQ ID NO: 35498 - protein, 11 aa, Mycobacterium tuberculosis
YPSDHELIAHT

SEQ ID NO: 35499 - protein, 11 aa, Mycobacterium tuberculosis
PSDHELIAHTL

SEQ ID NO: 35500 - protein, 11 aa, Mycobacterium tuberculosis
SDHELIAHTLW

SEQ ID NO: 35501 - protein, 11 aa, Mycobacterium tuberculosis
DHELIAHTLWI

SEQ ID NO: 35502 - protein, 11 aa, Mycobacterium tuberculosis
HELIAHTLWIA

SEQ ID NO: 35503 - protein, 11 aa, Mycobacterium tuberculosis
ELIAHTLWIAH

SEQ ID NO: 35504 - protein, 11 aa, Mycobacterium tuberculosis
LIAHTLWIAHC

SEQ ID NO: 35505 - protein, 11 aa, Mycobacterium tuberculosis
IAHTLWIAHCW

SEQ ID NO: 35506 - protein, 11 aa, Mycobacterium tuberculosis
AHTLWIAHCWF

SEQ ID NO: 35507 - protein, 11 aa, Mycobacterium tuberculosis
HTLWIAHCWFM

SEQ ID NO: 35508 - protein, 11 aa, Mycobacterium tuberculosis
TLWIAHCWFME

SEQ ID NO: 35509 - protein, 11 aa, Mycobacterium tuberculosis
LWIAHCWFMEA

SEQ ID NO: 35510 - protein, 11 aa, Mycobacterium tuberculosis
WIAHCWFMEAW

SEQ ID NO: 35511 - protein, 11 aa, Mycobacterium tuberculosis
IAHCWFMEAWD

SEQ ID NO: 35512 - protein, 11 aa, Mycobacterium tuberculosis
AHCWFMEAWDS

SEQ ID NO: 35513 - protein, 11 aa, Mycobacterium tuberculosis
HCWFMEAWDST

SEQ ID NO: 35514 - protein, 11 aa, Mycobacterium tuberculosis
CWFMEAWDSTP

SEQ ID NO: 35515 - protein, 11 aa, Mycobacterium tuberculosis
WFMEAWDSTPR

SEQ ID NO: 35516 - protein, 11 aa, Mycobacterium tuberculosis
FMEAWDSTPRI

SEQ ID NO: 35517 - protein, 11 aa, Mycobacterium tuberculosis
MEAWDSTPRIA

SEQ ID NO: 35518 - protein, 11 aa, Mycobacterium tuberculosis
EAWDSTPRIAF

SEQ ID NO: 35519 - protein, 11 aa, Mycobacterium tuberculosis
AWDSTPRIAFL

SEQ ID NO: 35520 - protein, 11 aa, Mycobacterium tuberculosis
WDSTPRIAFLS

SEQ ID NO: 35521 - protein, 11 aa, Mycobacterium tuberculosis
DSTPRIAFLSP

SEQ ID NO: 35522 - protein, 11 aa, Mycobacterium tuberculosis
STPRIAFLSPE

SEQ ID NO: 35523 - protein, 11 aa, Mycobacterium tuberculosis
TPRIAFLSPEP

SEQ ID NO: 35524 - protein, 11 aa, Mycobacterium tuberculosis
PRIAFLSPEPG

SEQ ID NO: 35525 - protein, 11 aa, Mycobacterium tuberculosis
RIAFLSPEPGS

SEQ ID NO: 35526 - protein, 11 aa, Mycobacterium tuberculosis
IAFLSPEPGSG

SEQ ID NO: 35527 - protein, 11 aa, Mycobacterium tuberculosis
AFLSPEPGSGK

SEQ ID NO: 35528 - protein, 11 aa, Mycobacterium tuberculosis
FLSPEPGSGKS

SEQ ID NO: 35529 - protein, 11 aa, Mycobacterium tuberculosis
LSPEPGSGKSR

SEQ ID NO: 35530 - protein, 11 aa, Mycobacterium tuberculosis
SPEPGSGKSRA

SEQ ID NO: 35531 - protein, 11 aa, Mycobacterium tuberculosis
PEPGSGKSRAL

SEQ ID NO: 35532 - protein, 11 aa, Mycobacterium tuberculosis
EPGSGKSRALE

SEQ ID NO: 35533 - protein, 11 aa, Mycobacterium tuberculosis
PGSGKSRALEV

SEQ ID NO: 35534 - protein, 11 aa, Mycobacterium tuberculosis
GSGKSRALEVT

SEQ ID NO: 35535 - protein, 11 aa, Mycobacterium tuberculosis
SGKSRALEVTE

SEQ ID NO: 35536 - protein, 11 aa, Mycobacterium tuberculosis
GKSRALEVTEP

SEQ ID NO: 35537 - protein, 11 aa, Mycobacterium tuberculosis
KSRALEVTEPL

SEQ ID NO: 35538 - protein, 11 aa, Mycobacterium tuberculosis
SRALEVTEPLV

SEQ ID NO: 35539 - protein, 11 aa, Mycobacterium tuberculosis
RALEVTEPLVP

SEQ ID NO: 35540 - protein, 11 aa, Mycobacterium tuberculosis
ALEVTEPLVPR

SEQ ID NO: 35541 - protein, 11 aa, Mycobacterium tuberculosis
LEVTEPLVPRP

SEQ ID NO: 35542 - protein, 11 aa, Mycobacterium tuberculosis
EVTEPLVPRPV

SEQ ID NO: 35543 - protein, 11 aa, Mycobacterium tuberculosis
VTEPLVPRPVH

SEQ ID NO: 35544 - protein, 11 aa, Mycobacterium tuberculosis
TEPLVPRPVHA

SEQ ID NO: 35545 - protein, 11 aa, Mycobacterium tuberculosis
EPLVPRPVHAI

SEQ ID NO: 35546 - protein, 11 aa, Mycobacterium tuberculosis
PLVPRPVHAIN

SEQ ID NO: 35547 - protein, 11 aa, Mycobacterium tuberculosis
LVPRPVHAINC

SEQ ID NO: 35548 - protein, 11 aa, Mycobacterium tuberculosis
VPRPVHAINCT

SEQ ID NO: 35549 - protein, 11 aa, Mycobacterium tuberculosis
PRPVHAINCTP

SEQ ID NO: 35550 - protein, 11 aa, Mycobacterium tuberculosis
RPVHAINCTPA

SEQ ID NO: 35551 - protein, 11 aa, Mycobacterium tuberculosis
PVHAINCTPAY

SEQ ID NO: 35552 - protein, 11 aa, Mycobacterium tuberculosis
VHAINCTPAYL

SEQ ID NO: 35553 - protein, 11 aa, Mycobacterium tuberculosis
HAINCTPAYLF

SEQ ID NO: 35554 - protein, 11 aa, Mycobacterium tuberculosis
AINCTPAYLFR

SEQ ID NO: 35555 - protein, 11 aa, Mycobacterium tuberculosis
INCTPAYLFRR

SEQ ID NO: 35556 - protein, 11 aa, Mycobacterium tuberculosis
NCTPAYLFRRV

SEQ ID NO: 35557 - protein, 11 aa, Mycobacterium tuberculosis
CTPAYLFRRVA

SEQ ID NO: 35558 - protein, 11 aa, Mycobacterium tuberculosis
TPAYLFRRVAD

SEQ ID NO: 35559 - protein, 11 aa, Mycobacterium tuberculosis
PAYLFRRVADP

SEQ ID NO: 35560 - protein, 11 aa, Mycobacterium tuberculosis
AYLFRRVADPV

SEQ ID NO: 35561 - protein, 11 aa, Mycobacterium tuberculosis
YLFRRVADPVG

SEQ ID NO: 35562 - protein, 11 aa, Mycobacterium tuberculosis
LFRRVADPVGR

SEQ ID NO: 35563 - protein, 11 aa, Mycobacterium tuberculosis
FRRVADPVGRP

SEQ ID NO: 35564 - protein, 11 aa, Mycobacterium tuberculosis
RRVADPVGRPT

SEQ ID NO: 35565 - protein, 11 aa, Mycobacterium tuberculosis
RVADPVGRPTV

SEQ ID NO: 35566 - protein, 11 aa, Mycobacterium tuberculosis
VADPVGRPTVL

SEQ ID NO: 35567 - protein, 11 aa, Mycobacterium tuberculosis
ADPVGRPTVLY

SEQ ID NO: 35568 - protein, 11 aa, Mycobacterium tuberculosis
DPVGRPTVLYD

SEQ ID NO: 35569 - protein, 11 aa, Mycobacterium tuberculosis
PVGRPTVLYDE

SEQ ID NO: 35570 - protein, 11 aa, Mycobacterium tuberculosis
VGRPTVLYDEC

SEQ ID NO: 35571 - protein, 11 aa, Mycobacterium tuberculosis
GRPTVLYDECD

SEQ ID NO: 35572 - protein, 11 aa, Mycobacterium tuberculosis
RPTVLYDECDT

SEQ ID NO: 35573 - protein, 11 aa, Mycobacterium tuberculosis
PTVLYDECDTL

SEQ ID NO: 35574 - protein, 11 aa, Mycobacterium tuberculosis
TVLYDECDTLF

SEQ ID NO: 35575 - protein, 11 aa, Mycobacterium tuberculosis
VLYDECDTLFG

SEQ ID NO: 35576 - protein, 11 aa, Mycobacterium tuberculosis
LYDECDTLFGP

SEQ ID NO: 35577 - protein, 11 aa, Mycobacterium tuberculosis
YDECDTLFGPK

SEQ ID NO: 35578 - protein, 11 aa, Mycobacterium tuberculosis
DECDTLFGPKA

SEQ ID NO: 35579 - protein, 11 aa, Mycobacterium tuberculosis
ECDTLFGPKAK

SEQ ID NO: 35580 - protein, 11 aa, Mycobacterium tuberculosis
CDTLFGPKAKE

SEQ ID NO: 35581 - protein, 11 aa, Mycobacterium tuberculosis
DTLFGPKAKEH

SEQ ID NO: 35582 - protein, 11 aa, Mycobacterium tuberculosis
TLFGPKAKEHE

SEQ ID NO: 35583 - protein, 11 aa, Mycobacterium tuberculosis
LFGPKAKEHEE

SEQ ID NO: 35584 - protein, 11 aa, Mycobacterium tuberculosis
FGPKAKEHEEI

SEQ ID NO: 35585 - protein, 11 aa, Mycobacterium tuberculosis
GPKAKEHEEIR

SEQ ID NO: 35586 - protein, 11 aa, Mycobacterium tuberculosis
PKAKEHEEIRG

SEQ ID NO: 35587 - protein, 11 aa, Mycobacterium tuberculosis
KAKEHEEIRGV

SEQ ID NO: 35588 - protein, 11 aa, Mycobacterium tuberculosis
AKEHEEIRGVI

SEQ ID NO: 35589 - protein, 11 aa, Mycobacterium tuberculosis
KEHEEIRGVIN

SEQ ID NO: 35590 - protein, 11 aa, Mycobacterium tuberculosis
EHEEIRGVINA

SEQ ID NO: 35591 - protein, 11 aa, Mycobacterium tuberculosis
HEEIRGVINAG

SEQ ID NO: 35592 - protein, 11 aa, Mycobacterium tuberculosis
EEIRGVINAGH

SEQ ID NO: 35593 - protein, 11 aa, Mycobacterium tuberculosis
EIRGVINAGHR

SEQ ID NO: 35594 - protein, 11 aa, Mycobacterium tuberculosis
IRGVINAGHRK

SEQ ID NO: 35595 - protein, 11 aa, Mycobacterium tuberculosis
RGVINAGHRKG

SEQ ID NO: 35596 - protein, 11 aa, Mycobacterium tuberculosis
GVINAGHRKGA

SEQ ID NO: 35597 - protein, 11 aa, Mycobacterium tuberculosis
VINAGHRKGAV

SEQ ID NO: 35598 - protein, 11 aa, Mycobacterium tuberculosis
INAGHRKGAVA

SEQ ID NO: 35599 - protein, 11 aa, Mycobacterium tuberculosis
NAGHRKGAVAG

SEQ ID NO: 35600 - protein, 11 aa, Mycobacterium tuberculosis
AGHRKGAVAGR

SEQ ID NO: 35601 - protein, 11 aa, Mycobacterium tuberculosis
GHRKGAVAGRC

SEQ ID NO: 35602 - protein, 11 aa, Mycobacterium tuberculosis
HRKGAVAGRCV

SEQ ID NO: 35603 - protein, 11 aa, Mycobacterium tuberculosis
RKGAVAGRCVI

SEQ ID NO: 35604 - protein, 11 aa, Mycobacterium tuberculosis
KGAVAGRCVIR

SEQ ID NO: 35605 - protein, 11 aa, Mycobacterium tuberculosis
GAVAGRCVIRG

SEQ ID NO: 35606 - protein, 11 aa, Mycobacterium tuberculosis
AVAGRCVIRGK

SEQ ID NO: 35607 - protein, 11 aa, Mycobacterium tuberculosis
VAGRCVIRGKI

SEQ ID NO: 35608 - protein, 11 aa, Mycobacterium tuberculosis
AGRCVIRGKIV

SEQ ID NO: 35609 - protein, 11 aa, Mycobacterium tuberculosis
GRCVIRGKIVE

SEQ ID NO: 35610 - protein, 11 aa, Mycobacterium tuberculosis
RCVIRGKIVET

SEQ ID NO: 35611 - protein, 11 aa, Mycobacterium tuberculosis
CVIRGKIVETE

SEQ ID NO: 35612 - protein, 11 aa, Mycobacterium tuberculosis
VIRGKIVETEE

SEQ ID NO: 35613 - protein, 11 aa, Mycobacterium tuberculosis
IRGKIVETEEL

SEQ ID NO: 35614 - protein, 11 aa, Mycobacterium tuberculosis
RGKIVETEELP

SEQ ID NO: 35615 - protein, 11 aa, Mycobacterium tuberculosis
GKIVETEELPA

SEQ ID NO: 35616 - protein, 11 aa, Mycobacterium tuberculosis
KIVETEELPAY

SEQ ID NO: 35617 - protein, 11 aa, Mycobacterium tuberculosis
IVETEELPAYC

SEQ ID NO: 35618 - protein, 11 aa, Mycobacterium tuberculosis
VETEELPAYCA

SEQ ID NO: 35619 - protein, 11 aa, Mycobacterium tuberculosis
ETEELPAYCAV

SEQ ID NO: 35620 - protein, 11 aa, Mycobacterium tuberculosis
TEELPAYCAVA

SEQ ID NO: 35621 - protein, 11 aa, Mycobacterium tuberculosis
EELPAYCAVAL

SEQ ID NO: 35622 - protein, 11 aa, Mycobacterium tuberculosis
ELPAYCAVALA

SEQ ID NO: 35623 - protein, 11 aa, Mycobacterium tuberculosis
LPAYCAVALAG

SEQ ID NO: 35624 - protein, 11 aa, Mycobacterium tuberculosis
PAYCAVALAGL

SEQ ID NO: 35625 - protein, 11 aa, Mycobacterium tuberculosis
AYCAVALAGLD

SEQ ID NO: 35626 - protein, 11 aa, Mycobacterium tuberculosis
YCAVALAGLDD

SEQ ID NO: 35627 - protein, 11 aa, Mycobacterium tuberculosis
CAVALAGLDDL

SEQ ID NO: 35628 - protein, 11 aa, Mycobacterium tuberculosis
AVALAGLDDLP

SEQ ID NO: 35629 - protein, 11 aa, Mycobacterium tuberculosis
VALAGLDDLPD

SEQ ID NO: 35630 - protein, 11 aa, Mycobacterium tuberculosis
ALAGLDDLPDT

SEQ ID NO: 35631 - protein, 11 aa, Mycobacterium tuberculosis
LAGLDDLPDTI

SEQ ID NO: 35632 - protein, 11 aa, Mycobacterium tuberculosis
AGLDDLPDTIM

SEQ ID NO: 35633 - protein, 11 aa, Mycobacterium tuberculosis
GLDDLPDTIMS

SEQ ID NO: 35634 - protein, 11 aa, Mycobacterium tuberculosis
LDDLPDTIMSR

SEQ ID NO: 35635 - protein, 11 aa, Mycobacterium tuberculosis
DDLPDTIMSRS

SEQ ID NO: 35636 - protein, 11 aa, Mycobacterium tuberculosis
DLPDTIMSRSI

SEQ ID NO: 35637 - protein, 11 aa, Mycobacterium tuberculosis
LPDTIMSRSIV

SEQ ID NO: 35638 - protein, 11 aa, Mycobacterium tuberculosis
PDTIMSRSIVV

SEQ ID NO: 35639 - protein, 11 aa, Mycobacterium tuberculosis
DTIMSRSIVVR

SEQ ID NO: 35640 - protein, 11 aa, Mycobacterium tuberculosis
TIMSRSIVVRM

SEQ ID NO: 35641 - protein, 11 aa, Mycobacterium tuberculosis
IMSRSIVVRMR

SEQ ID NO: 35642 - protein, 11 aa, Mycobacterium tuberculosis
MSRSIVVRMRR

SEQ ID NO: 35643 - protein, 11 aa, Mycobacterium tuberculosis
SRSIVVRMRRR

SEQ ID NO: 35644 - protein, 11 aa, Mycobacterium tuberculosis
RSIVVRMRRRA

SEQ ID NO: 35645 - protein, 11 aa, Mycobacterium tuberculosis
SIVVRMRRRAP

SEQ ID NO: 35646 - protein, 11 aa, Mycobacterium tuberculosis
IVVRMRRRAPT

SEQ ID NO: 35647 - protein, 11 aa, Mycobacterium tuberculosis
VVRMRRRAPTE

SEQ ID NO: 35648 - protein, 11 aa, Mycobacterium tuberculosis
VRMRRRAPTEP

SEQ ID NO: 35649 - protein, 11 aa, Mycobacterium tuberculosis
RMRRRAPTEPV

SEQ ID NO: 35650 - protein, 11 aa, Mycobacterium tuberculosis
MRRRAPTEPVE

SEQ ID NO: 35651 - protein, 11 aa, Mycobacterium tuberculosis
RRRAPTEPVEP

SEQ ID NO: 35652 - protein, 11 aa, Mycobacterium tuberculosis
RRAPTEPVEPW

SEQ ID NO: 35653 - protein, 11 aa, Mycobacterium tuberculosis
RAPTEPVEPWR

SEQ ID NO: 35654 - protein, 11 aa, Mycobacterium tuberculosis
APTEPVEPWRP

SEQ ID NO: 35655 - protein, 11 aa, Mycobacterium tuberculosis
PTEPVEPWRPR

SEQ ID NO: 35656 - protein, 11 aa, Mycobacterium tuberculosis
TEPVEPWRPRV

SEQ ID NO: 35657 - protein, 11 aa, Mycobacterium tuberculosis
EPVEPWRPRVN

SEQ ID NO: 35658 - protein, 11 aa, Mycobacterium tuberculosis
PVEPWRPRVNG

SEQ ID NO: 35659 - protein, 11 aa, Mycobacterium tuberculosis
VEPWRPRVNGP

SEQ ID NO: 35660 - protein, 11 aa, Mycobacterium tuberculosis
EPWRPRVNGPE

SEQ ID NO: 35661 - protein, 11 aa, Mycobacterium tuberculosis
PWRPRVNGPEA

SEQ ID NO: 35662 - protein, 11 aa, Mycobacterium tuberculosis
WRPRVNGPEAE

SEQ ID NO: 35663 - protein, 11 aa, Mycobacterium tuberculosis
RPRVNGPEAEK

SEQ ID NO: 35664 - protein, 11 aa, Mycobacterium tuberculosis
PRVNGPEAEKL

SEQ ID NO: 35665 - protein, 11 aa, Mycobacterium tuberculosis
RVNGPEAEKLH

SEQ ID NO: 35666 - protein, 11 aa, Mycobacterium tuberculosis
VNGPEAEKLHD

SEQ ID NO: 35667 - protein, 11 aa, Mycobacterium tuberculosis
NGPEAEKLHDR

SEQ ID NO: 35668 - protein, 11 aa, Mycobacterium tuberculosis
GPEAEKLHDRL

SEQ ID NO: 35669 - protein, 11 aa, Mycobacterium tuberculosis
PEAEKLHDRLA

SEQ ID NO: 35670 - protein, 11 aa, Mycobacterium tuberculosis
EAEKLHDRLAN

SEQ ID NO: 35671 - protein, 11 aa, Mycobacterium tuberculosis
AEKLHDRLANW

SEQ ID NO: 35672 - protein, 11 aa, Mycobacterium tuberculosis
EKLHDRLANWA

SEQ ID NO: 35673 - protein, 11 aa, Mycobacterium tuberculosis
KLHDRLANWAA

SEQ ID NO: 35674 - protein, 11 aa, Mycobacterium tuberculosis
LHDRLANWAAA

SEQ ID NO: 35675 - protein, 11 aa, Mycobacterium tuberculosis
HDRLANWAAAI

SEQ ID NO: 35676 - protein, 11 aa, Mycobacterium tuberculosis
DRLANWAAAIN

SEQ ID NO: 35677 - protein, 11 aa, Mycobacterium tuberculosis
RLANWAAAINP

SEQ ID NO: 35678 - protein, 11 aa, Mycobacterium tuberculosis
LANWAAAINPL

SEQ ID NO: 35679 - protein, 11 aa, Mycobacterium tuberculosis
ANWAAAINPLE

SEQ ID NO: 35680 - protein, 11 aa, Mycobacterium tuberculosis
NWAAAINPLES

SEQ ID NO: 35681 - protein, 11 aa, Mycobacterium tuberculosis
WAAAINPLESG

SEQ ID NO: 35682 - protein, 11 aa, Mycobacterium tuberculosis
AAAINPLESGW

SEQ ID NO: 35683 - protein, 11 aa, Mycobacterium tuberculosis
AAINPLESGWP

SEQ ID NO: 35684 - protein, 11 aa, Mycobacterium tuberculosis
AINPLESGWPA

SEQ ID NO: 35685 - protein, 11 aa, Mycobacterium tuberculosis
INPLESGWPAM

SEQ ID NO: 35686 - protein, 11 aa, Mycobacterium tuberculosis
NPLESGWPAMP

SEQ ID NO: 35687 - protein, 11 aa, Mycobacterium tuberculosis
PLESGWPAMPD

SEQ ID NO: 35688 - protein, 11 aa, Mycobacterium tuberculosis
LESGWPAMPDG

SEQ ID NO: 35689 - protein, 11 aa, Mycobacterium tuberculosis
ESGWPAMPDGV

SEQ ID NO: 35690 - protein, 11 aa, Mycobacterium tuberculosis
SGWPAMPDGVT

SEQ ID NO: 35691 - protein, 11 aa, Mycobacterium tuberculosis
GWPAMPDGVTD

SEQ ID NO: 35692 - protein, 11 aa, Mycobacterium tuberculosis
WPAMPDGVTDR

SEQ ID NO: 35693 - protein, 11 aa, Mycobacterium tuberculosis
PAMPDGVTDRR

SEQ ID NO: 35694 - protein, 11 aa, Mycobacterium tuberculosis
AMPDGVTDRRA

SEQ ID NO: 35695 - protein, 11 aa, Mycobacterium tuberculosis
MPDGVTDRRAD

SEQ ID NO: 35696 - protein, 11 aa, Mycobacterium tuberculosis
PDGVTDRRADV

SEQ ID NO: 35697 - protein, 11 aa, Mycobacterium tuberculosis
DGVTDRRADVW

SEQ ID NO: 35698 - protein, 11 aa, Mycobacterium tuberculosis
GVTDRRADVWE

SEQ ID NO: 35699 - protein, 11 aa, Mycobacterium tuberculosis
VTDRRADVWES

SEQ ID NO: 35700 - protein, 11 aa, Mycobacterium tuberculosis
TDRRADVWESL

SEQ ID NO: 35701 - protein, 11 aa, Mycobacterium tuberculosis
DRRADVWESLV

SEQ ID NO: 35702 - protein, 11 aa, Mycobacterium tuberculosis
RRADVWESLVA

SEQ ID NO: 35703 - protein, 11 aa, Mycobacterium tuberculosis
RADVWESLVAV

SEQ ID NO: 35704 - protein, 11 aa, Mycobacterium tuberculosis
ADVWESLVAVA

SEQ ID NO: 35705 - protein, 11 aa, Mycobacterium tuberculosis
DVWESLVAVAD

SEQ ID NO: 35706 - protein, 11 aa, Mycobacterium tuberculosis
VWESLVAVADT

SEQ ID NO: 35707 - protein, 11 aa, Mycobacterium tuberculosis
WESLVAVADTA

SEQ ID NO: 35708 - protein, 11 aa, Mycobacterium tuberculosis
ESLVAVADTAG

SEQ ID NO: 35709 - protein, 11 aa, Mycobacterium tuberculosis
SLVAVADTAGG

SEQ ID NO: 35710 - protein, 11 aa, Mycobacterium tuberculosis
LVAVADTAGGH

SEQ ID NO: 35711 - protein, 11 aa, Mycobacterium tuberculosis
VAVADTAGGHW

SEQ ID NO: 35712 - protein, 11 aa, Mycobacterium tuberculosis
AVADTAGGHWP

SEQ ID NO: 35713 - protein, 11 aa, Mycobacterium tuberculosis
VADTAGGHWPK

SEQ ID NO: 35714 - protein, 11 aa, Mycobacterium tuberculosis
ADTAGGHWPKT

SEQ ID NO: 35715 - protein, 11 aa, Mycobacterium tuberculosis
DTAGGHWPKTA

SEQ ID NO: 35716 - protein, 11 aa, Mycobacterium tuberculosis
TAGGHWPKTAR

SEQ ID NO: 35717 - protein, 11 aa, Mycobacterium tuberculosis
AGGHWPKTARA

SEQ ID NO: 35718 - protein, 11 aa, Mycobacterium tuberculosis
GGHWPKTARAT

SEQ ID NO: 35719 - protein, 11 aa, Mycobacterium tuberculosis
GHWPKTARATA

SEQ ID NO: 35720 - protein, 11 aa, Mycobacterium tuberculosis
HWPKTARATAE

SEQ ID NO: 35721 - protein, 11 aa, Mycobacterium tuberculosis
WPKTARATAET

SEQ ID NO: 35722 - protein, 11 aa, Mycobacterium tuberculosis
PKTARATAETD

SEQ ID NO: 35723 - protein, 11 aa, Mycobacterium tuberculosis
KTARATAETDA

SEQ ID NO: 35724 - protein, 11 aa, Mycobacterium tuberculosis
TARATAETDAT

SEQ ID NO: 35725 - protein, 11 aa, Mycobacterium tuberculosis
ARATAETDATA

SEQ ID NO: 35726 - protein, 11 aa, Mycobacterium tuberculosis
RATAETDATAN

SEQ ID NO: 35727 - protein, 11 aa, Mycobacterium tuberculosis
ATAETDATANR

SEQ ID NO: 35728 - protein, 11 aa, Mycobacterium tuberculosis
TAETDATANRG

SEQ ID NO: 35729 - protein, 11 aa, Mycobacterium tuberculosis
AETDATANRGA

SEQ ID NO: 35730 - protein, 11 aa, Mycobacterium tuberculosis
ETDATANRGAK

SEQ ID NO: 35731 - protein, 11 aa, Mycobacterium tuberculosis
TDATANRGAKP

SEQ ID NO: 35732 - protein, 11 aa, Mycobacterium tuberculosis
DATANRGAKPS

SEQ ID NO: 35733 - protein, 11 aa, Mycobacterium tuberculosis
ATANRGAKPSI

SEQ ID NO: 35734 - protein, 11 aa, Mycobacterium tuberculosis
TANRGAKPSIG

SEQ ID NO: 35735 - protein, 11 aa, Mycobacterium tuberculosis
ANRGAKPSIGV

SEQ ID NO: 35736 - protein, 11 aa, Mycobacterium tuberculosis
NRGAKPSIGVL

SEQ ID NO: 35737 - protein, 11 aa, Mycobacterium tuberculosis
RGAKPSIGVLL

SEQ ID NO: 35738 - protein, 11 aa, Mycobacterium tuberculosis
GAKPSIGVLLL

SEQ ID NO: 35739 - protein, 11 aa, Mycobacterium tuberculosis
AKPSIGVLLLR

SEQ ID NO: 35740 - protein, 11 aa, Mycobacterium tuberculosis
KPSIGVLLLRD

SEQ ID NO: 35741 - protein, 11 aa, Mycobacterium tuberculosis
PSIGVLLLRDI

SEQ ID NO: 35742 - protein, 11 aa, Mycobacterium tuberculosis
SIGVLLLRDIR

SEQ ID NO: 35743 - protein, 11 aa, Mycobacterium tuberculosis
IGVLLLRDIRR

SEQ ID NO: 35744 - protein, 11 aa, Mycobacterium tuberculosis
GVLLLRDIRRV

SEQ ID NO: 35745 - protein, 11 aa, Mycobacterium tuberculosis
VLLLRDIRRVF

SEQ ID NO: 35746 - protein, 11 aa, Mycobacterium tuberculosis
LLLRDIRRVFS

SEQ ID NO: 35747 - protein, 11 aa, Mycobacterium tuberculosis
LLRDIRRVFSD

SEQ ID NO: 35748 - protein, 11 aa, Mycobacterium tuberculosis
LRDIRRVFSDR

SEQ ID NO: 35749 - protein, 11 aa, Mycobacterium tuberculosis
RDIRRVFSDRD

SEQ ID NO: 35750 - protein, 11 aa, Mycobacterium tuberculosis
DIRRVFSDRDR

SEQ ID NO: 35751 - protein, 11 aa, Mycobacterium tuberculosis
IRRVFSDRDRM

SEQ ID NO: 35752 - protein, 11 aa, Mycobacterium tuberculosis
RRVFSDRDRMR

SEQ ID NO: 35753 - protein, 11 aa, Mycobacterium tuberculosis
RVFSDRDRMRT

SEQ ID NO: 35754 - protein, 11 aa, Mycobacterium tuberculosis
VFSDRDRMRTS

SEQ ID NO: 35755 - protein, 11 aa, Mycobacterium tuberculosis
FSDRDRMRTSD

SEQ ID NO: 35756 - protein, 11 aa, Mycobacterium tuberculosis
SDRDRMRTSDI

SEQ ID NO: 35757 - protein, 11 aa, Mycobacterium tuberculosis
DRDRMRTSDIL

SEQ ID NO: 35758 - protein, 11 aa, Mycobacterium tuberculosis
RDRMRTSDILT

SEQ ID NO: 35759 - protein, 11 aa, Mycobacterium tuberculosis
DRMRTSDILTG

SEQ ID NO: 35760 - protein, 11 aa, Mycobacterium tuberculosis
RMRTSDILTGL

SEQ ID NO: 35761 - protein, 11 aa, Mycobacterium tuberculosis
MRTSDILTGLN

SEQ ID NO: 35762 - protein, 11 aa, Mycobacterium tuberculosis
RTSDILTGLNR

SEQ ID NO: 35763 - protein, 11 aa, Mycobacterium tuberculosis
TSDILTGLNRM

SEQ ID NO: 35764 - protein, 11 aa, Mycobacterium tuberculosis
SDILTGLNRME

SEQ ID NO: 35765 - protein, 11 aa, Mycobacterium tuberculosis
DILTGLNRMEE

SEQ ID NO: 35766 - protein, 11 aa, Mycobacterium tuberculosis
ILTGLNRMEEG

SEQ ID NO: 35767 - protein, 11 aa, Mycobacterium tuberculosis
LTGLNRMEEGP

SEQ ID NO: 35768 - protein, 11 aa, Mycobacterium tuberculosis
TGLNRMEEGPW

SEQ ID NO: 35769 - protein, 11 aa, Mycobacterium tuberculosis
GLNRMEEGPWG

SEQ ID NO: 35770 - protein, 11 aa, Mycobacterium tuberculosis
LNRMEEGPWGS

SEQ ID NO: 35771 - protein, 11 aa, Mycobacterium tuberculosis
NRMEEGPWGSI

SEQ ID NO: 35772 - protein, 11 aa, Mycobacterium tuberculosis
RMEEGPWGSIR

SEQ ID NO: 35773 - protein, 11 aa, Mycobacterium tuberculosis
MEEGPWGSIRR

SEQ ID NO: 35774 - protein, 11 aa, Mycobacterium tuberculosis
EEGPWGSIRRG

SEQ ID NO: 35775 - protein, 11 aa, Mycobacterium tuberculosis
EGPWGSIRRGD

SEQ ID NO: 35776 - protein, 11 aa, Mycobacterium tuberculosis
GPWGSIRRGDP

SEQ ID NO: 35777 - protein, 11 aa, Mycobacterium tuberculosis
PWGSIRRGDPL

SEQ ID NO: 35778 - protein, 11 aa, Mycobacterium tuberculosis
WGSIRRGDPLD

SEQ ID NO: 35779 - protein, 11 aa, Mycobacterium tuberculosis
GSIRRGDPLDA

SEQ ID NO: 35780 - protein, 11 aa, Mycobacterium tuberculosis
SIRRGDPLDAR

SEQ ID NO: 35781 - protein, 11 aa, Mycobacterium tuberculosis
IRRGDPLDARG

SEQ ID NO: 35782 - protein, 11 aa, Mycobacterium tuberculosis
RRGDPLDARGL

SEQ ID NO: 35783 - protein, 11 aa, Mycobacterium tuberculosis
RGDPLDARGLA

SEQ ID NO: 35784 - protein, 11 aa, Mycobacterium tuberculosis
GDPLDARGLAT

SEQ ID NO: 35785 - protein, 11 aa, Mycobacterium tuberculosis
DPLDARGLATR

SEQ ID NO: 35786 - protein, 11 aa, Mycobacterium tuberculosis
PLDARGLATRL

SEQ ID NO: 35787 - protein, 11 aa, Mycobacterium tuberculosis
LDARGLATRLG

SEQ ID NO: 35788 - protein, 11 aa, Mycobacterium tuberculosis
DARGLATRLGR

SEQ ID NO: 35789 - protein, 11 aa, Mycobacterium tuberculosis
ARGLATRLGRY

SEQ ID NO: 35790 - protein, 11 aa, Mycobacterium tuberculosis
RGLATRLGRYG

SEQ ID NO: 35791 - protein, 11 aa, Mycobacterium tuberculosis
GLATRLGRYGI

SEQ ID NO: 35792 - protein, 11 aa, Mycobacterium tuberculosis
LATRLGRYGIG

SEQ ID NO: 35793 - protein, 11 aa, Mycobacterium tuberculosis
ATRLGRYGIGP

SEQ ID NO: 35794 - protein, 11 aa, Mycobacterium tuberculosis
TRLGRYGIGPK

SEQ ID NO: 35795 - protein, 11 aa, Mycobacterium tuberculosis
RLGRYGIGPKF

SEQ ID NO: 35796 - protein, 11 aa, Mycobacterium tuberculosis
LGRYGIGPKFQ

SEQ ID NO: 35797 - protein, 11 aa, Mycobacterium tuberculosis
GRYGIGPKFQH

SEQ ID NO: 35798 - protein, 11 aa, Mycobacterium tuberculosis
RYGIGPKFQHS

SEQ ID NO: 35799 - protein, 11 aa, Mycobacterium tuberculosis
YGIGPKFQHSG

SEQ ID NO: 35800 - protein, 11 aa, Mycobacterium tuberculosis
GIGPKFQHSGG

SEQ ID NO: 35801 - protein, 11 aa, Mycobacterium tuberculosis
IGPKFQHSGGE

SEQ ID NO: 35802 - protein, 11 aa, Mycobacterium tuberculosis
GPKFQHSGGEP

SEQ ID NO: 35803 - protein, 11 aa, Mycobacterium tuberculosis
PKFQHSGGEPP

SEQ ID NO: 35804 - protein, 11 aa, Mycobacterium tuberculosis
KFQHSGGEPPY

SEQ ID NO: 35805 - protein, 11 aa, Mycobacterium tuberculosis
FQHSGGEPPYK

SEQ ID NO: 35806 - protein, 11 aa, Mycobacterium tuberculosis
QHSGGEPPYKG

SEQ ID NO: 35807 - protein, 11 aa, Mycobacterium tuberculosis
HSGGEPPYKGY

SEQ ID NO: 35808 - protein, 11 aa, Mycobacterium tuberculosis
SGGEPPYKGYS

SEQ ID NO: 35809 - protein, 11 aa, Mycobacterium tuberculosis
GGEPPYKGYSR

SEQ ID NO: 35810 - protein, 11 aa, Mycobacterium tuberculosis
GEPPYKGYSRT

SEQ ID NO: 35811 - protein, 11 aa, Mycobacterium tuberculosis
EPPYKGYSRTQ

SEQ ID NO: 35812 - protein, 11 aa, Mycobacterium tuberculosis
PPYKGYSRTQF

SEQ ID NO: 35813 - protein, 11 aa, Mycobacterium tuberculosis
PYKGYSRTQFE

SEQ ID NO: 35814 - protein, 11 aa, Mycobacterium tuberculosis
YKGYSRTQFED

SEQ ID NO: 35815 - protein, 11 aa, Mycobacterium tuberculosis
KGYSRTQFEDA

SEQ ID NO: 35816 - protein, 11 aa, Mycobacterium tuberculosis
GYSRTQFEDAW

SEQ ID NO: 35817 - protein, 11 aa, Mycobacterium tuberculosis
YSRTQFEDAWS

SEQ ID NO: 35818 - protein, 11 aa, Mycobacterium tuberculosis
SRTQFEDAWSR

SEQ ID NO: 35819 - protein, 11 aa, Mycobacterium tuberculosis
RTQFEDAWSRY

SEQ ID NO: 35820 - protein, 11 aa, Mycobacterium tuberculosis
TQFEDAWSRYL

SEQ ID NO: 35821 - protein, 11 aa, Mycobacterium tuberculosis
QFEDAWSRYLS

SEQ ID NO: 35822 - protein, 11 aa, Mycobacterium tuberculosis
FEDAWSRYLSA

SEQ ID NO: 35823 - protein, 11 aa, Mycobacterium tuberculosis
EDAWSRYLSAD

SEQ ID NO: 35824 - protein, 11 aa, Mycobacterium tuberculosis
DAWSRYLSADD

SEQ ID NO: 35825 - protein, 11 aa, Mycobacterium tuberculosis
AWSRYLSADDE

SEQ ID NO: 35826 - protein, 11 aa, Mycobacterium tuberculosis
WSRYLSADDET

SEQ ID NO: 35827 - protein, 11 aa, Mycobacterium tuberculosis
SRYLSADDETP

SEQ ID NO: 35828 - protein, 11 aa, Mycobacterium tuberculosis
RYLSADDETPE

SEQ ID NO: 35829 - protein, 11 aa, Mycobacterium tuberculosis
YLSADDETPEE

SEQ ID NO: 35830 - protein, 11 aa, Mycobacterium tuberculosis
LSADDETPEER

SEQ ID NO: 35831 - protein, 11 aa, Mycobacterium tuberculosis
SADDETPEERD

SEQ ID NO: 35832 - protein, 11 aa, Mycobacterium tuberculosis
ADDETPEERDL

SEQ ID NO: 35833 - protein, 11 aa, Mycobacterium tuberculosis
DDETPEERDLS

SEQ ID NO: 35834 - protein, 11 aa, Mycobacterium tuberculosis
DETPEERDLSV

SEQ ID NO: 35835 - protein, 11 aa, Mycobacterium tuberculosis
ETPEERDLSVS

SEQ ID NO: 35836 - protein, 11 aa, Mycobacterium tuberculosis
TPEERDLSVSA

SEQ ID NO: 35837 - protein, 11 aa, Mycobacterium tuberculosis
PEERDLSVSAV

SEQ ID NO: 35838 - protein, 11 aa, Mycobacterium tuberculosis
EERDLSVSAVS

SEQ ID NO: 35839 - protein, 11 aa, Mycobacterium tuberculosis
ERDLSVSAVSA

SEQ ID NO: 35840 - protein, 11 aa, Mycobacterium tuberculosis
RDLSVSAVSAV

SEQ ID NO: 35841 - protein, 11 aa, Mycobacterium tuberculosis
DLSVSAVSAVS

SEQ ID NO: 35842 - protein, 11 aa, Mycobacterium tuberculosis
LSVSAVSAVSP

SEQ ID NO: 35843 - protein, 11 aa, Mycobacterium tuberculosis
SVSAVSAVSPP

SEQ ID NO: 35844 - protein, 11 aa, Mycobacterium tuberculosis
VSAVSAVSPPV

SEQ ID NO: 35845 - protein, 11 aa, Mycobacterium tuberculosis
SAVSAVSPPVG

SEQ ID NO: 35846 - protein, 11 aa, Mycobacterium tuberculosis
AVSAVSPPVGD

SEQ ID NO: 35847 - protein, 11 aa, Mycobacterium tuberculosis
VSAVSPPVGDP

SEQ ID NO: 35848 - protein, 11 aa, Mycobacterium tuberculosis
SAVSPPVGDPG

SEQ ID NO: 35849 - protein, 11 aa, Mycobacterium tuberculosis
AVSPPVGDPGD

SEQ ID NO: 35850 - protein, 11 aa, Mycobacterium tuberculosis
VSPPVGDPGDA

SEQ ID NO: 35851 - protein, 11 aa, Mycobacterium tuberculosis
SPPVGDPGDAT

SEQ ID NO: 35852 - protein, 11 aa, Mycobacterium tuberculosis
PPVGDPGDATG

SEQ ID NO: 35853 - protein, 11 aa, Mycobacterium tuberculosis
PVGDPGDATGA

SEQ ID NO: 35854 - protein, 11 aa, Mycobacterium tuberculosis
VGDPGDATGAT

SEQ ID NO: 35855 - protein, 11 aa, Mycobacterium tuberculosis
GDPGDATGATD

SEQ ID NO: 35856 - protein, 11 aa, Mycobacterium tuberculosis
DPGDATGATDA

SEQ ID NO: 35857 - protein, 11 aa, Mycobacterium tuberculosis
PGDATGATDAT

SEQ ID NO: 35858 - protein, 11 aa, Mycobacterium tuberculosis
GDATGATDATD

SEQ ID NO: 35859 - protein, 11 aa, Mycobacterium tuberculosis
DATGATDATDL

SEQ ID NO: 35860 - protein, 11 aa, Mycobacterium tuberculosis
ATGATDATDLP

SEQ ID NO: 35861 - protein, 11 aa, Mycobacterium tuberculosis
TGATDATDLPE

SEQ ID NO: 35862 - protein, 11 aa, Mycobacterium tuberculosis
GATDATDLPEA

SEQ ID NO: 35863 - protein, 11 aa, Mycobacterium tuberculosis
ATDATDLPEAG

SEQ ID NO: 35864 - protein, 11 aa, Mycobacterium tuberculosis
TDATDLPEAGD

SEQ ID NO: 35865 - protein, 11 aa, Mycobacterium tuberculosis
DATDLPEAGDL

SEQ ID NO: 35866 - protein, 11 aa, Mycobacterium tuberculosis
ATDLPEAGDLP

SEQ ID NO: 35867 - protein, 11 aa, Mycobacterium tuberculosis
TDLPEAGDLPY

SEQ ID NO: 35868 - protein, 11 aa, Mycobacterium tuberculosis
DLPEAGDLPYE

SEQ ID NO: 35869 - protein, 11 aa, Mycobacterium tuberculosis
LPEAGDLPYEP

SEQ ID NO: 35870 - protein, 11 aa, Mycobacterium tuberculosis
PEAGDLPYEPP

SEQ ID NO: 35871 - protein, 11 aa, Mycobacterium tuberculosis
EAGDLPYEPPA

SEQ ID NO: 35872 - protein, 11 aa, Mycobacterium tuberculosis
AGDLPYEPPAP

SEQ ID NO: 35873 - protein, 11 aa, Mycobacterium tuberculosis
GDLPYEPPAPN

SEQ ID NO: 35874 - protein, 11 aa, Mycobacterium tuberculosis
DLPYEPPAPNG

SEQ ID NO: 35875 - protein, 11 aa, Mycobacterium tuberculosis
LPYEPPAPNGH

SEQ ID NO: 35876 - protein, 11 aa, Mycobacterium tuberculosis
PYEPPAPNGHP

SEQ ID NO: 35877 - protein, 11 aa, Mycobacterium tuberculosis
YEPPAPNGHPN

SEQ ID NO: 35878 - protein, 11 aa, Mycobacterium tuberculosis
EPPAPNGHPNG

SEQ ID NO: 35879 - protein, 11 aa, Mycobacterium tuberculosis
PPAPNGHPNGD

SEQ ID NO: 35880 - protein, 11 aa, Mycobacterium tuberculosis
PAPNGHPNGDA

SEQ ID NO: 35881 - protein, 11 aa, Mycobacterium tuberculosis
APNGHPNGDAP

SEQ ID NO: 35882 - protein, 11 aa, Mycobacterium tuberculosis
PNGHPNGDAPL

SEQ ID NO: 35883 - protein, 11 aa, Mycobacterium tuberculosis
NGHPNGDAPLC

SEQ ID NO: 35884 - protein, 11 aa, Mycobacterium tuberculosis
GHPNGDAPLCS

SEQ ID NO: 35885 - protein, 11 aa, Mycobacterium tuberculosis
HPNGDAPLCSG

SEQ ID NO: 35886 - protein, 11 aa, Mycobacterium tuberculosis
PNGDAPLCSGP

SEQ ID NO: 35887 - protein, 11 aa, Mycobacterium tuberculosis
NGDAPLCSGPG

SEQ ID NO: 35888 - protein, 11 aa, Mycobacterium tuberculosis
GDAPLCSGPGC

SEQ ID NO: 35889 - protein, 11 aa, Mycobacterium tuberculosis
DAPLCSGPGCP

SEQ ID NO: 35890 - protein, 11 aa, Mycobacterium tuberculosis
APLCSGPGCPN

SEQ ID NO: 35891 - protein, 11 aa, Mycobacterium tuberculosis
PLCSGPGCPNK

SEQ ID NO: 35892 - protein, 11 aa, Mycobacterium tuberculosis
LCSGPGCPNKL

SEQ ID NO: 35893 - protein, 11 aa, Mycobacterium tuberculosis
CSGPGCPNKLL

SEQ ID NO: 35894 - protein, 11 aa, Mycobacterium tuberculosis
SGPGCPNKLLS

SEQ ID NO: 35895 - protein, 11 aa, Mycobacterium tuberculosis
GPGCPNKLLST

SEQ ID NO: 35896 - protein, 11 aa, Mycobacterium tuberculosis
PGCPNKLLSTE

SEQ ID NO: 35897 - protein, 11 aa, Mycobacterium tuberculosis
GCPNKLLSTEA

SEQ ID NO: 35898 - protein, 11 aa, Mycobacterium tuberculosis
CPNKLLSTEAK

SEQ ID NO: 35899 - protein, 11 aa, Mycobacterium tuberculosis
PNKLLSTEAKA

SEQ ID NO: 35900 - protein, 11 aa, Mycobacterium tuberculosis
NKLLSTEAKAA

SEQ ID NO: 35901 - protein, 11 aa, Mycobacterium tuberculosis
KLLSTEAKAAG

SEQ ID NO: 35902 - protein, 11 aa, Mycobacterium tuberculosis
LLSTEAKAAGK

SEQ ID NO: 35903 - protein, 11 aa, Mycobacterium tuberculosis
LSTEAKAAGKC

SEQ ID NO: 35904 - protein, 11 aa, Mycobacterium tuberculosis
STEAKAAGKCR

SEQ ID NO: 35905 - protein, 11 aa, Mycobacterium tuberculosis
TEAKAAGKCRP

SEQ ID NO: 35906 - protein, 11 aa, Mycobacterium tuberculosis
EAKAAGKCRPC

SEQ ID NO: 35907 - protein, 11 aa, Mycobacterium tuberculosis
AKAAGKCRPCR

SEQ ID NO: 35908 - protein, 11 aa, Mycobacterium tuberculosis
KAAGKCRPCRG

SEQ ID NO: 35909 - protein, 11 aa, Mycobacterium tuberculosis
AAGKCRPCRGR

SEQ ID NO: 35910 - protein, 11 aa, Mycobacterium tuberculosis
AGKCRPCRGRA

SEQ ID NO: 35911 - protein, 11 aa, Mycobacterium tuberculosis
GKCRPCRGRAA

SEQ ID NO: 35912 - protein, 11 aa, Mycobacterium tuberculosis
KCRPCRGRAAA

SEQ ID NO: 35913 - protein, 11 aa, Mycobacterium tuberculosis
CRPCRGRAAAS

SEQ ID NO: 35914 - protein, 11 aa, Mycobacterium tuberculosis
RPCRGRAAASA

SEQ ID NO: 35915 - protein, 11 aa, Mycobacterium tuberculosis
PCRGRAAASAR

SEQ ID NO: 35916 - protein, 11 aa, Mycobacterium tuberculosis
CRGRAAASARD

SEQ ID NO: 35917 - protein, 11 aa, Mycobacterium tuberculosis
RGRAAASARDG

SEQ ID NO: 35918 - protein, 11 aa, Mycobacterium tuberculosis
GRAAASARDGA

SEQ ID NO: 35919 - protein, 11 aa, Mycobacterium tuberculosis
RAAASARDGAR

SEQ ID NO: 35920 - protein, 8 aa, Mycobacterium tuberculosis
MTAVGGSP

SEQ ID NO: 35921 - protein, 8 aa, Mycobacterium tuberculosis
TAVGGSPP

SEQ ID NO: 35922 - protein, 8 aa, Mycobacterium tuberculosis
AVGGSPPT

SEQ ID NO: 35923 - protein, 8 aa, Mycobacterium tuberculosis
VGGSPPTR

SEQ ID NO: 35924 - protein, 8 aa, Mycobacterium tuberculosis
GGSPPTRR

SEQ ID NO: 35925 - protein, 8 aa, Mycobacterium tuberculosis
GSPPTRRC

SEQ ID NO: 35926 - protein, 8 aa, Mycobacterium tuberculosis
SPPTRRCP

SEQ ID NO: 35927 - protein, 8 aa, Mycobacterium tuberculosis
PPTRRCPA

SEQ ID NO: 35928 - protein, 8 aa, Mycobacterium tuberculosis
PTRRCPAT

SEQ ID NO: 35929 - protein, 8 aa, Mycobacterium tuberculosis
TRRCPATE

SEQ ID NO: 35930 - protein, 8 aa, Mycobacterium tuberculosis
RRCPATED

SEQ ID NO: 35931 - protein, 8 aa, Mycobacterium tuberculosis
RCPATEDR

SEQ ID NO: 35932 - protein, 8 aa, Mycobacterium tuberculosis
CPATEDRA

SEQ ID NO: 35933 - protein, 8 aa, Mycobacterium tuberculosis
PATEDRAP

SEQ ID NO: 35934 - protein, 8 aa, Mycobacterium tuberculosis
ATEDRAPA

SEQ ID NO: 35935 - protein, 8 aa, Mycobacterium tuberculosis
TEDRAPAT

SEQ ID NO: 35936 - protein, 8 aa, Mycobacterium tuberculosis
EDRAPATV

SEQ ID NO: 35937 - protein, 8 aa, Mycobacterium tuberculosis
DRAPATVA

SEQ ID NO: 35938 - protein, 8 aa, Mycobacterium tuberculosis
RAPATVAT

SEQ ID NO: 35939 - protein, 8 aa, Mycobacterium tuberculosis
APATVATP

SEQ ID NO: 35940 - protein, 8 aa, Mycobacterium tuberculosis
PATVATPS

SEQ ID NO: 35941 - protein, 8 aa, Mycobacterium tuberculosis
ATVATPSS

SEQ ID NO: 35942 - protein, 8 aa, Mycobacterium tuberculosis
TVATPSST

SEQ ID NO: 35943 - protein, 8 aa, Mycobacterium tuberculosis
VATPSSTD

SEQ ID NO: 35944 - protein, 8 aa, Mycobacterium tuberculosis
ATPSSTDP

SEQ ID NO: 35945 - protein, 8 aa, Mycobacterium tuberculosis
TPSSTDPT

SEQ ID NO: 35946 - protein, 8 aa, Mycobacterium tuberculosis
PSSTDPTA

SEQ ID NO: 35947 - protein, 8 aa, Mycobacterium tuberculosis
SSTDPTAS

SEQ ID NO: 35948 - protein, 8 aa, Mycobacterium tuberculosis
STDPTASR

SEQ ID NO: 35949 - protein, 8 aa, Mycobacterium tuberculosis
TDPTASRA

SEQ ID NO: 35950 - protein, 8 aa, Mycobacterium tuberculosis
DPTASRAV

SEQ ID NO: 35951 - protein, 8 aa, Mycobacterium tuberculosis
PTASRAVS

SEQ ID NO: 35952 - protein, 8 aa, Mycobacterium tuberculosis
TASRAVSW

SEQ ID NO: 35953 - protein, 8 aa, Mycobacterium tuberculosis
ASRAVSWW

SEQ ID NO: 35954 - protein, 8 aa, Mycobacterium tuberculosis
SRAVSWWS

SEQ ID NO: 35955 - protein, 8 aa, Mycobacterium tuberculosis
RAVSWWSV

SEQ ID NO: 35956 - protein, 8 aa, Mycobacterium tuberculosis
AVSWWSVH

SEQ ID NO: 35957 - protein, 8 aa, Mycobacterium tuberculosis
VSWWSVHE

SEQ ID NO: 35958 - protein, 8 aa, Mycobacterium tuberculosis
SWWSVHEY

SEQ ID NO: 35959 - protein, 8 aa, Mycobacterium tuberculosis
WWSVHEYV

SEQ ID NO: 35960 - protein, 8 aa, Mycobacterium tuberculosis
WSVHEYVA

SEQ ID NO: 35961 - protein, 8 aa, Mycobacterium tuberculosis
SVHEYVAP

SEQ ID NO: 35962 - protein, 8 aa, Mycobacterium tuberculosis
VHEYVAPT

SEQ ID NO: 35963 - protein, 8 aa, Mycobacterium tuberculosis
HEYVAPTL

SEQ ID NO: 35964 - protein, 8 aa, Mycobacterium tuberculosis
EYVAPTLA

SEQ ID NO: 35965 - protein, 8 aa, Mycobacterium tuberculosis
YVAPTLAA

SEQ ID NO: 35966 - protein, 8 aa, Mycobacterium tuberculosis
VAPTLAAA

SEQ ID NO: 35967 - protein, 8 aa, Mycobacterium tuberculosis
APTLAAAV

SEQ ID NO: 35968 - protein, 8 aa, Mycobacterium tuberculosis
PTLAAAVE

SEQ ID NO: 35969 - protein, 8 aa, Mycobacterium tuberculosis
TLAAAVEW

SEQ ID NO: 35970 - protein, 8 aa, Mycobacterium tuberculosis
LAAAVEWP

SEQ ID NO: 35971 - protein, 8 aa, Mycobacterium tuberculosis
AAAVEWPM

SEQ ID NO: 35972 - protein, 8 aa, Mycobacterium tuberculosis
AAVEWPMA

SEQ ID NO: 35973 - protein, 8 aa, Mycobacterium tuberculosis
AVEWPMAG

SEQ ID NO: 35974 - protein, 8 aa, Mycobacterium tuberculosis
VEWPMAGT

SEQ ID NO: 35975 - protein, 8 aa, Mycobacterium tuberculosis
EWPMAGTP

SEQ ID NO: 35976 - protein, 8 aa, Mycobacterium tuberculosis
WPMAGTPA

SEQ ID NO: 35977 - protein, 8 aa, Mycobacterium tuberculosis
PMAGTPAW

SEQ ID NO: 35978 - protein, 8 aa, Mycobacterium tuberculosis
MAGTPAWC

SEQ ID NO: 35979 - protein, 8 aa, Mycobacterium tuberculosis
AGTPAWCD

SEQ ID NO: 35980 - protein, 8 aa, Mycobacterium tuberculosis
GTPAWCDL

SEQ ID NO: 35981 - protein, 8 aa, Mycobacterium tuberculosis
TPAWCDLD

SEQ ID NO: 35982 - protein, 8 aa, Mycobacterium tuberculosis
PAWCDLDD

SEQ ID NO: 35983 - protein, 8 aa, Mycobacterium tuberculosis
AWCDLDDT

SEQ ID NO: 35984 - protein, 8 aa, Mycobacterium tuberculosis
WCDLDDTD

SEQ ID NO: 35985 - protein, 8 aa, Mycobacterium tuberculosis
CDLDDTDP

SEQ ID NO: 35986 - protein, 8 aa, Mycobacterium tuberculosis
DLDDTDPV

SEQ ID NO: 35987 - protein, 8 aa, Mycobacterium tuberculosis
LDDTDPVK

SEQ ID NO: 35988 - protein, 8 aa, Mycobacterium tuberculosis
DDTDPVKW

SEQ ID NO: 35989 - protein, 8 aa, Mycobacterium tuberculosis
DTDPVKWA

SEQ ID NO: 35990 - protein, 8 aa, Mycobacterium tuberculosis
TDPVKWAA

SEQ ID NO: 35991 - protein, 8 aa, Mycobacterium tuberculosis
DPVKWAAI

SEQ ID NO: 35992 - protein, 8 aa, Mycobacterium tuberculosis
PVKWAAIC

SEQ ID NO: 35993 - protein, 8 aa, Mycobacterium tuberculosis
VKWAAICD

SEQ ID NO: 35994 - protein, 8 aa, Mycobacterium tuberculosis
KWAAICDA

SEQ ID NO: 35995 - protein, 8 aa, Mycobacterium tuberculosis
WAAICDAA

SEQ ID NO: 35996 - protein, 8 aa, Mycobacterium tuberculosis
AAICDAAR

SEQ ID NO: 35997 - protein, 8 aa, Mycobacterium tuberculosis
AICDAARH

SEQ ID NO: 35998 - protein, 8 aa, Mycobacterium tuberculosis
ICDAARHW

SEQ ID NO: 35999 - protein, 8 aa, Mycobacterium tuberculosis
CDAARHWA

SEQ ID NO: 36000 - protein, 8 aa, Mycobacterium tuberculosis
DAARHWAL

SEQ ID NO: 36001 - protein, 8 aa, Mycobacterium tuberculosis
AARHWALR

SEQ ID NO: 36002 - protein, 8 aa, Mycobacterium tuberculosis
ARHWALRV

SEQ ID NO: 36003 - protein, 8 aa, Mycobacterium tuberculosis
RHWALRVE

SEQ ID NO: 36004 - protein, 8 aa, Mycobacterium tuberculosis
HWALRVET

SEQ ID NO: 36005 - protein, 8 aa, Mycobacterium tuberculosis
WALRVETC

SEQ ID NO: 36006 - protein, 8 aa, Mycobacterium tuberculosis
ALRVETCQ

SEQ ID NO: 36007 - protein, 8 aa, Mycobacterium tuberculosis
LRVETCQA

SEQ ID NO: 36008 - protein, 8 aa, Mycobacterium tuberculosis
RVETCQAA

SEQ ID NO: 36009 - protein, 8 aa, Mycobacterium tuberculosis
VETCQAAS

SEQ ID NO: 36010 - protein, 8 aa, Mycobacterium tuberculosis
ETCQAASA

SEQ ID NO: 36011 - protein, 8 aa, Mycobacterium tuberculosis
TCQAASAE

SEQ ID NO: 36012 - protein, 8 aa, Mycobacterium tuberculosis
CQAASAEA

SEQ ID NO: 36013 - protein, 8 aa, Mycobacterium tuberculosis
QAASAEAS

SEQ ID NO: 36014 - protein, 8 aa, Mycobacterium tuberculosis
AASAEASR

SEQ ID NO: 36015 - protein, 8 aa, Mycobacterium tuberculosis
ASAEASRD

SEQ ID NO: 36016 - protein, 8 aa, Mycobacterium tuberculosis
SAEASRDV

SEQ ID NO: 36017 - protein, 8 aa, Mycobacterium tuberculosis
AEASRDVS

SEQ ID NO: 36018 - protein, 8 aa, Mycobacterium tuberculosis
EASRDVSA

SEQ ID NO: 36019 - protein, 8 aa, Mycobacterium tuberculosis
ASRDVSAA

SEQ ID NO: 36020 - protein, 8 aa, Mycobacterium tuberculosis
SRDVSAAA

SEQ ID NO: 36021 - protein, 8 aa, Mycobacterium tuberculosis
RDVSAAAD

SEQ ID NO: 36022 - protein, 8 aa, Mycobacterium tuberculosis
DVSAAADW

SEQ ID NO: 36023 - protein, 8 aa, Mycobacterium tuberculosis
VSAAADWP

SEQ ID NO: 36024 - protein, 8 aa, Mycobacterium tuberculosis
SAAADWPA

SEQ ID NO: 36025 - protein, 8 aa, Mycobacterium tuberculosis
AAADWPAV

SEQ ID NO: 36026 - protein, 8 aa, Mycobacterium tuberculosis
AADWPAVS

SEQ ID NO: 36027 - protein, 8 aa, Mycobacterium tuberculosis
ADWPAVSR

SEQ ID NO: 36028 - protein, 8 aa, Mycobacterium tuberculosis
DWPAVSRE

SEQ ID NO: 36029 - protein, 8 aa, Mycobacterium tuberculosis
WPAVSREI

SEQ ID NO: 36030 - protein, 8 aa, Mycobacterium tuberculosis
PAVSREIQ

SEQ ID NO: 36031 - protein, 8 aa, Mycobacterium tuberculosis
AVSREIQR

SEQ ID NO: 36032 - protein, 8 aa, Mycobacterium tuberculosis
VSREIQRR

SEQ ID NO: 36033 - protein, 8 aa, Mycobacterium tuberculosis
SREIQRRR

SEQ ID NO: 36034 - protein, 8 aa, Mycobacterium tuberculosis
REIQRRRD

SEQ ID NO: 36035 - protein, 8 aa, Mycobacterium tuberculosis
EIQRRRDA

SEQ ID NO: 36036 - protein, 8 aa, Mycobacterium tuberculosis
IQRRRDAY

SEQ ID NO: 36037 - protein, 8 aa, Mycobacterium tuberculosis
QRRRDAYI

SEQ ID NO: 36038 - protein, 8 aa, Mycobacterium tuberculosis
RRRDAYIR

SEQ ID NO: 36039 - protein, 8 aa, Mycobacterium tuberculosis
RRDAYIRR

SEQ ID NO: 36040 - protein, 8 aa, Mycobacterium tuberculosis
RDAYIRRV

SEQ ID NO: 36041 - protein, 8 aa, Mycobacterium tuberculosis
DAYIRRVV

SEQ ID NO: 36042 - protein, 8 aa, Mycobacterium tuberculosis
AYIRRVVV

SEQ ID NO: 36043 - protein, 9 aa, Mycobacterium tuberculosis
MTAVGGSPP

SEQ ID NO: 36044 - protein, 9 aa, Mycobacterium tuberculosis
TAVGGSPPT

SEQ ID NO: 36045 - protein, 9 aa, Mycobacterium tuberculosis
AVGGSPPTR

SEQ ID NO: 36046 - protein, 9 aa, Mycobacterium tuberculosis
VGGSPPTRR

SEQ ID NO: 36047 - protein, 9 aa, Mycobacterium tuberculosis
GGSPPTRRC

SEQ ID NO: 36048 - protein, 9 aa, Mycobacterium tuberculosis
GSPPTRRCP

SEQ ID NO: 36049 - protein, 9 aa, Mycobacterium tuberculosis
SPPTRRCPA

SEQ ID NO: 36050 - protein, 9 aa, Mycobacterium tuberculosis
PPTRRCPAT

SEQ ID NO: 36051 - protein, 9 aa, Mycobacterium tuberculosis
PTRRCPATE

SEQ ID NO: 36052 - protein, 9 aa, Mycobacterium tuberculosis
TRRCPATED

SEQ ID NO: 36053 - protein, 9 aa, Mycobacterium tuberculosis
RRCPATEDR

SEQ ID NO: 36054 - protein, 9 aa, Mycobacterium tuberculosis
RCPATEDRA

SEQ ID NO: 36055 - protein, 9 aa, Mycobacterium tuberculosis
CPATEDRAP

SEQ ID NO: 36056 - protein, 9 aa, Mycobacterium tuberculosis
PATEDRAPA

SEQ ID NO: 36057 - protein, 9 aa, Mycobacterium tuberculosis
ATEDRAPAT

SEQ ID NO: 36058 - protein, 9 aa, Mycobacterium tuberculosis
TEDRAPATV

SEQ ID NO: 36059 - protein, 9 aa, Mycobacterium tuberculosis
EDRAPATVA

SEQ ID NO: 36060 - protein, 9 aa, Mycobacterium tuberculosis
DRAPATVAT

SEQ ID NO: 36061 - protein, 9 aa, Mycobacterium tuberculosis
RAPATVATP

SEQ ID NO: 36062 - protein, 9 aa, Mycobacterium tuberculosis
APATVATPS

SEQ ID NO: 36063 - protein, 9 aa, Mycobacterium tuberculosis
PATVATPSS

SEQ ID NO: 36064 - protein, 9 aa, Mycobacterium tuberculosis
ATVATPSST

SEQ ID NO: 36065 - protein, 9 aa, Mycobacterium tuberculosis
TVATPSSTD

SEQ ID NO: 36066 - protein, 9 aa, Mycobacterium tuberculosis
VATPSSTDP

SEQ ID NO: 36067 - protein, 9 aa, Mycobacterium tuberculosis
ATPSSTDPT

SEQ ID NO: 36068 - protein, 9 aa, Mycobacterium tuberculosis
TPSSTDPTA

SEQ ID NO: 36069 - protein, 9 aa, Mycobacterium tuberculosis
PSSTDPTAS

SEQ ID NO: 36070 - protein, 9 aa, Mycobacterium tuberculosis
SSTDPTASR

SEQ ID NO: 36071 - protein, 9 aa, Mycobacterium tuberculosis
STDPTASRA

SEQ ID NO: 36072 - protein, 9 aa, Mycobacterium tuberculosis
TDPTASRAV

SEQ ID NO: 36073 - protein, 9 aa, Mycobacterium tuberculosis
DPTASRAVS

SEQ ID NO: 36074 - protein, 9 aa, Mycobacterium tuberculosis
PTASRAVSW

SEQ ID NO: 36075 - protein, 9 aa, Mycobacterium tuberculosis
TASRAVSWW

SEQ ID NO: 36076 - protein, 9 aa, Mycobacterium tuberculosis
ASRAVSWWS

SEQ ID NO: 36077 - protein, 9 aa, Mycobacterium tuberculosis
SRAVSWWSV

SEQ ID NO: 36078 - protein, 9 aa, Mycobacterium tuberculosis
RAVSWWSVH

SEQ ID NO: 36079 - protein, 9 aa, Mycobacterium tuberculosis
AVSWWSVHE

SEQ ID NO: 36080 - protein, 9 aa, Mycobacterium tuberculosis
VSWWSVHEY

SEQ ID NO: 36081 - protein, 9 aa, Mycobacterium tuberculosis
SWWSVHEYV

SEQ ID NO: 36082 - protein, 9 aa, Mycobacterium tuberculosis
WWSVHEYVA

SEQ ID NO: 36083 - protein, 9 aa, Mycobacterium tuberculosis
WSVHEYVAP

SEQ ID NO: 36084 - protein, 9 aa, Mycobacterium tuberculosis
SVHEYVAPT

SEQ ID NO: 36085 - protein, 9 aa, Mycobacterium tuberculosis
VHEYVAPTL

SEQ ID NO: 36086 - protein, 9 aa, Mycobacterium tuberculosis
HEYVAPTLA

SEQ ID NO: 36087 - protein, 9 aa, Mycobacterium tuberculosis
EYVAPTLAA

SEQ ID NO: 36088 - protein, 9 aa, Mycobacterium tuberculosis
YVAPTLAAA

SEQ ID NO: 36089 - protein, 9 aa, Mycobacterium tuberculosis
VAPTLAAAV

SEQ ID NO: 36090 - protein, 9 aa, Mycobacterium tuberculosis
APTLAAAVE

SEQ ID NO: 36091 - protein, 9 aa, Mycobacterium tuberculosis
PTLAAAVEW

SEQ ID NO: 36092 - protein, 9 aa, Mycobacterium tuberculosis
TLAAAVEWP

SEQ ID NO: 36093 - protein, 9 aa, Mycobacterium tuberculosis
LAAAVEWPM

SEQ ID NO: 36094 - protein, 9 aa, Mycobacterium tuberculosis
AAAVEWPMA

SEQ ID NO: 36095 - protein, 9 aa, Mycobacterium tuberculosis
AAVEWPMAG

SEQ ID NO: 36096 - protein, 9 aa, Mycobacterium tuberculosis
AVEWPMAGT

SEQ ID NO: 36097 - protein, 9 aa, Mycobacterium tuberculosis
VEWPMAGTP

SEQ ID NO: 36098 - protein, 9 aa, Mycobacterium tuberculosis
EWPMAGTPA

SEQ ID NO: 36099 - protein, 9 aa, Mycobacterium tuberculosis
WPMAGTPAW

SEQ ID NO: 36100 - protein, 9 aa, Mycobacterium tuberculosis
PMAGTPAWC

SEQ ID NO: 36101 - protein, 9 aa, Mycobacterium tuberculosis
MAGTPAWCD

SEQ ID NO: 36102 - protein, 9 aa, Mycobacterium tuberculosis
AGTPAWCDL

SEQ ID NO: 36103 - protein, 9 aa, Mycobacterium tuberculosis
GTPAWCDLD

SEQ ID NO: 36104 - protein, 9 aa, Mycobacterium tuberculosis
TPAWCDLDD

SEQ ID NO: 36105 - protein, 9 aa, Mycobacterium tuberculosis
PAWCDLDDT

SEQ ID NO: 36106 - protein, 9 aa, Mycobacterium tuberculosis
AWCDLDDTD

SEQ ID NO: 36107 - protein, 9 aa, Mycobacterium tuberculosis
WCDLDDTDP

SEQ ID NO: 36108 - protein, 9 aa, Mycobacterium tuberculosis
CDLDDTDPV

SEQ ID NO: 36109 - protein, 9 aa, Mycobacterium tuberculosis
DLDDTDPVK

SEQ ID NO: 36110 - protein, 9 aa, Mycobacterium tuberculosis
LDDTDPVKW

SEQ ID NO: 36111 - protein, 9 aa, Mycobacterium tuberculosis
DDTDPVKWA

SEQ ID NO: 36112 - protein, 9 aa, Mycobacterium tuberculosis
DTDPVKWAA

SEQ ID NO: 36113 - protein, 9 aa, Mycobacterium tuberculosis
TDPVKWAAI

SEQ ID NO: 36114 - protein, 9 aa, Mycobacterium tuberculosis
DPVKWAAIC

SEQ ID NO: 36115 - protein, 9 aa, Mycobacterium tuberculosis
PVKWAAICD

SEQ ID NO: 36116 - protein, 9 aa, Mycobacterium tuberculosis
VKWAAICDA

SEQ ID NO: 36117 - protein, 9 aa, Mycobacterium tuberculosis
KWAAICDAA

SEQ ID NO: 36118 - protein, 9 aa, Mycobacterium tuberculosis
WAAICDAAR

SEQ ID NO: 36119 - protein, 9 aa, Mycobacterium tuberculosis
AAICDAARH

SEQ ID NO: 36120 - protein, 9 aa, Mycobacterium tuberculosis
AICDAARHW

SEQ ID NO: 36121 - protein, 9 aa, Mycobacterium tuberculosis
ICDAARHWA

SEQ ID NO: 36122 - protein, 9 aa, Mycobacterium tuberculosis
CDAARHWAL

SEQ ID NO: 36123 - protein, 9 aa, Mycobacterium tuberculosis
DAARHWALR

SEQ ID NO: 36124 - protein, 9 aa, Mycobacterium tuberculosis
AARHWALRV

SEQ ID NO: 36125 - protein, 9 aa, Mycobacterium tuberculosis
ARHWALRVE

SEQ ID NO: 36126 - protein, 9 aa, Mycobacterium tuberculosis
RHWALRVET

SEQ ID NO: 36127 - protein, 9 aa, Mycobacterium tuberculosis
HWALRVETC

SEQ ID NO: 36128 - protein, 9 aa, Mycobacterium tuberculosis
WALRVETCQ

SEQ ID NO: 36129 - protein, 9 aa, Mycobacterium tuberculosis
ALRVETCQA

SEQ ID NO: 36130 - protein, 9 aa, Mycobacterium tuberculosis
LRVETCQAA

SEQ ID NO: 36131 - protein, 9 aa, Mycobacterium tuberculosis
RVETCQAAS

SEQ ID NO: 36132 - protein, 9 aa, Mycobacterium tuberculosis
VETCQAASA

SEQ ID NO: 36133 - protein, 9 aa, Mycobacterium tuberculosis
ETCQAASAE

SEQ ID NO: 36134 - protein, 9 aa, Mycobacterium tuberculosis
TCQAASAEA

SEQ ID NO: 36135 - protein, 9 aa, Mycobacterium tuberculosis
CQAASAEAS

SEQ ID NO: 36136 - protein, 9 aa, Mycobacterium tuberculosis
QAASAEASR

SEQ ID NO: 36137 - protein, 9 aa, Mycobacterium tuberculosis
AASAEASRD

SEQ ID NO: 36138 - protein, 9 aa, Mycobacterium tuberculosis
ASAEASRDV

SEQ ID NO: 36139 - protein, 9 aa, Mycobacterium tuberculosis
SAEASRDVS

SEQ ID NO: 36140 - protein, 9 aa, Mycobacterium tuberculosis
AEASRDVSA

SEQ ID NO: 36141 - protein, 9 aa, Mycobacterium tuberculosis
EASRDVSAA

SEQ ID NO: 36142 - protein, 9 aa, Mycobacterium tuberculosis
ASRDVSAAA

SEQ ID NO: 36143 - protein, 9 aa, Mycobacterium tuberculosis
SRDVSAAAD

SEQ ID NO: 36144 - protein, 9 aa, Mycobacterium tuberculosis
RDVSAAADW

SEQ ID NO: 36145 - protein, 9 aa, Mycobacterium tuberculosis
DVSAAADWP

SEQ ID NO: 36146 - protein, 9 aa, Mycobacterium tuberculosis
VSAAADWPA

SEQ ID NO: 36147 - protein, 9 aa, Mycobacterium tuberculosis
SAAADWPAV

SEQ ID NO: 36148 - protein, 9 aa, Mycobacterium tuberculosis
AAADWPAVS

SEQ ID NO: 36149 - protein, 9 aa, Mycobacterium tuberculosis
AADWPAVSR

SEQ ID NO: 36150 - protein, 9 aa, Mycobacterium tuberculosis
ADWPAVSRE

SEQ ID NO: 36151 - protein, 9 aa, Mycobacterium tuberculosis
DWPAVSREI

SEQ ID NO: 36152 - protein, 9 aa, Mycobacterium tuberculosis
WPAVSREIQ

SEQ ID NO: 36153 - protein, 9 aa, Mycobacterium tuberculosis
PAVSREIQR

SEQ ID NO: 36154 - protein, 9 aa, Mycobacterium tuberculosis
AVSREIQRR

SEQ ID NO: 36155 - protein, 9 aa, Mycobacterium tuberculosis
VSREIQRRR

SEQ ID NO: 36156 - protein, 9 aa, Mycobacterium tuberculosis
SREIQRRRD

SEQ ID NO: 36157 - protein, 9 aa, Mycobacterium tuberculosis
REIQRRRDA

SEQ ID NO: 36158 - protein, 9 aa, Mycobacterium tuberculosis
EIQRRRDAY

SEQ ID NO: 36159 - protein, 9 aa, Mycobacterium tuberculosis
IQRRRDAYI

SEQ ID NO: 36160 - protein, 9 aa, Mycobacterium tuberculosis
QRRRDAYIR

SEQ ID NO: 36161 - protein, 9 aa, Mycobacterium tuberculosis
RRRDAYIRR

SEQ ID NO: 36162 - protein, 9 aa, Mycobacterium tuberculosis
RRDAYIRRV

SEQ ID NO: 36163 - protein, 9 aa, Mycobacterium tuberculosis
RDAYIRRVV

SEQ ID NO: 36164 - protein, 9 aa, Mycobacterium tuberculosis
DAYIRRVVV

SEQ ID NO: 36165 - protein, 10 aa, Mycobacterium tuberculosis
MTAVGGSPPT

SEQ ID NO: 36166 - protein, 10 aa, Mycobacterium tuberculosis
TAVGGSPPTR

SEQ ID NO: 36167 - protein, 10 aa, Mycobacterium tuberculosis
AVGGSPPTRR

SEQ ID NO: 36168 - protein, 10 aa, Mycobacterium tuberculosis
VGGSPPTRRC

SEQ ID NO: 36169 - protein, 10 aa, Mycobacterium tuberculosis
GGSPPTRRCP

SEQ ID NO: 36170 - protein, 10 aa, Mycobacterium tuberculosis
GSPPTRRCPA

SEQ ID NO: 36171 - protein, 10 aa, Mycobacterium tuberculosis
SPPTRRCPAT

SEQ ID NO: 36172 - protein, 10 aa, Mycobacterium tuberculosis
PPTRRCPATE

SEQ ID NO: 36173 - protein, 10 aa, Mycobacterium tuberculosis
PTRRCPATED

SEQ ID NO: 36174 - protein, 10 aa, Mycobacterium tuberculosis
TRRCPATEDR

SEQ ID NO: 36175 - protein, 10 aa, Mycobacterium tuberculosis
RRCPATEDRA

SEQ ID NO: 36176 - protein, 10 aa, Mycobacterium tuberculosis
RCPATEDRAP

SEQ ID NO: 36177 - protein, 10 aa, Mycobacterium tuberculosis
CPATEDRAPA

SEQ ID NO: 36178 - protein, 10 aa, Mycobacterium tuberculosis
PATEDRAPAT

SEQ ID NO: 36179 - protein, 10 aa, Mycobacterium tuberculosis
ATEDRAPATV

SEQ ID NO: 36180 - protein, 10 aa, Mycobacterium tuberculosis
TEDRAPATVA

SEQ ID NO: 36181 - protein, 10 aa, Mycobacterium tuberculosis
EDRAPATVAT

SEQ ID NO: 36182 - protein, 10 aa, Mycobacterium tuberculosis
DRAPATVATP

SEQ ID NO: 36183 - protein, 10 aa, Mycobacterium tuberculosis
RAPATVATPS

SEQ ID NO: 36184 - protein, 10 aa, Mycobacterium tuberculosis
APATVATPSS

SEQ ID NO: 36185 - protein, 10 aa, Mycobacterium tuberculosis
PATVATPSST

SEQ ID NO: 36186 - protein, 10 aa, Mycobacterium tuberculosis
ATVATPSSTD

SEQ ID NO: 36187 - protein, 10 aa, Mycobacterium tuberculosis
TVATPSSTDP

SEQ ID NO: 36188 - protein, 10 aa, Mycobacterium tuberculosis
VATPSSTDPT

SEQ ID NO: 36189 - protein, 10 aa, Mycobacterium tuberculosis
ATPSSTDPTA

SEQ ID NO: 36190 - protein, 10 aa, Mycobacterium tuberculosis
TPSSTDPTAS

SEQ ID NO: 36191 - protein, 10 aa, Mycobacterium tuberculosis
PSSTDPTASR

SEQ ID NO: 36192 - protein, 10 aa, Mycobacterium tuberculosis
SSTDPTASRA

SEQ ID NO: 36193 - protein, 10 aa, Mycobacterium tuberculosis
STDPTASRAV

SEQ ID NO: 36194 - protein, 10 aa, Mycobacterium tuberculosis
TDPTASRAVS

SEQ ID NO: 36195 - protein, 10 aa, Mycobacterium tuberculosis
DPTASRAVSW

SEQ ID NO: 36196 - protein, 10 aa, Mycobacterium tuberculosis
PTASRAVSWW

SEQ ID NO: 36197 - protein, 10 aa, Mycobacterium tuberculosis
TASRAVSWWS

SEQ ID NO: 36198 - protein, 10 aa, Mycobacterium tuberculosis
ASRAVSWWSV

SEQ ID NO: 36199 - protein, 10 aa, Mycobacterium tuberculosis
SRAVSWWSVH

SEQ ID NO: 36200 - protein, 10 aa, Mycobacterium tuberculosis
RAVSWWSVHE

SEQ ID NO: 36201 - protein, 10 aa, Mycobacterium tuberculosis
AVSWWSVHEY

SEQ ID NO: 36202 - protein, 10 aa, Mycobacterium tuberculosis
VSWWSVHEYV

SEQ ID NO: 36203 - protein, 10 aa, Mycobacterium tuberculosis
SWWSVHEYVA

SEQ ID NO: 36204 - protein, 10 aa, Mycobacterium tuberculosis
WWSVHEYVAP

SEQ ID NO: 36205 - protein, 10 aa, Mycobacterium tuberculosis
WSVHEYVAPT

SEQ ID NO: 36206 - protein, 10 aa, Mycobacterium tuberculosis
SVHEYVAPTL

SEQ ID NO: 36207 - protein, 10 aa, Mycobacterium tuberculosis
VHEYVAPTLA

SEQ ID NO: 36208 - protein, 10 aa, Mycobacterium tuberculosis
HEYVAPTLAA

SEQ ID NO: 36209 - protein, 10 aa, Mycobacterium tuberculosis
EYVAPTLAAA

SEQ ID NO: 36210 - protein, 10 aa, Mycobacterium tuberculosis
YVAPTLAAAV

SEQ ID NO: 36211 - protein, 10 aa, Mycobacterium tuberculosis
VAPTLAAAVE

SEQ ID NO: 36212 - protein, 10 aa, Mycobacterium tuberculosis
APTLAAAVEW

SEQ ID NO: 36213 - protein, 10 aa, Mycobacterium tuberculosis
PTLAAAVEWP

SEQ ID NO: 36214 - protein, 10 aa, Mycobacterium tuberculosis
TLAAAVEWPM

SEQ ID NO: 36215 - protein, 10 aa, Mycobacterium tuberculosis
LAAAVEWPMA

SEQ ID NO: 36216 - protein, 10 aa, Mycobacterium tuberculosis
AAAVEWPMAG

SEQ ID NO: 36217 - protein, 10 aa, Mycobacterium tuberculosis
AAVEWPMAGT

SEQ ID NO: 36218 - protein, 10 aa, Mycobacterium tuberculosis
AVEWPMAGTP

SEQ ID NO: 36219 - protein, 10 aa, Mycobacterium tuberculosis
VEWPMAGTPA

SEQ ID NO: 36220 - protein, 10 aa, Mycobacterium tuberculosis
EWPMAGTPAW

SEQ ID NO: 36221 - protein, 10 aa, Mycobacterium tuberculosis
WPMAGTPAWC

SEQ ID NO: 36222 - protein, 10 aa, Mycobacterium tuberculosis
PMAGTPAWCD

SEQ ID NO: 36223 - protein, 10 aa, Mycobacterium tuberculosis
MAGTPAWCDL

SEQ ID NO: 36224 - protein, 10 aa, Mycobacterium tuberculosis
AGTPAWCDLD

SEQ ID NO: 36225 - protein, 10 aa, Mycobacterium tuberculosis
GTPAWCDLDD

SEQ ID NO: 36226 - protein, 10 aa, Mycobacterium tuberculosis
TPAWCDLDDT

SEQ ID NO: 36227 - protein, 10 aa, Mycobacterium tuberculosis
PAWCDLDDTD

SEQ ID NO: 36228 - protein, 10 aa, Mycobacterium tuberculosis
AWCDLDDTDP

SEQ ID NO: 36229 - protein, 10 aa, Mycobacterium tuberculosis
WCDLDDTDPV

SEQ ID NO: 36230 - protein, 10 aa, Mycobacterium tuberculosis
CDLDDTDPVK

SEQ ID NO: 36231 - protein, 10 aa, Mycobacterium tuberculosis
DLDDTDPVKW

SEQ ID NO: 36232 - protein, 10 aa, Mycobacterium tuberculosis
LDDTDPVKWA

SEQ ID NO: 36233 - protein, 10 aa, Mycobacterium tuberculosis
DDTDPVKWAA

SEQ ID NO: 36234 - protein, 10 aa, Mycobacterium tuberculosis
DTDPVKWAAI

SEQ ID NO: 36235 - protein, 10 aa, Mycobacterium tuberculosis
TDPVKWAAIC

SEQ ID NO: 36236 - protein, 10 aa, Mycobacterium tuberculosis
DPVKWAAICD

SEQ ID NO: 36237 - protein, 10 aa, Mycobacterium tuberculosis
PVKWAAICDA

SEQ ID NO: 36238 - protein, 10 aa, Mycobacterium tuberculosis
VKWAAICDAA

SEQ ID NO: 36239 - protein, 10 aa, Mycobacterium tuberculosis
KWAAICDAAR

SEQ ID NO: 36240 - protein, 10 aa, Mycobacterium tuberculosis
WAAICDAARH

SEQ ID NO: 36241 - protein, 10 aa, Mycobacterium tuberculosis
AAICDAARHW

SEQ ID NO: 36242 - protein, 10 aa, Mycobacterium tuberculosis
AICDAARHWA

SEQ ID NO: 36243 - protein, 10 aa, Mycobacterium tuberculosis
ICDAARHWAL

SEQ ID NO: 36244 - protein, 10 aa, Mycobacterium tuberculosis
CDAARHWALR

SEQ ID NO: 36245 - protein, 10 aa, Mycobacterium tuberculosis
DAARHWALRV

SEQ ID NO: 36246 - protein, 10 aa, Mycobacterium tuberculosis
AARHWALRVE

SEQ ID NO: 36247 - protein, 10 aa, Mycobacterium tuberculosis
ARHWALRVET

SEQ ID NO: 36248 - protein, 10 aa, Mycobacterium tuberculosis
RHWALRVETC

SEQ ID NO: 36249 - protein, 10 aa, Mycobacterium tuberculosis
HWALRVETCQ

SEQ ID NO: 36250 - protein, 10 aa, Mycobacterium tuberculosis
WALRVETCQA

SEQ ID NO: 36251 - protein, 10 aa, Mycobacterium tuberculosis
ALRVETCQAA

SEQ ID NO: 36252 - protein, 10 aa, Mycobacterium tuberculosis
LRVETCQAAS

SEQ ID NO: 36253 - protein, 10 aa, Mycobacterium tuberculosis
RVETCQAASA

SEQ ID NO: 36254 - protein, 10 aa, Mycobacterium tuberculosis
VETCQAASAE

SEQ ID NO: 36255 - protein, 10 aa, Mycobacterium tuberculosis
ETCQAASAEA

SEQ ID NO: 36256 - protein, 10 aa, Mycobacterium tuberculosis
TCQAASAEAS

SEQ ID NO: 36257 - protein, 10 aa, Mycobacterium tuberculosis
CQAASAEASR

SEQ ID NO: 36258 - protein, 10 aa, Mycobacterium tuberculosis
QAASAEASRD

SEQ ID NO: 36259 - protein, 10 aa, Mycobacterium tuberculosis
AASAEASRDV

SEQ ID NO: 36260 - protein, 10 aa, Mycobacterium tuberculosis
ASAEASRDVS

SEQ ID NO: 36261 - protein, 10 aa, Mycobacterium tuberculosis
SAEASRDVSA

SEQ ID NO: 36262 - protein, 10 aa, Mycobacterium tuberculosis
AEASRDVSAA

SEQ ID NO: 36263 - protein, 10 aa, Mycobacterium tuberculosis
EASRDVSAAA

SEQ ID NO: 36264 - protein, 10 aa, Mycobacterium tuberculosis
ASRDVSAAAD

SEQ ID NO: 36265 - protein, 10 aa, Mycobacterium tuberculosis
SRDVSAAADW

SEQ ID NO: 36266 - protein, 10 aa, Mycobacterium tuberculosis
RDVSAAADWP

SEQ ID NO: 36267 - protein, 10 aa, Mycobacterium tuberculosis
DVSAAADWPA

SEQ ID NO: 36268 - protein, 10 aa, Mycobacterium tuberculosis
VSAAADWPAV

SEQ ID NO: 36269 - protein, 10 aa, Mycobacterium tuberculosis
SAAADWPAVS

SEQ ID NO: 36270 - protein, 10 aa, Mycobacterium tuberculosis
AAADWPAVSR

SEQ ID NO: 36271 - protein, 10 aa, Mycobacterium tuberculosis
AADWPAVSRE

SEQ ID NO: 36272 - protein, 10 aa, Mycobacterium tuberculosis
ADWPAVSREI

SEQ ID NO: 36273 - protein, 10 aa, Mycobacterium tuberculosis
DWPAVSREIQ

SEQ ID NO: 36274 - protein, 10 aa, Mycobacterium tuberculosis
WPAVSREIQR

SEQ ID NO: 36275 - protein, 10 aa, Mycobacterium tuberculosis
PAVSREIQRR

SEQ ID NO: 36276 - protein, 10 aa, Mycobacterium tuberculosis
AVSREIQRRR

SEQ ID NO: 36277 - protein, 10 aa, Mycobacterium tuberculosis
VSREIQRRRD

SEQ ID NO: 36278 - protein, 10 aa, Mycobacterium tuberculosis
SREIQRRRDA

SEQ ID NO: 36279 - protein, 10 aa, Mycobacterium tuberculosis
REIQRRRDAY

SEQ ID NO: 36280 - protein, 10 aa, Mycobacterium tuberculosis
EIQRRRDAYI

SEQ ID NO: 36281 - protein, 10 aa, Mycobacterium tuberculosis
IQRRRDAYIR

SEQ ID NO: 36282 - protein, 10 aa, Mycobacterium tuberculosis
QRRRDAYIRR

SEQ ID NO: 36283 - protein, 10 aa, Mycobacterium tuberculosis
RRRDAYIRRV

SEQ ID NO: 36284 - protein, 10 aa, Mycobacterium tuberculosis
RRDAYIRRVV

SEQ ID NO: 36285 - protein, 10 aa, Mycobacterium tuberculosis
RDAYIRRVVV

SEQ ID NO: 36286 - protein, 11 aa, Mycobacterium tuberculosis
MTAVGGSPPTR

SEQ ID NO: 36287 - protein, 11 aa, Mycobacterium tuberculosis
TAVGGSPPTRR

SEQ ID NO: 36288 - protein, 11 aa, Mycobacterium tuberculosis
AVGGSPPTRRC

SEQ ID NO: 36289 - protein, 11 aa, Mycobacterium tuberculosis
VGGSPPTRRCP

SEQ ID NO: 36290 - protein, 11 aa, Mycobacterium tuberculosis
GGSPPTRRCPA

SEQ ID NO: 36291 - protein, 11 aa, Mycobacterium tuberculosis
GSPPTRRCPAT

SEQ ID NO: 36292 - protein, 11 aa, Mycobacterium tuberculosis
SPPTRRCPATE

SEQ ID NO: 36293 - protein, 11 aa, Mycobacterium tuberculosis
PPTRRCPATED

SEQ ID NO: 36294 - protein, 11 aa, Mycobacterium tuberculosis
PTRRCPATEDR

SEQ ID NO: 36295 - protein, 11 aa, Mycobacterium tuberculosis
TRRCPATEDRA

SEQ ID NO: 36296 - protein, 11 aa, Mycobacterium tuberculosis
RRCPATEDRAP

SEQ ID NO: 36297 - protein, 11 aa, Mycobacterium tuberculosis
RCPATEDRAPA

SEQ ID NO: 36298 - protein, 11 aa, Mycobacterium tuberculosis
CPATEDRAPAT

SEQ ID NO: 36299 - protein, 11 aa, Mycobacterium tuberculosis
PATEDRAPATV

SEQ ID NO: 36300 - protein, 11 aa, Mycobacterium tuberculosis
ATEDRAPATVA

SEQ ID NO: 36301 - protein, 11 aa, Mycobacterium tuberculosis
TEDRAPATVAT

SEQ ID NO: 36302 - protein, 11 aa, Mycobacterium tuberculosis
EDRAPATVATP

SEQ ID NO: 36303 - protein, 11 aa, Mycobacterium tuberculosis
DRAPATVATPS

SEQ ID NO: 36304 - protein, 11 aa, Mycobacterium tuberculosis
RAPATVATPSS

SEQ ID NO: 36305 - protein, 11 aa, Mycobacterium tuberculosis
APATVATPSST

SEQ ID NO: 36306 - protein, 11 aa, Mycobacterium tuberculosis
PATVATPSSTD

SEQ ID NO: 36307 - protein, 11 aa, Mycobacterium tuberculosis
ATVATPSSTDP

SEQ ID NO: 36308 - protein, 11 aa, Mycobacterium tuberculosis
TVATPSSTDPT

SEQ ID NO: 36309 - protein, 11 aa, Mycobacterium tuberculosis
VATPSSTDPTA

SEQ ID NO: 36310 - protein, 11 aa, Mycobacterium tuberculosis
ATPSSTDPTAS

SEQ ID NO: 36311 - protein, 11 aa, Mycobacterium tuberculosis
TPSSTDPTASR

SEQ ID NO: 36312 - protein, 11 aa, Mycobacterium tuberculosis
PSSTDPTASRA

SEQ ID NO: 36313 - protein, 11 aa, Mycobacterium tuberculosis
SSTDPTASRAV

SEQ ID NO: 36314 - protein, 11 aa, Mycobacterium tuberculosis
STDPTASRAVS

SEQ ID NO: 36315 - protein, 11 aa, Mycobacterium tuberculosis
TDPTASRAVSW

SEQ ID NO: 36316 - protein, 11 aa, Mycobacterium tuberculosis
DPTASRAVSWW

SEQ ID NO: 36317 - protein, 11 aa, Mycobacterium tuberculosis
PTASRAVSWWS

SEQ ID NO: 36318 - protein, 11 aa, Mycobacterium tuberculosis
TASRAVSWWSV

SEQ ID NO: 36319 - protein, 11 aa, Mycobacterium tuberculosis
ASRAVSWWSVH

SEQ ID NO: 36320 - protein, 11 aa, Mycobacterium tuberculosis
SRAVSWWSVHE

SEQ ID NO: 36321 - protein, 11 aa, Mycobacterium tuberculosis
RAVSWWSVHEY

SEQ ID NO: 36322 - protein, 11 aa, Mycobacterium tuberculosis
AVSWWSVHEYV

SEQ ID NO: 36323 - protein, 11 aa, Mycobacterium tuberculosis
VSWWSVHEYVA

SEQ ID NO: 36324 - protein, 11 aa, Mycobacterium tuberculosis
SWWSVHEYVAP

SEQ ID NO: 36325 - protein, 11 aa, Mycobacterium tuberculosis
WWSVHEYVAPT

SEQ ID NO: 36326 - protein, 11 aa, Mycobacterium tuberculosis
WSVHEYVAPTL

SEQ ID NO: 36327 - protein, 11 aa, Mycobacterium tuberculosis
SVHEYVAPTLA

SEQ ID NO: 36328 - protein, 11 aa, Mycobacterium tuberculosis
VHEYVAPTLAA

SEQ ID NO: 36329 - protein, 11 aa, Mycobacterium tuberculosis
HEYVAPTLAAA

SEQ ID NO: 36330 - protein, 11 aa, Mycobacterium tuberculosis
EYVAPTLAAAV

SEQ ID NO: 36331 - protein, 11 aa, Mycobacterium tuberculosis
YVAPTLAAAVE

SEQ ID NO: 36332 - protein, 11 aa, Mycobacterium tuberculosis
VAPTLAAAVEW

SEQ ID NO: 36333 - protein, 11 aa, Mycobacterium tuberculosis
APTLAAAVEWP

SEQ ID NO: 36334 - protein, 11 aa, Mycobacterium tuberculosis
PTLAAAVEWPM

SEQ ID NO: 36335 - protein, 11 aa, Mycobacterium tuberculosis
TLAAAVEWPMA

SEQ ID NO: 36336 - protein, 11 aa, Mycobacterium tuberculosis
LAAAVEWPMAG

SEQ ID NO: 36337 - protein, 11 aa, Mycobacterium tuberculosis
AAAVEWPMAGT

SEQ ID NO: 36338 - protein, 11 aa, Mycobacterium tuberculosis
AAVEWPMAGTP

SEQ ID NO: 36339 - protein, 11 aa, Mycobacterium tuberculosis
AVEWPMAGTPA

SEQ ID NO: 36340 - protein, 11 aa, Mycobacterium tuberculosis
VEWPMAGTPAW

SEQ ID NO: 36341 - protein, 11 aa, Mycobacterium tuberculosis
EWPMAGTPAWC

SEQ ID NO: 36342 - protein, 11 aa, Mycobacterium tuberculosis
WPMAGTPAWCD

SEQ ID NO: 36343 - protein, 11 aa, Mycobacterium tuberculosis
PMAGTPAWCDL

SEQ ID NO: 36344 - protein, 11 aa, Mycobacterium tuberculosis
MAGTPAWCDLD

SEQ ID NO: 36345 - protein, 11 aa, Mycobacterium tuberculosis
AGTPAWCDLDD

SEQ ID NO: 36346 - protein, 11 aa, Mycobacterium tuberculosis
GTPAWCDLDDT

SEQ ID NO: 36347 - protein, 11 aa, Mycobacterium tuberculosis
TPAWCDLDDTD

SEQ ID NO: 36348 - protein, 11 aa, Mycobacterium tuberculosis
PAWCDLDDTDP

SEQ ID NO: 36349 - protein, 11 aa, Mycobacterium tuberculosis
AWCDLDDTDPV

SEQ ID NO: 36350 - protein, 11 aa, Mycobacterium tuberculosis
WCDLDDTDPVK

SEQ ID NO: 36351 - protein, 11 aa, Mycobacterium tuberculosis
CDLDDTDPVKW

SEQ ID NO: 36352 - protein, 11 aa, Mycobacterium tuberculosis
DLDDTDPVKWA

SEQ ID NO: 36353 - protein, 11 aa, Mycobacterium tuberculosis
LDDTDPVKWAA

SEQ ID NO: 36354 - protein, 11 aa, Mycobacterium tuberculosis
DDTDPVKWAAI

SEQ ID NO: 36355 - protein, 11 aa, Mycobacterium tuberculosis
DTDPVKWAAIC

SEQ ID NO: 36356 - protein, 11 aa, Mycobacterium tuberculosis
TDPVKWAAICD

SEQ ID NO: 36357 - protein, 11 aa, Mycobacterium tuberculosis
DPVKWAAICDA

SEQ ID NO: 36358 - protein, 11 aa, Mycobacterium tuberculosis
PVKWAAICDAA

SEQ ID NO: 36359 - protein, 11 aa, Mycobacterium tuberculosis
VKWAAICDAAR

SEQ ID NO: 36360 - protein, 11 aa, Mycobacterium tuberculosis
KWAAICDAARH

SEQ ID NO: 36361 - protein, 11 aa, Mycobacterium tuberculosis
WAAICDAARHW

SEQ ID NO: 36362 - protein, 11 aa, Mycobacterium tuberculosis
AAICDAARHWA

SEQ ID NO: 36363 - protein, 11 aa, Mycobacterium tuberculosis
AICDAARHWAL

SEQ ID NO: 36364 - protein, 11 aa, Mycobacterium tuberculosis
ICDAARHWALR

SEQ ID NO: 36365 - protein, 11 aa, Mycobacterium tuberculosis
CDAARHWALRV

SEQ ID NO: 36366 - protein, 11 aa, Mycobacterium tuberculosis
DAARHWALRVE

SEQ ID NO: 36367 - protein, 11 aa, Mycobacterium tuberculosis
AARHWALRVET

SEQ ID NO: 36368 - protein, 11 aa, Mycobacterium tuberculosis
ARHWALRVETC

SEQ ID NO: 36369 - protein, 11 aa, Mycobacterium tuberculosis
RHWALRVETCQ

SEQ ID NO: 36370 - protein, 11 aa, Mycobacterium tuberculosis
HWALRVETCQA

SEQ ID NO: 36371 - protein, 11 aa, Mycobacterium tuberculosis
WALRVETCQAA

SEQ ID NO: 36372 - protein, 11 aa, Mycobacterium tuberculosis
ALRVETCQAAS

SEQ ID NO: 36373 - protein, 11 aa, Mycobacterium tuberculosis
LRVETCQAASA

SEQ ID NO: 36374 - protein, 11 aa, Mycobacterium tuberculosis
RVETCQAASAE

SEQ ID NO: 36375 - protein, 11 aa, Mycobacterium tuberculosis
VETCQAASAEA

SEQ ID NO: 36376 - protein, 11 aa, Mycobacterium tuberculosis
ETCQAASAEAS

SEQ ID NO: 36377 - protein, 11 aa, Mycobacterium tuberculosis
TCQAASAEASR

SEQ ID NO: 36378 - protein, 11 aa, Mycobacterium tuberculosis
CQAASAEASRD

SEQ ID NO: 36379 - protein, 11 aa, Mycobacterium tuberculosis
QAASAEASRDV

SEQ ID NO: 36380 - protein, 11 aa, Mycobacterium tuberculosis
AASAEASRDVS

SEQ ID NO: 36381 - protein, 11 aa, Mycobacterium tuberculosis
ASAEASRDVSA

SEQ ID NO: 36382 - protein, 11 aa, Mycobacterium tuberculosis
SAEASRDVSAA

SEQ ID NO: 36383 - protein, 11 aa, Mycobacterium tuberculosis
AEASRDVSAAA

SEQ ID NO: 36384 - protein, 11 aa, Mycobacterium tuberculosis
EASRDVSAAAD

SEQ ID NO: 36385 - protein, 11 aa, Mycobacterium tuberculosis
ASRDVSAAADW

SEQ ID NO: 36386 - protein, 11 aa, Mycobacterium tuberculosis
SRDVSAAADWP

SEQ ID NO: 36387 - protein, 11 aa, Mycobacterium tuberculosis
RDVSAAADWPA

SEQ ID NO: 36388 - protein, 11 aa, Mycobacterium tuberculosis
DVSAAADWPAV

SEQ ID NO: 36389 - protein, 11 aa, Mycobacterium tuberculosis
VSAAADWPAVS

SEQ ID NO: 36390 - protein, 11 aa, Mycobacterium tuberculosis
SAAADWPAVSR

SEQ ID NO: 36391 - protein, 11 aa, Mycobacterium tuberculosis
AAADWPAVSRE

SEQ ID NO: 36392 - protein, 11 aa, Mycobacterium tuberculosis
AADWPAVSREI

SEQ ID NO: 36393 - protein, 11 aa, Mycobacterium tuberculosis
ADWPAVSREIQ

SEQ ID NO: 36394 - protein, 11 aa, Mycobacterium tuberculosis
DWPAVSREIQR

SEQ ID NO: 36395 - protein, 11 aa, Mycobacterium tuberculosis
WPAVSREIQRR

SEQ ID NO: 36396 - protein, 11 aa, Mycobacterium tuberculosis
PAVSREIQRRR

SEQ ID NO: 36397 - protein, 11 aa, Mycobacterium tuberculosis
AVSREIQRRRD

SEQ ID NO: 36398 - protein, 11 aa, Mycobacterium tuberculosis
VSREIQRRRDA

SEQ ID NO: 36399 - protein, 11 aa, Mycobacterium tuberculosis
SREIQRRRDAY

SEQ ID NO: 36400 - protein, 11 aa, Mycobacterium tuberculosis
REIQRRRDAYI

SEQ ID NO: 36401 - protein, 11 aa, Mycobacterium tuberculosis
EIQRRRDAYIR

SEQ ID NO: 36402 - protein, 11 aa, Mycobacterium tuberculosis
IQRRRDAYIRR

SEQ ID NO: 36403 - protein, 11 aa, Mycobacterium tuberculosis
QRRRDAYIRRV

SEQ ID NO: 36404 - protein, 11 aa, Mycobacterium tuberculosis
RRRDAYIRRVV

SEQ ID NO: 36405 - protein, 11 aa, Mycobacterium tuberculosis
RRDAYIRRVVV

SEQ ID NO: 36406 - protein, 8 aa, Mycobacterium tuberculosis
MCAFPSPS

SEQ ID NO: 36407 - protein, 8 aa, Mycobacterium tuberculosis
CAFPSPSL

SEQ ID NO: 36408 - protein, 8 aa, Mycobacterium tuberculosis
AFPSPSLG

SEQ ID NO: 36409 - protein, 8 aa, Mycobacterium tuberculosis
FPSPSLGW

SEQ ID NO: 36410 - protein, 8 aa, Mycobacterium tuberculosis
PSPSLGWT

SEQ ID NO: 36411 - protein, 8 aa, Mycobacterium tuberculosis
SPSLGWTV

SEQ ID NO: 36412 - protein, 8 aa, Mycobacterium tuberculosis
PSLGWTVS

SEQ ID NO: 36413 - protein, 8 aa, Mycobacterium tuberculosis
SLGWTVSH

SEQ ID NO: 36414 - protein, 8 aa, Mycobacterium tuberculosis
LGWTVSHE

SEQ ID NO: 36415 - protein, 8 aa, Mycobacterium tuberculosis
GWTVSHET

SEQ ID NO: 36416 - protein, 8 aa, Mycobacterium tuberculosis
WTVSHETE

SEQ ID NO: 36417 - protein, 8 aa, Mycobacterium tuberculosis
TVSHETER

SEQ ID NO: 36418 - protein, 8 aa, Mycobacterium tuberculosis
VSHETERP

SEQ ID NO: 36419 - protein, 8 aa, Mycobacterium tuberculosis
SHETERPG

SEQ ID NO: 36420 - protein, 8 aa, Mycobacterium tuberculosis
HETERPGM

SEQ ID NO: 36421 - protein, 8 aa, Mycobacterium tuberculosis
ETERPGMA

SEQ ID NO: 36422 - protein, 8 aa, Mycobacterium tuberculosis
TERPGMAD

SEQ ID NO: 36423 - protein, 8 aa, Mycobacterium tuberculosis
ERPGMADA

SEQ ID NO: 36424 - protein, 8 aa, Mycobacterium tuberculosis
RPGMADAP

SEQ ID NO: 36425 - protein, 8 aa, Mycobacterium tuberculosis
PGMADAPP

SEQ ID NO: 36426 - protein, 8 aa, Mycobacterium tuberculosis
GMADAPPL

SEQ ID NO: 36427 - protein, 8 aa, Mycobacterium tuberculosis
MADAPPLS

SEQ ID NO: 36428 - protein, 8 aa, Mycobacterium tuberculosis
ADAPPLSR

SEQ ID NO: 36429 - protein, 8 aa, Mycobacterium tuberculosis
DAPPLSRR

SEQ ID NO: 36430 - protein, 8 aa, Mycobacterium tuberculosis
APPLSRRY

SEQ ID NO: 36431 - protein, 8 aa, Mycobacterium tuberculosis
PPLSRRYI

SEQ ID NO: 36432 - protein, 8 aa, Mycobacterium tuberculosis
PLSRRYIT

SEQ ID NO: 36433 - protein, 8 aa, Mycobacterium tuberculosis
LSRRYITI

SEQ ID NO: 36434 - protein, 8 aa, Mycobacterium tuberculosis
SRRYITIS

SEQ ID NO: 36435 - protein, 8 aa, Mycobacterium tuberculosis
RRYITISE

SEQ ID NO: 36436 - protein, 8 aa, Mycobacterium tuberculosis
RYITISEA

SEQ ID NO: 36437 - protein, 8 aa, Mycobacterium tuberculosis
YITISEAA

SEQ ID NO: 36438 - protein, 8 aa, Mycobacterium tuberculosis
ITISEAAE

SEQ ID NO: 36439 - protein, 8 aa, Mycobacterium tuberculosis
TISEAAEY

SEQ ID NO: 36440 - protein, 8 aa, Mycobacterium tuberculosis
ISEAAEYL

SEQ ID NO: 36441 - protein, 8 aa, Mycobacterium tuberculosis
SEAAEYLA

SEQ ID NO: 36442 - protein, 8 aa, Mycobacterium tuberculosis
EAAEYLAV

SEQ ID NO: 36443 - protein, 8 aa, Mycobacterium tuberculosis
AAEYLAVT

SEQ ID NO: 36444 - protein, 8 aa, Mycobacterium tuberculosis
AEYLAVTD

SEQ ID NO: 36445 - protein, 8 aa, Mycobacterium tuberculosis
EYLAVTDR

SEQ ID NO: 36446 - protein, 8 aa, Mycobacterium tuberculosis
YLAVTDRT

SEQ ID NO: 36447 - protein, 8 aa, Mycobacterium tuberculosis
LAVTDRTV

SEQ ID NO: 36448 - protein, 8 aa, Mycobacterium tuberculosis
AVTDRTVR

SEQ ID NO: 36449 - protein, 8 aa, Mycobacterium tuberculosis
VTDRTVRQ

SEQ ID NO: 36450 - protein, 8 aa, Mycobacterium tuberculosis
TDRTVRQM

SEQ ID NO: 36451 - protein, 8 aa, Mycobacterium tuberculosis
DRTVRQMI

SEQ ID NO: 36452 - protein, 8 aa, Mycobacterium tuberculosis
RTVRQMIA

SEQ ID NO: 36453 - protein, 8 aa, Mycobacterium tuberculosis
TVRQMIAD

SEQ ID NO: 36454 - protein, 8 aa, Mycobacterium tuberculosis
VRQMIADG

SEQ ID NO: 36455 - protein, 8 aa, Mycobacterium tuberculosis
RQMIADGR

SEQ ID NO: 36456 - protein, 8 aa, Mycobacterium tuberculosis
QMIADGRL

SEQ ID NO: 36457 - protein, 8 aa, Mycobacterium tuberculosis
MIADGRLR

SEQ ID NO: 36458 - protein, 8 aa, Mycobacterium tuberculosis
IADGRLRG

SEQ ID NO: 36459 - protein, 8 aa, Mycobacterium tuberculosis
ADGRLRGY

SEQ ID NO: 36460 - protein, 8 aa, Mycobacterium tuberculosis
DGRLRGYR

SEQ ID NO: 36461 - protein, 8 aa, Mycobacterium tuberculosis
GRLRGYRS

SEQ ID NO: 36462 - protein, 8 aa, Mycobacterium tuberculosis
RLRGYRSG

SEQ ID NO: 36463 - protein, 8 aa, Mycobacterium tuberculosis
LRGYRSGT

SEQ ID NO: 36464 - protein, 8 aa, Mycobacterium tuberculosis
RGYRSGTR

SEQ ID NO: 36465 - protein, 8 aa, Mycobacterium tuberculosis
GYRSGTRL

SEQ ID NO: 36466 - protein, 8 aa, Mycobacterium tuberculosis
YRSGTRLV

SEQ ID NO: 36467 - protein, 8 aa, Mycobacterium tuberculosis
RSGTRLVR

SEQ ID NO: 36468 - protein, 8 aa, Mycobacterium tuberculosis
SGTRLVRL

SEQ ID NO: 36469 - protein, 8 aa, Mycobacterium tuberculosis
GTRLVRLR

SEQ ID NO: 36470 - protein, 8 aa, Mycobacterium tuberculosis
TRLVRLRR

SEQ ID NO: 36471 - protein, 8 aa, Mycobacterium tuberculosis
RLVRLRRD

SEQ ID NO: 36472 - protein, 8 aa, Mycobacterium tuberculosis
LVRLRRDE

SEQ ID NO: 36473 - protein, 8 aa, Mycobacterium tuberculosis
VRLRRDEV

SEQ ID NO: 36474 - protein, 8 aa, Mycobacterium tuberculosis
RLRRDEVD

SEQ ID NO: 36475 - protein, 8 aa, Mycobacterium tuberculosis
LRRDEVDG

SEQ ID NO: 36476 - protein, 8 aa, Mycobacterium tuberculosis
RRDEVDGA

SEQ ID NO: 36477 - protein, 8 aa, Mycobacterium tuberculosis
RDEVDGAM

SEQ ID NO: 36478 - protein, 8 aa, Mycobacterium tuberculosis
DEVDGAMH

SEQ ID NO: 36479 - protein, 8 aa, Mycobacterium tuberculosis
EVDGAMHP

SEQ ID NO: 36480 - protein, 8 aa, Mycobacterium tuberculosis
VDGAMHPF

SEQ ID NO: 36481 - protein, 8 aa, Mycobacterium tuberculosis
DGAMHPFG

SEQ ID NO: 36482 - protein, 8 aa, Mycobacterium tuberculosis
GAMHPFGG

SEQ ID NO: 36483 - protein, 8 aa, Mycobacterium tuberculosis
AMHPFGGA

SEQ ID NO: 36484 - protein, 8 aa, Mycobacterium tuberculosis
MHPFGGAA

SEQ ID NO: 36485 - protein, 9 aa, Mycobacterium tuberculosis
MCAFPSPSL

SEQ ID NO: 36486 - protein, 9 aa, Mycobacterium tuberculosis
CAFPSPSLG

SEQ ID NO: 36487 - protein, 9 aa, Mycobacterium tuberculosis
AFPSPSLGW

SEQ ID NO: 36488 - protein, 9 aa, Mycobacterium tuberculosis
FPSPSLGWT

SEQ ID NO: 36489 - protein, 9 aa, Mycobacterium tuberculosis
PSPSLGWTV

SEQ ID NO: 36490 - protein, 9 aa, Mycobacterium tuberculosis
SPSLGWTVS

SEQ ID NO: 36491 - protein, 9 aa, Mycobacterium tuberculosis
PSLGWTVSH

SEQ ID NO: 36492 - protein, 9 aa, Mycobacterium tuberculosis
SLGWTVSHE

SEQ ID NO: 36493 - protein, 9 aa, Mycobacterium tuberculosis
LGWTVSHET

SEQ ID NO: 36494 - protein, 9 aa, Mycobacterium tuberculosis
GWTVSHETE

SEQ ID NO: 36495 - protein, 9 aa, Mycobacterium tuberculosis
WTVSHETER

SEQ ID NO: 36496 - protein, 9 aa, Mycobacterium tuberculosis
TVSHETERP

SEQ ID NO: 36497 - protein, 9 aa, Mycobacterium tuberculosis
VSHETERPG

SEQ ID NO: 36498 - protein, 9 aa, Mycobacterium tuberculosis
SHETERPGM

SEQ ID NO: 36499 - protein, 9 aa, Mycobacterium tuberculosis
HETERPGMA

SEQ ID NO: 36500 - protein, 9 aa, Mycobacterium tuberculosis
ETERPGMAD

SEQ ID NO: 36501 - protein, 9 aa, Mycobacterium tuberculosis
TERPGMADA

SEQ ID NO: 36502 - protein, 9 aa, Mycobacterium tuberculosis
ERPGMADAP

SEQ ID NO: 36503 - protein, 9 aa, Mycobacterium tuberculosis
RPGMADAPP

SEQ ID NO: 36504 - protein, 9 aa, Mycobacterium tuberculosis
PGMADAPPL

SEQ ID NO: 36505 - protein, 9 aa, Mycobacterium tuberculosis
GMADAPPLS

SEQ ID NO: 36506 - protein, 9 aa, Mycobacterium tuberculosis
MADAPPLSR

SEQ ID NO: 36507 - protein, 9 aa, Mycobacterium tuberculosis
ADAPPLSRR

SEQ ID NO: 36508 - protein, 9 aa, Mycobacterium tuberculosis
DAPPLSRRY

SEQ ID NO: 36509 - protein, 9 aa, Mycobacterium tuberculosis
APPLSRRYI

SEQ ID NO: 36510 - protein, 9 aa, Mycobacterium tuberculosis
PPLSRRYIT

SEQ ID NO: 36511 - protein, 9 aa, Mycobacterium tuberculosis
PLSRRYITI

SEQ ID NO: 36512 - protein, 9 aa, Mycobacterium tuberculosis
LSRRYITIS

SEQ ID NO: 36513 - protein, 9 aa, Mycobacterium tuberculosis
SRRYITISE

SEQ ID NO: 36514 - protein, 9 aa, Mycobacterium tuberculosis
RRYITISEA

SEQ ID NO: 36515 - protein, 9 aa, Mycobacterium tuberculosis
RYITISEAA

SEQ ID NO: 36516 - protein, 9 aa, Mycobacterium tuberculosis
YITISEAAE

SEQ ID NO: 36517 - protein, 9 aa, Mycobacterium tuberculosis
ITISEAAEY

SEQ ID NO: 36518 - protein, 9 aa, Mycobacterium tuberculosis
TISEAAEYL

SEQ ID NO: 36519 - protein, 9 aa, Mycobacterium tuberculosis
ISEAAEYLA

SEQ ID NO: 36520 - protein, 9 aa, Mycobacterium tuberculosis
SEAAEYLAV

SEQ ID NO: 36521 - protein, 9 aa, Mycobacterium tuberculosis
EAAEYLAVT

SEQ ID NO: 36522 - protein, 9 aa, Mycobacterium tuberculosis
AAEYLAVTD

SEQ ID NO: 36523 - protein, 9 aa, Mycobacterium tuberculosis
AEYLAVTDR

SEQ ID NO: 36524 - protein, 9 aa, Mycobacterium tuberculosis
EYLAVTDRT

SEQ ID NO: 36525 - protein, 9 aa, Mycobacterium tuberculosis
YLAVTDRTV

SEQ ID NO: 36526 - protein, 9 aa, Mycobacterium tuberculosis
LAVTDRTVR

SEQ ID NO: 36527 - protein, 9 aa, Mycobacterium tuberculosis
AVTDRTVRQ

SEQ ID NO: 36528 - protein, 9 aa, Mycobacterium tuberculosis
VTDRTVRQM

SEQ ID NO: 36529 - protein, 9 aa, Mycobacterium tuberculosis
TDRTVRQMI

SEQ ID NO: 36530 - protein, 9 aa, Mycobacterium tuberculosis
DRTVRQMIA

SEQ ID NO: 36531 - protein, 9 aa, Mycobacterium tuberculosis
RTVRQMIAD

SEQ ID NO: 36532 - protein, 9 aa, Mycobacterium tuberculosis
TVRQMIADG

SEQ ID NO: 36533 - protein, 9 aa, Mycobacterium tuberculosis
VRQMIADGR

SEQ ID NO: 36534 - protein, 9 aa, Mycobacterium tuberculosis
RQMIADGRL

SEQ ID NO: 36535 - protein, 9 aa, Mycobacterium tuberculosis
QMIADGRLR

SEQ ID NO: 36536 - protein, 9 aa, Mycobacterium tuberculosis
MIADGRLRG

SEQ ID NO: 36537 - protein, 9 aa, Mycobacterium tuberculosis
IADGRLRGY

SEQ ID NO: 36538 - protein, 9 aa, Mycobacterium tuberculosis
ADGRLRGYR

SEQ ID NO: 36539 - protein, 9 aa, Mycobacterium tuberculosis
DGRLRGYRS

SEQ ID NO: 36540 - protein, 9 aa, Mycobacterium tuberculosis
GRLRGYRSG

SEQ ID NO: 36541 - protein, 9 aa, Mycobacterium tuberculosis
RLRGYRSGT

SEQ ID NO: 36542 - protein, 9 aa, Mycobacterium tuberculosis
LRGYRSGTR

SEQ ID NO: 36543 - protein, 9 aa, Mycobacterium tuberculosis
RGYRSGTRL

SEQ ID NO: 36544 - protein, 9 aa, Mycobacterium tuberculosis
GYRSGTRLV

SEQ ID NO: 36545 - protein, 9 aa, Mycobacterium tuberculosis
YRSGTRLVR

SEQ ID NO: 36546 - protein, 9 aa, Mycobacterium tuberculosis
RSGTRLVRL

SEQ ID NO: 36547 - protein, 9 aa, Mycobacterium tuberculosis
SGTRLVRLR

SEQ ID NO: 36548 - protein, 9 aa, Mycobacterium tuberculosis
GTRLVRLRR

SEQ ID NO: 36549 - protein, 9 aa, Mycobacterium tuberculosis
TRLVRLRRD

SEQ ID NO: 36550 - protein, 9 aa, Mycobacterium tuberculosis
RLVRLRRDE

SEQ ID NO: 36551 - protein, 9 aa, Mycobacterium tuberculosis
LVRLRRDEV

SEQ ID NO: 36552 - protein, 9 aa, Mycobacterium tuberculosis
VRLRRDEVD

SEQ ID NO: 36553 - protein, 9 aa, Mycobacterium tuberculosis
RLRRDEVDG

SEQ ID NO: 36554 - protein, 9 aa, Mycobacterium tuberculosis
LRRDEVDGA

SEQ ID NO: 36555 - protein, 9 aa, Mycobacterium tuberculosis
RRDEVDGAM

SEQ ID NO: 36556 - protein, 9 aa, Mycobacterium tuberculosis
RDEVDGAMH

SEQ ID NO: 36557 - protein, 9 aa, Mycobacterium tuberculosis
DEVDGAMHP

SEQ ID NO: 36558 - protein, 9 aa, Mycobacterium tuberculosis
EVDGAMHPF

SEQ ID NO: 36559 - protein, 9 aa, Mycobacterium tuberculosis
VDGAMHPFG

SEQ ID NO: 36560 - protein, 9 aa, Mycobacterium tuberculosis
DGAMHPFGG

SEQ ID NO: 36561 - protein, 9 aa, Mycobacterium tuberculosis
GAMHPFGGA

SEQ ID NO: 36562 - protein, 10 aa, Mycobacterium tuberculosis
MCAFPSPSLG

SEQ ID NO: 36563 - protein, 10 aa, Mycobacterium tuberculosis
CAFPSPSLGW

SEQ ID NO: 36564 - protein, 10 aa, Mycobacterium tuberculosis
AFPSPSLGWT

SEQ ID NO: 36565 - protein, 10 aa, Mycobacterium tuberculosis
FPSPSLGWTV

SEQ ID NO: 36566 - protein, 10 aa, Mycobacterium tuberculosis
PSPSLGWTVS

SEQ ID NO: 36567 - protein, 10 aa, Mycobacterium tuberculosis
SPSLGWTVSH

SEQ ID NO: 36568 - protein, 10 aa, Mycobacterium tuberculosis
PSLGWTVSHE

SEQ ID NO: 36569 - protein, 10 aa, Mycobacterium tuberculosis
SLGWTVSHET

SEQ ID NO: 36570 - protein, 10 aa, Mycobacterium tuberculosis
LGWTVSHETE

SEQ ID NO: 36571 - protein, 10 aa, Mycobacterium tuberculosis
GWTVSHETER

SEQ ID NO: 36572 - protein, 10 aa, Mycobacterium tuberculosis
WTVSHETERP

SEQ ID NO: 36573 - protein, 10 aa, Mycobacterium tuberculosis
TVSHETERPG

SEQ ID NO: 36574 - protein, 10 aa, Mycobacterium tuberculosis
VSHETERPGM

SEQ ID NO: 36575 - protein, 10 aa, Mycobacterium tuberculosis
SHETERPGMA

SEQ ID NO: 36576 - protein, 10 aa, Mycobacterium tuberculosis
HETERPGMAD

SEQ ID NO: 36577 - protein, 10 aa, Mycobacterium tuberculosis
ETERPGMADA

SEQ ID NO: 36578 - protein, 10 aa, Mycobacterium tuberculosis
TERPGMADAP

SEQ ID NO: 36579 - protein, 10 aa, Mycobacterium tuberculosis
ERPGMADAPP

SEQ ID NO: 36580 - protein, 10 aa, Mycobacterium tuberculosis
RPGMADAPPL

SEQ ID NO: 36581 - protein, 10 aa, Mycobacterium tuberculosis
PGMADAPPLS

SEQ ID NO: 36582 - protein, 10 aa, Mycobacterium tuberculosis
GMADAPPLSR

SEQ ID NO: 36583 - protein, 10 aa, Mycobacterium tuberculosis
MADAPPLSRR

SEQ ID NO: 36584 - protein, 10 aa, Mycobacterium tuberculosis
ADAPPLSRRY

SEQ ID NO: 36585 - protein, 10 aa, Mycobacterium tuberculosis
DAPPLSRRYI

SEQ ID NO: 36586 - protein, 10 aa, Mycobacterium tuberculosis
APPLSRRYIT

SEQ ID NO: 36587 - protein, 10 aa, Mycobacterium tuberculosis
PPLSRRYITI

SEQ ID NO: 36588 - protein, 10 aa, Mycobacterium tuberculosis
PLSRRYITIS

SEQ ID NO: 36589 - protein, 10 aa, Mycobacterium tuberculosis
LSRRYITISE

SEQ ID NO: 36590 - protein, 10 aa, Mycobacterium tuberculosis
SRRYITISEA

SEQ ID NO: 36591 - protein, 10 aa, Mycobacterium tuberculosis
RRYITISEAA

SEQ ID NO: 36592 - protein, 10 aa, Mycobacterium tuberculosis
RYITISEAAE

SEQ ID NO: 36593 - protein, 10 aa, Mycobacterium tuberculosis
YITISEAAEY

SEQ ID NO: 36594 - protein, 10 aa, Mycobacterium tuberculosis
ITISEAAEYL

SEQ ID NO: 36595 - protein, 10 aa, Mycobacterium tuberculosis
TISEAAEYLA

SEQ ID NO: 36596 - protein, 10 aa, Mycobacterium tuberculosis
ISEAAEYLAV

SEQ ID NO: 36597 - protein, 10 aa, Mycobacterium tuberculosis
SEAAEYLAVT

SEQ ID NO: 36598 - protein, 10 aa, Mycobacterium tuberculosis
EAAEYLAVTD

SEQ ID NO: 36599 - protein, 10 aa, Mycobacterium tuberculosis
AAEYLAVTDR

SEQ ID NO: 36600 - protein, 10 aa, Mycobacterium tuberculosis
AEYLAVTDRT

SEQ ID NO: 36601 - protein, 10 aa, Mycobacterium tuberculosis
EYLAVTDRTV

SEQ ID NO: 36602 - protein, 10 aa, Mycobacterium tuberculosis
YLAVTDRTVR

SEQ ID NO: 36603 - protein, 10 aa, Mycobacterium tuberculosis
LAVTDRTVRQ

SEQ ID NO: 36604 - protein, 10 aa, Mycobacterium tuberculosis
AVTDRTVRQM

SEQ ID NO: 36605 - protein, 10 aa, Mycobacterium tuberculosis
VTDRTVRQMI

SEQ ID NO: 36606 - protein, 10 aa, Mycobacterium tuberculosis
TDRTVRQMIA

SEQ ID NO: 36607 - protein, 10 aa, Mycobacterium tuberculosis
DRTVRQMIAD

SEQ ID NO: 36608 - protein, 10 aa, Mycobacterium tuberculosis
RTVRQMIADG

SEQ ID NO: 36609 - protein, 10 aa, Mycobacterium tuberculosis
TVRQMIADGR

SEQ ID NO: 36610 - protein, 10 aa, Mycobacterium tuberculosis
VRQMIADGRL

SEQ ID NO: 36611 - protein, 10 aa, Mycobacterium tuberculosis
RQMIADGRLR

SEQ ID NO: 36612 - protein, 10 aa, Mycobacterium tuberculosis
QMIADGRLRG

SEQ ID NO: 36613 - protein, 10 aa, Mycobacterium tuberculosis
MIADGRLRGY

SEQ ID NO: 36614 - protein, 10 aa, Mycobacterium tuberculosis
IADGRLRGYR

SEQ ID NO: 36615 - protein, 10 aa, Mycobacterium tuberculosis
ADGRLRGYRS

SEQ ID NO: 36616 - protein, 10 aa, Mycobacterium tuberculosis
DGRLRGYRSG

SEQ ID NO: 36617 - protein, 10 aa, Mycobacterium tuberculosis
GRLRGYRSGT

SEQ ID NO: 36618 - protein, 10 aa, Mycobacterium tuberculosis
RLRGYRSGTR

SEQ ID NO: 36619 - protein, 10 aa, Mycobacterium tuberculosis
LRGYRSGTRL

SEQ ID NO: 36620 - protein, 10 aa, Mycobacterium tuberculosis
RGYRSGTRLV

SEQ ID NO: 36621 - protein, 10 aa, Mycobacterium tuberculosis
GYRSGTRLVR

SEQ ID NO: 36622 - protein, 10 aa, Mycobacterium tuberculosis
YRSGTRLVRL

SEQ ID NO: 36623 - protein, 10 aa, Mycobacterium tuberculosis
RSGTRLVRLR

SEQ ID NO: 36624 - protein, 10 aa, Mycobacterium tuberculosis
SGTRLVRLRR

SEQ ID NO: 36625 - protein, 10 aa, Mycobacterium tuberculosis
GTRLVRLRRD

SEQ ID NO: 36626 - protein, 10 aa, Mycobacterium tuberculosis
TRLVRLRRDE

SEQ ID NO: 36627 - protein, 10 aa, Mycobacterium tuberculosis
RLVRLRRDEV

SEQ ID NO: 36628 - protein, 10 aa, Mycobacterium tuberculosis
LVRLRRDEVD

SEQ ID NO: 36629 - protein, 10 aa, Mycobacterium tuberculosis
VRLRRDEVDG

SEQ ID NO: 36630 - protein, 10 aa, Mycobacterium tuberculosis
RLRRDEVDGA

SEQ ID NO: 36631 - protein, 10 aa, Mycobacterium tuberculosis
LRRDEVDGAM

SEQ ID NO: 36632 - protein, 10 aa, Mycobacterium tuberculosis
RRDEVDGAMH

SEQ ID NO: 36633 - protein, 10 aa, Mycobacterium tuberculosis
RDEVDGAMHP

SEQ ID NO: 36634 - protein, 10 aa, Mycobacterium tuberculosis
DEVDGAMHPF

SEQ ID NO: 36635 - protein, 10 aa, Mycobacterium tuberculosis
EVDGAMHPFG

SEQ ID NO: 36636 - protein, 10 aa, Mycobacterium tuberculosis
VDGAMHPFGG

SEQ ID NO: 36637 - protein, 10 aa, Mycobacterium tuberculosis
DGAMHPFGGA

SEQ ID NO: 36638 - protein, 10 aa, Mycobacterium tuberculosis
GAMHPFGGAA

SEQ ID NO: 36639 - protein, 11 aa, Mycobacterium tuberculosis
MCAFPSPSLGW

SEQ ID NO: 36640 - protein, 11 aa, Mycobacterium tuberculosis
CAFPSPSLGWT

SEQ ID NO: 36641 - protein, 11 aa, Mycobacterium tuberculosis
AFPSPSLGWTV

SEQ ID NO: 36642 - protein, 11 aa, Mycobacterium tuberculosis
FPSPSLGWTVS

SEQ ID NO: 36643 - protein, 11 aa, Mycobacterium tuberculosis
PSPSLGWTVSH

SEQ ID NO: 36644 - protein, 11 aa, Mycobacterium tuberculosis
SPSLGWTVSHE

SEQ ID NO: 36645 - protein, 11 aa, Mycobacterium tuberculosis
PSLGWTVSHET

SEQ ID NO: 36646 - protein, 11 aa, Mycobacterium tuberculosis
SLGWTVSHETE

SEQ ID NO: 36647 - protein, 11 aa, Mycobacterium tuberculosis
LGWTVSHETER

SEQ ID NO: 36648 - protein, 11 aa, Mycobacterium tuberculosis
GWTVSHETERP

SEQ ID NO: 36649 - protein, 11 aa, Mycobacterium tuberculosis
WTVSHETERPG

SEQ ID NO: 36650 - protein, 11 aa, Mycobacterium tuberculosis
TVSHETERPGM

SEQ ID NO: 36651 - protein, 11 aa, Mycobacterium tuberculosis
VSHETERPGMA

SEQ ID NO: 36652 - protein, 11 aa, Mycobacterium tuberculosis
SHETERPGMAD

SEQ ID NO: 36653 - protein, 11 aa, Mycobacterium tuberculosis
HETERPGMADA

SEQ ID NO: 36654 - protein, 11 aa, Mycobacterium tuberculosis
ETERPGMADAP

SEQ ID NO: 36655 - protein, 11 aa, Mycobacterium tuberculosis
TERPGMADAPP

SEQ ID NO: 36656 - protein, 11 aa, Mycobacterium tuberculosis
ERPGMADAPPL

SEQ ID NO: 36657 - protein, 11 aa, Mycobacterium tuberculosis
RPGMADAPPLS

SEQ ID NO: 36658 - protein, 11 aa, Mycobacterium tuberculosis
PGMADAPPLSR

SEQ ID NO: 36659 - protein, 11 aa, Mycobacterium tuberculosis
GMADAPPLSRR

SEQ ID NO: 36660 - protein, 11 aa, Mycobacterium tuberculosis
MADAPPLSRRY

SEQ ID NO: 36661 - protein, 11 aa, Mycobacterium tuberculosis
ADAPPLSRRYI

SEQ ID NO: 36662 - protein, 11 aa, Mycobacterium tuberculosis
DAPPLSRRYIT

SEQ ID NO: 36663 - protein, 11 aa, Mycobacterium tuberculosis
APPLSRRYITI

SEQ ID NO: 36664 - protein, 11 aa, Mycobacterium tuberculosis
PPLSRRYITIS

SEQ ID NO: 36665 - protein, 11 aa, Mycobacterium tuberculosis
PLSRRYITISE

SEQ ID NO: 36666 - protein, 11 aa, Mycobacterium tuberculosis
LSRRYITISEA

SEQ ID NO: 36667 - protein, 11 aa, Mycobacterium tuberculosis
SRRYITISEAA

SEQ ID NO: 36668 - protein, 11 aa, Mycobacterium tuberculosis
RRYITISEAAE

SEQ ID NO: 36669 - protein, 11 aa, Mycobacterium tuberculosis
RYITISEAAEY

SEQ ID NO: 36670 - protein, 11 aa, Mycobacterium tuberculosis
YITISEAAEYL

SEQ ID NO: 36671 - protein, 11 aa, Mycobacterium tuberculosis
ITISEAAEYLA

SEQ ID NO: 36672 - protein, 11 aa, Mycobacterium tuberculosis
TISEAAEYLAV

SEQ ID NO: 36673 - protein, 11 aa, Mycobacterium tuberculosis
ISEAAEYLAVT

SEQ ID NO: 36674 - protein, 11 aa, Mycobacterium tuberculosis
SEAAEYLAVTD

SEQ ID NO: 36675 - protein, 11 aa, Mycobacterium tuberculosis
EAAEYLAVTDR

SEQ ID NO: 36676 - protein, 11 aa, Mycobacterium tuberculosis
AAEYLAVTDRT

SEQ ID NO: 36677 - protein, 11 aa, Mycobacterium tuberculosis
AEYLAVTDRTV

SEQ ID NO: 36678 - protein, 11 aa, Mycobacterium tuberculosis
EYLAVTDRTVR

SEQ ID NO: 36679 - protein, 11 aa, Mycobacterium tuberculosis
YLAVTDRTVRQ

SEQ ID NO: 36680 - protein, 11 aa, Mycobacterium tuberculosis
LAVTDRTVRQM

SEQ ID NO: 36681 - protein, 11 aa, Mycobacterium tuberculosis
AVTDRTVRQMI

SEQ ID NO: 36682 - protein, 11 aa, Mycobacterium tuberculosis
VTDRTVRQMIA

SEQ ID NO: 36683 - protein, 11 aa, Mycobacterium tuberculosis
TDRTVRQMIAD

SEQ ID NO: 36684 - protein, 11 aa, Mycobacterium tuberculosis
DRTVRQMIADG

SEQ ID NO: 36685 - protein, 11 aa, Mycobacterium tuberculosis
RTVRQMIADGR

SEQ ID NO: 36686 - protein, 11 aa, Mycobacterium tuberculosis
TVRQMIADGRL

SEQ ID NO: 36687 - protein, 11 aa, Mycobacterium tuberculosis
VRQMIADGRLR

SEQ ID NO: 36688 - protein, 11 aa, Mycobacterium tuberculosis
RQMIADGRLRG

SEQ ID NO: 36689 - protein, 11 aa, Mycobacterium tuberculosis
QMIADGRLRGY

SEQ ID NO: 36690 - protein, 11 aa, Mycobacterium tuberculosis
MIADGRLRGYR

SEQ ID NO: 36691 - protein, 11 aa, Mycobacterium tuberculosis
IADGRLRGYRS

SEQ ID NO: 36692 - protein, 11 aa, Mycobacterium tuberculosis
ADGRLRGYRSG

SEQ ID NO: 36693 - protein, 11 aa, Mycobacterium tuberculosis
DGRLRGYRSGT

SEQ ID NO: 36694 - protein, 11 aa, Mycobacterium tuberculosis
GRLRGYRSGTR

SEQ ID NO: 36695 - protein, 11 aa, Mycobacterium tuberculosis
RLRGYRSGTRL

SEQ ID NO: 36696 - protein, 11 aa, Mycobacterium tuberculosis
LRGYRSGTRLV

SEQ ID NO: 36697 - protein, 11 aa, Mycobacterium tuberculosis
RGYRSGTRLVR

SEQ ID NO: 36698 - protein, 11 aa, Mycobacterium tuberculosis
GYRSGTRLVRL

SEQ ID NO: 36699 - protein, 11 aa, Mycobacterium tuberculosis
YRSGTRLVRLR

SEQ ID NO: 36700 - protein, 11 aa, Mycobacterium tuberculosis
RSGTRLVRLRR

SEQ ID NO: 36701 - protein, 11 aa, Mycobacterium tuberculosis
SGTRLVRLRRD

SEQ ID NO: 36702 - protein, 11 aa, Mycobacterium tuberculosis
GTRLVRLRRDE

SEQ ID NO: 36703 - protein, 11 aa, Mycobacterium tuberculosis
TRLVRLRRDEV

SEQ ID NO: 36704 - protein, 11 aa, Mycobacterium tuberculosis
RLVRLRRDEVD

SEQ ID NO: 36705 - protein, 11 aa, Mycobacterium tuberculosis
LVRLRRDEVDG

SEQ ID NO: 36706 - protein, 11 aa, Mycobacterium tuberculosis
VRLRRDEVDGA

SEQ ID NO: 36707 - protein, 11 aa, Mycobacterium tuberculosis
RLRRDEVDGAM

SEQ ID NO: 36708 - protein, 11 aa, Mycobacterium tuberculosis
LRRDEVDGAMH

SEQ ID NO: 36709 - protein, 11 aa, Mycobacterium tuberculosis
RRDEVDGAMHP

SEQ ID NO: 36710 - protein, 11 aa, Mycobacterium tuberculosis
RDEVDGAMHPF

SEQ ID NO: 36711 - protein, 11 aa, Mycobacterium tuberculosis
DEVDGAMHPFG

SEQ ID NO: 36712 - protein, 11 aa, Mycobacterium tuberculosis
EVDGAMHPFGG

SEQ ID NO: 36713 - protein, 11 aa, Mycobacterium tuberculosis
VDGAMHPFGGA

SEQ ID NO: 36714 - protein, 11 aa, Mycobacterium tuberculosis
DGAMHPFGGAA

SEQ ID NO: 36715 - protein, 8 aa, Mycobacterium tuberculosis
MADAVKYV

SEQ ID NO: 36716 - protein, 8 aa, Mycobacterium tuberculosis
ADAVKYVV

SEQ ID NO: 36717 - protein, 8 aa, Mycobacterium tuberculosis
DAVKYVVM

SEQ ID NO: 36718 - protein, 8 aa, Mycobacterium tuberculosis
AVKYVVMC

SEQ ID NO: 36719 - protein, 8 aa, Mycobacterium tuberculosis
VKYVVMCN

SEQ ID NO: 36720 - protein, 8 aa, Mycobacterium tuberculosis
KYVVMCNC

SEQ ID NO: 36721 - protein, 8 aa, Mycobacterium tuberculosis
YVVMCNCD

SEQ ID NO: 36722 - protein, 8 aa, Mycobacterium tuberculosis
VVMCNCDD

SEQ ID NO: 36723 - protein, 8 aa, Mycobacterium tuberculosis
VMCNCDDE

SEQ ID NO: 36724 - protein, 8 aa, Mycobacterium tuberculosis
MCNCDDEP

SEQ ID NO: 36725 - protein, 8 aa, Mycobacterium tuberculosis
CNCDDEPG

SEQ ID NO: 36726 - protein, 8 aa, Mycobacterium tuberculosis
NCDDEPGA

SEQ ID NO: 36727 - protein, 8 aa, Mycobacterium tuberculosis
CDDEPGAL

SEQ ID NO: 36728 - protein, 8 aa, Mycobacterium tuberculosis
DDEPGALI

SEQ ID NO: 36729 - protein, 8 aa, Mycobacterium tuberculosis
DEPGALII

SEQ ID NO: 36730 - protein, 8 aa, Mycobacterium tuberculosis
EPGALIIA

SEQ ID NO: 36731 - protein, 8 aa, Mycobacterium tuberculosis
PGALIIAW

SEQ ID NO: 36732 - protein, 8 aa, Mycobacterium tuberculosis
GALIIAWI

SEQ ID NO: 36733 - protein, 8 aa, Mycobacterium tuberculosis
ALIIAWID

SEQ ID NO: 36734 - protein, 8 aa, Mycobacterium tuberculosis
LIIAWIDD

SEQ ID NO: 36735 - protein, 8 aa, Mycobacterium tuberculosis
IIAWIDDE

SEQ ID NO: 36736 - protein, 8 aa, Mycobacterium tuberculosis
IAWIDDER

SEQ ID NO: 36737 - protein, 8 aa, Mycobacterium tuberculosis
AWIDDERP

SEQ ID NO: 36738 - protein, 8 aa, Mycobacterium tuberculosis
WIDDERPA

SEQ ID NO: 36739 - protein, 8 aa, Mycobacterium tuberculosis
IDDERPAG

SEQ ID NO: 36740 - protein, 8 aa, Mycobacterium tuberculosis
DDERPAGG

SEQ ID NO: 36741 - protein, 8 aa, Mycobacterium tuberculosis
DERPAGGH

SEQ ID NO: 36742 - protein, 8 aa, Mycobacterium tuberculosis
ERPAGGHI

SEQ ID NO: 36743 - protein, 8 aa, Mycobacterium tuberculosis
RPAGGHIQ

SEQ ID NO: 36744 - protein, 8 aa, Mycobacterium tuberculosis
PAGGHIQM

SEQ ID NO: 36745 - protein, 8 aa, Mycobacterium tuberculosis
AGGHIQMR

SEQ ID NO: 36746 - protein, 8 aa, Mycobacterium tuberculosis
GGHIQMRS

SEQ ID NO: 36747 - protein, 8 aa, Mycobacterium tuberculosis
GHIQMRSN

SEQ ID NO: 36748 - protein, 8 aa, Mycobacterium tuberculosis
HIQMRSNT

SEQ ID NO: 36749 - protein, 8 aa, Mycobacterium tuberculosis
IQMRSNTR

SEQ ID NO: 36750 - protein, 8 aa, Mycobacterium tuberculosis
QMRSNTRF

SEQ ID NO: 36751 - protein, 8 aa, Mycobacterium tuberculosis
MRSNTRFT

SEQ ID NO: 36752 - protein, 8 aa, Mycobacterium tuberculosis
RSNTRFTE

SEQ ID NO: 36753 - protein, 8 aa, Mycobacterium tuberculosis
SNTRFTET

SEQ ID NO: 36754 - protein, 8 aa, Mycobacterium tuberculosis
NTRFTETQ

SEQ ID NO: 36755 - protein, 8 aa, Mycobacterium tuberculosis
TRFTETQW

SEQ ID NO: 36756 - protein, 8 aa, Mycobacterium tuberculosis
RFTETQWG

SEQ ID NO: 36757 - protein, 8 aa, Mycobacterium tuberculosis
FTETQWGR

SEQ ID NO: 36758 - protein, 8 aa, Mycobacterium tuberculosis
TETQWGRH

SEQ ID NO: 36759 - protein, 8 aa, Mycobacterium tuberculosis
ETQWGRHI

SEQ ID NO: 36760 - protein, 8 aa, Mycobacterium tuberculosis
TQWGRHIE

SEQ ID NO: 36761 - protein, 8 aa, Mycobacterium tuberculosis
QWGRHIEW

SEQ ID NO: 36762 - protein, 8 aa, Mycobacterium tuberculosis
WGRHIEWK

SEQ ID NO: 36763 - protein, 8 aa, Mycobacterium tuberculosis
GRHIEWKL

SEQ ID NO: 36764 - protein, 8 aa, Mycobacterium tuberculosis
RHIEWKLE

SEQ ID NO: 36765 - protein, 8 aa, Mycobacterium tuberculosis
HIEWKLEC

SEQ ID NO: 36766 - protein, 8 aa, Mycobacterium tuberculosis
IEWKLECR

SEQ ID NO: 36767 - protein, 8 aa, Mycobacterium tuberculosis
EWKLECRA

SEQ ID NO: 36768 - protein, 8 aa, Mycobacterium tuberculosis
WKLECRAC

SEQ ID NO: 36769 - protein, 8 aa, Mycobacterium tuberculosis
KLECRACR

SEQ ID NO: 36770 - protein, 8 aa, Mycobacterium tuberculosis
LECRACRK

SEQ ID NO: 36771 - protein, 8 aa, Mycobacterium tuberculosis
ECRACRKY

SEQ ID NO: 36772 - protein, 8 aa, Mycobacterium tuberculosis
CRACRKYA

SEQ ID NO: 36773 - protein, 8 aa, Mycobacterium tuberculosis
RACRKYAP

SEQ ID NO: 36774 - protein, 8 aa, Mycobacterium tuberculosis
ACRKYAPI

SEQ ID NO: 36775 - protein, 8 aa, Mycobacterium tuberculosis
CRKYAPIS

SEQ ID NO: 36776 - protein, 8 aa, Mycobacterium tuberculosis
RKYAPISE

SEQ ID NO: 36777 - protein, 8 aa, Mycobacterium tuberculosis
KYAPISEM

SEQ ID NO: 36778 - protein, 8 aa, Mycobacterium tuberculosis
YAPISEMT

SEQ ID NO: 36779 - protein, 8 aa, Mycobacterium tuberculosis
APISEMTA

SEQ ID NO: 36780 - protein, 8 aa, Mycobacterium tuberculosis
PISEMTAA

SEQ ID NO: 36781 - protein, 8 aa, Mycobacterium tuberculosis
ISEMTAAA

SEQ ID NO: 36782 - protein, 8 aa, Mycobacterium tuberculosis
SEMTAAAI

SEQ ID NO: 36783 - protein, 8 aa, Mycobacterium tuberculosis
EMTAAAIL

SEQ ID NO: 36784 - protein, 8 aa, Mycobacterium tuberculosis
MTAAAILD

SEQ ID NO: 36785 - protein, 8 aa, Mycobacterium tuberculosis
TAAAILDG

SEQ ID NO: 36786 - protein, 8 aa, Mycobacterium tuberculosis
AAAILDGF

SEQ ID NO: 36787 - protein, 8 aa, Mycobacterium tuberculosis
AAILDGFG

SEQ ID NO: 36788 - protein, 8 aa, Mycobacterium tuberculosis
AILDGFGA

SEQ ID NO: 36789 - protein, 8 aa, Mycobacterium tuberculosis
ILDGFGAK

SEQ ID NO: 36790 - protein, 8 aa, Mycobacterium tuberculosis
LDGFGAKL

SEQ ID NO: 36791 - protein, 8 aa, Mycobacterium tuberculosis
DGFGAKLH

SEQ ID NO: 36792 - protein, 8 aa, Mycobacterium tuberculosis
GFGAKLHE

SEQ ID NO: 36793 - protein, 8 aa, Mycobacterium tuberculosis
FGAKLHEL

SEQ ID NO: 36794 - protein, 8 aa, Mycobacterium tuberculosis
GAKLHELR

SEQ ID NO: 36795 - protein, 8 aa, Mycobacterium tuberculosis
AKLHELRT

SEQ ID NO: 36796 - protein, 8 aa, Mycobacterium tuberculosis
KLHELRTS

SEQ ID NO: 36797 - protein, 8 aa, Mycobacterium tuberculosis
LHELRTST

SEQ ID NO: 36798 - protein, 8 aa, Mycobacterium tuberculosis
HELRTSTI

SEQ ID NO: 36799 - protein, 8 aa, Mycobacterium tuberculosis
ELRTSTIP

SEQ ID NO: 36800 - protein, 8 aa, Mycobacterium tuberculosis
LRTSTIPD

SEQ ID NO: 36801 - protein, 8 aa, Mycobacterium tuberculosis
RTSTIPDA

SEQ ID NO: 36802 - protein, 8 aa, Mycobacterium tuberculosis
TSTIPDAD

SEQ ID NO: 36803 - protein, 8 aa, Mycobacterium tuberculosis
STIPDADD

SEQ ID NO: 36804 - protein, 8 aa, Mycobacterium tuberculosis
TIPDADDP

SEQ ID NO: 36805 - protein, 8 aa, Mycobacterium tuberculosis
IPDADDPS

SEQ ID NO: 36806 - protein, 8 aa, Mycobacterium tuberculosis
PDADDPSI

SEQ ID NO: 36807 - protein, 8 aa, Mycobacterium tuberculosis
DADDPSIA

SEQ ID NO: 36808 - protein, 8 aa, Mycobacterium tuberculosis
ADDPSIAE

SEQ ID NO: 36809 - protein, 8 aa, Mycobacterium tuberculosis
DDPSIAEA

SEQ ID NO: 36810 - protein, 8 aa, Mycobacterium tuberculosis
DPSIAEAR

SEQ ID NO: 36811 - protein, 8 aa, Mycobacterium tuberculosis
PSIAEARH

SEQ ID NO: 36812 - protein, 8 aa, Mycobacterium tuberculosis
SIAEARHV

SEQ ID NO: 36813 - protein, 8 aa, Mycobacterium tuberculosis
IAEARHVI

SEQ ID NO: 36814 - protein, 8 aa, Mycobacterium tuberculosis
AEARHVIP

SEQ ID NO: 36815 - protein, 8 aa, Mycobacterium tuberculosis
EARHVIPF

SEQ ID NO: 36816 - protein, 8 aa, Mycobacterium tuberculosis
ARHVIPFS

SEQ ID NO: 36817 - protein, 8 aa, Mycobacterium tuberculosis
RHVIPFSA

SEQ ID NO: 36818 - protein, 8 aa, Mycobacterium tuberculosis
HVIPFSAL

SEQ ID NO: 36819 - protein, 8 aa, Mycobacterium tuberculosis
VIPFSALC

SEQ ID NO: 36820 - protein, 8 aa, Mycobacterium tuberculosis
IPFSALCL

SEQ ID NO: 36821 - protein, 8 aa, Mycobacterium tuberculosis
PFSALCLR

SEQ ID NO: 36822 - protein, 8 aa, Mycobacterium tuberculosis
FSALCLRL

SEQ ID NO: 36823 - protein, 8 aa, Mycobacterium tuberculosis
SALCLRLS

SEQ ID NO: 36824 - protein, 8 aa, Mycobacterium tuberculosis
ALCLRLSQ

SEQ ID NO: 36825 - protein, 8 aa, Mycobacterium tuberculosis
LCLRLSQL

SEQ ID NO: 36826 - protein, 8 aa, Mycobacterium tuberculosis
CLRLSQLG

SEQ ID NO: 36827 - protein, 8 aa, Mycobacterium tuberculosis
LRLSQLGG

SEQ ID NO: 36828 - protein, 9 aa, Mycobacterium tuberculosis
MADAVKYVV

SEQ ID NO: 36829 - protein, 9 aa, Mycobacterium tuberculosis
ADAVKYVVM

SEQ ID NO: 36830 - protein, 9 aa, Mycobacterium tuberculosis
DAVKYVVMC

SEQ ID NO: 36831 - protein, 9 aa, Mycobacterium tuberculosis
AVKYVVMCN

SEQ ID NO: 36832 - protein, 9 aa, Mycobacterium tuberculosis
VKYVVMCNC

SEQ ID NO: 36833 - protein, 9 aa, Mycobacterium tuberculosis
KYVVMCNCD

SEQ ID NO: 36834 - protein, 9 aa, Mycobacterium tuberculosis
YVVMCNCDD

SEQ ID NO: 36835 - protein, 9 aa, Mycobacterium tuberculosis
VVMCNCDDE

SEQ ID NO: 36836 - protein, 9 aa, Mycobacterium tuberculosis
VMCNCDDEP

SEQ ID NO: 36837 - protein, 9 aa, Mycobacterium tuberculosis
MCNCDDEPG

SEQ ID NO: 36838 - protein, 9 aa, Mycobacterium tuberculosis
CNCDDEPGA

SEQ ID NO: 36839 - protein, 9 aa, Mycobacterium tuberculosis
NCDDEPGAL

SEQ ID NO: 36840 - protein, 9 aa, Mycobacterium tuberculosis
CDDEPGALI

SEQ ID NO: 36841 - protein, 9 aa, Mycobacterium tuberculosis
DDEPGALII

SEQ ID NO: 36842 - protein, 9 aa, Mycobacterium tuberculosis
DEPGALIIA

SEQ ID NO: 36843 - protein, 9 aa, Mycobacterium tuberculosis
EPGALIIAW

SEQ ID NO: 36844 - protein, 9 aa, Mycobacterium tuberculosis
PGALIIAWI

SEQ ID NO: 36845 - protein, 9 aa, Mycobacterium tuberculosis
GALIIAWID

SEQ ID NO: 36846 - protein, 9 aa, Mycobacterium tuberculosis
ALIIAWIDD

SEQ ID NO: 36847 - protein, 9 aa, Mycobacterium tuberculosis
LIIAWIDDE

SEQ ID NO: 36848 - protein, 9 aa, Mycobacterium tuberculosis
IIAWIDDER

SEQ ID NO: 36849 - protein, 9 aa, Mycobacterium tuberculosis
IAWIDDERP

SEQ ID NO: 36850 - protein, 9 aa, Mycobacterium tuberculosis
AWIDDERPA

SEQ ID NO: 36851 - protein, 9 aa, Mycobacterium tuberculosis
WIDDERPAG

SEQ ID NO: 36852 - protein, 9 aa, Mycobacterium tuberculosis
IDDERPAGG

SEQ ID NO: 36853 - protein, 9 aa, Mycobacterium tuberculosis
DDERPAGGH

SEQ ID NO: 36854 - protein, 9 aa, Mycobacterium tuberculosis
DERPAGGHI

SEQ ID NO: 36855 - protein, 9 aa, Mycobacterium tuberculosis
ERPAGGHIQ

SEQ ID NO: 36856 - protein, 9 aa, Mycobacterium tuberculosis
RPAGGHIQM

SEQ ID NO: 36857 - protein, 9 aa, Mycobacterium tuberculosis
PAGGHIQMR

SEQ ID NO: 36858 - protein, 9 aa, Mycobacterium tuberculosis
AGGHIQMRS

SEQ ID NO: 36859 - protein, 9 aa, Mycobacterium tuberculosis
GGHIQMRSN

SEQ ID NO: 36860 - protein, 9 aa, Mycobacterium tuberculosis
GHIQMRSNT

SEQ ID NO: 36861 - protein, 9 aa, Mycobacterium tuberculosis
HIQMRSNTR

SEQ ID NO: 36862 - protein, 9 aa, Mycobacterium tuberculosis
IQMRSNTRF

SEQ ID NO: 36863 - protein, 9 aa, Mycobacterium tuberculosis
QMRSNTRFT

SEQ ID NO: 36864 - protein, 9 aa, Mycobacterium tuberculosis
MRSNTRFTE

SEQ ID NO: 36865 - protein, 9 aa, Mycobacterium tuberculosis
RSNTRFTET

SEQ ID NO: 36866 - protein, 9 aa, Mycobacterium tuberculosis
SNTRFTETQ

SEQ ID NO: 36867 - protein, 9 aa, Mycobacterium tuberculosis
NTRFTETQW

SEQ ID NO: 36868 - protein, 9 aa, Mycobacterium tuberculosis
TRFTETQWG

SEQ ID NO: 36869 - protein, 9 aa, Mycobacterium tuberculosis
RFTETQWGR

SEQ ID NO: 36870 - protein, 9 aa, Mycobacterium tuberculosis
FTETQWGRH

SEQ ID NO: 36871 - protein, 9 aa, Mycobacterium tuberculosis
TETQWGRHI

SEQ ID NO: 36872 - protein, 9 aa, Mycobacterium tuberculosis
ETQWGRHIE

SEQ ID NO: 36873 - protein, 9 aa, Mycobacterium tuberculosis
TQWGRHIEW

SEQ ID NO: 36874 - protein, 9 aa, Mycobacterium tuberculosis
QWGRHIEWK

SEQ ID NO: 36875 - protein, 9 aa, Mycobacterium tuberculosis
WGRHIEWKL

SEQ ID NO: 36876 - protein, 9 aa, Mycobacterium tuberculosis
GRHIEWKLE

SEQ ID NO: 36877 - protein, 9 aa, Mycobacterium tuberculosis
RHIEWKLEC

SEQ ID NO: 36878 - protein, 9 aa, Mycobacterium tuberculosis
HIEWKLECR

SEQ ID NO: 36879 - protein, 9 aa, Mycobacterium tuberculosis
IEWKLECRA

SEQ ID NO: 36880 - protein, 9 aa, Mycobacterium tuberculosis
EWKLECRAC

SEQ ID NO: 36881 - protein, 9 aa, Mycobacterium tuberculosis
WKLECRACR

SEQ ID NO: 36882 - protein, 9 aa, Mycobacterium tuberculosis
KLECRACRK

SEQ ID NO: 36883 - protein, 9 aa, Mycobacterium tuberculosis
LECRACRKY

SEQ ID NO: 36884 - protein, 9 aa, Mycobacterium tuberculosis
ECRACRKYA

SEQ ID NO: 36885 - protein, 9 aa, Mycobacterium tuberculosis
CRACRKYAP

SEQ ID NO: 36886 - protein, 9 aa, Mycobacterium tuberculosis
RACRKYAPI

SEQ ID NO: 36887 - protein, 9 aa, Mycobacterium tuberculosis
ACRKYAPIS

SEQ ID NO: 36888 - protein, 9 aa, Mycobacterium tuberculosis
CRKYAPISE

SEQ ID NO: 36889 - protein, 9 aa, Mycobacterium tuberculosis
RKYAPISEM

SEQ ID NO: 36890 - protein, 9 aa, Mycobacterium tuberculosis
KYAPISEMT

SEQ ID NO: 36891 - protein, 9 aa, Mycobacterium tuberculosis
YAPISEMTA

SEQ ID NO: 36892 - protein, 9 aa, Mycobacterium tuberculosis
APISEMTAA

SEQ ID NO: 36893 - protein, 9 aa, Mycobacterium tuberculosis
PISEMTAAA

SEQ ID NO: 36894 - protein, 9 aa, Mycobacterium tuberculosis
ISEMTAAAI

SEQ ID NO: 36895 - protein, 9 aa, Mycobacterium tuberculosis
SEMTAAAIL

SEQ ID NO: 36896 - protein, 9 aa, Mycobacterium tuberculosis
EMTAAAILD

SEQ ID NO: 36897 - protein, 9 aa, Mycobacterium tuberculosis
MTAAAILDG

SEQ ID NO: 36898 - protein, 9 aa, Mycobacterium tuberculosis
TAAAILDGF

SEQ ID NO: 36899 - protein, 9 aa, Mycobacterium tuberculosis
AAAILDGFG

SEQ ID NO: 36900 - protein, 9 aa, Mycobacterium tuberculosis
AAILDGFGA

SEQ ID NO: 36901 - protein, 9 aa, Mycobacterium tuberculosis
AILDGFGAK

SEQ ID NO: 36902 - protein, 9 aa, Mycobacterium tuberculosis
ILDGFGAKL

SEQ ID NO: 36903 - protein, 9 aa, Mycobacterium tuberculosis
LDGFGAKLH

SEQ ID NO: 36904 - protein, 9 aa, Mycobacterium tuberculosis
DGFGAKLHE

SEQ ID NO: 36905 - protein, 9 aa, Mycobacterium tuberculosis
GFGAKLHEL

SEQ ID NO: 36906 - protein, 9 aa, Mycobacterium tuberculosis
FGAKLHELR

SEQ ID NO: 36907 - protein, 9 aa, Mycobacterium tuberculosis
GAKLHELRT

SEQ ID NO: 36908 - protein, 9 aa, Mycobacterium tuberculosis
AKLHELRTS

SEQ ID NO: 36909 - protein, 9 aa, Mycobacterium tuberculosis
KLHELRTST

SEQ ID NO: 36910 - protein, 9 aa, Mycobacterium tuberculosis
LHELRTSTI

SEQ ID NO: 36911 - protein, 9 aa, Mycobacterium tuberculosis
HELRTSTIP

SEQ ID NO: 36912 - protein, 9 aa, Mycobacterium tuberculosis
ELRTSTIPD

SEQ ID NO: 36913 - protein, 9 aa, Mycobacterium tuberculosis
LRTSTIPDA

SEQ ID NO: 36914 - protein, 9 aa, Mycobacterium tuberculosis
RTSTIPDAD

SEQ ID NO: 36915 - protein, 9 aa, Mycobacterium tuberculosis
TSTIPDADD

SEQ ID NO: 36916 - protein, 9 aa, Mycobacterium tuberculosis
STIPDADDP

SEQ ID NO: 36917 - protein, 9 aa, Mycobacterium tuberculosis
TIPDADDPS

SEQ ID NO: 36918 - protein, 9 aa, Mycobacterium tuberculosis
IPDADDPSI

SEQ ID NO: 36919 - protein, 9 aa, Mycobacterium tuberculosis
PDADDPSIA

SEQ ID NO: 36920 - protein, 9 aa, Mycobacterium tuberculosis
DADDPSIAE

SEQ ID NO: 36921 - protein, 9 aa, Mycobacterium tuberculosis
ADDPSIAEA

SEQ ID NO: 36922 - protein, 9 aa, Mycobacterium tuberculosis
DDPSIAEAR

SEQ ID NO: 36923 - protein, 9 aa, Mycobacterium tuberculosis
DPSIAEARH

SEQ ID NO: 36924 - protein, 9 aa, Mycobacterium tuberculosis
PSIAEARHV

SEQ ID NO: 36925 - protein, 9 aa, Mycobacterium tuberculosis
SIAEARHVI

SEQ ID NO: 36926 - protein, 9 aa, Mycobacterium tuberculosis
IAEARHVIP

SEQ ID NO: 36927 - protein, 9 aa, Mycobacterium tuberculosis
AEARHVIPF

SEQ ID NO: 36928 - protein, 9 aa, Mycobacterium tuberculosis
EARHVIPFS

SEQ ID NO: 36929 - protein, 9 aa, Mycobacterium tuberculosis
ARHVIPFSA

SEQ ID NO: 36930 - protein, 9 aa, Mycobacterium tuberculosis
RHVIPFSAL

SEQ ID NO: 36931 - protein, 9 aa, Mycobacterium tuberculosis
HVIPFSALC

SEQ ID NO: 36932 - protein, 9 aa, Mycobacterium tuberculosis
VIPFSALCL

SEQ ID NO: 36933 - protein, 9 aa, Mycobacterium tuberculosis
IPFSALCLR

SEQ ID NO: 36934 - protein, 9 aa, Mycobacterium tuberculosis
PFSALCLRL

SEQ ID NO: 36935 - protein, 9 aa, Mycobacterium tuberculosis
FSALCLRLS

SEQ ID NO: 36936 - protein, 9 aa, Mycobacterium tuberculosis
SALCLRLSQ

SEQ ID NO: 36937 - protein, 9 aa, Mycobacterium tuberculosis
ALCLRLSQL

SEQ ID NO: 36938 - protein, 9 aa, Mycobacterium tuberculosis
LCLRLSQLG

SEQ ID NO: 36939 - protein, 9 aa, Mycobacterium tuberculosis
CLRLSQLGG

SEQ ID NO: 36940 - protein, 10 aa, Mycobacterium tuberculosis
MADAVKYVVM

SEQ ID NO: 36941 - protein, 10 aa, Mycobacterium tuberculosis
ADAVKYVVMC

SEQ ID NO: 36942 - protein, 10 aa, Mycobacterium tuberculosis
DAVKYVVMCN

SEQ ID NO: 36943 - protein, 10 aa, Mycobacterium tuberculosis
AVKYVVMCNC

SEQ ID NO: 36944 - protein, 10 aa, Mycobacterium tuberculosis
VKYVVMCNCD

SEQ ID NO: 36945 - protein, 10 aa, Mycobacterium tuberculosis
KYVVMCNCDD

SEQ ID NO: 36946 - protein, 10 aa, Mycobacterium tuberculosis
YVVMCNCDDE

SEQ ID NO: 36947 - protein, 10 aa, Mycobacterium tuberculosis
VVMCNCDDEP

SEQ ID NO: 36948 - protein, 10 aa, Mycobacterium tuberculosis
VMCNCDDEPG

SEQ ID NO: 36949 - protein, 10 aa, Mycobacterium tuberculosis
MCNCDDEPGA

SEQ ID NO: 36950 - protein, 10 aa, Mycobacterium tuberculosis
CNCDDEPGAL

SEQ ID NO: 36951 - protein, 10 aa, Mycobacterium tuberculosis
NCDDEPGALI

SEQ ID NO: 36952 - protein, 10 aa, Mycobacterium tuberculosis
CDDEPGALII

SEQ ID NO: 36953 - protein, 10 aa, Mycobacterium tuberculosis
DDEPGALIIA

SEQ ID NO: 36954 - protein, 10 aa, Mycobacterium tuberculosis
DEPGALIIAW

SEQ ID NO: 36955 - protein, 10 aa, Mycobacterium tuberculosis
EPGALIIAWI

SEQ ID NO: 36956 - protein, 10 aa, Mycobacterium tuberculosis
PGALIIAWID

SEQ ID NO: 36957 - protein, 10 aa, Mycobacterium tuberculosis
GALIIAWIDD

SEQ ID NO: 36958 - protein, 10 aa, Mycobacterium tuberculosis
ALIIAWIDDE

SEQ ID NO: 36959 - protein, 10 aa, Mycobacterium tuberculosis
LIIAWIDDER

SEQ ID NO: 36960 - protein, 10 aa, Mycobacterium tuberculosis
IIAWIDDERP

SEQ ID NO: 36961 - protein, 10 aa, Mycobacterium tuberculosis
IAWIDDERPA

SEQ ID NO: 36962 - protein, 10 aa, Mycobacterium tuberculosis
AWIDDERPAG

SEQ ID NO: 36963 - protein, 10 aa, Mycobacterium tuberculosis
WIDDERPAGG

SEQ ID NO: 36964 - protein, 10 aa, Mycobacterium tuberculosis
IDDERPAGGH

SEQ ID NO: 36965 - protein, 10 aa, Mycobacterium tuberculosis
DDERPAGGHI

SEQ ID NO: 36966 - protein, 10 aa, Mycobacterium tuberculosis
DERPAGGHIQ

SEQ ID NO: 36967 - protein, 10 aa, Mycobacterium tuberculosis
ERPAGGHIQM

SEQ ID NO: 36968 - protein, 10 aa, Mycobacterium tuberculosis
RPAGGHIQMR

SEQ ID NO: 36969 - protein, 10 aa, Mycobacterium tuberculosis
PAGGHIQMRS

SEQ ID NO: 36970 - protein, 10 aa, Mycobacterium tuberculosis
AGGHIQMRSN

SEQ ID NO: 36971 - protein, 10 aa, Mycobacterium tuberculosis
GGHIQMRSNT

SEQ ID NO: 36972 - protein, 10 aa, Mycobacterium tuberculosis
GHIQMRSNTR

SEQ ID NO: 36973 - protein, 10 aa, Mycobacterium tuberculosis
HIQMRSNTRF

SEQ ID NO: 36974 - protein, 10 aa, Mycobacterium tuberculosis
IQMRSNTRFT

SEQ ID NO: 36975 - protein, 10 aa, Mycobacterium tuberculosis
QMRSNTRFTE

SEQ ID NO: 36976 - protein, 10 aa, Mycobacterium tuberculosis
MRSNTRFTET

SEQ ID NO: 36977 - protein, 10 aa, Mycobacterium tuberculosis
RSNTRFTETQ

SEQ ID NO: 36978 - protein, 10 aa, Mycobacterium tuberculosis
SNTRFTETQW

SEQ ID NO: 36979 - protein, 10 aa, Mycobacterium tuberculosis
NTRFTETQWG

SEQ ID NO: 36980 - protein, 10 aa, Mycobacterium tuberculosis
TRFTETQWGR

SEQ ID NO: 36981 - protein, 10 aa, Mycobacterium tuberculosis
RFTETQWGRH

SEQ ID NO: 36982 - protein, 10 aa, Mycobacterium tuberculosis
FTETQWGRHI

SEQ ID NO: 36983 - protein, 10 aa, Mycobacterium tuberculosis
TETQWGRHIE

SEQ ID NO: 36984 - protein, 10 aa, Mycobacterium tuberculosis
ETQWGRHIEW

SEQ ID NO: 36985 - protein, 10 aa, Mycobacterium tuberculosis
TQWGRHIEWK

SEQ ID NO: 36986 - protein, 10 aa, Mycobacterium tuberculosis
QWGRHIEWKL

SEQ ID NO: 36987 - protein, 10 aa, Mycobacterium tuberculosis
WGRHIEWKLE

SEQ ID NO: 36988 - protein, 10 aa, Mycobacterium tuberculosis
GRHIEWKLEC

SEQ ID NO: 36989 - protein, 10 aa, Mycobacterium tuberculosis
RHIEWKLECR

SEQ ID NO: 36990 - protein, 10 aa, Mycobacterium tuberculosis
HIEWKLECRA

SEQ ID NO: 36991 - protein, 10 aa, Mycobacterium tuberculosis
IEWKLECRAC

SEQ ID NO: 36992 - protein, 10 aa, Mycobacterium tuberculosis
EWKLECRACR

SEQ ID NO: 36993 - protein, 10 aa, Mycobacterium tuberculosis
WKLECRACRK

SEQ ID NO: 36994 - protein, 10 aa, Mycobacterium tuberculosis
KLECRACRKY

SEQ ID NO: 36995 - protein, 10 aa, Mycobacterium tuberculosis
LECRACRKYA

SEQ ID NO: 36996 - protein, 10 aa, Mycobacterium tuberculosis
ECRACRKYAP

SEQ ID NO: 36997 - protein, 10 aa, Mycobacterium tuberculosis
CRACRKYAPI

SEQ ID NO: 36998 - protein, 10 aa, Mycobacterium tuberculosis
RACRKYAPIS

SEQ ID NO: 36999 - protein, 10 aa, Mycobacterium tuberculosis
ACRKYAPISE

SEQ ID NO: 37000 - protein, 10 aa, Mycobacterium tuberculosis
CRKYAPISEM

SEQ ID NO: 37001 - protein, 10 aa, Mycobacterium tuberculosis
RKYAPISEMT

SEQ ID NO: 37002 - protein, 10 aa, Mycobacterium tuberculosis
KYAPISEMTA

SEQ ID NO: 37003 - protein, 10 aa, Mycobacterium tuberculosis
YAPISEMTAA

SEQ ID NO: 37004 - protein, 10 aa, Mycobacterium tuberculosis
APISEMTAAA

SEQ ID NO: 37005 - protein, 10 aa, Mycobacterium tuberculosis
PISEMTAAAI

SEQ ID NO: 37006 - protein, 10 aa, Mycobacterium tuberculosis
ISEMTAAAIL

SEQ ID NO: 37007 - protein, 10 aa, Mycobacterium tuberculosis
SEMTAAAILD

SEQ ID NO: 37008 - protein, 10 aa, Mycobacterium tuberculosis
EMTAAAILDG

SEQ ID NO: 37009 - protein, 10 aa, Mycobacterium tuberculosis
MTAAAILDGF

SEQ ID NO: 37010 - protein, 10 aa, Mycobacterium tuberculosis
TAAAILDGFG

SEQ ID NO: 37011 - protein, 10 aa, Mycobacterium tuberculosis
AAAILDGFGA

SEQ ID NO: 37012 - protein, 10 aa, Mycobacterium tuberculosis
AAILDGFGAK

SEQ ID NO: 37013 - protein, 10 aa, Mycobacterium tuberculosis
AILDGFGAKL

SEQ ID NO: 37014 - protein, 10 aa, Mycobacterium tuberculosis
ILDGFGAKLH

SEQ ID NO: 37015 - protein, 10 aa, Mycobacterium tuberculosis
LDGFGAKLHE

SEQ ID NO: 37016 - protein, 10 aa, Mycobacterium tuberculosis
DGFGAKLHEL

SEQ ID NO: 37017 - protein, 10 aa, Mycobacterium tuberculosis
GFGAKLHELR

SEQ ID NO: 37018 - protein, 10 aa, Mycobacterium tuberculosis
FGAKLHELRT

SEQ ID NO: 37019 - protein, 10 aa, Mycobacterium tuberculosis
GAKLHELRTS

SEQ ID NO: 37020 - protein, 10 aa, Mycobacterium tuberculosis
AKLHELRTST

SEQ ID NO: 37021 - protein, 10 aa, Mycobacterium tuberculosis
KLHELRTSTI

SEQ ID NO: 37022 - protein, 10 aa, Mycobacterium tuberculosis
LHELRTSTIP

SEQ ID NO: 37023 - protein, 10 aa, Mycobacterium tuberculosis
HELRTSTIPD

SEQ ID NO: 37024 - protein, 10 aa, Mycobacterium tuberculosis
ELRTSTIPDA

SEQ ID NO: 37025 - protein, 10 aa, Mycobacterium tuberculosis
LRTSTIPDAD

SEQ ID NO: 37026 - protein, 10 aa, Mycobacterium tuberculosis
RTSTIPDADD

SEQ ID NO: 37027 - protein, 10 aa, Mycobacterium tuberculosis
TSTIPDADDP

SEQ ID NO: 37028 - protein, 10 aa, Mycobacterium tuberculosis
STIPDADDPS

SEQ ID NO: 37029 - protein, 10 aa, Mycobacterium tuberculosis
TIPDADDPSI

SEQ ID NO: 37030 - protein, 10 aa, Mycobacterium tuberculosis
IPDADDPSIA

SEQ ID NO: 37031 - protein, 10 aa, Mycobacterium tuberculosis
PDADDPSIAE

SEQ ID NO: 37032 - protein, 10 aa, Mycobacterium tuberculosis
DADDPSIAEA

SEQ ID NO: 37033 - protein, 10 aa, Mycobacterium tuberculosis
ADDPSIAEAR

SEQ ID NO: 37034 - protein, 10 aa, Mycobacterium tuberculosis
DDPSIAEARH

SEQ ID NO: 37035 - protein, 10 aa, Mycobacterium tuberculosis
DPSIAEARHV

SEQ ID NO: 37036 - protein, 10 aa, Mycobacterium tuberculosis
PSIAEARHVI

SEQ ID NO: 37037 - protein, 10 aa, Mycobacterium tuberculosis
SIAEARHVIP

SEQ ID NO: 37038 - protein, 10 aa, Mycobacterium tuberculosis
IAEARHVIPF

SEQ ID NO: 37039 - protein, 10 aa, Mycobacterium tuberculosis
AEARHVIPFS

SEQ ID NO: 37040 - protein, 10 aa, Mycobacterium tuberculosis
EARHVIPFSA

SEQ ID NO: 37041 - protein, 10 aa, Mycobacterium tuberculosis
ARHVIPFSAL

SEQ ID NO: 37042 - protein, 10 aa, Mycobacterium tuberculosis
RHVIPFSALC

SEQ ID NO: 37043 - protein, 10 aa, Mycobacterium tuberculosis
HVIPFSALCL

SEQ ID NO: 37044 - protein, 10 aa, Mycobacterium tuberculosis
VIPFSALCLR

SEQ ID NO: 37045 - protein, 10 aa, Mycobacterium tuberculosis
IPFSALCLRL

SEQ ID NO: 37046 - protein, 10 aa, Mycobacterium tuberculosis
PFSALCLRLS

SEQ ID NO: 37047 - protein, 10 aa, Mycobacterium tuberculosis
FSALCLRLSQ

SEQ ID NO: 37048 - protein, 10 aa, Mycobacterium tuberculosis
SALCLRLSQL

SEQ ID NO: 37049 - protein, 10 aa, Mycobacterium tuberculosis
ALCLRLSQLG

SEQ ID NO: 37050 - protein, 10 aa, Mycobacterium tuberculosis
LCLRLSQLGG

SEQ ID NO: 37051 - protein, 11 aa, Mycobacterium tuberculosis
MADAVKYVVMC

SEQ ID NO: 37052 - protein, 11 aa, Mycobacterium tuberculosis
ADAVKYVVMCN

SEQ ID NO: 37053 - protein, 11 aa, Mycobacterium tuberculosis
DAVKYVVMCNC

SEQ ID NO: 37054 - protein, 11 aa, Mycobacterium tuberculosis
AVKYVVMCNCD

SEQ ID NO: 37055 - protein, 11 aa, Mycobacterium tuberculosis
VKYVVMCNCDD

SEQ ID NO: 37056 - protein, 11 aa, Mycobacterium tuberculosis
KYVVMCNCDDE

SEQ ID NO: 37057 - protein, 11 aa, Mycobacterium tuberculosis
YVVMCNCDDEP

SEQ ID NO: 37058 - protein, 11 aa, Mycobacterium tuberculosis
VVMCNCDDEPG

SEQ ID NO: 37059 - protein, 11 aa, Mycobacterium tuberculosis
VMCNCDDEPGA

SEQ ID NO: 37060 - protein, 11 aa, Mycobacterium tuberculosis
MCNCDDEPGAL

SEQ ID NO: 37061 - protein, 11 aa, Mycobacterium tuberculosis
CNCDDEPGALI

SEQ ID NO: 37062 - protein, 11 aa, Mycobacterium tuberculosis
NCDDEPGALII

SEQ ID NO: 37063 - protein, 11 aa, Mycobacterium tuberculosis
CDDEPGALIIA

SEQ ID NO: 37064 - protein, 11 aa, Mycobacterium tuberculosis
DDEPGALIIAW

SEQ ID NO: 37065 - protein, 11 aa, Mycobacterium tuberculosis
DEPGALIIAWI

SEQ ID NO: 37066 - protein, 11 aa, Mycobacterium tuberculosis
EPGALIIAWID

SEQ ID NO: 37067 - protein, 11 aa, Mycobacterium tuberculosis
PGALIIAWIDD

SEQ ID NO: 37068 - protein, 11 aa, Mycobacterium tuberculosis
GALIIAWIDDE

SEQ ID NO: 37069 - protein, 11 aa, Mycobacterium tuberculosis
ALIIAWIDDER

SEQ ID NO: 37070 - protein, 11 aa, Mycobacterium tuberculosis
LIIAWIDDERP

SEQ ID NO: 37071 - protein, 11 aa, Mycobacterium tuberculosis
IIAWIDDERPA

SEQ ID NO: 37072 - protein, 11 aa, Mycobacterium tuberculosis
IAWIDDERPAG

SEQ ID NO: 37073 - protein, 11 aa, Mycobacterium tuberculosis
AWIDDERPAGG

SEQ ID NO: 37074 - protein, 11 aa, Mycobacterium tuberculosis
WIDDERPAGGH

SEQ ID NO: 37075 - protein, 11 aa, Mycobacterium tuberculosis
IDDERPAGGHI

SEQ ID NO: 37076 - protein, 11 aa, Mycobacterium tuberculosis
DDERPAGGHIQ

SEQ ID NO: 37077 - protein, 11 aa, Mycobacterium tuberculosis
DERPAGGHIQM

SEQ ID NO: 37078 - protein, 11 aa, Mycobacterium tuberculosis
ERPAGGHIQMR

SEQ ID NO: 37079 - protein, 11 aa, Mycobacterium tuberculosis
RPAGGHIQMRS

SEQ ID NO: 37080 - protein, 11 aa, Mycobacterium tuberculosis
PAGGHIQMRSN

SEQ ID NO: 37081 - protein, 11 aa, Mycobacterium tuberculosis
AGGHIQMRSNT

SEQ ID NO: 37082 - protein, 11 aa, Mycobacterium tuberculosis
GGHIQMRSNTR

SEQ ID NO: 37083 - protein, 11 aa, Mycobacterium tuberculosis
GHIQMRSNTRF

SEQ ID NO: 37084 - protein, 11 aa, Mycobacterium tuberculosis
HIQMRSNTRFT

SEQ ID NO: 37085 - protein, 11 aa, Mycobacterium tuberculosis
IQMRSNTRFTE

SEQ ID NO: 37086 - protein, 11 aa, Mycobacterium tuberculosis
QMRSNTRFTET

SEQ ID NO: 37087 - protein, 11 aa, Mycobacterium tuberculosis
MRSNTRFTETQ

SEQ ID NO: 37088 - protein, 11 aa, Mycobacterium tuberculosis
RSNTRFTETQW

SEQ ID NO: 37089 - protein, 11 aa, Mycobacterium tuberculosis
SNTRFTETQWG

SEQ ID NO: 37090 - protein, 11 aa, Mycobacterium tuberculosis
NTRFTETQWGR

SEQ ID NO: 37091 - protein, 11 aa, Mycobacterium tuberculosis
TRFTETQWGRH

SEQ ID NO: 37092 - protein, 11 aa, Mycobacterium tuberculosis
RFTETQWGRHI

SEQ ID NO: 37093 - protein, 11 aa, Mycobacterium tuberculosis
FTETQWGRHIE

SEQ ID NO: 37094 - protein, 11 aa, Mycobacterium tuberculosis
TETQWGRHIEW

SEQ ID NO: 37095 - protein, 11 aa, Mycobacterium tuberculosis
ETQWGRHIEWK

SEQ ID NO: 37096 - protein, 11 aa, Mycobacterium tuberculosis
TQWGRHIEWKL

SEQ ID NO: 37097 - protein, 11 aa, Mycobacterium tuberculosis
QWGRHIEWKLE

SEQ ID NO: 37098 - protein, 11 aa, Mycobacterium tuberculosis
WGRHIEWKLEC

SEQ ID NO: 37099 - protein, 11 aa, Mycobacterium tuberculosis
GRHIEWKLECR

SEQ ID NO: 37100 - protein, 11 aa, Mycobacterium tuberculosis
RHIEWKLECRA

SEQ ID NO: 37101 - protein, 11 aa, Mycobacterium tuberculosis
HIEWKLECRAC

SEQ ID NO: 37102 - protein, 11 aa, Mycobacterium tuberculosis
IEWKLECRACR

SEQ ID NO: 37103 - protein, 11 aa, Mycobacterium tuberculosis
EWKLECRACRK

SEQ ID NO: 37104 - protein, 11 aa, Mycobacterium tuberculosis
WKLECRACRKY

SEQ ID NO: 37105 - protein, 11 aa, Mycobacterium tuberculosis
KLECRACRKYA

SEQ ID NO: 37106 - protein, 11 aa, Mycobacterium tuberculosis
LECRACRKYAP

SEQ ID NO: 37107 - protein, 11 aa, Mycobacterium tuberculosis
ECRACRKYAPI

SEQ ID NO: 37108 - protein, 11 aa, Mycobacterium tuberculosis
CRACRKYAPIS

SEQ ID NO: 37109 - protein, 11 aa, Mycobacterium tuberculosis
RACRKYAPISE

SEQ ID NO: 37110 - protein, 11 aa, Mycobacterium tuberculosis
ACRKYAPISEM

SEQ ID NO: 37111 - protein, 11 aa, Mycobacterium tuberculosis
CRKYAPISEMT

SEQ ID NO: 37112 - protein, 11 aa, Mycobacterium tuberculosis
RKYAPISEMTA

SEQ ID NO: 37113 - protein, 11 aa, Mycobacterium tuberculosis
KYAPISEMTAA

SEQ ID NO: 37114 - protein, 11 aa, Mycobacterium tuberculosis
YAPISEMTAAA

SEQ ID NO: 37115 - protein, 11 aa, Mycobacterium tuberculosis
APISEMTAAAI

SEQ ID NO: 37116 - protein, 11 aa, Mycobacterium tuberculosis
PISEMTAAAIL

SEQ ID NO: 37117 - protein, 11 aa, Mycobacterium tuberculosis
ISEMTAAAILD

SEQ ID NO: 37118 - protein, 11 aa, Mycobacterium tuberculosis
SEMTAAAILDG

SEQ ID NO: 37119 - protein, 11 aa, Mycobacterium tuberculosis
EMTAAAILDGF

SEQ ID NO: 37120 - protein, 11 aa, Mycobacterium tuberculosis
MTAAAILDGFG

SEQ ID NO: 37121 - protein, 11 aa, Mycobacterium tuberculosis
TAAAILDGFGA

SEQ ID NO: 37122 - protein, 11 aa, Mycobacterium tuberculosis
AAAILDGFGAK

SEQ ID NO: 37123 - protein, 11 aa, Mycobacterium tuberculosis
AAILDGFGAKL

SEQ ID NO: 37124 - protein, 11 aa, Mycobacterium tuberculosis
AILDGFGAKLH

SEQ ID NO: 37125 - protein, 11 aa, Mycobacterium tuberculosis
ILDGFGAKLHE

SEQ ID NO: 37126 - protein, 11 aa, Mycobacterium tuberculosis
LDGFGAKLHEL

SEQ ID NO: 37127 - protein, 11 aa, Mycobacterium tuberculosis
DGFGAKLHELR

SEQ ID NO: 37128 - protein, 11 aa, Mycobacterium tuberculosis
GFGAKLHELRT

SEQ ID NO: 37129 - protein, 11 aa, Mycobacterium tuberculosis
FGAKLHELRTS

SEQ ID NO: 37130 - protein, 11 aa, Mycobacterium tuberculosis
GAKLHELRTST

SEQ ID NO: 37131 - protein, 11 aa, Mycobacterium tuberculosis
AKLHELRTSTI

SEQ ID NO: 37132 - protein, 11 aa, Mycobacterium tuberculosis
KLHELRTSTIP

SEQ ID NO: 37133 - protein, 11 aa, Mycobacterium tuberculosis
LHELRTSTIPD

SEQ ID NO: 37134 - protein, 11 aa, Mycobacterium tuberculosis
HELRTSTIPDA

SEQ ID NO: 37135 - protein, 11 aa, Mycobacterium tuberculosis
ELRTSTIPDAD

SEQ ID NO: 37136 - protein, 11 aa, Mycobacterium tuberculosis
LRTSTIPDADD

SEQ ID NO: 37137 - protein, 11 aa, Mycobacterium tuberculosis
RTSTIPDADDP

SEQ ID NO: 37138 - protein, 11 aa, Mycobacterium tuberculosis
TSTIPDADDPS

SEQ ID NO: 37139 - protein, 11 aa, Mycobacterium tuberculosis
STIPDADDPSI

SEQ ID NO: 37140 - protein, 11 aa, Mycobacterium tuberculosis
TIPDADDPSIA

SEQ ID NO: 37141 - protein, 11 aa, Mycobacterium tuberculosis
IPDADDPSIAE

SEQ ID NO: 37142 - protein, 11 aa, Mycobacterium tuberculosis
PDADDPSIAEA

SEQ ID NO: 37143 - protein, 11 aa, Mycobacterium tuberculosis
DADDPSIAEAR

SEQ ID NO: 37144 - protein, 11 aa, Mycobacterium tuberculosis
ADDPSIAEARH

SEQ ID NO: 37145 - protein, 11 aa, Mycobacterium tuberculosis
DDPSIAEARHV

SEQ ID NO: 37146 - protein, 11 aa, Mycobacterium tuberculosis
DPSIAEARHVI

SEQ ID NO: 37147 - protein, 11 aa, Mycobacterium tuberculosis
PSIAEARHVIP

SEQ ID NO: 37148 - protein, 11 aa, Mycobacterium tuberculosis
SIAEARHVIPF

SEQ ID NO: 37149 - protein, 11 aa, Mycobacterium tuberculosis
IAEARHVIPFS

SEQ ID NO: 37150 - protein, 11 aa, Mycobacterium tuberculosis
AEARHVIPFSA

SEQ ID NO: 37151 - protein, 11 aa, Mycobacterium tuberculosis
EARHVIPFSAL

SEQ ID NO: 37152 - protein, 11 aa, Mycobacterium tuberculosis
ARHVIPFSALC

SEQ ID NO: 37153 - protein, 11 aa, Mycobacterium tuberculosis
RHVIPFSALCL

SEQ ID NO: 37154 - protein, 11 aa, Mycobacterium tuberculosis
HVIPFSALCLR

SEQ ID NO: 37155 - protein, 11 aa, Mycobacterium tuberculosis
VIPFSALCLRL

SEQ ID NO: 37156 - protein, 11 aa, Mycobacterium tuberculosis
IPFSALCLRLS

SEQ ID NO: 37157 - protein, 11 aa, Mycobacterium tuberculosis
PFSALCLRLSQ

SEQ ID NO: 37158 - protein, 11 aa, Mycobacterium tuberculosis
FSALCLRLSQL

SEQ ID NO: 37159 - protein, 11 aa, Mycobacterium tuberculosis
SALCLRLSQLG

SEQ ID NO: 37160 - protein, 11 aa, Mycobacterium tuberculosis
ALCLRLSQLGG

SEQ ID NO: 37161 - protein, 8 aa, Mycobacterium tuberculosis
MTQTGKRQ

SEQ ID NO: 37162 - protein, 8 aa, Mycobacterium tuberculosis
TQTGKRQR

SEQ ID NO: 37163 - protein, 8 aa, Mycobacterium tuberculosis
QTGKRQRR

SEQ ID NO: 37164 - protein, 8 aa, Mycobacterium tuberculosis
TGKRQRRK

SEQ ID NO: 37165 - protein, 8 aa, Mycobacterium tuberculosis
GKRQRRKF

SEQ ID NO: 37166 - protein, 8 aa, Mycobacterium tuberculosis
KRQRRKFG

SEQ ID NO: 37167 - protein, 8 aa, Mycobacterium tuberculosis
RQRRKFGR

SEQ ID NO: 37168 - protein, 8 aa, Mycobacterium tuberculosis
QRRKFGRI

SEQ ID NO: 37169 - protein, 8 aa, Mycobacterium tuberculosis
RRKFGRIR

SEQ ID NO: 37170 - protein, 8 aa, Mycobacterium tuberculosis
RKFGRIRQ

SEQ ID NO: 37171 - protein, 8 aa, Mycobacterium tuberculosis
KFGRIRQF

SEQ ID NO: 37172 - protein, 8 aa, Mycobacterium tuberculosis
FGRIRQFN

SEQ ID NO: 37173 - protein, 8 aa, Mycobacterium tuberculosis
GRIRQFNS

SEQ ID NO: 37174 - protein, 8 aa, Mycobacterium tuberculosis
RIRQFNSG

SEQ ID NO: 37175 - protein, 8 aa, Mycobacterium tuberculosis
IRQFNSGR

SEQ ID NO: 37176 - protein, 8 aa, Mycobacterium tuberculosis
RQFNSGRW

SEQ ID NO: 37177 - protein, 8 aa, Mycobacterium tuberculosis
QFNSGRWQ

SEQ ID NO: 37178 - protein, 8 aa, Mycobacterium tuberculosis
FNSGRWQA

SEQ ID NO: 37179 - protein, 8 aa, Mycobacterium tuberculosis
NSGRWQAS

SEQ ID NO: 37180 - protein, 8 aa, Mycobacterium tuberculosis
SGRWQASY

SEQ ID NO: 37181 - protein, 8 aa, Mycobacterium tuberculosis
GRWQASYT

SEQ ID NO: 37182 - protein, 8 aa, Mycobacterium tuberculosis
RWQASYTG

SEQ ID NO: 37183 - protein, 8 aa, Mycobacterium tuberculosis
WQASYTGP

SEQ ID NO: 37184 - protein, 8 aa, Mycobacterium tuberculosis
QASYTGPD

SEQ ID NO: 37185 - protein, 8 aa, Mycobacterium tuberculosis
ASYTGPDG

SEQ ID NO: 37186 - protein, 8 aa, Mycobacterium tuberculosis
SYTGPDGR

SEQ ID NO: 37187 - protein, 8 aa, Mycobacterium tuberculosis
YTGPDGRV

SEQ ID NO: 37188 - protein, 8 aa, Mycobacterium tuberculosis
TGPDGRVY

SEQ ID NO: 37189 - protein, 8 aa, Mycobacterium tuberculosis
GPDGRVYI

SEQ ID NO: 37190 - protein, 8 aa, Mycobacterium tuberculosis
PDGRVYIA

SEQ ID NO: 37191 - protein, 8 aa, Mycobacterium tuberculosis
DGRVYIAP

SEQ ID NO: 37192 - protein, 8 aa, Mycobacterium tuberculosis
GRVYIAPK

SEQ ID NO: 37193 - protein, 8 aa, Mycobacterium tuberculosis
RVYIAPKT

SEQ ID NO: 37194 - protein, 8 aa, Mycobacterium tuberculosis
VYIAPKTF

SEQ ID NO: 37195 - protein, 8 aa, Mycobacterium tuberculosis
YIAPKTFN

SEQ ID NO: 37196 - protein, 8 aa, Mycobacterium tuberculosis
IAPKTFNA

SEQ ID NO: 37197 - protein, 8 aa, Mycobacterium tuberculosis
APKTFNAK

SEQ ID NO: 37198 - protein, 8 aa, Mycobacterium tuberculosis
PKTFNAKI

SEQ ID NO: 37199 - protein, 8 aa, Mycobacterium tuberculosis
KTFNAKID

SEQ ID NO: 37200 - protein, 8 aa, Mycobacterium tuberculosis
TFNAKIDA

SEQ ID NO: 37201 - protein, 8 aa, Mycobacterium tuberculosis
FNAKIDAE

SEQ ID NO: 37202 - protein, 8 aa, Mycobacterium tuberculosis
NAKIDAEA

SEQ ID NO: 37203 - protein, 8 aa, Mycobacterium tuberculosis
AKIDAEAW

SEQ ID NO: 37204 - protein, 8 aa, Mycobacterium tuberculosis
KIDAEAWL

SEQ ID NO: 37205 - protein, 8 aa, Mycobacterium tuberculosis
IDAEAWLT

SEQ ID NO: 37206 - protein, 8 aa, Mycobacterium tuberculosis
DAEAWLTD

SEQ ID NO: 37207 - protein, 8 aa, Mycobacterium tuberculosis
AEAWLTDR

SEQ ID NO: 37208 - protein, 8 aa, Mycobacterium tuberculosis
EAWLTDRR

SEQ ID NO: 37209 - protein, 8 aa, Mycobacterium tuberculosis
AWLTDRRR

SEQ ID NO: 37210 - protein, 8 aa, Mycobacterium tuberculosis
WLTDRRRE

SEQ ID NO: 37211 - protein, 8 aa, Mycobacterium tuberculosis
LTDRRREI

SEQ ID NO: 37212 - protein, 8 aa, Mycobacterium tuberculosis
TDRRREID

SEQ ID NO: 37213 - protein, 8 aa, Mycobacterium tuberculosis
DRRREIDR

SEQ ID NO: 37214 - protein, 8 aa, Mycobacterium tuberculosis
RRREIDRQ

SEQ ID NO: 37215 - protein, 8 aa, Mycobacterium tuberculosis
RREIDRQL

SEQ ID NO: 37216 - protein, 8 aa, Mycobacterium tuberculosis
REIDRQLW

SEQ ID NO: 37217 - protein, 8 aa, Mycobacterium tuberculosis
EIDRQLWS

SEQ ID NO: 37218 - protein, 8 aa, Mycobacterium tuberculosis
IDRQLWSP

SEQ ID NO: 37219 - protein, 8 aa, Mycobacterium tuberculosis
DRQLWSPA

SEQ ID NO: 37220 - protein, 8 aa, Mycobacterium tuberculosis
RQLWSPAS

SEQ ID NO: 37221 - protein, 8 aa, Mycobacterium tuberculosis
QLWSPASG

SEQ ID NO: 37222 - protein, 8 aa, Mycobacterium tuberculosis
LWSPASGQ

SEQ ID NO: 37223 - protein, 8 aa, Mycobacterium tuberculosis
WSPASGQE

SEQ ID NO: 37224 - protein, 8 aa, Mycobacterium tuberculosis
SPASGQED

SEQ ID NO: 37225 - protein, 8 aa, Mycobacterium tuberculosis
PASGQEDR

SEQ ID NO: 37226 - protein, 8 aa, Mycobacterium tuberculosis
ASGQEDRP

SEQ ID NO: 37227 - protein, 8 aa, Mycobacterium tuberculosis
SGQEDRPG

SEQ ID NO: 37228 - protein, 8 aa, Mycobacterium tuberculosis
GQEDRPGA

SEQ ID NO: 37229 - protein, 8 aa, Mycobacterium tuberculosis
QEDRPGAP

SEQ ID NO: 37230 - protein, 8 aa, Mycobacterium tuberculosis
EDRPGAPF

SEQ ID NO: 37231 - protein, 8 aa, Mycobacterium tuberculosis
DRPGAPFG

SEQ ID NO: 37232 - protein, 8 aa, Mycobacterium tuberculosis
RPGAPFGE

SEQ ID NO: 37233 - protein, 8 aa, Mycobacterium tuberculosis
PGAPFGEY

SEQ ID NO: 37234 - protein, 8 aa, Mycobacterium tuberculosis
GAPFGEYA

SEQ ID NO: 37235 - protein, 8 aa, Mycobacterium tuberculosis
APFGEYAE

SEQ ID NO: 37236 - protein, 8 aa, Mycobacterium tuberculosis
PFGEYAEG

SEQ ID NO: 37237 - protein, 8 aa, Mycobacterium tuberculosis
FGEYAEGW

SEQ ID NO: 37238 - protein, 8 aa, Mycobacterium tuberculosis
GEYAEGWL

SEQ ID NO: 37239 - protein, 8 aa, Mycobacterium tuberculosis
EYAEGWLK

SEQ ID NO: 37240 - protein, 8 aa, Mycobacterium tuberculosis
YAEGWLKQ

SEQ ID NO: 37241 - protein, 8 aa, Mycobacterium tuberculosis
AEGWLKQR

SEQ ID NO: 37242 - protein, 8 aa, Mycobacterium tuberculosis
EGWLKQRG

SEQ ID NO: 37243 - protein, 8 aa, Mycobacterium tuberculosis
GWLKQRGI

SEQ ID NO: 37244 - protein, 8 aa, Mycobacterium tuberculosis
WLKQRGIK

SEQ ID NO: 37245 - protein, 8 aa, Mycobacterium tuberculosis
LKQRGIKD

SEQ ID NO: 37246 - protein, 8 aa, Mycobacterium tuberculosis
KQRGIKDR

SEQ ID NO: 37247 - protein, 8 aa, Mycobacterium tuberculosis
QRGIKDRT

SEQ ID NO: 37248 - protein, 8 aa, Mycobacterium tuberculosis
RGIKDRTR

SEQ ID NO: 37249 - protein, 8 aa, Mycobacterium tuberculosis
GIKDRTRA

SEQ ID NO: 37250 - protein, 8 aa, Mycobacterium tuberculosis
IKDRTRAH

SEQ ID NO: 37251 - protein, 8 aa, Mycobacterium tuberculosis
KDRTRAHY

SEQ ID NO: 37252 - protein, 8 aa, Mycobacterium tuberculosis
DRTRAHYR

SEQ ID NO: 37253 - protein, 8 aa, Mycobacterium tuberculosis
RTRAHYRK

SEQ ID NO: 37254 - protein, 8 aa, Mycobacterium tuberculosis
TRAHYRKL

SEQ ID NO: 37255 - protein, 8 aa, Mycobacterium tuberculosis
RAHYRKLL

SEQ ID NO: 37256 - protein, 8 aa, Mycobacterium tuberculosis
AHYRKLLD

SEQ ID NO: 37257 - protein, 8 aa, Mycobacterium tuberculosis
HYRKLLDN

SEQ ID NO: 37258 - protein, 8 aa, Mycobacterium tuberculosis
YRKLLDNH

SEQ ID NO: 37259 - protein, 8 aa, Mycobacterium tuberculosis
RKLLDNHI

SEQ ID NO: 37260 - protein, 8 aa, Mycobacterium tuberculosis
KLLDNHIL

SEQ ID NO: 37261 - protein, 8 aa, Mycobacterium tuberculosis
LLDNHILA

SEQ ID NO: 37262 - protein, 8 aa, Mycobacterium tuberculosis
LDNHILAT

SEQ ID NO: 37263 - protein, 8 aa, Mycobacterium tuberculosis
DNHILATF

SEQ ID NO: 37264 - protein, 8 aa, Mycobacterium tuberculosis
NHILATFA

SEQ ID NO: 37265 - protein, 8 aa, Mycobacterium tuberculosis
HILATFAD

SEQ ID NO: 37266 - protein, 8 aa, Mycobacterium tuberculosis
ILATFADT

SEQ ID NO: 37267 - protein, 8 aa, Mycobacterium tuberculosis
LATFADTD

SEQ ID NO: 37268 - protein, 8 aa, Mycobacterium tuberculosis
ATFADTDL

SEQ ID NO: 37269 - protein, 8 aa, Mycobacterium tuberculosis
TFADTDLR

SEQ ID NO: 37270 - protein, 8 aa, Mycobacterium tuberculosis
FADTDLRD

SEQ ID NO: 37271 - protein, 8 aa, Mycobacterium tuberculosis
ADTDLRDI

SEQ ID NO: 37272 - protein, 8 aa, Mycobacterium tuberculosis
DTDLRDIT

SEQ ID NO: 37273 - protein, 8 aa, Mycobacterium tuberculosis
TDLRDITP

SEQ ID NO: 37274 - protein, 8 aa, Mycobacterium tuberculosis
DLRDITPA

SEQ ID NO: 37275 - protein, 8 aa, Mycobacterium tuberculosis
LRDITPAA

SEQ ID NO: 37276 - protein, 8 aa, Mycobacterium tuberculosis
RDITPAAV

SEQ ID NO: 37277 - protein, 8 aa, Mycobacterium tuberculosis
DITPAAVR

SEQ ID NO: 37278 - protein, 8 aa, Mycobacterium tuberculosis
ITPAAVRR

SEQ ID NO: 37279 - protein, 8 aa, Mycobacterium tuberculosis
TPAAVRRW

SEQ ID NO: 37280 - protein, 8 aa, Mycobacterium tuberculosis
PAAVRRWY

SEQ ID NO: 37281 - protein, 8 aa, Mycobacterium tuberculosis
AAVRRWYA

SEQ ID NO: 37282 - protein, 8 aa, Mycobacterium tuberculosis
AVRRWYAT

SEQ ID NO: 37283 - protein, 8 aa, Mycobacterium tuberculosis
VRRWYATT

SEQ ID NO: 37284 - protein, 8 aa, Mycobacterium tuberculosis
RRWYATTA

SEQ ID NO: 37285 - protein, 8 aa, Mycobacterium tuberculosis
RWYATTAV

SEQ ID NO: 37286 - protein, 8 aa, Mycobacterium tuberculosis
WYATTAVG

SEQ ID NO: 37287 - protein, 8 aa, Mycobacterium tuberculosis
YATTAVGT

SEQ ID NO: 37288 - protein, 8 aa, Mycobacterium tuberculosis
ATTAVGTP

SEQ ID NO: 37289 - protein, 8 aa, Mycobacterium tuberculosis
TTAVGTPT

SEQ ID NO: 37290 - protein, 8 aa, Mycobacterium tuberculosis
TAVGTPTM

SEQ ID NO: 37291 - protein, 8 aa, Mycobacterium tuberculosis
AVGTPTMR

SEQ ID NO: 37292 - protein, 8 aa, Mycobacterium tuberculosis
VGTPTMRA

SEQ ID NO: 37293 - protein, 8 aa, Mycobacterium tuberculosis
GTPTMRAH

SEQ ID NO: 37294 - protein, 8 aa, Mycobacterium tuberculosis
TPTMRAHS

SEQ ID NO: 37295 - protein, 8 aa, Mycobacterium tuberculosis
PTMRAHSY

SEQ ID NO: 37296 - protein, 8 aa, Mycobacterium tuberculosis
TMRAHSYS

SEQ ID NO: 37297 - protein, 8 aa, Mycobacterium tuberculosis
MRAHSYSL

SEQ ID NO: 37298 - protein, 8 aa, Mycobacterium tuberculosis
RAHSYSLL

SEQ ID NO: 37299 - protein, 8 aa, Mycobacterium tuberculosis
AHSYSLLR

SEQ ID NO: 37300 - protein, 8 aa, Mycobacterium tuberculosis
HSYSLLRA

SEQ ID NO: 37301 - protein, 8 aa, Mycobacterium tuberculosis
SYSLLRAI

SEQ ID NO: 37302 - protein, 8 aa, Mycobacterium tuberculosis
YSLLRAIM

SEQ ID NO: 37303 - protein, 8 aa, Mycobacterium tuberculosis
SLLRAIMQ

SEQ ID NO: 37304 - protein, 8 aa, Mycobacterium tuberculosis
LLRAIMQT

SEQ ID NO: 37305 - protein, 8 aa, Mycobacterium tuberculosis
LRAIMQTA

SEQ ID NO: 37306 - protein, 8 aa, Mycobacterium tuberculosis
RAIMQTAL

SEQ ID NO: 37307 - protein, 8 aa, Mycobacterium tuberculosis
AIMQTALA

SEQ ID NO: 37308 - protein, 8 aa, Mycobacterium tuberculosis
IMQTALAD

SEQ ID NO: 37309 - protein, 8 aa, Mycobacterium tuberculosis
MQTALADD

SEQ ID NO: 37310 - protein, 8 aa, Mycobacterium tuberculosis
QTALADDL

SEQ ID NO: 37311 - protein, 8 aa, Mycobacterium tuberculosis
TALADDLI

SEQ ID NO: 37312 - protein, 8 aa, Mycobacterium tuberculosis
ALADDLID

SEQ ID NO: 37313 - protein, 8 aa, Mycobacterium tuberculosis
LADDLIDS

SEQ ID NO: 37314 - protein, 8 aa, Mycobacterium tuberculosis
ADDLIDSN

SEQ ID NO: 37315 - protein, 8 aa, Mycobacterium tuberculosis
DDLIDSNP

SEQ ID NO: 37316 - protein, 8 aa, Mycobacterium tuberculosis
DLIDSNPC

SEQ ID NO: 37317 - protein, 8 aa, Mycobacterium tuberculosis
LIDSNPCR

SEQ ID NO: 37318 - protein, 8 aa, Mycobacterium tuberculosis
IDSNPCRI

SEQ ID NO: 37319 - protein, 8 aa, Mycobacterium tuberculosis
DSNPCRIS

SEQ ID NO: 37320 - protein, 8 aa, Mycobacterium tuberculosis
SNPCRISG

SEQ ID NO: 37321 - protein, 8 aa, Mycobacterium tuberculosis
NPCRISGA

SEQ ID NO: 37322 - protein, 8 aa, Mycobacterium tuberculosis
PCRISGAS

SEQ ID NO: 37323 - protein, 8 aa, Mycobacterium tuberculosis
CRISGAST

SEQ ID NO: 37324 - protein, 8 aa, Mycobacterium tuberculosis
RISGASTA

SEQ ID NO: 37325 - protein, 8 aa, Mycobacterium tuberculosis
ISGASTAR

SEQ ID NO: 37326 - protein, 8 aa, Mycobacterium tuberculosis
SGASTARR

SEQ ID NO: 37327 - protein, 8 aa, Mycobacterium tuberculosis
GASTARRV

SEQ ID NO: 37328 - protein, 8 aa, Mycobacterium tuberculosis
ASTARRVH

SEQ ID NO: 37329 - protein, 8 aa, Mycobacterium tuberculosis
STARRVHK

SEQ ID NO: 37330 - protein, 8 aa, Mycobacterium tuberculosis
TARRVHKI

SEQ ID NO: 37331 - protein, 8 aa, Mycobacterium tuberculosis
ARRVHKIR

SEQ ID NO: 37332 - protein, 8 aa, Mycobacterium tuberculosis
RRVHKIRP

SEQ ID NO: 37333 - protein, 8 aa, Mycobacterium tuberculosis
RVHKIRPA

SEQ ID NO: 37334 - protein, 8 aa, Mycobacterium tuberculosis
VHKIRPAT

SEQ ID NO: 37335 - protein, 8 aa, Mycobacterium tuberculosis
HKIRPATL

SEQ ID NO: 37336 - protein, 8 aa, Mycobacterium tuberculosis
KIRPATLD

SEQ ID NO: 37337 - protein, 8 aa, Mycobacterium tuberculosis
IRPATLDE

SEQ ID NO: 37338 - protein, 8 aa, Mycobacterium tuberculosis
RPATLDEL

SEQ ID NO: 37339 - protein, 8 aa, Mycobacterium tuberculosis
PATLDELE

SEQ ID NO: 37340 - protein, 8 aa, Mycobacterium tuberculosis
ATLDELET

SEQ ID NO: 37341 - protein, 8 aa, Mycobacterium tuberculosis
TLDELETI

SEQ ID NO: 37342 - protein, 8 aa, Mycobacterium tuberculosis
LDELETIT

SEQ ID NO: 37343 - protein, 8 aa, Mycobacterium tuberculosis
DELETITK

SEQ ID NO: 37344 - protein, 8 aa, Mycobacterium tuberculosis
ELETITKA

SEQ ID NO: 37345 - protein, 8 aa, Mycobacterium tuberculosis
LETITKAM

SEQ ID NO: 37346 - protein, 8 aa, Mycobacterium tuberculosis
ETITKAMP

SEQ ID NO: 37347 - protein, 8 aa, Mycobacterium tuberculosis
TITKAMPD

SEQ ID NO: 37348 - protein, 8 aa, Mycobacterium tuberculosis
ITKAMPDP

SEQ ID NO: 37349 - protein, 8 aa, Mycobacterium tuberculosis
TKAMPDPY

SEQ ID NO: 37350 - protein, 8 aa, Mycobacterium tuberculosis
KAMPDPYQ

SEQ ID NO: 37351 - protein, 8 aa, Mycobacterium tuberculosis
AMPDPYQA

SEQ ID NO: 37352 - protein, 8 aa, Mycobacterium tuberculosis
MPDPYQAF

SEQ ID NO: 37353 - protein, 8 aa, Mycobacterium tuberculosis
PDPYQAFV

SEQ ID NO: 37354 - protein, 8 aa, Mycobacterium tuberculosis
DPYQAFVL

SEQ ID NO: 37355 - protein, 8 aa, Mycobacterium tuberculosis
PYQAFVLM

SEQ ID NO: 37356 - protein, 8 aa, Mycobacterium tuberculosis
YQAFVLMA

SEQ ID NO: 37357 - protein, 8 aa, Mycobacterium tuberculosis
QAFVLMAA

SEQ ID NO: 37358 - protein, 8 aa, Mycobacterium tuberculosis
AFVLMAAW

SEQ ID NO: 37359 - protein, 8 aa, Mycobacterium tuberculosis
FVLMAAWL

SEQ ID NO: 37360 - protein, 8 aa, Mycobacterium tuberculosis
VLMAAWLA

SEQ ID NO: 37361 - protein, 8 aa, Mycobacterium tuberculosis
LMAAWLAM

SEQ ID NO: 37362 - protein, 8 aa, Mycobacterium tuberculosis
MAAWLAMR

SEQ ID NO: 37363 - protein, 8 aa, Mycobacterium tuberculosis
AAWLAMRY

SEQ ID NO: 37364 - protein, 8 aa, Mycobacterium tuberculosis
AWLAMRYG

SEQ ID NO: 37365 - protein, 8 aa, Mycobacterium tuberculosis
WLAMRYGE

SEQ ID NO: 37366 - protein, 8 aa, Mycobacterium tuberculosis
LAMRYGEL

SEQ ID NO: 37367 - protein, 8 aa, Mycobacterium tuberculosis
AMRYGELT

SEQ ID NO: 37368 - protein, 8 aa, Mycobacterium tuberculosis
MRYGELTE

SEQ ID NO: 37369 - protein, 8 aa, Mycobacterium tuberculosis
RYGELTEL

SEQ ID NO: 37370 - protein, 8 aa, Mycobacterium tuberculosis
YGELTELR

SEQ ID NO: 37371 - protein, 8 aa, Mycobacterium tuberculosis
GELTELRR

SEQ ID NO: 37372 - protein, 8 aa, Mycobacterium tuberculosis
ELTELRRK

SEQ ID NO: 37373 - protein, 8 aa, Mycobacterium tuberculosis
LTELRRKD

SEQ ID NO: 37374 - protein, 8 aa, Mycobacterium tuberculosis
TELRRKDI

SEQ ID NO: 37375 - protein, 8 aa, Mycobacterium tuberculosis
ELRRKDID

SEQ ID NO: 37376 - protein, 8 aa, Mycobacterium tuberculosis
LRRKDIDL

SEQ ID NO: 37377 - protein, 8 aa, Mycobacterium tuberculosis
RRKDIDLH

SEQ ID NO: 37378 - protein, 8 aa, Mycobacterium tuberculosis
RKDIDLHG

SEQ ID NO: 37379 - protein, 8 aa, Mycobacterium tuberculosis
KDIDLHGE

SEQ ID NO: 37380 - protein, 8 aa, Mycobacterium tuberculosis
DIDLHGEV

SEQ ID NO: 37381 - protein, 8 aa, Mycobacterium tuberculosis
IDLHGEVA

SEQ ID NO: 37382 - protein, 8 aa, Mycobacterium tuberculosis
DLHGEVAR

SEQ ID NO: 37383 - protein, 8 aa, Mycobacterium tuberculosis
LHGEVARV

SEQ ID NO: 37384 - protein, 8 aa, Mycobacterium tuberculosis
HGEVARVR

SEQ ID NO: 37385 - protein, 8 aa, Mycobacterium tuberculosis
GEVARVRR

SEQ ID NO: 37386 - protein, 8 aa, Mycobacterium tuberculosis
EVARVRRA

SEQ ID NO: 37387 - protein, 8 aa, Mycobacterium tuberculosis
VARVRRAV

SEQ ID NO: 37388 - protein, 8 aa, Mycobacterium tuberculosis
ARVRRAVV

SEQ ID NO: 37389 - protein, 8 aa, Mycobacterium tuberculosis
RVRRAVVR

SEQ ID NO: 37390 - protein, 8 aa, Mycobacterium tuberculosis
VRRAVVRV

SEQ ID NO: 37391 - protein, 8 aa, Mycobacterium tuberculosis
RRAVVRVG

SEQ ID NO: 37392 - protein, 8 aa, Mycobacterium tuberculosis
RAVVRVGE

SEQ ID NO: 37393 - protein, 8 aa, Mycobacterium tuberculosis
AVVRVGEG

SEQ ID NO: 37394 - protein, 8 aa, Mycobacterium tuberculosis
VVRVGEGF

SEQ ID NO: 37395 - protein, 8 aa, Mycobacterium tuberculosis
VRVGEGFK

SEQ ID NO: 37396 - protein, 8 aa, Mycobacterium tuberculosis
RVGEGFKV

SEQ ID NO: 37397 - protein, 8 aa, Mycobacterium tuberculosis
VGEGFKVT

SEQ ID NO: 37398 - protein, 8 aa, Mycobacterium tuberculosis
GEGFKVTT

SEQ ID NO: 37399 - protein, 8 aa, Mycobacterium tuberculosis
EGFKVTTP

SEQ ID NO: 37400 - protein, 8 aa, Mycobacterium tuberculosis
GFKVTTPK

SEQ ID NO: 37401 - protein, 8 aa, Mycobacterium tuberculosis
FKVTTPKS

SEQ ID NO: 37402 - protein, 8 aa, Mycobacterium tuberculosis
KVTTPKSD

SEQ ID NO: 37403 - protein, 8 aa, Mycobacterium tuberculosis
VTTPKSDA

SEQ ID NO: 37404 - protein, 8 aa, Mycobacterium tuberculosis
TTPKSDAG

SEQ ID NO: 37405 - protein, 8 aa, Mycobacterium tuberculosis
TPKSDAGV

SEQ ID NO: 37406 - protein, 8 aa, Mycobacterium tuberculosis
PKSDAGVR

SEQ ID NO: 37407 - protein, 8 aa, Mycobacterium tuberculosis
KSDAGVRD

SEQ ID NO: 37408 - protein, 8 aa, Mycobacterium tuberculosis
SDAGVRDI

SEQ ID NO: 37409 - protein, 8 aa, Mycobacterium tuberculosis
DAGVRDIS

SEQ ID NO: 37410 - protein, 8 aa, Mycobacterium tuberculosis
AGVRDISI

SEQ ID NO: 37411 - protein, 8 aa, Mycobacterium tuberculosis
GVRDISIP

SEQ ID NO: 37412 - protein, 8 aa, Mycobacterium tuberculosis
VRDISIPP

SEQ ID NO: 37413 - protein, 8 aa, Mycobacterium tuberculosis
RDISIPPH

SEQ ID NO: 37414 - protein, 8 aa, Mycobacterium tuberculosis
DISIPPHL

SEQ ID NO: 37415 - protein, 8 aa, Mycobacterium tuberculosis
ISIPPHLI

SEQ ID NO: 37416 - protein, 8 aa, Mycobacterium tuberculosis
SIPPHLIP

SEQ ID NO: 37417 - protein, 8 aa, Mycobacterium tuberculosis
IPPHLIPA

SEQ ID NO: 37418 - protein, 8 aa, Mycobacterium tuberculosis
PPHLIPAI

SEQ ID NO: 37419 - protein, 8 aa, Mycobacterium tuberculosis
PHLIPAIE

SEQ ID NO: 37420 - protein, 8 aa, Mycobacterium tuberculosis
HLIPAIED

SEQ ID NO: 37421 - protein, 8 aa, Mycobacterium tuberculosis
LIPAIEDH

SEQ ID NO: 37422 - protein, 8 aa, Mycobacterium tuberculosis
IPAIEDHL

SEQ ID NO: 37423 - protein, 8 aa, Mycobacterium tuberculosis
PAIEDHLH

SEQ ID NO: 37424 - protein, 8 aa, Mycobacterium tuberculosis
AIEDHLHK

SEQ ID NO: 37425 - protein, 8 aa, Mycobacterium tuberculosis
IEDHLHKH

SEQ ID NO: 37426 - protein, 8 aa, Mycobacterium tuberculosis
EDHLHKHV

SEQ ID NO: 37427 - protein, 8 aa, Mycobacterium tuberculosis
DHLHKHVN

SEQ ID NO: 37428 - protein, 8 aa, Mycobacterium tuberculosis
HLHKHVNP

SEQ ID NO: 37429 - protein, 8 aa, Mycobacterium tuberculosis
LHKHVNPG

SEQ ID NO: 37430 - protein, 8 aa, Mycobacterium tuberculosis
HKHVNPGR

SEQ ID NO: 37431 - protein, 8 aa, Mycobacterium tuberculosis
KHVNPGRE

SEQ ID NO: 37432 - protein, 8 aa, Mycobacterium tuberculosis
HVNPGRES

SEQ ID NO: 37433 - protein, 8 aa, Mycobacterium tuberculosis
VNPGRESL

SEQ ID NO: 37434 - protein, 8 aa, Mycobacterium tuberculosis
NPGRESLL

SEQ ID NO: 37435 - protein, 8 aa, Mycobacterium tuberculosis
PGRESLLF

SEQ ID NO: 37436 - protein, 8 aa, Mycobacterium tuberculosis
GRESLLFP

SEQ ID NO: 37437 - protein, 8 aa, Mycobacterium tuberculosis
RESLLFPS

SEQ ID NO: 37438 - protein, 8 aa, Mycobacterium tuberculosis
ESLLFPSV

SEQ ID NO: 37439 - protein, 8 aa, Mycobacterium tuberculosis
SLLFPSVN

SEQ ID NO: 37440 - protein, 8 aa, Mycobacterium tuberculosis
LLFPSVND

SEQ ID NO: 37441 - protein, 8 aa, Mycobacterium tuberculosis
LFPSVNDP

SEQ ID NO: 37442 - protein, 8 aa, Mycobacterium tuberculosis
FPSVNDPN

SEQ ID NO: 37443 - protein, 8 aa, Mycobacterium tuberculosis
PSVNDPNR

SEQ ID NO: 37444 - protein, 8 aa, Mycobacterium tuberculosis
SVNDPNRH

SEQ ID NO: 37445 - protein, 8 aa, Mycobacterium tuberculosis
VNDPNRHL

SEQ ID NO: 37446 - protein, 8 aa, Mycobacterium tuberculosis
NDPNRHLA

SEQ ID NO: 37447 - protein, 8 aa, Mycobacterium tuberculosis
DPNRHLAP

SEQ ID NO: 37448 - protein, 8 aa, Mycobacterium tuberculosis
PNRHLAPS

SEQ ID NO: 37449 - protein, 8 aa, Mycobacterium tuberculosis
NRHLAPSA

SEQ ID NO: 37450 - protein, 8 aa, Mycobacterium tuberculosis
RHLAPSAL

SEQ ID NO: 37451 - protein, 8 aa, Mycobacterium tuberculosis
HLAPSALY

SEQ ID NO: 37452 - protein, 8 aa, Mycobacterium tuberculosis
LAPSALYR

SEQ ID NO: 37453 - protein, 8 aa, Mycobacterium tuberculosis
APSALYRM

SEQ ID NO: 37454 - protein, 8 aa, Mycobacterium tuberculosis
PSALYRMF

SEQ ID NO: 37455 - protein, 8 aa, Mycobacterium tuberculosis
SALYRMFY

SEQ ID NO: 37456 - protein, 8 aa, Mycobacterium tuberculosis
ALYRMFYK

SEQ ID NO: 37457 - protein, 8 aa, Mycobacterium tuberculosis
LYRMFYKA

SEQ ID NO: 37458 - protein, 8 aa, Mycobacterium tuberculosis
YRMFYKAR

SEQ ID NO: 37459 - protein, 8 aa, Mycobacterium tuberculosis
RMFYKARK

SEQ ID NO: 37460 - protein, 8 aa, Mycobacterium tuberculosis
MFYKARKA

SEQ ID NO: 37461 - protein, 8 aa, Mycobacterium tuberculosis
FYKARKAA

SEQ ID NO: 37462 - protein, 8 aa, Mycobacterium tuberculosis
YKARKAAG

SEQ ID NO: 37463 - protein, 8 aa, Mycobacterium tuberculosis
KARKAAGR

SEQ ID NO: 37464 - protein, 8 aa, Mycobacterium tuberculosis
ARKAAGRP

SEQ ID NO: 37465 - protein, 8 aa, Mycobacterium tuberculosis
RKAAGRPD

SEQ ID NO: 37466 - protein, 8 aa, Mycobacterium tuberculosis
KAAGRPDL

SEQ ID NO: 37467 - protein, 8 aa, Mycobacterium tuberculosis
AAGRPDLR

SEQ ID NO: 37468 - protein, 8 aa, Mycobacterium tuberculosis
AGRPDLRV

SEQ ID NO: 37469 - protein, 8 aa, Mycobacterium tuberculosis
GRPDLRVH

SEQ ID NO: 37470 - protein, 8 aa, Mycobacterium tuberculosis
RPDLRVHD

SEQ ID NO: 37471 - protein, 8 aa, Mycobacterium tuberculosis
PDLRVHDL

SEQ ID NO: 37472 - protein, 8 aa, Mycobacterium tuberculosis
DLRVHDLR

SEQ ID NO: 37473 - protein, 8 aa, Mycobacterium tuberculosis
LRVHDLRH

SEQ ID NO: 37474 - protein, 8 aa, Mycobacterium tuberculosis
RVHDLRHS

SEQ ID NO: 37475 - protein, 8 aa, Mycobacterium tuberculosis
VHDLRHSG

SEQ ID NO: 37476 - protein, 8 aa, Mycobacterium tuberculosis
HDLRHSGA

SEQ ID NO: 37477 - protein, 8 aa, Mycobacterium tuberculosis
DLRHSGAV

SEQ ID NO: 37478 - protein, 8 aa, Mycobacterium tuberculosis
LRHSGAVL

SEQ ID NO: 37479 - protein, 8 aa, Mycobacterium tuberculosis
RHSGAVLA

SEQ ID NO: 37480 - protein, 8 aa, Mycobacterium tuberculosis
HSGAVLAA

SEQ ID NO: 37481 - protein, 8 aa, Mycobacterium tuberculosis
SGAVLAAS

SEQ ID NO: 37482 - protein, 8 aa, Mycobacterium tuberculosis
GAVLAAST

SEQ ID NO: 37483 - protein, 8 aa, Mycobacterium tuberculosis
AVLAASTG

SEQ ID NO: 37484 - protein, 8 aa, Mycobacterium tuberculosis
VLAASTGA

SEQ ID NO: 37485 - protein, 8 aa, Mycobacterium tuberculosis
LAASTGAT

SEQ ID NO: 37486 - protein, 8 aa, Mycobacterium tuberculosis
AASTGATL

SEQ ID NO: 37487 - protein, 8 aa, Mycobacterium tuberculosis
ASTGATLA

SEQ ID NO: 37488 - protein, 8 aa, Mycobacterium tuberculosis
STGATLAE

SEQ ID NO: 37489 - protein, 8 aa, Mycobacterium tuberculosis
TGATLAEL

SEQ ID NO: 37490 - protein, 8 aa, Mycobacterium tuberculosis
GATLAELM

SEQ ID NO: 37491 - protein, 8 aa, Mycobacterium tuberculosis
ATLAELMQ

SEQ ID NO: 37492 - protein, 8 aa, Mycobacterium tuberculosis
TLAELMQR

SEQ ID NO: 37493 - protein, 8 aa, Mycobacterium tuberculosis
LAELMQRL

SEQ ID NO: 37494 - protein, 8 aa, Mycobacterium tuberculosis
AELMQRLG

SEQ ID NO: 37495 - protein, 8 aa, Mycobacterium tuberculosis
ELMQRLGH

SEQ ID NO: 37496 - protein, 8 aa, Mycobacterium tuberculosis
LMQRLGHS

SEQ ID NO: 37497 - protein, 8 aa, Mycobacterium tuberculosis
MQRLGHST

SEQ ID NO: 37498 - protein, 8 aa, Mycobacterium tuberculosis
QRLGHSTA

SEQ ID NO: 37499 - protein, 8 aa, Mycobacterium tuberculosis
RLGHSTAG

SEQ ID NO: 37500 - protein, 8 aa, Mycobacterium tuberculosis
LGHSTAGA

SEQ ID NO: 37501 - protein, 8 aa, Mycobacterium tuberculosis
GHSTAGAA

SEQ ID NO: 37502 - protein, 8 aa, Mycobacterium tuberculosis
HSTAGAAL

SEQ ID NO: 37503 - protein, 8 aa, Mycobacterium tuberculosis
STAGAALR

SEQ ID NO: 37504 - protein, 8 aa, Mycobacterium tuberculosis
TAGAALRY

SEQ ID NO: 37505 - protein, 8 aa, Mycobacterium tuberculosis
AGAALRYQ

SEQ ID NO: 37506 - protein, 8 aa, Mycobacterium tuberculosis
GAALRYQH

SEQ ID NO: 37507 - protein, 8 aa, Mycobacterium tuberculosis
AALRYQHA

SEQ ID NO: 37508 - protein, 8 aa, Mycobacterium tuberculosis
ALRYQHAA

SEQ ID NO: 37509 - protein, 8 aa, Mycobacterium tuberculosis
LRYQHAAK

SEQ ID NO: 37510 - protein, 8 aa, Mycobacterium tuberculosis
RYQHAAKG

SEQ ID NO: 37511 - protein, 8 aa, Mycobacterium tuberculosis
YQHAAKGR

SEQ ID NO: 37512 - protein, 8 aa, Mycobacterium tuberculosis
QHAAKGRD

SEQ ID NO: 37513 - protein, 8 aa, Mycobacterium tuberculosis
HAAKGRDR

SEQ ID NO: 37514 - protein, 8 aa, Mycobacterium tuberculosis
AAKGRDRE

SEQ ID NO: 37515 - protein, 8 aa, Mycobacterium tuberculosis
AKGRDREI

SEQ ID NO: 37516 - protein, 8 aa, Mycobacterium tuberculosis
KGRDREIA

SEQ ID NO: 37517 - protein, 8 aa, Mycobacterium tuberculosis
GRDREIAA

SEQ ID NO: 37518 - protein, 8 aa, Mycobacterium tuberculosis
RDREIAAL

SEQ ID NO: 37519 - protein, 8 aa, Mycobacterium tuberculosis
DREIAALL

SEQ ID NO: 37520 - protein, 8 aa, Mycobacterium tuberculosis
REIAALLS

SEQ ID NO: 37521 - protein, 8 aa, Mycobacterium tuberculosis
EIAALLSK

SEQ ID NO: 37522 - protein, 8 aa, Mycobacterium tuberculosis
IAALLSKL

SEQ ID NO: 37523 - protein, 8 aa, Mycobacterium tuberculosis
AALLSKLA

SEQ ID NO: 37524 - protein, 8 aa, Mycobacterium tuberculosis
ALLSKLAE

SEQ ID NO: 37525 - protein, 8 aa, Mycobacterium tuberculosis
LLSKLAEN

SEQ ID NO: 37526 - protein, 8 aa, Mycobacterium tuberculosis
LSKLAENQ

SEQ ID NO: 37527 - protein, 8 aa, Mycobacterium tuberculosis
SKLAENQE

SEQ ID NO: 37528 - protein, 8 aa, Mycobacterium tuberculosis
KLAENQEM

SEQ ID NO: 37529 - protein, 9 aa, Mycobacterium tuberculosis
MTQTGKRQR

SEQ ID NO: 37530 - protein, 9 aa, Mycobacterium tuberculosis
TQTGKRQRR

SEQ ID NO: 37531 - protein, 9 aa, Mycobacterium tuberculosis
QTGKRQRRK

SEQ ID NO: 37532 - protein, 9 aa, Mycobacterium tuberculosis
TGKRQRRKF

SEQ ID NO: 37533 - protein, 9 aa, Mycobacterium tuberculosis
GKRQRRKFG

SEQ ID NO: 37534 - protein, 9 aa, Mycobacterium tuberculosis
KRQRRKFGR

SEQ ID NO: 37535 - protein, 9 aa, Mycobacterium tuberculosis
RQRRKFGRI

SEQ ID NO: 37536 - protein, 9 aa, Mycobacterium tuberculosis
QRRKFGRIR

SEQ ID NO: 37537 - protein, 9 aa, Mycobacterium tuberculosis
RRKFGRIRQ

SEQ ID NO: 37538 - protein, 9 aa, Mycobacterium tuberculosis
RKFGRIRQF

SEQ ID NO: 37539 - protein, 9 aa, Mycobacterium tuberculosis
KFGRIRQFN

SEQ ID NO: 37540 - protein, 9 aa, Mycobacterium tuberculosis
FGRIRQFNS

SEQ ID NO: 37541 - protein, 9 aa, Mycobacterium tuberculosis
GRIRQFNSG

SEQ ID NO: 37542 - protein, 9 aa, Mycobacterium tuberculosis
RIRQFNSGR

SEQ ID NO: 37543 - protein, 9 aa, Mycobacterium tuberculosis
IRQFNSGRW

SEQ ID NO: 37544 - protein, 9 aa, Mycobacterium tuberculosis
RQFNSGRWQ

SEQ ID NO: 37545 - protein, 9 aa, Mycobacterium tuberculosis
QFNSGRWQA

SEQ ID NO: 37546 - protein, 9 aa, Mycobacterium tuberculosis
FNSGRWQAS

SEQ ID NO: 37547 - protein, 9 aa, Mycobacterium tuberculosis
NSGRWQASY

SEQ ID NO: 37548 - protein, 9 aa, Mycobacterium tuberculosis
SGRWQASYT

SEQ ID NO: 37549 - protein, 9 aa, Mycobacterium tuberculosis
GRWQASYTG

SEQ ID NO: 37550 - protein, 9 aa, Mycobacterium tuberculosis
RWQASYTGP

SEQ ID NO: 37551 - protein, 9 aa, Mycobacterium tuberculosis
WQASYTGPD

SEQ ID NO: 37552 - protein, 9 aa, Mycobacterium tuberculosis
QASYTGPDG

SEQ ID NO: 37553 - protein, 9 aa, Mycobacterium tuberculosis
ASYTGPDGR

SEQ ID NO: 37554 - protein, 9 aa, Mycobacterium tuberculosis
SYTGPDGRV

SEQ ID NO: 37555 - protein, 9 aa, Mycobacterium tuberculosis
YTGPDGRVY

SEQ ID NO: 37556 - protein, 9 aa, Mycobacterium tuberculosis
TGPDGRVYI

SEQ ID NO: 37557 - protein, 9 aa, Mycobacterium tuberculosis
GPDGRVYIA

SEQ ID NO: 37558 - protein, 9 aa, Mycobacterium tuberculosis
PDGRVYIAP

SEQ ID NO: 37559 - protein, 9 aa, Mycobacterium tuberculosis
DGRVYIAPK

SEQ ID NO: 37560 - protein, 9 aa, Mycobacterium tuberculosis
GRVYIAPKT

SEQ ID NO: 37561 - protein, 9 aa, Mycobacterium tuberculosis
RVYIAPKTF

SEQ ID NO: 37562 - protein, 9 aa, Mycobacterium tuberculosis
VYIAPKTFN

SEQ ID NO: 37563 - protein, 9 aa, Mycobacterium tuberculosis
YIAPKTFNA

SEQ ID NO: 37564 - protein, 9 aa, Mycobacterium tuberculosis
IAPKTFNAK

SEQ ID NO: 37565 - protein, 9 aa, Mycobacterium tuberculosis
APKTFNAKI

SEQ ID NO: 37566 - protein, 9 aa, Mycobacterium tuberculosis
PKTFNAKID

SEQ ID NO: 37567 - protein, 9 aa, Mycobacterium tuberculosis
KTFNAKIDA

SEQ ID NO: 37568 - protein, 9 aa, Mycobacterium tuberculosis
TFNAKIDAE

SEQ ID NO: 37569 - protein, 9 aa, Mycobacterium tuberculosis
FNAKIDAEA

SEQ ID NO: 37570 - protein, 9 aa, Mycobacterium tuberculosis
NAKIDAEAW

SEQ ID NO: 37571 - protein, 9 aa, Mycobacterium tuberculosis
AKIDAEAWL

SEQ ID NO: 37572 - protein, 9 aa, Mycobacterium tuberculosis
KIDAEAWLT

SEQ ID NO: 37573 - protein, 9 aa, Mycobacterium tuberculosis
IDAEAWLTD

SEQ ID NO: 37574 - protein, 9 aa, Mycobacterium tuberculosis
DAEAWLTDR

SEQ ID NO: 37575 - protein, 9 aa, Mycobacterium tuberculosis
AEAWLTDRR

SEQ ID NO: 37576 - protein, 9 aa, Mycobacterium tuberculosis
EAWLTDRRR

SEQ ID NO: 37577 - protein, 9 aa, Mycobacterium tuberculosis
AWLTDRRRE

SEQ ID NO: 37578 - protein, 9 aa, Mycobacterium tuberculosis
WLTDRRREI

SEQ ID NO: 37579 - protein, 9 aa, Mycobacterium tuberculosis
LTDRRREID

SEQ ID NO: 37580 - protein, 9 aa, Mycobacterium tuberculosis
TDRRREIDR

SEQ ID NO: 37581 - protein, 9 aa, Mycobacterium tuberculosis
DRRREIDRQ

SEQ ID NO: 37582 - protein, 9 aa, Mycobacterium tuberculosis
RRREIDRQL

SEQ ID NO: 37583 - protein, 9 aa, Mycobacterium tuberculosis
RREIDRQLW

SEQ ID NO: 37584 - protein, 9 aa, Mycobacterium tuberculosis
REIDRQLWS

SEQ ID NO: 37585 - protein, 9 aa, Mycobacterium tuberculosis
EIDRQLWSP

SEQ ID NO: 37586 - protein, 9 aa, Mycobacterium tuberculosis
IDRQLWSPA

SEQ ID NO: 37587 - protein, 9 aa, Mycobacterium tuberculosis
DRQLWSPAS

SEQ ID NO: 37588 - protein, 9 aa, Mycobacterium tuberculosis
RQLWSPASG

SEQ ID NO: 37589 - protein, 9 aa, Mycobacterium tuberculosis
QLWSPASGQ

SEQ ID NO: 37590 - protein, 9 aa, Mycobacterium tuberculosis
LWSPASGQE

SEQ ID NO: 37591 - protein, 9 aa, Mycobacterium tuberculosis
WSPASGQED

SEQ ID NO: 37592 - protein, 9 aa, Mycobacterium tuberculosis
SPASGQEDR

SEQ ID NO: 37593 - protein, 9 aa, Mycobacterium tuberculosis
PASGQEDRP

SEQ ID NO: 37594 - protein, 9 aa, Mycobacterium tuberculosis
ASGQEDRPG

SEQ ID NO: 37595 - protein, 9 aa, Mycobacterium tuberculosis
SGQEDRPGA

SEQ ID NO: 37596 - protein, 9 aa, Mycobacterium tuberculosis
GQEDRPGAP

SEQ ID NO: 37597 - protein, 9 aa, Mycobacterium tuberculosis
QEDRPGAPF

SEQ ID NO: 37598 - protein, 9 aa, Mycobacterium tuberculosis
EDRPGAPFG

SEQ ID NO: 37599 - protein, 9 aa, Mycobacterium tuberculosis
DRPGAPFGE

SEQ ID NO: 37600 - protein, 9 aa, Mycobacterium tuberculosis
RPGAPFGEY

SEQ ID NO: 37601 - protein, 9 aa, Mycobacterium tuberculosis
PGAPFGEYA

SEQ ID NO: 37602 - protein, 9 aa, Mycobacterium tuberculosis
GAPFGEYAE

SEQ ID NO: 37603 - protein, 9 aa, Mycobacterium tuberculosis
APFGEYAEG

SEQ ID NO: 37604 - protein, 9 aa, Mycobacterium tuberculosis
PFGEYAEGW

SEQ ID NO: 37605 - protein, 9 aa, Mycobacterium tuberculosis
FGEYAEGWL

SEQ ID NO: 37606 - protein, 9 aa, Mycobacterium tuberculosis
GEYAEGWLK

SEQ ID NO: 37607 - protein, 9 aa, Mycobacterium tuberculosis
EYAEGWLKQ

SEQ ID NO: 37608 - protein, 9 aa, Mycobacterium tuberculosis
YAEGWLKQR

SEQ ID NO: 37609 - protein, 9 aa, Mycobacterium tuberculosis
AEGWLKQRG

SEQ ID NO: 37610 - protein, 9 aa, Mycobacterium tuberculosis
EGWLKQRGI

SEQ ID NO: 37611 - protein, 9 aa, Mycobacterium tuberculosis
GWLKQRGIK

SEQ ID NO: 37612 - protein, 9 aa, Mycobacterium tuberculosis
WLKQRGIKD

SEQ ID NO: 37613 - protein, 9 aa, Mycobacterium tuberculosis
LKQRGIKDR

SEQ ID NO: 37614 - protein, 9 aa, Mycobacterium tuberculosis
KQRGIKDRT

SEQ ID NO: 37615 - protein, 9 aa, Mycobacterium tuberculosis
QRGIKDRTR

SEQ ID NO: 37616 - protein, 9 aa, Mycobacterium tuberculosis
RGIKDRTRA

SEQ ID NO: 37617 - protein, 9 aa, Mycobacterium tuberculosis
GIKDRTRAH

SEQ ID NO: 37618 - protein, 9 aa, Mycobacterium tuberculosis
IKDRTRAHY

SEQ ID NO: 37619 - protein, 9 aa, Mycobacterium tuberculosis
KDRTRAHYR

SEQ ID NO: 37620 - protein, 9 aa, Mycobacterium tuberculosis
DRTRAHYRK

SEQ ID NO: 37621 - protein, 9 aa, Mycobacterium tuberculosis
RTRAHYRKL

SEQ ID NO: 37622 - protein, 9 aa, Mycobacterium tuberculosis
TRAHYRKLL

SEQ ID NO: 37623 - protein, 9 aa, Mycobacterium tuberculosis
RAHYRKLLD

SEQ ID NO: 37624 - protein, 9 aa, Mycobacterium tuberculosis
AHYRKLLDN

SEQ ID NO: 37625 - protein, 9 aa, Mycobacterium tuberculosis
HYRKLLDNH

SEQ ID NO: 37626 - protein, 9 aa, Mycobacterium tuberculosis
YRKLLDNHI

SEQ ID NO: 37627 - protein, 9 aa, Mycobacterium tuberculosis
RKLLDNHIL

SEQ ID NO: 37628 - protein, 9 aa, Mycobacterium tuberculosis
KLLDNHILA

SEQ ID NO: 37629 - protein, 9 aa, Mycobacterium tuberculosis
LLDNHILAT

SEQ ID NO: 37630 - protein, 9 aa, Mycobacterium tuberculosis
LDNHILATF

SEQ ID NO: 37631 - protein, 9 aa, Mycobacterium tuberculosis
DNHILATFA

SEQ ID NO: 37632 - protein, 9 aa, Mycobacterium tuberculosis
NHILATFAD

SEQ ID NO: 37633 - protein, 9 aa, Mycobacterium tuberculosis
HILATFADT

SEQ ID NO: 37634 - protein, 9 aa, Mycobacterium tuberculosis
ILATFADTD

SEQ ID NO: 37635 - protein, 9 aa, Mycobacterium tuberculosis
LATFADTDL

SEQ ID NO: 37636 - protein, 9 aa, Mycobacterium tuberculosis
ATFADTDLR

SEQ ID NO: 37637 - protein, 9 aa, Mycobacterium tuberculosis
TFADTDLRD

SEQ ID NO: 37638 - protein, 9 aa, Mycobacterium tuberculosis
FADTDLRDI

SEQ ID NO: 37639 - protein, 9 aa, Mycobacterium tuberculosis
ADTDLRDIT

SEQ ID NO: 37640 - protein, 9 aa, Mycobacterium tuberculosis
DTDLRDITP

SEQ ID NO: 37641 - protein, 9 aa, Mycobacterium tuberculosis
TDLRDITPA

SEQ ID NO: 37642 - protein, 9 aa, Mycobacterium tuberculosis
DLRDITPAA

SEQ ID NO: 37643 - protein, 9 aa, Mycobacterium tuberculosis
LRDITPAAV

SEQ ID NO: 37644 - protein, 9 aa, Mycobacterium tuberculosis
RDITPAAVR

SEQ ID NO: 37645 - protein, 9 aa, Mycobacterium tuberculosis
DITPAAVRR

SEQ ID NO: 37646 - protein, 9 aa, Mycobacterium tuberculosis
ITPAAVRRW

SEQ ID NO: 37647 - protein, 9 aa, Mycobacterium tuberculosis
TPAAVRRWY

SEQ ID NO: 37648 - protein, 9 aa, Mycobacterium tuberculosis
PAAVRRWYA

SEQ ID NO: 37649 - protein, 9 aa, Mycobacterium tuberculosis
AAVRRWYAT

SEQ ID NO: 37650 - protein, 9 aa, Mycobacterium tuberculosis
AVRRWYATT

SEQ ID NO: 37651 - protein, 9 aa, Mycobacterium tuberculosis
VRRWYATTA

SEQ ID NO: 37652 - protein, 9 aa, Mycobacterium tuberculosis
RRWYATTAV

SEQ ID NO: 37653 - protein, 9 aa, Mycobacterium tuberculosis
RWYATTAVG

SEQ ID NO: 37654 - protein, 9 aa, Mycobacterium tuberculosis
WYATTAVGT

SEQ ID NO: 37655 - protein, 9 aa, Mycobacterium tuberculosis
YATTAVGTP

SEQ ID NO: 37656 - protein, 9 aa, Mycobacterium tuberculosis
ATTAVGTPT

SEQ ID NO: 37657 - protein, 9 aa, Mycobacterium tuberculosis
TTAVGTPTM

SEQ ID NO: 37658 - protein, 9 aa, Mycobacterium tuberculosis
TAVGTPTMR

SEQ ID NO: 37659 - protein, 9 aa, Mycobacterium tuberculosis
AVGTPTMRA

SEQ ID NO: 37660 - protein, 9 aa, Mycobacterium tuberculosis
VGTPTMRAH

SEQ ID NO: 37661 - protein, 9 aa, Mycobacterium tuberculosis
GTPTMRAHS

SEQ ID NO: 37662 - protein, 9 aa, Mycobacterium tuberculosis
TPTMRAHSY

SEQ ID NO: 37663 - protein, 9 aa, Mycobacterium tuberculosis
PTMRAHSYS

SEQ ID NO: 37664 - protein, 9 aa, Mycobacterium tuberculosis
TMRAHSYSL

SEQ ID NO: 37665 - protein, 9 aa, Mycobacterium tuberculosis
MRAHSYSLL

SEQ ID NO: 37666 - protein, 9 aa, Mycobacterium tuberculosis
RAHSYSLLR

SEQ ID NO: 37667 - protein, 9 aa, Mycobacterium tuberculosis
AHSYSLLRA

SEQ ID NO: 37668 - protein, 9 aa, Mycobacterium tuberculosis
HSYSLLRAI

SEQ ID NO: 37669 - protein, 9 aa, Mycobacterium tuberculosis
SYSLLRAIM

SEQ ID NO: 37670 - protein, 9 aa, Mycobacterium tuberculosis
YSLLRAIMQ

SEQ ID NO: 37671 - protein, 9 aa, Mycobacterium tuberculosis
SLLRAIMQT

SEQ ID NO: 37672 - protein, 9 aa, Mycobacterium tuberculosis
LLRAIMQTA

SEQ ID NO: 37673 - protein, 9 aa, Mycobacterium tuberculosis
LRAIMQTAL

SEQ ID NO: 37674 - protein, 9 aa, Mycobacterium tuberculosis
RAIMQTALA

SEQ ID NO: 37675 - protein, 9 aa, Mycobacterium tuberculosis
AIMQTALAD

SEQ ID NO: 37676 - protein, 9 aa, Mycobacterium tuberculosis
IMQTALADD

SEQ ID NO: 37677 - protein, 9 aa, Mycobacterium tuberculosis
MQTALADDL

SEQ ID NO: 37678 - protein, 9 aa, Mycobacterium tuberculosis
QTALADDLI

SEQ ID NO: 37679 - protein, 9 aa, Mycobacterium tuberculosis
TALADDLID

SEQ ID NO: 37680 - protein, 9 aa, Mycobacterium tuberculosis
ALADDLIDS

SEQ ID NO: 37681 - protein, 9 aa, Mycobacterium tuberculosis
LADDLIDSN

SEQ ID NO: 37682 - protein, 9 aa, Mycobacterium tuberculosis
ADDLIDSNP

SEQ ID NO: 37683 - protein, 9 aa, Mycobacterium tuberculosis
DDLIDSNPC

SEQ ID NO: 37684 - protein, 9 aa, Mycobacterium tuberculosis
DLIDSNPCR

SEQ ID NO: 37685 - protein, 9 aa, Mycobacterium tuberculosis
LIDSNPCRI

SEQ ID NO: 37686 - protein, 9 aa, Mycobacterium tuberculosis
IDSNPCRIS

SEQ ID NO: 37687 - protein, 9 aa, Mycobacterium tuberculosis
DSNPCRISG

SEQ ID NO: 37688 - protein, 9 aa, Mycobacterium tuberculosis
SNPCRISGA

SEQ ID NO: 37689 - protein, 9 aa, Mycobacterium tuberculosis
NPCRISGAS

SEQ ID NO: 37690 - protein, 9 aa, Mycobacterium tuberculosis
PCRISGAST

SEQ ID NO: 37691 - protein, 9 aa, Mycobacterium tuberculosis
CRISGASTA

SEQ ID NO: 37692 - protein, 9 aa, Mycobacterium tuberculosis
RISGASTAR

SEQ ID NO: 37693 - protein, 9 aa, Mycobacterium tuberculosis
ISGASTARR

SEQ ID NO: 37694 - protein, 9 aa, Mycobacterium tuberculosis
SGASTARRV

SEQ ID NO: 37695 - protein, 9 aa, Mycobacterium tuberculosis
GASTARRVH

SEQ ID NO: 37696 - protein, 9 aa, Mycobacterium tuberculosis
ASTARRVHK

SEQ ID NO: 37697 - protein, 9 aa, Mycobacterium tuberculosis
STARRVHKI

SEQ ID NO: 37698 - protein, 9 aa, Mycobacterium tuberculosis
TARRVHKIR

SEQ ID NO: 37699 - protein, 9 aa, Mycobacterium tuberculosis
ARRVHKIRP

SEQ ID NO: 37700 - protein, 9 aa, Mycobacterium tuberculosis
RRVHKIRPA

SEQ ID NO: 37701 - protein, 9 aa, Mycobacterium tuberculosis
RVHKIRPAT

SEQ ID NO: 37702 - protein, 9 aa, Mycobacterium tuberculosis
VHKIRPATL

SEQ ID NO: 37703 - protein, 9 aa, Mycobacterium tuberculosis
HKIRPATLD

SEQ ID NO: 37704 - protein, 9 aa, Mycobacterium tuberculosis
KIRPATLDE

SEQ ID NO: 37705 - protein, 9 aa, Mycobacterium tuberculosis
IRPATLDEL

SEQ ID NO: 37706 - protein, 9 aa, Mycobacterium tuberculosis
RPATLDELE

SEQ ID NO: 37707 - protein, 9 aa, Mycobacterium tuberculosis
PATLDELET

SEQ ID NO: 37708 - protein, 9 aa, Mycobacterium tuberculosis
ATLDELETI

SEQ ID NO: 37709 - protein, 9 aa, Mycobacterium tuberculosis
TLDELETIT

SEQ ID NO: 37710 - protein, 9 aa, Mycobacterium tuberculosis
LDELETITK

SEQ ID NO: 37711 - protein, 9 aa, Mycobacterium tuberculosis
DELETITKA

SEQ ID NO: 37712 - protein, 9 aa, Mycobacterium tuberculosis
ELETITKAM

SEQ ID NO: 37713 - protein, 9 aa, Mycobacterium tuberculosis
LETITKAMP

SEQ ID NO: 37714 - protein, 9 aa, Mycobacterium tuberculosis
ETITKAMPD

SEQ ID NO: 37715 - protein, 9 aa, Mycobacterium tuberculosis
TITKAMPDP

SEQ ID NO: 37716 - protein, 9 aa, Mycobacterium tuberculosis
ITKAMPDPY

SEQ ID NO: 37717 - protein, 9 aa, Mycobacterium tuberculosis
TKAMPDPYQ

SEQ ID NO: 37718 - protein, 9 aa, Mycobacterium tuberculosis
KAMPDPYQA

SEQ ID NO: 37719 - protein, 9 aa, Mycobacterium tuberculosis
AMPDPYQAF

SEQ ID NO: 37720 - protein, 9 aa, Mycobacterium tuberculosis
MPDPYQAFV

SEQ ID NO: 37721 - protein, 9 aa, Mycobacterium tuberculosis
PDPYQAFVL

SEQ ID NO: 37722 - protein, 9 aa, Mycobacterium tuberculosis
DPYQAFVLM

SEQ ID NO: 37723 - protein, 9 aa, Mycobacterium tuberculosis
PYQAFVLMA

SEQ ID NO: 37724 - protein, 9 aa, Mycobacterium tuberculosis
YQAFVLMAA

SEQ ID NO: 37725 - protein, 9 aa, Mycobacterium tuberculosis
QAFVLMAAW

SEQ ID NO: 37726 - protein, 9 aa, Mycobacterium tuberculosis
AFVLMAAWL

SEQ ID NO: 37727 - protein, 9 aa, Mycobacterium tuberculosis
FVLMAAWLA

SEQ ID NO: 37728 - protein, 9 aa, Mycobacterium tuberculosis
VLMAAWLAM

SEQ ID NO: 37729 - protein, 9 aa, Mycobacterium tuberculosis
LMAAWLAMR

SEQ ID NO: 37730 - protein, 9 aa, Mycobacterium tuberculosis
MAAWLAMRY

SEQ ID NO: 37731 - protein, 9 aa, Mycobacterium tuberculosis
AAWLAMRYG

SEQ ID NO: 37732 - protein, 9 aa, Mycobacterium tuberculosis
AWLAMRYGE

SEQ ID NO: 37733 - protein, 9 aa, Mycobacterium tuberculosis
WLAMRYGEL

SEQ ID NO: 37734 - protein, 9 aa, Mycobacterium tuberculosis
LAMRYGELT

SEQ ID NO: 37735 - protein, 9 aa, Mycobacterium tuberculosis
AMRYGELTE

SEQ ID NO: 37736 - protein, 9 aa, Mycobacterium tuberculosis
MRYGELTEL

SEQ ID NO: 37737 - protein, 9 aa, Mycobacterium tuberculosis
RYGELTELR

SEQ ID NO: 37738 - protein, 9 aa, Mycobacterium tuberculosis
YGELTELRR

SEQ ID NO: 37739 - protein, 9 aa, Mycobacterium tuberculosis
GELTELRRK

SEQ ID NO: 37740 - protein, 9 aa, Mycobacterium tuberculosis
ELTELRRKD

SEQ ID NO: 37741 - protein, 9 aa, Mycobacterium tuberculosis
LTELRRKDI

SEQ ID NO: 37742 - protein, 9 aa, Mycobacterium tuberculosis
TELRRKDID

SEQ ID NO: 37743 - protein, 9 aa, Mycobacterium tuberculosis
ELRRKDIDL

SEQ ID NO: 37744 - protein, 9 aa, Mycobacterium tuberculosis
LRRKDIDLH

SEQ ID NO: 37745 - protein, 9 aa, Mycobacterium tuberculosis
RRKDIDLHG

SEQ ID NO: 37746 - protein, 9 aa, Mycobacterium tuberculosis
RKDIDLHGE

SEQ ID NO: 37747 - protein, 9 aa, Mycobacterium tuberculosis
KDIDLHGEV

SEQ ID NO: 37748 - protein, 9 aa, Mycobacterium tuberculosis
DIDLHGEVA

SEQ ID NO: 37749 - protein, 9 aa, Mycobacterium tuberculosis
IDLHGEVAR

SEQ ID NO: 37750 - protein, 9 aa, Mycobacterium tuberculosis
DLHGEVARV

SEQ ID NO: 37751 - protein, 9 aa, Mycobacterium tuberculosis
LHGEVARVR

SEQ ID NO: 37752 - protein, 9 aa, Mycobacterium tuberculosis
HGEVARVRR

SEQ ID NO: 37753 - protein, 9 aa, Mycobacterium tuberculosis
GEVARVRRA

SEQ ID NO: 37754 - protein, 9 aa, Mycobacterium tuberculosis
EVARVRRAV

SEQ ID NO: 37755 - protein, 9 aa, Mycobacterium tuberculosis
VARVRRAVV

SEQ ID NO: 37756 - protein, 9 aa, Mycobacterium tuberculosis
ARVRRAVVR

SEQ ID NO: 37757 - protein, 9 aa, Mycobacterium tuberculosis
RVRRAVVRV

SEQ ID NO: 37758 - protein, 9 aa, Mycobacterium tuberculosis
VRRAVVRVG

SEQ ID NO: 37759 - protein, 9 aa, Mycobacterium tuberculosis
RRAVVRVGE

SEQ ID NO: 37760 - protein, 9 aa, Mycobacterium tuberculosis
RAVVRVGEG

SEQ ID NO: 37761 - protein, 9 aa, Mycobacterium tuberculosis
AVVRVGEGF

SEQ ID NO: 37762 - protein, 9 aa, Mycobacterium tuberculosis
VVRVGEGFK

SEQ ID NO: 37763 - protein, 9 aa, Mycobacterium tuberculosis
VRVGEGFKV

SEQ ID NO: 37764 - protein, 9 aa, Mycobacterium tuberculosis
RVGEGFKVT

SEQ ID NO: 37765 - protein, 9 aa, Mycobacterium tuberculosis
VGEGFKVTT

SEQ ID NO: 37766 - protein, 9 aa, Mycobacterium tuberculosis
GEGFKVTTP

SEQ ID NO: 37767 - protein, 9 aa, Mycobacterium tuberculosis
EGFKVTTPK

SEQ ID NO: 37768 - protein, 9 aa, Mycobacterium tuberculosis
GFKVTTPKS

SEQ ID NO: 37769 - protein, 9 aa, Mycobacterium tuberculosis
FKVTTPKSD

SEQ ID NO: 37770 - protein, 9 aa, Mycobacterium tuberculosis
KVTTPKSDA

SEQ ID NO: 37771 - protein, 9 aa, Mycobacterium tuberculosis
VTTPKSDAG

SEQ ID NO: 37772 - protein, 9 aa, Mycobacterium tuberculosis
TTPKSDAGV

SEQ ID NO: 37773 - protein, 9 aa, Mycobacterium tuberculosis
TPKSDAGVR

SEQ ID NO: 37774 - protein, 9 aa, Mycobacterium tuberculosis
PKSDAGVRD

SEQ ID NO: 37775 - protein, 9 aa, Mycobacterium tuberculosis
KSDAGVRDI

SEQ ID NO: 37776 - protein, 9 aa, Mycobacterium tuberculosis
SDAGVRDIS

SEQ ID NO: 37777 - protein, 9 aa, Mycobacterium tuberculosis
DAGVRDISI

SEQ ID NO: 37778 - protein, 9 aa, Mycobacterium tuberculosis
AGVRDISIP

SEQ ID NO: 37779 - protein, 9 aa, Mycobacterium tuberculosis
GVRDISIPP

SEQ ID NO: 37780 - protein, 9 aa, Mycobacterium tuberculosis
VRDISIPPH

SEQ ID NO: 37781 - protein, 9 aa, Mycobacterium tuberculosis
RDISIPPHL

SEQ ID NO: 37782 - protein, 9 aa, Mycobacterium tuberculosis
DISIPPHLI

SEQ ID NO: 37783 - protein, 9 aa, Mycobacterium tuberculosis
ISIPPHLIP

SEQ ID NO: 37784 - protein, 9 aa, Mycobacterium tuberculosis
SIPPHLIPA

SEQ ID NO: 37785 - protein, 9 aa, Mycobacterium tuberculosis
IPPHLIPAI

SEQ ID NO: 37786 - protein, 9 aa, Mycobacterium tuberculosis
PPHLIPAIE

SEQ ID NO: 37787 - protein, 9 aa, Mycobacterium tuberculosis
PHLIPAIED

SEQ ID NO: 37788 - protein, 9 aa, Mycobacterium tuberculosis
HLIPAIEDH

SEQ ID NO: 37789 - protein, 9 aa, Mycobacterium tuberculosis
LIPAIEDHL

SEQ ID NO: 37790 - protein, 9 aa, Mycobacterium tuberculosis
IPAIEDHLH

SEQ ID NO: 37791 - protein, 9 aa, Mycobacterium tuberculosis
PAIEDHLHK

SEQ ID NO: 37792 - protein, 9 aa, Mycobacterium tuberculosis
AIEDHLHKH

SEQ ID NO: 37793 - protein, 9 aa, Mycobacterium tuberculosis
IEDHLHKHV

SEQ ID NO: 37794 - protein, 9 aa, Mycobacterium tuberculosis
EDHLHKHVN

SEQ ID NO: 37795 - protein, 9 aa, Mycobacterium tuberculosis
DHLHKHVNP

SEQ ID NO: 37796 - protein, 9 aa, Mycobacterium tuberculosis
HLHKHVNPG

SEQ ID NO: 37797 - protein, 9 aa, Mycobacterium tuberculosis
LHKHVNPGR

SEQ ID NO: 37798 - protein, 9 aa, Mycobacterium tuberculosis
HKHVNPGRE

SEQ ID NO: 37799 - protein, 9 aa, Mycobacterium tuberculosis
KHVNPGRES

SEQ ID NO: 37800 - protein, 9 aa, Mycobacterium tuberculosis
HVNPGRESL

SEQ ID NO: 37801 - protein, 9 aa, Mycobacterium tuberculosis
VNPGRESLL

SEQ ID NO: 37802 - protein, 9 aa, Mycobacterium tuberculosis
NPGRESLLF

SEQ ID NO: 37803 - protein, 9 aa, Mycobacterium tuberculosis
PGRESLLFP

SEQ ID NO: 37804 - protein, 9 aa, Mycobacterium tuberculosis
GRESLLFPS

SEQ ID NO: 37805 - protein, 9 aa, Mycobacterium tuberculosis
RESLLFPSV

SEQ ID NO: 37806 - protein, 9 aa, Mycobacterium tuberculosis
ESLLFPSVN

SEQ ID NO: 37807 - protein, 9 aa, Mycobacterium tuberculosis
SLLFPSVND

SEQ ID NO: 37808 - protein, 9 aa, Mycobacterium tuberculosis
LLFPSVNDP

SEQ ID NO: 37809 - protein, 9 aa, Mycobacterium tuberculosis
LFPSVNDPN

SEQ ID NO: 37810 - protein, 9 aa, Mycobacterium tuberculosis
FPSVNDPNR

SEQ ID NO: 37811 - protein, 9 aa, Mycobacterium tuberculosis
PSVNDPNRH

SEQ ID NO: 37812 - protein, 9 aa, Mycobacterium tuberculosis
SVNDPNRHL

SEQ ID NO: 37813 - protein, 9 aa, Mycobacterium tuberculosis
VNDPNRHLA

SEQ ID NO: 37814 - protein, 9 aa, Mycobacterium tuberculosis
NDPNRHLAP

SEQ ID NO: 37815 - protein, 9 aa, Mycobacterium tuberculosis
DPNRHLAPS

SEQ ID NO: 37816 - protein, 9 aa, Mycobacterium tuberculosis
PNRHLAPSA

SEQ ID NO: 37817 - protein, 9 aa, Mycobacterium tuberculosis
NRHLAPSAL

SEQ ID NO: 37818 - protein, 9 aa, Mycobacterium tuberculosis
RHLAPSALY

SEQ ID NO: 37819 - protein, 9 aa, Mycobacterium tuberculosis
HLAPSALYR

SEQ ID NO: 37820 - protein, 9 aa, Mycobacterium tuberculosis
LAPSALYRM

SEQ ID NO: 37821 - protein, 9 aa, Mycobacterium tuberculosis
APSALYRMF

SEQ ID NO: 37822 - protein, 9 aa, Mycobacterium tuberculosis
PSALYRMFY

SEQ ID NO: 37823 - protein, 9 aa, Mycobacterium tuberculosis
SALYRMFYK

SEQ ID NO: 37824 - protein, 9 aa, Mycobacterium tuberculosis
ALYRMFYKA

SEQ ID NO: 37825 - protein, 9 aa, Mycobacterium tuberculosis
LYRMFYKAR

SEQ ID NO: 37826 - protein, 9 aa, Mycobacterium tuberculosis
YRMFYKARK

SEQ ID NO: 37827 - protein, 9 aa, Mycobacterium tuberculosis
RMFYKARKA

SEQ ID NO: 37828 - protein, 9 aa, Mycobacterium tuberculosis
MFYKARKAA

SEQ ID NO: 37829 - protein, 9 aa, Mycobacterium tuberculosis
FYKARKAAG

SEQ ID NO: 37830 - protein, 9 aa, Mycobacterium tuberculosis
YKARKAAGR

SEQ ID NO: 37831 - protein, 9 aa, Mycobacterium tuberculosis
KARKAAGRP

SEQ ID NO: 37832 - protein, 9 aa, Mycobacterium tuberculosis
ARKAAGRPD

SEQ ID NO: 37833 - protein, 9 aa, Mycobacterium tuberculosis
RKAAGRPDL

SEQ ID NO: 37834 - protein, 9 aa, Mycobacterium tuberculosis
KAAGRPDLR

SEQ ID NO: 37835 - protein, 9 aa, Mycobacterium tuberculosis
AAGRPDLRV

SEQ ID NO: 37836 - protein, 9 aa, Mycobacterium tuberculosis
AGRPDLRVH

SEQ ID NO: 37837 - protein, 9 aa, Mycobacterium tuberculosis
GRPDLRVHD

SEQ ID NO: 37838 - protein, 9 aa, Mycobacterium tuberculosis
RPDLRVHDL

SEQ ID NO: 37839 - protein, 9 aa, Mycobacterium tuberculosis
PDLRVHDLR

SEQ ID NO: 37840 - protein, 9 aa, Mycobacterium tuberculosis
DLRVHDLRH

SEQ ID NO: 37841 - protein, 9 aa, Mycobacterium tuberculosis
LRVHDLRHS

SEQ ID NO: 37842 - protein, 9 aa, Mycobacterium tuberculosis
RVHDLRHSG

SEQ ID NO: 37843 - protein, 9 aa, Mycobacterium tuberculosis
VHDLRHSGA

SEQ ID NO: 37844 - protein, 9 aa, Mycobacterium tuberculosis
HDLRHSGAV

SEQ ID NO: 37845 - protein, 9 aa, Mycobacterium tuberculosis
DLRHSGAVL

SEQ ID NO: 37846 - protein, 9 aa, Mycobacterium tuberculosis
LRHSGAVLA

SEQ ID NO: 37847 - protein, 9 aa, Mycobacterium tuberculosis
RHSGAVLAA

SEQ ID NO: 37848 - protein, 9 aa, Mycobacterium tuberculosis
HSGAVLAAS

SEQ ID NO: 37849 - protein, 9 aa, Mycobacterium tuberculosis
SGAVLAAST

SEQ ID NO: 37850 - protein, 9 aa, Mycobacterium tuberculosis
GAVLAASTG

SEQ ID NO: 37851 - protein, 9 aa, Mycobacterium tuberculosis
AVLAASTGA

SEQ ID NO: 37852 - protein, 9 aa, Mycobacterium tuberculosis
VLAASTGAT

SEQ ID NO: 37853 - protein, 9 aa, Mycobacterium tuberculosis
LAASTGATL

SEQ ID NO: 37854 - protein, 9 aa, Mycobacterium tuberculosis
AASTGATLA

SEQ ID NO: 37855 - protein, 9 aa, Mycobacterium tuberculosis
ASTGATLAE

SEQ ID NO: 37856 - protein, 9 aa, Mycobacterium tuberculosis
STGATLAEL

SEQ ID NO: 37857 - protein, 9 aa, Mycobacterium tuberculosis
TGATLAELM

SEQ ID NO: 37858 - protein, 9 aa, Mycobacterium tuberculosis
GATLAELMQ

SEQ ID NO: 37859 - protein, 9 aa, Mycobacterium tuberculosis
ATLAELMQR

SEQ ID NO: 37860 - protein, 9 aa, Mycobacterium tuberculosis
TLAELMQRL

SEQ ID NO: 37861 - protein, 9 aa, Mycobacterium tuberculosis
LAELMQRLG

SEQ ID NO: 37862 - protein, 9 aa, Mycobacterium tuberculosis
AELMQRLGH

SEQ ID NO: 37863 - protein, 9 aa, Mycobacterium tuberculosis
ELMQRLGHS

SEQ ID NO: 37864 - protein, 9 aa, Mycobacterium tuberculosis
LMQRLGHST

SEQ ID NO: 37865 - protein, 9 aa, Mycobacterium tuberculosis
MQRLGHSTA

SEQ ID NO: 37866 - protein, 9 aa, Mycobacterium tuberculosis
QRLGHSTAG

SEQ ID NO: 37867 - protein, 9 aa, Mycobacterium tuberculosis
RLGHSTAGA

SEQ ID NO: 37868 - protein, 9 aa, Mycobacterium tuberculosis
LGHSTAGAA

SEQ ID NO: 37869 - protein, 9 aa, Mycobacterium tuberculosis
GHSTAGAAL

SEQ ID NO: 37870 - protein, 9 aa, Mycobacterium tuberculosis
HSTAGAALR

SEQ ID NO: 37871 - protein, 9 aa, Mycobacterium tuberculosis
STAGAALRY

SEQ ID NO: 37872 - protein, 9 aa, Mycobacterium tuberculosis
TAGAALRYQ

SEQ ID NO: 37873 - protein, 9 aa, Mycobacterium tuberculosis
AGAALRYQH

SEQ ID NO: 37874 - protein, 9 aa, Mycobacterium tuberculosis
GAALRYQHA

SEQ ID NO: 37875 - protein, 9 aa, Mycobacterium tuberculosis
AALRYQHAA

SEQ ID NO: 37876 - protein, 9 aa, Mycobacterium tuberculosis
ALRYQHAAK

SEQ ID NO: 37877 - protein, 9 aa, Mycobacterium tuberculosis
LRYQHAAKG

SEQ ID NO: 37878 - protein, 9 aa, Mycobacterium tuberculosis
RYQHAAKGR

SEQ ID NO: 37879 - protein, 9 aa, Mycobacterium tuberculosis
YQHAAKGRD

SEQ ID NO: 37880 - protein, 9 aa, Mycobacterium tuberculosis
QHAAKGRDR

SEQ ID NO: 37881 - protein, 9 aa, Mycobacterium tuberculosis
HAAKGRDRE

SEQ ID NO: 37882 - protein, 9 aa, Mycobacterium tuberculosis
AAKGRDREI

SEQ ID NO: 37883 - protein, 9 aa, Mycobacterium tuberculosis
AKGRDREIA

SEQ ID NO: 37884 - protein, 9 aa, Mycobacterium tuberculosis
KGRDREIAA

SEQ ID NO: 37885 - protein, 9 aa, Mycobacterium tuberculosis
GRDREIAAL

SEQ ID NO: 37886 - protein, 9 aa, Mycobacterium tuberculosis
RDREIAALL

SEQ ID NO: 37887 - protein, 9 aa, Mycobacterium tuberculosis
DREIAALLS

SEQ ID NO: 37888 - protein, 9 aa, Mycobacterium tuberculosis
REIAALLSK

SEQ ID NO: 37889 - protein, 9 aa, Mycobacterium tuberculosis
EIAALLSKL

SEQ ID NO: 37890 - protein, 9 aa, Mycobacterium tuberculosis
IAALLSKLA

SEQ ID NO: 37891 - protein, 9 aa, Mycobacterium tuberculosis
AALLSKLAE

SEQ ID NO: 37892 - protein, 9 aa, Mycobacterium tuberculosis
ALLSKLAEN

SEQ ID NO: 37893 - protein, 9 aa, Mycobacterium tuberculosis
LLSKLAENQ

SEQ ID NO: 37894 - protein, 9 aa, Mycobacterium tuberculosis
LSKLAENQE

SEQ ID NO: 37895 - protein, 9 aa, Mycobacterium tuberculosis
SKLAENQEM

SEQ ID NO: 37896 - protein, 10 aa, Mycobacterium tuberculosis
MTQTGKRQRR

SEQ ID NO: 37897 - protein, 10 aa, Mycobacterium tuberculosis
TQTGKRQRRK

SEQ ID NO: 37898 - protein, 10 aa, Mycobacterium tuberculosis
QTGKRQRRKF

SEQ ID NO: 37899 - protein, 10 aa, Mycobacterium tuberculosis
TGKRQRRKFG

SEQ ID NO: 37900 - protein, 10 aa, Mycobacterium tuberculosis
GKRQRRKFGR

SEQ ID NO: 37901 - protein, 10 aa, Mycobacterium tuberculosis
KRQRRKFGRI

SEQ ID NO: 37902 - protein, 10 aa, Mycobacterium tuberculosis
RQRRKFGRIR

SEQ ID NO: 37903 - protein, 10 aa, Mycobacterium tuberculosis
QRRKFGRIRQ

SEQ ID NO: 37904 - protein, 10 aa, Mycobacterium tuberculosis
RRKFGRIRQF

SEQ ID NO: 37905 - protein, 10 aa, Mycobacterium tuberculosis
RKFGRIRQFN

SEQ ID NO: 37906 - protein, 10 aa, Mycobacterium tuberculosis
KFGRIRQFNS

SEQ ID NO: 37907 - protein, 10 aa, Mycobacterium tuberculosis
FGRIRQFNSG

SEQ ID NO: 37908 - protein, 10 aa, Mycobacterium tuberculosis
GRIRQFNSGR

SEQ ID NO: 37909 - protein, 10 aa, Mycobacterium tuberculosis
RIRQFNSGRW

SEQ ID NO: 37910 - protein, 10 aa, Mycobacterium tuberculosis
IRQFNSGRWQ

SEQ ID NO: 37911 - protein, 10 aa, Mycobacterium tuberculosis
RQFNSGRWQA

SEQ ID NO: 37912 - protein, 10 aa, Mycobacterium tuberculosis
QFNSGRWQAS

SEQ ID NO: 37913 - protein, 10 aa, Mycobacterium tuberculosis
FNSGRWQASY

SEQ ID NO: 37914 - protein, 10 aa, Mycobacterium tuberculosis
NSGRWQASYT

SEQ ID NO: 37915 - protein, 10 aa, Mycobacterium tuberculosis
SGRWQASYTG

SEQ ID NO: 37916 - protein, 10 aa, Mycobacterium tuberculosis
GRWQASYTGP

SEQ ID NO: 37917 - protein, 10 aa, Mycobacterium tuberculosis
RWQASYTGPD

SEQ ID NO: 37918 - protein, 10 aa, Mycobacterium tuberculosis
WQASYTGPDG

SEQ ID NO: 37919 - protein, 10 aa, Mycobacterium tuberculosis
QASYTGPDGR

SEQ ID NO: 37920 - protein, 10 aa, Mycobacterium tuberculosis
ASYTGPDGRV

SEQ ID NO: 37921 - protein, 10 aa, Mycobacterium tuberculosis
SYTGPDGRVY

SEQ ID NO: 37922 - protein, 10 aa, Mycobacterium tuberculosis
YTGPDGRVYI

SEQ ID NO: 37923 - protein, 10 aa, Mycobacterium tuberculosis
TGPDGRVYIA

SEQ ID NO: 37924 - protein, 10 aa, Mycobacterium tuberculosis
GPDGRVYIAP

SEQ ID NO: 37925 - protein, 10 aa, Mycobacterium tuberculosis
PDGRVYIAPK

SEQ ID NO: 37926 - protein, 10 aa, Mycobacterium tuberculosis
DGRVYIAPKT

SEQ ID NO: 37927 - protein, 10 aa, Mycobacterium tuberculosis
GRVYIAPKTF

SEQ ID NO: 37928 - protein, 10 aa, Mycobacterium tuberculosis
RVYIAPKTFN

SEQ ID NO: 37929 - protein, 10 aa, Mycobacterium tuberculosis
VYIAPKTFNA

SEQ ID NO: 37930 - protein, 10 aa, Mycobacterium tuberculosis
YIAPKTFNAK

SEQ ID NO: 37931 - protein, 10 aa, Mycobacterium tuberculosis
IAPKTFNAKI

SEQ ID NO: 37932 - protein, 10 aa, Mycobacterium tuberculosis
APKTFNAKID

SEQ ID NO: 37933 - protein, 10 aa, Mycobacterium tuberculosis
PKTFNAKIDA

SEQ ID NO: 37934 - protein, 10 aa, Mycobacterium tuberculosis
KTFNAKIDAE

SEQ ID NO: 37935 - protein, 10 aa, Mycobacterium tuberculosis
TFNAKIDAEA

SEQ ID NO: 37936 - protein, 10 aa, Mycobacterium tuberculosis
FNAKIDAEAW

SEQ ID NO: 37937 - protein, 10 aa, Mycobacterium tuberculosis
NAKIDAEAWL

SEQ ID NO: 37938 - protein, 10 aa, Mycobacterium tuberculosis
AKIDAEAWLT

SEQ ID NO: 37939 - protein, 10 aa, Mycobacterium tuberculosis
KIDAEAWLTD

SEQ ID NO: 37940 - protein, 10 aa, Mycobacterium tuberculosis
IDAEAWLTDR

SEQ ID NO: 37941 - protein, 10 aa, Mycobacterium tuberculosis
DAEAWLTDRR

SEQ ID NO: 37942 - protein, 10 aa, Mycobacterium tuberculosis
AEAWLTDRRR

SEQ ID NO: 37943 - protein, 10 aa, Mycobacterium tuberculosis
EAWLTDRRRE

SEQ ID NO: 37944 - protein, 10 aa, Mycobacterium tuberculosis
AWLTDRRREI

SEQ ID NO: 37945 - protein, 10 aa, Mycobacterium tuberculosis
WLTDRRREID

SEQ ID NO: 37946 - protein, 10 aa, Mycobacterium tuberculosis
LTDRRREIDR

SEQ ID NO: 37947 - protein, 10 aa, Mycobacterium tuberculosis
TDRRREIDRQ

SEQ ID NO: 37948 - protein, 10 aa, Mycobacterium tuberculosis
DRRREIDRQL

SEQ ID NO: 37949 - protein, 10 aa, Mycobacterium tuberculosis
RRREIDRQLW

SEQ ID NO: 37950 - protein, 10 aa, Mycobacterium tuberculosis
RREIDRQLWS

SEQ ID NO: 37951 - protein, 10 aa, Mycobacterium tuberculosis
REIDRQLWSP

SEQ ID NO: 37952 - protein, 10 aa, Mycobacterium tuberculosis
EIDRQLWSPA

SEQ ID NO: 37953 - protein, 10 aa, Mycobacterium tuberculosis
IDRQLWSPAS

SEQ ID NO: 37954 - protein, 10 aa, Mycobacterium tuberculosis
DRQLWSPASG

SEQ ID NO: 37955 - protein, 10 aa, Mycobacterium tuberculosis
RQLWSPASGQ

SEQ ID NO: 37956 - protein, 10 aa, Mycobacterium tuberculosis
QLWSPASGQE

SEQ ID NO: 37957 - protein, 10 aa, Mycobacterium tuberculosis
LWSPASGQED

SEQ ID NO: 37958 - protein, 10 aa, Mycobacterium tuberculosis
WSPASGQEDR

SEQ ID NO: 37959 - protein, 10 aa, Mycobacterium tuberculosis
SPASGQEDRP

SEQ ID NO: 37960 - protein, 10 aa, Mycobacterium tuberculosis
PASGQEDRPG

SEQ ID NO: 37961 - protein, 10 aa, Mycobacterium tuberculosis
ASGQEDRPGA

SEQ ID NO: 37962 - protein, 10 aa, Mycobacterium tuberculosis
SGQEDRPGAP

SEQ ID NO: 37963 - protein, 10 aa, Mycobacterium tuberculosis
GQEDRPGAPF

SEQ ID NO: 37964 - protein, 10 aa, Mycobacterium tuberculosis
QEDRPGAPFG

SEQ ID NO: 37965 - protein, 10 aa, Mycobacterium tuberculosis
EDRPGAPFGE

SEQ ID NO: 37966 - protein, 10 aa, Mycobacterium tuberculosis
DRPGAPFGEY

SEQ ID NO: 37967 - protein, 10 aa, Mycobacterium tuberculosis
RPGAPFGEYA

SEQ ID NO: 37968 - protein, 10 aa, Mycobacterium tuberculosis
PGAPFGEYAE

SEQ ID NO: 37969 - protein, 10 aa, Mycobacterium tuberculosis
GAPFGEYAEG

SEQ ID NO: 37970 - protein, 10 aa, Mycobacterium tuberculosis
APFGEYAEGW

SEQ ID NO: 37971 - protein, 10 aa, Mycobacterium tuberculosis
PFGEYAEGWL

SEQ ID NO: 37972 - protein, 10 aa, Mycobacterium tuberculosis
FGEYAEGWLK

SEQ ID NO: 37973 - protein, 10 aa, Mycobacterium tuberculosis
GEYAEGWLKQ

SEQ ID NO: 37974 - protein, 10 aa, Mycobacterium tuberculosis
EYAEGWLKQR

SEQ ID NO: 37975 - protein, 10 aa, Mycobacterium tuberculosis
YAEGWLKQRG

SEQ ID NO: 37976 - protein, 10 aa, Mycobacterium tuberculosis
AEGWLKQRGI

SEQ ID NO: 37977 - protein, 10 aa, Mycobacterium tuberculosis
EGWLKQRGIK

SEQ ID NO: 37978 - protein, 10 aa, Mycobacterium tuberculosis
GWLKQRGIKD

SEQ ID NO: 37979 - protein, 10 aa, Mycobacterium tuberculosis
WLKQRGIKDR

SEQ ID NO: 37980 - protein, 10 aa, Mycobacterium tuberculosis
LKQRGIKDRT

SEQ ID NO: 37981 - protein, 10 aa, Mycobacterium tuberculosis
KQRGIKDRTR

SEQ ID NO: 37982 - protein, 10 aa, Mycobacterium tuberculosis
QRGIKDRTRA

SEQ ID NO: 37983 - protein, 10 aa, Mycobacterium tuberculosis
RGIKDRTRAH

SEQ ID NO: 37984 - protein, 10 aa, Mycobacterium tuberculosis
GIKDRTRAHY

SEQ ID NO: 37985 - protein, 10 aa, Mycobacterium tuberculosis
IKDRTRAHYR

SEQ ID NO: 37986 - protein, 10 aa, Mycobacterium tuberculosis
KDRTRAHYRK

SEQ ID NO: 37987 - protein, 10 aa, Mycobacterium tuberculosis
DRTRAHYRKL

SEQ ID NO: 37988 - protein, 10 aa, Mycobacterium tuberculosis
RTRAHYRKLL

SEQ ID NO: 37989 - protein, 10 aa, Mycobacterium tuberculosis
TRAHYRKLLD

SEQ ID NO: 37990 - protein, 10 aa, Mycobacterium tuberculosis
RAHYRKLLDN

SEQ ID NO: 37991 - protein, 10 aa, Mycobacterium tuberculosis
AHYRKLLDNH

SEQ ID NO: 37992 - protein, 10 aa, Mycobacterium tuberculosis
HYRKLLDNHI

SEQ ID NO: 37993 - protein, 10 aa, Mycobacterium tuberculosis
YRKLLDNHIL

SEQ ID NO: 37994 - protein, 10 aa, Mycobacterium tuberculosis
RKLLDNHILA

SEQ ID NO: 37995 - protein, 10 aa, Mycobacterium tuberculosis
KLLDNHILAT

SEQ ID NO: 37996 - protein, 10 aa, Mycobacterium tuberculosis
LLDNHILATF

SEQ ID NO: 37997 - protein, 10 aa, Mycobacterium tuberculosis
LDNHILATFA

SEQ ID NO: 37998 - protein, 10 aa, Mycobacterium tuberculosis
DNHILATFAD

SEQ ID NO: 37999 - protein, 10 aa, Mycobacterium tuberculosis
NHILATFADT

SEQ ID NO: 38000 - protein, 10 aa, Mycobacterium tuberculosis
HILATFADTD

SEQ ID NO: 38001 - protein, 10 aa, Mycobacterium tuberculosis
ILATFADTDL

SEQ ID NO: 38002 - protein, 10 aa, Mycobacterium tuberculosis
LATFADTDLR

SEQ ID NO: 38003 - protein, 10 aa, Mycobacterium tuberculosis
ATFADTDLRD

SEQ ID NO: 38004 - protein, 10 aa, Mycobacterium tuberculosis
TFADTDLRDI

SEQ ID NO: 38005 - protein, 10 aa, Mycobacterium tuberculosis
FADTDLRDIT

SEQ ID NO: 38006 - protein, 10 aa, Mycobacterium tuberculosis
ADTDLRDITP

SEQ ID NO: 38007 - protein, 10 aa, Mycobacterium tuberculosis
DTDLRDITPA

SEQ ID NO: 38008 - protein, 10 aa, Mycobacterium tuberculosis
TDLRDITPAA

SEQ ID NO: 38009 - protein, 10 aa, Mycobacterium tuberculosis
DLRDITPAAV

SEQ ID NO: 38010 - protein, 10 aa, Mycobacterium tuberculosis
LRDITPAAVR

SEQ ID NO: 38011 - protein, 10 aa, Mycobacterium tuberculosis
RDITPAAVRR

SEQ ID NO: 38012 - protein, 10 aa, Mycobacterium tuberculosis
DITPAAVRRW

SEQ ID NO: 38013 - protein, 10 aa, Mycobacterium tuberculosis
ITPAAVRRWY

SEQ ID NO: 38014 - protein, 10 aa, Mycobacterium tuberculosis
TPAAVRRWYA

SEQ ID NO: 38015 - protein, 10 aa, Mycobacterium tuberculosis
PAAVRRWYAT

SEQ ID NO: 38016 - protein, 10 aa, Mycobacterium tuberculosis
AAVRRWYATT

SEQ ID NO: 38017 - protein, 10 aa, Mycobacterium tuberculosis
AVRRWYATTA

SEQ ID NO: 38018 - protein, 10 aa, Mycobacterium tuberculosis
VRRWYATTAV

SEQ ID NO: 38019 - protein, 10 aa, Mycobacterium tuberculosis
RRWYATTAVG

SEQ ID NO: 38020 - protein, 10 aa, Mycobacterium tuberculosis
RWYATTAVGT

SEQ ID NO: 38021 - protein, 10 aa, Mycobacterium tuberculosis
WYATTAVGTP

SEQ ID NO: 38022 - protein, 10 aa, Mycobacterium tuberculosis
YATTAVGTPT

SEQ ID NO: 38023 - protein, 10 aa, Mycobacterium tuberculosis
ATTAVGTPTM

SEQ ID NO: 38024 - protein, 10 aa, Mycobacterium tuberculosis
TTAVGTPTMR

SEQ ID NO: 38025 - protein, 10 aa, Mycobacterium tuberculosis
TAVGTPTMRA

SEQ ID NO: 38026 - protein, 10 aa, Mycobacterium tuberculosis
AVGTPTMRAH

SEQ ID NO: 38027 - protein, 10 aa, Mycobacterium tuberculosis
VGTPTMRAHS

SEQ ID NO: 38028 - protein, 10 aa, Mycobacterium tuberculosis
GTPTMRAHSY

SEQ ID NO: 38029 - protein, 10 aa, Mycobacterium tuberculosis
TPTMRAHSYS

SEQ ID NO: 38030 - protein, 10 aa, Mycobacterium tuberculosis
PTMRAHSYSL

SEQ ID NO: 38031 - protein, 10 aa, Mycobacterium tuberculosis
TMRAHSYSLL

SEQ ID NO: 38032 - protein, 10 aa, Mycobacterium tuberculosis
MRAHSYSLLR

SEQ ID NO: 38033 - protein, 10 aa, Mycobacterium tuberculosis
RAHSYSLLRA

SEQ ID NO: 38034 - protein, 10 aa, Mycobacterium tuberculosis
AHSYSLLRAI

SEQ ID NO: 38035 - protein, 10 aa, Mycobacterium tuberculosis
HSYSLLRAIM

SEQ ID NO: 38036 - protein, 10 aa, Mycobacterium tuberculosis
SYSLLRAIMQ

SEQ ID NO: 38037 - protein, 10 aa, Mycobacterium tuberculosis
YSLLRAIMQT

SEQ ID NO: 38038 - protein, 10 aa, Mycobacterium tuberculosis
SLLRAIMQTA

SEQ ID NO: 38039 - protein, 10 aa, Mycobacterium tuberculosis
LLRAIMQTAL

SEQ ID NO: 38040 - protein, 10 aa, Mycobacterium tuberculosis
LRAIMQTALA

SEQ ID NO: 38041 - protein, 10 aa, Mycobacterium tuberculosis
RAIMQTALAD

SEQ ID NO: 38042 - protein, 10 aa, Mycobacterium tuberculosis
AIMQTALADD

SEQ ID NO: 38043 - protein, 10 aa, Mycobacterium tuberculosis
IMQTALADDL

SEQ ID NO: 38044 - protein, 10 aa, Mycobacterium tuberculosis
MQTALADDLI

SEQ ID NO: 38045 - protein, 10 aa, Mycobacterium tuberculosis
QTALADDLID

SEQ ID NO: 38046 - protein, 10 aa, Mycobacterium tuberculosis
TALADDLIDS

SEQ ID NO: 38047 - protein, 10 aa, Mycobacterium tuberculosis
ALADDLIDSN

SEQ ID NO: 38048 - protein, 10 aa, Mycobacterium tuberculosis
LADDLIDSNP

SEQ ID NO: 38049 - protein, 10 aa, Mycobacterium tuberculosis
ADDLIDSNPC

SEQ ID NO: 38050 - protein, 10 aa, Mycobacterium tuberculosis
DDLIDSNPCR

SEQ ID NO: 38051 - protein, 10 aa, Mycobacterium tuberculosis
DLIDSNPCRI

SEQ ID NO: 38052 - protein, 10 aa, Mycobacterium tuberculosis
LIDSNPCRIS

SEQ ID NO: 38053 - protein, 10 aa, Mycobacterium tuberculosis
IDSNPCRISG

SEQ ID NO: 38054 - protein, 10 aa, Mycobacterium tuberculosis
DSNPCRISGA

SEQ ID NO: 38055 - protein, 10 aa, Mycobacterium tuberculosis
SNPCRISGAS

SEQ ID NO: 38056 - protein, 10 aa, Mycobacterium tuberculosis
NPCRISGAST

SEQ ID NO: 38057 - protein, 10 aa, Mycobacterium tuberculosis
PCRISGASTA

SEQ ID NO: 38058 - protein, 10 aa, Mycobacterium tuberculosis
CRISGASTAR

SEQ ID NO: 38059 - protein, 10 aa, Mycobacterium tuberculosis
RISGASTARR

SEQ ID NO: 38060 - protein, 10 aa, Mycobacterium tuberculosis
ISGASTARRV

SEQ ID NO: 38061 - protein, 10 aa, Mycobacterium tuberculosis
SGASTARRVH

SEQ ID NO: 38062 - protein, 10 aa, Mycobacterium tuberculosis
GASTARRVHK

SEQ ID NO: 38063 - protein, 10 aa, Mycobacterium tuberculosis
ASTARRVHKI

SEQ ID NO: 38064 - protein, 10 aa, Mycobacterium tuberculosis
STARRVHKIR

SEQ ID NO: 38065 - protein, 10 aa, Mycobacterium tuberculosis
TARRVHKIRP

SEQ ID NO: 38066 - protein, 10 aa, Mycobacterium tuberculosis
ARRVHKIRPA

SEQ ID NO: 38067 - protein, 10 aa, Mycobacterium tuberculosis
RRVHKIRPAT

SEQ ID NO: 38068 - protein, 10 aa, Mycobacterium tuberculosis
RVHKIRPATL

SEQ ID NO: 38069 - protein, 10 aa, Mycobacterium tuberculosis
VHKIRPATLD

SEQ ID NO: 38070 - protein, 10 aa, Mycobacterium tuberculosis
HKIRPATLDE

SEQ ID NO: 38071 - protein, 10 aa, Mycobacterium tuberculosis
KIRPATLDEL

SEQ ID NO: 38072 - protein, 10 aa, Mycobacterium tuberculosis
IRPATLDELE

SEQ ID NO: 38073 - protein, 10 aa, Mycobacterium tuberculosis
RPATLDELET

SEQ ID NO: 38074 - protein, 10 aa, Mycobacterium tuberculosis
PATLDELETI

SEQ ID NO: 38075 - protein, 10 aa, Mycobacterium tuberculosis
ATLDELETIT

SEQ ID NO: 38076 - protein, 10 aa, Mycobacterium tuberculosis
TLDELETITK

SEQ ID NO: 38077 - protein, 10 aa, Mycobacterium tuberculosis
LDELETITKA

SEQ ID NO: 38078 - protein, 10 aa, Mycobacterium tuberculosis
DELETITKAM

SEQ ID NO: 38079 - protein, 10 aa, Mycobacterium tuberculosis
ELETITKAMP

SEQ ID NO: 38080 - protein, 10 aa, Mycobacterium tuberculosis
LETITKAMPD

SEQ ID NO: 38081 - protein, 10 aa, Mycobacterium tuberculosis
ETITKAMPDP

SEQ ID NO: 38082 - protein, 10 aa, Mycobacterium tuberculosis
TITKAMPDPY

SEQ ID NO: 38083 - protein, 10 aa, Mycobacterium tuberculosis
ITKAMPDPYQ

SEQ ID NO: 38084 - protein, 10 aa, Mycobacterium tuberculosis
TKAMPDPYQA

SEQ ID NO: 38085 - protein, 10 aa, Mycobacterium tuberculosis
KAMPDPYQAF

SEQ ID NO: 38086 - protein, 10 aa, Mycobacterium tuberculosis
AMPDPYQAFV

SEQ ID NO: 38087 - protein, 10 aa, Mycobacterium tuberculosis
MPDPYQAFVL

SEQ ID NO: 38088 - protein, 10 aa, Mycobacterium tuberculosis
PDPYQAFVLM

SEQ ID NO: 38089 - protein, 10 aa, Mycobacterium tuberculosis
DPYQAFVLMA

SEQ ID NO: 38090 - protein, 10 aa, Mycobacterium tuberculosis
PYQAFVLMAA

SEQ ID NO: 38091 - protein, 10 aa, Mycobacterium tuberculosis
YQAFVLMAAW

SEQ ID NO: 38092 - protein, 10 aa, Mycobacterium tuberculosis
QAFVLMAAWL

SEQ ID NO: 38093 - protein, 10 aa, Mycobacterium tuberculosis
AFVLMAAWLA

SEQ ID NO: 38094 - protein, 10 aa, Mycobacterium tuberculosis
FVLMAAWLAM

SEQ ID NO: 38095 - protein, 10 aa, Mycobacterium tuberculosis
VLMAAWLAMR

SEQ ID NO: 38096 - protein, 10 aa, Mycobacterium tuberculosis
LMAAWLAMRY

SEQ ID NO: 38097 - protein, 10 aa, Mycobacterium tuberculosis
MAAWLAMRYG

SEQ ID NO: 38098 - protein, 10 aa, Mycobacterium tuberculosis
AAWLAMRYGE

SEQ ID NO: 38099 - protein, 10 aa, Mycobacterium tuberculosis
AWLAMRYGEL

SEQ ID NO: 38100 - protein, 10 aa, Mycobacterium tuberculosis
WLAMRYGELT

SEQ ID NO: 38101 - protein, 10 aa, Mycobacterium tuberculosis
LAMRYGELTE

SEQ ID NO: 38102 - protein, 10 aa, Mycobacterium tuberculosis
AMRYGELTEL

SEQ ID NO: 38103 - protein, 10 aa, Mycobacterium tuberculosis
MRYGELTELR

SEQ ID NO: 38104 - protein, 10 aa, Mycobacterium tuberculosis
RYGELTELRR

SEQ ID NO: 38105 - protein, 10 aa, Mycobacterium tuberculosis
YGELTELRRK

SEQ ID NO: 38106 - protein, 10 aa, Mycobacterium tuberculosis
GELTELRRKD

SEQ ID NO: 38107 - protein, 10 aa, Mycobacterium tuberculosis
ELTELRRKDI

SEQ ID NO: 38108 - protein, 10 aa, Mycobacterium tuberculosis
LTELRRKDID

SEQ ID NO: 38109 - protein, 10 aa, Mycobacterium tuberculosis
TELRRKDIDL

SEQ ID NO: 38110 - protein, 10 aa, Mycobacterium tuberculosis
ELRRKDIDLH

SEQ ID NO: 38111 - protein, 10 aa, Mycobacterium tuberculosis
LRRKDIDLHG

SEQ ID NO: 38112 - protein, 10 aa, Mycobacterium tuberculosis
RRKDIDLHGE

SEQ ID NO: 38113 - protein, 10 aa, Mycobacterium tuberculosis
RKDIDLHGEV

SEQ ID NO: 38114 - protein, 10 aa, Mycobacterium tuberculosis
KDIDLHGEVA

SEQ ID NO: 38115 - protein, 10 aa, Mycobacterium tuberculosis
DIDLHGEVAR

SEQ ID NO: 38116 - protein, 10 aa, Mycobacterium tuberculosis
IDLHGEVARV

SEQ ID NO: 38117 - protein, 10 aa, Mycobacterium tuberculosis
DLHGEVARVR

SEQ ID NO: 38118 - protein, 10 aa, Mycobacterium tuberculosis
LHGEVARVRR

SEQ ID NO: 38119 - protein, 10 aa, Mycobacterium tuberculosis
HGEVARVRRA

SEQ ID NO: 38120 - protein, 10 aa, Mycobacterium tuberculosis
GEVARVRRAV

SEQ ID NO: 38121 - protein, 10 aa, Mycobacterium tuberculosis
EVARVRRAVV

SEQ ID NO: 38122 - protein, 10 aa, Mycobacterium tuberculosis
VARVRRAVVR

SEQ ID NO: 38123 - protein, 10 aa, Mycobacterium tuberculosis
ARVRRAVVRV

SEQ ID NO: 38124 - protein, 10 aa, Mycobacterium tuberculosis
RVRRAVVRVG

SEQ ID NO: 38125 - protein, 10 aa, Mycobacterium tuberculosis
VRRAVVRVGE

SEQ ID NO: 38126 - protein, 10 aa, Mycobacterium tuberculosis
RRAVVRVGEG

SEQ ID NO: 38127 - protein, 10 aa, Mycobacterium tuberculosis
RAVVRVGEGF

SEQ ID NO: 38128 - protein, 10 aa, Mycobacterium tuberculosis
AVVRVGEGFK

SEQ ID NO: 38129 - protein, 10 aa, Mycobacterium tuberculosis
VVRVGEGFKV

SEQ ID NO: 38130 - protein, 10 aa, Mycobacterium tuberculosis
VRVGEGFKVT

SEQ ID NO: 38131 - protein, 10 aa, Mycobacterium tuberculosis
RVGEGFKVTT

SEQ ID NO: 38132 - protein, 10 aa, Mycobacterium tuberculosis
VGEGFKVTTP

SEQ ID NO: 38133 - protein, 10 aa, Mycobacterium tuberculosis
GEGFKVTTPK

SEQ ID NO: 38134 - protein, 10 aa, Mycobacterium tuberculosis
EGFKVTTPKS

SEQ ID NO: 38135 - protein, 10 aa, Mycobacterium tuberculosis
GFKVTTPKSD

SEQ ID NO: 38136 - protein, 10 aa, Mycobacterium tuberculosis
FKVTTPKSDA

SEQ ID NO: 38137 - protein, 10 aa, Mycobacterium tuberculosis
KVTTPKSDAG

SEQ ID NO: 38138 - protein, 10 aa, Mycobacterium tuberculosis
VTTPKSDAGV

SEQ ID NO: 38139 - protein, 10 aa, Mycobacterium tuberculosis
TTPKSDAGVR

SEQ ID NO: 38140 - protein, 10 aa, Mycobacterium tuberculosis
TPKSDAGVRD

SEQ ID NO: 38141 - protein, 10 aa, Mycobacterium tuberculosis
PKSDAGVRDI

SEQ ID NO: 38142 - protein, 10 aa, Mycobacterium tuberculosis
KSDAGVRDIS

SEQ ID NO: 38143 - protein, 10 aa, Mycobacterium tuberculosis
SDAGVRDISI

SEQ ID NO: 38144 - protein, 10 aa, Mycobacterium tuberculosis
DAGVRDISIP

SEQ ID NO: 38145 - protein, 10 aa, Mycobacterium tuberculosis
AGVRDISIPP

SEQ ID NO: 38146 - protein, 10 aa, Mycobacterium tuberculosis
GVRDISIPPH

SEQ ID NO: 38147 - protein, 10 aa, Mycobacterium tuberculosis
VRDISIPPHL

SEQ ID NO: 38148 - protein, 10 aa, Mycobacterium tuberculosis
RDISIPPHLI

SEQ ID NO: 38149 - protein, 10 aa, Mycobacterium tuberculosis
DISIPPHLIP

SEQ ID NO: 38150 - protein, 10 aa, Mycobacterium tuberculosis
ISIPPHLIPA

SEQ ID NO: 38151 - protein, 10 aa, Mycobacterium tuberculosis
SIPPHLIPAI

SEQ ID NO: 38152 - protein, 10 aa, Mycobacterium tuberculosis
IPPHLIPAIE

SEQ ID NO: 38153 - protein, 10 aa, Mycobacterium tuberculosis
PPHLIPAIED

SEQ ID NO: 38154 - protein, 10 aa, Mycobacterium tuberculosis
PHLIPAIEDH

SEQ ID NO: 38155 - protein, 10 aa, Mycobacterium tuberculosis
HLIPAIEDHL

SEQ ID NO: 38156 - protein, 10 aa, Mycobacterium tuberculosis
LIPAIEDHLH

SEQ ID NO: 38157 - protein, 10 aa, Mycobacterium tuberculosis
IPAIEDHLHK

SEQ ID NO: 38158 - protein, 10 aa, Mycobacterium tuberculosis
PAIEDHLHKH

SEQ ID NO: 38159 - protein, 10 aa, Mycobacterium tuberculosis
AIEDHLHKHV

SEQ ID NO: 38160 - protein, 10 aa, Mycobacterium tuberculosis
IEDHLHKHVN

SEQ ID NO: 38161 - protein, 10 aa, Mycobacterium tuberculosis
EDHLHKHVNP

SEQ ID NO: 38162 - protein, 10 aa, Mycobacterium tuberculosis
DHLHKHVNPG

SEQ ID NO: 38163 - protein, 10 aa, Mycobacterium tuberculosis
HLHKHVNPGR

SEQ ID NO: 38164 - protein, 10 aa, Mycobacterium tuberculosis
LHKHVNPGRE

SEQ ID NO: 38165 - protein, 10 aa, Mycobacterium tuberculosis
HKHVNPGRES

SEQ ID NO: 38166 - protein, 10 aa, Mycobacterium tuberculosis
KHVNPGRESL

SEQ ID NO: 38167 - protein, 10 aa, Mycobacterium tuberculosis
HVNPGRESLL

SEQ ID NO: 38168 - protein, 10 aa, Mycobacterium tuberculosis
VNPGRESLLF

SEQ ID NO: 38169 - protein, 10 aa, Mycobacterium tuberculosis
NPGRESLLFP

SEQ ID NO: 38170 - protein, 10 aa, Mycobacterium tuberculosis
PGRESLLFPS

SEQ ID NO: 38171 - protein, 10 aa, Mycobacterium tuberculosis
GRESLLFPSV

SEQ ID NO: 38172 - protein, 10 aa, Mycobacterium tuberculosis
RESLLFPSVN

SEQ ID NO: 38173 - protein, 10 aa, Mycobacterium tuberculosis
ESLLFPSVND

SEQ ID NO: 38174 - protein, 10 aa, Mycobacterium tuberculosis
SLLFPSVNDP

SEQ ID NO: 38175 - protein, 10 aa, Mycobacterium tuberculosis
LLFPSVNDPN

SEQ ID NO: 38176 - protein, 10 aa, Mycobacterium tuberculosis
LFPSVNDPNR

SEQ ID NO: 38177 - protein, 10 aa, Mycobacterium tuberculosis
FPSVNDPNRH

SEQ ID NO: 38178 - protein, 10 aa, Mycobacterium tuberculosis
PSVNDPNRHL

SEQ ID NO: 38179 - protein, 10 aa, Mycobacterium tuberculosis
SVNDPNRHLA

SEQ ID NO: 38180 - protein, 10 aa, Mycobacterium tuberculosis
VNDPNRHLAP

SEQ ID NO: 38181 - protein, 10 aa, Mycobacterium tuberculosis
NDPNRHLAPS

SEQ ID NO: 38182 - protein, 10 aa, Mycobacterium tuberculosis
DPNRHLAPSA

SEQ ID NO: 38183 - protein, 10 aa, Mycobacterium tuberculosis
PNRHLAPSAL

SEQ ID NO: 38184 - protein, 10 aa, Mycobacterium tuberculosis
NRHLAPSALY

SEQ ID NO: 38185 - protein, 10 aa, Mycobacterium tuberculosis
RHLAPSALYR

SEQ ID NO: 38186 - protein, 10 aa, Mycobacterium tuberculosis
HLAPSALYRM

SEQ ID NO: 38187 - protein, 10 aa, Mycobacterium tuberculosis
LAPSALYRMF

SEQ ID NO: 38188 - protein, 10 aa, Mycobacterium tuberculosis
APSALYRMFY

SEQ ID NO: 38189 - protein, 10 aa, Mycobacterium tuberculosis
PSALYRMFYK

SEQ ID NO: 38190 - protein, 10 aa, Mycobacterium tuberculosis
SALYRMFYKA

SEQ ID NO: 38191 - protein, 10 aa, Mycobacterium tuberculosis
ALYRMFYKAR

SEQ ID NO: 38192 - protein, 10 aa, Mycobacterium tuberculosis
LYRMFYKARK

SEQ ID NO: 38193 - protein, 10 aa, Mycobacterium tuberculosis
YRMFYKARKA

SEQ ID NO: 38194 - protein, 10 aa, Mycobacterium tuberculosis
RMFYKARKAA

SEQ ID NO: 38195 - protein, 10 aa, Mycobacterium tuberculosis
MFYKARKAAG

SEQ ID NO: 38196 - protein, 10 aa, Mycobacterium tuberculosis
FYKARKAAGR

SEQ ID NO: 38197 - protein, 10 aa, Mycobacterium tuberculosis
YKARKAAGRP

SEQ ID NO: 38198 - protein, 10 aa, Mycobacterium tuberculosis
KARKAAGRPD

SEQ ID NO: 38199 - protein, 10 aa, Mycobacterium tuberculosis
ARKAAGRPDL

SEQ ID NO: 38200 - protein, 10 aa, Mycobacterium tuberculosis
RKAAGRPDLR

SEQ ID NO: 38201 - protein, 10 aa, Mycobacterium tuberculosis
KAAGRPDLRV

SEQ ID NO: 38202 - protein, 10 aa, Mycobacterium tuberculosis
AAGRPDLRVH

SEQ ID NO: 38203 - protein, 10 aa, Mycobacterium tuberculosis
AGRPDLRVHD

SEQ ID NO: 38204 - protein, 10 aa, Mycobacterium tuberculosis
GRPDLRVHDL

SEQ ID NO: 38205 - protein, 10 aa, Mycobacterium tuberculosis
RPDLRVHDLR

SEQ ID NO: 38206 - protein, 10 aa, Mycobacterium tuberculosis
PDLRVHDLRH

SEQ ID NO: 38207 - protein, 10 aa, Mycobacterium tuberculosis
DLRVHDLRHS

SEQ ID NO: 38208 - protein, 10 aa, Mycobacterium tuberculosis
LRVHDLRHSG

SEQ ID NO: 38209 - protein, 10 aa, Mycobacterium tuberculosis
RVHDLRHSGA

SEQ ID NO: 38210 - protein, 10 aa, Mycobacterium tuberculosis
VHDLRHSGAV

SEQ ID NO: 38211 - protein, 10 aa, Mycobacterium tuberculosis
HDLRHSGAVL

SEQ ID NO: 38212 - protein, 10 aa, Mycobacterium tuberculosis
DLRHSGAVLA

SEQ ID NO: 38213 - protein, 10 aa, Mycobacterium tuberculosis
LRHSGAVLAA

SEQ ID NO: 38214 - protein, 10 aa, Mycobacterium tuberculosis
RHSGAVLAAS

SEQ ID NO: 38215 - protein, 10 aa, Mycobacterium tuberculosis
HSGAVLAAST

SEQ ID NO: 38216 - protein, 10 aa, Mycobacterium tuberculosis
SGAVLAASTG

SEQ ID NO: 38217 - protein, 10 aa, Mycobacterium tuberculosis
GAVLAASTGA

SEQ ID NO: 38218 - protein, 10 aa, Mycobacterium tuberculosis
AVLAASTGAT

SEQ ID NO: 38219 - protein, 10 aa, Mycobacterium tuberculosis
VLAASTGATL

SEQ ID NO: 38220 - protein, 10 aa, Mycobacterium tuberculosis
LAASTGATLA

SEQ ID NO: 38221 - protein, 10 aa, Mycobacterium tuberculosis
AASTGATLAE

SEQ ID NO: 38222 - protein, 10 aa, Mycobacterium tuberculosis
ASTGATLAEL

SEQ ID NO: 38223 - protein, 10 aa, Mycobacterium tuberculosis
STGATLAELM

SEQ ID NO: 38224 - protein, 10 aa, Mycobacterium tuberculosis
TGATLAELMQ

SEQ ID NO: 38225 - protein, 10 aa, Mycobacterium tuberculosis
GATLAELMQR

SEQ ID NO: 38226 - protein, 10 aa, Mycobacterium tuberculosis
ATLAELMQRL

SEQ ID NO: 38227 - protein, 10 aa, Mycobacterium tuberculosis
TLAELMQRLG

SEQ ID NO: 38228 - protein, 10 aa, Mycobacterium tuberculosis
LAELMQRLGH

SEQ ID NO: 38229 - protein, 10 aa, Mycobacterium tuberculosis
AELMQRLGHS

SEQ ID NO: 38230 - protein, 10 aa, Mycobacterium tuberculosis
ELMQRLGHST

SEQ ID NO: 38231 - protein, 10 aa, Mycobacterium tuberculosis
LMQRLGHSTA

SEQ ID NO: 38232 - protein, 10 aa, Mycobacterium tuberculosis
MQRLGHSTAG

SEQ ID NO: 38233 - protein, 10 aa, Mycobacterium tuberculosis
QRLGHSTAGA

SEQ ID NO: 38234 - protein, 10 aa, Mycobacterium tuberculosis
RLGHSTAGAA

SEQ ID NO: 38235 - protein, 10 aa, Mycobacterium tuberculosis
LGHSTAGAAL

SEQ ID NO: 38236 - protein, 10 aa, Mycobacterium tuberculosis
GHSTAGAALR

SEQ ID NO: 38237 - protein, 10 aa, Mycobacterium tuberculosis
HSTAGAALRY

SEQ ID NO: 38238 - protein, 10 aa, Mycobacterium tuberculosis
STAGAALRYQ

SEQ ID NO: 38239 - protein, 10 aa, Mycobacterium tuberculosis
TAGAALRYQH

SEQ ID NO: 38240 - protein, 10 aa, Mycobacterium tuberculosis
AGAALRYQHA

SEQ ID NO: 38241 - protein, 10 aa, Mycobacterium tuberculosis
GAALRYQHAA

SEQ ID NO: 38242 - protein, 10 aa, Mycobacterium tuberculosis
AALRYQHAAK

SEQ ID NO: 38243 - protein, 10 aa, Mycobacterium tuberculosis
ALRYQHAAKG

SEQ ID NO: 38244 - protein, 10 aa, Mycobacterium tuberculosis
LRYQHAAKGR

SEQ ID NO: 38245 - protein, 10 aa, Mycobacterium tuberculosis
RYQHAAKGRD

SEQ ID NO: 38246 - protein, 10 aa, Mycobacterium tuberculosis
YQHAAKGRDR

SEQ ID NO: 38247 - protein, 10 aa, Mycobacterium tuberculosis
QHAAKGRDRE

SEQ ID NO: 38248 - protein, 10 aa, Mycobacterium tuberculosis
HAAKGRDREI

SEQ ID NO: 38249 - protein, 10 aa, Mycobacterium tuberculosis
AAKGRDREIA

SEQ ID NO: 38250 - protein, 10 aa, Mycobacterium tuberculosis
AKGRDREIAA

SEQ ID NO: 38251 - protein, 10 aa, Mycobacterium tuberculosis
KGRDREIAAL

SEQ ID NO: 38252 - protein, 10 aa, Mycobacterium tuberculosis
GRDREIAALL

SEQ ID NO: 38253 - protein, 10 aa, Mycobacterium tuberculosis
RDREIAALLS

SEQ ID NO: 38254 - protein, 10 aa, Mycobacterium tuberculosis
DREIAALLSK

SEQ ID NO: 38255 - protein, 10 aa, Mycobacterium tuberculosis
REIAALLSKL

SEQ ID NO: 38256 - protein, 10 aa, Mycobacterium tuberculosis
EIAALLSKLA

SEQ ID NO: 38257 - protein, 10 aa, Mycobacterium tuberculosis
IAALLSKLAE

SEQ ID NO: 38258 - protein, 10 aa, Mycobacterium tuberculosis
AALLSKLAEN

SEQ ID NO: 38259 - protein, 10 aa, Mycobacterium tuberculosis
ALLSKLAENQ

SEQ ID NO: 38260 - protein, 10 aa, Mycobacterium tuberculosis
LLSKLAENQE

SEQ ID NO: 38261 - protein, 10 aa, Mycobacterium tuberculosis
LSKLAENQEM

SEQ ID NO: 38262 - protein, 11 aa, Mycobacterium tuberculosis
MTQTGKRQRRK

SEQ ID NO: 38263 - protein, 11 aa, Mycobacterium tuberculosis
TQTGKRQRRKF

SEQ ID NO: 38264 - protein, 11 aa, Mycobacterium tuberculosis
QTGKRQRRKFG

SEQ ID NO: 38265 - protein, 11 aa, Mycobacterium tuberculosis
TGKRQRRKFGR

SEQ ID NO: 38266 - protein, 11 aa, Mycobacterium tuberculosis
GKRQRRKFGRI

SEQ ID NO: 38267 - protein, 11 aa, Mycobacterium tuberculosis
KRQRRKFGRIR

SEQ ID NO: 38268 - protein, 11 aa, Mycobacterium tuberculosis
RQRRKFGRIRQ

SEQ ID NO: 38269 - protein, 11 aa, Mycobacterium tuberculosis
QRRKFGRIRQF

SEQ ID NO: 38270 - protein, 11 aa, Mycobacterium tuberculosis
RRKFGRIRQFN

SEQ ID NO: 38271 - protein, 11 aa, Mycobacterium tuberculosis
RKFGRIRQFNS

SEQ ID NO: 38272 - protein, 11 aa, Mycobacterium tuberculosis
KFGRIRQFNSG

SEQ ID NO: 38273 - protein, 11 aa, Mycobacterium tuberculosis
FGRIRQFNSGR

SEQ ID NO: 38274 - protein, 11 aa, Mycobacterium tuberculosis
GRIRQFNSGRW

SEQ ID NO: 38275 - protein, 11 aa, Mycobacterium tuberculosis
RIRQFNSGRWQ

SEQ ID NO: 38276 - protein, 11 aa, Mycobacterium tuberculosis
IRQFNSGRWQA

SEQ ID NO: 38277 - protein, 11 aa, Mycobacterium tuberculosis
RQFNSGRWQAS

SEQ ID NO: 38278 - protein, 11 aa, Mycobacterium tuberculosis
QFNSGRWQASY

SEQ ID NO: 38279 - protein, 11 aa, Mycobacterium tuberculosis
FNSGRWQASYT

SEQ ID NO: 38280 - protein, 11 aa, Mycobacterium tuberculosis
NSGRWQASYTG

SEQ ID NO: 38281 - protein, 11 aa, Mycobacterium tuberculosis
SGRWQASYTGP

SEQ ID NO: 38282 - protein, 11 aa, Mycobacterium tuberculosis
GRWQASYTGPD

SEQ ID NO: 38283 - protein, 11 aa, Mycobacterium tuberculosis
RWQASYTGPDG

SEQ ID NO: 38284 - protein, 11 aa, Mycobacterium tuberculosis
WQASYTGPDGR

SEQ ID NO: 38285 - protein, 11 aa, Mycobacterium tuberculosis
QASYTGPDGRV

SEQ ID NO: 38286 - protein, 11 aa, Mycobacterium tuberculosis
ASYTGPDGRVY

SEQ ID NO: 38287 - protein, 11 aa, Mycobacterium tuberculosis
SYTGPDGRVYI

SEQ ID NO: 38288 - protein, 11 aa, Mycobacterium tuberculosis
YTGPDGRVYIA

SEQ ID NO: 38289 - protein, 11 aa, Mycobacterium tuberculosis
TGPDGRVYIAP

SEQ ID NO: 38290 - protein, 11 aa, Mycobacterium tuberculosis
GPDGRVYIAPK

SEQ ID NO: 38291 - protein, 11 aa, Mycobacterium tuberculosis
PDGRVYIAPKT

SEQ ID NO: 38292 - protein, 11 aa, Mycobacterium tuberculosis
DGRVYIAPKTF

SEQ ID NO: 38293 - protein, 11 aa, Mycobacterium tuberculosis
GRVYIAPKTFN

SEQ ID NO: 38294 - protein, 11 aa, Mycobacterium tuberculosis
RVYIAPKTFNA

SEQ ID NO: 38295 - protein, 11 aa, Mycobacterium tuberculosis
VYIAPKTFNAK

SEQ ID NO: 38296 - protein, 11 aa, Mycobacterium tuberculosis
YIAPKTFNAKI

SEQ ID NO: 38297 - protein, 11 aa, Mycobacterium tuberculosis
IAPKTFNAKID

SEQ ID NO: 38298 - protein, 11 aa, Mycobacterium tuberculosis
APKTFNAKIDA

SEQ ID NO: 38299 - protein, 11 aa, Mycobacterium tuberculosis
PKTFNAKIDAE

SEQ ID NO: 38300 - protein, 11 aa, Mycobacterium tuberculosis
KTFNAKIDAEA

SEQ ID NO: 38301 - protein, 11 aa, Mycobacterium tuberculosis
TFNAKIDAEAW

SEQ ID NO: 38302 - protein, 11 aa, Mycobacterium tuberculosis
FNAKIDAEAWL

SEQ ID NO: 38303 - protein, 11 aa, Mycobacterium tuberculosis
NAKIDAEAWLT

SEQ ID NO: 38304 - protein, 11 aa, Mycobacterium tuberculosis
AKIDAEAWLTD

SEQ ID NO: 38305 - protein, 11 aa, Mycobacterium tuberculosis
KIDAEAWLTDR

SEQ ID NO: 38306 - protein, 11 aa, Mycobacterium tuberculosis
IDAEAWLTDRR

SEQ ID NO: 38307 - protein, 11 aa, Mycobacterium tuberculosis
DAEAWLTDRRR

SEQ ID NO: 38308 - protein, 11 aa, Mycobacterium tuberculosis
AEAWLTDRRRE

SEQ ID NO: 38309 - protein, 11 aa, Mycobacterium tuberculosis
EAWLTDRRREI

SEQ ID NO: 38310 - protein, 11 aa, Mycobacterium tuberculosis
AWLTDRRREID

SEQ ID NO: 38311 - protein, 11 aa, Mycobacterium tuberculosis
WLTDRRREIDR

SEQ ID NO: 38312 - protein, 11 aa, Mycobacterium tuberculosis
LTDRRREIDRQ

SEQ ID NO: 38313 - protein, 11 aa, Mycobacterium tuberculosis
TDRRREIDRQL

SEQ ID NO: 38314 - protein, 11 aa, Mycobacterium tuberculosis
DRRREIDRQLW

SEQ ID NO: 38315 - protein, 11 aa, Mycobacterium tuberculosis
RRREIDRQLWS

SEQ ID NO: 38316 - protein, 11 aa, Mycobacterium tuberculosis
RREIDRQLWSP

SEQ ID NO: 38317 - protein, 11 aa, Mycobacterium tuberculosis
REIDRQLWSPA

SEQ ID NO: 38318 - protein, 11 aa, Mycobacterium tuberculosis
EIDRQLWSPAS

SEQ ID NO: 38319 - protein, 11 aa, Mycobacterium tuberculosis
IDRQLWSPASG

SEQ ID NO: 38320 - protein, 11 aa, Mycobacterium tuberculosis
DRQLWSPASGQ

SEQ ID NO: 38321 - protein, 11 aa, Mycobacterium tuberculosis
RQLWSPASGQE

SEQ ID NO: 38322 - protein, 11 aa, Mycobacterium tuberculosis
QLWSPASGQED

SEQ ID NO: 38323 - protein, 11 aa, Mycobacterium tuberculosis
LWSPASGQEDR

SEQ ID NO: 38324 - protein, 11 aa, Mycobacterium tuberculosis
WSPASGQEDRP

SEQ ID NO: 38325 - protein, 11 aa, Mycobacterium tuberculosis
SPASGQEDRPG

SEQ ID NO: 38326 - protein, 11 aa, Mycobacterium tuberculosis
PASGQEDRPGA

SEQ ID NO: 38327 - protein, 11 aa, Mycobacterium tuberculosis
ASGQEDRPGAP

SEQ ID NO: 38328 - protein, 11 aa, Mycobacterium tuberculosis
SGQEDRPGAPF

SEQ ID NO: 38329 - protein, 11 aa, Mycobacterium tuberculosis
GQEDRPGAPFG

SEQ ID NO: 38330 - protein, 11 aa, Mycobacterium tuberculosis
QEDRPGAPFGE

SEQ ID NO: 38331 - protein, 11 aa, Mycobacterium tuberculosis
EDRPGAPFGEY

SEQ ID NO: 38332 - protein, 11 aa, Mycobacterium tuberculosis
DRPGAPFGEYA

SEQ ID NO: 38333 - protein, 11 aa, Mycobacterium tuberculosis
RPGAPFGEYAE

SEQ ID NO: 38334 - protein, 11 aa, Mycobacterium tuberculosis
PGAPFGEYAEG

SEQ ID NO: 38335 - protein, 11 aa, Mycobacterium tuberculosis
GAPFGEYAEGW

SEQ ID NO: 38336 - protein, 11 aa, Mycobacterium tuberculosis
APFGEYAEGWL

SEQ ID NO: 38337 - protein, 11 aa, Mycobacterium tuberculosis
PFGEYAEGWLK

SEQ ID NO: 38338 - protein, 11 aa, Mycobacterium tuberculosis
FGEYAEGWLKQ

SEQ ID NO: 38339 - protein, 11 aa, Mycobacterium tuberculosis
GEYAEGWLKQR

SEQ ID NO: 38340 - protein, 11 aa, Mycobacterium tuberculosis
EYAEGWLKQRG

SEQ ID NO: 38341 - protein, 11 aa, Mycobacterium tuberculosis
YAEGWLKQRGI

SEQ ID NO: 38342 - protein, 11 aa, Mycobacterium tuberculosis
AEGWLKQRGIK

SEQ ID NO: 38343 - protein, 11 aa, Mycobacterium tuberculosis
EGWLKQRGIKD

SEQ ID NO: 38344 - protein, 11 aa, Mycobacterium tuberculosis
GWLKQRGIKDR

SEQ ID NO: 38345 - protein, 11 aa, Mycobacterium tuberculosis
WLKQRGIKDRT

SEQ ID NO: 38346 - protein, 11 aa, Mycobacterium tuberculosis
LKQRGIKDRTR

SEQ ID NO: 38347 - protein, 11 aa, Mycobacterium tuberculosis
KQRGIKDRTRA

SEQ ID NO: 38348 - protein, 11 aa, Mycobacterium tuberculosis
QRGIKDRTRAH

SEQ ID NO: 38349 - protein, 11 aa, Mycobacterium tuberculosis
RGIKDRTRAHY

SEQ ID NO: 38350 - protein, 11 aa, Mycobacterium tuberculosis
GIKDRTRAHYR

SEQ ID NO: 38351 - protein, 11 aa, Mycobacterium tuberculosis
IKDRTRAHYRK

SEQ ID NO: 38352 - protein, 11 aa, Mycobacterium tuberculosis
KDRTRAHYRKL

SEQ ID NO: 38353 - protein, 11 aa, Mycobacterium tuberculosis
DRTRAHYRKLL

SEQ ID NO: 38354 - protein, 11 aa, Mycobacterium tuberculosis
RTRAHYRKLLD

SEQ ID NO: 38355 - protein, 11 aa, Mycobacterium tuberculosis
TRAHYRKLLDN

SEQ ID NO: 38356 - protein, 11 aa, Mycobacterium tuberculosis
RAHYRKLLDNH

SEQ ID NO: 38357 - protein, 11 aa, Mycobacterium tuberculosis
AHYRKLLDNHI

SEQ ID NO: 38358 - protein, 11 aa, Mycobacterium tuberculosis
HYRKLLDNHIL

SEQ ID NO: 38359 - protein, 11 aa, Mycobacterium tuberculosis
YRKLLDNHILA

SEQ ID NO: 38360 - protein, 11 aa, Mycobacterium tuberculosis
RKLLDNHILAT

SEQ ID NO: 38361 - protein, 11 aa, Mycobacterium tuberculosis
KLLDNHILATF

SEQ ID NO: 38362 - protein, 11 aa, Mycobacterium tuberculosis
LLDNHILATFA

SEQ ID NO: 38363 - protein, 11 aa, Mycobacterium tuberculosis
LDNHILATFAD

SEQ ID NO: 38364 - protein, 11 aa, Mycobacterium tuberculosis
DNHILATFADT

SEQ ID NO: 38365 - protein, 11 aa, Mycobacterium tuberculosis
NHILATFADTD

SEQ ID NO: 38366 - protein, 11 aa, Mycobacterium tuberculosis
HILATFADTDL

SEQ ID NO: 38367 - protein, 11 aa, Mycobacterium tuberculosis
ILATFADTDLR

SEQ ID NO: 38368 - protein, 11 aa, Mycobacterium tuberculosis
LATFADTDLRD

SEQ ID NO: 38369 - protein, 11 aa, Mycobacterium tuberculosis
ATFADTDLRDI

SEQ ID NO: 38370 - protein, 11 aa, Mycobacterium tuberculosis
TFADTDLRDIT

SEQ ID NO: 38371 - protein, 11 aa, Mycobacterium tuberculosis
FADTDLRDITP

SEQ ID NO: 38372 - protein, 11 aa, Mycobacterium tuberculosis
ADTDLRDITPA

SEQ ID NO: 38373 - protein, 11 aa, Mycobacterium tuberculosis
DTDLRDITPAA

SEQ ID NO: 38374 - protein, 11 aa, Mycobacterium tuberculosis
TDLRDITPAAV

SEQ ID NO: 38375 - protein, 11 aa, Mycobacterium tuberculosis
DLRDITPAAVR

SEQ ID NO: 38376 - protein, 11 aa, Mycobacterium tuberculosis
LRDITPAAVRR

SEQ ID NO: 38377 - protein, 11 aa, Mycobacterium tuberculosis
RDITPAAVRRW

SEQ ID NO: 38378 - protein, 11 aa, Mycobacterium tuberculosis
DITPAAVRRWY

SEQ ID NO: 38379 - protein, 11 aa, Mycobacterium tuberculosis
ITPAAVRRWYA

SEQ ID NO: 38380 - protein, 11 aa, Mycobacterium tuberculosis
TPAAVRRWYAT

SEQ ID NO: 38381 - protein, 11 aa, Mycobacterium tuberculosis
PAAVRRWYATT

SEQ ID NO: 38382 - protein, 11 aa, Mycobacterium tuberculosis
AAVRRWYATTA

SEQ ID NO: 38383 - protein, 11 aa, Mycobacterium tuberculosis
AVRRWYATTAV

SEQ ID NO: 38384 - protein, 11 aa, Mycobacterium tuberculosis
VRRWYATTAVG

SEQ ID NO: 38385 - protein, 11 aa, Mycobacterium tuberculosis
RRWYATTAVGT

SEQ ID NO: 38386 - protein, 11 aa, Mycobacterium tuberculosis
RWYATTAVGTP

SEQ ID NO: 38387 - protein, 11 aa, Mycobacterium tuberculosis
WYATTAVGTPT

SEQ ID NO: 38388 - protein, 11 aa, Mycobacterium tuberculosis
YATTAVGTPTM

SEQ ID NO: 38389 - protein, 11 aa, Mycobacterium tuberculosis
ATTAVGTPTMR

SEQ ID NO: 38390 - protein, 11 aa, Mycobacterium tuberculosis
TTAVGTPTMRA

SEQ ID NO: 38391 - protein, 11 aa, Mycobacterium tuberculosis
TAVGTPTMRAH

SEQ ID NO: 38392 - protein, 11 aa, Mycobacterium tuberculosis
AVGTPTMRAHS

SEQ ID NO: 38393 - protein, 11 aa, Mycobacterium tuberculosis
VGTPTMRAHSY

SEQ ID NO: 38394 - protein, 11 aa, Mycobacterium tuberculosis
GTPTMRAHSYS

SEQ ID NO: 38395 - protein, 11 aa, Mycobacterium tuberculosis
TPTMRAHSYSL

SEQ ID NO: 38396 - protein, 11 aa, Mycobacterium tuberculosis
PTMRAHSYSLL

SEQ ID NO: 38397 - protein, 11 aa, Mycobacterium tuberculosis
TMRAHSYSLLR

SEQ ID NO: 38398 - protein, 11 aa, Mycobacterium tuberculosis
MRAHSYSLLRA

SEQ ID NO: 38399 - protein, 11 aa, Mycobacterium tuberculosis
RAHSYSLLRAI

SEQ ID NO: 38400 - protein, 11 aa, Mycobacterium tuberculosis
AHSYSLLRAIM

SEQ ID NO: 38401 - protein, 11 aa, Mycobacterium tuberculosis
HSYSLLRAIMQ

SEQ ID NO: 38402 - protein, 11 aa, Mycobacterium tuberculosis
SYSLLRAIMQT

SEQ ID NO: 38403 - protein, 11 aa, Mycobacterium tuberculosis
YSLLRAIMQTA

SEQ ID NO: 38404 - protein, 11 aa, Mycobacterium tuberculosis
SLLRAIMQTAL

SEQ ID NO: 38405 - protein, 11 aa, Mycobacterium tuberculosis
LLRAIMQTALA

SEQ ID NO: 38406 - protein, 11 aa, Mycobacterium tuberculosis
LRAIMQTALAD

SEQ ID NO: 38407 - protein, 11 aa, Mycobacterium tuberculosis
RAIMQTALADD

SEQ ID NO: 38408 - protein, 11 aa, Mycobacterium tuberculosis
AIMQTALADDL

SEQ ID NO: 38409 - protein, 11 aa, Mycobacterium tuberculosis
IMQTALADDLI

SEQ ID NO: 38410 - protein, 11 aa, Mycobacterium tuberculosis
MQTALADDLID

SEQ ID NO: 38411 - protein, 11 aa, Mycobacterium tuberculosis
QTALADDLIDS

SEQ ID NO: 38412 - protein, 11 aa, Mycobacterium tuberculosis
TALADDLIDSN

SEQ ID NO: 38413 - protein, 11 aa, Mycobacterium tuberculosis
ALADDLIDSNP

SEQ ID NO: 38414 - protein, 11 aa, Mycobacterium tuberculosis
LADDLIDSNPC

SEQ ID NO: 38415 - protein, 11 aa, Mycobacterium tuberculosis
ADDLIDSNPCR

SEQ ID NO: 38416 - protein, 11 aa, Mycobacterium tuberculosis
DDLIDSNPCRI

SEQ ID NO: 38417 - protein, 11 aa, Mycobacterium tuberculosis
DLIDSNPCRIS

SEQ ID NO: 38418 - protein, 11 aa, Mycobacterium tuberculosis
LIDSNPCRISG

SEQ ID NO: 38419 - protein, 11 aa, Mycobacterium tuberculosis
IDSNPCRISGA

SEQ ID NO: 38420 - protein, 11 aa, Mycobacterium tuberculosis
DSNPCRISGAS

SEQ ID NO: 38421 - protein, 11 aa, Mycobacterium tuberculosis
SNPCRISGAST

SEQ ID NO: 38422 - protein, 11 aa, Mycobacterium tuberculosis
NPCRISGASTA

SEQ ID NO: 38423 - protein, 11 aa, Mycobacterium tuberculosis
PCRISGASTAR

SEQ ID NO: 38424 - protein, 11 aa, Mycobacterium tuberculosis
CRISGASTARR

SEQ ID NO: 38425 - protein, 11 aa, Mycobacterium tuberculosis
RISGASTARRV

SEQ ID NO: 38426 - protein, 11 aa, Mycobacterium tuberculosis
ISGASTARRVH

SEQ ID NO: 38427 - protein, 11 aa, Mycobacterium tuberculosis
SGASTARRVHK

SEQ ID NO: 38428 - protein, 11 aa, Mycobacterium tuberculosis
GASTARRVHKI

SEQ ID NO: 38429 - protein, 11 aa, Mycobacterium tuberculosis
ASTARRVHKIR

SEQ ID NO: 38430 - protein, 11 aa, Mycobacterium tuberculosis
STARRVHKIRP

SEQ ID NO: 38431 - protein, 11 aa, Mycobacterium tuberculosis
TARRVHKIRPA

SEQ ID NO: 38432 - protein, 11 aa, Mycobacterium tuberculosis
ARRVHKIRPAT

SEQ ID NO: 38433 - protein, 11 aa, Mycobacterium tuberculosis
RRVHKIRPATL

SEQ ID NO: 38434 - protein, 11 aa, Mycobacterium tuberculosis
RVHKIRPATLD

SEQ ID NO: 38435 - protein, 11 aa, Mycobacterium tuberculosis
VHKIRPATLDE

SEQ ID NO: 38436 - protein, 11 aa, Mycobacterium tuberculosis
HKIRPATLDEL

SEQ ID NO: 38437 - protein, 11 aa, Mycobacterium tuberculosis
KIRPATLDELE

SEQ ID NO: 38438 - protein, 11 aa, Mycobacterium tuberculosis
IRPATLDELET

SEQ ID NO: 38439 - protein, 11 aa, Mycobacterium tuberculosis
RPATLDELETI

SEQ ID NO: 38440 - protein, 11 aa, Mycobacterium tuberculosis
PATLDELETIT

SEQ ID NO: 38441 - protein, 11 aa, Mycobacterium tuberculosis
ATLDELETITK

SEQ ID NO: 38442 - protein, 11 aa, Mycobacterium tuberculosis
TLDELETITKA

SEQ ID NO: 38443 - protein, 11 aa, Mycobacterium tuberculosis
LDELETITKAM

SEQ ID NO: 38444 - protein, 11 aa, Mycobacterium tuberculosis
DELETITKAMP

SEQ ID NO: 38445 - protein, 11 aa, Mycobacterium tuberculosis
ELETITKAMPD

SEQ ID NO: 38446 - protein, 11 aa, Mycobacterium tuberculosis
LETITKAMPDP

SEQ ID NO: 38447 - protein, 11 aa, Mycobacterium tuberculosis
ETITKAMPDPY

SEQ ID NO: 38448 - protein, 11 aa, Mycobacterium tuberculosis
TITKAMPDPYQ

SEQ ID NO: 38449 - protein, 11 aa, Mycobacterium tuberculosis
ITKAMPDPYQA

SEQ ID NO: 38450 - protein, 11 aa, Mycobacterium tuberculosis
TKAMPDPYQAF

SEQ ID NO: 38451 - protein, 11 aa, Mycobacterium tuberculosis
KAMPDPYQAFV

SEQ ID NO: 38452 - protein, 11 aa, Mycobacterium tuberculosis
AMPDPYQAFVL

SEQ ID NO: 38453 - protein, 11 aa, Mycobacterium tuberculosis
MPDPYQAFVLM

SEQ ID NO: 38454 - protein, 11 aa, Mycobacterium tuberculosis
PDPYQAFVLMA

SEQ ID NO: 38455 - protein, 11 aa, Mycobacterium tuberculosis
DPYQAFVLMAA

SEQ ID NO: 38456 - protein, 11 aa, Mycobacterium tuberculosis
PYQAFVLMAAW

SEQ ID NO: 38457 - protein, 11 aa, Mycobacterium tuberculosis
YQAFVLMAAWL

SEQ ID NO: 38458 - protein, 11 aa, Mycobacterium tuberculosis
QAFVLMAAWLA

SEQ ID NO: 38459 - protein, 11 aa, Mycobacterium tuberculosis
AFVLMAAWLAM

SEQ ID NO: 38460 - protein, 11 aa, Mycobacterium tuberculosis
FVLMAAWLAMR

SEQ ID NO: 38461 - protein, 11 aa, Mycobacterium tuberculosis
VLMAAWLAMRY

SEQ ID NO: 38462 - protein, 11 aa, Mycobacterium tuberculosis
LMAAWLAMRYG

SEQ ID NO: 38463 - protein, 11 aa, Mycobacterium tuberculosis
MAAWLAMRYGE

SEQ ID NO: 38464 - protein, 11 aa, Mycobacterium tuberculosis
AAWLAMRYGEL

SEQ ID NO: 38465 - protein, 11 aa, Mycobacterium tuberculosis
AWLAMRYGELT

SEQ ID NO: 38466 - protein, 11 aa, Mycobacterium tuberculosis
WLAMRYGELTE

SEQ ID NO: 38467 - protein, 11 aa, Mycobacterium tuberculosis
LAMRYGELTEL

SEQ ID NO: 38468 - protein, 11 aa, Mycobacterium tuberculosis
AMRYGELTELR

SEQ ID NO: 38469 - protein, 11 aa, Mycobacterium tuberculosis
MRYGELTELRR

SEQ ID NO: 38470 - protein, 11 aa, Mycobacterium tuberculosis
RYGELTELRRK

SEQ ID NO: 38471 - protein, 11 aa, Mycobacterium tuberculosis
YGELTELRRKD

SEQ ID NO: 38472 - protein, 11 aa, Mycobacterium tuberculosis
GELTELRRKDI

SEQ ID NO: 38473 - protein, 11 aa, Mycobacterium tuberculosis
ELTELRRKDID

SEQ ID NO: 38474 - protein, 11 aa, Mycobacterium tuberculosis
LTELRRKDIDL

SEQ ID NO: 38475 - protein, 11 aa, Mycobacterium tuberculosis
TELRRKDIDLH

SEQ ID NO: 38476 - protein, 11 aa, Mycobacterium tuberculosis
ELRRKDIDLHG

SEQ ID NO: 38477 - protein, 11 aa, Mycobacterium tuberculosis
LRRKDIDLHGE

SEQ ID NO: 38478 - protein, 11 aa, Mycobacterium tuberculosis
RRKDIDLHGEV

SEQ ID NO: 38479 - protein, 11 aa, Mycobacterium tuberculosis
RKDIDLHGEVA

SEQ ID NO: 38480 - protein, 11 aa, Mycobacterium tuberculosis
KDIDLHGEVAR

SEQ ID NO: 38481 - protein, 11 aa, Mycobacterium tuberculosis
DIDLHGEVARV

SEQ ID NO: 38482 - protein, 11 aa, Mycobacterium tuberculosis
IDLHGEVARVR

SEQ ID NO: 38483 - protein, 11 aa, Mycobacterium tuberculosis
DLHGEVARVRR

SEQ ID NO: 38484 - protein, 11 aa, Mycobacterium tuberculosis
LHGEVARVRRA

SEQ ID NO: 38485 - protein, 11 aa, Mycobacterium tuberculosis
HGEVARVRRAV

SEQ ID NO: 38486 - protein, 11 aa, Mycobacterium tuberculosis
GEVARVRRAVV

SEQ ID NO: 38487 - protein, 11 aa, Mycobacterium tuberculosis
EVARVRRAVVR

SEQ ID NO: 38488 - protein, 11 aa, Mycobacterium tuberculosis
VARVRRAVVRV

SEQ ID NO: 38489 - protein, 11 aa, Mycobacterium tuberculosis
ARVRRAVVRVG

SEQ ID NO: 38490 - protein, 11 aa, Mycobacterium tuberculosis
RVRRAVVRVGE

SEQ ID NO: 38491 - protein, 11 aa, Mycobacterium tuberculosis
VRRAVVRVGEG

SEQ ID NO: 38492 - protein, 11 aa, Mycobacterium tuberculosis
RRAVVRVGEGF

SEQ ID NO: 38493 - protein, 11 aa, Mycobacterium tuberculosis
RAVVRVGEGFK

SEQ ID NO: 38494 - protein, 11 aa, Mycobacterium tuberculosis
AVVRVGEGFKV

SEQ ID NO: 38495 - protein, 11 aa, Mycobacterium tuberculosis
VVRVGEGFKVT

SEQ ID NO: 38496 - protein, 11 aa, Mycobacterium tuberculosis
VRVGEGFKVTT

SEQ ID NO: 38497 - protein, 11 aa, Mycobacterium tuberculosis
RVGEGFKVTTP

SEQ ID NO: 38498 - protein, 11 aa, Mycobacterium tuberculosis
VGEGFKVTTPK

SEQ ID NO: 38499 - protein, 11 aa, Mycobacterium tuberculosis
GEGFKVTTPKS

SEQ ID NO: 38500 - protein, 11 aa, Mycobacterium tuberculosis
EGFKVTTPKSD

SEQ ID NO: 38501 - protein, 11 aa, Mycobacterium tuberculosis
GFKVTTPKSDA

SEQ ID NO: 38502 - protein, 11 aa, Mycobacterium tuberculosis
FKVTTPKSDAG

SEQ ID NO: 38503 - protein, 11 aa, Mycobacterium tuberculosis
KVTTPKSDAGV

SEQ ID NO: 38504 - protein, 11 aa, Mycobacterium tuberculosis
VTTPKSDAGVR

SEQ ID NO: 38505 - protein, 11 aa, Mycobacterium tuberculosis
TTPKSDAGVRD

SEQ ID NO: 38506 - protein, 11 aa, Mycobacterium tuberculosis
TPKSDAGVRDI

SEQ ID NO: 38507 - protein, 11 aa, Mycobacterium tuberculosis
PKSDAGVRDIS

SEQ ID NO: 38508 - protein, 11 aa, Mycobacterium tuberculosis
KSDAGVRDISI

SEQ ID NO: 38509 - protein, 11 aa, Mycobacterium tuberculosis
SDAGVRDISIP

SEQ ID NO: 38510 - protein, 11 aa, Mycobacterium tuberculosis
DAGVRDISIPP

SEQ ID NO: 38511 - protein, 11 aa, Mycobacterium tuberculosis
AGVRDISIPPH

SEQ ID NO: 38512 - protein, 11 aa, Mycobacterium tuberculosis
GVRDISIPPHL

SEQ ID NO: 38513 - protein, 11 aa, Mycobacterium tuberculosis
VRDISIPPHLI

SEQ ID NO: 38514 - protein, 11 aa, Mycobacterium tuberculosis
RDISIPPHLIP

SEQ ID NO: 38515 - protein, 11 aa, Mycobacterium tuberculosis
DISIPPHLIPA

SEQ ID NO: 38516 - protein, 11 aa, Mycobacterium tuberculosis
ISIPPHLIPAI

SEQ ID NO: 38517 - protein, 11 aa, Mycobacterium tuberculosis
SIPPHLIPAIE

SEQ ID NO: 38518 - protein, 11 aa, Mycobacterium tuberculosis
IPPHLIPAIED

SEQ ID NO: 38519 - protein, 11 aa, Mycobacterium tuberculosis
PPHLIPAIEDH

SEQ ID NO: 38520 - protein, 11 aa, Mycobacterium tuberculosis
PHLIPAIEDHL

SEQ ID NO: 38521 - protein, 11 aa, Mycobacterium tuberculosis
HLIPAIEDHLH

SEQ ID NO: 38522 - protein, 11 aa, Mycobacterium tuberculosis
LIPAIEDHLHK

SEQ ID NO: 38523 - protein, 11 aa, Mycobacterium tuberculosis
IPAIEDHLHKH

SEQ ID NO: 38524 - protein, 11 aa, Mycobacterium tuberculosis
PAIEDHLHKHV

SEQ ID NO: 38525 - protein, 11 aa, Mycobacterium tuberculosis
AIEDHLHKHVN

SEQ ID NO: 38526 - protein, 11 aa, Mycobacterium tuberculosis
IEDHLHKHVNP

SEQ ID NO: 38527 - protein, 11 aa, Mycobacterium tuberculosis
EDHLHKHVNPG

SEQ ID NO: 38528 - protein, 11 aa, Mycobacterium tuberculosis
DHLHKHVNPGR

SEQ ID NO: 38529 - protein, 11 aa, Mycobacterium tuberculosis
HLHKHVNPGRE

SEQ ID NO: 38530 - protein, 11 aa, Mycobacterium tuberculosis
LHKHVNPGRES

SEQ ID NO: 38531 - protein, 11 aa, Mycobacterium tuberculosis
HKHVNPGRESL

SEQ ID NO: 38532 - protein, 11 aa, Mycobacterium tuberculosis
KHVNPGRESLL

SEQ ID NO: 38533 - protein, 11 aa, Mycobacterium tuberculosis
HVNPGRESLLF

SEQ ID NO: 38534 - protein, 11 aa, Mycobacterium tuberculosis
VNPGRESLLFP

SEQ ID NO: 38535 - protein, 11 aa, Mycobacterium tuberculosis
NPGRESLLFPS

SEQ ID NO: 38536 - protein, 11 aa, Mycobacterium tuberculosis
PGRESLLFPSV

SEQ ID NO: 38537 - protein, 11 aa, Mycobacterium tuberculosis
GRESLLFPSVN

SEQ ID NO: 38538 - protein, 11 aa, Mycobacterium tuberculosis
RESLLFPSVND

SEQ ID NO: 38539 - protein, 11 aa, Mycobacterium tuberculosis
ESLLFPSVNDP

SEQ ID NO: 38540 - protein, 11 aa, Mycobacterium tuberculosis
SLLFPSVNDPN

SEQ ID NO: 38541 - protein, 11 aa, Mycobacterium tuberculosis
LLFPSVNDPNR

SEQ ID NO: 38542 - protein, 11 aa, Mycobacterium tuberculosis
LFPSVNDPNRH

SEQ ID NO: 38543 - protein, 11 aa, Mycobacterium tuberculosis
FPSVNDPNRHL

SEQ ID NO: 38544 - protein, 11 aa, Mycobacterium tuberculosis
PSVNDPNRHLA

SEQ ID NO: 38545 - protein, 11 aa, Mycobacterium tuberculosis
SVNDPNRHLAP

SEQ ID NO: 38546 - protein, 11 aa, Mycobacterium tuberculosis
VNDPNRHLAPS

SEQ ID NO: 38547 - protein, 11 aa, Mycobacterium tuberculosis
NDPNRHLAPSA

SEQ ID NO: 38548 - protein, 11 aa, Mycobacterium tuberculosis
DPNRHLAPSAL

SEQ ID NO: 38549 - protein, 11 aa, Mycobacterium tuberculosis
PNRHLAPSALY

SEQ ID NO: 38550 - protein, 11 aa, Mycobacterium tuberculosis
NRHLAPSALYR

SEQ ID NO: 38551 - protein, 11 aa, Mycobacterium tuberculosis
RHLAPSALYRM

SEQ ID NO: 38552 - protein, 11 aa, Mycobacterium tuberculosis
HLAPSALYRMF

SEQ ID NO: 38553 - protein, 11 aa, Mycobacterium tuberculosis
LAPSALYRMFY

SEQ ID NO: 38554 - protein, 11 aa, Mycobacterium tuberculosis
APSALYRMFYK

SEQ ID NO: 38555 - protein, 11 aa, Mycobacterium tuberculosis
PSALYRMFYKA

SEQ ID NO: 38556 - protein, 11 aa, Mycobacterium tuberculosis
SALYRMFYKAR

SEQ ID NO: 38557 - protein, 11 aa, Mycobacterium tuberculosis
ALYRMFYKARK

SEQ ID NO: 38558 - protein, 11 aa, Mycobacterium tuberculosis
LYRMFYKARKA

SEQ ID NO: 38559 - protein, 11 aa, Mycobacterium tuberculosis
YRMFYKARKAA

SEQ ID NO: 38560 - protein, 11 aa, Mycobacterium tuberculosis
RMFYKARKAAG

SEQ ID NO: 38561 - protein, 11 aa, Mycobacterium tuberculosis
MFYKARKAAGR

SEQ ID NO: 38562 - protein, 11 aa, Mycobacterium tuberculosis
FYKARKAAGRP

SEQ ID NO: 38563 - protein, 11 aa, Mycobacterium tuberculosis
YKARKAAGRPD

SEQ ID NO: 38564 - protein, 11 aa, Mycobacterium tuberculosis
KARKAAGRPDL

SEQ ID NO: 38565 - protein, 11 aa, Mycobacterium tuberculosis
ARKAAGRPDLR

SEQ ID NO: 38566 - protein, 11 aa, Mycobacterium tuberculosis
RKAAGRPDLRV

SEQ ID NO: 38567 - protein, 11 aa, Mycobacterium tuberculosis
KAAGRPDLRVH

SEQ ID NO: 38568 - protein, 11 aa, Mycobacterium tuberculosis
AAGRPDLRVHD

SEQ ID NO: 38569 - protein, 11 aa, Mycobacterium tuberculosis
AGRPDLRVHDL

SEQ ID NO: 38570 - protein, 11 aa, Mycobacterium tuberculosis
GRPDLRVHDLR

SEQ ID NO: 38571 - protein, 11 aa, Mycobacterium tuberculosis
RPDLRVHDLRH

SEQ ID NO: 38572 - protein, 11 aa, Mycobacterium tuberculosis
PDLRVHDLRHS

SEQ ID NO: 38573 - protein, 11 aa, Mycobacterium tuberculosis
DLRVHDLRHSG

SEQ ID NO: 38574 - protein, 11 aa, Mycobacterium tuberculosis
LRVHDLRHSGA

SEQ ID NO: 38575 - protein, 11 aa, Mycobacterium tuberculosis
RVHDLRHSGAV

SEQ ID NO: 38576 - protein, 11 aa, Mycobacterium tuberculosis
VHDLRHSGAVL

SEQ ID NO: 38577 - protein, 11 aa, Mycobacterium tuberculosis
HDLRHSGAVLA

SEQ ID NO: 38578 - protein, 11 aa, Mycobacterium tuberculosis
DLRHSGAVLAA

SEQ ID NO: 38579 - protein, 11 aa, Mycobacterium tuberculosis
LRHSGAVLAAS

SEQ ID NO: 38580 - protein, 11 aa, Mycobacterium tuberculosis
RHSGAVLAAST

SEQ ID NO: 38581 - protein, 11 aa, Mycobacterium tuberculosis
HSGAVLAASTG

SEQ ID NO: 38582 - protein, 11 aa, Mycobacterium tuberculosis
SGAVLAASTGA

SEQ ID NO: 38583 - protein, 11 aa, Mycobacterium tuberculosis
GAVLAASTGAT

SEQ ID NO: 38584 - protein, 11 aa, Mycobacterium tuberculosis
AVLAASTGATL

SEQ ID NO: 38585 - protein, 11 aa, Mycobacterium tuberculosis
VLAASTGATLA

SEQ ID NO: 38586 - protein, 11 aa, Mycobacterium tuberculosis
LAASTGATLAE

SEQ ID NO: 38587 - protein, 11 aa, Mycobacterium tuberculosis
AASTGATLAEL

SEQ ID NO: 38588 - protein, 11 aa, Mycobacterium tuberculosis
ASTGATLAELM

SEQ ID NO: 38589 - protein, 11 aa, Mycobacterium tuberculosis
STGATLAELMQ

SEQ ID NO: 38590 - protein, 11 aa, Mycobacterium tuberculosis
TGATLAELMQR

SEQ ID NO: 38591 - protein, 11 aa, Mycobacterium tuberculosis
GATLAELMQRL

SEQ ID NO: 38592 - protein, 11 aa, Mycobacterium tuberculosis
ATLAELMQRLG

SEQ ID NO: 38593 - protein, 11 aa, Mycobacterium tuberculosis
TLAELMQRLGH

SEQ ID NO: 38594 - protein, 11 aa, Mycobacterium tuberculosis
LAELMQRLGHS

SEQ ID NO: 38595 - protein, 11 aa, Mycobacterium tuberculosis
AELMQRLGHST

SEQ ID NO: 38596 - protein, 11 aa, Mycobacterium tuberculosis
ELMQRLGHSTA

SEQ ID NO: 38597 - protein, 11 aa, Mycobacterium tuberculosis
LMQRLGHSTAG

SEQ ID NO: 38598 - protein, 11 aa, Mycobacterium tuberculosis
MQRLGHSTAGA

SEQ ID NO: 38599 - protein, 11 aa, Mycobacterium tuberculosis
QRLGHSTAGAA

SEQ ID NO: 38600 - protein, 11 aa, Mycobacterium tuberculosis
RLGHSTAGAAL

SEQ ID NO: 38601 - protein, 11 aa, Mycobacterium tuberculosis
LGHSTAGAALR

SEQ ID NO: 38602 - protein, 11 aa, Mycobacterium tuberculosis
GHSTAGAALRY

SEQ ID NO: 38603 - protein, 11 aa, Mycobacterium tuberculosis
HSTAGAALRYQ

SEQ ID NO: 38604 - protein, 11 aa, Mycobacterium tuberculosis
STAGAALRYQH

SEQ ID NO: 38605 - protein, 11 aa, Mycobacterium tuberculosis
TAGAALRYQHA

SEQ ID NO: 38606 - protein, 11 aa, Mycobacterium tuberculosis
AGAALRYQHAA

SEQ ID NO: 38607 - protein, 11 aa, Mycobacterium tuberculosis
GAALRYQHAAK

SEQ ID NO: 38608 - protein, 11 aa, Mycobacterium tuberculosis
AALRYQHAAKG

SEQ ID NO: 38609 - protein, 11 aa, Mycobacterium tuberculosis
ALRYQHAAKGR

SEQ ID NO: 38610 - protein, 11 aa, Mycobacterium tuberculosis
LRYQHAAKGRD

SEQ ID NO: 38611 - protein, 11 aa, Mycobacterium tuberculosis
RYQHAAKGRDR

SEQ ID NO: 38612 - protein, 11 aa, Mycobacterium tuberculosis
YQHAAKGRDRE

SEQ ID NO: 38613 - protein, 11 aa, Mycobacterium tuberculosis
QHAAKGRDREI

SEQ ID NO: 38614 - protein, 11 aa, Mycobacterium tuberculosis
HAAKGRDREIA

SEQ ID NO: 38615 - protein, 11 aa, Mycobacterium tuberculosis
AAKGRDREIAA

SEQ ID NO: 38616 - protein, 11 aa, Mycobacterium tuberculosis
AKGRDREIAAL

SEQ ID NO: 38617 - protein, 11 aa, Mycobacterium tuberculosis
KGRDREIAALL

SEQ ID NO: 38618 - protein, 11 aa, Mycobacterium tuberculosis
GRDREIAALLS

SEQ ID NO: 38619 - protein, 11 aa, Mycobacterium tuberculosis
RDREIAALLSK

SEQ ID NO: 38620 - protein, 11 aa, Mycobacterium tuberculosis
DREIAALLSKL

SEQ ID NO: 38621 - protein, 11 aa, Mycobacterium tuberculosis
REIAALLSKLA

SEQ ID NO: 38622 - protein, 11 aa, Mycobacterium tuberculosis
EIAALLSKLAE

SEQ ID NO: 38623 - protein, 11 aa, Mycobacterium tuberculosis
IAALLSKLAEN

SEQ ID NO: 38624 - protein, 11 aa, Mycobacterium tuberculosis
AALLSKLAENQ

SEQ ID NO: 38625 - protein, 11 aa, Mycobacterium tuberculosis
ALLSKLAENQE

SEQ ID NO: 38626 - protein, 11 aa, Mycobacterium tuberculosis
LLSKLAENQEM

SEQ ID NO: 38627 - protein, 10 aa, Mycobacterium tuberculosis
LSKLAENQEM

SEQ ID NO: 38628 - protein, 9 aa, Mycobacterium tuberculosis
SKLAENQEM

SEQ ID NO: 38629 - protein, 8 aa, Mycobacterium tuberculosis
MIAGVDQA

SEQ ID NO: 38630 - protein, 8 aa, Mycobacterium tuberculosis
IAGVDQAL

SEQ ID NO: 38631 - protein, 8 aa, Mycobacterium tuberculosis
AGVDQALA

SEQ ID NO: 38632 - protein, 8 aa, Mycobacterium tuberculosis
GVDQALAA

SEQ ID NO: 38633 - protein, 8 aa, Mycobacterium tuberculosis
VDQALAAT

SEQ ID NO: 38634 - protein, 8 aa, Mycobacterium tuberculosis
DQALAATG

SEQ ID NO: 38635 - protein, 8 aa, Mycobacterium tuberculosis
QALAATGQ

SEQ ID NO: 38636 - protein, 8 aa, Mycobacterium tuberculosis
ALAATGQA

SEQ ID NO: 38637 - protein, 8 aa, Mycobacterium tuberculosis
LAATGQAS

SEQ ID NO: 38638 - protein, 8 aa, Mycobacterium tuberculosis
AATGQASQ

SEQ ID NO: 38639 - protein, 8 aa, Mycobacterium tuberculosis
ATGQASQR

SEQ ID NO: 38640 - protein, 8 aa, Mycobacterium tuberculosis
TGQASQRA

SEQ ID NO: 38641 - protein, 8 aa, Mycobacterium tuberculosis
GQASQRAA

SEQ ID NO: 38642 - protein, 8 aa, Mycobacterium tuberculosis
QASQRAAG

SEQ ID NO: 38643 - protein, 8 aa, Mycobacterium tuberculosis
ASQRAAGA

SEQ ID NO: 38644 - protein, 8 aa, Mycobacterium tuberculosis
SQRAAGAS

SEQ ID NO: 38645 - protein, 8 aa, Mycobacterium tuberculosis
QRAAGASG

SEQ ID NO: 38646 - protein, 8 aa, Mycobacterium tuberculosis
RAAGASGG

SEQ ID NO: 38647 - protein, 8 aa, Mycobacterium tuberculosis
AAGASGGV

SEQ ID NO: 38648 - protein, 8 aa, Mycobacterium tuberculosis
AGASGGVT

SEQ ID NO: 38649 - protein, 8 aa, Mycobacterium tuberculosis
GASGGVTV

SEQ ID NO: 38650 - protein, 8 aa, Mycobacterium tuberculosis
ASGGVTVG

SEQ ID NO: 38651 - protein, 8 aa, Mycobacterium tuberculosis
SGGVTVGV

SEQ ID NO: 38652 - protein, 8 aa, Mycobacterium tuberculosis
GGVTVGVG

SEQ ID NO: 38653 - protein, 8 aa, Mycobacterium tuberculosis
GVTVGVGV

SEQ ID NO: 38654 - protein, 8 aa, Mycobacterium tuberculosis
VTVGVGVG

SEQ ID NO: 38655 - protein, 8 aa, Mycobacterium tuberculosis
TVGVGVGT

SEQ ID NO: 38656 - protein, 8 aa, Mycobacterium tuberculosis
VGVGVGTE

SEQ ID NO: 38657 - protein, 8 aa, Mycobacterium tuberculosis
GVGVGTEQ

SEQ ID NO: 38658 - protein, 8 aa, Mycobacterium tuberculosis
VGVGTEQR

SEQ ID NO: 38659 - protein, 8 aa, Mycobacterium tuberculosis
GVGTEQRN

SEQ ID NO: 38660 - protein, 8 aa, Mycobacterium tuberculosis
VGTEQRNL

SEQ ID NO: 38661 - protein, 8 aa, Mycobacterium tuberculosis
GTEQRNLS

SEQ ID NO: 38662 - protein, 8 aa, Mycobacterium tuberculosis
TEQRNLSV

SEQ ID NO: 38663 - protein, 8 aa, Mycobacterium tuberculosis
EQRNLSVV

SEQ ID NO: 38664 - protein, 8 aa, Mycobacterium tuberculosis
QRNLSVVA

SEQ ID NO: 38665 - protein, 8 aa, Mycobacterium tuberculosis
RNLSVVAP

SEQ ID NO: 38666 - protein, 8 aa, Mycobacterium tuberculosis
NLSVVAPS

SEQ ID NO: 38667 - protein, 8 aa, Mycobacterium tuberculosis
LSVVAPSQ

SEQ ID NO: 38668 - protein, 8 aa, Mycobacterium tuberculosis
SVVAPSQF

SEQ ID NO: 38669 - protein, 8 aa, Mycobacterium tuberculosis
VVAPSQFT

SEQ ID NO: 38670 - protein, 8 aa, Mycobacterium tuberculosis
VAPSQFTF

SEQ ID NO: 38671 - protein, 8 aa, Mycobacterium tuberculosis
APSQFTFS

SEQ ID NO: 38672 - protein, 8 aa, Mycobacterium tuberculosis
PSQFTFSS

SEQ ID NO: 38673 - protein, 8 aa, Mycobacterium tuberculosis
SQFTFSSR

SEQ ID NO: 38674 - protein, 8 aa, Mycobacterium tuberculosis
QFTFSSRS

SEQ ID NO: 38675 - protein, 8 aa, Mycobacterium tuberculosis
FTFSSRSP

SEQ ID NO: 38676 - protein, 8 aa, Mycobacterium tuberculosis
TFSSRSPD

SEQ ID NO: 38677 - protein, 8 aa, Mycobacterium tuberculosis
FSSRSPDF

SEQ ID NO: 38678 - protein, 8 aa, Mycobacterium tuberculosis
SSRSPDFV

SEQ ID NO: 38679 - protein, 8 aa, Mycobacterium tuberculosis
SRSPDFVD

SEQ ID NO: 38680 - protein, 8 aa, Mycobacterium tuberculosis
RSPDFVDE

SEQ ID NO: 38681 - protein, 8 aa, Mycobacterium tuberculosis
SPDFVDET

SEQ ID NO: 38682 - protein, 8 aa, Mycobacterium tuberculosis
PDFVDETA

SEQ ID NO: 38683 - protein, 8 aa, Mycobacterium tuberculosis
DFVDETAG

SEQ ID NO: 38684 - protein, 8 aa, Mycobacterium tuberculosis
FVDETAGQ

SEQ ID NO: 38685 - protein, 8 aa, Mycobacterium tuberculosis
VDETAGQS

SEQ ID NO: 38686 - protein, 8 aa, Mycobacterium tuberculosis
DETAGQSW

SEQ ID NO: 38687 - protein, 8 aa, Mycobacterium tuberculosis
ETAGQSWC

SEQ ID NO: 38688 - protein, 8 aa, Mycobacterium tuberculosis
TAGQSWCA

SEQ ID NO: 38689 - protein, 8 aa, Mycobacterium tuberculosis
AGQSWCAI

SEQ ID NO: 38690 - protein, 8 aa, Mycobacterium tuberculosis
GQSWCAIL

SEQ ID NO: 38691 - protein, 8 aa, Mycobacterium tuberculosis
QSWCAILG

SEQ ID NO: 38692 - protein, 8 aa, Mycobacterium tuberculosis
SWCAILGL

SEQ ID NO: 38693 - protein, 8 aa, Mycobacterium tuberculosis
WCAILGLN

SEQ ID NO: 38694 - protein, 8 aa, Mycobacterium tuberculosis
CAILGLNQ

SEQ ID NO: 38695 - protein, 8 aa, Mycobacterium tuberculosis
AILGLNQF

SEQ ID NO: 38696 - protein, 8 aa, Mycobacterium tuberculosis
ILGLNQFH

SEQ ID NO: 38697 - protein, 9 aa, Mycobacterium tuberculosis
MIAGVDQAL

SEQ ID NO: 38698 - protein, 9 aa, Mycobacterium tuberculosis
IAGVDQALA

SEQ ID NO: 38699 - protein, 9 aa, Mycobacterium tuberculosis
AGVDQALAA

SEQ ID NO: 38700 - protein, 9 aa, Mycobacterium tuberculosis
GVDQALAAT

SEQ ID NO: 38701 - protein, 9 aa, Mycobacterium tuberculosis
VDQALAATG

SEQ ID NO: 38702 - protein, 9 aa, Mycobacterium tuberculosis
DQALAATGQ

SEQ ID NO: 38703 - protein, 9 aa, Mycobacterium tuberculosis
QALAATGQA

SEQ ID NO: 38704 - protein, 9 aa, Mycobacterium tuberculosis
ALAATGQAS

SEQ ID NO: 38705 - protein, 9 aa, Mycobacterium tuberculosis
LAATGQASQ

SEQ ID NO: 38706 - protein, 9 aa, Mycobacterium tuberculosis
AATGQASQR

SEQ ID NO: 38707 - protein, 9 aa, Mycobacterium tuberculosis
ATGQASQRA

SEQ ID NO: 38708 - protein, 9 aa, Mycobacterium tuberculosis
TGQASQRAA

SEQ ID NO: 38709 - protein, 9 aa, Mycobacterium tuberculosis
GQASQRAAG

SEQ ID NO: 38710 - protein, 9 aa, Mycobacterium tuberculosis
QASQRAAGA

SEQ ID NO: 38711 - protein, 9 aa, Mycobacterium tuberculosis
ASQRAAGAS

SEQ ID NO: 38712 - protein, 9 aa, Mycobacterium tuberculosis
SQRAAGASG

SEQ ID NO: 38713 - protein, 9 aa, Mycobacterium tuberculosis
QRAAGASGG

SEQ ID NO: 38714 - protein, 9 aa, Mycobacterium tuberculosis
RAAGASGGV

SEQ ID NO: 38715 - protein, 9 aa, Mycobacterium tuberculosis
AAGASGGVT

SEQ ID NO: 38716 - protein, 9 aa, Mycobacterium tuberculosis
AGASGGVTV

SEQ ID NO: 38717 - protein, 9 aa, Mycobacterium tuberculosis
GASGGVTVG

SEQ ID NO: 38718 - protein, 9 aa, Mycobacterium tuberculosis
ASGGVTVGV

SEQ ID NO: 38719 - protein, 9 aa, Mycobacterium tuberculosis
SGGVTVGVG

SEQ ID NO: 38720 - protein, 9 aa, Mycobacterium tuberculosis
GGVTVGVGV

SEQ ID NO: 38721 - protein, 9 aa, Mycobacterium tuberculosis
GVTVGVGVG

SEQ ID NO: 38722 - protein, 9 aa, Mycobacterium tuberculosis
VTVGVGVGT

SEQ ID NO: 38723 - protein, 9 aa, Mycobacterium tuberculosis
TVGVGVGTE

SEQ ID NO: 38724 - protein, 9 aa, Mycobacterium tuberculosis
VGVGVGTEQ

SEQ ID NO: 38725 - protein, 9 aa, Mycobacterium tuberculosis
GVGVGTEQR

SEQ ID NO: 38726 - protein, 9 aa, Mycobacterium tuberculosis
VGVGTEQRN

SEQ ID NO: 38727 - protein, 9 aa, Mycobacterium tuberculosis
GVGTEQRNL

SEQ ID NO: 38728 - protein, 9 aa, Mycobacterium tuberculosis
VGTEQRNLS

SEQ ID NO: 38729 - protein, 9 aa, Mycobacterium tuberculosis
GTEQRNLSV

SEQ ID NO: 38730 - protein, 9 aa, Mycobacterium tuberculosis
TEQRNLSVV

SEQ ID NO: 38731 - protein, 9 aa, Mycobacterium tuberculosis
EQRNLSVVA

SEQ ID NO: 38732 - protein, 9 aa, Mycobacterium tuberculosis
QRNLSVVAP

SEQ ID NO: 38733 - protein, 9 aa, Mycobacterium tuberculosis
RNLSVVAPS

SEQ ID NO: 38734 - protein, 9 aa, Mycobacterium tuberculosis
NLSVVAPSQ

SEQ ID NO: 38735 - protein, 9 aa, Mycobacterium tuberculosis
LSVVAPSQF

SEQ ID NO: 38736 - protein, 9 aa, Mycobacterium tuberculosis
SVVAPSQFT

SEQ ID NO: 38737 - protein, 9 aa, Mycobacterium tuberculosis
VVAPSQFTF

SEQ ID NO: 38738 - protein, 9 aa, Mycobacterium tuberculosis
VAPSQFTFS

SEQ ID NO: 38739 - protein, 9 aa, Mycobacterium tuberculosis
APSQFTFSS

SEQ ID NO: 38740 - protein, 9 aa, Mycobacterium tuberculosis
PSQFTFSSR

SEQ ID NO: 38741 - protein, 9 aa, Mycobacterium tuberculosis
SQFTFSSRS

SEQ ID NO: 38742 - protein, 9 aa, Mycobacterium tuberculosis
QFTFSSRSP

SEQ ID NO: 38743 - protein, 9 aa, Mycobacterium tuberculosis
FTFSSRSPD

SEQ ID NO: 38744 - protein, 9 aa, Mycobacterium tuberculosis
TFSSRSPDF

SEQ ID NO: 38745 - protein, 9 aa, Mycobacterium tuberculosis
FSSRSPDFV

SEQ ID NO: 38746 - protein, 9 aa, Mycobacterium tuberculosis
SSRSPDFVD

SEQ ID NO: 38747 - protein, 9 aa, Mycobacterium tuberculosis
SRSPDFVDE

SEQ ID NO: 38748 - protein, 9 aa, Mycobacterium tuberculosis
RSPDFVDET

SEQ ID NO: 38749 - protein, 9 aa, Mycobacterium tuberculosis
SPDFVDETA

SEQ ID NO: 38750 - protein, 9 aa, Mycobacterium tuberculosis
PDFVDETAG

SEQ ID NO: 38751 - protein, 9 aa, Mycobacterium tuberculosis
DFVDETAGQ

SEQ ID NO: 38752 - protein, 9 aa, Mycobacterium tuberculosis
FVDETAGQS

SEQ ID NO: 38753 - protein, 9 aa, Mycobacterium tuberculosis
VDETAGQSW

SEQ ID NO: 38754 - protein, 9 aa, Mycobacterium tuberculosis
DETAGQSWC

SEQ ID NO: 38755 - protein, 9 aa, Mycobacterium tuberculosis
ETAGQSWCA

SEQ ID NO: 38756 - protein, 9 aa, Mycobacterium tuberculosis
TAGQSWCAI

SEQ ID NO: 38757 - protein, 9 aa, Mycobacterium tuberculosis
AGQSWCAIL

SEQ ID NO: 38758 - protein, 9 aa, Mycobacterium tuberculosis
GQSWCAILG

SEQ ID NO: 38759 - protein, 9 aa, Mycobacterium tuberculosis
QSWCAILGL

SEQ ID NO: 38760 - protein, 9 aa, Mycobacterium tuberculosis
SWCAILGLN

SEQ ID NO: 38761 - protein, 9 aa, Mycobacterium tuberculosis
WCAILGLNQ

SEQ ID NO: 38762 - protein, 9 aa, Mycobacterium tuberculosis
CAILGLNQF

SEQ ID NO: 38763 - protein, 9 aa, Mycobacterium tuberculosis
AILGLNQFH

SEQ ID NO: 38764 - protein, 10 aa, Mycobacterium tuberculosis
MIAGVDQALA

SEQ ID NO: 38765 - protein, 10 aa, Mycobacterium tuberculosis
IAGVDQALAA

SEQ ID NO: 38766 - protein, 10 aa, Mycobacterium tuberculosis
AGVDQALAAT

SEQ ID NO: 38767 - protein, 10 aa, Mycobacterium tuberculosis
GVDQALAATG

SEQ ID NO: 38768 - protein, 10 aa, Mycobacterium tuberculosis
VDQALAATGQ

SEQ ID NO: 38769 - protein, 10 aa, Mycobacterium tuberculosis
DQALAATGQA

SEQ ID NO: 38770 - protein, 10 aa, Mycobacterium tuberculosis
QALAATGQAS

SEQ ID NO: 38771 - protein, 10 aa, Mycobacterium tuberculosis
ALAATGQASQ

SEQ ID NO: 38772 - protein, 10 aa, Mycobacterium tuberculosis
LAATGQASQR

SEQ ID NO: 38773 - protein, 10 aa, Mycobacterium tuberculosis
AATGQASQRA

SEQ ID NO: 38774 - protein, 10 aa, Mycobacterium tuberculosis
ATGQASQRAA

SEQ ID NO: 38775 - protein, 10 aa, Mycobacterium tuberculosis
TGQASQRAAG

SEQ ID NO: 38776 - protein, 10 aa, Mycobacterium tuberculosis
GQASQRAAGA

SEQ ID NO: 38777 - protein, 10 aa, Mycobacterium tuberculosis
QASQRAAGAS

SEQ ID NO: 38778 - protein, 10 aa, Mycobacterium tuberculosis
ASQRAAGASG

SEQ ID NO: 38779 - protein, 10 aa, Mycobacterium tuberculosis
SQRAAGASGG

SEQ ID NO: 38780 - protein, 10 aa, Mycobacterium tuberculosis
QRAAGASGGV

SEQ ID NO: 38781 - protein, 10 aa, Mycobacterium tuberculosis
RAAGASGGVT

SEQ ID NO: 38782 - protein, 10 aa, Mycobacterium tuberculosis
AAGASGGVTV

SEQ ID NO: 38783 - protein, 10 aa, Mycobacterium tuberculosis
AGASGGVTVG

SEQ ID NO: 38784 - protein, 10 aa, Mycobacterium tuberculosis
GASGGVTVGV

SEQ ID NO: 38785 - protein, 10 aa, Mycobacterium tuberculosis
ASGGVTVGVG

SEQ ID NO: 38786 - protein, 10 aa, Mycobacterium tuberculosis
SGGVTVGVGV

SEQ ID NO: 38787 - protein, 10 aa, Mycobacterium tuberculosis
GGVTVGVGVG

SEQ ID NO: 38788 - protein, 10 aa, Mycobacterium tuberculosis
GVTVGVGVGT

SEQ ID NO: 38789 - protein, 10 aa, Mycobacterium tuberculosis
VTVGVGVGTE

SEQ ID NO: 38790 - protein, 10 aa, Mycobacterium tuberculosis
TVGVGVGTEQ

SEQ ID NO: 38791 - protein, 10 aa, Mycobacterium tuberculosis
VGVGVGTEQR

SEQ ID NO: 38792 - protein, 10 aa, Mycobacterium tuberculosis
GVGVGTEQRN

SEQ ID NO: 38793 - protein, 10 aa, Mycobacterium tuberculosis
VGVGTEQRNL

SEQ ID NO: 38794 - protein, 10 aa, Mycobacterium tuberculosis
GVGTEQRNLS

SEQ ID NO: 38795 - protein, 10 aa, Mycobacterium tuberculosis
VGTEQRNLSV

SEQ ID NO: 38796 - protein, 10 aa, Mycobacterium tuberculosis
GTEQRNLSVV

SEQ ID NO: 38797 - protein, 10 aa, Mycobacterium tuberculosis
TEQRNLSVVA

SEQ ID NO: 38798 - protein, 10 aa, Mycobacterium tuberculosis
EQRNLSVVAP

SEQ ID NO: 38799 - protein, 10 aa, Mycobacterium tuberculosis
QRNLSVVAPS

SEQ ID NO: 38800 - protein, 10 aa, Mycobacterium tuberculosis
RNLSVVAPSQ

SEQ ID NO: 38801 - protein, 10 aa, Mycobacterium tuberculosis
NLSVVAPSQF

SEQ ID NO: 38802 - protein, 10 aa, Mycobacterium tuberculosis
LSVVAPSQFT

SEQ ID NO: 38803 - protein, 10 aa, Mycobacterium tuberculosis
SVVAPSQFTF

SEQ ID NO: 38804 - protein, 10 aa, Mycobacterium tuberculosis
VVAPSQFTFS

SEQ ID NO: 38805 - protein, 10 aa, Mycobacterium tuberculosis
VAPSQFTFSS

SEQ ID NO: 38806 - protein, 10 aa, Mycobacterium tuberculosis
APSQFTFSSR

SEQ ID NO: 38807 - protein, 10 aa, Mycobacterium tuberculosis
PSQFTFSSRS

SEQ ID NO: 38808 - protein, 10 aa, Mycobacterium tuberculosis
SQFTFSSRSP

SEQ ID NO: 38809 - protein, 10 aa, Mycobacterium tuberculosis
QFTFSSRSPD

SEQ ID NO: 38810 - protein, 10 aa, Mycobacterium tuberculosis
FTFSSRSPDF

SEQ ID NO: 38811 - protein, 10 aa, Mycobacterium tuberculosis
TFSSRSPDFV

SEQ ID NO: 38812 - protein, 10 aa, Mycobacterium tuberculosis
FSSRSPDFVD

SEQ ID NO: 38813 - protein, 10 aa, Mycobacterium tuberculosis
SSRSPDFVDE

SEQ ID NO: 38814 - protein, 10 aa, Mycobacterium tuberculosis
SRSPDFVDET

SEQ ID NO: 38815 - protein, 10 aa, Mycobacterium tuberculosis
RSPDFVDETA

SEQ ID NO: 38816 - protein, 10 aa, Mycobacterium tuberculosis
SPDFVDETAG

SEQ ID NO: 38817 - protein, 10 aa, Mycobacterium tuberculosis
PDFVDETAGQ

SEQ ID NO: 38818 - protein, 10 aa, Mycobacterium tuberculosis
DFVDETAGQS

SEQ ID NO: 38819 - protein, 10 aa, Mycobacterium tuberculosis
FVDETAGQSW

SEQ ID NO: 38820 - protein, 10 aa, Mycobacterium tuberculosis
VDETAGQSWC

SEQ ID NO: 38821 - protein, 10 aa, Mycobacterium tuberculosis
DETAGQSWCA

SEQ ID NO: 38822 - protein, 10 aa, Mycobacterium tuberculosis
ETAGQSWCAI

SEQ ID NO: 38823 - protein, 10 aa, Mycobacterium tuberculosis
TAGQSWCAIL

SEQ ID NO: 38824 - protein, 10 aa, Mycobacterium tuberculosis
AGQSWCAILG

SEQ ID NO: 38825 - protein, 10 aa, Mycobacterium tuberculosis
GQSWCAILGL

SEQ ID NO: 38826 - protein, 10 aa, Mycobacterium tuberculosis
QSWCAILGLN

SEQ ID NO: 38827 - protein, 10 aa, Mycobacterium tuberculosis
SWCAILGLNQ

SEQ ID NO: 38828 - protein, 10 aa, Mycobacterium tuberculosis
WCAILGLNQF

SEQ ID NO: 38829 - protein, 10 aa, Mycobacterium tuberculosis
CAILGLNQFH

SEQ ID NO: 38830 - protein, 11 aa, Mycobacterium tuberculosis
MIAGVDQALAA

SEQ ID NO: 38831 - protein, 11 aa, Mycobacterium tuberculosis
IAGVDQALAAT

SEQ ID NO: 38832 - protein, 11 aa, Mycobacterium tuberculosis
AGVDQALAATG

SEQ ID NO: 38833 - protein, 11 aa, Mycobacterium tuberculosis
GVDQALAATGQ

SEQ ID NO: 38834 - protein, 11 aa, Mycobacterium tuberculosis
VDQALAATGQA

SEQ ID NO: 38835 - protein, 11 aa, Mycobacterium tuberculosis
DQALAATGQAS

SEQ ID NO: 38836 - protein, 11 aa, Mycobacterium tuberculosis
QALAATGQASQ

SEQ ID NO: 38837 - protein, 11 aa, Mycobacterium tuberculosis
ALAATGQASQR

SEQ ID NO: 38838 - protein, 11 aa, Mycobacterium tuberculosis
LAATGQASQRA

SEQ ID NO: 38839 - protein, 11 aa, Mycobacterium tuberculosis
AATGQASQRAA

SEQ ID NO: 38840 - protein, 11 aa, Mycobacterium tuberculosis
ATGQASQRAAG

SEQ ID NO: 38841 - protein, 11 aa, Mycobacterium tuberculosis
TGQASQRAAGA

SEQ ID NO: 38842 - protein, 11 aa, Mycobacterium tuberculosis
GQASQRAAGAS

SEQ ID NO: 38843 - protein, 11 aa, Mycobacterium tuberculosis
QASQRAAGASG

SEQ ID NO: 38844 - protein, 11 aa, Mycobacterium tuberculosis
ASQRAAGASGG

SEQ ID NO: 38845 - protein, 11 aa, Mycobacterium tuberculosis
SQRAAGASGGV

SEQ ID NO: 38846 - protein, 11 aa, Mycobacterium tuberculosis
QRAAGASGGVT

SEQ ID NO: 38847 - protein, 11 aa, Mycobacterium tuberculosis
RAAGASGGVTV

SEQ ID NO: 38848 - protein, 11 aa, Mycobacterium tuberculosis
AAGASGGVTVG

SEQ ID NO: 38849 - protein, 11 aa, Mycobacterium tuberculosis
AGASGGVTVGV

SEQ ID NO: 38850 - protein, 11 aa, Mycobacterium tuberculosis
GASGGVTVGVG

SEQ ID NO: 38851 - protein, 11 aa, Mycobacterium tuberculosis
ASGGVTVGVGV

SEQ ID NO: 38852 - protein, 11 aa, Mycobacterium tuberculosis
SGGVTVGVGVG

SEQ ID NO: 38853 - protein, 11 aa, Mycobacterium tuberculosis
GGVTVGVGVGT

SEQ ID NO: 38854 - protein, 11 aa, Mycobacterium tuberculosis
GVTVGVGVGTE

SEQ ID NO: 38855 - protein, 11 aa, Mycobacterium tuberculosis
VTVGVGVGTEQ

SEQ ID NO: 38856 - protein, 11 aa, Mycobacterium tuberculosis
TVGVGVGTEQR

SEQ ID NO: 38857 - protein, 11 aa, Mycobacterium tuberculosis
VGVGVGTEQRN

SEQ ID NO: 38858 - protein, 11 aa, Mycobacterium tuberculosis
GVGVGTEQRNL

SEQ ID NO: 38859 - protein, 11 aa, Mycobacterium tuberculosis
VGVGTEQRNLS

SEQ ID NO: 38860 - protein, 11 aa, Mycobacterium tuberculosis
GVGTEQRNLSV

SEQ ID NO: 38861 - protein, 11 aa, Mycobacterium tuberculosis
VGTEQRNLSVV

SEQ ID NO: 38862 - protein, 11 aa, Mycobacterium tuberculosis
GTEQRNLSVVA

SEQ ID NO: 38863 - protein, 11 aa, Mycobacterium tuberculosis
TEQRNLSVVAP

SEQ ID NO: 38864 - protein, 11 aa, Mycobacterium tuberculosis
EQRNLSVVAPS

SEQ ID NO: 38865 - protein, 11 aa, Mycobacterium tuberculosis
QRNLSVVAPSQ

SEQ ID NO: 38866 - protein, 11 aa, Mycobacterium tuberculosis
RNLSVVAPSQF

SEQ ID NO: 38867 - protein, 11 aa, Mycobacterium tuberculosis
NLSVVAPSQFT

SEQ ID NO: 38868 - protein, 11 aa, Mycobacterium tuberculosis
LSVVAPSQFTF

SEQ ID NO: 38869 - protein, 11 aa, Mycobacterium tuberculosis
SVVAPSQFTFS

SEQ ID NO: 38870 - protein, 11 aa, Mycobacterium tuberculosis
VVAPSQFTFSS

SEQ ID NO: 38871 - protein, 11 aa, Mycobacterium tuberculosis
VAPSQFTFSSR

SEQ ID NO: 38872 - protein, 11 aa, Mycobacterium tuberculosis
APSQFTFSSRS

SEQ ID NO: 38873 - protein, 11 aa, Mycobacterium tuberculosis
PSQFTFSSRSP

SEQ ID NO: 38874 - protein, 11 aa, Mycobacterium tuberculosis
SQFTFSSRSPD

SEQ ID NO: 38875 - protein, 11 aa, Mycobacterium tuberculosis
QFTFSSRSPDF

SEQ ID NO: 38876 - protein, 11 aa, Mycobacterium tuberculosis
FTFSSRSPDFV

SEQ ID NO: 38877 - protein, 11 aa, Mycobacterium tuberculosis
TFSSRSPDFVD

SEQ ID NO: 38878 - protein, 11 aa, Mycobacterium tuberculosis
FSSRSPDFVDE

SEQ ID NO: 38879 - protein, 11 aa, Mycobacterium tuberculosis
SSRSPDFVDET

SEQ ID NO: 38880 - protein, 11 aa, Mycobacterium tuberculosis
SRSPDFVDETA

SEQ ID NO: 38881 - protein, 11 aa, Mycobacterium tuberculosis
RSPDFVDETAG

SEQ ID NO: 38882 - protein, 11 aa, Mycobacterium tuberculosis
SPDFVDETAGQ

SEQ ID NO: 38883 - protein, 11 aa, Mycobacterium tuberculosis
PDFVDETAGQS

SEQ ID NO: 38884 - protein, 11 aa, Mycobacterium tuberculosis
DFVDETAGQSW

SEQ ID NO: 38885 - protein, 11 aa, Mycobacterium tuberculosis
FVDETAGQSWC

SEQ ID NO: 38886 - protein, 11 aa, Mycobacterium tuberculosis
VDETAGQSWCA

SEQ ID NO: 38887 - protein, 11 aa, Mycobacterium tuberculosis
DETAGQSWCAI

SEQ ID NO: 38888 - protein, 11 aa, Mycobacterium tuberculosis
ETAGQSWCAIL

SEQ ID NO: 38889 - protein, 11 aa, Mycobacterium tuberculosis
TAGQSWCAILG

SEQ ID NO: 38890 - protein, 11 aa, Mycobacterium tuberculosis
AGQSWCAILGL

SEQ ID NO: 38891 - protein, 11 aa, Mycobacterium tuberculosis
GQSWCAILGLN

SEQ ID NO: 38892 - protein, 11 aa, Mycobacterium tuberculosis
QSWCAILGLNQ

SEQ ID NO: 38893 - protein, 11 aa, Mycobacterium tuberculosis
SWCAILGLNQF

SEQ ID NO: 38894 - protein, 11 aa, Mycobacterium tuberculosis
WCAILGLNQFH

SEQ ID NO: 38895 - protein, 8 aa, Mycobacterium tuberculosis
MRARSDAG

SEQ ID NO: 38896 - protein, 8 aa, Mycobacterium tuberculosis
RARSDAGG

SEQ ID NO: 38897 - protein, 8 aa, Mycobacterium tuberculosis
ARSDAGGQ

SEQ ID NO: 38898 - protein, 8 aa, Mycobacterium tuberculosis
RSDAGGQS

SEQ ID NO: 38899 - protein, 8 aa, Mycobacterium tuberculosis
SDAGGQSV

SEQ ID NO: 38900 - protein, 8 aa, Mycobacterium tuberculosis
DAGGQSVK

SEQ ID NO: 38901 - protein, 8 aa, Mycobacterium tuberculosis
AGGQSVKS

SEQ ID NO: 38902 - protein, 8 aa, Mycobacterium tuberculosis
GGQSVKSR

SEQ ID NO: 38903 - protein, 8 aa, Mycobacterium tuberculosis
GQSVKSRT

SEQ ID NO: 38904 - protein, 8 aa, Mycobacterium tuberculosis
QSVKSRTS

SEQ ID NO: 38905 - protein, 8 aa, Mycobacterium tuberculosis
SVKSRTSN

SEQ ID NO: 38906 - protein, 8 aa, Mycobacterium tuberculosis
VKSRTSNR

SEQ ID NO: 38907 - protein, 8 aa, Mycobacterium tuberculosis
KSRTSNRS

SEQ ID NO: 38908 - protein, 8 aa, Mycobacterium tuberculosis
SRTSNRSR

SEQ ID NO: 38909 - protein, 8 aa, Mycobacterium tuberculosis
RTSNRSRS

SEQ ID NO: 38910 - protein, 8 aa, Mycobacterium tuberculosis
TSNRSRSS

SEQ ID NO: 38911 - protein, 8 aa, Mycobacterium tuberculosis
SNRSRSSR

SEQ ID NO: 38912 - protein, 8 aa, Mycobacterium tuberculosis
NRSRSSRR

SEQ ID NO: 38913 - protein, 8 aa, Mycobacterium tuberculosis
RSRSSRRS

SEQ ID NO: 38914 - protein, 8 aa, Mycobacterium tuberculosis
SRSSRRSR

SEQ ID NO: 38915 - protein, 8 aa, Mycobacterium tuberculosis
RSSRRSRV

SEQ ID NO: 38916 - protein, 8 aa, Mycobacterium tuberculosis
SSRRSRVR

SEQ ID NO: 38917 - protein, 8 aa, Mycobacterium tuberculosis
SRRSRVRS

SEQ ID NO: 38918 - protein, 8 aa, Mycobacterium tuberculosis
RRSRVRSS

SEQ ID NO: 38919 - protein, 8 aa, Mycobacterium tuberculosis
RSRVRSSI

SEQ ID NO: 38920 - protein, 8 aa, Mycobacterium tuberculosis
SRVRSSIS

SEQ ID NO: 38921 - protein, 8 aa, Mycobacterium tuberculosis
RVRSSISA

SEQ ID NO: 38922 - protein, 8 aa, Mycobacterium tuberculosis
VRSSISAL

SEQ ID NO: 38923 - protein, 8 aa, Mycobacterium tuberculosis
RSSISALV

SEQ ID NO: 38924 - protein, 8 aa, Mycobacterium tuberculosis
SSISALVD

SEQ ID NO: 38925 - protein, 8 aa, Mycobacterium tuberculosis
SISALVDN

SEQ ID NO: 38926 - protein, 8 aa, Mycobacterium tuberculosis
ISALVDNP

SEQ ID NO: 38927 - protein, 8 aa, Mycobacterium tuberculosis
SALVDNPQ

SEQ ID NO: 38928 - protein, 8 aa, Mycobacterium tuberculosis
ALVDNPQA

SEQ ID NO: 38929 - protein, 8 aa, Mycobacterium tuberculosis
LVDNPQAR

SEQ ID NO: 38930 - protein, 8 aa, Mycobacterium tuberculosis
VDNPQARP

SEQ ID NO: 38931 - protein, 8 aa, Mycobacterium tuberculosis
DNPQARPR

SEQ ID NO: 38932 - protein, 8 aa, Mycobacterium tuberculosis
NPQARPRE

SEQ ID NO: 38933 - protein, 8 aa, Mycobacterium tuberculosis
PQARPREL

SEQ ID NO: 38934 - protein, 8 aa, Mycobacterium tuberculosis
QARPRELP

SEQ ID NO: 38935 - protein, 8 aa, Mycobacterium tuberculosis
ARPRELPV

SEQ ID NO: 38936 - protein, 8 aa, Mycobacterium tuberculosis
RPRELPVL

SEQ ID NO: 38937 - protein, 8 aa, Mycobacterium tuberculosis
PRELPVLC

SEQ ID NO: 38938 - protein, 8 aa, Mycobacterium tuberculosis
RELPVLCG

SEQ ID NO: 38939 - protein, 8 aa, Mycobacterium tuberculosis
ELPVLCGW

SEQ ID NO: 38940 - protein, 8 aa, Mycobacterium tuberculosis
LPVLCGWP

SEQ ID NO: 38941 - protein, 8 aa, Mycobacterium tuberculosis
PVLCGWPV

SEQ ID NO: 38942 - protein, 8 aa, Mycobacterium tuberculosis
VLCGWPVV

SEQ ID NO: 38943 - protein, 8 aa, Mycobacterium tuberculosis
LCGWPVVR

SEQ ID NO: 38944 - protein, 8 aa, Mycobacterium tuberculosis
CGWPVVRV

SEQ ID NO: 38945 - protein, 8 aa, Mycobacterium tuberculosis
GWPVVRVE

SEQ ID NO: 38946 - protein, 8 aa, Mycobacterium tuberculosis
WPVVRVEP

SEQ ID NO: 38947 - protein, 8 aa, Mycobacterium tuberculosis
PVVRVEPV

SEQ ID NO: 38948 - protein, 8 aa, Mycobacterium tuberculosis
VVRVEPVC

SEQ ID NO: 38949 - protein, 8 aa, Mycobacterium tuberculosis
VRVEPVCE

SEQ ID NO: 38950 - protein, 8 aa, Mycobacterium tuberculosis
RVEPVCEF

SEQ ID NO: 38951 - protein, 8 aa, Mycobacterium tuberculosis
VEPVCEFV

SEQ ID NO: 38952 - protein, 8 aa, Mycobacterium tuberculosis
EPVCEFVP

SEQ ID NO: 38953 - protein, 8 aa, Mycobacterium tuberculosis
PVCEFVPE

SEQ ID NO: 38954 - protein, 8 aa, Mycobacterium tuberculosis
VCEFVPEP

SEQ ID NO: 38955 - protein, 8 aa, Mycobacterium tuberculosis
CEFVPEPV

SEQ ID NO: 38956 - protein, 8 aa, Mycobacterium tuberculosis
EFVPEPVC

SEQ ID NO: 38957 - protein, 8 aa, Mycobacterium tuberculosis
FVPEPVCG

SEQ ID NO: 38958 - protein, 8 aa, Mycobacterium tuberculosis
VPEPVCGQ

SEQ ID NO: 38959 - protein, 8 aa, Mycobacterium tuberculosis
PEPVCGQA

SEQ ID NO: 38960 - protein, 8 aa, Mycobacterium tuberculosis
EPVCGQAE

SEQ ID NO: 38961 - protein, 8 aa, Mycobacterium tuberculosis
PVCGQAEV

SEQ ID NO: 38962 - protein, 8 aa, Mycobacterium tuberculosis
VCGQAEVL

SEQ ID NO: 38963 - protein, 8 aa, Mycobacterium tuberculosis
CGQAEVLG

SEQ ID NO: 38964 - protein, 8 aa, Mycobacterium tuberculosis
GQAEVLGE

SEQ ID NO: 38965 - protein, 8 aa, Mycobacterium tuberculosis
QAEVLGEP

SEQ ID NO: 38966 - protein, 8 aa, Mycobacterium tuberculosis
AEVLGEPA

SEQ ID NO: 38967 - protein, 8 aa, Mycobacterium tuberculosis
EVLGEPAA

SEQ ID NO: 38968 - protein, 8 aa, Mycobacterium tuberculosis
VLGEPAAA

SEQ ID NO: 38969 - protein, 8 aa, Mycobacterium tuberculosis
LGEPAAAH

SEQ ID NO: 38970 - protein, 8 aa, Mycobacterium tuberculosis
GEPAAAHR

SEQ ID NO: 38971 - protein, 8 aa, Mycobacterium tuberculosis
EPAAAHRV

SEQ ID NO: 38972 - protein, 8 aa, Mycobacterium tuberculosis
PAAAHRVT

SEQ ID NO: 38973 - protein, 8 aa, Mycobacterium tuberculosis
AAAHRVTS

SEQ ID NO: 38974 - protein, 8 aa, Mycobacterium tuberculosis
AAHRVTSA

SEQ ID NO: 38975 - protein, 8 aa, Mycobacterium tuberculosis
AHRVTSAR

SEQ ID NO: 38976 - protein, 8 aa, Mycobacterium tuberculosis
HRVTSARR

SEQ ID NO: 38977 - protein, 8 aa, Mycobacterium tuberculosis
RVTSARRS

SEQ ID NO: 38978 - protein, 8 aa, Mycobacterium tuberculosis
VTSARRSP

SEQ ID NO: 38979 - protein, 8 aa, Mycobacterium tuberculosis
TSARRSPS

SEQ ID NO: 38980 - protein, 8 aa, Mycobacterium tuberculosis
SARRSPST

SEQ ID NO: 38981 - protein, 8 aa, Mycobacterium tuberculosis
ARRSPSTT

SEQ ID NO: 38982 - protein, 8 aa, Mycobacterium tuberculosis
RRSPSTTV

SEQ ID NO: 38983 - protein, 8 aa, Mycobacterium tuberculosis
RSPSTTVC

SEQ ID NO: 38984 - protein, 8 aa, Mycobacterium tuberculosis
SPSTTVCS

SEQ ID NO: 38985 - protein, 8 aa, Mycobacterium tuberculosis
PSTTVCSR

SEQ ID NO: 38986 - protein, 8 aa, Mycobacterium tuberculosis
STTVCSRS

SEQ ID NO: 38987 - protein, 8 aa, Mycobacterium tuberculosis
TTVCSRSQ

SEQ ID NO: 38988 - protein, 8 aa, Mycobacterium tuberculosis
TVCSRSQK

SEQ ID NO: 38989 - protein, 8 aa, Mycobacterium tuberculosis
VCSRSQKA

SEQ ID NO: 38990 - protein, 8 aa, Mycobacterium tuberculosis
CSRSQKAS

SEQ ID NO: 38991 - protein, 8 aa, Mycobacterium tuberculosis
SRSQKASA

SEQ ID NO: 38992 - protein, 8 aa, Mycobacterium tuberculosis
RSQKASAV

SEQ ID NO: 38993 - protein, 8 aa, Mycobacterium tuberculosis
SQKASAVV

SEQ ID NO: 38994 - protein, 8 aa, Mycobacterium tuberculosis
QKASAVVI

SEQ ID NO: 38995 - protein, 8 aa, Mycobacterium tuberculosis
KASAVVIS

SEQ ID NO: 38996 - protein, 8 aa, Mycobacterium tuberculosis
ASAVVISS

SEQ ID NO: 38997 - protein, 8 aa, Mycobacterium tuberculosis
SAVVISSV

SEQ ID NO: 38998 - protein, 8 aa, Mycobacterium tuberculosis
AVVISSVS

SEQ ID NO: 38999 - protein, 8 aa, Mycobacterium tuberculosis
VVISSVSS

SEQ ID NO: 39000 - protein, 8 aa, Mycobacterium tuberculosis
VISSVSSV

SEQ ID NO: 39001 - protein, 8 aa, Mycobacterium tuberculosis
ISSVSSVA

SEQ ID NO: 39002 - protein, 8 aa, Mycobacterium tuberculosis
SSVSSVAR

SEQ ID NO: 39003 - protein, 8 aa, Mycobacterium tuberculosis
SVSSVARV

SEQ ID NO: 39004 - protein, 8 aa, Mycobacterium tuberculosis
VSSVARVR

SEQ ID NO: 39005 - protein, 8 aa, Mycobacterium tuberculosis
SSVARVRR

SEQ ID NO: 39006 - protein, 8 aa, Mycobacterium tuberculosis
SVARVRRA

SEQ ID NO: 39007 - protein, 8 aa, Mycobacterium tuberculosis
VARVRRAS

SEQ ID NO: 39008 - protein, 8 aa, Mycobacterium tuberculosis
ARVRRASV

SEQ ID NO: 39009 - protein, 8 aa, Mycobacterium tuberculosis
RVRRASVS

SEQ ID NO: 39010 - protein, 8 aa, Mycobacterium tuberculosis
VRRASVSS

SEQ ID NO: 39011 - protein, 8 aa, Mycobacterium tuberculosis
RRASVSSV

SEQ ID NO: 39012 - protein, 8 aa, Mycobacterium tuberculosis
RASVSSVD

SEQ ID NO: 39013 - protein, 8 aa, Mycobacterium tuberculosis
ASVSSVDA

SEQ ID NO: 39014 - protein, 8 aa, Mycobacterium tuberculosis
SVSSVDAT

SEQ ID NO: 39015 - protein, 8 aa, Mycobacterium tuberculosis
VSSVDATT

SEQ ID NO: 39016 - protein, 8 aa, Mycobacterium tuberculosis
SSVDATTA

SEQ ID NO: 39017 - protein, 9 aa, Mycobacterium tuberculosis
MRARSDAGG

SEQ ID NO: 39018 - protein, 9 aa, Mycobacterium tuberculosis
RARSDAGGQ

SEQ ID NO: 39019 - protein, 9 aa, Mycobacterium tuberculosis
ARSDAGGQS

SEQ ID NO: 39020 - protein, 9 aa, Mycobacterium tuberculosis
RSDAGGQSV

SEQ ID NO: 39021 - protein, 9 aa, Mycobacterium tuberculosis
SDAGGQSVK

SEQ ID NO: 39022 - protein, 9 aa, Mycobacterium tuberculosis
DAGGQSVKS

SEQ ID NO: 39023 - protein, 9 aa, Mycobacterium tuberculosis
AGGQSVKSR

SEQ ID NO: 39024 - protein, 9 aa, Mycobacterium tuberculosis
GGQSVKSRT

SEQ ID NO: 39025 - protein, 9 aa, Mycobacterium tuberculosis
GQSVKSRTS

SEQ ID NO: 39026 - protein, 9 aa, Mycobacterium tuberculosis
QSVKSRTSN

SEQ ID NO: 39027 - protein, 9 aa, Mycobacterium tuberculosis
SVKSRTSNR

SEQ ID NO: 39028 - protein, 9 aa, Mycobacterium tuberculosis
VKSRTSNRS

SEQ ID NO: 39029 - protein, 9 aa, Mycobacterium tuberculosis
KSRTSNRSR

SEQ ID NO: 39030 - protein, 9 aa, Mycobacterium tuberculosis
SRTSNRSRS

SEQ ID NO: 39031 - protein, 9 aa, Mycobacterium tuberculosis
RTSNRSRSS

SEQ ID NO: 39032 - protein, 9 aa, Mycobacterium tuberculosis
TSNRSRSSR

SEQ ID NO: 39033 - protein, 9 aa, Mycobacterium tuberculosis
SNRSRSSRR

SEQ ID NO: 39034 - protein, 9 aa, Mycobacterium tuberculosis
NRSRSSRRS

SEQ ID NO: 39035 - protein, 9 aa, Mycobacterium tuberculosis
RSRSSRRSR

SEQ ID NO: 39036 - protein, 9 aa, Mycobacterium tuberculosis
SRSSRRSRV

SEQ ID NO: 39037 - protein, 9 aa, Mycobacterium tuberculosis
RSSRRSRVR

SEQ ID NO: 39038 - protein, 9 aa, Mycobacterium tuberculosis
SSRRSRVRS

SEQ ID NO: 39039 - protein, 9 aa, Mycobacterium tuberculosis
SRRSRVRSS

SEQ ID NO: 39040 - protein, 9 aa, Mycobacterium tuberculosis
RRSRVRSSI

SEQ ID NO: 39041 - protein, 9 aa, Mycobacterium tuberculosis
RSRVRSSIS

SEQ ID NO: 39042 - protein, 9 aa, Mycobacterium tuberculosis
SRVRSSISA

SEQ ID NO: 39043 - protein, 9 aa, Mycobacterium tuberculosis
RVRSSISAL

SEQ ID NO: 39044 - protein, 9 aa, Mycobacterium tuberculosis
VRSSISALV

SEQ ID NO: 39045 - protein, 9 aa, Mycobacterium tuberculosis
RSSISALVD

SEQ ID NO: 39046 - protein, 9 aa, Mycobacterium tuberculosis
SSISALVDN

SEQ ID NO: 39047 - protein, 9 aa, Mycobacterium tuberculosis
SISALVDNP

SEQ ID NO: 39048 - protein, 9 aa, Mycobacterium tuberculosis
ISALVDNPQ

SEQ ID NO: 39049 - protein, 9 aa, Mycobacterium tuberculosis
SALVDNPQA

SEQ ID NO: 39050 - protein, 9 aa, Mycobacterium tuberculosis
ALVDNPQAR

SEQ ID NO: 39051 - protein, 9 aa, Mycobacterium tuberculosis
LVDNPQARP

SEQ ID NO: 39052 - protein, 9 aa, Mycobacterium tuberculosis
VDNPQARPR

SEQ ID NO: 39053 - protein, 9 aa, Mycobacterium tuberculosis
DNPQARPRE

SEQ ID NO: 39054 - protein, 9 aa, Mycobacterium tuberculosis
NPQARPREL

SEQ ID NO: 39055 - protein, 9 aa, Mycobacterium tuberculosis
PQARPRELP

SEQ ID NO: 39056 - protein, 9 aa, Mycobacterium tuberculosis
QARPRELPV

SEQ ID NO: 39057 - protein, 9 aa, Mycobacterium tuberculosis
ARPRELPVL

SEQ ID NO: 39058 - protein, 9 aa, Mycobacterium tuberculosis
RPRELPVLC

SEQ ID NO: 39059 - protein, 9 aa, Mycobacterium tuberculosis
PRELPVLCG

SEQ ID NO: 39060 - protein, 9 aa, Mycobacterium tuberculosis
RELPVLCGW

SEQ ID NO: 39061 - protein, 9 aa, Mycobacterium tuberculosis
ELPVLCGWP

SEQ ID NO: 39062 - protein, 9 aa, Mycobacterium tuberculosis
LPVLCGWPV

SEQ ID NO: 39063 - protein, 9 aa, Mycobacterium tuberculosis
PVLCGWPVV

SEQ ID NO: 39064 - protein, 9 aa, Mycobacterium tuberculosis
VLCGWPVVR

SEQ ID NO: 39065 - protein, 9 aa, Mycobacterium tuberculosis
LCGWPVVRV

SEQ ID NO: 39066 - protein, 9 aa, Mycobacterium tuberculosis
CGWPVVRVE

SEQ ID NO: 39067 - protein, 9 aa, Mycobacterium tuberculosis
GWPVVRVEP

SEQ ID NO: 39068 - protein, 9 aa, Mycobacterium tuberculosis
WPVVRVEPV

SEQ ID NO: 39069 - protein, 9 aa, Mycobacterium tuberculosis
PVVRVEPVC

SEQ ID NO: 39070 - protein, 9 aa, Mycobacterium tuberculosis
VVRVEPVCE

SEQ ID NO: 39071 - protein, 9 aa, Mycobacterium tuberculosis
VRVEPVCEF

SEQ ID NO: 39072 - protein, 9 aa, Mycobacterium tuberculosis
RVEPVCEFV

SEQ ID NO: 39073 - protein, 9 aa, Mycobacterium tuberculosis
VEPVCEFVP

SEQ ID NO: 39074 - protein, 9 aa, Mycobacterium tuberculosis
EPVCEFVPE

SEQ ID NO: 39075 - protein, 9 aa, Mycobacterium tuberculosis
PVCEFVPEP

SEQ ID NO: 39076 - protein, 9 aa, Mycobacterium tuberculosis
VCEFVPEPV

SEQ ID NO: 39077 - protein, 9 aa, Mycobacterium tuberculosis
CEFVPEPVC

SEQ ID NO: 39078 - protein, 9 aa, Mycobacterium tuberculosis
EFVPEPVCG

SEQ ID NO: 39079 - protein, 9 aa, Mycobacterium tuberculosis
FVPEPVCGQ

SEQ ID NO: 39080 - protein, 9 aa, Mycobacterium tuberculosis
VPEPVCGQA

SEQ ID NO: 39081 - protein, 9 aa, Mycobacterium tuberculosis
PEPVCGQAE

SEQ ID NO: 39082 - protein, 9 aa, Mycobacterium tuberculosis
EPVCGQAEV

SEQ ID NO: 39083 - protein, 9 aa, Mycobacterium tuberculosis
PVCGQAEVL

SEQ ID NO: 39084 - protein, 9 aa, Mycobacterium tuberculosis
VCGQAEVLG

SEQ ID NO: 39085 - protein, 9 aa, Mycobacterium tuberculosis
CGQAEVLGE

SEQ ID NO: 39086 - protein, 9 aa, Mycobacterium tuberculosis
GQAEVLGEP

SEQ ID NO: 39087 - protein, 9 aa, Mycobacterium tuberculosis
QAEVLGEPA

SEQ ID NO: 39088 - protein, 9 aa, Mycobacterium tuberculosis
AEVLGEPAA

SEQ ID NO: 39089 - protein, 9 aa, Mycobacterium tuberculosis
EVLGEPAAA

SEQ ID NO: 39090 - protein, 9 aa, Mycobacterium tuberculosis
VLGEPAAAH

SEQ ID NO: 39091 - protein, 9 aa, Mycobacterium tuberculosis
LGEPAAAHR

SEQ ID NO: 39092 - protein, 9 aa, Mycobacterium tuberculosis
GEPAAAHRV

SEQ ID NO: 39093 - protein, 9 aa, Mycobacterium tuberculosis
EPAAAHRVT

SEQ ID NO: 39094 - protein, 9 aa, Mycobacterium tuberculosis
PAAAHRVTS

SEQ ID NO: 39095 - protein, 9 aa, Mycobacterium tuberculosis
AAAHRVTSA

SEQ ID NO: 39096 - protein, 9 aa, Mycobacterium tuberculosis
AAHRVTSAR

SEQ ID NO: 39097 - protein, 9 aa, Mycobacterium tuberculosis
AHRVTSARR

SEQ ID NO: 39098 - protein, 9 aa, Mycobacterium tuberculosis
HRVTSARRS

SEQ ID NO: 39099 - protein, 9 aa, Mycobacterium tuberculosis
RVTSARRSP

SEQ ID NO: 39100 - protein, 9 aa, Mycobacterium tuberculosis
VTSARRSPS

SEQ ID NO: 39101 - protein, 9 aa, Mycobacterium tuberculosis
TSARRSPST

SEQ ID NO: 39102 - protein, 9 aa, Mycobacterium tuberculosis
SARRSPSTT

SEQ ID NO: 39103 - protein, 9 aa, Mycobacterium tuberculosis
ARRSPSTTV

SEQ ID NO: 39104 - protein, 9 aa, Mycobacterium tuberculosis
RRSPSTTVC

SEQ ID NO: 39105 - protein, 9 aa, Mycobacterium tuberculosis
RSPSTTVCS

SEQ ID NO: 39106 - protein, 9 aa, Mycobacterium tuberculosis
SPSTTVCSR

SEQ ID NO: 39107 - protein, 9 aa, Mycobacterium tuberculosis
PSTTVCSRS

SEQ ID NO: 39108 - protein, 9 aa, Mycobacterium tuberculosis
STTVCSRSQ

SEQ ID NO: 39109 - protein, 9 aa, Mycobacterium tuberculosis
TTVCSRSQK

SEQ ID NO: 39110 - protein, 9 aa, Mycobacterium tuberculosis
TVCSRSQKA

SEQ ID NO: 39111 - protein, 9 aa, Mycobacterium tuberculosis
VCSRSQKAS

SEQ ID NO: 39112 - protein, 9 aa, Mycobacterium tuberculosis
CSRSQKASA

SEQ ID NO: 39113 - protein, 9 aa, Mycobacterium tuberculosis
SRSQKASAV

SEQ ID NO: 39114 - protein, 9 aa, Mycobacterium tuberculosis
RSQKASAVV

SEQ ID NO: 39115 - protein, 9 aa, Mycobacterium tuberculosis
SQKASAVVI

SEQ ID NO: 39116 - protein, 9 aa, Mycobacterium tuberculosis
QKASAVVIS

SEQ ID NO: 39117 - protein, 9 aa, Mycobacterium tuberculosis
KASAVVISS

SEQ ID NO: 39118 - protein, 9 aa, Mycobacterium tuberculosis
ASAVVISSV

SEQ ID NO: 39119 - protein, 9 aa, Mycobacterium tuberculosis
SAVVISSVS

SEQ ID NO: 39120 - protein, 9 aa, Mycobacterium tuberculosis
AVVISSVSS

SEQ ID NO: 39121 - protein, 9 aa, Mycobacterium tuberculosis
VVISSVSSV

SEQ ID NO: 39122 - protein, 9 aa, Mycobacterium tuberculosis
VISSVSSVA

SEQ ID NO: 39123 - protein, 9 aa, Mycobacterium tuberculosis
ISSVSSVAR

SEQ ID NO: 39124 - protein, 9 aa, Mycobacterium tuberculosis
SSVSSVARV

SEQ ID NO: 39125 - protein, 9 aa, Mycobacterium tuberculosis
SVSSVARVR

SEQ ID NO: 39126 - protein, 9 aa, Mycobacterium tuberculosis
VSSVARVRR

SEQ ID NO: 39127 - protein, 9 aa, Mycobacterium tuberculosis
SSVARVRRA

SEQ ID NO: 39128 - protein, 9 aa, Mycobacterium tuberculosis
SVARVRRAS

SEQ ID NO: 39129 - protein, 9 aa, Mycobacterium tuberculosis
VARVRRASV

SEQ ID NO: 39130 - protein, 9 aa, Mycobacterium tuberculosis
ARVRRASVS

SEQ ID NO: 39131 - protein, 9 aa, Mycobacterium tuberculosis
RVRRASVSS

SEQ ID NO: 39132 - protein, 9 aa, Mycobacterium tuberculosis
VRRASVSSV

SEQ ID NO: 39133 - protein, 9 aa, Mycobacterium tuberculosis
RRASVSSVD

SEQ ID NO: 39134 - protein, 9 aa, Mycobacterium tuberculosis
RASVSSVDA

SEQ ID NO: 39135 - protein, 9 aa, Mycobacterium tuberculosis
ASVSSVDAT

SEQ ID NO: 39136 - protein, 9 aa, Mycobacterium tuberculosis
SVSSVDATT

SEQ ID NO: 39137 - protein, 9 aa, Mycobacterium tuberculosis
VSSVDATTA

SEQ ID NO: 39138 - protein, 10 aa, Mycobacterium tuberculosis
MRARSDAGGQ

SEQ ID NO: 39139 - protein, 10 aa, Mycobacterium tuberculosis
RARSDAGGQS

SEQ ID NO: 39140 - protein, 10 aa, Mycobacterium tuberculosis
ARSDAGGQSV

SEQ ID NO: 39141 - protein, 10 aa, Mycobacterium tuberculosis
RSDAGGQSVK

SEQ ID NO: 39142 - protein, 10 aa, Mycobacterium tuberculosis
SDAGGQSVKS

SEQ ID NO: 39143 - protein, 10 aa, Mycobacterium tuberculosis
DAGGQSVKSR

SEQ ID NO: 39144 - protein, 10 aa, Mycobacterium tuberculosis
AGGQSVKSRT

SEQ ID NO: 39145 - protein, 10 aa, Mycobacterium tuberculosis
GGQSVKSRTS

SEQ ID NO: 39146 - protein, 10 aa, Mycobacterium tuberculosis
GQSVKSRTSN

SEQ ID NO: 39147 - protein, 10 aa, Mycobacterium tuberculosis
QSVKSRTSNR

SEQ ID NO: 39148 - protein, 10 aa, Mycobacterium tuberculosis
SVKSRTSNRS

SEQ ID NO: 39149 - protein, 10 aa, Mycobacterium tuberculosis
VKSRTSNRSR

SEQ ID NO: 39150 - protein, 10 aa, Mycobacterium tuberculosis
KSRTSNRSRS

SEQ ID NO: 39151 - protein, 10 aa, Mycobacterium tuberculosis
SRTSNRSRSS

SEQ ID NO: 39152 - protein, 10 aa, Mycobacterium tuberculosis
RTSNRSRSSR

SEQ ID NO: 39153 - protein, 10 aa, Mycobacterium tuberculosis
TSNRSRSSRR

SEQ ID NO: 39154 - protein, 10 aa, Mycobacterium tuberculosis
SNRSRSSRRS

SEQ ID NO: 39155 - protein, 10 aa, Mycobacterium tuberculosis
NRSRSSRRSR

SEQ ID NO: 39156 - protein, 10 aa, Mycobacterium tuberculosis
RSRSSRRSRV

SEQ ID NO: 39157 - protein, 10 aa, Mycobacterium tuberculosis
SRSSRRSRVR

SEQ ID NO: 39158 - protein, 10 aa, Mycobacterium tuberculosis
RSSRRSRVRS

SEQ ID NO: 39159 - protein, 10 aa, Mycobacterium tuberculosis
SSRRSRVRSS

SEQ ID NO: 39160 - protein, 10 aa, Mycobacterium tuberculosis
SRRSRVRSSI

SEQ ID NO: 39161 - protein, 10 aa, Mycobacterium tuberculosis
RRSRVRSSIS

SEQ ID NO: 39162 - protein, 10 aa, Mycobacterium tuberculosis
RSRVRSSISA

SEQ ID NO: 39163 - protein, 10 aa, Mycobacterium tuberculosis
SRVRSSISAL

SEQ ID NO: 39164 - protein, 10 aa, Mycobacterium tuberculosis
RVRSSISALV

SEQ ID NO: 39165 - protein, 10 aa, Mycobacterium tuberculosis
VRSSISALVD

SEQ ID NO: 39166 - protein, 10 aa, Mycobacterium tuberculosis
RSSISALVDN

SEQ ID NO: 39167 - protein, 10 aa, Mycobacterium tuberculosis
SSISALVDNP

SEQ ID NO: 39168 - protein, 10 aa, Mycobacterium tuberculosis
SISALVDNPQ

SEQ ID NO: 39169 - protein, 10 aa, Mycobacterium tuberculosis
ISALVDNPQA

SEQ ID NO: 39170 - protein, 10 aa, Mycobacterium tuberculosis
SALVDNPQAR

SEQ ID NO: 39171 - protein, 10 aa, Mycobacterium tuberculosis
ALVDNPQARP

SEQ ID NO: 39172 - protein, 10 aa, Mycobacterium tuberculosis
LVDNPQARPR

SEQ ID NO: 39173 - protein, 10 aa, Mycobacterium tuberculosis
VDNPQARPRE

SEQ ID NO: 39174 - protein, 10 aa, Mycobacterium tuberculosis
DNPQARPREL

SEQ ID NO: 39175 - protein, 10 aa, Mycobacterium tuberculosis
NPQARPRELP

SEQ ID NO: 39176 - protein, 10 aa, Mycobacterium tuberculosis
PQARPRELPV

SEQ ID NO: 39177 - protein, 10 aa, Mycobacterium tuberculosis
QARPRELPVL

SEQ ID NO: 39178 - protein, 10 aa, Mycobacterium tuberculosis
ARPRELPVLC

SEQ ID NO: 39179 - protein, 10 aa, Mycobacterium tuberculosis
RPRELPVLCG

SEQ ID NO: 39180 - protein, 10 aa, Mycobacterium tuberculosis
PRELPVLCGW

SEQ ID NO: 39181 - protein, 10 aa, Mycobacterium tuberculosis
RELPVLCGWP

SEQ ID NO: 39182 - protein, 10 aa, Mycobacterium tuberculosis
ELPVLCGWPV

SEQ ID NO: 39183 - protein, 10 aa, Mycobacterium tuberculosis
LPVLCGWPVV

SEQ ID NO: 39184 - protein, 10 aa, Mycobacterium tuberculosis
PVLCGWPVVR

SEQ ID NO: 39185 - protein, 10 aa, Mycobacterium tuberculosis
VLCGWPVVRV

SEQ ID NO: 39186 - protein, 10 aa, Mycobacterium tuberculosis
LCGWPVVRVE

SEQ ID NO: 39187 - protein, 10 aa, Mycobacterium tuberculosis
CGWPVVRVEP

SEQ ID NO: 39188 - protein, 10 aa, Mycobacterium tuberculosis
GWPVVRVEPV

SEQ ID NO: 39189 - protein, 10 aa, Mycobacterium tuberculosis
WPVVRVEPVC

SEQ ID NO: 39190 - protein, 10 aa, Mycobacterium tuberculosis
PVVRVEPVCE

SEQ ID NO: 39191 - protein, 10 aa, Mycobacterium tuberculosis
VVRVEPVCEF

SEQ ID NO: 39192 - protein, 10 aa, Mycobacterium tuberculosis
VRVEPVCEFV

SEQ ID NO: 39193 - protein, 10 aa, Mycobacterium tuberculosis
RVEPVCEFVP

SEQ ID NO: 39194 - protein, 10 aa, Mycobacterium tuberculosis
VEPVCEFVPE

SEQ ID NO: 39195 - protein, 10 aa, Mycobacterium tuberculosis
EPVCEFVPEP

SEQ ID NO: 39196 - protein, 10 aa, Mycobacterium tuberculosis
PVCEFVPEPV

SEQ ID NO: 39197 - protein, 10 aa, Mycobacterium tuberculosis
VCEFVPEPVC

SEQ ID NO: 39198 - protein, 10 aa, Mycobacterium tuberculosis
CEFVPEPVCG

SEQ ID NO: 39199 - protein, 10 aa, Mycobacterium tuberculosis
EFVPEPVCGQ

SEQ ID NO: 39200 - protein, 10 aa, Mycobacterium tuberculosis
FVPEPVCGQA

SEQ ID NO: 39201 - protein, 10 aa, Mycobacterium tuberculosis
VPEPVCGQAE

SEQ ID NO: 39202 - protein, 10 aa, Mycobacterium tuberculosis
PEPVCGQAEV

SEQ ID NO: 39203 - protein, 10 aa, Mycobacterium tuberculosis
EPVCGQAEVL

SEQ ID NO: 39204 - protein, 10 aa, Mycobacterium tuberculosis
PVCGQAEVLG

SEQ ID NO: 39205 - protein, 10 aa, Mycobacterium tuberculosis
VCGQAEVLGE

SEQ ID NO: 39206 - protein, 10 aa, Mycobacterium tuberculosis
CGQAEVLGEP

SEQ ID NO: 39207 - protein, 10 aa, Mycobacterium tuberculosis
GQAEVLGEPA

SEQ ID NO: 39208 - protein, 10 aa, Mycobacterium tuberculosis
QAEVLGEPAA

SEQ ID NO: 39209 - protein, 10 aa, Mycobacterium tuberculosis
AEVLGEPAAA

SEQ ID NO: 39210 - protein, 10 aa, Mycobacterium tuberculosis
EVLGEPAAAH

SEQ ID NO: 39211 - protein, 10 aa, Mycobacterium tuberculosis
VLGEPAAAHR

SEQ ID NO: 39212 - protein, 10 aa, Mycobacterium tuberculosis
LGEPAAAHRV

SEQ ID NO: 39213 - protein, 10 aa, Mycobacterium tuberculosis
GEPAAAHRVT

SEQ ID NO: 39214 - protein, 10 aa, Mycobacterium tuberculosis
EPAAAHRVTS

SEQ ID NO: 39215 - protein, 10 aa, Mycobacterium tuberculosis
PAAAHRVTSA

SEQ ID NO: 39216 - protein, 10 aa, Mycobacterium tuberculosis
AAAHRVTSAR

SEQ ID NO: 39217 - protein, 10 aa, Mycobacterium tuberculosis
AAHRVTSARR

SEQ ID NO: 39218 - protein, 10 aa, Mycobacterium tuberculosis
AHRVTSARRS

SEQ ID NO: 39219 - protein, 10 aa, Mycobacterium tuberculosis
HRVTSARRSP

SEQ ID NO: 39220 - protein, 10 aa, Mycobacterium tuberculosis
RVTSARRSPS

SEQ ID NO: 39221 - protein, 10 aa, Mycobacterium tuberculosis
VTSARRSPST

SEQ ID NO: 39222 - protein, 10 aa, Mycobacterium tuberculosis
TSARRSPSTT

SEQ ID NO: 39223 - protein, 10 aa, Mycobacterium tuberculosis
SARRSPSTTV

SEQ ID NO: 39224 - protein, 10 aa, Mycobacterium tuberculosis
ARRSPSTTVC

SEQ ID NO: 39225 - protein, 10 aa, Mycobacterium tuberculosis
RRSPSTTVCS

SEQ ID NO: 39226 - protein, 10 aa, Mycobacterium tuberculosis
RSPSTTVCSR

SEQ ID NO: 39227 - protein, 10 aa, Mycobacterium tuberculosis
SPSTTVCSRS

SEQ ID NO: 39228 - protein, 10 aa, Mycobacterium tuberculosis
PSTTVCSRSQ

SEQ ID NO: 39229 - protein, 10 aa, Mycobacterium tuberculosis
STTVCSRSQK

SEQ ID NO: 39230 - protein, 10 aa, Mycobacterium tuberculosis
TTVCSRSQKA

SEQ ID NO: 39231 - protein, 10 aa, Mycobacterium tuberculosis
TVCSRSQKAS

SEQ ID NO: 39232 - protein, 10 aa, Mycobacterium tuberculosis
VCSRSQKASA

SEQ ID NO: 39233 - protein, 10 aa, Mycobacterium tuberculosis
CSRSQKASAV

SEQ ID NO: 39234 - protein, 10 aa, Mycobacterium tuberculosis
SRSQKASAVV

SEQ ID NO: 39235 - protein, 10 aa, Mycobacterium tuberculosis
RSQKASAVVI

SEQ ID NO: 39236 - protein, 10 aa, Mycobacterium tuberculosis
SQKASAVVIS

SEQ ID NO: 39237 - protein, 10 aa, Mycobacterium tuberculosis
QKASAVVISS

SEQ ID NO: 39238 - protein, 10 aa, Mycobacterium tuberculosis
KASAVVISSV

SEQ ID NO: 39239 - protein, 10 aa, Mycobacterium tuberculosis
ASAVVISSVS

SEQ ID NO: 39240 - protein, 10 aa, Mycobacterium tuberculosis
SAVVISSVSS

SEQ ID NO: 39241 - protein, 10 aa, Mycobacterium tuberculosis
AVVISSVSSV

SEQ ID NO: 39242 - protein, 10 aa, Mycobacterium tuberculosis
VVISSVSSVA

SEQ ID NO: 39243 - protein, 10 aa, Mycobacterium tuberculosis
VISSVSSVAR

SEQ ID NO: 39244 - protein, 10 aa, Mycobacterium tuberculosis
ISSVSSVARV

SEQ ID NO: 39245 - protein, 10 aa, Mycobacterium tuberculosis
SSVSSVARVR

SEQ ID NO: 39246 - protein, 10 aa, Mycobacterium tuberculosis
SVSSVARVRR

SEQ ID NO: 39247 - protein, 10 aa, Mycobacterium tuberculosis
VSSVARVRRA

SEQ ID NO: 39248 - protein, 10 aa, Mycobacterium tuberculosis
SSVARVRRAS

SEQ ID NO: 39249 - protein, 10 aa, Mycobacterium tuberculosis
SVARVRRASV

SEQ ID NO: 39250 - protein, 10 aa, Mycobacterium tuberculosis
VARVRRASVS

SEQ ID NO: 39251 - protein, 10 aa, Mycobacterium tuberculosis
ARVRRASVSS

SEQ ID NO: 39252 - protein, 10 aa, Mycobacterium tuberculosis
RVRRASVSSV

SEQ ID NO: 39253 - protein, 10 aa, Mycobacterium tuberculosis
VRRASVSSVD

SEQ ID NO: 39254 - protein, 10 aa, Mycobacterium tuberculosis
RRASVSSVDA

SEQ ID NO: 39255 - protein, 10 aa, Mycobacterium tuberculosis
RASVSSVDAT

SEQ ID NO: 39256 - protein, 10 aa, Mycobacterium tuberculosis
ASVSSVDATT

SEQ ID NO: 39257 - protein, 10 aa, Mycobacterium tuberculosis
SVSSVDATTA

SEQ ID NO: 39258 - protein, 11 aa, Mycobacterium tuberculosis
MRARSDAGGQS

SEQ ID NO: 39259 - protein, 11 aa, Mycobacterium tuberculosis
RARSDAGGQSV

SEQ ID NO: 39260 - protein, 11 aa, Mycobacterium tuberculosis
ARSDAGGQSVK

SEQ ID NO: 39261 - protein, 11 aa, Mycobacterium tuberculosis
RSDAGGQSVKS

SEQ ID NO: 39262 - protein, 11 aa, Mycobacterium tuberculosis
SDAGGQSVKSR

SEQ ID NO: 39263 - protein, 11 aa, Mycobacterium tuberculosis
DAGGQSVKSRT

SEQ ID NO: 39264 - protein, 11 aa, Mycobacterium tuberculosis
AGGQSVKSRTS

SEQ ID NO: 39265 - protein, 11 aa, Mycobacterium tuberculosis
GGQSVKSRTSN

SEQ ID NO: 39266 - protein, 11 aa, Mycobacterium tuberculosis
GQSVKSRTSNR

SEQ ID NO: 39267 - protein, 11 aa, Mycobacterium tuberculosis
QSVKSRTSNRS

SEQ ID NO: 39268 - protein, 11 aa, Mycobacterium tuberculosis
SVKSRTSNRSR

SEQ ID NO: 39269 - protein, 11 aa, Mycobacterium tuberculosis
VKSRTSNRSRS

SEQ ID NO: 39270 - protein, 11 aa, Mycobacterium tuberculosis
KSRTSNRSRSS

SEQ ID NO: 39271 - protein, 11 aa, Mycobacterium tuberculosis
SRTSNRSRSSR

SEQ ID NO: 39272 - protein, 11 aa, Mycobacterium tuberculosis
RTSNRSRSSRR

SEQ ID NO: 39273 - protein, 11 aa, Mycobacterium tuberculosis
TSNRSRSSRRS

SEQ ID NO: 39274 - protein, 11 aa, Mycobacterium tuberculosis
SNRSRSSRRSR

SEQ ID NO: 39275 - protein, 11 aa, Mycobacterium tuberculosis
NRSRSSRRSRV

SEQ ID NO: 39276 - protein, 11 aa, Mycobacterium tuberculosis
RSRSSRRSRVR

SEQ ID NO: 39277 - protein, 11 aa, Mycobacterium tuberculosis
SRSSRRSRVRS

SEQ ID NO: 39278 - protein, 11 aa, Mycobacterium tuberculosis
RSSRRSRVRSS

SEQ ID NO: 39279 - protein, 11 aa, Mycobacterium tuberculosis
SSRRSRVRSSI

SEQ ID NO: 39280 - protein, 11 aa, Mycobacterium tuberculosis
SRRSRVRSSIS

SEQ ID NO: 39281 - protein, 11 aa, Mycobacterium tuberculosis
RRSRVRSSISA

SEQ ID NO: 39282 - protein, 11 aa, Mycobacterium tuberculosis
RSRVRSSISAL

SEQ ID NO: 39283 - protein, 11 aa, Mycobacterium tuberculosis
SRVRSSISALV

SEQ ID NO: 39284 - protein, 11 aa, Mycobacterium tuberculosis
RVRSSISALVD

SEQ ID NO: 39285 - protein, 11 aa, Mycobacterium tuberculosis
VRSSISALVDN

SEQ ID NO: 39286 - protein, 11 aa, Mycobacterium tuberculosis
RSSISALVDNP

SEQ ID NO: 39287 - protein, 11 aa, Mycobacterium tuberculosis
SSISALVDNPQ

SEQ ID NO: 39288 - protein, 11 aa, Mycobacterium tuberculosis
SISALVDNPQA

SEQ ID NO: 39289 - protein, 11 aa, Mycobacterium tuberculosis
ISALVDNPQAR

SEQ ID NO: 39290 - protein, 11 aa, Mycobacterium tuberculosis
SALVDNPQARP

SEQ ID NO: 39291 - protein, 11 aa, Mycobacterium tuberculosis
ALVDNPQARPR

SEQ ID NO: 39292 - protein, 11 aa, Mycobacterium tuberculosis
LVDNPQARPRE

SEQ ID NO: 39293 - protein, 11 aa, Mycobacterium tuberculosis
VDNPQARPREL

SEQ ID NO: 39294 - protein, 11 aa, Mycobacterium tuberculosis
DNPQARPRELP

SEQ ID NO: 39295 - protein, 11 aa, Mycobacterium tuberculosis
NPQARPRELPV

SEQ ID NO: 39296 - protein, 11 aa, Mycobacterium tuberculosis
PQARPRELPVL

SEQ ID NO: 39297 - protein, 11 aa, Mycobacterium tuberculosis
QARPRELPVLC

SEQ ID NO: 39298 - protein, 11 aa, Mycobacterium tuberculosis
ARPRELPVLCG

SEQ ID NO: 39299 - protein, 11 aa, Mycobacterium tuberculosis
RPRELPVLCGW

SEQ ID NO: 39300 - protein, 11 aa, Mycobacterium tuberculosis
PRELPVLCGWP

SEQ ID NO: 39301 - protein, 11 aa, Mycobacterium tuberculosis
RELPVLCGWPV

SEQ ID NO: 39302 - protein, 11 aa, Mycobacterium tuberculosis
ELPVLCGWPVV

SEQ ID NO: 39303 - protein, 11 aa, Mycobacterium tuberculosis
LPVLCGWPVVR

SEQ ID NO: 39304 - protein, 11 aa, Mycobacterium tuberculosis
PVLCGWPVVRV

SEQ ID NO: 39305 - protein, 11 aa, Mycobacterium tuberculosis
VLCGWPVVRVE

SEQ ID NO: 39306 - protein, 11 aa, Mycobacterium tuberculosis
LCGWPVVRVEP

SEQ ID NO: 39307 - protein, 11 aa, Mycobacterium tuberculosis
CGWPVVRVEPV

SEQ ID NO: 39308 - protein, 11 aa, Mycobacterium tuberculosis
GWPVVRVEPVC

SEQ ID NO: 39309 - protein, 11 aa, Mycobacterium tuberculosis
WPVVRVEPVCE

SEQ ID NO: 39310 - protein, 11 aa, Mycobacterium tuberculosis
PVVRVEPVCEF

SEQ ID NO: 39311 - protein, 11 aa, Mycobacterium tuberculosis
VVRVEPVCEFV

SEQ ID NO: 39312 - protein, 11 aa, Mycobacterium tuberculosis
VRVEPVCEFVP

SEQ ID NO: 39313 - protein, 11 aa, Mycobacterium tuberculosis
RVEPVCEFVPE

SEQ ID NO: 39314 - protein, 11 aa, Mycobacterium tuberculosis
VEPVCEFVPEP

SEQ ID NO: 39315 - protein, 11 aa, Mycobacterium tuberculosis
EPVCEFVPEPV

SEQ ID NO: 39316 - protein, 11 aa, Mycobacterium tuberculosis
PVCEFVPEPVC

SEQ ID NO: 39317 - protein, 11 aa, Mycobacterium tuberculosis
VCEFVPEPVCG

SEQ ID NO: 39318 - protein, 11 aa, Mycobacterium tuberculosis
CEFVPEPVCGQ

SEQ ID NO: 39319 - protein, 11 aa, Mycobacterium tuberculosis
EFVPEPVCGQA

SEQ ID NO: 39320 - protein, 11 aa, Mycobacterium tuberculosis
FVPEPVCGQAE

SEQ ID NO: 39321 - protein, 11 aa, Mycobacterium tuberculosis
VPEPVCGQAEV

SEQ ID NO: 39322 - protein, 11 aa, Mycobacterium tuberculosis
PEPVCGQAEVL

SEQ ID NO: 39323 - protein, 11 aa, Mycobacterium tuberculosis
EPVCGQAEVLG

SEQ ID NO: 39324 - protein, 11 aa, Mycobacterium tuberculosis
PVCGQAEVLGE

SEQ ID NO: 39325 - protein, 11 aa, Mycobacterium tuberculosis
VCGQAEVLGEP

SEQ ID NO: 39326 - protein, 11 aa, Mycobacterium tuberculosis
CGQAEVLGEPA

SEQ ID NO: 39327 - protein, 11 aa, Mycobacterium tuberculosis
GQAEVLGEPAA

SEQ ID NO: 39328 - protein, 11 aa, Mycobacterium tuberculosis
QAEVLGEPAAA

SEQ ID NO: 39329 - protein, 11 aa, Mycobacterium tuberculosis
AEVLGEPAAAH

SEQ ID NO: 39330 - protein, 11 aa, Mycobacterium tuberculosis
EVLGEPAAAHR

SEQ ID NO: 39331 - protein, 11 aa, Mycobacterium tuberculosis
VLGEPAAAHRV

SEQ ID NO: 39332 - protein, 11 aa, Mycobacterium tuberculosis
LGEPAAAHRVT

SEQ ID NO: 39333 - protein, 11 aa, Mycobacterium tuberculosis
GEPAAAHRVTS

SEQ ID NO: 39334 - protein, 11 aa, Mycobacterium tuberculosis
EPAAAHRVTSA

SEQ ID NO: 39335 - protein, 11 aa, Mycobacterium tuberculosis
PAAAHRVTSAR

SEQ ID NO: 39336 - protein, 11 aa, Mycobacterium tuberculosis
AAAHRVTSARR

SEQ ID NO: 39337 - protein, 11 aa, Mycobacterium tuberculosis
AAHRVTSARRS

SEQ ID NO: 39338 - protein, 11 aa, Mycobacterium tuberculosis
AHRVTSARRSP

SEQ ID NO: 39339 - protein, 11 aa, Mycobacterium tuberculosis
HRVTSARRSPS

SEQ ID NO: 39340 - protein, 11 aa, Mycobacterium tuberculosis
RVTSARRSPST

SEQ ID NO: 39341 - protein, 11 aa, Mycobacterium tuberculosis
VTSARRSPSTT

SEQ ID NO: 39342 - protein, 11 aa, Mycobacterium tuberculosis
TSARRSPSTTV

SEQ ID NO: 39343 - protein, 11 aa, Mycobacterium tuberculosis
SARRSPSTTVC

SEQ ID NO: 39344 - protein, 11 aa, Mycobacterium tuberculosis
ARRSPSTTVCS

SEQ ID NO: 39345 - protein, 11 aa, Mycobacterium tuberculosis
RRSPSTTVCSR

SEQ ID NO: 39346 - protein, 11 aa, Mycobacterium tuberculosis
RSPSTTVCSRS

SEQ ID NO: 39347 - protein, 11 aa, Mycobacterium tuberculosis
SPSTTVCSRSQ

SEQ ID NO: 39348 - protein, 11 aa, Mycobacterium tuberculosis
PSTTVCSRSQK

SEQ ID NO: 39349 - protein, 11 aa, Mycobacterium tuberculosis
STTVCSRSQKA

SEQ ID NO: 39350 - protein, 11 aa, Mycobacterium tuberculosis
TTVCSRSQKAS

SEQ ID NO: 39351 - protein, 11 aa, Mycobacterium tuberculosis
TVCSRSQKASA

SEQ ID NO: 39352 - protein, 11 aa, Mycobacterium tuberculosis
VCSRSQKASAV

SEQ ID NO: 39353 - protein, 11 aa, Mycobacterium tuberculosis
CSRSQKASAVV

SEQ ID NO: 39354 - protein, 11 aa, Mycobacterium tuberculosis
SRSQKASAVVI

SEQ ID NO: 39355 - protein, 11 aa, Mycobacterium tuberculosis
RSQKASAVVIS

SEQ ID NO: 39356 - protein, 11 aa, Mycobacterium tuberculosis
SQKASAVVISS

SEQ ID NO: 39357 - protein, 11 aa, Mycobacterium tuberculosis
QKASAVVISSV

SEQ ID NO: 39358 - protein, 11 aa, Mycobacterium tuberculosis
KASAVVISSVS

SEQ ID NO: 39359 - protein, 11 aa, Mycobacterium tuberculosis
ASAVVISSVSS

SEQ ID NO: 39360 - protein, 11 aa, Mycobacterium tuberculosis
SAVVISSVSSV

SEQ ID NO: 39361 - protein, 11 aa, Mycobacterium tuberculosis
AVVISSVSSVA

SEQ ID NO: 39362 - protein, 11 aa, Mycobacterium tuberculosis
VVISSVSSVAR

SEQ ID NO: 39363 - protein, 11 aa, Mycobacterium tuberculosis
VISSVSSVARV

SEQ ID NO: 39364 - protein, 11 aa, Mycobacterium tuberculosis
ISSVSSVARVR

SEQ ID NO: 39365 - protein, 11 aa, Mycobacterium tuberculosis
SSVSSVARVRR

SEQ ID NO: 39366 - protein, 11 aa, Mycobacterium tuberculosis
SVSSVARVRRA

SEQ ID NO: 39367 - protein, 11 aa, Mycobacterium tuberculosis
VSSVARVRRAS

SEQ ID NO: 39368 - protein, 11 aa, Mycobacterium tuberculosis
SSVARVRRASV

SEQ ID NO: 39369 - protein, 11 aa, Mycobacterium tuberculosis
SVARVRRASVS

SEQ ID NO: 39370 - protein, 11 aa, Mycobacterium tuberculosis
VARVRRASVSS

SEQ ID NO: 39371 - protein, 11 aa, Mycobacterium tuberculosis
ARVRRASVSSV

SEQ ID NO: 39372 - protein, 11 aa, Mycobacterium tuberculosis
RVRRASVSSVD

SEQ ID NO: 39373 - protein, 11 aa, Mycobacterium tuberculosis
VRRASVSSVDA

SEQ ID NO: 39374 - protein, 11 aa, Mycobacterium tuberculosis
RRASVSSVDAT

SEQ ID NO: 39375 - protein, 11 aa, Mycobacterium tuberculosis
RASVSSVDATT

SEQ ID NO: 39376 - protein, 11 aa, Mycobacterium tuberculosis
ASVSSVDATTA

SEQ ID NO: 39377 - protein, 8 aa, Mycobacterium tuberculosis
MDDLTRLR

SEQ ID NO: 39378 - protein, 8 aa, Mycobacterium tuberculosis
DDLTRLRR

SEQ ID NO: 39379 - protein, 8 aa, Mycobacterium tuberculosis
DLTRLRRE

SEQ ID NO: 39380 - protein, 8 aa, Mycobacterium tuberculosis
LTRLRREL

SEQ ID NO: 39381 - protein, 8 aa, Mycobacterium tuberculosis
TRLRRELL

SEQ ID NO: 39382 - protein, 8 aa, Mycobacterium tuberculosis
RLRRELLD

SEQ ID NO: 39383 - protein, 8 aa, Mycobacterium tuberculosis
LRRELLDR

SEQ ID NO: 39384 - protein, 8 aa, Mycobacterium tuberculosis
RRELLDRF

SEQ ID NO: 39385 - protein, 8 aa, Mycobacterium tuberculosis
RELLDRFD

SEQ ID NO: 39386 - protein, 8 aa, Mycobacterium tuberculosis
ELLDRFDV

SEQ ID NO: 39387 - protein, 8 aa, Mycobacterium tuberculosis
LLDRFDVR

SEQ ID NO: 39388 - protein, 8 aa, Mycobacterium tuberculosis
LDRFDVRD

SEQ ID NO: 39389 - protein, 8 aa, Mycobacterium tuberculosis
DRFDVRDF

SEQ ID NO: 39390 - protein, 8 aa, Mycobacterium tuberculosis
RFDVRDFT

SEQ ID NO: 39391 - protein, 8 aa, Mycobacterium tuberculosis
FDVRDFTD

SEQ ID NO: 39392 - protein, 8 aa, Mycobacterium tuberculosis
DVRDFTDW

SEQ ID NO: 39393 - protein, 8 aa, Mycobacterium tuberculosis
VRDFTDWP

SEQ ID NO: 39394 - protein, 8 aa, Mycobacterium tuberculosis
RDFTDWPP

SEQ ID NO: 39395 - protein, 8 aa, Mycobacterium tuberculosis
DFTDWPPA

SEQ ID NO: 39396 - protein, 8 aa, Mycobacterium tuberculosis
FTDWPPAS

SEQ ID NO: 39397 - protein, 8 aa, Mycobacterium tuberculosis
TDWPPASL

SEQ ID NO: 39398 - protein, 8 aa, Mycobacterium tuberculosis
DWPPASLR

SEQ ID NO: 39399 - protein, 8 aa, Mycobacterium tuberculosis
WPPASLRA

SEQ ID NO: 39400 - protein, 8 aa, Mycobacterium tuberculosis
PPASLRAL

SEQ ID NO: 39401 - protein, 8 aa, Mycobacterium tuberculosis
PASLRALI

SEQ ID NO: 39402 - protein, 8 aa, Mycobacterium tuberculosis
ASLRALIA

SEQ ID NO: 39403 - protein, 8 aa, Mycobacterium tuberculosis
SLRALIAT

SEQ ID NO: 39404 - protein, 8 aa, Mycobacterium tuberculosis
LRALIATY

SEQ ID NO: 39405 - protein, 8 aa, Mycobacterium tuberculosis
RALIATYD

SEQ ID NO: 39406 - protein, 8 aa, Mycobacterium tuberculosis
ALIATYDP

SEQ ID NO: 39407 - protein, 8 aa, Mycobacterium tuberculosis
LIATYDPW

SEQ ID NO: 39408 - protein, 8 aa, Mycobacterium tuberculosis
IATYDPWI

SEQ ID NO: 39409 - protein, 8 aa, Mycobacterium tuberculosis
ATYDPWID

SEQ ID NO: 39410 - protein, 8 aa, Mycobacterium tuberculosis
TYDPWIDM

SEQ ID NO: 39411 - protein, 8 aa, Mycobacterium tuberculosis
YDPWIDMT

SEQ ID NO: 39412 - protein, 8 aa, Mycobacterium tuberculosis
DPWIDMTA

SEQ ID NO: 39413 - protein, 8 aa, Mycobacterium tuberculosis
PWIDMTAS

SEQ ID NO: 39414 - protein, 8 aa, Mycobacterium tuberculosis
WIDMTASP

SEQ ID NO: 39415 - protein, 8 aa, Mycobacterium tuberculosis
IDMTASPP

SEQ ID NO: 39416 - protein, 8 aa, Mycobacterium tuberculosis
DMTASPPQ

SEQ ID NO: 39417 - protein, 8 aa, Mycobacterium tuberculosis
MTASPPQP

SEQ ID NO: 39418 - protein, 8 aa, Mycobacterium tuberculosis
TASPPQPV

SEQ ID NO: 39419 - protein, 8 aa, Mycobacterium tuberculosis
ASPPQPVS

SEQ ID NO: 39420 - protein, 8 aa, Mycobacterium tuberculosis
SPPQPVSP

SEQ ID NO: 39421 - protein, 8 aa, Mycobacterium tuberculosis
PPQPVSPG

SEQ ID NO: 39422 - protein, 8 aa, Mycobacterium tuberculosis
PQPVSPGG

SEQ ID NO: 39423 - protein, 8 aa, Mycobacterium tuberculosis
QPVSPGGP

SEQ ID NO: 39424 - protein, 8 aa, Mycobacterium tuberculosis
PVSPGGPR

SEQ ID NO: 39425 - protein, 8 aa, Mycobacterium tuberculosis
VSPGGPRL

SEQ ID NO: 39426 - protein, 8 aa, Mycobacterium tuberculosis
SPGGPRLR

SEQ ID NO: 39427 - protein, 8 aa, Mycobacterium tuberculosis
PGGPRLRL

SEQ ID NO: 39428 - protein, 8 aa, Mycobacterium tuberculosis
GGPRLRLV

SEQ ID NO: 39429 - protein, 8 aa, Mycobacterium tuberculosis
GPRLRLVR

SEQ ID NO: 39430 - protein, 8 aa, Mycobacterium tuberculosis
PRLRLVRL

SEQ ID NO: 39431 - protein, 8 aa, Mycobacterium tuberculosis
RLRLVRLT

SEQ ID NO: 39432 - protein, 8 aa, Mycobacterium tuberculosis
LRLVRLTT

SEQ ID NO: 39433 - protein, 8 aa, Mycobacterium tuberculosis
RLVRLTTN

SEQ ID NO: 39434 - protein, 8 aa, Mycobacterium tuberculosis
LVRLTTNP

SEQ ID NO: 39435 - protein, 8 aa, Mycobacterium tuberculosis
VRLTTNPS

SEQ ID NO: 39436 - protein, 8 aa, Mycobacterium tuberculosis
RLTTNPSA

SEQ ID NO: 39437 - protein, 8 aa, Mycobacterium tuberculosis
LTTNPSAR

SEQ ID NO: 39438 - protein, 8 aa, Mycobacterium tuberculosis
TTNPSARA

SEQ ID NO: 39439 - protein, 8 aa, Mycobacterium tuberculosis
TNPSARAA

SEQ ID NO: 39440 - protein, 8 aa, Mycobacterium tuberculosis
NPSARAAP

SEQ ID NO: 39441 - protein, 8 aa, Mycobacterium tuberculosis
PSARAAPI

SEQ ID NO: 39442 - protein, 8 aa, Mycobacterium tuberculosis
SARAAPIG

SEQ ID NO: 39443 - protein, 8 aa, Mycobacterium tuberculosis
ARAAPIGN

SEQ ID NO: 39444 - protein, 8 aa, Mycobacterium tuberculosis
RAAPIGNG

SEQ ID NO: 39445 - protein, 8 aa, Mycobacterium tuberculosis
AAPIGNGG

SEQ ID NO: 39446 - protein, 8 aa, Mycobacterium tuberculosis
APIGNGGD

SEQ ID NO: 39447 - protein, 8 aa, Mycobacterium tuberculosis
PIGNGGDS

SEQ ID NO: 39448 - protein, 8 aa, Mycobacterium tuberculosis
IGNGGDSS

SEQ ID NO: 39449 - protein, 8 aa, Mycobacterium tuberculosis
GNGGDSSV

SEQ ID NO: 39450 - protein, 8 aa, Mycobacterium tuberculosis
NGGDSSVC

SEQ ID NO: 39451 - protein, 8 aa, Mycobacterium tuberculosis
GGDSSVCA

SEQ ID NO: 39452 - protein, 8 aa, Mycobacterium tuberculosis
GDSSVCAG

SEQ ID NO: 39453 - protein, 8 aa, Mycobacterium tuberculosis
DSSVCAGE

SEQ ID NO: 39454 - protein, 8 aa, Mycobacterium tuberculosis
SSVCAGEK

SEQ ID NO: 39455 - protein, 8 aa, Mycobacterium tuberculosis
SVCAGEKQ

SEQ ID NO: 39456 - protein, 8 aa, Mycobacterium tuberculosis
VCAGEKQC

SEQ ID NO: 39457 - protein, 8 aa, Mycobacterium tuberculosis
CAGEKQCR

SEQ ID NO: 39458 - protein, 8 aa, Mycobacterium tuberculosis
AGEKQCRP

SEQ ID NO: 39459 - protein, 8 aa, Mycobacterium tuberculosis
GEKQCRPP

SEQ ID NO: 39460 - protein, 9 aa, Mycobacterium tuberculosis
MDDLTRLRR

SEQ ID NO: 39461 - protein, 9 aa, Mycobacterium tuberculosis
DDLTRLRRE

SEQ ID NO: 39462 - protein, 9 aa, Mycobacterium tuberculosis
DLTRLRREL

SEQ ID NO: 39463 - protein, 9 aa, Mycobacterium tuberculosis
LTRLRRELL

SEQ ID NO: 39464 - protein, 9 aa, Mycobacterium tuberculosis
TRLRRELLD

SEQ ID NO: 39465 - protein, 9 aa, Mycobacterium tuberculosis
RLRRELLDR

SEQ ID NO: 39466 - protein, 9 aa, Mycobacterium tuberculosis
LRRELLDRF

SEQ ID NO: 39467 - protein, 9 aa, Mycobacterium tuberculosis
RRELLDRFD

SEQ ID NO: 39468 - protein, 9 aa, Mycobacterium tuberculosis
RELLDRFDV

SEQ ID NO: 39469 - protein, 9 aa, Mycobacterium tuberculosis
ELLDRFDVR

SEQ ID NO: 39470 - protein, 9 aa, Mycobacterium tuberculosis
LLDRFDVRD

SEQ ID NO: 39471 - protein, 9 aa, Mycobacterium tuberculosis
LDRFDVRDF

SEQ ID NO: 39472 - protein, 9 aa, Mycobacterium tuberculosis
DRFDVRDFT

SEQ ID NO: 39473 - protein, 9 aa, Mycobacterium tuberculosis
RFDVRDFTD

SEQ ID NO: 39474 - protein, 9 aa, Mycobacterium tuberculosis
FDVRDFTDW

SEQ ID NO: 39475 - protein, 9 aa, Mycobacterium tuberculosis
DVRDFTDWP

SEQ ID NO: 39476 - protein, 9 aa, Mycobacterium tuberculosis
VRDFTDWPP

SEQ ID NO: 39477 - protein, 9 aa, Mycobacterium tuberculosis
RDFTDWPPA

SEQ ID NO: 39478 - protein, 9 aa, Mycobacterium tuberculosis
DFTDWPPAS

SEQ ID NO: 39479 - protein, 9 aa, Mycobacterium tuberculosis
FTDWPPASL

SEQ ID NO: 39480 - protein, 9 aa, Mycobacterium tuberculosis
TDWPPASLR

SEQ ID NO: 39481 - protein, 9 aa, Mycobacterium tuberculosis
DWPPASLRA

SEQ ID NO: 39482 - protein, 9 aa, Mycobacterium tuberculosis
WPPASLRAL

SEQ ID NO: 39483 - protein, 9 aa, Mycobacterium tuberculosis
PPASLRALI

SEQ ID NO: 39484 - protein, 9 aa, Mycobacterium tuberculosis
PASLRALIA

SEQ ID NO: 39485 - protein, 9 aa, Mycobacterium tuberculosis
ASLRALIAT

SEQ ID NO: 39486 - protein, 9 aa, Mycobacterium tuberculosis
SLRALIATY

SEQ ID NO: 39487 - protein, 9 aa, Mycobacterium tuberculosis
LRALIATYD

SEQ ID NO: 39488 - protein, 9 aa, Mycobacterium tuberculosis
RALIATYDP

SEQ ID NO: 39489 - protein, 9 aa, Mycobacterium tuberculosis
ALIATYDPW

SEQ ID NO: 39490 - protein, 9 aa, Mycobacterium tuberculosis
LIATYDPWI

SEQ ID NO: 39491 - protein, 9 aa, Mycobacterium tuberculosis
IATYDPWID

SEQ ID NO: 39492 - protein, 9 aa, Mycobacterium tuberculosis
ATYDPWIDM

SEQ ID NO: 39493 - protein, 9 aa, Mycobacterium tuberculosis
TYDPWIDMT

SEQ ID NO: 39494 - protein, 9 aa, Mycobacterium tuberculosis
YDPWIDMTA

SEQ ID NO: 39495 - protein, 9 aa, Mycobacterium tuberculosis
DPWIDMTAS

SEQ ID NO: 39496 - protein, 9 aa, Mycobacterium tuberculosis
PWIDMTASP

SEQ ID NO: 39497 - protein, 9 aa, Mycobacterium tuberculosis
WIDMTASPP

SEQ ID NO: 39498 - protein, 9 aa, Mycobacterium tuberculosis
IDMTASPPQ

SEQ ID NO: 39499 - protein, 9 aa, Mycobacterium tuberculosis
DMTASPPQP

SEQ ID NO: 39500 - protein, 9 aa, Mycobacterium tuberculosis
MTASPPQPV

SEQ ID NO: 39501 - protein, 9 aa, Mycobacterium tuberculosis
TASPPQPVS

SEQ ID NO: 39502 - protein, 9 aa, Mycobacterium tuberculosis
ASPPQPVSP

SEQ ID NO: 39503 - protein, 9 aa, Mycobacterium tuberculosis
SPPQPVSPG

SEQ ID NO: 39504 - protein, 9 aa, Mycobacterium tuberculosis
PPQPVSPGG

SEQ ID NO: 39505 - protein, 9 aa, Mycobacterium tuberculosis
PQPVSPGGP

SEQ ID NO: 39506 - protein, 9 aa, Mycobacterium tuberculosis
QPVSPGGPR

SEQ ID NO: 39507 - protein, 9 aa, Mycobacterium tuberculosis
PVSPGGPRL

SEQ ID NO: 39508 - protein, 9 aa, Mycobacterium tuberculosis
VSPGGPRLR

SEQ ID NO: 39509 - protein, 9 aa, Mycobacterium tuberculosis
SPGGPRLRL

SEQ ID NO: 39510 - protein, 9 aa, Mycobacterium tuberculosis
PGGPRLRLV

SEQ ID NO: 39511 - protein, 9 aa, Mycobacterium tuberculosis
GGPRLRLVR

SEQ ID NO: 39512 - protein, 9 aa, Mycobacterium tuberculosis
GPRLRLVRL

SEQ ID NO: 39513 - protein, 9 aa, Mycobacterium tuberculosis
PRLRLVRLT

SEQ ID NO: 39514 - protein, 9 aa, Mycobacterium tuberculosis
RLRLVRLTT

SEQ ID NO: 39515 - protein, 9 aa, Mycobacterium tuberculosis
LRLVRLTTN

SEQ ID NO: 39516 - protein, 9 aa, Mycobacterium tuberculosis
RLVRLTTNP

SEQ ID NO: 39517 - protein, 9 aa, Mycobacterium tuberculosis
LVRLTTNPS

SEQ ID NO: 39518 - protein, 9 aa, Mycobacterium tuberculosis
VRLTTNPSA

SEQ ID NO: 39519 - protein, 9 aa, Mycobacterium tuberculosis
RLTTNPSAR

SEQ ID NO: 39520 - protein, 9 aa, Mycobacterium tuberculosis
LTTNPSARA

SEQ ID NO: 39521 - protein, 9 aa, Mycobacterium tuberculosis
TTNPSARAA

SEQ ID NO: 39522 - protein, 9 aa, Mycobacterium tuberculosis
TNPSARAAP

SEQ ID NO: 39523 - protein, 9 aa, Mycobacterium tuberculosis
NPSARAAPI

SEQ ID NO: 39524 - protein, 9 aa, Mycobacterium tuberculosis
PSARAAPIG

SEQ ID NO: 39525 - protein, 9 aa, Mycobacterium tuberculosis
SARAAPIGN

SEQ ID NO: 39526 - protein, 9 aa, Mycobacterium tuberculosis
ARAAPIGNG

SEQ ID NO: 39527 - protein, 9 aa, Mycobacterium tuberculosis
RAAPIGNGG

SEQ ID NO: 39528 - protein, 9 aa, Mycobacterium tuberculosis
AAPIGNGGD

SEQ ID NO: 39529 - protein, 9 aa, Mycobacterium tuberculosis
APIGNGGDS

SEQ ID NO: 39530 - protein, 9 aa, Mycobacterium tuberculosis
PIGNGGDSS

SEQ ID NO: 39531 - protein, 9 aa, Mycobacterium tuberculosis
IGNGGDSSV

SEQ ID NO: 39532 - protein, 9 aa, Mycobacterium tuberculosis
GNGGDSSVC

SEQ ID NO: 39533 - protein, 9 aa, Mycobacterium tuberculosis
NGGDSSVCA

SEQ ID NO: 39534 - protein, 9 aa, Mycobacterium tuberculosis
GGDSSVCAG

SEQ ID NO: 39535 - protein, 9 aa, Mycobacterium tuberculosis
GDSSVCAGE

SEQ ID NO: 39536 - protein, 9 aa, Mycobacterium tuberculosis
DSSVCAGEK

SEQ ID NO: 39537 - protein, 9 aa, Mycobacterium tuberculosis
SSVCAGEKQ

SEQ ID NO: 39538 - protein, 9 aa, Mycobacterium tuberculosis
SVCAGEKQC

SEQ ID NO: 39539 - protein, 9 aa, Mycobacterium tuberculosis
VCAGEKQCR

SEQ ID NO: 39540 - protein, 9 aa, Mycobacterium tuberculosis
CAGEKQCRP

SEQ ID NO: 39541 - protein, 9 aa, Mycobacterium tuberculosis
AGEKQCRPP

SEQ ID NO: 39542 - protein, 10 aa, Mycobacterium tuberculosis
MDDLTRLRRE

SEQ ID NO: 39543 - protein, 10 aa, Mycobacterium tuberculosis
DDLTRLRREL

SEQ ID NO: 39544 - protein, 10 aa, Mycobacterium tuberculosis
DLTRLRRELL

SEQ ID NO: 39545 - protein, 10 aa, Mycobacterium tuberculosis
LTRLRRELLD

SEQ ID NO: 39546 - protein, 10 aa, Mycobacterium tuberculosis
TRLRRELLDR

SEQ ID NO: 39547 - protein, 10 aa, Mycobacterium tuberculosis
RLRRELLDRF

SEQ ID NO: 39548 - protein, 10 aa, Mycobacterium tuberculosis
LRRELLDRFD

SEQ ID NO: 39549 - protein, 10 aa, Mycobacterium tuberculosis
RRELLDRFDV

SEQ ID NO: 39550 - protein, 10 aa, Mycobacterium tuberculosis
RELLDRFDVR

SEQ ID NO: 39551 - protein, 10 aa, Mycobacterium tuberculosis
ELLDRFDVRD

SEQ ID NO: 39552 - protein, 10 aa, Mycobacterium tuberculosis
LLDRFDVRDF

SEQ ID NO: 39553 - protein, 10 aa, Mycobacterium tuberculosis
LDRFDVRDFT

SEQ ID NO: 39554 - protein, 10 aa, Mycobacterium tuberculosis
DRFDVRDFTD

SEQ ID NO: 39555 - protein, 10 aa, Mycobacterium tuberculosis
RFDVRDFTDW

SEQ ID NO: 39556 - protein, 10 aa, Mycobacterium tuberculosis
FDVRDFTDWP

SEQ ID NO: 39557 - protein, 10 aa, Mycobacterium tuberculosis
DVRDFTDWPP

SEQ ID NO: 39558 - protein, 10 aa, Mycobacterium tuberculosis
VRDFTDWPPA

SEQ ID NO: 39559 - protein, 10 aa, Mycobacterium tuberculosis
RDFTDWPPAS

SEQ ID NO: 39560 - protein, 10 aa, Mycobacterium tuberculosis
DFTDWPPASL

SEQ ID NO: 39561 - protein, 10 aa, Mycobacterium tuberculosis
FTDWPPASLR

SEQ ID NO: 39562 - protein, 10 aa, Mycobacterium tuberculosis
TDWPPASLRA

SEQ ID NO: 39563 - protein, 10 aa, Mycobacterium tuberculosis
DWPPASLRAL

SEQ ID NO: 39564 - protein, 10 aa, Mycobacterium tuberculosis
WPPASLRALI

SEQ ID NO: 39565 - protein, 10 aa, Mycobacterium tuberculosis
PPASLRALIA

SEQ ID NO: 39566 - protein, 10 aa, Mycobacterium tuberculosis
PASLRALIAT

SEQ ID NO: 39567 - protein, 10 aa, Mycobacterium tuberculosis
ASLRALIATY

SEQ ID NO: 39568 - protein, 10 aa, Mycobacterium tuberculosis
SLRALIATYD

SEQ ID NO: 39569 - protein, 10 aa, Mycobacterium tuberculosis
LRALIATYDP

SEQ ID NO: 39570 - protein, 10 aa, Mycobacterium tuberculosis
RALIATYDPW

SEQ ID NO: 39571 - protein, 10 aa, Mycobacterium tuberculosis
ALIATYDPWI

SEQ ID NO: 39572 - protein, 10 aa, Mycobacterium tuberculosis
LIATYDPWID

SEQ ID NO: 39573 - protein, 10 aa, Mycobacterium tuberculosis
IATYDPWIDM

SEQ ID NO: 39574 - protein, 10 aa, Mycobacterium tuberculosis
ATYDPWIDMT

SEQ ID NO: 39575 - protein, 10 aa, Mycobacterium tuberculosis
TYDPWIDMTA

SEQ ID NO: 39576 - protein, 10 aa, Mycobacterium tuberculosis
YDPWIDMTAS

SEQ ID NO: 39577 - protein, 10 aa, Mycobacterium tuberculosis
DPWIDMTASP

SEQ ID NO: 39578 - protein, 10 aa, Mycobacterium tuberculosis
PWIDMTASPP

SEQ ID NO: 39579 - protein, 10 aa, Mycobacterium tuberculosis
WIDMTASPPQ

SEQ ID NO: 39580 - protein, 10 aa, Mycobacterium tuberculosis
IDMTASPPQP

SEQ ID NO: 39581 - protein, 10 aa, Mycobacterium tuberculosis
DMTASPPQPV

SEQ ID NO: 39582 - protein, 10 aa, Mycobacterium tuberculosis
MTASPPQPVS

SEQ ID NO: 39583 - protein, 10 aa, Mycobacterium tuberculosis
TASPPQPVSP

SEQ ID NO: 39584 - protein, 10 aa, Mycobacterium tuberculosis
ASPPQPVSPG

SEQ ID NO: 39585 - protein, 10 aa, Mycobacterium tuberculosis
SPPQPVSPGG

SEQ ID NO: 39586 - protein, 10 aa, Mycobacterium tuberculosis
PPQPVSPGGP

SEQ ID NO: 39587 - protein, 10 aa, Mycobacterium tuberculosis
PQPVSPGGPR

SEQ ID NO: 39588 - protein, 10 aa, Mycobacterium tuberculosis
QPVSPGGPRL

SEQ ID NO: 39589 - protein, 10 aa, Mycobacterium tuberculosis
PVSPGGPRLR

SEQ ID NO: 39590 - protein, 10 aa, Mycobacterium tuberculosis
VSPGGPRLRL

SEQ ID NO: 39591 - protein, 10 aa, Mycobacterium tuberculosis
SPGGPRLRLV

SEQ ID NO: 39592 - protein, 10 aa, Mycobacterium tuberculosis
PGGPRLRLVR

SEQ ID NO: 39593 - protein, 10 aa, Mycobacterium tuberculosis
GGPRLRLVRL

SEQ ID NO: 39594 - protein, 10 aa, Mycobacterium tuberculosis
GPRLRLVRLT

SEQ ID NO: 39595 - protein, 10 aa, Mycobacterium tuberculosis
PRLRLVRLTT

SEQ ID NO: 39596 - protein, 10 aa, Mycobacterium tuberculosis
RLRLVRLTTN

SEQ ID NO: 39597 - protein, 10 aa, Mycobacterium tuberculosis
LRLVRLTTNP

SEQ ID NO: 39598 - protein, 10 aa, Mycobacterium tuberculosis
RLVRLTTNPS

SEQ ID NO: 39599 - protein, 10 aa, Mycobacterium tuberculosis
LVRLTTNPSA

SEQ ID NO: 39600 - protein, 10 aa, Mycobacterium tuberculosis
VRLTTNPSAR

SEQ ID NO: 39601 - protein, 10 aa, Mycobacterium tuberculosis
RLTTNPSARA

SEQ ID NO: 39602 - protein, 10 aa, Mycobacterium tuberculosis
LTTNPSARAA

SEQ ID NO: 39603 - protein, 10 aa, Mycobacterium tuberculosis
TTNPSARAAP

SEQ ID NO: 39604 - protein, 10 aa, Mycobacterium tuberculosis
TNPSARAAPI

SEQ ID NO: 39605 - protein, 10 aa, Mycobacterium tuberculosis
NPSARAAPIG

SEQ ID NO: 39606 - protein, 10 aa, Mycobacterium tuberculosis
PSARAAPIGN

SEQ ID NO: 39607 - protein, 10 aa, Mycobacterium tuberculosis
SARAAPIGNG

SEQ ID NO: 39608 - protein, 10 aa, Mycobacterium tuberculosis
ARAAPIGNGG

SEQ ID NO: 39609 - protein, 10 aa, Mycobacterium tuberculosis
RAAPIGNGGD

SEQ ID NO: 39610 - protein, 10 aa, Mycobacterium tuberculosis
AAPIGNGGDS

SEQ ID NO: 39611 - protein, 10 aa, Mycobacterium tuberculosis
APIGNGGDSS

SEQ ID NO: 39612 - protein, 10 aa, Mycobacterium tuberculosis
PIGNGGDSSV

SEQ ID NO: 39613 - protein, 10 aa, Mycobacterium tuberculosis
IGNGGDSSVC

SEQ ID NO: 39614 - protein, 10 aa, Mycobacterium tuberculosis
GNGGDSSVCA

SEQ ID NO: 39615 - protein, 10 aa, Mycobacterium tuberculosis
NGGDSSVCAG

SEQ ID NO: 39616 - protein, 10 aa, Mycobacterium tuberculosis
GGDSSVCAGE

SEQ ID NO: 39617 - protein, 10 aa, Mycobacterium tuberculosis
GDSSVCAGEK

SEQ ID NO: 39618 - protein, 10 aa, Mycobacterium tuberculosis
DSSVCAGEKQ

SEQ ID NO: 39619 - protein, 10 aa, Mycobacterium tuberculosis
SSVCAGEKQC

SEQ ID NO: 39620 - protein, 10 aa, Mycobacterium tuberculosis
SVCAGEKQCR

SEQ ID NO: 39621 - protein, 10 aa, Mycobacterium tuberculosis
VCAGEKQCRP

SEQ ID NO: 39622 - protein, 10 aa, Mycobacterium tuberculosis
CAGEKQCRPP

SEQ ID NO: 39623 - protein, 11 aa, Mycobacterium tuberculosis
MDDLTRLRREL

SEQ ID NO: 39624 - protein, 11 aa, Mycobacterium tuberculosis
DDLTRLRRELL

SEQ ID NO: 39625 - protein, 11 aa, Mycobacterium tuberculosis
DLTRLRRELLD

SEQ ID NO: 39626 - protein, 11 aa, Mycobacterium tuberculosis
LTRLRRELLDR

SEQ ID NO: 39627 - protein, 11 aa, Mycobacterium tuberculosis
TRLRRELLDRF

SEQ ID NO: 39628 - protein, 11 aa, Mycobacterium tuberculosis
RLRRELLDRFD

SEQ ID NO: 39629 - protein, 11 aa, Mycobacterium tuberculosis
LRRELLDRFDV

SEQ ID NO: 39630 - protein, 11 aa, Mycobacterium tuberculosis
RRELLDRFDVR

SEQ ID NO: 39631 - protein, 11 aa, Mycobacterium tuberculosis
RELLDRFDVRD

SEQ ID NO: 39632 - protein, 11 aa, Mycobacterium tuberculosis
ELLDRFDVRDF

SEQ ID NO: 39633 - protein, 11 aa, Mycobacterium tuberculosis
LLDRFDVRDFT

SEQ ID NO: 39634 - protein, 11 aa, Mycobacterium tuberculosis
LDRFDVRDFTD

SEQ ID NO: 39635 - protein, 11 aa, Mycobacterium tuberculosis
DRFDVRDFTDW

SEQ ID NO: 39636 - protein, 11 aa, Mycobacterium tuberculosis
RFDVRDFTDWP

SEQ ID NO: 39637 - protein, 11 aa, Mycobacterium tuberculosis
FDVRDFTDWPP

SEQ ID NO: 39638 - protein, 11 aa, Mycobacterium tuberculosis
DVRDFTDWPPA

SEQ ID NO: 39639 - protein, 11 aa, Mycobacterium tuberculosis
VRDFTDWPPAS

SEQ ID NO: 39640 - protein, 11 aa, Mycobacterium tuberculosis
RDFTDWPPASL

SEQ ID NO: 39641 - protein, 11 aa, Mycobacterium tuberculosis
DFTDWPPASLR

SEQ ID NO: 39642 - protein, 11 aa, Mycobacterium tuberculosis
FTDWPPASLRA

SEQ ID NO: 39643 - protein, 11 aa, Mycobacterium tuberculosis
TDWPPASLRAL

SEQ ID NO: 39644 - protein, 11 aa, Mycobacterium tuberculosis
DWPPASLRALI

SEQ ID NO: 39645 - protein, 11 aa, Mycobacterium tuberculosis
WPPASLRALIA

SEQ ID NO: 39646 - protein, 11 aa, Mycobacterium tuberculosis
PPASLRALIAT

SEQ ID NO: 39647 - protein, 11 aa, Mycobacterium tuberculosis
PASLRALIATY

SEQ ID NO: 39648 - protein, 11 aa, Mycobacterium tuberculosis
ASLRALIATYD

SEQ ID NO: 39649 - protein, 11 aa, Mycobacterium tuberculosis
SLRALIATYDP

SEQ ID NO: 39650 - protein, 11 aa, Mycobacterium tuberculosis
LRALIATYDPW

SEQ ID NO: 39651 - protein, 11 aa, Mycobacterium tuberculosis
RALIATYDPWI

SEQ ID NO: 39652 - protein, 11 aa, Mycobacterium tuberculosis
ALIATYDPWID

SEQ ID NO: 39653 - protein, 11 aa, Mycobacterium tuberculosis
LIATYDPWIDM

SEQ ID NO: 39654 - protein, 11 aa, Mycobacterium tuberculosis
IATYDPWIDMT

SEQ ID NO: 39655 - protein, 11 aa, Mycobacterium tuberculosis
ATYDPWIDMTA

SEQ ID NO: 39656 - protein, 11 aa, Mycobacterium tuberculosis
TYDPWIDMTAS

SEQ ID NO: 39657 - protein, 11 aa, Mycobacterium tuberculosis
YDPWIDMTASP

SEQ ID NO: 39658 - protein, 11 aa, Mycobacterium tuberculosis
DPWIDMTASPP

SEQ ID NO: 39659 - protein, 11 aa, Mycobacterium tuberculosis
PWIDMTASPPQ

SEQ ID NO: 39660 - protein, 11 aa, Mycobacterium tuberculosis
WIDMTASPPQP

SEQ ID NO: 39661 - protein, 11 aa, Mycobacterium tuberculosis
IDMTASPPQPV

SEQ ID NO: 39662 - protein, 11 aa, Mycobacterium tuberculosis
DMTASPPQPVS

SEQ ID NO: 39663 - protein, 11 aa, Mycobacterium tuberculosis
MTASPPQPVSP

SEQ ID NO: 39664 - protein, 11 aa, Mycobacterium tuberculosis
TASPPQPVSPG

SEQ ID NO: 39665 - protein, 11 aa, Mycobacterium tuberculosis
ASPPQPVSPGG

SEQ ID NO: 39666 - protein, 11 aa, Mycobacterium tuberculosis
SPPQPVSPGGP

SEQ ID NO: 39667 - protein, 11 aa, Mycobacterium tuberculosis
PPQPVSPGGPR

SEQ ID NO: 39668 - protein, 11 aa, Mycobacterium tuberculosis
PQPVSPGGPRL

SEQ ID NO: 39669 - protein, 11 aa, Mycobacterium tuberculosis
QPVSPGGPRLR

SEQ ID NO: 39670 - protein, 11 aa, Mycobacterium tuberculosis
PVSPGGPRLRL

SEQ ID NO: 39671 - protein, 11 aa, Mycobacterium tuberculosis
VSPGGPRLRLV

SEQ ID NO: 39672 - protein, 11 aa, Mycobacterium tuberculosis
SPGGPRLRLVR

SEQ ID NO: 39673 - protein, 11 aa, Mycobacterium tuberculosis
PGGPRLRLVRL

SEQ ID NO: 39674 - protein, 11 aa, Mycobacterium tuberculosis
GGPRLRLVRLT

SEQ ID NO: 39675 - protein, 11 aa, Mycobacterium tuberculosis
GPRLRLVRLTT

SEQ ID NO: 39676 - protein, 11 aa, Mycobacterium tuberculosis
PRLRLVRLTTN

SEQ ID NO: 39677 - protein, 11 aa, Mycobacterium tuberculosis
RLRLVRLTTNP

SEQ ID NO: 39678 - protein, 11 aa, Mycobacterium tuberculosis
LRLVRLTTNPS

SEQ ID NO: 39679 - protein, 11 aa, Mycobacterium tuberculosis
RLVRLTTNPSA

SEQ ID NO: 39680 - protein, 11 aa, Mycobacterium tuberculosis
LVRLTTNPSAR

SEQ ID NO: 39681 - protein, 11 aa, Mycobacterium tuberculosis
VRLTTNPSARA

SEQ ID NO: 39682 - protein, 11 aa, Mycobacterium tuberculosis
RLTTNPSARAA

SEQ ID NO: 39683 - protein, 11 aa, Mycobacterium tuberculosis
LTTNPSARAAP

SEQ ID NO: 39684 - protein, 11 aa, Mycobacterium tuberculosis
TTNPSARAAPI

SEQ ID NO: 39685 - protein, 11 aa, Mycobacterium tuberculosis
TNPSARAAPIG

SEQ ID NO: 39686 - protein, 11 aa, Mycobacterium tuberculosis
NPSARAAPIGN

SEQ ID NO: 39687 - protein, 11 aa, Mycobacterium tuberculosis
PSARAAPIGNG

SEQ ID NO: 39688 - protein, 11 aa, Mycobacterium tuberculosis
SARAAPIGNGG

SEQ ID NO: 39689 - protein, 11 aa, Mycobacterium tuberculosis
ARAAPIGNGGD

SEQ ID NO: 39690 - protein, 11 aa, Mycobacterium tuberculosis
RAAPIGNGGDS

SEQ ID NO: 39691 - protein, 11 aa, Mycobacterium tuberculosis
AAPIGNGGDSS

SEQ ID NO: 39692 - protein, 11 aa, Mycobacterium tuberculosis
APIGNGGDSSV

SEQ ID NO: 39693 - protein, 11 aa, Mycobacterium tuberculosis
PIGNGGDSSVC

SEQ ID NO: 39694 - protein, 11 aa, Mycobacterium tuberculosis
IGNGGDSSVCA

SEQ ID NO: 39695 - protein, 11 aa, Mycobacterium tuberculosis
GNGGDSSVCAG

SEQ ID NO: 39696 - protein, 11 aa, Mycobacterium tuberculosis
NGGDSSVCAGE

SEQ ID NO: 39697 - protein, 11 aa, Mycobacterium tuberculosis
GGDSSVCAGEK

SEQ ID NO: 39698 - protein, 11 aa, Mycobacterium tuberculosis
GDSSVCAGEKQ

SEQ ID NO: 39699 - protein, 11 aa, Mycobacterium tuberculosis
DSSVCAGEKQC

SEQ ID NO: 39700 - protein, 11 aa, Mycobacterium tuberculosis
SSVCAGEKQCR

SEQ ID NO: 39701 - protein, 11 aa, Mycobacterium tuberculosis
SVCAGEKQCRP

SEQ ID NO: 39702 - protein, 11 aa, Mycobacterium tuberculosis
VCAGEKQCRPP

SEQ ID NO: 39703 - protein, 8 aa, Mycobacterium tuberculosis
MEVRASAR

SEQ ID NO: 39704 - protein, 8 aa, Mycobacterium tuberculosis
EVRASARK

SEQ ID NO: 39705 - protein, 8 aa, Mycobacterium tuberculosis
VRASARKH

SEQ ID NO: 39706 - protein, 8 aa, Mycobacterium tuberculosis
RASARKHG

SEQ ID NO: 39707 - protein, 8 aa, Mycobacterium tuberculosis
ASARKHGI

SEQ ID NO: 39708 - protein, 8 aa, Mycobacterium tuberculosis
SARKHGIN

SEQ ID NO: 39709 - protein, 8 aa, Mycobacterium tuberculosis
ARKHGIND

SEQ ID NO: 39710 - protein, 8 aa, Mycobacterium tuberculosis
RKHGINDD

SEQ ID NO: 39711 - protein, 8 aa, Mycobacterium tuberculosis
KHGINDDA

SEQ ID NO: 39712 - protein, 8 aa, Mycobacterium tuberculosis
HGINDDAM

SEQ ID NO: 39713 - protein, 8 aa, Mycobacterium tuberculosis
GINDDAML

SEQ ID NO: 39714 - protein, 8 aa, Mycobacterium tuberculosis
INDDAMLH

SEQ ID NO: 39715 - protein, 8 aa, Mycobacterium tuberculosis
NDDAMLHA

SEQ ID NO: 39716 - protein, 8 aa, Mycobacterium tuberculosis
DDAMLHAY

SEQ ID NO: 39717 - protein, 8 aa, Mycobacterium tuberculosis
DAMLHAYR

SEQ ID NO: 39718 - protein, 8 aa, Mycobacterium tuberculosis
AMLHAYRN

SEQ ID NO: 39719 - protein, 8 aa, Mycobacterium tuberculosis
MLHAYRNA

SEQ ID NO: 39720 - protein, 8 aa, Mycobacterium tuberculosis
LHAYRNAL

SEQ ID NO: 39721 - protein, 8 aa, Mycobacterium tuberculosis
HAYRNALR

SEQ ID NO: 39722 - protein, 8 aa, Mycobacterium tuberculosis
AYRNALRY

SEQ ID NO: 39723 - protein, 8 aa, Mycobacterium tuberculosis
YRNALRYV

SEQ ID NO: 39724 - protein, 8 aa, Mycobacterium tuberculosis
RNALRYVE

SEQ ID NO: 39725 - protein, 8 aa, Mycobacterium tuberculosis
NALRYVEL

SEQ ID NO: 39726 - protein, 8 aa, Mycobacterium tuberculosis
ALRYVELE

SEQ ID NO: 39727 - protein, 8 aa, Mycobacterium tuberculosis
LRYVELEY

SEQ ID NO: 39728 - protein, 8 aa, Mycobacterium tuberculosis
RYVELEYH

SEQ ID NO: 39729 - protein, 8 aa, Mycobacterium tuberculosis
YVELEYHG

SEQ ID NO: 39730 - protein, 8 aa, Mycobacterium tuberculosis
VELEYHGE

SEQ ID NO: 39731 - protein, 8 aa, Mycobacterium tuberculosis
ELEYHGEV

SEQ ID NO: 39732 - protein, 8 aa, Mycobacterium tuberculosis
LEYHGEVQ

SEQ ID NO: 39733 - protein, 8 aa, Mycobacterium tuberculosis
EYHGEVQL

SEQ ID NO: 39734 - protein, 8 aa, Mycobacterium tuberculosis
YHGEVQLL

SEQ ID NO: 39735 - protein, 8 aa, Mycobacterium tuberculosis
HGEVQLLV

SEQ ID NO: 39736 - protein, 8 aa, Mycobacterium tuberculosis
GEVQLLVI

SEQ ID NO: 39737 - protein, 8 aa, Mycobacterium tuberculosis
EVQLLVIG

SEQ ID NO: 39738 - protein, 8 aa, Mycobacterium tuberculosis
VQLLVIGP

SEQ ID NO: 39739 - protein, 8 aa, Mycobacterium tuberculosis
QLLVIGPD

SEQ ID NO: 39740 - protein, 8 aa, Mycobacterium tuberculosis
LLVIGPDQ

SEQ ID NO: 39741 - protein, 8 aa, Mycobacterium tuberculosis
LVIGPDQT

SEQ ID NO: 39742 - protein, 8 aa, Mycobacterium tuberculosis
VIGPDQTG

SEQ ID NO: 39743 - protein, 8 aa, Mycobacterium tuberculosis
IGPDQTGR

SEQ ID NO: 39744 - protein, 8 aa, Mycobacterium tuberculosis
GPDQTGRL

SEQ ID NO: 39745 - protein, 8 aa, Mycobacterium tuberculosis
PDQTGRLL

SEQ ID NO: 39746 - protein, 8 aa, Mycobacterium tuberculosis
DQTGRLLE

SEQ ID NO: 39747 - protein, 8 aa, Mycobacterium tuberculosis
QTGRLLEL

SEQ ID NO: 39748 - protein, 8 aa, Mycobacterium tuberculosis
TGRLLELV

SEQ ID NO: 39749 - protein, 8 aa, Mycobacterium tuberculosis
GRLLELVI

SEQ ID NO: 39750 - protein, 8 aa, Mycobacterium tuberculosis
RLLELVIP

SEQ ID NO: 39751 - protein, 8 aa, Mycobacterium tuberculosis
LLELVIPA

SEQ ID NO: 39752 - protein, 8 aa, Mycobacterium tuberculosis
LELVIPAD

SEQ ID NO: 39753 - protein, 8 aa, Mycobacterium tuberculosis
ELVIPADE

SEQ ID NO: 39754 - protein, 8 aa, Mycobacterium tuberculosis
LVIPADEP

SEQ ID NO: 39755 - protein, 8 aa, Mycobacterium tuberculosis
VIPADEPP

SEQ ID NO: 39756 - protein, 8 aa, Mycobacterium tuberculosis
IPADEPPR

SEQ ID NO: 39757 - protein, 8 aa, Mycobacterium tuberculosis
PADEPPRI

SEQ ID NO: 39758 - protein, 8 aa, Mycobacterium tuberculosis
ADEPPRII

SEQ ID NO: 39759 - protein, 8 aa, Mycobacterium tuberculosis
DEPPRIIH

SEQ ID NO: 39760 - protein, 8 aa, Mycobacterium tuberculosis
EPPRIIHA

SEQ ID NO: 39761 - protein, 8 aa, Mycobacterium tuberculosis
PPRIIHAN

SEQ ID NO: 39762 - protein, 8 aa, Mycobacterium tuberculosis
PRIIHANV

SEQ ID NO: 39763 - protein, 8 aa, Mycobacterium tuberculosis
RIIHANVL

SEQ ID NO: 39764 - protein, 8 aa, Mycobacterium tuberculosis
IIHANVLR

SEQ ID NO: 39765 - protein, 8 aa, Mycobacterium tuberculosis
IHANVLRP

SEQ ID NO: 39766 - protein, 8 aa, Mycobacterium tuberculosis
HANVLRPK

SEQ ID NO: 39767 - protein, 8 aa, Mycobacterium tuberculosis
ANVLRPKF

SEQ ID NO: 39768 - protein, 8 aa, Mycobacterium tuberculosis
NVLRPKFY

SEQ ID NO: 39769 - protein, 8 aa, Mycobacterium tuberculosis
VLRPKFYD

SEQ ID NO: 39770 - protein, 8 aa, Mycobacterium tuberculosis
LRPKFYDY

SEQ ID NO: 39771 - protein, 8 aa, Mycobacterium tuberculosis
RPKFYDYL

SEQ ID NO: 39772 - protein, 8 aa, Mycobacterium tuberculosis
PKFYDYLR

SEQ ID NO: 39773 - protein, 9 aa, Mycobacterium tuberculosis
MEVRASARK

SEQ ID NO: 39774 - protein, 9 aa, Mycobacterium tuberculosis
EVRASARKH

SEQ ID NO: 39775 - protein, 9 aa, Mycobacterium tuberculosis
VRASARKHG

SEQ ID NO: 39776 - protein, 9 aa, Mycobacterium tuberculosis
RASARKHGI

SEQ ID NO: 39777 - protein, 9 aa, Mycobacterium tuberculosis
ASARKHGIN

SEQ ID NO: 39778 - protein, 9 aa, Mycobacterium tuberculosis
SARKHGIND

SEQ ID NO: 39779 - protein, 9 aa, Mycobacterium tuberculosis
ARKHGINDD

SEQ ID NO: 39780 - protein, 9 aa, Mycobacterium tuberculosis
RKHGINDDA

SEQ ID NO: 39781 - protein, 9 aa, Mycobacterium tuberculosis
KHGINDDAM

SEQ ID NO: 39782 - protein, 9 aa, Mycobacterium tuberculosis
HGINDDAML

SEQ ID NO: 39783 - protein, 9 aa, Mycobacterium tuberculosis
GINDDAMLH

SEQ ID NO: 39784 - protein, 9 aa, Mycobacterium tuberculosis
INDDAMLHA

SEQ ID NO: 39785 - protein, 9 aa, Mycobacterium tuberculosis
NDDAMLHAY

SEQ ID NO: 39786 - protein, 9 aa, Mycobacterium tuberculosis
DDAMLHAYR

SEQ ID NO: 39787 - protein, 9 aa, Mycobacterium tuberculosis
DAMLHAYRN

SEQ ID NO: 39788 - protein, 9 aa, Mycobacterium tuberculosis
AMLHAYRNA

SEQ ID NO: 39789 - protein, 9 aa, Mycobacterium tuberculosis
MLHAYRNAL

SEQ ID NO: 39790 - protein, 9 aa, Mycobacterium tuberculosis
LHAYRNALR

SEQ ID NO: 39791 - protein, 9 aa, Mycobacterium tuberculosis
HAYRNALRY

SEQ ID NO: 39792 - protein, 9 aa, Mycobacterium tuberculosis
AYRNALRYV

SEQ ID NO: 39793 - protein, 9 aa, Mycobacterium tuberculosis
YRNALRYVE

SEQ ID NO: 39794 - protein, 9 aa, Mycobacterium tuberculosis
RNALRYVEL

SEQ ID NO: 39795 - protein, 9 aa, Mycobacterium tuberculosis
NALRYVELE

SEQ ID NO: 39796 - protein, 9 aa, Mycobacterium tuberculosis
ALRYVELEY

SEQ ID NO: 39797 - protein, 9 aa, Mycobacterium tuberculosis
LRYVELEYH

SEQ ID NO: 39798 - protein, 9 aa, Mycobacterium tuberculosis
RYVELEYHG

SEQ ID NO: 39799 - protein, 9 aa, Mycobacterium tuberculosis
YVELEYHGE

SEQ ID NO: 39800 - protein, 9 aa, Mycobacterium tuberculosis
VELEYHGEV

SEQ ID NO: 39801 - protein, 9 aa, Mycobacterium tuberculosis
ELEYHGEVQ

SEQ ID NO: 39802 - protein, 9 aa, Mycobacterium tuberculosis
LEYHGEVQL

SEQ ID NO: 39803 - protein, 9 aa, Mycobacterium tuberculosis
EYHGEVQLL

SEQ ID NO: 39804 - protein, 9 aa, Mycobacterium tuberculosis
YHGEVQLLV

SEQ ID NO: 39805 - protein, 9 aa, Mycobacterium tuberculosis
HGEVQLLVI

SEQ ID NO: 39806 - protein, 9 aa, Mycobacterium tuberculosis
GEVQLLVIG

SEQ ID NO: 39807 - protein, 9 aa, Mycobacterium tuberculosis
EVQLLVIGP

SEQ ID NO: 39808 - protein, 9 aa, Mycobacterium tuberculosis
VQLLVIGPD

SEQ ID NO: 39809 - protein, 9 aa, Mycobacterium tuberculosis
QLLVIGPDQ

SEQ ID NO: 39810 - protein, 9 aa, Mycobacterium tuberculosis
LLVIGPDQT

SEQ ID NO: 39811 - protein, 9 aa, Mycobacterium tuberculosis
LVIGPDQTG

SEQ ID NO: 39812 - protein, 9 aa, Mycobacterium tuberculosis
VIGPDQTGR

SEQ ID NO: 39813 - protein, 9 aa, Mycobacterium tuberculosis
IGPDQTGRL

SEQ ID NO: 39814 - protein, 9 aa, Mycobacterium tuberculosis
GPDQTGRLL

SEQ ID NO: 39815 - protein, 9 aa, Mycobacterium tuberculosis
PDQTGRLLE

SEQ ID NO: 39816 - protein, 9 aa, Mycobacterium tuberculosis
DQTGRLLEL

SEQ ID NO: 39817 - protein, 9 aa, Mycobacterium tuberculosis
QTGRLLELV

SEQ ID NO: 39818 - protein, 9 aa, Mycobacterium tuberculosis
TGRLLELVI

SEQ ID NO: 39819 - protein, 9 aa, Mycobacterium tuberculosis
GRLLELVIP

SEQ ID NO: 39820 - protein, 9 aa, Mycobacterium tuberculosis
RLLELVIPA

SEQ ID NO: 39821 - protein, 9 aa, Mycobacterium tuberculosis
LLELVIPAD

SEQ ID NO: 39822 - protein, 9 aa, Mycobacterium tuberculosis
LELVIPADE

SEQ ID NO: 39823 - protein, 9 aa, Mycobacterium tuberculosis
ELVIPADEP

SEQ ID NO: 39824 - protein, 9 aa, Mycobacterium tuberculosis
LVIPADEPP

SEQ ID NO: 39825 - protein, 9 aa, Mycobacterium tuberculosis
VIPADEPPR

SEQ ID NO: 39826 - protein, 9 aa, Mycobacterium tuberculosis
IPADEPPRI

SEQ ID NO: 39827 - protein, 9 aa, Mycobacterium tuberculosis
PADEPPRII

SEQ ID NO: 39828 - protein, 9 aa, Mycobacterium tuberculosis
ADEPPRIIH

SEQ ID NO: 39829 - protein, 9 aa, Mycobacterium tuberculosis
DEPPRIIHA

SEQ ID NO: 39830 - protein, 9 aa, Mycobacterium tuberculosis
EPPRIIHAN

SEQ ID NO: 39831 - protein, 9 aa, Mycobacterium tuberculosis
PPRIIHANV

SEQ ID NO: 39832 - protein, 9 aa, Mycobacterium tuberculosis
PRIIHANVL

SEQ ID NO: 39833 - protein, 9 aa, Mycobacterium tuberculosis
RIIHANVLR

SEQ ID NO: 39834 - protein, 9 aa, Mycobacterium tuberculosis
IIHANVLRP

SEQ ID NO: 39835 - protein, 9 aa, Mycobacterium tuberculosis
IHANVLRPK

SEQ ID NO: 39836 - protein, 9 aa, Mycobacterium tuberculosis
HANVLRPKF

SEQ ID NO: 39837 - protein, 9 aa, Mycobacterium tuberculosis
ANVLRPKFY

SEQ ID NO: 39838 - protein, 9 aa, Mycobacterium tuberculosis
NVLRPKFYD

SEQ ID NO: 39839 - protein, 9 aa, Mycobacterium tuberculosis
VLRPKFYDY

SEQ ID NO: 39840 - protein, 9 aa, Mycobacterium tuberculosis
LRPKFYDYL

SEQ ID NO: 39841 - protein, 9 aa, Mycobacterium tuberculosis
RPKFYDYLR

SEQ ID NO: 39842 - protein, 10 aa, Mycobacterium tuberculosis
MEVRASARKH

SEQ ID NO: 39843 - protein, 10 aa, Mycobacterium tuberculosis
EVRASARKHG

SEQ ID NO: 39844 - protein, 10 aa, Mycobacterium tuberculosis
VRASARKHGI

SEQ ID NO: 39845 - protein, 10 aa, Mycobacterium tuberculosis
RASARKHGIN

SEQ ID NO: 39846 - protein, 10 aa, Mycobacterium tuberculosis
ASARKHGIND

SEQ ID NO: 39847 - protein, 10 aa, Mycobacterium tuberculosis
SARKHGINDD

SEQ ID NO: 39848 - protein, 10 aa, Mycobacterium tuberculosis
ARKHGINDDA

SEQ ID NO: 39849 - protein, 10 aa, Mycobacterium tuberculosis
RKHGINDDAM

SEQ ID NO: 39850 - protein, 10 aa, Mycobacterium tuberculosis
KHGINDDAML

SEQ ID NO: 39851 - protein, 10 aa, Mycobacterium tuberculosis
HGINDDAMLH

SEQ ID NO: 39852 - protein, 10 aa, Mycobacterium tuberculosis
GINDDAMLHA

SEQ ID NO: 39853 - protein, 10 aa, Mycobacterium tuberculosis
INDDAMLHAY

SEQ ID NO: 39854 - protein, 10 aa, Mycobacterium tuberculosis
NDDAMLHAYR

SEQ ID NO: 39855 - protein, 10 aa, Mycobacterium tuberculosis
DDAMLHAYRN

SEQ ID NO: 39856 - protein, 10 aa, Mycobacterium tuberculosis
DAMLHAYRNA

SEQ ID NO: 39857 - protein, 10 aa, Mycobacterium tuberculosis
AMLHAYRNAL

SEQ ID NO: 39858 - protein, 10 aa, Mycobacterium tuberculosis
MLHAYRNALR

SEQ ID NO: 39859 - protein, 10 aa, Mycobacterium tuberculosis
LHAYRNALRY

SEQ ID NO: 39860 - protein, 10 aa, Mycobacterium tuberculosis
HAYRNALRYV

SEQ ID NO: 39861 - protein, 10 aa, Mycobacterium tuberculosis
AYRNALRYVE

SEQ ID NO: 39862 - protein, 10 aa, Mycobacterium tuberculosis
YRNALRYVEL

SEQ ID NO: 39863 - protein, 10 aa, Mycobacterium tuberculosis
RNALRYVELE

SEQ ID NO: 39864 - protein, 10 aa, Mycobacterium tuberculosis
NALRYVELEY

SEQ ID NO: 39865 - protein, 10 aa, Mycobacterium tuberculosis
ALRYVELEYH

SEQ ID NO: 39866 - protein, 10 aa, Mycobacterium tuberculosis
LRYVELEYHG

SEQ ID NO: 39867 - protein, 10 aa, Mycobacterium tuberculosis
RYVELEYHGE

SEQ ID NO: 39868 - protein, 10 aa, Mycobacterium tuberculosis
YVELEYHGEV

SEQ ID NO: 39869 - protein, 10 aa, Mycobacterium tuberculosis
VELEYHGEVQ

SEQ ID NO: 39870 - protein, 10 aa, Mycobacterium tuberculosis
ELEYHGEVQL

SEQ ID NO: 39871 - protein, 10 aa, Mycobacterium tuberculosis
LEYHGEVQLL

SEQ ID NO: 39872 - protein, 10 aa, Mycobacterium tuberculosis
EYHGEVQLLV

SEQ ID NO: 39873 - protein, 10 aa, Mycobacterium tuberculosis
YHGEVQLLVI

SEQ ID NO: 39874 - protein, 10 aa, Mycobacterium tuberculosis
HGEVQLLVIG

SEQ ID NO: 39875 - protein, 10 aa, Mycobacterium tuberculosis
GEVQLLVIGP

SEQ ID NO: 39876 - protein, 10 aa, Mycobacterium tuberculosis
EVQLLVIGPD

SEQ ID NO: 39877 - protein, 10 aa, Mycobacterium tuberculosis
VQLLVIGPDQ

SEQ ID NO: 39878 - protein, 10 aa, Mycobacterium tuberculosis
QLLVIGPDQT

SEQ ID NO: 39879 - protein, 10 aa, Mycobacterium tuberculosis
LLVIGPDQTG

SEQ ID NO: 39880 - protein, 10 aa, Mycobacterium tuberculosis
LVIGPDQTGR

SEQ ID NO: 39881 - protein, 10 aa, Mycobacterium tuberculosis
VIGPDQTGRL

SEQ ID NO: 39882 - protein, 10 aa, Mycobacterium tuberculosis
IGPDQTGRLL

SEQ ID NO: 39883 - protein, 10 aa, Mycobacterium tuberculosis
GPDQTGRLLE

SEQ ID NO: 39884 - protein, 10 aa, Mycobacterium tuberculosis
PDQTGRLLEL

SEQ ID NO: 39885 - protein, 10 aa, Mycobacterium tuberculosis
DQTGRLLELV

SEQ ID NO: 39886 - protein, 10 aa, Mycobacterium tuberculosis
QTGRLLELVI

SEQ ID NO: 39887 - protein, 10 aa, Mycobacterium tuberculosis
TGRLLELVIP

SEQ ID NO: 39888 - protein, 10 aa, Mycobacterium tuberculosis
GRLLELVIPA

SEQ ID NO: 39889 - protein, 10 aa, Mycobacterium tuberculosis
RLLELVIPAD

SEQ ID NO: 39890 - protein, 10 aa, Mycobacterium tuberculosis
LLELVIPADE

SEQ ID NO: 39891 - protein, 10 aa, Mycobacterium tuberculosis
LELVIPADEP

SEQ ID NO: 39892 - protein, 10 aa, Mycobacterium tuberculosis
ELVIPADEPP

SEQ ID NO: 39893 - protein, 10 aa, Mycobacterium tuberculosis
LVIPADEPPR

SEQ ID NO: 39894 - protein, 10 aa, Mycobacterium tuberculosis
VIPADEPPRI

SEQ ID NO: 39895 - protein, 10 aa, Mycobacterium tuberculosis
IPADEPPRII

SEQ ID NO: 39896 - protein, 10 aa, Mycobacterium tuberculosis
PADEPPRIIH

SEQ ID NO: 39897 - protein, 10 aa, Mycobacterium tuberculosis
ADEPPRIIHA

SEQ ID NO: 39898 - protein, 10 aa, Mycobacterium tuberculosis
DEPPRIIHAN

SEQ ID NO: 39899 - protein, 10 aa, Mycobacterium tuberculosis
EPPRIIHANV

SEQ ID NO: 39900 - protein, 10 aa, Mycobacterium tuberculosis
PPRIIHANVL

SEQ ID NO: 39901 - protein, 10 aa, Mycobacterium tuberculosis
PRIIHANVLR

SEQ ID NO: 39902 - protein, 10 aa, Mycobacterium tuberculosis
RIIHANVLRP

SEQ ID NO: 39903 - protein, 10 aa, Mycobacterium tuberculosis
IIHANVLRPK

SEQ ID NO: 39904 - protein, 10 aa, Mycobacterium tuberculosis
IHANVLRPKF

SEQ ID NO: 39905 - protein, 10 aa, Mycobacterium tuberculosis
HANVLRPKFY

SEQ ID NO: 39906 - protein, 10 aa, Mycobacterium tuberculosis
ANVLRPKFYD

SEQ ID NO: 39907 - protein, 10 aa, Mycobacterium tuberculosis
NVLRPKFYDY

SEQ ID NO: 39908 - protein, 10 aa, Mycobacterium tuberculosis
VLRPKFYDYL

SEQ ID NO: 39909 - protein, 10 aa, Mycobacterium tuberculosis
LRPKFYDYLR

SEQ ID NO: 39910 - protein, 11 aa, Mycobacterium tuberculosis
MEVRASARKHG

SEQ ID NO: 39911 - protein, 11 aa, Mycobacterium tuberculosis
EVRASARKHGI

SEQ ID NO: 39912 - protein, 11 aa, Mycobacterium tuberculosis
VRASARKHGIN

SEQ ID NO: 39913 - protein, 11 aa, Mycobacterium tuberculosis
RASARKHGIND

SEQ ID NO: 39914 - protein, 11 aa, Mycobacterium tuberculosis
ASARKHGINDD

SEQ ID NO: 39915 - protein, 11 aa, Mycobacterium tuberculosis
SARKHGINDDA

SEQ ID NO: 39916 - protein, 11 aa, Mycobacterium tuberculosis
ARKHGINDDAM

SEQ ID NO: 39917 - protein, 11 aa, Mycobacterium tuberculosis
RKHGINDDAML

SEQ ID NO: 39918 - protein, 11 aa, Mycobacterium tuberculosis
KHGINDDAMLH

SEQ ID NO: 39919 - protein, 11 aa, Mycobacterium tuberculosis
HGINDDAMLHA

SEQ ID NO: 39920 - protein, 11 aa, Mycobacterium tuberculosis
GINDDAMLHAY

SEQ ID NO: 39921 - protein, 11 aa, Mycobacterium tuberculosis
INDDAMLHAYR

SEQ ID NO: 39922 - protein, 11 aa, Mycobacterium tuberculosis
NDDAMLHAYRN

SEQ ID NO: 39923 - protein, 11 aa, Mycobacterium tuberculosis
DDAMLHAYRNA

SEQ ID NO: 39924 - protein, 11 aa, Mycobacterium tuberculosis
DAMLHAYRNAL

SEQ ID NO: 39925 - protein, 11 aa, Mycobacterium tuberculosis
AMLHAYRNALR

SEQ ID NO: 39926 - protein, 11 aa, Mycobacterium tuberculosis
MLHAYRNALRY

SEQ ID NO: 39927 - protein, 11 aa, Mycobacterium tuberculosis
LHAYRNALRYV

SEQ ID NO: 39928 - protein, 11 aa, Mycobacterium tuberculosis
HAYRNALRYVE

SEQ ID NO: 39929 - protein, 11 aa, Mycobacterium tuberculosis
AYRNALRYVEL

SEQ ID NO: 39930 - protein, 11 aa, Mycobacterium tuberculosis
YRNALRYVELE

SEQ ID NO: 39931 - protein, 11 aa, Mycobacterium tuberculosis
RNALRYVELEY

SEQ ID NO: 39932 - protein, 11 aa, Mycobacterium tuberculosis
NALRYVELEYH

SEQ ID NO: 39933 - protein, 11 aa, Mycobacterium tuberculosis
ALRYVELEYHG

SEQ ID NO: 39934 - protein, 11 aa, Mycobacterium tuberculosis
LRYVELEYHGE

SEQ ID NO: 39935 - protein, 11 aa, Mycobacterium tuberculosis
RYVELEYHGEV

SEQ ID NO: 39936 - protein, 11 aa, Mycobacterium tuberculosis
YVELEYHGEVQ

SEQ ID NO: 39937 - protein, 11 aa, Mycobacterium tuberculosis
VELEYHGEVQL

SEQ ID NO: 39938 - protein, 11 aa, Mycobacterium tuberculosis
ELEYHGEVQLL

SEQ ID NO: 39939 - protein, 11 aa, Mycobacterium tuberculosis
LEYHGEVQLLV

SEQ ID NO: 39940 - protein, 11 aa, Mycobacterium tuberculosis
EYHGEVQLLVI

SEQ ID NO: 39941 - protein, 11 aa, Mycobacterium tuberculosis
YHGEVQLLVIG

SEQ ID NO: 39942 - protein, 11 aa, Mycobacterium tuberculosis
HGEVQLLVIGP

SEQ ID NO: 39943 - protein, 11 aa, Mycobacterium tuberculosis
GEVQLLVIGPD

SEQ ID NO: 39944 - protein, 11 aa, Mycobacterium tuberculosis
EVQLLVIGPDQ

SEQ ID NO: 39945 - protein, 11 aa, Mycobacterium tuberculosis
VQLLVIGPDQT

SEQ ID NO: 39946 - protein, 11 aa, Mycobacterium tuberculosis
QLLVIGPDQTG

SEQ ID NO: 39947 - protein, 11 aa, Mycobacterium tuberculosis
LLVIGPDQTGR

SEQ ID NO: 39948 - protein, 11 aa, Mycobacterium tuberculosis
LVIGPDQTGRL

SEQ ID NO: 39949 - protein, 11 aa, Mycobacterium tuberculosis
VIGPDQTGRLL

SEQ ID NO: 39950 - protein, 11 aa, Mycobacterium tuberculosis
IGPDQTGRLLE

SEQ ID NO: 39951 - protein, 11 aa, Mycobacterium tuberculosis
GPDQTGRLLEL

SEQ ID NO: 39952 - protein, 11 aa, Mycobacterium tuberculosis
PDQTGRLLELV

SEQ ID NO: 39953 - protein, 11 aa, Mycobacterium tuberculosis
DQTGRLLELVI

SEQ ID NO: 39954 - protein, 11 aa, Mycobacterium tuberculosis
QTGRLLELVIP

SEQ ID NO: 39955 - protein, 11 aa, Mycobacterium tuberculosis
TGRLLELVIPA

SEQ ID NO: 39956 - protein, 11 aa, Mycobacterium tuberculosis
GRLLELVIPAD

SEQ ID NO: 39957 - protein, 11 aa, Mycobacterium tuberculosis
RLLELVIPADE

SEQ ID NO: 39958 - protein, 11 aa, Mycobacterium tuberculosis
LLELVIPADEP

SEQ ID NO: 39959 - protein, 11 aa, Mycobacterium tuberculosis
LELVIPADEPP

SEQ ID NO: 39960 - protein, 11 aa, Mycobacterium tuberculosis
ELVIPADEPPR

SEQ ID NO: 39961 - protein, 11 aa, Mycobacterium tuberculosis
LVIPADEPPRI

SEQ ID NO: 39962 - protein, 11 aa, Mycobacterium tuberculosis
VIPADEPPRII

SEQ ID NO: 39963 - protein, 11 aa, Mycobacterium tuberculosis
IPADEPPRIIH

SEQ ID NO: 39964 - protein, 11 aa, Mycobacterium tuberculosis
PADEPPRIIHA

SEQ ID NO: 39965 - protein, 11 aa, Mycobacterium tuberculosis
ADEPPRIIHAN

SEQ ID NO: 39966 - protein, 11 aa, Mycobacterium tuberculosis
DEPPRIIHANV

SEQ ID NO: 39967 - protein, 11 aa, Mycobacterium tuberculosis
EPPRIIHANVL

SEQ ID NO: 39968 - protein, 11 aa, Mycobacterium tuberculosis
PPRIIHANVLR

SEQ ID NO: 39969 - protein, 11 aa, Mycobacterium tuberculosis
PRIIHANVLRP

SEQ ID NO: 39970 - protein, 11 aa, Mycobacterium tuberculosis
RIIHANVLRPK

SEQ ID NO: 39971 - protein, 11 aa, Mycobacterium tuberculosis
IIHANVLRPKF

SEQ ID NO: 39972 - protein, 11 aa, Mycobacterium tuberculosis
IHANVLRPKFY

SEQ ID NO: 39973 - protein, 11 aa, Mycobacterium tuberculosis
HANVLRPKFYD

SEQ ID NO: 39974 - protein, 11 aa, Mycobacterium tuberculosis
ANVLRPKFYDY

SEQ ID NO: 39975 - protein, 11 aa, Mycobacterium tuberculosis
NVLRPKFYDYL

SEQ ID NO: 39976 - protein, 11 aa, Mycobacterium tuberculosis
VLRPKFYDYLR

SEQ ID NO: 39977 - protein, 8 aa, Mycobacterium tuberculosis
MSVGFVTP

SEQ ID NO: 39978 - protein, 8 aa, Mycobacterium tuberculosis
SVGFVTPV

SEQ ID NO: 39979 - protein, 8 aa, Mycobacterium tuberculosis
VGFVTPVG

SEQ ID NO: 39980 - protein, 8 aa, Mycobacterium tuberculosis
GFVTPVGV

SEQ ID NO: 39981 - protein, 8 aa, Mycobacterium tuberculosis
FVTPVGVR

SEQ ID NO: 39982 - protein, 8 aa, Mycobacterium tuberculosis
VTPVGVRW

SEQ ID NO: 39983 - protein, 8 aa, Mycobacterium tuberculosis
TPVGVRWS

SEQ ID NO: 39984 - protein, 8 aa, Mycobacterium tuberculosis
PVGVRWSD

SEQ ID NO: 39985 - protein, 8 aa, Mycobacterium tuberculosis
VGVRWSDI

SEQ ID NO: 39986 - protein, 8 aa, Mycobacterium tuberculosis
GVRWSDID

SEQ ID NO: 39987 - protein, 8 aa, Mycobacterium tuberculosis
VRWSDIDM

SEQ ID NO: 39988 - protein, 8 aa, Mycobacterium tuberculosis
RWSDIDMY

SEQ ID NO: 39989 - protein, 8 aa, Mycobacterium tuberculosis
WSDIDMYQ

SEQ ID NO: 39990 - protein, 8 aa, Mycobacterium tuberculosis
SDIDMYQH

SEQ ID NO: 39991 - protein, 8 aa, Mycobacterium tuberculosis
DIDMYQHV

SEQ ID NO: 39992 - protein, 8 aa, Mycobacterium tuberculosis
IDMYQHVN

SEQ ID NO: 39993 - protein, 8 aa, Mycobacterium tuberculosis
DMYQHVNH

SEQ ID NO: 39994 - protein, 8 aa, Mycobacterium tuberculosis
MYQHVNHA

SEQ ID NO: 39995 - protein, 8 aa, Mycobacterium tuberculosis
YQHVNHAT

SEQ ID NO: 39996 - protein, 8 aa, Mycobacterium tuberculosis
QHVNHATM

SEQ ID NO: 39997 - protein, 8 aa, Mycobacterium tuberculosis
HVNHATMV

SEQ ID NO: 39998 - protein, 8 aa, Mycobacterium tuberculosis
VNHATMVT

SEQ ID NO: 39999 - protein, 8 aa, Mycobacterium tuberculosis
NHATMVTI

SEQ ID NO: 40000 - protein, 8 aa, Mycobacterium tuberculosis
HATMVTIL

SEQ ID NO: 40001 - protein, 8 aa, Mycobacterium tuberculosis
ATMVTILE

SEQ ID NO: 40002 - protein, 8 aa, Mycobacterium tuberculosis
TMVTILEE

SEQ ID NO: 40003 - protein, 8 aa, Mycobacterium tuberculosis
MVTILEEA

SEQ ID NO: 40004 - protein, 8 aa, Mycobacterium tuberculosis
VTILEEAR

SEQ ID NO: 40005 - protein, 8 aa, Mycobacterium tuberculosis
TILEEARV

SEQ ID NO: 40006 - protein, 8 aa, Mycobacterium tuberculosis
ILEEARVP

SEQ ID NO: 40007 - protein, 8 aa, Mycobacterium tuberculosis
LEEARVPF

SEQ ID NO: 40008 - protein, 8 aa, Mycobacterium tuberculosis
EEARVPFL

SEQ ID NO: 40009 - protein, 8 aa, Mycobacterium tuberculosis
EARVPFLK

SEQ ID NO: 40010 - protein, 8 aa, Mycobacterium tuberculosis
ARVPFLKD

SEQ ID NO: 40011 - protein, 8 aa, Mycobacterium tuberculosis
RVPFLKDA

SEQ ID NO: 40012 - protein, 8 aa, Mycobacterium tuberculosis
VPFLKDAF

SEQ ID NO: 40013 - protein, 8 aa, Mycobacterium tuberculosis
PFLKDAFG

SEQ ID NO: 40014 - protein, 8 aa, Mycobacterium tuberculosis
FLKDAFGA

SEQ ID NO: 40015 - protein, 8 aa, Mycobacterium tuberculosis
LKDAFGAD

SEQ ID NO: 40016 - protein, 8 aa, Mycobacterium tuberculosis
KDAFGADI

SEQ ID NO: 40017 - protein, 8 aa, Mycobacterium tuberculosis
DAFGADIT

SEQ ID NO: 40018 - protein, 8 aa, Mycobacterium tuberculosis
AFGADITS

SEQ ID NO: 40019 - protein, 8 aa, Mycobacterium tuberculosis
FGADITST

SEQ ID NO: 40020 - protein, 8 aa, Mycobacterium tuberculosis
GADITSTG

SEQ ID NO: 40021 - protein, 8 aa, Mycobacterium tuberculosis
ADITSTGL

SEQ ID NO: 40022 - protein, 8 aa, Mycobacterium tuberculosis
DITSTGLL

SEQ ID NO: 40023 - protein, 8 aa, Mycobacterium tuberculosis
ITSTGLLI

SEQ ID NO: 40024 - protein, 8 aa, Mycobacterium tuberculosis
TSTGLLIA

SEQ ID NO: 40025 - protein, 8 aa, Mycobacterium tuberculosis
STGLLIAD

SEQ ID NO: 40026 - protein, 8 aa, Mycobacterium tuberculosis
TGLLIADV

SEQ ID NO: 40027 - protein, 8 aa, Mycobacterium tuberculosis
GLLIADVR

SEQ ID NO: 40028 - protein, 8 aa, Mycobacterium tuberculosis
LLIADVRV

SEQ ID NO: 40029 - protein, 8 aa, Mycobacterium tuberculosis
LIADVRVT

SEQ ID NO: 40030 - protein, 8 aa, Mycobacterium tuberculosis
IADVRVTY

SEQ ID NO: 40031 - protein, 8 aa, Mycobacterium tuberculosis
ADVRVTYK

SEQ ID NO: 40032 - protein, 8 aa, Mycobacterium tuberculosis
DVRVTYKG

SEQ ID NO: 40033 - protein, 8 aa, Mycobacterium tuberculosis
VRVTYKGQ

SEQ ID NO: 40034 - protein, 8 aa, Mycobacterium tuberculosis
RVTYKGQL

SEQ ID NO: 40035 - protein, 8 aa, Mycobacterium tuberculosis
VTYKGQLR

SEQ ID NO: 40036 - protein, 8 aa, Mycobacterium tuberculosis
TYKGQLRL

SEQ ID NO: 40037 - protein, 8 aa, Mycobacterium tuberculosis
YKGQLRLS

SEQ ID NO: 40038 - protein, 8 aa, Mycobacterium tuberculosis
KGQLRLSD

SEQ ID NO: 40039 - protein, 8 aa, Mycobacterium tuberculosis
GQLRLSDS

SEQ ID NO: 40040 - protein, 8 aa, Mycobacterium tuberculosis
QLRLSDSP

SEQ ID NO: 40041 - protein, 8 aa, Mycobacterium tuberculosis
LRLSDSPL

SEQ ID NO: 40042 - protein, 8 aa, Mycobacterium tuberculosis
RLSDSPLQ

SEQ ID NO: 40043 - protein, 8 aa, Mycobacterium tuberculosis
LSDSPLQV

SEQ ID NO: 40044 - protein, 8 aa, Mycobacterium tuberculosis
SDSPLQVT

SEQ ID NO: 40045 - protein, 8 aa, Mycobacterium tuberculosis
DSPLQVTI

SEQ ID NO: 40046 - protein, 8 aa, Mycobacterium tuberculosis
SPLQVTIW

SEQ ID NO: 40047 - protein, 8 aa, Mycobacterium tuberculosis
PLQVTIWT

SEQ ID NO: 40048 - protein, 8 aa, Mycobacterium tuberculosis
LQVTIWTK

SEQ ID NO: 40049 - protein, 8 aa, Mycobacterium tuberculosis
QVTIWTKR

SEQ ID NO: 40050 - protein, 8 aa, Mycobacterium tuberculosis
VTIWTKRL

SEQ ID NO: 40051 - protein, 8 aa, Mycobacterium tuberculosis
TIWTKRLR

SEQ ID NO: 40052 - protein, 8 aa, Mycobacterium tuberculosis
IWTKRLRA

SEQ ID NO: 40053 - protein, 8 aa, Mycobacterium tuberculosis
WTKRLRAV

SEQ ID NO: 40054 - protein, 8 aa, Mycobacterium tuberculosis
TKRLRAVD

SEQ ID NO: 40055 - protein, 8 aa, Mycobacterium tuberculosis
KRLRAVDF

SEQ ID NO: 40056 - protein, 8 aa, Mycobacterium tuberculosis
RLRAVDFT

SEQ ID NO: 40057 - protein, 8 aa, Mycobacterium tuberculosis
LRAVDFTL

SEQ ID NO: 40058 - protein, 8 aa, Mycobacterium tuberculosis
RAVDFTLG

SEQ ID NO: 40059 - protein, 8 aa, Mycobacterium tuberculosis
AVDFTLGY

SEQ ID NO: 40060 - protein, 8 aa, Mycobacterium tuberculosis
VDFTLGYE

SEQ ID NO: 40061 - protein, 8 aa, Mycobacterium tuberculosis
DFTLGYEV

SEQ ID NO: 40062 - protein, 8 aa, Mycobacterium tuberculosis
FTLGYEVR

SEQ ID NO: 40063 - protein, 8 aa, Mycobacterium tuberculosis
TLGYEVRS

SEQ ID NO: 40064 - protein, 8 aa, Mycobacterium tuberculosis
LGYEVRSV

SEQ ID NO: 40065 - protein, 8 aa, Mycobacterium tuberculosis
GYEVRSVN

SEQ ID NO: 40066 - protein, 8 aa, Mycobacterium tuberculosis
YEVRSVNA

SEQ ID NO: 40067 - protein, 8 aa, Mycobacterium tuberculosis
EVRSVNAE

SEQ ID NO: 40068 - protein, 8 aa, Mycobacterium tuberculosis
VRSVNAEP

SEQ ID NO: 40069 - protein, 8 aa, Mycobacterium tuberculosis
RSVNAEPD

SEQ ID NO: 40070 - protein, 8 aa, Mycobacterium tuberculosis
SVNAEPDS

SEQ ID NO: 40071 - protein, 8 aa, Mycobacterium tuberculosis
VNAEPDSR

SEQ ID NO: 40072 - protein, 8 aa, Mycobacterium tuberculosis
NAEPDSRP

SEQ ID NO: 40073 - protein, 8 aa, Mycobacterium tuberculosis
AEPDSRPA

SEQ ID NO: 40074 - protein, 8 aa, Mycobacterium tuberculosis
EPDSRPAV

SEQ ID NO: 40075 - protein, 8 aa, Mycobacterium tuberculosis
PDSRPAVI

SEQ ID NO: 40076 - protein, 8 aa, Mycobacterium tuberculosis
DSRPAVIA

SEQ ID NO: 40077 - protein, 8 aa, Mycobacterium tuberculosis
SRPAVIAE

SEQ ID NO: 40078 - protein, 8 aa, Mycobacterium tuberculosis
RPAVIAES

SEQ ID NO: 40079 - protein, 8 aa, Mycobacterium tuberculosis
PAVIAESQ

SEQ ID NO: 40080 - protein, 8 aa, Mycobacterium tuberculosis
AVIAESQL

SEQ ID NO: 40081 - protein, 8 aa, Mycobacterium tuberculosis
VIAESQLA

SEQ ID NO: 40082 - protein, 8 aa, Mycobacterium tuberculosis
IAESQLAA

SEQ ID NO: 40083 - protein, 8 aa, Mycobacterium tuberculosis
AESQLAAF

SEQ ID NO: 40084 - protein, 8 aa, Mycobacterium tuberculosis
ESQLAAFH

SEQ ID NO: 40085 - protein, 8 aa, Mycobacterium tuberculosis
SQLAAFHI

SEQ ID NO: 40086 - protein, 8 aa, Mycobacterium tuberculosis
QLAAFHIE

SEQ ID NO: 40087 - protein, 8 aa, Mycobacterium tuberculosis
LAAFHIEE

SEQ ID NO: 40088 - protein, 8 aa, Mycobacterium tuberculosis
AAFHIEEQ

SEQ ID NO: 40089 - protein, 8 aa, Mycobacterium tuberculosis
AFHIEEQR

SEQ ID NO: 40090 - protein, 8 aa, Mycobacterium tuberculosis
FHIEEQRL

SEQ ID NO: 40091 - protein, 8 aa, Mycobacterium tuberculosis
HIEEQRLV

SEQ ID NO: 40092 - protein, 8 aa, Mycobacterium tuberculosis
IEEQRLVR

SEQ ID NO: 40093 - protein, 8 aa, Mycobacterium tuberculosis
EEQRLVRL

SEQ ID NO: 40094 - protein, 8 aa, Mycobacterium tuberculosis
EQRLVRLS

SEQ ID NO: 40095 - protein, 8 aa, Mycobacterium tuberculosis
QRLVRLSP

SEQ ID NO: 40096 - protein, 8 aa, Mycobacterium tuberculosis
RLVRLSPH

SEQ ID NO: 40097 - protein, 8 aa, Mycobacterium tuberculosis
LVRLSPHH

SEQ ID NO: 40098 - protein, 8 aa, Mycobacterium tuberculosis
VRLSPHHR

SEQ ID NO: 40099 - protein, 8 aa, Mycobacterium tuberculosis
RLSPHHRE

SEQ ID NO: 40100 - protein, 8 aa, Mycobacterium tuberculosis
LSPHHREY

SEQ ID NO: 40101 - protein, 8 aa, Mycobacterium tuberculosis
SPHHREYL

SEQ ID NO: 40102 - protein, 8 aa, Mycobacterium tuberculosis
PHHREYLQ

SEQ ID NO: 40103 - protein, 8 aa, Mycobacterium tuberculosis
HHREYLQR

SEQ ID NO: 40104 - protein, 8 aa, Mycobacterium tuberculosis
HREYLQRW

SEQ ID NO: 40105 - protein, 8 aa, Mycobacterium tuberculosis
REYLQRWF

SEQ ID NO: 40106 - protein, 8 aa, Mycobacterium tuberculosis
EYLQRWFR

SEQ ID NO: 40107 - protein, 8 aa, Mycobacterium tuberculosis
YLQRWFRG

SEQ ID NO: 40108 - protein, 9 aa, Mycobacterium tuberculosis
MSVGFVTPV

SEQ ID NO: 40109 - protein, 9 aa, Mycobacterium tuberculosis
SVGFVTPVG

SEQ ID NO: 40110 - protein, 9 aa, Mycobacterium tuberculosis
VGFVTPVGV

SEQ ID NO: 40111 - protein, 9 aa, Mycobacterium tuberculosis
GFVTPVGVR

SEQ ID NO: 40112 - protein, 9 aa, Mycobacterium tuberculosis
FVTPVGVRW

SEQ ID NO: 40113 - protein, 9 aa, Mycobacterium tuberculosis
VTPVGVRWS

SEQ ID NO: 40114 - protein, 9 aa, Mycobacterium tuberculosis
TPVGVRWSD

SEQ ID NO: 40115 - protein, 9 aa, Mycobacterium tuberculosis
PVGVRWSDI

SEQ ID NO: 40116 - protein, 9 aa, Mycobacterium tuberculosis
VGVRWSDID

SEQ ID NO: 40117 - protein, 9 aa, Mycobacterium tuberculosis
GVRWSDIDM

SEQ ID NO: 40118 - protein, 9 aa, Mycobacterium tuberculosis
VRWSDIDMY

SEQ ID NO: 40119 - protein, 9 aa, Mycobacterium tuberculosis
RWSDIDMYQ

SEQ ID NO: 40120 - protein, 9 aa, Mycobacterium tuberculosis
WSDIDMYQH

SEQ ID NO: 40121 - protein, 9 aa, Mycobacterium tuberculosis
SDIDMYQHV

SEQ ID NO: 40122 - protein, 9 aa, Mycobacterium tuberculosis
DIDMYQHVN

SEQ ID NO: 40123 - protein, 9 aa, Mycobacterium tuberculosis
IDMYQHVNH

SEQ ID NO: 40124 - protein, 9 aa, Mycobacterium tuberculosis
DMYQHVNHA

SEQ ID NO: 40125 - protein, 9 aa, Mycobacterium tuberculosis
MYQHVNHAT

SEQ ID NO: 40126 - protein, 9 aa, Mycobacterium tuberculosis
YQHVNHATM

SEQ ID NO: 40127 - protein, 9 aa, Mycobacterium tuberculosis
QHVNHATMV

SEQ ID NO: 40128 - protein, 9 aa, Mycobacterium tuberculosis
HVNHATMVT

SEQ ID NO: 40129 - protein, 9 aa, Mycobacterium tuberculosis
VNHATMVTI

SEQ ID NO: 40130 - protein, 9 aa, Mycobacterium tuberculosis
NHATMVTIL

SEQ ID NO: 40131 - protein, 9 aa, Mycobacterium tuberculosis
HATMVTILE

SEQ ID NO: 40132 - protein, 9 aa, Mycobacterium tuberculosis
ATMVTILEE

SEQ ID NO: 40133 - protein, 9 aa, Mycobacterium tuberculosis
TMVTILEEA

SEQ ID NO: 40134 - protein, 9 aa, Mycobacterium tuberculosis
MVTILEEAR

SEQ ID NO: 40135 - protein, 9 aa, Mycobacterium tuberculosis
VTILEEARV

SEQ ID NO: 40136 - protein, 9 aa, Mycobacterium tuberculosis
TILEEARVP

SEQ ID NO: 40137 - protein, 9 aa, Mycobacterium tuberculosis
ILEEARVPF

SEQ ID NO: 40138 - protein, 9 aa, Mycobacterium tuberculosis
LEEARVPFL

SEQ ID NO: 40139 - protein, 9 aa, Mycobacterium tuberculosis
EEARVPFLK

SEQ ID NO: 40140 - protein, 9 aa, Mycobacterium tuberculosis
EARVPFLKD

SEQ ID NO: 40141 - protein, 9 aa, Mycobacterium tuberculosis
ARVPFLKDA

SEQ ID NO: 40142 - protein, 9 aa, Mycobacterium tuberculosis
RVPFLKDAF

SEQ ID NO: 40143 - protein, 9 aa, Mycobacterium tuberculosis
VPFLKDAFG

SEQ ID NO: 40144 - protein, 9 aa, Mycobacterium tuberculosis
PFLKDAFGA

SEQ ID NO: 40145 - protein, 9 aa, Mycobacterium tuberculosis
FLKDAFGAD

SEQ ID NO: 40146 - protein, 9 aa, Mycobacterium tuberculosis
LKDAFGADI

SEQ ID NO: 40147 - protein, 9 aa, Mycobacterium tuberculosis
KDAFGADIT

SEQ ID NO: 40148 - protein, 9 aa, Mycobacterium tuberculosis
DAFGADITS

SEQ ID NO: 40149 - protein, 9 aa, Mycobacterium tuberculosis
AFGADITST

SEQ ID NO: 40150 - protein, 9 aa, Mycobacterium tuberculosis
FGADITSTG

SEQ ID NO: 40151 - protein, 9 aa, Mycobacterium tuberculosis
GADITSTGL

SEQ ID NO: 40152 - protein, 9 aa, Mycobacterium tuberculosis
ADITSTGLL

SEQ ID NO: 40153 - protein, 9 aa, Mycobacterium tuberculosis
DITSTGLLI

SEQ ID NO: 40154 - protein, 9 aa, Mycobacterium tuberculosis
ITSTGLLIA

SEQ ID NO: 40155 - protein, 9 aa, Mycobacterium tuberculosis
TSTGLLIAD

SEQ ID NO: 40156 - protein, 9 aa, Mycobacterium tuberculosis
STGLLIADV

SEQ ID NO: 40157 - protein, 9 aa, Mycobacterium tuberculosis
TGLLIADVR

SEQ ID NO: 40158 - protein, 9 aa, Mycobacterium tuberculosis
GLLIADVRV

SEQ ID NO: 40159 - protein, 9 aa, Mycobacterium tuberculosis
LLIADVRVT

SEQ ID NO: 40160 - protein, 9 aa, Mycobacterium tuberculosis
LIADVRVTY

SEQ ID NO: 40161 - protein, 9 aa, Mycobacterium tuberculosis
IADVRVTYK

SEQ ID NO: 40162 - protein, 9 aa, Mycobacterium tuberculosis
ADVRVTYKG

SEQ ID NO: 40163 - protein, 9 aa, Mycobacterium tuberculosis
DVRVTYKGQ

SEQ ID NO: 40164 - protein, 9 aa, Mycobacterium tuberculosis
VRVTYKGQL

SEQ ID NO: 40165 - protein, 9 aa, Mycobacterium tuberculosis
RVTYKGQLR

SEQ ID NO: 40166 - protein, 9 aa, Mycobacterium tuberculosis
VTYKGQLRL

SEQ ID NO: 40167 - protein, 9 aa, Mycobacterium tuberculosis
TYKGQLRLS

SEQ ID NO: 40168 - protein, 9 aa, Mycobacterium tuberculosis
YKGQLRLSD

SEQ ID NO: 40169 - protein, 9 aa, Mycobacterium tuberculosis
KGQLRLSDS

SEQ ID NO: 40170 - protein, 9 aa, Mycobacterium tuberculosis
GQLRLSDSP

SEQ ID NO: 40171 - protein, 9 aa, Mycobacterium tuberculosis
QLRLSDSPL

SEQ ID NO: 40172 - protein, 9 aa, Mycobacterium tuberculosis
LRLSDSPLQ

SEQ ID NO: 40173 - protein, 9 aa, Mycobacterium tuberculosis
RLSDSPLQV

SEQ ID NO: 40174 - protein, 9 aa, Mycobacterium tuberculosis
LSDSPLQVT

SEQ ID NO: 40175 - protein, 9 aa, Mycobacterium tuberculosis
SDSPLQVTI

SEQ ID NO: 40176 - protein, 9 aa, Mycobacterium tuberculosis
DSPLQVTIW

SEQ ID NO: 40177 - protein, 9 aa, Mycobacterium tuberculosis
SPLQVTIWT

SEQ ID NO: 40178 - protein, 9 aa, Mycobacterium tuberculosis
PLQVTIWTK

SEQ ID NO: 40179 - protein, 9 aa, Mycobacterium tuberculosis
LQVTIWTKR

SEQ ID NO: 40180 - protein, 9 aa, Mycobacterium tuberculosis
QVTIWTKRL

SEQ ID NO: 40181 - protein, 9 aa, Mycobacterium tuberculosis
VTIWTKRLR

SEQ ID NO: 40182 - protein, 9 aa, Mycobacterium tuberculosis
TIWTKRLRA

SEQ ID NO: 40183 - protein, 9 aa, Mycobacterium tuberculosis
IWTKRLRAV

SEQ ID NO: 40184 - protein, 9 aa, Mycobacterium tuberculosis
WTKRLRAVD

SEQ ID NO: 40185 - protein, 9 aa, Mycobacterium tuberculosis
TKRLRAVDF

SEQ ID NO: 40186 - protein, 9 aa, Mycobacterium tuberculosis
KRLRAVDFT

SEQ ID NO: 40187 - protein, 9 aa, Mycobacterium tuberculosis
RLRAVDFTL

SEQ ID NO: 40188 - protein, 9 aa, Mycobacterium tuberculosis
LRAVDFTLG

SEQ ID NO: 40189 - protein, 9 aa, Mycobacterium tuberculosis
RAVDFTLGY

SEQ ID NO: 40190 - protein, 9 aa, Mycobacterium tuberculosis
AVDFTLGYE

SEQ ID NO: 40191 - protein, 9 aa, Mycobacterium tuberculosis
VDFTLGYEV

SEQ ID NO: 40192 - protein, 9 aa, Mycobacterium tuberculosis
DFTLGYEVR

SEQ ID NO: 40193 - protein, 9 aa, Mycobacterium tuberculosis
FTLGYEVRS

SEQ ID NO: 40194 - protein, 9 aa, Mycobacterium tuberculosis
TLGYEVRSV

SEQ ID NO: 40195 - protein, 9 aa, Mycobacterium tuberculosis
LGYEVRSVN

SEQ ID NO: 40196 - protein, 9 aa, Mycobacterium tuberculosis
GYEVRSVNA

SEQ ID NO: 40197 - protein, 9 aa, Mycobacterium tuberculosis
YEVRSVNAE

SEQ ID NO: 40198 - protein, 9 aa, Mycobacterium tuberculosis
EVRSVNAEP

SEQ ID NO: 40199 - protein, 9 aa, Mycobacterium tuberculosis
VRSVNAEPD

SEQ ID NO: 40200 - protein, 9 aa, Mycobacterium tuberculosis
RSVNAEPDS

SEQ ID NO: 40201 - protein, 9 aa, Mycobacterium tuberculosis
SVNAEPDSR

SEQ ID NO: 40202 - protein, 9 aa, Mycobacterium tuberculosis
VNAEPDSRP

SEQ ID NO: 40203 - protein, 9 aa, Mycobacterium tuberculosis
NAEPDSRPA

SEQ ID NO: 40204 - protein, 9 aa, Mycobacterium tuberculosis
AEPDSRPAV

SEQ ID NO: 40205 - protein, 9 aa, Mycobacterium tuberculosis
EPDSRPAVI

SEQ ID NO: 40206 - protein, 9 aa, Mycobacterium tuberculosis
PDSRPAVIA

SEQ ID NO: 40207 - protein, 9 aa, Mycobacterium tuberculosis
DSRPAVIAE

SEQ ID NO: 40208 - protein, 9 aa, Mycobacterium tuberculosis
SRPAVIAES

SEQ ID NO: 40209 - protein, 9 aa, Mycobacterium tuberculosis
RPAVIAESQ

SEQ ID NO: 40210 - protein, 9 aa, Mycobacterium tuberculosis
PAVIAESQL

SEQ ID NO: 40211 - protein, 9 aa, Mycobacterium tuberculosis
AVIAESQLA

SEQ ID NO: 40212 - protein, 9 aa, Mycobacterium tuberculosis
VIAESQLAA

SEQ ID NO: 40213 - protein, 9 aa, Mycobacterium tuberculosis
IAESQLAAF

SEQ ID NO: 40214 - protein, 9 aa, Mycobacterium tuberculosis
AESQLAAFH

SEQ ID NO: 40215 - protein, 9 aa, Mycobacterium tuberculosis
ESQLAAFHI

SEQ ID NO: 40216 - protein, 9 aa, Mycobacterium tuberculosis
SQLAAFHIE

SEQ ID NO: 40217 - protein, 9 aa, Mycobacterium tuberculosis
QLAAFHIEE

SEQ ID NO: 40218 - protein, 9 aa, Mycobacterium tuberculosis
LAAFHIEEQ

SEQ ID NO: 40219 - protein, 9 aa, Mycobacterium tuberculosis
AAFHIEEQR

SEQ ID NO: 40220 - protein, 9 aa, Mycobacterium tuberculosis
AFHIEEQRL

SEQ ID NO: 40221 - protein, 9 aa, Mycobacterium tuberculosis
FHIEEQRLV

SEQ ID NO: 40222 - protein, 9 aa, Mycobacterium tuberculosis
HIEEQRLVR

SEQ ID NO: 40223 - protein, 9 aa, Mycobacterium tuberculosis
IEEQRLVRL

SEQ ID NO: 40224 - protein, 9 aa, Mycobacterium tuberculosis
EEQRLVRLS

SEQ ID NO: 40225 - protein, 9 aa, Mycobacterium tuberculosis
EQRLVRLSP

SEQ ID NO: 40226 - protein, 9 aa, Mycobacterium tuberculosis
QRLVRLSPH

SEQ ID NO: 40227 - protein, 9 aa, Mycobacterium tuberculosis
RLVRLSPHH

SEQ ID NO: 40228 - protein, 9 aa, Mycobacterium tuberculosis
LVRLSPHHR

SEQ ID NO: 40229 - protein, 9 aa, Mycobacterium tuberculosis
VRLSPHHRE

SEQ ID NO: 40230 - protein, 9 aa, Mycobacterium tuberculosis
RLSPHHREY

SEQ ID NO: 40231 - protein, 9 aa, Mycobacterium tuberculosis
LSPHHREYL

SEQ ID NO: 40232 - protein, 9 aa, Mycobacterium tuberculosis
SPHHREYLQ

SEQ ID NO: 40233 - protein, 9 aa, Mycobacterium tuberculosis
PHHREYLQR

SEQ ID NO: 40234 - protein, 9 aa, Mycobacterium tuberculosis
HHREYLQRW

SEQ ID NO: 40235 - protein, 9 aa, Mycobacterium tuberculosis
HREYLQRWF

SEQ ID NO: 40236 - protein, 9 aa, Mycobacterium tuberculosis
REYLQRWFR

SEQ ID NO: 40237 - protein, 9 aa, Mycobacterium tuberculosis
EYLQRWFRG

SEQ ID NO: 40238 - protein, 10 aa, Mycobacterium tuberculosis
MSVGFVTPVG

SEQ ID NO: 40239 - protein, 10 aa, Mycobacterium tuberculosis
SVGFVTPVGV

SEQ ID NO: 40240 - protein, 10 aa, Mycobacterium tuberculosis
VGFVTPVGVR

SEQ ID NO: 40241 - protein, 10 aa, Mycobacterium tuberculosis
GFVTPVGVRW

SEQ ID NO: 40242 - protein, 10 aa, Mycobacterium tuberculosis
FVTPVGVRWS

SEQ ID NO: 40243 - protein, 10 aa, Mycobacterium tuberculosis
VTPVGVRWSD

SEQ ID NO: 40244 - protein, 10 aa, Mycobacterium tuberculosis
TPVGVRWSDI

SEQ ID NO: 40245 - protein, 10 aa, Mycobacterium tuberculosis
PVGVRWSDID

SEQ ID NO: 40246 - protein, 10 aa, Mycobacterium tuberculosis
VGVRWSDIDM

SEQ ID NO: 40247 - protein, 10 aa, Mycobacterium tuberculosis
GVRWSDIDMY

SEQ ID NO: 40248 - protein, 10 aa, Mycobacterium tuberculosis
VRWSDIDMYQ

SEQ ID NO: 40249 - protein, 10 aa, Mycobacterium tuberculosis
RWSDIDMYQH

SEQ ID NO: 40250 - protein, 10 aa, Mycobacterium tuberculosis
WSDIDMYQHV

SEQ ID NO: 40251 - protein, 10 aa, Mycobacterium tuberculosis
SDIDMYQHVN

SEQ ID NO: 40252 - protein, 10 aa, Mycobacterium tuberculosis
DIDMYQHVNH

SEQ ID NO: 40253 - protein, 10 aa, Mycobacterium tuberculosis
IDMYQHVNHA

SEQ ID NO: 40254 - protein, 10 aa, Mycobacterium tuberculosis
DMYQHVNHAT

SEQ ID NO: 40255 - protein, 10 aa, Mycobacterium tuberculosis
MYQHVNHATM

SEQ ID NO: 40256 - protein, 10 aa, Mycobacterium tuberculosis
YQHVNHATMV

SEQ ID NO: 40257 - protein, 10 aa, Mycobacterium tuberculosis
QHVNHATMVT

SEQ ID NO: 40258 - protein, 10 aa, Mycobacterium tuberculosis
HVNHATMVTI

SEQ ID NO: 40259 - protein, 10 aa, Mycobacterium tuberculosis
VNHATMVTIL

SEQ ID NO: 40260 - protein, 10 aa, Mycobacterium tuberculosis
NHATMVTILE

SEQ ID NO: 40261 - protein, 10 aa, Mycobacterium tuberculosis
HATMVTILEE

SEQ ID NO: 40262 - protein, 10 aa, Mycobacterium tuberculosis
ATMVTILEEA

SEQ ID NO: 40263 - protein, 10 aa, Mycobacterium tuberculosis
TMVTILEEAR

SEQ ID NO: 40264 - protein, 10 aa, Mycobacterium tuberculosis
MVTILEEARV

SEQ ID NO: 40265 - protein, 10 aa, Mycobacterium tuberculosis
VTILEEARVP

SEQ ID NO: 40266 - protein, 10 aa, Mycobacterium tuberculosis
TILEEARVPF

SEQ ID NO: 40267 - protein, 10 aa, Mycobacterium tuberculosis
ILEEARVPFL

SEQ ID NO: 40268 - protein, 10 aa, Mycobacterium tuberculosis
LEEARVPFLK

SEQ ID NO: 40269 - protein, 10 aa, Mycobacterium tuberculosis
EEARVPFLKD

SEQ ID NO: 40270 - protein, 10 aa, Mycobacterium tuberculosis
EARVPFLKDA

SEQ ID NO: 40271 - protein, 10 aa, Mycobacterium tuberculosis
ARVPFLKDAF

SEQ ID NO: 40272 - protein, 10 aa, Mycobacterium tuberculosis
RVPFLKDAFG

SEQ ID NO: 40273 - protein, 10 aa, Mycobacterium tuberculosis
VPFLKDAFGA

SEQ ID NO: 40274 - protein, 10 aa, Mycobacterium tuberculosis
PFLKDAFGAD

SEQ ID NO: 40275 - protein, 10 aa, Mycobacterium tuberculosis
FLKDAFGADI

SEQ ID NO: 40276 - protein, 10 aa, Mycobacterium tuberculosis
LKDAFGADIT

SEQ ID NO: 40277 - protein, 10 aa, Mycobacterium tuberculosis
KDAFGADITS

SEQ ID NO: 40278 - protein, 10 aa, Mycobacterium tuberculosis
DAFGADITST

SEQ ID NO: 40279 - protein, 10 aa, Mycobacterium tuberculosis
AFGADITSTG

SEQ ID NO: 40280 - protein, 10 aa, Mycobacterium tuberculosis
FGADITSTGL

SEQ ID NO: 40281 - protein, 10 aa, Mycobacterium tuberculosis
GADITSTGLL

SEQ ID NO: 40282 - protein, 10 aa, Mycobacterium tuberculosis
ADITSTGLLI

SEQ ID NO: 40283 - protein, 10 aa, Mycobacterium tuberculosis
DITSTGLLIA

SEQ ID NO: 40284 - protein, 10 aa, Mycobacterium tuberculosis
ITSTGLLIAD

SEQ ID NO: 40285 - protein, 10 aa, Mycobacterium tuberculosis
TSTGLLIADV

SEQ ID NO: 40286 - protein, 10 aa, Mycobacterium tuberculosis
STGLLIADVR

SEQ ID NO: 40287 - protein, 10 aa, Mycobacterium tuberculosis
TGLLIADVRV

SEQ ID NO: 40288 - protein, 10 aa, Mycobacterium tuberculosis
GLLIADVRVT

SEQ ID NO: 40289 - protein, 10 aa, Mycobacterium tuberculosis
LLIADVRVTY

SEQ ID NO: 40290 - protein, 10 aa, Mycobacterium tuberculosis
LIADVRVTYK

SEQ ID NO: 40291 - protein, 10 aa, Mycobacterium tuberculosis
IADVRVTYKG

SEQ ID NO: 40292 - protein, 10 aa, Mycobacterium tuberculosis
ADVRVTYKGQ

SEQ ID NO: 40293 - protein, 10 aa, Mycobacterium tuberculosis
DVRVTYKGQL

SEQ ID NO: 40294 - protein, 10 aa, Mycobacterium tuberculosis
VRVTYKGQLR

SEQ ID NO: 40295 - protein, 10 aa, Mycobacterium tuberculosis
RVTYKGQLRL

SEQ ID NO: 40296 - protein, 10 aa, Mycobacterium tuberculosis
VTYKGQLRLS

SEQ ID NO: 40297 - protein, 10 aa, Mycobacterium tuberculosis
TYKGQLRLSD

SEQ ID NO: 40298 - protein, 10 aa, Mycobacterium tuberculosis
YKGQLRLSDS

SEQ ID NO: 40299 - protein, 10 aa, Mycobacterium tuberculosis
KGQLRLSDSP

SEQ ID NO: 40300 - protein, 10 aa, Mycobacterium tuberculosis
GQLRLSDSPL

SEQ ID NO: 40301 - protein, 10 aa, Mycobacterium tuberculosis
QLRLSDSPLQ

SEQ ID NO: 40302 - protein, 10 aa, Mycobacterium tuberculosis
LRLSDSPLQV

SEQ ID NO: 40303 - protein, 10 aa, Mycobacterium tuberculosis
RLSDSPLQVT

SEQ ID NO: 40304 - protein, 10 aa, Mycobacterium tuberculosis
LSDSPLQVTI

SEQ ID NO: 40305 - protein, 10 aa, Mycobacterium tuberculosis
SDSPLQVTIW

SEQ ID NO: 40306 - protein, 10 aa, Mycobacterium tuberculosis
DSPLQVTIWT

SEQ ID NO: 40307 - protein, 10 aa, Mycobacterium tuberculosis
SPLQVTIWTK

SEQ ID NO: 40308 - protein, 10 aa, Mycobacterium tuberculosis
PLQVTIWTKR

SEQ ID NO: 40309 - protein, 10 aa, Mycobacterium tuberculosis
LQVTIWTKRL

SEQ ID NO: 40310 - protein, 10 aa, Mycobacterium tuberculosis
QVTIWTKRLR

SEQ ID NO: 40311 - protein, 10 aa, Mycobacterium tuberculosis
VTIWTKRLRA

SEQ ID NO: 40312 - protein, 10 aa, Mycobacterium tuberculosis
TIWTKRLRAV

SEQ ID NO: 40313 - protein, 10 aa, Mycobacterium tuberculosis
IWTKRLRAVD

SEQ ID NO: 40314 - protein, 10 aa, Mycobacterium tuberculosis
WTKRLRAVDF

SEQ ID NO: 40315 - protein, 10 aa, Mycobacterium tuberculosis
TKRLRAVDFT

SEQ ID NO: 40316 - protein, 10 aa, Mycobacterium tuberculosis
KRLRAVDFTL

SEQ ID NO: 40317 - protein, 10 aa, Mycobacterium tuberculosis
RLRAVDFTLG

SEQ ID NO: 40318 - protein, 10 aa, Mycobacterium tuberculosis
LRAVDFTLGY

SEQ ID NO: 40319 - protein, 10 aa, Mycobacterium tuberculosis
RAVDFTLGYE

SEQ ID NO: 40320 - protein, 10 aa, Mycobacterium tuberculosis
AVDFTLGYEV

SEQ ID NO: 40321 - protein, 10 aa, Mycobacterium tuberculosis
VDFTLGYEVR

SEQ ID NO: 40322 - protein, 10 aa, Mycobacterium tuberculosis
DFTLGYEVRS

SEQ ID NO: 40323 - protein, 10 aa, Mycobacterium tuberculosis
FTLGYEVRSV

SEQ ID NO: 40324 - protein, 10 aa, Mycobacterium tuberculosis
TLGYEVRSVN

SEQ ID NO: 40325 - protein, 10 aa, Mycobacterium tuberculosis
LGYEVRSVNA

SEQ ID NO: 40326 - protein, 10 aa, Mycobacterium tuberculosis
GYEVRSVNAE

SEQ ID NO: 40327 - protein, 10 aa, Mycobacterium tuberculosis
YEVRSVNAEP

SEQ ID NO: 40328 - protein, 10 aa, Mycobacterium tuberculosis
EVRSVNAEPD

SEQ ID NO: 40329 - protein, 10 aa, Mycobacterium tuberculosis
VRSVNAEPDS

SEQ ID NO: 40330 - protein, 10 aa, Mycobacterium tuberculosis
RSVNAEPDSR

SEQ ID NO: 40331 - protein, 10 aa, Mycobacterium tuberculosis
SVNAEPDSRP

SEQ ID NO: 40332 - protein, 10 aa, Mycobacterium tuberculosis
VNAEPDSRPA

SEQ ID NO: 40333 - protein, 10 aa, Mycobacterium tuberculosis
NAEPDSRPAV

SEQ ID NO: 40334 - protein, 10 aa, Mycobacterium tuberculosis
AEPDSRPAVI

SEQ ID NO: 40335 - protein, 10 aa, Mycobacterium tuberculosis
EPDSRPAVIA

SEQ ID NO: 40336 - protein, 10 aa, Mycobacterium tuberculosis
PDSRPAVIAE

SEQ ID NO: 40337 - protein, 10 aa, Mycobacterium tuberculosis
DSRPAVIAES

SEQ ID NO: 40338 - protein, 10 aa, Mycobacterium tuberculosis
SRPAVIAESQ

SEQ ID NO: 40339 - protein, 10 aa, Mycobacterium tuberculosis
RPAVIAESQL

SEQ ID NO: 40340 - protein, 10 aa, Mycobacterium tuberculosis
PAVIAESQLA

SEQ ID NO: 40341 - protein, 10 aa, Mycobacterium tuberculosis
AVIAESQLAA

SEQ ID NO: 40342 - protein, 10 aa, Mycobacterium tuberculosis
VIAESQLAAF

SEQ ID NO: 40343 - protein, 10 aa, Mycobacterium tuberculosis
IAESQLAAFH

SEQ ID NO: 40344 - protein, 10 aa, Mycobacterium tuberculosis
AESQLAAFHI

SEQ ID NO: 40345 - protein, 10 aa, Mycobacterium tuberculosis
ESQLAAFHIE

SEQ ID NO: 40346 - protein, 10 aa, Mycobacterium tuberculosis
SQLAAFHIEE

SEQ ID NO: 40347 - protein, 10 aa, Mycobacterium tuberculosis
QLAAFHIEEQ

SEQ ID NO: 40348 - protein, 10 aa, Mycobacterium tuberculosis
LAAFHIEEQR

SEQ ID NO: 40349 - protein, 10 aa, Mycobacterium tuberculosis
AAFHIEEQRL

SEQ ID NO: 40350 - protein, 10 aa, Mycobacterium tuberculosis
AFHIEEQRLV

SEQ ID NO: 40351 - protein, 10 aa, Mycobacterium tuberculosis
FHIEEQRLVR

SEQ ID NO: 40352 - protein, 10 aa, Mycobacterium tuberculosis
HIEEQRLVRL

SEQ ID NO: 40353 - protein, 10 aa, Mycobacterium tuberculosis
IEEQRLVRLS

SEQ ID NO: 40354 - protein, 10 aa, Mycobacterium tuberculosis
EEQRLVRLSP

SEQ ID NO: 40355 - protein, 10 aa, Mycobacterium tuberculosis
EQRLVRLSPH

SEQ ID NO: 40356 - protein, 10 aa, Mycobacterium tuberculosis
QRLVRLSPHH

SEQ ID NO: 40357 - protein, 10 aa, Mycobacterium tuberculosis
RLVRLSPHHR

SEQ ID NO: 40358 - protein, 10 aa, Mycobacterium tuberculosis
LVRLSPHHRE

SEQ ID NO: 40359 - protein, 10 aa, Mycobacterium tuberculosis
VRLSPHHREY

SEQ ID NO: 40360 - protein, 10 aa, Mycobacterium tuberculosis
RLSPHHREYL

SEQ ID NO: 40361 - protein, 10 aa, Mycobacterium tuberculosis
LSPHHREYLQ

SEQ ID NO: 40362 - protein, 10 aa, Mycobacterium tuberculosis
SPHHREYLQR

SEQ ID NO: 40363 - protein, 10 aa, Mycobacterium tuberculosis
PHHREYLQRW

SEQ ID NO: 40364 - protein, 10 aa, Mycobacterium tuberculosis
HHREYLQRWF

SEQ ID NO: 40365 - protein, 10 aa, Mycobacterium tuberculosis
HREYLQRWFR

SEQ ID NO: 40366 - protein, 10 aa, Mycobacterium tuberculosis
REYLQRWFRG

SEQ ID NO: 40367 - protein, 11 aa, Mycobacterium tuberculosis
MSVGFVTPVGV

SEQ ID NO: 40368 - protein, 11 aa, Mycobacterium tuberculosis
SVGFVTPVGVR

SEQ ID NO: 40369 - protein, 11 aa, Mycobacterium tuberculosis
VGFVTPVGVRW

SEQ ID NO: 40370 - protein, 11 aa, Mycobacterium tuberculosis
GFVTPVGVRWS

SEQ ID NO: 40371 - protein, 11 aa, Mycobacterium tuberculosis
FVTPVGVRWSD

SEQ ID NO: 40372 - protein, 11 aa, Mycobacterium tuberculosis
VTPVGVRWSDI

SEQ ID NO: 40373 - protein, 11 aa, Mycobacterium tuberculosis
TPVGVRWSDID

SEQ ID NO: 40374 - protein, 11 aa, Mycobacterium tuberculosis
PVGVRWSDIDM

SEQ ID NO: 40375 - protein, 11 aa, Mycobacterium tuberculosis
VGVRWSDIDMY

SEQ ID NO: 40376 - protein, 11 aa, Mycobacterium tuberculosis
GVRWSDIDMYQ

SEQ ID NO: 40377 - protein, 11 aa, Mycobacterium tuberculosis
VRWSDIDMYQH

SEQ ID NO: 40378 - protein, 11 aa, Mycobacterium tuberculosis
RWSDIDMYQHV

SEQ ID NO: 40379 - protein, 11 aa, Mycobacterium tuberculosis
WSDIDMYQHVN

SEQ ID NO: 40380 - protein, 11 aa, Mycobacterium tuberculosis
SDIDMYQHVNH

SEQ ID NO: 40381 - protein, 11 aa, Mycobacterium tuberculosis
DIDMYQHVNHA

SEQ ID NO: 40382 - protein, 11 aa, Mycobacterium tuberculosis
IDMYQHVNHAT

SEQ ID NO: 40383 - protein, 11 aa, Mycobacterium tuberculosis
DMYQHVNHATM

SEQ ID NO: 40384 - protein, 11 aa, Mycobacterium tuberculosis
MYQHVNHATMV

SEQ ID NO: 40385 - protein, 11 aa, Mycobacterium tuberculosis
YQHVNHATMVT

SEQ ID NO: 40386 - protein, 11 aa, Mycobacterium tuberculosis
QHVNHATMVTI

SEQ ID NO: 40387 - protein, 11 aa, Mycobacterium tuberculosis
HVNHATMVTIL

SEQ ID NO: 40388 - protein, 11 aa, Mycobacterium tuberculosis
VNHATMVTILE

SEQ ID NO: 40389 - protein, 11 aa, Mycobacterium tuberculosis
NHATMVTILEE

SEQ ID NO: 40390 - protein, 11 aa, Mycobacterium tuberculosis
HATMVTILEEA

SEQ ID NO: 40391 - protein, 11 aa, Mycobacterium tuberculosis
ATMVTILEEAR

SEQ ID NO: 40392 - protein, 11 aa, Mycobacterium tuberculosis
TMVTILEEARV

SEQ ID NO: 40393 - protein, 11 aa, Mycobacterium tuberculosis
MVTILEEARVP

SEQ ID NO: 40394 - protein, 11 aa, Mycobacterium tuberculosis
VTILEEARVPF

SEQ ID NO: 40395 - protein, 11 aa, Mycobacterium tuberculosis
TILEEARVPFL

SEQ ID NO: 40396 - protein, 11 aa, Mycobacterium tuberculosis
ILEEARVPFLK

SEQ ID NO: 40397 - protein, 11 aa, Mycobacterium tuberculosis
LEEARVPFLKD

SEQ ID NO: 40398 - protein, 11 aa, Mycobacterium tuberculosis
EEARVPFLKDA

SEQ ID NO: 40399 - protein, 11 aa, Mycobacterium tuberculosis
EARVPFLKDAF

SEQ ID NO: 40400 - protein, 11 aa, Mycobacterium tuberculosis
ARVPFLKDAFG

SEQ ID NO: 40401 - protein, 11 aa, Mycobacterium tuberculosis
RVPFLKDAFGA

SEQ ID NO: 40402 - protein, 11 aa, Mycobacterium tuberculosis
VPFLKDAFGAD

SEQ ID NO: 40403 - protein, 11 aa, Mycobacterium tuberculosis
PFLKDAFGADI

SEQ ID NO: 40404 - protein, 11 aa, Mycobacterium tuberculosis
FLKDAFGADIT

SEQ ID NO: 40405 - protein, 11 aa, Mycobacterium tuberculosis
LKDAFGADITS

SEQ ID NO: 40406 - protein, 11 aa, Mycobacterium tuberculosis
KDAFGADITST

SEQ ID NO: 40407 - protein, 11 aa, Mycobacterium tuberculosis
DAFGADITSTG

SEQ ID NO: 40408 - protein, 11 aa, Mycobacterium tuberculosis
AFGADITSTGL

SEQ ID NO: 40409 - protein, 11 aa, Mycobacterium tuberculosis
FGADITSTGLL

SEQ ID NO: 40410 - protein, 11 aa, Mycobacterium tuberculosis
GADITSTGLLI

SEQ ID NO: 40411 - protein, 11 aa, Mycobacterium tuberculosis
ADITSTGLLIA

SEQ ID NO: 40412 - protein, 11 aa, Mycobacterium tuberculosis
DITSTGLLIAD

SEQ ID NO: 40413 - protein, 11 aa, Mycobacterium tuberculosis
ITSTGLLIADV

SEQ ID NO: 40414 - protein, 11 aa, Mycobacterium tuberculosis
TSTGLLIADVR

SEQ ID NO: 40415 - protein, 11 aa, Mycobacterium tuberculosis
STGLLIADVRV

SEQ ID NO: 40416 - protein, 11 aa, Mycobacterium tuberculosis
TGLLIADVRVT

SEQ ID NO: 40417 - protein, 11 aa, Mycobacterium tuberculosis
GLLIADVRVTY

SEQ ID NO: 40418 - protein, 11 aa, Mycobacterium tuberculosis
LLIADVRVTYK

SEQ ID NO: 40419 - protein, 11 aa, Mycobacterium tuberculosis
LIADVRVTYKG

SEQ ID NO: 40420 - protein, 11 aa, Mycobacterium tuberculosis
IADVRVTYKGQ

SEQ ID NO: 40421 - protein, 11 aa, Mycobacterium tuberculosis
ADVRVTYKGQL

SEQ ID NO: 40422 - protein, 11 aa, Mycobacterium tuberculosis
DVRVTYKGQLR

SEQ ID NO: 40423 - protein, 11 aa, Mycobacterium tuberculosis
VRVTYKGQLRL

SEQ ID NO: 40424 - protein, 11 aa, Mycobacterium tuberculosis
RVTYKGQLRLS

SEQ ID NO: 40425 - protein, 11 aa, Mycobacterium tuberculosis
VTYKGQLRLSD

SEQ ID NO: 40426 - protein, 11 aa, Mycobacterium tuberculosis
TYKGQLRLSDS

SEQ ID NO: 40427 - protein, 11 aa, Mycobacterium tuberculosis
YKGQLRLSDSP

SEQ ID NO: 40428 - protein, 11 aa, Mycobacterium tuberculosis
KGQLRLSDSPL

SEQ ID NO: 40429 - protein, 11 aa, Mycobacterium tuberculosis
GQLRLSDSPLQ

SEQ ID NO: 40430 - protein, 11 aa, Mycobacterium tuberculosis
QLRLSDSPLQV

SEQ ID NO: 40431 - protein, 11 aa, Mycobacterium tuberculosis
LRLSDSPLQVT

SEQ ID NO: 40432 - protein, 11 aa, Mycobacterium tuberculosis
RLSDSPLQVTI

SEQ ID NO: 40433 - protein, 11 aa, Mycobacterium tuberculosis
LSDSPLQVTIW

SEQ ID NO: 40434 - protein, 11 aa, Mycobacterium tuberculosis
SDSPLQVTIWT

SEQ ID NO: 40435 - protein, 11 aa, Mycobacterium tuberculosis
DSPLQVTIWTK

SEQ ID NO: 40436 - protein, 11 aa, Mycobacterium tuberculosis
SPLQVTIWTKR

SEQ ID NO: 40437 - protein, 11 aa, Mycobacterium tuberculosis
PLQVTIWTKRL

SEQ ID NO: 40438 - protein, 11 aa, Mycobacterium tuberculosis
LQVTIWTKRLR

SEQ ID NO: 40439 - protein, 11 aa, Mycobacterium tuberculosis
QVTIWTKRLRA

SEQ ID NO: 40440 - protein, 11 aa, Mycobacterium tuberculosis
VTIWTKRLRAV

SEQ ID NO: 40441 - protein, 11 aa, Mycobacterium tuberculosis
TIWTKRLRAVD

SEQ ID NO: 40442 - protein, 11 aa, Mycobacterium tuberculosis
IWTKRLRAVDF

SEQ ID NO: 40443 - protein, 11 aa, Mycobacterium tuberculosis
WTKRLRAVDFT

SEQ ID NO: 40444 - protein, 11 aa, Mycobacterium tuberculosis
TKRLRAVDFTL

SEQ ID NO: 40445 - protein, 11 aa, Mycobacterium tuberculosis
KRLRAVDFTLG

SEQ ID NO: 40446 - protein, 11 aa, Mycobacterium tuberculosis
RLRAVDFTLGY

SEQ ID NO: 40447 - protein, 11 aa, Mycobacterium tuberculosis
LRAVDFTLGYE

SEQ ID NO: 40448 - protein, 11 aa, Mycobacterium tuberculosis
RAVDFTLGYEV

SEQ ID NO: 40449 - protein, 11 aa, Mycobacterium tuberculosis
AVDFTLGYEVR

SEQ ID NO: 40450 - protein, 11 aa, Mycobacterium tuberculosis
VDFTLGYEVRS

SEQ ID NO: 40451 - protein, 11 aa, Mycobacterium tuberculosis
DFTLGYEVRSV

SEQ ID NO: 40452 - protein, 11 aa, Mycobacterium tuberculosis
FTLGYEVRSVN

SEQ ID NO: 40453 - protein, 11 aa, Mycobacterium tuberculosis
TLGYEVRSVNA

SEQ ID NO: 40454 - protein, 11 aa, Mycobacterium tuberculosis
LGYEVRSVNAE

SEQ ID NO: 40455 - protein, 11 aa, Mycobacterium tuberculosis
GYEVRSVNAEP

SEQ ID NO: 40456 - protein, 11 aa, Mycobacterium tuberculosis
YEVRSVNAEPD

SEQ ID NO: 40457 - protein, 11 aa, Mycobacterium tuberculosis
EVRSVNAEPDS

SEQ ID NO: 40458 - protein, 11 aa, Mycobacterium tuberculosis
VRSVNAEPDSR

SEQ ID NO: 40459 - protein, 11 aa, Mycobacterium tuberculosis
RSVNAEPDSRP

SEQ ID NO: 40460 - protein, 11 aa, Mycobacterium tuberculosis
SVNAEPDSRPA

SEQ ID NO: 40461 - protein, 11 aa, Mycobacterium tuberculosis
VNAEPDSRPAV

SEQ ID NO: 40462 - protein, 11 aa, Mycobacterium tuberculosis
NAEPDSRPAVI

SEQ ID NO: 40463 - protein, 11 aa, Mycobacterium tuberculosis
AEPDSRPAVIA

SEQ ID NO: 40464 - protein, 11 aa, Mycobacterium tuberculosis
EPDSRPAVIAE

SEQ ID NO: 40465 - protein, 11 aa, Mycobacterium tuberculosis
PDSRPAVIAES

SEQ ID NO: 40466 - protein, 11 aa, Mycobacterium tuberculosis
DSRPAVIAESQ

SEQ ID NO: 40467 - protein, 11 aa, Mycobacterium tuberculosis
SRPAVIAESQL

SEQ ID NO: 40468 - protein, 11 aa, Mycobacterium tuberculosis
RPAVIAESQLA

SEQ ID NO: 40469 - protein, 11 aa, Mycobacterium tuberculosis
PAVIAESQLAA

SEQ ID NO: 40470 - protein, 11 aa, Mycobacterium tuberculosis
AVIAESQLAAF

SEQ ID NO: 40471 - protein, 11 aa, Mycobacterium tuberculosis
VIAESQLAAFH

SEQ ID NO: 40472 - protein, 11 aa, Mycobacterium tuberculosis
IAESQLAAFHI

SEQ ID NO: 40473 - protein, 11 aa, Mycobacterium tuberculosis
AESQLAAFHIE

SEQ ID NO: 40474 - protein, 11 aa, Mycobacterium tuberculosis
ESQLAAFHIEE

SEQ ID NO: 40475 - protein, 11 aa, Mycobacterium tuberculosis
SQLAAFHIEEQ

SEQ ID NO: 40476 - protein, 11 aa, Mycobacterium tuberculosis
QLAAFHIEEQR

SEQ ID NO: 40477 - protein, 11 aa, Mycobacterium tuberculosis
LAAFHIEEQRL

SEQ ID NO: 40478 - protein, 11 aa, Mycobacterium tuberculosis
AAFHIEEQRLV

SEQ ID NO: 40479 - protein, 11 aa, Mycobacterium tuberculosis
AFHIEEQRLVR

SEQ ID NO: 40480 - protein, 11 aa, Mycobacterium tuberculosis
FHIEEQRLVRL

SEQ ID NO: 40481 - protein, 11 aa, Mycobacterium tuberculosis
HIEEQRLVRLS

SEQ ID NO: 40482 - protein, 11 aa, Mycobacterium tuberculosis
IEEQRLVRLSP

SEQ ID NO: 40483 - protein, 11 aa, Mycobacterium tuberculosis
EEQRLVRLSPH

SEQ ID NO: 40484 - protein, 11 aa, Mycobacterium tuberculosis
EQRLVRLSPHH

SEQ ID NO: 40485 - protein, 11 aa, Mycobacterium tuberculosis
QRLVRLSPHHR

SEQ ID NO: 40486 - protein, 11 aa, Mycobacterium tuberculosis
RLVRLSPHHRE

SEQ ID NO: 40487 - protein, 11 aa, Mycobacterium tuberculosis
LVRLSPHHREY

SEQ ID NO: 40488 - protein, 11 aa, Mycobacterium tuberculosis
VRLSPHHREYL

SEQ ID NO: 40489 - protein, 11 aa, Mycobacterium tuberculosis
RLSPHHREYLQ

SEQ ID NO: 40490 - protein, 11 aa, Mycobacterium tuberculosis
LSPHHREYLQR

SEQ ID NO: 40491 - protein, 11 aa, Mycobacterium tuberculosis
SPHHREYLQRW

SEQ ID NO: 40492 - protein, 11 aa, Mycobacterium tuberculosis
PHHREYLQRWF

SEQ ID NO: 40493 - protein, 11 aa, Mycobacterium tuberculosis
HHREYLQRWFR

SEQ ID NO: 40494 - protein, 11 aa, Mycobacterium tuberculosis
HREYLQRWFRG

SEQ ID NO: 40495 - protein, 8 aa, Mycobacterium tuberculosis
MSQIMYNY

SEQ ID NO: 40496 - protein, 8 aa, Mycobacterium tuberculosis
SQIMYNYP

SEQ ID NO: 40497 - protein, 8 aa, Mycobacterium tuberculosis
QIMYNYPA

SEQ ID NO: 40498 - protein, 8 aa, Mycobacterium tuberculosis
IMYNYPAM

SEQ ID NO: 40499 - protein, 8 aa, Mycobacterium tuberculosis
MYNYPAMM

SEQ ID NO: 40500 - protein, 8 aa, Mycobacterium tuberculosis
YNYPAMMA

SEQ ID NO: 40501 - protein, 8 aa, Mycobacterium tuberculosis
NYPAMMAH

SEQ ID NO: 40502 - protein, 8 aa, Mycobacterium tuberculosis
YPAMMAHA

SEQ ID NO: 40503 - protein, 8 aa, Mycobacterium tuberculosis
PAMMAHAG

SEQ ID NO: 40504 - protein, 8 aa, Mycobacterium tuberculosis
AMMAHAGD

SEQ ID NO: 40505 - protein, 8 aa, Mycobacterium tuberculosis
MMAHAGDM

SEQ ID NO: 40506 - protein, 8 aa, Mycobacterium tuberculosis
MAHAGDMA

SEQ ID NO: 40507 - protein, 8 aa, Mycobacterium tuberculosis
AHAGDMAG

SEQ ID NO: 40508 - protein, 8 aa, Mycobacterium tuberculosis
HAGDMAGY

SEQ ID NO: 40509 - protein, 8 aa, Mycobacterium tuberculosis
AGDMAGYA

SEQ ID NO: 40510 - protein, 8 aa, Mycobacterium tuberculosis
GDMAGYAG

SEQ ID NO: 40511 - protein, 8 aa, Mycobacterium tuberculosis
DMAGYAGT

SEQ ID NO: 40512 - protein, 8 aa, Mycobacterium tuberculosis
MAGYAGTL

SEQ ID NO: 40513 - protein, 8 aa, Mycobacterium tuberculosis
AGYAGTLQ

SEQ ID NO: 40514 - protein, 8 aa, Mycobacterium tuberculosis
GYAGTLQS

SEQ ID NO: 40515 - protein, 8 aa, Mycobacterium tuberculosis
YAGTLQSL

SEQ ID NO: 40516 - protein, 8 aa, Mycobacterium tuberculosis
AGTLQSLG

SEQ ID NO: 40517 - protein, 8 aa, Mycobacterium tuberculosis
GTLQSLGA

SEQ ID NO: 40518 - protein, 8 aa, Mycobacterium tuberculosis
TLQSLGAD

SEQ ID NO: 40519 - protein, 8 aa, Mycobacterium tuberculosis
LQSLGADI

SEQ ID NO: 40520 - protein, 8 aa, Mycobacterium tuberculosis
QSLGADIA

SEQ ID NO: 40521 - protein, 8 aa, Mycobacterium tuberculosis
SLGADIAS

SEQ ID NO: 40522 - protein, 8 aa, Mycobacterium tuberculosis
LGADIASE

SEQ ID NO: 40523 - protein, 8 aa, Mycobacterium tuberculosis
GADIASEQ

SEQ ID NO: 40524 - protein, 8 aa, Mycobacterium tuberculosis
ADIASEQA

SEQ ID NO: 40525 - protein, 8 aa, Mycobacterium tuberculosis
DIASEQAV

SEQ ID NO: 40526 - protein, 8 aa, Mycobacterium tuberculosis
IASEQAVL

SEQ ID NO: 40527 - protein, 8 aa, Mycobacterium tuberculosis
ASEQAVLS

SEQ ID NO: 40528 - protein, 8 aa, Mycobacterium tuberculosis
SEQAVLSS

SEQ ID NO: 40529 - protein, 8 aa, Mycobacterium tuberculosis
EQAVLSSA

SEQ ID NO: 40530 - protein, 8 aa, Mycobacterium tuberculosis
QAVLSSAW

SEQ ID NO: 40531 - protein, 8 aa, Mycobacterium tuberculosis
AVLSSAWQ

SEQ ID NO: 40532 - protein, 8 aa, Mycobacterium tuberculosis
VLSSAWQG

SEQ ID NO: 40533 - protein, 8 aa, Mycobacterium tuberculosis
LSSAWQGD

SEQ ID NO: 40534 - protein, 8 aa, Mycobacterium tuberculosis
SSAWQGDT

SEQ ID NO: 40535 - protein, 8 aa, Mycobacterium tuberculosis
SAWQGDTG

SEQ ID NO: 40536 - protein, 8 aa, Mycobacterium tuberculosis
AWQGDTGI

SEQ ID NO: 40537 - protein, 8 aa, Mycobacterium tuberculosis
WQGDTGIT

SEQ ID NO: 40538 - protein, 8 aa, Mycobacterium tuberculosis
QGDTGITY

SEQ ID NO: 40539 - protein, 8 aa, Mycobacterium tuberculosis
GDTGITYQ

SEQ ID NO: 40540 - protein, 8 aa, Mycobacterium tuberculosis
DTGITYQG

SEQ ID NO: 40541 - protein, 8 aa, Mycobacterium tuberculosis
TGITYQGW

SEQ ID NO: 40542 - protein, 8 aa, Mycobacterium tuberculosis
GITYQGWQ

SEQ ID NO: 40543 - protein, 8 aa, Mycobacterium tuberculosis
ITYQGWQT

SEQ ID NO: 40544 - protein, 8 aa, Mycobacterium tuberculosis
TYQGWQTQ

SEQ ID NO: 40545 - protein, 8 aa, Mycobacterium tuberculosis
YQGWQTQW

SEQ ID NO: 40546 - protein, 8 aa, Mycobacterium tuberculosis
QGWQTQWN

SEQ ID NO: 40547 - protein, 8 aa, Mycobacterium tuberculosis
GWQTQWNQ

SEQ ID NO: 40548 - protein, 8 aa, Mycobacterium tuberculosis
WQTQWNQA

SEQ ID NO: 40549 - protein, 8 aa, Mycobacterium tuberculosis
QTQWNQAL

SEQ ID NO: 40550 - protein, 8 aa, Mycobacterium tuberculosis
TQWNQALE

SEQ ID NO: 40551 - protein, 8 aa, Mycobacterium tuberculosis
QWNQALED

SEQ ID NO: 40552 - protein, 8 aa, Mycobacterium tuberculosis
WNQALEDL

SEQ ID NO: 40553 - protein, 8 aa, Mycobacterium tuberculosis
NQALEDLV

SEQ ID NO: 40554 - protein, 8 aa, Mycobacterium tuberculosis
QALEDLVR

SEQ ID NO: 40555 - protein, 8 aa, Mycobacterium tuberculosis
ALEDLVRA

SEQ ID NO: 40556 - protein, 8 aa, Mycobacterium tuberculosis
LEDLVRAY

SEQ ID NO: 40557 - protein, 8 aa, Mycobacterium tuberculosis
EDLVRAYQ

SEQ ID NO: 40558 - protein, 8 aa, Mycobacterium tuberculosis
DLVRAYQS

SEQ ID NO: 40559 - protein, 8 aa, Mycobacterium tuberculosis
LVRAYQSM

SEQ ID NO: 40560 - protein, 8 aa, Mycobacterium tuberculosis
VRAYQSMS

SEQ ID NO: 40561 - protein, 8 aa, Mycobacterium tuberculosis
RAYQSMSG

SEQ ID NO: 40562 - protein, 8 aa, Mycobacterium tuberculosis
AYQSMSGT

SEQ ID NO: 40563 - protein, 8 aa, Mycobacterium tuberculosis
YQSMSGTH

SEQ ID NO: 40564 - protein, 8 aa, Mycobacterium tuberculosis
QSMSGTHE

SEQ ID NO: 40565 - protein, 8 aa, Mycobacterium tuberculosis
SMSGTHES

SEQ ID NO: 40566 - protein, 8 aa, Mycobacterium tuberculosis
MSGTHESN

SEQ ID NO: 40567 - protein, 8 aa, Mycobacterium tuberculosis
SGTHESNT

SEQ ID NO: 40568 - protein, 8 aa, Mycobacterium tuberculosis
GTHESNTM

SEQ ID NO: 40569 - protein, 8 aa, Mycobacterium tuberculosis
THESNTMA

SEQ ID NO: 40570 - protein, 8 aa, Mycobacterium tuberculosis
HESNTMAM

SEQ ID NO: 40571 - protein, 8 aa, Mycobacterium tuberculosis
ESNTMAML

SEQ ID NO: 40572 - protein, 8 aa, Mycobacterium tuberculosis
SNTMAMLA

SEQ ID NO: 40573 - protein, 8 aa, Mycobacterium tuberculosis
NTMAMLAR

SEQ ID NO: 40574 - protein, 8 aa, Mycobacterium tuberculosis
TMAMLARD

SEQ ID NO: 40575 - protein, 8 aa, Mycobacterium tuberculosis
MAMLARDG

SEQ ID NO: 40576 - protein, 8 aa, Mycobacterium tuberculosis
AMLARDGA

SEQ ID NO: 40577 - protein, 8 aa, Mycobacterium tuberculosis
MLARDGAE

SEQ ID NO: 40578 - protein, 8 aa, Mycobacterium tuberculosis
LARDGAEA

SEQ ID NO: 40579 - protein, 8 aa, Mycobacterium tuberculosis
ARDGAEAA

SEQ ID NO: 40580 - protein, 8 aa, Mycobacterium tuberculosis
RDGAEAAK

SEQ ID NO: 40581 - protein, 8 aa, Mycobacterium tuberculosis
DGAEAAKW

SEQ ID NO: 40582 - protein, 8 aa, Mycobacterium tuberculosis
GAEAAKWG

SEQ ID NO: 40583 - protein, 8 aa, Mycobacterium tuberculosis
AEAAKWGG

SEQ ID NO: 40584 - protein, 9 aa, Mycobacterium tuberculosis
MSQIMYNYP

SEQ ID NO: 40585 - protein, 9 aa, Mycobacterium tuberculosis
SQIMYNYPA

SEQ ID NO: 40586 - protein, 9 aa, Mycobacterium tuberculosis
QIMYNYPAM

SEQ ID NO: 40587 - protein, 9 aa, Mycobacterium tuberculosis
IMYNYPAMM

SEQ ID NO: 40588 - protein, 9 aa, Mycobacterium tuberculosis
MYNYPAMMA

SEQ ID NO: 40589 - protein, 9 aa, Mycobacterium tuberculosis
YNYPAMMAH

SEQ ID NO: 40590 - protein, 9 aa, Mycobacterium tuberculosis
NYPAMMAHA

SEQ ID NO: 40591 - protein, 9 aa, Mycobacterium tuberculosis
YPAMMAHAG

SEQ ID NO: 40592 - protein, 9 aa, Mycobacterium tuberculosis
PAMMAHAGD

SEQ ID NO: 40593 - protein, 9 aa, Mycobacterium tuberculosis
AMMAHAGDM

SEQ ID NO: 40594 - protein, 9 aa, Mycobacterium tuberculosis
MMAHAGDMA

SEQ ID NO: 40595 - protein, 9 aa, Mycobacterium tuberculosis
MAHAGDMAG

SEQ ID NO: 40596 - protein, 9 aa, Mycobacterium tuberculosis
AHAGDMAGY

SEQ ID NO: 40597 - protein, 9 aa, Mycobacterium tuberculosis
HAGDMAGYA

SEQ ID NO: 40598 - protein, 9 aa, Mycobacterium tuberculosis
AGDMAGYAG

SEQ ID NO: 40599 - protein, 9 aa, Mycobacterium tuberculosis
GDMAGYAGT

SEQ ID NO: 40600 - protein, 9 aa, Mycobacterium tuberculosis
DMAGYAGTL

SEQ ID NO: 40601 - protein, 9 aa, Mycobacterium tuberculosis
MAGYAGTLQ

SEQ ID NO: 40602 - protein, 9 aa, Mycobacterium tuberculosis
AGYAGTLQS

SEQ ID NO: 40603 - protein, 9 aa, Mycobacterium tuberculosis
GYAGTLQSL

SEQ ID NO: 40604 - protein, 9 aa, Mycobacterium tuberculosis
YAGTLQSLG

SEQ ID NO: 40605 - protein, 9 aa, Mycobacterium tuberculosis
AGTLQSLGA

SEQ ID NO: 40606 - protein, 9 aa, Mycobacterium tuberculosis
GTLQSLGAD

SEQ ID NO: 40607 - protein, 9 aa, Mycobacterium tuberculosis
TLQSLGADI

SEQ ID NO: 40608 - protein, 9 aa, Mycobacterium tuberculosis
LQSLGADIA

SEQ ID NO: 40609 - protein, 9 aa, Mycobacterium tuberculosis
QSLGADIAS

SEQ ID NO: 40610 - protein, 9 aa, Mycobacterium tuberculosis
SLGADIASE

SEQ ID NO: 40611 - protein, 9 aa, Mycobacterium tuberculosis
LGADIASEQ

SEQ ID NO: 40612 - protein, 9 aa, Mycobacterium tuberculosis
GADIASEQA

SEQ ID NO: 40613 - protein, 9 aa, Mycobacterium tuberculosis
ADIASEQAV

SEQ ID NO: 40614 - protein, 9 aa, Mycobacterium tuberculosis
DIASEQAVL

SEQ ID NO: 40615 - protein, 9 aa, Mycobacterium tuberculosis
IASEQAVLS

SEQ ID NO: 40616 - protein, 9 aa, Mycobacterium tuberculosis
ASEQAVLSS

SEQ ID NO: 40617 - protein, 9 aa, Mycobacterium tuberculosis
SEQAVLSSA

SEQ ID NO: 40618 - protein, 9 aa, Mycobacterium tuberculosis
EQAVLSSAW

SEQ ID NO: 40619 - protein, 9 aa, Mycobacterium tuberculosis
QAVLSSAWQ

SEQ ID NO: 40620 - protein, 9 aa, Mycobacterium tuberculosis
AVLSSAWQG

SEQ ID NO: 40621 - protein, 9 aa, Mycobacterium tuberculosis
VLSSAWQGD

SEQ ID NO: 40622 - protein, 9 aa, Mycobacterium tuberculosis
LSSAWQGDT

SEQ ID NO: 40623 - protein, 9 aa, Mycobacterium tuberculosis
SSAWQGDTG

SEQ ID NO: 40624 - protein, 9 aa, Mycobacterium tuberculosis
SAWQGDTGI

SEQ ID NO: 40625 - protein, 9 aa, Mycobacterium tuberculosis
AWQGDTGIT

SEQ ID NO: 40626 - protein, 9 aa, Mycobacterium tuberculosis
WQGDTGITY

SEQ ID NO: 40627 - protein, 9 aa, Mycobacterium tuberculosis
QGDTGITYQ

SEQ ID NO: 40628 - protein, 9 aa, Mycobacterium tuberculosis
GDTGITYQG

SEQ ID NO: 40629 - protein, 9 aa, Mycobacterium tuberculosis
DTGITYQGW

SEQ ID NO: 40630 - protein, 9 aa, Mycobacterium tuberculosis
TGITYQGWQ

SEQ ID NO: 40631 - protein, 9 aa, Mycobacterium tuberculosis
GITYQGWQT

SEQ ID NO: 40632 - protein, 9 aa, Mycobacterium tuberculosis
ITYQGWQTQ

SEQ ID NO: 40633 - protein, 9 aa, Mycobacterium tuberculosis
TYQGWQTQW

SEQ ID NO: 40634 - protein, 9 aa, Mycobacterium tuberculosis
YQGWQTQWN

SEQ ID NO: 40635 - protein, 9 aa, Mycobacterium tuberculosis
QGWQTQWNQ

SEQ ID NO: 40636 - protein, 9 aa, Mycobacterium tuberculosis
GWQTQWNQA

SEQ ID NO: 40637 - protein, 9 aa, Mycobacterium tuberculosis
WQTQWNQAL

SEQ ID NO: 40638 - protein, 9 aa, Mycobacterium tuberculosis
QTQWNQALE

SEQ ID NO: 40639 - protein, 9 aa, Mycobacterium tuberculosis
TQWNQALED

SEQ ID NO: 40640 - protein, 9 aa, Mycobacterium tuberculosis
QWNQALEDL

SEQ ID NO: 40641 - protein, 9 aa, Mycobacterium tuberculosis
WNQALEDLV

SEQ ID NO: 40642 - protein, 9 aa, Mycobacterium tuberculosis
NQALEDLVR

SEQ ID NO: 40643 - protein, 9 aa, Mycobacterium tuberculosis
QALEDLVRA

SEQ ID NO: 40644 - protein, 9 aa, Mycobacterium tuberculosis
ALEDLVRAY

SEQ ID NO: 40645 - protein, 9 aa, Mycobacterium tuberculosis
LEDLVRAYQ

SEQ ID NO: 40646 - protein, 9 aa, Mycobacterium tuberculosis
EDLVRAYQS

SEQ ID NO: 40647 - protein, 9 aa, Mycobacterium tuberculosis
DLVRAYQSM

SEQ ID NO: 40648 - protein, 9 aa, Mycobacterium tuberculosis
LVRAYQSMS

SEQ ID NO: 40649 - protein, 9 aa, Mycobacterium tuberculosis
VRAYQSMSG

SEQ ID NO: 40650 - protein, 9 aa, Mycobacterium tuberculosis
RAYQSMSGT

SEQ ID NO: 40651 - protein, 9 aa, Mycobacterium tuberculosis
AYQSMSGTH

SEQ ID NO: 40652 - protein, 9 aa, Mycobacterium tuberculosis
YQSMSGTHE

SEQ ID NO: 40653 - protein, 9 aa, Mycobacterium tuberculosis
QSMSGTHES

SEQ ID NO: 40654 - protein, 9 aa, Mycobacterium tuberculosis
SMSGTHESN

SEQ ID NO: 40655 - protein, 9 aa, Mycobacterium tuberculosis
MSGTHESNT

SEQ ID NO: 40656 - protein, 9 aa, Mycobacterium tuberculosis
SGTHESNTM

SEQ ID NO: 40657 - protein, 9 aa, Mycobacterium tuberculosis
GTHESNTMA

SEQ ID NO: 40658 - protein, 9 aa, Mycobacterium tuberculosis
THESNTMAM

SEQ ID NO: 40659 - protein, 9 aa, Mycobacterium tuberculosis
HESNTMAML

SEQ ID NO: 40660 - protein, 9 aa, Mycobacterium tuberculosis
ESNTMAMLA

SEQ ID NO: 40661 - protein, 9 aa, Mycobacterium tuberculosis
SNTMAMLAR

SEQ ID NO: 40662 - protein, 9 aa, Mycobacterium tuberculosis
NTMAMLARD

SEQ ID NO: 40663 - protein, 9 aa, Mycobacterium tuberculosis
TMAMLARDG

SEQ ID NO: 40664 - protein, 9 aa, Mycobacterium tuberculosis
MAMLARDGA

SEQ ID NO: 40665 - protein, 9 aa, Mycobacterium tuberculosis
AMLARDGAE

SEQ ID NO: 40666 - protein, 9 aa, Mycobacterium tuberculosis
MLARDGAEA

SEQ ID NO: 40667 - protein, 9 aa, Mycobacterium tuberculosis
LARDGAEAA

SEQ ID NO: 40668 - protein, 9 aa, Mycobacterium tuberculosis
ARDGAEAAK

SEQ ID NO: 40669 - protein, 9 aa, Mycobacterium tuberculosis
RDGAEAAKW

SEQ ID NO: 40670 - protein, 9 aa, Mycobacterium tuberculosis
DGAEAAKWG

SEQ ID NO: 40671 - protein, 9 aa, Mycobacterium tuberculosis
GAEAAKWGG

SEQ ID NO: 40672 - protein, 10 aa, Mycobacterium tuberculosis
MSQIMYNYPA

SEQ ID NO: 40673 - protein, 10 aa, Mycobacterium tuberculosis
SQIMYNYPAM

SEQ ID NO: 40674 - protein, 10 aa, Mycobacterium tuberculosis
QIMYNYPAMM

SEQ ID NO: 40675 - protein, 10 aa, Mycobacterium tuberculosis
IMYNYPAMMA

SEQ ID NO: 40676 - protein, 10 aa, Mycobacterium tuberculosis
MYNYPAMMAH

SEQ ID NO: 40677 - protein, 10 aa, Mycobacterium tuberculosis
YNYPAMMAHA

SEQ ID NO: 40678 - protein, 10 aa, Mycobacterium tuberculosis
NYPAMMAHAG

SEQ ID NO: 40679 - protein, 10 aa, Mycobacterium tuberculosis
YPAMMAHAGD

SEQ ID NO: 40680 - protein, 10 aa, Mycobacterium tuberculosis
PAMMAHAGDM

SEQ ID NO: 40681 - protein, 10 aa, Mycobacterium tuberculosis
AMMAHAGDMA

SEQ ID NO: 40682 - protein, 10 aa, Mycobacterium tuberculosis
MMAHAGDMAG

SEQ ID NO: 40683 - protein, 10 aa, Mycobacterium tuberculosis
MAHAGDMAGY

SEQ ID NO: 40684 - protein, 10 aa, Mycobacterium tuberculosis
AHAGDMAGYA

SEQ ID NO: 40685 - protein, 10 aa, Mycobacterium tuberculosis
HAGDMAGYAG

SEQ ID NO: 40686 - protein, 10 aa, Mycobacterium tuberculosis
AGDMAGYAGT

SEQ ID NO: 40687 - protein, 10 aa, Mycobacterium tuberculosis
GDMAGYAGTL

SEQ ID NO: 40688 - protein, 10 aa, Mycobacterium tuberculosis
DMAGYAGTLQ

SEQ ID NO: 40689 - protein, 10 aa, Mycobacterium tuberculosis
MAGYAGTLQS

SEQ ID NO: 40690 - protein, 10 aa, Mycobacterium tuberculosis
AGYAGTLQSL

SEQ ID NO: 40691 - protein, 10 aa, Mycobacterium tuberculosis
GYAGTLQSLG

SEQ ID NO: 40692 - protein, 10 aa, Mycobacterium tuberculosis
YAGTLQSLGA

SEQ ID NO: 40693 - protein, 10 aa, Mycobacterium tuberculosis
AGTLQSLGAD

SEQ ID NO: 40694 - protein, 10 aa, Mycobacterium tuberculosis
GTLQSLGADI

SEQ ID NO: 40695 - protein, 10 aa, Mycobacterium tuberculosis
TLQSLGADIA

SEQ ID NO: 40696 - protein, 10 aa, Mycobacterium tuberculosis
LQSLGADIAS

SEQ ID NO: 40697 - protein, 10 aa, Mycobacterium tuberculosis
QSLGADIASE

SEQ ID NO: 40698 - protein, 10 aa, Mycobacterium tuberculosis
SLGADIASEQ

SEQ ID NO: 40699 - protein, 10 aa, Mycobacterium tuberculosis
LGADIASEQA

SEQ ID NO: 40700 - protein, 10 aa, Mycobacterium tuberculosis
GADIASEQAV

SEQ ID NO: 40701 - protein, 10 aa, Mycobacterium tuberculosis
ADIASEQAVL

SEQ ID NO: 40702 - protein, 10 aa, Mycobacterium tuberculosis
DIASEQAVLS

SEQ ID NO: 40703 - protein, 10 aa, Mycobacterium tuberculosis
IASEQAVLSS

SEQ ID NO: 40704 - protein, 10 aa, Mycobacterium tuberculosis
ASEQAVLSSA

SEQ ID NO: 40705 - protein, 10 aa, Mycobacterium tuberculosis
SEQAVLSSAW

SEQ ID NO: 40706 - protein, 10 aa, Mycobacterium tuberculosis
EQAVLSSAWQ

SEQ ID NO: 40707 - protein, 10 aa, Mycobacterium tuberculosis
QAVLSSAWQG

SEQ ID NO: 40708 - protein, 10 aa, Mycobacterium tuberculosis
AVLSSAWQGD

SEQ ID NO: 40709 - protein, 10 aa, Mycobacterium tuberculosis
VLSSAWQGDT

SEQ ID NO: 40710 - protein, 10 aa, Mycobacterium tuberculosis
LSSAWQGDTG

SEQ ID NO: 40711 - protein, 10 aa, Mycobacterium tuberculosis
SSAWQGDTGI

SEQ ID NO: 40712 - protein, 10 aa, Mycobacterium tuberculosis
SAWQGDTGIT

SEQ ID NO: 40713 - protein, 10 aa, Mycobacterium tuberculosis
AWQGDTGITY

SEQ ID NO: 40714 - protein, 10 aa, Mycobacterium tuberculosis
WQGDTGITYQ

SEQ ID NO: 40715 - protein, 10 aa, Mycobacterium tuberculosis
QGDTGITYQG

SEQ ID NO: 40716 - protein, 10 aa, Mycobacterium tuberculosis
GDTGITYQGW

SEQ ID NO: 40717 - protein, 10 aa, Mycobacterium tuberculosis
DTGITYQGWQ

SEQ ID NO: 40718 - protein, 10 aa, Mycobacterium tuberculosis
TGITYQGWQT

SEQ ID NO: 40719 - protein, 10 aa, Mycobacterium tuberculosis
GITYQGWQTQ

SEQ ID NO: 40720 - protein, 10 aa, Mycobacterium tuberculosis
ITYQGWQTQW

SEQ ID NO: 40721 - protein, 10 aa, Mycobacterium tuberculosis
TYQGWQTQWN

SEQ ID NO: 40722 - protein, 10 aa, Mycobacterium tuberculosis
YQGWQTQWNQ

SEQ ID NO: 40723 - protein, 10 aa, Mycobacterium tuberculosis
QGWQTQWNQA

SEQ ID NO: 40724 - protein, 10 aa, Mycobacterium tuberculosis
GWQTQWNQAL

SEQ ID NO: 40725 - protein, 10 aa, Mycobacterium tuberculosis
WQTQWNQALE

SEQ ID NO: 40726 - protein, 10 aa, Mycobacterium tuberculosis
QTQWNQALED

SEQ ID NO: 40727 - protein, 10 aa, Mycobacterium tuberculosis
TQWNQALEDL

SEQ ID NO: 40728 - protein, 10 aa, Mycobacterium tuberculosis
QWNQALEDLV

SEQ ID NO: 40729 - protein, 10 aa, Mycobacterium tuberculosis
WNQALEDLVR

SEQ ID NO: 40730 - protein, 10 aa, Mycobacterium tuberculosis
NQALEDLVRA

SEQ ID NO: 40731 - protein, 10 aa, Mycobacterium tuberculosis
QALEDLVRAY

SEQ ID NO: 40732 - protein, 10 aa, Mycobacterium tuberculosis
ALEDLVRAYQ

SEQ ID NO: 40733 - protein, 10 aa, Mycobacterium tuberculosis
LEDLVRAYQS

SEQ ID NO: 40734 - protein, 10 aa, Mycobacterium tuberculosis
EDLVRAYQSM

SEQ ID NO: 40735 - protein, 10 aa, Mycobacterium tuberculosis
DLVRAYQSMS

SEQ ID NO: 40736 - protein, 10 aa, Mycobacterium tuberculosis
LVRAYQSMSG

SEQ ID NO: 40737 - protein, 10 aa, Mycobacterium tuberculosis
VRAYQSMSGT

SEQ ID NO: 40738 - protein, 10 aa, Mycobacterium tuberculosis
RAYQSMSGTH

SEQ ID NO: 40739 - protein, 10 aa, Mycobacterium tuberculosis
AYQSMSGTHE

SEQ ID NO: 40740 - protein, 10 aa, Mycobacterium tuberculosis
YQSMSGTHES

SEQ ID NO: 40741 - protein, 10 aa, Mycobacterium tuberculosis
QSMSGTHESN

SEQ ID NO: 40742 - protein, 10 aa, Mycobacterium tuberculosis
SMSGTHESNT

SEQ ID NO: 40743 - protein, 10 aa, Mycobacterium tuberculosis
MSGTHESNTM

SEQ ID NO: 40744 - protein, 10 aa, Mycobacterium tuberculosis
SGTHESNTMA

SEQ ID NO: 40745 - protein, 10 aa, Mycobacterium tuberculosis
GTHESNTMAM

SEQ ID NO: 40746 - protein, 10 aa, Mycobacterium tuberculosis
THESNTMAML

SEQ ID NO: 40747 - protein, 10 aa, Mycobacterium tuberculosis
HESNTMAMLA

SEQ ID NO: 40748 - protein, 10 aa, Mycobacterium tuberculosis
ESNTMAMLAR

SEQ ID NO: 40749 - protein, 10 aa, Mycobacterium tuberculosis
SNTMAMLARD

SEQ ID NO: 40750 - protein, 10 aa, Mycobacterium tuberculosis
NTMAMLARDG

SEQ ID NO: 40751 - protein, 10 aa, Mycobacterium tuberculosis
TMAMLARDGA

SEQ ID NO: 40752 - protein, 10 aa, Mycobacterium tuberculosis
MAMLARDGAE

SEQ ID NO: 40753 - protein, 10 aa, Mycobacterium tuberculosis
AMLARDGAEA

SEQ ID NO: 40754 - protein, 10 aa, Mycobacterium tuberculosis
MLARDGAEAA

SEQ ID NO: 40755 - protein, 10 aa, Mycobacterium tuberculosis
LARDGAEAAK

SEQ ID NO: 40756 - protein, 10 aa, Mycobacterium tuberculosis
ARDGAEAAKW

SEQ ID NO: 40757 - protein, 10 aa, Mycobacterium tuberculosis
RDGAEAAKWG

SEQ ID NO: 40758 - protein, 10 aa, Mycobacterium tuberculosis
DGAEAAKWGG

SEQ ID NO: 40759 - protein, 11 aa, Mycobacterium tuberculosis
MSQIMYNYPAM

SEQ ID NO: 40760 - protein, 11 aa, Mycobacterium tuberculosis
SQIMYNYPAMM

SEQ ID NO: 40761 - protein, 11 aa, Mycobacterium tuberculosis
QIMYNYPAMMA

SEQ ID NO: 40762 - protein, 11 aa, Mycobacterium tuberculosis
IMYNYPAMMAH

SEQ ID NO: 40763 - protein, 11 aa, Mycobacterium tuberculosis
MYNYPAMMAHA

SEQ ID NO: 40764 - protein, 11 aa, Mycobacterium tuberculosis
YNYPAMMAHAG

SEQ ID NO: 40765 - protein, 11 aa, Mycobacterium tuberculosis
NYPAMMAHAGD

SEQ ID NO: 40766 - protein, 11 aa, Mycobacterium tuberculosis
YPAMMAHAGDM

SEQ ID NO: 40767 - protein, 11 aa, Mycobacterium tuberculosis
PAMMAHAGDMA

SEQ ID NO: 40768 - protein, 11 aa, Mycobacterium tuberculosis
AMMAHAGDMAG

SEQ ID NO: 40769 - protein, 11 aa, Mycobacterium tuberculosis
MMAHAGDMAGY

SEQ ID NO: 40770 - protein, 11 aa, Mycobacterium tuberculosis
MAHAGDMAGYA

SEQ ID NO: 40771 - protein, 11 aa, Mycobacterium tuberculosis
AHAGDMAGYAG

SEQ ID NO: 40772 - protein, 11 aa, Mycobacterium tuberculosis
HAGDMAGYAGT

SEQ ID NO: 40773 - protein, 11 aa, Mycobacterium tuberculosis
AGDMAGYAGTL

SEQ ID NO: 40774 - protein, 11 aa, Mycobacterium tuberculosis
GDMAGYAGTLQ

SEQ ID NO: 40775 - protein, 11 aa, Mycobacterium tuberculosis
DMAGYAGTLQS

SEQ ID NO: 40776 - protein, 11 aa, Mycobacterium tuberculosis
MAGYAGTLQSL

SEQ ID NO: 40777 - protein, 11 aa, Mycobacterium tuberculosis
AGYAGTLQSLG

SEQ ID NO: 40778 - protein, 11 aa, Mycobacterium tuberculosis
GYAGTLQSLGA

SEQ ID NO: 40779 - protein, 11 aa, Mycobacterium tuberculosis
YAGTLQSLGAD

SEQ ID NO: 40780 - protein, 11 aa, Mycobacterium tuberculosis
AGTLQSLGADI

SEQ ID NO: 40781 - protein, 11 aa, Mycobacterium tuberculosis
GTLQSLGADIA

SEQ ID NO: 40782 - protein, 11 aa, Mycobacterium tuberculosis
TLQSLGADIAS

SEQ ID NO: 40783 - protein, 11 aa, Mycobacterium tuberculosis
LQSLGADIASE

SEQ ID NO: 40784 - protein, 11 aa, Mycobacterium tuberculosis
QSLGADIASEQ

SEQ ID NO: 40785 - protein, 11 aa, Mycobacterium tuberculosis
SLGADIASEQA

SEQ ID NO: 40786 - protein, 11 aa, Mycobacterium tuberculosis
LGADIASEQAV

SEQ ID NO: 40787 - protein, 11 aa, Mycobacterium tuberculosis
GADIASEQAVL

SEQ ID NO: 40788 - protein, 11 aa, Mycobacterium tuberculosis
ADIASEQAVLS

SEQ ID NO: 40789 - protein, 11 aa, Mycobacterium tuberculosis
DIASEQAVLSS

SEQ ID NO: 40790 - protein, 11 aa, Mycobacterium tuberculosis
IASEQAVLSSA

SEQ ID NO: 40791 - protein, 11 aa, Mycobacterium tuberculosis
ASEQAVLSSAW

SEQ ID NO: 40792 - protein, 11 aa, Mycobacterium tuberculosis
SEQAVLSSAWQ

SEQ ID NO: 40793 - protein, 11 aa, Mycobacterium tuberculosis
EQAVLSSAWQG

SEQ ID NO: 40794 - protein, 11 aa, Mycobacterium tuberculosis
QAVLSSAWQGD

SEQ ID NO: 40795 - protein, 11 aa, Mycobacterium tuberculosis
AVLSSAWQGDT

SEQ ID NO: 40796 - protein, 11 aa, Mycobacterium tuberculosis
VLSSAWQGDTG

SEQ ID NO: 40797 - protein, 11 aa, Mycobacterium tuberculosis
LSSAWQGDTGI

SEQ ID NO: 40798 - protein, 11 aa, Mycobacterium tuberculosis
SSAWQGDTGIT

SEQ ID NO: 40799 - protein, 11 aa, Mycobacterium tuberculosis
SAWQGDTGITY

SEQ ID NO: 40800 - protein, 11 aa, Mycobacterium tuberculosis
AWQGDTGITYQ

SEQ ID NO: 40801 - protein, 11 aa, Mycobacterium tuberculosis
WQGDTGITYQG

SEQ ID NO: 40802 - protein, 11 aa, Mycobacterium tuberculosis
QGDTGITYQGW

SEQ ID NO: 40803 - protein, 11 aa, Mycobacterium tuberculosis
GDTGITYQGWQ

SEQ ID NO: 40804 - protein, 11 aa, Mycobacterium tuberculosis
DTGITYQGWQT

SEQ ID NO: 40805 - protein, 11 aa, Mycobacterium tuberculosis
TGITYQGWQTQ

SEQ ID NO: 40806 - protein, 11 aa, Mycobacterium tuberculosis
GITYQGWQTQW

SEQ ID NO: 40807 - protein, 11 aa, Mycobacterium tuberculosis
ITYQGWQTQWN

SEQ ID NO: 40808 - protein, 11 aa, Mycobacterium tuberculosis
TYQGWQTQWNQ

SEQ ID NO: 40809 - protein, 11 aa, Mycobacterium tuberculosis
YQGWQTQWNQA

SEQ ID NO: 40810 - protein, 11 aa, Mycobacterium tuberculosis
QGWQTQWNQAL

SEQ ID NO: 40811 - protein, 11 aa, Mycobacterium tuberculosis
GWQTQWNQALE

SEQ ID NO: 40812 - protein, 11 aa, Mycobacterium tuberculosis
WQTQWNQALED

SEQ ID NO: 40813 - protein, 11 aa, Mycobacterium tuberculosis
QTQWNQALEDL

SEQ ID NO: 40814 - protein, 11 aa, Mycobacterium tuberculosis
TQWNQALEDLV

SEQ ID NO: 40815 - protein, 11 aa, Mycobacterium tuberculosis
QWNQALEDLVR

SEQ ID NO: 40816 - protein, 11 aa, Mycobacterium tuberculosis
WNQALEDLVRA

SEQ ID NO: 40817 - protein, 11 aa, Mycobacterium tuberculosis
NQALEDLVRAY

SEQ ID NO: 40818 - protein, 11 aa, Mycobacterium tuberculosis
QALEDLVRAYQ

SEQ ID NO: 40819 - protein, 11 aa, Mycobacterium tuberculosis
ALEDLVRAYQS

SEQ ID NO: 40820 - protein, 11 aa, Mycobacterium tuberculosis
LEDLVRAYQSM

SEQ ID NO: 40821 - protein, 11 aa, Mycobacterium tuberculosis
EDLVRAYQSMS

SEQ ID NO: 40822 - protein, 11 aa, Mycobacterium tuberculosis
DLVRAYQSMSG

SEQ ID NO: 40823 - protein, 11 aa, Mycobacterium tuberculosis
LVRAYQSMSGT

SEQ ID NO: 40824 - protein, 11 aa, Mycobacterium tuberculosis
VRAYQSMSGTH

SEQ ID NO: 40825 - protein, 11 aa, Mycobacterium tuberculosis
RAYQSMSGTHE

SEQ ID NO: 40826 - protein, 11 aa, Mycobacterium tuberculosis
AYQSMSGTHES

SEQ ID NO: 40827 - protein, 11 aa, Mycobacterium tuberculosis
YQSMSGTHESN

SEQ ID NO: 40828 - protein, 11 aa, Mycobacterium tuberculosis
QSMSGTHESNT

SEQ ID NO: 40829 - protein, 11 aa, Mycobacterium tuberculosis
SMSGTHESNTM

SEQ ID NO: 40830 - protein, 11 aa, Mycobacterium tuberculosis
MSGTHESNTMA

SEQ ID NO: 40831 - protein, 11 aa, Mycobacterium tuberculosis
SGTHESNTMAM

SEQ ID NO: 40832 - protein, 11 aa, Mycobacterium tuberculosis
GTHESNTMAML

SEQ ID NO: 40833 - protein, 11 aa, Mycobacterium tuberculosis
THESNTMAMLA

SEQ ID NO: 40834 - protein, 11 aa, Mycobacterium tuberculosis
HESNTMAMLAR

SEQ ID NO: 40835 - protein, 11 aa, Mycobacterium tuberculosis
ESNTMAMLARD

SEQ ID NO: 40836 - protein, 11 aa, Mycobacterium tuberculosis
SNTMAMLARDG

SEQ ID NO: 40837 - protein, 11 aa, Mycobacterium tuberculosis
NTMAMLARDGA

SEQ ID NO: 40838 - protein, 11 aa, Mycobacterium tuberculosis
TMAMLARDGAE

SEQ ID NO: 40839 - protein, 11 aa, Mycobacterium tuberculosis
MAMLARDGAEA

SEQ ID NO: 40840 - protein, 11 aa, Mycobacterium tuberculosis
AMLARDGAEAA

SEQ ID NO: 40841 - protein, 11 aa, Mycobacterium tuberculosis
MLARDGAEAAK

SEQ ID NO: 40842 - protein, 11 aa, Mycobacterium tuberculosis
LARDGAEAAKW

SEQ ID NO: 40843 - protein, 11 aa, Mycobacterium tuberculosis
ARDGAEAAKWG

SEQ ID NO: 40844 - protein, 11 aa, Mycobacterium tuberculosis
RDGAEAAKWGG

SEQ ID NO: 40845 - protein, 8 aa, Mycobacterium tuberculosis
MSLLDAHI

SEQ ID NO: 40846 - protein, 8 aa, Mycobacterium tuberculosis
SLLDAHIP

SEQ ID NO: 40847 - protein, 8 aa, Mycobacterium tuberculosis
LLDAHIPQ

SEQ ID NO: 40848 - protein, 8 aa, Mycobacterium tuberculosis
LDAHIPQL

SEQ ID NO: 40849 - protein, 8 aa, Mycobacterium tuberculosis
DAHIPQLI

SEQ ID NO: 40850 - protein, 8 aa, Mycobacterium tuberculosis
AHIPQLIA

SEQ ID NO: 40851 - protein, 8 aa, Mycobacterium tuberculosis
HIPQLIAS

SEQ ID NO: 40852 - protein, 8 aa, Mycobacterium tuberculosis
IPQLIASH

SEQ ID NO: 40853 - protein, 8 aa, Mycobacterium tuberculosis
PQLIASHT

SEQ ID NO: 40854 - protein, 8 aa, Mycobacterium tuberculosis
QLIASHTA

SEQ ID NO: 40855 - protein, 8 aa, Mycobacterium tuberculosis
LIASHTAF

SEQ ID NO: 40856 - protein, 8 aa, Mycobacterium tuberculosis
IASHTAFA

SEQ ID NO: 40857 - protein, 8 aa, Mycobacterium tuberculosis
ASHTAFAA

SEQ ID NO: 40858 - protein, 8 aa, Mycobacterium tuberculosis
SHTAFAAK

SEQ ID NO: 40859 - protein, 8 aa, Mycobacterium tuberculosis
HTAFAAKA

SEQ ID NO: 40860 - protein, 8 aa, Mycobacterium tuberculosis
TAFAAKAG

SEQ ID NO: 40861 - protein, 8 aa, Mycobacterium tuberculosis
AFAAKAGL

SEQ ID NO: 40862 - protein, 8 aa, Mycobacterium tuberculosis
FAAKAGLM

SEQ ID NO: 40863 - protein, 8 aa, Mycobacterium tuberculosis
AAKAGLMR

SEQ ID NO: 40864 - protein, 8 aa, Mycobacterium tuberculosis
AKAGLMRH

SEQ ID NO: 40865 - protein, 8 aa, Mycobacterium tuberculosis
KAGLMRHT

SEQ ID NO: 40866 - protein, 8 aa, Mycobacterium tuberculosis
AGLMRHTI

SEQ ID NO: 40867 - protein, 8 aa, Mycobacterium tuberculosis
GLMRHTIG

SEQ ID NO: 40868 - protein, 8 aa, Mycobacterium tuberculosis
LMRHTIGQ

SEQ ID NO: 40869 - protein, 8 aa, Mycobacterium tuberculosis
MRHTIGQA

SEQ ID NO: 40870 - protein, 8 aa, Mycobacterium tuberculosis
RHTIGQAE

SEQ ID NO: 40871 - protein, 8 aa, Mycobacterium tuberculosis
HTIGQAEQ

SEQ ID NO: 40872 - protein, 8 aa, Mycobacterium tuberculosis
TIGQAEQQ

SEQ ID NO: 40873 - protein, 8 aa, Mycobacterium tuberculosis
IGQAEQQA

SEQ ID NO: 40874 - protein, 8 aa, Mycobacterium tuberculosis
GQAEQQAM

SEQ ID NO: 40875 - protein, 8 aa, Mycobacterium tuberculosis
QAEQQAMS

SEQ ID NO: 40876 - protein, 8 aa, Mycobacterium tuberculosis
AEQQAMSA

SEQ ID NO: 40877 - protein, 8 aa, Mycobacterium tuberculosis
EQQAMSAQ

SEQ ID NO: 40878 - protein, 8 aa, Mycobacterium tuberculosis
QQAMSAQA

SEQ ID NO: 40879 - protein, 8 aa, Mycobacterium tuberculosis
QAMSAQAF

SEQ ID NO: 40880 - protein, 8 aa, Mycobacterium tuberculosis
AMSAQAFH

SEQ ID NO: 40881 - protein, 8 aa, Mycobacterium tuberculosis
MSAQAFHQ

SEQ ID NO: 40882 - protein, 8 aa, Mycobacterium tuberculosis
SAQAFHQG

SEQ ID NO: 40883 - protein, 8 aa, Mycobacterium tuberculosis
AQAFHQGE

SEQ ID NO: 40884 - protein, 8 aa, Mycobacterium tuberculosis
QAFHQGES

SEQ ID NO: 40885 - protein, 8 aa, Mycobacterium tuberculosis
AFHQGESA

SEQ ID NO: 40886 - protein, 8 aa, Mycobacterium tuberculosis
FHQGESAA

SEQ ID NO: 40887 - protein, 8 aa, Mycobacterium tuberculosis
HQGESAAA

SEQ ID NO: 40888 - protein, 8 aa, Mycobacterium tuberculosis
QGESAAAF

SEQ ID NO: 40889 - protein, 8 aa, Mycobacterium tuberculosis
GESAAAFQ

SEQ ID NO: 40890 - protein, 8 aa, Mycobacterium tuberculosis
ESAAAFQG

SEQ ID NO: 40891 - protein, 8 aa, Mycobacterium tuberculosis
SAAAFQGA

SEQ ID NO: 40892 - protein, 8 aa, Mycobacterium tuberculosis
AAAFQGAH

SEQ ID NO: 40893 - protein, 8 aa, Mycobacterium tuberculosis
AAFQGAHA

SEQ ID NO: 40894 - protein, 8 aa, Mycobacterium tuberculosis
AFQGAHAR

SEQ ID NO: 40895 - protein, 8 aa, Mycobacterium tuberculosis
FQGAHARF

SEQ ID NO: 40896 - protein, 8 aa, Mycobacterium tuberculosis
QGAHARFV

SEQ ID NO: 40897 - protein, 8 aa, Mycobacterium tuberculosis
GAHARFVA

SEQ ID NO: 40898 - protein, 8 aa, Mycobacterium tuberculosis
AHARFVAA

SEQ ID NO: 40899 - protein, 8 aa, Mycobacterium tuberculosis
HARFVAAA

SEQ ID NO: 40900 - protein, 8 aa, Mycobacterium tuberculosis
ARFVAAAA

SEQ ID NO: 40901 - protein, 8 aa, Mycobacterium tuberculosis
RFVAAAAK

SEQ ID NO: 40902 - protein, 8 aa, Mycobacterium tuberculosis
FVAAAAKV

SEQ ID NO: 40903 - protein, 8 aa, Mycobacterium tuberculosis
VAAAAKVN

SEQ ID NO: 40904 - protein, 8 aa, Mycobacterium tuberculosis
AAAAKVNT

SEQ ID NO: 40905 - protein, 8 aa, Mycobacterium tuberculosis
AAAKVNTL

SEQ ID NO: 40906 - protein, 8 aa, Mycobacterium tuberculosis
AAKVNTLL

SEQ ID NO: 40907 - protein, 8 aa, Mycobacterium tuberculosis
AKVNTLLD

SEQ ID NO: 40908 - protein, 8 aa, Mycobacterium tuberculosis
KVNTLLDI

SEQ ID NO: 40909 - protein, 8 aa, Mycobacterium tuberculosis
VNTLLDIA

SEQ ID NO: 40910 - protein, 8 aa, Mycobacterium tuberculosis
NTLLDIAQ

SEQ ID NO: 40911 - protein, 8 aa, Mycobacterium tuberculosis
TLLDIAQA

SEQ ID NO: 40912 - protein, 8 aa, Mycobacterium tuberculosis
LLDIAQAN

SEQ ID NO: 40913 - protein, 8 aa, Mycobacterium tuberculosis
LDIAQANL

SEQ ID NO: 40914 - protein, 8 aa, Mycobacterium tuberculosis
DIAQANLG

SEQ ID NO: 40915 - protein, 8 aa, Mycobacterium tuberculosis
IAQANLGE

SEQ ID NO: 40916 - protein, 8 aa, Mycobacterium tuberculosis
AQANLGEA

SEQ ID NO: 40917 - protein, 8 aa, Mycobacterium tuberculosis
QANLGEAA

SEQ ID NO: 40918 - protein, 8 aa, Mycobacterium tuberculosis
ANLGEAAG

SEQ ID NO: 40919 - protein, 8 aa, Mycobacterium tuberculosis
NLGEAAGT

SEQ ID NO: 40920 - protein, 8 aa, Mycobacterium tuberculosis
LGEAAGTY

SEQ ID NO: 40921 - protein, 8 aa, Mycobacterium tuberculosis
GEAAGTYV

SEQ ID NO: 40922 - protein, 8 aa, Mycobacterium tuberculosis
EAAGTYVA

SEQ ID NO: 40923 - protein, 8 aa, Mycobacterium tuberculosis
AAGTYVAA

SEQ ID NO: 40924 - protein, 8 aa, Mycobacterium tuberculosis
AGTYVAAD

SEQ ID NO: 40925 - protein, 8 aa, Mycobacterium tuberculosis
GTYVAADA

SEQ ID NO: 40926 - protein, 8 aa, Mycobacterium tuberculosis
TYVAADAA

SEQ ID NO: 40927 - protein, 8 aa, Mycobacterium tuberculosis
YVAADAAA

SEQ ID NO: 40928 - protein, 8 aa, Mycobacterium tuberculosis
VAADAAAA

SEQ ID NO: 40929 - protein, 8 aa, Mycobacterium tuberculosis
AADAAAAS

SEQ ID NO: 40930 - protein, 8 aa, Mycobacterium tuberculosis
ADAAAASS

SEQ ID NO: 40931 - protein, 8 aa, Mycobacterium tuberculosis
DAAAASSY

SEQ ID NO: 40932 - protein, 8 aa, Mycobacterium tuberculosis
AAAASSYT

SEQ ID NO: 40933 - protein, 8 aa, Mycobacterium tuberculosis
AAASSYTG

SEQ ID NO: 40934 - protein, 8 aa, Mycobacterium tuberculosis
AASSYTGF

SEQ ID NO: 40935 - protein, 9 aa, Mycobacterium tuberculosis
MSLLDAHIP

SEQ ID NO: 40936 - protein, 9 aa, Mycobacterium tuberculosis
SLLDAHIPQ

SEQ ID NO: 40937 - protein, 9 aa, Mycobacterium tuberculosis
LLDAHIPQL

SEQ ID NO: 40938 - protein, 9 aa, Mycobacterium tuberculosis
LDAHIPQLI

SEQ ID NO: 40939 - protein, 9 aa, Mycobacterium tuberculosis
DAHIPQLIA

SEQ ID NO: 40940 - protein, 9 aa, Mycobacterium tuberculosis
AHIPQLIAS

SEQ ID NO: 40941 - protein, 9 aa, Mycobacterium tuberculosis
HIPQLIASH

SEQ ID NO: 40942 - protein, 9 aa, Mycobacterium tuberculosis
IPQLIASHT

SEQ ID NO: 40943 - protein, 9 aa, Mycobacterium tuberculosis
PQLIASHTA

SEQ ID NO: 40944 - protein, 9 aa, Mycobacterium tuberculosis
QLIASHTAF

SEQ ID NO: 40945 - protein, 9 aa, Mycobacterium tuberculosis
LIASHTAFA

SEQ ID NO: 40946 - protein, 9 aa, Mycobacterium tuberculosis
IASHTAFAA

SEQ ID NO: 40947 - protein, 9 aa, Mycobacterium tuberculosis
ASHTAFAAK

SEQ ID NO: 40948 - protein, 9 aa, Mycobacterium tuberculosis
SHTAFAAKA

SEQ ID NO: 40949 - protein, 9 aa, Mycobacterium tuberculosis
HTAFAAKAG

SEQ ID NO: 40950 - protein, 9 aa, Mycobacterium tuberculosis
TAFAAKAGL

SEQ ID NO: 40951 - protein, 9 aa, Mycobacterium tuberculosis
AFAAKAGLM

SEQ ID NO: 40952 - protein, 9 aa, Mycobacterium tuberculosis
FAAKAGLMR

SEQ ID NO: 40953 - protein, 9 aa, Mycobacterium tuberculosis
AAKAGLMRH

SEQ ID NO: 40954 - protein, 9 aa, Mycobacterium tuberculosis
AKAGLMRHT

SEQ ID NO: 40955 - protein, 9 aa, Mycobacterium tuberculosis
KAGLMRHTI

SEQ ID NO: 40956 - protein, 9 aa, Mycobacterium tuberculosis
AGLMRHTIG

SEQ ID NO: 40957 - protein, 9 aa, Mycobacterium tuberculosis
GLMRHTIGQ

SEQ ID NO: 40958 - protein, 9 aa, Mycobacterium tuberculosis
LMRHTIGQA

SEQ ID NO: 40959 - protein, 9 aa, Mycobacterium tuberculosis
MRHTIGQAE

SEQ ID NO: 40960 - protein, 9 aa, Mycobacterium tuberculosis
RHTIGQAEQ

SEQ ID NO: 40961 - protein, 9 aa, Mycobacterium tuberculosis
HTIGQAEQQ

SEQ ID NO: 40962 - protein, 9 aa, Mycobacterium tuberculosis
TIGQAEQQA

SEQ ID NO: 40963 - protein, 9 aa, Mycobacterium tuberculosis
IGQAEQQAM

SEQ ID NO: 40964 - protein, 9 aa, Mycobacterium tuberculosis
GQAEQQAMS

SEQ ID NO: 40965 - protein, 9 aa, Mycobacterium tuberculosis
QAEQQAMSA

SEQ ID NO: 40966 - protein, 9 aa, Mycobacterium tuberculosis
AEQQAMSAQ

SEQ ID NO: 40967 - protein, 9 aa, Mycobacterium tuberculosis
EQQAMSAQA

SEQ ID NO: 40968 - protein, 9 aa, Mycobacterium tuberculosis
QQAMSAQAF

SEQ ID NO: 40969 - protein, 9 aa, Mycobacterium tuberculosis
QAMSAQAFH

SEQ ID NO: 40970 - protein, 9 aa, Mycobacterium tuberculosis
AMSAQAFHQ

SEQ ID NO: 40971 - protein, 9 aa, Mycobacterium tuberculosis
MSAQAFHQG

SEQ ID NO: 40972 - protein, 9 aa, Mycobacterium tuberculosis
SAQAFHQGE

SEQ ID NO: 40973 - protein, 9 aa, Mycobacterium tuberculosis
AQAFHQGES

SEQ ID NO: 40974 - protein, 9 aa, Mycobacterium tuberculosis
QAFHQGESA

SEQ ID NO: 40975 - protein, 9 aa, Mycobacterium tuberculosis
AFHQGESAA

SEQ ID NO: 40976 - protein, 9 aa, Mycobacterium tuberculosis
FHQGESAAA

SEQ ID NO: 40977 - protein, 9 aa, Mycobacterium tuberculosis
HQGESAAAF

SEQ ID NO: 40978 - protein, 9 aa, Mycobacterium tuberculosis
QGESAAAFQ

SEQ ID NO: 40979 - protein, 9 aa, Mycobacterium tuberculosis
GESAAAFQG

SEQ ID NO: 40980 - protein, 9 aa, Mycobacterium tuberculosis
ESAAAFQGA

SEQ ID NO: 40981 - protein, 9 aa, Mycobacterium tuberculosis
SAAAFQGAH

SEQ ID NO: 40982 - protein, 9 aa, Mycobacterium tuberculosis
AAAFQGAHA

SEQ ID NO: 40983 - protein, 9 aa, Mycobacterium tuberculosis
AAFQGAHAR

SEQ ID NO: 40984 - protein, 9 aa, Mycobacterium tuberculosis
AFQGAHARF

SEQ ID NO: 40985 - protein, 9 aa, Mycobacterium tuberculosis
FQGAHARFV

SEQ ID NO: 40986 - protein, 9 aa, Mycobacterium tuberculosis
QGAHARFVA

SEQ ID NO: 40987 - protein, 9 aa, Mycobacterium tuberculosis
GAHARFVAA

SEQ ID NO: 40988 - protein, 9 aa, Mycobacterium tuberculosis
AHARFVAAA

SEQ ID NO: 40989 - protein, 9 aa, Mycobacterium tuberculosis
HARFVAAAA

SEQ ID NO: 40990 - protein, 9 aa, Mycobacterium tuberculosis
ARFVAAAAK

SEQ ID NO: 40991 - protein, 9 aa, Mycobacterium tuberculosis
RFVAAAAKV

SEQ ID NO: 40992 - protein, 9 aa, Mycobacterium tuberculosis
FVAAAAKVN

SEQ ID NO: 40993 - protein, 9 aa, Mycobacterium tuberculosis
VAAAAKVNT

SEQ ID NO: 40994 - protein, 9 aa, Mycobacterium tuberculosis
AAAAKVNTL

SEQ ID NO: 40995 - protein, 9 aa, Mycobacterium tuberculosis
AAAKVNTLL

SEQ ID NO: 40996 - protein, 9 aa, Mycobacterium tuberculosis
AAKVNTLLD

SEQ ID NO: 40997 - protein, 9 aa, Mycobacterium tuberculosis
AKVNTLLDI

SEQ ID NO: 40998 - protein, 9 aa, Mycobacterium tuberculosis
KVNTLLDIA

SEQ ID NO: 40999 - protein, 9 aa, Mycobacterium tuberculosis
VNTLLDIAQ

SEQ ID NO: 41000 - protein, 9 aa, Mycobacterium tuberculosis
NTLLDIAQA

SEQ ID NO: 41001 - protein, 9 aa, Mycobacterium tuberculosis
TLLDIAQAN

SEQ ID NO: 41002 - protein, 9 aa, Mycobacterium tuberculosis
LLDIAQANL

SEQ ID NO: 41003 - protein, 9 aa, Mycobacterium tuberculosis
LDIAQANLG

SEQ ID NO: 41004 - protein, 9 aa, Mycobacterium tuberculosis
DIAQANLGE

SEQ ID NO: 41005 - protein, 9 aa, Mycobacterium tuberculosis
IAQANLGEA

SEQ ID NO: 41006 - protein, 9 aa, Mycobacterium tuberculosis
AQANLGEAA

SEQ ID NO: 41007 - protein, 9 aa, Mycobacterium tuberculosis
QANLGEAAG

SEQ ID NO: 41008 - protein, 9 aa, Mycobacterium tuberculosis
ANLGEAAGT

SEQ ID NO: 41009 - protein, 9 aa, Mycobacterium tuberculosis
NLGEAAGTY

SEQ ID NO: 41010 - protein, 9 aa, Mycobacterium tuberculosis
LGEAAGTYV

SEQ ID NO: 41011 - protein, 9 aa, Mycobacterium tuberculosis
GEAAGTYVA

SEQ ID NO: 41012 - protein, 9 aa, Mycobacterium tuberculosis
EAAGTYVAA

SEQ ID NO: 41013 - protein, 9 aa, Mycobacterium tuberculosis
AAGTYVAAD

SEQ ID NO: 41014 - protein, 9 aa, Mycobacterium tuberculosis
AGTYVAADA

SEQ ID NO: 41015 - protein, 9 aa, Mycobacterium tuberculosis
GTYVAADAA

SEQ ID NO: 41016 - protein, 9 aa, Mycobacterium tuberculosis
TYVAADAAA

SEQ ID NO: 41017 - protein, 9 aa, Mycobacterium tuberculosis
YVAADAAAA

SEQ ID NO: 41018 - protein, 9 aa, Mycobacterium tuberculosis
VAADAAAAS

SEQ ID NO: 41019 - protein, 9 aa, Mycobacterium tuberculosis
AADAAAASS

SEQ ID NO: 41020 - protein, 9 aa, Mycobacterium tuberculosis
ADAAAASSY

SEQ ID NO: 41021 - protein, 9 aa, Mycobacterium tuberculosis
DAAAASSYT

SEQ ID NO: 41022 - protein, 9 aa, Mycobacterium tuberculosis
AAAASSYTG

SEQ ID NO: 41023 - protein, 9 aa, Mycobacterium tuberculosis
AAASSYTGF

SEQ ID NO: 41024 - protein, 10 aa, Mycobacterium tuberculosis
MSLLDAHIPQ

SEQ ID NO: 41025 - protein, 10 aa, Mycobacterium tuberculosis
SLLDAHIPQL

SEQ ID NO: 41026 - protein, 10 aa, Mycobacterium tuberculosis
LLDAHIPQLI

SEQ ID NO: 41027 - protein, 10 aa, Mycobacterium tuberculosis
LDAHIPQLIA

SEQ ID NO: 41028 - protein, 10 aa, Mycobacterium tuberculosis
DAHIPQLIAS

SEQ ID NO: 41029 - protein, 10 aa, Mycobacterium tuberculosis
AHIPQLIASH

SEQ ID NO: 41030 - protein, 10 aa, Mycobacterium tuberculosis
HIPQLIASHT

SEQ ID NO: 41031 - protein, 10 aa, Mycobacterium tuberculosis
IPQLIASHTA

SEQ ID NO: 41032 - protein, 10 aa, Mycobacterium tuberculosis
PQLIASHTAF

SEQ ID NO: 41033 - protein, 10 aa, Mycobacterium tuberculosis
QLIASHTAFA

SEQ ID NO: 41034 - protein, 10 aa, Mycobacterium tuberculosis
LIASHTAFAA

SEQ ID NO: 41035 - protein, 10 aa, Mycobacterium tuberculosis
IASHTAFAAK

SEQ ID NO: 41036 - protein, 10 aa, Mycobacterium tuberculosis
ASHTAFAAKA

SEQ ID NO: 41037 - protein, 10 aa, Mycobacterium tuberculosis
SHTAFAAKAG

SEQ ID NO: 41038 - protein, 10 aa, Mycobacterium tuberculosis
HTAFAAKAGL

SEQ ID NO: 41039 - protein, 10 aa, Mycobacterium tuberculosis
TAFAAKAGLM

SEQ ID NO: 41040 - protein, 10 aa, Mycobacterium tuberculosis
AFAAKAGLMR

SEQ ID NO: 41041 - protein, 10 aa, Mycobacterium tuberculosis
FAAKAGLMRH

SEQ ID NO: 41042 - protein, 10 aa, Mycobacterium tuberculosis
AAKAGLMRHT

SEQ ID NO: 41043 - protein, 10 aa, Mycobacterium tuberculosis
AKAGLMRHTI

SEQ ID NO: 41044 - protein, 10 aa, Mycobacterium tuberculosis
KAGLMRHTIG

SEQ ID NO: 41045 - protein, 10 aa, Mycobacterium tuberculosis
AGLMRHTIGQ

SEQ ID NO: 41046 - protein, 10 aa, Mycobacterium tuberculosis
GLMRHTIGQA

SEQ ID NO: 41047 - protein, 10 aa, Mycobacterium tuberculosis
LMRHTIGQAE

SEQ ID NO: 41048 - protein, 10 aa, Mycobacterium tuberculosis
MRHTIGQAEQ

SEQ ID NO: 41049 - protein, 10 aa, Mycobacterium tuberculosis
RHTIGQAEQQ

SEQ ID NO: 41050 - protein, 10 aa, Mycobacterium tuberculosis
HTIGQAEQQA

SEQ ID NO: 41051 - protein, 10 aa, Mycobacterium tuberculosis
TIGQAEQQAM

SEQ ID NO: 41052 - protein, 10 aa, Mycobacterium tuberculosis
IGQAEQQAMS

SEQ ID NO: 41053 - protein, 10 aa, Mycobacterium tuberculosis
GQAEQQAMSA

SEQ ID NO: 41054 - protein, 10 aa, Mycobacterium tuberculosis
QAEQQAMSAQ

SEQ ID NO: 41055 - protein, 10 aa, Mycobacterium tuberculosis
AEQQAMSAQA

SEQ ID NO: 41056 - protein, 10 aa, Mycobacterium tuberculosis
EQQAMSAQAF

SEQ ID NO: 41057 - protein, 10 aa, Mycobacterium tuberculosis
QQAMSAQAFH

SEQ ID NO: 41058 - protein, 10 aa, Mycobacterium tuberculosis
QAMSAQAFHQ

SEQ ID NO: 41059 - protein, 10 aa, Mycobacterium tuberculosis
AMSAQAFHQG

SEQ ID NO: 41060 - protein, 10 aa, Mycobacterium tuberculosis
MSAQAFHQGE

SEQ ID NO: 41061 - protein, 10 aa, Mycobacterium tuberculosis
SAQAFHQGES

SEQ ID NO: 41062 - protein, 10 aa, Mycobacterium tuberculosis
AQAFHQGESA

SEQ ID NO: 41063 - protein, 10 aa, Mycobacterium tuberculosis
QAFHQGESAA

SEQ ID NO: 41064 - protein, 10 aa, Mycobacterium tuberculosis
AFHQGESAAA

SEQ ID NO: 41065 - protein, 10 aa, Mycobacterium tuberculosis
FHQGESAAAF

SEQ ID NO: 41066 - protein, 10 aa, Mycobacterium tuberculosis
HQGESAAAFQ

SEQ ID NO: 41067 - protein, 10 aa, Mycobacterium tuberculosis
QGESAAAFQG

SEQ ID NO: 41068 - protein, 10 aa, Mycobacterium tuberculosis
GESAAAFQGA

SEQ ID NO: 41069 - protein, 10 aa, Mycobacterium tuberculosis
ESAAAFQGAH

SEQ ID NO: 41070 - protein, 10 aa, Mycobacterium tuberculosis
SAAAFQGAHA

SEQ ID NO: 41071 - protein, 10 aa, Mycobacterium tuberculosis
AAAFQGAHAR

SEQ ID NO: 41072 - protein, 10 aa, Mycobacterium tuberculosis
AAFQGAHARF

SEQ ID NO: 41073 - protein, 10 aa, Mycobacterium tuberculosis
AFQGAHARFV

SEQ ID NO: 41074 - protein, 10 aa, Mycobacterium tuberculosis
FQGAHARFVA

SEQ ID NO: 41075 - protein, 10 aa, Mycobacterium tuberculosis
QGAHARFVAA

SEQ ID NO: 41076 - protein, 10 aa, Mycobacterium tuberculosis
GAHARFVAAA

SEQ ID NO: 41077 - protein, 10 aa, Mycobacterium tuberculosis
AHARFVAAAA

SEQ ID NO: 41078 - protein, 10 aa, Mycobacterium tuberculosis
HARFVAAAAK

SEQ ID NO: 41079 - protein, 10 aa, Mycobacterium tuberculosis
ARFVAAAAKV

SEQ ID NO: 41080 - protein, 10 aa, Mycobacterium tuberculosis
RFVAAAAKVN

SEQ ID NO: 41081 - protein, 10 aa, Mycobacterium tuberculosis
FVAAAAKVNT

SEQ ID NO: 41082 - protein, 10 aa, Mycobacterium tuberculosis
VAAAAKVNTL

SEQ ID NO: 41083 - protein, 10 aa, Mycobacterium tuberculosis
AAAAKVNTLL

SEQ ID NO: 41084 - protein, 10 aa, Mycobacterium tuberculosis
AAAKVNTLLD

SEQ ID NO: 41085 - protein, 10 aa, Mycobacterium tuberculosis
AAKVNTLLDI

SEQ ID NO: 41086 - protein, 10 aa, Mycobacterium tuberculosis
AKVNTLLDIA

SEQ ID NO: 41087 - protein, 10 aa, Mycobacterium tuberculosis
KVNTLLDIAQ

SEQ ID NO: 41088 - protein, 10 aa, Mycobacterium tuberculosis
VNTLLDIAQA

SEQ ID NO: 41089 - protein, 10 aa, Mycobacterium tuberculosis
NTLLDIAQAN

SEQ ID NO: 41090 - protein, 10 aa, Mycobacterium tuberculosis
TLLDIAQANL

SEQ ID NO: 41091 - protein, 10 aa, Mycobacterium tuberculosis
LLDIAQANLG

SEQ ID NO: 41092 - protein, 10 aa, Mycobacterium tuberculosis
LDIAQANLGE

SEQ ID NO: 41093 - protein, 10 aa, Mycobacterium tuberculosis
DIAQANLGEA

SEQ ID NO: 41094 - protein, 10 aa, Mycobacterium tuberculosis
IAQANLGEAA

SEQ ID NO: 41095 - protein, 10 aa, Mycobacterium tuberculosis
AQANLGEAAG

SEQ ID NO: 41096 - protein, 10 aa, Mycobacterium tuberculosis
QANLGEAAGT

SEQ ID NO: 41097 - protein, 10 aa, Mycobacterium tuberculosis
ANLGEAAGTY

SEQ ID NO: 41098 - protein, 10 aa, Mycobacterium tuberculosis
NLGEAAGTYV

SEQ ID NO: 41099 - protein, 10 aa, Mycobacterium tuberculosis
LGEAAGTYVA

SEQ ID NO: 41100 - protein, 10 aa, Mycobacterium tuberculosis
GEAAGTYVAA

SEQ ID NO: 41101 - protein, 10 aa, Mycobacterium tuberculosis
EAAGTYVAAD

SEQ ID NO: 41102 - protein, 10 aa, Mycobacterium tuberculosis
AAGTYVAADA

SEQ ID NO: 41103 - protein, 10 aa, Mycobacterium tuberculosis
AGTYVAADAA

SEQ ID NO: 41104 - protein, 10 aa, Mycobacterium tuberculosis
GTYVAADAAA

SEQ ID NO: 41105 - protein, 10 aa, Mycobacterium tuberculosis
TYVAADAAAA

SEQ ID NO: 41106 - protein, 10 aa, Mycobacterium tuberculosis
YVAADAAAAS

SEQ ID NO: 41107 - protein, 10 aa, Mycobacterium tuberculosis
VAADAAAASS

SEQ ID NO: 41108 - protein, 10 aa, Mycobacterium tuberculosis
AADAAAASSY

SEQ ID NO: 41109 - protein, 10 aa, Mycobacterium tuberculosis
ADAAAASSYT

SEQ ID NO: 41110 - protein, 10 aa, Mycobacterium tuberculosis
DAAAASSYTG

SEQ ID NO: 41111 - protein, 10 aa, Mycobacterium tuberculosis
AAAASSYTGF

SEQ ID NO: 41112 - protein, 11 aa, Mycobacterium tuberculosis
MSLLDAHIPQL

SEQ ID NO: 41113 - protein, 11 aa, Mycobacterium tuberculosis
SLLDAHIPQLI

SEQ ID NO: 41114 - protein, 11 aa, Mycobacterium tuberculosis
LLDAHIPQLIA

SEQ ID NO: 41115 - protein, 11 aa, Mycobacterium tuberculosis
LDAHIPQLIAS

SEQ ID NO: 41116 - protein, 11 aa, Mycobacterium tuberculosis
DAHIPQLIASH

SEQ ID NO: 41117 - protein, 11 aa, Mycobacterium tuberculosis
AHIPQLIASHT

SEQ ID NO: 41118 - protein, 11 aa, Mycobacterium tuberculosis
HIPQLIASHTA

SEQ ID NO: 41119 - protein, 11 aa, Mycobacterium tuberculosis
IPQLIASHTAF

SEQ ID NO: 41120 - protein, 11 aa, Mycobacterium tuberculosis
PQLIASHTAFA

SEQ ID NO: 41121 - protein, 11 aa, Mycobacterium tuberculosis
QLIASHTAFAA

SEQ ID NO: 41122 - protein, 11 aa, Mycobacterium tuberculosis
LIASHTAFAAK

SEQ ID NO: 41123 - protein, 11 aa, Mycobacterium tuberculosis
IASHTAFAAKA

SEQ ID NO: 41124 - protein, 11 aa, Mycobacterium tuberculosis
ASHTAFAAKAG

SEQ ID NO: 41125 - protein, 11 aa, Mycobacterium tuberculosis
SHTAFAAKAGL

SEQ ID NO: 41126 - protein, 11 aa, Mycobacterium tuberculosis
HTAFAAKAGLM

SEQ ID NO: 41127 - protein, 11 aa, Mycobacterium tuberculosis
TAFAAKAGLMR

SEQ ID NO: 41128 - protein, 11 aa, Mycobacterium tuberculosis
AFAAKAGLMRH

SEQ ID NO: 41129 - protein, 11 aa, Mycobacterium tuberculosis
FAAKAGLMRHT

SEQ ID NO: 41130 - protein, 11 aa, Mycobacterium tuberculosis
AAKAGLMRHTI

SEQ ID NO: 41131 - protein, 11 aa, Mycobacterium tuberculosis
AKAGLMRHTIG

SEQ ID NO: 41132 - protein, 11 aa, Mycobacterium tuberculosis
KAGLMRHTIGQ

SEQ ID NO: 41133 - protein, 11 aa, Mycobacterium tuberculosis
AGLMRHTIGQA

SEQ ID NO: 41134 - protein, 11 aa, Mycobacterium tuberculosis
GLMRHTIGQAE

SEQ ID NO: 41135 - protein, 11 aa, Mycobacterium tuberculosis
LMRHTIGQAEQ

SEQ ID NO: 41136 - protein, 11 aa, Mycobacterium tuberculosis
MRHTIGQAEQQ

SEQ ID NO: 41137 - protein, 11 aa, Mycobacterium tuberculosis
RHTIGQAEQQA

SEQ ID NO: 41138 - protein, 11 aa, Mycobacterium tuberculosis
HTIGQAEQQAM

SEQ ID NO: 41139 - protein, 11 aa, Mycobacterium tuberculosis
TIGQAEQQAMS

SEQ ID NO: 41140 - protein, 11 aa, Mycobacterium tuberculosis
IGQAEQQAMSA

SEQ ID NO: 41141 - protein, 11 aa, Mycobacterium tuberculosis
GQAEQQAMSAQ

SEQ ID NO: 41142 - protein, 11 aa, Mycobacterium tuberculosis
QAEQQAMSAQA

SEQ ID NO: 41143 - protein, 11 aa, Mycobacterium tuberculosis
AEQQAMSAQAF

SEQ ID NO: 41144 - protein, 11 aa, Mycobacterium tuberculosis
EQQAMSAQAFH

SEQ ID NO: 41145 - protein, 11 aa, Mycobacterium tuberculosis
QQAMSAQAFHQ

SEQ ID NO: 41146 - protein, 11 aa, Mycobacterium tuberculosis
QAMSAQAFHQG

SEQ ID NO: 41147 - protein, 11 aa, Mycobacterium tuberculosis
AMSAQAFHQGE

SEQ ID NO: 41148 - protein, 11 aa, Mycobacterium tuberculosis
MSAQAFHQGES

SEQ ID NO: 41149 - protein, 11 aa, Mycobacterium tuberculosis
SAQAFHQGESA

SEQ ID NO: 41150 - protein, 11 aa, Mycobacterium tuberculosis
AQAFHQGESAA

SEQ ID NO: 41151 - protein, 11 aa, Mycobacterium tuberculosis
QAFHQGESAAA

SEQ ID NO: 41152 - protein, 11 aa, Mycobacterium tuberculosis
AFHQGESAAAF

SEQ ID NO: 41153 - protein, 11 aa, Mycobacterium tuberculosis
FHQGESAAAFQ

SEQ ID NO: 41154 - protein, 11 aa, Mycobacterium tuberculosis
HQGESAAAFQG

SEQ ID NO: 41155 - protein, 11 aa, Mycobacterium tuberculosis
QGESAAAFQGA

SEQ ID NO: 41156 - protein, 11 aa, Mycobacterium tuberculosis
GESAAAFQGAH

SEQ ID NO: 41157 - protein, 11 aa, Mycobacterium tuberculosis
ESAAAFQGAHA

SEQ ID NO: 41158 - protein, 11 aa, Mycobacterium tuberculosis
SAAAFQGAHAR

SEQ ID NO: 41159 - protein, 11 aa, Mycobacterium tuberculosis
AAAFQGAHARF

SEQ ID NO: 41160 - protein, 11 aa, Mycobacterium tuberculosis
AAFQGAHARFV

SEQ ID NO: 41161 - protein, 11 aa, Mycobacterium tuberculosis
AFQGAHARFVA

SEQ ID NO: 41162 - protein, 11 aa, Mycobacterium tuberculosis
FQGAHARFVAA

SEQ ID NO: 41163 - protein, 11 aa, Mycobacterium tuberculosis
QGAHARFVAAA

SEQ ID NO: 41164 - protein, 11 aa, Mycobacterium tuberculosis
GAHARFVAAAA

SEQ ID NO: 41165 - protein, 11 aa, Mycobacterium tuberculosis
AHARFVAAAAK

SEQ ID NO: 41166 - protein, 11 aa, Mycobacterium tuberculosis
HARFVAAAAKV

SEQ ID NO: 41167 - protein, 11 aa, Mycobacterium tuberculosis
ARFVAAAAKVN

SEQ ID NO: 41168 - protein, 11 aa, Mycobacterium tuberculosis
RFVAAAAKVNT

SEQ ID NO: 41169 - protein, 11 aa, Mycobacterium tuberculosis
FVAAAAKVNTL

SEQ ID NO: 41170 - protein, 11 aa, Mycobacterium tuberculosis
VAAAAKVNTLL

SEQ ID NO: 41171 - protein, 11 aa, Mycobacterium tuberculosis
AAAAKVNTLLD

SEQ ID NO: 41172 - protein, 11 aa, Mycobacterium tuberculosis
AAAKVNTLLDI

SEQ ID NO: 41173 - protein, 11 aa, Mycobacterium tuberculosis
AAKVNTLLDIA

SEQ ID NO: 41174 - protein, 11 aa, Mycobacterium tuberculosis
AKVNTLLDIAQ

SEQ ID NO: 41175 - protein, 11 aa, Mycobacterium tuberculosis
KVNTLLDIAQA

SEQ ID NO: 41176 - protein, 11 aa, Mycobacterium tuberculosis
VNTLLDIAQAN

SEQ ID NO: 41177 - protein, 11 aa, Mycobacterium tuberculosis
NTLLDIAQANL

SEQ ID NO: 41178 - protein, 11 aa, Mycobacterium tuberculosis
TLLDIAQANLG

SEQ ID NO: 41179 - protein, 11 aa, Mycobacterium tuberculosis
LLDIAQANLGE

SEQ ID NO: 41180 - protein, 11 aa, Mycobacterium tuberculosis
LDIAQANLGEA

SEQ ID NO: 41181 - protein, 11 aa, Mycobacterium tuberculosis
DIAQANLGEAA

SEQ ID NO: 41182 - protein, 11 aa, Mycobacterium tuberculosis
IAQANLGEAAG

SEQ ID NO: 41183 - protein, 11 aa, Mycobacterium tuberculosis
AQANLGEAAGT

SEQ ID NO: 41184 - protein, 11 aa, Mycobacterium tuberculosis
QANLGEAAGTY

SEQ ID NO: 41185 - protein, 11 aa, Mycobacterium tuberculosis
ANLGEAAGTYV

SEQ ID NO: 41186 - protein, 11 aa, Mycobacterium tuberculosis
NLGEAAGTYVA

SEQ ID NO: 41187 - protein, 11 aa, Mycobacterium tuberculosis
LGEAAGTYVAA

SEQ ID NO: 41188 - protein, 11 aa, Mycobacterium tuberculosis
GEAAGTYVAAD

SEQ ID NO: 41189 - protein, 11 aa, Mycobacterium tuberculosis
EAAGTYVAADA

SEQ ID NO: 41190 - protein, 11 aa, Mycobacterium tuberculosis
AAGTYVAADAA

SEQ ID NO: 41191 - protein, 11 aa, Mycobacterium tuberculosis
AGTYVAADAAA

SEQ ID NO: 41192 - protein, 11 aa, Mycobacterium tuberculosis
GTYVAADAAAA

SEQ ID NO: 41193 - protein, 11 aa, Mycobacterium tuberculosis
TYVAADAAAAS

SEQ ID NO: 41194 - protein, 11 aa, Mycobacterium tuberculosis
YVAADAAAASS

SEQ ID NO: 41195 - protein, 11 aa, Mycobacterium tuberculosis
VAADAAAASSY

SEQ ID NO: 41196 - protein, 11 aa, Mycobacterium tuberculosis
AADAAAASSYT

SEQ ID NO: 41197 - protein, 11 aa, Mycobacterium tuberculosis
ADAAAASSYTG

SEQ ID NO: 41198 - protein, 11 aa, Mycobacterium tuberculosis
DAAAASSYTGF

SEQ ID NO: 41199 - protein, 8 aa, Mycobacterium tuberculosis
MADSDLPT

SEQ ID NO: 41200 - protein, 8 aa, Mycobacterium tuberculosis
ADSDLPTK

SEQ ID NO: 41201 - protein, 8 aa, Mycobacterium tuberculosis
DSDLPTKG

SEQ ID NO: 41202 - protein, 8 aa, Mycobacterium tuberculosis
SDLPTKGR

SEQ ID NO: 41203 - protein, 8 aa, Mycobacterium tuberculosis
DLPTKGRQ

SEQ ID NO: 41204 - protein, 8 aa, Mycobacterium tuberculosis
LPTKGRQR

SEQ ID NO: 41205 - protein, 8 aa, Mycobacterium tuberculosis
PTKGRQRG

SEQ ID NO: 41206 - protein, 8 aa, Mycobacterium tuberculosis
TKGRQRGV

SEQ ID NO: 41207 - protein, 8 aa, Mycobacterium tuberculosis
KGRQRGVR

SEQ ID NO: 41208 - protein, 8 aa, Mycobacterium tuberculosis
GRQRGVRA

SEQ ID NO: 41209 - protein, 8 aa, Mycobacterium tuberculosis
RQRGVRAV

SEQ ID NO: 41210 - protein, 8 aa, Mycobacterium tuberculosis
QRGVRAVE

SEQ ID NO: 41211 - protein, 8 aa, Mycobacterium tuberculosis
RGVRAVEL

SEQ ID NO: 41212 - protein, 8 aa, Mycobacterium tuberculosis
GVRAVELN

SEQ ID NO: 41213 - protein, 8 aa, Mycobacterium tuberculosis
VRAVELNV

SEQ ID NO: 41214 - protein, 8 aa, Mycobacterium tuberculosis
RAVELNVA

SEQ ID NO: 41215 - protein, 8 aa, Mycobacterium tuberculosis
AVELNVAA

SEQ ID NO: 41216 - protein, 8 aa, Mycobacterium tuberculosis
VELNVAAR

SEQ ID NO: 41217 - protein, 8 aa, Mycobacterium tuberculosis
ELNVAARL

SEQ ID NO: 41218 - protein, 8 aa, Mycobacterium tuberculosis
LNVAARLE

SEQ ID NO: 41219 - protein, 8 aa, Mycobacterium tuberculosis
NVAARLEN

SEQ ID NO: 41220 - protein, 8 aa, Mycobacterium tuberculosis
VAARLENL

SEQ ID NO: 41221 - protein, 8 aa, Mycobacterium tuberculosis
AARLENLA

SEQ ID NO: 41222 - protein, 8 aa, Mycobacterium tuberculosis
ARLENLAL

SEQ ID NO: 41223 - protein, 8 aa, Mycobacterium tuberculosis
RLENLALL

SEQ ID NO: 41224 - protein, 8 aa, Mycobacterium tuberculosis
LENLALLR

SEQ ID NO: 41225 - protein, 8 aa, Mycobacterium tuberculosis
ENLALLRT

SEQ ID NO: 41226 - protein, 8 aa, Mycobacterium tuberculosis
NLALLRTL

SEQ ID NO: 41227 - protein, 8 aa, Mycobacterium tuberculosis
LALLRTLV

SEQ ID NO: 41228 - protein, 8 aa, Mycobacterium tuberculosis
ALLRTLVG

SEQ ID NO: 41229 - protein, 8 aa, Mycobacterium tuberculosis
LLRTLVGA

SEQ ID NO: 41230 - protein, 8 aa, Mycobacterium tuberculosis
LRTLVGAI

SEQ ID NO: 41231 - protein, 8 aa, Mycobacterium tuberculosis
RTLVGAIG

SEQ ID NO: 41232 - protein, 8 aa, Mycobacterium tuberculosis
TLVGAIGT

SEQ ID NO: 41233 - protein, 8 aa, Mycobacterium tuberculosis
LVGAIGTF

SEQ ID NO: 41234 - protein, 8 aa, Mycobacterium tuberculosis
VGAIGTFE

SEQ ID NO: 41235 - protein, 8 aa, Mycobacterium tuberculosis
GAIGTFED

SEQ ID NO: 41236 - protein, 8 aa, Mycobacterium tuberculosis
AIGTFEDL

SEQ ID NO: 41237 - protein, 8 aa, Mycobacterium tuberculosis
IGTFEDLD

SEQ ID NO: 41238 - protein, 8 aa, Mycobacterium tuberculosis
GTFEDLDF

SEQ ID NO: 41239 - protein, 8 aa, Mycobacterium tuberculosis
TFEDLDFD

SEQ ID NO: 41240 - protein, 8 aa, Mycobacterium tuberculosis
FEDLDFDA

SEQ ID NO: 41241 - protein, 8 aa, Mycobacterium tuberculosis
EDLDFDAV

SEQ ID NO: 41242 - protein, 8 aa, Mycobacterium tuberculosis
DLDFDAVA

SEQ ID NO: 41243 - protein, 8 aa, Mycobacterium tuberculosis
LDFDAVAD

SEQ ID NO: 41244 - protein, 8 aa, Mycobacterium tuberculosis
DFDAVADL

SEQ ID NO: 41245 - protein, 8 aa, Mycobacterium tuberculosis
FDAVADLR

SEQ ID NO: 41246 - protein, 8 aa, Mycobacterium tuberculosis
DAVADLRL

SEQ ID NO: 41247 - protein, 8 aa, Mycobacterium tuberculosis
AVADLRLA

SEQ ID NO: 41248 - protein, 8 aa, Mycobacterium tuberculosis
VADLRLAV

SEQ ID NO: 41249 - protein, 8 aa, Mycobacterium tuberculosis
ADLRLAVD

SEQ ID NO: 41250 - protein, 8 aa, Mycobacterium tuberculosis
DLRLAVDE

SEQ ID NO: 41251 - protein, 8 aa, Mycobacterium tuberculosis
LRLAVDEV

SEQ ID NO: 41252 - protein, 8 aa, Mycobacterium tuberculosis
RLAVDEVC

SEQ ID NO: 41253 - protein, 8 aa, Mycobacterium tuberculosis
LAVDEVCT

SEQ ID NO: 41254 - protein, 8 aa, Mycobacterium tuberculosis
AVDEVCTR

SEQ ID NO: 41255 - protein, 8 aa, Mycobacterium tuberculosis
VDEVCTRL

SEQ ID NO: 41256 - protein, 8 aa, Mycobacterium tuberculosis
DEVCTRLI

SEQ ID NO: 41257 - protein, 8 aa, Mycobacterium tuberculosis
EVCTRLIR

SEQ ID NO: 41258 - protein, 8 aa, Mycobacterium tuberculosis
VCTRLIRS

SEQ ID NO: 41259 - protein, 8 aa, Mycobacterium tuberculosis
CTRLIRSA

SEQ ID NO: 41260 - protein, 8 aa, Mycobacterium tuberculosis
TRLIRSAL

SEQ ID NO: 41261 - protein, 8 aa, Mycobacterium tuberculosis
RLIRSALP

SEQ ID NO: 41262 - protein, 8 aa, Mycobacterium tuberculosis
LIRSALPD

SEQ ID NO: 41263 - protein, 8 aa, Mycobacterium tuberculosis
IRSALPDA

SEQ ID NO: 41264 - protein, 8 aa, Mycobacterium tuberculosis
RSALPDAT

SEQ ID NO: 41265 - protein, 8 aa, Mycobacterium tuberculosis
SALPDATL

SEQ ID NO: 41266 - protein, 8 aa, Mycobacterium tuberculosis
ALPDATLR

SEQ ID NO: 41267 - protein, 8 aa, Mycobacterium tuberculosis
LPDATLRL

SEQ ID NO: 41268 - protein, 8 aa, Mycobacterium tuberculosis
PDATLRLV

SEQ ID NO: 41269 - protein, 8 aa, Mycobacterium tuberculosis
DATLRLVV

SEQ ID NO: 41270 - protein, 8 aa, Mycobacterium tuberculosis
ATLRLVVD

SEQ ID NO: 41271 - protein, 8 aa, Mycobacterium tuberculosis
TLRLVVDP

SEQ ID NO: 41272 - protein, 8 aa, Mycobacterium tuberculosis
LRLVVDPR

SEQ ID NO: 41273 - protein, 8 aa, Mycobacterium tuberculosis
RLVVDPRK

SEQ ID NO: 41274 - protein, 8 aa, Mycobacterium tuberculosis
LVVDPRKD

SEQ ID NO: 41275 - protein, 8 aa, Mycobacterium tuberculosis
VVDPRKDE

SEQ ID NO: 41276 - protein, 8 aa, Mycobacterium tuberculosis
VDPRKDEV

SEQ ID NO: 41277 - protein, 8 aa, Mycobacterium tuberculosis
DPRKDEVV

SEQ ID NO: 41278 - protein, 8 aa, Mycobacterium tuberculosis
PRKDEVVV

SEQ ID NO: 41279 - protein, 8 aa, Mycobacterium tuberculosis
RKDEVVVE

SEQ ID NO: 41280 - protein, 8 aa, Mycobacterium tuberculosis
KDEVVVEA

SEQ ID NO: 41281 - protein, 8 aa, Mycobacterium tuberculosis
DEVVVEAS

SEQ ID NO: 41282 - protein, 8 aa, Mycobacterium tuberculosis
EVVVEASA

SEQ ID NO: 41283 - protein, 8 aa, Mycobacterium tuberculosis
VVVEASAA

SEQ ID NO: 41284 - protein, 8 aa, Mycobacterium tuberculosis
VVEASAAC

SEQ ID NO: 41285 - protein, 8 aa, Mycobacterium tuberculosis
VEASAACD

SEQ ID NO: 41286 - protein, 8 aa, Mycobacterium tuberculosis
EASAACDT

SEQ ID NO: 41287 - protein, 8 aa, Mycobacterium tuberculosis
ASAACDTH

SEQ ID NO: 41288 - protein, 8 aa, Mycobacterium tuberculosis
SAACDTHD

SEQ ID NO: 41289 - protein, 8 aa, Mycobacterium tuberculosis
AACDTHDV

SEQ ID NO: 41290 - protein, 8 aa, Mycobacterium tuberculosis
ACDTHDVV

SEQ ID NO: 41291 - protein, 8 aa, Mycobacterium tuberculosis
CDTHDVVA

SEQ ID NO: 41292 - protein, 8 aa, Mycobacterium tuberculosis
DTHDVVAP

SEQ ID NO: 41293 - protein, 8 aa, Mycobacterium tuberculosis
THDVVAPG

SEQ ID NO: 41294 - protein, 8 aa, Mycobacterium tuberculosis
HDVVAPGS

SEQ ID NO: 41295 - protein, 8 aa, Mycobacterium tuberculosis
DVVAPGSF

SEQ ID NO: 41296 - protein, 8 aa, Mycobacterium tuberculosis
VVAPGSFS

SEQ ID NO: 41297 - protein, 8 aa, Mycobacterium tuberculosis
VAPGSFSW

SEQ ID NO: 41298 - protein, 8 aa, Mycobacterium tuberculosis
APGSFSWH

SEQ ID NO: 41299 - protein, 8 aa, Mycobacterium tuberculosis
PGSFSWHV

SEQ ID NO: 41300 - protein, 8 aa, Mycobacterium tuberculosis
GSFSWHVL

SEQ ID NO: 41301 - protein, 8 aa, Mycobacterium tuberculosis
SFSWHVLT

SEQ ID NO: 41302 - protein, 8 aa, Mycobacterium tuberculosis
FSWHVLTA

SEQ ID NO: 41303 - protein, 8 aa, Mycobacterium tuberculosis
SWHVLTAL

SEQ ID NO: 41304 - protein, 8 aa, Mycobacterium tuberculosis
WHVLTALA

SEQ ID NO: 41305 - protein, 8 aa, Mycobacterium tuberculosis
HVLTALAD

SEQ ID NO: 41306 - protein, 8 aa, Mycobacterium tuberculosis
VLTALADD

SEQ ID NO: 41307 - protein, 8 aa, Mycobacterium tuberculosis
LTALADDV

SEQ ID NO: 41308 - protein, 8 aa, Mycobacterium tuberculosis
TALADDVQ

SEQ ID NO: 41309 - protein, 8 aa, Mycobacterium tuberculosis
ALADDVQT

SEQ ID NO: 41310 - protein, 8 aa, Mycobacterium tuberculosis
LADDVQTF

SEQ ID NO: 41311 - protein, 8 aa, Mycobacterium tuberculosis
ADDVQTFH

SEQ ID NO: 41312 - protein, 8 aa, Mycobacterium tuberculosis
DDVQTFHD

SEQ ID NO: 41313 - protein, 8 aa, Mycobacterium tuberculosis
DVQTFHDG

SEQ ID NO: 41314 - protein, 8 aa, Mycobacterium tuberculosis
VQTFHDGR

SEQ ID NO: 41315 - protein, 8 aa, Mycobacterium tuberculosis
QTFHDGRQ

SEQ ID NO: 41316 - protein, 8 aa, Mycobacterium tuberculosis
TFHDGRQP

SEQ ID NO: 41317 - protein, 8 aa, Mycobacterium tuberculosis
FHDGRQPD

SEQ ID NO: 41318 - protein, 8 aa, Mycobacterium tuberculosis
HDGRQPDV

SEQ ID NO: 41319 - protein, 8 aa, Mycobacterium tuberculosis
DGRQPDVA

SEQ ID NO: 41320 - protein, 8 aa, Mycobacterium tuberculosis
GRQPDVAG

SEQ ID NO: 41321 - protein, 8 aa, Mycobacterium tuberculosis
RQPDVAGS

SEQ ID NO: 41322 - protein, 8 aa, Mycobacterium tuberculosis
QPDVAGSV

SEQ ID NO: 41323 - protein, 8 aa, Mycobacterium tuberculosis
PDVAGSVF

SEQ ID NO: 41324 - protein, 8 aa, Mycobacterium tuberculosis
DVAGSVFG

SEQ ID NO: 41325 - protein, 8 aa, Mycobacterium tuberculosis
VAGSVFGI

SEQ ID NO: 41326 - protein, 8 aa, Mycobacterium tuberculosis
AGSVFGIT

SEQ ID NO: 41327 - protein, 8 aa, Mycobacterium tuberculosis
GSVFGITL

SEQ ID NO: 41328 - protein, 8 aa, Mycobacterium tuberculosis
SVFGITLT

SEQ ID NO: 41329 - protein, 8 aa, Mycobacterium tuberculosis
VFGITLTA

SEQ ID NO: 41330 - protein, 8 aa, Mycobacterium tuberculosis
FGITLTAR

SEQ ID NO: 41331 - protein, 8 aa, Mycobacterium tuberculosis
GITLTARR

SEQ ID NO: 41332 - protein, 8 aa, Mycobacterium tuberculosis
ITLTARRA

SEQ ID NO: 41333 - protein, 8 aa, Mycobacterium tuberculosis
TLTARRAA

SEQ ID NO: 41334 - protein, 8 aa, Mycobacterium tuberculosis
LTARRAAS

SEQ ID NO: 41335 - protein, 8 aa, Mycobacterium tuberculosis
TARRAASS

SEQ ID NO: 41336 - protein, 8 aa, Mycobacterium tuberculosis
ARRAASSR

SEQ ID NO: 41337 - protein, 9 aa, Mycobacterium tuberculosis
MADSDLPTK

SEQ ID NO: 41338 - protein, 9 aa, Mycobacterium tuberculosis
ADSDLPTKG

SEQ ID NO: 41339 - protein, 9 aa, Mycobacterium tuberculosis
DSDLPTKGR

SEQ ID NO: 41340 - protein, 9 aa, Mycobacterium tuberculosis
SDLPTKGRQ

SEQ ID NO: 41341 - protein, 9 aa, Mycobacterium tuberculosis
DLPTKGRQR

SEQ ID NO: 41342 - protein, 9 aa, Mycobacterium tuberculosis
LPTKGRQRG

SEQ ID NO: 41343 - protein, 9 aa, Mycobacterium tuberculosis
PTKGRQRGV

SEQ ID NO: 41344 - protein, 9 aa, Mycobacterium tuberculosis
TKGRQRGVR

SEQ ID NO: 41345 - protein, 9 aa, Mycobacterium tuberculosis
KGRQRGVRA

SEQ ID NO: 41346 - protein, 9 aa, Mycobacterium tuberculosis
GRQRGVRAV

SEQ ID NO: 41347 - protein, 9 aa, Mycobacterium tuberculosis
RQRGVRAVE

SEQ ID NO: 41348 - protein, 9 aa, Mycobacterium tuberculosis
QRGVRAVEL

SEQ ID NO: 41349 - protein, 9 aa, Mycobacterium tuberculosis
RGVRAVELN

SEQ ID NO: 41350 - protein, 9 aa, Mycobacterium tuberculosis
GVRAVELNV

SEQ ID NO: 41351 - protein, 9 aa, Mycobacterium tuberculosis
VRAVELNVA

SEQ ID NO: 41352 - protein, 9 aa, Mycobacterium tuberculosis
RAVELNVAA

SEQ ID NO: 41353 - protein, 9 aa, Mycobacterium tuberculosis
AVELNVAAR

SEQ ID NO: 41354 - protein, 9 aa, Mycobacterium tuberculosis
VELNVAARL

SEQ ID NO: 41355 - protein, 9 aa, Mycobacterium tuberculosis
ELNVAARLE

SEQ ID NO: 41356 - protein, 9 aa, Mycobacterium tuberculosis
LNVAARLEN

SEQ ID NO: 41357 - protein, 9 aa, Mycobacterium tuberculosis
NVAARLENL

SEQ ID NO: 41358 - protein, 9 aa, Mycobacterium tuberculosis
VAARLENLA

SEQ ID NO: 41359 - protein, 9 aa, Mycobacterium tuberculosis
AARLENLAL

SEQ ID NO: 41360 - protein, 9 aa, Mycobacterium tuberculosis
ARLENLALL

SEQ ID NO: 41361 - protein, 9 aa, Mycobacterium tuberculosis
RLENLALLR

SEQ ID NO: 41362 - protein, 9 aa, Mycobacterium tuberculosis
LENLALLRT

SEQ ID NO: 41363 - protein, 9 aa, Mycobacterium tuberculosis
ENLALLRTL

SEQ ID NO: 41364 - protein, 9 aa, Mycobacterium tuberculosis
NLALLRTLV

SEQ ID NO: 41365 - protein, 9 aa, Mycobacterium tuberculosis
LALLRTLVG

SEQ ID NO: 41366 - protein, 9 aa, Mycobacterium tuberculosis
ALLRTLVGA

SEQ ID NO: 41367 - protein, 9 aa, Mycobacterium tuberculosis
LLRTLVGAI

SEQ ID NO: 41368 - protein, 9 aa, Mycobacterium tuberculosis
LRTLVGAIG

SEQ ID NO: 41369 - protein, 9 aa, Mycobacterium tuberculosis
RTLVGAIGT

SEQ ID NO: 41370 - protein, 9 aa, Mycobacterium tuberculosis
TLVGAIGTF

SEQ ID NO: 41371 - protein, 9 aa, Mycobacterium tuberculosis
LVGAIGTFE

SEQ ID NO: 41372 - protein, 9 aa, Mycobacterium tuberculosis
VGAIGTFED

SEQ ID NO: 41373 - protein, 9 aa, Mycobacterium tuberculosis
GAIGTFEDL

SEQ ID NO: 41374 - protein, 9 aa, Mycobacterium tuberculosis
AIGTFEDLD

SEQ ID NO: 41375 - protein, 9 aa, Mycobacterium tuberculosis
IGTFEDLDF

SEQ ID NO: 41376 - protein, 9 aa, Mycobacterium tuberculosis
GTFEDLDFD

SEQ ID NO: 41377 - protein, 9 aa, Mycobacterium tuberculosis
TFEDLDFDA

SEQ ID NO: 41378 - protein, 9 aa, Mycobacterium tuberculosis
FEDLDFDAV

SEQ ID NO: 41379 - protein, 9 aa, Mycobacterium tuberculosis
EDLDFDAVA

SEQ ID NO: 41380 - protein, 9 aa, Mycobacterium tuberculosis
DLDFDAVAD

SEQ ID NO: 41381 - protein, 9 aa, Mycobacterium tuberculosis
LDFDAVADL

SEQ ID NO: 41382 - protein, 9 aa, Mycobacterium tuberculosis
DFDAVADLR

SEQ ID NO: 41383 - protein, 9 aa, Mycobacterium tuberculosis
FDAVADLRL

SEQ ID NO: 41384 - protein, 9 aa, Mycobacterium tuberculosis
DAVADLRLA

SEQ ID NO: 41385 - protein, 9 aa, Mycobacterium tuberculosis
AVADLRLAV

SEQ ID NO: 41386 - protein, 9 aa, Mycobacterium tuberculosis
VADLRLAVD

SEQ ID NO: 41387 - protein, 9 aa, Mycobacterium tuberculosis
ADLRLAVDE

SEQ ID NO: 41388 - protein, 9 aa, Mycobacterium tuberculosis
DLRLAVDEV

SEQ ID NO: 41389 - protein, 9 aa, Mycobacterium tuberculosis
LRLAVDEVC

SEQ ID NO: 41390 - protein, 9 aa, Mycobacterium tuberculosis
RLAVDEVCT

SEQ ID NO: 41391 - protein, 9 aa, Mycobacterium tuberculosis
LAVDEVCTR

SEQ ID NO: 41392 - protein, 9 aa, Mycobacterium tuberculosis
AVDEVCTRL

SEQ ID NO: 41393 - protein, 9 aa, Mycobacterium tuberculosis
VDEVCTRLI

SEQ ID NO: 41394 - protein, 9 aa, Mycobacterium tuberculosis
DEVCTRLIR

SEQ ID NO: 41395 - protein, 9 aa, Mycobacterium tuberculosis
EVCTRLIRS

SEQ ID NO: 41396 - protein, 9 aa, Mycobacterium tuberculosis
VCTRLIRSA

SEQ ID NO: 41397 - protein, 9 aa, Mycobacterium tuberculosis
CTRLIRSAL

SEQ ID NO: 41398 - protein, 9 aa, Mycobacterium tuberculosis
TRLIRSALP

SEQ ID NO: 41399 - protein, 9 aa, Mycobacterium tuberculosis
RLIRSALPD

SEQ ID NO: 41400 - protein, 9 aa, Mycobacterium tuberculosis
LIRSALPDA

SEQ ID NO: 41401 - protein, 9 aa, Mycobacterium tuberculosis
IRSALPDAT

SEQ ID NO: 41402 - protein, 9 aa, Mycobacterium tuberculosis
RSALPDATL

SEQ ID NO: 41403 - protein, 9 aa, Mycobacterium tuberculosis
SALPDATLR

SEQ ID NO: 41404 - protein, 9 aa, Mycobacterium tuberculosis
ALPDATLRL

SEQ ID NO: 41405 - protein, 9 aa, Mycobacterium tuberculosis
LPDATLRLV

SEQ ID NO: 41406 - protein, 9 aa, Mycobacterium tuberculosis
PDATLRLVV

SEQ ID NO: 41407 - protein, 9 aa, Mycobacterium tuberculosis
DATLRLVVD

SEQ ID NO: 41408 - protein, 9 aa, Mycobacterium tuberculosis
ATLRLVVDP

SEQ ID NO: 41409 - protein, 9 aa, Mycobacterium tuberculosis
TLRLVVDPR

SEQ ID NO: 41410 - protein, 9 aa, Mycobacterium tuberculosis
LRLVVDPRK

SEQ ID NO: 41411 - protein, 9 aa, Mycobacterium tuberculosis
RLVVDPRKD

SEQ ID NO: 41412 - protein, 9 aa, Mycobacterium tuberculosis
LVVDPRKDE

SEQ ID NO: 41413 - protein, 9 aa, Mycobacterium tuberculosis
VVDPRKDEV

SEQ ID NO: 41414 - protein, 9 aa, Mycobacterium tuberculosis
VDPRKDEVV

SEQ ID NO: 41415 - protein, 9 aa, Mycobacterium tuberculosis
DPRKDEVVV

SEQ ID NO: 41416 - protein, 9 aa, Mycobacterium tuberculosis
PRKDEVVVE

SEQ ID NO: 41417 - protein, 9 aa, Mycobacterium tuberculosis
RKDEVVVEA

SEQ ID NO: 41418 - protein, 9 aa, Mycobacterium tuberculosis
KDEVVVEAS

SEQ ID NO: 41419 - protein, 9 aa, Mycobacterium tuberculosis
DEVVVEASA

SEQ ID NO: 41420 - protein, 9 aa, Mycobacterium tuberculosis
EVVVEASAA

SEQ ID NO: 41421 - protein, 9 aa, Mycobacterium tuberculosis
VVVEASAAC

SEQ ID NO: 41422 - protein, 9 aa, Mycobacterium tuberculosis
VVEASAACD

SEQ ID NO: 41423 - protein, 9 aa, Mycobacterium tuberculosis
VEASAACDT

SEQ ID NO: 41424 - protein, 9 aa, Mycobacterium tuberculosis
EASAACDTH

SEQ ID NO: 41425 - protein, 9 aa, Mycobacterium tuberculosis
ASAACDTHD

SEQ ID NO: 41426 - protein, 9 aa, Mycobacterium tuberculosis
SAACDTHDV

SEQ ID NO: 41427 - protein, 9 aa, Mycobacterium tuberculosis
AACDTHDVV

SEQ ID NO: 41428 - protein, 9 aa, Mycobacterium tuberculosis
ACDTHDVVA

SEQ ID NO: 41429 - protein, 9 aa, Mycobacterium tuberculosis
CDTHDVVAP

SEQ ID NO: 41430 - protein, 9 aa, Mycobacterium tuberculosis
DTHDVVAPG

SEQ ID NO: 41431 - protein, 9 aa, Mycobacterium tuberculosis
THDVVAPGS

SEQ ID NO: 41432 - protein, 9 aa, Mycobacterium tuberculosis
HDVVAPGSF

SEQ ID NO: 41433 - protein, 9 aa, Mycobacterium tuberculosis
DVVAPGSFS

SEQ ID NO: 41434 - protein, 9 aa, Mycobacterium tuberculosis
VVAPGSFSW

SEQ ID NO: 41435 - protein, 9 aa, Mycobacterium tuberculosis
VAPGSFSWH

SEQ ID NO: 41436 - protein, 9 aa, Mycobacterium tuberculosis
APGSFSWHV

SEQ ID NO: 41437 - protein, 9 aa, Mycobacterium tuberculosis
PGSFSWHVL

SEQ ID NO: 41438 - protein, 9 aa, Mycobacterium tuberculosis
GSFSWHVLT

SEQ ID NO: 41439 - protein, 9 aa, Mycobacterium tuberculosis
SFSWHVLTA

SEQ ID NO: 41440 - protein, 9 aa, Mycobacterium tuberculosis
FSWHVLTAL

SEQ ID NO: 41441 - protein, 9 aa, Mycobacterium tuberculosis
SWHVLTALA

SEQ ID NO: 41442 - protein, 9 aa, Mycobacterium tuberculosis
WHVLTALAD

SEQ ID NO: 41443 - protein, 9 aa, Mycobacterium tuberculosis
HVLTALADD

SEQ ID NO: 41444 - protein, 9 aa, Mycobacterium tuberculosis
VLTALADDV

SEQ ID NO: 41445 - protein, 9 aa, Mycobacterium tuberculosis
LTALADDVQ

SEQ ID NO: 41446 - protein, 9 aa, Mycobacterium tuberculosis
TALADDVQT

SEQ ID NO: 41447 - protein, 9 aa, Mycobacterium tuberculosis
ALADDVQTF

SEQ ID NO: 41448 - protein, 9 aa, Mycobacterium tuberculosis
LADDVQTFH

SEQ ID NO: 41449 - protein, 9 aa, Mycobacterium tuberculosis
ADDVQTFHD

SEQ ID NO: 41450 - protein, 9 aa, Mycobacterium tuberculosis
DDVQTFHDG

SEQ ID NO: 41451 - protein, 9 aa, Mycobacterium tuberculosis
DVQTFHDGR

SEQ ID NO: 41452 - protein, 9 aa, Mycobacterium tuberculosis
VQTFHDGRQ

SEQ ID NO: 41453 - protein, 9 aa, Mycobacterium tuberculosis
QTFHDGRQP

SEQ ID NO: 41454 - protein, 9 aa, Mycobacterium tuberculosis
TFHDGRQPD

SEQ ID NO: 41455 - protein, 9 aa, Mycobacterium tuberculosis
FHDGRQPDV

SEQ ID NO: 41456 - protein, 9 aa, Mycobacterium tuberculosis
HDGRQPDVA

SEQ ID NO: 41457 - protein, 9 aa, Mycobacterium tuberculosis
DGRQPDVAG

SEQ ID NO: 41458 - protein, 9 aa, Mycobacterium tuberculosis
GRQPDVAGS

SEQ ID NO: 41459 - protein, 9 aa, Mycobacterium tuberculosis
RQPDVAGSV

SEQ ID NO: 41460 - protein, 9 aa, Mycobacterium tuberculosis
QPDVAGSVF

SEQ ID NO: 41461 - protein, 9 aa, Mycobacterium tuberculosis
PDVAGSVFG

SEQ ID NO: 41462 - protein, 9 aa, Mycobacterium tuberculosis
DVAGSVFGI

SEQ ID NO: 41463 - protein, 9 aa, Mycobacterium tuberculosis
VAGSVFGIT

SEQ ID NO: 41464 - protein, 9 aa, Mycobacterium tuberculosis
AGSVFGITL

SEQ ID NO: 41465 - protein, 9 aa, Mycobacterium tuberculosis
GSVFGITLT

SEQ ID NO: 41466 - protein, 9 aa, Mycobacterium tuberculosis
SVFGITLTA

SEQ ID NO: 41467 - protein, 9 aa, Mycobacterium tuberculosis
VFGITLTAR

SEQ ID NO: 41468 - protein, 9 aa, Mycobacterium tuberculosis
FGITLTARR

SEQ ID NO: 41469 - protein, 9 aa, Mycobacterium tuberculosis
GITLTARRA

SEQ ID NO: 41470 - protein, 9 aa, Mycobacterium tuberculosis
ITLTARRAA

SEQ ID NO: 41471 - protein, 9 aa, Mycobacterium tuberculosis
TLTARRAAS

SEQ ID NO: 41472 - protein, 9 aa, Mycobacterium tuberculosis
LTARRAASS

SEQ ID NO: 41473 - protein, 9 aa, Mycobacterium tuberculosis
TARRAASSR

SEQ ID NO: 41474 - protein, 10 aa, Mycobacterium tuberculosis
MADSDLPTKG

SEQ ID NO: 41475 - protein, 10 aa, Mycobacterium tuberculosis
ADSDLPTKGR

SEQ ID NO: 41476 - protein, 10 aa, Mycobacterium tuberculosis
DSDLPTKGRQ

SEQ ID NO: 41477 - protein, 10 aa, Mycobacterium tuberculosis
SDLPTKGRQR

SEQ ID NO: 41478 - protein, 10 aa, Mycobacterium tuberculosis
DLPTKGRQRG

SEQ ID NO: 41479 - protein, 10 aa, Mycobacterium tuberculosis
LPTKGRQRGV

SEQ ID NO: 41480 - protein, 10 aa, Mycobacterium tuberculosis
PTKGRQRGVR

SEQ ID NO: 41481 - protein, 10 aa, Mycobacterium tuberculosis
TKGRQRGVRA

SEQ ID NO: 41482 - protein, 10 aa, Mycobacterium tuberculosis
KGRQRGVRAV

SEQ ID NO: 41483 - protein, 10 aa, Mycobacterium tuberculosis
GRQRGVRAVE

SEQ ID NO: 41484 - protein, 10 aa, Mycobacterium tuberculosis
RQRGVRAVEL

SEQ ID NO: 41485 - protein, 10 aa, Mycobacterium tuberculosis
QRGVRAVELN

SEQ ID NO: 41486 - protein, 10 aa, Mycobacterium tuberculosis
RGVRAVELNV

SEQ ID NO: 41487 - protein, 10 aa, Mycobacterium tuberculosis
GVRAVELNVA

SEQ ID NO: 41488 - protein, 10 aa, Mycobacterium tuberculosis
VRAVELNVAA

SEQ ID NO: 41489 - protein, 10 aa, Mycobacterium tuberculosis
RAVELNVAAR

SEQ ID NO: 41490 - protein, 10 aa, Mycobacterium tuberculosis
AVELNVAARL

SEQ ID NO: 41491 - protein, 10 aa, Mycobacterium tuberculosis
VELNVAARLE

SEQ ID NO: 41492 - protein, 10 aa, Mycobacterium tuberculosis
ELNVAARLEN

SEQ ID NO: 41493 - protein, 10 aa, Mycobacterium tuberculosis
LNVAARLENL

SEQ ID NO: 41494 - protein, 10 aa, Mycobacterium tuberculosis
NVAARLENLA

SEQ ID NO: 41495 - protein, 10 aa, Mycobacterium tuberculosis
VAARLENLAL

SEQ ID NO: 41496 - protein, 10 aa, Mycobacterium tuberculosis
AARLENLALL

SEQ ID NO: 41497 - protein, 10 aa, Mycobacterium tuberculosis
ARLENLALLR

SEQ ID NO: 41498 - protein, 10 aa, Mycobacterium tuberculosis
RLENLALLRT

SEQ ID NO: 41499 - protein, 10 aa, Mycobacterium tuberculosis
LENLALLRTL

SEQ ID NO: 41500 - protein, 10 aa, Mycobacterium tuberculosis
ENLALLRTLV

SEQ ID NO: 41501 - protein, 10 aa, Mycobacterium tuberculosis
NLALLRTLVG

SEQ ID NO: 41502 - protein, 10 aa, Mycobacterium tuberculosis
LALLRTLVGA

SEQ ID NO: 41503 - protein, 10 aa, Mycobacterium tuberculosis
ALLRTLVGAI

SEQ ID NO: 41504 - protein, 10 aa, Mycobacterium tuberculosis
LLRTLVGAIG

SEQ ID NO: 41505 - protein, 10 aa, Mycobacterium tuberculosis
LRTLVGAIGT

SEQ ID NO: 41506 - protein, 10 aa, Mycobacterium tuberculosis
RTLVGAIGTF

SEQ ID NO: 41507 - protein, 10 aa, Mycobacterium tuberculosis
TLVGAIGTFE

SEQ ID NO: 41508 - protein, 10 aa, Mycobacterium tuberculosis
LVGAIGTFED

SEQ ID NO: 41509 - protein, 10 aa, Mycobacterium tuberculosis
VGAIGTFEDL

SEQ ID NO: 41510 - protein, 10 aa, Mycobacterium tuberculosis
GAIGTFEDLD

SEQ ID NO: 41511 - protein, 10 aa, Mycobacterium tuberculosis
AIGTFEDLDF

SEQ ID NO: 41512 - protein, 10 aa, Mycobacterium tuberculosis
IGTFEDLDFD

SEQ ID NO: 41513 - protein, 10 aa, Mycobacterium tuberculosis
GTFEDLDFDA

SEQ ID NO: 41514 - protein, 10 aa, Mycobacterium tuberculosis
TFEDLDFDAV

SEQ ID NO: 41515 - protein, 10 aa, Mycobacterium tuberculosis
FEDLDFDAVA

SEQ ID NO: 41516 - protein, 10 aa, Mycobacterium tuberculosis
EDLDFDAVAD

SEQ ID NO: 41517 - protein, 10 aa, Mycobacterium tuberculosis
DLDFDAVADL

SEQ ID NO: 41518 - protein, 10 aa, Mycobacterium tuberculosis
LDFDAVADLR

SEQ ID NO: 41519 - protein, 10 aa, Mycobacterium tuberculosis
DFDAVADLRL

SEQ ID NO: 41520 - protein, 10 aa, Mycobacterium tuberculosis
FDAVADLRLA

SEQ ID NO: 41521 - protein, 10 aa, Mycobacterium tuberculosis
DAVADLRLAV

SEQ ID NO: 41522 - protein, 10 aa, Mycobacterium tuberculosis
AVADLRLAVD

SEQ ID NO: 41523 - protein, 10 aa, Mycobacterium tuberculosis
VADLRLAVDE

SEQ ID NO: 41524 - protein, 10 aa, Mycobacterium tuberculosis
ADLRLAVDEV

SEQ ID NO: 41525 - protein, 10 aa, Mycobacterium tuberculosis
DLRLAVDEVC

SEQ ID NO: 41526 - protein, 10 aa, Mycobacterium tuberculosis
LRLAVDEVCT

SEQ ID NO: 41527 - protein, 10 aa, Mycobacterium tuberculosis
RLAVDEVCTR

SEQ ID NO: 41528 - protein, 10 aa, Mycobacterium tuberculosis
LAVDEVCTRL

SEQ ID NO: 41529 - protein, 10 aa, Mycobacterium tuberculosis
AVDEVCTRLI

SEQ ID NO: 41530 - protein, 10 aa, Mycobacterium tuberculosis
VDEVCTRLIR

SEQ ID NO: 41531 - protein, 10 aa, Mycobacterium tuberculosis
DEVCTRLIRS

SEQ ID NO: 41532 - protein, 10 aa, Mycobacterium tuberculosis
EVCTRLIRSA

SEQ ID NO: 41533 - protein, 10 aa, Mycobacterium tuberculosis
VCTRLIRSAL

SEQ ID NO: 41534 - protein, 10 aa, Mycobacterium tuberculosis
CTRLIRSALP

SEQ ID NO: 41535 - protein, 10 aa, Mycobacterium tuberculosis
TRLIRSALPD

SEQ ID NO: 41536 - protein, 10 aa, Mycobacterium tuberculosis
RLIRSALPDA

SEQ ID NO: 41537 - protein, 10 aa, Mycobacterium tuberculosis
LIRSALPDAT

SEQ ID NO: 41538 - protein, 10 aa, Mycobacterium tuberculosis
IRSALPDATL

SEQ ID NO: 41539 - protein, 10 aa, Mycobacterium tuberculosis
RSALPDATLR

SEQ ID NO: 41540 - protein, 10 aa, Mycobacterium tuberculosis
SALPDATLRL

SEQ ID NO: 41541 - protein, 10 aa, Mycobacterium tuberculosis
ALPDATLRLV

SEQ ID NO: 41542 - protein, 10 aa, Mycobacterium tuberculosis
LPDATLRLVV

SEQ ID NO: 41543 - protein, 10 aa, Mycobacterium tuberculosis
PDATLRLVVD

SEQ ID NO: 41544 - protein, 10 aa, Mycobacterium tuberculosis
DATLRLVVDP

SEQ ID NO: 41545 - protein, 10 aa, Mycobacterium tuberculosis
ATLRLVVDPR

SEQ ID NO: 41546 - protein, 10 aa, Mycobacterium tuberculosis
TLRLVVDPRK

SEQ ID NO: 41547 - protein, 10 aa, Mycobacterium tuberculosis
LRLVVDPRKD

SEQ ID NO: 41548 - protein, 10 aa, Mycobacterium tuberculosis
RLVVDPRKDE

SEQ ID NO: 41549 - protein, 10 aa, Mycobacterium tuberculosis
LVVDPRKDEV

SEQ ID NO: 41550 - protein, 10 aa, Mycobacterium tuberculosis
VVDPRKDEVV

SEQ ID NO: 41551 - protein, 10 aa, Mycobacterium tuberculosis
VDPRKDEVVV

SEQ ID NO: 41552 - protein, 10 aa, Mycobacterium tuberculosis
DPRKDEVVVE

SEQ ID NO: 41553 - protein, 10 aa, Mycobacterium tuberculosis
PRKDEVVVEA

SEQ ID NO: 41554 - protein, 10 aa, Mycobacterium tuberculosis
RKDEVVVEAS

SEQ ID NO: 41555 - protein, 10 aa, Mycobacterium tuberculosis
KDEVVVEASA

SEQ ID NO: 41556 - protein, 10 aa, Mycobacterium tuberculosis
DEVVVEASAA

SEQ ID NO: 41557 - protein, 10 aa, Mycobacterium tuberculosis
EVVVEASAAC

SEQ ID NO: 41558 - protein, 10 aa, Mycobacterium tuberculosis
VVVEASAACD

SEQ ID NO: 41559 - protein, 10 aa, Mycobacterium tuberculosis
VVEASAACDT

SEQ ID NO: 41560 - protein, 10 aa, Mycobacterium tuberculosis
VEASAACDTH

SEQ ID NO: 41561 - protein, 10 aa, Mycobacterium tuberculosis
EASAACDTHD

SEQ ID NO: 41562 - protein, 10 aa, Mycobacterium tuberculosis
ASAACDTHDV

SEQ ID NO: 41563 - protein, 10 aa, Mycobacterium tuberculosis
SAACDTHDVV

SEQ ID NO: 41564 - protein, 10 aa, Mycobacterium tuberculosis
AACDTHDVVA

SEQ ID NO: 41565 - protein, 10 aa, Mycobacterium tuberculosis
ACDTHDVVAP

SEQ ID NO: 41566 - protein, 10 aa, Mycobacterium tuberculosis
CDTHDVVAPG

SEQ ID NO: 41567 - protein, 10 aa, Mycobacterium tuberculosis
DTHDVVAPGS

SEQ ID NO: 41568 - protein, 10 aa, Mycobacterium tuberculosis
THDVVAPGSF

SEQ ID NO: 41569 - protein, 10 aa, Mycobacterium tuberculosis
HDVVAPGSFS

SEQ ID NO: 41570 - protein, 10 aa, Mycobacterium tuberculosis
DVVAPGSFSW

SEQ ID NO: 41571 - protein, 10 aa, Mycobacterium tuberculosis
VVAPGSFSWH

SEQ ID NO: 41572 - protein, 10 aa, Mycobacterium tuberculosis
VAPGSFSWHV

SEQ ID NO: 41573 - protein, 10 aa, Mycobacterium tuberculosis
APGSFSWHVL

SEQ ID NO: 41574 - protein, 10 aa, Mycobacterium tuberculosis
PGSFSWHVLT

SEQ ID NO: 41575 - protein, 10 aa, Mycobacterium tuberculosis
GSFSWHVLTA

SEQ ID NO: 41576 - protein, 10 aa, Mycobacterium tuberculosis
SFSWHVLTAL

SEQ ID NO: 41577 - protein, 10 aa, Mycobacterium tuberculosis
FSWHVLTALA

SEQ ID NO: 41578 - protein, 10 aa, Mycobacterium tuberculosis
SWHVLTALAD

SEQ ID NO: 41579 - protein, 10 aa, Mycobacterium tuberculosis
WHVLTALADD

SEQ ID NO: 41580 - protein, 10 aa, Mycobacterium tuberculosis
HVLTALADDV

SEQ ID NO: 41581 - protein, 10 aa, Mycobacterium tuberculosis
VLTALADDVQ

SEQ ID NO: 41582 - protein, 10 aa, Mycobacterium tuberculosis
LTALADDVQT

SEQ ID NO: 41583 - protein, 10 aa, Mycobacterium tuberculosis
TALADDVQTF

SEQ ID NO: 41584 - protein, 10 aa, Mycobacterium tuberculosis
ALADDVQTFH

SEQ ID NO: 41585 - protein, 10 aa, Mycobacterium tuberculosis
LADDVQTFHD

SEQ ID NO: 41586 - protein, 10 aa, Mycobacterium tuberculosis
ADDVQTFHDG

SEQ ID NO: 41587 - protein, 10 aa, Mycobacterium tuberculosis
DDVQTFHDGR

SEQ ID NO: 41588 - protein, 10 aa, Mycobacterium tuberculosis
DVQTFHDGRQ

SEQ ID NO: 41589 - protein, 10 aa, Mycobacterium tuberculosis
VQTFHDGRQP

SEQ ID NO: 41590 - protein, 10 aa, Mycobacterium tuberculosis
QTFHDGRQPD

SEQ ID NO: 41591 - protein, 10 aa, Mycobacterium tuberculosis
TFHDGRQPDV

SEQ ID NO: 41592 - protein, 10 aa, Mycobacterium tuberculosis
FHDGRQPDVA

SEQ ID NO: 41593 - protein, 10 aa, Mycobacterium tuberculosis
HDGRQPDVAG

SEQ ID NO: 41594 - protein, 10 aa, Mycobacterium tuberculosis
DGRQPDVAGS

SEQ ID NO: 41595 - protein, 10 aa, Mycobacterium tuberculosis
GRQPDVAGSV

SEQ ID NO: 41596 - protein, 10 aa, Mycobacterium tuberculosis
RQPDVAGSVF

SEQ ID NO: 41597 - protein, 10 aa, Mycobacterium tuberculosis
QPDVAGSVFG

SEQ ID NO: 41598 - protein, 10 aa, Mycobacterium tuberculosis
PDVAGSVFGI

SEQ ID NO: 41599 - protein, 10 aa, Mycobacterium tuberculosis
DVAGSVFGIT

SEQ ID NO: 41600 - protein, 10 aa, Mycobacterium tuberculosis
VAGSVFGITL

SEQ ID NO: 41601 - protein, 10 aa, Mycobacterium tuberculosis
AGSVFGITLT

SEQ ID NO: 41602 - protein, 10 aa, Mycobacterium tuberculosis
GSVFGITLTA

SEQ ID NO: 41603 - protein, 10 aa, Mycobacterium tuberculosis
SVFGITLTAR

SEQ ID NO: 41604 - protein, 10 aa, Mycobacterium tuberculosis
VFGITLTARR

SEQ ID NO: 41605 - protein, 10 aa, Mycobacterium tuberculosis
FGITLTARRA

SEQ ID NO: 41606 - protein, 10 aa, Mycobacterium tuberculosis
GITLTARRAA

SEQ ID NO: 41607 - protein, 10 aa, Mycobacterium tuberculosis
ITLTARRAAS

SEQ ID NO: 41608 - protein, 10 aa, Mycobacterium tuberculosis
TLTARRAASS

SEQ ID NO: 41609 - protein, 10 aa, Mycobacterium tuberculosis
LTARRAASSR

SEQ ID NO: 41610 - protein, 11 aa, Mycobacterium tuberculosis
MADSDLPTKGR

SEQ ID NO: 41611 - protein, 11 aa, Mycobacterium tuberculosis
ADSDLPTKGRQ

SEQ ID NO: 41612 - protein, 11 aa, Mycobacterium tuberculosis
DSDLPTKGRQR

SEQ ID NO: 41613 - protein, 11 aa, Mycobacterium tuberculosis
SDLPTKGRQRG

SEQ ID NO: 41614 - protein, 11 aa, Mycobacterium tuberculosis
DLPTKGRQRGV

SEQ ID NO: 41615 - protein, 11 aa, Mycobacterium tuberculosis
LPTKGRQRGVR

SEQ ID NO: 41616 - protein, 11 aa, Mycobacterium tuberculosis
PTKGRQRGVRA

SEQ ID NO: 41617 - protein, 11 aa, Mycobacterium tuberculosis
TKGRQRGVRAV

SEQ ID NO: 41618 - protein, 11 aa, Mycobacterium tuberculosis
KGRQRGVRAVE

SEQ ID NO: 41619 - protein, 11 aa, Mycobacterium tuberculosis
GRQRGVRAVEL

SEQ ID NO: 41620 - protein, 11 aa, Mycobacterium tuberculosis
RQRGVRAVELN

SEQ ID NO: 41621 - protein, 11 aa, Mycobacterium tuberculosis
QRGVRAVELNV

SEQ ID NO: 41622 - protein, 11 aa, Mycobacterium tuberculosis
RGVRAVELNVA

SEQ ID NO: 41623 - protein, 11 aa, Mycobacterium tuberculosis
GVRAVELNVAA

SEQ ID NO: 41624 - protein, 11 aa, Mycobacterium tuberculosis
VRAVELNVAAR

SEQ ID NO: 41625 - protein, 11 aa, Mycobacterium tuberculosis
RAVELNVAARL

SEQ ID NO: 41626 - protein, 11 aa, Mycobacterium tuberculosis
AVELNVAARLE

SEQ ID NO: 41627 - protein, 11 aa, Mycobacterium tuberculosis
VELNVAARLEN

SEQ ID NO: 41628 - protein, 11 aa, Mycobacterium tuberculosis
ELNVAARLENL

SEQ ID NO: 41629 - protein, 11 aa, Mycobacterium tuberculosis
LNVAARLENLA

SEQ ID NO: 41630 - protein, 11 aa, Mycobacterium tuberculosis
NVAARLENLAL

SEQ ID NO: 41631 - protein, 11 aa, Mycobacterium tuberculosis
VAARLENLALL

SEQ ID NO: 41632 - protein, 11 aa, Mycobacterium tuberculosis
AARLENLALLR

SEQ ID NO: 41633 - protein, 11 aa, Mycobacterium tuberculosis
ARLENLALLRT

SEQ ID NO: 41634 - protein, 11 aa, Mycobacterium tuberculosis
RLENLALLRTL

SEQ ID NO: 41635 - protein, 11 aa, Mycobacterium tuberculosis
LENLALLRTLV

SEQ ID NO: 41636 - protein, 11 aa, Mycobacterium tuberculosis
ENLALLRTLVG

SEQ ID NO: 41637 - protein, 11 aa, Mycobacterium tuberculosis
NLALLRTLVGA

SEQ ID NO: 41638 - protein, 11 aa, Mycobacterium tuberculosis
LALLRTLVGAI

SEQ ID NO: 41639 - protein, 11 aa, Mycobacterium tuberculosis
ALLRTLVGAIG

SEQ ID NO: 41640 - protein, 11 aa, Mycobacterium tuberculosis
LLRTLVGAIGT

SEQ ID NO: 41641 - protein, 11 aa, Mycobacterium tuberculosis
LRTLVGAIGTF

SEQ ID NO: 41642 - protein, 11 aa, Mycobacterium tuberculosis
RTLVGAIGTFE

SEQ ID NO: 41643 - protein, 11 aa, Mycobacterium tuberculosis
TLVGAIGTFED

SEQ ID NO: 41644 - protein, 11 aa, Mycobacterium tuberculosis
LVGAIGTFEDL

SEQ ID NO: 41645 - protein, 11 aa, Mycobacterium tuberculosis
VGAIGTFEDLD

SEQ ID NO: 41646 - protein, 11 aa, Mycobacterium tuberculosis
GAIGTFEDLDF

SEQ ID NO: 41647 - protein, 11 aa, Mycobacterium tuberculosis
AIGTFEDLDFD

SEQ ID NO: 41648 - protein, 11 aa, Mycobacterium tuberculosis
IGTFEDLDFDA

SEQ ID NO: 41649 - protein, 11 aa, Mycobacterium tuberculosis
GTFEDLDFDAV

SEQ ID NO: 41650 - protein, 11 aa, Mycobacterium tuberculosis
TFEDLDFDAVA

SEQ ID NO: 41651 - protein, 11 aa, Mycobacterium tuberculosis
FEDLDFDAVAD

SEQ ID NO: 41652 - protein, 11 aa, Mycobacterium tuberculosis
EDLDFDAVADL

SEQ ID NO: 41653 - protein, 11 aa, Mycobacterium tuberculosis
DLDFDAVADLR

SEQ ID NO: 41654 - protein, 11 aa, Mycobacterium tuberculosis
LDFDAVADLRL

SEQ ID NO: 41655 - protein, 11 aa, Mycobacterium tuberculosis
DFDAVADLRLA

SEQ ID NO: 41656 - protein, 11 aa, Mycobacterium tuberculosis
FDAVADLRLAV

SEQ ID NO: 41657 - protein, 11 aa, Mycobacterium tuberculosis
DAVADLRLAVD

SEQ ID NO: 41658 - protein, 11 aa, Mycobacterium tuberculosis
AVADLRLAVDE

SEQ ID NO: 41659 - protein, 11 aa, Mycobacterium tuberculosis
VADLRLAVDEV

SEQ ID NO: 41660 - protein, 11 aa, Mycobacterium tuberculosis
ADLRLAVDEVC

SEQ ID NO: 41661 - protein, 11 aa, Mycobacterium tuberculosis
DLRLAVDEVCT

SEQ ID NO: 41662 - protein, 11 aa, Mycobacterium tuberculosis
LRLAVDEVCTR

SEQ ID NO: 41663 - protein, 11 aa, Mycobacterium tuberculosis
RLAVDEVCTRL

SEQ ID NO: 41664 - protein, 11 aa, Mycobacterium tuberculosis
LAVDEVCTRLI

SEQ ID NO: 41665 - protein, 11 aa, Mycobacterium tuberculosis
AVDEVCTRLIR

SEQ ID NO: 41666 - protein, 11 aa, Mycobacterium tuberculosis
VDEVCTRLIRS

SEQ ID NO: 41667 - protein, 11 aa, Mycobacterium tuberculosis
DEVCTRLIRSA

SEQ ID NO: 41668 - protein, 11 aa, Mycobacterium tuberculosis
EVCTRLIRSAL

SEQ ID NO: 41669 - protein, 11 aa, Mycobacterium tuberculosis
VCTRLIRSALP

SEQ ID NO: 41670 - protein, 11 aa, Mycobacterium tuberculosis
CTRLIRSALPD

SEQ ID NO: 41671 - protein, 11 aa, Mycobacterium tuberculosis
TRLIRSALPDA

SEQ ID NO: 41672 - protein, 11 aa, Mycobacterium tuberculosis
RLIRSALPDAT

SEQ ID NO: 41673 - protein, 11 aa, Mycobacterium tuberculosis
LIRSALPDATL

SEQ ID NO: 41674 - protein, 11 aa, Mycobacterium tuberculosis
IRSALPDATLR

SEQ ID NO: 41675 - protein, 11 aa, Mycobacterium tuberculosis
RSALPDATLRL

SEQ ID NO: 41676 - protein, 11 aa, Mycobacterium tuberculosis
SALPDATLRLV

SEQ ID NO: 41677 - protein, 11 aa, Mycobacterium tuberculosis
ALPDATLRLVV

SEQ ID NO: 41678 - protein, 11 aa, Mycobacterium tuberculosis
LPDATLRLVVD

SEQ ID NO: 41679 - protein, 11 aa, Mycobacterium tuberculosis
PDATLRLVVDP

SEQ ID NO: 41680 - protein, 11 aa, Mycobacterium tuberculosis
DATLRLVVDPR

SEQ ID NO: 41681 - protein, 11 aa, Mycobacterium tuberculosis
ATLRLVVDPRK

SEQ ID NO: 41682 - protein, 11 aa, Mycobacterium tuberculosis
TLRLVVDPRKD

SEQ ID NO: 41683 - protein, 11 aa, Mycobacterium tuberculosis
LRLVVDPRKDE

SEQ ID NO: 41684 - protein, 11 aa, Mycobacterium tuberculosis
RLVVDPRKDEV

SEQ ID NO: 41685 - protein, 11 aa, Mycobacterium tuberculosis
LVVDPRKDEVV

SEQ ID NO: 41686 - protein, 11 aa, Mycobacterium tuberculosis
VVDPRKDEVVV

SEQ ID NO: 41687 - protein, 11 aa, Mycobacterium tuberculosis
VDPRKDEVVVE

SEQ ID NO: 41688 - protein, 11 aa, Mycobacterium tuberculosis
DPRKDEVVVEA

SEQ ID NO: 41689 - protein, 11 aa, Mycobacterium tuberculosis
PRKDEVVVEAS

SEQ ID NO: 41690 - protein, 11 aa, Mycobacterium tuberculosis
RKDEVVVEASA

SEQ ID NO: 41691 - protein, 11 aa, Mycobacterium tuberculosis
KDEVVVEASAA

SEQ ID NO: 41692 - protein, 11 aa, Mycobacterium tuberculosis
DEVVVEASAAC

SEQ ID NO: 41693 - protein, 11 aa, Mycobacterium tuberculosis
EVVVEASAACD

SEQ ID NO: 41694 - protein, 11 aa, Mycobacterium tuberculosis
VVVEASAACDT

SEQ ID NO: 41695 - protein, 11 aa, Mycobacterium tuberculosis
VVEASAACDTH

SEQ ID NO: 41696 - protein, 11 aa, Mycobacterium tuberculosis
VEASAACDTHD

SEQ ID NO: 41697 - protein, 11 aa, Mycobacterium tuberculosis
EASAACDTHDV

SEQ ID NO: 41698 - protein, 11 aa, Mycobacterium tuberculosis
ASAACDTHDVV

SEQ ID NO: 41699 - protein, 11 aa, Mycobacterium tuberculosis
SAACDTHDVVA

SEQ ID NO: 41700 - protein, 11 aa, Mycobacterium tuberculosis
AACDTHDVVAP

SEQ ID NO: 41701 - protein, 11 aa, Mycobacterium tuberculosis
ACDTHDVVAPG

SEQ ID NO: 41702 - protein, 11 aa, Mycobacterium tuberculosis
CDTHDVVAPGS

SEQ ID NO: 41703 - protein, 11 aa, Mycobacterium tuberculosis
DTHDVVAPGSF

SEQ ID NO: 41704 - protein, 11 aa, Mycobacterium tuberculosis
THDVVAPGSFS

SEQ ID NO: 41705 - protein, 11 aa, Mycobacterium tuberculosis
HDVVAPGSFSW

SEQ ID NO: 41706 - protein, 11 aa, Mycobacterium tuberculosis
DVVAPGSFSWH

SEQ ID NO: 41707 - protein, 11 aa, Mycobacterium tuberculosis
VVAPGSFSWHV

SEQ ID NO: 41708 - protein, 11 aa, Mycobacterium tuberculosis
VAPGSFSWHVL

SEQ ID NO: 41709 - protein, 11 aa, Mycobacterium tuberculosis
APGSFSWHVLT

SEQ ID NO: 41710 - protein, 11 aa, Mycobacterium tuberculosis
PGSFSWHVLTA

SEQ ID NO: 41711 - protein, 11 aa, Mycobacterium tuberculosis
GSFSWHVLTAL

SEQ ID NO: 41712 - protein, 11 aa, Mycobacterium tuberculosis
SFSWHVLTALA

SEQ ID NO: 41713 - protein, 11 aa, Mycobacterium tuberculosis
FSWHVLTALAD

SEQ ID NO: 41714 - protein, 11 aa, Mycobacterium tuberculosis
SWHVLTALADD

SEQ ID NO: 41715 - protein, 11 aa, Mycobacterium tuberculosis
WHVLTALADDV

SEQ ID NO: 41716 - protein, 11 aa, Mycobacterium tuberculosis
HVLTALADDVQ

SEQ ID NO: 41717 - protein, 11 aa, Mycobacterium tuberculosis
VLTALADDVQT

SEQ ID NO: 41718 - protein, 11 aa, Mycobacterium tuberculosis
LTALADDVQTF

SEQ ID NO: 41719 - protein, 11 aa, Mycobacterium tuberculosis
TALADDVQTFH

SEQ ID NO: 41720 - protein, 11 aa, Mycobacterium tuberculosis
ALADDVQTFHD

SEQ ID NO: 41721 - protein, 11 aa, Mycobacterium tuberculosis
LADDVQTFHDG

SEQ ID NO: 41722 - protein, 11 aa, Mycobacterium tuberculosis
ADDVQTFHDGR

SEQ ID NO: 41723 - protein, 11 aa, Mycobacterium tuberculosis
DDVQTFHDGRQ

SEQ ID NO: 41724 - protein, 11 aa, Mycobacterium tuberculosis
DVQTFHDGRQP

SEQ ID NO: 41725 - protein, 11 aa, Mycobacterium tuberculosis
VQTFHDGRQPD

SEQ ID NO: 41726 - protein, 11 aa, Mycobacterium tuberculosis
QTFHDGRQPDV

SEQ ID NO: 41727 - protein, 11 aa, Mycobacterium tuberculosis
TFHDGRQPDVA

SEQ ID NO: 41728 - protein, 11 aa, Mycobacterium tuberculosis
FHDGRQPDVAG

SEQ ID NO: 41729 - protein, 11 aa, Mycobacterium tuberculosis
HDGRQPDVAGS

SEQ ID NO: 41730 - protein, 11 aa, Mycobacterium tuberculosis
DGRQPDVAGSV

SEQ ID NO: 41731 - protein, 11 aa, Mycobacterium tuberculosis
GRQPDVAGSVF

SEQ ID NO: 41732 - protein, 11 aa, Mycobacterium tuberculosis
RQPDVAGSVFG

SEQ ID NO: 41733 - protein, 11 aa, Mycobacterium tuberculosis
QPDVAGSVFGI

SEQ ID NO: 41734 - protein, 11 aa, Mycobacterium tuberculosis
PDVAGSVFGIT

SEQ ID NO: 41735 - protein, 11 aa, Mycobacterium tuberculosis
DVAGSVFGITL

SEQ ID NO: 41736 - protein, 11 aa, Mycobacterium tuberculosis
VAGSVFGITLT

SEQ ID NO: 41737 - protein, 11 aa, Mycobacterium tuberculosis
AGSVFGITLTA

SEQ ID NO: 41738 - protein, 11 aa, Mycobacterium tuberculosis
GSVFGITLTAR

SEQ ID NO: 41739 - protein, 11 aa, Mycobacterium tuberculosis
SVFGITLTARR

SEQ ID NO: 41740 - protein, 11 aa, Mycobacterium tuberculosis
VFGITLTARRA

SEQ ID NO: 41741 - protein, 11 aa, Mycobacterium tuberculosis
FGITLTARRAA

SEQ ID NO: 41742 - protein, 11 aa, Mycobacterium tuberculosis
GITLTARRAAS

SEQ ID NO: 41743 - protein, 11 aa, Mycobacterium tuberculosis
ITLTARRAASS

SEQ ID NO: 41744 - protein, 11 aa, Mycobacterium tuberculosis
TLTARRAASSR

SEQ ID NO: 41745 - protein, 8 aa, Mycobacterium tuberculosis
MGQIPPQP

SEQ ID NO: 41746 - protein, 8 aa, Mycobacterium tuberculosis
GQIPPQPV

SEQ ID NO: 41747 - protein, 8 aa, Mycobacterium tuberculosis
QIPPQPVR

SEQ ID NO: 41748 - protein, 8 aa, Mycobacterium tuberculosis
IPPQPVRR

SEQ ID NO: 41749 - protein, 8 aa, Mycobacterium tuberculosis
PPQPVRRV

SEQ ID NO: 41750 - protein, 8 aa, Mycobacterium tuberculosis
PQPVRRVL

SEQ ID NO: 41751 - protein, 8 aa, Mycobacterium tuberculosis
QPVRRVLP

SEQ ID NO: 41752 - protein, 8 aa, Mycobacterium tuberculosis
PVRRVLPL

SEQ ID NO: 41753 - protein, 8 aa, Mycobacterium tuberculosis
VRRVLPLM

SEQ ID NO: 41754 - protein, 8 aa, Mycobacterium tuberculosis
RRVLPLMV

SEQ ID NO: 41755 - protein, 8 aa, Mycobacterium tuberculosis
RVLPLMVV

SEQ ID NO: 41756 - protein, 8 aa, Mycobacterium tuberculosis
VLPLMVVP

SEQ ID NO: 41757 - protein, 8 aa, Mycobacterium tuberculosis
LPLMVVPG

SEQ ID NO: 41758 - protein, 8 aa, Mycobacterium tuberculosis
PLMVVPGN

SEQ ID NO: 41759 - protein, 8 aa, Mycobacterium tuberculosis
LMVVPGNG

SEQ ID NO: 41760 - protein, 8 aa, Mycobacterium tuberculosis
MVVPGNGQ

SEQ ID NO: 41761 - protein, 8 aa, Mycobacterium tuberculosis
VVPGNGQK

SEQ ID NO: 41762 - protein, 8 aa, Mycobacterium tuberculosis
VPGNGQKW

SEQ ID NO: 41763 - protein, 8 aa, Mycobacterium tuberculosis
PGNGQKWR

SEQ ID NO: 41764 - protein, 8 aa, Mycobacterium tuberculosis
GNGQKWRN

SEQ ID NO: 41765 - protein, 8 aa, Mycobacterium tuberculosis
NGQKWRNR

SEQ ID NO: 41766 - protein, 8 aa, Mycobacterium tuberculosis
GQKWRNRT

SEQ ID NO: 41767 - protein, 8 aa, Mycobacterium tuberculosis
QKWRNRTE

SEQ ID NO: 41768 - protein, 8 aa, Mycobacterium tuberculosis
KWRNRTET

SEQ ID NO: 41769 - protein, 8 aa, Mycobacterium tuberculosis
WRNRTETE

SEQ ID NO: 41770 - protein, 8 aa, Mycobacterium tuberculosis
RNRTETEE

SEQ ID NO: 41771 - protein, 8 aa, Mycobacterium tuberculosis
NRTETEEA

SEQ ID NO: 41772 - protein, 8 aa, Mycobacterium tuberculosis
RTETEEAM

SEQ ID NO: 41773 - protein, 8 aa, Mycobacterium tuberculosis
TETEEAMG

SEQ ID NO: 41774 - protein, 8 aa, Mycobacterium tuberculosis
ETEEAMGD

SEQ ID NO: 41775 - protein, 8 aa, Mycobacterium tuberculosis
TEEAMGDT

SEQ ID NO: 41776 - protein, 8 aa, Mycobacterium tuberculosis
EEAMGDTY

SEQ ID NO: 41777 - protein, 8 aa, Mycobacterium tuberculosis
EAMGDTYR

SEQ ID NO: 41778 - protein, 8 aa, Mycobacterium tuberculosis
AMGDTYRD

SEQ ID NO: 41779 - protein, 8 aa, Mycobacterium tuberculosis
MGDTYRDP

SEQ ID NO: 41780 - protein, 8 aa, Mycobacterium tuberculosis
GDTYRDPV

SEQ ID NO: 41781 - protein, 8 aa, Mycobacterium tuberculosis
DTYRDPVD

SEQ ID NO: 41782 - protein, 8 aa, Mycobacterium tuberculosis
TYRDPVDH

SEQ ID NO: 41783 - protein, 8 aa, Mycobacterium tuberculosis
YRDPVDHL

SEQ ID NO: 41784 - protein, 8 aa, Mycobacterium tuberculosis
RDPVDHLR

SEQ ID NO: 41785 - protein, 8 aa, Mycobacterium tuberculosis
DPVDHLRT

SEQ ID NO: 41786 - protein, 8 aa, Mycobacterium tuberculosis
PVDHLRTT

SEQ ID NO: 41787 - protein, 8 aa, Mycobacterium tuberculosis
VDHLRTTR

SEQ ID NO: 41788 - protein, 8 aa, Mycobacterium tuberculosis
DHLRTTRP

SEQ ID NO: 41789 - protein, 8 aa, Mycobacterium tuberculosis
HLRTTRPL

SEQ ID NO: 41790 - protein, 8 aa, Mycobacterium tuberculosis
LRTTRPLA

SEQ ID NO: 41791 - protein, 8 aa, Mycobacterium tuberculosis
RTTRPLAG

SEQ ID NO: 41792 - protein, 8 aa, Mycobacterium tuberculosis
TTRPLAGE

SEQ ID NO: 41793 - protein, 8 aa, Mycobacterium tuberculosis
TRPLAGES

SEQ ID NO: 41794 - protein, 8 aa, Mycobacterium tuberculosis
RPLAGESL

SEQ ID NO: 41795 - protein, 8 aa, Mycobacterium tuberculosis
PLAGESLI

SEQ ID NO: 41796 - protein, 8 aa, Mycobacterium tuberculosis
LAGESLID

SEQ ID NO: 41797 - protein, 8 aa, Mycobacterium tuberculosis
AGESLIDV

SEQ ID NO: 41798 - protein, 8 aa, Mycobacterium tuberculosis
GESLIDVV

SEQ ID NO: 41799 - protein, 8 aa, Mycobacterium tuberculosis
ESLIDVVH

SEQ ID NO: 41800 - protein, 8 aa, Mycobacterium tuberculosis
SLIDVVHW

SEQ ID NO: 41801 - protein, 8 aa, Mycobacterium tuberculosis
LIDVVHWP

SEQ ID NO: 41802 - protein, 8 aa, Mycobacterium tuberculosis
IDVVHWPG

SEQ ID NO: 41803 - protein, 8 aa, Mycobacterium tuberculosis
DVVHWPGY

SEQ ID NO: 41804 - protein, 8 aa, Mycobacterium tuberculosis
VVHWPGYL

SEQ ID NO: 41805 - protein, 8 aa, Mycobacterium tuberculosis
VHWPGYLL

SEQ ID NO: 41806 - protein, 8 aa, Mycobacterium tuberculosis
HWPGYLLI

SEQ ID NO: 41807 - protein, 8 aa, Mycobacterium tuberculosis
WPGYLLIV

SEQ ID NO: 41808 - protein, 8 aa, Mycobacterium tuberculosis
PGYLLIVA

SEQ ID NO: 41809 - protein, 8 aa, Mycobacterium tuberculosis
GYLLIVAG

SEQ ID NO: 41810 - protein, 8 aa, Mycobacterium tuberculosis
YLLIVAGV

SEQ ID NO: 41811 - protein, 8 aa, Mycobacterium tuberculosis
LLIVAGVV

SEQ ID NO: 41812 - protein, 8 aa, Mycobacterium tuberculosis
LIVAGVVG

SEQ ID NO: 41813 - protein, 8 aa, Mycobacterium tuberculosis
IVAGVVGG

SEQ ID NO: 41814 - protein, 8 aa, Mycobacterium tuberculosis
VAGVVGGV

SEQ ID NO: 41815 - protein, 8 aa, Mycobacterium tuberculosis
AGVVGGVG

SEQ ID NO: 41816 - protein, 8 aa, Mycobacterium tuberculosis
GVVGGVGA

SEQ ID NO: 41817 - protein, 8 aa, Mycobacterium tuberculosis
VVGGVGAL

SEQ ID NO: 41818 - protein, 8 aa, Mycobacterium tuberculosis
VGGVGALA

SEQ ID NO: 41819 - protein, 8 aa, Mycobacterium tuberculosis
GGVGALAA

SEQ ID NO: 41820 - protein, 8 aa, Mycobacterium tuberculosis
GVGALAAF

SEQ ID NO: 41821 - protein, 8 aa, Mycobacterium tuberculosis
VGALAAFG

SEQ ID NO: 41822 - protein, 8 aa, Mycobacterium tuberculosis
GALAAFGT

SEQ ID NO: 41823 - protein, 8 aa, Mycobacterium tuberculosis
ALAAFGTG

SEQ ID NO: 41824 - protein, 8 aa, Mycobacterium tuberculosis
LAAFGTGH

SEQ ID NO: 41825 - protein, 8 aa, Mycobacterium tuberculosis
AAFGTGHH

SEQ ID NO: 41826 - protein, 8 aa, Mycobacterium tuberculosis
AFGTGHHA

SEQ ID NO: 41827 - protein, 8 aa, Mycobacterium tuberculosis
FGTGHHAE

SEQ ID NO: 41828 - protein, 8 aa, Mycobacterium tuberculosis
GTGHHAEG

SEQ ID NO: 41829 - protein, 8 aa, Mycobacterium tuberculosis
TGHHAEGM

SEQ ID NO: 41830 - protein, 8 aa, Mycobacterium tuberculosis
GHHAEGMT

SEQ ID NO: 41831 - protein, 8 aa, Mycobacterium tuberculosis
HHAEGMTF

SEQ ID NO: 41832 - protein, 8 aa, Mycobacterium tuberculosis
HAEGMTFG

SEQ ID NO: 41833 - protein, 8 aa, Mycobacterium tuberculosis
AEGMTFGV

SEQ ID NO: 41834 - protein, 8 aa, Mycobacterium tuberculosis
EGMTFGVV

SEQ ID NO: 41835 - protein, 8 aa, Mycobacterium tuberculosis
GMTFGVVA

SEQ ID NO: 41836 - protein, 8 aa, Mycobacterium tuberculosis
MTFGVVAI

SEQ ID NO: 41837 - protein, 8 aa, Mycobacterium tuberculosis
TFGVVAIV

SEQ ID NO: 41838 - protein, 8 aa, Mycobacterium tuberculosis
FGVVAIVV

SEQ ID NO: 41839 - protein, 8 aa, Mycobacterium tuberculosis
GVVAIVVT

SEQ ID NO: 41840 - protein, 8 aa, Mycobacterium tuberculosis
VVAIVVTV

SEQ ID NO: 41841 - protein, 8 aa, Mycobacterium tuberculosis
VAIVVTVV

SEQ ID NO: 41842 - protein, 8 aa, Mycobacterium tuberculosis
AIVVTVVG

SEQ ID NO: 41843 - protein, 8 aa, Mycobacterium tuberculosis
IVVTVVGL

SEQ ID NO: 41844 - protein, 8 aa, Mycobacterium tuberculosis
VVTVVGLA

SEQ ID NO: 41845 - protein, 8 aa, Mycobacterium tuberculosis
VTVVGLAW

SEQ ID NO: 41846 - protein, 8 aa, Mycobacterium tuberculosis
TVVGLAWL

SEQ ID NO: 41847 - protein, 8 aa, Mycobacterium tuberculosis
VVGLAWLA

SEQ ID NO: 41848 - protein, 8 aa, Mycobacterium tuberculosis
VGLAWLAF

SEQ ID NO: 41849 - protein, 8 aa, Mycobacterium tuberculosis
GLAWLAFE

SEQ ID NO: 41850 - protein, 8 aa, Mycobacterium tuberculosis
LAWLAFEH

SEQ ID NO: 41851 - protein, 8 aa, Mycobacterium tuberculosis
AWLAFEHR

SEQ ID NO: 41852 - protein, 8 aa, Mycobacterium tuberculosis
WLAFEHRR

SEQ ID NO: 41853 - protein, 8 aa, Mycobacterium tuberculosis
LAFEHRRI

SEQ ID NO: 41854 - protein, 8 aa, Mycobacterium tuberculosis
AFEHRRIR

SEQ ID NO: 41855 - protein, 8 aa, Mycobacterium tuberculosis
FEHRRIRK

SEQ ID NO: 41856 - protein, 8 aa, Mycobacterium tuberculosis
EHRRIRKI

SEQ ID NO: 41857 - protein, 8 aa, Mycobacterium tuberculosis
HRRIRKIA

SEQ ID NO: 41858 - protein, 8 aa, Mycobacterium tuberculosis
RRIRKIAD

SEQ ID NO: 41859 - protein, 8 aa, Mycobacterium tuberculosis
RIRKIADR

SEQ ID NO: 41860 - protein, 8 aa, Mycobacterium tuberculosis
IRKIADRW

SEQ ID NO: 41861 - protein, 8 aa, Mycobacterium tuberculosis
RKIADRWY

SEQ ID NO: 41862 - protein, 8 aa, Mycobacterium tuberculosis
KIADRWYT

SEQ ID NO: 41863 - protein, 8 aa, Mycobacterium tuberculosis
IADRWYTE

SEQ ID NO: 41864 - protein, 8 aa, Mycobacterium tuberculosis
ADRWYTEH

SEQ ID NO: 41865 - protein, 8 aa, Mycobacterium tuberculosis
DRWYTEHP

SEQ ID NO: 41866 - protein, 8 aa, Mycobacterium tuberculosis
RWYTEHPE

SEQ ID NO: 41867 - protein, 8 aa, Mycobacterium tuberculosis
WYTEHPEV

SEQ ID NO: 41868 - protein, 8 aa, Mycobacterium tuberculosis
YTEHPEVR

SEQ ID NO: 41869 - protein, 8 aa, Mycobacterium tuberculosis
TEHPEVRR

SEQ ID NO: 41870 - protein, 8 aa, Mycobacterium tuberculosis
EHPEVRRQ

SEQ ID NO: 41871 - protein, 8 aa, Mycobacterium tuberculosis
HPEVRRQR

SEQ ID NO: 41872 - protein, 8 aa, Mycobacterium tuberculosis
PEVRRQRL

SEQ ID NO: 41873 - protein, 8 aa, Mycobacterium tuberculosis
EVRRQRLA

SEQ ID NO: 41874 - protein, 8 aa, Mycobacterium tuberculosis
VRRQRLAG

SEQ ID NO: 41875 - protein, 9 aa, Mycobacterium tuberculosis
MGQIPPQPV

SEQ ID NO: 41876 - protein, 9 aa, Mycobacterium tuberculosis
GQIPPQPVR

SEQ ID NO: 41877 - protein, 9 aa, Mycobacterium tuberculosis
QIPPQPVRR

SEQ ID NO: 41878 - protein, 9 aa, Mycobacterium tuberculosis
IPPQPVRRV

SEQ ID NO: 41879 - protein, 9 aa, Mycobacterium tuberculosis
PPQPVRRVL

SEQ ID NO: 41880 - protein, 9 aa, Mycobacterium tuberculosis
PQPVRRVLP

SEQ ID NO: 41881 - protein, 9 aa, Mycobacterium tuberculosis
QPVRRVLPL

SEQ ID NO: 41882 - protein, 9 aa, Mycobacterium tuberculosis
PVRRVLPLM

SEQ ID NO: 41883 - protein, 9 aa, Mycobacterium tuberculosis
VRRVLPLMV

SEQ ID NO: 41884 - protein, 9 aa, Mycobacterium tuberculosis
RRVLPLMVV

SEQ ID NO: 41885 - protein, 9 aa, Mycobacterium tuberculosis
RVLPLMVVP

SEQ ID NO: 41886 - protein, 9 aa, Mycobacterium tuberculosis
VLPLMVVPG

SEQ ID NO: 41887 - protein, 9 aa, Mycobacterium tuberculosis
LPLMVVPGN

SEQ ID NO: 41888 - protein, 9 aa, Mycobacterium tuberculosis
PLMVVPGNG

SEQ ID NO: 41889 - protein, 9 aa, Mycobacterium tuberculosis
LMVVPGNGQ

SEQ ID NO: 41890 - protein, 9 aa, Mycobacterium tuberculosis
MVVPGNGQK

SEQ ID NO: 41891 - protein, 9 aa, Mycobacterium tuberculosis
VVPGNGQKW

SEQ ID NO: 41892 - protein, 9 aa, Mycobacterium tuberculosis
VPGNGQKWR

SEQ ID NO: 41893 - protein, 9 aa, Mycobacterium tuberculosis
PGNGQKWRN

SEQ ID NO: 41894 - protein, 9 aa, Mycobacterium tuberculosis
GNGQKWRNR

SEQ ID NO: 41895 - protein, 9 aa, Mycobacterium tuberculosis
NGQKWRNRT

SEQ ID NO: 41896 - protein, 9 aa, Mycobacterium tuberculosis
GQKWRNRTE

SEQ ID NO: 41897 - protein, 9 aa, Mycobacterium tuberculosis
QKWRNRTET

SEQ ID NO: 41898 - protein, 9 aa, Mycobacterium tuberculosis
KWRNRTETE

SEQ ID NO: 41899 - protein, 9 aa, Mycobacterium tuberculosis
WRNRTETEE

SEQ ID NO: 41900 - protein, 9 aa, Mycobacterium tuberculosis
RNRTETEEA

SEQ ID NO: 41901 - protein, 9 aa, Mycobacterium tuberculosis
NRTETEEAM

SEQ ID NO: 41902 - protein, 9 aa, Mycobacterium tuberculosis
RTETEEAMG

SEQ ID NO: 41903 - protein, 9 aa, Mycobacterium tuberculosis
TETEEAMGD

SEQ ID NO: 41904 - protein, 9 aa, Mycobacterium tuberculosis
ETEEAMGDT

SEQ ID NO: 41905 - protein, 9 aa, Mycobacterium tuberculosis
TEEAMGDTY

SEQ ID NO: 41906 - protein, 9 aa, Mycobacterium tuberculosis
EEAMGDTYR

SEQ ID NO: 41907 - protein, 9 aa, Mycobacterium tuberculosis
EAMGDTYRD

SEQ ID NO: 41908 - protein, 9 aa, Mycobacterium tuberculosis
AMGDTYRDP

SEQ ID NO: 41909 - protein, 9 aa, Mycobacterium tuberculosis
MGDTYRDPV

SEQ ID NO: 41910 - protein, 9 aa, Mycobacterium tuberculosis
GDTYRDPVD

SEQ ID NO: 41911 - protein, 9 aa, Mycobacterium tuberculosis
DTYRDPVDH

SEQ ID NO: 41912 - protein, 9 aa, Mycobacterium tuberculosis
TYRDPVDHL

SEQ ID NO: 41913 - protein, 9 aa, Mycobacterium tuberculosis
YRDPVDHLR

SEQ ID NO: 41914 - protein, 9 aa, Mycobacterium tuberculosis
RDPVDHLRT

SEQ ID NO: 41915 - protein, 9 aa, Mycobacterium tuberculosis
DPVDHLRTT

SEQ ID NO: 41916 - protein, 9 aa, Mycobacterium tuberculosis
PVDHLRTTR

SEQ ID NO: 41917 - protein, 9 aa, Mycobacterium tuberculosis
VDHLRTTRP

SEQ ID NO: 41918 - protein, 9 aa, Mycobacterium tuberculosis
DHLRTTRPL

SEQ ID NO: 41919 - protein, 9 aa, Mycobacterium tuberculosis
HLRTTRPLA

SEQ ID NO: 41920 - protein, 9 aa, Mycobacterium tuberculosis
LRTTRPLAG

SEQ ID NO: 41921 - protein, 9 aa, Mycobacterium tuberculosis
RTTRPLAGE

SEQ ID NO: 41922 - protein, 9 aa, Mycobacterium tuberculosis
TTRPLAGES

SEQ ID NO: 41923 - protein, 9 aa, Mycobacterium tuberculosis
TRPLAGESL

SEQ ID NO: 41924 - protein, 9 aa, Mycobacterium tuberculosis
RPLAGESLI

SEQ ID NO: 41925 - protein, 9 aa, Mycobacterium tuberculosis
PLAGESLID

SEQ ID NO: 41926 - protein, 9 aa, Mycobacterium tuberculosis
LAGESLIDV

SEQ ID NO: 41927 - protein, 9 aa, Mycobacterium tuberculosis
AGESLIDVV

SEQ ID NO: 41928 - protein, 9 aa, Mycobacterium tuberculosis
GESLIDVVH

SEQ ID NO: 41929 - protein, 9 aa, Mycobacterium tuberculosis
ESLIDVVHW

SEQ ID NO: 41930 - protein, 9 aa, Mycobacterium tuberculosis
SLIDVVHWP

SEQ ID NO: 41931 - protein, 9 aa, Mycobacterium tuberculosis
LIDVVHWPG

SEQ ID NO: 41932 - protein, 9 aa, Mycobacterium tuberculosis
IDVVHWPGY

SEQ ID NO: 41933 - protein, 9 aa, Mycobacterium tuberculosis
DVVHWPGYL

SEQ ID NO: 41934 - protein, 9 aa, Mycobacterium tuberculosis
VVHWPGYLL

SEQ ID NO: 41935 - protein, 9 aa, Mycobacterium tuberculosis
VHWPGYLLI

SEQ ID NO: 41936 - protein, 9 aa, Mycobacterium tuberculosis
HWPGYLLIV

SEQ ID NO: 41937 - protein, 9 aa, Mycobacterium tuberculosis
WPGYLLIVA

SEQ ID NO: 41938 - protein, 9 aa, Mycobacterium tuberculosis
PGYLLIVAG

SEQ ID NO: 41939 - protein, 9 aa, Mycobacterium tuberculosis
GYLLIVAGV

SEQ ID NO: 41940 - protein, 9 aa, Mycobacterium tuberculosis
YLLIVAGVV

SEQ ID NO: 41941 - protein, 9 aa, Mycobacterium tuberculosis
LLIVAGVVG

SEQ ID NO: 41942 - protein, 9 aa, Mycobacterium tuberculosis
LIVAGVVGG

SEQ ID NO: 41943 - protein, 9 aa, Mycobacterium tuberculosis
IVAGVVGGV

SEQ ID NO: 41944 - protein, 9 aa, Mycobacterium tuberculosis
VAGVVGGVG

SEQ ID NO: 41945 - protein, 9 aa, Mycobacterium tuberculosis
AGVVGGVGA

SEQ ID NO: 41946 - protein, 9 aa, Mycobacterium tuberculosis
GVVGGVGAL

SEQ ID NO: 41947 - protein, 9 aa, Mycobacterium tuberculosis
VVGGVGALA

SEQ ID NO: 41948 - protein, 9 aa, Mycobacterium tuberculosis
VGGVGALAA

SEQ ID NO: 41949 - protein, 9 aa, Mycobacterium tuberculosis
GGVGALAAF

SEQ ID NO: 41950 - protein, 9 aa, Mycobacterium tuberculosis
GVGALAAFG

SEQ ID NO: 41951 - protein, 9 aa, Mycobacterium tuberculosis
VGALAAFGT

SEQ ID NO: 41952 - protein, 9 aa, Mycobacterium tuberculosis
GALAAFGTG

SEQ ID NO: 41953 - protein, 9 aa, Mycobacterium tuberculosis
ALAAFGTGH

SEQ ID NO: 41954 - protein, 9 aa, Mycobacterium tuberculosis
LAAFGTGHH

SEQ ID NO: 41955 - protein, 9 aa, Mycobacterium tuberculosis
AAFGTGHHA

SEQ ID NO: 41956 - protein, 9 aa, Mycobacterium tuberculosis
AFGTGHHAE

SEQ ID NO: 41957 - protein, 9 aa, Mycobacterium tuberculosis
FGTGHHAEG

SEQ ID NO: 41958 - protein, 9 aa, Mycobacterium tuberculosis
GTGHHAEGM

SEQ ID NO: 41959 - protein, 9 aa, Mycobacterium tuberculosis
TGHHAEGMT

SEQ ID NO: 41960 - protein, 9 aa, Mycobacterium tuberculosis
GHHAEGMTF

SEQ ID NO: 41961 - protein, 9 aa, Mycobacterium tuberculosis
HHAEGMTFG

SEQ ID NO: 41962 - protein, 9 aa, Mycobacterium tuberculosis
HAEGMTFGV

SEQ ID NO: 41963 - protein, 9 aa, Mycobacterium tuberculosis
AEGMTFGVV

SEQ ID NO: 41964 - protein, 9 aa, Mycobacterium tuberculosis
EGMTFGVVA

SEQ ID NO: 41965 - protein, 9 aa, Mycobacterium tuberculosis
GMTFGVVAI

SEQ ID NO: 41966 - protein, 9 aa, Mycobacterium tuberculosis
MTFGVVAIV

SEQ ID NO: 41967 - protein, 9 aa, Mycobacterium tuberculosis
TFGVVAIVV

SEQ ID NO: 41968 - protein, 9 aa, Mycobacterium tuberculosis
FGVVAIVVT

SEQ ID NO: 41969 - protein, 9 aa, Mycobacterium tuberculosis
GVVAIVVTV

SEQ ID NO: 41970 - protein, 9 aa, Mycobacterium tuberculosis
VVAIVVTVV

SEQ ID NO: 41971 - protein, 9 aa, Mycobacterium tuberculosis
VAIVVTVVG

SEQ ID NO: 41972 - protein, 9 aa, Mycobacterium tuberculosis
AIVVTVVGL

SEQ ID NO: 41973 - protein, 9 aa, Mycobacterium tuberculosis
IVVTVVGLA

SEQ ID NO: 41974 - protein, 9 aa, Mycobacterium tuberculosis
VVTVVGLAW

SEQ ID NO: 41975 - protein, 9 aa, Mycobacterium tuberculosis
VTVVGLAWL

SEQ ID NO: 41976 - protein, 9 aa, Mycobacterium tuberculosis
TVVGLAWLA

SEQ ID NO: 41977 - protein, 9 aa, Mycobacterium tuberculosis
VVGLAWLAF

SEQ ID NO: 41978 - protein, 9 aa, Mycobacterium tuberculosis
VGLAWLAFE

SEQ ID NO: 41979 - protein, 9 aa, Mycobacterium tuberculosis
GLAWLAFEH

SEQ ID NO: 41980 - protein, 9 aa, Mycobacterium tuberculosis
LAWLAFEHR

SEQ ID NO: 41981 - protein, 9 aa, Mycobacterium tuberculosis
AWLAFEHRR

SEQ ID NO: 41982 - protein, 9 aa, Mycobacterium tuberculosis
WLAFEHRRI

SEQ ID NO: 41983 - protein, 9 aa, Mycobacterium tuberculosis
LAFEHRRIR

SEQ ID NO: 41984 - protein, 9 aa, Mycobacterium tuberculosis
AFEHRRIRK

SEQ ID NO: 41985 - protein, 9 aa, Mycobacterium tuberculosis
FEHRRIRKI

SEQ ID NO: 41986 - protein, 9 aa, Mycobacterium tuberculosis
EHRRIRKIA

SEQ ID NO: 41987 - protein, 9 aa, Mycobacterium tuberculosis
HRRIRKIAD

SEQ ID NO: 41988 - protein, 9 aa, Mycobacterium tuberculosis
RRIRKIADR

SEQ ID NO: 41989 - protein, 9 aa, Mycobacterium tuberculosis
RIRKIADRW

SEQ ID NO: 41990 - protein, 9 aa, Mycobacterium tuberculosis
IRKIADRWY

SEQ ID NO: 41991 - protein, 9 aa, Mycobacterium tuberculosis
RKIADRWYT

SEQ ID NO: 41992 - protein, 9 aa, Mycobacterium tuberculosis
KIADRWYTE

SEQ ID NO: 41993 - protein, 9 aa, Mycobacterium tuberculosis
IADRWYTEH

SEQ ID NO: 41994 - protein, 9 aa, Mycobacterium tuberculosis
ADRWYTEHP

SEQ ID NO: 41995 - protein, 9 aa, Mycobacterium tuberculosis
DRWYTEHPE

SEQ ID NO: 41996 - protein, 9 aa, Mycobacterium tuberculosis
RWYTEHPEV

SEQ ID NO: 41997 - protein, 9 aa, Mycobacterium tuberculosis
WYTEHPEVR

SEQ ID NO: 41998 - protein, 9 aa, Mycobacterium tuberculosis
YTEHPEVRR

SEQ ID NO: 41999 - protein, 9 aa, Mycobacterium tuberculosis
TEHPEVRRQ

SEQ ID NO: 42000 - protein, 9 aa, Mycobacterium tuberculosis
EHPEVRRQR

SEQ ID NO: 42001 - protein, 9 aa, Mycobacterium tuberculosis
HPEVRRQRL

SEQ ID NO: 42002 - protein, 9 aa, Mycobacterium tuberculosis
PEVRRQRLA

SEQ ID NO: 42003 - protein, 9 aa, Mycobacterium tuberculosis
EVRRQRLAG

SEQ ID NO: 42004 - protein, 10 aa, Mycobacterium tuberculosis
MGQIPPQPVR

SEQ ID NO: 42005 - protein, 10 aa, Mycobacterium tuberculosis
GQIPPQPVRR

SEQ ID NO: 42006 - protein, 10 aa, Mycobacterium tuberculosis
QIPPQPVRRV

SEQ ID NO: 42007 - protein, 10 aa, Mycobacterium tuberculosis
IPPQPVRRVL

SEQ ID NO: 42008 - protein, 10 aa, Mycobacterium tuberculosis
PPQPVRRVLP

SEQ ID NO: 42009 - protein, 10 aa, Mycobacterium tuberculosis
PQPVRRVLPL

SEQ ID NO: 42010 - protein, 10 aa, Mycobacterium tuberculosis
QPVRRVLPLM

SEQ ID NO: 42011 - protein, 10 aa, Mycobacterium tuberculosis
PVRRVLPLMV

SEQ ID NO: 42012 - protein, 10 aa, Mycobacterium tuberculosis
VRRVLPLMVV

SEQ ID NO: 42013 - protein, 10 aa, Mycobacterium tuberculosis
RRVLPLMVVP

SEQ ID NO: 42014 - protein, 10 aa, Mycobacterium tuberculosis
RVLPLMVVPG

SEQ ID NO: 42015 - protein, 10 aa, Mycobacterium tuberculosis
VLPLMVVPGN

SEQ ID NO: 42016 - protein, 10 aa, Mycobacterium tuberculosis
LPLMVVPGNG

SEQ ID NO: 42017 - protein, 10 aa, Mycobacterium tuberculosis
PLMVVPGNGQ

SEQ ID NO: 42018 - protein, 10 aa, Mycobacterium tuberculosis
LMVVPGNGQK

SEQ ID NO: 42019 - protein, 10 aa, Mycobacterium tuberculosis
MVVPGNGQKW

SEQ ID NO: 42020 - protein, 10 aa, Mycobacterium tuberculosis
VVPGNGQKWR

SEQ ID NO: 42021 - protein, 10 aa, Mycobacterium tuberculosis
VPGNGQKWRN

SEQ ID NO: 42022 - protein, 10 aa, Mycobacterium tuberculosis
PGNGQKWRNR

SEQ ID NO: 42023 - protein, 10 aa, Mycobacterium tuberculosis
GNGQKWRNRT

SEQ ID NO: 42024 - protein, 10 aa, Mycobacterium tuberculosis
NGQKWRNRTE

SEQ ID NO: 42025 - protein, 10 aa, Mycobacterium tuberculosis
GQKWRNRTET

SEQ ID NO: 42026 - protein, 10 aa, Mycobacterium tuberculosis
QKWRNRTETE

SEQ ID NO: 42027 - protein, 10 aa, Mycobacterium tuberculosis
KWRNRTETEE

SEQ ID NO: 42028 - protein, 10 aa, Mycobacterium tuberculosis
WRNRTETEEA

SEQ ID NO: 42029 - protein, 10 aa, Mycobacterium tuberculosis
RNRTETEEAM

SEQ ID NO: 42030 - protein, 10 aa, Mycobacterium tuberculosis
NRTETEEAMG

SEQ ID NO: 42031 - protein, 10 aa, Mycobacterium tuberculosis
RTETEEAMGD

SEQ ID NO: 42032 - protein, 10 aa, Mycobacterium tuberculosis
TETEEAMGDT

SEQ ID NO: 42033 - protein, 10 aa, Mycobacterium tuberculosis
ETEEAMGDTY

SEQ ID NO: 42034 - protein, 10 aa, Mycobacterium tuberculosis
TEEAMGDTYR

SEQ ID NO: 42035 - protein, 10 aa, Mycobacterium tuberculosis
EEAMGDTYRD

SEQ ID NO: 42036 - protein, 10 aa, Mycobacterium tuberculosis
EAMGDTYRDP

SEQ ID NO: 42037 - protein, 10 aa, Mycobacterium tuberculosis
AMGDTYRDPV

SEQ ID NO: 42038 - protein, 10 aa, Mycobacterium tuberculosis
MGDTYRDPVD

SEQ ID NO: 42039 - protein, 10 aa, Mycobacterium tuberculosis
GDTYRDPVDH

SEQ ID NO: 42040 - protein, 10 aa, Mycobacterium tuberculosis
DTYRDPVDHL

SEQ ID NO: 42041 - protein, 10 aa, Mycobacterium tuberculosis
TYRDPVDHLR

SEQ ID NO: 42042 - protein, 10 aa, Mycobacterium tuberculosis
YRDPVDHLRT

SEQ ID NO: 42043 - protein, 10 aa, Mycobacterium tuberculosis
RDPVDHLRTT

SEQ ID NO: 42044 - protein, 10 aa, Mycobacterium tuberculosis
DPVDHLRTTR

SEQ ID NO: 42045 - protein, 10 aa, Mycobacterium tuberculosis
PVDHLRTTRP

SEQ ID NO: 42046 - protein, 10 aa, Mycobacterium tuberculosis
VDHLRTTRPL

SEQ ID NO: 42047 - protein, 10 aa, Mycobacterium tuberculosis
DHLRTTRPLA

SEQ ID NO: 42048 - protein, 10 aa, Mycobacterium tuberculosis
HLRTTRPLAG

SEQ ID NO: 42049 - protein, 10 aa, Mycobacterium tuberculosis
LRTTRPLAGE

SEQ ID NO: 42050 - protein, 10 aa, Mycobacterium tuberculosis
RTTRPLAGES

SEQ ID NO: 42051 - protein, 10 aa, Mycobacterium tuberculosis
TTRPLAGESL

SEQ ID NO: 42052 - protein, 10 aa, Mycobacterium tuberculosis
TRPLAGESLI

SEQ ID NO: 42053 - protein, 10 aa, Mycobacterium tuberculosis
RPLAGESLID

SEQ ID NO: 42054 - protein, 10 aa, Mycobacterium tuberculosis
PLAGESLIDV

SEQ ID NO: 42055 - protein, 10 aa, Mycobacterium tuberculosis
LAGESLIDVV

SEQ ID NO: 42056 - protein, 10 aa, Mycobacterium tuberculosis
AGESLIDVVH

SEQ ID NO: 42057 - protein, 10 aa, Mycobacterium tuberculosis
GESLIDVVHW

SEQ ID NO: 42058 - protein, 10 aa, Mycobacterium tuberculosis
ESLIDVVHWP

SEQ ID NO: 42059 - protein, 10 aa, Mycobacterium tuberculosis
SLIDVVHWPG

SEQ ID NO: 42060 - protein, 10 aa, Mycobacterium tuberculosis
LIDVVHWPGY

SEQ ID NO: 42061 - protein, 10 aa, Mycobacterium tuberculosis
IDVVHWPGYL

SEQ ID NO: 42062 - protein, 10 aa, Mycobacterium tuberculosis
DVVHWPGYLL

SEQ ID NO: 42063 - protein, 10 aa, Mycobacterium tuberculosis
VVHWPGYLLI

SEQ ID NO: 42064 - protein, 10 aa, Mycobacterium tuberculosis
VHWPGYLLIV

SEQ ID NO: 42065 - protein, 10 aa, Mycobacterium tuberculosis
HWPGYLLIVA

SEQ ID NO: 42066 - protein, 10 aa, Mycobacterium tuberculosis
WPGYLLIVAG

SEQ ID NO: 42067 - protein, 10 aa, Mycobacterium tuberculosis
PGYLLIVAGV

SEQ ID NO: 42068 - protein, 10 aa, Mycobacterium tuberculosis
GYLLIVAGVV

SEQ ID NO: 42069 - protein, 10 aa, Mycobacterium tuberculosis
YLLIVAGVVG

SEQ ID NO: 42070 - protein, 10 aa, Mycobacterium tuberculosis
LLIVAGVVGG

SEQ ID NO: 42071 - protein, 10 aa, Mycobacterium tuberculosis
LIVAGVVGGV

SEQ ID NO: 42072 - protein, 10 aa, Mycobacterium tuberculosis
IVAGVVGGVG

SEQ ID NO: 42073 - protein, 10 aa, Mycobacterium tuberculosis
VAGVVGGVGA

SEQ ID NO: 42074 - protein, 10 aa, Mycobacterium tuberculosis
AGVVGGVGAL

SEQ ID NO: 42075 - protein, 10 aa, Mycobacterium tuberculosis
GVVGGVGALA

SEQ ID NO: 42076 - protein, 10 aa, Mycobacterium tuberculosis
VVGGVGALAA

SEQ ID NO: 42077 - protein, 10 aa, Mycobacterium tuberculosis
VGGVGALAAF

SEQ ID NO: 42078 - protein, 10 aa, Mycobacterium tuberculosis
GGVGALAAFG

SEQ ID NO: 42079 - protein, 10 aa, Mycobacterium tuberculosis
GVGALAAFGT

SEQ ID NO: 42080 - protein, 10 aa, Mycobacterium tuberculosis
VGALAAFGTG

SEQ ID NO: 42081 - protein, 10 aa, Mycobacterium tuberculosis
GALAAFGTGH

SEQ ID NO: 42082 - protein, 10 aa, Mycobacterium tuberculosis
ALAAFGTGHH

SEQ ID NO: 42083 - protein, 10 aa, Mycobacterium tuberculosis
LAAFGTGHHA

SEQ ID NO: 42084 - protein, 10 aa, Mycobacterium tuberculosis
AAFGTGHHAE

SEQ ID NO: 42085 - protein, 10 aa, Mycobacterium tuberculosis
AFGTGHHAEG

SEQ ID NO: 42086 - protein, 10 aa, Mycobacterium tuberculosis
FGTGHHAEGM

SEQ ID NO: 42087 - protein, 10 aa, Mycobacterium tuberculosis
GTGHHAEGMT

SEQ ID NO: 42088 - protein, 10 aa, Mycobacterium tuberculosis
TGHHAEGMTF

SEQ ID NO: 42089 - protein, 10 aa, Mycobacterium tuberculosis
GHHAEGMTFG

SEQ ID NO: 42090 - protein, 10 aa, Mycobacterium tuberculosis
HHAEGMTFGV

SEQ ID NO: 42091 - protein, 10 aa, Mycobacterium tuberculosis
HAEGMTFGVV

SEQ ID NO: 42092 - protein, 10 aa, Mycobacterium tuberculosis
AEGMTFGVVA

SEQ ID NO: 42093 - protein, 10 aa, Mycobacterium tuberculosis
EGMTFGVVAI

SEQ ID NO: 42094 - protein, 10 aa, Mycobacterium tuberculosis
GMTFGVVAIV

SEQ ID NO: 42095 - protein, 10 aa, Mycobacterium tuberculosis
MTFGVVAIVV

SEQ ID NO: 42096 - protein, 10 aa, Mycobacterium tuberculosis
TFGVVAIVVT

SEQ ID NO: 42097 - protein, 10 aa, Mycobacterium tuberculosis
FGVVAIVVTV

SEQ ID NO: 42098 - protein, 10 aa, Mycobacterium tuberculosis
GVVAIVVTVV

SEQ ID NO: 42099 - protein, 10 aa, Mycobacterium tuberculosis
VVAIVVTVVG

SEQ ID NO: 42100 - protein, 10 aa, Mycobacterium tuberculosis
VAIVVTVVGL

SEQ ID NO: 42101 - protein, 10 aa, Mycobacterium tuberculosis
AIVVTVVGLA

SEQ ID NO: 42102 - protein, 10 aa, Mycobacterium tuberculosis
IVVTVVGLAW

SEQ ID NO: 42103 - protein, 10 aa, Mycobacterium tuberculosis
VVTVVGLAWL

SEQ ID NO: 42104 - protein, 10 aa, Mycobacterium tuberculosis
VTVVGLAWLA

SEQ ID NO: 42105 - protein, 10 aa, Mycobacterium tuberculosis
TVVGLAWLAF

SEQ ID NO: 42106 - protein, 10 aa, Mycobacterium tuberculosis
VVGLAWLAFE

SEQ ID NO: 42107 - protein, 10 aa, Mycobacterium tuberculosis
VGLAWLAFEH

SEQ ID NO: 42108 - protein, 10 aa, Mycobacterium tuberculosis
GLAWLAFEHR

SEQ ID NO: 42109 - protein, 10 aa, Mycobacterium tuberculosis
LAWLAFEHRR

SEQ ID NO: 42110 - protein, 10 aa, Mycobacterium tuberculosis
AWLAFEHRRI

SEQ ID NO: 42111 - protein, 10 aa, Mycobacterium tuberculosis
WLAFEHRRIR

SEQ ID NO: 42112 - protein, 10 aa, Mycobacterium tuberculosis
LAFEHRRIRK

SEQ ID NO: 42113 - protein, 10 aa, Mycobacterium tuberculosis
AFEHRRIRKI

SEQ ID NO: 42114 - protein, 10 aa, Mycobacterium tuberculosis
FEHRRIRKIA

SEQ ID NO: 42115 - protein, 10 aa, Mycobacterium tuberculosis
EHRRIRKIAD

SEQ ID NO: 42116 - protein, 10 aa, Mycobacterium tuberculosis
HRRIRKIADR

SEQ ID NO: 42117 - protein, 10 aa, Mycobacterium tuberculosis
RRIRKIADRW

SEQ ID NO: 42118 - protein, 10 aa, Mycobacterium tuberculosis
RIRKIADRWY

SEQ ID NO: 42119 - protein, 10 aa, Mycobacterium tuberculosis
IRKIADRWYT

SEQ ID NO: 42120 - protein, 10 aa, Mycobacterium tuberculosis
RKIADRWYTE

SEQ ID NO: 42121 - protein, 10 aa, Mycobacterium tuberculosis
KIADRWYTEH

SEQ ID NO: 42122 - protein, 10 aa, Mycobacterium tuberculosis
IADRWYTEHP

SEQ ID NO: 42123 - protein, 10 aa, Mycobacterium tuberculosis
ADRWYTEHPE

SEQ ID NO: 42124 - protein, 10 aa, Mycobacterium tuberculosis
DRWYTEHPEV

SEQ ID NO: 42125 - protein, 10 aa, Mycobacterium tuberculosis
RWYTEHPEVR

SEQ ID NO: 42126 - protein, 10 aa, Mycobacterium tuberculosis
WYTEHPEVRR

SEQ ID NO: 42127 - protein, 10 aa, Mycobacterium tuberculosis
YTEHPEVRRQ

SEQ ID NO: 42128 - protein, 10 aa, Mycobacterium tuberculosis
TEHPEVRRQR

SEQ ID NO: 42129 - protein, 10 aa, Mycobacterium tuberculosis
EHPEVRRQRL

SEQ ID NO: 42130 - protein, 10 aa, Mycobacterium tuberculosis
HPEVRRQRLA

SEQ ID NO: 42131 - protein, 10 aa, Mycobacterium tuberculosis
PEVRRQRLAG

SEQ ID NO: 42132 - protein, 11 aa, Mycobacterium tuberculosis
MGQIPPQPVRR

SEQ ID NO: 42133 - protein, 11 aa, Mycobacterium tuberculosis
GQIPPQPVRRV

SEQ ID NO: 42134 - protein, 11 aa, Mycobacterium tuberculosis
QIPPQPVRRVL

SEQ ID NO: 42135 - protein, 11 aa, Mycobacterium tuberculosis
IPPQPVRRVLP

SEQ ID NO: 42136 - protein, 11 aa, Mycobacterium tuberculosis
PPQPVRRVLPL

SEQ ID NO: 42137 - protein, 11 aa, Mycobacterium tuberculosis
PQPVRRVLPLM

SEQ ID NO: 42138 - protein, 11 aa, Mycobacterium tuberculosis
QPVRRVLPLMV

SEQ ID NO: 42139 - protein, 11 aa, Mycobacterium tuberculosis
PVRRVLPLMVV

SEQ ID NO: 42140 - protein, 11 aa, Mycobacterium tuberculosis
VRRVLPLMVVP

SEQ ID NO: 42141 - protein, 11 aa, Mycobacterium tuberculosis
RRVLPLMVVPG

SEQ ID NO: 42142 - protein, 11 aa, Mycobacterium tuberculosis
RVLPLMVVPGN

SEQ ID NO: 42143 - protein, 11 aa, Mycobacterium tuberculosis
VLPLMVVPGNG

SEQ ID NO: 42144 - protein, 11 aa, Mycobacterium tuberculosis
LPLMVVPGNGQ

SEQ ID NO: 42145 - protein, 11 aa, Mycobacterium tuberculosis
PLMVVPGNGQK

SEQ ID NO: 42146 - protein, 11 aa, Mycobacterium tuberculosis
LMVVPGNGQKW

SEQ ID NO: 42147 - protein, 11 aa, Mycobacterium tuberculosis
MVVPGNGQKWR

SEQ ID NO: 42148 - protein, 11 aa, Mycobacterium tuberculosis
VVPGNGQKWRN

SEQ ID NO: 42149 - protein, 11 aa, Mycobacterium tuberculosis
VPGNGQKWRNR

SEQ ID NO: 42150 - protein, 11 aa, Mycobacterium tuberculosis
PGNGQKWRNRT

SEQ ID NO: 42151 - protein, 11 aa, Mycobacterium tuberculosis
GNGQKWRNRTE

SEQ ID NO: 42152 - protein, 11 aa, Mycobacterium tuberculosis
NGQKWRNRTET

SEQ ID NO: 42153 - protein, 11 aa, Mycobacterium tuberculosis
GQKWRNRTETE

SEQ ID NO: 42154 - protein, 11 aa, Mycobacterium tuberculosis
QKWRNRTETEE

SEQ ID NO: 42155 - protein, 11 aa, Mycobacterium tuberculosis
KWRNRTETEEA

SEQ ID NO: 42156 - protein, 11 aa, Mycobacterium tuberculosis
WRNRTETEEAM

SEQ ID NO: 42157 - protein, 11 aa, Mycobacterium tuberculosis
RNRTETEEAMG

SEQ ID NO: 42158 - protein, 11 aa, Mycobacterium tuberculosis
NRTETEEAMGD

SEQ ID NO: 42159 - protein, 11 aa, Mycobacterium tuberculosis
RTETEEAMGDT

SEQ ID NO: 42160 - protein, 11 aa, Mycobacterium tuberculosis
TETEEAMGDTY

SEQ ID NO: 42161 - protein, 11 aa, Mycobacterium tuberculosis
ETEEAMGDTYR

SEQ ID NO: 42162 - protein, 11 aa, Mycobacterium tuberculosis
TEEAMGDTYRD

SEQ ID NO: 42163 - protein, 11 aa, Mycobacterium tuberculosis
EEAMGDTYRDP

SEQ ID NO: 42164 - protein, 11 aa, Mycobacterium tuberculosis
EAMGDTYRDPV

SEQ ID NO: 42165 - protein, 11 aa, Mycobacterium tuberculosis
AMGDTYRDPVD

SEQ ID NO: 42166 - protein, 11 aa, Mycobacterium tuberculosis
MGDTYRDPVDH

SEQ ID NO: 42167 - protein, 11 aa, Mycobacterium tuberculosis
GDTYRDPVDHL

SEQ ID NO: 42168 - protein, 11 aa, Mycobacterium tuberculosis
DTYRDPVDHLR

SEQ ID NO: 42169 - protein, 11 aa, Mycobacterium tuberculosis
TYRDPVDHLRT

SEQ ID NO: 42170 - protein, 11 aa, Mycobacterium tuberculosis
YRDPVDHLRTT

SEQ ID NO: 42171 - protein, 11 aa, Mycobacterium tuberculosis
RDPVDHLRTTR

SEQ ID NO: 42172 - protein, 11 aa, Mycobacterium tuberculosis
DPVDHLRTTRP

SEQ ID NO: 42173 - protein, 11 aa, Mycobacterium tuberculosis
PVDHLRTTRPL

SEQ ID NO: 42174 - protein, 11 aa, Mycobacterium tuberculosis
VDHLRTTRPLA

SEQ ID NO: 42175 - protein, 11 aa, Mycobacterium tuberculosis
DHLRTTRPLAG

SEQ ID NO: 42176 - protein, 11 aa, Mycobacterium tuberculosis
HLRTTRPLAGE

SEQ ID NO: 42177 - protein, 11 aa, Mycobacterium tuberculosis
LRTTRPLAGES

SEQ ID NO: 42178 - protein, 11 aa, Mycobacterium tuberculosis
RTTRPLAGESL

SEQ ID NO: 42179 - protein, 11 aa, Mycobacterium tuberculosis
TTRPLAGESLI

SEQ ID NO: 42180 - protein, 11 aa, Mycobacterium tuberculosis
TRPLAGESLID

SEQ ID NO: 42181 - protein, 11 aa, Mycobacterium tuberculosis
RPLAGESLIDV

SEQ ID NO: 42182 - protein, 11 aa, Mycobacterium tuberculosis
PLAGESLIDVV

SEQ ID NO: 42183 - protein, 11 aa, Mycobacterium tuberculosis
LAGESLIDVVH

SEQ ID NO: 42184 - protein, 11 aa, Mycobacterium tuberculosis
AGESLIDVVHW

SEQ ID NO: 42185 - protein, 11 aa, Mycobacterium tuberculosis
GESLIDVVHWP

SEQ ID NO: 42186 - protein, 11 aa, Mycobacterium tuberculosis
ESLIDVVHWPG

SEQ ID NO: 42187 - protein, 11 aa, Mycobacterium tuberculosis
SLIDVVHWPGY

SEQ ID NO: 42188 - protein, 11 aa, Mycobacterium tuberculosis
LIDVVHWPGYL

SEQ ID NO: 42189 - protein, 11 aa, Mycobacterium tuberculosis
IDVVHWPGYLL

SEQ ID NO: 42190 - protein, 11 aa, Mycobacterium tuberculosis
DVVHWPGYLLI

SEQ ID NO: 42191 - protein, 11 aa, Mycobacterium tuberculosis
VVHWPGYLLIV

SEQ ID NO: 42192 - protein, 11 aa, Mycobacterium tuberculosis
VHWPGYLLIVA

SEQ ID NO: 42193 - protein, 11 aa, Mycobacterium tuberculosis
HWPGYLLIVAG

SEQ ID NO: 42194 - protein, 11 aa, Mycobacterium tuberculosis
WPGYLLIVAGV

SEQ ID NO: 42195 - protein, 11 aa, Mycobacterium tuberculosis
PGYLLIVAGVV

SEQ ID NO: 42196 - protein, 11 aa, Mycobacterium tuberculosis
GYLLIVAGVVG

SEQ ID NO: 42197 - protein, 11 aa, Mycobacterium tuberculosis
YLLIVAGVVGG

SEQ ID NO: 42198 - protein, 11 aa, Mycobacterium tuberculosis
LLIVAGVVGGV

SEQ ID NO: 42199 - protein, 11 aa, Mycobacterium tuberculosis
LIVAGVVGGVG

SEQ ID NO: 42200 - protein, 11 aa, Mycobacterium tuberculosis
IVAGVVGGVGA

SEQ ID NO: 42201 - protein, 11 aa, Mycobacterium tuberculosis
VAGVVGGVGAL

SEQ ID NO: 42202 - protein, 11 aa, Mycobacterium tuberculosis
AGVVGGVGALA

SEQ ID NO: 42203 - protein, 11 aa, Mycobacterium tuberculosis
GVVGGVGALAA

SEQ ID NO: 42204 - protein, 11 aa, Mycobacterium tuberculosis
VVGGVGALAAF

SEQ ID NO: 42205 - protein, 11 aa, Mycobacterium tuberculosis
VGGVGALAAFG

SEQ ID NO: 42206 - protein, 11 aa, Mycobacterium tuberculosis
GGVGALAAFGT

SEQ ID NO: 42207 - protein, 11 aa, Mycobacterium tuberculosis
GVGALAAFGTG

SEQ ID NO: 42208 - protein, 11 aa, Mycobacterium tuberculosis
VGALAAFGTGH

SEQ ID NO: 42209 - protein, 11 aa, Mycobacterium tuberculosis
GALAAFGTGHH

SEQ ID NO: 42210 - protein, 11 aa, Mycobacterium tuberculosis
ALAAFGTGHHA

SEQ ID NO: 42211 - protein, 11 aa, Mycobacterium tuberculosis
LAAFGTGHHAE

SEQ ID NO: 42212 - protein, 11 aa, Mycobacterium tuberculosis
AAFGTGHHAEG

SEQ ID NO: 42213 - protein, 11 aa, Mycobacterium tuberculosis
AFGTGHHAEGM

SEQ ID NO: 42214 - protein, 11 aa, Mycobacterium tuberculosis
FGTGHHAEGMT

SEQ ID NO: 42215 - protein, 11 aa, Mycobacterium tuberculosis
GTGHHAEGMTF

SEQ ID NO: 42216 - protein, 11 aa, Mycobacterium tuberculosis
TGHHAEGMTFG

SEQ ID NO: 42217 - protein, 11 aa, Mycobacterium tuberculosis
GHHAEGMTFGV

SEQ ID NO: 42218 - protein, 11 aa, Mycobacterium tuberculosis
HHAEGMTFGVV

SEQ ID NO: 42219 - protein, 11 aa, Mycobacterium tuberculosis
HAEGMTFGVVA

SEQ ID NO: 42220 - protein, 11 aa, Mycobacterium tuberculosis
AEGMTFGVVAI

SEQ ID NO: 42221 - protein, 11 aa, Mycobacterium tuberculosis
EGMTFGVVAIV

SEQ ID NO: 42222 - protein, 11 aa, Mycobacterium tuberculosis
GMTFGVVAIVV

SEQ ID NO: 42223 - protein, 11 aa, Mycobacterium tuberculosis
MTFGVVAIVVT

SEQ ID NO: 42224 - protein, 11 aa, Mycobacterium tuberculosis
TFGVVAIVVTV

SEQ ID NO: 42225 - protein, 11 aa, Mycobacterium tuberculosis
FGVVAIVVTVV

SEQ ID NO: 42226 - protein, 11 aa, Mycobacterium tuberculosis
GVVAIVVTVVG

SEQ ID NO: 42227 - protein, 11 aa, Mycobacterium tuberculosis
VVAIVVTVVGL

SEQ ID NO: 42228 - protein, 11 aa, Mycobacterium tuberculosis
VAIVVTVVGLA

SEQ ID NO: 42229 - protein, 11 aa, Mycobacterium tuberculosis
AIVVTVVGLAW

SEQ ID NO: 42230 - protein, 11 aa, Mycobacterium tuberculosis
IVVTVVGLAWL

SEQ ID NO: 42231 - protein, 11 aa, Mycobacterium tuberculosis
VVTVVGLAWLA

SEQ ID NO: 42232 - protein, 11 aa, Mycobacterium tuberculosis
VTVVGLAWLAF

SEQ ID NO: 42233 - protein, 11 aa, Mycobacterium tuberculosis
TVVGLAWLAFE

SEQ ID NO: 42234 - protein, 11 aa, Mycobacterium tuberculosis
VVGLAWLAFEH

SEQ ID NO: 42235 - protein, 11 aa, Mycobacterium tuberculosis
VGLAWLAFEHR

SEQ ID NO: 42236 - protein, 11 aa, Mycobacterium tuberculosis
GLAWLAFEHRR

SEQ ID NO: 42237 - protein, 11 aa, Mycobacterium tuberculosis
LAWLAFEHRRI

SEQ ID NO: 42238 - protein, 11 aa, Mycobacterium tuberculosis
AWLAFEHRRIR

SEQ ID NO: 42239 - protein, 11 aa, Mycobacterium tuberculosis
WLAFEHRRIRK

SEQ ID NO: 42240 - protein, 11 aa, Mycobacterium tuberculosis
LAFEHRRIRKI

SEQ ID NO: 42241 - protein, 11 aa, Mycobacterium tuberculosis
AFEHRRIRKIA

SEQ ID NO: 42242 - protein, 11 aa, Mycobacterium tuberculosis
FEHRRIRKIAD

SEQ ID NO: 42243 - protein, 11 aa, Mycobacterium tuberculosis
EHRRIRKIADR

SEQ ID NO: 42244 - protein, 11 aa, Mycobacterium tuberculosis
HRRIRKIADRW

SEQ ID NO: 42245 - protein, 11 aa, Mycobacterium tuberculosis
RRIRKIADRWY

SEQ ID NO: 42246 - protein, 11 aa, Mycobacterium tuberculosis
RIRKIADRWYT

SEQ ID NO: 42247 - protein, 11 aa, Mycobacterium tuberculosis
IRKIADRWYTE

SEQ ID NO: 42248 - protein, 11 aa, Mycobacterium tuberculosis
RKIADRWYTEH

SEQ ID NO: 42249 - protein, 11 aa, Mycobacterium tuberculosis
KIADRWYTEHP

SEQ ID NO: 42250 - protein, 11 aa, Mycobacterium tuberculosis
IADRWYTEHPE

SEQ ID NO: 42251 - protein, 11 aa, Mycobacterium tuberculosis
ADRWYTEHPEV

SEQ ID NO: 42252 - protein, 11 aa, Mycobacterium tuberculosis
DRWYTEHPEVR

SEQ ID NO: 42253 - protein, 11 aa, Mycobacterium tuberculosis
RWYTEHPEVRR

SEQ ID NO: 42254 - protein, 11 aa, Mycobacterium tuberculosis
WYTEHPEVRRQ

SEQ ID NO: 42255 - protein, 11 aa, Mycobacterium tuberculosis
YTEHPEVRRQR

SEQ ID NO: 42256 - protein, 11 aa, Mycobacterium tuberculosis
TEHPEVRRQRL

SEQ ID NO: 42257 - protein, 11 aa, Mycobacterium tuberculosis
EHPEVRRQRLA

SEQ ID NO: 42258 - protein, 11 aa, Mycobacterium tuberculosis
HPEVRRQRLAG

SEQ ID NO: 42259 - protein, 8 aa, Mycobacterium tuberculosis
MHEVGGPS

SEQ ID NO: 42260 - protein, 8 aa, Mycobacterium tuberculosis
HEVGGPSR

SEQ ID NO: 42261 - protein, 8 aa, Mycobacterium tuberculosis
EVGGPSRG

SEQ ID NO: 42262 - protein, 8 aa, Mycobacterium tuberculosis
VGGPSRGD

SEQ ID NO: 42263 - protein, 8 aa, Mycobacterium tuberculosis
GGPSRGDR

SEQ ID NO: 42264 - protein, 8 aa, Mycobacterium tuberculosis
GPSRGDRL

SEQ ID NO: 42265 - protein, 8 aa, Mycobacterium tuberculosis
PSRGDRLG

SEQ ID NO: 42266 - protein, 8 aa, Mycobacterium tuberculosis
SRGDRLGR

SEQ ID NO: 42267 - protein, 8 aa, Mycobacterium tuberculosis
RGDRLGRD

SEQ ID NO: 42268 - protein, 8 aa, Mycobacterium tuberculosis
GDRLGRDD

SEQ ID NO: 42269 - protein, 8 aa, Mycobacterium tuberculosis
DRLGRDDS

SEQ ID NO: 42270 - protein, 8 aa, Mycobacterium tuberculosis
RLGRDDSE

SEQ ID NO: 42271 - protein, 8 aa, Mycobacterium tuberculosis
LGRDDSEV

SEQ ID NO: 42272 - protein, 8 aa, Mycobacterium tuberculosis
GRDDSEVH

SEQ ID NO: 42273 - protein, 8 aa, Mycobacterium tuberculosis
RDDSEVHS

SEQ ID NO: 42274 - protein, 8 aa, Mycobacterium tuberculosis
DDSEVHSA

SEQ ID NO: 42275 - protein, 8 aa, Mycobacterium tuberculosis
DSEVHSAI

SEQ ID NO: 42276 - protein, 8 aa, Mycobacterium tuberculosis
SEVHSAIR

SEQ ID NO: 42277 - protein, 8 aa, Mycobacterium tuberculosis
EVHSAIRF

SEQ ID NO: 42278 - protein, 8 aa, Mycobacterium tuberculosis
VHSAIRFA

SEQ ID NO: 42279 - protein, 8 aa, Mycobacterium tuberculosis
HSAIRFAV

SEQ ID NO: 42280 - protein, 8 aa, Mycobacterium tuberculosis
SAIRFAVV

SEQ ID NO: 42281 - protein, 8 aa, Mycobacterium tuberculosis
AIRFAVVA

SEQ ID NO: 42282 - protein, 8 aa, Mycobacterium tuberculosis
IRFAVVAA

SEQ ID NO: 42283 - protein, 8 aa, Mycobacterium tuberculosis
RFAVVAAV

SEQ ID NO: 42284 - protein, 8 aa, Mycobacterium tuberculosis
FAVVAAVV

SEQ ID NO: 42285 - protein, 8 aa, Mycobacterium tuberculosis
AVVAAVVG

SEQ ID NO: 42286 - protein, 8 aa, Mycobacterium tuberculosis
VVAAVVGV

SEQ ID NO: 42287 - protein, 8 aa, Mycobacterium tuberculosis
VAAVVGVG

SEQ ID NO: 42288 - protein, 8 aa, Mycobacterium tuberculosis
AAVVGVGF

SEQ ID NO: 42289 - protein, 8 aa, Mycobacterium tuberculosis
AVVGVGFL

SEQ ID NO: 42290 - protein, 8 aa, Mycobacterium tuberculosis
VVGVGFLI

SEQ ID NO: 42291 - protein, 8 aa, Mycobacterium tuberculosis
VGVGFLIM

SEQ ID NO: 42292 - protein, 8 aa, Mycobacterium tuberculosis
GVGFLIMG

SEQ ID NO: 42293 - protein, 8 aa, Mycobacterium tuberculosis
VGFLIMGA

SEQ ID NO: 42294 - protein, 8 aa, Mycobacterium tuberculosis
GFLIMGAL

SEQ ID NO: 42295 - protein, 8 aa, Mycobacterium tuberculosis
FLIMGALL

SEQ ID NO: 42296 - protein, 8 aa, Mycobacterium tuberculosis
LIMGALLV

SEQ ID NO: 42297 - protein, 8 aa, Mycobacterium tuberculosis
IMGALLVS

SEQ ID NO: 42298 - protein, 8 aa, Mycobacterium tuberculosis
MGALLVST

SEQ ID NO: 42299 - protein, 8 aa, Mycobacterium tuberculosis
GALLVSTC

SEQ ID NO: 42300 - protein, 8 aa, Mycobacterium tuberculosis
ALLVSTCS

SEQ ID NO: 42301 - protein, 8 aa, Mycobacterium tuberculosis
LLVSTCSG

SEQ ID NO: 42302 - protein, 8 aa, Mycobacterium tuberculosis
LVSTCSGV

SEQ ID NO: 42303 - protein, 8 aa, Mycobacterium tuberculosis
VSTCSGVD

SEQ ID NO: 42304 - protein, 8 aa, Mycobacterium tuberculosis
STCSGVDT

SEQ ID NO: 42305 - protein, 8 aa, Mycobacterium tuberculosis
TCSGVDTA

SEQ ID NO: 42306 - protein, 8 aa, Mycobacterium tuberculosis
CSGVDTAA

SEQ ID NO: 42307 - protein, 8 aa, Mycobacterium tuberculosis
SGVDTAAC

SEQ ID NO: 42308 - protein, 8 aa, Mycobacterium tuberculosis
GVDTAACG

SEQ ID NO: 42309 - protein, 8 aa, Mycobacterium tuberculosis
VDTAACGP

SEQ ID NO: 42310 - protein, 8 aa, Mycobacterium tuberculosis
DTAACGPP

SEQ ID NO: 42311 - protein, 8 aa, Mycobacterium tuberculosis
TAACGPPQ

SEQ ID NO: 42312 - protein, 8 aa, Mycobacterium tuberculosis
AACGPPQR

SEQ ID NO: 42313 - protein, 8 aa, Mycobacterium tuberculosis
ACGPPQRI

SEQ ID NO: 42314 - protein, 8 aa, Mycobacterium tuberculosis
CGPPQRIL

SEQ ID NO: 42315 - protein, 8 aa, Mycobacterium tuberculosis
GPPQRILL

SEQ ID NO: 42316 - protein, 8 aa, Mycobacterium tuberculosis
PPQRILLA

SEQ ID NO: 42317 - protein, 8 aa, Mycobacterium tuberculosis
PQRILLAL

SEQ ID NO: 42318 - protein, 8 aa, Mycobacterium tuberculosis
QRILLALG

SEQ ID NO: 42319 - protein, 8 aa, Mycobacterium tuberculosis
RILLALGG

SEQ ID NO: 42320 - protein, 8 aa, Mycobacterium tuberculosis
ILLALGGP

SEQ ID NO: 42321 - protein, 8 aa, Mycobacterium tuberculosis
LLALGGPL

SEQ ID NO: 42322 - protein, 8 aa, Mycobacterium tuberculosis
LALGGPLI

SEQ ID NO: 42323 - protein, 8 aa, Mycobacterium tuberculosis
ALGGPLIL

SEQ ID NO: 42324 - protein, 8 aa, Mycobacterium tuberculosis
LGGPLILC

SEQ ID NO: 42325 - protein, 8 aa, Mycobacterium tuberculosis
GGPLILCA

SEQ ID NO: 42326 - protein, 8 aa, Mycobacterium tuberculosis
GPLILCAA

SEQ ID NO: 42327 - protein, 8 aa, Mycobacterium tuberculosis
PLILCAAG

SEQ ID NO: 42328 - protein, 8 aa, Mycobacterium tuberculosis
LILCAAGL

SEQ ID NO: 42329 - protein, 8 aa, Mycobacterium tuberculosis
ILCAAGLW

SEQ ID NO: 42330 - protein, 8 aa, Mycobacterium tuberculosis
LCAAGLWA

SEQ ID NO: 42331 - protein, 8 aa, Mycobacterium tuberculosis
CAAGLWAF

SEQ ID NO: 42332 - protein, 8 aa, Mycobacterium tuberculosis
AAGLWAFL

SEQ ID NO: 42333 - protein, 8 aa, Mycobacterium tuberculosis
AGLWAFLR

SEQ ID NO: 42334 - protein, 8 aa, Mycobacterium tuberculosis
GLWAFLRT

SEQ ID NO: 42335 - protein, 8 aa, Mycobacterium tuberculosis
LWAFLRTY

SEQ ID NO: 42336 - protein, 8 aa, Mycobacterium tuberculosis
WAFLRTYR

SEQ ID NO: 42337 - protein, 8 aa, Mycobacterium tuberculosis
AFLRTYRV

SEQ ID NO: 42338 - protein, 8 aa, Mycobacterium tuberculosis
FLRTYRVW

SEQ ID NO: 42339 - protein, 8 aa, Mycobacterium tuberculosis
LRTYRVWR

SEQ ID NO: 42340 - protein, 8 aa, Mycobacterium tuberculosis
RTYRVWRA

SEQ ID NO: 42341 - protein, 8 aa, Mycobacterium tuberculosis
TYRVWRAE

SEQ ID NO: 42342 - protein, 8 aa, Mycobacterium tuberculosis
YRVWRAEG

SEQ ID NO: 42343 - protein, 8 aa, Mycobacterium tuberculosis
RVWRAEGT

SEQ ID NO: 42344 - protein, 8 aa, Mycobacterium tuberculosis
VWRAEGTW

SEQ ID NO: 42345 - protein, 8 aa, Mycobacterium tuberculosis
WRAEGTWW

SEQ ID NO: 42346 - protein, 8 aa, Mycobacterium tuberculosis
RAEGTWWG

SEQ ID NO: 42347 - protein, 8 aa, Mycobacterium tuberculosis
AEGTWWGW

SEQ ID NO: 42348 - protein, 8 aa, Mycobacterium tuberculosis
EGTWWGWH

SEQ ID NO: 42349 - protein, 8 aa, Mycobacterium tuberculosis
GTWWGWHG

SEQ ID NO: 42350 - protein, 8 aa, Mycobacterium tuberculosis
TWWGWHGA

SEQ ID NO: 42351 - protein, 8 aa, Mycobacterium tuberculosis
WWGWHGAG

SEQ ID NO: 42352 - protein, 8 aa, Mycobacterium tuberculosis
WGWHGAGW

SEQ ID NO: 42353 - protein, 8 aa, Mycobacterium tuberculosis
GWHGAGWF

SEQ ID NO: 42354 - protein, 8 aa, Mycobacterium tuberculosis
WHGAGWFL

SEQ ID NO: 42355 - protein, 8 aa, Mycobacterium tuberculosis
HGAGWFLL

SEQ ID NO: 42356 - protein, 8 aa, Mycobacterium tuberculosis
GAGWFLLT

SEQ ID NO: 42357 - protein, 8 aa, Mycobacterium tuberculosis
AGWFLLTL

SEQ ID NO: 42358 - protein, 8 aa, Mycobacterium tuberculosis
GWFLLTLM

SEQ ID NO: 42359 - protein, 8 aa, Mycobacterium tuberculosis
WFLLTLMV

SEQ ID NO: 42360 - protein, 8 aa, Mycobacterium tuberculosis
FLLTLMVL

SEQ ID NO: 42361 - protein, 8 aa, Mycobacterium tuberculosis
LLTLMVLT

SEQ ID NO: 42362 - protein, 8 aa, Mycobacterium tuberculosis
LTLMVLTL

SEQ ID NO: 42363 - protein, 8 aa, Mycobacterium tuberculosis
TLMVLTLC

SEQ ID NO: 42364 - protein, 8 aa, Mycobacterium tuberculosis
LMVLTLCI

SEQ ID NO: 42365 - protein, 8 aa, Mycobacterium tuberculosis
MVLTLCIG

SEQ ID NO: 42366 - protein, 8 aa, Mycobacterium tuberculosis
VLTLCIGV

SEQ ID NO: 42367 - protein, 8 aa, Mycobacterium tuberculosis
LTLCIGVP

SEQ ID NO: 42368 - protein, 8 aa, Mycobacterium tuberculosis
TLCIGVPP

SEQ ID NO: 42369 - protein, 8 aa, Mycobacterium tuberculosis
LCIGVPPI

SEQ ID NO: 42370 - protein, 8 aa, Mycobacterium tuberculosis
CIGVPPIA

SEQ ID NO: 42371 - protein, 8 aa, Mycobacterium tuberculosis
IGVPPIAG

SEQ ID NO: 42372 - protein, 8 aa, Mycobacterium tuberculosis
GVPPIAGP

SEQ ID NO: 42373 - protein, 8 aa, Mycobacterium tuberculosis
VPPIAGPV

SEQ ID NO: 42374 - protein, 8 aa, Mycobacterium tuberculosis
PPIAGPVM

SEQ ID NO: 42375 - protein, 8 aa, Mycobacterium tuberculosis
PIAGPVMA

SEQ ID NO: 42376 - protein, 8 aa, Mycobacterium tuberculosis
IAGPVMAP

SEQ ID NO: 42377 - protein, 9 aa, Mycobacterium tuberculosis
MHEVGGPSR

SEQ ID NO: 42378 - protein, 9 aa, Mycobacterium tuberculosis
HEVGGPSRG

SEQ ID NO: 42379 - protein, 9 aa, Mycobacterium tuberculosis
EVGGPSRGD

SEQ ID NO: 42380 - protein, 9 aa, Mycobacterium tuberculosis
VGGPSRGDR

SEQ ID NO: 42381 - protein, 9 aa, Mycobacterium tuberculosis
GGPSRGDRL

SEQ ID NO: 42382 - protein, 9 aa, Mycobacterium tuberculosis
GPSRGDRLG

SEQ ID NO: 42383 - protein, 9 aa, Mycobacterium tuberculosis
PSRGDRLGR

SEQ ID NO: 42384 - protein, 9 aa, Mycobacterium tuberculosis
SRGDRLGRD

SEQ ID NO: 42385 - protein, 9 aa, Mycobacterium tuberculosis
RGDRLGRDD

SEQ ID NO: 42386 - protein, 9 aa, Mycobacterium tuberculosis
GDRLGRDDS

SEQ ID NO: 42387 - protein, 9 aa, Mycobacterium tuberculosis
DRLGRDDSE

SEQ ID NO: 42388 - protein, 9 aa, Mycobacterium tuberculosis
RLGRDDSEV

SEQ ID NO: 42389 - protein, 9 aa, Mycobacterium tuberculosis
LGRDDSEVH

SEQ ID NO: 42390 - protein, 9 aa, Mycobacterium tuberculosis
GRDDSEVHS

SEQ ID NO: 42391 - protein, 9 aa, Mycobacterium tuberculosis
RDDSEVHSA

SEQ ID NO: 42392 - protein, 9 aa, Mycobacterium tuberculosis
DDSEVHSAI

SEQ ID NO: 42393 - protein, 9 aa, Mycobacterium tuberculosis
DSEVHSAIR

SEQ ID NO: 42394 - protein, 9 aa, Mycobacterium tuberculosis
SEVHSAIRF

SEQ ID NO: 42395 - protein, 9 aa, Mycobacterium tuberculosis
EVHSAIRFA

SEQ ID NO: 42396 - protein, 9 aa, Mycobacterium tuberculosis
VHSAIRFAV

SEQ ID NO: 42397 - protein, 9 aa, Mycobacterium tuberculosis
HSAIRFAVV

SEQ ID NO: 42398 - protein, 9 aa, Mycobacterium tuberculosis
SAIRFAVVA

SEQ ID NO: 42399 - protein, 9 aa, Mycobacterium tuberculosis
AIRFAVVAA

SEQ ID NO: 42400 - protein, 9 aa, Mycobacterium tuberculosis
IRFAVVAAV

SEQ ID NO: 42401 - protein, 9 aa, Mycobacterium tuberculosis
RFAVVAAVV

SEQ ID NO: 42402 - protein, 9 aa, Mycobacterium tuberculosis
FAVVAAVVG

SEQ ID NO: 42403 - protein, 9 aa, Mycobacterium tuberculosis
AVVAAVVGV

SEQ ID NO: 42404 - protein, 9 aa, Mycobacterium tuberculosis
VVAAVVGVG

SEQ ID NO: 42405 - protein, 9 aa, Mycobacterium tuberculosis
VAAVVGVGF

SEQ ID NO: 42406 - protein, 9 aa, Mycobacterium tuberculosis
AAVVGVGFL

SEQ ID NO: 42407 - protein, 9 aa, Mycobacterium tuberculosis
AVVGVGFLI

SEQ ID NO: 42408 - protein, 9 aa, Mycobacterium tuberculosis
VVGVGFLIM

SEQ ID NO: 42409 - protein, 9 aa, Mycobacterium tuberculosis
VGVGFLIMG

SEQ ID NO: 42410 - protein, 9 aa, Mycobacterium tuberculosis
GVGFLIMGA

SEQ ID NO: 42411 - protein, 9 aa, Mycobacterium tuberculosis
VGFLIMGAL

SEQ ID NO: 42412 - protein, 9 aa, Mycobacterium tuberculosis
GFLIMGALL

SEQ ID NO: 42413 - protein, 9 aa, Mycobacterium tuberculosis
FLIMGALLV

SEQ ID NO: 42414 - protein, 9 aa, Mycobacterium tuberculosis
LIMGALLVS

SEQ ID NO: 42415 - protein, 9 aa, Mycobacterium tuberculosis
IMGALLVST

SEQ ID NO: 42416 - protein, 9 aa, Mycobacterium tuberculosis
MGALLVSTC

SEQ ID NO: 42417 - protein, 9 aa, Mycobacterium tuberculosis
GALLVSTCS

SEQ ID NO: 42418 - protein, 9 aa, Mycobacterium tuberculosis
ALLVSTCSG

SEQ ID NO: 42419 - protein, 9 aa, Mycobacterium tuberculosis
LLVSTCSGV

SEQ ID NO: 42420 - protein, 9 aa, Mycobacterium tuberculosis
LVSTCSGVD

SEQ ID NO: 42421 - protein, 9 aa, Mycobacterium tuberculosis
VSTCSGVDT

SEQ ID NO: 42422 - protein, 9 aa, Mycobacterium tuberculosis
STCSGVDTA

SEQ ID NO: 42423 - protein, 9 aa, Mycobacterium tuberculosis
TCSGVDTAA

SEQ ID NO: 42424 - protein, 9 aa, Mycobacterium tuberculosis
CSGVDTAAC

SEQ ID NO: 42425 - protein, 9 aa, Mycobacterium tuberculosis
SGVDTAACG

SEQ ID NO: 42426 - protein, 9 aa, Mycobacterium tuberculosis
GVDTAACGP

SEQ ID NO: 42427 - protein, 9 aa, Mycobacterium tuberculosis
VDTAACGPP

SEQ ID NO: 42428 - protein, 9 aa, Mycobacterium tuberculosis
DTAACGPPQ

SEQ ID NO: 42429 - protein, 9 aa, Mycobacterium tuberculosis
TAACGPPQR

SEQ ID NO: 42430 - protein, 9 aa, Mycobacterium tuberculosis
AACGPPQRI

SEQ ID NO: 42431 - protein, 9 aa, Mycobacterium tuberculosis
ACGPPQRIL

SEQ ID NO: 42432 - protein, 9 aa, Mycobacterium tuberculosis
CGPPQRILL

SEQ ID NO: 42433 - protein, 9 aa, Mycobacterium tuberculosis
GPPQRILLA

SEQ ID NO: 42434 - protein, 9 aa, Mycobacterium tuberculosis
PPQRILLAL

SEQ ID NO: 42435 - protein, 9 aa, Mycobacterium tuberculosis
PQRILLALG

SEQ ID NO: 42436 - protein, 9 aa, Mycobacterium tuberculosis
QRILLALGG

SEQ ID NO: 42437 - protein, 9 aa, Mycobacterium tuberculosis
RILLALGGP

SEQ ID NO: 42438 - protein, 9 aa, Mycobacterium tuberculosis
ILLALGGPL

SEQ ID NO: 42439 - protein, 9 aa, Mycobacterium tuberculosis
LLALGGPLI

SEQ ID NO: 42440 - protein, 9 aa, Mycobacterium tuberculosis
LALGGPLIL

SEQ ID NO: 42441 - protein, 9 aa, Mycobacterium tuberculosis
ALGGPLILC

SEQ ID NO: 42442 - protein, 9 aa, Mycobacterium tuberculosis
LGGPLILCA

SEQ ID NO: 42443 - protein, 9 aa, Mycobacterium tuberculosis
GGPLILCAA

SEQ ID NO: 42444 - protein, 9 aa, Mycobacterium tuberculosis
GPLILCAAG

SEQ ID NO: 42445 - protein, 9 aa, Mycobacterium tuberculosis
PLILCAAGL

SEQ ID NO: 42446 - protein, 9 aa, Mycobacterium tuberculosis
LILCAAGLW

SEQ ID NO: 42447 - protein, 9 aa, Mycobacterium tuberculosis
ILCAAGLWA

SEQ ID NO: 42448 - protein, 9 aa, Mycobacterium tuberculosis
LCAAGLWAF

SEQ ID NO: 42449 - protein, 9 aa, Mycobacterium tuberculosis
CAAGLWAFL

SEQ ID NO: 42450 - protein, 9 aa, Mycobacterium tuberculosis
AAGLWAFLR

SEQ ID NO: 42451 - protein, 9 aa, Mycobacterium tuberculosis
AGLWAFLRT

SEQ ID NO: 42452 - protein, 9 aa, Mycobacterium tuberculosis
GLWAFLRTY

SEQ ID NO: 42453 - protein, 9 aa, Mycobacterium tuberculosis
LWAFLRTYR

SEQ ID NO: 42454 - protein, 9 aa, Mycobacterium tuberculosis
WAFLRTYRV

SEQ ID NO: 42455 - protein, 9 aa, Mycobacterium tuberculosis
AFLRTYRVW

SEQ ID NO: 42456 - protein, 9 aa, Mycobacterium tuberculosis
FLRTYRVWR

SEQ ID NO: 42457 - protein, 9 aa, Mycobacterium tuberculosis
LRTYRVWRA

SEQ ID NO: 42458 - protein, 9 aa, Mycobacterium tuberculosis
RTYRVWRAE

SEQ ID NO: 42459 - protein, 9 aa, Mycobacterium tuberculosis
TYRVWRAEG

SEQ ID NO: 42460 - protein, 9 aa, Mycobacterium tuberculosis
YRVWRAEGT

SEQ ID NO: 42461 - protein, 9 aa, Mycobacterium tuberculosis
RVWRAEGTW

SEQ ID NO: 42462 - protein, 9 aa, Mycobacterium tuberculosis
VWRAEGTWW

SEQ ID NO: 42463 - protein, 9 aa, Mycobacterium tuberculosis
WRAEGTWWG

SEQ ID NO: 42464 - protein, 9 aa, Mycobacterium tuberculosis
RAEGTWWGW

SEQ ID NO: 42465 - protein, 9 aa, Mycobacterium tuberculosis
AEGTWWGWH

SEQ ID NO: 42466 - protein, 9 aa, Mycobacterium tuberculosis
EGTWWGWHG

SEQ ID NO: 42467 - protein, 9 aa, Mycobacterium tuberculosis
GTWWGWHGA

SEQ ID NO: 42468 - protein, 9 aa, Mycobacterium tuberculosis
TWWGWHGAG

SEQ ID NO: 42469 - protein, 9 aa, Mycobacterium tuberculosis
WWGWHGAGW

SEQ ID NO: 42470 - protein, 9 aa, Mycobacterium tuberculosis
WGWHGAGWF

SEQ ID NO: 42471 - protein, 9 aa, Mycobacterium tuberculosis
GWHGAGWFL

SEQ ID NO: 42472 - protein, 9 aa, Mycobacterium tuberculosis
WHGAGWFLL

SEQ ID NO: 42473 - protein, 9 aa, Mycobacterium tuberculosis
HGAGWFLLT

SEQ ID NO: 42474 - protein, 9 aa, Mycobacterium tuberculosis
GAGWFLLTL

SEQ ID NO: 42475 - protein, 9 aa, Mycobacterium tuberculosis
AGWFLLTLM

SEQ ID NO: 42476 - protein, 9 aa, Mycobacterium tuberculosis
GWFLLTLMV

SEQ ID NO: 42477 - protein, 9 aa, Mycobacterium tuberculosis
WFLLTLMVL

SEQ ID NO: 42478 - protein, 9 aa, Mycobacterium tuberculosis
FLLTLMVLT

SEQ ID NO: 42479 - protein, 9 aa, Mycobacterium tuberculosis
LLTLMVLTL

SEQ ID NO: 42480 - protein, 9 aa, Mycobacterium tuberculosis
LTLMVLTLC

SEQ ID NO: 42481 - protein, 9 aa, Mycobacterium tuberculosis
TLMVLTLCI

SEQ ID NO: 42482 - protein, 9 aa, Mycobacterium tuberculosis
LMVLTLCIG

SEQ ID NO: 42483 - protein, 9 aa, Mycobacterium tuberculosis
MVLTLCIGV

SEQ ID NO: 42484 - protein, 9 aa, Mycobacterium tuberculosis
VLTLCIGVP

SEQ ID NO: 42485 - protein, 9 aa, Mycobacterium tuberculosis
LTLCIGVPP

SEQ ID NO: 42486 - protein, 9 aa, Mycobacterium tuberculosis
TLCIGVPPI

SEQ ID NO: 42487 - protein, 9 aa, Mycobacterium tuberculosis
LCIGVPPIA

SEQ ID NO: 42488 - protein, 9 aa, Mycobacterium tuberculosis
CIGVPPIAG

SEQ ID NO: 42489 - protein, 9 aa, Mycobacterium tuberculosis
IGVPPIAGP

SEQ ID NO: 42490 - protein, 9 aa, Mycobacterium tuberculosis
GVPPIAGPV

SEQ ID NO: 42491 - protein, 9 aa, Mycobacterium tuberculosis
VPPIAGPVM

SEQ ID NO: 42492 - protein, 9 aa, Mycobacterium tuberculosis
PPIAGPVMA

SEQ ID NO: 42493 - protein, 9 aa, Mycobacterium tuberculosis
PIAGPVMAP

SEQ ID NO: 42494 - protein, 10 aa, Mycobacterium tuberculosis
MHEVGGPSRG

SEQ ID NO: 42495 - protein, 10 aa, Mycobacterium tuberculosis
HEVGGPSRGD

SEQ ID NO: 42496 - protein, 10 aa, Mycobacterium tuberculosis
EVGGPSRGDR

SEQ ID NO: 42497 - protein, 10 aa, Mycobacterium tuberculosis
VGGPSRGDRL

SEQ ID NO: 42498 - protein, 10 aa, Mycobacterium tuberculosis
GGPSRGDRLG

SEQ ID NO: 42499 - protein, 10 aa, Mycobacterium tuberculosis
GPSRGDRLGR

SEQ ID NO: 42500 - protein, 10 aa, Mycobacterium tuberculosis
PSRGDRLGRD

SEQ ID NO: 42501 - protein, 10 aa, Mycobacterium tuberculosis
SRGDRLGRDD

SEQ ID NO: 42502 - protein, 10 aa, Mycobacterium tuberculosis
RGDRLGRDDS

SEQ ID NO: 42503 - protein, 10 aa, Mycobacterium tuberculosis
GDRLGRDDSE

SEQ ID NO: 42504 - protein, 10 aa, Mycobacterium tuberculosis
DRLGRDDSEV

SEQ ID NO: 42505 - protein, 10 aa, Mycobacterium tuberculosis
RLGRDDSEVH

SEQ ID NO: 42506 - protein, 10 aa, Mycobacterium tuberculosis
LGRDDSEVHS

SEQ ID NO: 42507 - protein, 10 aa, Mycobacterium tuberculosis
GRDDSEVHSA

SEQ ID NO: 42508 - protein, 10 aa, Mycobacterium tuberculosis
RDDSEVHSAI

SEQ ID NO: 42509 - protein, 10 aa, Mycobacterium tuberculosis
DDSEVHSAIR

SEQ ID NO: 42510 - protein, 10 aa, Mycobacterium tuberculosis
DSEVHSAIRF

SEQ ID NO: 42511 - protein, 10 aa, Mycobacterium tuberculosis
SEVHSAIRFA

SEQ ID NO: 42512 - protein, 10 aa, Mycobacterium tuberculosis
EVHSAIRFAV

SEQ ID NO: 42513 - protein, 10 aa, Mycobacterium tuberculosis
VHSAIRFAVV

SEQ ID NO: 42514 - protein, 10 aa, Mycobacterium tuberculosis
HSAIRFAVVA

SEQ ID NO: 42515 - protein, 10 aa, Mycobacterium tuberculosis
SAIRFAVVAA

SEQ ID NO: 42516 - protein, 10 aa, Mycobacterium tuberculosis
AIRFAVVAAV

SEQ ID NO: 42517 - protein, 10 aa, Mycobacterium tuberculosis
IRFAVVAAVV

SEQ ID NO: 42518 - protein, 10 aa, Mycobacterium tuberculosis
RFAVVAAVVG

SEQ ID NO: 42519 - protein, 10 aa, Mycobacterium tuberculosis
FAVVAAVVGV

SEQ ID NO: 42520 - protein, 10 aa, Mycobacterium tuberculosis
AVVAAVVGVG

SEQ ID NO: 42521 - protein, 10 aa, Mycobacterium tuberculosis
VVAAVVGVGF

SEQ ID NO: 42522 - protein, 10 aa, Mycobacterium tuberculosis
VAAVVGVGFL

SEQ ID NO: 42523 - protein, 10 aa, Mycobacterium tuberculosis
AAVVGVGFLI

SEQ ID NO: 42524 - protein, 10 aa, Mycobacterium tuberculosis
AVVGVGFLIM

SEQ ID NO: 42525 - protein, 10 aa, Mycobacterium tuberculosis
VVGVGFLIMG

SEQ ID NO: 42526 - protein, 10 aa, Mycobacterium tuberculosis
VGVGFLIMGA

SEQ ID NO: 42527 - protein, 10 aa, Mycobacterium tuberculosis
GVGFLIMGAL

SEQ ID NO: 42528 - protein, 10 aa, Mycobacterium tuberculosis
VGFLIMGALL

SEQ ID NO: 42529 - protein, 10 aa, Mycobacterium tuberculosis
GFLIMGALLV

SEQ ID NO: 42530 - protein, 10 aa, Mycobacterium tuberculosis
FLIMGALLVS

SEQ ID NO: 42531 - protein, 10 aa, Mycobacterium tuberculosis
LIMGALLVST

SEQ ID NO: 42532 - protein, 10 aa, Mycobacterium tuberculosis
IMGALLVSTC

SEQ ID NO: 42533 - protein, 10 aa, Mycobacterium tuberculosis
MGALLVSTCS

SEQ ID NO: 42534 - protein, 10 aa, Mycobacterium tuberculosis
GALLVSTCSG

SEQ ID NO: 42535 - protein, 10 aa, Mycobacterium tuberculosis
ALLVSTCSGV

SEQ ID NO: 42536 - protein, 10 aa, Mycobacterium tuberculosis
LLVSTCSGVD

SEQ ID NO: 42537 - protein, 10 aa, Mycobacterium tuberculosis
LVSTCSGVDT

SEQ ID NO: 42538 - protein, 10 aa, Mycobacterium tuberculosis
VSTCSGVDTA

SEQ ID NO: 42539 - protein, 10 aa, Mycobacterium tuberculosis
STCSGVDTAA

SEQ ID NO: 42540 - protein, 10 aa, Mycobacterium tuberculosis
TCSGVDTAAC

SEQ ID NO: 42541 - protein, 10 aa, Mycobacterium tuberculosis
CSGVDTAACG

SEQ ID NO: 42542 - protein, 10 aa, Mycobacterium tuberculosis
SGVDTAACGP

SEQ ID NO: 42543 - protein, 10 aa, Mycobacterium tuberculosis
GVDTAACGPP

SEQ ID NO: 42544 - protein, 10 aa, Mycobacterium tuberculosis
VDTAACGPPQ

SEQ ID NO: 42545 - protein, 10 aa, Mycobacterium tuberculosis
DTAACGPPQR

SEQ ID NO: 42546 - protein, 10 aa, Mycobacterium tuberculosis
TAACGPPQRI

SEQ ID NO: 42547 - protein, 10 aa, Mycobacterium tuberculosis
AACGPPQRIL

SEQ ID NO: 42548 - protein, 10 aa, Mycobacterium tuberculosis
ACGPPQRILL

SEQ ID NO: 42549 - protein, 10 aa, Mycobacterium tuberculosis
CGPPQRILLA

SEQ ID NO: 42550 - protein, 10 aa, Mycobacterium tuberculosis
GPPQRILLAL

SEQ ID NO: 42551 - protein, 10 aa, Mycobacterium tuberculosis
PPQRILLALG

SEQ ID NO: 42552 - protein, 10 aa, Mycobacterium tuberculosis
PQRILLALGG

SEQ ID NO: 42553 - protein, 10 aa, Mycobacterium tuberculosis
QRILLALGGP

SEQ ID NO: 42554 - protein, 10 aa, Mycobacterium tuberculosis
RILLALGGPL

SEQ ID NO: 42555 - protein, 10 aa, Mycobacterium tuberculosis
ILLALGGPLI

SEQ ID NO: 42556 - protein, 10 aa, Mycobacterium tuberculosis
LLALGGPLIL

SEQ ID NO: 42557 - protein, 10 aa, Mycobacterium tuberculosis
LALGGPLILC

SEQ ID NO: 42558 - protein, 10 aa, Mycobacterium tuberculosis
ALGGPLILCA

SEQ ID NO: 42559 - protein, 10 aa, Mycobacterium tuberculosis
LGGPLILCAA

SEQ ID NO: 42560 - protein, 10 aa, Mycobacterium tuberculosis
GGPLILCAAG

SEQ ID NO: 42561 - protein, 10 aa, Mycobacterium tuberculosis
GPLILCAAGL

SEQ ID NO: 42562 - protein, 10 aa, Mycobacterium tuberculosis
PLILCAAGLW

SEQ ID NO: 42563 - protein, 10 aa, Mycobacterium tuberculosis
LILCAAGLWA

SEQ ID NO: 42564 - protein, 10 aa, Mycobacterium tuberculosis
ILCAAGLWAF

SEQ ID NO: 42565 - protein, 10 aa, Mycobacterium tuberculosis
LCAAGLWAFL

SEQ ID NO: 42566 - protein, 10 aa, Mycobacterium tuberculosis
CAAGLWAFLR

SEQ ID NO: 42567 - protein, 10 aa, Mycobacterium tuberculosis
AAGLWAFLRT

SEQ ID NO: 42568 - protein, 10 aa, Mycobacterium tuberculosis
AGLWAFLRTY

SEQ ID NO: 42569 - protein, 10 aa, Mycobacterium tuberculosis
GLWAFLRTYR

SEQ ID NO: 42570 - protein, 10 aa, Mycobacterium tuberculosis
LWAFLRTYRV

SEQ ID NO: 42571 - protein, 10 aa, Mycobacterium tuberculosis
WAFLRTYRVW

SEQ ID NO: 42572 - protein, 10 aa, Mycobacterium tuberculosis
AFLRTYRVWR

SEQ ID NO: 42573 - protein, 10 aa, Mycobacterium tuberculosis
FLRTYRVWRA

SEQ ID NO: 42574 - protein, 10 aa, Mycobacterium tuberculosis
LRTYRVWRAE

SEQ ID NO: 42575 - protein, 10 aa, Mycobacterium tuberculosis
RTYRVWRAEG

SEQ ID NO: 42576 - protein, 10 aa, Mycobacterium tuberculosis
TYRVWRAEGT

SEQ ID NO: 42577 - protein, 10 aa, Mycobacterium tuberculosis
YRVWRAEGTW

SEQ ID NO: 42578 - protein, 10 aa, Mycobacterium tuberculosis
RVWRAEGTWW

SEQ ID NO: 42579 - protein, 10 aa, Mycobacterium tuberculosis
VWRAEGTWWG

SEQ ID NO: 42580 - protein, 10 aa, Mycobacterium tuberculosis
WRAEGTWWGW

SEQ ID NO: 42581 - protein, 10 aa, Mycobacterium tuberculosis
RAEGTWWGWH

SEQ ID NO: 42582 - protein, 10 aa, Mycobacterium tuberculosis
AEGTWWGWHG

SEQ ID NO: 42583 - protein, 10 aa, Mycobacterium tuberculosis
EGTWWGWHGA

SEQ ID NO: 42584 - protein, 10 aa, Mycobacterium tuberculosis
GTWWGWHGAG

SEQ ID NO: 42585 - protein, 10 aa, Mycobacterium tuberculosis
TWWGWHGAGW

SEQ ID NO: 42586 - protein, 10 aa, Mycobacterium tuberculosis
WWGWHGAGWF

SEQ ID NO: 42587 - protein, 10 aa, Mycobacterium tuberculosis
WGWHGAGWFL

SEQ ID NO: 42588 - protein, 10 aa, Mycobacterium tuberculosis
GWHGAGWFLL

SEQ ID NO: 42589 - protein, 10 aa, Mycobacterium tuberculosis
WHGAGWFLLT

SEQ ID NO: 42590 - protein, 10 aa, Mycobacterium tuberculosis
HGAGWFLLTL

SEQ ID NO: 42591 - protein, 10 aa, Mycobacterium tuberculosis
GAGWFLLTLM

SEQ ID NO: 42592 - protein, 10 aa, Mycobacterium tuberculosis
AGWFLLTLMV

SEQ ID NO: 42593 - protein, 10 aa, Mycobacterium tuberculosis
GWFLLTLMVL

SEQ ID NO: 42594 - protein, 10 aa, Mycobacterium tuberculosis
WFLLTLMVLT

SEQ ID NO: 42595 - protein, 10 aa, Mycobacterium tuberculosis
FLLTLMVLTL

SEQ ID NO: 42596 - protein, 10 aa, Mycobacterium tuberculosis
LLTLMVLTLC

SEQ ID NO: 42597 - protein, 10 aa, Mycobacterium tuberculosis
LTLMVLTLCI

SEQ ID NO: 42598 - protein, 10 aa, Mycobacterium tuberculosis
TLMVLTLCIG

SEQ ID NO: 42599 - protein, 10 aa, Mycobacterium tuberculosis
LMVLTLCIGV

SEQ ID NO: 42600 - protein, 10 aa, Mycobacterium tuberculosis
MVLTLCIGVP

SEQ ID NO: 42601 - protein, 10 aa, Mycobacterium tuberculosis
VLTLCIGVPP

SEQ ID NO: 42602 - protein, 10 aa, Mycobacterium tuberculosis
LTLCIGVPPI

SEQ ID NO: 42603 - protein, 10 aa, Mycobacterium tuberculosis
TLCIGVPPIA

SEQ ID NO: 42604 - protein, 10 aa, Mycobacterium tuberculosis
LCIGVPPIAG

SEQ ID NO: 42605 - protein, 10 aa, Mycobacterium tuberculosis
CIGVPPIAGP

SEQ ID NO: 42606 - protein, 10 aa, Mycobacterium tuberculosis
IGVPPIAGPV

SEQ ID NO: 42607 - protein, 10 aa, Mycobacterium tuberculosis
GVPPIAGPVM

SEQ ID NO: 42608 - protein, 10 aa, Mycobacterium tuberculosis
VPPIAGPVMA

SEQ ID NO: 42609 - protein, 10 aa, Mycobacterium tuberculosis
PPIAGPVMAP

SEQ ID NO: 42610 - protein, 11 aa, Mycobacterium tuberculosis
MHEVGGPSRGD

SEQ ID NO: 42611 - protein, 11 aa, Mycobacterium tuberculosis
HEVGGPSRGDR

SEQ ID NO: 42612 - protein, 11 aa, Mycobacterium tuberculosis
EVGGPSRGDRL

SEQ ID NO: 42613 - protein, 11 aa, Mycobacterium tuberculosis
VGGPSRGDRLG

SEQ ID NO: 42614 - protein, 11 aa, Mycobacterium tuberculosis
GGPSRGDRLGR

SEQ ID NO: 42615 - protein, 11 aa, Mycobacterium tuberculosis
GPSRGDRLGRD

SEQ ID NO: 42616 - protein, 11 aa, Mycobacterium tuberculosis
PSRGDRLGRDD

SEQ ID NO: 42617 - protein, 11 aa, Mycobacterium tuberculosis
SRGDRLGRDDS

SEQ ID NO: 42618 - protein, 11 aa, Mycobacterium tuberculosis
RGDRLGRDDSE

SEQ ID NO: 42619 - protein, 11 aa, Mycobacterium tuberculosis
GDRLGRDDSEV

SEQ ID NO: 42620 - protein, 11 aa, Mycobacterium tuberculosis
DRLGRDDSEVH

SEQ ID NO: 42621 - protein, 11 aa, Mycobacterium tuberculosis
RLGRDDSEVHS

SEQ ID NO: 42622 - protein, 11 aa, Mycobacterium tuberculosis
LGRDDSEVHSA

SEQ ID NO: 42623 - protein, 11 aa, Mycobacterium tuberculosis
GRDDSEVHSAI

SEQ ID NO: 42624 - protein, 11 aa, Mycobacterium tuberculosis
RDDSEVHSAIR

SEQ ID NO: 42625 - protein, 11 aa, Mycobacterium tuberculosis
DDSEVHSAIRF

SEQ ID NO: 42626 - protein, 11 aa, Mycobacterium tuberculosis
DSEVHSAIRFA

SEQ ID NO: 42627 - protein, 11 aa, Mycobacterium tuberculosis
SEVHSAIRFAV

SEQ ID NO: 42628 - protein, 11 aa, Mycobacterium tuberculosis
EVHSAIRFAVV

SEQ ID NO: 42629 - protein, 11 aa, Mycobacterium tuberculosis
VHSAIRFAVVA

SEQ ID NO: 42630 - protein, 11 aa, Mycobacterium tuberculosis
HSAIRFAVVAA

SEQ ID NO: 42631 - protein, 11 aa, Mycobacterium tuberculosis
SAIRFAVVAAV

SEQ ID NO: 42632 - protein, 11 aa, Mycobacterium tuberculosis
AIRFAVVAAVV

SEQ ID NO: 42633 - protein, 11 aa, Mycobacterium tuberculosis
IRFAVVAAVVG

SEQ ID NO: 42634 - protein, 11 aa, Mycobacterium tuberculosis
RFAVVAAVVGV

SEQ ID NO: 42635 - protein, 11 aa, Mycobacterium tuberculosis
FAVVAAVVGVG

SEQ ID NO: 42636 - protein, 11 aa, Mycobacterium tuberculosis
AVVAAVVGVGF

SEQ ID NO: 42637 - protein, 11 aa, Mycobacterium tuberculosis
VVAAVVGVGFL

SEQ ID NO: 42638 - protein, 11 aa, Mycobacterium tuberculosis
VAAVVGVGFLI

SEQ ID NO: 42639 - protein, 11 aa, Mycobacterium tuberculosis
AAVVGVGFLIM

SEQ ID NO: 42640 - protein, 11 aa, Mycobacterium tuberculosis
AVVGVGFLIMG

SEQ ID NO: 42641 - protein, 11 aa, Mycobacterium tuberculosis
VVGVGFLIMGA

SEQ ID NO: 42642 - protein, 11 aa, Mycobacterium tuberculosis
VGVGFLIMGAL

SEQ ID NO: 42643 - protein, 11 aa, Mycobacterium tuberculosis
GVGFLIMGALL

SEQ ID NO: 42644 - protein, 11 aa, Mycobacterium tuberculosis
VGFLIMGALLV

SEQ ID NO: 42645 - protein, 11 aa, Mycobacterium tuberculosis
GFLIMGALLVS

SEQ ID NO: 42646 - protein, 11 aa, Mycobacterium tuberculosis
FLIMGALLVST

SEQ ID NO: 42647 - protein, 11 aa, Mycobacterium tuberculosis
LIMGALLVSTC

SEQ ID NO: 42648 - protein, 11 aa, Mycobacterium tuberculosis
IMGALLVSTCS

SEQ ID NO: 42649 - protein, 11 aa, Mycobacterium tuberculosis
MGALLVSTCSG

SEQ ID NO: 42650 - protein, 11 aa, Mycobacterium tuberculosis
GALLVSTCSGV

SEQ ID NO: 42651 - protein, 11 aa, Mycobacterium tuberculosis
ALLVSTCSGVD

SEQ ID NO: 42652 - protein, 11 aa, Mycobacterium tuberculosis
LLVSTCSGVDT

SEQ ID NO: 42653 - protein, 11 aa, Mycobacterium tuberculosis
LVSTCSGVDTA

SEQ ID NO: 42654 - protein, 11 aa, Mycobacterium tuberculosis
VSTCSGVDTAA

SEQ ID NO: 42655 - protein, 11 aa, Mycobacterium tuberculosis
STCSGVDTAAC

SEQ ID NO: 42656 - protein, 11 aa, Mycobacterium tuberculosis
TCSGVDTAACG

SEQ ID NO: 42657 - protein, 11 aa, Mycobacterium tuberculosis
CSGVDTAACGP

SEQ ID NO: 42658 - protein, 11 aa, Mycobacterium tuberculosis
SGVDTAACGPP

SEQ ID NO: 42659 - protein, 11 aa, Mycobacterium tuberculosis
GVDTAACGPPQ

SEQ ID NO: 42660 - protein, 11 aa, Mycobacterium tuberculosis
VDTAACGPPQR

SEQ ID NO: 42661 - protein, 11 aa, Mycobacterium tuberculosis
DTAACGPPQRI

SEQ ID NO: 42662 - protein, 11 aa, Mycobacterium tuberculosis
TAACGPPQRIL

SEQ ID NO: 42663 - protein, 11 aa, Mycobacterium tuberculosis
AACGPPQRILL

SEQ ID NO: 42664 - protein, 11 aa, Mycobacterium tuberculosis
ACGPPQRILLA

SEQ ID NO: 42665 - protein, 11 aa, Mycobacterium tuberculosis
CGPPQRILLAL

SEQ ID NO: 42666 - protein, 11 aa, Mycobacterium tuberculosis
GPPQRILLALG

SEQ ID NO: 42667 - protein, 11 aa, Mycobacterium tuberculosis
PPQRILLALGG

SEQ ID NO: 42668 - protein, 11 aa, Mycobacterium tuberculosis
PQRILLALGGP

SEQ ID NO: 42669 - protein, 11 aa, Mycobacterium tuberculosis
QRILLALGGPL

SEQ ID NO: 42670 - protein, 11 aa, Mycobacterium tuberculosis
RILLALGGPLI

SEQ ID NO: 42671 - protein, 11 aa, Mycobacterium tuberculosis
ILLALGGPLIL

SEQ ID NO: 42672 - protein, 11 aa, Mycobacterium tuberculosis
LLALGGPLILC

SEQ ID NO: 42673 - protein, 11 aa, Mycobacterium tuberculosis
LALGGPLILCA

SEQ ID NO: 42674 - protein, 11 aa, Mycobacterium tuberculosis
ALGGPLILCAA

SEQ ID NO: 42675 - protein, 11 aa, Mycobacterium tuberculosis
LGGPLILCAAG

SEQ ID NO: 42676 - protein, 11 aa, Mycobacterium tuberculosis
GGPLILCAAGL

SEQ ID NO: 42677 - protein, 11 aa, Mycobacterium tuberculosis
GPLILCAAGLW

SEQ ID NO: 42678 - protein, 11 aa, Mycobacterium tuberculosis
PLILCAAGLWA

SEQ ID NO: 42679 - protein, 11 aa, Mycobacterium tuberculosis
LILCAAGLWAF

SEQ ID NO: 42680 - protein, 11 aa, Mycobacterium tuberculosis
ILCAAGLWAFL

SEQ ID NO: 42681 - protein, 11 aa, Mycobacterium tuberculosis
LCAAGLWAFLR

SEQ ID NO: 42682 - protein, 11 aa, Mycobacterium tuberculosis
CAAGLWAFLRT

SEQ ID NO: 42683 - protein, 11 aa, Mycobacterium tuberculosis
AAGLWAFLRTY

SEQ ID NO: 42684 - protein, 11 aa, Mycobacterium tuberculosis
AGLWAFLRTYR

SEQ ID NO: 42685 - protein, 11 aa, Mycobacterium tuberculosis
GLWAFLRTYRV

SEQ ID NO: 42686 - protein, 11 aa, Mycobacterium tuberculosis
LWAFLRTYRVW

SEQ ID NO: 42687 - protein, 11 aa, Mycobacterium tuberculosis
WAFLRTYRVWR

SEQ ID NO: 42688 - protein, 11 aa, Mycobacterium tuberculosis
AFLRTYRVWRA

SEQ ID NO: 42689 - protein, 11 aa, Mycobacterium tuberculosis
FLRTYRVWRAE

SEQ ID NO: 42690 - protein, 11 aa, Mycobacterium tuberculosis
LRTYRVWRAEG

SEQ ID NO: 42691 - protein, 11 aa, Mycobacterium tuberculosis
RTYRVWRAEGT

SEQ ID NO: 42692 - protein, 11 aa, Mycobacterium tuberculosis
TYRVWRAEGTW

SEQ ID NO: 42693 - protein, 11 aa, Mycobacterium tuberculosis
YRVWRAEGTWW

SEQ ID NO: 42694 - protein, 11 aa, Mycobacterium tuberculosis
RVWRAEGTWWG

SEQ ID NO: 42695 - protein, 11 aa, Mycobacterium tuberculosis
VWRAEGTWWGW

SEQ ID NO: 42696 - protein, 11 aa, Mycobacterium tuberculosis
WRAEGTWWGWH

SEQ ID NO: 42697 - protein, 11 aa, Mycobacterium tuberculosis
RAEGTWWGWHG

SEQ ID NO: 42698 - protein, 11 aa, Mycobacterium tuberculosis
AEGTWWGWHGA

SEQ ID NO: 42699 - protein, 11 aa, Mycobacterium tuberculosis
EGTWWGWHGAG

SEQ ID NO: 42700 - protein, 11 aa, Mycobacterium tuberculosis
GTWWGWHGAGW

SEQ ID NO: 42701 - protein, 11 aa, Mycobacterium tuberculosis
TWWGWHGAGWF

SEQ ID NO: 42702 - protein, 11 aa, Mycobacterium tuberculosis
WWGWHGAGWFL

SEQ ID NO: 42703 - protein, 11 aa, Mycobacterium tuberculosis
WGWHGAGWFLL

SEQ ID NO: 42704 - protein, 11 aa, Mycobacterium tuberculosis
GWHGAGWFLLT

SEQ ID NO: 42705 - protein, 11 aa, Mycobacterium tuberculosis
WHGAGWFLLTL

SEQ ID NO: 42706 - protein, 11 aa, Mycobacterium tuberculosis
HGAGWFLLTLM

SEQ ID NO: 42707 - protein, 11 aa, Mycobacterium tuberculosis
GAGWFLLTLMV

SEQ ID NO: 42708 - protein, 11 aa, Mycobacterium tuberculosis
AGWFLLTLMVL

SEQ ID NO: 42709 - protein, 11 aa, Mycobacterium tuberculosis
GWFLLTLMVLT

SEQ ID NO: 42710 - protein, 11 aa, Mycobacterium tuberculosis
WFLLTLMVLTL

SEQ ID NO: 42711 - protein, 11 aa, Mycobacterium tuberculosis
FLLTLMVLTLC

SEQ ID NO: 42712 - protein, 11 aa, Mycobacterium tuberculosis
LLTLMVLTLCI

SEQ ID NO: 42713 - protein, 11 aa, Mycobacterium tuberculosis
LTLMVLTLCIG

SEQ ID NO: 42714 - protein, 11 aa, Mycobacterium tuberculosis
TLMVLTLCIGV

SEQ ID NO: 42715 - protein, 11 aa, Mycobacterium tuberculosis
LMVLTLCIGVP

SEQ ID NO: 42716 - protein, 11 aa, Mycobacterium tuberculosis
MVLTLCIGVPP

SEQ ID NO: 42717 - protein, 11 aa, Mycobacterium tuberculosis
VLTLCIGVPPI

SEQ ID NO: 42718 - protein, 11 aa, Mycobacterium tuberculosis
LTLCIGVPPIA

SEQ ID NO: 42719 - protein, 11 aa, Mycobacterium tuberculosis
TLCIGVPPIAG

SEQ ID NO: 42720 - protein, 11 aa, Mycobacterium tuberculosis
LCIGVPPIAGP

SEQ ID NO: 42721 - protein, 11 aa, Mycobacterium tuberculosis
CIGVPPIAGPV

SEQ ID NO: 42722 - protein, 11 aa, Mycobacterium tuberculosis
IGVPPIAGPVM

SEQ ID NO: 42723 - protein, 11 aa, Mycobacterium tuberculosis
GVPPIAGPVMA

SEQ ID NO: 42724 - protein, 11 aa, Mycobacterium tuberculosis
VPPIAGPVMAP

SEQ ID NO: 42725 - protein, 8 aa, Mycobacterium tuberculosis
MAAVVKSV

SEQ ID NO: 42726 - protein, 8 aa, Mycobacterium tuberculosis
AAVVKSVA

SEQ ID NO: 42727 - protein, 8 aa, Mycobacterium tuberculosis
AVVKSVAL

SEQ ID NO: 42728 - protein, 8 aa, Mycobacterium tuberculosis
VVKSVALA

SEQ ID NO: 42729 - protein, 8 aa, Mycobacterium tuberculosis
VKSVALAG

SEQ ID NO: 42730 - protein, 8 aa, Mycobacterium tuberculosis
KSVALAGR

SEQ ID NO: 42731 - protein, 8 aa, Mycobacterium tuberculosis
SVALAGRP

SEQ ID NO: 42732 - protein, 8 aa, Mycobacterium tuberculosis
VALAGRPT

SEQ ID NO: 42733 - protein, 8 aa, Mycobacterium tuberculosis
ALAGRPTT

SEQ ID NO: 42734 - protein, 8 aa, Mycobacterium tuberculosis
LAGRPTTP

SEQ ID NO: 42735 - protein, 8 aa, Mycobacterium tuberculosis
AGRPTTPD

SEQ ID NO: 42736 - protein, 8 aa, Mycobacterium tuberculosis
GRPTTPDR

SEQ ID NO: 42737 - protein, 8 aa, Mycobacterium tuberculosis
RPTTPDRV

SEQ ID NO: 42738 - protein, 8 aa, Mycobacterium tuberculosis
PTTPDRVH

SEQ ID NO: 42739 - protein, 8 aa, Mycobacterium tuberculosis
TTPDRVHE

SEQ ID NO: 42740 - protein, 8 aa, Mycobacterium tuberculosis
TPDRVHEV

SEQ ID NO: 42741 - protein, 8 aa, Mycobacterium tuberculosis
PDRVHEVL

SEQ ID NO: 42742 - protein, 8 aa, Mycobacterium tuberculosis
DRVHEVLG

SEQ ID NO: 42743 - protein, 8 aa, Mycobacterium tuberculosis
RVHEVLGR

SEQ ID NO: 42744 - protein, 8 aa, Mycobacterium tuberculosis
VHEVLGRS

SEQ ID NO: 42745 - protein, 8 aa, Mycobacterium tuberculosis
HEVLGRSM

SEQ ID NO: 42746 - protein, 8 aa, Mycobacterium tuberculosis
EVLGRSML

SEQ ID NO: 42747 - protein, 8 aa, Mycobacterium tuberculosis
VLGRSMLV

SEQ ID NO: 42748 - protein, 8 aa, Mycobacterium tuberculosis
LGRSMLVD

SEQ ID NO: 42749 - protein, 8 aa, Mycobacterium tuberculosis
GRSMLVDG

SEQ ID NO: 42750 - protein, 8 aa, Mycobacterium tuberculosis
RSMLVDGL

SEQ ID NO: 42751 - protein, 8 aa, Mycobacterium tuberculosis
SMLVDGLD

SEQ ID NO: 42752 - protein, 8 aa, Mycobacterium tuberculosis
MLVDGLDI

SEQ ID NO: 42753 - protein, 8 aa, Mycobacterium tuberculosis
LVDGLDIV

SEQ ID NO: 42754 - protein, 8 aa, Mycobacterium tuberculosis
VDGLDIVL

SEQ ID NO: 42755 - protein, 8 aa, Mycobacterium tuberculosis
DGLDIVLD

SEQ ID NO: 42756 - protein, 8 aa, Mycobacterium tuberculosis
GLDIVLDL

SEQ ID NO: 42757 - protein, 8 aa, Mycobacterium tuberculosis
LDIVLDLT

SEQ ID NO: 42758 - protein, 8 aa, Mycobacterium tuberculosis
DIVLDLTR

SEQ ID NO: 42759 - protein, 8 aa, Mycobacterium tuberculosis
IVLDLTRS

SEQ ID NO: 42760 - protein, 8 aa, Mycobacterium tuberculosis
VLDLTRSG

SEQ ID NO: 42761 - protein, 8 aa, Mycobacterium tuberculosis
LDLTRSGG

SEQ ID NO: 42762 - protein, 8 aa, Mycobacterium tuberculosis
DLTRSGGS

SEQ ID NO: 42763 - protein, 8 aa, Mycobacterium tuberculosis
LTRSGGSY

SEQ ID NO: 42764 - protein, 8 aa, Mycobacterium tuberculosis
TRSGGSYL

SEQ ID NO: 42765 - protein, 8 aa, Mycobacterium tuberculosis
RSGGSYLV

SEQ ID NO: 42766 - protein, 8 aa, Mycobacterium tuberculosis
SGGSYLVD

SEQ ID NO: 42767 - protein, 8 aa, Mycobacterium tuberculosis
GGSYLVDA

SEQ ID NO: 42768 - protein, 8 aa, Mycobacterium tuberculosis
GSYLVDAI

SEQ ID NO: 42769 - protein, 8 aa, Mycobacterium tuberculosis
SYLVDAIT

SEQ ID NO: 42770 - protein, 8 aa, Mycobacterium tuberculosis
YLVDAITG

SEQ ID NO: 42771 - protein, 8 aa, Mycobacterium tuberculosis
LVDAITGR

SEQ ID NO: 42772 - protein, 8 aa, Mycobacterium tuberculosis
VDAITGRR

SEQ ID NO: 42773 - protein, 8 aa, Mycobacterium tuberculosis
DAITGRRY

SEQ ID NO: 42774 - protein, 8 aa, Mycobacterium tuberculosis
AITGRRYL

SEQ ID NO: 42775 - protein, 8 aa, Mycobacterium tuberculosis
ITGRRYLD

SEQ ID NO: 42776 - protein, 8 aa, Mycobacterium tuberculosis
TGRRYLDM

SEQ ID NO: 42777 - protein, 8 aa, Mycobacterium tuberculosis
GRRYLDMF

SEQ ID NO: 42778 - protein, 8 aa, Mycobacterium tuberculosis
RRYLDMFT

SEQ ID NO: 42779 - protein, 8 aa, Mycobacterium tuberculosis
RYLDMFTF

SEQ ID NO: 42780 - protein, 8 aa, Mycobacterium tuberculosis
YLDMFTFV

SEQ ID NO: 42781 - protein, 8 aa, Mycobacterium tuberculosis
LDMFTFVA

SEQ ID NO: 42782 - protein, 8 aa, Mycobacterium tuberculosis
DMFTFVAS

SEQ ID NO: 42783 - protein, 8 aa, Mycobacterium tuberculosis
MFTFVASS

SEQ ID NO: 42784 - protein, 8 aa, Mycobacterium tuberculosis
FTFVASSA

SEQ ID NO: 42785 - protein, 8 aa, Mycobacterium tuberculosis
TFVASSAL

SEQ ID NO: 42786 - protein, 8 aa, Mycobacterium tuberculosis
FVASSALG

SEQ ID NO: 42787 - protein, 8 aa, Mycobacterium tuberculosis
VASSALGM

SEQ ID NO: 42788 - protein, 8 aa, Mycobacterium tuberculosis
ASSALGMN

SEQ ID NO: 42789 - protein, 8 aa, Mycobacterium tuberculosis
SSALGMNP

SEQ ID NO: 42790 - protein, 8 aa, Mycobacterium tuberculosis
SALGMNPP

SEQ ID NO: 42791 - protein, 8 aa, Mycobacterium tuberculosis
ALGMNPPA

SEQ ID NO: 42792 - protein, 8 aa, Mycobacterium tuberculosis
LGMNPPAL

SEQ ID NO: 42793 - protein, 8 aa, Mycobacterium tuberculosis
GMNPPALV

SEQ ID NO: 42794 - protein, 8 aa, Mycobacterium tuberculosis
MNPPALVD

SEQ ID NO: 42795 - protein, 8 aa, Mycobacterium tuberculosis
NPPALVDD

SEQ ID NO: 42796 - protein, 8 aa, Mycobacterium tuberculosis
PPALVDDR

SEQ ID NO: 42797 - protein, 8 aa, Mycobacterium tuberculosis
PALVDDRE

SEQ ID NO: 42798 - protein, 8 aa, Mycobacterium tuberculosis
ALVDDREF

SEQ ID NO: 42799 - protein, 8 aa, Mycobacterium tuberculosis
LVDDREFH

SEQ ID NO: 42800 - protein, 8 aa, Mycobacterium tuberculosis
VDDREFHA

SEQ ID NO: 42801 - protein, 8 aa, Mycobacterium tuberculosis
DDREFHAE

SEQ ID NO: 42802 - protein, 8 aa, Mycobacterium tuberculosis
DREFHAEL

SEQ ID NO: 42803 - protein, 8 aa, Mycobacterium tuberculosis
REFHAELM

SEQ ID NO: 42804 - protein, 8 aa, Mycobacterium tuberculosis
EFHAELMQ

SEQ ID NO: 42805 - protein, 8 aa, Mycobacterium tuberculosis
FHAELMQA

SEQ ID NO: 42806 - protein, 8 aa, Mycobacterium tuberculosis
HAELMQAA

SEQ ID NO: 42807 - protein, 8 aa, Mycobacterium tuberculosis
AELMQAAL

SEQ ID NO: 42808 - protein, 8 aa, Mycobacterium tuberculosis
ELMQAALN

SEQ ID NO: 42809 - protein, 8 aa, Mycobacterium tuberculosis
LMQAALNK

SEQ ID NO: 42810 - protein, 8 aa, Mycobacterium tuberculosis
MQAALNKP

SEQ ID NO: 42811 - protein, 8 aa, Mycobacterium tuberculosis
QAALNKPS

SEQ ID NO: 42812 - protein, 8 aa, Mycobacterium tuberculosis
AALNKPSN

SEQ ID NO: 42813 - protein, 8 aa, Mycobacterium tuberculosis
ALNKPSNS

SEQ ID NO: 42814 - protein, 8 aa, Mycobacterium tuberculosis
LNKPSNSD

SEQ ID NO: 42815 - protein, 8 aa, Mycobacterium tuberculosis
NKPSNSDV

SEQ ID NO: 42816 - protein, 8 aa, Mycobacterium tuberculosis
KPSNSDVY

SEQ ID NO: 42817 - protein, 8 aa, Mycobacterium tuberculosis
PSNSDVYS

SEQ ID NO: 42818 - protein, 8 aa, Mycobacterium tuberculosis
SNSDVYSV

SEQ ID NO: 42819 - protein, 8 aa, Mycobacterium tuberculosis
NSDVYSVA

SEQ ID NO: 42820 - protein, 8 aa, Mycobacterium tuberculosis
SDVYSVAM

SEQ ID NO: 42821 - protein, 8 aa, Mycobacterium tuberculosis
DVYSVAMA

SEQ ID NO: 42822 - protein, 8 aa, Mycobacterium tuberculosis
VYSVAMAR

SEQ ID NO: 42823 - protein, 8 aa, Mycobacterium tuberculosis
YSVAMARF

SEQ ID NO: 42824 - protein, 8 aa, Mycobacterium tuberculosis
SVAMARFV

SEQ ID NO: 42825 - protein, 8 aa, Mycobacterium tuberculosis
VAMARFVE

SEQ ID NO: 42826 - protein, 8 aa, Mycobacterium tuberculosis
AMARFVET

SEQ ID NO: 42827 - protein, 8 aa, Mycobacterium tuberculosis
MARFVETF

SEQ ID NO: 42828 - protein, 8 aa, Mycobacterium tuberculosis
ARFVETFA

SEQ ID NO: 42829 - protein, 8 aa, Mycobacterium tuberculosis
RFVETFAR

SEQ ID NO: 42830 - protein, 8 aa, Mycobacterium tuberculosis
FVETFARV

SEQ ID NO: 42831 - protein, 8 aa, Mycobacterium tuberculosis
VETFARVL

SEQ ID NO: 42832 - protein, 8 aa, Mycobacterium tuberculosis
ETFARVLG

SEQ ID NO: 42833 - protein, 8 aa, Mycobacterium tuberculosis
TFARVLGD

SEQ ID NO: 42834 - protein, 8 aa, Mycobacterium tuberculosis
FARVLGDP

SEQ ID NO: 42835 - protein, 8 aa, Mycobacterium tuberculosis
ARVLGDPA

SEQ ID NO: 42836 - protein, 8 aa, Mycobacterium tuberculosis
RVLGDPAL

SEQ ID NO: 42837 - protein, 8 aa, Mycobacterium tuberculosis
VLGDPALP

SEQ ID NO: 42838 - protein, 8 aa, Mycobacterium tuberculosis
LGDPALPH

SEQ ID NO: 42839 - protein, 8 aa, Mycobacterium tuberculosis
GDPALPHL

SEQ ID NO: 42840 - protein, 8 aa, Mycobacterium tuberculosis
DPALPHLF

SEQ ID NO: 42841 - protein, 8 aa, Mycobacterium tuberculosis
PALPHLFF

SEQ ID NO: 42842 - protein, 8 aa, Mycobacterium tuberculosis
ALPHLFFV

SEQ ID NO: 42843 - protein, 8 aa, Mycobacterium tuberculosis
LPHLFFVE

SEQ ID NO: 42844 - protein, 8 aa, Mycobacterium tuberculosis
PHLFFVEG

SEQ ID NO: 42845 - protein, 8 aa, Mycobacterium tuberculosis
HLFFVEGG

SEQ ID NO: 42846 - protein, 8 aa, Mycobacterium tuberculosis
LFFVEGGA

SEQ ID NO: 42847 - protein, 8 aa, Mycobacterium tuberculosis
FFVEGGAL

SEQ ID NO: 42848 - protein, 8 aa, Mycobacterium tuberculosis
FVEGGALA

SEQ ID NO: 42849 - protein, 8 aa, Mycobacterium tuberculosis
VEGGALAV

SEQ ID NO: 42850 - protein, 8 aa, Mycobacterium tuberculosis
EGGALAVE

SEQ ID NO: 42851 - protein, 8 aa, Mycobacterium tuberculosis
GGALAVEN

SEQ ID NO: 42852 - protein, 8 aa, Mycobacterium tuberculosis
GALAVENA

SEQ ID NO: 42853 - protein, 8 aa, Mycobacterium tuberculosis
ALAVENAL

SEQ ID NO: 42854 - protein, 8 aa, Mycobacterium tuberculosis
LAVENALK

SEQ ID NO: 42855 - protein, 8 aa, Mycobacterium tuberculosis
AVENALKA

SEQ ID NO: 42856 - protein, 8 aa, Mycobacterium tuberculosis
VENALKAA

SEQ ID NO: 42857 - protein, 8 aa, Mycobacterium tuberculosis
ENALKAAF

SEQ ID NO: 42858 - protein, 8 aa, Mycobacterium tuberculosis
NALKAAFD

SEQ ID NO: 42859 - protein, 8 aa, Mycobacterium tuberculosis
ALKAAFDW

SEQ ID NO: 42860 - protein, 8 aa, Mycobacterium tuberculosis
LKAAFDWK

SEQ ID NO: 42861 - protein, 8 aa, Mycobacterium tuberculosis
KAAFDWKS

SEQ ID NO: 42862 - protein, 8 aa, Mycobacterium tuberculosis
AAFDWKSR

SEQ ID NO: 42863 - protein, 8 aa, Mycobacterium tuberculosis
AFDWKSRH

SEQ ID NO: 42864 - protein, 8 aa, Mycobacterium tuberculosis
FDWKSRHN

SEQ ID NO: 42865 - protein, 8 aa, Mycobacterium tuberculosis
DWKSRHNQ

SEQ ID NO: 42866 - protein, 8 aa, Mycobacterium tuberculosis
WKSRHNQA

SEQ ID NO: 42867 - protein, 8 aa, Mycobacterium tuberculosis
KSRHNQAH

SEQ ID NO: 42868 - protein, 8 aa, Mycobacterium tuberculosis
SRHNQAHG

SEQ ID NO: 42869 - protein, 8 aa, Mycobacterium tuberculosis
RHNQAHGI

SEQ ID NO: 42870 - protein, 8 aa, Mycobacterium tuberculosis
HNQAHGID

SEQ ID NO: 42871 - protein, 8 aa, Mycobacterium tuberculosis
NQAHGIDP

SEQ ID NO: 42872 - protein, 8 aa, Mycobacterium tuberculosis
QAHGIDPA

SEQ ID NO: 42873 - protein, 8 aa, Mycobacterium tuberculosis
AHGIDPAL

SEQ ID NO: 42874 - protein, 8 aa, Mycobacterium tuberculosis
HGIDPALG

SEQ ID NO: 42875 - protein, 8 aa, Mycobacterium tuberculosis
GIDPALGT

SEQ ID NO: 42876 - protein, 8 aa, Mycobacterium tuberculosis
IDPALGTQ

SEQ ID NO: 42877 - protein, 8 aa, Mycobacterium tuberculosis
DPALGTQV

SEQ ID NO: 42878 - protein, 8 aa, Mycobacterium tuberculosis
PALGTQVL

SEQ ID NO: 42879 - protein, 8 aa, Mycobacterium tuberculosis
ALGTQVLH

SEQ ID NO: 42880 - protein, 8 aa, Mycobacterium tuberculosis
LGTQVLHL

SEQ ID NO: 42881 - protein, 8 aa, Mycobacterium tuberculosis
GTQVLHLR

SEQ ID NO: 42882 - protein, 8 aa, Mycobacterium tuberculosis
TQVLHLRG

SEQ ID NO: 42883 - protein, 8 aa, Mycobacterium tuberculosis
QVLHLRGA

SEQ ID NO: 42884 - protein, 8 aa, Mycobacterium tuberculosis
VLHLRGAF

SEQ ID NO: 42885 - protein, 8 aa, Mycobacterium tuberculosis
LHLRGAFH

SEQ ID NO: 42886 - protein, 8 aa, Mycobacterium tuberculosis
HLRGAFHG

SEQ ID NO: 42887 - protein, 8 aa, Mycobacterium tuberculosis
LRGAFHGR

SEQ ID NO: 42888 - protein, 8 aa, Mycobacterium tuberculosis
RGAFHGRS

SEQ ID NO: 42889 - protein, 8 aa, Mycobacterium tuberculosis
GAFHGRSG

SEQ ID NO: 42890 - protein, 8 aa, Mycobacterium tuberculosis
AFHGRSGY

SEQ ID NO: 42891 - protein, 8 aa, Mycobacterium tuberculosis
FHGRSGYT

SEQ ID NO: 42892 - protein, 8 aa, Mycobacterium tuberculosis
HGRSGYTL

SEQ ID NO: 42893 - protein, 8 aa, Mycobacterium tuberculosis
GRSGYTLS

SEQ ID NO: 42894 - protein, 8 aa, Mycobacterium tuberculosis
RSGYTLSL

SEQ ID NO: 42895 - protein, 8 aa, Mycobacterium tuberculosis
SGYTLSLT

SEQ ID NO: 42896 - protein, 8 aa, Mycobacterium tuberculosis
GYTLSLTN

SEQ ID NO: 42897 - protein, 8 aa, Mycobacterium tuberculosis
YTLSLTNT

SEQ ID NO: 42898 - protein, 8 aa, Mycobacterium tuberculosis
TLSLTNTK

SEQ ID NO: 42899 - protein, 8 aa, Mycobacterium tuberculosis
LSLTNTKP

SEQ ID NO: 42900 - protein, 8 aa, Mycobacterium tuberculosis
SLTNTKPT

SEQ ID NO: 42901 - protein, 8 aa, Mycobacterium tuberculosis
LTNTKPTI

SEQ ID NO: 42902 - protein, 8 aa, Mycobacterium tuberculosis
TNTKPTIT

SEQ ID NO: 42903 - protein, 8 aa, Mycobacterium tuberculosis
NTKPTITA

SEQ ID NO: 42904 - protein, 8 aa, Mycobacterium tuberculosis
TKPTITAR

SEQ ID NO: 42905 - protein, 8 aa, Mycobacterium tuberculosis
KPTITARF

SEQ ID NO: 42906 - protein, 8 aa, Mycobacterium tuberculosis
PTITARFP

SEQ ID NO: 42907 - protein, 8 aa, Mycobacterium tuberculosis
TITARFPK

SEQ ID NO: 42908 - protein, 8 aa, Mycobacterium tuberculosis
ITARFPKF

SEQ ID NO: 42909 - protein, 8 aa, Mycobacterium tuberculosis
TARFPKFD

SEQ ID NO: 42910 - protein, 8 aa, Mycobacterium tuberculosis
ARFPKFDW

SEQ ID NO: 42911 - protein, 8 aa, Mycobacterium tuberculosis
RFPKFDWP

SEQ ID NO: 42912 - protein, 8 aa, Mycobacterium tuberculosis
FPKFDWPR

SEQ ID NO: 42913 - protein, 8 aa, Mycobacterium tuberculosis
PKFDWPRI

SEQ ID NO: 42914 - protein, 8 aa, Mycobacterium tuberculosis
KFDWPRID

SEQ ID NO: 42915 - protein, 8 aa, Mycobacterium tuberculosis
FDWPRIDA

SEQ ID NO: 42916 - protein, 8 aa, Mycobacterium tuberculosis
DWPRIDAP

SEQ ID NO: 42917 - protein, 8 aa, Mycobacterium tuberculosis
WPRIDAPY

SEQ ID NO: 42918 - protein, 8 aa, Mycobacterium tuberculosis
PRIDAPYM

SEQ ID NO: 42919 - protein, 8 aa, Mycobacterium tuberculosis
RIDAPYMR

SEQ ID NO: 42920 - protein, 8 aa, Mycobacterium tuberculosis
IDAPYMRP

SEQ ID NO: 42921 - protein, 8 aa, Mycobacterium tuberculosis
DAPYMRPG

SEQ ID NO: 42922 - protein, 8 aa, Mycobacterium tuberculosis
APYMRPGL

SEQ ID NO: 42923 - protein, 8 aa, Mycobacterium tuberculosis
PYMRPGLD

SEQ ID NO: 42924 - protein, 8 aa, Mycobacterium tuberculosis
YMRPGLDE

SEQ ID NO: 42925 - protein, 8 aa, Mycobacterium tuberculosis
MRPGLDEP

SEQ ID NO: 42926 - protein, 8 aa, Mycobacterium tuberculosis
RPGLDEPA

SEQ ID NO: 42927 - protein, 8 aa, Mycobacterium tuberculosis
PGLDEPAM

SEQ ID NO: 42928 - protein, 8 aa, Mycobacterium tuberculosis
GLDEPAMA

SEQ ID NO: 42929 - protein, 8 aa, Mycobacterium tuberculosis
LDEPAMAA

SEQ ID NO: 42930 - protein, 8 aa, Mycobacterium tuberculosis
DEPAMAAL

SEQ ID NO: 42931 - protein, 8 aa, Mycobacterium tuberculosis
EPAMAALE

SEQ ID NO: 42932 - protein, 8 aa, Mycobacterium tuberculosis
PAMAALEA

SEQ ID NO: 42933 - protein, 8 aa, Mycobacterium tuberculosis
AMAALEAE

SEQ ID NO: 42934 - protein, 8 aa, Mycobacterium tuberculosis
MAALEAEA

SEQ ID NO: 42935 - protein, 8 aa, Mycobacterium tuberculosis
AALEAEAL

SEQ ID NO: 42936 - protein, 8 aa, Mycobacterium tuberculosis
ALEAEALR

SEQ ID NO: 42937 - protein, 8 aa, Mycobacterium tuberculosis
LEAEALRQ

SEQ ID NO: 42938 - protein, 8 aa, Mycobacterium tuberculosis
EAEALRQA

SEQ ID NO: 42939 - protein, 8 aa, Mycobacterium tuberculosis
AEALRQAR

SEQ ID NO: 42940 - protein, 8 aa, Mycobacterium tuberculosis
EALRQARA

SEQ ID NO: 42941 - protein, 8 aa, Mycobacterium tuberculosis
ALRQARAA

SEQ ID NO: 42942 - protein, 8 aa, Mycobacterium tuberculosis
LRQARAAF

SEQ ID NO: 42943 - protein, 8 aa, Mycobacterium tuberculosis
RQARAAFE

SEQ ID NO: 42944 - protein, 8 aa, Mycobacterium tuberculosis
QARAAFET

SEQ ID NO: 42945 - protein, 8 aa, Mycobacterium tuberculosis
ARAAFETR

SEQ ID NO: 42946 - protein, 8 aa, Mycobacterium tuberculosis
RAAFETRP

SEQ ID NO: 42947 - protein, 8 aa, Mycobacterium tuberculosis
AAFETRPH

SEQ ID NO: 42948 - protein, 8 aa, Mycobacterium tuberculosis
AFETRPHD

SEQ ID NO: 42949 - protein, 8 aa, Mycobacterium tuberculosis
FETRPHDI

SEQ ID NO: 42950 - protein, 8 aa, Mycobacterium tuberculosis
ETRPHDIA

SEQ ID NO: 42951 - protein, 8 aa, Mycobacterium tuberculosis
TRPHDIAC

SEQ ID NO: 42952 - protein, 8 aa, Mycobacterium tuberculosis
RPHDIACF

SEQ ID NO: 42953 - protein, 8 aa, Mycobacterium tuberculosis
PHDIACFV

SEQ ID NO: 42954 - protein, 8 aa, Mycobacterium tuberculosis
HDIACFVA

SEQ ID NO: 42955 - protein, 8 aa, Mycobacterium tuberculosis
DIACFVAE

SEQ ID NO: 42956 - protein, 8 aa, Mycobacterium tuberculosis
IACFVAEP

SEQ ID NO: 42957 - protein, 8 aa, Mycobacterium tuberculosis
ACFVAEPI

SEQ ID NO: 42958 - protein, 8 aa, Mycobacterium tuberculosis
CFVAEPIQ

SEQ ID NO: 42959 - protein, 8 aa, Mycobacterium tuberculosis
FVAEPIQG

SEQ ID NO: 42960 - protein, 8 aa, Mycobacterium tuberculosis
VAEPIQGE

SEQ ID NO: 42961 - protein, 8 aa, Mycobacterium tuberculosis
AEPIQGEG

SEQ ID NO: 42962 - protein, 8 aa, Mycobacterium tuberculosis
EPIQGEGG

SEQ ID NO: 42963 - protein, 8 aa, Mycobacterium tuberculosis
PIQGEGGD

SEQ ID NO: 42964 - protein, 8 aa, Mycobacterium tuberculosis
IQGEGGDR

SEQ ID NO: 42965 - protein, 8 aa, Mycobacterium tuberculosis
QGEGGDRH

SEQ ID NO: 42966 - protein, 8 aa, Mycobacterium tuberculosis
GEGGDRHF

SEQ ID NO: 42967 - protein, 8 aa, Mycobacterium tuberculosis
EGGDRHFR

SEQ ID NO: 42968 - protein, 8 aa, Mycobacterium tuberculosis
GGDRHFRP

SEQ ID NO: 42969 - protein, 8 aa, Mycobacterium tuberculosis
GDRHFRPE

SEQ ID NO: 42970 - protein, 8 aa, Mycobacterium tuberculosis
DRHFRPEF

SEQ ID NO: 42971 - protein, 8 aa, Mycobacterium tuberculosis
RHFRPEFF

SEQ ID NO: 42972 - protein, 8 aa, Mycobacterium tuberculosis
HFRPEFFA

SEQ ID NO: 42973 - protein, 8 aa, Mycobacterium tuberculosis
FRPEFFAA

SEQ ID NO: 42974 - protein, 8 aa, Mycobacterium tuberculosis
RPEFFAAM

SEQ ID NO: 42975 - protein, 8 aa, Mycobacterium tuberculosis
PEFFAAMR

SEQ ID NO: 42976 - protein, 8 aa, Mycobacterium tuberculosis
EFFAAMRE

SEQ ID NO: 42977 - protein, 8 aa, Mycobacterium tuberculosis
FFAAMREL

SEQ ID NO: 42978 - protein, 8 aa, Mycobacterium tuberculosis
FAAMRELC

SEQ ID NO: 42979 - protein, 8 aa, Mycobacterium tuberculosis
AAMRELCD

SEQ ID NO: 42980 - protein, 8 aa, Mycobacterium tuberculosis
AMRELCDE

SEQ ID NO: 42981 - protein, 8 aa, Mycobacterium tuberculosis
MRELCDEF

SEQ ID NO: 42982 - protein, 8 aa, Mycobacterium tuberculosis
RELCDEFD

SEQ ID NO: 42983 - protein, 8 aa, Mycobacterium tuberculosis
ELCDEFDA

SEQ ID NO: 42984 - protein, 8 aa, Mycobacterium tuberculosis
LCDEFDAL

SEQ ID NO: 42985 - protein, 8 aa, Mycobacterium tuberculosis
CDEFDALL

SEQ ID NO: 42986 - protein, 8 aa, Mycobacterium tuberculosis
DEFDALLI

SEQ ID NO: 42987 - protein, 8 aa, Mycobacterium tuberculosis
EFDALLIF

SEQ ID NO: 42988 - protein, 8 aa, Mycobacterium tuberculosis
FDALLIFD

SEQ ID NO: 42989 - protein, 8 aa, Mycobacterium tuberculosis
DALLIFDE

SEQ ID NO: 42990 - protein, 8 aa, Mycobacterium tuberculosis
ALLIFDEV

SEQ ID NO: 42991 - protein, 8 aa, Mycobacterium tuberculosis
LLIFDEVQ

SEQ ID NO: 42992 - protein, 8 aa, Mycobacterium tuberculosis
LIFDEVQT

SEQ ID NO: 42993 - protein, 8 aa, Mycobacterium tuberculosis
IFDEVQTG

SEQ ID NO: 42994 - protein, 8 aa, Mycobacterium tuberculosis
FDEVQTGC

SEQ ID NO: 42995 - protein, 8 aa, Mycobacterium tuberculosis
DEVQTGCG

SEQ ID NO: 42996 - protein, 8 aa, Mycobacterium tuberculosis
EVQTGCGL

SEQ ID NO: 42997 - protein, 8 aa, Mycobacterium tuberculosis
VQTGCGLT

SEQ ID NO: 42998 - protein, 8 aa, Mycobacterium tuberculosis
QTGCGLTG

SEQ ID NO: 42999 - protein, 8 aa, Mycobacterium tuberculosis
TGCGLTGT

SEQ ID NO: 43000 - protein, 8 aa, Mycobacterium tuberculosis
GCGLTGTA

SEQ ID NO: 43001 - protein, 8 aa, Mycobacterium tuberculosis
CGLTGTAW

SEQ ID NO: 43002 - protein, 8 aa, Mycobacterium tuberculosis
GLTGTAWA

SEQ ID NO: 43003 - protein, 8 aa, Mycobacterium tuberculosis
LTGTAWAY

SEQ ID NO: 43004 - protein, 8 aa, Mycobacterium tuberculosis
TGTAWAYQ

SEQ ID NO: 43005 - protein, 8 aa, Mycobacterium tuberculosis
GTAWAYQQ

SEQ ID NO: 43006 - protein, 8 aa, Mycobacterium tuberculosis
TAWAYQQL

SEQ ID NO: 43007 - protein, 8 aa, Mycobacterium tuberculosis
AWAYQQLD

SEQ ID NO: 43008 - protein, 8 aa, Mycobacterium tuberculosis
WAYQQLDV

SEQ ID NO: 43009 - protein, 8 aa, Mycobacterium tuberculosis
AYQQLDVA

SEQ ID NO: 43010 - protein, 8 aa, Mycobacterium tuberculosis
YQQLDVAP

SEQ ID NO: 43011 - protein, 8 aa, Mycobacterium tuberculosis
QQLDVAPD

SEQ ID NO: 43012 - protein, 8 aa, Mycobacterium tuberculosis
QLDVAPDI

SEQ ID NO: 43013 - protein, 8 aa, Mycobacterium tuberculosis
LDVAPDIV

SEQ ID NO: 43014 - protein, 8 aa, Mycobacterium tuberculosis
DVAPDIVA

SEQ ID NO: 43015 - protein, 8 aa, Mycobacterium tuberculosis
VAPDIVAF

SEQ ID NO: 43016 - protein, 8 aa, Mycobacterium tuberculosis
APDIVAFG

SEQ ID NO: 43017 - protein, 8 aa, Mycobacterium tuberculosis
PDIVAFGK

SEQ ID NO: 43018 - protein, 8 aa, Mycobacterium tuberculosis
DIVAFGKK

SEQ ID NO: 43019 - protein, 8 aa, Mycobacterium tuberculosis
IVAFGKKT

SEQ ID NO: 43020 - protein, 8 aa, Mycobacterium tuberculosis
VAFGKKTQ

SEQ ID NO: 43021 - protein, 8 aa, Mycobacterium tuberculosis
AFGKKTQV

SEQ ID NO: 43022 - protein, 8 aa, Mycobacterium tuberculosis
FGKKTQVC

SEQ ID NO: 43023 - protein, 8 aa, Mycobacterium tuberculosis
GKKTQVCG

SEQ ID NO: 43024 - protein, 8 aa, Mycobacterium tuberculosis
KKTQVCGV

SEQ ID NO: 43025 - protein, 8 aa, Mycobacterium tuberculosis
KTQVCGVM

SEQ ID NO: 43026 - protein, 8 aa, Mycobacterium tuberculosis
TQVCGVMA

SEQ ID NO: 43027 - protein, 8 aa, Mycobacterium tuberculosis
QVCGVMAG

SEQ ID NO: 43028 - protein, 8 aa, Mycobacterium tuberculosis
VCGVMAGR

SEQ ID NO: 43029 - protein, 8 aa, Mycobacterium tuberculosis
CGVMAGRR

SEQ ID NO: 43030 - protein, 8 aa, Mycobacterium tuberculosis
GVMAGRRV

SEQ ID NO: 43031 - protein, 8 aa, Mycobacterium tuberculosis
VMAGRRVD

SEQ ID NO: 43032 - protein, 8 aa, Mycobacterium tuberculosis
MAGRRVDE

SEQ ID NO: 43033 - protein, 8 aa, Mycobacterium tuberculosis
AGRRVDEV

SEQ ID NO: 43034 - protein, 8 aa, Mycobacterium tuberculosis
GRRVDEVA

SEQ ID NO: 43035 - protein, 8 aa, Mycobacterium tuberculosis
RRVDEVAD

SEQ ID NO: 43036 - protein, 8 aa, Mycobacterium tuberculosis
RVDEVADN

SEQ ID NO: 43037 - protein, 8 aa, Mycobacterium tuberculosis
VDEVADNV

SEQ ID NO: 43038 - protein, 8 aa, Mycobacterium tuberculosis
DEVADNVF

SEQ ID NO: 43039 - protein, 8 aa, Mycobacterium tuberculosis
EVADNVFA

SEQ ID NO: 43040 - protein, 8 aa, Mycobacterium tuberculosis
VADNVFAV

SEQ ID NO: 43041 - protein, 8 aa, Mycobacterium tuberculosis
ADNVFAVP

SEQ ID NO: 43042 - protein, 8 aa, Mycobacterium tuberculosis
DNVFAVPS

SEQ ID NO: 43043 - protein, 8 aa, Mycobacterium tuberculosis
NVFAVPSR

SEQ ID NO: 43044 - protein, 8 aa, Mycobacterium tuberculosis
VFAVPSRL

SEQ ID NO: 43045 - protein, 8 aa, Mycobacterium tuberculosis
FAVPSRLN

SEQ ID NO: 43046 - protein, 8 aa, Mycobacterium tuberculosis
AVPSRLNS

SEQ ID NO: 43047 - protein, 8 aa, Mycobacterium tuberculosis
VPSRLNST

SEQ ID NO: 43048 - protein, 8 aa, Mycobacterium tuberculosis
PSRLNSTW

SEQ ID NO: 43049 - protein, 8 aa, Mycobacterium tuberculosis
SRLNSTWG

SEQ ID NO: 43050 - protein, 8 aa, Mycobacterium tuberculosis
RLNSTWGG

SEQ ID NO: 43051 - protein, 8 aa, Mycobacterium tuberculosis
LNSTWGGN

SEQ ID NO: 43052 - protein, 8 aa, Mycobacterium tuberculosis
NSTWGGNL

SEQ ID NO: 43053 - protein, 8 aa, Mycobacterium tuberculosis
STWGGNLT

SEQ ID NO: 43054 - protein, 8 aa, Mycobacterium tuberculosis
TWGGNLTD

SEQ ID NO: 43055 - protein, 8 aa, Mycobacterium tuberculosis
WGGNLTDM

SEQ ID NO: 43056 - protein, 8 aa, Mycobacterium tuberculosis
GGNLTDMV

SEQ ID NO: 43057 - protein, 8 aa, Mycobacterium tuberculosis
GNLTDMVR

SEQ ID NO: 43058 - protein, 8 aa, Mycobacterium tuberculosis
NLTDMVRA

SEQ ID NO: 43059 - protein, 8 aa, Mycobacterium tuberculosis
LTDMVRAR

SEQ ID NO: 43060 - protein, 8 aa, Mycobacterium tuberculosis
TDMVRARR

SEQ ID NO: 43061 - protein, 8 aa, Mycobacterium tuberculosis
DMVRARRI

SEQ ID NO: 43062 - protein, 8 aa, Mycobacterium tuberculosis
MVRARRIL

SEQ ID NO: 43063 - protein, 8 aa, Mycobacterium tuberculosis
VRARRILE

SEQ ID NO: 43064 - protein, 8 aa, Mycobacterium tuberculosis
RARRILEV

SEQ ID NO: 43065 - protein, 8 aa, Mycobacterium tuberculosis
ARRILEVI

SEQ ID NO: 43066 - protein, 8 aa, Mycobacterium tuberculosis
RRILEVIE

SEQ ID NO: 43067 - protein, 8 aa, Mycobacterium tuberculosis
RILEVIEA

SEQ ID NO: 43068 - protein, 8 aa, Mycobacterium tuberculosis
ILEVIEAE

SEQ ID NO: 43069 - protein, 8 aa, Mycobacterium tuberculosis
LEVIEAEG

SEQ ID NO: 43070 - protein, 8 aa, Mycobacterium tuberculosis
EVIEAEGL

SEQ ID NO: 43071 - protein, 8 aa, Mycobacterium tuberculosis
VIEAEGLF

SEQ ID NO: 43072 - protein, 8 aa, Mycobacterium tuberculosis
IEAEGLFE

SEQ ID NO: 43073 - protein, 8 aa, Mycobacterium tuberculosis
EAEGLFER

SEQ ID NO: 43074 - protein, 8 aa, Mycobacterium tuberculosis
AEGLFERA

SEQ ID NO: 43075 - protein, 8 aa, Mycobacterium tuberculosis
EGLFERAV

SEQ ID NO: 43076 - protein, 8 aa, Mycobacterium tuberculosis
GLFERAVQ

SEQ ID NO: 43077 - protein, 8 aa, Mycobacterium tuberculosis
LFERAVQH

SEQ ID NO: 43078 - protein, 8 aa, Mycobacterium tuberculosis
FERAVQHG

SEQ ID NO: 43079 - protein, 8 aa, Mycobacterium tuberculosis
ERAVQHGK

SEQ ID NO: 43080 - protein, 8 aa, Mycobacterium tuberculosis
RAVQHGKY

SEQ ID NO: 43081 - protein, 8 aa, Mycobacterium tuberculosis
AVQHGKYL

SEQ ID NO: 43082 - protein, 8 aa, Mycobacterium tuberculosis
VQHGKYLR

SEQ ID NO: 43083 - protein, 8 aa, Mycobacterium tuberculosis
QHGKYLRA

SEQ ID NO: 43084 - protein, 8 aa, Mycobacterium tuberculosis
HGKYLRAR

SEQ ID NO: 43085 - protein, 8 aa, Mycobacterium tuberculosis
GKYLRARL

SEQ ID NO: 43086 - protein, 8 aa, Mycobacterium tuberculosis
KYLRARLD

SEQ ID NO: 43087 - protein, 8 aa, Mycobacterium tuberculosis
YLRARLDE

SEQ ID NO: 43088 - protein, 8 aa, Mycobacterium tuberculosis
LRARLDEL

SEQ ID NO: 43089 - protein, 8 aa, Mycobacterium tuberculosis
RARLDELA

SEQ ID NO: 43090 - protein, 8 aa, Mycobacterium tuberculosis
ARLDELAA

SEQ ID NO: 43091 - protein, 8 aa, Mycobacterium tuberculosis
RLDELAAD

SEQ ID NO: 43092 - protein, 8 aa, Mycobacterium tuberculosis
LDELAADF

SEQ ID NO: 43093 - protein, 8 aa, Mycobacterium tuberculosis
DELAADFP

SEQ ID NO: 43094 - protein, 8 aa, Mycobacterium tuberculosis
ELAADFPA

SEQ ID NO: 43095 - protein, 8 aa, Mycobacterium tuberculosis
LAADFPAV

SEQ ID NO: 43096 - protein, 8 aa, Mycobacterium tuberculosis
AADFPAVV

SEQ ID NO: 43097 - protein, 8 aa, Mycobacterium tuberculosis
ADFPAVVL

SEQ ID NO: 43098 - protein, 8 aa, Mycobacterium tuberculosis
DFPAVVLD

SEQ ID NO: 43099 - protein, 8 aa, Mycobacterium tuberculosis
FPAVVLDP

SEQ ID NO: 43100 - protein, 8 aa, Mycobacterium tuberculosis
PAVVLDPR

SEQ ID NO: 43101 - protein, 8 aa, Mycobacterium tuberculosis
AVVLDPRG

SEQ ID NO: 43102 - protein, 8 aa, Mycobacterium tuberculosis
VVLDPRGR

SEQ ID NO: 43103 - protein, 8 aa, Mycobacterium tuberculosis
VLDPRGRG

SEQ ID NO: 43104 - protein, 8 aa, Mycobacterium tuberculosis
LDPRGRGL

SEQ ID NO: 43105 - protein, 8 aa, Mycobacterium tuberculosis
DPRGRGLM

SEQ ID NO: 43106 - protein, 8 aa, Mycobacterium tuberculosis
PRGRGLMC

SEQ ID NO: 43107 - protein, 8 aa, Mycobacterium tuberculosis
RGRGLMCA

SEQ ID NO: 43108 - protein, 8 aa, Mycobacterium tuberculosis
GRGLMCAF

SEQ ID NO: 43109 - protein, 8 aa, Mycobacterium tuberculosis
RGLMCAFS

SEQ ID NO: 43110 - protein, 8 aa, Mycobacterium tuberculosis
GLMCAFSL

SEQ ID NO: 43111 - protein, 8 aa, Mycobacterium tuberculosis
LMCAFSLP

SEQ ID NO: 43112 - protein, 8 aa, Mycobacterium tuberculosis
MCAFSLPT

SEQ ID NO: 43113 - protein, 8 aa, Mycobacterium tuberculosis
CAFSLPTT

SEQ ID NO: 43114 - protein, 8 aa, Mycobacterium tuberculosis
AFSLPTTA

SEQ ID NO: 43115 - protein, 8 aa, Mycobacterium tuberculosis
FSLPTTAD

SEQ ID NO: 43116 - protein, 8 aa, Mycobacterium tuberculosis
SLPTTADR

SEQ ID NO: 43117 - protein, 8 aa, Mycobacterium tuberculosis
LPTTADRD

SEQ ID NO: 43118 - protein, 8 aa, Mycobacterium tuberculosis
PTTADRDE

SEQ ID NO: 43119 - protein, 8 aa, Mycobacterium tuberculosis
TTADRDEL

SEQ ID NO: 43120 - protein, 8 aa, Mycobacterium tuberculosis
TADRDELI

SEQ ID NO: 43121 - protein, 8 aa, Mycobacterium tuberculosis
ADRDELIR

SEQ ID NO: 43122 - protein, 8 aa, Mycobacterium tuberculosis
DRDELIRQ

SEQ ID NO: 43123 - protein, 8 aa, Mycobacterium tuberculosis
RDELIRQL

SEQ ID NO: 43124 - protein, 8 aa, Mycobacterium tuberculosis
DELIRQLW

SEQ ID NO: 43125 - protein, 8 aa, Mycobacterium tuberculosis
ELIRQLWQ

SEQ ID NO: 43126 - protein, 8 aa, Mycobacterium tuberculosis
LIRQLWQR

SEQ ID NO: 43127 - protein, 8 aa, Mycobacterium tuberculosis
IRQLWQRA

SEQ ID NO: 43128 - protein, 8 aa, Mycobacterium tuberculosis
RQLWQRAV

SEQ ID NO: 43129 - protein, 8 aa, Mycobacterium tuberculosis
QLWQRAVI

SEQ ID NO: 43130 - protein, 8 aa, Mycobacterium tuberculosis
LWQRAVIV

SEQ ID NO: 43131 - protein, 8 aa, Mycobacterium tuberculosis
WQRAVIVL

SEQ ID NO: 43132 - protein, 8 aa, Mycobacterium tuberculosis
QRAVIVLP

SEQ ID NO: 43133 - protein, 8 aa, Mycobacterium tuberculosis
RAVIVLPA

SEQ ID NO: 43134 - protein, 8 aa, Mycobacterium tuberculosis
AVIVLPAG

SEQ ID NO: 43135 - protein, 8 aa, Mycobacterium tuberculosis
VIVLPAGA

SEQ ID NO: 43136 - protein, 8 aa, Mycobacterium tuberculosis
IVLPAGAD

SEQ ID NO: 43137 - protein, 8 aa, Mycobacterium tuberculosis
VLPAGADT

SEQ ID NO: 43138 - protein, 8 aa, Mycobacterium tuberculosis
LPAGADTV

SEQ ID NO: 43139 - protein, 8 aa, Mycobacterium tuberculosis
PAGADTVR

SEQ ID NO: 43140 - protein, 8 aa, Mycobacterium tuberculosis
AGADTVRF

SEQ ID NO: 43141 - protein, 8 aa, Mycobacterium tuberculosis
GADTVRFR

SEQ ID NO: 43142 - protein, 8 aa, Mycobacterium tuberculosis
ADTVRFRP

SEQ ID NO: 43143 - protein, 8 aa, Mycobacterium tuberculosis
DTVRFRPP

SEQ ID NO: 43144 - protein, 8 aa, Mycobacterium tuberculosis
TVRFRPPL

SEQ ID NO: 43145 - protein, 8 aa, Mycobacterium tuberculosis
VRFRPPLT

SEQ ID NO: 43146 - protein, 8 aa, Mycobacterium tuberculosis
RFRPPLTV

SEQ ID NO: 43147 - protein, 8 aa, Mycobacterium tuberculosis
FRPPLTVS

SEQ ID NO: 43148 - protein, 8 aa, Mycobacterium tuberculosis
RPPLTVST

SEQ ID NO: 43149 - protein, 8 aa, Mycobacterium tuberculosis
PPLTVSTA

SEQ ID NO: 43150 - protein, 8 aa, Mycobacterium tuberculosis
PLTVSTAE

SEQ ID NO: 43151 - protein, 8 aa, Mycobacterium tuberculosis
LTVSTAEI

SEQ ID NO: 43152 - protein, 8 aa, Mycobacterium tuberculosis
TVSTAEID

SEQ ID NO: 43153 - protein, 8 aa, Mycobacterium tuberculosis
VSTAEIDA

SEQ ID NO: 43154 - protein, 8 aa, Mycobacterium tuberculosis
STAEIDAA

SEQ ID NO: 43155 - protein, 8 aa, Mycobacterium tuberculosis
TAEIDAAI

SEQ ID NO: 43156 - protein, 8 aa, Mycobacterium tuberculosis
AEIDAAIA

SEQ ID NO: 43157 - protein, 8 aa, Mycobacterium tuberculosis
EIDAAIAA

SEQ ID NO: 43158 - protein, 8 aa, Mycobacterium tuberculosis
IDAAIAAV

SEQ ID NO: 43159 - protein, 8 aa, Mycobacterium tuberculosis
DAAIAAVR

SEQ ID NO: 43160 - protein, 8 aa, Mycobacterium tuberculosis
AAIAAVRS

SEQ ID NO: 43161 - protein, 8 aa, Mycobacterium tuberculosis
AIAAVRSA

SEQ ID NO: 43162 - protein, 8 aa, Mycobacterium tuberculosis
IAAVRSAL

SEQ ID NO: 43163 - protein, 8 aa, Mycobacterium tuberculosis
AAVRSALP

SEQ ID NO: 43164 - protein, 8 aa, Mycobacterium tuberculosis
AVRSALPV

SEQ ID NO: 43165 - protein, 8 aa, Mycobacterium tuberculosis
VRSALPVV

SEQ ID NO: 43166 - protein, 8 aa, Mycobacterium tuberculosis
RSALPVVT

SEQ ID NO: 43167 - protein, 9 aa, Mycobacterium tuberculosis
MAAVVKSVA

SEQ ID NO: 43168 - protein, 9 aa, Mycobacterium tuberculosis
AAVVKSVAL

SEQ ID NO: 43169 - protein, 9 aa, Mycobacterium tuberculosis
AVVKSVALA

SEQ ID NO: 43170 - protein, 9 aa, Mycobacterium tuberculosis
VVKSVALAG

SEQ ID NO: 43171 - protein, 9 aa, Mycobacterium tuberculosis
VKSVALAGR

SEQ ID NO: 43172 - protein, 9 aa, Mycobacterium tuberculosis
KSVALAGRP

SEQ ID NO: 43173 - protein, 9 aa, Mycobacterium tuberculosis
SVALAGRPT

SEQ ID NO: 43174 - protein, 9 aa, Mycobacterium tuberculosis
VALAGRPTT

SEQ ID NO: 43175 - protein, 9 aa, Mycobacterium tuberculosis
ALAGRPTTP

SEQ ID NO: 43176 - protein, 9 aa, Mycobacterium tuberculosis
LAGRPTTPD

SEQ ID NO: 43177 - protein, 9 aa, Mycobacterium tuberculosis
AGRPTTPDR

SEQ ID NO: 43178 - protein, 9 aa, Mycobacterium tuberculosis
GRPTTPDRV

SEQ ID NO: 43179 - protein, 9 aa, Mycobacterium tuberculosis
RPTTPDRVH

SEQ ID NO: 43180 - protein, 9 aa, Mycobacterium tuberculosis
PTTPDRVHE

SEQ ID NO: 43181 - protein, 9 aa, Mycobacterium tuberculosis
TTPDRVHEV

SEQ ID NO: 43182 - protein, 9 aa, Mycobacterium tuberculosis
TPDRVHEVL

SEQ ID NO: 43183 - protein, 9 aa, Mycobacterium tuberculosis
PDRVHEVLG

SEQ ID NO: 43184 - protein, 9 aa, Mycobacterium tuberculosis
DRVHEVLGR

SEQ ID NO: 43185 - protein, 9 aa, Mycobacterium tuberculosis
RVHEVLGRS

SEQ ID NO: 43186 - protein, 9 aa, Mycobacterium tuberculosis
VHEVLGRSM

SEQ ID NO: 43187 - protein, 9 aa, Mycobacterium tuberculosis
HEVLGRSML

SEQ ID NO: 43188 - protein, 9 aa, Mycobacterium tuberculosis
EVLGRSMLV

SEQ ID NO: 43189 - protein, 9 aa, Mycobacterium tuberculosis
VLGRSMLVD

SEQ ID NO: 43190 - protein, 9 aa, Mycobacterium tuberculosis
LGRSMLVDG

SEQ ID NO: 43191 - protein, 9 aa, Mycobacterium tuberculosis
GRSMLVDGL

SEQ ID NO: 43192 - protein, 9 aa, Mycobacterium tuberculosis
RSMLVDGLD

SEQ ID NO: 43193 - protein, 9 aa, Mycobacterium tuberculosis
SMLVDGLDI

SEQ ID NO: 43194 - protein, 9 aa, Mycobacterium tuberculosis
MLVDGLDIV

SEQ ID NO: 43195 - protein, 9 aa, Mycobacterium tuberculosis
LVDGLDIVL

SEQ ID NO: 43196 - protein, 9 aa, Mycobacterium tuberculosis
VDGLDIVLD

SEQ ID NO: 43197 - protein, 9 aa, Mycobacterium tuberculosis
DGLDIVLDL

SEQ ID NO: 43198 - protein, 9 aa, Mycobacterium tuberculosis
GLDIVLDLT

SEQ ID NO: 43199 - protein, 9 aa, Mycobacterium tuberculosis
LDIVLDLTR

SEQ ID NO: 43200 - protein, 9 aa, Mycobacterium tuberculosis
DIVLDLTRS

SEQ ID NO: 43201 - protein, 9 aa, Mycobacterium tuberculosis
IVLDLTRSG

SEQ ID NO: 43202 - protein, 9 aa, Mycobacterium tuberculosis
VLDLTRSGG

SEQ ID NO: 43203 - protein, 9 aa, Mycobacterium tuberculosis
LDLTRSGGS

SEQ ID NO: 43204 - protein, 9 aa, Mycobacterium tuberculosis
DLTRSGGSY

SEQ ID NO: 43205 - protein, 9 aa, Mycobacterium tuberculosis
LTRSGGSYL

SEQ ID NO: 43206 - protein, 9 aa, Mycobacterium tuberculosis
TRSGGSYLV

SEQ ID NO: 43207 - protein, 9 aa, Mycobacterium tuberculosis
RSGGSYLVD

SEQ ID NO: 43208 - protein, 9 aa, Mycobacterium tuberculosis
SGGSYLVDA

SEQ ID NO: 43209 - protein, 9 aa, Mycobacterium tuberculosis
GGSYLVDAI

SEQ ID NO: 43210 - protein, 9 aa, Mycobacterium tuberculosis
GSYLVDAIT

SEQ ID NO: 43211 - protein, 9 aa, Mycobacterium tuberculosis
SYLVDAITG

SEQ ID NO: 43212 - protein, 9 aa, Mycobacterium tuberculosis
YLVDAITGR

SEQ ID NO: 43213 - protein, 9 aa, Mycobacterium tuberculosis
LVDAITGRR

SEQ ID NO: 43214 - protein, 9 aa, Mycobacterium tuberculosis
VDAITGRRY

SEQ ID NO: 43215 - protein, 9 aa, Mycobacterium tuberculosis
DAITGRRYL

SEQ ID NO: 43216 - protein, 9 aa, Mycobacterium tuberculosis
AITGRRYLD

SEQ ID NO: 43217 - protein, 9 aa, Mycobacterium tuberculosis
ITGRRYLDM

SEQ ID NO: 43218 - protein, 9 aa, Mycobacterium tuberculosis
TGRRYLDMF

SEQ ID NO: 43219 - protein, 9 aa, Mycobacterium tuberculosis
GRRYLDMFT

SEQ ID NO: 43220 - protein, 9 aa, Mycobacterium tuberculosis
RRYLDMFTF

SEQ ID NO: 43221 - protein, 9 aa, Mycobacterium tuberculosis
RYLDMFTFV

SEQ ID NO: 43222 - protein, 9 aa, Mycobacterium tuberculosis
YLDMFTFVA

SEQ ID NO: 43223 - protein, 9 aa, Mycobacterium tuberculosis
LDMFTFVAS

SEQ ID NO: 43224 - protein, 9 aa, Mycobacterium tuberculosis
DMFTFVASS

SEQ ID NO: 43225 - protein, 9 aa, Mycobacterium tuberculosis
MFTFVASSA

SEQ ID NO: 43226 - protein, 9 aa, Mycobacterium tuberculosis
FTFVASSAL

SEQ ID NO: 43227 - protein, 9 aa, Mycobacterium tuberculosis
TFVASSALG

SEQ ID NO: 43228 - protein, 9 aa, Mycobacterium tuberculosis
FVASSALGM

SEQ ID NO: 43229 - protein, 9 aa, Mycobacterium tuberculosis
VASSALGMN

SEQ ID NO: 43230 - protein, 9 aa, Mycobacterium tuberculosis
ASSALGMNP

SEQ ID NO: 43231 - protein, 9 aa, Mycobacterium tuberculosis
SSALGMNPP

SEQ ID NO: 43232 - protein, 9 aa, Mycobacterium tuberculosis
SALGMNPPA

SEQ ID NO: 43233 - protein, 9 aa, Mycobacterium tuberculosis
ALGMNPPAL

SEQ ID NO: 43234 - protein, 9 aa, Mycobacterium tuberculosis
LGMNPPALV

SEQ ID NO: 43235 - protein, 9 aa, Mycobacterium tuberculosis
GMNPPALVD

SEQ ID NO: 43236 - protein, 9 aa, Mycobacterium tuberculosis
MNPPALVDD

SEQ ID NO: 43237 - protein, 9 aa, Mycobacterium tuberculosis
NPPALVDDR

SEQ ID NO: 43238 - protein, 9 aa, Mycobacterium tuberculosis
PPALVDDRE

SEQ ID NO: 43239 - protein, 9 aa, Mycobacterium tuberculosis
PALVDDREF

SEQ ID NO: 43240 - protein, 9 aa, Mycobacterium tuberculosis
ALVDDREFH

SEQ ID NO: 43241 - protein, 9 aa, Mycobacterium tuberculosis
LVDDREFHA

SEQ ID NO: 43242 - protein, 9 aa, Mycobacterium tuberculosis
VDDREFHAE

SEQ ID NO: 43243 - protein, 9 aa, Mycobacterium tuberculosis
DDREFHAEL

SEQ ID NO: 43244 - protein, 9 aa, Mycobacterium tuberculosis
DREFHAELM

SEQ ID NO: 43245 - protein, 9 aa, Mycobacterium tuberculosis
REFHAELMQ

SEQ ID NO: 43246 - protein, 9 aa, Mycobacterium tuberculosis
EFHAELMQA

SEQ ID NO: 43247 - protein, 9 aa, Mycobacterium tuberculosis
FHAELMQAA

SEQ ID NO: 43248 - protein, 9 aa, Mycobacterium tuberculosis
HAELMQAAL

SEQ ID NO: 43249 - protein, 9 aa, Mycobacterium tuberculosis
AELMQAALN

SEQ ID NO: 43250 - protein, 9 aa, Mycobacterium tuberculosis
ELMQAALNK

SEQ ID NO: 43251 - protein, 9 aa, Mycobacterium tuberculosis
LMQAALNKP

SEQ ID NO: 43252 - protein, 9 aa, Mycobacterium tuberculosis
MQAALNKPS

SEQ ID NO: 43253 - protein, 9 aa, Mycobacterium tuberculosis
QAALNKPSN

SEQ ID NO: 43254 - protein, 9 aa, Mycobacterium tuberculosis
AALNKPSNS

SEQ ID NO: 43255 - protein, 9 aa, Mycobacterium tuberculosis
ALNKPSNSD

SEQ ID NO: 43256 - protein, 9 aa, Mycobacterium tuberculosis
LNKPSNSDV

SEQ ID NO: 43257 - protein, 9 aa, Mycobacterium tuberculosis
NKPSNSDVY

SEQ ID NO: 43258 - protein, 9 aa, Mycobacterium tuberculosis
KPSNSDVYS

SEQ ID NO: 43259 - protein, 9 aa, Mycobacterium tuberculosis
PSNSDVYSV

SEQ ID NO: 43260 - protein, 9 aa, Mycobacterium tuberculosis
SNSDVYSVA

SEQ ID NO: 43261 - protein, 9 aa, Mycobacterium tuberculosis
NSDVYSVAM

SEQ ID NO: 43262 - protein, 9 aa, Mycobacterium tuberculosis
SDVYSVAMA

SEQ ID NO: 43263 - protein, 9 aa, Mycobacterium tuberculosis
DVYSVAMAR

SEQ ID NO: 43264 - protein, 9 aa, Mycobacterium tuberculosis
VYSVAMARF

SEQ ID NO: 43265 - protein, 9 aa, Mycobacterium tuberculosis
YSVAMARFV

SEQ ID NO: 43266 - protein, 9 aa, Mycobacterium tuberculosis
SVAMARFVE

SEQ ID NO: 43267 - protein, 9 aa, Mycobacterium tuberculosis
VAMARFVET

SEQ ID NO: 43268 - protein, 9 aa, Mycobacterium tuberculosis
AMARFVETF

SEQ ID NO: 43269 - protein, 9 aa, Mycobacterium tuberculosis
MARFVETFA

SEQ ID NO: 43270 - protein, 9 aa, Mycobacterium tuberculosis
ARFVETFAR

SEQ ID NO: 43271 - protein, 9 aa, Mycobacterium tuberculosis
RFVETFARV

SEQ ID NO: 43272 - protein, 9 aa, Mycobacterium tuberculosis
FVETFARVL

SEQ ID NO: 43273 - protein, 9 aa, Mycobacterium tuberculosis
VETFARVLG

SEQ ID NO: 43274 - protein, 9 aa, Mycobacterium tuberculosis
ETFARVLGD

SEQ ID NO: 43275 - protein, 9 aa, Mycobacterium tuberculosis
TFARVLGDP

SEQ ID NO: 43276 - protein, 9 aa, Mycobacterium tuberculosis
FARVLGDPA

SEQ ID NO: 43277 - protein, 9 aa, Mycobacterium tuberculosis
ARVLGDPAL

SEQ ID NO: 43278 - protein, 9 aa, Mycobacterium tuberculosis
RVLGDPALP

SEQ ID NO: 43279 - protein, 9 aa, Mycobacterium tuberculosis
VLGDPALPH

SEQ ID NO: 43280 - protein, 9 aa, Mycobacterium tuberculosis
LGDPALPHL

SEQ ID NO: 43281 - protein, 9 aa, Mycobacterium tuberculosis
GDPALPHLF

SEQ ID NO: 43282 - protein, 9 aa, Mycobacterium tuberculosis
DPALPHLFF

SEQ ID NO: 43283 - protein, 9 aa, Mycobacterium tuberculosis
PALPHLFFV

SEQ ID NO: 43284 - protein, 9 aa, Mycobacterium tuberculosis
ALPHLFFVE

SEQ ID NO: 43285 - protein, 9 aa, Mycobacterium tuberculosis
LPHLFFVEG

SEQ ID NO: 43286 - protein, 9 aa, Mycobacterium tuberculosis
PHLFFVEGG

SEQ ID NO: 43287 - protein, 9 aa, Mycobacterium tuberculosis
HLFFVEGGA

SEQ ID NO: 43288 - protein, 9 aa, Mycobacterium tuberculosis
LFFVEGGAL

SEQ ID NO: 43289 - protein, 9 aa, Mycobacterium tuberculosis
FFVEGGALA

SEQ ID NO: 43290 - protein, 9 aa, Mycobacterium tuberculosis
FVEGGALAV

SEQ ID NO: 43291 - protein, 9 aa, Mycobacterium tuberculosis
VEGGALAVE

SEQ ID NO: 43292 - protein, 9 aa, Mycobacterium tuberculosis
EGGALAVEN

SEQ ID NO: 43293 - protein, 9 aa, Mycobacterium tuberculosis
GGALAVENA

SEQ ID NO: 43294 - protein, 9 aa, Mycobacterium tuberculosis
GALAVENAL

SEQ ID NO: 43295 - protein, 9 aa, Mycobacterium tuberculosis
ALAVENALK

SEQ ID NO: 43296 - protein, 9 aa, Mycobacterium tuberculosis
LAVENALKA

SEQ ID NO: 43297 - protein, 9 aa, Mycobacterium tuberculosis
AVENALKAA

SEQ ID NO: 43298 - protein, 9 aa, Mycobacterium tuberculosis
VENALKAAF

SEQ ID NO: 43299 - protein, 9 aa, Mycobacterium tuberculosis
ENALKAAFD

SEQ ID NO: 43300 - protein, 9 aa, Mycobacterium tuberculosis
NALKAAFDW

SEQ ID NO: 43301 - protein, 9 aa, Mycobacterium tuberculosis
ALKAAFDWK

SEQ ID NO: 43302 - protein, 9 aa, Mycobacterium tuberculosis
LKAAFDWKS

SEQ ID NO: 43303 - protein, 9 aa, Mycobacterium tuberculosis
KAAFDWKSR

SEQ ID NO: 43304 - protein, 9 aa, Mycobacterium tuberculosis
AAFDWKSRH

SEQ ID NO: 43305 - protein, 9 aa, Mycobacterium tuberculosis
AFDWKSRHN

SEQ ID NO: 43306 - protein, 9 aa, Mycobacterium tuberculosis
FDWKSRHNQ

SEQ ID NO: 43307 - protein, 9 aa, Mycobacterium tuberculosis
DWKSRHNQA

SEQ ID NO: 43308 - protein, 9 aa, Mycobacterium tuberculosis
WKSRHNQAH

SEQ ID NO: 43309 - protein, 9 aa, Mycobacterium tuberculosis
KSRHNQAHG

SEQ ID NO: 43310 - protein, 9 aa, Mycobacterium tuberculosis
SRHNQAHGI

SEQ ID NO: 43311 - protein, 9 aa, Mycobacterium tuberculosis
RHNQAHGID

SEQ ID NO: 43312 - protein, 9 aa, Mycobacterium tuberculosis
HNQAHGIDP

SEQ ID NO: 43313 - protein, 9 aa, Mycobacterium tuberculosis
NQAHGIDPA

SEQ ID NO: 43314 - protein, 9 aa, Mycobacterium tuberculosis
QAHGIDPAL

SEQ ID NO: 43315 - protein, 9 aa, Mycobacterium tuberculosis
AHGIDPALG

SEQ ID NO: 43316 - protein, 9 aa, Mycobacterium tuberculosis
HGIDPALGT

SEQ ID NO: 43317 - protein, 9 aa, Mycobacterium tuberculosis
GIDPALGTQ

SEQ ID NO: 43318 - protein, 9 aa, Mycobacterium tuberculosis
IDPALGTQV

SEQ ID NO: 43319 - protein, 9 aa, Mycobacterium tuberculosis
DPALGTQVL

SEQ ID NO: 43320 - protein, 9 aa, Mycobacterium tuberculosis
PALGTQVLH

SEQ ID NO: 43321 - protein, 9 aa, Mycobacterium tuberculosis
ALGTQVLHL

SEQ ID NO: 43322 - protein, 9 aa, Mycobacterium tuberculosis
LGTQVLHLR

SEQ ID NO: 43323 - protein, 9 aa, Mycobacterium tuberculosis
GTQVLHLRG

SEQ ID NO: 43324 - protein, 9 aa, Mycobacterium tuberculosis
TQVLHLRGA

SEQ ID NO: 43325 - protein, 9 aa, Mycobacterium tuberculosis
QVLHLRGAF

SEQ ID NO: 43326 - protein, 9 aa, Mycobacterium tuberculosis
VLHLRGAFH

SEQ ID NO: 43327 - protein, 9 aa, Mycobacterium tuberculosis
LHLRGAFHG

SEQ ID NO: 43328 - protein, 9 aa, Mycobacterium tuberculosis
HLRGAFHGR

SEQ ID NO: 43329 - protein, 9 aa, Mycobacterium tuberculosis
LRGAFHGRS

SEQ ID NO: 43330 - protein, 9 aa, Mycobacterium tuberculosis
RGAFHGRSG

SEQ ID NO: 43331 - protein, 9 aa, Mycobacterium tuberculosis
GAFHGRSGY

SEQ ID NO: 43332 - protein, 9 aa, Mycobacterium tuberculosis
AFHGRSGYT

SEQ ID NO: 43333 - protein, 9 aa, Mycobacterium tuberculosis
FHGRSGYTL

SEQ ID NO: 43334 - protein, 9 aa, Mycobacterium tuberculosis
HGRSGYTLS

SEQ ID NO: 43335 - protein, 9 aa, Mycobacterium tuberculosis
GRSGYTLSL

SEQ ID NO: 43336 - protein, 9 aa, Mycobacterium tuberculosis
RSGYTLSLT

SEQ ID NO: 43337 - protein, 9 aa, Mycobacterium tuberculosis
SGYTLSLTN

SEQ ID NO: 43338 - protein, 9 aa, Mycobacterium tuberculosis
GYTLSLTNT

SEQ ID NO: 43339 - protein, 9 aa, Mycobacterium tuberculosis
YTLSLTNTK

SEQ ID NO: 43340 - protein, 9 aa, Mycobacterium tuberculosis
TLSLTNTKP

SEQ ID NO: 43341 - protein, 9 aa, Mycobacterium tuberculosis
LSLTNTKPT

SEQ ID NO: 43342 - protein, 9 aa, Mycobacterium tuberculosis
SLTNTKPTI

SEQ ID NO: 43343 - protein, 9 aa, Mycobacterium tuberculosis
LTNTKPTIT

SEQ ID NO: 43344 - protein, 9 aa, Mycobacterium tuberculosis
TNTKPTITA

SEQ ID NO: 43345 - protein, 9 aa, Mycobacterium tuberculosis
NTKPTITAR

SEQ ID NO: 43346 - protein, 9 aa, Mycobacterium tuberculosis
TKPTITARF

SEQ ID NO: 43347 - protein, 9 aa, Mycobacterium tuberculosis
KPTITARFP

SEQ ID NO: 43348 - protein, 9 aa, Mycobacterium tuberculosis
PTITARFPK

SEQ ID NO: 43349 - protein, 9 aa, Mycobacterium tuberculosis
TITARFPKF

SEQ ID NO: 43350 - protein, 9 aa, Mycobacterium tuberculosis
ITARFPKFD

SEQ ID NO: 43351 - protein, 9 aa, Mycobacterium tuberculosis
TARFPKFDW

SEQ ID NO: 43352 - protein, 9 aa, Mycobacterium tuberculosis
ARFPKFDWP

SEQ ID NO: 43353 - protein, 9 aa, Mycobacterium tuberculosis
RFPKFDWPR

SEQ ID NO: 43354 - protein, 9 aa, Mycobacterium tuberculosis
FPKFDWPRI

SEQ ID NO: 43355 - protein, 9 aa, Mycobacterium tuberculosis
PKFDWPRID

SEQ ID NO: 43356 - protein, 9 aa, Mycobacterium tuberculosis
KFDWPRIDA

SEQ ID NO: 43357 - protein, 9 aa, Mycobacterium tuberculosis
FDWPRIDAP

SEQ ID NO: 43358 - protein, 9 aa, Mycobacterium tuberculosis
DWPRIDAPY

SEQ ID NO: 43359 - protein, 9 aa, Mycobacterium tuberculosis
WPRIDAPYM

SEQ ID NO: 43360 - protein, 9 aa, Mycobacterium tuberculosis
PRIDAPYMR

SEQ ID NO: 43361 - protein, 9 aa, Mycobacterium tuberculosis
RIDAPYMRP

SEQ ID NO: 43362 - protein, 9 aa, Mycobacterium tuberculosis
IDAPYMRPG

SEQ ID NO: 43363 - protein, 9 aa, Mycobacterium tuberculosis
DAPYMRPGL

SEQ ID NO: 43364 - protein, 9 aa, Mycobacterium tuberculosis
APYMRPGLD

SEQ ID NO: 43365 - protein, 9 aa, Mycobacterium tuberculosis
PYMRPGLDE

SEQ ID NO: 43366 - protein, 9 aa, Mycobacterium tuberculosis
YMRPGLDEP

SEQ ID NO: 43367 - protein, 9 aa, Mycobacterium tuberculosis
MRPGLDEPA

SEQ ID NO: 43368 - protein, 9 aa, Mycobacterium tuberculosis
RPGLDEPAM

SEQ ID NO: 43369 - protein, 9 aa, Mycobacterium tuberculosis
PGLDEPAMA

SEQ ID NO: 43370 - protein, 9 aa, Mycobacterium tuberculosis
GLDEPAMAA

SEQ ID NO: 43371 - protein, 9 aa, Mycobacterium tuberculosis
LDEPAMAAL

SEQ ID NO: 43372 - protein, 9 aa, Mycobacterium tuberculosis
DEPAMAALE

SEQ ID NO: 43373 - protein, 9 aa, Mycobacterium tuberculosis
EPAMAALEA

SEQ ID NO: 43374 - protein, 9 aa, Mycobacterium tuberculosis
PAMAALEAE

SEQ ID NO: 43375 - protein, 9 aa, Mycobacterium tuberculosis
AMAALEAEA

SEQ ID NO: 43376 - protein, 9 aa, Mycobacterium tuberculosis
MAALEAEAL

SEQ ID NO: 43377 - protein, 9 aa, Mycobacterium tuberculosis
AALEAEALR

SEQ ID NO: 43378 - protein, 9 aa, Mycobacterium tuberculosis
ALEAEALRQ

SEQ ID NO: 43379 - protein, 9 aa, Mycobacterium tuberculosis
LEAEALRQA

SEQ ID NO: 43380 - protein, 9 aa, Mycobacterium tuberculosis
EAEALRQAR

SEQ ID NO: 43381 - protein, 9 aa, Mycobacterium tuberculosis
AEALRQARA

SEQ ID NO: 43382 - protein, 9 aa, Mycobacterium tuberculosis
EALRQARAA

SEQ ID NO: 43383 - protein, 9 aa, Mycobacterium tuberculosis
ALRQARAAF

SEQ ID NO: 43384 - protein, 9 aa, Mycobacterium tuberculosis
LRQARAAFE

SEQ ID NO: 43385 - protein, 9 aa, Mycobacterium tuberculosis
RQARAAFET

SEQ ID NO: 43386 - protein, 9 aa, Mycobacterium tuberculosis
QARAAFETR

SEQ ID NO: 43387 - protein, 9 aa, Mycobacterium tuberculosis
ARAAFETRP

SEQ ID NO: 43388 - protein, 9 aa, Mycobacterium tuberculosis
RAAFETRPH

SEQ ID NO: 43389 - protein, 9 aa, Mycobacterium tuberculosis
AAFETRPHD

SEQ ID NO: 43390 - protein, 9 aa, Mycobacterium tuberculosis
AFETRPHDI

SEQ ID NO: 43391 - protein, 9 aa, Mycobacterium tuberculosis
FETRPHDIA

SEQ ID NO: 43392 - protein, 9 aa, Mycobacterium tuberculosis
ETRPHDIAC

SEQ ID NO: 43393 - protein, 9 aa, Mycobacterium tuberculosis
TRPHDIACF

SEQ ID NO: 43394 - protein, 9 aa, Mycobacterium tuberculosis
RPHDIACFV

SEQ ID NO: 43395 - protein, 9 aa, Mycobacterium tuberculosis
PHDIACFVA

SEQ ID NO: 43396 - protein, 9 aa, Mycobacterium tuberculosis
HDIACFVAE

SEQ ID NO: 43397 - protein, 9 aa, Mycobacterium tuberculosis
DIACFVAEP

SEQ ID NO: 43398 - protein, 9 aa, Mycobacterium tuberculosis
IACFVAEPI

SEQ ID NO: 43399 - protein, 9 aa, Mycobacterium tuberculosis
ACFVAEPIQ

SEQ ID NO: 43400 - protein, 9 aa, Mycobacterium tuberculosis
CFVAEPIQG

SEQ ID NO: 43401 - protein, 9 aa, Mycobacterium tuberculosis
FVAEPIQGE

SEQ ID NO: 43402 - protein, 9 aa, Mycobacterium tuberculosis
VAEPIQGEG

SEQ ID NO: 43403 - protein, 9 aa, Mycobacterium tuberculosis
AEPIQGEGG

SEQ ID NO: 43404 - protein, 9 aa, Mycobacterium tuberculosis
EPIQGEGGD

SEQ ID NO: 43405 - protein, 9 aa, Mycobacterium tuberculosis
PIQGEGGDR

SEQ ID NO: 43406 - protein, 9 aa, Mycobacterium tuberculosis
IQGEGGDRH

SEQ ID NO: 43407 - protein, 9 aa, Mycobacterium tuberculosis
QGEGGDRHF

SEQ ID NO: 43408 - protein, 9 aa, Mycobacterium tuberculosis
GEGGDRHFR

SEQ ID NO: 43409 - protein, 9 aa, Mycobacterium tuberculosis
EGGDRHFRP

SEQ ID NO: 43410 - protein, 9 aa, Mycobacterium tuberculosis
GGDRHFRPE

SEQ ID NO: 43411 - protein, 9 aa, Mycobacterium tuberculosis
GDRHFRPEF

SEQ ID NO: 43412 - protein, 9 aa, Mycobacterium tuberculosis
DRHFRPEFF

SEQ ID NO: 43413 - protein, 9 aa, Mycobacterium tuberculosis
RHFRPEFFA

SEQ ID NO: 43414 - protein, 9 aa, Mycobacterium tuberculosis
HFRPEFFAA

SEQ ID NO: 43415 - protein, 9 aa, Mycobacterium tuberculosis
FRPEFFAAM

SEQ ID NO: 43416 - protein, 9 aa, Mycobacterium tuberculosis
RPEFFAAMR

SEQ ID NO: 43417 - protein, 9 aa, Mycobacterium tuberculosis
PEFFAAMRE

SEQ ID NO: 43418 - protein, 9 aa, Mycobacterium tuberculosis
EFFAAMREL

SEQ ID NO: 43419 - protein, 9 aa, Mycobacterium tuberculosis
FFAAMRELC

SEQ ID NO: 43420 - protein, 9 aa, Mycobacterium tuberculosis
FAAMRELCD

SEQ ID NO: 43421 - protein, 9 aa, Mycobacterium tuberculosis
AAMRELCDE

SEQ ID NO: 43422 - protein, 9 aa, Mycobacterium tuberculosis
AMRELCDEF

SEQ ID NO: 43423 - protein, 9 aa, Mycobacterium tuberculosis
MRELCDEFD

SEQ ID NO: 43424 - protein, 9 aa, Mycobacterium tuberculosis
RELCDEFDA

SEQ ID NO: 43425 - protein, 9 aa, Mycobacterium tuberculosis
ELCDEFDAL

SEQ ID NO: 43426 - protein, 9 aa, Mycobacterium tuberculosis
LCDEFDALL

SEQ ID NO: 43427 - protein, 9 aa, Mycobacterium tuberculosis
CDEFDALLI

SEQ ID NO: 43428 - protein, 9 aa, Mycobacterium tuberculosis
DEFDALLIF

SEQ ID NO: 43429 - protein, 9 aa, Mycobacterium tuberculosis
EFDALLIFD

SEQ ID NO: 43430 - protein, 9 aa, Mycobacterium tuberculosis
FDALLIFDE

SEQ ID NO: 43431 - protein, 9 aa, Mycobacterium tuberculosis
DALLIFDEV

SEQ ID NO: 43432 - protein, 9 aa, Mycobacterium tuberculosis
ALLIFDEVQ

SEQ ID NO: 43433 - protein, 9 aa, Mycobacterium tuberculosis
LLIFDEVQT

SEQ ID NO: 43434 - protein, 9 aa, Mycobacterium tuberculosis
LIFDEVQTG

SEQ ID NO: 43435 - protein, 9 aa, Mycobacterium tuberculosis
IFDEVQTGC

SEQ ID NO: 43436 - protein, 9 aa, Mycobacterium tuberculosis
FDEVQTGCG

SEQ ID NO: 43437 - protein, 9 aa, Mycobacterium tuberculosis
DEVQTGCGL

SEQ ID NO: 43438 - protein, 9 aa, Mycobacterium tuberculosis
EVQTGCGLT

SEQ ID NO: 43439 - protein, 9 aa, Mycobacterium tuberculosis
VQTGCGLTG

SEQ ID NO: 43440 - protein, 9 aa, Mycobacterium tuberculosis
QTGCGLTGT

SEQ ID NO: 43441 - protein, 9 aa, Mycobacterium tuberculosis
TGCGLTGTA

SEQ ID NO: 43442 - protein, 9 aa, Mycobacterium tuberculosis
GCGLTGTAW

SEQ ID NO: 43443 - protein, 9 aa, Mycobacterium tuberculosis
CGLTGTAWA

SEQ ID NO: 43444 - protein, 9 aa, Mycobacterium tuberculosis
GLTGTAWAY

SEQ ID NO: 43445 - protein, 9 aa, Mycobacterium tuberculosis
LTGTAWAYQ

SEQ ID NO: 43446 - protein, 9 aa, Mycobacterium tuberculosis
TGTAWAYQQ

SEQ ID NO: 43447 - protein, 9 aa, Mycobacterium tuberculosis
GTAWAYQQL

SEQ ID NO: 43448 - protein, 9 aa, Mycobacterium tuberculosis
TAWAYQQLD

SEQ ID NO: 43449 - protein, 9 aa, Mycobacterium tuberculosis
AWAYQQLDV

SEQ ID NO: 43450 - protein, 9 aa, Mycobacterium tuberculosis
WAYQQLDVA

SEQ ID NO: 43451 - protein, 9 aa, Mycobacterium tuberculosis
AYQQLDVAP

SEQ ID NO: 43452 - protein, 9 aa, Mycobacterium tuberculosis
YQQLDVAPD

SEQ ID NO: 43453 - protein, 9 aa, Mycobacterium tuberculosis
QQLDVAPDI

SEQ ID NO: 43454 - protein, 9 aa, Mycobacterium tuberculosis
QLDVAPDIV

SEQ ID NO: 43455 - protein, 9 aa, Mycobacterium tuberculosis
LDVAPDIVA

SEQ ID NO: 43456 - protein, 9 aa, Mycobacterium tuberculosis
DVAPDIVAF

SEQ ID NO: 43457 - protein, 9 aa, Mycobacterium tuberculosis
VAPDIVAFG

SEQ ID NO: 43458 - protein, 9 aa, Mycobacterium tuberculosis
APDIVAFGK

SEQ ID NO: 43459 - protein, 9 aa, Mycobacterium tuberculosis
PDIVAFGKK

SEQ ID NO: 43460 - protein, 9 aa, Mycobacterium tuberculosis
DIVAFGKKT

SEQ ID NO: 43461 - protein, 9 aa, Mycobacterium tuberculosis
IVAFGKKTQ

SEQ ID NO: 43462 - protein, 9 aa, Mycobacterium tuberculosis
VAFGKKTQV

SEQ ID NO: 43463 - protein, 9 aa, Mycobacterium tuberculosis
AFGKKTQVC

SEQ ID NO: 43464 - protein, 9 aa, Mycobacterium tuberculosis
FGKKTQVCG

SEQ ID NO: 43465 - protein, 9 aa, Mycobacterium tuberculosis
GKKTQVCGV

SEQ ID NO: 43466 - protein, 9 aa, Mycobacterium tuberculosis
KKTQVCGVM

SEQ ID NO: 43467 - protein, 9 aa, Mycobacterium tuberculosis
KTQVCGVMA

SEQ ID NO: 43468 - protein, 9 aa, Mycobacterium tuberculosis
TQVCGVMAG

SEQ ID NO: 43469 - protein, 9 aa, Mycobacterium tuberculosis
QVCGVMAGR

SEQ ID NO: 43470 - protein, 9 aa, Mycobacterium tuberculosis
VCGVMAGRR

SEQ ID NO: 43471 - protein, 9 aa, Mycobacterium tuberculosis
CGVMAGRRV

SEQ ID NO: 43472 - protein, 9 aa, Mycobacterium tuberculosis
GVMAGRRVD

SEQ ID NO: 43473 - protein, 9 aa, Mycobacterium tuberculosis
VMAGRRVDE

SEQ ID NO: 43474 - protein, 9 aa, Mycobacterium tuberculosis
MAGRRVDEV

SEQ ID NO: 43475 - protein, 9 aa, Mycobacterium tuberculosis
AGRRVDEVA

SEQ ID NO: 43476 - protein, 9 aa, Mycobacterium tuberculosis
GRRVDEVAD

SEQ ID NO: 43477 - protein, 9 aa, Mycobacterium tuberculosis
RRVDEVADN

SEQ ID NO: 43478 - protein, 9 aa, Mycobacterium tuberculosis
RVDEVADNV

SEQ ID NO: 43479 - protein, 9 aa, Mycobacterium tuberculosis
VDEVADNVF

SEQ ID NO: 43480 - protein, 9 aa, Mycobacterium tuberculosis
DEVADNVFA

SEQ ID NO: 43481 - protein, 9 aa, Mycobacterium tuberculosis
EVADNVFAV

SEQ ID NO: 43482 - protein, 9 aa, Mycobacterium tuberculosis
VADNVFAVP

SEQ ID NO: 43483 - protein, 9 aa, Mycobacterium tuberculosis
ADNVFAVPS

SEQ ID NO: 43484 - protein, 9 aa, Mycobacterium tuberculosis
DNVFAVPSR

SEQ ID NO: 43485 - protein, 9 aa, Mycobacterium tuberculosis
NVFAVPSRL

SEQ ID NO: 43486 - protein, 9 aa, Mycobacterium tuberculosis
VFAVPSRLN

SEQ ID NO: 43487 - protein, 9 aa, Mycobacterium tuberculosis
FAVPSRLNS

SEQ ID NO: 43488 - protein, 9 aa, Mycobacterium tuberculosis
AVPSRLNST

SEQ ID NO: 43489 - protein, 9 aa, Mycobacterium tuberculosis
VPSRLNSTW

SEQ ID NO: 43490 - protein, 9 aa, Mycobacterium tuberculosis
PSRLNSTWG

SEQ ID NO: 43491 - protein, 9 aa, Mycobacterium tuberculosis
SRLNSTWGG

SEQ ID NO: 43492 - protein, 9 aa, Mycobacterium tuberculosis
RLNSTWGGN

SEQ ID NO: 43493 - protein, 9 aa, Mycobacterium tuberculosis
LNSTWGGNL

SEQ ID NO: 43494 - protein, 9 aa, Mycobacterium tuberculosis
NSTWGGNLT

SEQ ID NO: 43495 - protein, 9 aa, Mycobacterium tuberculosis
STWGGNLTD

SEQ ID NO: 43496 - protein, 9 aa, Mycobacterium tuberculosis
TWGGNLTDM

SEQ ID NO: 43497 - protein, 9 aa, Mycobacterium tuberculosis
WGGNLTDMV

SEQ ID NO: 43498 - protein, 9 aa, Mycobacterium tuberculosis
GGNLTDMVR

SEQ ID NO: 43499 - protein, 9 aa, Mycobacterium tuberculosis
GNLTDMVRA

SEQ ID NO: 43500 - protein, 9 aa, Mycobacterium tuberculosis
NLTDMVRAR

SEQ ID NO: 43501 - protein, 9 aa, Mycobacterium tuberculosis
LTDMVRARR

SEQ ID NO: 43502 - protein, 9 aa, Mycobacterium tuberculosis
TDMVRARRI

SEQ ID NO: 43503 - protein, 9 aa, Mycobacterium tuberculosis
DMVRARRIL

SEQ ID NO: 43504 - protein, 9 aa, Mycobacterium tuberculosis
MVRARRILE

SEQ ID NO: 43505 - protein, 9 aa, Mycobacterium tuberculosis
VRARRILEV

SEQ ID NO: 43506 - protein, 9 aa, Mycobacterium tuberculosis
RARRILEVI

SEQ ID NO: 43507 - protein, 9 aa, Mycobacterium tuberculosis
ARRILEVIE

SEQ ID NO: 43508 - protein, 9 aa, Mycobacterium tuberculosis
RRILEVIEA

SEQ ID NO: 43509 - protein, 9 aa, Mycobacterium tuberculosis
RILEVIEAE

SEQ ID NO: 43510 - protein, 9 aa, Mycobacterium tuberculosis
ILEVIEAEG

SEQ ID NO: 43511 - protein, 9 aa, Mycobacterium tuberculosis
LEVIEAEGL

SEQ ID NO: 43512 - protein, 9 aa, Mycobacterium tuberculosis
EVIEAEGLF

SEQ ID NO: 43513 - protein, 9 aa, Mycobacterium tuberculosis
VIEAEGLFE

SEQ ID NO: 43514 - protein, 9 aa, Mycobacterium tuberculosis
IEAEGLFER

SEQ ID NO: 43515 - protein, 9 aa, Mycobacterium tuberculosis
EAEGLFERA

SEQ ID NO: 43516 - protein, 9 aa, Mycobacterium tuberculosis
AEGLFERAV

SEQ ID NO: 43517 - protein, 9 aa, Mycobacterium tuberculosis
EGLFERAVQ

SEQ ID NO: 43518 - protein, 9 aa, Mycobacterium tuberculosis
GLFERAVQH

SEQ ID NO: 43519 - protein, 9 aa, Mycobacterium tuberculosis
LFERAVQHG

SEQ ID NO: 43520 - protein, 9 aa, Mycobacterium tuberculosis
FERAVQHGK

SEQ ID NO: 43521 - protein, 9 aa, Mycobacterium tuberculosis
ERAVQHGKY

SEQ ID NO: 43522 - protein, 9 aa, Mycobacterium tuberculosis
RAVQHGKYL

SEQ ID NO: 43523 - protein, 9 aa, Mycobacterium tuberculosis
AVQHGKYLR

SEQ ID NO: 43524 - protein, 9 aa, Mycobacterium tuberculosis
VQHGKYLRA

SEQ ID NO: 43525 - protein, 9 aa, Mycobacterium tuberculosis
QHGKYLRAR

SEQ ID NO: 43526 - protein, 9 aa, Mycobacterium tuberculosis
HGKYLRARL

SEQ ID NO: 43527 - protein, 9 aa, Mycobacterium tuberculosis
GKYLRARLD

SEQ ID NO: 43528 - protein, 9 aa, Mycobacterium tuberculosis
KYLRARLDE

SEQ ID NO: 43529 - protein, 9 aa, Mycobacterium tuberculosis
YLRARLDEL

SEQ ID NO: 43530 - protein, 9 aa, Mycobacterium tuberculosis
LRARLDELA

SEQ ID NO: 43531 - protein, 9 aa, Mycobacterium tuberculosis
RARLDELAA

SEQ ID NO: 43532 - protein, 9 aa, Mycobacterium tuberculosis
ARLDELAAD

SEQ ID NO: 43533 - protein, 9 aa, Mycobacterium tuberculosis
RLDELAADF

SEQ ID NO: 43534 - protein, 9 aa, Mycobacterium tuberculosis
LDELAADFP

SEQ ID NO: 43535 - protein, 9 aa, Mycobacterium tuberculosis
DELAADFPA

SEQ ID NO: 43536 - protein, 9 aa, Mycobacterium tuberculosis
ELAADFPAV

SEQ ID NO: 43537 - protein, 9 aa, Mycobacterium tuberculosis
LAADFPAVV

SEQ ID NO: 43538 - protein, 9 aa, Mycobacterium tuberculosis
AADFPAVVL

SEQ ID NO: 43539 - protein, 9 aa, Mycobacterium tuberculosis
ADFPAVVLD

SEQ ID NO: 43540 - protein, 9 aa, Mycobacterium tuberculosis
DFPAVVLDP

SEQ ID NO: 43541 - protein, 9 aa, Mycobacterium tuberculosis
FPAVVLDPR

SEQ ID NO: 43542 - protein, 9 aa, Mycobacterium tuberculosis
PAVVLDPRG

SEQ ID NO: 43543 - protein, 9 aa, Mycobacterium tuberculosis
AVVLDPRGR

SEQ ID NO: 43544 - protein, 9 aa, Mycobacterium tuberculosis
VVLDPRGRG

SEQ ID NO: 43545 - protein, 9 aa, Mycobacterium tuberculosis
VLDPRGRGL

SEQ ID NO: 43546 - protein, 9 aa, Mycobacterium tuberculosis
LDPRGRGLM

SEQ ID NO: 43547 - protein, 9 aa, Mycobacterium tuberculosis
DPRGRGLMC

SEQ ID NO: 43548 - protein, 9 aa, Mycobacterium tuberculosis
PRGRGLMCA

SEQ ID NO: 43549 - protein, 9 aa, Mycobacterium tuberculosis
RGRGLMCAF

SEQ ID NO: 43550 - protein, 9 aa, Mycobacterium tuberculosis
GRGLMCAFS

SEQ ID NO: 43551 - protein, 9 aa, Mycobacterium tuberculosis
RGLMCAFSL

SEQ ID NO: 43552 - protein, 9 aa, Mycobacterium tuberculosis
GLMCAFSLP

SEQ ID NO: 43553 - protein, 9 aa, Mycobacterium tuberculosis
LMCAFSLPT

SEQ ID NO: 43554 - protein, 9 aa, Mycobacterium tuberculosis
MCAFSLPTT

SEQ ID NO: 43555 - protein, 9 aa, Mycobacterium tuberculosis
CAFSLPTTA

SEQ ID NO: 43556 - protein, 9 aa, Mycobacterium tuberculosis
AFSLPTTAD

SEQ ID NO: 43557 - protein, 9 aa, Mycobacterium tuberculosis
FSLPTTADR

SEQ ID NO: 43558 - protein, 9 aa, Mycobacterium tuberculosis
SLPTTADRD

SEQ ID NO: 43559 - protein, 9 aa, Mycobacterium tuberculosis
LPTTADRDE

SEQ ID NO: 43560 - protein, 9 aa, Mycobacterium tuberculosis
PTTADRDEL

SEQ ID NO: 43561 - protein, 9 aa, Mycobacterium tuberculosis
TTADRDELI

SEQ ID NO: 43562 - protein, 9 aa, Mycobacterium tuberculosis
TADRDELIR

SEQ ID NO: 43563 - protein, 9 aa, Mycobacterium tuberculosis
ADRDELIRQ

SEQ ID NO: 43564 - protein, 9 aa, Mycobacterium tuberculosis
DRDELIRQL

SEQ ID NO: 43565 - protein, 9 aa, Mycobacterium tuberculosis
RDELIRQLW

SEQ ID NO: 43566 - protein, 9 aa, Mycobacterium tuberculosis
DELIRQLWQ

SEQ ID NO: 43567 - protein, 9 aa, Mycobacterium tuberculosis
ELIRQLWQR

SEQ ID NO: 43568 - protein, 9 aa, Mycobacterium tuberculosis
LIRQLWQRA

SEQ ID NO: 43569 - protein, 9 aa, Mycobacterium tuberculosis
IRQLWQRAV

SEQ ID NO: 43570 - protein, 9 aa, Mycobacterium tuberculosis
RQLWQRAVI

SEQ ID NO: 43571 - protein, 9 aa, Mycobacterium tuberculosis
QLWQRAVIV

SEQ ID NO: 43572 - protein, 9 aa, Mycobacterium tuberculosis
LWQRAVIVL

SEQ ID NO: 43573 - protein, 9 aa, Mycobacterium tuberculosis
WQRAVIVLP

SEQ ID NO: 43574 - protein, 9 aa, Mycobacterium tuberculosis
QRAVIVLPA

SEQ ID NO: 43575 - protein, 9 aa, Mycobacterium tuberculosis
RAVIVLPAG

SEQ ID NO: 43576 - protein, 9 aa, Mycobacterium tuberculosis
AVIVLPAGA

SEQ ID NO: 43577 - protein, 9 aa, Mycobacterium tuberculosis
VIVLPAGAD

SEQ ID NO: 43578 - protein, 9 aa, Mycobacterium tuberculosis
IVLPAGADT

SEQ ID NO: 43579 - protein, 9 aa, Mycobacterium tuberculosis
VLPAGADTV

SEQ ID NO: 43580 - protein, 9 aa, Mycobacterium tuberculosis
LPAGADTVR

SEQ ID NO: 43581 - protein, 9 aa, Mycobacterium tuberculosis
PAGADTVRF

SEQ ID NO: 43582 - protein, 9 aa, Mycobacterium tuberculosis
AGADTVRFR

SEQ ID NO: 43583 - protein, 9 aa, Mycobacterium tuberculosis
GADTVRFRP

SEQ ID NO: 43584 - protein, 9 aa, Mycobacterium tuberculosis
ADTVRFRPP

SEQ ID NO: 43585 - protein, 9 aa, Mycobacterium tuberculosis
DTVRFRPPL

SEQ ID NO: 43586 - protein, 9 aa, Mycobacterium tuberculosis
TVRFRPPLT

SEQ ID NO: 43587 - protein, 9 aa, Mycobacterium tuberculosis
VRFRPPLTV

SEQ ID NO: 43588 - protein, 9 aa, Mycobacterium tuberculosis
RFRPPLTVS

SEQ ID NO: 43589 - protein, 9 aa, Mycobacterium tuberculosis
FRPPLTVST

SEQ ID NO: 43590 - protein, 9 aa, Mycobacterium tuberculosis
RPPLTVSTA

SEQ ID NO: 43591 - protein, 9 aa, Mycobacterium tuberculosis
PPLTVSTAE

SEQ ID NO: 43592 - protein, 9 aa, Mycobacterium tuberculosis
PLTVSTAEI

SEQ ID NO: 43593 - protein, 9 aa, Mycobacterium tuberculosis
LTVSTAEID

SEQ ID NO: 43594 - protein, 9 aa, Mycobacterium tuberculosis
TVSTAEIDA

SEQ ID NO: 43595 - protein, 9 aa, Mycobacterium tuberculosis
VSTAEIDAA

SEQ ID NO: 43596 - protein, 9 aa, Mycobacterium tuberculosis
STAEIDAAI

SEQ ID NO: 43597 - protein, 9 aa, Mycobacterium tuberculosis
TAEIDAAIA

SEQ ID NO: 43598 - protein, 9 aa, Mycobacterium tuberculosis
AEIDAAIAA

SEQ ID NO: 43599 - protein, 9 aa, Mycobacterium tuberculosis
EIDAAIAAV

SEQ ID NO: 43600 - protein, 9 aa, Mycobacterium tuberculosis
IDAAIAAVR

SEQ ID NO: 43601 - protein, 9 aa, Mycobacterium tuberculosis
DAAIAAVRS

SEQ ID NO: 43602 - protein, 9 aa, Mycobacterium tuberculosis
AAIAAVRSA

SEQ ID NO: 43603 - protein, 9 aa, Mycobacterium tuberculosis
AIAAVRSAL

SEQ ID NO: 43604 - protein, 9 aa, Mycobacterium tuberculosis
IAAVRSALP

SEQ ID NO: 43605 - protein, 9 aa, Mycobacterium tuberculosis
AAVRSALPV

SEQ ID NO: 43606 - protein, 9 aa, Mycobacterium tuberculosis
AVRSALPVV

SEQ ID NO: 43607 - protein, 9 aa, Mycobacterium tuberculosis
VRSALPVVT

SEQ ID NO: 43608 - protein, 10 aa, Mycobacterium tuberculosis
MAAVVKSVAL

SEQ ID NO: 43609 - protein, 10 aa, Mycobacterium tuberculosis
AAVVKSVALA

SEQ ID NO: 43610 - protein, 10 aa, Mycobacterium tuberculosis
AVVKSVALAG

SEQ ID NO: 43611 - protein, 10 aa, Mycobacterium tuberculosis
VVKSVALAGR

SEQ ID NO: 43612 - protein, 10 aa, Mycobacterium tuberculosis
VKSVALAGRP

SEQ ID NO: 43613 - protein, 10 aa, Mycobacterium tuberculosis
KSVALAGRPT

SEQ ID NO: 43614 - protein, 10 aa, Mycobacterium tuberculosis
SVALAGRPTT

SEQ ID NO: 43615 - protein, 10 aa, Mycobacterium tuberculosis
VALAGRPTTP

SEQ ID NO: 43616 - protein, 10 aa, Mycobacterium tuberculosis
ALAGRPTTPD

SEQ ID NO: 43617 - protein, 10 aa, Mycobacterium tuberculosis
LAGRPTTPDR

SEQ ID NO: 43618 - protein, 10 aa, Mycobacterium tuberculosis
AGRPTTPDRV

SEQ ID NO: 43619 - protein, 10 aa, Mycobacterium tuberculosis
GRPTTPDRVH

SEQ ID NO: 43620 - protein, 10 aa, Mycobacterium tuberculosis
RPTTPDRVHE

SEQ ID NO: 43621 - protein, 10 aa, Mycobacterium tuberculosis
PTTPDRVHEV

SEQ ID NO: 43622 - protein, 10 aa, Mycobacterium tuberculosis
TTPDRVHEVL

SEQ ID NO: 43623 - protein, 10 aa, Mycobacterium tuberculosis
TPDRVHEVLG

SEQ ID NO: 43624 - protein, 10 aa, Mycobacterium tuberculosis
PDRVHEVLGR

SEQ ID NO: 43625 - protein, 10 aa, Mycobacterium tuberculosis
DRVHEVLGRS

SEQ ID NO: 43626 - protein, 10 aa, Mycobacterium tuberculosis
RVHEVLGRSM

SEQ ID NO: 43627 - protein, 10 aa, Mycobacterium tuberculosis
VHEVLGRSML

SEQ ID NO: 43628 - protein, 10 aa, Mycobacterium tuberculosis
HEVLGRSMLV

SEQ ID NO: 43629 - protein, 10 aa, Mycobacterium tuberculosis
EVLGRSMLVD

SEQ ID NO: 43630 - protein, 10 aa, Mycobacterium tuberculosis
VLGRSMLVDG

SEQ ID NO: 43631 - protein, 10 aa, Mycobacterium tuberculosis
LGRSMLVDGL

SEQ ID NO: 43632 - protein, 10 aa, Mycobacterium tuberculosis
GRSMLVDGLD

SEQ ID NO: 43633 - protein, 10 aa, Mycobacterium tuberculosis
RSMLVDGLDI

SEQ ID NO: 43634 - protein, 10 aa, Mycobacterium tuberculosis
SMLVDGLDIV

SEQ ID NO: 43635 - protein, 10 aa, Mycobacterium tuberculosis
MLVDGLDIVL

SEQ ID NO: 43636 - protein, 10 aa, Mycobacterium tuberculosis
LVDGLDIVLD

SEQ ID NO: 43637 - protein, 10 aa, Mycobacterium tuberculosis
VDGLDIVLDL

SEQ ID NO: 43638 - protein, 10 aa, Mycobacterium tuberculosis
DGLDIVLDLT

SEQ ID NO: 43639 - protein, 10 aa, Mycobacterium tuberculosis
GLDIVLDLTR

SEQ ID NO: 43640 - protein, 10 aa, Mycobacterium tuberculosis
LDIVLDLTRS

SEQ ID NO: 43641 - protein, 10 aa, Mycobacterium tuberculosis
DIVLDLTRSG

SEQ ID NO: 43642 - protein, 10 aa, Mycobacterium tuberculosis
IVLDLTRSGG

SEQ ID NO: 43643 - protein, 10 aa, Mycobacterium tuberculosis
VLDLTRSGGS

SEQ ID NO: 43644 - protein, 10 aa, Mycobacterium tuberculosis
LDLTRSGGSY

SEQ ID NO: 43645 - protein, 10 aa, Mycobacterium tuberculosis
DLTRSGGSYL

SEQ ID NO: 43646 - protein, 10 aa, Mycobacterium tuberculosis
LTRSGGSYLV

SEQ ID NO: 43647 - protein, 10 aa, Mycobacterium tuberculosis
TRSGGSYLVD

SEQ ID NO: 43648 - protein, 10 aa, Mycobacterium tuberculosis
RSGGSYLVDA

SEQ ID NO: 43649 - protein, 10 aa, Mycobacterium tuberculosis
SGGSYLVDAI

SEQ ID NO: 43650 - protein, 10 aa, Mycobacterium tuberculosis
GGSYLVDAIT

SEQ ID NO: 43651 - protein, 10 aa, Mycobacterium tuberculosis
GSYLVDAITG

SEQ ID NO: 43652 - protein, 10 aa, Mycobacterium tuberculosis
SYLVDAITGR

SEQ ID NO: 43653 - protein, 10 aa, Mycobacterium tuberculosis
YLVDAITGRR

SEQ ID NO: 43654 - protein, 10 aa, Mycobacterium tuberculosis
LVDAITGRRY

SEQ ID NO: 43655 - protein, 10 aa, Mycobacterium tuberculosis
VDAITGRRYL

SEQ ID NO: 43656 - protein, 10 aa, Mycobacterium tuberculosis
DAITGRRYLD

SEQ ID NO: 43657 - protein, 10 aa, Mycobacterium tuberculosis
AITGRRYLDM

SEQ ID NO: 43658 - protein, 10 aa, Mycobacterium tuberculosis
ITGRRYLDMF

SEQ ID NO: 43659 - protein, 10 aa, Mycobacterium tuberculosis
TGRRYLDMFT

SEQ ID NO: 43660 - protein, 10 aa, Mycobacterium tuberculosis
GRRYLDMFTF

SEQ ID NO: 43661 - protein, 10 aa, Mycobacterium tuberculosis
RRYLDMFTFV

SEQ ID NO: 43662 - protein, 10 aa, Mycobacterium tuberculosis
RYLDMFTFVA

SEQ ID NO: 43663 - protein, 10 aa, Mycobacterium tuberculosis
YLDMFTFVAS

SEQ ID NO: 43664 - protein, 10 aa, Mycobacterium tuberculosis
LDMFTFVASS

SEQ ID NO: 43665 - protein, 10 aa, Mycobacterium tuberculosis
DMFTFVASSA

SEQ ID NO: 43666 - protein, 10 aa, Mycobacterium tuberculosis
MFTFVASSAL

SEQ ID NO: 43667 - protein, 10 aa, Mycobacterium tuberculosis
FTFVASSALG

SEQ ID NO: 43668 - protein, 10 aa, Mycobacterium tuberculosis
TFVASSALGM

SEQ ID NO: 43669 - protein, 10 aa, Mycobacterium tuberculosis
FVASSALGMN

SEQ ID NO: 43670 - protein, 10 aa, Mycobacterium tuberculosis
VASSALGMNP

SEQ ID NO: 43671 - protein, 10 aa, Mycobacterium tuberculosis
ASSALGMNPP

SEQ ID NO: 43672 - protein, 10 aa, Mycobacterium tuberculosis
SSALGMNPPA

SEQ ID NO: 43673 - protein, 10 aa, Mycobacterium tuberculosis
SALGMNPPAL

SEQ ID NO: 43674 - protein, 10 aa, Mycobacterium tuberculosis
ALGMNPPALV

SEQ ID NO: 43675 - protein, 10 aa, Mycobacterium tuberculosis
LGMNPPALVD

SEQ ID NO: 43676 - protein, 10 aa, Mycobacterium tuberculosis
GMNPPALVDD

SEQ ID NO: 43677 - protein, 10 aa, Mycobacterium tuberculosis
MNPPALVDDR

SEQ ID NO: 43678 - protein, 10 aa, Mycobacterium tuberculosis
NPPALVDDRE

SEQ ID NO: 43679 - protein, 10 aa, Mycobacterium tuberculosis
PPALVDDREF

SEQ ID NO: 43680 - protein, 10 aa, Mycobacterium tuberculosis
PALVDDREFH

SEQ ID NO: 43681 - protein, 10 aa, Mycobacterium tuberculosis
ALVDDREFHA

SEQ ID NO: 43682 - protein, 10 aa, Mycobacterium tuberculosis
LVDDREFHAE

SEQ ID NO: 43683 - protein, 10 aa, Mycobacterium tuberculosis
VDDREFHAEL

SEQ ID NO: 43684 - protein, 10 aa, Mycobacterium tuberculosis
DDREFHAELM

SEQ ID NO: 43685 - protein, 10 aa, Mycobacterium tuberculosis
DREFHAELMQ

SEQ ID NO: 43686 - protein, 10 aa, Mycobacterium tuberculosis
REFHAELMQA

SEQ ID NO: 43687 - protein, 10 aa, Mycobacterium tuberculosis
EFHAELMQAA

SEQ ID NO: 43688 - protein, 10 aa, Mycobacterium tuberculosis
FHAELMQAAL

SEQ ID NO: 43689 - protein, 10 aa, Mycobacterium tuberculosis
HAELMQAALN

SEQ ID NO: 43690 - protein, 10 aa, Mycobacterium tuberculosis
AELMQAALNK

SEQ ID NO: 43691 - protein, 10 aa, Mycobacterium tuberculosis
ELMQAALNKP

SEQ ID NO: 43692 - protein, 10 aa, Mycobacterium tuberculosis
LMQAALNKPS

SEQ ID NO: 43693 - protein, 10 aa, Mycobacterium tuberculosis
MQAALNKPSN

SEQ ID NO: 43694 - protein, 10 aa, Mycobacterium tuberculosis
QAALNKPSNS

SEQ ID NO: 43695 - protein, 10 aa, Mycobacterium tuberculosis
AALNKPSNSD

SEQ ID NO: 43696 - protein, 10 aa, Mycobacterium tuberculosis
ALNKPSNSDV

SEQ ID NO: 43697 - protein, 10 aa, Mycobacterium tuberculosis
LNKPSNSDVY

SEQ ID NO: 43698 - protein, 10 aa, Mycobacterium tuberculosis
NKPSNSDVYS

SEQ ID NO: 43699 - protein, 10 aa, Mycobacterium tuberculosis
KPSNSDVYSV

SEQ ID NO: 43700 - protein, 10 aa, Mycobacterium tuberculosis
PSNSDVYSVA

SEQ ID NO: 43701 - protein, 10 aa, Mycobacterium tuberculosis
SNSDVYSVAM

SEQ ID NO: 43702 - protein, 10 aa, Mycobacterium tuberculosis
NSDVYSVAMA

SEQ ID NO: 43703 - protein, 10 aa, Mycobacterium tuberculosis
SDVYSVAMAR

SEQ ID NO: 43704 - protein, 10 aa, Mycobacterium tuberculosis
DVYSVAMARF

SEQ ID NO: 43705 - protein, 10 aa, Mycobacterium tuberculosis
VYSVAMARFV

SEQ ID NO: 43706 - protein, 10 aa, Mycobacterium tuberculosis
YSVAMARFVE

SEQ ID NO: 43707 - protein, 10 aa, Mycobacterium tuberculosis
SVAMARFVET

SEQ ID NO: 43708 - protein, 10 aa, Mycobacterium tuberculosis
VAMARFVETF

SEQ ID NO: 43709 - protein, 10 aa, Mycobacterium tuberculosis
AMARFVETFA

SEQ ID NO: 43710 - protein, 10 aa, Mycobacterium tuberculosis
MARFVETFAR

SEQ ID NO: 43711 - protein, 10 aa, Mycobacterium tuberculosis
ARFVETFARV

SEQ ID NO: 43712 - protein, 10 aa, Mycobacterium tuberculosis
RFVETFARVL

SEQ ID NO: 43713 - protein, 10 aa, Mycobacterium tuberculosis
FVETFARVLG

SEQ ID NO: 43714 - protein, 10 aa, Mycobacterium tuberculosis
VETFARVLGD

SEQ ID NO: 43715 - protein, 10 aa, Mycobacterium tuberculosis
ETFARVLGDP

SEQ ID NO: 43716 - protein, 10 aa, Mycobacterium tuberculosis
TFARVLGDPA

SEQ ID NO: 43717 - protein, 10 aa, Mycobacterium tuberculosis
FARVLGDPAL

SEQ ID NO: 43718 - protein, 10 aa, Mycobacterium tuberculosis
ARVLGDPALP

SEQ ID NO: 43719 - protein, 10 aa, Mycobacterium tuberculosis
RVLGDPALPH

SEQ ID NO: 43720 - protein, 10 aa, Mycobacterium tuberculosis
VLGDPALPHL

SEQ ID NO: 43721 - protein, 10 aa, Mycobacterium tuberculosis
LGDPALPHLF

SEQ ID NO: 43722 - protein, 10 aa, Mycobacterium tuberculosis
GDPALPHLFF

SEQ ID NO: 43723 - protein, 10 aa, Mycobacterium tuberculosis
DPALPHLFFV

SEQ ID NO: 43724 - protein, 10 aa, Mycobacterium tuberculosis
PALPHLFFVE

SEQ ID NO: 43725 - protein, 10 aa, Mycobacterium tuberculosis
ALPHLFFVEG

SEQ ID NO: 43726 - protein, 10 aa, Mycobacterium tuberculosis
LPHLFFVEGG

SEQ ID NO: 43727 - protein, 10 aa, Mycobacterium tuberculosis
PHLFFVEGGA

SEQ ID NO: 43728 - protein, 10 aa, Mycobacterium tuberculosis
HLFFVEGGAL

SEQ ID NO: 43729 - protein, 10 aa, Mycobacterium tuberculosis
LFFVEGGALA

SEQ ID NO: 43730 - protein, 10 aa, Mycobacterium tuberculosis
FFVEGGALAV

SEQ ID NO: 43731 - protein, 10 aa, Mycobacterium tuberculosis
FVEGGALAVE

SEQ ID NO: 43732 - protein, 10 aa, Mycobacterium tuberculosis
VEGGALAVEN

SEQ ID NO: 43733 - protein, 10 aa, Mycobacterium tuberculosis
EGGALAVENA

SEQ ID NO: 43734 - protein, 10 aa, Mycobacterium tuberculosis
GGALAVENAL

SEQ ID NO: 43735 - protein, 10 aa, Mycobacterium tuberculosis
GALAVENALK

SEQ ID NO: 43736 - protein, 10 aa, Mycobacterium tuberculosis
ALAVENALKA

SEQ ID NO: 43737 - protein, 10 aa, Mycobacterium tuberculosis
LAVENALKAA

SEQ ID NO: 43738 - protein, 10 aa, Mycobacterium tuberculosis
AVENALKAAF

SEQ ID NO: 43739 - protein, 10 aa, Mycobacterium tuberculosis
VENALKAAFD

SEQ ID NO: 43740 - protein, 10 aa, Mycobacterium tuberculosis
ENALKAAFDW

SEQ ID NO: 43741 - protein, 10 aa, Mycobacterium tuberculosis
NALKAAFDWK

SEQ ID NO: 43742 - protein, 10 aa, Mycobacterium tuberculosis
ALKAAFDWKS

SEQ ID NO: 43743 - protein, 10 aa, Mycobacterium tuberculosis
LKAAFDWKSR

SEQ ID NO: 43744 - protein, 10 aa, Mycobacterium tuberculosis
KAAFDWKSRH

SEQ ID NO: 43745 - protein, 10 aa, Mycobacterium tuberculosis
AAFDWKSRHN

SEQ ID NO: 43746 - protein, 10 aa, Mycobacterium tuberculosis
AFDWKSRHNQ

SEQ ID NO: 43747 - protein, 10 aa, Mycobacterium tuberculosis
FDWKSRHNQA

SEQ ID NO: 43748 - protein, 10 aa, Mycobacterium tuberculosis
DWKSRHNQAH

SEQ ID NO: 43749 - protein, 10 aa, Mycobacterium tuberculosis
WKSRHNQAHG

SEQ ID NO: 43750 - protein, 10 aa, Mycobacterium tuberculosis
KSRHNQAHGI

SEQ ID NO: 43751 - protein, 10 aa, Mycobacterium tuberculosis
SRHNQAHGID

SEQ ID NO: 43752 - protein, 10 aa, Mycobacterium tuberculosis
RHNQAHGIDP

SEQ ID NO: 43753 - protein, 10 aa, Mycobacterium tuberculosis
HNQAHGIDPA

SEQ ID NO: 43754 - protein, 10 aa, Mycobacterium tuberculosis
NQAHGIDPAL

SEQ ID NO: 43755 - protein, 10 aa, Mycobacterium tuberculosis
QAHGIDPALG

SEQ ID NO: 43756 - protein, 10 aa, Mycobacterium tuberculosis
AHGIDPALGT

SEQ ID NO: 43757 - protein, 10 aa, Mycobacterium tuberculosis
HGIDPALGTQ

SEQ ID NO: 43758 - protein, 10 aa, Mycobacterium tuberculosis
GIDPALGTQV

SEQ ID NO: 43759 - protein, 10 aa, Mycobacterium tuberculosis
IDPALGTQVL

SEQ ID NO: 43760 - protein, 10 aa, Mycobacterium tuberculosis
DPALGTQVLH

SEQ ID NO: 43761 - protein, 10 aa, Mycobacterium tuberculosis
PALGTQVLHL

SEQ ID NO: 43762 - protein, 10 aa, Mycobacterium tuberculosis
ALGTQVLHLR

SEQ ID NO: 43763 - protein, 10 aa, Mycobacterium tuberculosis
LGTQVLHLRG

SEQ ID NO: 43764 - protein, 10 aa, Mycobacterium tuberculosis
GTQVLHLRGA

SEQ ID NO: 43765 - protein, 10 aa, Mycobacterium tuberculosis
TQVLHLRGAF

SEQ ID NO: 43766 - protein, 10 aa, Mycobacterium tuberculosis
QVLHLRGAFH

SEQ ID NO: 43767 - protein, 10 aa, Mycobacterium tuberculosis
VLHLRGAFHG

SEQ ID NO: 43768 - protein, 10 aa, Mycobacterium tuberculosis
LHLRGAFHGR

SEQ ID NO: 43769 - protein, 10 aa, Mycobacterium tuberculosis
HLRGAFHGRS

SEQ ID NO: 43770 - protein, 10 aa, Mycobacterium tuberculosis
LRGAFHGRSG

SEQ ID NO: 43771 - protein, 10 aa, Mycobacterium tuberculosis
RGAFHGRSGY

SEQ ID NO: 43772 - protein, 10 aa, Mycobacterium tuberculosis
GAFHGRSGYT

SEQ ID NO: 43773 - protein, 10 aa, Mycobacterium tuberculosis
AFHGRSGYTL

SEQ ID NO: 43774 - protein, 10 aa, Mycobacterium tuberculosis
FHGRSGYTLS

SEQ ID NO: 43775 - protein, 10 aa, Mycobacterium tuberculosis
HGRSGYTLSL

SEQ ID NO: 43776 - protein, 10 aa, Mycobacterium tuberculosis
GRSGYTLSLT

SEQ ID NO: 43777 - protein, 10 aa, Mycobacterium tuberculosis
RSGYTLSLTN

SEQ ID NO: 43778 - protein, 10 aa, Mycobacterium tuberculosis
SGYTLSLTNT

SEQ ID NO: 43779 - protein, 10 aa, Mycobacterium tuberculosis
GYTLSLTNTK

SEQ ID NO: 43780 - protein, 10 aa, Mycobacterium tuberculosis
YTLSLTNTKP

SEQ ID NO: 43781 - protein, 10 aa, Mycobacterium tuberculosis
TLSLTNTKPT

SEQ ID NO: 43782 - protein, 10 aa, Mycobacterium tuberculosis
LSLTNTKPTI

SEQ ID NO: 43783 - protein, 10 aa, Mycobacterium tuberculosis
SLTNTKPTIT

SEQ ID NO: 43784 - protein, 10 aa, Mycobacterium tuberculosis
LTNTKPTITA

SEQ ID NO: 43785 - protein, 10 aa, Mycobacterium tuberculosis
TNTKPTITAR

SEQ ID NO: 43786 - protein, 10 aa, Mycobacterium tuberculosis
NTKPTITARF

SEQ ID NO: 43787 - protein, 10 aa, Mycobacterium tuberculosis
TKPTITARFP

SEQ ID NO: 43788 - protein, 10 aa, Mycobacterium tuberculosis
KPTITARFPK

SEQ ID NO: 43789 - protein, 10 aa, Mycobacterium tuberculosis
PTITARFPKF

SEQ ID NO: 43790 - protein, 10 aa, Mycobacterium tuberculosis
TITARFPKFD

SEQ ID NO: 43791 - protein, 10 aa, Mycobacterium tuberculosis
ITARFPKFDW

SEQ ID NO: 43792 - protein, 10 aa, Mycobacterium tuberculosis
TARFPKFDWP

SEQ ID NO: 43793 - protein, 10 aa, Mycobacterium tuberculosis
ARFPKFDWPR

SEQ ID NO: 43794 - protein, 10 aa, Mycobacterium tuberculosis
RFPKFDWPRI

SEQ ID NO: 43795 - protein, 10 aa, Mycobacterium tuberculosis
FPKFDWPRID

SEQ ID NO: 43796 - protein, 10 aa, Mycobacterium tuberculosis
PKFDWPRIDA

SEQ ID NO: 43797 - protein, 10 aa, Mycobacterium tuberculosis
KFDWPRIDAP

SEQ ID NO: 43798 - protein, 10 aa, Mycobacterium tuberculosis
FDWPRIDAPY

SEQ ID NO: 43799 - protein, 10 aa, Mycobacterium tuberculosis
DWPRIDAPYM

SEQ ID NO: 43800 - protein, 10 aa, Mycobacterium tuberculosis
WPRIDAPYMR

SEQ ID NO: 43801 - protein, 10 aa, Mycobacterium tuberculosis
PRIDAPYMRP

SEQ ID NO: 43802 - protein, 10 aa, Mycobacterium tuberculosis
RIDAPYMRPG

SEQ ID NO: 43803 - protein, 10 aa, Mycobacterium tuberculosis
IDAPYMRPGL

SEQ ID NO: 43804 - protein, 10 aa, Mycobacterium tuberculosis
DAPYMRPGLD

SEQ ID NO: 43805 - protein, 10 aa, Mycobacterium tuberculosis
APYMRPGLDE

SEQ ID NO: 43806 - protein, 10 aa, Mycobacterium tuberculosis
PYMRPGLDEP

SEQ ID NO: 43807 - protein, 10 aa, Mycobacterium tuberculosis
YMRPGLDEPA

SEQ ID NO: 43808 - protein, 10 aa, Mycobacterium tuberculosis
MRPGLDEPAM

SEQ ID NO: 43809 - protein, 10 aa, Mycobacterium tuberculosis
RPGLDEPAMA

SEQ ID NO: 43810 - protein, 10 aa, Mycobacterium tuberculosis
PGLDEPAMAA

SEQ ID NO: 43811 - protein, 10 aa, Mycobacterium tuberculosis
GLDEPAMAAL

SEQ ID NO: 43812 - protein, 10 aa, Mycobacterium tuberculosis
LDEPAMAALE

SEQ ID NO: 43813 - protein, 10 aa, Mycobacterium tuberculosis
DEPAMAALEA

SEQ ID NO: 43814 - protein, 10 aa, Mycobacterium tuberculosis
EPAMAALEAE

SEQ ID NO: 43815 - protein, 10 aa, Mycobacterium tuberculosis
PAMAALEAEA

SEQ ID NO: 43816 - protein, 10 aa, Mycobacterium tuberculosis
AMAALEAEAL

SEQ ID NO: 43817 - protein, 10 aa, Mycobacterium tuberculosis
MAALEAEALR

SEQ ID NO: 43818 - protein, 10 aa, Mycobacterium tuberculosis
AALEAEALRQ

SEQ ID NO: 43819 - protein, 10 aa, Mycobacterium tuberculosis
ALEAEALRQA

SEQ ID NO: 43820 - protein, 10 aa, Mycobacterium tuberculosis
LEAEALRQAR

SEQ ID NO: 43821 - protein, 10 aa, Mycobacterium tuberculosis
EAEALRQARA

SEQ ID NO: 43822 - protein, 10 aa, Mycobacterium tuberculosis
AEALRQARAA

SEQ ID NO: 43823 - protein, 10 aa, Mycobacterium tuberculosis
EALRQARAAF

SEQ ID NO: 43824 - protein, 10 aa, Mycobacterium tuberculosis
ALRQARAAFE

SEQ ID NO: 43825 - protein, 10 aa, Mycobacterium tuberculosis
LRQARAAFET

SEQ ID NO: 43826 - protein, 10 aa, Mycobacterium tuberculosis
RQARAAFETR

SEQ ID NO: 43827 - protein, 10 aa, Mycobacterium tuberculosis
QARAAFETRP

SEQ ID NO: 43828 - protein, 10 aa, Mycobacterium tuberculosis
ARAAFETRPH

SEQ ID NO: 43829 - protein, 10 aa, Mycobacterium tuberculosis
RAAFETRPHD

SEQ ID NO: 43830 - protein, 10 aa, Mycobacterium tuberculosis
AAFETRPHDI

SEQ ID NO: 43831 - protein, 10 aa, Mycobacterium tuberculosis
AFETRPHDIA

SEQ ID NO: 43832 - protein, 10 aa, Mycobacterium tuberculosis
FETRPHDIAC

SEQ ID NO: 43833 - protein, 10 aa, Mycobacterium tuberculosis
ETRPHDIACF

SEQ ID NO: 43834 - protein, 10 aa, Mycobacterium tuberculosis
TRPHDIACFV

SEQ ID NO: 43835 - protein, 10 aa, Mycobacterium tuberculosis
RPHDIACFVA

SEQ ID NO: 43836 - protein, 10 aa, Mycobacterium tuberculosis
PHDIACFVAE

SEQ ID NO: 43837 - protein, 10 aa, Mycobacterium tuberculosis
HDIACFVAEP

SEQ ID NO: 43838 - protein, 10 aa, Mycobacterium tuberculosis
DIACFVAEPI

SEQ ID NO: 43839 - protein, 10 aa, Mycobacterium tuberculosis
IACFVAEPIQ

SEQ ID NO: 43840 - protein, 10 aa, Mycobacterium tuberculosis
ACFVAEPIQG

SEQ ID NO: 43841 - protein, 10 aa, Mycobacterium tuberculosis
CFVAEPIQGE

SEQ ID NO: 43842 - protein, 10 aa, Mycobacterium tuberculosis
FVAEPIQGEG

SEQ ID NO: 43843 - protein, 10 aa, Mycobacterium tuberculosis
VAEPIQGEGG

SEQ ID NO: 43844 - protein, 10 aa, Mycobacterium tuberculosis
AEPIQGEGGD

SEQ ID NO: 43845 - protein, 10 aa, Mycobacterium tuberculosis
EPIQGEGGDR

SEQ ID NO: 43846 - protein, 10 aa, Mycobacterium tuberculosis
PIQGEGGDRH

SEQ ID NO: 43847 - protein, 10 aa, Mycobacterium tuberculosis
IQGEGGDRHF

SEQ ID NO: 43848 - protein, 10 aa, Mycobacterium tuberculosis
QGEGGDRHFR

SEQ ID NO: 43849 - protein, 10 aa, Mycobacterium tuberculosis
GEGGDRHFRP

SEQ ID NO: 43850 - protein, 10 aa, Mycobacterium tuberculosis
EGGDRHFRPE

SEQ ID NO: 43851 - protein, 10 aa, Mycobacterium tuberculosis
GGDRHFRPEF

SEQ ID NO: 43852 - protein, 10 aa, Mycobacterium tuberculosis
GDRHFRPEFF

SEQ ID NO: 43853 - protein, 10 aa, Mycobacterium tuberculosis
DRHFRPEFFA

SEQ ID NO: 43854 - protein, 10 aa, Mycobacterium tuberculosis
RHFRPEFFAA

SEQ ID NO: 43855 - protein, 10 aa, Mycobacterium tuberculosis
HFRPEFFAAM

SEQ ID NO: 43856 - protein, 10 aa, Mycobacterium tuberculosis
FRPEFFAAMR

SEQ ID NO: 43857 - protein, 10 aa, Mycobacterium tuberculosis
RPEFFAAMRE

SEQ ID NO: 43858 - protein, 10 aa, Mycobacterium tuberculosis
PEFFAAMREL

SEQ ID NO: 43859 - protein, 10 aa, Mycobacterium tuberculosis
EFFAAMRELC

SEQ ID NO: 43860 - protein, 10 aa, Mycobacterium tuberculosis
FFAAMRELCD

SEQ ID NO: 43861 - protein, 10 aa, Mycobacterium tuberculosis
FAAMRELCDE

SEQ ID NO: 43862 - protein, 10 aa, Mycobacterium tuberculosis
AAMRELCDEF

SEQ ID NO: 43863 - protein, 10 aa, Mycobacterium tuberculosis
AMRELCDEFD

SEQ ID NO: 43864 - protein, 10 aa, Mycobacterium tuberculosis
MRELCDEFDA

SEQ ID NO: 43865 - protein, 10 aa, Mycobacterium tuberculosis
RELCDEFDAL

SEQ ID NO: 43866 - protein, 10 aa, Mycobacterium tuberculosis
ELCDEFDALL

SEQ ID NO: 43867 - protein, 10 aa, Mycobacterium tuberculosis
LCDEFDALLI

SEQ ID NO: 43868 - protein, 10 aa, Mycobacterium tuberculosis
CDEFDALLIF

SEQ ID NO: 43869 - protein, 10 aa, Mycobacterium tuberculosis
DEFDALLIFD

SEQ ID NO: 43870 - protein, 10 aa, Mycobacterium tuberculosis
EFDALLIFDE

SEQ ID NO: 43871 - protein, 10 aa, Mycobacterium tuberculosis
FDALLIFDEV

SEQ ID NO: 43872 - protein, 10 aa, Mycobacterium tuberculosis
DALLIFDEVQ

SEQ ID NO: 43873 - protein, 10 aa, Mycobacterium tuberculosis
ALLIFDEVQT

SEQ ID NO: 43874 - protein, 10 aa, Mycobacterium tuberculosis
LLIFDEVQTG

SEQ ID NO: 43875 - protein, 10 aa, Mycobacterium tuberculosis
LIFDEVQTGC

SEQ ID NO: 43876 - protein, 10 aa, Mycobacterium tuberculosis
IFDEVQTGCG

SEQ ID NO: 43877 - protein, 10 aa, Mycobacterium tuberculosis
FDEVQTGCGL

SEQ ID NO: 43878 - protein, 10 aa, Mycobacterium tuberculosis
DEVQTGCGLT

SEQ ID NO: 43879 - protein, 10 aa, Mycobacterium tuberculosis
EVQTGCGLTG

SEQ ID NO: 43880 - protein, 10 aa, Mycobacterium tuberculosis
VQTGCGLTGT

SEQ ID NO: 43881 - protein, 10 aa, Mycobacterium tuberculosis
QTGCGLTGTA

SEQ ID NO: 43882 - protein, 10 aa, Mycobacterium tuberculosis
TGCGLTGTAW

SEQ ID NO: 43883 - protein, 10 aa, Mycobacterium tuberculosis
GCGLTGTAWA

SEQ ID NO: 43884 - protein, 10 aa, Mycobacterium tuberculosis
CGLTGTAWAY

SEQ ID NO: 43885 - protein, 10 aa, Mycobacterium tuberculosis
GLTGTAWAYQ

SEQ ID NO: 43886 - protein, 10 aa, Mycobacterium tuberculosis
LTGTAWAYQQ

SEQ ID NO: 43887 - protein, 10 aa, Mycobacterium tuberculosis
TGTAWAYQQL

SEQ ID NO: 43888 - protein, 10 aa, Mycobacterium tuberculosis
GTAWAYQQLD

SEQ ID NO: 43889 - protein, 10 aa, Mycobacterium tuberculosis
TAWAYQQLDV

SEQ ID NO: 43890 - protein, 10 aa, Mycobacterium tuberculosis
AWAYQQLDVA

SEQ ID NO: 43891 - protein, 10 aa, Mycobacterium tuberculosis
WAYQQLDVAP

SEQ ID NO: 43892 - protein, 10 aa, Mycobacterium tuberculosis
AYQQLDVAPD

SEQ ID NO: 43893 - protein, 10 aa, Mycobacterium tuberculosis
YQQLDVAPDI

SEQ ID NO: 43894 - protein, 10 aa, Mycobacterium tuberculosis
QQLDVAPDIV

SEQ ID NO: 43895 - protein, 10 aa, Mycobacterium tuberculosis
QLDVAPDIVA

SEQ ID NO: 43896 - protein, 10 aa, Mycobacterium tuberculosis
LDVAPDIVAF

SEQ ID NO: 43897 - protein, 10 aa, Mycobacterium tuberculosis
DVAPDIVAFG

SEQ ID NO: 43898 - protein, 10 aa, Mycobacterium tuberculosis
VAPDIVAFGK

SEQ ID NO: 43899 - protein, 10 aa, Mycobacterium tuberculosis
APDIVAFGKK

SEQ ID NO: 43900 - protein, 10 aa, Mycobacterium tuberculosis
PDIVAFGKKT

SEQ ID NO: 43901 - protein, 10 aa, Mycobacterium tuberculosis
DIVAFGKKTQ

SEQ ID NO: 43902 - protein, 10 aa, Mycobacterium tuberculosis
IVAFGKKTQV

SEQ ID NO: 43903 - protein, 10 aa, Mycobacterium tuberculosis
VAFGKKTQVC

SEQ ID NO: 43904 - protein, 10 aa, Mycobacterium tuberculosis
AFGKKTQVCG

SEQ ID NO: 43905 - protein, 10 aa, Mycobacterium tuberculosis
FGKKTQVCGV

SEQ ID NO: 43906 - protein, 10 aa, Mycobacterium tuberculosis
GKKTQVCGVM

SEQ ID NO: 43907 - protein, 10 aa, Mycobacterium tuberculosis
KKTQVCGVMA

SEQ ID NO: 43908 - protein, 10 aa, Mycobacterium tuberculosis
KTQVCGVMAG

SEQ ID NO: 43909 - protein, 10 aa, Mycobacterium tuberculosis
TQVCGVMAGR

SEQ ID NO: 43910 - protein, 10 aa, Mycobacterium tuberculosis
QVCGVMAGRR

SEQ ID NO: 43911 - protein, 10 aa, Mycobacterium tuberculosis
VCGVMAGRRV

SEQ ID NO: 43912 - protein, 10 aa, Mycobacterium tuberculosis
CGVMAGRRVD

SEQ ID NO: 43913 - protein, 10 aa, Mycobacterium tuberculosis
GVMAGRRVDE

SEQ ID NO: 43914 - protein, 10 aa, Mycobacterium tuberculosis
VMAGRRVDEV

SEQ ID NO: 43915 - protein, 10 aa, Mycobacterium tuberculosis
MAGRRVDEVA

SEQ ID NO: 43916 - protein, 10 aa, Mycobacterium tuberculosis
AGRRVDEVAD

SEQ ID NO: 43917 - protein, 10 aa, Mycobacterium tuberculosis
GRRVDEVADN

SEQ ID NO: 43918 - protein, 10 aa, Mycobacterium tuberculosis
RRVDEVADNV

SEQ ID NO: 43919 - protein, 10 aa, Mycobacterium tuberculosis
RVDEVADNVF

SEQ ID NO: 43920 - protein, 10 aa, Mycobacterium tuberculosis
VDEVADNVFA

SEQ ID NO: 43921 - protein, 10 aa, Mycobacterium tuberculosis
DEVADNVFAV

SEQ ID NO: 43922 - protein, 10 aa, Mycobacterium tuberculosis
EVADNVFAVP

SEQ ID NO: 43923 - protein, 10 aa, Mycobacterium tuberculosis
VADNVFAVPS

SEQ ID NO: 43924 - protein, 10 aa, Mycobacterium tuberculosis
ADNVFAVPSR

SEQ ID NO: 43925 - protein, 10 aa, Mycobacterium tuberculosis
DNVFAVPSRL

SEQ ID NO: 43926 - protein, 10 aa, Mycobacterium tuberculosis
NVFAVPSRLN

SEQ ID NO: 43927 - protein, 10 aa, Mycobacterium tuberculosis
VFAVPSRLNS

SEQ ID NO: 43928 - protein, 10 aa, Mycobacterium tuberculosis
FAVPSRLNST

SEQ ID NO: 43929 - protein, 10 aa, Mycobacterium tuberculosis
AVPSRLNSTW

SEQ ID NO: 43930 - protein, 10 aa, Mycobacterium tuberculosis
VPSRLNSTWG

SEQ ID NO: 43931 - protein, 10 aa, Mycobacterium tuberculosis
PSRLNSTWGG

SEQ ID NO: 43932 - protein, 10 aa, Mycobacterium tuberculosis
SRLNSTWGGN

SEQ ID NO: 43933 - protein, 10 aa, Mycobacterium tuberculosis
RLNSTWGGNL

SEQ ID NO: 43934 - protein, 10 aa, Mycobacterium tuberculosis
LNSTWGGNLT

SEQ ID NO: 43935 - protein, 10 aa, Mycobacterium tuberculosis
NSTWGGNLTD

SEQ ID NO: 43936 - protein, 10 aa, Mycobacterium tuberculosis
STWGGNLTDM

SEQ ID NO: 43937 - protein, 10 aa, Mycobacterium tuberculosis
TWGGNLTDMV

SEQ ID NO: 43938 - protein, 10 aa, Mycobacterium tuberculosis
WGGNLTDMVR

SEQ ID NO: 43939 - protein, 10 aa, Mycobacterium tuberculosis
GGNLTDMVRA

SEQ ID NO: 43940 - protein, 10 aa, Mycobacterium tuberculosis
GNLTDMVRAR

SEQ ID NO: 43941 - protein, 10 aa, Mycobacterium tuberculosis
NLTDMVRARR

SEQ ID NO: 43942 - protein, 10 aa, Mycobacterium tuberculosis
LTDMVRARRI

SEQ ID NO: 43943 - protein, 10 aa, Mycobacterium tuberculosis
TDMVRARRIL

SEQ ID NO: 43944 - protein, 10 aa, Mycobacterium tuberculosis
DMVRARRILE

SEQ ID NO: 43945 - protein, 10 aa, Mycobacterium tuberculosis
MVRARRILEV

SEQ ID NO: 43946 - protein, 10 aa, Mycobacterium tuberculosis
VRARRILEVI

SEQ ID NO: 43947 - protein, 10 aa, Mycobacterium tuberculosis
RARRILEVIE

SEQ ID NO: 43948 - protein, 10 aa, Mycobacterium tuberculosis
ARRILEVIEA

SEQ ID NO: 43949 - protein, 10 aa, Mycobacterium tuberculosis
RRILEVIEAE

SEQ ID NO: 43950 - protein, 10 aa, Mycobacterium tuberculosis
RILEVIEAEG

SEQ ID NO: 43951 - protein, 10 aa, Mycobacterium tuberculosis
ILEVIEAEGL

SEQ ID NO: 43952 - protein, 10 aa, Mycobacterium tuberculosis
LEVIEAEGLF

SEQ ID NO: 43953 - protein, 10 aa, Mycobacterium tuberculosis
EVIEAEGLFE

SEQ ID NO: 43954 - protein, 10 aa, Mycobacterium tuberculosis
VIEAEGLFER

SEQ ID NO: 43955 - protein, 10 aa, Mycobacterium tuberculosis
IEAEGLFERA

SEQ ID NO: 43956 - protein, 10 aa, Mycobacterium tuberculosis
EAEGLFERAV

SEQ ID NO: 43957 - protein, 10 aa, Mycobacterium tuberculosis
AEGLFERAVQ

SEQ ID NO: 43958 - protein, 10 aa, Mycobacterium tuberculosis
EGLFERAVQH

SEQ ID NO: 43959 - protein, 10 aa, Mycobacterium tuberculosis
GLFERAVQHG

SEQ ID NO: 43960 - protein, 10 aa, Mycobacterium tuberculosis
LFERAVQHGK

SEQ ID NO: 43961 - protein, 10 aa, Mycobacterium tuberculosis
FERAVQHGKY

SEQ ID NO: 43962 - protein, 10 aa, Mycobacterium tuberculosis
ERAVQHGKYL

SEQ ID NO: 43963 - protein, 10 aa, Mycobacterium tuberculosis
RAVQHGKYLR

SEQ ID NO: 43964 - protein, 10 aa, Mycobacterium tuberculosis
AVQHGKYLRA

SEQ ID NO: 43965 - protein, 10 aa, Mycobacterium tuberculosis
VQHGKYLRAR

SEQ ID NO: 43966 - protein, 10 aa, Mycobacterium tuberculosis
QHGKYLRARL

SEQ ID NO: 43967 - protein, 10 aa, Mycobacterium tuberculosis
HGKYLRARLD

SEQ ID NO: 43968 - protein, 10 aa, Mycobacterium tuberculosis
GKYLRARLDE

SEQ ID NO: 43969 - protein, 10 aa, Mycobacterium tuberculosis
KYLRARLDEL

SEQ ID NO: 43970 - protein, 10 aa, Mycobacterium tuberculosis
YLRARLDELA

SEQ ID NO: 43971 - protein, 10 aa, Mycobacterium tuberculosis
LRARLDELAA

SEQ ID NO: 43972 - protein, 10 aa, Mycobacterium tuberculosis
RARLDELAAD

SEQ ID NO: 43973 - protein, 10 aa, Mycobacterium tuberculosis
ARLDELAADF

SEQ ID NO: 43974 - protein, 10 aa, Mycobacterium tuberculosis
RLDELAADFP

SEQ ID NO: 43975 - protein, 10 aa, Mycobacterium tuberculosis
LDELAADFPA

SEQ ID NO: 43976 - protein, 10 aa, Mycobacterium tuberculosis
DELAADFPAV

SEQ ID NO: 43977 - protein, 10 aa, Mycobacterium tuberculosis
ELAADFPAVV

SEQ ID NO: 43978 - protein, 10 aa, Mycobacterium tuberculosis
LAADFPAVVL

SEQ ID NO: 43979 - protein, 10 aa, Mycobacterium tuberculosis
AADFPAVVLD

SEQ ID NO: 43980 - protein, 10 aa, Mycobacterium tuberculosis
ADFPAVVLDP

SEQ ID NO: 43981 - protein, 10 aa, Mycobacterium tuberculosis
DFPAVVLDPR

SEQ ID NO: 43982 - protein, 10 aa, Mycobacterium tuberculosis
FPAVVLDPRG

SEQ ID NO: 43983 - protein, 10 aa, Mycobacterium tuberculosis
PAVVLDPRGR

SEQ ID NO: 43984 - protein, 10 aa, Mycobacterium tuberculosis
AVVLDPRGRG

SEQ ID NO: 43985 - protein, 10 aa, Mycobacterium tuberculosis
VVLDPRGRGL

SEQ ID NO: 43986 - protein, 10 aa, Mycobacterium tuberculosis
VLDPRGRGLM

SEQ ID NO: 43987 - protein, 10 aa, Mycobacterium tuberculosis
LDPRGRGLMC

SEQ ID NO: 43988 - protein, 10 aa, Mycobacterium tuberculosis
DPRGRGLMCA

SEQ ID NO: 43989 - protein, 10 aa, Mycobacterium tuberculosis
PRGRGLMCAF

SEQ ID NO: 43990 - protein, 10 aa, Mycobacterium tuberculosis
RGRGLMCAFS

SEQ ID NO: 43991 - protein, 10 aa, Mycobacterium tuberculosis
GRGLMCAFSL

SEQ ID NO: 43992 - protein, 10 aa, Mycobacterium tuberculosis
RGLMCAFSLP

SEQ ID NO: 43993 - protein, 10 aa, Mycobacterium tuberculosis
GLMCAFSLPT

SEQ ID NO: 43994 - protein, 10 aa, Mycobacterium tuberculosis
LMCAFSLPTT

SEQ ID NO: 43995 - protein, 10 aa, Mycobacterium tuberculosis
MCAFSLPTTA

SEQ ID NO: 43996 - protein, 10 aa, Mycobacterium tuberculosis
CAFSLPTTAD

SEQ ID NO: 43997 - protein, 10 aa, Mycobacterium tuberculosis
AFSLPTTADR

SEQ ID NO: 43998 - protein, 10 aa, Mycobacterium tuberculosis
FSLPTTADRD

SEQ ID NO: 43999 - protein, 10 aa, Mycobacterium tuberculosis
SLPTTADRDE

SEQ ID NO: 44000 - protein, 10 aa, Mycobacterium tuberculosis
LPTTADRDEL

SEQ ID NO: 44001 - protein, 10 aa, Mycobacterium tuberculosis
PTTADRDELI

SEQ ID NO: 44002 - protein, 10 aa, Mycobacterium tuberculosis
TTADRDELIR

SEQ ID NO: 44003 - protein, 10 aa, Mycobacterium tuberculosis
TADRDELIRQ

SEQ ID NO: 44004 - protein, 10 aa, Mycobacterium tuberculosis
ADRDELIRQL

SEQ ID NO: 44005 - protein, 10 aa, Mycobacterium tuberculosis
DRDELIRQLW

SEQ ID NO: 44006 - protein, 10 aa, Mycobacterium tuberculosis
RDELIRQLWQ

SEQ ID NO: 44007 - protein, 10 aa, Mycobacterium tuberculosis
DELIRQLWQR

SEQ ID NO: 44008 - protein, 10 aa, Mycobacterium tuberculosis
ELIRQLWQRA

SEQ ID NO: 44009 - protein, 10 aa, Mycobacterium tuberculosis
LIRQLWQRAV

SEQ ID NO: 44010 - protein, 10 aa, Mycobacterium tuberculosis
IRQLWQRAVI

SEQ ID NO: 44011 - protein, 10 aa, Mycobacterium tuberculosis
RQLWQRAVIV

SEQ ID NO: 44012 - protein, 10 aa, Mycobacterium tuberculosis
QLWQRAVIVL

SEQ ID NO: 44013 - protein, 10 aa, Mycobacterium tuberculosis
LWQRAVIVLP

SEQ ID NO: 44014 - protein, 10 aa, Mycobacterium tuberculosis
WQRAVIVLPA

SEQ ID NO: 44015 - protein, 10 aa, Mycobacterium tuberculosis
QRAVIVLPAG

SEQ ID NO: 44016 - protein, 10 aa, Mycobacterium tuberculosis
RAVIVLPAGA

SEQ ID NO: 44017 - protein, 10 aa, Mycobacterium tuberculosis
AVIVLPAGAD

SEQ ID NO: 44018 - protein, 10 aa, Mycobacterium tuberculosis
VIVLPAGADT

SEQ ID NO: 44019 - protein, 10 aa, Mycobacterium tuberculosis
IVLPAGADTV

SEQ ID NO: 44020 - protein, 10 aa, Mycobacterium tuberculosis
VLPAGADTVR

SEQ ID NO: 44021 - protein, 10 aa, Mycobacterium tuberculosis
LPAGADTVRF

SEQ ID NO: 44022 - protein, 10 aa, Mycobacterium tuberculosis
PAGADTVRFR

SEQ ID NO: 44023 - protein, 10 aa, Mycobacterium tuberculosis
AGADTVRFRP

SEQ ID NO: 44024 - protein, 10 aa, Mycobacterium tuberculosis
GADTVRFRPP

SEQ ID NO: 44025 - protein, 10 aa, Mycobacterium tuberculosis
ADTVRFRPPL

SEQ ID NO: 44026 - protein, 10 aa, Mycobacterium tuberculosis
DTVRFRPPLT

SEQ ID NO: 44027 - protein, 10 aa, Mycobacterium tuberculosis
TVRFRPPLTV

SEQ ID NO: 44028 - protein, 10 aa, Mycobacterium tuberculosis
VRFRPPLTVS

SEQ ID NO: 44029 - protein, 10 aa, Mycobacterium tuberculosis
RFRPPLTVST

SEQ ID NO: 44030 - protein, 10 aa, Mycobacterium tuberculosis
FRPPLTVSTA

SEQ ID NO: 44031 - protein, 10 aa, Mycobacterium tuberculosis
RPPLTVSTAE

SEQ ID NO: 44032 - protein, 10 aa, Mycobacterium tuberculosis
PPLTVSTAEI

SEQ ID NO: 44033 - protein, 10 aa, Mycobacterium tuberculosis
PLTVSTAEID

SEQ ID NO: 44034 - protein, 10 aa, Mycobacterium tuberculosis
LTVSTAEIDA

SEQ ID NO: 44035 - protein, 10 aa, Mycobacterium tuberculosis
TVSTAEIDAA

SEQ ID NO: 44036 - protein, 10 aa, Mycobacterium tuberculosis
VSTAEIDAAI

SEQ ID NO: 44037 - protein, 10 aa, Mycobacterium tuberculosis
STAEIDAAIA

SEQ ID NO: 44038 - protein, 10 aa, Mycobacterium tuberculosis
TAEIDAAIAA

SEQ ID NO: 44039 - protein, 10 aa, Mycobacterium tuberculosis
AEIDAAIAAV

SEQ ID NO: 44040 - protein, 10 aa, Mycobacterium tuberculosis
EIDAAIAAVR

SEQ ID NO: 44041 - protein, 10 aa, Mycobacterium tuberculosis
IDAAIAAVRS

SEQ ID NO: 44042 - protein, 10 aa, Mycobacterium tuberculosis
DAAIAAVRSA

SEQ ID NO: 44043 - protein, 10 aa, Mycobacterium tuberculosis
AAIAAVRSAL

SEQ ID NO: 44044 - protein, 10 aa, Mycobacterium tuberculosis
AIAAVRSALP

SEQ ID NO: 44045 - protein, 10 aa, Mycobacterium tuberculosis
IAAVRSALPV

SEQ ID NO: 44046 - protein, 10 aa, Mycobacterium tuberculosis
AAVRSALPVV

SEQ ID NO: 44047 - protein, 11 aa, Mycobacterium tuberculosis
MAAVVKSVALA

SEQ ID NO: 44048 - protein, 11 aa, Mycobacterium tuberculosis
AAVVKSVALAG

SEQ ID NO: 44049 - protein, 11 aa, Mycobacterium tuberculosis
AVVKSVALAGR

SEQ ID NO: 44050 - protein, 11 aa, Mycobacterium tuberculosis
VVKSVALAGRP

SEQ ID NO: 44051 - protein, 11 aa, Mycobacterium tuberculosis
VKSVALAGRPT

SEQ ID NO: 44052 - protein, 11 aa, Mycobacterium tuberculosis
KSVALAGRPTT

SEQ ID NO: 44053 - protein, 11 aa, Mycobacterium tuberculosis
SVALAGRPTTP

SEQ ID NO: 44054 - protein, 11 aa, Mycobacterium tuberculosis
VALAGRPTTPD

SEQ ID NO: 44055 - protein, 11 aa, Mycobacterium tuberculosis
ALAGRPTTPDR

SEQ ID NO: 44056 - protein, 11 aa, Mycobacterium tuberculosis
LAGRPTTPDRV

SEQ ID NO: 44057 - protein, 11 aa, Mycobacterium tuberculosis
AGRPTTPDRVH

SEQ ID NO: 44058 - protein, 11 aa, Mycobacterium tuberculosis
GRPTTPDRVHE

SEQ ID NO: 44059 - protein, 11 aa, Mycobacterium tuberculosis
RPTTPDRVHEV

SEQ ID NO: 44060 - protein, 11 aa, Mycobacterium tuberculosis
PTTPDRVHEVL

SEQ ID NO: 44061 - protein, 11 aa, Mycobacterium tuberculosis
TTPDRVHEVLG

SEQ ID NO: 44062 - protein, 11 aa, Mycobacterium tuberculosis
TPDRVHEVLGR

SEQ ID NO: 44063 - protein, 11 aa, Mycobacterium tuberculosis
PDRVHEVLGRS

SEQ ID NO: 44064 - protein, 11 aa, Mycobacterium tuberculosis
DRVHEVLGRSM

SEQ ID NO: 44065 - protein, 11 aa, Mycobacterium tuberculosis
RVHEVLGRSML

SEQ ID NO: 44066 - protein, 11 aa, Mycobacterium tuberculosis
VHEVLGRSMLV

SEQ ID NO: 44067 - protein, 11 aa, Mycobacterium tuberculosis
HEVLGRSMLVD

SEQ ID NO: 44068 - protein, 11 aa, Mycobacterium tuberculosis
EVLGRSMLVDG

SEQ ID NO: 44069 - protein, 11 aa, Mycobacterium tuberculosis
VLGRSMLVDGL

SEQ ID NO: 44070 - protein, 11 aa, Mycobacterium tuberculosis
LGRSMLVDGLD

SEQ ID NO: 44071 - protein, 11 aa, Mycobacterium tuberculosis
GRSMLVDGLDI

SEQ ID NO: 44072 - protein, 11 aa, Mycobacterium tuberculosis
RSMLVDGLDIV

SEQ ID NO: 44073 - protein, 11 aa, Mycobacterium tuberculosis
SMLVDGLDIVL

SEQ ID NO: 44074 - protein, 11 aa, Mycobacterium tuberculosis
MLVDGLDIVLD

SEQ ID NO: 44075 - protein, 11 aa, Mycobacterium tuberculosis
LVDGLDIVLDL

SEQ ID NO: 44076 - protein, 11 aa, Mycobacterium tuberculosis
VDGLDIVLDLT

SEQ ID NO: 44077 - protein, 11 aa, Mycobacterium tuberculosis
DGLDIVLDLTR

SEQ ID NO: 44078 - protein, 11 aa, Mycobacterium tuberculosis
GLDIVLDLTRS

SEQ ID NO: 44079 - protein, 11 aa, Mycobacterium tuberculosis
LDIVLDLTRSG

SEQ ID NO: 44080 - protein, 11 aa, Mycobacterium tuberculosis
DIVLDLTRSGG

SEQ ID NO: 44081 - protein, 11 aa, Mycobacterium tuberculosis
IVLDLTRSGGS

SEQ ID NO: 44082 - protein, 11 aa, Mycobacterium tuberculosis
VLDLTRSGGSY

SEQ ID NO: 44083 - protein, 11 aa, Mycobacterium tuberculosis
LDLTRSGGSYL

SEQ ID NO: 44084 - protein, 11 aa, Mycobacterium tuberculosis
DLTRSGGSYLV

SEQ ID NO: 44085 - protein, 11 aa, Mycobacterium tuberculosis
LTRSGGSYLVD

SEQ ID NO: 44086 - protein, 11 aa, Mycobacterium tuberculosis
TRSGGSYLVDA

SEQ ID NO: 44087 - protein, 11 aa, Mycobacterium tuberculosis
RSGGSYLVDAI

SEQ ID NO: 44088 - protein, 11 aa, Mycobacterium tuberculosis
SGGSYLVDAIT

SEQ ID NO: 44089 - protein, 11 aa, Mycobacterium tuberculosis
GGSYLVDAITG

SEQ ID NO: 44090 - protein, 11 aa, Mycobacterium tuberculosis
GSYLVDAITGR

SEQ ID NO: 44091 - protein, 11 aa, Mycobacterium tuberculosis
SYLVDAITGRR

SEQ ID NO: 44092 - protein, 11 aa, Mycobacterium tuberculosis
YLVDAITGRRY

SEQ ID NO: 44093 - protein, 11 aa, Mycobacterium tuberculosis
LVDAITGRRYL

SEQ ID NO: 44094 - protein, 11 aa, Mycobacterium tuberculosis
VDAITGRRYLD

SEQ ID NO: 44095 - protein, 11 aa, Mycobacterium tuberculosis
DAITGRRYLDM

SEQ ID NO: 44096 - protein, 11 aa, Mycobacterium tuberculosis
AITGRRYLDMF

SEQ ID NO: 44097 - protein, 11 aa, Mycobacterium tuberculosis
ITGRRYLDMFT

SEQ ID NO: 44098 - protein, 11 aa, Mycobacterium tuberculosis
TGRRYLDMFTF

SEQ ID NO: 44099 - protein, 11 aa, Mycobacterium tuberculosis
GRRYLDMFTFV

SEQ ID NO: 44100 - protein, 11 aa, Mycobacterium tuberculosis
RRYLDMFTFVA

SEQ ID NO: 44101 - protein, 11 aa, Mycobacterium tuberculosis
RYLDMFTFVAS

SEQ ID NO: 44102 - protein, 11 aa, Mycobacterium tuberculosis
YLDMFTFVASS

SEQ ID NO: 44103 - protein, 11 aa, Mycobacterium tuberculosis
LDMFTFVASSA

SEQ ID NO: 44104 - protein, 11 aa, Mycobacterium tuberculosis
DMFTFVASSAL

SEQ ID NO: 44105 - protein, 11 aa, Mycobacterium tuberculosis
MFTFVASSALG

SEQ ID NO: 44106 - protein, 11 aa, Mycobacterium tuberculosis
FTFVASSALGM

SEQ ID NO: 44107 - protein, 11 aa, Mycobacterium tuberculosis
TFVASSALGMN

SEQ ID NO: 44108 - protein, 11 aa, Mycobacterium tuberculosis
FVASSALGMNP

SEQ ID NO: 44109 - protein, 11 aa, Mycobacterium tuberculosis
VASSALGMNPP

SEQ ID NO: 44110 - protein, 11 aa, Mycobacterium tuberculosis
ASSALGMNPPA

SEQ ID NO: 44111 - protein, 11 aa, Mycobacterium tuberculosis
SSALGMNPPAL

SEQ ID NO: 44112 - protein, 11 aa, Mycobacterium tuberculosis
SALGMNPPALV

SEQ ID NO: 44113 - protein, 11 aa, Mycobacterium tuberculosis
ALGMNPPALVD

SEQ ID NO: 44114 - protein, 11 aa, Mycobacterium tuberculosis
LGMNPPALVDD

SEQ ID NO: 44115 - protein, 11 aa, Mycobacterium tuberculosis
GMNPPALVDDR

SEQ ID NO: 44116 - protein, 11 aa, Mycobacterium tuberculosis
MNPPALVDDRE

SEQ ID NO: 44117 - protein, 11 aa, Mycobacterium tuberculosis
NPPALVDDREF

SEQ ID NO: 44118 - protein, 11 aa, Mycobacterium tuberculosis
PPALVDDREFH

SEQ ID NO: 44119 - protein, 11 aa, Mycobacterium tuberculosis
PALVDDREFHA

SEQ ID NO: 44120 - protein, 11 aa, Mycobacterium tuberculosis
ALVDDREFHAE

SEQ ID NO: 44121 - protein, 11 aa, Mycobacterium tuberculosis
LVDDREFHAEL

SEQ ID NO: 44122 - protein, 11 aa, Mycobacterium tuberculosis
VDDREFHAELM

SEQ ID NO: 44123 - protein, 11 aa, Mycobacterium tuberculosis
DDREFHAELMQ

SEQ ID NO: 44124 - protein, 11 aa, Mycobacterium tuberculosis
DREFHAELMQA

SEQ ID NO: 44125 - protein, 11 aa, Mycobacterium tuberculosis
REFHAELMQAA

SEQ ID NO: 44126 - protein, 11 aa, Mycobacterium tuberculosis
EFHAELMQAAL

SEQ ID NO: 44127 - protein, 11 aa, Mycobacterium tuberculosis
FHAELMQAALN

SEQ ID NO: 44128 - protein, 11 aa, Mycobacterium tuberculosis
HAELMQAALNK

SEQ ID NO: 44129 - protein, 11 aa, Mycobacterium tuberculosis
AELMQAALNKP

SEQ ID NO: 44130 - protein, 11 aa, Mycobacterium tuberculosis
ELMQAALNKPS

SEQ ID NO: 44131 - protein, 11 aa, Mycobacterium tuberculosis
LMQAALNKPSN

SEQ ID NO: 44132 - protein, 11 aa, Mycobacterium tuberculosis
MQAALNKPSNS

SEQ ID NO: 44133 - protein, 11 aa, Mycobacterium tuberculosis
QAALNKPSNSD

SEQ ID NO: 44134 - protein, 11 aa, Mycobacterium tuberculosis
AALNKPSNSDV

SEQ ID NO: 44135 - protein, 11 aa, Mycobacterium tuberculosis
ALNKPSNSDVY

SEQ ID NO: 44136 - protein, 11 aa, Mycobacterium tuberculosis
LNKPSNSDVYS

SEQ ID NO: 44137 - protein, 11 aa, Mycobacterium tuberculosis
NKPSNSDVYSV

SEQ ID NO: 44138 - protein, 11 aa, Mycobacterium tuberculosis
KPSNSDVYSVA

SEQ ID NO: 44139 - protein, 11 aa, Mycobacterium tuberculosis
PSNSDVYSVAM

SEQ ID NO: 44140 - protein, 11 aa, Mycobacterium tuberculosis
SNSDVYSVAMA

SEQ ID NO: 44141 - protein, 11 aa, Mycobacterium tuberculosis
NSDVYSVAMAR

SEQ ID NO: 44142 - protein, 11 aa, Mycobacterium tuberculosis
SDVYSVAMARF

SEQ ID NO: 44143 - protein, 11 aa, Mycobacterium tuberculosis
DVYSVAMARFV

SEQ ID NO: 44144 - protein, 11 aa, Mycobacterium tuberculosis
VYSVAMARFVE

SEQ ID NO: 44145 - protein, 11 aa, Mycobacterium tuberculosis
YSVAMARFVET

SEQ ID NO: 44146 - protein, 11 aa, Mycobacterium tuberculosis
SVAMARFVETF

SEQ ID NO: 44147 - protein, 11 aa, Mycobacterium tuberculosis
VAMARFVETFA

SEQ ID NO: 44148 - protein, 11 aa, Mycobacterium tuberculosis
AMARFVETFAR

SEQ ID NO: 44149 - protein, 11 aa, Mycobacterium tuberculosis
MARFVETFARV

SEQ ID NO: 44150 - protein, 11 aa, Mycobacterium tuberculosis
ARFVETFARVL

SEQ ID NO: 44151 - protein, 11 aa, Mycobacterium tuberculosis
RFVETFARVLG

SEQ ID NO: 44152 - protein, 11 aa, Mycobacterium tuberculosis
FVETFARVLGD

SEQ ID NO: 44153 - protein, 11 aa, Mycobacterium tuberculosis
VETFARVLGDP

SEQ ID NO: 44154 - protein, 11 aa, Mycobacterium tuberculosis
ETFARVLGDPA

SEQ ID NO: 44155 - protein, 11 aa, Mycobacterium tuberculosis
TFARVLGDPAL

SEQ ID NO: 44156 - protein, 11 aa, Mycobacterium tuberculosis
FARVLGDPALP

SEQ ID NO: 44157 - protein, 11 aa, Mycobacterium tuberculosis
ARVLGDPALPH

SEQ ID NO: 44158 - protein, 11 aa, Mycobacterium tuberculosis
RVLGDPALPHL

SEQ ID NO: 44159 - protein, 11 aa, Mycobacterium tuberculosis
VLGDPALPHLF

SEQ ID NO: 44160 - protein, 11 aa, Mycobacterium tuberculosis
LGDPALPHLFF

SEQ ID NO: 44161 - protein, 11 aa, Mycobacterium tuberculosis
GDPALPHLFFV

SEQ ID NO: 44162 - protein, 11 aa, Mycobacterium tuberculosis
DPALPHLFFVE

SEQ ID NO: 44163 - protein, 11 aa, Mycobacterium tuberculosis
PALPHLFFVEG

SEQ ID NO: 44164 - protein, 11 aa, Mycobacterium tuberculosis
ALPHLFFVEGG

SEQ ID NO: 44165 - protein, 11 aa, Mycobacterium tuberculosis
LPHLFFVEGGA

SEQ ID NO: 44166 - protein, 11 aa, Mycobacterium tuberculosis
PHLFFVEGGAL

SEQ ID NO: 44167 - protein, 11 aa, Mycobacterium tuberculosis
HLFFVEGGALA

SEQ ID NO: 44168 - protein, 11 aa, Mycobacterium tuberculosis
LFFVEGGALAV

SEQ ID NO: 44169 - protein, 11 aa, Mycobacterium tuberculosis
FFVEGGALAVE

SEQ ID NO: 44170 - protein, 11 aa, Mycobacterium tuberculosis
FVEGGALAVEN

SEQ ID NO: 44171 - protein, 11 aa, Mycobacterium tuberculosis
VEGGALAVENA

SEQ ID NO: 44172 - protein, 11 aa, Mycobacterium tuberculosis
EGGALAVENAL

SEQ ID NO: 44173 - protein, 11 aa, Mycobacterium tuberculosis
GGALAVENALK

SEQ ID NO: 44174 - protein, 11 aa, Mycobacterium tuberculosis
GALAVENALKA

SEQ ID NO: 44175 - protein, 11 aa, Mycobacterium tuberculosis
ALAVENALKAA

SEQ ID NO: 44176 - protein, 11 aa, Mycobacterium tuberculosis
LAVENALKAAF

SEQ ID NO: 44177 - protein, 11 aa, Mycobacterium tuberculosis
AVENALKAAFD

SEQ ID NO: 44178 - protein, 11 aa, Mycobacterium tuberculosis
VENALKAAFDW

SEQ ID NO: 44179 - protein, 11 aa, Mycobacterium tuberculosis
ENALKAAFDWK

SEQ ID NO: 44180 - protein, 11 aa, Mycobacterium tuberculosis
NALKAAFDWKS

SEQ ID NO: 44181 - protein, 11 aa, Mycobacterium tuberculosis
ALKAAFDWKSR

SEQ ID NO: 44182 - protein, 11 aa, Mycobacterium tuberculosis
LKAAFDWKSRH

SEQ ID NO: 44183 - protein, 11 aa, Mycobacterium tuberculosis
KAAFDWKSRHN

SEQ ID NO: 44184 - protein, 11 aa, Mycobacterium tuberculosis
AAFDWKSRHNQ

SEQ ID NO: 44185 - protein, 11 aa, Mycobacterium tuberculosis
AFDWKSRHNQA

SEQ ID NO: 44186 - protein, 11 aa, Mycobacterium tuberculosis
FDWKSRHNQAH

SEQ ID NO: 44187 - protein, 11 aa, Mycobacterium tuberculosis
DWKSRHNQAHG

SEQ ID NO: 44188 - protein, 11 aa, Mycobacterium tuberculosis
WKSRHNQAHGI

SEQ ID NO: 44189 - protein, 11 aa, Mycobacterium tuberculosis
KSRHNQAHGID

SEQ ID NO: 44190 - protein, 11 aa, Mycobacterium tuberculosis
SRHNQAHGIDP

SEQ ID NO: 44191 - protein, 11 aa, Mycobacterium tuberculosis
RHNQAHGIDPA

SEQ ID NO: 44192 - protein, 11 aa, Mycobacterium tuberculosis
HNQAHGIDPAL

SEQ ID NO: 44193 - protein, 11 aa, Mycobacterium tuberculosis
NQAHGIDPALG

SEQ ID NO: 44194 - protein, 11 aa, Mycobacterium tuberculosis
QAHGIDPALGT

SEQ ID NO: 44195 - protein, 11 aa, Mycobacterium tuberculosis
AHGIDPALGTQ

SEQ ID NO: 44196 - protein, 11 aa, Mycobacterium tuberculosis
HGIDPALGTQV

SEQ ID NO: 44197 - protein, 11 aa, Mycobacterium tuberculosis
GIDPALGTQVL

SEQ ID NO: 44198 - protein, 11 aa, Mycobacterium tuberculosis
IDPALGTQVLH

SEQ ID NO: 44199 - protein, 11 aa, Mycobacterium tuberculosis
DPALGTQVLHL

SEQ ID NO: 44200 - protein, 11 aa, Mycobacterium tuberculosis
PALGTQVLHLR

SEQ ID NO: 44201 - protein, 11 aa, Mycobacterium tuberculosis
ALGTQVLHLRG

SEQ ID NO: 44202 - protein, 11 aa, Mycobacterium tuberculosis
LGTQVLHLRGA

SEQ ID NO: 44203 - protein, 11 aa, Mycobacterium tuberculosis
GTQVLHLRGAF

SEQ ID NO: 44204 - protein, 11 aa, Mycobacterium tuberculosis
TQVLHLRGAFH

SEQ ID NO: 44205 - protein, 11 aa, Mycobacterium tuberculosis
QVLHLRGAFHG

SEQ ID NO: 44206 - protein, 11 aa, Mycobacterium tuberculosis
VLHLRGAFHGR

SEQ ID NO: 44207 - protein, 11 aa, Mycobacterium tuberculosis
LHLRGAFHGRS

SEQ ID NO: 44208 - protein, 11 aa, Mycobacterium tuberculosis
HLRGAFHGRSG

SEQ ID NO: 44209 - protein, 11 aa, Mycobacterium tuberculosis
LRGAFHGRSGY

SEQ ID NO: 44210 - protein, 11 aa, Mycobacterium tuberculosis
RGAFHGRSGYT

SEQ ID NO: 44211 - protein, 11 aa, Mycobacterium tuberculosis
GAFHGRSGYTL

SEQ ID NO: 44212 - protein, 11 aa, Mycobacterium tuberculosis
AFHGRSGYTLS

SEQ ID NO: 44213 - protein, 11 aa, Mycobacterium tuberculosis
FHGRSGYTLSL

SEQ ID NO: 44214 - protein, 11 aa, Mycobacterium tuberculosis
HGRSGYTLSLT

SEQ ID NO: 44215 - protein, 11 aa, Mycobacterium tuberculosis
GRSGYTLSLTN

SEQ ID NO: 44216 - protein, 11 aa, Mycobacterium tuberculosis
RSGYTLSLTNT

SEQ ID NO: 44217 - protein, 11 aa, Mycobacterium tuberculosis
SGYTLSLTNTK

SEQ ID NO: 44218 - protein, 11 aa, Mycobacterium tuberculosis
GYTLSLTNTKP

SEQ ID NO: 44219 - protein, 11 aa, Mycobacterium tuberculosis
YTLSLTNTKPT

SEQ ID NO: 44220 - protein, 11 aa, Mycobacterium tuberculosis
TLSLTNTKPTI

SEQ ID NO: 44221 - protein, 11 aa, Mycobacterium tuberculosis
LSLTNTKPTIT

SEQ ID NO: 44222 - protein, 11 aa, Mycobacterium tuberculosis
SLTNTKPTITA

SEQ ID NO: 44223 - protein, 11 aa, Mycobacterium tuberculosis
LTNTKPTITAR

SEQ ID NO: 44224 - protein, 11 aa, Mycobacterium tuberculosis
TNTKPTITARF

SEQ ID NO: 44225 - protein, 11 aa, Mycobacterium tuberculosis
NTKPTITARFP

SEQ ID NO: 44226 - protein, 11 aa, Mycobacterium tuberculosis
TKPTITARFPK

SEQ ID NO: 44227 - protein, 11 aa, Mycobacterium tuberculosis
KPTITARFPKF

SEQ ID NO: 44228 - protein, 11 aa, Mycobacterium tuberculosis
PTITARFPKFD

SEQ ID NO: 44229 - protein, 11 aa, Mycobacterium tuberculosis
TITARFPKFDW

SEQ ID NO: 44230 - protein, 11 aa, Mycobacterium tuberculosis
ITARFPKFDWP

SEQ ID NO: 44231 - protein, 11 aa, Mycobacterium tuberculosis
TARFPKFDWPR

SEQ ID NO: 44232 - protein, 11 aa, Mycobacterium tuberculosis
ARFPKFDWPRI

SEQ ID NO: 44233 - protein, 11 aa, Mycobacterium tuberculosis
RFPKFDWPRID

SEQ ID NO: 44234 - protein, 11 aa, Mycobacterium tuberculosis
FPKFDWPRIDA

SEQ ID NO: 44235 - protein, 11 aa, Mycobacterium tuberculosis
PKFDWPRIDAP

SEQ ID NO: 44236 - protein, 11 aa, Mycobacterium tuberculosis
KFDWPRIDAPY

SEQ ID NO: 44237 - protein, 11 aa, Mycobacterium tuberculosis
FDWPRIDAPYM

SEQ ID NO: 44238 - protein, 11 aa, Mycobacterium tuberculosis
DWPRIDAPYMR

SEQ ID NO: 44239 - protein, 11 aa, Mycobacterium tuberculosis
WPRIDAPYMRP

SEQ ID NO: 44240 - protein, 11 aa, Mycobacterium tuberculosis
PRIDAPYMRPG

SEQ ID NO: 44241 - protein, 11 aa, Mycobacterium tuberculosis
RIDAPYMRPGL

SEQ ID NO: 44242 - protein, 11 aa, Mycobacterium tuberculosis
IDAPYMRPGLD

SEQ ID NO: 44243 - protein, 11 aa, Mycobacterium tuberculosis
DAPYMRPGLDE

SEQ ID NO: 44244 - protein, 11 aa, Mycobacterium tuberculosis
APYMRPGLDEP

SEQ ID NO: 44245 - protein, 11 aa, Mycobacterium tuberculosis
PYMRPGLDEPA

SEQ ID NO: 44246 - protein, 11 aa, Mycobacterium tuberculosis
YMRPGLDEPAM

SEQ ID NO: 44247 - protein, 11 aa, Mycobacterium tuberculosis
MRPGLDEPAMA

SEQ ID NO: 44248 - protein, 11 aa, Mycobacterium tuberculosis
RPGLDEPAMAA

SEQ ID NO: 44249 - protein, 11 aa, Mycobacterium tuberculosis
PGLDEPAMAAL

SEQ ID NO: 44250 - protein, 11 aa, Mycobacterium tuberculosis
GLDEPAMAALE

SEQ ID NO: 44251 - protein, 11 aa, Mycobacterium tuberculosis
LDEPAMAALEA

SEQ ID NO: 44252 - protein, 11 aa, Mycobacterium tuberculosis
DEPAMAALEAE

SEQ ID NO: 44253 - protein, 11 aa, Mycobacterium tuberculosis
EPAMAALEAEA

SEQ ID NO: 44254 - protein, 11 aa, Mycobacterium tuberculosis
PAMAALEAEAL

SEQ ID NO: 44255 - protein, 11 aa, Mycobacterium tuberculosis
AMAALEAEALR

SEQ ID NO: 44256 - protein, 11 aa, Mycobacterium tuberculosis
MAALEAEALRQ

SEQ ID NO: 44257 - protein, 11 aa, Mycobacterium tuberculosis
AALEAEALRQA

SEQ ID NO: 44258 - protein, 11 aa, Mycobacterium tuberculosis
ALEAEALRQAR

SEQ ID NO: 44259 - protein, 11 aa, Mycobacterium tuberculosis
LEAEALRQARA

SEQ ID NO: 44260 - protein, 11 aa, Mycobacterium tuberculosis
EAEALRQARAA

SEQ ID NO: 44261 - protein, 11 aa, Mycobacterium tuberculosis
AEALRQARAAF

SEQ ID NO: 44262 - protein, 11 aa, Mycobacterium tuberculosis
EALRQARAAFE

SEQ ID NO: 44263 - protein, 11 aa, Mycobacterium tuberculosis
ALRQARAAFET

SEQ ID NO: 44264 - protein, 11 aa, Mycobacterium tuberculosis
LRQARAAFETR

SEQ ID NO: 44265 - protein, 11 aa, Mycobacterium tuberculosis
RQARAAFETRP

SEQ ID NO: 44266 - protein, 11 aa, Mycobacterium tuberculosis
QARAAFETRPH

SEQ ID NO: 44267 - protein, 11 aa, Mycobacterium tuberculosis
ARAAFETRPHD

SEQ ID NO: 44268 - protein, 11 aa, Mycobacterium tuberculosis
RAAFETRPHDI

SEQ ID NO: 44269 - protein, 11 aa, Mycobacterium tuberculosis
AAFETRPHDIA

SEQ ID NO: 44270 - protein, 11 aa, Mycobacterium tuberculosis
AFETRPHDIAC

SEQ ID NO: 44271 - protein, 11 aa, Mycobacterium tuberculosis
FETRPHDIACF

SEQ ID NO: 44272 - protein, 11 aa, Mycobacterium tuberculosis
ETRPHDIACFV

SEQ ID NO: 44273 - protein, 11 aa, Mycobacterium tuberculosis
TRPHDIACFVA

SEQ ID NO: 44274 - protein, 11 aa, Mycobacterium tuberculosis
RPHDIACFVAE

SEQ ID NO: 44275 - protein, 11 aa, Mycobacterium tuberculosis
PHDIACFVAEP

SEQ ID NO: 44276 - protein, 11 aa, Mycobacterium tuberculosis
HDIACFVAEPI

SEQ ID NO: 44277 - protein, 11 aa, Mycobacterium tuberculosis
DIACFVAEPIQ

SEQ ID NO: 44278 - protein, 11 aa, Mycobacterium tuberculosis
IACFVAEPIQG

SEQ ID NO: 44279 - protein, 11 aa, Mycobacterium tuberculosis
ACFVAEPIQGE

SEQ ID NO: 44280 - protein, 11 aa, Mycobacterium tuberculosis
CFVAEPIQGEG

SEQ ID NO: 44281 - protein, 11 aa, Mycobacterium tuberculosis
FVAEPIQGEGG

SEQ ID NO: 44282 - protein, 11 aa, Mycobacterium tuberculosis
VAEPIQGEGGD

SEQ ID NO: 44283 - protein, 11 aa, Mycobacterium tuberculosis
AEPIQGEGGDR

SEQ ID NO: 44284 - protein, 11 aa, Mycobacterium tuberculosis
EPIQGEGGDRH

SEQ ID NO: 44285 - protein, 11 aa, Mycobacterium tuberculosis
PIQGEGGDRHF

SEQ ID NO: 44286 - protein, 11 aa, Mycobacterium tuberculosis
IQGEGGDRHFR

SEQ ID NO: 44287 - protein, 11 aa, Mycobacterium tuberculosis
QGEGGDRHFRP

SEQ ID NO: 44288 - protein, 11 aa, Mycobacterium tuberculosis
GEGGDRHFRPE

SEQ ID NO: 44289 - protein, 11 aa, Mycobacterium tuberculosis
EGGDRHFRPEF

SEQ ID NO: 44290 - protein, 11 aa, Mycobacterium tuberculosis
GGDRHFRPEFF

SEQ ID NO: 44291 - protein, 11 aa, Mycobacterium tuberculosis
GDRHFRPEFFA

SEQ ID NO: 44292 - protein, 11 aa, Mycobacterium tuberculosis
DRHFRPEFFAA

SEQ ID NO: 44293 - protein, 11 aa, Mycobacterium tuberculosis
RHFRPEFFAAM

SEQ ID NO: 44294 - protein, 11 aa, Mycobacterium tuberculosis
HFRPEFFAAMR

SEQ ID NO: 44295 - protein, 11 aa, Mycobacterium tuberculosis
FRPEFFAAMRE

SEQ ID NO: 44296 - protein, 11 aa, Mycobacterium tuberculosis
RPEFFAAMREL

SEQ ID NO: 44297 - protein, 11 aa, Mycobacterium tuberculosis
PEFFAAMRELC

SEQ ID NO: 44298 - protein, 11 aa, Mycobacterium tuberculosis
EFFAAMRELCD

SEQ ID NO: 44299 - protein, 11 aa, Mycobacterium tuberculosis
FFAAMRELCDE

SEQ ID NO: 44300 - protein, 11 aa, Mycobacterium tuberculosis
FAAMRELCDEF

SEQ ID NO: 44301 - protein, 11 aa, Mycobacterium tuberculosis
AAMRELCDEFD

SEQ ID NO: 44302 - protein, 11 aa, Mycobacterium tuberculosis
AMRELCDEFDA

SEQ ID NO: 44303 - protein, 11 aa, Mycobacterium tuberculosis
MRELCDEFDAL

SEQ ID NO: 44304 - protein, 11 aa, Mycobacterium tuberculosis
RELCDEFDALL

SEQ ID NO: 44305 - protein, 11 aa, Mycobacterium tuberculosis
ELCDEFDALLI

SEQ ID NO: 44306 - protein, 11 aa, Mycobacterium tuberculosis
LCDEFDALLIF

SEQ ID NO: 44307 - protein, 11 aa, Mycobacterium tuberculosis
CDEFDALLIFD

SEQ ID NO: 44308 - protein, 11 aa, Mycobacterium tuberculosis
DEFDALLIFDE

SEQ ID NO: 44309 - protein, 11 aa, Mycobacterium tuberculosis
EFDALLIFDEV

SEQ ID NO: 44310 - protein, 11 aa, Mycobacterium tuberculosis
FDALLIFDEVQ

SEQ ID NO: 44311 - protein, 11 aa, Mycobacterium tuberculosis
DALLIFDEVQT

SEQ ID NO: 44312 - protein, 11 aa, Mycobacterium tuberculosis
ALLIFDEVQTG

SEQ ID NO: 44313 - protein, 11 aa, Mycobacterium tuberculosis
LLIFDEVQTGC

SEQ ID NO: 44314 - protein, 11 aa, Mycobacterium tuberculosis
LIFDEVQTGCG

SEQ ID NO: 44315 - protein, 11 aa, Mycobacterium tuberculosis
IFDEVQTGCGL

SEQ ID NO: 44316 - protein, 11 aa, Mycobacterium tuberculosis
FDEVQTGCGLT

SEQ ID NO: 44317 - protein, 11 aa, Mycobacterium tuberculosis
DEVQTGCGLTG

SEQ ID NO: 44318 - protein, 11 aa, Mycobacterium tuberculosis
EVQTGCGLTGT

SEQ ID NO: 44319 - protein, 11 aa, Mycobacterium tuberculosis
VQTGCGLTGTA

SEQ ID NO: 44320 - protein, 11 aa, Mycobacterium tuberculosis
QTGCGLTGTAW

SEQ ID NO: 44321 - protein, 11 aa, Mycobacterium tuberculosis
TGCGLTGTAWA

SEQ ID NO: 44322 - protein, 11 aa, Mycobacterium tuberculosis
GCGLTGTAWAY

SEQ ID NO: 44323 - protein, 11 aa, Mycobacterium tuberculosis
CGLTGTAWAYQ

SEQ ID NO: 44324 - protein, 11 aa, Mycobacterium tuberculosis
GLTGTAWAYQQ

SEQ ID NO: 44325 - protein, 11 aa, Mycobacterium tuberculosis
LTGTAWAYQQL

SEQ ID NO: 44326 - protein, 11 aa, Mycobacterium tuberculosis
TGTAWAYQQLD

SEQ ID NO: 44327 - protein, 11 aa, Mycobacterium tuberculosis
GTAWAYQQLDV

SEQ ID NO: 44328 - protein, 11 aa, Mycobacterium tuberculosis
TAWAYQQLDVA

SEQ ID NO: 44329 - protein, 11 aa, Mycobacterium tuberculosis
AWAYQQLDVAP

SEQ ID NO: 44330 - protein, 11 aa, Mycobacterium tuberculosis
WAYQQLDVAPD

SEQ ID NO: 44331 - protein, 11 aa, Mycobacterium tuberculosis
AYQQLDVAPDI

SEQ ID NO: 44332 - protein, 11 aa, Mycobacterium tuberculosis
YQQLDVAPDIV

SEQ ID NO: 44333 - protein, 11 aa, Mycobacterium tuberculosis
QQLDVAPDIVA

SEQ ID NO: 44334 - protein, 11 aa, Mycobacterium tuberculosis
QLDVAPDIVAF

SEQ ID NO: 44335 - protein, 11 aa, Mycobacterium tuberculosis
LDVAPDIVAFG

SEQ ID NO: 44336 - protein, 11 aa, Mycobacterium tuberculosis
DVAPDIVAFGK

SEQ ID NO: 44337 - protein, 11 aa, Mycobacterium tuberculosis
VAPDIVAFGKK

SEQ ID NO: 44338 - protein, 11 aa, Mycobacterium tuberculosis
APDIVAFGKKT

SEQ ID NO: 44339 - protein, 11 aa, Mycobacterium tuberculosis
PDIVAFGKKTQ

SEQ ID NO: 44340 - protein, 11 aa, Mycobacterium tuberculosis
DIVAFGKKTQV

SEQ ID NO: 44341 - protein, 11 aa, Mycobacterium tuberculosis
IVAFGKKTQVC

SEQ ID NO: 44342 - protein, 11 aa, Mycobacterium tuberculosis
VAFGKKTQVCG

SEQ ID NO: 44343 - protein, 11 aa, Mycobacterium tuberculosis
AFGKKTQVCGV

SEQ ID NO: 44344 - protein, 11 aa, Mycobacterium tuberculosis
FGKKTQVCGVM

SEQ ID NO: 44345 - protein, 11 aa, Mycobacterium tuberculosis
GKKTQVCGVMA

SEQ ID NO: 44346 - protein, 11 aa, Mycobacterium tuberculosis
KKTQVCGVMAG

SEQ ID NO: 44347 - protein, 11 aa, Mycobacterium tuberculosis
KTQVCGVMAGR

SEQ ID NO: 44348 - protein, 11 aa, Mycobacterium tuberculosis
TQVCGVMAGRR

SEQ ID NO: 44349 - protein, 11 aa, Mycobacterium tuberculosis
QVCGVMAGRRV

SEQ ID NO: 44350 - protein, 11 aa, Mycobacterium tuberculosis
VCGVMAGRRVD

SEQ ID NO: 44351 - protein, 11 aa, Mycobacterium tuberculosis
CGVMAGRRVDE

SEQ ID NO: 44352 - protein, 11 aa, Mycobacterium tuberculosis
GVMAGRRVDEV

SEQ ID NO: 44353 - protein, 11 aa, Mycobacterium tuberculosis
VMAGRRVDEVA

SEQ ID NO: 44354 - protein, 11 aa, Mycobacterium tuberculosis
MAGRRVDEVAD

SEQ ID NO: 44355 - protein, 11 aa, Mycobacterium tuberculosis
AGRRVDEVADN

SEQ ID NO: 44356 - protein, 11 aa, Mycobacterium tuberculosis
GRRVDEVADNV

SEQ ID NO: 44357 - protein, 11 aa, Mycobacterium tuberculosis
RRVDEVADNVF

SEQ ID NO: 44358 - protein, 11 aa, Mycobacterium tuberculosis
RVDEVADNVFA

SEQ ID NO: 44359 - protein, 11 aa, Mycobacterium tuberculosis
VDEVADNVFAV

SEQ ID NO: 44360 - protein, 11 aa, Mycobacterium tuberculosis
DEVADNVFAVP

SEQ ID NO: 44361 - protein, 11 aa, Mycobacterium tuberculosis
EVADNVFAVPS

SEQ ID NO: 44362 - protein, 11 aa, Mycobacterium tuberculosis
VADNVFAVPSR

SEQ ID NO: 44363 - protein, 11 aa, Mycobacterium tuberculosis
ADNVFAVPSRL

SEQ ID NO: 44364 - protein, 11 aa, Mycobacterium tuberculosis
DNVFAVPSRLN

SEQ ID NO: 44365 - protein, 11 aa, Mycobacterium tuberculosis
NVFAVPSRLNS

SEQ ID NO: 44366 - protein, 11 aa, Mycobacterium tuberculosis
VFAVPSRLNST

SEQ ID NO: 44367 - protein, 11 aa, Mycobacterium tuberculosis
FAVPSRLNSTW

SEQ ID NO: 44368 - protein, 11 aa, Mycobacterium tuberculosis
AVPSRLNSTWG

SEQ ID NO: 44369 - protein, 11 aa, Mycobacterium tuberculosis
VPSRLNSTWGG

SEQ ID NO: 44370 - protein, 11 aa, Mycobacterium tuberculosis
PSRLNSTWGGN

SEQ ID NO: 44371 - protein, 11 aa, Mycobacterium tuberculosis
SRLNSTWGGNL

SEQ ID NO: 44372 - protein, 11 aa, Mycobacterium tuberculosis
RLNSTWGGNLT

SEQ ID NO: 44373 - protein, 11 aa, Mycobacterium tuberculosis
LNSTWGGNLTD

SEQ ID NO: 44374 - protein, 11 aa, Mycobacterium tuberculosis
NSTWGGNLTDM

SEQ ID NO: 44375 - protein, 11 aa, Mycobacterium tuberculosis
STWGGNLTDMV

SEQ ID NO: 44376 - protein, 11 aa, Mycobacterium tuberculosis
TWGGNLTDMVR

SEQ ID NO: 44377 - protein, 11 aa, Mycobacterium tuberculosis
WGGNLTDMVRA

SEQ ID NO: 44378 - protein, 11 aa, Mycobacterium tuberculosis
GGNLTDMVRAR

SEQ ID NO: 44379 - protein, 11 aa, Mycobacterium tuberculosis
GNLTDMVRARR

SEQ ID NO: 44380 - protein, 11 aa, Mycobacterium tuberculosis
NLTDMVRARRI

SEQ ID NO: 44381 - protein, 11 aa, Mycobacterium tuberculosis
LTDMVRARRIL

SEQ ID NO: 44382 - protein, 11 aa, Mycobacterium tuberculosis
TDMVRARRILE

SEQ ID NO: 44383 - protein, 11 aa, Mycobacterium tuberculosis
DMVRARRILEV

SEQ ID NO: 44384 - protein, 11 aa, Mycobacterium tuberculosis
MVRARRILEVI

SEQ ID NO: 44385 - protein, 11 aa, Mycobacterium tuberculosis
VRARRILEVIE

SEQ ID NO: 44386 - protein, 11 aa, Mycobacterium tuberculosis
RARRILEVIEA

SEQ ID NO: 44387 - protein, 11 aa, Mycobacterium tuberculosis
ARRILEVIEAE

SEQ ID NO: 44388 - protein, 11 aa, Mycobacterium tuberculosis
RRILEVIEAEG

SEQ ID NO: 44389 - protein, 11 aa, Mycobacterium tuberculosis
RILEVIEAEGL

SEQ ID NO: 44390 - protein, 11 aa, Mycobacterium tuberculosis
ILEVIEAEGLF

SEQ ID NO: 44391 - protein, 11 aa, Mycobacterium tuberculosis
LEVIEAEGLFE

SEQ ID NO: 44392 - protein, 11 aa, Mycobacterium tuberculosis
EVIEAEGLFER

SEQ ID NO: 44393 - protein, 11 aa, Mycobacterium tuberculosis
VIEAEGLFERA

SEQ ID NO: 44394 - protein, 11 aa, Mycobacterium tuberculosis
IEAEGLFERAV

SEQ ID NO: 44395 - protein, 11 aa, Mycobacterium tuberculosis
EAEGLFERAVQ

SEQ ID NO: 44396 - protein, 11 aa, Mycobacterium tuberculosis
AEGLFERAVQH

SEQ ID NO: 44397 - protein, 11 aa, Mycobacterium tuberculosis
EGLFERAVQHG

SEQ ID NO: 44398 - protein, 11 aa, Mycobacterium tuberculosis
GLFERAVQHGK

SEQ ID NO: 44399 - protein, 11 aa, Mycobacterium tuberculosis
LFERAVQHGKY

SEQ ID NO: 44400 - protein, 11 aa, Mycobacterium tuberculosis
FERAVQHGKYL

SEQ ID NO: 44401 - protein, 11 aa, Mycobacterium tuberculosis
ERAVQHGKYLR

SEQ ID NO: 44402 - protein, 11 aa, Mycobacterium tuberculosis
RAVQHGKYLRA

SEQ ID NO: 44403 - protein, 11 aa, Mycobacterium tuberculosis
AVQHGKYLRAR

SEQ ID NO: 44404 - protein, 11 aa, Mycobacterium tuberculosis
VQHGKYLRARL

SEQ ID NO: 44405 - protein, 11 aa, Mycobacterium tuberculosis
QHGKYLRARLD

SEQ ID NO: 44406 - protein, 11 aa, Mycobacterium tuberculosis
HGKYLRARLDE

SEQ ID NO: 44407 - protein, 11 aa, Mycobacterium tuberculosis
GKYLRARLDEL

SEQ ID NO: 44408 - protein, 11 aa, Mycobacterium tuberculosis
KYLRARLDELA

SEQ ID NO: 44409 - protein, 11 aa, Mycobacterium tuberculosis
YLRARLDELAA

SEQ ID NO: 44410 - protein, 11 aa, Mycobacterium tuberculosis
LRARLDELAAD

SEQ ID NO: 44411 - protein, 11 aa, Mycobacterium tuberculosis
RARLDELAADF

SEQ ID NO: 44412 - protein, 11 aa, Mycobacterium tuberculosis
ARLDELAADFP

SEQ ID NO: 44413 - protein, 11 aa, Mycobacterium tuberculosis
RLDELAADFPA

SEQ ID NO: 44414 - protein, 11 aa, Mycobacterium tuberculosis
LDELAADFPAV

SEQ ID NO: 44415 - protein, 11 aa, Mycobacterium tuberculosis
DELAADFPAVV

SEQ ID NO: 44416 - protein, 11 aa, Mycobacterium tuberculosis
ELAADFPAVVL

SEQ ID NO: 44417 - protein, 11 aa, Mycobacterium tuberculosis
LAADFPAVVLD

SEQ ID NO: 44418 - protein, 11 aa, Mycobacterium tuberculosis
AADFPAVVLDP

SEQ ID NO: 44419 - protein, 11 aa, Mycobacterium tuberculosis
ADFPAVVLDPR

SEQ ID NO: 44420 - protein, 11 aa, Mycobacterium tuberculosis
DFPAVVLDPRG

SEQ ID NO: 44421 - protein, 11 aa, Mycobacterium tuberculosis
FPAVVLDPRGR

SEQ ID NO: 44422 - protein, 11 aa, Mycobacterium tuberculosis
PAVVLDPRGRG

SEQ ID NO: 44423 - protein, 11 aa, Mycobacterium tuberculosis
AVVLDPRGRGL

SEQ ID NO: 44424 - protein, 11 aa, Mycobacterium tuberculosis
VVLDPRGRGLM

SEQ ID NO: 44425 - protein, 11 aa, Mycobacterium tuberculosis
VLDPRGRGLMC

SEQ ID NO: 44426 - protein, 11 aa, Mycobacterium tuberculosis
LDPRGRGLMCA

SEQ ID NO: 44427 - protein, 11 aa, Mycobacterium tuberculosis
DPRGRGLMCAF

SEQ ID NO: 44428 - protein, 11 aa, Mycobacterium tuberculosis
PRGRGLMCAFS

SEQ ID NO: 44429 - protein, 11 aa, Mycobacterium tuberculosis
RGRGLMCAFSL

SEQ ID NO: 44430 - protein, 11 aa, Mycobacterium tuberculosis
GRGLMCAFSLP

SEQ ID NO: 44431 - protein, 11 aa, Mycobacterium tuberculosis
RGLMCAFSLPT

SEQ ID NO: 44432 - protein, 11 aa, Mycobacterium tuberculosis
GLMCAFSLPTT

SEQ ID NO: 44433 - protein, 11 aa, Mycobacterium tuberculosis
LMCAFSLPTTA

SEQ ID NO: 44434 - protein, 11 aa, Mycobacterium tuberculosis
MCAFSLPTTAD

SEQ ID NO: 44435 - protein, 11 aa, Mycobacterium tuberculosis
CAFSLPTTADR

SEQ ID NO: 44436 - protein, 11 aa, Mycobacterium tuberculosis
AFSLPTTADRD

SEQ ID NO: 44437 - protein, 11 aa, Mycobacterium tuberculosis
FSLPTTADRDE

SEQ ID NO: 44438 - protein, 11 aa, Mycobacterium tuberculosis
SLPTTADRDEL

SEQ ID NO: 44439 - protein, 11 aa, Mycobacterium tuberculosis
LPTTADRDELI

SEQ ID NO: 44440 - protein, 11 aa, Mycobacterium tuberculosis
PTTADRDELIR

SEQ ID NO: 44441 - protein, 11 aa, Mycobacterium tuberculosis
TTADRDELIRQ

SEQ ID NO: 44442 - protein, 11 aa, Mycobacterium tuberculosis
TADRDELIRQL

SEQ ID NO: 44443 - protein, 11 aa, Mycobacterium tuberculosis
ADRDELIRQLW

SEQ ID NO: 44444 - protein, 11 aa, Mycobacterium tuberculosis
DRDELIRQLWQ

SEQ ID NO: 44445 - protein, 11 aa, Mycobacterium tuberculosis
RDELIRQLWQR

SEQ ID NO: 44446 - protein, 11 aa, Mycobacterium tuberculosis
DELIRQLWQRA

SEQ ID NO: 44447 - protein, 11 aa, Mycobacterium tuberculosis
ELIRQLWQRAV

SEQ ID NO: 44448 - protein, 11 aa, Mycobacterium tuberculosis
LIRQLWQRAVI

SEQ ID NO: 44449 - protein, 11 aa, Mycobacterium tuberculosis
IRQLWQRAVIV

SEQ ID NO: 44450 - protein, 11 aa, Mycobacterium tuberculosis
RQLWQRAVIVL

SEQ ID NO: 44451 - protein, 11 aa, Mycobacterium tuberculosis
QLWQRAVIVLP

SEQ ID NO: 44452 - protein, 11 aa, Mycobacterium tuberculosis
LWQRAVIVLPA

SEQ ID NO: 44453 - protein, 11 aa, Mycobacterium tuberculosis
WQRAVIVLPAG

SEQ ID NO: 44454 - protein, 11 aa, Mycobacterium tuberculosis
QRAVIVLPAGA

SEQ ID NO: 44455 - protein, 11 aa, Mycobacterium tuberculosis
RAVIVLPAGAD

SEQ ID NO: 44456 - protein, 11 aa, Mycobacterium tuberculosis
AVIVLPAGADT

SEQ ID NO: 44457 - protein, 11 aa, Mycobacterium tuberculosis
VIVLPAGADTV

SEQ ID NO: 44458 - protein, 11 aa, Mycobacterium tuberculosis
IVLPAGADTVR

SEQ ID NO: 44459 - protein, 11 aa, Mycobacterium tuberculosis
VLPAGADTVRF

SEQ ID NO: 44460 - protein, 11 aa, Mycobacterium tuberculosis
LPAGADTVRFR

SEQ ID NO: 44461 - protein, 11 aa, Mycobacterium tuberculosis
PAGADTVRFRP

SEQ ID NO: 44462 - protein, 11 aa, Mycobacterium tuberculosis
AGADTVRFRPP

SEQ ID NO: 44463 - protein, 11 aa, Mycobacterium tuberculosis
GADTVRFRPPL

SEQ ID NO: 44464 - protein, 11 aa, Mycobacterium tuberculosis
ADTVRFRPPLT

SEQ ID NO: 44465 - protein, 11 aa, Mycobacterium tuberculosis
DTVRFRPPLTV

SEQ ID NO: 44466 - protein, 11 aa, Mycobacterium tuberculosis
TVRFRPPLTVS

SEQ ID NO: 44467 - protein, 11 aa, Mycobacterium tuberculosis
VRFRPPLTVST

SEQ ID NO: 44468 - protein, 11 aa, Mycobacterium tuberculosis
RFRPPLTVSTA

SEQ ID NO: 44469 - protein, 11 aa, Mycobacterium tuberculosis
FRPPLTVSTAE

SEQ ID NO: 44470 - protein, 11 aa, Mycobacterium tuberculosis
RPPLTVSTAEI

SEQ ID NO: 44471 - protein, 11 aa, Mycobacterium tuberculosis
PPLTVSTAEID

SEQ ID NO: 44472 - protein, 11 aa, Mycobacterium tuberculosis
PLTVSTAEIDA

SEQ ID NO: 44473 - protein, 11 aa, Mycobacterium tuberculosis
LTVSTAEIDAA

SEQ ID NO: 44474 - protein, 11 aa, Mycobacterium tuberculosis
TVSTAEIDAAI

SEQ ID NO: 44475 - protein, 11 aa, Mycobacterium tuberculosis
VSTAEIDAAIA

SEQ ID NO: 44476 - protein, 11 aa, Mycobacterium tuberculosis
STAEIDAAIAA

SEQ ID NO: 44477 - protein, 11 aa, Mycobacterium tuberculosis
TAEIDAAIAAV

SEQ ID NO: 44478 - protein, 11 aa, Mycobacterium tuberculosis
AEIDAAIAAVR

SEQ ID NO: 44479 - protein, 11 aa, Mycobacterium tuberculosis
EIDAAIAAVRS

SEQ ID NO: 44480 - protein, 11 aa, Mycobacterium tuberculosis
IDAAIAAVRSA

SEQ ID NO: 44481 - protein, 11 aa, Mycobacterium tuberculosis
DAAIAAVRSAL

SEQ ID NO: 44482 - protein, 11 aa, Mycobacterium tuberculosis
AAIAAVRSALP

SEQ ID NO: 44483 - protein, 11 aa, Mycobacterium tuberculosis
AIAAVRSALPV

SEQ ID NO: 44484 - protein, 11 aa, Mycobacterium tuberculosis
IAAVRSALPVV

SEQ ID NO: 44485 - protein, 11 aa, Mycobacterium tuberculosis
AAVRSALPVVT

SEQ ID NO: 44486 - protein, 8 aa, Mycobacterium tuberculosis
MNEALDDI

SEQ ID NO: 44487 - protein, 8 aa, Mycobacterium tuberculosis
NEALDDID

SEQ ID NO: 44488 - protein, 8 aa, Mycobacterium tuberculosis
EALDDIDR

SEQ ID NO: 44489 - protein, 8 aa, Mycobacterium tuberculosis
ALDDIDRI

SEQ ID NO: 44490 - protein, 8 aa, Mycobacterium tuberculosis
LDDIDRIL

SEQ ID NO: 44491 - protein, 8 aa, Mycobacterium tuberculosis
DDIDRILV

SEQ ID NO: 44492 - protein, 8 aa, Mycobacterium tuberculosis
DIDRILVR

SEQ ID NO: 44493 - protein, 8 aa, Mycobacterium tuberculosis
IDRILVRE

SEQ ID NO: 44494 - protein, 8 aa, Mycobacterium tuberculosis
DRILVREL

SEQ ID NO: 44495 - protein, 8 aa, Mycobacterium tuberculosis
RILVRELA

SEQ ID NO: 44496 - protein, 8 aa, Mycobacterium tuberculosis
ILVRELAA

SEQ ID NO: 44497 - protein, 8 aa, Mycobacterium tuberculosis
LVRELAAD

SEQ ID NO: 44498 - protein, 8 aa, Mycobacterium tuberculosis
VRELAADG

SEQ ID NO: 44499 - protein, 8 aa, Mycobacterium tuberculosis
RELAADGR

SEQ ID NO: 44500 - protein, 8 aa, Mycobacterium tuberculosis
ELAADGRA

SEQ ID NO: 44501 - protein, 8 aa, Mycobacterium tuberculosis
LAADGRAT

SEQ ID NO: 44502 - protein, 8 aa, Mycobacterium tuberculosis
AADGRATL

SEQ ID NO: 44503 - protein, 8 aa, Mycobacterium tuberculosis
ADGRATLS

SEQ ID NO: 44504 - protein, 8 aa, Mycobacterium tuberculosis
DGRATLSE

SEQ ID NO: 44505 - protein, 8 aa, Mycobacterium tuberculosis
GRATLSEL

SEQ ID NO: 44506 - protein, 8 aa, Mycobacterium tuberculosis
RATLSELA

SEQ ID NO: 44507 - protein, 8 aa, Mycobacterium tuberculosis
ATLSELAT

SEQ ID NO: 44508 - protein, 8 aa, Mycobacterium tuberculosis
TLSELATR

SEQ ID NO: 44509 - protein, 8 aa, Mycobacterium tuberculosis
LSELATRA

SEQ ID NO: 44510 - protein, 8 aa, Mycobacterium tuberculosis
SELATRAG

SEQ ID NO: 44511 - protein, 8 aa, Mycobacterium tuberculosis
ELATRAGL

SEQ ID NO: 44512 - protein, 8 aa, Mycobacterium tuberculosis
LATRAGLS

SEQ ID NO: 44513 - protein, 8 aa, Mycobacterium tuberculosis
ATRAGLSV

SEQ ID NO: 44514 - protein, 8 aa, Mycobacterium tuberculosis
TRAGLSVS

SEQ ID NO: 44515 - protein, 8 aa, Mycobacterium tuberculosis
RAGLSVSA

SEQ ID NO: 44516 - protein, 8 aa, Mycobacterium tuberculosis
AGLSVSAV

SEQ ID NO: 44517 - protein, 8 aa, Mycobacterium tuberculosis
GLSVSAVQ

SEQ ID NO: 44518 - protein, 8 aa, Mycobacterium tuberculosis
LSVSAVQS

SEQ ID NO: 44519 - protein, 8 aa, Mycobacterium tuberculosis
SVSAVQSR

SEQ ID NO: 44520 - protein, 8 aa, Mycobacterium tuberculosis
VSAVQSRV

SEQ ID NO: 44521 - protein, 8 aa, Mycobacterium tuberculosis
SAVQSRVR

SEQ ID NO: 44522 - protein, 8 aa, Mycobacterium tuberculosis
AVQSRVRR

SEQ ID NO: 44523 - protein, 8 aa, Mycobacterium tuberculosis
VQSRVRRL

SEQ ID NO: 44524 - protein, 8 aa, Mycobacterium tuberculosis
QSRVRRLE

SEQ ID NO: 44525 - protein, 8 aa, Mycobacterium tuberculosis
SRVRRLES

SEQ ID NO: 44526 - protein, 8 aa, Mycobacterium tuberculosis
RVRRLESR

SEQ ID NO: 44527 - protein, 8 aa, Mycobacterium tuberculosis
VRRLESRG

SEQ ID NO: 44528 - protein, 8 aa, Mycobacterium tuberculosis
RRLESRGV

SEQ ID NO: 44529 - protein, 8 aa, Mycobacterium tuberculosis
RLESRGVV

SEQ ID NO: 44530 - protein, 8 aa, Mycobacterium tuberculosis
LESRGVVQ

SEQ ID NO: 44531 - protein, 8 aa, Mycobacterium tuberculosis
ESRGVVQG

SEQ ID NO: 44532 - protein, 8 aa, Mycobacterium tuberculosis
SRGVVQGY

SEQ ID NO: 44533 - protein, 8 aa, Mycobacterium tuberculosis
RGVVQGYS

SEQ ID NO: 44534 - protein, 8 aa, Mycobacterium tuberculosis
GVVQGYSA

SEQ ID NO: 44535 - protein, 8 aa, Mycobacterium tuberculosis
VVQGYSAR

SEQ ID NO: 44536 - protein, 8 aa, Mycobacterium tuberculosis
VQGYSARI

SEQ ID NO: 44537 - protein, 8 aa, Mycobacterium tuberculosis
QGYSARIN

SEQ ID NO: 44538 - protein, 8 aa, Mycobacterium tuberculosis
GYSARINP

SEQ ID NO: 44539 - protein, 8 aa, Mycobacterium tuberculosis
YSARINPE

SEQ ID NO: 44540 - protein, 8 aa, Mycobacterium tuberculosis
SARINPEA

SEQ ID NO: 44541 - protein, 8 aa, Mycobacterium tuberculosis
ARINPEAV

SEQ ID NO: 44542 - protein, 8 aa, Mycobacterium tuberculosis
RINPEAVG

SEQ ID NO: 44543 - protein, 8 aa, Mycobacterium tuberculosis
INPEAVGH

SEQ ID NO: 44544 - protein, 8 aa, Mycobacterium tuberculosis
NPEAVGHL

SEQ ID NO: 44545 - protein, 8 aa, Mycobacterium tuberculosis
PEAVGHLL

SEQ ID NO: 44546 - protein, 8 aa, Mycobacterium tuberculosis
EAVGHLLS

SEQ ID NO: 44547 - protein, 8 aa, Mycobacterium tuberculosis
AVGHLLSA

SEQ ID NO: 44548 - protein, 8 aa, Mycobacterium tuberculosis
VGHLLSAF

SEQ ID NO: 44549 - protein, 8 aa, Mycobacterium tuberculosis
GHLLSAFV

SEQ ID NO: 44550 - protein, 8 aa, Mycobacterium tuberculosis
HLLSAFVA

SEQ ID NO: 44551 - protein, 8 aa, Mycobacterium tuberculosis
LLSAFVAI

SEQ ID NO: 44552 - protein, 8 aa, Mycobacterium tuberculosis
LSAFVAIT

SEQ ID NO: 44553 - protein, 8 aa, Mycobacterium tuberculosis
SAFVAITP

SEQ ID NO: 44554 - protein, 8 aa, Mycobacterium tuberculosis
AFVAITPL

SEQ ID NO: 44555 - protein, 8 aa, Mycobacterium tuberculosis
FVAITPLD

SEQ ID NO: 44556 - protein, 8 aa, Mycobacterium tuberculosis
VAITPLDP

SEQ ID NO: 44557 - protein, 8 aa, Mycobacterium tuberculosis
AITPLDPS

SEQ ID NO: 44558 - protein, 8 aa, Mycobacterium tuberculosis
ITPLDPSQ

SEQ ID NO: 44559 - protein, 8 aa, Mycobacterium tuberculosis
TPLDPSQP

SEQ ID NO: 44560 - protein, 8 aa, Mycobacterium tuberculosis
PLDPSQPD

SEQ ID NO: 44561 - protein, 8 aa, Mycobacterium tuberculosis
LDPSQPDD

SEQ ID NO: 44562 - protein, 8 aa, Mycobacterium tuberculosis
DPSQPDDA

SEQ ID NO: 44563 - protein, 8 aa, Mycobacterium tuberculosis
PSQPDDAP

SEQ ID NO: 44564 - protein, 8 aa, Mycobacterium tuberculosis
SQPDDAPA

SEQ ID NO: 44565 - protein, 8 aa, Mycobacterium tuberculosis
QPDDAPAR

SEQ ID NO: 44566 - protein, 8 aa, Mycobacterium tuberculosis
PDDAPARL

SEQ ID NO: 44567 - protein, 8 aa, Mycobacterium tuberculosis
DDAPARLE

SEQ ID NO: 44568 - protein, 8 aa, Mycobacterium tuberculosis
DAPARLEH

SEQ ID NO: 44569 - protein, 8 aa, Mycobacterium tuberculosis
APARLEHI

SEQ ID NO: 44570 - protein, 8 aa, Mycobacterium tuberculosis
PARLEHIE

SEQ ID NO: 44571 - protein, 8 aa, Mycobacterium tuberculosis
ARLEHIEE

SEQ ID NO: 44572 - protein, 8 aa, Mycobacterium tuberculosis
RLEHIEEV

SEQ ID NO: 44573 - protein, 8 aa, Mycobacterium tuberculosis
LEHIEEVE

SEQ ID NO: 44574 - protein, 8 aa, Mycobacterium tuberculosis
EHIEEVES

SEQ ID NO: 44575 - protein, 8 aa, Mycobacterium tuberculosis
HIEEVESC

SEQ ID NO: 44576 - protein, 8 aa, Mycobacterium tuberculosis
IEEVESCY

SEQ ID NO: 44577 - protein, 8 aa, Mycobacterium tuberculosis
EEVESCYS

SEQ ID NO: 44578 - protein, 8 aa, Mycobacterium tuberculosis
EVESCYSV

SEQ ID NO: 44579 - protein, 8 aa, Mycobacterium tuberculosis
VESCYSVA

SEQ ID NO: 44580 - protein, 8 aa, Mycobacterium tuberculosis
ESCYSVAG

SEQ ID NO: 44581 - protein, 8 aa, Mycobacterium tuberculosis
SCYSVAGE

SEQ ID NO: 44582 - protein, 8 aa, Mycobacterium tuberculosis
CYSVAGEE

SEQ ID NO: 44583 - protein, 8 aa, Mycobacterium tuberculosis
YSVAGEES

SEQ ID NO: 44584 - protein, 8 aa, Mycobacterium tuberculosis
SVAGEESY

SEQ ID NO: 44585 - protein, 8 aa, Mycobacterium tuberculosis
VAGEESYV

SEQ ID NO: 44586 - protein, 8 aa, Mycobacterium tuberculosis
AGEESYVL

SEQ ID NO: 44587 - protein, 8 aa, Mycobacterium tuberculosis
GEESYVLL

SEQ ID NO: 44588 - protein, 8 aa, Mycobacterium tuberculosis
EESYVLLV

SEQ ID NO: 44589 - protein, 8 aa, Mycobacterium tuberculosis
ESYVLLVR

SEQ ID NO: 44590 - protein, 8 aa, Mycobacterium tuberculosis
SYVLLVRV

SEQ ID NO: 44591 - protein, 8 aa, Mycobacterium tuberculosis
YVLLVRVA

SEQ ID NO: 44592 - protein, 8 aa, Mycobacterium tuberculosis
VLLVRVAS

SEQ ID NO: 44593 - protein, 8 aa, Mycobacterium tuberculosis
LLVRVASA

SEQ ID NO: 44594 - protein, 8 aa, Mycobacterium tuberculosis
LVRVASAR

SEQ ID NO: 44595 - protein, 8 aa, Mycobacterium tuberculosis
VRVASARA

SEQ ID NO: 44596 - protein, 8 aa, Mycobacterium tuberculosis
RVASARAL

SEQ ID NO: 44597 - protein, 8 aa, Mycobacterium tuberculosis
VASARALE

SEQ ID NO: 44598 - protein, 8 aa, Mycobacterium tuberculosis
ASARALED

SEQ ID NO: 44599 - protein, 8 aa, Mycobacterium tuberculosis
SARALEDL

SEQ ID NO: 44600 - protein, 8 aa, Mycobacterium tuberculosis
ARALEDLL

SEQ ID NO: 44601 - protein, 8 aa, Mycobacterium tuberculosis
RALEDLLQ

SEQ ID NO: 44602 - protein, 8 aa, Mycobacterium tuberculosis
ALEDLLQR

SEQ ID NO: 44603 - protein, 8 aa, Mycobacterium tuberculosis
LEDLLQRI

SEQ ID NO: 44604 - protein, 8 aa, Mycobacterium tuberculosis
EDLLQRIR

SEQ ID NO: 44605 - protein, 8 aa, Mycobacterium tuberculosis
DLLQRIRT

SEQ ID NO: 44606 - protein, 8 aa, Mycobacterium tuberculosis
LLQRIRTT

SEQ ID NO: 44607 - protein, 8 aa, Mycobacterium tuberculosis
LQRIRTTA

SEQ ID NO: 44608 - protein, 8 aa, Mycobacterium tuberculosis
QRIRTTAN

SEQ ID NO: 44609 - protein, 8 aa, Mycobacterium tuberculosis
RIRTTANV

SEQ ID NO: 44610 - protein, 8 aa, Mycobacterium tuberculosis
IRTTANVR

SEQ ID NO: 44611 - protein, 8 aa, Mycobacterium tuberculosis
RTTANVRT

SEQ ID NO: 44612 - protein, 8 aa, Mycobacterium tuberculosis
TTANVRTR

SEQ ID NO: 44613 - protein, 8 aa, Mycobacterium tuberculosis
TANVRTRS

SEQ ID NO: 44614 - protein, 8 aa, Mycobacterium tuberculosis
ANVRTRST

SEQ ID NO: 44615 - protein, 8 aa, Mycobacterium tuberculosis
NVRTRSTI

SEQ ID NO: 44616 - protein, 8 aa, Mycobacterium tuberculosis
VRTRSTII

SEQ ID NO: 44617 - protein, 8 aa, Mycobacterium tuberculosis
RTRSTIIL

SEQ ID NO: 44618 - protein, 8 aa, Mycobacterium tuberculosis
TRSTIILN

SEQ ID NO: 44619 - protein, 8 aa, Mycobacterium tuberculosis
RSTIILNT

SEQ ID NO: 44620 - protein, 8 aa, Mycobacterium tuberculosis
STIILNTF

SEQ ID NO: 44621 - protein, 8 aa, Mycobacterium tuberculosis
TIILNTFY

SEQ ID NO: 44622 - protein, 8 aa, Mycobacterium tuberculosis
IILNTFYS

SEQ ID NO: 44623 - protein, 8 aa, Mycobacterium tuberculosis
ILNTFYSD

SEQ ID NO: 44624 - protein, 8 aa, Mycobacterium tuberculosis
LNTFYSDR

SEQ ID NO: 44625 - protein, 8 aa, Mycobacterium tuberculosis
NTFYSDRQ

SEQ ID NO: 44626 - protein, 8 aa, Mycobacterium tuberculosis
TFYSDRQH

SEQ ID NO: 44627 - protein, 8 aa, Mycobacterium tuberculosis
FYSDRQHI

SEQ ID NO: 44628 - protein, 8 aa, Mycobacterium tuberculosis
YSDRQHIP

SEQ ID NO: 44629 - protein, 9 aa, Mycobacterium tuberculosis
MNEALDDID

SEQ ID NO: 44630 - protein, 9 aa, Mycobacterium tuberculosis
NEALDDIDR

SEQ ID NO: 44631 - protein, 9 aa, Mycobacterium tuberculosis
EALDDIDRI

SEQ ID NO: 44632 - protein, 9 aa, Mycobacterium tuberculosis
ALDDIDRIL

SEQ ID NO: 44633 - protein, 9 aa, Mycobacterium tuberculosis
LDDIDRILV

SEQ ID NO: 44634 - protein, 9 aa, Mycobacterium tuberculosis
DDIDRILVR

SEQ ID NO: 44635 - protein, 9 aa, Mycobacterium tuberculosis
DIDRILVRE

SEQ ID NO: 44636 - protein, 9 aa, Mycobacterium tuberculosis
IDRILVREL

SEQ ID NO: 44637 - protein, 9 aa, Mycobacterium tuberculosis
DRILVRELA

SEQ ID NO: 44638 - protein, 9 aa, Mycobacterium tuberculosis
RILVRELAA

SEQ ID NO: 44639 - protein, 9 aa, Mycobacterium tuberculosis
ILVRELAAD

SEQ ID NO: 44640 - protein, 9 aa, Mycobacterium tuberculosis
LVRELAADG

SEQ ID NO: 44641 - protein, 9 aa, Mycobacterium tuberculosis
VRELAADGR

SEQ ID NO: 44642 - protein, 9 aa, Mycobacterium tuberculosis
RELAADGRA

SEQ ID NO: 44643 - protein, 9 aa, Mycobacterium tuberculosis
ELAADGRAT

SEQ ID NO: 44644 - protein, 9 aa, Mycobacterium tuberculosis
LAADGRATL

SEQ ID NO: 44645 - protein, 9 aa, Mycobacterium tuberculosis
AADGRATLS

SEQ ID NO: 44646 - protein, 9 aa, Mycobacterium tuberculosis
ADGRATLSE

SEQ ID NO: 44647 - protein, 9 aa, Mycobacterium tuberculosis
DGRATLSEL

SEQ ID NO: 44648 - protein, 9 aa, Mycobacterium tuberculosis
GRATLSELA

SEQ ID NO: 44649 - protein, 9 aa, Mycobacterium tuberculosis
RATLSELAT

SEQ ID NO: 44650 - protein, 9 aa, Mycobacterium tuberculosis
ATLSELATR

SEQ ID NO: 44651 - protein, 9 aa, Mycobacterium tuberculosis
TLSELATRA

SEQ ID NO: 44652 - protein, 9 aa, Mycobacterium tuberculosis
LSELATRAG

SEQ ID NO: 44653 - protein, 9 aa, Mycobacterium tuberculosis
SELATRAGL

SEQ ID NO: 44654 - protein, 9 aa, Mycobacterium tuberculosis
ELATRAGLS

SEQ ID NO: 44655 - protein, 9 aa, Mycobacterium tuberculosis
LATRAGLSV

SEQ ID NO: 44656 - protein, 9 aa, Mycobacterium tuberculosis
ATRAGLSVS

SEQ ID NO: 44657 - protein, 9 aa, Mycobacterium tuberculosis
TRAGLSVSA

SEQ ID NO: 44658 - protein, 9 aa, Mycobacterium tuberculosis
RAGLSVSAV

SEQ ID NO: 44659 - protein, 9 aa, Mycobacterium tuberculosis
AGLSVSAVQ

SEQ ID NO: 44660 - protein, 9 aa, Mycobacterium tuberculosis
GLSVSAVQS

SEQ ID NO: 44661 - protein, 9 aa, Mycobacterium tuberculosis
LSVSAVQSR

SEQ ID NO: 44662 - protein, 9 aa, Mycobacterium tuberculosis
SVSAVQSRV

SEQ ID NO: 44663 - protein, 9 aa, Mycobacterium tuberculosis
VSAVQSRVR

SEQ ID NO: 44664 - protein, 9 aa, Mycobacterium tuberculosis
SAVQSRVRR

SEQ ID NO: 44665 - protein, 9 aa, Mycobacterium tuberculosis
AVQSRVRRL

SEQ ID NO: 44666 - protein, 9 aa, Mycobacterium tuberculosis
VQSRVRRLE

SEQ ID NO: 44667 - protein, 9 aa, Mycobacterium tuberculosis
QSRVRRLES

SEQ ID NO: 44668 - protein, 9 aa, Mycobacterium tuberculosis
SRVRRLESR

SEQ ID NO: 44669 - protein, 9 aa, Mycobacterium tuberculosis
RVRRLESRG

SEQ ID NO: 44670 - protein, 9 aa, Mycobacterium tuberculosis
VRRLESRGV

SEQ ID NO: 44671 - protein, 9 aa, Mycobacterium tuberculosis
RRLESRGVV

SEQ ID NO: 44672 - protein, 9 aa, Mycobacterium tuberculosis
RLESRGVVQ

SEQ ID NO: 44673 - protein, 9 aa, Mycobacterium tuberculosis
LESRGVVQG

SEQ ID NO: 44674 - protein, 9 aa, Mycobacterium tuberculosis
ESRGVVQGY

SEQ ID NO: 44675 - protein, 9 aa, Mycobacterium tuberculosis
SRGVVQGYS

SEQ ID NO: 44676 - protein, 9 aa, Mycobacterium tuberculosis
RGVVQGYSA

SEQ ID NO: 44677 - protein, 9 aa, Mycobacterium tuberculosis
GVVQGYSAR

SEQ ID NO: 44678 - protein, 9 aa, Mycobacterium tuberculosis
VVQGYSARI

SEQ ID NO: 44679 - protein, 9 aa, Mycobacterium tuberculosis
VQGYSARIN

SEQ ID NO: 44680 - protein, 9 aa, Mycobacterium tuberculosis
QGYSARINP

SEQ ID NO: 44681 - protein, 9 aa, Mycobacterium tuberculosis
GYSARINPE

SEQ ID NO: 44682 - protein, 9 aa, Mycobacterium tuberculosis
YSARINPEA

SEQ ID NO: 44683 - protein, 9 aa, Mycobacterium tuberculosis
SARINPEAV

SEQ ID NO: 44684 - protein, 9 aa, Mycobacterium tuberculosis
ARINPEAVG

SEQ ID NO: 44685 - protein, 9 aa, Mycobacterium tuberculosis
RINPEAVGH

SEQ ID NO: 44686 - protein, 9 aa, Mycobacterium tuberculosis
INPEAVGHL

SEQ ID NO: 44687 - protein, 9 aa, Mycobacterium tuberculosis
NPEAVGHLL

SEQ ID NO: 44688 - protein, 9 aa, Mycobacterium tuberculosis
PEAVGHLLS

SEQ ID NO: 44689 - protein, 9 aa, Mycobacterium tuberculosis
EAVGHLLSA

SEQ ID NO: 44690 - protein, 9 aa, Mycobacterium tuberculosis
AVGHLLSAF

SEQ ID NO: 44691 - protein, 9 aa, Mycobacterium tuberculosis
VGHLLSAFV

SEQ ID NO: 44692 - protein, 9 aa, Mycobacterium tuberculosis
GHLLSAFVA

SEQ ID NO: 44693 - protein, 9 aa, Mycobacterium tuberculosis
HLLSAFVAI

SEQ ID NO: 44694 - protein, 9 aa, Mycobacterium tuberculosis
LLSAFVAIT

SEQ ID NO: 44695 - protein, 9 aa, Mycobacterium tuberculosis
LSAFVAITP

SEQ ID NO: 44696 - protein, 9 aa, Mycobacterium tuberculosis
SAFVAITPL

SEQ ID NO: 44697 - protein, 9 aa, Mycobacterium tuberculosis
AFVAITPLD

SEQ ID NO: 44698 - protein, 9 aa, Mycobacterium tuberculosis
FVAITPLDP

SEQ ID NO: 44699 - protein, 9 aa, Mycobacterium tuberculosis
VAITPLDPS

SEQ ID NO: 44700 - protein, 9 aa, Mycobacterium tuberculosis
AITPLDPSQ

SEQ ID NO: 44701 - protein, 9 aa, Mycobacterium tuberculosis
ITPLDPSQP

SEQ ID NO: 44702 - protein, 9 aa, Mycobacterium tuberculosis
TPLDPSQPD

SEQ ID NO: 44703 - protein, 9 aa, Mycobacterium tuberculosis
PLDPSQPDD

SEQ ID NO: 44704 - protein, 9 aa, Mycobacterium tuberculosis
LDPSQPDDA

SEQ ID NO: 44705 - protein, 9 aa, Mycobacterium tuberculosis
DPSQPDDAP

SEQ ID NO: 44706 - protein, 9 aa, Mycobacterium tuberculosis
PSQPDDAPA

SEQ ID NO: 44707 - protein, 9 aa, Mycobacterium tuberculosis
SQPDDAPAR

SEQ ID NO: 44708 - protein, 9 aa, Mycobacterium tuberculosis
QPDDAPARL

SEQ ID NO: 44709 - protein, 9 aa, Mycobacterium tuberculosis
PDDAPARLE

SEQ ID NO: 44710 - protein, 9 aa, Mycobacterium tuberculosis
DDAPARLEH

SEQ ID NO: 44711 - protein, 9 aa, Mycobacterium tuberculosis
DAPARLEHI

SEQ ID NO: 44712 - protein, 9 aa, Mycobacterium tuberculosis
APARLEHIE

SEQ ID NO: 44713 - protein, 9 aa, Mycobacterium tuberculosis
PARLEHIEE

SEQ ID NO: 44714 - protein, 9 aa, Mycobacterium tuberculosis
ARLEHIEEV

SEQ ID NO: 44715 - protein, 9 aa, Mycobacterium tuberculosis
RLEHIEEVE

SEQ ID NO: 44716 - protein, 9 aa, Mycobacterium tuberculosis
LEHIEEVES

SEQ ID NO: 44717 - protein, 9 aa, Mycobacterium tuberculosis
EHIEEVESC

SEQ ID NO: 44718 - protein, 9 aa, Mycobacterium tuberculosis
HIEEVESCY

SEQ ID NO: 44719 - protein, 9 aa, Mycobacterium tuberculosis
IEEVESCYS

SEQ ID NO: 44720 - protein, 9 aa, Mycobacterium tuberculosis
EEVESCYSV

SEQ ID NO: 44721 - protein, 9 aa, Mycobacterium tuberculosis
EVESCYSVA

SEQ ID NO: 44722 - protein, 9 aa, Mycobacterium tuberculosis
VESCYSVAG

SEQ ID NO: 44723 - protein, 9 aa, Mycobacterium tuberculosis
ESCYSVAGE

SEQ ID NO: 44724 - protein, 9 aa, Mycobacterium tuberculosis
SCYSVAGEE

SEQ ID NO: 44725 - protein, 9 aa, Mycobacterium tuberculosis
CYSVAGEES

SEQ ID NO: 44726 - protein, 9 aa, Mycobacterium tuberculosis
YSVAGEESY

SEQ ID NO: 44727 - protein, 9 aa, Mycobacterium tuberculosis
SVAGEESYV

SEQ ID NO: 44728 - protein, 9 aa, Mycobacterium tuberculosis
VAGEESYVL

SEQ ID NO: 44729 - protein, 9 aa, Mycobacterium tuberculosis
AGEESYVLL

SEQ ID NO: 44730 - protein, 9 aa, Mycobacterium tuberculosis
GEESYVLLV

SEQ ID NO: 44731 - protein, 9 aa, Mycobacterium tuberculosis
EESYVLLVR

SEQ ID NO: 44732 - protein, 9 aa, Mycobacterium tuberculosis
ESYVLLVRV

SEQ ID NO: 44733 - protein, 9 aa, Mycobacterium tuberculosis
SYVLLVRVA

SEQ ID NO: 44734 - protein, 9 aa, Mycobacterium tuberculosis
YVLLVRVAS

SEQ ID NO: 44735 - protein, 9 aa, Mycobacterium tuberculosis
VLLVRVASA

SEQ ID NO: 44736 - protein, 9 aa, Mycobacterium tuberculosis
LLVRVASAR

SEQ ID NO: 44737 - protein, 9 aa, Mycobacterium tuberculosis
LVRVASARA

SEQ ID NO: 44738 - protein, 9 aa, Mycobacterium tuberculosis
VRVASARAL

SEQ ID NO: 44739 - protein, 9 aa, Mycobacterium tuberculosis
RVASARALE

SEQ ID NO: 44740 - protein, 9 aa, Mycobacterium tuberculosis
VASARALED

SEQ ID NO: 44741 - protein, 9 aa, Mycobacterium tuberculosis
ASARALEDL

SEQ ID NO: 44742 - protein, 9 aa, Mycobacterium tuberculosis
SARALEDLL

SEQ ID NO: 44743 - protein, 9 aa, Mycobacterium tuberculosis
ARALEDLLQ

SEQ ID NO: 44744 - protein, 9 aa, Mycobacterium tuberculosis
RALEDLLQR

SEQ ID NO: 44745 - protein, 9 aa, Mycobacterium tuberculosis
ALEDLLQRI

SEQ ID NO: 44746 - protein, 9 aa, Mycobacterium tuberculosis
LEDLLQRIR

SEQ ID NO: 44747 - protein, 9 aa, Mycobacterium tuberculosis
EDLLQRIRT

SEQ ID NO: 44748 - protein, 9 aa, Mycobacterium tuberculosis
DLLQRIRTT

SEQ ID NO: 44749 - protein, 9 aa, Mycobacterium tuberculosis
LLQRIRTTA

SEQ ID NO: 44750 - protein, 9 aa, Mycobacterium tuberculosis
LQRIRTTAN

SEQ ID NO: 44751 - protein, 9 aa, Mycobacterium tuberculosis
QRIRTTANV

SEQ ID NO: 44752 - protein, 9 aa, Mycobacterium tuberculosis
RIRTTANVR

SEQ ID NO: 44753 - protein, 9 aa, Mycobacterium tuberculosis
IRTTANVRT

SEQ ID NO: 44754 - protein, 9 aa, Mycobacterium tuberculosis
RTTANVRTR

SEQ ID NO: 44755 - protein, 9 aa, Mycobacterium tuberculosis
TTANVRTRS

SEQ ID NO: 44756 - protein, 9 aa, Mycobacterium tuberculosis
TANVRTRST

SEQ ID NO: 44757 - protein, 9 aa, Mycobacterium tuberculosis
ANVRTRSTI

SEQ ID NO: 44758 - protein, 9 aa, Mycobacterium tuberculosis
NVRTRSTII

SEQ ID NO: 44759 - protein, 9 aa, Mycobacterium tuberculosis
VRTRSTIIL

SEQ ID NO: 44760 - protein, 9 aa, Mycobacterium tuberculosis
RTRSTIILN

SEQ ID NO: 44761 - protein, 9 aa, Mycobacterium tuberculosis
TRSTIILNT

SEQ ID NO: 44762 - protein, 9 aa, Mycobacterium tuberculosis
RSTIILNTF

SEQ ID NO: 44763 - protein, 9 aa, Mycobacterium tuberculosis
STIILNTFY

SEQ ID NO: 44764 - protein, 9 aa, Mycobacterium tuberculosis
TIILNTFYS

SEQ ID NO: 44765 - protein, 9 aa, Mycobacterium tuberculosis
IILNTFYSD

SEQ ID NO: 44766 - protein, 9 aa, Mycobacterium tuberculosis
ILNTFYSDR

SEQ ID NO: 44767 - protein, 9 aa, Mycobacterium tuberculosis
LNTFYSDRQ

SEQ ID NO: 44768 - protein, 9 aa, Mycobacterium tuberculosis
NTFYSDRQH

SEQ ID NO: 44769 - protein, 9 aa, Mycobacterium tuberculosis
TFYSDRQHI

SEQ ID NO: 44770 - protein, 9 aa, Mycobacterium tuberculosis
FYSDRQHIP

SEQ ID NO: 44771 - protein, 10 aa, Mycobacterium tuberculosis
MNEALDDIDR

SEQ ID NO: 44772 - protein, 10 aa, Mycobacterium tuberculosis
NEALDDIDRI

SEQ ID NO: 44773 - protein, 10 aa, Mycobacterium tuberculosis
EALDDIDRIL

SEQ ID NO: 44774 - protein, 10 aa, Mycobacterium tuberculosis
ALDDIDRILV

SEQ ID NO: 44775 - protein, 10 aa, Mycobacterium tuberculosis
LDDIDRILVR

SEQ ID NO: 44776 - protein, 10 aa, Mycobacterium tuberculosis
DDIDRILVRE

SEQ ID NO: 44777 - protein, 10 aa, Mycobacterium tuberculosis
DIDRILVREL

SEQ ID NO: 44778 - protein, 10 aa, Mycobacterium tuberculosis
IDRILVRELA

SEQ ID NO: 44779 - protein, 10 aa, Mycobacterium tuberculosis
DRILVRELAA

SEQ ID NO: 44780 - protein, 10 aa, Mycobacterium tuberculosis
RILVRELAAD

SEQ ID NO: 44781 - protein, 10 aa, Mycobacterium tuberculosis
ILVRELAADG

SEQ ID NO: 44782 - protein, 10 aa, Mycobacterium tuberculosis
LVRELAADGR

SEQ ID NO: 44783 - protein, 10 aa, Mycobacterium tuberculosis
VRELAADGRA

SEQ ID NO: 44784 - protein, 10 aa, Mycobacterium tuberculosis
RELAADGRAT

SEQ ID NO: 44785 - protein, 10 aa, Mycobacterium tuberculosis
ELAADGRATL

SEQ ID NO: 44786 - protein, 10 aa, Mycobacterium tuberculosis
LAADGRATLS

SEQ ID NO: 44787 - protein, 10 aa, Mycobacterium tuberculosis
AADGRATLSE

SEQ ID NO: 44788 - protein, 10 aa, Mycobacterium tuberculosis
ADGRATLSEL

SEQ ID NO: 44789 - protein, 10 aa, Mycobacterium tuberculosis
DGRATLSELA

SEQ ID NO: 44790 - protein, 10 aa, Mycobacterium tuberculosis
GRATLSELAT

SEQ ID NO: 44791 - protein, 10 aa, Mycobacterium tuberculosis
RATLSELATR

SEQ ID NO: 44792 - protein, 10 aa, Mycobacterium tuberculosis
ATLSELATRA

SEQ ID NO: 44793 - protein, 10 aa, Mycobacterium tuberculosis
TLSELATRAG

SEQ ID NO: 44794 - protein, 10 aa, Mycobacterium tuberculosis
LSELATRAGL

SEQ ID NO: 44795 - protein, 10 aa, Mycobacterium tuberculosis
SELATRAGLS

SEQ ID NO: 44796 - protein, 10 aa, Mycobacterium tuberculosis
ELATRAGLSV

SEQ ID NO: 44797 - protein, 10 aa, Mycobacterium tuberculosis
LATRAGLSVS

SEQ ID NO: 44798 - protein, 10 aa, Mycobacterium tuberculosis
ATRAGLSVSA

SEQ ID NO: 44799 - protein, 10 aa, Mycobacterium tuberculosis
TRAGLSVSAV

SEQ ID NO: 44800 - protein, 10 aa, Mycobacterium tuberculosis
RAGLSVSAVQ

SEQ ID NO: 44801 - protein, 10 aa, Mycobacterium tuberculosis
AGLSVSAVQS

SEQ ID NO: 44802 - protein, 10 aa, Mycobacterium tuberculosis
GLSVSAVQSR

SEQ ID NO: 44803 - protein, 10 aa, Mycobacterium tuberculosis
LSVSAVQSRV

SEQ ID NO: 44804 - protein, 10 aa, Mycobacterium tuberculosis
SVSAVQSRVR

SEQ ID NO: 44805 - protein, 10 aa, Mycobacterium tuberculosis
VSAVQSRVRR

SEQ ID NO: 44806 - protein, 10 aa, Mycobacterium tuberculosis
SAVQSRVRRL

SEQ ID NO: 44807 - protein, 10 aa, Mycobacterium tuberculosis
AVQSRVRRLE

SEQ ID NO: 44808 - protein, 10 aa, Mycobacterium tuberculosis
VQSRVRRLES

SEQ ID NO: 44809 - protein, 10 aa, Mycobacterium tuberculosis
QSRVRRLESR

SEQ ID NO: 44810 - protein, 10 aa, Mycobacterium tuberculosis
SRVRRLESRG

SEQ ID NO: 44811 - protein, 10 aa, Mycobacterium tuberculosis
RVRRLESRGV

SEQ ID NO: 44812 - protein, 10 aa, Mycobacterium tuberculosis
VRRLESRGVV

SEQ ID NO: 44813 - protein, 10 aa, Mycobacterium tuberculosis
RRLESRGVVQ

SEQ ID NO: 44814 - protein, 10 aa, Mycobacterium tuberculosis
RLESRGVVQG

SEQ ID NO: 44815 - protein, 10 aa, Mycobacterium tuberculosis
LESRGVVQGY

SEQ ID NO: 44816 - protein, 10 aa, Mycobacterium tuberculosis
ESRGVVQGYS

SEQ ID NO: 44817 - protein, 10 aa, Mycobacterium tuberculosis
SRGVVQGYSA

SEQ ID NO: 44818 - protein, 10 aa, Mycobacterium tuberculosis
RGVVQGYSAR

SEQ ID NO: 44819 - protein, 10 aa, Mycobacterium tuberculosis
GVVQGYSARI

SEQ ID NO: 44820 - protein, 10 aa, Mycobacterium tuberculosis
VVQGYSARIN

SEQ ID NO: 44821 - protein, 10 aa, Mycobacterium tuberculosis
VQGYSARINP

SEQ ID NO: 44822 - protein, 10 aa, Mycobacterium tuberculosis
QGYSARINPE

SEQ ID NO: 44823 - protein, 10 aa, Mycobacterium tuberculosis
GYSARINPEA

SEQ ID NO: 44824 - protein, 10 aa, Mycobacterium tuberculosis
YSARINPEAV

SEQ ID NO: 44825 - protein, 10 aa, Mycobacterium tuberculosis
SARINPEAVG

SEQ ID NO: 44826 - protein, 10 aa, Mycobacterium tuberculosis
ARINPEAVGH

SEQ ID NO: 44827 - protein, 10 aa, Mycobacterium tuberculosis
RINPEAVGHL

SEQ ID NO: 44828 - protein, 10 aa, Mycobacterium tuberculosis
INPEAVGHLL

SEQ ID NO: 44829 - protein, 10 aa, Mycobacterium tuberculosis
NPEAVGHLLS

SEQ ID NO: 44830 - protein, 10 aa, Mycobacterium tuberculosis
PEAVGHLLSA

SEQ ID NO: 44831 - protein, 10 aa, Mycobacterium tuberculosis
EAVGHLLSAF

SEQ ID NO: 44832 - protein, 10 aa, Mycobacterium tuberculosis
AVGHLLSAFV

SEQ ID NO: 44833 - protein, 10 aa, Mycobacterium tuberculosis
VGHLLSAFVA

SEQ ID NO: 44834 - protein, 10 aa, Mycobacterium tuberculosis
GHLLSAFVAI

SEQ ID NO: 44835 - protein, 10 aa, Mycobacterium tuberculosis
HLLSAFVAIT

SEQ ID NO: 44836 - protein, 10 aa, Mycobacterium tuberculosis
LLSAFVAITP

SEQ ID NO: 44837 - protein, 10 aa, Mycobacterium tuberculosis
LSAFVAITPL

SEQ ID NO: 44838 - protein, 10 aa, Mycobacterium tuberculosis
SAFVAITPLD

SEQ ID NO: 44839 - protein, 10 aa, Mycobacterium tuberculosis
AFVAITPLDP

SEQ ID NO: 44840 - protein, 10 aa, Mycobacterium tuberculosis
FVAITPLDPS

SEQ ID NO: 44841 - protein, 10 aa, Mycobacterium tuberculosis
VAITPLDPSQ

SEQ ID NO: 44842 - protein, 10 aa, Mycobacterium tuberculosis
AITPLDPSQP

SEQ ID NO: 44843 - protein, 10 aa, Mycobacterium tuberculosis
ITPLDPSQPD

SEQ ID NO: 44844 - protein, 10 aa, Mycobacterium tuberculosis
TPLDPSQPDD

SEQ ID NO: 44845 - protein, 10 aa, Mycobacterium tuberculosis
PLDPSQPDDA

SEQ ID NO: 44846 - protein, 10 aa, Mycobacterium tuberculosis
LDPSQPDDAP

SEQ ID NO: 44847 - protein, 10 aa, Mycobacterium tuberculosis
DPSQPDDAPA

SEQ ID NO: 44848 - protein, 10 aa, Mycobacterium tuberculosis
PSQPDDAPAR

SEQ ID NO: 44849 - protein, 10 aa, Mycobacterium tuberculosis
SQPDDAPARL

SEQ ID NO: 44850 - protein, 10 aa, Mycobacterium tuberculosis
QPDDAPARLE

SEQ ID NO: 44851 - protein, 10 aa, Mycobacterium tuberculosis
PDDAPARLEH

SEQ ID NO: 44852 - protein, 10 aa, Mycobacterium tuberculosis
DDAPARLEHI

SEQ ID NO: 44853 - protein, 10 aa, Mycobacterium tuberculosis
DAPARLEHIE

SEQ ID NO: 44854 - protein, 10 aa, Mycobacterium tuberculosis
APARLEHIEE

SEQ ID NO: 44855 - protein, 10 aa, Mycobacterium tuberculosis
PARLEHIEEV

SEQ ID NO: 44856 - protein, 10 aa, Mycobacterium tuberculosis
ARLEHIEEVE

SEQ ID NO: 44857 - protein, 10 aa, Mycobacterium tuberculosis
RLEHIEEVES

SEQ ID NO: 44858 - protein, 10 aa, Mycobacterium tuberculosis
LEHIEEVESC

SEQ ID NO: 44859 - protein, 10 aa, Mycobacterium tuberculosis
EHIEEVESCY

SEQ ID NO: 44860 - protein, 10 aa, Mycobacterium tuberculosis
HIEEVESCYS

SEQ ID NO: 44861 - protein, 10 aa, Mycobacterium tuberculosis
IEEVESCYSV

SEQ ID NO: 44862 - protein, 10 aa, Mycobacterium tuberculosis
EEVESCYSVA

SEQ ID NO: 44863 - protein, 10 aa, Mycobacterium tuberculosis
EVESCYSVAG

SEQ ID NO: 44864 - protein, 10 aa, Mycobacterium tuberculosis
VESCYSVAGE

SEQ ID NO: 44865 - protein, 10 aa, Mycobacterium tuberculosis
ESCYSVAGEE

SEQ ID NO: 44866 - protein, 10 aa, Mycobacterium tuberculosis
SCYSVAGEES

SEQ ID NO: 44867 - protein, 10 aa, Mycobacterium tuberculosis
CYSVAGEESY

SEQ ID NO: 44868 - protein, 10 aa, Mycobacterium tuberculosis
YSVAGEESYV

SEQ ID NO: 44869 - protein, 10 aa, Mycobacterium tuberculosis
SVAGEESYVL

SEQ ID NO: 44870 - protein, 10 aa, Mycobacterium tuberculosis
VAGEESYVLL

SEQ ID NO: 44871 - protein, 10 aa, Mycobacterium tuberculosis
AGEESYVLLV

SEQ ID NO: 44872 - protein, 10 aa, Mycobacterium tuberculosis
GEESYVLLVR

SEQ ID NO: 44873 - protein, 10 aa, Mycobacterium tuberculosis
EESYVLLVRV

SEQ ID NO: 44874 - protein, 10 aa, Mycobacterium tuberculosis
ESYVLLVRVA

SEQ ID NO: 44875 - protein, 10 aa, Mycobacterium tuberculosis
SYVLLVRVAS

SEQ ID NO: 44876 - protein, 10 aa, Mycobacterium tuberculosis
YVLLVRVASA

SEQ ID NO: 44877 - protein, 10 aa, Mycobacterium tuberculosis
VLLVRVASAR

SEQ ID NO: 44878 - protein, 10 aa, Mycobacterium tuberculosis
LLVRVASARA

SEQ ID NO: 44879 - protein, 10 aa, Mycobacterium tuberculosis
LVRVASARAL

SEQ ID NO: 44880 - protein, 10 aa, Mycobacterium tuberculosis
VRVASARALE

SEQ ID NO: 44881 - protein, 10 aa, Mycobacterium tuberculosis
RVASARALED

SEQ ID NO: 44882 - protein, 10 aa, Mycobacterium tuberculosis
VASARALEDL

SEQ ID NO: 44883 - protein, 10 aa, Mycobacterium tuberculosis
ASARALEDLL

SEQ ID NO: 44884 - protein, 10 aa, Mycobacterium tuberculosis
SARALEDLLQ

SEQ ID NO: 44885 - protein, 10 aa, Mycobacterium tuberculosis
ARALEDLLQR

SEQ ID NO: 44886 - protein, 10 aa, Mycobacterium tuberculosis
RALEDLLQRI

SEQ ID NO: 44887 - protein, 10 aa, Mycobacterium tuberculosis
ALEDLLQRIR

SEQ ID NO: 44888 - protein, 10 aa, Mycobacterium tuberculosis
LEDLLQRIRT

SEQ ID NO: 44889 - protein, 10 aa, Mycobacterium tuberculosis
EDLLQRIRTT

SEQ ID NO: 44890 - protein, 10 aa, Mycobacterium tuberculosis
DLLQRIRTTA

SEQ ID NO: 44891 - protein, 10 aa, Mycobacterium tuberculosis
LLQRIRTTAN

SEQ ID NO: 44892 - protein, 10 aa, Mycobacterium tuberculosis
LQRIRTTANV

SEQ ID NO: 44893 - protein, 10 aa, Mycobacterium tuberculosis
QRIRTTANVR

SEQ ID NO: 44894 - protein, 10 aa, Mycobacterium tuberculosis
RIRTTANVRT

SEQ ID NO: 44895 - protein, 10 aa, Mycobacterium tuberculosis
IRTTANVRTR

SEQ ID NO: 44896 - protein, 10 aa, Mycobacterium tuberculosis
RTTANVRTRS

SEQ ID NO: 44897 - protein, 10 aa, Mycobacterium tuberculosis
TTANVRTRST

SEQ ID NO: 44898 - protein, 10 aa, Mycobacterium tuberculosis
TANVRTRSTI

SEQ ID NO: 44899 - protein, 10 aa, Mycobacterium tuberculosis
ANVRTRSTII

SEQ ID NO: 44900 - protein, 10 aa, Mycobacterium tuberculosis
NVRTRSTIIL

SEQ ID NO: 44901 - protein, 10 aa, Mycobacterium tuberculosis
VRTRSTIILN

SEQ ID NO: 44902 - protein, 10 aa, Mycobacterium tuberculosis
RTRSTIILNT

SEQ ID NO: 44903 - protein, 10 aa, Mycobacterium tuberculosis
TRSTIILNTF

SEQ ID NO: 44904 - protein, 10 aa, Mycobacterium tuberculosis
RSTIILNTFY

SEQ ID NO: 44905 - protein, 10 aa, Mycobacterium tuberculosis
STIILNTFYS

SEQ ID NO: 44906 - protein, 10 aa, Mycobacterium tuberculosis
TIILNTFYSD

SEQ ID NO: 44907 - protein, 10 aa, Mycobacterium tuberculosis
IILNTFYSDR

SEQ ID NO: 44908 - protein, 10 aa, Mycobacterium tuberculosis
ILNTFYSDRQ

SEQ ID NO: 44909 - protein, 10 aa, Mycobacterium tuberculosis
LNTFYSDRQH

SEQ ID NO: 44910 - protein, 10 aa, Mycobacterium tuberculosis
NTFYSDRQHI

SEQ ID NO: 44911 - protein, 10 aa, Mycobacterium tuberculosis
TFYSDRQHIP

SEQ ID NO: 44912 - protein, 11 aa, Mycobacterium tuberculosis
MNEALDDIDRI

SEQ ID NO: 44913 - protein, 11 aa, Mycobacterium tuberculosis
NEALDDIDRIL

SEQ ID NO: 44914 - protein, 11 aa, Mycobacterium tuberculosis
EALDDIDRILV

SEQ ID NO: 44915 - protein, 11 aa, Mycobacterium tuberculosis
ALDDIDRILVR

SEQ ID NO: 44916 - protein, 11 aa, Mycobacterium tuberculosis
LDDIDRILVRE

SEQ ID NO: 44917 - protein, 11 aa, Mycobacterium tuberculosis
DDIDRILVREL

SEQ ID NO: 44918 - protein, 11 aa, Mycobacterium tuberculosis
DIDRILVRELA

SEQ ID NO: 44919 - protein, 11 aa, Mycobacterium tuberculosis
IDRILVRELAA

SEQ ID NO: 44920 - protein, 11 aa, Mycobacterium tuberculosis
DRILVRELAAD

SEQ ID NO: 44921 - protein, 11 aa, Mycobacterium tuberculosis
RILVRELAADG

SEQ ID NO: 44922 - protein, 11 aa, Mycobacterium tuberculosis
ILVRELAADGR

SEQ ID NO: 44923 - protein, 11 aa, Mycobacterium tuberculosis
LVRELAADGRA

SEQ ID NO: 44924 - protein, 11 aa, Mycobacterium tuberculosis
VRELAADGRAT

SEQ ID NO: 44925 - protein, 11 aa, Mycobacterium tuberculosis
RELAADGRATL

SEQ ID NO: 44926 - protein, 11 aa, Mycobacterium tuberculosis
ELAADGRATLS

SEQ ID NO: 44927 - protein, 11 aa, Mycobacterium tuberculosis
LAADGRATLSE

SEQ ID NO: 44928 - protein, 11 aa, Mycobacterium tuberculosis
AADGRATLSEL

SEQ ID NO: 44929 - protein, 11 aa, Mycobacterium tuberculosis
ADGRATLSELA

SEQ ID NO: 44930 - protein, 11 aa, Mycobacterium tuberculosis
DGRATLSELAT

SEQ ID NO: 44931 - protein, 11 aa, Mycobacterium tuberculosis
GRATLSELATR

SEQ ID NO: 44932 - protein, 11 aa, Mycobacterium tuberculosis
RATLSELATRA

SEQ ID NO: 44933 - protein, 11 aa, Mycobacterium tuberculosis
ATLSELATRAG

SEQ ID NO: 44934 - protein, 11 aa, Mycobacterium tuberculosis
TLSELATRAGL

SEQ ID NO: 44935 - protein, 11 aa, Mycobacterium tuberculosis
LSELATRAGLS

SEQ ID NO: 44936 - protein, 11 aa, Mycobacterium tuberculosis
SELATRAGLSV

SEQ ID NO: 44937 - protein, 11 aa, Mycobacterium tuberculosis
ELATRAGLSVS

SEQ ID NO: 44938 - protein, 11 aa, Mycobacterium tuberculosis
LATRAGLSVSA

SEQ ID NO: 44939 - protein, 11 aa, Mycobacterium tuberculosis
ATRAGLSVSAV

SEQ ID NO: 44940 - protein, 11 aa, Mycobacterium tuberculosis
TRAGLSVSAVQ

SEQ ID NO: 44941 - protein, 11 aa, Mycobacterium tuberculosis
RAGLSVSAVQS

SEQ ID NO: 44942 - protein, 11 aa, Mycobacterium tuberculosis
AGLSVSAVQSR

SEQ ID NO: 44943 - protein, 11 aa, Mycobacterium tuberculosis
GLSVSAVQSRV

SEQ ID NO: 44944 - protein, 11 aa, Mycobacterium tuberculosis
LSVSAVQSRVR

SEQ ID NO: 44945 - protein, 11 aa, Mycobacterium tuberculosis
SVSAVQSRVRR

SEQ ID NO: 44946 - protein, 11 aa, Mycobacterium tuberculosis
VSAVQSRVRRL

SEQ ID NO: 44947 - protein, 11 aa, Mycobacterium tuberculosis
SAVQSRVRRLE

SEQ ID NO: 44948 - protein, 11 aa, Mycobacterium tuberculosis
AVQSRVRRLES

SEQ ID NO: 44949 - protein, 11 aa, Mycobacterium tuberculosis
VQSRVRRLESR

SEQ ID NO: 44950 - protein, 11 aa, Mycobacterium tuberculosis
QSRVRRLESRG

SEQ ID NO: 44951 - protein, 11 aa, Mycobacterium tuberculosis
SRVRRLESRGV

SEQ ID NO: 44952 - protein, 11 aa, Mycobacterium tuberculosis
RVRRLESRGVV

SEQ ID NO: 44953 - protein, 11 aa, Mycobacterium tuberculosis
VRRLESRGVVQ

SEQ ID NO: 44954 - protein, 11 aa, Mycobacterium tuberculosis
RRLESRGVVQG

SEQ ID NO: 44955 - protein, 11 aa, Mycobacterium tuberculosis
RLESRGVVQGY

SEQ ID NO: 44956 - protein, 11 aa, Mycobacterium tuberculosis
LESRGVVQGYS

SEQ ID NO: 44957 - protein, 11 aa, Mycobacterium tuberculosis
ESRGVVQGYSA

SEQ ID NO: 44958 - protein, 11 aa, Mycobacterium tuberculosis
SRGVVQGYSAR

SEQ ID NO: 44959 - protein, 11 aa, Mycobacterium tuberculosis
RGVVQGYSARI

SEQ ID NO: 44960 - protein, 11 aa, Mycobacterium tuberculosis
GVVQGYSARIN

SEQ ID NO: 44961 - protein, 11 aa, Mycobacterium tuberculosis
VVQGYSARINP

SEQ ID NO: 44962 - protein, 11 aa, Mycobacterium tuberculosis
VQGYSARINPE

SEQ ID NO: 44963 - protein, 11 aa, Mycobacterium tuberculosis
QGYSARINPEA

SEQ ID NO: 44964 - protein, 11 aa, Mycobacterium tuberculosis
GYSARINPEAV

SEQ ID NO: 44965 - protein, 11 aa, Mycobacterium tuberculosis
YSARINPEAVG

SEQ ID NO: 44966 - protein, 11 aa, Mycobacterium tuberculosis
SARINPEAVGH

SEQ ID NO: 44967 - protein, 11 aa, Mycobacterium tuberculosis
ARINPEAVGHL

SEQ ID NO: 44968 - protein, 11 aa, Mycobacterium tuberculosis
RINPEAVGHLL

SEQ ID NO: 44969 - protein, 11 aa, Mycobacterium tuberculosis
INPEAVGHLLS

SEQ ID NO: 44970 - protein, 11 aa, Mycobacterium tuberculosis
NPEAVGHLLSA

SEQ ID NO: 44971 - protein, 11 aa, Mycobacterium tuberculosis
PEAVGHLLSAF

SEQ ID NO: 44972 - protein, 11 aa, Mycobacterium tuberculosis
EAVGHLLSAFV

SEQ ID NO: 44973 - protein, 11 aa, Mycobacterium tuberculosis
AVGHLLSAFVA

SEQ ID NO: 44974 - protein, 11 aa, Mycobacterium tuberculosis
VGHLLSAFVAI

SEQ ID NO: 44975 - protein, 11 aa, Mycobacterium tuberculosis
GHLLSAFVAIT

SEQ ID NO: 44976 - protein, 11 aa, Mycobacterium tuberculosis
HLLSAFVAITP

SEQ ID NO: 44977 - protein, 11 aa, Mycobacterium tuberculosis
LLSAFVAITPL

SEQ ID NO: 44978 - protein, 11 aa, Mycobacterium tuberculosis
LSAFVAITPLD

SEQ ID NO: 44979 - protein, 11 aa, Mycobacterium tuberculosis
SAFVAITPLDP

SEQ ID NO: 44980 - protein, 11 aa, Mycobacterium tuberculosis
AFVAITPLDPS

SEQ ID NO: 44981 - protein, 11 aa, Mycobacterium tuberculosis
FVAITPLDPSQ

SEQ ID NO: 44982 - protein, 11 aa, Mycobacterium tuberculosis
VAITPLDPSQP

SEQ ID NO: 44983 - protein, 11 aa, Mycobacterium tuberculosis
AITPLDPSQPD

SEQ ID NO: 44984 - protein, 11 aa, Mycobacterium tuberculosis
ITPLDPSQPDD

SEQ ID NO: 44985 - protein, 11 aa, Mycobacterium tuberculosis
TPLDPSQPDDA

SEQ ID NO: 44986 - protein, 11 aa, Mycobacterium tuberculosis
PLDPSQPDDAP

SEQ ID NO: 44987 - protein, 11 aa, Mycobacterium tuberculosis
LDPSQPDDAPA

SEQ ID NO: 44988 - protein, 11 aa, Mycobacterium tuberculosis
DPSQPDDAPAR

SEQ ID NO: 44989 - protein, 11 aa, Mycobacterium tuberculosis
PSQPDDAPARL

SEQ ID NO: 44990 - protein, 11 aa, Mycobacterium tuberculosis
SQPDDAPARLE

SEQ ID NO: 44991 - protein, 11 aa, Mycobacterium tuberculosis
QPDDAPARLEH

SEQ ID NO: 44992 - protein, 11 aa, Mycobacterium tuberculosis
PDDAPARLEHI

SEQ ID NO: 44993 - protein, 11 aa, Mycobacterium tuberculosis
DDAPARLEHIE

SEQ ID NO: 44994 - protein, 11 aa, Mycobacterium tuberculosis
DAPARLEHIEE

SEQ ID NO: 44995 - protein, 11 aa, Mycobacterium tuberculosis
APARLEHIEEV

SEQ ID NO: 44996 - protein, 11 aa, Mycobacterium tuberculosis
PARLEHIEEVE

SEQ ID NO: 44997 - protein, 11 aa, Mycobacterium tuberculosis
ARLEHIEEVES

SEQ ID NO: 44998 - protein, 11 aa, Mycobacterium tuberculosis
RLEHIEEVESC

SEQ ID NO: 44999 - protein, 11 aa, Mycobacterium tuberculosis
LEHIEEVESCY

SEQ ID NO: 45000 - protein, 11 aa, Mycobacterium tuberculosis
EHIEEVESCYS

SEQ ID NO: 45001 - protein, 11 aa, Mycobacterium tuberculosis
HIEEVESCYSV

SEQ ID NO: 45002 - protein, 11 aa, Mycobacterium tuberculosis
IEEVESCYSVA

SEQ ID NO: 45003 - protein, 11 aa, Mycobacterium tuberculosis
EEVESCYSVAG

SEQ ID NO: 45004 - protein, 11 aa, Mycobacterium tuberculosis
EVESCYSVAGE

SEQ ID NO: 45005 - protein, 11 aa, Mycobacterium tuberculosis
VESCYSVAGEE

SEQ ID NO: 45006 - protein, 11 aa, Mycobacterium tuberculosis
ESCYSVAGEES

SEQ ID NO: 45007 - protein, 11 aa, Mycobacterium tuberculosis
SCYSVAGEESY

SEQ ID NO: 45008 - protein, 11 aa, Mycobacterium tuberculosis
CYSVAGEESYV

SEQ ID NO: 45009 - protein, 11 aa, Mycobacterium tuberculosis
YSVAGEESYVL

SEQ ID NO: 45010 - protein, 11 aa, Mycobacterium tuberculosis
SVAGEESYVLL

SEQ ID NO: 45011 - protein, 11 aa, Mycobacterium tuberculosis
VAGEESYVLLV

SEQ ID NO: 45012 - protein, 11 aa, Mycobacterium tuberculosis
AGEESYVLLVR

SEQ ID NO: 45013 - protein, 11 aa, Mycobacterium tuberculosis
GEESYVLLVRV

SEQ ID NO: 45014 - protein, 11 aa, Mycobacterium tuberculosis
EESYVLLVRVA

SEQ ID NO: 45015 - protein, 11 aa, Mycobacterium tuberculosis
ESYVLLVRVAS

SEQ ID NO: 45016 - protein, 11 aa, Mycobacterium tuberculosis
SYVLLVRVASA

SEQ ID NO: 45017 - protein, 11 aa, Mycobacterium tuberculosis
YVLLVRVASAR

SEQ ID NO: 45018 - protein, 11 aa, Mycobacterium tuberculosis
VLLVRVASARA

SEQ ID NO: 45019 - protein, 11 aa, Mycobacterium tuberculosis
LLVRVASARAL

SEQ ID NO: 45020 - protein, 11 aa, Mycobacterium tuberculosis
LVRVASARALE

SEQ ID NO: 45021 - protein, 11 aa, Mycobacterium tuberculosis
VRVASARALED

SEQ ID NO: 45022 - protein, 11 aa, Mycobacterium tuberculosis
RVASARALEDL

SEQ ID NO: 45023 - protein, 11 aa, Mycobacterium tuberculosis
VASARALEDLL

SEQ ID NO: 45024 - protein, 11 aa, Mycobacterium tuberculosis
ASARALEDLLQ

SEQ ID NO: 45025 - protein, 11 aa, Mycobacterium tuberculosis
SARALEDLLQR

SEQ ID NO: 45026 - protein, 11 aa, Mycobacterium tuberculosis
ARALEDLLQRI

SEQ ID NO: 45027 - protein, 11 aa, Mycobacterium tuberculosis
RALEDLLQRIR

SEQ ID NO: 45028 - protein, 11 aa, Mycobacterium tuberculosis
ALEDLLQRIRT

SEQ ID NO: 45029 - protein, 11 aa, Mycobacterium tuberculosis
LEDLLQRIRTT

SEQ ID NO: 45030 - protein, 11 aa, Mycobacterium tuberculosis
EDLLQRIRTTA

SEQ ID NO: 45031 - protein, 11 aa, Mycobacterium tuberculosis
DLLQRIRTTAN

SEQ ID NO: 45032 - protein, 11 aa, Mycobacterium tuberculosis
LLQRIRTTANV

SEQ ID NO: 45033 - protein, 11 aa, Mycobacterium tuberculosis
LQRIRTTANVR

SEQ ID NO: 45034 - protein, 11 aa, Mycobacterium tuberculosis
QRIRTTANVRT

SEQ ID NO: 45035 - protein, 11 aa, Mycobacterium tuberculosis
RIRTTANVRTR

SEQ ID NO: 45036 - protein, 11 aa, Mycobacterium tuberculosis
IRTTANVRTRS

SEQ ID NO: 45037 - protein, 11 aa, Mycobacterium tuberculosis
RTTANVRTRST

SEQ ID NO: 45038 - protein, 11 aa, Mycobacterium tuberculosis
TTANVRTRSTI

SEQ ID NO: 45039 - protein, 11 aa, Mycobacterium tuberculosis
TANVRTRSTII

SEQ ID NO: 45040 - protein, 11 aa, Mycobacterium tuberculosis
ANVRTRSTIIL

SEQ ID NO: 45041 - protein, 11 aa, Mycobacterium tuberculosis
NVRTRSTIILN

SEQ ID NO: 45042 - protein, 11 aa, Mycobacterium tuberculosis
VRTRSTIILNT

SEQ ID NO: 45043 - protein, 11 aa, Mycobacterium tuberculosis
RTRSTIILNTF

SEQ ID NO: 45044 - protein, 11 aa, Mycobacterium tuberculosis
TRSTIILNTFY

SEQ ID NO: 45045 - protein, 11 aa, Mycobacterium tuberculosis
RSTIILNTFYS

SEQ ID NO: 45046 - protein, 11 aa, Mycobacterium tuberculosis
STIILNTFYSD

SEQ ID NO: 45047 - protein, 11 aa, Mycobacterium tuberculosis
TIILNTFYSDR

SEQ ID NO: 45048 - protein, 11 aa, Mycobacterium tuberculosis
IILNTFYSDRQ

SEQ ID NO: 45049 - protein, 11 aa, Mycobacterium tuberculosis
ILNTFYSDRQH

SEQ ID NO: 45050 - protein, 11 aa, Mycobacterium tuberculosis
LNTFYSDRQHI

SEQ ID NO: 45051 - protein, 11 aa, Mycobacterium tuberculosis
NTFYSDRQHIP

SEQ ID NO: 45052 - protein, 8 aa, Mycobacterium tuberculosis
MNADPVLS

SEQ ID NO: 45053 - protein, 8 aa, Mycobacterium tuberculosis
NADPVLSY

SEQ ID NO: 45054 - protein, 8 aa, Mycobacterium tuberculosis
ADPVLSYN

SEQ ID NO: 45055 - protein, 8 aa, Mycobacterium tuberculosis
DPVLSYNF

SEQ ID NO: 45056 - protein, 8 aa, Mycobacterium tuberculosis
PVLSYNFD

SEQ ID NO: 45057 - protein, 8 aa, Mycobacterium tuberculosis
VLSYNFDA

SEQ ID NO: 45058 - protein, 8 aa, Mycobacterium tuberculosis
LSYNFDAI

SEQ ID NO: 45059 - protein, 8 aa, Mycobacterium tuberculosis
SYNFDAIE

SEQ ID NO: 45060 - protein, 8 aa, Mycobacterium tuberculosis
YNFDAIEY

SEQ ID NO: 45061 - protein, 8 aa, Mycobacterium tuberculosis
NFDAIEYS

SEQ ID NO: 45062 - protein, 8 aa, Mycobacterium tuberculosis
FDAIEYSV

SEQ ID NO: 45063 - protein, 8 aa, Mycobacterium tuberculosis
DAIEYSVR

SEQ ID NO: 45064 - protein, 8 aa, Mycobacterium tuberculosis
AIEYSVRQ

SEQ ID NO: 45065 - protein, 8 aa, Mycobacterium tuberculosis
IEYSVRQE

SEQ ID NO: 45066 - protein, 8 aa, Mycobacterium tuberculosis
EYSVRQEI

SEQ ID NO: 45067 - protein, 8 aa, Mycobacterium tuberculosis
YSVRQEIH

SEQ ID NO: 45068 - protein, 8 aa, Mycobacterium tuberculosis
SVRQEIHT

SEQ ID NO: 45069 - protein, 8 aa, Mycobacterium tuberculosis
VRQEIHTT

SEQ ID NO: 45070 - protein, 8 aa, Mycobacterium tuberculosis
RQEIHTTA

SEQ ID NO: 45071 - protein, 8 aa, Mycobacterium tuberculosis
QEIHTTAA

SEQ ID NO: 45072 - protein, 8 aa, Mycobacterium tuberculosis
EIHTTAAR

SEQ ID NO: 45073 - protein, 8 aa, Mycobacterium tuberculosis
IHTTAARF

SEQ ID NO: 45074 - protein, 8 aa, Mycobacterium tuberculosis
HTTAARFN

SEQ ID NO: 45075 - protein, 8 aa, Mycobacterium tuberculosis
TTAARFNA

SEQ ID NO: 45076 - protein, 8 aa, Mycobacterium tuberculosis
TAARFNAA

SEQ ID NO: 45077 - protein, 8 aa, Mycobacterium tuberculosis
AARFNAAL

SEQ ID NO: 45078 - protein, 8 aa, Mycobacterium tuberculosis
ARFNAALQ

SEQ ID NO: 45079 - protein, 8 aa, Mycobacterium tuberculosis
RFNAALQE

SEQ ID NO: 45080 - protein, 8 aa, Mycobacterium tuberculosis
FNAALQEL

SEQ ID NO: 45081 - protein, 8 aa, Mycobacterium tuberculosis
NAALQELR

SEQ ID NO: 45082 - protein, 8 aa, Mycobacterium tuberculosis
AALQELRS

SEQ ID NO: 45083 - protein, 8 aa, Mycobacterium tuberculosis
ALQELRSQ

SEQ ID NO: 45084 - protein, 8 aa, Mycobacterium tuberculosis
LQELRSQI

SEQ ID NO: 45085 - protein, 8 aa, Mycobacterium tuberculosis
QELRSQIA

SEQ ID NO: 45086 - protein, 8 aa, Mycobacterium tuberculosis
ELRSQIAP

SEQ ID NO: 45087 - protein, 8 aa, Mycobacterium tuberculosis
LRSQIAPL

SEQ ID NO: 45088 - protein, 8 aa, Mycobacterium tuberculosis
RSQIAPLQ

SEQ ID NO: 45089 - protein, 8 aa, Mycobacterium tuberculosis
SQIAPLQQ

SEQ ID NO: 45090 - protein, 8 aa, Mycobacterium tuberculosis
QIAPLQQL

SEQ ID NO: 45091 - protein, 8 aa, Mycobacterium tuberculosis
IAPLQQLW

SEQ ID NO: 45092 - protein, 8 aa, Mycobacterium tuberculosis
APLQQLWT

SEQ ID NO: 45093 - protein, 8 aa, Mycobacterium tuberculosis
PLQQLWTR

SEQ ID NO: 45094 - protein, 8 aa, Mycobacterium tuberculosis
LQQLWTRE

SEQ ID NO: 45095 - protein, 8 aa, Mycobacterium tuberculosis
QQLWTREA

SEQ ID NO: 45096 - protein, 8 aa, Mycobacterium tuberculosis
QLWTREAA

SEQ ID NO: 45097 - protein, 8 aa, Mycobacterium tuberculosis
LWTREAAA

SEQ ID NO: 45098 - protein, 8 aa, Mycobacterium tuberculosis
WTREAAAA

SEQ ID NO: 45099 - protein, 8 aa, Mycobacterium tuberculosis
TREAAAAY

SEQ ID NO: 45100 - protein, 8 aa, Mycobacterium tuberculosis
REAAAAYH

SEQ ID NO: 45101 - protein, 8 aa, Mycobacterium tuberculosis
EAAAAYHA

SEQ ID NO: 45102 - protein, 8 aa, Mycobacterium tuberculosis
AAAAYHAE

SEQ ID NO: 45103 - protein, 8 aa, Mycobacterium tuberculosis
AAAYHAEQ

SEQ ID NO: 45104 - protein, 8 aa, Mycobacterium tuberculosis
AAYHAEQL

SEQ ID NO: 45105 - protein, 8 aa, Mycobacterium tuberculosis
AYHAEQLK

SEQ ID NO: 45106 - protein, 8 aa, Mycobacterium tuberculosis
YHAEQLKW

SEQ ID NO: 45107 - protein, 8 aa, Mycobacterium tuberculosis
HAEQLKWH

SEQ ID NO: 45108 - protein, 8 aa, Mycobacterium tuberculosis
AEQLKWHQ

SEQ ID NO: 45109 - protein, 8 aa, Mycobacterium tuberculosis
EQLKWHQA

SEQ ID NO: 45110 - protein, 8 aa, Mycobacterium tuberculosis
QLKWHQAA

SEQ ID NO: 45111 - protein, 8 aa, Mycobacterium tuberculosis
LKWHQAAS

SEQ ID NO: 45112 - protein, 8 aa, Mycobacterium tuberculosis
KWHQAASA

SEQ ID NO: 45113 - protein, 8 aa, Mycobacterium tuberculosis
WHQAASAL

SEQ ID NO: 45114 - protein, 8 aa, Mycobacterium tuberculosis
HQAASALN

SEQ ID NO: 45115 - protein, 8 aa, Mycobacterium tuberculosis
QAASALNE

SEQ ID NO: 45116 - protein, 8 aa, Mycobacterium tuberculosis
AASALNEI

SEQ ID NO: 45117 - protein, 8 aa, Mycobacterium tuberculosis
ASALNEIL

SEQ ID NO: 45118 - protein, 8 aa, Mycobacterium tuberculosis
SALNEILI

SEQ ID NO: 45119 - protein, 8 aa, Mycobacterium tuberculosis
ALNEILID

SEQ ID NO: 45120 - protein, 8 aa, Mycobacterium tuberculosis
LNEILIDL

SEQ ID NO: 45121 - protein, 8 aa, Mycobacterium tuberculosis
NEILIDLG

SEQ ID NO: 45122 - protein, 8 aa, Mycobacterium tuberculosis
EILIDLGN

SEQ ID NO: 45123 - protein, 8 aa, Mycobacterium tuberculosis
ILIDLGNA

SEQ ID NO: 45124 - protein, 8 aa, Mycobacterium tuberculosis
LIDLGNAV

SEQ ID NO: 45125 - protein, 8 aa, Mycobacterium tuberculosis
IDLGNAVR

SEQ ID NO: 45126 - protein, 8 aa, Mycobacterium tuberculosis
DLGNAVRH

SEQ ID NO: 45127 - protein, 8 aa, Mycobacterium tuberculosis
LGNAVRHG

SEQ ID NO: 45128 - protein, 8 aa, Mycobacterium tuberculosis
GNAVRHGA

SEQ ID NO: 45129 - protein, 8 aa, Mycobacterium tuberculosis
NAVRHGAD

SEQ ID NO: 45130 - protein, 8 aa, Mycobacterium tuberculosis
AVRHGADD

SEQ ID NO: 45131 - protein, 8 aa, Mycobacterium tuberculosis
VRHGADDV

SEQ ID NO: 45132 - protein, 8 aa, Mycobacterium tuberculosis
RHGADDVA

SEQ ID NO: 45133 - protein, 8 aa, Mycobacterium tuberculosis
HGADDVAH

SEQ ID NO: 45134 - protein, 8 aa, Mycobacterium tuberculosis
GADDVAHA

SEQ ID NO: 45135 - protein, 8 aa, Mycobacterium tuberculosis
ADDVAHAD

SEQ ID NO: 45136 - protein, 8 aa, Mycobacterium tuberculosis
DDVAHADR

SEQ ID NO: 45137 - protein, 8 aa, Mycobacterium tuberculosis
DVAHADRR

SEQ ID NO: 45138 - protein, 8 aa, Mycobacterium tuberculosis
VAHADRRA

SEQ ID NO: 45139 - protein, 8 aa, Mycobacterium tuberculosis
AHADRRAA

SEQ ID NO: 45140 - protein, 8 aa, Mycobacterium tuberculosis
HADRRAAG

SEQ ID NO: 45141 - protein, 8 aa, Mycobacterium tuberculosis
ADRRAAGA

SEQ ID NO: 45142 - protein, 8 aa, Mycobacterium tuberculosis
DRRAAGAW

SEQ ID NO: 45143 - protein, 8 aa, Mycobacterium tuberculosis
RRAAGAWA

SEQ ID NO: 45144 - protein, 8 aa, Mycobacterium tuberculosis
RAAGAWAR

SEQ ID NO: 45145 - protein, 9 aa, Mycobacterium tuberculosis
MNADPVLSY

SEQ ID NO: 45146 - protein, 9 aa, Mycobacterium tuberculosis
NADPVLSYN

SEQ ID NO: 45147 - protein, 9 aa, Mycobacterium tuberculosis
ADPVLSYNF

SEQ ID NO: 45148 - protein, 9 aa, Mycobacterium tuberculosis
DPVLSYNFD

SEQ ID NO: 45149 - protein, 9 aa, Mycobacterium tuberculosis
PVLSYNFDA

SEQ ID NO: 45150 - protein, 9 aa, Mycobacterium tuberculosis
VLSYNFDAI

SEQ ID NO: 45151 - protein, 9 aa, Mycobacterium tuberculosis
LSYNFDAIE

SEQ ID NO: 45152 - protein, 9 aa, Mycobacterium tuberculosis
SYNFDAIEY

SEQ ID NO: 45153 - protein, 9 aa, Mycobacterium tuberculosis
YNFDAIEYS

SEQ ID NO: 45154 - protein, 9 aa, Mycobacterium tuberculosis
NFDAIEYSV

SEQ ID NO: 45155 - protein, 9 aa, Mycobacterium tuberculosis
FDAIEYSVR

SEQ ID NO: 45156 - protein, 9 aa, Mycobacterium tuberculosis
DAIEYSVRQ

SEQ ID NO: 45157 - protein, 9 aa, Mycobacterium tuberculosis
AIEYSVRQE

SEQ ID NO: 45158 - protein, 9 aa, Mycobacterium tuberculosis
IEYSVRQEI

SEQ ID NO: 45159 - protein, 9 aa, Mycobacterium tuberculosis
EYSVRQEIH

SEQ ID NO: 45160 - protein, 9 aa, Mycobacterium tuberculosis
YSVRQEIHT

SEQ ID NO: 45161 - protein, 9 aa, Mycobacterium tuberculosis
SVRQEIHTT

SEQ ID NO: 45162 - protein, 9 aa, Mycobacterium tuberculosis
VRQEIHTTA

SEQ ID NO: 45163 - protein, 9 aa, Mycobacterium tuberculosis
RQEIHTTAA

SEQ ID NO: 45164 - protein, 9 aa, Mycobacterium tuberculosis
QEIHTTAAR

SEQ ID NO: 45165 - protein, 9 aa, Mycobacterium tuberculosis
EIHTTAARF

SEQ ID NO: 45166 - protein, 9 aa, Mycobacterium tuberculosis
IHTTAARFN

SEQ ID NO: 45167 - protein, 9 aa, Mycobacterium tuberculosis
HTTAARFNA

SEQ ID NO: 45168 - protein, 9 aa, Mycobacterium tuberculosis
TTAARFNAA

SEQ ID NO: 45169 - protein, 9 aa, Mycobacterium tuberculosis
TAARFNAAL

SEQ ID NO: 45170 - protein, 9 aa, Mycobacterium tuberculosis
AARFNAALQ

SEQ ID NO: 45171 - protein, 9 aa, Mycobacterium tuberculosis
ARFNAALQE

SEQ ID NO: 45172 - protein, 9 aa, Mycobacterium tuberculosis
RFNAALQEL

SEQ ID NO: 45173 - protein, 9 aa, Mycobacterium tuberculosis
FNAALQELR

SEQ ID NO: 45174 - protein, 9 aa, Mycobacterium tuberculosis
NAALQELRS

SEQ ID NO: 45175 - protein, 9 aa, Mycobacterium tuberculosis
AALQELRSQ

SEQ ID NO: 45176 - protein, 9 aa, Mycobacterium tuberculosis
ALQELRSQI

SEQ ID NO: 45177 - protein, 9 aa, Mycobacterium tuberculosis
LQELRSQIA

SEQ ID NO: 45178 - protein, 9 aa, Mycobacterium tuberculosis
QELRSQIAP

SEQ ID NO: 45179 - protein, 9 aa, Mycobacterium tuberculosis
ELRSQIAPL

SEQ ID NO: 45180 - protein, 9 aa, Mycobacterium tuberculosis
LRSQIAPLQ

SEQ ID NO: 45181 - protein, 9 aa, Mycobacterium tuberculosis
RSQIAPLQQ

SEQ ID NO: 45182 - protein, 9 aa, Mycobacterium tuberculosis
SQIAPLQQL

SEQ ID NO: 45183 - protein, 9 aa, Mycobacterium tuberculosis
QIAPLQQLW

SEQ ID NO: 45184 - protein, 9 aa, Mycobacterium tuberculosis
IAPLQQLWT

SEQ ID NO: 45185 - protein, 9 aa, Mycobacterium tuberculosis
APLQQLWTR

SEQ ID NO: 45186 - protein, 9 aa, Mycobacterium tuberculosis
PLQQLWTRE

SEQ ID NO: 45187 - protein, 9 aa, Mycobacterium tuberculosis
LQQLWTREA

SEQ ID NO: 45188 - protein, 9 aa, Mycobacterium tuberculosis
QQLWTREAA

SEQ ID NO: 45189 - protein, 9 aa, Mycobacterium tuberculosis
QLWTREAAA

SEQ ID NO: 45190 - protein, 9 aa, Mycobacterium tuberculosis
LWTREAAAA

SEQ ID NO: 45191 - protein, 9 aa, Mycobacterium tuberculosis
WTREAAAAY

SEQ ID NO: 45192 - protein, 9 aa, Mycobacterium tuberculosis
TREAAAAYH

SEQ ID NO: 45193 - protein, 9 aa, Mycobacterium tuberculosis
REAAAAYHA

SEQ ID NO: 45194 - protein, 9 aa, Mycobacterium tuberculosis
EAAAAYHAE

SEQ ID NO: 45195 - protein, 9 aa, Mycobacterium tuberculosis
AAAAYHAEQ

SEQ ID NO: 45196 - protein, 9 aa, Mycobacterium tuberculosis
AAAYHAEQL

SEQ ID NO: 45197 - protein, 9 aa, Mycobacterium tuberculosis
AAYHAEQLK

SEQ ID NO: 45198 - protein, 9 aa, Mycobacterium tuberculosis
AYHAEQLKW

SEQ ID NO: 45199 - protein, 9 aa, Mycobacterium tuberculosis
YHAEQLKWH

SEQ ID NO: 45200 - protein, 9 aa, Mycobacterium tuberculosis
HAEQLKWHQ

SEQ ID NO: 45201 - protein, 9 aa, Mycobacterium tuberculosis
AEQLKWHQA

SEQ ID NO: 45202 - protein, 9 aa, Mycobacterium tuberculosis
EQLKWHQAA

SEQ ID NO: 45203 - protein, 9 aa, Mycobacterium tuberculosis
QLKWHQAAS

SEQ ID NO: 45204 - protein, 9 aa, Mycobacterium tuberculosis
LKWHQAASA

SEQ ID NO: 45205 - protein, 9 aa, Mycobacterium tuberculosis
KWHQAASAL

SEQ ID NO: 45206 - protein, 9 aa, Mycobacterium tuberculosis
WHQAASALN

SEQ ID NO: 45207 - protein, 9 aa, Mycobacterium tuberculosis
HQAASALNE

SEQ ID NO: 45208 - protein, 9 aa, Mycobacterium tuberculosis
QAASALNEI

SEQ ID NO: 45209 - protein, 9 aa, Mycobacterium tuberculosis
AASALNEIL

SEQ ID NO: 45210 - protein, 9 aa, Mycobacterium tuberculosis
ASALNEILI

SEQ ID NO: 45211 - protein, 9 aa, Mycobacterium tuberculosis
SALNEILID

SEQ ID NO: 45212 - protein, 9 aa, Mycobacterium tuberculosis
ALNEILIDL

SEQ ID NO: 45213 - protein, 9 aa, Mycobacterium tuberculosis
LNEILIDLG

SEQ ID NO: 45214 - protein, 9 aa, Mycobacterium tuberculosis
NEILIDLGN

SEQ ID NO: 45215 - protein, 9 aa, Mycobacterium tuberculosis
EILIDLGNA

SEQ ID NO: 45216 - protein, 9 aa, Mycobacterium tuberculosis
ILIDLGNAV

SEQ ID NO: 45217 - protein, 9 aa, Mycobacterium tuberculosis
LIDLGNAVR

SEQ ID NO: 45218 - protein, 9 aa, Mycobacterium tuberculosis
IDLGNAVRH

SEQ ID NO: 45219 - protein, 9 aa, Mycobacterium tuberculosis
DLGNAVRHG

SEQ ID NO: 45220 - protein, 9 aa, Mycobacterium tuberculosis
LGNAVRHGA

SEQ ID NO: 45221 - protein, 9 aa, Mycobacterium tuberculosis
GNAVRHGAD

SEQ ID NO: 45222 - protein, 9 aa, Mycobacterium tuberculosis
NAVRHGADD

SEQ ID NO: 45223 - protein, 9 aa, Mycobacterium tuberculosis
AVRHGADDV

SEQ ID NO: 45224 - protein, 9 aa, Mycobacterium tuberculosis
VRHGADDVA

SEQ ID NO: 45225 - protein, 9 aa, Mycobacterium tuberculosis
RHGADDVAH

SEQ ID NO: 45226 - protein, 9 aa, Mycobacterium tuberculosis
HGADDVAHA

SEQ ID NO: 45227 - protein, 9 aa, Mycobacterium tuberculosis
GADDVAHAD

SEQ ID NO: 45228 - protein, 9 aa, Mycobacterium tuberculosis
ADDVAHADR

SEQ ID NO: 45229 - protein, 9 aa, Mycobacterium tuberculosis
DDVAHADRR

SEQ ID NO: 45230 - protein, 9 aa, Mycobacterium tuberculosis
DVAHADRRA

SEQ ID NO: 45231 - protein, 9 aa, Mycobacterium tuberculosis
VAHADRRAA

SEQ ID NO: 45232 - protein, 9 aa, Mycobacterium tuberculosis
AHADRRAAG

SEQ ID NO: 45233 - protein, 9 aa, Mycobacterium tuberculosis
HADRRAAGA

SEQ ID NO: 45234 - protein, 9 aa, Mycobacterium tuberculosis
ADRRAAGAW

SEQ ID NO: 45235 - protein, 9 aa, Mycobacterium tuberculosis
DRRAAGAWA

SEQ ID NO: 45236 - protein, 9 aa, Mycobacterium tuberculosis
RRAAGAWAR

SEQ ID NO: 45237 - protein, 10 aa, Mycobacterium tuberculosis
MNADPVLSYN

SEQ ID NO: 45238 - protein, 10 aa, Mycobacterium tuberculosis
NADPVLSYNF

SEQ ID NO: 45239 - protein, 10 aa, Mycobacterium tuberculosis
ADPVLSYNFD

SEQ ID NO: 45240 - protein, 10 aa, Mycobacterium tuberculosis
DPVLSYNFDA

SEQ ID NO: 45241 - protein, 10 aa, Mycobacterium tuberculosis
PVLSYNFDAI

SEQ ID NO: 45242 - protein, 10 aa, Mycobacterium tuberculosis
VLSYNFDAIE

SEQ ID NO: 45243 - protein, 10 aa, Mycobacterium tuberculosis
LSYNFDAIEY

SEQ ID NO: 45244 - protein, 10 aa, Mycobacterium tuberculosis
SYNFDAIEYS

SEQ ID NO: 45245 - protein, 10 aa, Mycobacterium tuberculosis
YNFDAIEYSV

SEQ ID NO: 45246 - protein, 10 aa, Mycobacterium tuberculosis
NFDAIEYSVR

SEQ ID NO: 45247 - protein, 10 aa, Mycobacterium tuberculosis
FDAIEYSVRQ

SEQ ID NO: 45248 - protein, 10 aa, Mycobacterium tuberculosis
DAIEYSVRQE

SEQ ID NO: 45249 - protein, 10 aa, Mycobacterium tuberculosis
AIEYSVRQEI

SEQ ID NO: 45250 - protein, 10 aa, Mycobacterium tuberculosis
IEYSVRQEIH

SEQ ID NO: 45251 - protein, 10 aa, Mycobacterium tuberculosis
EYSVRQEIHT

SEQ ID NO: 45252 - protein, 10 aa, Mycobacterium tuberculosis
YSVRQEIHTT

SEQ ID NO: 45253 - protein, 10 aa, Mycobacterium tuberculosis
SVRQEIHTTA

SEQ ID NO: 45254 - protein, 10 aa, Mycobacterium tuberculosis
VRQEIHTTAA

SEQ ID NO: 45255 - protein, 10 aa, Mycobacterium tuberculosis
RQEIHTTAAR

SEQ ID NO: 45256 - protein, 10 aa, Mycobacterium tuberculosis
QEIHTTAARF

SEQ ID NO: 45257 - protein, 10 aa, Mycobacterium tuberculosis
EIHTTAARFN

SEQ ID NO: 45258 - protein, 10 aa, Mycobacterium tuberculosis
IHTTAARFNA

SEQ ID NO: 45259 - protein, 10 aa, Mycobacterium tuberculosis
HTTAARFNAA

SEQ ID NO: 45260 - protein, 10 aa, Mycobacterium tuberculosis
TTAARFNAAL

SEQ ID NO: 45261 - protein, 10 aa, Mycobacterium tuberculosis
TAARFNAALQ

SEQ ID NO: 45262 - protein, 10 aa, Mycobacterium tuberculosis
AARFNAALQE

SEQ ID NO: 45263 - protein, 10 aa, Mycobacterium tuberculosis
ARFNAALQEL

SEQ ID NO: 45264 - protein, 10 aa, Mycobacterium tuberculosis
RFNAALQELR

SEQ ID NO: 45265 - protein, 10 aa, Mycobacterium tuberculosis
FNAALQELRS

SEQ ID NO: 45266 - protein, 10 aa, Mycobacterium tuberculosis
NAALQELRSQ

SEQ ID NO: 45267 - protein, 10 aa, Mycobacterium tuberculosis
AALQELRSQI

SEQ ID NO: 45268 - protein, 10 aa, Mycobacterium tuberculosis
ALQELRSQIA

SEQ ID NO: 45269 - protein, 10 aa, Mycobacterium tuberculosis
LQELRSQIAP

SEQ ID NO: 45270 - protein, 10 aa, Mycobacterium tuberculosis
QELRSQIAPL

SEQ ID NO: 45271 - protein, 10 aa, Mycobacterium tuberculosis
ELRSQIAPLQ

SEQ ID NO: 45272 - protein, 10 aa, Mycobacterium tuberculosis
LRSQIAPLQQ

SEQ ID NO: 45273 - protein, 10 aa, Mycobacterium tuberculosis
RSQIAPLQQL

SEQ ID NO: 45274 - protein, 10 aa, Mycobacterium tuberculosis
SQIAPLQQLW

SEQ ID NO: 45275 - protein, 10 aa, Mycobacterium tuberculosis
QIAPLQQLWT

SEQ ID NO: 45276 - protein, 10 aa, Mycobacterium tuberculosis
IAPLQQLWTR

SEQ ID NO: 45277 - protein, 10 aa, Mycobacterium tuberculosis
APLQQLWTRE

SEQ ID NO: 45278 - protein, 10 aa, Mycobacterium tuberculosis
PLQQLWTREA

SEQ ID NO: 45279 - protein, 10 aa, Mycobacterium tuberculosis
LQQLWTREAA

SEQ ID NO: 45280 - protein, 10 aa, Mycobacterium tuberculosis
QQLWTREAAA

SEQ ID NO: 45281 - protein, 10 aa, Mycobacterium tuberculosis
QLWTREAAAA

SEQ ID NO: 45282 - protein, 10 aa, Mycobacterium tuberculosis
LWTREAAAAY

SEQ ID NO: 45283 - protein, 10 aa, Mycobacterium tuberculosis
WTREAAAAYH

SEQ ID NO: 45284 - protein, 10 aa, Mycobacterium tuberculosis
TREAAAAYHA

SEQ ID NO: 45285 - protein, 10 aa, Mycobacterium tuberculosis
REAAAAYHAE

SEQ ID NO: 45286 - protein, 10 aa, Mycobacterium tuberculosis
EAAAAYHAEQ

SEQ ID NO: 45287 - protein, 10 aa, Mycobacterium tuberculosis
AAAAYHAEQL

SEQ ID NO: 45288 - protein, 10 aa, Mycobacterium tuberculosis
AAAYHAEQLK

SEQ ID NO: 45289 - protein, 10 aa, Mycobacterium tuberculosis
AAYHAEQLKW

SEQ ID NO: 45290 - protein, 10 aa, Mycobacterium tuberculosis
AYHAEQLKWH

SEQ ID NO: 45291 - protein, 10 aa, Mycobacterium tuberculosis
YHAEQLKWHQ

SEQ ID NO: 45292 - protein, 10 aa, Mycobacterium tuberculosis
HAEQLKWHQA

SEQ ID NO: 45293 - protein, 10 aa, Mycobacterium tuberculosis
AEQLKWHQAA

SEQ ID NO: 45294 - protein, 10 aa, Mycobacterium tuberculosis
EQLKWHQAAS

SEQ ID NO: 45295 - protein, 10 aa, Mycobacterium tuberculosis
QLKWHQAASA

SEQ ID NO: 45296 - protein, 10 aa, Mycobacterium tuberculosis
LKWHQAASAL

SEQ ID NO: 45297 - protein, 10 aa, Mycobacterium tuberculosis
KWHQAASALN

SEQ ID NO: 45298 - protein, 10 aa, Mycobacterium tuberculosis
WHQAASALNE

SEQ ID NO: 45299 - protein, 10 aa, Mycobacterium tuberculosis
HQAASALNEI

SEQ ID NO: 45300 - protein, 10 aa, Mycobacterium tuberculosis
QAASALNEIL

SEQ ID NO: 45301 - protein, 10 aa, Mycobacterium tuberculosis
AASALNEILI

SEQ ID NO: 45302 - protein, 10 aa, Mycobacterium tuberculosis
ASALNEILID

SEQ ID NO: 45303 - protein, 10 aa, Mycobacterium tuberculosis
SALNEILIDL

SEQ ID NO: 45304 - protein, 10 aa, Mycobacterium tuberculosis
ALNEILIDLG

SEQ ID NO: 45305 - protein, 10 aa, Mycobacterium tuberculosis
LNEILIDLGN

SEQ ID NO: 45306 - protein, 10 aa, Mycobacterium tuberculosis
NEILIDLGNA

SEQ ID NO: 45307 - protein, 10 aa, Mycobacterium tuberculosis
EILIDLGNAV

SEQ ID NO: 45308 - protein, 10 aa, Mycobacterium tuberculosis
ILIDLGNAVR

SEQ ID NO: 45309 - protein, 10 aa, Mycobacterium tuberculosis
LIDLGNAVRH

SEQ ID NO: 45310 - protein, 10 aa, Mycobacterium tuberculosis
IDLGNAVRHG

SEQ ID NO: 45311 - protein, 10 aa, Mycobacterium tuberculosis
DLGNAVRHGA

SEQ ID NO: 45312 - protein, 10 aa, Mycobacterium tuberculosis
LGNAVRHGAD

SEQ ID NO: 45313 - protein, 10 aa, Mycobacterium tuberculosis
GNAVRHGADD

SEQ ID NO: 45314 - protein, 10 aa, Mycobacterium tuberculosis
NAVRHGADDV

SEQ ID NO: 45315 - protein, 10 aa, Mycobacterium tuberculosis
AVRHGADDVA

SEQ ID NO: 45316 - protein, 10 aa, Mycobacterium tuberculosis
VRHGADDVAH

SEQ ID NO: 45317 - protein, 10 aa, Mycobacterium tuberculosis
RHGADDVAHA

SEQ ID NO: 45318 - protein, 10 aa, Mycobacterium tuberculosis
HGADDVAHAD

SEQ ID NO: 45319 - protein, 10 aa, Mycobacterium tuberculosis
GADDVAHADR

SEQ ID NO: 45320 - protein, 10 aa, Mycobacterium tuberculosis
ADDVAHADRR

SEQ ID NO: 45321 - protein, 10 aa, Mycobacterium tuberculosis
DDVAHADRRA

SEQ ID NO: 45322 - protein, 10 aa, Mycobacterium tuberculosis
DVAHADRRAA

SEQ ID NO: 45323 - protein, 10 aa, Mycobacterium tuberculosis
VAHADRRAAG

SEQ ID NO: 45324 - protein, 10 aa, Mycobacterium tuberculosis
AHADRRAAGA

SEQ ID NO: 45325 - protein, 10 aa, Mycobacterium tuberculosis
HADRRAAGAW

SEQ ID NO: 45326 - protein, 10 aa, Mycobacterium tuberculosis
ADRRAAGAWA

SEQ ID NO: 45327 - protein, 10 aa, Mycobacterium tuberculosis
DRRAAGAWAR

SEQ ID NO: 45328 - protein, 11 aa, Mycobacterium tuberculosis
MNADPVLSYNF

SEQ ID NO: 45329 - protein, 11 aa, Mycobacterium tuberculosis
NADPVLSYNFD

SEQ ID NO: 45330 - protein, 11 aa, Mycobacterium tuberculosis
ADPVLSYNFDA

SEQ ID NO: 45331 - protein, 11 aa, Mycobacterium tuberculosis
DPVLSYNFDAI

SEQ ID NO: 45332 - protein, 11 aa, Mycobacterium tuberculosis
PVLSYNFDAIE

SEQ ID NO: 45333 - protein, 11 aa, Mycobacterium tuberculosis
VLSYNFDAIEY

SEQ ID NO: 45334 - protein, 11 aa, Mycobacterium tuberculosis
LSYNFDAIEYS

SEQ ID NO: 45335 - protein, 11 aa, Mycobacterium tuberculosis
SYNFDAIEYSV

SEQ ID NO: 45336 - protein, 11 aa, Mycobacterium tuberculosis
YNFDAIEYSVR

SEQ ID NO: 45337 - protein, 11 aa, Mycobacterium tuberculosis
NFDAIEYSVRQ

SEQ ID NO: 45338 - protein, 11 aa, Mycobacterium tuberculosis
FDAIEYSVRQE

SEQ ID NO: 45339 - protein, 11 aa, Mycobacterium tuberculosis
DAIEYSVRQEI

SEQ ID NO: 45340 - protein, 11 aa, Mycobacterium tuberculosis
AIEYSVRQEIH

SEQ ID NO: 45341 - protein, 11 aa, Mycobacterium tuberculosis
IEYSVRQEIHT

SEQ ID NO: 45342 - protein, 11 aa, Mycobacterium tuberculosis
EYSVRQEIHTT

SEQ ID NO: 45343 - protein, 11 aa, Mycobacterium tuberculosis
YSVRQEIHTTA

SEQ ID NO: 45344 - protein, 11 aa, Mycobacterium tuberculosis
SVRQEIHTTAA

SEQ ID NO: 45345 - protein, 11 aa, Mycobacterium tuberculosis
VRQEIHTTAAR

SEQ ID NO: 45346 - protein, 11 aa, Mycobacterium tuberculosis
RQEIHTTAARF

SEQ ID NO: 45347 - protein, 11 aa, Mycobacterium tuberculosis
QEIHTTAARFN

SEQ ID NO: 45348 - protein, 11 aa, Mycobacterium tuberculosis
EIHTTAARFNA

SEQ ID NO: 45349 - protein, 11 aa, Mycobacterium tuberculosis
IHTTAARFNAA

SEQ ID NO: 45350 - protein, 11 aa, Mycobacterium tuberculosis
HTTAARFNAAL

SEQ ID NO: 45351 - protein, 11 aa, Mycobacterium tuberculosis
TTAARFNAALQ

SEQ ID NO: 45352 - protein, 11 aa, Mycobacterium tuberculosis
TAARFNAALQE

SEQ ID NO: 45353 - protein, 11 aa, Mycobacterium tuberculosis
AARFNAALQEL

SEQ ID NO: 45354 - protein, 11 aa, Mycobacterium tuberculosis
ARFNAALQELR

SEQ ID NO: 45355 - protein, 11 aa, Mycobacterium tuberculosis
RFNAALQELRS

SEQ ID NO: 45356 - protein, 11 aa, Mycobacterium tuberculosis
FNAALQELRSQ

SEQ ID NO: 45357 - protein, 11 aa, Mycobacterium tuberculosis
NAALQELRSQI

SEQ ID NO: 45358 - protein, 11 aa, Mycobacterium tuberculosis
AALQELRSQIA

SEQ ID NO: 45359 - protein, 11 aa, Mycobacterium tuberculosis
ALQELRSQIAP

SEQ ID NO: 45360 - protein, 11 aa, Mycobacterium tuberculosis
LQELRSQIAPL

SEQ ID NO: 45361 - protein, 11 aa, Mycobacterium tuberculosis
QELRSQIAPLQ

SEQ ID NO: 45362 - protein, 11 aa, Mycobacterium tuberculosis
ELRSQIAPLQQ

SEQ ID NO: 45363 - protein, 11 aa, Mycobacterium tuberculosis
LRSQIAPLQQL

SEQ ID NO: 45364 - protein, 11 aa, Mycobacterium tuberculosis
RSQIAPLQQLW

SEQ ID NO: 45365 - protein, 11 aa, Mycobacterium tuberculosis
SQIAPLQQLWT

SEQ ID NO: 45366 - protein, 11 aa, Mycobacterium tuberculosis
QIAPLQQLWTR

SEQ ID NO: 45367 - protein, 11 aa, Mycobacterium tuberculosis
IAPLQQLWTRE

SEQ ID NO: 45368 - protein, 11 aa, Mycobacterium tuberculosis
APLQQLWTREA

SEQ ID NO: 45369 - protein, 11 aa, Mycobacterium tuberculosis
PLQQLWTREAA

SEQ ID NO: 45370 - protein, 11 aa, Mycobacterium tuberculosis
LQQLWTREAAA

SEQ ID NO: 45371 - protein, 11 aa, Mycobacterium tuberculosis
QQLWTREAAAA

SEQ ID NO: 45372 - protein, 11 aa, Mycobacterium tuberculosis
QLWTREAAAAY

SEQ ID NO: 45373 - protein, 11 aa, Mycobacterium tuberculosis
LWTREAAAAYH

SEQ ID NO: 45374 - protein, 11 aa, Mycobacterium tuberculosis
WTREAAAAYHA

SEQ ID NO: 45375 - protein, 11 aa, Mycobacterium tuberculosis
TREAAAAYHAE

SEQ ID NO: 45376 - protein, 11 aa, Mycobacterium tuberculosis
REAAAAYHAEQ

SEQ ID NO: 45377 - protein, 11 aa, Mycobacterium tuberculosis
EAAAAYHAEQL

SEQ ID NO: 45378 - protein, 11 aa, Mycobacterium tuberculosis
AAAAYHAEQLK

SEQ ID NO: 45379 - protein, 11 aa, Mycobacterium tuberculosis
AAAYHAEQLKW

SEQ ID NO: 45380 - protein, 11 aa, Mycobacterium tuberculosis
AAYHAEQLKWH

SEQ ID NO: 45381 - protein, 11 aa, Mycobacterium tuberculosis
AYHAEQLKWHQ

SEQ ID NO: 45382 - protein, 11 aa, Mycobacterium tuberculosis
YHAEQLKWHQA

SEQ ID NO: 45383 - protein, 11 aa, Mycobacterium tuberculosis
HAEQLKWHQAA

SEQ ID NO: 45384 - protein, 11 aa, Mycobacterium tuberculosis
AEQLKWHQAAS

SEQ ID NO: 45385 - protein, 11 aa, Mycobacterium tuberculosis
EQLKWHQAASA

SEQ ID NO: 45386 - protein, 11 aa, Mycobacterium tuberculosis
QLKWHQAASAL

SEQ ID NO: 45387 - protein, 11 aa, Mycobacterium tuberculosis
LKWHQAASALN

SEQ ID NO: 45388 - protein, 11 aa, Mycobacterium tuberculosis
KWHQAASALNE

SEQ ID NO: 45389 - protein, 11 aa, Mycobacterium tuberculosis
WHQAASALNEI

SEQ ID NO: 45390 - protein, 11 aa, Mycobacterium tuberculosis
HQAASALNEIL

SEQ ID NO: 45391 - protein, 11 aa, Mycobacterium tuberculosis
QAASALNEILI

SEQ ID NO: 45392 - protein, 11 aa, Mycobacterium tuberculosis
AASALNEILID

SEQ ID NO: 45393 - protein, 11 aa, Mycobacterium tuberculosis
ASALNEILIDL

SEQ ID NO: 45394 - protein, 11 aa, Mycobacterium tuberculosis
SALNEILIDLG

SEQ ID NO: 45395 - protein, 11 aa, Mycobacterium tuberculosis
ALNEILIDLGN

SEQ ID NO: 45396 - protein, 11 aa, Mycobacterium tuberculosis
LNEILIDLGNA

SEQ ID NO: 45397 - protein, 11 aa, Mycobacterium tuberculosis
NEILIDLGNAV

SEQ ID NO: 45398 - protein, 11 aa, Mycobacterium tuberculosis
EILIDLGNAVR

SEQ ID NO: 45399 - protein, 11 aa, Mycobacterium tuberculosis
ILIDLGNAVRH

SEQ ID NO: 45400 - protein, 11 aa, Mycobacterium tuberculosis
LIDLGNAVRHG

SEQ ID NO: 45401 - protein, 11 aa, Mycobacterium tuberculosis
IDLGNAVRHGA

SEQ ID NO: 45402 - protein, 11 aa, Mycobacterium tuberculosis
DLGNAVRHGAD

SEQ ID NO: 45403 - protein, 11 aa, Mycobacterium tuberculosis
LGNAVRHGADD

SEQ ID NO: 45404 - protein, 11 aa, Mycobacterium tuberculosis
GNAVRHGADDV

SEQ ID NO: 45405 - protein, 11 aa, Mycobacterium tuberculosis
NAVRHGADDVA

SEQ ID NO: 45406 - protein, 11 aa, Mycobacterium tuberculosis
AVRHGADDVAH

SEQ ID NO: 45407 - protein, 11 aa, Mycobacterium tuberculosis
VRHGADDVAHA

SEQ ID NO: 45408 - protein, 11 aa, Mycobacterium tuberculosis
RHGADDVAHAD

SEQ ID NO: 45409 - protein, 11 aa, Mycobacterium tuberculosis
HGADDVAHADR

SEQ ID NO: 45410 - protein, 11 aa, Mycobacterium tuberculosis
GADDVAHADRR

SEQ ID NO: 45411 - protein, 11 aa, Mycobacterium tuberculosis
ADDVAHADRRA

SEQ ID NO: 45412 - protein, 11 aa, Mycobacterium tuberculosis
DDVAHADRRAA

SEQ ID NO: 45413 - protein, 11 aa, Mycobacterium tuberculosis
DVAHADRRAAG

SEQ ID NO: 45414 - protein, 11 aa, Mycobacterium tuberculosis
VAHADRRAAGA

SEQ ID NO: 45415 - protein, 11 aa, Mycobacterium tuberculosis
AHADRRAAGAW

SEQ ID NO: 45416 - protein, 11 aa, Mycobacterium tuberculosis
HADRRAAGAWA

SEQ ID NO: 45417 - protein, 11 aa, Mycobacterium tuberculosis
ADRRAAGAWAR

SEQ ID NO: 45418 - protein, 8 aa, Mycobacterium tuberculosis
MVEPGRIG

SEQ ID NO: 45419 - protein, 8 aa, Mycobacterium tuberculosis
VEPGRIGG

SEQ ID NO: 45420 - protein, 8 aa, Mycobacterium tuberculosis
EPGRIGGN

SEQ ID NO: 45421 - protein, 8 aa, Mycobacterium tuberculosis
PGRIGGNQ

SEQ ID NO: 45422 - protein, 8 aa, Mycobacterium tuberculosis
GRIGGNQT

SEQ ID NO: 45423 - protein, 8 aa, Mycobacterium tuberculosis
RIGGNQTR

SEQ ID NO: 45424 - protein, 8 aa, Mycobacterium tuberculosis
IGGNQTRL

SEQ ID NO: 45425 - protein, 8 aa, Mycobacterium tuberculosis
GGNQTRLA

SEQ ID NO: 45426 - protein, 8 aa, Mycobacterium tuberculosis
GNQTRLAA

SEQ ID NO: 45427 - protein, 8 aa, Mycobacterium tuberculosis
NQTRLAAV

SEQ ID NO: 45428 - protein, 8 aa, Mycobacterium tuberculosis
QTRLAAVL

SEQ ID NO: 45429 - protein, 8 aa, Mycobacterium tuberculosis
TRLAAVLL

SEQ ID NO: 45430 - protein, 8 aa, Mycobacterium tuberculosis
RLAAVLLD

SEQ ID NO: 45431 - protein, 8 aa, Mycobacterium tuberculosis
LAAVLLDV

SEQ ID NO: 45432 - protein, 8 aa, Mycobacterium tuberculosis
AAVLLDVS

SEQ ID NO: 45433 - protein, 8 aa, Mycobacterium tuberculosis
AVLLDVST

SEQ ID NO: 45434 - protein, 8 aa, Mycobacterium tuberculosis
VLLDVSTP

SEQ ID NO: 45435 - protein, 8 aa, Mycobacterium tuberculosis
LLDVSTPN

SEQ ID NO: 45436 - protein, 8 aa, Mycobacterium tuberculosis
LDVSTPNT

SEQ ID NO: 45437 - protein, 8 aa, Mycobacterium tuberculosis
DVSTPNTL

SEQ ID NO: 45438 - protein, 8 aa, Mycobacterium tuberculosis
VSTPNTLN

SEQ ID NO: 45439 - protein, 8 aa, Mycobacterium tuberculosis
STPNTLNA

SEQ ID NO: 45440 - protein, 8 aa, Mycobacterium tuberculosis
TPNTLNAD

SEQ ID NO: 45441 - protein, 8 aa, Mycobacterium tuberculosis
PNTLNADF

SEQ ID NO: 45442 - protein, 8 aa, Mycobacterium tuberculosis
NTLNADFD

SEQ ID NO: 45443 - protein, 8 aa, Mycobacterium tuberculosis
TLNADFDL

SEQ ID NO: 45444 - protein, 8 aa, Mycobacterium tuberculosis
LNADFDLM

SEQ ID NO: 45445 - protein, 8 aa, Mycobacterium tuberculosis
NADFDLMR

SEQ ID NO: 45446 - protein, 8 aa, Mycobacterium tuberculosis
ADFDLMRS

SEQ ID NO: 45447 - protein, 8 aa, Mycobacterium tuberculosis
DFDLMRSV

SEQ ID NO: 45448 - protein, 8 aa, Mycobacterium tuberculosis
FDLMRSVA

SEQ ID NO: 45449 - protein, 8 aa, Mycobacterium tuberculosis
DLMRSVAG

SEQ ID NO: 45450 - protein, 8 aa, Mycobacterium tuberculosis
LMRSVAGI

SEQ ID NO: 45451 - protein, 8 aa, Mycobacterium tuberculosis
MRSVAGIT

SEQ ID NO: 45452 - protein, 8 aa, Mycobacterium tuberculosis
RSVAGITD

SEQ ID NO: 45453 - protein, 8 aa, Mycobacterium tuberculosis
SVAGITDA

SEQ ID NO: 45454 - protein, 8 aa, Mycobacterium tuberculosis
VAGITDAR

SEQ ID NO: 45455 - protein, 8 aa, Mycobacterium tuberculosis
AGITDARN

SEQ ID NO: 45456 - protein, 8 aa, Mycobacterium tuberculosis
GITDARNE

SEQ ID NO: 45457 - protein, 8 aa, Mycobacterium tuberculosis
ITDARNEE

SEQ ID NO: 45458 - protein, 8 aa, Mycobacterium tuberculosis
TDARNEEI

SEQ ID NO: 45459 - protein, 8 aa, Mycobacterium tuberculosis
DARNEEIR

SEQ ID NO: 45460 - protein, 8 aa, Mycobacterium tuberculosis
ARNEEIRA

SEQ ID NO: 45461 - protein, 8 aa, Mycobacterium tuberculosis
RNEEIRAM

SEQ ID NO: 45462 - protein, 8 aa, Mycobacterium tuberculosis
NEEIRAML

SEQ ID NO: 45463 - protein, 8 aa, Mycobacterium tuberculosis
EEIRAMLQ

SEQ ID NO: 45464 - protein, 8 aa, Mycobacterium tuberculosis
EIRAMLQA

SEQ ID NO: 45465 - protein, 8 aa, Mycobacterium tuberculosis
IRAMLQAF

SEQ ID NO: 45466 - protein, 8 aa, Mycobacterium tuberculosis
RAMLQAFI

SEQ ID NO: 45467 - protein, 8 aa, Mycobacterium tuberculosis
AMLQAFIG

SEQ ID NO: 45468 - protein, 8 aa, Mycobacterium tuberculosis
MLQAFIGR

SEQ ID NO: 45469 - protein, 8 aa, Mycobacterium tuberculosis
LQAFIGRM

SEQ ID NO: 45470 - protein, 8 aa, Mycobacterium tuberculosis
QAFIGRMS

SEQ ID NO: 45471 - protein, 8 aa, Mycobacterium tuberculosis
AFIGRMSG

SEQ ID NO: 45472 - protein, 8 aa, Mycobacterium tuberculosis
FIGRMSGV

SEQ ID NO: 45473 - protein, 8 aa, Mycobacterium tuberculosis
IGRMSGVP

SEQ ID NO: 45474 - protein, 8 aa, Mycobacterium tuberculosis
GRMSGVPP

SEQ ID NO: 45475 - protein, 8 aa, Mycobacterium tuberculosis
RMSGVPPS

SEQ ID NO: 45476 - protein, 8 aa, Mycobacterium tuberculosis
MSGVPPSV

SEQ ID NO: 45477 - protein, 8 aa, Mycobacterium tuberculosis
SGVPPSVW

SEQ ID NO: 45478 - protein, 8 aa, Mycobacterium tuberculosis
GVPPSVWG

SEQ ID NO: 45479 - protein, 8 aa, Mycobacterium tuberculosis
VPPSVWGG

SEQ ID NO: 45480 - protein, 8 aa, Mycobacterium tuberculosis
PPSVWGGL

SEQ ID NO: 45481 - protein, 8 aa, Mycobacterium tuberculosis
PSVWGGLA

SEQ ID NO: 45482 - protein, 8 aa, Mycobacterium tuberculosis
SVWGGLAA

SEQ ID NO: 45483 - protein, 8 aa, Mycobacterium tuberculosis
VWGGLAAA

SEQ ID NO: 45484 - protein, 8 aa, Mycobacterium tuberculosis
WGGLAAAR

SEQ ID NO: 45485 - protein, 8 aa, Mycobacterium tuberculosis
GGLAAARF

SEQ ID NO: 45486 - protein, 8 aa, Mycobacterium tuberculosis
GLAAARFQ

SEQ ID NO: 45487 - protein, 8 aa, Mycobacterium tuberculosis
LAAARFQD

SEQ ID NO: 45488 - protein, 8 aa, Mycobacterium tuberculosis
AAARFQDV

SEQ ID NO: 45489 - protein, 8 aa, Mycobacterium tuberculosis
AARFQDVV

SEQ ID NO: 45490 - protein, 8 aa, Mycobacterium tuberculosis
ARFQDVVD

SEQ ID NO: 45491 - protein, 8 aa, Mycobacterium tuberculosis
RFQDVVDR

SEQ ID NO: 45492 - protein, 8 aa, Mycobacterium tuberculosis
FQDVVDRW

SEQ ID NO: 45493 - protein, 8 aa, Mycobacterium tuberculosis
QDVVDRWN

SEQ ID NO: 45494 - protein, 8 aa, Mycobacterium tuberculosis
DVVDRWNA

SEQ ID NO: 45495 - protein, 8 aa, Mycobacterium tuberculosis
VVDRWNAE

SEQ ID NO: 45496 - protein, 8 aa, Mycobacterium tuberculosis
VDRWNAES

SEQ ID NO: 45497 - protein, 8 aa, Mycobacterium tuberculosis
DRWNAEST

SEQ ID NO: 45498 - protein, 8 aa, Mycobacterium tuberculosis
RWNAESTR

SEQ ID NO: 45499 - protein, 8 aa, Mycobacterium tuberculosis
WNAESTRL

SEQ ID NO: 45500 - protein, 8 aa, Mycobacterium tuberculosis
NAESTRLY

SEQ ID NO: 45501 - protein, 8 aa, Mycobacterium tuberculosis
AESTRLYH

SEQ ID NO: 45502 - protein, 8 aa, Mycobacterium tuberculosis
ESTRLYHV

SEQ ID NO: 45503 - protein, 8 aa, Mycobacterium tuberculosis
STRLYHVL

SEQ ID NO: 45504 - protein, 8 aa, Mycobacterium tuberculosis
TRLYHVLH

SEQ ID NO: 45505 - protein, 8 aa, Mycobacterium tuberculosis
RLYHVLHA

SEQ ID NO: 45506 - protein, 8 aa, Mycobacterium tuberculosis
LYHVLHAI

SEQ ID NO: 45507 - protein, 8 aa, Mycobacterium tuberculosis
YHVLHAIA

SEQ ID NO: 45508 - protein, 8 aa, Mycobacterium tuberculosis
HVLHAIAD

SEQ ID NO: 45509 - protein, 8 aa, Mycobacterium tuberculosis
VLHAIADT

SEQ ID NO: 45510 - protein, 8 aa, Mycobacterium tuberculosis
LHAIADTI

SEQ ID NO: 45511 - protein, 8 aa, Mycobacterium tuberculosis
HAIADTIR

SEQ ID NO: 45512 - protein, 8 aa, Mycobacterium tuberculosis
AIADTIRH

SEQ ID NO: 45513 - protein, 8 aa, Mycobacterium tuberculosis
IADTIRHN

SEQ ID NO: 45514 - protein, 8 aa, Mycobacterium tuberculosis
ADTIRHNE

SEQ ID NO: 45515 - protein, 8 aa, Mycobacterium tuberculosis
DTIRHNEA

SEQ ID NO: 45516 - protein, 8 aa, Mycobacterium tuberculosis
TIRHNEAA

SEQ ID NO: 45517 - protein, 8 aa, Mycobacterium tuberculosis
IRHNEAAL

SEQ ID NO: 45518 - protein, 8 aa, Mycobacterium tuberculosis
RHNEAALR

SEQ ID NO: 45519 - protein, 8 aa, Mycobacterium tuberculosis
HNEAALRE

SEQ ID NO: 45520 - protein, 8 aa, Mycobacterium tuberculosis
NEAALREA

SEQ ID NO: 45521 - protein, 8 aa, Mycobacterium tuberculosis
EAALREAG

SEQ ID NO: 45522 - protein, 8 aa, Mycobacterium tuberculosis
AALREAGQ

SEQ ID NO: 45523 - protein, 8 aa, Mycobacterium tuberculosis
ALREAGQI

SEQ ID NO: 45524 - protein, 8 aa, Mycobacterium tuberculosis
LREAGQIH

SEQ ID NO: 45525 - protein, 8 aa, Mycobacterium tuberculosis
REAGQIHA

SEQ ID NO: 45526 - protein, 8 aa, Mycobacterium tuberculosis
EAGQIHAR

SEQ ID NO: 45527 - protein, 8 aa, Mycobacterium tuberculosis
AGQIHARH

SEQ ID NO: 45528 - protein, 8 aa, Mycobacterium tuberculosis
GQIHARHI

SEQ ID NO: 45529 - protein, 8 aa, Mycobacterium tuberculosis
QIHARHIA

SEQ ID NO: 45530 - protein, 8 aa, Mycobacterium tuberculosis
IHARHIAA

SEQ ID NO: 45531 - protein, 8 aa, Mycobacterium tuberculosis
HARHIAAA

SEQ ID NO: 45532 - protein, 8 aa, Mycobacterium tuberculosis
ARHIAAAG

SEQ ID NO: 45533 - protein, 8 aa, Mycobacterium tuberculosis
RHIAAAGG

SEQ ID NO: 45534 - protein, 8 aa, Mycobacterium tuberculosis
HIAAAGGD

SEQ ID NO: 45535 - protein, 8 aa, Mycobacterium tuberculosis
IAAAGGDL

SEQ ID NO: 45536 - protein, 9 aa, Mycobacterium tuberculosis
MVEPGRIGG

SEQ ID NO: 45537 - protein, 9 aa, Mycobacterium tuberculosis
VEPGRIGGN

SEQ ID NO: 45538 - protein, 9 aa, Mycobacterium tuberculosis
EPGRIGGNQ

SEQ ID NO: 45539 - protein, 9 aa, Mycobacterium tuberculosis
PGRIGGNQT

SEQ ID NO: 45540 - protein, 9 aa, Mycobacterium tuberculosis
GRIGGNQTR

SEQ ID NO: 45541 - protein, 9 aa, Mycobacterium tuberculosis
RIGGNQTRL

SEQ ID NO: 45542 - protein, 9 aa, Mycobacterium tuberculosis
IGGNQTRLA

SEQ ID NO: 45543 - protein, 9 aa, Mycobacterium tuberculosis
GGNQTRLAA

SEQ ID NO: 45544 - protein, 9 aa, Mycobacterium tuberculosis
GNQTRLAAV

SEQ ID NO: 45545 - protein, 9 aa, Mycobacterium tuberculosis
NQTRLAAVL

SEQ ID NO: 45546 - protein, 9 aa, Mycobacterium tuberculosis
QTRLAAVLL

SEQ ID NO: 45547 - protein, 9 aa, Mycobacterium tuberculosis
TRLAAVLLD

SEQ ID NO: 45548 - protein, 9 aa, Mycobacterium tuberculosis
RLAAVLLDV

SEQ ID NO: 45549 - protein, 9 aa, Mycobacterium tuberculosis
LAAVLLDVS

SEQ ID NO: 45550 - protein, 9 aa, Mycobacterium tuberculosis
AAVLLDVST

SEQ ID NO: 45551 - protein, 9 aa, Mycobacterium tuberculosis
AVLLDVSTP

SEQ ID NO: 45552 - protein, 9 aa, Mycobacterium tuberculosis
VLLDVSTPN

SEQ ID NO: 45553 - protein, 9 aa, Mycobacterium tuberculosis
LLDVSTPNT

SEQ ID NO: 45554 - protein, 9 aa, Mycobacterium tuberculosis
LDVSTPNTL

SEQ ID NO: 45555 - protein, 9 aa, Mycobacterium tuberculosis
DVSTPNTLN

SEQ ID NO: 45556 - protein, 9 aa, Mycobacterium tuberculosis
VSTPNTLNA

SEQ ID NO: 45557 - protein, 9 aa, Mycobacterium tuberculosis
STPNTLNAD

SEQ ID NO: 45558 - protein, 9 aa, Mycobacterium tuberculosis
TPNTLNADF

SEQ ID NO: 45559 - protein, 9 aa, Mycobacterium tuberculosis
PNTLNADFD

SEQ ID NO: 45560 - protein, 9 aa, Mycobacterium tuberculosis
NTLNADFDL

SEQ ID NO: 45561 - protein, 9 aa, Mycobacterium tuberculosis
TLNADFDLM

SEQ ID NO: 45562 - protein, 9 aa, Mycobacterium tuberculosis
LNADFDLMR

SEQ ID NO: 45563 - protein, 9 aa, Mycobacterium tuberculosis
NADFDLMRS

SEQ ID NO: 45564 - protein, 9 aa, Mycobacterium tuberculosis
ADFDLMRSV

SEQ ID NO: 45565 - protein, 9 aa, Mycobacterium tuberculosis
DFDLMRSVA

SEQ ID NO: 45566 - protein, 9 aa, Mycobacterium tuberculosis
FDLMRSVAG

SEQ ID NO: 45567 - protein, 9 aa, Mycobacterium tuberculosis
DLMRSVAGI

SEQ ID NO: 45568 - protein, 9 aa, Mycobacterium tuberculosis
LMRSVAGIT

SEQ ID NO: 45569 - protein, 9 aa, Mycobacterium tuberculosis
MRSVAGITD

SEQ ID NO: 45570 - protein, 9 aa, Mycobacterium tuberculosis
RSVAGITDA

SEQ ID NO: 45571 - protein, 9 aa, Mycobacterium tuberculosis
SVAGITDAR

SEQ ID NO: 45572 - protein, 9 aa, Mycobacterium tuberculosis
VAGITDARN

SEQ ID NO: 45573 - protein, 9 aa, Mycobacterium tuberculosis
AGITDARNE

SEQ ID NO: 45574 - protein, 9 aa, Mycobacterium tuberculosis
GITDARNEE

SEQ ID NO: 45575 - protein, 9 aa, Mycobacterium tuberculosis
ITDARNEEI

SEQ ID NO: 45576 - protein, 9 aa, Mycobacterium tuberculosis
TDARNEEIR

SEQ ID NO: 45577 - protein, 9 aa, Mycobacterium tuberculosis
DARNEEIRA

SEQ ID NO: 45578 - protein, 9 aa, Mycobacterium tuberculosis
ARNEEIRAM

SEQ ID NO: 45579 - protein, 9 aa, Mycobacterium tuberculosis
RNEEIRAML

SEQ ID NO: 45580 - protein, 9 aa, Mycobacterium tuberculosis
NEEIRAMLQ

SEQ ID NO: 45581 - protein, 9 aa, Mycobacterium tuberculosis
EEIRAMLQA

SEQ ID NO: 45582 - protein, 9 aa, Mycobacterium tuberculosis
EIRAMLQAF

SEQ ID NO: 45583 - protein, 9 aa, Mycobacterium tuberculosis
IRAMLQAFI

SEQ ID NO: 45584 - protein, 9 aa, Mycobacterium tuberculosis
RAMLQAFIG

SEQ ID NO: 45585 - protein, 9 aa, Mycobacterium tuberculosis
AMLQAFIGR

SEQ ID NO: 45586 - protein, 9 aa, Mycobacterium tuberculosis
MLQAFIGRM

SEQ ID NO: 45587 - protein, 9 aa, Mycobacterium tuberculosis
LQAFIGRMS

SEQ ID NO: 45588 - protein, 9 aa, Mycobacterium tuberculosis
QAFIGRMSG

SEQ ID NO: 45589 - protein, 9 aa, Mycobacterium tuberculosis
AFIGRMSGV

SEQ ID NO: 45590 - protein, 9 aa, Mycobacterium tuberculosis
FIGRMSGVP

SEQ ID NO: 45591 - protein, 9 aa, Mycobacterium tuberculosis
IGRMSGVPP

SEQ ID NO: 45592 - protein, 9 aa, Mycobacterium tuberculosis
GRMSGVPPS

SEQ ID NO: 45593 - protein, 9 aa, Mycobacterium tuberculosis
RMSGVPPSV

SEQ ID NO: 45594 - protein, 9 aa, Mycobacterium tuberculosis
MSGVPPSVW

SEQ ID NO: 45595 - protein, 9 aa, Mycobacterium tuberculosis
SGVPPSVWG

SEQ ID NO: 45596 - protein, 9 aa, Mycobacterium tuberculosis
GVPPSVWGG

SEQ ID NO: 45597 - protein, 9 aa, Mycobacterium tuberculosis
VPPSVWGGL

SEQ ID NO: 45598 - protein, 9 aa, Mycobacterium tuberculosis
PPSVWGGLA

SEQ ID NO: 45599 - protein, 9 aa, Mycobacterium tuberculosis
PSVWGGLAA

SEQ ID NO: 45600 - protein, 9 aa, Mycobacterium tuberculosis
SVWGGLAAA

SEQ ID NO: 45601 - protein, 9 aa, Mycobacterium tuberculosis
VWGGLAAAR

SEQ ID NO: 45602 - protein, 9 aa, Mycobacterium tuberculosis
WGGLAAARF

SEQ ID NO: 45603 - protein, 9 aa, Mycobacterium tuberculosis
GGLAAARFQ

SEQ ID NO: 45604 - protein, 9 aa, Mycobacterium tuberculosis
GLAAARFQD

SEQ ID NO: 45605 - protein, 9 aa, Mycobacterium tuberculosis
LAAARFQDV

SEQ ID NO: 45606 - protein, 9 aa, Mycobacterium tuberculosis
AAARFQDVV

SEQ ID NO: 45607 - protein, 9 aa, Mycobacterium tuberculosis
AARFQDVVD

SEQ ID NO: 45608 - protein, 9 aa, Mycobacterium tuberculosis
ARFQDVVDR

SEQ ID NO: 45609 - protein, 9 aa, Mycobacterium tuberculosis
RFQDVVDRW

SEQ ID NO: 45610 - protein, 9 aa, Mycobacterium tuberculosis
FQDVVDRWN

SEQ ID NO: 45611 - protein, 9 aa, Mycobacterium tuberculosis
QDVVDRWNA

SEQ ID NO: 45612 - protein, 9 aa, Mycobacterium tuberculosis
DVVDRWNAE

SEQ ID NO: 45613 - protein, 9 aa, Mycobacterium tuberculosis
VVDRWNAES

SEQ ID NO: 45614 - protein, 9 aa, Mycobacterium tuberculosis
VDRWNAEST

SEQ ID NO: 45615 - protein, 9 aa, Mycobacterium tuberculosis
DRWNAESTR

SEQ ID NO: 45616 - protein, 9 aa, Mycobacterium tuberculosis
RWNAESTRL

SEQ ID NO: 45617 - protein, 9 aa, Mycobacterium tuberculosis
WNAESTRLY

SEQ ID NO: 45618 - protein, 9 aa, Mycobacterium tuberculosis
NAESTRLYH

SEQ ID NO: 45619 - protein, 9 aa, Mycobacterium tuberculosis
AESTRLYHV

SEQ ID NO: 45620 - protein, 9 aa, Mycobacterium tuberculosis
ESTRLYHVL

SEQ ID NO: 45621 - protein, 9 aa, Mycobacterium tuberculosis
STRLYHVLH

SEQ ID NO: 45622 - protein, 9 aa, Mycobacterium tuberculosis
TRLYHVLHA

SEQ ID NO: 45623 - protein, 9 aa, Mycobacterium tuberculosis
RLYHVLHAI

SEQ ID NO: 45624 - protein, 9 aa, Mycobacterium tuberculosis
LYHVLHAIA

SEQ ID NO: 45625 - protein, 9 aa, Mycobacterium tuberculosis
YHVLHAIAD

SEQ ID NO: 45626 - protein, 9 aa, Mycobacterium tuberculosis
HVLHAIADT

SEQ ID NO: 45627 - protein, 9 aa, Mycobacterium tuberculosis
VLHAIADTI

SEQ ID NO: 45628 - protein, 9 aa, Mycobacterium tuberculosis
LHAIADTIR

SEQ ID NO: 45629 - protein, 9 aa, Mycobacterium tuberculosis
HAIADTIRH

SEQ ID NO: 45630 - protein, 9 aa, Mycobacterium tuberculosis
AIADTIRHN

SEQ ID NO: 45631 - protein, 9 aa, Mycobacterium tuberculosis
IADTIRHNE

SEQ ID NO: 45632 - protein, 9 aa, Mycobacterium tuberculosis
ADTIRHNEA

SEQ ID NO: 45633 - protein, 9 aa, Mycobacterium tuberculosis
DTIRHNEAA

SEQ ID NO: 45634 - protein, 9 aa, Mycobacterium tuberculosis
TIRHNEAAL

SEQ ID NO: 45635 - protein, 9 aa, Mycobacterium tuberculosis
IRHNEAALR

SEQ ID NO: 45636 - protein, 9 aa, Mycobacterium tuberculosis
RHNEAALRE

SEQ ID NO: 45637 - protein, 9 aa, Mycobacterium tuberculosis
HNEAALREA

SEQ ID NO: 45638 - protein, 9 aa, Mycobacterium tuberculosis
NEAALREAG

SEQ ID NO: 45639 - protein, 9 aa, Mycobacterium tuberculosis
EAALREAGQ

SEQ ID NO: 45640 - protein, 9 aa, Mycobacterium tuberculosis
AALREAGQI

SEQ ID NO: 45641 - protein, 9 aa, Mycobacterium tuberculosis
ALREAGQIH

SEQ ID NO: 45642 - protein, 9 aa, Mycobacterium tuberculosis
LREAGQIHA

SEQ ID NO: 45643 - protein, 9 aa, Mycobacterium tuberculosis
REAGQIHAR

SEQ ID NO: 45644 - protein, 9 aa, Mycobacterium tuberculosis
EAGQIHARH

SEQ ID NO: 45645 - protein, 9 aa, Mycobacterium tuberculosis
AGQIHARHI

SEQ ID NO: 45646 - protein, 9 aa, Mycobacterium tuberculosis
GQIHARHIA

SEQ ID NO: 45647 - protein, 9 aa, Mycobacterium tuberculosis
QIHARHIAA

SEQ ID NO: 45648 - protein, 9 aa, Mycobacterium tuberculosis
IHARHIAAA

SEQ ID NO: 45649 - protein, 9 aa, Mycobacterium tuberculosis
HARHIAAAG

SEQ ID NO: 45650 - protein, 9 aa, Mycobacterium tuberculosis
ARHIAAAGG

SEQ ID NO: 45651 - protein, 9 aa, Mycobacterium tuberculosis
RHIAAAGGD

SEQ ID NO: 45652 - protein, 9 aa, Mycobacterium tuberculosis
HIAAAGGDL

SEQ ID NO: 45653 - protein, 10 aa, Mycobacterium tuberculosis
MVEPGRIGGN

SEQ ID NO: 45654 - protein, 10 aa, Mycobacterium tuberculosis
VEPGRIGGNQ

SEQ ID NO: 45655 - protein, 10 aa, Mycobacterium tuberculosis
EPGRIGGNQT

SEQ ID NO: 45656 - protein, 10 aa, Mycobacterium tuberculosis
PGRIGGNQTR

SEQ ID NO: 45657 - protein, 10 aa, Mycobacterium tuberculosis
GRIGGNQTRL

SEQ ID NO: 45658 - protein, 10 aa, Mycobacterium tuberculosis
RIGGNQTRLA

SEQ ID NO: 45659 - protein, 10 aa, Mycobacterium tuberculosis
IGGNQTRLAA

SEQ ID NO: 45660 - protein, 10 aa, Mycobacterium tuberculosis
GGNQTRLAAV

SEQ ID NO: 45661 - protein, 10 aa, Mycobacterium tuberculosis
GNQTRLAAVL

SEQ ID NO: 45662 - protein, 10 aa, Mycobacterium tuberculosis
NQTRLAAVLL

SEQ ID NO: 45663 - protein, 10 aa, Mycobacterium tuberculosis
QTRLAAVLLD

SEQ ID NO: 45664 - protein, 10 aa, Mycobacterium tuberculosis
TRLAAVLLDV

SEQ ID NO: 45665 - protein, 10 aa, Mycobacterium tuberculosis
RLAAVLLDVS

SEQ ID NO: 45666 - protein, 10 aa, Mycobacterium tuberculosis
LAAVLLDVST

SEQ ID NO: 45667 - protein, 10 aa, Mycobacterium tuberculosis
AAVLLDVSTP

SEQ ID NO: 45668 - protein, 10 aa, Mycobacterium tuberculosis
AVLLDVSTPN

SEQ ID NO: 45669 - protein, 10 aa, Mycobacterium tuberculosis
VLLDVSTPNT

SEQ ID NO: 45670 - protein, 10 aa, Mycobacterium tuberculosis
LLDVSTPNTL

SEQ ID NO: 45671 - protein, 10 aa, Mycobacterium tuberculosis
LDVSTPNTLN

SEQ ID NO: 45672 - protein, 10 aa, Mycobacterium tuberculosis
DVSTPNTLNA

SEQ ID NO: 45673 - protein, 10 aa, Mycobacterium tuberculosis
VSTPNTLNAD

SEQ ID NO: 45674 - protein, 10 aa, Mycobacterium tuberculosis
STPNTLNADF

SEQ ID NO: 45675 - protein, 10 aa, Mycobacterium tuberculosis
TPNTLNADFD

SEQ ID NO: 45676 - protein, 10 aa, Mycobacterium tuberculosis
PNTLNADFDL

SEQ ID NO: 45677 - protein, 10 aa, Mycobacterium tuberculosis
NTLNADFDLM

SEQ ID NO: 45678 - protein, 10 aa, Mycobacterium tuberculosis
TLNADFDLMR

SEQ ID NO: 45679 - protein, 10 aa, Mycobacterium tuberculosis
LNADFDLMRS

SEQ ID NO: 45680 - protein, 10 aa, Mycobacterium tuberculosis
NADFDLMRSV

SEQ ID NO: 45681 - protein, 10 aa, Mycobacterium tuberculosis
ADFDLMRSVA

SEQ ID NO: 45682 - protein, 10 aa, Mycobacterium tuberculosis
DFDLMRSVAG

SEQ ID NO: 45683 - protein, 10 aa, Mycobacterium tuberculosis
FDLMRSVAGI

SEQ ID NO: 45684 - protein, 10 aa, Mycobacterium tuberculosis
DLMRSVAGIT

SEQ ID NO: 45685 - protein, 10 aa, Mycobacterium tuberculosis
LMRSVAGITD

SEQ ID NO: 45686 - protein, 10 aa, Mycobacterium tuberculosis
MRSVAGITDA

SEQ ID NO: 45687 - protein, 10 aa, Mycobacterium tuberculosis
RSVAGITDAR

SEQ ID NO: 45688 - protein, 10 aa, Mycobacterium tuberculosis
SVAGITDARN

SEQ ID NO: 45689 - protein, 10 aa, Mycobacterium tuberculosis
VAGITDARNE

SEQ ID NO: 45690 - protein, 10 aa, Mycobacterium tuberculosis
AGITDARNEE

SEQ ID NO: 45691 - protein, 10 aa, Mycobacterium tuberculosis
GITDARNEEI

SEQ ID NO: 45692 - protein, 10 aa, Mycobacterium tuberculosis
ITDARNEEIR

SEQ ID NO: 45693 - protein, 10 aa, Mycobacterium tuberculosis
TDARNEEIRA

SEQ ID NO: 45694 - protein, 10 aa, Mycobacterium tuberculosis
DARNEEIRAM

SEQ ID NO: 45695 - protein, 10 aa, Mycobacterium tuberculosis
ARNEEIRAML

SEQ ID NO: 45696 - protein, 10 aa, Mycobacterium tuberculosis
RNEEIRAMLQ

SEQ ID NO: 45697 - protein, 10 aa, Mycobacterium tuberculosis
NEEIRAMLQA

SEQ ID NO: 45698 - protein, 10 aa, Mycobacterium tuberculosis
EEIRAMLQAF

SEQ ID NO: 45699 - protein, 10 aa, Mycobacterium tuberculosis
EIRAMLQAFI

SEQ ID NO: 45700 - protein, 10 aa, Mycobacterium tuberculosis
IRAMLQAFIG

SEQ ID NO: 45701 - protein, 10 aa, Mycobacterium tuberculosis
RAMLQAFIGR

SEQ ID NO: 45702 - protein, 10 aa, Mycobacterium tuberculosis
AMLQAFIGRM

SEQ ID NO: 45703 - protein, 10 aa, Mycobacterium tuberculosis
MLQAFIGRMS

SEQ ID NO: 45704 - protein, 10 aa, Mycobacterium tuberculosis
LQAFIGRMSG

SEQ ID NO: 45705 - protein, 10 aa, Mycobacterium tuberculosis
QAFIGRMSGV

SEQ ID NO: 45706 - protein, 10 aa, Mycobacterium tuberculosis
AFIGRMSGVP

SEQ ID NO: 45707 - protein, 10 aa, Mycobacterium tuberculosis
FIGRMSGVPP

SEQ ID NO: 45708 - protein, 10 aa, Mycobacterium tuberculosis
IGRMSGVPPS

SEQ ID NO: 45709 - protein, 10 aa, Mycobacterium tuberculosis
GRMSGVPPSV

SEQ ID NO: 45710 - protein, 10 aa, Mycobacterium tuberculosis
RMSGVPPSVW

SEQ ID NO: 45711 - protein, 10 aa, Mycobacterium tuberculosis
MSGVPPSVWG

SEQ ID NO: 45712 - protein, 10 aa, Mycobacterium tuberculosis
SGVPPSVWGG

SEQ ID NO: 45713 - protein, 10 aa, Mycobacterium tuberculosis
GVPPSVWGGL

SEQ ID NO: 45714 - protein, 10 aa, Mycobacterium tuberculosis
VPPSVWGGLA

SEQ ID NO: 45715 - protein, 10 aa, Mycobacterium tuberculosis
PPSVWGGLAA

SEQ ID NO: 45716 - protein, 10 aa, Mycobacterium tuberculosis
PSVWGGLAAA

SEQ ID NO: 45717 - protein, 10 aa, Mycobacterium tuberculosis
SVWGGLAAAR

SEQ ID NO: 45718 - protein, 10 aa, Mycobacterium tuberculosis
VWGGLAAARF

SEQ ID NO: 45719 - protein, 10 aa, Mycobacterium tuberculosis
WGGLAAARFQ

SEQ ID NO: 45720 - protein, 10 aa, Mycobacterium tuberculosis
GGLAAARFQD

SEQ ID NO: 45721 - protein, 10 aa, Mycobacterium tuberculosis
GLAAARFQDV

SEQ ID NO: 45722 - protein, 10 aa, Mycobacterium tuberculosis
LAAARFQDVV

SEQ ID NO: 45723 - protein, 10 aa, Mycobacterium tuberculosis
AAARFQDVVD

SEQ ID NO: 45724 - protein, 10 aa, Mycobacterium tuberculosis
AARFQDVVDR

SEQ ID NO: 45725 - protein, 10 aa, Mycobacterium tuberculosis
ARFQDVVDRW

SEQ ID NO: 45726 - protein, 10 aa, Mycobacterium tuberculosis
RFQDVVDRWN

SEQ ID NO: 45727 - protein, 10 aa, Mycobacterium tuberculosis
FQDVVDRWNA

SEQ ID NO: 45728 - protein, 10 aa, Mycobacterium tuberculosis
QDVVDRWNAE

SEQ ID NO: 45729 - protein, 10 aa, Mycobacterium tuberculosis
DVVDRWNAES

SEQ ID NO: 45730 - protein, 10 aa, Mycobacterium tuberculosis
VVDRWNAEST

SEQ ID NO: 45731 - protein, 10 aa, Mycobacterium tuberculosis
VDRWNAESTR

SEQ ID NO: 45732 - protein, 10 aa, Mycobacterium tuberculosis
DRWNAESTRL

SEQ ID NO: 45733 - protein, 10 aa, Mycobacterium tuberculosis
RWNAESTRLY

SEQ ID NO: 45734 - protein, 10 aa, Mycobacterium tuberculosis
WNAESTRLYH

SEQ ID NO: 45735 - protein, 10 aa, Mycobacterium tuberculosis
NAESTRLYHV

SEQ ID NO: 45736 - protein, 10 aa, Mycobacterium tuberculosis
AESTRLYHVL

SEQ ID NO: 45737 - protein, 10 aa, Mycobacterium tuberculosis
ESTRLYHVLH

SEQ ID NO: 45738 - protein, 10 aa, Mycobacterium tuberculosis
STRLYHVLHA

SEQ ID NO: 45739 - protein, 10 aa, Mycobacterium tuberculosis
TRLYHVLHAI

SEQ ID NO: 45740 - protein, 10 aa, Mycobacterium tuberculosis
RLYHVLHAIA

SEQ ID NO: 45741 - protein, 10 aa, Mycobacterium tuberculosis
LYHVLHAIAD

SEQ ID NO: 45742 - protein, 10 aa, Mycobacterium tuberculosis
YHVLHAIADT

SEQ ID NO: 45743 - protein, 10 aa, Mycobacterium tuberculosis
HVLHAIADTI

SEQ ID NO: 45744 - protein, 10 aa, Mycobacterium tuberculosis
VLHAIADTIR

SEQ ID NO: 45745 - protein, 10 aa, Mycobacterium tuberculosis
LHAIADTIRH

SEQ ID NO: 45746 - protein, 10 aa, Mycobacterium tuberculosis
HAIADTIRHN

SEQ ID NO: 45747 - protein, 10 aa, Mycobacterium tuberculosis
AIADTIRHNE

SEQ ID NO: 45748 - protein, 10 aa, Mycobacterium tuberculosis
IADTIRHNEA

SEQ ID NO: 45749 - protein, 10 aa, Mycobacterium tuberculosis
ADTIRHNEAA

SEQ ID NO: 45750 - protein, 10 aa, Mycobacterium tuberculosis
DTIRHNEAAL

SEQ ID NO: 45751 - protein, 10 aa, Mycobacterium tuberculosis
TIRHNEAALR

SEQ ID NO: 45752 - protein, 10 aa, Mycobacterium tuberculosis
IRHNEAALRE

SEQ ID NO: 45753 - protein, 10 aa, Mycobacterium tuberculosis
RHNEAALREA

SEQ ID NO: 45754 - protein, 10 aa, Mycobacterium tuberculosis
HNEAALREAG

SEQ ID NO: 45755 - protein, 10 aa, Mycobacterium tuberculosis
NEAALREAGQ

SEQ ID NO: 45756 - protein, 10 aa, Mycobacterium tuberculosis
EAALREAGQI

SEQ ID NO: 45757 - protein, 10 aa, Mycobacterium tuberculosis
AALREAGQIH

SEQ ID NO: 45758 - protein, 10 aa, Mycobacterium tuberculosis
ALREAGQIHA

SEQ ID NO: 45759 - protein, 10 aa, Mycobacterium tuberculosis
LREAGQIHAR

SEQ ID NO: 45760 - protein, 10 aa, Mycobacterium tuberculosis
REAGQIHARH

SEQ ID NO: 45761 - protein, 10 aa, Mycobacterium tuberculosis
EAGQIHARHI

SEQ ID NO: 45762 - protein, 10 aa, Mycobacterium tuberculosis
AGQIHARHIA

SEQ ID NO: 45763 - protein, 10 aa, Mycobacterium tuberculosis
GQIHARHIAA

SEQ ID NO: 45764 - protein, 10 aa, Mycobacterium tuberculosis
QIHARHIAAA

SEQ ID NO: 45765 - protein, 10 aa, Mycobacterium tuberculosis
IHARHIAAAG

SEQ ID NO: 45766 - protein, 10 aa, Mycobacterium tuberculosis
HARHIAAAGG

SEQ ID NO: 45767 - protein, 10 aa, Mycobacterium tuberculosis
ARHIAAAGGD

SEQ ID NO: 45768 - protein, 10 aa, Mycobacterium tuberculosis
RHIAAAGGDL

SEQ ID NO: 45769 - protein, 11 aa, Mycobacterium tuberculosis
MVEPGRIGGNQ

SEQ ID NO: 45770 - protein, 11 aa, Mycobacterium tuberculosis
VEPGRIGGNQT

SEQ ID NO: 45771 - protein, 11 aa, Mycobacterium tuberculosis
EPGRIGGNQTR

SEQ ID NO: 45772 - protein, 11 aa, Mycobacterium tuberculosis
PGRIGGNQTRL

SEQ ID NO: 45773 - protein, 11 aa, Mycobacterium tuberculosis
GRIGGNQTRLA

SEQ ID NO: 45774 - protein, 11 aa, Mycobacterium tuberculosis
RIGGNQTRLAA

SEQ ID NO: 45775 - protein, 11 aa, Mycobacterium tuberculosis
IGGNQTRLAAV

SEQ ID NO: 45776 - protein, 11 aa, Mycobacterium tuberculosis
GGNQTRLAAVL

SEQ ID NO: 45777 - protein, 11 aa, Mycobacterium tuberculosis
GNQTRLAAVLL

SEQ ID NO: 45778 - protein, 11 aa, Mycobacterium tuberculosis
NQTRLAAVLLD

SEQ ID NO: 45779 - protein, 11 aa, Mycobacterium tuberculosis
QTRLAAVLLDV

SEQ ID NO: 45780 - protein, 11 aa, Mycobacterium tuberculosis
TRLAAVLLDVS

SEQ ID NO: 45781 - protein, 11 aa, Mycobacterium tuberculosis
RLAAVLLDVST

SEQ ID NO: 45782 - protein, 11 aa, Mycobacterium tuberculosis
LAAVLLDVSTP

SEQ ID NO: 45783 - protein, 11 aa, Mycobacterium tuberculosis
AAVLLDVSTPN

SEQ ID NO: 45784 - protein, 11 aa, Mycobacterium tuberculosis
AVLLDVSTPNT

SEQ ID NO: 45785 - protein, 11 aa, Mycobacterium tuberculosis
VLLDVSTPNTL

SEQ ID NO: 45786 - protein, 11 aa, Mycobacterium tuberculosis
LLDVSTPNTLN

SEQ ID NO: 45787 - protein, 11 aa, Mycobacterium tuberculosis
LDVSTPNTLNA

SEQ ID NO: 45788 - protein, 11 aa, Mycobacterium tuberculosis
DVSTPNTLNAD

SEQ ID NO: 45789 - protein, 11 aa, Mycobacterium tuberculosis
VSTPNTLNADF

SEQ ID NO: 45790 - protein, 11 aa, Mycobacterium tuberculosis
STPNTLNADFD

SEQ ID NO: 45791 - protein, 11 aa, Mycobacterium tuberculosis
TPNTLNADFDL

SEQ ID NO: 45792 - protein, 11 aa, Mycobacterium tuberculosis
PNTLNADFDLM

SEQ ID NO: 45793 - protein, 11 aa, Mycobacterium tuberculosis
NTLNADFDLMR

SEQ ID NO: 45794 - protein, 11 aa, Mycobacterium tuberculosis
TLNADFDLMRS

SEQ ID NO: 45795 - protein, 11 aa, Mycobacterium tuberculosis
LNADFDLMRSV

SEQ ID NO: 45796 - protein, 11 aa, Mycobacterium tuberculosis
NADFDLMRSVA

SEQ ID NO: 45797 - protein, 11 aa, Mycobacterium tuberculosis
ADFDLMRSVAG

SEQ ID NO: 45798 - protein, 11 aa, Mycobacterium tuberculosis
DFDLMRSVAGI

SEQ ID NO: 45799 - protein, 11 aa, Mycobacterium tuberculosis
FDLMRSVAGIT

SEQ ID NO: 45800 - protein, 11 aa, Mycobacterium tuberculosis
DLMRSVAGITD

SEQ ID NO: 45801 - protein, 11 aa, Mycobacterium tuberculosis
LMRSVAGITDA

SEQ ID NO: 45802 - protein, 11 aa, Mycobacterium tuberculosis
MRSVAGITDAR

SEQ ID NO: 45803 - protein, 11 aa, Mycobacterium tuberculosis
RSVAGITDARN

SEQ ID NO: 45804 - protein, 11 aa, Mycobacterium tuberculosis
SVAGITDARNE

SEQ ID NO: 45805 - protein, 11 aa, Mycobacterium tuberculosis
VAGITDARNEE

SEQ ID NO: 45806 - protein, 11 aa, Mycobacterium tuberculosis
AGITDARNEEI

SEQ ID NO: 45807 - protein, 11 aa, Mycobacterium tuberculosis
GITDARNEEIR

SEQ ID NO: 45808 - protein, 11 aa, Mycobacterium tuberculosis
ITDARNEEIRA

SEQ ID NO: 45809 - protein, 11 aa, Mycobacterium tuberculosis
TDARNEEIRAM

SEQ ID NO: 45810 - protein, 11 aa, Mycobacterium tuberculosis
DARNEEIRAML

SEQ ID NO: 45811 - protein, 11 aa, Mycobacterium tuberculosis
ARNEEIRAMLQ

SEQ ID NO: 45812 - protein, 11 aa, Mycobacterium tuberculosis
RNEEIRAMLQA

SEQ ID NO: 45813 - protein, 11 aa, Mycobacterium tuberculosis
NEEIRAMLQAF

SEQ ID NO: 45814 - protein, 11 aa, Mycobacterium tuberculosis
EEIRAMLQAFI

SEQ ID NO: 45815 - protein, 11 aa, Mycobacterium tuberculosis
EIRAMLQAFIG

SEQ ID NO: 45816 - protein, 11 aa, Mycobacterium tuberculosis
IRAMLQAFIGR

SEQ ID NO: 45817 - protein, 11 aa, Mycobacterium tuberculosis
RAMLQAFIGRM

SEQ ID NO: 45818 - protein, 11 aa, Mycobacterium tuberculosis
AMLQAFIGRMS

SEQ ID NO: 45819 - protein, 11 aa, Mycobacterium tuberculosis
MLQAFIGRMSG

SEQ ID NO: 45820 - protein, 11 aa, Mycobacterium tuberculosis
LQAFIGRMSGV

SEQ ID NO: 45821 - protein, 11 aa, Mycobacterium tuberculosis
QAFIGRMSGVP

SEQ ID NO: 45822 - protein, 11 aa, Mycobacterium tuberculosis
AFIGRMSGVPP

SEQ ID NO: 45823 - protein, 11 aa, Mycobacterium tuberculosis
FIGRMSGVPPS

SEQ ID NO: 45824 - protein, 11 aa, Mycobacterium tuberculosis
IGRMSGVPPSV

SEQ ID NO: 45825 - protein, 11 aa, Mycobacterium tuberculosis
GRMSGVPPSVW

SEQ ID NO: 45826 - protein, 11 aa, Mycobacterium tuberculosis
RMSGVPPSVWG

SEQ ID NO: 45827 - protein, 11 aa, Mycobacterium tuberculosis
MSGVPPSVWGG

SEQ ID NO: 45828 - protein, 11 aa, Mycobacterium tuberculosis
SGVPPSVWGGL

SEQ ID NO: 45829 - protein, 11 aa, Mycobacterium tuberculosis
GVPPSVWGGLA

SEQ ID NO: 45830 - protein, 11 aa, Mycobacterium tuberculosis
VPPSVWGGLAA

SEQ ID NO: 45831 - protein, 11 aa, Mycobacterium tuberculosis
PPSVWGGLAAA

SEQ ID NO: 45832 - protein, 11 aa, Mycobacterium tuberculosis
PSVWGGLAAAR

SEQ ID NO: 45833 - protein, 11 aa, Mycobacterium tuberculosis
SVWGGLAAARF

SEQ ID NO: 45834 - protein, 11 aa, Mycobacterium tuberculosis
VWGGLAAARFQ

SEQ ID NO: 45835 - protein, 11 aa, Mycobacterium tuberculosis
WGGLAAARFQD

SEQ ID NO: 45836 - protein, 11 aa, Mycobacterium tuberculosis
GGLAAARFQDV

SEQ ID NO: 45837 - protein, 11 aa, Mycobacterium tuberculosis
GLAAARFQDVV

SEQ ID NO: 45838 - protein, 11 aa, Mycobacterium tuberculosis
LAAARFQDVVD

SEQ ID NO: 45839 - protein, 11 aa, Mycobacterium tuberculosis
AAARFQDVVDR

SEQ ID NO: 45840 - protein, 11 aa, Mycobacterium tuberculosis
AARFQDVVDRW

SEQ ID NO: 45841 - protein, 11 aa, Mycobacterium tuberculosis
ARFQDVVDRWN

SEQ ID NO: 45842 - protein, 11 aa, Mycobacterium tuberculosis
RFQDVVDRWNA

SEQ ID NO: 45843 - protein, 11 aa, Mycobacterium tuberculosis
FQDVVDRWNAE

SEQ ID NO: 45844 - protein, 11 aa, Mycobacterium tuberculosis
QDVVDRWNAES

SEQ ID NO: 45845 - protein, 11 aa, Mycobacterium tuberculosis
DVVDRWNAEST

SEQ ID NO: 45846 - protein, 11 aa, Mycobacterium tuberculosis
VVDRWNAESTR

SEQ ID NO: 45847 - protein, 11 aa, Mycobacterium tuberculosis
VDRWNAESTRL

SEQ ID NO: 45848 - protein, 11 aa, Mycobacterium tuberculosis
DRWNAESTRLY

SEQ ID NO: 45849 - protein, 11 aa, Mycobacterium tuberculosis
RWNAESTRLYH

SEQ ID NO: 45850 - protein, 11 aa, Mycobacterium tuberculosis
WNAESTRLYHV

SEQ ID NO: 45851 - protein, 11 aa, Mycobacterium tuberculosis
NAESTRLYHVL

SEQ ID NO: 45852 - protein, 11 aa, Mycobacterium tuberculosis
AESTRLYHVLH

SEQ ID NO: 45853 - protein, 11 aa, Mycobacterium tuberculosis
ESTRLYHVLHA

SEQ ID NO: 45854 - protein, 11 aa, Mycobacterium tuberculosis
STRLYHVLHAI

SEQ ID NO: 45855 - protein, 11 aa, Mycobacterium tuberculosis
TRLYHVLHAIA

SEQ ID NO: 45856 - protein, 11 aa, Mycobacterium tuberculosis
RLYHVLHAIAD

SEQ ID NO: 45857 - protein, 11 aa, Mycobacterium tuberculosis
LYHVLHAIADT

SEQ ID NO: 45858 - protein, 11 aa, Mycobacterium tuberculosis
YHVLHAIADTI

SEQ ID NO: 45859 - protein, 11 aa, Mycobacterium tuberculosis
HVLHAIADTIR

SEQ ID NO: 45860 - protein, 11 aa, Mycobacterium tuberculosis
VLHAIADTIRH

SEQ ID NO: 45861 - protein, 11 aa, Mycobacterium tuberculosis
LHAIADTIRHN

SEQ ID NO: 45862 - protein, 11 aa, Mycobacterium tuberculosis
HAIADTIRHNE

SEQ ID NO: 45863 - protein, 11 aa, Mycobacterium tuberculosis
AIADTIRHNEA

SEQ ID NO: 45864 - protein, 11 aa, Mycobacterium tuberculosis
IADTIRHNEAA

SEQ ID NO: 45865 - protein, 11 aa, Mycobacterium tuberculosis
ADTIRHNEAAL

SEQ ID NO: 45866 - protein, 11 aa, Mycobacterium tuberculosis
DTIRHNEAALR

SEQ ID NO: 45867 - protein, 11 aa, Mycobacterium tuberculosis
TIRHNEAALRE

SEQ ID NO: 45868 - protein, 11 aa, Mycobacterium tuberculosis
IRHNEAALREA

SEQ ID NO: 45869 - protein, 11 aa, Mycobacterium tuberculosis
RHNEAALREAG

SEQ ID NO: 45870 - protein, 11 aa, Mycobacterium tuberculosis
HNEAALREAGQ

SEQ ID NO: 45871 - protein, 11 aa, Mycobacterium tuberculosis
NEAALREAGQI

SEQ ID NO: 45872 - protein, 11 aa, Mycobacterium tuberculosis
EAALREAGQIH

SEQ ID NO: 45873 - protein, 11 aa, Mycobacterium tuberculosis
AALREAGQIHA

SEQ ID NO: 45874 - protein, 11 aa, Mycobacterium tuberculosis
ALREAGQIHAR

SEQ ID NO: 45875 - protein, 11 aa, Mycobacterium tuberculosis
LREAGQIHARH

SEQ ID NO: 45876 - protein, 11 aa, Mycobacterium tuberculosis
REAGQIHARHI

SEQ ID NO: 45877 - protein, 11 aa, Mycobacterium tuberculosis
EAGQIHARHIA

SEQ ID NO: 45878 - protein, 11 aa, Mycobacterium tuberculosis
AGQIHARHIAA

SEQ ID NO: 45879 - protein, 11 aa, Mycobacterium tuberculosis
GQIHARHIAAA

SEQ ID NO: 45880 - protein, 11 aa, Mycobacterium tuberculosis
QIHARHIAAAG

SEQ ID NO: 45881 - protein, 11 aa, Mycobacterium tuberculosis
IHARHIAAAGG

SEQ ID NO: 45882 - protein, 11 aa, Mycobacterium tuberculosis
HARHIAAAGGD

SEQ ID NO: 45883 - protein, 11 aa, Mycobacterium tuberculosis
ARHIAAAGGDL

SEQ ID NO: 45884 - protein, 8 aa, Mycobacterium tuberculosis
MSFTAQPE

SEQ ID NO: 45885 - protein, 8 aa, Mycobacterium tuberculosis
SFTAQPEM

SEQ ID NO: 45886 - protein, 8 aa, Mycobacterium tuberculosis
FTAQPEML

SEQ ID NO: 45887 - protein, 8 aa, Mycobacterium tuberculosis
TAQPEMLA

SEQ ID NO: 45888 - protein, 8 aa, Mycobacterium tuberculosis
AQPEMLAA

SEQ ID NO: 45889 - protein, 8 aa, Mycobacterium tuberculosis
QPEMLAAA

SEQ ID NO: 45890 - protein, 8 aa, Mycobacterium tuberculosis
PEMLAAAA

SEQ ID NO: 45891 - protein, 8 aa, Mycobacterium tuberculosis
EMLAAAAG

SEQ ID NO: 45892 - protein, 8 aa, Mycobacterium tuberculosis
MLAAAAGE

SEQ ID NO: 45893 - protein, 8 aa, Mycobacterium tuberculosis
LAAAAGEL

SEQ ID NO: 45894 - protein, 8 aa, Mycobacterium tuberculosis
AAAAGELR

SEQ ID NO: 45895 - protein, 8 aa, Mycobacterium tuberculosis
AAAGELRS

SEQ ID NO: 45896 - protein, 8 aa, Mycobacterium tuberculosis
AAGELRSL

SEQ ID NO: 45897 - protein, 8 aa, Mycobacterium tuberculosis
AGELRSLG

SEQ ID NO: 45898 - protein, 8 aa, Mycobacterium tuberculosis
GELRSLGA

SEQ ID NO: 45899 - protein, 8 aa, Mycobacterium tuberculosis
ELRSLGAT

SEQ ID NO: 45900 - protein, 8 aa, Mycobacterium tuberculosis
LRSLGATL

SEQ ID NO: 45901 - protein, 8 aa, Mycobacterium tuberculosis
RSLGATLK

SEQ ID NO: 45902 - protein, 8 aa, Mycobacterium tuberculosis
SLGATLKA

SEQ ID NO: 45903 - protein, 8 aa, Mycobacterium tuberculosis
LGATLKAS

SEQ ID NO: 45904 - protein, 8 aa, Mycobacterium tuberculosis
GATLKASN

SEQ ID NO: 45905 - protein, 8 aa, Mycobacterium tuberculosis
ATLKASNA

SEQ ID NO: 45906 - protein, 8 aa, Mycobacterium tuberculosis
TLKASNAA

SEQ ID NO: 45907 - protein, 8 aa, Mycobacterium tuberculosis
LKASNAAA

SEQ ID NO: 45908 - protein, 8 aa, Mycobacterium tuberculosis
KASNAAAA

SEQ ID NO: 45909 - protein, 8 aa, Mycobacterium tuberculosis
ASNAAAAV

SEQ ID NO: 45910 - protein, 8 aa, Mycobacterium tuberculosis
SNAAAAVP

SEQ ID NO: 45911 - protein, 8 aa, Mycobacterium tuberculosis
NAAAAVPT

SEQ ID NO: 45912 - protein, 8 aa, Mycobacterium tuberculosis
AAAAVPTT

SEQ ID NO: 45913 - protein, 8 aa, Mycobacterium tuberculosis
AAAVPTTG

SEQ ID NO: 45914 - protein, 8 aa, Mycobacterium tuberculosis
AAVPTTGV

SEQ ID NO: 45915 - protein, 8 aa, Mycobacterium tuberculosis
AVPTTGVV

SEQ ID NO: 45916 - protein, 8 aa, Mycobacterium tuberculosis
VPTTGVVP

SEQ ID NO: 45917 - protein, 8 aa, Mycobacterium tuberculosis
PTTGVVPP

SEQ ID NO: 45918 - protein, 8 aa, Mycobacterium tuberculosis
TTGVVPPA

SEQ ID NO: 45919 - protein, 8 aa, Mycobacterium tuberculosis
TGVVPPAA

SEQ ID NO: 45920 - protein, 8 aa, Mycobacterium tuberculosis
GVVPPAAD

SEQ ID NO: 45921 - protein, 8 aa, Mycobacterium tuberculosis
VVPPAADE

SEQ ID NO: 45922 - protein, 8 aa, Mycobacterium tuberculosis
VPPAADEV

SEQ ID NO: 45923 - protein, 8 aa, Mycobacterium tuberculosis
PPAADEVS

SEQ ID NO: 45924 - protein, 8 aa, Mycobacterium tuberculosis
PAADEVSL

SEQ ID NO: 45925 - protein, 8 aa, Mycobacterium tuberculosis
AADEVSLL

SEQ ID NO: 45926 - protein, 8 aa, Mycobacterium tuberculosis
ADEVSLLL

SEQ ID NO: 45927 - protein, 8 aa, Mycobacterium tuberculosis
DEVSLLLA

SEQ ID NO: 45928 - protein, 8 aa, Mycobacterium tuberculosis
EVSLLLAT

SEQ ID NO: 45929 - protein, 8 aa, Mycobacterium tuberculosis
VSLLLATQ

SEQ ID NO: 45930 - protein, 8 aa, Mycobacterium tuberculosis
SLLLATQF

SEQ ID NO: 45931 - protein, 8 aa, Mycobacterium tuberculosis
LLLATQFR

SEQ ID NO: 45932 - protein, 8 aa, Mycobacterium tuberculosis
LLATQFRT

SEQ ID NO: 45933 - protein, 8 aa, Mycobacterium tuberculosis
LATQFRTH

SEQ ID NO: 45934 - protein, 8 aa, Mycobacterium tuberculosis
ATQFRTHA

SEQ ID NO: 45935 - protein, 8 aa, Mycobacterium tuberculosis
TQFRTHAA

SEQ ID NO: 45936 - protein, 8 aa, Mycobacterium tuberculosis
QFRTHAAT

SEQ ID NO: 45937 - protein, 8 aa, Mycobacterium tuberculosis
FRTHAATY

SEQ ID NO: 45938 - protein, 8 aa, Mycobacterium tuberculosis
RTHAATYQ

SEQ ID NO: 45939 - protein, 8 aa, Mycobacterium tuberculosis
THAATYQT

SEQ ID NO: 45940 - protein, 8 aa, Mycobacterium tuberculosis
HAATYQTA

SEQ ID NO: 45941 - protein, 8 aa, Mycobacterium tuberculosis
AATYQTAS

SEQ ID NO: 45942 - protein, 8 aa, Mycobacterium tuberculosis
ATYQTASA

SEQ ID NO: 45943 - protein, 8 aa, Mycobacterium tuberculosis
TYQTASAK

SEQ ID NO: 45944 - protein, 8 aa, Mycobacterium tuberculosis
YQTASAKA

SEQ ID NO: 45945 - protein, 8 aa, Mycobacterium tuberculosis
QTASAKAA

SEQ ID NO: 45946 - protein, 8 aa, Mycobacterium tuberculosis
TASAKAAV

SEQ ID NO: 45947 - protein, 8 aa, Mycobacterium tuberculosis
ASAKAAVI

SEQ ID NO: 45948 - protein, 8 aa, Mycobacterium tuberculosis
SAKAAVIH

SEQ ID NO: 45949 - protein, 8 aa, Mycobacterium tuberculosis
AKAAVIHE

SEQ ID NO: 45950 - protein, 8 aa, Mycobacterium tuberculosis
KAAVIHEQ

SEQ ID NO: 45951 - protein, 8 aa, Mycobacterium tuberculosis
AAVIHEQF

SEQ ID NO: 45952 - protein, 8 aa, Mycobacterium tuberculosis
AVIHEQFV

SEQ ID NO: 45953 - protein, 8 aa, Mycobacterium tuberculosis
VIHEQFVT

SEQ ID NO: 45954 - protein, 8 aa, Mycobacterium tuberculosis
IHEQFVTT

SEQ ID NO: 45955 - protein, 8 aa, Mycobacterium tuberculosis
HEQFVTTL

SEQ ID NO: 45956 - protein, 8 aa, Mycobacterium tuberculosis
EQFVTTLA

SEQ ID NO: 45957 - protein, 8 aa, Mycobacterium tuberculosis
QFVTTLAT

SEQ ID NO: 45958 - protein, 8 aa, Mycobacterium tuberculosis
FVTTLATS

SEQ ID NO: 45959 - protein, 8 aa, Mycobacterium tuberculosis
VTTLATSA

SEQ ID NO: 45960 - protein, 8 aa, Mycobacterium tuberculosis
TTLATSAS

SEQ ID NO: 45961 - protein, 8 aa, Mycobacterium tuberculosis
TLATSASS

SEQ ID NO: 45962 - protein, 8 aa, Mycobacterium tuberculosis
LATSASSY

SEQ ID NO: 45963 - protein, 8 aa, Mycobacterium tuberculosis
ATSASSYA

SEQ ID NO: 45964 - protein, 8 aa, Mycobacterium tuberculosis
TSASSYAD

SEQ ID NO: 45965 - protein, 8 aa, Mycobacterium tuberculosis
SASSYADT

SEQ ID NO: 45966 - protein, 8 aa, Mycobacterium tuberculosis
ASSYADTE

SEQ ID NO: 45967 - protein, 8 aa, Mycobacterium tuberculosis
SSYADTEA

SEQ ID NO: 45968 - protein, 8 aa, Mycobacterium tuberculosis
SYADTEAA

SEQ ID NO: 45969 - protein, 8 aa, Mycobacterium tuberculosis
YADTEAAN

SEQ ID NO: 45970 - protein, 8 aa, Mycobacterium tuberculosis
ADTEAANA

SEQ ID NO: 45971 - protein, 8 aa, Mycobacterium tuberculosis
DTEAANAV

SEQ ID NO: 45972 - protein, 8 aa, Mycobacterium tuberculosis
TEAANAVV

SEQ ID NO: 45973 - protein, 8 aa, Mycobacterium tuberculosis
EAANAVVT

SEQ ID NO: 45974 - protein, 8 aa, Mycobacterium tuberculosis
AANAVVTG

SEQ ID NO: 45975 - protein, 9 aa, Mycobacterium tuberculosis
MSFTAQPEM

SEQ ID NO: 45976 - protein, 9 aa, Mycobacterium tuberculosis
SFTAQPEML

SEQ ID NO: 45977 - protein, 9 aa, Mycobacterium tuberculosis
FTAQPEMLA

SEQ ID NO: 45978 - protein, 9 aa, Mycobacterium tuberculosis
TAQPEMLAA

SEQ ID NO: 45979 - protein, 9 aa, Mycobacterium tuberculosis
AQPEMLAAA

SEQ ID NO: 45980 - protein, 9 aa, Mycobacterium tuberculosis
QPEMLAAAA

SEQ ID NO: 45981 - protein, 9 aa, Mycobacterium tuberculosis
PEMLAAAAG

SEQ ID NO: 45982 - protein, 9 aa, Mycobacterium tuberculosis
EMLAAAAGE

SEQ ID NO: 45983 - protein, 9 aa, Mycobacterium tuberculosis
MLAAAAGEL

SEQ ID NO: 45984 - protein, 9 aa, Mycobacterium tuberculosis
LAAAAGELR

SEQ ID NO: 45985 - protein, 9 aa, Mycobacterium tuberculosis
AAAAGELRS

SEQ ID NO: 45986 - protein, 9 aa, Mycobacterium tuberculosis
AAAGELRSL

SEQ ID NO: 45987 - protein, 9 aa, Mycobacterium tuberculosis
AAGELRSLG

SEQ ID NO: 45988 - protein, 9 aa, Mycobacterium tuberculosis
AGELRSLGA

SEQ ID NO: 45989 - protein, 9 aa, Mycobacterium tuberculosis
GELRSLGAT

SEQ ID NO: 45990 - protein, 9 aa, Mycobacterium tuberculosis
ELRSLGATL

SEQ ID NO: 45991 - protein, 9 aa, Mycobacterium tuberculosis
LRSLGATLK

SEQ ID NO: 45992 - protein, 9 aa, Mycobacterium tuberculosis
RSLGATLKA

SEQ ID NO: 45993 - protein, 9 aa, Mycobacterium tuberculosis
SLGATLKAS

SEQ ID NO: 45994 - protein, 9 aa, Mycobacterium tuberculosis
LGATLKASN

SEQ ID NO: 45995 - protein, 9 aa, Mycobacterium tuberculosis
GATLKASNA

SEQ ID NO: 45996 - protein, 9 aa, Mycobacterium tuberculosis
ATLKASNAA

SEQ ID NO: 45997 - protein, 9 aa, Mycobacterium tuberculosis
TLKASNAAA

SEQ ID NO: 45998 - protein, 9 aa, Mycobacterium tuberculosis
LKASNAAAA

SEQ ID NO: 45999 - protein, 9 aa, Mycobacterium tuberculosis
KASNAAAAV

SEQ ID NO: 46000 - protein, 9 aa, Mycobacterium tuberculosis
ASNAAAAVP

SEQ ID NO: 46001 - protein, 9 aa, Mycobacterium tuberculosis
SNAAAAVPT

SEQ ID NO: 46002 - protein, 9 aa, Mycobacterium tuberculosis
NAAAAVPTT

SEQ ID NO: 46003 - protein, 9 aa, Mycobacterium tuberculosis
AAAAVPTTG

SEQ ID NO: 46004 - protein, 9 aa, Mycobacterium tuberculosis
AAAVPTTGV

SEQ ID NO: 46005 - protein, 9 aa, Mycobacterium tuberculosis
AAVPTTGVV

SEQ ID NO: 46006 - protein, 9 aa, Mycobacterium tuberculosis
AVPTTGVVP

SEQ ID NO: 46007 - protein, 9 aa, Mycobacterium tuberculosis
VPTTGVVPP

SEQ ID NO: 46008 - protein, 9 aa, Mycobacterium tuberculosis
PTTGVVPPA

SEQ ID NO: 46009 - protein, 9 aa, Mycobacterium tuberculosis
TTGVVPPAA

SEQ ID NO: 46010 - protein, 9 aa, Mycobacterium tuberculosis
TGVVPPAAD

SEQ ID NO: 46011 - protein, 9 aa, Mycobacterium tuberculosis
GVVPPAADE

SEQ ID NO: 46012 - protein, 9 aa, Mycobacterium tuberculosis
VVPPAADEV

SEQ ID NO: 46013 - protein, 9 aa, Mycobacterium tuberculosis
VPPAADEVS

SEQ ID NO: 46014 - protein, 9 aa, Mycobacterium tuberculosis
PPAADEVSL

SEQ ID NO: 46015 - protein, 9 aa, Mycobacterium tuberculosis
PAADEVSLL

SEQ ID NO: 46016 - protein, 9 aa, Mycobacterium tuberculosis
AADEVSLLL

SEQ ID NO: 46017 - protein, 9 aa, Mycobacterium tuberculosis
ADEVSLLLA

SEQ ID NO: 46018 - protein, 9 aa, Mycobacterium tuberculosis
DEVSLLLAT

SEQ ID NO: 46019 - protein, 9 aa, Mycobacterium tuberculosis
EVSLLLATQ

SEQ ID NO: 46020 - protein, 9 aa, Mycobacterium tuberculosis
VSLLLATQF

SEQ ID NO: 46021 - protein, 9 aa, Mycobacterium tuberculosis
SLLLATQFR

SEQ ID NO: 46022 - protein, 9 aa, Mycobacterium tuberculosis
LLLATQFRT

SEQ ID NO: 46023 - protein, 9 aa, Mycobacterium tuberculosis
LLATQFRTH

SEQ ID NO: 46024 - protein, 9 aa, Mycobacterium tuberculosis
LATQFRTHA

SEQ ID NO: 46025 - protein, 9 aa, Mycobacterium tuberculosis
ATQFRTHAA

SEQ ID NO: 46026 - protein, 9 aa, Mycobacterium tuberculosis
TQFRTHAAT

SEQ ID NO: 46027 - protein, 9 aa, Mycobacterium tuberculosis
QFRTHAATY

SEQ ID NO: 46028 - protein, 9 aa, Mycobacterium tuberculosis
FRTHAATYQ

SEQ ID NO: 46029 - protein, 9 aa, Mycobacterium tuberculosis
RTHAATYQT

SEQ ID NO: 46030 - protein, 9 aa, Mycobacterium tuberculosis
THAATYQTA

SEQ ID NO: 46031 - protein, 9 aa, Mycobacterium tuberculosis
HAATYQTAS

SEQ ID NO: 46032 - protein, 9 aa, Mycobacterium tuberculosis
AATYQTASA

SEQ ID NO: 46033 - protein, 9 aa, Mycobacterium tuberculosis
ATYQTASAK

SEQ ID NO: 46034 - protein, 9 aa, Mycobacterium tuberculosis
TYQTASAKA

SEQ ID NO: 46035 - protein, 9 aa, Mycobacterium tuberculosis
YQTASAKAA

SEQ ID NO: 46036 - protein, 9 aa, Mycobacterium tuberculosis
QTASAKAAV

SEQ ID NO: 46037 - protein, 9 aa, Mycobacterium tuberculosis
TASAKAAVI

SEQ ID NO: 46038 - protein, 9 aa, Mycobacterium tuberculosis
ASAKAAVIH

SEQ ID NO: 46039 - protein, 9 aa, Mycobacterium tuberculosis
SAKAAVIHE

SEQ ID NO: 46040 - protein, 9 aa, Mycobacterium tuberculosis
AKAAVIHEQ

SEQ ID NO: 46041 - protein, 9 aa, Mycobacterium tuberculosis
KAAVIHEQF

SEQ ID NO: 46042 - protein, 9 aa, Mycobacterium tuberculosis
AAVIHEQFV

SEQ ID NO: 46043 - protein, 9 aa, Mycobacterium tuberculosis
AVIHEQFVT

SEQ ID NO: 46044 - protein, 9 aa, Mycobacterium tuberculosis
VIHEQFVTT

SEQ ID NO: 46045 - protein, 9 aa, Mycobacterium tuberculosis
IHEQFVTTL

SEQ ID NO: 46046 - protein, 9 aa, Mycobacterium tuberculosis
HEQFVTTLA

SEQ ID NO: 46047 - protein, 9 aa, Mycobacterium tuberculosis
EQFVTTLAT

SEQ ID NO: 46048 - protein, 9 aa, Mycobacterium tuberculosis
QFVTTLATS

SEQ ID NO: 46049 - protein, 9 aa, Mycobacterium tuberculosis
FVTTLATSA

SEQ ID NO: 46050 - protein, 9 aa, Mycobacterium tuberculosis
VTTLATSAS

SEQ ID NO: 46051 - protein, 9 aa, Mycobacterium tuberculosis
TTLATSASS

SEQ ID NO: 46052 - protein, 9 aa, Mycobacterium tuberculosis
TLATSASSY

SEQ ID NO: 46053 - protein, 9 aa, Mycobacterium tuberculosis
LATSASSYA

SEQ ID NO: 46054 - protein, 9 aa, Mycobacterium tuberculosis
ATSASSYAD

SEQ ID NO: 46055 - protein, 9 aa, Mycobacterium tuberculosis
TSASSYADT

SEQ ID NO: 46056 - protein, 9 aa, Mycobacterium tuberculosis
SASSYADTE

SEQ ID NO: 46057 - protein, 9 aa, Mycobacterium tuberculosis
ASSYADTEA

SEQ ID NO: 46058 - protein, 9 aa, Mycobacterium tuberculosis
SSYADTEAA

SEQ ID NO: 46059 - protein, 9 aa, Mycobacterium tuberculosis
SYADTEAAN

SEQ ID NO: 46060 - protein, 9 aa, Mycobacterium tuberculosis
YADTEAANA

SEQ ID NO: 46061 - protein, 9 aa, Mycobacterium tuberculosis
ADTEAANAV

SEQ ID NO: 46062 - protein, 9 aa, Mycobacterium tuberculosis
DTEAANAVV

SEQ ID NO: 46063 - protein, 9 aa, Mycobacterium tuberculosis
TEAANAVVT

SEQ ID NO: 46064 - protein, 9 aa, Mycobacterium tuberculosis
EAANAVVTG

SEQ ID NO: 46065 - protein, 10 aa, Mycobacterium tuberculosis
MSFTAQPEML

SEQ ID NO: 46066 - protein, 10 aa, Mycobacterium tuberculosis
SFTAQPEMLA

SEQ ID NO: 46067 - protein, 10 aa, Mycobacterium tuberculosis
FTAQPEMLAA

SEQ ID NO: 46068 - protein, 10 aa, Mycobacterium tuberculosis
TAQPEMLAAA

SEQ ID NO: 46069 - protein, 10 aa, Mycobacterium tuberculosis
AQPEMLAAAA

SEQ ID NO: 46070 - protein, 10 aa, Mycobacterium tuberculosis
QPEMLAAAAG

SEQ ID NO: 46071 - protein, 10 aa, Mycobacterium tuberculosis
PEMLAAAAGE

SEQ ID NO: 46072 - protein, 10 aa, Mycobacterium tuberculosis
EMLAAAAGEL

SEQ ID NO: 46073 - protein, 10 aa, Mycobacterium tuberculosis
MLAAAAGELR

SEQ ID NO: 46074 - protein, 10 aa, Mycobacterium tuberculosis
LAAAAGELRS

SEQ ID NO: 46075 - protein, 10 aa, Mycobacterium tuberculosis
AAAAGELRSL

SEQ ID NO: 46076 - protein, 10 aa, Mycobacterium tuberculosis
AAAGELRSLG

SEQ ID NO: 46077 - protein, 10 aa, Mycobacterium tuberculosis
AAGELRSLGA

SEQ ID NO: 46078 - protein, 10 aa, Mycobacterium tuberculosis
AGELRSLGAT

SEQ ID NO: 46079 - protein, 10 aa, Mycobacterium tuberculosis
GELRSLGATL

SEQ ID NO: 46080 - protein, 10 aa, Mycobacterium tuberculosis
ELRSLGATLK

SEQ ID NO: 46081 - protein, 10 aa, Mycobacterium tuberculosis
LRSLGATLKA

SEQ ID NO: 46082 - protein, 10 aa, Mycobacterium tuberculosis
RSLGATLKAS

SEQ ID NO: 46083 - protein, 10 aa, Mycobacterium tuberculosis
SLGATLKASN

SEQ ID NO: 46084 - protein, 10 aa, Mycobacterium tuberculosis
LGATLKASNA

SEQ ID NO: 46085 - protein, 10 aa, Mycobacterium tuberculosis
GATLKASNAA

SEQ ID NO: 46086 - protein, 10 aa, Mycobacterium tuberculosis
ATLKASNAAA

SEQ ID NO: 46087 - protein, 10 aa, Mycobacterium tuberculosis
TLKASNAAAA

SEQ ID NO: 46088 - protein, 10 aa, Mycobacterium tuberculosis
LKASNAAAAV

SEQ ID NO: 46089 - protein, 10 aa, Mycobacterium tuberculosis
KASNAAAAVP

SEQ ID NO: 46090 - protein, 10 aa, Mycobacterium tuberculosis
ASNAAAAVPT

SEQ ID NO: 46091 - protein, 10 aa, Mycobacterium tuberculosis
SNAAAAVPTT

SEQ ID NO: 46092 - protein, 10 aa, Mycobacterium tuberculosis
NAAAAVPTTG

SEQ ID NO: 46093 - protein, 10 aa, Mycobacterium tuberculosis
AAAAVPTTGV

SEQ ID NO: 46094 - protein, 10 aa, Mycobacterium tuberculosis
AAAVPTTGVV

SEQ ID NO: 46095 - protein, 10 aa, Mycobacterium tuberculosis
AAVPTTGVVP

SEQ ID NO: 46096 - protein, 10 aa, Mycobacterium tuberculosis
AVPTTGVVPP

SEQ ID NO: 46097 - protein, 10 aa, Mycobacterium tuberculosis
VPTTGVVPPA

SEQ ID NO: 46098 - protein, 10 aa, Mycobacterium tuberculosis
PTTGVVPPAA

SEQ ID NO: 46099 - protein, 10 aa, Mycobacterium tuberculosis
TTGVVPPAAD

SEQ ID NO: 46100 - protein, 10 aa, Mycobacterium tuberculosis
TGVVPPAADE

SEQ ID NO: 46101 - protein, 10 aa, Mycobacterium tuberculosis
GVVPPAADEV

SEQ ID NO: 46102 - protein, 10 aa, Mycobacterium tuberculosis
VVPPAADEVS

SEQ ID NO: 46103 - protein, 10 aa, Mycobacterium tuberculosis
VPPAADEVSL

SEQ ID NO: 46104 - protein, 10 aa, Mycobacterium tuberculosis
PPAADEVSLL

SEQ ID NO: 46105 - protein, 10 aa, Mycobacterium tuberculosis
PAADEVSLLL

SEQ ID NO: 46106 - protein, 10 aa, Mycobacterium tuberculosis
AADEVSLLLA

SEQ ID NO: 46107 - protein, 10 aa, Mycobacterium tuberculosis
ADEVSLLLAT

SEQ ID NO: 46108 - protein, 10 aa, Mycobacterium tuberculosis
DEVSLLLATQ

SEQ ID NO: 46109 - protein, 10 aa, Mycobacterium tuberculosis
EVSLLLATQF

SEQ ID NO: 46110 - protein, 10 aa, Mycobacterium tuberculosis
VSLLLATQFR

SEQ ID NO: 46111 - protein, 10 aa, Mycobacterium tuberculosis
SLLLATQFRT

SEQ ID NO: 46112 - protein, 10 aa, Mycobacterium tuberculosis
LLLATQFRTH

SEQ ID NO: 46113 - protein, 10 aa, Mycobacterium tuberculosis
LLATQFRTHA

SEQ ID NO: 46114 - protein, 10 aa, Mycobacterium tuberculosis
LATQFRTHAA

SEQ ID NO: 46115 - protein, 10 aa, Mycobacterium tuberculosis
ATQFRTHAAT

SEQ ID NO: 46116 - protein, 10 aa, Mycobacterium tuberculosis
TQFRTHAATY

SEQ ID NO: 46117 - protein, 10 aa, Mycobacterium tuberculosis
QFRTHAATYQ

SEQ ID NO: 46118 - protein, 10 aa, Mycobacterium tuberculosis
FRTHAATYQT

SEQ ID NO: 46119 - protein, 10 aa, Mycobacterium tuberculosis
RTHAATYQTA

SEQ ID NO: 46120 - protein, 10 aa, Mycobacterium tuberculosis
THAATYQTAS

SEQ ID NO: 46121 - protein, 10 aa, Mycobacterium tuberculosis
HAATYQTASA

SEQ ID NO: 46122 - protein, 10 aa, Mycobacterium tuberculosis
AATYQTASAK

SEQ ID NO: 46123 - protein, 10 aa, Mycobacterium tuberculosis
ATYQTASAKA

SEQ ID NO: 46124 - protein, 10 aa, Mycobacterium tuberculosis
TYQTASAKAA

SEQ ID NO: 46125 - protein, 10 aa, Mycobacterium tuberculosis
YQTASAKAAV

SEQ ID NO: 46126 - protein, 10 aa, Mycobacterium tuberculosis
QTASAKAAVI

SEQ ID NO: 46127 - protein, 10 aa, Mycobacterium tuberculosis
TASAKAAVIH

SEQ ID NO: 46128 - protein, 10 aa, Mycobacterium tuberculosis
ASAKAAVIHE

SEQ ID NO: 46129 - protein, 10 aa, Mycobacterium tuberculosis
SAKAAVIHEQ

SEQ ID NO: 46130 - protein, 10 aa, Mycobacterium tuberculosis
AKAAVIHEQF

SEQ ID NO: 46131 - protein, 10 aa, Mycobacterium tuberculosis
KAAVIHEQFV

SEQ ID NO: 46132 - protein, 10 aa, Mycobacterium tuberculosis
AAVIHEQFVT

SEQ ID NO: 46133 - protein, 10 aa, Mycobacterium tuberculosis
AVIHEQFVTT

SEQ ID NO: 46134 - protein, 10 aa, Mycobacterium tuberculosis
VIHEQFVTTL

SEQ ID NO: 46135 - protein, 10 aa, Mycobacterium tuberculosis
IHEQFVTTLA

SEQ ID NO: 46136 - protein, 10 aa, Mycobacterium tuberculosis
HEQFVTTLAT

SEQ ID NO: 46137 - protein, 10 aa, Mycobacterium tuberculosis
EQFVTTLATS

SEQ ID NO: 46138 - protein, 10 aa, Mycobacterium tuberculosis
QFVTTLATSA

SEQ ID NO: 46139 - protein, 10 aa, Mycobacterium tuberculosis
FVTTLATSAS

SEQ ID NO: 46140 - protein, 10 aa, Mycobacterium tuberculosis
VTTLATSASS

SEQ ID NO: 46141 - protein, 10 aa, Mycobacterium tuberculosis
TTLATSASSY

SEQ ID NO: 46142 - protein, 10 aa, Mycobacterium tuberculosis
TLATSASSYA

SEQ ID NO: 46143 - protein, 10 aa, Mycobacterium tuberculosis
LATSASSYAD

SEQ ID NO: 46144 - protein, 10 aa, Mycobacterium tuberculosis
ATSASSYADT

SEQ ID NO: 46145 - protein, 10 aa, Mycobacterium tuberculosis
TSASSYADTE

SEQ ID NO: 46146 - protein, 10 aa, Mycobacterium tuberculosis
SASSYADTEA

SEQ ID NO: 46147 - protein, 10 aa, Mycobacterium tuberculosis
ASSYADTEAA

SEQ ID NO: 46148 - protein, 10 aa, Mycobacterium tuberculosis
SSYADTEAAN

SEQ ID NO: 46149 - protein, 10 aa, Mycobacterium tuberculosis
SYADTEAANA

SEQ ID NO: 46150 - protein, 10 aa, Mycobacterium tuberculosis
YADTEAANAV

SEQ ID NO: 46151 - protein, 10 aa, Mycobacterium tuberculosis
ADTEAANAVV

SEQ ID NO: 46152 - protein, 10 aa, Mycobacterium tuberculosis
DTEAANAVVT

SEQ ID NO: 46153 - protein, 10 aa, Mycobacterium tuberculosis
TEAANAVVTG

SEQ ID NO: 46154 - protein, 11 aa, Mycobacterium tuberculosis
MSFTAQPEMLA

SEQ ID NO: 46155 - protein, 11 aa, Mycobacterium tuberculosis
SFTAQPEMLAA

SEQ ID NO: 46156 - protein, 11 aa, Mycobacterium tuberculosis
FTAQPEMLAAA

SEQ ID NO: 46157 - protein, 11 aa, Mycobacterium tuberculosis
TAQPEMLAAAA

SEQ ID NO: 46158 - protein, 11 aa, Mycobacterium tuberculosis
AQPEMLAAAAG

SEQ ID NO: 46159 - protein, 11 aa, Mycobacterium tuberculosis
QPEMLAAAAGE

SEQ ID NO: 46160 - protein, 11 aa, Mycobacterium tuberculosis
PEMLAAAAGEL

SEQ ID NO: 46161 - protein, 11 aa, Mycobacterium tuberculosis
EMLAAAAGELR

SEQ ID NO: 46162 - protein, 11 aa, Mycobacterium tuberculosis
MLAAAAGELRS

SEQ ID NO: 46163 - protein, 11 aa, Mycobacterium tuberculosis
LAAAAGELRSL

SEQ ID NO: 46164 - protein, 11 aa, Mycobacterium tuberculosis
AAAAGELRSLG

SEQ ID NO: 46165 - protein, 11 aa, Mycobacterium tuberculosis
AAAGELRSLGA

SEQ ID NO: 46166 - protein, 11 aa, Mycobacterium tuberculosis
AAGELRSLGAT

SEQ ID NO: 46167 - protein, 11 aa, Mycobacterium tuberculosis
AGELRSLGATL

SEQ ID NO: 46168 - protein, 11 aa, Mycobacterium tuberculosis
GELRSLGATLK

SEQ ID NO: 46169 - protein, 11 aa, Mycobacterium tuberculosis
ELRSLGATLKA

SEQ ID NO: 46170 - protein, 11 aa, Mycobacterium tuberculosis
LRSLGATLKAS

SEQ ID NO: 46171 - protein, 11 aa, Mycobacterium tuberculosis
RSLGATLKASN

SEQ ID NO: 46172 - protein, 11 aa, Mycobacterium tuberculosis
SLGATLKASNA

SEQ ID NO: 46173 - protein, 11 aa, Mycobacterium tuberculosis
LGATLKASNAA

SEQ ID NO: 46174 - protein, 11 aa, Mycobacterium tuberculosis
GATLKASNAAA

SEQ ID NO: 46175 - protein, 11 aa, Mycobacterium tuberculosis
ATLKASNAAAA

SEQ ID NO: 46176 - protein, 11 aa, Mycobacterium tuberculosis
TLKASNAAAAV

SEQ ID NO: 46177 - protein, 11 aa, Mycobacterium tuberculosis
LKASNAAAAVP

SEQ ID NO: 46178 - protein, 11 aa, Mycobacterium tuberculosis
KASNAAAAVPT

SEQ ID NO: 46179 - protein, 11 aa, Mycobacterium tuberculosis
ASNAAAAVPTT

SEQ ID NO: 46180 - protein, 11 aa, Mycobacterium tuberculosis
SNAAAAVPTTG

SEQ ID NO: 46181 - protein, 11 aa, Mycobacterium tuberculosis
NAAAAVPTTGV

SEQ ID NO: 46182 - protein, 11 aa, Mycobacterium tuberculosis
AAAAVPTTGVV

SEQ ID NO: 46183 - protein, 11 aa, Mycobacterium tuberculosis
AAAVPTTGVVP

SEQ ID NO: 46184 - protein, 11 aa, Mycobacterium tuberculosis
AAVPTTGVVPP

SEQ ID NO: 46185 - protein, 11 aa, Mycobacterium tuberculosis
AVPTTGVVPPA

SEQ ID NO: 46186 - protein, 11 aa, Mycobacterium tuberculosis
VPTTGVVPPAA

SEQ ID NO: 46187 - protein, 11 aa, Mycobacterium tuberculosis
PTTGVVPPAAD

SEQ ID NO: 46188 - protein, 11 aa, Mycobacterium tuberculosis
TTGVVPPAADE

SEQ ID NO: 46189 - protein, 11 aa, Mycobacterium tuberculosis
TGVVPPAADEV

SEQ ID NO: 46190 - protein, 11 aa, Mycobacterium tuberculosis
GVVPPAADEVS

SEQ ID NO: 46191 - protein, 11 aa, Mycobacterium tuberculosis
VVPPAADEVSL

SEQ ID NO: 46192 - protein, 11 aa, Mycobacterium tuberculosis
VPPAADEVSLL

SEQ ID NO: 46193 - protein, 11 aa, Mycobacterium tuberculosis
PPAADEVSLLL

SEQ ID NO: 46194 - protein, 11 aa, Mycobacterium tuberculosis
PAADEVSLLLA

SEQ ID NO: 46195 - protein, 11 aa, Mycobacterium tuberculosis
AADEVSLLLAT

SEQ ID NO: 46196 - protein, 11 aa, Mycobacterium tuberculosis
ADEVSLLLATQ

SEQ ID NO: 46197 - protein, 11 aa, Mycobacterium tuberculosis
DEVSLLLATQF

SEQ ID NO: 46198 - protein, 11 aa, Mycobacterium tuberculosis
EVSLLLATQFR

SEQ ID NO: 46199 - protein, 11 aa, Mycobacterium tuberculosis
VSLLLATQFRT

SEQ ID NO: 46200 - protein, 11 aa, Mycobacterium tuberculosis
SLLLATQFRTH

SEQ ID NO: 46201 - protein, 11 aa, Mycobacterium tuberculosis
LLLATQFRTHA

SEQ ID NO: 46202 - protein, 11 aa, Mycobacterium tuberculosis
LLATQFRTHAA

SEQ ID NO: 46203 - protein, 11 aa, Mycobacterium tuberculosis
LATQFRTHAAT

SEQ ID NO: 46204 - protein, 11 aa, Mycobacterium tuberculosis
ATQFRTHAATY

SEQ ID NO: 46205 - protein, 11 aa, Mycobacterium tuberculosis
TQFRTHAATYQ

SEQ ID NO: 46206 - protein, 11 aa, Mycobacterium tuberculosis
QFRTHAATYQT

SEQ ID NO: 46207 - protein, 11 aa, Mycobacterium tuberculosis
FRTHAATYQTA

SEQ ID NO: 46208 - protein, 11 aa, Mycobacterium tuberculosis
RTHAATYQTAS

SEQ ID NO: 46209 - protein, 11 aa, Mycobacterium tuberculosis
THAATYQTASA

SEQ ID NO: 46210 - protein, 11 aa, Mycobacterium tuberculosis
HAATYQTASAK

SEQ ID NO: 46211 - protein, 11 aa, Mycobacterium tuberculosis
AATYQTASAKA

SEQ ID NO: 46212 - protein, 11 aa, Mycobacterium tuberculosis
ATYQTASAKAA

SEQ ID NO: 46213 - protein, 11 aa, Mycobacterium tuberculosis
TYQTASAKAAV

SEQ ID NO: 46214 - protein, 11 aa, Mycobacterium tuberculosis
YQTASAKAAVI

SEQ ID NO: 46215 - protein, 11 aa, Mycobacterium tuberculosis
QTASAKAAVIH

SEQ ID NO: 46216 - protein, 11 aa, Mycobacterium tuberculosis
TASAKAAVIHE

SEQ ID NO: 46217 - protein, 11 aa, Mycobacterium tuberculosis
ASAKAAVIHEQ

SEQ ID NO: 46218 - protein, 11 aa, Mycobacterium tuberculosis
SAKAAVIHEQF

SEQ ID NO: 46219 - protein, 11 aa, Mycobacterium tuberculosis
AKAAVIHEQFV

SEQ ID NO: 46220 - protein, 11 aa, Mycobacterium tuberculosis
KAAVIHEQFVT

SEQ ID NO: 46221 - protein, 11 aa, Mycobacterium tuberculosis
AAVIHEQFVTT

SEQ ID NO: 46222 - protein, 11 aa, Mycobacterium tuberculosis
AVIHEQFVTTL

SEQ ID NO: 46223 - protein, 11 aa, Mycobacterium tuberculosis
VIHEQFVTTLA

SEQ ID NO: 46224 - protein, 11 aa, Mycobacterium tuberculosis
IHEQFVTTLAT

SEQ ID NO: 46225 - protein, 11 aa, Mycobacterium tuberculosis
HEQFVTTLATS

SEQ ID NO: 46226 - protein, 11 aa, Mycobacterium tuberculosis
EQFVTTLATSA

SEQ ID NO: 46227 - protein, 11 aa, Mycobacterium tuberculosis
QFVTTLATSAS

SEQ ID NO: 46228 - protein, 11 aa, Mycobacterium tuberculosis
FVTTLATSASS

SEQ ID NO: 46229 - protein, 11 aa, Mycobacterium tuberculosis
VTTLATSASSY

SEQ ID NO: 46230 - protein, 11 aa, Mycobacterium tuberculosis
TTLATSASSYA

SEQ ID NO: 46231 - protein, 11 aa, Mycobacterium tuberculosis
TLATSASSYAD

SEQ ID NO: 46232 - protein, 11 aa, Mycobacterium tuberculosis
LATSASSYADT

SEQ ID NO: 46233 - protein, 11 aa, Mycobacterium tuberculosis
ATSASSYADTE

SEQ ID NO: 46234 - protein, 11 aa, Mycobacterium tuberculosis
TSASSYADTEA

SEQ ID NO: 46235 - protein, 11 aa, Mycobacterium tuberculosis
SASSYADTEAA

SEQ ID NO: 46236 - protein, 11 aa, Mycobacterium tuberculosis
ASSYADTEAAN

SEQ ID NO: 46237 - protein, 11 aa, Mycobacterium tuberculosis
SSYADTEAANA

SEQ ID NO: 46238 - protein, 11 aa, Mycobacterium tuberculosis
SYADTEAANAV

SEQ ID NO: 46239 - protein, 11 aa, Mycobacterium tuberculosis
YADTEAANAVV

SEQ ID NO: 46240 - protein, 11 aa, Mycobacterium tuberculosis
ADTEAANAVVT

SEQ ID NO: 46241 - protein, 11 aa, Mycobacterium tuberculosis
DTEAANAVVTG

SEQ ID NO: 46242 - protein, 8 aa, Mycobacterium tuberculosis
MTINYQFG

SEQ ID NO: 46243 - protein, 8 aa, Mycobacterium tuberculosis
TINYQFGD

SEQ ID NO: 46244 - protein, 8 aa, Mycobacterium tuberculosis
INYQFGDV

SEQ ID NO: 46245 - protein, 8 aa, Mycobacterium tuberculosis
NYQFGDVD

SEQ ID NO: 46246 - protein, 8 aa, Mycobacterium tuberculosis
YQFGDVDA

SEQ ID NO: 46247 - protein, 8 aa, Mycobacterium tuberculosis
QFGDVDAH

SEQ ID NO: 46248 - protein, 8 aa, Mycobacterium tuberculosis
FGDVDAHG

SEQ ID NO: 46249 - protein, 8 aa, Mycobacterium tuberculosis
GDVDAHGA

SEQ ID NO: 46250 - protein, 8 aa, Mycobacterium tuberculosis
DVDAHGAM

SEQ ID NO: 46251 - protein, 8 aa, Mycobacterium tuberculosis
VDAHGAMI

SEQ ID NO: 46252 - protein, 8 aa, Mycobacterium tuberculosis
DAHGAMIR

SEQ ID NO: 46253 - protein, 8 aa, Mycobacterium tuberculosis
AHGAMIRA

SEQ ID NO: 46254 - protein, 8 aa, Mycobacterium tuberculosis
HGAMIRAQ

SEQ ID NO: 46255 - protein, 8 aa, Mycobacterium tuberculosis
GAMIRAQA

SEQ ID NO: 46256 - protein, 8 aa, Mycobacterium tuberculosis
AMIRAQAG

SEQ ID NO: 46257 - protein, 8 aa, Mycobacterium tuberculosis
MIRAQAGS

SEQ ID NO: 46258 - protein, 8 aa, Mycobacterium tuberculosis
IRAQAGSL

SEQ ID NO: 46259 - protein, 8 aa, Mycobacterium tuberculosis
RAQAGSLE

SEQ ID NO: 46260 - protein, 8 aa, Mycobacterium tuberculosis
AQAGSLEA

SEQ ID NO: 46261 - protein, 8 aa, Mycobacterium tuberculosis
QAGSLEAE

SEQ ID NO: 46262 - protein, 8 aa, Mycobacterium tuberculosis
AGSLEAEH

SEQ ID NO: 46263 - protein, 8 aa, Mycobacterium tuberculosis
GSLEAEHQ

SEQ ID NO: 46264 - protein, 8 aa, Mycobacterium tuberculosis
SLEAEHQA

SEQ ID NO: 46265 - protein, 8 aa, Mycobacterium tuberculosis
LEAEHQAI

SEQ ID NO: 46266 - protein, 8 aa, Mycobacterium tuberculosis
EAEHQAII

SEQ ID NO: 46267 - protein, 8 aa, Mycobacterium tuberculosis
AEHQAIIS

SEQ ID NO: 46268 - protein, 8 aa, Mycobacterium tuberculosis
EHQAIISD

SEQ ID NO: 46269 - protein, 8 aa, Mycobacterium tuberculosis
HQAIISDV

SEQ ID NO: 46270 - protein, 8 aa, Mycobacterium tuberculosis
QAIISDVL

SEQ ID NO: 46271 - protein, 8 aa, Mycobacterium tuberculosis
AIISDVLT

SEQ ID NO: 46272 - protein, 8 aa, Mycobacterium tuberculosis
IISDVLTA

SEQ ID NO: 46273 - protein, 8 aa, Mycobacterium tuberculosis
ISDVLTAS

SEQ ID NO: 46274 - protein, 8 aa, Mycobacterium tuberculosis
SDVLTASD

SEQ ID NO: 46275 - protein, 8 aa, Mycobacterium tuberculosis
DVLTASDF

SEQ ID NO: 46276 - protein, 8 aa, Mycobacterium tuberculosis
VLTASDFW

SEQ ID NO: 46277 - protein, 8 aa, Mycobacterium tuberculosis
LTASDFWG

SEQ ID NO: 46278 - protein, 8 aa, Mycobacterium tuberculosis
TASDFWGG

SEQ ID NO: 46279 - protein, 8 aa, Mycobacterium tuberculosis
ASDFWGGA

SEQ ID NO: 46280 - protein, 8 aa, Mycobacterium tuberculosis
SDFWGGAG

SEQ ID NO: 46281 - protein, 8 aa, Mycobacterium tuberculosis
DFWGGAGS

SEQ ID NO: 46282 - protein, 8 aa, Mycobacterium tuberculosis
FWGGAGSA

SEQ ID NO: 46283 - protein, 8 aa, Mycobacterium tuberculosis
WGGAGSAA

SEQ ID NO: 46284 - protein, 8 aa, Mycobacterium tuberculosis
GGAGSAAC

SEQ ID NO: 46285 - protein, 8 aa, Mycobacterium tuberculosis
GAGSAACQ

SEQ ID NO: 46286 - protein, 8 aa, Mycobacterium tuberculosis
AGSAACQG

SEQ ID NO: 46287 - protein, 8 aa, Mycobacterium tuberculosis
GSAACQGF

SEQ ID NO: 46288 - protein, 8 aa, Mycobacterium tuberculosis
SAACQGFI

SEQ ID NO: 46289 - protein, 8 aa, Mycobacterium tuberculosis
AACQGFIT

SEQ ID NO: 46290 - protein, 8 aa, Mycobacterium tuberculosis
ACQGFITQ

SEQ ID NO: 46291 - protein, 8 aa, Mycobacterium tuberculosis
CQGFITQL

SEQ ID NO: 46292 - protein, 8 aa, Mycobacterium tuberculosis
QGFITQLG

SEQ ID NO: 46293 - protein, 8 aa, Mycobacterium tuberculosis
GFITQLGR

SEQ ID NO: 46294 - protein, 8 aa, Mycobacterium tuberculosis
FITQLGRN

SEQ ID NO: 46295 - protein, 8 aa, Mycobacterium tuberculosis
ITQLGRNF

SEQ ID NO: 46296 - protein, 8 aa, Mycobacterium tuberculosis
TQLGRNFQ

SEQ ID NO: 46297 - protein, 8 aa, Mycobacterium tuberculosis
QLGRNFQV

SEQ ID NO: 46298 - protein, 8 aa, Mycobacterium tuberculosis
LGRNFQVI

SEQ ID NO: 46299 - protein, 8 aa, Mycobacterium tuberculosis
GRNFQVIY

SEQ ID NO: 46300 - protein, 8 aa, Mycobacterium tuberculosis
RNFQVIYE

SEQ ID NO: 46301 - protein, 8 aa, Mycobacterium tuberculosis
NFQVIYEQ

SEQ ID NO: 46302 - protein, 8 aa, Mycobacterium tuberculosis
FQVIYEQA

SEQ ID NO: 46303 - protein, 8 aa, Mycobacterium tuberculosis
QVIYEQAN

SEQ ID NO: 46304 - protein, 8 aa, Mycobacterium tuberculosis
VIYEQANA

SEQ ID NO: 46305 - protein, 8 aa, Mycobacterium tuberculosis
IYEQANAH

SEQ ID NO: 46306 - protein, 8 aa, Mycobacterium tuberculosis
YEQANAHG

SEQ ID NO: 46307 - protein, 8 aa, Mycobacterium tuberculosis
EQANAHGQ

SEQ ID NO: 46308 - protein, 8 aa, Mycobacterium tuberculosis
QANAHGQK

SEQ ID NO: 46309 - protein, 8 aa, Mycobacterium tuberculosis
ANAHGQKV

SEQ ID NO: 46310 - protein, 8 aa, Mycobacterium tuberculosis
NAHGQKVQ

SEQ ID NO: 46311 - protein, 8 aa, Mycobacterium tuberculosis
AHGQKVQA

SEQ ID NO: 46312 - protein, 8 aa, Mycobacterium tuberculosis
HGQKVQAA

SEQ ID NO: 46313 - protein, 8 aa, Mycobacterium tuberculosis
GQKVQAAG

SEQ ID NO: 46314 - protein, 8 aa, Mycobacterium tuberculosis
QKVQAAGN

SEQ ID NO: 46315 - protein, 8 aa, Mycobacterium tuberculosis
KVQAAGNN

SEQ ID NO: 46316 - protein, 8 aa, Mycobacterium tuberculosis
VQAAGNNM

SEQ ID NO: 46317 - protein, 8 aa, Mycobacterium tuberculosis
QAAGNNMA

SEQ ID NO: 46318 - protein, 8 aa, Mycobacterium tuberculosis
AAGNNMAQ

SEQ ID NO: 46319 - protein, 8 aa, Mycobacterium tuberculosis
AGNNMAQT

SEQ ID NO: 46320 - protein, 8 aa, Mycobacterium tuberculosis
GNNMAQTD

SEQ ID NO: 46321 - protein, 8 aa, Mycobacterium tuberculosis
NNMAQTDS

SEQ ID NO: 46322 - protein, 8 aa, Mycobacterium tuberculosis
NMAQTDSA

SEQ ID NO: 46323 - protein, 8 aa, Mycobacterium tuberculosis
MAQTDSAV

SEQ ID NO: 46324 - protein, 8 aa, Mycobacterium tuberculosis
AQTDSAVG

SEQ ID NO: 46325 - protein, 8 aa, Mycobacterium tuberculosis
QTDSAVGS

SEQ ID NO: 46326 - protein, 8 aa, Mycobacterium tuberculosis
TDSAVGSS

SEQ ID NO: 46327 - protein, 8 aa, Mycobacterium tuberculosis
DSAVGSSW

SEQ ID NO: 46328 - protein, 8 aa, Mycobacterium tuberculosis
SAVGSSWA

SEQ ID NO: 46329 - protein, 9 aa, Mycobacterium tuberculosis
MTINYQFGD

SEQ ID NO: 46330 - protein, 9 aa, Mycobacterium tuberculosis
TINYQFGDV

SEQ ID NO: 46331 - protein, 9 aa, Mycobacterium tuberculosis
INYQFGDVD

SEQ ID NO: 46332 - protein, 9 aa, Mycobacterium tuberculosis
NYQFGDVDA

SEQ ID NO: 46333 - protein, 9 aa, Mycobacterium tuberculosis
YQFGDVDAH

SEQ ID NO: 46334 - protein, 9 aa, Mycobacterium tuberculosis
QFGDVDAHG

SEQ ID NO: 46335 - protein, 9 aa, Mycobacterium tuberculosis
FGDVDAHGA

SEQ ID NO: 46336 - protein, 9 aa, Mycobacterium tuberculosis
GDVDAHGAM

SEQ ID NO: 46337 - protein, 9 aa, Mycobacterium tuberculosis
DVDAHGAMI

SEQ ID NO: 46338 - protein, 9 aa, Mycobacterium tuberculosis
VDAHGAMIR

SEQ ID NO: 46339 - protein, 9 aa, Mycobacterium tuberculosis
DAHGAMIRA

SEQ ID NO: 46340 - protein, 9 aa, Mycobacterium tuberculosis
AHGAMIRAQ

SEQ ID NO: 46341 - protein, 9 aa, Mycobacterium tuberculosis
HGAMIRAQA

SEQ ID NO: 46342 - protein, 9 aa, Mycobacterium tuberculosis
GAMIRAQAG

SEQ ID NO: 46343 - protein, 9 aa, Mycobacterium tuberculosis
AMIRAQAGS

SEQ ID NO: 46344 - protein, 9 aa, Mycobacterium tuberculosis
MIRAQAGSL

SEQ ID NO: 46345 - protein, 9 aa, Mycobacterium tuberculosis
IRAQAGSLE

SEQ ID NO: 46346 - protein, 9 aa, Mycobacterium tuberculosis
RAQAGSLEA

SEQ ID NO: 46347 - protein, 9 aa, Mycobacterium tuberculosis
AQAGSLEAE

SEQ ID NO: 46348 - protein, 9 aa, Mycobacterium tuberculosis
QAGSLEAEH

SEQ ID NO: 46349 - protein, 9 aa, Mycobacterium tuberculosis
AGSLEAEHQ

SEQ ID NO: 46350 - protein, 9 aa, Mycobacterium tuberculosis
GSLEAEHQA

SEQ ID NO: 46351 - protein, 9 aa, Mycobacterium tuberculosis
SLEAEHQAI

SEQ ID NO: 46352 - protein, 9 aa, Mycobacterium tuberculosis
LEAEHQAII

SEQ ID NO: 46353 - protein, 9 aa, Mycobacterium tuberculosis
EAEHQAIIS

SEQ ID NO: 46354 - protein, 9 aa, Mycobacterium tuberculosis
AEHQAIISD

SEQ ID NO: 46355 - protein, 9 aa, Mycobacterium tuberculosis
EHQAIISDV

SEQ ID NO: 46356 - protein, 9 aa, Mycobacterium tuberculosis
HQAIISDVL

SEQ ID NO: 46357 - protein, 9 aa, Mycobacterium tuberculosis
QAIISDVLT

SEQ ID NO: 46358 - protein, 9 aa, Mycobacterium tuberculosis
AIISDVLTA

SEQ ID NO: 46359 - protein, 9 aa, Mycobacterium tuberculosis
IISDVLTAS

SEQ ID NO: 46360 - protein, 9 aa, Mycobacterium tuberculosis
ISDVLTASD

SEQ ID NO: 46361 - protein, 9 aa, Mycobacterium tuberculosis
SDVLTASDF

SEQ ID NO: 46362 - protein, 9 aa, Mycobacterium tuberculosis
DVLTASDFW

SEQ ID NO: 46363 - protein, 9 aa, Mycobacterium tuberculosis
VLTASDFWG

SEQ ID NO: 46364 - protein, 9 aa, Mycobacterium tuberculosis
LTASDFWGG

SEQ ID NO: 46365 - protein, 9 aa, Mycobacterium tuberculosis
TASDFWGGA

SEQ ID NO: 46366 - protein, 9 aa, Mycobacterium tuberculosis
ASDFWGGAG

SEQ ID NO: 46367 - protein, 9 aa, Mycobacterium tuberculosis
SDFWGGAGS

SEQ ID NO: 46368 - protein, 9 aa, Mycobacterium tuberculosis
DFWGGAGSA

SEQ ID NO: 46369 - protein, 9 aa, Mycobacterium tuberculosis
FWGGAGSAA

SEQ ID NO: 46370 - protein, 9 aa, Mycobacterium tuberculosis
WGGAGSAAC

SEQ ID NO: 46371 - protein, 9 aa, Mycobacterium tuberculosis
GGAGSAACQ

SEQ ID NO: 46372 - protein, 9 aa, Mycobacterium tuberculosis
GAGSAACQG

SEQ ID NO: 46373 - protein, 9 aa, Mycobacterium tuberculosis
AGSAACQGF

SEQ ID NO: 46374 - protein, 9 aa, Mycobacterium tuberculosis
GSAACQGFI

SEQ ID NO: 46375 - protein, 9 aa, Mycobacterium tuberculosis
SAACQGFIT

SEQ ID NO: 46376 - protein, 9 aa, Mycobacterium tuberculosis
AACQGFITQ

SEQ ID NO: 46377 - protein, 9 aa, Mycobacterium tuberculosis
ACQGFITQL
